United States Patent 7,691,997 (FUNCTIONAL AND HYPERFUNCTIONAL SIRNA) - sequence listing, part 15

SEQ ID NO: 585306 - RNA, 19 nt, Homo sapiens
uugaagcccaccaauauau

SEQ ID NO: 585307 - RNA, 19 nt, Homo sapiens
gaagaggaugacugagaca

SEQ ID NO: 585308 - RNA, 19 nt, Homo sapiens
ggaggguggguucagcuau

SEQ ID NO: 585309 - RNA, 19 nt, Homo sapiens
cuauaugccaugauguuug

SEQ ID NO: 585310 - RNA, 19 nt, Homo sapiens
ucagcuauguggaccuagu

SEQ ID NO: 585311 - RNA, 19 nt, Homo sapiens
ccucagaccguccuugaag

SEQ ID NO: 585312 - RNA, 19 nt, Homo sapiens
uugaagaggaugacugaga

SEQ ID NO: 585313 - RNA, 19 nt, Homo sapiens
agagguacgcuguggaaug

SEQ ID NO: 585314 - RNA, 19 nt, Homo sapiens
agaggaugacugagacauu

SEQ ID NO: 585315 - RNA, 19 nt, Homo sapiens
aauccauggacuucucuua

SEQ ID NO: 585316 - RNA, 19 nt, Homo sapiens
agagagguacgcuguggaa

SEQ ID NO: 585317 - RNA, 19 nt, Homo sapiens
ccuggcugcugcuaccauu

SEQ ID NO: 585318 - RNA, 19 nt, Homo sapiens
guugagcucacauaguguu

SEQ ID NO: 585319 - RNA, 19 nt, Homo sapiens
gggaggguggguucagcua

SEQ ID NO: 585320 - RNA, 19 nt, Homo sapiens
ccuugaagaggaugacuga

SEQ ID NO: 585321 - RNA, 19 nt, Homo sapiens
ccagcgagaagccgacaug

SEQ ID NO: 585322 - RNA, 19 nt, Homo sapiens
aaaagcagcauguugagaa

SEQ ID NO: 585323 - RNA, 19 nt, Homo sapiens
aacauacuacccaaauuga

SEQ ID NO: 585324 - RNA, 19 nt, Homo sapiens
ccaggcauucuucagcauu

SEQ ID NO: 585325 - RNA, 19 nt, Homo sapiens
ucggggaacugucaucauu

SEQ ID NO: 585326 - RNA, 19 nt, Homo sapiens
agauagaaaggcugaagga

SEQ ID NO: 585327 - RNA, 19 nt, Homo sapiens
uuaaagaucugaaguguga

SEQ ID NO: 585328 - RNA, 19 nt, Homo sapiens
aaagaaagaugauggacua

SEQ ID NO: 585329 - RNA, 19 nt, Homo sapiens
gaaagaugauggacuacaa

SEQ ID NO: 585330 - RNA, 19 nt, Homo sapiens
cgagaagcaucuuguauaa

SEQ ID NO: 585331 - RNA, 19 nt, Homo sapiens
gguuuaaacugaugacuuu

SEQ ID NO: 585332 - RNA, 19 nt, Homo sapiens
gagaagauguuuauauugg

SEQ ID NO: 585333 - RNA, 19 nt, Homo sapiens
gggcagaaguucacagaaa

SEQ ID NO: 585334 - RNA, 19 nt, Homo sapiens
gaaagaugcuagugaucaa

SEQ ID NO: 585335 - RNA, 19 nt, Homo sapiens
ggaccaugcuacucugaua

SEQ ID NO: 585336 - RNA, 19 nt, Homo sapiens
ccaaauuuguccuguagua

SEQ ID NO: 585337 - RNA, 19 nt, Homo sapiens
caucaacugcucagaauua

SEQ ID NO: 585338 - RNA, 19 nt, Homo sapiens
agacguauauccaaauuug

SEQ ID NO: 585339 - RNA, 19 nt, Homo sapiens
gaacuaaagguaaagaugu

SEQ ID NO: 585340 - RNA, 19 nt, Homo sapiens
gagggagucugacguaaga

SEQ ID NO: 585341 - RNA, 19 nt, Homo sapiens
ccagaaugguuuaaacuga

SEQ ID NO: 585342 - RNA, 19 nt, Homo sapiens
ggagaugguuugaaaugug

SEQ ID NO: 585343 - RNA, 19 nt, Homo sapiens
gcaauuguaaugugcauaa

SEQ ID NO: 585344 - RNA, 19 nt, Homo sapiens
caagacguauauccaaauu

SEQ ID NO: 585345 - RNA, 19 nt, Homo sapiens
uaaagaagauggagauggu

SEQ ID NO: 585346 - RNA, 19 nt, Homo sapiens
gaugggaguuccuauaaca

SEQ ID NO: 585347 - RNA, 19 nt, Homo sapiens
ggaggagucuguaaagaag

SEQ ID NO: 585348 - RNA, 19 nt, Homo sapiens
ucagauacgucauccagaa

SEQ ID NO: 585349 - RNA, 19 nt, Homo sapiens
uauuggagcuguacagauu

SEQ ID NO: 585350 - RNA, 19 nt, Homo sapiens
ccacaugccuugcccugaa

SEQ ID NO: 585351 - RNA, 19 nt, Homo sapiens
aaacaaaucguaucagugu

SEQ ID NO: 585352 - RNA, 19 nt, Homo sapiens
gaucaaagagaagauguuu

SEQ ID NO: 585353 - RNA, 19 nt, Homo sapiens
agaagcaucuuguauaaag

SEQ ID NO: 585354 - RNA, 19 nt, Homo sapiens
caacugcucagaauuaaau

SEQ ID NO: 585355 - RNA, 19 nt, Homo sapiens
gaccaagcaugaacuaaag

SEQ ID NO: 585356 - RNA, 19 nt, Homo sapiens
agauggagaugguuugaaa

SEQ ID NO: 585357 - RNA, 19 nt, Homo sapiens
gauuguugguguuuaaaga

SEQ ID NO: 585358 - RNA, 19 nt, Homo sapiens
gauuauuccucccuuugaa

SEQ ID NO: 585359 - RNA, 19 nt, Homo sapiens
guaaagcuguguguauuag

SEQ ID NO: 585360 - RNA, 19 nt, Homo sapiens
cccauggaauguaauauuu

SEQ ID NO: 585361 - RNA, 19 nt, Homo sapiens
guaaugugcauaacaagaa

SEQ ID NO: 585362 - RNA, 19 nt, Homo sapiens
uaaggcaucuuggucauug

SEQ ID NO: 585363 - RNA, 19 nt, Homo sapiens
caucauaguagcaauugua

SEQ ID NO: 585364 - RNA, 19 nt, Homo sapiens
ccagaaagagauaacagua

SEQ ID NO: 585365 - RNA, 19 nt, Homo sapiens
gaucugaagugugaguaga

SEQ ID NO: 585366 - RNA, 19 nt, Homo sapiens
gauuggugcucuuaaagug

SEQ ID NO: 585367 - RNA, 19 nt, Homo sapiens
cagaagggcugcuuguaag

SEQ ID NO: 585368 - RNA, 19 nt, Homo sapiens
cauaguagcaauuguaaug

SEQ ID NO: 585369 - RNA, 19 nt, Homo sapiens
uguggacccugcaaauaua

SEQ ID NO: 585370 - RNA, 19 nt, Homo sapiens
ucagaagggcugcuuguaa

SEQ ID NO: 585371 - RNA, 19 nt, Homo sapiens
uugcaaagauggacuacuu

SEQ ID NO: 585372 - RNA, 19 nt, Homo sapiens
caauuucagugccauacaa

SEQ ID NO: 585373 - RNA, 19 nt, Homo sapiens
caaacagauuggaauaaag

SEQ ID NO: 585374 - RNA, 19 nt, Homo sapiens
gcaaaugaccaagcaugaa

SEQ ID NO: 585375 - RNA, 19 nt, Homo sapiens
gcucacucauguucuuauu

SEQ ID NO: 585376 - RNA, 19 nt, Homo sapiens
caaaaugaaugcuuucuca

SEQ ID NO: 585377 - RNA, 19 nt, Homo sapiens
guaguacuguuggcucgua

SEQ ID NO: 585378 - RNA, 19 nt, Homo sapiens
acacugaccaugugaugua

SEQ ID NO: 585379 - RNA, 19 nt, Homo sapiens
ggacgucgacagaagcaaa

SEQ ID NO: 585380 - RNA, 19 nt, Homo sapiens
aagacagacuuuaguauuc

SEQ ID NO: 585381 - RNA, 19 nt, Homo sapiens
gaugauggacuacaauauc

SEQ ID NO: 585382 - RNA, 19 nt, Homo sapiens
ucgagaagcaucuuguaua

SEQ ID NO: 585383 - RNA, 19 nt, Homo sapiens
cagaaagagauaacaguaa

SEQ ID NO: 585384 - RNA, 19 nt, Homo sapiens
gaucaaauggggacacuua

SEQ ID NO: 585385 - RNA, 19 nt, Homo sapiens
ggcaaaagcucacucaugu

SEQ ID NO: 585386 - RNA, 19 nt, Homo sapiens
gacacugccuaucgcauga

SEQ ID NO: 585387 - RNA, 19 nt, Homo sapiens
ugaccaagcaugaacuaaa

SEQ ID NO: 585388 - RNA, 19 nt, Homo sapiens
gcaaagauggacuacuuca

SEQ ID NO: 585389 - RNA, 19 nt, Homo sapiens
gagauaacaguaauagcaa

SEQ ID NO: 585390 - RNA, 19 nt, Homo sapiens
gaagauggagaugguuuga

SEQ ID NO: 585391 - RNA, 19 nt, Homo sapiens
cauagauuguugguguuua

SEQ ID NO: 585392 - RNA, 19 nt, Homo sapiens
cagaaugguuuaaacugau

SEQ ID NO: 585393 - RNA, 19 nt, Homo sapiens
aaugauuggugcucuuaaa

SEQ ID NO: 585394 - RNA, 19 nt, Homo sapiens
acaaaucguaucaguguuu

SEQ ID NO: 585395 - RNA, 19 nt, Homo sapiens
ccuaucgcaugaacuguaa

SEQ ID NO: 585396 - RNA, 19 nt, Homo sapiens
acagauugccaucauagua

SEQ ID NO: 585397 - RNA, 19 nt, Homo sapiens
guaucaguguuugugaaua

SEQ ID NO: 585398 - RNA, 19 nt, Homo sapiens
auacagaugacacuaguuu

SEQ ID NO: 585399 - RNA, 19 nt, Homo sapiens
ggguguguauguaauauag

SEQ ID NO: 585400 - RNA, 19 nt, Homo sapiens
gaagugugaguagaaugua

SEQ ID NO: 585401 - RNA, 19 nt, Homo sapiens
guuuaaagaucugaagugu

SEQ ID NO: 585402 - RNA, 19 nt, Homo sapiens
uauccaaauuuguccugua

SEQ ID NO: 585403 - RNA, 19 nt, Homo sapiens
ccacaaugaccacagcaaa

SEQ ID NO: 585404 - RNA, 19 nt, Homo sapiens
cacaaaugguuauaaaguc

SEQ ID NO: 585405 - RNA, 19 nt, Homo sapiens
guacuguuggcucguauuu

SEQ ID NO: 585406 - RNA, 19 nt, Homo sapiens
caaauuuguccuguaguaa

SEQ ID NO: 585407 - RNA, 19 nt, Homo sapiens
cguaagaguuugugaugag

SEQ ID NO: 585408 - RNA, 19 nt, Homo sapiens
uguaaagcuguguguauua

SEQ ID NO: 585409 - RNA, 19 nt, Homo sapiens
guacagauugccaucauag

SEQ ID NO: 585410 - RNA, 19 nt, Homo sapiens
aaagcucacucauguucuu

SEQ ID NO: 585411 - RNA, 19 nt, Homo sapiens
gagaagcaucuuguauaaa

SEQ ID NO: 585412 - RNA, 19 nt, Homo sapiens
ucagugccauacaaauuau

SEQ ID NO: 585413 - RNA, 19 nt, Homo sapiens
guaauucuaagacuuguuc

SEQ ID NO: 585414 - RNA, 19 nt, Homo sapiens
caugguaauucuaagacuu

SEQ ID NO: 585415 - RNA, 19 nt, Homo sapiens
caauaucgaccagauguga

SEQ ID NO: 585416 - RNA, 19 nt, Homo sapiens
acacuaguuuguugggaaa

SEQ ID NO: 585417 - RNA, 19 nt, Homo sapiens
aauauaaagcugaguguga

SEQ ID NO: 585418 - RNA, 19 nt, Homo sapiens
gauaacaguaauagcaaga

SEQ ID NO: 585419 - RNA, 19 nt, Homo sapiens
ggacuggggaauuugauua

SEQ ID NO: 585420 - RNA, 19 nt, Homo sapiens
gaacuguaaagcugugugu

SEQ ID NO: 585421 - RNA, 19 nt, Homo sapiens
aagcaugaacuaaagguaa

SEQ ID NO: 585422 - RNA, 19 nt, Homo sapiens
aaagauggacuacuucaca

SEQ ID NO: 585423 - RNA, 19 nt, Homo sapiens
ccacaugguaauucuaaga

SEQ ID NO: 585424 - RNA, 19 nt, Homo sapiens
ugaaagaugcuagugauca

SEQ ID NO: 585425 - RNA, 19 nt, Homo sapiens
ugugaaagaugcuagugau

SEQ ID NO: 585426 - RNA, 19 nt, Homo sapiens
agaugacacuaguuuguug

SEQ ID NO: 585427 - RNA, 19 nt, Homo sapiens
gaaaggcacuaaaugguuu

SEQ ID NO: 585428 - RNA, 19 nt, Homo sapiens
gaagcaggcugaagaggaa

SEQ ID NO: 585429 - RNA, 19 nt, Homo sapiens
uaagggcuauucuuucuuu

SEQ ID NO: 585430 - RNA, 19 nt, Homo sapiens
ggauguauguguauaaaca

SEQ ID NO: 585431 - RNA, 19 nt, Homo sapiens
gcagaaggaucaagaaugc

SEQ ID NO: 585432 - RNA, 19 nt, Homo sapiens
ggaaaggcacuaaaugguu

SEQ ID NO: 585433 - RNA, 19 nt, Homo sapiens
ugaaauagcaaacaaccua

SEQ ID NO: 585434 - RNA, 19 nt, Homo sapiens
ggacuagacugugcugugu

SEQ ID NO: 585435 - RNA, 19 nt, Homo sapiens
ccaccacgcuuggcuaauu

SEQ ID NO: 585436 - RNA, 19 nt, Homo sapiens
cuacauguuugcugauaaa

SEQ ID NO: 585437 - RNA, 19 nt, Homo sapiens
cauaagggcuauucuuucu

SEQ ID NO: 585438 - RNA, 19 nt, Homo sapiens
ccagaacccugaugaccuu

SEQ ID NO: 585439 - RNA, 19 nt, Homo sapiens
gaacccugaugaccuugaa

SEQ ID NO: 585440 - RNA, 19 nt, Homo sapiens
gggcagagacccuguagga

SEQ ID NO: 585441 - RNA, 19 nt, Homo sapiens
gacccugugugccucauaa

SEQ ID NO: 585442 - RNA, 19 nt, Homo sapiens
gagaguggauggacuagac

SEQ ID NO: 585443 - RNA, 19 nt, Homo sapiens
ggaggaaccugaguaugag

SEQ ID NO: 585444 - RNA, 19 nt, Homo sapiens
augcaagccuggauucuuu

SEQ ID NO: 585445 - RNA, 19 nt, Homo sapiens
gagauuguaggugauauuu

SEQ ID NO: 585446 - RNA, 19 nt, Homo sapiens
uaaacagauucaagggaaa

SEQ ID NO: 585447 - RNA, 19 nt, Homo sapiens
agacaggguuucaccaugu

SEQ ID NO: 585448 - RNA, 19 nt, Homo sapiens
gaaccugaguaugagaaug

SEQ ID NO: 585449 - RNA, 19 nt, Homo sapiens
ccaaagugcugggaugaca

SEQ ID NO: 585450 - RNA, 19 nt, Homo sapiens
gagcuaccguguccaggau

SEQ ID NO: 585451 - RNA, 19 nt, Homo sapiens
gaugagauuguaggugaua

SEQ ID NO: 585452 - RNA, 19 nt, Homo sapiens
ucuggaagaugagauugua

SEQ ID NO: 585453 - RNA, 19 nt, Homo sapiens
caagggaaaggcacuaaau

SEQ ID NO: 585454 - RNA, 19 nt, Homo sapiens
caccacgcuuggcuaauuu

SEQ ID NO: 585455 - RNA, 19 nt, Homo sapiens
ggaggcagaaggaucaaga

SEQ ID NO: 585456 - RNA, 19 nt, Homo sapiens
gauaaaagauuggcuaaac

SEQ ID NO: 585457 - RNA, 19 nt, Homo sapiens
gacaggguuucaccauguu

SEQ ID NO: 585458 - RNA, 19 nt, Homo sapiens
cugaugaccuugaauuugg

SEQ ID NO: 585459 - RNA, 19 nt, Homo sapiens
aggaggaaccugaguauga

SEQ ID NO: 585460 - RNA, 19 nt, Homo sapiens
gcugugugcuggaaaauga

SEQ ID NO: 585461 - RNA, 19 nt, Homo sapiens
gggaaaggcacuaaauggu

SEQ ID NO: 585462 - RNA, 19 nt, Homo sapiens
ccuacauguuugcugauaa

SEQ ID NO: 585463 - RNA, 19 nt, Homo sapiens
ccagaaagacgaggugugu

SEQ ID NO: 585464 - RNA, 19 nt, Homo sapiens
uuugguagcuuccagaaag

SEQ ID NO: 585465 - RNA, 19 nt, Homo sapiens
gcuaccguguccaggauga

SEQ ID NO: 585466 - RNA, 19 nt, Homo sapiens
ggcagaaggaucaagaaug

SEQ ID NO: 585467 - RNA, 19 nt, Homo sapiens
ugagguuccugccuacugu

SEQ ID NO: 585468 - RNA, 19 nt, Homo sapiens
cauguuugcugauaaaaga

SEQ ID NO: 585469 - RNA, 19 nt, Homo sapiens
uagcaaacaaccuacaugu

SEQ ID NO: 585470 - RNA, 19 nt, Homo sapiens
gaugcaagccuggauucuu

SEQ ID NO: 585471 - RNA, 19 nt, Homo sapiens
gcuggaggcagaaggauca

SEQ ID NO: 585472 - RNA, 19 nt, Homo sapiens
agaaagacgaggugugugu

SEQ ID NO: 585473 - RNA, 19 nt, Homo sapiens
gccgugcucuccagacaca

SEQ ID NO: 585474 - RNA, 19 nt, Homo sapiens
gcacguggaagccauugag

SEQ ID NO: 585475 - RNA, 19 nt, Homo sapiens
ggacaggccagcgagagau

SEQ ID NO: 585476 - RNA, 19 nt, Homo sapiens
cgccuggucuaugaacuuu

SEQ ID NO: 585477 - RNA, 19 nt, Homo sapiens
ucauaagggcuauucuuuc

SEQ ID NO: 585478 - RNA, 19 nt, Homo sapiens
cucauaagggcuauucuuu

SEQ ID NO: 585479 - RNA, 19 nt, Homo sapiens
caaagggcagcacgucugu

SEQ ID NO: 585480 - RNA, 19 nt, Homo sapiens
gcucugucuuccgccauuu

SEQ ID NO: 585481 - RNA, 19 nt, Homo sapiens
uaauagagacaggguuuca

SEQ ID NO: 585482 - RNA, 19 nt, Homo sapiens
ccacagagucgccgaagcu

SEQ ID NO: 585483 - RNA, 19 nt, Homo sapiens
gcucaguuccuugugaaug

SEQ ID NO: 585484 - RNA, 19 nt, Homo sapiens
uuuaauagagacaggguuu

SEQ ID NO: 585485 - RNA, 19 nt, Homo sapiens
caaguuugcaccacagagu

SEQ ID NO: 585486 - RNA, 19 nt, Homo sapiens
uagccaggauggucucgau

SEQ ID NO: 585487 - RNA, 19 nt, Homo sapiens
ccugaugaccuugaauuug

SEQ ID NO: 585488 - RNA, 19 nt, Homo sapiens
cccagaagcaggcugaaga

SEQ ID NO: 585489 - RNA, 19 nt, Homo sapiens
ggaagaugagauuguaggu

SEQ ID NO: 585490 - RNA, 19 nt, Homo sapiens
ucaagggaaaggcacuaaa

SEQ ID NO: 585491 - RNA, 19 nt, Homo sapiens
ugccucagccucccgagua

SEQ ID NO: 585492 - RNA, 19 nt, Homo sapiens
gggcuauucuuucuuucac

SEQ ID NO: 585493 - RNA, 19 nt, Homo sapiens
ccucauaagggcuauucuu

SEQ ID NO: 585494 - RNA, 19 nt, Homo sapiens
gagaauguuguacccaucu

SEQ ID NO: 585495 - RNA, 19 nt, Homo sapiens
ugagauuguaggugauauu

SEQ ID NO: 585496 - RNA, 19 nt, Homo sapiens
gaggcagaaggaucaagaa

SEQ ID NO: 585497 - RNA, 19 nt, Homo sapiens
ggacccugugugccucaua

SEQ ID NO: 585498 - RNA, 19 nt, Homo sapiens
aagacgaggugugugugaa

SEQ ID NO: 585499 - RNA, 19 nt, Homo sapiens
aggaaggccugggcagaga

SEQ ID NO: 585500 - RNA, 19 nt, Homo sapiens
ugaccacgaucuacaugcu

SEQ ID NO: 585501 - RNA, 19 nt, Homo sapiens
guccacaggcccagacgaa

SEQ ID NO: 585502 - RNA, 19 nt, Homo sapiens
aaagacgagguguguguga

SEQ ID NO: 585503 - RNA, 19 nt, Homo sapiens
cugcucaguuccuugugaa

SEQ ID NO: 585504 - RNA, 19 nt, Homo sapiens
ggaggccugugagccagau

SEQ ID NO: 585505 - RNA, 19 nt, Homo sapiens
ugaguaugagaauguugua

SEQ ID NO: 585506 - RNA, 19 nt, Homo sapiens
ggaaccugaguaugagaau

SEQ ID NO: 585507 - RNA, 19 nt, Homo sapiens
uggagaggcagaugagguu

SEQ ID NO: 585508 - RNA, 19 nt, Homo sapiens
guacucaaaucucuacaug

SEQ ID NO: 585509 - RNA, 19 nt, Homo sapiens
ggaaucuggugaagaagga

SEQ ID NO: 585510 - RNA, 19 nt, Homo sapiens
gcaaugagaagcugcacaa

SEQ ID NO: 585511 - RNA, 19 nt, Homo sapiens
acucaaaucucuacaugga

SEQ ID NO: 585512 - RNA, 19 nt, Homo sapiens
gaggaccugugcaaugaga

SEQ ID NO: 585513 - RNA, 19 nt, Homo sapiens
ccuccuggccgucaucuua

SEQ ID NO: 585514 - RNA, 19 nt, Homo sapiens
aggaggaccugugcaauga

SEQ ID NO: 585515 - RNA, 19 nt, Homo sapiens
gcaagaccacgaacacagu

SEQ ID NO: 585516 - RNA, 19 nt, Homo sapiens
ggaaugcugaugacuugga

SEQ ID NO: 585517 - RNA, 19 nt, Homo sapiens
gcugagggcuuccccgaaa

SEQ ID NO: 585518 - RNA, 19 nt, Homo sapiens
auggaaugcugaugacuug

SEQ ID NO: 585519 - RNA, 19 nt, Homo sapiens
uccagcaacugcaagcauu

SEQ ID NO: 585520 - RNA, 19 nt, Homo sapiens
gcaacugcaagcauucugu

SEQ ID NO: 585521 - RNA, 19 nt, Homo sapiens
ucacacuccuucuguuuug

SEQ ID NO: 585522 - RNA, 19 nt, Homo sapiens
cauggaaugcugaugacuu

SEQ ID NO: 585523 - RNA, 19 nt, Homo sapiens
gauuucacacuccuucugu

SEQ ID NO: 585524 - RNA, 19 nt, Homo sapiens
ggaagguggaggacagaag

SEQ ID NO: 585525 - RNA, 19 nt, Homo sapiens
cuacauggagauaaaugau

SEQ ID NO: 585526 - RNA, 19 nt, Homo sapiens
ggauuccacaccucucuuc

SEQ ID NO: 585527 - RNA, 19 nt, Homo sapiens
ggauuucacacuccuucug

SEQ ID NO: 585528 - RNA, 19 nt, Homo sapiens
cagcagagcuuacagauuu

SEQ ID NO: 585529 - RNA, 19 nt, Homo sapiens
gagaacacacucaucauua

SEQ ID NO: 585530 - RNA, 19 nt, Homo sapiens
caagaaagguagcagaaau

SEQ ID NO: 585531 - RNA, 19 nt, Homo sapiens
gccaguaucuucauuuaug

SEQ ID NO: 585532 - RNA, 19 nt, Homo sapiens
cagccaguaucuucauuua

SEQ ID NO: 585533 - RNA, 19 nt, Homo sapiens
guaugucacugucacuauu

SEQ ID NO: 585534 - RNA, 19 nt, Homo sapiens
ccacaaacccauguacuuu

SEQ ID NO: 585535 - RNA, 19 nt, Homo sapiens
aaagguagcagaaauguau

SEQ ID NO: 585536 - RNA, 19 nt, Homo sapiens
agaacacacucaucauuau

SEQ ID NO: 585537 - RNA, 19 nt, Homo sapiens
gaaagguagcagaaaugua

SEQ ID NO: 585538 - RNA, 19 nt, Homo sapiens
gaacacacucaucauuaug

SEQ ID NO: 585539 - RNA, 19 nt, Homo sapiens
caacaucaucaaccacuuu

SEQ ID NO: 585540 - RNA, 19 nt, Homo sapiens
guuggucucuguacuguau

SEQ ID NO: 585541 - RNA, 19 nt, Homo sapiens
ggacagcuaaucuccuuug

SEQ ID NO: 585542 - RNA, 19 nt, Homo sapiens
gaugcuugcuggcuuuguu

SEQ ID NO: 585543 - RNA, 19 nt, Homo sapiens
guaauauuguuugcccuuu

SEQ ID NO: 585544 - RNA, 19 nt, Homo sapiens
ggccaaugaucgcuauaug

SEQ ID NO: 585545 - RNA, 19 nt, Homo sapiens
gaucauggacagcuaaucu

SEQ ID NO: 585546 - RNA, 19 nt, Homo sapiens
uagcuaauauguccuuucu

SEQ ID NO: 585547 - RNA, 19 nt, Homo sapiens
acuguaugcugucauugua

SEQ ID NO: 585548 - RNA, 19 nt, Homo sapiens
gcagccaguaucuucauuu

SEQ ID NO: 585549 - RNA, 19 nt, Homo sapiens
gagagugagugaguuugug

SEQ ID NO: 585550 - RNA, 19 nt, Homo sapiens
gcaucuccauggucaaagu

SEQ ID NO: 585551 - RNA, 19 nt, Homo sapiens
gacagcuaaucuccuuuga

SEQ ID NO: 585552 - RNA, 19 nt, Homo sapiens
ucaaucccaucauuuacug

SEQ ID NO: 585553 - RNA, 19 nt, Homo sapiens
caugacacagcuuuacuuu

SEQ ID NO: 585554 - RNA, 19 nt, Homo sapiens
gcaugacacagcuuuacuu

SEQ ID NO: 585555 - RNA, 19 nt, Homo sapiens
agagcccuaugcuguauuu

SEQ ID NO: 585556 - RNA, 19 nt, Homo sapiens
ccaccugugccucucauuu

SEQ ID NO: 585557 - RNA, 19 nt, Homo sapiens
gauuucauccuggccauuu

SEQ ID NO: 585558 - RNA, 19 nt, Homo sapiens
ggagagugagugaguuugu

SEQ ID NO: 585559 - RNA, 19 nt, Homo sapiens
gcugcuggccuauguguug

SEQ ID NO: 585560 - RNA, 19 nt, Homo sapiens
ucugugaugucucuccauu

SEQ ID NO: 585561 - RNA, 19 nt, Homo sapiens
ccaagaaagguagcagaaa

SEQ ID NO: 585562 - RNA, 19 nt, Homo sapiens
gcuauauggccaucugcua

SEQ ID NO: 585563 - RNA, 19 nt, Homo sapiens
ccacagcagagcuuacaga

SEQ ID NO: 585564 - RNA, 19 nt, Homo sapiens
agagagcccuaugcuguau

SEQ ID NO: 585565 - RNA, 19 nt, Homo sapiens
gcaaucaagaggucaagag

SEQ ID NO: 585566 - RNA, 19 nt, Homo sapiens
uguacuguaugcugucauu

SEQ ID NO: 585567 - RNA, 19 nt, Homo sapiens
ucgcuguuauggccaauga

SEQ ID NO: 585568 - RNA, 19 nt, Homo sapiens
caaucaagaggucaagaga

SEQ ID NO: 585569 - RNA, 19 nt, Homo sapiens
ggaugcaugacacagcuuu

SEQ ID NO: 585570 - RNA, 19 nt, Homo sapiens
ucugcuaucuucuccacaa

SEQ ID NO: 585571 - RNA, 19 nt, Homo sapiens
gaugcaugacacagcuuua

SEQ ID NO: 585572 - RNA, 19 nt, Homo sapiens
caaguuggucucuguacug

SEQ ID NO: 585573 - RNA, 19 nt, Homo sapiens
ccaacaucaucaaccacuu

SEQ ID NO: 585574 - RNA, 19 nt, Homo sapiens
gcucuugggcuggagguuu

SEQ ID NO: 585575 - RNA, 19 nt, Homo sapiens
cuggagauuugguauguca

SEQ ID NO: 585576 - RNA, 19 nt, Homo sapiens
aagagagcccuaugcugua

SEQ ID NO: 585577 - RNA, 19 nt, Homo sapiens
uguccuuucuggagauuug

SEQ ID NO: 585578 - RNA, 19 nt, Homo sapiens
ugagugaguuuguguugcu

SEQ ID NO: 585579 - RNA, 19 nt, Homo sapiens
gguaugucacugucacuau

SEQ ID NO: 585580 - RNA, 19 nt, Homo sapiens
acaggaucauggacagcua

SEQ ID NO: 585581 - RNA, 19 nt, Homo sapiens
cuauauggccaucugcuau

SEQ ID NO: 585582 - RNA, 19 nt, Homo sapiens
ggcuugggcugcacugagu

SEQ ID NO: 585583 - RNA, 19 nt, Homo sapiens
aagaaagguagcagaaaug

SEQ ID NO: 585584 - RNA, 19 nt, Homo sapiens
ugugaugucucuccauugc

SEQ ID NO: 585585 - RNA, 19 nt, Homo sapiens
ugcucaaucccaucauuua

SEQ ID NO: 585586 - RNA, 19 nt, Homo sapiens
ccuccuauguggccauuac

SEQ ID NO: 585587 - RNA, 19 nt, Homo sapiens
gcucaaucccaucauuuac

SEQ ID NO: 585588 - RNA, 19 nt, Homo sapiens
ccaguaucuucauuuaugc

SEQ ID NO: 585589 - RNA, 19 nt, Homo sapiens
cauuacuggugcugugaug

SEQ ID NO: 585590 - RNA, 19 nt, Homo sapiens
uguuggugcugacugagaa

SEQ ID NO: 585591 - RNA, 19 nt, Homo sapiens
aaccauagugggagaguga

SEQ ID NO: 585592 - RNA, 19 nt, Homo sapiens
caccugugccucucauuuc

SEQ ID NO: 585593 - RNA, 19 nt, Homo sapiens
gcagagcuuacagauuuca

SEQ ID NO: 585594 - RNA, 19 nt, Homo sapiens
aaccucucaugcacugaua

SEQ ID NO: 585595 - RNA, 19 nt, Homo sapiens
ggugcugacugagaacaca

SEQ ID NO: 585596 - RNA, 19 nt, Homo sapiens
uauggccaaugaucgcuau

SEQ ID NO: 585597 - RNA, 19 nt, Homo sapiens
gcuguuauggccaaugauc

SEQ ID NO: 585598 - RNA, 19 nt, Homo sapiens
cccaagaaagguagcagaa

SEQ ID NO: 585599 - RNA, 19 nt, Homo sapiens
caaccucucaugcacugau

SEQ ID NO: 585600 - RNA, 19 nt, Homo sapiens
gccaaugaucgcuauaugg

SEQ ID NO: 585601 - RNA, 19 nt, Homo sapiens
auggacagcuaaucuccuu

SEQ ID NO: 585602 - RNA, 19 nt, Homo sapiens
gcagauggauccuaauaga

SEQ ID NO: 585603 - RNA, 19 nt, Homo sapiens
ccaggugccuuucaaauuu

SEQ ID NO: 585604 - RNA, 19 nt, Homo sapiens
gccaagaucuccaacauga

SEQ ID NO: 585605 - RNA, 19 nt, Homo sapiens
guagagaacacgcguauuu

SEQ ID NO: 585606 - RNA, 19 nt, Homo sapiens
caagaaagauguauauagg

SEQ ID NO: 585607 - RNA, 19 nt, Homo sapiens
gagcgcagauggauccuaa

SEQ ID NO: 585608 - RNA, 19 nt, Homo sapiens
cauaaacguugguggauuu

SEQ ID NO: 585609 - RNA, 19 nt, Homo sapiens
guacagacauauuuaacug

SEQ ID NO: 585610 - RNA, 19 nt, Homo sapiens
gauggauccuaauagaaua

SEQ ID NO: 585611 - RNA, 19 nt, Homo sapiens
cagaguaucuucaacuaau

SEQ ID NO: 585612 - RNA, 19 nt, Homo sapiens
ggaggaagcaccaaguauu

SEQ ID NO: 585613 - RNA, 19 nt, Homo sapiens
ggcacucacugcauuuaua

SEQ ID NO: 585614 - RNA, 19 nt, Homo sapiens
ggaauuacaacauaucguu

SEQ ID NO: 585615 - RNA, 19 nt, Homo sapiens
gcagagacuacaccaagua

SEQ ID NO: 585616 - RNA, 19 nt, Homo sapiens
ugaaaucugucaagaguag

SEQ ID NO: 585617 - RNA, 19 nt, Homo sapiens
agaccuagcuacagaguau

SEQ ID NO: 585618 - RNA, 19 nt, Homo sapiens
caggugccuuucaaauuua

SEQ ID NO: 585619 - RNA, 19 nt, Homo sapiens
gcacaucagagcagagaaa

SEQ ID NO: 585620 - RNA, 19 nt, Homo sapiens
gaauuaaacaggccuuuca

SEQ ID NO: 585621 - RNA, 19 nt, Homo sapiens
auggaugccuugaauaaua

SEQ ID NO: 585622 - RNA, 19 nt, Homo sapiens
gcgcagauggauccuaaua

SEQ ID NO: 585623 - RNA, 19 nt, Homo sapiens
ccacugaaaucugucaaga

SEQ ID NO: 585624 - RNA, 19 nt, Homo sapiens
gcucaucucacuauuaaug

SEQ ID NO: 585625 - RNA, 19 nt, Homo sapiens
ccacaagugccgcaaauug

SEQ ID NO: 585626 - RNA, 19 nt, Homo sapiens
gaggaagcaccaaguauug

SEQ ID NO: 585627 - RNA, 19 nt, Homo sapiens
caggagaccuagcuacaga

SEQ ID NO: 585628 - RNA, 19 nt, Homo sapiens
aaauggaugccuugaauaa

SEQ ID NO: 585629 - RNA, 19 nt, Homo sapiens
uugcucaucucacuauuaa

SEQ ID NO: 585630 - RNA, 19 nt, Homo sapiens
ggggaaaacuugcagcuaa

SEQ ID NO: 585631 - RNA, 19 nt, Homo sapiens
ggugucaucuagcgcaauu

SEQ ID NO: 585632 - RNA, 19 nt, Homo sapiens
gaaacugcaugugggcuau

SEQ ID NO: 585633 - RNA, 19 nt, Homo sapiens
caacaugacuuuuagcaau

SEQ ID NO: 585634 - RNA, 19 nt, Homo sapiens
uggaugccuugaauaauaa

SEQ ID NO: 585635 - RNA, 19 nt, Homo sapiens
gguuagaucuggccaagag

SEQ ID NO: 585636 - RNA, 19 nt, Homo sapiens
ccaagaaagauguauauag

SEQ ID NO: 585637 - RNA, 19 nt, Homo sapiens
uaaaauggaugccuugaau

SEQ ID NO: 585638 - RNA, 19 nt, Homo sapiens
ccuaauaucaaaugcagua

SEQ ID NO: 585639 - RNA, 19 nt, Homo sapiens
guggauggcucaugguuag

SEQ ID NO: 585640 - RNA, 19 nt, Homo sapiens
uaacuggugcacuuuguaa

SEQ ID NO: 585641 - RNA, 19 nt, Homo sapiens
uacagaguaucuucaacua

SEQ ID NO: 585642 - RNA, 19 nt, Homo sapiens
gggccaagaucuccaacau

SEQ ID NO: 585643 - RNA, 19 nt, Homo sapiens
uuagacucaugguguguua

SEQ ID NO: 585644 - RNA, 19 nt, Homo sapiens
ggaguuggccgcagacaag

SEQ ID NO: 585645 - RNA, 19 nt, Homo sapiens
uagagaacacgcguauuua

SEQ ID NO: 585646 - RNA, 19 nt, Homo sapiens
ccauaaacguugguggauu

SEQ ID NO: 585647 - RNA, 19 nt, Homo sapiens
gagaacacgcguauuuaca

SEQ ID NO: 585648 - RNA, 19 nt, Homo sapiens
gagaggaaaucagcaucga

SEQ ID NO: 585649 - RNA, 19 nt, Homo sapiens
cauaaugggccacugaaau

SEQ ID NO: 585650 - RNA, 19 nt, Homo sapiens
gcuguugacauauuuaaug

SEQ ID NO: 585651 - RNA, 19 nt, Homo sapiens
gcccuguucuucuauuuca

SEQ ID NO: 585652 - RNA, 19 nt, Homo sapiens
acugaaaucugucaagagu

SEQ ID NO: 585653 - RNA, 19 nt, Homo sapiens
ggaucaggaugcaacauac

SEQ ID NO: 585654 - RNA, 19 nt, Homo sapiens
gaaagcugacauugccaaa

SEQ ID NO: 585655 - RNA, 19 nt, Homo sapiens
guuacggucuggagaggaa

SEQ ID NO: 585656 - RNA, 19 nt, Homo sapiens
gcacucacugcauuuauag

SEQ ID NO: 585657 - RNA, 19 nt, Homo sapiens
ugcaguauauuucuucguu

SEQ ID NO: 585658 - RNA, 19 nt, Homo sapiens
uuaccuguaugccaacauu

SEQ ID NO: 585659 - RNA, 19 nt, Homo sapiens
caacauacuuuggggcuuu

SEQ ID NO: 585660 - RNA, 19 nt, Homo sapiens
aaacaagccaagaaagaug

SEQ ID NO: 585661 - RNA, 19 nt, Homo sapiens
gguggauggcucaugguua

SEQ ID NO: 585662 - RNA, 19 nt, Homo sapiens
ugaauaauaagcaggaugu

SEQ ID NO: 585663 - RNA, 19 nt, Homo sapiens
auauuuaacuggugcacuu

SEQ ID NO: 585664 - RNA, 19 nt, Homo sapiens
agauggcacucacugcauu

SEQ ID NO: 585665 - RNA, 19 nt, Homo sapiens
uguauuuccuggauguuug

SEQ ID NO: 585666 - RNA, 19 nt, Homo sapiens
cggaucaggaugcaacaua

SEQ ID NO: 585667 - RNA, 19 nt, Homo sapiens
ccuaauagaauaucagaag

SEQ ID NO: 585668 - RNA, 19 nt, Homo sapiens
gccaagaaagauguauaua

SEQ ID NO: 585669 - RNA, 19 nt, Homo sapiens
cuggugcacuuuguaaauu

SEQ ID NO: 585670 - RNA, 19 nt, Homo sapiens
uggagagggugucaucuag

SEQ ID NO: 585671 - RNA, 19 nt, Homo sapiens
guggagagggugucaucua

SEQ ID NO: 585672 - RNA, 19 nt, Homo sapiens
gcgucgcccuguucuucua

SEQ ID NO: 585673 - RNA, 19 nt, Homo sapiens
caauugaaggaucaucuga

SEQ ID NO: 585674 - RNA, 19 nt, Homo sapiens
gcaauugaaggaucaucug

SEQ ID NO: 585675 - RNA, 19 nt, Homo sapiens
uauccaugcucuugaccuu

SEQ ID NO: 585676 - RNA, 19 nt, Homo sapiens
guacacgacucaguaucca

SEQ ID NO: 585677 - RNA, 19 nt, Homo sapiens
aagugagucuguccucuug

SEQ ID NO: 585678 - RNA, 19 nt, Homo sapiens
uagcgcaauugaaggauca

SEQ ID NO: 585679 - RNA, 19 nt, Homo sapiens
guuggucccuggucaugug

SEQ ID NO: 585680 - RNA, 19 nt, Homo sapiens
uaaaacaagccaagaaaga

SEQ ID NO: 585681 - RNA, 19 nt, Homo sapiens
agauggauccuaauagaau

SEQ ID NO: 585682 - RNA, 19 nt, Homo sapiens
ugccgcaaauuguaccuuu

SEQ ID NO: 585683 - RNA, 19 nt, Homo sapiens
cagauggauccuaauagaa

SEQ ID NO: 585684 - RNA, 19 nt, Homo sapiens
gggagauguuagacucaug

SEQ ID NO: 585685 - RNA, 19 nt, Homo sapiens
ucaaggagcugugcaaaag

SEQ ID NO: 585686 - RNA, 19 nt, Homo sapiens
ccugauucauguaggagaa

SEQ ID NO: 585687 - RNA, 19 nt, Homo sapiens
ucaggaugcaacauacuuu

SEQ ID NO: 585688 - RNA, 19 nt, Homo sapiens
aacauuugcuuucgacauc

SEQ ID NO: 585689 - RNA, 19 nt, Homo sapiens
caacauuugcuuucgacau

SEQ ID NO: 585690 - RNA, 19 nt, Homo sapiens
caagaucuccaacaugacu

SEQ ID NO: 585691 - RNA, 19 nt, Homo sapiens
gagcagagaaagcgauggu

SEQ ID NO: 585692 - RNA, 19 nt, Homo sapiens
gugcuauaguauuugauuc

SEQ ID NO: 585693 - RNA, 19 nt, Homo sapiens
agaguaucuucaacuaaug

SEQ ID NO: 585694 - RNA, 19 nt, Homo sapiens
gagaauuaaacaggccuuu

SEQ ID NO: 585695 - RNA, 19 nt, Homo sapiens
gauggcacucacugcauuu

SEQ ID NO: 585696 - RNA, 19 nt, Homo sapiens
cuaaugguguacgucacua

SEQ ID NO: 585697 - RNA, 19 nt, Homo sapiens
gcaaaaggaauuacaacau

SEQ ID NO: 585698 - RNA, 19 nt, Homo sapiens
caguauauuucuucguucu

SEQ ID NO: 585699 - RNA, 19 nt, Homo sapiens
uuauguauuuccuggaugu

SEQ ID NO: 585700 - RNA, 19 nt, Homo sapiens
gcaucaaaaucccaaguuc

SEQ ID NO: 585701 - RNA, 19 nt, Homo sapiens
acagaguaucuucaacuaa

SEQ ID NO: 585702 - RNA, 19 nt, Homo sapiens
gcagauggauccuaauaga

SEQ ID NO: 585703 - RNA, 19 nt, Homo sapiens
ccaggugccuuucaaauuu

SEQ ID NO: 585704 - RNA, 19 nt, Homo sapiens
gccaagaucuccaacauga

SEQ ID NO: 585705 - RNA, 19 nt, Homo sapiens
guagagaacacgcguauuu

SEQ ID NO: 585706 - RNA, 19 nt, Homo sapiens
caagaaagauguauauagg

SEQ ID NO: 585707 - RNA, 19 nt, Homo sapiens
cauaaacguugguggauuu

SEQ ID NO: 585708 - RNA, 19 nt, Homo sapiens
guacagacauauuuaacug

SEQ ID NO: 585709 - RNA, 19 nt, Homo sapiens
gauggauccuaauagaaua

SEQ ID NO: 585710 - RNA, 19 nt, Homo sapiens
cagaguaucuucaacuaau

SEQ ID NO: 585711 - RNA, 19 nt, Homo sapiens
ggaggaagcaccaaguauu

SEQ ID NO: 585712 - RNA, 19 nt, Homo sapiens
ggcacucacugcauuuaua

SEQ ID NO: 585713 - RNA, 19 nt, Homo sapiens
ggaauuacaacauaucguu

SEQ ID NO: 585714 - RNA, 19 nt, Homo sapiens
ccaaagaauugcagaugga

SEQ ID NO: 585715 - RNA, 19 nt, Homo sapiens
ugaaaucugucaagaguag

SEQ ID NO: 585716 - RNA, 19 nt, Homo sapiens
agaccuagcuacagaguau

SEQ ID NO: 585717 - RNA, 19 nt, Homo sapiens
caggugccuuucaaauuua

SEQ ID NO: 585718 - RNA, 19 nt, Homo sapiens
gcacaucagagcagagaaa

SEQ ID NO: 585719 - RNA, 19 nt, Homo sapiens
gaauuaaacaggccuuuca

SEQ ID NO: 585720 - RNA, 19 nt, Homo sapiens
auggaugccuugaauaaua

SEQ ID NO: 585721 - RNA, 19 nt, Homo sapiens
ccacugaaaucugucaaga

SEQ ID NO: 585722 - RNA, 19 nt, Homo sapiens
gcucaucucacuauuaaug

SEQ ID NO: 585723 - RNA, 19 nt, Homo sapiens
ccacaagugccgcaaauug

SEQ ID NO: 585724 - RNA, 19 nt, Homo sapiens
gaggaagcaccaaguauug

SEQ ID NO: 585725 - RNA, 19 nt, Homo sapiens
caggagaccuagcuacaga

SEQ ID NO: 585726 - RNA, 19 nt, Homo sapiens
cuucagaguuucgacuuua

SEQ ID NO: 585727 - RNA, 19 nt, Homo sapiens
aaauggaugccuugaauaa

SEQ ID NO: 585728 - RNA, 19 nt, Homo sapiens
uugcucaucucacuauuaa

SEQ ID NO: 585729 - RNA, 19 nt, Homo sapiens
ggggaaaacuugcagcuaa

SEQ ID NO: 585730 - RNA, 19 nt, Homo sapiens
ggugucaucuagcgcaauu

SEQ ID NO: 585731 - RNA, 19 nt, Homo sapiens
gaaacugcaugugggcuau

SEQ ID NO: 585732 - RNA, 19 nt, Homo sapiens
caacaugacuuuuagcaau

SEQ ID NO: 585733 - RNA, 19 nt, Homo sapiens
uggaugccuugaauaauaa

SEQ ID NO: 585734 - RNA, 19 nt, Homo sapiens
gguuagaucuggccaagag

SEQ ID NO: 585735 - RNA, 19 nt, Homo sapiens
ccaagaaagauguauauag

SEQ ID NO: 585736 - RNA, 19 nt, Homo sapiens
uaaaauggaugccuugaau

SEQ ID NO: 585737 - RNA, 19 nt, Homo sapiens
ccuaauaucaaaugcagua

SEQ ID NO: 585738 - RNA, 19 nt, Homo sapiens
guggauggcucaugguuag

SEQ ID NO: 585739 - RNA, 19 nt, Homo sapiens
uaacuggugcacuuuguaa

SEQ ID NO: 585740 - RNA, 19 nt, Homo sapiens
uacagaguaucuucaacua

SEQ ID NO: 585741 - RNA, 19 nt, Homo sapiens
gggccaagaucuccaacau

SEQ ID NO: 585742 - RNA, 19 nt, Homo sapiens
uuagacucaugguguguua

SEQ ID NO: 585743 - RNA, 19 nt, Homo sapiens
uagagaacacgcguauuua

SEQ ID NO: 585744 - RNA, 19 nt, Homo sapiens
ccauaaacguugguggauu

SEQ ID NO: 585745 - RNA, 19 nt, Homo sapiens
gagaacacgcguauuuaca

SEQ ID NO: 585746 - RNA, 19 nt, Homo sapiens
gagaggaaaucagcaucga

SEQ ID NO: 585747 - RNA, 19 nt, Homo sapiens
cauaaugggccacugaaau

SEQ ID NO: 585748 - RNA, 19 nt, Homo sapiens
gcuguugacauauuuaaug

SEQ ID NO: 585749 - RNA, 19 nt, Homo sapiens
acugaaaucugucaagagu

SEQ ID NO: 585750 - RNA, 19 nt, Homo sapiens
ggaucaggaugcaacauac

SEQ ID NO: 585751 - RNA, 19 nt, Homo sapiens
gaaagcugacauugccaaa

SEQ ID NO: 585752 - RNA, 19 nt, Homo sapiens
guuacggucuggagaggaa

SEQ ID NO: 585753 - RNA, 19 nt, Homo sapiens
gcacucacugcauuuauag

SEQ ID NO: 585754 - RNA, 19 nt, Homo sapiens
ugcaguauauuucuucguu

SEQ ID NO: 585755 - RNA, 19 nt, Homo sapiens
uagaagccaccaaagaauu

SEQ ID NO: 585756 - RNA, 19 nt, Homo sapiens
uuaccuguaugccaacauu

SEQ ID NO: 585757 - RNA, 19 nt, Homo sapiens
caacauacuuuggggcuuu

SEQ ID NO: 585758 - RNA, 19 nt, Homo sapiens
aaacaagccaagaaagaug

SEQ ID NO: 585759 - RNA, 19 nt, Homo sapiens
aauugcagauggauccuaa

SEQ ID NO: 585760 - RNA, 19 nt, Homo sapiens
acacuuagaagccaccaaa

SEQ ID NO: 585761 - RNA, 19 nt, Homo sapiens
cuuagaagccaccaaagaa

SEQ ID NO: 585762 - RNA, 19 nt, Homo sapiens
gguggauggcucaugguua

SEQ ID NO: 585763 - RNA, 19 nt, Homo sapiens
ugaauaauaagcaggaugu

SEQ ID NO: 585764 - RNA, 19 nt, Homo sapiens
auauuuaacuggugcacuu

SEQ ID NO: 585765 - RNA, 19 nt, Homo sapiens
ccuaauagaauaucagaag

SEQ ID NO: 585766 - RNA, 19 nt, Homo sapiens
agauggcacucacugcauu

SEQ ID NO: 585767 - RNA, 19 nt, Homo sapiens
uguauuuccuggauguuug

SEQ ID NO: 585768 - RNA, 19 nt, Homo sapiens
cggaucaggaugcaacaua

SEQ ID NO: 585769 - RNA, 19 nt, Homo sapiens
gccaagaaagauguauaua

SEQ ID NO: 585770 - RNA, 19 nt, Homo sapiens
cuggugcacuuuguaaauu

SEQ ID NO: 585771 - RNA, 19 nt, Homo sapiens
uggagagggugucaucuag

SEQ ID NO: 585772 - RNA, 19 nt, Homo sapiens
guggagagggugucaucua

SEQ ID NO: 585773 - RNA, 19 nt, Homo sapiens
caauugaaggaucaucuga

SEQ ID NO: 585774 - RNA, 19 nt, Homo sapiens
gcaauugaaggaucaucug

SEQ ID NO: 585775 - RNA, 19 nt, Homo sapiens
uauccaugcucuugaccuu

SEQ ID NO: 585776 - RNA, 19 nt, Homo sapiens
guacacgacucaguaucca

SEQ ID NO: 585777 - RNA, 19 nt, Homo sapiens
aagugagucuguccucuug

SEQ ID NO: 585778 - RNA, 19 nt, Homo sapiens
uagcgcaauugaaggauca

SEQ ID NO: 585779 - RNA, 19 nt, Homo sapiens
guuggucccuggucaugug

SEQ ID NO: 585780 - RNA, 19 nt, Homo sapiens
uaaaacaagccaagaaaga

SEQ ID NO: 585781 - RNA, 19 nt, Homo sapiens
agauggauccuaauagaau

SEQ ID NO: 585782 - RNA, 19 nt, Homo sapiens
ugccgcaaauuguaccuuu

SEQ ID NO: 585783 - RNA, 19 nt, Homo sapiens
agaagccaccaaagaauug

SEQ ID NO: 585784 - RNA, 19 nt, Homo sapiens
gggagauguuagacucaug

SEQ ID NO: 585785 - RNA, 19 nt, Homo sapiens
cagauggauccuaauagaa

SEQ ID NO: 585786 - RNA, 19 nt, Homo sapiens
ucaaggagcugugcaaaag

SEQ ID NO: 585787 - RNA, 19 nt, Homo sapiens
uugcagauggauccuaaua

SEQ ID NO: 585788 - RNA, 19 nt, Homo sapiens
ucaggaugcaacauacuuu

SEQ ID NO: 585789 - RNA, 19 nt, Homo sapiens
ccugauucauguaggagaa

SEQ ID NO: 585790 - RNA, 19 nt, Homo sapiens
aacauuugcuuucgacauc

SEQ ID NO: 585791 - RNA, 19 nt, Homo sapiens
caacauuugcuuucgacau

SEQ ID NO: 585792 - RNA, 19 nt, Homo sapiens
caagaucuccaacaugacu

SEQ ID NO: 585793 - RNA, 19 nt, Homo sapiens
gagcagagaaagcgauggu

SEQ ID NO: 585794 - RNA, 19 nt, Homo sapiens
gugcuauaguauuugauuc

SEQ ID NO: 585795 - RNA, 19 nt, Homo sapiens
agaguaucuucaacuaaug

SEQ ID NO: 585796 - RNA, 19 nt, Homo sapiens
cuaaugguguacgucacua

SEQ ID NO: 585797 - RNA, 19 nt, Homo sapiens
gauggcacucacugcauuu

SEQ ID NO: 585798 - RNA, 19 nt, Homo sapiens
gagaauuaaacaggccuuu

SEQ ID NO: 585799 - RNA, 19 nt, Homo sapiens
gcaaaaggaauuacaacau

SEQ ID NO: 585800 - RNA, 19 nt, Homo sapiens
ccuggccuauugaagguuu

SEQ ID NO: 585801 - RNA, 19 nt, Homo sapiens
caguauauuucuucguucu

SEQ ID NO: 585802 - RNA, 19 nt, Homo sapiens
guagaaagauagcguauuu

SEQ ID NO: 585803 - RNA, 19 nt, Homo sapiens
ggauauggcuguuguagaa

SEQ ID NO: 585804 - RNA, 19 nt, Homo sapiens
gaagagaaagcaaggauaa

SEQ ID NO: 585805 - RNA, 19 nt, Homo sapiens
gcagccaccuuuagugaua

SEQ ID NO: 585806 - RNA, 19 nt, Homo sapiens
ggagaaaucuauugaagca

SEQ ID NO: 585807 - RNA, 19 nt, Homo sapiens
gagaagugaucaacagaaa

SEQ ID NO: 585808 - RNA, 19 nt, Homo sapiens
gaagaaagcccugcuccua

SEQ ID NO: 585809 - RNA, 19 nt, Homo sapiens
cacaauagcuucccacgaa

SEQ ID NO: 585810 - RNA, 19 nt, Homo sapiens
gauagcguauuugcauuua

SEQ ID NO: 585811 - RNA, 19 nt, Homo sapiens
gaacucugcugucuauaag

SEQ ID NO: 585812 - RNA, 19 nt, Homo sapiens
gaucagaggcccacaauag

SEQ ID NO: 585813 - RNA, 19 nt, Homo sapiens
ucaacagacugcuauauau

SEQ ID NO: 585814 - RNA, 19 nt, Homo sapiens
gauaaucuaugaagacuac

SEQ ID NO: 585815 - RNA, 19 nt, Homo sapiens
gaaaagacauucagguguu

SEQ ID NO: 585816 - RNA, 19 nt, Homo sapiens
caacacauauucgaugaug

SEQ ID NO: 585817 - RNA, 19 nt, Homo sapiens
caugaacucugcugucuau

SEQ ID NO: 585818 - RNA, 19 nt, Homo sapiens
aagcaaggauaaucuauga

SEQ ID NO: 585819 - RNA, 19 nt, Homo sapiens
ggacccaaauucacaguuc

SEQ ID NO: 585820 - RNA, 19 nt, Homo sapiens
caacagacugcuauauauu

SEQ ID NO: 585821 - RNA, 19 nt, Homo sapiens
gaucagagcggauggagau

SEQ ID NO: 585822 - RNA, 19 nt, Homo sapiens
ggagccaucccaacacaua

SEQ ID NO: 585823 - RNA, 19 nt, Homo sapiens
gaagugaucaacagaaaca

SEQ ID NO: 585824 - RNA, 19 nt, Homo sapiens
gcacaagaauuuuaucuca

SEQ ID NO: 585825 - RNA, 19 nt, Homo sapiens
augcucaacuucagauuua

SEQ ID NO: 585826 - RNA, 19 nt, Homo sapiens
uauaaggacuugcuucagu

SEQ ID NO: 585827 - RNA, 19 nt, Homo sapiens
caaggauaaucuaugaaga

SEQ ID NO: 585828 - RNA, 19 nt, Homo sapiens
gaaagcaaggauaaucuau

SEQ ID NO: 585829 - RNA, 19 nt, Homo sapiens
ugaaagaaauaugggcauu

SEQ ID NO: 585830 - RNA, 19 nt, Homo sapiens
ccagcaagcucgguuugaa

SEQ ID NO: 585831 - RNA, 19 nt, Homo sapiens
gcuauauauucaccaugua

SEQ ID NO: 585832 - RNA, 19 nt, Homo sapiens
gaauuuagagguuguagca

SEQ ID NO: 585833 - RNA, 19 nt, Homo sapiens
gcucgugucucacuguuag

SEQ ID NO: 585834 - RNA, 19 nt, Homo sapiens
uaacagaugauuccuucaa

SEQ ID NO: 585835 - RNA, 19 nt, Homo sapiens
gcaaggauaaucuaugaag

SEQ ID NO: 585836 - RNA, 19 nt, Homo sapiens
cauauucgaugaugcucaa

SEQ ID NO: 585837 - RNA, 19 nt, Homo sapiens
gaauuugccaaccuaaaga

SEQ ID NO: 585838 - RNA, 19 nt, Homo sapiens
gaacucagagcagaucuuc

SEQ ID NO: 585839 - RNA, 19 nt, Homo sapiens
ccaaauucacaguucauaa

SEQ ID NO: 585840 - RNA, 19 nt, Homo sapiens
aaagauagcguauuugcau

SEQ ID NO: 585841 - RNA, 19 nt, Homo sapiens
aaagggauauggcuguugu

SEQ ID NO: 585842 - RNA, 19 nt, Homo sapiens
ugaacucugcugucuauaa

SEQ ID NO: 585843 - RNA, 19 nt, Homo sapiens
agacucauauccucgauuc

SEQ ID NO: 585844 - RNA, 19 nt, Homo sapiens
gcacagagacucauauccu

SEQ ID NO: 585845 - RNA, 19 nt, Homo sapiens
ggccaaggcuacacagaag

SEQ ID NO: 585846 - RNA, 19 nt, Homo sapiens
guaaacugcagccaccuuu

SEQ ID NO: 585847 - RNA, 19 nt, Homo sapiens
ugagagaagugaucaacag

SEQ ID NO: 585848 - RNA, 19 nt, Homo sapiens
gaagacuacauuucuauac

SEQ ID NO: 585849 - RNA, 19 nt, Homo sapiens
gggaaccacuuuuauuuug

SEQ ID NO: 585850 - RNA, 19 nt, Homo sapiens
caacuagcacagggaauuu

SEQ ID NO: 585851 - RNA, 19 nt, Homo sapiens
gaugcucaacuucagauuu

SEQ ID NO: 585852 - RNA, 19 nt, Homo sapiens
ggaucagucucaagugucu

SEQ ID NO: 585853 - RNA, 19 nt, Homo sapiens
gaagaucagaggcccacaa

SEQ ID NO: 585854 - RNA, 19 nt, Homo sapiens
uugccaaccuaaagaauga

SEQ ID NO: 585855 - RNA, 19 nt, Homo sapiens
uaaaagaugugaccacuac

SEQ ID NO: 585856 - RNA, 19 nt, Homo sapiens
gcauuuacaauaacaguag

SEQ ID NO: 585857 - RNA, 19 nt, Homo sapiens
gagaaagcaaggauaaucu

SEQ ID NO: 585858 - RNA, 19 nt, Homo sapiens
cgccugggcucagucauuu

SEQ ID NO: 585859 - RNA, 19 nt, Homo sapiens
uagcguauuugcauuuaca

SEQ ID NO: 585860 - RNA, 19 nt, Homo sapiens
guggaucagucucaagugu

SEQ ID NO: 585861 - RNA, 19 nt, Homo sapiens
cuacaugguuaauggaaag

SEQ ID NO: 585862 - RNA, 19 nt, Homo sapiens
gaaagauagcguauuugca

SEQ ID NO: 585863 - RNA, 19 nt, Homo sapiens
cacagggaauuuagagguu

SEQ ID NO: 585864 - RNA, 19 nt, Homo sapiens
caguauguauguauguaug

SEQ ID NO: 585865 - RNA, 19 nt, Homo sapiens
gguuugaauacgucacuua

SEQ ID NO: 585866 - RNA, 19 nt, Homo sapiens
gagcagguacauccacaga

SEQ ID NO: 585867 - RNA, 19 nt, Homo sapiens
acagacugcuauauauuca

SEQ ID NO: 585868 - RNA, 19 nt, Homo sapiens
gagagaagugaucaacaga

SEQ ID NO: 585869 - RNA, 19 nt, Homo sapiens
ugaagagaaagcaaggaua

SEQ ID NO: 585870 - RNA, 19 nt, Homo sapiens
gacccaaauucacaguuca

SEQ ID NO: 585871 - RNA, 19 nt, Homo sapiens
ucggagaaaucuauugaag

SEQ ID NO: 585872 - RNA, 19 nt, Homo sapiens
cccaacacauauucgauga

SEQ ID NO: 585873 - RNA, 19 nt, Homo sapiens
agucucaagugucugguaa

SEQ ID NO: 585874 - RNA, 19 nt, Homo sapiens
uacaauaacaguagcaugu

SEQ ID NO: 585875 - RNA, 19 nt, Homo sapiens
uaucggagaaaucuauuga

SEQ ID NO: 585876 - RNA, 19 nt, Homo sapiens
uuagaaaccaggaagauca

SEQ ID NO: 585877 - RNA, 19 nt, Homo sapiens
agaaagcaaggauaaucua

SEQ ID NO: 585878 - RNA, 19 nt, Homo sapiens
gugaauuccuccgaacaga

SEQ ID NO: 585879 - RNA, 19 nt, Homo sapiens
auucauaacuuggucaugu

SEQ ID NO: 585880 - RNA, 19 nt, Homo sapiens
ugaaguggaucagucucaa

SEQ ID NO: 585881 - RNA, 19 nt, Homo sapiens
agaaagcccugcuccuacu

SEQ ID NO: 585882 - RNA, 19 nt, Homo sapiens
uucaacagacugcuauaua

SEQ ID NO: 585883 - RNA, 19 nt, Homo sapiens
aagauagcguauuugcauu

SEQ ID NO: 585884 - RNA, 19 nt, Homo sapiens
uggcuguuguagaaagaua

SEQ ID NO: 585885 - RNA, 19 nt, Homo sapiens
acagaugauuccuucaaca

SEQ ID NO: 585886 - RNA, 19 nt, Homo sapiens
guauguauguauguaugga

SEQ ID NO: 585887 - RNA, 19 nt, Homo sapiens
gcauucuacuugaucuuac

SEQ ID NO: 585888 - RNA, 19 nt, Homo sapiens
ccacuuuuauuuugcauga

SEQ ID NO: 585889 - RNA, 19 nt, Homo sapiens
acaacuagcacagggaauu

SEQ ID NO: 585890 - RNA, 19 nt, Homo sapiens
cagaauuugccaaccuaaa

SEQ ID NO: 585891 - RNA, 19 nt, Homo sapiens
uugaauacgucacuuacca

SEQ ID NO: 585892 - RNA, 19 nt, Homo sapiens
guacauccacagagcaaag

SEQ ID NO: 585893 - RNA, 19 nt, Homo sapiens
acucugcugucuauaagga

SEQ ID NO: 585894 - RNA, 19 nt, Homo sapiens
uaucagaauuugccaaccu

SEQ ID NO: 585895 - RNA, 19 nt, Homo sapiens
gaguuacuguuauuaucag

SEQ ID NO: 585896 - RNA, 19 nt, Homo sapiens
ucuacaugguuaauggaaa

SEQ ID NO: 585897 - RNA, 19 nt, Homo sapiens
acaguagcauguugucagu

SEQ ID NO: 585898 - RNA, 19 nt, Homo sapiens
aaacugcagccaccuuuag

SEQ ID NO: 585899 - RNA, 19 nt, Homo sapiens
guggagccaucccaacaca

SEQ ID NO: 585900 - RNA, 19 nt, Homo sapiens
aaaauaugcucuucuggau

SEQ ID NO: 585901 - RNA, 19 nt, Homo sapiens
agcaagcucgguuugaaua

SEQ ID NO: 585902 - RNA, 19 nt, Homo sapiens
ggagaaagcucgccuagaa

SEQ ID NO: 585903 - RNA, 19 nt, Homo sapiens
gaagaacaguuaaccaaua

SEQ ID NO: 585904 - RNA, 19 nt, Homo sapiens
caagagaccuccuucagua

SEQ ID NO: 585905 - RNA, 19 nt, Homo sapiens
gaaagaaccauaugaagaa

SEQ ID NO: 585906 - RNA, 19 nt, Homo sapiens
gaugaugucuuucuaccua

SEQ ID NO: 585907 - RNA, 19 nt, Homo sapiens
ggaaagaggagcaaccuaa

SEQ ID NO: 585908 - RNA, 19 nt, Homo sapiens
gagaacaacuucacagaca

SEQ ID NO: 585909 - RNA, 19 nt, Homo sapiens
aaaggaagcuggaggagaa

SEQ ID NO: 585910 - RNA, 19 nt, Homo sapiens
cagaagugaugaaugauaa

SEQ ID NO: 585911 - RNA, 19 nt, Homo sapiens
cgugggaacugcauaauaa

SEQ ID NO: 585912 - RNA, 19 nt, Homo sapiens
ugaaggagcucguggauag

SEQ ID NO: 585913 - RNA, 19 nt, Homo sapiens
gaggauuuguugcaguuua

SEQ ID NO: 585914 - RNA, 19 nt, Homo sapiens
agagggaaguggaauauuu

SEQ ID NO: 585915 - RNA, 19 nt, Homo sapiens
guagccagcuuguguaaga

SEQ ID NO: 585916 - RNA, 19 nt, Homo sapiens
ggaaguggaauauuucaaa

SEQ ID NO: 585917 - RNA, 19 nt, Homo sapiens
ccaagaugcuuucauggaa

SEQ ID NO: 585918 - RNA, 19 nt, Homo sapiens
gauaggaguuugcaucauc

SEQ ID NO: 585919 - RNA, 19 nt, Homo sapiens
gcacuggugucacagauca

SEQ ID NO: 585920 - RNA, 19 nt, Homo sapiens
cuaaagauauugaccuaga

SEQ ID NO: 585921 - RNA, 19 nt, Homo sapiens
caccagagacuccaaauuu

SEQ ID NO: 585922 - RNA, 19 nt, Homo sapiens
gaaagaggagcaaccuaaa

SEQ ID NO: 585923 - RNA, 19 nt, Homo sapiens
gggcaggccuccuuuguuc

SEQ ID NO: 585924 - RNA, 19 nt, Homo sapiens
gaacaguuaaccaauaaga

SEQ ID NO: 585925 - RNA, 19 nt, Homo sapiens
gcucugugcugucggauug

SEQ ID NO: 585926 - RNA, 19 nt, Homo sapiens
ggagacagagucaacaauu

SEQ ID NO: 585927 - RNA, 19 nt, Homo sapiens
ggaggaggaugaggaagaa

SEQ ID NO: 585928 - RNA, 19 nt, Homo sapiens
caucaagucuguuauagag

SEQ ID NO: 585929 - RNA, 19 nt, Homo sapiens
gcaccaacaaguagaaauu

SEQ ID NO: 585930 - RNA, 19 nt, Homo sapiens
gagaguaugugcuggagau

SEQ ID NO: 585931 - RNA, 19 nt, Homo sapiens
gcaguugcuucgcuauuga

SEQ ID NO: 585932 - RNA, 19 nt, Homo sapiens
gagacagagucaacaauuc

SEQ ID NO: 585933 - RNA, 19 nt, Homo sapiens
acagcaagcucgagaguau

SEQ ID NO: 585934 - RNA, 19 nt, Homo sapiens
aaacugggcuaaugugaca

SEQ ID NO: 585935 - RNA, 19 nt, Homo sapiens
gugaaugucauguuuguaa

SEQ ID NO: 585936 - RNA, 19 nt, Homo sapiens
gaagaagaaaggagacaga

SEQ ID NO: 585937 - RNA, 19 nt, Homo sapiens
gaacaagcuccaaacacuu

SEQ ID NO: 585938 - RNA, 19 nt, Homo sapiens
ucuaucaacugguccaauu

SEQ ID NO: 585939 - RNA, 19 nt, Homo sapiens
guucagaaucacacaaaua

SEQ ID NO: 585940 - RNA, 19 nt, Homo sapiens
gaagaugugcuugcgauga

SEQ ID NO: 585941 - RNA, 19 nt, Homo sapiens
ggaagcaaauaaaguuguc

SEQ ID NO: 585942 - RNA, 19 nt, Homo sapiens
ggacugacaccaucugcaa

SEQ ID NO: 585943 - RNA, 19 nt, Homo sapiens
ugaacaagcuccaaacacu

SEQ ID NO: 585944 - RNA, 19 nt, Homo sapiens
agaaagaaccauaugaaga

SEQ ID NO: 585945 - RNA, 19 nt, Homo sapiens
gagagaaagaaccauauga

SEQ ID NO: 585946 - RNA, 19 nt, Homo sapiens
gaaaggagacagagucaac

SEQ ID NO: 585947 - RNA, 19 nt, Homo sapiens
gacaugcucacuagaaauu

SEQ ID NO: 585948 - RNA, 19 nt, Homo sapiens
gaaauuaugcagaaaugag

SEQ ID NO: 585949 - RNA, 19 nt, Homo sapiens
gaacuacuggucagaagug

SEQ ID NO: 585950 - RNA, 19 nt, Homo sapiens
caacaagaguaaggcaguu

SEQ ID NO: 585951 - RNA, 19 nt, Homo sapiens
gagcaaggcauaagcaaag

SEQ ID NO: 585952 - RNA, 19 nt, Homo sapiens
ucacagaucaggcuaggaa

SEQ ID NO: 585953 - RNA, 19 nt, Homo sapiens
agaaggagaggccaaguaa

SEQ ID NO: 585954 - RNA, 19 nt, Homo sapiens
cagcaccuguucagaauca

SEQ ID NO: 585955 - RNA, 19 nt, Homo sapiens
uccaaacacuugugaaugu

SEQ ID NO: 585956 - RNA, 19 nt, Homo sapiens
gaaaagagaggagagaaaa

SEQ ID NO: 585957 - RNA, 19 nt, Homo sapiens
cggagaaacugggcuaaug

SEQ ID NO: 585958 - RNA, 19 nt, Homo sapiens
gcgaagcgagcaaggcaua

SEQ ID NO: 585959 - RNA, 19 nt, Homo sapiens
ggacgagagugcagaugag

SEQ ID NO: 585960 - RNA, 19 nt, Homo sapiens
gcaaggaggaccacagaca

SEQ ID NO: 585961 - RNA, 19 nt, Homo sapiens
ggagaaacugggcuaaugu

SEQ ID NO: 585962 - RNA, 19 nt, Homo sapiens
gaaccccgcuggcagauga

SEQ ID NO: 585963 - RNA, 19 nt, Homo sapiens
ccaaagggcaagaacaaga

SEQ ID NO: 585964 - RNA, 19 nt, Homo sapiens
auaaauagcuccgaaacca

SEQ ID NO: 585965 - RNA, 19 nt, Homo sapiens
ucagaagugaugaaugaua

SEQ ID NO: 585966 - RNA, 19 nt, Homo sapiens
gccagcaccuguucagaau

SEQ ID NO: 585967 - RNA, 19 nt, Homo sapiens
ugaagauguugcaccauug

SEQ ID NO: 585968 - RNA, 19 nt, Homo sapiens
acagaagacugggagcuuu

SEQ ID NO: 585969 - RNA, 19 nt, Homo sapiens
ggcaguugcuucgcuauug

SEQ ID NO: 585970 - RNA, 19 nt, Homo sapiens
gaacagcaagcucgagagu

SEQ ID NO: 585971 - RNA, 19 nt, Homo sapiens
caccuuugcugcccacuga

SEQ ID NO: 585972 - RNA, 19 nt, Homo sapiens
caaagggcaagaacaagaa

SEQ ID NO: 585973 - RNA, 19 nt, Homo sapiens
agagaaaagucaacaguaa

SEQ ID NO: 585974 - RNA, 19 nt, Homo sapiens
gagaaagaaccauaugaag

SEQ ID NO: 585975 - RNA, 19 nt, Homo sapiens
ccaacacucucagaaacaa

SEQ ID NO: 585976 - RNA, 19 nt, Homo sapiens
uguaagaucccuugcagaa

SEQ ID NO: 585977 - RNA, 19 nt, Homo sapiens
uucaguaggugacguguuu

SEQ ID NO: 585978 - RNA, 19 nt, Homo sapiens
cauggaagcaaauaaaguu

SEQ ID NO: 585979 - RNA, 19 nt, Homo sapiens
gaagugaugaaugauaaga

SEQ ID NO: 585980 - RNA, 19 nt, Homo sapiens
gguauucaaugcaucucuu

SEQ ID NO: 585981 - RNA, 19 nt, Homo sapiens
gaagaggaucgacgccuau

SEQ ID NO: 585982 - RNA, 19 nt, Homo sapiens
gcagcaccauaaagaagga

SEQ ID NO: 585983 - RNA, 19 nt, Homo sapiens
gaaggagaggccaaguaaa

SEQ ID NO: 585984 - RNA, 19 nt, Homo sapiens
gacaccaucugcaaugaca

SEQ ID NO: 585985 - RNA, 19 nt, Homo sapiens
gcgugagacuccuucgauu

SEQ ID NO: 585986 - RNA, 19 nt, Homo sapiens
gagcuggugcugccugaaa

SEQ ID NO: 585987 - RNA, 19 nt, Homo sapiens
agagaaagaaccauaugaa

SEQ ID NO: 585988 - RNA, 19 nt, Homo sapiens
gggaggaggaggaggauga

SEQ ID NO: 585989 - RNA, 19 nt, Homo sapiens
ccaccuccaucuagcaaug

SEQ ID NO: 585990 - RNA, 19 nt, Homo sapiens
caucagguauucaaugcau

SEQ ID NO: 585991 - RNA, 19 nt, Homo sapiens
agaagcugaugaugaagaa

SEQ ID NO: 585992 - RNA, 19 nt, Homo sapiens
cagcaguaguuccucagaa

SEQ ID NO: 585993 - RNA, 19 nt, Homo sapiens
gcaaacugaagaaccagaa

SEQ ID NO: 585994 - RNA, 19 nt, Homo sapiens
aagaagaggaggaucguuu

SEQ ID NO: 585995 - RNA, 19 nt, Homo sapiens
caccaacaaguagaaauua

SEQ ID NO: 585996 - RNA, 19 nt, Homo sapiens
ggccaacacucucagaaac

SEQ ID NO: 585997 - RNA, 19 nt, Homo sapiens
gaagauguugcaccauugu

SEQ ID NO: 585998 - RNA, 19 nt, Homo sapiens
gacaguggcucggcaccaa

SEQ ID NO: 585999 - RNA, 19 nt, Homo sapiens
caccucaccuugcaaaucu

SEQ ID NO: 586000 - RNA, 19 nt, Homo sapiens
ugaaugauaagaacuggaa

SEQ ID NO: 586001 - RNA, 19 nt, Homo sapiens
acauggcccugaaggauga

SEQ ID NO: 586002 - RNA, 19 nt, Homo sapiens
uaacugggauugugaauuu

SEQ ID NO: 586003 - RNA, 19 nt, Homo sapiens
gcaaguagcuggagagauc

SEQ ID NO: 586004 - RNA, 19 nt, Homo sapiens
gagcagcccuguaauguau

SEQ ID NO: 586005 - RNA, 19 nt, Homo sapiens
guuucaagcuuuagucuua

SEQ ID NO: 586006 - RNA, 19 nt, Homo sapiens
ggacaaauuuaccagaaga

SEQ ID NO: 586007 - RNA, 19 nt, Homo sapiens
ggaccaggcuaaugacuug

SEQ ID NO: 586008 - RNA, 19 nt, Homo sapiens
gaagauucgucugcaagua

SEQ ID NO: 586009 - RNA, 19 nt, Homo sapiens
cauaguggcuuuccaguug

SEQ ID NO: 586010 - RNA, 19 nt, Homo sapiens
ggucugauaccacaacuua

SEQ ID NO: 586011 - RNA, 19 nt, Homo sapiens
gaucuccuaucaagaguuu

SEQ ID NO: 586012 - RNA, 19 nt, Homo sapiens
gaauuuauccgacugcauu

SEQ ID NO: 586013 - RNA, 19 nt, Homo sapiens
ucacaucgguggauacaga

SEQ ID NO: 586014 - RNA, 19 nt, Homo sapiens
acauggagcuuguucguaa

SEQ ID NO: 586015 - RNA, 19 nt, Homo sapiens
ggauaugauuccagucaaa

SEQ ID NO: 586016 - RNA, 19 nt, Homo sapiens
caucauuacuggcuuaguu

SEQ ID NO: 586017 - RNA, 19 nt, Homo sapiens
gaaagauguugaagucaca

SEQ ID NO: 586018 - RNA, 19 nt, Homo sapiens
gccauuaaacugacuguua

SEQ ID NO: 586019 - RNA, 19 nt, Homo sapiens
agggacaucuccaucauua

SEQ ID NO: 586020 - RNA, 19 nt, Homo sapiens
gacugcagcucgaguguuu

SEQ ID NO: 586021 - RNA, 19 nt, Homo sapiens
gcugauguguuuccauuug

SEQ ID NO: 586022 - RNA, 19 nt, Homo sapiens
caucuuaacuacacagaau

SEQ ID NO: 586023 - RNA, 19 nt, Homo sapiens
gccuuuaucucccgaaauu

SEQ ID NO: 586024 - RNA, 19 nt, Homo sapiens
ucacaccacuagaaauuga

SEQ ID NO: 586025 - RNA, 19 nt, Homo sapiens
ggagcuuguucguaagaua

SEQ ID NO: 586026 - RNA, 19 nt, Homo sapiens
cugaguggcuugaaaugua

SEQ ID NO: 586027 - RNA, 19 nt, Homo sapiens
gcuuuagucuuauguguug

SEQ ID NO: 586028 - RNA, 19 nt, Homo sapiens
gaaaacaaauuuggccuuu

SEQ ID NO: 586029 - RNA, 19 nt, Homo sapiens
gacagacuauuauucauca

SEQ ID NO: 586030 - RNA, 19 nt, Homo sapiens
uauaucagcuugcagacuu

SEQ ID NO: 586031 - RNA, 19 nt, Homo sapiens
caauuucccuucauaugga

SEQ ID NO: 586032 - RNA, 19 nt, Homo sapiens
gacauucccuucucugcaa

SEQ ID NO: 586033 - RNA, 19 nt, Homo sapiens
ggacaagucacaccacuag

SEQ ID NO: 586034 - RNA, 19 nt, Homo sapiens
cauuagaucucacaugcuu

SEQ ID NO: 586035 - RNA, 19 nt, Homo sapiens
ggauuucagugacaucaug

SEQ ID NO: 586036 - RNA, 19 nt, Homo sapiens
gcaauuggaacaugcaaga

SEQ ID NO: 586037 - RNA, 19 nt, Homo sapiens
gugcugauguguuuccauu

SEQ ID NO: 586038 - RNA, 19 nt, Homo sapiens
ugaauaacauggagcuugu

SEQ ID NO: 586039 - RNA, 19 nt, Homo sapiens
acacagaauucacgcaguu

SEQ ID NO: 586040 - RNA, 19 nt, Homo sapiens
gucaaacucuucuuucugu

SEQ ID NO: 586041 - RNA, 19 nt, Homo sapiens
ggaagauucuccgggaaga

SEQ ID NO: 586042 - RNA, 19 nt, Homo sapiens
gaaaaggccauuaaacuga

SEQ ID NO: 586043 - RNA, 19 nt, Homo sapiens
gcacaaggaaagauguuga

SEQ ID NO: 586044 - RNA, 19 nt, Homo sapiens
ugacaagaguggaaaugga

SEQ ID NO: 586045 - RNA, 19 nt, Homo sapiens
gugaagacccgaaugcaaa

SEQ ID NO: 586046 - RNA, 19 nt, Homo sapiens
ggagaggugacauuugaaa

SEQ ID NO: 586047 - RNA, 19 nt, Homo sapiens
caacgcuguuucaagcuuu

SEQ ID NO: 586048 - RNA, 19 nt, Homo sapiens
ggagagcagcccuguaaug

SEQ ID NO: 586049 - RNA, 19 nt, Homo sapiens
uaggagagcagcccuguaa

SEQ ID NO: 586050 - RNA, 19 nt, Homo sapiens
aaauuuaagucuccuagug

SEQ ID NO: 586051 - RNA, 19 nt, Homo sapiens
uggcagaacuucagagaca

SEQ ID NO: 586052 - RNA, 19 nt, Homo sapiens
acagcagucuccuggguua

SEQ ID NO: 586053 - RNA, 19 nt, Homo sapiens
uggcagauauugagagaau

SEQ ID NO: 586054 - RNA, 19 nt, Homo sapiens
ggaggaauuugcccagagu

SEQ ID NO: 586055 - RNA, 19 nt, Homo sapiens
aaggaaagauguugaaguc

SEQ ID NO: 586056 - RNA, 19 nt, Homo sapiens
gauggagagcguuauauga

SEQ ID NO: 586057 - RNA, 19 nt, Homo sapiens
ggacagacuauuauucauc

SEQ ID NO: 586058 - RNA, 19 nt, Homo sapiens
cagaggaccaggcuaauga

SEQ ID NO: 586059 - RNA, 19 nt, Homo sapiens
agucuuauguguugaaaug

SEQ ID NO: 586060 - RNA, 19 nt, Homo sapiens
acaccuaagucacgcauug

SEQ ID NO: 586061 - RNA, 19 nt, Homo sapiens
ccucaugaguuaagaaaca

SEQ ID NO: 586062 - RNA, 19 nt, Homo sapiens
ucugauaccacaacuuaua

SEQ ID NO: 586063 - RNA, 19 nt, Homo sapiens
ucaaugcauuuaacucguu

SEQ ID NO: 586064 - RNA, 19 nt, Homo sapiens
ccaaauaguaacccaaaga

SEQ ID NO: 586065 - RNA, 19 nt, Homo sapiens
gagagcagcccuguaaugu

SEQ ID NO: 586066 - RNA, 19 nt, Homo sapiens
ugugugugcugauguguuu

SEQ ID NO: 586067 - RNA, 19 nt, Homo sapiens
gaagggcccucagcauuuu

SEQ ID NO: 586068 - RNA, 19 nt, Homo sapiens
caagucacaccacuagaaa

SEQ ID NO: 586069 - RNA, 19 nt, Homo sapiens
agacaagccuuugcacuca

SEQ ID NO: 586070 - RNA, 19 nt, Homo sapiens
gagcugcaauuggaacaug

SEQ ID NO: 586071 - RNA, 19 nt, Homo sapiens
gaagaagggcccucagcau

SEQ ID NO: 586072 - RNA, 19 nt, Homo sapiens
ucaaggugcagacaacuaa

SEQ ID NO: 586073 - RNA, 19 nt, Homo sapiens
uuaccuuggucacuuauga

SEQ ID NO: 586074 - RNA, 19 nt, Homo sapiens
gguguuaccuuggucacuu

SEQ ID NO: 586075 - RNA, 19 nt, Homo sapiens
agaagggcccucagcauuu

SEQ ID NO: 586076 - RNA, 19 nt, Homo sapiens
ucagggcgcuugacuuugg

SEQ ID NO: 586077 - RNA, 19 nt, Homo sapiens
ggacaucuccaucauuacu

SEQ ID NO: 586078 - RNA, 19 nt, Homo sapiens
uaucuuggacuguauaaug

SEQ ID NO: 586079 - RNA, 19 nt, Homo sapiens
gcgcuggccagacgacaua

SEQ ID NO: 586080 - RNA, 19 nt, Homo sapiens
cgugggagguuuaaaucuu

SEQ ID NO: 586081 - RNA, 19 nt, Homo sapiens
ggcaugaauuaguguucua

SEQ ID NO: 586082 - RNA, 19 nt, Homo sapiens
auggagaggugacauuuga

SEQ ID NO: 586083 - RNA, 19 nt, Homo sapiens
gaaauguaaugcgguucug

SEQ ID NO: 586084 - RNA, 19 nt, Homo sapiens
aaacucuucuuucuguaug

SEQ ID NO: 586085 - RNA, 19 nt, Homo sapiens
guguuaccuuggucacuua

SEQ ID NO: 586086 - RNA, 19 nt, Homo sapiens
cgggacaaauuuaccagaa

SEQ ID NO: 586087 - RNA, 19 nt, Homo sapiens
cuauagaucuggugaagac

SEQ ID NO: 586088 - RNA, 19 nt, Homo sapiens
gagcuuguucguaagauau

SEQ ID NO: 586089 - RNA, 19 nt, Homo sapiens
cagguuagcuucuccuacu

SEQ ID NO: 586090 - RNA, 19 nt, Homo sapiens
ugauguguuuccauuugua

SEQ ID NO: 586091 - RNA, 19 nt, Homo sapiens
cuuuaucucccgaaauuua

SEQ ID NO: 586092 - RNA, 19 nt, Homo sapiens
caaauaguaacccaaagau

SEQ ID NO: 586093 - RNA, 19 nt, Homo sapiens
gcagacuuauauaaugcuu

SEQ ID NO: 586094 - RNA, 19 nt, Homo sapiens
cagauuccauguucauagu

SEQ ID NO: 586095 - RNA, 19 nt, Homo sapiens
gugcugcuaccacugaaua

SEQ ID NO: 586096 - RNA, 19 nt, Homo sapiens
uguagacccuccucuguuc

SEQ ID NO: 586097 - RNA, 19 nt, Homo sapiens
cuugaaauguacagaaugu

SEQ ID NO: 586098 - RNA, 19 nt, Homo sapiens
ucaaacucuucuuucugua

SEQ ID NO: 586099 - RNA, 19 nt, Homo sapiens
aagaagggcccucagcauu

SEQ ID NO: 586100 - RNA, 19 nt, Homo sapiens
cauuggagauagugaagau

SEQ ID NO: 586101 - RNA, 19 nt, Homo sapiens
aaaggcauaacgagacaua

SEQ ID NO: 586102 - RNA, 19 nt, Homo sapiens
gagaagggcuguugcuaau

SEQ ID NO: 586103 - RNA, 19 nt, Homo sapiens
gaagauccuuagagaguug

SEQ ID NO: 586104 - RNA, 19 nt, Homo sapiens
agaagaagauccuuagaga

SEQ ID NO: 586105 - RNA, 19 nt, Homo sapiens
ugacugagaugcucgagaa

SEQ ID NO: 586106 - RNA, 19 nt, Homo sapiens
ugaagaagcuaaggauuga

SEQ ID NO: 586107 - RNA, 19 nt, Homo sapiens
uaaggaaucugacccugaa

SEQ ID NO: 586108 - RNA, 19 nt, Homo sapiens
uacaacaagugcucaauaa

SEQ ID NO: 586109 - RNA, 19 nt, Homo sapiens
ggagaagggcuguugcuaa

SEQ ID NO: 586110 - RNA, 19 nt, Homo sapiens
aauaaaugcuugcugauug

SEQ ID NO: 586111 - RNA, 19 nt, Homo sapiens
caaguuagcucuguagaag

SEQ ID NO: 586112 - RNA, 19 nt, Homo sapiens
ggcaauaucuucucucuac

SEQ ID NO: 586113 - RNA, 19 nt, Homo sapiens
caacaagugcucaauaaau

SEQ ID NO: 586114 - RNA, 19 nt, Homo sapiens
ucaguaacuugauggauuu

SEQ ID NO: 586115 - RNA, 19 nt, Homo sapiens
aggaaaggcucacucagua

SEQ ID NO: 586116 - RNA, 19 nt, Homo sapiens
gcucugaaguuuccauaau

SEQ ID NO: 586117 - RNA, 19 nt, Homo sapiens
gaaaggaaaggcucacuca

SEQ ID NO: 586118 - RNA, 19 nt, Homo sapiens
gaagaagcccguggaagaa

SEQ ID NO: 586119 - RNA, 19 nt, Homo sapiens
gcagcgaggucugagaauu

SEQ ID NO: 586120 - RNA, 19 nt, Homo sapiens
gaccugaaacaucgauuua

SEQ ID NO: 586121 - RNA, 19 nt, Homo sapiens
gacacuacccuacccaaua

SEQ ID NO: 586122 - RNA, 19 nt, Homo sapiens
gcugaaagcucugaagaag

SEQ ID NO: 586123 - RNA, 19 nt, Homo sapiens
gaagggcuguugcuaaugc

SEQ ID NO: 586124 - RNA, 19 nt, Homo sapiens
ugaagaagcccguggaaga

SEQ ID NO: 586125 - RNA, 19 nt, Homo sapiens
ugagugagaugaaagaaca

SEQ ID NO: 586126 - RNA, 19 nt, Homo sapiens
gaacuugggcuuaaaucau

SEQ ID NO: 586127 - RNA, 19 nt, Homo sapiens
cagcgaggucugagaauua

SEQ ID NO: 586128 - RNA, 19 nt, Homo sapiens
acacuacccuacccaauau

SEQ ID NO: 586129 - RNA, 19 nt, Homo sapiens
cagaaugaaugugauaguu

SEQ ID NO: 586130 - RNA, 19 nt, Homo sapiens
ggaaaggcucacucaguaa

SEQ ID NO: 586131 - RNA, 19 nt, Homo sapiens
ucucgaggcugaccugaaa

SEQ ID NO: 586132 - RNA, 19 nt, Homo sapiens
aacaagugcucaauaaaug

SEQ ID NO: 586133 - RNA, 19 nt, Homo sapiens
caguagcucugcacaaguu

SEQ ID NO: 586134 - RNA, 19 nt, Homo sapiens
ccugguggaugcugguuua

SEQ ID NO: 586135 - RNA, 19 nt, Homo sapiens
gcuaagagccuacagaaaa

SEQ ID NO: 586136 - RNA, 19 nt, Homo sapiens
aaguggagcucugagaaua

SEQ ID NO: 586137 - RNA, 19 nt, Homo sapiens
caccuuggcuguccuaaca

SEQ ID NO: 586138 - RNA, 19 nt, Homo sapiens
gaagacuggucagaacuca

SEQ ID NO: 586139 - RNA, 19 nt, Homo sapiens
ggacugcgggcucacauug

SEQ ID NO: 586140 - RNA, 19 nt, Homo sapiens
uaucuucucucuacaccaa

SEQ ID NO: 586141 - RNA, 19 nt, Homo sapiens
aguuagcucuguagaagua

SEQ ID NO: 586142 - RNA, 19 nt, Homo sapiens
gcugacaccuacacucuag

SEQ ID NO: 586143 - RNA, 19 nt, Homo sapiens
uuacugaggcugcaagaaa

SEQ ID NO: 586144 - RNA, 19 nt, Homo sapiens
auaaaugcuugcugauuga

SEQ ID NO: 586145 - RNA, 19 nt, Homo sapiens
gugaccagcuagacuguga

SEQ ID NO: 586146 - RNA, 19 nt, Homo sapiens
gagucucauuuguccaaua

SEQ ID NO: 586147 - RNA, 19 nt, Homo sapiens
caaugauggugacauggaa

SEQ ID NO: 586148 - RNA, 19 nt, Homo sapiens
caauaaaugcuugcugauu

SEQ ID NO: 586149 - RNA, 19 nt, Homo sapiens
gaaguugcugcuuggcaua

SEQ ID NO: 586150 - RNA, 19 nt, Homo sapiens
gaaggauagugcccgaagu

SEQ ID NO: 586151 - RNA, 19 nt, Homo sapiens
aggcugagcuggauuugug

SEQ ID NO: 586152 - RNA, 19 nt, Homo sapiens
agaccugacuuuccugaga

SEQ ID NO: 586153 - RNA, 19 nt, Homo sapiens
gaacugccggagucucauu

SEQ ID NO: 586154 - RNA, 19 nt, Homo sapiens
ccuacaugguuaucucuaa

SEQ ID NO: 586155 - RNA, 19 nt, Homo sapiens
cucaguaacuugauggauu

SEQ ID NO: 586156 - RNA, 19 nt, Homo sapiens
ugguaacacugaagucauu

SEQ ID NO: 586157 - RNA, 19 nt, Homo sapiens
gaagugcucuugguaacac

SEQ ID NO: 586158 - RNA, 19 nt, Homo sapiens
ugacuuuccugagagguuu

SEQ ID NO: 586159 - RNA, 19 nt, Homo sapiens
gacaaugaccugcaaccuu

SEQ ID NO: 586160 - RNA, 19 nt, Homo sapiens
gagugggacuuggcuaaga

SEQ ID NO: 586161 - RNA, 19 nt, Homo sapiens
gccaguagcucugcacaag

SEQ ID NO: 586162 - RNA, 19 nt, Homo sapiens
ccagauggccagaaugaau

SEQ ID NO: 586163 - RNA, 19 nt, Homo sapiens
cugaaagguuuauggagaa

SEQ ID NO: 586164 - RNA, 19 nt, Homo sapiens
gggaagugcucuugguaac

SEQ ID NO: 586165 - RNA, 19 nt, Homo sapiens
ugacacauacgacacauuc

SEQ ID NO: 586166 - RNA, 19 nt, Homo sapiens
ucaccacgcuggcuucucu

SEQ ID NO: 586167 - RNA, 19 nt, Homo sapiens
gcaauaucuucucucuaca

SEQ ID NO: 586168 - RNA, 19 nt, Homo sapiens
gccuuccacugcuccuuua

SEQ ID NO: 586169 - RNA, 19 nt, Homo sapiens
caccuacacucuagaugug

SEQ ID NO: 586170 - RNA, 19 nt, Homo sapiens
cgacuucagugccggagau

SEQ ID NO: 586171 - RNA, 19 nt, Homo sapiens
acaccuggcugacugagau

SEQ ID NO: 586172 - RNA, 19 nt, Homo sapiens
cccaauauuugcagccauu

SEQ ID NO: 586173 - RNA, 19 nt, Homo sapiens
auacaacaagugcucaaua

SEQ ID NO: 586174 - RNA, 19 nt, Homo sapiens
gcacaaguuagcucuguag

SEQ ID NO: 586175 - RNA, 19 nt, Homo sapiens
aagaagauccuuagagagu

SEQ ID NO: 586176 - RNA, 19 nt, Homo sapiens
gauagcgucauucagaaga

SEQ ID NO: 586177 - RNA, 19 nt, Homo sapiens
ccaccuggccuuccuguuc

SEQ ID NO: 586178 - RNA, 19 nt, Homo sapiens
gaaaggcucacucaguaac

SEQ ID NO: 586179 - RNA, 19 nt, Homo sapiens
aaucugacccugaaagguu

SEQ ID NO: 586180 - RNA, 19 nt, Homo sapiens
ggagauuccggcugaagga

SEQ ID NO: 586181 - RNA, 19 nt, Homo sapiens
augggaagcucugaaguuu

SEQ ID NO: 586182 - RNA, 19 nt, Homo sapiens
ggaggaccacagaagcuuu

SEQ ID NO: 586183 - RNA, 19 nt, Homo sapiens
gcucugagaauacaacaag

SEQ ID NO: 586184 - RNA, 19 nt, Homo sapiens
cuuuaugacugcacuucua

SEQ ID NO: 586185 - RNA, 19 nt, Homo sapiens
uuagagaguugaugaacgu

SEQ ID NO: 586186 - RNA, 19 nt, Homo sapiens
ucugaaguuuccauaauuc

SEQ ID NO: 586187 - RNA, 19 nt, Homo sapiens
gaagggaagacuggucaga

SEQ ID NO: 586188 - RNA, 19 nt, Homo sapiens
augguuaucucuaagcaaa

SEQ ID NO: 586189 - RNA, 19 nt, Homo sapiens
ccaaguggagcucugagaa

SEQ ID NO: 586190 - RNA, 19 nt, Homo sapiens
agaagaggcugagcuggau

SEQ ID NO: 586191 - RNA, 19 nt, Homo sapiens
acaacuuccuguacaaaca

SEQ ID NO: 586192 - RNA, 19 nt, Homo sapiens
cugaagaagcuaaggauug

SEQ ID NO: 586193 - RNA, 19 nt, Homo sapiens
gucauuagggaauacauuu

SEQ ID NO: 586194 - RNA, 19 nt, Homo sapiens
gguccugagugagaugaaa

SEQ ID NO: 586195 - RNA, 19 nt, Homo sapiens
ggacacuacccuacccaau

SEQ ID NO: 586196 - RNA, 19 nt, Homo sapiens
ccacuugggcaauaucuuc

SEQ ID NO: 586197 - RNA, 19 nt, Homo sapiens
gaauacaacaagugcucaa

SEQ ID NO: 586198 - RNA, 19 nt, Homo sapiens
ggccagaaugaaugugaua

SEQ ID NO: 586199 - RNA, 19 nt, Homo sapiens
uccuggagcuggagcauga

SEQ ID NO: 586200 - RNA, 19 nt, Homo sapiens
gugcuacucuuggcauuag

SEQ ID NO: 586201 - RNA, 19 nt, Homo sapiens
caugggaagcucugaaguu

SEQ ID NO: 586202 - RNA, 19 nt, Homo sapiens
gaagagaucagugaacuuu

SEQ ID NO: 586203 - RNA, 19 nt, Homo sapiens
caagauauccuguccauga

SEQ ID NO: 586204 - RNA, 19 nt, Homo sapiens
agaaagaaaucauccaaga

SEQ ID NO: 586205 - RNA, 19 nt, Homo sapiens
gcagaaagagcgaguagaa

SEQ ID NO: 586206 - RNA, 19 nt, Homo sapiens
gaaagagcaugucgaagag

SEQ ID NO: 586207 - RNA, 19 nt, Homo sapiens
caacugagaucaagaagac

SEQ ID NO: 586208 - RNA, 19 nt, Homo sapiens
uuaauaagguggugaacaa

SEQ ID NO: 586209 - RNA, 19 nt, Homo sapiens
ccacagaauucgaccuuga

SEQ ID NO: 586210 - RNA, 19 nt, Homo sapiens
caaaggaaccaaacaguug

SEQ ID NO: 586211 - RNA, 19 nt, Homo sapiens
gaauaaaggagaccaagga

SEQ ID NO: 586212 - RNA, 19 nt, Homo sapiens
caaggaaguuuaugaaggu

SEQ ID NO: 586213 - RNA, 19 nt, Homo sapiens
agacagaaaucacagacaa

SEQ ID NO: 586214 - RNA, 19 nt, Homo sapiens
agacagaggugcugaugga

SEQ ID NO: 586215 - RNA, 19 nt, Homo sapiens
ggaaguuuaugaaggugaa

SEQ ID NO: 586216 - RNA, 19 nt, Homo sapiens
agaaagagcaugucgaaga

SEQ ID NO: 586217 - RNA, 19 nt, Homo sapiens
gaaagaaaucauccaagau

SEQ ID NO: 586218 - RNA, 19 nt, Homo sapiens
ccuugaagcugaagaguau

SEQ ID NO: 586219 - RNA, 19 nt, Homo sapiens
ucagugaacuuuucuauga

SEQ ID NO: 586220 - RNA, 19 nt, Homo sapiens
ggaaggacagcauugagaa

SEQ ID NO: 586221 - RNA, 19 nt, Homo sapiens
gaugugaccuugcaugacu

SEQ ID NO: 586222 - RNA, 19 nt, Homo sapiens
gugaagagcacuacgaaga

SEQ ID NO: 586223 - RNA, 19 nt, Homo sapiens
gaaggacagcauugagaaa

SEQ ID NO: 586224 - RNA, 19 nt, Homo sapiens
gcacugaggacaucacauc

SEQ ID NO: 586225 - RNA, 19 nt, Homo sapiens
auaagguggugaacaagua

SEQ ID NO: 586226 - RNA, 19 nt, Homo sapiens
cagaggugcugauggagaa

SEQ ID NO: 586227 - RNA, 19 nt, Homo sapiens
uaaaggagaccaaggaagu

SEQ ID NO: 586228 - RNA, 19 nt, Homo sapiens
ccauugggcugcgaauaaa

SEQ ID NO: 586229 - RNA, 19 nt, Homo sapiens
gccauugggcugcgaauaa

SEQ ID NO: 586230 - RNA, 19 nt, Homo sapiens
agaggcauguggcgucaua

SEQ ID NO: 586231 - RNA, 19 nt, Homo sapiens
gaaagaacccuuccuuacc

SEQ ID NO: 586232 - RNA, 19 nt, Homo sapiens
gaaaucacagacaaacuuc

SEQ ID NO: 586233 - RNA, 19 nt, Homo sapiens
aguagaagcuggagaugug

SEQ ID NO: 586234 - RNA, 19 nt, Homo sapiens
ccaaaggaaccaaacaguu

SEQ ID NO: 586235 - RNA, 19 nt, Homo sapiens
uuccuuaccugguguguuu

SEQ ID NO: 586236 - RNA, 19 nt, Homo sapiens
ggacagcauugagaaagag

SEQ ID NO: 586237 - RNA, 19 nt, Homo sapiens
gaccaaggaaguuuaugaa

SEQ ID NO: 586238 - RNA, 19 nt, Homo sapiens
ugaaagaacccuuccuuac

SEQ ID NO: 586239 - RNA, 19 nt, Homo sapiens
ugagaaagagcaugucgaa

SEQ ID NO: 586240 - RNA, 19 nt, Homo sapiens
cauuagccaugugaucaua

SEQ ID NO: 586241 - RNA, 19 nt, Homo sapiens
cggcaucccucuugaccuu

SEQ ID NO: 586242 - RNA, 19 nt, Homo sapiens
gaagacagaggugcugaug

SEQ ID NO: 586243 - RNA, 19 nt, Homo sapiens
cucaggagcuggguaguaa

SEQ ID NO: 586244 - RNA, 19 nt, Homo sapiens
ccaaagaagacagaaauca

SEQ ID NO: 586245 - RNA, 19 nt, Homo sapiens
cuaaugaagccaaagaaga

SEQ ID NO: 586246 - RNA, 19 nt, Homo sapiens
caggauaaguacaugaagu

SEQ ID NO: 586247 - RNA, 19 nt, Homo sapiens
gggaaggacagcauugaga

SEQ ID NO: 586248 - RNA, 19 nt, Homo sapiens
cacaggaaaugaaacagau

SEQ ID NO: 586249 - RNA, 19 nt, Homo sapiens
agaaaucacagacaaacuu

SEQ ID NO: 586250 - RNA, 19 nt, Homo sapiens
cugcagcgcugucaguuca

SEQ ID NO: 586251 - RNA, 19 nt, Homo sapiens
cgaggcaacugugucauca

SEQ ID NO: 586252 - RNA, 19 nt, Homo sapiens
guacaucgaccagggcauu

SEQ ID NO: 586253 - RNA, 19 nt, Homo sapiens
gaccuugcaugacuuggau

SEQ ID NO: 586254 - RNA, 19 nt, Homo sapiens
gagcuaacuccgugugaga

SEQ ID NO: 586255 - RNA, 19 nt, Homo sapiens
gcauguggcgucauaguag

SEQ ID NO: 586256 - RNA, 19 nt, Homo sapiens
ccacaggaaaugaaacaga

SEQ ID NO: 586257 - RNA, 19 nt, Homo sapiens
aaagaacccuuccuuaccu

SEQ ID NO: 586258 - RNA, 19 nt, Homo sapiens
ggagaccaaggaaguuuau

SEQ ID NO: 586259 - RNA, 19 nt, Homo sapiens
ggaaggaaucaacaucagu

SEQ ID NO: 586260 - RNA, 19 nt, Homo sapiens
cgggugugcuguuuguuga

SEQ ID NO: 586261 - RNA, 19 nt, Homo sapiens
gacagaaaucacagacaaa

SEQ ID NO: 586262 - RNA, 19 nt, Homo sapiens
ugacuuggauguggcuaau

SEQ ID NO: 586263 - RNA, 19 nt, Homo sapiens
aggcagggcaggugugaua

SEQ ID NO: 586264 - RNA, 19 nt, Homo sapiens
cgucauaguagaauuaauc

SEQ ID NO: 586265 - RNA, 19 nt, Homo sapiens
ccaagaccacacugaggua

SEQ ID NO: 586266 - RNA, 19 nt, Homo sapiens
gaggggagauuaauaaggu

SEQ ID NO: 586267 - RNA, 19 nt, Homo sapiens
aaagaagacagaaaucaca

SEQ ID NO: 586268 - RNA, 19 nt, Homo sapiens
ggcauguggcgucauagua

SEQ ID NO: 586269 - RNA, 19 nt, Homo sapiens
guccguagcugcugguuuu

SEQ ID NO: 586270 - RNA, 19 nt, Homo sapiens
gaagcuggagaugugauuu

SEQ ID NO: 586271 - RNA, 19 nt, Homo sapiens
uugaaaguuugcagaaaga

SEQ ID NO: 586272 - RNA, 19 nt, Homo sapiens
gcaaaaccauuagccaugu

SEQ ID NO: 586273 - RNA, 19 nt, Homo sapiens
gcauugagaaagagcaugu

SEQ ID NO: 586274 - RNA, 19 nt, Homo sapiens
caacgggaaggacagcauu

SEQ ID NO: 586275 - RNA, 19 nt, Homo sapiens
cggccaacuugcuugcuaa

SEQ ID NO: 586276 - RNA, 19 nt, Homo sapiens
aggcaacugugucaucaga

SEQ ID NO: 586277 - RNA, 19 nt, Homo sapiens
aagcuggagaugugauuua

SEQ ID NO: 586278 - RNA, 19 nt, Homo sapiens
gaucauaggacucaaaaca

SEQ ID NO: 586279 - RNA, 19 nt, Homo sapiens
agaccaaggaaguuuauga

SEQ ID NO: 586280 - RNA, 19 nt, Homo sapiens
uugaaagaacccuuccuua

SEQ ID NO: 586281 - RNA, 19 nt, Homo sapiens
ugauaccuaugccacagaa

SEQ ID NO: 586282 - RNA, 19 nt, Homo sapiens
aaaggaaccaaacaguuga

SEQ ID NO: 586283 - RNA, 19 nt, Homo sapiens
ggauaaguacaugaaguga

SEQ ID NO: 586284 - RNA, 19 nt, Homo sapiens
cauguggcgucauaguaga

SEQ ID NO: 586285 - RNA, 19 nt, Homo sapiens
ccaacuugcuugcuaaaau

SEQ ID NO: 586286 - RNA, 19 nt, Homo sapiens
ggucccgggugugcuguuu

SEQ ID NO: 586287 - RNA, 19 nt, Homo sapiens
gaaagagcgaguagaagcu

SEQ ID NO: 586288 - RNA, 19 nt, Homo sapiens
ggugugcuguuuguugaug

SEQ ID NO: 586289 - RNA, 19 nt, Homo sapiens
gcgaguagaagcuggagau

SEQ ID NO: 586290 - RNA, 19 nt, Homo sapiens
caacuugcuugcuaaaauc

SEQ ID NO: 586291 - RNA, 19 nt, Homo sapiens
cagaggcacugaggacauc

SEQ ID NO: 586292 - RNA, 19 nt, Homo sapiens
uggcgucauaguagaauua

SEQ ID NO: 586293 - RNA, 19 nt, Homo sapiens
caugggaggauauggcaaa

SEQ ID NO: 586294 - RNA, 19 nt, Homo sapiens
gaacuuccgcagggccauu

SEQ ID NO: 586295 - RNA, 19 nt, Homo sapiens
ccggccaacuugcuugcua

SEQ ID NO: 586296 - RNA, 19 nt, Homo sapiens
caaagaagacagaaaucac

SEQ ID NO: 586297 - RNA, 19 nt, Homo sapiens
uaaugaagccaaagaagac

SEQ ID NO: 586298 - RNA, 19 nt, Homo sapiens
uuugaaaguuugcagaaag

SEQ ID NO: 586299 - RNA, 19 nt, Homo sapiens
ucgaagagaucagugaacu

SEQ ID NO: 586300 - RNA, 19 nt, Homo sapiens
gagcaugucgaagagauca

SEQ ID NO: 586301 - RNA, 19 nt, Homo sapiens
cagcuaaugaagccaaaga

SEQ ID NO: 586302 - RNA, 19 nt, Homo sapiens
gaaaucagcugaacaaaug

SEQ ID NO: 586303 - RNA, 19 nt, Homo sapiens
gcaaaggugugcaugagua

SEQ ID NO: 586304 - RNA, 19 nt, Homo sapiens
gaaauggccuggaggaugu

SEQ ID NO: 586305 - RNA, 19 nt, Homo sapiens
gaaccuggcuauuucaaga

SEQ ID NO: 586306 - RNA, 19 nt, Homo sapiens
gaccggagcuguuccuauu

SEQ ID NO: 586307 - RNA, 19 nt, Homo sapiens
gaagguggcuaugauugaa

SEQ ID NO: 586308 - RNA, 19 nt, Homo sapiens
gaaguuuguugcagacuau

SEQ ID NO: 586309 - RNA, 19 nt, Homo sapiens
gaggugguguccuaaguaa

SEQ ID NO: 586310 - RNA, 19 nt, Homo sapiens
gauugaaccuggcuauuuc

SEQ ID NO: 586311 - RNA, 19 nt, Homo sapiens
caaucccacuccuucauua

SEQ ID NO: 586312 - RNA, 19 nt, Homo sapiens
caauaaggccuuucuaugu

SEQ ID NO: 586313 - RNA, 19 nt, Homo sapiens
ggaaacugcuggccagaca

SEQ ID NO: 586314 - RNA, 19 nt, Homo sapiens
gaggacaaauaaaucaguu

SEQ ID NO: 586315 - RNA, 19 nt, Homo sapiens
aauaaggccuuucuauguu

SEQ ID NO: 586316 - RNA, 19 nt, Homo sapiens
gcugggaggugguguccua

SEQ ID NO: 586317 - RNA, 19 nt, Homo sapiens
uaagaaaucagcugaacaa

SEQ ID NO: 586318 - RNA, 19 nt, Homo sapiens
uaucggagcuuuguagaga

SEQ ID NO: 586319 - RNA, 19 nt, Homo sapiens
ggaccgagagugcuuggua

SEQ ID NO: 586320 - RNA, 19 nt, Homo sapiens
gcacagcccaguaggaaga

SEQ ID NO: 586321 - RNA, 19 nt, Homo sapiens
auaaggccuuucuauguua

SEQ ID NO: 586322 - RNA, 19 nt, Homo sapiens
gcagaggacaaauaaauca

SEQ ID NO: 586323 - RNA, 19 nt, Homo sapiens
gaacaaauggagcagaagu

SEQ ID NO: 586324 - RNA, 19 nt, Homo sapiens
aaacagggaccaaauagug

SEQ ID NO: 586325 - RNA, 19 nt, Homo sapiens
ccaauaaggccuuucuaug

SEQ ID NO: 586326 - RNA, 19 nt, Homo sapiens
ucagaggagugauugauuc

SEQ ID NO: 586327 - RNA, 19 nt, Homo sapiens
ggaggugguguccuaagua

SEQ ID NO: 586328 - RNA, 19 nt, Homo sapiens
guuccugugucuuauauau

SEQ ID NO: 586329 - RNA, 19 nt, Homo sapiens
gugcagaggacaaauaaau

SEQ ID NO: 586330 - RNA, 19 nt, Homo sapiens
ccaugaaucuccugggaau

SEQ ID NO: 586331 - RNA, 19 nt, Homo sapiens
gagggaacucuccuacuuu

SEQ ID NO: 586332 - RNA, 19 nt, Homo sapiens
ccaaggcucuaugaagcua

SEQ ID NO: 586333 - RNA, 19 nt, Homo sapiens
caccuaaugugccuggaaa

SEQ ID NO: 586334 - RNA, 19 nt, Homo sapiens
gcuccugggugcauuguca

SEQ ID NO: 586335 - RNA, 19 nt, Homo sapiens
cuuaaauccuccugucuga

SEQ ID NO: 586336 - RNA, 19 nt, Homo sapiens
gaccgagagugcuugguau

SEQ ID NO: 586337 - RNA, 19 nt, Homo sapiens
cuuaucaggcuguguguua

SEQ ID NO: 586338 - RNA, 19 nt, Homo sapiens
gauguugguaggaaaguuu

SEQ ID NO: 586339 - RNA, 19 nt, Homo sapiens
ugauugaaccuggcuauuu

SEQ ID NO: 586340 - RNA, 19 nt, Homo sapiens
cugcaugucugacggagaa

SEQ ID NO: 586341 - RNA, 19 nt, Homo sapiens
gcagaaaggcgaucaucag

SEQ ID NO: 586342 - RNA, 19 nt, Homo sapiens
gggccagaauaauauguug

SEQ ID NO: 586343 - RNA, 19 nt, Homo sapiens
ggacacugcaugcauguag

SEQ ID NO: 586344 - RNA, 19 nt, Homo sapiens
ccacggcucccaaugaguu

SEQ ID NO: 586345 - RNA, 19 nt, Homo sapiens
ugagccaccugagagauaa

SEQ ID NO: 586346 - RNA, 19 nt, Homo sapiens
ccggagcuguuccuauuug

SEQ ID NO: 586347 - RNA, 19 nt, Homo sapiens
gggaaaauauaaaguggaa

SEQ ID NO: 586348 - RNA, 19 nt, Homo sapiens
agaaguuuguugcagacua

SEQ ID NO: 586349 - RNA, 19 nt, Homo sapiens
uaaagagcuuccuggagau

SEQ ID NO: 586350 - RNA, 19 nt, Homo sapiens
ugauugaugugacucugaa

SEQ ID NO: 586351 - RNA, 19 nt, Homo sapiens
uguauguuccugugucuua

SEQ ID NO: 586352 - RNA, 19 nt, Homo sapiens
gggaggugguguccuaagu

SEQ ID NO: 586353 - RNA, 19 nt, Homo sapiens
gggugaagguggcuaugau

SEQ ID NO: 586354 - RNA, 19 nt, Homo sapiens
gucaacgucuucaguguca

SEQ ID NO: 586355 - RNA, 19 nt, Homo sapiens
gauguuaccaagacagaga

SEQ ID NO: 586356 - RNA, 19 nt, Homo sapiens
cugaacaaauggagcagaa

SEQ ID NO: 586357 - RNA, 19 nt, Homo sapiens
gagcagaggguguguuugc

SEQ ID NO: 586358 - RNA, 19 nt, Homo sapiens
guuugacccuguacuuaga

SEQ ID NO: 586359 - RNA, 19 nt, Homo sapiens
agaaaucagcugaacaaau

SEQ ID NO: 586360 - RNA, 19 nt, Homo sapiens
ugaagguggcuaugauuga

SEQ ID NO: 586361 - RNA, 19 nt, Homo sapiens
gguggaggcuacugcaucu

SEQ ID NO: 586362 - RNA, 19 nt, Homo sapiens
ccauaggccucaggaguca

SEQ ID NO: 586363 - RNA, 19 nt, Homo sapiens
agggaacucuccuacuuug

SEQ ID NO: 586364 - RNA, 19 nt, Homo sapiens
gagagaaaccaggagucua

SEQ ID NO: 586365 - RNA, 19 nt, Homo sapiens
uaaugugccuggaaaccau

SEQ ID NO: 586366 - RNA, 19 nt, Homo sapiens
ccugguggaugccauuaug

SEQ ID NO: 586367 - RNA, 19 nt, Homo sapiens
uauaagaaaucagcugaac

SEQ ID NO: 586368 - RNA, 19 nt, Homo sapiens
ggaggccuauggcgagaag

SEQ ID NO: 586369 - RNA, 19 nt, Homo sapiens
gagauaaguauguguucau

SEQ ID NO: 586370 - RNA, 19 nt, Homo sapiens
gaggauucccugccaagau

SEQ ID NO: 586371 - RNA, 19 nt, Homo sapiens
gggcauagcaaggcagaga

SEQ ID NO: 586372 - RNA, 19 nt, Homo sapiens
uagagcagaggguguguuu

SEQ ID NO: 586373 - RNA, 19 nt, Homo sapiens
gaaucuccugggaauaauu

SEQ ID NO: 586374 - RNA, 19 nt, Homo sapiens
ccaaucccacuccuucauu

SEQ ID NO: 586375 - RNA, 19 nt, Homo sapiens
ugagagauaaguauguguu

SEQ ID NO: 586376 - RNA, 19 nt, Homo sapiens
aggauucccugccaagaug

SEQ ID NO: 586377 - RNA, 19 nt, Homo sapiens
gggaggaaagugaggauuc

SEQ ID NO: 586378 - RNA, 19 nt, Homo sapiens
agagaaaccaggagucuag

SEQ ID NO: 586379 - RNA, 19 nt, Homo sapiens
caguuugacccuguacuua

SEQ ID NO: 586380 - RNA, 19 nt, Homo sapiens
guugggacuggaaccauua

SEQ ID NO: 586381 - RNA, 19 nt, Homo sapiens
ggugaagguggcuaugauu

SEQ ID NO: 586382 - RNA, 19 nt, Homo sapiens
ugaccauacuggacgugaa

SEQ ID NO: 586383 - RNA, 19 nt, Homo sapiens
gcauagcaaggcagagaga

SEQ ID NO: 586384 - RNA, 19 nt, Homo sapiens
ugagggugguguuauccuu

SEQ ID NO: 586385 - RNA, 19 nt, Homo sapiens
ugagcuacaugcccaccuu

SEQ ID NO: 586386 - RNA, 19 nt, Homo sapiens
ggacuugaggugugcaaag

SEQ ID NO: 586387 - RNA, 19 nt, Homo sapiens
cuaugaagcuaagguugga

SEQ ID NO: 586388 - RNA, 19 nt, Homo sapiens
guugcagacuauaagaaau

SEQ ID NO: 586389 - RNA, 19 nt, Homo sapiens
agagcuuccuggagauuug

SEQ ID NO: 586390 - RNA, 19 nt, Homo sapiens
gugaagguggcuaugauug

SEQ ID NO: 586391 - RNA, 19 nt, Homo sapiens
ggagugcgugagagacaaa

SEQ ID NO: 586392 - RNA, 19 nt, Homo sapiens
ugaaggagugcgugagaga

SEQ ID NO: 586393 - RNA, 19 nt, Homo sapiens
ggugaaggagugcgugaga

SEQ ID NO: 586394 - RNA, 19 nt, Homo sapiens
agagauaaguauguguuca

SEQ ID NO: 586395 - RNA, 19 nt, Homo sapiens
cccauccucucccugcuuu

SEQ ID NO: 586396 - RNA, 19 nt, Homo sapiens
uuaucaggcuguguguuaa

SEQ ID NO: 586397 - RNA, 19 nt, Homo sapiens
gcagaagugcacacaggau

SEQ ID NO: 586398 - RNA, 19 nt, Homo sapiens
uggaaaccauggguagcua

SEQ ID NO: 586399 - RNA, 19 nt, Homo sapiens
gauaaguauguguucauca

SEQ ID NO: 586400 - RNA, 19 nt, Homo sapiens
ccugagagauaaguaugug

SEQ ID NO: 586401 - RNA, 19 nt, Homo sapiens
gugcggagaggaugaggaa

SEQ ID NO: 586402 - RNA, 19 nt, Homo sapiens
gaagaaagcucucacuuau

SEQ ID NO: 586403 - RNA, 19 nt, Homo sapiens
ggaagaagaugaagaagga

SEQ ID NO: 586404 - RNA, 19 nt, Homo sapiens
agaaagcucucacuuauaa

SEQ ID NO: 586405 - RNA, 19 nt, Homo sapiens
guucaccgcugucaguuua

SEQ ID NO: 586406 - RNA, 19 nt, Homo sapiens
gcaaagcccuucaaaugca

SEQ ID NO: 586407 - RNA, 19 nt, Homo sapiens
gugcaaagcccuucaaaug

SEQ ID NO: 586408 - RNA, 19 nt, Homo sapiens
ucacagacccacacacaua

SEQ ID NO: 586409 - RNA, 19 nt, Homo sapiens
gcagacaugccuugaauug

SEQ ID NO: 586410 - RNA, 19 nt, Homo sapiens
agaagaaagcucucacuua

SEQ ID NO: 586411 - RNA, 19 nt, Homo sapiens
gggacaaguugcuaucuga

SEQ ID NO: 586412 - RNA, 19 nt, Homo sapiens
cagcagacaugccuugaau

SEQ ID NO: 586413 - RNA, 19 nt, Homo sapiens
agacaugccuugaauugga

SEQ ID NO: 586414 - RNA, 19 nt, Homo sapiens
gucaugcacucaacuauau

SEQ ID NO: 586415 - RNA, 19 nt, Homo sapiens
gccggaaaguuuauacaaa

SEQ ID NO: 586416 - RNA, 19 nt, Homo sapiens
gcucuucucuagacagcua

SEQ ID NO: 586417 - RNA, 19 nt, Homo sapiens
gauggaagaagaugaagaa

SEQ ID NO: 586418 - RNA, 19 nt, Homo sapiens
gugagaagccuuauaagug

SEQ ID NO: 586419 - RNA, 19 nt, Homo sapiens
gagcgacagugaccaagga

SEQ ID NO: 586420 - RNA, 19 nt, Homo sapiens
gugaggacuuggacuguuu

SEQ ID NO: 586421 - RNA, 19 nt, Homo sapiens
ggcaucggcuagugucuaa

SEQ ID NO: 586422 - RNA, 19 nt, Homo sapiens
cagacuggcugcuuacuuc

SEQ ID NO: 586423 - RNA, 19 nt, Homo sapiens
caggugagaagccuuauaa

SEQ ID NO: 586424 - RNA, 19 nt, Homo sapiens
ccacacacauacacacugu

SEQ ID NO: 586425 - RNA, 19 nt, Homo sapiens
gcugaagcaugucccgaaa

SEQ ID NO: 586426 - RNA, 19 nt, Homo sapiens
ugaaacugguggccaagaa

SEQ ID NO: 586427 - RNA, 19 nt, Homo sapiens
caacgcagugaccucauua

SEQ ID NO: 586428 - RNA, 19 nt, Homo sapiens
cagacagacugacaaacaa

SEQ ID NO: 586429 - RNA, 19 nt, Homo sapiens
cuucagcacuauuggaauu

SEQ ID NO: 586430 - RNA, 19 nt, Homo sapiens
gacaugccuugaauuggaa

SEQ ID NO: 586431 - RNA, 19 nt, Homo sapiens
ucaacgcagugaccucauu

SEQ ID NO: 586432 - RNA, 19 nt, Homo sapiens
ccaauggaaaucaaagaaa

SEQ ID NO: 586433 - RNA, 19 nt, Homo sapiens
ccagacagacugacaaaca

SEQ ID NO: 586434 - RNA, 19 nt, Homo sapiens
aaauggaugugacgucugu

SEQ ID NO: 586435 - RNA, 19 nt, Homo sapiens
caucuugcccuccacauga

SEQ ID NO: 586436 - RNA, 19 nt, Homo sapiens
ggugagaagccuuauaagu

SEQ ID NO: 586437 - RNA, 19 nt, Homo sapiens
gcucucagcuccguaaagg

SEQ ID NO: 586438 - RNA, 19 nt, Homo sapiens
caaagcccuucaaaugcaa

SEQ ID NO: 586439 - RNA, 19 nt, Homo sapiens
gaaacacacaggugcaaag

SEQ ID NO: 586440 - RNA, 19 nt, Homo sapiens
cuggaugucugccuucuug

SEQ ID NO: 586441 - RNA, 19 nt, Homo sapiens
caugaagagacauaucuaa

SEQ ID NO: 586442 - RNA, 19 nt, Homo sapiens
acacaggugagaagccuua

SEQ ID NO: 586443 - RNA, 19 nt, Homo sapiens
ccagauggaagaagaugaa

SEQ ID NO: 586444 - RNA, 19 nt, Homo sapiens
gcuagugucuaaaggaaac

SEQ ID NO: 586445 - RNA, 19 nt, Homo sapiens
ggugaggacuuggacuguu

SEQ ID NO: 586446 - RNA, 19 nt, Homo sapiens
gcagcagcauggacguguu

SEQ ID NO: 586447 - RNA, 19 nt, Homo sapiens
auaaaccucuguacacaca

SEQ ID NO: 586448 - RNA, 19 nt, Homo sapiens
cggcuagugucuaaaggaa

SEQ ID NO: 586449 - RNA, 19 nt, Homo sapiens
ucacgaggcacuacaggaa

SEQ ID NO: 586450 - RNA, 19 nt, Homo sapiens
ggccagcucuucucuagac

SEQ ID NO: 586451 - RNA, 19 nt, Homo sapiens
gcucggcaguggacaucuu

SEQ ID NO: 586452 - RNA, 19 nt, Homo sapiens
gaagcggccaucugugaga

SEQ ID NO: 586453 - RNA, 19 nt, Homo sapiens
ccacgacaccggcuacuuc

SEQ ID NO: 586454 - RNA, 19 nt, Homo sapiens
aagaaagcucucacuuaua

SEQ ID NO: 586455 - RNA, 19 nt, Homo sapiens
gaccuuuggugaggacuug

SEQ ID NO: 586456 - RNA, 19 nt, Homo sapiens
cagcacuauuggaauuauu

SEQ ID NO: 586457 - RNA, 19 nt, Homo sapiens
cuagccagauggaagaaga

SEQ ID NO: 586458 - RNA, 19 nt, Homo sapiens
ggaaacacacaggugcaaa

SEQ ID NO: 586459 - RNA, 19 nt, Homo sapiens
ugaauuggaacgcuaccua

SEQ ID NO: 586460 - RNA, 19 nt, Homo sapiens
cgacaccggcuacuucuca

SEQ ID NO: 586461 - RNA, 19 nt, Homo sapiens
ugucaugcacucaacuaua

SEQ ID NO: 586462 - RNA, 19 nt, Homo sapiens
uuauaaaccucuguacaca

SEQ ID NO: 586463 - RNA, 19 nt, Homo sapiens
gccaauggaaaucaaagaa

SEQ ID NO: 586464 - RNA, 19 nt, Homo sapiens
acacauacacacugucaug

SEQ ID NO: 586465 - RNA, 19 nt, Homo sapiens
ucacuuauaaaccucugua

SEQ ID NO: 586466 - RNA, 19 nt, Homo sapiens
gaaagcucucacuuauaaa

SEQ ID NO: 586467 - RNA, 19 nt, Homo sapiens
cccauugccucgcagaaga

SEQ ID NO: 586468 - RNA, 19 nt, Homo sapiens
ccggaaaguuuauacaaaa

SEQ ID NO: 586469 - RNA, 19 nt, Homo sapiens
gcuaggggcugaagcaugu

SEQ ID NO: 586470 - RNA, 19 nt, Homo sapiens
uggacguguuggcuaguua

SEQ ID NO: 586471 - RNA, 19 nt, Homo sapiens
cagaagaaagcucucacuu

SEQ ID NO: 586472 - RNA, 19 nt, Homo sapiens
gcacggugacguugaaacu

SEQ ID NO: 586473 - RNA, 19 nt, Homo sapiens
gcagcagacaugccuugaa

SEQ ID NO: 586474 - RNA, 19 nt, Homo sapiens
cguguuggcuaguuauagu

SEQ ID NO: 586475 - RNA, 19 nt, Homo sapiens
gacaaguugcuaucugaga

SEQ ID NO: 586476 - RNA, 19 nt, Homo sapiens
auacgucuauucuuuaugc

SEQ ID NO: 586477 - RNA, 19 nt, Homo sapiens
guacacacacacacacaca

SEQ ID NO: 586478 - RNA, 19 nt, Homo sapiens
ggacguguuggcuaguuau

SEQ ID NO: 586479 - RNA, 19 nt, Homo sapiens
uggaagcggccaucuguga

SEQ ID NO: 586480 - RNA, 19 nt, Homo sapiens
uuggaacgcuaccuacaga

SEQ ID NO: 586481 - RNA, 19 nt, Homo sapiens
gcacuauuggaauuauuuc

SEQ ID NO: 586482 - RNA, 19 nt, Homo sapiens
gaaggaaaccaggugaacu

SEQ ID NO: 586483 - RNA, 19 nt, Homo sapiens
gcucaugggagggauguga

SEQ ID NO: 586484 - RNA, 19 nt, Homo sapiens
caugcacucaacuauauuu

SEQ ID NO: 586485 - RNA, 19 nt, Homo sapiens
gaaacugguggccaagaag

SEQ ID NO: 586486 - RNA, 19 nt, Homo sapiens
ucagcacuauuggaauuau

SEQ ID NO: 586487 - RNA, 19 nt, Homo sapiens
agacagacugacaaacaaa

SEQ ID NO: 586488 - RNA, 19 nt, Homo sapiens
ccggccagcucuucucuag

SEQ ID NO: 586489 - RNA, 19 nt, Homo sapiens
cggcuacuucucagcuuua

SEQ ID NO: 586490 - RNA, 19 nt, Homo sapiens
ccacgagcuggagugauua

SEQ ID NO: 586491 - RNA, 19 nt, Homo sapiens
caaaagggccacuggaugu

SEQ ID NO: 586492 - RNA, 19 nt, Homo sapiens
uaacgggugccggaaaguu

SEQ ID NO: 586493 - RNA, 19 nt, Homo sapiens
gcggccaucugugagaaga

SEQ ID NO: 586494 - RNA, 19 nt, Homo sapiens
gaagaagaugaagaaggaa

SEQ ID NO: 586495 - RNA, 19 nt, Homo sapiens
aaaccucuguacacacaca

SEQ ID NO: 586496 - RNA, 19 nt, Homo sapiens
gcacuacaggaaacacaca

SEQ ID NO: 586497 - RNA, 19 nt, Homo sapiens
ggaugugaguggcguuuug

SEQ ID NO: 586498 - RNA, 19 nt, Homo sapiens
guggacagagcgacaguga

SEQ ID NO: 586499 - RNA, 19 nt, Homo sapiens
gaacucagcaaggcagacu

SEQ ID NO: 586500 - RNA, 19 nt, Homo sapiens
ccggcuacuucucagcuuu

SEQ ID NO: 586501 - RNA, 19 nt, Homo sapiens
gagccagacagacugacaa

SEQ ID NO: 586502 - RNA, 19 nt, Homo sapiens
caaguacccuuacaaagaa

SEQ ID NO: 586503 - RNA, 19 nt, Homo sapiens
ugacugacauugccaagua

SEQ ID NO: 586504 - RNA, 19 nt, Homo sapiens
gaggaggacucucauacaa

SEQ ID NO: 586505 - RNA, 19 nt, Homo sapiens
gcacucaaauuccuuuauc

SEQ ID NO: 586506 - RNA, 19 nt, Homo sapiens
ggaguauucuguaaugaug

SEQ ID NO: 586507 - RNA, 19 nt, Homo sapiens
guacaagccuuuaaagacu

SEQ ID NO: 586508 - RNA, 19 nt, Homo sapiens
gggcagagaccauguuuga

SEQ ID NO: 586509 - RNA, 19 nt, Homo sapiens
ucaaguacccuuacaaaga

SEQ ID NO: 586510 - RNA, 19 nt, Homo sapiens
gcaaucaccagccuugaaa

SEQ ID NO: 586511 - RNA, 19 nt, Homo sapiens
ccucuuggaugcacacuuu

SEQ ID NO: 586512 - RNA, 19 nt, Homo sapiens
uuacaaagaagacaccaua

SEQ ID NO: 586513 - RNA, 19 nt, Homo sapiens
cgaggaguauucuguaaug

SEQ ID NO: 586514 - RNA, 19 nt, Homo sapiens
gagcucugguugcaauauu

SEQ ID NO: 586515 - RNA, 19 nt, Homo sapiens
cuacauaugucgagggaau

SEQ ID NO: 586516 - RNA, 19 nt, Homo sapiens
gcagagaccauguuugaca

SEQ ID NO: 586517 - RNA, 19 nt, Homo sapiens
aagaagacaccauaccuua

SEQ ID NO: 586518 - RNA, 19 nt, Homo sapiens
ggaggacucucauacaacu

SEQ ID NO: 586519 - RNA, 19 nt, Homo sapiens
caacgaggaguauucugua

SEQ ID NO: 586520 - RNA, 19 nt, Homo sapiens
caacaacugggaaucacua

SEQ ID NO: 586521 - RNA, 19 nt, Homo sapiens
gaagggagacugggcaaga

SEQ ID NO: 586522 - RNA, 19 nt, Homo sapiens
gggaaugcagaaagaguua

SEQ ID NO: 586523 - RNA, 19 nt, Homo sapiens
cugcagcgaugguuacauu

SEQ ID NO: 586524 - RNA, 19 nt, Homo sapiens
caucaaguacccuuacaaa

SEQ ID NO: 586525 - RNA, 19 nt, Homo sapiens
aggugaagcuggccuguuu

SEQ ID NO: 586526 - RNA, 19 nt, Homo sapiens
uguaucggauuucuucaaa

SEQ ID NO: 586527 - RNA, 19 nt, Homo sapiens
cagcgaugguuacauugaa

SEQ ID NO: 586528 - RNA, 19 nt, Homo sapiens
gaggaguauucuguaauga

SEQ ID NO: 586529 - RNA, 19 nt, Homo sapiens
guacguggcccucgaugug

SEQ ID NO: 586530 - RNA, 19 nt, Homo sapiens
uguguugacuggacucauu

SEQ ID NO: 586531 - RNA, 19 nt, Homo sapiens
uuucucgaguuucugauua

SEQ ID NO: 586532 - RNA, 19 nt, Homo sapiens
cagagaccauguuugacaa

SEQ ID NO: 586533 - RNA, 19 nt, Homo sapiens
gcagcgaugguuacauuga

SEQ ID NO: 586534 - RNA, 19 nt, Homo sapiens
gagaccauguuugacaaga

SEQ ID NO: 586535 - RNA, 19 nt, Homo sapiens
auacaacucugcaugaaac

SEQ ID NO: 586536 - RNA, 19 nt, Homo sapiens
ggaaaaugauugccacaag

SEQ ID NO: 586537 - RNA, 19 nt, Homo sapiens
cuguauauguaucggauuu

SEQ ID NO: 586538 - RNA, 19 nt, Homo sapiens
acacugcaauuuggucuug

SEQ ID NO: 586539 - RNA, 19 nt, Homo sapiens
gcgaugguuacauugaaua

SEQ ID NO: 586540 - RNA, 19 nt, Homo sapiens
ccacuggagcgauguguug

SEQ ID NO: 586541 - RNA, 19 nt, Homo sapiens
gcagguuguccuucuauuc

SEQ ID NO: 586542 - RNA, 19 nt, Homo sapiens
ucgagggaaugcagaaaga

SEQ ID NO: 586543 - RNA, 19 nt, Homo sapiens
gcguguugcuggcuggauu

SEQ ID NO: 586544 - RNA, 19 nt, Homo sapiens
ccucacuucuuggauguuu

SEQ ID NO: 586545 - RNA, 19 nt, Homo sapiens
ccauucaguauuaucguua

SEQ ID NO: 586546 - RNA, 19 nt, Homo sapiens
ucagggagcucugguugca

SEQ ID NO: 586547 - RNA, 19 nt, Homo sapiens
gaagcuggccuguuuucua

SEQ ID NO: 586548 - RNA, 19 nt, Homo sapiens
ccaacgaggaguauucugu

SEQ ID NO: 586549 - RNA, 19 nt, Homo sapiens
caugaaacaccaacaacug

SEQ ID NO: 586550 - RNA, 19 nt, Homo sapiens
ucucgaguuucugauuaua

SEQ ID NO: 586551 - RNA, 19 nt, Homo sapiens
aacgaggaguauucuguaa

SEQ ID NO: 586552 - RNA, 19 nt, Homo sapiens
acaaagccauuggaaccuu

SEQ ID NO: 586553 - RNA, 19 nt, Homo sapiens
aaagaagacaccauaccuu

SEQ ID NO: 586554 - RNA, 19 nt, Homo sapiens
cuuuguguguacauaguua

SEQ ID NO: 586555 - RNA, 19 nt, Homo sapiens
caucuuucuuccuggugua

SEQ ID NO: 586556 - RNA, 19 nt, Homo sapiens
guauauguaucggauuucu

SEQ ID NO: 586557 - RNA, 19 nt, Homo sapiens
ggaaugcagaaagaguuaa

SEQ ID NO: 586558 - RNA, 19 nt, Homo sapiens
guguacauaguuaccuuua

SEQ ID NO: 586559 - RNA, 19 nt, Homo sapiens
aagcuggccuguuuucuaa

SEQ ID NO: 586560 - RNA, 19 nt, Homo sapiens
cauacaacucugcaugaaa

SEQ ID NO: 586561 - RNA, 19 nt, Homo sapiens
cagguuguccuucuauuca

SEQ ID NO: 586562 - RNA, 19 nt, Homo sapiens
caaagaagacaccauaccu

SEQ ID NO: 586563 - RNA, 19 nt, Homo sapiens
uacaagccuuuaaagacuu

SEQ ID NO: 586564 - RNA, 19 nt, Homo sapiens
gaaucacuauccgagcaau

SEQ ID NO: 586565 - RNA, 19 nt, Homo sapiens
gcaugaaacaccaacaacu

SEQ ID NO: 586566 - RNA, 19 nt, Homo sapiens
ggcagguuguccuucuauu

SEQ ID NO: 586567 - RNA, 19 nt, Homo sapiens
ucaacugcagcgaugguua

SEQ ID NO: 586568 - RNA, 19 nt, Homo sapiens
gacugacauugccaaguau

SEQ ID NO: 586569 - RNA, 19 nt, Homo sapiens
ggaaucacuauccgagcaa

SEQ ID NO: 586570 - RNA, 19 nt, Homo sapiens
ggccucacuucuuggaugu

SEQ ID NO: 586571 - RNA, 19 nt, Homo sapiens
ccauuuaugugggccuuuc

SEQ ID NO: 586572 - RNA, 19 nt, Homo sapiens
agaagacaccauaccuuau

SEQ ID NO: 586573 - RNA, 19 nt, Homo sapiens
gaaugcagaaagaguuaag

SEQ ID NO: 586574 - RNA, 19 nt, Homo sapiens
guguacaagccuuuaaaga

SEQ ID NO: 586575 - RNA, 19 nt, Homo sapiens
caacugggaaucacuaucc

SEQ ID NO: 586576 - RNA, 19 nt, Homo sapiens
gggccuuucucgaguuucu

SEQ ID NO: 586577 - RNA, 19 nt, Homo sapiens
ugacauugccaaguauuca

SEQ ID NO: 586578 - RNA, 19 nt, Homo sapiens
gugggccuuucucgaguuu

SEQ ID NO: 586579 - RNA, 19 nt, Homo sapiens
caacugcagcgaugguuac

SEQ ID NO: 586580 - RNA, 19 nt, Homo sapiens
cuucuuggauguuugugau

SEQ ID NO: 586581 - RNA, 19 nt, Homo sapiens
gagggaaugcagaaagagu

SEQ ID NO: 586582 - RNA, 19 nt, Homo sapiens
aacccugucuguuuacugu

SEQ ID NO: 586583 - RNA, 19 nt, Homo sapiens
guguguacauaguuaccuu

SEQ ID NO: 586584 - RNA, 19 nt, Homo sapiens
agcucugguugcaauauua

SEQ ID NO: 586585 - RNA, 19 nt, Homo sapiens
agggagcucugguugcaau

SEQ ID NO: 586586 - RNA, 19 nt, Homo sapiens
uaucuucaagccaggauga

SEQ ID NO: 586587 - RNA, 19 nt, Homo sapiens
gacauugccaaguauucaa

SEQ ID NO: 586588 - RNA, 19 nt, Homo sapiens
cacucaaauuccuuuauca

SEQ ID NO: 586589 - RNA, 19 nt, Homo sapiens
gagcaaucaccagccuuga

SEQ ID NO: 586590 - RNA, 19 nt, Homo sapiens
uguacaagccuuuaaagac

SEQ ID NO: 586591 - RNA, 19 nt, Homo sapiens
ggagcucugguugcaauau

SEQ ID NO: 586592 - RNA, 19 nt, Homo sapiens
uuguugccguauccauuua

SEQ ID NO: 586593 - RNA, 19 nt, Homo sapiens
acaagccuuuaaagacuuc

SEQ ID NO: 586594 - RNA, 19 nt, Homo sapiens
gaguauucuguaaugauga

SEQ ID NO: 586595 - RNA, 19 nt, Homo sapiens
uguacugcaugcuguuugu

SEQ ID NO: 586596 - RNA, 19 nt, Homo sapiens
uccauucaguauuaucguu

SEQ ID NO: 586597 - RNA, 19 nt, Homo sapiens
ugacagaccuggccaagua

SEQ ID NO: 586598 - RNA, 19 nt, Homo sapiens
gcacgacucuguuggaagu

SEQ ID NO: 586599 - RNA, 19 nt, Homo sapiens
gcucggacuucaacaacua

SEQ ID NO: 586600 - RNA, 19 nt, Homo sapiens
gauaguugcuguuuuguaa

SEQ ID NO: 586601 - RNA, 19 nt, Homo sapiens
cuacguggcugcuguauac

SEQ ID NO: 586602 - RNA, 19 nt, Homo sapiens
gaucagauaguugcuguuu

SEQ ID NO: 586603 - RNA, 19 nt, Homo sapiens
ccgcgugucugauuacaaa

SEQ ID NO: 586604 - RNA, 19 nt, Homo sapiens
gggaaacccugcugauguc

SEQ ID NO: 586605 - RNA, 19 nt, Homo sapiens
caucucagacuucuucaaa

SEQ ID NO: 586606 - RNA, 19 nt, Homo sapiens
ccaaauauccccuucuuuu

SEQ ID NO: 586607 - RNA, 19 nt, Homo sapiens
acacagaccggcucuauuc

SEQ ID NO: 586608 - RNA, 19 nt, Homo sapiens
uaaaauagggcaccuguuu

SEQ ID NO: 586609 - RNA, 19 nt, Homo sapiens
guacacagaccggcucuau

SEQ ID NO: 586610 - RNA, 19 nt, Homo sapiens
ggaagggaccgagagauca

SEQ ID NO: 586611 - RNA, 19 nt, Homo sapiens
ucagauaguugcuguuuug

SEQ ID NO: 586612 - RNA, 19 nt, Homo sapiens
ggguagcccucagcauuug

SEQ ID NO: 586613 - RNA, 19 nt, Homo sapiens
cuacaucucagacuucuuc

SEQ ID NO: 586614 - RNA, 19 nt, Homo sapiens
caacugcucggucuaugug

SEQ ID NO: 586615 - RNA, 19 nt, Homo sapiens
caacuacguggcugcugua

SEQ ID NO: 586616 - RNA, 19 nt, Homo sapiens
ggaccgagagaucagauag

SEQ ID NO: 586617 - RNA, 19 nt, Homo sapiens
gaggccagguugucuuucu

SEQ ID NO: 586618 - RNA, 19 nt, Homo sapiens
ccacaaccacuauggauac

SEQ ID NO: 586619 - RNA, 19 nt, Homo sapiens
gccgugagccagucucuga

SEQ ID NO: 586620 - RNA, 19 nt, Homo sapiens
gaaggaggaggagcuggaa

SEQ ID NO: 586621 - RNA, 19 nt, Homo sapiens
cuggagcgauguccuuguu

SEQ ID NO: 586622 - RNA, 19 nt, Homo sapiens
gaccacaaccacuauggau

SEQ ID NO: 586623 - RNA, 19 nt, Homo sapiens
ucgggacacucuuccuuug

SEQ ID NO: 586624 - RNA, 19 nt, Homo sapiens
gacccacaguccaguucuu

SEQ ID NO: 586625 - RNA, 19 nt, Homo sapiens
accgagagaucagauaguu

SEQ ID NO: 586626 - RNA, 19 nt, Homo sapiens
uaaggaagggaccgagaga

SEQ ID NO: 586627 - RNA, 19 nt, Homo sapiens
gaccuggccaaguacauga

SEQ ID NO: 586628 - RNA, 19 nt, Homo sapiens
ggucaacugcucggucuau

SEQ ID NO: 586629 - RNA, 19 nt, Homo sapiens
aagcccagccugucacuga

SEQ ID NO: 586630 - RNA, 19 nt, Homo sapiens
ucucagacuucuucaaagc

SEQ ID NO: 586631 - RNA, 19 nt, Homo sapiens
gaagggaccgagagaucag

SEQ ID NO: 586632 - RNA, 19 nt, Homo sapiens
uggguagcccucagcauuu

SEQ ID NO: 586633 - RNA, 19 nt, Homo sapiens
gcucgacgugcugugcuua

SEQ ID NO: 586634 - RNA, 19 nt, Homo sapiens
cuggguagcccucagcauu

SEQ ID NO: 586635 - RNA, 19 nt, Homo sapiens
ccacuggagcgauguccuu

SEQ ID NO: 586636 - RNA, 19 nt, Homo sapiens
gggaagccuaccuggugua

SEQ ID NO: 586637 - RNA, 19 nt, Homo sapiens
gggcugaugggagcaguga

SEQ ID NO: 586638 - RNA, 19 nt, Homo sapiens
ggauguacugcaugguguu

SEQ ID NO: 586639 - RNA, 19 nt, Homo sapiens
guaaagcacuauugucuug

SEQ ID NO: 586640 - RNA, 19 nt, Homo sapiens
ggaaacaacagcaaacuaa

SEQ ID NO: 586641 - RNA, 19 nt, Homo sapiens
ugaaauaacugcaacuaga

SEQ ID NO: 586642 - RNA, 19 nt, Homo sapiens
gaaaugcguuuagaucuug

SEQ ID NO: 586643 - RNA, 19 nt, Homo sapiens
gcaauugguuuaaguguuc

SEQ ID NO: 586644 - RNA, 19 nt, Homo sapiens
gcgcagcucccauucauua

SEQ ID NO: 586645 - RNA, 19 nt, Homo sapiens
gaacauauggguuaaaucu

SEQ ID NO: 586646 - RNA, 19 nt, Homo sapiens
gggcagaacauauggguua

SEQ ID NO: 586647 - RNA, 19 nt, Homo sapiens
gaagaaaugcguuuagauc

SEQ ID NO: 586648 - RNA, 19 nt, Homo sapiens
gcacaugaugccagaaaua

SEQ ID NO: 586649 - RNA, 19 nt, Homo sapiens
ucacagacauugccaaagu

SEQ ID NO: 586650 - RNA, 19 nt, Homo sapiens
ggaggaggaggcaaaguua

SEQ ID NO: 586651 - RNA, 19 nt, Homo sapiens
gaaagcagccuucuguaca

SEQ ID NO: 586652 - RNA, 19 nt, Homo sapiens
gcacauccuuacuacagaa

SEQ ID NO: 586653 - RNA, 19 nt, Homo sapiens
gcacuugcauacucuuaga

SEQ ID NO: 586654 - RNA, 19 nt, Homo sapiens
caagcaccaucaagccuua

SEQ ID NO: 586655 - RNA, 19 nt, Homo sapiens
cagaauccguccuuucauu

SEQ ID NO: 586656 - RNA, 19 nt, Homo sapiens
gaucuuggaugcagaccuu

SEQ ID NO: 586657 - RNA, 19 nt, Homo sapiens
guagagaguuucccucauc

SEQ ID NO: 586658 - RNA, 19 nt, Homo sapiens
aaauagcacugaaucaaga

SEQ ID NO: 586659 - RNA, 19 nt, Homo sapiens
gaaggaagaaaugcguuua

SEQ ID NO: 586660 - RNA, 19 nt, Homo sapiens
gcaggaugcugauguugug

SEQ ID NO: 586661 - RNA, 19 nt, Homo sapiens
gaacaaucaccacaacaug

SEQ ID NO: 586662 - RNA, 19 nt, Homo sapiens
ggaaccagcugcggaggaa

SEQ ID NO: 586663 - RNA, 19 nt, Homo sapiens
gaguugcucuugcugugua

SEQ ID NO: 586664 - RNA, 19 nt, Homo sapiens
cagcacaauuucagaagaa

SEQ ID NO: 586665 - RNA, 19 nt, Homo sapiens
gcuauauccacuaugauua

SEQ ID NO: 586666 - RNA, 19 nt, Homo sapiens
caugagagguuacccuuca

SEQ ID NO: 586667 - RNA, 19 nt, Homo sapiens
gaaaggaggaaggaagaaa

SEQ ID NO: 586668 - RNA, 19 nt, Homo sapiens
ugacagagcugagggucuu

SEQ ID NO: 586669 - RNA, 19 nt, Homo sapiens
gaaauagcacugaaucaag

SEQ ID NO: 586670 - RNA, 19 nt, Homo sapiens
ccacuaugauuauaaacug

SEQ ID NO: 586671 - RNA, 19 nt, Homo sapiens
cugcgaaacuauacuugua

SEQ ID NO: 586672 - RNA, 19 nt, Homo sapiens
gagcugcccucuugagucu

SEQ ID NO: 586673 - RNA, 19 nt, Homo sapiens
uuagcuauauccacuauga

SEQ ID NO: 586674 - RNA, 19 nt, Homo sapiens
guccuuucauuucaacuua

SEQ ID NO: 586675 - RNA, 19 nt, Homo sapiens
ggaaggaagaaaugcguuu

SEQ ID NO: 586676 - RNA, 19 nt, Homo sapiens
aaccauaguuccucacauu

SEQ ID NO: 586677 - RNA, 19 nt, Homo sapiens
gggacugucucgcguauca

SEQ ID NO: 586678 - RNA, 19 nt, Homo sapiens
gaaaacuggugagacaaua

SEQ ID NO: 586679 - RNA, 19 nt, Homo sapiens
agaaaugcguuuagaucuu

SEQ ID NO: 586680 - RNA, 19 nt, Homo sapiens
cuacugaaccuuugaggaa

SEQ ID NO: 586681 - RNA, 19 nt, Homo sapiens
gaguuucccucauccucua

SEQ ID NO: 586682 - RNA, 19 nt, Homo sapiens
cagaacauauggguuaaau

SEQ ID NO: 586683 - RNA, 19 nt, Homo sapiens
gaaaaucgaaccaaccuuu

SEQ ID NO: 586684 - RNA, 19 nt, Homo sapiens
ucuauuaccugaagaaguc

SEQ ID NO: 586685 - RNA, 19 nt, Homo sapiens
caguucaccuugaucauga

SEQ ID NO: 586686 - RNA, 19 nt, Homo sapiens
gaaauaacugcaacuagag

SEQ ID NO: 586687 - RNA, 19 nt, Homo sapiens
uugcggagcugcccucuug

SEQ ID NO: 586688 - RNA, 19 nt, Homo sapiens
ggaagaaaugcguuuagau

SEQ ID NO: 586689 - RNA, 19 nt, Homo sapiens
gagcugagggucuuuguag

SEQ ID NO: 586690 - RNA, 19 nt, Homo sapiens
aaagcagccuucuguacaa

SEQ ID NO: 586691 - RNA, 19 nt, Homo sapiens
ggaaagcagccuucuguac

SEQ ID NO: 586692 - RNA, 19 nt, Homo sapiens
gugauuagcagacucuuug

SEQ ID NO: 586693 - RNA, 19 nt, Homo sapiens
gaacaaacacuaaaacgau

SEQ ID NO: 586694 - RNA, 19 nt, Homo sapiens
gcugcccucuugagucuuu

SEQ ID NO: 586695 - RNA, 19 nt, Homo sapiens
ggaacaaucaccacaacau

SEQ ID NO: 586696 - RNA, 19 nt, Homo sapiens
uaaguguccuuccaugcaa

SEQ ID NO: 586697 - RNA, 19 nt, Homo sapiens
ucacaaacagcacaauuuc

SEQ ID NO: 586698 - RNA, 19 nt, Homo sapiens
caucaaguacccacugaaa

SEQ ID NO: 586699 - RNA, 19 nt, Homo sapiens
gaccuguguuauuuacauu

SEQ ID NO: 586700 - RNA, 19 nt, Homo sapiens
gcucagcgcagcucccauu

SEQ ID NO: 586701 - RNA, 19 nt, Homo sapiens
gagggucuuuguaggaguu

SEQ ID NO: 586702 - RNA, 19 nt, Homo sapiens
gcucuccaaucucaucaga

SEQ ID NO: 586703 - RNA, 19 nt, Homo sapiens
cagaggugaugacagcaaa

SEQ ID NO: 586704 - RNA, 19 nt, Homo sapiens
ggaauucuaccggaucuau

SEQ ID NO: 586705 - RNA, 19 nt, Homo sapiens
ggaggcaaaguuagaguug

SEQ ID NO: 586706 - RNA, 19 nt, Homo sapiens
gggcaguucuugguagguu

SEQ ID NO: 586707 - RNA, 19 nt, Homo sapiens
caaguuugcucagucaagu

SEQ ID NO: 586708 - RNA, 19 nt, Homo sapiens
aauaaaagcucguaacaca

SEQ ID NO: 586709 - RNA, 19 nt, Homo sapiens
cagcgcagcucccauucau

SEQ ID NO: 586710 - RNA, 19 nt, Homo sapiens
aaacagcacaauuucagaa

SEQ ID NO: 586711 - RNA, 19 nt, Homo sapiens
acaguagaauguagggaaa

SEQ ID NO: 586712 - RNA, 19 nt, Homo sapiens
ggcaggauuugcucaagga

SEQ ID NO: 586713 - RNA, 19 nt, Homo sapiens
uggcagcacucuauaagca

SEQ ID NO: 586714 - RNA, 19 nt, Homo sapiens
cgaccuguguuauuuacau

SEQ ID NO: 586715 - RNA, 19 nt, Homo sapiens
ccauauggaucaaccacau

SEQ ID NO: 586716 - RNA, 19 nt, Homo sapiens
caugcaaggucccacucua

SEQ ID NO: 586717 - RNA, 19 nt, Homo sapiens
agaaauagcacugaaucaa

SEQ ID NO: 586718 - RNA, 19 nt, Homo sapiens
uauguggccuuccaaaaua

SEQ ID NO: 586719 - RNA, 19 nt, Homo sapiens
gugauguucuggcaggauu

SEQ ID NO: 586720 - RNA, 19 nt, Homo sapiens
gcaguucaccuugaucaug

SEQ ID NO: 586721 - RNA, 19 nt, Homo sapiens
aaggcuacauucagaacua

SEQ ID NO: 586722 - RNA, 19 nt, Homo sapiens
cauaguuccucacauuagu

SEQ ID NO: 586723 - RNA, 19 nt, Homo sapiens
acacuaugcuguauuuggu

SEQ ID NO: 586724 - RNA, 19 nt, Homo sapiens
aaacuacaaguacgacaaa

SEQ ID NO: 586725 - RNA, 19 nt, Homo sapiens
ggcagaacauauggguuaa

SEQ ID NO: 586726 - RNA, 19 nt, Homo sapiens
caucagacaguagaaugua

SEQ ID NO: 586727 - RNA, 19 nt, Homo sapiens
gcagccagcgccaugcaaa

SEQ ID NO: 586728 - RNA, 19 nt, Homo sapiens
aauucuaccggaucuauua

SEQ ID NO: 586729 - RNA, 19 nt, Homo sapiens
aaacuggugagacaauaaa

SEQ ID NO: 586730 - RNA, 19 nt, Homo sapiens
guaaguguccuuccaugca

SEQ ID NO: 586731 - RNA, 19 nt, Homo sapiens
aaacaacagcaaacuaaca

SEQ ID NO: 586732 - RNA, 19 nt, Homo sapiens
gguaguguuugccuaugug

SEQ ID NO: 586733 - RNA, 19 nt, Homo sapiens
ucuccaaucucaucagaca

SEQ ID NO: 586734 - RNA, 19 nt, Homo sapiens
cuacguggcagcacucuau

SEQ ID NO: 586735 - RNA, 19 nt, Homo sapiens
gcaagcgggugcugcucau

SEQ ID NO: 586736 - RNA, 19 nt, Homo sapiens
aaacaaacccaggcgauca

SEQ ID NO: 586737 - RNA, 19 nt, Homo sapiens
guacugugacuuuaguuca

SEQ ID NO: 586738 - RNA, 19 nt, Homo sapiens
gaauucuaccggaucuauu

SEQ ID NO: 586739 - RNA, 19 nt, Homo sapiens
cuacauaucugucaucuaa

SEQ ID NO: 586740 - RNA, 19 nt, Homo sapiens
gcacaacgcuggaaaauuu

SEQ ID NO: 586741 - RNA, 19 nt, Homo sapiens
caaagcaacugggucauua

SEQ ID NO: 586742 - RNA, 19 nt, Homo sapiens
ggacaggagugaauguaaa

SEQ ID NO: 586743 - RNA, 19 nt, Homo sapiens
gcaagucauucaucaaaga

SEQ ID NO: 586744 - RNA, 19 nt, Homo sapiens
ggaggagugucauuucuau

SEQ ID NO: 586745 - RNA, 19 nt, Homo sapiens
ggaaagaagagaaugaaga

SEQ ID NO: 586746 - RNA, 19 nt, Homo sapiens
aaagacgccuugaaaugua

SEQ ID NO: 586747 - RNA, 19 nt, Homo sapiens
ugacaaauuucccuuagga

SEQ ID NO: 586748 - RNA, 19 nt, Homo sapiens
ggucaacgcuggcgaugug

SEQ ID NO: 586749 - RNA, 19 nt, Homo sapiens
aaaccuggcuucuccaugu

SEQ ID NO: 586750 - RNA, 19 nt, Homo sapiens
caaagacgccuugaaaugu

SEQ ID NO: 586751 - RNA, 19 nt, Homo sapiens
ggaaauggugucccaguug

SEQ ID NO: 586752 - RNA, 19 nt, Homo sapiens
gcacagguucggcugcaua

SEQ ID NO: 586753 - RNA, 19 nt, Homo sapiens
gacgggagguuaauaccaa

SEQ ID NO: 586754 - RNA, 19 nt, Homo sapiens
gggcaagucauucaucaaa

SEQ ID NO: 586755 - RNA, 19 nt, Homo sapiens
ggaaaggaaagaagagaau

SEQ ID NO: 586756 - RNA, 19 nt, Homo sapiens
aaacagcgacauagccaua

SEQ ID NO: 586757 - RNA, 19 nt, Homo sapiens
gcacuuacacguacucaag

SEQ ID NO: 586758 - RNA, 19 nt, Homo sapiens
gcagagagagagagagaga

SEQ ID NO: 586759 - RNA, 19 nt, Homo sapiens
cgacauagccauacaucug

SEQ ID NO: 586760 - RNA, 19 nt, Homo sapiens
ggaaauuuagcaauaagga

SEQ ID NO: 586761 - RNA, 19 nt, Homo sapiens
gaaagaagagaaugaagac

SEQ ID NO: 586762 - RNA, 19 nt, Homo sapiens
ggagggaggagugucauuu

SEQ ID NO: 586763 - RNA, 19 nt, Homo sapiens
gacccuggcuuugguguug

SEQ ID NO: 586764 - RNA, 19 nt, Homo sapiens
ggagugucauuucuaugug

SEQ ID NO: 586765 - RNA, 19 nt, Homo sapiens
ggugaauucugcacuuaca

SEQ ID NO: 586766 - RNA, 19 nt, Homo sapiens
gcgugcagguucaguguga

SEQ ID NO: 586767 - RNA, 19 nt, Homo sapiens
agagaaugaagacuacuua

SEQ ID NO: 586768 - RNA, 19 nt, Homo sapiens
aagaagagaaugaagacua

SEQ ID NO: 586769 - RNA, 19 nt, Homo sapiens
gacauagccauacaucuga

SEQ ID NO: 586770 - RNA, 19 nt, Homo sapiens
gaaaggaaagaagagaaug

SEQ ID NO: 586771 - RNA, 19 nt, Homo sapiens
gcuaucaaacagcgacaua

SEQ ID NO: 586772 - RNA, 19 nt, Homo sapiens
gcaccucggccauccagaa

SEQ ID NO: 586773 - RNA, 19 nt, Homo sapiens
ggaagccugugcuccaucu

SEQ ID NO: 586774 - RNA, 19 nt, Homo sapiens
caaggagacugcugaaaau

SEQ ID NO: 586775 - RNA, 19 nt, Homo sapiens
ggacauuccaaaacauuua

SEQ ID NO: 586776 - RNA, 19 nt, Homo sapiens
gguguggcguguuugaaug

SEQ ID NO: 586777 - RNA, 19 nt, Homo sapiens
gaaaagagagagagaaaag

SEQ ID NO: 586778 - RNA, 19 nt, Homo sapiens
acaaauaaaggcagagaga

SEQ ID NO: 586779 - RNA, 19 nt, Homo sapiens
ggacaaauaaaggcagaga

SEQ ID NO: 586780 - RNA, 19 nt, Homo sapiens
aaauaucgcuuagaaugca

SEQ ID NO: 586781 - RNA, 19 nt, Homo sapiens
gcguuauccucguaccuuu

SEQ ID NO: 586782 - RNA, 19 nt, Homo sapiens
ggagauccagcacuguuug

SEQ ID NO: 586783 - RNA, 19 nt, Homo sapiens
aggaaaugcugaccuuuua

SEQ ID NO: 586784 - RNA, 19 nt, Homo sapiens
gaugggaaaggaaagaaga

SEQ ID NO: 586785 - RNA, 19 nt, Homo sapiens
acaaauuucccuuaggauu

SEQ ID NO: 586786 - RNA, 19 nt, Homo sapiens
agaagagaaugaagacuac

SEQ ID NO: 586787 - RNA, 19 nt, Homo sapiens
gggaggagugucauuucua

SEQ ID NO: 586788 - RNA, 19 nt, Homo sapiens
gacgaacagucugaguauu

SEQ ID NO: 586789 - RNA, 19 nt, Homo sapiens
aaauaaaggcagagagaga

SEQ ID NO: 586790 - RNA, 19 nt, Homo sapiens
aaaggaaagaagagaauga

SEQ ID NO: 586791 - RNA, 19 nt, Homo sapiens
ggaacggacaggugagaug

SEQ ID NO: 586792 - RNA, 19 nt, Homo sapiens
gauauccggaggugaaaug

SEQ ID NO: 586793 - RNA, 19 nt, Homo sapiens
uguaauuucugagccauug

SEQ ID NO: 586794 - RNA, 19 nt, Homo sapiens
gagugucauuucuaugugu

SEQ ID NO: 586795 - RNA, 19 nt, Homo sapiens
cagggcaagucauucauca

SEQ ID NO: 586796 - RNA, 19 nt, Homo sapiens
gggaaaggaaagaagagaa

SEQ ID NO: 586797 - RNA, 19 nt, Homo sapiens
ggaagaggaggaggaggaa

SEQ ID NO: 586798 - RNA, 19 nt, Homo sapiens
uuuaaccacugcuucaaau

SEQ ID NO: 586799 - RNA, 19 nt, Homo sapiens
aagacgccuugaaauguaa

SEQ ID NO: 586800 - RNA, 19 nt, Homo sapiens
agagagagagggagaggaa

SEQ ID NO: 586801 - RNA, 19 nt, Homo sapiens
ggacaggauuuuccagauc

SEQ ID NO: 586802 - RNA, 19 nt, Homo sapiens
caggagacccagcuggaaa

SEQ ID NO: 586803 - RNA, 19 nt, Homo sapiens
cuggugaauucugcacuua

SEQ ID NO: 586804 - RNA, 19 nt, Homo sapiens
ggaugucacacgcaggauu

SEQ ID NO: 586805 - RNA, 19 nt, Homo sapiens
auccggaggugaaaugaaa

SEQ ID NO: 586806 - RNA, 19 nt, Homo sapiens
cgaacagucugaguauucu

SEQ ID NO: 586807 - RNA, 19 nt, Homo sapiens
gagagagggagaggaagaa

SEQ ID NO: 586808 - RNA, 19 nt, Homo sapiens
gcggagauccagcacuguu

SEQ ID NO: 586809 - RNA, 19 nt, Homo sapiens
gcaacugggucauuaaaac

SEQ ID NO: 586810 - RNA, 19 nt, Homo sapiens
guagcaagagccacccaaa

SEQ ID NO: 586811 - RNA, 19 nt, Homo sapiens
ggcaagucauucaucaaag

SEQ ID NO: 586812 - RNA, 19 nt, Homo sapiens
gagggaggagugucauuuc

SEQ ID NO: 586813 - RNA, 19 nt, Homo sapiens
gaugucacacgcaggauuc

SEQ ID NO: 586814 - RNA, 19 nt, Homo sapiens
cagucugaguauucugaua

SEQ ID NO: 586815 - RNA, 19 nt, Homo sapiens
aaaccagcccauccuuuga

SEQ ID NO: 586816 - RNA, 19 nt, Homo sapiens
uaauuucugagccauugua

SEQ ID NO: 586817 - RNA, 19 nt, Homo sapiens
ccaaaacauuuaccauuag

SEQ ID NO: 586818 - RNA, 19 nt, Homo sapiens
ggugagcgagguagcaaga

SEQ ID NO: 586819 - RNA, 19 nt, Homo sapiens
ucucuaagggacaggauuu

SEQ ID NO: 586820 - RNA, 19 nt, Homo sapiens
ucaaggagacugcugaaaa

SEQ ID NO: 586821 - RNA, 19 nt, Homo sapiens
gggcuuacaugggauuugc

SEQ ID NO: 586822 - RNA, 19 nt, Homo sapiens
guggcguguuugaauguuu

SEQ ID NO: 586823 - RNA, 19 nt, Homo sapiens
augcugaccuuuuacauaa

SEQ ID NO: 586824 - RNA, 19 nt, Homo sapiens
gagaaugaagacuacuuag

SEQ ID NO: 586825 - RNA, 19 nt, Homo sapiens
uaaccacugcuucaaaucu

SEQ ID NO: 586826 - RNA, 19 nt, Homo sapiens
ggagguuaauaccaagaac

SEQ ID NO: 586827 - RNA, 19 nt, Homo sapiens
acaaagcaacugggucauu

SEQ ID NO: 586828 - RNA, 19 nt, Homo sapiens
ucugauauccggaggugaa

SEQ ID NO: 586829 - RNA, 19 nt, Homo sapiens
agagagagagagagagaga

SEQ ID NO: 586830 - RNA, 19 nt, Homo sapiens
gccugucccugcagaauac

SEQ ID NO: 586831 - RNA, 19 nt, Homo sapiens
aagcaacugggucauuaaa

SEQ ID NO: 586832 - RNA, 19 nt, Homo sapiens
aaagcaacugggucauuaa

SEQ ID NO: 586833 - RNA, 19 nt, Homo sapiens
ccucguaccuuugucuucu

SEQ ID NO: 586834 - RNA, 19 nt, Homo sapiens
caggagcucccagcagaaa

SEQ ID NO: 586835 - RNA, 19 nt, Homo sapiens
uaaauaucgcuuagaaugc

SEQ ID NO: 586836 - RNA, 19 nt, Homo sapiens
guucaugacccuggcuuug

SEQ ID NO: 586837 - RNA, 19 nt, Homo sapiens
gaagaaaagagagagagaa

SEQ ID NO: 586838 - RNA, 19 nt, Homo sapiens
ggacuguggacuucaucga

SEQ ID NO: 586839 - RNA, 19 nt, Homo sapiens
ggaaagaacugccauuaaa

SEQ ID NO: 586840 - RNA, 19 nt, Homo sapiens
gaacagugauggagguaua

SEQ ID NO: 586841 - RNA, 19 nt, Homo sapiens
gagaagagauagaagaauu

SEQ ID NO: 586842 - RNA, 19 nt, Homo sapiens
ugaacaaguugcagaauua

SEQ ID NO: 586843 - RNA, 19 nt, Homo sapiens
ccaaagaguuaaagaauga

SEQ ID NO: 586844 - RNA, 19 nt, Homo sapiens
aaagaaggcucauauauuc

SEQ ID NO: 586845 - RNA, 19 nt, Homo sapiens
gaaaaggacucuaugauug

SEQ ID NO: 586846 - RNA, 19 nt, Homo sapiens
ggcaauguguccaaauuua

SEQ ID NO: 586847 - RNA, 19 nt, Homo sapiens
gcagcagguuucuacauua

SEQ ID NO: 586848 - RNA, 19 nt, Homo sapiens
gcaaagagaauuucauaga

SEQ ID NO: 586849 - RNA, 19 nt, Homo sapiens
gcucauauauucaacguau

SEQ ID NO: 586850 - RNA, 19 nt, Homo sapiens
aaaugucacucuucuguua

SEQ ID NO: 586851 - RNA, 19 nt, Homo sapiens
gaaaggcagccauuuguuu

SEQ ID NO: 586852 - RNA, 19 nt, Homo sapiens
ggagagaccgagacuauaa

SEQ ID NO: 586853 - RNA, 19 nt, Homo sapiens
gaagauggacucuaaacuu

SEQ ID NO: 586854 - RNA, 19 nt, Homo sapiens
ccaaacaucuggcacaaau

SEQ ID NO: 586855 - RNA, 19 nt, Homo sapiens
ggaagccaauuuacagaaa

SEQ ID NO: 586856 - RNA, 19 nt, Homo sapiens
caucuaaugugauugcuaa

SEQ ID NO: 586857 - RNA, 19 nt, Homo sapiens
gaaguuauacguaaugaug

SEQ ID NO: 586858 - RNA, 19 nt, Homo sapiens
gcaccaauauucuuucaca

SEQ ID NO: 586859 - RNA, 19 nt, Homo sapiens
ccagggaaguuauacguaa

SEQ ID NO: 586860 - RNA, 19 nt, Homo sapiens
gaggcaauguguccaaauu

SEQ ID NO: 586861 - RNA, 19 nt, Homo sapiens
gcuaagaugugcaggauag

SEQ ID NO: 586862 - RNA, 19 nt, Homo sapiens
uaugaaaucuucccaaaca

SEQ ID NO: 586863 - RNA, 19 nt, Homo sapiens
gaacuugaagguguuauaa

SEQ ID NO: 586864 - RNA, 19 nt, Homo sapiens
aagauggacucuaaacuuu

SEQ ID NO: 586865 - RNA, 19 nt, Homo sapiens
cagcuggauucaucuaaua

SEQ ID NO: 586866 - RNA, 19 nt, Homo sapiens
gcacaaagaccaguauaau

SEQ ID NO: 586867 - RNA, 19 nt, Homo sapiens
ugaagaagaagaagaagua

SEQ ID NO: 586868 - RNA, 19 nt, Homo sapiens
gaggaaagaacugccauua

SEQ ID NO: 586869 - RNA, 19 nt, Homo sapiens
cagaagaaauugguagauu

SEQ ID NO: 586870 - RNA, 19 nt, Homo sapiens
caagacagagugaagauuu

SEQ ID NO: 586871 - RNA, 19 nt, Homo sapiens
gcucucaaaucauuaucua

SEQ ID NO: 586872 - RNA, 19 nt, Homo sapiens
gaauguguauugaauugga

SEQ ID NO: 586873 - RNA, 19 nt, Homo sapiens
cagcagguuucuacauuaa

SEQ ID NO: 586874 - RNA, 19 nt, Homo sapiens
gcuaagcaauugucccauu

SEQ ID NO: 586875 - RNA, 19 nt, Homo sapiens
gcauuugaguccuuaguug

SEQ ID NO: 586876 - RNA, 19 nt, Homo sapiens
uaucauaacucugaagaug

SEQ ID NO: 586877 - RNA, 19 nt, Homo sapiens
gcaaacaugaguuguauuc

SEQ ID NO: 586878 - RNA, 19 nt, Homo sapiens
caaagagaauuucauagag

SEQ ID NO: 586879 - RNA, 19 nt, Homo sapiens
gcaauguguccaaauuuaa

SEQ ID NO: 586880 - RNA, 19 nt, Homo sapiens
ggaagacugucagcauuau

SEQ ID NO: 586881 - RNA, 19 nt, Homo sapiens
ggaugaggaugaugaaagu

SEQ ID NO: 586882 - RNA, 19 nt, Homo sapiens
agaauaaacucaaggaucu

SEQ ID NO: 586883 - RNA, 19 nt, Homo sapiens
gaauuaaggcagcagguuu

SEQ ID NO: 586884 - RNA, 19 nt, Homo sapiens
caacagugcaccaauauuc

SEQ ID NO: 586885 - RNA, 19 nt, Homo sapiens
gcgcugugcuguucucuau

SEQ ID NO: 586886 - RNA, 19 nt, Homo sapiens
aacaggaacuggcaacuuu

SEQ ID NO: 586887 - RNA, 19 nt, Homo sapiens
agaagaaauugguagauug

SEQ ID NO: 586888 - RNA, 19 nt, Homo sapiens
gaacagcaugacaauauug

SEQ ID NO: 586889 - RNA, 19 nt, Homo sapiens
gaagaggauuggcaaagag

SEQ ID NO: 586890 - RNA, 19 nt, Homo sapiens
gugcuguucucuauuguuu

SEQ ID NO: 586891 - RNA, 19 nt, Homo sapiens
ucacucuucuguuaucuuu

SEQ ID NO: 586892 - RNA, 19 nt, Homo sapiens
ugaauagguuuaagucaga

SEQ ID NO: 586893 - RNA, 19 nt, Homo sapiens
gaacaaguugcagaauuaa

SEQ ID NO: 586894 - RNA, 19 nt, Homo sapiens
guaccuggcuaagcaauug

SEQ ID NO: 586895 - RNA, 19 nt, Homo sapiens
caaucuacaucuaaugcua

SEQ ID NO: 586896 - RNA, 19 nt, Homo sapiens
aaacagaucguucagauuc

SEQ ID NO: 586897 - RNA, 19 nt, Homo sapiens
agaagaggaugaacuugaa

SEQ ID NO: 586898 - RNA, 19 nt, Homo sapiens
gaacagucuucagcaauag

SEQ ID NO: 586899 - RNA, 19 nt, Homo sapiens
ggcagcagguuucuacauu

SEQ ID NO: 586900 - RNA, 19 nt, Homo sapiens
guuauuauguggagguuug

SEQ ID NO: 586901 - RNA, 19 nt, Homo sapiens
gcugugcuguucucuauug

SEQ ID NO: 586902 - RNA, 19 nt, Homo sapiens
aacaacaacuccaaucaaa

SEQ ID NO: 586903 - RNA, 19 nt, Homo sapiens
guacuaacacauuugauug

SEQ ID NO: 586904 - RNA, 19 nt, Homo sapiens
uagaacagcaugacaauau

SEQ ID NO: 586905 - RNA, 19 nt, Homo sapiens
gaccaaagaguuaaagaau

SEQ ID NO: 586906 - RNA, 19 nt, Homo sapiens
acaaacaagaguuggauua

SEQ ID NO: 586907 - RNA, 19 nt, Homo sapiens
gcugauauccugacugaga

SEQ ID NO: 586908 - RNA, 19 nt, Homo sapiens
gaaagugaccaaucuacau

SEQ ID NO: 586909 - RNA, 19 nt, Homo sapiens
gcacuaacaagaagcaaug

SEQ ID NO: 586910 - RNA, 19 nt, Homo sapiens
acaaacagaucguucagau

SEQ ID NO: 586911 - RNA, 19 nt, Homo sapiens
gaaagaacugccauuaaag

SEQ ID NO: 586912 - RNA, 19 nt, Homo sapiens
acaagagaccaaagaguua

SEQ ID NO: 586913 - RNA, 19 nt, Homo sapiens
gcaucaagguucuuacagu

SEQ ID NO: 586914 - RNA, 19 nt, Homo sapiens
uagcaaacaugaguuguau

SEQ ID NO: 586915 - RNA, 19 nt, Homo sapiens
cuucaacagugcaccaaua

SEQ ID NO: 586916 - RNA, 19 nt, Homo sapiens
gcccaugcguugcaagaaa

SEQ ID NO: 586917 - RNA, 19 nt, Homo sapiens
gcacagaaagugaccaauc

SEQ ID NO: 586918 - RNA, 19 nt, Homo sapiens
gagagacuacuggacauua

SEQ ID NO: 586919 - RNA, 19 nt, Homo sapiens
uaagaaauaccgcuuggaa

SEQ ID NO: 586920 - RNA, 19 nt, Homo sapiens
guucauacaacucagauuu

SEQ ID NO: 586921 - RNA, 19 nt, Homo sapiens
caucagcccuccaucuaau

SEQ ID NO: 586922 - RNA, 19 nt, Homo sapiens
gcagcuggauucaucuaau

SEQ ID NO: 586923 - RNA, 19 nt, Homo sapiens
gaaggaagacugucagcau

SEQ ID NO: 586924 - RNA, 19 nt, Homo sapiens
ucaccaaacuacagacaga

SEQ ID NO: 586925 - RNA, 19 nt, Homo sapiens
gcacaaaugaacagucuuc

SEQ ID NO: 586926 - RNA, 19 nt, Homo sapiens
guauaguaguugaagauug

SEQ ID NO: 586927 - RNA, 19 nt, Homo sapiens
gaagaagaaguagaagaaa

SEQ ID NO: 586928 - RNA, 19 nt, Homo sapiens
uagagauucugaacaaguu

SEQ ID NO: 586929 - RNA, 19 nt, Homo sapiens
aaacaucuggcacaaauga

SEQ ID NO: 586930 - RNA, 19 nt, Homo sapiens
ugauggagguauaguaguu

SEQ ID NO: 586931 - RNA, 19 nt, Homo sapiens
uuaaagagcagcuggauuc

SEQ ID NO: 586932 - RNA, 19 nt, Homo sapiens
ggaaguggguauacaagcu

SEQ ID NO: 586933 - RNA, 19 nt, Homo sapiens
aguuucagcuggccaguua

SEQ ID NO: 586934 - RNA, 19 nt, Homo sapiens
ugacugagaccauaaauac

SEQ ID NO: 586935 - RNA, 19 nt, Homo sapiens
gcaacaguguauuaaugug

SEQ ID NO: 586936 - RNA, 19 nt, Homo sapiens
ucauaacucugaagaugga

SEQ ID NO: 586937 - RNA, 19 nt, Homo sapiens
uuucaaaucucuaggaaca

SEQ ID NO: 586938 - RNA, 19 nt, Homo sapiens
gaaguggguauacaagcua

SEQ ID NO: 586939 - RNA, 19 nt, Homo sapiens
gaaccaggauugcauuuga

SEQ ID NO: 586940 - RNA, 19 nt, Homo sapiens
gagcaccauucuuuaaaua

SEQ ID NO: 586941 - RNA, 19 nt, Homo sapiens
cuacagagauuuccgauug

SEQ ID NO: 586942 - RNA, 19 nt, Homo sapiens
ggaaaugggccaagaguuu

SEQ ID NO: 586943 - RNA, 19 nt, Homo sapiens
caacuaccaugagauguua

SEQ ID NO: 586944 - RNA, 19 nt, Homo sapiens
gaggagauguacauagaaa

SEQ ID NO: 586945 - RNA, 19 nt, Homo sapiens
gcaagucuccaacaauuaa

SEQ ID NO: 586946 - RNA, 19 nt, Homo sapiens
gaagacgauuagaccauuu

SEQ ID NO: 586947 - RNA, 19 nt, Homo sapiens
guccaugucuauauguuua

SEQ ID NO: 586948 - RNA, 19 nt, Homo sapiens
guaccaagauuagcaaaug

SEQ ID NO: 586949 - RNA, 19 nt, Homo sapiens
caauacaacugccauuuua

SEQ ID NO: 586950 - RNA, 19 nt, Homo sapiens
ggacuuacagcuucauauu

SEQ ID NO: 586951 - RNA, 19 nt, Homo sapiens
ggauauuccuucaguagau

SEQ ID NO: 586952 - RNA, 19 nt, Homo sapiens
ucaaguacauucacucugu

SEQ ID NO: 586953 - RNA, 19 nt, Homo sapiens
guauguggaugccaguuaa

SEQ ID NO: 586954 - RNA, 19 nt, Homo sapiens
ggagcaccauucuuuaaau

SEQ ID NO: 586955 - RNA, 19 nt, Homo sapiens
caugagauguuaucaauac

SEQ ID NO: 586956 - RNA, 19 nt, Homo sapiens
gcauguccuuagucuguua

SEQ ID NO: 586957 - RNA, 19 nt, Homo sapiens
ggauugcauuugaaguuaa

SEQ ID NO: 586958 - RNA, 19 nt, Homo sapiens
ucagauguccuaagaauau

SEQ ID NO: 586959 - RNA, 19 nt, Homo sapiens
guuaacccauccuucauuu

SEQ ID NO: 586960 - RNA, 19 nt, Homo sapiens
acacauagaucugcuuugu

SEQ ID NO: 586961 - RNA, 19 nt, Homo sapiens
caaguuguccucuaaaugu

SEQ ID NO: 586962 - RNA, 19 nt, Homo sapiens
ggauugauucucuuaauug

SEQ ID NO: 586963 - RNA, 19 nt, Homo sapiens
acauagaucugcuuugugu

SEQ ID NO: 586964 - RNA, 19 nt, Homo sapiens
ggaggaagccacagcauca

SEQ ID NO: 586965 - RNA, 19 nt, Homo sapiens
caauaugcaccauguuuaa

SEQ ID NO: 586966 - RNA, 19 nt, Homo sapiens
gaaaugggccaagaguuug

SEQ ID NO: 586967 - RNA, 19 nt, Homo sapiens
gcuauuucuuuccauguaa

SEQ ID NO: 586968 - RNA, 19 nt, Homo sapiens
ucaauaugcaccauguuua

SEQ ID NO: 586969 - RNA, 19 nt, Homo sapiens
ggaugccaguuaauuaaau

SEQ ID NO: 586970 - RNA, 19 nt, Homo sapiens
ugccaaagcucaaucaaca

SEQ ID NO: 586971 - RNA, 19 nt, Homo sapiens
gcaccauguuuaauguuau

SEQ ID NO: 586972 - RNA, 19 nt, Homo sapiens
gauauuccuucaguagauu

SEQ ID NO: 586973 - RNA, 19 nt, Homo sapiens
aggcaagucuccaacaauu

SEQ ID NO: 586974 - RNA, 19 nt, Homo sapiens
guccuuagucuguuaguua

SEQ ID NO: 586975 - RNA, 19 nt, Homo sapiens
caaaguucguuacuaucuu

SEQ ID NO: 586976 - RNA, 19 nt, Homo sapiens
aaacuguggcuucucaaua

SEQ ID NO: 586977 - RNA, 19 nt, Homo sapiens
gcagagcuauuucuuucca

SEQ ID NO: 586978 - RNA, 19 nt, Homo sapiens
ucaguagauuguaaccaua

SEQ ID NO: 586979 - RNA, 19 nt, Homo sapiens
aacuguggcuucucaauaa

SEQ ID NO: 586980 - RNA, 19 nt, Homo sapiens
cugcagagcuauuucuuuc

SEQ ID NO: 586981 - RNA, 19 nt, Homo sapiens
ggacagcgaugaggaagac

SEQ ID NO: 586982 - RNA, 19 nt, Homo sapiens
ggacuuuguuuucuucuuu

SEQ ID NO: 586983 - RNA, 19 nt, Homo sapiens
gcaaaguucguuacuaucu

SEQ ID NO: 586984 - RNA, 19 nt, Homo sapiens
gaaggacagcgaugaggaa

SEQ ID NO: 586985 - RNA, 19 nt, Homo sapiens
uugcaaaguucguuacuau

SEQ ID NO: 586986 - RNA, 19 nt, Homo sapiens
uagacgaacuaauugaaga

SEQ ID NO: 586987 - RNA, 19 nt, Homo sapiens
ccaaagcucaaucaacaaa

SEQ ID NO: 586988 - RNA, 19 nt, Homo sapiens
gagaauacauagucuaacc

SEQ ID NO: 586989 - RNA, 19 nt, Homo sapiens
gcaccauucuuuaaauacu

SEQ ID NO: 586990 - RNA, 19 nt, Homo sapiens
gcuaugugguaccaagauu

SEQ ID NO: 586991 - RNA, 19 nt, Homo sapiens
aaaguucguuacuaucuug

SEQ ID NO: 586992 - RNA, 19 nt, Homo sapiens
ggaaaacuguggcuucuca

SEQ ID NO: 586993 - RNA, 19 nt, Homo sapiens
ucucaacuguguauguaaa

SEQ ID NO: 586994 - RNA, 19 nt, Homo sapiens
cgucucaacuguguaugua

SEQ ID NO: 586995 - RNA, 19 nt, Homo sapiens
gaugccaguuaauuaaaug

SEQ ID NO: 586996 - RNA, 19 nt, Homo sapiens
guuaaacccauuaccaauu

SEQ ID NO: 586997 - RNA, 19 nt, Homo sapiens
cauguacuauguaugcauu

SEQ ID NO: 586998 - RNA, 19 nt, Homo sapiens
ugacgaagggacuuuguuu

SEQ ID NO: 586999 - RNA, 19 nt, Homo sapiens
gcauggaaaugggccaaga

SEQ ID NO: 587000 - RNA, 19 nt, Homo sapiens
aaaggcaagucuccaacaa

SEQ ID NO: 587001 - RNA, 19 nt, Homo sapiens
caaguacauucacucuguu

SEQ ID NO: 587002 - RNA, 19 nt, Homo sapiens
ccuauagacuuacaucaag

SEQ ID NO: 587003 - RNA, 19 nt, Homo sapiens
uguggcuucucaauaaaua

SEQ ID NO: 587004 - RNA, 19 nt, Homo sapiens
ugcaccauguuuaauguua

SEQ ID NO: 587005 - RNA, 19 nt, Homo sapiens
ggcaagucuccaacaauua

SEQ ID NO: 587006 - RNA, 19 nt, Homo sapiens
aggauugcauuugaaguua

SEQ ID NO: 587007 - RNA, 19 nt, Homo sapiens
guggaugccaguuaauuaa

SEQ ID NO: 587008 - RNA, 19 nt, Homo sapiens
agaagacgauuagaccauu

SEQ ID NO: 587009 - RNA, 19 nt, Homo sapiens
ccacugauuuccugauguc

SEQ ID NO: 587010 - RNA, 19 nt, Homo sapiens
gauguacauagaaagguua

SEQ ID NO: 587011 - RNA, 19 nt, Homo sapiens
cgaacuaauugaagaaacu

SEQ ID NO: 587012 - RNA, 19 nt, Homo sapiens
gcuaaaauguggcaucaau

SEQ ID NO: 587013 - RNA, 19 nt, Homo sapiens
uaucagcaaagaucaauga

SEQ ID NO: 587014 - RNA, 19 nt, Homo sapiens
ggaagacgaagaagacgau

SEQ ID NO: 587015 - RNA, 19 nt, Homo sapiens
gacuuacagcuucauauuu

SEQ ID NO: 587016 - RNA, 19 nt, Homo sapiens
uaacccauccuucauuuua

SEQ ID NO: 587017 - RNA, 19 nt, Homo sapiens
guacauucacucuguuuca

SEQ ID NO: 587018 - RNA, 19 nt, Homo sapiens
uaccaagauuagcaaauga

SEQ ID NO: 587019 - RNA, 19 nt, Homo sapiens
gagauguuaucaauacaac

SEQ ID NO: 587020 - RNA, 19 nt, Homo sapiens
uaacacucuugguugcaaa

SEQ ID NO: 587021 - RNA, 19 nt, Homo sapiens
gucaauaugcaccauguuu

SEQ ID NO: 587022 - RNA, 19 nt, Homo sapiens
gaagggacuuuguuuucuu

SEQ ID NO: 587023 - RNA, 19 nt, Homo sapiens
auauucagauguccuaaga

SEQ ID NO: 587024 - RNA, 19 nt, Homo sapiens
uuacaacccuagacuaaaa

SEQ ID NO: 587025 - RNA, 19 nt, Homo sapiens
accaugagauguuaucaau

SEQ ID NO: 587026 - RNA, 19 nt, Homo sapiens
gugcauguccuuagucugu

SEQ ID NO: 587027 - RNA, 19 nt, Homo sapiens
gaagccacagcaucaguga

SEQ ID NO: 587028 - RNA, 19 nt, Homo sapiens
gccaagaguuugcuaaaau

SEQ ID NO: 587029 - RNA, 19 nt, Homo sapiens
augaggagauguacauaga

SEQ ID NO: 587030 - RNA, 19 nt, Homo sapiens
aauuacaacccuagacuaa

SEQ ID NO: 587031 - RNA, 19 nt, Homo sapiens
caggauugcauuugaaguu

SEQ ID NO: 587032 - RNA, 19 nt, Homo sapiens
aaacacauagaucugcuuu

SEQ ID NO: 587033 - RNA, 19 nt, Homo sapiens
uguggaugccaguuaauua

SEQ ID NO: 587034 - RNA, 19 nt, Homo sapiens
gauguuaucaauacaacug

SEQ ID NO: 587035 - RNA, 19 nt, Homo sapiens
cuaauuaggaugguaaaga

SEQ ID NO: 587036 - RNA, 19 nt, Homo sapiens
uaaggucaaugaggagaug

SEQ ID NO: 587037 - RNA, 19 nt, Homo sapiens
guucguuacuaucuuggaa

SEQ ID NO: 587038 - RNA, 19 nt, Homo sapiens
aaacuuugcagcauggaaa

SEQ ID NO: 587039 - RNA, 19 nt, Homo sapiens
gagccaagccuuccuguuu

SEQ ID NO: 587040 - RNA, 19 nt, Homo sapiens
gaucccagguggcuccuaa

SEQ ID NO: 587041 - RNA, 19 nt, Homo sapiens
gggaacagcagguauaaga

SEQ ID NO: 587042 - RNA, 19 nt, Homo sapiens
ccucaacgcuuugggaaga

SEQ ID NO: 587043 - RNA, 19 nt, Homo sapiens
ccagguggcuccuaaugag

SEQ ID NO: 587044 - RNA, 19 nt, Homo sapiens
ccagagguuuggcagaaau

SEQ ID NO: 587045 - RNA, 19 nt, Homo sapiens
guagguggcagcauggauu

SEQ ID NO: 587046 - RNA, 19 nt, Homo sapiens
ucauuugccugcucuagau

SEQ ID NO: 587047 - RNA, 19 nt, Homo sapiens
gccaagccuuccuguuuca

SEQ ID NO: 587048 - RNA, 19 nt, Homo sapiens
gggcugaauucccaguucu

SEQ ID NO: 587049 - RNA, 19 nt, Homo sapiens
cugggucacuguugcacua

SEQ ID NO: 587050 - RNA, 19 nt, Homo sapiens
gagcccugcauuucauuug

SEQ ID NO: 587051 - RNA, 19 nt, Homo sapiens
gugcugcugcuguuaauag

SEQ ID NO: 587052 - RNA, 19 nt, Homo sapiens
cagagguuuggcagaaaua

SEQ ID NO: 587053 - RNA, 19 nt, Homo sapiens
agccaagccuuccuguuuc

SEQ ID NO: 587054 - RNA, 19 nt, Homo sapiens
ggaacagcagguauaagag

SEQ ID NO: 587055 - RNA, 19 nt, Homo sapiens
gguggcagcauggauucua

SEQ ID NO: 587056 - RNA, 19 nt, Homo sapiens
ggagccaagccuuccuguu

SEQ ID NO: 587057 - RNA, 19 nt, Homo sapiens
caggaggccagcaggaaga

SEQ ID NO: 587058 - RNA, 19 nt, Homo sapiens
gaugauguuuccacaauua

SEQ ID NO: 587059 - RNA, 19 nt, Homo sapiens
gcagaaagaugugcuacua

SEQ ID NO: 587060 - RNA, 19 nt, Homo sapiens
gcaagauugucaugaguua

SEQ ID NO: 587061 - RNA, 19 nt, Homo sapiens
gcaauaucgucgaaaguua

SEQ ID NO: 587062 - RNA, 19 nt, Homo sapiens
uaacuauggugguaacuua

SEQ ID NO: 587063 - RNA, 19 nt, Homo sapiens
cagcaaagaugcacaacua

SEQ ID NO: 587064 - RNA, 19 nt, Homo sapiens
gcugauagcuuacgaggaa

SEQ ID NO: 587065 - RNA, 19 nt, Homo sapiens
ggagcaacauguagcuuua

SEQ ID NO: 587066 - RNA, 19 nt, Homo sapiens
aaagggcacugauuuauuu

SEQ ID NO: 587067 - RNA, 19 nt, Homo sapiens
gauauucagucuuuggaua

SEQ ID NO: 587068 - RNA, 19 nt, Homo sapiens
gaagaaagucggccguaua

SEQ ID NO: 587069 - RNA, 19 nt, Homo sapiens
uaaagacacuggagaaaug

SEQ ID NO: 587070 - RNA, 19 nt, Homo sapiens
gaaagucggccguauacua

SEQ ID NO: 587071 - RNA, 19 nt, Homo sapiens
caagaaagcagucauaguu

SEQ ID NO: 587072 - RNA, 19 nt, Homo sapiens
gcaccugcuuucaguguua

SEQ ID NO: 587073 - RNA, 19 nt, Homo sapiens
gcaaagaugcacaacuaua

SEQ ID NO: 587074 - RNA, 19 nt, Homo sapiens
gcgcuagacuuauuugauu

SEQ ID NO: 587075 - RNA, 19 nt, Homo sapiens
ggacaaaggugcauuuuau

SEQ ID NO: 587076 - RNA, 19 nt, Homo sapiens
ccaaggaccuggauauuca

SEQ ID NO: 587077 - RNA, 19 nt, Homo sapiens
uaacgaagguggaaaauaa

SEQ ID NO: 587078 - RNA, 19 nt, Homo sapiens
ggacagaccuggacuucuc

SEQ ID NO: 587079 - RNA, 19 nt, Homo sapiens
caaagaugcacaacuauaa

SEQ ID NO: 587080 - RNA, 19 nt, Homo sapiens
gaaagggcacugauuuauu

SEQ ID NO: 587081 - RNA, 19 nt, Homo sapiens
ugaggaagaucuagauuau

SEQ ID NO: 587082 - RNA, 19 nt, Homo sapiens
gggcaugacugaugauguu

SEQ ID NO: 587083 - RNA, 19 nt, Homo sapiens
gagaaggugggauugauua

SEQ ID NO: 587084 - RNA, 19 nt, Homo sapiens
gcacugauuuauuugguau

SEQ ID NO: 587085 - RNA, 19 nt, Homo sapiens
gagaaaugguagccuuaaa

SEQ ID NO: 587086 - RNA, 19 nt, Homo sapiens
ggagaagggucuugcauac

SEQ ID NO: 587087 - RNA, 19 nt, Homo sapiens
ggaaauagugacugauaaa

SEQ ID NO: 587088 - RNA, 19 nt, Homo sapiens
gauaucaucggaauuauug

SEQ ID NO: 587089 - RNA, 19 nt, Homo sapiens
gaaucaggcuugguucauu

SEQ ID NO: 587090 - RNA, 19 nt, Homo sapiens
aaacacaaccuuucucuug

SEQ ID NO: 587091 - RNA, 19 nt, Homo sapiens
gaauucagccuucuucuca

SEQ ID NO: 587092 - RNA, 19 nt, Homo sapiens
caccagaucucccuuuaug

SEQ ID NO: 587093 - RNA, 19 nt, Homo sapiens
gaagcaauaucgucgaaag

SEQ ID NO: 587094 - RNA, 19 nt, Homo sapiens
gaagauaaagaagcugaua

SEQ ID NO: 587095 - RNA, 19 nt, Homo sapiens
gagaguaaaucugcugcua

SEQ ID NO: 587096 - RNA, 19 nt, Homo sapiens
gaauauagccaugguccua

SEQ ID NO: 587097 - RNA, 19 nt, Homo sapiens
ugaaggaaauagugacuga

SEQ ID NO: 587098 - RNA, 19 nt, Homo sapiens
gaaaacaacaacacaguua

SEQ ID NO: 587099 - RNA, 19 nt, Homo sapiens
ggagaaggagcaacaugua

SEQ ID NO: 587100 - RNA, 19 nt, Homo sapiens
gauaaaacuugcagacuuu

SEQ ID NO: 587101 - RNA, 19 nt, Homo sapiens
guaaaucugcugcuacaaa

SEQ ID NO: 587102 - RNA, 19 nt, Homo sapiens
caccaccaguucuucauua

SEQ ID NO: 587103 - RNA, 19 nt, Homo sapiens
agaaagaugugcuacuaga

SEQ ID NO: 587104 - RNA, 19 nt, Homo sapiens
cagcugcgcuagacuuauu

SEQ ID NO: 587105 - RNA, 19 nt, Homo sapiens
gaugucuucuugcugauuu

SEQ ID NO: 587106 - RNA, 19 nt, Homo sapiens
cagaaagggcacugauuua

SEQ ID NO: 587107 - RNA, 19 nt, Homo sapiens
agacaaggaccauagauuu

SEQ ID NO: 587108 - RNA, 19 nt, Homo sapiens
gaagaugcuuuggauuuca

SEQ ID NO: 587109 - RNA, 19 nt, Homo sapiens
aaacuccgaugucuucuug

SEQ ID NO: 587110 - RNA, 19 nt, Homo sapiens
gaguaaaucugcugcuaca

SEQ ID NO: 587111 - RNA, 19 nt, Homo sapiens
cagcugaauugaacaagaa

SEQ ID NO: 587112 - RNA, 19 nt, Homo sapiens
guauggagcuguggcugua

SEQ ID NO: 587113 - RNA, 19 nt, Homo sapiens
gaaggacaaaggugcauuu

SEQ ID NO: 587114 - RNA, 19 nt, Homo sapiens
acaacacaguuacauagua

SEQ ID NO: 587115 - RNA, 19 nt, Homo sapiens
aaacaaaccaugugaagga

SEQ ID NO: 587116 - RNA, 19 nt, Homo sapiens
gcacaacuauaacuauggu

SEQ ID NO: 587117 - RNA, 19 nt, Homo sapiens
caacaacacaguuacauag

SEQ ID NO: 587118 - RNA, 19 nt, Homo sapiens
ggaaucaguaucucuuaaa

SEQ ID NO: 587119 - RNA, 19 nt, Homo sapiens
ucaaacacuucuacaccua

SEQ ID NO: 587120 - RNA, 19 nt, Homo sapiens
agaagggucuugcauacaa

SEQ ID NO: 587121 - RNA, 19 nt, Homo sapiens
ggucuggauuauugucaua

SEQ ID NO: 587122 - RNA, 19 nt, Homo sapiens
gcaaggaccgggacucgaa

SEQ ID NO: 587123 - RNA, 19 nt, Homo sapiens
ggaaaacucugcguggaua

SEQ ID NO: 587124 - RNA, 19 nt, Homo sapiens
gcagcugaauugaacaaga

SEQ ID NO: 587125 - RNA, 19 nt, Homo sapiens
guguuaauauggcugauuu

SEQ ID NO: 587126 - RNA, 19 nt, Homo sapiens
ugucaugaguuauggagua

SEQ ID NO: 587127 - RNA, 19 nt, Homo sapiens
ggacuugcucgauuguaua

SEQ ID NO: 587128 - RNA, 19 nt, Homo sapiens
aauaauagagggcagauaa

SEQ ID NO: 587129 - RNA, 19 nt, Homo sapiens
gaaucaguaucucuuaaag

SEQ ID NO: 587130 - RNA, 19 nt, Homo sapiens
ggucuugcauacaauaguu

SEQ ID NO: 587131 - RNA, 19 nt, Homo sapiens
caacaggagucuucgaaac

SEQ ID NO: 587132 - RNA, 19 nt, Homo sapiens
gaagaagacagaagcagau

SEQ ID NO: 587133 - RNA, 19 nt, Homo sapiens
ucaggaacuugcacaacua

SEQ ID NO: 587134 - RNA, 19 nt, Homo sapiens
uggagggucuggauuauug

SEQ ID NO: 587135 - RNA, 19 nt, Homo sapiens
ggauaaagacacuggagaa

SEQ ID NO: 587136 - RNA, 19 nt, Homo sapiens
aaacaaagccaccucuuca

SEQ ID NO: 587137 - RNA, 19 nt, Homo sapiens
aagaagaugcuuuggauuu

SEQ ID NO: 587138 - RNA, 19 nt, Homo sapiens
caaaccaugugaaggaugu

SEQ ID NO: 587139 - RNA, 19 nt, Homo sapiens
gaaccagaccggccucgaa

SEQ ID NO: 587140 - RNA, 19 nt, Homo sapiens
gaaagaugugcuacuagaa

SEQ ID NO: 587141 - RNA, 19 nt, Homo sapiens
gcaguucuguugacucagu

SEQ ID NO: 587142 - RNA, 19 nt, Homo sapiens
caagguaauuacuuuaugg

SEQ ID NO: 587143 - RNA, 19 nt, Homo sapiens
gcagaagcccguauucauc

SEQ ID NO: 587144 - RNA, 19 nt, Homo sapiens
gaagucgucauucuaguau

SEQ ID NO: 587145 - RNA, 19 nt, Homo sapiens
caaggaccauagauuugaa

SEQ ID NO: 587146 - RNA, 19 nt, Homo sapiens
gaaaauggaucgggacaug

SEQ ID NO: 587147 - RNA, 19 nt, Homo sapiens
ucuguugacucaguuaaua

SEQ ID NO: 587148 - RNA, 19 nt, Homo sapiens
cuacuaaaccuacuacaau

SEQ ID NO: 587149 - RNA, 19 nt, Homo sapiens
gaacuugcacaacuagaau

SEQ ID NO: 587150 - RNA, 19 nt, Homo sapiens
gagaaaaccaaaccacuua

SEQ ID NO: 587151 - RNA, 19 nt, Homo sapiens
gaggaaucaguaucucuua

SEQ ID NO: 587152 - RNA, 19 nt, Homo sapiens
gcagaggguuaccauacug

SEQ ID NO: 587153 - RNA, 19 nt, Homo sapiens
ggacauauuagcacaucaa

SEQ ID NO: 587154 - RNA, 19 nt, Homo sapiens
gagacaaggaccauagauu

SEQ ID NO: 587155 - RNA, 19 nt, Homo sapiens
gaagcgucauuacaacuca

SEQ ID NO: 587156 - RNA, 19 nt, Homo sapiens
acauuaagguaaacucuga

SEQ ID NO: 587157 - RNA, 19 nt, Homo sapiens
caauaucgucgaaaguuaa

SEQ ID NO: 587158 - RNA, 19 nt, Homo sapiens
gaugauguuuccacaauua

SEQ ID NO: 587159 - RNA, 19 nt, Homo sapiens
gcagaaagaugugcuacua

SEQ ID NO: 587160 - RNA, 19 nt, Homo sapiens
gcaagauugucaugaguua

SEQ ID NO: 587161 - RNA, 19 nt, Homo sapiens
gcaauaucgucgaaaguua

SEQ ID NO: 587162 - RNA, 19 nt, Homo sapiens
uaacuauggugguaacuua

SEQ ID NO: 587163 - RNA, 19 nt, Homo sapiens
cagcaaagaugcacaacua

SEQ ID NO: 587164 - RNA, 19 nt, Homo sapiens
gcugauagcuuacgaggaa

SEQ ID NO: 587165 - RNA, 19 nt, Homo sapiens
ggagcaacauguagcuuua

SEQ ID NO: 587166 - RNA, 19 nt, Homo sapiens
aaagggcacugauuuauuu

SEQ ID NO: 587167 - RNA, 19 nt, Homo sapiens
gauauucagucuuuggaua

SEQ ID NO: 587168 - RNA, 19 nt, Homo sapiens
gaagaaagucggccguaua

SEQ ID NO: 587169 - RNA, 19 nt, Homo sapiens
uaaagacacuggagaaaug

SEQ ID NO: 587170 - RNA, 19 nt, Homo sapiens
gaaagucggccguauacua

SEQ ID NO: 587171 - RNA, 19 nt, Homo sapiens
caagaaagcagucauaguu

SEQ ID NO: 587172 - RNA, 19 nt, Homo sapiens
gcaccugcuuucaguguua

SEQ ID NO: 587173 - RNA, 19 nt, Homo sapiens
gcaaagaugcacaacuaua

SEQ ID NO: 587174 - RNA, 19 nt, Homo sapiens
gcgcuagacuuauuugauu

SEQ ID NO: 587175 - RNA, 19 nt, Homo sapiens
ggacaaaggugcauuuuau

SEQ ID NO: 587176 - RNA, 19 nt, Homo sapiens
ccaaggaccuggauauuca

SEQ ID NO: 587177 - RNA, 19 nt, Homo sapiens
uaacgaagguggaaaauaa

SEQ ID NO: 587178 - RNA, 19 nt, Homo sapiens
ggacagaccuggacuucuc

SEQ ID NO: 587179 - RNA, 19 nt, Homo sapiens
caaagaugcacaacuauaa

SEQ ID NO: 587180 - RNA, 19 nt, Homo sapiens
gaaagggcacugauuuauu

SEQ ID NO: 587181 - RNA, 19 nt, Homo sapiens
ugaggaagaucuagauuau

SEQ ID NO: 587182 - RNA, 19 nt, Homo sapiens
gggcaugacugaugauguu

SEQ ID NO: 587183 - RNA, 19 nt, Homo sapiens
gagaaggugggauugauua

SEQ ID NO: 587184 - RNA, 19 nt, Homo sapiens
gcacugauuuauuugguau

SEQ ID NO: 587185 - RNA, 19 nt, Homo sapiens
gagaaaugguagccuuaaa

SEQ ID NO: 587186 - RNA, 19 nt, Homo sapiens
ggagaagggucuugcauac

SEQ ID NO: 587187 - RNA, 19 nt, Homo sapiens
ggaaauagugacugauaaa

SEQ ID NO: 587188 - RNA, 19 nt, Homo sapiens
gauaucaucggaauuauug

SEQ ID NO: 587189 - RNA, 19 nt, Homo sapiens
gaaucaggcuugguucauu

SEQ ID NO: 587190 - RNA, 19 nt, Homo sapiens
aaacacaaccuuucucuug

SEQ ID NO: 587191 - RNA, 19 nt, Homo sapiens
gaauucagccuucuucuca

SEQ ID NO: 587192 - RNA, 19 nt, Homo sapiens
caccagaucucccuuuaug

SEQ ID NO: 587193 - RNA, 19 nt, Homo sapiens
gaagcaauaucgucgaaag

SEQ ID NO: 587194 - RNA, 19 nt, Homo sapiens
gaagauaaagaagcugaua

SEQ ID NO: 587195 - RNA, 19 nt, Homo sapiens
gagaguaaaucugcugcua

SEQ ID NO: 587196 - RNA, 19 nt, Homo sapiens
gaauauagccaugguccua

SEQ ID NO: 587197 - RNA, 19 nt, Homo sapiens
ugaaggaaauagugacuga

SEQ ID NO: 587198 - RNA, 19 nt, Homo sapiens
gaaaacaacaacacaguua

SEQ ID NO: 587199 - RNA, 19 nt, Homo sapiens
ggagaaggagcaacaugua

SEQ ID NO: 587200 - RNA, 19 nt, Homo sapiens
gauaaaacuugcagacuuu

SEQ ID NO: 587201 - RNA, 19 nt, Homo sapiens
guaaaucugcugcuacaaa

SEQ ID NO: 587202 - RNA, 19 nt, Homo sapiens
caccaccaguucuucauua

SEQ ID NO: 587203 - RNA, 19 nt, Homo sapiens
agaaagaugugcuacuaga

SEQ ID NO: 587204 - RNA, 19 nt, Homo sapiens
cagcugcgcuagacuuauu

SEQ ID NO: 587205 - RNA, 19 nt, Homo sapiens
gaugucuucuugcugauuu

SEQ ID NO: 587206 - RNA, 19 nt, Homo sapiens
cagaaagggcacugauuua

SEQ ID NO: 587207 - RNA, 19 nt, Homo sapiens
agacaaggaccauagauuu

SEQ ID NO: 587208 - RNA, 19 nt, Homo sapiens
gaagaugcuuuggauuuca

SEQ ID NO: 587209 - RNA, 19 nt, Homo sapiens
aaacuccgaugucuucuug

SEQ ID NO: 587210 - RNA, 19 nt, Homo sapiens
gaguaaaucugcugcuaca

SEQ ID NO: 587211 - RNA, 19 nt, Homo sapiens
cagcugaauugaacaagaa

SEQ ID NO: 587212 - RNA, 19 nt, Homo sapiens
guauggagcuguggcugua

SEQ ID NO: 587213 - RNA, 19 nt, Homo sapiens
gaaggacaaaggugcauuu

SEQ ID NO: 587214 - RNA, 19 nt, Homo sapiens
acaacacaguuacauagua

SEQ ID NO: 587215 - RNA, 19 nt, Homo sapiens
aaacaaaccaugugaagga

SEQ ID NO: 587216 - RNA, 19 nt, Homo sapiens
gcacaacuauaacuauggu

SEQ ID NO: 587217 - RNA, 19 nt, Homo sapiens
caacaacacaguuacauag

SEQ ID NO: 587218 - RNA, 19 nt, Homo sapiens
ggaaucaguaucucuuaaa

SEQ ID NO: 587219 - RNA, 19 nt, Homo sapiens
ucaaacacuucuacaccua

SEQ ID NO: 587220 - RNA, 19 nt, Homo sapiens
agaagggucuugcauacaa

SEQ ID NO: 587221 - RNA, 19 nt, Homo sapiens
ggucuggauuauugucaua

SEQ ID NO: 587222 - RNA, 19 nt, Homo sapiens
gcaaggaccgggacucgaa

SEQ ID NO: 587223 - RNA, 19 nt, Homo sapiens
ggaaaacucugcguggaua

SEQ ID NO: 587224 - RNA, 19 nt, Homo sapiens
gcagcugaauugaacaaga

SEQ ID NO: 587225 - RNA, 19 nt, Homo sapiens
ugucaugaguuauggagua

SEQ ID NO: 587226 - RNA, 19 nt, Homo sapiens
ggacuugcucgauuguaua

SEQ ID NO: 587227 - RNA, 19 nt, Homo sapiens
aauaauagagggcagauaa

SEQ ID NO: 587228 - RNA, 19 nt, Homo sapiens
gaaucaguaucucuuaaag

SEQ ID NO: 587229 - RNA, 19 nt, Homo sapiens
ggucuugcauacaauaguu

SEQ ID NO: 587230 - RNA, 19 nt, Homo sapiens
caacaggagucuucgaaac

SEQ ID NO: 587231 - RNA, 19 nt, Homo sapiens
gaagaagacagaagcagau

SEQ ID NO: 587232 - RNA, 19 nt, Homo sapiens
ucaggaacuugcacaacua

SEQ ID NO: 587233 - RNA, 19 nt, Homo sapiens
uggagggucuggauuauug

SEQ ID NO: 587234 - RNA, 19 nt, Homo sapiens
ggauaaagacacuggagaa

SEQ ID NO: 587235 - RNA, 19 nt, Homo sapiens
aaacaaagccaccucuuca

SEQ ID NO: 587236 - RNA, 19 nt, Homo sapiens
aagaagaugcuuuggauuu

SEQ ID NO: 587237 - RNA, 19 nt, Homo sapiens
caaaccaugugaaggaugu

SEQ ID NO: 587238 - RNA, 19 nt, Homo sapiens
gaaccagaccggccucgaa

SEQ ID NO: 587239 - RNA, 19 nt, Homo sapiens
gaaagaugugcuacuagaa

SEQ ID NO: 587240 - RNA, 19 nt, Homo sapiens
gcaguucuguugacucagu

SEQ ID NO: 587241 - RNA, 19 nt, Homo sapiens
caagguaauuacuuuaugg

SEQ ID NO: 587242 - RNA, 19 nt, Homo sapiens
gcagaagcccguauucauc

SEQ ID NO: 587243 - RNA, 19 nt, Homo sapiens
gaagucgucauucuaguau

SEQ ID NO: 587244 - RNA, 19 nt, Homo sapiens
caaggaccauagauuugaa

SEQ ID NO: 587245 - RNA, 19 nt, Homo sapiens
gaaaauggaucgggacaug

SEQ ID NO: 587246 - RNA, 19 nt, Homo sapiens
ucuguugacucaguuaaua

SEQ ID NO: 587247 - RNA, 19 nt, Homo sapiens
gaacuugcacaacuagaau

SEQ ID NO: 587248 - RNA, 19 nt, Homo sapiens
gagaaaaccaaaccacuua

SEQ ID NO: 587249 - RNA, 19 nt, Homo sapiens
gaggaaucaguaucucuua

SEQ ID NO: 587250 - RNA, 19 nt, Homo sapiens
gcagaggguuaccauacug

SEQ ID NO: 587251 - RNA, 19 nt, Homo sapiens
ggacauauuagcacaucaa

SEQ ID NO: 587252 - RNA, 19 nt, Homo sapiens
gagacaaggaccauagauu

SEQ ID NO: 587253 - RNA, 19 nt, Homo sapiens
gaagcgucauuacaacuca

SEQ ID NO: 587254 - RNA, 19 nt, Homo sapiens
caauaucgucgaaaguuaa

SEQ ID NO: 587255 - RNA, 19 nt, Homo sapiens
uuaauaagccgaauaugug

SEQ ID NO: 587256 - RNA, 19 nt, Homo sapiens
ggaacuugcacaacuagaa

SEQ ID NO: 587257 - RNA, 19 nt, Homo sapiens
aaagucggccguauacuaa

SEQ ID NO: 587258 - RNA, 19 nt, Homo sapiens
ggacagaguucuagagauu

SEQ ID NO: 587259 - RNA, 19 nt, Homo sapiens
cgacagagcugguuauaga

SEQ ID NO: 587260 - RNA, 19 nt, Homo sapiens
ugaaggagcuaauguuuaa

SEQ ID NO: 587261 - RNA, 19 nt, Homo sapiens
gagaauagcagcauaauug

SEQ ID NO: 587262 - RNA, 19 nt, Homo sapiens
gguuauagaugcaauauug

SEQ ID NO: 587263 - RNA, 19 nt, Homo sapiens
gugaucagcucauccuuua

SEQ ID NO: 587264 - RNA, 19 nt, Homo sapiens
gaaguucgcucccaguuca

SEQ ID NO: 587265 - RNA, 19 nt, Homo sapiens
caagaggccuuccuuucua

SEQ ID NO: 587266 - RNA, 19 nt, Homo sapiens
ucucagaucucuuucauug

SEQ ID NO: 587267 - RNA, 19 nt, Homo sapiens
caacaucuuugaauuggaa

SEQ ID NO: 587268 - RNA, 19 nt, Homo sapiens
agacagagccucauucauu

SEQ ID NO: 587269 - RNA, 19 nt, Homo sapiens
ucaaacgcaugaugauuaa

SEQ ID NO: 587270 - RNA, 19 nt, Homo sapiens
gaaaagaacucgcugaucu

SEQ ID NO: 587271 - RNA, 19 nt, Homo sapiens
ggagauuuauggagaauag

SEQ ID NO: 587272 - RNA, 19 nt, Homo sapiens
ggaccaaauuacagauaaa

SEQ ID NO: 587273 - RNA, 19 nt, Homo sapiens
gaucauagacaaacucaga

SEQ ID NO: 587274 - RNA, 19 nt, Homo sapiens
caacagagaugacaaaaca

SEQ ID NO: 587275 - RNA, 19 nt, Homo sapiens
ugagaagacugucaggaaa

SEQ ID NO: 587276 - RNA, 19 nt, Homo sapiens
ucaugaagccauagaaaua

SEQ ID NO: 587277 - RNA, 19 nt, Homo sapiens
caaaggacacugugaauca

SEQ ID NO: 587278 - RNA, 19 nt, Homo sapiens
uccaugagcuuccuuuauu

SEQ ID NO: 587279 - RNA, 19 nt, Homo sapiens
ccaggauggugacuaagua

SEQ ID NO: 587280 - RNA, 19 nt, Homo sapiens
gacagagccucauucauuc

SEQ ID NO: 587281 - RNA, 19 nt, Homo sapiens
caucauugcuguuuagcuu

SEQ ID NO: 587282 - RNA, 19 nt, Homo sapiens
gcaggacccuauucagguu

SEQ ID NO: 587283 - RNA, 19 nt, Homo sapiens
gaggaucucugaggaguau

SEQ ID NO: 587284 - RNA, 19 nt, Homo sapiens
cuugaaugcuuucuugaua

SEQ ID NO: 587285 - RNA, 19 nt, Homo sapiens
uaaaagggguucaucuuaa

SEQ ID NO: 587286 - RNA, 19 nt, Homo sapiens
gcacgccaccgcuuucuuu

SEQ ID NO: 587287 - RNA, 19 nt, Homo sapiens
cagauaaacuaguuagcuu

SEQ ID NO: 587288 - RNA, 19 nt, Homo sapiens
gacacuagaugaccuaaag

SEQ ID NO: 587289 - RNA, 19 nt, Homo sapiens
gcaccaagccugcagaauc

SEQ ID NO: 587290 - RNA, 19 nt, Homo sapiens
ccucauucauucagauaua

SEQ ID NO: 587291 - RNA, 19 nt, Homo sapiens
cuguuuagcuugacuguuu

SEQ ID NO: 587292 - RNA, 19 nt, Homo sapiens
gaacaugugaauaaguuug

SEQ ID NO: 587293 - RNA, 19 nt, Homo sapiens
gaugaugggcuaccacaaa

SEQ ID NO: 587294 - RNA, 19 nt, Homo sapiens
ggcacuacaccaaguauua

SEQ ID NO: 587295 - RNA, 19 nt, Homo sapiens
gaacuucccugaaaaccaa

SEQ ID NO: 587296 - RNA, 19 nt, Homo sapiens
agaaaguuauguuccauga

SEQ ID NO: 587297 - RNA, 19 nt, Homo sapiens
uggaagccauuacgcauaa

SEQ ID NO: 587298 - RNA, 19 nt, Homo sapiens
caagauucaucgugauuca

SEQ ID NO: 587299 - RNA, 19 nt, Homo sapiens
ccaagucucagaucucuuu

SEQ ID NO: 587300 - RNA, 19 nt, Homo sapiens
caacagcacgugaagauca

SEQ ID NO: 587301 - RNA, 19 nt, Homo sapiens
ccaugagcuuccuuuauuu

SEQ ID NO: 587302 - RNA, 19 nt, Homo sapiens
gugaaggagcuaauguuua

SEQ ID NO: 587303 - RNA, 19 nt, Homo sapiens
gcagugguuucgcgaguau

SEQ ID NO: 587304 - RNA, 19 nt, Homo sapiens
gaacaaauacuuggcaaac

SEQ ID NO: 587305 - RNA, 19 nt, Homo sapiens
ccacaccagugaucuuguu

SEQ ID NO: 587306 - RNA, 19 nt, Homo sapiens
aaacagcccagucacagua

SEQ ID NO: 587307 - RNA, 19 nt, Homo sapiens
aaggugagcuccugggaaa

SEQ ID NO: 587308 - RNA, 19 nt, Homo sapiens
cagcucauccuuuaccaua

SEQ ID NO: 587309 - RNA, 19 nt, Homo sapiens
aaaguuauguuccaugaag

SEQ ID NO: 587310 - RNA, 19 nt, Homo sapiens
guuugaggcuuccaucuga

SEQ ID NO: 587311 - RNA, 19 nt, Homo sapiens
caucgaggcucccaucaca

SEQ ID NO: 587312 - RNA, 19 nt, Homo sapiens
ggaggaaagaguccauuga

SEQ ID NO: 587313 - RNA, 19 nt, Homo sapiens
ucaagaaacuguguuguac

SEQ ID NO: 587314 - RNA, 19 nt, Homo sapiens
caacuaggaccaaauuaca

SEQ ID NO: 587315 - RNA, 19 nt, Homo sapiens
ggugaaggagcuaauguuu

SEQ ID NO: 587316 - RNA, 19 nt, Homo sapiens
ugaauaaguuugugaacag

SEQ ID NO: 587317 - RNA, 19 nt, Homo sapiens
guaccacugacaauaauaa

SEQ ID NO: 587318 - RNA, 19 nt, Homo sapiens
ucacugucaugaagccaua

SEQ ID NO: 587319 - RNA, 19 nt, Homo sapiens
guaaaagggguucaucuua

SEQ ID NO: 587320 - RNA, 19 nt, Homo sapiens
gcccuugaaugcuuucuug

SEQ ID NO: 587321 - RNA, 19 nt, Homo sapiens
uagaugaccuaaagugcaa

SEQ ID NO: 587322 - RNA, 19 nt, Homo sapiens
cgacaaaggacacugugaa

SEQ ID NO: 587323 - RNA, 19 nt, Homo sapiens
gaagacacuagaugaccua

SEQ ID NO: 587324 - RNA, 19 nt, Homo sapiens
ggguucaucuuaacaaagu

SEQ ID NO: 587325 - RNA, 19 nt, Homo sapiens
uaaacuaguuagcuucaca

SEQ ID NO: 587326 - RNA, 19 nt, Homo sapiens
gaagccaacuaccacucuu

SEQ ID NO: 587327 - RNA, 19 nt, Homo sapiens
ggagaauagcagcauaauu

SEQ ID NO: 587328 - RNA, 19 nt, Homo sapiens
gcacuacaccaaguauuau

SEQ ID NO: 587329 - RNA, 19 nt, Homo sapiens
gaaggcagcgacugugaau

SEQ ID NO: 587330 - RNA, 19 nt, Homo sapiens
gugaauaaguuugugaaca

SEQ ID NO: 587331 - RNA, 19 nt, Homo sapiens
gacaggaaccauuaucgaa

SEQ ID NO: 587332 - RNA, 19 nt, Homo sapiens
gcgaggauccacuccauga

SEQ ID NO: 587333 - RNA, 19 nt, Homo sapiens
ggccuguaauucaguguuu

SEQ ID NO: 587334 - RNA, 19 nt, Homo sapiens
gguaucagcagccugugua

SEQ ID NO: 587335 - RNA, 19 nt, Homo sapiens
ccgaugguaugacaccuaa

SEQ ID NO: 587336 - RNA, 19 nt, Homo sapiens
gcaaaggaagauagucaga

SEQ ID NO: 587337 - RNA, 19 nt, Homo sapiens
gaggagaguugggacuuca

SEQ ID NO: 587338 - RNA, 19 nt, Homo sapiens
auaagcagauucacaagau

SEQ ID NO: 587339 - RNA, 19 nt, Homo sapiens
uaaugacaaugacagguau

SEQ ID NO: 587340 - RNA, 19 nt, Homo sapiens
uugcugugcucuacaauga

SEQ ID NO: 587341 - RNA, 19 nt, Homo sapiens
gcaaugccaauaaccauca

SEQ ID NO: 587342 - RNA, 19 nt, Homo sapiens
gauauaagaacaggaggaa

SEQ ID NO: 587343 - RNA, 19 nt, Homo sapiens
uaagcagauucacaagauu

SEQ ID NO: 587344 - RNA, 19 nt, Homo sapiens
uuagaucacugucaugaag

SEQ ID NO: 587345 - RNA, 19 nt, Homo sapiens
gcauaauugcuugcuauaa

SEQ ID NO: 587346 - RNA, 19 nt, Homo sapiens
acaaauacuuggcaaacuc

SEQ ID NO: 587347 - RNA, 19 nt, Homo sapiens
cuaaugacaaugacaggua

SEQ ID NO: 587348 - RNA, 19 nt, Homo sapiens
gcuuccaucugacagcuaa

SEQ ID NO: 587349 - RNA, 19 nt, Homo sapiens
gggacuaccuguggugaug

SEQ ID NO: 587350 - RNA, 19 nt, Homo sapiens
gcucccaucacaaagguua

SEQ ID NO: 587351 - RNA, 19 nt, Homo sapiens
caugaagccauagaaauaa

SEQ ID NO: 587352 - RNA, 19 nt, Homo sapiens
gauaaacuaguuagcuuca

SEQ ID NO: 587353 - RNA, 19 nt, Homo sapiens
cacaguagcguaaacaaga

SEQ ID NO: 587354 - RNA, 19 nt, Homo sapiens
gaccuaaagugcaaaaguu

SEQ ID NO: 587355 - RNA, 19 nt, Homo sapiens
caaugacacugcuguucug

SEQ ID NO: 587356 - RNA, 19 nt, Homo sapiens
caucgugauucaggagaua

SEQ ID NO: 587357 - RNA, 19 nt, Homo sapiens
gaacugauucaaauagaac

SEQ ID NO: 587358 - RNA, 19 nt, Homo sapiens
cgacaaaguccacaaguua

SEQ ID NO: 587359 - RNA, 19 nt, Homo sapiens
cauggaaccucuuuacaua

SEQ ID NO: 587360 - RNA, 19 nt, Homo sapiens
ccaggcagcauguucauua

SEQ ID NO: 587361 - RNA, 19 nt, Homo sapiens
ccagaaggcugcggauauu

SEQ ID NO: 587362 - RNA, 19 nt, Homo sapiens
caacgcgggucucagguuu

SEQ ID NO: 587363 - RNA, 19 nt, Homo sapiens
gcacaauaaugaccucaca

SEQ ID NO: 587364 - RNA, 19 nt, Homo sapiens
auaaugaccucacauggaa

SEQ ID NO: 587365 - RNA, 19 nt, Homo sapiens
gcucaccgcuugcaaacug

SEQ ID NO: 587366 - RNA, 19 nt, Homo sapiens
ggaagaaggcggaagaucu

SEQ ID NO: 587367 - RNA, 19 nt, Homo sapiens
gaagaaggcggaagaucug

SEQ ID NO: 587368 - RNA, 19 nt, Homo sapiens
uuacauaccuggaguuugc

SEQ ID NO: 587369 - RNA, 19 nt, Homo sapiens
aaacgaaggugaaguucuc

SEQ ID NO: 587370 - RNA, 19 nt, Homo sapiens
ggcagcauguucauuauag

SEQ ID NO: 587371 - RNA, 19 nt, Homo sapiens
aagagaagcuggacaaagc

SEQ ID NO: 587372 - RNA, 19 nt, Homo sapiens
acaccagggucucggaauu

SEQ ID NO: 587373 - RNA, 19 nt, Homo sapiens
ccuccaaguuuaaagagaa

SEQ ID NO: 587374 - RNA, 19 nt, Homo sapiens
guaugcaggugacuguguu

SEQ ID NO: 587375 - RNA, 19 nt, Homo sapiens
gaagacagagcaagguuac

SEQ ID NO: 587376 - RNA, 19 nt, Homo sapiens
aacugaagguguucgauuu

SEQ ID NO: 587377 - RNA, 19 nt, Homo sapiens
gagaagacagagcaagguu

SEQ ID NO: 587378 - RNA, 19 nt, Homo sapiens
aaacugaagguguucgauu

SEQ ID NO: 587379 - RNA, 19 nt, Homo sapiens
gauugagggcuuuaugcua

SEQ ID NO: 587380 - RNA, 19 nt, Homo sapiens
gaaggcggaagaucuguuc

SEQ ID NO: 587381 - RNA, 19 nt, Homo sapiens
gcuucaucaugcacaauaa

SEQ ID NO: 587382 - RNA, 19 nt, Homo sapiens
uuaaagagaagcuggacaa

SEQ ID NO: 587383 - RNA, 19 nt, Homo sapiens
auugagggcuuuaugcuau

SEQ ID NO: 587384 - RNA, 19 nt, Homo sapiens
ugacuggccagacgacaaa

SEQ ID NO: 587385 - RNA, 19 nt, Homo sapiens
agaagacagagcaagguua

SEQ ID NO: 587386 - RNA, 19 nt, Homo sapiens
cggcagaggcugaguguca

SEQ ID NO: 587387 - RNA, 19 nt, Homo sapiens
gaaacgaaggugaaguucu

SEQ ID NO: 587388 - RNA, 19 nt, Homo sapiens
gcccgugaguacccucgua

SEQ ID NO: 587389 - RNA, 19 nt, Homo sapiens
gccacggccuucaaucugu

SEQ ID NO: 587390 - RNA, 19 nt, Homo sapiens
ggagaggcuucuggacauc

SEQ ID NO: 587391 - RNA, 19 nt, Homo sapiens
acgacaaaguccacaaguu

SEQ ID NO: 587392 - RNA, 19 nt, Homo sapiens
gcaacgcgggucucagguu

SEQ ID NO: 587393 - RNA, 19 nt, Homo sapiens
ggagcugauugagggcuuu

SEQ ID NO: 587394 - RNA, 19 nt, Homo sapiens
caggcagcauguucauuau

SEQ ID NO: 587395 - RNA, 19 nt, Homo sapiens
gcaggugacuguguuugac

SEQ ID NO: 587396 - RNA, 19 nt, Homo sapiens
uugggaagcugcugcacaa

SEQ ID NO: 587397 - RNA, 19 nt, Homo sapiens
aauaaugaccucacaugga

SEQ ID NO: 587398 - RNA, 19 nt, Homo sapiens
gauucccgcugaaccacuu

SEQ ID NO: 587399 - RNA, 19 nt, Homo sapiens
acaauaaugaccucacaug

SEQ ID NO: 587400 - RNA, 19 nt, Homo sapiens
uggagaggcuucuggacau

SEQ ID NO: 587401 - RNA, 19 nt, Homo sapiens
ucacauggaaccucuuuac

SEQ ID NO: 587402 - RNA, 19 nt, Homo sapiens
uggagaagccgguggacaa

SEQ ID NO: 587403 - RNA, 19 nt, Homo sapiens
acagagcaagguuacagua

SEQ ID NO: 587404 - RNA, 19 nt, Homo sapiens
cuucgcagcaggugacuuu

SEQ ID NO: 587405 - RNA, 19 nt, Homo sapiens
uaaagagaagcuggacaaa

SEQ ID NO: 587406 - RNA, 19 nt, Homo sapiens
agaagccgguggacaagca

SEQ ID NO: 587407 - RNA, 19 nt, Homo sapiens
ggcuucaucaugcacaaua

SEQ ID NO: 587408 - RNA, 19 nt, Homo sapiens
gagcugauugagggcuuua

SEQ ID NO: 587409 - RNA, 19 nt, Homo sapiens
ggaaacgaaggugaaguuc

SEQ ID NO: 587410 - RNA, 19 nt, Homo sapiens
gacaaaguccacaaguuac

SEQ ID NO: 587411 - RNA, 19 nt, Homo sapiens
ggagaagacagagcaaggu

SEQ ID NO: 587412 - RNA, 19 nt, Homo sapiens
ucacaggugucgcgaucgu

SEQ ID NO: 587413 - RNA, 19 nt, Homo sapiens
cuugcaaacugaagguguu

SEQ ID NO: 587414 - RNA, 19 nt, Homo sapiens
cccagaaggcugcggauau

SEQ ID NO: 587415 - RNA, 19 nt, Homo sapiens
gcaaacugaagguguucga

SEQ ID NO: 587416 - RNA, 19 nt, Homo sapiens
gagacgcggcugagguuca

SEQ ID NO: 587417 - RNA, 19 nt, Homo sapiens
acgcgggucucagguuuga

SEQ ID NO: 587418 - RNA, 19 nt, Homo sapiens
aggaaacgaaggugaaguu

SEQ ID NO: 587419 - RNA, 19 nt, Homo sapiens
acauggaaccucuuuacau

SEQ ID NO: 587420 - RNA, 19 nt, Homo sapiens
ccucacauggaaccucuuu

SEQ ID NO: 587421 - RNA, 19 nt, Homo sapiens
gcugauugagggcuuuaug

SEQ ID NO: 587422 - RNA, 19 nt, Homo sapiens
ggagaagccgguggacaag

SEQ ID NO: 587423 - RNA, 19 nt, Homo sapiens
ccauggagaccgccaagca

SEQ ID NO: 587424 - RNA, 19 nt, Homo sapiens
cuccuucgcuacuccguau

SEQ ID NO: 587425 - RNA, 19 nt, Homo sapiens
acacagagacagcgaacgu

SEQ ID NO: 587426 - RNA, 19 nt, Homo sapiens
aaagagaagcuggacaaag

SEQ ID NO: 587427 - RNA, 19 nt, Homo sapiens
ccgcggacaccuucgaaga

SEQ ID NO: 587428 - RNA, 19 nt, Homo sapiens
aggaugcugucccgguuga

SEQ ID NO: 587429 - RNA, 19 nt, Homo sapiens
caaaugagauucagaguaa

SEQ ID NO: 587430 - RNA, 19 nt, Homo sapiens
gcacugagauacuaaagaa

SEQ ID NO: 587431 - RNA, 19 nt, Homo sapiens
gcagauaacuauucucaca

SEQ ID NO: 587432 - RNA, 19 nt, Homo sapiens
ccaaagcacugagauacua

SEQ ID NO: 587433 - RNA, 19 nt, Homo sapiens
ggaagaacaugcagauaac

SEQ ID NO: 587434 - RNA, 19 nt, Homo sapiens
gcauuucugucaucauuug

SEQ ID NO: 587435 - RNA, 19 nt, Homo sapiens
uagcauuucugucaucauu

SEQ ID NO: 587436 - RNA, 19 nt, Homo sapiens
gcaauucuguacuuguguu

SEQ ID NO: 587437 - RNA, 19 nt, Homo sapiens
gucgacauguuaccgauua

SEQ ID NO: 587438 - RNA, 19 nt, Homo sapiens
guauauuacuuguccauuc

SEQ ID NO: 587439 - RNA, 19 nt, Homo sapiens
gaacaugcagauaacuauu

SEQ ID NO: 587440 - RNA, 19 nt, Homo sapiens
uauccgugcuccaaguuua

SEQ ID NO: 587441 - RNA, 19 nt, Homo sapiens
gagauucagaguaacauuu

SEQ ID NO: 587442 - RNA, 19 nt, Homo sapiens
guucuaagcuacugucaag

SEQ ID NO: 587443 - RNA, 19 nt, Homo sapiens
ccagaagcuugaaggguuu

SEQ ID NO: 587444 - RNA, 19 nt, Homo sapiens
caacagacacuacacaucu

SEQ ID NO: 587445 - RNA, 19 nt, Homo sapiens
gaacaacagacacuacaca

SEQ ID NO: 587446 - RNA, 19 nt, Homo sapiens
ugaaggguuugguuaagaa

SEQ ID NO: 587447 - RNA, 19 nt, Homo sapiens
guacuuguguuauacugau

SEQ ID NO: 587448 - RNA, 19 nt, Homo sapiens
uggaaugaaugguguagaa

SEQ ID NO: 587449 - RNA, 19 nt, Homo sapiens
gaauauaguacacgaccuu

SEQ ID NO: 587450 - RNA, 19 nt, Homo sapiens
gaugacaacaaaugagauu

SEQ ID NO: 587451 - RNA, 19 nt, Homo sapiens
cagcaauucuguacuugug

SEQ ID NO: 587452 - RNA, 19 nt, Homo sapiens
gacauguuaccgauuauaa

SEQ ID NO: 587453 - RNA, 19 nt, Homo sapiens
ugcagaagaucaacaguau

SEQ ID NO: 587454 - RNA, 19 nt, Homo sapiens
cagaagaucaacaguauca

SEQ ID NO: 587455 - RNA, 19 nt, Homo sapiens
uuacuuguccauuccuuua

SEQ ID NO: 587456 - RNA, 19 nt, Homo sapiens
aggaagaacaugcagauaa

SEQ ID NO: 587457 - RNA, 19 nt, Homo sapiens
gaagaucaacaguaucagu

SEQ ID NO: 587458 - RNA, 19 nt, Homo sapiens
gaacaaccgaauauaguac

SEQ ID NO: 587459 - RNA, 19 nt, Homo sapiens
gauaacuauucucacaugu

SEQ ID NO: 587460 - RNA, 19 nt, Homo sapiens
acaaaugagauucagagua

SEQ ID NO: 587461 - RNA, 19 nt, Homo sapiens
agaacaaccgaauauagua

SEQ ID NO: 587462 - RNA, 19 nt, Homo sapiens
gcuagaacaaccgaauaua

SEQ ID NO: 587463 - RNA, 19 nt, Homo sapiens
ucaaagacucggcguguug

SEQ ID NO: 587464 - RNA, 19 nt, Homo sapiens
ucagugcaguugcuauguu

SEQ ID NO: 587465 - RNA, 19 nt, Homo sapiens
uaaucacaguggaagcuuu

SEQ ID NO: 587466 - RNA, 19 nt, Homo sapiens
gcuccaaguuuauaauugc

SEQ ID NO: 587467 - RNA, 19 nt, Homo sapiens
acacagaauuucaaagacu

SEQ ID NO: 587468 - RNA, 19 nt, Homo sapiens
agauaacuauucucacaug

SEQ ID NO: 587469 - RNA, 19 nt, Homo sapiens
gaaugaaugguguagaaca

SEQ ID NO: 587470 - RNA, 19 nt, Homo sapiens
gcaguagcauuucugucau

SEQ ID NO: 587471 - RNA, 19 nt, Homo sapiens
agaaugaugaaacggaaua

SEQ ID NO: 587472 - RNA, 19 nt, Homo sapiens
caaggaagaacaugcagau

SEQ ID NO: 587473 - RNA, 19 nt, Homo sapiens
aaugaaugguguagaacaa

SEQ ID NO: 587474 - RNA, 19 nt, Homo sapiens
ggggauauauuuugagaau

SEQ ID NO: 587475 - RNA, 19 nt, Homo sapiens
caaagcacugagauacuaa

SEQ ID NO: 587476 - RNA, 19 nt, Homo sapiens
guugcuauguugcagaaga

SEQ ID NO: 587477 - RNA, 19 nt, Homo sapiens
gcuugaaggguuugguuaa

SEQ ID NO: 587478 - RNA, 19 nt, Homo sapiens
uagaacaaccgaauauagu

SEQ ID NO: 587479 - RNA, 19 nt, Homo sapiens
caguaucaguggcuggaaa

SEQ ID NO: 587480 - RNA, 19 nt, Homo sapiens
ugaaugguguagaacaaca

SEQ ID NO: 587481 - RNA, 19 nt, Homo sapiens
ugacaacaaaugagauuca

SEQ ID NO: 587482 - RNA, 19 nt, Homo sapiens
gaaugaugaaacggaauaa

SEQ ID NO: 587483 - RNA, 19 nt, Homo sapiens
uuuggaaguuucuuugcua

SEQ ID NO: 587484 - RNA, 19 nt, Homo sapiens
cuagaacaaccgaauauag

SEQ ID NO: 587485 - RNA, 19 nt, Homo sapiens
cgacauguuaccgauuaua

SEQ ID NO: 587486 - RNA, 19 nt, Homo sapiens
cagugcaguugcuauguug

SEQ ID NO: 587487 - RNA, 19 nt, Homo sapiens
aaauauccgugcuccaagu

SEQ ID NO: 587488 - RNA, 19 nt, Homo sapiens
cugaugugaugaaauuaga

SEQ ID NO: 587489 - RNA, 19 nt, Homo sapiens
aggguuugguuaagaauau

SEQ ID NO: 587490 - RNA, 19 nt, Homo sapiens
caguugcuauguugcagaa

SEQ ID NO: 587491 - RNA, 19 nt, Homo sapiens
ucccagcaauucuguacuu

SEQ ID NO: 587492 - RNA, 19 nt, Homo sapiens
aagaacaugcagauaacua

SEQ ID NO: 587493 - RNA, 19 nt, Homo sapiens
guguuauacugaugugaug

SEQ ID NO: 587494 - RNA, 19 nt, Homo sapiens
caauucuguacuuguguua

SEQ ID NO: 587495 - RNA, 19 nt, Homo sapiens
gaaaaucccagcaauucug

SEQ ID NO: 587496 - RNA, 19 nt, Homo sapiens
gacaacaaaugagauucag

SEQ ID NO: 587497 - RNA, 19 nt, Homo sapiens
caucuuuggaaguuucuuu

SEQ ID NO: 587498 - RNA, 19 nt, Homo sapiens
uugaaggguuugguuaaga

SEQ ID NO: 587499 - RNA, 19 nt, Homo sapiens
gcagccuuccuucuccuuu

SEQ ID NO: 587500 - RNA, 19 nt, Homo sapiens
uugcagaagaucaacagua

SEQ ID NO: 587501 - RNA, 19 nt, Homo sapiens
gugcuccaaguuuauaauu

SEQ ID NO: 587502 - RNA, 19 nt, Homo sapiens
ggguuugguuaagaauauu

SEQ ID NO: 587503 - RNA, 19 nt, Homo sapiens
gaaggguuugguuaagaau

SEQ ID NO: 587504 - RNA, 19 nt, Homo sapiens
cagccuuccuucuccuuuc

SEQ ID NO: 587505 - RNA, 19 nt, Homo sapiens
ugcaguagcauuucuguca

SEQ ID NO: 587506 - RNA, 19 nt, Homo sapiens
agaacaugcagauaacuau

SEQ ID NO: 587507 - RNA, 19 nt, Homo sapiens
ggcguguuguccauugcua

SEQ ID NO: 587508 - RNA, 19 nt, Homo sapiens
uauauuacuuguccauucc

SEQ ID NO: 587509 - RNA, 19 nt, Homo sapiens
guuauacugaugugaugaa

SEQ ID NO: 587510 - RNA, 19 nt, Homo sapiens
caguagcauuucugucauc

SEQ ID NO: 587511 - RNA, 19 nt, Homo sapiens
guuaugaauucaggagucu

SEQ ID NO: 587512 - RNA, 19 nt, Homo sapiens
gaagaacaugcagauaacu

SEQ ID NO: 587513 - RNA, 19 nt, Homo sapiens
gcagaagaucaacaguauc

SEQ ID NO: 587514 - RNA, 19 nt, Homo sapiens
uagaacaacagacacuaca

SEQ ID NO: 587515 - RNA, 19 nt, Homo sapiens
caaagacucggcguguugu

SEQ ID NO: 587516 - RNA, 19 nt, Homo sapiens
acaugcagauaacuauucu

SEQ ID NO: 587517 - RNA, 19 nt, Homo sapiens
gaagaacucucucccuuuc

SEQ ID NO: 587518 - RNA, 19 nt, Homo sapiens
caacaucuaugauuggaau

SEQ ID NO: 587519 - RNA, 19 nt, Homo sapiens
ggaagaacucucucccuuu

SEQ ID NO: 587520 - RNA, 19 nt, Homo sapiens
gaaggagcauuugcggaaa

SEQ ID NO: 587521 - RNA, 19 nt, Homo sapiens
acccagaacugacuucaaa

SEQ ID NO: 587522 - RNA, 19 nt, Homo sapiens
caucugggccuccgccuuu

SEQ ID NO: 587523 - RNA, 19 nt, Homo sapiens
gaaccaauaaaccuucugu

SEQ ID NO: 587524 - RNA, 19 nt, Homo sapiens
gcacaggcggcuacacaga

SEQ ID NO: 587525 - RNA, 19 nt, Homo sapiens
gaaccggaugccaguguuu

SEQ ID NO: 587526 - RNA, 19 nt, Homo sapiens
ugcaacaggugaucgagaa

SEQ ID NO: 587527 - RNA, 19 nt, Homo sapiens
gagggacgccacugcugua

SEQ ID NO: 587528 - RNA, 19 nt, Homo sapiens
gcgggaaccacgugaaaug

SEQ ID NO: 587529 - RNA, 19 nt, Homo sapiens
gaacucucucccuuucuga

SEQ ID NO: 587530 - RNA, 19 nt, Homo sapiens
ugagagaacugggcuuucg

SEQ ID NO: 587531 - RNA, 19 nt, Homo sapiens
ggaaagugcaacaggugau

SEQ ID NO: 587532 - RNA, 19 nt, Homo sapiens
caagaaaggggcuguguga

SEQ ID NO: 587533 - RNA, 19 nt, Homo sapiens
gaaagugcaacaggugauc

SEQ ID NO: 587534 - RNA, 19 nt, Homo sapiens
caucuaugauuggaaugga

SEQ ID NO: 587535 - RNA, 19 nt, Homo sapiens
ugaaccggaugccaguguu

SEQ ID NO: 587536 - RNA, 19 nt, Homo sapiens
cagcacaggcggcuacaca

SEQ ID NO: 587537 - RNA, 19 nt, Homo sapiens
uuacccagccugcagaaga

SEQ ID NO: 587538 - RNA, 19 nt, Homo sapiens
ggaaacccagaacugacuu

SEQ ID NO: 587539 - RNA, 19 nt, Homo sapiens
gagcgugacguggacauca

SEQ ID NO: 587540 - RNA, 19 nt, Homo sapiens
gcccugggauaccggaaag

SEQ ID NO: 587541 - RNA, 19 nt, Homo sapiens
acguggacaucaacaucua

SEQ ID NO: 587542 - RNA, 19 nt, Homo sapiens
gggaaacccagaacugacu

SEQ ID NO: 587543 - RNA, 19 nt, Homo sapiens
ugacguggacaucaacauc

SEQ ID NO: 587544 - RNA, 19 nt, Homo sapiens
gaaacccagaacugacuuc

SEQ ID NO: 587545 - RNA, 19 nt, Homo sapiens
ccgcugacccugagugaag

SEQ ID NO: 587546 - RNA, 19 nt, Homo sapiens
acaggcggcuacacagaca

SEQ ID NO: 587547 - RNA, 19 nt, Homo sapiens
ggagaggaggcugcagaug

SEQ ID NO: 587548 - RNA, 19 nt, Homo sapiens
gaagaacucucucccuuuc

SEQ ID NO: 587549 - RNA, 19 nt, Homo sapiens
caacaucuaugauuggaau

SEQ ID NO: 587550 - RNA, 19 nt, Homo sapiens
ggaagaacucucucccuuu

SEQ ID NO: 587551 - RNA, 19 nt, Homo sapiens
acccagaacugacuucaaa

SEQ ID NO: 587552 - RNA, 19 nt, Homo sapiens
caucugggccuccgccuuu

SEQ ID NO: 587553 - RNA, 19 nt, Homo sapiens
gaaccaauaaaccuucugu

SEQ ID NO: 587554 - RNA, 19 nt, Homo sapiens
gcacaggcggcuacacaga

SEQ ID NO: 587555 - RNA, 19 nt, Homo sapiens
gaaccggaugccaguguuu

SEQ ID NO: 587556 - RNA, 19 nt, Homo sapiens
ugcaacaggugaucgagaa

SEQ ID NO: 587557 - RNA, 19 nt, Homo sapiens
gagggacgccacugcugua

SEQ ID NO: 587558 - RNA, 19 nt, Homo sapiens
gcgggaaccacgugaaaug

SEQ ID NO: 587559 - RNA, 19 nt, Homo sapiens
gaacucucucccuuucuga

SEQ ID NO: 587560 - RNA, 19 nt, Homo sapiens
ugagagaacugggcuuucg

SEQ ID NO: 587561 - RNA, 19 nt, Homo sapiens
ggaaagugcaacaggugau

SEQ ID NO: 587562 - RNA, 19 nt, Homo sapiens
caagaaaggggcuguguga

SEQ ID NO: 587563 - RNA, 19 nt, Homo sapiens
gaaagugcaacaggugauc

SEQ ID NO: 587564 - RNA, 19 nt, Homo sapiens
caucuaugauuggaaugga

SEQ ID NO: 587565 - RNA, 19 nt, Homo sapiens
cggccacccuagacuguga

SEQ ID NO: 587566 - RNA, 19 nt, Homo sapiens
ugaaccggaugccaguguu

SEQ ID NO: 587567 - RNA, 19 nt, Homo sapiens
cagcacaggcggcuacaca

SEQ ID NO: 587568 - RNA, 19 nt, Homo sapiens
uuacccagccugcagaaga

SEQ ID NO: 587569 - RNA, 19 nt, Homo sapiens
ggaaacccagaacugacuu

SEQ ID NO: 587570 - RNA, 19 nt, Homo sapiens
gagcgugacguggacauca

SEQ ID NO: 587571 - RNA, 19 nt, Homo sapiens
gcccugggauaccggaaag

SEQ ID NO: 587572 - RNA, 19 nt, Homo sapiens
acguggacaucaacaucua

SEQ ID NO: 587573 - RNA, 19 nt, Homo sapiens
gggaaacccagaacugacu

SEQ ID NO: 587574 - RNA, 19 nt, Homo sapiens
ugacguggacaucaacauc

SEQ ID NO: 587575 - RNA, 19 nt, Homo sapiens
gaaacccagaacugacuuc

SEQ ID NO: 587576 - RNA, 19 nt, Homo sapiens
ccgcugacccugagugaag

SEQ ID NO: 587577 - RNA, 19 nt, Homo sapiens
acaggcggcuacacagaca

SEQ ID NO: 587578 - RNA, 19 nt, Homo sapiens
ggagaggaggcugcagaug

SEQ ID NO: 587579 - RNA, 19 nt, Homo sapiens
gcaguuagcugaagaauug

SEQ ID NO: 587580 - RNA, 19 nt, Homo sapiens
caucaugucuggacuauuu

SEQ ID NO: 587581 - RNA, 19 nt, Homo sapiens
gagaaugaguccuugauuu

SEQ ID NO: 587582 - RNA, 19 nt, Homo sapiens
gaacagccaugcccaguau

SEQ ID NO: 587583 - RNA, 19 nt, Homo sapiens
gaaaugcuguugaagauca

SEQ ID NO: 587584 - RNA, 19 nt, Homo sapiens
uaaagcauguucacccuua

SEQ ID NO: 587585 - RNA, 19 nt, Homo sapiens
caucugaccuggcaucuaa

SEQ ID NO: 587586 - RNA, 19 nt, Homo sapiens
caaaugagcucugaaaucu

SEQ ID NO: 587587 - RNA, 19 nt, Homo sapiens
ccucuugucugauuucuua

SEQ ID NO: 587588 - RNA, 19 nt, Homo sapiens
caaacaagauugagauuag

SEQ ID NO: 587589 - RNA, 19 nt, Homo sapiens
uaaagacccuccuauucua

SEQ ID NO: 587590 - RNA, 19 nt, Homo sapiens
ccauuuccauugcuuauua

SEQ ID NO: 587591 - RNA, 19 nt, Homo sapiens
gaaccacacuugaaaccuu

SEQ ID NO: 587592 - RNA, 19 nt, Homo sapiens
aaacagaccucaauacagu

SEQ ID NO: 587593 - RNA, 19 nt, Homo sapiens
gguaagaguuucaguuugu

SEQ ID NO: 587594 - RNA, 19 nt, Homo sapiens
ucuaucagauugagcauua

SEQ ID NO: 587595 - RNA, 19 nt, Homo sapiens
caaagacaguugaaggaaa

SEQ ID NO: 587596 - RNA, 19 nt, Homo sapiens
gcacacagacaaaugaauu

SEQ ID NO: 587597 - RNA, 19 nt, Homo sapiens
gaaauggaaagcagaguuu

SEQ ID NO: 587598 - RNA, 19 nt, Homo sapiens
guaagacuguagauaugua

SEQ ID NO: 587599 - RNA, 19 nt, Homo sapiens
cacauaagcuuccauuuua

SEQ ID NO: 587600 - RNA, 19 nt, Homo sapiens
cuaaauacaugccacauca

SEQ ID NO: 587601 - RNA, 19 nt, Homo sapiens
cgacagucuuguacaauuu

SEQ ID NO: 587602 - RNA, 19 nt, Homo sapiens
gaaacucuacugccaaauu

SEQ ID NO: 587603 - RNA, 19 nt, Homo sapiens
guaagaauaccacaucaaa

SEQ ID NO: 587604 - RNA, 19 nt, Homo sapiens
gaagauagcaucagaaagc

SEQ ID NO: 587605 - RNA, 19 nt, Homo sapiens
ccacugaacugaagaaacu

SEQ ID NO: 587606 - RNA, 19 nt, Homo sapiens
ugugggauauugaauguua

SEQ ID NO: 587607 - RNA, 19 nt, Homo sapiens
ugaacaagcugccuucugu

SEQ ID NO: 587608 - RNA, 19 nt, Homo sapiens
gcauagaaaccacuagaaa

SEQ ID NO: 587609 - RNA, 19 nt, Homo sapiens
gcauguagaggcuuguuua

SEQ ID NO: 587610 - RNA, 19 nt, Homo sapiens
caauaggaguggugauuug

SEQ ID NO: 587611 - RNA, 19 nt, Homo sapiens
gaagaucccaucacaggaa

SEQ ID NO: 587612 - RNA, 19 nt, Homo sapiens
gcaaaugagcucugaaauc

SEQ ID NO: 587613 - RNA, 19 nt, Homo sapiens
ucucuaagguuuacaauag

SEQ ID NO: 587614 - RNA, 19 nt, Homo sapiens
agaguugggugucuccuua

SEQ ID NO: 587615 - RNA, 19 nt, Homo sapiens
gaucaaagagucccuggaa

SEQ ID NO: 587616 - RNA, 19 nt, Homo sapiens
gaaccgccguccaauuuua

SEQ ID NO: 587617 - RNA, 19 nt, Homo sapiens
aauaagcacuguaaacuuc

SEQ ID NO: 587618 - RNA, 19 nt, Homo sapiens
uugcaucacuguaucauuu

SEQ ID NO: 587619 - RNA, 19 nt, Homo sapiens
agagugugcugguaccuua

SEQ ID NO: 587620 - RNA, 19 nt, Homo sapiens
ccucuuaccuaacaucuga

SEQ ID NO: 587621 - RNA, 19 nt, Homo sapiens
aaacucuacugccaaauug

SEQ ID NO: 587622 - RNA, 19 nt, Homo sapiens
ccaaagcgaggcacccuua

SEQ ID NO: 587623 - RNA, 19 nt, Homo sapiens
gcacauaagcuuccauuuu

SEQ ID NO: 587624 - RNA, 19 nt, Homo sapiens
ugacgaugauguacagauu

SEQ ID NO: 587625 - RNA, 19 nt, Homo sapiens
guacagauucuuucaguuc

SEQ ID NO: 587626 - RNA, 19 nt, Homo sapiens
uggaaugacuucaacuuug

SEQ ID NO: 587627 - RNA, 19 nt, Homo sapiens
aaagacaguugaaggaaau

SEQ ID NO: 587628 - RNA, 19 nt, Homo sapiens
caccagcacuuacuucaga

SEQ ID NO: 587629 - RNA, 19 nt, Homo sapiens
gagauuagcauggacugua

SEQ ID NO: 587630 - RNA, 19 nt, Homo sapiens
gggcugucauugcacauaa

SEQ ID NO: 587631 - RNA, 19 nt, Homo sapiens
cacccgacgucauguauuu

SEQ ID NO: 587632 - RNA, 19 nt, Homo sapiens
ccaaacguccucuuuaguu

SEQ ID NO: 587633 - RNA, 19 nt, Homo sapiens
ucucaguguugguauauuu

SEQ ID NO: 587634 - RNA, 19 nt, Homo sapiens
ucaguucuuuggauucuaa

SEQ ID NO: 587635 - RNA, 19 nt, Homo sapiens
ggcauugaguauuguuuaa

SEQ ID NO: 587636 - RNA, 19 nt, Homo sapiens
gaaaacauuugcugccauu

SEQ ID NO: 587637 - RNA, 19 nt, Homo sapiens
uuacugacauuucuucuag

SEQ ID NO: 587638 - RNA, 19 nt, Homo sapiens
gaugauguacagauucuuu

SEQ ID NO: 587639 - RNA, 19 nt, Homo sapiens
gggcauugaguauuguuua

SEQ ID NO: 587640 - RNA, 19 nt, Homo sapiens
caugugagcucuuccuauc

SEQ ID NO: 587641 - RNA, 19 nt, Homo sapiens
acgaagaguucccuugaaa

SEQ ID NO: 587642 - RNA, 19 nt, Homo sapiens
acaguaagauaucucaaug

SEQ ID NO: 587643 - RNA, 19 nt, Homo sapiens
agaagaaguucauguccaa

SEQ ID NO: 587644 - RNA, 19 nt, Homo sapiens
gaaagaaaauugaguugca

SEQ ID NO: 587645 - RNA, 19 nt, Homo sapiens
gaugaacuguuauacuuac

SEQ ID NO: 587646 - RNA, 19 nt, Homo sapiens
gagcugagccgugaauuca

SEQ ID NO: 587647 - RNA, 19 nt, Homo sapiens
gaaaucuucccaugcauuc

SEQ ID NO: 587648 - RNA, 19 nt, Homo sapiens
ucaguuuguuggaaaguaa

SEQ ID NO: 587649 - RNA, 19 nt, Homo sapiens
uaaauugcaucacuguauc

SEQ ID NO: 587650 - RNA, 19 nt, Homo sapiens
cccagaugaugaacuguua

SEQ ID NO: 587651 - RNA, 19 nt, Homo sapiens
ucacgacagucuuguacaa

SEQ ID NO: 587652 - RNA, 19 nt, Homo sapiens
auagguaucuagagcuuaa

SEQ ID NO: 587653 - RNA, 19 nt, Homo sapiens
cgccaugccugucuacaaa

SEQ ID NO: 587654 - RNA, 19 nt, Homo sapiens
aaugagcucugaaaucuuc

SEQ ID NO: 587655 - RNA, 19 nt, Homo sapiens
ccacuuaaacgaagaguuc

SEQ ID NO: 587656 - RNA, 19 nt, Homo sapiens
cacauuugcuacuguugua

SEQ ID NO: 587657 - RNA, 19 nt, Homo sapiens
gagccaacauucccaugau

SEQ ID NO: 587658 - RNA, 19 nt, Homo sapiens
cgucagaacacacauggua

SEQ ID NO: 587659 - RNA, 19 nt, Homo sapiens
gaagauggugcgacaaaca

SEQ ID NO: 587660 - RNA, 19 nt, Homo sapiens
guaagaagacaaacugcuu

SEQ ID NO: 587661 - RNA, 19 nt, Homo sapiens
gacaauauuccagaucuuu

SEQ ID NO: 587662 - RNA, 19 nt, Homo sapiens
uaggaguggugauuugaaa

SEQ ID NO: 587663 - RNA, 19 nt, Homo sapiens
cgucauguauuugagcaua

SEQ ID NO: 587664 - RNA, 19 nt, Homo sapiens
gaguagauccauuuccauu

SEQ ID NO: 587665 - RNA, 19 nt, Homo sapiens
cagccuauauguucaguuc

SEQ ID NO: 587666 - RNA, 19 nt, Homo sapiens
ggaacagccaugcccagua

SEQ ID NO: 587667 - RNA, 19 nt, Homo sapiens
aagaaacucuacugccaaa

SEQ ID NO: 587668 - RNA, 19 nt, Homo sapiens
ggacuacccauagacauga

SEQ ID NO: 587669 - RNA, 19 nt, Homo sapiens
ugacauuucuucuagugau

SEQ ID NO: 587670 - RNA, 19 nt, Homo sapiens
guacugcccugacccuuac

SEQ ID NO: 587671 - RNA, 19 nt, Homo sapiens
caaacugcuucccuuacuu

SEQ ID NO: 587672 - RNA, 19 nt, Homo sapiens
gugugaaauugcauacuuu

SEQ ID NO: 587673 - RNA, 19 nt, Homo sapiens
gcaugcaaaugagcucuga

SEQ ID NO: 587674 - RNA, 19 nt, Homo sapiens
aaacgaagaguucccuuga

SEQ ID NO: 587675 - RNA, 19 nt, Homo sapiens
guagaggcuuguuuaccuu

SEQ ID NO: 587676 - RNA, 19 nt, Homo sapiens
ucaauacagucuccaucuu

SEQ ID NO: 587677 - RNA, 19 nt, Homo sapiens
gaaacagaccucaauacag

SEQ ID NO: 587678 - RNA, 19 nt, Homo sapiens
agacaaacugcuucccuua

SEQ ID NO: 587679 - RNA, 19 nt, Homo sapiens
gaucagacauucagagauu

SEQ ID NO: 587680 - RNA, 19 nt, Homo sapiens
gcccagaauuucauacuua

SEQ ID NO: 587681 - RNA, 19 nt, Homo sapiens
gcagagugcuucccaguga

SEQ ID NO: 587682 - RNA, 19 nt, Homo sapiens
ggagagauuucaugaggaa

SEQ ID NO: 587683 - RNA, 19 nt, Homo sapiens
gggagccgcugccauagua

SEQ ID NO: 587684 - RNA, 19 nt, Homo sapiens
gcacaucucacuucaguug

SEQ ID NO: 587685 - RNA, 19 nt, Homo sapiens
cagcaaagccguucucuug

SEQ ID NO: 587686 - RNA, 19 nt, Homo sapiens
caacaugaacgaugccaua

SEQ ID NO: 587687 - RNA, 19 nt, Homo sapiens
guaagaggaugugguuauu

SEQ ID NO: 587688 - RNA, 19 nt, Homo sapiens
ggacaggcuucgucucaga

SEQ ID NO: 587689 - RNA, 19 nt, Homo sapiens
gagaggcaccugcugcuua

SEQ ID NO: 587690 - RNA, 19 nt, Homo sapiens
gcuguuagcacguuaguaa

SEQ ID NO: 587691 - RNA, 19 nt, Homo sapiens
gaacaggccgcacaucuca

SEQ ID NO: 587692 - RNA, 19 nt, Homo sapiens
caugaacgaugccauauuc

SEQ ID NO: 587693 - RNA, 19 nt, Homo sapiens
ggagugaaguggugugauc

SEQ ID NO: 587694 - RNA, 19 nt, Homo sapiens
ugacagagcccuaucuaug

SEQ ID NO: 587695 - RNA, 19 nt, Homo sapiens
ugaaaccucuguucucaug

SEQ ID NO: 587696 - RNA, 19 nt, Homo sapiens
gcacguaagucacugaaaa

SEQ ID NO: 587697 - RNA, 19 nt, Homo sapiens
gaaugcaugugugaagauu

SEQ ID NO: 587698 - RNA, 19 nt, Homo sapiens
gcacguaguuugcauucca

SEQ ID NO: 587699 - RNA, 19 nt, Homo sapiens
gagauuagucuuagguuug

SEQ ID NO: 587700 - RNA, 19 nt, Homo sapiens
ccacagcacucggccuaaa

SEQ ID NO: 587701 - RNA, 19 nt, Homo sapiens
cuagaugcauccagugaaa

SEQ ID NO: 587702 - RNA, 19 nt, Homo sapiens
cgaaagugaggaaauguuu

SEQ ID NO: 587703 - RNA, 19 nt, Homo sapiens
cuggaaccauccucuguua

SEQ ID NO: 587704 - RNA, 19 nt, Homo sapiens
cacagcaggugacaacuga

SEQ ID NO: 587705 - RNA, 19 nt, Homo sapiens
aaaccucuguucucaugaa

SEQ ID NO: 587706 - RNA, 19 nt, Homo sapiens
agagauuagucuuagguuu

SEQ ID NO: 587707 - RNA, 19 nt, Homo sapiens
gaguugacuugguagaguu

SEQ ID NO: 587708 - RNA, 19 nt, Homo sapiens
gacagagcccuaucuaugu

SEQ ID NO: 587709 - RNA, 19 nt, Homo sapiens
gcuguugauuccacugaaa

SEQ ID NO: 587710 - RNA, 19 nt, Homo sapiens
acggagaguugacuuggua

SEQ ID NO: 587711 - RNA, 19 nt, Homo sapiens
ggccagacacggcauuaaa

SEQ ID NO: 587712 - RNA, 19 nt, Homo sapiens
gcaugugugaagauuauaa

SEQ ID NO: 587713 - RNA, 19 nt, Homo sapiens
agucuuagguuugcacgua

SEQ ID NO: 587714 - RNA, 19 nt, Homo sapiens
gccauaguauccacagaga

SEQ ID NO: 587715 - RNA, 19 nt, Homo sapiens
cuuauggccuuuacaugaa

SEQ ID NO: 587716 - RNA, 19 nt, Homo sapiens
ccgcacaucucacuucagu

SEQ ID NO: 587717 - RNA, 19 nt, Homo sapiens
ccgauugguuccaucauau

SEQ ID NO: 587718 - RNA, 19 nt, Homo sapiens
ugauuagccucgucuuuca

SEQ ID NO: 587719 - RNA, 19 nt, Homo sapiens
ugucuguccuggucaguuu

SEQ ID NO: 587720 - RNA, 19 nt, Homo sapiens
aaaacaggcugcuuagauu

SEQ ID NO: 587721 - RNA, 19 nt, Homo sapiens
cguguucgcuggcugauca

SEQ ID NO: 587722 - RNA, 19 nt, Homo sapiens
ggugagagagcacuucaga

SEQ ID NO: 587723 - RNA, 19 nt, Homo sapiens
aaacaggcugcuuagauuu

SEQ ID NO: 587724 - RNA, 19 nt, Homo sapiens
gcuuugcccuugaauucuu

SEQ ID NO: 587725 - RNA, 19 nt, Homo sapiens
cuaaagugcugggauuaca

SEQ ID NO: 587726 - RNA, 19 nt, Homo sapiens
ggcagggucucacucuguu

SEQ ID NO: 587727 - RNA, 19 nt, Homo sapiens
cuucuaaagugcugggauu

SEQ ID NO: 587728 - RNA, 19 nt, Homo sapiens
gagcugggacucaguucuu

SEQ ID NO: 587729 - RNA, 19 nt, Homo sapiens
gagauuucaugaggaacuu

SEQ ID NO: 587730 - RNA, 19 nt, Homo sapiens
agaggcaccugcugcuuau

SEQ ID NO: 587731 - RNA, 19 nt, Homo sapiens
agagagcacuucagaacca

SEQ ID NO: 587732 - RNA, 19 nt, Homo sapiens
ccucuguucucaugaagga

SEQ ID NO: 587733 - RNA, 19 nt, Homo sapiens
cgaccucccuggcuugagu

SEQ ID NO: 587734 - RNA, 19 nt, Homo sapiens
ccaugucuguaguugcuuu

SEQ ID NO: 587735 - RNA, 19 nt, Homo sapiens
cgagguuccugucaauaca

SEQ ID NO: 587736 - RNA, 19 nt, Homo sapiens
uccgauugguuccaucaua

SEQ ID NO: 587737 - RNA, 19 nt, Homo sapiens
cgagucagcacguaguuug

SEQ ID NO: 587738 - RNA, 19 nt, Homo sapiens
gugcuuugcccuugaauuc

SEQ ID NO: 587739 - RNA, 19 nt, Homo sapiens
ucacagaggcgguuguaag

SEQ ID NO: 587740 - RNA, 19 nt, Homo sapiens
uguuagcacguuaguaaua

SEQ ID NO: 587741 - RNA, 19 nt, Homo sapiens
ggguggcuuuggcgcuuua

SEQ ID NO: 587742 - RNA, 19 nt, Homo sapiens
gcugacagagcccuaucua

SEQ ID NO: 587743 - RNA, 19 nt, Homo sapiens
gcugugguuucucguacuu

SEQ ID NO: 587744 - RNA, 19 nt, Homo sapiens
uaagaggaugugguuauuu

SEQ ID NO: 587745 - RNA, 19 nt, Homo sapiens
ccauagguuugccggaaga

SEQ ID NO: 587746 - RNA, 19 nt, Homo sapiens
ggacuucuacgagcagaug

SEQ ID NO: 587747 - RNA, 19 nt, Homo sapiens
acugaaaccucuguucuca

SEQ ID NO: 587748 - RNA, 19 nt, Homo sapiens
cugaguagcugggacuaga

SEQ ID NO: 587749 - RNA, 19 nt, Homo sapiens
aagaggaugugguuauuuu

SEQ ID NO: 587750 - RNA, 19 nt, Homo sapiens
cccagaauuucauacuuau

SEQ ID NO: 587751 - RNA, 19 nt, Homo sapiens
guaccauguugcccagaau

SEQ ID NO: 587752 - RNA, 19 nt, Homo sapiens
gacaacugauggcuucucu

SEQ ID NO: 587753 - RNA, 19 nt, Homo sapiens
ugagagagcacuucagaac

SEQ ID NO: 587754 - RNA, 19 nt, Homo sapiens
uugguuccaucauaucuuu

SEQ ID NO: 587755 - RNA, 19 nt, Homo sapiens
augcaugugugaagauuau

SEQ ID NO: 587756 - RNA, 19 nt, Homo sapiens
gaauucuuuuccucucuua

SEQ ID NO: 587757 - RNA, 19 nt, Homo sapiens
cacagaggcgguuguaaga

SEQ ID NO: 587758 - RNA, 19 nt, Homo sapiens
gcccgagguuccugucaau

SEQ ID NO: 587759 - RNA, 19 nt, Homo sapiens
ucacugagcccugcguguu

SEQ ID NO: 587760 - RNA, 19 nt, Homo sapiens
ucagugcuuugcccuugaa

SEQ ID NO: 587761 - RNA, 19 nt, Homo sapiens
acagcacucggccuaaaua

SEQ ID NO: 587762 - RNA, 19 nt, Homo sapiens
gugauuagccucgucuuuc

SEQ ID NO: 587763 - RNA, 19 nt, Homo sapiens
uguaagaggaugugguuau

SEQ ID NO: 587764 - RNA, 19 nt, Homo sapiens
gcaggaggagagggaagua

SEQ ID NO: 587765 - RNA, 19 nt, Homo sapiens
uuacaugaauacgucuuga

SEQ ID NO: 587766 - RNA, 19 nt, Homo sapiens
gcagagguuguguggaguu

SEQ ID NO: 587767 - RNA, 19 nt, Homo sapiens
gacagucccaguucccauu

SEQ ID NO: 587768 - RNA, 19 nt, Homo sapiens
cauaguauccacagagaag

SEQ ID NO: 587769 - RNA, 19 nt, Homo sapiens
caguaugugugcucuuauc

SEQ ID NO: 587770 - RNA, 19 nt, Homo sapiens
ggguggugcugacacugaa

SEQ ID NO: 587771 - RNA, 19 nt, Homo sapiens
acagagcccuaucuauguc

SEQ ID NO: 587772 - RNA, 19 nt, Homo sapiens
ggaggagagggaaguagug

SEQ ID NO: 587773 - RNA, 19 nt, Homo sapiens
guuagcacguuaguaauac

SEQ ID NO: 587774 - RNA, 19 nt, Homo sapiens
acuuauggccuuuacauga

SEQ ID NO: 587775 - RNA, 19 nt, Homo sapiens
gaaggagaagauugacauc

SEQ ID NO: 587776 - RNA, 19 nt, Homo sapiens
caaguccuuugcacacauc

SEQ ID NO: 587777 - RNA, 19 nt, Homo sapiens
gagcaguucugugcguuuu

SEQ ID NO: 587778 - RNA, 19 nt, Homo sapiens
guguguuucuugcuuugaa

SEQ ID NO: 587779 - RNA, 19 nt, Homo sapiens
gaaauauguugguguguuu

SEQ ID NO: 587780 - RNA, 19 nt, Homo sapiens
gaagggcuguugaauugua

SEQ ID NO: 587781 - RNA, 19 nt, Homo sapiens
gaaccuggcuacuucagaa

SEQ ID NO: 587782 - RNA, 19 nt, Homo sapiens
gaaggaagcacccucacua

SEQ ID NO: 587783 - RNA, 19 nt, Homo sapiens
ccaauuaccuuaugugagu

SEQ ID NO: 587784 - RNA, 19 nt, Homo sapiens
gaacgggaaugacaaacau

SEQ ID NO: 587785 - RNA, 19 nt, Homo sapiens
gaagcaaaguuggaaagaa

SEQ ID NO: 587786 - RNA, 19 nt, Homo sapiens
ggcgugagauucaacauuu

SEQ ID NO: 587787 - RNA, 19 nt, Homo sapiens
ugaggaaacuacuaagaaa

SEQ ID NO: 587788 - RNA, 19 nt, Homo sapiens
cuacaucacuggcagacua

SEQ ID NO: 587789 - RNA, 19 nt, Homo sapiens
aggaagggcuguugaauug

SEQ ID NO: 587790 - RNA, 19 nt, Homo sapiens
gaaaugggucuguauuaug

SEQ ID NO: 587791 - RNA, 19 nt, Homo sapiens
ggugaugaaucuuuacuau

SEQ ID NO: 587792 - RNA, 19 nt, Homo sapiens
ugaaaugggucuguauuau

SEQ ID NO: 587793 - RNA, 19 nt, Homo sapiens
ggaagcacccucacuaugu

SEQ ID NO: 587794 - RNA, 19 nt, Homo sapiens
uggcugggaugcuaaauuu

SEQ ID NO: 587795 - RNA, 19 nt, Homo sapiens
gaagcacccucacuaugug

SEQ ID NO: 587796 - RNA, 19 nt, Homo sapiens
ggacuggacucuuccuaag

SEQ ID NO: 587797 - RNA, 19 nt, Homo sapiens
guucuugccuuauuaaaca

SEQ ID NO: 587798 - RNA, 19 nt, Homo sapiens
ucagaguacuaacauguuu

SEQ ID NO: 587799 - RNA, 19 nt, Homo sapiens
ugaauaugcucaaagugaa

SEQ ID NO: 587800 - RNA, 19 nt, Homo sapiens
acugaggacucuaugaaua

SEQ ID NO: 587801 - RNA, 19 nt, Homo sapiens
gagcaucgcugcagcuacu

SEQ ID NO: 587802 - RNA, 19 nt, Homo sapiens
gaaccucauuggugugauc

SEQ ID NO: 587803 - RNA, 19 nt, Homo sapiens
aaacaugacacaguccuua

SEQ ID NO: 587804 - RNA, 19 nt, Homo sapiens
ucauuuaucuggcaucauc

SEQ ID NO: 587805 - RNA, 19 nt, Homo sapiens
agaaauauguugguguguu

SEQ ID NO: 587806 - RNA, 19 nt, Homo sapiens
uugaugcccuuuacaauau

SEQ ID NO: 587807 - RNA, 19 nt, Homo sapiens
cuucaucccucuaucuuau

SEQ ID NO: 587808 - RNA, 19 nt, Homo sapiens
aaaugggucuguauuaugg

SEQ ID NO: 587809 - RNA, 19 nt, Homo sapiens
uaaacagaguagauggaaa

SEQ ID NO: 587810 - RNA, 19 nt, Homo sapiens
aagcaaaguuggaaagaag

SEQ ID NO: 587811 - RNA, 19 nt, Homo sapiens
gugaggaaacuacuaagaa

SEQ ID NO: 587812 - RNA, 19 nt, Homo sapiens
gacuauuugucuaaaguga

SEQ ID NO: 587813 - RNA, 19 nt, Homo sapiens
gaaugaagcaaaguuggaa

SEQ ID NO: 587814 - RNA, 19 nt, Homo sapiens
gaaggaagggcuguugaau

SEQ ID NO: 587815 - RNA, 19 nt, Homo sapiens
uuacaccaauuaccuuaug

SEQ ID NO: 587816 - RNA, 19 nt, Homo sapiens
ugaaauuguuagugucuca

SEQ ID NO: 587817 - RNA, 19 nt, Homo sapiens
gaaguccuuucaagucucu

SEQ ID NO: 587818 - RNA, 19 nt, Homo sapiens
ccuauggacagcaguauuu

SEQ ID NO: 587819 - RNA, 19 nt, Homo sapiens
guggaagccuuuucagaua

SEQ ID NO: 587820 - RNA, 19 nt, Homo sapiens
gcucaaagugaaccucauu

SEQ ID NO: 587821 - RNA, 19 nt, Homo sapiens
ggacagcaguauuuugaug

SEQ ID NO: 587822 - RNA, 19 nt, Homo sapiens
gagcgaaugaagcaaaguu

SEQ ID NO: 587823 - RNA, 19 nt, Homo sapiens
cuaugaauaugcucaaagu

SEQ ID NO: 587824 - RNA, 19 nt, Homo sapiens
ggcauucuuacaccaauua

SEQ ID NO: 587825 - RNA, 19 nt, Homo sapiens
ggaaccugcuggccagaca

SEQ ID NO: 587826 - RNA, 19 nt, Homo sapiens
guugguguguuuguccuua

SEQ ID NO: 587827 - RNA, 19 nt, Homo sapiens
cagaguagauggaaaacaa

SEQ ID NO: 587828 - RNA, 19 nt, Homo sapiens
cauuuguucuugccuuauu

SEQ ID NO: 587829 - RNA, 19 nt, Homo sapiens
uuucagauauccaaagcuu

SEQ ID NO: 587830 - RNA, 19 nt, Homo sapiens
ucaucccucuaucuuauuu

SEQ ID NO: 587831 - RNA, 19 nt, Homo sapiens
gaacacugaggacucuaug

SEQ ID NO: 587832 - RNA, 19 nt, Homo sapiens
gaggaaacuacuaagaaau

SEQ ID NO: 587833 - RNA, 19 nt, Homo sapiens
caucagaguacuaacaugu

SEQ ID NO: 587834 - RNA, 19 nt, Homo sapiens
uuugaugcccuuuacaaua

SEQ ID NO: 587835 - RNA, 19 nt, Homo sapiens
uugaaaugggucuguauua

SEQ ID NO: 587836 - RNA, 19 nt, Homo sapiens
cacuuuaggugaugaaucu

SEQ ID NO: 587837 - RNA, 19 nt, Homo sapiens
gaaaaucagcauaguugaa

SEQ ID NO: 587838 - RNA, 19 nt, Homo sapiens
acacugaggacucuaugaa

SEQ ID NO: 587839 - RNA, 19 nt, Homo sapiens
cagaguacuaacauguuua

SEQ ID NO: 587840 - RNA, 19 nt, Homo sapiens
cccaggcagucuaaagaaa

SEQ ID NO: 587841 - RNA, 19 nt, Homo sapiens
gcugaacacugaggacucu

SEQ ID NO: 587842 - RNA, 19 nt, Homo sapiens
gauuuagaacccaggcuuu

SEQ ID NO: 587843 - RNA, 19 nt, Homo sapiens
aagaaguccuuucaagucu

SEQ ID NO: 587844 - RNA, 19 nt, Homo sapiens
cgaaugaagcaaaguugga

SEQ ID NO: 587845 - RNA, 19 nt, Homo sapiens
gauauucugaggcgugaga

SEQ ID NO: 587846 - RNA, 19 nt, Homo sapiens
gguuggugcuucuuggaau

SEQ ID NO: 587847 - RNA, 19 nt, Homo sapiens
ugagccaccuccaagacaa

SEQ ID NO: 587848 - RNA, 19 nt, Homo sapiens
ggaagccuuuucagauauu

SEQ ID NO: 587849 - RNA, 19 nt, Homo sapiens
ugaggacucuaugaauaug

SEQ ID NO: 587850 - RNA, 19 nt, Homo sapiens
cugcgugucugacggagaa

SEQ ID NO: 587851 - RNA, 19 nt, Homo sapiens
uuaccaagauggagagcau

SEQ ID NO: 587852 - RNA, 19 nt, Homo sapiens
aaacuggguuggugcuucu

SEQ ID NO: 587853 - RNA, 19 nt, Homo sapiens
aaggaagggcuguugaauu

SEQ ID NO: 587854 - RNA, 19 nt, Homo sapiens
ugaaggaagggcuguugaa

SEQ ID NO: 587855 - RNA, 19 nt, Homo sapiens
guauggaguggaagccuuu

SEQ ID NO: 587856 - RNA, 19 nt, Homo sapiens
acaaguaugucuuuaucac

SEQ ID NO: 587857 - RNA, 19 nt, Homo sapiens
gaaugacaaacaugacaca

SEQ ID NO: 587858 - RNA, 19 nt, Homo sapiens
ucagaacgggaaugacaaa

SEQ ID NO: 587859 - RNA, 19 nt, Homo sapiens
uaagcaaguccgagaagga

SEQ ID NO: 587860 - RNA, 19 nt, Homo sapiens
caaagugaaccucauuggu

SEQ ID NO: 587861 - RNA, 19 nt, Homo sapiens
ggacucuuccuaagcaagu

SEQ ID NO: 587862 - RNA, 19 nt, Homo sapiens
gcuuaccacuuuaggugau

SEQ ID NO: 587863 - RNA, 19 nt, Homo sapiens
ucagauauccaaagcuuac

SEQ ID NO: 587864 - RNA, 19 nt, Homo sapiens
caucaucagaguacuaaca

SEQ ID NO: 587865 - RNA, 19 nt, Homo sapiens
augaauaugcucaaaguga

SEQ ID NO: 587866 - RNA, 19 nt, Homo sapiens
gagagcaucgcugcagcua

SEQ ID NO: 587867 - RNA, 19 nt, Homo sapiens
ggcaucaucagaguacuaa

SEQ ID NO: 587868 - RNA, 19 nt, Homo sapiens
gggaaugacaaacaugaca

SEQ ID NO: 587869 - RNA, 19 nt, Homo sapiens
agaguugcuuucuuuguag

SEQ ID NO: 587870 - RNA, 19 nt, Homo sapiens
gcaggcauucuuacaccaa

SEQ ID NO: 587871 - RNA, 19 nt, Homo sapiens
uguuuguccuuacuugaaa

SEQ ID NO: 587872 - RNA, 19 nt, Homo sapiens
gcccaggcagucuaaagaa

SEQ ID NO: 587873 - RNA, 19 nt, Homo sapiens
ucacuggcagacuacauuu

SEQ ID NO: 587874 - RNA, 19 nt, Homo sapiens
aguugaaccuggcuacuuc

SEQ ID NO: 587875 - RNA, 19 nt, Homo sapiens
aaacagaguagauggaaaa

SEQ ID NO: 587876 - RNA, 19 nt, Homo sapiens
ccuugagcaugcuuccuuu

SEQ ID NO: 587877 - RNA, 19 nt, Homo sapiens
caccaauuaccuuauguga

SEQ ID NO: 587878 - RNA, 19 nt, Homo sapiens
acggugacccuggauguua

SEQ ID NO: 587879 - RNA, 19 nt, Homo sapiens
gaacugaccucccaggaua

SEQ ID NO: 587880 - RNA, 19 nt, Homo sapiens
ggaagaugcugaagaguuu

SEQ ID NO: 587881 - RNA, 19 nt, Homo sapiens
gaagagacauaugaugaua

SEQ ID NO: 587882 - RNA, 19 nt, Homo sapiens
gcgaagagauuccaagaaa

SEQ ID NO: 587883 - RNA, 19 nt, Homo sapiens
ggacagcucugaugauaau

SEQ ID NO: 587884 - RNA, 19 nt, Homo sapiens
caucaaaccuguuacuaaa

SEQ ID NO: 587885 - RNA, 19 nt, Homo sapiens
gaucauaguuucuuuggau

SEQ ID NO: 587886 - RNA, 19 nt, Homo sapiens
gaucugagcuccuuaacca

SEQ ID NO: 587887 - RNA, 19 nt, Homo sapiens
gaagagauuccaagaaaga

SEQ ID NO: 587888 - RNA, 19 nt, Homo sapiens
caaagaaggugagagagaa

SEQ ID NO: 587889 - RNA, 19 nt, Homo sapiens
caaauaaacuugggaugug

SEQ ID NO: 587890 - RNA, 19 nt, Homo sapiens
gcaaggaguauaacaugua

SEQ ID NO: 587891 - RNA, 19 nt, Homo sapiens
caggacagcucugaugaua

SEQ ID NO: 587892 - RNA, 19 nt, Homo sapiens
gcagaagguuugcggaaug

SEQ ID NO: 587893 - RNA, 19 nt, Homo sapiens
cagaagcgaugguguguug

SEQ ID NO: 587894 - RNA, 19 nt, Homo sapiens
ucacagagaccauauucua

SEQ ID NO: 587895 - RNA, 19 nt, Homo sapiens
ggagaaagaagaagaagau

SEQ ID NO: 587896 - RNA, 19 nt, Homo sapiens
ggacauuacugguuguucu

SEQ ID NO: 587897 - RNA, 19 nt, Homo sapiens
ugaagagcaugaucuagaa

SEQ ID NO: 587898 - RNA, 19 nt, Homo sapiens
aagcaaagaucauaguuuc

SEQ ID NO: 587899 - RNA, 19 nt, Homo sapiens
ggaagaggcacguucauca

SEQ ID NO: 587900 - RNA, 19 nt, Homo sapiens
caaggaguauaacauguau

SEQ ID NO: 587901 - RNA, 19 nt, Homo sapiens
gaacagccucguugggauu

SEQ ID NO: 587902 - RNA, 19 nt, Homo sapiens
gagacuggguggaucaaau

SEQ ID NO: 587903 - RNA, 19 nt, Homo sapiens
aaaaggagcucaagaacuu

SEQ ID NO: 587904 - RNA, 19 nt, Homo sapiens
ggacaggacagcucugaug

SEQ ID NO: 587905 - RNA, 19 nt, Homo sapiens
gaugaaacccaggaaauau

SEQ ID NO: 587906 - RNA, 19 nt, Homo sapiens
gagcaaggaguauaacaug

SEQ ID NO: 587907 - RNA, 19 nt, Homo sapiens
gaagaggcacguucaucaa

SEQ ID NO: 587908 - RNA, 19 nt, Homo sapiens
uaugaagucuugccagaug

SEQ ID NO: 587909 - RNA, 19 nt, Homo sapiens
gggaauggaagacaucgua

SEQ ID NO: 587910 - RNA, 19 nt, Homo sapiens
gaccucauccguauucuga

SEQ ID NO: 587911 - RNA, 19 nt, Homo sapiens
gaguagacuaugccaguua

SEQ ID NO: 587912 - RNA, 19 nt, Homo sapiens
ggaguagacuaugccaguu

SEQ ID NO: 587913 - RNA, 19 nt, Homo sapiens
gaucacagagaccauauuc

SEQ ID NO: 587914 - RNA, 19 nt, Homo sapiens
gaauggaagacaucguaaa

SEQ ID NO: 587915 - RNA, 19 nt, Homo sapiens
cuacagaggagaaagaaga

SEQ ID NO: 587916 - RNA, 19 nt, Homo sapiens
aagaagagacauaugauga

SEQ ID NO: 587917 - RNA, 19 nt, Homo sapiens
ccuuaaccauuccauauga

SEQ ID NO: 587918 - RNA, 19 nt, Homo sapiens
aaggauacuuggagaagaa

SEQ ID NO: 587919 - RNA, 19 nt, Homo sapiens
ucaucaaaccuguuacuaa

SEQ ID NO: 587920 - RNA, 19 nt, Homo sapiens
gugcagacccacuaucuug

SEQ ID NO: 587921 - RNA, 19 nt, Homo sapiens
gaauccugcuuugaacuga

SEQ ID NO: 587922 - RNA, 19 nt, Homo sapiens
ucaaagccagguacuauug

SEQ ID NO: 587923 - RNA, 19 nt, Homo sapiens
cagaagguuugcggaauga

SEQ ID NO: 587924 - RNA, 19 nt, Homo sapiens
cagaugaacuguccuucca

SEQ ID NO: 587925 - RNA, 19 nt, Homo sapiens
ugaagaggaugaggaggaa

SEQ ID NO: 587926 - RNA, 19 nt, Homo sapiens
ggaauggaagacaucguaa

SEQ ID NO: 587927 - RNA, 19 nt, Homo sapiens
gaggaggacauuacugguu

SEQ ID NO: 587928 - RNA, 19 nt, Homo sapiens
cuaaaccagccuagucaua

SEQ ID NO: 587929 - RNA, 19 nt, Homo sapiens
ugaaguggaagaaagauga

SEQ ID NO: 587930 - RNA, 19 nt, Homo sapiens
gagaaagaagaagaagaua

SEQ ID NO: 587931 - RNA, 19 nt, Homo sapiens
agaugaaacccaggaaaua

SEQ ID NO: 587932 - RNA, 19 nt, Homo sapiens
gaaagaugaaacccaggaa

SEQ ID NO: 587933 - RNA, 19 nt, Homo sapiens
ggaugaggaggaagaagaa

SEQ ID NO: 587934 - RNA, 19 nt, Homo sapiens
agacuggguggaucaaaua

SEQ ID NO: 587935 - RNA, 19 nt, Homo sapiens
gaagguuugcggaaugaga

SEQ ID NO: 587936 - RNA, 19 nt, Homo sapiens
gaaguggaagaaagaugaa

SEQ ID NO: 587937 - RNA, 19 nt, Homo sapiens
ucucaccacugccuuugaa

SEQ ID NO: 587938 - RNA, 19 nt, Homo sapiens
gaaaaggaguagacuaugc

SEQ ID NO: 587939 - RNA, 19 nt, Homo sapiens
cgaagagauuccaagaaag

SEQ ID NO: 587940 - RNA, 19 nt, Homo sapiens
cuacuaugcuaaugagaag

SEQ ID NO: 587941 - RNA, 19 nt, Homo sapiens
gacaggacagcucugauga

SEQ ID NO: 587942 - RNA, 19 nt, Homo sapiens
acaaagaaggugagagaga

SEQ ID NO: 587943 - RNA, 19 nt, Homo sapiens
ugaaacccaggaaauauau

SEQ ID NO: 587944 - RNA, 19 nt, Homo sapiens
gcgcagcuaugaguuuaca

SEQ ID NO: 587945 - RNA, 19 nt, Homo sapiens
aggcgcagcuaugaguuua

SEQ ID NO: 587946 - RNA, 19 nt, Homo sapiens
aaucacagcgggacucuug

SEQ ID NO: 587947 - RNA, 19 nt, Homo sapiens
aaucaaagccagguacuau

SEQ ID NO: 587948 - RNA, 19 nt, Homo sapiens
ggauuguuccaaaggagua

SEQ ID NO: 587949 - RNA, 19 nt, Homo sapiens
ggguggaucaaauaaguuu

SEQ ID NO: 587950 - RNA, 19 nt, Homo sapiens
gaaacccaggaaauauauu

SEQ ID NO: 587951 - RNA, 19 nt, Homo sapiens
ccuggaagaugcugaagag

SEQ ID NO: 587952 - RNA, 19 nt, Homo sapiens
gaagagcaagcagcccaaa

SEQ ID NO: 587953 - RNA, 19 nt, Homo sapiens
uaccagggccuaugggauu

SEQ ID NO: 587954 - RNA, 19 nt, Homo sapiens
ggcagaagguuugcggaau

SEQ ID NO: 587955 - RNA, 19 nt, Homo sapiens
gaggucucuucuacuacua

SEQ ID NO: 587956 - RNA, 19 nt, Homo sapiens
acaaauaaacuugggaugu

SEQ ID NO: 587957 - RNA, 19 nt, Homo sapiens
ggaggacauuacugguugu

SEQ ID NO: 587958 - RNA, 19 nt, Homo sapiens
uaaaccagccuagucauag

SEQ ID NO: 587959 - RNA, 19 nt, Homo sapiens
ucagagugacuguaagcua

SEQ ID NO: 587960 - RNA, 19 nt, Homo sapiens
cccaggaaauauauucuuc

SEQ ID NO: 587961 - RNA, 19 nt, Homo sapiens
cuacuacuaugcuaaugag

SEQ ID NO: 587962 - RNA, 19 nt, Homo sapiens
uggaagaugcugaagaguu

SEQ ID NO: 587963 - RNA, 19 nt, Homo sapiens
uguucuggcugguuugaaa

SEQ ID NO: 587964 - RNA, 19 nt, Homo sapiens
cuacggggcuuucagcaaa

SEQ ID NO: 587965 - RNA, 19 nt, Homo sapiens
uaagcuaccaguaagacaa

SEQ ID NO: 587966 - RNA, 19 nt, Homo sapiens
caccucagagugacuguaa

SEQ ID NO: 587967 - RNA, 19 nt, Homo sapiens
gccagguacuauugggauu

SEQ ID NO: 587968 - RNA, 19 nt, Homo sapiens
aaagaagagacauaugaug

SEQ ID NO: 587969 - RNA, 19 nt, Homo sapiens
cagaggagaaagaagaaga

SEQ ID NO: 587970 - RNA, 19 nt, Homo sapiens
gaaggugagagagaaggaa

SEQ ID NO: 587971 - RNA, 19 nt, Homo sapiens
augaaacccaggaaauaua

SEQ ID NO: 587972 - RNA, 19 nt, Homo sapiens
aaagaugaaacccaggaaa

SEQ ID NO: 587973 - RNA, 19 nt, Homo sapiens
aauauauucuucccucucu

SEQ ID NO: 587974 - RNA, 19 nt, Homo sapiens
ggugaccucauccguauuc

SEQ ID NO: 587975 - RNA, 19 nt, Homo sapiens
gagaaccucagcgcuguug

SEQ ID NO: 587976 - RNA, 19 nt, Homo sapiens
gaaccucagcgcuguugca

SEQ ID NO: 587977 - RNA, 19 nt, Homo sapiens
uccguuggcuccuggaaga

SEQ ID NO: 587978 - RNA, 19 nt, Homo sapiens
ggucucuucuacuacuaug

SEQ ID NO: 587979 - RNA, 19 nt, Homo sapiens
gcacagaacuucccagaug

SEQ ID NO: 587980 - RNA, 19 nt, Homo sapiens
gaauuuagcuaucaaccua

SEQ ID NO: 587981 - RNA, 19 nt, Homo sapiens
gaagaaucaucgugacuuu

SEQ ID NO: 587982 - RNA, 19 nt, Homo sapiens
cauaguagaugaaagagua

SEQ ID NO: 587983 - RNA, 19 nt, Homo sapiens
gaucacaaccucaucauaa

SEQ ID NO: 587984 - RNA, 19 nt, Homo sapiens
ugaagaagcuuauauugug

SEQ ID NO: 587985 - RNA, 19 nt, Homo sapiens
ggaggaugcuggcccauaa

SEQ ID NO: 587986 - RNA, 19 nt, Homo sapiens
gaagugagcauugagauuu

SEQ ID NO: 587987 - RNA, 19 nt, Homo sapiens
gaagaagcuuauauuguga

SEQ ID NO: 587988 - RNA, 19 nt, Homo sapiens
caucaagugucucagauaa

SEQ ID NO: 587989 - RNA, 19 nt, Homo sapiens
gaaaugggaagacaugaaa

SEQ ID NO: 587990 - RNA, 19 nt, Homo sapiens
gaugaccucucugaguuua

SEQ ID NO: 587991 - RNA, 19 nt, Homo sapiens
cagcagaagggcaguauua

SEQ ID NO: 587992 - RNA, 19 nt, Homo sapiens
gcacaccucugucuacgau

SEQ ID NO: 587993 - RNA, 19 nt, Homo sapiens
gaagaaaugggaagacaug

SEQ ID NO: 587994 - RNA, 19 nt, Homo sapiens
ggacagggaugcagacacu

SEQ ID NO: 587995 - RNA, 19 nt, Homo sapiens
ccagauauauggauaaacu

SEQ ID NO: 587996 - RNA, 19 nt, Homo sapiens
gaaccuaaggcucuucauu

SEQ ID NO: 587997 - RNA, 19 nt, Homo sapiens
ggaaaauacugcucaagaa

SEQ ID NO: 587998 - RNA, 19 nt, Homo sapiens
gaacaucaaggcagcaaga

SEQ ID NO: 587999 - RNA, 19 nt, Homo sapiens
ucucugauacugcaaauua

SEQ ID NO: 588000 - RNA, 19 nt, Homo sapiens
caaacccaauuucuacaaa

SEQ ID NO: 588001 - RNA, 19 nt, Homo sapiens
cgaaauguaugugacugua

SEQ ID NO: 588002 - RNA, 19 nt, Homo sapiens
gaagacauuugagcaggaa

SEQ ID NO: 588003 - RNA, 19 nt, Homo sapiens
guccauggcucguucuauu

SEQ ID NO: 588004 - RNA, 19 nt, Homo sapiens
guacaggaucuuacaguuu

SEQ ID NO: 588005 - RNA, 19 nt, Homo sapiens
ccacauaguagaugaaaga

SEQ ID NO: 588006 - RNA, 19 nt, Homo sapiens
ucagaaggaccacauagua

SEQ ID NO: 588007 - RNA, 19 nt, Homo sapiens
ccagaucuauuucaagugu

SEQ ID NO: 588008 - RNA, 19 nt, Homo sapiens
caaccuaauuuuccucuua

SEQ ID NO: 588009 - RNA, 19 nt, Homo sapiens
gcgcuugguugucguuauu

SEQ ID NO: 588010 - RNA, 19 nt, Homo sapiens
aagaugaccucucugaguu

SEQ ID NO: 588011 - RNA, 19 nt, Homo sapiens
cauaauugaucccguugaa

SEQ ID NO: 588012 - RNA, 19 nt, Homo sapiens
uaacaaacccaauuucuac

SEQ ID NO: 588013 - RNA, 19 nt, Homo sapiens
ggaaagauuuagccugaac

SEQ ID NO: 588014 - RNA, 19 nt, Homo sapiens
gaccaacucuccaauucug

SEQ ID NO: 588015 - RNA, 19 nt, Homo sapiens
cagaugauguugcucucua

SEQ ID NO: 588016 - RNA, 19 nt, Homo sapiens
gaaauaacuaagacuccua

SEQ ID NO: 588017 - RNA, 19 nt, Homo sapiens
gguacaggaucuuacaguu

SEQ ID NO: 588018 - RNA, 19 nt, Homo sapiens
gaugaaagaguagaugaaa

SEQ ID NO: 588019 - RNA, 19 nt, Homo sapiens
gagaucaucacgggaguua

SEQ ID NO: 588020 - RNA, 19 nt, Homo sapiens
cagagaaccucagcaccua

SEQ ID NO: 588021 - RNA, 19 nt, Homo sapiens
acagagaaaucacagacuu

SEQ ID NO: 588022 - RNA, 19 nt, Homo sapiens
ucaagugucucagauaauc

SEQ ID NO: 588023 - RNA, 19 nt, Homo sapiens
gagagucuacgaaauguau

SEQ ID NO: 588024 - RNA, 19 nt, Homo sapiens
ggaagugucuuuggaacag

SEQ ID NO: 588025 - RNA, 19 nt, Homo sapiens
ggaagugagcauugagauu

SEQ ID NO: 588026 - RNA, 19 nt, Homo sapiens
ccacccagaucuauuucaa

SEQ ID NO: 588027 - RNA, 19 nt, Homo sapiens
gcacuucacaggcaagaau

SEQ ID NO: 588028 - RNA, 19 nt, Homo sapiens
ugaauuacuuugccaccaa

SEQ ID NO: 588029 - RNA, 19 nt, Homo sapiens
cgcccaagaugaugacuuu

SEQ ID NO: 588030 - RNA, 19 nt, Homo sapiens
gaguggaucucaaagaaac

SEQ ID NO: 588031 - RNA, 19 nt, Homo sapiens
uggaguggaucucaaagaa

SEQ ID NO: 588032 - RNA, 19 nt, Homo sapiens
ggcuaaauaucaggaaauu

SEQ ID NO: 588033 - RNA, 19 nt, Homo sapiens
uccaagaacugcacugaug

SEQ ID NO: 588034 - RNA, 19 nt, Homo sapiens
ggacgaggguaucagaaac

SEQ ID NO: 588035 - RNA, 19 nt, Homo sapiens
cuacaaaucgugugcauca

SEQ ID NO: 588036 - RNA, 19 nt, Homo sapiens
uacaggaucuuacaguuuc

SEQ ID NO: 588037 - RNA, 19 nt, Homo sapiens
caguggagcugguuugcaa

SEQ ID NO: 588038 - RNA, 19 nt, Homo sapiens
caagggagagucuacgaaa

SEQ ID NO: 588039 - RNA, 19 nt, Homo sapiens
aaucacagcugaggaggaa

SEQ ID NO: 588040 - RNA, 19 nt, Homo sapiens
cuaaggcucuucauuuuaa

SEQ ID NO: 588041 - RNA, 19 nt, Homo sapiens
uaauugaucccguugaaga

SEQ ID NO: 588042 - RNA, 19 nt, Homo sapiens
gaaacuuccggucucauug

SEQ ID NO: 588043 - RNA, 19 nt, Homo sapiens
caaaucgugugcaucaagu

SEQ ID NO: 588044 - RNA, 19 nt, Homo sapiens
gauuuagccugaacacagu

SEQ ID NO: 588045 - RNA, 19 nt, Homo sapiens
uggcugagguggaaugguu

SEQ ID NO: 588046 - RNA, 19 nt, Homo sapiens
gaugaaacuuccggucuca

SEQ ID NO: 588047 - RNA, 19 nt, Homo sapiens
cugugaaccuguacuguaa

SEQ ID NO: 588048 - RNA, 19 nt, Homo sapiens
gcaucaagugucucagaua

SEQ ID NO: 588049 - RNA, 19 nt, Homo sapiens
caaauugcuggcuaaauau

SEQ ID NO: 588050 - RNA, 19 nt, Homo sapiens
caagaugaccucucugagu

SEQ ID NO: 588051 - RNA, 19 nt, Homo sapiens
ggaagaaucaucgugacuu

SEQ ID NO: 588052 - RNA, 19 nt, Homo sapiens
ucagggaaguggagaaucu

SEQ ID NO: 588053 - RNA, 19 nt, Homo sapiens
ucccaucaguguucuguuu

SEQ ID NO: 588054 - RNA, 19 nt, Homo sapiens
cagcaucccucucccuauc

SEQ ID NO: 588055 - RNA, 19 nt, Homo sapiens
ggaguggaucucaaagaaa

SEQ ID NO: 588056 - RNA, 19 nt, Homo sapiens
uaucagaaacguacaagga

SEQ ID NO: 588057 - RNA, 19 nt, Homo sapiens
gaaccuguacuguaaagca

SEQ ID NO: 588058 - RNA, 19 nt, Homo sapiens
guggagaaucuaaguguaa

SEQ ID NO: 588059 - RNA, 19 nt, Homo sapiens
acagguacuugaauuacuu

SEQ ID NO: 588060 - RNA, 19 nt, Homo sapiens
ggcgaucucuguaguugug

SEQ ID NO: 588061 - RNA, 19 nt, Homo sapiens
ugauguugcucucuauguu

SEQ ID NO: 588062 - RNA, 19 nt, Homo sapiens
gaaggcguaugugcgcauu

SEQ ID NO: 588063 - RNA, 19 nt, Homo sapiens
guguaaauuuguaccuuga

SEQ ID NO: 588064 - RNA, 19 nt, Homo sapiens
gaaccuacuggcaucgauu

SEQ ID NO: 588065 - RNA, 19 nt, Homo sapiens
gaacacaguggagcugguu

SEQ ID NO: 588066 - RNA, 19 nt, Homo sapiens
ggaugacucucagacacuu

SEQ ID NO: 588067 - RNA, 19 nt, Homo sapiens
gggagagucuacgaaaugu

SEQ ID NO: 588068 - RNA, 19 nt, Homo sapiens
cagauauuauugacucuuc

SEQ ID NO: 588069 - RNA, 19 nt, Homo sapiens
ggaaguggagaaucuaagu

SEQ ID NO: 588070 - RNA, 19 nt, Homo sapiens
gaacuuguagaaccagugu

SEQ ID NO: 588071 - RNA, 19 nt, Homo sapiens
gaucaucacgggaguuaag

SEQ ID NO: 588072 - RNA, 19 nt, Homo sapiens
aaccuaaggcucuucauuu

SEQ ID NO: 588073 - RNA, 19 nt, Homo sapiens
guuguggccuuguuugugu

SEQ ID NO: 588074 - RNA, 19 nt, Homo sapiens
ugauagcagugaucguuug

SEQ ID NO: 588075 - RNA, 19 nt, Homo sapiens
acaccucugucuacgauga

SEQ ID NO: 588076 - RNA, 19 nt, Homo sapiens
gaggaggaaauccagauga

SEQ ID NO: 588077 - RNA, 19 nt, Homo sapiens
guacacaggaaagaaacua

SEQ ID NO: 588078 - RNA, 19 nt, Homo sapiens
gaaggaccacauaguagau

SEQ ID NO: 588079 - RNA, 19 nt, Homo sapiens
gaaauuggcucaacagaaa

SEQ ID NO: 588080 - RNA, 19 nt, Homo sapiens
gcaguuagaugcaucagaa

SEQ ID NO: 588081 - RNA, 19 nt, Homo sapiens
gaagaaaucagaagaugaa

SEQ ID NO: 588082 - RNA, 19 nt, Homo sapiens
guucgaaugucaccaguua

SEQ ID NO: 588083 - RNA, 19 nt, Homo sapiens
gaaaucagaagaugaagaa

SEQ ID NO: 588084 - RNA, 19 nt, Homo sapiens
gagccaacgucucuucuuu

SEQ ID NO: 588085 - RNA, 19 nt, Homo sapiens
gaugacaaauccaaaucua

SEQ ID NO: 588086 - RNA, 19 nt, Homo sapiens
ccugagagauggacaauga

SEQ ID NO: 588087 - RNA, 19 nt, Homo sapiens
gaagacgccgcuaaagaua

SEQ ID NO: 588088 - RNA, 19 nt, Homo sapiens
agacaaaguuggaauugaa

SEQ ID NO: 588089 - RNA, 19 nt, Homo sapiens
caacagaaauaaccuuuac

SEQ ID NO: 588090 - RNA, 19 nt, Homo sapiens
gauggacaaugaaauauca

SEQ ID NO: 588091 - RNA, 19 nt, Homo sapiens
ugugauagcugauuucaau

SEQ ID NO: 588092 - RNA, 19 nt, Homo sapiens
gagcguggcugugugacua

SEQ ID NO: 588093 - RNA, 19 nt, Homo sapiens
gaaguacaguguucuaggu

SEQ ID NO: 588094 - RNA, 19 nt, Homo sapiens
ggcuaugacuuaaauuuga

SEQ ID NO: 588095 - RNA, 19 nt, Homo sapiens
ucaagaaccuaaagaccaa

SEQ ID NO: 588096 - RNA, 19 nt, Homo sapiens
guacaguguucuagguuug

SEQ ID NO: 588097 - RNA, 19 nt, Homo sapiens
uaaacgagguguaaaugca

SEQ ID NO: 588098 - RNA, 19 nt, Homo sapiens
gaucaucgcuugguaaacg

SEQ ID NO: 588099 - RNA, 19 nt, Homo sapiens
agagauggacaaugaaaua

SEQ ID NO: 588100 - RNA, 19 nt, Homo sapiens
ggaauugggaugacaaauc

SEQ ID NO: 588101 - RNA, 19 nt, Homo sapiens
gcaaaggcuaaauuuauug

SEQ ID NO: 588102 - RNA, 19 nt, Homo sapiens
aauugaagcugccgaaaug

SEQ ID NO: 588103 - RNA, 19 nt, Homo sapiens
cauccagccuguucaagaa

SEQ ID NO: 588104 - RNA, 19 nt, Homo sapiens
gaagugauuguucgaaugu

SEQ ID NO: 588105 - RNA, 19 nt, Homo sapiens
acauuuaucuggacuggaa

SEQ ID NO: 588106 - RNA, 19 nt, Homo sapiens
gugaagaaaucagaagaug

SEQ ID NO: 588107 - RNA, 19 nt, Homo sapiens
caccacagaucgauuauac

SEQ ID NO: 588108 - RNA, 19 nt, Homo sapiens
gaagaugaaguacaguguu

SEQ ID NO: 588109 - RNA, 19 nt, Homo sapiens
caagaccagcugauuguuu

SEQ ID NO: 588110 - RNA, 19 nt, Homo sapiens
gaauugaagcugccgaaau

SEQ ID NO: 588111 - RNA, 19 nt, Homo sapiens
caagguuucugaacuacug

SEQ ID NO: 588112 - RNA, 19 nt, Homo sapiens
ugaagaagacgccgcuaaa

SEQ ID NO: 588113 - RNA, 19 nt, Homo sapiens
gggagugugugccucuuga

SEQ ID NO: 588114 - RNA, 19 nt, Homo sapiens
gacaaugaaauaucaguug

SEQ ID NO: 588115 - RNA, 19 nt, Homo sapiens
ggacaaugaaauaucaguu

SEQ ID NO: 588116 - RNA, 19 nt, Homo sapiens
gaaugucaccaguuaaaca

SEQ ID NO: 588117 - RNA, 19 nt, Homo sapiens
ggaauccacacagcagaua

SEQ ID NO: 588118 - RNA, 19 nt, Homo sapiens
gaagaucaaagguggaauc

SEQ ID NO: 588119 - RNA, 19 nt, Homo sapiens
gcagacaaaguuggaauug

SEQ ID NO: 588120 - RNA, 19 nt, Homo sapiens
gaccuccacuggcuguuug

SEQ ID NO: 588121 - RNA, 19 nt, Homo sapiens
ugaagugauuguucgaaug

SEQ ID NO: 588122 - RNA, 19 nt, Homo sapiens
cagacaaaguuggaauuga

SEQ ID NO: 588123 - RNA, 19 nt, Homo sapiens
gcugugugacuaagauaua

SEQ ID NO: 588124 - RNA, 19 nt, Homo sapiens
uaucuggacuggaaaugau

SEQ ID NO: 588125 - RNA, 19 nt, Homo sapiens
gaucgauuauacagugaug

SEQ ID NO: 588126 - RNA, 19 nt, Homo sapiens
guaaaugcagacaaaguug

SEQ ID NO: 588127 - RNA, 19 nt, Homo sapiens
ugucaccaguuaaacaauu

SEQ ID NO: 588128 - RNA, 19 nt, Homo sapiens
uggaagagcuuucguugcu

SEQ ID NO: 588129 - RNA, 19 nt, Homo sapiens
gugaagugauuguucgaau

SEQ ID NO: 588130 - RNA, 19 nt, Homo sapiens
gaagaagacgccgcuaaag

SEQ ID NO: 588131 - RNA, 19 nt, Homo sapiens
ugaaauggcaccacagauc

SEQ ID NO: 588132 - RNA, 19 nt, Homo sapiens
gagaagaucaaagguggaa

SEQ ID NO: 588133 - RNA, 19 nt, Homo sapiens
gaugaaguacaguguucua

SEQ ID NO: 588134 - RNA, 19 nt, Homo sapiens
gcuggaucaucgcuuggua

SEQ ID NO: 588135 - RNA, 19 nt, Homo sapiens
uaugugugauagcugauuu

SEQ ID NO: 588136 - RNA, 19 nt, Homo sapiens
agaagacgccgcuaaagau

SEQ ID NO: 588137 - RNA, 19 nt, Homo sapiens
uaacugagcguggcugugu

SEQ ID NO: 588138 - RNA, 19 nt, Homo sapiens
gccaacgucucuucuuucu

SEQ ID NO: 588139 - RNA, 19 nt, Homo sapiens
aagaugaaguacaguguuc

SEQ ID NO: 588140 - RNA, 19 nt, Homo sapiens
aagaagacgccgcuaaaga

SEQ ID NO: 588141 - RNA, 19 nt, Homo sapiens
gagauggacaaugaaauau

SEQ ID NO: 588142 - RNA, 19 nt, Homo sapiens
ccgcuaaagauacuuauau

SEQ ID NO: 588143 - RNA, 19 nt, Homo sapiens
ugaagaaaucagaagauga

SEQ ID NO: 588144 - RNA, 19 nt, Homo sapiens
gguaaacgagguguaaaug

SEQ ID NO: 588145 - RNA, 19 nt, Homo sapiens
gcaccacagaucgauuaua

SEQ ID NO: 588146 - RNA, 19 nt, Homo sapiens
gggcagaaauuggcucaac

SEQ ID NO: 588147 - RNA, 19 nt, Homo sapiens
gcaaaccgcgauacauuuu

SEQ ID NO: 588148 - RNA, 19 nt, Homo sapiens
uuugaaagguggaacuaau

SEQ ID NO: 588149 - RNA, 19 nt, Homo sapiens
agaaauuggcucaacagaa

SEQ ID NO: 588150 - RNA, 19 nt, Homo sapiens
auacagugauggucuucaa

SEQ ID NO: 588151 - RNA, 19 nt, Homo sapiens
uggcaccacagaucgauua

SEQ ID NO: 588152 - RNA, 19 nt, Homo sapiens
ggcagaaauuggcucaaca

SEQ ID NO: 588153 - RNA, 19 nt, Homo sapiens
ugagagauggacaaugaaa

SEQ ID NO: 588154 - RNA, 19 nt, Homo sapiens
ggaccaguuacacuccaua

SEQ ID NO: 588155 - RNA, 19 nt, Homo sapiens
ggccagauccugagagucu

SEQ ID NO: 588156 - RNA, 19 nt, Homo sapiens
uguaaaugcagacaaaguu

SEQ ID NO: 588157 - RNA, 19 nt, Homo sapiens
ggcaauggaaauggaauaa

SEQ ID NO: 588158 - RNA, 19 nt, Homo sapiens
ucgaaugucaccaguuaaa

SEQ ID NO: 588159 - RNA, 19 nt, Homo sapiens
ccacagaucgauuauacag

SEQ ID NO: 588160 - RNA, 19 nt, Homo sapiens
gcugaaauggcaccacaga

SEQ ID NO: 588161 - RNA, 19 nt, Homo sapiens
aaucagaagaugaagaaga

SEQ ID NO: 588162 - RNA, 19 nt, Homo sapiens
acgcaaaccgcgauacauu

SEQ ID NO: 588163 - RNA, 19 nt, Homo sapiens
gcaauggaaauggaauaau

SEQ ID NO: 588164 - RNA, 19 nt, Homo sapiens
gagagauggacaaugaaau

SEQ ID NO: 588165 - RNA, 19 nt, Homo sapiens
gacaaauccaaaucuauag

SEQ ID NO: 588166 - RNA, 19 nt, Homo sapiens
gaagcugccgaaaugcuau

SEQ ID NO: 588167 - RNA, 19 nt, Homo sapiens
ugaagcugccgaaaugcua

SEQ ID NO: 588168 - RNA, 19 nt, Homo sapiens
gcugguguuuugccauuua

SEQ ID NO: 588169 - RNA, 19 nt, Homo sapiens
ggaauugaagcugccgaaa

SEQ ID NO: 588170 - RNA, 19 nt, Homo sapiens
uccacuggcuguuuguuug

SEQ ID NO: 588171 - RNA, 19 nt, Homo sapiens
uuagaugcaucagaaagga

SEQ ID NO: 588172 - RNA, 19 nt, Homo sapiens
gucaccaguuaaacaauug

SEQ ID NO: 588173 - RNA, 19 nt, Homo sapiens
cagaucgauuauacaguga

SEQ ID NO: 588174 - RNA, 19 nt, Homo sapiens
cgcaaaccgcgauacauuu

SEQ ID NO: 588175 - RNA, 19 nt, Homo sapiens
agguguaaaugcagacaaa

SEQ ID NO: 588176 - RNA, 19 nt, Homo sapiens
gcaagaccagcugauuguu

SEQ ID NO: 588177 - RNA, 19 nt, Homo sapiens
uggaacuaaugcugaaaug

SEQ ID NO: 588178 - RNA, 19 nt, Homo sapiens
aguacaguguucuagguuu

SEQ ID NO: 588179 - RNA, 19 nt, Homo sapiens
guagagacccuccggauua

SEQ ID NO: 588180 - RNA, 19 nt, Homo sapiens
gaucguggcccuucaauuu

SEQ ID NO: 588181 - RNA, 19 nt, Homo sapiens
cagaguauauggagugaua

SEQ ID NO: 588182 - RNA, 19 nt, Homo sapiens
gcagaagccuggaacucua

SEQ ID NO: 588183 - RNA, 19 nt, Homo sapiens
caagagaaauucacaaacu

SEQ ID NO: 588184 - RNA, 19 nt, Homo sapiens
gacaauacauggacuaugg

SEQ ID NO: 588185 - RNA, 19 nt, Homo sapiens
ugacguaauucacucguuu

SEQ ID NO: 588186 - RNA, 19 nt, Homo sapiens
gcgcucaacucccagaaga

SEQ ID NO: 588187 - RNA, 19 nt, Homo sapiens
auacuggccugacguaauu

SEQ ID NO: 588188 - RNA, 19 nt, Homo sapiens
acagacaauuggucagaua

SEQ ID NO: 588189 - RNA, 19 nt, Homo sapiens
gacaauuggucagauagaa

SEQ ID NO: 588190 - RNA, 19 nt, Homo sapiens
aaccauccaucaauuacua

SEQ ID NO: 588191 - RNA, 19 nt, Homo sapiens
gaacugugccucacuaagc

SEQ ID NO: 588192 - RNA, 19 nt, Homo sapiens
gaggaaguacagacaauug

SEQ ID NO: 588193 - RNA, 19 nt, Homo sapiens
ugacaaccaugaguggaaa

SEQ ID NO: 588194 - RNA, 19 nt, Homo sapiens
acagggagcuggaccucaa

SEQ ID NO: 588195 - RNA, 19 nt, Homo sapiens
cauggacuauggcccgaua

SEQ ID NO: 588196 - RNA, 19 nt, Homo sapiens
ucaacagugugcuucuaaa

SEQ ID NO: 588197 - RNA, 19 nt, Homo sapiens
gacaagcgccugcgugaca

SEQ ID NO: 588198 - RNA, 19 nt, Homo sapiens
ucaacucccagaagaagua

SEQ ID NO: 588199 - RNA, 19 nt, Homo sapiens
guacagacaauuggucaga

SEQ ID NO: 588200 - RNA, 19 nt, Homo sapiens
auagaacugugccucacua

SEQ ID NO: 588201 - RNA, 19 nt, Homo sapiens
agugaaggauguaauagau

SEQ ID NO: 588202 - RNA, 19 nt, Homo sapiens
caucaauuacuaccaaguu

SEQ ID NO: 588203 - RNA, 19 nt, Homo sapiens
gauaaaaccauccaucaau

SEQ ID NO: 588204 - RNA, 19 nt, Homo sapiens
aagagaaauucacaaacug

SEQ ID NO: 588205 - RNA, 19 nt, Homo sapiens
aagccaggaugaggaagua

SEQ ID NO: 588206 - RNA, 19 nt, Homo sapiens
ccucaacagugugcuucua

SEQ ID NO: 588207 - RNA, 19 nt, Homo sapiens
acuaccaaguugcagauuu

SEQ ID NO: 588208 - RNA, 19 nt, Homo sapiens
acagugugcuucuaaaauu

SEQ ID NO: 588209 - RNA, 19 nt, Homo sapiens
cccgcgagauacugguuua

SEQ ID NO: 588210 - RNA, 19 nt, Homo sapiens
cuaccaaguugcagauuuu

SEQ ID NO: 588211 - RNA, 19 nt, Homo sapiens
aagaaguacuuuggcagaa

SEQ ID NO: 588212 - RNA, 19 nt, Homo sapiens
ccggauuacuggacaauac

SEQ ID NO: 588213 - RNA, 19 nt, Homo sapiens
gcgagaaaauucaaaacga

SEQ ID NO: 588214 - RNA, 19 nt, Homo sapiens
gcaagagaaauucacaaac

SEQ ID NO: 588215 - RNA, 19 nt, Homo sapiens
ggucugagagucugugaag

SEQ ID NO: 588216 - RNA, 19 nt, Homo sapiens
ggacaauacauggacuaug

SEQ ID NO: 588217 - RNA, 19 nt, Homo sapiens
gaugaggaaguacagacaa

SEQ ID NO: 588218 - RNA, 19 nt, Homo sapiens
ugagacaguaugcgagaaa

SEQ ID NO: 588219 - RNA, 19 nt, Homo sapiens
ggaaguacagacaauuggu

SEQ ID NO: 588220 - RNA, 19 nt, Homo sapiens
cagcguuucucccggaagu

SEQ ID NO: 588221 - RNA, 19 nt, Homo sapiens
cgauaaaagugaaggaugu

SEQ ID NO: 588222 - RNA, 19 nt, Homo sapiens
gaagucuggcuggcaaaug

SEQ ID NO: 588223 - RNA, 19 nt, Homo sapiens
gccagaguauauggaguga

SEQ ID NO: 588224 - RNA, 19 nt, Homo sapiens
ggagcuggaccucaacagu

SEQ ID NO: 588225 - RNA, 19 nt, Homo sapiens
ggaugaggaaguacagaca

SEQ ID NO: 588226 - RNA, 19 nt, Homo sapiens
gugacaaccaugaguggaa

SEQ ID NO: 588227 - RNA, 19 nt, Homo sapiens
gcucaacucccagaagaag

SEQ ID NO: 588228 - RNA, 19 nt, Homo sapiens
cauacuggccugacguaau

SEQ ID NO: 588229 - RNA, 19 nt, Homo sapiens
cugagagucugugaagaug

SEQ ID NO: 588230 - RNA, 19 nt, Homo sapiens
gcucggagacagcguuucu

SEQ ID NO: 588231 - RNA, 19 nt, Homo sapiens
ggaagucuggcuggcaaau

SEQ ID NO: 588232 - RNA, 19 nt, Homo sapiens
agaaguacuuuggcagaag

SEQ ID NO: 588233 - RNA, 19 nt, Homo sapiens
caacagugugcuucuaaaa

SEQ ID NO: 588234 - RNA, 19 nt, Homo sapiens
ggaccucaacagugugcuu

SEQ ID NO: 588235 - RNA, 19 nt, Homo sapiens
ggcagaagccuggaacucu

SEQ ID NO: 588236 - RNA, 19 nt, Homo sapiens
uagagacccuccggauuac

SEQ ID NO: 588237 - RNA, 19 nt, Homo sapiens
ucugagagucugugaagau

SEQ ID NO: 588238 - RNA, 19 nt, Homo sapiens
ugaggaaguacagacaauu

SEQ ID NO: 588239 - RNA, 19 nt, Homo sapiens
ccaaguugcagauuuuaaa

SEQ ID NO: 588240 - RNA, 19 nt, Homo sapiens
ggcauacuggccugacgua

SEQ ID NO: 588241 - RNA, 19 nt, Homo sapiens
agcaagagaaauucacaaa

SEQ ID NO: 588242 - RNA, 19 nt, Homo sapiens
gagacccuccggauuacug

SEQ ID NO: 588243 - RNA, 19 nt, Homo sapiens
uguagagacccuccggauu

SEQ ID NO: 588244 - RNA, 19 nt, Homo sapiens
gcauacuggccugacguaa

SEQ ID NO: 588245 - RNA, 19 nt, Homo sapiens
ucguggcccuucaauuuag

SEQ ID NO: 588246 - RNA, 19 nt, Homo sapiens
gaaccuggcacgcaagauu

SEQ ID NO: 588247 - RNA, 19 nt, Homo sapiens
acaacgagcuggucaagug

SEQ ID NO: 588248 - RNA, 19 nt, Homo sapiens
ugaggcagcugacagagaa

SEQ ID NO: 588249 - RNA, 19 nt, Homo sapiens
uagaggagcugugccagaa

SEQ ID NO: 588250 - RNA, 19 nt, Homo sapiens
gcagcuaccuucccucacu

SEQ ID NO: 588251 - RNA, 19 nt, Homo sapiens
cagagcaucuuuguucuuc

SEQ ID NO: 588252 - RNA, 19 nt, Homo sapiens
ggacagggguucuccuuca

SEQ ID NO: 588253 - RNA, 19 nt, Homo sapiens
ucaagauccuggagagcuu

SEQ ID NO: 588254 - RNA, 19 nt, Homo sapiens
gagcaucuuuguucuucac

SEQ ID NO: 588255 - RNA, 19 nt, Homo sapiens
gagcuggucaagugcauag

SEQ ID NO: 588256 - RNA, 19 nt, Homo sapiens
caacaacgagcuggucaag

SEQ ID NO: 588257 - RNA, 19 nt, Homo sapiens
gagaaccuggcacgcaaga

SEQ ID NO: 588258 - RNA, 19 nt, Homo sapiens
ggagagcuuccagacuuug

SEQ ID NO: 588259 - RNA, 19 nt, Homo sapiens
ggaggaggaggacgagaag

SEQ ID NO: 588260 - RNA, 19 nt, Homo sapiens
ccuguggccugugauuaug

SEQ ID NO: 588261 - RNA, 19 nt, Homo sapiens
ggaagggagugacuuguua

SEQ ID NO: 588262 - RNA, 19 nt, Homo sapiens
ggagacagaggaagagaua

SEQ ID NO: 588263 - RNA, 19 nt, Homo sapiens
gggagugacuuguuaguuc

SEQ ID NO: 588264 - RNA, 19 nt, Homo sapiens
ggucacaacuccuccaaca

SEQ ID NO: 588265 - RNA, 19 nt, Homo sapiens
gcaccaggaucaucuacga

SEQ ID NO: 588266 - RNA, 19 nt, Homo sapiens
gaccuggcauguggaguua

SEQ ID NO: 588267 - RNA, 19 nt, Homo sapiens
ugcaagaacucacccauug

SEQ ID NO: 588268 - RNA, 19 nt, Homo sapiens
ggaguaagucaccuucuga

SEQ ID NO: 588269 - RNA, 19 nt, Homo sapiens
guacuccuccuaacccuaa

SEQ ID NO: 588270 - RNA, 19 nt, Homo sapiens
aggaagagauacccgauga

SEQ ID NO: 588271 - RNA, 19 nt, Homo sapiens
gccaagcccuuaacucuac

SEQ ID NO: 588272 - RNA, 19 nt, Homo sapiens
ugaaggagcaggagacaga

SEQ ID NO: 588273 - RNA, 19 nt, Homo sapiens
gauaggagugggcaacuug

SEQ ID NO: 588274 - RNA, 19 nt, Homo sapiens
ggccucaucuaaucuggaa

SEQ ID NO: 588275 - RNA, 19 nt, Homo sapiens
uaacucuacuuccucuuca

SEQ ID NO: 588276 - RNA, 19 nt, Homo sapiens
ggauaggagugggcaacuu

SEQ ID NO: 588277 - RNA, 19 nt, Homo sapiens
gauacccgaugacgcacaa

SEQ ID NO: 588278 - RNA, 19 nt, Homo sapiens
gaucaucuacgaccgaaag

SEQ ID NO: 588279 - RNA, 19 nt, Homo sapiens
ccuucugacugcuuaguaa

SEQ ID NO: 588280 - RNA, 19 nt, Homo sapiens
ccagcugggccucaucuaa

SEQ ID NO: 588281 - RNA, 19 nt, Homo sapiens
gcagaugaccuggcaugug

SEQ ID NO: 588282 - RNA, 19 nt, Homo sapiens
caucuacgaccgaaaguuc

SEQ ID NO: 588283 - RNA, 19 nt, Homo sapiens
uccacuagcugcccgauuc

SEQ ID NO: 588284 - RNA, 19 nt, Homo sapiens
uuccaggccuccuuuaguu

SEQ ID NO: 588285 - RNA, 19 nt, Homo sapiens
gaugacgcacaauuugaaa

SEQ ID NO: 588286 - RNA, 19 nt, Homo sapiens
gaagggagugacuuguuag

SEQ ID NO: 588287 - RNA, 19 nt, Homo sapiens
cagcugggccucaucuaau

SEQ ID NO: 588288 - RNA, 19 nt, Homo sapiens
cgaugacgcacaauuugaa

SEQ ID NO: 588289 - RNA, 19 nt, Homo sapiens
gcccuuaacucuacuuccu

SEQ ID NO: 588290 - RNA, 19 nt, Homo sapiens
gugcaagaacucacccauu

SEQ ID NO: 588291 - RNA, 19 nt, Homo sapiens
gcagcuagaccagggauag

SEQ ID NO: 588292 - RNA, 19 nt, Homo sapiens
gaauggaguaagucaccuu

SEQ ID NO: 588293 - RNA, 19 nt, Homo sapiens
ggaggcaccaggaucaucu

SEQ ID NO: 588294 - RNA, 19 nt, Homo sapiens
ugaccuggcauguggaguu

SEQ ID NO: 588295 - RNA, 19 nt, Homo sapiens
ugacugcuuaguaaacauu

SEQ ID NO: 588296 - RNA, 19 nt, Homo sapiens
uggaguaagucaccuucug

SEQ ID NO: 588297 - RNA, 19 nt, Homo sapiens
ccgaugacgcacaauuuga

SEQ ID NO: 588298 - RNA, 19 nt, Homo sapiens
ugaaauggacaucuaaucc

SEQ ID NO: 588299 - RNA, 19 nt, Homo sapiens
ucuaauccagugcagauga

SEQ ID NO: 588300 - RNA, 19 nt, Homo sapiens
caacagccccucucuccaa

SEQ ID NO: 588301 - RNA, 19 nt, Homo sapiens
gaacuggggaauggaguaa

SEQ ID NO: 588302 - RNA, 19 nt, Homo sapiens
gccaggcgguuacuuugcu

SEQ ID NO: 588303 - RNA, 19 nt, Homo sapiens
uggaagggagugacuuguu

SEQ ID NO: 588304 - RNA, 19 nt, Homo sapiens
ggagcaggagacagaggaa

SEQ ID NO: 588305 - RNA, 19 nt, Homo sapiens
ggaaauggguacugaagaa

SEQ ID NO: 588306 - RNA, 19 nt, Homo sapiens
gaacucauccugucaauca

SEQ ID NO: 588307 - RNA, 19 nt, Homo sapiens
uaaggaagguuaaagagaa

SEQ ID NO: 588308 - RNA, 19 nt, Homo sapiens
gaagucaucuguaucuacu

SEQ ID NO: 588309 - RNA, 19 nt, Homo sapiens
agacuucucuguacauuuc

SEQ ID NO: 588310 - RNA, 19 nt, Homo sapiens
gaagagggcacgagacauc

SEQ ID NO: 588311 - RNA, 19 nt, Homo sapiens
ugaaacaucggccaacuaa

SEQ ID NO: 588312 - RNA, 19 nt, Homo sapiens
gaagaagacgagaauuuca

SEQ ID NO: 588313 - RNA, 19 nt, Homo sapiens
agacgagaauuucauguug

SEQ ID NO: 588314 - RNA, 19 nt, Homo sapiens
gcacgagacauccacuuga

SEQ ID NO: 588315 - RNA, 19 nt, Homo sapiens
gaacuucuaaccaucuaug

SEQ ID NO: 588316 - RNA, 19 nt, Homo sapiens
ugaagcagcagauugaaga

SEQ ID NO: 588317 - RNA, 19 nt, Homo sapiens
ggaaauuucugcccauccu

SEQ ID NO: 588318 - RNA, 19 nt, Homo sapiens
cagccaagcaucacaaaga

SEQ ID NO: 588319 - RNA, 19 nt, Homo sapiens
ucucuaugcucuugaacuu

SEQ ID NO: 588320 - RNA, 19 nt, Homo sapiens
ggaaggaagaggugcuaga

SEQ ID NO: 588321 - RNA, 19 nt, Homo sapiens
guacuacacacuccacaau

SEQ ID NO: 588322 - RNA, 19 nt, Homo sapiens
cugaagaagacgagaauuu

SEQ ID NO: 588323 - RNA, 19 nt, Homo sapiens
gagcccauaaggaagguua

SEQ ID NO: 588324 - RNA, 19 nt, Homo sapiens
cauugaggauugugucaga

SEQ ID NO: 588325 - RNA, 19 nt, Homo sapiens
ccauaaggaagguuaaaga

SEQ ID NO: 588326 - RNA, 19 nt, Homo sapiens
ugaagaagacgagaauuuc

SEQ ID NO: 588327 - RNA, 19 nt, Homo sapiens
ggugcuccuuagccaaaua

SEQ ID NO: 588328 - RNA, 19 nt, Homo sapiens
aaggaagguuaaagagaaa

SEQ ID NO: 588329 - RNA, 19 nt, Homo sapiens
gcggugguccuggaaauuu

SEQ ID NO: 588330 - RNA, 19 nt, Homo sapiens
ucccaggucuucaccaguu

SEQ ID NO: 588331 - RNA, 19 nt, Homo sapiens
cauugugccugccuacaga

SEQ ID NO: 588332 - RNA, 19 nt, Homo sapiens
guacugaagaagacgagaa

SEQ ID NO: 588333 - RNA, 19 nt, Homo sapiens
guucugaggcugauaugga

SEQ ID NO: 588334 - RNA, 19 nt, Homo sapiens
gagcugguggcguuucuga

SEQ ID NO: 588335 - RNA, 19 nt, Homo sapiens
ggugggagcuacgccuaug

SEQ ID NO: 588336 - RNA, 19 nt, Homo sapiens
ccuguaaucccagaacuuu

SEQ ID NO: 588337 - RNA, 19 nt, Homo sapiens
gaagacgagaauuucaugu

SEQ ID NO: 588338 - RNA, 19 nt, Homo sapiens
ggccuucucuucccaacuc

SEQ ID NO: 588339 - RNA, 19 nt, Homo sapiens
guaccagcaguaugugaaa

SEQ ID NO: 588340 - RNA, 19 nt, Homo sapiens
gcacugaugcaggaacugu

SEQ ID NO: 588341 - RNA, 19 nt, Homo sapiens
gggaaauggguacugaaga

SEQ ID NO: 588342 - RNA, 19 nt, Homo sapiens
aaacaucggccaacuaagc

SEQ ID NO: 588343 - RNA, 19 nt, Homo sapiens
gugaaacaucggccaacua

SEQ ID NO: 588344 - RNA, 19 nt, Homo sapiens
gggaauggcacgguucuca

SEQ ID NO: 588345 - RNA, 19 nt, Homo sapiens
cagaacucauccugucaau

SEQ ID NO: 588346 - RNA, 19 nt, Homo sapiens
ccugggaaauggguacuga

SEQ ID NO: 588347 - RNA, 19 nt, Homo sapiens
gauguucugaggcugauau

SEQ ID NO: 588348 - RNA, 19 nt, Homo sapiens
gcagugagaggcagcuucu

SEQ ID NO: 588349 - RNA, 19 nt, Homo sapiens
gaaauggguacugaagaag

SEQ ID NO: 588350 - RNA, 19 nt, Homo sapiens
ccaucacggucaccauugu

SEQ ID NO: 588351 - RNA, 19 nt, Homo sapiens
ccaaauaugggaucuucuc

SEQ ID NO: 588352 - RNA, 19 nt, Homo sapiens
ucuaugcucuugaacuucu

SEQ ID NO: 588353 - RNA, 19 nt, Homo sapiens
gaaggaagaggugcuagac

SEQ ID NO: 588354 - RNA, 19 nt, Homo sapiens
gguaccagcaguaugugaa

SEQ ID NO: 588355 - RNA, 19 nt, Homo sapiens
gcccaucacggucaccauu

SEQ ID NO: 588356 - RNA, 19 nt, Homo sapiens
uggcguuucugagcuguuu

SEQ ID NO: 588357 - RNA, 19 nt, Homo sapiens
caggugcuccuuagccaaa

SEQ ID NO: 588358 - RNA, 19 nt, Homo sapiens
gugaagagggcacgagaca

SEQ ID NO: 588359 - RNA, 19 nt, Homo sapiens
gcgagcugcagagaaauuu

SEQ ID NO: 588360 - RNA, 19 nt, Homo sapiens
ccuccgagauccaggucuu

SEQ ID NO: 588361 - RNA, 19 nt, Homo sapiens
caucuaugccugggaaaug

SEQ ID NO: 588362 - RNA, 19 nt, Homo sapiens
gaaauuucugcccauccuu

SEQ ID NO: 588363 - RNA, 19 nt, Homo sapiens
ccagaacucauccugucaa

SEQ ID NO: 588364 - RNA, 19 nt, Homo sapiens
acgagaauuucauguugga

SEQ ID NO: 588365 - RNA, 19 nt, Homo sapiens
ucgaggaccugaggaugga

SEQ ID NO: 588366 - RNA, 19 nt, Homo sapiens
gcgcuugagccgaggaguu

SEQ ID NO: 588367 - RNA, 19 nt, Homo sapiens
gccauguacuccagaacuc

SEQ ID NO: 588368 - RNA, 19 nt, Homo sapiens
auaaggaagguuaaagaga

SEQ ID NO: 588369 - RNA, 19 nt, Homo sapiens
ggaaaaccauguggcaaag

SEQ ID NO: 588370 - RNA, 19 nt, Homo sapiens
guagcucacaccuguaauc

SEQ ID NO: 588371 - RNA, 19 nt, Homo sapiens
ucaaucacucugucccauu

SEQ ID NO: 588372 - RNA, 19 nt, Homo sapiens
cagcaggggcuuccuaaaa

SEQ ID NO: 588373 - RNA, 19 nt, Homo sapiens
ggcacgagacauccacuug

SEQ ID NO: 588374 - RNA, 19 nt, Homo sapiens
ggaccaaguacuacacacu

SEQ ID NO: 588375 - RNA, 19 nt, Homo sapiens
cauaaggaagguuaaagag

SEQ ID NO: 588376 - RNA, 19 nt, Homo sapiens
ccccgucucuacaaaauaa

SEQ ID NO: 588377 - RNA, 19 nt, Homo sapiens
acacucucauccucucgaa

SEQ ID NO: 588378 - RNA, 19 nt, Homo sapiens
agccaaauaugggaucuuc

SEQ ID NO: 588379 - RNA, 19 nt, Homo sapiens
agccaagcaucacaaagau

SEQ ID NO: 588380 - RNA, 19 nt, Homo sapiens
gcuaugacaacagggagaa

SEQ ID NO: 588381 - RNA, 19 nt, Homo sapiens
aagacgagaauuucauguu

SEQ ID NO: 588382 - RNA, 19 nt, Homo sapiens
gcucuugaacuucuaacca

SEQ ID NO: 588383 - RNA, 19 nt, Homo sapiens
guuuccagccaguuaguuu

SEQ ID NO: 588384 - RNA, 19 nt, Homo sapiens
cgugaagaauccugauggu

SEQ ID NO: 588385 - RNA, 19 nt, Homo sapiens
cucccacacucacaucuau

SEQ ID NO: 588386 - RNA, 19 nt, Homo sapiens
agaagacgagaauuucaug

SEQ ID NO: 588387 - RNA, 19 nt, Homo sapiens
aaauggguacugaagaaga

SEQ ID NO: 588388 - RNA, 19 nt, Homo sapiens
ggaagggucuuaacacuua

SEQ ID NO: 588389 - RNA, 19 nt, Homo sapiens
gagaaagacuaguuuauga

SEQ ID NO: 588390 - RNA, 19 nt, Homo sapiens
gacaauacgugaugccuuu

SEQ ID NO: 588391 - RNA, 19 nt, Homo sapiens
gcacuucccauuuguguuu

SEQ ID NO: 588392 - RNA, 19 nt, Homo sapiens
cuaaaggacugguuaaauc

SEQ ID NO: 588393 - RNA, 19 nt, Homo sapiens
ccaccuugcucaacuauga

SEQ ID NO: 588394 - RNA, 19 nt, Homo sapiens
ggacaaagaaauagcaaga

SEQ ID NO: 588395 - RNA, 19 nt, Homo sapiens
caaguuagcauuucaagug

SEQ ID NO: 588396 - RNA, 19 nt, Homo sapiens
gagaaacaacagaaacuuu

SEQ ID NO: 588397 - RNA, 19 nt, Homo sapiens
gcaaugauaaugaagaaug

SEQ ID NO: 588398 - RNA, 19 nt, Homo sapiens
gaaagacuaguuuaugaga

SEQ ID NO: 588399 - RNA, 19 nt, Homo sapiens
ggagaaagacuaguuuaug

SEQ ID NO: 588400 - RNA, 19 nt, Homo sapiens
acaaagaaauagcaagaga

SEQ ID NO: 588401 - RNA, 19 nt, Homo sapiens
caagguggaucuggaugua

SEQ ID NO: 588402 - RNA, 19 nt, Homo sapiens
gauacagccuuacaauaca

SEQ ID NO: 588403 - RNA, 19 nt, Homo sapiens
ucagaaaggaguagaauau

SEQ ID NO: 588404 - RNA, 19 nt, Homo sapiens
gggcuucucucacaacuag

SEQ ID NO: 588405 - RNA, 19 nt, Homo sapiens
ggacauagaccagaugauc

SEQ ID NO: 588406 - RNA, 19 nt, Homo sapiens
gaccauugcuggaaaggau

SEQ ID NO: 588407 - RNA, 19 nt, Homo sapiens
ggaagcugcuggagaugga

SEQ ID NO: 588408 - RNA, 19 nt, Homo sapiens
gcucaacuaugacuaugug

SEQ ID NO: 588409 - RNA, 19 nt, Homo sapiens
gacggaaccuggugacaau

SEQ ID NO: 588410 - RNA, 19 nt, Homo sapiens
aagaguaccuggacauaga

SEQ ID NO: 588411 - RNA, 19 nt, Homo sapiens
gaaccaugugacuguauua

SEQ ID NO: 588412 - RNA, 19 nt, Homo sapiens
gcuuggagcugcuagugaa

SEQ ID NO: 588413 - RNA, 19 nt, Homo sapiens
ugaaucagcugucccucuu

SEQ ID NO: 588414 - RNA, 19 nt, Homo sapiens
gugcaaugauaaugaagaa

SEQ ID NO: 588415 - RNA, 19 nt, Homo sapiens
acaauaguaugcagcuaaa

SEQ ID NO: 588416 - RNA, 19 nt, Homo sapiens
gaugccagcuguacugagu

SEQ ID NO: 588417 - RNA, 19 nt, Homo sapiens
gagaugagaaacaacagaa

SEQ ID NO: 588418 - RNA, 19 nt, Homo sapiens
ggauuucagugacuucauc

SEQ ID NO: 588419 - RNA, 19 nt, Homo sapiens
guuagcauuucaagugauu

SEQ ID NO: 588420 - RNA, 19 nt, Homo sapiens
ggaugcuucugcucacauu

SEQ ID NO: 588421 - RNA, 19 nt, Homo sapiens
ucagugacuucaucaacaa

SEQ ID NO: 588422 - RNA, 19 nt, Homo sapiens
uagcaggacuggagaacug

SEQ ID NO: 588423 - RNA, 19 nt, Homo sapiens
gcuuauguaugccuauuca

SEQ ID NO: 588424 - RNA, 19 nt, Homo sapiens
cagaaaggaguagaauaua

SEQ ID NO: 588425 - RNA, 19 nt, Homo sapiens
caauucugauacagccuua

SEQ ID NO: 588426 - RNA, 19 nt, Homo sapiens
cuagaugguucccuuuguu

SEQ ID NO: 588427 - RNA, 19 nt, Homo sapiens
gcagccugguucccucuuu

SEQ ID NO: 588428 - RNA, 19 nt, Homo sapiens
caaggagaaagacuaguuu

SEQ ID NO: 588429 - RNA, 19 nt, Homo sapiens
ggacggaaccuggugacaa

SEQ ID NO: 588430 - RNA, 19 nt, Homo sapiens
cugguuaaaucaauucuga

SEQ ID NO: 588431 - RNA, 19 nt, Homo sapiens
ucaaagaugagaagccaaa

SEQ ID NO: 588432 - RNA, 19 nt, Homo sapiens
gacagcagcagcucaaguu

SEQ ID NO: 588433 - RNA, 19 nt, Homo sapiens
guuccugccuucucuucua

SEQ ID NO: 588434 - RNA, 19 nt, Homo sapiens
gaauacauugcucuccuuu

SEQ ID NO: 588435 - RNA, 19 nt, Homo sapiens
ccacagcgcccacuucaag

SEQ ID NO: 588436 - RNA, 19 nt, Homo sapiens
ccaaggagaaagacuaguu

SEQ ID NO: 588437 - RNA, 19 nt, Homo sapiens
gguuuggccucuacuacaa

SEQ ID NO: 588438 - RNA, 19 nt, Homo sapiens
uaaaggacugguuaaauca

SEQ ID NO: 588439 - RNA, 19 nt, Homo sapiens
ucagaucuauguccaccuu

SEQ ID NO: 588440 - RNA, 19 nt, Homo sapiens
gugacuguauuaccuauuc

SEQ ID NO: 588441 - RNA, 19 nt, Homo sapiens
ugaaccaugugacuguauu

SEQ ID NO: 588442 - RNA, 19 nt, Homo sapiens
caagagaugagaaacaaca

SEQ ID NO: 588443 - RNA, 19 nt, Homo sapiens
gaaauagcaagagaugaga

SEQ ID NO: 588444 - RNA, 19 nt, Homo sapiens
ccgaggauauggucuuugu

SEQ ID NO: 588445 - RNA, 19 nt, Homo sapiens
gcauuccucuuuggugcua

SEQ ID NO: 588446 - RNA, 19 nt, Homo sapiens
aaagaaauagcaagagaug

SEQ ID NO: 588447 - RNA, 19 nt, Homo sapiens
guaccagggcucuguauuc

SEQ ID NO: 588448 - RNA, 19 nt, Homo sapiens
ucucuucuauccugcaauu

SEQ ID NO: 588449 - RNA, 19 nt, Homo sapiens
gaacggcgugggcuucuuc

SEQ ID NO: 588450 - RNA, 19 nt, Homo sapiens
cuauguggauggaggcuuu

SEQ ID NO: 588451 - RNA, 19 nt, Homo sapiens
ggccagagccagcuguuug

SEQ ID NO: 588452 - RNA, 19 nt, Homo sapiens
ggagagggaagggucuuaa

SEQ ID NO: 588453 - RNA, 19 nt, Homo sapiens
guauagcgcacuucccauu

SEQ ID NO: 588454 - RNA, 19 nt, Homo sapiens
ugauacagccuuacaauac

SEQ ID NO: 588455 - RNA, 19 nt, Homo sapiens
gcagcucaaguuagcauuu

SEQ ID NO: 588456 - RNA, 19 nt, Homo sapiens
gccuuacaauacaauagua

SEQ ID NO: 588457 - RNA, 19 nt, Homo sapiens
ggaaguacgggaaccaagu

SEQ ID NO: 588458 - RNA, 19 nt, Homo sapiens
auacauugcucuccuuugg

SEQ ID NO: 588459 - RNA, 19 nt, Homo sapiens
gcugugaugcgcuuucuga

SEQ ID NO: 588460 - RNA, 19 nt, Homo sapiens
caaugauaaugaagaaugg

SEQ ID NO: 588461 - RNA, 19 nt, Homo sapiens
gaaguacgggaaccaagug

SEQ ID NO: 588462 - RNA, 19 nt, Homo sapiens
gcaaugacgacccgcuaug

SEQ ID NO: 588463 - RNA, 19 nt, Homo sapiens
ccaagaguaccuggacaua

SEQ ID NO: 588464 - RNA, 19 nt, Homo sapiens
acauugcucuccuuugguu

SEQ ID NO: 588465 - RNA, 19 nt, Homo sapiens
ggacacugaaccuuguuga

SEQ ID NO: 588466 - RNA, 19 nt, Homo sapiens
gagagccgcugccccaaaa

SEQ ID NO: 588467 - RNA, 19 nt, Homo sapiens
aaauggguaacacugauua

SEQ ID NO: 588468 - RNA, 19 nt, Homo sapiens
ggccgaggauauggucuuu

SEQ ID NO: 588469 - RNA, 19 nt, Homo sapiens
cagcucggcauuccucuuu

SEQ ID NO: 588470 - RNA, 19 nt, Homo sapiens
acuguggacuuucuccuuu

SEQ ID NO: 588471 - RNA, 19 nt, Homo sapiens
guacgggaaccaaguguca

SEQ ID NO: 588472 - RNA, 19 nt, Homo sapiens
uacaauaguaugcagcuaa

SEQ ID NO: 588473 - RNA, 19 nt, Homo sapiens
ggacugguuaaaucaauuc

SEQ ID NO: 588474 - RNA, 19 nt, Homo sapiens
caaagaaauagcaagagau

SEQ ID NO: 588475 - RNA, 19 nt, Homo sapiens
aaacaaagggugggcauca

SEQ ID NO: 588476 - RNA, 19 nt, Homo sapiens
cgacaccacucagaucucu

SEQ ID NO: 588477 - RNA, 19 nt, Homo sapiens
gggaagggucuuaacacuu

SEQ ID NO: 588478 - RNA, 19 nt, Homo sapiens
ggccauagaaauacgauuc

SEQ ID NO: 588479 - RNA, 19 nt, Homo sapiens
gcuuuggcaugggcaagua

SEQ ID NO: 588480 - RNA, 19 nt, Homo sapiens
ccuccucacuguggacuuu

SEQ ID NO: 588481 - RNA, 19 nt, Homo sapiens
ggacuauccagaagguguu

SEQ ID NO: 588482 - RNA, 19 nt, Homo sapiens
aacaauaaaugggcccaaa

SEQ ID NO: 588483 - RNA, 19 nt, Homo sapiens
uaaauggguaacacugauu

SEQ ID NO: 588484 - RNA, 19 nt, Homo sapiens
agcaagagaugagaaacaa

SEQ ID NO: 588485 - RNA, 19 nt, Homo sapiens
cagcucaaguuagcauuuc

SEQ ID NO: 588486 - RNA, 19 nt, Homo sapiens
acacugaaccuuguugaug

SEQ ID NO: 588487 - RNA, 19 nt, Homo sapiens
agaauacauugcucuccuu

SEQ ID NO: 588488 - RNA, 19 nt, Homo sapiens
gcaacacacugcagaauua

SEQ ID NO: 588489 - RNA, 19 nt, Homo sapiens
ggacaaagcuugacacauc

SEQ ID NO: 588490 - RNA, 19 nt, Homo sapiens
gaaaucagauggcaguaaa

SEQ ID NO: 588491 - RNA, 19 nt, Homo sapiens
gaaagacggaguuuaauuu

SEQ ID NO: 588492 - RNA, 19 nt, Homo sapiens
guacugacuucuccuauaa

SEQ ID NO: 588493 - RNA, 19 nt, Homo sapiens
gcaagaaggagaagaagua

SEQ ID NO: 588494 - RNA, 19 nt, Homo sapiens
gcagaaauccuaccacuug

SEQ ID NO: 588495 - RNA, 19 nt, Homo sapiens
ggauuaaacuggcauuuca

SEQ ID NO: 588496 - RNA, 19 nt, Homo sapiens
uaacaggaccaauggauua

SEQ ID NO: 588497 - RNA, 19 nt, Homo sapiens
gaagacaccuuuggacaga

SEQ ID NO: 588498 - RNA, 19 nt, Homo sapiens
caagaucaaugcucaaguu

SEQ ID NO: 588499 - RNA, 19 nt, Homo sapiens
gcucugcgcucuucgauau

SEQ ID NO: 588500 - RNA, 19 nt, Homo sapiens
ggaaagacggaguuuaauu

SEQ ID NO: 588501 - RNA, 19 nt, Homo sapiens
ggacuuugccuuauuccua

SEQ ID NO: 588502 - RNA, 19 nt, Homo sapiens
gaacacauauugcuuugcu

SEQ ID NO: 588503 - RNA, 19 nt, Homo sapiens
gaaggugauguuccauuua

SEQ ID NO: 588504 - RNA, 19 nt, Homo sapiens
caggaaagacggaguuuaa

SEQ ID NO: 588505 - RNA, 19 nt, Homo sapiens
ugacugaugccaaugauaa

SEQ ID NO: 588506 - RNA, 19 nt, Homo sapiens
gaagcucgaagcagguuua

SEQ ID NO: 588507 - RNA, 19 nt, Homo sapiens
gaucaaugcucaaguuuug

SEQ ID NO: 588508 - RNA, 19 nt, Homo sapiens
aauuugaccugaacucuaa

SEQ ID NO: 588509 - RNA, 19 nt, Homo sapiens
uagaauagccaguagugua

SEQ ID NO: 588510 - RNA, 19 nt, Homo sapiens
gaauccagaguacaauaua

SEQ ID NO: 588511 - RNA, 19 nt, Homo sapiens
gcaguugaguucaggacaa

SEQ ID NO: 588512 - RNA, 19 nt, Homo sapiens
aaggugauguuccauuuaa

SEQ ID NO: 588513 - RNA, 19 nt, Homo sapiens
guaaauacccugagauggu

SEQ ID NO: 588514 - RNA, 19 nt, Homo sapiens
gagcugggaacacauauug

SEQ ID NO: 588515 - RNA, 19 nt, Homo sapiens
gaggagauaugcgggaaga

SEQ ID NO: 588516 - RNA, 19 nt, Homo sapiens
guagugagcaguugaguuc

SEQ ID NO: 588517 - RNA, 19 nt, Homo sapiens
caaaguccgugacaaggau

SEQ ID NO: 588518 - RNA, 19 nt, Homo sapiens
gggaacacauauugcuuug

SEQ ID NO: 588519 - RNA, 19 nt, Homo sapiens
gggaccaaaugaacagaaa

SEQ ID NO: 588520 - RNA, 19 nt, Homo sapiens
gcucgaagcagguuuagga

SEQ ID NO: 588521 - RNA, 19 nt, Homo sapiens
gcaauggcaacaagaagaa

SEQ ID NO: 588522 - RNA, 19 nt, Homo sapiens
ggagguagaagucauagau

SEQ ID NO: 588523 - RNA, 19 nt, Homo sapiens
cguacugacuucuccuaua

SEQ ID NO: 588524 - RNA, 19 nt, Homo sapiens
gacaaagcuugacacauca

SEQ ID NO: 588525 - RNA, 19 nt, Homo sapiens
cagcugaacuccuccaucu

SEQ ID NO: 588526 - RNA, 19 nt, Homo sapiens
gacaacauccuccagauuc

SEQ ID NO: 588527 - RNA, 19 nt, Homo sapiens
gagaaaagcagaaauccua

SEQ ID NO: 588528 - RNA, 19 nt, Homo sapiens
ggagaucgaggacauuaau

SEQ ID NO: 588529 - RNA, 19 nt, Homo sapiens
gccauagccugguuaaagu

SEQ ID NO: 588530 - RNA, 19 nt, Homo sapiens
agaaacaagugcccaguca

SEQ ID NO: 588531 - RNA, 19 nt, Homo sapiens
gaagaagucgggcaagaag

SEQ ID NO: 588532 - RNA, 19 nt, Homo sapiens
ugauaaugcuccaguguuc

SEQ ID NO: 588533 - RNA, 19 nt, Homo sapiens
uggcacacgauuuauauua

SEQ ID NO: 588534 - RNA, 19 nt, Homo sapiens
gaaagucucagcccaggau

SEQ ID NO: 588535 - RNA, 19 nt, Homo sapiens
ggaggaggcucuguauguc

SEQ ID NO: 588536 - RNA, 19 nt, Homo sapiens
gcacacgauuuauauuagg

SEQ ID NO: 588537 - RNA, 19 nt, Homo sapiens
ggaccagucuucuguuuug

SEQ ID NO: 588538 - RNA, 19 nt, Homo sapiens
aggcugagcugcaguuuua

SEQ ID NO: 588539 - RNA, 19 nt, Homo sapiens
gcaaugcacaguggaggua

SEQ ID NO: 588540 - RNA, 19 nt, Homo sapiens
cagccuggcacacgauuua

SEQ ID NO: 588541 - RNA, 19 nt, Homo sapiens
cagaaauccuaccacuuga

SEQ ID NO: 588542 - RNA, 19 nt, Homo sapiens
uaaauuggaaggugauguu

SEQ ID NO: 588543 - RNA, 19 nt, Homo sapiens
ggacccuucccacuacaua

SEQ ID NO: 588544 - RNA, 19 nt, Homo sapiens
cuacaagccuccuaguucu

SEQ ID NO: 588545 - RNA, 19 nt, Homo sapiens
gaacuccuccaucuuccaa

SEQ ID NO: 588546 - RNA, 19 nt, Homo sapiens
ucacagucuuccuauauag

SEQ ID NO: 588547 - RNA, 19 nt, Homo sapiens
guguugaaguaccaaguaa

SEQ ID NO: 588548 - RNA, 19 nt, Homo sapiens
gaguucaggacaagacaua

SEQ ID NO: 588549 - RNA, 19 nt, Homo sapiens
gagccucuauuucacaagu

SEQ ID NO: 588550 - RNA, 19 nt, Homo sapiens
ggcaguaaauacccugaga

SEQ ID NO: 588551 - RNA, 19 nt, Homo sapiens
ggcacacgauuuauauuag

SEQ ID NO: 588552 - RNA, 19 nt, Homo sapiens
ggccuuauuuccacuuugu

SEQ ID NO: 588553 - RNA, 19 nt, Homo sapiens
ggacgguggaggaaugauu

SEQ ID NO: 588554 - RNA, 19 nt, Homo sapiens
gcacagauacacguucuag

SEQ ID NO: 588555 - RNA, 19 nt, Homo sapiens
ggauauugguagcaacaca

SEQ ID NO: 588556 - RNA, 19 nt, Homo sapiens
gaccugcccuuacaguagu

SEQ ID NO: 588557 - RNA, 19 nt, Homo sapiens
ugaaguaccaaguaaccua

SEQ ID NO: 588558 - RNA, 19 nt, Homo sapiens
gcugaacuccuccaucuuc

SEQ ID NO: 588559 - RNA, 19 nt, Homo sapiens
gcacccaggccucagaguu

SEQ ID NO: 588560 - RNA, 19 nt, Homo sapiens
caagaaggagaagaaguaa

SEQ ID NO: 588561 - RNA, 19 nt, Homo sapiens
gaacuuuuaucacgugaau

SEQ ID NO: 588562 - RNA, 19 nt, Homo sapiens
gcgagcagaauccagagua

SEQ ID NO: 588563 - RNA, 19 nt, Homo sapiens
gacaaggauuccagacaca

SEQ ID NO: 588564 - RNA, 19 nt, Homo sapiens
cuagccagaucacccaauu

SEQ ID NO: 588565 - RNA, 19 nt, Homo sapiens
aaucagauggcaguaaaua

SEQ ID NO: 588566 - RNA, 19 nt, Homo sapiens
ccuauaagcgcuucucuuc

SEQ ID NO: 588567 - RNA, 19 nt, Homo sapiens
ggccauagccugguuaaag

SEQ ID NO: 588568 - RNA, 19 nt, Homo sapiens
ggagaagaaguaacaugga

SEQ ID NO: 588569 - RNA, 19 nt, Homo sapiens
caauuugaccugaacucua

SEQ ID NO: 588570 - RNA, 19 nt, Homo sapiens
cagauacacguucuaguga

SEQ ID NO: 588571 - RNA, 19 nt, Homo sapiens
guagugcggugugcuuuua

SEQ ID NO: 588572 - RNA, 19 nt, Homo sapiens
caacaaccaguuugacaca

SEQ ID NO: 588573 - RNA, 19 nt, Homo sapiens
cuugugcucuggaauuuga

SEQ ID NO: 588574 - RNA, 19 nt, Homo sapiens
ccaacggccaagucucuua

SEQ ID NO: 588575 - RNA, 19 nt, Homo sapiens
cucacagucuuccuauaua

SEQ ID NO: 588576 - RNA, 19 nt, Homo sapiens
cagaauccagaguacaaua

SEQ ID NO: 588577 - RNA, 19 nt, Homo sapiens
ucucuacccaaccuaauua

SEQ ID NO: 588578 - RNA, 19 nt, Homo sapiens
ucaaugccgagauuacuuu

SEQ ID NO: 588579 - RNA, 19 nt, Homo sapiens
ucaguucggagaagccuua

SEQ ID NO: 588580 - RNA, 19 nt, Homo sapiens
gggcauggacaaagcuuga

SEQ ID NO: 588581 - RNA, 19 nt, Homo sapiens
ugaauugacuucccaucag

SEQ ID NO: 588582 - RNA, 19 nt, Homo sapiens
cguauaaauuagugacaga

SEQ ID NO: 588583 - RNA, 19 nt, Homo sapiens
gcucaaaguccgugacaag

SEQ ID NO: 588584 - RNA, 19 nt, Homo sapiens
guauacagggugagccuuu

SEQ ID NO: 588585 - RNA, 19 nt, Homo sapiens
guucagcguccaggaguua

SEQ ID NO: 588586 - RNA, 19 nt, Homo sapiens
gagcuaacaggaccaaugg

SEQ ID NO: 588587 - RNA, 19 nt, Homo sapiens
gccauaaaccaauaacuag

SEQ ID NO: 588588 - RNA, 19 nt, Homo sapiens
gcaacacacugcagaauua

SEQ ID NO: 588589 - RNA, 19 nt, Homo sapiens
gaaaucagauggcaguaaa

SEQ ID NO: 588590 - RNA, 19 nt, Homo sapiens
gaaagacggaguuuaauuu

SEQ ID NO: 588591 - RNA, 19 nt, Homo sapiens
gcagaaauccuaccacuug

SEQ ID NO: 588592 - RNA, 19 nt, Homo sapiens
gaagacaccuuuggacaga

SEQ ID NO: 588593 - RNA, 19 nt, Homo sapiens
gcucugcgcucuucgauau

SEQ ID NO: 588594 - RNA, 19 nt, Homo sapiens
ggaaagacggaguuuaauu

SEQ ID NO: 588595 - RNA, 19 nt, Homo sapiens
ggacuuugccuuauuccua

SEQ ID NO: 588596 - RNA, 19 nt, Homo sapiens
gaacacauauugcuuugcu

SEQ ID NO: 588597 - RNA, 19 nt, Homo sapiens
gaaggugauguuccauuua

SEQ ID NO: 588598 - RNA, 19 nt, Homo sapiens
caggaaagacggaguuuaa

SEQ ID NO: 588599 - RNA, 19 nt, Homo sapiens
ucaggugaguuuccuuuaa

SEQ ID NO: 588600 - RNA, 19 nt, Homo sapiens
ugacugaugccaaugauaa

SEQ ID NO: 588601 - RNA, 19 nt, Homo sapiens
aauuugaccugaacucuaa

SEQ ID NO: 588602 - RNA, 19 nt, Homo sapiens
gaauccagaguacaauaua

SEQ ID NO: 588603 - RNA, 19 nt, Homo sapiens
gcaguugaguucaggacaa

SEQ ID NO: 588604 - RNA, 19 nt, Homo sapiens
aaggugauguuccauuuaa

SEQ ID NO: 588605 - RNA, 19 nt, Homo sapiens
guaaauacccugagauggu

SEQ ID NO: 588606 - RNA, 19 nt, Homo sapiens
gagcugggaacacauauug

SEQ ID NO: 588607 - RNA, 19 nt, Homo sapiens
gaggagauaugcgggaaga

SEQ ID NO: 588608 - RNA, 19 nt, Homo sapiens
guagugagcaguugaguuc

SEQ ID NO: 588609 - RNA, 19 nt, Homo sapiens
caaaguccgugacaaggau

SEQ ID NO: 588610 - RNA, 19 nt, Homo sapiens
gggaacacauauugcuuug

SEQ ID NO: 588611 - RNA, 19 nt, Homo sapiens
ggagguagaagucauagau

SEQ ID NO: 588612 - RNA, 19 nt, Homo sapiens
gagaaaagcagaaauccua

SEQ ID NO: 588613 - RNA, 19 nt, Homo sapiens
ggagaucgaggacauuaau

SEQ ID NO: 588614 - RNA, 19 nt, Homo sapiens
ugauaaugcuccaguguuc

SEQ ID NO: 588615 - RNA, 19 nt, Homo sapiens
uggcacacgauuuauauua

SEQ ID NO: 588616 - RNA, 19 nt, Homo sapiens
gcacacgauuuauauuagg

SEQ ID NO: 588617 - RNA, 19 nt, Homo sapiens
aggcugagcugcaguuuua

SEQ ID NO: 588618 - RNA, 19 nt, Homo sapiens
gcaaugcacaguggaggua

SEQ ID NO: 588619 - RNA, 19 nt, Homo sapiens
cagccuggcacacgauuua

SEQ ID NO: 588620 - RNA, 19 nt, Homo sapiens
cagaaauccuaccacuuga

SEQ ID NO: 588621 - RNA, 19 nt, Homo sapiens
uaaauuggaaggugauguu

SEQ ID NO: 588622 - RNA, 19 nt, Homo sapiens
ucacagucuuccuauauag

SEQ ID NO: 588623 - RNA, 19 nt, Homo sapiens
gaguucaggacaagacaua

SEQ ID NO: 588624 - RNA, 19 nt, Homo sapiens
gagccucuauuucacaagu

SEQ ID NO: 588625 - RNA, 19 nt, Homo sapiens
ggcaguaaauacccugaga

SEQ ID NO: 588626 - RNA, 19 nt, Homo sapiens
ggcacacgauuuauauuag

SEQ ID NO: 588627 - RNA, 19 nt, Homo sapiens
ggccuuauuuccacuuugu

SEQ ID NO: 588628 - RNA, 19 nt, Homo sapiens
ggacgguggaggaaugauu

SEQ ID NO: 588629 - RNA, 19 nt, Homo sapiens
gcacagauacacguucuag

SEQ ID NO: 588630 - RNA, 19 nt, Homo sapiens
ggauauugguagcaacaca

SEQ ID NO: 588631 - RNA, 19 nt, Homo sapiens
gcgagcagaauccagagua

SEQ ID NO: 588632 - RNA, 19 nt, Homo sapiens
gacaaggauuccagacaca

SEQ ID NO: 588633 - RNA, 19 nt, Homo sapiens
cuagccagaucacccaauu

SEQ ID NO: 588634 - RNA, 19 nt, Homo sapiens
aaucagauggcaguaaaua

SEQ ID NO: 588635 - RNA, 19 nt, Homo sapiens
gaacuuuuaucacgugaau

SEQ ID NO: 588636 - RNA, 19 nt, Homo sapiens
caauuugaccugaacucua

SEQ ID NO: 588637 - RNA, 19 nt, Homo sapiens
cagauacacguucuaguga

SEQ ID NO: 588638 - RNA, 19 nt, Homo sapiens
ccaacggccaagucucuua

SEQ ID NO: 588639 - RNA, 19 nt, Homo sapiens
cuugugcucuggaauuuga

SEQ ID NO: 588640 - RNA, 19 nt, Homo sapiens
cucacagucuuccuauaua

SEQ ID NO: 588641 - RNA, 19 nt, Homo sapiens
cagaauccagaguacaaua

SEQ ID NO: 588642 - RNA, 19 nt, Homo sapiens
ucucuacccaaccuaauua

SEQ ID NO: 588643 - RNA, 19 nt, Homo sapiens
ucaaugccgagauuacuuu

SEQ ID NO: 588644 - RNA, 19 nt, Homo sapiens
ucaguucggagaagccuua

SEQ ID NO: 588645 - RNA, 19 nt, Homo sapiens
ugaauugacuucccaucag

SEQ ID NO: 588646 - RNA, 19 nt, Homo sapiens
cguauaaauuagugacaga

SEQ ID NO: 588647 - RNA, 19 nt, Homo sapiens
gcucaaaguccgugacaag

SEQ ID NO: 588648 - RNA, 19 nt, Homo sapiens
guauacagggugagccuuu

SEQ ID NO: 588649 - RNA, 19 nt, Homo sapiens
agacauacuuugcggugau

SEQ ID NO: 588650 - RNA, 19 nt, Homo sapiens
cagccuggucucuguguua

SEQ ID NO: 588651 - RNA, 19 nt, Homo sapiens
gcaucacccugcacauugg

SEQ ID NO: 588652 - RNA, 19 nt, Homo sapiens
guucagcguccaggaguua

SEQ ID NO: 588653 - RNA, 19 nt, Homo sapiens
cagugaagcuagccagauc

SEQ ID NO: 588654 - RNA, 19 nt, Homo sapiens
gggugucaaugccgagauu

SEQ ID NO: 588655 - RNA, 19 nt, Homo sapiens
gacauacuuugcggugauu

SEQ ID NO: 588656 - RNA, 19 nt, Homo sapiens
acagauacacguucuagug

SEQ ID NO: 588657 - RNA, 19 nt, Homo sapiens
acccugagaugguauugaa

SEQ ID NO: 588658 - RNA, 19 nt, Homo sapiens
caucaggugaguuuccuuu

SEQ ID NO: 588659 - RNA, 19 nt, Homo sapiens
cuucaagaaacacguauaa

SEQ ID NO: 588660 - RNA, 19 nt, Homo sapiens
cagacacaauggagaagug

SEQ ID NO: 588661 - RNA, 19 nt, Homo sapiens
gucaaagaauauuccauag

SEQ ID NO: 588662 - RNA, 19 nt, Homo sapiens
guggagaucgaggacauua

SEQ ID NO: 588663 - RNA, 19 nt, Homo sapiens
cauccuacguguccauaag

SEQ ID NO: 588664 - RNA, 19 nt, Homo sapiens
agcgggagcugucauccua

SEQ ID NO: 588665 - RNA, 19 nt, Homo sapiens
ucucacagucuuccuauau

SEQ ID NO: 588666 - RNA, 19 nt, Homo sapiens
cagcaucacccugcacauu

SEQ ID NO: 588667 - RNA, 19 nt, Homo sapiens
gcacaguggagguagaagu

SEQ ID NO: 588668 - RNA, 19 nt, Homo sapiens
ucuagugacugaugccaau

SEQ ID NO: 588669 - RNA, 19 nt, Homo sapiens
gauacacguucuagugacu

SEQ ID NO: 588670 - RNA, 19 nt, Homo sapiens
aauccuaccacuugacuuu

SEQ ID NO: 588671 - RNA, 19 nt, Homo sapiens
ggagauaugcgggaagaag

SEQ ID NO: 588672 - RNA, 19 nt, Homo sapiens
caacucagucccagugauc

SEQ ID NO: 588673 - RNA, 19 nt, Homo sapiens
uuaaugaccacacgccaaa

SEQ ID NO: 588674 - RNA, 19 nt, Homo sapiens
gacggaguuuaauuuccua

SEQ ID NO: 588675 - RNA, 19 nt, Homo sapiens
gaaauccuaccacuugacu

SEQ ID NO: 588676 - RNA, 19 nt, Homo sapiens
cagcuugugcucuggaauu

SEQ ID NO: 588677 - RNA, 19 nt, Homo sapiens
gcaagggacgguggaggaa

SEQ ID NO: 588678 - RNA, 19 nt, Homo sapiens
agacaccuuuggacagaga

SEQ ID NO: 588679 - RNA, 19 nt, Homo sapiens
gcagaauuaccaacucagu

SEQ ID NO: 588680 - RNA, 19 nt, Homo sapiens
ccuggucucuguguuaaau

SEQ ID NO: 588681 - RNA, 19 nt, Homo sapiens
ggacgaccgcaacgacaau

SEQ ID NO: 588682 - RNA, 19 nt, Homo sapiens
guucggagaagccuuacuu

SEQ ID NO: 588683 - RNA, 19 nt, Homo sapiens
aaagacggaguuuaauuuc

SEQ ID NO: 588684 - RNA, 19 nt, Homo sapiens
uaaauccgaauccgugguu

SEQ ID NO: 588685 - RNA, 19 nt, Homo sapiens
gccuggagccucuauuuca

SEQ ID NO: 588686 - RNA, 19 nt, Homo sapiens
aguguucagucaagacgua

SEQ ID NO: 588687 - RNA, 19 nt, Homo sapiens
gugaauugacuucccauca

SEQ ID NO: 588688 - RNA, 19 nt, Homo sapiens
gcacagaccuggccauuga

SEQ ID NO: 588689 - RNA, 19 nt, Homo sapiens
gcacuacuguggacucuua

SEQ ID NO: 588690 - RNA, 19 nt, Homo sapiens
gagaaccgcucacacuaua

SEQ ID NO: 588691 - RNA, 19 nt, Homo sapiens
gggcucaccuccucaguua

SEQ ID NO: 588692 - RNA, 19 nt, Homo sapiens
ggaguaugcugccaguaua

SEQ ID NO: 588693 - RNA, 19 nt, Homo sapiens
ugacaacccuccucaguuu

SEQ ID NO: 588694 - RNA, 19 nt, Homo sapiens
gcugagacuuuauuuauug

SEQ ID NO: 588695 - RNA, 19 nt, Homo sapiens
acacggagcugcacaucua

SEQ ID NO: 588696 - RNA, 19 nt, Homo sapiens
gagcugagacuuuauuuau

SEQ ID NO: 588697 - RNA, 19 nt, Homo sapiens
gcuugaaccucuagacuuu

SEQ ID NO: 588698 - RNA, 19 nt, Homo sapiens
gggcgacucuccuaccaua

SEQ ID NO: 588699 - RNA, 19 nt, Homo sapiens
gcaccugccuucucacaga

SEQ ID NO: 588700 - RNA, 19 nt, Homo sapiens
ccagaggacuuucuacaau

SEQ ID NO: 588701 - RNA, 19 nt, Homo sapiens
gccgauggcuucaguguug

SEQ ID NO: 588702 - RNA, 19 nt, Homo sapiens
ggacuacccuugucaugca

SEQ ID NO: 588703 - RNA, 19 nt, Homo sapiens
ccaauggucaggucacuua

SEQ ID NO: 588704 - RNA, 19 nt, Homo sapiens
caauugagguccaggaugu

SEQ ID NO: 588705 - RNA, 19 nt, Homo sapiens
ugcaagaugugaaugauaa

SEQ ID NO: 588706 - RNA, 19 nt, Homo sapiens
gcacgucacugaugucaac

SEQ ID NO: 588707 - RNA, 19 nt, Homo sapiens
agauggagcugagacuuua

SEQ ID NO: 588708 - RNA, 19 nt, Homo sapiens
caggaucccuucaguguug

SEQ ID NO: 588709 - RNA, 19 nt, Homo sapiens
ggaugaagcucggccaugu

SEQ ID NO: 588710 - RNA, 19 nt, Homo sapiens
gaucguguccucuucauug

SEQ ID NO: 588711 - RNA, 19 nt, Homo sapiens
ggaggcgucucuagcgaaa

SEQ ID NO: 588712 - RNA, 19 nt, Homo sapiens
gaacacuggugacgacucu

SEQ ID NO: 588713 - RNA, 19 nt, Homo sapiens
gagcaacuacaguauguuu

SEQ ID NO: 588714 - RNA, 19 nt, Homo sapiens
ggagagggaugccuauaac

SEQ ID NO: 588715 - RNA, 19 nt, Homo sapiens
ucaaguccaugguauaugu

SEQ ID NO: 588716 - RNA, 19 nt, Homo sapiens
ggaugaguaugacccugua

SEQ ID NO: 588717 - RNA, 19 nt, Homo sapiens
acaacgagcugagcacgua

SEQ ID NO: 588718 - RNA, 19 nt, Homo sapiens
ggacucuucucccuagaug

SEQ ID NO: 588719 - RNA, 19 nt, Homo sapiens
ccaaugggcaguugcagua

SEQ ID NO: 588720 - RNA, 19 nt, Homo sapiens
gagagaaccgcucacacua

SEQ ID NO: 588721 - RNA, 19 nt, Homo sapiens
gagauggagcugagacuuu

SEQ ID NO: 588722 - RNA, 19 nt, Homo sapiens
cgacucagguguuaacagu

SEQ ID NO: 588723 - RNA, 19 nt, Homo sapiens
ggagcugagacuuuauuua

SEQ ID NO: 588724 - RNA, 19 nt, Homo sapiens
uugaaagccugacacagua

SEQ ID NO: 588725 - RNA, 19 nt, Homo sapiens
caaugcaccugccuucuca

SEQ ID NO: 588726 - RNA, 19 nt, Homo sapiens
gucagaagaugcguuauug

SEQ ID NO: 588727 - RNA, 19 nt, Homo sapiens
ccacaccacccauauuuga

SEQ ID NO: 588728 - RNA, 19 nt, Homo sapiens
gccagugucuucacagaga

SEQ ID NO: 588729 - RNA, 19 nt, Homo sapiens
ccacuggugugaucauugu

SEQ ID NO: 588730 - RNA, 19 nt, Homo sapiens
agaaggagcugggcauugu

SEQ ID NO: 588731 - RNA, 19 nt, Homo sapiens
gcuagugacuggagaggau

SEQ ID NO: 588732 - RNA, 19 nt, Homo sapiens
ugaccaugcuccagccuuu

SEQ ID NO: 588733 - RNA, 19 nt, Homo sapiens
gaaccgcucacacuauaug

SEQ ID NO: 588734 - RNA, 19 nt, Homo sapiens
gagaucaaccugacagugu

SEQ ID NO: 588735 - RNA, 19 nt, Homo sapiens
ugcaacagcugucugaaga

SEQ ID NO: 588736 - RNA, 19 nt, Homo sapiens
cagaggacuuucuacaaug

SEQ ID NO: 588737 - RNA, 19 nt, Homo sapiens
gcgaguggcugacaucaac

SEQ ID NO: 588738 - RNA, 19 nt, Homo sapiens
cgugagaucugggcugaaa

SEQ ID NO: 588739 - RNA, 19 nt, Homo sapiens
ugacagugguggccucaga

SEQ ID NO: 588740 - RNA, 19 nt, Homo sapiens
caaggcagcccuccucgaa

SEQ ID NO: 588741 - RNA, 19 nt, Homo sapiens
gggccucccuauacaggua

SEQ ID NO: 588742 - RNA, 19 nt, Homo sapiens
gagggaugccuauaacuug

SEQ ID NO: 588743 - RNA, 19 nt, Homo sapiens
gaccugacccaaagucuga

SEQ ID NO: 588744 - RNA, 19 nt, Homo sapiens
cgacaaugcaccugccuuu

SEQ ID NO: 588745 - RNA, 19 nt, Homo sapiens
ugacacugcuggacaucaa

SEQ ID NO: 588746 - RNA, 19 nt, Homo sapiens
ccgauggccugguucugua

SEQ ID NO: 588747 - RNA, 19 nt, Homo sapiens
ggcaccagcuuuccacuuc

SEQ ID NO: 588748 - RNA, 19 nt, Homo sapiens
caaccagaaugaacacagu

SEQ ID NO: 588749 - RNA, 19 nt, Homo sapiens
gcaagaugccaacgacaau

SEQ ID NO: 588750 - RNA, 19 nt, Homo sapiens
ggaggagccuuugccuuca

SEQ ID NO: 588751 - RNA, 19 nt, Homo sapiens
cagcuccucucauguacuu

SEQ ID NO: 588752 - RNA, 19 nt, Homo sapiens
gcgagugcccuuugacuau

SEQ ID NO: 588753 - RNA, 19 nt, Homo sapiens
gaaccucuagacuuugaaa

SEQ ID NO: 588754 - RNA, 19 nt, Homo sapiens
ggacccaucaggagccuuu

SEQ ID NO: 588755 - RNA, 19 nt, Homo sapiens
gaguggcuguggaggauga

SEQ ID NO: 588756 - RNA, 19 nt, Homo sapiens
ggaguacagcguccucuug

SEQ ID NO: 588757 - RNA, 19 nt, Homo sapiens
gacaaucagcccuccauga

SEQ ID NO: 588758 - RNA, 19 nt, Homo sapiens
ugaguaugacccuguauuu

SEQ ID NO: 588759 - RNA, 19 nt, Homo sapiens
gcacugaacagcucaacag

SEQ ID NO: 588760 - RNA, 19 nt, Homo sapiens
uaucaggacuguugcaaac

SEQ ID NO: 588761 - RNA, 19 nt, Homo sapiens
gggaguaugcugccaguau

SEQ ID NO: 588762 - RNA, 19 nt, Homo sapiens
ucgcucggcucaaggauga

SEQ ID NO: 588763 - RNA, 19 nt, Homo sapiens
ggaggcggaugaccuggau

SEQ ID NO: 588764 - RNA, 19 nt, Homo sapiens
gagaacagugucccagcua

SEQ ID NO: 588765 - RNA, 19 nt, Homo sapiens
agaucaaccugacagugua

SEQ ID NO: 588766 - RNA, 19 nt, Homo sapiens
ggccauguacggcuuauga

SEQ ID NO: 588767 - RNA, 19 nt, Homo sapiens
caagacagcgucaucuauc

SEQ ID NO: 588768 - RNA, 19 nt, Homo sapiens
gcucguugcucgcaucucu

SEQ ID NO: 588769 - RNA, 19 nt, Homo sapiens
ccucugagcaccucuauca

SEQ ID NO: 588770 - RNA, 19 nt, Homo sapiens
guaugacccuguauuucug

SEQ ID NO: 588771 - RNA, 19 nt, Homo sapiens
cggcagcuccucucaugua

SEQ ID NO: 588772 - RNA, 19 nt, Homo sapiens
gagaaguggagccagcuuu

SEQ ID NO: 588773 - RNA, 19 nt, Homo sapiens
ggacucccaucuauacacu

SEQ ID NO: 588774 - RNA, 19 nt, Homo sapiens
acaaugcaccugccuuuga

SEQ ID NO: 588775 - RNA, 19 nt, Homo sapiens
ucaucuaucuggugugugu

SEQ ID NO: 588776 - RNA, 19 nt, Homo sapiens
gaugaugagauccgcauga

SEQ ID NO: 588777 - RNA, 19 nt, Homo sapiens
guuauugggcucagagauu

SEQ ID NO: 588778 - RNA, 19 nt, Homo sapiens
gagaggaacaggaggagau

SEQ ID NO: 588779 - RNA, 19 nt, Homo sapiens
ccaauggacgucugaccua

SEQ ID NO: 588780 - RNA, 19 nt, Homo sapiens
uaccugagcauacagcuuu

SEQ ID NO: 588781 - RNA, 19 nt, Homo sapiens
gcccaggaauuguacauac

SEQ ID NO: 588782 - RNA, 19 nt, Homo sapiens
uggaugaugugaaugacaa

SEQ ID NO: 588783 - RNA, 19 nt, Homo sapiens
gagaugccaaugacaauca

SEQ ID NO: 588784 - RNA, 19 nt, Homo sapiens
guacagcccgugucuugga

SEQ ID NO: 588785 - RNA, 19 nt, Homo sapiens
ugaccacucugcaugcaau

SEQ ID NO: 588786 - RNA, 19 nt, Homo sapiens
cagcgugggccgagucuuu

SEQ ID NO: 588787 - RNA, 19 nt, Homo sapiens
ugaagacacgguauugcua

SEQ ID NO: 588788 - RNA, 19 nt, Homo sapiens
gcaccuggcugcacuauua

SEQ ID NO: 588789 - RNA, 19 nt, Homo sapiens
ccagaagacugcagacuuu

SEQ ID NO: 588790 - RNA, 19 nt, Homo sapiens
gcuggaaucuugcccauuu

SEQ ID NO: 588791 - RNA, 19 nt, Homo sapiens
ggacagagagggacugauu

SEQ ID NO: 588792 - RNA, 19 nt, Homo sapiens
gaacagcucuggguagaag

SEQ ID NO: 588793 - RNA, 19 nt, Homo sapiens
ccagagacauuguggcaaa

SEQ ID NO: 588794 - RNA, 19 nt, Homo sapiens
gcaacuggcuacagggaau

SEQ ID NO: 588795 - RNA, 19 nt, Homo sapiens
ccucauggcugcccucguu

SEQ ID NO: 588796 - RNA, 19 nt, Homo sapiens
ggaacucuuugguaucaug

SEQ ID NO: 588797 - RNA, 19 nt, Homo sapiens
guacucacauccaucaaca

SEQ ID NO: 588798 - RNA, 19 nt, Homo sapiens
ggaagcugguggacagaga

SEQ ID NO: 588799 - RNA, 19 nt, Homo sapiens
cacuuugacuucauuguaa

SEQ ID NO: 588800 - RNA, 19 nt, Homo sapiens
gcucagcccuuggaguuug

SEQ ID NO: 588801 - RNA, 19 nt, Homo sapiens
ucacauccaucaacaacau

SEQ ID NO: 588802 - RNA, 19 nt, Homo sapiens
ccacuuugacuucauugua

SEQ ID NO: 588803 - RNA, 19 nt, Homo sapiens
gaugacaguggaacucuuu

SEQ ID NO: 588804 - RNA, 19 nt, Homo sapiens
gggaaguccugggauuuga

SEQ ID NO: 588805 - RNA, 19 nt, Homo sapiens
caguggaacucuuugguau

SEQ ID NO: 588806 - RNA, 19 nt, Homo sapiens
gugguuggcugcaccuuug

SEQ ID NO: 588807 - RNA, 19 nt, Homo sapiens
guggaacucuuugguauca

SEQ ID NO: 588808 - RNA, 19 nt, Homo sapiens
cggcguggaugacguauuc

SEQ ID NO: 588809 - RNA, 19 nt, Homo sapiens
gcaggcaggcucccaaugu

SEQ ID NO: 588810 - RNA, 19 nt, Homo sapiens
gaccuccacugcccaccua

SEQ ID NO: 588811 - RNA, 19 nt, Homo sapiens
ccaguaaaguccaaguauc

SEQ ID NO: 588812 - RNA, 19 nt, Homo sapiens
cugaauggcugcacgacaa

SEQ ID NO: 588813 - RNA, 19 nt, Homo sapiens
ugauugagcagaugauuga

SEQ ID NO: 588814 - RNA, 19 nt, Homo sapiens
ggaaugauugagcagauga

SEQ ID NO: 588815 - RNA, 19 nt, Homo sapiens
cuggacggcuggccucaua

SEQ ID NO: 588816 - RNA, 19 nt, Homo sapiens
gccaggagcugcauuacac

SEQ ID NO: 588817 - RNA, 19 nt, Homo sapiens
cgccagaggugauacagau

SEQ ID NO: 588818 - RNA, 19 nt, Homo sapiens
gaagacugcagacuuugug

SEQ ID NO: 588819 - RNA, 19 nt, Homo sapiens
cacccgagcucuucuacau

SEQ ID NO: 588820 - RNA, 19 nt, Homo sapiens
gaugugcucugcugcuucu

SEQ ID NO: 588821 - RNA, 19 nt, Homo sapiens
cagcucagcccuuggaguu

SEQ ID NO: 588822 - RNA, 19 nt, Homo sapiens
uaugggaaguccugggauu

SEQ ID NO: 588823 - RNA, 19 nt, Homo sapiens
gcgcccagcucagguacuu

SEQ ID NO: 588824 - RNA, 19 nt, Homo sapiens
gagacauuguggcaaagug

SEQ ID NO: 588825 - RNA, 19 nt, Homo sapiens
ggucuccgcauggccauua

SEQ ID NO: 588826 - RNA, 19 nt, Homo sapiens
gaugcgggauccagagaca

SEQ ID NO: 588827 - RNA, 19 nt, Homo sapiens
caguaaaguccaaguauca

SEQ ID NO: 588828 - RNA, 19 nt, Homo sapiens
caaggaaagcccagagauc

SEQ ID NO: 588829 - RNA, 19 nt, Homo sapiens
gcgcuucaguucccucaag

SEQ ID NO: 588830 - RNA, 19 nt, Homo sapiens
gcacuggcaggaggaauug

SEQ ID NO: 588831 - RNA, 19 nt, Homo sapiens
ccucacaggccaacuucua

SEQ ID NO: 588832 - RNA, 19 nt, Homo sapiens
ugccacaguucaagccuuu

SEQ ID NO: 588833 - RNA, 19 nt, Homo sapiens
gugacuaucagacacauga

SEQ ID NO: 588834 - RNA, 19 nt, Homo sapiens
uugagcagaugauugagaa

SEQ ID NO: 588835 - RNA, 19 nt, Homo sapiens
guccaaguaucacucuaug

SEQ ID NO: 588836 - RNA, 19 nt, Homo sapiens
uggaacagcucuggguaga

SEQ ID NO: 588837 - RNA, 19 nt, Homo sapiens
gaggcuaucugcucaugcu

SEQ ID NO: 588838 - RNA, 19 nt, Homo sapiens
ggaguuccccuuauugaaa

SEQ ID NO: 588839 - RNA, 19 nt, Homo sapiens
gaacaaaaucugcuacaag

SEQ ID NO: 588840 - RNA, 19 nt, Homo sapiens
ggaaguccugggauuugaa

SEQ ID NO: 588841 - RNA, 19 nt, Homo sapiens
ccaccacccuggaugacau

SEQ ID NO: 588842 - RNA, 19 nt, Homo sapiens
cauuguaagguacuucuuu

SEQ ID NO: 588843 - RNA, 19 nt, Homo sapiens
ccuacaagcugcucaucca

SEQ ID NO: 588844 - RNA, 19 nt, Homo sapiens
gcucuuuggugcucuucug

SEQ ID NO: 588845 - RNA, 19 nt, Homo sapiens
gggaggcuaucugcucaug

SEQ ID NO: 588846 - RNA, 19 nt, Homo sapiens
ugagccaggagcugcauua

SEQ ID NO: 588847 - RNA, 19 nt, Homo sapiens
gcuugcugguucccacuuu

SEQ ID NO: 588848 - RNA, 19 nt, Homo sapiens
caggcaggcucccaaugug

SEQ ID NO: 588849 - RNA, 19 nt, Homo sapiens
gccaguaaaguccaaguau

SEQ ID NO: 588850 - RNA, 19 nt, Homo sapiens
gcucugcucaggugauuca

SEQ ID NO: 588851 - RNA, 19 nt, Homo sapiens
uccgggagcugcuagacaa

SEQ ID NO: 588852 - RNA, 19 nt, Homo sapiens
acaguggaacucuuuggua

SEQ ID NO: 588853 - RNA, 19 nt, Homo sapiens
gcaucacccgccacucgua

SEQ ID NO: 588854 - RNA, 19 nt, Homo sapiens
gaucugcaccagcgcuuca

SEQ ID NO: 588855 - RNA, 19 nt, Homo sapiens
cacucuggcuucgugcuua

SEQ ID NO: 588856 - RNA, 19 nt, Homo sapiens
uggcuucucccacaaauuc

SEQ ID NO: 588857 - RNA, 19 nt, Homo sapiens
gggcaccagugucguacuc

SEQ ID NO: 588858 - RNA, 19 nt, Homo sapiens
caaaaucugcuacaaguca

SEQ ID NO: 588859 - RNA, 19 nt, Homo sapiens
ccuuggaguuugcccaguu

SEQ ID NO: 588860 - RNA, 19 nt, Homo sapiens
gacaguaccagugggcauu

SEQ ID NO: 588861 - RNA, 19 nt, Homo sapiens
uaucagacacaugacauug

SEQ ID NO: 588862 - RNA, 19 nt, Homo sapiens
gaguuccccuuauugaaaa

SEQ ID NO: 588863 - RNA, 19 nt, Homo sapiens
ucuuugguaucauggguuu

SEQ ID NO: 588864 - RNA, 19 nt, Homo sapiens
cugcucaggugauucagau

SEQ ID NO: 588865 - RNA, 19 nt, Homo sapiens
gaugauugagaagcuguuu

SEQ ID NO: 588866 - RNA, 19 nt, Homo sapiens
ccagaggugauacagaugu

SEQ ID NO: 588867 - RNA, 19 nt, Homo sapiens
gaggagcugggucccuuug

SEQ ID NO: 588868 - RNA, 19 nt, Homo sapiens
ggaggagcugggucccuuu

SEQ ID NO: 588869 - RNA, 19 nt, Homo sapiens
ccucacacccgaagcacuu

SEQ ID NO: 588870 - RNA, 19 nt, Homo sapiens
auuguaagguacuucuuug

SEQ ID NO: 588871 - RNA, 19 nt, Homo sapiens
ggacggcuggccucauagu

SEQ ID NO: 588872 - RNA, 19 nt, Homo sapiens
ugugcccgcuggaaucuug

SEQ ID NO: 588873 - RNA, 19 nt, Homo sapiens
cuucuuggcucugggaauc

SEQ ID NO: 588874 - RNA, 19 nt, Homo sapiens
ggaacagcucuggguagaa

SEQ ID NO: 588875 - RNA, 19 nt, Homo sapiens
ugggaggcauggccagaga

SEQ ID NO: 588876 - RNA, 19 nt, Homo sapiens
cauggcuucucccacaaau

SEQ ID NO: 588877 - RNA, 19 nt, Homo sapiens
uggccauuauugagacaaa

SEQ ID NO: 588878 - RNA, 19 nt, Homo sapiens
cugcaugcguucucugaag

SEQ ID NO: 588879 - RNA, 19 nt, Homo sapiens
gaacgcuucccagcagauc

SEQ ID NO: 588880 - RNA, 19 nt, Homo sapiens
gccauggcuucucccacaa

SEQ ID NO: 588881 - RNA, 19 nt, Homo sapiens
gugcucugcugcuccucaa

SEQ ID NO: 588882 - RNA, 19 nt, Homo sapiens
aauggcugcacgacaaaua

SEQ ID NO: 588883 - RNA, 19 nt, Homo sapiens
gacagagagggacugauuc

SEQ ID NO: 588884 - RNA, 19 nt, Homo sapiens
aacaaaaucugcuacaagu

SEQ ID NO: 588885 - RNA, 19 nt, Homo sapiens
ugaugacaguggaacucuu

SEQ ID NO: 588886 - RNA, 19 nt, Homo sapiens
cugcguggccuccagaaga

SEQ ID NO: 588887 - RNA, 19 nt, Homo sapiens
ugaauggcugcacgacaaa

SEQ ID NO: 588888 - RNA, 19 nt, Homo sapiens
gaagagagaagacauauuc

SEQ ID NO: 588889 - RNA, 19 nt, Homo sapiens
gaagacauauucuacacuu

SEQ ID NO: 588890 - RNA, 19 nt, Homo sapiens
gaagcuggguuccgccaua

SEQ ID NO: 588891 - RNA, 19 nt, Homo sapiens
ggacauaucaccucuacuu

SEQ ID NO: 588892 - RNA, 19 nt, Homo sapiens
cauaucaccucuacuuaaa

SEQ ID NO: 588893 - RNA, 19 nt, Homo sapiens
agacagaaaucuccacuau

SEQ ID NO: 588894 - RNA, 19 nt, Homo sapiens
gaaagauauuguucugguu

SEQ ID NO: 588895 - RNA, 19 nt, Homo sapiens
ggacuauguugaccucuau

SEQ ID NO: 588896 - RNA, 19 nt, Homo sapiens
gguagaaugucauccguau

SEQ ID NO: 588897 - RNA, 19 nt, Homo sapiens
cggaguaaauugcuagauu

SEQ ID NO: 588898 - RNA, 19 nt, Homo sapiens
gcaaccagguagaauguca

SEQ ID NO: 588899 - RNA, 19 nt, Homo sapiens
uagaaugucauccguauuu

SEQ ID NO: 588900 - RNA, 19 nt, Homo sapiens
gcuaaaugauggccacuuc

SEQ ID NO: 588901 - RNA, 19 nt, Homo sapiens
gagcagcgcaucagacaga

SEQ ID NO: 588902 - RNA, 19 nt, Homo sapiens
uauguugaccucuaucuua

SEQ ID NO: 588903 - RNA, 19 nt, Homo sapiens
agacagaacgugcagguuu

SEQ ID NO: 588904 - RNA, 19 nt, Homo sapiens
caaccggaguaaauugcua

SEQ ID NO: 588905 - RNA, 19 nt, Homo sapiens
gaacuuucaccaacagaug

SEQ ID NO: 588906 - RNA, 19 nt, Homo sapiens
gacauaucaccucuacuua

SEQ ID NO: 588907 - RNA, 19 nt, Homo sapiens
uagauggccuagacagaaa

SEQ ID NO: 588908 - RNA, 19 nt, Homo sapiens
gaagcagcagcaaacauuu

SEQ ID NO: 588909 - RNA, 19 nt, Homo sapiens
guguaaggaugcaggauug

SEQ ID NO: 588910 - RNA, 19 nt, Homo sapiens
ccauauagauucugcucau

SEQ ID NO: 588911 - RNA, 19 nt, Homo sapiens
gccagaaagacaauaaauu

SEQ ID NO: 588912 - RNA, 19 nt, Homo sapiens
uaucaccucuacuuaaauc

SEQ ID NO: 588913 - RNA, 19 nt, Homo sapiens
ggagggcuuugccugaugu

SEQ ID NO: 588914 - RNA, 19 nt, Homo sapiens
guugaccucuaucuuauuc

SEQ ID NO: 588915 - RNA, 19 nt, Homo sapiens
agaagcagcagcaaacauu

SEQ ID NO: 588916 - RNA, 19 nt, Homo sapiens
gcaagucgaaagauauugu

SEQ ID NO: 588917 - RNA, 19 nt, Homo sapiens
gggaggccauggagaagug

SEQ ID NO: 588918 - RNA, 19 nt, Homo sapiens
caacaagccaggacucaag

SEQ ID NO: 588919 - RNA, 19 nt, Homo sapiens
gacauauucuacacuucaa

SEQ ID NO: 588920 - RNA, 19 nt, Homo sapiens
acauaucaccucuacuuaa

SEQ ID NO: 588921 - RNA, 19 nt, Homo sapiens
ugacauaguggaucucugu

SEQ ID NO: 588922 - RNA, 19 nt, Homo sapiens
ugaagaaagcucaauugga

SEQ ID NO: 588923 - RNA, 19 nt, Homo sapiens
gaggagaagcagcagcaaa

SEQ ID NO: 588924 - RNA, 19 nt, Homo sapiens
gacagaaaucuccacuauu

SEQ ID NO: 588925 - RNA, 19 nt, Homo sapiens
cauauagauucugcucauu

SEQ ID NO: 588926 - RNA, 19 nt, Homo sapiens
gacagaacgugcagguuuu

SEQ ID NO: 588927 - RNA, 19 nt, Homo sapiens
gaaugucauccguauuuca

SEQ ID NO: 588928 - RNA, 19 nt, Homo sapiens
ugaggaacuuucaccaaca

SEQ ID NO: 588929 - RNA, 19 nt, Homo sapiens
ggacuggccauccgaagca

SEQ ID NO: 588930 - RNA, 19 nt, Homo sapiens
acuuaaauccguccuguuu

SEQ ID NO: 588931 - RNA, 19 nt, Homo sapiens
gggcuuugccugaugucua

SEQ ID NO: 588932 - RNA, 19 nt, Homo sapiens
uugcuagccacccuaauua

SEQ ID NO: 588933 - RNA, 19 nt, Homo sapiens
gaggaacuuucaccaacag

SEQ ID NO: 588934 - RNA, 19 nt, Homo sapiens
agccaggacucaaguacaa

SEQ ID NO: 588935 - RNA, 19 nt, Homo sapiens
agaaagcucaauuggacua

SEQ ID NO: 588936 - RNA, 19 nt, Homo sapiens
agacauauucuacacuuca

SEQ ID NO: 588937 - RNA, 19 nt, Homo sapiens
aacuacagcugaguccaua

SEQ ID NO: 588938 - RNA, 19 nt, Homo sapiens
ccacuucaugccuguauug

SEQ ID NO: 588939 - RNA, 19 nt, Homo sapiens
ccacccuaauuauccauau

SEQ ID NO: 588940 - RNA, 19 nt, Homo sapiens
gucgaaagauauuguucug

SEQ ID NO: 588941 - RNA, 19 nt, Homo sapiens
aagcucaauuggacuaugu

SEQ ID NO: 588942 - RNA, 19 nt, Homo sapiens
ggccagaaagacaauaaau

SEQ ID NO: 588943 - RNA, 19 nt, Homo sapiens
gccggugacuggacauauc

SEQ ID NO: 588944 - RNA, 19 nt, Homo sapiens
ugccugaugucuaccagaa

SEQ ID NO: 588945 - RNA, 19 nt, Homo sapiens
ggagaaguguaaggaugca

SEQ ID NO: 588946 - RNA, 19 nt, Homo sapiens
cacccuaauuauccauauu

SEQ ID NO: 588947 - RNA, 19 nt, Homo sapiens
uggacuauguugaccucua

SEQ ID NO: 588948 - RNA, 19 nt, Homo sapiens
ggaaaacucacugaagaaa

SEQ ID NO: 588949 - RNA, 19 nt, Homo sapiens
ggauuggccaaguccauug

SEQ ID NO: 588950 - RNA, 19 nt, Homo sapiens
ugaccucuaucuuauucau

SEQ ID NO: 588951 - RNA, 19 nt, Homo sapiens
gagaagcagcagcaaacau

SEQ ID NO: 588952 - RNA, 19 nt, Homo sapiens
caagugacagggaauggau

SEQ ID NO: 588953 - RNA, 19 nt, Homo sapiens
caacuacagcugaguccau

SEQ ID NO: 588954 - RNA, 19 nt, Homo sapiens
agauucugcucauuuauac

SEQ ID NO: 588955 - RNA, 19 nt, Homo sapiens
gugaagagagaagacauau

SEQ ID NO: 588956 - RNA, 19 nt, Homo sapiens
gcuagccacccuaauuauc

SEQ ID NO: 588957 - RNA, 19 nt, Homo sapiens
uggccaagagcuacaauga

SEQ ID NO: 588958 - RNA, 19 nt, Homo sapiens
aaagccaggugaggaacuu

SEQ ID NO: 588959 - RNA, 19 nt, Homo sapiens
auucuacacuucaaagcuu

SEQ ID NO: 588960 - RNA, 19 nt, Homo sapiens
caagucgaaagauauuguu

SEQ ID NO: 588961 - RNA, 19 nt, Homo sapiens
ggagaagcagcagcaaaca

SEQ ID NO: 588962 - RNA, 19 nt, Homo sapiens
ugaagagagaagacauauu

SEQ ID NO: 588963 - RNA, 19 nt, Homo sapiens
cauagauggccuagacaga

SEQ ID NO: 588964 - RNA, 19 nt, Homo sapiens
gaugcaggauuggccaagu

SEQ ID NO: 588965 - RNA, 19 nt, Homo sapiens
ggaacuuucaccaacagau

SEQ ID NO: 588966 - RNA, 19 nt, Homo sapiens
guagaaugucauccguauu

SEQ ID NO: 588967 - RNA, 19 nt, Homo sapiens
caacagaugaaaauggaaa

SEQ ID NO: 588968 - RNA, 19 nt, Homo sapiens
gaaagcucaauuggacuau

SEQ ID NO: 588969 - RNA, 19 nt, Homo sapiens
ccauaggccagaaagacaa

SEQ ID NO: 588970 - RNA, 19 nt, Homo sapiens
ggcuuugccugaugucuac

SEQ ID NO: 588971 - RNA, 19 nt, Homo sapiens
uguguaaagcuaaaugaug

SEQ ID NO: 588972 - RNA, 19 nt, Homo sapiens
auagauggccuagacagaa

SEQ ID NO: 588973 - RNA, 19 nt, Homo sapiens
ucuaaagccaggugaggaa

SEQ ID NO: 588974 - RNA, 19 nt, Homo sapiens
ggguuccgccauauagauu

SEQ ID NO: 588975 - RNA, 19 nt, Homo sapiens
uaccagaagcccugugugu

SEQ ID NO: 588976 - RNA, 19 nt, Homo sapiens
agaaugucauccguauuuc

SEQ ID NO: 588977 - RNA, 19 nt, Homo sapiens
gcuggguuccgccauauag

SEQ ID NO: 588978 - RNA, 19 nt, Homo sapiens
ccugggaggccauggagaa

SEQ ID NO: 588979 - RNA, 19 nt, Homo sapiens
auguugaccucuaucuuau

SEQ ID NO: 588980 - RNA, 19 nt, Homo sapiens
gcucaauuggacuauguug

SEQ ID NO: 588981 - RNA, 19 nt, Homo sapiens
gacauaguggaucucugua

SEQ ID NO: 588982 - RNA, 19 nt, Homo sapiens
gccacuucaugccuguauu

SEQ ID NO: 588983 - RNA, 19 nt, Homo sapiens
auagugcucugggaucuca

SEQ ID NO: 588984 - RNA, 19 nt, Homo sapiens
cugcaagucgaaagauauu

SEQ ID NO: 588985 - RNA, 19 nt, Homo sapiens
aguacaagccugucugcaa

SEQ ID NO: 588986 - RNA, 19 nt, Homo sapiens
gcaacgaugucaaauguaa

SEQ ID NO: 588987 - RNA, 19 nt, Homo sapiens
gagcuuggcugguguaucu

SEQ ID NO: 588988 - RNA, 19 nt, Homo sapiens
gagcaaaggccacguauca

SEQ ID NO: 588989 - RNA, 19 nt, Homo sapiens
acgaacagcugaugaauga

SEQ ID NO: 588990 - RNA, 19 nt, Homo sapiens
ccucagcuguuuaaguuua

SEQ ID NO: 588991 - RNA, 19 nt, Homo sapiens
ggccucagcuguuuaaguu

SEQ ID NO: 588992 - RNA, 19 nt, Homo sapiens
ggaaggcccugcaggugaa

SEQ ID NO: 588993 - RNA, 19 nt, Homo sapiens
ggucgccucuucuguguuu

SEQ ID NO: 588994 - RNA, 19 nt, Homo sapiens
uuacugagcucggcauuug

SEQ ID NO: 588995 - RNA, 19 nt, Homo sapiens
ccaaggacgucaacaucuu

SEQ ID NO: 588996 - RNA, 19 nt, Homo sapiens
ccacaaagccauuaagaag

SEQ ID NO: 588997 - RNA, 19 nt, Homo sapiens
gaacuggcccaaugcaaug

SEQ ID NO: 588998 - RNA, 19 nt, Homo sapiens
uuauauaccuggaaucugu

SEQ ID NO: 588999 - RNA, 19 nt, Homo sapiens
uggcaacgaugucaaaugu

SEQ ID NO: 589000 - RNA, 19 nt, Homo sapiens
ccacuucucuagccguuug

SEQ ID NO: 589001 - RNA, 19 nt, Homo sapiens
gcaacucaauugggccuuu

SEQ ID NO: 589002 - RNA, 19 nt, Homo sapiens
gaacagcugaugaaugagu

SEQ ID NO: 589003 - RNA, 19 nt, Homo sapiens
ggaagaaggccaugaagac

SEQ ID NO: 589004 - RNA, 19 nt, Homo sapiens
ucaagcagaucgggaagaa

SEQ ID NO: 589005 - RNA, 19 nt, Homo sapiens
ggaaccagaccuucaacaa

SEQ ID NO: 589006 - RNA, 19 nt, Homo sapiens
gcaaaggccacguaucaag

SEQ ID NO: 589007 - RNA, 19 nt, Homo sapiens
ggaacuggcccaaugcaau

SEQ ID NO: 589008 - RNA, 19 nt, Homo sapiens
gggcaucuguccugagcuu

SEQ ID NO: 589009 - RNA, 19 nt, Homo sapiens
gaagaaggccaugaagaca

SEQ ID NO: 589010 - RNA, 19 nt, Homo sapiens
gucaacaucuucagcuuuc

SEQ ID NO: 589011 - RNA, 19 nt, Homo sapiens
gaaguccacaaagccauua

SEQ ID NO: 589012 - RNA, 19 nt, Homo sapiens
acaacgaccucaucaagca

SEQ ID NO: 589013 - RNA, 19 nt, Homo sapiens
gaucccacccuucguauuc

SEQ ID NO: 589014 - RNA, 19 nt, Homo sapiens
caacaugugaagacaguga

SEQ ID NO: 589015 - RNA, 19 nt, Homo sapiens
gcugguguaucucacaaug

SEQ ID NO: 589016 - RNA, 19 nt, Homo sapiens
gcaguuccuuaccaagaga

SEQ ID NO: 589017 - RNA, 19 nt, Homo sapiens
gagcagggucccaaggauu

SEQ ID NO: 589018 - RNA, 19 nt, Homo sapiens
gaaccagaccuucaacaac

SEQ ID NO: 589019 - RNA, 19 nt, Homo sapiens
ccaaggccaugaugucaag

SEQ ID NO: 589020 - RNA, 19 nt, Homo sapiens
cagagccagugguuaaaga

SEQ ID NO: 589021 - RNA, 19 nt, Homo sapiens
cuucagagccagugguuaa

SEQ ID NO: 589022 - RNA, 19 nt, Homo sapiens
gcacagucaucuucaucgu

SEQ ID NO: 589023 - RNA, 19 nt, Homo sapiens
augcggagcuccaaauuca

SEQ ID NO: 589024 - RNA, 19 nt, Homo sapiens
gggaagaaggccaugaaga

SEQ ID NO: 589025 - RNA, 19 nt, Homo sapiens
ggaaguccacaaagccauu

SEQ ID NO: 589026 - RNA, 19 nt, Homo sapiens
cagaucacgugcacaguca

SEQ ID NO: 589027 - RNA, 19 nt, Homo sapiens
gcggagcuccaaauucaaa

SEQ ID NO: 589028 - RNA, 19 nt, Homo sapiens
ccaagaaggaagagaccua

SEQ ID NO: 589029 - RNA, 19 nt, Homo sapiens
agacuagggcaguuccuua

SEQ ID NO: 589030 - RNA, 19 nt, Homo sapiens
ccaagagacuagggcaguu

SEQ ID NO: 589031 - RNA, 19 nt, Homo sapiens
ggacuaccacccacucauc

SEQ ID NO: 589032 - RNA, 19 nt, Homo sapiens
gagcauguuuguggaaguc

SEQ ID NO: 589033 - RNA, 19 nt, Homo sapiens
gggcaguuccuuaccaaga

SEQ ID NO: 589034 - RNA, 19 nt, Homo sapiens
ccucggccaucaucuucua

SEQ ID NO: 589035 - RNA, 19 nt, Homo sapiens
ggucuuugucucaccauuu

SEQ ID NO: 589036 - RNA, 19 nt, Homo sapiens
gaggagcaaaggccacgua

SEQ ID NO: 589037 - RNA, 19 nt, Homo sapiens
uccuagaggugguaucuga

SEQ ID NO: 589038 - RNA, 19 nt, Homo sapiens
ggaaggugagcauguuugu

SEQ ID NO: 589039 - RNA, 19 nt, Homo sapiens
ccaacuaccacgcccugua

SEQ ID NO: 589040 - RNA, 19 nt, Homo sapiens
gaaaaggagcagccucgua

SEQ ID NO: 589041 - RNA, 19 nt, Homo sapiens
ccugugcccugaacaagga

SEQ ID NO: 589042 - RNA, 19 nt, Homo sapiens
gaaggaagagaccuacaac

SEQ ID NO: 589043 - RNA, 19 nt, Homo sapiens
aaccagaccuucaacaacu

SEQ ID NO: 589044 - RNA, 19 nt, Homo sapiens
gcucagcuccguucacucu

SEQ ID NO: 589045 - RNA, 19 nt, Homo sapiens
agagucaaguccuguguuc

SEQ ID NO: 589046 - RNA, 19 nt, Homo sapiens
ggacgugccaagagacuag

SEQ ID NO: 589047 - RNA, 19 nt, Homo sapiens
gcaugcggagcuccaaauu

SEQ ID NO: 589048 - RNA, 19 nt, Homo sapiens
gucuuugucucaccauuug

SEQ ID NO: 589049 - RNA, 19 nt, Homo sapiens
gaagcugcaucugcucaag

SEQ ID NO: 589050 - RNA, 19 nt, Homo sapiens
cggcuucggugacuuugug

SEQ ID NO: 589051 - RNA, 19 nt, Homo sapiens
aaggagcagccucguauuu

SEQ ID NO: 589052 - RNA, 19 nt, Homo sapiens
agaaggccaugaagacaag

SEQ ID NO: 589053 - RNA, 19 nt, Homo sapiens
cuacaacgaccucaucaag

SEQ ID NO: 589054 - RNA, 19 nt, Homo sapiens
uuaaugaaccauguuguug

SEQ ID NO: 589055 - RNA, 19 nt, Homo sapiens
caacaucuucagcuuucuu

SEQ ID NO: 589056 - RNA, 19 nt, Homo sapiens
gaccgucauuaccaccauu

SEQ ID NO: 589057 - RNA, 19 nt, Homo sapiens
uggcaucgcgcacacugua

SEQ ID NO: 589058 - RNA, 19 nt, Homo sapiens
caccuuugauggccucuuc

SEQ ID NO: 589059 - RNA, 19 nt, Homo sapiens
uguuuaaguuuaccgguau

SEQ ID NO: 589060 - RNA, 19 nt, Homo sapiens
ccuagggugucccgagaug

SEQ ID NO: 589061 - RNA, 19 nt, Homo sapiens
ucguggagcucuggaucua

SEQ ID NO: 589062 - RNA, 19 nt, Homo sapiens
caacuaccacgcccuguac

SEQ ID NO: 589063 - RNA, 19 nt, Homo sapiens
ggcaguuccuuaccaagag

SEQ ID NO: 589064 - RNA, 19 nt, Homo sapiens
ucauuaccaccauuggaua

SEQ ID NO: 589065 - RNA, 19 nt, Homo sapiens
ucacagggaaccagaccuu

SEQ ID NO: 589066 - RNA, 19 nt, Homo sapiens
ggacaggguguggccauca

SEQ ID NO: 589067 - RNA, 19 nt, Homo sapiens
gcaggaagcaagucaucag

SEQ ID NO: 589068 - RNA, 19 nt, Homo sapiens
guccucauccuccuuguug

SEQ ID NO: 589069 - RNA, 19 nt, Homo sapiens
ggucgggcaccuacuacaa

SEQ ID NO: 589070 - RNA, 19 nt, Homo sapiens
ccucuguucuccagcugaa

SEQ ID NO: 589071 - RNA, 19 nt, Homo sapiens
agaaggaagagaccuacaa

SEQ ID NO: 589072 - RNA, 19 nt, Homo sapiens
cgucaacaucuucagcuuu

SEQ ID NO: 589073 - RNA, 19 nt, Homo sapiens
caucggcuucggugacuuu

SEQ ID NO: 589074 - RNA, 19 nt, Homo sapiens
gagggcagggucucaaaca

SEQ ID NO: 589075 - RNA, 19 nt, Homo sapiens
uuccuaaccuuccaucauc

SEQ ID NO: 589076 - RNA, 19 nt, Homo sapiens
gaugaaugaguacaacaag

SEQ ID NO: 589077 - RNA, 19 nt, Homo sapiens
aacagcugaugaaugagua

SEQ ID NO: 589078 - RNA, 19 nt, Homo sapiens
uggaggagccacacuggaa

SEQ ID NO: 589079 - RNA, 19 nt, Homo sapiens
aggaagagaccuacaacga

SEQ ID NO: 589080 - RNA, 19 nt, Homo sapiens
caaggacgucaacaucuuc

SEQ ID NO: 589081 - RNA, 19 nt, Homo sapiens
cccaacaugugaagacagu

SEQ ID NO: 589082 - RNA, 19 nt, Homo sapiens
cacuguguccugaauguuu

SEQ ID NO: 589083 - RNA, 19 nt, Homo sapiens
gggcagggucucaaacagu

SEQ ID NO: 589084 - RNA, 19 nt, Homo sapiens
aggagggccuggacaagau

SEQ ID NO: 589085 - RNA, 19 nt, Homo sapiens
gcaauguggcucccaagac

SEQ ID NO: 589086 - RNA, 19 nt, Homo sapiens
gaacaaaggucacagauca

SEQ ID NO: 589087 - RNA, 19 nt, Homo sapiens
aaacugaccuugguuauua

SEQ ID NO: 589088 - RNA, 19 nt, Homo sapiens
gcagaaagggaaaguauua

SEQ ID NO: 589089 - RNA, 19 nt, Homo sapiens
aaagagagguugaaaggua

SEQ ID NO: 589090 - RNA, 19 nt, Homo sapiens
gaaauucagugcuccagaa

SEQ ID NO: 589091 - RNA, 19 nt, Homo sapiens
gaaaucaagcucuuaauga

SEQ ID NO: 589092 - RNA, 19 nt, Homo sapiens
gaaaccagcuuccuucauc

SEQ ID NO: 589093 - RNA, 19 nt, Homo sapiens
ggauuugccucucgagaua

SEQ ID NO: 589094 - RNA, 19 nt, Homo sapiens
gaaacuaggguccauauga

SEQ ID NO: 589095 - RNA, 19 nt, Homo sapiens
gcagguugcucuagacaaa

SEQ ID NO: 589096 - RNA, 19 nt, Homo sapiens
gaaaggugauggcguuaga

SEQ ID NO: 589097 - RNA, 19 nt, Homo sapiens
gauauugccugguuugaug

SEQ ID NO: 589098 - RNA, 19 nt, Homo sapiens
ggugaucucugcaguugua

SEQ ID NO: 589099 - RNA, 19 nt, Homo sapiens
ggaaaugacagcucuggua

SEQ ID NO: 589100 - RNA, 19 nt, Homo sapiens
agcaugagcuuuccaguua

SEQ ID NO: 589101 - RNA, 19 nt, Homo sapiens
caaaugaagcccucaguaa

SEQ ID NO: 589102 - RNA, 19 nt, Homo sapiens
gacauucgcucucuuaaca

SEQ ID NO: 589103 - RNA, 19 nt, Homo sapiens
gaaauagggugguuugacu

SEQ ID NO: 589104 - RNA, 19 nt, Homo sapiens
ccaaagaaauucccaugga

SEQ ID NO: 589105 - RNA, 19 nt, Homo sapiens
gauaagaaaucaagguuac

SEQ ID NO: 589106 - RNA, 19 nt, Homo sapiens
gcacgaaccuccauuagcu

SEQ ID NO: 589107 - RNA, 19 nt, Homo sapiens
gaccagcuguguuucuuaa

SEQ ID NO: 589108 - RNA, 19 nt, Homo sapiens
gagccaguccugauuaaua

SEQ ID NO: 589109 - RNA, 19 nt, Homo sapiens
gaucauugccuucuccuuu

SEQ ID NO: 589110 - RNA, 19 nt, Homo sapiens
ccucagcucuggacaauga

SEQ ID NO: 589111 - RNA, 19 nt, Homo sapiens
cagagaagaugcaacaaug

SEQ ID NO: 589112 - RNA, 19 nt, Homo sapiens
uaaaugaccucaacauggu

SEQ ID NO: 589113 - RNA, 19 nt, Homo sapiens
ggauaugccuuugcuaaau

SEQ ID NO: 589114 - RNA, 19 nt, Homo sapiens
ccaagucucagcuuucuua

SEQ ID NO: 589115 - RNA, 19 nt, Homo sapiens
ugacuacgacguugaguua

SEQ ID NO: 589116 - RNA, 19 nt, Homo sapiens
agagaacugucuuucauuu

SEQ ID NO: 589117 - RNA, 19 nt, Homo sapiens
caagacagccauucagaaa

SEQ ID NO: 589118 - RNA, 19 nt, Homo sapiens
gaccagaggugaagauucu

SEQ ID NO: 589119 - RNA, 19 nt, Homo sapiens
ugccauagcugaccaaaug

SEQ ID NO: 589120 - RNA, 19 nt, Homo sapiens
gaacaucgagagcgaaaug

SEQ ID NO: 589121 - RNA, 19 nt, Homo sapiens
aguuagggcuguugauuua

SEQ ID NO: 589122 - RNA, 19 nt, Homo sapiens
ggagacaacaccaaagaaa

SEQ ID NO: 589123 - RNA, 19 nt, Homo sapiens
gcacuagcauucagcuguu

SEQ ID NO: 589124 - RNA, 19 nt, Homo sapiens
ggaaaucaagcucuuaaug

SEQ ID NO: 589125 - RNA, 19 nt, Homo sapiens
aauaucagcugcacgcuuu

SEQ ID NO: 589126 - RNA, 19 nt, Homo sapiens
agagggagcuaccaggaua

SEQ ID NO: 589127 - RNA, 19 nt, Homo sapiens
cauaaaggaugcaacugaa

SEQ ID NO: 589128 - RNA, 19 nt, Homo sapiens
gcuguugauuuaugcuuua

SEQ ID NO: 589129 - RNA, 19 nt, Homo sapiens
gaaagaaacuaggguccau

SEQ ID NO: 589130 - RNA, 19 nt, Homo sapiens
gaaccuccauuagcuguug

SEQ ID NO: 589131 - RNA, 19 nt, Homo sapiens
ccagagcccucauccgaaa

SEQ ID NO: 589132 - RNA, 19 nt, Homo sapiens
gaugagugguggccagaaa

SEQ ID NO: 589133 - RNA, 19 nt, Homo sapiens
gagaggagaaugaugguuu

SEQ ID NO: 589134 - RNA, 19 nt, Homo sapiens
ccagagaaauaugaaacua

SEQ ID NO: 589135 - RNA, 19 nt, Homo sapiens
ugggacagauuacaaauga

SEQ ID NO: 589136 - RNA, 19 nt, Homo sapiens
uuaggaggauucugaaauu

SEQ ID NO: 589137 - RNA, 19 nt, Homo sapiens
acacaugacgcaccaguua

SEQ ID NO: 589138 - RNA, 19 nt, Homo sapiens
gcucaaacauuggaauugu

SEQ ID NO: 589139 - RNA, 19 nt, Homo sapiens
aaauagcccuggagcauug

SEQ ID NO: 589140 - RNA, 19 nt, Homo sapiens
ggagcuaccaggauaguuu

SEQ ID NO: 589141 - RNA, 19 nt, Homo sapiens
gaucaaauuugccaguuac

SEQ ID NO: 589142 - RNA, 19 nt, Homo sapiens
aggcucagcugcaugauuu

SEQ ID NO: 589143 - RNA, 19 nt, Homo sapiens
gagauggugggacagauua

SEQ ID NO: 589144 - RNA, 19 nt, Homo sapiens
aaggaaagguguuuacuuc

SEQ ID NO: 589145 - RNA, 19 nt, Homo sapiens
ggaaagagggacccaugaa

SEQ ID NO: 589146 - RNA, 19 nt, Homo sapiens
caaguuggaucgaaucaag

SEQ ID NO: 589147 - RNA, 19 nt, Homo sapiens
gaaacugaccuugguuauu

SEQ ID NO: 589148 - RNA, 19 nt, Homo sapiens
uggaauugcugucgcagua

SEQ ID NO: 589149 - RNA, 19 nt, Homo sapiens
gaacaugacaaauggaaca

SEQ ID NO: 589150 - RNA, 19 nt, Homo sapiens
ggaaaagcaugugugaaua

SEQ ID NO: 589151 - RNA, 19 nt, Homo sapiens
gagaaacaacgcauugcua

SEQ ID NO: 589152 - RNA, 19 nt, Homo sapiens
gaaauagcccuggagcauu

SEQ ID NO: 589153 - RNA, 19 nt, Homo sapiens
gauaugccuuugcuaaauc

SEQ ID NO: 589154 - RNA, 19 nt, Homo sapiens
agaguuggcuucuuucaau

SEQ ID NO: 589155 - RNA, 19 nt, Homo sapiens
gaaaucaagguuacaagau

SEQ ID NO: 589156 - RNA, 19 nt, Homo sapiens
aaacaacgcauugcuauug

SEQ ID NO: 589157 - RNA, 19 nt, Homo sapiens
caugaagaauuacuggaaa

SEQ ID NO: 589158 - RNA, 19 nt, Homo sapiens
ugcaagaagugcugaguaa

SEQ ID NO: 589159 - RNA, 19 nt, Homo sapiens
gcaaugccucuccuuguuu

SEQ ID NO: 589160 - RNA, 19 nt, Homo sapiens
guaggagcuuuaaaucuug

SEQ ID NO: 589161 - RNA, 19 nt, Homo sapiens
aguaggagcuuuaaaucuu

SEQ ID NO: 589162 - RNA, 19 nt, Homo sapiens
ugagaacaguggcugcuuu

SEQ ID NO: 589163 - RNA, 19 nt, Homo sapiens
agagcgaaaugaucaaauu

SEQ ID NO: 589164 - RNA, 19 nt, Homo sapiens
ggauaucauugcugucaug

SEQ ID NO: 589165 - RNA, 19 nt, Homo sapiens
ccagaacgcggauaucauu

SEQ ID NO: 589166 - RNA, 19 nt, Homo sapiens
gaaacaacgcauugcuauu

SEQ ID NO: 589167 - RNA, 19 nt, Homo sapiens
ccaaucaguguauacaaua

SEQ ID NO: 589168 - RNA, 19 nt, Homo sapiens
caagaagugcugaguaaga

SEQ ID NO: 589169 - RNA, 19 nt, Homo sapiens
gaaggaggaggccagauga

SEQ ID NO: 589170 - RNA, 19 nt, Homo sapiens
guacagcacugcaacucau

SEQ ID NO: 589171 - RNA, 19 nt, Homo sapiens
caaauuugccaguuacuau

SEQ ID NO: 589172 - RNA, 19 nt, Homo sapiens
ugaucaaauuugccaguua

SEQ ID NO: 589173 - RNA, 19 nt, Homo sapiens
gugaauaacaccauuguau

SEQ ID NO: 589174 - RNA, 19 nt, Homo sapiens
cagcuuccuucaucucuaa

SEQ ID NO: 589175 - RNA, 19 nt, Homo sapiens
agacaacaccaaagaaauu

SEQ ID NO: 589176 - RNA, 19 nt, Homo sapiens
gagcuaccaggauaguuua

SEQ ID NO: 589177 - RNA, 19 nt, Homo sapiens
gaaagguguuuacuucacu

SEQ ID NO: 589178 - RNA, 19 nt, Homo sapiens
acaagauucucugaugaua

SEQ ID NO: 589179 - RNA, 19 nt, Homo sapiens
cguuagaguuggcuucuuu

SEQ ID NO: 589180 - RNA, 19 nt, Homo sapiens
guuacaagaugagaagaaa

SEQ ID NO: 589181 - RNA, 19 nt, Homo sapiens
gcaaugggcuguguaucuc

SEQ ID NO: 589182 - RNA, 19 nt, Homo sapiens
uccauuagcuguuguagau

SEQ ID NO: 589183 - RNA, 19 nt, Homo sapiens
agaagaugguuacaaguug

SEQ ID NO: 589184 - RNA, 19 nt, Homo sapiens
ggucagagcugcagauacc

SEQ ID NO: 589185 - RNA, 19 nt, Homo sapiens
gcagagaagaugcaacaau

SEQ ID NO: 589186 - RNA, 19 nt, Homo sapiens
caaggaaacuccaguauaa

SEQ ID NO: 589187 - RNA, 19 nt, Homo sapiens
gaauucaccuagcagauua

SEQ ID NO: 589188 - RNA, 19 nt, Homo sapiens
cgaaauagccauaccuuua

SEQ ID NO: 589189 - RNA, 19 nt, Homo sapiens
cagaugagcucacagaauu

SEQ ID NO: 589190 - RNA, 19 nt, Homo sapiens
gaaauagccauaccuuuaa

SEQ ID NO: 589191 - RNA, 19 nt, Homo sapiens
gaauguaaccagcuacuua

SEQ ID NO: 589192 - RNA, 19 nt, Homo sapiens
ucagacaucucaucaagua

SEQ ID NO: 589193 - RNA, 19 nt, Homo sapiens
gacgaugccuguucaagua

SEQ ID NO: 589194 - RNA, 19 nt, Homo sapiens
gacaacagcucuagugaug

SEQ ID NO: 589195 - RNA, 19 nt, Homo sapiens
ugaagaaucugcuaccaaa

SEQ ID NO: 589196 - RNA, 19 nt, Homo sapiens
cagauuccauggacaaaua

SEQ ID NO: 589197 - RNA, 19 nt, Homo sapiens
ccagacagcuguuccaaga

SEQ ID NO: 589198 - RNA, 19 nt, Homo sapiens
ucaccuagcagauuaaaua

SEQ ID NO: 589199 - RNA, 19 nt, Homo sapiens
gaauaucccuagcacaguu

SEQ ID NO: 589200 - RNA, 19 nt, Homo sapiens
gagaagauuuccagucaug

SEQ ID NO: 589201 - RNA, 19 nt, Homo sapiens
caagagaaaucaacaacug

SEQ ID NO: 589202 - RNA, 19 nt, Homo sapiens
caacuuugcuccaucucua

SEQ ID NO: 589203 - RNA, 19 nt, Homo sapiens
ccucagauaucaccacuuu

SEQ ID NO: 589204 - RNA, 19 nt, Homo sapiens
caggaggaauuaaugaaua

SEQ ID NO: 589205 - RNA, 19 nt, Homo sapiens
gaacaugaacccaaugaug

SEQ ID NO: 589206 - RNA, 19 nt, Homo sapiens
gacacaagcugcaaagaug

SEQ ID NO: 589207 - RNA, 19 nt, Homo sapiens
gaaauacgaauguucagaa

SEQ ID NO: 589208 - RNA, 19 nt, Homo sapiens
gaucagauacagcuaauga

SEQ ID NO: 589209 - RNA, 19 nt, Homo sapiens
gcagaggcaugacaggaaa

SEQ ID NO: 589210 - RNA, 19 nt, Homo sapiens
aguagugccuguaauaaua

SEQ ID NO: 589211 - RNA, 19 nt, Homo sapiens
ucagaagaccaguguauua

SEQ ID NO: 589212 - RNA, 19 nt, Homo sapiens
uguauuagcucacaauuag

SEQ ID NO: 589213 - RNA, 19 nt, Homo sapiens
gcaagauacuacagguaaa

SEQ ID NO: 589214 - RNA, 19 nt, Homo sapiens
gcaaagagccaugcuuaug

SEQ ID NO: 589215 - RNA, 19 nt, Homo sapiens
gauuuaagaucaacuccaa

SEQ ID NO: 589216 - RNA, 19 nt, Homo sapiens
gguguagaauccuuuauga

SEQ ID NO: 589217 - RNA, 19 nt, Homo sapiens
caaagagccaugcuuauga

SEQ ID NO: 589218 - RNA, 19 nt, Homo sapiens
cagcugguauccuuccuua

SEQ ID NO: 589219 - RNA, 19 nt, Homo sapiens
ggagaaggcagcacaguug

SEQ ID NO: 589220 - RNA, 19 nt, Homo sapiens
cagcugaccuugaccaguu

SEQ ID NO: 589221 - RNA, 19 nt, Homo sapiens
gaaaucagacaucucauca

SEQ ID NO: 589222 - RNA, 19 nt, Homo sapiens
ucaaaccagucacaaacua

SEQ ID NO: 589223 - RNA, 19 nt, Homo sapiens
uauggaagguacaggaaua

SEQ ID NO: 589224 - RNA, 19 nt, Homo sapiens
gagaauggaacaagagaaa

SEQ ID NO: 589225 - RNA, 19 nt, Homo sapiens
uaaaugaggugagagugaa

SEQ ID NO: 589226 - RNA, 19 nt, Homo sapiens
ggaagcaauugauaaccaa

SEQ ID NO: 589227 - RNA, 19 nt, Homo sapiens
gcuuagaaauuaacagguu

SEQ ID NO: 589228 - RNA, 19 nt, Homo sapiens
gaaaacagucgaucagaua

SEQ ID NO: 589229 - RNA, 19 nt, Homo sapiens
ugaccaguuugaucaguua

SEQ ID NO: 589230 - RNA, 19 nt, Homo sapiens
gcauaacaaugacagacuu

SEQ ID NO: 589231 - RNA, 19 nt, Homo sapiens
uaaccgaucuuauucaaac

SEQ ID NO: 589232 - RNA, 19 nt, Homo sapiens
gaagggagaauuguauuug

SEQ ID NO: 589233 - RNA, 19 nt, Homo sapiens
gcccugagcagauaaauga

SEQ ID NO: 589234 - RNA, 19 nt, Homo sapiens
auucagggcuucugcauaa

SEQ ID NO: 589235 - RNA, 19 nt, Homo sapiens
gaacugguugggaagauuu

SEQ ID NO: 589236 - RNA, 19 nt, Homo sapiens
gaugagcucuuugcagaug

SEQ ID NO: 589237 - RNA, 19 nt, Homo sapiens
gauuugaccauaucuguuu

SEQ ID NO: 589238 - RNA, 19 nt, Homo sapiens
cauagcagcagucauagua

SEQ ID NO: 589239 - RNA, 19 nt, Homo sapiens
guaaaucccucggucaauc

SEQ ID NO: 589240 - RNA, 19 nt, Homo sapiens
guacagaaaucagacaucu

SEQ ID NO: 589241 - RNA, 19 nt, Homo sapiens
gaacaagagaaaucaacaa

SEQ ID NO: 589242 - RNA, 19 nt, Homo sapiens
ggacaggccaguucacaga

SEQ ID NO: 589243 - RNA, 19 nt, Homo sapiens
cuucauagcagcagucaua

SEQ ID NO: 589244 - RNA, 19 nt, Homo sapiens
guccagacaugcaaccuuu

SEQ ID NO: 589245 - RNA, 19 nt, Homo sapiens
ucaagaggauggagaagau

SEQ ID NO: 589246 - RNA, 19 nt, Homo sapiens
gaggcaacacgacgaaaua

SEQ ID NO: 589247 - RNA, 19 nt, Homo sapiens
ccugaaugcucaaauguug

SEQ ID NO: 589248 - RNA, 19 nt, Homo sapiens
gagccuggaugauguaaag

SEQ ID NO: 589249 - RNA, 19 nt, Homo sapiens
aaagcugaguccaaagaua

SEQ ID NO: 589250 - RNA, 19 nt, Homo sapiens
gggaagauuuagugaggaa

SEQ ID NO: 589251 - RNA, 19 nt, Homo sapiens
agucaugucugauuuguau

SEQ ID NO: 589252 - RNA, 19 nt, Homo sapiens
gaaguaaugcaguguuuca

SEQ ID NO: 589253 - RNA, 19 nt, Homo sapiens
ugaagagaauggaacaaga

SEQ ID NO: 589254 - RNA, 19 nt, Homo sapiens
ggaaaggaucgccauguga

SEQ ID NO: 589255 - RNA, 19 nt, Homo sapiens
aaacugagcuagcugaacu

SEQ ID NO: 589256 - RNA, 19 nt, Homo sapiens
ugacagacuuucagaugga

SEQ ID NO: 589257 - RNA, 19 nt, Homo sapiens
acaaguagugccuguaaua

SEQ ID NO: 589258 - RNA, 19 nt, Homo sapiens
cagaaugucuuccaguauc

SEQ ID NO: 589259 - RNA, 19 nt, Homo sapiens
gugaggaagugcauuuaug

SEQ ID NO: 589260 - RNA, 19 nt, Homo sapiens
auugacagcuugaguguaa

SEQ ID NO: 589261 - RNA, 19 nt, Homo sapiens
acacaggccucuacugcaa

SEQ ID NO: 589262 - RNA, 19 nt, Homo sapiens
caggcaaacucuaaacaga

SEQ ID NO: 589263 - RNA, 19 nt, Homo sapiens
gaagaccaguguauuagcu

SEQ ID NO: 589264 - RNA, 19 nt, Homo sapiens
uaccugagcuggaauugga

SEQ ID NO: 589265 - RNA, 19 nt, Homo sapiens
gaacuggaugcuucaaaga

SEQ ID NO: 589266 - RNA, 19 nt, Homo sapiens
guacaaggaaacuccagua

SEQ ID NO: 589267 - RNA, 19 nt, Homo sapiens
ucacagaauucaccuagca

SEQ ID NO: 589268 - RNA, 19 nt, Homo sapiens
gcagagaaccaucuuaugc

SEQ ID NO: 589269 - RNA, 19 nt, Homo sapiens
cagagaauguaaccagcua

SEQ ID NO: 589270 - RNA, 19 nt, Homo sapiens
ugaugacgauguacagaaa

SEQ ID NO: 589271 - RNA, 19 nt, Homo sapiens
ccuagcagauuaaauauac

SEQ ID NO: 589272 - RNA, 19 nt, Homo sapiens
uaacaucuuuacaggguau

SEQ ID NO: 589273 - RNA, 19 nt, Homo sapiens
guuacugucugccaacauu

SEQ ID NO: 589274 - RNA, 19 nt, Homo sapiens
guuacggcaugcugauaua

SEQ ID NO: 589275 - RNA, 19 nt, Homo sapiens
uagccaauguugccuuaaa

SEQ ID NO: 589276 - RNA, 19 nt, Homo sapiens
uagauuaccugagcuggaa

SEQ ID NO: 589277 - RNA, 19 nt, Homo sapiens
acaaggaaacuccaguaua

SEQ ID NO: 589278 - RNA, 19 nt, Homo sapiens
gacaacaacugccgaacag

SEQ ID NO: 589279 - RNA, 19 nt, Homo sapiens
gaauuguauuugugucaga

SEQ ID NO: 589280 - RNA, 19 nt, Homo sapiens
aaacaucauuaucccauuc

SEQ ID NO: 589281 - RNA, 19 nt, Homo sapiens
caaguagugccuguaauaa

SEQ ID NO: 589282 - RNA, 19 nt, Homo sapiens
caaaaucacuaguaaaugg

SEQ ID NO: 589283 - RNA, 19 nt, Homo sapiens
gaauggaacaagagaaauc

SEQ ID NO: 589284 - RNA, 19 nt, Homo sapiens
gaucagauuccauggacaa

SEQ ID NO: 589285 - RNA, 19 nt, Homo sapiens
gcagaugagcucacagaau

SEQ ID NO: 589286 - RNA, 19 nt, Homo sapiens
caaggaaacuccaguauaa

SEQ ID NO: 589287 - RNA, 19 nt, Homo sapiens
gaauucaccuagcagauua

SEQ ID NO: 589288 - RNA, 19 nt, Homo sapiens
cgaaauagccauaccuuua

SEQ ID NO: 589289 - RNA, 19 nt, Homo sapiens
cagaugagcucacagaauu

SEQ ID NO: 589290 - RNA, 19 nt, Homo sapiens
gaaauagccauaccuuuaa

SEQ ID NO: 589291 - RNA, 19 nt, Homo sapiens
gaauguaaccagcuacuua

SEQ ID NO: 589292 - RNA, 19 nt, Homo sapiens
ucagacaucucaucaagua

SEQ ID NO: 589293 - RNA, 19 nt, Homo sapiens
gacgaugccuguucaagua

SEQ ID NO: 589294 - RNA, 19 nt, Homo sapiens
gacaacagcucuagugaug

SEQ ID NO: 589295 - RNA, 19 nt, Homo sapiens
ugaagaaucugcuaccaaa

SEQ ID NO: 589296 - RNA, 19 nt, Homo sapiens
cagauuccauggacaaaua

SEQ ID NO: 589297 - RNA, 19 nt, Homo sapiens
ccagacagcuguuccaaga

SEQ ID NO: 589298 - RNA, 19 nt, Homo sapiens
ucaccuagcagauuaaaua

SEQ ID NO: 589299 - RNA, 19 nt, Homo sapiens
gaauaucccuagcacaguu

SEQ ID NO: 589300 - RNA, 19 nt, Homo sapiens
gagaagauuuccagucaug

SEQ ID NO: 589301 - RNA, 19 nt, Homo sapiens
caagagaaaucaacaacug

SEQ ID NO: 589302 - RNA, 19 nt, Homo sapiens
caacuuugcuccaucucua

SEQ ID NO: 589303 - RNA, 19 nt, Homo sapiens
ccucagauaucaccacuuu

SEQ ID NO: 589304 - RNA, 19 nt, Homo sapiens
caggaggaauuaaugaaua

SEQ ID NO: 589305 - RNA, 19 nt, Homo sapiens
gaacaugaacccaaugaug

SEQ ID NO: 589306 - RNA, 19 nt, Homo sapiens
gacacaagcugcaaagaug

SEQ ID NO: 589307 - RNA, 19 nt, Homo sapiens
gaaauacgaauguucagaa

SEQ ID NO: 589308 - RNA, 19 nt, Homo sapiens
gaucagauacagcuaauga

SEQ ID NO: 589309 - RNA, 19 nt, Homo sapiens
gcagaggcaugacaggaaa

SEQ ID NO: 589310 - RNA, 19 nt, Homo sapiens
aguagugccuguaauaaua

SEQ ID NO: 589311 - RNA, 19 nt, Homo sapiens
ucagaagaccaguguauua

SEQ ID NO: 589312 - RNA, 19 nt, Homo sapiens
uguauuagcucacaauuag

SEQ ID NO: 589313 - RNA, 19 nt, Homo sapiens
gcaagauacuacagguaaa

SEQ ID NO: 589314 - RNA, 19 nt, Homo sapiens
gcaaagagccaugcuuaug

SEQ ID NO: 589315 - RNA, 19 nt, Homo sapiens
gauuuaagaucaacuccaa

SEQ ID NO: 589316 - RNA, 19 nt, Homo sapiens
gguguagaauccuuuauga

SEQ ID NO: 589317 - RNA, 19 nt, Homo sapiens
caaagagccaugcuuauga

SEQ ID NO: 589318 - RNA, 19 nt, Homo sapiens
cagcugguauccuuccuua

SEQ ID NO: 589319 - RNA, 19 nt, Homo sapiens
ggagaaggcagcacaguug

SEQ ID NO: 589320 - RNA, 19 nt, Homo sapiens
cagcugaccuugaccaguu

SEQ ID NO: 589321 - RNA, 19 nt, Homo sapiens
gaaaucagacaucucauca

SEQ ID NO: 589322 - RNA, 19 nt, Homo sapiens
ucaaaccagucacaaacua

SEQ ID NO: 589323 - RNA, 19 nt, Homo sapiens
uauggaagguacaggaaua

SEQ ID NO: 589324 - RNA, 19 nt, Homo sapiens
gagaauggaacaagagaaa

SEQ ID NO: 589325 - RNA, 19 nt, Homo sapiens
uaaaugaggugagagugaa

SEQ ID NO: 589326 - RNA, 19 nt, Homo sapiens
ggaagcaauugauaaccaa

SEQ ID NO: 589327 - RNA, 19 nt, Homo sapiens
gcuuagaaauuaacagguu

SEQ ID NO: 589328 - RNA, 19 nt, Homo sapiens
gaaaacagucgaucagaua

SEQ ID NO: 589329 - RNA, 19 nt, Homo sapiens
ugaccaguuugaucaguua

SEQ ID NO: 589330 - RNA, 19 nt, Homo sapiens
gcauaacaaugacagacuu

SEQ ID NO: 589331 - RNA, 19 nt, Homo sapiens
uaaccgaucuuauucaaac

SEQ ID NO: 589332 - RNA, 19 nt, Homo sapiens
gaagggagaauuguauuug

SEQ ID NO: 589333 - RNA, 19 nt, Homo sapiens
gcccugagcagauaaauga

SEQ ID NO: 589334 - RNA, 19 nt, Homo sapiens
auucagggcuucugcauaa

SEQ ID NO: 589335 - RNA, 19 nt, Homo sapiens
gaacugguugggaagauuu

SEQ ID NO: 589336 - RNA, 19 nt, Homo sapiens
gaugagcucuuugcagaug

SEQ ID NO: 589337 - RNA, 19 nt, Homo sapiens
gauuugaccauaucuguuu

SEQ ID NO: 589338 - RNA, 19 nt, Homo sapiens
cauagcagcagucauagua

SEQ ID NO: 589339 - RNA, 19 nt, Homo sapiens
guaaaucccucggucaauc

SEQ ID NO: 589340 - RNA, 19 nt, Homo sapiens
guacagaaaucagacaucu

SEQ ID NO: 589341 - RNA, 19 nt, Homo sapiens
gaacaagagaaaucaacaa

SEQ ID NO: 589342 - RNA, 19 nt, Homo sapiens
ggacaggccaguucacaga

SEQ ID NO: 589343 - RNA, 19 nt, Homo sapiens
cuucauagcagcagucaua

SEQ ID NO: 589344 - RNA, 19 nt, Homo sapiens
guccagacaugcaaccuuu

SEQ ID NO: 589345 - RNA, 19 nt, Homo sapiens
ucaagaggauggagaagau

SEQ ID NO: 589346 - RNA, 19 nt, Homo sapiens
gaggcaacacgacgaaaua

SEQ ID NO: 589347 - RNA, 19 nt, Homo sapiens
ccugaaugcucaaauguug

SEQ ID NO: 589348 - RNA, 19 nt, Homo sapiens
gagccuggaugauguaaag

SEQ ID NO: 589349 - RNA, 19 nt, Homo sapiens
aaagcugaguccaaagaua

SEQ ID NO: 589350 - RNA, 19 nt, Homo sapiens
gggaagauuuagugaggaa

SEQ ID NO: 589351 - RNA, 19 nt, Homo sapiens
agucaugucugauuuguau

SEQ ID NO: 589352 - RNA, 19 nt, Homo sapiens
gaaguaaugcaguguuuca

SEQ ID NO: 589353 - RNA, 19 nt, Homo sapiens
ugaagagaauggaacaaga

SEQ ID NO: 589354 - RNA, 19 nt, Homo sapiens
ggaaaggaucgccauguga

SEQ ID NO: 589355 - RNA, 19 nt, Homo sapiens
aaacugagcuagcugaacu

SEQ ID NO: 589356 - RNA, 19 nt, Homo sapiens
ugacagacuuucagaugga

SEQ ID NO: 589357 - RNA, 19 nt, Homo sapiens
acaaguagugccuguaaua

SEQ ID NO: 589358 - RNA, 19 nt, Homo sapiens
cagaaugucuuccaguauc

SEQ ID NO: 589359 - RNA, 19 nt, Homo sapiens
gugaggaagugcauuuaug

SEQ ID NO: 589360 - RNA, 19 nt, Homo sapiens
auugacagcuugaguguaa

SEQ ID NO: 589361 - RNA, 19 nt, Homo sapiens
acacaggccucuacugcaa

SEQ ID NO: 589362 - RNA, 19 nt, Homo sapiens
caggcaaacucuaaacaga

SEQ ID NO: 589363 - RNA, 19 nt, Homo sapiens
gaagaccaguguauuagcu

SEQ ID NO: 589364 - RNA, 19 nt, Homo sapiens
uaccugagcuggaauugga

SEQ ID NO: 589365 - RNA, 19 nt, Homo sapiens
gaacuggaugcuucaaaga

SEQ ID NO: 589366 - RNA, 19 nt, Homo sapiens
guacaaggaaacuccagua

SEQ ID NO: 589367 - RNA, 19 nt, Homo sapiens
ucacagaauucaccuagca

SEQ ID NO: 589368 - RNA, 19 nt, Homo sapiens
gcagagaaccaucuuaugc

SEQ ID NO: 589369 - RNA, 19 nt, Homo sapiens
cagagaauguaaccagcua

SEQ ID NO: 589370 - RNA, 19 nt, Homo sapiens
ugaugacgauguacagaaa

SEQ ID NO: 589371 - RNA, 19 nt, Homo sapiens
ccuagcagauuaaauauac

SEQ ID NO: 589372 - RNA, 19 nt, Homo sapiens
uaacaucuuuacaggguau

SEQ ID NO: 589373 - RNA, 19 nt, Homo sapiens
guuacugucugccaacauu

SEQ ID NO: 589374 - RNA, 19 nt, Homo sapiens
guuacggcaugcugauaua

SEQ ID NO: 589375 - RNA, 19 nt, Homo sapiens
uagccaauguugccuuaaa

SEQ ID NO: 589376 - RNA, 19 nt, Homo sapiens
caagaagacagaagaguuc

SEQ ID NO: 589377 - RNA, 19 nt, Homo sapiens
uagauuaccugagcuggaa

SEQ ID NO: 589378 - RNA, 19 nt, Homo sapiens
acaaggaaacuccaguaua

SEQ ID NO: 589379 - RNA, 19 nt, Homo sapiens
gacaacaacugccgaacag

SEQ ID NO: 589380 - RNA, 19 nt, Homo sapiens
gaauuguauuugugucaga

SEQ ID NO: 589381 - RNA, 19 nt, Homo sapiens
aaacaucauuaucccauuc

SEQ ID NO: 589382 - RNA, 19 nt, Homo sapiens
caaguagugccuguaauaa

SEQ ID NO: 589383 - RNA, 19 nt, Homo sapiens
caaaaucacuaguaaaugg

SEQ ID NO: 589384 - RNA, 19 nt, Homo sapiens
gaauggaacaagagaaauc

SEQ ID NO: 589385 - RNA, 19 nt, Homo sapiens
gaucagauuccauggacaa

SEQ ID NO: 589386 - RNA, 19 nt, Homo sapiens
caaggaaacuccaguauaa

SEQ ID NO: 589387 - RNA, 19 nt, Homo sapiens
gaauucaccuagcagauua

SEQ ID NO: 589388 - RNA, 19 nt, Homo sapiens
cgaaauagccauaccuuua

SEQ ID NO: 589389 - RNA, 19 nt, Homo sapiens
cagaugagcucacagaauu

SEQ ID NO: 589390 - RNA, 19 nt, Homo sapiens
gaaauagccauaccuuuaa

SEQ ID NO: 589391 - RNA, 19 nt, Homo sapiens
gaauguaaccagcuacuua

SEQ ID NO: 589392 - RNA, 19 nt, Homo sapiens
ucagacaucucaucaagua

SEQ ID NO: 589393 - RNA, 19 nt, Homo sapiens
gacgaugccuguucaagua

SEQ ID NO: 589394 - RNA, 19 nt, Homo sapiens
gacaacagcucuagugaug

SEQ ID NO: 589395 - RNA, 19 nt, Homo sapiens
ugaagaaucugcuaccaaa

SEQ ID NO: 589396 - RNA, 19 nt, Homo sapiens
cagauuccauggacaaaua

SEQ ID NO: 589397 - RNA, 19 nt, Homo sapiens
ccagacagcuguuccaaga

SEQ ID NO: 589398 - RNA, 19 nt, Homo sapiens
ucaccuagcagauuaaaua

SEQ ID NO: 589399 - RNA, 19 nt, Homo sapiens
gaauaucccuagcacaguu

SEQ ID NO: 589400 - RNA, 19 nt, Homo sapiens
gagaagauuuccagucaug

SEQ ID NO: 589401 - RNA, 19 nt, Homo sapiens
caagagaaaucaacaacug

SEQ ID NO: 589402 - RNA, 19 nt, Homo sapiens
caacuuugcuccaucucua

SEQ ID NO: 589403 - RNA, 19 nt, Homo sapiens
ccucagauaucaccacuuu

SEQ ID NO: 589404 - RNA, 19 nt, Homo sapiens
caggaggaauuaaugaaua

SEQ ID NO: 589405 - RNA, 19 nt, Homo sapiens
gaacaugaacccaaugaug

SEQ ID NO: 589406 - RNA, 19 nt, Homo sapiens
gacacaagcugcaaagaug

SEQ ID NO: 589407 - RNA, 19 nt, Homo sapiens
gaaauacgaauguucagaa

SEQ ID NO: 589408 - RNA, 19 nt, Homo sapiens
gaucagauacagcuaauga

SEQ ID NO: 589409 - RNA, 19 nt, Homo sapiens
gcagaggcaugacaggaaa

SEQ ID NO: 589410 - RNA, 19 nt, Homo sapiens
aguagugccuguaauaaua

SEQ ID NO: 589411 - RNA, 19 nt, Homo sapiens
ucagaagaccaguguauua

SEQ ID NO: 589412 - RNA, 19 nt, Homo sapiens
uguauuagcucacaauuag

SEQ ID NO: 589413 - RNA, 19 nt, Homo sapiens
gcaagauacuacagguaaa

SEQ ID NO: 589414 - RNA, 19 nt, Homo sapiens
gcaaagagccaugcuuaug

SEQ ID NO: 589415 - RNA, 19 nt, Homo sapiens
gauuuaagaucaacuccaa

SEQ ID NO: 589416 - RNA, 19 nt, Homo sapiens
gguguagaauccuuuauga

SEQ ID NO: 589417 - RNA, 19 nt, Homo sapiens
caaagagccaugcuuauga

SEQ ID NO: 589418 - RNA, 19 nt, Homo sapiens
cagcugguauccuuccuua

SEQ ID NO: 589419 - RNA, 19 nt, Homo sapiens
ggagaaggcagcacaguug

SEQ ID NO: 589420 - RNA, 19 nt, Homo sapiens
cagcugaccuugaccaguu

SEQ ID NO: 589421 - RNA, 19 nt, Homo sapiens
gaaaucagacaucucauca

SEQ ID NO: 589422 - RNA, 19 nt, Homo sapiens
ucaaaccagucacaaacua

SEQ ID NO: 589423 - RNA, 19 nt, Homo sapiens
uauggaagguacaggaaua

SEQ ID NO: 589424 - RNA, 19 nt, Homo sapiens
gagaauggaacaagagaaa

SEQ ID NO: 589425 - RNA, 19 nt, Homo sapiens
ggaagcaauugauaaccaa

SEQ ID NO: 589426 - RNA, 19 nt, Homo sapiens
gcuuagaaauuaacagguu

SEQ ID NO: 589427 - RNA, 19 nt, Homo sapiens
uaaaugaggugagagugaa

SEQ ID NO: 589428 - RNA, 19 nt, Homo sapiens
gaaaacagucgaucagaua

SEQ ID NO: 589429 - RNA, 19 nt, Homo sapiens
ugaccaguuugaucaguua

SEQ ID NO: 589430 - RNA, 19 nt, Homo sapiens
gcauaacaaugacagacuu

SEQ ID NO: 589431 - RNA, 19 nt, Homo sapiens
uaaccgaucuuauucaaac

SEQ ID NO: 589432 - RNA, 19 nt, Homo sapiens
gaagggagaauuguauuug

SEQ ID NO: 589433 - RNA, 19 nt, Homo sapiens
gcccugagcagauaaauga

SEQ ID NO: 589434 - RNA, 19 nt, Homo sapiens
auucagggcuucugcauaa

SEQ ID NO: 589435 - RNA, 19 nt, Homo sapiens
gaacugguugggaagauuu

SEQ ID NO: 589436 - RNA, 19 nt, Homo sapiens
gaugagcucuuugcagaug

SEQ ID NO: 589437 - RNA, 19 nt, Homo sapiens
gauuugaccauaucuguuu

SEQ ID NO: 589438 - RNA, 19 nt, Homo sapiens
cauagcagcagucauagua

SEQ ID NO: 589439 - RNA, 19 nt, Homo sapiens
guaaaucccucggucaauc

SEQ ID NO: 589440 - RNA, 19 nt, Homo sapiens
guacagaaaucagacaucu

SEQ ID NO: 589441 - RNA, 19 nt, Homo sapiens
gaacaagagaaaucaacaa

SEQ ID NO: 589442 - RNA, 19 nt, Homo sapiens
ggacaggccaguucacaga

SEQ ID NO: 589443 - RNA, 19 nt, Homo sapiens
cuucauagcagcagucaua

SEQ ID NO: 589444 - RNA, 19 nt, Homo sapiens
guccagacaugcaaccuuu

SEQ ID NO: 589445 - RNA, 19 nt, Homo sapiens
ucaagaggauggagaagau

SEQ ID NO: 589446 - RNA, 19 nt, Homo sapiens
gaggcaacacgacgaaaua

SEQ ID NO: 589447 - RNA, 19 nt, Homo sapiens
ccugaaugcucaaauguug

SEQ ID NO: 589448 - RNA, 19 nt, Homo sapiens
gagccuggaugauguaaag

SEQ ID NO: 589449 - RNA, 19 nt, Homo sapiens
aaagcugaguccaaagaua

SEQ ID NO: 589450 - RNA, 19 nt, Homo sapiens
gggaagauuuagugaggaa

SEQ ID NO: 589451 - RNA, 19 nt, Homo sapiens
agucaugucugauuuguau

SEQ ID NO: 589452 - RNA, 19 nt, Homo sapiens
gaaguaaugcaguguuuca

SEQ ID NO: 589453 - RNA, 19 nt, Homo sapiens
ugaagagaauggaacaaga

SEQ ID NO: 589454 - RNA, 19 nt, Homo sapiens
ggaaaggaucgccauguga

SEQ ID NO: 589455 - RNA, 19 nt, Homo sapiens
aaacugagcuagcugaacu

SEQ ID NO: 589456 - RNA, 19 nt, Homo sapiens
ugacagacuuucagaugga

SEQ ID NO: 589457 - RNA, 19 nt, Homo sapiens
acaaguagugccuguaaua

SEQ ID NO: 589458 - RNA, 19 nt, Homo sapiens
cagaaugucuuccaguauc

SEQ ID NO: 589459 - RNA, 19 nt, Homo sapiens
gugaggaagugcauuuaug

SEQ ID NO: 589460 - RNA, 19 nt, Homo sapiens
auugacagcuugaguguaa

SEQ ID NO: 589461 - RNA, 19 nt, Homo sapiens
acacaggccucuacugcaa

SEQ ID NO: 589462 - RNA, 19 nt, Homo sapiens
caggcaaacucuaaacaga

SEQ ID NO: 589463 - RNA, 19 nt, Homo sapiens
gaagaccaguguauuagcu

SEQ ID NO: 589464 - RNA, 19 nt, Homo sapiens
uaccugagcuggaauugga

SEQ ID NO: 589465 - RNA, 19 nt, Homo sapiens
gaacuggaugcuucaaaga

SEQ ID NO: 589466 - RNA, 19 nt, Homo sapiens
guacaaggaaacuccagua

SEQ ID NO: 589467 - RNA, 19 nt, Homo sapiens
ucacagaauucaccuagca

SEQ ID NO: 589468 - RNA, 19 nt, Homo sapiens
gcagagaaccaucuuaugc

SEQ ID NO: 589469 - RNA, 19 nt, Homo sapiens
cagagaauguaaccagcua

SEQ ID NO: 589470 - RNA, 19 nt, Homo sapiens
ugaugacgauguacagaaa

SEQ ID NO: 589471 - RNA, 19 nt, Homo sapiens
ccuagcagauuaaauauac

SEQ ID NO: 589472 - RNA, 19 nt, Homo sapiens
uaacaucuuuacaggguau

SEQ ID NO: 589473 - RNA, 19 nt, Homo sapiens
guuacugucugccaacauu

SEQ ID NO: 589474 - RNA, 19 nt, Homo sapiens
guuacggcaugcugauaua

SEQ ID NO: 589475 - RNA, 19 nt, Homo sapiens
uagccaauguugccuuaaa

SEQ ID NO: 589476 - RNA, 19 nt, Homo sapiens
uagauuaccugagcuggaa

SEQ ID NO: 589477 - RNA, 19 nt, Homo sapiens
acaaggaaacuccaguaua

SEQ ID NO: 589478 - RNA, 19 nt, Homo sapiens
gacaacaacugccgaacag

SEQ ID NO: 589479 - RNA, 19 nt, Homo sapiens
gaauuguauuugugucaga

SEQ ID NO: 589480 - RNA, 19 nt, Homo sapiens
aaacaucauuaucccauuc

SEQ ID NO: 589481 - RNA, 19 nt, Homo sapiens
caaguagugccuguaauaa

SEQ ID NO: 589482 - RNA, 19 nt, Homo sapiens
caaaaucacuaguaaaugg

SEQ ID NO: 589483 - RNA, 19 nt, Homo sapiens
gaauggaacaagagaaauc

SEQ ID NO: 589484 - RNA, 19 nt, Homo sapiens
gaucagauuccauggacaa

SEQ ID NO: 589485 - RNA, 19 nt, Homo sapiens
gcagaugagcucacagaau

SEQ ID NO: 589486 - RNA, 19 nt, Homo sapiens
ggaggaaccugucuuuaaa

SEQ ID NO: 589487 - RNA, 19 nt, Homo sapiens
gaaucaaacugguacauug

SEQ ID NO: 589488 - RNA, 19 nt, Homo sapiens
ggaacuugcuccauuguuu

SEQ ID NO: 589489 - RNA, 19 nt, Homo sapiens
cuaaagagcuagcauauag

SEQ ID NO: 589490 - RNA, 19 nt, Homo sapiens
cuaaagcgauucuuguaua

SEQ ID NO: 589491 - RNA, 19 nt, Homo sapiens
uguagggucuuucuuauuu

SEQ ID NO: 589492 - RNA, 19 nt, Homo sapiens
ucacuaacuuuccuuugua

SEQ ID NO: 589493 - RNA, 19 nt, Homo sapiens
gagcuagcauauagaugua

SEQ ID NO: 589494 - RNA, 19 nt, Homo sapiens
uggaguaccuguuauuaaa

SEQ ID NO: 589495 - RNA, 19 nt, Homo sapiens
gugcugcucuuuaaugaaa

SEQ ID NO: 589496 - RNA, 19 nt, Homo sapiens
uuagugagaucuagggaua

SEQ ID NO: 589497 - RNA, 19 nt, Homo sapiens
gaagcaaacuuggacuuuc

SEQ ID NO: 589498 - RNA, 19 nt, Homo sapiens
guagggucuuucuuauuua

SEQ ID NO: 589499 - RNA, 19 nt, Homo sapiens
gaugagagauucuauucag

SEQ ID NO: 589500 - RNA, 19 nt, Homo sapiens
gaaccaggcagcccagaaa

SEQ ID NO: 589501 - RNA, 19 nt, Homo sapiens
cagaaaugguucagucuau

SEQ ID NO: 589502 - RNA, 19 nt, Homo sapiens
cagacgaggucaugaauca

SEQ ID NO: 589503 - RNA, 19 nt, Homo sapiens
gcccaggcuugcagaauaa

SEQ ID NO: 589504 - RNA, 19 nt, Homo sapiens
gaucagaaucaaacuggua

SEQ ID NO: 589505 - RNA, 19 nt, Homo sapiens
guuaagugcugccaauugu

SEQ ID NO: 589506 - RNA, 19 nt, Homo sapiens
gagauucuauucaguggau

SEQ ID NO: 589507 - RNA, 19 nt, Homo sapiens
gauggaguaccuguuauua

SEQ ID NO: 589508 - RNA, 19 nt, Homo sapiens
caaacucugcuuucuguaa

SEQ ID NO: 589509 - RNA, 19 nt, Homo sapiens
guuauucuguuuccaaugu

SEQ ID NO: 589510 - RNA, 19 nt, Homo sapiens
gaacuugcuccauuguuug

SEQ ID NO: 589511 - RNA, 19 nt, Homo sapiens
aaaggaacuugcuccauug

SEQ ID NO: 589512 - RNA, 19 nt, Homo sapiens
ggaagcaaacuuggacuuu

SEQ ID NO: 589513 - RNA, 19 nt, Homo sapiens
gguguagggucuuucuuau

SEQ ID NO: 589514 - RNA, 19 nt, Homo sapiens
caauaucaauccagcaauc

SEQ ID NO: 589515 - RNA, 19 nt, Homo sapiens
gaaaugguucagucuauca

SEQ ID NO: 589516 - RNA, 19 nt, Homo sapiens
ccagcaaucuuuagacuac

SEQ ID NO: 589517 - RNA, 19 nt, Homo sapiens
agagauggaguaccuguua

SEQ ID NO: 589518 - RNA, 19 nt, Homo sapiens
guacauugauccacuugag

SEQ ID NO: 589519 - RNA, 19 nt, Homo sapiens
auagauagaucaguugcua

SEQ ID NO: 589520 - RNA, 19 nt, Homo sapiens
uuugcgaccugguuucuua

SEQ ID NO: 589521 - RNA, 19 nt, Homo sapiens
gagauggaguaccuguuau

SEQ ID NO: 589522 - RNA, 19 nt, Homo sapiens
ucaguacaaucacuaacuu

SEQ ID NO: 589523 - RNA, 19 nt, Homo sapiens
ccaggugguucaauuuaau

SEQ ID NO: 589524 - RNA, 19 nt, Homo sapiens
cggaugaccuaaagcgauu

SEQ ID NO: 589525 - RNA, 19 nt, Homo sapiens
gacagugguuucagugugu

SEQ ID NO: 589526 - RNA, 19 nt, Homo sapiens
aaaaggaacuugcuccauu

SEQ ID NO: 589527 - RNA, 19 nt, Homo sapiens
ccggaaaucccguaucgua

SEQ ID NO: 589528 - RNA, 19 nt, Homo sapiens
guuuguguguucuucauaa

SEQ ID NO: 589529 - RNA, 19 nt, Homo sapiens
gggugcugcucuuuaauga

SEQ ID NO: 589530 - RNA, 19 nt, Homo sapiens
uaaaauggcuugguaaaag

SEQ ID NO: 589531 - RNA, 19 nt, Homo sapiens
gaguaccuguuauuaaagu

SEQ ID NO: 589532 - RNA, 19 nt, Homo sapiens
ugcccaggcuugcagaaua

SEQ ID NO: 589533 - RNA, 19 nt, Homo sapiens
gaggaggaaccugucuuua

SEQ ID NO: 589534 - RNA, 19 nt, Homo sapiens
cuuuaaagcugucccugaa

SEQ ID NO: 589535 - RNA, 19 nt, Homo sapiens
uaaaguggcaaaugacaau

SEQ ID NO: 589536 - RNA, 19 nt, Homo sapiens
aggaggaaccugucuuuaa

SEQ ID NO: 589537 - RNA, 19 nt, Homo sapiens
gaucuagggauaccacaga

SEQ ID NO: 589538 - RNA, 19 nt, Homo sapiens
gugguucaauuuaaucguu

SEQ ID NO: 589539 - RNA, 19 nt, Homo sapiens
cagcagcagugccaauaca

SEQ ID NO: 589540 - RNA, 19 nt, Homo sapiens
uaccuuugguggugaguuu

SEQ ID NO: 589541 - RNA, 19 nt, Homo sapiens
gcuagcauauagauguaau

SEQ ID NO: 589542 - RNA, 19 nt, Homo sapiens
gaaguuucuuaaucugaca

SEQ ID NO: 589543 - RNA, 19 nt, Homo sapiens
cuaauugucagccuagaaa

SEQ ID NO: 589544 - RNA, 19 nt, Homo sapiens
uaucaauccagcaaucuuu

SEQ ID NO: 589545 - RNA, 19 nt, Homo sapiens
gaagggcuccaugccauug

SEQ ID NO: 589546 - RNA, 19 nt, Homo sapiens
ggucuuucuuauuuaguga

SEQ ID NO: 589547 - RNA, 19 nt, Homo sapiens
uuaaagcugucccugaagu

SEQ ID NO: 589548 - RNA, 19 nt, Homo sapiens
ucuauucaguggaucagaa

SEQ ID NO: 589549 - RNA, 19 nt, Homo sapiens
gaagugacagcggagagaa

SEQ ID NO: 589550 - RNA, 19 nt, Homo sapiens
gcgcagacgaggucaugaa

SEQ ID NO: 589551 - RNA, 19 nt, Homo sapiens
cucaaacucugcuuucugu

SEQ ID NO: 589552 - RNA, 19 nt, Homo sapiens
uguggaaguuucuuaaucu

SEQ ID NO: 589553 - RNA, 19 nt, Homo sapiens
ugaggaggaaccugucuuu

SEQ ID NO: 589554 - RNA, 19 nt, Homo sapiens
aaaguuaccaaguguugaa

SEQ ID NO: 589555 - RNA, 19 nt, Homo sapiens
gaccuaaagcgauucuugu

SEQ ID NO: 589556 - RNA, 19 nt, Homo sapiens
caacagaccaaggaagcaa

SEQ ID NO: 589557 - RNA, 19 nt, Homo sapiens
agauauggaugagagauuc

SEQ ID NO: 589558 - RNA, 19 nt, Homo sapiens
auacuaaagagcuagcaua

SEQ ID NO: 589559 - RNA, 19 nt, Homo sapiens
caugauaguacagccauuu

SEQ ID NO: 589560 - RNA, 19 nt, Homo sapiens
guguguaccuuaucuucau

SEQ ID NO: 589561 - RNA, 19 nt, Homo sapiens
gcauugagugaggaacaua

SEQ ID NO: 589562 - RNA, 19 nt, Homo sapiens
gccguuaagugcugccaau

SEQ ID NO: 589563 - RNA, 19 nt, Homo sapiens
ugguguagggucuuucuua

SEQ ID NO: 589564 - RNA, 19 nt, Homo sapiens
gccagcagcagugccaaua

SEQ ID NO: 589565 - RNA, 19 nt, Homo sapiens
ugaccuaaagcgauucuug

SEQ ID NO: 589566 - RNA, 19 nt, Homo sapiens
aaacucugcuuucuguaac

SEQ ID NO: 589567 - RNA, 19 nt, Homo sapiens
ggucaccagauauggauga

SEQ ID NO: 589568 - RNA, 19 nt, Homo sapiens
uugaagaacugagacaagu

SEQ ID NO: 589569 - RNA, 19 nt, Homo sapiens
gggucuuucuuauuuagug

SEQ ID NO: 589570 - RNA, 19 nt, Homo sapiens
agagcuagcauauagaugu

SEQ ID NO: 589571 - RNA, 19 nt, Homo sapiens
cauggcggaugaccuaaag

SEQ ID NO: 589572 - RNA, 19 nt, Homo sapiens
ccaauguuaguauguaugu

SEQ ID NO: 589573 - RNA, 19 nt, Homo sapiens
gauugauccugcgagagaa

SEQ ID NO: 589574 - RNA, 19 nt, Homo sapiens
ggaugagagauucuauuca

SEQ ID NO: 589575 - RNA, 19 nt, Homo sapiens
agaaaugguucagucuauc

SEQ ID NO: 589576 - RNA, 19 nt, Homo sapiens
acagaaaugguucagucua

SEQ ID NO: 589577 - RNA, 19 nt, Homo sapiens
agauagagauggaguaccu

SEQ ID NO: 589578 - RNA, 19 nt, Homo sapiens
aaagagcuagcauauagau

SEQ ID NO: 589579 - RNA, 19 nt, Homo sapiens
ggaguaccuguuauuaaag

SEQ ID NO: 589580 - RNA, 19 nt, Homo sapiens
uaaagagcuagcauauaga

SEQ ID NO: 589581 - RNA, 19 nt, Homo sapiens
gguuucaguguguaccuua

SEQ ID NO: 589582 - RNA, 19 nt, Homo sapiens
gagcgcagacgaggucaug

SEQ ID NO: 589583 - RNA, 19 nt, Homo sapiens
agauugauccugcgagaga

SEQ ID NO: 589584 - RNA, 19 nt, Homo sapiens
cagauauggaugagagauu

SEQ ID NO: 589585 - RNA, 19 nt, Homo sapiens
cuagggauaccacagaaau

SEQ ID NO: 589586 - RNA, 19 nt, Homo sapiens
gaacacagguuaccauauu

SEQ ID NO: 589587 - RNA, 19 nt, Homo sapiens
caaaguaucugaacaagaa

SEQ ID NO: 589588 - RNA, 19 nt, Homo sapiens
caagaaagcugaaacagau

SEQ ID NO: 589589 - RNA, 19 nt, Homo sapiens
ggagaaagaaggauguuua

SEQ ID NO: 589590 - RNA, 19 nt, Homo sapiens
cagaagaugucacccuuua

SEQ ID NO: 589591 - RNA, 19 nt, Homo sapiens
aaauguagcuucccgguua

SEQ ID NO: 589592 - RNA, 19 nt, Homo sapiens
gaaagaaggauguuuaugu

SEQ ID NO: 589593 - RNA, 19 nt, Homo sapiens
gagaggagaucaugaaaca

SEQ ID NO: 589594 - RNA, 19 nt, Homo sapiens
gaaagcuacuggaaagaaa

SEQ ID NO: 589595 - RNA, 19 nt, Homo sapiens
gaaguuguaugaguuguaa

SEQ ID NO: 589596 - RNA, 19 nt, Homo sapiens
gaacuuugauagagccuuu

SEQ ID NO: 589597 - RNA, 19 nt, Homo sapiens
caacaacaaucaugcuuau

SEQ ID NO: 589598 - RNA, 19 nt, Homo sapiens
gaaagcaguuaaagcaguu

SEQ ID NO: 589599 - RNA, 19 nt, Homo sapiens
gaagaugucacccuuuaaa

SEQ ID NO: 589600 - RNA, 19 nt, Homo sapiens
gaacagagaggcacgcuau

SEQ ID NO: 589601 - RNA, 19 nt, Homo sapiens
ccagugggcugcauuagaa

SEQ ID NO: 589602 - RNA, 19 nt, Homo sapiens
ggacaaaugaggaaacuga

SEQ ID NO: 589603 - RNA, 19 nt, Homo sapiens
caacagagaggcaaaguau

SEQ ID NO: 589604 - RNA, 19 nt, Homo sapiens
cuaaggaccucauaguuga

SEQ ID NO: 589605 - RNA, 19 nt, Homo sapiens
ccaagcacauuuacugaaa

SEQ ID NO: 589606 - RNA, 19 nt, Homo sapiens
gaagacguuugaaauugaa

SEQ ID NO: 589607 - RNA, 19 nt, Homo sapiens
cagaagacguuugaaauug

SEQ ID NO: 589608 - RNA, 19 nt, Homo sapiens
cuaaagaagucaaggaaau

SEQ ID NO: 589609 - RNA, 19 nt, Homo sapiens
gcaacaacaaucaugcuua

SEQ ID NO: 589610 - RNA, 19 nt, Homo sapiens
gaggagaucaugaaacaaa

SEQ ID NO: 589611 - RNA, 19 nt, Homo sapiens
gcaguuuccuuauguuaau

SEQ ID NO: 589612 - RNA, 19 nt, Homo sapiens
uaaguaaucuugccaaagg

SEQ ID NO: 589613 - RNA, 19 nt, Homo sapiens
gagaaaagcugccuugcaa

SEQ ID NO: 589614 - RNA, 19 nt, Homo sapiens
gaugguggccaacguauuu

SEQ ID NO: 589615 - RNA, 19 nt, Homo sapiens
gauagucguugguucauca

SEQ ID NO: 589616 - RNA, 19 nt, Homo sapiens
gagaaggaauguggaguga

SEQ ID NO: 589617 - RNA, 19 nt, Homo sapiens
gaaggaauguggagugacu

SEQ ID NO: 589618 - RNA, 19 nt, Homo sapiens
caggaucccuagcuuguuu

SEQ ID NO: 589619 - RNA, 19 nt, Homo sapiens
ccaauacagucacuagguu

SEQ ID NO: 589620 - RNA, 19 nt, Homo sapiens
agaagacguuugaaauuga

SEQ ID NO: 589621 - RNA, 19 nt, Homo sapiens
gaaggaucauuccguguca

SEQ ID NO: 589622 - RNA, 19 nt, Homo sapiens
gcucacagaucaccaaugc

SEQ ID NO: 589623 - RNA, 19 nt, Homo sapiens
ggaaauugcagccacaugu

SEQ ID NO: 589624 - RNA, 19 nt, Homo sapiens
gaaauugcagccacauguu

SEQ ID NO: 589625 - RNA, 19 nt, Homo sapiens
aaagaaagcaguuaaagca

SEQ ID NO: 589626 - RNA, 19 nt, Homo sapiens
gacauaaucauaccauaga

SEQ ID NO: 589627 - RNA, 19 nt, Homo sapiens
guaguggccuguauuagag

SEQ ID NO: 589628 - RNA, 19 nt, Homo sapiens
caacgguucugcagcuuuc

SEQ ID NO: 589629 - RNA, 19 nt, Homo sapiens
gaaagagaggagaucauga

SEQ ID NO: 589630 - RNA, 19 nt, Homo sapiens
uaaguaccuuggccaugua

SEQ ID NO: 589631 - RNA, 19 nt, Homo sapiens
gagaaagaaggauguuuau

SEQ ID NO: 589632 - RNA, 19 nt, Homo sapiens
gagcuuccauuuugaguaa

SEQ ID NO: 589633 - RNA, 19 nt, Homo sapiens
uuacaaaucucuggcaaca

SEQ ID NO: 589634 - RNA, 19 nt, Homo sapiens
ccaccagucccuucuuuaa

SEQ ID NO: 589635 - RNA, 19 nt, Homo sapiens
ccaagaaagcugaaacaga

SEQ ID NO: 589636 - RNA, 19 nt, Homo sapiens
gacaggaacuuugauagag

SEQ ID NO: 589637 - RNA, 19 nt, Homo sapiens
gaacguuggccuuacaauc

SEQ ID NO: 589638 - RNA, 19 nt, Homo sapiens
acacuaagguaacaugaca

SEQ ID NO: 589639 - RNA, 19 nt, Homo sapiens
ugucagucauucauuguaa

SEQ ID NO: 589640 - RNA, 19 nt, Homo sapiens
gcaacagagaggcaaagua

SEQ ID NO: 589641 - RNA, 19 nt, Homo sapiens
uguacucccucuucccuua

SEQ ID NO: 589642 - RNA, 19 nt, Homo sapiens
ggaaagaaagcaguuaaag

SEQ ID NO: 589643 - RNA, 19 nt, Homo sapiens
caagaggaaugcacaucug

SEQ ID NO: 589644 - RNA, 19 nt, Homo sapiens
uagaagggaacacagguua

SEQ ID NO: 589645 - RNA, 19 nt, Homo sapiens
aaacacaacaggaagcaaa

SEQ ID NO: 589646 - RNA, 19 nt, Homo sapiens
gaaagaaagcaguuaaagc

SEQ ID NO: 589647 - RNA, 19 nt, Homo sapiens
acagaagacguuugaaauu

SEQ ID NO: 589648 - RNA, 19 nt, Homo sapiens
ucagacgccucacuuagga

SEQ ID NO: 589649 - RNA, 19 nt, Homo sapiens
aaagagaggagaucaugaa

SEQ ID NO: 589650 - RNA, 19 nt, Homo sapiens
gaacaaauuacggcaaagu

SEQ ID NO: 589651 - RNA, 19 nt, Homo sapiens
uggaaucaaucgaaauaug

SEQ ID NO: 589652 - RNA, 19 nt, Homo sapiens
auugaugccuacugaaaua

SEQ ID NO: 589653 - RNA, 19 nt, Homo sapiens
uauuagagaucaagaagag

SEQ ID NO: 589654 - RNA, 19 nt, Homo sapiens
ucaguaguggccuguauua

SEQ ID NO: 589655 - RNA, 19 nt, Homo sapiens
gaaaagcugccuugcaauu

SEQ ID NO: 589656 - RNA, 19 nt, Homo sapiens
aaugcaagaugccaagaaa

SEQ ID NO: 589657 - RNA, 19 nt, Homo sapiens
gaauguggagugacugcua

SEQ ID NO: 589658 - RNA, 19 nt, Homo sapiens
ccagacaggaacuuugaua

SEQ ID NO: 589659 - RNA, 19 nt, Homo sapiens
ugaccucggauaacaauaa

SEQ ID NO: 589660 - RNA, 19 nt, Homo sapiens
gcaaaguaucugaacaaga

SEQ ID NO: 589661 - RNA, 19 nt, Homo sapiens
ucccaaaggucccaaggaa

SEQ ID NO: 589662 - RNA, 19 nt, Homo sapiens
ucuccuaccuuccaagcua

SEQ ID NO: 589663 - RNA, 19 nt, Homo sapiens
uaagauagucguugguuca

SEQ ID NO: 589664 - RNA, 19 nt, Homo sapiens
gggaacacagguuaccaua

SEQ ID NO: 589665 - RNA, 19 nt, Homo sapiens
ccaaaggucccaaggaaca

SEQ ID NO: 589666 - RNA, 19 nt, Homo sapiens
uuacgaaacuuguccaaaa

SEQ ID NO: 589667 - RNA, 19 nt, Homo sapiens
ugaguugccuuccacuaug

SEQ ID NO: 589668 - RNA, 19 nt, Homo sapiens
uuaaguaccuuggccaugu

SEQ ID NO: 589669 - RNA, 19 nt, Homo sapiens
acaaauuacggcaaaguuu

SEQ ID NO: 589670 - RNA, 19 nt, Homo sapiens
uuacagaagacguuugaaa

SEQ ID NO: 589671 - RNA, 19 nt, Homo sapiens
gauaagauagucguugguu

SEQ ID NO: 589672 - RNA, 19 nt, Homo sapiens
ugaaacagauaagauaguc

SEQ ID NO: 589673 - RNA, 19 nt, Homo sapiens
gaucaugaaacaaaugcaa

SEQ ID NO: 589674 - RNA, 19 nt, Homo sapiens
guaaagggcacagccaaga

SEQ ID NO: 589675 - RNA, 19 nt, Homo sapiens
aagguaacaugacauaauc

SEQ ID NO: 589676 - RNA, 19 nt, Homo sapiens
aaagcugccuugcaauuag

SEQ ID NO: 589677 - RNA, 19 nt, Homo sapiens
caaucauuauggcuaugua

SEQ ID NO: 589678 - RNA, 19 nt, Homo sapiens
caacuaucccuacgcauca

SEQ ID NO: 589679 - RNA, 19 nt, Homo sapiens
gaaggauguuuauguucca

SEQ ID NO: 589680 - RNA, 19 nt, Homo sapiens
gcccagcagagcuauauuu

SEQ ID NO: 589681 - RNA, 19 nt, Homo sapiens
cgagggcgcuugaguuggu

SEQ ID NO: 589682 - RNA, 19 nt, Homo sapiens
cagcagacauucccucacu

SEQ ID NO: 589683 - RNA, 19 nt, Homo sapiens
gcaguaggcugugcuuuug

SEQ ID NO: 589684 - RNA, 19 nt, Homo sapiens
cauuguaaguagcacauug

SEQ ID NO: 589685 - RNA, 19 nt, Homo sapiens
gcuaaagaagucaaggaaa

SEQ ID NO: 589686 - RNA, 19 nt, Homo sapiens
gagggucucuggcuuuauu

SEQ ID NO: 589687 - RNA, 19 nt, Homo sapiens
gggagggucucuggcuuua

SEQ ID NO: 589688 - RNA, 19 nt, Homo sapiens
uguagcagcuuaacuguau

SEQ ID NO: 589689 - RNA, 19 nt, Homo sapiens
ccuccuaccucuucauguu

SEQ ID NO: 589690 - RNA, 19 nt, Homo sapiens
gagcuucgacugccucuuc

SEQ ID NO: 589691 - RNA, 19 nt, Homo sapiens
gagcauccgcgugcacuuu

SEQ ID NO: 589692 - RNA, 19 nt, Homo sapiens
gcgacuaccugagcuccuu

SEQ ID NO: 589693 - RNA, 19 nt, Homo sapiens
uccuaccucuucauguuua

SEQ ID NO: 589694 - RNA, 19 nt, Homo sapiens
guaggaugguagcacacaa

SEQ ID NO: 589695 - RNA, 19 nt, Homo sapiens
gaaccuuccuccucuuccu

SEQ ID NO: 589696 - RNA, 19 nt, Homo sapiens
ccagaaccuuccuccucuu

SEQ ID NO: 589697 - RNA, 19 nt, Homo sapiens
gcugugcagaauccuauuu

SEQ ID NO: 589698 - RNA, 19 nt, Homo sapiens
gggaugccguguuauuuug

SEQ ID NO: 589699 - RNA, 19 nt, Homo sapiens
gacacgcacuuccgcacau

SEQ ID NO: 589700 - RNA, 19 nt, Homo sapiens
uguuauuacuugccuggaa

SEQ ID NO: 589701 - RNA, 19 nt, Homo sapiens
ccagguggcagccgacaau

SEQ ID NO: 589702 - RNA, 19 nt, Homo sapiens
gcauccgcgugcacuuuca

SEQ ID NO: 589703 - RNA, 19 nt, Homo sapiens
cgccgugcacgcagcauua

SEQ ID NO: 589704 - RNA, 19 nt, Homo sapiens
ggacgccugcggauucuac

SEQ ID NO: 589705 - RNA, 19 nt, Homo sapiens
acacgcacuuccgcacauu

SEQ ID NO: 589706 - RNA, 19 nt, Homo sapiens
uccguucgcacgccgauua

SEQ ID NO: 589707 - RNA, 19 nt, Homo sapiens
gguggcagccgacaaugca

SEQ ID NO: 589708 - RNA, 19 nt, Homo sapiens
ccugaacucgcaccuccua

SEQ ID NO: 589709 - RNA, 19 nt, Homo sapiens
guauugaggucauuuguua

SEQ ID NO: 589710 - RNA, 19 nt, Homo sapiens
caaagaagcuaauauggaa

SEQ ID NO: 589711 - RNA, 19 nt, Homo sapiens
gaggaucguuuguuuguua

SEQ ID NO: 589712 - RNA, 19 nt, Homo sapiens
gagaacaucuuaaagcauu

SEQ ID NO: 589713 - RNA, 19 nt, Homo sapiens
cuauauaccuccucacuua

SEQ ID NO: 589714 - RNA, 19 nt, Homo sapiens
caaaguuucucuugaguuu

SEQ ID NO: 589715 - RNA, 19 nt, Homo sapiens
caagaaagguuuaaagcuu

SEQ ID NO: 589716 - RNA, 19 nt, Homo sapiens
gaaauugguuugaagaugu

SEQ ID NO: 589717 - RNA, 19 nt, Homo sapiens
gaacagagaagcaucuaaa

SEQ ID NO: 589718 - RNA, 19 nt, Homo sapiens
ggaaaccacauguaacuua

SEQ ID NO: 589719 - RNA, 19 nt, Homo sapiens
gugauugucugguauauuu

SEQ ID NO: 589720 - RNA, 19 nt, Homo sapiens
aaacaugccauuccuauua

SEQ ID NO: 589721 - RNA, 19 nt, Homo sapiens
gcacuugaauguugaaugu

SEQ ID NO: 589722 - RNA, 19 nt, Homo sapiens
gaggaaagccugguuauuu

SEQ ID NO: 589723 - RNA, 19 nt, Homo sapiens
gaaaguaguuuggguggaa

SEQ ID NO: 589724 - RNA, 19 nt, Homo sapiens
gaacaucacacagaaagua

SEQ ID NO: 589725 - RNA, 19 nt, Homo sapiens
caccguaugugaaauaaua

SEQ ID NO: 589726 - RNA, 19 nt, Homo sapiens
gcaaauacguacuaaacug

SEQ ID NO: 589727 - RNA, 19 nt, Homo sapiens
gcaaagauaaggaugcaua

SEQ ID NO: 589728 - RNA, 19 nt, Homo sapiens
uaacaggagucaucaauuc

SEQ ID NO: 589729 - RNA, 19 nt, Homo sapiens
gagcaaagggcgcuauaua

SEQ ID NO: 589730 - RNA, 19 nt, Homo sapiens
ucacacagcuugcaaauac

SEQ ID NO: 589731 - RNA, 19 nt, Homo sapiens
uaacuuagccagacuauau

SEQ ID NO: 589732 - RNA, 19 nt, Homo sapiens
ggauaugcuuguacuagua

SEQ ID NO: 589733 - RNA, 19 nt, Homo sapiens
guacuaaacugcacaaggu

SEQ ID NO: 589734 - RNA, 19 nt, Homo sapiens
uauggaggcuucuacaaua

SEQ ID NO: 589735 - RNA, 19 nt, Homo sapiens
gauaaacggucauuucuac

SEQ ID NO: 589736 - RNA, 19 nt, Homo sapiens
ucuaaaggauuccaugaua

SEQ ID NO: 589737 - RNA, 19 nt, Homo sapiens
gcaguauucuucaguaaau

SEQ ID NO: 589738 - RNA, 19 nt, Homo sapiens
gaggaaagauuggauuaga

SEQ ID NO: 589739 - RNA, 19 nt, Homo sapiens
gaauggaauugcugaaugu

SEQ ID NO: 589740 - RNA, 19 nt, Homo sapiens
caagguguguguucuauau

SEQ ID NO: 589741 - RNA, 19 nt, Homo sapiens
guacagcaauuucucaugu

SEQ ID NO: 589742 - RNA, 19 nt, Homo sapiens
cagauucccuggaggauuu

SEQ ID NO: 589743 - RNA, 19 nt, Homo sapiens
ggccaaccuuacuaaauua

SEQ ID NO: 589744 - RNA, 19 nt, Homo sapiens
ggauauggaggaaauuaua

SEQ ID NO: 589745 - RNA, 19 nt, Homo sapiens
uguuaaagcugcauugaaa

SEQ ID NO: 589746 - RNA, 19 nt, Homo sapiens
gagguggaauguaucagua

SEQ ID NO: 589747 - RNA, 19 nt, Homo sapiens
uguagaagcuaaacaagaa

SEQ ID NO: 589748 - RNA, 19 nt, Homo sapiens
uaacuguccuccacauauu

SEQ ID NO: 589749 - RNA, 19 nt, Homo sapiens
cuaaaggauuccaugauaa

SEQ ID NO: 589750 - RNA, 19 nt, Homo sapiens
guagggcacuugacaguau

SEQ ID NO: 589751 - RNA, 19 nt, Homo sapiens
gaaccucgagucacuguaa

SEQ ID NO: 589752 - RNA, 19 nt, Homo sapiens
gaaaccacauguaacuuag

SEQ ID NO: 589753 - RNA, 19 nt, Homo sapiens
gggauuaacuuugagaaau

SEQ ID NO: 589754 - RNA, 19 nt, Homo sapiens
gaugcuugcucgugacuuu

SEQ ID NO: 589755 - RNA, 19 nt, Homo sapiens
gaaugguaguugagaagaa

SEQ ID NO: 589756 - RNA, 19 nt, Homo sapiens
gauucauacugcucuguua

SEQ ID NO: 589757 - RNA, 19 nt, Homo sapiens
cagcagcccuauucagaaa

SEQ ID NO: 589758 - RNA, 19 nt, Homo sapiens
ccucaaacaugguuauuuc

SEQ ID NO: 589759 - RNA, 19 nt, Homo sapiens
cuacaggccugguuggauu

SEQ ID NO: 589760 - RNA, 19 nt, Homo sapiens
gguggaauguaucaguaua

SEQ ID NO: 589761 - RNA, 19 nt, Homo sapiens
guucaguaauugcuuauug

SEQ ID NO: 589762 - RNA, 19 nt, Homo sapiens
ccacaaaguuucucuugag

SEQ ID NO: 589763 - RNA, 19 nt, Homo sapiens
gugaagaaguagauuccua

SEQ ID NO: 589764 - RNA, 19 nt, Homo sapiens
guacauuucucccauaacu

SEQ ID NO: 589765 - RNA, 19 nt, Homo sapiens
uggccaaccuuacuaaauu

SEQ ID NO: 589766 - RNA, 19 nt, Homo sapiens
guacugugacuuuaacuuu

SEQ ID NO: 589767 - RNA, 19 nt, Homo sapiens
gcacgaggacuagacauuu

SEQ ID NO: 589768 - RNA, 19 nt, Homo sapiens
gaaugcagccagugaagaa

SEQ ID NO: 589769 - RNA, 19 nt, Homo sapiens
uauagucucuugugcuaaa

SEQ ID NO: 589770 - RNA, 19 nt, Homo sapiens
gcaaguacuuaguguugga

SEQ ID NO: 589771 - RNA, 19 nt, Homo sapiens
agaauuggcuguacagauc

SEQ ID NO: 589772 - RNA, 19 nt, Homo sapiens
gggagaacaucuuaaagca

SEQ ID NO: 589773 - RNA, 19 nt, Homo sapiens
gacugaggaucguuuguuu

SEQ ID NO: 589774 - RNA, 19 nt, Homo sapiens
gcagcccuauucagaaauu

SEQ ID NO: 589775 - RNA, 19 nt, Homo sapiens
gcaaagucacccuuacaaa

SEQ ID NO: 589776 - RNA, 19 nt, Homo sapiens
uagauucaguggaggauuu

SEQ ID NO: 589777 - RNA, 19 nt, Homo sapiens
gauaaagacaguucagguu

SEQ ID NO: 589778 - RNA, 19 nt, Homo sapiens
caaacaugguuauuucugu

SEQ ID NO: 589779 - RNA, 19 nt, Homo sapiens
gauaggcacuugggaacuu

SEQ ID NO: 589780 - RNA, 19 nt, Homo sapiens
aagaauaugugcaucguau

SEQ ID NO: 589781 - RNA, 19 nt, Homo sapiens
gguggaagacuuagauaaa

SEQ ID NO: 589782 - RNA, 19 nt, Homo sapiens
acaagucaguugaagauga

SEQ ID NO: 589783 - RNA, 19 nt, Homo sapiens
gcugauaggaugcuggaua

SEQ ID NO: 589784 - RNA, 19 nt, Homo sapiens
caauguagcuguaauuuuc

SEQ ID NO: 589785 - RNA, 19 nt, Homo sapiens
uuacuaaacuuggccuaaa

SEQ ID NO: 589786 - RNA, 19 nt, Homo sapiens
gaaggaaaauggaagguau

SEQ ID NO: 589787 - RNA, 19 nt, Homo sapiens
cagcaguauucuucaguaa

SEQ ID NO: 589788 - RNA, 19 nt, Homo sapiens
ccucgaccuuccaaucuua

SEQ ID NO: 589789 - RNA, 19 nt, Homo sapiens
ggcaugcuaucacaagaaa

SEQ ID NO: 589790 - RNA, 19 nt, Homo sapiens
cauuaggacuguuugaguu

SEQ ID NO: 589791 - RNA, 19 nt, Homo sapiens
agucaucaauucauccaua

SEQ ID NO: 589792 - RNA, 19 nt, Homo sapiens
uaacguacugugacuuuaa

SEQ ID NO: 589793 - RNA, 19 nt, Homo sapiens
cuacaauagugauggauau

SEQ ID NO: 589794 - RNA, 19 nt, Homo sapiens
caagagaauuggcuguaca

SEQ ID NO: 589795 - RNA, 19 nt, Homo sapiens
cuccacauauugagaauuu

SEQ ID NO: 589796 - RNA, 19 nt, Homo sapiens
ccagcaguauucuucagua

SEQ ID NO: 589797 - RNA, 19 nt, Homo sapiens
ggaauucuguacugauuuu

SEQ ID NO: 589798 - RNA, 19 nt, Homo sapiens
gcauagguuuccaugguau

SEQ ID NO: 589799 - RNA, 19 nt, Homo sapiens
guuggauucuggucuuuaa

SEQ ID NO: 589800 - RNA, 19 nt, Homo sapiens
aaucaaaccuuggcacaga

SEQ ID NO: 589801 - RNA, 19 nt, Homo sapiens
cuacuuugauguccuguug

SEQ ID NO: 589802 - RNA, 19 nt, Homo sapiens
cagagaagcaucuaaagga

SEQ ID NO: 589803 - RNA, 19 nt, Homo sapiens
gaacggaguggacauaguc

SEQ ID NO: 589804 - RNA, 19 nt, Homo sapiens
gaagaaguagauuccuaaa

SEQ ID NO: 589805 - RNA, 19 nt, Homo sapiens
gggaguuuauucuaaccua

SEQ ID NO: 589806 - RNA, 19 nt, Homo sapiens
caauagugauggauaugga

SEQ ID NO: 589807 - RNA, 19 nt, Homo sapiens
gccagagacuaucgacaaa

SEQ ID NO: 589808 - RNA, 19 nt, Homo sapiens
gccaagugauauugaagaa

SEQ ID NO: 589809 - RNA, 19 nt, Homo sapiens
gaagacagcuccaaugaca

SEQ ID NO: 589810 - RNA, 19 nt, Homo sapiens
ggaagaauguugccuauca

SEQ ID NO: 589811 - RNA, 19 nt, Homo sapiens
gaaaucaggugcugcuuga

SEQ ID NO: 589812 - RNA, 19 nt, Homo sapiens
caauaugccuaguuucuua

SEQ ID NO: 589813 - RNA, 19 nt, Homo sapiens
ggacuuugcugcuuauuug

SEQ ID NO: 589814 - RNA, 19 nt, Homo sapiens
gaaaagaacucaacauaga

SEQ ID NO: 589815 - RNA, 19 nt, Homo sapiens
gaacaacaaucauuagaag

SEQ ID NO: 589816 - RNA, 19 nt, Homo sapiens
caagagagcuacagucguu

SEQ ID NO: 589817 - RNA, 19 nt, Homo sapiens
ggaacugaguggccuauuu

SEQ ID NO: 589818 - RNA, 19 nt, Homo sapiens
gugcagaacuuccagauga

SEQ ID NO: 589819 - RNA, 19 nt, Homo sapiens
gaauuugaccggccucuua

SEQ ID NO: 589820 - RNA, 19 nt, Homo sapiens
caaaguguaugcaguauuc

SEQ ID NO: 589821 - RNA, 19 nt, Homo sapiens
gaugacagcuugugaucuu

SEQ ID NO: 589822 - RNA, 19 nt, Homo sapiens
gaguauagcaugaauguuu

SEQ ID NO: 589823 - RNA, 19 nt, Homo sapiens
ggaagagguuguuggugua

SEQ ID NO: 589824 - RNA, 19 nt, Homo sapiens
gaugguguguucugcaaua

SEQ ID NO: 589825 - RNA, 19 nt, Homo sapiens
gagaagaugcugauuaaug

SEQ ID NO: 589826 - RNA, 19 nt, Homo sapiens
cuagauggcugcagaaaga

SEQ ID NO: 589827 - RNA, 19 nt, Homo sapiens
gaauaacucuuacauacag

SEQ ID NO: 589828 - RNA, 19 nt, Homo sapiens
ggaagaaguuucaaauaac

SEQ ID NO: 589829 - RNA, 19 nt, Homo sapiens
gaaagaacaggcagaaaug

SEQ ID NO: 589830 - RNA, 19 nt, Homo sapiens
ggaacaugaugcaaacaaa

SEQ ID NO: 589831 - RNA, 19 nt, Homo sapiens
gugaauaacucuuacauac

SEQ ID NO: 589832 - RNA, 19 nt, Homo sapiens
ggagaauacuggcaagguu

SEQ ID NO: 589833 - RNA, 19 nt, Homo sapiens
gaacugaaaggaucaacaa

SEQ ID NO: 589834 - RNA, 19 nt, Homo sapiens
uuacagagaugguguguuc

SEQ ID NO: 589835 - RNA, 19 nt, Homo sapiens
caaguuggguucauagaug

SEQ ID NO: 589836 - RNA, 19 nt, Homo sapiens
uuaauaagauggaggagaa

SEQ ID NO: 589837 - RNA, 19 nt, Homo sapiens
ugaaggauauuucuaguca

SEQ ID NO: 589838 - RNA, 19 nt, Homo sapiens
gacgaucacugggacuuua

SEQ ID NO: 589839 - RNA, 19 nt, Homo sapiens
ggugggacauuuacugaaa

SEQ ID NO: 589840 - RNA, 19 nt, Homo sapiens
ggaaacggugggacauuua

SEQ ID NO: 589841 - RNA, 19 nt, Homo sapiens
ggauauuucuagucauuug

SEQ ID NO: 589842 - RNA, 19 nt, Homo sapiens
gaaaaucucugccucugaa

SEQ ID NO: 589843 - RNA, 19 nt, Homo sapiens
gagaauacuggcaagguua

SEQ ID NO: 589844 - RNA, 19 nt, Homo sapiens
aggagaagaugcugauuaa

SEQ ID NO: 589845 - RNA, 19 nt, Homo sapiens
gaacugaguggccuauuuc

SEQ ID NO: 589846 - RNA, 19 nt, Homo sapiens
ggaagaaacaagagagcua

SEQ ID NO: 589847 - RNA, 19 nt, Homo sapiens
gcagaaguugaccaaauua

SEQ ID NO: 589848 - RNA, 19 nt, Homo sapiens
gaguugaaguuuacagaga

SEQ ID NO: 589849 - RNA, 19 nt, Homo sapiens
ggugagcccuugaacauca

SEQ ID NO: 589850 - RNA, 19 nt, Homo sapiens
gaccuagcacuguacauua

SEQ ID NO: 589851 - RNA, 19 nt, Homo sapiens
caauucggauguuuacuga

SEQ ID NO: 589852 - RNA, 19 nt, Homo sapiens
gaauauaagaccacguuga

SEQ ID NO: 589853 - RNA, 19 nt, Homo sapiens
gaagaauuaucggaagaau

SEQ ID NO: 589854 - RNA, 19 nt, Homo sapiens
cauuggagguucugucgua

SEQ ID NO: 589855 - RNA, 19 nt, Homo sapiens
uuacauguaugcucaguau

SEQ ID NO: 589856 - RNA, 19 nt, Homo sapiens
ugaccuugcuaguuuaauu

SEQ ID NO: 589857 - RNA, 19 nt, Homo sapiens
aaauaacuguauccgcuua

SEQ ID NO: 589858 - RNA, 19 nt, Homo sapiens
aagcauggcuggacgauca

SEQ ID NO: 589859 - RNA, 19 nt, Homo sapiens
uaucauaauuggagacaug

SEQ ID NO: 589860 - RNA, 19 nt, Homo sapiens
cauggagugugaggaauua

SEQ ID NO: 589861 - RNA, 19 nt, Homo sapiens
gagaaaagaacucaacaua

SEQ ID NO: 589862 - RNA, 19 nt, Homo sapiens
ucaguggccucuccauuga

SEQ ID NO: 589863 - RNA, 19 nt, Homo sapiens
ccagagaaauggucaaugc

SEQ ID NO: 589864 - RNA, 19 nt, Homo sapiens
gcccagacccuuaaaauua

SEQ ID NO: 589865 - RNA, 19 nt, Homo sapiens
guaaaccagcagugcauua

SEQ ID NO: 589866 - RNA, 19 nt, Homo sapiens
gauaucugcugaccgcuau

SEQ ID NO: 589867 - RNA, 19 nt, Homo sapiens
gagaugguguguucugcaa

SEQ ID NO: 589868 - RNA, 19 nt, Homo sapiens
caggagaagaugcugauua

SEQ ID NO: 589869 - RNA, 19 nt, Homo sapiens
gaagaauguugccuaucau

SEQ ID NO: 589870 - RNA, 19 nt, Homo sapiens
gaugaaacaugagguucuu

SEQ ID NO: 589871 - RNA, 19 nt, Homo sapiens
gaugaagauugcuccgauu

SEQ ID NO: 589872 - RNA, 19 nt, Homo sapiens
gaagaacaacaaucauuag

SEQ ID NO: 589873 - RNA, 19 nt, Homo sapiens
agacuucacugcuggagaa

SEQ ID NO: 589874 - RNA, 19 nt, Homo sapiens
agaagaugcugauuaaugg

SEQ ID NO: 589875 - RNA, 19 nt, Homo sapiens
gaacuuguagcaacugaau

SEQ ID NO: 589876 - RNA, 19 nt, Homo sapiens
gaauguugccuaucauaau

SEQ ID NO: 589877 - RNA, 19 nt, Homo sapiens
caaauuacaggcuacaaga

SEQ ID NO: 589878 - RNA, 19 nt, Homo sapiens
guucaacacuggaagaagu

SEQ ID NO: 589879 - RNA, 19 nt, Homo sapiens
gcuauucccuguuccuugu

SEQ ID NO: 589880 - RNA, 19 nt, Homo sapiens
gcagaguccucgugcagau

SEQ ID NO: 589881 - RNA, 19 nt, Homo sapiens
gagaguauagcaugaaugu

SEQ ID NO: 589882 - RNA, 19 nt, Homo sapiens
ccacugaucuaaugaacag

SEQ ID NO: 589883 - RNA, 19 nt, Homo sapiens
gcagauggauuuuaagugu

SEQ ID NO: 589884 - RNA, 19 nt, Homo sapiens
gagguucugucguaucaug

SEQ ID NO: 589885 - RNA, 19 nt, Homo sapiens
ccagaugucaguaaggaua

SEQ ID NO: 589886 - RNA, 19 nt, Homo sapiens
caagggaacaugaugcaaa

SEQ ID NO: 589887 - RNA, 19 nt, Homo sapiens
uuacugaccucaaccuugu

SEQ ID NO: 589888 - RNA, 19 nt, Homo sapiens
cagcuccaaugacaaguuu

SEQ ID NO: 589889 - RNA, 19 nt, Homo sapiens
gaccagugcucaagacucu

SEQ ID NO: 589890 - RNA, 19 nt, Homo sapiens
caugcagaguugaaguuua

SEQ ID NO: 589891 - RNA, 19 nt, Homo sapiens
uaagaggcgaggagaauuu

SEQ ID NO: 589892 - RNA, 19 nt, Homo sapiens
agacaugccuuuaauacag

SEQ ID NO: 589893 - RNA, 19 nt, Homo sapiens
ggagacaugccuuuaauac

SEQ ID NO: 589894 - RNA, 19 nt, Homo sapiens
ugacugaccuggagauacu

SEQ ID NO: 589895 - RNA, 19 nt, Homo sapiens
gauauuucguguacugcaa

SEQ ID NO: 589896 - RNA, 19 nt, Homo sapiens
gcacaacuuuugagaguau

SEQ ID NO: 589897 - RNA, 19 nt, Homo sapiens
gcagaaagaacaggcagaa

SEQ ID NO: 589898 - RNA, 19 nt, Homo sapiens
caacauagaacccacugau

SEQ ID NO: 589899 - RNA, 19 nt, Homo sapiens
agaauuaucggaagaaugu

SEQ ID NO: 589900 - RNA, 19 nt, Homo sapiens
ugcagaaguugaccaaauu

SEQ ID NO: 589901 - RNA, 19 nt, Homo sapiens
caccgaaucuugcucuugu

SEQ ID NO: 589902 - RNA, 19 nt, Homo sapiens
ugugaucuuucugcaauua

SEQ ID NO: 589903 - RNA, 19 nt, Homo sapiens
gacuuuagcuucagugacu

SEQ ID NO: 589904 - RNA, 19 nt, Homo sapiens
caaccgaaaugacgaacag

SEQ ID NO: 589905 - RNA, 19 nt, Homo sapiens
gcagugcauuagaaguuug

SEQ ID NO: 589906 - RNA, 19 nt, Homo sapiens
gugaagacagcuccaauga

SEQ ID NO: 589907 - RNA, 19 nt, Homo sapiens
agaaagaacaggcagaaau

SEQ ID NO: 589908 - RNA, 19 nt, Homo sapiens
gcuugaccuugcuaguuua

SEQ ID NO: 589909 - RNA, 19 nt, Homo sapiens
gaagacagcuccaaugaca

SEQ ID NO: 589910 - RNA, 19 nt, Homo sapiens
ggaagaauguugccuauca

SEQ ID NO: 589911 - RNA, 19 nt, Homo sapiens
gaaaucaggugcugcuuga

SEQ ID NO: 589912 - RNA, 19 nt, Homo sapiens
caauaugccuaguuucuua

SEQ ID NO: 589913 - RNA, 19 nt, Homo sapiens
ggacuuugcugcuuauuug

SEQ ID NO: 589914 - RNA, 19 nt, Homo sapiens
gaaaagaacucaacauaga

SEQ ID NO: 589915 - RNA, 19 nt, Homo sapiens
gaacaacaaucauuagaag

SEQ ID NO: 589916 - RNA, 19 nt, Homo sapiens
caagagagcuacagucguu

SEQ ID NO: 589917 - RNA, 19 nt, Homo sapiens
ggaacugaguggccuauuu

SEQ ID NO: 589918 - RNA, 19 nt, Homo sapiens
gugcagaacuuccagauga

SEQ ID NO: 589919 - RNA, 19 nt, Homo sapiens
gaauuugaccggccucuua

SEQ ID NO: 589920 - RNA, 19 nt, Homo sapiens
caaaguguaugcaguauuc

SEQ ID NO: 589921 - RNA, 19 nt, Homo sapiens
gaugacagcuugugaucuu

SEQ ID NO: 589922 - RNA, 19 nt, Homo sapiens
gaguauagcaugaauguuu

SEQ ID NO: 589923 - RNA, 19 nt, Homo sapiens
ggaagagguuguuggugua

SEQ ID NO: 589924 - RNA, 19 nt, Homo sapiens
gaugguguguucugcaaua

SEQ ID NO: 589925 - RNA, 19 nt, Homo sapiens
gagaagaugcugauuaaug

SEQ ID NO: 589926 - RNA, 19 nt, Homo sapiens
cuagauggcugcagaaaga

SEQ ID NO: 589927 - RNA, 19 nt, Homo sapiens
gaauaacucuuacauacag

SEQ ID NO: 589928 - RNA, 19 nt, Homo sapiens
ggaagaaguuucaaauaac

SEQ ID NO: 589929 - RNA, 19 nt, Homo sapiens
gaaagaacaggcagaaaug

SEQ ID NO: 589930 - RNA, 19 nt, Homo sapiens
ggaacaugaugcaaacaaa

SEQ ID NO: 589931 - RNA, 19 nt, Homo sapiens
gugaauaacucuuacauac

SEQ ID NO: 589932 - RNA, 19 nt, Homo sapiens
ggagaauacuggcaagguu

SEQ ID NO: 589933 - RNA, 19 nt, Homo sapiens
gaacugaaaggaucaacaa

SEQ ID NO: 589934 - RNA, 19 nt, Homo sapiens
uuacagagaugguguguuc

SEQ ID NO: 589935 - RNA, 19 nt, Homo sapiens
caaguuggguucauagaug

SEQ ID NO: 589936 - RNA, 19 nt, Homo sapiens
caagagaaauggucaaugc

SEQ ID NO: 589937 - RNA, 19 nt, Homo sapiens
uuaauaagauggaggagaa

SEQ ID NO: 589938 - RNA, 19 nt, Homo sapiens
ugaaggauauuucuaguca

SEQ ID NO: 589939 - RNA, 19 nt, Homo sapiens
ggugggacauuuacugaaa

SEQ ID NO: 589940 - RNA, 19 nt, Homo sapiens
ggaaacggugggacauuua

SEQ ID NO: 589941 - RNA, 19 nt, Homo sapiens
ggauauuucuagucauuug

SEQ ID NO: 589942 - RNA, 19 nt, Homo sapiens
gaaaaucucugccucugaa

SEQ ID NO: 589943 - RNA, 19 nt, Homo sapiens
gagaauacuggcaagguua

SEQ ID NO: 589944 - RNA, 19 nt, Homo sapiens
aggagaagaugcugauuaa

SEQ ID NO: 589945 - RNA, 19 nt, Homo sapiens
gaacugaguggccuauuuc

SEQ ID NO: 589946 - RNA, 19 nt, Homo sapiens
ggaagaaacaagagagcua

SEQ ID NO: 589947 - RNA, 19 nt, Homo sapiens
gcagaaguugaccaaauua

SEQ ID NO: 589948 - RNA, 19 nt, Homo sapiens
gaguugaaguuuacagaga

SEQ ID NO: 589949 - RNA, 19 nt, Homo sapiens
ggugagcccuugaacauca

SEQ ID NO: 589950 - RNA, 19 nt, Homo sapiens
gaccuagcacuguacauua

SEQ ID NO: 589951 - RNA, 19 nt, Homo sapiens
caauucggauguuuacuga

SEQ ID NO: 589952 - RNA, 19 nt, Homo sapiens
gaauauaagaccacguuga

SEQ ID NO: 589953 - RNA, 19 nt, Homo sapiens
gaagaauuaucggaagaau

SEQ ID NO: 589954 - RNA, 19 nt, Homo sapiens
cauuggagguucugucgua

SEQ ID NO: 589955 - RNA, 19 nt, Homo sapiens
uuacauguaugcucaguau

SEQ ID NO: 589956 - RNA, 19 nt, Homo sapiens
ugaccuugcuaguuuaauu

SEQ ID NO: 589957 - RNA, 19 nt, Homo sapiens
aaauaacuguauccgcuua

SEQ ID NO: 589958 - RNA, 19 nt, Homo sapiens
uaucauaauuggagacaug

SEQ ID NO: 589959 - RNA, 19 nt, Homo sapiens
cauggagugugaggaauua

SEQ ID NO: 589960 - RNA, 19 nt, Homo sapiens
gagaaaagaacucaacaua

SEQ ID NO: 589961 - RNA, 19 nt, Homo sapiens
ucaguggccucuccauuga

SEQ ID NO: 589962 - RNA, 19 nt, Homo sapiens
gcccagacccuuaaaauua

SEQ ID NO: 589963 - RNA, 19 nt, Homo sapiens
guaaaccagcagugcauua

SEQ ID NO: 589964 - RNA, 19 nt, Homo sapiens
gauaucugcugaccgcuau

SEQ ID NO: 589965 - RNA, 19 nt, Homo sapiens
gagaugguguguucugcaa

SEQ ID NO: 589966 - RNA, 19 nt, Homo sapiens
caggagaagaugcugauua

SEQ ID NO: 589967 - RNA, 19 nt, Homo sapiens
gaagaauguugccuaucau

SEQ ID NO: 589968 - RNA, 19 nt, Homo sapiens
gaugaaacaugagguucuu

SEQ ID NO: 589969 - RNA, 19 nt, Homo sapiens
gaugaagauugcuccgauu

SEQ ID NO: 589970 - RNA, 19 nt, Homo sapiens
gaagaacaacaaucauuag

SEQ ID NO: 589971 - RNA, 19 nt, Homo sapiens
agacuucacugcuggagaa

SEQ ID NO: 589972 - RNA, 19 nt, Homo sapiens
agaagaugcugauuaaugg

SEQ ID NO: 589973 - RNA, 19 nt, Homo sapiens
gaacuuguagcaacugaau

SEQ ID NO: 589974 - RNA, 19 nt, Homo sapiens
gcagaguccucgugcagau

SEQ ID NO: 589975 - RNA, 19 nt, Homo sapiens
gaauguugccuaucauaau

SEQ ID NO: 589976 - RNA, 19 nt, Homo sapiens
caaauuacaggcuacaaga

SEQ ID NO: 589977 - RNA, 19 nt, Homo sapiens
guucaacacuggaagaagu

SEQ ID NO: 589978 - RNA, 19 nt, Homo sapiens
gcuauucccuguuccuugu

SEQ ID NO: 589979 - RNA, 19 nt, Homo sapiens
gagaguauagcaugaaugu

SEQ ID NO: 589980 - RNA, 19 nt, Homo sapiens
ccacugaucuaaugaacag

SEQ ID NO: 589981 - RNA, 19 nt, Homo sapiens
gcagauggauuuuaagugu

SEQ ID NO: 589982 - RNA, 19 nt, Homo sapiens
gagguucugucguaucaug

SEQ ID NO: 589983 - RNA, 19 nt, Homo sapiens
ccagaugucaguaaggaua

SEQ ID NO: 589984 - RNA, 19 nt, Homo sapiens
caagggaacaugaugcaaa

SEQ ID NO: 589985 - RNA, 19 nt, Homo sapiens
uuacugaccucaaccuugu

SEQ ID NO: 589986 - RNA, 19 nt, Homo sapiens
cagcuccaaugacaaguuu

SEQ ID NO: 589987 - RNA, 19 nt, Homo sapiens
gaccagugcucaagacucu

SEQ ID NO: 589988 - RNA, 19 nt, Homo sapiens
caugcagaguugaaguuua

SEQ ID NO: 589989 - RNA, 19 nt, Homo sapiens
uaagaggcgaggagaauuu

SEQ ID NO: 589990 - RNA, 19 nt, Homo sapiens
agacaugccuuuaauacag

SEQ ID NO: 589991 - RNA, 19 nt, Homo sapiens
ggagacaugccuuuaauac

SEQ ID NO: 589992 - RNA, 19 nt, Homo sapiens
gauauuucguguacugcaa

SEQ ID NO: 589993 - RNA, 19 nt, Homo sapiens
gcacaacuuuugagaguau

SEQ ID NO: 589994 - RNA, 19 nt, Homo sapiens
gcagaaagaacaggcagaa

SEQ ID NO: 589995 - RNA, 19 nt, Homo sapiens
caacauagaacccacugau

SEQ ID NO: 589996 - RNA, 19 nt, Homo sapiens
agaauuaucggaagaaugu

SEQ ID NO: 589997 - RNA, 19 nt, Homo sapiens
ugcagaaguugaccaaauu

SEQ ID NO: 589998 - RNA, 19 nt, Homo sapiens
ugugaucuuucugcaauua

SEQ ID NO: 589999 - RNA, 19 nt, Homo sapiens
gacuuuagcuucagugacu

SEQ ID NO: 590000 - RNA, 19 nt, Homo sapiens
caaccgaaaugacgaacag

SEQ ID NO: 590001 - RNA, 19 nt, Homo sapiens
gcagugcauuagaaguuug

SEQ ID NO: 590002 - RNA, 19 nt, Homo sapiens
caccgaaucuugcucuugu

SEQ ID NO: 590003 - RNA, 19 nt, Homo sapiens
gugaagacagcuccaauga

SEQ ID NO: 590004 - RNA, 19 nt, Homo sapiens
agaaagaacaggcagaaau

SEQ ID NO: 590005 - RNA, 19 nt, Homo sapiens
gcuugaccuugcuaguuua

SEQ ID NO: 590006 - RNA, 19 nt, Homo sapiens
guaugccaauuaagaauca

SEQ ID NO: 590007 - RNA, 19 nt, Homo sapiens
gcacauugauaaaagcauu

SEQ ID NO: 590008 - RNA, 19 nt, Homo sapiens
gaccagugccugaugauuc

SEQ ID NO: 590009 - RNA, 19 nt, Homo sapiens
gaagacagcuccaaugaca

SEQ ID NO: 590010 - RNA, 19 nt, Homo sapiens
ggaagaauguugccuauca

SEQ ID NO: 590011 - RNA, 19 nt, Homo sapiens
gaaaucaggugcugcuuga

SEQ ID NO: 590012 - RNA, 19 nt, Homo sapiens
caauaugccuaguuucuua

SEQ ID NO: 590013 - RNA, 19 nt, Homo sapiens
ggacuuugcugcuuauuug

SEQ ID NO: 590014 - RNA, 19 nt, Homo sapiens
gaaaagaacucaacauaga

SEQ ID NO: 590015 - RNA, 19 nt, Homo sapiens
gaacaacaaucauuagaag

SEQ ID NO: 590016 - RNA, 19 nt, Homo sapiens
caagagagcuacagucguu

SEQ ID NO: 590017 - RNA, 19 nt, Homo sapiens
ggaacugaguggccuauuu

SEQ ID NO: 590018 - RNA, 19 nt, Homo sapiens
gugcagaacuuccagauga

SEQ ID NO: 590019 - RNA, 19 nt, Homo sapiens
gaauuugaccggccucuua

SEQ ID NO: 590020 - RNA, 19 nt, Homo sapiens
caaaguguaugcaguauuc

SEQ ID NO: 590021 - RNA, 19 nt, Homo sapiens
gaugacagcuugugaucuu

SEQ ID NO: 590022 - RNA, 19 nt, Homo sapiens
gaguauagcaugaauguuu

SEQ ID NO: 590023 - RNA, 19 nt, Homo sapiens
ggaagagguuguuggugua

SEQ ID NO: 590024 - RNA, 19 nt, Homo sapiens
gaugguguguucugcaaua

SEQ ID NO: 590025 - RNA, 19 nt, Homo sapiens
gagaagaugcugauuaaug

SEQ ID NO: 590026 - RNA, 19 nt, Homo sapiens
cuagauggcugcagaaaga

SEQ ID NO: 590027 - RNA, 19 nt, Homo sapiens
gaauaacucuuacauacag

SEQ ID NO: 590028 - RNA, 19 nt, Homo sapiens
ggaagaaguuucaaauaac

SEQ ID NO: 590029 - RNA, 19 nt, Homo sapiens
gaaagaacaggcagaaaug

SEQ ID NO: 590030 - RNA, 19 nt, Homo sapiens
ggaacaugaugcaaacaaa

SEQ ID NO: 590031 - RNA, 19 nt, Homo sapiens
gugaauaacucuuacauac

SEQ ID NO: 590032 - RNA, 19 nt, Homo sapiens
ggagaauacuggcaagguu

SEQ ID NO: 590033 - RNA, 19 nt, Homo sapiens
gaacugaaaggaucaacaa

SEQ ID NO: 590034 - RNA, 19 nt, Homo sapiens
uuacagagaugguguguuc

SEQ ID NO: 590035 - RNA, 19 nt, Homo sapiens
caaguuggguucauagaug

SEQ ID NO: 590036 - RNA, 19 nt, Homo sapiens
uuaauaagauggaggagaa

SEQ ID NO: 590037 - RNA, 19 nt, Homo sapiens
ugaaggauauuucuaguca

SEQ ID NO: 590038 - RNA, 19 nt, Homo sapiens
gacgaucacugggacuuua

SEQ ID NO: 590039 - RNA, 19 nt, Homo sapiens
ggugggacauuuacugaaa

SEQ ID NO: 590040 - RNA, 19 nt, Homo sapiens
ggaaacggugggacauuua

SEQ ID NO: 590041 - RNA, 19 nt, Homo sapiens
ggauauuucuagucauuug

SEQ ID NO: 590042 - RNA, 19 nt, Homo sapiens
gaaaaucucugccucugaa

SEQ ID NO: 590043 - RNA, 19 nt, Homo sapiens
ggagagaguucugucguau

SEQ ID NO: 590044 - RNA, 19 nt, Homo sapiens
gagaauacuggcaagguua

SEQ ID NO: 590045 - RNA, 19 nt, Homo sapiens
aggagaagaugcugauuaa

SEQ ID NO: 590046 - RNA, 19 nt, Homo sapiens
gaacugaguggccuauuuc

SEQ ID NO: 590047 - RNA, 19 nt, Homo sapiens
ggaagaaacaagagagcua

SEQ ID NO: 590048 - RNA, 19 nt, Homo sapiens
gcagaaguugaccaaauua

SEQ ID NO: 590049 - RNA, 19 nt, Homo sapiens
gaguugaaguuuacagaga

SEQ ID NO: 590050 - RNA, 19 nt, Homo sapiens
ggugagcccuugaacauca

SEQ ID NO: 590051 - RNA, 19 nt, Homo sapiens
gaccuagcacuguacauua

SEQ ID NO: 590052 - RNA, 19 nt, Homo sapiens
caauucggauguuuacuga

SEQ ID NO: 590053 - RNA, 19 nt, Homo sapiens
gaauauaagaccacguuga

SEQ ID NO: 590054 - RNA, 19 nt, Homo sapiens
gaagaauuaucggaagaau

SEQ ID NO: 590055 - RNA, 19 nt, Homo sapiens
uuacauguaugcucaguau

SEQ ID NO: 590056 - RNA, 19 nt, Homo sapiens
ugaccuugcuaguuuaauu

SEQ ID NO: 590057 - RNA, 19 nt, Homo sapiens
aaauaacuguauccgcuua

SEQ ID NO: 590058 - RNA, 19 nt, Homo sapiens
aagcauggcuggacgauca

SEQ ID NO: 590059 - RNA, 19 nt, Homo sapiens
uaucauaauuggagacaug

SEQ ID NO: 590060 - RNA, 19 nt, Homo sapiens
cauggagugugaggaauua

SEQ ID NO: 590061 - RNA, 19 nt, Homo sapiens
gagaaaagaacucaacaua

SEQ ID NO: 590062 - RNA, 19 nt, Homo sapiens
ucaguggccucuccauuga

SEQ ID NO: 590063 - RNA, 19 nt, Homo sapiens
ccagagaaauggucaaugc

SEQ ID NO: 590064 - RNA, 19 nt, Homo sapiens
gcccagacccuuaaaauua

SEQ ID NO: 590065 - RNA, 19 nt, Homo sapiens
guaaaccagcagugcauua

SEQ ID NO: 590066 - RNA, 19 nt, Homo sapiens
gauaucugcugaccgcuau

SEQ ID NO: 590067 - RNA, 19 nt, Homo sapiens
gagaugguguguucugcaa

SEQ ID NO: 590068 - RNA, 19 nt, Homo sapiens
caggagaagaugcugauua

SEQ ID NO: 590069 - RNA, 19 nt, Homo sapiens
gaagaauguugccuaucau

SEQ ID NO: 590070 - RNA, 19 nt, Homo sapiens
gaugaaacaugagguucuu

SEQ ID NO: 590071 - RNA, 19 nt, Homo sapiens
gaugaagauugcuccgauu

SEQ ID NO: 590072 - RNA, 19 nt, Homo sapiens
gaagaacaacaaucauuag

SEQ ID NO: 590073 - RNA, 19 nt, Homo sapiens
agacuucacugcuggagaa

SEQ ID NO: 590074 - RNA, 19 nt, Homo sapiens
agaagaugcugauuaaugg

SEQ ID NO: 590075 - RNA, 19 nt, Homo sapiens
gaacuuguagcaacugaau

SEQ ID NO: 590076 - RNA, 19 nt, Homo sapiens
gaauguugccuaucauaau

SEQ ID NO: 590077 - RNA, 19 nt, Homo sapiens
caaauuacaggcuacaaga

SEQ ID NO: 590078 - RNA, 19 nt, Homo sapiens
guucaacacuggaagaagu

SEQ ID NO: 590079 - RNA, 19 nt, Homo sapiens
gcuauucccuguuccuugu

SEQ ID NO: 590080 - RNA, 19 nt, Homo sapiens
gcagaguccucgugcagau

SEQ ID NO: 590081 - RNA, 19 nt, Homo sapiens
gagaguauagcaugaaugu

SEQ ID NO: 590082 - RNA, 19 nt, Homo sapiens
ccacugaucuaaugaacag

SEQ ID NO: 590083 - RNA, 19 nt, Homo sapiens
gcagauggauuuuaagugu

SEQ ID NO: 590084 - RNA, 19 nt, Homo sapiens
ccagaugucaguaaggaua

SEQ ID NO: 590085 - RNA, 19 nt, Homo sapiens
caagggaacaugaugcaaa

SEQ ID NO: 590086 - RNA, 19 nt, Homo sapiens
uuacugaccucaaccuugu

SEQ ID NO: 590087 - RNA, 19 nt, Homo sapiens
cagcuccaaugacaaguuu

SEQ ID NO: 590088 - RNA, 19 nt, Homo sapiens
gaccagugcucaagacucu

SEQ ID NO: 590089 - RNA, 19 nt, Homo sapiens
caugcagaguugaaguuua

SEQ ID NO: 590090 - RNA, 19 nt, Homo sapiens
uaagaggcgaggagaauuu

SEQ ID NO: 590091 - RNA, 19 nt, Homo sapiens
agacaugccuuuaauacag

SEQ ID NO: 590092 - RNA, 19 nt, Homo sapiens
ggagacaugccuuuaauac

SEQ ID NO: 590093 - RNA, 19 nt, Homo sapiens
ugacugaccuggagauacu

SEQ ID NO: 590094 - RNA, 19 nt, Homo sapiens
agagaguucugucguauca

SEQ ID NO: 590095 - RNA, 19 nt, Homo sapiens
gauauuucguguacugcaa

SEQ ID NO: 590096 - RNA, 19 nt, Homo sapiens
gcacaacuuuugagaguau

SEQ ID NO: 590097 - RNA, 19 nt, Homo sapiens
gcagaaagaacaggcagaa

SEQ ID NO: 590098 - RNA, 19 nt, Homo sapiens
caacauagaacccacugau

SEQ ID NO: 590099 - RNA, 19 nt, Homo sapiens
agaauuaucggaagaaugu

SEQ ID NO: 590100 - RNA, 19 nt, Homo sapiens
ugcagaaguugaccaaauu

SEQ ID NO: 590101 - RNA, 19 nt, Homo sapiens
caccgaaucuugcucuugu

SEQ ID NO: 590102 - RNA, 19 nt, Homo sapiens
ugugaucuuucugcaauua

SEQ ID NO: 590103 - RNA, 19 nt, Homo sapiens
gacuuuagcuucagugacu

SEQ ID NO: 590104 - RNA, 19 nt, Homo sapiens
caaccgaaaugacgaacag

SEQ ID NO: 590105 - RNA, 19 nt, Homo sapiens
gcagugcauuagaaguuug

SEQ ID NO: 590106 - RNA, 19 nt, Homo sapiens
gugaagacagcuccaauga

SEQ ID NO: 590107 - RNA, 19 nt, Homo sapiens
agaaagaacaggcagaaau

SEQ ID NO: 590108 - RNA, 19 nt, Homo sapiens
gcuugaccuugcuaguuua

SEQ ID NO: 590109 - RNA, 19 nt, Homo sapiens
gaagacagcuccaaugaca

SEQ ID NO: 590110 - RNA, 19 nt, Homo sapiens
ggaagaauguugccuauca

SEQ ID NO: 590111 - RNA, 19 nt, Homo sapiens
gaaaucaggugcugcuuga

SEQ ID NO: 590112 - RNA, 19 nt, Homo sapiens
caauaugccuaguuucuua

SEQ ID NO: 590113 - RNA, 19 nt, Homo sapiens
ggacuuugcugcuuauuug

SEQ ID NO: 590114 - RNA, 19 nt, Homo sapiens
gaaaagaacucaacauaga

SEQ ID NO: 590115 - RNA, 19 nt, Homo sapiens
gaacaacaaucauuagaag

SEQ ID NO: 590116 - RNA, 19 nt, Homo sapiens
caagagagcuacagucguu

SEQ ID NO: 590117 - RNA, 19 nt, Homo sapiens
ggaacugaguggccuauuu

SEQ ID NO: 590118 - RNA, 19 nt, Homo sapiens
gugcagaacuuccagauga

SEQ ID NO: 590119 - RNA, 19 nt, Homo sapiens
gaauuugaccggccucuua

SEQ ID NO: 590120 - RNA, 19 nt, Homo sapiens
caaaguguaugcaguauuc

SEQ ID NO: 590121 - RNA, 19 nt, Homo sapiens
gaugacagcuugugaucuu

SEQ ID NO: 590122 - RNA, 19 nt, Homo sapiens
gaguauagcaugaauguuu

SEQ ID NO: 590123 - RNA, 19 nt, Homo sapiens
ggaagagguuguuggugua

SEQ ID NO: 590124 - RNA, 19 nt, Homo sapiens
gaugguguguucugcaaua

SEQ ID NO: 590125 - RNA, 19 nt, Homo sapiens
gagaagaugcugauuaaug

SEQ ID NO: 590126 - RNA, 19 nt, Homo sapiens
cuagauggcugcagaaaga

SEQ ID NO: 590127 - RNA, 19 nt, Homo sapiens
gaauaacucuuacauacag

SEQ ID NO: 590128 - RNA, 19 nt, Homo sapiens
ggaagaaguuucaaauaac

SEQ ID NO: 590129 - RNA, 19 nt, Homo sapiens
gaaagaacaggcagaaaug

SEQ ID NO: 590130 - RNA, 19 nt, Homo sapiens
ggaacaugaugcaaacaaa

SEQ ID NO: 590131 - RNA, 19 nt, Homo sapiens
gugaauaacucuuacauac

SEQ ID NO: 590132 - RNA, 19 nt, Homo sapiens
ggagaauacuggcaagguu

SEQ ID NO: 590133 - RNA, 19 nt, Homo sapiens
gaacugaaaggaucaacaa

SEQ ID NO: 590134 - RNA, 19 nt, Homo sapiens
uuacagagaugguguguuc

SEQ ID NO: 590135 - RNA, 19 nt, Homo sapiens
caaguuggguucauagaug

SEQ ID NO: 590136 - RNA, 19 nt, Homo sapiens
uuaauaagauggaggagaa

SEQ ID NO: 590137 - RNA, 19 nt, Homo sapiens
ugaaggauauuucuaguca

SEQ ID NO: 590138 - RNA, 19 nt, Homo sapiens
ggugggacauuuacugaaa

SEQ ID NO: 590139 - RNA, 19 nt, Homo sapiens
ggaaacggugggacauuua

SEQ ID NO: 590140 - RNA, 19 nt, Homo sapiens
ggauauuucuagucauuug

SEQ ID NO: 590141 - RNA, 19 nt, Homo sapiens
gaaaaucucugccucugaa

SEQ ID NO: 590142 - RNA, 19 nt, Homo sapiens
gagaauacuggcaagguua

SEQ ID NO: 590143 - RNA, 19 nt, Homo sapiens
aggagaagaugcugauuaa

SEQ ID NO: 590144 - RNA, 19 nt, Homo sapiens
gaacugaguggccuauuuc

SEQ ID NO: 590145 - RNA, 19 nt, Homo sapiens
ggaagaaacaagagagcua

SEQ ID NO: 590146 - RNA, 19 nt, Homo sapiens
gcagaaguugaccaaauua

SEQ ID NO: 590147 - RNA, 19 nt, Homo sapiens
gaguugaaguuuacagaga

SEQ ID NO: 590148 - RNA, 19 nt, Homo sapiens
ggugagcccuugaacauca

SEQ ID NO: 590149 - RNA, 19 nt, Homo sapiens
gaccuagcacuguacauua

SEQ ID NO: 590150 - RNA, 19 nt, Homo sapiens
caauucggauguuuacuga

SEQ ID NO: 590151 - RNA, 19 nt, Homo sapiens
gaauauaagaccacguuga

SEQ ID NO: 590152 - RNA, 19 nt, Homo sapiens
gaagaauuaucggaagaau

SEQ ID NO: 590153 - RNA, 19 nt, Homo sapiens
cauuggagguucugucgua

SEQ ID NO: 590154 - RNA, 19 nt, Homo sapiens
uuacauguaugcucaguau

SEQ ID NO: 590155 - RNA, 19 nt, Homo sapiens
ugaccuugcuaguuuaauu

SEQ ID NO: 590156 - RNA, 19 nt, Homo sapiens
aaauaacuguauccgcuua

SEQ ID NO: 590157 - RNA, 19 nt, Homo sapiens
uaucauaauuggagacaug

SEQ ID NO: 590158 - RNA, 19 nt, Homo sapiens
cauggagugugaggaauua

SEQ ID NO: 590159 - RNA, 19 nt, Homo sapiens
gagaaaagaacucaacaua

SEQ ID NO: 590160 - RNA, 19 nt, Homo sapiens
ucaguggccucuccauuga

SEQ ID NO: 590161 - RNA, 19 nt, Homo sapiens
gcccagacccuuaaaauua

SEQ ID NO: 590162 - RNA, 19 nt, Homo sapiens
guaaaccagcagugcauua

SEQ ID NO: 590163 - RNA, 19 nt, Homo sapiens
gauaucugcugaccgcuau

SEQ ID NO: 590164 - RNA, 19 nt, Homo sapiens
gagaugguguguucugcaa

SEQ ID NO: 590165 - RNA, 19 nt, Homo sapiens
caggagaagaugcugauua

SEQ ID NO: 590166 - RNA, 19 nt, Homo sapiens
gaagaauguugccuaucau

SEQ ID NO: 590167 - RNA, 19 nt, Homo sapiens
gaugaaacaugagguucuu

SEQ ID NO: 590168 - RNA, 19 nt, Homo sapiens
gaugaagauugcuccgauu

SEQ ID NO: 590169 - RNA, 19 nt, Homo sapiens
gaagaacaacaaucauuag

SEQ ID NO: 590170 - RNA, 19 nt, Homo sapiens
agacuucacugcuggagaa

SEQ ID NO: 590171 - RNA, 19 nt, Homo sapiens
agaagaugcugauuaaugg

SEQ ID NO: 590172 - RNA, 19 nt, Homo sapiens
gaacuuguagcaacugaau

SEQ ID NO: 590173 - RNA, 19 nt, Homo sapiens
gaauguugccuaucauaau

SEQ ID NO: 590174 - RNA, 19 nt, Homo sapiens
gcagaguccucgugcagau

SEQ ID NO: 590175 - RNA, 19 nt, Homo sapiens
caaauuacaggcuacaaga

SEQ ID NO: 590176 - RNA, 19 nt, Homo sapiens
guucaacacuggaagaagu

SEQ ID NO: 590177 - RNA, 19 nt, Homo sapiens
gcuauucccuguuccuugu

SEQ ID NO: 590178 - RNA, 19 nt, Homo sapiens
gagaguauagcaugaaugu

SEQ ID NO: 590179 - RNA, 19 nt, Homo sapiens
ccacugaucuaaugaacag

SEQ ID NO: 590180 - RNA, 19 nt, Homo sapiens
gcagauggauuuuaagugu

SEQ ID NO: 590181 - RNA, 19 nt, Homo sapiens
gagguucugucguaucaug

SEQ ID NO: 590182 - RNA, 19 nt, Homo sapiens
ccagaugucaguaaggaua

SEQ ID NO: 590183 - RNA, 19 nt, Homo sapiens
caagggaacaugaugcaaa

SEQ ID NO: 590184 - RNA, 19 nt, Homo sapiens
uuacugaccucaaccuugu

SEQ ID NO: 590185 - RNA, 19 nt, Homo sapiens
cagcuccaaugacaaguuu

SEQ ID NO: 590186 - RNA, 19 nt, Homo sapiens
gaccagugcucaagacucu

SEQ ID NO: 590187 - RNA, 19 nt, Homo sapiens
caugcagaguugaaguuua

SEQ ID NO: 590188 - RNA, 19 nt, Homo sapiens
uaagaggcgaggagaauuu

SEQ ID NO: 590189 - RNA, 19 nt, Homo sapiens
agacaugccuuuaauacag

SEQ ID NO: 590190 - RNA, 19 nt, Homo sapiens
ggagacaugccuuuaauac

SEQ ID NO: 590191 - RNA, 19 nt, Homo sapiens
ugacugaccuggagauacu

SEQ ID NO: 590192 - RNA, 19 nt, Homo sapiens
gauauuucguguacugcaa

SEQ ID NO: 590193 - RNA, 19 nt, Homo sapiens
gcacaacuuuugagaguau

SEQ ID NO: 590194 - RNA, 19 nt, Homo sapiens
gcagaaagaacaggcagaa

SEQ ID NO: 590195 - RNA, 19 nt, Homo sapiens
caacauagaacccacugau

SEQ ID NO: 590196 - RNA, 19 nt, Homo sapiens
agaauuaucggaagaaugu

SEQ ID NO: 590197 - RNA, 19 nt, Homo sapiens
ugcagaaguugaccaaauu

SEQ ID NO: 590198 - RNA, 19 nt, Homo sapiens
caaaagaaauggucaaugc

SEQ ID NO: 590199 - RNA, 19 nt, Homo sapiens
caccgaaucuugcucuugu

SEQ ID NO: 590200 - RNA, 19 nt, Homo sapiens
ugugaucuuucugcaauua

SEQ ID NO: 590201 - RNA, 19 nt, Homo sapiens
gacuuuagcuucagugacu

SEQ ID NO: 590202 - RNA, 19 nt, Homo sapiens
caaccgaaaugacgaacag

SEQ ID NO: 590203 - RNA, 19 nt, Homo sapiens
gcagugcauuagaaguuug

SEQ ID NO: 590204 - RNA, 19 nt, Homo sapiens
gugaagacagcuccaauga

SEQ ID NO: 590205 - RNA, 19 nt, Homo sapiens
agaaagaacaggcagaaau

SEQ ID NO: 590206 - RNA, 19 nt, Homo sapiens
gcuugaccuugcuaguuua

SEQ ID NO: 590207 - RNA, 19 nt, Homo sapiens
guaugccaauuaagaauca

SEQ ID NO: 590208 - RNA, 19 nt, Homo sapiens
gcacauugauaaaagcauu

SEQ ID NO: 590209 - RNA, 19 nt, Homo sapiens
gaaggaauuugacaagaag

SEQ ID NO: 590210 - RNA, 19 nt, Homo sapiens
cagaauagccuacauuugu

SEQ ID NO: 590211 - RNA, 19 nt, Homo sapiens
ggcauucucuguacuaguu

SEQ ID NO: 590212 - RNA, 19 nt, Homo sapiens
ccaaacacuucaucuacuu

SEQ ID NO: 590213 - RNA, 19 nt, Homo sapiens
agaaggaauuugacaagaa

SEQ ID NO: 590214 - RNA, 19 nt, Homo sapiens
ggacaugucggaagagaug

SEQ ID NO: 590215 - RNA, 19 nt, Homo sapiens
guacuaguuugucgugguu

SEQ ID NO: 590216 - RNA, 19 nt, Homo sapiens
caacauagagaaggacauu

SEQ ID NO: 590217 - RNA, 19 nt, Homo sapiens
aacaaggacugcagccuaa

SEQ ID NO: 590218 - RNA, 19 nt, Homo sapiens
gcagaauagccuacauuug

SEQ ID NO: 590219 - RNA, 19 nt, Homo sapiens
ggacauugcggcucauauc

SEQ ID NO: 590220 - RNA, 19 nt, Homo sapiens
ccagugauccauccagaaa

SEQ ID NO: 590221 - RNA, 19 nt, Homo sapiens
guucaaaucugguuaaaag

SEQ ID NO: 590222 - RNA, 19 nt, Homo sapiens
aaaccaaacacuucaucua

SEQ ID NO: 590223 - RNA, 19 nt, Homo sapiens
ggccugagcugugcuagca

SEQ ID NO: 590224 - RNA, 19 nt, Homo sapiens
caagaaggaauuugacaag

SEQ ID NO: 590225 - RNA, 19 nt, Homo sapiens
gcucauaucaagaaggaau

SEQ ID NO: 590226 - RNA, 19 nt, Homo sapiens
gaaccuuuguuguguuuug

SEQ ID NO: 590227 - RNA, 19 nt, Homo sapiens
cggcucauaucaagaagga

SEQ ID NO: 590228 - RNA, 19 nt, Homo sapiens
ccgaaaggccgugaucaaa

SEQ ID NO: 590229 - RNA, 19 nt, Homo sapiens
aagaaggaauuugacaaga

SEQ ID NO: 590230 - RNA, 19 nt, Homo sapiens
caaguggccauucuucugu

SEQ ID NO: 590231 - RNA, 19 nt, Homo sapiens
gauguuugaaccuuuguug

SEQ ID NO: 590232 - RNA, 19 nt, Homo sapiens
gcggacaugucggaagaga

SEQ ID NO: 590233 - RNA, 19 nt, Homo sapiens
guuugaaccuuuguugugu

SEQ ID NO: 590234 - RNA, 19 nt, Homo sapiens
gaaaccaaacacuucaucu

SEQ ID NO: 590235 - RNA, 19 nt, Homo sapiens
ccauacuucugcccacguu

SEQ ID NO: 590236 - RNA, 19 nt, Homo sapiens
uagcagaauagccuacauu

SEQ ID NO: 590237 - RNA, 19 nt, Homo sapiens
ucucgauguuugaaccuuu

SEQ ID NO: 590238 - RNA, 19 nt, Homo sapiens
gcuaagggaacaucucgau

SEQ ID NO: 590239 - RNA, 19 nt, Homo sapiens
gcagccuaaauuccaaaua

SEQ ID NO: 590240 - RNA, 19 nt, Homo sapiens
ccauucuucuguucaaauc

SEQ ID NO: 590241 - RNA, 19 nt, Homo sapiens
uugaaccuuuguuguguuu

SEQ ID NO: 590242 - RNA, 19 nt, Homo sapiens
ccaaguggccauucuucug

SEQ ID NO: 590243 - RNA, 19 nt, Homo sapiens
cuacucaggcgcuggagaa

SEQ ID NO: 590244 - RNA, 19 nt, Homo sapiens
caaggacugcagccuaaau

SEQ ID NO: 590245 - RNA, 19 nt, Homo sapiens
gacauugcggcucauauca

SEQ ID NO: 590246 - RNA, 19 nt, Homo sapiens
cauugcggcucauaucaag

SEQ ID NO: 590247 - RNA, 19 nt, Homo sapiens
gaauuugacaagaaguaca

SEQ ID NO: 590248 - RNA, 19 nt, Homo sapiens
agugauccauccagaaaca

SEQ ID NO: 590249 - RNA, 19 nt, Homo sapiens
ggccauucuucuguucaaa

SEQ ID NO: 590250 - RNA, 19 nt, Homo sapiens
cacaugaaaccaaacacuu

SEQ ID NO: 590251 - RNA, 19 nt, Homo sapiens
cgaaaggccgugaucaaaa

SEQ ID NO: 590252 - RNA, 19 nt, Homo sapiens
ggacugcagccuaaauucc

SEQ ID NO: 590253 - RNA, 19 nt, Homo sapiens
acaugaaaccaaacacuuc

SEQ ID NO: 590254 - RNA, 19 nt, Homo sapiens
ugacacaugaaaccaaaca

SEQ ID NO: 590255 - RNA, 19 nt, Homo sapiens
caaacacuucaucuacuuc

SEQ ID NO: 590256 - RNA, 19 nt, Homo sapiens
augcggacaugucggaaga

SEQ ID NO: 590257 - RNA, 19 nt, Homo sapiens
gaaggacauugcggcucau

SEQ ID NO: 590258 - RNA, 19 nt, Homo sapiens
ggaauuugacaagaaguac

SEQ ID NO: 590259 - RNA, 19 nt, Homo sapiens
uaguuugucgugguuauaa

SEQ ID NO: 590260 - RNA, 19 nt, Homo sapiens
cagggcauucucuguacua

SEQ ID NO: 590261 - RNA, 19 nt, Homo sapiens
uacaaucccaccuggcauu

SEQ ID NO: 590262 - RNA, 19 nt, Homo sapiens
gaaauaagcuguuugucuu

SEQ ID NO: 590263 - RNA, 19 nt, Homo sapiens
ggacaagggugguuuaauu

SEQ ID NO: 590264 - RNA, 19 nt, Homo sapiens
gaacagagauggaaauaca

SEQ ID NO: 590265 - RNA, 19 nt, Homo sapiens
cagaguaucuuaucacuua

SEQ ID NO: 590266 - RNA, 19 nt, Homo sapiens
ggaaguagcugaauaucuu

SEQ ID NO: 590267 - RNA, 19 nt, Homo sapiens
gcaugaagcugcuauuaaa

SEQ ID NO: 590268 - RNA, 19 nt, Homo sapiens
caacagaguucgaauaguu

SEQ ID NO: 590269 - RNA, 19 nt, Homo sapiens
ucacagaacugcuacuaaa

SEQ ID NO: 590270 - RNA, 19 nt, Homo sapiens
guaaacaagugacagaauu

SEQ ID NO: 590271 - RNA, 19 nt, Homo sapiens
ccaaggagcugauccaaau

SEQ ID NO: 590272 - RNA, 19 nt, Homo sapiens
ggacaggucaugcuauaua

SEQ ID NO: 590273 - RNA, 19 nt, Homo sapiens
gcauggagcugauguuaau

SEQ ID NO: 590274 - RNA, 19 nt, Homo sapiens
gcauggagcuuguguuaau

SEQ ID NO: 590275 - RNA, 19 nt, Homo sapiens
caaccucacuggcccuuua

SEQ ID NO: 590276 - RNA, 19 nt, Homo sapiens
cauagcggcuuuauugaua

SEQ ID NO: 590277 - RNA, 19 nt, Homo sapiens
gaagaucgaugugugcauu

SEQ ID NO: 590278 - RNA, 19 nt, Homo sapiens
gaagagaugcaaaguacua

SEQ ID NO: 590279 - RNA, 19 nt, Homo sapiens
ugacauagcggcuuuauug

SEQ ID NO: 590280 - RNA, 19 nt, Homo sapiens
ggaaauacaccuuuggauu

SEQ ID NO: 590281 - RNA, 19 nt, Homo sapiens
gcaaaguacuauucgagaa

SEQ ID NO: 590282 - RNA, 19 nt, Homo sapiens
gcacggagcugacccaaac

SEQ ID NO: 590283 - RNA, 19 nt, Homo sapiens
gaagaagagaugcaaagua

SEQ ID NO: 590284 - RNA, 19 nt, Homo sapiens
caagaaagacgaacuccua

SEQ ID NO: 590285 - RNA, 19 nt, Homo sapiens
gguaccagcuguugcagua

SEQ ID NO: 590286 - RNA, 19 nt, Homo sapiens
guagaagucugcucuuugu

SEQ ID NO: 590287 - RNA, 19 nt, Homo sapiens
gaaagacgaacuccuagaa

SEQ ID NO: 590288 - RNA, 19 nt, Homo sapiens
ggaaggagacacagauauu

SEQ ID NO: 590289 - RNA, 19 nt, Homo sapiens
ggacuugugccucuucaua

SEQ ID NO: 590290 - RNA, 19 nt, Homo sapiens
gacaaaugcucuucuguag

SEQ ID NO: 590291 - RNA, 19 nt, Homo sapiens
caaccaauauguuuaugga

SEQ ID NO: 590292 - RNA, 19 nt, Homo sapiens
cgaaagagcccauaaugau

SEQ ID NO: 590293 - RNA, 19 nt, Homo sapiens
gaacagauuacacuagaug

SEQ ID NO: 590294 - RNA, 19 nt, Homo sapiens
gagaguacaccuauacgua

SEQ ID NO: 590295 - RNA, 19 nt, Homo sapiens
guacuucugauguugauua

SEQ ID NO: 590296 - RNA, 19 nt, Homo sapiens
gugacagaauuguuacuua

SEQ ID NO: 590297 - RNA, 19 nt, Homo sapiens
gaacaggcauacccagagu

SEQ ID NO: 590298 - RNA, 19 nt, Homo sapiens
ggaagugucugaggagaau

SEQ ID NO: 590299 - RNA, 19 nt, Homo sapiens
gaaagagcccauaaugaug

SEQ ID NO: 590300 - RNA, 19 nt, Homo sapiens
gcacuucgcugcagguuuu

SEQ ID NO: 590301 - RNA, 19 nt, Homo sapiens
cagaacagauuacacuaga

SEQ ID NO: 590302 - RNA, 19 nt, Homo sapiens
acacagagauggugguaau

SEQ ID NO: 590303 - RNA, 19 nt, Homo sapiens
caugaagaguugaaagaaa

SEQ ID NO: 590304 - RNA, 19 nt, Homo sapiens
ggauaucuuugaaacagaa

SEQ ID NO: 590305 - RNA, 19 nt, Homo sapiens
gaauaucagccaauuucua

SEQ ID NO: 590306 - RNA, 19 nt, Homo sapiens
agggauaacuggaacuaua

SEQ ID NO: 590307 - RNA, 19 nt, Homo sapiens
uacagaggauuguuucuaa

SEQ ID NO: 590308 - RNA, 19 nt, Homo sapiens
ugagcgacaugcauacaua

SEQ ID NO: 590309 - RNA, 19 nt, Homo sapiens
gagcauggagcugauguua

SEQ ID NO: 590310 - RNA, 19 nt, Homo sapiens
ucauggaaguucugcauaa

SEQ ID NO: 590311 - RNA, 19 nt, Homo sapiens
caaccgcagucucaugaaa

SEQ ID NO: 590312 - RNA, 19 nt, Homo sapiens
gggagagauugacuuauga

SEQ ID NO: 590313 - RNA, 19 nt, Homo sapiens
ggcaacagcugacgauauc

SEQ ID NO: 590314 - RNA, 19 nt, Homo sapiens
acacagauauucaggacuu

SEQ ID NO: 590315 - RNA, 19 nt, Homo sapiens
gcggacuuauggaaauuua

SEQ ID NO: 590316 - RNA, 19 nt, Homo sapiens
cagcacagaugggcaauga

SEQ ID NO: 590317 - RNA, 19 nt, Homo sapiens
acagauaagugggcguuua

SEQ ID NO: 590318 - RNA, 19 nt, Homo sapiens
ggucucaucccgcuucaua

SEQ ID NO: 590319 - RNA, 19 nt, Homo sapiens
gaaggaaggauguuguaga

SEQ ID NO: 590320 - RNA, 19 nt, Homo sapiens
gaaagaaauaggcaucaau

SEQ ID NO: 590321 - RNA, 19 nt, Homo sapiens
ugacagaauuguuacuuag

SEQ ID NO: 590322 - RNA, 19 nt, Homo sapiens
gaagcagacuuagcuaaag

SEQ ID NO: 590323 - RNA, 19 nt, Homo sapiens
caagaaccguguagaaguc

SEQ ID NO: 590324 - RNA, 19 nt, Homo sapiens
ucaaugggcuggcauaugc

SEQ ID NO: 590325 - RNA, 19 nt, Homo sapiens
gaacacagagaugguggua

SEQ ID NO: 590326 - RNA, 19 nt, Homo sapiens
aagaagagaugcaaaguac

SEQ ID NO: 590327 - RNA, 19 nt, Homo sapiens
gugcugauguucaugcaaa

SEQ ID NO: 590328 - RNA, 19 nt, Homo sapiens
cagaagaccuagugaaugc

SEQ ID NO: 590329 - RNA, 19 nt, Homo sapiens
aaggacaggucaugcuaua

SEQ ID NO: 590330 - RNA, 19 nt, Homo sapiens
gaagucugcucuuuguuac

SEQ ID NO: 590331 - RNA, 19 nt, Homo sapiens
aaggaaggauguuguagaa

SEQ ID NO: 590332 - RNA, 19 nt, Homo sapiens
gacaggucaugcuauauau

SEQ ID NO: 590333 - RNA, 19 nt, Homo sapiens
gaaaguaugaaaucugcaa

SEQ ID NO: 590334 - RNA, 19 nt, Homo sapiens
agaagucugcucuuuguua

SEQ ID NO: 590335 - RNA, 19 nt, Homo sapiens
cagaggauuguuucuaaua

SEQ ID NO: 590336 - RNA, 19 nt, Homo sapiens
gugaaugccugcuggugaa

SEQ ID NO: 590337 - RNA, 19 nt, Homo sapiens
agacaaaugcucuucugua

SEQ ID NO: 590338 - RNA, 19 nt, Homo sapiens
gggcaccgccacaaauuaa

SEQ ID NO: 590339 - RNA, 19 nt, Homo sapiens
gagaagcagacuuagcuaa

SEQ ID NO: 590340 - RNA, 19 nt, Homo sapiens
cuagauguguuggcugaua

SEQ ID NO: 590341 - RNA, 19 nt, Homo sapiens
aaacuaauggcuuuacuga

SEQ ID NO: 590342 - RNA, 19 nt, Homo sapiens
gaaacugugaagcaacuuu

SEQ ID NO: 590343 - RNA, 19 nt, Homo sapiens
gagcuuagggagagauuga

SEQ ID NO: 590344 - RNA, 19 nt, Homo sapiens
gggcgaaagucgacuccuu

SEQ ID NO: 590345 - RNA, 19 nt, Homo sapiens
cggcaaacguaaaugcaaa

SEQ ID NO: 590346 - RNA, 19 nt, Homo sapiens
gcagaagaccuagugaaug

SEQ ID NO: 590347 - RNA, 19 nt, Homo sapiens
gggcaccacucagucauug

SEQ ID NO: 590348 - RNA, 19 nt, Homo sapiens
gaaggagacacagauauuc

SEQ ID NO: 590349 - RNA, 19 nt, Homo sapiens
gaaaucugcaagcuccuuu

SEQ ID NO: 590350 - RNA, 19 nt, Homo sapiens
gcacagaugggcaaugaag

SEQ ID NO: 590351 - RNA, 19 nt, Homo sapiens
ccugacagccuagaaauaa

SEQ ID NO: 590352 - RNA, 19 nt, Homo sapiens
ucacuuaccagaucaugaa

SEQ ID NO: 590353 - RNA, 19 nt, Homo sapiens
ggaacaggcugcccuacac

SEQ ID NO: 590354 - RNA, 19 nt, Homo sapiens
aaucaaaggaguagaaaga

SEQ ID NO: 590355 - RNA, 19 nt, Homo sapiens
gcuaaaggaaaguaugaaa

SEQ ID NO: 590356 - RNA, 19 nt, Homo sapiens
ucaaacaaccgcagucuca

SEQ ID NO: 590357 - RNA, 19 nt, Homo sapiens
cuacaacagaguucgaaua

SEQ ID NO: 590358 - RNA, 19 nt, Homo sapiens
acucuuagguggacaacaa

SEQ ID NO: 590359 - RNA, 19 nt, Homo sapiens
ggucuugacaugaauauca

SEQ ID NO: 590360 - RNA, 19 nt, Homo sapiens
cauaaugccuguucuuuug

SEQ ID NO: 590361 - RNA, 19 nt, Homo sapiens
ccgcagagcagaagaccua

SEQ ID NO: 590362 - RNA, 19 nt, Homo sapiens
guagagaccuccacuccua

SEQ ID NO: 590363 - RNA, 19 nt, Homo sapiens
ccacaaaggugcugaggaa

SEQ ID NO: 590364 - RNA, 19 nt, Homo sapiens
gacauaagguggccaaguu

SEQ ID NO: 590365 - RNA, 19 nt, Homo sapiens
ggaagcagguggcccagaa

SEQ ID NO: 590366 - RNA, 19 nt, Homo sapiens
gcacagcugccuuucuaua

SEQ ID NO: 590367 - RNA, 19 nt, Homo sapiens
gcaguguucucccaggaua

SEQ ID NO: 590368 - RNA, 19 nt, Homo sapiens
gcucagaugccacccaaua

SEQ ID NO: 590369 - RNA, 19 nt, Homo sapiens
caaguccacuggcucgaua

SEQ ID NO: 590370 - RNA, 19 nt, Homo sapiens
gaaagaacuuccacuucgu

SEQ ID NO: 590371 - RNA, 19 nt, Homo sapiens
ggaggaacauggccacuac

SEQ ID NO: 590372 - RNA, 19 nt, Homo sapiens
cagcggaacucaucgacuu

SEQ ID NO: 590373 - RNA, 19 nt, Homo sapiens
uggcaaaccucaccacuca

SEQ ID NO: 590374 - RNA, 19 nt, Homo sapiens
gcaacgugguccuauggaa

SEQ ID NO: 590375 - RNA, 19 nt, Homo sapiens
gcggccaucucgcccuuua

SEQ ID NO: 590376 - RNA, 19 nt, Homo sapiens
ggaaagagugggaccugaa

SEQ ID NO: 590377 - RNA, 19 nt, Homo sapiens
ggacguugccuguagaauc

SEQ ID NO: 590378 - RNA, 19 nt, Homo sapiens
gagcaccucuguggcauca

SEQ ID NO: 590379 - RNA, 19 nt, Homo sapiens
aagcaugacuuucaaggau

SEQ ID NO: 590380 - RNA, 19 nt, Homo sapiens
ggccaacgagcccgucuua

SEQ ID NO: 590381 - RNA, 19 nt, Homo sapiens
agagaucuguaaagcauga

SEQ ID NO: 590382 - RNA, 19 nt, Homo sapiens
cuucuucucugcagugauu

SEQ ID NO: 590383 - RNA, 19 nt, Homo sapiens
ucaaacaccuguggaagca

SEQ ID NO: 590384 - RNA, 19 nt, Homo sapiens
ugacgcagccaaucuguga

SEQ ID NO: 590385 - RNA, 19 nt, Homo sapiens
augcacagcugccuuucua

SEQ ID NO: 590386 - RNA, 19 nt, Homo sapiens
caaaggugcugaggaaugc

SEQ ID NO: 590387 - RNA, 19 nt, Homo sapiens
ggccuguacugucugugua

SEQ ID NO: 590388 - RNA, 19 nt, Homo sapiens
ggagcacagucggaucaaa

SEQ ID NO: 590389 - RNA, 19 nt, Homo sapiens
gcacaccuccucccugaag

SEQ ID NO: 590390 - RNA, 19 nt, Homo sapiens
ccacagaugccuccugcuu

SEQ ID NO: 590391 - RNA, 19 nt, Homo sapiens
gccggcaacuucuacauca

SEQ ID NO: 590392 - RNA, 19 nt, Homo sapiens
ucagaugccacccaauaaa

SEQ ID NO: 590393 - RNA, 19 nt, Homo sapiens
ggaugggccuucguccuau

SEQ ID NO: 590394 - RNA, 19 nt, Homo sapiens
gcaaaccucaccacucaca

SEQ ID NO: 590395 - RNA, 19 nt, Homo sapiens
ccaaguccuuugcccguau

SEQ ID NO: 590396 - RNA, 19 nt, Homo sapiens
gggcccagaucuuccugaa

SEQ ID NO: 590397 - RNA, 19 nt, Homo sapiens
cagcugccuuucuauaauc

SEQ ID NO: 590398 - RNA, 19 nt, Homo sapiens
gcagugugcccaccuucaa

SEQ ID NO: 590399 - RNA, 19 nt, Homo sapiens
gaaagagugggaccugaag

SEQ ID NO: 590400 - RNA, 19 nt, Homo sapiens
gccaaucugugaccacgau

SEQ ID NO: 590401 - RNA, 19 nt, Homo sapiens
cacagcugccuuucuauaa

SEQ ID NO: 590402 - RNA, 19 nt, Homo sapiens
ggacgugcaguaccaagug

SEQ ID NO: 590403 - RNA, 19 nt, Homo sapiens
cgaguacgguggccagaag

SEQ ID NO: 590404 - RNA, 19 nt, Homo sapiens
gcaccucuguggcaucaac

SEQ ID NO: 590405 - RNA, 19 nt, Homo sapiens
ugagcgagaugcccugcaa

SEQ ID NO: 590406 - RNA, 19 nt, Homo sapiens
uguccaggguaaaguguaa

SEQ ID NO: 590407 - RNA, 19 nt, Homo sapiens
acagcugccuuucuauaau

SEQ ID NO: 590408 - RNA, 19 nt, Homo sapiens
gagcacagucggaucaaag

SEQ ID NO: 590409 - RNA, 19 nt, Homo sapiens
gaggagcacagucggauca

SEQ ID NO: 590410 - RNA, 19 nt, Homo sapiens
cgaggacguugccuguaga

SEQ ID NO: 590411 - RNA, 19 nt, Homo sapiens
ccgaggacguugccuguag

SEQ ID NO: 590412 - RNA, 19 nt, Homo sapiens
gcugagauccucgccaaga

SEQ ID NO: 590413 - RNA, 19 nt, Homo sapiens
ggacauaagguggccaagu

SEQ ID NO: 590414 - RNA, 19 nt, Homo sapiens
gaaugcugccggcaacuuc

SEQ ID NO: 590415 - RNA, 19 nt, Homo sapiens
uuucaaggaugguucuuag

SEQ ID NO: 590416 - RNA, 19 nt, Homo sapiens
uaccaagugucgccuuuua

SEQ ID NO: 590417 - RNA, 19 nt, Homo sapiens
ugacagcaccaccagcuau

SEQ ID NO: 590418 - RNA, 19 nt, Homo sapiens
ccaacaucauccaguuugu

SEQ ID NO: 590419 - RNA, 19 nt, Homo sapiens
ccgguucaaugccaaguau

SEQ ID NO: 590420 - RNA, 19 nt, Homo sapiens
ggaacucaucgacuucuuc

SEQ ID NO: 590421 - RNA, 19 nt, Homo sapiens
gacguugccuguagaaucc

SEQ ID NO: 590422 - RNA, 19 nt, Homo sapiens
ucaucaaggagacacauaa

SEQ ID NO: 590423 - RNA, 19 nt, Homo sapiens
acaaaggugcugaggaaug

SEQ ID NO: 590424 - RNA, 19 nt, Homo sapiens
agugggaccugaagccuau

SEQ ID NO: 590425 - RNA, 19 nt, Homo sapiens
ccacgauuccucccacaga

SEQ ID NO: 590426 - RNA, 19 nt, Homo sapiens
gaugggccuucguccuaug

SEQ ID NO: 590427 - RNA, 19 nt, Homo sapiens
gccgaggccugugugauuc

SEQ ID NO: 590428 - RNA, 19 nt, Homo sapiens
cuuccucacuguaucuuug

SEQ ID NO: 590429 - RNA, 19 nt, Homo sapiens
ggaaugcugccggcaacuu

SEQ ID NO: 590430 - RNA, 19 nt, Homo sapiens
caaugggauuugcucagau

SEQ ID NO: 590431 - RNA, 19 nt, Homo sapiens
gggcacaggcuggaguauu

SEQ ID NO: 590432 - RNA, 19 nt, Homo sapiens
uggaugggccuucguccua

SEQ ID NO: 590433 - RNA, 19 nt, Homo sapiens
ggguaaaguguaacucaga

SEQ ID NO: 590434 - RNA, 19 nt, Homo sapiens
gggaggaacauggccacua

SEQ ID NO: 590435 - RNA, 19 nt, Homo sapiens
gaucuucgggccuguacug

SEQ ID NO: 590436 - RNA, 19 nt, Homo sapiens
aaugggauuugcucagaug

SEQ ID NO: 590437 - RNA, 19 nt, Homo sapiens
gaugccuccugcuuggauu

SEQ ID NO: 590438 - RNA, 19 nt, Homo sapiens
cgccgcaggucaucaagga

SEQ ID NO: 590439 - RNA, 19 nt, Homo sapiens
ccucaggagcccaucauga

SEQ ID NO: 590440 - RNA, 19 nt, Homo sapiens
cccuuuaacuucacugcaa

SEQ ID NO: 590441 - RNA, 19 nt, Homo sapiens
caucucgcccuuuaacuuc

SEQ ID NO: 590442 - RNA, 19 nt, Homo sapiens
ccaucucgcccuuuaacuu

SEQ ID NO: 590443 - RNA, 19 nt, Homo sapiens
gacauuggcccucccuucu

SEQ ID NO: 590444 - RNA, 19 nt, Homo sapiens
cuccagguguccaggguaa

SEQ ID NO: 590445 - RNA, 19 nt, Homo sapiens
gacgugcaguaccaagugu

SEQ ID NO: 590446 - RNA, 19 nt, Homo sapiens
ggagaucuucgggccugua

SEQ ID NO: 590447 - RNA, 19 nt, Homo sapiens
gcacagucggaucaaagug

SEQ ID NO: 590448 - RNA, 19 nt, Homo sapiens
gagcugguguggccauucc

SEQ ID NO: 590449 - RNA, 19 nt, Homo sapiens
caacaucauccaguuugug

SEQ ID NO: 590450 - RNA, 19 nt, Homo sapiens
ccaauaaaaugccuguuac

SEQ ID NO: 590451 - RNA, 19 nt, Homo sapiens
gagccucuggaaccaauga

SEQ ID NO: 590452 - RNA, 19 nt, Homo sapiens
cucaggagcccaucaugaa

SEQ ID NO: 590453 - RNA, 19 nt, Homo sapiens
ccuccugcuuggauucuga

SEQ ID NO: 590454 - RNA, 19 nt, Homo sapiens
ccucacuggcccauucuuu

SEQ ID NO: 590455 - RNA, 19 nt, Homo sapiens
gucccucacuggcccauuc

SEQ ID NO: 590456 - RNA, 19 nt, Homo sapiens
gggccuucguccuauguca

SEQ ID NO: 590457 - RNA, 19 nt, Homo sapiens
aaaccucaccacucacaga

SEQ ID NO: 590458 - RNA, 19 nt, Homo sapiens
ccaacgagcccgucuuagc

SEQ ID NO: 590459 - RNA, 19 nt, Homo sapiens
gagcccgucuuagccuuca

SEQ ID NO: 590460 - RNA, 19 nt, Homo sapiens
guggccaaguucuguuaug

SEQ ID NO: 590461 - RNA, 19 nt, Homo sapiens
caggguaaaguguaacuca

SEQ ID NO: 590462 - RNA, 19 nt, Homo sapiens
ccacaaaggugcugaggaa

SEQ ID NO: 590463 - RNA, 19 nt, Homo sapiens
gacauaagguggccaaguu

SEQ ID NO: 590464 - RNA, 19 nt, Homo sapiens
ggaagcagguggcccagaa

SEQ ID NO: 590465 - RNA, 19 nt, Homo sapiens
gcaguguucucccaggaua

SEQ ID NO: 590466 - RNA, 19 nt, Homo sapiens
gcucagaugccacccaaua

SEQ ID NO: 590467 - RNA, 19 nt, Homo sapiens
caaguccacuggcucgaua

SEQ ID NO: 590468 - RNA, 19 nt, Homo sapiens
gaaagaacuuccacuucgu

SEQ ID NO: 590469 - RNA, 19 nt, Homo sapiens
cagcggaacucaucgacuu

SEQ ID NO: 590470 - RNA, 19 nt, Homo sapiens
gcaacgugguccuauggaa

SEQ ID NO: 590471 - RNA, 19 nt, Homo sapiens
gcggccaucucgcccuuua

SEQ ID NO: 590472 - RNA, 19 nt, Homo sapiens
ggaaagagugggaccugaa

SEQ ID NO: 590473 - RNA, 19 nt, Homo sapiens
gagcaccucuguggcauca

SEQ ID NO: 590474 - RNA, 19 nt, Homo sapiens
aagcaugacuuucaaggau

SEQ ID NO: 590475 - RNA, 19 nt, Homo sapiens
ggccaacgagcccgucuua

SEQ ID NO: 590476 - RNA, 19 nt, Homo sapiens
agagaucuguaaagcauga

SEQ ID NO: 590477 - RNA, 19 nt, Homo sapiens
cuucuucucugcagugauu

SEQ ID NO: 590478 - RNA, 19 nt, Homo sapiens
ucaaacaccuguggaagca

SEQ ID NO: 590479 - RNA, 19 nt, Homo sapiens
caaaggugcugaggaaugc

SEQ ID NO: 590480 - RNA, 19 nt, Homo sapiens
ggccuguacugucugugua

SEQ ID NO: 590481 - RNA, 19 nt, Homo sapiens
ggagcacagucggaucaaa

SEQ ID NO: 590482 - RNA, 19 nt, Homo sapiens
gccggcaacuucuacauca

SEQ ID NO: 590483 - RNA, 19 nt, Homo sapiens
gcacaccuccucccugaag

SEQ ID NO: 590484 - RNA, 19 nt, Homo sapiens
ucagaugccacccaauaaa

SEQ ID NO: 590485 - RNA, 19 nt, Homo sapiens
ccaaguccuuugcccguau

SEQ ID NO: 590486 - RNA, 19 nt, Homo sapiens
gggcccagaucuuccugaa

SEQ ID NO: 590487 - RNA, 19 nt, Homo sapiens
gcagugugcccaccuucaa

SEQ ID NO: 590488 - RNA, 19 nt, Homo sapiens
gaaagagugggaccugaag

SEQ ID NO: 590489 - RNA, 19 nt, Homo sapiens
ugagcgagaugcccugcaa

SEQ ID NO: 590490 - RNA, 19 nt, Homo sapiens
cgaguacgguggccagaag

SEQ ID NO: 590491 - RNA, 19 nt, Homo sapiens
gcaccucuguggcaucaac

SEQ ID NO: 590492 - RNA, 19 nt, Homo sapiens
ggacgugcaguaccaagug

SEQ ID NO: 590493 - RNA, 19 nt, Homo sapiens
gagcacagucggaucaaag

SEQ ID NO: 590494 - RNA, 19 nt, Homo sapiens
gaggagcacagucggauca

SEQ ID NO: 590495 - RNA, 19 nt, Homo sapiens
gcugagauccucgccaaga

SEQ ID NO: 590496 - RNA, 19 nt, Homo sapiens
ggacauaagguggccaagu

SEQ ID NO: 590497 - RNA, 19 nt, Homo sapiens
gaaugcugccggcaacuuc

SEQ ID NO: 590498 - RNA, 19 nt, Homo sapiens
uuucaaggaugguucuuag

SEQ ID NO: 590499 - RNA, 19 nt, Homo sapiens
ugacagcaccaccagcuau

SEQ ID NO: 590500 - RNA, 19 nt, Homo sapiens
uaccaagugucgccuuuua

SEQ ID NO: 590501 - RNA, 19 nt, Homo sapiens
ccaacaucauccaguuugu

SEQ ID NO: 590502 - RNA, 19 nt, Homo sapiens
ccgguucaaugccaaguau

SEQ ID NO: 590503 - RNA, 19 nt, Homo sapiens
ggaacucaucgacuucuuc

SEQ ID NO: 590504 - RNA, 19 nt, Homo sapiens
ucaucaaggagacacauaa

SEQ ID NO: 590505 - RNA, 19 nt, Homo sapiens
acaaaggugcugaggaaug

SEQ ID NO: 590506 - RNA, 19 nt, Homo sapiens
agugggaccugaagccuau

SEQ ID NO: 590507 - RNA, 19 nt, Homo sapiens
ggaaugcugccggcaacuu

SEQ ID NO: 590508 - RNA, 19 nt, Homo sapiens
caaugggauuugcucagau

SEQ ID NO: 590509 - RNA, 19 nt, Homo sapiens
gggcacaggcuggaguauu

SEQ ID NO: 590510 - RNA, 19 nt, Homo sapiens
gaucuucgggccuguacug

SEQ ID NO: 590511 - RNA, 19 nt, Homo sapiens
aaugggauuugcucagaug

SEQ ID NO: 590512 - RNA, 19 nt, Homo sapiens
gaugccuccugcuuggauu

SEQ ID NO: 590513 - RNA, 19 nt, Homo sapiens
cgccgcaggucaucaagga

SEQ ID NO: 590514 - RNA, 19 nt, Homo sapiens
ccucaggagcccaucauga

SEQ ID NO: 590515 - RNA, 19 nt, Homo sapiens
cccuuuaacuucacugcaa

SEQ ID NO: 590516 - RNA, 19 nt, Homo sapiens
caucucgcccuuuaacuuc

SEQ ID NO: 590517 - RNA, 19 nt, Homo sapiens
ccaucucgcccuuuaacuu

SEQ ID NO: 590518 - RNA, 19 nt, Homo sapiens
ggagaucuucgggccugua

SEQ ID NO: 590519 - RNA, 19 nt, Homo sapiens
gcacagucggaucaaagug

SEQ ID NO: 590520 - RNA, 19 nt, Homo sapiens
gacgugcaguaccaagugu

SEQ ID NO: 590521 - RNA, 19 nt, Homo sapiens
gagcugguguggccauucc

SEQ ID NO: 590522 - RNA, 19 nt, Homo sapiens
caacaucauccaguuugug

SEQ ID NO: 590523 - RNA, 19 nt, Homo sapiens
ccaauaaaaugccuguuac

SEQ ID NO: 590524 - RNA, 19 nt, Homo sapiens
gagccucuggaaccaauga

SEQ ID NO: 590525 - RNA, 19 nt, Homo sapiens
cucaggagcccaucaugaa

SEQ ID NO: 590526 - RNA, 19 nt, Homo sapiens
gagcccgucuuagccuuca

SEQ ID NO: 590527 - RNA, 19 nt, Homo sapiens
ccuccugcuuggauucuga

SEQ ID NO: 590528 - RNA, 19 nt, Homo sapiens
ccaacgagcccgucuuagc

SEQ ID NO: 590529 - RNA, 19 nt, Homo sapiens
uaagguggccaaguucugu

SEQ ID NO: 590530 - RNA, 19 nt, Homo sapiens
guggccaaguucuguuaug

SEQ ID NO: 590531 - RNA, 19 nt, Homo sapiens
ggagcuacgcguacaugca

SEQ ID NO: 590532 - RNA, 19 nt, Homo sapiens
ccgagccucuggaaccaau

SEQ ID NO: 590533 - RNA, 19 nt, Homo sapiens
ugagguggcaaugggauuu

SEQ ID NO: 590534 - RNA, 19 nt, Homo sapiens
ugacuccgugggcuacuuu

SEQ ID NO: 590535 - RNA, 19 nt, Homo sapiens
aguaccaagugucgccuuu

SEQ ID NO: 590536 - RNA, 19 nt, Homo sapiens
ccugaaggcggcagacaug

SEQ ID NO: 590537 - RNA, 19 nt, Homo sapiens
gggcaacgugguccuaugg

SEQ ID NO: 590538 - RNA, 19 nt, Homo sapiens
ucuacugguucuacacugu

SEQ ID NO: 590539 - RNA, 19 nt, Homo sapiens
gacagcaccaccagcuaug

SEQ ID NO: 590540 - RNA, 19 nt, Homo sapiens
gaucuguaaagcaugacuu

SEQ ID NO: 590541 - RNA, 19 nt, Homo sapiens
cuucgggccuguacugucu

SEQ ID NO: 590542 - RNA, 19 nt, Homo sapiens
caaguccuuugcccguauc

SEQ ID NO: 590543 - RNA, 19 nt, Homo sapiens
gagcgagaugcccugcaaa

SEQ ID NO: 590544 - RNA, 19 nt, Homo sapiens
ccgcucagccuucgaguac

SEQ ID NO: 590545 - RNA, 19 nt, Homo sapiens
ucaaggagcucuucgaguu

SEQ ID NO: 590546 - RNA, 19 nt, Homo sapiens
caacacagccguucgaugu

SEQ ID NO: 590547 - RNA, 19 nt, Homo sapiens
gaacaaaguggcauugcuu

SEQ ID NO: 590548 - RNA, 19 nt, Homo sapiens
ggucuccgcucuccgacua

SEQ ID NO: 590549 - RNA, 19 nt, Homo sapiens
guacaucaacaucgacuuu

SEQ ID NO: 590550 - RNA, 19 nt, Homo sapiens
gcagaagcauggccacaag

SEQ ID NO: 590551 - RNA, 19 nt, Homo sapiens
aaaugucucucucaggaaa

SEQ ID NO: 590552 - RNA, 19 nt, Homo sapiens
cugccucgcuggaugaaua

SEQ ID NO: 590553 - RNA, 19 nt, Homo sapiens
gcgaguacaucaacaucga

SEQ ID NO: 590554 - RNA, 19 nt, Homo sapiens
agaauggucucaaguacau

SEQ ID NO: 590555 - RNA, 19 nt, Homo sapiens
caacucggccuccguggaa

SEQ ID NO: 590556 - RNA, 19 nt, Homo sapiens
caaccuacgcccagcauug

SEQ ID NO: 590557 - RNA, 19 nt, Homo sapiens
ucaaguacaucgccaucga

SEQ ID NO: 590558 - RNA, 19 nt, Homo sapiens
ggaacaaaguggcauugcu

SEQ ID NO: 590559 - RNA, 19 nt, Homo sapiens
ggacagcuucuucuucauc

SEQ ID NO: 590560 - RNA, 19 nt, Homo sapiens
ccagaauggucucaaguac

SEQ ID NO: 590561 - RNA, 19 nt, Homo sapiens
ucggacagcuucuucuuca

SEQ ID NO: 590562 - RNA, 19 nt, Homo sapiens
gaccaguacgugcucauga

SEQ ID NO: 590563 - RNA, 19 nt, Homo sapiens
gcaacacgcccgaguccau

SEQ ID NO: 590564 - RNA, 19 nt, Homo sapiens
cuacaugaaccucgacuuc

SEQ ID NO: 590565 - RNA, 19 nt, Homo sapiens
ggaugaauacacccugaug

SEQ ID NO: 590566 - RNA, 19 nt, Homo sapiens
ccaugaaggcgcucaagga

SEQ ID NO: 590567 - RNA, 19 nt, Homo sapiens
caacaacaacaacaacaac

SEQ ID NO: 590568 - RNA, 19 nt, Homo sapiens
caacaacaacaacaacaac

SEQ ID NO: 590569 - RNA, 19 nt, Homo sapiens
caacaacaacaacaacaac

SEQ ID NO: 590570 - RNA, 19 nt, Homo sapiens
ucaacaacaacaacaacaa

SEQ ID NO: 590571 - RNA, 19 nt, Homo sapiens
caggagcgacgacuacaug

SEQ ID NO: 590572 - RNA, 19 nt, Homo sapiens
gaucgcccaugcgcagaga

SEQ ID NO: 590573 - RNA, 19 nt, Homo sapiens
ccagaggacuacggagaca

SEQ ID NO: 590574 - RNA, 19 nt, Homo sapiens
cgaggacaguggguacaug

SEQ ID NO: 590575 - RNA, 19 nt, Homo sapiens
cuacggagacaucgagauc

SEQ ID NO: 590576 - RNA, 19 nt, Homo sapiens
caaggagcucuucgaguuc

SEQ ID NO: 590577 - RNA, 19 nt, Homo sapiens
uccagaauggucucaagua

SEQ ID NO: 590578 - RNA, 19 nt, Homo sapiens
ggcagacgacggcuacaug

SEQ ID NO: 590579 - RNA, 19 nt, Homo sapiens
acaacaacaacaacaacaa

SEQ ID NO: 590580 - RNA, 19 nt, Homo sapiens
acaacaacaacaacaacaa

SEQ ID NO: 590581 - RNA, 19 nt, Homo sapiens
cagaauggucucaaguaca

SEQ ID NO: 590582 - RNA, 19 nt, Homo sapiens
acaccaaggacgaguacuu

SEQ ID NO: 590583 - RNA, 19 nt, Homo sapiens
ugaucgcccucuacaccaa

SEQ ID NO: 590584 - RNA, 19 nt, Homo sapiens
gccccaaccucaacaacaa

SEQ ID NO: 590585 - RNA, 19 nt, Homo sapiens
ccacucggacagcuucuuc

SEQ ID NO: 590586 - RNA, 19 nt, Homo sapiens
gaaagaaucucacacaaga

SEQ ID NO: 590587 - RNA, 19 nt, Homo sapiens
gaaguaagguucuguuaaa

SEQ ID NO: 590588 - RNA, 19 nt, Homo sapiens
ucacaaagguucuaaauug

SEQ ID NO: 590589 - RNA, 19 nt, Homo sapiens
gauuuaaacuggugucuua

SEQ ID NO: 590590 - RNA, 19 nt, Homo sapiens
gaauuggccuuauuaauga

SEQ ID NO: 590591 - RNA, 19 nt, Homo sapiens
ggagaaacauggaugauga

SEQ ID NO: 590592 - RNA, 19 nt, Homo sapiens
ggauauggauggcauuaua

SEQ ID NO: 590593 - RNA, 19 nt, Homo sapiens
ggacaggucucauagaaga

SEQ ID NO: 590594 - RNA, 19 nt, Homo sapiens
ggacagagauaaucaagau

SEQ ID NO: 590595 - RNA, 19 nt, Homo sapiens
agacagagauuuauucgua

SEQ ID NO: 590596 - RNA, 19 nt, Homo sapiens
gaaauuagaagaaguggaa

SEQ ID NO: 590597 - RNA, 19 nt, Homo sapiens
gaacagagaauuaaagaca

SEQ ID NO: 590598 - RNA, 19 nt, Homo sapiens
gcaaacugcuuuuccauua

SEQ ID NO: 590599 - RNA, 19 nt, Homo sapiens
gaggacaggucucauagaa

SEQ ID NO: 590600 - RNA, 19 nt, Homo sapiens
ccagcaagcuuucaaauuc

SEQ ID NO: 590601 - RNA, 19 nt, Homo sapiens
gagagaaggugaguacaaa

SEQ ID NO: 590602 - RNA, 19 nt, Homo sapiens
gacguuaagucucaagaua

SEQ ID NO: 590603 - RNA, 19 nt, Homo sapiens
gaacgccgaugaugacaga

SEQ ID NO: 590604 - RNA, 19 nt, Homo sapiens
gaagguggcuggagaagag

SEQ ID NO: 590605 - RNA, 19 nt, Homo sapiens
gccaaagcauucaaagaua

SEQ ID NO: 590606 - RNA, 19 nt, Homo sapiens
gcagauggucuuagauaua

SEQ ID NO: 590607 - RNA, 19 nt, Homo sapiens
guacggcaaucaaucuuaa

SEQ ID NO: 590608 - RNA, 19 nt, Homo sapiens
aaagagcgcuuacgaggaa

SEQ ID NO: 590609 - RNA, 19 nt, Homo sapiens
ggucagauuuaauguacua

SEQ ID NO: 590610 - RNA, 19 nt, Homo sapiens
caacgaauuucuugagguu

SEQ ID NO: 590611 - RNA, 19 nt, Homo sapiens
guagcuauguuaaagauga

SEQ ID NO: 590612 - RNA, 19 nt, Homo sapiens
cgaauuggccuuauuaaug

SEQ ID NO: 590613 - RNA, 19 nt, Homo sapiens
ggaucguacugacagauua

SEQ ID NO: 590614 - RNA, 19 nt, Homo sapiens
ggaauuggauccagauuuu

SEQ ID NO: 590615 - RNA, 19 nt, Homo sapiens
ccaaagcauucaaagauau

SEQ ID NO: 590616 - RNA, 19 nt, Homo sapiens
cagcaggugucacagauuu

SEQ ID NO: 590617 - RNA, 19 nt, Homo sapiens
ugaaauacuuggaacuuug

SEQ ID NO: 590618 - RNA, 19 nt, Homo sapiens
aaagggaguuggaaauuga

SEQ ID NO: 590619 - RNA, 19 nt, Homo sapiens
caaagggaguuggaaauug

SEQ ID NO: 590620 - RNA, 19 nt, Homo sapiens
caagaggaagaaagaauua

SEQ ID NO: 590621 - RNA, 19 nt, Homo sapiens
uaaaccagcucauauacug

SEQ ID NO: 590622 - RNA, 19 nt, Homo sapiens
gaauuaugcuacucgagaa

SEQ ID NO: 590623 - RNA, 19 nt, Homo sapiens
ucaaagcuguggaagauau

SEQ ID NO: 590624 - RNA, 19 nt, Homo sapiens
uaaggguguugcauuauuu

SEQ ID NO: 590625 - RNA, 19 nt, Homo sapiens
uaaagaagaacgcaggaua

SEQ ID NO: 590626 - RNA, 19 nt, Homo sapiens
gaagaaaggcauaaucgau

SEQ ID NO: 590627 - RNA, 19 nt, Homo sapiens
cagugaaucugaaacaauu

SEQ ID NO: 590628 - RNA, 19 nt, Homo sapiens
caaacgcgccaacgaauuu

SEQ ID NO: 590629 - RNA, 19 nt, Homo sapiens
uagaagaaguggaaaggaa

SEQ ID NO: 590630 - RNA, 19 nt, Homo sapiens
gaagagcgauuagcagaag

SEQ ID NO: 590631 - RNA, 19 nt, Homo sapiens
aaacuggugucuuaaauag

SEQ ID NO: 590632 - RNA, 19 nt, Homo sapiens
gaagaacgcaggauaacau

SEQ ID NO: 590633 - RNA, 19 nt, Homo sapiens
gcaacaagaggaagaaaga

SEQ ID NO: 590634 - RNA, 19 nt, Homo sapiens
gaacaacuggagaaagaaa

SEQ ID NO: 590635 - RNA, 19 nt, Homo sapiens
uaucauggcuaaacagguu

SEQ ID NO: 590636 - RNA, 19 nt, Homo sapiens
acaauuggcuugaaguaga

SEQ ID NO: 590637 - RNA, 19 nt, Homo sapiens
gcgcaagugugaauccaaa

SEQ ID NO: 590638 - RNA, 19 nt, Homo sapiens
gcaugaacuuguauuaauc

SEQ ID NO: 590639 - RNA, 19 nt, Homo sapiens
uaaacugugugacaauuug

SEQ ID NO: 590640 - RNA, 19 nt, Homo sapiens
gaagaaauuagaagaagug

SEQ ID NO: 590641 - RNA, 19 nt, Homo sapiens
gagaagggcagaagaacaa

SEQ ID NO: 590642 - RNA, 19 nt, Homo sapiens
caagaacgccuaaagaauc

SEQ ID NO: 590643 - RNA, 19 nt, Homo sapiens
uugaagaccuugaggaauu

SEQ ID NO: 590644 - RNA, 19 nt, Homo sapiens
gaucugauuugaauuaugc

SEQ ID NO: 590645 - RNA, 19 nt, Homo sapiens
gucaacaggugaacauaaa

SEQ ID NO: 590646 - RNA, 19 nt, Homo sapiens
aaacauagaacauggcaaa

SEQ ID NO: 590647 - RNA, 19 nt, Homo sapiens
gauagauucuuucaacaag

SEQ ID NO: 590648 - RNA, 19 nt, Homo sapiens
gagaagacuuggcgauagu

SEQ ID NO: 590649 - RNA, 19 nt, Homo sapiens
gacagagauuuauucguaa

SEQ ID NO: 590650 - RNA, 19 nt, Homo sapiens
gauauggucagauuuaaug

SEQ ID NO: 590651 - RNA, 19 nt, Homo sapiens
gaaggugaguacaaagcaa

SEQ ID NO: 590652 - RNA, 19 nt, Homo sapiens
gagagaagacuuggcgaua

SEQ ID NO: 590653 - RNA, 19 nt, Homo sapiens
gcagagaagggcagaagaa

SEQ ID NO: 590654 - RNA, 19 nt, Homo sapiens
ggucuuagauauagaggau

SEQ ID NO: 590655 - RNA, 19 nt, Homo sapiens
agaacuugcugcuguguuu

SEQ ID NO: 590656 - RNA, 19 nt, Homo sapiens
gagcgcaguagcuauguua

SEQ ID NO: 590657 - RNA, 19 nt, Homo sapiens
gacgugggauggaugauga

SEQ ID NO: 590658 - RNA, 19 nt, Homo sapiens
aaagauacacgaaccaauu

SEQ ID NO: 590659 - RNA, 19 nt, Homo sapiens
cuagagaaaugagaaagaa

SEQ ID NO: 590660 - RNA, 19 nt, Homo sapiens
cagcagauggucuuagaua

SEQ ID NO: 590661 - RNA, 19 nt, Homo sapiens
gagaauucaugccuuucaa

SEQ ID NO: 590662 - RNA, 19 nt, Homo sapiens
uaacaccuuuaucuuggua

SEQ ID NO: 590663 - RNA, 19 nt, Homo sapiens
gaguaacaccuuuaucuug

SEQ ID NO: 590664 - RNA, 19 nt, Homo sapiens
gguauugaguaacaccuuu

SEQ ID NO: 590665 - RNA, 19 nt, Homo sapiens
gaucagaacgugaagaagu

SEQ ID NO: 590666 - RNA, 19 nt, Homo sapiens
aaagaaagggacagagaua

SEQ ID NO: 590667 - RNA, 19 nt, Homo sapiens
ggaggaacgccgaugauga

SEQ ID NO: 590668 - RNA, 19 nt, Homo sapiens
ggcgauaguucccuuucua

SEQ ID NO: 590669 - RNA, 19 nt, Homo sapiens
gcagaagaacaaaugcuaa

SEQ ID NO: 590670 - RNA, 19 nt, Homo sapiens
gcucauauacugcaagaga

SEQ ID NO: 590671 - RNA, 19 nt, Homo sapiens
ggaacaaccugaaaaggaa

SEQ ID NO: 590672 - RNA, 19 nt, Homo sapiens
caaagucucaacuguguuu

SEQ ID NO: 590673 - RNA, 19 nt, Homo sapiens
ugaacuauuuggucucauu

SEQ ID NO: 590674 - RNA, 19 nt, Homo sapiens
gguaaauuaucgcugaguu

SEQ ID NO: 590675 - RNA, 19 nt, Homo sapiens
ggaaauugaagaacgagaa

SEQ ID NO: 590676 - RNA, 19 nt, Homo sapiens
aaaaggcucuugaacauaa

SEQ ID NO: 590677 - RNA, 19 nt, Homo sapiens
ggauauugcucgacuucug

SEQ ID NO: 590678 - RNA, 19 nt, Homo sapiens
gagcgccuguaccaugaua

SEQ ID NO: 590679 - RNA, 19 nt, Homo sapiens
aaacugaagcugcuaaaga

SEQ ID NO: 590680 - RNA, 19 nt, Homo sapiens
gauaguucccuuucuagaa

SEQ ID NO: 590681 - RNA, 19 nt, Homo sapiens
agaaaggcauaaucgauug

SEQ ID NO: 590682 - RNA, 19 nt, Homo sapiens
gcuugaagacagagauuua

SEQ ID NO: 590683 - RNA, 19 nt, Homo sapiens
cauuaaaccagcucauaua

SEQ ID NO: 590684 - RNA, 19 nt, Homo sapiens
gaaucucuccgucguacua

SEQ ID NO: 590685 - RNA, 19 nt, Homo sapiens
gcacggcagucuguuuaug

SEQ ID NO: 590686 - RNA, 19 nt, Homo sapiens
gaacagaucaagcaaauua

SEQ ID NO: 590687 - RNA, 19 nt, Homo sapiens
ggagagaaauucaagcaaa

SEQ ID NO: 590688 - RNA, 19 nt, Homo sapiens
gaacggagacuacuugugu

SEQ ID NO: 590689 - RNA, 19 nt, Homo sapiens
gaagaaauacucuaagauc

SEQ ID NO: 590690 - RNA, 19 nt, Homo sapiens
gaacagaaggaucguuuga

SEQ ID NO: 590691 - RNA, 19 nt, Homo sapiens
ggauaucugugucuuucua

SEQ ID NO: 590692 - RNA, 19 nt, Homo sapiens
ggaagcagauggaaucgau

SEQ ID NO: 590693 - RNA, 19 nt, Homo sapiens
gcaccuaccuggcuaccuu

SEQ ID NO: 590694 - RNA, 19 nt, Homo sapiens
ggagacuacuuguguguga

SEQ ID NO: 590695 - RNA, 19 nt, Homo sapiens
gaagaacggagacuacuug

SEQ ID NO: 590696 - RNA, 19 nt, Homo sapiens
gagagaaauucaagcaaau

SEQ ID NO: 590697 - RNA, 19 nt, Homo sapiens
gaagaucucugggauaaaa

SEQ ID NO: 590698 - RNA, 19 nt, Homo sapiens
gaagaaagagcgagaugga

SEQ ID NO: 590699 - RNA, 19 nt, Homo sapiens
ucaagcaaauucagagauu

SEQ ID NO: 590700 - RNA, 19 nt, Homo sapiens
gagagaaggcgcaccauga

SEQ ID NO: 590701 - RNA, 19 nt, Homo sapiens
gcagagaucaguacagugu

SEQ ID NO: 590702 - RNA, 19 nt, Homo sapiens
gguugaacauggaaauaaa

SEQ ID NO: 590703 - RNA, 19 nt, Homo sapiens
gagcagcauuuccguugaa

SEQ ID NO: 590704 - RNA, 19 nt, Homo sapiens
gggaagaggagaccauuga

SEQ ID NO: 590705 - RNA, 19 nt, Homo sapiens
ucuaagaucuuugaacaga

SEQ ID NO: 590706 - RNA, 19 nt, Homo sapiens
uugaagaucucugggauaa

SEQ ID NO: 590707 - RNA, 19 nt, Homo sapiens
gaagagggguuuucacugu

SEQ ID NO: 590708 - RNA, 19 nt, Homo sapiens
ggaugacccucaggccaua

SEQ ID NO: 590709 - RNA, 19 nt, Homo sapiens
gcggauaucugugucuuuc

SEQ ID NO: 590710 - RNA, 19 nt, Homo sapiens
ggagaccgcacuuccauau

SEQ ID NO: 590711 - RNA, 19 nt, Homo sapiens
guccaaagccucaaaggaa

SEQ ID NO: 590712 - RNA, 19 nt, Homo sapiens
gaacaucgcagagcacuac

SEQ ID NO: 590713 - RNA, 19 nt, Homo sapiens
cugaagaaauacucuaaga

SEQ ID NO: 590714 - RNA, 19 nt, Homo sapiens
ggguucagcuuauugacuu

SEQ ID NO: 590715 - RNA, 19 nt, Homo sapiens
gaguaugaacggugccuua

SEQ ID NO: 590716 - RNA, 19 nt, Homo sapiens
cgugagcgaggaagaauua

SEQ ID NO: 590717 - RNA, 19 nt, Homo sapiens
agaccgcacuuccauauuc

SEQ ID NO: 590718 - RNA, 19 nt, Homo sapiens
cccaggagcucuauaugga

SEQ ID NO: 590719 - RNA, 19 nt, Homo sapiens
caagaagaguuugaagauc

SEQ ID NO: 590720 - RNA, 19 nt, Homo sapiens
ggagauguacucaaagauc

SEQ ID NO: 590721 - RNA, 19 nt, Homo sapiens
aagaagaguuugaagaucu

SEQ ID NO: 590722 - RNA, 19 nt, Homo sapiens
gacaagaagaguuugaaga

SEQ ID NO: 590723 - RNA, 19 nt, Homo sapiens
ggaaauaaaagcaaacuug

SEQ ID NO: 590724 - RNA, 19 nt, Homo sapiens
uaagaucuuugaacagaag

SEQ ID NO: 590725 - RNA, 19 nt, Homo sapiens
ggaaccaaauggaaguaag

SEQ ID NO: 590726 - RNA, 19 nt, Homo sapiens
cuaugaaacuccuucuaug

SEQ ID NO: 590727 - RNA, 19 nt, Homo sapiens
caagaucuuuuccaaguuu

SEQ ID NO: 590728 - RNA, 19 nt, Homo sapiens
gcgccuggauucugccauu

SEQ ID NO: 590729 - RNA, 19 nt, Homo sapiens
acugggagauguacucaaa

SEQ ID NO: 590730 - RNA, 19 nt, Homo sapiens
acagaaggaucguuugagu

SEQ ID NO: 590731 - RNA, 19 nt, Homo sapiens
acucuaagaucuuugaaca

SEQ ID NO: 590732 - RNA, 19 nt, Homo sapiens
ggacgccuccugcagaaga

SEQ ID NO: 590733 - RNA, 19 nt, Homo sapiens
gaaccaaauggaaguaagu

SEQ ID NO: 590734 - RNA, 19 nt, Homo sapiens
aggaacagaucaagcaaau

SEQ ID NO: 590735 - RNA, 19 nt, Homo sapiens
cguacuggcuguggacuuu

SEQ ID NO: 590736 - RNA, 19 nt, Homo sapiens
cgagauggacagagacgua

SEQ ID NO: 590737 - RNA, 19 nt, Homo sapiens
agagaucaguacaguguga

SEQ ID NO: 590738 - RNA, 19 nt, Homo sapiens
gucaaccucuuuacggauu

SEQ ID NO: 590739 - RNA, 19 nt, Homo sapiens
uggauacgcuuagcaucua

SEQ ID NO: 590740 - RNA, 19 nt, Homo sapiens
gauauuccagccaggguaa

SEQ ID NO: 590741 - RNA, 19 nt, Homo sapiens
agagcgagauggacagaga

SEQ ID NO: 590742 - RNA, 19 nt, Homo sapiens
gacccugucucaauugaag

SEQ ID NO: 590743 - RNA, 19 nt, Homo sapiens
gaagaggagaccauugagu

SEQ ID NO: 590744 - RNA, 19 nt, Homo sapiens
ugggagauguacucaaaga

SEQ ID NO: 590745 - RNA, 19 nt, Homo sapiens
gaaaccaucauagccuuug

SEQ ID NO: 590746 - RNA, 19 nt, Homo sapiens
ucaaugugguggacugcaa

SEQ ID NO: 590747 - RNA, 19 nt, Homo sapiens
acaagaagaguuugaagau

SEQ ID NO: 590748 - RNA, 19 nt, Homo sapiens
acgcuuagcaucuaugaaa

SEQ ID NO: 590749 - RNA, 19 nt, Homo sapiens
cuggcuaccuuucaucaaa

SEQ ID NO: 590750 - RNA, 19 nt, Homo sapiens
ccaggaagcagauggaauc

SEQ ID NO: 590751 - RNA, 19 nt, Homo sapiens
gaggagggguggacacuga

SEQ ID NO: 590752 - RNA, 19 nt, Homo sapiens
agaaggaucguuugaguca

SEQ ID NO: 590753 - RNA, 19 nt, Homo sapiens
gaucugaagaaauacucua

SEQ ID NO: 590754 - RNA, 19 nt, Homo sapiens
gcagaagaacggagacuac

SEQ ID NO: 590755 - RNA, 19 nt, Homo sapiens
caagcaaauucagagauuc

SEQ ID NO: 590756 - RNA, 19 nt, Homo sapiens
ggagaccauugaguucuuc

SEQ ID NO: 590757 - RNA, 19 nt, Homo sapiens
ggauacgcuuagcaucuau

SEQ ID NO: 590758 - RNA, 19 nt, Homo sapiens
ugucucaauugaagaaaga

SEQ ID NO: 590759 - RNA, 19 nt, Homo sapiens
gaagaggaugggaagacaa

SEQ ID NO: 590760 - RNA, 19 nt, Homo sapiens
cuuauugacuucucaccuu

SEQ ID NO: 590761 - RNA, 19 nt, Homo sapiens
gaagaauuacugggagaug

SEQ ID NO: 590762 - RNA, 19 nt, Homo sapiens
cgagcagcauuuccguuga

SEQ ID NO: 590763 - RNA, 19 nt, Homo sapiens
aagaggagaccauugaguu

SEQ ID NO: 590764 - RNA, 19 nt, Homo sapiens
ugaagaggaugggaagaca

SEQ ID NO: 590765 - RNA, 19 nt, Homo sapiens
cagcauuuccguugaagga

SEQ ID NO: 590766 - RNA, 19 nt, Homo sapiens
ccaaagccucaaaggaauu

SEQ ID NO: 590767 - RNA, 19 nt, Homo sapiens
gagacuacuugugugugaa

SEQ ID NO: 590768 - RNA, 19 nt, Homo sapiens
ggacaagaagaguuugaag

SEQ ID NO: 590769 - RNA, 19 nt, Homo sapiens
ggacccgaccgacuugaga

SEQ ID NO: 590770 - RNA, 19 nt, Homo sapiens
gagcgaggaagaauuacug

SEQ ID NO: 590771 - RNA, 19 nt, Homo sapiens
uaugugcguuggucuccua

SEQ ID NO: 590772 - RNA, 19 nt, Homo sapiens
acaaguauaugacgaucag

SEQ ID NO: 590773 - RNA, 19 nt, Homo sapiens
uuacggauuuugacaagua

SEQ ID NO: 590774 - RNA, 19 nt, Homo sapiens
gagaaggcgcaccaugaug

SEQ ID NO: 590775 - RNA, 19 nt, Homo sapiens
cuaagaucuuugaacagaa

SEQ ID NO: 590776 - RNA, 19 nt, Homo sapiens
cugggugccugaagacaaa

SEQ ID NO: 590777 - RNA, 19 nt, Homo sapiens
ucuaugaaacuccuucuau

SEQ ID NO: 590778 - RNA, 19 nt, Homo sapiens
agaauuacugggagaugua

SEQ ID NO: 590779 - RNA, 19 nt, Homo sapiens
acacagccgagcagcauuu

SEQ ID NO: 590780 - RNA, 19 nt, Homo sapiens
cguuggcuccgaagacuua

SEQ ID NO: 590781 - RNA, 19 nt, Homo sapiens
uccaaagccucaaaggaau

SEQ ID NO: 590782 - RNA, 19 nt, Homo sapiens
gaggcagaaugcagagauc

SEQ ID NO: 590783 - RNA, 19 nt, Homo sapiens
ucaaagaccuggggaacuu

SEQ ID NO: 590784 - RNA, 19 nt, Homo sapiens
guacacagccgagcagcau

SEQ ID NO: 590785 - RNA, 19 nt, Homo sapiens
ggacugcacggucaugaac

SEQ ID NO: 590786 - RNA, 19 nt, Homo sapiens
ucaaugagcugauggauau

SEQ ID NO: 590787 - RNA, 19 nt, Homo sapiens
ggaccuaccucuucaccua

SEQ ID NO: 590788 - RNA, 19 nt, Homo sapiens
ggaugaagaugcugagaaa

SEQ ID NO: 590789 - RNA, 19 nt, Homo sapiens
ggacaaagcuaagaagaag

SEQ ID NO: 590790 - RNA, 19 nt, Homo sapiens
agaagaagaugaacaagaa

SEQ ID NO: 590791 - RNA, 19 nt, Homo sapiens
ggacacagguuccacaucu

SEQ ID NO: 590792 - RNA, 19 nt, Homo sapiens
gaagauaccaagagaguug

SEQ ID NO: 590793 - RNA, 19 nt, Homo sapiens
acgaauggaugaagaauuu

SEQ ID NO: 590794 - RNA, 19 nt, Homo sapiens
ucaagaaacugaaugagau

SEQ ID NO: 590795 - RNA, 19 nt, Homo sapiens
gaagaugaaugggaaagug

SEQ ID NO: 590796 - RNA, 19 nt, Homo sapiens
gcugauggauauccuguuu

SEQ ID NO: 590797 - RNA, 19 nt, Homo sapiens
ggaagaagaagaugaacaa

SEQ ID NO: 590798 - RNA, 19 nt, Homo sapiens
gggaggagcucgucaccaa

SEQ ID NO: 590799 - RNA, 19 nt, Homo sapiens
gcacaccuacuacaaguuu

SEQ ID NO: 590800 - RNA, 19 nt, Homo sapiens
gagcgaggaugaagaagau

SEQ ID NO: 590801 - RNA, 19 nt, Homo sapiens
gaaacugaaugagauccua

SEQ ID NO: 590802 - RNA, 19 nt, Homo sapiens
aaagauggaugaugaagau

SEQ ID NO: 590803 - RNA, 19 nt, Homo sapiens
ugaagaagauaccaagaga

SEQ ID NO: 590804 - RNA, 19 nt, Homo sapiens
ccaagugccuggaagaguu

SEQ ID NO: 590805 - RNA, 19 nt, Homo sapiens
gaaggcagccgagaagaaa

SEQ ID NO: 590806 - RNA, 19 nt, Homo sapiens
ggacucggcuguguugaug

SEQ ID NO: 590807 - RNA, 19 nt, Homo sapiens
gaagaagcacgacaggaaa

SEQ ID NO: 590808 - RNA, 19 nt, Homo sapiens
uuaaugagcuuugggaaga

SEQ ID NO: 590809 - RNA, 19 nt, Homo sapiens
cuacugagcucuccacucu

SEQ ID NO: 590810 - RNA, 19 nt, Homo sapiens
ggaagugccuggacugcau

SEQ ID NO: 590811 - RNA, 19 nt, Homo sapiens
gaucacccaugcuguuguu

SEQ ID NO: 590812 - RNA, 19 nt, Homo sapiens
cuagaggacuaucuuaaug

SEQ ID NO: 590813 - RNA, 19 nt, Homo sapiens
ggagagggcgucauuguca

SEQ ID NO: 590814 - RNA, 19 nt, Homo sapiens
gcgcuggccucaagauuuc

SEQ ID NO: 590815 - RNA, 19 nt, Homo sapiens
gaagaaacgggaggacaaa

SEQ ID NO: 590816 - RNA, 19 nt, Homo sapiens
gccaaggccugaccaagga

SEQ ID NO: 590817 - RNA, 19 nt, Homo sapiens
ggaugaagaauuuaccaaa

SEQ ID NO: 590818 - RNA, 19 nt, Homo sapiens
guccguggcugcauccuaa

SEQ ID NO: 590819 - RNA, 19 nt, Homo sapiens
uaucaucgccucucucuau

SEQ ID NO: 590820 - RNA, 19 nt, Homo sapiens
gaagggaagaagaagauga

SEQ ID NO: 590821 - RNA, 19 nt, Homo sapiens
uuaggaagauccaggaaga

SEQ ID NO: 590822 - RNA, 19 nt, Homo sapiens
ccacagaugaggacaagaa

SEQ ID NO: 590823 - RNA, 19 nt, Homo sapiens
guguugagcccauucauuu

SEQ ID NO: 590824 - RNA, 19 nt, Homo sapiens
gaagauccaggaagaguca

SEQ ID NO: 590825 - RNA, 19 nt, Homo sapiens
gaggaggucugccgcaucu

SEQ ID NO: 590826 - RNA, 19 nt, Homo sapiens
cccauucauuugcugauua

SEQ ID NO: 590827 - RNA, 19 nt, Homo sapiens
gucaagaucaaguucaaua

SEQ ID NO: 590828 - RNA, 19 nt, Homo sapiens
gcauggagacgcugucaga

SEQ ID NO: 590829 - RNA, 19 nt, Homo sapiens
gaggagcugaccaaccuua

SEQ ID NO: 590830 - RNA, 19 nt, Homo sapiens
acacaaggcucagaugaag

SEQ ID NO: 590831 - RNA, 19 nt, Homo sapiens
cagaagauuccgaagauga

SEQ ID NO: 590832 - RNA, 19 nt, Homo sapiens
gagagacugugcaaguaca

SEQ ID NO: 590833 - RNA, 19 nt, Homo sapiens
agaagaagcacgacaggaa

SEQ ID NO: 590834 - RNA, 19 nt, Homo sapiens
gauaaggaagggaagaaga

SEQ ID NO: 590835 - RNA, 19 nt, Homo sapiens
uggagagacugugcaagua

SEQ ID NO: 590836 - RNA, 19 nt, Homo sapiens
ggaacgaauggaugaagaa

SEQ ID NO: 590837 - RNA, 19 nt, Homo sapiens
gagagggcgucauugucaa

SEQ ID NO: 590838 - RNA, 19 nt, Homo sapiens
cagaugaggaugaggauga

SEQ ID NO: 590839 - RNA, 19 nt, Homo sapiens
cagaugaagaggugaauug

SEQ ID NO: 590840 - RNA, 19 nt, Homo sapiens
cauccuaacucugguggaa

SEQ ID NO: 590841 - RNA, 19 nt, Homo sapiens
caacugcugguucagauug

SEQ ID NO: 590842 - RNA, 19 nt, Homo sapiens
gaggaagaagggaaacaaa

SEQ ID NO: 590843 - RNA, 19 nt, Homo sapiens
guaaugccaugaagauucg

SEQ ID NO: 590844 - RNA, 19 nt, Homo sapiens
ucaaugagaagaugaaugg

SEQ ID NO: 590845 - RNA, 19 nt, Homo sapiens
cuacaaguuugauuacaag

SEQ ID NO: 590846 - RNA, 19 nt, Homo sapiens
ccuacuacaaguuugauua

SEQ ID NO: 590847 - RNA, 19 nt, Homo sapiens
gcggagugccguugguuaa

SEQ ID NO: 590848 - RNA, 19 nt, Homo sapiens
uggcugaccuagaggacua

SEQ ID NO: 590849 - RNA, 19 nt, Homo sapiens
ccaugaagauucgugaugu

SEQ ID NO: 590850 - RNA, 19 nt, Homo sapiens
gauauccuguuugcaaauc

SEQ ID NO: 590851 - RNA, 19 nt, Homo sapiens
ggaggaggaggacaaugaa

SEQ ID NO: 590852 - RNA, 19 nt, Homo sapiens
aaaccgcgcuggccucaag

SEQ ID NO: 590853 - RNA, 19 nt, Homo sapiens
gaagauaaggaagggaaga

SEQ ID NO: 590854 - RNA, 19 nt, Homo sapiens
gacacaaggcucagaugaa

SEQ ID NO: 590855 - RNA, 19 nt, Homo sapiens
ggacaacauucagcaugca

SEQ ID NO: 590856 - RNA, 19 nt, Homo sapiens
gagcaagaccaggcagaaa

SEQ ID NO: 590857 - RNA, 19 nt, Homo sapiens
gauuucgagucccauauca

SEQ ID NO: 590858 - RNA, 19 nt, Homo sapiens
gaagaugaacaagaacaau

SEQ ID NO: 590859 - RNA, 19 nt, Homo sapiens
gaccuagaggacuaucuua

SEQ ID NO: 590860 - RNA, 19 nt, Homo sapiens
gaugaagaggugaauugaa

SEQ ID NO: 590861 - RNA, 19 nt, Homo sapiens
ccauucauuugcugauuau

SEQ ID NO: 590862 - RNA, 19 nt, Homo sapiens
cagugcagauccuuuacaa

SEQ ID NO: 590863 - RNA, 19 nt, Homo sapiens
gaacgaauggaugaagaau

SEQ ID NO: 590864 - RNA, 19 nt, Homo sapiens
caagaaggcagccgagaag

SEQ ID NO: 590865 - RNA, 19 nt, Homo sapiens
ggaggaagaagggaaacaa

SEQ ID NO: 590866 - RNA, 19 nt, Homo sapiens
cauccuggcugaccuagag

SEQ ID NO: 590867 - RNA, 19 nt, Homo sapiens
gcugagcgaggaugaagaa

SEQ ID NO: 590868 - RNA, 19 nt, Homo sapiens
ggacuaucuuaaugagcuu

SEQ ID NO: 590869 - RNA, 19 nt, Homo sapiens
caagaucaaguucaauauc

SEQ ID NO: 590870 - RNA, 19 nt, Homo sapiens
aguuugagcuccugggaaa

SEQ ID NO: 590871 - RNA, 19 nt, Homo sapiens
gaggacaaagcuaagaaga

SEQ ID NO: 590872 - RNA, 19 nt, Homo sapiens
gaagaagaaaucagaagcu

SEQ ID NO: 590873 - RNA, 19 nt, Homo sapiens
gcaaccaggagcaggagaa

SEQ ID NO: 590874 - RNA, 19 nt, Homo sapiens
gaccggauccgcacaugug

SEQ ID NO: 590875 - RNA, 19 nt, Homo sapiens
uaacucugguggaacgaau

SEQ ID NO: 590876 - RNA, 19 nt, Homo sapiens
uggauauccuguuugcaaa

SEQ ID NO: 590877 - RNA, 19 nt, Homo sapiens
aagaguacguggagcacuu

SEQ ID NO: 590878 - RNA, 19 nt, Homo sapiens
guuugcaaaucccaacauu

SEQ ID NO: 590879 - RNA, 19 nt, Homo sapiens
ucgccucucucuaugacua

SEQ ID NO: 590880 - RNA, 19 nt, Homo sapiens
agauugagcugcugcaacu

SEQ ID NO: 590881 - RNA, 19 nt, Homo sapiens
gauggaugaugaagaugag

SEQ ID NO: 590882 - RNA, 19 nt, Homo sapiens
gucagaagauccgaaaaua

SEQ ID NO: 590883 - RNA, 19 nt, Homo sapiens
caacacagacaguggugau

SEQ ID NO: 590884 - RNA, 19 nt, Homo sapiens
ccacuugcaggacaacauu

SEQ ID NO: 590885 - RNA, 19 nt, Homo sapiens
ccaggugugugccaucauc

SEQ ID NO: 590886 - RNA, 19 nt, Homo sapiens
gauaagagguacacaaaua

SEQ ID NO: 590887 - RNA, 19 nt, Homo sapiens
gcaaauaccucauccucaa

SEQ ID NO: 590888 - RNA, 19 nt, Homo sapiens
gaaaugggaucagaaauca

SEQ ID NO: 590889 - RNA, 19 nt, Homo sapiens
ccacggagcugaagaacaa

SEQ ID NO: 590890 - RNA, 19 nt, Homo sapiens
gagaugauauugaccuuau

SEQ ID NO: 590891 - RNA, 19 nt, Homo sapiens
gaaacgcaguaacggauuu

SEQ ID NO: 590892 - RNA, 19 nt, Homo sapiens
ggaagaagaggaagaagaa

SEQ ID NO: 590893 - RNA, 19 nt, Homo sapiens
guucaagccuaaugaguuu

SEQ ID NO: 590894 - RNA, 19 nt, Homo sapiens
gaucagaaaucacagaaac

SEQ ID NO: 590895 - RNA, 19 nt, Homo sapiens
ggaauguguuugccacuga

SEQ ID NO: 590896 - RNA, 19 nt, Homo sapiens
caaaggagaucggcuagga

SEQ ID NO: 590897 - RNA, 19 nt, Homo sapiens
gguggaagcuuggagauga

SEQ ID NO: 590898 - RNA, 19 nt, Homo sapiens
gcagaaaugggaucagaaa

SEQ ID NO: 590899 - RNA, 19 nt, Homo sapiens
gcgcgcauguuuccucuuu

SEQ ID NO: 590900 - RNA, 19 nt, Homo sapiens
caaccuacaucaaccacaa

SEQ ID NO: 590901 - RNA, 19 nt, Homo sapiens
gaagaugcgcuacuuggaa

SEQ ID NO: 590902 - RNA, 19 nt, Homo sapiens
uaaguacuccucucaguuu

SEQ ID NO: 590903 - RNA, 19 nt, Homo sapiens
ggagccacauaccaagaua

SEQ ID NO: 590904 - RNA, 19 nt, Homo sapiens
ggaagaagaagaggaagaa

SEQ ID NO: 590905 - RNA, 19 nt, Homo sapiens
gucagaagcuggacucuca

SEQ ID NO: 590906 - RNA, 19 nt, Homo sapiens
gaagaggaagaaacuuaaa

SEQ ID NO: 590907 - RNA, 19 nt, Homo sapiens
aagaagaggaagaaacuua

SEQ ID NO: 590908 - RNA, 19 nt, Homo sapiens
cgacauggauaagaaugaa

SEQ ID NO: 590909 - RNA, 19 nt, Homo sapiens
ugagugagacugccaauga

SEQ ID NO: 590910 - RNA, 19 nt, Homo sapiens
cgagggccuuugaugcuua

SEQ ID NO: 590911 - RNA, 19 nt, Homo sapiens
gaaagagagagaacgcauu

SEQ ID NO: 590912 - RNA, 19 nt, Homo sapiens
agaaugaaaucgccucugu

SEQ ID NO: 590913 - RNA, 19 nt, Homo sapiens
cacaggacauugaguguug

SEQ ID NO: 590914 - RNA, 19 nt, Homo sapiens
caaauaaguacuccucuca

SEQ ID NO: 590915 - RNA, 19 nt, Homo sapiens
gaagauggcaaaguucaug

SEQ ID NO: 590916 - RNA, 19 nt, Homo sapiens
ggaaggaaagauacaacuu

SEQ ID NO: 590917 - RNA, 19 nt, Homo sapiens
uaagagugccaaacagaaa

SEQ ID NO: 590918 - RNA, 19 nt, Homo sapiens
ccgaggccauugcagauuu

SEQ ID NO: 590919 - RNA, 19 nt, Homo sapiens
ggaggaagaagaggaagaa

SEQ ID NO: 590920 - RNA, 19 nt, Homo sapiens
gaugauauugaccuuauug

SEQ ID NO: 590921 - RNA, 19 nt, Homo sapiens
gaagcgggagagcaguuua

SEQ ID NO: 590922 - RNA, 19 nt, Homo sapiens
gauaccgccugacguagug

SEQ ID NO: 590923 - RNA, 19 nt, Homo sapiens
caagauaagagguacacaa

SEQ ID NO: 590924 - RNA, 19 nt, Homo sapiens
caagagugcugcugcuaac

SEQ ID NO: 590925 - RNA, 19 nt, Homo sapiens
uggaaugugugucuaacuu

SEQ ID NO: 590926 - RNA, 19 nt, Homo sapiens
ggagaugauauugaccuua

SEQ ID NO: 590927 - RNA, 19 nt, Homo sapiens
gaaccuccgcagagacaaa

SEQ ID NO: 590928 - RNA, 19 nt, Homo sapiens
ugucuaacuugcucucuga

SEQ ID NO: 590929 - RNA, 19 nt, Homo sapiens
ggaagaggaggaggaagaa

SEQ ID NO: 590930 - RNA, 19 nt, Homo sapiens
gaagaacaacagcuacaag

SEQ ID NO: 590931 - RNA, 19 nt, Homo sapiens
gagacaacucugacuuuga

SEQ ID NO: 590932 - RNA, 19 nt, Homo sapiens
gacaggagccacauaccaa

SEQ ID NO: 590933 - RNA, 19 nt, Homo sapiens
ggaaugugugucuaacuug

SEQ ID NO: 590934 - RNA, 19 nt, Homo sapiens
ggaggaggaagaagaggaa

SEQ ID NO: 590935 - RNA, 19 nt, Homo sapiens
ccuagaauacuacgacaaa

SEQ ID NO: 590936 - RNA, 19 nt, Homo sapiens
agagguacacaaauaagua

SEQ ID NO: 590937 - RNA, 19 nt, Homo sapiens
uaacuugcucucugacauu

SEQ ID NO: 590938 - RNA, 19 nt, Homo sapiens
gaagaagaagaggaagaaa

SEQ ID NO: 590939 - RNA, 19 nt, Homo sapiens
gaagcuuggagaugauauu

SEQ ID NO: 590940 - RNA, 19 nt, Homo sapiens
agacaacucugacuuugac

SEQ ID NO: 590941 - RNA, 19 nt, Homo sapiens
aagauaagagguacacaaa

SEQ ID NO: 590942 - RNA, 19 nt, Homo sapiens
agaagaggaagaaacuuaa

SEQ ID NO: 590943 - RNA, 19 nt, Homo sapiens
ugaugaagaugaggaggaa

SEQ ID NO: 590944 - RNA, 19 nt, Homo sapiens
ccacauaccaagauaagag

SEQ ID NO: 590945 - RNA, 19 nt, Homo sapiens
gaaugaaaucgccucuguu

SEQ ID NO: 590946 - RNA, 19 nt, Homo sapiens
cuacaucaaccacaauuuc

SEQ ID NO: 590947 - RNA, 19 nt, Homo sapiens
gagcaucaagcgcaucuuc

SEQ ID NO: 590948 - RNA, 19 nt, Homo sapiens
ccaaacagaaagagagaga

SEQ ID NO: 590949 - RNA, 19 nt, Homo sapiens
guggaagucaauaugcuua

SEQ ID NO: 590950 - RNA, 19 nt, Homo sapiens
ggacaggagccacauacca

SEQ ID NO: 590951 - RNA, 19 nt, Homo sapiens
ucaagagugcugcugcuaa

SEQ ID NO: 590952 - RNA, 19 nt, Homo sapiens
gaauguguuugccacugau

SEQ ID NO: 590953 - RNA, 19 nt, Homo sapiens
ugaugaagaugcgcuacuu

SEQ ID NO: 590954 - RNA, 19 nt, Homo sapiens
ggaagugaaagaggaaaug

SEQ ID NO: 590955 - RNA, 19 nt, Homo sapiens
caaagaucgucggaacaug

SEQ ID NO: 590956 - RNA, 19 nt, Homo sapiens
gggauuccaggcacuguaa

SEQ ID NO: 590957 - RNA, 19 nt, Homo sapiens
caacaucaagacacucaau

SEQ ID NO: 590958 - RNA, 19 nt, Homo sapiens
aaugaaaucgccucuguug

SEQ ID NO: 590959 - RNA, 19 nt, Homo sapiens
agaaaugggaucagaaauc

SEQ ID NO: 590960 - RNA, 19 nt, Homo sapiens
ggaggaagaggaggaggaa

SEQ ID NO: 590961 - RNA, 19 nt, Homo sapiens
aaagagagagaacgcauuc

SEQ ID NO: 590962 - RNA, 19 nt, Homo sapiens
ccagcggaaucgaaugaga

SEQ ID NO: 590963 - RNA, 19 nt, Homo sapiens
aauaaguacuccucucagu

SEQ ID NO: 590964 - RNA, 19 nt, Homo sapiens
gaaacuuaaaccagugaug

SEQ ID NO: 590965 - RNA, 19 nt, Homo sapiens
ccgccaaguuucagugaug

SEQ ID NO: 590966 - RNA, 19 nt, Homo sapiens
aggacgacauggauaagaa

SEQ ID NO: 590967 - RNA, 19 nt, Homo sapiens
ggaggcaaccuacaucaac

SEQ ID NO: 590968 - RNA, 19 nt, Homo sapiens
caguugaaguucguaguga

SEQ ID NO: 590969 - RNA, 19 nt, Homo sapiens
ggaagcgggagagcaguuu

SEQ ID NO: 590970 - RNA, 19 nt, Homo sapiens
aaacuuaaaccagugaugu

SEQ ID NO: 590971 - RNA, 19 nt, Homo sapiens
caagcuugguuaugugucu

SEQ ID NO: 590972 - RNA, 19 nt, Homo sapiens
ugagcacgauggcgucaug

SEQ ID NO: 590973 - RNA, 19 nt, Homo sapiens
ggacgacauggauaagaau

SEQ ID NO: 590974 - RNA, 19 nt, Homo sapiens
gagugagacugccaaugag

SEQ ID NO: 590975 - RNA, 19 nt, Homo sapiens
ucaguguauuccugggaua

SEQ ID NO: 590976 - RNA, 19 nt, Homo sapiens
ccggauaccgccugacgua

SEQ ID NO: 590977 - RNA, 19 nt, Homo sapiens
cagaaacaauuugggguua

SEQ ID NO: 590978 - RNA, 19 nt, Homo sapiens
gucggaacauguugcaguu

SEQ ID NO: 590979 - RNA, 19 nt, Homo sapiens
gagaucggcuaggaaaggu

SEQ ID NO: 590980 - RNA, 19 nt, Homo sapiens
gugaugaacgcccucuuug

SEQ ID NO: 590981 - RNA, 19 nt, Homo sapiens
gaagaagaggaagaaacuu

SEQ ID NO: 590982 - RNA, 19 nt, Homo sapiens
cccagcaguucaagccuaa

SEQ ID NO: 590983 - RNA, 19 nt, Homo sapiens
gcuuggagaugauauugac

SEQ ID NO: 590984 - RNA, 19 nt, Homo sapiens
cggguggaccuucgcuuua

SEQ ID NO: 590985 - RNA, 19 nt, Homo sapiens
guguauuccugggauauug

SEQ ID NO: 590986 - RNA, 19 nt, Homo sapiens
gauagucaguuguguguga

SEQ ID NO: 590987 - RNA, 19 nt, Homo sapiens
ugaaguggcuguugacaug

SEQ ID NO: 590988 - RNA, 19 nt, Homo sapiens
gaguugaccugaucaugaa

SEQ ID NO: 590989 - RNA, 19 nt, Homo sapiens
ugaguacaguguugcaaua

SEQ ID NO: 590990 - RNA, 19 nt, Homo sapiens
ggaguugaccugaucauga

SEQ ID NO: 590991 - RNA, 19 nt, Homo sapiens
ggaauuugcuaagaauaug

SEQ ID NO: 590992 - RNA, 19 nt, Homo sapiens
guugggaacugucgacaaa

SEQ ID NO: 590993 - RNA, 19 nt, Homo sapiens
gaauauguaugaacugcau

SEQ ID NO: 590994 - RNA, 19 nt, Homo sapiens
ggacacaagucuccagaac

SEQ ID NO: 590995 - RNA, 19 nt, Homo sapiens
caguggaggucaccaauug

SEQ ID NO: 590996 - RNA, 19 nt, Homo sapiens
caacaucaaugaccuuuug

SEQ ID NO: 590997 - RNA, 19 nt, Homo sapiens
ugauuggacucucaaguga

SEQ ID NO: 590998 - RNA, 19 nt, Homo sapiens
ggaggucaccaauugcuuu

SEQ ID NO: 590999 - RNA, 19 nt, Homo sapiens
gcaauaugcagaggaugua

SEQ ID NO: 591000 - RNA, 19 nt, Homo sapiens
gacauggaauuugcuaaga

SEQ ID NO: 591001 - RNA, 19 nt, Homo sapiens
guacaguguugcaauaugc

SEQ ID NO: 591002 - RNA, 19 nt, Homo sapiens
gcacaaugagucagaagau

SEQ ID NO: 591003 - RNA, 19 nt, Homo sapiens
aagaugaaguggcuguuga

SEQ ID NO: 591004 - RNA, 19 nt, Homo sapiens
caucggaguugaccugauc

SEQ ID NO: 591005 - RNA, 19 nt, Homo sapiens
gaagaugaaguggcuguug

SEQ ID NO: 591006 - RNA, 19 nt, Homo sapiens
gagauagucaguugugugu

SEQ ID NO: 591007 - RNA, 19 nt, Homo sapiens
cauggaauuugcuaagaau

SEQ ID NO: 591008 - RNA, 19 nt, Homo sapiens
gaggauguacugucuggaa

SEQ ID NO: 591009 - RNA, 19 nt, Homo sapiens
gaucaugaagaccugcuuu

SEQ ID NO: 591010 - RNA, 19 nt, Homo sapiens
acauggaauuugcuaagaa

SEQ ID NO: 591011 - RNA, 19 nt, Homo sapiens
gaauggaccccaagcagua

SEQ ID NO: 591012 - RNA, 19 nt, Homo sapiens
acucugugcugauccauga

SEQ ID NO: 591013 - RNA, 19 nt, Homo sapiens
aaacggagccuaccuuuug

SEQ ID NO: 591014 - RNA, 19 nt, Homo sapiens
acaaugagucagaagauga

SEQ ID NO: 591015 - RNA, 19 nt, Homo sapiens
caaugagucagaagaugaa

SEQ ID NO: 591016 - RNA, 19 nt, Homo sapiens
cacaaugagucagaagaug

SEQ ID NO: 591017 - RNA, 19 nt, Homo sapiens
agucacagauugcacucaa

SEQ ID NO: 591018 - RNA, 19 nt, Homo sapiens
gugauuggacucucaagug

SEQ ID NO: 591019 - RNA, 19 nt, Homo sapiens
aagccuacgucagcacuuu

SEQ ID NO: 591020 - RNA, 19 nt, Homo sapiens
ucaacagcaacaucaauga

SEQ ID NO: 591021 - RNA, 19 nt, Homo sapiens
gcucaacagcaacaucaau

SEQ ID NO: 591022 - RNA, 19 nt, Homo sapiens
gggaggaccaugggaguga

SEQ ID NO: 591023 - RNA, 19 nt, Homo sapiens
gugugugacucuaauaaac

SEQ ID NO: 591024 - RNA, 19 nt, Homo sapiens
ugggaacugucgacaaaca

SEQ ID NO: 591025 - RNA, 19 nt, Homo sapiens
gauguacugucuggaaagg

SEQ ID NO: 591026 - RNA, 19 nt, Homo sapiens
gcugauccaugaguacuac

SEQ ID NO: 591027 - RNA, 19 nt, Homo sapiens
ugaccuaccuggccaaccu

SEQ ID NO: 591028 - RNA, 19 nt, Homo sapiens
aggauguacugucuggaaa

SEQ ID NO: 591029 - RNA, 19 nt, Homo sapiens
ucaguugugugugacucua

SEQ ID NO: 591030 - RNA, 19 nt, Homo sapiens
ugacauggaauuugcuaag

SEQ ID NO: 591031 - RNA, 19 nt, Homo sapiens
uugcuggucuagguauuaa

SEQ ID NO: 591032 - RNA, 19 nt, Homo sapiens
gauguucacgccucugaca

SEQ ID NO: 591033 - RNA, 19 nt, Homo sapiens
ggaggaccaugggagugau

SEQ ID NO: 591034 - RNA, 19 nt, Homo sapiens
gcuaagaauauguaugaac

SEQ ID NO: 591035 - RNA, 19 nt, Homo sapiens
ccucacacagucacagauu

SEQ ID NO: 591036 - RNA, 19 nt, Homo sapiens
gaguacaguguugcaauau

SEQ ID NO: 591037 - RNA, 19 nt, Homo sapiens
cuacgucagcacuuuaaug

SEQ ID NO: 591038 - RNA, 19 nt, Homo sapiens
ugagucagaagaugaagug

SEQ ID NO: 591039 - RNA, 19 nt, Homo sapiens
caguacacuugcuggucua

SEQ ID NO: 591040 - RNA, 19 nt, Homo sapiens
gagucacacugagauaguc

SEQ ID NO: 591041 - RNA, 19 nt, Homo sapiens
gcaucggaguugaccugau

SEQ ID NO: 591042 - RNA, 19 nt, Homo sapiens
gaccaugggagugauguuc

SEQ ID NO: 591043 - RNA, 19 nt, Homo sapiens
gcuguugacauggaauuug

SEQ ID NO: 591044 - RNA, 19 nt, Homo sapiens
auaaacggagccuaccuuu

SEQ ID NO: 591045 - RNA, 19 nt, Homo sapiens
caacagcaacaucaaugac

SEQ ID NO: 591046 - RNA, 19 nt, Homo sapiens
ggucaccaauugcuuuuca

SEQ ID NO: 591047 - RNA, 19 nt, Homo sapiens
ccgaugacuuugagaccau

SEQ ID NO: 591048 - RNA, 19 nt, Homo sapiens
cuuguaaaccugugaaugg

SEQ ID NO: 591049 - RNA, 19 nt, Homo sapiens
ucaguggaggucaccaauu

SEQ ID NO: 591050 - RNA, 19 nt, Homo sapiens
aguacaguguugcaauaug

SEQ ID NO: 591051 - RNA, 19 nt, Homo sapiens
gcaagaaguucaagauugu

SEQ ID NO: 591052 - RNA, 19 nt, Homo sapiens
uaaagcagcuccacucuca

SEQ ID NO: 591053 - RNA, 19 nt, Homo sapiens
uaaagacagugacagagua

SEQ ID NO: 591054 - RNA, 19 nt, Homo sapiens
ggcaagaaguucaagauug

SEQ ID NO: 591055 - RNA, 19 nt, Homo sapiens
gcaucuaccuggcuaagga

SEQ ID NO: 591056 - RNA, 19 nt, Homo sapiens
gaacaagacagggaaguau

SEQ ID NO: 591057 - RNA, 19 nt, Homo sapiens
ggucaucaacggaaacaua

SEQ ID NO: 591058 - RNA, 19 nt, Homo sapiens
gcaaagaggaccugaacug

SEQ ID NO: 591059 - RNA, 19 nt, Homo sapiens
ggaggacccuaugaacaaa

SEQ ID NO: 591060 - RNA, 19 nt, Homo sapiens
ggaaacauaaagacaguga

SEQ ID NO: 591061 - RNA, 19 nt, Homo sapiens
aggaagaacuggaagaagu

SEQ ID NO: 591062 - RNA, 19 nt, Homo sapiens
ggaggaagaacuggaagaa

SEQ ID NO: 591063 - RNA, 19 nt, Homo sapiens
ugacagaguacaagauaga

SEQ ID NO: 591064 - RNA, 19 nt, Homo sapiens
guccgcaccuucaggauug

SEQ ID NO: 591065 - RNA, 19 nt, Homo sapiens
caacggaaacauaaagaca

SEQ ID NO: 591066 - RNA, 19 nt, Homo sapiens
gaggaggacccuaugaaca

SEQ ID NO: 591067 - RNA, 19 nt, Homo sapiens
cagaguacaagauagauga

SEQ ID NO: 591068 - RNA, 19 nt, Homo sapiens
caagaccacuggccaaucc

SEQ ID NO: 591069 - RNA, 19 nt, Homo sapiens
caaggaggaagaacuggaa

SEQ ID NO: 591070 - RNA, 19 nt, Homo sapiens
gucaucaacggaaacauaa

SEQ ID NO: 591071 - RNA, 19 nt, Homo sapiens
gaggauggcaagaaguuca

SEQ ID NO: 591072 - RNA, 19 nt, Homo sapiens
aaacauaaagacagugaca

SEQ ID NO: 591073 - RNA, 19 nt, Homo sapiens
gaggaggaggacccuauga

SEQ ID NO: 591074 - RNA, 19 nt, Homo sapiens
ccaagccguccaccaacua

SEQ ID NO: 591075 - RNA, 19 nt, Homo sapiens
cagcugggccugucuacug

SEQ ID NO: 591076 - RNA, 19 nt, Homo sapiens
ugacguucaucaccagcaa

SEQ ID NO: 591077 - RNA, 19 nt, Homo sapiens
aagcagcuccacucucaaa

SEQ ID NO: 591078 - RNA, 19 nt, Homo sapiens
gagcagcugggccugucua

SEQ ID NO: 591079 - RNA, 19 nt, Homo sapiens
ggaggaggacccuaugaac

SEQ ID NO: 591080 - RNA, 19 nt, Homo sapiens
cagugacgaugucucuaug

SEQ ID NO: 591081 - RNA, 19 nt, Homo sapiens
agugacagaguacaagaua

SEQ ID NO: 591082 - RNA, 19 nt, Homo sapiens
acauaaagacagugacaga

SEQ ID NO: 591083 - RNA, 19 nt, Homo sapiens
caagccguccaccaacuaa

SEQ ID NO: 591084 - RNA, 19 nt, Homo sapiens
agaacaagacagggaagua

SEQ ID NO: 591085 - RNA, 19 nt, Homo sapiens
ggaggaggaggacccuaug

SEQ ID NO: 591086 - RNA, 19 nt, Homo sapiens
ucagugacgaugucucuau

SEQ ID NO: 591087 - RNA, 19 nt, Homo sapiens
gggaggacgacaaaugugu

SEQ ID NO: 591088 - RNA, 19 nt, Homo sapiens
ucagaggacacgcgugaga

SEQ ID NO: 591089 - RNA, 19 nt, Homo sapiens
aggaggacccuaugaacaa

SEQ ID NO: 591090 - RNA, 19 nt, Homo sapiens
caucaacggaaacauaaag

SEQ ID NO: 591091 - RNA, 19 nt, Homo sapiens
guacaagauagaugaggau

SEQ ID NO: 591092 - RNA, 19 nt, Homo sapiens
gaucgugcgcgugccauug

SEQ ID NO: 591093 - RNA, 19 nt, Homo sapiens
cagcaaagaggaccugaac

SEQ ID NO: 591094 - RNA, 19 nt, Homo sapiens
uagaugaggauggcaagaa

SEQ ID NO: 591095 - RNA, 19 nt, Homo sapiens
gacaagaccacuggccaau

SEQ ID NO: 591096 - RNA, 19 nt, Homo sapiens
aaacucaagggccagaaga

SEQ ID NO: 591097 - RNA, 19 nt, Homo sapiens
uggcaagaaguucaagauu

SEQ ID NO: 591098 - RNA, 19 nt, Homo sapiens
agaugaggauggcaagaag

SEQ ID NO: 591099 - RNA, 19 nt, Homo sapiens
gccaagccguccaccaacu

SEQ ID NO: 591100 - RNA, 19 nt, Homo sapiens
acaagacagggaaguaugu

SEQ ID NO: 591101 - RNA, 19 nt, Homo sapiens
gugacagaguacaagauag

SEQ ID NO: 591102 - RNA, 19 nt, Homo sapiens
guucaucaccagcaaagag

SEQ ID NO: 591103 - RNA, 19 nt, Homo sapiens
agacagugacagaguacaa

SEQ ID NO: 591104 - RNA, 19 nt, Homo sapiens
acggaaacauaaagacagu

SEQ ID NO: 591105 - RNA, 19 nt, Homo sapiens
gaagaucggcuugaaauua

SEQ ID NO: 591106 - RNA, 19 nt, Homo sapiens
gaagucagcuguugcagau

SEQ ID NO: 591107 - RNA, 19 nt, Homo sapiens
ccaaggaucucucucacua

SEQ ID NO: 591108 - RNA, 19 nt, Homo sapiens
gcagauagauggccuugug

SEQ ID NO: 591109 - RNA, 19 nt, Homo sapiens
gauggaaguuuguaaagaa

SEQ ID NO: 591110 - RNA, 19 nt, Homo sapiens
gaagaagugccgauuguaa

SEQ ID NO: 591111 - RNA, 19 nt, Homo sapiens
gagccaagauauaguuaaa

SEQ ID NO: 591112 - RNA, 19 nt, Homo sapiens
gaaaugagccaagauauag

SEQ ID NO: 591113 - RNA, 19 nt, Homo sapiens
gcacagaggauuucuuuag

SEQ ID NO: 591114 - RNA, 19 nt, Homo sapiens
ggacagaguggaugaaaug

SEQ ID NO: 591115 - RNA, 19 nt, Homo sapiens
gaugaaaugagccaagaua

SEQ ID NO: 591116 - RNA, 19 nt, Homo sapiens
gaggauuucuuuaguguca

SEQ ID NO: 591117 - RNA, 19 nt, Homo sapiens
gaagugccgauuguaauua

SEQ ID NO: 591118 - RNA, 19 nt, Homo sapiens
guacauguuugaagaagug

SEQ ID NO: 591119 - RNA, 19 nt, Homo sapiens
ugaaaugagccaagauaua

SEQ ID NO: 591120 - RNA, 19 nt, Homo sapiens
gaaaagaagucagcuguug

SEQ ID NO: 591121 - RNA, 19 nt, Homo sapiens
uacuauggcucauucguua

SEQ ID NO: 591122 - RNA, 19 nt, Homo sapiens
gaggaauacuaguaaacaa

SEQ ID NO: 591123 - RNA, 19 nt, Homo sapiens
ggaagaaucuacaguugcu

SEQ ID NO: 591124 - RNA, 19 nt, Homo sapiens
cauacagacugacuccuaa

SEQ ID NO: 591125 - RNA, 19 nt, Homo sapiens
gcucauugcaggccagaua

SEQ ID NO: 591126 - RNA, 19 nt, Homo sapiens
guaaacaacagcagcagaa

SEQ ID NO: 591127 - RNA, 19 nt, Homo sapiens
gcauacagacugacuccua

SEQ ID NO: 591128 - RNA, 19 nt, Homo sapiens
gcugguaucaguccacaua

SEQ ID NO: 591129 - RNA, 19 nt, Homo sapiens
caggccagauaaacacuua

SEQ ID NO: 591130 - RNA, 19 nt, Homo sapiens
cuaaaggcauacagacuga

SEQ ID NO: 591131 - RNA, 19 nt, Homo sapiens
gaaucugucguucucauuu

SEQ ID NO: 591132 - RNA, 19 nt, Homo sapiens
gccagaacaucaaggaguu

SEQ ID NO: 591133 - RNA, 19 nt, Homo sapiens
aaucugucguucucauuua

SEQ ID NO: 591134 - RNA, 19 nt, Homo sapiens
ggaugaugcugacuuugau

SEQ ID NO: 591135 - RNA, 19 nt, Homo sapiens
gaagguaccggcucuacug

SEQ ID NO: 591136 - RNA, 19 nt, Homo sapiens
uagauggccuugugguauu

SEQ ID NO: 591137 - RNA, 19 nt, Homo sapiens
ugaagcaagugcagauaga

SEQ ID NO: 591138 - RNA, 19 nt, Homo sapiens
cagaggauuucuuuagugu

SEQ ID NO: 591139 - RNA, 19 nt, Homo sapiens
agucagcuguugcagauaa

SEQ ID NO: 591140 - RNA, 19 nt, Homo sapiens
aaggaucucucucacuaaa

SEQ ID NO: 591141 - RNA, 19 nt, Homo sapiens
gauagauggccuuguggua

SEQ ID NO: 591142 - RNA, 19 nt, Homo sapiens
gaugaaguccaauaucaga

SEQ ID NO: 591143 - RNA, 19 nt, Homo sapiens
ggauuucuuuagugucauu

SEQ ID NO: 591144 - RNA, 19 nt, Homo sapiens
acacauacaugaggaauac

SEQ ID NO: 591145 - RNA, 19 nt, Homo sapiens
agaggaugaugcugacuuu

SEQ ID NO: 591146 - RNA, 19 nt, Homo sapiens
cuauaacagugucuuucua

SEQ ID NO: 591147 - RNA, 19 nt, Homo sapiens
gcagaaacaucaguaucag

SEQ ID NO: 591148 - RNA, 19 nt, Homo sapiens
ggaauacuaguaaacaaca

SEQ ID NO: 591149 - RNA, 19 nt, Homo sapiens
caugaggaauacuaguaaa

SEQ ID NO: 591150 - RNA, 19 nt, Homo sapiens
cuccuggacucucaguuua

SEQ ID NO: 591151 - RNA, 19 nt, Homo sapiens
gcggagccuucgccaugua

SEQ ID NO: 591152 - RNA, 19 nt, Homo sapiens
ucaagaagaaggacaagga

SEQ ID NO: 591153 - RNA, 19 nt, Homo sapiens
ggaucucucucacuaaagg

SEQ ID NO: 591154 - RNA, 19 nt, Homo sapiens
ucugaucaauguccuaaug

SEQ ID NO: 591155 - RNA, 19 nt, Homo sapiens
ugauggaaguuuguaaaga

SEQ ID NO: 591156 - RNA, 19 nt, Homo sapiens
ugaaauuaccaacugcuuu

SEQ ID NO: 591157 - RNA, 19 nt, Homo sapiens
uagaagaucggcuugaaau

SEQ ID NO: 591158 - RNA, 19 nt, Homo sapiens
aagcacagaggauuucuuu

SEQ ID NO: 591159 - RNA, 19 nt, Homo sapiens
guagaagaucggcuugaaa

SEQ ID NO: 591160 - RNA, 19 nt, Homo sapiens
caagaagaaggacaaggaa

SEQ ID NO: 591161 - RNA, 19 nt, Homo sapiens
acagaggauuucuuuagug

SEQ ID NO: 591162 - RNA, 19 nt, Homo sapiens
cacagaggauuucuuuagu

SEQ ID NO: 591163 - RNA, 19 nt, Homo sapiens
uugaguacauguuugaaga

SEQ ID NO: 591164 - RNA, 19 nt, Homo sapiens
cagacugacuccuaaacug

SEQ ID NO: 591165 - RNA, 19 nt, Homo sapiens
gggcacuccuggacucuca

SEQ ID NO: 591166 - RNA, 19 nt, Homo sapiens
aaaggcggcucgggagauu

SEQ ID NO: 591167 - RNA, 19 nt, Homo sapiens
uguagaagaucggcuugaa

SEQ ID NO: 591168 - RNA, 19 nt, Homo sapiens
gaagaaggacaaggaacug

SEQ ID NO: 591169 - RNA, 19 nt, Homo sapiens
aagaucggcuugaaauuac

SEQ ID NO: 591170 - RNA, 19 nt, Homo sapiens
uuagugucauugccgauuu

SEQ ID NO: 591171 - RNA, 19 nt, Homo sapiens
uugaagaagugccgauugu

SEQ ID NO: 591172 - RNA, 19 nt, Homo sapiens
caacagcagcagaaacauc

SEQ ID NO: 591173 - RNA, 19 nt, Homo sapiens
uacaugaggaauacuagua

SEQ ID NO: 591174 - RNA, 19 nt, Homo sapiens
aagugccgauuguaauuaa

SEQ ID NO: 591175 - RNA, 19 nt, Homo sapiens
agacugacuccuaaacuga

SEQ ID NO: 591176 - RNA, 19 nt, Homo sapiens
agauggccuugugguauua

SEQ ID NO: 591177 - RNA, 19 nt, Homo sapiens
guccuaaugugggaacuug

SEQ ID NO: 591178 - RNA, 19 nt, Homo sapiens
agaagugccgauuguaauu

SEQ ID NO: 591179 - RNA, 19 nt, Homo sapiens
caauaucagauggaaauga

SEQ ID NO: 591180 - RNA, 19 nt, Homo sapiens
gaaggacaaggaacugaag

SEQ ID NO: 591181 - RNA, 19 nt, Homo sapiens
uggacucucaguuuaguua

SEQ ID NO: 591182 - RNA, 19 nt, Homo sapiens
aaacauugaucaucuucac

SEQ ID NO: 591183 - RNA, 19 nt, Homo sapiens
cagugucuuucuagccaua

SEQ ID NO: 591184 - RNA, 19 nt, Homo sapiens
gaguacauguuugaagaag

SEQ ID NO: 591185 - RNA, 19 nt, Homo sapiens
caaggaucucucucacuaa

SEQ ID NO: 591186 - RNA, 19 nt, Homo sapiens
gaugcugacuuugaugaag

SEQ ID NO: 591187 - RNA, 19 nt, Homo sapiens
aaauaucaccuuugaguac

SEQ ID NO: 591188 - RNA, 19 nt, Homo sapiens
cacgugggcugguaucagu

SEQ ID NO: 591189 - RNA, 19 nt, Homo sapiens
gcacacagaggaugaugcu

SEQ ID NO: 591190 - RNA, 19 nt, Homo sapiens
ggcuugaaauuaccaacug

SEQ ID NO: 591191 - RNA, 19 nt, Homo sapiens
gcagcagaaacaucaguau

SEQ ID NO: 591192 - RNA, 19 nt, Homo sapiens
uggaugaaaugagccaaga

SEQ ID NO: 591193 - RNA, 19 nt, Homo sapiens
ugaagaagugccgauugua

SEQ ID NO: 591194 - RNA, 19 nt, Homo sapiens
cuccuaaacugauggaagu

SEQ ID NO: 591195 - RNA, 19 nt, Homo sapiens
gcaugccauugaagaaucu

SEQ ID NO: 591196 - RNA, 19 nt, Homo sapiens
uuaccagcaugccauugaa

SEQ ID NO: 591197 - RNA, 19 nt, Homo sapiens
guuaccagcaugccauuga

SEQ ID NO: 591198 - RNA, 19 nt, Homo sapiens
guaaacauugaucaucuuc

SEQ ID NO: 591199 - RNA, 19 nt, Homo sapiens
aaacuuaggcaagcucuuc

SEQ ID NO: 591200 - RNA, 19 nt, Homo sapiens
ggaguucacugcccaaaac

SEQ ID NO: 591201 - RNA, 19 nt, Homo sapiens
ggggaagaaucuacaguug

SEQ ID NO: 591202 - RNA, 19 nt, Homo sapiens
ugaucaauguccuaaugug

SEQ ID NO: 591203 - RNA, 19 nt, Homo sapiens
gcuauaacagugucuuucu

SEQ ID NO: 591204 - RNA, 19 nt, Homo sapiens
gaagcaagugcagauagau

SEQ ID NO: 591205 - RNA, 19 nt, Homo sapiens
gagcugagaucacgucauu

SEQ ID NO: 591206 - RNA, 19 nt, Homo sapiens
guggagagcucaaccagua

SEQ ID NO: 591207 - RNA, 19 nt, Homo sapiens
ccacaacucuugaacauca

SEQ ID NO: 591208 - RNA, 19 nt, Homo sapiens
gaucaacgacauccaguua

SEQ ID NO: 591209 - RNA, 19 nt, Homo sapiens
gaaagcagcuggcccuucu

SEQ ID NO: 591210 - RNA, 19 nt, Homo sapiens
gaagaucccuugcaaugac

SEQ ID NO: 591211 - RNA, 19 nt, Homo sapiens
gaaaccucgucucuacuaa

SEQ ID NO: 591212 - RNA, 19 nt, Homo sapiens
ccacaguacuuugaauuug

SEQ ID NO: 591213 - RNA, 19 nt, Homo sapiens
gaagaagaguuuggaagag

SEQ ID NO: 591214 - RNA, 19 nt, Homo sapiens
acaaugagcccuacaugaa

SEQ ID NO: 591215 - RNA, 19 nt, Homo sapiens
ggagagguguuggugaaug

SEQ ID NO: 591216 - RNA, 19 nt, Homo sapiens
ggagagcucaaccaguaua

SEQ ID NO: 591217 - RNA, 19 nt, Homo sapiens
cacaguacuuugaauuuga

SEQ ID NO: 591218 - RNA, 19 nt, Homo sapiens
caaggacccuaucgucaau

SEQ ID NO: 591219 - RNA, 19 nt, Homo sapiens
ccauuacgcagauuaagua

SEQ ID NO: 591220 - RNA, 19 nt, Homo sapiens
aauuugaguuugaggcuua

SEQ ID NO: 591221 - RNA, 19 nt, Homo sapiens
ggacaacacagccaagcuu

SEQ ID NO: 591222 - RNA, 19 nt, Homo sapiens
gagagguguuggugaaugu

SEQ ID NO: 591223 - RNA, 19 nt, Homo sapiens
gcaaaacuccgucucaaaa

SEQ ID NO: 591224 - RNA, 19 nt, Homo sapiens
ggccaugagcgguccauua

SEQ ID NO: 591225 - RNA, 19 nt, Homo sapiens
ccauuuggccuuugaagaa

SEQ ID NO: 591226 - RNA, 19 nt, Homo sapiens
gaggccagguucuuccauu

SEQ ID NO: 591227 - RNA, 19 nt, Homo sapiens
ugaagaagaguuuggaaga

SEQ ID NO: 591228 - RNA, 19 nt, Homo sapiens
caccaggauuggcaaguuu

SEQ ID NO: 591229 - RNA, 19 nt, Homo sapiens
cgagccagauugacaacaa

SEQ ID NO: 591230 - RNA, 19 nt, Homo sapiens
gcaggagaaucacuugaac

SEQ ID NO: 591231 - RNA, 19 nt, Homo sapiens
ccuguaaucccaccacuuu

SEQ ID NO: 591232 - RNA, 19 nt, Homo sapiens
ccaccaggauuggcaaguu

SEQ ID NO: 591233 - RNA, 19 nt, Homo sapiens
ucaacgacauccaguuauc

SEQ ID NO: 591234 - RNA, 19 nt, Homo sapiens
gagcucaaccaguauagug

SEQ ID NO: 591235 - RNA, 19 nt, Homo sapiens
gaccugcgguuuugacuuu

SEQ ID NO: 591236 - RNA, 19 nt, Homo sapiens
gugagaggcugggcaccua

SEQ ID NO: 591237 - RNA, 19 nt, Homo sapiens
ccaaggacccuaucgucaa

SEQ ID NO: 591238 - RNA, 19 nt, Homo sapiens
caacaaugagcccuacaug

SEQ ID NO: 591239 - RNA, 19 nt, Homo sapiens
gacccuaucgucaauguau

SEQ ID NO: 591240 - RNA, 19 nt, Homo sapiens
gagguguuggugaauguua

SEQ ID NO: 591241 - RNA, 19 nt, Homo sapiens
acaugaagaucccuugcaa

SEQ ID NO: 591242 - RNA, 19 nt, Homo sapiens
gauccgagccagauugaca

SEQ ID NO: 591243 - RNA, 19 nt, Homo sapiens
gacaacacagccaagcuuu

SEQ ID NO: 591244 - RNA, 19 nt, Homo sapiens
caaccaggccagagaagau

SEQ ID NO: 591245 - RNA, 19 nt, Homo sapiens
agaaaccucgucucuacua

SEQ ID NO: 591246 - RNA, 19 nt, Homo sapiens
guucuuccauuuggccuuu

SEQ ID NO: 591247 - RNA, 19 nt, Homo sapiens
ucaggaagccauggaugua

SEQ ID NO: 591248 - RNA, 19 nt, Homo sapiens
aaugagcccuacaugaaga

SEQ ID NO: 591249 - RNA, 19 nt, Homo sapiens
gagaccuccucuuuacugu

SEQ ID NO: 591250 - RNA, 19 nt, Homo sapiens
cuggagagguguuggugaa

SEQ ID NO: 591251 - RNA, 19 nt, Homo sapiens
agucaagggucacuuugga

SEQ ID NO: 591252 - RNA, 19 nt, Homo sapiens
gcagcuggcccuucucaag

SEQ ID NO: 591253 - RNA, 19 nt, Homo sapiens
ggcaggagaaucacuugaa

SEQ ID NO: 591254 - RNA, 19 nt, Homo sapiens
gagcaaaacuccgucucaa

SEQ ID NO: 591255 - RNA, 19 nt, Homo sapiens
gaagaguuuggaagaguca

SEQ ID NO: 591256 - RNA, 19 nt, Homo sapiens
aagaagaguuuggaagagu

SEQ ID NO: 591257 - RNA, 19 nt, Homo sapiens
uugaacaucagaagacuuu

SEQ ID NO: 591258 - RNA, 19 nt, Homo sapiens
cagcuggcccuucucaaga

SEQ ID NO: 591259 - RNA, 19 nt, Homo sapiens
ugaagaucccuugcaauga

SEQ ID NO: 591260 - RNA, 19 nt, Homo sapiens
ccagugcuuugugagcuuu

SEQ ID NO: 591261 - RNA, 19 nt, Homo sapiens
agaacguccugucaacuca

SEQ ID NO: 591262 - RNA, 19 nt, Homo sapiens
agaccagccugaccaacau

SEQ ID NO: 591263 - RNA, 19 nt, Homo sapiens
gacccacaguacuuugaau

SEQ ID NO: 591264 - RNA, 19 nt, Homo sapiens
guaugguacucugugaaug

SEQ ID NO: 591265 - RNA, 19 nt, Homo sapiens
gguuggcucaugccuguaa

SEQ ID NO: 591266 - RNA, 19 nt, Homo sapiens
gccaugagcgguccauuac

SEQ ID NO: 591267 - RNA, 19 nt, Homo sapiens
gccagguucuuccauuugg

SEQ ID NO: 591268 - RNA, 19 nt, Homo sapiens
caggaagccauggauguaa

SEQ ID NO: 591269 - RNA, 19 nt, Homo sapiens
gagcacucccggcagauca

SEQ ID NO: 591270 - RNA, 19 nt, Homo sapiens
aaaccucgucucuacuaaa

SEQ ID NO: 591271 - RNA, 19 nt, Homo sapiens
ggccuuugaagaagaguuu

SEQ ID NO: 591272 - RNA, 19 nt, Homo sapiens
aggccagguucuuccauuu

SEQ ID NO: 591273 - RNA, 19 nt, Homo sapiens
gcaaguuugaggccagguu

SEQ ID NO: 591274 - RNA, 19 nt, Homo sapiens
cuccacaacucuugaacau

SEQ ID NO: 591275 - RNA, 19 nt, Homo sapiens
gguccauuacgcagauuaa

SEQ ID NO: 591276 - RNA, 19 nt, Homo sapiens
caaugagcccuacaugaag

SEQ ID NO: 591277 - RNA, 19 nt, Homo sapiens
ggcuaccagugcuuuguga

SEQ ID NO: 591278 - RNA, 19 nt, Homo sapiens
augaagaucccuugcaaug

SEQ ID NO: 591279 - RNA, 19 nt, Homo sapiens
gcugagaucacgucauugc

SEQ ID NO: 591280 - RNA, 19 nt, Homo sapiens
aauguaugguacucuguga

SEQ ID NO: 591281 - RNA, 19 nt, Homo sapiens
ggccagguucuuccauuug

SEQ ID NO: 591282 - RNA, 19 nt, Homo sapiens
gaacaucagaagacuuucc

SEQ ID NO: 591283 - RNA, 19 nt, Homo sapiens
gggauccgagccagauuga

SEQ ID NO: 591284 - RNA, 19 nt, Homo sapiens
gaugaagccgauccuacug

SEQ ID NO: 591285 - RNA, 19 nt, Homo sapiens
ugaguuugaggcuuaagaa

SEQ ID NO: 591286 - RNA, 19 nt, Homo sapiens
cccacaguacuuugaauuu

SEQ ID NO: 591287 - RNA, 19 nt, Homo sapiens
ccaguauagugccaagucu

SEQ ID NO: 591288 - RNA, 19 nt, Homo sapiens
ugcaaugacucuaaaauca

SEQ ID NO: 591289 - RNA, 19 nt, Homo sapiens
gaugggcuaccagugcuuu

SEQ ID NO: 591290 - RNA, 19 nt, Homo sapiens
ucacgucauugcacuccau

SEQ ID NO: 591291 - RNA, 19 nt, Homo sapiens
ugaccaacauggagaaacc

SEQ ID NO: 591292 - RNA, 19 nt, Homo sapiens
ccaguuauccagggacaug

SEQ ID NO: 591293 - RNA, 19 nt, Homo sapiens
aacaaugagcccuacauga

SEQ ID NO: 591294 - RNA, 19 nt, Homo sapiens
gcccuucucaagaccaauu

SEQ ID NO: 591295 - RNA, 19 nt, Homo sapiens
aagagucaagggucacuuu

SEQ ID NO: 591296 - RNA, 19 nt, Homo sapiens
uaaguauaaccgcgaagga

SEQ ID NO: 591297 - RNA, 19 nt, Homo sapiens
caccaagcauguccucacu

SEQ ID NO: 591298 - RNA, 19 nt, Homo sapiens
ggacccuaucgucaaugua

SEQ ID NO: 591299 - RNA, 19 nt, Homo sapiens
caugguggcacacgccuau

SEQ ID NO: 591300 - RNA, 19 nt, Homo sapiens
ccauggauguaaccacaac

SEQ ID NO: 591301 - RNA, 19 nt, Homo sapiens
agaagacuuuccggacaga

SEQ ID NO: 591302 - RNA, 19 nt, Homo sapiens
aaucaccagugcuguuugg

SEQ ID NO: 591303 - RNA, 19 nt, Homo sapiens
ccacaaccuccaccaggau

SEQ ID NO: 591304 - RNA, 19 nt, Homo sapiens
acaagcagaugggcuacca

SEQ ID NO: 591305 - RNA, 19 nt, Homo sapiens
ggacauaguuacagcuuua

SEQ ID NO: 591306 - RNA, 19 nt, Homo sapiens
gaaccuaaguugcuacuaa

SEQ ID NO: 591307 - RNA, 19 nt, Homo sapiens
ggaaauugaugacuugaaa

SEQ ID NO: 591308 - RNA, 19 nt, Homo sapiens
gaagaacaauuagcagaua

SEQ ID NO: 591309 - RNA, 19 nt, Homo sapiens
gaaaagcacuaguuugaua

SEQ ID NO: 591310 - RNA, 19 nt, Homo sapiens
gacauacacugaauugaaa

SEQ ID NO: 591311 - RNA, 19 nt, Homo sapiens
ucaaagcucuguauaccua

SEQ ID NO: 591312 - RNA, 19 nt, Homo sapiens
gaauacugcuuaucucaga

SEQ ID NO: 591313 - RNA, 19 nt, Homo sapiens
cgaagaaccuaaagugcua

SEQ ID NO: 591314 - RNA, 19 nt, Homo sapiens
guaaaccuuuccauuauug

SEQ ID NO: 591315 - RNA, 19 nt, Homo sapiens
guugcuaucugauuucaua

SEQ ID NO: 591316 - RNA, 19 nt, Homo sapiens
gaggauauguacaagacua

SEQ ID NO: 591317 - RNA, 19 nt, Homo sapiens
uaauacagccuuaaccaua

SEQ ID NO: 591318 - RNA, 19 nt, Homo sapiens
gagaugacuuuacagaguu

SEQ ID NO: 591319 - RNA, 19 nt, Homo sapiens
gaaauuacaggaagaguca

SEQ ID NO: 591320 - RNA, 19 nt, Homo sapiens
gguaaaccuuuccauuauu

SEQ ID NO: 591321 - RNA, 19 nt, Homo sapiens
uagcagcagucacuaaauu

SEQ ID NO: 591322 - RNA, 19 nt, Homo sapiens
ggaugacgaugaugaugaa

SEQ ID NO: 591323 - RNA, 19 nt, Homo sapiens
aaacaagaccaucaucuaa

SEQ ID NO: 591324 - RNA, 19 nt, Homo sapiens
ccaaaugugugguuagugu

SEQ ID NO: 591325 - RNA, 19 nt, Homo sapiens
guuuauggcuguuaaguau

SEQ ID NO: 591326 - RNA, 19 nt, Homo sapiens
ccagcaccauucaguaaua

SEQ ID NO: 591327 - RNA, 19 nt, Homo sapiens
gaaaauguaucaccuguuc

SEQ ID NO: 591328 - RNA, 19 nt, Homo sapiens
gaagaauacugcuuaucuc

SEQ ID NO: 591329 - RNA, 19 nt, Homo sapiens
gaacauguagcacaacuuc

SEQ ID NO: 591330 - RNA, 19 nt, Homo sapiens
gcacaacuuccuuuccuuu

SEQ ID NO: 591331 - RNA, 19 nt, Homo sapiens
gauaaacugcggcuaaaga

SEQ ID NO: 591332 - RNA, 19 nt, Homo sapiens
uaccaaggccuaauuaauu

SEQ ID NO: 591333 - RNA, 19 nt, Homo sapiens
gaaauaauaggaacgucaa

SEQ ID NO: 591334 - RNA, 19 nt, Homo sapiens
uaacugggaugacgaugau

SEQ ID NO: 591335 - RNA, 19 nt, Homo sapiens
agagucagaccucgaauua

SEQ ID NO: 591336 - RNA, 19 nt, Homo sapiens
ugacauacacugaauugaa

SEQ ID NO: 591337 - RNA, 19 nt, Homo sapiens
gaacgucaaagcucuguau

SEQ ID NO: 591338 - RNA, 19 nt, Homo sapiens
cuaaguugcuacuaaauca

SEQ ID NO: 591339 - RNA, 19 nt, Homo sapiens
uuacagaguuuggaaaguu

SEQ ID NO: 591340 - RNA, 19 nt, Homo sapiens
cagauaaacugcggcuaaa

SEQ ID NO: 591341 - RNA, 19 nt, Homo sapiens
uguaucaccuguuccuuaa

SEQ ID NO: 591342 - RNA, 19 nt, Homo sapiens
cacaaucccuugaacaugu

SEQ ID NO: 591343 - RNA, 19 nt, Homo sapiens
gccuuccucuuauuuauuu

SEQ ID NO: 591344 - RNA, 19 nt, Homo sapiens
gaguacaguucucuacguu

SEQ ID NO: 591345 - RNA, 19 nt, Homo sapiens
cuaauaauguugucguugu

SEQ ID NO: 591346 - RNA, 19 nt, Homo sapiens
gaagaagaaaggugugguu

SEQ ID NO: 591347 - RNA, 19 nt, Homo sapiens
gacuacacagcaauaauua

SEQ ID NO: 591348 - RNA, 19 nt, Homo sapiens
ugacuacacagcaauaauu

SEQ ID NO: 591349 - RNA, 19 nt, Homo sapiens
ccuaagcaguuuaaccaaa

SEQ ID NO: 591350 - RNA, 19 nt, Homo sapiens
gccaaaugcuacaaucaga

SEQ ID NO: 591351 - RNA, 19 nt, Homo sapiens
uacagaguuuggaaaguua

SEQ ID NO: 591352 - RNA, 19 nt, Homo sapiens
caagagaugacuuuacaga

SEQ ID NO: 591353 - RNA, 19 nt, Homo sapiens
ccauagagcaacaaaggua

SEQ ID NO: 591354 - RNA, 19 nt, Homo sapiens
ggaagagucagaccucgaa

SEQ ID NO: 591355 - RNA, 19 nt, Homo sapiens
gaaagaacggcaacagaag

SEQ ID NO: 591356 - RNA, 19 nt, Homo sapiens
ucucuacguucucuacuaa

SEQ ID NO: 591357 - RNA, 19 nt, Homo sapiens
guacaguucucuacguucu

SEQ ID NO: 591358 - RNA, 19 nt, Homo sapiens
ugauuuaagugucugagaa

SEQ ID NO: 591359 - RNA, 19 nt, Homo sapiens
aaucagaagugcaguaucu

SEQ ID NO: 591360 - RNA, 19 nt, Homo sapiens
gaagaaaggugugguuccu

SEQ ID NO: 591361 - RNA, 19 nt, Homo sapiens
gagaaagaacggcaacaga

SEQ ID NO: 591362 - RNA, 19 nt, Homo sapiens
gcagacaagggcuaagauu

SEQ ID NO: 591363 - RNA, 19 nt, Homo sapiens
cuaagcaguuuaaccaaau

SEQ ID NO: 591364 - RNA, 19 nt, Homo sapiens
agagaugacuuuacagagu

SEQ ID NO: 591365 - RNA, 19 nt, Homo sapiens
gaaaaggcaagaagaaauu

SEQ ID NO: 591366 - RNA, 19 nt, Homo sapiens
agaaagaacggcaacagaa

SEQ ID NO: 591367 - RNA, 19 nt, Homo sapiens
acgaggacgucaaggauaa

SEQ ID NO: 591368 - RNA, 19 nt, Homo sapiens
acaauuagcagauaaacug

SEQ ID NO: 591369 - RNA, 19 nt, Homo sapiens
gcuaacaccagaagaacaa

SEQ ID NO: 591370 - RNA, 19 nt, Homo sapiens
gggcugccuuccucuuauu

SEQ ID NO: 591371 - RNA, 19 nt, Homo sapiens
ggaguacaguucucuacgu

SEQ ID NO: 591372 - RNA, 19 nt, Homo sapiens
gaagauacugcggcugaaa

SEQ ID NO: 591373 - RNA, 19 nt, Homo sapiens
gcaguaauaaugacauaca

SEQ ID NO: 591374 - RNA, 19 nt, Homo sapiens
acaagaccaucaucuaagu

SEQ ID NO: 591375 - RNA, 19 nt, Homo sapiens
gauauguacaagacuauga

SEQ ID NO: 591376 - RNA, 19 nt, Homo sapiens
gaagaaaaggcaagaagaa

SEQ ID NO: 591377 - RNA, 19 nt, Homo sapiens
gaucaguuucuaacaaaug

SEQ ID NO: 591378 - RNA, 19 nt, Homo sapiens
cagacaagggcuaagauuu

SEQ ID NO: 591379 - RNA, 19 nt, Homo sapiens
uuaagugucugagaaacaa

SEQ ID NO: 591380 - RNA, 19 nt, Homo sapiens
uggaaucucucgagugcaa

SEQ ID NO: 591381 - RNA, 19 nt, Homo sapiens
cgagauguguguauuucau

SEQ ID NO: 591382 - RNA, 19 nt, Homo sapiens
agacaagggcuaagauuuc

SEQ ID NO: 591383 - RNA, 19 nt, Homo sapiens
gauaccaaggccuaauuaa

SEQ ID NO: 591384 - RNA, 19 nt, Homo sapiens
gaagaacccgaagaaccua

SEQ ID NO: 591385 - RNA, 19 nt, Homo sapiens
ugaagaauacugcuuaucu

SEQ ID NO: 591386 - RNA, 19 nt, Homo sapiens
gggaugacgaugaugauga

SEQ ID NO: 591387 - RNA, 19 nt, Homo sapiens
gcuaaagaaauuacaggaa

SEQ ID NO: 591388 - RNA, 19 nt, Homo sapiens
aaacugcggcuaaagaaau

SEQ ID NO: 591389 - RNA, 19 nt, Homo sapiens
guuagaagaacccgaagaa

SEQ ID NO: 591390 - RNA, 19 nt, Homo sapiens
ucagguuuauggcuguuaa

SEQ ID NO: 591391 - RNA, 19 nt, Homo sapiens
uggaguaacugagccugua

SEQ ID NO: 591392 - RNA, 19 nt, Homo sapiens
gauuuaagugucugagaaa

SEQ ID NO: 591393 - RNA, 19 nt, Homo sapiens
aaccuaaguugcuacuaaa

SEQ ID NO: 591394 - RNA, 19 nt, Homo sapiens
guacaagacuaugaagacu

SEQ ID NO: 591395 - RNA, 19 nt, Homo sapiens
aagauuuccuuagcaguaa

SEQ ID NO: 591396 - RNA, 19 nt, Homo sapiens
gcuguuaaguauagauugg

SEQ ID NO: 591397 - RNA, 19 nt, Homo sapiens
ggaguaacugagccuguaa

SEQ ID NO: 591398 - RNA, 19 nt, Homo sapiens
aauaaaugcuuggacauag

SEQ ID NO: 591399 - RNA, 19 nt, Homo sapiens
cauagcagcagucacuaaa

SEQ ID NO: 591400 - RNA, 19 nt, Homo sapiens
acacagcaauaauuacagu

SEQ ID NO: 591401 - RNA, 19 nt, Homo sapiens
ccuccaacuuugaagcuaa

SEQ ID NO: 591402 - RNA, 19 nt, Homo sapiens
gaacuacuucauaacuugu

SEQ ID NO: 591403 - RNA, 19 nt, Homo sapiens
acaaucccuugaacaugua

SEQ ID NO: 591404 - RNA, 19 nt, Homo sapiens
cauuggaaauugaugacuu

SEQ ID NO: 591405 - RNA, 19 nt, Homo sapiens
ggaaagauguccacugaaa

SEQ ID NO: 591406 - RNA, 19 nt, Homo sapiens
caacuuaacucaucauuuc

SEQ ID NO: 591407 - RNA, 19 nt, Homo sapiens
gcucuaacaugcaauauaa

SEQ ID NO: 591408 - RNA, 19 nt, Homo sapiens
ggacaaagccuucuucaau

SEQ ID NO: 591409 - RNA, 19 nt, Homo sapiens
ggaaugggauccagcaauu

SEQ ID NO: 591410 - RNA, 19 nt, Homo sapiens
gaacaaagagucacuggaa

SEQ ID NO: 591411 - RNA, 19 nt, Homo sapiens
cugauuagcuucaucuuua

SEQ ID NO: 591412 - RNA, 19 nt, Homo sapiens
gcaauucucuucauuuauc

SEQ ID NO: 591413 - RNA, 19 nt, Homo sapiens
cagagucccuucucacuua

SEQ ID NO: 591414 - RNA, 19 nt, Homo sapiens
uguaauagaugcccuagua

SEQ ID NO: 591415 - RNA, 19 nt, Homo sapiens
ugaucaagcuugcagauua

SEQ ID NO: 591416 - RNA, 19 nt, Homo sapiens
gaagggcuuugauuucuuu

SEQ ID NO: 591417 - RNA, 19 nt, Homo sapiens
gaacagcaaccuuuccuaa

SEQ ID NO: 591418 - RNA, 19 nt, Homo sapiens
gaacagaaguaguuaacca

SEQ ID NO: 591419 - RNA, 19 nt, Homo sapiens
gaaagaacauaaacucaag

SEQ ID NO: 591420 - RNA, 19 nt, Homo sapiens
caagaagucuguccauaug

SEQ ID NO: 591421 - RNA, 19 nt, Homo sapiens
ggucacaggccaaauaaua

SEQ ID NO: 591422 - RNA, 19 nt, Homo sapiens
guaaugaucuuggcacuug

SEQ ID NO: 591423 - RNA, 19 nt, Homo sapiens
gaacauaaacucaagaaag

SEQ ID NO: 591424 - RNA, 19 nt, Homo sapiens
gaauuuacccauugacuaa

SEQ ID NO: 591425 - RNA, 19 nt, Homo sapiens
gaaggaggaugagaagaaa

SEQ ID NO: 591426 - RNA, 19 nt, Homo sapiens
ggacacaaauuacaacagu

SEQ ID NO: 591427 - RNA, 19 nt, Homo sapiens
cuacugacauguaccauaa

SEQ ID NO: 591428 - RNA, 19 nt, Homo sapiens
gcaaacuggacacaaauua

SEQ ID NO: 591429 - RNA, 19 nt, Homo sapiens
uaacugaauuuacccauug

SEQ ID NO: 591430 - RNA, 19 nt, Homo sapiens
gcucccaucuugaaguuua

SEQ ID NO: 591431 - RNA, 19 nt, Homo sapiens
cggcaauucucuucauuua

SEQ ID NO: 591432 - RNA, 19 nt, Homo sapiens
ucaaagaacuccugaagca

SEQ ID NO: 591433 - RNA, 19 nt, Homo sapiens
caggaaagauguccacuga

SEQ ID NO: 591434 - RNA, 19 nt, Homo sapiens
ggccagagauuuagauaug

SEQ ID NO: 591435 - RNA, 19 nt, Homo sapiens
gaucaugaaucaaguaucu

SEQ ID NO: 591436 - RNA, 19 nt, Homo sapiens
ucagauguguccuuugaua

SEQ ID NO: 591437 - RNA, 19 nt, Homo sapiens
ccaauuuccuggcucauuu

SEQ ID NO: 591438 - RNA, 19 nt, Homo sapiens
caaauucugucacucaaga

SEQ ID NO: 591439 - RNA, 19 nt, Homo sapiens
aaaccucacuugccaaauu

SEQ ID NO: 591440 - RNA, 19 nt, Homo sapiens
ggaauuaagagaugaagaa

SEQ ID NO: 591441 - RNA, 19 nt, Homo sapiens
caaaggaacagaaguaguu

SEQ ID NO: 591442 - RNA, 19 nt, Homo sapiens
ggaguagcaucccuuaaug

SEQ ID NO: 591443 - RNA, 19 nt, Homo sapiens
ggacauguauggagaaagg

SEQ ID NO: 591444 - RNA, 19 nt, Homo sapiens
ucaagugucugccuuauca

SEQ ID NO: 591445 - RNA, 19 nt, Homo sapiens
caacugugauauauccuaa

SEQ ID NO: 591446 - RNA, 19 nt, Homo sapiens
gcagaggauggaaguauua

SEQ ID NO: 591447 - RNA, 19 nt, Homo sapiens
ggaaagaacauaaacucaa

SEQ ID NO: 591448 - RNA, 19 nt, Homo sapiens
uuacagagguugacauugu

SEQ ID NO: 591449 - RNA, 19 nt, Homo sapiens
gccauuaucuuguccauuc

SEQ ID NO: 591450 - RNA, 19 nt, Homo sapiens
aaccugaacuuaaggauaa

SEQ ID NO: 591451 - RNA, 19 nt, Homo sapiens
gaaaggauccaucaugcuu

SEQ ID NO: 591452 - RNA, 19 nt, Homo sapiens
ccaaauggcuggguacaau

SEQ ID NO: 591453 - RNA, 19 nt, Homo sapiens
gacaaagccuucuucaauc

SEQ ID NO: 591454 - RNA, 19 nt, Homo sapiens
aauaaccgauguucugaua

SEQ ID NO: 591455 - RNA, 19 nt, Homo sapiens
gagaagagacaaacuccua

SEQ ID NO: 591456 - RNA, 19 nt, Homo sapiens
caaauuagacuagaacuug

SEQ ID NO: 591457 - RNA, 19 nt, Homo sapiens
guacuuuacucccuauaga

SEQ ID NO: 591458 - RNA, 19 nt, Homo sapiens
guacucagguggagagaau

SEQ ID NO: 591459 - RNA, 19 nt, Homo sapiens
caaguaggauguuuaccaa

SEQ ID NO: 591460 - RNA, 19 nt, Homo sapiens
gaauaguaccuuacauuug

SEQ ID NO: 591461 - RNA, 19 nt, Homo sapiens
uaacaguacucucaugcaa

SEQ ID NO: 591462 - RNA, 19 nt, Homo sapiens
gcaagaauucuguuuccua

SEQ ID NO: 591463 - RNA, 19 nt, Homo sapiens
ggagaggacuuaacugacu

SEQ ID NO: 591464 - RNA, 19 nt, Homo sapiens
ccagguaucagucauuaua

SEQ ID NO: 591465 - RNA, 19 nt, Homo sapiens
gggccuaaccugccacuua

SEQ ID NO: 591466 - RNA, 19 nt, Homo sapiens
aaaguugccucaaauuaga

SEQ ID NO: 591467 - RNA, 19 nt, Homo sapiens
caaaguacgcucagaguug

SEQ ID NO: 591468 - RNA, 19 nt, Homo sapiens
gaaggcaagaucagauuaa

SEQ ID NO: 591469 - RNA, 19 nt, Homo sapiens
uugagaggcuucuauuuaa

SEQ ID NO: 591470 - RNA, 19 nt, Homo sapiens
gauagagccuccuaagagu

SEQ ID NO: 591471 - RNA, 19 nt, Homo sapiens
ggagaaaggauccaucaug

SEQ ID NO: 591472 - RNA, 19 nt, Homo sapiens
gagauggaguggaaggaaa

SEQ ID NO: 591473 - RNA, 19 nt, Homo sapiens
uaaccaaacuaacaagcaa

SEQ ID NO: 591474 - RNA, 19 nt, Homo sapiens
gcaaagucauugaaucucu

SEQ ID NO: 591475 - RNA, 19 nt, Homo sapiens
uaaccgauguucugauaau

SEQ ID NO: 591476 - RNA, 19 nt, Homo sapiens
ucaaguaucugugguuuca

SEQ ID NO: 591477 - RNA, 19 nt, Homo sapiens
uccaugacauugcuuauaa

SEQ ID NO: 591478 - RNA, 19 nt, Homo sapiens
ugaagcaacuuaacucauc

SEQ ID NO: 591479 - RNA, 19 nt, Homo sapiens
gcaguauuguuagacauuu

SEQ ID NO: 591480 - RNA, 19 nt, Homo sapiens
ggauagagccuccuaagag

SEQ ID NO: 591481 - RNA, 19 nt, Homo sapiens
gaacgcauccgauucaucu

SEQ ID NO: 591482 - RNA, 19 nt, Homo sapiens
caucuucucuacuguguga

SEQ ID NO: 591483 - RNA, 19 nt, Homo sapiens
gaacuccugaagcaacuua

SEQ ID NO: 591484 - RNA, 19 nt, Homo sapiens
guauuuagggcuauccuua

SEQ ID NO: 591485 - RNA, 19 nt, Homo sapiens
acaguacucucaugcaauu

SEQ ID NO: 591486 - RNA, 19 nt, Homo sapiens
ugccauggcugguguauau

SEQ ID NO: 591487 - RNA, 19 nt, Homo sapiens
aggaccagcugaagaauaa

SEQ ID NO: 591488 - RNA, 19 nt, Homo sapiens
cauugucccuucauaguuu

SEQ ID NO: 591489 - RNA, 19 nt, Homo sapiens
gcagaacgcauccgauuca

SEQ ID NO: 591490 - RNA, 19 nt, Homo sapiens
ugaaguagaucaacauggu

SEQ ID NO: 591491 - RNA, 19 nt, Homo sapiens
uuucauggcugguacauau

SEQ ID NO: 591492 - RNA, 19 nt, Homo sapiens
gaugugacuuccggagaua

SEQ ID NO: 591493 - RNA, 19 nt, Homo sapiens
gaagcaacuuaacucauca

SEQ ID NO: 591494 - RNA, 19 nt, Homo sapiens
ggccuaaccugccacuuau

SEQ ID NO: 591495 - RNA, 19 nt, Homo sapiens
agagaaagaucaccaacau

SEQ ID NO: 591496 - RNA, 19 nt, Homo sapiens
gaguccaccuguucacuuu

SEQ ID NO: 591497 - RNA, 19 nt, Homo sapiens
ggcaggagauggaguggaa

SEQ ID NO: 591498 - RNA, 19 nt, Homo sapiens
guaauucaguuugcgugua

SEQ ID NO: 591499 - RNA, 19 nt, Homo sapiens
gaauagagaagggcuuuga

SEQ ID NO: 591500 - RNA, 19 nt, Homo sapiens
ugaguuagcuguuacuuuu

SEQ ID NO: 591501 - RNA, 19 nt, Homo sapiens
cagaguauuugccaacuau

SEQ ID NO: 591502 - RNA, 19 nt, Homo sapiens
ggagagaauguucagauga

SEQ ID NO: 591503 - RNA, 19 nt, Homo sapiens
gcacuuucagauauucuua

SEQ ID NO: 591504 - RNA, 19 nt, Homo sapiens
uaugcaaacuggacacaaa

SEQ ID NO: 591505 - RNA, 19 nt, Homo sapiens
ccacagaacuccaagaauu

SEQ ID NO: 591506 - RNA, 19 nt, Homo sapiens
gaaauugacucaguacuau

SEQ ID NO: 591507 - RNA, 19 nt, Homo sapiens
ggagaacucuuuaaacuca

SEQ ID NO: 591508 - RNA, 19 nt, Homo sapiens
gaacagcaguccuuccauu

SEQ ID NO: 591509 - RNA, 19 nt, Homo sapiens
guaaagaccugcuagacaa

SEQ ID NO: 591510 - RNA, 19 nt, Homo sapiens
gcaaacaaaugagccauaa

SEQ ID NO: 591511 - RNA, 19 nt, Homo sapiens
ugacaaggcugcauuauca

SEQ ID NO: 591512 - RNA, 19 nt, Homo sapiens
aaacaaggacucauacuua

SEQ ID NO: 591513 - RNA, 19 nt, Homo sapiens
gaacuugccuuagugaaga

SEQ ID NO: 591514 - RNA, 19 nt, Homo sapiens
gagaggaagucgaaaucua

SEQ ID NO: 591515 - RNA, 19 nt, Homo sapiens
gaagaggagucugaggaua

SEQ ID NO: 591516 - RNA, 19 nt, Homo sapiens
ugagagaacuuaccauaga

SEQ ID NO: 591517 - RNA, 19 nt, Homo sapiens
ggacaaagcgaaugaugaa

SEQ ID NO: 591518 - RNA, 19 nt, Homo sapiens
ggagagcauuguggaaaua

SEQ ID NO: 591519 - RNA, 19 nt, Homo sapiens
ccagggagguaaagacaua

SEQ ID NO: 591520 - RNA, 19 nt, Homo sapiens
cuacaagcaucgauaguaa

SEQ ID NO: 591521 - RNA, 19 nt, Homo sapiens
ucacuaagccuacaauuga

SEQ ID NO: 591522 - RNA, 19 nt, Homo sapiens
aagaggagcuuuccauuga

SEQ ID NO: 591523 - RNA, 19 nt, Homo sapiens
caagaaacccuguagugua

SEQ ID NO: 591524 - RNA, 19 nt, Homo sapiens
gaggaugccuucuacaaau

SEQ ID NO: 591525 - RNA, 19 nt, Homo sapiens
guucaugccugccuguaua

SEQ ID NO: 591526 - RNA, 19 nt, Homo sapiens
agaagaagcugagccagua

SEQ ID NO: 591527 - RNA, 19 nt, Homo sapiens
caaaagagauucagaacaa

SEQ ID NO: 591528 - RNA, 19 nt, Homo sapiens
gccauugacucuugaauug

SEQ ID NO: 591529 - RNA, 19 nt, Homo sapiens
gcaagcacuuuaugcacua

SEQ ID NO: 591530 - RNA, 19 nt, Homo sapiens
ugacagaugugaacucuca

SEQ ID NO: 591531 - RNA, 19 nt, Homo sapiens
ucgagaaacucauuauuga

SEQ ID NO: 591532 - RNA, 19 nt, Homo sapiens
gucaagugcuuccaguuua

SEQ ID NO: 591533 - RNA, 19 nt, Homo sapiens
ccagaaagaucaucacagu

SEQ ID NO: 591534 - RNA, 19 nt, Homo sapiens
gaagaggcguaccuuuguu

SEQ ID NO: 591535 - RNA, 19 nt, Homo sapiens
caaaguacuugaaucugaa

SEQ ID NO: 591536 - RNA, 19 nt, Homo sapiens
ggacacugcuguuaucaag

SEQ ID NO: 591537 - RNA, 19 nt, Homo sapiens
aaauucagcugguaccuaa

SEQ ID NO: 591538 - RNA, 19 nt, Homo sapiens
aaagaaccaugaugaagaa

SEQ ID NO: 591539 - RNA, 19 nt, Homo sapiens
acaaaguacuugaaucuga

SEQ ID NO: 591540 - RNA, 19 nt, Homo sapiens
gaagaggagcuuuccauug

SEQ ID NO: 591541 - RNA, 19 nt, Homo sapiens
gcacugaggcugagcgaaa

SEQ ID NO: 591542 - RNA, 19 nt, Homo sapiens
agaaagaucaucacaguuu

SEQ ID NO: 591543 - RNA, 19 nt, Homo sapiens
gaagagaacccagaaagau

SEQ ID NO: 591544 - RNA, 19 nt, Homo sapiens
aaaugaaacuggaguguau

SEQ ID NO: 591545 - RNA, 19 nt, Homo sapiens
gaaaugaaacuggagugua

SEQ ID NO: 591546 - RNA, 19 nt, Homo sapiens
gagagaacuuaccauagaa

SEQ ID NO: 591547 - RNA, 19 nt, Homo sapiens
gaccaguacuuuaaucaga

SEQ ID NO: 591548 - RNA, 19 nt, Homo sapiens
ggaagaagccaaggacaaa

SEQ ID NO: 591549 - RNA, 19 nt, Homo sapiens
ugagaaggcuauugaugaa

SEQ ID NO: 591550 - RNA, 19 nt, Homo sapiens
gaacaagguaagaaagauu

SEQ ID NO: 591551 - RNA, 19 nt, Homo sapiens
ucaaguaccuagacucaga

SEQ ID NO: 591552 - RNA, 19 nt, Homo sapiens
ggaagaaaauggagaagaa

SEQ ID NO: 591553 - RNA, 19 nt, Homo sapiens
cagaugacauggccauuga

SEQ ID NO: 591554 - RNA, 19 nt, Homo sapiens
ggaauuggcagaugacaug

SEQ ID NO: 591555 - RNA, 19 nt, Homo sapiens
gaugauauaugcaagaaac

SEQ ID NO: 591556 - RNA, 19 nt, Homo sapiens
caagaugcaccucauguuu

SEQ ID NO: 591557 - RNA, 19 nt, Homo sapiens
gcagagagugccgaucuua

SEQ ID NO: 591558 - RNA, 19 nt, Homo sapiens
caaaugagccauaagaaag

SEQ ID NO: 591559 - RNA, 19 nt, Homo sapiens
ucgaacagauucacaaaga

SEQ ID NO: 591560 - RNA, 19 nt, Homo sapiens
caccacagauguucaauca

SEQ ID NO: 591561 - RNA, 19 nt, Homo sapiens
gauguuagaggcagaauug

SEQ ID NO: 591562 - RNA, 19 nt, Homo sapiens
ugaaaucugucacggcauu

SEQ ID NO: 591563 - RNA, 19 nt, Homo sapiens
caaagaggcuaaaauagaa

SEQ ID NO: 591564 - RNA, 19 nt, Homo sapiens
uaaagaaccaugaugaaga

SEQ ID NO: 591565 - RNA, 19 nt, Homo sapiens
ccacagauguucaaucaac

SEQ ID NO: 591566 - RNA, 19 nt, Homo sapiens
uaacacaaguggcaagaca

SEQ ID NO: 591567 - RNA, 19 nt, Homo sapiens
ccaaagacauggaagaaac

SEQ ID NO: 591568 - RNA, 19 nt, Homo sapiens
ccacugguuucuaguacua

SEQ ID NO: 591569 - RNA, 19 nt, Homo sapiens
ugacauggccauugauauu

SEQ ID NO: 591570 - RNA, 19 nt, Homo sapiens
ucaagugcuuccaguuuaa

SEQ ID NO: 591571 - RNA, 19 nt, Homo sapiens
ggagagcgcucaucuugcu

SEQ ID NO: 591572 - RNA, 19 nt, Homo sapiens
caagucagccgguguauca

SEQ ID NO: 591573 - RNA, 19 nt, Homo sapiens
gaacuccaagaauuguuua

SEQ ID NO: 591574 - RNA, 19 nt, Homo sapiens
aacaaggacucauacuuaa

SEQ ID NO: 591575 - RNA, 19 nt, Homo sapiens
uaaagcagaugaugauguc

SEQ ID NO: 591576 - RNA, 19 nt, Homo sapiens
ccucacaucuugcacagaa

SEQ ID NO: 591577 - RNA, 19 nt, Homo sapiens
aaacaaaugagccauaaga

SEQ ID NO: 591578 - RNA, 19 nt, Homo sapiens
gaccuaaggcugugcaauu

SEQ ID NO: 591579 - RNA, 19 nt, Homo sapiens
ggaagaggcguaccuuugu

SEQ ID NO: 591580 - RNA, 19 nt, Homo sapiens
gaucaaccaacccaaauug

SEQ ID NO: 591581 - RNA, 19 nt, Homo sapiens
agaaacaucagacccuuua

SEQ ID NO: 591582 - RNA, 19 nt, Homo sapiens
ccucucagcuugcuucaga

SEQ ID NO: 591583 - RNA, 19 nt, Homo sapiens
ggaagggcguggcucugaa

SEQ ID NO: 591584 - RNA, 19 nt, Homo sapiens
ggagaagauguacauaauu

SEQ ID NO: 591585 - RNA, 19 nt, Homo sapiens
caggaaguauugccauuga

SEQ ID NO: 591586 - RNA, 19 nt, Homo sapiens
gcaagaaacccuguagugu

SEQ ID NO: 591587 - RNA, 19 nt, Homo sapiens
aagaggaacuggagaggaa

SEQ ID NO: 591588 - RNA, 19 nt, Homo sapiens
gaagagcagcggagagaga

SEQ ID NO: 591589 - RNA, 19 nt, Homo sapiens
ggucaagugcuuccaguuu

SEQ ID NO: 591590 - RNA, 19 nt, Homo sapiens
ucagugaugugguucuuga

SEQ ID NO: 591591 - RNA, 19 nt, Homo sapiens
gacgagagcauaagaacuu

SEQ ID NO: 591592 - RNA, 19 nt, Homo sapiens
ccaacaauauccaguucaa

SEQ ID NO: 591593 - RNA, 19 nt, Homo sapiens
gaacugcaagcacuuuaug

SEQ ID NO: 591594 - RNA, 19 nt, Homo sapiens
gaaagugggagccuuaugg

SEQ ID NO: 591595 - RNA, 19 nt, Homo sapiens
caugagagaacuuaccaua

SEQ ID NO: 591596 - RNA, 19 nt, Homo sapiens
gaugacauggccauugaua

SEQ ID NO: 591597 - RNA, 19 nt, Homo sapiens
gaacaagaagagcaaagga

SEQ ID NO: 591598 - RNA, 19 nt, Homo sapiens
guauggaccaguacuuuaa

SEQ ID NO: 591599 - RNA, 19 nt, Homo sapiens
agacaagccugguaacaca

SEQ ID NO: 591600 - RNA, 19 nt, Homo sapiens
ugucaggacuuacuguuga

SEQ ID NO: 591601 - RNA, 19 nt, Homo sapiens
gggguuacauuuccauuua

SEQ ID NO: 591602 - RNA, 19 nt, Homo sapiens
gugaaggaauagaugcuaa

SEQ ID NO: 591603 - RNA, 19 nt, Homo sapiens
gcaacagcucggccaaaua

SEQ ID NO: 591604 - RNA, 19 nt, Homo sapiens
uggugaagcugcuaaagaa

SEQ ID NO: 591605 - RNA, 19 nt, Homo sapiens
ggacaacccuccauaaaug

SEQ ID NO: 591606 - RNA, 19 nt, Homo sapiens
gaacaucuccgcaacaaga

SEQ ID NO: 591607 - RNA, 19 nt, Homo sapiens
ggaagaacgugaagaugau

SEQ ID NO: 591608 - RNA, 19 nt, Homo sapiens
gaagaugauuguccuuauc

SEQ ID NO: 591609 - RNA, 19 nt, Homo sapiens
ggagggaguuaagaauauu

SEQ ID NO: 591610 - RNA, 19 nt, Homo sapiens
ccacuggugccuucucuua

SEQ ID NO: 591611 - RNA, 19 nt, Homo sapiens
ugaagaugauuguccuuau

SEQ ID NO: 591612 - RNA, 19 nt, Homo sapiens
gauggacuguggcugcauu

SEQ ID NO: 591613 - RNA, 19 nt, Homo sapiens
ggaggaagccagugaaggu

SEQ ID NO: 591614 - RNA, 19 nt, Homo sapiens
gggacaacccuccauaaau

SEQ ID NO: 591615 - RNA, 19 nt, Homo sapiens
gcauguggcugggaaacug

SEQ ID NO: 591616 - RNA, 19 nt, Homo sapiens
ccauaaaugugugccaaga

SEQ ID NO: 591617 - RNA, 19 nt, Homo sapiens
guccuuaucugcgugauug

SEQ ID NO: 591618 - RNA, 19 nt, Homo sapiens
uggagggaguuaagaauau

SEQ ID NO: 591619 - RNA, 19 nt, Homo sapiens
gaagguggaggaaaugauc

SEQ ID NO: 591620 - RNA, 19 nt, Homo sapiens
gacuguggcugcauuucuu

SEQ ID NO: 591621 - RNA, 19 nt, Homo sapiens
gagggaguuaagaauauua

SEQ ID NO: 591622 - RNA, 19 nt, Homo sapiens
uggaagaacgugaagauga

SEQ ID NO: 591623 - RNA, 19 nt, Homo sapiens
guggagggaguuaagaaua

SEQ ID NO: 591624 - RNA, 19 nt, Homo sapiens
cagugaagguggaggaaau

SEQ ID NO: 591625 - RNA, 19 nt, Homo sapiens
gugaagaugauuguccuua

SEQ ID NO: 591626 - RNA, 19 nt, Homo sapiens
gaagccgacuaggcgaauu

SEQ ID NO: 591627 - RNA, 19 nt, Homo sapiens
ggugccuucucuuaaguaa

SEQ ID NO: 591628 - RNA, 19 nt, Homo sapiens
agaauauuaugacccagaa

SEQ ID NO: 591629 - RNA, 19 nt, Homo sapiens
gaagaacgugaagaugauu

SEQ ID NO: 591630 - RNA, 19 nt, Homo sapiens
gcaacaagacagaggaucu

SEQ ID NO: 591631 - RNA, 19 nt, Homo sapiens
ugcggaaccugcaaaguga

SEQ ID NO: 591632 - RNA, 19 nt, Homo sapiens
gguggccaguggguaauaa

SEQ ID NO: 591633 - RNA, 19 nt, Homo sapiens
gugcggaaccugcaaagug

SEQ ID NO: 591634 - RNA, 19 nt, Homo sapiens
ugccuucucuuaaguaaca

SEQ ID NO: 591635 - RNA, 19 nt, Homo sapiens
uggaacaucuccgcaacaa

SEQ ID NO: 591636 - RNA, 19 nt, Homo sapiens
uaucaucauccucuucauu

SEQ ID NO: 591637 - RNA, 19 nt, Homo sapiens
ggacuguggcugcauuucu

SEQ ID NO: 591638 - RNA, 19 nt, Homo sapiens
ccaagagggucuccuuucc

SEQ ID NO: 591639 - RNA, 19 nt, Homo sapiens
cgacuaggcgaauucacuu

SEQ ID NO: 591640 - RNA, 19 nt, Homo sapiens
gguggaagaacgugaagau

SEQ ID NO: 591641 - RNA, 19 nt, Homo sapiens
ggucuccuuuccugucuuc

SEQ ID NO: 591642 - RNA, 19 nt, Homo sapiens
ccucuucauugugcucuuu

SEQ ID NO: 591643 - RNA, 19 nt, Homo sapiens
caucugagcacuucaagac

SEQ ID NO: 591644 - RNA, 19 nt, Homo sapiens
gccaagagggucuccuuuc

SEQ ID NO: 591645 - RNA, 19 nt, Homo sapiens
gacuaggcgaauucacuua

SEQ ID NO: 591646 - RNA, 19 nt, Homo sapiens
ucaagacgacaucgcagaa

SEQ ID NO: 591647 - RNA, 19 nt, Homo sapiens
ccacaucugagcacuucaa

SEQ ID NO: 591648 - RNA, 19 nt, Homo sapiens
ggccaguggguaauaaaga

SEQ ID NO: 591649 - RNA, 19 nt, Homo sapiens
guugguggccaguggguaa

SEQ ID NO: 591650 - RNA, 19 nt, Homo sapiens
gcucugagacauggaggaa

SEQ ID NO: 591651 - RNA, 19 nt, Homo sapiens
gacaacccuccauaaaugu

SEQ ID NO: 591652 - RNA, 19 nt, Homo sapiens
gccaguggguaauaaagac

SEQ ID NO: 591653 - RNA, 19 nt, Homo sapiens
gcccugcugccacguugua

SEQ ID NO: 591654 - RNA, 19 nt, Homo sapiens
aauauuaugacccagaaug

SEQ ID NO: 591655 - RNA, 19 nt, Homo sapiens
gggaaaacuuggaacaucu

SEQ ID NO: 591656 - RNA, 19 nt, Homo sapiens
ggggaaaacuuggaacauc

SEQ ID NO: 591657 - RNA, 19 nt, Homo sapiens
uuucuuggguccuuagagu

SEQ ID NO: 591658 - RNA, 19 nt, Homo sapiens
caucauccucuucauugug

SEQ ID NO: 591659 - RNA, 19 nt, Homo sapiens
ucaucauccucuucauugu

SEQ ID NO: 591660 - RNA, 19 nt, Homo sapiens
gguggagggaguuaagaau

SEQ ID NO: 591661 - RNA, 19 nt, Homo sapiens
ugacagagaucuucauuaa

SEQ ID NO: 591662 - RNA, 19 nt, Homo sapiens
ggacaaaucagaaagcuua

SEQ ID NO: 591663 - RNA, 19 nt, Homo sapiens
aacaagaucuggacaguaa

SEQ ID NO: 591664 - RNA, 19 nt, Homo sapiens
ucaaguggaugaaguuauu

SEQ ID NO: 591665 - RNA, 19 nt, Homo sapiens
acagagaucuucauuaaca

SEQ ID NO: 591666 - RNA, 19 nt, Homo sapiens
aaauaugccucccaaguuu

SEQ ID NO: 591667 - RNA, 19 nt, Homo sapiens
caacagauccaaacaacuu

SEQ ID NO: 591668 - RNA, 19 nt, Homo sapiens
ugaaauaccguacuugauu

SEQ ID NO: 591669 - RNA, 19 nt, Homo sapiens
ggagagacuagaugaacua

SEQ ID NO: 591670 - RNA, 19 nt, Homo sapiens
caagaucuggacaguaaua

SEQ ID NO: 591671 - RNA, 19 nt, Homo sapiens
gagacuagaugaacuacag

SEQ ID NO: 591672 - RNA, 19 nt, Homo sapiens
uuaagcauguucagaauca

SEQ ID NO: 591673 - RNA, 19 nt, Homo sapiens
caacuucgaaggcaaaugu

SEQ ID NO: 591674 - RNA, 19 nt, Homo sapiens
uagaugaacuacaggacaa

SEQ ID NO: 591675 - RNA, 19 nt, Homo sapiens
gguggugacuauccuguug

SEQ ID NO: 591676 - RNA, 19 nt, Homo sapiens
gggaccaucuggaccaaga

SEQ ID NO: 591677 - RNA, 19 nt, Homo sapiens
caaaugugguggcguggau

SEQ ID NO: 591678 - RNA, 19 nt, Homo sapiens
uggaugaaguuauugaugu

SEQ ID NO: 591679 - RNA, 19 nt, Homo sapiens
gaucuggacaguaauaaag

SEQ ID NO: 591680 - RNA, 19 nt, Homo sapiens
gaaucaaguggaugaaguu

SEQ ID NO: 591681 - RNA, 19 nt, Homo sapiens
ggaugaaguuauugauguc

SEQ ID NO: 591682 - RNA, 19 nt, Homo sapiens
caugaaauaccguacuuga

SEQ ID NO: 591683 - RNA, 19 nt, Homo sapiens
ugacuauccuguugagaag

SEQ ID NO: 591684 - RNA, 19 nt, Homo sapiens
caaugaugaugaugucaca

SEQ ID NO: 591685 - RNA, 19 nt, Homo sapiens
uaacaagaucuggacagua

SEQ ID NO: 591686 - RNA, 19 nt, Homo sapiens
cuacaggacaaaucagaaa

SEQ ID NO: 591687 - RNA, 19 nt, Homo sapiens
agaaucaaguggaugaagu

SEQ ID NO: 591688 - RNA, 19 nt, Homo sapiens
gugacuauccuguugagaa

SEQ ID NO: 591689 - RNA, 19 nt, Homo sapiens
aaacaacuucgaaggcaaa

SEQ ID NO: 591690 - RNA, 19 nt, Homo sapiens
ccaccucaaugaugaugau

SEQ ID NO: 591691 - RNA, 19 nt, Homo sapiens
ggacaguaauaaagaugcu

SEQ ID NO: 591692 - RNA, 19 nt, Homo sapiens
gucaugaaauaccguacuu

SEQ ID NO: 591693 - RNA, 19 nt, Homo sapiens
ugaaguuauugaugucaug

SEQ ID NO: 591694 - RNA, 19 nt, Homo sapiens
uaccguacuugauuugaug

SEQ ID NO: 591695 - RNA, 19 nt, Homo sapiens
gggagagacuagaugaacu

SEQ ID NO: 591696 - RNA, 19 nt, Homo sapiens
uggaagaugauucagauga

SEQ ID NO: 591697 - RNA, 19 nt, Homo sapiens
cagagaucuucauuaacaa

SEQ ID NO: 591698 - RNA, 19 nt, Homo sapiens
caucauggcuuugguugcu

SEQ ID NO: 591699 - RNA, 19 nt, Homo sapiens
caaaauaaaagccaucaug

SEQ ID NO: 591700 - RNA, 19 nt, Homo sapiens
uggcguggaugcaaaauaa

SEQ ID NO: 591701 - RNA, 19 nt, Homo sapiens
ugaacuacaggacaaauca

SEQ ID NO: 591702 - RNA, 19 nt, Homo sapiens
ccucaaugaugaugauguc

SEQ ID NO: 591703 - RNA, 19 nt, Homo sapiens
uuuggaagaugauucagau

SEQ ID NO: 591704 - RNA, 19 nt, Homo sapiens
uuaacaagaucuggacagu

SEQ ID NO: 591705 - RNA, 19 nt, Homo sapiens
gugguggcguggaugcaaa

SEQ ID NO: 591706 - RNA, 19 nt, Homo sapiens
gauaaugcaacagcuuuua

SEQ ID NO: 591707 - RNA, 19 nt, Homo sapiens
cggauaaugcaacagcuuu

SEQ ID NO: 591708 - RNA, 19 nt, Homo sapiens
caaaucagaaagcuuaucg

SEQ ID NO: 591709 - RNA, 19 nt, Homo sapiens
aauaugccucccaaguuua

SEQ ID NO: 591710 - RNA, 19 nt, Homo sapiens
caagauuuggaccuagaaa

SEQ ID NO: 591711 - RNA, 19 nt, Homo sapiens
gaugaugaugucacagguu

SEQ ID NO: 591712 - RNA, 19 nt, Homo sapiens
uggcuuugguugcugcuau

SEQ ID NO: 591713 - RNA, 19 nt, Homo sapiens
uagcaacagauccaaacaa

SEQ ID NO: 591714 - RNA, 19 nt, Homo sapiens
uuaagcgccaccucaauga

SEQ ID NO: 591715 - RNA, 19 nt, Homo sapiens
agccucagguggugacuau

SEQ ID NO: 591716 - RNA, 19 nt, Homo sapiens
aaucaaguggaugaaguua

SEQ ID NO: 591717 - RNA, 19 nt, Homo sapiens
aaggagaaaucuuuuggaa

SEQ ID NO: 591718 - RNA, 19 nt, Homo sapiens
uacuugauuugaugacaga

SEQ ID NO: 591719 - RNA, 19 nt, Homo sapiens
aaaauaugccucccaaguu

SEQ ID NO: 591720 - RNA, 19 nt, Homo sapiens
gaacuacaggacaaaucag

SEQ ID NO: 591721 - RNA, 19 nt, Homo sapiens
guggaugaaguuauugaug

SEQ ID NO: 591722 - RNA, 19 nt, Homo sapiens
agaugaagaagaggacuuu

SEQ ID NO: 591723 - RNA, 19 nt, Homo sapiens
gaugaacuacaggacaaau

SEQ ID NO: 591724 - RNA, 19 nt, Homo sapiens
ggaccuagaaaugauaaaa

SEQ ID NO: 591725 - RNA, 19 nt, Homo sapiens
gaggaaagaucccagcauu

SEQ ID NO: 591726 - RNA, 19 nt, Homo sapiens
gaacaugccauugagauaa

SEQ ID NO: 591727 - RNA, 19 nt, Homo sapiens
gaaauucaguaugauguug

SEQ ID NO: 591728 - RNA, 19 nt, Homo sapiens
ucgagaagcuuccgugaaa

SEQ ID NO: 591729 - RNA, 19 nt, Homo sapiens
ggaagaugcuugugauuuu

SEQ ID NO: 591730 - RNA, 19 nt, Homo sapiens
ugacaagcauuuaaacaga

SEQ ID NO: 591731 - RNA, 19 nt, Homo sapiens
guacaguccuugacagaau

SEQ ID NO: 591732 - RNA, 19 nt, Homo sapiens
cgagaaagaaagugaauaa

SEQ ID NO: 591733 - RNA, 19 nt, Homo sapiens
ggauuaagcagaagaugaa

SEQ ID NO: 591734 - RNA, 19 nt, Homo sapiens
ggaacaugccauugagaua

SEQ ID NO: 591735 - RNA, 19 nt, Homo sapiens
gaagaugcuugugauuuua

SEQ ID NO: 591736 - RNA, 19 nt, Homo sapiens
gagacgauaacacucuuua

SEQ ID NO: 591737 - RNA, 19 nt, Homo sapiens
ucacaaggcagaacaguau

SEQ ID NO: 591738 - RNA, 19 nt, Homo sapiens
ugagauaacuacccaagag

SEQ ID NO: 591739 - RNA, 19 nt, Homo sapiens
ggaaagaucccagcauuuu

SEQ ID NO: 591740 - RNA, 19 nt, Homo sapiens
cgacacaucaguaccacua

SEQ ID NO: 591741 - RNA, 19 nt, Homo sapiens
ggauggaguggaugaaauu

SEQ ID NO: 591742 - RNA, 19 nt, Homo sapiens
caugaagaaucgagaggaa

SEQ ID NO: 591743 - RNA, 19 nt, Homo sapiens
gcacuggugucaggcauca

SEQ ID NO: 591744 - RNA, 19 nt, Homo sapiens
aaccgacgcuuucuuguug

SEQ ID NO: 591745 - RNA, 19 nt, Homo sapiens
cgugaagucucgauaagug

SEQ ID NO: 591746 - RNA, 19 nt, Homo sapiens
gcucauuguuguccucguu

SEQ ID NO: 591747 - RNA, 19 nt, Homo sapiens
ugacagaauugacuauaac

SEQ ID NO: 591748 - RNA, 19 nt, Homo sapiens
gauaaguggcauuggguuu

SEQ ID NO: 591749 - RNA, 19 nt, Homo sapiens
gaagagcgggaacgagaga

SEQ ID NO: 591750 - RNA, 19 nt, Homo sapiens
cgauaacacucuuuaccau

SEQ ID NO: 591751 - RNA, 19 nt, Homo sapiens
gcagaacaguaucaaaaga

SEQ ID NO: 591752 - RNA, 19 nt, Homo sapiens
gaauugacuauaacguuga

SEQ ID NO: 591753 - RNA, 19 nt, Homo sapiens
ccugaggccuugucgagaa

SEQ ID NO: 591754 - RNA, 19 nt, Homo sapiens
caucaucauugugcucauu

SEQ ID NO: 591755 - RNA, 19 nt, Homo sapiens
aaagaagaaucggaagaug

SEQ ID NO: 591756 - RNA, 19 nt, Homo sapiens
acaaucaggcuaccucaaa

SEQ ID NO: 591757 - RNA, 19 nt, Homo sapiens
gaagaggaacaugccauug

SEQ ID NO: 591758 - RNA, 19 nt, Homo sapiens
gggcgaugauuguagaaca

SEQ ID NO: 591759 - RNA, 19 nt, Homo sapiens
cagaauugacuauaacguu

SEQ ID NO: 591760 - RNA, 19 nt, Homo sapiens
uaaccgacgcuuucuuguu

SEQ ID NO: 591761 - RNA, 19 nt, Homo sapiens
aacugaagaugguuugaaa

SEQ ID NO: 591762 - RNA, 19 nt, Homo sapiens
ggugucaggcaucagcuua

SEQ ID NO: 591763 - RNA, 19 nt, Homo sapiens
cggaagaugcuugugauuu

SEQ ID NO: 591764 - RNA, 19 nt, Homo sapiens
acacacugaugguggaaga

SEQ ID NO: 591765 - RNA, 19 nt, Homo sapiens
guccauuucugaccugaau

SEQ ID NO: 591766 - RNA, 19 nt, Homo sapiens
caguaccacuaauggauga

SEQ ID NO: 591767 - RNA, 19 nt, Homo sapiens
ucaaacgcaugaagaaucg

SEQ ID NO: 591768 - RNA, 19 nt, Homo sapiens
gagauaacuacccaagaga

SEQ ID NO: 591769 - RNA, 19 nt, Homo sapiens
aaacagacccacccuggau

SEQ ID NO: 591770 - RNA, 19 nt, Homo sapiens
gcuguuagccgagcaacuu

SEQ ID NO: 591771 - RNA, 19 nt, Homo sapiens
cgaagaggaacaugccauu

SEQ ID NO: 591772 - RNA, 19 nt, Homo sapiens
acacaucaguaccacuaau

SEQ ID NO: 591773 - RNA, 19 nt, Homo sapiens
aagaggaacaugccauuga

SEQ ID NO: 591774 - RNA, 19 nt, Homo sapiens
ugacagcagcgaagaggaa

SEQ ID NO: 591775 - RNA, 19 nt, Homo sapiens
ucauugugcucauuguugu

SEQ ID NO: 591776 - RNA, 19 nt, Homo sapiens
gaagaaucgagaggaaaga

SEQ ID NO: 591777 - RNA, 19 nt, Homo sapiens
gauaacuacccaagagauc

SEQ ID NO: 591778 - RNA, 19 nt, Homo sapiens
uuaagcagaagaugaaaga

SEQ ID NO: 591779 - RNA, 19 nt, Homo sapiens
gauguuggccggauuaagc

SEQ ID NO: 591780 - RNA, 19 nt, Homo sapiens
agcagaagaugaaagaauc

SEQ ID NO: 591781 - RNA, 19 nt, Homo sapiens
uacaguccuugacagaauu

SEQ ID NO: 591782 - RNA, 19 nt, Homo sapiens
gaaauauucagggacuuag

SEQ ID NO: 591783 - RNA, 19 nt, Homo sapiens
ggcgugaagucucgauaag

SEQ ID NO: 591784 - RNA, 19 nt, Homo sapiens
uaucaaaacugaagauggu

SEQ ID NO: 591785 - RNA, 19 nt, Homo sapiens
ggagacgauaacacucuuu

SEQ ID NO: 591786 - RNA, 19 nt, Homo sapiens
cuucaugacaagcauuuaa

SEQ ID NO: 591787 - RNA, 19 nt, Homo sapiens
cggauuaagcagaagauga

SEQ ID NO: 591788 - RNA, 19 nt, Homo sapiens
uaugauguuggccggauua

SEQ ID NO: 591789 - RNA, 19 nt, Homo sapiens
guaugauguuggccggauu

SEQ ID NO: 591790 - RNA, 19 nt, Homo sapiens
uggauggaguggaugaaau

SEQ ID NO: 591791 - RNA, 19 nt, Homo sapiens
uuacagaggaccaguuagu

SEQ ID NO: 591792 - RNA, 19 nt, Homo sapiens
caaucaggcuaccucaaac

SEQ ID NO: 591793 - RNA, 19 nt, Homo sapiens
ucgcaaagggugagacaug

SEQ ID NO: 591794 - RNA, 19 nt, Homo sapiens
gaacacacugaugguggaa

SEQ ID NO: 591795 - RNA, 19 nt, Homo sapiens
gagaagcuuccgugaaagg

SEQ ID NO: 591796 - RNA, 19 nt, Homo sapiens
agaggaacaugccauugag

SEQ ID NO: 591797 - RNA, 19 nt, Homo sapiens
gaaucggccagccuucaug

SEQ ID NO: 591798 - RNA, 19 nt, Homo sapiens
aagcagaagaugaaagaau

SEQ ID NO: 591799 - RNA, 19 nt, Homo sapiens
caaaacggccaccuccuaa

SEQ ID NO: 591800 - RNA, 19 nt, Homo sapiens
cggccagccuucaugacaa

SEQ ID NO: 591801 - RNA, 19 nt, Homo sapiens
guggguggauggaguggau

SEQ ID NO: 591802 - RNA, 19 nt, Homo sapiens
aaucggaagaugcuuguga

SEQ ID NO: 591803 - RNA, 19 nt, Homo sapiens
ugaagaaucgagaggaaag

SEQ ID NO: 591804 - RNA, 19 nt, Homo sapiens
gaggaacaugccauugaga

SEQ ID NO: 591805 - RNA, 19 nt, Homo sapiens
ggccagccuucaugacaag

SEQ ID NO: 591806 - RNA, 19 nt, Homo sapiens
aaacggccaccuccuaagu

SEQ ID NO: 591807 - RNA, 19 nt, Homo sapiens
ccacgagaaagaaagugaa

SEQ ID NO: 591808 - RNA, 19 nt, Homo sapiens
agaacaggguacaguccuu

SEQ ID NO: 591809 - RNA, 19 nt, Homo sapiens
ugucaggcaucagcuuaga

SEQ ID NO: 591810 - RNA, 19 nt, Homo sapiens
acagaggaccaguuaguuc

SEQ ID NO: 591811 - RNA, 19 nt, Homo sapiens
gaagcagcgauugguguga

SEQ ID NO: 591812 - RNA, 19 nt, Homo sapiens
caugacaagcauuuaaaca

SEQ ID NO: 591813 - RNA, 19 nt, Homo sapiens
gguacaguccuugacagaa

SEQ ID NO: 591814 - RNA, 19 nt, Homo sapiens
ggguacaguccuugacaga

SEQ ID NO: 591815 - RNA, 19 nt, Homo sapiens
ggacuuaggggcgaugauu

SEQ ID NO: 591816 - RNA, 19 nt, Homo sapiens
gagcgggaacgagagauuc

SEQ ID NO: 591817 - RNA, 19 nt, Homo sapiens
gccacgagaaagaaaguga

SEQ ID NO: 591818 - RNA, 19 nt, Homo sapiens
caaaagaagaaucggaaga

SEQ ID NO: 591819 - RNA, 19 nt, Homo sapiens
ggagcagaacacacugaug

SEQ ID NO: 591820 - RNA, 19 nt, Homo sapiens
uggaugauggagacgauaa

SEQ ID NO: 591821 - RNA, 19 nt, Homo sapiens
caucaguaccacuaaugga

SEQ ID NO: 591822 - RNA, 19 nt, Homo sapiens
aggaaagaucccagcauuu

SEQ ID NO: 591823 - RNA, 19 nt, Homo sapiens
caucagcuuagauccagaa

SEQ ID NO: 591824 - RNA, 19 nt, Homo sapiens
gcauuggguuuucgugugu

SEQ ID NO: 591825 - RNA, 19 nt, Homo sapiens
gaaagaugguuaguugaua

SEQ ID NO: 591826 - RNA, 19 nt, Homo sapiens
ggaacucagucuuuagaaa

SEQ ID NO: 591827 - RNA, 19 nt, Homo sapiens
ggaaagaugguuaguugau

SEQ ID NO: 591828 - RNA, 19 nt, Homo sapiens
ggaaggccgugcaguacga

SEQ ID NO: 591829 - RNA, 19 nt, Homo sapiens
uuggaaagaugguuaguug

SEQ ID NO: 591830 - RNA, 19 nt, Homo sapiens
gaaagaccggcuagcagaa

SEQ ID NO: 591831 - RNA, 19 nt, Homo sapiens
gaaacgccagguucaagaa

SEQ ID NO: 591832 - RNA, 19 nt, Homo sapiens
gaacucagucuuuagaaaa

SEQ ID NO: 591833 - RNA, 19 nt, Homo sapiens
guccgaugauucuucagua

SEQ ID NO: 591834 - RNA, 19 nt, Homo sapiens
guucaagaauugcaaacca

SEQ ID NO: 591835 - RNA, 19 nt, Homo sapiens
aaagaugguuaguugauac

SEQ ID NO: 591836 - RNA, 19 nt, Homo sapiens
cgaugauucuucaguaaag

SEQ ID NO: 591837 - RNA, 19 nt, Homo sapiens
gggagucgcgcaacagguu

SEQ ID NO: 591838 - RNA, 19 nt, Homo sapiens
uuccggaacucagucuuua

SEQ ID NO: 591839 - RNA, 19 nt, Homo sapiens
ucaucgagcucaacguaca

SEQ ID NO: 591840 - RNA, 19 nt, Homo sapiens
cgucaucgagcucaacgua

SEQ ID NO: 591841 - RNA, 19 nt, Homo sapiens
ccagaucgaggacauguuc

SEQ ID NO: 591842 - RNA, 19 nt, Homo sapiens
gcaauaugaccagcaguuc

SEQ ID NO: 591843 - RNA, 19 nt, Homo sapiens
gugcuuggaaagaugguua

SEQ ID NO: 591844 - RNA, 19 nt, Homo sapiens
uacacgagcucuucuugca

SEQ ID NO: 591845 - RNA, 19 nt, Homo sapiens
gcaucaagcgcgacaccaa

SEQ ID NO: 591846 - RNA, 19 nt, Homo sapiens
ggagaucaugggcaaggaa

SEQ ID NO: 591847 - RNA, 19 nt, Homo sapiens
uccgaugauucuucaguaa

SEQ ID NO: 591848 - RNA, 19 nt, Homo sapiens
uggcggugcugguggagaa

SEQ ID NO: 591849 - RNA, 19 nt, Homo sapiens
ugaagcggcugggaaagca

SEQ ID NO: 591850 - RNA, 19 nt, Homo sapiens
aaaccagccugugcuugga

SEQ ID NO: 591851 - RNA, 19 nt, Homo sapiens
gcgaccagaucgaggacau

SEQ ID NO: 591852 - RNA, 19 nt, Homo sapiens
ugaagcagcgcgacaacug

SEQ ID NO: 591853 - RNA, 19 nt, Homo sapiens
gcgaggucauccacugcaa

SEQ ID NO: 591854 - RNA, 19 nt, Homo sapiens
acgccagguucaagaauug

SEQ ID NO: 591855 - RNA, 19 nt, Homo sapiens
uccgggacauucaggauga

SEQ ID NO: 591856 - RNA, 19 nt, Homo sapiens
cgagacauccgggacauuc

SEQ ID NO: 591857 - RNA, 19 nt, Homo sapiens
cgacguacacgagcucuuc

SEQ ID NO: 591858 - RNA, 19 nt, Homo sapiens
ccgaugauucuucaguaaa

SEQ ID NO: 591859 - RNA, 19 nt, Homo sapiens
ggguaagugggacguguuu

SEQ ID NO: 591860 - RNA, 19 nt, Homo sapiens
guugauaccguccgaugau

SEQ ID NO: 591861 - RNA, 19 nt, Homo sapiens
agaaacgccagguucaaga

SEQ ID NO: 591862 - RNA, 19 nt, Homo sapiens
ggagucgcgcaacagguuu

SEQ ID NO: 591863 - RNA, 19 nt, Homo sapiens
gagcucaacguacaaaaga

SEQ ID NO: 591864 - RNA, 19 nt, Homo sapiens
gaucaugggcaaggaaguc

SEQ ID NO: 591865 - RNA, 19 nt, Homo sapiens
caaccaggccgagaugaag

SEQ ID NO: 591866 - RNA, 19 nt, Homo sapiens
aaagaaacgccagguucaa

SEQ ID NO: 591867 - RNA, 19 nt, Homo sapiens
aacgccagguucaagaauu

SEQ ID NO: 591868 - RNA, 19 nt, Homo sapiens
gaccagaucgaggacaugu

SEQ ID NO: 591869 - RNA, 19 nt, Homo sapiens
cgcaacagguuuccuucuc

SEQ ID NO: 591870 - RNA, 19 nt, Homo sapiens
ccggaacucagucuuuaga

SEQ ID NO: 591871 - RNA, 19 nt, Homo sapiens
gcgcgacaacugcaagauc

SEQ ID NO: 591872 - RNA, 19 nt, Homo sapiens
gauaccguccgaugauucu

SEQ ID NO: 591873 - RNA, 19 nt, Homo sapiens
acaaccaggccgagaugaa

SEQ ID NO: 591874 - RNA, 19 nt, Homo sapiens
cuacaaccaggccgagaug

SEQ ID NO: 591875 - RNA, 19 nt, Homo sapiens
ggaagagaccaucgguaua

SEQ ID NO: 591876 - RNA, 19 nt, Homo sapiens
ccaaugagcugcggaaugg

SEQ ID NO: 591877 - RNA, 19 nt, Homo sapiens
gaagagaccaucgguauag

SEQ ID NO: 591878 - RNA, 19 nt, Homo sapiens
gccaaaguaucccacauga

SEQ ID NO: 591879 - RNA, 19 nt, Homo sapiens
gaccaucgguauaguggaa

SEQ ID NO: 591880 - RNA, 19 nt, Homo sapiens
ggaaaugaaggaccauaug

SEQ ID NO: 591881 - RNA, 19 nt, Homo sapiens
gagaggcaguccaggaaau

SEQ ID NO: 591882 - RNA, 19 nt, Homo sapiens
gaaaugaaggaccauaugg

SEQ ID NO: 591883 - RNA, 19 nt, Homo sapiens
guucucaucuuacuauucu

SEQ ID NO: 591884 - RNA, 19 nt, Homo sapiens
ggccacaucucgcuacauc

SEQ ID NO: 591885 - RNA, 19 nt, Homo sapiens
ucuccucguucucaucuua

SEQ ID NO: 591886 - RNA, 19 nt, Homo sapiens
ucaggaaguuggccaaagu

SEQ ID NO: 591887 - RNA, 19 nt, Homo sapiens
caagccagcugcccagaag

SEQ ID NO: 591888 - RNA, 19 nt, Homo sapiens
cccaacagccguagcauuu

SEQ ID NO: 591889 - RNA, 19 nt, Homo sapiens
gaaguuggccaaaguaucc

SEQ ID NO: 591890 - RNA, 19 nt, Homo sapiens
gaggaauaacagagagaua

SEQ ID NO: 591891 - RNA, 19 nt, Homo sapiens
ggaauggccugcgcagcau

SEQ ID NO: 591892 - RNA, 19 nt, Homo sapiens
gcauccagguucugaagca

SEQ ID NO: 591893 - RNA, 19 nt, Homo sapiens
uaucccacaugacgaguga

SEQ ID NO: 591894 - RNA, 19 nt, Homo sapiens
gcgagaggcaguccaggaa

SEQ ID NO: 591895 - RNA, 19 nt, Homo sapiens
uggaagagaccaucgguau

SEQ ID NO: 591896 - RNA, 19 nt, Homo sapiens
ggaccucgaggaccuggaa

SEQ ID NO: 591897 - RNA, 19 nt, Homo sapiens
ggaaguuggccaaaguauc

SEQ ID NO: 591898 - RNA, 19 nt, Homo sapiens
ggacgagcagggcaucaug

SEQ ID NO: 591899 - RNA, 19 nt, Homo sapiens
gcaagccagcugcccagaa

SEQ ID NO: 591900 - RNA, 19 nt, Homo sapiens
ccacaucucgcuacaucga

SEQ ID NO: 591901 - RNA, 19 nt, Homo sapiens
ggccaaaguaucccacaug

SEQ ID NO: 591902 - RNA, 19 nt, Homo sapiens
ggaauaacagagagauacu

SEQ ID NO: 591903 - RNA, 19 nt, Homo sapiens
gagcauccagguucugaag

SEQ ID NO: 591904 - RNA, 19 nt, Homo sapiens
gagaggaauaacagagaga

SEQ ID NO: 591905 - RNA, 19 nt, Homo sapiens
caggaaguuggccaaagua

SEQ ID NO: 591906 - RNA, 19 nt, Homo sapiens
gcccaacagccguagcauu

SEQ ID NO: 591907 - RNA, 19 nt, Homo sapiens
cgagaggcaguccaggaaa

SEQ ID NO: 591908 - RNA, 19 nt, Homo sapiens
gggagcauccagguucuga

SEQ ID NO: 591909 - RNA, 19 nt, Homo sapiens
gaagccaacccaggcaagu

SEQ ID NO: 591910 - RNA, 19 nt, Homo sapiens
ggacuggacgaccaaugag

SEQ ID NO: 591911 - RNA, 19 nt, Homo sapiens
uggacuggacgaccaauga

SEQ ID NO: 591912 - RNA, 19 nt, Homo sapiens
gaggcaguccaggaaauga

SEQ ID NO: 591913 - RNA, 19 nt, Homo sapiens
cuaaggagcugccguuaua

SEQ ID NO: 591914 - RNA, 19 nt, Homo sapiens
gauaugaaaugguguuuga

SEQ ID NO: 591915 - RNA, 19 nt, Homo sapiens
gaauugagauugauguguu

SEQ ID NO: 591916 - RNA, 19 nt, Homo sapiens
uaaaggagcuggcacuaga

SEQ ID NO: 591917 - RNA, 19 nt, Homo sapiens
uaagaugggucugaaauuu

SEQ ID NO: 591918 - RNA, 19 nt, Homo sapiens
ggaugacagugaacaguua

SEQ ID NO: 591919 - RNA, 19 nt, Homo sapiens
gccaacagcuucacucuga

SEQ ID NO: 591920 - RNA, 19 nt, Homo sapiens
gaucagaugcuugaaauuu

SEQ ID NO: 591921 - RNA, 19 nt, Homo sapiens
gaggagccauuuauugaaa

SEQ ID NO: 591922 - RNA, 19 nt, Homo sapiens
gauaccgacuuguuccuua

SEQ ID NO: 591923 - RNA, 19 nt, Homo sapiens
gagaggagccauuuauuga

SEQ ID NO: 591924 - RNA, 19 nt, Homo sapiens
gagagaauacagugaauuu

SEQ ID NO: 591925 - RNA, 19 nt, Homo sapiens
caaagaagagguugagaaa

SEQ ID NO: 591926 - RNA, 19 nt, Homo sapiens
ggaacucacagcuccauua

SEQ ID NO: 591927 - RNA, 19 nt, Homo sapiens
caacaugccaucuauaguu

SEQ ID NO: 591928 - RNA, 19 nt, Homo sapiens
gaaugaggaugacagugaa

SEQ ID NO: 591929 - RNA, 19 nt, Homo sapiens
gagaugaggauauguuuga

SEQ ID NO: 591930 - RNA, 19 nt, Homo sapiens
ggagaggagccauuuauug

SEQ ID NO: 591931 - RNA, 19 nt, Homo sapiens
gaaaugguguuugauacug

SEQ ID NO: 591932 - RNA, 19 nt, Homo sapiens
gacaaaagcucucaaguuc

SEQ ID NO: 591933 - RNA, 19 nt, Homo sapiens
ggacacgaguuucaagauc

SEQ ID NO: 591934 - RNA, 19 nt, Homo sapiens
gauacuguuugagacauua

SEQ ID NO: 591935 - RNA, 19 nt, Homo sapiens
gagaugcacaguuggauaa

SEQ ID NO: 591936 - RNA, 19 nt, Homo sapiens
ggaauggaaugagauuaau

SEQ ID NO: 591937 - RNA, 19 nt, Homo sapiens
cggguaauauuaaacagua

SEQ ID NO: 591938 - RNA, 19 nt, Homo sapiens
gcuacaacaugccaucuau

SEQ ID NO: 591939 - RNA, 19 nt, Homo sapiens
gaaaagaaccgcaagauag

SEQ ID NO: 591940 - RNA, 19 nt, Homo sapiens
ccaauaagaugggucugaa

SEQ ID NO: 591941 - RNA, 19 nt, Homo sapiens
gaucuuagagcaaaugaau

SEQ ID NO: 591942 - RNA, 19 nt, Homo sapiens
ugaguugaauugagauuga

SEQ ID NO: 591943 - RNA, 19 nt, Homo sapiens
gacauuauggagagauuua

SEQ ID NO: 591944 - RNA, 19 nt, Homo sapiens
acucacagcuccauuacuu

SEQ ID NO: 591945 - RNA, 19 nt, Homo sapiens
gagcugccguuauacuguu

SEQ ID NO: 591946 - RNA, 19 nt, Homo sapiens
gugaucagaugcuugaaau

SEQ ID NO: 591947 - RNA, 19 nt, Homo sapiens
aagaagagguugagaaagg

SEQ ID NO: 591948 - RNA, 19 nt, Homo sapiens
aagauuugcugcagucuga

SEQ ID NO: 591949 - RNA, 19 nt, Homo sapiens
uccaugcucuggccaauaa

SEQ ID NO: 591950 - RNA, 19 nt, Homo sapiens
ggaggaagcucaguaucag

SEQ ID NO: 591951 - RNA, 19 nt, Homo sapiens
gagacauuauggagagauu

SEQ ID NO: 591952 - RNA, 19 nt, Homo sapiens
caacaaguuugaccaugca

SEQ ID NO: 591953 - RNA, 19 nt, Homo sapiens
ugaaugaggaugacaguga

SEQ ID NO: 591954 - RNA, 19 nt, Homo sapiens
gauggugucucucgcagau

SEQ ID NO: 591955 - RNA, 19 nt, Homo sapiens
gaugugaucagaugcuuga

SEQ ID NO: 591956 - RNA, 19 nt, Homo sapiens
ggagaaaggcaagauugaa

SEQ ID NO: 591957 - RNA, 19 nt, Homo sapiens
ggauggauguggagaaagg

SEQ ID NO: 591958 - RNA, 19 nt, Homo sapiens
ggaaaagaaccgcaagaua

SEQ ID NO: 591959 - RNA, 19 nt, Homo sapiens
ggacaaaagcucucaaguu

SEQ ID NO: 591960 - RNA, 19 nt, Homo sapiens
gagaaaggcgagacacguu

SEQ ID NO: 591961 - RNA, 19 nt, Homo sapiens
ucacuugguucuuauacug

SEQ ID NO: 591962 - RNA, 19 nt, Homo sapiens
uuacugagaugaggauaug

SEQ ID NO: 591963 - RNA, 19 nt, Homo sapiens
caggauggauguggagaaa

SEQ ID NO: 591964 - RNA, 19 nt, Homo sapiens
uuucagagauaccgacuug

SEQ ID NO: 591965 - RNA, 19 nt, Homo sapiens
aaaccaacgucuuuaaugc

SEQ ID NO: 591966 - RNA, 19 nt, Homo sapiens
gcacagauacucuuuuaga

SEQ ID NO: 591967 - RNA, 19 nt, Homo sapiens
gguguuugauacuguuuga

SEQ ID NO: 591968 - RNA, 19 nt, Homo sapiens
uagaccagcuggacacuca

SEQ ID NO: 591969 - RNA, 19 nt, Homo sapiens
aggaugauguccacagaaa

SEQ ID NO: 591970 - RNA, 19 nt, Homo sapiens
ggacuccuuucccuuucuu

SEQ ID NO: 591971 - RNA, 19 nt, Homo sapiens
cagauacuuuccagagcua

SEQ ID NO: 591972 - RNA, 19 nt, Homo sapiens
gagaaaggcaagauugaag

SEQ ID NO: 591973 - RNA, 19 nt, Homo sapiens
augaugagcugaagagugu

SEQ ID NO: 591974 - RNA, 19 nt, Homo sapiens
ucuaagacguccaacaaca

SEQ ID NO: 591975 - RNA, 19 nt, Homo sapiens
gagacuggaucaggaggaa

SEQ ID NO: 591976 - RNA, 19 nt, Homo sapiens
gcaaaugaaugaggaugac

SEQ ID NO: 591977 - RNA, 19 nt, Homo sapiens
gaaaaugagugucagaacu

SEQ ID NO: 591978 - RNA, 19 nt, Homo sapiens
gaaagugccaacagcuuca

SEQ ID NO: 591979 - RNA, 19 nt, Homo sapiens
ggaggaagagacuaacuca

SEQ ID NO: 591980 - RNA, 19 nt, Homo sapiens
guacauguuuacaauacca

SEQ ID NO: 591981 - RNA, 19 nt, Homo sapiens
caguuuggcacaaucaaua

SEQ ID NO: 591982 - RNA, 19 nt, Homo sapiens
gaaugcacagauacucuuu

SEQ ID NO: 591983 - RNA, 19 nt, Homo sapiens
ggaaugcacagauacucuu

SEQ ID NO: 591984 - RNA, 19 nt, Homo sapiens
caacagcuucacucugauu

SEQ ID NO: 591985 - RNA, 19 nt, Homo sapiens
ccaggaugauguccacaga

SEQ ID NO: 591986 - RNA, 19 nt, Homo sapiens
gaaaaugacaucuaagcuu

SEQ ID NO: 591987 - RNA, 19 nt, Homo sapiens
uguuugagaugcacaguug

SEQ ID NO: 591988 - RNA, 19 nt, Homo sapiens
ucagagauaccgacuuguu

SEQ ID NO: 591989 - RNA, 19 nt, Homo sapiens
uggaauggaaugagauuaa

SEQ ID NO: 591990 - RNA, 19 nt, Homo sapiens
gaugauguccacagaaagu

SEQ ID NO: 591991 - RNA, 19 nt, Homo sapiens
gaacucacagcuccauuac

SEQ ID NO: 591992 - RNA, 19 nt, Homo sapiens
caguacauguuuacaauac

SEQ ID NO: 591993 - RNA, 19 nt, Homo sapiens
ucaaguucaugcugacgaa

SEQ ID NO: 591994 - RNA, 19 nt, Homo sapiens
caaaagcucucaaguucau

SEQ ID NO: 591995 - RNA, 19 nt, Homo sapiens
uuacggaaaccauucauau

SEQ ID NO: 591996 - RNA, 19 nt, Homo sapiens
gugcagcaguucaaagaag

SEQ ID NO: 591997 - RNA, 19 nt, Homo sapiens
gaauggaaugagauuaaug

SEQ ID NO: 591998 - RNA, 19 nt, Homo sapiens
ucagagagaauacagugaa

SEQ ID NO: 591999 - RNA, 19 nt, Homo sapiens
uuccugcacuuaacaauau

SEQ ID NO: 592000 - RNA, 19 nt, Homo sapiens
gagagacccaggaggaaga

SEQ ID NO: 592001 - RNA, 19 nt, Homo sapiens
gagcugaagaguguugaaa

SEQ ID NO: 592002 - RNA, 19 nt, Homo sapiens
caggagaggagccauuuau

SEQ ID NO: 592003 - RNA, 19 nt, Homo sapiens
gcaagauaguggcagaaaa

SEQ ID NO: 592004 - RNA, 19 nt, Homo sapiens
gaugcacaguuggauaaug

SEQ ID NO: 592005 - RNA, 19 nt, Homo sapiens
gcaguucaaagaagagguu

SEQ ID NO: 592006 - RNA, 19 nt, Homo sapiens
ggacaacaaguuugaccau

SEQ ID NO: 592007 - RNA, 19 nt, Homo sapiens
cagagagaauacagugaau

SEQ ID NO: 592008 - RNA, 19 nt, Homo sapiens
cagaaaaucucgagaaggu

SEQ ID NO: 592009 - RNA, 19 nt, Homo sapiens
cauggacuccuuucccuuu

SEQ ID NO: 592010 - RNA, 19 nt, Homo sapiens
caaguuugaccaugcaaug

SEQ ID NO: 592011 - RNA, 19 nt, Homo sapiens
auucauaucuggagucucu

SEQ ID NO: 592012 - RNA, 19 nt, Homo sapiens
gugaacaguuacagaugga

SEQ ID NO: 592013 - RNA, 19 nt, Homo sapiens
caacuccgcuccacuucua

SEQ ID NO: 592014 - RNA, 19 nt, Homo sapiens
gcaaugacuucccuguaug

SEQ ID NO: 592015 - RNA, 19 nt, Homo sapiens
ggcaaugacuucccuguau

SEQ ID NO: 592016 - RNA, 19 nt, Homo sapiens
gcucaagaaugucauggaa

SEQ ID NO: 592017 - RNA, 19 nt, Homo sapiens
ggcagagccugaccacuuu

SEQ ID NO: 592018 - RNA, 19 nt, Homo sapiens
gagagaagcauuuccuguu

SEQ ID NO: 592019 - RNA, 19 nt, Homo sapiens
acaggcagcucaagaaugu

SEQ ID NO: 592020 - RNA, 19 nt, Homo sapiens
caucacagacucauacaaa

SEQ ID NO: 592021 - RNA, 19 nt, Homo sapiens
gggcagagccugaccacuu

SEQ ID NO: 592022 - RNA, 19 nt, Homo sapiens
gagcugggccucuuggauu

SEQ ID NO: 592023 - RNA, 19 nt, Homo sapiens
aaccagagcuuucacuuca

SEQ ID NO: 592024 - RNA, 19 nt, Homo sapiens
caaccuaccagcuaacuga

SEQ ID NO: 592025 - RNA, 19 nt, Homo sapiens
guaguuggagcacuugaua

SEQ ID NO: 592026 - RNA, 19 nt, Homo sapiens
gagcaggagcugaguauuc

SEQ ID NO: 592027 - RNA, 19 nt, Homo sapiens
caacuaaaggcgccacuga

SEQ ID NO: 592028 - RNA, 19 nt, Homo sapiens
gaaccagagcuuucacuuc

SEQ ID NO: 592029 - RNA, 19 nt, Homo sapiens
gcaguagcccugucuggaa

SEQ ID NO: 592030 - RNA, 19 nt, Homo sapiens
gcacaaggaccacuaugag

SEQ ID NO: 592031 - RNA, 19 nt, Homo sapiens
gccaagcccauuuguguaa

SEQ ID NO: 592032 - RNA, 19 nt, Homo sapiens
cggcugcagugacuucuuu

SEQ ID NO: 592033 - RNA, 19 nt, Homo sapiens
agacccaggugaccaagaa

SEQ ID NO: 592034 - RNA, 19 nt, Homo sapiens
ccacugaguugcugaagac

SEQ ID NO: 592035 - RNA, 19 nt, Homo sapiens
gagaugacccuguguuguc

SEQ ID NO: 592036 - RNA, 19 nt, Homo sapiens
ucaagaaugucauggaacu

SEQ ID NO: 592037 - RNA, 19 nt, Homo sapiens
agagaagcauuuccuguuc

SEQ ID NO: 592038 - RNA, 19 nt, Homo sapiens
ugaaggagcugggccucuu

SEQ ID NO: 592039 - RNA, 19 nt, Homo sapiens
caacaggccgugcauuauc

SEQ ID NO: 592040 - RNA, 19 nt, Homo sapiens
ggagcgaguuacgagaauu

SEQ ID NO: 592041 - RNA, 19 nt, Homo sapiens
acgaggcgcugcugcauga

SEQ ID NO: 592042 - RNA, 19 nt, Homo sapiens
cccaacaggccgugcauua

SEQ ID NO: 592043 - RNA, 19 nt, Homo sapiens
ucauggaacugaaagucuu

SEQ ID NO: 592044 - RNA, 19 nt, Homo sapiens
ugacuucuuugcacaagga

SEQ ID NO: 592045 - RNA, 19 nt, Homo sapiens
gcaccugacacauuacaau

SEQ ID NO: 592046 - RNA, 19 nt, Homo sapiens
gcccaggccacacauaauu

SEQ ID NO: 592047 - RNA, 19 nt, Homo sapiens
gauugcgucuccuacauca

SEQ ID NO: 592048 - RNA, 19 nt, Homo sapiens
gcgccuggaaguugaauuu

SEQ ID NO: 592049 - RNA, 19 nt, Homo sapiens
caaccuccaggacagcuua

SEQ ID NO: 592050 - RNA, 19 nt, Homo sapiens
gcugcugccugaucuggaa

SEQ ID NO: 592051 - RNA, 19 nt, Homo sapiens
gaagaaccacccucaacag

SEQ ID NO: 592052 - RNA, 19 nt, Homo sapiens
gggcaaugacuucccugua

SEQ ID NO: 592053 - RNA, 19 nt, Homo sapiens
gcccaucgccuacccucua

SEQ ID NO: 592054 - RNA, 19 nt, Homo sapiens
cugaagagggcaccuuuaa

SEQ ID NO: 592055 - RNA, 19 nt, Homo sapiens
acaaggaccacuaugagaa

SEQ ID NO: 592056 - RNA, 19 nt, Homo sapiens
uuaaggugguggaugaaga

SEQ ID NO: 592057 - RNA, 19 nt, Homo sapiens
ccuaccagcuaacugaaga

SEQ ID NO: 592058 - RNA, 19 nt, Homo sapiens
ugcugcaccugacacauua

SEQ ID NO: 592059 - RNA, 19 nt, Homo sapiens
ggugggauccgggcaauga

SEQ ID NO: 592060 - RNA, 19 nt, Homo sapiens
gaaugucauggaacugaaa

SEQ ID NO: 592061 - RNA, 19 nt, Homo sapiens
gaugagaguggagcugaaa

SEQ ID NO: 592062 - RNA, 19 nt, Homo sapiens
ggagacaggagaccagaag

SEQ ID NO: 592063 - RNA, 19 nt, Homo sapiens
ggagaugacccuguguugu

SEQ ID NO: 592064 - RNA, 19 nt, Homo sapiens
ggaaccagagcuuucacuu

SEQ ID NO: 592065 - RNA, 19 nt, Homo sapiens
ggccaagcccauuugugua

SEQ ID NO: 592066 - RNA, 19 nt, Homo sapiens
ccucagagcccagccaguu

SEQ ID NO: 592067 - RNA, 19 nt, Homo sapiens
ccugaccacuuuugaauuu

SEQ ID NO: 592068 - RNA, 19 nt, Homo sapiens
agaacccucugcccaucua

SEQ ID NO: 592069 - RNA, 19 nt, Homo sapiens
gagaggggaucgcuucaug

SEQ ID NO: 592070 - RNA, 19 nt, Homo sapiens
gauacaucacagacucaua

SEQ ID NO: 592071 - RNA, 19 nt, Homo sapiens
gaaggagcugggccucuug

SEQ ID NO: 592072 - RNA, 19 nt, Homo sapiens
ccggcaaccuaccagcuaa

SEQ ID NO: 592073 - RNA, 19 nt, Homo sapiens
ccgaagcccugggaaagau

SEQ ID NO: 592074 - RNA, 19 nt, Homo sapiens
cccuaacucucauucauuc

SEQ ID NO: 592075 - RNA, 19 nt, Homo sapiens
ccaacaggccgugcauuau

SEQ ID NO: 592076 - RNA, 19 nt, Homo sapiens
uuacgcggaugccgugaga

SEQ ID NO: 592077 - RNA, 19 nt, Homo sapiens
aggccaaccuggacaagga

SEQ ID NO: 592078 - RNA, 19 nt, Homo sapiens
uggcagggcccacugaguu

SEQ ID NO: 592079 - RNA, 19 nt, Homo sapiens
gggagcaggagcugaguau

SEQ ID NO: 592080 - RNA, 19 nt, Homo sapiens
agaaugucauggaacugaa

SEQ ID NO: 592081 - RNA, 19 nt, Homo sapiens
gcccgaugcugugaacuuc

SEQ ID NO: 592082 - RNA, 19 nt, Homo sapiens
gaccucauccugucauugg

SEQ ID NO: 592083 - RNA, 19 nt, Homo sapiens
cauccucacuucuccacau

SEQ ID NO: 592084 - RNA, 19 nt, Homo sapiens
uagaagguaucuggagcaa

SEQ ID NO: 592085 - RNA, 19 nt, Homo sapiens
gagcucugcgugccucuug

SEQ ID NO: 592086 - RNA, 19 nt, Homo sapiens
gagaccagaaguccucaga

SEQ ID NO: 592087 - RNA, 19 nt, Homo sapiens
gcggagcgaguuacgagaa

SEQ ID NO: 592088 - RNA, 19 nt, Homo sapiens
gagcgaguuacgagaauuc

SEQ ID NO: 592089 - RNA, 19 nt, Homo sapiens
ccacaggcagcucaagaau

SEQ ID NO: 592090 - RNA, 19 nt, Homo sapiens
caagcccauuuguguaauc

SEQ ID NO: 592091 - RNA, 19 nt, Homo sapiens
gaaagcuaccacucuggau

SEQ ID NO: 592092 - RNA, 19 nt, Homo sapiens
uggccuccauuuccacaaa

SEQ ID NO: 592093 - RNA, 19 nt, Homo sapiens
gccggcagauagcugaguu

SEQ ID NO: 592094 - RNA, 19 nt, Homo sapiens
agaagaaccacccucaaca

SEQ ID NO: 592095 - RNA, 19 nt, Homo sapiens
gaaguccucagagcacaga

SEQ ID NO: 592096 - RNA, 19 nt, Homo sapiens
gacccuguguugucaguac

SEQ ID NO: 592097 - RNA, 19 nt, Homo sapiens
uuggagcacuugauacauc

SEQ ID NO: 592098 - RNA, 19 nt, Homo sapiens
cccaucgccuacccucuaa

SEQ ID NO: 592099 - RNA, 19 nt, Homo sapiens
cacaaggaccacuaugaga

SEQ ID NO: 592100 - RNA, 19 nt, Homo sapiens
uugaguaguuggagcacuu

SEQ ID NO: 592101 - RNA, 19 nt, Homo sapiens
caucuacugugcccucaac

SEQ ID NO: 592102 - RNA, 19 nt, Homo sapiens
aucacaagcucucagauca

SEQ ID NO: 592103 - RNA, 19 nt, Homo sapiens
cgucagcaauggcguucug

SEQ ID NO: 592104 - RNA, 19 nt, Homo sapiens
agacacgcacggucaagaa

SEQ ID NO: 592105 - RNA, 19 nt, Homo sapiens
ggacucucccuaccacuac

SEQ ID NO: 592106 - RNA, 19 nt, Homo sapiens
gcucuuuggcuccgaguuc

SEQ ID NO: 592107 - RNA, 19 nt, Homo sapiens
ucacaagcucucagaucaa

SEQ ID NO: 592108 - RNA, 19 nt, Homo sapiens
aggcgcugcugcaugauga

SEQ ID NO: 592109 - RNA, 19 nt, Homo sapiens
cagaguggucucagaagga

SEQ ID NO: 592110 - RNA, 19 nt, Homo sapiens
ugaugagaguggagcugaa

SEQ ID NO: 592111 - RNA, 19 nt, Homo sapiens
uguguugucaguacuguuu

SEQ ID NO: 592112 - RNA, 19 nt, Homo sapiens
cuucugcgcuaccuugagu

SEQ ID NO: 592113 - RNA, 19 nt, Homo sapiens
gaauaaaggugauugauug

SEQ ID NO: 592114 - RNA, 19 nt, Homo sapiens
gaaguuaacuacaguguuu

SEQ ID NO: 592115 - RNA, 19 nt, Homo sapiens
ggaagggacuuacuuagga

SEQ ID NO: 592116 - RNA, 19 nt, Homo sapiens
gaaagaaguuaacuacagu

SEQ ID NO: 592117 - RNA, 19 nt, Homo sapiens
gaagagagagauacuugua

SEQ ID NO: 592118 - RNA, 19 nt, Homo sapiens
gagagauacuuguagaauu

SEQ ID NO: 592119 - RNA, 19 nt, Homo sapiens
aggaagagaucaucaaauu

SEQ ID NO: 592120 - RNA, 19 nt, Homo sapiens
acaacaagcuggacaaaga

SEQ ID NO: 592121 - RNA, 19 nt, Homo sapiens
ggaauaaaggugauugauu

SEQ ID NO: 592122 - RNA, 19 nt, Homo sapiens
gaacuguccuuccauuugg

SEQ ID NO: 592123 - RNA, 19 nt, Homo sapiens
gaagagaucaucaaauugg

SEQ ID NO: 592124 - RNA, 19 nt, Homo sapiens
gaacaucccaagccagaaa

SEQ ID NO: 592125 - RNA, 19 nt, Homo sapiens
gacaaccucuccuacauug

SEQ ID NO: 592126 - RNA, 19 nt, Homo sapiens
agagauacuuguagaauug

SEQ ID NO: 592127 - RNA, 19 nt, Homo sapiens
gaagggacuuacuuaggaa

SEQ ID NO: 592128 - RNA, 19 nt, Homo sapiens
ucuaguaguuucucuguaa

SEQ ID NO: 592129 - RNA, 19 nt, Homo sapiens
gaaugagacccuuagguuu

SEQ ID NO: 592130 - RNA, 19 nt, Homo sapiens
caacaucacccuugaagau

SEQ ID NO: 592131 - RNA, 19 nt, Homo sapiens
cagagacuauuuagacaaa

SEQ ID NO: 592132 - RNA, 19 nt, Homo sapiens
cuaacuguguguacauaua

SEQ ID NO: 592133 - RNA, 19 nt, Homo sapiens
ggaaacccuucuuuacuag

SEQ ID NO: 592134 - RNA, 19 nt, Homo sapiens
aggaaacccuucuuuacua

SEQ ID NO: 592135 - RNA, 19 nt, Homo sapiens
guagguggauccagggaaa

SEQ ID NO: 592136 - RNA, 19 nt, Homo sapiens
gaaucaaauugcuacauag

SEQ ID NO: 592137 - RNA, 19 nt, Homo sapiens
ccaacaacaucacccuuga

SEQ ID NO: 592138 - RNA, 19 nt, Homo sapiens
acaguacucuuaacuccua

SEQ ID NO: 592139 - RNA, 19 nt, Homo sapiens
gaagggaguggcagaauca

SEQ ID NO: 592140 - RNA, 19 nt, Homo sapiens
cuagggagguugaagaaug

SEQ ID NO: 592141 - RNA, 19 nt, Homo sapiens
agaaagaaguuaacuacag

SEQ ID NO: 592142 - RNA, 19 nt, Homo sapiens
ucacuauggugguugacua

SEQ ID NO: 592143 - RNA, 19 nt, Homo sapiens
gaagaaaugggagaagaga

SEQ ID NO: 592144 - RNA, 19 nt, Homo sapiens
agagagagauacuuguaga

SEQ ID NO: 592145 - RNA, 19 nt, Homo sapiens
ggaagagaucaucaaauug

SEQ ID NO: 592146 - RNA, 19 nt, Homo sapiens
agacaaaguucaaguuagg

SEQ ID NO: 592147 - RNA, 19 nt, Homo sapiens
gcauuaacuuauugucuag

SEQ ID NO: 592148 - RNA, 19 nt, Homo sapiens
aaacugcacugccaugucu

SEQ ID NO: 592149 - RNA, 19 nt, Homo sapiens
ugcaagaccugaccaacaa

SEQ ID NO: 592150 - RNA, 19 nt, Homo sapiens
caagaaguacaaagacauu

SEQ ID NO: 592151 - RNA, 19 nt, Homo sapiens
acaccaagcuaacccguau

SEQ ID NO: 592152 - RNA, 19 nt, Homo sapiens
uuugggauauguuacguua

SEQ ID NO: 592153 - RNA, 19 nt, Homo sapiens
caugaacuguccuuccauu

SEQ ID NO: 592154 - RNA, 19 nt, Homo sapiens
ccacaucacuacaguacag

SEQ ID NO: 592155 - RNA, 19 nt, Homo sapiens
uagggagguugaagaauga

SEQ ID NO: 592156 - RNA, 19 nt, Homo sapiens
caucuaguuccucuucuua

SEQ ID NO: 592157 - RNA, 19 nt, Homo sapiens
cagcagagucuaguaguuu

SEQ ID NO: 592158 - RNA, 19 nt, Homo sapiens
ugggauauguuacguuaga

SEQ ID NO: 592159 - RNA, 19 nt, Homo sapiens
gagacuauuuagacaaagu

SEQ ID NO: 592160 - RNA, 19 nt, Homo sapiens
ucuauagggucccaacuug

SEQ ID NO: 592161 - RNA, 19 nt, Homo sapiens
gaaaaucucugaggaggau

SEQ ID NO: 592162 - RNA, 19 nt, Homo sapiens
agaaugagacccuuagguu

SEQ ID NO: 592163 - RNA, 19 nt, Homo sapiens
gccaagaaguacaaagaca

SEQ ID NO: 592164 - RNA, 19 nt, Homo sapiens
aggaugagcuggacaccaa

SEQ ID NO: 592165 - RNA, 19 nt, Homo sapiens
guccugaccuacucacuau

SEQ ID NO: 592166 - RNA, 19 nt, Homo sapiens
gcuacauaguccaaacaaa

SEQ ID NO: 592167 - RNA, 19 nt, Homo sapiens
ucagacuguugcacucuaa

SEQ ID NO: 592168 - RNA, 19 nt, Homo sapiens
gaaguacaaagacauuauc

SEQ ID NO: 592169 - RNA, 19 nt, Homo sapiens
guucuaacccggaauaaag

SEQ ID NO: 592170 - RNA, 19 nt, Homo sapiens
agagugagagagagaauaa

SEQ ID NO: 592171 - RNA, 19 nt, Homo sapiens
ccagaaagaaguuaacuac

SEQ ID NO: 592172 - RNA, 19 nt, Homo sapiens
uuuguggugucuagcauua

SEQ ID NO: 592173 - RNA, 19 nt, Homo sapiens
caagucggccugcaaggaa

SEQ ID NO: 592174 - RNA, 19 nt, Homo sapiens
cuacauugagcacaucuuu

SEQ ID NO: 592175 - RNA, 19 nt, Homo sapiens
ggugauugauuguauugca

SEQ ID NO: 592176 - RNA, 19 nt, Homo sapiens
caucacccuugaagaucua

SEQ ID NO: 592177 - RNA, 19 nt, Homo sapiens
ggaguggcagaaucaaauu

SEQ ID NO: 592178 - RNA, 19 nt, Homo sapiens
gggaguggcagaaucaaau

SEQ ID NO: 592179 - RNA, 19 nt, Homo sapiens
cuuaggaaacccuucuuua

SEQ ID NO: 592180 - RNA, 19 nt, Homo sapiens
ucagcagagucuaguaguu

SEQ ID NO: 592181 - RNA, 19 nt, Homo sapiens
ugaacuguccuuccauuug

SEQ ID NO: 592182 - RNA, 19 nt, Homo sapiens
cccaccaucuacccacuua

SEQ ID NO: 592183 - RNA, 19 nt, Homo sapiens
acauugagcacaucuuuga

SEQ ID NO: 592184 - RNA, 19 nt, Homo sapiens
acaaagacaaccucuccua

SEQ ID NO: 592185 - RNA, 19 nt, Homo sapiens
uggaagaaaugggagaaga

SEQ ID NO: 592186 - RNA, 19 nt, Homo sapiens
gguuagacaguacucuuaa

SEQ ID NO: 592187 - RNA, 19 nt, Homo sapiens
ugaagggaguggcagaauc

SEQ ID NO: 592188 - RNA, 19 nt, Homo sapiens
gaagacauccccagcgaaa

SEQ ID NO: 592189 - RNA, 19 nt, Homo sapiens
aagccagaguuccauguuu

SEQ ID NO: 592190 - RNA, 19 nt, Homo sapiens
gugcacggccuuguucuaa

SEQ ID NO: 592191 - RNA, 19 nt, Homo sapiens
uuauauugcugugagauug

SEQ ID NO: 592192 - RNA, 19 nt, Homo sapiens
uagacaaaguucaaguuag

SEQ ID NO: 592193 - RNA, 19 nt, Homo sapiens
aaauucacaugcagucuca

SEQ ID NO: 592194 - RNA, 19 nt, Homo sapiens
uuacuaaccugguccuaac

SEQ ID NO: 592195 - RNA, 19 nt, Homo sapiens
gagagagauacuuguagaa

SEQ ID NO: 592196 - RNA, 19 nt, Homo sapiens
guacgggacccuccugcaa

SEQ ID NO: 592197 - RNA, 19 nt, Homo sapiens
caacaacaucacccuugaa

SEQ ID NO: 592198 - RNA, 19 nt, Homo sapiens
ccaucuacccacuuacuaa

SEQ ID NO: 592199 - RNA, 19 nt, Homo sapiens
gugauugauuguauugcaa

SEQ ID NO: 592200 - RNA, 19 nt, Homo sapiens
aagacaaccucuccuacau

SEQ ID NO: 592201 - RNA, 19 nt, Homo sapiens
agaaaugggagaagagaga

SEQ ID NO: 592202 - RNA, 19 nt, Homo sapiens
aagaagagagagauacuug

SEQ ID NO: 592203 - RNA, 19 nt, Homo sapiens
acaccugccuuaacacaca

SEQ ID NO: 592204 - RNA, 19 nt, Homo sapiens
gagcagccagcguuagaug

SEQ ID NO: 592205 - RNA, 19 nt, Homo sapiens
acauugaggagcugacaua

SEQ ID NO: 592206 - RNA, 19 nt, Homo sapiens
gaggcgucauggcugagua

SEQ ID NO: 592207 - RNA, 19 nt, Homo sapiens
ugaggaagagaucaucaaa

SEQ ID NO: 592208 - RNA, 19 nt, Homo sapiens
ggaagaaaugggagaagag

SEQ ID NO: 592209 - RNA, 19 nt, Homo sapiens
gaacaccuccuagccacau

SEQ ID NO: 592210 - RNA, 19 nt, Homo sapiens
aaacccuucuuuacuagau

SEQ ID NO: 592211 - RNA, 19 nt, Homo sapiens
cuccugugcuggacuguuu

SEQ ID NO: 592212 - RNA, 19 nt, Homo sapiens
gaggaagagaucaucaaau

SEQ ID NO: 592213 - RNA, 19 nt, Homo sapiens
cuauggagaucaacaguua

SEQ ID NO: 592214 - RNA, 19 nt, Homo sapiens
gaaugggccuccuacaaga

SEQ ID NO: 592215 - RNA, 19 nt, Homo sapiens
gaaaagaagacauggaaua

SEQ ID NO: 592216 - RNA, 19 nt, Homo sapiens
uaaacuggaugacaccaaa

SEQ ID NO: 592217 - RNA, 19 nt, Homo sapiens
ggaagaaaugguuaugauu

SEQ ID NO: 592218 - RNA, 19 nt, Homo sapiens
ggaaugggccuccuacaag

SEQ ID NO: 592219 - RNA, 19 nt, Homo sapiens
gauuuagugucuuaggaaa

SEQ ID NO: 592220 - RNA, 19 nt, Homo sapiens
gagagaagcaccagcuaug

SEQ ID NO: 592221 - RNA, 19 nt, Homo sapiens
uggaggaccuguucuacaa

SEQ ID NO: 592222 - RNA, 19 nt, Homo sapiens
gaauaugcccugcguaaac

SEQ ID NO: 592223 - RNA, 19 nt, Homo sapiens
gcucuacuauggagaucaa

SEQ ID NO: 592224 - RNA, 19 nt, Homo sapiens
gggugaaacuuccuacauc

SEQ ID NO: 592225 - RNA, 19 nt, Homo sapiens
ugagacaggugaugggaau

SEQ ID NO: 592226 - RNA, 19 nt, Homo sapiens
gaaaugguuaugauuaugg

SEQ ID NO: 592227 - RNA, 19 nt, Homo sapiens
ggacuuggaggaccuguuc

SEQ ID NO: 592228 - RNA, 19 nt, Homo sapiens
aagaagacauggaauaugc

SEQ ID NO: 592229 - RNA, 19 nt, Homo sapiens
uggaagaaaugguuaugau

SEQ ID NO: 592230 - RNA, 19 nt, Homo sapiens
gauugaggauuuagugucu

SEQ ID NO: 592231 - RNA, 19 nt, Homo sapiens
cauuccagauugaggauuu

SEQ ID NO: 592232 - RNA, 19 nt, Homo sapiens
ccacacuacuucucuccuu

SEQ ID NO: 592233 - RNA, 19 nt, Homo sapiens
ggaauaugcccugcguaaa

SEQ ID NO: 592234 - RNA, 19 nt, Homo sapiens
uugaggauuuagugucuua

SEQ ID NO: 592235 - RNA, 19 nt, Homo sapiens
ccaaauuccgcucucauga

SEQ ID NO: 592236 - RNA, 19 nt, Homo sapiens
ggauuuagugucuuaggaa

SEQ ID NO: 592237 - RNA, 19 nt, Homo sapiens
augcagaggaugcuauuua

SEQ ID NO: 592238 - RNA, 19 nt, Homo sapiens
gaggaccuguucuacaagu

SEQ ID NO: 592239 - RNA, 19 nt, Homo sapiens
caccagcuauggcuacuca

SEQ ID NO: 592240 - RNA, 19 nt, Homo sapiens
ggaugucuguuaugcugau

SEQ ID NO: 592241 - RNA, 19 nt, Homo sapiens
gaguuuauccugagagaag

SEQ ID NO: 592242 - RNA, 19 nt, Homo sapiens
uggaauaugcccugcguaa

SEQ ID NO: 592243 - RNA, 19 nt, Homo sapiens
ugcagaggaugcuauuuau

SEQ ID NO: 592244 - RNA, 19 nt, Homo sapiens
cuacaagaagaucugauuu

SEQ ID NO: 592245 - RNA, 19 nt, Homo sapiens
cacacuacuucucuccuuu

SEQ ID NO: 592246 - RNA, 19 nt, Homo sapiens
gcagaggaugcuauuuaug

SEQ ID NO: 592247 - RNA, 19 nt, Homo sapiens
cagaggaugcuauuuaugg

SEQ ID NO: 592248 - RNA, 19 nt, Homo sapiens
gauggucgaguaucucaga

SEQ ID NO: 592249 - RNA, 19 nt, Homo sapiens
gaugcuauuuauggaagaa

SEQ ID NO: 592250 - RNA, 19 nt, Homo sapiens
gcuuugugcucagaaucua

SEQ ID NO: 592251 - RNA, 19 nt, Homo sapiens
ggccauauuagcagugaaa

SEQ ID NO: 592252 - RNA, 19 nt, Homo sapiens
uagguuaacugagcugcuu

SEQ ID NO: 592253 - RNA, 19 nt, Homo sapiens
gauuuccgaguucuuguuu

SEQ ID NO: 592254 - RNA, 19 nt, Homo sapiens
agaggaugcuauuuaugga

SEQ ID NO: 592255 - RNA, 19 nt, Homo sapiens
cuuccuacauccgaguuua

SEQ ID NO: 592256 - RNA, 19 nt, Homo sapiens
ggucgaguaucucagaaaa

SEQ ID NO: 592257 - RNA, 19 nt, Homo sapiens
cauauuagcagugaaacau

SEQ ID NO: 592258 - RNA, 19 nt, Homo sapiens
gaucugauuuccgaguucu

SEQ ID NO: 592259 - RNA, 19 nt, Homo sapiens
agacaggugaugggaauuu

SEQ ID NO: 592260 - RNA, 19 nt, Homo sapiens
gaggaugcuauuuauggaa

SEQ ID NO: 592261 - RNA, 19 nt, Homo sapiens
ggaccugaaggaucacaug

SEQ ID NO: 592262 - RNA, 19 nt, Homo sapiens
ccuacaagaagaucugauu

SEQ ID NO: 592263 - RNA, 19 nt, Homo sapiens
gagaugcagaggaugcuau

SEQ ID NO: 592264 - RNA, 19 nt, Homo sapiens
ccagauugaggauuuagug

SEQ ID NO: 592265 - RNA, 19 nt, Homo sapiens
ggaugcuauuuauggaaga

SEQ ID NO: 592266 - RNA, 19 nt, Homo sapiens
caaauuccgcucucaugag

SEQ ID NO: 592267 - RNA, 19 nt, Homo sapiens
aaagaagacauggaauaug

SEQ ID NO: 592268 - RNA, 19 nt, Homo sapiens
acaagaagaucugauuucc

SEQ ID NO: 592269 - RNA, 19 nt, Homo sapiens
cugcagaaauugugguuuu

SEQ ID NO: 592270 - RNA, 19 nt, Homo sapiens
ugagagaagcaccagcuau

SEQ ID NO: 592271 - RNA, 19 nt, Homo sapiens
ccgaguuuauccugagaga

SEQ ID NO: 592272 - RNA, 19 nt, Homo sapiens
gaguggggauggucgagua

SEQ ID NO: 592273 - RNA, 19 nt, Homo sapiens
uacaagaagaucugauuuc

SEQ ID NO: 592274 - RNA, 19 nt, Homo sapiens
gggguucgcucuacuaugg

SEQ ID NO: 592275 - RNA, 19 nt, Homo sapiens
aagaucugauuuccgaguu

SEQ ID NO: 592276 - RNA, 19 nt, Homo sapiens
agucggcccauucuguuua

SEQ ID NO: 592277 - RNA, 19 nt, Homo sapiens
gagucggcccauucuguuu

SEQ ID NO: 592278 - RNA, 19 nt, Homo sapiens
augcugaugugcagaagga

SEQ ID NO: 592279 - RNA, 19 nt, Homo sapiens
guaaacuggaugacaccaa

SEQ ID NO: 592280 - RNA, 19 nt, Homo sapiens
uuuccgaguucuuguuuca

SEQ ID NO: 592281 - RNA, 19 nt, Homo sapiens
ggaccuguucuacaaguac

SEQ ID NO: 592282 - RNA, 19 nt, Homo sapiens
gggauggucgaguaucuca

SEQ ID NO: 592283 - RNA, 19 nt, Homo sapiens
ugagucggcccauucuguu

SEQ ID NO: 592284 - RNA, 19 nt, Homo sapiens
ccgugacucuccauaccaa

SEQ ID NO: 592285 - RNA, 19 nt, Homo sapiens
cagaaaagaagacauggaa

SEQ ID NO: 592286 - RNA, 19 nt, Homo sapiens
guucuuguuucaggacuuc

SEQ ID NO: 592287 - RNA, 19 nt, Homo sapiens
aaaucguucugucuuugug

SEQ ID NO: 592288 - RNA, 19 nt, Homo sapiens
ucgaguaucucagaaaaga

SEQ ID NO: 592289 - RNA, 19 nt, Homo sapiens
uaccagggccauauuagca

SEQ ID NO: 592290 - RNA, 19 nt, Homo sapiens
aggauuuagugucuuagga

SEQ ID NO: 592291 - RNA, 19 nt, Homo sapiens
aauaugcccugcguaaacu

SEQ ID NO: 592292 - RNA, 19 nt, Homo sapiens
gggcagaucuggcuggaua

SEQ ID NO: 592293 - RNA, 19 nt, Homo sapiens
gaaguuuacuacaguggua

SEQ ID NO: 592294 - RNA, 19 nt, Homo sapiens
uaaaggagaucaaggacaa

SEQ ID NO: 592295 - RNA, 19 nt, Homo sapiens
gaagggcccuguacaaagu

SEQ ID NO: 592296 - RNA, 19 nt, Homo sapiens
guagacaacuucacucaga

SEQ ID NO: 592297 - RNA, 19 nt, Homo sapiens
ggagauguauuuccucaau

SEQ ID NO: 592298 - RNA, 19 nt, Homo sapiens
ggacuuuggccaucuauaa

SEQ ID NO: 592299 - RNA, 19 nt, Homo sapiens
cuauaaagcuuggcaauga

SEQ ID NO: 592300 - RNA, 19 nt, Homo sapiens
ccagggauguucagaauca

SEQ ID NO: 592301 - RNA, 19 nt, Homo sapiens
cgaaaucaauguuccaaag

SEQ ID NO: 592302 - RNA, 19 nt, Homo sapiens
gacgagcucuugagugaga

SEQ ID NO: 592303 - RNA, 19 nt, Homo sapiens
ggacacaggacuucaagga

SEQ ID NO: 592304 - RNA, 19 nt, Homo sapiens
gggaagugcugcgagguuu

SEQ ID NO: 592305 - RNA, 19 nt, Homo sapiens
caauggagccuuucgaaau

SEQ ID NO: 592306 - RNA, 19 nt, Homo sapiens
gaggaucucugaggaguuc

SEQ ID NO: 592307 - RNA, 19 nt, Homo sapiens
gcaaaauucugaugccauu

SEQ ID NO: 592308 - RNA, 19 nt, Homo sapiens
gcaauggagccuuucgaaa

SEQ ID NO: 592309 - RNA, 19 nt, Homo sapiens
ggagaggggccauuaauaa

SEQ ID NO: 592310 - RNA, 19 nt, Homo sapiens
ugaaagaggugaaaacuca

SEQ ID NO: 592311 - RNA, 19 nt, Homo sapiens
gaacuaagggagagaaagg

SEQ ID NO: 592312 - RNA, 19 nt, Homo sapiens
aggacgagcucuugaguga

SEQ ID NO: 592313 - RNA, 19 nt, Homo sapiens
ggaagugcugcgagguuua

SEQ ID NO: 592314 - RNA, 19 nt, Homo sapiens
agauguauuuccucaauga

SEQ ID NO: 592315 - RNA, 19 nt, Homo sapiens
gggacgagauggagcaaca

SEQ ID NO: 592316 - RNA, 19 nt, Homo sapiens
ggaagggcccuguacaaag

SEQ ID NO: 592317 - RNA, 19 nt, Homo sapiens
gcuuggcaaugagaaauaa

SEQ ID NO: 592318 - RNA, 19 nt, Homo sapiens
gggcugaaguuuacuacag

SEQ ID NO: 592319 - RNA, 19 nt, Homo sapiens
gagauguauuuccucaaug

SEQ ID NO: 592320 - RNA, 19 nt, Homo sapiens
aaauugcaauggagccuuu

SEQ ID NO: 592321 - RNA, 19 nt, Homo sapiens
gaaggaucuuucuccaagu

SEQ ID NO: 592322 - RNA, 19 nt, Homo sapiens
agaucuggcuggauaaugu

SEQ ID NO: 592323 - RNA, 19 nt, Homo sapiens
ccaggacuuuggccaucua

SEQ ID NO: 592324 - RNA, 19 nt, Homo sapiens
uagcugugguggucaucua

SEQ ID NO: 592325 - RNA, 19 nt, Homo sapiens
caugcuggguuacuccaaa

SEQ ID NO: 592326 - RNA, 19 nt, Homo sapiens
ggagagaagggcagcaaag

SEQ ID NO: 592327 - RNA, 19 nt, Homo sapiens
aauggagccuuucgaaauc

SEQ ID NO: 592328 - RNA, 19 nt, Homo sapiens
uagacaacuucacucagaa

SEQ ID NO: 592329 - RNA, 19 nt, Homo sapiens
gaaauggggugaacuucuc

SEQ ID NO: 592330 - RNA, 19 nt, Homo sapiens
gacuuuggccaucuauaaa

SEQ ID NO: 592331 - RNA, 19 nt, Homo sapiens
gaugacgaguggcaaaauu

SEQ ID NO: 592332 - RNA, 19 nt, Homo sapiens
ccaaaggaagggcccugua

SEQ ID NO: 592333 - RNA, 19 nt, Homo sapiens
uggacaagcuggccagaag

SEQ ID NO: 592334 - RNA, 19 nt, Homo sapiens
gggaccaccugcugagaag

SEQ ID NO: 592335 - RNA, 19 nt, Homo sapiens
ccaaagcccaagaggagaa

SEQ ID NO: 592336 - RNA, 19 nt, Homo sapiens
ggagcugcaccaagaauag

SEQ ID NO: 592337 - RNA, 19 nt, Homo sapiens
cuguggagcugcaccaaga

SEQ ID NO: 592338 - RNA, 19 nt, Homo sapiens
gcuggauaauguucagugu

SEQ ID NO: 592339 - RNA, 19 nt, Homo sapiens
ucaaggacagcaaggaaga

SEQ ID NO: 592340 - RNA, 19 nt, Homo sapiens
cgucagccaugagcacuug

SEQ ID NO: 592341 - RNA, 19 nt, Homo sapiens
ggagugaaaggaucuucug

SEQ ID NO: 592342 - RNA, 19 nt, Homo sapiens
aaaggagaaucaggaguuc

SEQ ID NO: 592343 - RNA, 19 nt, Homo sapiens
cagaaucaaaggugaacaa

SEQ ID NO: 592344 - RNA, 19 nt, Homo sapiens
gaaaucaauguuccaaagc

SEQ ID NO: 592345 - RNA, 19 nt, Homo sapiens
gagaggggccauuaauaaa

SEQ ID NO: 592346 - RNA, 19 nt, Homo sapiens
caaaggaagggcccuguac

SEQ ID NO: 592347 - RNA, 19 nt, Homo sapiens
gcaaggaguaaagggagaa

SEQ ID NO: 592348 - RNA, 19 nt, Homo sapiens
ggcaaugagaaauaagaaa

SEQ ID NO: 592349 - RNA, 19 nt, Homo sapiens
ggaggacgagcucuugagu

SEQ ID NO: 592350 - RNA, 19 nt, Homo sapiens
gccacaggccugaaaggaa

SEQ ID NO: 592351 - RNA, 19 nt, Homo sapiens
ggcugaaguuuacuacagu

SEQ ID NO: 592352 - RNA, 19 nt, Homo sapiens
gaccagggagugaaaggau

SEQ ID NO: 592353 - RNA, 19 nt, Homo sapiens
acccagggauguucagaau

SEQ ID NO: 592354 - RNA, 19 nt, Homo sapiens
gaucuggcuggauaauguu

SEQ ID NO: 592355 - RNA, 19 nt, Homo sapiens
aaggaucuuucuccaagug

SEQ ID NO: 592356 - RNA, 19 nt, Homo sapiens
gggagaccagggagugaaa

SEQ ID NO: 592357 - RNA, 19 nt, Homo sapiens
uauaaagcuuggcaaugag

SEQ ID NO: 592358 - RNA, 19 nt, Homo sapiens
gggaaggaucuuucuccaa

SEQ ID NO: 592359 - RNA, 19 nt, Homo sapiens
aggauugucggcaguagua

SEQ ID NO: 592360 - RNA, 19 nt, Homo sapiens
gcagaucuggcuggauaau

SEQ ID NO: 592361 - RNA, 19 nt, Homo sapiens
gguccaaguucugaaucug

SEQ ID NO: 592362 - RNA, 19 nt, Homo sapiens
gaagugcugcgagguuuac

SEQ ID NO: 592363 - RNA, 19 nt, Homo sapiens
aggaagggcccuguacaaa

SEQ ID NO: 592364 - RNA, 19 nt, Homo sapiens
gaucuuucuccaagugguu

SEQ ID NO: 592365 - RNA, 19 nt, Homo sapiens
ggguagacaacuucacuca

SEQ ID NO: 592366 - RNA, 19 nt, Homo sapiens
ucaaggaggacgagcucuu

SEQ ID NO: 592367 - RNA, 19 nt, Homo sapiens
gagagaagggcagcaaagg

SEQ ID NO: 592368 - RNA, 19 nt, Homo sapiens
ggagaaauggggugaacuu

SEQ ID NO: 592369 - RNA, 19 nt, Homo sapiens
ggccauuaauaaagcucaa

SEQ ID NO: 592370 - RNA, 19 nt, Homo sapiens
aaggaagggcccuguacaa

SEQ ID NO: 592371 - RNA, 19 nt, Homo sapiens
caaggacagcaaggaagaa

SEQ ID NO: 592372 - RNA, 19 nt, Homo sapiens
ggaacuaagggagagaaag

SEQ ID NO: 592373 - RNA, 19 nt, Homo sapiens
caacacagccucuuacaua

SEQ ID NO: 592374 - RNA, 19 nt, Homo sapiens
ggauugagcuggacauuga

SEQ ID NO: 592375 - RNA, 19 nt, Homo sapiens
gaacacggcaugauuuaaa

SEQ ID NO: 592376 - RNA, 19 nt, Homo sapiens
ggaucaagcuggagaguga

SEQ ID NO: 592377 - RNA, 19 nt, Homo sapiens
agaaugagauugccacgua

SEQ ID NO: 592378 - RNA, 19 nt, Homo sapiens
gcuauaacuuugcuucuuu

SEQ ID NO: 592379 - RNA, 19 nt, Homo sapiens
aaagagagaugcuuguuau

SEQ ID NO: 592380 - RNA, 19 nt, Homo sapiens
guagagauuugcuaaguau

SEQ ID NO: 592381 - RNA, 19 nt, Homo sapiens
ggaaacugauuaaguggaa

SEQ ID NO: 592382 - RNA, 19 nt, Homo sapiens
gaacaccaacuuuaacuug

SEQ ID NO: 592383 - RNA, 19 nt, Homo sapiens
cacagaagcuccuggauga

SEQ ID NO: 592384 - RNA, 19 nt, Homo sapiens
gaaauguuccuuccucuga

SEQ ID NO: 592385 - RNA, 19 nt, Homo sapiens
ccacauuccuggcaacauu

SEQ ID NO: 592386 - RNA, 19 nt, Homo sapiens
gguagagauuugcuaagua

SEQ ID NO: 592387 - RNA, 19 nt, Homo sapiens
cagccaaccugauuucaaa

SEQ ID NO: 592388 - RNA, 19 nt, Homo sapiens
caaagagagaugcuuguua

SEQ ID NO: 592389 - RNA, 19 nt, Homo sapiens
aaaucuggcuucuaacuuu

SEQ ID NO: 592390 - RNA, 19 nt, Homo sapiens
ucaagaacaccaacuuuaa

SEQ ID NO: 592391 - RNA, 19 nt, Homo sapiens
caaaggaagugaagaacag

SEQ ID NO: 592392 - RNA, 19 nt, Homo sapiens
guccaaaggcuaugagaua

SEQ ID NO: 592393 - RNA, 19 nt, Homo sapiens
ggaaagcgaggacugcaaa

SEQ ID NO: 592394 - RNA, 19 nt, Homo sapiens
ucgaggagcuccaacagaa

SEQ ID NO: 592395 - RNA, 19 nt, Homo sapiens
ggcaggaggucaaagcauu

SEQ ID NO: 592396 - RNA, 19 nt, Homo sapiens
gagaaugccaggcugauug

SEQ ID NO: 592397 - RNA, 19 nt, Homo sapiens
cacaacagguagauaauca

SEQ ID NO: 592398 - RNA, 19 nt, Homo sapiens
uguaucaaauccugaguuu

SEQ ID NO: 592399 - RNA, 19 nt, Homo sapiens
gccgaugacuuuaggauca

SEQ ID NO: 592400 - RNA, 19 nt, Homo sapiens
uuucuuggguuguuucuaa

SEQ ID NO: 592401 - RNA, 19 nt, Homo sapiens
ccaugcaguuccugaauga

SEQ ID NO: 592402 - RNA, 19 nt, Homo sapiens
ccacauuucuuggguuguu

SEQ ID NO: 592403 - RNA, 19 nt, Homo sapiens
ucugagauuucccacauuu

SEQ ID NO: 592404 - RNA, 19 nt, Homo sapiens
ugacaaaggaagugaagaa

SEQ ID NO: 592405 - RNA, 19 nt, Homo sapiens
agacccggcuggagaauga

SEQ ID NO: 592406 - RNA, 19 nt, Homo sapiens
agaggaggcuucagucuca

SEQ ID NO: 592407 - RNA, 19 nt, Homo sapiens
guaggaacacggcaugauu

SEQ ID NO: 592408 - RNA, 19 nt, Homo sapiens
uuaacgagcugagaaacuu

SEQ ID NO: 592409 - RNA, 19 nt, Homo sapiens
ccugaaguauugaaaccua

SEQ ID NO: 592410 - RNA, 19 nt, Homo sapiens
ggaacuuucagauuaagaa

SEQ ID NO: 592411 - RNA, 19 nt, Homo sapiens
guauaggccuguccaaagg

SEQ ID NO: 592412 - RNA, 19 nt, Homo sapiens
ggguagagauuugcuaagu

SEQ ID NO: 592413 - RNA, 19 nt, Homo sapiens
ggagaggcauaagguugaa

SEQ ID NO: 592414 - RNA, 19 nt, Homo sapiens
gaugcuuguuauaccuuua

SEQ ID NO: 592415 - RNA, 19 nt, Homo sapiens
uaaagauucugaggaguca

SEQ ID NO: 592416 - RNA, 19 nt, Homo sapiens
ucugauggcuauaacuuug

SEQ ID NO: 592417 - RNA, 19 nt, Homo sapiens
gaaacugauuaaguggaaa

SEQ ID NO: 592418 - RNA, 19 nt, Homo sapiens
cuuggaaacugauuaagug

SEQ ID NO: 592419 - RNA, 19 nt, Homo sapiens
ggacauugagcccaccauu

SEQ ID NO: 592420 - RNA, 19 nt, Homo sapiens
cuucaggguuucuagcuuu

SEQ ID NO: 592421 - RNA, 19 nt, Homo sapiens
cuaauucccuucuccuauc

SEQ ID NO: 592422 - RNA, 19 nt, Homo sapiens
aguggaaucuugauggaaa

SEQ ID NO: 592423 - RNA, 19 nt, Homo sapiens
gcuucuaacuuucuguaug

SEQ ID NO: 592424 - RNA, 19 nt, Homo sapiens
gccaagaggccucagauuc

SEQ ID NO: 592425 - RNA, 19 nt, Homo sapiens
gagcaggaaguaaagauuc

SEQ ID NO: 592426 - RNA, 19 nt, Homo sapiens
caccacaacagguagauaa

SEQ ID NO: 592427 - RNA, 19 nt, Homo sapiens
gauggcaccacaacaggua

SEQ ID NO: 592428 - RNA, 19 nt, Homo sapiens
gagauuugcuaaguaugau

SEQ ID NO: 592429 - RNA, 19 nt, Homo sapiens
gaaguauugaaaccuauug

SEQ ID NO: 592430 - RNA, 19 nt, Homo sapiens
acaccaacuuuaacuugaa

SEQ ID NO: 592431 - RNA, 19 nt, Homo sapiens
ggaacacggcaugauuuaa

SEQ ID NO: 592432 - RNA, 19 nt, Homo sapiens
caacagccaaccugauuuc

SEQ ID NO: 592433 - RNA, 19 nt, Homo sapiens
ggcgagggauacccaaaga

SEQ ID NO: 592434 - RNA, 19 nt, Homo sapiens
acauugagcccaccauuga

SEQ ID NO: 592435 - RNA, 19 nt, Homo sapiens
agaaggagaccaugcaguu

SEQ ID NO: 592436 - RNA, 19 nt, Homo sapiens
ccaacaccaugaccucuuc

SEQ ID NO: 592437 - RNA, 19 nt, Homo sapiens
cagggacaguggaaucuug

SEQ ID NO: 592438 - RNA, 19 nt, Homo sapiens
caccaacuuuaacuugaaa

SEQ ID NO: 592439 - RNA, 19 nt, Homo sapiens
ggagaugcgggcucaguau

SEQ ID NO: 592440 - RNA, 19 nt, Homo sapiens
gaggagcuccaacagaaga

SEQ ID NO: 592441 - RNA, 19 nt, Homo sapiens
gagcaagaaaugucucugu

SEQ ID NO: 592442 - RNA, 19 nt, Homo sapiens
ccucuucucuucauacucu

SEQ ID NO: 592443 - RNA, 19 nt, Homo sapiens
gacccugucuuuucuaauu

SEQ ID NO: 592444 - RNA, 19 nt, Homo sapiens
cuucuaacuuucuguaugu

SEQ ID NO: 592445 - RNA, 19 nt, Homo sapiens
gcagaacucccugugugaa

SEQ ID NO: 592446 - RNA, 19 nt, Homo sapiens
uaggaacacggcaugauuu

SEQ ID NO: 592447 - RNA, 19 nt, Homo sapiens
gagagaugcuuguuauacc

SEQ ID NO: 592448 - RNA, 19 nt, Homo sapiens
ggacaguggaaucuugaug

SEQ ID NO: 592449 - RNA, 19 nt, Homo sapiens
caaaggcuaugagauacca

SEQ ID NO: 592450 - RNA, 19 nt, Homo sapiens
ggcuauaacuuugcuucuu

SEQ ID NO: 592451 - RNA, 19 nt, Homo sapiens
gcaggaggucaaagcauug

SEQ ID NO: 592452 - RNA, 19 nt, Homo sapiens
ccucagauucgucaacauu

SEQ ID NO: 592453 - RNA, 19 nt, Homo sapiens
uucaagaacaccaacuuua

SEQ ID NO: 592454 - RNA, 19 nt, Homo sapiens
cgagggauacccaaagaga

SEQ ID NO: 592455 - RNA, 19 nt, Homo sapiens
gaggagcagcugucugaga

SEQ ID NO: 592456 - RNA, 19 nt, Homo sapiens
gaaggacugucugcagaac

SEQ ID NO: 592457 - RNA, 19 nt, Homo sapiens
caggcugauuguacaaauu

SEQ ID NO: 592458 - RNA, 19 nt, Homo sapiens
ugucugagauuucccacau

SEQ ID NO: 592459 - RNA, 19 nt, Homo sapiens
caugguggcucagaauauc

SEQ ID NO: 592460 - RNA, 19 nt, Homo sapiens
gggagaugcgggcucagua

SEQ ID NO: 592461 - RNA, 19 nt, Homo sapiens
gacauugagcccaccauug

SEQ ID NO: 592462 - RNA, 19 nt, Homo sapiens
caaccacgagcaggaagua

SEQ ID NO: 592463 - RNA, 19 nt, Homo sapiens
gaaggagaccaugcaguuc

SEQ ID NO: 592464 - RNA, 19 nt, Homo sapiens
gcaagaaaugucucugucu

SEQ ID NO: 592465 - RNA, 19 nt, Homo sapiens
gaggagaggaggcuucagu

SEQ ID NO: 592466 - RNA, 19 nt, Homo sapiens
agagauuugcuaaguauga

SEQ ID NO: 592467 - RNA, 19 nt, Homo sapiens
cuauaacuuugcuucuuug

SEQ ID NO: 592468 - RNA, 19 nt, Homo sapiens
uggaggagcagcugucuga

SEQ ID NO: 592469 - RNA, 19 nt, Homo sapiens
gcaccacaacagguagaua

SEQ ID NO: 592470 - RNA, 19 nt, Homo sapiens
gggcagaggccaacauugc

SEQ ID NO: 592471 - RNA, 19 nt, Homo sapiens
cacagccucuuacauaugg

SEQ ID NO: 592472 - RNA, 19 nt, Homo sapiens
aacaccaacuuuaacuuga

SEQ ID NO: 592473 - RNA, 19 nt, Homo sapiens
gaagagcaguugucugaga

SEQ ID NO: 592474 - RNA, 19 nt, Homo sapiens
ggaucaagcuggagaguga

SEQ ID NO: 592475 - RNA, 19 nt, Homo sapiens
ggaucgagcuggacauuga

SEQ ID NO: 592476 - RNA, 19 nt, Homo sapiens
agaacgagauugccacaua

SEQ ID NO: 592477 - RNA, 19 nt, Homo sapiens
cagcuaaccugauauggaa

SEQ ID NO: 592478 - RNA, 19 nt, Homo sapiens
ccaugaaguuccugaauga

SEQ ID NO: 592479 - RNA, 19 nt, Homo sapiens
gaacgagauugccacauac

SEQ ID NO: 592480 - RNA, 19 nt, Homo sapiens
cgcagaagcuccuggauga

SEQ ID NO: 592481 - RNA, 19 nt, Homo sapiens
uuaaugagcugaggaacuu

SEQ ID NO: 592482 - RNA, 19 nt, Homo sapiens
uaacuggguucccugcauu

SEQ ID NO: 592483 - RNA, 19 nt, Homo sapiens
ugaaucaacugcugguguu

SEQ ID NO: 592484 - RNA, 19 nt, Homo sapiens
gagaaugccaggcugauug

SEQ ID NO: 592485 - RNA, 19 nt, Homo sapiens
ucgaggagcuccagcagaa

SEQ ID NO: 592486 - RNA, 19 nt, Homo sapiens
ucucagauuugucaacauu

SEQ ID NO: 592487 - RNA, 19 nt, Homo sapiens
cacaacagguagauaauca

SEQ ID NO: 592488 - RNA, 19 nt, Homo sapiens
gcuggcugcugaugacuuu

SEQ ID NO: 592489 - RNA, 19 nt, Homo sapiens
accaacagcuaaccugaua

SEQ ID NO: 592490 - RNA, 19 nt, Homo sapiens
agaaggagaccaugaaguu

SEQ ID NO: 592491 - RNA, 19 nt, Homo sapiens
gaagcuggcugcugaugac

SEQ ID NO: 592492 - RNA, 19 nt, Homo sapiens
agaggaggcuucagucuca

SEQ ID NO: 592493 - RNA, 19 nt, Homo sapiens
uggaagagcaguugucuga

SEQ ID NO: 592494 - RNA, 19 nt, Homo sapiens
ccucagcccuacaccauga

SEQ ID NO: 592495 - RNA, 19 nt, Homo sapiens
uaaagauucugaggaguca

SEQ ID NO: 592496 - RNA, 19 nt, Homo sapiens
ggacauugagcccaccauu

SEQ ID NO: 592497 - RNA, 19 nt, Homo sapiens
caacagcuaaccugauaug

SEQ ID NO: 592498 - RNA, 19 nt, Homo sapiens
gagcaggaaguaaagauuc

SEQ ID NO: 592499 - RNA, 19 nt, Homo sapiens
caccacaacagguagauaa

SEQ ID NO: 592500 - RNA, 19 nt, Homo sapiens
gauggcaccacaacaggua

SEQ ID NO: 592501 - RNA, 19 nt, Homo sapiens
gaggaacuucucaugguaa

SEQ ID NO: 592502 - RNA, 19 nt, Homo sapiens
acauugagcccaccauuga

SEQ ID NO: 592503 - RNA, 19 nt, Homo sapiens
uagcagauacuuccaagga

SEQ ID NO: 592504 - RNA, 19 nt, Homo sapiens
cagaugcagagccucauua

SEQ ID NO: 592505 - RNA, 19 nt, Homo sapiens
gcagaaacagugagucucu

SEQ ID NO: 592506 - RNA, 19 nt, Homo sapiens
gaacuucucaugguaaacu

SEQ ID NO: 592507 - RNA, 19 nt, Homo sapiens
gcagaacucccugugugaa

SEQ ID NO: 592508 - RNA, 19 nt, Homo sapiens
uggguucccugcauuaaau

SEQ ID NO: 592509 - RNA, 19 nt, Homo sapiens
guaacuggguucccugcau

SEQ ID NO: 592510 - RNA, 19 nt, Homo sapiens
gagccucauuagcaacuug

SEQ ID NO: 592511 - RNA, 19 nt, Homo sapiens
gaaggagaccaugaaguuc

SEQ ID NO: 592512 - RNA, 19 nt, Homo sapiens
uaucuuccaugaaagcaau

SEQ ID NO: 592513 - RNA, 19 nt, Homo sapiens
ccacauaccggaaccuuac

SEQ ID NO: 592514 - RNA, 19 nt, Homo sapiens
gagcagaaacagugagucu

SEQ ID NO: 592515 - RNA, 19 nt, Homo sapiens
gaggagcuccagcagaaga

SEQ ID NO: 592516 - RNA, 19 nt, Homo sapiens
gaaggacugucugcagaac

SEQ ID NO: 592517 - RNA, 19 nt, Homo sapiens
caggcugauuguacaaauu

SEQ ID NO: 592518 - RNA, 19 nt, Homo sapiens
gggagaugcgggcucagua

SEQ ID NO: 592519 - RNA, 19 nt, Homo sapiens
gacauugagcccaccauug

SEQ ID NO: 592520 - RNA, 19 nt, Homo sapiens
caaccacgagcaggaagua

SEQ ID NO: 592521 - RNA, 19 nt, Homo sapiens
gaggagaggaggcuucagu

SEQ ID NO: 592522 - RNA, 19 nt, Homo sapiens
gcaccacaacagguagaua

SEQ ID NO: 592523 - RNA, 19 nt, Homo sapiens
ccaggcugauuguacaaau

SEQ ID NO: 592524 - RNA, 19 nt, Homo sapiens
ugaauggccaugagaagga

SEQ ID NO: 592525 - RNA, 19 nt, Homo sapiens
gaugauggcaccacaacag

SEQ ID NO: 592526 - RNA, 19 nt, Homo sapiens
uuaguucuauuccaguguu

SEQ ID NO: 592527 - RNA, 19 nt, Homo sapiens
gagcaaccacgagcaggaa

SEQ ID NO: 592528 - RNA, 19 nt, Homo sapiens
gaccaugaaguuccugaau

SEQ ID NO: 592529 - RNA, 19 nt, Homo sapiens
gagaaggagaccaugaagu

SEQ ID NO: 592530 - RNA, 19 nt, Homo sapiens
caacagguagauaaucaag

SEQ ID NO: 592531 - RNA, 19 nt, Homo sapiens
gggagaaguuccggaucga

SEQ ID NO: 592532 - RNA, 19 nt, Homo sapiens
gaaccuuacuccccugcaa

SEQ ID NO: 592533 - RNA, 19 nt, Homo sapiens
gguguuuguugagcagaaa

SEQ ID NO: 592534 - RNA, 19 nt, Homo sapiens
gccacauaccggaaccuua

SEQ ID NO: 592535 - RNA, 19 nt, Homo sapiens
cgagcaggaaguaaagauu

SEQ ID NO: 592536 - RNA, 19 nt, Homo sapiens
accaugaaguuccugaaug

SEQ ID NO: 592537 - RNA, 19 nt, Homo sapiens
aggaacuucucaugguaaa

SEQ ID NO: 592538 - RNA, 19 nt, Homo sapiens
gaaucaacugcugguguuu

SEQ ID NO: 592539 - RNA, 19 nt, Homo sapiens
ucacauucccggcaacauc

SEQ ID NO: 592540 - RNA, 19 nt, Homo sapiens
gcuaaccugauauggaaga

SEQ ID NO: 592541 - RNA, 19 nt, Homo sapiens
aagagcaguugucugagau

SEQ ID NO: 592542 - RNA, 19 nt, Homo sapiens
ugcagagccucauuagcaa

SEQ ID NO: 592543 - RNA, 19 nt, Homo sapiens
ggagaccaaccaccaggau

SEQ ID NO: 592544 - RNA, 19 nt, Homo sapiens
cgaagcuggcugcugauga

SEQ ID NO: 592545 - RNA, 19 nt, Homo sapiens
cagcugaguaacaggauga

SEQ ID NO: 592546 - RNA, 19 nt, Homo sapiens
ucagauuugucaacauugc

SEQ ID NO: 592547 - RNA, 19 nt, Homo sapiens
ggagaggaggcuucagucu

SEQ ID NO: 592548 - RNA, 19 nt, Homo sapiens
ugucucuucuugguacuuu

SEQ ID NO: 592549 - RNA, 19 nt, Homo sapiens
ccacaacagguagauaauc

SEQ ID NO: 592550 - RNA, 19 nt, Homo sapiens
augcagagccucauuagca

SEQ ID NO: 592551 - RNA, 19 nt, Homo sapiens
ggagaugcgggcucaguac

SEQ ID NO: 592552 - RNA, 19 nt, Homo sapiens
agaaacagugagucucuga

SEQ ID NO: 592553 - RNA, 19 nt, Homo sapiens
cuauuccaguguuucagaa

SEQ ID NO: 592554 - RNA, 19 nt, Homo sapiens
ugaaggacugucugcagaa

SEQ ID NO: 592555 - RNA, 19 nt, Homo sapiens
agagugagcgcucccuuca

SEQ ID NO: 592556 - RNA, 19 nt, Homo sapiens
acagcuaaccugauaugga

SEQ ID NO: 592557 - RNA, 19 nt, Homo sapiens
ccaaugcugccuccaugug

SEQ ID NO: 592558 - RNA, 19 nt, Homo sapiens
ucaagacuagacucacuga

SEQ ID NO: 592559 - RNA, 19 nt, Homo sapiens
caccaugaccuccuucuac

SEQ ID NO: 592560 - RNA, 19 nt, Homo sapiens
ccagaugcagagccucauu

SEQ ID NO: 592561 - RNA, 19 nt, Homo sapiens
caggaaguaaagauucuga

SEQ ID NO: 592562 - RNA, 19 nt, Homo sapiens
ccacgagcaggaaguaaag

SEQ ID NO: 592563 - RNA, 19 nt, Homo sapiens
gaagagccaagaggcaucu

SEQ ID NO: 592564 - RNA, 19 nt, Homo sapiens
agaagauccugugcagcaa

SEQ ID NO: 592565 - RNA, 19 nt, Homo sapiens
ccuggugucucuucuuggu

SEQ ID NO: 592566 - RNA, 19 nt, Homo sapiens
auucugaaggcccgaguua

SEQ ID NO: 592567 - RNA, 19 nt, Homo sapiens
gcuuuaaugagcugaggaa

SEQ ID NO: 592568 - RNA, 19 nt, Homo sapiens
accaugaccuccuucuaca

SEQ ID NO: 592569 - RNA, 19 nt, Homo sapiens
aaucaaccgguagcagaua

SEQ ID NO: 592570 - RNA, 19 nt, Homo sapiens
cuucaagacuagacucacu

SEQ ID NO: 592571 - RNA, 19 nt, Homo sapiens
ggcccgaguuaggagauug

SEQ ID NO: 592572 - RNA, 19 nt, Homo sapiens
guuccaagcccagucugaa

SEQ ID NO: 592573 - RNA, 19 nt, Homo sapiens
gagaauaaccgcagagaug

SEQ ID NO: 592574 - RNA, 19 nt, Homo sapiens
gagcugaugugccucaaga

SEQ ID NO: 592575 - RNA, 19 nt, Homo sapiens
gcuccuaccugucuucuga

SEQ ID NO: 592576 - RNA, 19 nt, Homo sapiens
ucaagaccaucgaagauuu

SEQ ID NO: 592577 - RNA, 19 nt, Homo sapiens
gaucagagaugggaaaguc

SEQ ID NO: 592578 - RNA, 19 nt, Homo sapiens
cagaagauccugcugacua

SEQ ID NO: 592579 - RNA, 19 nt, Homo sapiens
agaagauccugcugacuaa

SEQ ID NO: 592580 - RNA, 19 nt, Homo sapiens
gaaggagacuaugcaguuc

SEQ ID NO: 592581 - RNA, 19 nt, Homo sapiens
ggguacaucucuucugcua

SEQ ID NO: 592582 - RNA, 19 nt, Homo sapiens
ggucaacgcgcuagagauu

SEQ ID NO: 592583 - RNA, 19 nt, Homo sapiens
gcaagccuguuauuagagu

SEQ ID NO: 592584 - RNA, 19 nt, Homo sapiens
gcaugcaagccuguuauua

SEQ ID NO: 592585 - RNA, 19 nt, Homo sapiens
gaagauuuccagcagaaga

SEQ ID NO: 592586 - RNA, 19 nt, Homo sapiens
ugaugugccucaagaagaa

SEQ ID NO: 592587 - RNA, 19 nt, Homo sapiens
cagcacagcaugcggaauu

SEQ ID NO: 592588 - RNA, 19 nt, Homo sapiens
agaaggagacuaugcaguu

SEQ ID NO: 592589 - RNA, 19 nt, Homo sapiens
ggagaucagagaugggaaa

SEQ ID NO: 592590 - RNA, 19 nt, Homo sapiens
ggaccaaguaugagacaga

SEQ ID NO: 592591 - RNA, 19 nt, Homo sapiens
ucgaagauuuccagcagaa

SEQ ID NO: 592592 - RNA, 19 nt, Homo sapiens
gcagcgagaaggagacuau

SEQ ID NO: 592593 - RNA, 19 nt, Homo sapiens
gcacucagauccgcaccau

SEQ ID NO: 592594 - RNA, 19 nt, Homo sapiens
cagaugcagugccugauca

SEQ ID NO: 592595 - RNA, 19 nt, Homo sapiens
augcaagccuguuauuaga

SEQ ID NO: 592596 - RNA, 19 nt, Homo sapiens
guggaggccugguucaaca

SEQ ID NO: 592597 - RNA, 19 nt, Homo sapiens
caugcaagccuguuauuag

SEQ ID NO: 592598 - RNA, 19 nt, Homo sapiens
ccaggaguaccagguguua

SEQ ID NO: 592599 - RNA, 19 nt, Homo sapiens
gaagaaucacgaggaggaa

SEQ ID NO: 592600 - RNA, 19 nt, Homo sapiens
gcuggcugcugacgacuuc

SEQ ID NO: 592601 - RNA, 19 nt, Homo sapiens
gaauaaccgcagagaugug

SEQ ID NO: 592602 - RNA, 19 nt, Homo sapiens
acucagauccgcaccauca

SEQ ID NO: 592603 - RNA, 19 nt, Homo sapiens
ccaggagugguacgaguuu

SEQ ID NO: 592604 - RNA, 19 nt, Homo sapiens
gggagaggacugcaagcuu

SEQ ID NO: 592605 - RNA, 19 nt, Homo sapiens
ggagaauaaccgcagagau

SEQ ID NO: 592606 - RNA, 19 nt, Homo sapiens
cgaggaggaagucagugua

SEQ ID NO: 592607 - RNA, 19 nt, Homo sapiens
ugaaggaggagcugaugug

SEQ ID NO: 592608 - RNA, 19 nt, Homo sapiens
uaccaguccuacuucaaga

SEQ ID NO: 592609 - RNA, 19 nt, Homo sapiens
ucaccgaggagaucagaga

SEQ ID NO: 592610 - RNA, 19 nt, Homo sapiens
acgaggcccugguggagaa

SEQ ID NO: 592611 - RNA, 19 nt, Homo sapiens
caagaccaucgaagauuuc

SEQ ID NO: 592612 - RNA, 19 nt, Homo sapiens
ggagaucaucgagcugaga

SEQ ID NO: 592613 - RNA, 19 nt, Homo sapiens
ggaggaagucaguguacuc

SEQ ID NO: 592614 - RNA, 19 nt, Homo sapiens
uuauuagaguuccuucugu

SEQ ID NO: 592615 - RNA, 19 nt, Homo sapiens
guuauuagaguuccuucug

SEQ ID NO: 592616 - RNA, 19 nt, Homo sapiens
gcgagaaggagacuaugca

SEQ ID NO: 592617 - RNA, 19 nt, Homo sapiens
ggcugguccugcagauuga

SEQ ID NO: 592618 - RNA, 19 nt, Homo sapiens
gaauccacccuggccgaaa

SEQ ID NO: 592619 - RNA, 19 nt, Homo sapiens
gagauguggaggccugguu

SEQ ID NO: 592620 - RNA, 19 nt, Homo sapiens
cccaguggaucucaacaag

SEQ ID NO: 592621 - RNA, 19 nt, Homo sapiens
ugcagugccugaucagcaa

SEQ ID NO: 592622 - RNA, 19 nt, Homo sapiens
agaauaaccgcagagaugu

SEQ ID NO: 592623 - RNA, 19 nt, Homo sapiens
ggauaugagaugccaguac

SEQ ID NO: 592624 - RNA, 19 nt, Homo sapiens
ggcaugcaagccuguuauu

SEQ ID NO: 592625 - RNA, 19 nt, Homo sapiens
gguucaacacccagacuga

SEQ ID NO: 592626 - RNA, 19 nt, Homo sapiens
ccaguggaucucaacaaga

SEQ ID NO: 592627 - RNA, 19 nt, Homo sapiens
gaggaggaagucaguguac

SEQ ID NO: 592628 - RNA, 19 nt, Homo sapiens
gcugaugugccucaagaag

SEQ ID NO: 592629 - RNA, 19 nt, Homo sapiens
caagccuguuauuagaguu

SEQ ID NO: 592630 - RNA, 19 nt, Homo sapiens
agacuaugcaguuccugaa

SEQ ID NO: 592631 - RNA, 19 nt, Homo sapiens
ucaacggccugcguaggau

SEQ ID NO: 592632 - RNA, 19 nt, Homo sapiens
gauaugagcucccaccuua

SEQ ID NO: 592633 - RNA, 19 nt, Homo sapiens
uaaaucaacugacaccuua

SEQ ID NO: 592634 - RNA, 19 nt, Homo sapiens
ugggaaagcugaucuauaa

SEQ ID NO: 592635 - RNA, 19 nt, Homo sapiens
ggaagaagcuaacucuguu

SEQ ID NO: 592636 - RNA, 19 nt, Homo sapiens
guaggaaacugggaaauaa

SEQ ID NO: 592637 - RNA, 19 nt, Homo sapiens
gcaauuauaccuucuguaa

SEQ ID NO: 592638 - RNA, 19 nt, Homo sapiens
gaaacuacuuugcacauau

SEQ ID NO: 592639 - RNA, 19 nt, Homo sapiens
gaaagcugaucuauaaaga

SEQ ID NO: 592640 - RNA, 19 nt, Homo sapiens
gaagaaagagucacaauca

SEQ ID NO: 592641 - RNA, 19 nt, Homo sapiens
gcagaugaauccagugaaa

SEQ ID NO: 592642 - RNA, 19 nt, Homo sapiens
gggaacaucuugggaauuu

SEQ ID NO: 592643 - RNA, 19 nt, Homo sapiens
ugaagugguuugaggauua

SEQ ID NO: 592644 - RNA, 19 nt, Homo sapiens
gcacaaaucaauugaagaa

SEQ ID NO: 592645 - RNA, 19 nt, Homo sapiens
gcuaugaaguguuaacuga

SEQ ID NO: 592646 - RNA, 19 nt, Homo sapiens
ggaugcacuuuaugaaaua

SEQ ID NO: 592647 - RNA, 19 nt, Homo sapiens
ggaaguuauugccaaauga

SEQ ID NO: 592648 - RNA, 19 nt, Homo sapiens
ggacuuugauguugaagau

SEQ ID NO: 592649 - RNA, 19 nt, Homo sapiens
gauaugauucuaccugaua

SEQ ID NO: 592650 - RNA, 19 nt, Homo sapiens
uagcaacgaugaagagaaa

SEQ ID NO: 592651 - RNA, 19 nt, Homo sapiens
aaaccucgcuccuuuaaau

SEQ ID NO: 592652 - RNA, 19 nt, Homo sapiens
gcacagcauuagagagauu

SEQ ID NO: 592653 - RNA, 19 nt, Homo sapiens
acaacaaggugauaugauu

SEQ ID NO: 592654 - RNA, 19 nt, Homo sapiens
gcugugcucuuguuggaua

SEQ ID NO: 592655 - RNA, 19 nt, Homo sapiens
gggcagaguucuucuuuua

SEQ ID NO: 592656 - RNA, 19 nt, Homo sapiens
guaaaguguuuccaugcua

SEQ ID NO: 592657 - RNA, 19 nt, Homo sapiens
gaacaacaaggugauauga

SEQ ID NO: 592658 - RNA, 19 nt, Homo sapiens
gggcaaugcuggaaugguu

SEQ ID NO: 592659 - RNA, 19 nt, Homo sapiens
gaaacaacaguucgggaua

SEQ ID NO: 592660 - RNA, 19 nt, Homo sapiens
gauaggaugagaaagauuu

SEQ ID NO: 592661 - RNA, 19 nt, Homo sapiens
gaaagagucacaaucaugu

SEQ ID NO: 592662 - RNA, 19 nt, Homo sapiens
agaugaaacuggacucuuu

SEQ ID NO: 592663 - RNA, 19 nt, Homo sapiens
agacugcgguggaagauuu

SEQ ID NO: 592664 - RNA, 19 nt, Homo sapiens
gaacaucuugggaauuuga

SEQ ID NO: 592665 - RNA, 19 nt, Homo sapiens
aaauguaucugaagugguu

SEQ ID NO: 592666 - RNA, 19 nt, Homo sapiens
agacggagguucuuccaaa

SEQ ID NO: 592667 - RNA, 19 nt, Homo sapiens
ucuaaaggcuugcaggaaa

SEQ ID NO: 592668 - RNA, 19 nt, Homo sapiens
cgugugguguugacuauua

SEQ ID NO: 592669 - RNA, 19 nt, Homo sapiens
cagaagaugauacugaaua

SEQ ID NO: 592670 - RNA, 19 nt, Homo sapiens
gaaccaggcuaugaagugu

SEQ ID NO: 592671 - RNA, 19 nt, Homo sapiens
gacaaagucaagucaauaa

SEQ ID NO: 592672 - RNA, 19 nt, Homo sapiens
gcaauggcauggaacuuag

SEQ ID NO: 592673 - RNA, 19 nt, Homo sapiens
gaagcuaacucuguuggau

SEQ ID NO: 592674 - RNA, 19 nt, Homo sapiens
gagccaccaucagaaauaa

SEQ ID NO: 592675 - RNA, 19 nt, Homo sapiens
ggauuaaucugcuaaaaug

SEQ ID NO: 592676 - RNA, 19 nt, Homo sapiens
gggaauaaauaggcugauu

SEQ ID NO: 592677 - RNA, 19 nt, Homo sapiens
ggaaaaggcugugcucuug

SEQ ID NO: 592678 - RNA, 19 nt, Homo sapiens
ucccauaucuggaccaauu

SEQ ID NO: 592679 - RNA, 19 nt, Homo sapiens
gcagugauuuauggaauug

SEQ ID NO: 592680 - RNA, 19 nt, Homo sapiens
ugaaacuacuuugcacaua

SEQ ID NO: 592681 - RNA, 19 nt, Homo sapiens
caaaugagagagaaacuau

SEQ ID NO: 592682 - RNA, 19 nt, Homo sapiens
gggaaguuauugccaaaug

SEQ ID NO: 592683 - RNA, 19 nt, Homo sapiens
ggaaaugaaguaaauaugg

SEQ ID NO: 592684 - RNA, 19 nt, Homo sapiens
caacgaugaagagaaauua

SEQ ID NO: 592685 - RNA, 19 nt, Homo sapiens
gaaauaaacagaagaugac

SEQ ID NO: 592686 - RNA, 19 nt, Homo sapiens
ggaggaaauagaacuaauu

SEQ ID NO: 592687 - RNA, 19 nt, Homo sapiens
gaagugguuugaggauuau

SEQ ID NO: 592688 - RNA, 19 nt, Homo sapiens
gcauucugaucaauucauu

SEQ ID NO: 592689 - RNA, 19 nt, Homo sapiens
guacagauaaucagaagau

SEQ ID NO: 592690 - RNA, 19 nt, Homo sapiens
guuugaggauuauguguuu

SEQ ID NO: 592691 - RNA, 19 nt, Homo sapiens
gucagaugauggccaaaua

SEQ ID NO: 592692 - RNA, 19 nt, Homo sapiens
gggaauggauggugauuuu

SEQ ID NO: 592693 - RNA, 19 nt, Homo sapiens
uaaaguguuuccaugcuau

SEQ ID NO: 592694 - RNA, 19 nt, Homo sapiens
uaaagaggcauucugauca

SEQ ID NO: 592695 - RNA, 19 nt, Homo sapiens
uaacaguggcauucccuua

SEQ ID NO: 592696 - RNA, 19 nt, Homo sapiens
gguaauacguaaacuucga

SEQ ID NO: 592697 - RNA, 19 nt, Homo sapiens
aaacaacaguucgggauau

SEQ ID NO: 592698 - RNA, 19 nt, Homo sapiens
gggcacaaaucaauugaag

SEQ ID NO: 592699 - RNA, 19 nt, Homo sapiens
ggaaagcugaucuauaaag

SEQ ID NO: 592700 - RNA, 19 nt, Homo sapiens
gaacagacugaagcacuuu

SEQ ID NO: 592701 - RNA, 19 nt, Homo sapiens
caucagaaauaaacagaag

SEQ ID NO: 592702 - RNA, 19 nt, Homo sapiens
gaagauucucccuauggua

SEQ ID NO: 592703 - RNA, 19 nt, Homo sapiens
gugcuugccuucuaggauu

SEQ ID NO: 592704 - RNA, 19 nt, Homo sapiens
cuugggaauuugagauuua

SEQ ID NO: 592705 - RNA, 19 nt, Homo sapiens
gagauuauucuggaaauga

SEQ ID NO: 592706 - RNA, 19 nt, Homo sapiens
caaagucaagucaauaaug

SEQ ID NO: 592707 - RNA, 19 nt, Homo sapiens
guacugaaccaggcuauga

SEQ ID NO: 592708 - RNA, 19 nt, Homo sapiens
gugcauggauggaucuuuc

SEQ ID NO: 592709 - RNA, 19 nt, Homo sapiens
gaggcauucugaucaauuc

SEQ ID NO: 592710 - RNA, 19 nt, Homo sapiens
gagagaaacuaugggaaag

SEQ ID NO: 592711 - RNA, 19 nt, Homo sapiens
agagauaacugaacagacu

SEQ ID NO: 592712 - RNA, 19 nt, Homo sapiens
gacuugguccugugaaaua

SEQ ID NO: 592713 - RNA, 19 nt, Homo sapiens
gauagacugguaauacgua

SEQ ID NO: 592714 - RNA, 19 nt, Homo sapiens
gguguugacuauuaaagau

SEQ ID NO: 592715 - RNA, 19 nt, Homo sapiens
aagagagccuggacuuuga

SEQ ID NO: 592716 - RNA, 19 nt, Homo sapiens
gcaacgaugaagagaaauu

SEQ ID NO: 592717 - RNA, 19 nt, Homo sapiens
ugcaacagguuuacacaaa

SEQ ID NO: 592718 - RNA, 19 nt, Homo sapiens
aaacuacuuugcacauaug

SEQ ID NO: 592719 - RNA, 19 nt, Homo sapiens
uaugagcucccaccuuaua

SEQ ID NO: 592720 - RNA, 19 nt, Homo sapiens
gaucaauucauuuguagga

SEQ ID NO: 592721 - RNA, 19 nt, Homo sapiens
aaagaggcauucugaucaa

SEQ ID NO: 592722 - RNA, 19 nt, Homo sapiens
agaacuaauuccagagaaa

SEQ ID NO: 592723 - RNA, 19 nt, Homo sapiens
caaguucgagaguauuuaa

SEQ ID NO: 592724 - RNA, 19 nt, Homo sapiens
gaauuuacagccugaacaa

SEQ ID NO: 592725 - RNA, 19 nt, Homo sapiens
gaggaaauagaacuaauuc

SEQ ID NO: 592726 - RNA, 19 nt, Homo sapiens
gccaagaggaaaucuauga

SEQ ID NO: 592727 - RNA, 19 nt, Homo sapiens
ggagauuauucuggaaaug

SEQ ID NO: 592728 - RNA, 19 nt, Homo sapiens
aaauagcaauggcauggaa

SEQ ID NO: 592729 - RNA, 19 nt, Homo sapiens
cagacacuaaggaauauua

SEQ ID NO: 592730 - RNA, 19 nt, Homo sapiens
ggaggaggaaauagaacua

SEQ ID NO: 592731 - RNA, 19 nt, Homo sapiens
gcacaaggccaggcagaug

SEQ ID NO: 592732 - RNA, 19 nt, Homo sapiens
gccaguaccucaaagauua

SEQ ID NO: 592733 - RNA, 19 nt, Homo sapiens
gaccucaucucuaccauug

SEQ ID NO: 592734 - RNA, 19 nt, Homo sapiens
gugcaggccucaccuaaug

SEQ ID NO: 592735 - RNA, 19 nt, Homo sapiens
ccucaaagauuaccugaca

SEQ ID NO: 592736 - RNA, 19 nt, Homo sapiens
ugcccuagauaguuuauua

SEQ ID NO: 592737 - RNA, 19 nt, Homo sapiens
gcacggagaccugccagua

SEQ ID NO: 592738 - RNA, 19 nt, Homo sapiens
ucaaacaggcacaauauga

SEQ ID NO: 592739 - RNA, 19 nt, Homo sapiens
gcaacuggcaggacaaaga

SEQ ID NO: 592740 - RNA, 19 nt, Homo sapiens
ggaagaugcugcagaaacg

SEQ ID NO: 592741 - RNA, 19 nt, Homo sapiens
ggaccugaaugccuuugau

SEQ ID NO: 592742 - RNA, 19 nt, Homo sapiens
agaaacguguggagcacua

SEQ ID NO: 592743 - RNA, 19 nt, Homo sapiens
ccacagaaugucagccuuu

SEQ ID NO: 592744 - RNA, 19 nt, Homo sapiens
agauguguaucgccgguua

SEQ ID NO: 592745 - RNA, 19 nt, Homo sapiens
uuugugagcuuccguguuc

SEQ ID NO: 592746 - RNA, 19 nt, Homo sapiens
cuagcaagcuggccucuac

SEQ ID NO: 592747 - RNA, 19 nt, Homo sapiens
gcaggacaaagauguguau

SEQ ID NO: 592748 - RNA, 19 nt, Homo sapiens
gaacugggagagcuacaca

SEQ ID NO: 592749 - RNA, 19 nt, Homo sapiens
gggcuggaguggugagcaa

SEQ ID NO: 592750 - RNA, 19 nt, Homo sapiens
caucucagcaccaacaguu

SEQ ID NO: 592751 - RNA, 19 nt, Homo sapiens
gaauauuaccaucuucuac

SEQ ID NO: 592752 - RNA, 19 nt, Homo sapiens
aagcuggccucuaccacaa

SEQ ID NO: 592753 - RNA, 19 nt, Homo sapiens
ucaguugggccgacauuga

SEQ ID NO: 592754 - RNA, 19 nt, Homo sapiens
cacaauaugaguuugaguu

SEQ ID NO: 592755 - RNA, 19 nt, Homo sapiens
gccuuuaccuggaccuugu

SEQ ID NO: 592756 - RNA, 19 nt, Homo sapiens
ggucccaccucaccagucu

SEQ ID NO: 592757 - RNA, 19 nt, Homo sapiens
ggaccucaucucuaccauu

SEQ ID NO: 592758 - RNA, 19 nt, Homo sapiens
caacuggcaggacaaagau

SEQ ID NO: 592759 - RNA, 19 nt, Homo sapiens
caaacaggcacaauaugag

SEQ ID NO: 592760 - RNA, 19 nt, Homo sapiens
cacagaaugucagccuuug

SEQ ID NO: 592761 - RNA, 19 nt, Homo sapiens
ccacagcaccacccaucuu

SEQ ID NO: 592762 - RNA, 19 nt, Homo sapiens
uggagacacugcguuaugu

SEQ ID NO: 592763 - RNA, 19 nt, Homo sapiens
agucaaacaggcacaauau

SEQ ID NO: 592764 - RNA, 19 nt, Homo sapiens
ccagaauauuaccaucuuc

SEQ ID NO: 592765 - RNA, 19 nt, Homo sapiens
uggcagcccuggccuuuac

SEQ ID NO: 592766 - RNA, 19 nt, Homo sapiens
caaugccagugggaccaua

SEQ ID NO: 592767 - RNA, 19 nt, Homo sapiens
caacaguuuccgccuagug

SEQ ID NO: 592768 - RNA, 19 nt, Homo sapiens
gacggacucccacacaguu

SEQ ID NO: 592769 - RNA, 19 nt, Homo sapiens
gaccugccaguaccucaaa

SEQ ID NO: 592770 - RNA, 19 nt, Homo sapiens
ccuacucccuugcccuaga

SEQ ID NO: 592771 - RNA, 19 nt, Homo sapiens
uagucaaacaggcacaaua

SEQ ID NO: 592772 - RNA, 19 nt, Homo sapiens
ccugacugcuacaaucaug

SEQ ID NO: 592773 - RNA, 19 nt, Homo sapiens
acaggcacaauaugaguuu

SEQ ID NO: 592774 - RNA, 19 nt, Homo sapiens
aaacaggcacaauaugagu

SEQ ID NO: 592775 - RNA, 19 nt, Homo sapiens
accagaauauuaccaucuu

SEQ ID NO: 592776 - RNA, 19 nt, Homo sapiens
gggucucuuuuguaaauua

SEQ ID NO: 592777 - RNA, 19 nt, Homo sapiens
gaccugaaugccuuugaug

SEQ ID NO: 592778 - RNA, 19 nt, Homo sapiens
ccuagugccuggccaugca

SEQ ID NO: 592779 - RNA, 19 nt, Homo sapiens
cccuugcccuagauaguuu

SEQ ID NO: 592780 - RNA, 19 nt, Homo sapiens
ccaguaccuuccugcaucu

SEQ ID NO: 592781 - RNA, 19 nt, Homo sapiens
gaugugcaggccucaccua

SEQ ID NO: 592782 - RNA, 19 nt, Homo sapiens
accggaagaugcugcagaa

SEQ ID NO: 592783 - RNA, 19 nt, Homo sapiens
ccgcugcccugauguugag

SEQ ID NO: 592784 - RNA, 19 nt, Homo sapiens
augauuaugugcagaacug

SEQ ID NO: 592785 - RNA, 19 nt, Homo sapiens
gcucaguugggccgacauu

SEQ ID NO: 592786 - RNA, 19 nt, Homo sapiens
acaauaugaguuugaguuc

SEQ ID NO: 592787 - RNA, 19 nt, Homo sapiens
ccgguuaucacgccagcua

SEQ ID NO: 592788 - RNA, 19 nt, Homo sapiens
gcgcaacuggcaggacaaa

SEQ ID NO: 592789 - RNA, 19 nt, Homo sapiens
uauccacgcuucgauucug

SEQ ID NO: 592790 - RNA, 19 nt, Homo sapiens
ccugaaugccuuugaugug

SEQ ID NO: 592791 - RNA, 19 nt, Homo sapiens
accaugcacucccagucua

SEQ ID NO: 592792 - RNA, 19 nt, Homo sapiens
gcacccaccaugccaacca

SEQ ID NO: 592793 - RNA, 19 nt, Homo sapiens
cggaaggucugugcauggu

SEQ ID NO: 592794 - RNA, 19 nt, Homo sapiens
gccaguaccucaaagauua

SEQ ID NO: 592795 - RNA, 19 nt, Homo sapiens
gaccucaucucuaccauug

SEQ ID NO: 592796 - RNA, 19 nt, Homo sapiens
gugcaggccucaccuaaug

SEQ ID NO: 592797 - RNA, 19 nt, Homo sapiens
ccucaaagauuaccugaca

SEQ ID NO: 592798 - RNA, 19 nt, Homo sapiens
ugcccuagauaguuuauua

SEQ ID NO: 592799 - RNA, 19 nt, Homo sapiens
gcacggagaccugccagua

SEQ ID NO: 592800 - RNA, 19 nt, Homo sapiens
ucaaacaggcacaauauga

SEQ ID NO: 592801 - RNA, 19 nt, Homo sapiens
gcaacuggcaggacaaaga

SEQ ID NO: 592802 - RNA, 19 nt, Homo sapiens
ggaagaugcugcagaaacg

SEQ ID NO: 592803 - RNA, 19 nt, Homo sapiens
ggaccugaaugccuuugau

SEQ ID NO: 592804 - RNA, 19 nt, Homo sapiens
agaaacguguggagcacua

SEQ ID NO: 592805 - RNA, 19 nt, Homo sapiens
ccacagaaugucagccuuu

SEQ ID NO: 592806 - RNA, 19 nt, Homo sapiens
agauguguaucgccgguua

SEQ ID NO: 592807 - RNA, 19 nt, Homo sapiens
uuugugagcuuccguguuc

SEQ ID NO: 592808 - RNA, 19 nt, Homo sapiens
cuagcaagcuggccucuac

SEQ ID NO: 592809 - RNA, 19 nt, Homo sapiens
gcaggacaaagauguguau

SEQ ID NO: 592810 - RNA, 19 nt, Homo sapiens
gaacugggagagcuacaca

SEQ ID NO: 592811 - RNA, 19 nt, Homo sapiens
gggcuggaguggugagcaa

SEQ ID NO: 592812 - RNA, 19 nt, Homo sapiens
caucucagcaccaacaguu

SEQ ID NO: 592813 - RNA, 19 nt, Homo sapiens
gaauauuaccaucuucuac

SEQ ID NO: 592814 - RNA, 19 nt, Homo sapiens
aagcuggccucuaccacaa

SEQ ID NO: 592815 - RNA, 19 nt, Homo sapiens
ucaguugggccgacauuga

SEQ ID NO: 592816 - RNA, 19 nt, Homo sapiens
cacaauaugaguuugaguu

SEQ ID NO: 592817 - RNA, 19 nt, Homo sapiens
gccuuuaccuggaccuugu

SEQ ID NO: 592818 - RNA, 19 nt, Homo sapiens
ggucccaccucaccagucu

SEQ ID NO: 592819 - RNA, 19 nt, Homo sapiens
ggaccucaucucuaccauu

SEQ ID NO: 592820 - RNA, 19 nt, Homo sapiens
caacuggcaggacaaagau

SEQ ID NO: 592821 - RNA, 19 nt, Homo sapiens
ccacagcaccacccaucuu

SEQ ID NO: 592822 - RNA, 19 nt, Homo sapiens
caaacaggcacaauaugag

SEQ ID NO: 592823 - RNA, 19 nt, Homo sapiens
cacagaaugucagccuuug

SEQ ID NO: 592824 - RNA, 19 nt, Homo sapiens
uggagacacugcguuaugu

SEQ ID NO: 592825 - RNA, 19 nt, Homo sapiens
agucaaacaggcacaauau

SEQ ID NO: 592826 - RNA, 19 nt, Homo sapiens
ccagaauauuaccaucuuc

SEQ ID NO: 592827 - RNA, 19 nt, Homo sapiens
uggcagcccuggccuuuac

SEQ ID NO: 592828 - RNA, 19 nt, Homo sapiens
caaugccagugggaccaua

SEQ ID NO: 592829 - RNA, 19 nt, Homo sapiens
caacaguuuccgccuagug

SEQ ID NO: 592830 - RNA, 19 nt, Homo sapiens
gaccugccaguaccucaaa

SEQ ID NO: 592831 - RNA, 19 nt, Homo sapiens
ccuacucccuugcccuaga

SEQ ID NO: 592832 - RNA, 19 nt, Homo sapiens
uagucaaacaggcacaaua

SEQ ID NO: 592833 - RNA, 19 nt, Homo sapiens
accagaauauuaccaucuu

SEQ ID NO: 592834 - RNA, 19 nt, Homo sapiens
ccugacugcuacaaucaug

SEQ ID NO: 592835 - RNA, 19 nt, Homo sapiens
acaggcacaauaugaguuu

SEQ ID NO: 592836 - RNA, 19 nt, Homo sapiens
aaacaggcacaauaugagu

SEQ ID NO: 592837 - RNA, 19 nt, Homo sapiens
gggucucuuuuguaaauua

SEQ ID NO: 592838 - RNA, 19 nt, Homo sapiens
gaccugaaugccuuugaug

SEQ ID NO: 592839 - RNA, 19 nt, Homo sapiens
ccuagugccuggccaugca

SEQ ID NO: 592840 - RNA, 19 nt, Homo sapiens
cccuugcccuagauaguuu

SEQ ID NO: 592841 - RNA, 19 nt, Homo sapiens
gaugugcaggccucaccua

SEQ ID NO: 592842 - RNA, 19 nt, Homo sapiens
ccaguaccuuccugcaucu

SEQ ID NO: 592843 - RNA, 19 nt, Homo sapiens
accggaagaugcugcagaa

SEQ ID NO: 592844 - RNA, 19 nt, Homo sapiens
ccgcugcccugauguugag

SEQ ID NO: 592845 - RNA, 19 nt, Homo sapiens
augauuaugugcagaacug

SEQ ID NO: 592846 - RNA, 19 nt, Homo sapiens
gcucaguugggccgacauu

SEQ ID NO: 592847 - RNA, 19 nt, Homo sapiens
acaauaugaguuugaguuc

SEQ ID NO: 592848 - RNA, 19 nt, Homo sapiens
uauccacgcuucgauucug

SEQ ID NO: 592849 - RNA, 19 nt, Homo sapiens
ccgguuaucacgccagcua

SEQ ID NO: 592850 - RNA, 19 nt, Homo sapiens
gcgcaacuggcaggacaaa

SEQ ID NO: 592851 - RNA, 19 nt, Homo sapiens
ccugaaugccuuugaugug

SEQ ID NO: 592852 - RNA, 19 nt, Homo sapiens
accaugcacucccagucua

SEQ ID NO: 592853 - RNA, 19 nt, Homo sapiens
gcacccaccaugccaacca

SEQ ID NO: 592854 - RNA, 19 nt, Homo sapiens
cggaaggucugugcauggu

SEQ ID NO: 592855 - RNA, 19 nt, Homo sapiens
agacacaacuugaaacuua

SEQ ID NO: 592856 - RNA, 19 nt, Homo sapiens
aaagagcacuucuacaaua

SEQ ID NO: 592857 - RNA, 19 nt, Homo sapiens
gcaguuguguguccuguua

SEQ ID NO: 592858 - RNA, 19 nt, Homo sapiens
gaucucgucugaauguuua

SEQ ID NO: 592859 - RNA, 19 nt, Homo sapiens
gauacgccaucaauauuua

SEQ ID NO: 592860 - RNA, 19 nt, Homo sapiens
guagagggaucucgucuga

SEQ ID NO: 592861 - RNA, 19 nt, Homo sapiens
gcaagagcuuugacuggua

SEQ ID NO: 592862 - RNA, 19 nt, Homo sapiens
gauagaguacgcuugauua

SEQ ID NO: 592863 - RNA, 19 nt, Homo sapiens
gcagugugguggcaaauug

SEQ ID NO: 592864 - RNA, 19 nt, Homo sapiens
ugacuggcguuuaacauuu

SEQ ID NO: 592865 - RNA, 19 nt, Homo sapiens
ugacagaguuuauuugaag

SEQ ID NO: 592866 - RNA, 19 nt, Homo sapiens
gagauacgccaucaauauu

SEQ ID NO: 592867 - RNA, 19 nt, Homo sapiens
caacgaggaugaacugaag

SEQ ID NO: 592868 - RNA, 19 nt, Homo sapiens
gaaagggacaggcggauau

SEQ ID NO: 592869 - RNA, 19 nt, Homo sapiens
ggaaaggauugggagauau

SEQ ID NO: 592870 - RNA, 19 nt, Homo sapiens
caaaugagaacuugugaug

SEQ ID NO: 592871 - RNA, 19 nt, Homo sapiens
gugcuaaccuuucacuguu

SEQ ID NO: 592872 - RNA, 19 nt, Homo sapiens
uagaaacccuccagcaaga

SEQ ID NO: 592873 - RNA, 19 nt, Homo sapiens
acaaagagcacuucuacaa

SEQ ID NO: 592874 - RNA, 19 nt, Homo sapiens
ggguuugacuggcguuuaa

SEQ ID NO: 592875 - RNA, 19 nt, Homo sapiens
agaguacgcuugauuagga

SEQ ID NO: 592876 - RNA, 19 nt, Homo sapiens
gggccgaccugauguacaa

SEQ ID NO: 592877 - RNA, 19 nt, Homo sapiens
caagagcuuugacugguau

SEQ ID NO: 592878 - RNA, 19 nt, Homo sapiens
gaaaggauugggagauaug

SEQ ID NO: 592879 - RNA, 19 nt, Homo sapiens
gaacguaugacacaggaau

SEQ ID NO: 592880 - RNA, 19 nt, Homo sapiens
uggaaaggauugggagaua

SEQ ID NO: 592881 - RNA, 19 nt, Homo sapiens
gauuauaauucuccugaca

SEQ ID NO: 592882 - RNA, 19 nt, Homo sapiens
ucacuuuccuguauuguca

SEQ ID NO: 592883 - RNA, 19 nt, Homo sapiens
gagagauacgccaucaaua

SEQ ID NO: 592884 - RNA, 19 nt, Homo sapiens
gcagcaagaagaacucauu

SEQ ID NO: 592885 - RNA, 19 nt, Homo sapiens
agagggaucucgucugaau

SEQ ID NO: 592886 - RNA, 19 nt, Homo sapiens
ugacuugagugacagaguu

SEQ ID NO: 592887 - RNA, 19 nt, Homo sapiens
gacugugucuuagugcuua

SEQ ID NO: 592888 - RNA, 19 nt, Homo sapiens
aggcggauaucaagaauug

SEQ ID NO: 592889 - RNA, 19 nt, Homo sapiens
aaagauggguucccuguac

SEQ ID NO: 592890 - RNA, 19 nt, Homo sapiens
aaguuuggauggaugaaua

SEQ ID NO: 592891 - RNA, 19 nt, Homo sapiens
ggaaagggacaggcggaua

SEQ ID NO: 592892 - RNA, 19 nt, Homo sapiens
cagcaaucuugauagagua

SEQ ID NO: 592893 - RNA, 19 nt, Homo sapiens
aaacuuacaucagcaaucu

SEQ ID NO: 592894 - RNA, 19 nt, Homo sapiens
uaccaccucuguuaucauu

SEQ ID NO: 592895 - RNA, 19 nt, Homo sapiens
gaacugaagcagcaagaag

SEQ ID NO: 592896 - RNA, 19 nt, Homo sapiens
ugaaacagcaguugugugu

SEQ ID NO: 592897 - RNA, 19 nt, Homo sapiens
agagauacgccaucaauau

SEQ ID NO: 592898 - RNA, 19 nt, Homo sapiens
gaacuugugaugcucuaga

SEQ ID NO: 592899 - RNA, 19 nt, Homo sapiens
ucaaggaggcaaucaauuc

SEQ ID NO: 592900 - RNA, 19 nt, Homo sapiens
gaaacccuccagcaagaaa

SEQ ID NO: 592901 - RNA, 19 nt, Homo sapiens
ucagcaaucuugauagagu

SEQ ID NO: 592902 - RNA, 19 nt, Homo sapiens
gagaacuugugaugcucua

SEQ ID NO: 592903 - RNA, 19 nt, Homo sapiens
caaagagcacuucuacaau

SEQ ID NO: 592904 - RNA, 19 nt, Homo sapiens
ccaauuuccuacagaauac

SEQ ID NO: 592905 - RNA, 19 nt, Homo sapiens
gcucucagaccuccagaaa

SEQ ID NO: 592906 - RNA, 19 nt, Homo sapiens
gcuaaccuuucacuguuug

SEQ ID NO: 592907 - RNA, 19 nt, Homo sapiens
cgucugaauguuuagauua

SEQ ID NO: 592908 - RNA, 19 nt, Homo sapiens
uuggauggaugaauacaaa

SEQ ID NO: 592909 - RNA, 19 nt, Homo sapiens
ggaggacuguuugcuguca

SEQ ID NO: 592910 - RNA, 19 nt, Homo sapiens
gaguuuauuugaagacaca

SEQ ID NO: 592911 - RNA, 19 nt, Homo sapiens
guggaugacuugagugaca

SEQ ID NO: 592912 - RNA, 19 nt, Homo sapiens
aggaggcaaucaauucuuu

SEQ ID NO: 592913 - RNA, 19 nt, Homo sapiens
cgagagcgguugagaugca

SEQ ID NO: 592914 - RNA, 19 nt, Homo sapiens
aaagaagcuuauggugaua

SEQ ID NO: 592915 - RNA, 19 nt, Homo sapiens
cagcagaaguuuggaugga

SEQ ID NO: 592916 - RNA, 19 nt, Homo sapiens
caacuugaaacuuacauca

SEQ ID NO: 592917 - RNA, 19 nt, Homo sapiens
gaagacacaacuugaaacu

SEQ ID NO: 592918 - RNA, 19 nt, Homo sapiens
aaaagaagcuuauggugau

SEQ ID NO: 592919 - RNA, 19 nt, Homo sapiens
ccagcaaacuccagcucaa

SEQ ID NO: 592920 - RNA, 19 nt, Homo sapiens
gaguguaagucccagaagu

SEQ ID NO: 592921 - RNA, 19 nt, Homo sapiens
cguccucacuuuccuguau

SEQ ID NO: 592922 - RNA, 19 nt, Homo sapiens
gacagaguuuauuugaaga

SEQ ID NO: 592923 - RNA, 19 nt, Homo sapiens
ugagugacagaguuuauuu

SEQ ID NO: 592924 - RNA, 19 nt, Homo sapiens
ucaggacugugucuuagug

SEQ ID NO: 592925 - RNA, 19 nt, Homo sapiens
uaacaguggccuauaucuu

SEQ ID NO: 592926 - RNA, 19 nt, Homo sapiens
gugacagaguuuauuugaa

SEQ ID NO: 592927 - RNA, 19 nt, Homo sapiens
guaccagcaaacauuauuu

SEQ ID NO: 592928 - RNA, 19 nt, Homo sapiens
ggaucucgucugaauguuu

SEQ ID NO: 592929 - RNA, 19 nt, Homo sapiens
ggacaggcggauaucaaga

SEQ ID NO: 592930 - RNA, 19 nt, Homo sapiens
ugagagauacgccaucaau

SEQ ID NO: 592931 - RNA, 19 nt, Homo sapiens
gcaaaauugucccaaagau

SEQ ID NO: 592932 - RNA, 19 nt, Homo sapiens
ggucaaggaggcaaucaau

SEQ ID NO: 592933 - RNA, 19 nt, Homo sapiens
cccaauuuccuacagaaua

SEQ ID NO: 592934 - RNA, 19 nt, Homo sapiens
gacaggcggauaucaagaa

SEQ ID NO: 592935 - RNA, 19 nt, Homo sapiens
gaaacuuacaucagcaauc

SEQ ID NO: 592936 - RNA, 19 nt, Homo sapiens
ccucuguuaucauugcuuu

SEQ ID NO: 592937 - RNA, 19 nt, Homo sapiens
guaagucccagaaguucaa

SEQ ID NO: 592938 - RNA, 19 nt, Homo sapiens
caaagauggguucccugua

SEQ ID NO: 592939 - RNA, 19 nt, Homo sapiens
ggauggaugaauacaaaga

SEQ ID NO: 592940 - RNA, 19 nt, Homo sapiens
gauaugaaacagcaguugu

SEQ ID NO: 592941 - RNA, 19 nt, Homo sapiens
gcagauucccgugcacuug

SEQ ID NO: 592942 - RNA, 19 nt, Homo sapiens
gaccugauguacaaaugag

SEQ ID NO: 592943 - RNA, 19 nt, Homo sapiens
ccacgugggccauguguuc

SEQ ID NO: 592944 - RNA, 19 nt, Homo sapiens
cucgaccgcuuuauaagaa

SEQ ID NO: 592945 - RNA, 19 nt, Homo sapiens
ggagggccgaccugaugua

SEQ ID NO: 592946 - RNA, 19 nt, Homo sapiens
ugucucgaccgcuuuauaa

SEQ ID NO: 592947 - RNA, 19 nt, Homo sapiens
agaagcuuauggugauauu

SEQ ID NO: 592948 - RNA, 19 nt, Homo sapiens
gacuggcguuuaacauuuc

SEQ ID NO: 592949 - RNA, 19 nt, Homo sapiens
aaugagaacuugugaugcu

SEQ ID NO: 592950 - RNA, 19 nt, Homo sapiens
ggugcuaaccuuucacugu

SEQ ID NO: 592951 - RNA, 19 nt, Homo sapiens
agauacgccaucaauauuu

SEQ ID NO: 592952 - RNA, 19 nt, Homo sapiens
gagcuuugacugguauuug

SEQ ID NO: 592953 - RNA, 19 nt, Homo sapiens
cuuccuaccaccucuguua

SEQ ID NO: 592954 - RNA, 19 nt, Homo sapiens
gauguacaaaugagaacuu

SEQ ID NO: 592955 - RNA, 19 nt, Homo sapiens
uggagaaccucaucaagua

SEQ ID NO: 592956 - RNA, 19 nt, Homo sapiens
caauagccguccucaugua

SEQ ID NO: 592957 - RNA, 19 nt, Homo sapiens
gagcaaugcccgguuauuu

SEQ ID NO: 592958 - RNA, 19 nt, Homo sapiens
gaacugguguguggugaug

SEQ ID NO: 592959 - RNA, 19 nt, Homo sapiens
uggcugagcucaugcaguu

SEQ ID NO: 592960 - RNA, 19 nt, Homo sapiens
gagcccaccucuccuccua

SEQ ID NO: 592961 - RNA, 19 nt, Homo sapiens
gccaauagccguccucaug

SEQ ID NO: 592962 - RNA, 19 nt, Homo sapiens
gguccgagggugucaauaa

SEQ ID NO: 592963 - RNA, 19 nt, Homo sapiens
gagcgucccucugcgaaug

SEQ ID NO: 592964 - RNA, 19 nt, Homo sapiens
gacaguggcuucagcaacu

SEQ ID NO: 592965 - RNA, 19 nt, Homo sapiens
guccgagggugucaauaaa

SEQ ID NO: 592966 - RNA, 19 nt, Homo sapiens
ucauguacguccacgacua

SEQ ID NO: 592967 - RNA, 19 nt, Homo sapiens
ucaaggacauggacuacuc

SEQ ID NO: 592968 - RNA, 19 nt, Homo sapiens
ccaggugguuucucuguuc

SEQ ID NO: 592969 - RNA, 19 nt, Homo sapiens
ggacuacucacgcaucauc

SEQ ID NO: 592970 - RNA, 19 nt, Homo sapiens
gcuacgagcucaacuuucc

SEQ ID NO: 592971 - RNA, 19 nt, Homo sapiens
gcaaugcccgguuauuucu

SEQ ID NO: 592972 - RNA, 19 nt, Homo sapiens
cuugagcaaugcccgguua

SEQ ID NO: 592973 - RNA, 19 nt, Homo sapiens
acuacgugcucaacuauga

SEQ ID NO: 592974 - RNA, 19 nt, Homo sapiens
ggagaaccucaucaaguau

SEQ ID NO: 592975 - RNA, 19 nt, Homo sapiens
ggaggccucucugcccuau

SEQ ID NO: 592976 - RNA, 19 nt, Homo sapiens
acuacuacgugcucaacua

SEQ ID NO: 592977 - RNA, 19 nt, Homo sapiens
caucaucggacagccaaua

SEQ ID NO: 592978 - RNA, 19 nt, Homo sapiens
caucagacacuucuacaag

SEQ ID NO: 592979 - RNA, 19 nt, Homo sapiens
ccugcaggauucuuuauuc

SEQ ID NO: 592980 - RNA, 19 nt, Homo sapiens
gagaaccucaucaaguaug

SEQ ID NO: 592981 - RNA, 19 nt, Homo sapiens
gugcuacgagcucaacuuu

SEQ ID NO: 592982 - RNA, 19 nt, Homo sapiens
ucaucuggcucaucuucuu

SEQ ID NO: 592983 - RNA, 19 nt, Homo sapiens
gccaucgccugcaggauuc

SEQ ID NO: 592984 - RNA, 19 nt, Homo sapiens
ccgagggugucaauaaagu

SEQ ID NO: 592985 - RNA, 19 nt, Homo sapiens
ccaauagccguccucaugu

SEQ ID NO: 592986 - RNA, 19 nt, Homo sapiens
ccgagucugucaccuacuu

SEQ ID NO: 592987 - RNA, 19 nt, Homo sapiens
uggccaccauucuguguuu

SEQ ID NO: 592988 - RNA, 19 nt, Homo sapiens
gcugagcucaugcaguuug

SEQ ID NO: 592989 - RNA, 19 nt, Homo sapiens
caccucaucuggcucaucu

SEQ ID NO: 592990 - RNA, 19 nt, Homo sapiens
cuaccgcgaucucuacuac

SEQ ID NO: 592991 - RNA, 19 nt, Homo sapiens
cugcaggauucuuuauuca

SEQ ID NO: 592992 - RNA, 19 nt, Homo sapiens
gaugccagcugggagucuu

SEQ ID NO: 592993 - RNA, 19 nt, Homo sapiens
gcaucagacacuucuacaa

SEQ ID NO: 592994 - RNA, 19 nt, Homo sapiens
guacguccacgacuacuac

SEQ ID NO: 592995 - RNA, 19 nt, Homo sapiens
acgcagccguuguccuuga

SEQ ID NO: 592996 - RNA, 19 nt, Homo sapiens
ugaccuaccgcgaucucua

SEQ ID NO: 592997 - RNA, 19 nt, Homo sapiens
uccucaagcucuucuccua

SEQ ID NO: 592998 - RNA, 19 nt, Homo sapiens
guggugaugcugaucuuga

SEQ ID NO: 592999 - RNA, 19 nt, Homo sapiens
gagcuacccggacaaucug

SEQ ID NO: 593000 - RNA, 19 nt, Homo sapiens
caaccuggccaccauucug

SEQ ID NO: 593001 - RNA, 19 nt, Homo sapiens
cuacuacgugcucaacuau

SEQ ID NO: 593002 - RNA, 19 nt, Homo sapiens
ugccaucgccugcaggauu

SEQ ID NO: 593003 - RNA, 19 nt, Homo sapiens
ugagcuacccggacaaucu

SEQ ID NO: 593004 - RNA, 19 nt, Homo sapiens
gguguguggugaugcugau

SEQ ID NO: 593005 - RNA, 19 nt, Homo sapiens
acaguggcuucagcaacua

SEQ ID NO: 593006 - RNA, 19 nt, Homo sapiens
ccauccaggugguuucucu

SEQ ID NO: 593007 - RNA, 19 nt, Homo sapiens
ugguuucucuguuccugaa

SEQ ID NO: 593008 - RNA, 19 nt, Homo sapiens
cgacagcaggccagacaca

SEQ ID NO: 593009 - RNA, 19 nt, Homo sapiens
uggcugcauuccagguuga

SEQ ID NO: 593010 - RNA, 19 nt, Homo sapiens
gacauuaucuugccaguua

SEQ ID NO: 593011 - RNA, 19 nt, Homo sapiens
gaaauuaaauccucgguau

SEQ ID NO: 593012 - RNA, 19 nt, Homo sapiens
ggagauaggauuauagaua

SEQ ID NO: 593013 - RNA, 19 nt, Homo sapiens
gcaaggagauaggauuaua

SEQ ID NO: 593014 - RNA, 19 nt, Homo sapiens
ucuaagagcucguauauug

SEQ ID NO: 593015 - RNA, 19 nt, Homo sapiens
guagaaacgugcuguguaa

SEQ ID NO: 593016 - RNA, 19 nt, Homo sapiens
gguccagacuuuauucuua

SEQ ID NO: 593017 - RNA, 19 nt, Homo sapiens
gcaguugccuaucacaaua

SEQ ID NO: 593018 - RNA, 19 nt, Homo sapiens
ugaaacaguugauagcuua

SEQ ID NO: 593019 - RNA, 19 nt, Homo sapiens
gagauuagguuuaaaugga

SEQ ID NO: 593020 - RNA, 19 nt, Homo sapiens
ccagagagcccugaaauua

SEQ ID NO: 593021 - RNA, 19 nt, Homo sapiens
gaaggacgaugaaacaguu

SEQ ID NO: 593022 - RNA, 19 nt, Homo sapiens
acaaagagaugcugaaguu

SEQ ID NO: 593023 - RNA, 19 nt, Homo sapiens
gaugugggcuucucuaaga

SEQ ID NO: 593024 - RNA, 19 nt, Homo sapiens
gaaacgugcuguguaauug

SEQ ID NO: 593025 - RNA, 19 nt, Homo sapiens
gagguaauaugcuauaaug

SEQ ID NO: 593026 - RNA, 19 nt, Homo sapiens
gaaacucaaucaacuagug

SEQ ID NO: 593027 - RNA, 19 nt, Homo sapiens
ggaaauaguagaacacuug

SEQ ID NO: 593028 - RNA, 19 nt, Homo sapiens
ggaaauaacauuggugauu

SEQ ID NO: 593029 - RNA, 19 nt, Homo sapiens
gaaaauggcucuggugaaa

SEQ ID NO: 593030 - RNA, 19 nt, Homo sapiens
gaacacgucugcugcuauc

SEQ ID NO: 593031 - RNA, 19 nt, Homo sapiens
gggacagcuuguauaauua

SEQ ID NO: 593032 - RNA, 19 nt, Homo sapiens
gaccucagcucuucuuguu

SEQ ID NO: 593033 - RNA, 19 nt, Homo sapiens
gcuauaaugucugcuguaa

SEQ ID NO: 593034 - RNA, 19 nt, Homo sapiens
ugaaaucggaguugaguua

SEQ ID NO: 593035 - RNA, 19 nt, Homo sapiens
ugacaaagcccucuccauu

SEQ ID NO: 593036 - RNA, 19 nt, Homo sapiens
gaagucagagcaauggaua

SEQ ID NO: 593037 - RNA, 19 nt, Homo sapiens
gauuuggacuuuaucugua

SEQ ID NO: 593038 - RNA, 19 nt, Homo sapiens
ugucagagauuagguuuaa

SEQ ID NO: 593039 - RNA, 19 nt, Homo sapiens
agagagcccugaaauuaaa

SEQ ID NO: 593040 - RNA, 19 nt, Homo sapiens
ugagaaagcagccuuauau

SEQ ID NO: 593041 - RNA, 19 nt, Homo sapiens
cgacuugaauucauuuguu

SEQ ID NO: 593042 - RNA, 19 nt, Homo sapiens
aaacagcgauuucucagau

SEQ ID NO: 593043 - RNA, 19 nt, Homo sapiens
guuagacccaucuuaauua

SEQ ID NO: 593044 - RNA, 19 nt, Homo sapiens
uggcaaagcuucaugaaca

SEQ ID NO: 593045 - RNA, 19 nt, Homo sapiens
gacaaagcccucuccauuu

SEQ ID NO: 593046 - RNA, 19 nt, Homo sapiens
agaauaaacucacuucaag

SEQ ID NO: 593047 - RNA, 19 nt, Homo sapiens
ugaccuugcucuuggauuu

SEQ ID NO: 593048 - RNA, 19 nt, Homo sapiens
agggacagcuuguauaauu

SEQ ID NO: 593049 - RNA, 19 nt, Homo sapiens
ucagagcaauggauacaaa

SEQ ID NO: 593050 - RNA, 19 nt, Homo sapiens
guacuucugucucacuuau

SEQ ID NO: 593051 - RNA, 19 nt, Homo sapiens
acaccaagcucgagaacuu

SEQ ID NO: 593052 - RNA, 19 nt, Homo sapiens
guagaacacuuggaggaaa

SEQ ID NO: 593053 - RNA, 19 nt, Homo sapiens
agaaagcagccuuauauuu

SEQ ID NO: 593054 - RNA, 19 nt, Homo sapiens
gagcaauggauacaaauga

SEQ ID NO: 593055 - RNA, 19 nt, Homo sapiens
gaauaucuaauacgacuug

SEQ ID NO: 593056 - RNA, 19 nt, Homo sapiens
ccaaggaccucagcucuuc

SEQ ID NO: 593057 - RNA, 19 nt, Homo sapiens
cgaggugccugcucccuuu

SEQ ID NO: 593058 - RNA, 19 nt, Homo sapiens
gcagaccuaugaaauccuu

SEQ ID NO: 593059 - RNA, 19 nt, Homo sapiens
acaagacccuuacaggauu

SEQ ID NO: 593060 - RNA, 19 nt, Homo sapiens
gcucauauauacacagagu

SEQ ID NO: 593061 - RNA, 19 nt, Homo sapiens
caacaaacgggacuacaga

SEQ ID NO: 593062 - RNA, 19 nt, Homo sapiens
caggcaagcuguauacuag

SEQ ID NO: 593063 - RNA, 19 nt, Homo sapiens
gaacugcugauagcccuua

SEQ ID NO: 593064 - RNA, 19 nt, Homo sapiens
ucacuuauguccaaagagu

SEQ ID NO: 593065 - RNA, 19 nt, Homo sapiens
gcugguugcuuuaggagaa

SEQ ID NO: 593066 - RNA, 19 nt, Homo sapiens
cagagagcccugaaauuaa

SEQ ID NO: 593067 - RNA, 19 nt, Homo sapiens
gcaaauggucggcggaguu

SEQ ID NO: 593068 - RNA, 19 nt, Homo sapiens
gguccagaaugauguuuga

SEQ ID NO: 593069 - RNA, 19 nt, Homo sapiens
ccacucaacuugucuucug

SEQ ID NO: 593070 - RNA, 19 nt, Homo sapiens
ccuaugaaauccuuaagau

SEQ ID NO: 593071 - RNA, 19 nt, Homo sapiens
gagaaagcagccuuauauu

SEQ ID NO: 593072 - RNA, 19 nt, Homo sapiens
acacagaguugcaguugau

SEQ ID NO: 593073 - RNA, 19 nt, Homo sapiens
ggaagaagucagagcaaug

SEQ ID NO: 593074 - RNA, 19 nt, Homo sapiens
gaucacagacaaagagaug

SEQ ID NO: 593075 - RNA, 19 nt, Homo sapiens
gcaagcuguauacuaguua

SEQ ID NO: 593076 - RNA, 19 nt, Homo sapiens
ggcaaaagauggcuauauu

SEQ ID NO: 593077 - RNA, 19 nt, Homo sapiens
gcacugaguacccuuagga

SEQ ID NO: 593078 - RNA, 19 nt, Homo sapiens
ggaacaaaguuucaaugcu

SEQ ID NO: 593079 - RNA, 19 nt, Homo sapiens
ggacacuaaugggacauga

SEQ ID NO: 593080 - RNA, 19 nt, Homo sapiens
cauaaccucugugagauug

SEQ ID NO: 593081 - RNA, 19 nt, Homo sapiens
ucuccaaccuucuuuaugu

SEQ ID NO: 593082 - RNA, 19 nt, Homo sapiens
uuaaugagcuaaggaaaca

SEQ ID NO: 593083 - RNA, 19 nt, Homo sapiens
ucgagaacuugauggauuu

SEQ ID NO: 593084 - RNA, 19 nt, Homo sapiens
ggcaagcuguauacuaguu

SEQ ID NO: 593085 - RNA, 19 nt, Homo sapiens
caugaucccuauucugaug

SEQ ID NO: 593086 - RNA, 19 nt, Homo sapiens
caaccgccuccgccuauua

SEQ ID NO: 593087 - RNA, 19 nt, Homo sapiens
ccucagcucuucuuguuuc

SEQ ID NO: 593088 - RNA, 19 nt, Homo sapiens
aaacuggacuugguuaaag

SEQ ID NO: 593089 - RNA, 19 nt, Homo sapiens
uaagagcucguauauuguu

SEQ ID NO: 593090 - RNA, 19 nt, Homo sapiens
uuaaagaggccauugaugu

SEQ ID NO: 593091 - RNA, 19 nt, Homo sapiens
cacaguagaugcuauggau

SEQ ID NO: 593092 - RNA, 19 nt, Homo sapiens
gauaauuucacggacauuu

SEQ ID NO: 593093 - RNA, 19 nt, Homo sapiens
ugaguacccuuaggaagaa

SEQ ID NO: 593094 - RNA, 19 nt, Homo sapiens
cuucuucccugaaugcuuu

SEQ ID NO: 593095 - RNA, 19 nt, Homo sapiens
caaaaguguugugcauuua

SEQ ID NO: 593096 - RNA, 19 nt, Homo sapiens
aggagaauguuacgagaaa

SEQ ID NO: 593097 - RNA, 19 nt, Homo sapiens
ucagagauauugacaaagc

SEQ ID NO: 593098 - RNA, 19 nt, Homo sapiens
gguaauaugcuauaauguc

SEQ ID NO: 593099 - RNA, 19 nt, Homo sapiens
cuaaagcuuucaaauugga

SEQ ID NO: 593100 - RNA, 19 nt, Homo sapiens
acaaagcccucuccauuuu

SEQ ID NO: 593101 - RNA, 19 nt, Homo sapiens
guccagacuuuauucuuau

SEQ ID NO: 593102 - RNA, 19 nt, Homo sapiens
aagcuggucuguuuuaaua

SEQ ID NO: 593103 - RNA, 19 nt, Homo sapiens
gagacaaucuuccaaaaca

SEQ ID NO: 593104 - RNA, 19 nt, Homo sapiens
ccaaagaguggcuauagau

SEQ ID NO: 593105 - RNA, 19 nt, Homo sapiens
cugcuucacucucugcuaa

SEQ ID NO: 593106 - RNA, 19 nt, Homo sapiens
ggauuuggacuuuaucugu

SEQ ID NO: 593107 - RNA, 19 nt, Homo sapiens
uagaugcuauggaucauuc

SEQ ID NO: 593108 - RNA, 19 nt, Homo sapiens
uagcuauacuccuaccaaa

SEQ ID NO: 593109 - RNA, 19 nt, Homo sapiens
gagcuuggaacugcugaua

SEQ ID NO: 593110 - RNA, 19 nt, Homo sapiens
gaaguucgaucaugguaaa

SEQ ID NO: 593111 - RNA, 19 nt, Homo sapiens
gacgcugggucuacuauug

SEQ ID NO: 593112 - RNA, 19 nt, Homo sapiens
gugcggagcaucugaaguu

SEQ ID NO: 593113 - RNA, 19 nt, Homo sapiens
ugaagacggugcugaugau

SEQ ID NO: 593114 - RNA, 19 nt, Homo sapiens
caacauugaaguucgauca

SEQ ID NO: 593115 - RNA, 19 nt, Homo sapiens
caucugaaguugcagucuu

SEQ ID NO: 593116 - RNA, 19 nt, Homo sapiens
gcacagccggcucauuguu

SEQ ID NO: 593117 - RNA, 19 nt, Homo sapiens
gaacugccugugcgccuuu

SEQ ID NO: 593118 - RNA, 19 nt, Homo sapiens
gcugcuggccgacgucuuu

SEQ ID NO: 593119 - RNA, 19 nt, Homo sapiens
caaccccgcuucuguguga

SEQ ID NO: 593120 - RNA, 19 nt, Homo sapiens
cggagcaucugaaguugca

SEQ ID NO: 593121 - RNA, 19 nt, Homo sapiens
acuauugccuggugaacau

SEQ ID NO: 593122 - RNA, 19 nt, Homo sapiens
acauugaaguucgaucaug

SEQ ID NO: 593123 - RNA, 19 nt, Homo sapiens
gggcuucugacgccaaaug

SEQ ID NO: 593124 - RNA, 19 nt, Homo sapiens
gcucauuguucugcacuac

SEQ ID NO: 593125 - RNA, 19 nt, Homo sapiens
ggccaucaccagccacaug

SEQ ID NO: 593126 - RNA, 19 nt, Homo sapiens
ugaaguucgaucaugguaa

SEQ ID NO: 593127 - RNA, 19 nt, Homo sapiens
cacgcagccucgccuguau

SEQ ID NO: 593128 - RNA, 19 nt, Homo sapiens
cugaagacggugcugauga

SEQ ID NO: 593129 - RNA, 19 nt, Homo sapiens
uggcaacauugaaguucga

SEQ ID NO: 593130 - RNA, 19 nt, Homo sapiens
gagcaucucuucuuuauuu

SEQ ID NO: 593131 - RNA, 19 nt, Homo sapiens
ggagaaagcuuccaaagga

SEQ ID NO: 593132 - RNA, 19 nt, Homo sapiens
caacacaccuggaaauuaa

SEQ ID NO: 593133 - RNA, 19 nt, Homo sapiens
gaagaagcauugauaauug

SEQ ID NO: 593134 - RNA, 19 nt, Homo sapiens
gaaagaugcuagaagauuu

SEQ ID NO: 593135 - RNA, 19 nt, Homo sapiens
ggaggaagcugcacuuuga

SEQ ID NO: 593136 - RNA, 19 nt, Homo sapiens
guaagcaacuguauaauga

SEQ ID NO: 593137 - RNA, 19 nt, Homo sapiens
gaaagcagcuaaagucuuc

SEQ ID NO: 593138 - RNA, 19 nt, Homo sapiens
gcacuaacauggaguuuga

SEQ ID NO: 593139 - RNA, 19 nt, Homo sapiens
gauagacccucuugaauug

SEQ ID NO: 593140 - RNA, 19 nt, Homo sapiens
ggaauuaaguggaucaaga

SEQ ID NO: 593141 - RNA, 19 nt, Homo sapiens
gaccacagauguaggaaua

SEQ ID NO: 593142 - RNA, 19 nt, Homo sapiens
agacaacucuccucaauuu

SEQ ID NO: 593143 - RNA, 19 nt, Homo sapiens
gacaacagaugaacucuuu

SEQ ID NO: 593144 - RNA, 19 nt, Homo sapiens
gaagauuacugaaagcauu

SEQ ID NO: 593145 - RNA, 19 nt, Homo sapiens
ggaagaauuucgaggcaua

SEQ ID NO: 593146 - RNA, 19 nt, Homo sapiens
caaauuagcuaacagacuu

SEQ ID NO: 593147 - RNA, 19 nt, Homo sapiens
ggguagaucuugccaauuu

SEQ ID NO: 593148 - RNA, 19 nt, Homo sapiens
gaaaguucauuacguugua

SEQ ID NO: 593149 - RNA, 19 nt, Homo sapiens
aaacagcccugaaggauuu

SEQ ID NO: 593150 - RNA, 19 nt, Homo sapiens
ugaaugagcuacaagaauu

SEQ ID NO: 593151 - RNA, 19 nt, Homo sapiens
gaacuagauuucuggauga

SEQ ID NO: 593152 - RNA, 19 nt, Homo sapiens
agacuuggcuuuacaauug

SEQ ID NO: 593153 - RNA, 19 nt, Homo sapiens
ggaaauacguauaucacuu

SEQ ID NO: 593154 - RNA, 19 nt, Homo sapiens
gaauccagcuugugaaaga

SEQ ID NO: 593155 - RNA, 19 nt, Homo sapiens
gcaauugaaucugugguua

SEQ ID NO: 593156 - RNA, 19 nt, Homo sapiens
gacagaaggugaugcuuaa

SEQ ID NO: 593157 - RNA, 19 nt, Homo sapiens
cagaugaacucuuugguuu

SEQ ID NO: 593158 - RNA, 19 nt, Homo sapiens
aagcaaaucuuaagcauga

SEQ ID NO: 593159 - RNA, 19 nt, Homo sapiens
gaaacagugucgcaaagaa

SEQ ID NO: 593160 - RNA, 19 nt, Homo sapiens
gcuggaaacugcuuauaaa

SEQ ID NO: 593161 - RNA, 19 nt, Homo sapiens
ggacuuaguuaaagcauuc

SEQ ID NO: 593162 - RNA, 19 nt, Homo sapiens
gaugaaagcagugaaauuu

SEQ ID NO: 593163 - RNA, 19 nt, Homo sapiens
gaucagaauuguucagaga

SEQ ID NO: 593164 - RNA, 19 nt, Homo sapiens
aacaagaacuuucgccuua

SEQ ID NO: 593165 - RNA, 19 nt, Homo sapiens
ggaaugacuuaaacccuaa

SEQ ID NO: 593166 - RNA, 19 nt, Homo sapiens
ccacuuugcuugaucaauu

SEQ ID NO: 593167 - RNA, 19 nt, Homo sapiens
uuaagaaccuguugaagaa

SEQ ID NO: 593168 - RNA, 19 nt, Homo sapiens
gaaaugaguaccagauauu

SEQ ID NO: 593169 - RNA, 19 nt, Homo sapiens
cagaagaucaugacaauuu

SEQ ID NO: 593170 - RNA, 19 nt, Homo sapiens
ggaagucacucuuauaagg

SEQ ID NO: 593171 - RNA, 19 nt, Homo sapiens
gagcaaauuugaggacuuu

SEQ ID NO: 593172 - RNA, 19 nt, Homo sapiens
gaacaaccaccaacucuug

SEQ ID NO: 593173 - RNA, 19 nt, Homo sapiens
gcuaaucugugaaaucuug

SEQ ID NO: 593174 - RNA, 19 nt, Homo sapiens
gaaauuuggucacucaaca

SEQ ID NO: 593175 - RNA, 19 nt, Homo sapiens
gcuaguggcuguauugaga

SEQ ID NO: 593176 - RNA, 19 nt, Homo sapiens
gugauuauguggcauuuaa

SEQ ID NO: 593177 - RNA, 19 nt, Homo sapiens
acugacagguguuauauua

SEQ ID NO: 593178 - RNA, 19 nt, Homo sapiens
gaacagacuaugcaagaaa

SEQ ID NO: 593179 - RNA, 19 nt, Homo sapiens
gcagguggcuguuaacauc

SEQ ID NO: 593180 - RNA, 19 nt, Homo sapiens
gaacuuugcuggagaugca

SEQ ID NO: 593181 - RNA, 19 nt, Homo sapiens
ccacccaaaugcugaaaua

SEQ ID NO: 593182 - RNA, 19 nt, Homo sapiens
gagacaaacugauagacaa

SEQ ID NO: 593183 - RNA, 19 nt, Homo sapiens
gacagaagaucaugacaau

SEQ ID NO: 593184 - RNA, 19 nt, Homo sapiens
gaagcaacgugcagaccua

SEQ ID NO: 593185 - RNA, 19 nt, Homo sapiens
gcaacacaccuggaaauua

SEQ ID NO: 593186 - RNA, 19 nt, Homo sapiens
gaaguugaauacccucuga

SEQ ID NO: 593187 - RNA, 19 nt, Homo sapiens
ccaaggagcaggaguuuaa

SEQ ID NO: 593188 - RNA, 19 nt, Homo sapiens
gaaaguauaucaggauugg

SEQ ID NO: 593189 - RNA, 19 nt, Homo sapiens
caacaugugugucgcauca

SEQ ID NO: 593190 - RNA, 19 nt, Homo sapiens
ggaaacagcccucgacuag

SEQ ID NO: 593191 - RNA, 19 nt, Homo sapiens
gcacuaaccagcucacaaa

SEQ ID NO: 593192 - RNA, 19 nt, Homo sapiens
ccacaacuuuggcagauuu

SEQ ID NO: 593193 - RNA, 19 nt, Homo sapiens
caacaaagucuuagauuuc

SEQ ID NO: 593194 - RNA, 19 nt, Homo sapiens
uaaauggucuucucugugu

SEQ ID NO: 593195 - RNA, 19 nt, Homo sapiens
ccacagacacgcauauuaa

SEQ ID NO: 593196 - RNA, 19 nt, Homo sapiens
ccaagaagauuacugaaag

SEQ ID NO: 593197 - RNA, 19 nt, Homo sapiens
cuaaccagcucacaaauau

SEQ ID NO: 593198 - RNA, 19 nt, Homo sapiens
gaacaggcauuccauuacu

SEQ ID NO: 593199 - RNA, 19 nt, Homo sapiens
uaaaugaagccacaacuuu

SEQ ID NO: 593200 - RNA, 19 nt, Homo sapiens
ggagacagauuccggacuu

SEQ ID NO: 593201 - RNA, 19 nt, Homo sapiens
uaacugcaauggcuuagaa

SEQ ID NO: 593202 - RNA, 19 nt, Homo sapiens
gaaaggauaauacuucaug

SEQ ID NO: 593203 - RNA, 19 nt, Homo sapiens
ugggaaagguugaugauuu

SEQ ID NO: 593204 - RNA, 19 nt, Homo sapiens
aaacagagaccaccaaaga

SEQ ID NO: 593205 - RNA, 19 nt, Homo sapiens
ggaagaaggcuacgaaaca

SEQ ID NO: 593206 - RNA, 19 nt, Homo sapiens
gauugaauguggucaugua

SEQ ID NO: 593207 - RNA, 19 nt, Homo sapiens
ggcaacagcuuaccuuuca

SEQ ID NO: 593208 - RNA, 19 nt, Homo sapiens
ugaaagacccagaguuuaa

SEQ ID NO: 593209 - RNA, 19 nt, Homo sapiens
gcacggcuauugacugguu

SEQ ID NO: 593210 - RNA, 19 nt, Homo sapiens
gcaagucucucugaggauu

SEQ ID NO: 593211 - RNA, 19 nt, Homo sapiens
aaacugagaacaagcuuua

SEQ ID NO: 593212 - RNA, 19 nt, Homo sapiens
ugugaaaucuuguuaguug

SEQ ID NO: 593213 - RNA, 19 nt, Homo sapiens
gagcuaaucugugaaaucu

SEQ ID NO: 593214 - RNA, 19 nt, Homo sapiens
gccaucaguuggaauauuu

SEQ ID NO: 593215 - RNA, 19 nt, Homo sapiens
cauaccagauucagcuuua

SEQ ID NO: 593216 - RNA, 19 nt, Homo sapiens
guuaagauccugacaacua

SEQ ID NO: 593217 - RNA, 19 nt, Homo sapiens
gagauucagugcagcguuu

SEQ ID NO: 593218 - RNA, 19 nt, Homo sapiens
gaaauacguauaucacuug

SEQ ID NO: 593219 - RNA, 19 nt, Homo sapiens
uggcaaauccucacuauaa

SEQ ID NO: 593220 - RNA, 19 nt, Homo sapiens
gagagaagacacaacuaua

SEQ ID NO: 593221 - RNA, 19 nt, Homo sapiens
gcuauugacugguuucaug

SEQ ID NO: 593222 - RNA, 19 nt, Homo sapiens
gagcugguauucuguaugu

SEQ ID NO: 593223 - RNA, 19 nt, Homo sapiens
aaacagcccucgacuagug

SEQ ID NO: 593224 - RNA, 19 nt, Homo sapiens
gugcagaccuaaucucuau

SEQ ID NO: 593225 - RNA, 19 nt, Homo sapiens
ggaaagcuauggccagaag

SEQ ID NO: 593226 - RNA, 19 nt, Homo sapiens
acagagagcuacugaugaa

SEQ ID NO: 593227 - RNA, 19 nt, Homo sapiens
gagcugaguuuaugaagca

SEQ ID NO: 593228 - RNA, 19 nt, Homo sapiens
gaaagucguaucuauaaug

SEQ ID NO: 593229 - RNA, 19 nt, Homo sapiens
ccaacgacuucaaauguuu

SEQ ID NO: 593230 - RNA, 19 nt, Homo sapiens
gagaaugacuuuaaccuuu

SEQ ID NO: 593231 - RNA, 19 nt, Homo sapiens
gcagagagauagauauuau

SEQ ID NO: 593232 - RNA, 19 nt, Homo sapiens
gagcagaacuacugagaaa

SEQ ID NO: 593233 - RNA, 19 nt, Homo sapiens
ucaaauaccucuguaguaa

SEQ ID NO: 593234 - RNA, 19 nt, Homo sapiens
gaaauaagacugcugaaug

SEQ ID NO: 593235 - RNA, 19 nt, Homo sapiens
caaaggaguucauggcuaa

SEQ ID NO: 593236 - RNA, 19 nt, Homo sapiens
ggaacacaauccuuuauau

SEQ ID NO: 593237 - RNA, 19 nt, Homo sapiens
guagaaagguacgaagaua

SEQ ID NO: 593238 - RNA, 19 nt, Homo sapiens
gagccaaacucuugaaugu

SEQ ID NO: 593239 - RNA, 19 nt, Homo sapiens
cuagagacuucaaauagua

SEQ ID NO: 593240 - RNA, 19 nt, Homo sapiens
caaauaguagcacacauua

SEQ ID NO: 593241 - RNA, 19 nt, Homo sapiens
ggauaugaauuagcaguuu

SEQ ID NO: 593242 - RNA, 19 nt, Homo sapiens
cgaagaagguagaacuuga

SEQ ID NO: 593243 - RNA, 19 nt, Homo sapiens
guacgaagauacaauacug

SEQ ID NO: 593244 - RNA, 19 nt, Homo sapiens
gaacagauggguugaguag

SEQ ID NO: 593245 - RNA, 19 nt, Homo sapiens
gagagaaacaccugaugua

SEQ ID NO: 593246 - RNA, 19 nt, Homo sapiens
aaauaagacugcugaaugu

SEQ ID NO: 593247 - RNA, 19 nt, Homo sapiens
cgaagacgaugaccucaga

SEQ ID NO: 593248 - RNA, 19 nt, Homo sapiens
ccaccaggcugaagguaaa

SEQ ID NO: 593249 - RNA, 19 nt, Homo sapiens
ucaugaggguuaaauauug

SEQ ID NO: 593250 - RNA, 19 nt, Homo sapiens
acagauggguugaguaguu

SEQ ID NO: 593251 - RNA, 19 nt, Homo sapiens
acaauggucuuccacacua

SEQ ID NO: 593252 - RNA, 19 nt, Homo sapiens
ggguugagcuccaaagaau

SEQ ID NO: 593253 - RNA, 19 nt, Homo sapiens
gaaugugggcuaucuagaa

SEQ ID NO: 593254 - RNA, 19 nt, Homo sapiens
gcagugaagcagagagaua

SEQ ID NO: 593255 - RNA, 19 nt, Homo sapiens
gaucaugaggguuaaauau

SEQ ID NO: 593256 - RNA, 19 nt, Homo sapiens
caacugcccuucugugucu

SEQ ID NO: 593257 - RNA, 19 nt, Homo sapiens
acagugaacuugggaauga

SEQ ID NO: 593258 - RNA, 19 nt, Homo sapiens
uagaagcccucaaggaaga

SEQ ID NO: 593259 - RNA, 19 nt, Homo sapiens
gcccuucugugucuccuua

SEQ ID NO: 593260 - RNA, 19 nt, Homo sapiens
caaccugacuuuccaccuu

SEQ ID NO: 593261 - RNA, 19 nt, Homo sapiens
uagcagagcuccuggugau

SEQ ID NO: 593262 - RNA, 19 nt, Homo sapiens
cacaguggauuucugguuu

SEQ ID NO: 593263 - RNA, 19 nt, Homo sapiens
gguugaaggagauuuauuu

SEQ ID NO: 593264 - RNA, 19 nt, Homo sapiens
ucaaauaguagcacacauu

SEQ ID NO: 593265 - RNA, 19 nt, Homo sapiens
gagaacagauggguugagu

SEQ ID NO: 593266 - RNA, 19 nt, Homo sapiens
ggcauuguaucuucaguug

SEQ ID NO: 593267 - RNA, 19 nt, Homo sapiens
ggaugacuccaaaggauaa

SEQ ID NO: 593268 - RNA, 19 nt, Homo sapiens
ugaauuagcaguuuacaag

SEQ ID NO: 593269 - RNA, 19 nt, Homo sapiens
cgaagauacaauacuguua

SEQ ID NO: 593270 - RNA, 19 nt, Homo sapiens
ggaaauaagacugcugaau

SEQ ID NO: 593271 - RNA, 19 nt, Homo sapiens
aaccagaucucacuuugga

SEQ ID NO: 593272 - RNA, 19 nt, Homo sapiens
caaauuccgauuacuguug

SEQ ID NO: 593273 - RNA, 19 nt, Homo sapiens
cguccaagguagaaaggua

SEQ ID NO: 593274 - RNA, 19 nt, Homo sapiens
uguuacagcucauuguuga

SEQ ID NO: 593275 - RNA, 19 nt, Homo sapiens
ugaaguggguaaauauaca

SEQ ID NO: 593276 - RNA, 19 nt, Homo sapiens
aaauugggacugcuuuaua

SEQ ID NO: 593277 - RNA, 19 nt, Homo sapiens
gaagguagaacuugacaac

SEQ ID NO: 593278 - RNA, 19 nt, Homo sapiens
caaguaggauaugaauuag

SEQ ID NO: 593279 - RNA, 19 nt, Homo sapiens
guacaaguaggauaugaau

SEQ ID NO: 593280 - RNA, 19 nt, Homo sapiens
gugagaaggcguccacaaa

SEQ ID NO: 593281 - RNA, 19 nt, Homo sapiens
caagagauuccuaaagcaa

SEQ ID NO: 593282 - RNA, 19 nt, Homo sapiens
caaauaccucuguaguaaa

SEQ ID NO: 593283 - RNA, 19 nt, Homo sapiens
cuggugauguagaguauaa

SEQ ID NO: 593284 - RNA, 19 nt, Homo sapiens
ccuagagacuucaaauagu

SEQ ID NO: 593285 - RNA, 19 nt, Homo sapiens
aauugggacugcuuuauau

SEQ ID NO: 593286 - RNA, 19 nt, Homo sapiens
ugauguaccugcuggaaca

SEQ ID NO: 593287 - RNA, 19 nt, Homo sapiens
ugaagcagagagauagaua

SEQ ID NO: 593288 - RNA, 19 nt, Homo sapiens
ugagagaaccagaguuguu

SEQ ID NO: 593289 - RNA, 19 nt, Homo sapiens
gauaaaaggccacaggaaa

SEQ ID NO: 593290 - RNA, 19 nt, Homo sapiens
caacaucacaguggauuuc

SEQ ID NO: 593291 - RNA, 19 nt, Homo sapiens
ugccugaaguggguaaaua

SEQ ID NO: 593292 - RNA, 19 nt, Homo sapiens
ggguacagguuacguuaca

SEQ ID NO: 593293 - RNA, 19 nt, Homo sapiens
ucuagaagcccucaaggaa

SEQ ID NO: 593294 - RNA, 19 nt, Homo sapiens
gaagagguacaggcagaaa

SEQ ID NO: 593295 - RNA, 19 nt, Homo sapiens
cagagcuccuggugaugua

SEQ ID NO: 593296 - RNA, 19 nt, Homo sapiens
gaaguggguaaauauacaa

SEQ ID NO: 593297 - RNA, 19 nt, Homo sapiens
cgauuacuguugcuguuga

SEQ ID NO: 593298 - RNA, 19 nt, Homo sapiens
gaagcagagagauagauau

SEQ ID NO: 593299 - RNA, 19 nt, Homo sapiens
gguaugccuuccagugaug

SEQ ID NO: 593300 - RNA, 19 nt, Homo sapiens
ccuguacaaucaucuguga

SEQ ID NO: 593301 - RNA, 19 nt, Homo sapiens
cauuuauccuguacaauca

SEQ ID NO: 593302 - RNA, 19 nt, Homo sapiens
cauuguaucuucaguuguc

SEQ ID NO: 593303 - RNA, 19 nt, Homo sapiens
caugaggguuaaauauugu

SEQ ID NO: 593304 - RNA, 19 nt, Homo sapiens
ggccuagagacuucaaaua

SEQ ID NO: 593305 - RNA, 19 nt, Homo sapiens
guugagcuccaaagaauga

SEQ ID NO: 593306 - RNA, 19 nt, Homo sapiens
aaaguuuaaucgagccaaa

SEQ ID NO: 593307 - RNA, 19 nt, Homo sapiens
uaucuucaguugucaucaa

SEQ ID NO: 593308 - RNA, 19 nt, Homo sapiens
gcagagcuccuggugaugu

SEQ ID NO: 593309 - RNA, 19 nt, Homo sapiens
gcaugacccuggaucuuuu

SEQ ID NO: 593310 - RNA, 19 nt, Homo sapiens
gcacuuuguggcuucauga

SEQ ID NO: 593311 - RNA, 19 nt, Homo sapiens
ucacgagucuggagaacag

SEQ ID NO: 593312 - RNA, 19 nt, Homo sapiens
gaaugacuuuaaccuuuac

SEQ ID NO: 593313 - RNA, 19 nt, Homo sapiens
gaaaauugggacugcuuua

SEQ ID NO: 593314 - RNA, 19 nt, Homo sapiens
uaaucgagccaaacucuug

SEQ ID NO: 593315 - RNA, 19 nt, Homo sapiens
gccuagagacuucaaauag

SEQ ID NO: 593316 - RNA, 19 nt, Homo sapiens
cagauggguugaguaguug

SEQ ID NO: 593317 - RNA, 19 nt, Homo sapiens
cagaacggaugaagcucuu

SEQ ID NO: 593318 - RNA, 19 nt, Homo sapiens
gacgaugaccucagacuca

SEQ ID NO: 593319 - RNA, 19 nt, Homo sapiens
agaaacaccugauguaccu

SEQ ID NO: 593320 - RNA, 19 nt, Homo sapiens
guacaaucaucugugaagu

SEQ ID NO: 593321 - RNA, 19 nt, Homo sapiens
ucaaaccagaucucacuuu

SEQ ID NO: 593322 - RNA, 19 nt, Homo sapiens
aggaguucauggcuaauuu

SEQ ID NO: 593323 - RNA, 19 nt, Homo sapiens
ucaagagauuccuaaagca

SEQ ID NO: 593324 - RNA, 19 nt, Homo sapiens
uacuguugcuguugacuuu

SEQ ID NO: 593325 - RNA, 19 nt, Homo sapiens
aaggaugacuccaaaggau

SEQ ID NO: 593326 - RNA, 19 nt, Homo sapiens
guggguaaauauacaaugg

SEQ ID NO: 593327 - RNA, 19 nt, Homo sapiens
aagcagagagauagauauu

SEQ ID NO: 593328 - RNA, 19 nt, Homo sapiens
aaugaagcauccacgaaga

SEQ ID NO: 593329 - RNA, 19 nt, Homo sapiens
aguaggauaugaauuagca

SEQ ID NO: 593330 - RNA, 19 nt, Homo sapiens
ggaccucugugaauauuua

SEQ ID NO: 593331 - RNA, 19 nt, Homo sapiens
ggaggagucucagcacuua

SEQ ID NO: 593332 - RNA, 19 nt, Homo sapiens
agaacgaucuccucucuua

SEQ ID NO: 593333 - RNA, 19 nt, Homo sapiens
gauaaugccucacaucucu

SEQ ID NO: 593334 - RNA, 19 nt, Homo sapiens
gaaguuguuuggugaagga

SEQ ID NO: 593335 - RNA, 19 nt, Homo sapiens
gaacucuggugccgugcua

SEQ ID NO: 593336 - RNA, 19 nt, Homo sapiens
caacaucacagcagacauu

SEQ ID NO: 593337 - RNA, 19 nt, Homo sapiens
gaucagggaccgacauuug

SEQ ID NO: 593338 - RNA, 19 nt, Homo sapiens
ucugugacauuuccaauuu

SEQ ID NO: 593339 - RNA, 19 nt, Homo sapiens
ccucggaccucugugaaua

SEQ ID NO: 593340 - RNA, 19 nt, Homo sapiens
ggaccgacauuugacuauu

SEQ ID NO: 593341 - RNA, 19 nt, Homo sapiens
gggaugaacucacugacau

SEQ ID NO: 593342 - RNA, 19 nt, Homo sapiens
gagaggcccugcgugauga

SEQ ID NO: 593343 - RNA, 19 nt, Homo sapiens
cagcagacauugggacuga

SEQ ID NO: 593344 - RNA, 19 nt, Homo sapiens
gcuccucacuguucucaga

SEQ ID NO: 593345 - RNA, 19 nt, Homo sapiens
gggcugggauuuugauaua

SEQ ID NO: 593346 - RNA, 19 nt, Homo sapiens
gaccgacauuugacuauuc

SEQ ID NO: 593347 - RNA, 19 nt, Homo sapiens
uggaauagcucccucuucu

SEQ ID NO: 593348 - RNA, 19 nt, Homo sapiens
ccagaacgaucuccucucu

SEQ ID NO: 593349 - RNA, 19 nt, Homo sapiens
gaccaguaccugaagauga

SEQ ID NO: 593350 - RNA, 19 nt, Homo sapiens
guggaccucuugccagaaa

SEQ ID NO: 593351 - RNA, 19 nt, Homo sapiens
ggaugaacucacugacaua

SEQ ID NO: 593352 - RNA, 19 nt, Homo sapiens
ccacaucuguaggacacua

SEQ ID NO: 593353 - RNA, 19 nt, Homo sapiens
gaggagauaagggcaauga

SEQ ID NO: 593354 - RNA, 19 nt, Homo sapiens
gugaagcaccgaggagaua

SEQ ID NO: 593355 - RNA, 19 nt, Homo sapiens
acuauaagauggugaagca

SEQ ID NO: 593356 - RNA, 19 nt, Homo sapiens
gaaaaugaccacaaucugu

SEQ ID NO: 593357 - RNA, 19 nt, Homo sapiens
guaccgcccugcagguugu

SEQ ID NO: 593358 - RNA, 19 nt, Homo sapiens
gauaagggcaaugaggaaa

SEQ ID NO: 593359 - RNA, 19 nt, Homo sapiens
gaacauuuaacagggcaaa

SEQ ID NO: 593360 - RNA, 19 nt, Homo sapiens
gaggaugacgacauugcua

SEQ ID NO: 593361 - RNA, 19 nt, Homo sapiens
accaguaccugaagaugaa

SEQ ID NO: 593362 - RNA, 19 nt, Homo sapiens
ugaacucacugacauacca

SEQ ID NO: 593363 - RNA, 19 nt, Homo sapiens
guacuucggaggagucuca

SEQ ID NO: 593364 - RNA, 19 nt, Homo sapiens
gcuuauggcaucuauguca

SEQ ID NO: 593365 - RNA, 19 nt, Homo sapiens
cucgugaugucuacaguaa

SEQ ID NO: 593366 - RNA, 19 nt, Homo sapiens
gagaucagggaccgacauu

SEQ ID NO: 593367 - RNA, 19 nt, Homo sapiens
gggcaaaacuguugaacgu

SEQ ID NO: 593368 - RNA, 19 nt, Homo sapiens
ucucuagggucuccuguag

SEQ ID NO: 593369 - RNA, 19 nt, Homo sapiens
cugucuaccuuaaucauga

SEQ ID NO: 593370 - RNA, 19 nt, Homo sapiens
gagcuggggccucuuuaua

SEQ ID NO: 593371 - RNA, 19 nt, Homo sapiens
gaugggaugaacucacuga

SEQ ID NO: 593372 - RNA, 19 nt, Homo sapiens
gcacgauguggaccucuug

SEQ ID NO: 593373 - RNA, 19 nt, Homo sapiens
gggacugccuguucuugca

SEQ ID NO: 593374 - RNA, 19 nt, Homo sapiens
ccucagcuccucacuguuc

SEQ ID NO: 593375 - RNA, 19 nt, Homo sapiens
gcuaugaacaaguuuggau

SEQ ID NO: 593376 - RNA, 19 nt, Homo sapiens
gcccuacuguccagaacga

SEQ ID NO: 593377 - RNA, 19 nt, Homo sapiens
gcugggauuuugauauauu

SEQ ID NO: 593378 - RNA, 19 nt, Homo sapiens
ccacguuacccaccugguu

SEQ ID NO: 593379 - RNA, 19 nt, Homo sapiens
cuaugaacaaguuuggaua

SEQ ID NO: 593380 - RNA, 19 nt, Homo sapiens
ccguugcuaugaacaaguu

SEQ ID NO: 593381 - RNA, 19 nt, Homo sapiens
gagugggacugccuguucu

SEQ ID NO: 593382 - RNA, 19 nt, Homo sapiens
gaacgaucuccucucuuag

SEQ ID NO: 593383 - RNA, 19 nt, Homo sapiens
cgacauuugacuauucuca

SEQ ID NO: 593384 - RNA, 19 nt, Homo sapiens
uguaggacacuauaagaug

SEQ ID NO: 593385 - RNA, 19 nt, Homo sapiens
uggugaggaugacgacauu

SEQ ID NO: 593386 - RNA, 19 nt, Homo sapiens
gccuuucucugcccucugu

SEQ ID NO: 593387 - RNA, 19 nt, Homo sapiens
aaaaugaccacaaucugua

SEQ ID NO: 593388 - RNA, 19 nt, Homo sapiens
ccgaacagccaucauugug

SEQ ID NO: 593389 - RNA, 19 nt, Homo sapiens
aagucucagugcccuauuu

SEQ ID NO: 593390 - RNA, 19 nt, Homo sapiens
ggaauagcucccucuucug

SEQ ID NO: 593391 - RNA, 19 nt, Homo sapiens
ucggaccucugugaauauu

SEQ ID NO: 593392 - RNA, 19 nt, Homo sapiens
acccucagcuccucacugu

SEQ ID NO: 593393 - RNA, 19 nt, Homo sapiens
aagaugggaugaacucacu

SEQ ID NO: 593394 - RNA, 19 nt, Homo sapiens
ggacgcaagaugggaugaa

SEQ ID NO: 593395 - RNA, 19 nt, Homo sapiens
gggaaguuguuuggugaag

SEQ ID NO: 593396 - RNA, 19 nt, Homo sapiens
ucccaagccuuccgucaag

SEQ ID NO: 593397 - RNA, 19 nt, Homo sapiens
ugaauggcuuccccaauga

SEQ ID NO: 593398 - RNA, 19 nt, Homo sapiens
ugaacaaguuuggauacag

SEQ ID NO: 593399 - RNA, 19 nt, Homo sapiens
gaugaacucacugacauac

SEQ ID NO: 593400 - RNA, 19 nt, Homo sapiens
ugaagcaccgaggagauaa

SEQ ID NO: 593401 - RNA, 19 nt, Homo sapiens
gacacuauaagauggugaa

SEQ ID NO: 593402 - RNA, 19 nt, Homo sapiens
caucuguaggacacuauaa

SEQ ID NO: 593403 - RNA, 19 nt, Homo sapiens
cucaaggucugcccuacug

SEQ ID NO: 593404 - RNA, 19 nt, Homo sapiens
ugaggaaaauccccacaga

SEQ ID NO: 593405 - RNA, 19 nt, Homo sapiens
cauguugccguugcuauga

SEQ ID NO: 593406 - RNA, 19 nt, Homo sapiens
gccagaaaaugaccacaau

SEQ ID NO: 593407 - RNA, 19 nt, Homo sapiens
ugucuaccuuaaucaugaa

SEQ ID NO: 593408 - RNA, 19 nt, Homo sapiens
ggugacgacaggcagcaaa

SEQ ID NO: 593409 - RNA, 19 nt, Homo sapiens
gaagucucagugcccuauu

SEQ ID NO: 593410 - RNA, 19 nt, Homo sapiens
cuuccugucuaccuuaauc

SEQ ID NO: 593411 - RNA, 19 nt, Homo sapiens
ccgaggagauaagggcaau

SEQ ID NO: 593412 - RNA, 19 nt, Homo sapiens
agugcuggauggagccuuu

SEQ ID NO: 593413 - RNA, 19 nt, Homo sapiens
caaccacucuucaccaaua

SEQ ID NO: 593414 - RNA, 19 nt, Homo sapiens
acacgaagcugaccaugaa

SEQ ID NO: 593415 - RNA, 19 nt, Homo sapiens
gaaggaggaugccgccuau

SEQ ID NO: 593416 - RNA, 19 nt, Homo sapiens
gcuacuggcuccacuaucu

SEQ ID NO: 593417 - RNA, 19 nt, Homo sapiens
aaacuugugugggugcuuu

SEQ ID NO: 593418 - RNA, 19 nt, Homo sapiens
ggcaaccacucuucaccaa

SEQ ID NO: 593419 - RNA, 19 nt, Homo sapiens
gaguaaggcucaguuucug

SEQ ID NO: 593420 - RNA, 19 nt, Homo sapiens
ucagagguuuaccaagauu

SEQ ID NO: 593421 - RNA, 19 nt, Homo sapiens
ucccuaugcuggcuacuuu

SEQ ID NO: 593422 - RNA, 19 nt, Homo sapiens
guuuguacauugcacagaa

SEQ ID NO: 593423 - RNA, 19 nt, Homo sapiens
guacauugcacagaaacuu

SEQ ID NO: 593424 - RNA, 19 nt, Homo sapiens
gggcuuggaucaguaaguc

SEQ ID NO: 593425 - RNA, 19 nt, Homo sapiens
ugacugggaugaagaucuc

SEQ ID NO: 593426 - RNA, 19 nt, Homo sapiens
gaacaccaccugcgcuacu

SEQ ID NO: 593427 - RNA, 19 nt, Homo sapiens
ggaggugucucggcaacca

SEQ ID NO: 593428 - RNA, 19 nt, Homo sapiens
gaacccaggcgugcucaug

SEQ ID NO: 593429 - RNA, 19 nt, Homo sapiens
caauaucacaguggacauu

SEQ ID NO: 593430 - RNA, 19 nt, Homo sapiens
uggaugaccgcaaccuaua

SEQ ID NO: 593431 - RNA, 19 nt, Homo sapiens
uaacgugggcuuccuagag

SEQ ID NO: 593432 - RNA, 19 nt, Homo sapiens
cggcuuguguuuguacauu

SEQ ID NO: 593433 - RNA, 19 nt, Homo sapiens
uagcuacaccuggaaguuu

SEQ ID NO: 593434 - RNA, 19 nt, Homo sapiens
uugugugggugcuuuagua

SEQ ID NO: 593435 - RNA, 19 nt, Homo sapiens
acaagcauaacgaaccuaa

SEQ ID NO: 593436 - RNA, 19 nt, Homo sapiens
gaucucacgcccagacauc

SEQ ID NO: 593437 - RNA, 19 nt, Homo sapiens
cgacaagcauaacgaaccu

SEQ ID NO: 593438 - RNA, 19 nt, Homo sapiens
ggaagggugggagguaugu

SEQ ID NO: 593439 - RNA, 19 nt, Homo sapiens
ugggcaggcucuucaagug

SEQ ID NO: 593440 - RNA, 19 nt, Homo sapiens
gcacgaccgcgacaagcau

SEQ ID NO: 593441 - RNA, 19 nt, Homo sapiens
ggccgucauccucuacuuu

SEQ ID NO: 593442 - RNA, 19 nt, Homo sapiens
ccacucuucaccaauauca

SEQ ID NO: 593443 - RNA, 19 nt, Homo sapiens
gccgucauccucuacuuug

SEQ ID NO: 593444 - RNA, 19 nt, Homo sapiens
gggcaggcucuucaagugu

SEQ ID NO: 593445 - RNA, 19 nt, Homo sapiens
uuccaagggucuucacuag

SEQ ID NO: 593446 - RNA, 19 nt, Homo sapiens
ucaauggcuuccccaauga

SEQ ID NO: 593447 - RNA, 19 nt, Homo sapiens
aggaggaugccgccuauga

SEQ ID NO: 593448 - RNA, 19 nt, Homo sapiens
ggcuuguguuuguacauug

SEQ ID NO: 593449 - RNA, 19 nt, Homo sapiens
gcaaccacucuucaccaau

SEQ ID NO: 593450 - RNA, 19 nt, Homo sapiens
gcgcuacuggcuccacuau

SEQ ID NO: 593451 - RNA, 19 nt, Homo sapiens
gcuaccgcaugaucaagca

SEQ ID NO: 593452 - RNA, 19 nt, Homo sapiens
gacugagacugggcucugu

SEQ ID NO: 593453 - RNA, 19 nt, Homo sapiens
gacgguggcggucaucauc

SEQ ID NO: 593454 - RNA, 19 nt, Homo sapiens
gaggaugccgccuaugacu

SEQ ID NO: 593455 - RNA, 19 nt, Homo sapiens
gcgucuaugucaucaacca

SEQ ID NO: 593456 - RNA, 19 nt, Homo sapiens
gcgcuacggcgucuauguc

SEQ ID NO: 593457 - RNA, 19 nt, Homo sapiens
cuacuggcuccacuaucua

SEQ ID NO: 593458 - RNA, 19 nt, Homo sapiens
caaccacucuucaccaaua

SEQ ID NO: 593459 - RNA, 19 nt, Homo sapiens
acacgaagcugaccaugaa

SEQ ID NO: 593460 - RNA, 19 nt, Homo sapiens
gaaggaggaugccgccuau

SEQ ID NO: 593461 - RNA, 19 nt, Homo sapiens
gcuacuggcuccacuaucu

SEQ ID NO: 593462 - RNA, 19 nt, Homo sapiens
aaacuugugugggugcuuu

SEQ ID NO: 593463 - RNA, 19 nt, Homo sapiens
ggcaaccacucuucaccaa

SEQ ID NO: 593464 - RNA, 19 nt, Homo sapiens
gaguaaggcucaguuucug

SEQ ID NO: 593465 - RNA, 19 nt, Homo sapiens
ucagagguuuaccaagauu

SEQ ID NO: 593466 - RNA, 19 nt, Homo sapiens
ucccuaugcuggcuacuuu

SEQ ID NO: 593467 - RNA, 19 nt, Homo sapiens
guuuguacauugcacagaa

SEQ ID NO: 593468 - RNA, 19 nt, Homo sapiens
guacauugcacagaaacuu

SEQ ID NO: 593469 - RNA, 19 nt, Homo sapiens
gggcuuggaucaguaaguc

SEQ ID NO: 593470 - RNA, 19 nt, Homo sapiens
ugacugggaugaagaucuc

SEQ ID NO: 593471 - RNA, 19 nt, Homo sapiens
gaacaccaccugcgcuacu

SEQ ID NO: 593472 - RNA, 19 nt, Homo sapiens
ggaggugucucggcaacca

SEQ ID NO: 593473 - RNA, 19 nt, Homo sapiens
gaacccaggcgugcucaug

SEQ ID NO: 593474 - RNA, 19 nt, Homo sapiens
caauaucacaguggacauu

SEQ ID NO: 593475 - RNA, 19 nt, Homo sapiens
uggaugaccgcaaccuaua

SEQ ID NO: 593476 - RNA, 19 nt, Homo sapiens
uaacgugggcuuccuagag

SEQ ID NO: 593477 - RNA, 19 nt, Homo sapiens
cggcuuguguuuguacauu

SEQ ID NO: 593478 - RNA, 19 nt, Homo sapiens
uagcuacaccuggaaguuu

SEQ ID NO: 593479 - RNA, 19 nt, Homo sapiens
uugugugggugcuuuagua

SEQ ID NO: 593480 - RNA, 19 nt, Homo sapiens
acaagcauaacgaaccuaa

SEQ ID NO: 593481 - RNA, 19 nt, Homo sapiens
gaucucacgcccagacauc

SEQ ID NO: 593482 - RNA, 19 nt, Homo sapiens
cgacaagcauaacgaaccu

SEQ ID NO: 593483 - RNA, 19 nt, Homo sapiens
ggaagggugggagguaugu

SEQ ID NO: 593484 - RNA, 19 nt, Homo sapiens
ugggcaggcucuucaagug

SEQ ID NO: 593485 - RNA, 19 nt, Homo sapiens
gcacgaccgcgacaagcau

SEQ ID NO: 593486 - RNA, 19 nt, Homo sapiens
ggccgucauccucuacuuu

SEQ ID NO: 593487 - RNA, 19 nt, Homo sapiens
ccacucuucaccaauauca

SEQ ID NO: 593488 - RNA, 19 nt, Homo sapiens
gccgucauccucuacuuug

SEQ ID NO: 593489 - RNA, 19 nt, Homo sapiens
gggcaggcucuucaagugu

SEQ ID NO: 593490 - RNA, 19 nt, Homo sapiens
uuccaagggucuucacuag

SEQ ID NO: 593491 - RNA, 19 nt, Homo sapiens
ucaauggcuuccccaauga

SEQ ID NO: 593492 - RNA, 19 nt, Homo sapiens
aggaggaugccgccuauga

SEQ ID NO: 593493 - RNA, 19 nt, Homo sapiens
ggcuuguguuuguacauug

SEQ ID NO: 593494 - RNA, 19 nt, Homo sapiens
gcaaccacucuucaccaau

SEQ ID NO: 593495 - RNA, 19 nt, Homo sapiens
gcgcuacuggcuccacuau

SEQ ID NO: 593496 - RNA, 19 nt, Homo sapiens
gcuaccgcaugaucaagca

SEQ ID NO: 593497 - RNA, 19 nt, Homo sapiens
gacugagacugggcucugu

SEQ ID NO: 593498 - RNA, 19 nt, Homo sapiens
gacgguggcggucaucauc

SEQ ID NO: 593499 - RNA, 19 nt, Homo sapiens
gaggaugccgccuaugacu

SEQ ID NO: 593500 - RNA, 19 nt, Homo sapiens
gcgucuaugucaucaacca

SEQ ID NO: 593501 - RNA, 19 nt, Homo sapiens
gcgcuacggcgucuauguc

SEQ ID NO: 593502 - RNA, 19 nt, Homo sapiens
cuacuggcuccacuaucua

SEQ ID NO: 593503 - RNA, 19 nt, Homo sapiens
cagcugaucuguuuccuua

SEQ ID NO: 593504 - RNA, 19 nt, Homo sapiens
caacgucccugaacuggua

SEQ ID NO: 593505 - RNA, 19 nt, Homo sapiens
aaacuugucuccacuuaaa

SEQ ID NO: 593506 - RNA, 19 nt, Homo sapiens
gcugaucuguuuccuuaua

SEQ ID NO: 593507 - RNA, 19 nt, Homo sapiens
gugucaagcuccucaauaa

SEQ ID NO: 593508 - RNA, 19 nt, Homo sapiens
gagagaggcugagcaggaa

SEQ ID NO: 593509 - RNA, 19 nt, Homo sapiens
gaacugggcugagaaacac

SEQ ID NO: 593510 - RNA, 19 nt, Homo sapiens
ggcugcagcugaucuguuu

SEQ ID NO: 593511 - RNA, 19 nt, Homo sapiens
gacggacgaugauguguau

SEQ ID NO: 593512 - RNA, 19 nt, Homo sapiens
gauccucagucucacuaaa

SEQ ID NO: 593513 - RNA, 19 nt, Homo sapiens
gggcugaacugggcugaga

SEQ ID NO: 593514 - RNA, 19 nt, Homo sapiens
auaaacuugucuccacuua

SEQ ID NO: 593515 - RNA, 19 nt, Homo sapiens
gcaggaaggaggccagguu

SEQ ID NO: 593516 - RNA, 19 nt, Homo sapiens
ggugucaagcuccucaaua

SEQ ID NO: 593517 - RNA, 19 nt, Homo sapiens
ggacgaugauguguauguc

SEQ ID NO: 593518 - RNA, 19 nt, Homo sapiens
gcaggcaccgcguaucaga

SEQ ID NO: 593519 - RNA, 19 nt, Homo sapiens
uaccagauccucagucuca

SEQ ID NO: 593520 - RNA, 19 nt, Homo sapiens
ucuccgcccuucgcucuua

SEQ ID NO: 593521 - RNA, 19 nt, Homo sapiens
ggaacaggaccuucucucu

SEQ ID NO: 593522 - RNA, 19 nt, Homo sapiens
cccauuagaggaugucuuu

SEQ ID NO: 593523 - RNA, 19 nt, Homo sapiens
gcacggaaccccagagaga

SEQ ID NO: 593524 - RNA, 19 nt, Homo sapiens
caguuguucucucaagcua

SEQ ID NO: 593525 - RNA, 19 nt, Homo sapiens
gugcugcuaugggaaauuc

SEQ ID NO: 593526 - RNA, 19 nt, Homo sapiens
caagacggacgaugaugug

SEQ ID NO: 593527 - RNA, 19 nt, Homo sapiens
gguacagacgcuauucuug

SEQ ID NO: 593528 - RNA, 19 nt, Homo sapiens
uaaacuugucuccacuuaa

SEQ ID NO: 593529 - RNA, 19 nt, Homo sapiens
ucaagcuccucaauaaacu

SEQ ID NO: 593530 - RNA, 19 nt, Homo sapiens
ccugcggugucgagcaaua

SEQ ID NO: 593531 - RNA, 19 nt, Homo sapiens
cuagaccggugcugcuaug

SEQ ID NO: 593532 - RNA, 19 nt, Homo sapiens
gaaccagagaaacgccauu

SEQ ID NO: 593533 - RNA, 19 nt, Homo sapiens
cuagaauagucuuaagucu

SEQ ID NO: 593534 - RNA, 19 nt, Homo sapiens
gcugaacugggcugagaaa

SEQ ID NO: 593535 - RNA, 19 nt, Homo sapiens
uauaccagauccucagucu

SEQ ID NO: 593536 - RNA, 19 nt, Homo sapiens
cauuagaggaugucuuugu

SEQ ID NO: 593537 - RNA, 19 nt, Homo sapiens
caggaaggaggccagguuu

SEQ ID NO: 593538 - RNA, 19 nt, Homo sapiens
agacggacgaugaugugua

SEQ ID NO: 593539 - RNA, 19 nt, Homo sapiens
acgaugauguguaugucaa

SEQ ID NO: 593540 - RNA, 19 nt, Homo sapiens
ggaaggaggccagguuuug

SEQ ID NO: 593541 - RNA, 19 nt, Homo sapiens
ucaagacggacgaugaugu

SEQ ID NO: 593542 - RNA, 19 nt, Homo sapiens
ugaacugggcugagaaaca

SEQ ID NO: 593543 - RNA, 19 nt, Homo sapiens
uaccgcaaccucacccuaa

SEQ ID NO: 593544 - RNA, 19 nt, Homo sapiens
gguaucagagcuggucuug

SEQ ID NO: 593545 - RNA, 19 nt, Homo sapiens
ggguacagacgcuauucuu

SEQ ID NO: 593546 - RNA, 19 nt, Homo sapiens
gucaagcuccucaauaaac

SEQ ID NO: 593547 - RNA, 19 nt, Homo sapiens
cagaagagggugucaagcu

SEQ ID NO: 593548 - RNA, 19 nt, Homo sapiens
ccaugcagcucaggcucuu

SEQ ID NO: 593549 - RNA, 19 nt, Homo sapiens
ugucaagcuccucaauaaa

SEQ ID NO: 593550 - RNA, 19 nt, Homo sapiens
cagauccucagucucacua

SEQ ID NO: 593551 - RNA, 19 nt, Homo sapiens
gggcaccccuucucccauu

SEQ ID NO: 593552 - RNA, 19 nt, Homo sapiens
ggagaaccugaaccagaga

SEQ ID NO: 593553 - RNA, 19 nt, Homo sapiens
ccgcuuugcugcuggugau

SEQ ID NO: 593554 - RNA, 19 nt, Homo sapiens
gcuccucaauaaacuuguc

SEQ ID NO: 593555 - RNA, 19 nt, Homo sapiens
auuagaggaugucuuugug

SEQ ID NO: 593556 - RNA, 19 nt, Homo sapiens
gagaaccugaaccagagaa

SEQ ID NO: 593557 - RNA, 19 nt, Homo sapiens
guagucagcucuuguaaua

SEQ ID NO: 593558 - RNA, 19 nt, Homo sapiens
gauccaaguugcauuauua

SEQ ID NO: 593559 - RNA, 19 nt, Homo sapiens
gauaugagguucuuacauu

SEQ ID NO: 593560 - RNA, 19 nt, Homo sapiens
ccaaggagaucaucacuuu

SEQ ID NO: 593561 - RNA, 19 nt, Homo sapiens
caucaauacuggcaauuua

SEQ ID NO: 593562 - RNA, 19 nt, Homo sapiens
gaugauauguggaggaauu

SEQ ID NO: 593563 - RNA, 19 nt, Homo sapiens
ugaaagcccuaauauguaa

SEQ ID NO: 593564 - RNA, 19 nt, Homo sapiens
gaugaaagcccuaauaugu

SEQ ID NO: 593565 - RNA, 19 nt, Homo sapiens
gaagauccaaguugcauua

SEQ ID NO: 593566 - RNA, 19 nt, Homo sapiens
ggguuacacuugugauuua

SEQ ID NO: 593567 - RNA, 19 nt, Homo sapiens
gaacauucauauuccagaa

SEQ ID NO: 593568 - RNA, 19 nt, Homo sapiens
ggaauaauguagaaugcaa

SEQ ID NO: 593569 - RNA, 19 nt, Homo sapiens
gaaaugaugggucacguaa

SEQ ID NO: 593570 - RNA, 19 nt, Homo sapiens
ccaaggaucuaugaaauga

SEQ ID NO: 593571 - RNA, 19 nt, Homo sapiens
gcucagaccuaauccaguu

SEQ ID NO: 593572 - RNA, 19 nt, Homo sapiens
ucauagacguggugauaua

SEQ ID NO: 593573 - RNA, 19 nt, Homo sapiens
gagaagaauuaaagcaaga

SEQ ID NO: 593574 - RNA, 19 nt, Homo sapiens
ucaaacugcucucaucaaa

SEQ ID NO: 593575 - RNA, 19 nt, Homo sapiens
auacaucacuccauuaaug

SEQ ID NO: 593576 - RNA, 19 nt, Homo sapiens
caagaugaaagcccuaaua

SEQ ID NO: 593577 - RNA, 19 nt, Homo sapiens
guaaagucauaggucauua

SEQ ID NO: 593578 - RNA, 19 nt, Homo sapiens
gaacaccacaugccauuau

SEQ ID NO: 593579 - RNA, 19 nt, Homo sapiens
gcauaucaguaaucucuug

SEQ ID NO: 593580 - RNA, 19 nt, Homo sapiens
gaaaagcuaucaaggaaga

SEQ ID NO: 593581 - RNA, 19 nt, Homo sapiens
gaaaaucuauugccucaug

SEQ ID NO: 593582 - RNA, 19 nt, Homo sapiens
ucacugaaguuauacugaa

SEQ ID NO: 593583 - RNA, 19 nt, Homo sapiens
gcaauuuagugaaguaucu

SEQ ID NO: 593584 - RNA, 19 nt, Homo sapiens
auaauaaccugaccuugaa

SEQ ID NO: 593585 - RNA, 19 nt, Homo sapiens
ucaguaaucucuuggacuu

SEQ ID NO: 593586 - RNA, 19 nt, Homo sapiens
gaagacagacacugauguu

SEQ ID NO: 593587 - RNA, 19 nt, Homo sapiens
gucauagccuagugcauua

SEQ ID NO: 593588 - RNA, 19 nt, Homo sapiens
ggaaagagaagagugaaga

SEQ ID NO: 593589 - RNA, 19 nt, Homo sapiens
agacaagacuuucacuuca

SEQ ID NO: 593590 - RNA, 19 nt, Homo sapiens
cagaguaguucacaacaga

SEQ ID NO: 593591 - RNA, 19 nt, Homo sapiens
ggaagaaauugccaaacca

SEQ ID NO: 593592 - RNA, 19 nt, Homo sapiens
ccucaugggcagaauauua

SEQ ID NO: 593593 - RNA, 19 nt, Homo sapiens
ggacaugucauucuguaga

SEQ ID NO: 593594 - RNA, 19 nt, Homo sapiens
uauaauaaccugaccuuga

SEQ ID NO: 593595 - RNA, 19 nt, Homo sapiens
gcccuaauauguaaaguca

SEQ ID NO: 593596 - RNA, 19 nt, Homo sapiens
gcaguggguuggguuauau

SEQ ID NO: 593597 - RNA, 19 nt, Homo sapiens
gaugaacaccuucuuuaug

SEQ ID NO: 593598 - RNA, 19 nt, Homo sapiens
gcagaagauuacaguuaug

SEQ ID NO: 593599 - RNA, 19 nt, Homo sapiens
gguuagauuugacugguuu

SEQ ID NO: 593600 - RNA, 19 nt, Homo sapiens
guuaaucuccauccauaua

SEQ ID NO: 593601 - RNA, 19 nt, Homo sapiens
caacugagacgugugauug

SEQ ID NO: 593602 - RNA, 19 nt, Homo sapiens
ugaacuggauguacuucua

SEQ ID NO: 593603 - RNA, 19 nt, Homo sapiens
gaacugaaacucaugaaaa

SEQ ID NO: 593604 - RNA, 19 nt, Homo sapiens
gggaaaagcuaucaaggaa

SEQ ID NO: 593605 - RNA, 19 nt, Homo sapiens
uguagucacuugaagguuu

SEQ ID NO: 593606 - RNA, 19 nt, Homo sapiens
ccacuacaaugugauagaa

SEQ ID NO: 593607 - RNA, 19 nt, Homo sapiens
cauaggucauuauugcaua

SEQ ID NO: 593608 - RNA, 19 nt, Homo sapiens
gaacaauguagucacuuga

SEQ ID NO: 593609 - RNA, 19 nt, Homo sapiens
ggaugucugucaacugaga

SEQ ID NO: 593610 - RNA, 19 nt, Homo sapiens
gucgggaucuguuugaauu

SEQ ID NO: 593611 - RNA, 19 nt, Homo sapiens
ucaguuauguacaguaugu

SEQ ID NO: 593612 - RNA, 19 nt, Homo sapiens
guacagcacauucaguuau

SEQ ID NO: 593613 - RNA, 19 nt, Homo sapiens
ggagauugccugcguuuag

SEQ ID NO: 593614 - RNA, 19 nt, Homo sapiens
cgggaucuguuugaauuua

SEQ ID NO: 593615 - RNA, 19 nt, Homo sapiens
cagguuauccucuaauuga

SEQ ID NO: 593616 - RNA, 19 nt, Homo sapiens
uaagacagauggugguagu

SEQ ID NO: 593617 - RNA, 19 nt, Homo sapiens
guguauaucuuauguggau

SEQ ID NO: 593618 - RNA, 19 nt, Homo sapiens
ugaacaauguagucacuug

SEQ ID NO: 593619 - RNA, 19 nt, Homo sapiens
ggaugaacaccuucuuuau

SEQ ID NO: 593620 - RNA, 19 nt, Homo sapiens
gaacuggauguacuucuau

SEQ ID NO: 593621 - RNA, 19 nt, Homo sapiens
gaucuaugcccuuguuaau

SEQ ID NO: 593622 - RNA, 19 nt, Homo sapiens
aaaggguguuacugaguua

SEQ ID NO: 593623 - RNA, 19 nt, Homo sapiens
gaaccucaugggcagaaua

SEQ ID NO: 593624 - RNA, 19 nt, Homo sapiens
gaagggagagaaccucaug

SEQ ID NO: 593625 - RNA, 19 nt, Homo sapiens
gugguaauauagagaagaa

SEQ ID NO: 593626 - RNA, 19 nt, Homo sapiens
caauaaaugacaccgguuu

SEQ ID NO: 593627 - RNA, 19 nt, Homo sapiens
aaucugaaguauugucuug

SEQ ID NO: 593628 - RNA, 19 nt, Homo sapiens
gcaagaaaaucugaaguau

SEQ ID NO: 593629 - RNA, 19 nt, Homo sapiens
uagaaggacaggauacuuu

SEQ ID NO: 593630 - RNA, 19 nt, Homo sapiens
ggacccgguugaccuguug

SEQ ID NO: 593631 - RNA, 19 nt, Homo sapiens
gucaggaaauauaaacuug

SEQ ID NO: 593632 - RNA, 19 nt, Homo sapiens
ucaagguguucccuccaua

SEQ ID NO: 593633 - RNA, 19 nt, Homo sapiens
gaggaugaacaccuucuuu

SEQ ID NO: 593634 - RNA, 19 nt, Homo sapiens
ucuauugccucaugauguu

SEQ ID NO: 593635 - RNA, 19 nt, Homo sapiens
gacagauggugguaguuau

SEQ ID NO: 593636 - RNA, 19 nt, Homo sapiens
agacagauggugguaguua

SEQ ID NO: 593637 - RNA, 19 nt, Homo sapiens
gaccuaauccaguuauaau

SEQ ID NO: 593638 - RNA, 19 nt, Homo sapiens
ccaagaggcugaaaaggaa

SEQ ID NO: 593639 - RNA, 19 nt, Homo sapiens
gacuuucacuucacacuuc

SEQ ID NO: 593640 - RNA, 19 nt, Homo sapiens
gcuuuaauuucaucuggaa

SEQ ID NO: 593641 - RNA, 19 nt, Homo sapiens
ggguguuacugaguuauaa

SEQ ID NO: 593642 - RNA, 19 nt, Homo sapiens
acacugaacugaaacucau

SEQ ID NO: 593643 - RNA, 19 nt, Homo sapiens
ggcuuacacugaacugaaa

SEQ ID NO: 593644 - RNA, 19 nt, Homo sapiens
gacaggauacuuuguggaa

SEQ ID NO: 593645 - RNA, 19 nt, Homo sapiens
auacaauaguggucccaua

SEQ ID NO: 593646 - RNA, 19 nt, Homo sapiens
ugcagaagauuacaguuau

SEQ ID NO: 593647 - RNA, 19 nt, Homo sapiens
gaaugcaaggcaguaauuu

SEQ ID NO: 593648 - RNA, 19 nt, Homo sapiens
gauauguggaggaauuaaa

SEQ ID NO: 593649 - RNA, 19 nt, Homo sapiens
gguguaaacaaaccuacua

SEQ ID NO: 593650 - RNA, 19 nt, Homo sapiens
auaacaaggugaugucugu

SEQ ID NO: 593651 - RNA, 19 nt, Homo sapiens
uuauuaaucugcccugugu

SEQ ID NO: 593652 - RNA, 19 nt, Homo sapiens
gaaagagaagagugaagau

SEQ ID NO: 593653 - RNA, 19 nt, Homo sapiens
gaaauuaauaggaccaaac

SEQ ID NO: 593654 - RNA, 19 nt, Homo sapiens
cacaugccauuauuaacuu

SEQ ID NO: 593655 - RNA, 19 nt, Homo sapiens
caccacaugccauuauuaa

SEQ ID NO: 593656 - RNA, 19 nt, Homo sapiens
uauaauguccagagauuug

SEQ ID NO: 593657 - RNA, 19 nt, Homo sapiens
gauaugagguucuuacauu

SEQ ID NO: 593658 - RNA, 19 nt, Homo sapiens
ccaaggagaucaucacuuu

SEQ ID NO: 593659 - RNA, 19 nt, Homo sapiens
caucaauacuggcaauuua

SEQ ID NO: 593660 - RNA, 19 nt, Homo sapiens
gaugauauguggaggaauu

SEQ ID NO: 593661 - RNA, 19 nt, Homo sapiens
ggguuacacuugugauuua

SEQ ID NO: 593662 - RNA, 19 nt, Homo sapiens
gaacauucauauuccagaa

SEQ ID NO: 593663 - RNA, 19 nt, Homo sapiens
gaaaugaugggucacguaa

SEQ ID NO: 593664 - RNA, 19 nt, Homo sapiens
ccaaggaucuaugaaauga

SEQ ID NO: 593665 - RNA, 19 nt, Homo sapiens
gagaagaauuaaagcaaga

SEQ ID NO: 593666 - RNA, 19 nt, Homo sapiens
ucaaacugcucucaucaaa

SEQ ID NO: 593667 - RNA, 19 nt, Homo sapiens
auacaucacuccauuaaug

SEQ ID NO: 593668 - RNA, 19 nt, Homo sapiens
guaaagucauaggucauua

SEQ ID NO: 593669 - RNA, 19 nt, Homo sapiens
ucaagauguugcaguauuu

SEQ ID NO: 593670 - RNA, 19 nt, Homo sapiens
gaacaccacaugccauuau

SEQ ID NO: 593671 - RNA, 19 nt, Homo sapiens
gcauaucaguaaucucuug

SEQ ID NO: 593672 - RNA, 19 nt, Homo sapiens
gaaaagcuaucaaggaaga

SEQ ID NO: 593673 - RNA, 19 nt, Homo sapiens
ucacugaaguuauacugaa

SEQ ID NO: 593674 - RNA, 19 nt, Homo sapiens
gcaauuuagugaaguaucu

SEQ ID NO: 593675 - RNA, 19 nt, Homo sapiens
auaauaaccugaccuugaa

SEQ ID NO: 593676 - RNA, 19 nt, Homo sapiens
ucaguaaucucuuggacuu

SEQ ID NO: 593677 - RNA, 19 nt, Homo sapiens
gaagacagacacugauguu

SEQ ID NO: 593678 - RNA, 19 nt, Homo sapiens
agacaagacuuucacuuca

SEQ ID NO: 593679 - RNA, 19 nt, Homo sapiens
cagaguaguucacaacaga

SEQ ID NO: 593680 - RNA, 19 nt, Homo sapiens
ggaagaaauugccaaacca

SEQ ID NO: 593681 - RNA, 19 nt, Homo sapiens
ggacaugucauucuguaga

SEQ ID NO: 593682 - RNA, 19 nt, Homo sapiens
uauaauaaccugaccuuga

SEQ ID NO: 593683 - RNA, 19 nt, Homo sapiens
gcaguggguuggguuauau

SEQ ID NO: 593684 - RNA, 19 nt, Homo sapiens
gaugaacaccuucuuuaug

SEQ ID NO: 593685 - RNA, 19 nt, Homo sapiens
caacugagacgugugauug

SEQ ID NO: 593686 - RNA, 19 nt, Homo sapiens
ugaacuggauguacuucua

SEQ ID NO: 593687 - RNA, 19 nt, Homo sapiens
gaacugaaacucaugaaaa

SEQ ID NO: 593688 - RNA, 19 nt, Homo sapiens
uguagucacuugaagguuu

SEQ ID NO: 593689 - RNA, 19 nt, Homo sapiens
gggaaaagcuaucaaggaa

SEQ ID NO: 593690 - RNA, 19 nt, Homo sapiens
ccacuacaaugugauagaa

SEQ ID NO: 593691 - RNA, 19 nt, Homo sapiens
cauaggucauuauugcaua

SEQ ID NO: 593692 - RNA, 19 nt, Homo sapiens
gaacaauguagucacuuga

SEQ ID NO: 593693 - RNA, 19 nt, Homo sapiens
ggaugucugucaacugaga

SEQ ID NO: 593694 - RNA, 19 nt, Homo sapiens
gucgggaucuguuugaauu

SEQ ID NO: 593695 - RNA, 19 nt, Homo sapiens
cgggaucuguuugaauuua

SEQ ID NO: 593696 - RNA, 19 nt, Homo sapiens
ggagauugccugcguuuag

SEQ ID NO: 593697 - RNA, 19 nt, Homo sapiens
cagguuauccucuaauuga

SEQ ID NO: 593698 - RNA, 19 nt, Homo sapiens
guguauaucuuauguggau

SEQ ID NO: 593699 - RNA, 19 nt, Homo sapiens
ugaacaauguagucacuug

SEQ ID NO: 593700 - RNA, 19 nt, Homo sapiens
ggaugaacaccuucuuuau

SEQ ID NO: 593701 - RNA, 19 nt, Homo sapiens
gaacuggauguacuucuau

SEQ ID NO: 593702 - RNA, 19 nt, Homo sapiens
aaaggguguuacugaguua

SEQ ID NO: 593703 - RNA, 19 nt, Homo sapiens
gugguaauauagagaagaa

SEQ ID NO: 593704 - RNA, 19 nt, Homo sapiens
uagaaggacaggauacuuu

SEQ ID NO: 593705 - RNA, 19 nt, Homo sapiens
ggacccgguugaccuguug

SEQ ID NO: 593706 - RNA, 19 nt, Homo sapiens
ucaagguguucccuccaua

SEQ ID NO: 593707 - RNA, 19 nt, Homo sapiens
gaggaugaacaccuucuuu

SEQ ID NO: 593708 - RNA, 19 nt, Homo sapiens
ccaagaggcugaaaaggaa

SEQ ID NO: 593709 - RNA, 19 nt, Homo sapiens
gacuuucacuucacacuuc

SEQ ID NO: 593710 - RNA, 19 nt, Homo sapiens
ggguguuacugaguuauaa

SEQ ID NO: 593711 - RNA, 19 nt, Homo sapiens
acacugaacugaaacucau

SEQ ID NO: 593712 - RNA, 19 nt, Homo sapiens
ggcuuacacugaacugaaa

SEQ ID NO: 593713 - RNA, 19 nt, Homo sapiens
gacaggauacuuuguggaa

SEQ ID NO: 593714 - RNA, 19 nt, Homo sapiens
gcuuuaauuucaucuggaa

SEQ ID NO: 593715 - RNA, 19 nt, Homo sapiens
gauauguggaggaauuaaa

SEQ ID NO: 593716 - RNA, 19 nt, Homo sapiens
caaggaagaaauugccaaa

SEQ ID NO: 593717 - RNA, 19 nt, Homo sapiens
gaaauuaauaggaccaaac

SEQ ID NO: 593718 - RNA, 19 nt, Homo sapiens
cacaugccauuauuaacuu

SEQ ID NO: 593719 - RNA, 19 nt, Homo sapiens
caccacaugccauuauuaa

SEQ ID NO: 593720 - RNA, 19 nt, Homo sapiens
uauaauguccagagauuug

SEQ ID NO: 593721 - RNA, 19 nt, Homo sapiens
uggguuggguuauauaaug

SEQ ID NO: 593722 - RNA, 19 nt, Homo sapiens
cuucugagcugcuguggau

SEQ ID NO: 593723 - RNA, 19 nt, Homo sapiens
uaucuuauguggauuacca

SEQ ID NO: 593724 - RNA, 19 nt, Homo sapiens
uaagcucacuaggcuguaa

SEQ ID NO: 593725 - RNA, 19 nt, Homo sapiens
uaaaggaauuggagguuuu

SEQ ID NO: 593726 - RNA, 19 nt, Homo sapiens
acuggagacuggaggguua

SEQ ID NO: 593727 - RNA, 19 nt, Homo sapiens
uaaugaagacagacacuga

SEQ ID NO: 593728 - RNA, 19 nt, Homo sapiens
aaacugcucucaucaaaau

SEQ ID NO: 593729 - RNA, 19 nt, Homo sapiens
auaaaggaauuggagguuu

SEQ ID NO: 593730 - RNA, 19 nt, Homo sapiens
ggaacaccacaugccauua

SEQ ID NO: 593731 - RNA, 19 nt, Homo sapiens
gaagaaauugccaaaccau

SEQ ID NO: 593732 - RNA, 19 nt, Homo sapiens
uuggaugucugucaacuga

SEQ ID NO: 593733 - RNA, 19 nt, Homo sapiens
gggaucuguuugaauuuau

SEQ ID NO: 593734 - RNA, 19 nt, Homo sapiens
aaggaucuaugaaaugaug

SEQ ID NO: 593735 - RNA, 19 nt, Homo sapiens
cacagguuauccucuaauu

SEQ ID NO: 593736 - RNA, 19 nt, Homo sapiens
ccaaguacguaaugaagac

SEQ ID NO: 593737 - RNA, 19 nt, Homo sapiens
agucauaggucauuauugc

SEQ ID NO: 593738 - RNA, 19 nt, Homo sapiens
gaaauugccaaaccauguc

SEQ ID NO: 593739 - RNA, 19 nt, Homo sapiens
ugacauaauccgacaagau

SEQ ID NO: 593740 - RNA, 19 nt, Homo sapiens
aggaugaacaccuucuuua

SEQ ID NO: 593741 - RNA, 19 nt, Homo sapiens
uugcaguauuucacaguua

SEQ ID NO: 593742 - RNA, 19 nt, Homo sapiens
gucaggcccuucaaagaug

SEQ ID NO: 593743 - RNA, 19 nt, Homo sapiens
ccacaugccauuauuaacu

SEQ ID NO: 593744 - RNA, 19 nt, Homo sapiens
ugccaaggaucuaugaaau

SEQ ID NO: 593745 - RNA, 19 nt, Homo sapiens
guuauauaauguccagaga

SEQ ID NO: 593746 - RNA, 19 nt, Homo sapiens
uuucacagguuauccucua

SEQ ID NO: 593747 - RNA, 19 nt, Homo sapiens
aggcaggccauuagaguua

SEQ ID NO: 593748 - RNA, 19 nt, Homo sapiens
cagacaagacuuucacuuc

SEQ ID NO: 593749 - RNA, 19 nt, Homo sapiens
gagauugccugcguuuagg

SEQ ID NO: 593750 - RNA, 19 nt, Homo sapiens
caucacuccauuaauguaa

SEQ ID NO: 593751 - RNA, 19 nt, Homo sapiens
guuugaagauguuuauguc

SEQ ID NO: 593752 - RNA, 19 nt, Homo sapiens
gcauucagguggguaacug

SEQ ID NO: 593753 - RNA, 19 nt, Homo sapiens
cuccugaguuucuuuguga

SEQ ID NO: 593754 - RNA, 19 nt, Homo sapiens
gaauuccacaguuuucuua

SEQ ID NO: 593755 - RNA, 19 nt, Homo sapiens
ccauuuggaugucugucaa

SEQ ID NO: 593756 - RNA, 19 nt, Homo sapiens
gauuuacagacaagacuuu

SEQ ID NO: 593757 - RNA, 19 nt, Homo sapiens
gauaugagguucuuacauu

SEQ ID NO: 593758 - RNA, 19 nt, Homo sapiens
ccaaggagaucaucacuuu

SEQ ID NO: 593759 - RNA, 19 nt, Homo sapiens
caucaauacuggcaauuua

SEQ ID NO: 593760 - RNA, 19 nt, Homo sapiens
gaugauauguggaggaauu

SEQ ID NO: 593761 - RNA, 19 nt, Homo sapiens
gcacaucaguaaucucuug

SEQ ID NO: 593762 - RNA, 19 nt, Homo sapiens
ggguuacacuugugauuua

SEQ ID NO: 593763 - RNA, 19 nt, Homo sapiens
gaacauucauauuccagaa

SEQ ID NO: 593764 - RNA, 19 nt, Homo sapiens
gaaaugaugggucacguaa

SEQ ID NO: 593765 - RNA, 19 nt, Homo sapiens
ccaaggaucuaugaaauga

SEQ ID NO: 593766 - RNA, 19 nt, Homo sapiens
ucaaacugcucucaucaaa

SEQ ID NO: 593767 - RNA, 19 nt, Homo sapiens
auacaucacuccauuaaug

SEQ ID NO: 593768 - RNA, 19 nt, Homo sapiens
guaaagucauaggucauua

SEQ ID NO: 593769 - RNA, 19 nt, Homo sapiens
ucaagauguugcaguauuu

SEQ ID NO: 593770 - RNA, 19 nt, Homo sapiens
gaacaccacaugccauuau

SEQ ID NO: 593771 - RNA, 19 nt, Homo sapiens
ggguguuacugaauuauaa

SEQ ID NO: 593772 - RNA, 19 nt, Homo sapiens
ucacugaaguuauacugaa

SEQ ID NO: 593773 - RNA, 19 nt, Homo sapiens
gcaauuuagugaaguaucu

SEQ ID NO: 593774 - RNA, 19 nt, Homo sapiens
auaauaaccugaccuugaa

SEQ ID NO: 593775 - RNA, 19 nt, Homo sapiens
ucaguaaucucuuggacuu

SEQ ID NO: 593776 - RNA, 19 nt, Homo sapiens
gaagacagacacugauguu

SEQ ID NO: 593777 - RNA, 19 nt, Homo sapiens
aaaggguguuacugaauua

SEQ ID NO: 593778 - RNA, 19 nt, Homo sapiens
agacaagacuuucacuuca

SEQ ID NO: 593779 - RNA, 19 nt, Homo sapiens
ggacaugucauucuguaga

SEQ ID NO: 593780 - RNA, 19 nt, Homo sapiens
uauaauaaccugaccuuga

SEQ ID NO: 593781 - RNA, 19 nt, Homo sapiens
gcaguggguuggguuauau

SEQ ID NO: 593782 - RNA, 19 nt, Homo sapiens
gaugaacaccuucuuuaug

SEQ ID NO: 593783 - RNA, 19 nt, Homo sapiens
caacugagacgugugauug

SEQ ID NO: 593784 - RNA, 19 nt, Homo sapiens
ugaacuggauguacuucua

SEQ ID NO: 593785 - RNA, 19 nt, Homo sapiens
gaacugaaacucaugaaaa

SEQ ID NO: 593786 - RNA, 19 nt, Homo sapiens
uguagucacuugaagguuu

SEQ ID NO: 593787 - RNA, 19 nt, Homo sapiens
ccacuacaaugugauagaa

SEQ ID NO: 593788 - RNA, 19 nt, Homo sapiens
gaacaauguagucacuuga

SEQ ID NO: 593789 - RNA, 19 nt, Homo sapiens
ggaugucugucaacugaga

SEQ ID NO: 593790 - RNA, 19 nt, Homo sapiens
gucgggaucuguuugaauu

SEQ ID NO: 593791 - RNA, 19 nt, Homo sapiens
cgggaucuguuugaauuua

SEQ ID NO: 593792 - RNA, 19 nt, Homo sapiens
cagguuauccucuaauuga

SEQ ID NO: 593793 - RNA, 19 nt, Homo sapiens
guguauaucuuauguggau

SEQ ID NO: 593794 - RNA, 19 nt, Homo sapiens
ugaacaauguagucacuug

SEQ ID NO: 593795 - RNA, 19 nt, Homo sapiens
ggaugaacaccuucuuuau

SEQ ID NO: 593796 - RNA, 19 nt, Homo sapiens
gaacuggauguacuucuau

SEQ ID NO: 593797 - RNA, 19 nt, Homo sapiens
uuugauaacucuuccagaa

SEQ ID NO: 593798 - RNA, 19 nt, Homo sapiens
gugguaauauagagaagaa

SEQ ID NO: 593799 - RNA, 19 nt, Homo sapiens
uagaaggacaggauacuuu

SEQ ID NO: 593800 - RNA, 19 nt, Homo sapiens
ucaagguguucccuccaua

SEQ ID NO: 593801 - RNA, 19 nt, Homo sapiens
gaggaugaacaccuucuuu

SEQ ID NO: 593802 - RNA, 19 nt, Homo sapiens
ccaagaggcugaaaaggaa

SEQ ID NO: 593803 - RNA, 19 nt, Homo sapiens
gacuuucacuucacacuuc

SEQ ID NO: 593804 - RNA, 19 nt, Homo sapiens
acacugaacugaaacucau

SEQ ID NO: 593805 - RNA, 19 nt, Homo sapiens
ggcuuacacugaacugaaa

SEQ ID NO: 593806 - RNA, 19 nt, Homo sapiens
gacaggauacuuuguggaa

SEQ ID NO: 593807 - RNA, 19 nt, Homo sapiens
gauauguggaggaauuaaa

SEQ ID NO: 593808 - RNA, 19 nt, Homo sapiens
cuucugagcugcuguggau

SEQ ID NO: 593809 - RNA, 19 nt, Homo sapiens
gaaauuaauaggaccaaac

SEQ ID NO: 593810 - RNA, 19 nt, Homo sapiens
cacaugccauuauuaacuu

SEQ ID NO: 593811 - RNA, 19 nt, Homo sapiens
caccacaugccauuauuaa

SEQ ID NO: 593812 - RNA, 19 nt, Homo sapiens
uauaauguccagagauuug

SEQ ID NO: 593813 - RNA, 19 nt, Homo sapiens
uggguuggguuauauaaug

SEQ ID NO: 593814 - RNA, 19 nt, Homo sapiens
uaucuuauguggauuacca

SEQ ID NO: 593815 - RNA, 19 nt, Homo sapiens
uaagcucacuaggcuguaa

SEQ ID NO: 593816 - RNA, 19 nt, Homo sapiens
uaaaggaauuggagguuuu

SEQ ID NO: 593817 - RNA, 19 nt, Homo sapiens
acuggagacuggaggguua

SEQ ID NO: 593818 - RNA, 19 nt, Homo sapiens
uaaugaagacagacacuga

SEQ ID NO: 593819 - RNA, 19 nt, Homo sapiens
aaacugcucucaucaaaau

SEQ ID NO: 593820 - RNA, 19 nt, Homo sapiens
auaaaggaauuggagguuu

SEQ ID NO: 593821 - RNA, 19 nt, Homo sapiens
ggaacaccacaugccauua

SEQ ID NO: 593822 - RNA, 19 nt, Homo sapiens
uuggaugucugucaacuga

SEQ ID NO: 593823 - RNA, 19 nt, Homo sapiens
gggaucuguuugaauuuau

SEQ ID NO: 593824 - RNA, 19 nt, Homo sapiens
aaggaucuaugaaaugaug

SEQ ID NO: 593825 - RNA, 19 nt, Homo sapiens
cacagguuauccucuaauu

SEQ ID NO: 593826 - RNA, 19 nt, Homo sapiens
ccaaguacguaaugaagac

SEQ ID NO: 593827 - RNA, 19 nt, Homo sapiens
agucauaggucauuauugc

SEQ ID NO: 593828 - RNA, 19 nt, Homo sapiens
ugacauaauccgacaagau

SEQ ID NO: 593829 - RNA, 19 nt, Homo sapiens
aggaugaacaccuucuuua

SEQ ID NO: 593830 - RNA, 19 nt, Homo sapiens
uugcaguauuucacaguua

SEQ ID NO: 593831 - RNA, 19 nt, Homo sapiens
gucaggcccuucaaagaug

SEQ ID NO: 593832 - RNA, 19 nt, Homo sapiens
ccacaugccauuauuaacu

SEQ ID NO: 593833 - RNA, 19 nt, Homo sapiens
ugccaaggaucuaugaaau

SEQ ID NO: 593834 - RNA, 19 nt, Homo sapiens
guuauauaauguccagaga

SEQ ID NO: 593835 - RNA, 19 nt, Homo sapiens
uuucacagguuauccucua

SEQ ID NO: 593836 - RNA, 19 nt, Homo sapiens
aggcaggccauuagaguua

SEQ ID NO: 593837 - RNA, 19 nt, Homo sapiens
cauuauugcacaucaguaa

SEQ ID NO: 593838 - RNA, 19 nt, Homo sapiens
cagacaagacuuucacuuc

SEQ ID NO: 593839 - RNA, 19 nt, Homo sapiens
caucacuccauuaauguaa

SEQ ID NO: 593840 - RNA, 19 nt, Homo sapiens
guuugaagauguuuauguc

SEQ ID NO: 593841 - RNA, 19 nt, Homo sapiens
gcauucagguggguaacug

SEQ ID NO: 593842 - RNA, 19 nt, Homo sapiens
cuccugaguuucuuuguga

SEQ ID NO: 593843 - RNA, 19 nt, Homo sapiens
ugaauuauaagcucacuag

SEQ ID NO: 593844 - RNA, 19 nt, Homo sapiens
ccauuuggaugucugucaa

SEQ ID NO: 593845 - RNA, 19 nt, Homo sapiens
gauuuacagacaagacuuu

SEQ ID NO: 593846 - RNA, 19 nt, Homo sapiens
ucucuuggacuuuguuaaa

SEQ ID NO: 593847 - RNA, 19 nt, Homo sapiens
aguaaucucuuggacuuug

SEQ ID NO: 593848 - RNA, 19 nt, Homo sapiens
uucaagauguugcaguauu

SEQ ID NO: 593849 - RNA, 19 nt, Homo sapiens
aaaaggguguuacugaauu

SEQ ID NO: 593850 - RNA, 19 nt, Homo sapiens
aagaugauauguggaggaa

SEQ ID NO: 593851 - RNA, 19 nt, Homo sapiens
augaacaccuucuuuaugg

SEQ ID NO: 593852 - RNA, 19 nt, Homo sapiens
uauauguaguucuguguca

SEQ ID NO: 593853 - RNA, 19 nt, Homo sapiens
acauucauauuccagaaga

SEQ ID NO: 593854 - RNA, 19 nt, Homo sapiens
ugaaaugaugggucacgua

SEQ ID NO: 593855 - RNA, 19 nt, Homo sapiens
aaacccauauuucuuacca

SEQ ID NO: 593856 - RNA, 19 nt, Homo sapiens
cauucaaacugcucucauc

SEQ ID NO: 593857 - RNA, 19 nt, Homo sapiens
gauaugagguucuuacauu

SEQ ID NO: 593858 - RNA, 19 nt, Homo sapiens
ccaaggagaucaucacuuu

SEQ ID NO: 593859 - RNA, 19 nt, Homo sapiens
caucaauacuggcaauuua

SEQ ID NO: 593860 - RNA, 19 nt, Homo sapiens
gaacauucauauuccagaa

SEQ ID NO: 593861 - RNA, 19 nt, Homo sapiens
gaaaugaugggucacguaa

SEQ ID NO: 593862 - RNA, 19 nt, Homo sapiens
ccaaggaucuaugaaauga

SEQ ID NO: 593863 - RNA, 19 nt, Homo sapiens
ucaaacugcucucaucaaa

SEQ ID NO: 593864 - RNA, 19 nt, Homo sapiens
gaacaccacaugccauuau

SEQ ID NO: 593865 - RNA, 19 nt, Homo sapiens
gaaaagcuaucaaggaaga

SEQ ID NO: 593866 - RNA, 19 nt, Homo sapiens
gcaauuuagugaaguaucu

SEQ ID NO: 593867 - RNA, 19 nt, Homo sapiens
auaauaaccugaccuugaa

SEQ ID NO: 593868 - RNA, 19 nt, Homo sapiens
gaagacagacacugauguu

SEQ ID NO: 593869 - RNA, 19 nt, Homo sapiens
agacaagacuuucacuuca

SEQ ID NO: 593870 - RNA, 19 nt, Homo sapiens
cagaguaguucacaacaga

SEQ ID NO: 593871 - RNA, 19 nt, Homo sapiens
ggaagaaauugccaaacca

SEQ ID NO: 593872 - RNA, 19 nt, Homo sapiens
uauaauaaccugaccuuga

SEQ ID NO: 593873 - RNA, 19 nt, Homo sapiens
gcaguggguuggguuauau

SEQ ID NO: 593874 - RNA, 19 nt, Homo sapiens
gaugaacaccuucuuuaug

SEQ ID NO: 593875 - RNA, 19 nt, Homo sapiens
caacugagacgugugauug

SEQ ID NO: 593876 - RNA, 19 nt, Homo sapiens
ugaacuggauguacuucua

SEQ ID NO: 593877 - RNA, 19 nt, Homo sapiens
ccacuacaaugugauagaa

SEQ ID NO: 593878 - RNA, 19 nt, Homo sapiens
gggaaaagcuaucaaggaa

SEQ ID NO: 593879 - RNA, 19 nt, Homo sapiens
ggaugucugucaacugaga

SEQ ID NO: 593880 - RNA, 19 nt, Homo sapiens
gucgggaucuguuugaauu

SEQ ID NO: 593881 - RNA, 19 nt, Homo sapiens
cgggaucuguuugaauuua

SEQ ID NO: 593882 - RNA, 19 nt, Homo sapiens
cagguuauccucuaauuga

SEQ ID NO: 593883 - RNA, 19 nt, Homo sapiens
ggaugaacaccuucuuuau

SEQ ID NO: 593884 - RNA, 19 nt, Homo sapiens
gaacuggauguacuucuau

SEQ ID NO: 593885 - RNA, 19 nt, Homo sapiens
ggacccgguugaccuguug

SEQ ID NO: 593886 - RNA, 19 nt, Homo sapiens
ucaagguguucccuccaua

SEQ ID NO: 593887 - RNA, 19 nt, Homo sapiens
gaggaugaacaccuucuuu

SEQ ID NO: 593888 - RNA, 19 nt, Homo sapiens
ccaagaggcugaaaaggaa

SEQ ID NO: 593889 - RNA, 19 nt, Homo sapiens
gacuuucacuucacacuuc

SEQ ID NO: 593890 - RNA, 19 nt, Homo sapiens
gcuuuaauuucaucuggaa

SEQ ID NO: 593891 - RNA, 19 nt, Homo sapiens
caccacaugccauuauuaa

SEQ ID NO: 593892 - RNA, 19 nt, Homo sapiens
cgggaacgguguuacgauu

SEQ ID NO: 593893 - RNA, 19 nt, Homo sapiens
uauaauguccagagauuug

SEQ ID NO: 593894 - RNA, 19 nt, Homo sapiens
uggguuggguuauauaaug

SEQ ID NO: 593895 - RNA, 19 nt, Homo sapiens
caaggaagaaauugccaaa

SEQ ID NO: 593896 - RNA, 19 nt, Homo sapiens
cuucugagcugcuguggau

SEQ ID NO: 593897 - RNA, 19 nt, Homo sapiens
uaaugaagacagacacuga

SEQ ID NO: 593898 - RNA, 19 nt, Homo sapiens
aaacugcucucaucaaaau

SEQ ID NO: 593899 - RNA, 19 nt, Homo sapiens
ggaacaccacaugccauua

SEQ ID NO: 593900 - RNA, 19 nt, Homo sapiens
uuggaugucugucaacuga

SEQ ID NO: 593901 - RNA, 19 nt, Homo sapiens
gggaucuguuugaauuuau

SEQ ID NO: 593902 - RNA, 19 nt, Homo sapiens
aaggaucuaugaaaugaug

SEQ ID NO: 593903 - RNA, 19 nt, Homo sapiens
cacagguuauccucuaauu

SEQ ID NO: 593904 - RNA, 19 nt, Homo sapiens
ccaaguacguaaugaagac

SEQ ID NO: 593905 - RNA, 19 nt, Homo sapiens
gaagaaauugccaaaccau

SEQ ID NO: 593906 - RNA, 19 nt, Homo sapiens
gaaauugccaaaccauguc

SEQ ID NO: 593907 - RNA, 19 nt, Homo sapiens
ggaacgguguuacgauugc

SEQ ID NO: 593908 - RNA, 19 nt, Homo sapiens
ugacauaauccgacaagau

SEQ ID NO: 593909 - RNA, 19 nt, Homo sapiens
aggaugaacaccuucuuua

SEQ ID NO: 593910 - RNA, 19 nt, Homo sapiens
ugccaaggaucuaugaaau

SEQ ID NO: 593911 - RNA, 19 nt, Homo sapiens
guuauauaauguccagaga

SEQ ID NO: 593912 - RNA, 19 nt, Homo sapiens
uuucacagguuauccucua

SEQ ID NO: 593913 - RNA, 19 nt, Homo sapiens
aggcaggccauuagaguua

SEQ ID NO: 593914 - RNA, 19 nt, Homo sapiens
cagacaagacuuucacuuc

SEQ ID NO: 593915 - RNA, 19 nt, Homo sapiens
guuugaagauguuuauguc

SEQ ID NO: 593916 - RNA, 19 nt, Homo sapiens
gcauucagguggguaacug

SEQ ID NO: 593917 - RNA, 19 nt, Homo sapiens
cuccugaguuucuuuguga

SEQ ID NO: 593918 - RNA, 19 nt, Homo sapiens
ccauuuggaugucugucaa

SEQ ID NO: 593919 - RNA, 19 nt, Homo sapiens
gauuuacagacaagacuuu

SEQ ID NO: 593920 - RNA, 19 nt, Homo sapiens
gaauuccacaguuuucuua

SEQ ID NO: 593921 - RNA, 19 nt, Homo sapiens
augaacaccuucuuuaugg

SEQ ID NO: 593922 - RNA, 19 nt, Homo sapiens
acauucauauuccagaaga

SEQ ID NO: 593923 - RNA, 19 nt, Homo sapiens
ugaaaugaugggucacgua

SEQ ID NO: 593924 - RNA, 19 nt, Homo sapiens
aaacccauauuucuuacca

SEQ ID NO: 593925 - RNA, 19 nt, Homo sapiens
cauucaaacugcucucauc

SEQ ID NO: 593926 - RNA, 19 nt, Homo sapiens
ggguuggguuauauaaugu

SEQ ID NO: 593927 - RNA, 19 nt, Homo sapiens
gacagacacugauguuuuc

SEQ ID NO: 593928 - RNA, 19 nt, Homo sapiens
ccgaguaggaugucacuga

SEQ ID NO: 593929 - RNA, 19 nt, Homo sapiens
acaccacaugccauuauua

SEQ ID NO: 593930 - RNA, 19 nt, Homo sapiens
agaaauugccaaaccaugu

SEQ ID NO: 593931 - RNA, 19 nt, Homo sapiens
gugccaaggaucuaugaaa

SEQ ID NO: 593932 - RNA, 19 nt, Homo sapiens
cuaaaccacucagagaagu

SEQ ID NO: 593933 - RNA, 19 nt, Homo sapiens
gccaaggaucuaugaaaug

SEQ ID NO: 593934 - RNA, 19 nt, Homo sapiens
ugcaguggguuggguuaua

SEQ ID NO: 593935 - RNA, 19 nt, Homo sapiens
cuuagaggaugaacaccuu

SEQ ID NO: 593936 - RNA, 19 nt, Homo sapiens
acaagacuuucacuucaca

SEQ ID NO: 593937 - RNA, 19 nt, Homo sapiens
gacaagacuuucacuucac

SEQ ID NO: 593938 - RNA, 19 nt, Homo sapiens
gagccgauuuacagacaag

SEQ ID NO: 593939 - RNA, 19 nt, Homo sapiens
aaugaugggucacguaaaa

SEQ ID NO: 593940 - RNA, 19 nt, Homo sapiens
cauauaauaaccugaccuu

SEQ ID NO: 593941 - RNA, 19 nt, Homo sapiens
ggcaggucaugcuaaggaa

SEQ ID NO: 593942 - RNA, 19 nt, Homo sapiens
uugcagcggugccgaggaa

SEQ ID NO: 593943 - RNA, 19 nt, Homo sapiens
ggauaugagguucuuacau

SEQ ID NO: 593944 - RNA, 19 nt, Homo sapiens
ucacaacagaucugagugu

SEQ ID NO: 593945 - RNA, 19 nt, Homo sapiens
gggaacgguguuacgauug

SEQ ID NO: 593946 - RNA, 19 nt, Homo sapiens
aguaggaugucacugagau

SEQ ID NO: 593947 - RNA, 19 nt, Homo sapiens
gccaaguacguaaugaaga

SEQ ID NO: 593948 - RNA, 19 nt, Homo sapiens
uagaacgcgugaacuggau

SEQ ID NO: 593949 - RNA, 19 nt, Homo sapiens
guucacaacagaucugagu

SEQ ID NO: 593950 - RNA, 19 nt, Homo sapiens
gaggacgggaacgguguua

SEQ ID NO: 593951 - RNA, 19 nt, Homo sapiens
ucaucaauacuggcaauuu

SEQ ID NO: 593952 - RNA, 19 nt, Homo sapiens
cccgcuggcugcucuauca

SEQ ID NO: 593953 - RNA, 19 nt, Homo sapiens
gaguaugagccgauuuaca

SEQ ID NO: 593954 - RNA, 19 nt, Homo sapiens
uggauguacuucuaugagu

SEQ ID NO: 593955 - RNA, 19 nt, Homo sapiens
ugauagaacgcgugaacug

SEQ ID NO: 593956 - RNA, 19 nt, Homo sapiens
cuauauagaauccauuugg

SEQ ID NO: 593957 - RNA, 19 nt, Homo sapiens
gaaccaaacuccuauuuca

SEQ ID NO: 593958 - RNA, 19 nt, Homo sapiens
gcagacagauggacacuuu

SEQ ID NO: 593959 - RNA, 19 nt, Homo sapiens
gaagagagguaaauccuau

SEQ ID NO: 593960 - RNA, 19 nt, Homo sapiens
gcaacuaacucuaauaaca

SEQ ID NO: 593961 - RNA, 19 nt, Homo sapiens
caacaggaauacuuagaua

SEQ ID NO: 593962 - RNA, 19 nt, Homo sapiens
caaauaggauguacuguug

SEQ ID NO: 593963 - RNA, 19 nt, Homo sapiens
gcauaauccucuucacaua

SEQ ID NO: 593964 - RNA, 19 nt, Homo sapiens
gcaauaagauuuaguugag

SEQ ID NO: 593965 - RNA, 19 nt, Homo sapiens
gcaacauacuguccacaua

SEQ ID NO: 593966 - RNA, 19 nt, Homo sapiens
gaagaaagcagacaauauc

SEQ ID NO: 593967 - RNA, 19 nt, Homo sapiens
guacacaugccaacacuua

SEQ ID NO: 593968 - RNA, 19 nt, Homo sapiens
caauacaacugaagcacua

SEQ ID NO: 593969 - RNA, 19 nt, Homo sapiens
uaacaagcaugcauaaauc

SEQ ID NO: 593970 - RNA, 19 nt, Homo sapiens
caaugugacugaauuagaa

SEQ ID NO: 593971 - RNA, 19 nt, Homo sapiens
gagacaaugugacugaauu

SEQ ID NO: 593972 - RNA, 19 nt, Homo sapiens
aaauacagccaccuaauua

SEQ ID NO: 593973 - RNA, 19 nt, Homo sapiens
aaccguggauuucauauua

SEQ ID NO: 593974 - RNA, 19 nt, Homo sapiens
gcaauaacaagcaugcaua

SEQ ID NO: 593975 - RNA, 19 nt, Homo sapiens
aggcagagcuggauucaaa

SEQ ID NO: 593976 - RNA, 19 nt, Homo sapiens
gagagaauaugaaagaaag

SEQ ID NO: 593977 - RNA, 19 nt, Homo sapiens
gaacuggguugcaacauac

SEQ ID NO: 593978 - RNA, 19 nt, Homo sapiens
uaaauggccugaccaagga

SEQ ID NO: 593979 - RNA, 19 nt, Homo sapiens
gagauucuguguauuaaca

SEQ ID NO: 593980 - RNA, 19 nt, Homo sapiens
ugaacuggguugcaacaua

SEQ ID NO: 593981 - RNA, 19 nt, Homo sapiens
gaggguaacucgaagacaa

SEQ ID NO: 593982 - RNA, 19 nt, Homo sapiens
aaacacaauucuaggauga

SEQ ID NO: 593983 - RNA, 19 nt, Homo sapiens
gcacuuggaagauguauau

SEQ ID NO: 593984 - RNA, 19 nt, Homo sapiens
ggaagaaagcagacaauau

SEQ ID NO: 593985 - RNA, 19 nt, Homo sapiens
gagaagacacugcugcuuu

SEQ ID NO: 593986 - RNA, 19 nt, Homo sapiens
gcaccaccauuuaauuuca

SEQ ID NO: 593987 - RNA, 19 nt, Homo sapiens
ccaaugaguuuguguucaa

SEQ ID NO: 593988 - RNA, 19 nt, Homo sapiens
gaaagcagacaauaucaug

SEQ ID NO: 593989 - RNA, 19 nt, Homo sapiens
ucacuuaaaggcacaaaua

SEQ ID NO: 593990 - RNA, 19 nt, Homo sapiens
gaaaaugauugccaaagaa

SEQ ID NO: 593991 - RNA, 19 nt, Homo sapiens
caacugaagcacuacauuu

SEQ ID NO: 593992 - RNA, 19 nt, Homo sapiens
caacauacgggaaguuuau

SEQ ID NO: 593993 - RNA, 19 nt, Homo sapiens
auaaggagauucuguguau

SEQ ID NO: 593994 - RNA, 19 nt, Homo sapiens
gaaagucuagcaccuggua

SEQ ID NO: 593995 - RNA, 19 nt, Homo sapiens
aaacagcaacuaacucuaa

SEQ ID NO: 593996 - RNA, 19 nt, Homo sapiens
ugccaacacuuaaucauuu

SEQ ID NO: 593997 - RNA, 19 nt, Homo sapiens
guuaggaacugauuacauc

SEQ ID NO: 593998 - RNA, 19 nt, Homo sapiens
cuaauuaccucucaucagu

SEQ ID NO: 593999 - RNA, 19 nt, Homo sapiens
gaaagaaacagucccucaa

SEQ ID NO: 594000 - RNA, 19 nt, Homo sapiens
ucaccaaucucucauauac

SEQ ID NO: 594001 - RNA, 19 nt, Homo sapiens
ggacccauaugaacaagga

SEQ ID NO: 594002 - RNA, 19 nt, Homo sapiens
cgaaagagagaauaugaaa

SEQ ID NO: 594003 - RNA, 19 nt, Homo sapiens
uuguugggcuuaaguauua

SEQ ID NO: 594004 - RNA, 19 nt, Homo sapiens
gcaaagaugaccuggaaug

SEQ ID NO: 594005 - RNA, 19 nt, Homo sapiens
gaacacagcacugcauugu

SEQ ID NO: 594006 - RNA, 19 nt, Homo sapiens
aaacagcaccaccauuuaa

SEQ ID NO: 594007 - RNA, 19 nt, Homo sapiens
gcagguaucgccaccguaa

SEQ ID NO: 594008 - RNA, 19 nt, Homo sapiens
uaaauacagccaccuaauu

SEQ ID NO: 594009 - RNA, 19 nt, Homo sapiens
gcacaaauaggauguacug

SEQ ID NO: 594010 - RNA, 19 nt, Homo sapiens
uaccacuacuggauauuua

SEQ ID NO: 594011 - RNA, 19 nt, Homo sapiens
gacagcagguguacacaug

SEQ ID NO: 594012 - RNA, 19 nt, Homo sapiens
uuaaacagcaccaccauuu

SEQ ID NO: 594013 - RNA, 19 nt, Homo sapiens
cuuggaagauguauaugua

SEQ ID NO: 594014 - RNA, 19 nt, Homo sapiens
gauaugcacccaaucgaaa

SEQ ID NO: 594015 - RNA, 19 nt, Homo sapiens
gagguaaauccuauucuuu

SEQ ID NO: 594016 - RNA, 19 nt, Homo sapiens
cauguucgauagcaucuuu

SEQ ID NO: 594017 - RNA, 19 nt, Homo sapiens
gaugugcgcauguucgaua

SEQ ID NO: 594018 - RNA, 19 nt, Homo sapiens
cuacagcucuuuuguuuaa

SEQ ID NO: 594019 - RNA, 19 nt, Homo sapiens
caacauacuguccacauau

SEQ ID NO: 594020 - RNA, 19 nt, Homo sapiens
ugcagagccuggacaaaua

SEQ ID NO: 594021 - RNA, 19 nt, Homo sapiens
cagcaacuaacucuaauaa

SEQ ID NO: 594022 - RNA, 19 nt, Homo sapiens
aaggagauucuguguauua

SEQ ID NO: 594023 - RNA, 19 nt, Homo sapiens
ggaguacuuucucuagugu

SEQ ID NO: 594024 - RNA, 19 nt, Homo sapiens
agaagacacugcugcuuug

SEQ ID NO: 594025 - RNA, 19 nt, Homo sapiens
gcaacauacgggaaguuua

SEQ ID NO: 594026 - RNA, 19 nt, Homo sapiens
ucaaugcaguucucacgaa

SEQ ID NO: 594027 - RNA, 19 nt, Homo sapiens
guugagaauugauccugua

SEQ ID NO: 594028 - RNA, 19 nt, Homo sapiens
uuacaggccuggagaauac

SEQ ID NO: 594029 - RNA, 19 nt, Homo sapiens
ggagaaugacuacaagaga

SEQ ID NO: 594030 - RNA, 19 nt, Homo sapiens
accaauuacugcacucuua

SEQ ID NO: 594031 - RNA, 19 nt, Homo sapiens
guuaagaaccaaacuccua

SEQ ID NO: 594032 - RNA, 19 nt, Homo sapiens
gcaguucucacgaaaguau

SEQ ID NO: 594033 - RNA, 19 nt, Homo sapiens
acaaauagaagcuagaaga

SEQ ID NO: 594034 - RNA, 19 nt, Homo sapiens
gaaagaagagagguaaauc

SEQ ID NO: 594035 - RNA, 19 nt, Homo sapiens
cagcaccaccauuuaauuu

SEQ ID NO: 594036 - RNA, 19 nt, Homo sapiens
gguucuaaaugcaauaaga

SEQ ID NO: 594037 - RNA, 19 nt, Homo sapiens
gucaaaagauccuucauuu

SEQ ID NO: 594038 - RNA, 19 nt, Homo sapiens
acaaagauagcaaguggua

SEQ ID NO: 594039 - RNA, 19 nt, Homo sapiens
ggacaaauagaagcuagaa

SEQ ID NO: 594040 - RNA, 19 nt, Homo sapiens
guuccgcacucaucuuauu

SEQ ID NO: 594041 - RNA, 19 nt, Homo sapiens
uugcaaagaugaccuggaa

SEQ ID NO: 594042 - RNA, 19 nt, Homo sapiens
caaugcaguucucacgaaa

SEQ ID NO: 594043 - RNA, 19 nt, Homo sapiens
ccacaaacacauuauaaag

SEQ ID NO: 594044 - RNA, 19 nt, Homo sapiens
caauaacaagcaugcauaa

SEQ ID NO: 594045 - RNA, 19 nt, Homo sapiens
gcgaggauaugcacccaau

SEQ ID NO: 594046 - RNA, 19 nt, Homo sapiens
cggaacauuuggaaagaaa

SEQ ID NO: 594047 - RNA, 19 nt, Homo sapiens
ccaaggagaaugacuacaa

SEQ ID NO: 594048 - RNA, 19 nt, Homo sapiens
caacgaaagaagagaggua

SEQ ID NO: 594049 - RNA, 19 nt, Homo sapiens
gaagacaagcagacagaug

SEQ ID NO: 594050 - RNA, 19 nt, Homo sapiens
ccaaacuccuauuucaaug

SEQ ID NO: 594051 - RNA, 19 nt, Homo sapiens
gaaccguggauuucauauu

SEQ ID NO: 594052 - RNA, 19 nt, Homo sapiens
cuaaauggcuaccuucaac

SEQ ID NO: 594053 - RNA, 19 nt, Homo sapiens
caaggagaaugacuacaag

SEQ ID NO: 594054 - RNA, 19 nt, Homo sapiens
cauaauccucuucacauaa

SEQ ID NO: 594055 - RNA, 19 nt, Homo sapiens
gcuaaaagcauguauaguu

SEQ ID NO: 594056 - RNA, 19 nt, Homo sapiens
cuauuucacugguuaccua

SEQ ID NO: 594057 - RNA, 19 nt, Homo sapiens
ccaaacaacucuuaggauu

SEQ ID NO: 594058 - RNA, 19 nt, Homo sapiens
gaugggaguuuaaauuuga

SEQ ID NO: 594059 - RNA, 19 nt, Homo sapiens
cgauguagcugaacucauu

SEQ ID NO: 594060 - RNA, 19 nt, Homo sapiens
cagaguggcugcaguuaaa

SEQ ID NO: 594061 - RNA, 19 nt, Homo sapiens
aaacaacucuuaggauuga

SEQ ID NO: 594062 - RNA, 19 nt, Homo sapiens
gaauagacguguucucaag

SEQ ID NO: 594063 - RNA, 19 nt, Homo sapiens
ucagaucucuccagaagaa

SEQ ID NO: 594064 - RNA, 19 nt, Homo sapiens
cuucaaaggucuccuguuu

SEQ ID NO: 594065 - RNA, 19 nt, Homo sapiens
uagcugaacucauuuacaa

SEQ ID NO: 594066 - RNA, 19 nt, Homo sapiens
ugagauggguggccacuuu

SEQ ID NO: 594067 - RNA, 19 nt, Homo sapiens
caagaaugcugauccuguu

SEQ ID NO: 594068 - RNA, 19 nt, Homo sapiens
gaacuuguaguaagaagaa

SEQ ID NO: 594069 - RNA, 19 nt, Homo sapiens
gcagguggaauguguauaa

SEQ ID NO: 594070 - RNA, 19 nt, Homo sapiens
agccaaaucuuccaugaua

SEQ ID NO: 594071 - RNA, 19 nt, Homo sapiens
gaguuaagaggaagauuua

SEQ ID NO: 594072 - RNA, 19 nt, Homo sapiens
cagaagaaaugcacagaau

SEQ ID NO: 594073 - RNA, 19 nt, Homo sapiens
caucagaucucuccagaag

SEQ ID NO: 594074 - RNA, 19 nt, Homo sapiens
guaaacauggacaaucuua

SEQ ID NO: 594075 - RNA, 19 nt, Homo sapiens
cauaagaacucgaccuauc

SEQ ID NO: 594076 - RNA, 19 nt, Homo sapiens
gggaugagaacaacuuuaa

SEQ ID NO: 594077 - RNA, 19 nt, Homo sapiens
uaagugcauuucacaguuu

SEQ ID NO: 594078 - RNA, 19 nt, Homo sapiens
cagaaaggaugcacaguca

SEQ ID NO: 594079 - RNA, 19 nt, Homo sapiens
caagauagccacccuguuc

SEQ ID NO: 594080 - RNA, 19 nt, Homo sapiens
ucaagacaauggcuucaaa

SEQ ID NO: 594081 - RNA, 19 nt, Homo sapiens
gaaaauggccuacaguuug

SEQ ID NO: 594082 - RNA, 19 nt, Homo sapiens
gaagaaaugcacagaaucu

SEQ ID NO: 594083 - RNA, 19 nt, Homo sapiens
acaguaaugugucauauca

SEQ ID NO: 594084 - RNA, 19 nt, Homo sapiens
ucaacgagcccaauaaaug

SEQ ID NO: 594085 - RNA, 19 nt, Homo sapiens
gcauacauccuuuccagaa

SEQ ID NO: 594086 - RNA, 19 nt, Homo sapiens
gaggaagauuuaugaguca

SEQ ID NO: 594087 - RNA, 19 nt, Homo sapiens
aauauaaucucaccugcuu

SEQ ID NO: 594088 - RNA, 19 nt, Homo sapiens
guuagacucuggucauaga

SEQ ID NO: 594089 - RNA, 19 nt, Homo sapiens
uuaguaauaugcugccuuu

SEQ ID NO: 594090 - RNA, 19 nt, Homo sapiens
gacaguaacuacccaccuu

SEQ ID NO: 594091 - RNA, 19 nt, Homo sapiens
cagcaccacucacaaggaa

SEQ ID NO: 594092 - RNA, 19 nt, Homo sapiens
ccaaggaggcguauucuuc

SEQ ID NO: 594093 - RNA, 19 nt, Homo sapiens
ccagaacaguggcuucaau

SEQ ID NO: 594094 - RNA, 19 nt, Homo sapiens
caacgagcccaauaaaugu

SEQ ID NO: 594095 - RNA, 19 nt, Homo sapiens
cuaagugcauuucacaguu

SEQ ID NO: 594096 - RNA, 19 nt, Homo sapiens
uuuauugacuccuaccaua

SEQ ID NO: 594097 - RNA, 19 nt, Homo sapiens
caucagauuuggaagaaag

SEQ ID NO: 594098 - RNA, 19 nt, Homo sapiens
gaagacaacucugcuugcu

SEQ ID NO: 594099 - RNA, 19 nt, Homo sapiens
gcaguuccaccaagaaaug

SEQ ID NO: 594100 - RNA, 19 nt, Homo sapiens
cacuggaugugauuauuaa

SEQ ID NO: 594101 - RNA, 19 nt, Homo sapiens
gcaccacucacaaggaauu

SEQ ID NO: 594102 - RNA, 19 nt, Homo sapiens
ccaacagaguuaagaggaa

SEQ ID NO: 594103 - RNA, 19 nt, Homo sapiens
caaacaacucuuaggauug

SEQ ID NO: 594104 - RNA, 19 nt, Homo sapiens
gcauugcuauuuaucucaa

SEQ ID NO: 594105 - RNA, 19 nt, Homo sapiens
gcuauaaguucuuuucuug

SEQ ID NO: 594106 - RNA, 19 nt, Homo sapiens
cguguguguuguuacauua

SEQ ID NO: 594107 - RNA, 19 nt, Homo sapiens
ugacguaccgugcaucuga

SEQ ID NO: 594108 - RNA, 19 nt, Homo sapiens
uggagaccaugcuugauuu

SEQ ID NO: 594109 - RNA, 19 nt, Homo sapiens
ccuaacaguugccaggaaa

SEQ ID NO: 594110 - RNA, 19 nt, Homo sapiens
acacuggaugugauuauua

SEQ ID NO: 594111 - RNA, 19 nt, Homo sapiens
ccacgaagaagguauuuua

SEQ ID NO: 594112 - RNA, 19 nt, Homo sapiens
gaaaacagacagcgacauu

SEQ ID NO: 594113 - RNA, 19 nt, Homo sapiens
ggaacccuccaucagauuu

SEQ ID NO: 594114 - RNA, 19 nt, Homo sapiens
ggaauagacguguucucaa

SEQ ID NO: 594115 - RNA, 19 nt, Homo sapiens
gaagggguuuuguaaaguu

SEQ ID NO: 594116 - RNA, 19 nt, Homo sapiens
aaaggucuccuguuuguau

SEQ ID NO: 594117 - RNA, 19 nt, Homo sapiens
ggaaaauggccuacaguuu

SEQ ID NO: 594118 - RNA, 19 nt, Homo sapiens
gcugaacucauuuacaaga

SEQ ID NO: 594119 - RNA, 19 nt, Homo sapiens
aauaucguguguguuguua

SEQ ID NO: 594120 - RNA, 19 nt, Homo sapiens
cauauauucccauguaaug

SEQ ID NO: 594121 - RNA, 19 nt, Homo sapiens
uuuaagaaaugggaccuaa

SEQ ID NO: 594122 - RNA, 19 nt, Homo sapiens
gguauaugcccagggauuu

SEQ ID NO: 594123 - RNA, 19 nt, Homo sapiens
uaucaacgagcccaauaaa

SEQ ID NO: 594124 - RNA, 19 nt, Homo sapiens
gacguguucucaagacaau

SEQ ID NO: 594125 - RNA, 19 nt, Homo sapiens
caaggaggcguauucuuca

SEQ ID NO: 594126 - RNA, 19 nt, Homo sapiens
agaugggaguuuaaauuug

SEQ ID NO: 594127 - RNA, 19 nt, Homo sapiens
gaguggcugcaguuaaaua

SEQ ID NO: 594128 - RNA, 19 nt, Homo sapiens
gcacgggcaccuugaaucu

SEQ ID NO: 594129 - RNA, 19 nt, Homo sapiens
uaacuacccaccuuucugu

SEQ ID NO: 594130 - RNA, 19 nt, Homo sapiens
gaugagaacaacuuuaagg

SEQ ID NO: 594131 - RNA, 19 nt, Homo sapiens
uaaauggugccuccaagga

SEQ ID NO: 594132 - RNA, 19 nt, Homo sapiens
agaguuaagaggaagauuu

SEQ ID NO: 594133 - RNA, 19 nt, Homo sapiens
uuuacuggcuaugucauua

SEQ ID NO: 594134 - RNA, 19 nt, Homo sapiens
guuaagaggaagauuuaug

SEQ ID NO: 594135 - RNA, 19 nt, Homo sapiens
gccaaaucuuccaugauau

SEQ ID NO: 594136 - RNA, 19 nt, Homo sapiens
gcuggagccaacagaguua

SEQ ID NO: 594137 - RNA, 19 nt, Homo sapiens
uaacucgcccuacuucuuc

SEQ ID NO: 594138 - RNA, 19 nt, Homo sapiens
uugauuuccugaacuugua

SEQ ID NO: 594139 - RNA, 19 nt, Homo sapiens
caaaagcaauucagaaagg

SEQ ID NO: 594140 - RNA, 19 nt, Homo sapiens
ccacucacaaggaauuuga

SEQ ID NO: 594141 - RNA, 19 nt, Homo sapiens
aauggugccuccaaggaaa

SEQ ID NO: 594142 - RNA, 19 nt, Homo sapiens
ccauaaccuuacccucaaa

SEQ ID NO: 594143 - RNA, 19 nt, Homo sapiens
guggaggacuuuauugacu

SEQ ID NO: 594144 - RNA, 19 nt, Homo sapiens
gguggaauguguauaaaau

SEQ ID NO: 594145 - RNA, 19 nt, Homo sapiens
cagguggaauguguauaaa

SEQ ID NO: 594146 - RNA, 19 nt, Homo sapiens
uaucguguguguuguuaca

SEQ ID NO: 594147 - RNA, 19 nt, Homo sapiens
gaacccuccaucagauuug

SEQ ID NO: 594148 - RNA, 19 nt, Homo sapiens
agccaaguaugucaugaaa

SEQ ID NO: 594149 - RNA, 19 nt, Homo sapiens
caucguggaggacuuuauu

SEQ ID NO: 594150 - RNA, 19 nt, Homo sapiens
agagccaaaucuuccauga

SEQ ID NO: 594151 - RNA, 19 nt, Homo sapiens
cuucaccuuuggcaacaua

SEQ ID NO: 594152 - RNA, 19 nt, Homo sapiens
gucagcagguggaaugugu

SEQ ID NO: 594153 - RNA, 19 nt, Homo sapiens
ggugacagacagccacuga

SEQ ID NO: 594154 - RNA, 19 nt, Homo sapiens
aguaaugugucauaucauc

SEQ ID NO: 594155 - RNA, 19 nt, Homo sapiens
agaagggccagauuucauu

SEQ ID NO: 594156 - RNA, 19 nt, Homo sapiens
uggcuucaaucacuggaaa

SEQ ID NO: 594157 - RNA, 19 nt, Homo sapiens
gcacaaaucuuacauagag

SEQ ID NO: 594158 - RNA, 19 nt, Homo sapiens
gaacagaucaccuagagaa

SEQ ID NO: 594159 - RNA, 19 nt, Homo sapiens
gaaauaagugugaaggaua

SEQ ID NO: 594160 - RNA, 19 nt, Homo sapiens
gacacuagacguaauauua

SEQ ID NO: 594161 - RNA, 19 nt, Homo sapiens
cgaaugaccucuaaguaug

SEQ ID NO: 594162 - RNA, 19 nt, Homo sapiens
gaguuuaccuucauauguu

SEQ ID NO: 594163 - RNA, 19 nt, Homo sapiens
gaagacacuagacguaaua

SEQ ID NO: 594164 - RNA, 19 nt, Homo sapiens
gauaaguugcuucauguua

SEQ ID NO: 594165 - RNA, 19 nt, Homo sapiens
gagaacagaucaccuagag

SEQ ID NO: 594166 - RNA, 19 nt, Homo sapiens
caaaguuucuugcccuuga

SEQ ID NO: 594167 - RNA, 19 nt, Homo sapiens
agaaugaccucucugaaau

SEQ ID NO: 594168 - RNA, 19 nt, Homo sapiens
ucagagagauggaugacaa

SEQ ID NO: 594169 - RNA, 19 nt, Homo sapiens
cuagacaccugguugauug

SEQ ID NO: 594170 - RNA, 19 nt, Homo sapiens
ggaugaugcacaaaucuua

SEQ ID NO: 594171 - RNA, 19 nt, Homo sapiens
cuaaguauguugagguauu

SEQ ID NO: 594172 - RNA, 19 nt, Homo sapiens
ccaugugucucacccauuu

SEQ ID NO: 594173 - RNA, 19 nt, Homo sapiens
ugagaaguguggaaacauu

SEQ ID NO: 594174 - RNA, 19 nt, Homo sapiens
caaggcgaaugaccucuaa

SEQ ID NO: 594175 - RNA, 19 nt, Homo sapiens
cagauacaaugguggcaua

SEQ ID NO: 594176 - RNA, 19 nt, Homo sapiens
gaacgugauuggugaaggu

SEQ ID NO: 594177 - RNA, 19 nt, Homo sapiens
guuguuaucuacagaauca

SEQ ID NO: 594178 - RNA, 19 nt, Homo sapiens
gcgaaugaccucuaaguau

SEQ ID NO: 594179 - RNA, 19 nt, Homo sapiens
gaaguucaauuugucuguu

SEQ ID NO: 594180 - RNA, 19 nt, Homo sapiens
gcauaaacauguacguucu

SEQ ID NO: 594181 - RNA, 19 nt, Homo sapiens
ucaaggaaauggaaaugug

SEQ ID NO: 594182 - RNA, 19 nt, Homo sapiens
cauaugcuguguaguuuau

SEQ ID NO: 594183 - RNA, 19 nt, Homo sapiens
ucucacccauuucuaauuu

SEQ ID NO: 594184 - RNA, 19 nt, Homo sapiens
caccacaagucaauagauu

SEQ ID NO: 594185 - RNA, 19 nt, Homo sapiens
ugaccucucugaaauugaa

SEQ ID NO: 594186 - RNA, 19 nt, Homo sapiens
ggauuaugaucucagcauu

SEQ ID NO: 594187 - RNA, 19 nt, Homo sapiens
gauauggaaacucuucuaa

SEQ ID NO: 594188 - RNA, 19 nt, Homo sapiens
gaccacccauuccuauuug

SEQ ID NO: 594189 - RNA, 19 nt, Homo sapiens
cacaggaaguaauauugua

SEQ ID NO: 594190 - RNA, 19 nt, Homo sapiens
caaggaugaugcacaaauc

SEQ ID NO: 594191 - RNA, 19 nt, Homo sapiens
gaguugacuuuacgaauca

SEQ ID NO: 594192 - RNA, 19 nt, Homo sapiens
cgaguugacuuuacgaauc

SEQ ID NO: 594193 - RNA, 19 nt, Homo sapiens
ccacaaggauuaugaucuc

SEQ ID NO: 594194 - RNA, 19 nt, Homo sapiens
ucucucagauugauaaguu

SEQ ID NO: 594195 - RNA, 19 nt, Homo sapiens
ggaugacaaucaaggaaau

SEQ ID NO: 594196 - RNA, 19 nt, Homo sapiens
ggaaggcagucgccaugau

SEQ ID NO: 594197 - RNA, 19 nt, Homo sapiens
uaaggagaacguagaagua

SEQ ID NO: 594198 - RNA, 19 nt, Homo sapiens
gguguuuccuuugaguuua

SEQ ID NO: 594199 - RNA, 19 nt, Homo sapiens
aagcucaucugcuguaaug

SEQ ID NO: 594200 - RNA, 19 nt, Homo sapiens
gaggacccaucaaugaaga

SEQ ID NO: 594201 - RNA, 19 nt, Homo sapiens
gaaauggaaauguguucuu

SEQ ID NO: 594202 - RNA, 19 nt, Homo sapiens
uaacauuggucagcagaug

SEQ ID NO: 594203 - RNA, 19 nt, Homo sapiens
gucuagaaaugcugacuuu

SEQ ID NO: 594204 - RNA, 19 nt, Homo sapiens
gaaugaccucucugaaauu

SEQ ID NO: 594205 - RNA, 19 nt, Homo sapiens
cauaaggacuacauugagu

SEQ ID NO: 594206 - RNA, 19 nt, Homo sapiens
agagauggaugacaaucaa

SEQ ID NO: 594207 - RNA, 19 nt, Homo sapiens
ggacagccuuuaaaacuga

SEQ ID NO: 594208 - RNA, 19 nt, Homo sapiens
guaagcaaucuaggaaaua

SEQ ID NO: 594209 - RNA, 19 nt, Homo sapiens
cagauauucuagcuucauu

SEQ ID NO: 594210 - RNA, 19 nt, Homo sapiens
gacuuugguucauuaggua

SEQ ID NO: 594211 - RNA, 19 nt, Homo sapiens
uaacacugccucaggauau

SEQ ID NO: 594212 - RNA, 19 nt, Homo sapiens
gaaacucuucuaauaguca

SEQ ID NO: 594213 - RNA, 19 nt, Homo sapiens
caucacugcuucuggguau

SEQ ID NO: 594214 - RNA, 19 nt, Homo sapiens
gagaaguguggaaacauuu

SEQ ID NO: 594215 - RNA, 19 nt, Homo sapiens
gcuguguaguuuauaaguu

SEQ ID NO: 594216 - RNA, 19 nt, Homo sapiens
caaucagccuucaccaaga

SEQ ID NO: 594217 - RNA, 19 nt, Homo sapiens
uggaaacucuucuaauagu

SEQ ID NO: 594218 - RNA, 19 nt, Homo sapiens
uggaggugcucaacuggua

SEQ ID NO: 594219 - RNA, 19 nt, Homo sapiens
ggugaaugcuguguacuuc

SEQ ID NO: 594220 - RNA, 19 nt, Homo sapiens
ggaaacucuucuaauaguc

SEQ ID NO: 594221 - RNA, 19 nt, Homo sapiens
gcuucaaccuguucagaga

SEQ ID NO: 594222 - RNA, 19 nt, Homo sapiens
gaaaccagauucccaucac

SEQ ID NO: 594223 - RNA, 19 nt, Homo sapiens
agaaauaagugugaaggau

SEQ ID NO: 594224 - RNA, 19 nt, Homo sapiens
gaaggcagucgccaugaug

SEQ ID NO: 594225 - RNA, 19 nt, Homo sapiens
agucagggcuccagucuca

SEQ ID NO: 594226 - RNA, 19 nt, Homo sapiens
ugacccgucuggaaauuau

SEQ ID NO: 594227 - RNA, 19 nt, Homo sapiens
uagaaaugcugacuuuggu

SEQ ID NO: 594228 - RNA, 19 nt, Homo sapiens
gaaaauaccuagggcucaa

SEQ ID NO: 594229 - RNA, 19 nt, Homo sapiens
uguaagcaaucuaggaaau

SEQ ID NO: 594230 - RNA, 19 nt, Homo sapiens
guaaggagaacguagaagu

SEQ ID NO: 594231 - RNA, 19 nt, Homo sapiens
caaagaccaccacaaguca

SEQ ID NO: 594232 - RNA, 19 nt, Homo sapiens
caucaaagaccaccacaag

SEQ ID NO: 594233 - RNA, 19 nt, Homo sapiens
ugaccacccauuccuauuu

SEQ ID NO: 594234 - RNA, 19 nt, Homo sapiens
cuguauauaucaaggauga

SEQ ID NO: 594235 - RNA, 19 nt, Homo sapiens
cauaagcucaucugcugua

SEQ ID NO: 594236 - RNA, 19 nt, Homo sapiens
agaugacacuggugacuug

SEQ ID NO: 594237 - RNA, 19 nt, Homo sapiens
ucaaagaccaccacaaguc

SEQ ID NO: 594238 - RNA, 19 nt, Homo sapiens
caagagcgaaaccauaaau

SEQ ID NO: 594239 - RNA, 19 nt, Homo sapiens
gagaaaggaaaccagauuc

SEQ ID NO: 594240 - RNA, 19 nt, Homo sapiens
ggucgucuguauauaucaa

SEQ ID NO: 594241 - RNA, 19 nt, Homo sapiens
gaaugaccucuaaguaugu

SEQ ID NO: 594242 - RNA, 19 nt, Homo sapiens
ugacuuugguucauuaggu

SEQ ID NO: 594243 - RNA, 19 nt, Homo sapiens
guccugaucccugcucuua

SEQ ID NO: 594244 - RNA, 19 nt, Homo sapiens
gaugcacaaaucuuacaua

SEQ ID NO: 594245 - RNA, 19 nt, Homo sapiens
cccuagggcugaaagauau

SEQ ID NO: 594246 - RNA, 19 nt, Homo sapiens
cuaauggaauggaccaauc

SEQ ID NO: 594247 - RNA, 19 nt, Homo sapiens
ggauauggaaacucuucua

SEQ ID NO: 594248 - RNA, 19 nt, Homo sapiens
gaaaccauaaauugccauu

SEQ ID NO: 594249 - RNA, 19 nt, Homo sapiens
gauauucuagcuucauugu

SEQ ID NO: 594250 - RNA, 19 nt, Homo sapiens
ccuuugaguuuauuucuuc

SEQ ID NO: 594251 - RNA, 19 nt, Homo sapiens
cuuauucaguggcaaaguu

SEQ ID NO: 594252 - RNA, 19 nt, Homo sapiens
ccacaggaaguaauauugu

SEQ ID NO: 594253 - RNA, 19 nt, Homo sapiens
aaaacaaacugaccuuuca

SEQ ID NO: 594254 - RNA, 19 nt, Homo sapiens
aaugaccucucugaaauug

SEQ ID NO: 594255 - RNA, 19 nt, Homo sapiens
gagcgaaaccauaaauugc

SEQ ID NO: 594256 - RNA, 19 nt, Homo sapiens
guacagggaagcucuccuu

SEQ ID NO: 594257 - RNA, 19 nt, Homo sapiens
gaaaagagcuacuauacau

SEQ ID NO: 594258 - RNA, 19 nt, Homo sapiens
aagcauagauggagacaga

SEQ ID NO: 594259 - RNA, 19 nt, Homo sapiens
gagcuacuauacaucauau

SEQ ID NO: 594260 - RNA, 19 nt, Homo sapiens
gagagugccaucauccuua

SEQ ID NO: 594261 - RNA, 19 nt, Homo sapiens
caagguagaucagcucuuc

SEQ ID NO: 594262 - RNA, 19 nt, Homo sapiens
gaaggagagugccaucauc

SEQ ID NO: 594263 - RNA, 19 nt, Homo sapiens
gaacagccauccggaacug

SEQ ID NO: 594264 - RNA, 19 nt, Homo sapiens
guucugggccuaagucuaa

SEQ ID NO: 594265 - RNA, 19 nt, Homo sapiens
ccacuacauucucaaacaa

SEQ ID NO: 594266 - RNA, 19 nt, Homo sapiens
gcacagacaccagcaugaa

SEQ ID NO: 594267 - RNA, 19 nt, Homo sapiens
gaacugggucuacaagauc

SEQ ID NO: 594268 - RNA, 19 nt, Homo sapiens
gcccugagcucaccaucug

SEQ ID NO: 594269 - RNA, 19 nt, Homo sapiens
gaugacgauugcucucuug

SEQ ID NO: 594270 - RNA, 19 nt, Homo sapiens
uaaagccgcugcccucucu

SEQ ID NO: 594271 - RNA, 19 nt, Homo sapiens
ggcccaaacugccuucguu

SEQ ID NO: 594272 - RNA, 19 nt, Homo sapiens
gcagugacgcugacagaug

SEQ ID NO: 594273 - RNA, 19 nt, Homo sapiens
uaguauggauuaugagaug

SEQ ID NO: 594274 - RNA, 19 nt, Homo sapiens
gaacugccaucagcuacca

SEQ ID NO: 594275 - RNA, 19 nt, Homo sapiens
cgagagguaucggucauga

SEQ ID NO: 594276 - RNA, 19 nt, Homo sapiens
guugggcacuggcaaaugu

SEQ ID NO: 594277 - RNA, 19 nt, Homo sapiens
gcauagauggagacagaaa

SEQ ID NO: 594278 - RNA, 19 nt, Homo sapiens
gguagacguuccacuugug

SEQ ID NO: 594279 - RNA, 19 nt, Homo sapiens
gagcucaccaucugaagga

SEQ ID NO: 594280 - RNA, 19 nt, Homo sapiens
gggccacacuggaccaugu

SEQ ID NO: 594281 - RNA, 19 nt, Homo sapiens
ggaccaaguggaaccagaa

SEQ ID NO: 594282 - RNA, 19 nt, Homo sapiens
ggcgcauccuggagcauua

SEQ ID NO: 594283 - RNA, 19 nt, Homo sapiens
gaguugcagaggaagauua

SEQ ID NO: 594284 - RNA, 19 nt, Homo sapiens
ggaacuccuucuccagaca

SEQ ID NO: 594285 - RNA, 19 nt, Homo sapiens
agaacugggucuacaagau

SEQ ID NO: 594286 - RNA, 19 nt, Homo sapiens
ccuauuacauacaucuuuc

SEQ ID NO: 594287 - RNA, 19 nt, Homo sapiens
ggagagugccaucauccuu

SEQ ID NO: 594288 - RNA, 19 nt, Homo sapiens
aaagagcuacuauacauca

SEQ ID NO: 594289 - RNA, 19 nt, Homo sapiens
gaggaggagcccagaguug

SEQ ID NO: 594290 - RNA, 19 nt, Homo sapiens
ggguagacguuccacuugu

SEQ ID NO: 594291 - RNA, 19 nt, Homo sapiens
ggagaucaacacccaggaa

SEQ ID NO: 594292 - RNA, 19 nt, Homo sapiens
ggacuuccugcgagaggua

SEQ ID NO: 594293 - RNA, 19 nt, Homo sapiens
cugguaguauggauuauga

SEQ ID NO: 594294 - RNA, 19 nt, Homo sapiens
ucggaagcauguuguguga

SEQ ID NO: 594295 - RNA, 19 nt, Homo sapiens
ccagggcacuucgacuuug

SEQ ID NO: 594296 - RNA, 19 nt, Homo sapiens
cuucuacccuccccuauua

SEQ ID NO: 594297 - RNA, 19 nt, Homo sapiens
ccaaguggaaccagaacaa

SEQ ID NO: 594298 - RNA, 19 nt, Homo sapiens
ccaucaagguggcugacuu

SEQ ID NO: 594299 - RNA, 19 nt, Homo sapiens
uacaucauaugcagaggaa

SEQ ID NO: 594300 - RNA, 19 nt, Homo sapiens
ggaggaggagcccagaguu

SEQ ID NO: 594301 - RNA, 19 nt, Homo sapiens
gaucaacacccaggaagca

SEQ ID NO: 594302 - RNA, 19 nt, Homo sapiens
gagaggaugaaaggcauuu

SEQ ID NO: 594303 - RNA, 19 nt, Homo sapiens
gacauuugaugcugguagu

SEQ ID NO: 594304 - RNA, 19 nt, Homo sapiens
acagaaagaaggcaaaucu

SEQ ID NO: 594305 - RNA, 19 nt, Homo sapiens
ucuaagaacugggucuaca

SEQ ID NO: 594306 - RNA, 19 nt, Homo sapiens
gggccuaagucuaagaacu

SEQ ID NO: 594307 - RNA, 19 nt, Homo sapiens
cagcccaguucucacauuc

SEQ ID NO: 594308 - RNA, 19 nt, Homo sapiens
gguaguauggauuaugaga

SEQ ID NO: 594309 - RNA, 19 nt, Homo sapiens
ucaacacccaggaagcaua

SEQ ID NO: 594310 - RNA, 19 nt, Homo sapiens
ccagcccaguucucacauu

SEQ ID NO: 594311 - RNA, 19 nt, Homo sapiens
gccagggcacuucgacuuu

SEQ ID NO: 594312 - RNA, 19 nt, Homo sapiens
ugaugacgauugcucucuu

SEQ ID NO: 594313 - RNA, 19 nt, Homo sapiens
cccacuacauucucaaaca

SEQ ID NO: 594314 - RNA, 19 nt, Homo sapiens
caacacccaggaagcauag

SEQ ID NO: 594315 - RNA, 19 nt, Homo sapiens
agagguaucggucaugaug

SEQ ID NO: 594316 - RNA, 19 nt, Homo sapiens
cuagaggagcuuaauguca

SEQ ID NO: 594317 - RNA, 19 nt, Homo sapiens
ggccagggcacuucgacuu

SEQ ID NO: 594318 - RNA, 19 nt, Homo sapiens
gagacagaaagaaggcaaa

SEQ ID NO: 594319 - RNA, 19 nt, Homo sapiens
gaauggucgcaccuucaaa

SEQ ID NO: 594320 - RNA, 19 nt, Homo sapiens
ccucggacguguggauguu

SEQ ID NO: 594321 - RNA, 19 nt, Homo sapiens
gggcacuucgacuuuguaa

SEQ ID NO: 594322 - RNA, 19 nt, Homo sapiens
ggccuaagucuaagaacug

SEQ ID NO: 594323 - RNA, 19 nt, Homo sapiens
gcacucauggacauuugau

SEQ ID NO: 594324 - RNA, 19 nt, Homo sapiens
cacagacaccagcaugaaa

SEQ ID NO: 594325 - RNA, 19 nt, Homo sapiens
agagugccaucauccuuag

SEQ ID NO: 594326 - RNA, 19 nt, Homo sapiens
ccuccacgcccaccuuuau

SEQ ID NO: 594327 - RNA, 19 nt, Homo sapiens
ggagaggaugaaaggcauu

SEQ ID NO: 594328 - RNA, 19 nt, Homo sapiens
gaacuccuucuccagacau

SEQ ID NO: 594329 - RNA, 19 nt, Homo sapiens
agagcuacuauacaucaua

SEQ ID NO: 594330 - RNA, 19 nt, Homo sapiens
acuacauucucaaacaaga

SEQ ID NO: 594331 - RNA, 19 nt, Homo sapiens
caugcuccuuggcuucuga

SEQ ID NO: 594332 - RNA, 19 nt, Homo sapiens
cacaugggaccaaguggaa

SEQ ID NO: 594333 - RNA, 19 nt, Homo sapiens
cagaauggucgcaccuuca

SEQ ID NO: 594334 - RNA, 19 nt, Homo sapiens
caucaagguggcugacuuc

SEQ ID NO: 594335 - RNA, 19 nt, Homo sapiens
uggauuaugagauggacua

SEQ ID NO: 594336 - RNA, 19 nt, Homo sapiens
ugaaggagagugccaucau

SEQ ID NO: 594337 - RNA, 19 nt, Homo sapiens
uaagaacugggucuacaag

SEQ ID NO: 594338 - RNA, 19 nt, Homo sapiens
cagggcacuucgacuuugu

SEQ ID NO: 594339 - RNA, 19 nt, Homo sapiens
cuaagaacugggucuacaa

SEQ ID NO: 594340 - RNA, 19 nt, Homo sapiens
cuuguccgauccugaguug

SEQ ID NO: 594341 - RNA, 19 nt, Homo sapiens
gggugacgcugugggagau

SEQ ID NO: 594342 - RNA, 19 nt, Homo sapiens
gcuccgggacauccaguug

SEQ ID NO: 594343 - RNA, 19 nt, Homo sapiens
guaguauggauuaugagau

SEQ ID NO: 594344 - RNA, 19 nt, Homo sapiens
gcuacuauacaucauaugc

SEQ ID NO: 594345 - RNA, 19 nt, Homo sapiens
agaauggucgcaccuucaa

SEQ ID NO: 594346 - RNA, 19 nt, Homo sapiens
gaucccagagggugcuguu

SEQ ID NO: 594347 - RNA, 19 nt, Homo sapiens
gggcugaaguugugaaaua

SEQ ID NO: 594348 - RNA, 19 nt, Homo sapiens
guuggaaauuugaccauua

SEQ ID NO: 594349 - RNA, 19 nt, Homo sapiens
gaaaugaagagcagaugaa

SEQ ID NO: 594350 - RNA, 19 nt, Homo sapiens
gaaguggaaucaccaacuc

SEQ ID NO: 594351 - RNA, 19 nt, Homo sapiens
gaaaacaccugaggaagau

SEQ ID NO: 594352 - RNA, 19 nt, Homo sapiens
gcuccuguguuggaaauuu

SEQ ID NO: 594353 - RNA, 19 nt, Homo sapiens
ugagcaaccugacgaagug

SEQ ID NO: 594354 - RNA, 19 nt, Homo sapiens
aagacacgcugaaaugguu

SEQ ID NO: 594355 - RNA, 19 nt, Homo sapiens
gcgcggagaugguccugau

SEQ ID NO: 594356 - RNA, 19 nt, Homo sapiens
ggaguccagugaugagcaa

SEQ ID NO: 594357 - RNA, 19 nt, Homo sapiens
gaagacacgcugaaauggu

SEQ ID NO: 594358 - RNA, 19 nt, Homo sapiens
ggaaucaccaacucaaagu

SEQ ID NO: 594359 - RNA, 19 nt, Homo sapiens
aagaagacacgcugaaaug

SEQ ID NO: 594360 - RNA, 19 nt, Homo sapiens
gggugugccugcgaaauga

SEQ ID NO: 594361 - RNA, 19 nt, Homo sapiens
caacucaaagucaggauuc

SEQ ID NO: 594362 - RNA, 19 nt, Homo sapiens
cgaaaugaagagcagauga

SEQ ID NO: 594363 - RNA, 19 nt, Homo sapiens
ggcugaaguugugaaauau

SEQ ID NO: 594364 - RNA, 19 nt, Homo sapiens
aaagaagacacgcugaaau

SEQ ID NO: 594365 - RNA, 19 nt, Homo sapiens
ugaagcggauagccaggaa

SEQ ID NO: 594366 - RNA, 19 nt, Homo sapiens
aaacaccugaggaagauga

SEQ ID NO: 594367 - RNA, 19 nt, Homo sapiens
ggaagaugaagggcaauca

SEQ ID NO: 594368 - RNA, 19 nt, Homo sapiens
ggauagccaggaacagguu

SEQ ID NO: 594369 - RNA, 19 nt, Homo sapiens
aaucacagccuuaaaagaa

SEQ ID NO: 594370 - RNA, 19 nt, Homo sapiens
ucugaggaguccagugaug

SEQ ID NO: 594371 - RNA, 19 nt, Homo sapiens
gcggagaugguccugaugu

SEQ ID NO: 594372 - RNA, 19 nt, Homo sapiens
aaaugaagagcagaugaaa

SEQ ID NO: 594373 - RNA, 19 nt, Homo sapiens
ugaagcugauagccaggaa

SEQ ID NO: 594374 - RNA, 19 nt, Homo sapiens
gcaaccugacgaaguggaa

SEQ ID NO: 594375 - RNA, 19 nt, Homo sapiens
gggcaaucacagccuuaaa

SEQ ID NO: 594376 - RNA, 19 nt, Homo sapiens
cugaaguugugaaauaugg

SEQ ID NO: 594377 - RNA, 19 nt, Homo sapiens
uaucggcguagaccaauga

SEQ ID NO: 594378 - RNA, 19 nt, Homo sapiens
cugaagagagagaggauga

SEQ ID NO: 594379 - RNA, 19 nt, Homo sapiens
ugaaaacaccugaggaaga

SEQ ID NO: 594380 - RNA, 19 nt, Homo sapiens
cggcguagaccaaugaucu

SEQ ID NO: 594381 - RNA, 19 nt, Homo sapiens
cuucugaggaguccaguga

SEQ ID NO: 594382 - RNA, 19 nt, Homo sapiens
cuuuacagccuucugcaaa

SEQ ID NO: 594383 - RNA, 19 nt, Homo sapiens
gcugaaguugugaaauaug

SEQ ID NO: 594384 - RNA, 19 nt, Homo sapiens
gaagaugaagggcaaucac

SEQ ID NO: 594385 - RNA, 19 nt, Homo sapiens
ccaacucaaagucaggauu

SEQ ID NO: 594386 - RNA, 19 nt, Homo sapiens
guggaaucaccaacucaaa

SEQ ID NO: 594387 - RNA, 19 nt, Homo sapiens
ggcaaucacagccuuaaaa

SEQ ID NO: 594388 - RNA, 19 nt, Homo sapiens
caaauccagaggaggugaa

SEQ ID NO: 594389 - RNA, 19 nt, Homo sapiens
gaacugcacucuucaggaa

SEQ ID NO: 594390 - RNA, 19 nt, Homo sapiens
ggaaggaaaugacaccaaa

SEQ ID NO: 594391 - RNA, 19 nt, Homo sapiens
caaagaaugucgacccuaa

SEQ ID NO: 594392 - RNA, 19 nt, Homo sapiens
gcucuuugcugcacuauuu

SEQ ID NO: 594393 - RNA, 19 nt, Homo sapiens
gaaaugacaccaaauaugu

SEQ ID NO: 594394 - RNA, 19 nt, Homo sapiens
uaacugugcugaaugcuuu

SEQ ID NO: 594395 - RNA, 19 nt, Homo sapiens
gaauggacuugauagcaaa

SEQ ID NO: 594396 - RNA, 19 nt, Homo sapiens
gcacgccgcucuucacugu

SEQ ID NO: 594397 - RNA, 19 nt, Homo sapiens
gaucaugggugucaucuac

SEQ ID NO: 594398 - RNA, 19 nt, Homo sapiens
ggaaaugacaccaaauaug

SEQ ID NO: 594399 - RNA, 19 nt, Homo sapiens
gggcgucuaugcugcuuua

SEQ ID NO: 594400 - RNA, 19 nt, Homo sapiens
ugaaacggauccagcaauu

SEQ ID NO: 594401 - RNA, 19 nt, Homo sapiens
gcucugaacuggaugauac

SEQ ID NO: 594402 - RNA, 19 nt, Homo sapiens
ucaaggugcugaagcugua

SEQ ID NO: 594403 - RNA, 19 nt, Homo sapiens
ggacuugccuaaaauauau

SEQ ID NO: 594404 - RNA, 19 nt, Homo sapiens
gcacaccggcuuaacacua

SEQ ID NO: 594405 - RNA, 19 nt, Homo sapiens
agacagagauuggagagaa

SEQ ID NO: 594406 - RNA, 19 nt, Homo sapiens
ugggaguacugaugaaaua

SEQ ID NO: 594407 - RNA, 19 nt, Homo sapiens
ccaaauauguccgcagaau

SEQ ID NO: 594408 - RNA, 19 nt, Homo sapiens
gaccugcucuccuucauca

SEQ ID NO: 594409 - RNA, 19 nt, Homo sapiens
cagacagacuucaucauug

SEQ ID NO: 594410 - RNA, 19 nt, Homo sapiens
gagguggaguuccggaauu

SEQ ID NO: 594411 - RNA, 19 nt, Homo sapiens
ggugaaauccgcauugaug

SEQ ID NO: 594412 - RNA, 19 nt, Homo sapiens
ccacaguccuucuuugaca

SEQ ID NO: 594413 - RNA, 19 nt, Homo sapiens
ccagacagacuucaucauu

SEQ ID NO: 594414 - RNA, 19 nt, Homo sapiens
gaaauugucaaccucaugu

SEQ ID NO: 594415 - RNA, 19 nt, Homo sapiens
agaauggacuugauagcaa

SEQ ID NO: 594416 - RNA, 19 nt, Homo sapiens
agacagacuucaucauugu

SEQ ID NO: 594417 - RNA, 19 nt, Homo sapiens
uuacagugaugccgauauu

SEQ ID NO: 594418 - RNA, 19 nt, Homo sapiens
ucuguguccuuguuuaaua

SEQ ID NO: 594419 - RNA, 19 nt, Homo sapiens
gcucucagcugaccaucau

SEQ ID NO: 594420 - RNA, 19 nt, Homo sapiens
gaaggcaaagugcacauga

SEQ ID NO: 594421 - RNA, 19 nt, Homo sapiens
gaagcuagaaggcaaagug

SEQ ID NO: 594422 - RNA, 19 nt, Homo sapiens
ccacccugcugauacagua

SEQ ID NO: 594423 - RNA, 19 nt, Homo sapiens
ggacaaaggaguaguagcu

SEQ ID NO: 594424 - RNA, 19 nt, Homo sapiens
ccaucgaccuggagacuga

SEQ ID NO: 594425 - RNA, 19 nt, Homo sapiens
ggccaucugucuccuguau

SEQ ID NO: 594426 - RNA, 19 nt, Homo sapiens
ggaguacugaugaaauaaa

SEQ ID NO: 594427 - RNA, 19 nt, Homo sapiens
gcuggcaagucuuccauga

SEQ ID NO: 594428 - RNA, 19 nt, Homo sapiens
ucaccuaugugguccagaa

SEQ ID NO: 594429 - RNA, 19 nt, Homo sapiens
uggagagggucaaggagua

SEQ ID NO: 594430 - RNA, 19 nt, Homo sapiens
uacgaaugaugucagauuu

SEQ ID NO: 594431 - RNA, 19 nt, Homo sapiens
gaacugcguggugcucuuu

SEQ ID NO: 594432 - RNA, 19 nt, Homo sapiens
ggaaggcucugguuaucac

SEQ ID NO: 594433 - RNA, 19 nt, Homo sapiens
gcugaaugcuuuagaugag

SEQ ID NO: 594434 - RNA, 19 nt, Homo sapiens
aaggaaaugacaccaaaua

SEQ ID NO: 594435 - RNA, 19 nt, Homo sapiens
cgucuaugcugcuuuagga

SEQ ID NO: 594436 - RNA, 19 nt, Homo sapiens
guaccacgcuggccaucug

SEQ ID NO: 594437 - RNA, 19 nt, Homo sapiens
ugaagcggcuggaaucagu

SEQ ID NO: 594438 - RNA, 19 nt, Homo sapiens
guacguggacccaaacaau

SEQ ID NO: 594439 - RNA, 19 nt, Homo sapiens
cgaaugaugucagauuugg

SEQ ID NO: 594440 - RNA, 19 nt, Homo sapiens
ggaacucaguccuguacuc

SEQ ID NO: 594441 - RNA, 19 nt, Homo sapiens
ugaacuggaugauacgaau

SEQ ID NO: 594442 - RNA, 19 nt, Homo sapiens
guagacagaacaacacuuc

SEQ ID NO: 594443 - RNA, 19 nt, Homo sapiens
ccaacuuucucugcaacua

SEQ ID NO: 594444 - RNA, 19 nt, Homo sapiens
ccagguaaagcaaaugaaa

SEQ ID NO: 594445 - RNA, 19 nt, Homo sapiens
ggugcugccugaauccauu

SEQ ID NO: 594446 - RNA, 19 nt, Homo sapiens
caggugacauuugcucuga

SEQ ID NO: 594447 - RNA, 19 nt, Homo sapiens
caacugaagcggcuggaau

SEQ ID NO: 594448 - RNA, 19 nt, Homo sapiens
ccaucugucuccuguaugu

SEQ ID NO: 594449 - RNA, 19 nt, Homo sapiens
ucaguguguucugggauua

SEQ ID NO: 594450 - RNA, 19 nt, Homo sapiens
acaaugauccagucaccua

SEQ ID NO: 594451 - RNA, 19 nt, Homo sapiens
cgagaaggccuuugugucu

SEQ ID NO: 594452 - RNA, 19 nt, Homo sapiens
caggguaacugugcugaau

SEQ ID NO: 594453 - RNA, 19 nt, Homo sapiens
uuaacacuaucauggacua

SEQ ID NO: 594454 - RNA, 19 nt, Homo sapiens
ggaacugcguggugcucuu

SEQ ID NO: 594455 - RNA, 19 nt, Homo sapiens
agaagcaguuuaugagaca

SEQ ID NO: 594456 - RNA, 19 nt, Homo sapiens
ggaaauugucaaccucaug

SEQ ID NO: 594457 - RNA, 19 nt, Homo sapiens
caggaaggcucugguuauc

SEQ ID NO: 594458 - RNA, 19 nt, Homo sapiens
gaucuuacaacacuauuac

SEQ ID NO: 594459 - RNA, 19 nt, Homo sapiens
gguacucucugcccucauc

SEQ ID NO: 594460 - RNA, 19 nt, Homo sapiens
ccuaaaguuucguuucugu

SEQ ID NO: 594461 - RNA, 19 nt, Homo sapiens
ucagucagccgcucaccua

SEQ ID NO: 594462 - RNA, 19 nt, Homo sapiens
gcucuucacuguggucauc

SEQ ID NO: 594463 - RNA, 19 nt, Homo sapiens
aagauacgcucgccacagu

SEQ ID NO: 594464 - RNA, 19 nt, Homo sapiens
gcacugcugcacaacaaga

SEQ ID NO: 594465 - RNA, 19 nt, Homo sapiens
aggaggcacugcugauuga

SEQ ID NO: 594466 - RNA, 19 nt, Homo sapiens
guuggaaggugcagaggau

SEQ ID NO: 594467 - RNA, 19 nt, Homo sapiens
gaagggcauuaaccugucu

SEQ ID NO: 594468 - RNA, 19 nt, Homo sapiens
gcaucaaggugcugaagcu

SEQ ID NO: 594469 - RNA, 19 nt, Homo sapiens
caaccucauugcagcuaga

SEQ ID NO: 594470 - RNA, 19 nt, Homo sapiens
cacaccggcuuaacacuau

SEQ ID NO: 594471 - RNA, 19 nt, Homo sapiens
ccacaucacggcaacugaa

SEQ ID NO: 594472 - RNA, 19 nt, Homo sapiens
gaaggacucgcgcaucaag

SEQ ID NO: 594473 - RNA, 19 nt, Homo sapiens
caacugaguguuauuugca

SEQ ID NO: 594474 - RNA, 19 nt, Homo sapiens
guccagaagcaguuuauga

SEQ ID NO: 594475 - RNA, 19 nt, Homo sapiens
acacugcacuguuuucaaa

SEQ ID NO: 594476 - RNA, 19 nt, Homo sapiens
ccgcagaauggacuugaua

SEQ ID NO: 594477 - RNA, 19 nt, Homo sapiens
gaaggaaaugacaccaaau

SEQ ID NO: 594478 - RNA, 19 nt, Homo sapiens
cuaugcugcuuuaggaauu

SEQ ID NO: 594479 - RNA, 19 nt, Homo sapiens
gaagggcuccguggccuau

SEQ ID NO: 594480 - RNA, 19 nt, Homo sapiens
gaugcagucgcugaucuua

SEQ ID NO: 594481 - RNA, 19 nt, Homo sapiens
uuuaugaaaugaccucugu

SEQ ID NO: 594482 - RNA, 19 nt, Homo sapiens
caaauauguccgcagaaug

SEQ ID NO: 594483 - RNA, 19 nt, Homo sapiens
ugauacgaaugaugucaga

SEQ ID NO: 594484 - RNA, 19 nt, Homo sapiens
gaacuggaugauacgaaug

SEQ ID NO: 594485 - RNA, 19 nt, Homo sapiens
gacaguagacagaacaaca

SEQ ID NO: 594486 - RNA, 19 nt, Homo sapiens
ucgcugaucuuacaacacu

SEQ ID NO: 594487 - RNA, 19 nt, Homo sapiens
uaaggucacagcuaguuug

SEQ ID NO: 594488 - RNA, 19 nt, Homo sapiens
gcugcucaauuccuucuuc

SEQ ID NO: 594489 - RNA, 19 nt, Homo sapiens
gaacugcacucuucaggaa

SEQ ID NO: 594490 - RNA, 19 nt, Homo sapiens
ggaaggaaaugacaccaaa

SEQ ID NO: 594491 - RNA, 19 nt, Homo sapiens
caaagaaugucgacccuaa

SEQ ID NO: 594492 - RNA, 19 nt, Homo sapiens
gcucuuugcugcacuauuu

SEQ ID NO: 594493 - RNA, 19 nt, Homo sapiens
gaaaugacaccaaauaugu

SEQ ID NO: 594494 - RNA, 19 nt, Homo sapiens
uaacugugcugaaugcuuu

SEQ ID NO: 594495 - RNA, 19 nt, Homo sapiens
gaauggacuugauagcaaa

SEQ ID NO: 594496 - RNA, 19 nt, Homo sapiens
gcacgccgcucuucacugu

SEQ ID NO: 594497 - RNA, 19 nt, Homo sapiens
gaucaugggugucaucuac

SEQ ID NO: 594498 - RNA, 19 nt, Homo sapiens
ggaaaugacaccaaauaug

SEQ ID NO: 594499 - RNA, 19 nt, Homo sapiens
gggcgucuaugcugcuuua

SEQ ID NO: 594500 - RNA, 19 nt, Homo sapiens
ugaaacggauccagcaauu

SEQ ID NO: 594501 - RNA, 19 nt, Homo sapiens
gcucugaacuggaugauac

SEQ ID NO: 594502 - RNA, 19 nt, Homo sapiens
ucaaggugcugaagcugua

SEQ ID NO: 594503 - RNA, 19 nt, Homo sapiens
ggacuugccuaaaauauau

SEQ ID NO: 594504 - RNA, 19 nt, Homo sapiens
gcacaccggcuuaacacua

SEQ ID NO: 594505 - RNA, 19 nt, Homo sapiens
agacagagauuggagagaa

SEQ ID NO: 594506 - RNA, 19 nt, Homo sapiens
ugggaguacugaugaaaua

SEQ ID NO: 594507 - RNA, 19 nt, Homo sapiens
ccaaauauguccgcagaau

SEQ ID NO: 594508 - RNA, 19 nt, Homo sapiens
gaccugcucuccuucauca

SEQ ID NO: 594509 - RNA, 19 nt, Homo sapiens
cagacagacuucaucauug

SEQ ID NO: 594510 - RNA, 19 nt, Homo sapiens
gagguggaguuccggaauu

SEQ ID NO: 594511 - RNA, 19 nt, Homo sapiens
ggugaaauccgcauugaug

SEQ ID NO: 594512 - RNA, 19 nt, Homo sapiens
ccacaguccuucuuugaca

SEQ ID NO: 594513 - RNA, 19 nt, Homo sapiens
ccagacagacuucaucauu

SEQ ID NO: 594514 - RNA, 19 nt, Homo sapiens
gaaauugucaaccucaugu

SEQ ID NO: 594515 - RNA, 19 nt, Homo sapiens
agaauggacuugauagcaa

SEQ ID NO: 594516 - RNA, 19 nt, Homo sapiens
agacagacuucaucauugu

SEQ ID NO: 594517 - RNA, 19 nt, Homo sapiens
uuacagugaugccgauauu

SEQ ID NO: 594518 - RNA, 19 nt, Homo sapiens
ucuguguccuuguuuaaua

SEQ ID NO: 594519 - RNA, 19 nt, Homo sapiens
gcucucagcugaccaucau

SEQ ID NO: 594520 - RNA, 19 nt, Homo sapiens
gaaggcaaagugcacauga

SEQ ID NO: 594521 - RNA, 19 nt, Homo sapiens
gaagcuagaaggcaaagug

SEQ ID NO: 594522 - RNA, 19 nt, Homo sapiens
ccacccugcugauacagua

SEQ ID NO: 594523 - RNA, 19 nt, Homo sapiens
ggacaaaggaguaguagcu

SEQ ID NO: 594524 - RNA, 19 nt, Homo sapiens
ccaucgaccuggagacuga

SEQ ID NO: 594525 - RNA, 19 nt, Homo sapiens
ggccaucugucuccuguau

SEQ ID NO: 594526 - RNA, 19 nt, Homo sapiens
ggaguacugaugaaauaaa

SEQ ID NO: 594527 - RNA, 19 nt, Homo sapiens
gcuggcaagucuuccauga

SEQ ID NO: 594528 - RNA, 19 nt, Homo sapiens
ucaccuaugugguccagaa

SEQ ID NO: 594529 - RNA, 19 nt, Homo sapiens
uggagagggucaaggagua

SEQ ID NO: 594530 - RNA, 19 nt, Homo sapiens
uacgaaugaugucagauuu

SEQ ID NO: 594531 - RNA, 19 nt, Homo sapiens
gaacugcguggugcucuuu

SEQ ID NO: 594532 - RNA, 19 nt, Homo sapiens
ggaaggcucugguuaucac

SEQ ID NO: 594533 - RNA, 19 nt, Homo sapiens
gcugaaugcuuuagaugag

SEQ ID NO: 594534 - RNA, 19 nt, Homo sapiens
aaggaaaugacaccaaaua

SEQ ID NO: 594535 - RNA, 19 nt, Homo sapiens
cgucuaugcugcuuuagga

SEQ ID NO: 594536 - RNA, 19 nt, Homo sapiens
guaccacgcuggccaucug

SEQ ID NO: 594537 - RNA, 19 nt, Homo sapiens
ugaagcggcuggaaucagu

SEQ ID NO: 594538 - RNA, 19 nt, Homo sapiens
guacguggacccaaacaau

SEQ ID NO: 594539 - RNA, 19 nt, Homo sapiens
cgaaugaugucagauuugg

SEQ ID NO: 594540 - RNA, 19 nt, Homo sapiens
ggaacucaguccuguacuc

SEQ ID NO: 594541 - RNA, 19 nt, Homo sapiens
ugaacuggaugauacgaau

SEQ ID NO: 594542 - RNA, 19 nt, Homo sapiens
guagacagaacaacacuuc

SEQ ID NO: 594543 - RNA, 19 nt, Homo sapiens
ccaacuuucucugcaacua

SEQ ID NO: 594544 - RNA, 19 nt, Homo sapiens
ccagguaaagcaaaugaaa

SEQ ID NO: 594545 - RNA, 19 nt, Homo sapiens
ggugcugccugaauccauu

SEQ ID NO: 594546 - RNA, 19 nt, Homo sapiens
caggugacauuugcucuga

SEQ ID NO: 594547 - RNA, 19 nt, Homo sapiens
caacugaagcggcuggaau

SEQ ID NO: 594548 - RNA, 19 nt, Homo sapiens
ccaucugucuccuguaugu

SEQ ID NO: 594549 - RNA, 19 nt, Homo sapiens
ucaguguguucugggauua

SEQ ID NO: 594550 - RNA, 19 nt, Homo sapiens
acaaugauccagucaccua

SEQ ID NO: 594551 - RNA, 19 nt, Homo sapiens
cgagaaggccuuugugucu

SEQ ID NO: 594552 - RNA, 19 nt, Homo sapiens
caggguaacugugcugaau

SEQ ID NO: 594553 - RNA, 19 nt, Homo sapiens
uuaacacuaucauggacua

SEQ ID NO: 594554 - RNA, 19 nt, Homo sapiens
ggaacugcguggugcucuu

SEQ ID NO: 594555 - RNA, 19 nt, Homo sapiens
agaagcaguuuaugagaca

SEQ ID NO: 594556 - RNA, 19 nt, Homo sapiens
ggaaauugucaaccucaug

SEQ ID NO: 594557 - RNA, 19 nt, Homo sapiens
caggaaggcucugguuauc

SEQ ID NO: 594558 - RNA, 19 nt, Homo sapiens
gaucuuacaacacuauuac

SEQ ID NO: 594559 - RNA, 19 nt, Homo sapiens
ccuaaaguuucguuucugu

SEQ ID NO: 594560 - RNA, 19 nt, Homo sapiens
ucagucagccgcucaccua

SEQ ID NO: 594561 - RNA, 19 nt, Homo sapiens
gcucuucacuguggucauc

SEQ ID NO: 594562 - RNA, 19 nt, Homo sapiens
aagauacgcucgccacagu

SEQ ID NO: 594563 - RNA, 19 nt, Homo sapiens
gcacugcugcacaacaaga

SEQ ID NO: 594564 - RNA, 19 nt, Homo sapiens
aggaggcacugcugauuga

SEQ ID NO: 594565 - RNA, 19 nt, Homo sapiens
guuggaaggugcagaggau

SEQ ID NO: 594566 - RNA, 19 nt, Homo sapiens
gaagggcauuaaccugucu

SEQ ID NO: 594567 - RNA, 19 nt, Homo sapiens
gcaucaaggugcugaagcu

SEQ ID NO: 594568 - RNA, 19 nt, Homo sapiens
caaccucauugcagcuaga

SEQ ID NO: 594569 - RNA, 19 nt, Homo sapiens
cacaccggcuuaacacuau

SEQ ID NO: 594570 - RNA, 19 nt, Homo sapiens
ccacaucacggcaacugaa

SEQ ID NO: 594571 - RNA, 19 nt, Homo sapiens
gaaggacucgcgcaucaag

SEQ ID NO: 594572 - RNA, 19 nt, Homo sapiens
caacugaguguuauuugca

SEQ ID NO: 594573 - RNA, 19 nt, Homo sapiens
guccagaagcaguuuauga

SEQ ID NO: 594574 - RNA, 19 nt, Homo sapiens
acacugcacuguuuucaaa

SEQ ID NO: 594575 - RNA, 19 nt, Homo sapiens
ccgcagaauggacuugaua

SEQ ID NO: 594576 - RNA, 19 nt, Homo sapiens
gaaggaaaugacaccaaau

SEQ ID NO: 594577 - RNA, 19 nt, Homo sapiens
cuaugcugcuuuaggaauu

SEQ ID NO: 594578 - RNA, 19 nt, Homo sapiens
gaagggcuccguggccuau

SEQ ID NO: 594579 - RNA, 19 nt, Homo sapiens
gaugcagucgcugaucuua

SEQ ID NO: 594580 - RNA, 19 nt, Homo sapiens
uuuaugaaaugaccucugu

SEQ ID NO: 594581 - RNA, 19 nt, Homo sapiens
caaauauguccgcagaaug

SEQ ID NO: 594582 - RNA, 19 nt, Homo sapiens
ugauacgaaugaugucaga

SEQ ID NO: 594583 - RNA, 19 nt, Homo sapiens
gaacuggaugauacgaaug

SEQ ID NO: 594584 - RNA, 19 nt, Homo sapiens
gacaguagacagaacaaca

SEQ ID NO: 594585 - RNA, 19 nt, Homo sapiens
ucgcugaucuuacaacacu

SEQ ID NO: 594586 - RNA, 19 nt, Homo sapiens
uaaggucacagcuaguuug

SEQ ID NO: 594587 - RNA, 19 nt, Homo sapiens
gcugcucaauuccuucuuc

SEQ ID NO: 594588 - RNA, 19 nt, Homo sapiens
gcagacaguagacagaaca

SEQ ID NO: 594589 - RNA, 19 nt, Homo sapiens
gaacugcacucuucaggaa

SEQ ID NO: 594590 - RNA, 19 nt, Homo sapiens
ggaaggaaaugacaccaaa

SEQ ID NO: 594591 - RNA, 19 nt, Homo sapiens
caaagaaugucgacccuaa

SEQ ID NO: 594592 - RNA, 19 nt, Homo sapiens
gcucuuugcugcacuauuu

SEQ ID NO: 594593 - RNA, 19 nt, Homo sapiens
gaaaugacaccaaauaugu

SEQ ID NO: 594594 - RNA, 19 nt, Homo sapiens
uaacugugcugaaugcuuu

SEQ ID NO: 594595 - RNA, 19 nt, Homo sapiens
gaauggacuugauagcaaa

SEQ ID NO: 594596 - RNA, 19 nt, Homo sapiens
gcacgccgcucuucacugu

SEQ ID NO: 594597 - RNA, 19 nt, Homo sapiens
gaucaugggugucaucuac

SEQ ID NO: 594598 - RNA, 19 nt, Homo sapiens
ggaaaugacaccaaauaug

SEQ ID NO: 594599 - RNA, 19 nt, Homo sapiens
gggcgucuaugcugcuuua

SEQ ID NO: 594600 - RNA, 19 nt, Homo sapiens
ugaaacggauccagcaauu

SEQ ID NO: 594601 - RNA, 19 nt, Homo sapiens
gcucugaacuggaugauac

SEQ ID NO: 594602 - RNA, 19 nt, Homo sapiens
ucaaggugcugaagcugua

SEQ ID NO: 594603 - RNA, 19 nt, Homo sapiens
ggacuugccuaaaauauau

SEQ ID NO: 594604 - RNA, 19 nt, Homo sapiens
gcacaccggcuuaacacua

SEQ ID NO: 594605 - RNA, 19 nt, Homo sapiens
agacagagauuggagagaa

SEQ ID NO: 594606 - RNA, 19 nt, Homo sapiens
ugggaguacugaugaaaua

SEQ ID NO: 594607 - RNA, 19 nt, Homo sapiens
ccaaauauguccgcagaau

SEQ ID NO: 594608 - RNA, 19 nt, Homo sapiens
gaccugcucuccuucauca

SEQ ID NO: 594609 - RNA, 19 nt, Homo sapiens
cagacagacuucaucauug

SEQ ID NO: 594610 - RNA, 19 nt, Homo sapiens
gagguggaguuccggaauu

SEQ ID NO: 594611 - RNA, 19 nt, Homo sapiens
ggugaaauccgcauugaug

SEQ ID NO: 594612 - RNA, 19 nt, Homo sapiens
ccacaguccuucuuugaca

SEQ ID NO: 594613 - RNA, 19 nt, Homo sapiens
ccagacagacuucaucauu

SEQ ID NO: 594614 - RNA, 19 nt, Homo sapiens
gaaauugucaaccucaugu

SEQ ID NO: 594615 - RNA, 19 nt, Homo sapiens
agaauggacuugauagcaa

SEQ ID NO: 594616 - RNA, 19 nt, Homo sapiens
agacagacuucaucauugu

SEQ ID NO: 594617 - RNA, 19 nt, Homo sapiens
uuacagugaugccgauauu

SEQ ID NO: 594618 - RNA, 19 nt, Homo sapiens
ucuguguccuuguuuaaua

SEQ ID NO: 594619 - RNA, 19 nt, Homo sapiens
gcucucagcugaccaucau

SEQ ID NO: 594620 - RNA, 19 nt, Homo sapiens
gaaggcaaagugcacauga

SEQ ID NO: 594621 - RNA, 19 nt, Homo sapiens
gaagcuagaaggcaaagug

SEQ ID NO: 594622 - RNA, 19 nt, Homo sapiens
ccacccugcugauacagua

SEQ ID NO: 594623 - RNA, 19 nt, Homo sapiens
ggacaaaggaguaguagcu

SEQ ID NO: 594624 - RNA, 19 nt, Homo sapiens
ccaucgaccuggagacuga

SEQ ID NO: 594625 - RNA, 19 nt, Homo sapiens
ggccaucugucuccuguau

SEQ ID NO: 594626 - RNA, 19 nt, Homo sapiens
ggaguacugaugaaauaaa

SEQ ID NO: 594627 - RNA, 19 nt, Homo sapiens
gcuggcaagucuuccauga

SEQ ID NO: 594628 - RNA, 19 nt, Homo sapiens
ucaccuaugugguccagaa

SEQ ID NO: 594629 - RNA, 19 nt, Homo sapiens
uggagagggucaaggagua

SEQ ID NO: 594630 - RNA, 19 nt, Homo sapiens
uacgaaugaugucagauuu

SEQ ID NO: 594631 - RNA, 19 nt, Homo sapiens
gaacugcguggugcucuuu

SEQ ID NO: 594632 - RNA, 19 nt, Homo sapiens
ggaaggcucugguuaucac

SEQ ID NO: 594633 - RNA, 19 nt, Homo sapiens
gcugaaugcuuuagaugag

SEQ ID NO: 594634 - RNA, 19 nt, Homo sapiens
aaggaaaugacaccaaaua

SEQ ID NO: 594635 - RNA, 19 nt, Homo sapiens
cgucuaugcugcuuuagga

SEQ ID NO: 594636 - RNA, 19 nt, Homo sapiens
guaccacgcuggccaucug

SEQ ID NO: 594637 - RNA, 19 nt, Homo sapiens
ugaagcggcuggaaucagu

SEQ ID NO: 594638 - RNA, 19 nt, Homo sapiens
guacguggacccaaacaau

SEQ ID NO: 594639 - RNA, 19 nt, Homo sapiens
cgaaugaugucagauuugg

SEQ ID NO: 594640 - RNA, 19 nt, Homo sapiens
ggaacucaguccuguacuc

SEQ ID NO: 594641 - RNA, 19 nt, Homo sapiens
ugaacuggaugauacgaau

SEQ ID NO: 594642 - RNA, 19 nt, Homo sapiens
guagacagaacaacacuuc

SEQ ID NO: 594643 - RNA, 19 nt, Homo sapiens
ccaacuuucucugcaacua

SEQ ID NO: 594644 - RNA, 19 nt, Homo sapiens
ccagguaaagcaaaugaaa

SEQ ID NO: 594645 - RNA, 19 nt, Homo sapiens
ggugcugccugaauccauu

SEQ ID NO: 594646 - RNA, 19 nt, Homo sapiens
caggugacauuugcucuga

SEQ ID NO: 594647 - RNA, 19 nt, Homo sapiens
caacugaagcggcuggaau

SEQ ID NO: 594648 - RNA, 19 nt, Homo sapiens
ccaucugucuccuguaugu

SEQ ID NO: 594649 - RNA, 19 nt, Homo sapiens
ucaguguguucugggauua

SEQ ID NO: 594650 - RNA, 19 nt, Homo sapiens
acaaugauccagucaccua

SEQ ID NO: 594651 - RNA, 19 nt, Homo sapiens
cgagaaggccuuugugucu

SEQ ID NO: 594652 - RNA, 19 nt, Homo sapiens
caggguaacugugcugaau

SEQ ID NO: 594653 - RNA, 19 nt, Homo sapiens
uuaacacuaucauggacua

SEQ ID NO: 594654 - RNA, 19 nt, Homo sapiens
ggaacugcguggugcucuu

SEQ ID NO: 594655 - RNA, 19 nt, Homo sapiens
agaagcaguuuaugagaca

SEQ ID NO: 594656 - RNA, 19 nt, Homo sapiens
ggaaauugucaaccucaug

SEQ ID NO: 594657 - RNA, 19 nt, Homo sapiens
caggaaggcucugguuauc

SEQ ID NO: 594658 - RNA, 19 nt, Homo sapiens
gaucuuacaacacuauuac

SEQ ID NO: 594659 - RNA, 19 nt, Homo sapiens
gguacucucugcccucauc

SEQ ID NO: 594660 - RNA, 19 nt, Homo sapiens
ccuaaaguuucguuucugu

SEQ ID NO: 594661 - RNA, 19 nt, Homo sapiens
ucagucagccgcucaccua

SEQ ID NO: 594662 - RNA, 19 nt, Homo sapiens
gcucuucacuguggucauc

SEQ ID NO: 594663 - RNA, 19 nt, Homo sapiens
aagauacgcucgccacagu

SEQ ID NO: 594664 - RNA, 19 nt, Homo sapiens
gcacugcugcacaacaaga

SEQ ID NO: 594665 - RNA, 19 nt, Homo sapiens
aggaggcacugcugauuga

SEQ ID NO: 594666 - RNA, 19 nt, Homo sapiens
guuggaaggugcagaggau

SEQ ID NO: 594667 - RNA, 19 nt, Homo sapiens
gaagggcauuaaccugucu

SEQ ID NO: 594668 - RNA, 19 nt, Homo sapiens
gcaucaaggugcugaagcu

SEQ ID NO: 594669 - RNA, 19 nt, Homo sapiens
caaccucauugcagcuaga

SEQ ID NO: 594670 - RNA, 19 nt, Homo sapiens
cacaccggcuuaacacuau

SEQ ID NO: 594671 - RNA, 19 nt, Homo sapiens
ccacaucacggcaacugaa

SEQ ID NO: 594672 - RNA, 19 nt, Homo sapiens
gaaggacucgcgcaucaag

SEQ ID NO: 594673 - RNA, 19 nt, Homo sapiens
caacugaguguuauuugca

SEQ ID NO: 594674 - RNA, 19 nt, Homo sapiens
guccagaagcaguuuauga

SEQ ID NO: 594675 - RNA, 19 nt, Homo sapiens
acacugcacuguuuucaaa

SEQ ID NO: 594676 - RNA, 19 nt, Homo sapiens
ccgcagaauggacuugaua

SEQ ID NO: 594677 - RNA, 19 nt, Homo sapiens
gaaggaaaugacaccaaau

SEQ ID NO: 594678 - RNA, 19 nt, Homo sapiens
cuaugcugcuuuaggaauu

SEQ ID NO: 594679 - RNA, 19 nt, Homo sapiens
gaagggcuccguggccuau

SEQ ID NO: 594680 - RNA, 19 nt, Homo sapiens
gaugcagucgcugaucuua

SEQ ID NO: 594681 - RNA, 19 nt, Homo sapiens
uuuaugaaaugaccucugu

SEQ ID NO: 594682 - RNA, 19 nt, Homo sapiens
caaauauguccgcagaaug

SEQ ID NO: 594683 - RNA, 19 nt, Homo sapiens
ugauacgaaugaugucaga

SEQ ID NO: 594684 - RNA, 19 nt, Homo sapiens
gaacuggaugauacgaaug

SEQ ID NO: 594685 - RNA, 19 nt, Homo sapiens
gacaguagacagaacaaca

SEQ ID NO: 594686 - RNA, 19 nt, Homo sapiens
ucgcugaucuuacaacacu

SEQ ID NO: 594687 - RNA, 19 nt, Homo sapiens
uaaggucacagcuaguuug

SEQ ID NO: 594688 - RNA, 19 nt, Homo sapiens
gcugcucaauuccuucuuc

SEQ ID NO: 594689 - RNA, 19 nt, Homo sapiens
gaucuuagcuccaaucuug

SEQ ID NO: 594690 - RNA, 19 nt, Homo sapiens
gaaaugggaccuauaguua

SEQ ID NO: 594691 - RNA, 19 nt, Homo sapiens
agaagaagcuugugguaua

SEQ ID NO: 594692 - RNA, 19 nt, Homo sapiens
gaagaagcuugugguauaa

SEQ ID NO: 594693 - RNA, 19 nt, Homo sapiens
ggacaacgccaaauuuaaa

SEQ ID NO: 594694 - RNA, 19 nt, Homo sapiens
ucacugaggucuaaauuug

SEQ ID NO: 594695 - RNA, 19 nt, Homo sapiens
gcugugaacucugaucuua

SEQ ID NO: 594696 - RNA, 19 nt, Homo sapiens
gagaaauacuuccauuaug

SEQ ID NO: 594697 - RNA, 19 nt, Homo sapiens
gagaagcggugacacgauu

SEQ ID NO: 594698 - RNA, 19 nt, Homo sapiens
agauccagcugaaauauua

SEQ ID NO: 594699 - RNA, 19 nt, Homo sapiens
aaagagaacuuacaaagca

SEQ ID NO: 594700 - RNA, 19 nt, Homo sapiens
ggaauuugcuacugacuca

SEQ ID NO: 594701 - RNA, 19 nt, Homo sapiens
ggaaaugggaccuauaguu

SEQ ID NO: 594702 - RNA, 19 nt, Homo sapiens
ggagaaaguuaaugagaca

SEQ ID NO: 594703 - RNA, 19 nt, Homo sapiens
aaacugggcuggagcaaga

SEQ ID NO: 594704 - RNA, 19 nt, Homo sapiens
gaagaaagaaugcaaaguc

SEQ ID NO: 594705 - RNA, 19 nt, Homo sapiens
cauauucacugaggucuaa

SEQ ID NO: 594706 - RNA, 19 nt, Homo sapiens
cagaauagaugaucacaac

SEQ ID NO: 594707 - RNA, 19 nt, Homo sapiens
ugaaaucaaugccgugaga

SEQ ID NO: 594708 - RNA, 19 nt, Homo sapiens
gcugaaagcuuuuaauaug

SEQ ID NO: 594709 - RNA, 19 nt, Homo sapiens
gugacacgauuucuaauga

SEQ ID NO: 594710 - RNA, 19 nt, Homo sapiens
agagauacuucuggucuua

SEQ ID NO: 594711 - RNA, 19 nt, Homo sapiens
cgagacagccguugcaauu

SEQ ID NO: 594712 - RNA, 19 nt, Homo sapiens
gagaugaggacgaagauga

SEQ ID NO: 594713 - RNA, 19 nt, Homo sapiens
gacuacaacaugccaauua

SEQ ID NO: 594714 - RNA, 19 nt, Homo sapiens
gaauuugacaugagugauu

SEQ ID NO: 594715 - RNA, 19 nt, Homo sapiens
gaacuuacaaagcaauuuc

SEQ ID NO: 594716 - RNA, 19 nt, Homo sapiens
gagaacaaauucggaaaca

SEQ ID NO: 594717 - RNA, 19 nt, Homo sapiens
gcaagucuccugcacauag

SEQ ID NO: 594718 - RNA, 19 nt, Homo sapiens
uaaagagaccgaccgcuaa

SEQ ID NO: 594719 - RNA, 19 nt, Homo sapiens
ggaugguccuggucacaaa

SEQ ID NO: 594720 - RNA, 19 nt, Homo sapiens
gaacgagaggcgagagaaa

SEQ ID NO: 594721 - RNA, 19 nt, Homo sapiens
gcagcuaacuucggaauac

SEQ ID NO: 594722 - RNA, 19 nt, Homo sapiens
uagaugaucacaacaguaa

SEQ ID NO: 594723 - RNA, 19 nt, Homo sapiens
ugacaugagugauucaaca

SEQ ID NO: 594724 - RNA, 19 nt, Homo sapiens
gaaacacgcuggacaaaag

SEQ ID NO: 594725 - RNA, 19 nt, Homo sapiens
uagcugugguugaagauuu

SEQ ID NO: 594726 - RNA, 19 nt, Homo sapiens
ucacaacaguaaugggaaa

SEQ ID NO: 594727 - RNA, 19 nt, Homo sapiens
gggcacaguucaauugcuu

SEQ ID NO: 594728 - RNA, 19 nt, Homo sapiens
uuaaggugcuucaaaggaa

SEQ ID NO: 594729 - RNA, 19 nt, Homo sapiens
uggaacagaucauaaagau

SEQ ID NO: 594730 - RNA, 19 nt, Homo sapiens
aaggaacucugaccucuga

SEQ ID NO: 594731 - RNA, 19 nt, Homo sapiens
uaucuuggcuucagcuugu

SEQ ID NO: 594732 - RNA, 19 nt, Homo sapiens
agaaauacuuccauuaugc

SEQ ID NO: 594733 - RNA, 19 nt, Homo sapiens
gagacagccguugcaauua

SEQ ID NO: 594734 - RNA, 19 nt, Homo sapiens
uaaauuugcaguuccacua

SEQ ID NO: 594735 - RNA, 19 nt, Homo sapiens
gcggugacacgauuucuaa

SEQ ID NO: 594736 - RNA, 19 nt, Homo sapiens
ucaagauccagcugaaaua

SEQ ID NO: 594737 - RNA, 19 nt, Homo sapiens
ccgagcggcugaaagcuuu

SEQ ID NO: 594738 - RNA, 19 nt, Homo sapiens
ggaacagaucauaaagaua

SEQ ID NO: 594739 - RNA, 19 nt, Homo sapiens
gcugaaauauuaguggaau

SEQ ID NO: 594740 - RNA, 19 nt, Homo sapiens
ggcuaucuauucuuaauuc

SEQ ID NO: 594741 - RNA, 19 nt, Homo sapiens
gaauggucccaaucucuaa

SEQ ID NO: 594742 - RNA, 19 nt, Homo sapiens
ccaaauggagaacaaauuc

SEQ ID NO: 594743 - RNA, 19 nt, Homo sapiens
gaaaugccgccaagaggau

SEQ ID NO: 594744 - RNA, 19 nt, Homo sapiens
ccuauuccuucccaccuua

SEQ ID NO: 594745 - RNA, 19 nt, Homo sapiens
gacaauucccugaguauca

SEQ ID NO: 594746 - RNA, 19 nt, Homo sapiens
ccagcaagaugaugauucu

SEQ ID NO: 594747 - RNA, 19 nt, Homo sapiens
gaugucagcugugaacucu

SEQ ID NO: 594748 - RNA, 19 nt, Homo sapiens
agagagcuaugccuuccua

SEQ ID NO: 594749 - RNA, 19 nt, Homo sapiens
gaugagaagcuaucuuuac

SEQ ID NO: 594750 - RNA, 19 nt, Homo sapiens
ccacggacaacgccaaauu

SEQ ID NO: 594751 - RNA, 19 nt, Homo sapiens
gacagacgaccaccauauu

SEQ ID NO: 594752 - RNA, 19 nt, Homo sapiens
gaguccaacugaaaucaau

SEQ ID NO: 594753 - RNA, 19 nt, Homo sapiens
gaugaucacaacaguaaug

SEQ ID NO: 594754 - RNA, 19 nt, Homo sapiens
ugaccagcaugauugacua

SEQ ID NO: 594755 - RNA, 19 nt, Homo sapiens
ccaccuuacuucagcaguu

SEQ ID NO: 594756 - RNA, 19 nt, Homo sapiens
cgaauggucccaaucucua

SEQ ID NO: 594757 - RNA, 19 nt, Homo sapiens
auccguaagugauguguua

SEQ ID NO: 594758 - RNA, 19 nt, Homo sapiens
cgaccaccauauucacuga

SEQ ID NO: 594759 - RNA, 19 nt, Homo sapiens
cagcugaguccaacugaaa

SEQ ID NO: 594760 - RNA, 19 nt, Homo sapiens
gagaguaucuuggcuucag

SEQ ID NO: 594761 - RNA, 19 nt, Homo sapiens
acacggaugucagcuguga

SEQ ID NO: 594762 - RNA, 19 nt, Homo sapiens
uaaacucacagcaagauga

SEQ ID NO: 594763 - RNA, 19 nt, Homo sapiens
gaaaagauccaggcuauca

SEQ ID NO: 594764 - RNA, 19 nt, Homo sapiens
caagaugaacagccacuga

SEQ ID NO: 594765 - RNA, 19 nt, Homo sapiens
ccagauggaacagaucaua

SEQ ID NO: 594766 - RNA, 19 nt, Homo sapiens
aaacccagauggaacagau

SEQ ID NO: 594767 - RNA, 19 nt, Homo sapiens
caauggaaaugggaccuau

SEQ ID NO: 594768 - RNA, 19 nt, Homo sapiens
gaggaugcgucuggagaga

SEQ ID NO: 594769 - RNA, 19 nt, Homo sapiens
gagagugagaguagaaaug

SEQ ID NO: 594770 - RNA, 19 nt, Homo sapiens
ggcgacaauucccugagua

SEQ ID NO: 594771 - RNA, 19 nt, Homo sapiens
gcauuuaaacccagaugga

SEQ ID NO: 594772 - RNA, 19 nt, Homo sapiens
ggguagcugugguugaaga

SEQ ID NO: 594773 - RNA, 19 nt, Homo sapiens
ucgagaaucagcugcauuu

SEQ ID NO: 594774 - RNA, 19 nt, Homo sapiens
gacagcuuguugcaggaua

SEQ ID NO: 594775 - RNA, 19 nt, Homo sapiens
ucucuaagcagcccaaaga

SEQ ID NO: 594776 - RNA, 19 nt, Homo sapiens
ccaugacgauucggagaaa

SEQ ID NO: 594777 - RNA, 19 nt, Homo sapiens
agacagccguugcaauuac

SEQ ID NO: 594778 - RNA, 19 nt, Homo sapiens
gaauagaugaucacaacag

SEQ ID NO: 594779 - RNA, 19 nt, Homo sapiens
gcaagaugaggaugaaagu

SEQ ID NO: 594780 - RNA, 19 nt, Homo sapiens
cauaaaaggcuaucuauuc

SEQ ID NO: 594781 - RNA, 19 nt, Homo sapiens
ugcaggauaucgagaauca

SEQ ID NO: 594782 - RNA, 19 nt, Homo sapiens
cgacauguaccgccaguuc

SEQ ID NO: 594783 - RNA, 19 nt, Homo sapiens
acaauucccugaguaucaa

SEQ ID NO: 594784 - RNA, 19 nt, Homo sapiens
caagauccagcugaaauau

SEQ ID NO: 594785 - RNA, 19 nt, Homo sapiens
ccaggccacuuacucaaca

SEQ ID NO: 594786 - RNA, 19 nt, Homo sapiens
guagaaaugccgccaagag

SEQ ID NO: 594787 - RNA, 19 nt, Homo sapiens
ggaccucgcaucccugcaa

SEQ ID NO: 594788 - RNA, 19 nt, Homo sapiens
uuucugaccucaagaugga

SEQ ID NO: 594789 - RNA, 19 nt, Homo sapiens
gaggagcgcuguuugaguu

SEQ ID NO: 594790 - RNA, 19 nt, Homo sapiens
ugaagcaccuugaucuuug

SEQ ID NO: 594791 - RNA, 19 nt, Homo sapiens
gggcagcgcauaccuguuu

SEQ ID NO: 594792 - RNA, 19 nt, Homo sapiens
gaaccuggauggccuuagg

SEQ ID NO: 594793 - RNA, 19 nt, Homo sapiens
ggacgaggagcgcuguuug

SEQ ID NO: 594794 - RNA, 19 nt, Homo sapiens
cgaauguuaagcaaugaua

SEQ ID NO: 594795 - RNA, 19 nt, Homo sapiens
gaagcaccuugaucuuugg

SEQ ID NO: 594796 - RNA, 19 nt, Homo sapiens
gcagccagcuuuuggagaa

SEQ ID NO: 594797 - RNA, 19 nt, Homo sapiens
gagaucagccucaccuucu

SEQ ID NO: 594798 - RNA, 19 nt, Homo sapiens
ugccucagguacuuugaua

SEQ ID NO: 594799 - RNA, 19 nt, Homo sapiens
gcuccgggaugaagaacug

SEQ ID NO: 594800 - RNA, 19 nt, Homo sapiens
cagccagcccuuacaguuu

SEQ ID NO: 594801 - RNA, 19 nt, Homo sapiens
ucagguacuuugauagagu

SEQ ID NO: 594802 - RNA, 19 nt, Homo sapiens
uggaggcacucgaggagaa

SEQ ID NO: 594803 - RNA, 19 nt, Homo sapiens
gaggaugcgcugcgaaauc

SEQ ID NO: 594804 - RNA, 19 nt, Homo sapiens
agcagaagguggcagugua

SEQ ID NO: 594805 - RNA, 19 nt, Homo sapiens
ggaccugcuuuggagauca

SEQ ID NO: 594806 - RNA, 19 nt, Homo sapiens
gaaacuccacuuggccuau

SEQ ID NO: 594807 - RNA, 19 nt, Homo sapiens
gacgaggagcgcuguuuga

SEQ ID NO: 594808 - RNA, 19 nt, Homo sapiens
ugaaggaccaacagacguu

SEQ ID NO: 594809 - RNA, 19 nt, Homo sapiens
ccuuacaguuucacucaug

SEQ ID NO: 594810 - RNA, 19 nt, Homo sapiens
ccucagguacuuugauaga

SEQ ID NO: 594811 - RNA, 19 nt, Homo sapiens
cauccugggugcugcagau

SEQ ID NO: 594812 - RNA, 19 nt, Homo sapiens
gauucugccucagguacuu

SEQ ID NO: 594813 - RNA, 19 nt, Homo sapiens
gggucagccuguagugaau

SEQ ID NO: 594814 - RNA, 19 nt, Homo sapiens
gaugcgcugcgaaaucuga

SEQ ID NO: 594815 - RNA, 19 nt, Homo sapiens
gauggcagcugggcaaaau

SEQ ID NO: 594816 - RNA, 19 nt, Homo sapiens
gcagaagguggcaguguac

SEQ ID NO: 594817 - RNA, 19 nt, Homo sapiens
uggacucgcuggccuacga

SEQ ID NO: 594818 - RNA, 19 nt, Homo sapiens
gcucugugggucucaaaug

SEQ ID NO: 594819 - RNA, 19 nt, Homo sapiens
gcccuuacaguuucacuca

SEQ ID NO: 594820 - RNA, 19 nt, Homo sapiens
ucaugaagcaccuugaucu

SEQ ID NO: 594821 - RNA, 19 nt, Homo sapiens
agccagcccuuacaguuuc

SEQ ID NO: 594822 - RNA, 19 nt, Homo sapiens
aaacuccacuuggccuauc

SEQ ID NO: 594823 - RNA, 19 nt, Homo sapiens
acagccagcccuuacaguu

SEQ ID NO: 594824 - RNA, 19 nt, Homo sapiens
gagaaccuggauggccuua

SEQ ID NO: 594825 - RNA, 19 nt, Homo sapiens
caugaagcaccuugaucuu

SEQ ID NO: 594826 - RNA, 19 nt, Homo sapiens
cuuacaguuucacucauga

SEQ ID NO: 594827 - RNA, 19 nt, Homo sapiens
aggaugcgcugcgaaaucu

SEQ ID NO: 594828 - RNA, 19 nt, Homo sapiens
gagcgcuguuugaguugca

SEQ ID NO: 594829 - RNA, 19 nt, Homo sapiens
cgugggaccccgaauguua

SEQ ID NO: 594830 - RNA, 19 nt, Homo sapiens
ggaggaugcgcugcgaaau

SEQ ID NO: 594831 - RNA, 19 nt, Homo sapiens
gaggagcgcuguuugaguu

SEQ ID NO: 594832 - RNA, 19 nt, Homo sapiens
ggaugucucucuccucuuu

SEQ ID NO: 594833 - RNA, 19 nt, Homo sapiens
gcucacuccuuucuacuaa

SEQ ID NO: 594834 - RNA, 19 nt, Homo sapiens
ugaagcaccuugaucuuug

SEQ ID NO: 594835 - RNA, 19 nt, Homo sapiens
gaaccuggauggccuuagg

SEQ ID NO: 594836 - RNA, 19 nt, Homo sapiens
ucacuccuuucuacuaauu

SEQ ID NO: 594837 - RNA, 19 nt, Homo sapiens
ucgagucuguguaugauuu

SEQ ID NO: 594838 - RNA, 19 nt, Homo sapiens
ccagccggcucacuccuuu

SEQ ID NO: 594839 - RNA, 19 nt, Homo sapiens
ggacgaggagcgcuguuug

SEQ ID NO: 594840 - RNA, 19 nt, Homo sapiens
gguuauugcuguuuguauc

SEQ ID NO: 594841 - RNA, 19 nt, Homo sapiens
cgaauguuaagcaaugaua

SEQ ID NO: 594842 - RNA, 19 nt, Homo sapiens
gaagcaccuugaucuuugg

SEQ ID NO: 594843 - RNA, 19 nt, Homo sapiens
gacagauccuggucuucuu

SEQ ID NO: 594844 - RNA, 19 nt, Homo sapiens
gcagccagcuuuuggagaa

SEQ ID NO: 594845 - RNA, 19 nt, Homo sapiens
gagaucagccucaccuucu

SEQ ID NO: 594846 - RNA, 19 nt, Homo sapiens
ugccucagguacuuugaua

SEQ ID NO: 594847 - RNA, 19 nt, Homo sapiens
gcuccgggaugaagaacug

SEQ ID NO: 594848 - RNA, 19 nt, Homo sapiens
cagccagcccuuacaguuu

SEQ ID NO: 594849 - RNA, 19 nt, Homo sapiens
ucagguacuuugauagagu

SEQ ID NO: 594850 - RNA, 19 nt, Homo sapiens
uuaccaauuugugcacuaa

SEQ ID NO: 594851 - RNA, 19 nt, Homo sapiens
uggaggcacucgaggagaa

SEQ ID NO: 594852 - RNA, 19 nt, Homo sapiens
gaggaugcgcugcgaaauc

SEQ ID NO: 594853 - RNA, 19 nt, Homo sapiens
cuacccagacggcuuguuu

SEQ ID NO: 594854 - RNA, 19 nt, Homo sapiens
ggaccugcuuuggagauca

SEQ ID NO: 594855 - RNA, 19 nt, Homo sapiens
gaaacuccacuuggccuau

SEQ ID NO: 594856 - RNA, 19 nt, Homo sapiens
gacgaggagcgcuguuuga

SEQ ID NO: 594857 - RNA, 19 nt, Homo sapiens
ugaaggaccaacagacguu

SEQ ID NO: 594858 - RNA, 19 nt, Homo sapiens
ccuuacaguuucacucaug

SEQ ID NO: 594859 - RNA, 19 nt, Homo sapiens
uggcacccacucugucuua

SEQ ID NO: 594860 - RNA, 19 nt, Homo sapiens
cuucgaagucccucucuuu

SEQ ID NO: 594861 - RNA, 19 nt, Homo sapiens
ccucagguacuuugauaga

SEQ ID NO: 594862 - RNA, 19 nt, Homo sapiens
gcuguuuguaucccaauuu

SEQ ID NO: 594863 - RNA, 19 nt, Homo sapiens
cauccugggugcugcagau

SEQ ID NO: 594864 - RNA, 19 nt, Homo sapiens
gauucugccucagguacuu

SEQ ID NO: 594865 - RNA, 19 nt, Homo sapiens
gggucagccuguagugaau

SEQ ID NO: 594866 - RNA, 19 nt, Homo sapiens
gaugcgcugcgaaaucuga

SEQ ID NO: 594867 - RNA, 19 nt, Homo sapiens
ggucuucuuucuggguuau

SEQ ID NO: 594868 - RNA, 19 nt, Homo sapiens
cgagucuguguaugauuua

SEQ ID NO: 594869 - RNA, 19 nt, Homo sapiens
uggacucgcuggccuacga

SEQ ID NO: 594870 - RNA, 19 nt, Homo sapiens
gcucugugggucucaaaug

SEQ ID NO: 594871 - RNA, 19 nt, Homo sapiens
ugacagauccuggucuucu

SEQ ID NO: 594872 - RNA, 19 nt, Homo sapiens
ugugacagauccuggucuu

SEQ ID NO: 594873 - RNA, 19 nt, Homo sapiens
ggaggccgaagaccugaga

SEQ ID NO: 594874 - RNA, 19 nt, Homo sapiens
gaggauaggcguguguucu

SEQ ID NO: 594875 - RNA, 19 nt, Homo sapiens
gcccuuacaguuucacuca

SEQ ID NO: 594876 - RNA, 19 nt, Homo sapiens
ucaugaagcaccuugaucu

SEQ ID NO: 594877 - RNA, 19 nt, Homo sapiens
agccagcccuuacaguuuc

SEQ ID NO: 594878 - RNA, 19 nt, Homo sapiens
aaacuccacuuggccuauc

SEQ ID NO: 594879 - RNA, 19 nt, Homo sapiens
acagccagcccuuacaguu

SEQ ID NO: 594880 - RNA, 19 nt, Homo sapiens
cguguguucucgagucugu

SEQ ID NO: 594881 - RNA, 19 nt, Homo sapiens
gagaaccuggauggccuua

SEQ ID NO: 594882 - RNA, 19 nt, Homo sapiens
acagauccuggucuucuuu

SEQ ID NO: 594883 - RNA, 19 nt, Homo sapiens
caugaagcaccuugaucuu

SEQ ID NO: 594884 - RNA, 19 nt, Homo sapiens
cuuacaguuucacucauga

SEQ ID NO: 594885 - RNA, 19 nt, Homo sapiens
aggaugcgcugcgaaaucu

SEQ ID NO: 594886 - RNA, 19 nt, Homo sapiens
gagcgcuguuugaguugca

SEQ ID NO: 594887 - RNA, 19 nt, Homo sapiens
cgugggaccccgaauguua

SEQ ID NO: 594888 - RNA, 19 nt, Homo sapiens
ggaggaugcgcugcgaaau

SEQ ID NO: 594889 - RNA, 19 nt, Homo sapiens
ucucgagucuguguaugau

SEQ ID NO: 594890 - RNA, 19 nt, Homo sapiens
caagaagauuggucuguuu

SEQ ID NO: 594891 - RNA, 19 nt, Homo sapiens
gaagaagcacgaacgaaug

SEQ ID NO: 594892 - RNA, 19 nt, Homo sapiens
gaaccaccauaauucugaa

SEQ ID NO: 594893 - RNA, 19 nt, Homo sapiens
gaucugcaccguccaguug

SEQ ID NO: 594894 - RNA, 19 nt, Homo sapiens
gggagaaccaccauaauuc

SEQ ID NO: 594895 - RNA, 19 nt, Homo sapiens
ugagaucgcgguauuaaau

SEQ ID NO: 594896 - RNA, 19 nt, Homo sapiens
ccgcagagauacugacugu

SEQ ID NO: 594897 - RNA, 19 nt, Homo sapiens
gguauuaaaucugugaaag

SEQ ID NO: 594898 - RNA, 19 nt, Homo sapiens
ugaagacauuucucaacuu

SEQ ID NO: 594899 - RNA, 19 nt, Homo sapiens
cgaagaagcacgaacgaau

SEQ ID NO: 594900 - RNA, 19 nt, Homo sapiens
acacacggcuacucuguuc

SEQ ID NO: 594901 - RNA, 19 nt, Homo sapiens
gugaagacauuucucaacu

SEQ ID NO: 594902 - RNA, 19 nt, Homo sapiens
acaagaagauuggucuguu

SEQ ID NO: 594903 - RNA, 19 nt, Homo sapiens
gcugagaucgcgguauuaa

SEQ ID NO: 594904 - RNA, 19 nt, Homo sapiens
uggcugagaucgcgguauu

SEQ ID NO: 594905 - RNA, 19 nt, Homo sapiens
gaagcccuaaguacgguua

SEQ ID NO: 594906 - RNA, 19 nt, Homo sapiens
gccggugacuuccacaaga

SEQ ID NO: 594907 - RNA, 19 nt, Homo sapiens
ugggagaaccaccauaauu

SEQ ID NO: 594908 - RNA, 19 nt, Homo sapiens
gaaccacgacgggcagaga

SEQ ID NO: 594909 - RNA, 19 nt, Homo sapiens
ugacagcagugagaagauc

SEQ ID NO: 594910 - RNA, 19 nt, Homo sapiens
agacauuucucaacuucuc

SEQ ID NO: 594911 - RNA, 19 nt, Homo sapiens
ccggugacuuccacaagaa

SEQ ID NO: 594912 - RNA, 19 nt, Homo sapiens
gaagauuggucuguuuugu

SEQ ID NO: 594913 - RNA, 19 nt, Homo sapiens
caacuccaccugccuugug

SEQ ID NO: 594914 - RNA, 19 nt, Homo sapiens
ugacugugccggugacuuc

SEQ ID NO: 594915 - RNA, 19 nt, Homo sapiens
gacacccgcuguggcugua

SEQ ID NO: 594916 - RNA, 19 nt, Homo sapiens
ccugggagaaccaccauaa

SEQ ID NO: 594917 - RNA, 19 nt, Homo sapiens
ggccggaguuuggcugaga

SEQ ID NO: 594918 - RNA, 19 nt, Homo sapiens
gagaccagcaguacgagau

SEQ ID NO: 594919 - RNA, 19 nt, Homo sapiens
ccugguuacugcagaugaa

SEQ ID NO: 594920 - RNA, 19 nt, Homo sapiens
gcagcucuacgacgugaug

SEQ ID NO: 594921 - RNA, 19 nt, Homo sapiens
ccacccugaccuacacaua

SEQ ID NO: 594922 - RNA, 19 nt, Homo sapiens
ccacacacggcuacucugu

SEQ ID NO: 594923 - RNA, 19 nt, Homo sapiens
acuuaugcguguagacauu

SEQ ID NO: 594924 - RNA, 19 nt, Homo sapiens
gagaucgcgguauuaaauc

SEQ ID NO: 594925 - RNA, 19 nt, Homo sapiens
gcgaagaagcacgaacgaa

SEQ ID NO: 594926 - RNA, 19 nt, Homo sapiens
cugccugccuggcuucuau

SEQ ID NO: 594927 - RNA, 19 nt, Homo sapiens
gcgcgaggcagagaucgaa

SEQ ID NO: 594928 - RNA, 19 nt, Homo sapiens
ggugaagacauuucucaac

SEQ ID NO: 594929 - RNA, 19 nt, Homo sapiens
cagccaaggcgaagaagca

SEQ ID NO: 594930 - RNA, 19 nt, Homo sapiens
aagaagcacgaacgaaugu

SEQ ID NO: 594931 - RNA, 19 nt, Homo sapiens
caagaagauuggucuguuu

SEQ ID NO: 594932 - RNA, 19 nt, Homo sapiens
gaagaagcacgaacgaaug

SEQ ID NO: 594933 - RNA, 19 nt, Homo sapiens
gaaccaccauaauucugaa

SEQ ID NO: 594934 - RNA, 19 nt, Homo sapiens
gaucugcaccguccaguug

SEQ ID NO: 594935 - RNA, 19 nt, Homo sapiens
gggagaaccaccauaauuc

SEQ ID NO: 594936 - RNA, 19 nt, Homo sapiens
ugagaucgcgguauuaaau

SEQ ID NO: 594937 - RNA, 19 nt, Homo sapiens
ccgcagagauacugacugu

SEQ ID NO: 594938 - RNA, 19 nt, Homo sapiens
gguauuaaaucugugaaag

SEQ ID NO: 594939 - RNA, 19 nt, Homo sapiens
ugaagacauuucucaacuu

SEQ ID NO: 594940 - RNA, 19 nt, Homo sapiens
cgaagaagcacgaacgaau

SEQ ID NO: 594941 - RNA, 19 nt, Homo sapiens
acacacggcuacucuguuc

SEQ ID NO: 594942 - RNA, 19 nt, Homo sapiens
gugaagacauuucucaacu

SEQ ID NO: 594943 - RNA, 19 nt, Homo sapiens
acaagaagauuggucuguu

SEQ ID NO: 594944 - RNA, 19 nt, Homo sapiens
gcugagaucgcgguauuaa

SEQ ID NO: 594945 - RNA, 19 nt, Homo sapiens
uggcugagaucgcgguauu

SEQ ID NO: 594946 - RNA, 19 nt, Homo sapiens
gaagcccuaaguacgguua

SEQ ID NO: 594947 - RNA, 19 nt, Homo sapiens
gccggugacuuccacaaga

SEQ ID NO: 594948 - RNA, 19 nt, Homo sapiens
ugggagaaccaccauaauu

SEQ ID NO: 594949 - RNA, 19 nt, Homo sapiens
gaaccacgacgggcagaga

SEQ ID NO: 594950 - RNA, 19 nt, Homo sapiens
ugacagcagugagaagauc

SEQ ID NO: 594951 - RNA, 19 nt, Homo sapiens
agacauuucucaacuucuc

SEQ ID NO: 594952 - RNA, 19 nt, Homo sapiens
ccggugacuuccacaagaa

SEQ ID NO: 594953 - RNA, 19 nt, Homo sapiens
gaagauuggucuguuuugu

SEQ ID NO: 594954 - RNA, 19 nt, Homo sapiens
caacuccaccugccuugug

SEQ ID NO: 594955 - RNA, 19 nt, Homo sapiens
ugacugugccggugacuuc

SEQ ID NO: 594956 - RNA, 19 nt, Homo sapiens
gacacccgcuguggcugua

SEQ ID NO: 594957 - RNA, 19 nt, Homo sapiens
ccugggagaaccaccauaa

SEQ ID NO: 594958 - RNA, 19 nt, Homo sapiens
ggccggaguuuggcugaga

SEQ ID NO: 594959 - RNA, 19 nt, Homo sapiens
gagaccagcaguacgagau

SEQ ID NO: 594960 - RNA, 19 nt, Homo sapiens
ccugguuacugcagaugaa

SEQ ID NO: 594961 - RNA, 19 nt, Homo sapiens
gcagcucuacgacgugaug

SEQ ID NO: 594962 - RNA, 19 nt, Homo sapiens
ccacccugaccuacacaua

SEQ ID NO: 594963 - RNA, 19 nt, Homo sapiens
ccacacacggcuacucugu

SEQ ID NO: 594964 - RNA, 19 nt, Homo sapiens
acuuaugcguguagacauu

SEQ ID NO: 594965 - RNA, 19 nt, Homo sapiens
gagaucgcgguauuaaauc

SEQ ID NO: 594966 - RNA, 19 nt, Homo sapiens
gcgaagaagcacgaacgaa

SEQ ID NO: 594967 - RNA, 19 nt, Homo sapiens
cugccugccuggcuucuau

SEQ ID NO: 594968 - RNA, 19 nt, Homo sapiens
gcgcgaggcagagaucgaa

SEQ ID NO: 594969 - RNA, 19 nt, Homo sapiens
ggugaagacauuucucaac

SEQ ID NO: 594970 - RNA, 19 nt, Homo sapiens
cagccaaggcgaagaagca

SEQ ID NO: 594971 - RNA, 19 nt, Homo sapiens
ggaggcagaguaggugugu

SEQ ID NO: 594972 - RNA, 19 nt, Homo sapiens
aagaagcacgaacgaaugu

SEQ ID NO: 594973 - RNA, 19 nt, Homo sapiens
caagaagauuggucuguuu

SEQ ID NO: 594974 - RNA, 19 nt, Homo sapiens
gaagaagcacgaacgaaug

SEQ ID NO: 594975 - RNA, 19 nt, Homo sapiens
gaaccaccauaauucugaa

SEQ ID NO: 594976 - RNA, 19 nt, Homo sapiens
gaucugcaccguccaguug

SEQ ID NO: 594977 - RNA, 19 nt, Homo sapiens
gggagaaccaccauaauuc

SEQ ID NO: 594978 - RNA, 19 nt, Homo sapiens
ugagaucgcgguauuaaau

SEQ ID NO: 594979 - RNA, 19 nt, Homo sapiens
ccgcagagauacugacugu

SEQ ID NO: 594980 - RNA, 19 nt, Homo sapiens
gguauuaaaucugugaaag

SEQ ID NO: 594981 - RNA, 19 nt, Homo sapiens
ugaagacauuucucaacuu

SEQ ID NO: 594982 - RNA, 19 nt, Homo sapiens
cgaagaagcacgaacgaau

SEQ ID NO: 594983 - RNA, 19 nt, Homo sapiens
acacacggcuacucuguuc

SEQ ID NO: 594984 - RNA, 19 nt, Homo sapiens
gugaagacauuucucaacu

SEQ ID NO: 594985 - RNA, 19 nt, Homo sapiens
acaagaagauuggucuguu

SEQ ID NO: 594986 - RNA, 19 nt, Homo sapiens
gcugagaucgcgguauuaa

SEQ ID NO: 594987 - RNA, 19 nt, Homo sapiens
uggcugagaucgcgguauu

SEQ ID NO: 594988 - RNA, 19 nt, Homo sapiens
gaagcccuaaguacgguua

SEQ ID NO: 594989 - RNA, 19 nt, Homo sapiens
gccggugacuuccacaaga

SEQ ID NO: 594990 - RNA, 19 nt, Homo sapiens
ugggagaaccaccauaauu

SEQ ID NO: 594991 - RNA, 19 nt, Homo sapiens
gaaccacgacgggcagaga

SEQ ID NO: 594992 - RNA, 19 nt, Homo sapiens
ugacagcagugagaagauc

SEQ ID NO: 594993 - RNA, 19 nt, Homo sapiens
agacauuucucaacuucuc

SEQ ID NO: 594994 - RNA, 19 nt, Homo sapiens
ccggugacuuccacaagaa

SEQ ID NO: 594995 - RNA, 19 nt, Homo sapiens
gaagauuggucuguuuugu

SEQ ID NO: 594996 - RNA, 19 nt, Homo sapiens
caacuccaccugccuugug

SEQ ID NO: 594997 - RNA, 19 nt, Homo sapiens
ugacugugccggugacuuc

SEQ ID NO: 594998 - RNA, 19 nt, Homo sapiens
gacacccgcuguggcugua

SEQ ID NO: 594999 - RNA, 19 nt, Homo sapiens
ccugggagaaccaccauaa

SEQ ID NO: 595000 - RNA, 19 nt, Homo sapiens
ggccggaguuuggcugaga

SEQ ID NO: 595001 - RNA, 19 nt, Homo sapiens
gagaccagcaguacgagau

SEQ ID NO: 595002 - RNA, 19 nt, Homo sapiens
gcagcucuacgacgugaug

SEQ ID NO: 595003 - RNA, 19 nt, Homo sapiens
ccacacacggcuacucugu

SEQ ID NO: 595004 - RNA, 19 nt, Homo sapiens
acuuaugcguguagacauu

SEQ ID NO: 595005 - RNA, 19 nt, Homo sapiens
gagaucgcgguauuaaauc

SEQ ID NO: 595006 - RNA, 19 nt, Homo sapiens
gcgaagaagcacgaacgaa

SEQ ID NO: 595007 - RNA, 19 nt, Homo sapiens
cugccugccuggcuucuau

SEQ ID NO: 595008 - RNA, 19 nt, Homo sapiens
gcgcgaggcagagaucgaa

SEQ ID NO: 595009 - RNA, 19 nt, Homo sapiens
ggugaagacauuucucaac

SEQ ID NO: 595010 - RNA, 19 nt, Homo sapiens
cagccaaggcgaagaagca

SEQ ID NO: 595011 - RNA, 19 nt, Homo sapiens
aagaagcacgaacgaaugu

SEQ ID NO: 595012 - RNA, 19 nt, Homo sapiens
caagaagauuggucuguuu

SEQ ID NO: 595013 - RNA, 19 nt, Homo sapiens
gaagaagcacgaacgaaug

SEQ ID NO: 595014 - RNA, 19 nt, Homo sapiens
gaucugcaccguccaguug

SEQ ID NO: 595015 - RNA, 19 nt, Homo sapiens
ugagaucgcgguauuaaau

SEQ ID NO: 595016 - RNA, 19 nt, Homo sapiens
ccgcagagauacugacugu

SEQ ID NO: 595017 - RNA, 19 nt, Homo sapiens
gguauuaaaucugugaaag

SEQ ID NO: 595018 - RNA, 19 nt, Homo sapiens
ugaagacauuucucaacuu

SEQ ID NO: 595019 - RNA, 19 nt, Homo sapiens
cgaagaagcacgaacgaau

SEQ ID NO: 595020 - RNA, 19 nt, Homo sapiens
acacacggcuacucuguuc

SEQ ID NO: 595021 - RNA, 19 nt, Homo sapiens
gugaagacauuucucaacu

SEQ ID NO: 595022 - RNA, 19 nt, Homo sapiens
acaagaagauuggucuguu

SEQ ID NO: 595023 - RNA, 19 nt, Homo sapiens
gcugagaucgcgguauuaa

SEQ ID NO: 595024 - RNA, 19 nt, Homo sapiens
uggcugagaucgcgguauu

SEQ ID NO: 595025 - RNA, 19 nt, Homo sapiens
gaagcccuaaguacgguua

SEQ ID NO: 595026 - RNA, 19 nt, Homo sapiens
gccggugacuuccacaaga

SEQ ID NO: 595027 - RNA, 19 nt, Homo sapiens
gaaccacgacgggcagaga

SEQ ID NO: 595028 - RNA, 19 nt, Homo sapiens
ugacagcagugagaagauc

SEQ ID NO: 595029 - RNA, 19 nt, Homo sapiens
ccggugacuuccacaagaa

SEQ ID NO: 595030 - RNA, 19 nt, Homo sapiens
agacauuucucaacuucuc

SEQ ID NO: 595031 - RNA, 19 nt, Homo sapiens
gaagauuggucuguuuugu

SEQ ID NO: 595032 - RNA, 19 nt, Homo sapiens
ugacugugccggugacuuc

SEQ ID NO: 595033 - RNA, 19 nt, Homo sapiens
gacacccgcuguggcugua

SEQ ID NO: 595034 - RNA, 19 nt, Homo sapiens
ggccggaguuuggcugaga

SEQ ID NO: 595035 - RNA, 19 nt, Homo sapiens
gagaccagcaguacgagau

SEQ ID NO: 595036 - RNA, 19 nt, Homo sapiens
ccugguuacugcagaugaa

SEQ ID NO: 595037 - RNA, 19 nt, Homo sapiens
gcagcucuacgacgugaug

SEQ ID NO: 595038 - RNA, 19 nt, Homo sapiens
ccacccugaccuacacaua

SEQ ID NO: 595039 - RNA, 19 nt, Homo sapiens
ccacacacggcuacucugu

SEQ ID NO: 595040 - RNA, 19 nt, Homo sapiens
acuuaugcguguagacauu

SEQ ID NO: 595041 - RNA, 19 nt, Homo sapiens
gagaucgcgguauuaaauc

SEQ ID NO: 595042 - RNA, 19 nt, Homo sapiens
gcgaagaagcacgaacgaa

SEQ ID NO: 595043 - RNA, 19 nt, Homo sapiens
cugccugccuggcuucuau

SEQ ID NO: 595044 - RNA, 19 nt, Homo sapiens
gcgcgaggcagagaucgaa

SEQ ID NO: 595045 - RNA, 19 nt, Homo sapiens
ggugaagacauuucucaac

SEQ ID NO: 595046 - RNA, 19 nt, Homo sapiens
cagccaaggcgaagaagca

SEQ ID NO: 595047 - RNA, 19 nt, Homo sapiens
aagaagcacgaacgaaugu

SEQ ID NO: 595048 - RNA, 19 nt, Homo sapiens
caagaagauuggucuguuu

SEQ ID NO: 595049 - RNA, 19 nt, Homo sapiens
gaagaagcacgaacgaaug

SEQ ID NO: 595050 - RNA, 19 nt, Homo sapiens
gaaccaccauaauucugaa

SEQ ID NO: 595051 - RNA, 19 nt, Homo sapiens
gaucugcaccguccaguug

SEQ ID NO: 595052 - RNA, 19 nt, Homo sapiens
gggagaaccaccauaauuc

SEQ ID NO: 595053 - RNA, 19 nt, Homo sapiens
ugagaucgcgguauuaaau

SEQ ID NO: 595054 - RNA, 19 nt, Homo sapiens
ccgcagagauacugacugu

SEQ ID NO: 595055 - RNA, 19 nt, Homo sapiens
gguauuaaaucugugaaag

SEQ ID NO: 595056 - RNA, 19 nt, Homo sapiens
ugaagacauuucucaacuu

SEQ ID NO: 595057 - RNA, 19 nt, Homo sapiens
cgaagaagcacgaacgaau

SEQ ID NO: 595058 - RNA, 19 nt, Homo sapiens
acacacggcuacucuguuc

SEQ ID NO: 595059 - RNA, 19 nt, Homo sapiens
gugaagacauuucucaacu

SEQ ID NO: 595060 - RNA, 19 nt, Homo sapiens
acaagaagauuggucuguu

SEQ ID NO: 595061 - RNA, 19 nt, Homo sapiens
gcugagaucgcgguauuaa

SEQ ID NO: 595062 - RNA, 19 nt, Homo sapiens
uggcugagaucgcgguauu

SEQ ID NO: 595063 - RNA, 19 nt, Homo sapiens
gaagcccuaaguacgguua

SEQ ID NO: 595064 - RNA, 19 nt, Homo sapiens
gccggugacuuccacaaga

SEQ ID NO: 595065 - RNA, 19 nt, Homo sapiens
ugggagaaccaccauaauu

SEQ ID NO: 595066 - RNA, 19 nt, Homo sapiens
gaaccacgacgggcagaga

SEQ ID NO: 595067 - RNA, 19 nt, Homo sapiens
ugacagcagugagaagauc

SEQ ID NO: 595068 - RNA, 19 nt, Homo sapiens
agacauuucucaacuucuc

SEQ ID NO: 595069 - RNA, 19 nt, Homo sapiens
ccggugacuuccacaagaa

SEQ ID NO: 595070 - RNA, 19 nt, Homo sapiens
gaagauuggucuguuuugu

SEQ ID NO: 595071 - RNA, 19 nt, Homo sapiens
caacuccaccugccuugug

SEQ ID NO: 595072 - RNA, 19 nt, Homo sapiens
ugacugugccggugacuuc

SEQ ID NO: 595073 - RNA, 19 nt, Homo sapiens
gacacccgcuguggcugua

SEQ ID NO: 595074 - RNA, 19 nt, Homo sapiens
ccugggagaaccaccauaa

SEQ ID NO: 595075 - RNA, 19 nt, Homo sapiens
ggccggaguuuggcugaga

SEQ ID NO: 595076 - RNA, 19 nt, Homo sapiens
gagaccagcaguacgagau

SEQ ID NO: 595077 - RNA, 19 nt, Homo sapiens
ccugguuacugcagaugaa

SEQ ID NO: 595078 - RNA, 19 nt, Homo sapiens
gcagcucuacgacgugaug

SEQ ID NO: 595079 - RNA, 19 nt, Homo sapiens
ccacccugaccuacacaua

SEQ ID NO: 595080 - RNA, 19 nt, Homo sapiens
ccacacacggcuacucugu

SEQ ID NO: 595081 - RNA, 19 nt, Homo sapiens
acuuaugcguguagacauu

SEQ ID NO: 595082 - RNA, 19 nt, Homo sapiens
gagaucgcgguauuaaauc

SEQ ID NO: 595083 - RNA, 19 nt, Homo sapiens
gcgaagaagcacgaacgaa

SEQ ID NO: 595084 - RNA, 19 nt, Homo sapiens
ccagcugcuuucaguguuc

SEQ ID NO: 595085 - RNA, 19 nt, Homo sapiens
cugccugccuggcuucuau

SEQ ID NO: 595086 - RNA, 19 nt, Homo sapiens
ggaaugcgcgugggagaac

SEQ ID NO: 595087 - RNA, 19 nt, Homo sapiens
gcgcgaggcagagaucgaa

SEQ ID NO: 595088 - RNA, 19 nt, Homo sapiens
ggugaagacauuucucaac

SEQ ID NO: 595089 - RNA, 19 nt, Homo sapiens
cagccaaggcgaagaagca

SEQ ID NO: 595090 - RNA, 19 nt, Homo sapiens
cccaccagcugcuuucagu

SEQ ID NO: 595091 - RNA, 19 nt, Homo sapiens
aagaagcacgaacgaaugu

SEQ ID NO: 595092 - RNA, 19 nt, Homo sapiens
gggaaugcgcgugggagaa

SEQ ID NO: 595093 - RNA, 19 nt, Homo sapiens
caagaagauuggucuguuu

SEQ ID NO: 595094 - RNA, 19 nt, Homo sapiens
gaagaagcacgaacgaaug

SEQ ID NO: 595095 - RNA, 19 nt, Homo sapiens
gaaccaccauaauucugaa

SEQ ID NO: 595096 - RNA, 19 nt, Homo sapiens
gaucugcaccguccaguug

SEQ ID NO: 595097 - RNA, 19 nt, Homo sapiens
gggagaaccaccauaauuc

SEQ ID NO: 595098 - RNA, 19 nt, Homo sapiens
ugagaucgcgguauuaaau

SEQ ID NO: 595099 - RNA, 19 nt, Homo sapiens
ccgcagagauacugacugu

SEQ ID NO: 595100 - RNA, 19 nt, Homo sapiens
gguauuaaaucugugaaag

SEQ ID NO: 595101 - RNA, 19 nt, Homo sapiens
ugaagacauuucucaacuu

SEQ ID NO: 595102 - RNA, 19 nt, Homo sapiens
cgaagaagcacgaacgaau

SEQ ID NO: 595103 - RNA, 19 nt, Homo sapiens
acacacggcuacucuguuc

SEQ ID NO: 595104 - RNA, 19 nt, Homo sapiens
gugaagacauuucucaacu

SEQ ID NO: 595105 - RNA, 19 nt, Homo sapiens
acaagaagauuggucuguu

SEQ ID NO: 595106 - RNA, 19 nt, Homo sapiens
gcugagaucgcgguauuaa

SEQ ID NO: 595107 - RNA, 19 nt, Homo sapiens
uggcugagaucgcgguauu

SEQ ID NO: 595108 - RNA, 19 nt, Homo sapiens
gaagcccuaaguacgguua

SEQ ID NO: 595109 - RNA, 19 nt, Homo sapiens
gccggugacuuccacaaga

SEQ ID NO: 595110 - RNA, 19 nt, Homo sapiens
ugggagaaccaccauaauu

SEQ ID NO: 595111 - RNA, 19 nt, Homo sapiens
gaaccacgacgggcagaga

SEQ ID NO: 595112 - RNA, 19 nt, Homo sapiens
ugacagcagugagaagauc

SEQ ID NO: 595113 - RNA, 19 nt, Homo sapiens
agacauuucucaacuucuc

SEQ ID NO: 595114 - RNA, 19 nt, Homo sapiens
ccggugacuuccacaagaa

SEQ ID NO: 595115 - RNA, 19 nt, Homo sapiens
gaagauuggucuguuuugu

SEQ ID NO: 595116 - RNA, 19 nt, Homo sapiens
caacuccaccugccuugug

SEQ ID NO: 595117 - RNA, 19 nt, Homo sapiens
ugacugugccggugacuuc

SEQ ID NO: 595118 - RNA, 19 nt, Homo sapiens
gacacccgcuguggcugua

SEQ ID NO: 595119 - RNA, 19 nt, Homo sapiens
ccugggagaaccaccauaa

SEQ ID NO: 595120 - RNA, 19 nt, Homo sapiens
ggccggaguuuggcugaga

SEQ ID NO: 595121 - RNA, 19 nt, Homo sapiens
gagaccagcaguacgagau

SEQ ID NO: 595122 - RNA, 19 nt, Homo sapiens
ccugguuacugcagaugaa

SEQ ID NO: 595123 - RNA, 19 nt, Homo sapiens
gcagcucuacgacgugaug

SEQ ID NO: 595124 - RNA, 19 nt, Homo sapiens
ccacccugaccuacacaua

SEQ ID NO: 595125 - RNA, 19 nt, Homo sapiens
ccacacacggcuacucugu

SEQ ID NO: 595126 - RNA, 19 nt, Homo sapiens
acuuaugcguguagacauu

SEQ ID NO: 595127 - RNA, 19 nt, Homo sapiens
gagaucgcgguauuaaauc

SEQ ID NO: 595128 - RNA, 19 nt, Homo sapiens
gcgaagaagcacgaacgaa

SEQ ID NO: 595129 - RNA, 19 nt, Homo sapiens
ccagcugcuuucaguguuc

SEQ ID NO: 595130 - RNA, 19 nt, Homo sapiens
cugccugccuggcuucuau

SEQ ID NO: 595131 - RNA, 19 nt, Homo sapiens
gcgcgaggcagagaucgaa

SEQ ID NO: 595132 - RNA, 19 nt, Homo sapiens
ggugaagacauuucucaac

SEQ ID NO: 595133 - RNA, 19 nt, Homo sapiens
cagccaaggcgaagaagca

SEQ ID NO: 595134 - RNA, 19 nt, Homo sapiens
cccaccagcugcuuucagu

SEQ ID NO: 595135 - RNA, 19 nt, Homo sapiens
aagaagcacgaacgaaugu

SEQ ID NO: 595136 - RNA, 19 nt, Homo sapiens
caagaagauuggucuguuu

SEQ ID NO: 595137 - RNA, 19 nt, Homo sapiens
gaagaagcacgaacgaaug

SEQ ID NO: 595138 - RNA, 19 nt, Homo sapiens
gaucugcaccguccaguug

SEQ ID NO: 595139 - RNA, 19 nt, Homo sapiens
ugagaucgcgguauuaaau

SEQ ID NO: 595140 - RNA, 19 nt, Homo sapiens
gguauuaaaucugugaaag

SEQ ID NO: 595141 - RNA, 19 nt, Homo sapiens
ugaagacauuucucaacuu

SEQ ID NO: 595142 - RNA, 19 nt, Homo sapiens
cgaagaagcacgaacgaau

SEQ ID NO: 595143 - RNA, 19 nt, Homo sapiens
gugaagacauuucucaacu

SEQ ID NO: 595144 - RNA, 19 nt, Homo sapiens
acaagaagauuggucuguu

SEQ ID NO: 595145 - RNA, 19 nt, Homo sapiens
gcugagaucgcgguauuaa

SEQ ID NO: 595146 - RNA, 19 nt, Homo sapiens
uggcugagaucgcgguauu

SEQ ID NO: 595147 - RNA, 19 nt, Homo sapiens
gccggugacuuccacaaga

SEQ ID NO: 595148 - RNA, 19 nt, Homo sapiens
gaagcccuaaguacgguua

SEQ ID NO: 595149 - RNA, 19 nt, Homo sapiens
gaaccacgacgggcagaga

SEQ ID NO: 595150 - RNA, 19 nt, Homo sapiens
ugacagcagugagaagauc

SEQ ID NO: 595151 - RNA, 19 nt, Homo sapiens
ccggugacuuccacaagaa

SEQ ID NO: 595152 - RNA, 19 nt, Homo sapiens
agacauuucucaacuucuc

SEQ ID NO: 595153 - RNA, 19 nt, Homo sapiens
gaagauuggucuguuuugu

SEQ ID NO: 595154 - RNA, 19 nt, Homo sapiens
ugacugugccggugacuuc

SEQ ID NO: 595155 - RNA, 19 nt, Homo sapiens
ggccggaguuuggcugaga

SEQ ID NO: 595156 - RNA, 19 nt, Homo sapiens
gagaccagcaguacgagau

SEQ ID NO: 595157 - RNA, 19 nt, Homo sapiens
gcagcucuacgacgugaug

SEQ ID NO: 595158 - RNA, 19 nt, Homo sapiens
acuuaugcguguagacauu

SEQ ID NO: 595159 - RNA, 19 nt, Homo sapiens
gagaucgcgguauuaaauc

SEQ ID NO: 595160 - RNA, 19 nt, Homo sapiens
gcgaagaagcacgaacgaa

SEQ ID NO: 595161 - RNA, 19 nt, Homo sapiens
gcgcgaggcagagaucgaa

SEQ ID NO: 595162 - RNA, 19 nt, Homo sapiens
ggugaagacauuucucaac

SEQ ID NO: 595163 - RNA, 19 nt, Homo sapiens
cagccaaggcgaagaagca

SEQ ID NO: 595164 - RNA, 19 nt, Homo sapiens
aagaagcacgaacgaaugu

SEQ ID NO: 595165 - RNA, 19 nt, Homo sapiens
caagaagauuggucuguuu

SEQ ID NO: 595166 - RNA, 19 nt, Homo sapiens
gaagaagcacgaacgaaug

SEQ ID NO: 595167 - RNA, 19 nt, Homo sapiens
gaaccaccauaauucugaa

SEQ ID NO: 595168 - RNA, 19 nt, Homo sapiens
gaucugcaccguccaguug

SEQ ID NO: 595169 - RNA, 19 nt, Homo sapiens
gggagaaccaccauaauuc

SEQ ID NO: 595170 - RNA, 19 nt, Homo sapiens
ugagaucgcgguauuaaau

SEQ ID NO: 595171 - RNA, 19 nt, Homo sapiens
ccgcagagauacugacugu

SEQ ID NO: 595172 - RNA, 19 nt, Homo sapiens
gguauuaaaucugugaaag

SEQ ID NO: 595173 - RNA, 19 nt, Homo sapiens
ugaagacauuucucaacuu

SEQ ID NO: 595174 - RNA, 19 nt, Homo sapiens
cgaagaagcacgaacgaau

SEQ ID NO: 595175 - RNA, 19 nt, Homo sapiens
acacacggcuacucuguuc

SEQ ID NO: 595176 - RNA, 19 nt, Homo sapiens
gugaagacauuucucaacu

SEQ ID NO: 595177 - RNA, 19 nt, Homo sapiens
acaagaagauuggucuguu

SEQ ID NO: 595178 - RNA, 19 nt, Homo sapiens
gcugagaucgcgguauuaa

SEQ ID NO: 595179 - RNA, 19 nt, Homo sapiens
uggcugagaucgcgguauu

SEQ ID NO: 595180 - RNA, 19 nt, Homo sapiens
gaagcccuaaguacgguua

SEQ ID NO: 595181 - RNA, 19 nt, Homo sapiens
gccggugacuuccacaaga

SEQ ID NO: 595182 - RNA, 19 nt, Homo sapiens
ugggagaaccaccauaauu

SEQ ID NO: 595183 - RNA, 19 nt, Homo sapiens
gaaccacgacgggcagaga

SEQ ID NO: 595184 - RNA, 19 nt, Homo sapiens
ugacagcagugagaagauc

SEQ ID NO: 595185 - RNA, 19 nt, Homo sapiens
agacauuucucaacuucuc

SEQ ID NO: 595186 - RNA, 19 nt, Homo sapiens
ccggugacuuccacaagaa

SEQ ID NO: 595187 - RNA, 19 nt, Homo sapiens
gaagauuggucuguuuugu

SEQ ID NO: 595188 - RNA, 19 nt, Homo sapiens
caacuccaccugccuugug

SEQ ID NO: 595189 - RNA, 19 nt, Homo sapiens
ugacugugccggugacuuc

SEQ ID NO: 595190 - RNA, 19 nt, Homo sapiens
gacacccgcuguggcugua

SEQ ID NO: 595191 - RNA, 19 nt, Homo sapiens
ccugggagaaccaccauaa

SEQ ID NO: 595192 - RNA, 19 nt, Homo sapiens
ggccggaguuuggcugaga

SEQ ID NO: 595193 - RNA, 19 nt, Homo sapiens
gagaccagcaguacgagau

SEQ ID NO: 595194 - RNA, 19 nt, Homo sapiens
ccugguuacugcagaugaa

SEQ ID NO: 595195 - RNA, 19 nt, Homo sapiens
gcagcucuacgacgugaug

SEQ ID NO: 595196 - RNA, 19 nt, Homo sapiens
ccacccugaccuacacaua

SEQ ID NO: 595197 - RNA, 19 nt, Homo sapiens
ccacacacggcuacucugu

SEQ ID NO: 595198 - RNA, 19 nt, Homo sapiens
acuuaugcguguagacauu

SEQ ID NO: 595199 - RNA, 19 nt, Homo sapiens
gagaucgcgguauuaaauc

SEQ ID NO: 595200 - RNA, 19 nt, Homo sapiens
gcgaagaagcacgaacgaa

SEQ ID NO: 595201 - RNA, 19 nt, Homo sapiens
cugccugccuggcuucuau

SEQ ID NO: 595202 - RNA, 19 nt, Homo sapiens
gcgcgaggcagagaucgaa

SEQ ID NO: 595203 - RNA, 19 nt, Homo sapiens
ggugaagacauuucucaac

SEQ ID NO: 595204 - RNA, 19 nt, Homo sapiens
cagccaaggcgaagaagca

SEQ ID NO: 595205 - RNA, 19 nt, Homo sapiens
aagaagcacgaacgaaugu

SEQ ID NO: 595206 - RNA, 19 nt, Homo sapiens
caagaagauuggucuguuu

SEQ ID NO: 595207 - RNA, 19 nt, Homo sapiens
gaagaagcacgaacgaaug

SEQ ID NO: 595208 - RNA, 19 nt, Homo sapiens
gaaccaccauaauucugaa

SEQ ID NO: 595209 - RNA, 19 nt, Homo sapiens
gaucugcaccguccaguug

SEQ ID NO: 595210 - RNA, 19 nt, Homo sapiens
gggagaaccaccauaauuc

SEQ ID NO: 595211 - RNA, 19 nt, Homo sapiens
ugagaucgcgguauuaaau

SEQ ID NO: 595212 - RNA, 19 nt, Homo sapiens
ccgcagagauacugacugu

SEQ ID NO: 595213 - RNA, 19 nt, Homo sapiens
gguauuaaaucugugaaag

SEQ ID NO: 595214 - RNA, 19 nt, Homo sapiens
ugaagacauuucucaacuu

SEQ ID NO: 595215 - RNA, 19 nt, Homo sapiens
cgaagaagcacgaacgaau

SEQ ID NO: 595216 - RNA, 19 nt, Homo sapiens
acacacggcuacucuguuc

SEQ ID NO: 595217 - RNA, 19 nt, Homo sapiens
gugaagacauuucucaacu

SEQ ID NO: 595218 - RNA, 19 nt, Homo sapiens
acaagaagauuggucuguu

SEQ ID NO: 595219 - RNA, 19 nt, Homo sapiens
gcugagaucgcgguauuaa

SEQ ID NO: 595220 - RNA, 19 nt, Homo sapiens
uggcugagaucgcgguauu

SEQ ID NO: 595221 - RNA, 19 nt, Homo sapiens
gaagcccuaaguacgguua

SEQ ID NO: 595222 - RNA, 19 nt, Homo sapiens
gccggugacuuccacaaga

SEQ ID NO: 595223 - RNA, 19 nt, Homo sapiens
ugggagaaccaccauaauu

SEQ ID NO: 595224 - RNA, 19 nt, Homo sapiens
gaaccacgacgggcagaga

SEQ ID NO: 595225 - RNA, 19 nt, Homo sapiens
ugacagcagugagaagauc

SEQ ID NO: 595226 - RNA, 19 nt, Homo sapiens
agacauuucucaacuucuc

SEQ ID NO: 595227 - RNA, 19 nt, Homo sapiens
ccggugacuuccacaagaa

SEQ ID NO: 595228 - RNA, 19 nt, Homo sapiens
gaagauuggucuguuuugu

SEQ ID NO: 595229 - RNA, 19 nt, Homo sapiens
caacuccaccugccuugug

SEQ ID NO: 595230 - RNA, 19 nt, Homo sapiens
ugacugugccggugacuuc

SEQ ID NO: 595231 - RNA, 19 nt, Homo sapiens
gacacccgcuguggcugua

SEQ ID NO: 595232 - RNA, 19 nt, Homo sapiens
ccugggagaaccaccauaa

SEQ ID NO: 595233 - RNA, 19 nt, Homo sapiens
ggccggaguuuggcugaga

SEQ ID NO: 595234 - RNA, 19 nt, Homo sapiens
gagaccagcaguacgagau

SEQ ID NO: 595235 - RNA, 19 nt, Homo sapiens
gcagcucuacgacgugaug

SEQ ID NO: 595236 - RNA, 19 nt, Homo sapiens
ccacacacggcuacucugu

SEQ ID NO: 595237 - RNA, 19 nt, Homo sapiens
acuuaugcguguagacauu

SEQ ID NO: 595238 - RNA, 19 nt, Homo sapiens
gagaucgcgguauuaaauc

SEQ ID NO: 595239 - RNA, 19 nt, Homo sapiens
gcgaagaagcacgaacgaa

SEQ ID NO: 595240 - RNA, 19 nt, Homo sapiens
cugccugccuggcuucuau

SEQ ID NO: 595241 - RNA, 19 nt, Homo sapiens
gcgcgaggcagagaucgaa

SEQ ID NO: 595242 - RNA, 19 nt, Homo sapiens
ggugaagacauuucucaac

SEQ ID NO: 595243 - RNA, 19 nt, Homo sapiens
cagccaaggcgaagaagca

SEQ ID NO: 595244 - RNA, 19 nt, Homo sapiens
aagaagcacgaacgaaugu

SEQ ID NO: 595245 - RNA, 19 nt, Homo sapiens
caagaagauuggucuguuu

SEQ ID NO: 595246 - RNA, 19 nt, Homo sapiens
gaagaagcacgaacgaaug

SEQ ID NO: 595247 - RNA, 19 nt, Homo sapiens
gaucugcaccguccaguug

SEQ ID NO: 595248 - RNA, 19 nt, Homo sapiens
ugagaucgcgguauuaaau

SEQ ID NO: 595249 - RNA, 19 nt, Homo sapiens
ccgcagagauacugacugu

SEQ ID NO: 595250 - RNA, 19 nt, Homo sapiens
gguauuaaaucugugaaag

SEQ ID NO: 595251 - RNA, 19 nt, Homo sapiens
ugaagacauuucucaacuu

SEQ ID NO: 595252 - RNA, 19 nt, Homo sapiens
cgaagaagcacgaacgaau

SEQ ID NO: 595253 - RNA, 19 nt, Homo sapiens
acacacggcuacucuguuc

SEQ ID NO: 595254 - RNA, 19 nt, Homo sapiens
gugaagacauuucucaacu

SEQ ID NO: 595255 - RNA, 19 nt, Homo sapiens
acaagaagauuggucuguu

SEQ ID NO: 595256 - RNA, 19 nt, Homo sapiens
gcugagaucgcgguauuaa

SEQ ID NO: 595257 - RNA, 19 nt, Homo sapiens
uggcugagaucgcgguauu

SEQ ID NO: 595258 - RNA, 19 nt, Homo sapiens
gaagcccuaaguacgguua

SEQ ID NO: 595259 - RNA, 19 nt, Homo sapiens
gccggugacuuccacaaga

SEQ ID NO: 595260 - RNA, 19 nt, Homo sapiens
gaaccacgacgggcagaga

SEQ ID NO: 595261 - RNA, 19 nt, Homo sapiens
ugacagcagugagaagauc

SEQ ID NO: 595262 - RNA, 19 nt, Homo sapiens
ccggugacuuccacaagaa

SEQ ID NO: 595263 - RNA, 19 nt, Homo sapiens
agacauuucucaacuucuc

SEQ ID NO: 595264 - RNA, 19 nt, Homo sapiens
gaagauuggucuguuuugu

SEQ ID NO: 595265 - RNA, 19 nt, Homo sapiens
ugacugugccggugacuuc

SEQ ID NO: 595266 - RNA, 19 nt, Homo sapiens
gacacccgcuguggcugua

SEQ ID NO: 595267 - RNA, 19 nt, Homo sapiens
ggccggaguuuggcugaga

SEQ ID NO: 595268 - RNA, 19 nt, Homo sapiens
gagaccagcaguacgagau

SEQ ID NO: 595269 - RNA, 19 nt, Homo sapiens
gcagcucuacgacgugaug

SEQ ID NO: 595270 - RNA, 19 nt, Homo sapiens
ccacacacggcuacucugu

SEQ ID NO: 595271 - RNA, 19 nt, Homo sapiens
acuuaugcguguagacauu

SEQ ID NO: 595272 - RNA, 19 nt, Homo sapiens
gagaucgcgguauuaaauc

SEQ ID NO: 595273 - RNA, 19 nt, Homo sapiens
gcgaagaagcacgaacgaa

SEQ ID NO: 595274 - RNA, 19 nt, Homo sapiens
cugccugccuggcuucuau

SEQ ID NO: 595275 - RNA, 19 nt, Homo sapiens
gcgcgaggcagagaucgaa

SEQ ID NO: 595276 - RNA, 19 nt, Homo sapiens
ggugaagacauuucucaac

SEQ ID NO: 595277 - RNA, 19 nt, Homo sapiens
cagccaaggcgaagaagca

SEQ ID NO: 595278 - RNA, 19 nt, Homo sapiens
aagaagcacgaacgaaugu

SEQ ID NO: 595279 - RNA, 19 nt, Homo sapiens
caagaagauuggucuguuu

SEQ ID NO: 595280 - RNA, 19 nt, Homo sapiens
gaagaagcacgaacgaaug

SEQ ID NO: 595281 - RNA, 19 nt, Homo sapiens
gaucugcaccguccaguug

SEQ ID NO: 595282 - RNA, 19 nt, Homo sapiens
ugagaucgcgguauuaaau

SEQ ID NO: 595283 - RNA, 19 nt, Homo sapiens
gguauuaaaucugugaaag

SEQ ID NO: 595284 - RNA, 19 nt, Homo sapiens
ugaagacauuucucaacuu

SEQ ID NO: 595285 - RNA, 19 nt, Homo sapiens
cgaagaagcacgaacgaau

SEQ ID NO: 595286 - RNA, 19 nt, Homo sapiens
gugaagacauuucucaacu

SEQ ID NO: 595287 - RNA, 19 nt, Homo sapiens
acaagaagauuggucuguu

SEQ ID NO: 595288 - RNA, 19 nt, Homo sapiens
gcugagaucgcgguauuaa

SEQ ID NO: 595289 - RNA, 19 nt, Homo sapiens
uggcugagaucgcgguauu

SEQ ID NO: 595290 - RNA, 19 nt, Homo sapiens
gccggugacuuccacaaga

SEQ ID NO: 595291 - RNA, 19 nt, Homo sapiens
gaagcccuaaguacgguua

SEQ ID NO: 595292 - RNA, 19 nt, Homo sapiens
gaaccacgacgggcagaga

SEQ ID NO: 595293 - RNA, 19 nt, Homo sapiens
ugacagcagugagaagauc

SEQ ID NO: 595294 - RNA, 19 nt, Homo sapiens
ccggugacuuccacaagaa

SEQ ID NO: 595295 - RNA, 19 nt, Homo sapiens
agacauuucucaacuucuc

SEQ ID NO: 595296 - RNA, 19 nt, Homo sapiens
gaagauuggucuguuuugu

SEQ ID NO: 595297 - RNA, 19 nt, Homo sapiens
ugacugugccggugacuuc

SEQ ID NO: 595298 - RNA, 19 nt, Homo sapiens
gacacccgcuguggcugua

SEQ ID NO: 595299 - RNA, 19 nt, Homo sapiens
ggccggaguuuggcugaga

SEQ ID NO: 595300 - RNA, 19 nt, Homo sapiens
gagaccagcaguacgagau

SEQ ID NO: 595301 - RNA, 19 nt, Homo sapiens
gcagcucuacgacgugaug

SEQ ID NO: 595302 - RNA, 19 nt, Homo sapiens
acuuaugcguguagacauu

SEQ ID NO: 595303 - RNA, 19 nt, Homo sapiens
gagaucgcgguauuaaauc

SEQ ID NO: 595304 - RNA, 19 nt, Homo sapiens
gcgaagaagcacgaacgaa

SEQ ID NO: 595305 - RNA, 19 nt, Homo sapiens
gcgcgaggcagagaucgaa

SEQ ID NO: 595306 - RNA, 19 nt, Homo sapiens
ggugaagacauuucucaac

SEQ ID NO: 595307 - RNA, 19 nt, Homo sapiens
cagccaaggcgaagaagca

SEQ ID NO: 595308 - RNA, 19 nt, Homo sapiens
aagaagcacgaacgaaugu

SEQ ID NO: 595309 - RNA, 19 nt, Homo sapiens
gaacagacuucaacaguaa

SEQ ID NO: 595310 - RNA, 19 nt, Homo sapiens
uaagauggcugaucaguaa

SEQ ID NO: 595311 - RNA, 19 nt, Homo sapiens
caacauagauuccaugauc

SEQ ID NO: 595312 - RNA, 19 nt, Homo sapiens
gaugaagaaugacccuuua

SEQ ID NO: 595313 - RNA, 19 nt, Homo sapiens
ccaauaaucagguaucuua

SEQ ID NO: 595314 - RNA, 19 nt, Homo sapiens
gcagugaaguagacaauug

SEQ ID NO: 595315 - RNA, 19 nt, Homo sapiens
gcauugacuuugaagauaa

SEQ ID NO: 595316 - RNA, 19 nt, Homo sapiens
ugaaugagcugcugucugu

SEQ ID NO: 595317 - RNA, 19 nt, Homo sapiens
gaauaacccugcugaucaa

SEQ ID NO: 595318 - RNA, 19 nt, Homo sapiens
ggacguugguucuguggua

SEQ ID NO: 595319 - RNA, 19 nt, Homo sapiens
uaaagaagaucgacguguu

SEQ ID NO: 595320 - RNA, 19 nt, Homo sapiens
aaacauagaccuucgcuuu

SEQ ID NO: 595321 - RNA, 19 nt, Homo sapiens
gaagauggcgucgugauaa

SEQ ID NO: 595322 - RNA, 19 nt, Homo sapiens
gaacggagacaacauugaa

SEQ ID NO: 595323 - RNA, 19 nt, Homo sapiens
gaaacaauccauccaguga

SEQ ID NO: 595324 - RNA, 19 nt, Homo sapiens
caggaagaauuguagauaa

SEQ ID NO: 595325 - RNA, 19 nt, Homo sapiens
ggaauuaacagcuaacaau

SEQ ID NO: 595326 - RNA, 19 nt, Homo sapiens
gcacaaaucuguaaaacau

SEQ ID NO: 595327 - RNA, 19 nt, Homo sapiens
gagaagaagcggagaaaga

SEQ ID NO: 595328 - RNA, 19 nt, Homo sapiens
gaaggaaacaugcacaaau

SEQ ID NO: 595329 - RNA, 19 nt, Homo sapiens
gaaaugaaagccucucuuc

SEQ ID NO: 595330 - RNA, 19 nt, Homo sapiens
ucaguaauguugcagcuuu

SEQ ID NO: 595331 - RNA, 19 nt, Homo sapiens
ggcauugacuuugaagaua

SEQ ID NO: 595332 - RNA, 19 nt, Homo sapiens
uaacacagacuuucaagga

SEQ ID NO: 595333 - RNA, 19 nt, Homo sapiens
gaagagcagugaaguagac

SEQ ID NO: 595334 - RNA, 19 nt, Homo sapiens
agaacagacuucaacagua

SEQ ID NO: 595335 - RNA, 19 nt, Homo sapiens
gcaaugacggaccucuuua

SEQ ID NO: 595336 - RNA, 19 nt, Homo sapiens
gacaaggugugggaauuaa

SEQ ID NO: 595337 - RNA, 19 nt, Homo sapiens
gauguacuuuccaaacaaa

SEQ ID NO: 595338 - RNA, 19 nt, Homo sapiens
ggauguacuuuccaaacaa

SEQ ID NO: 595339 - RNA, 19 nt, Homo sapiens
gaucacauccacaccaauu

SEQ ID NO: 595340 - RNA, 19 nt, Homo sapiens
ggaauucucaucaacaguu

SEQ ID NO: 595341 - RNA, 19 nt, Homo sapiens
ccaugaagcuugucaacau

SEQ ID NO: 595342 - RNA, 19 nt, Homo sapiens
guucagcgauggccuguau

SEQ ID NO: 595343 - RNA, 19 nt, Homo sapiens
ccaguaaccuuuggaaaca

SEQ ID NO: 595344 - RNA, 19 nt, Homo sapiens
cagagaggauggaaggaaa

SEQ ID NO: 595345 - RNA, 19 nt, Homo sapiens
ucagguaucuuacacaucu

SEQ ID NO: 595346 - RNA, 19 nt, Homo sapiens
acaguacccugcaaugaaa

SEQ ID NO: 595347 - RNA, 19 nt, Homo sapiens
gaagaucauccaaacauca

SEQ ID NO: 595348 - RNA, 19 nt, Homo sapiens
ggagaauuauaccucgaaa

SEQ ID NO: 595349 - RNA, 19 nt, Homo sapiens
agacugagauuugaaggaa

SEQ ID NO: 595350 - RNA, 19 nt, Homo sapiens
ggaggaaugccgacaguug

SEQ ID NO: 595351 - RNA, 19 nt, Homo sapiens
ggucuugauuucaccauug

SEQ ID NO: 595352 - RNA, 19 nt, Homo sapiens
ggaugaagaaugacccuuu

SEQ ID NO: 595353 - RNA, 19 nt, Homo sapiens
gcaugaaaccugacauugu

SEQ ID NO: 595354 - RNA, 19 nt, Homo sapiens
uaacccugcugaucaaaug

SEQ ID NO: 595355 - RNA, 19 nt, Homo sapiens
ucaaguaugcugaaucuga

SEQ ID NO: 595356 - RNA, 19 nt, Homo sapiens
gaagguggaauucucauca

SEQ ID NO: 595357 - RNA, 19 nt, Homo sapiens
agagaagccuuauuuccaa

SEQ ID NO: 595358 - RNA, 19 nt, Homo sapiens
ggaaugccgacaguuguua

SEQ ID NO: 595359 - RNA, 19 nt, Homo sapiens
ugaauaacccugcugauca

SEQ ID NO: 595360 - RNA, 19 nt, Homo sapiens
gaauuaacagcuaacaaug

SEQ ID NO: 595361 - RNA, 19 nt, Homo sapiens
aaagaagaucgacguguua

SEQ ID NO: 595362 - RNA, 19 nt, Homo sapiens
gagagaagccuuauuucca

SEQ ID NO: 595363 - RNA, 19 nt, Homo sapiens
gaaacaugcacaaaucugu

SEQ ID NO: 595364 - RNA, 19 nt, Homo sapiens
caguaaagcuccccauuaa

SEQ ID NO: 595365 - RNA, 19 nt, Homo sapiens
ucaaauggaugugauugga

SEQ ID NO: 595366 - RNA, 19 nt, Homo sapiens
cauauucgcuugugaccau

SEQ ID NO: 595367 - RNA, 19 nt, Homo sapiens
gaagaagcggagaaagaaa

SEQ ID NO: 595368 - RNA, 19 nt, Homo sapiens
guaagauggcugaucagua

SEQ ID NO: 595369 - RNA, 19 nt, Homo sapiens
cagcagagacagagucaaa

SEQ ID NO: 595370 - RNA, 19 nt, Homo sapiens
gaaguagacaauuggagaa

SEQ ID NO: 595371 - RNA, 19 nt, Homo sapiens
gaucauccguuuguugaca

SEQ ID NO: 595372 - RNA, 19 nt, Homo sapiens
ucacagugguugauugauc

SEQ ID NO: 595373 - RNA, 19 nt, Homo sapiens
ggagucacaggaagaauug

SEQ ID NO: 595374 - RNA, 19 nt, Homo sapiens
caucuacuauggaggaaug

SEQ ID NO: 595375 - RNA, 19 nt, Homo sapiens
aaucaugguuucugcuauu

SEQ ID NO: 595376 - RNA, 19 nt, Homo sapiens
ugacaaggugugggaauua

SEQ ID NO: 595377 - RNA, 19 nt, Homo sapiens
cauagaccuucgcuuuauu

SEQ ID NO: 595378 - RNA, 19 nt, Homo sapiens
acauagaccuucgcuuuau

SEQ ID NO: 595379 - RNA, 19 nt, Homo sapiens
aaggaaacaugcacaaauc

SEQ ID NO: 595380 - RNA, 19 nt, Homo sapiens
gcucccagcccaucuacua

SEQ ID NO: 595381 - RNA, 19 nt, Homo sapiens
ggccaugggauuuaacuuu

SEQ ID NO: 595382 - RNA, 19 nt, Homo sapiens
uaacaucccagcucugaau

SEQ ID NO: 595383 - RNA, 19 nt, Homo sapiens
gaagaucgacguguuaaac

SEQ ID NO: 595384 - RNA, 19 nt, Homo sapiens
ccaaggauuugcuccagau

SEQ ID NO: 595385 - RNA, 19 nt, Homo sapiens
agccaaagcuagaaauuca

SEQ ID NO: 595386 - RNA, 19 nt, Homo sapiens
gagaagcaugggcuacuuu

SEQ ID NO: 595387 - RNA, 19 nt, Homo sapiens
ucagggucuuuaccaauaa

SEQ ID NO: 595388 - RNA, 19 nt, Homo sapiens
guaauuugaggucuugauu

SEQ ID NO: 595389 - RNA, 19 nt, Homo sapiens
ggaggaagcccagggugaa

SEQ ID NO: 595390 - RNA, 19 nt, Homo sapiens
ucgaaucgcccucaaguga

SEQ ID NO: 595391 - RNA, 19 nt, Homo sapiens
gugaaucccgccaguauga

SEQ ID NO: 595392 - RNA, 19 nt, Homo sapiens
ggcaaugacggaccucuuu

SEQ ID NO: 595393 - RNA, 19 nt, Homo sapiens
gcuaaaagacgcuuguuaa

SEQ ID NO: 595394 - RNA, 19 nt, Homo sapiens
guacuuuccaaacaaauga

SEQ ID NO: 595395 - RNA, 19 nt, Homo sapiens
gcuaacaucccagcucuga

SEQ ID NO: 595396 - RNA, 19 nt, Homo sapiens
aagcaugggcuacuuugua

SEQ ID NO: 595397 - RNA, 19 nt, Homo sapiens
uucagggucuuuaccaaua

SEQ ID NO: 595398 - RNA, 19 nt, Homo sapiens
gagggagugccaaggauuu

SEQ ID NO: 595399 - RNA, 19 nt, Homo sapiens
acacugggcugagcgagaa

SEQ ID NO: 595400 - RNA, 19 nt, Homo sapiens
ggcuuucaauggauacuuu

SEQ ID NO: 595401 - RNA, 19 nt, Homo sapiens
aaacaugcacaaaucugua

SEQ ID NO: 595402 - RNA, 19 nt, Homo sapiens
gaggccggauuguacugua

SEQ ID NO: 595403 - RNA, 19 nt, Homo sapiens
gaagaaugacccuuuagac

SEQ ID NO: 595404 - RNA, 19 nt, Homo sapiens
agggauaauuuaaggauga

SEQ ID NO: 595405 - RNA, 19 nt, Homo sapiens
guaaucaugguuucugcua

SEQ ID NO: 595406 - RNA, 19 nt, Homo sapiens
gaugcagaacuucacauuu

SEQ ID NO: 595407 - RNA, 19 nt, Homo sapiens
gauauacaggugcuaaugu

SEQ ID NO: 595408 - RNA, 19 nt, Homo sapiens
ccucaaguaugcugaaucu

SEQ ID NO: 595409 - RNA, 19 nt, Homo sapiens
cagaggagcugcaccauga

SEQ ID NO: 595410 - RNA, 19 nt, Homo sapiens
ggacgggccauacccaaua

SEQ ID NO: 595411 - RNA, 19 nt, Homo sapiens
gaacacaaagccucgaaau

SEQ ID NO: 595412 - RNA, 19 nt, Homo sapiens
agaaggaccuggccacgaa

SEQ ID NO: 595413 - RNA, 19 nt, Homo sapiens
acacaaagccucgaaauca

SEQ ID NO: 595414 - RNA, 19 nt, Homo sapiens
gcaaggggcuuacgcagaa

SEQ ID NO: 595415 - RNA, 19 nt, Homo sapiens
gcccauuccugcugucaaa

SEQ ID NO: 595416 - RNA, 19 nt, Homo sapiens
gacgggccauacccaauaa

SEQ ID NO: 595417 - RNA, 19 nt, Homo sapiens
gcacagagacgaggagaag

SEQ ID NO: 595418 - RNA, 19 nt, Homo sapiens
ugacggugcugcgcaagaa

SEQ ID NO: 595419 - RNA, 19 nt, Homo sapiens
ccacgaaaaucaaugagaa

SEQ ID NO: 595420 - RNA, 19 nt, Homo sapiens
ggccagaacaaacaacauu

SEQ ID NO: 595421 - RNA, 19 nt, Homo sapiens
uaucuuagcggcacagaga

SEQ ID NO: 595422 - RNA, 19 nt, Homo sapiens
caaacaacauucuauuacc

SEQ ID NO: 595423 - RNA, 19 nt, Homo sapiens
ccaaauccaagcaggcuau

SEQ ID NO: 595424 - RNA, 19 nt, Homo sapiens
caacauucuauuaccaaga

SEQ ID NO: 595425 - RNA, 19 nt, Homo sapiens
uuggaaagcccaucgagaa

SEQ ID NO: 595426 - RNA, 19 nt, Homo sapiens
gagacgaggagaagaugug

SEQ ID NO: 595427 - RNA, 19 nt, Homo sapiens
cacaaagccucgaaaucag

SEQ ID NO: 595428 - RNA, 19 nt, Homo sapiens
ggaaaggacauuggaaagc

SEQ ID NO: 595429 - RNA, 19 nt, Homo sapiens
gggaaaggacauuggaaag

SEQ ID NO: 595430 - RNA, 19 nt, Homo sapiens
cacaggugaucgcggacua

SEQ ID NO: 595431 - RNA, 19 nt, Homo sapiens
gaaggaccuggccacgaaa

SEQ ID NO: 595432 - RNA, 19 nt, Homo sapiens
gggccuagggcgaaaugaa

SEQ ID NO: 595433 - RNA, 19 nt, Homo sapiens
agggcgaaaugaacacaaa

SEQ ID NO: 595434 - RNA, 19 nt, Homo sapiens
ggugaucgcggacuaugag

SEQ ID NO: 595435 - RNA, 19 nt, Homo sapiens
ccaagaacacggccaagcu

SEQ ID NO: 595436 - RNA, 19 nt, Homo sapiens
uaaccaggugcuuggcaaa

SEQ ID NO: 595437 - RNA, 19 nt, Homo sapiens
acagagacgaggagaagau

SEQ ID NO: 595438 - RNA, 19 nt, Homo sapiens
gaaggggccuagggcgaaa

SEQ ID NO: 595439 - RNA, 19 nt, Homo sapiens
aauccaagcaggcuaucuu

SEQ ID NO: 595440 - RNA, 19 nt, Homo sapiens
cagaggagcugcaccauga

SEQ ID NO: 595441 - RNA, 19 nt, Homo sapiens
ggacgggccauacccaaua

SEQ ID NO: 595442 - RNA, 19 nt, Homo sapiens
agaaggaccuggccacgaa

SEQ ID NO: 595443 - RNA, 19 nt, Homo sapiens
gcaaggggcuuacgcagaa

SEQ ID NO: 595444 - RNA, 19 nt, Homo sapiens
gacgggccauacccaauaa

SEQ ID NO: 595445 - RNA, 19 nt, Homo sapiens
gcacagagacgaggagaag

SEQ ID NO: 595446 - RNA, 19 nt, Homo sapiens
ugacggugcugcgcaagaa

SEQ ID NO: 595447 - RNA, 19 nt, Homo sapiens
ccacgaaaaucaaugagaa

SEQ ID NO: 595448 - RNA, 19 nt, Homo sapiens
ggccagaacaaacaacauu

SEQ ID NO: 595449 - RNA, 19 nt, Homo sapiens
uaucuuagcggcacagaga

SEQ ID NO: 595450 - RNA, 19 nt, Homo sapiens
caaacaacauucuauuacc

SEQ ID NO: 595451 - RNA, 19 nt, Homo sapiens
caacauucuauuaccaaga

SEQ ID NO: 595452 - RNA, 19 nt, Homo sapiens
ccaaauccaagcaggcuau

SEQ ID NO: 595453 - RNA, 19 nt, Homo sapiens
gagacgaggagaagaugug

SEQ ID NO: 595454 - RNA, 19 nt, Homo sapiens
cacaggugaucgcggacua

SEQ ID NO: 595455 - RNA, 19 nt, Homo sapiens
gaaggaccuggccacgaaa

SEQ ID NO: 595456 - RNA, 19 nt, Homo sapiens
ggugaucgcggacuaugag

SEQ ID NO: 595457 - RNA, 19 nt, Homo sapiens
ccaagaacacggccaagcu

SEQ ID NO: 595458 - RNA, 19 nt, Homo sapiens
uaaccaggugcuuggcaaa

SEQ ID NO: 595459 - RNA, 19 nt, Homo sapiens
acagagacgaggagaagau

SEQ ID NO: 595460 - RNA, 19 nt, Homo sapiens
aauccaagcaggcuaucuu

SEQ ID NO: 595461 - RNA, 19 nt, Homo sapiens
gaaugggacuggaggagua

SEQ ID NO: 595462 - RNA, 19 nt, Homo sapiens
auaaagagguguccuugua

SEQ ID NO: 595463 - RNA, 19 nt, Homo sapiens
ggugaagggugguaucuug

SEQ ID NO: 595464 - RNA, 19 nt, Homo sapiens
ggacauaugagucaaagga

SEQ ID NO: 595465 - RNA, 19 nt, Homo sapiens
ggacuugccugugaagaug

SEQ ID NO: 595466 - RNA, 19 nt, Homo sapiens
gcucagccaugauuucuuc

SEQ ID NO: 595467 - RNA, 19 nt, Homo sapiens
gaggaggaguuccgcacua

SEQ ID NO: 595468 - RNA, 19 nt, Homo sapiens
aaagagguguccuuguaaa

SEQ ID NO: 595469 - RNA, 19 nt, Homo sapiens
ggugguaucuuggcaguug

SEQ ID NO: 595470 - RNA, 19 nt, Homo sapiens
guugaauugugguagcuua

SEQ ID NO: 595471 - RNA, 19 nt, Homo sapiens
gaaaagagccuggcaacaa

SEQ ID NO: 595472 - RNA, 19 nt, Homo sapiens
gaauugugguagcuuagga

SEQ ID NO: 595473 - RNA, 19 nt, Homo sapiens
gccaaggucuacaucaaug

SEQ ID NO: 595474 - RNA, 19 nt, Homo sapiens
ugagaaggguuacuacuac

SEQ ID NO: 595475 - RNA, 19 nt, Homo sapiens
uaaagagguguccuuguaa

SEQ ID NO: 595476 - RNA, 19 nt, Homo sapiens
gaaggguuacuacuacuug

SEQ ID NO: 595477 - RNA, 19 nt, Homo sapiens
gcaauaaagagguguccuu

SEQ ID NO: 595478 - RNA, 19 nt, Homo sapiens
cgcacuaucuaccugaaua

SEQ ID NO: 595479 - RNA, 19 nt, Homo sapiens
ccuauaaccggacauauga

SEQ ID NO: 595480 - RNA, 19 nt, Homo sapiens
ucaagaacuuugucauuac

SEQ ID NO: 595481 - RNA, 19 nt, Homo sapiens
gugagaaggguuacuacua

SEQ ID NO: 595482 - RNA, 19 nt, Homo sapiens
guaaugagcaggaagaaaa

SEQ ID NO: 595483 - RNA, 19 nt, Homo sapiens
gcaccuuuguugaauugug

SEQ ID NO: 595484 - RNA, 19 nt, Homo sapiens
gaacucugggcuuggguaa

SEQ ID NO: 595485 - RNA, 19 nt, Homo sapiens
gaacuuugucauuaccuau

SEQ ID NO: 595486 - RNA, 19 nt, Homo sapiens
gccaugauuucuucucugu

SEQ ID NO: 595487 - RNA, 19 nt, Homo sapiens
ugggagggcuggagacaga

SEQ ID NO: 595488 - RNA, 19 nt, Homo sapiens
gcucagucauuucccuguu

SEQ ID NO: 595489 - RNA, 19 nt, Homo sapiens
gcaccugcaccuuuguuga

SEQ ID NO: 595490 - RNA, 19 nt, Homo sapiens
cagagaaggccaaggucua

SEQ ID NO: 595491 - RNA, 19 nt, Homo sapiens
ggagacagaggaugacuac

SEQ ID NO: 595492 - RNA, 19 nt, Homo sapiens
acucggccauaaagaauuu

SEQ ID NO: 595493 - RNA, 19 nt, Homo sapiens
gagccuggcaacaagauga

SEQ ID NO: 595494 - RNA, 19 nt, Homo sapiens
gcuucgcgcuggagauguu

SEQ ID NO: 595495 - RNA, 19 nt, Homo sapiens
aaacuuguaaccacccuuu

SEQ ID NO: 595496 - RNA, 19 nt, Homo sapiens
gagaaggguuacuacuacu

SEQ ID NO: 595497 - RNA, 19 nt, Homo sapiens
uggaugagcucggaagaca

SEQ ID NO: 595498 - RNA, 19 nt, Homo sapiens
gcucugacguucccuuuug

SEQ ID NO: 595499 - RNA, 19 nt, Homo sapiens
gagggccagugguuucuca

SEQ ID NO: 595500 - RNA, 19 nt, Homo sapiens
uggcacagcucaguaugga

SEQ ID NO: 595501 - RNA, 19 nt, Homo sapiens
ucagucauuucccuguuga

SEQ ID NO: 595502 - RNA, 19 nt, Homo sapiens
acucugggcuuggguaaug

SEQ ID NO: 595503 - RNA, 19 nt, Homo sapiens
aguauggagucaccaaguu

SEQ ID NO: 595504 - RNA, 19 nt, Homo sapiens
cauaugagucaaaggaaga

SEQ ID NO: 595505 - RNA, 19 nt, Homo sapiens
agaacuuugucauuaccua

SEQ ID NO: 595506 - RNA, 19 nt, Homo sapiens
ccaagucagccuucacuca

SEQ ID NO: 595507 - RNA, 19 nt, Homo sapiens
uaaccacccuuuucuaaca

SEQ ID NO: 595508 - RNA, 19 nt, Homo sapiens
cugcaccuuuguugaauug

SEQ ID NO: 595509 - RNA, 19 nt, Homo sapiens
cagaggaugacuacagcua

SEQ ID NO: 595510 - RNA, 19 nt, Homo sapiens
cuaucuaccugaauacucu

SEQ ID NO: 595511 - RNA, 19 nt, Homo sapiens
gaggaguuccgcacuaucu

SEQ ID NO: 595512 - RNA, 19 nt, Homo sapiens
uaaccggacauaugaguca

SEQ ID NO: 595513 - RNA, 19 nt, Homo sapiens
acuuucagcucagucauuu

SEQ ID NO: 595514 - RNA, 19 nt, Homo sapiens
gccaagagaggcccaaucu

SEQ ID NO: 595515 - RNA, 19 nt, Homo sapiens
caaagaccagggcaugugu

SEQ ID NO: 595516 - RNA, 19 nt, Homo sapiens
cuucaagaacuuugucauu

SEQ ID NO: 595517 - RNA, 19 nt, Homo sapiens
gcuuuccucuguuugauac

SEQ ID NO: 595518 - RNA, 19 nt, Homo sapiens
ugugguagcuuaggaggau

SEQ ID NO: 595519 - RNA, 19 nt, Homo sapiens
cagcagagaaggccaaggu

SEQ ID NO: 595520 - RNA, 19 nt, Homo sapiens
gguaaugagcaggaagaaa

SEQ ID NO: 595521 - RNA, 19 nt, Homo sapiens
caccugcaccuuuguugaa

SEQ ID NO: 595522 - RNA, 19 nt, Homo sapiens
ccguggagcugagccagaa

SEQ ID NO: 595523 - RNA, 19 nt, Homo sapiens
ggccaaggucuacaucaau

SEQ ID NO: 595524 - RNA, 19 nt, Homo sapiens
gacauaugagucaaaggaa

SEQ ID NO: 595525 - RNA, 19 nt, Homo sapiens
caagaacuuugucauuacc

SEQ ID NO: 595526 - RNA, 19 nt, Homo sapiens
aggccaaggucuacaucaa

SEQ ID NO: 595527 - RNA, 19 nt, Homo sapiens
ugaagcaagccaagucugu

SEQ ID NO: 595528 - RNA, 19 nt, Homo sapiens
caaucuccguggccaucaa

SEQ ID NO: 595529 - RNA, 19 nt, Homo sapiens
ucaaagaccagggcaugug

SEQ ID NO: 595530 - RNA, 19 nt, Homo sapiens
uguccgucuuugucaauaa

SEQ ID NO: 595531 - RNA, 19 nt, Homo sapiens
agacagaggaugacuacag

SEQ ID NO: 595532 - RNA, 19 nt, Homo sapiens
cuacucggccauaaagaau

SEQ ID NO: 595533 - RNA, 19 nt, Homo sapiens
ccuacucggccauaaagaa

SEQ ID NO: 595534 - RNA, 19 nt, Homo sapiens
ccaaggucuacaucaauga

SEQ ID NO: 595535 - RNA, 19 nt, Homo sapiens
gaaggccaaggucuacauc

SEQ ID NO: 595536 - RNA, 19 nt, Homo sapiens
acaacagaaacgagacuuu

SEQ ID NO: 595537 - RNA, 19 nt, Homo sapiens
cagccaugauuucuucucu

SEQ ID NO: 595538 - RNA, 19 nt, Homo sapiens
gagcccaagucagccuuca

SEQ ID NO: 595539 - RNA, 19 nt, Homo sapiens
guauggagucaccaaguuc

SEQ ID NO: 595540 - RNA, 19 nt, Homo sapiens
aaaagagccuggcaacaag

SEQ ID NO: 595541 - RNA, 19 nt, Homo sapiens
gaugaagcaagccaagucu

SEQ ID NO: 595542 - RNA, 19 nt, Homo sapiens
gcacuaucuaccugaauac

SEQ ID NO: 595543 - RNA, 19 nt, Homo sapiens
gcucugcagcuuccaaguc

SEQ ID NO: 595544 - RNA, 19 nt, Homo sapiens
ggaguuccgcacuaucuac

SEQ ID NO: 595545 - RNA, 19 nt, Homo sapiens
aggaggaguuccgcacuau

SEQ ID NO: 595546 - RNA, 19 nt, Homo sapiens
ccugcaccuuuguugaauu

SEQ ID NO: 595547 - RNA, 19 nt, Homo sapiens
gaauaaaggugcuagaaga

SEQ ID NO: 595548 - RNA, 19 nt, Homo sapiens
gguauaagauguagcauuu

SEQ ID NO: 595549 - RNA, 19 nt, Homo sapiens
gcagaaacuugaugugaaa

SEQ ID NO: 595550 - RNA, 19 nt, Homo sapiens
ggaaggagacugugaauga

SEQ ID NO: 595551 - RNA, 19 nt, Homo sapiens
ugacaaagcucagcagaaa

SEQ ID NO: 595552 - RNA, 19 nt, Homo sapiens
gcagagagaagccagaaua

SEQ ID NO: 595553 - RNA, 19 nt, Homo sapiens
guugcuaucuucaucauua

SEQ ID NO: 595554 - RNA, 19 nt, Homo sapiens
gaagcuaccuuuuaguuua

SEQ ID NO: 595555 - RNA, 19 nt, Homo sapiens
caacuucucagaucuauaa

SEQ ID NO: 595556 - RNA, 19 nt, Homo sapiens
gaaggcagacuccagguua

SEQ ID NO: 595557 - RNA, 19 nt, Homo sapiens
gauguaauccugugaauug

SEQ ID NO: 595558 - RNA, 19 nt, Homo sapiens
gaaggagacugugaaugaa

SEQ ID NO: 595559 - RNA, 19 nt, Homo sapiens
gaauuugaguuguugagaa

SEQ ID NO: 595560 - RNA, 19 nt, Homo sapiens
gaacaugcaagaaacauau

SEQ ID NO: 595561 - RNA, 19 nt, Homo sapiens
uuacugaccuuaagcacua

SEQ ID NO: 595562 - RNA, 19 nt, Homo sapiens
caacauggauccagauuuu

SEQ ID NO: 595563 - RNA, 19 nt, Homo sapiens
caagaaacauauacugcuu

SEQ ID NO: 595564 - RNA, 19 nt, Homo sapiens
gaagaaaugccaugaacau

SEQ ID NO: 595565 - RNA, 19 nt, Homo sapiens
aacaugaacuuaugcagua

SEQ ID NO: 595566 - RNA, 19 nt, Homo sapiens
ccaagaagcagcaguguga

SEQ ID NO: 595567 - RNA, 19 nt, Homo sapiens
ggacuuagcauccaagaag

SEQ ID NO: 595568 - RNA, 19 nt, Homo sapiens
gaagauagaaaucaguguu

SEQ ID NO: 595569 - RNA, 19 nt, Homo sapiens
gagagaagccagaauaaag

SEQ ID NO: 595570 - RNA, 19 nt, Homo sapiens
caggaaacaugaacuuaug

SEQ ID NO: 595571 - RNA, 19 nt, Homo sapiens
gugaugaacugcagucugu

SEQ ID NO: 595572 - RNA, 19 nt, Homo sapiens
gaaacaaggucaguugaac

SEQ ID NO: 595573 - RNA, 19 nt, Homo sapiens
ucagaucuauaaugggaua

SEQ ID NO: 595574 - RNA, 19 nt, Homo sapiens
gauggcugcucaggacuua

SEQ ID NO: 595575 - RNA, 19 nt, Homo sapiens
gcaggaaacaugaacuuau

SEQ ID NO: 595576 - RNA, 19 nt, Homo sapiens
ugaagaacauuaugcagau

SEQ ID NO: 595577 - RNA, 19 nt, Homo sapiens
gcagagugcuggucaucau

SEQ ID NO: 595578 - RNA, 19 nt, Homo sapiens
gaacauaccgauggucaga

SEQ ID NO: 595579 - RNA, 19 nt, Homo sapiens
uaguugagcuauuugguuu

SEQ ID NO: 595580 - RNA, 19 nt, Homo sapiens
gucaagauguucguuaauu

SEQ ID NO: 595581 - RNA, 19 nt, Homo sapiens
gcggcgauauagugaauuu

SEQ ID NO: 595582 - RNA, 19 nt, Homo sapiens
cagaagcacaaguaaauaa

SEQ ID NO: 595583 - RNA, 19 nt, Homo sapiens
gacaaaaucuucuaucugu

SEQ ID NO: 595584 - RNA, 19 nt, Homo sapiens
uagcaacuccuauauagaa

SEQ ID NO: 595585 - RNA, 19 nt, Homo sapiens
guaauccugugaauugaau

SEQ ID NO: 595586 - RNA, 19 nt, Homo sapiens
ggugcuagaagaacaaaua

SEQ ID NO: 595587 - RNA, 19 nt, Homo sapiens
gagauuuacugaccuuaag

SEQ ID NO: 595588 - RNA, 19 nt, Homo sapiens
gaaggcagagaauuuguga

SEQ ID NO: 595589 - RNA, 19 nt, Homo sapiens
gaucgacucuaugguguau

SEQ ID NO: 595590 - RNA, 19 nt, Homo sapiens
caagagauuuacugaccuu

SEQ ID NO: 595591 - RNA, 19 nt, Homo sapiens
gaaggagaacaacagcuaa

SEQ ID NO: 595592 - RNA, 19 nt, Homo sapiens
uaaaggugcuagaagaaca

SEQ ID NO: 595593 - RNA, 19 nt, Homo sapiens
gaacugcagucugucaucu

SEQ ID NO: 595594 - RNA, 19 nt, Homo sapiens
ucacaucccauccuuugua

SEQ ID NO: 595595 - RNA, 19 nt, Homo sapiens
ggaccaaugcuaaggaaug

SEQ ID NO: 595596 - RNA, 19 nt, Homo sapiens
ucuagcaacuccuauauag

SEQ ID NO: 595597 - RNA, 19 nt, Homo sapiens
gcagaucaguaugugcaaa

SEQ ID NO: 595598 - RNA, 19 nt, Homo sapiens
ggaagaugaagaacauuau

SEQ ID NO: 595599 - RNA, 19 nt, Homo sapiens
guaugcaucuucuauugau

SEQ ID NO: 595600 - RNA, 19 nt, Homo sapiens
guguaugcaucuucuauug

SEQ ID NO: 595601 - RNA, 19 nt, Homo sapiens
cagaauuuguuuggcauaa

SEQ ID NO: 595602 - RNA, 19 nt, Homo sapiens
agacucaacuucucagauc

SEQ ID NO: 595603 - RNA, 19 nt, Homo sapiens
caacaaagaagacucaacu

SEQ ID NO: 595604 - RNA, 19 nt, Homo sapiens
gaagaugaagaacauuaug

SEQ ID NO: 595605 - RNA, 19 nt, Homo sapiens
caacuccuauauagaaagu

SEQ ID NO: 595606 - RNA, 19 nt, Homo sapiens
ucucuugccuuauaguuga

SEQ ID NO: 595607 - RNA, 19 nt, Homo sapiens
gauguucguuaauuucuag

SEQ ID NO: 595608 - RNA, 19 nt, Homo sapiens
aaacagaagcacaaguaaa

SEQ ID NO: 595609 - RNA, 19 nt, Homo sapiens
cgaugacacacaauaauuu

SEQ ID NO: 595610 - RNA, 19 nt, Homo sapiens
caaggucaguugaacauac

SEQ ID NO: 595611 - RNA, 19 nt, Homo sapiens
gauccacuaaucuguuaua

SEQ ID NO: 595612 - RNA, 19 nt, Homo sapiens
gacugaaugucaagauguu

SEQ ID NO: 595613 - RNA, 19 nt, Homo sapiens
cgcaugggcugauauugaa

SEQ ID NO: 595614 - RNA, 19 nt, Homo sapiens
gaccagcuguuucagaucu

SEQ ID NO: 595615 - RNA, 19 nt, Homo sapiens
ugaaggagaacaacagcua

SEQ ID NO: 595616 - RNA, 19 nt, Homo sapiens
gaacuuaugcaguaugacu

SEQ ID NO: 595617 - RNA, 19 nt, Homo sapiens
cuaguccuguuuagcauuu

SEQ ID NO: 595618 - RNA, 19 nt, Homo sapiens
cuagauguuuguuucaaga

SEQ ID NO: 595619 - RNA, 19 nt, Homo sapiens
caaaacagaagcacaagua

SEQ ID NO: 595620 - RNA, 19 nt, Homo sapiens
ugaagggaaugacuaccaa

SEQ ID NO: 595621 - RNA, 19 nt, Homo sapiens
cauaaacucucugcugaca

SEQ ID NO: 595622 - RNA, 19 nt, Homo sapiens
gcagucaugcagaucagua

SEQ ID NO: 595623 - RNA, 19 nt, Homo sapiens
gaagaacauuaugcagauc

SEQ ID NO: 595624 - RNA, 19 nt, Homo sapiens
gagaggcgacggauugguu

SEQ ID NO: 595625 - RNA, 19 nt, Homo sapiens
ucaguaaugagccuaaauu

SEQ ID NO: 595626 - RNA, 19 nt, Homo sapiens
caagauguucguuaauuuc

SEQ ID NO: 595627 - RNA, 19 nt, Homo sapiens
uggaagaugaagaacauua

SEQ ID NO: 595628 - RNA, 19 nt, Homo sapiens
uaaacucucugcugacaac

SEQ ID NO: 595629 - RNA, 19 nt, Homo sapiens
gcuuggcucucuacacaug

SEQ ID NO: 595630 - RNA, 19 nt, Homo sapiens
ggacuggugcugauuccaa

SEQ ID NO: 595631 - RNA, 19 nt, Homo sapiens
caaaagaaccgagacuuaa

SEQ ID NO: 595632 - RNA, 19 nt, Homo sapiens
ugaagaagauagaaaucag

SEQ ID NO: 595633 - RNA, 19 nt, Homo sapiens
gacacgaugacacacaaua

SEQ ID NO: 595634 - RNA, 19 nt, Homo sapiens
gauacauugucauccucua

SEQ ID NO: 595635 - RNA, 19 nt, Homo sapiens
cagcagaaacuugauguga

SEQ ID NO: 595636 - RNA, 19 nt, Homo sapiens
gacuggugcugauuccaaa

SEQ ID NO: 595637 - RNA, 19 nt, Homo sapiens
cagagagaagccagaauaa

SEQ ID NO: 595638 - RNA, 19 nt, Homo sapiens
guugagcuauuugguuuga

SEQ ID NO: 595639 - RNA, 19 nt, Homo sapiens
ggagaacaacagcuaaagu

SEQ ID NO: 595640 - RNA, 19 nt, Homo sapiens
gaagaagauagaaaucagu

SEQ ID NO: 595641 - RNA, 19 nt, Homo sapiens
gcgacggauugguuuagaa

SEQ ID NO: 595642 - RNA, 19 nt, Homo sapiens
uguaguauauguucagaag

SEQ ID NO: 595643 - RNA, 19 nt, Homo sapiens
guauguguguuuguaguau

SEQ ID NO: 595644 - RNA, 19 nt, Homo sapiens
cauauguguugcuaucuuc

SEQ ID NO: 595645 - RNA, 19 nt, Homo sapiens
ggaagaaaugccaugaaca

SEQ ID NO: 595646 - RNA, 19 nt, Homo sapiens
uaauuguggucguguuaau

SEQ ID NO: 595647 - RNA, 19 nt, Homo sapiens
uagaggagaugauggaaua

SEQ ID NO: 595648 - RNA, 19 nt, Homo sapiens
uaacaugccuucaguauac

SEQ ID NO: 595649 - RNA, 19 nt, Homo sapiens
gaagauacagugacuuuga

SEQ ID NO: 595650 - RNA, 19 nt, Homo sapiens
ggucuuauuugcacaguuu

SEQ ID NO: 595651 - RNA, 19 nt, Homo sapiens
gaagugaauuagaaagaga

SEQ ID NO: 595652 - RNA, 19 nt, Homo sapiens
guaauacccuucacaugga

SEQ ID NO: 595653 - RNA, 19 nt, Homo sapiens
cugaaagaaucuacuguua

SEQ ID NO: 595654 - RNA, 19 nt, Homo sapiens
ucacaaaccuguuauucca

SEQ ID NO: 595655 - RNA, 19 nt, Homo sapiens
acacucauaugcucaguuu

SEQ ID NO: 595656 - RNA, 19 nt, Homo sapiens
cacauaagauacauacuug

SEQ ID NO: 595657 - RNA, 19 nt, Homo sapiens
cacagaaacugguauaaca

SEQ ID NO: 595658 - RNA, 19 nt, Homo sapiens
gauaagcaccagugaagaa

SEQ ID NO: 595659 - RNA, 19 nt, Homo sapiens
gaaaucagggucaagacaa

SEQ ID NO: 595660 - RNA, 19 nt, Homo sapiens
gguauaacaugccuucagu

SEQ ID NO: 595661 - RNA, 19 nt, Homo sapiens
aauaagacaugccugaaau

SEQ ID NO: 595662 - RNA, 19 nt, Homo sapiens
agacaugccugaaauuugg

SEQ ID NO: 595663 - RNA, 19 nt, Homo sapiens
gcugcgaagugaauuagaa

SEQ ID NO: 595664 - RNA, 19 nt, Homo sapiens
gacaagaaguuaauuugcu

SEQ ID NO: 595665 - RNA, 19 nt, Homo sapiens
uaagacaugccugaaauuu

SEQ ID NO: 595666 - RNA, 19 nt, Homo sapiens
gauaaaagcuauacuccau

SEQ ID NO: 595667 - RNA, 19 nt, Homo sapiens
gaugauggaauauuugaug

SEQ ID NO: 595668 - RNA, 19 nt, Homo sapiens
gagggaaaucuuuauauuc

SEQ ID NO: 595669 - RNA, 19 nt, Homo sapiens
gauggaauauuugaugaca

SEQ ID NO: 595670 - RNA, 19 nt, Homo sapiens
gagaugauggaauauuuga

SEQ ID NO: 595671 - RNA, 19 nt, Homo sapiens
aggagaugauggaauauuu

SEQ ID NO: 595672 - RNA, 19 nt, Homo sapiens
gcaguugacaagaaguuaa

SEQ ID NO: 595673 - RNA, 19 nt, Homo sapiens
ggcagcagcuacagcgaaa

SEQ ID NO: 595674 - RNA, 19 nt, Homo sapiens
gaacguugucuucacaugu

SEQ ID NO: 595675 - RNA, 19 nt, Homo sapiens
aacaagggcuggagcaguu

SEQ ID NO: 595676 - RNA, 19 nt, Homo sapiens
gcacacauaagauacauac

SEQ ID NO: 595677 - RNA, 19 nt, Homo sapiens
uaggagcacuacaccauug

SEQ ID NO: 595678 - RNA, 19 nt, Homo sapiens
aaagcuauacuccaucuaa

SEQ ID NO: 595679 - RNA, 19 nt, Homo sapiens
ggagaugauggaauauuug

SEQ ID NO: 595680 - RNA, 19 nt, Homo sapiens
aaaucagggucaagacaaa

SEQ ID NO: 595681 - RNA, 19 nt, Homo sapiens
gggcuggagcaguuuauaa

SEQ ID NO: 595682 - RNA, 19 nt, Homo sapiens
aagaagauacagugacuuu

SEQ ID NO: 595683 - RNA, 19 nt, Homo sapiens
ucuugcaucugauuaacua

SEQ ID NO: 595684 - RNA, 19 nt, Homo sapiens
gcgaagugaauuagaaaga

SEQ ID NO: 595685 - RNA, 19 nt, Homo sapiens
gcugaaagaaucuacuguu

SEQ ID NO: 595686 - RNA, 19 nt, Homo sapiens
gaugugagcaacccgcaaa

SEQ ID NO: 595687 - RNA, 19 nt, Homo sapiens
uugaauggcugcgaaguga

SEQ ID NO: 595688 - RNA, 19 nt, Homo sapiens
aagauacagugacuuugaa

SEQ ID NO: 595689 - RNA, 19 nt, Homo sapiens
auacugcacacauaagaua

SEQ ID NO: 595690 - RNA, 19 nt, Homo sapiens
gcacagaaacugguauaac

SEQ ID NO: 595691 - RNA, 19 nt, Homo sapiens
aagcuauacuccaucuaaa

SEQ ID NO: 595692 - RNA, 19 nt, Homo sapiens
uuccaauacugcacacaua

SEQ ID NO: 595693 - RNA, 19 nt, Homo sapiens
uuacuggcuuggucuuauu

SEQ ID NO: 595694 - RNA, 19 nt, Homo sapiens
gcagugucguaacuaaagu

SEQ ID NO: 595695 - RNA, 19 nt, Homo sapiens
auuccagccuuucuauaua

SEQ ID NO: 595696 - RNA, 19 nt, Homo sapiens
uauaacaugccuucaguau

SEQ ID NO: 595697 - RNA, 19 nt, Homo sapiens
aagcaccagugaagaaguu

SEQ ID NO: 595698 - RNA, 19 nt, Homo sapiens
aaauaagacaugccugaaa

SEQ ID NO: 595699 - RNA, 19 nt, Homo sapiens
gaggagaugauggaauauu

SEQ ID NO: 595700 - RNA, 19 nt, Homo sapiens
agaagaagauacagugacu

SEQ ID NO: 595701 - RNA, 19 nt, Homo sapiens
uuccagccuuucuauauaa

SEQ ID NO: 595702 - RNA, 19 nt, Homo sapiens
uuagcaugcugcacagaaa

SEQ ID NO: 595703 - RNA, 19 nt, Homo sapiens
cgaagugaauuagaaagag

SEQ ID NO: 595704 - RNA, 19 nt, Homo sapiens
gaauggcugcgaagugaau

SEQ ID NO: 595705 - RNA, 19 nt, Homo sapiens
cuucaccacuuacgaaauc

SEQ ID NO: 595706 - RNA, 19 nt, Homo sapiens
ugaaagaaucuacuguuag

SEQ ID NO: 595707 - RNA, 19 nt, Homo sapiens
cauaagauacauacuugug

SEQ ID NO: 595708 - RNA, 19 nt, Homo sapiens
caauacugcacacauaaga

SEQ ID NO: 595709 - RNA, 19 nt, Homo sapiens
guuacuggcuuggucuuau

SEQ ID NO: 595710 - RNA, 19 nt, Homo sapiens
caaggucgcuggucauccu

SEQ ID NO: 595711 - RNA, 19 nt, Homo sapiens
ggcuggagcaguuuauaaa

SEQ ID NO: 595712 - RNA, 19 nt, Homo sapiens
gggaaaucuuuauauucug

SEQ ID NO: 595713 - RNA, 19 nt, Homo sapiens
uaauacccuucacauggaa

SEQ ID NO: 595714 - RNA, 19 nt, Homo sapiens
cauuccagccuuucuauau

SEQ ID NO: 595715 - RNA, 19 nt, Homo sapiens
cgaacguugucuucacaug

SEQ ID NO: 595716 - RNA, 19 nt, Homo sapiens
cagaaacugguauaacaug

SEQ ID NO: 595717 - RNA, 19 nt, Homo sapiens
caagggcuggagcaguuua

SEQ ID NO: 595718 - RNA, 19 nt, Homo sapiens
gcucaguuuuguuuuguuu

SEQ ID NO: 595719 - RNA, 19 nt, Homo sapiens
ccugaaauuuggcaagaag

SEQ ID NO: 595720 - RNA, 19 nt, Homo sapiens
gcucuuucuugcuguuuua

SEQ ID NO: 595721 - RNA, 19 nt, Homo sapiens
guauaacaugccuucagua

SEQ ID NO: 595722 - RNA, 19 nt, Homo sapiens
aacguugucuucacauguu

SEQ ID NO: 595723 - RNA, 19 nt, Homo sapiens
ucugcagugucguaacuaa

SEQ ID NO: 595724 - RNA, 19 nt, Homo sapiens
auaacaugccuucaguaua

SEQ ID NO: 595725 - RNA, 19 nt, Homo sapiens
gcaucugauuaacuagaau

SEQ ID NO: 595726 - RNA, 19 nt, Homo sapiens
uagccucacaaaccuguua

SEQ ID NO: 595727 - RNA, 19 nt, Homo sapiens
cgaaaucagggucaagaca

SEQ ID NO: 595728 - RNA, 19 nt, Homo sapiens
gauacagugacuuugaaug

SEQ ID NO: 595729 - RNA, 19 nt, Homo sapiens
cagcagcuacagcgaaaug

SEQ ID NO: 595730 - RNA, 19 nt, Homo sapiens
guaaucugcagugucguaa

SEQ ID NO: 595731 - RNA, 19 nt, Homo sapiens
gaagaagauacagugacuu

SEQ ID NO: 595732 - RNA, 19 nt, Homo sapiens
ccagcaacuuccucgagau

SEQ ID NO: 595733 - RNA, 19 nt, Homo sapiens
ccaagccgcagaaccugaa

SEQ ID NO: 595734 - RNA, 19 nt, Homo sapiens
caguauacuaacacucaua

SEQ ID NO: 595735 - RNA, 19 nt, Homo sapiens
ugcaucugauuaacuagaa

SEQ ID NO: 595736 - RNA, 19 nt, Homo sapiens
gcuucuugcaucugauuaa

SEQ ID NO: 595737 - RNA, 19 nt, Homo sapiens
guuugcuucuugcaucuga

SEQ ID NO: 595738 - RNA, 19 nt, Homo sapiens
uguaaucugcagugucgua

SEQ ID NO: 595739 - RNA, 19 nt, Homo sapiens
ggcaguugacaagaaguua

SEQ ID NO: 595740 - RNA, 19 nt, Homo sapiens
aagacaugccugaaauuug

SEQ ID NO: 595741 - RNA, 19 nt, Homo sapiens
uccaauacugcacacauaa

SEQ ID NO: 595742 - RNA, 19 nt, Homo sapiens
aaucugcagugucguaacu

SEQ ID NO: 595743 - RNA, 19 nt, Homo sapiens
acgugacuauuaaugauug

SEQ ID NO: 595744 - RNA, 19 nt, Homo sapiens
ccucacaaaccuguuauuc

SEQ ID NO: 595745 - RNA, 19 nt, Homo sapiens
ugacaagaaguuaauuugc

SEQ ID NO: 595746 - RNA, 19 nt, Homo sapiens
agagagcaaggucguaguu

SEQ ID NO: 595747 - RNA, 19 nt, Homo sapiens
uagaggagaugauggaaua

SEQ ID NO: 595748 - RNA, 19 nt, Homo sapiens
uaacaugccuucaguauac

SEQ ID NO: 595749 - RNA, 19 nt, Homo sapiens
ggucuuauuugcacaguuu

SEQ ID NO: 595750 - RNA, 19 nt, Homo sapiens
guaauacccuucacaugga

SEQ ID NO: 595751 - RNA, 19 nt, Homo sapiens
ucacaaaccuguuauucca

SEQ ID NO: 595752 - RNA, 19 nt, Homo sapiens
acacucauaugcucaguuu

SEQ ID NO: 595753 - RNA, 19 nt, Homo sapiens
cacauaagauacauacuug

SEQ ID NO: 595754 - RNA, 19 nt, Homo sapiens
cacagaaacugguauaaca

SEQ ID NO: 595755 - RNA, 19 nt, Homo sapiens
gauaagcaccagugaagaa

SEQ ID NO: 595756 - RNA, 19 nt, Homo sapiens
gguauaacaugccuucagu

SEQ ID NO: 595757 - RNA, 19 nt, Homo sapiens
aauaagacaugccugaaau

SEQ ID NO: 595758 - RNA, 19 nt, Homo sapiens
agacaugccugaaauuugg

SEQ ID NO: 595759 - RNA, 19 nt, Homo sapiens
gacaagaaguuaauuugcu

SEQ ID NO: 595760 - RNA, 19 nt, Homo sapiens
uaagacaugccugaaauuu

SEQ ID NO: 595761 - RNA, 19 nt, Homo sapiens
gauaaaagcuauacuccau

SEQ ID NO: 595762 - RNA, 19 nt, Homo sapiens
gaugauggaauauuugaug

SEQ ID NO: 595763 - RNA, 19 nt, Homo sapiens
gagggaaaucuuuauauuc

SEQ ID NO: 595764 - RNA, 19 nt, Homo sapiens
gauggaauauuugaugaca

SEQ ID NO: 595765 - RNA, 19 nt, Homo sapiens
gagaugauggaauauuuga

SEQ ID NO: 595766 - RNA, 19 nt, Homo sapiens
aggagaugauggaauauuu

SEQ ID NO: 595767 - RNA, 19 nt, Homo sapiens
gcaguugacaagaaguuaa

SEQ ID NO: 595768 - RNA, 19 nt, Homo sapiens
gaacguugucuucacaugu

SEQ ID NO: 595769 - RNA, 19 nt, Homo sapiens
aacaagggcuggagcaguu

SEQ ID NO: 595770 - RNA, 19 nt, Homo sapiens
ggcagcagcuacagcgaaa

SEQ ID NO: 595771 - RNA, 19 nt, Homo sapiens
gcacacauaagauacauac

SEQ ID NO: 595772 - RNA, 19 nt, Homo sapiens
uaggagcacuacaccauug

SEQ ID NO: 595773 - RNA, 19 nt, Homo sapiens
aaagcuauacuccaucuaa

SEQ ID NO: 595774 - RNA, 19 nt, Homo sapiens
ggagaugauggaauauuug

SEQ ID NO: 595775 - RNA, 19 nt, Homo sapiens
gggcuggagcaguuuauaa

SEQ ID NO: 595776 - RNA, 19 nt, Homo sapiens
ucuugcaucugauuaacua

SEQ ID NO: 595777 - RNA, 19 nt, Homo sapiens
gaugugagcaacccgcaaa

SEQ ID NO: 595778 - RNA, 19 nt, Homo sapiens
auacugcacacauaagaua

SEQ ID NO: 595779 - RNA, 19 nt, Homo sapiens
gcacagaaacugguauaac

SEQ ID NO: 595780 - RNA, 19 nt, Homo sapiens
aagcuauacuccaucuaaa

SEQ ID NO: 595781 - RNA, 19 nt, Homo sapiens
uuccaauacugcacacaua

SEQ ID NO: 595782 - RNA, 19 nt, Homo sapiens
uuacuggcuuggucuuauu

SEQ ID NO: 595783 - RNA, 19 nt, Homo sapiens
gcagugucguaacuaaagu

SEQ ID NO: 595784 - RNA, 19 nt, Homo sapiens
auuccagccuuucuauaua

SEQ ID NO: 595785 - RNA, 19 nt, Homo sapiens
uauaacaugccuucaguau

SEQ ID NO: 595786 - RNA, 19 nt, Homo sapiens
aagcaccagugaagaaguu

SEQ ID NO: 595787 - RNA, 19 nt, Homo sapiens
aaauaagacaugccugaaa

SEQ ID NO: 595788 - RNA, 19 nt, Homo sapiens
gaggagaugauggaauauu

SEQ ID NO: 595789 - RNA, 19 nt, Homo sapiens
uuccagccuuucuauauaa

SEQ ID NO: 595790 - RNA, 19 nt, Homo sapiens
uuagcaugcugcacagaaa

SEQ ID NO: 595791 - RNA, 19 nt, Homo sapiens
cuucaccacuuacgaaauc

SEQ ID NO: 595792 - RNA, 19 nt, Homo sapiens
cauaagauacauacuugug

SEQ ID NO: 595793 - RNA, 19 nt, Homo sapiens
caauacugcacacauaaga

SEQ ID NO: 595794 - RNA, 19 nt, Homo sapiens
guuacuggcuuggucuuau

SEQ ID NO: 595795 - RNA, 19 nt, Homo sapiens
caaggucgcuggucauccu

SEQ ID NO: 595796 - RNA, 19 nt, Homo sapiens
ggcuggagcaguuuauaaa

SEQ ID NO: 595797 - RNA, 19 nt, Homo sapiens
gggaaaucuuuauauucug

SEQ ID NO: 595798 - RNA, 19 nt, Homo sapiens
uaauacccuucacauggaa

SEQ ID NO: 595799 - RNA, 19 nt, Homo sapiens
cauuccagccuuucuauau

SEQ ID NO: 595800 - RNA, 19 nt, Homo sapiens
cgaacguugucuucacaug

SEQ ID NO: 595801 - RNA, 19 nt, Homo sapiens
cagaaacugguauaacaug

SEQ ID NO: 595802 - RNA, 19 nt, Homo sapiens
caagggcuggagcaguuua

SEQ ID NO: 595803 - RNA, 19 nt, Homo sapiens
gcucaguuuuguuuuguuu

SEQ ID NO: 595804 - RNA, 19 nt, Homo sapiens
ccugaaauuuggcaagaag

SEQ ID NO: 595805 - RNA, 19 nt, Homo sapiens
gcucuuucuugcuguuuua

SEQ ID NO: 595806 - RNA, 19 nt, Homo sapiens
guauaacaugccuucagua

SEQ ID NO: 595807 - RNA, 19 nt, Homo sapiens
aacguugucuucacauguu

SEQ ID NO: 595808 - RNA, 19 nt, Homo sapiens
ucugcagugucguaacuaa

SEQ ID NO: 595809 - RNA, 19 nt, Homo sapiens
auaacaugccuucaguaua

SEQ ID NO: 595810 - RNA, 19 nt, Homo sapiens
gcaucugauuaacuagaau

SEQ ID NO: 595811 - RNA, 19 nt, Homo sapiens
uagccucacaaaccuguua

SEQ ID NO: 595812 - RNA, 19 nt, Homo sapiens
cagcagcuacagcgaaaug

SEQ ID NO: 595813 - RNA, 19 nt, Homo sapiens
guaaucugcagugucguaa

SEQ ID NO: 595814 - RNA, 19 nt, Homo sapiens
ccagcaacuuccucgagau

SEQ ID NO: 595815 - RNA, 19 nt, Homo sapiens
ccaagccgcagaaccugaa

SEQ ID NO: 595816 - RNA, 19 nt, Homo sapiens
caguauacuaacacucaua

SEQ ID NO: 595817 - RNA, 19 nt, Homo sapiens
ugcaucugauuaacuagaa

SEQ ID NO: 595818 - RNA, 19 nt, Homo sapiens
gcuucuugcaucugauuaa

SEQ ID NO: 595819 - RNA, 19 nt, Homo sapiens
guuugcuucuugcaucuga

SEQ ID NO: 595820 - RNA, 19 nt, Homo sapiens
uguaaucugcagugucgua

SEQ ID NO: 595821 - RNA, 19 nt, Homo sapiens
ggcaguugacaagaaguua

SEQ ID NO: 595822 - RNA, 19 nt, Homo sapiens
aagacaugccugaaauuug

SEQ ID NO: 595823 - RNA, 19 nt, Homo sapiens
uccaauacugcacacauaa

SEQ ID NO: 595824 - RNA, 19 nt, Homo sapiens
aaucugcagugucguaacu

SEQ ID NO: 595825 - RNA, 19 nt, Homo sapiens
acgugacuauuaaugauug

SEQ ID NO: 595826 - RNA, 19 nt, Homo sapiens
ccucacaaaccuguuauuc

SEQ ID NO: 595827 - RNA, 19 nt, Homo sapiens
ugacaagaaguuaauuugc

SEQ ID NO: 595828 - RNA, 19 nt, Homo sapiens
gccugaaauuuggcaagaa

SEQ ID NO: 595829 - RNA, 19 nt, Homo sapiens
uaaaagcuauacuccaucu

SEQ ID NO: 595830 - RNA, 19 nt, Homo sapiens
aaccuguuauuccagugua

SEQ ID NO: 595831 - RNA, 19 nt, Homo sapiens
cauaugcucaguuuuguuu

SEQ ID NO: 595832 - RNA, 19 nt, Homo sapiens
uauacuaacacucauaugc

SEQ ID NO: 595833 - RNA, 19 nt, Homo sapiens
gcgucuuguuugcuucuug

SEQ ID NO: 595834 - RNA, 19 nt, Homo sapiens
ccucauuccagccuuucua

SEQ ID NO: 595835 - RNA, 19 nt, Homo sapiens
uagaggagaugauggaaua

SEQ ID NO: 595836 - RNA, 19 nt, Homo sapiens
uaacaugccuucaguauac

SEQ ID NO: 595837 - RNA, 19 nt, Homo sapiens
gaagauacagugacuuuga

SEQ ID NO: 595838 - RNA, 19 nt, Homo sapiens
ggucuuauuugcacaguuu

SEQ ID NO: 595839 - RNA, 19 nt, Homo sapiens
gaagugaauuagaaagaga

SEQ ID NO: 595840 - RNA, 19 nt, Homo sapiens
guaauacccuucacaugga

SEQ ID NO: 595841 - RNA, 19 nt, Homo sapiens
cugaaagaaucuacuguua

SEQ ID NO: 595842 - RNA, 19 nt, Homo sapiens
ucacaaaccuguuauucca

SEQ ID NO: 595843 - RNA, 19 nt, Homo sapiens
acacucauaugcucaguuu

SEQ ID NO: 595844 - RNA, 19 nt, Homo sapiens
cacauaagauacauacuug

SEQ ID NO: 595845 - RNA, 19 nt, Homo sapiens
cacagaaacugguauaaca

SEQ ID NO: 595846 - RNA, 19 nt, Homo sapiens
gauaagcaccagugaagaa

SEQ ID NO: 595847 - RNA, 19 nt, Homo sapiens
gaaaucagggucaagacaa

SEQ ID NO: 595848 - RNA, 19 nt, Homo sapiens
gguauaacaugccuucagu

SEQ ID NO: 595849 - RNA, 19 nt, Homo sapiens
aauaagacaugccugaaau

SEQ ID NO: 595850 - RNA, 19 nt, Homo sapiens
agacaugccugaaauuugg

SEQ ID NO: 595851 - RNA, 19 nt, Homo sapiens
gcugcgaagugaauuagaa

SEQ ID NO: 595852 - RNA, 19 nt, Homo sapiens
gagcaagcccugccucaga

SEQ ID NO: 595853 - RNA, 19 nt, Homo sapiens
gacaagaaguuaauuugcu

SEQ ID NO: 595854 - RNA, 19 nt, Homo sapiens
uaagacaugccugaaauuu

SEQ ID NO: 595855 - RNA, 19 nt, Homo sapiens
gauaaaagcuauacuccau

SEQ ID NO: 595856 - RNA, 19 nt, Homo sapiens
gaugauggaauauuugaug

SEQ ID NO: 595857 - RNA, 19 nt, Homo sapiens
gagggaaaucuuuauauuc

SEQ ID NO: 595858 - RNA, 19 nt, Homo sapiens
gauggaauauuugaugaca

SEQ ID NO: 595859 - RNA, 19 nt, Homo sapiens
gagaugauggaauauuuga

SEQ ID NO: 595860 - RNA, 19 nt, Homo sapiens
aggagaugauggaauauuu

SEQ ID NO: 595861 - RNA, 19 nt, Homo sapiens
gcaguugacaagaaguuaa

SEQ ID NO: 595862 - RNA, 19 nt, Homo sapiens
ggcagcagcuacagcgaaa

SEQ ID NO: 595863 - RNA, 19 nt, Homo sapiens
gaacguugucuucacaugu

SEQ ID NO: 595864 - RNA, 19 nt, Homo sapiens
aacaagggcuggagcaguu

SEQ ID NO: 595865 - RNA, 19 nt, Homo sapiens
gcacacauaagauacauac

SEQ ID NO: 595866 - RNA, 19 nt, Homo sapiens
uaggagcacuacaccauug

SEQ ID NO: 595867 - RNA, 19 nt, Homo sapiens
aaagcuauacuccaucuaa

SEQ ID NO: 595868 - RNA, 19 nt, Homo sapiens
ggagaugauggaauauuug

SEQ ID NO: 595869 - RNA, 19 nt, Homo sapiens
aaaucagggucaagacaaa

SEQ ID NO: 595870 - RNA, 19 nt, Homo sapiens
gggcuggagcaguuuauaa

SEQ ID NO: 595871 - RNA, 19 nt, Homo sapiens
aagaagauacagugacuuu

SEQ ID NO: 595872 - RNA, 19 nt, Homo sapiens
ucuugcaucugauuaacua

SEQ ID NO: 595873 - RNA, 19 nt, Homo sapiens
gaugugagcaacccgcaaa

SEQ ID NO: 595874 - RNA, 19 nt, Homo sapiens
gcgaagugaauuagaaaga

SEQ ID NO: 595875 - RNA, 19 nt, Homo sapiens
gcugaaagaaucuacuguu

SEQ ID NO: 595876 - RNA, 19 nt, Homo sapiens
uugaauggcugcgaaguga

SEQ ID NO: 595877 - RNA, 19 nt, Homo sapiens
aagauacagugacuuugaa

SEQ ID NO: 595878 - RNA, 19 nt, Homo sapiens
auacugcacacauaagaua

SEQ ID NO: 595879 - RNA, 19 nt, Homo sapiens
gcacagaaacugguauaac

SEQ ID NO: 595880 - RNA, 19 nt, Homo sapiens
aagcuauacuccaucuaaa

SEQ ID NO: 595881 - RNA, 19 nt, Homo sapiens
uuccaauacugcacacaua

SEQ ID NO: 595882 - RNA, 19 nt, Homo sapiens
uuacuggcuuggucuuauu

SEQ ID NO: 595883 - RNA, 19 nt, Homo sapiens
gcagugucguaacuaaagu

SEQ ID NO: 595884 - RNA, 19 nt, Homo sapiens
auuccagccuuucuauaua

SEQ ID NO: 595885 - RNA, 19 nt, Homo sapiens
uauaacaugccuucaguau

SEQ ID NO: 595886 - RNA, 19 nt, Homo sapiens
aagcaccagugaagaaguu

SEQ ID NO: 595887 - RNA, 19 nt, Homo sapiens
aaauaagacaugccugaaa

SEQ ID NO: 595888 - RNA, 19 nt, Homo sapiens
gaggagaugauggaauauu

SEQ ID NO: 595889 - RNA, 19 nt, Homo sapiens
ggacguggugugcucagaa

SEQ ID NO: 595890 - RNA, 19 nt, Homo sapiens
agaagaagauacagugacu

SEQ ID NO: 595891 - RNA, 19 nt, Homo sapiens
uuccagccuuucuauauaa

SEQ ID NO: 595892 - RNA, 19 nt, Homo sapiens
uuagcaugcugcacagaaa

SEQ ID NO: 595893 - RNA, 19 nt, Homo sapiens
cgaagugaauuagaaagag

SEQ ID NO: 595894 - RNA, 19 nt, Homo sapiens
gaauggcugcgaagugaau

SEQ ID NO: 595895 - RNA, 19 nt, Homo sapiens
cuucaccacuuacgaaauc

SEQ ID NO: 595896 - RNA, 19 nt, Homo sapiens
ugaaagaaucuacuguuag

SEQ ID NO: 595897 - RNA, 19 nt, Homo sapiens
cauaagauacauacuugug

SEQ ID NO: 595898 - RNA, 19 nt, Homo sapiens
caauacugcacacauaaga

SEQ ID NO: 595899 - RNA, 19 nt, Homo sapiens
guuacuggcuuggucuuau

SEQ ID NO: 595900 - RNA, 19 nt, Homo sapiens
caaggucgcuggucauccu

SEQ ID NO: 595901 - RNA, 19 nt, Homo sapiens
ggcuggagcaguuuauaaa

SEQ ID NO: 595902 - RNA, 19 nt, Homo sapiens
ggugugcucagaaugauga

SEQ ID NO: 595903 - RNA, 19 nt, Homo sapiens
gacguggugugcucagaau

SEQ ID NO: 595904 - RNA, 19 nt, Homo sapiens
gcaaggagucauggaagga

SEQ ID NO: 595905 - RNA, 19 nt, Homo sapiens
gggaaaucuuuauauucug

SEQ ID NO: 595906 - RNA, 19 nt, Homo sapiens
uaauacccuucacauggaa

SEQ ID NO: 595907 - RNA, 19 nt, Homo sapiens
cauuccagccuuucuauau

SEQ ID NO: 595908 - RNA, 19 nt, Homo sapiens
cgaacguugucuucacaug

SEQ ID NO: 595909 - RNA, 19 nt, Homo sapiens
cagaaacugguauaacaug

SEQ ID NO: 595910 - RNA, 19 nt, Homo sapiens
caagggcuggagcaguuua

SEQ ID NO: 595911 - RNA, 19 nt, Homo sapiens
gcucaguuuuguuuuguuu

SEQ ID NO: 595912 - RNA, 19 nt, Homo sapiens
ccugaaauuuggcaagaag

SEQ ID NO: 595913 - RNA, 19 nt, Homo sapiens
gaggcaaggagucauggaa

SEQ ID NO: 595914 - RNA, 19 nt, Homo sapiens
gcucuuucuugcuguuuua

SEQ ID NO: 595915 - RNA, 19 nt, Homo sapiens
guauaacaugccuucagua

SEQ ID NO: 595916 - RNA, 19 nt, Homo sapiens
aacguugucuucacauguu

SEQ ID NO: 595917 - RNA, 19 nt, Homo sapiens
ucugcagugucguaacuaa

SEQ ID NO: 595918 - RNA, 19 nt, Homo sapiens
auaacaugccuucaguaua

SEQ ID NO: 595919 - RNA, 19 nt, Homo sapiens
gcaucugauuaacuagaau

SEQ ID NO: 595920 - RNA, 19 nt, Homo sapiens
cgaaaucagggucaagaca

SEQ ID NO: 595921 - RNA, 19 nt, Homo sapiens
uagccucacaaaccuguua

SEQ ID NO: 595922 - RNA, 19 nt, Homo sapiens
gauacagugacuuugaaug

SEQ ID NO: 595923 - RNA, 19 nt, Homo sapiens
agcaagcccugccucagaa

SEQ ID NO: 595924 - RNA, 19 nt, Homo sapiens
cagcagcuacagcgaaaug

SEQ ID NO: 595925 - RNA, 19 nt, Homo sapiens
guaaucugcagugucguaa

SEQ ID NO: 595926 - RNA, 19 nt, Homo sapiens
gaagaagauacagugacuu

SEQ ID NO: 595927 - RNA, 19 nt, Homo sapiens
ccagcaacuuccucgagau

SEQ ID NO: 595928 - RNA, 19 nt, Homo sapiens
ccaagccgcagaaccugaa

SEQ ID NO: 595929 - RNA, 19 nt, Homo sapiens
caucagaggcaaggaguca

SEQ ID NO: 595930 - RNA, 19 nt, Homo sapiens
caguauacuaacacucaua

SEQ ID NO: 595931 - RNA, 19 nt, Homo sapiens
ugcaucugauuaacuagaa

SEQ ID NO: 595932 - RNA, 19 nt, Homo sapiens
gcuucuugcaucugauuaa

SEQ ID NO: 595933 - RNA, 19 nt, Homo sapiens
guuugcuucuugcaucuga

SEQ ID NO: 595934 - RNA, 19 nt, Homo sapiens
uguaaucugcagugucgua

SEQ ID NO: 595935 - RNA, 19 nt, Homo sapiens
gaagaaagcuacaugaauu

SEQ ID NO: 595936 - RNA, 19 nt, Homo sapiens
caagguaacugucugaaua

SEQ ID NO: 595937 - RNA, 19 nt, Homo sapiens
ggaagaagguagauaauga

SEQ ID NO: 595938 - RNA, 19 nt, Homo sapiens
gaagguagauaaugacuau

SEQ ID NO: 595939 - RNA, 19 nt, Homo sapiens
ggaaagaacauguaagaaa

SEQ ID NO: 595940 - RNA, 19 nt, Homo sapiens
gaaaggaaguucuguugga

SEQ ID NO: 595941 - RNA, 19 nt, Homo sapiens
gaaauaagguauccugagu

SEQ ID NO: 595942 - RNA, 19 nt, Homo sapiens
guaacugucugaauacuuu

SEQ ID NO: 595943 - RNA, 19 nt, Homo sapiens
caaaugaugugaaauccaa

SEQ ID NO: 595944 - RNA, 19 nt, Homo sapiens
ggagauaauucuauaccaa

SEQ ID NO: 595945 - RNA, 19 nt, Homo sapiens
aauaagguauccugaguua

SEQ ID NO: 595946 - RNA, 19 nt, Homo sapiens
aagcagauauugcaaauga

SEQ ID NO: 595947 - RNA, 19 nt, Homo sapiens
ugucaacacucuuaucuaa

SEQ ID NO: 595948 - RNA, 19 nt, Homo sapiens
aaagaggguuucaaaguuu

SEQ ID NO: 595949 - RNA, 19 nt, Homo sapiens
aaagcaggcuguagguuua

SEQ ID NO: 595950 - RNA, 19 nt, Homo sapiens
guuuaaagcugccagauug

SEQ ID NO: 595951 - RNA, 19 nt, Homo sapiens
ggaagcaucugaagaaacu

SEQ ID NO: 595952 - RNA, 19 nt, Homo sapiens
gaagaggaaccacaagaaa

SEQ ID NO: 595953 - RNA, 19 nt, Homo sapiens
caaaauagguuacauguag

SEQ ID NO: 595954 - RNA, 19 nt, Homo sapiens
aaaccuaguuguucauuug

SEQ ID NO: 595955 - RNA, 19 nt, Homo sapiens
gcaccuugccugauaaauu

SEQ ID NO: 595956 - RNA, 19 nt, Homo sapiens
ggaagaaagcuacaugaau

SEQ ID NO: 595957 - RNA, 19 nt, Homo sapiens
ugggugaacuugauaguaa

SEQ ID NO: 595958 - RNA, 19 nt, Homo sapiens
gguuggagauaauucuaua

SEQ ID NO: 595959 - RNA, 19 nt, Homo sapiens
uaacgaccaugaggcuuua

SEQ ID NO: 595960 - RNA, 19 nt, Homo sapiens
caccuugccugauaaauug

SEQ ID NO: 595961 - RNA, 19 nt, Homo sapiens
caaagcaggcuguagguuu

SEQ ID NO: 595962 - RNA, 19 nt, Homo sapiens
cuaguuggcuauucaagaa

SEQ ID NO: 595963 - RNA, 19 nt, Homo sapiens
gaauaugucccucgcaaau

SEQ ID NO: 595964 - RNA, 19 nt, Homo sapiens
aaaggaagaucguaacaca

SEQ ID NO: 595965 - RNA, 19 nt, Homo sapiens
ugacauacgagaagaaauu

SEQ ID NO: 595966 - RNA, 19 nt, Homo sapiens
ggaagaggaaccacaagaa

SEQ ID NO: 595967 - RNA, 19 nt, Homo sapiens
gagaaagacucagcaccuu

SEQ ID NO: 595968 - RNA, 19 nt, Homo sapiens
ccuaagaggguccgaauaa

SEQ ID NO: 595969 - RNA, 19 nt, Homo sapiens
gaaaacuuguccauacuaa

SEQ ID NO: 595970 - RNA, 19 nt, Homo sapiens
caagagagaauccagcauu

SEQ ID NO: 595971 - RNA, 19 nt, Homo sapiens
uagguuacauguaguuuga

SEQ ID NO: 595972 - RNA, 19 nt, Homo sapiens
uaugaaacuuggucucaaa

SEQ ID NO: 595973 - RNA, 19 nt, Homo sapiens
gaaagaagaagccaaacgu

SEQ ID NO: 595974 - RNA, 19 nt, Homo sapiens
aagaggguccgaauaaaua

SEQ ID NO: 595975 - RNA, 19 nt, Homo sapiens
cacagaagauuugcagaaa

SEQ ID NO: 595976 - RNA, 19 nt, Homo sapiens
ccacagugaugaugaugau

SEQ ID NO: 595977 - RNA, 19 nt, Homo sapiens
gaagaucguaacacaaaug

SEQ ID NO: 595978 - RNA, 19 nt, Homo sapiens
ugaagcagauauugcaaau

SEQ ID NO: 595979 - RNA, 19 nt, Homo sapiens
uauaaugcccuucgagaaa

SEQ ID NO: 595980 - RNA, 19 nt, Homo sapiens
uuacagagccuuuguugau

SEQ ID NO: 595981 - RNA, 19 nt, Homo sapiens
ggacgccugcagacauuua

SEQ ID NO: 595982 - RNA, 19 nt, Homo sapiens
aaagaaagaagaagccaaa

SEQ ID NO: 595983 - RNA, 19 nt, Homo sapiens
ucaagugaauagucaguug

SEQ ID NO: 595984 - RNA, 19 nt, Homo sapiens
caaguaacagacucucaua

SEQ ID NO: 595985 - RNA, 19 nt, Homo sapiens
ggaagaucguaacacaaau

SEQ ID NO: 595986 - RNA, 19 nt, Homo sapiens
gcagauauugcaaaugaug

SEQ ID NO: 595987 - RNA, 19 nt, Homo sapiens
gaguugaauucacagaaga

SEQ ID NO: 595988 - RNA, 19 nt, Homo sapiens
aagaggguuucaaaguuua

SEQ ID NO: 595989 - RNA, 19 nt, Homo sapiens
agaagaagccaaacguaaa

SEQ ID NO: 595990 - RNA, 19 nt, Homo sapiens
guaacagacucucauacuc

SEQ ID NO: 595991 - RNA, 19 nt, Homo sapiens
gaacugugggcucgacuug

SEQ ID NO: 595992 - RNA, 19 nt, Homo sapiens
gguuacauguaguuugaaa

SEQ ID NO: 595993 - RNA, 19 nt, Homo sapiens
cuaagaggguccgaauaaa

SEQ ID NO: 595994 - RNA, 19 nt, Homo sapiens
cgacgacgacgacaacauu

SEQ ID NO: 595995 - RNA, 19 nt, Homo sapiens
gcugugauauugugcauac

SEQ ID NO: 595996 - RNA, 19 nt, Homo sapiens
ccuaguuguucauuuguuu

SEQ ID NO: 595997 - RNA, 19 nt, Homo sapiens
auaaggauguugcaaguuc

SEQ ID NO: 595998 - RNA, 19 nt, Homo sapiens
uuugcuagcugauaaagaa

SEQ ID NO: 595999 - RNA, 19 nt, Homo sapiens
gacauacgagaagaaauua

SEQ ID NO: 596000 - RNA, 19 nt, Homo sapiens
aaacuuguccauacuaaug

SEQ ID NO: 596001 - RNA, 19 nt, Homo sapiens
uaaguuugccuuuaugaug

SEQ ID NO: 596002 - RNA, 19 nt, Homo sapiens
cacauacuguugagccuaa

SEQ ID NO: 596003 - RNA, 19 nt, Homo sapiens
ugaauucacagaagauuug

SEQ ID NO: 596004 - RNA, 19 nt, Homo sapiens
guuggaagcaucugaagaa

SEQ ID NO: 596005 - RNA, 19 nt, Homo sapiens
aaaggaaguucuguuggaa

SEQ ID NO: 596006 - RNA, 19 nt, Homo sapiens
uguaucaccuuccuuaaca

SEQ ID NO: 596007 - RNA, 19 nt, Homo sapiens
gaaguagagagaauagugu

SEQ ID NO: 596008 - RNA, 19 nt, Homo sapiens
gaagccaaacguaaacgaa

SEQ ID NO: 596009 - RNA, 19 nt, Homo sapiens
aagaagaagccaaacguaa

SEQ ID NO: 596010 - RNA, 19 nt, Homo sapiens
uaagaggguccgaauaaau

SEQ ID NO: 596011 - RNA, 19 nt, Homo sapiens
acaccgaauugcucauaaa

SEQ ID NO: 596012 - RNA, 19 nt, Homo sapiens
gagcgaugcugcaggugau

SEQ ID NO: 596013 - RNA, 19 nt, Homo sapiens
ucacagaagauuugcagaa

SEQ ID NO: 596014 - RNA, 19 nt, Homo sapiens
cgacaacauugacgacgau

SEQ ID NO: 596015 - RNA, 19 nt, Homo sapiens
gugaaugguuccaguucuu

SEQ ID NO: 596016 - RNA, 19 nt, Homo sapiens
gauugcaaauggagaagau

SEQ ID NO: 596017 - RNA, 19 nt, Homo sapiens
gucacuaacugccaagaga

SEQ ID NO: 596018 - RNA, 19 nt, Homo sapiens
gagagaauaguguguguag

SEQ ID NO: 596019 - RNA, 19 nt, Homo sapiens
gaagaagccaaacguaaac

SEQ ID NO: 596020 - RNA, 19 nt, Homo sapiens
ucauaaggauguugcaagu

SEQ ID NO: 596021 - RNA, 19 nt, Homo sapiens
ucucauacuccuugucaua

SEQ ID NO: 596022 - RNA, 19 nt, Homo sapiens
aagagagaauccagcauug

SEQ ID NO: 596023 - RNA, 19 nt, Homo sapiens
ugaauacugucaacacucu

SEQ ID NO: 596024 - RNA, 19 nt, Homo sapiens
gaaguucuguuggaagcau

SEQ ID NO: 596025 - RNA, 19 nt, Homo sapiens
aaacguaaacgaaagaaca

SEQ ID NO: 596026 - RNA, 19 nt, Homo sapiens
aggauuugcuagcugauaa

SEQ ID NO: 596027 - RNA, 19 nt, Homo sapiens
gcaccggaaagaacaugua

SEQ ID NO: 596028 - RNA, 19 nt, Homo sapiens
gcugccagauugcaacaga

SEQ ID NO: 596029 - RNA, 19 nt, Homo sapiens
ccgaauaaauacuggaaag

SEQ ID NO: 596030 - RNA, 19 nt, Homo sapiens
caacauugacgacgaugau

SEQ ID NO: 596031 - RNA, 19 nt, Homo sapiens
agagagacaggaagaauug

SEQ ID NO: 596032 - RNA, 19 nt, Homo sapiens
ggacaacugguuugcaaag

SEQ ID NO: 596033 - RNA, 19 nt, Homo sapiens
cgaaguagagagaauagug

SEQ ID NO: 596034 - RNA, 19 nt, Homo sapiens
aaagaagaagccaaacgua

SEQ ID NO: 596035 - RNA, 19 nt, Homo sapiens
gaagaaagcuacaugaauu

SEQ ID NO: 596036 - RNA, 19 nt, Homo sapiens
caagguaacugucugaaua

SEQ ID NO: 596037 - RNA, 19 nt, Homo sapiens
ggaagaagguagauaauga

SEQ ID NO: 596038 - RNA, 19 nt, Homo sapiens
gaagguagauaaugacuau

SEQ ID NO: 596039 - RNA, 19 nt, Homo sapiens
ggaaagaacauguaagaaa

SEQ ID NO: 596040 - RNA, 19 nt, Homo sapiens
gaaaggaaguucuguugga

SEQ ID NO: 596041 - RNA, 19 nt, Homo sapiens
gaaauaagguauccugagu

SEQ ID NO: 596042 - RNA, 19 nt, Homo sapiens
guaacugucugaauacuuu

SEQ ID NO: 596043 - RNA, 19 nt, Homo sapiens
caaaugaugugaaauccaa

SEQ ID NO: 596044 - RNA, 19 nt, Homo sapiens
ggagauaauucuauaccaa

SEQ ID NO: 596045 - RNA, 19 nt, Homo sapiens
aauaagguauccugaguua

SEQ ID NO: 596046 - RNA, 19 nt, Homo sapiens
aagcagauauugcaaauga

SEQ ID NO: 596047 - RNA, 19 nt, Homo sapiens
ugucaacacucuuaucuaa

SEQ ID NO: 596048 - RNA, 19 nt, Homo sapiens
aaagaggguuucaaaguuu

SEQ ID NO: 596049 - RNA, 19 nt, Homo sapiens
aaagcaggcuguagguuua

SEQ ID NO: 596050 - RNA, 19 nt, Homo sapiens
guuuaaagcugccagauug

SEQ ID NO: 596051 - RNA, 19 nt, Homo sapiens
ggaagcaucugaagaaacu

SEQ ID NO: 596052 - RNA, 19 nt, Homo sapiens
gaagaggaaccacaagaaa

SEQ ID NO: 596053 - RNA, 19 nt, Homo sapiens
caaaauagguuacauguag

SEQ ID NO: 596054 - RNA, 19 nt, Homo sapiens
aaaccuaguuguucauuug

SEQ ID NO: 596055 - RNA, 19 nt, Homo sapiens
gcaccuugccugauaaauu

SEQ ID NO: 596056 - RNA, 19 nt, Homo sapiens
ggaagaaagcuacaugaau

SEQ ID NO: 596057 - RNA, 19 nt, Homo sapiens
ugggugaacuugauaguaa

SEQ ID NO: 596058 - RNA, 19 nt, Homo sapiens
gguuggagauaauucuaua

SEQ ID NO: 596059 - RNA, 19 nt, Homo sapiens
uaacgaccaugaggcuuua

SEQ ID NO: 596060 - RNA, 19 nt, Homo sapiens
caccuugccugauaaauug

SEQ ID NO: 596061 - RNA, 19 nt, Homo sapiens
caaagcaggcuguagguuu

SEQ ID NO: 596062 - RNA, 19 nt, Homo sapiens
cuaguuggcuauucaagaa

SEQ ID NO: 596063 - RNA, 19 nt, Homo sapiens
gaauaugucccucgcaaau

SEQ ID NO: 596064 - RNA, 19 nt, Homo sapiens
aaaggaagaucguaacaca

SEQ ID NO: 596065 - RNA, 19 nt, Homo sapiens
ugacauacgagaagaaauu

SEQ ID NO: 596066 - RNA, 19 nt, Homo sapiens
ggaagaggaaccacaagaa

SEQ ID NO: 596067 - RNA, 19 nt, Homo sapiens
gagaaagacucagcaccuu

SEQ ID NO: 596068 - RNA, 19 nt, Homo sapiens
ccuaagaggguccgaauaa

SEQ ID NO: 596069 - RNA, 19 nt, Homo sapiens
gaaaacuuguccauacuaa

SEQ ID NO: 596070 - RNA, 19 nt, Homo sapiens
uagguuacauguaguuuga

SEQ ID NO: 596071 - RNA, 19 nt, Homo sapiens
aaaggaagaagguagauaa

SEQ ID NO: 596072 - RNA, 19 nt, Homo sapiens
uaugaaacuuggucucaaa

SEQ ID NO: 596073 - RNA, 19 nt, Homo sapiens
gaaagaagaagccaaacgu

SEQ ID NO: 596074 - RNA, 19 nt, Homo sapiens
aagaggguccgaauaaaua

SEQ ID NO: 596075 - RNA, 19 nt, Homo sapiens
cacagaagauuugcagaaa

SEQ ID NO: 596076 - RNA, 19 nt, Homo sapiens
ccacagugaugaugaugau

SEQ ID NO: 596077 - RNA, 19 nt, Homo sapiens
gaagaucguaacacaaaug

SEQ ID NO: 596078 - RNA, 19 nt, Homo sapiens
ugaagcagauauugcaaau

SEQ ID NO: 596079 - RNA, 19 nt, Homo sapiens
uuacagagccuuuguugau

SEQ ID NO: 596080 - RNA, 19 nt, Homo sapiens
ggacgccugcagacauuua

SEQ ID NO: 596081 - RNA, 19 nt, Homo sapiens
aaagaaagaagaagccaaa

SEQ ID NO: 596082 - RNA, 19 nt, Homo sapiens
uauaaugcccuucgagaaa

SEQ ID NO: 596083 - RNA, 19 nt, Homo sapiens
ucaagugaauagucaguug

SEQ ID NO: 596084 - RNA, 19 nt, Homo sapiens
caaguaacagacucucaua

SEQ ID NO: 596085 - RNA, 19 nt, Homo sapiens
ggaagaucguaacacaaau

SEQ ID NO: 596086 - RNA, 19 nt, Homo sapiens
gcagauauugcaaaugaug

SEQ ID NO: 596087 - RNA, 19 nt, Homo sapiens
gaguugaauucacagaaga

SEQ ID NO: 596088 - RNA, 19 nt, Homo sapiens
aagaggguuucaaaguuua

SEQ ID NO: 596089 - RNA, 19 nt, Homo sapiens
agaagaagccaaacguaaa

SEQ ID NO: 596090 - RNA, 19 nt, Homo sapiens
guaacagacucucauacuc

SEQ ID NO: 596091 - RNA, 19 nt, Homo sapiens
gaacugugggcucgacuug

SEQ ID NO: 596092 - RNA, 19 nt, Homo sapiens
gguuacauguaguuugaaa

SEQ ID NO: 596093 - RNA, 19 nt, Homo sapiens
cuaagaggguccgaauaaa

SEQ ID NO: 596094 - RNA, 19 nt, Homo sapiens
cgacgacgacgacaacauu

SEQ ID NO: 596095 - RNA, 19 nt, Homo sapiens
gcugugauauugugcauac

SEQ ID NO: 596096 - RNA, 19 nt, Homo sapiens
ccuaguuguucauuuguuu

SEQ ID NO: 596097 - RNA, 19 nt, Homo sapiens
aaacuuguccauacuaaug

SEQ ID NO: 596098 - RNA, 19 nt, Homo sapiens
auaaggauguugcaaguuc

SEQ ID NO: 596099 - RNA, 19 nt, Homo sapiens
uuugcuagcugauaaagaa

SEQ ID NO: 596100 - RNA, 19 nt, Homo sapiens
gacauacgagaagaaauua

SEQ ID NO: 596101 - RNA, 19 nt, Homo sapiens
uaaguuugccuuuaugaug

SEQ ID NO: 596102 - RNA, 19 nt, Homo sapiens
cacauacuguugagccuaa

SEQ ID NO: 596103 - RNA, 19 nt, Homo sapiens
ugaauucacagaagauuug

SEQ ID NO: 596104 - RNA, 19 nt, Homo sapiens
guuggaagcaucugaagaa

SEQ ID NO: 596105 - RNA, 19 nt, Homo sapiens
aaaggaaguucuguuggaa

SEQ ID NO: 596106 - RNA, 19 nt, Homo sapiens
uguaucaccuuccuuaaca

SEQ ID NO: 596107 - RNA, 19 nt, Homo sapiens
gaaguagagagaauagugu

SEQ ID NO: 596108 - RNA, 19 nt, Homo sapiens
gaagccaaacguaaacgaa

SEQ ID NO: 596109 - RNA, 19 nt, Homo sapiens
aagaagaagccaaacguaa

SEQ ID NO: 596110 - RNA, 19 nt, Homo sapiens
uaagaggguccgaauaaau

SEQ ID NO: 596111 - RNA, 19 nt, Homo sapiens
acaccgaauugcucauaaa

SEQ ID NO: 596112 - RNA, 19 nt, Homo sapiens
gagcgaugcugcaggugau

SEQ ID NO: 596113 - RNA, 19 nt, Homo sapiens
ucacagaagauuugcagaa

SEQ ID NO: 596114 - RNA, 19 nt, Homo sapiens
cgacaacauugacgacgau

SEQ ID NO: 596115 - RNA, 19 nt, Homo sapiens
gugaaugguuccaguucuu

SEQ ID NO: 596116 - RNA, 19 nt, Homo sapiens
gauugcaaauggagaagau

SEQ ID NO: 596117 - RNA, 19 nt, Homo sapiens
gagagaauaguguguguag

SEQ ID NO: 596118 - RNA, 19 nt, Homo sapiens
gaagaagccaaacguaaac

SEQ ID NO: 596119 - RNA, 19 nt, Homo sapiens
ucauaaggauguugcaagu

SEQ ID NO: 596120 - RNA, 19 nt, Homo sapiens
ucucauacuccuugucaua

SEQ ID NO: 596121 - RNA, 19 nt, Homo sapiens
ugaauacugucaacacucu

SEQ ID NO: 596122 - RNA, 19 nt, Homo sapiens
gaaguucuguuggaagcau

SEQ ID NO: 596123 - RNA, 19 nt, Homo sapiens
aaacguaaacgaaagaaca

SEQ ID NO: 596124 - RNA, 19 nt, Homo sapiens
aggauuugcuagcugauaa

SEQ ID NO: 596125 - RNA, 19 nt, Homo sapiens
gcaccggaaagaacaugua

SEQ ID NO: 596126 - RNA, 19 nt, Homo sapiens
gcugccagauugcaacaga

SEQ ID NO: 596127 - RNA, 19 nt, Homo sapiens
ccgaauaaauacuggaaag

SEQ ID NO: 596128 - RNA, 19 nt, Homo sapiens
caacauugacgacgaugau

SEQ ID NO: 596129 - RNA, 19 nt, Homo sapiens
agagagacaggaagaauug

SEQ ID NO: 596130 - RNA, 19 nt, Homo sapiens
ggacaacugguuugcaaag

SEQ ID NO: 596131 - RNA, 19 nt, Homo sapiens
cgaaguagagagaauagug

SEQ ID NO: 596132 - RNA, 19 nt, Homo sapiens
aaagaagaagccaaacgua

SEQ ID NO: 596133 - RNA, 19 nt, Homo sapiens
ugacgacgaugauggugau

SEQ ID NO: 596134 - RNA, 19 nt, Homo sapiens
gcggcuaguuggcuauuca

SEQ ID NO: 596135 - RNA, 19 nt, Homo sapiens
gcacagagaugaaguucua

SEQ ID NO: 596136 - RNA, 19 nt, Homo sapiens
ggaauuauguugauugugu

SEQ ID NO: 596137 - RNA, 19 nt, Homo sapiens
guacaacacugacucauca

SEQ ID NO: 596138 - RNA, 19 nt, Homo sapiens
caacagaguuaccuuguau

SEQ ID NO: 596139 - RNA, 19 nt, Homo sapiens
uaaagaaggagauccauua

SEQ ID NO: 596140 - RNA, 19 nt, Homo sapiens
uaaauagucucaaggaaga

SEQ ID NO: 596141 - RNA, 19 nt, Homo sapiens
gauggaagaugauauagau

SEQ ID NO: 596142 - RNA, 19 nt, Homo sapiens
gaaauuccauccaagagau

SEQ ID NO: 596143 - RNA, 19 nt, Homo sapiens
caaggaagaucauaaccaa

SEQ ID NO: 596144 - RNA, 19 nt, Homo sapiens
gcaacagaguuaccuugua

SEQ ID NO: 596145 - RNA, 19 nt, Homo sapiens
gaucaugcuuuacgauuau

SEQ ID NO: 596146 - RNA, 19 nt, Homo sapiens
ggaucuagaggcauaauua

SEQ ID NO: 596147 - RNA, 19 nt, Homo sapiens
gaaauccgguuguugcaau

SEQ ID NO: 596148 - RNA, 19 nt, Homo sapiens
guaggaagcaacagaguua

SEQ ID NO: 596149 - RNA, 19 nt, Homo sapiens
ggagggaggcggaggaaua

SEQ ID NO: 596150 - RNA, 19 nt, Homo sapiens
caagauggaagaugauaua

SEQ ID NO: 596151 - RNA, 19 nt, Homo sapiens
gcuuuacgauuauggaaua

SEQ ID NO: 596152 - RNA, 19 nt, Homo sapiens
gaggaucaauucaaagaga

SEQ ID NO: 596153 - RNA, 19 nt, Homo sapiens
gagcugaaauuccauccaa

SEQ ID NO: 596154 - RNA, 19 nt, Homo sapiens
agaaggagauccauuagug

SEQ ID NO: 596155 - RNA, 19 nt, Homo sapiens
gcgauuugauacuuucuaa

SEQ ID NO: 596156 - RNA, 19 nt, Homo sapiens
ucaaugagcugaaauucca

SEQ ID NO: 596157 - RNA, 19 nt, Homo sapiens
gaucauaaccaaccauugu

SEQ ID NO: 596158 - RNA, 19 nt, Homo sapiens
gauagcagcauucuuauag

SEQ ID NO: 596159 - RNA, 19 nt, Homo sapiens
gaagggagacauacuuaau

SEQ ID NO: 596160 - RNA, 19 nt, Homo sapiens
agaguuaccuuguaugaau

SEQ ID NO: 596161 - RNA, 19 nt, Homo sapiens
caacacugacucaucauaa

SEQ ID NO: 596162 - RNA, 19 nt, Homo sapiens
ccagagacauacauaggaa

SEQ ID NO: 596163 - RNA, 19 nt, Homo sapiens
caaagagaaugaugaaugc

SEQ ID NO: 596164 - RNA, 19 nt, Homo sapiens
ggagauccauuaguguuug

SEQ ID NO: 596165 - RNA, 19 nt, Homo sapiens
uaaauguggugcugcuauu

SEQ ID NO: 596166 - RNA, 19 nt, Homo sapiens
aguagaagauccucauaaa

SEQ ID NO: 596167 - RNA, 19 nt, Homo sapiens
gagcaucccuuugaguuuc

SEQ ID NO: 596168 - RNA, 19 nt, Homo sapiens
gaaguagaagauccucaua

SEQ ID NO: 596169 - RNA, 19 nt, Homo sapiens
gggaagggagacauacuua

SEQ ID NO: 596170 - RNA, 19 nt, Homo sapiens
ucaaagagaaugaugaaug

SEQ ID NO: 596171 - RNA, 19 nt, Homo sapiens
cgaaggaacgggccaauug

SEQ ID NO: 596172 - RNA, 19 nt, Homo sapiens
agaucaugcuuuacgauua

SEQ ID NO: 596173 - RNA, 19 nt, Homo sapiens
ggauagcagcauucuuaua

SEQ ID NO: 596174 - RNA, 19 nt, Homo sapiens
agggauagcagcauucuua

SEQ ID NO: 596175 - RNA, 19 nt, Homo sapiens
gaaaauggaagucaaagaa

SEQ ID NO: 596176 - RNA, 19 nt, Homo sapiens
gcacguagagcauuuagag

SEQ ID NO: 596177 - RNA, 19 nt, Homo sapiens
ggaagggagacauacuuaa

SEQ ID NO: 596178 - RNA, 19 nt, Homo sapiens
agaguugucuuucagcauu

SEQ ID NO: 596179 - RNA, 19 nt, Homo sapiens
ggagacauacuuaauacug

SEQ ID NO: 596180 - RNA, 19 nt, Homo sapiens
acuaacaggccauuuauuu

SEQ ID NO: 596181 - RNA, 19 nt, Homo sapiens
ugaaugcaauuaaggaauc

SEQ ID NO: 596182 - RNA, 19 nt, Homo sapiens
guauggaucauucucuuaa

SEQ ID NO: 596183 - RNA, 19 nt, Homo sapiens
aaaauaauguccuguggua

SEQ ID NO: 596184 - RNA, 19 nt, Homo sapiens
gcucagacucuacugcuuu

SEQ ID NO: 596185 - RNA, 19 nt, Homo sapiens
ggaucauucucuuaaacuu

SEQ ID NO: 596186 - RNA, 19 nt, Homo sapiens
ccauggaaaugcuaucaau

SEQ ID NO: 596187 - RNA, 19 nt, Homo sapiens
gcacuauguuggccaugga

SEQ ID NO: 596188 - RNA, 19 nt, Homo sapiens
ggauuuagaaguagaagau

SEQ ID NO: 596189 - RNA, 19 nt, Homo sapiens
cguagagcauuuagaguug

SEQ ID NO: 596190 - RNA, 19 nt, Homo sapiens
uguuugggauuuagaagua

SEQ ID NO: 596191 - RNA, 19 nt, Homo sapiens
ugaaacgucuuuggaagga

SEQ ID NO: 596192 - RNA, 19 nt, Homo sapiens
aaaugcaccuggaaggaaa

SEQ ID NO: 596193 - RNA, 19 nt, Homo sapiens
gagacauacauaggaauua

SEQ ID NO: 596194 - RNA, 19 nt, Homo sapiens
cuauaacaaugcaguguau

SEQ ID NO: 596195 - RNA, 19 nt, Homo sapiens
guaaagaaggagauccauu

SEQ ID NO: 596196 - RNA, 19 nt, Homo sapiens
uagcagggauagcagcauu

SEQ ID NO: 596197 - RNA, 19 nt, Homo sapiens
ggagcaucccuuugaguuu

SEQ ID NO: 596198 - RNA, 19 nt, Homo sapiens
caaaucuucuccugucagu

SEQ ID NO: 596199 - RNA, 19 nt, Homo sapiens
ggcuguagcuggaucuaga

SEQ ID NO: 596200 - RNA, 19 nt, Homo sapiens
ccucauaaagccaaaugua

SEQ ID NO: 596201 - RNA, 19 nt, Homo sapiens
cuggaaaccuggcaagaug

SEQ ID NO: 596202 - RNA, 19 nt, Homo sapiens
aaacuaacaggccauuuau

SEQ ID NO: 596203 - RNA, 19 nt, Homo sapiens
gguauggaucauucucuua

SEQ ID NO: 596204 - RNA, 19 nt, Homo sapiens
ucuaagugcugauuaugau

SEQ ID NO: 596205 - RNA, 19 nt, Homo sapiens
aaucuucuccugucaguaa

SEQ ID NO: 596206 - RNA, 19 nt, Homo sapiens
acuuaauacugcccucuua

SEQ ID NO: 596207 - RNA, 19 nt, Homo sapiens
uaacaggccauuuauuucu

SEQ ID NO: 596208 - RNA, 19 nt, Homo sapiens
gaagucaaagaaaugcaaa

SEQ ID NO: 596209 - RNA, 19 nt, Homo sapiens
ucuuauagcuguuugugau

SEQ ID NO: 596210 - RNA, 19 nt, Homo sapiens
gaaggagauccauuagugu

SEQ ID NO: 596211 - RNA, 19 nt, Homo sapiens
ggaagucaaagaaaugcaa

SEQ ID NO: 596212 - RNA, 19 nt, Homo sapiens
caaaugcaccuggaaggaa

SEQ ID NO: 596213 - RNA, 19 nt, Homo sapiens
guuaggcgauuugauacuu

SEQ ID NO: 596214 - RNA, 19 nt, Homo sapiens
gaugaaugcaauuaaggaa

SEQ ID NO: 596215 - RNA, 19 nt, Homo sapiens
gaaguucuaagugcugauu

SEQ ID NO: 596216 - RNA, 19 nt, Homo sapiens
uauagaaagugguacaaac

SEQ ID NO: 596217 - RNA, 19 nt, Homo sapiens
ggaugcugaugcugaugaa

SEQ ID NO: 596218 - RNA, 19 nt, Homo sapiens
gaguuaccuuguaugaaug

SEQ ID NO: 596219 - RNA, 19 nt, Homo sapiens
aagggagacauacuuaaua

SEQ ID NO: 596220 - RNA, 19 nt, Homo sapiens
aacacugacucaucauaaa

SEQ ID NO: 596221 - RNA, 19 nt, Homo sapiens
cccagugaaucuaauguga

SEQ ID NO: 596222 - RNA, 19 nt, Homo sapiens
gcaagauggaagaugauau

SEQ ID NO: 596223 - RNA, 19 nt, Homo sapiens
agagaaugaugaaugcaau

SEQ ID NO: 596224 - RNA, 19 nt, Homo sapiens
gcugaaauuccauccaaga

SEQ ID NO: 596225 - RNA, 19 nt, Homo sapiens
gaagggaaggagccaggaa

SEQ ID NO: 596226 - RNA, 19 nt, Homo sapiens
aggcugagcugaauguagu

SEQ ID NO: 596227 - RNA, 19 nt, Homo sapiens
uagaagauccucauaaagc

SEQ ID NO: 596228 - RNA, 19 nt, Homo sapiens
gagaaugaugaaugcaauu

SEQ ID NO: 596229 - RNA, 19 nt, Homo sapiens
acacucugguggcaauauu

SEQ ID NO: 596230 - RNA, 19 nt, Homo sapiens
guugcaaucuuacguggau

SEQ ID NO: 596231 - RNA, 19 nt, Homo sapiens
ugacuauucuugggcgauu

SEQ ID NO: 596232 - RNA, 19 nt, Homo sapiens
guagaagggcacagagaug

SEQ ID NO: 596233 - RNA, 19 nt, Homo sapiens
ggaagaucauaaccaacca

SEQ ID NO: 596234 - RNA, 19 nt, Homo sapiens
uguaaauagucucaaggaa

SEQ ID NO: 596235 - RNA, 19 nt, Homo sapiens
gcacagagaugaaguucua

SEQ ID NO: 596236 - RNA, 19 nt, Homo sapiens
ggaauuauguugauugugu

SEQ ID NO: 596237 - RNA, 19 nt, Homo sapiens
guacaacacugacucauca

SEQ ID NO: 596238 - RNA, 19 nt, Homo sapiens
caacagaguuaccuuguau

SEQ ID NO: 596239 - RNA, 19 nt, Homo sapiens
uaaagaaggagauccauua

SEQ ID NO: 596240 - RNA, 19 nt, Homo sapiens
uaaauagucucaaggaaga

SEQ ID NO: 596241 - RNA, 19 nt, Homo sapiens
gauggaagaugauauagau

SEQ ID NO: 596242 - RNA, 19 nt, Homo sapiens
gaaauuccauccaagagau

SEQ ID NO: 596243 - RNA, 19 nt, Homo sapiens
caaggaagaucauaaccaa

SEQ ID NO: 596244 - RNA, 19 nt, Homo sapiens
gcaacagaguuaccuugua

SEQ ID NO: 596245 - RNA, 19 nt, Homo sapiens
gaucaugcuuuacgauuau

SEQ ID NO: 596246 - RNA, 19 nt, Homo sapiens
ggaucuagaggcauaauua

SEQ ID NO: 596247 - RNA, 19 nt, Homo sapiens
gaaauccgguuguugcaau

SEQ ID NO: 596248 - RNA, 19 nt, Homo sapiens
guaggaagcaacagaguua

SEQ ID NO: 596249 - RNA, 19 nt, Homo sapiens
ggagggaggcggaggaaua

SEQ ID NO: 596250 - RNA, 19 nt, Homo sapiens
agacugagcucuuagugaa

SEQ ID NO: 596251 - RNA, 19 nt, Homo sapiens
caagauggaagaugauaua

SEQ ID NO: 596252 - RNA, 19 nt, Homo sapiens
gcuuuacgauuauggaaua

SEQ ID NO: 596253 - RNA, 19 nt, Homo sapiens
gaggaucaauucaaagaga

SEQ ID NO: 596254 - RNA, 19 nt, Homo sapiens
gagcugaaauuccauccaa

SEQ ID NO: 596255 - RNA, 19 nt, Homo sapiens
agaaggagauccauuagug

SEQ ID NO: 596256 - RNA, 19 nt, Homo sapiens
gguagacacugacaacguu

SEQ ID NO: 596257 - RNA, 19 nt, Homo sapiens
caaauuauguagugcuugu

SEQ ID NO: 596258 - RNA, 19 nt, Homo sapiens
gcgauuugauacuuucuaa

SEQ ID NO: 596259 - RNA, 19 nt, Homo sapiens
ucaaugagcugaaauucca

SEQ ID NO: 596260 - RNA, 19 nt, Homo sapiens
gaucauaaccaaccauugu

SEQ ID NO: 596261 - RNA, 19 nt, Homo sapiens
gauagcagcauucuuauag

SEQ ID NO: 596262 - RNA, 19 nt, Homo sapiens
gaagggagacauacuuaau

SEQ ID NO: 596263 - RNA, 19 nt, Homo sapiens
agaguuaccuuguaugaau

SEQ ID NO: 596264 - RNA, 19 nt, Homo sapiens
caacacugacucaucauaa

SEQ ID NO: 596265 - RNA, 19 nt, Homo sapiens
ccagagacauacauaggaa

SEQ ID NO: 596266 - RNA, 19 nt, Homo sapiens
caaagagaaugaugaaugc

SEQ ID NO: 596267 - RNA, 19 nt, Homo sapiens
ggagauccauuaguguuug

SEQ ID NO: 596268 - RNA, 19 nt, Homo sapiens
uaaauguggugcugcuauu

SEQ ID NO: 596269 - RNA, 19 nt, Homo sapiens
gagcaucccuuugaguuuc

SEQ ID NO: 596270 - RNA, 19 nt, Homo sapiens
acacuuguaugccaaugua

SEQ ID NO: 596271 - RNA, 19 nt, Homo sapiens
aguagaagauccucauaaa

SEQ ID NO: 596272 - RNA, 19 nt, Homo sapiens
gggaagggagacauacuua

SEQ ID NO: 596273 - RNA, 19 nt, Homo sapiens
gaaguagaagauccucaua

SEQ ID NO: 596274 - RNA, 19 nt, Homo sapiens
ucaaagagaaugaugaaug

SEQ ID NO: 596275 - RNA, 19 nt, Homo sapiens
cgaaggaacgggccaauug

SEQ ID NO: 596276 - RNA, 19 nt, Homo sapiens
agaucaugcuuuacgauua

SEQ ID NO: 596277 - RNA, 19 nt, Homo sapiens
ggauagcagcauucuuaua

SEQ ID NO: 596278 - RNA, 19 nt, Homo sapiens
agggauagcagcauucuua

SEQ ID NO: 596279 - RNA, 19 nt, Homo sapiens
gaaaauggaagucaaagaa

SEQ ID NO: 596280 - RNA, 19 nt, Homo sapiens
gcacguagagcauuuagag

SEQ ID NO: 596281 - RNA, 19 nt, Homo sapiens
ggaagggagacauacuuaa

SEQ ID NO: 596282 - RNA, 19 nt, Homo sapiens
gcagugccauccuuaaguc

SEQ ID NO: 596283 - RNA, 19 nt, Homo sapiens
agaguugucuuucagcauu

SEQ ID NO: 596284 - RNA, 19 nt, Homo sapiens
ucauaaagccaaguaagua

SEQ ID NO: 596285 - RNA, 19 nt, Homo sapiens
acuaacaggccauuuauuu

SEQ ID NO: 596286 - RNA, 19 nt, Homo sapiens
ugaaugcaauuaaggaauc

SEQ ID NO: 596287 - RNA, 19 nt, Homo sapiens
ggagacauacuuaauacug

SEQ ID NO: 596288 - RNA, 19 nt, Homo sapiens
guauggaucauucucuuaa

SEQ ID NO: 596289 - RNA, 19 nt, Homo sapiens
aaaauaauguccuguggua

SEQ ID NO: 596290 - RNA, 19 nt, Homo sapiens
gcucagacucuacugcuuu

SEQ ID NO: 596291 - RNA, 19 nt, Homo sapiens
ggaucauucucuuaaacuu

SEQ ID NO: 596292 - RNA, 19 nt, Homo sapiens
ccauggaaaugcuaucaau

SEQ ID NO: 596293 - RNA, 19 nt, Homo sapiens
gcacuauguuggccaugga

SEQ ID NO: 596294 - RNA, 19 nt, Homo sapiens
cuaaguaccuuggugacaa

SEQ ID NO: 596295 - RNA, 19 nt, Homo sapiens
ggauuuagaaguagaagau

SEQ ID NO: 596296 - RNA, 19 nt, Homo sapiens
cguagagcauuuagaguug

SEQ ID NO: 596297 - RNA, 19 nt, Homo sapiens
uguuugggauuuagaagua

SEQ ID NO: 596298 - RNA, 19 nt, Homo sapiens
ugaaacgucuuuggaagga

SEQ ID NO: 596299 - RNA, 19 nt, Homo sapiens
aaaugcaccuggaaggaaa

SEQ ID NO: 596300 - RNA, 19 nt, Homo sapiens
cguuauguguggucuuuaa

SEQ ID NO: 596301 - RNA, 19 nt, Homo sapiens
gagacauacauaggaauua

SEQ ID NO: 596302 - RNA, 19 nt, Homo sapiens
cuauaacaaugcaguguau

SEQ ID NO: 596303 - RNA, 19 nt, Homo sapiens
guaaagaaggagauccauu

SEQ ID NO: 596304 - RNA, 19 nt, Homo sapiens
uagcagggauagcagcauu

SEQ ID NO: 596305 - RNA, 19 nt, Homo sapiens
caaaucuucuccugucagu

SEQ ID NO: 596306 - RNA, 19 nt, Homo sapiens
ggcuguagcuggaucuaga

SEQ ID NO: 596307 - RNA, 19 nt, Homo sapiens
ggagcaucccuuugaguuu

SEQ ID NO: 596308 - RNA, 19 nt, Homo sapiens
cuggaaaccuggcaagaug

SEQ ID NO: 596309 - RNA, 19 nt, Homo sapiens
aaacuaacaggccauuuau

SEQ ID NO: 596310 - RNA, 19 nt, Homo sapiens
gguauggaucauucucuua

SEQ ID NO: 596311 - RNA, 19 nt, Homo sapiens
ucuaagugcugauuaugau

SEQ ID NO: 596312 - RNA, 19 nt, Homo sapiens
aaucuucuccugucaguaa

SEQ ID NO: 596313 - RNA, 19 nt, Homo sapiens
uaacaggccauuuauuucu

SEQ ID NO: 596314 - RNA, 19 nt, Homo sapiens
acuuaauacugcccucuua

SEQ ID NO: 596315 - RNA, 19 nt, Homo sapiens
gaagucaaagaaaugcaaa

SEQ ID NO: 596316 - RNA, 19 nt, Homo sapiens
ucuuauagcuguuugugau

SEQ ID NO: 596317 - RNA, 19 nt, Homo sapiens
gaaggagauccauuagugu

SEQ ID NO: 596318 - RNA, 19 nt, Homo sapiens
ggaagucaaagaaaugcaa

SEQ ID NO: 596319 - RNA, 19 nt, Homo sapiens
caaaugcaccuggaaggaa

SEQ ID NO: 596320 - RNA, 19 nt, Homo sapiens
guuaggcgauuugauacuu

SEQ ID NO: 596321 - RNA, 19 nt, Homo sapiens
uggaacaucugcuuauuuu

SEQ ID NO: 596322 - RNA, 19 nt, Homo sapiens
gaugaaugcaauuaaggaa

SEQ ID NO: 596323 - RNA, 19 nt, Homo sapiens
gaaguucuaagugcugauu

SEQ ID NO: 596324 - RNA, 19 nt, Homo sapiens
uauagaaagugguacaaac

SEQ ID NO: 596325 - RNA, 19 nt, Homo sapiens
ucuuuaaccuguugucaug

SEQ ID NO: 596326 - RNA, 19 nt, Homo sapiens
gagacugagcucuuaguga

SEQ ID NO: 596327 - RNA, 19 nt, Homo sapiens
gugccauccuuaagucauu

SEQ ID NO: 596328 - RNA, 19 nt, Homo sapiens
aagggagacauacuuaaua

SEQ ID NO: 596329 - RNA, 19 nt, Homo sapiens
ggaugcugaugcugaugaa

SEQ ID NO: 596330 - RNA, 19 nt, Homo sapiens
gaguuaccuuguaugaaug

SEQ ID NO: 596331 - RNA, 19 nt, Homo sapiens
aacacugacucaucauaaa

SEQ ID NO: 596332 - RNA, 19 nt, Homo sapiens
cauaaagccaaguaaguau

SEQ ID NO: 596333 - RNA, 19 nt, Homo sapiens
cccagugaaucuaauguga

SEQ ID NO: 596334 - RNA, 19 nt, Homo sapiens
gcaagauggaagaugauau

SEQ ID NO: 596335 - RNA, 19 nt, Homo sapiens
gauaaaggcugcaagauua

SEQ ID NO: 596336 - RNA, 19 nt, Homo sapiens
gaaauaaccuguauacaug

SEQ ID NO: 596337 - RNA, 19 nt, Homo sapiens
gaaaugaaaugguggaguu

SEQ ID NO: 596338 - RNA, 19 nt, Homo sapiens
gcagaggguuuaaagcuua

SEQ ID NO: 596339 - RNA, 19 nt, Homo sapiens
gaaagacgaugacaagcuu

SEQ ID NO: 596340 - RNA, 19 nt, Homo sapiens
caaagccaaugaagaauaa

SEQ ID NO: 596341 - RNA, 19 nt, Homo sapiens
gaauagcuuucaagaguuu

SEQ ID NO: 596342 - RNA, 19 nt, Homo sapiens
guuauaaacugcugaagaa

SEQ ID NO: 596343 - RNA, 19 nt, Homo sapiens
ggaaauaaccuguauacau

SEQ ID NO: 596344 - RNA, 19 nt, Homo sapiens
uagcaaagcuuggacuuaa

SEQ ID NO: 596345 - RNA, 19 nt, Homo sapiens
gagaagcuauagccaauga

SEQ ID NO: 596346 - RNA, 19 nt, Homo sapiens
gaauaugccuguaaacucu

SEQ ID NO: 596347 - RNA, 19 nt, Homo sapiens
gaaagaacuucauaguaca

SEQ ID NO: 596348 - RNA, 19 nt, Homo sapiens
gcacagagaacgcaucuug

SEQ ID NO: 596349 - RNA, 19 nt, Homo sapiens
gcaguuggaagauuuguua

SEQ ID NO: 596350 - RNA, 19 nt, Homo sapiens
agaaaucaaugacguguuu

SEQ ID NO: 596351 - RNA, 19 nt, Homo sapiens
gaacgcaucuuggaacugu

SEQ ID NO: 596352 - RNA, 19 nt, Homo sapiens
agaaagaacuucauaguac

SEQ ID NO: 596353 - RNA, 19 nt, Homo sapiens
ucaccacgcuuauuaauca

SEQ ID NO: 596354 - RNA, 19 nt, Homo sapiens
gggaagaucaggagaauga

SEQ ID NO: 596355 - RNA, 19 nt, Homo sapiens
gauaauuucugcugcugaa

SEQ ID NO: 596356 - RNA, 19 nt, Homo sapiens
uaaaguaggagaagcuaua

SEQ ID NO: 596357 - RNA, 19 nt, Homo sapiens
ugagaccugucgauuguua

SEQ ID NO: 596358 - RNA, 19 nt, Homo sapiens
agacugacauuucaucuau

SEQ ID NO: 596359 - RNA, 19 nt, Homo sapiens
gaaccuuucugugacauug

SEQ ID NO: 596360 - RNA, 19 nt, Homo sapiens
caacuucuuucacuuuguu

SEQ ID NO: 596361 - RNA, 19 nt, Homo sapiens
gaaacugauuguaaagcuu

SEQ ID NO: 596362 - RNA, 19 nt, Homo sapiens
aaacugggauuugaaagaa

SEQ ID NO: 596363 - RNA, 19 nt, Homo sapiens
cagaucaccacgcuuauua

SEQ ID NO: 596364 - RNA, 19 nt, Homo sapiens
uagaagcuuuggcugaaua

SEQ ID NO: 596365 - RNA, 19 nt, Homo sapiens
ugaaccaucuggaaucuga

SEQ ID NO: 596366 - RNA, 19 nt, Homo sapiens
gaaggaaauuuagaagcuu

SEQ ID NO: 596367 - RNA, 19 nt, Homo sapiens
gauaaggucauugaaauug

SEQ ID NO: 596368 - RNA, 19 nt, Homo sapiens
caugauggcucucuuaguc

SEQ ID NO: 596369 - RNA, 19 nt, Homo sapiens
ccaaagccaaugaagaaua

SEQ ID NO: 596370 - RNA, 19 nt, Homo sapiens
guugagaccugucgauugu

SEQ ID NO: 596371 - RNA, 19 nt, Homo sapiens
gacauuucaucuaucagua

SEQ ID NO: 596372 - RNA, 19 nt, Homo sapiens
gaaacaauugcagcacuua

SEQ ID NO: 596373 - RNA, 19 nt, Homo sapiens
augcaaaccugaaaucauu

SEQ ID NO: 596374 - RNA, 19 nt, Homo sapiens
ucauugaaauugugacuga

SEQ ID NO: 596375 - RNA, 19 nt, Homo sapiens
ggccuauucucuguauuua

SEQ ID NO: 596376 - RNA, 19 nt, Homo sapiens
agaaagagcagcuuguuga

SEQ ID NO: 596377 - RNA, 19 nt, Homo sapiens
gaagcuauagccaaugaaa

SEQ ID NO: 596378 - RNA, 19 nt, Homo sapiens
gacggaacauguccaguau

SEQ ID NO: 596379 - RNA, 19 nt, Homo sapiens
gaaagacuagagaaaguga

SEQ ID NO: 596380 - RNA, 19 nt, Homo sapiens
caaauaaggacacuaugga

SEQ ID NO: 596381 - RNA, 19 nt, Homo sapiens
gaauaaugcaaaccugaaa

SEQ ID NO: 596382 - RNA, 19 nt, Homo sapiens
caacacugcugagagaaau

SEQ ID NO: 596383 - RNA, 19 nt, Homo sapiens
uggauaaggucauugaaau

SEQ ID NO: 596384 - RNA, 19 nt, Homo sapiens
guccaaauauucagucaau

SEQ ID NO: 596385 - RNA, 19 nt, Homo sapiens
gaagacaagauccaugaug

SEQ ID NO: 596386 - RNA, 19 nt, Homo sapiens
uggaguagaaggaaauuua

SEQ ID NO: 596387 - RNA, 19 nt, Homo sapiens
aagcaucgcugaagaacug

SEQ ID NO: 596388 - RNA, 19 nt, Homo sapiens
ucucacagcuucaaagaca

SEQ ID NO: 596389 - RNA, 19 nt, Homo sapiens
uuacagacauaaccaacuu

SEQ ID NO: 596390 - RNA, 19 nt, Homo sapiens
gcaaaccugaaaucauuaa

SEQ ID NO: 596391 - RNA, 19 nt, Homo sapiens
ggauaaggucauugaaauu

SEQ ID NO: 596392 - RNA, 19 nt, Homo sapiens
gcagaccgaguagucauua

SEQ ID NO: 596393 - RNA, 19 nt, Homo sapiens
uaaacaagcaggagaaaca

SEQ ID NO: 596394 - RNA, 19 nt, Homo sapiens
gcaagcaauucagcgugua

SEQ ID NO: 596395 - RNA, 19 nt, Homo sapiens
gggucucaguuacaaauaa

SEQ ID NO: 596396 - RNA, 19 nt, Homo sapiens
ugucaacacugcugagaga

SEQ ID NO: 596397 - RNA, 19 nt, Homo sapiens
gggagaaucuuuauuuuca

SEQ ID NO: 596398 - RNA, 19 nt, Homo sapiens
uagagaaagugaauagcuu

SEQ ID NO: 596399 - RNA, 19 nt, Homo sapiens
ugauaaaggcugcaagauu

SEQ ID NO: 596400 - RNA, 19 nt, Homo sapiens
ggaugggucucaguuacaa

SEQ ID NO: 596401 - RNA, 19 nt, Homo sapiens
gaaguauggcuaccuuuca

SEQ ID NO: 596402 - RNA, 19 nt, Homo sapiens
ucucagaucaccacgcuua

SEQ ID NO: 596403 - RNA, 19 nt, Homo sapiens
gcugaaacauugacauugc

SEQ ID NO: 596404 - RNA, 19 nt, Homo sapiens
gaaaaucagucacagucuu

SEQ ID NO: 596405 - RNA, 19 nt, Homo sapiens
gaaaguggcauuggauaag

SEQ ID NO: 596406 - RNA, 19 nt, Homo sapiens
guaugaaaguggcauugga

SEQ ID NO: 596407 - RNA, 19 nt, Homo sapiens
caacuugaaccaucuggaa

SEQ ID NO: 596408 - RNA, 19 nt, Homo sapiens
gaaauugugacugacugua

SEQ ID NO: 596409 - RNA, 19 nt, Homo sapiens
gaugggcagaucacaauuu

SEQ ID NO: 596410 - RNA, 19 nt, Homo sapiens
gaagaucaggagaaugaga

SEQ ID NO: 596411 - RNA, 19 nt, Homo sapiens
ccuguaaacucucugaaca

SEQ ID NO: 596412 - RNA, 19 nt, Homo sapiens
gaacuuaagaaagaacuuc

SEQ ID NO: 596413 - RNA, 19 nt, Homo sapiens
ggagauagacaaaaugauu

SEQ ID NO: 596414 - RNA, 19 nt, Homo sapiens
uuacuucuuucuucaguga

SEQ ID NO: 596415 - RNA, 19 nt, Homo sapiens
ugaaaguggcauuggauaa

SEQ ID NO: 596416 - RNA, 19 nt, Homo sapiens
aauaaggacacuauggaua

SEQ ID NO: 596417 - RNA, 19 nt, Homo sapiens
caauauggacggaacaugu

SEQ ID NO: 596418 - RNA, 19 nt, Homo sapiens
guuggaagauuuguuaaag

SEQ ID NO: 596419 - RNA, 19 nt, Homo sapiens
ugacguguuugaaggaaga

SEQ ID NO: 596420 - RNA, 19 nt, Homo sapiens
gaucaccacgcuuauuaau

SEQ ID NO: 596421 - RNA, 19 nt, Homo sapiens
guuaauuucuguguggauu

SEQ ID NO: 596422 - RNA, 19 nt, Homo sapiens
guauggaggacuuuacuga

SEQ ID NO: 596423 - RNA, 19 nt, Homo sapiens
caagaugaauauugaagcu

SEQ ID NO: 596424 - RNA, 19 nt, Homo sapiens
gcugaaagacgaugacaag

SEQ ID NO: 596425 - RNA, 19 nt, Homo sapiens
agaaggaaauuuagaagcu

SEQ ID NO: 596426 - RNA, 19 nt, Homo sapiens
gagacugacauuucaucua

SEQ ID NO: 596427 - RNA, 19 nt, Homo sapiens
uggagagacugacauuuca

SEQ ID NO: 596428 - RNA, 19 nt, Homo sapiens
guugacaaguguauuacga

SEQ ID NO: 596429 - RNA, 19 nt, Homo sapiens
ucuaaagguugacaagugu

SEQ ID NO: 596430 - RNA, 19 nt, Homo sapiens
gaaaacuucccaggauuua

SEQ ID NO: 596431 - RNA, 19 nt, Homo sapiens
gacauuggaagucaucuug

SEQ ID NO: 596432 - RNA, 19 nt, Homo sapiens
uauugaagcuaaacaagca

SEQ ID NO: 596433 - RNA, 19 nt, Homo sapiens
uaaggucauugaaauugug

SEQ ID NO: 596434 - RNA, 19 nt, Homo sapiens
uggaaagacuagagaaagu

SEQ ID NO: 596435 - RNA, 19 nt, Homo sapiens
gcaaggaagugcauuagua

SEQ ID NO: 596436 - RNA, 19 nt, Homo sapiens
ggagggagcuggacaggua

SEQ ID NO: 596437 - RNA, 19 nt, Homo sapiens
ggaauuagaggacugauua

SEQ ID NO: 596438 - RNA, 19 nt, Homo sapiens
ggacugugcugcugccuua

SEQ ID NO: 596439 - RNA, 19 nt, Homo sapiens
ggacugaacuuccagaaca

SEQ ID NO: 596440 - RNA, 19 nt, Homo sapiens
ccucguggcugauuauuua

SEQ ID NO: 596441 - RNA, 19 nt, Homo sapiens
ugaaguauguggagcuuua

SEQ ID NO: 596442 - RNA, 19 nt, Homo sapiens
gagccuggauggacaagua

SEQ ID NO: 596443 - RNA, 19 nt, Homo sapiens
gcaccaaauugcaucguuu

SEQ ID NO: 596444 - RNA, 19 nt, Homo sapiens
gaacaccuccuucuuugaa

SEQ ID NO: 596445 - RNA, 19 nt, Homo sapiens
gagaagaagaggaauguaa

SEQ ID NO: 596446 - RNA, 19 nt, Homo sapiens
ucauagagaucgccaacua

SEQ ID NO: 596447 - RNA, 19 nt, Homo sapiens
gaacuuaucauaccucagu

SEQ ID NO: 596448 - RNA, 19 nt, Homo sapiens
gcagucaggugguggaaug

SEQ ID NO: 596449 - RNA, 19 nt, Homo sapiens
gaucaacacuccggaaauc

SEQ ID NO: 596450 - RNA, 19 nt, Homo sapiens
gggaacaugugugaaguuu

SEQ ID NO: 596451 - RNA, 19 nt, Homo sapiens
gauuuaaacuccaugaagu

SEQ ID NO: 596452 - RNA, 19 nt, Homo sapiens
ggacagguaucugcaguca

SEQ ID NO: 596453 - RNA, 19 nt, Homo sapiens
gggaagcccucaaggugaa

SEQ ID NO: 596454 - RNA, 19 nt, Homo sapiens
ugacaacgcccaauuaauc

SEQ ID NO: 596455 - RNA, 19 nt, Homo sapiens
cuacaaccauauuugcuuu

SEQ ID NO: 596456 - RNA, 19 nt, Homo sapiens
uaaacuccaugaaguaugu

SEQ ID NO: 596457 - RNA, 19 nt, Homo sapiens
ggagaagaaugagcaacuu

SEQ ID NO: 596458 - RNA, 19 nt, Homo sapiens
ugugguagcuggaguguug

SEQ ID NO: 596459 - RNA, 19 nt, Homo sapiens
gaguguggguccuguggua

SEQ ID NO: 596460 - RNA, 19 nt, Homo sapiens
cgagaugggccacaacuuu

SEQ ID NO: 596461 - RNA, 19 nt, Homo sapiens
gcuaugaugagcaguagua

SEQ ID NO: 596462 - RNA, 19 nt, Homo sapiens
ggacaugaauggugaacac

SEQ ID NO: 596463 - RNA, 19 nt, Homo sapiens
ggagacaccuuuggaaacu

SEQ ID NO: 596464 - RNA, 19 nt, Homo sapiens
gggaggcuguguacacuug

SEQ ID NO: 596465 - RNA, 19 nt, Homo sapiens
cacaggaagugcaacauga

SEQ ID NO: 596466 - RNA, 19 nt, Homo sapiens
ccaacgcggugcccauuga

SEQ ID NO: 596467 - RNA, 19 nt, Homo sapiens
gagaagaaugagcaacuuu

SEQ ID NO: 596468 - RNA, 19 nt, Homo sapiens
guacagaggcuaugaugag

SEQ ID NO: 596469 - RNA, 19 nt, Homo sapiens
ugacaccacuaucaucaug

SEQ ID NO: 596470 - RNA, 19 nt, Homo sapiens
gggaagauccagugucaga

SEQ ID NO: 596471 - RNA, 19 nt, Homo sapiens
ccacugcccuaccaacuuc

SEQ ID NO: 596472 - RNA, 19 nt, Homo sapiens
agaaagggaugagugaaga

SEQ ID NO: 596473 - RNA, 19 nt, Homo sapiens
ggaagugcauuaguagaag

SEQ ID NO: 596474 - RNA, 19 nt, Homo sapiens
gaacacaggaagugcaaca

SEQ ID NO: 596475 - RNA, 19 nt, Homo sapiens
agaaggcacucccggcaaa

SEQ ID NO: 596476 - RNA, 19 nt, Homo sapiens
gugggaagauccaguguca

SEQ ID NO: 596477 - RNA, 19 nt, Homo sapiens
gagaugggccacaacuuug

SEQ ID NO: 596478 - RNA, 19 nt, Homo sapiens
ccaugacaacgcccaauua

SEQ ID NO: 596479 - RNA, 19 nt, Homo sapiens
caugagagaugcgaagugu

SEQ ID NO: 596480 - RNA, 19 nt, Homo sapiens
gccaacaccuuauuuacag

SEQ ID NO: 596481 - RNA, 19 nt, Homo sapiens
aaacacaagcucauagaga

SEQ ID NO: 596482 - RNA, 19 nt, Homo sapiens
ugugaaaggugauucuuag

SEQ ID NO: 596483 - RNA, 19 nt, Homo sapiens
gaagaagaggaauguaaca

SEQ ID NO: 596484 - RNA, 19 nt, Homo sapiens
caugacaacgcccaauuaa

SEQ ID NO: 596485 - RNA, 19 nt, Homo sapiens
gaagauuuaaacuccauga

SEQ ID NO: 596486 - RNA, 19 nt, Homo sapiens
gaugaaaagggaagauuua

SEQ ID NO: 596487 - RNA, 19 nt, Homo sapiens
ccgcuugacuguggaguuu

SEQ ID NO: 596488 - RNA, 19 nt, Homo sapiens
ccucagcucucccuuccaa

SEQ ID NO: 596489 - RNA, 19 nt, Homo sapiens
caaacuaggccaacucaag

SEQ ID NO: 596490 - RNA, 19 nt, Homo sapiens
ggaagugcaacaugagaga

SEQ ID NO: 596491 - RNA, 19 nt, Homo sapiens
gcaggagacaccuuuggaa

SEQ ID NO: 596492 - RNA, 19 nt, Homo sapiens
acacagaaacccauuauac

SEQ ID NO: 596493 - RNA, 19 nt, Homo sapiens
gaaagggaugagugaagaa

SEQ ID NO: 596494 - RNA, 19 nt, Homo sapiens
gcaugugccucaccuacca

SEQ ID NO: 596495 - RNA, 19 nt, Homo sapiens
cagaaacccauuauacuuc

SEQ ID NO: 596496 - RNA, 19 nt, Homo sapiens
acagaaacccauuauacuu

SEQ ID NO: 596497 - RNA, 19 nt, Homo sapiens
gagcugugguggcuucagu

SEQ ID NO: 596498 - RNA, 19 nt, Homo sapiens
gcagacagaacaacaaacu

SEQ ID NO: 596499 - RNA, 19 nt, Homo sapiens
uuacacaacagaccaagaa

SEQ ID NO: 596500 - RNA, 19 nt, Homo sapiens
gaaacccauuauacuucaa

SEQ ID NO: 596501 - RNA, 19 nt, Homo sapiens
agaaacccauuauacuuca

SEQ ID NO: 596502 - RNA, 19 nt, Homo sapiens
ggcuugacaugcuguauuc

SEQ ID NO: 596503 - RNA, 19 nt, Homo sapiens
gggaagauuuaaacuccau

SEQ ID NO: 596504 - RNA, 19 nt, Homo sapiens
ggaacaccuccuucuuuga

SEQ ID NO: 596505 - RNA, 19 nt, Homo sapiens
gcccagaaguaccaugaca

SEQ ID NO: 596506 - RNA, 19 nt, Homo sapiens
caaggaagugcauuaguag

SEQ ID NO: 596507 - RNA, 19 nt, Homo sapiens
gaaaacaaagcaauucaug

SEQ ID NO: 596508 - RNA, 19 nt, Homo sapiens
gcuccuuccuacacagaaa

SEQ ID NO: 596509 - RNA, 19 nt, Homo sapiens
aaguguggcuacaaccaua

SEQ ID NO: 596510 - RNA, 19 nt, Homo sapiens
ggauggacaaguaaaggaa

SEQ ID NO: 596511 - RNA, 19 nt, Homo sapiens
acaccaggauguuguaugg

SEQ ID NO: 596512 - RNA, 19 nt, Homo sapiens
gacaacgcccaauuaauca

SEQ ID NO: 596513 - RNA, 19 nt, Homo sapiens
aacacaagcucauagagau

SEQ ID NO: 596514 - RNA, 19 nt, Homo sapiens
ccaaacacaagcucauaga

SEQ ID NO: 596515 - RNA, 19 nt, Homo sapiens
gcucuucaguuuacacaac

SEQ ID NO: 596516 - RNA, 19 nt, Homo sapiens
gaaccaaguguggcuacaa

SEQ ID NO: 596517 - RNA, 19 nt, Homo sapiens
caggagacaccuuuggaaa

SEQ ID NO: 596518 - RNA, 19 nt, Homo sapiens
ggacaaguaaaggaaguga

SEQ ID NO: 596519 - RNA, 19 nt, Homo sapiens
gacugaacuuccagaacaa

SEQ ID NO: 596520 - RNA, 19 nt, Homo sapiens
agacagaacaacaaacuag

SEQ ID NO: 596521 - RNA, 19 nt, Homo sapiens
gaugcgaagugugggaaga

SEQ ID NO: 596522 - RNA, 19 nt, Homo sapiens
ggccaacaccuuauuuaca

SEQ ID NO: 596523 - RNA, 19 nt, Homo sapiens
gcagcaaccucagcuacgu

SEQ ID NO: 596524 - RNA, 19 nt, Homo sapiens
ccucguacuucuucugugu

SEQ ID NO: 596525 - RNA, 19 nt, Homo sapiens
gaggcuaugaugagcagua

SEQ ID NO: 596526 - RNA, 19 nt, Homo sapiens
caccauggcccacgagaug

SEQ ID NO: 596527 - RNA, 19 nt, Homo sapiens
agagaucgccaacuauguu

SEQ ID NO: 596528 - RNA, 19 nt, Homo sapiens
gaaaagggaagauuuaaac

SEQ ID NO: 596529 - RNA, 19 nt, Homo sapiens
gaagagcaaggaagugcau

SEQ ID NO: 596530 - RNA, 19 nt, Homo sapiens
acaaccauauuugcuuuga

SEQ ID NO: 596531 - RNA, 19 nt, Homo sapiens
gcuacaaccauauuugcuu

SEQ ID NO: 596532 - RNA, 19 nt, Homo sapiens
ggcugauuauuuagaguuu

SEQ ID NO: 596533 - RNA, 19 nt, Homo sapiens
ccaacaccuuauuuacaga

SEQ ID NO: 596534 - RNA, 19 nt, Homo sapiens
agaaaagcauccacucaaa

SEQ ID NO: 596535 - RNA, 19 nt, Homo sapiens
ggagagaccuuauuccaaa

SEQ ID NO: 596536 - RNA, 19 nt, Homo sapiens
guagauagcucugaaauga

SEQ ID NO: 596537 - RNA, 19 nt, Homo sapiens
gaagaagacuggccauuau

SEQ ID NO: 596538 - RNA, 19 nt, Homo sapiens
ggagggagcuggacaggua

SEQ ID NO: 596539 - RNA, 19 nt, Homo sapiens
ggaauuagaggacugauua

SEQ ID NO: 596540 - RNA, 19 nt, Homo sapiens
aaacaaaccucaagggauu

SEQ ID NO: 596541 - RNA, 19 nt, Homo sapiens
ggaagaugguggaauguuu

SEQ ID NO: 596542 - RNA, 19 nt, Homo sapiens
ccucguggcugauuauuua

SEQ ID NO: 596543 - RNA, 19 nt, Homo sapiens
ugaaguauguggagcuuua

SEQ ID NO: 596544 - RNA, 19 nt, Homo sapiens
ggaagaagacuggccauua

SEQ ID NO: 596545 - RNA, 19 nt, Homo sapiens
gcagagaacagacccauuu

SEQ ID NO: 596546 - RNA, 19 nt, Homo sapiens
acaaauaaaucugggcuua

SEQ ID NO: 596547 - RNA, 19 nt, Homo sapiens
caaagcaccuggagauguu

SEQ ID NO: 596548 - RNA, 19 nt, Homo sapiens
ggagcaggcuggucauuga

SEQ ID NO: 596549 - RNA, 19 nt, Homo sapiens
caagagagcuucccauugc

SEQ ID NO: 596550 - RNA, 19 nt, Homo sapiens
gagggaagcuuaacucaag

SEQ ID NO: 596551 - RNA, 19 nt, Homo sapiens
gcaccaaauugcaucguuu

SEQ ID NO: 596552 - RNA, 19 nt, Homo sapiens
gaacaccuccuucuuugaa

SEQ ID NO: 596553 - RNA, 19 nt, Homo sapiens
gagcccagcuauuuacaaa

SEQ ID NO: 596554 - RNA, 19 nt, Homo sapiens
gagaagaagaggaauguaa

SEQ ID NO: 596555 - RNA, 19 nt, Homo sapiens
ucauagagaucgccaacua

SEQ ID NO: 596556 - RNA, 19 nt, Homo sapiens
gcaaccaguucuacuaaug

SEQ ID NO: 596557 - RNA, 19 nt, Homo sapiens
ccauaaaguuguacuguga

SEQ ID NO: 596558 - RNA, 19 nt, Homo sapiens
gcaccuggcucaaucuugu

SEQ ID NO: 596559 - RNA, 19 nt, Homo sapiens
gaacuuaucauaccucagu

SEQ ID NO: 596560 - RNA, 19 nt, Homo sapiens
ggaaagggaauauugcaaa

SEQ ID NO: 596561 - RNA, 19 nt, Homo sapiens
uuagaaagaucucaggaaa

SEQ ID NO: 596562 - RNA, 19 nt, Homo sapiens
ggagguagauagcucugaa

SEQ ID NO: 596563 - RNA, 19 nt, Homo sapiens
guucuuggguuuggaaaua

SEQ ID NO: 596564 - RNA, 19 nt, Homo sapiens
gcagucaggugguggaaug

SEQ ID NO: 596565 - RNA, 19 nt, Homo sapiens
gcaauacgccuuuccaauc

SEQ ID NO: 596566 - RNA, 19 nt, Homo sapiens
gaucaacacuccggaaauc

SEQ ID NO: 596567 - RNA, 19 nt, Homo sapiens
ggaaauaaguggaaaauac

SEQ ID NO: 596568 - RNA, 19 nt, Homo sapiens
gaaguaaacauggcuagaa

SEQ ID NO: 596569 - RNA, 19 nt, Homo sapiens
gggaacaugugugaaguuu

SEQ ID NO: 596570 - RNA, 19 nt, Homo sapiens
gauuuaaacuccaugaagu

SEQ ID NO: 596571 - RNA, 19 nt, Homo sapiens
ggacagguaucugcaguca

SEQ ID NO: 596572 - RNA, 19 nt, Homo sapiens
cagggaagcugcccaggaa

SEQ ID NO: 596573 - RNA, 19 nt, Homo sapiens
ugacaacgcccaauuaauc

SEQ ID NO: 596574 - RNA, 19 nt, Homo sapiens
cuacaaccauauuugcuuu

SEQ ID NO: 596575 - RNA, 19 nt, Homo sapiens
uaaacuccaugaaguaugu

SEQ ID NO: 596576 - RNA, 19 nt, Homo sapiens
ggagaagaaugagcaacuu

SEQ ID NO: 596577 - RNA, 19 nt, Homo sapiens
aaacauggcuagaaagaac

SEQ ID NO: 596578 - RNA, 19 nt, Homo sapiens
ugugguagcuggaguguug

SEQ ID NO: 596579 - RNA, 19 nt, Homo sapiens
gaguguggguccuguggua

SEQ ID NO: 596580 - RNA, 19 nt, Homo sapiens
caaagucaguaauuguguu

SEQ ID NO: 596581 - RNA, 19 nt, Homo sapiens
gcaagagagcuucccauug

SEQ ID NO: 596582 - RNA, 19 nt, Homo sapiens
cgagaugggccacaacuuu

SEQ ID NO: 596583 - RNA, 19 nt, Homo sapiens
gaaagggaauauugcaaaa

SEQ ID NO: 596584 - RNA, 19 nt, Homo sapiens
ggacaugaauggugaacac

SEQ ID NO: 596585 - RNA, 19 nt, Homo sapiens
ggagacaccuuuggaaacu

SEQ ID NO: 596586 - RNA, 19 nt, Homo sapiens
guaaacauggcuagaaaga

SEQ ID NO: 596587 - RNA, 19 nt, Homo sapiens
cacaggaagugcaacauga

SEQ ID NO: 596588 - RNA, 19 nt, Homo sapiens
uggaagacuugcaauuuga

SEQ ID NO: 596589 - RNA, 19 nt, Homo sapiens
ugacagcgccacagccaua

SEQ ID NO: 596590 - RNA, 19 nt, Homo sapiens
gagggacuaugaucugaug

SEQ ID NO: 596591 - RNA, 19 nt, Homo sapiens
ccaacgcggugcccauuga

SEQ ID NO: 596592 - RNA, 19 nt, Homo sapiens
guccaccuauuaauuguuu

SEQ ID NO: 596593 - RNA, 19 nt, Homo sapiens
caauacgccuuuccaaucu

SEQ ID NO: 596594 - RNA, 19 nt, Homo sapiens
gaaccacaccagaaagaga

SEQ ID NO: 596595 - RNA, 19 nt, Homo sapiens
ggauggaggugguacuuac

SEQ ID NO: 596596 - RNA, 19 nt, Homo sapiens
gagaagaaugagcaacuuu

SEQ ID NO: 596597 - RNA, 19 nt, Homo sapiens
gaaaacagaucuucuucuc

SEQ ID NO: 596598 - RNA, 19 nt, Homo sapiens
gcaaagcaccuggagaugu

SEQ ID NO: 596599 - RNA, 19 nt, Homo sapiens
ugacaccacuaucaucaug

SEQ ID NO: 596600 - RNA, 19 nt, Homo sapiens
gggaagauccagugucaga

SEQ ID NO: 596601 - RNA, 19 nt, Homo sapiens
ccacugcccuaccaacuuc

SEQ ID NO: 596602 - RNA, 19 nt, Homo sapiens
ugacagaggguauggaaga

SEQ ID NO: 596603 - RNA, 19 nt, Homo sapiens
aaauuaaccuccugccaau

SEQ ID NO: 596604 - RNA, 19 nt, Homo sapiens
gcccagcuauuuacaaagu

SEQ ID NO: 596605 - RNA, 19 nt, Homo sapiens
gaacacaggaagugcaaca

SEQ ID NO: 596606 - RNA, 19 nt, Homo sapiens
aaguaaacauggcuagaaa

SEQ ID NO: 596607 - RNA, 19 nt, Homo sapiens
agaaggcacucccggcaaa

SEQ ID NO: 596608 - RNA, 19 nt, Homo sapiens
gugggaagauccaguguca

SEQ ID NO: 596609 - RNA, 19 nt, Homo sapiens
gagaugggccacaacuuug

SEQ ID NO: 596610 - RNA, 19 nt, Homo sapiens
ccaugacaacgcccaauua

SEQ ID NO: 596611 - RNA, 19 nt, Homo sapiens
caugagagaugcgaagugu

SEQ ID NO: 596612 - RNA, 19 nt, Homo sapiens
gccaacaccuuauuuacag

SEQ ID NO: 596613 - RNA, 19 nt, Homo sapiens
guuccaaagucaguaauug

SEQ ID NO: 596614 - RNA, 19 nt, Homo sapiens
cugccuacuuccuaauuua

SEQ ID NO: 596615 - RNA, 19 nt, Homo sapiens
ggauguagguaaaucuuuu

SEQ ID NO: 596616 - RNA, 19 nt, Homo sapiens
aaacacaagcucauagaga

SEQ ID NO: 596617 - RNA, 19 nt, Homo sapiens
uuagggagcccagcuauuu

SEQ ID NO: 596618 - RNA, 19 nt, Homo sapiens
gaagaagaggaauguaaca

SEQ ID NO: 596619 - RNA, 19 nt, Homo sapiens
caugacaacgcccaauuaa

SEQ ID NO: 596620 - RNA, 19 nt, Homo sapiens
gaagauuuaaacuccauga

SEQ ID NO: 596621 - RNA, 19 nt, Homo sapiens
gaugaaaagggaagauuua

SEQ ID NO: 596622 - RNA, 19 nt, Homo sapiens
cagaucuucuucucucuug

SEQ ID NO: 596623 - RNA, 19 nt, Homo sapiens
uauggaagacuugcaauuu

SEQ ID NO: 596624 - RNA, 19 nt, Homo sapiens
ggaauuugauagacuuucg

SEQ ID NO: 596625 - RNA, 19 nt, Homo sapiens
ccucagcucucccuuccaa

SEQ ID NO: 596626 - RNA, 19 nt, Homo sapiens
gaagacuugcaauuugaaa

SEQ ID NO: 596627 - RNA, 19 nt, Homo sapiens
ggagcuggccugacucuca

SEQ ID NO: 596628 - RNA, 19 nt, Homo sapiens
gauguuugcugggagauag

SEQ ID NO: 596629 - RNA, 19 nt, Homo sapiens
caaacuaggccaacucaag

SEQ ID NO: 596630 - RNA, 19 nt, Homo sapiens
ggaagugcaacaugagaga

SEQ ID NO: 596631 - RNA, 19 nt, Homo sapiens
gcaggagacaccuuuggaa

SEQ ID NO: 596632 - RNA, 19 nt, Homo sapiens
acacagaaacccauuauac

SEQ ID NO: 596633 - RNA, 19 nt, Homo sapiens
gagccuggauggacaagag

SEQ ID NO: 596634 - RNA, 19 nt, Homo sapiens
guacaucuaugcaaaauac

SEQ ID NO: 596635 - RNA, 19 nt, Homo sapiens
uaacagaacucucagaaau

SEQ ID NO: 596636 - RNA, 19 nt, Homo sapiens
gaagaugauuggagaguuu

SEQ ID NO: 596637 - RNA, 19 nt, Homo sapiens
gcacagagcaguucaauca

SEQ ID NO: 596638 - RNA, 19 nt, Homo sapiens
gaugagggcuuccacauug

SEQ ID NO: 596639 - RNA, 19 nt, Homo sapiens
ucacagagcucuacaucaa

SEQ ID NO: 596640 - RNA, 19 nt, Homo sapiens
caucacaccugacaacuuu

SEQ ID NO: 596641 - RNA, 19 nt, Homo sapiens
ucacaaagcugcuguccaa

SEQ ID NO: 596642 - RNA, 19 nt, Homo sapiens
ggaggaagcuguugacucu

SEQ ID NO: 596643 - RNA, 19 nt, Homo sapiens
caagaugccuuaugagaug

SEQ ID NO: 596644 - RNA, 19 nt, Homo sapiens
ggaaccaccuuaucaucua

SEQ ID NO: 596645 - RNA, 19 nt, Homo sapiens
cuaauuaguuggucaguuu

SEQ ID NO: 596646 - RNA, 19 nt, Homo sapiens
ucacaaauaugacagcaaa

SEQ ID NO: 596647 - RNA, 19 nt, Homo sapiens
guccaucccugaaguguua

SEQ ID NO: 596648 - RNA, 19 nt, Homo sapiens
gaaacaggcuccuucucuu

SEQ ID NO: 596649 - RNA, 19 nt, Homo sapiens
gcaagagucacaaauauga

SEQ ID NO: 596650 - RNA, 19 nt, Homo sapiens
gcaaggacuuugagcaaga

SEQ ID NO: 596651 - RNA, 19 nt, Homo sapiens
caucaucucucuaugcaaa

SEQ ID NO: 596652 - RNA, 19 nt, Homo sapiens
gcacggauccugccaguga

SEQ ID NO: 596653 - RNA, 19 nt, Homo sapiens
ggaaggaugacguugauaa

SEQ ID NO: 596654 - RNA, 19 nt, Homo sapiens
ugauagagguagaagauuu

SEQ ID NO: 596655 - RNA, 19 nt, Homo sapiens
gaaccugcccaguguauuu

SEQ ID NO: 596656 - RNA, 19 nt, Homo sapiens
caauagcgaugccugcuuu

SEQ ID NO: 596657 - RNA, 19 nt, Homo sapiens
gaaccaccuuaucaucuaa

SEQ ID NO: 596658 - RNA, 19 nt, Homo sapiens
gagcacuacuuguacauga

SEQ ID NO: 596659 - RNA, 19 nt, Homo sapiens
cgggagggcuggaagaaua

SEQ ID NO: 596660 - RNA, 19 nt, Homo sapiens
caaagcugcuguccaagaa

SEQ ID NO: 596661 - RNA, 19 nt, Homo sapiens
ggagaaacguggcaagagu

SEQ ID NO: 596662 - RNA, 19 nt, Homo sapiens
gugauucgcucugaagaua

SEQ ID NO: 596663 - RNA, 19 nt, Homo sapiens
gguagaagauuucguggau

SEQ ID NO: 596664 - RNA, 19 nt, Homo sapiens
ccaagacaguauuccauuu

SEQ ID NO: 596665 - RNA, 19 nt, Homo sapiens
gggaacgcauugacuguuu

SEQ ID NO: 596666 - RNA, 19 nt, Homo sapiens
gaacaugcuucuggugaug

SEQ ID NO: 596667 - RNA, 19 nt, Homo sapiens
caacacaccuacuaucucu

SEQ ID NO: 596668 - RNA, 19 nt, Homo sapiens
ccaagaugguggauaagaa

SEQ ID NO: 596669 - RNA, 19 nt, Homo sapiens
gcuaugaucuugaccucuu

SEQ ID NO: 596670 - RNA, 19 nt, Homo sapiens
ccacauugcucucuaaggu

SEQ ID NO: 596671 - RNA, 19 nt, Homo sapiens
gcagcgagcacuacuugua

SEQ ID NO: 596672 - RNA, 19 nt, Homo sapiens
caacagugcugagcuuugu

SEQ ID NO: 596673 - RNA, 19 nt, Homo sapiens
caaccacucugcacuuugu

SEQ ID NO: 596674 - RNA, 19 nt, Homo sapiens
ggagacagguggccagaag

SEQ ID NO: 596675 - RNA, 19 nt, Homo sapiens
caucaagaaugaggaaauu

SEQ ID NO: 596676 - RNA, 19 nt, Homo sapiens
caaccacaauguucguaaa

SEQ ID NO: 596677 - RNA, 19 nt, Homo sapiens
ggaagaaacagaagagauc

SEQ ID NO: 596678 - RNA, 19 nt, Homo sapiens
gaugugccgucacuuauuc

SEQ ID NO: 596679 - RNA, 19 nt, Homo sapiens
aagaagaacccaagaacua

SEQ ID NO: 596680 - RNA, 19 nt, Homo sapiens
acagaacucucagaaauug

SEQ ID NO: 596681 - RNA, 19 nt, Homo sapiens
auagugagcucccauccua

SEQ ID NO: 596682 - RNA, 19 nt, Homo sapiens
gggaagagacaccaucaaa

SEQ ID NO: 596683 - RNA, 19 nt, Homo sapiens
gcagugagucuauugagaa

SEQ ID NO: 596684 - RNA, 19 nt, Homo sapiens
ggaagggacccauguggaa

SEQ ID NO: 596685 - RNA, 19 nt, Homo sapiens
ggaagaccuuacugaucua

SEQ ID NO: 596686 - RNA, 19 nt, Homo sapiens
gaaugggaguccuguuuua

SEQ ID NO: 596687 - RNA, 19 nt, Homo sapiens
gcugucaucaugcuuaaua

SEQ ID NO: 596688 - RNA, 19 nt, Homo sapiens
ggauucaguuucugcaaga

SEQ ID NO: 596689 - RNA, 19 nt, Homo sapiens
gaagcuagcaauacugaga

SEQ ID NO: 596690 - RNA, 19 nt, Homo sapiens
caacuaugauugugacuac

SEQ ID NO: 596691 - RNA, 19 nt, Homo sapiens
ucagugaguuauugagaaa

SEQ ID NO: 596692 - RNA, 19 nt, Homo sapiens
gcacucaccucugucaaca

SEQ ID NO: 596693 - RNA, 19 nt, Homo sapiens
gcaggucacucagagauca

SEQ ID NO: 596694 - RNA, 19 nt, Homo sapiens
gagaguggccuuagagugu

SEQ ID NO: 596695 - RNA, 19 nt, Homo sapiens
acucagagguuaugauuca

SEQ ID NO: 596696 - RNA, 19 nt, Homo sapiens
ucaacaaguuccuguccua

SEQ ID NO: 596697 - RNA, 19 nt, Homo sapiens
ggaagugauucgcucugaa

SEQ ID NO: 596698 - RNA, 19 nt, Homo sapiens
gaacaucagcccugcagau

SEQ ID NO: 596699 - RNA, 19 nt, Homo sapiens
uggcaagagucacaaauau

SEQ ID NO: 596700 - RNA, 19 nt, Homo sapiens
ggaaacaggcuccuucucu

SEQ ID NO: 596701 - RNA, 19 nt, Homo sapiens
ugagaugugccgucacuua

SEQ ID NO: 596702 - RNA, 19 nt, Homo sapiens
aaagcuagaugcccuggaa

SEQ ID NO: 596703 - RNA, 19 nt, Homo sapiens
ugaggaagaugcugcuuuc

SEQ ID NO: 596704 - RNA, 19 nt, Homo sapiens
ccaagagaguggccuuaga

SEQ ID NO: 596705 - RNA, 19 nt, Homo sapiens
caagaaugaggaaauugua

SEQ ID NO: 596706 - RNA, 19 nt, Homo sapiens
gagaagcuagcaauacuga

SEQ ID NO: 596707 - RNA, 19 nt, Homo sapiens
gaugguggauaagaauauu

SEQ ID NO: 596708 - RNA, 19 nt, Homo sapiens
acagagcguuggaugaauu

SEQ ID NO: 596709 - RNA, 19 nt, Homo sapiens
ccaaauggaagaaacagaa

SEQ ID NO: 596710 - RNA, 19 nt, Homo sapiens
ggaccaacaugaagaagcu

SEQ ID NO: 596711 - RNA, 19 nt, Homo sapiens
gcagagugaugaugaugag

SEQ ID NO: 596712 - RNA, 19 nt, Homo sapiens
gaacaugggaaaucaggau

SEQ ID NO: 596713 - RNA, 19 nt, Homo sapiens
ggcaugcccuucauugaug

SEQ ID NO: 596714 - RNA, 19 nt, Homo sapiens
ccacugcugucacucucua

SEQ ID NO: 596715 - RNA, 19 nt, Homo sapiens
agagacauaugaugaggaa

SEQ ID NO: 596716 - RNA, 19 nt, Homo sapiens
ggagaacuauguguggaau

SEQ ID NO: 596717 - RNA, 19 nt, Homo sapiens
gaauggaggcaaggacuuu

SEQ ID NO: 596718 - RNA, 19 nt, Homo sapiens
cagagcaguucaaucagaa

SEQ ID NO: 596719 - RNA, 19 nt, Homo sapiens
gagaugcugcuaaggauug

SEQ ID NO: 596720 - RNA, 19 nt, Homo sapiens
aagaaugccuucccugugu

SEQ ID NO: 596721 - RNA, 19 nt, Homo sapiens
gaucaucacuguggagaac

SEQ ID NO: 596722 - RNA, 19 nt, Homo sapiens
gaugagaugugccgucacu

SEQ ID NO: 596723 - RNA, 19 nt, Homo sapiens
ccaaugaaucuguguguga

SEQ ID NO: 596724 - RNA, 19 nt, Homo sapiens
cagaugaagagacauauga

SEQ ID NO: 596725 - RNA, 19 nt, Homo sapiens
caugaaggcucuggucuca

SEQ ID NO: 596726 - RNA, 19 nt, Homo sapiens
ugacagguuugccaagaug

SEQ ID NO: 596727 - RNA, 19 nt, Homo sapiens
caagacaguauuccauuug

SEQ ID NO: 596728 - RNA, 19 nt, Homo sapiens
ggccuaugcugucaucaug

SEQ ID NO: 596729 - RNA, 19 nt, Homo sapiens
gaagaacccaagaacuaug

SEQ ID NO: 596730 - RNA, 19 nt, Homo sapiens
ucaccucugucaacaaguu

SEQ ID NO: 596731 - RNA, 19 nt, Homo sapiens
gagcauguacauauggaaa

SEQ ID NO: 596732 - RNA, 19 nt, Homo sapiens
ccuacgagaugaacucuuc

SEQ ID NO: 596733 - RNA, 19 nt, Homo sapiens
ugaaggcucuggucucagu

SEQ ID NO: 596734 - RNA, 19 nt, Homo sapiens
aaagcaaugugacccagaa

SEQ ID NO: 596735 - RNA, 19 nt, Homo sapiens
gaacauggcuggauuguga

SEQ ID NO: 596736 - RNA, 19 nt, Homo sapiens
gcaaagaaguacaauauga

SEQ ID NO: 596737 - RNA, 19 nt, Homo sapiens
gaacagaaagguagaguua

SEQ ID NO: 596738 - RNA, 19 nt, Homo sapiens
caaaggaacuucugauuga

SEQ ID NO: 596739 - RNA, 19 nt, Homo sapiens
caacucaucucgauauauu

SEQ ID NO: 596740 - RNA, 19 nt, Homo sapiens
ggaccaggcccuaauaaua

SEQ ID NO: 596741 - RNA, 19 nt, Homo sapiens
guacaagugugugauguua

SEQ ID NO: 596742 - RNA, 19 nt, Homo sapiens
gaaaagaguuugaagauga

SEQ ID NO: 596743 - RNA, 19 nt, Homo sapiens
ggaaguauauugauagcuu

SEQ ID NO: 596744 - RNA, 19 nt, Homo sapiens
gaagguggaugacuaugaa

SEQ ID NO: 596745 - RNA, 19 nt, Homo sapiens
gcagagcaauugaguauuc

SEQ ID NO: 596746 - RNA, 19 nt, Homo sapiens
guacuuacgugaacuguug

SEQ ID NO: 596747 - RNA, 19 nt, Homo sapiens
gaacaacucaucucgauau

SEQ ID NO: 596748 - RNA, 19 nt, Homo sapiens
gaaacagaaucauuuggaa

SEQ ID NO: 596749 - RNA, 19 nt, Homo sapiens
caagaaugcugauguugaa

SEQ ID NO: 596750 - RNA, 19 nt, Homo sapiens
gaacuguuguccuugcuuu

SEQ ID NO: 596751 - RNA, 19 nt, Homo sapiens
guucuaaacuugucucuga

SEQ ID NO: 596752 - RNA, 19 nt, Homo sapiens
gagcagaguugggaguaua

SEQ ID NO: 596753 - RNA, 19 nt, Homo sapiens
agaaauugcuaccauagua

SEQ ID NO: 596754 - RNA, 19 nt, Homo sapiens
gaacaacauuccuaauucu

SEQ ID NO: 596755 - RNA, 19 nt, Homo sapiens
gauauugacuuaagaacug

SEQ ID NO: 596756 - RNA, 19 nt, Homo sapiens
gaaacagagucuucauuca

SEQ ID NO: 596757 - RNA, 19 nt, Homo sapiens
caacauaccuuggacaaag

SEQ ID NO: 596758 - RNA, 19 nt, Homo sapiens
gcacaaauuugaacaacuc

SEQ ID NO: 596759 - RNA, 19 nt, Homo sapiens
gaagaacagucaaguaagg

SEQ ID NO: 596760 - RNA, 19 nt, Homo sapiens
gaauggaauuggaaaugaa

SEQ ID NO: 596761 - RNA, 19 nt, Homo sapiens
gaagaauccuccaaacgau

SEQ ID NO: 596762 - RNA, 19 nt, Homo sapiens
gaacagucaaguaagguua

SEQ ID NO: 596763 - RNA, 19 nt, Homo sapiens
caacaguggcugcccauua

SEQ ID NO: 596764 - RNA, 19 nt, Homo sapiens
caacauuccuaauucuuug

SEQ ID NO: 596765 - RNA, 19 nt, Homo sapiens
guuagaaccucccuaguug

SEQ ID NO: 596766 - RNA, 19 nt, Homo sapiens
guacugauauugccgaugu

SEQ ID NO: 596767 - RNA, 19 nt, Homo sapiens
caaaggagagccaggauuu

SEQ ID NO: 596768 - RNA, 19 nt, Homo sapiens
gcaaauaugacuucaacuu

SEQ ID NO: 596769 - RNA, 19 nt, Homo sapiens
caaggguacucuccaguuu

SEQ ID NO: 596770 - RNA, 19 nt, Homo sapiens
ugacacaccuuguagucua

SEQ ID NO: 596771 - RNA, 19 nt, Homo sapiens
cuucguaucugguuucuuu

SEQ ID NO: 596772 - RNA, 19 nt, Homo sapiens
cagauucccuuccaguuaa

SEQ ID NO: 596773 - RNA, 19 nt, Homo sapiens
ccucaggccuugugcauuu

SEQ ID NO: 596774 - RNA, 19 nt, Homo sapiens
gcgcauagauuaguucugu

SEQ ID NO: 596775 - RNA, 19 nt, Homo sapiens
ggacugagcccacuguugu

SEQ ID NO: 596776 - RNA, 19 nt, Homo sapiens
gccaggaaguauauugaua

SEQ ID NO: 596777 - RNA, 19 nt, Homo sapiens
gaacugcaguaggaauauu

SEQ ID NO: 596778 - RNA, 19 nt, Homo sapiens
gaaugaagcagagcaauug

SEQ ID NO: 596779 - RNA, 19 nt, Homo sapiens
gaaaaucccucccauguag

SEQ ID NO: 596780 - RNA, 19 nt, Homo sapiens
gaaauugcuaccauaguaa

SEQ ID NO: 596781 - RNA, 19 nt, Homo sapiens
aaacagcagugagcacaua

SEQ ID NO: 596782 - RNA, 19 nt, Homo sapiens
gcaaguagacauagcaaga

SEQ ID NO: 596783 - RNA, 19 nt, Homo sapiens
gaauaaaccacauacuguu

SEQ ID NO: 596784 - RNA, 19 nt, Homo sapiens
gagaggagcuggcaguuuu

SEQ ID NO: 596785 - RNA, 19 nt, Homo sapiens
ggaaagacacuccauccaa

SEQ ID NO: 596786 - RNA, 19 nt, Homo sapiens
gauuaguucugucugguuu

SEQ ID NO: 596787 - RNA, 19 nt, Homo sapiens
gaggaguguuuauuucuga

SEQ ID NO: 596788 - RNA, 19 nt, Homo sapiens
cacaaaguguuaccaguuu

SEQ ID NO: 596789 - RNA, 19 nt, Homo sapiens
cauagugucuucauuagug

SEQ ID NO: 596790 - RNA, 19 nt, Homo sapiens
caaaguacaugaagaacag

SEQ ID NO: 596791 - RNA, 19 nt, Homo sapiens
ucucugacuucacauguua

SEQ ID NO: 596792 - RNA, 19 nt, Homo sapiens
gcagagagcaagauuagau

SEQ ID NO: 596793 - RNA, 19 nt, Homo sapiens
uuaauggucuguacaguug

SEQ ID NO: 596794 - RNA, 19 nt, Homo sapiens
ggauguuccugaauucuug

SEQ ID NO: 596795 - RNA, 19 nt, Homo sapiens
gagauuauccuuuauuugg

SEQ ID NO: 596796 - RNA, 19 nt, Homo sapiens
caucugcaguugucaguuu

SEQ ID NO: 596797 - RNA, 19 nt, Homo sapiens
guacgagaguguagccaaa

SEQ ID NO: 596798 - RNA, 19 nt, Homo sapiens
ggucuuaauuaacagguaa

SEQ ID NO: 596799 - RNA, 19 nt, Homo sapiens
gccagaaacuccaauguag

SEQ ID NO: 596800 - RNA, 19 nt, Homo sapiens
ggaaaccacuauccugagu

SEQ ID NO: 596801 - RNA, 19 nt, Homo sapiens
agauguagauguagugaaa

SEQ ID NO: 596802 - RNA, 19 nt, Homo sapiens
gaaaguauugcaauucugu

SEQ ID NO: 596803 - RNA, 19 nt, Homo sapiens
ggaaagguuuguaaauggu

SEQ ID NO: 596804 - RNA, 19 nt, Homo sapiens
uaggaaagguuuguaaaug

SEQ ID NO: 596805 - RNA, 19 nt, Homo sapiens
ggaauauucucaccaucug

SEQ ID NO: 596806 - RNA, 19 nt, Homo sapiens
ggagcugguuagaacauuu

SEQ ID NO: 596807 - RNA, 19 nt, Homo sapiens
ggagauggcacucaaaaua

SEQ ID NO: 596808 - RNA, 19 nt, Homo sapiens
ccacuauccugaguucuaa

SEQ ID NO: 596809 - RNA, 19 nt, Homo sapiens
gcaggaagcagagauaaga

SEQ ID NO: 596810 - RNA, 19 nt, Homo sapiens
agaacaacauuccuaauuc

SEQ ID NO: 596811 - RNA, 19 nt, Homo sapiens
cagaacaacauuccuaauu

SEQ ID NO: 596812 - RNA, 19 nt, Homo sapiens
guugggaccucugucuuua

SEQ ID NO: 596813 - RNA, 19 nt, Homo sapiens
caaauaugacuucaacuug

SEQ ID NO: 596814 - RNA, 19 nt, Homo sapiens
ggaaauugagggagcauga

SEQ ID NO: 596815 - RNA, 19 nt, Homo sapiens
caaagucauugaaaguguu

SEQ ID NO: 596816 - RNA, 19 nt, Homo sapiens
gaauauacuugagaaagca

SEQ ID NO: 596817 - RNA, 19 nt, Homo sapiens
gagcagagagcaagauuag

SEQ ID NO: 596818 - RNA, 19 nt, Homo sapiens
gaacagaaaggagcagaga

SEQ ID NO: 596819 - RNA, 19 nt, Homo sapiens
gcagcaaaguacaugaaga

SEQ ID NO: 596820 - RNA, 19 nt, Homo sapiens
ggagaagcguagucaaagu

SEQ ID NO: 596821 - RNA, 19 nt, Homo sapiens
ucagauucccuuccaguua

SEQ ID NO: 596822 - RNA, 19 nt, Homo sapiens
ucacuuugcuaaauucuuc

SEQ ID NO: 596823 - RNA, 19 nt, Homo sapiens
gagagaagaauccuccaaa

SEQ ID NO: 596824 - RNA, 19 nt, Homo sapiens
gugcaucuauuaacuguuc

SEQ ID NO: 596825 - RNA, 19 nt, Homo sapiens
ucauuaacaugcugcaauu

SEQ ID NO: 596826 - RNA, 19 nt, Homo sapiens
guucuguccugcacaaauu

SEQ ID NO: 596827 - RNA, 19 nt, Homo sapiens
uaaaggaaaguucuaguug

SEQ ID NO: 596828 - RNA, 19 nt, Homo sapiens
gagauaagacuugaauuuc

SEQ ID NO: 596829 - RNA, 19 nt, Homo sapiens
gcagagauaagacuugaau

SEQ ID NO: 596830 - RNA, 19 nt, Homo sapiens
cauagaggauacagacuug

SEQ ID NO: 596831 - RNA, 19 nt, Homo sapiens
gcauuuggguuaucucaag

SEQ ID NO: 596832 - RNA, 19 nt, Homo sapiens
ggaguagccagugguaaua

SEQ ID NO: 596833 - RNA, 19 nt, Homo sapiens
aaucucagcuucacaaagu

SEQ ID NO: 596834 - RNA, 19 nt, Homo sapiens
acaaaguguuaccaguuua

SEQ ID NO: 596835 - RNA, 19 nt, Homo sapiens
gaaagaacucugagaauua

SEQ ID NO: 596836 - RNA, 19 nt, Homo sapiens
caaaagagcugaaacagua

SEQ ID NO: 596837 - RNA, 19 nt, Homo sapiens
cuaaagagccuaaagguua

SEQ ID NO: 596838 - RNA, 19 nt, Homo sapiens
gaaacaguaugacaacaaa

SEQ ID NO: 596839 - RNA, 19 nt, Homo sapiens
guaaguauaugcaagugua

SEQ ID NO: 596840 - RNA, 19 nt, Homo sapiens
ggagugauaucaaauacaa

SEQ ID NO: 596841 - RNA, 19 nt, Homo sapiens
ccaaggagaugcuguuuga

SEQ ID NO: 596842 - RNA, 19 nt, Homo sapiens
gcauaucuguguaaguaua

SEQ ID NO: 596843 - RNA, 19 nt, Homo sapiens
cagcuaacuucuuugauua

SEQ ID NO: 596844 - RNA, 19 nt, Homo sapiens
aaagaggccuuguuuauau

SEQ ID NO: 596845 - RNA, 19 nt, Homo sapiens
ugaaauggauggacuuauu

SEQ ID NO: 596846 - RNA, 19 nt, Homo sapiens
gcagaagugucaucaauuc

SEQ ID NO: 596847 - RNA, 19 nt, Homo sapiens
ugaaagaacucugagaauu

SEQ ID NO: 596848 - RNA, 19 nt, Homo sapiens
ccagcaugcucucaaauua

SEQ ID NO: 596849 - RNA, 19 nt, Homo sapiens
guaaauacuugaugcauuc

SEQ ID NO: 596850 - RNA, 19 nt, Homo sapiens
guaguuggccuuauaagua

SEQ ID NO: 596851 - RNA, 19 nt, Homo sapiens
gaaagcuacuugaaggaaa

SEQ ID NO: 596852 - RNA, 19 nt, Homo sapiens
ucaaggaaaucaagacauu

SEQ ID NO: 596853 - RNA, 19 nt, Homo sapiens
cuacaagggugauuauuug

SEQ ID NO: 596854 - RNA, 19 nt, Homo sapiens
uaaagagccuaaagguuaa

SEQ ID NO: 596855 - RNA, 19 nt, Homo sapiens
ucaaaugaguuacgugaaa

SEQ ID NO: 596856 - RNA, 19 nt, Homo sapiens
ggucugaauuguauaugua

SEQ ID NO: 596857 - RNA, 19 nt, Homo sapiens
ugagaucccuguauucaaa

SEQ ID NO: 596858 - RNA, 19 nt, Homo sapiens
caaagggaaugccagcuaa

SEQ ID NO: 596859 - RNA, 19 nt, Homo sapiens
uagaguaguuggccuuaua

SEQ ID NO: 596860 - RNA, 19 nt, Homo sapiens
guaaaugcauaucugugua

SEQ ID NO: 596861 - RNA, 19 nt, Homo sapiens
ggaacuaaauaucaaggaa

SEQ ID NO: 596862 - RNA, 19 nt, Homo sapiens
ccagcuaacuucuuugauu

SEQ ID NO: 596863 - RNA, 19 nt, Homo sapiens
gauaaacuguucuaauugg

SEQ ID NO: 596864 - RNA, 19 nt, Homo sapiens
ccaaagaagugagccauga

SEQ ID NO: 596865 - RNA, 19 nt, Homo sapiens
ugacaggguuguuaaguug

SEQ ID NO: 596866 - RNA, 19 nt, Homo sapiens
guaaagaucuucguaugca

SEQ ID NO: 596867 - RNA, 19 nt, Homo sapiens
gaauuuccauuucguaaag

SEQ ID NO: 596868 - RNA, 19 nt, Homo sapiens
auggguagcuucacauuua

SEQ ID NO: 596869 - RNA, 19 nt, Homo sapiens
cauaauaccaucugcagua

SEQ ID NO: 596870 - RNA, 19 nt, Homo sapiens
guaaugucauggaauagaa

SEQ ID NO: 596871 - RNA, 19 nt, Homo sapiens
gagguuggaauucagauua

SEQ ID NO: 596872 - RNA, 19 nt, Homo sapiens
cagcagaagugucaucaau

SEQ ID NO: 596873 - RNA, 19 nt, Homo sapiens
gaagugucaucaauucugu

SEQ ID NO: 596874 - RNA, 19 nt, Homo sapiens
ugaccgaaaugacauagaa

SEQ ID NO: 596875 - RNA, 19 nt, Homo sapiens
cuaauugguuugugaaaga

SEQ ID NO: 596876 - RNA, 19 nt, Homo sapiens
aagguaaugucauggaaua

SEQ ID NO: 596877 - RNA, 19 nt, Homo sapiens
gcaaagggaaugccagcua

SEQ ID NO: 596878 - RNA, 19 nt, Homo sapiens
auacaaaccuggucgaugu

SEQ ID NO: 596879 - RNA, 19 nt, Homo sapiens
ggaagguguuacuguuaaa

SEQ ID NO: 596880 - RNA, 19 nt, Homo sapiens
gcacugguuuccucauaug

SEQ ID NO: 596881 - RNA, 19 nt, Homo sapiens
ggacauuccuuuuccaauu

SEQ ID NO: 596882 - RNA, 19 nt, Homo sapiens
aauggaggcuaguguauuu

SEQ ID NO: 596883 - RNA, 19 nt, Homo sapiens
cgagaauucuaucuacauu

SEQ ID NO: 596884 - RNA, 19 nt, Homo sapiens
caaaugacaggguuguuaa

SEQ ID NO: 596885 - RNA, 19 nt, Homo sapiens
gaugauuauugacagagua

SEQ ID NO: 596886 - RNA, 19 nt, Homo sapiens
ggaaaugugcuccuucuca

SEQ ID NO: 596887 - RNA, 19 nt, Homo sapiens
cugaauaucugacgggauu

SEQ ID NO: 596888 - RNA, 19 nt, Homo sapiens
gaucggagagguuggaauu

SEQ ID NO: 596889 - RNA, 19 nt, Homo sapiens
gcauuaaacauucuugcua

SEQ ID NO: 596890 - RNA, 19 nt, Homo sapiens
aaacuuugcuuucuucagu

SEQ ID NO: 596891 - RNA, 19 nt, Homo sapiens
caagucauguaauguauag

SEQ ID NO: 596892 - RNA, 19 nt, Homo sapiens
ccauggauuuccuacauuu

SEQ ID NO: 596893 - RNA, 19 nt, Homo sapiens
gcaaguguauauucuuucu

SEQ ID NO: 596894 - RNA, 19 nt, Homo sapiens
agacugggcucauugacaa

SEQ ID NO: 596895 - RNA, 19 nt, Homo sapiens
ugacaaauacuucaagguu

SEQ ID NO: 596896 - RNA, 19 nt, Homo sapiens
auaaguagaucccauuuag

SEQ ID NO: 596897 - RNA, 19 nt, Homo sapiens
ggucugguuuauaucauuu

SEQ ID NO: 596898 - RNA, 19 nt, Homo sapiens
gagaauacugagaccuuua

SEQ ID NO: 596899 - RNA, 19 nt, Homo sapiens
augcauaucuguguaagua

SEQ ID NO: 596900 - RNA, 19 nt, Homo sapiens
guagacaucuguaggaacu

SEQ ID NO: 596901 - RNA, 19 nt, Homo sapiens
uuaacaaucuggaaacugu

SEQ ID NO: 596902 - RNA, 19 nt, Homo sapiens
gaacccgggucaagugcuu

SEQ ID NO: 596903 - RNA, 19 nt, Homo sapiens
gcucucaaauuaccuaaag

SEQ ID NO: 596904 - RNA, 19 nt, Homo sapiens
gagcaucucacuuuuaaua

SEQ ID NO: 596905 - RNA, 19 nt, Homo sapiens
gaggcuaguguauuuauuu

SEQ ID NO: 596906 - RNA, 19 nt, Homo sapiens
ccaggcuacuucugcuuua

SEQ ID NO: 596907 - RNA, 19 nt, Homo sapiens
uaaacaacuuggucugguu

SEQ ID NO: 596908 - RNA, 19 nt, Homo sapiens
uaucguagccagccuguaa

SEQ ID NO: 596909 - RNA, 19 nt, Homo sapiens
gacuguggcuugauguuga

SEQ ID NO: 596910 - RNA, 19 nt, Homo sapiens
ugacaucuguacuucaaga

SEQ ID NO: 596911 - RNA, 19 nt, Homo sapiens
cagcucacuucaauaacua

SEQ ID NO: 596912 - RNA, 19 nt, Homo sapiens
aaagaacucugagaauuag

SEQ ID NO: 596913 - RNA, 19 nt, Homo sapiens
agaaugcugucaccagaaa

SEQ ID NO: 596914 - RNA, 19 nt, Homo sapiens
caacuuggucugguuuaua

SEQ ID NO: 596915 - RNA, 19 nt, Homo sapiens
gaacgagaaauuauaaguc

SEQ ID NO: 596916 - RNA, 19 nt, Homo sapiens
uaacaacacaaccaaaguu

SEQ ID NO: 596917 - RNA, 19 nt, Homo sapiens
ugugagcgguuuaaugaaa

SEQ ID NO: 596918 - RNA, 19 nt, Homo sapiens
cagcauuucuguccugaau

SEQ ID NO: 596919 - RNA, 19 nt, Homo sapiens
ggaggcuaguguauuuauu

SEQ ID NO: 596920 - RNA, 19 nt, Homo sapiens
ggaccaagauaugauaguc

SEQ ID NO: 596921 - RNA, 19 nt, Homo sapiens
uggaagguguuacuguuaa

SEQ ID NO: 596922 - RNA, 19 nt, Homo sapiens
ggaugaggauggaaagaag

SEQ ID NO: 596923 - RNA, 19 nt, Homo sapiens
ccaccucuauugccagauu

SEQ ID NO: 596924 - RNA, 19 nt, Homo sapiens
ugucugccauuguugauaa

SEQ ID NO: 596925 - RNA, 19 nt, Homo sapiens
aaacgacuguggcuugaug

SEQ ID NO: 596926 - RNA, 19 nt, Homo sapiens
gccugugacuugaggguua

SEQ ID NO: 596927 - RNA, 19 nt, Homo sapiens
gaacaacagcugggucuuc

SEQ ID NO: 596928 - RNA, 19 nt, Homo sapiens
caacugcauuccuuugauc

SEQ ID NO: 596929 - RNA, 19 nt, Homo sapiens
ggacauagcacagaugaac

SEQ ID NO: 596930 - RNA, 19 nt, Homo sapiens
gaaacugugagcccauaaa

SEQ ID NO: 596931 - RNA, 19 nt, Homo sapiens
ccaaagguuuaaacaagau

SEQ ID NO: 596932 - RNA, 19 nt, Homo sapiens
uauaaguccucgacacgaa

SEQ ID NO: 596933 - RNA, 19 nt, Homo sapiens
aagaggccuuguuuauaua

SEQ ID NO: 596934 - RNA, 19 nt, Homo sapiens
gcaauacaucauggacuua

SEQ ID NO: 596935 - RNA, 19 nt, Homo sapiens
gcacuuacaugucggagaa

SEQ ID NO: 596936 - RNA, 19 nt, Homo sapiens
ggaaugugcucuucuggaa

SEQ ID NO: 596937 - RNA, 19 nt, Homo sapiens
ugacacugcuggcgauuua

SEQ ID NO: 596938 - RNA, 19 nt, Homo sapiens
gauaucgucuuccugguaa

SEQ ID NO: 596939 - RNA, 19 nt, Homo sapiens
aaacugcccuucccagaug

SEQ ID NO: 596940 - RNA, 19 nt, Homo sapiens
gcacugaggcuuggcuuga

SEQ ID NO: 596941 - RNA, 19 nt, Homo sapiens
gaaauaaaugagugucugu

SEQ ID NO: 596942 - RNA, 19 nt, Homo sapiens
gaaacugcccuucccagau

SEQ ID NO: 596943 - RNA, 19 nt, Homo sapiens
uaaaugagugucuguuuca

SEQ ID NO: 596944 - RNA, 19 nt, Homo sapiens
gcaucgcccucaccaacuu

SEQ ID NO: 596945 - RNA, 19 nt, Homo sapiens
caguagggcuggaggucua

SEQ ID NO: 596946 - RNA, 19 nt, Homo sapiens
gggcaucgccugguucuug

SEQ ID NO: 596947 - RNA, 19 nt, Homo sapiens
ggacuggacaucauuggau

SEQ ID NO: 596948 - RNA, 19 nt, Homo sapiens
auaaaugagugucuguuuc

SEQ ID NO: 596949 - RNA, 19 nt, Homo sapiens
gguaacagaacaugaccuu

SEQ ID NO: 596950 - RNA, 19 nt, Homo sapiens
ccaugggacuggcccucua

SEQ ID NO: 596951 - RNA, 19 nt, Homo sapiens
ucaauagcuuccgccagua

SEQ ID NO: 596952 - RNA, 19 nt, Homo sapiens
ucucaaggcucuggaacug

SEQ ID NO: 596953 - RNA, 19 nt, Homo sapiens
cuaccacgaugucaauguc

SEQ ID NO: 596954 - RNA, 19 nt, Homo sapiens
agacacugcugcucauggu

SEQ ID NO: 596955 - RNA, 19 nt, Homo sapiens
agauaucgucuuccuggua

SEQ ID NO: 596956 - RNA, 19 nt, Homo sapiens
gacagagacuccccaagga

SEQ ID NO: 596957 - RNA, 19 nt, Homo sapiens
cccuggagcugagcaguga

SEQ ID NO: 596958 - RNA, 19 nt, Homo sapiens
caccucugcugaucucaca

SEQ ID NO: 596959 - RNA, 19 nt, Homo sapiens
gggacuggcccucuauguc

SEQ ID NO: 596960 - RNA, 19 nt, Homo sapiens
cacugaggcuuggcuugaa

SEQ ID NO: 596961 - RNA, 19 nt, Homo sapiens
gaagcugguagcccugauc

SEQ ID NO: 596962 - RNA, 19 nt, Homo sapiens
gagagaagcuaucauauuu

SEQ ID NO: 596963 - RNA, 19 nt, Homo sapiens
caucgaaacuuaucuguua

SEQ ID NO: 596964 - RNA, 19 nt, Homo sapiens
ggaaggagcuggaggagaa

SEQ ID NO: 596965 - RNA, 19 nt, Homo sapiens
ggaagaagauaaagucaau

SEQ ID NO: 596966 - RNA, 19 nt, Homo sapiens
cggcagacaucgaaacuua

SEQ ID NO: 596967 - RNA, 19 nt, Homo sapiens
gaagagauuuccgacuuaa

SEQ ID NO: 596968 - RNA, 19 nt, Homo sapiens
cagaauagaugacgaacaa

SEQ ID NO: 596969 - RNA, 19 nt, Homo sapiens
gauaaaugcuccucucuca

SEQ ID NO: 596970 - RNA, 19 nt, Homo sapiens
caugaacccucccaaauuu

SEQ ID NO: 596971 - RNA, 19 nt, Homo sapiens
gcaaauagaagagaaauug

SEQ ID NO: 596972 - RNA, 19 nt, Homo sapiens
gcuuugagaucuuugauuu

SEQ ID NO: 596973 - RNA, 19 nt, Homo sapiens
ggaagaagcagauccagaa

SEQ ID NO: 596974 - RNA, 19 nt, Homo sapiens
gaagaaaucgagcagcuaa

SEQ ID NO: 596975 - RNA, 19 nt, Homo sapiens
gaagaaugaccuccaauug

SEQ ID NO: 596976 - RNA, 19 nt, Homo sapiens
cgacuuaacugagcagauu

SEQ ID NO: 596977 - RNA, 19 nt, Homo sapiens
gguagaagaucaauuuagu

SEQ ID NO: 596978 - RNA, 19 nt, Homo sapiens
gaaggagucucugauuuca

SEQ ID NO: 596979 - RNA, 19 nt, Homo sapiens
gagcugaccuugacgaaag

SEQ ID NO: 596980 - RNA, 19 nt, Homo sapiens
gcaggucgccuuagaagaa

SEQ ID NO: 596981 - RNA, 19 nt, Homo sapiens
ugacaacuccucaagauuu

SEQ ID NO: 596982 - RNA, 19 nt, Homo sapiens
gaggaggaccgcaagaaua

SEQ ID NO: 596983 - RNA, 19 nt, Homo sapiens
ggacauugcuggcuuugag

SEQ ID NO: 596984 - RNA, 19 nt, Homo sapiens
gcaaugaauaugucacuaa

SEQ ID NO: 596985 - RNA, 19 nt, Homo sapiens
gaagggagcccacaaguac

SEQ ID NO: 596986 - RNA, 19 nt, Homo sapiens
aagaggagaugaauucuga

SEQ ID NO: 596987 - RNA, 19 nt, Homo sapiens
gaacugcuggcgacagaua

SEQ ID NO: 596988 - RNA, 19 nt, Homo sapiens
cagagugacguuucaauua

SEQ ID NO: 596989 - RNA, 19 nt, Homo sapiens
uaaagucaauggucuaauc

SEQ ID NO: 596990 - RNA, 19 nt, Homo sapiens
caagaagccagaacuaauu

SEQ ID NO: 596991 - RNA, 19 nt, Homo sapiens
ggaagacugugaacaccaa

SEQ ID NO: 596992 - RNA, 19 nt, Homo sapiens
acacaagccugauaaauac

SEQ ID NO: 596993 - RNA, 19 nt, Homo sapiens
uuaaugagauggagauuca

SEQ ID NO: 596994 - RNA, 19 nt, Homo sapiens
agaagagauuuccgacuua

SEQ ID NO: 596995 - RNA, 19 nt, Homo sapiens
ugagaaggaugaagaaauc

SEQ ID NO: 596996 - RNA, 19 nt, Homo sapiens
gaagggcaguucauugaca

SEQ ID NO: 596997 - RNA, 19 nt, Homo sapiens
gccagaagauggaagaaug

SEQ ID NO: 596998 - RNA, 19 nt, Homo sapiens
gaacacaagccugauaaau

SEQ ID NO: 596999 - RNA, 19 nt, Homo sapiens
agacacaguugauccauga

SEQ ID NO: 597000 - RNA, 19 nt, Homo sapiens
gagccaagauugagaagca

SEQ ID NO: 597001 - RNA, 19 nt, Homo sapiens
ccaaagccgucuacgagaa

SEQ ID NO: 597002 - RNA, 19 nt, Homo sapiens
gcaucaacuucaccaauga

SEQ ID NO: 597003 - RNA, 19 nt, Homo sapiens
gaaagucgggaucuacaaa

SEQ ID NO: 597004 - RNA, 19 nt, Homo sapiens
acaaguggcugccggugua

SEQ ID NO: 597005 - RNA, 19 nt, Homo sapiens
gcaaggucauugagaagga

SEQ ID NO: 597006 - RNA, 19 nt, Homo sapiens
gagaagagcgagcugaaga

SEQ ID NO: 597007 - RNA, 19 nt, Homo sapiens
ggaagaagcaagcagauag

SEQ ID NO: 597008 - RNA, 19 nt, Homo sapiens
agauugagaugaacaagaa

SEQ ID NO: 597009 - RNA, 19 nt, Homo sapiens
ggaaaugccaagacuguga

SEQ ID NO: 597010 - RNA, 19 nt, Homo sapiens
aagaagagauuuccgacuu

SEQ ID NO: 597011 - RNA, 19 nt, Homo sapiens
gcuggaagcugcucagaag

SEQ ID NO: 597012 - RNA, 19 nt, Homo sapiens
gacgguagaagaucaauuu

SEQ ID NO: 597013 - RNA, 19 nt, Homo sapiens
cagagaagcuccucaacuc

SEQ ID NO: 597014 - RNA, 19 nt, Homo sapiens
caacuucaccaaugagaaa

SEQ ID NO: 597015 - RNA, 19 nt, Homo sapiens
gcaccgaaguggcugacaa

SEQ ID NO: 597016 - RNA, 19 nt, Homo sapiens
ccacagagaacaagguaaa

SEQ ID NO: 597017 - RNA, 19 nt, Homo sapiens
gcaguucauugacagcaaa

SEQ ID NO: 597018 - RNA, 19 nt, Homo sapiens
acacgcagcuguccagaug

SEQ ID NO: 597019 - RNA, 19 nt, Homo sapiens
gaagaaaugacagcacuug

SEQ ID NO: 597020 - RNA, 19 nt, Homo sapiens
gaugucugauucccaauga

SEQ ID NO: 597021 - RNA, 19 nt, Homo sapiens
gacaacuccucaagauuug

SEQ ID NO: 597022 - RNA, 19 nt, Homo sapiens
ggugguggcugccuacaga

SEQ ID NO: 597023 - RNA, 19 nt, Homo sapiens
ucaaggagaugacuuacca

SEQ ID NO: 597024 - RNA, 19 nt, Homo sapiens
aacacaagccugauaaaua

SEQ ID NO: 597025 - RNA, 19 nt, Homo sapiens
gaagcccucugcagucaug

SEQ ID NO: 597026 - RNA, 19 nt, Homo sapiens
cgggagccgugaugcauua

SEQ ID NO: 597027 - RNA, 19 nt, Homo sapiens
agagugacguuucaauuau

SEQ ID NO: 597028 - RNA, 19 nt, Homo sapiens
ccaagacugugaggaauga

SEQ ID NO: 597029 - RNA, 19 nt, Homo sapiens
gaagagggaggcugaguuc

SEQ ID NO: 597030 - RNA, 19 nt, Homo sapiens
ggaaggagaucugaaaaug

SEQ ID NO: 597031 - RNA, 19 nt, Homo sapiens
gaaaugacagcacuugaag

SEQ ID NO: 597032 - RNA, 19 nt, Homo sapiens
acagacaccuccuucaaga

SEQ ID NO: 597033 - RNA, 19 nt, Homo sapiens
gacaaugccuaucaguuca

SEQ ID NO: 597034 - RNA, 19 nt, Homo sapiens
ccugauaaauaccaagaaa

SEQ ID NO: 597035 - RNA, 19 nt, Homo sapiens
uggaggagcuggaggaaau

SEQ ID NO: 597036 - RNA, 19 nt, Homo sapiens
gaacaugcagaaagcaaga

SEQ ID NO: 597037 - RNA, 19 nt, Homo sapiens
caaaauaaaugccaagcuu

SEQ ID NO: 597038 - RNA, 19 nt, Homo sapiens
aagcuucucuccuuccuuu

SEQ ID NO: 597039 - RNA, 19 nt, Homo sapiens
gaagguuggcaaugaauau

SEQ ID NO: 597040 - RNA, 19 nt, Homo sapiens
ugagagaagcuaucauauu

SEQ ID NO: 597041 - RNA, 19 nt, Homo sapiens
ccaagcgugucauccagua

SEQ ID NO: 597042 - RNA, 19 nt, Homo sapiens
caugauggcugaggagcua

SEQ ID NO: 597043 - RNA, 19 nt, Homo sapiens
ggugaagguuggcaaugaa

SEQ ID NO: 597044 - RNA, 19 nt, Homo sapiens
aggccaaagugaagucuua

SEQ ID NO: 597045 - RNA, 19 nt, Homo sapiens
gaagaagcagauccagaaa

SEQ ID NO: 597046 - RNA, 19 nt, Homo sapiens
gaacaaguccacaguuugc

SEQ ID NO: 597047 - RNA, 19 nt, Homo sapiens
agaaugaccuccaauugca

SEQ ID NO: 597048 - RNA, 19 nt, Homo sapiens
ccaugaacccucccaaauu

SEQ ID NO: 597049 - RNA, 19 nt, Homo sapiens
gaagauggagggagaccuu

SEQ ID NO: 597050 - RNA, 19 nt, Homo sapiens
gauaaagucaauggucuaa

SEQ ID NO: 597051 - RNA, 19 nt, Homo sapiens
ugacagcacuugaagaaaa

SEQ ID NO: 597052 - RNA, 19 nt, Homo sapiens
gauccucuaugcugacuuc

SEQ ID NO: 597053 - RNA, 19 nt, Homo sapiens
ucaagaacaagcuguauga

SEQ ID NO: 597054 - RNA, 19 nt, Homo sapiens
gggugaagguuggcaauga

SEQ ID NO: 597055 - RNA, 19 nt, Homo sapiens
caagacuccuggugugaug

SEQ ID NO: 597056 - RNA, 19 nt, Homo sapiens
ggaagaggagugcauguuc

SEQ ID NO: 597057 - RNA, 19 nt, Homo sapiens
gaagaaaccaaggccaaga

SEQ ID NO: 597058 - RNA, 19 nt, Homo sapiens
acgaacaaguccacaguuu

SEQ ID NO: 597059 - RNA, 19 nt, Homo sapiens
caagagagacauugaugau

SEQ ID NO: 597060 - RNA, 19 nt, Homo sapiens
uaauugaccugcuucugau

SEQ ID NO: 597061 - RNA, 19 nt, Homo sapiens
ugacaaugccuaucaguuc

SEQ ID NO: 597062 - RNA, 19 nt, Homo sapiens
gaaacaagguccucacuuu

SEQ ID NO: 597063 - RNA, 19 nt, Homo sapiens
ggaaagagguuguuguaaa

SEQ ID NO: 597064 - RNA, 19 nt, Homo sapiens
gaaauaaugucaggucuuu

SEQ ID NO: 597065 - RNA, 19 nt, Homo sapiens
gagcagaucuggcuacaaa

SEQ ID NO: 597066 - RNA, 19 nt, Homo sapiens
gaaagagguuguuguaaau

SEQ ID NO: 597067 - RNA, 19 nt, Homo sapiens
caagaaagaugcugggauu

SEQ ID NO: 597068 - RNA, 19 nt, Homo sapiens
ggaagugacuggugaaugu

SEQ ID NO: 597069 - RNA, 19 nt, Homo sapiens
gauaucaccugucuugaaa

SEQ ID NO: 597070 - RNA, 19 nt, Homo sapiens
ggacuccggucacugguua

SEQ ID NO: 597071 - RNA, 19 nt, Homo sapiens
gaaagaugcugggauuuau

SEQ ID NO: 597072 - RNA, 19 nt, Homo sapiens
gaaguuauccugaaagaug

SEQ ID NO: 597073 - RNA, 19 nt, Homo sapiens
gaaggagacucauauugug

SEQ ID NO: 597074 - RNA, 19 nt, Homo sapiens
gaggaggcauacaagauua

SEQ ID NO: 597075 - RNA, 19 nt, Homo sapiens
gaucgaaggucguuccuau

SEQ ID NO: 597076 - RNA, 19 nt, Homo sapiens
ggagaagacuugaaugaag

SEQ ID NO: 597077 - RNA, 19 nt, Homo sapiens
aaggagagcuuucggcaua

SEQ ID NO: 597078 - RNA, 19 nt, Homo sapiens
caauaaauguccaugcaaa

SEQ ID NO: 597079 - RNA, 19 nt, Homo sapiens
gcuccugaguuuaucauua

SEQ ID NO: 597080 - RNA, 19 nt, Homo sapiens
gcaucaagcuacuuaauag

SEQ ID NO: 597081 - RNA, 19 nt, Homo sapiens
gggagaauauuaugaacaa

SEQ ID NO: 597082 - RNA, 19 nt, Homo sapiens
gacugaagcuuguggauga

SEQ ID NO: 597083 - RNA, 19 nt, Homo sapiens
gcuguuagaugauuauuca

SEQ ID NO: 597084 - RNA, 19 nt, Homo sapiens
ugagaaagcuagacuaaag

SEQ ID NO: 597085 - RNA, 19 nt, Homo sapiens
gaaggaaucacaacaccua

SEQ ID NO: 597086 - RNA, 19 nt, Homo sapiens
ggaaucuucuugcuaguga

SEQ ID NO: 597087 - RNA, 19 nt, Homo sapiens
gcauccaacuguacucuuu

SEQ ID NO: 597088 - RNA, 19 nt, Homo sapiens
ucaccugucuugaaaguuu

SEQ ID NO: 597089 - RNA, 19 nt, Homo sapiens
gaauugaaacguuuacuug

SEQ ID NO: 597090 - RNA, 19 nt, Homo sapiens
gugauaagaugacuccaaa

SEQ ID NO: 597091 - RNA, 19 nt, Homo sapiens
gaaggucguuccuauaucu

SEQ ID NO: 597092 - RNA, 19 nt, Homo sapiens
ugucaucacuccugaaauu

SEQ ID NO: 597093 - RNA, 19 nt, Homo sapiens
gaggaagaauugaaacguu

SEQ ID NO: 597094 - RNA, 19 nt, Homo sapiens
gcagagacccguccaggaa

SEQ ID NO: 597095 - RNA, 19 nt, Homo sapiens
ucaaugaggcggcuauuaa

SEQ ID NO: 597096 - RNA, 19 nt, Homo sapiens
gaugaaggccucuauacaa

SEQ ID NO: 597097 - RNA, 19 nt, Homo sapiens
gaagaugaaggccucuaua

SEQ ID NO: 597098 - RNA, 19 nt, Homo sapiens
ggaguccuauucucggaua

SEQ ID NO: 597099 - RNA, 19 nt, Homo sapiens
gguuugagauccacuuuga

SEQ ID NO: 597100 - RNA, 19 nt, Homo sapiens
guggaggauuugaaaguua

SEQ ID NO: 597101 - RNA, 19 nt, Homo sapiens
gcgaaugcuucaaauguga

SEQ ID NO: 597102 - RNA, 19 nt, Homo sapiens
cagcuggacuuagugaaua

SEQ ID NO: 597103 - RNA, 19 nt, Homo sapiens
gaaggagaauguaaaauug

SEQ ID NO: 597104 - RNA, 19 nt, Homo sapiens
gaaaagaagucaaggaaag

SEQ ID NO: 597105 - RNA, 19 nt, Homo sapiens
gcaugaagauuaggaaaca

SEQ ID NO: 597106 - RNA, 19 nt, Homo sapiens
gauggaagcaaccagauaa

SEQ ID NO: 597107 - RNA, 19 nt, Homo sapiens
uuacagaggugaugugcuu

SEQ ID NO: 597108 - RNA, 19 nt, Homo sapiens
uaacagaguuuuccaagaa

SEQ ID NO: 597109 - RNA, 19 nt, Homo sapiens
ggaagaauugaaacguuua

SEQ ID NO: 597110 - RNA, 19 nt, Homo sapiens
gaaauuacuggcuauuaug

SEQ ID NO: 597111 - RNA, 19 nt, Homo sapiens
acacggagcucccugugaa

SEQ ID NO: 597112 - RNA, 19 nt, Homo sapiens
uagaagaaaccgagacaua

SEQ ID NO: 597113 - RNA, 19 nt, Homo sapiens
gaaguuggagggacauuga

SEQ ID NO: 597114 - RNA, 19 nt, Homo sapiens
agacucauauuguguggua

SEQ ID NO: 597115 - RNA, 19 nt, Homo sapiens
caacuaaccauucuacugu

SEQ ID NO: 597116 - RNA, 19 nt, Homo sapiens
gcaagugggagcccuguaa

SEQ ID NO: 597117 - RNA, 19 nt, Homo sapiens
uuaaggaacugaugaugga

SEQ ID NO: 597118 - RNA, 19 nt, Homo sapiens
uggcaaauauuaagaagga

SEQ ID NO: 597119 - RNA, 19 nt, Homo sapiens
gcaagguggcaaauauuaa

SEQ ID NO: 597120 - RNA, 19 nt, Homo sapiens
ucaaagaccuugggaugga

SEQ ID NO: 597121 - RNA, 19 nt, Homo sapiens
guagugaagucaggaaaga

SEQ ID NO: 597122 - RNA, 19 nt, Homo sapiens
gagauccggugguacagaa

SEQ ID NO: 597123 - RNA, 19 nt, Homo sapiens
caucacuccugaaauuaaa

SEQ ID NO: 597124 - RNA, 19 nt, Homo sapiens
gaagaaaccgagacauauc

SEQ ID NO: 597125 - RNA, 19 nt, Homo sapiens
agaaagaugcugggauuua

SEQ ID NO: 597126 - RNA, 19 nt, Homo sapiens
aacagacacugauggaaua

SEQ ID NO: 597127 - RNA, 19 nt, Homo sapiens
gcuauuaugugaacuaucg

SEQ ID NO: 597128 - RNA, 19 nt, Homo sapiens
caacuguacucuuuuguaa

SEQ ID NO: 597129 - RNA, 19 nt, Homo sapiens
gaacugaugauggaaguau

SEQ ID NO: 597130 - RNA, 19 nt, Homo sapiens
ccagaaagaagcugaauuc

SEQ ID NO: 597131 - RNA, 19 nt, Homo sapiens
cuuaauagaugaggaagaa

SEQ ID NO: 597132 - RNA, 19 nt, Homo sapiens
ugaggacucuccacgauug

SEQ ID NO: 597133 - RNA, 19 nt, Homo sapiens
gagaaacugucuggcaaug

SEQ ID NO: 597134 - RNA, 19 nt, Homo sapiens
aaucagaguuggcaguuga

SEQ ID NO: 597135 - RNA, 19 nt, Homo sapiens
caaugcagcuggacuuagu

SEQ ID NO: 597136 - RNA, 19 nt, Homo sapiens
ccagucugcuguuagauga

SEQ ID NO: 597137 - RNA, 19 nt, Homo sapiens
caagcuacuuaauagauga

SEQ ID NO: 597138 - RNA, 19 nt, Homo sapiens
ccucggcgaugaauguuaa

SEQ ID NO: 597139 - RNA, 19 nt, Homo sapiens
ggagauaucaguggaugaa

SEQ ID NO: 597140 - RNA, 19 nt, Homo sapiens
gaaaggccagguccgguuu

SEQ ID NO: 597141 - RNA, 19 nt, Homo sapiens
gaaagcaagggcaacaaga

SEQ ID NO: 597142 - RNA, 19 nt, Homo sapiens
gauaagaugacuccaaagu

SEQ ID NO: 597143 - RNA, 19 nt, Homo sapiens
gaacuucgagugugauaag

SEQ ID NO: 597144 - RNA, 19 nt, Homo sapiens
gcugagaaagcuagacuaa

SEQ ID NO: 597145 - RNA, 19 nt, Homo sapiens
gaugggagaauauuaugaa

SEQ ID NO: 597146 - RNA, 19 nt, Homo sapiens
gaugacaaauuugaugugu

SEQ ID NO: 597147 - RNA, 19 nt, Homo sapiens
ggccgugucucguguguug

SEQ ID NO: 597148 - RNA, 19 nt, Homo sapiens
gcugggauuuaugaaguua

SEQ ID NO: 597149 - RNA, 19 nt, Homo sapiens
guacccugcuuauaacaga

SEQ ID NO: 597150 - RNA, 19 nt, Homo sapiens
uaacagacacugauggaau

SEQ ID NO: 597151 - RNA, 19 nt, Homo sapiens
gagagaagccaaugucaag

SEQ ID NO: 597152 - RNA, 19 nt, Homo sapiens
cguguccgcuguucuaauu

SEQ ID NO: 597153 - RNA, 19 nt, Homo sapiens
ccuggaaaguauauuauug

SEQ ID NO: 597154 - RNA, 19 nt, Homo sapiens
gaaaauaccauucauagca

SEQ ID NO: 597155 - RNA, 19 nt, Homo sapiens
uauuuacucuugcgaugua

SEQ ID NO: 597156 - RNA, 19 nt, Homo sapiens
gaaggagaaggccaaagaa

SEQ ID NO: 597157 - RNA, 19 nt, Homo sapiens
ggauggaagcaaccagaua

SEQ ID NO: 597158 - RNA, 19 nt, Homo sapiens
agucaaagcugcuauugca

SEQ ID NO: 597159 - RNA, 19 nt, Homo sapiens
aggaagaauugaaacguuu

SEQ ID NO: 597160 - RNA, 19 nt, Homo sapiens
gauuggaagucgaaagcaa

SEQ ID NO: 597161 - RNA, 19 nt, Homo sapiens
aagauuauguauccacuga

SEQ ID NO: 597162 - RNA, 19 nt, Homo sapiens
gcaaagaccuuacgagaau

SEQ ID NO: 597163 - RNA, 19 nt, Homo sapiens
ggagcaaacugaauaauga

SEQ ID NO: 597164 - RNA, 19 nt, Homo sapiens
gaaagaguauucaaacgaa

SEQ ID NO: 597165 - RNA, 19 nt, Homo sapiens
gaaauuaucagucucauga

SEQ ID NO: 597166 - RNA, 19 nt, Homo sapiens
gaauguggcuuacaacaga

SEQ ID NO: 597167 - RNA, 19 nt, Homo sapiens
ccacuagucugacggauaa

SEQ ID NO: 597168 - RNA, 19 nt, Homo sapiens
gaagccaacuaccaucuuu

SEQ ID NO: 597169 - RNA, 19 nt, Homo sapiens
gauaauaccacuagucuga

SEQ ID NO: 597170 - RNA, 19 nt, Homo sapiens
gagcagcaguugauaaugu

SEQ ID NO: 597171 - RNA, 19 nt, Homo sapiens
caaauaaggagccauauga

SEQ ID NO: 597172 - RNA, 19 nt, Homo sapiens
guacuccgcuuucuguaaa

SEQ ID NO: 597173 - RNA, 19 nt, Homo sapiens
ggaaagaaaucugcagcaa

SEQ ID NO: 597174 - RNA, 19 nt, Homo sapiens
caagagaaauuaucagucu

SEQ ID NO: 597175 - RNA, 19 nt, Homo sapiens
gcacaaauacgaacuucaa

SEQ ID NO: 597176 - RNA, 19 nt, Homo sapiens
aaagaaaucugcagcaaag

SEQ ID NO: 597177 - RNA, 19 nt, Homo sapiens
gaaagaaaucugcagcaaa

SEQ ID NO: 597178 - RNA, 19 nt, Homo sapiens
gaaggaaugugcuacuuac

SEQ ID NO: 597179 - RNA, 19 nt, Homo sapiens
ucacauggcuuuggaacaa

SEQ ID NO: 597180 - RNA, 19 nt, Homo sapiens
guaccaagcuaucuuugau

SEQ ID NO: 597181 - RNA, 19 nt, Homo sapiens
gacagaauguggcuuacaa

SEQ ID NO: 597182 - RNA, 19 nt, Homo sapiens
ccaaagugcugggauauca

SEQ ID NO: 597183 - RNA, 19 nt, Homo sapiens
gaagaggacgugaagaguu

SEQ ID NO: 597184 - RNA, 19 nt, Homo sapiens
ugaaugacgucaacgcaaa

SEQ ID NO: 597185 - RNA, 19 nt, Homo sapiens
cuucauagcuggagaaugg

SEQ ID NO: 597186 - RNA, 19 nt, Homo sapiens
ggagagaagagaugucuga

SEQ ID NO: 597187 - RNA, 19 nt, Homo sapiens
gaaggugucucuguguuuc

SEQ ID NO: 597188 - RNA, 19 nt, Homo sapiens
caaauacgaacuucaaaga

SEQ ID NO: 597189 - RNA, 19 nt, Homo sapiens
gaccaacuaucuaggaaau

SEQ ID NO: 597190 - RNA, 19 nt, Homo sapiens
ggaaggucauguucuuuca

SEQ ID NO: 597191 - RNA, 19 nt, Homo sapiens
gugaagaguuuaaagaaag

SEQ ID NO: 597192 - RNA, 19 nt, Homo sapiens
aagaggacgugaagaguuu

SEQ ID NO: 597193 - RNA, 19 nt, Homo sapiens
ggccuugccuccuuuaaga

SEQ ID NO: 597194 - RNA, 19 nt, Homo sapiens
ugagcgagauggacugaaa

SEQ ID NO: 597195 - RNA, 19 nt, Homo sapiens
cuacuagacagcacaaaua

SEQ ID NO: 597196 - RNA, 19 nt, Homo sapiens
gaacaggccagauguggau

SEQ ID NO: 597197 - RNA, 19 nt, Homo sapiens
ucacguaggcuccuguuaa

SEQ ID NO: 597198 - RNA, 19 nt, Homo sapiens
cgagauggacugaaagaaa

SEQ ID NO: 597199 - RNA, 19 nt, Homo sapiens
gaugaaauccagugacuuc

SEQ ID NO: 597200 - RNA, 19 nt, Homo sapiens
gagaccaacuaucuaggaa

SEQ ID NO: 597201 - RNA, 19 nt, Homo sapiens
ccagacauguccuugaaug

SEQ ID NO: 597202 - RNA, 19 nt, Homo sapiens
gucauguucuuucagcuua

SEQ ID NO: 597203 - RNA, 19 nt, Homo sapiens
ugaggaaggucauguucuu

SEQ ID NO: 597204 - RNA, 19 nt, Homo sapiens
gaaaguuggcugccucaga

SEQ ID NO: 597205 - RNA, 19 nt, Homo sapiens
gagauggacugaaagaaaa

SEQ ID NO: 597206 - RNA, 19 nt, Homo sapiens
ccagacagaauguggcuua

SEQ ID NO: 597207 - RNA, 19 nt, Homo sapiens
cacguaggcuccuguuaaa

SEQ ID NO: 597208 - RNA, 19 nt, Homo sapiens
agaauucuguccucacuga

SEQ ID NO: 597209 - RNA, 19 nt, Homo sapiens
gagcccagccugcagagua

SEQ ID NO: 597210 - RNA, 19 nt, Homo sapiens
cgugaagaguuuaaagaaa

SEQ ID NO: 597211 - RNA, 19 nt, Homo sapiens
gcaaauaaggagccauaug

SEQ ID NO: 597212 - RNA, 19 nt, Homo sapiens
gaaaaggcgugauacacaa

SEQ ID NO: 597213 - RNA, 19 nt, Homo sapiens
ggaaggugucucuguguuu

SEQ ID NO: 597214 - RNA, 19 nt, Homo sapiens
gacauuuccuggcauugaa

SEQ ID NO: 597215 - RNA, 19 nt, Homo sapiens
ugaaggaaugugcuacuua

SEQ ID NO: 597216 - RNA, 19 nt, Homo sapiens
guaguacucugggcgauau

SEQ ID NO: 597217 - RNA, 19 nt, Homo sapiens
ucuaagcccuguucagaga

SEQ ID NO: 597218 - RNA, 19 nt, Homo sapiens
gaaagggagagaagagaug

SEQ ID NO: 597219 - RNA, 19 nt, Homo sapiens
gggaaggugucucuguguu

SEQ ID NO: 597220 - RNA, 19 nt, Homo sapiens
aagaagagccagcugcuaa

SEQ ID NO: 597221 - RNA, 19 nt, Homo sapiens
guacuggcauucagauugg

SEQ ID NO: 597222 - RNA, 19 nt, Homo sapiens
gagaugaguacuccgcuuu

SEQ ID NO: 597223 - RNA, 19 nt, Homo sapiens
aaauugaccaugacuauga

SEQ ID NO: 597224 - RNA, 19 nt, Homo sapiens
agaagaaaguguagaagag

SEQ ID NO: 597225 - RNA, 19 nt, Homo sapiens
ccacagagaagucggaugu

SEQ ID NO: 597226 - RNA, 19 nt, Homo sapiens
acaaugagcugagggaagu

SEQ ID NO: 597227 - RNA, 19 nt, Homo sapiens
ucacacagucucagauuga

SEQ ID NO: 597228 - RNA, 19 nt, Homo sapiens
guacugcccaagagaaauu

SEQ ID NO: 597229 - RNA, 19 nt, Homo sapiens
gcaaacugaauaaugaaga

SEQ ID NO: 597230 - RNA, 19 nt, Homo sapiens
ugaaauugaccaugacuau

SEQ ID NO: 597231 - RNA, 19 nt, Homo sapiens
uugaugaaauugaccauga

SEQ ID NO: 597232 - RNA, 19 nt, Homo sapiens
ugccuagucugcauaauau

SEQ ID NO: 597233 - RNA, 19 nt, Homo sapiens
caagucauaugccuagucu

SEQ ID NO: 597234 - RNA, 19 nt, Homo sapiens
cagccaaccucaaguacug

SEQ ID NO: 597235 - RNA, 19 nt, Homo sapiens
ucagagacuucgcggauca

SEQ ID NO: 597236 - RNA, 19 nt, Homo sapiens
gaaauugaccaugacuaug

SEQ ID NO: 597237 - RNA, 19 nt, Homo sapiens
gaaguacucccuggugaug

SEQ ID NO: 597238 - RNA, 19 nt, Homo sapiens
cuucugagcagcuugauuu

SEQ ID NO: 597239 - RNA, 19 nt, Homo sapiens
ccaacuaucuaggaaauac

SEQ ID NO: 597240 - RNA, 19 nt, Homo sapiens
ggagaagggcaaccugaug

SEQ ID NO: 597241 - RNA, 19 nt, Homo sapiens
auaaacaccuggacccaau

SEQ ID NO: 597242 - RNA, 19 nt, Homo sapiens
gaacagcaggucccagagu

SEQ ID NO: 597243 - RNA, 19 nt, Homo sapiens
caaguacuguaucagaaca

SEQ ID NO: 597244 - RNA, 19 nt, Homo sapiens
gaagcucggccgacauuuc

SEQ ID NO: 597245 - RNA, 19 nt, Homo sapiens
gcuccugggcgucaucaua

SEQ ID NO: 597246 - RNA, 19 nt, Homo sapiens
ggacggcaccgcuaagaag

SEQ ID NO: 597247 - RNA, 19 nt, Homo sapiens
aaccagacauguccuugaa

SEQ ID NO: 597248 - RNA, 19 nt, Homo sapiens
uaaguaccaagcuaucuuu

SEQ ID NO: 597249 - RNA, 19 nt, Homo sapiens
caaagaccuuacgagaauu

SEQ ID NO: 597250 - RNA, 19 nt, Homo sapiens
caaacugaauaaugaagag

SEQ ID NO: 597251 - RNA, 19 nt, Homo sapiens
gaaagcguaagcaggaaga

SEQ ID NO: 597252 - RNA, 19 nt, Homo sapiens
cgaaacagcagcccagaca

SEQ ID NO: 597253 - RNA, 19 nt, Homo sapiens
acgcaaagcccacagagaa

SEQ ID NO: 597254 - RNA, 19 nt, Homo sapiens
gagcaaacugaauaaugaa

SEQ ID NO: 597255 - RNA, 19 nt, Homo sapiens
ggaaagggagagaagagau

SEQ ID NO: 597256 - RNA, 19 nt, Homo sapiens
gaacaauggauuauauagc

SEQ ID NO: 597257 - RNA, 19 nt, Homo sapiens
gacgcagggucucccauga

SEQ ID NO: 597258 - RNA, 19 nt, Homo sapiens
cagagaagucggaugugua

SEQ ID NO: 597259 - RNA, 19 nt, Homo sapiens
gcaccugaaugacgucaac

SEQ ID NO: 597260 - RNA, 19 nt, Homo sapiens
ccaacugcauugagcacaa

SEQ ID NO: 597261 - RNA, 19 nt, Homo sapiens
gggacgaguucaucacuac

SEQ ID NO: 597262 - RNA, 19 nt, Homo sapiens
gaaggaaucuugacggaaa

SEQ ID NO: 597263 - RNA, 19 nt, Homo sapiens
ggacugaacuguggacuuu

SEQ ID NO: 597264 - RNA, 19 nt, Homo sapiens
gcaggugucucauauguaa

SEQ ID NO: 597265 - RNA, 19 nt, Homo sapiens
uaacaaagauggugcuuau

SEQ ID NO: 597266 - RNA, 19 nt, Homo sapiens
cagcagaucucccauguug

SEQ ID NO: 597267 - RNA, 19 nt, Homo sapiens
gaagauugcauuguuguaa

SEQ ID NO: 597268 - RNA, 19 nt, Homo sapiens
ggagcugggugcagaggua

SEQ ID NO: 597269 - RNA, 19 nt, Homo sapiens
caucagaccggcagauuaa

SEQ ID NO: 597270 - RNA, 19 nt, Homo sapiens
gcuugaagauugcauuguu

SEQ ID NO: 597271 - RNA, 19 nt, Homo sapiens
ggccagagacaaacaagua

SEQ ID NO: 597272 - RNA, 19 nt, Homo sapiens
gaacuguggacuuuacuau

SEQ ID NO: 597273 - RNA, 19 nt, Homo sapiens
cacuagacauuacuugaaa

SEQ ID NO: 597274 - RNA, 19 nt, Homo sapiens
acaggcaggugucucauau

SEQ ID NO: 597275 - RNA, 19 nt, Homo sapiens
acaaugcuccugcuggaua

SEQ ID NO: 597276 - RNA, 19 nt, Homo sapiens
ccacuagacauuacuugaa

SEQ ID NO: 597277 - RNA, 19 nt, Homo sapiens
uagauucccuacaggaguu

SEQ ID NO: 597278 - RNA, 19 nt, Homo sapiens
uuaccugaauguugucuga

SEQ ID NO: 597279 - RNA, 19 nt, Homo sapiens
ucacagugguucaaaauau

SEQ ID NO: 597280 - RNA, 19 nt, Homo sapiens
ugaaaggccagauuacuca

SEQ ID NO: 597281 - RNA, 19 nt, Homo sapiens
ccaucagaccggcagauua

SEQ ID NO: 597282 - RNA, 19 nt, Homo sapiens
gaaauggaggccagagaca

SEQ ID NO: 597283 - RNA, 19 nt, Homo sapiens
acuguggacuuuacuauuc

SEQ ID NO: 597284 - RNA, 19 nt, Homo sapiens
acggauaucuaccgcugua

SEQ ID NO: 597285 - RNA, 19 nt, Homo sapiens
gcagguucccuaacaguca

SEQ ID NO: 597286 - RNA, 19 nt, Homo sapiens
caaugcuccugcuggauau

SEQ ID NO: 597287 - RNA, 19 nt, Homo sapiens
aggcaggugucucauaugu

SEQ ID NO: 597288 - RNA, 19 nt, Homo sapiens
guaaaucacagugguucaa

SEQ ID NO: 597289 - RNA, 19 nt, Homo sapiens
gagaaauggaggccagaga

SEQ ID NO: 597290 - RNA, 19 nt, Homo sapiens
ggcccuaaagcauuugaua

SEQ ID NO: 597291 - RNA, 19 nt, Homo sapiens
gccugcaggugacagauug

SEQ ID NO: 597292 - RNA, 19 nt, Homo sapiens
acaaagauggugcuuaugg

SEQ ID NO: 597293 - RNA, 19 nt, Homo sapiens
ccagauuacucagcagauc

SEQ ID NO: 597294 - RNA, 19 nt, Homo sapiens
gaagaaggcaagggaagag

SEQ ID NO: 597295 - RNA, 19 nt, Homo sapiens
aauguugucugaggacuga

SEQ ID NO: 597296 - RNA, 19 nt, Homo sapiens
uaaaucacagugguucaaa

SEQ ID NO: 597297 - RNA, 19 nt, Homo sapiens
gcauuguuguaauuguuca

SEQ ID NO: 597298 - RNA, 19 nt, Homo sapiens
cacagugguucaaaauaua

SEQ ID NO: 597299 - RNA, 19 nt, Homo sapiens
cuugaagauugcauuguug

SEQ ID NO: 597300 - RNA, 19 nt, Homo sapiens
uggagggacugguucuuca

SEQ ID NO: 597301 - RNA, 19 nt, Homo sapiens
ccuaaagcauuugauacau

SEQ ID NO: 597302 - RNA, 19 nt, Homo sapiens
ggguuuccacuagacauua

SEQ ID NO: 597303 - RNA, 19 nt, Homo sapiens
ggauuccgguugcaguuuu

SEQ ID NO: 597304 - RNA, 19 nt, Homo sapiens
gguugcagacggagaaaug

SEQ ID NO: 597305 - RNA, 19 nt, Homo sapiens
ugaagauugcauuguugua

SEQ ID NO: 597306 - RNA, 19 nt, Homo sapiens
ugggcugaauccugacuuu

SEQ ID NO: 597307 - RNA, 19 nt, Homo sapiens
ccaaagauacgugguugca

SEQ ID NO: 597308 - RNA, 19 nt, Homo sapiens
ugaagaaggcaagggaaga

SEQ ID NO: 597309 - RNA, 19 nt, Homo sapiens
ggagugugucccugaguca

SEQ ID NO: 597310 - RNA, 19 nt, Homo sapiens
ggauaucuaccgcuguaag

SEQ ID NO: 597311 - RNA, 19 nt, Homo sapiens
uacuugaaaggccagauua

SEQ ID NO: 597312 - RNA, 19 nt, Homo sapiens
ugagucaugugggcugaau

SEQ ID NO: 597313 - RNA, 19 nt, Homo sapiens
aauggaggccagagacaaa

SEQ ID NO: 597314 - RNA, 19 nt, Homo sapiens
cuaccaggaaggaaucuug

SEQ ID NO: 597315 - RNA, 19 nt, Homo sapiens
ggcaggugucucauaugua

SEQ ID NO: 597316 - RNA, 19 nt, Homo sapiens
uuacuugaaaggccagauu

SEQ ID NO: 597317 - RNA, 19 nt, Homo sapiens
gcaagggaagaggccauga

SEQ ID NO: 597318 - RNA, 19 nt, Homo sapiens
ggaggccagagacaaacaa

SEQ ID NO: 597319 - RNA, 19 nt, Homo sapiens
uuaauugcuugaagauugc

SEQ ID NO: 597320 - RNA, 19 nt, Homo sapiens
gaauccugacuuucacuca

SEQ ID NO: 597321 - RNA, 19 nt, Homo sapiens
gauaucuaccgcuguaagg

SEQ ID NO: 597322 - RNA, 19 nt, Homo sapiens
cucagcagaucucccaugu

SEQ ID NO: 597323 - RNA, 19 nt, Homo sapiens
uugauacauuccuagauuc

SEQ ID NO: 597324 - RNA, 19 nt, Homo sapiens
agaaggaaguggagaguaa

SEQ ID NO: 597325 - RNA, 19 nt, Homo sapiens
ccaaugcuauuuacauaca

SEQ ID NO: 597326 - RNA, 19 nt, Homo sapiens
gggaagcccuuuggaaauc

SEQ ID NO: 597327 - RNA, 19 nt, Homo sapiens
ggaaauccagcugcagaaa

SEQ ID NO: 597328 - RNA, 19 nt, Homo sapiens
aaauccagcugcagaaaca

SEQ ID NO: 597329 - RNA, 19 nt, Homo sapiens
gaucguagaaacacagaau

SEQ ID NO: 597330 - RNA, 19 nt, Homo sapiens
gaaggaaguggagaguaaa

SEQ ID NO: 597331 - RNA, 19 nt, Homo sapiens
gaaagcugguucccguuuu

SEQ ID NO: 597332 - RNA, 19 nt, Homo sapiens
gagaaggaaguggagagua

SEQ ID NO: 597333 - RNA, 19 nt, Homo sapiens
gaaguggagaguaaagaca

SEQ ID NO: 597334 - RNA, 19 nt, Homo sapiens
cuauuuacauacagcucua

SEQ ID NO: 597335 - RNA, 19 nt, Homo sapiens
gaaauccagcugcagaaac

SEQ ID NO: 597336 - RNA, 19 nt, Homo sapiens
gcgguuggcacuucgagaa

SEQ ID NO: 597337 - RNA, 19 nt, Homo sapiens
gagcgaucguagaaacaca

SEQ ID NO: 597338 - RNA, 19 nt, Homo sapiens
agaaagcugguucccguuu

SEQ ID NO: 597339 - RNA, 19 nt, Homo sapiens
gcaggcggaacuuguagga

SEQ ID NO: 597340 - RNA, 19 nt, Homo sapiens
ccccaaugcuauuuacaua

SEQ ID NO: 597341 - RNA, 19 nt, Homo sapiens
ggaaguggagaguaaagac

SEQ ID NO: 597342 - RNA, 19 nt, Homo sapiens
gaaggagcguggugcauug

SEQ ID NO: 597343 - RNA, 19 nt, Homo sapiens
gggagcagcugauacaaga

SEQ ID NO: 597344 - RNA, 19 nt, Homo sapiens
caauuucgguuuccucuga

SEQ ID NO: 597345 - RNA, 19 nt, Homo sapiens
caccaaagcuggcuacuac

SEQ ID NO: 597346 - RNA, 19 nt, Homo sapiens
gcacagcccaggaguguug

SEQ ID NO: 597347 - RNA, 19 nt, Homo sapiens
gaaugaagcauccaagaag

SEQ ID NO: 597348 - RNA, 19 nt, Homo sapiens
ggaaggagcguggugcauu

SEQ ID NO: 597349 - RNA, 19 nt, Homo sapiens
ccaggaguguugagcaauu

SEQ ID NO: 597350 - RNA, 19 nt, Homo sapiens
guacggcccucaguguuug

SEQ ID NO: 597351 - RNA, 19 nt, Homo sapiens
agaaaguccucagucgaua

SEQ ID NO: 597352 - RNA, 19 nt, Homo sapiens
ucacaccacugcacuccaa

SEQ ID NO: 597353 - RNA, 19 nt, Homo sapiens
ccaaagcuggcuacuacua

SEQ ID NO: 597354 - RNA, 19 nt, Homo sapiens
gcacuugccaccugaguca

SEQ ID NO: 597355 - RNA, 19 nt, Homo sapiens
cgaaugaagcauccaagaa

SEQ ID NO: 597356 - RNA, 19 nt, Homo sapiens
gaaaguccucagucgauau

SEQ ID NO: 597357 - RNA, 19 nt, Homo sapiens
cagcugcacuggcgucuag

SEQ ID NO: 597358 - RNA, 19 nt, Homo sapiens
gaaggacccaggcguguca

SEQ ID NO: 597359 - RNA, 19 nt, Homo sapiens
caggaguguugagcaauuu

SEQ ID NO: 597360 - RNA, 19 nt, Homo sapiens
aaagaaaacucacgaagca

SEQ ID NO: 597361 - RNA, 19 nt, Homo sapiens
gguggugccugccuguaau

SEQ ID NO: 597362 - RNA, 19 nt, Homo sapiens
gcccaggaguguugagcaa

SEQ ID NO: 597363 - RNA, 19 nt, Homo sapiens
gaaggucucacgaggucaa

SEQ ID NO: 597364 - RNA, 19 nt, Homo sapiens
guugagcaauuucgguuuc

SEQ ID NO: 597365 - RNA, 19 nt, Homo sapiens
gcaggauaauuuugcuuaa

SEQ ID NO: 597366 - RNA, 19 nt, Homo sapiens
ggacccuucuugcuguugu

SEQ ID NO: 597367 - RNA, 19 nt, Homo sapiens
cagaaaguccucagucgau

SEQ ID NO: 597368 - RNA, 19 nt, Homo sapiens
ggcugaggcaggauaauuu

SEQ ID NO: 597369 - RNA, 19 nt, Homo sapiens
gcgaaugaagcauccaaga

SEQ ID NO: 597370 - RNA, 19 nt, Homo sapiens
ugguggcucucgccuguaa

SEQ ID NO: 597371 - RNA, 19 nt, Homo sapiens
gaugguacccggucuuacu

SEQ ID NO: 597372 - RNA, 19 nt, Homo sapiens
ggaggcugaggcaggauaa

SEQ ID NO: 597373 - RNA, 19 nt, Homo sapiens
ccuguaaucccagcacuuu

SEQ ID NO: 597374 - RNA, 19 nt, Homo sapiens
cuuccugggugguguggua

SEQ ID NO: 597375 - RNA, 19 nt, Homo sapiens
aaagcuggcuacuacuaca

SEQ ID NO: 597376 - RNA, 19 nt, Homo sapiens
gugaugguacccggucuua

SEQ ID NO: 597377 - RNA, 19 nt, Homo sapiens
caaaaccccaucucuacua

SEQ ID NO: 597378 - RNA, 19 nt, Homo sapiens
aaaguccucagucgauauu

SEQ ID NO: 597379 - RNA, 19 nt, Homo sapiens
gcauuggacaugggucuga

SEQ ID NO: 597380 - RNA, 19 nt, Homo sapiens
aaacccacaacguauuauu

SEQ ID NO: 597381 - RNA, 19 nt, Homo sapiens
cguacggcccucaguguuu

SEQ ID NO: 597382 - RNA, 19 nt, Homo sapiens
ucaccaaagcuggcuacua

SEQ ID NO: 597383 - RNA, 19 nt, Homo sapiens
acuacuacaucuacuccaa

SEQ ID NO: 597384 - RNA, 19 nt, Homo sapiens
gugcacagcccaggagugu

SEQ ID NO: 597385 - RNA, 19 nt, Homo sapiens
aguccucagucgauauuug

SEQ ID NO: 597386 - RNA, 19 nt, Homo sapiens
caaagcuggcuacuacuac

SEQ ID NO: 597387 - RNA, 19 nt, Homo sapiens
aacccacaacguauuauuu

SEQ ID NO: 597388 - RNA, 19 nt, Homo sapiens
ccuguaauccagcuacuca

SEQ ID NO: 597389 - RNA, 19 nt, Homo sapiens
aaaaccccaucucuacuaa

SEQ ID NO: 597390 - RNA, 19 nt, Homo sapiens
gagccuggcaugggcagaa

SEQ ID NO: 597391 - RNA, 19 nt, Homo sapiens
ggucguccgugugcuggau

SEQ ID NO: 597392 - RNA, 19 nt, Homo sapiens
gacagaccgacaucccauu

SEQ ID NO: 597393 - RNA, 19 nt, Homo sapiens
gaaggagcguggugcauug

SEQ ID NO: 597394 - RNA, 19 nt, Homo sapiens
gggagcagcugauacaaga

SEQ ID NO: 597395 - RNA, 19 nt, Homo sapiens
caauuucgguuuccucuga

SEQ ID NO: 597396 - RNA, 19 nt, Homo sapiens
caccaaagcuggcuacuac

SEQ ID NO: 597397 - RNA, 19 nt, Homo sapiens
gcacagcccaggaguguug

SEQ ID NO: 597398 - RNA, 19 nt, Homo sapiens
gaaugaagcauccaagaag

SEQ ID NO: 597399 - RNA, 19 nt, Homo sapiens
ggaaggagcguggugcauu

SEQ ID NO: 597400 - RNA, 19 nt, Homo sapiens
ccaggaguguugagcaauu

SEQ ID NO: 597401 - RNA, 19 nt, Homo sapiens
guacggcccucaguguuug

SEQ ID NO: 597402 - RNA, 19 nt, Homo sapiens
agaaaguccucagucgaua

SEQ ID NO: 597403 - RNA, 19 nt, Homo sapiens
ucacaccacugcacuccaa

SEQ ID NO: 597404 - RNA, 19 nt, Homo sapiens
ccaaagcuggcuacuacua

SEQ ID NO: 597405 - RNA, 19 nt, Homo sapiens
gcacuugccaccugaguca

SEQ ID NO: 597406 - RNA, 19 nt, Homo sapiens
cgaaugaagcauccaagaa

SEQ ID NO: 597407 - RNA, 19 nt, Homo sapiens
gaaaguccucagucgauau

SEQ ID NO: 597408 - RNA, 19 nt, Homo sapiens
gaaggacccaggcguguca

SEQ ID NO: 597409 - RNA, 19 nt, Homo sapiens
caggaguguugagcaauuu

SEQ ID NO: 597410 - RNA, 19 nt, Homo sapiens
aaagaaaacucacgaagca

SEQ ID NO: 597411 - RNA, 19 nt, Homo sapiens
gguggugccugccuguaau

SEQ ID NO: 597412 - RNA, 19 nt, Homo sapiens
gcccaggaguguugagcaa

SEQ ID NO: 597413 - RNA, 19 nt, Homo sapiens
gaaggucucacgaggucaa

SEQ ID NO: 597414 - RNA, 19 nt, Homo sapiens
guugagcaauuucgguuuc

SEQ ID NO: 597415 - RNA, 19 nt, Homo sapiens
gcaggauaauuuugcuuaa

SEQ ID NO: 597416 - RNA, 19 nt, Homo sapiens
ggacccuucuugcuguugu

SEQ ID NO: 597417 - RNA, 19 nt, Homo sapiens
ggcugaggcaggauaauuu

SEQ ID NO: 597418 - RNA, 19 nt, Homo sapiens
cagaaaguccucagucgau

SEQ ID NO: 597419 - RNA, 19 nt, Homo sapiens
gcgaaugaagcauccaaga

SEQ ID NO: 597420 - RNA, 19 nt, Homo sapiens
ugguggcucucgccuguaa

SEQ ID NO: 597421 - RNA, 19 nt, Homo sapiens
gaugguacccggucuuacu

SEQ ID NO: 597422 - RNA, 19 nt, Homo sapiens
ggaggcugaggcaggauaa

SEQ ID NO: 597423 - RNA, 19 nt, Homo sapiens
ccuguaaucccagcacuuu

SEQ ID NO: 597424 - RNA, 19 nt, Homo sapiens
cuuccugggugguguggua

SEQ ID NO: 597425 - RNA, 19 nt, Homo sapiens
aaagcuggcuacuacuaca

SEQ ID NO: 597426 - RNA, 19 nt, Homo sapiens
gugaugguacccggucuua

SEQ ID NO: 597427 - RNA, 19 nt, Homo sapiens
ggagacagucgugcagugu

SEQ ID NO: 597428 - RNA, 19 nt, Homo sapiens
caaaaccccaucucuacua

SEQ ID NO: 597429 - RNA, 19 nt, Homo sapiens
gcauuggacaugggucuga

SEQ ID NO: 597430 - RNA, 19 nt, Homo sapiens
aaacccacaacguauuauu

SEQ ID NO: 597431 - RNA, 19 nt, Homo sapiens
cguacggcccucaguguuu

SEQ ID NO: 597432 - RNA, 19 nt, Homo sapiens
aaaguccucagucgauauu

SEQ ID NO: 597433 - RNA, 19 nt, Homo sapiens
ucaccaaagcuggcuacua

SEQ ID NO: 597434 - RNA, 19 nt, Homo sapiens
acuacuacaucuacuccaa

SEQ ID NO: 597435 - RNA, 19 nt, Homo sapiens
gugcacagcccaggagugu

SEQ ID NO: 597436 - RNA, 19 nt, Homo sapiens
aguccucagucgauauuug

SEQ ID NO: 597437 - RNA, 19 nt, Homo sapiens
caaagcuggcuacuacuac

SEQ ID NO: 597438 - RNA, 19 nt, Homo sapiens
aacccacaacguauuauuu

SEQ ID NO: 597439 - RNA, 19 nt, Homo sapiens
ccuguaauccagcuacuca

SEQ ID NO: 597440 - RNA, 19 nt, Homo sapiens
aaaaccccaucucuacuaa

SEQ ID NO: 597441 - RNA, 19 nt, Homo sapiens
gagccuggcaugggcagaa

SEQ ID NO: 597442 - RNA, 19 nt, Homo sapiens
ggucguccgugugcuggau

SEQ ID NO: 597443 - RNA, 19 nt, Homo sapiens
gacagaccgacaucccauu

SEQ ID NO: 597444 - RNA, 19 nt, Homo sapiens
gccaagagcugaguauaua

SEQ ID NO: 597445 - RNA, 19 nt, Homo sapiens
gaguuuaucugcuguauag

SEQ ID NO: 597446 - RNA, 19 nt, Homo sapiens
gcgcaggugucuuccauuu

SEQ ID NO: 597447 - RNA, 19 nt, Homo sapiens
ccagagauguagcuauuau

SEQ ID NO: 597448 - RNA, 19 nt, Homo sapiens
gagacucuauuccgaugua

SEQ ID NO: 597449 - RNA, 19 nt, Homo sapiens
gaacagcaccaccaucuag

SEQ ID NO: 597450 - RNA, 19 nt, Homo sapiens
gcaggugucuuccauuuac

SEQ ID NO: 597451 - RNA, 19 nt, Homo sapiens
uagagggacuggaaccuaa

SEQ ID NO: 597452 - RNA, 19 nt, Homo sapiens
ccucugagcucuucuuucu

SEQ ID NO: 597453 - RNA, 19 nt, Homo sapiens
gggcaagggcgaaacuuaa

SEQ ID NO: 597454 - RNA, 19 nt, Homo sapiens
ucugagcucuucuuucuga

SEQ ID NO: 597455 - RNA, 19 nt, Homo sapiens
gccaggagcacuaacagua

SEQ ID NO: 597456 - RNA, 19 nt, Homo sapiens
gagcucuucuuucugauca

SEQ ID NO: 597457 - RNA, 19 nt, Homo sapiens
gagggaaugugcaggaaca

SEQ ID NO: 597458 - RNA, 19 nt, Homo sapiens
caagagcugaguauauaaa

SEQ ID NO: 597459 - RNA, 19 nt, Homo sapiens
gaaggcaggagacucuauu

SEQ ID NO: 597460 - RNA, 19 nt, Homo sapiens
gagcugaguauauaaagga

SEQ ID NO: 597461 - RNA, 19 nt, Homo sapiens
gugaaacugugauuguguu

SEQ ID NO: 597462 - RNA, 19 nt, Homo sapiens
ugccuucgcagucaaauua

SEQ ID NO: 597463 - RNA, 19 nt, Homo sapiens
cuccagagauguagcuauu

SEQ ID NO: 597464 - RNA, 19 nt, Homo sapiens
acggauaucuugcuucugu

SEQ ID NO: 597465 - RNA, 19 nt, Homo sapiens
gagagggaaugugcaggaa

SEQ ID NO: 597466 - RNA, 19 nt, Homo sapiens
cacaagaagccuuauccua

SEQ ID NO: 597467 - RNA, 19 nt, Homo sapiens
agaccaggguggguacaua

SEQ ID NO: 597468 - RNA, 19 nt, Homo sapiens
gauauucugagugucauaa

SEQ ID NO: 597469 - RNA, 19 nt, Homo sapiens
cuauuccgauguauaagaa

SEQ ID NO: 597470 - RNA, 19 nt, Homo sapiens
agaagaagcagcacucugu

SEQ ID NO: 597471 - RNA, 19 nt, Homo sapiens
gcaccugguucccauuaac

SEQ ID NO: 597472 - RNA, 19 nt, Homo sapiens
ggaguuuaucugcuguaua

SEQ ID NO: 597473 - RNA, 19 nt, Homo sapiens
gagccucggguguaucgua

SEQ ID NO: 597474 - RNA, 19 nt, Homo sapiens
ccauggagcuccgaauucu

SEQ ID NO: 597475 - RNA, 19 nt, Homo sapiens
aaggaugacuccgauguga

SEQ ID NO: 597476 - RNA, 19 nt, Homo sapiens
ccaagagcugaguauauaa

SEQ ID NO: 597477 - RNA, 19 nt, Homo sapiens
cuuaaccucucuccacaug

SEQ ID NO: 597478 - RNA, 19 nt, Homo sapiens
gaguagugcaggccuuauu

SEQ ID NO: 597479 - RNA, 19 nt, Homo sapiens
uuacggauaucuugcuucu

SEQ ID NO: 597480 - RNA, 19 nt, Homo sapiens
gggaguagugcaggccuua

SEQ ID NO: 597481 - RNA, 19 nt, Homo sapiens
gaaguccugcuugccaauu

SEQ ID NO: 597482 - RNA, 19 nt, Homo sapiens
acucuauuccgauguauaa

SEQ ID NO: 597483 - RNA, 19 nt, Homo sapiens
ggaaggcaggagacucuau

SEQ ID NO: 597484 - RNA, 19 nt, Homo sapiens
ggaugacuccgaugugaca

SEQ ID NO: 597485 - RNA, 19 nt, Homo sapiens
ucacuccucugagcucuuc

SEQ ID NO: 597486 - RNA, 19 nt, Homo sapiens
ugaggccgcugcuuugucu

SEQ ID NO: 597487 - RNA, 19 nt, Homo sapiens
agccucaucuccuuucuug

SEQ ID NO: 597488 - RNA, 19 nt, Homo sapiens
gaaacugugauuguguuau

SEQ ID NO: 597489 - RNA, 19 nt, Homo sapiens
ccaaggaugacuccgaugu

SEQ ID NO: 597490 - RNA, 19 nt, Homo sapiens
cagaacagcaccaccaucu

SEQ ID NO: 597491 - RNA, 19 nt, Homo sapiens
ugaaacugugauuguguua

SEQ ID NO: 597492 - RNA, 19 nt, Homo sapiens
ugucuuccauuuacaccaa

SEQ ID NO: 597493 - RNA, 19 nt, Homo sapiens
ucaguugcccucugguuga

SEQ ID NO: 597494 - RNA, 19 nt, Homo sapiens
ggacuggaaccuaauucuc

SEQ ID NO: 597495 - RNA, 19 nt, Homo sapiens
gacggugccuucgcaguca

SEQ ID NO: 597496 - RNA, 19 nt, Homo sapiens
cgggcaagggcgaaacuua

SEQ ID NO: 597497 - RNA, 19 nt, Homo sapiens
gagccggcacucucaguug

SEQ ID NO: 597498 - RNA, 19 nt, Homo sapiens
guccuucucuccaucuauc

SEQ ID NO: 597499 - RNA, 19 nt, Homo sapiens
ccuacaggcccaaggauau

SEQ ID NO: 597500 - RNA, 19 nt, Homo sapiens
gcucugcugacccaacaaa

SEQ ID NO: 597501 - RNA, 19 nt, Homo sapiens
ggauaucuugcuucuguuc

SEQ ID NO: 597502 - RNA, 19 nt, Homo sapiens
uagcgcaggugucuuccau

SEQ ID NO: 597503 - RNA, 19 nt, Homo sapiens
gagggacuggaaccuaauu

SEQ ID NO: 597504 - RNA, 19 nt, Homo sapiens
gcuugaggccgcugcuuug

SEQ ID NO: 597505 - RNA, 19 nt, Homo sapiens
ggauauucugagugucaua

SEQ ID NO: 597506 - RNA, 19 nt, Homo sapiens
gccuacaacagcugcuaua

SEQ ID NO: 597507 - RNA, 19 nt, Homo sapiens
uaacgccaccuccaaggau

SEQ ID NO: 597508 - RNA, 19 nt, Homo sapiens
gcucaugccagccucaucu

SEQ ID NO: 597509 - RNA, 19 nt, Homo sapiens
aaguccugcuugccaauuu

SEQ ID NO: 597510 - RNA, 19 nt, Homo sapiens
gauaugguguccgaaucca

SEQ ID NO: 597511 - RNA, 19 nt, Homo sapiens
ccccuagacuuugauuuua

SEQ ID NO: 597512 - RNA, 19 nt, Homo sapiens
cuauagcgcaggugucuuc

SEQ ID NO: 597513 - RNA, 19 nt, Homo sapiens
caaggaugacuccgaugug

SEQ ID NO: 597514 - RNA, 19 nt, Homo sapiens
gcucuucuuucugaucaag

SEQ ID NO: 597515 - RNA, 19 nt, Homo sapiens
guuccucacuuuucccuuu

SEQ ID NO: 597516 - RNA, 19 nt, Homo sapiens
ggcuugaggccgcugcuuu

SEQ ID NO: 597517 - RNA, 19 nt, Homo sapiens
cguccagagccuuauguaa

SEQ ID NO: 597518 - RNA, 19 nt, Homo sapiens
ggaaguccugcuugccaau

SEQ ID NO: 597519 - RNA, 19 nt, Homo sapiens
ggcgaaacuuaaccucucu

SEQ ID NO: 597520 - RNA, 19 nt, Homo sapiens
cagguggugucucgagaag

SEQ ID NO: 597521 - RNA, 19 nt, Homo sapiens
guugcccucugguugaguu

SEQ ID NO: 597522 - RNA, 19 nt, Homo sapiens
cuagagggacuggaaccua

SEQ ID NO: 597523 - RNA, 19 nt, Homo sapiens
gacucuauuccgauguaua

SEQ ID NO: 597524 - RNA, 19 nt, Homo sapiens
uaucguacgcccugguguu

SEQ ID NO: 597525 - RNA, 19 nt, Homo sapiens
cgcaggugucuuccauuua

SEQ ID NO: 597526 - RNA, 19 nt, Homo sapiens
ccauuaacgccaccuccaa

SEQ ID NO: 597527 - RNA, 19 nt, Homo sapiens
gccaagagcugaguauaua

SEQ ID NO: 597528 - RNA, 19 nt, Homo sapiens
gaguuuaucugcuguauag

SEQ ID NO: 597529 - RNA, 19 nt, Homo sapiens
gcgcaggugucuuccauuu

SEQ ID NO: 597530 - RNA, 19 nt, Homo sapiens
ccagagauguagcuauuau

SEQ ID NO: 597531 - RNA, 19 nt, Homo sapiens
gagacucuauuccgaugua

SEQ ID NO: 597532 - RNA, 19 nt, Homo sapiens
gaacagcaccaccaucuag

SEQ ID NO: 597533 - RNA, 19 nt, Homo sapiens
gcaggugucuuccauuuac

SEQ ID NO: 597534 - RNA, 19 nt, Homo sapiens
uagagggacuggaaccuaa

SEQ ID NO: 597535 - RNA, 19 nt, Homo sapiens
ccucugagcucuucuuucu

SEQ ID NO: 597536 - RNA, 19 nt, Homo sapiens
gggcaagggcgaaacuuaa

SEQ ID NO: 597537 - RNA, 19 nt, Homo sapiens
ucugagcucuucuuucuga

SEQ ID NO: 597538 - RNA, 19 nt, Homo sapiens
gccaggagcacuaacagua

SEQ ID NO: 597539 - RNA, 19 nt, Homo sapiens
gagcucuucuuucugauca

SEQ ID NO: 597540 - RNA, 19 nt, Homo sapiens
gagggaaugugcaggaaca

SEQ ID NO: 597541 - RNA, 19 nt, Homo sapiens
caagagcugaguauauaaa

SEQ ID NO: 597542 - RNA, 19 nt, Homo sapiens
gaaggcaggagacucuauu

SEQ ID NO: 597543 - RNA, 19 nt, Homo sapiens
gagcugaguauauaaagga

SEQ ID NO: 597544 - RNA, 19 nt, Homo sapiens
gaagaaugacuccgaugug

SEQ ID NO: 597545 - RNA, 19 nt, Homo sapiens
gugaaacugugauuguguu

SEQ ID NO: 597546 - RNA, 19 nt, Homo sapiens
aagaaugacuccgauguga

SEQ ID NO: 597547 - RNA, 19 nt, Homo sapiens
ugccuucgcagucaaauua

SEQ ID NO: 597548 - RNA, 19 nt, Homo sapiens
cuccagagauguagcuauu

SEQ ID NO: 597549 - RNA, 19 nt, Homo sapiens
acggauaucuugcuucugu

SEQ ID NO: 597550 - RNA, 19 nt, Homo sapiens
gagagggaaugugcaggaa

SEQ ID NO: 597551 - RNA, 19 nt, Homo sapiens
gaaugacuccgaugugaca

SEQ ID NO: 597552 - RNA, 19 nt, Homo sapiens
cacaagaagccuuauccua

SEQ ID NO: 597553 - RNA, 19 nt, Homo sapiens
agaccaggguggguacaua

SEQ ID NO: 597554 - RNA, 19 nt, Homo sapiens
gauauucugagugucauaa

SEQ ID NO: 597555 - RNA, 19 nt, Homo sapiens
cuauuccgauguauaagaa

SEQ ID NO: 597556 - RNA, 19 nt, Homo sapiens
ggaguuuaucugcuguaua

SEQ ID NO: 597557 - RNA, 19 nt, Homo sapiens
gagccucggguguaucgua

SEQ ID NO: 597558 - RNA, 19 nt, Homo sapiens
ccauggagcuccgaauucu

SEQ ID NO: 597559 - RNA, 19 nt, Homo sapiens
gaguagugcaggccuuauu

SEQ ID NO: 597560 - RNA, 19 nt, Homo sapiens
ccaagagcugaguauauaa

SEQ ID NO: 597561 - RNA, 19 nt, Homo sapiens
cuuaaccucucuccacaug

SEQ ID NO: 597562 - RNA, 19 nt, Homo sapiens
uuacggauaucuugcuucu

SEQ ID NO: 597563 - RNA, 19 nt, Homo sapiens
gaaguccugcuugccaauu

SEQ ID NO: 597564 - RNA, 19 nt, Homo sapiens
acucuauuccgauguauaa

SEQ ID NO: 597565 - RNA, 19 nt, Homo sapiens
ggaaggcaggagacucuau

SEQ ID NO: 597566 - RNA, 19 nt, Homo sapiens
gggaguagugcaggccuua

SEQ ID NO: 597567 - RNA, 19 nt, Homo sapiens
ucacuccucugagcucuuc

SEQ ID NO: 597568 - RNA, 19 nt, Homo sapiens
ugaggccgcugcuuugucu

SEQ ID NO: 597569 - RNA, 19 nt, Homo sapiens
agccucaucuccuuucuug

SEQ ID NO: 597570 - RNA, 19 nt, Homo sapiens
gaaacugugauuguguuau

SEQ ID NO: 597571 - RNA, 19 nt, Homo sapiens
cagaacagcaccaccaucu

SEQ ID NO: 597572 - RNA, 19 nt, Homo sapiens
ugaaacugugauuguguua

SEQ ID NO: 597573 - RNA, 19 nt, Homo sapiens
ugucuuccauuuacaccaa

SEQ ID NO: 597574 - RNA, 19 nt, Homo sapiens
ucaguugcccucugguuga

SEQ ID NO: 597575 - RNA, 19 nt, Homo sapiens
ggacuggaaccuaauucuc

SEQ ID NO: 597576 - RNA, 19 nt, Homo sapiens
gacggugccuucgcaguca

SEQ ID NO: 597577 - RNA, 19 nt, Homo sapiens
cgggcaagggcgaaacuua

SEQ ID NO: 597578 - RNA, 19 nt, Homo sapiens
gagccggcacucucaguug

SEQ ID NO: 597579 - RNA, 19 nt, Homo sapiens
guccuucucuccaucuauc

SEQ ID NO: 597580 - RNA, 19 nt, Homo sapiens
ccuacaggcccaaggauau

SEQ ID NO: 597581 - RNA, 19 nt, Homo sapiens
gcucugcugacccaacaaa

SEQ ID NO: 597582 - RNA, 19 nt, Homo sapiens
ggauaucuugcuucuguuc

SEQ ID NO: 597583 - RNA, 19 nt, Homo sapiens
uagcgcaggugucuuccau

SEQ ID NO: 597584 - RNA, 19 nt, Homo sapiens
gagggacuggaaccuaauu

SEQ ID NO: 597585 - RNA, 19 nt, Homo sapiens
gcuugaggccgcugcuuug

SEQ ID NO: 597586 - RNA, 19 nt, Homo sapiens
ggauauucugagugucaua

SEQ ID NO: 597587 - RNA, 19 nt, Homo sapiens
gccuacaacagcugcuaua

SEQ ID NO: 597588 - RNA, 19 nt, Homo sapiens
gcucaugccagccucaucu

SEQ ID NO: 597589 - RNA, 19 nt, Homo sapiens
aaguccugcuugccaauuu

SEQ ID NO: 597590 - RNA, 19 nt, Homo sapiens
gauaugguguccgaaucca

SEQ ID NO: 597591 - RNA, 19 nt, Homo sapiens
agaagaaugacuccgaugu

SEQ ID NO: 597592 - RNA, 19 nt, Homo sapiens
ccccuagacuuugauuuua

SEQ ID NO: 597593 - RNA, 19 nt, Homo sapiens
cuauagcgcaggugucuuc

SEQ ID NO: 597594 - RNA, 19 nt, Homo sapiens
gcucuucuuucugaucaag

SEQ ID NO: 597595 - RNA, 19 nt, Homo sapiens
guuccucacuuuucccuuu

SEQ ID NO: 597596 - RNA, 19 nt, Homo sapiens
ggcuugaggccgcugcuuu

SEQ ID NO: 597597 - RNA, 19 nt, Homo sapiens
cguccagagccuuauguaa

SEQ ID NO: 597598 - RNA, 19 nt, Homo sapiens
ggcgaaacuuaaccucucu

SEQ ID NO: 597599 - RNA, 19 nt, Homo sapiens
cagguggugucucgagaag

SEQ ID NO: 597600 - RNA, 19 nt, Homo sapiens
ggaaguccugcuugccaau

SEQ ID NO: 597601 - RNA, 19 nt, Homo sapiens
guugcccucugguugaguu

SEQ ID NO: 597602 - RNA, 19 nt, Homo sapiens
cuagagggacuggaaccua

SEQ ID NO: 597603 - RNA, 19 nt, Homo sapiens
gacucuauuccgauguaua

SEQ ID NO: 597604 - RNA, 19 nt, Homo sapiens
uaucguacgcccugguguu

SEQ ID NO: 597605 - RNA, 19 nt, Homo sapiens
cgcaggugucuuccauuua

SEQ ID NO: 597606 - RNA, 19 nt, Homo sapiens
gaguuuaucugcuguauag

SEQ ID NO: 597607 - RNA, 19 nt, Homo sapiens
gcgcaggugucuuccauuu

SEQ ID NO: 597608 - RNA, 19 nt, Homo sapiens
ccagagauguagcuauuau

SEQ ID NO: 597609 - RNA, 19 nt, Homo sapiens
gagacucuauuccgaugua

SEQ ID NO: 597610 - RNA, 19 nt, Homo sapiens
gaacagcaccaccaucuag

SEQ ID NO: 597611 - RNA, 19 nt, Homo sapiens
gcaggugucuuccauuuac

SEQ ID NO: 597612 - RNA, 19 nt, Homo sapiens
uagagggacuggaaccuaa

SEQ ID NO: 597613 - RNA, 19 nt, Homo sapiens
ccucugagcucuucuuucu

SEQ ID NO: 597614 - RNA, 19 nt, Homo sapiens
gggcaagggcgaaacuuaa

SEQ ID NO: 597615 - RNA, 19 nt, Homo sapiens
ucugagcucuucuuucuga

SEQ ID NO: 597616 - RNA, 19 nt, Homo sapiens
gccaggagcacuaacagua

SEQ ID NO: 597617 - RNA, 19 nt, Homo sapiens
gagcucuucuuucugauca

SEQ ID NO: 597618 - RNA, 19 nt, Homo sapiens
gaaccuuccugggacuuug

SEQ ID NO: 597619 - RNA, 19 nt, Homo sapiens
gaaggcaggagacucuauu

SEQ ID NO: 597620 - RNA, 19 nt, Homo sapiens
ugccuucgcagucaaauua

SEQ ID NO: 597621 - RNA, 19 nt, Homo sapiens
cuccagagauguagcuauu

SEQ ID NO: 597622 - RNA, 19 nt, Homo sapiens
acggauaucuugcuucugu

SEQ ID NO: 597623 - RNA, 19 nt, Homo sapiens
cacaagaagccuuauccua

SEQ ID NO: 597624 - RNA, 19 nt, Homo sapiens
gauauucugagugucauaa

SEQ ID NO: 597625 - RNA, 19 nt, Homo sapiens
cuauuccgauguauaagaa

SEQ ID NO: 597626 - RNA, 19 nt, Homo sapiens
agaagaagcagcacucugu

SEQ ID NO: 597627 - RNA, 19 nt, Homo sapiens
gcaccugguucccauuaac

SEQ ID NO: 597628 - RNA, 19 nt, Homo sapiens
ggaguuuaucugcuguaua

SEQ ID NO: 597629 - RNA, 19 nt, Homo sapiens
gagccucggguguaucgua

SEQ ID NO: 597630 - RNA, 19 nt, Homo sapiens
ccauggagcuccgaauucu

SEQ ID NO: 597631 - RNA, 19 nt, Homo sapiens
aaggaugacuccgauguga

SEQ ID NO: 597632 - RNA, 19 nt, Homo sapiens
cuuaaccucucuccacaug

SEQ ID NO: 597633 - RNA, 19 nt, Homo sapiens
gaguagugcaggccuuauu

SEQ ID NO: 597634 - RNA, 19 nt, Homo sapiens
uuacggauaucuugcuucu

SEQ ID NO: 597635 - RNA, 19 nt, Homo sapiens
acucuauuccgauguauaa

SEQ ID NO: 597636 - RNA, 19 nt, Homo sapiens
gggaguagugcaggccuua

SEQ ID NO: 597637 - RNA, 19 nt, Homo sapiens
ggaaggcaggagacucuau

SEQ ID NO: 597638 - RNA, 19 nt, Homo sapiens
ggaugacuccgaugugaca

SEQ ID NO: 597639 - RNA, 19 nt, Homo sapiens
gaaguccugcuugccaauu

SEQ ID NO: 597640 - RNA, 19 nt, Homo sapiens
ucacuccucugagcucuuc

SEQ ID NO: 597641 - RNA, 19 nt, Homo sapiens
agccucaucuccuuucuug

SEQ ID NO: 597642 - RNA, 19 nt, Homo sapiens
ugaggccgcugcuuugucu

SEQ ID NO: 597643 - RNA, 19 nt, Homo sapiens
ccaaggaugacuccgaugu

SEQ ID NO: 597644 - RNA, 19 nt, Homo sapiens
cagaacagcaccaccaucu

SEQ ID NO: 597645 - RNA, 19 nt, Homo sapiens
ugucuuccauuuacaccaa

SEQ ID NO: 597646 - RNA, 19 nt, Homo sapiens
ucaguugcccucugguuga

SEQ ID NO: 597647 - RNA, 19 nt, Homo sapiens
ggacuggaaccuaauucuc

SEQ ID NO: 597648 - RNA, 19 nt, Homo sapiens
gacggugccuucgcaguca

SEQ ID NO: 597649 - RNA, 19 nt, Homo sapiens
cgggcaagggcgaaacuua

SEQ ID NO: 597650 - RNA, 19 nt, Homo sapiens
gagccggcacucucaguug

SEQ ID NO: 597651 - RNA, 19 nt, Homo sapiens
guccuucucuccaucuauc

SEQ ID NO: 597652 - RNA, 19 nt, Homo sapiens
ccuacaggcccaaggauau

SEQ ID NO: 597653 - RNA, 19 nt, Homo sapiens
gcucugcugacccaacaaa

SEQ ID NO: 597654 - RNA, 19 nt, Homo sapiens
ggauaucuugcuucuguuc

SEQ ID NO: 597655 - RNA, 19 nt, Homo sapiens
uagcgcaggugucuuccau

SEQ ID NO: 597656 - RNA, 19 nt, Homo sapiens
gagggacuggaaccuaauu

SEQ ID NO: 597657 - RNA, 19 nt, Homo sapiens
gcuugaggccgcugcuuug

SEQ ID NO: 597658 - RNA, 19 nt, Homo sapiens
ggauauucugagugucaua

SEQ ID NO: 597659 - RNA, 19 nt, Homo sapiens
gccuacaacagcugcuaua

SEQ ID NO: 597660 - RNA, 19 nt, Homo sapiens
uaacgccaccuccaaggau

SEQ ID NO: 597661 - RNA, 19 nt, Homo sapiens
gcucaugccagccucaucu

SEQ ID NO: 597662 - RNA, 19 nt, Homo sapiens
gauaugguguccgaaucca

SEQ ID NO: 597663 - RNA, 19 nt, Homo sapiens
aaguccugcuugccaauuu

SEQ ID NO: 597664 - RNA, 19 nt, Homo sapiens
cuauagcgcaggugucuuc

SEQ ID NO: 597665 - RNA, 19 nt, Homo sapiens
caaggaugacuccgaugug

SEQ ID NO: 597666 - RNA, 19 nt, Homo sapiens
gcucuucuuucugaucaag

SEQ ID NO: 597667 - RNA, 19 nt, Homo sapiens
ggcuugaggccgcugcuuu

SEQ ID NO: 597668 - RNA, 19 nt, Homo sapiens
cguccagagccuuauguaa

SEQ ID NO: 597669 - RNA, 19 nt, Homo sapiens
ggcgaaacuuaaccucucu

SEQ ID NO: 597670 - RNA, 19 nt, Homo sapiens
ggaaguccugcuugccaau

SEQ ID NO: 597671 - RNA, 19 nt, Homo sapiens
cagguggugucucgagaag

SEQ ID NO: 597672 - RNA, 19 nt, Homo sapiens
guugcccucugguugaguu

SEQ ID NO: 597673 - RNA, 19 nt, Homo sapiens
cuagagggacuggaaccua

SEQ ID NO: 597674 - RNA, 19 nt, Homo sapiens
gacucuauuccgauguaua

SEQ ID NO: 597675 - RNA, 19 nt, Homo sapiens
uaucguacgcccugguguu

SEQ ID NO: 597676 - RNA, 19 nt, Homo sapiens
cgcaggugucuuccauuua

SEQ ID NO: 597677 - RNA, 19 nt, Homo sapiens
ccauuaacgccaccuccaa

SEQ ID NO: 597678 - RNA, 19 nt, Homo sapiens
gccaagagcugaguauaua

SEQ ID NO: 597679 - RNA, 19 nt, Homo sapiens
gaguuuaucugcuguauag

SEQ ID NO: 597680 - RNA, 19 nt, Homo sapiens
gcgcaggugucuuccauuu

SEQ ID NO: 597681 - RNA, 19 nt, Homo sapiens
ccagagauguagcuauuau

SEQ ID NO: 597682 - RNA, 19 nt, Homo sapiens
gagacucuauuccgaugua

SEQ ID NO: 597683 - RNA, 19 nt, Homo sapiens
gaacagcaccaccaucuag

SEQ ID NO: 597684 - RNA, 19 nt, Homo sapiens
gcaggugucuuccauuuac

SEQ ID NO: 597685 - RNA, 19 nt, Homo sapiens
gaucgcagcccauuaugaa

SEQ ID NO: 597686 - RNA, 19 nt, Homo sapiens
ccucugagcucuucuuucu

SEQ ID NO: 597687 - RNA, 19 nt, Homo sapiens
gggcaagggcgaaacuuaa

SEQ ID NO: 597688 - RNA, 19 nt, Homo sapiens
ucugagcucuucuuucuga

SEQ ID NO: 597689 - RNA, 19 nt, Homo sapiens
gagcucuucuuucugauca

SEQ ID NO: 597690 - RNA, 19 nt, Homo sapiens
gagggaaugugcaggaaca

SEQ ID NO: 597691 - RNA, 19 nt, Homo sapiens
caagagcugaguauauaaa

SEQ ID NO: 597692 - RNA, 19 nt, Homo sapiens
gaaggcaggagacucuauu

SEQ ID NO: 597693 - RNA, 19 nt, Homo sapiens
gagcugaguauauaaagga

SEQ ID NO: 597694 - RNA, 19 nt, Homo sapiens
gugaaacugugauuguguu

SEQ ID NO: 597695 - RNA, 19 nt, Homo sapiens
ucgcagaagugcaccuaaa

SEQ ID NO: 597696 - RNA, 19 nt, Homo sapiens
ugccuucgcagucaaauua

SEQ ID NO: 597697 - RNA, 19 nt, Homo sapiens
cuccagagauguagcuauu

SEQ ID NO: 597698 - RNA, 19 nt, Homo sapiens
acggauaucuugcuucugu

SEQ ID NO: 597699 - RNA, 19 nt, Homo sapiens
gagagggaaugugcaggaa

SEQ ID NO: 597700 - RNA, 19 nt, Homo sapiens
ucuacuaccuguacuguca

SEQ ID NO: 597701 - RNA, 19 nt, Homo sapiens
ggaggaagccagaaucaac

SEQ ID NO: 597702 - RNA, 19 nt, Homo sapiens
cacaagaagccuuauccua

SEQ ID NO: 597703 - RNA, 19 nt, Homo sapiens
agaccaggguggguacaua

SEQ ID NO: 597704 - RNA, 19 nt, Homo sapiens
gauauucugagugucauaa

SEQ ID NO: 597705 - RNA, 19 nt, Homo sapiens
cuauuccgauguauaagaa

SEQ ID NO: 597706 - RNA, 19 nt, Homo sapiens
agaagaagcagcacucugu

SEQ ID NO: 597707 - RNA, 19 nt, Homo sapiens
gcaccugguucccauuaac

SEQ ID NO: 597708 - RNA, 19 nt, Homo sapiens
ggaguuuaucugcuguaua

SEQ ID NO: 597709 - RNA, 19 nt, Homo sapiens
gagccucggguguaucgua

SEQ ID NO: 597710 - RNA, 19 nt, Homo sapiens
ccauggagcuccgaauucu

SEQ ID NO: 597711 - RNA, 19 nt, Homo sapiens
aaggaugacuccgauguga

SEQ ID NO: 597712 - RNA, 19 nt, Homo sapiens
gggcugggcucuacuaccu

SEQ ID NO: 597713 - RNA, 19 nt, Homo sapiens
gagcgaucgcagcccauua

SEQ ID NO: 597714 - RNA, 19 nt, Homo sapiens
ccaagagcugaguauauaa

SEQ ID NO: 597715 - RNA, 19 nt, Homo sapiens
cuuaaccucucuccacaug

SEQ ID NO: 597716 - RNA, 19 nt, Homo sapiens
gaggaagccagaaucaaca

SEQ ID NO: 597717 - RNA, 19 nt, Homo sapiens
uuacggauaucuugcuucu

SEQ ID NO: 597718 - RNA, 19 nt, Homo sapiens
acucuauuccgauguauaa

SEQ ID NO: 597719 - RNA, 19 nt, Homo sapiens
ggaaggcaggagacucuau

SEQ ID NO: 597720 - RNA, 19 nt, Homo sapiens
ggaugacuccgaugugaca

SEQ ID NO: 597721 - RNA, 19 nt, Homo sapiens
ucacuccucugagcucuuc

SEQ ID NO: 597722 - RNA, 19 nt, Homo sapiens
gaaacugugauuguguuau

SEQ ID NO: 597723 - RNA, 19 nt, Homo sapiens
ccaaggaugacuccgaugu

SEQ ID NO: 597724 - RNA, 19 nt, Homo sapiens
cagaacagcaccaccaucu

SEQ ID NO: 597725 - RNA, 19 nt, Homo sapiens
ugaaacugugauuguguua

SEQ ID NO: 597726 - RNA, 19 nt, Homo sapiens
ugucuuccauuuacaccaa

SEQ ID NO: 597727 - RNA, 19 nt, Homo sapiens
uaccuguacugucagaguu

SEQ ID NO: 597728 - RNA, 19 nt, Homo sapiens
gacggugccuucgcaguca

SEQ ID NO: 597729 - RNA, 19 nt, Homo sapiens
cgggcaagggcgaaacuua

SEQ ID NO: 597730 - RNA, 19 nt, Homo sapiens
guccuucucuccaucuauc

SEQ ID NO: 597731 - RNA, 19 nt, Homo sapiens
ccuacaggcccaaggauau

SEQ ID NO: 597732 - RNA, 19 nt, Homo sapiens
gcagaagugcaccuaaagg

SEQ ID NO: 597733 - RNA, 19 nt, Homo sapiens
ggauaucuugcuucuguuc

SEQ ID NO: 597734 - RNA, 19 nt, Homo sapiens
gguguggacgggacaguga

SEQ ID NO: 597735 - RNA, 19 nt, Homo sapiens
uagcgcaggugucuuccau

SEQ ID NO: 597736 - RNA, 19 nt, Homo sapiens
gaaaacacgggcucgaaga

SEQ ID NO: 597737 - RNA, 19 nt, Homo sapiens
ggauauucugagugucaua

SEQ ID NO: 597738 - RNA, 19 nt, Homo sapiens
gccuacaacagcugcuaua

SEQ ID NO: 597739 - RNA, 19 nt, Homo sapiens
uaacgccaccuccaaggau

SEQ ID NO: 597740 - RNA, 19 nt, Homo sapiens
gauaugguguccgaaucca

SEQ ID NO: 597741 - RNA, 19 nt, Homo sapiens
ggacccgucggaacugaau

SEQ ID NO: 597742 - RNA, 19 nt, Homo sapiens
cgcagcccauuaugaaguu

SEQ ID NO: 597743 - RNA, 19 nt, Homo sapiens
ccccuagacuuugauuuua

SEQ ID NO: 597744 - RNA, 19 nt, Homo sapiens
cuauagcgcaggugucuuc

SEQ ID NO: 597745 - RNA, 19 nt, Homo sapiens
caaggaugacuccgaugug

SEQ ID NO: 597746 - RNA, 19 nt, Homo sapiens
gcucuucuuucugaucaag

SEQ ID NO: 597747 - RNA, 19 nt, Homo sapiens
guuccucacuuuucccuuu

SEQ ID NO: 597748 - RNA, 19 nt, Homo sapiens
gacagaagaaagccaggau

SEQ ID NO: 597749 - RNA, 19 nt, Homo sapiens
ggcgaaacuuaaccucucu

SEQ ID NO: 597750 - RNA, 19 nt, Homo sapiens
cuaguucggccucgcagaa

SEQ ID NO: 597751 - RNA, 19 nt, Homo sapiens
cagguggugucucgagaag

SEQ ID NO: 597752 - RNA, 19 nt, Homo sapiens
caggacccgucggaacuga

SEQ ID NO: 597753 - RNA, 19 nt, Homo sapiens
gacucuauuccgauguaua

SEQ ID NO: 597754 - RNA, 19 nt, Homo sapiens
ggaacugaauccccagaca

SEQ ID NO: 597755 - RNA, 19 nt, Homo sapiens
uaucguacgcccugguguu

SEQ ID NO: 597756 - RNA, 19 nt, Homo sapiens
gggaggaagccagaaucaa

SEQ ID NO: 597757 - RNA, 19 nt, Homo sapiens
cgaucgcagcccauuauga

SEQ ID NO: 597758 - RNA, 19 nt, Homo sapiens
cgcaggugucuuccauuua

SEQ ID NO: 597759 - RNA, 19 nt, Homo sapiens
ccauuaacgccaccuccaa

SEQ ID NO: 597760 - RNA, 19 nt, Homo sapiens
gagaauucccuguggauuu

SEQ ID NO: 597761 - RNA, 19 nt, Homo sapiens
ggaaggcugucuaccugaa

SEQ ID NO: 597762 - RNA, 19 nt, Homo sapiens
gaucgcagcccauuaugaa

SEQ ID NO: 597763 - RNA, 19 nt, Homo sapiens
gcuccucccuugagaauuc

SEQ ID NO: 597764 - RNA, 19 nt, Homo sapiens
gccaggaguucccaaaugu

SEQ ID NO: 597765 - RNA, 19 nt, Homo sapiens
ggccaggaguucccaaaug

SEQ ID NO: 597766 - RNA, 19 nt, Homo sapiens
ucgcagaagugcaccuaaa

SEQ ID NO: 597767 - RNA, 19 nt, Homo sapiens
uauucccacucuuaucuua

SEQ ID NO: 597768 - RNA, 19 nt, Homo sapiens
ucuacuaccuguacuguca

SEQ ID NO: 597769 - RNA, 19 nt, Homo sapiens
ggaggaagccagaaucaac

SEQ ID NO: 597770 - RNA, 19 nt, Homo sapiens
gcaggaagccaaagagacu

SEQ ID NO: 597771 - RNA, 19 nt, Homo sapiens
cccaaucccugacccuuug

SEQ ID NO: 597772 - RNA, 19 nt, Homo sapiens
uacaguauucccacucuua

SEQ ID NO: 597773 - RNA, 19 nt, Homo sapiens
gcaaggauggguccagaag

SEQ ID NO: 597774 - RNA, 19 nt, Homo sapiens
gggcugggcucuacuaccu

SEQ ID NO: 597775 - RNA, 19 nt, Homo sapiens
gagcgaucgcagcccauua

SEQ ID NO: 597776 - RNA, 19 nt, Homo sapiens
gaggaagccagaaucaaca

SEQ ID NO: 597777 - RNA, 19 nt, Homo sapiens
caggaguucccaaauguga

SEQ ID NO: 597778 - RNA, 19 nt, Homo sapiens
uguguucacuguacucugu

SEQ ID NO: 597779 - RNA, 19 nt, Homo sapiens
ggcauuguguucacuguac

SEQ ID NO: 597780 - RNA, 19 nt, Homo sapiens
acugucaggugcacuuuga

SEQ ID NO: 597781 - RNA, 19 nt, Homo sapiens
gcagaagugcaccuaaagg

SEQ ID NO: 597782 - RNA, 19 nt, Homo sapiens
agaauucccuguggauuuu

SEQ ID NO: 597783 - RNA, 19 nt, Homo sapiens
gguguggacgggacaguga

SEQ ID NO: 597784 - RNA, 19 nt, Homo sapiens
gaaaacacgggcucgaaga

SEQ ID NO: 597785 - RNA, 19 nt, Homo sapiens
gggcauuguguucacugua

SEQ ID NO: 597786 - RNA, 19 nt, Homo sapiens
ggacccgucggaacugaau

SEQ ID NO: 597787 - RNA, 19 nt, Homo sapiens
caaggauggguccagaaga

SEQ ID NO: 597788 - RNA, 19 nt, Homo sapiens
cgcagcccauuaugaaguu

SEQ ID NO: 597789 - RNA, 19 nt, Homo sapiens
aaggauggguccagaagac

SEQ ID NO: 597790 - RNA, 19 nt, Homo sapiens
cuaguucggccucgcagaa

SEQ ID NO: 597791 - RNA, 19 nt, Homo sapiens
gacagaagaaagccaggau

SEQ ID NO: 597792 - RNA, 19 nt, Homo sapiens
caucccacauaaauacagu

SEQ ID NO: 597793 - RNA, 19 nt, Homo sapiens
caggacccgucggaacuga

SEQ ID NO: 597794 - RNA, 19 nt, Homo sapiens
ccacucuuaucuuacaacu

SEQ ID NO: 597795 - RNA, 19 nt, Homo sapiens
ggaacugaauccccagaca

SEQ ID NO: 597796 - RNA, 19 nt, Homo sapiens
gucaggugcacuuugauga

SEQ ID NO: 597797 - RNA, 19 nt, Homo sapiens
guacugucaggugcacuuu

SEQ ID NO: 597798 - RNA, 19 nt, Homo sapiens
gggaggaagccagaaucaa

SEQ ID NO: 597799 - RNA, 19 nt, Homo sapiens
cgaucgcagcccauuauga

SEQ ID NO: 597800 - RNA, 19 nt, Homo sapiens
ggacacaucucccaccauu

SEQ ID NO: 597801 - RNA, 19 nt, Homo sapiens
gcuagaaugugccugugua

SEQ ID NO: 597802 - RNA, 19 nt, Homo sapiens
gagaauucccuguggauuu

SEQ ID NO: 597803 - RNA, 19 nt, Homo sapiens
ggaaggcugucuaccugaa

SEQ ID NO: 597804 - RNA, 19 nt, Homo sapiens
gaucgcagcccauuaugaa

SEQ ID NO: 597805 - RNA, 19 nt, Homo sapiens
gcuccucccuugagaauuc

SEQ ID NO: 597806 - RNA, 19 nt, Homo sapiens
gccaggaguucccaaaugu

SEQ ID NO: 597807 - RNA, 19 nt, Homo sapiens
ggccaggaguucccaaaug

SEQ ID NO: 597808 - RNA, 19 nt, Homo sapiens
gcaggcagauggagguuac

SEQ ID NO: 597809 - RNA, 19 nt, Homo sapiens
ucgcagaagugcaccuaaa

SEQ ID NO: 597810 - RNA, 19 nt, Homo sapiens
ugucugaggccaugagaua

SEQ ID NO: 597811 - RNA, 19 nt, Homo sapiens
gcagauggagguuacacaa

SEQ ID NO: 597812 - RNA, 19 nt, Homo sapiens
uauucccacucuuaucuua

SEQ ID NO: 597813 - RNA, 19 nt, Homo sapiens
gauggagguuacacaacuu

SEQ ID NO: 597814 - RNA, 19 nt, Homo sapiens
ucuacuaccuguacuguca

SEQ ID NO: 597815 - RNA, 19 nt, Homo sapiens
ggaggaagccagaaucaac

SEQ ID NO: 597816 - RNA, 19 nt, Homo sapiens
gcaggaagccaaagagacu

SEQ ID NO: 597817 - RNA, 19 nt, Homo sapiens
ggucaaaggagaacaagag

SEQ ID NO: 597818 - RNA, 19 nt, Homo sapiens
cccaaucccugacccuuug

SEQ ID NO: 597819 - RNA, 19 nt, Homo sapiens
uacaguauucccacucuua

SEQ ID NO: 597820 - RNA, 19 nt, Homo sapiens
gauuugaacccagcuagaa

SEQ ID NO: 597821 - RNA, 19 nt, Homo sapiens
gcaaggauggguccagaag

SEQ ID NO: 597822 - RNA, 19 nt, Homo sapiens
gggcugggcucuacuaccu

SEQ ID NO: 597823 - RNA, 19 nt, Homo sapiens
gagcgaucgcagcccauua

SEQ ID NO: 597824 - RNA, 19 nt, Homo sapiens
gaggaagccagaaucaaca

SEQ ID NO: 597825 - RNA, 19 nt, Homo sapiens
caggaguucccaaauguga

SEQ ID NO: 597826 - RNA, 19 nt, Homo sapiens
uguguucacuguacucugu

SEQ ID NO: 597827 - RNA, 19 nt, Homo sapiens
ggcauuguguucacuguac

SEQ ID NO: 597828 - RNA, 19 nt, Homo sapiens
acugucaggugcacuuuga

SEQ ID NO: 597829 - RNA, 19 nt, Homo sapiens
gaaagaagagaggacacau

SEQ ID NO: 597830 - RNA, 19 nt, Homo sapiens
acacaucucccaccauuac

SEQ ID NO: 597831 - RNA, 19 nt, Homo sapiens
gcagaagugcaccuaaagg

SEQ ID NO: 597832 - RNA, 19 nt, Homo sapiens
agaauucccuguggauuuu

SEQ ID NO: 597833 - RNA, 19 nt, Homo sapiens
gguguggacgggacaguga

SEQ ID NO: 597834 - RNA, 19 nt, Homo sapiens
agauggagguuacacaacu

SEQ ID NO: 597835 - RNA, 19 nt, Homo sapiens
gaaaacacgggcucgaaga

SEQ ID NO: 597836 - RNA, 19 nt, Homo sapiens
gggcauuguguucacugua

SEQ ID NO: 597837 - RNA, 19 nt, Homo sapiens
ggacccgucggaacugaau

SEQ ID NO: 597838 - RNA, 19 nt, Homo sapiens
gagggucaaaggagaacaa

SEQ ID NO: 597839 - RNA, 19 nt, Homo sapiens
ccagagggucaaaggagaa

SEQ ID NO: 597840 - RNA, 19 nt, Homo sapiens
gacacaucucccaccauua

SEQ ID NO: 597841 - RNA, 19 nt, Homo sapiens
agaaugugccuguguacug

SEQ ID NO: 597842 - RNA, 19 nt, Homo sapiens
caaggauggguccagaaga

SEQ ID NO: 597843 - RNA, 19 nt, Homo sapiens
aagaagagaggacacaucu

SEQ ID NO: 597844 - RNA, 19 nt, Homo sapiens
cgcagcccauuaugaaguu

SEQ ID NO: 597845 - RNA, 19 nt, Homo sapiens
ggccaugagauacuaagug

SEQ ID NO: 597846 - RNA, 19 nt, Homo sapiens
cugaggccaugagauacua

SEQ ID NO: 597847 - RNA, 19 nt, Homo sapiens
aaggauggguccagaagac

SEQ ID NO: 597848 - RNA, 19 nt, Homo sapiens
cuaguucggccucgcagaa

SEQ ID NO: 597849 - RNA, 19 nt, Homo sapiens
gacagaagaaagccaggau

SEQ ID NO: 597850 - RNA, 19 nt, Homo sapiens
caucccacauaaauacagu

SEQ ID NO: 597851 - RNA, 19 nt, Homo sapiens
caggacccgucggaacuga

SEQ ID NO: 597852 - RNA, 19 nt, Homo sapiens
ccacucuuaucuuacaacu

SEQ ID NO: 597853 - RNA, 19 nt, Homo sapiens
caagauuugaacccagcua

SEQ ID NO: 597854 - RNA, 19 nt, Homo sapiens
cgaucgcagcccauuauga

SEQ ID NO: 597855 - RNA, 19 nt, Homo sapiens
gucaggugcacuuugauga

SEQ ID NO: 597856 - RNA, 19 nt, Homo sapiens
guacugucaggugcacuuu

SEQ ID NO: 597857 - RNA, 19 nt, Homo sapiens
gggaggaagccagaaucaa

SEQ ID NO: 597858 - RNA, 19 nt, Homo sapiens
ggaacugaauccccagaca

SEQ ID NO: 597859 - RNA, 19 nt, Homo sapiens
uaacugaccuggaaagaaa

SEQ ID NO: 597860 - RNA, 19 nt, Homo sapiens
caaagugacuauucaguuu

SEQ ID NO: 597861 - RNA, 19 nt, Homo sapiens
guuaacaucuucugucuuu

SEQ ID NO: 597862 - RNA, 19 nt, Homo sapiens
gagaguagcagcucacaua

SEQ ID NO: 597863 - RNA, 19 nt, Homo sapiens
acaaacaaaugguccaaua

SEQ ID NO: 597864 - RNA, 19 nt, Homo sapiens
uggcauugcuuguuucuua

SEQ ID NO: 597865 - RNA, 19 nt, Homo sapiens
caaaugagcacuugauaga

SEQ ID NO: 597866 - RNA, 19 nt, Homo sapiens
agaaauaguuguuggucua

SEQ ID NO: 597867 - RNA, 19 nt, Homo sapiens
ccaaacauacuuucgauuu

SEQ ID NO: 597868 - RNA, 19 nt, Homo sapiens
uguaaagacuguagaagaa

SEQ ID NO: 597869 - RNA, 19 nt, Homo sapiens
gacccuauauuguugauga

SEQ ID NO: 597870 - RNA, 19 nt, Homo sapiens
uaacuuacguguacuuuac

SEQ ID NO: 597871 - RNA, 19 nt, Homo sapiens
caaguaguguaucacagua

SEQ ID NO: 597872 - RNA, 19 nt, Homo sapiens
ccaacgagcugaagcagau

SEQ ID NO: 597873 - RNA, 19 nt, Homo sapiens
ugaaauugcugaaagaucu

SEQ ID NO: 597874 - RNA, 19 nt, Homo sapiens
ggaagaagcaacacauugu

SEQ ID NO: 597875 - RNA, 19 nt, Homo sapiens
aaaguggcauugcuuguuu

SEQ ID NO: 597876 - RNA, 19 nt, Homo sapiens
caaacauacuuucgauuuc

SEQ ID NO: 597877 - RNA, 19 nt, Homo sapiens
gcaagagaauuguuugaac

SEQ ID NO: 597878 - RNA, 19 nt, Homo sapiens
gagaagaggcaccacuaaa

SEQ ID NO: 597879 - RNA, 19 nt, Homo sapiens
gauacacuaugaagauguu

SEQ ID NO: 597880 - RNA, 19 nt, Homo sapiens
gucuaaagaugcagaauau

SEQ ID NO: 597881 - RNA, 19 nt, Homo sapiens
ggucuaaagaugcagaaua

SEQ ID NO: 597882 - RNA, 19 nt, Homo sapiens
caaguuauccugacccuau

SEQ ID NO: 597883 - RNA, 19 nt, Homo sapiens
gaugauacacuaugaagau

SEQ ID NO: 597884 - RNA, 19 nt, Homo sapiens
cuacaucuauucccaaaca

SEQ ID NO: 597885 - RNA, 19 nt, Homo sapiens
aaaccucuaugcaaucuga

SEQ ID NO: 597886 - RNA, 19 nt, Homo sapiens
gagagaagaggcaccacua

SEQ ID NO: 597887 - RNA, 19 nt, Homo sapiens
ggacaacauccuuaaguca

SEQ ID NO: 597888 - RNA, 19 nt, Homo sapiens
guaguagccuccagguuuc

SEQ ID NO: 597889 - RNA, 19 nt, Homo sapiens
gaaaagugcuagaaauagu

SEQ ID NO: 597890 - RNA, 19 nt, Homo sapiens
gaccauagugaccaacaua

SEQ ID NO: 597891 - RNA, 19 nt, Homo sapiens
gaaauaguuguuggucuaa

SEQ ID NO: 597892 - RNA, 19 nt, Homo sapiens
ugaagcagaugcaggacaa

SEQ ID NO: 597893 - RNA, 19 nt, Homo sapiens
gagcgagacuugguuucaa

SEQ ID NO: 597894 - RNA, 19 nt, Homo sapiens
caaagaacgacaaacaaau

SEQ ID NO: 597895 - RNA, 19 nt, Homo sapiens
acaaagaacgacaaacaaa

SEQ ID NO: 597896 - RNA, 19 nt, Homo sapiens
acaacauccuuaagucaaa

SEQ ID NO: 597897 - RNA, 19 nt, Homo sapiens
ucaggacucuaccucauau

SEQ ID NO: 597898 - RNA, 19 nt, Homo sapiens
ucaggaugauacacuauga

SEQ ID NO: 597899 - RNA, 19 nt, Homo sapiens
caagagaucaagaccauag

SEQ ID NO: 597900 - RNA, 19 nt, Homo sapiens
caauccaucucucaaguag

SEQ ID NO: 597901 - RNA, 19 nt, Homo sapiens
ggcauugcuuguuucuuaa

SEQ ID NO: 597902 - RNA, 19 nt, Homo sapiens
gggacaacauccuuaaguc

SEQ ID NO: 597903 - RNA, 19 nt, Homo sapiens
uaaagacuguagaagaaag

SEQ ID NO: 597904 - RNA, 19 nt, Homo sapiens
uagcagaaaucuagaagac

SEQ ID NO: 597905 - RNA, 19 nt, Homo sapiens
gaugaaaagugcuagaaau

SEQ ID NO: 597906 - RNA, 19 nt, Homo sapiens
caaacaaaugguccaauau

SEQ ID NO: 597907 - RNA, 19 nt, Homo sapiens
aaagaacgacaaacaaaug

SEQ ID NO: 597908 - RNA, 19 nt, Homo sapiens
acacaaagaacgacaaaca

SEQ ID NO: 597909 - RNA, 19 nt, Homo sapiens
uaacaaaugagcacuugau

SEQ ID NO: 597910 - RNA, 19 nt, Homo sapiens
ucuccaaacuccaagaaug

SEQ ID NO: 597911 - RNA, 19 nt, Homo sapiens
gagaucaagaccauaguga

SEQ ID NO: 597912 - RNA, 19 nt, Homo sapiens
gacaacauccuuaagucaa

SEQ ID NO: 597913 - RNA, 19 nt, Homo sapiens
guaaagacuguagaagaaa

SEQ ID NO: 597914 - RNA, 19 nt, Homo sapiens
ucaaagugacuauucaguu

SEQ ID NO: 597915 - RNA, 19 nt, Homo sapiens
gcaguguggugagaucaug

SEQ ID NO: 597916 - RNA, 19 nt, Homo sapiens
aguaguagccuccagguuu

SEQ ID NO: 597917 - RNA, 19 nt, Homo sapiens
gcaacaauccaucucucaa

SEQ ID NO: 597918 - RNA, 19 nt, Homo sapiens
gggaauauuugagcuuaag

SEQ ID NO: 597919 - RNA, 19 nt, Homo sapiens
gaggaagaagcaacacauu

SEQ ID NO: 597920 - RNA, 19 nt, Homo sapiens
aaugagcacuugauagaca

SEQ ID NO: 597921 - RNA, 19 nt, Homo sapiens
ugucagcuuccaaacauua

SEQ ID NO: 597922 - RNA, 19 nt, Homo sapiens
ucaguuugcuagcagaaau

SEQ ID NO: 597923 - RNA, 19 nt, Homo sapiens
aaaauaaacuccugggaau

SEQ ID NO: 597924 - RNA, 19 nt, Homo sapiens
gcaacuccgucagcucguu

SEQ ID NO: 597925 - RNA, 19 nt, Homo sapiens
ugcagaauauggacucuau

SEQ ID NO: 597926 - RNA, 19 nt, Homo sapiens
uaaagaugcagaauaugga

SEQ ID NO: 597927 - RNA, 19 nt, Homo sapiens
gaagaagcaacacauuguc

SEQ ID NO: 597928 - RNA, 19 nt, Homo sapiens
uccgucagcucguuagaaa

SEQ ID NO: 597929 - RNA, 19 nt, Homo sapiens
caacuccgucagcucguua

SEQ ID NO: 597930 - RNA, 19 nt, Homo sapiens
agcaauaaccucaaaguga

SEQ ID NO: 597931 - RNA, 19 nt, Homo sapiens
gaauauuugagcuuaagga

SEQ ID NO: 597932 - RNA, 19 nt, Homo sapiens
uguaacaaaugagcacuug

SEQ ID NO: 597933 - RNA, 19 nt, Homo sapiens
aaacacaaagaacgacaaa

SEQ ID NO: 597934 - RNA, 19 nt, Homo sapiens
gaaagaugauuuugagaac

SEQ ID NO: 597935 - RNA, 19 nt, Homo sapiens
ucaguaaguacguguuauu

SEQ ID NO: 597936 - RNA, 19 nt, Homo sapiens
gaaaccccaucucuacuga

SEQ ID NO: 597937 - RNA, 19 nt, Homo sapiens
gacucuaccucauaucagu

SEQ ID NO: 597938 - RNA, 19 nt, Homo sapiens
cuaaagaugcagaauaugg

SEQ ID NO: 597939 - RNA, 19 nt, Homo sapiens
gcaggacaaguacuccaaa

SEQ ID NO: 597940 - RNA, 19 nt, Homo sapiens
cgucagcucguuagaaaga

SEQ ID NO: 597941 - RNA, 19 nt, Homo sapiens
aaaauuagcuggguguguu

SEQ ID NO: 597942 - RNA, 19 nt, Homo sapiens
ucaagaccauagugaccaa

SEQ ID NO: 597943 - RNA, 19 nt, Homo sapiens
caacaauccaucucucaag

SEQ ID NO: 597944 - RNA, 19 nt, Homo sapiens
uuuccucacugacuauaaa

SEQ ID NO: 597945 - RNA, 19 nt, Homo sapiens
caaggagugggcauucauu

SEQ ID NO: 597946 - RNA, 19 nt, Homo sapiens
aguagcagcucacauaacu

SEQ ID NO: 597947 - RNA, 19 nt, Homo sapiens
ccaaugacgaagagaguau

SEQ ID NO: 597948 - RNA, 19 nt, Homo sapiens
cgacagagcgagacuuggu

SEQ ID NO: 597949 - RNA, 19 nt, Homo sapiens
ggcaagagaauuguuugaa

SEQ ID NO: 597950 - RNA, 19 nt, Homo sapiens
gaaauugcugaaagaucuu

SEQ ID NO: 597951 - RNA, 19 nt, Homo sapiens
ugacucacuuaucccaaga

SEQ ID NO: 597952 - RNA, 19 nt, Homo sapiens
ggugagaucaugccacuac

SEQ ID NO: 597953 - RNA, 19 nt, Homo sapiens
caccuguaaucccaacauu

SEQ ID NO: 597954 - RNA, 19 nt, Homo sapiens
cacauugucuucuccaaac

SEQ ID NO: 597955 - RNA, 19 nt, Homo sapiens
ugaggcaagagaauuguuu

SEQ ID NO: 597956 - RNA, 19 nt, Homo sapiens
ucucucaaguaguguauca

SEQ ID NO: 597957 - RNA, 19 nt, Homo sapiens
guagagcagccacaaccaa

SEQ ID NO: 597958 - RNA, 19 nt, Homo sapiens
gcauugcuuguuucuuaaa

SEQ ID NO: 597959 - RNA, 19 nt, Homo sapiens
uaaagaggauccugaguuu

SEQ ID NO: 597960 - RNA, 19 nt, Homo sapiens
gguaauacgugaggaauuu

SEQ ID NO: 597961 - RNA, 19 nt, Homo sapiens
guacuuauuugccuauuug

SEQ ID NO: 597962 - RNA, 19 nt, Homo sapiens
aguuggaccuugauauuua

SEQ ID NO: 597963 - RNA, 19 nt, Homo sapiens
uuacaugccaguacaauuu

SEQ ID NO: 597964 - RNA, 19 nt, Homo sapiens
gaacucggccuucgguuuc

SEQ ID NO: 597965 - RNA, 19 nt, Homo sapiens
guauugagcaucuguaaug

SEQ ID NO: 597966 - RNA, 19 nt, Homo sapiens
caucucagccucucgagua

SEQ ID NO: 597967 - RNA, 19 nt, Homo sapiens
gagacgguauugcuauguu

SEQ ID NO: 597968 - RNA, 19 nt, Homo sapiens
ggaacucggccuucgguuu

SEQ ID NO: 597969 - RNA, 19 nt, Homo sapiens
ggccaaggcuggagucuac

SEQ ID NO: 597970 - RNA, 19 nt, Homo sapiens
gaaaaucugaguuauggua

SEQ ID NO: 597971 - RNA, 19 nt, Homo sapiens
agucuacuaugucuucuuu

SEQ ID NO: 597972 - RNA, 19 nt, Homo sapiens
ggaccuugauauuuauucu

SEQ ID NO: 597973 - RNA, 19 nt, Homo sapiens
uuaaagaggauccugaguu

SEQ ID NO: 597974 - RNA, 19 nt, Homo sapiens
acaaagaggacacgaagga

SEQ ID NO: 597975 - RNA, 19 nt, Homo sapiens
gcggugcaaucaugaguca

SEQ ID NO: 597976 - RNA, 19 nt, Homo sapiens
guaauacgugaggaauuua

SEQ ID NO: 597977 - RNA, 19 nt, Homo sapiens
gcguccaucuucacacuga

SEQ ID NO: 597978 - RNA, 19 nt, Homo sapiens
gauccugaguuugugaaug

SEQ ID NO: 597979 - RNA, 19 nt, Homo sapiens
ucuacuaugucuucuuuca

SEQ ID NO: 597980 - RNA, 19 nt, Homo sapiens
guuggaccuugauauuuau

SEQ ID NO: 597981 - RNA, 19 nt, Homo sapiens
ccaagcaacugggauucau

SEQ ID NO: 597982 - RNA, 19 nt, Homo sapiens
ugccgaggcuggucuugaa

SEQ ID NO: 597983 - RNA, 19 nt, Homo sapiens
uacaugccaguacaauuua

SEQ ID NO: 597984 - RNA, 19 nt, Homo sapiens
caccacacuuggcuaacuu

SEQ ID NO: 597985 - RNA, 19 nt, Homo sapiens
cuagaaauagacugaaaga

SEQ ID NO: 597986 - RNA, 19 nt, Homo sapiens
aagaggauccugaguuugu

SEQ ID NO: 597987 - RNA, 19 nt, Homo sapiens
gcuggagucuacuaugucu

SEQ ID NO: 597988 - RNA, 19 nt, Homo sapiens
ugccaagguuguuuacaug

SEQ ID NO: 597989 - RNA, 19 nt, Homo sapiens
agacgguauugcuauguug

SEQ ID NO: 597990 - RNA, 19 nt, Homo sapiens
gggcucaggcuccguuuca

SEQ ID NO: 597991 - RNA, 19 nt, Homo sapiens
gcaaucaugagucaaugca

SEQ ID NO: 597992 - RNA, 19 nt, Homo sapiens
gcggagacgguauugcuau

SEQ ID NO: 597993 - RNA, 19 nt, Homo sapiens
aggcuggagucuacuaugu

SEQ ID NO: 597994 - RNA, 19 nt, Homo sapiens
gucuugaacuccuggacuu

SEQ ID NO: 597995 - RNA, 19 nt, Homo sapiens
cagcccaccuggacagagu

SEQ ID NO: 597996 - RNA, 19 nt, Homo sapiens
gggcguccaucuucacacu

SEQ ID NO: 597997 - RNA, 19 nt, Homo sapiens
cggagacgguauugcuaug

SEQ ID NO: 597998 - RNA, 19 nt, Homo sapiens
ccaccacacuuggcuaacu

SEQ ID NO: 597999 - RNA, 19 nt, Homo sapiens
gugcaaucaugagucaaug

SEQ ID NO: 598000 - RNA, 19 nt, Homo sapiens
ggugcaaucaugagucaau

SEQ ID NO: 598001 - RNA, 19 nt, Homo sapiens
ccaaggcuggagucuacua

SEQ ID NO: 598002 - RNA, 19 nt, Homo sapiens
gcuacaaagaggacacgaa

SEQ ID NO: 598003 - RNA, 19 nt, Homo sapiens
uaugucuucuuucaacuag

SEQ ID NO: 598004 - RNA, 19 nt, Homo sapiens
caugccaguacaauuuaua

SEQ ID NO: 598005 - RNA, 19 nt, Homo sapiens
cgugaggaauuuaaagacu

SEQ ID NO: 598006 - RNA, 19 nt, Homo sapiens
uugccaagguuguuuacau

SEQ ID NO: 598007 - RNA, 19 nt, Homo sapiens
guagcugggaccacaguug

SEQ ID NO: 598008 - RNA, 19 nt, Homo sapiens
aagaaaaucugaguuaugg

SEQ ID NO: 598009 - RNA, 19 nt, Homo sapiens
gaggauccugaguuuguga

SEQ ID NO: 598010 - RNA, 19 nt, Homo sapiens
ggucccugcugcuuucucu

SEQ ID NO: 598011 - RNA, 19 nt, Homo sapiens
gcugggucccugcugcuuu

SEQ ID NO: 598012 - RNA, 19 nt, Homo sapiens
ggagacgguauugcuaugu

SEQ ID NO: 598013 - RNA, 19 nt, Homo sapiens
guguauugagcaucuguaa

SEQ ID NO: 598014 - RNA, 19 nt, Homo sapiens
cuuauuugccuauuugugu

SEQ ID NO: 598015 - RNA, 19 nt, Homo sapiens
auacgccucugacgcuuca

SEQ ID NO: 598016 - RNA, 19 nt, Homo sapiens
uacuaugucuucuuucaac

SEQ ID NO: 598017 - RNA, 19 nt, Homo sapiens
aaguuggaccuugauauuu

SEQ ID NO: 598018 - RNA, 19 nt, Homo sapiens
gcugcuuucucuaccucaa

SEQ ID NO: 598019 - RNA, 19 nt, Homo sapiens
gccuauuuguguguauuga

SEQ ID NO: 598020 - RNA, 19 nt, Homo sapiens
uugaacuccuggacuuaga

SEQ ID NO: 598021 - RNA, 19 nt, Homo sapiens
cgaauccuacuccauccuu

SEQ ID NO: 598022 - RNA, 19 nt, Homo sapiens
ggaaagcccuuaucacguu

SEQ ID NO: 598023 - RNA, 19 nt, Homo sapiens
cagaauagcagcaguaaua

SEQ ID NO: 598024 - RNA, 19 nt, Homo sapiens
guagagaccuggacugaga

SEQ ID NO: 598025 - RNA, 19 nt, Homo sapiens
gaucggaagugccuacaaa

SEQ ID NO: 598026 - RNA, 19 nt, Homo sapiens
ggauaugcaugcaaucaaa

SEQ ID NO: 598027 - RNA, 19 nt, Homo sapiens
aacaauaccucaugucuuu

SEQ ID NO: 598028 - RNA, 19 nt, Homo sapiens
ggaagugccuacaaauuca

SEQ ID NO: 598029 - RNA, 19 nt, Homo sapiens
gacaaguucugcuaugaaa

SEQ ID NO: 598030 - RNA, 19 nt, Homo sapiens
ugaagaaucucacuaugga

SEQ ID NO: 598031 - RNA, 19 nt, Homo sapiens
caaauucaagcccuaaaua

SEQ ID NO: 598032 - RNA, 19 nt, Homo sapiens
ggaaaccacaguacucuaa

SEQ ID NO: 598033 - RNA, 19 nt, Homo sapiens
ggauuaugcuguaagaaau

SEQ ID NO: 598034 - RNA, 19 nt, Homo sapiens
gaacgagugugauauuacu

SEQ ID NO: 598035 - RNA, 19 nt, Homo sapiens
ggcaguggcacaaguauua

SEQ ID NO: 598036 - RNA, 19 nt, Homo sapiens
gcacauaccaacaacuuug

SEQ ID NO: 598037 - RNA, 19 nt, Homo sapiens
ggacaguauucuaagcaaa

SEQ ID NO: 598038 - RNA, 19 nt, Homo sapiens
ggaaugcuauggauuaugc

SEQ ID NO: 598039 - RNA, 19 nt, Homo sapiens
cacuagagcugguucauga

SEQ ID NO: 598040 - RNA, 19 nt, Homo sapiens
caccaaaucuucauaagca

SEQ ID NO: 598041 - RNA, 19 nt, Homo sapiens
gaagccaccugcauuugug

SEQ ID NO: 598042 - RNA, 19 nt, Homo sapiens
gugaacgagugugauauua

SEQ ID NO: 598043 - RNA, 19 nt, Homo sapiens
caggcaagcuuccagauug

SEQ ID NO: 598044 - RNA, 19 nt, Homo sapiens
aagcaucgcucuucucaug

SEQ ID NO: 598045 - RNA, 19 nt, Homo sapiens
gaagcagucugaguuacuu

SEQ ID NO: 598046 - RNA, 19 nt, Homo sapiens
caacagaauagcagcagua

SEQ ID NO: 598047 - RNA, 19 nt, Homo sapiens
caacuuccuucuaccauca

SEQ ID NO: 598048 - RNA, 19 nt, Homo sapiens
gaguuggugugaaugagua

SEQ ID NO: 598049 - RNA, 19 nt, Homo sapiens
gcccgucuaugauguguuu

SEQ ID NO: 598050 - RNA, 19 nt, Homo sapiens
gaccacauauaauccagaa

SEQ ID NO: 598051 - RNA, 19 nt, Homo sapiens
uaauaaggcuguccaucug

SEQ ID NO: 598052 - RNA, 19 nt, Homo sapiens
gaaaucacacugccuucaa

SEQ ID NO: 598053 - RNA, 19 nt, Homo sapiens
gggcccugcuguaacaaua

SEQ ID NO: 598054 - RNA, 19 nt, Homo sapiens
gcagcaguaauaucaguua

SEQ ID NO: 598055 - RNA, 19 nt, Homo sapiens
ggagaccgguggauucagu

SEQ ID NO: 598056 - RNA, 19 nt, Homo sapiens
gaacaacacacacacaaaa

SEQ ID NO: 598057 - RNA, 19 nt, Homo sapiens
ccaccaaucucauaauagg

SEQ ID NO: 598058 - RNA, 19 nt, Homo sapiens
gagcagcuguccacucgau

SEQ ID NO: 598059 - RNA, 19 nt, Homo sapiens
uguguucuguggauucuua

SEQ ID NO: 598060 - RNA, 19 nt, Homo sapiens
gcagaaagccaaaauguga

SEQ ID NO: 598061 - RNA, 19 nt, Homo sapiens
gcacaggucgaccacauau

SEQ ID NO: 598062 - RNA, 19 nt, Homo sapiens
ggaacaacacacacacaaa

SEQ ID NO: 598063 - RNA, 19 nt, Homo sapiens
gguaaugacuacggagcua

SEQ ID NO: 598064 - RNA, 19 nt, Homo sapiens
cauacucgcagcaguguua

SEQ ID NO: 598065 - RNA, 19 nt, Homo sapiens
uauaagagaagcagucuga

SEQ ID NO: 598066 - RNA, 19 nt, Homo sapiens
gaaucucacuauggaaaga

SEQ ID NO: 598067 - RNA, 19 nt, Homo sapiens
gcuccaaauucauucuuga

SEQ ID NO: 598068 - RNA, 19 nt, Homo sapiens
caaaagaccaugcuauaaa

SEQ ID NO: 598069 - RNA, 19 nt, Homo sapiens
ggaugugggcuauguagaa

SEQ ID NO: 598070 - RNA, 19 nt, Homo sapiens
caacaggccaacaaagcua

SEQ ID NO: 598071 - RNA, 19 nt, Homo sapiens
caaaugaagaaucucacua

SEQ ID NO: 598072 - RNA, 19 nt, Homo sapiens
ugccaccaaucucauaaua

SEQ ID NO: 598073 - RNA, 19 nt, Homo sapiens
ccaccugcauuugugauuu

SEQ ID NO: 598074 - RNA, 19 nt, Homo sapiens
ggugagaucauuccaacuu

SEQ ID NO: 598075 - RNA, 19 nt, Homo sapiens
cuaagcaaaugaagaaucu

SEQ ID NO: 598076 - RNA, 19 nt, Homo sapiens
acaggucgaccacauauaa

SEQ ID NO: 598077 - RNA, 19 nt, Homo sapiens
ccauguggcccgucuauga

SEQ ID NO: 598078 - RNA, 19 nt, Homo sapiens
gaauccaucacgugguaua

SEQ ID NO: 598079 - RNA, 19 nt, Homo sapiens
gaaggaagagagcagugaa

SEQ ID NO: 598080 - RNA, 19 nt, Homo sapiens
gaauuacagugguugaaaa

SEQ ID NO: 598081 - RNA, 19 nt, Homo sapiens
agacggauaugcaugcaau

SEQ ID NO: 598082 - RNA, 19 nt, Homo sapiens
gcugugaacgagugugaua

SEQ ID NO: 598083 - RNA, 19 nt, Homo sapiens
uccaucacgugguauauuu

SEQ ID NO: 598084 - RNA, 19 nt, Homo sapiens
ggaaauaaugucaaagaac

SEQ ID NO: 598085 - RNA, 19 nt, Homo sapiens
aagagaagguucgauccua

SEQ ID NO: 598086 - RNA, 19 nt, Homo sapiens
gaagagagcagugaaucca

SEQ ID NO: 598087 - RNA, 19 nt, Homo sapiens
ggaaugaaacugcagaaaa

SEQ ID NO: 598088 - RNA, 19 nt, Homo sapiens
ggacaccgccuugcacugu

SEQ ID NO: 598089 - RNA, 19 nt, Homo sapiens
gcagggacagauugcagua

SEQ ID NO: 598090 - RNA, 19 nt, Homo sapiens
uguggaaugcuauggauua

SEQ ID NO: 598091 - RNA, 19 nt, Homo sapiens
caagaggaguuggugugaa

SEQ ID NO: 598092 - RNA, 19 nt, Homo sapiens
gcaaaagaccaugcuauaa

SEQ ID NO: 598093 - RNA, 19 nt, Homo sapiens
cagaugaagacaauacauu

SEQ ID NO: 598094 - RNA, 19 nt, Homo sapiens
gaccagagacaaccagugu

SEQ ID NO: 598095 - RNA, 19 nt, Homo sapiens
ggucagugcccaccaaauc

SEQ ID NO: 598096 - RNA, 19 nt, Homo sapiens
ggagguggagccugccuuu

SEQ ID NO: 598097 - RNA, 19 nt, Homo sapiens
agagaagcagucugaguua

SEQ ID NO: 598098 - RNA, 19 nt, Homo sapiens
gaaugaguauggucuucca

SEQ ID NO: 598099 - RNA, 19 nt, Homo sapiens
aagaggaguuggugugaau

SEQ ID NO: 598100 - RNA, 19 nt, Homo sapiens
cgugguauauuugaagaaa

SEQ ID NO: 598101 - RNA, 19 nt, Homo sapiens
cggaagugccuacaaauuc

SEQ ID NO: 598102 - RNA, 19 nt, Homo sapiens
ugaguauggucuuccaaug

SEQ ID NO: 598103 - RNA, 19 nt, Homo sapiens
uggauucuauuuacaagga

SEQ ID NO: 598104 - RNA, 19 nt, Homo sapiens
cugauuauguggagauuca

SEQ ID NO: 598105 - RNA, 19 nt, Homo sapiens
uaacaauaccucaugucuu

SEQ ID NO: 598106 - RNA, 19 nt, Homo sapiens
gcuauggauuaugcuguaa

SEQ ID NO: 598107 - RNA, 19 nt, Homo sapiens
ggaauccaaugggaaccuu

SEQ ID NO: 598108 - RNA, 19 nt, Homo sapiens
gcagaugcuccaugaguuc

SEQ ID NO: 598109 - RNA, 19 nt, Homo sapiens
guggagagcacuguuacua

SEQ ID NO: 598110 - RNA, 19 nt, Homo sapiens
ugacuacggagcuaaaguu

SEQ ID NO: 598111 - RNA, 19 nt, Homo sapiens
aauagcagcaguaauauca

SEQ ID NO: 598112 - RNA, 19 nt, Homo sapiens
gaugugggcuauguagaag

SEQ ID NO: 598113 - RNA, 19 nt, Homo sapiens
caugauguguucuguggau

SEQ ID NO: 598114 - RNA, 19 nt, Homo sapiens
gauggagaccgguggauuc

SEQ ID NO: 598115 - RNA, 19 nt, Homo sapiens
ggucugacaaguucugcua

SEQ ID NO: 598116 - RNA, 19 nt, Homo sapiens
ggagugugauugugguuuu

SEQ ID NO: 598117 - RNA, 19 nt, Homo sapiens
uggcaggacaguauucuaa

SEQ ID NO: 598118 - RNA, 19 nt, Homo sapiens
gaauagcagcaguaauauc

SEQ ID NO: 598119 - RNA, 19 nt, Homo sapiens
ugacaaggaugggguaaaa

SEQ ID NO: 598120 - RNA, 19 nt, Homo sapiens
gcacugagaagggaaacug

SEQ ID NO: 598121 - RNA, 19 nt, Homo sapiens
uggauuaugcuguaagaaa

SEQ ID NO: 598122 - RNA, 19 nt, Homo sapiens
ggaaagaucugcauccaua

SEQ ID NO: 598123 - RNA, 19 nt, Homo sapiens
ggaaagagguugcaucaug

SEQ ID NO: 598124 - RNA, 19 nt, Homo sapiens
gaacauaucugacauuggu

SEQ ID NO: 598125 - RNA, 19 nt, Homo sapiens
gcaguuagguacuuacaua

SEQ ID NO: 598126 - RNA, 19 nt, Homo sapiens
gcaaagaucuucccuuaca

SEQ ID NO: 598127 - RNA, 19 nt, Homo sapiens
gaaagagguugcaucauga

SEQ ID NO: 598128 - RNA, 19 nt, Homo sapiens
gacaagaggucaaugaaug

SEQ ID NO: 598129 - RNA, 19 nt, Homo sapiens
gcacauuucugaccauuuc

SEQ ID NO: 598130 - RNA, 19 nt, Homo sapiens
ccagaaagcugcaaagauc

SEQ ID NO: 598131 - RNA, 19 nt, Homo sapiens
cugcaaagaucuucccuua

SEQ ID NO: 598132 - RNA, 19 nt, Homo sapiens
gaggauguauuucuuguug

SEQ ID NO: 598133 - RNA, 19 nt, Homo sapiens
ccugagaccugcaauauga

SEQ ID NO: 598134 - RNA, 19 nt, Homo sapiens
ucauaucucugaugucuuu

SEQ ID NO: 598135 - RNA, 19 nt, Homo sapiens
gcuaugagauguggcuuaa

SEQ ID NO: 598136 - RNA, 19 nt, Homo sapiens
gaucuucccuuacauuagu

SEQ ID NO: 598137 - RNA, 19 nt, Homo sapiens
aaacugagcacauuucuga

SEQ ID NO: 598138 - RNA, 19 nt, Homo sapiens
ugacauuggugaagugaaa

SEQ ID NO: 598139 - RNA, 19 nt, Homo sapiens
gaacucagcucuggaacca

SEQ ID NO: 598140 - RNA, 19 nt, Homo sapiens
gaaagaugguacugugugu

SEQ ID NO: 598141 - RNA, 19 nt, Homo sapiens
gaucaugucugcauaaucc

SEQ ID NO: 598142 - RNA, 19 nt, Homo sapiens
gcagcacacucauaucaau

SEQ ID NO: 598143 - RNA, 19 nt, Homo sapiens
ggaauggugugguugaaag

SEQ ID NO: 598144 - RNA, 19 nt, Homo sapiens
guauaaauggcacaacaua

SEQ ID NO: 598145 - RNA, 19 nt, Homo sapiens
gcagcaugaugaagaauuc

SEQ ID NO: 598146 - RNA, 19 nt, Homo sapiens
guagaaacauuaguacauc

SEQ ID NO: 598147 - RNA, 19 nt, Homo sapiens
ggggaaaucuuuaugcuaa

SEQ ID NO: 598148 - RNA, 19 nt, Homo sapiens
caaauaaagcuacauccuu

SEQ ID NO: 598149 - RNA, 19 nt, Homo sapiens
cuaaagcgcugugggaaug

SEQ ID NO: 598150 - RNA, 19 nt, Homo sapiens
ggugaaccaugauuucuuc

SEQ ID NO: 598151 - RNA, 19 nt, Homo sapiens
ccagaugacuguuacuauc

SEQ ID NO: 598152 - RNA, 19 nt, Homo sapiens
gagacacaauucccagcua

SEQ ID NO: 598153 - RNA, 19 nt, Homo sapiens
ccagaauggugcaauggaa

SEQ ID NO: 598154 - RNA, 19 nt, Homo sapiens
ggauggcucuccuauaguc

SEQ ID NO: 598155 - RNA, 19 nt, Homo sapiens
ggguauugacuaucauuua

SEQ ID NO: 598156 - RNA, 19 nt, Homo sapiens
gaauaugucguccaccuau

SEQ ID NO: 598157 - RNA, 19 nt, Homo sapiens
uaugagauguggcuuaaca

SEQ ID NO: 598158 - RNA, 19 nt, Homo sapiens
gaaugugaccuuccagaau

SEQ ID NO: 598159 - RNA, 19 nt, Homo sapiens
gagguugcaucaugaauac

SEQ ID NO: 598160 - RNA, 19 nt, Homo sapiens
ugacuuuccuguuuacugu

SEQ ID NO: 598161 - RNA, 19 nt, Homo sapiens
gaaagaucugcauccauaa

SEQ ID NO: 598162 - RNA, 19 nt, Homo sapiens
aaacuaaggcucauucauc

SEQ ID NO: 598163 - RNA, 19 nt, Homo sapiens
ugauugugauuccuucuuu

SEQ ID NO: 598164 - RNA, 19 nt, Homo sapiens
uggaacaucucaucagugu

SEQ ID NO: 598165 - RNA, 19 nt, Homo sapiens
ggaaguagcacgccaacag

SEQ ID NO: 598166 - RNA, 19 nt, Homo sapiens
uggccucacuuaugaaauu

SEQ ID NO: 598167 - RNA, 19 nt, Homo sapiens
gagcacauuucugaccauu

SEQ ID NO: 598168 - RNA, 19 nt, Homo sapiens
gaucugcaauaacaaacau

SEQ ID NO: 598169 - RNA, 19 nt, Homo sapiens
aaugugaccuuccagaaug

SEQ ID NO: 598170 - RNA, 19 nt, Homo sapiens
guagacaagaggucaauga

SEQ ID NO: 598171 - RNA, 19 nt, Homo sapiens
ggugcaagaggauguauuu

SEQ ID NO: 598172 - RNA, 19 nt, Homo sapiens
agauguggcuuaacagaga

SEQ ID NO: 598173 - RNA, 19 nt, Homo sapiens
ccaacacuguggcccauga

SEQ ID NO: 598174 - RNA, 19 nt, Homo sapiens
gaaauuuggaaucaaggaa

SEQ ID NO: 598175 - RNA, 19 nt, Homo sapiens
ggcaguagaaacauuagua

SEQ ID NO: 598176 - RNA, 19 nt, Homo sapiens
cuggauggcucuccuauag

SEQ ID NO: 598177 - RNA, 19 nt, Homo sapiens
agacauuccucuucuccaa

SEQ ID NO: 598178 - RNA, 19 nt, Homo sapiens
cuguugaacugcacucuaa

SEQ ID NO: 598179 - RNA, 19 nt, Homo sapiens
acaauguucuggucccaaa

SEQ ID NO: 598180 - RNA, 19 nt, Homo sapiens
ugaacgauuucucucaaug

SEQ ID NO: 598181 - RNA, 19 nt, Homo sapiens
ggauguauuucuuguuguc

SEQ ID NO: 598182 - RNA, 19 nt, Homo sapiens
ucucagaauugcuauaaag

SEQ ID NO: 598183 - RNA, 19 nt, Homo sapiens
acucagcucuggaaccaaa

SEQ ID NO: 598184 - RNA, 19 nt, Homo sapiens
gcaauggaacaucucauca

SEQ ID NO: 598185 - RNA, 19 nt, Homo sapiens
guacagcagugugaacaag

SEQ ID NO: 598186 - RNA, 19 nt, Homo sapiens
aaagagaagagcaguguga

SEQ ID NO: 598187 - RNA, 19 nt, Homo sapiens
ggaauaugucguccaccua

SEQ ID NO: 598188 - RNA, 19 nt, Homo sapiens
cauuugaacaccugguuua

SEQ ID NO: 598189 - RNA, 19 nt, Homo sapiens
caaagaaacuaaggcucau

SEQ ID NO: 598190 - RNA, 19 nt, Homo sapiens
gggcuuucgaggaguauua

SEQ ID NO: 598191 - RNA, 19 nt, Homo sapiens
ggaugaacauaucugacau

SEQ ID NO: 598192 - RNA, 19 nt, Homo sapiens
gugggagaguucaauguga

SEQ ID NO: 598193 - RNA, 19 nt, Homo sapiens
caucucagaauugcuauaa

SEQ ID NO: 598194 - RNA, 19 nt, Homo sapiens
agacacaauucccagcuau

SEQ ID NO: 598195 - RNA, 19 nt, Homo sapiens
caaaagagguguaauaacc

SEQ ID NO: 598196 - RNA, 19 nt, Homo sapiens
gaaacuaaggcucauucau

SEQ ID NO: 598197 - RNA, 19 nt, Homo sapiens
gauugugauuccuucuuug

SEQ ID NO: 598198 - RNA, 19 nt, Homo sapiens
ugucauaucucugaugucu

SEQ ID NO: 598199 - RNA, 19 nt, Homo sapiens
gugcaucucagaauugcua

SEQ ID NO: 598200 - RNA, 19 nt, Homo sapiens
cacuguggcccaugaguua

SEQ ID NO: 598201 - RNA, 19 nt, Homo sapiens
caaagcaacaucucaaagg

SEQ ID NO: 598202 - RNA, 19 nt, Homo sapiens
gcacucugccacauuugaa

SEQ ID NO: 598203 - RNA, 19 nt, Homo sapiens
gaugaacauaucugacauu

SEQ ID NO: 598204 - RNA, 19 nt, Homo sapiens
gaacgauuucucucaaugg

SEQ ID NO: 598205 - RNA, 19 nt, Homo sapiens
aaagcaacaucucaaaggu

SEQ ID NO: 598206 - RNA, 19 nt, Homo sapiens
gaaguagcacgccaacagu

SEQ ID NO: 598207 - RNA, 19 nt, Homo sapiens
aaagaucuucccuuacauu

SEQ ID NO: 598208 - RNA, 19 nt, Homo sapiens
caaagaucuucccuuacau

SEQ ID NO: 598209 - RNA, 19 nt, Homo sapiens
uuaguacacuuuagucucu

SEQ ID NO: 598210 - RNA, 19 nt, Homo sapiens
aacuaaggcucauucauca

SEQ ID NO: 598211 - RNA, 19 nt, Homo sapiens
gcaaagacugcaaguucau

SEQ ID NO: 598212 - RNA, 19 nt, Homo sapiens
agagguugcaucaugaaua

SEQ ID NO: 598213 - RNA, 19 nt, Homo sapiens
gauguggcuuaacagagaa

SEQ ID NO: 598214 - RNA, 19 nt, Homo sapiens
cccagcaucugcaaagaga

SEQ ID NO: 598215 - RNA, 19 nt, Homo sapiens
ugaaggggaucugcaauaa

SEQ ID NO: 598216 - RNA, 19 nt, Homo sapiens
caaugaaugugaccuucca

SEQ ID NO: 598217 - RNA, 19 nt, Homo sapiens
gggaucaugucugcauaau

SEQ ID NO: 598218 - RNA, 19 nt, Homo sapiens
cagggaucaugucugcaua

SEQ ID NO: 598219 - RNA, 19 nt, Homo sapiens
ccugaacgauuucucucaa

SEQ ID NO: 598220 - RNA, 19 nt, Homo sapiens
aagaucuucccuuacauua

SEQ ID NO: 598221 - RNA, 19 nt, Homo sapiens
aaaagugcaucucagaauu

SEQ ID NO: 598222 - RNA, 19 nt, Homo sapiens
gggaauauauuuagacuga

SEQ ID NO: 598223 - RNA, 19 nt, Homo sapiens
uaaagaagaugaagaagga

SEQ ID NO: 598224 - RNA, 19 nt, Homo sapiens
ggugaaagauggcacagua

SEQ ID NO: 598225 - RNA, 19 nt, Homo sapiens
gaacaacauggaaggauua

SEQ ID NO: 598226 - RNA, 19 nt, Homo sapiens
caacaacagugcagcauga

SEQ ID NO: 598227 - RNA, 19 nt, Homo sapiens
uaaauaagcuguuguuugc

SEQ ID NO: 598228 - RNA, 19 nt, Homo sapiens
ccuaagaccugcaacauga

SEQ ID NO: 598229 - RNA, 19 nt, Homo sapiens
gagcuacaguggugcauaa

SEQ ID NO: 598230 - RNA, 19 nt, Homo sapiens
auagaaaggugacaacuaa

SEQ ID NO: 598231 - RNA, 19 nt, Homo sapiens
gauuaaaugugaugggaaa

SEQ ID NO: 598232 - RNA, 19 nt, Homo sapiens
gcaguuaugcccaauauug

SEQ ID NO: 598233 - RNA, 19 nt, Homo sapiens
gaagaaggauaagagaaau

SEQ ID NO: 598234 - RNA, 19 nt, Homo sapiens
gaaaggugacaacuaaauu

SEQ ID NO: 598235 - RNA, 19 nt, Homo sapiens
gaguugcaauugucauaua

SEQ ID NO: 598236 - RNA, 19 nt, Homo sapiens
guaaauaagcuguuguuug

SEQ ID NO: 598237 - RNA, 19 nt, Homo sapiens
gacgggaucuccuguaaug

SEQ ID NO: 598238 - RNA, 19 nt, Homo sapiens
uacagugucuuaagcaaua

SEQ ID NO: 598239 - RNA, 19 nt, Homo sapiens
gacaaaggcuauggaggua

SEQ ID NO: 598240 - RNA, 19 nt, Homo sapiens
gaaaucaacacccaaggaa

SEQ ID NO: 598241 - RNA, 19 nt, Homo sapiens
gaacaccuaguauauaaga

SEQ ID NO: 598242 - RNA, 19 nt, Homo sapiens
gaaaucaagccaauuagug

SEQ ID NO: 598243 - RNA, 19 nt, Homo sapiens
gaauaugccagaauccuuu

SEQ ID NO: 598244 - RNA, 19 nt, Homo sapiens
caacauggaaggauuaaau

SEQ ID NO: 598245 - RNA, 19 nt, Homo sapiens
gaaguacugugggaaucua

SEQ ID NO: 598246 - RNA, 19 nt, Homo sapiens
aaagaucccuguugucugu

SEQ ID NO: 598247 - RNA, 19 nt, Homo sapiens
gaaaauagcacaccagaug

SEQ ID NO: 598248 - RNA, 19 nt, Homo sapiens
acagauaaaugaccuuguu

SEQ ID NO: 598249 - RNA, 19 nt, Homo sapiens
cauaaugcaugccuauaga

SEQ ID NO: 598250 - RNA, 19 nt, Homo sapiens
gccacgagcuuggucauaa

SEQ ID NO: 598251 - RNA, 19 nt, Homo sapiens
guggagaccuagauaaugu

SEQ ID NO: 598252 - RNA, 19 nt, Homo sapiens
ccuagccuauucuuacuua

SEQ ID NO: 598253 - RNA, 19 nt, Homo sapiens
ggucguggauaauauuaga

SEQ ID NO: 598254 - RNA, 19 nt, Homo sapiens
gauacacaguuuccaccua

SEQ ID NO: 598255 - RNA, 19 nt, Homo sapiens
gauagacagugaugauaca

SEQ ID NO: 598256 - RNA, 19 nt, Homo sapiens
cagaaguggugaucccuuu

SEQ ID NO: 598257 - RNA, 19 nt, Homo sapiens
ugacuggaauugauauaug

SEQ ID NO: 598258 - RNA, 19 nt, Homo sapiens
ugaagaaggauaagagaaa

SEQ ID NO: 598259 - RNA, 19 nt, Homo sapiens
ggaguaauucccaaucuga

SEQ ID NO: 598260 - RNA, 19 nt, Homo sapiens
uaaaugugaugggaaaguu

SEQ ID NO: 598261 - RNA, 19 nt, Homo sapiens
gaagcuugguguugccuau

SEQ ID NO: 598262 - RNA, 19 nt, Homo sapiens
uauauggacugcaucaaau

SEQ ID NO: 598263 - RNA, 19 nt, Homo sapiens
gagauacauuguccacaug

SEQ ID NO: 598264 - RNA, 19 nt, Homo sapiens
agccaugucucacuguuua

SEQ ID NO: 598265 - RNA, 19 nt, Homo sapiens
gaagccaugucucacuguu

SEQ ID NO: 598266 - RNA, 19 nt, Homo sapiens
cagaguugcuaccaagaaa

SEQ ID NO: 598267 - RNA, 19 nt, Homo sapiens
gugaaugccuucugcuaug

SEQ ID NO: 598268 - RNA, 19 nt, Homo sapiens
ggaaugcuacagauaaaug

SEQ ID NO: 598269 - RNA, 19 nt, Homo sapiens
uaagaagugugccaguaug

SEQ ID NO: 598270 - RNA, 19 nt, Homo sapiens
cguaagaagugugccagua

SEQ ID NO: 598271 - RNA, 19 nt, Homo sapiens
gaaagauggcacaguaugu

SEQ ID NO: 598272 - RNA, 19 nt, Homo sapiens
ggaaucuagugguugaaga

SEQ ID NO: 598273 - RNA, 19 nt, Homo sapiens
ccuaugagauguggguuaa

SEQ ID NO: 598274 - RNA, 19 nt, Homo sapiens
gcaaggagugcaucucaga

SEQ ID NO: 598275 - RNA, 19 nt, Homo sapiens
aaaggaauaugccagaauc

SEQ ID NO: 598276 - RNA, 19 nt, Homo sapiens
gaagugugccaguaugguu

SEQ ID NO: 598277 - RNA, 19 nt, Homo sapiens
gggaucuccuguaauguga

SEQ ID NO: 598278 - RNA, 19 nt, Homo sapiens
gaaguggugaucccuuuga

SEQ ID NO: 598279 - RNA, 19 nt, Homo sapiens
agaacaacauggaaggauu

SEQ ID NO: 598280 - RNA, 19 nt, Homo sapiens
guaagaagugugccaguau

SEQ ID NO: 598281 - RNA, 19 nt, Homo sapiens
ggauggcuauaccugauau

SEQ ID NO: 598282 - RNA, 19 nt, Homo sapiens
aguaguggauuauguauuc

SEQ ID NO: 598283 - RNA, 19 nt, Homo sapiens
gaggguaaauaagcuguug

SEQ ID NO: 598284 - RNA, 19 nt, Homo sapiens
guaguggucguggauaaua

SEQ ID NO: 598285 - RNA, 19 nt, Homo sapiens
caaaggcuauggagguagu

SEQ ID NO: 598286 - RNA, 19 nt, Homo sapiens
caacaacaaacaacacugu

SEQ ID NO: 598287 - RNA, 19 nt, Homo sapiens
gaaaagacguguaauaacc

SEQ ID NO: 598288 - RNA, 19 nt, Homo sapiens
gaaucuagugguugaagaa

SEQ ID NO: 598289 - RNA, 19 nt, Homo sapiens
uaucaguaguggauuaugu

SEQ ID NO: 598290 - RNA, 19 nt, Homo sapiens
cuggauggcucuccuauag

SEQ ID NO: 598291 - RNA, 19 nt, Homo sapiens
gauguggguuaacagaaga

SEQ ID NO: 598292 - RNA, 19 nt, Homo sapiens
gcaaagacugcaaauuucu

SEQ ID NO: 598293 - RNA, 19 nt, Homo sapiens
ggaauauguugcaaagacu

SEQ ID NO: 598294 - RNA, 19 nt, Homo sapiens
gugggaaucuagugguuga

SEQ ID NO: 598295 - RNA, 19 nt, Homo sapiens
ggaauaugccagaauccuu

SEQ ID NO: 598296 - RNA, 19 nt, Homo sapiens
ucaaaguaaugcaacaaca

SEQ ID NO: 598297 - RNA, 19 nt, Homo sapiens
uauugugccuucuuccuuu

SEQ ID NO: 598298 - RNA, 19 nt, Homo sapiens
aaaguugcguuaccuguca

SEQ ID NO: 598299 - RNA, 19 nt, Homo sapiens
gugggaggguucaguguga

SEQ ID NO: 598300 - RNA, 19 nt, Homo sapiens
guauucaaccgccuccaua

SEQ ID NO: 598301 - RNA, 19 nt, Homo sapiens
cagauggaguugcaauugu

SEQ ID NO: 598302 - RNA, 19 nt, Homo sapiens
uaagauagacagugaugau

SEQ ID NO: 598303 - RNA, 19 nt, Homo sapiens
gaaugcuacagauaaauga

SEQ ID NO: 598304 - RNA, 19 nt, Homo sapiens
guaggcacaacauauguaa

SEQ ID NO: 598305 - RNA, 19 nt, Homo sapiens
gccaggcccucccaguauu

SEQ ID NO: 598306 - RNA, 19 nt, Homo sapiens
cgagcuuggucauaauuug

SEQ ID NO: 598307 - RNA, 19 nt, Homo sapiens
gcaugaaguauuuaacguu

SEQ ID NO: 598308 - RNA, 19 nt, Homo sapiens
cauuagcuaucacagcaaa

SEQ ID NO: 598309 - RNA, 19 nt, Homo sapiens
ugaaugccuucugcuauga

SEQ ID NO: 598310 - RNA, 19 nt, Homo sapiens
gaucuccuguaaugugaau

SEQ ID NO: 598311 - RNA, 19 nt, Homo sapiens
gaaugugaccuuccagagu

SEQ ID NO: 598312 - RNA, 19 nt, Homo sapiens
gaaugugacuguggaacca

SEQ ID NO: 598313 - RNA, 19 nt, Homo sapiens
ggagaccuagauaauguuu

SEQ ID NO: 598314 - RNA, 19 nt, Homo sapiens
auacacaguuuccaccuau

SEQ ID NO: 598315 - RNA, 19 nt, Homo sapiens
ccucacaccuuguucucuu

SEQ ID NO: 598316 - RNA, 19 nt, Homo sapiens
gggaaucugcaacaacaaa

SEQ ID NO: 598317 - RNA, 19 nt, Homo sapiens
ccacgagcuuggucauaau

SEQ ID NO: 598318 - RNA, 19 nt, Homo sapiens
agagauacauuguccacau

SEQ ID NO: 598319 - RNA, 19 nt, Homo sapiens
ggagguugauguaauuuug

SEQ ID NO: 598320 - RNA, 19 nt, Homo sapiens
caacagugcagcaugaagu

SEQ ID NO: 598321 - RNA, 19 nt, Homo sapiens
gaugaagaaggauaagaga

SEQ ID NO: 598322 - RNA, 19 nt, Homo sapiens
gaacuuccauagcaaauaa

SEQ ID NO: 598323 - RNA, 19 nt, Homo sapiens
ggaaagggauauguaauaa

SEQ ID NO: 598324 - RNA, 19 nt, Homo sapiens
gcacagaacuuccauagca

SEQ ID NO: 598325 - RNA, 19 nt, Homo sapiens
gaaugugacugugguaaua

SEQ ID NO: 598326 - RNA, 19 nt, Homo sapiens
ggacauagaccuccagauu

SEQ ID NO: 598327 - RNA, 19 nt, Homo sapiens
gaaacuggaucuuugcauu

SEQ ID NO: 598328 - RNA, 19 nt, Homo sapiens
ggaugcugaugauauauua

SEQ ID NO: 598329 - RNA, 19 nt, Homo sapiens
caaauugacuguuauacug

SEQ ID NO: 598330 - RNA, 19 nt, Homo sapiens
ccagaaauguacuguguaa

SEQ ID NO: 598331 - RNA, 19 nt, Homo sapiens
gaacagacaaugccuaugu

SEQ ID NO: 598332 - RNA, 19 nt, Homo sapiens
ggaacugccuauugcuaua

SEQ ID NO: 598333 - RNA, 19 nt, Homo sapiens
cgaagguucugaaggaaua

SEQ ID NO: 598334 - RNA, 19 nt, Homo sapiens
gaauuguggucaaaugaaa

SEQ ID NO: 598335 - RNA, 19 nt, Homo sapiens
ccacgaagguucugaagga

SEQ ID NO: 598336 - RNA, 19 nt, Homo sapiens
gggaaagggauauguaaua

SEQ ID NO: 598337 - RNA, 19 nt, Homo sapiens
gcgaugacgugggacauua

SEQ ID NO: 598338 - RNA, 19 nt, Homo sapiens
ggaauccaaugaagaaugu

SEQ ID NO: 598339 - RNA, 19 nt, Homo sapiens
gcaauggaaccucuaguaa

SEQ ID NO: 598340 - RNA, 19 nt, Homo sapiens
uaaugaaacuggaucuuug

SEQ ID NO: 598341 - RNA, 19 nt, Homo sapiens
gagagaaugcagaguauaa

SEQ ID NO: 598342 - RNA, 19 nt, Homo sapiens
ccauguauguguaucuaua

SEQ ID NO: 598343 - RNA, 19 nt, Homo sapiens
uaaccagugugccaagaua

SEQ ID NO: 598344 - RNA, 19 nt, Homo sapiens
aauggaaccucuaguaauu

SEQ ID NO: 598345 - RNA, 19 nt, Homo sapiens
ugacauagcauacuuacuu

SEQ ID NO: 598346 - RNA, 19 nt, Homo sapiens
gagacuaaaugccuucaga

SEQ ID NO: 598347 - RNA, 19 nt, Homo sapiens
ccuuuaaacucacagauaa

SEQ ID NO: 598348 - RNA, 19 nt, Homo sapiens
uggaacaacugguuuauuc

SEQ ID NO: 598349 - RNA, 19 nt, Homo sapiens
gauuguaaauuccaguuug

SEQ ID NO: 598350 - RNA, 19 nt, Homo sapiens
uauuauagcucaacugcuu

SEQ ID NO: 598351 - RNA, 19 nt, Homo sapiens
aagaagugcugugauuaua

SEQ ID NO: 598352 - RNA, 19 nt, Homo sapiens
cacggaagauuaagucaaa

SEQ ID NO: 598353 - RNA, 19 nt, Homo sapiens
ucaagaccauguaugugua

SEQ ID NO: 598354 - RNA, 19 nt, Homo sapiens
gaagugcugugauuauaac

SEQ ID NO: 598355 - RNA, 19 nt, Homo sapiens
gaaagaccagcccuacaaa

SEQ ID NO: 598356 - RNA, 19 nt, Homo sapiens
uaugggaucugaaaugaug

SEQ ID NO: 598357 - RNA, 19 nt, Homo sapiens
uauaugggaucugaaauga

SEQ ID NO: 598358 - RNA, 19 nt, Homo sapiens
gaccagcccuacaaaguuc

SEQ ID NO: 598359 - RNA, 19 nt, Homo sapiens
cagagaggaagaugauuua

SEQ ID NO: 598360 - RNA, 19 nt, Homo sapiens
ucagaagcuuucaaauuug

SEQ ID NO: 598361 - RNA, 19 nt, Homo sapiens
aggauaugcugccgaauuu

SEQ ID NO: 598362 - RNA, 19 nt, Homo sapiens
gaccauguauguguaucua

SEQ ID NO: 598363 - RNA, 19 nt, Homo sapiens
ugaaagaucugaaaacugu

SEQ ID NO: 598364 - RNA, 19 nt, Homo sapiens
gaacugccuauugcuauaa

SEQ ID NO: 598365 - RNA, 19 nt, Homo sapiens
uaacacauguaaacugaag

SEQ ID NO: 598366 - RNA, 19 nt, Homo sapiens
gacauagcauacuuacuug

SEQ ID NO: 598367 - RNA, 19 nt, Homo sapiens
ggaagauuaagucaaauga

SEQ ID NO: 598368 - RNA, 19 nt, Homo sapiens
cagcaagauuugagcauau

SEQ ID NO: 598369 - RNA, 19 nt, Homo sapiens
gcauugccauuaccaagga

SEQ ID NO: 598370 - RNA, 19 nt, Homo sapiens
acauagaccuccagauugu

SEQ ID NO: 598371 - RNA, 19 nt, Homo sapiens
uuuaagaagugcugugauu

SEQ ID NO: 598372 - RNA, 19 nt, Homo sapiens
aaugauggcuguaacacaa

SEQ ID NO: 598373 - RNA, 19 nt, Homo sapiens
ucagcaagauuugagcaua

SEQ ID NO: 598374 - RNA, 19 nt, Homo sapiens
cagagagaaugcagaguau

SEQ ID NO: 598375 - RNA, 19 nt, Homo sapiens
gaacaacugguuuauucug

SEQ ID NO: 598376 - RNA, 19 nt, Homo sapiens
agaggaagaugauuuacau

SEQ ID NO: 598377 - RNA, 19 nt, Homo sapiens
gcacgacuauagauauuuu

SEQ ID NO: 598378 - RNA, 19 nt, Homo sapiens
gaaacgggacuaucucauc

SEQ ID NO: 598379 - RNA, 19 nt, Homo sapiens
gaauugaaccaguagaauc

SEQ ID NO: 598380 - RNA, 19 nt, Homo sapiens
gcagugagugccaguggua

SEQ ID NO: 598381 - RNA, 19 nt, Homo sapiens
gacauagaccuccagauug

SEQ ID NO: 598382 - RNA, 19 nt, Homo sapiens
guccagaaauguacugugu

SEQ ID NO: 598383 - RNA, 19 nt, Homo sapiens
ggaauuguggucaaaugaa

SEQ ID NO: 598384 - RNA, 19 nt, Homo sapiens
ggacaaccuuacacucuac

SEQ ID NO: 598385 - RNA, 19 nt, Homo sapiens
gauuauaugggaucugaaa

SEQ ID NO: 598386 - RNA, 19 nt, Homo sapiens
gacgcucaaucuacaguuu

SEQ ID NO: 598387 - RNA, 19 nt, Homo sapiens
uaagaagugcugugauuau

SEQ ID NO: 598388 - RNA, 19 nt, Homo sapiens
ucagagaggaagaugauuu

SEQ ID NO: 598389 - RNA, 19 nt, Homo sapiens
acagagagaaugcagagua

SEQ ID NO: 598390 - RNA, 19 nt, Homo sapiens
uuaauucucugcaugaaag

SEQ ID NO: 598391 - RNA, 19 nt, Homo sapiens
gaguauugauccagagugu

SEQ ID NO: 598392 - RNA, 19 nt, Homo sapiens
caauagguuuggagggauu

SEQ ID NO: 598393 - RNA, 19 nt, Homo sapiens
ucaaaugacagugaaguuu

SEQ ID NO: 598394 - RNA, 19 nt, Homo sapiens
gaaaucuggugacuuuuau

SEQ ID NO: 598395 - RNA, 19 nt, Homo sapiens
ucacugagcuuggaagacu

SEQ ID NO: 598396 - RNA, 19 nt, Homo sapiens
auucugaguuucugcauuu

SEQ ID NO: 598397 - RNA, 19 nt, Homo sapiens
gauaaccagugugccaaga

SEQ ID NO: 598398 - RNA, 19 nt, Homo sapiens
acagaguacugcaauggaa

SEQ ID NO: 598399 - RNA, 19 nt, Homo sapiens
caaaugacagugaaguuuc

SEQ ID NO: 598400 - RNA, 19 nt, Homo sapiens
ugacgugggacauuaauau

SEQ ID NO: 598401 - RNA, 19 nt, Homo sapiens
uaauucauccguuguauca

SEQ ID NO: 598402 - RNA, 19 nt, Homo sapiens
gaaccucuaguaauugugu

SEQ ID NO: 598403 - RNA, 19 nt, Homo sapiens
guauugauccagaguguga

SEQ ID NO: 598404 - RNA, 19 nt, Homo sapiens
gcaugcacgacuauagaua

SEQ ID NO: 598405 - RNA, 19 nt, Homo sapiens
ccaguagaaucuucagcaa

SEQ ID NO: 598406 - RNA, 19 nt, Homo sapiens
caaugucaaacuacugaua

SEQ ID NO: 598407 - RNA, 19 nt, Homo sapiens
gaagaaugugacuguggua

SEQ ID NO: 598408 - RNA, 19 nt, Homo sapiens
uugcaaccauuacaucaaa

SEQ ID NO: 598409 - RNA, 19 nt, Homo sapiens
agaaagaccagcccuacaa

SEQ ID NO: 598410 - RNA, 19 nt, Homo sapiens
caauggaaccucuaguaau

SEQ ID NO: 598411 - RNA, 19 nt, Homo sapiens
caauugauggacaaccuua

SEQ ID NO: 598412 - RNA, 19 nt, Homo sapiens
gcucaacugcuuggccuua

SEQ ID NO: 598413 - RNA, 19 nt, Homo sapiens
guaaaucauguaacagaga

SEQ ID NO: 598414 - RNA, 19 nt, Homo sapiens
aaagggaaagggauaugua

SEQ ID NO: 598415 - RNA, 19 nt, Homo sapiens
uggacaaccuuacacucua

SEQ ID NO: 598416 - RNA, 19 nt, Homo sapiens
gcaagauuugagcauauaa

SEQ ID NO: 598417 - RNA, 19 nt, Homo sapiens
caacugguuuauucugagu

SEQ ID NO: 598418 - RNA, 19 nt, Homo sapiens
caugugugguccagaaaug

SEQ ID NO: 598419 - RNA, 19 nt, Homo sapiens
ggaaaacaaucauucuuac

SEQ ID NO: 598420 - RNA, 19 nt, Homo sapiens
uuauggaauugaaccagua

SEQ ID NO: 598421 - RNA, 19 nt, Homo sapiens
gagaggaagaugauuuaca

SEQ ID NO: 598422 - RNA, 19 nt, Homo sapiens
caauaaacgugacaucuug

SEQ ID NO: 598423 - RNA, 19 nt, Homo sapiens
gcacaggaaugucgaagca

SEQ ID NO: 598424 - RNA, 19 nt, Homo sapiens
gcccaacccugguguggua

SEQ ID NO: 598425 - RNA, 19 nt, Homo sapiens
gcaauaaacgugacaucuu

SEQ ID NO: 598426 - RNA, 19 nt, Homo sapiens
gaccaagacuguggaguug

SEQ ID NO: 598427 - RNA, 19 nt, Homo sapiens
gacggacccuguugucaaa

SEQ ID NO: 598428 - RNA, 19 nt, Homo sapiens
ucaggacgaucucccaauu

SEQ ID NO: 598429 - RNA, 19 nt, Homo sapiens
gauugugacuugccugaau

SEQ ID NO: 598430 - RNA, 19 nt, Homo sapiens
gaucuacucugggagacaa

SEQ ID NO: 598431 - RNA, 19 nt, Homo sapiens
gggaaucuguacacacuca

SEQ ID NO: 598432 - RNA, 19 nt, Homo sapiens
acaggaaugucgaagcaaa

SEQ ID NO: 598433 - RNA, 19 nt, Homo sapiens
ggacccaccugccaguaca

SEQ ID NO: 598434 - RNA, 19 nt, Homo sapiens
gcccuggccugguguguau

SEQ ID NO: 598435 - RNA, 19 nt, Homo sapiens
gacuggcggugucuuaaga

SEQ ID NO: 598436 - RNA, 19 nt, Homo sapiens
gucgaucccugcugugauu

SEQ ID NO: 598437 - RNA, 19 nt, Homo sapiens
caucuguucuccugacuuc

SEQ ID NO: 598438 - RNA, 19 nt, Homo sapiens
gcuggugacugguacuuca

SEQ ID NO: 598439 - RNA, 19 nt, Homo sapiens
acucggaggcccagaaaua

SEQ ID NO: 598440 - RNA, 19 nt, Homo sapiens
ucaggguccucccauuauu

SEQ ID NO: 598441 - RNA, 19 nt, Homo sapiens
gcgggaaucuguacacacu

SEQ ID NO: 598442 - RNA, 19 nt, Homo sapiens
ccuggccgcucccaaauau

SEQ ID NO: 598443 - RNA, 19 nt, Homo sapiens
gggagacaauagaugugaa

SEQ ID NO: 598444 - RNA, 19 nt, Homo sapiens
gaggccaggugcacagugu

SEQ ID NO: 598445 - RNA, 19 nt, Homo sapiens
cuccauagcccaugaguug

SEQ ID NO: 598446 - RNA, 19 nt, Homo sapiens
ggcgggaugugguaacaga

SEQ ID NO: 598447 - RNA, 19 nt, Homo sapiens
ugacaucuugggagcguua

SEQ ID NO: 598448 - RNA, 19 nt, Homo sapiens
gaaugggacugagcugaac

SEQ ID NO: 598449 - RNA, 19 nt, Homo sapiens
caggacgaucucccaauua

SEQ ID NO: 598450 - RNA, 19 nt, Homo sapiens
gccugucucugcucaguug

SEQ ID NO: 598451 - RNA, 19 nt, Homo sapiens
caggaggugugaacaugga

SEQ ID NO: 598452 - RNA, 19 nt, Homo sapiens
cuucaggguccucccauua

SEQ ID NO: 598453 - RNA, 19 nt, Homo sapiens
ggacacacuuuggagaacu

SEQ ID NO: 598454 - RNA, 19 nt, Homo sapiens
ggagacaauagaugugaau

SEQ ID NO: 598455 - RNA, 19 nt, Homo sapiens
gcauggccauucagaacuc

SEQ ID NO: 598456 - RNA, 19 nt, Homo sapiens
ucucugcucaguugcaaua

SEQ ID NO: 598457 - RNA, 19 nt, Homo sapiens
ccaaucuggucccucugaa

SEQ ID NO: 598458 - RNA, 19 nt, Homo sapiens
ugaaugggacugagcugaa

SEQ ID NO: 598459 - RNA, 19 nt, Homo sapiens
cccuagagaugccauuugu

SEQ ID NO: 598460 - RNA, 19 nt, Homo sapiens
gggccuggaccaugauuug

SEQ ID NO: 598461 - RNA, 19 nt, Homo sapiens
agaccaagacuguggaguu

SEQ ID NO: 598462 - RNA, 19 nt, Homo sapiens
aggacgaucucccaauuag

SEQ ID NO: 598463 - RNA, 19 nt, Homo sapiens
ggacgggauugaggaaggu

SEQ ID NO: 598464 - RNA, 19 nt, Homo sapiens
gagcuggcgggaaucugua

SEQ ID NO: 598465 - RNA, 19 nt, Homo sapiens
uccuggagcugcuacagaa

SEQ ID NO: 598466 - RNA, 19 nt, Homo sapiens
ggugacugguacuucauuc

SEQ ID NO: 598467 - RNA, 19 nt, Homo sapiens
gcuaaaccgcacacuggaa

SEQ ID NO: 598468 - RNA, 19 nt, Homo sapiens
ccagaaauaccgggacuuc

SEQ ID NO: 598469 - RNA, 19 nt, Homo sapiens
gaggcgggaugugguaaca

SEQ ID NO: 598470 - RNA, 19 nt, Homo sapiens
cagaggggauugugacuug

SEQ ID NO: 598471 - RNA, 19 nt, Homo sapiens
gcaggcagagucagagaag

SEQ ID NO: 598472 - RNA, 19 nt, Homo sapiens
gggcauggccauucagaac

SEQ ID NO: 598473 - RNA, 19 nt, Homo sapiens
caggguccucccauuauuu

SEQ ID NO: 598474 - RNA, 19 nt, Homo sapiens
gcuccuggguguccaucug

SEQ ID NO: 598475 - RNA, 19 nt, Homo sapiens
ugacugaaggcgccagaga

SEQ ID NO: 598476 - RNA, 19 nt, Homo sapiens
gaucccugcugugauucuu

SEQ ID NO: 598477 - RNA, 19 nt, Homo sapiens
cugcaccacucagcucaaa

SEQ ID NO: 598478 - RNA, 19 nt, Homo sapiens
gcaacaggcacugcuacug

SEQ ID NO: 598479 - RNA, 19 nt, Homo sapiens
gcuacagaauagggaguug

SEQ ID NO: 598480 - RNA, 19 nt, Homo sapiens
ucugcucaguugcaauaaa

SEQ ID NO: 598481 - RNA, 19 nt, Homo sapiens
cuggagcugcuacagaaua

SEQ ID NO: 598482 - RNA, 19 nt, Homo sapiens
ucagccuccuggucuuauu

SEQ ID NO: 598483 - RNA, 19 nt, Homo sapiens
ggaccugggcagugaugug

SEQ ID NO: 598484 - RNA, 19 nt, Homo sapiens
gacacacuuuggagaacug

SEQ ID NO: 598485 - RNA, 19 nt, Homo sapiens
ggagcuggacggugacagu

SEQ ID NO: 598486 - RNA, 19 nt, Homo sapiens
ggacccuguugucaaaauu

SEQ ID NO: 598487 - RNA, 19 nt, Homo sapiens
gacugguacuucauucucu

SEQ ID NO: 598488 - RNA, 19 nt, Homo sapiens
agaaauaccgggacuucca

SEQ ID NO: 598489 - RNA, 19 nt, Homo sapiens
ccucagccuccuggucuua

SEQ ID NO: 598490 - RNA, 19 nt, Homo sapiens
caaauauagguggcacuga

SEQ ID NO: 598491 - RNA, 19 nt, Homo sapiens
ucacucggaggcccagaaa

SEQ ID NO: 598492 - RNA, 19 nt, Homo sapiens
uggagcugcuacagaauag

SEQ ID NO: 598493 - RNA, 19 nt, Homo sapiens
gcaccacucagcucaaagc

SEQ ID NO: 598494 - RNA, 19 nt, Homo sapiens
ucccugcugugauucuuug

SEQ ID NO: 598495 - RNA, 19 nt, Homo sapiens
caugauuugccugggaaua

SEQ ID NO: 598496 - RNA, 19 nt, Homo sapiens
ggcuggcagugucguccua

SEQ ID NO: 598497 - RNA, 19 nt, Homo sapiens
caucugacggacccuguug

SEQ ID NO: 598498 - RNA, 19 nt, Homo sapiens
ccuccuccauagcccauga

SEQ ID NO: 598499 - RNA, 19 nt, Homo sapiens
gggacacacuuuggagaac

SEQ ID NO: 598500 - RNA, 19 nt, Homo sapiens
gcaaagagcugcaucauga

SEQ ID NO: 598501 - RNA, 19 nt, Homo sapiens
ggaaguaccuguaagcuua

SEQ ID NO: 598502 - RNA, 19 nt, Homo sapiens
caacagaccucacaucuuu

SEQ ID NO: 598503 - RNA, 19 nt, Homo sapiens
ggaggaaacugccuucuua

SEQ ID NO: 598504 - RNA, 19 nt, Homo sapiens
gaaacugccuucuuaauau

SEQ ID NO: 598505 - RNA, 19 nt, Homo sapiens
gaaagaaacugcaaaggau

SEQ ID NO: 598506 - RNA, 19 nt, Homo sapiens
ggaaagaucuguagaaacu

SEQ ID NO: 598507 - RNA, 19 nt, Homo sapiens
ccagagaaguuccuauaua

SEQ ID NO: 598508 - RNA, 19 nt, Homo sapiens
gagauuaacuagagaaaga

SEQ ID NO: 598509 - RNA, 19 nt, Homo sapiens
ggaaacugccuucuuaaua

SEQ ID NO: 598510 - RNA, 19 nt, Homo sapiens
caacaaggauauagagaaa

SEQ ID NO: 598511 - RNA, 19 nt, Homo sapiens
ccucacaucuuucuucuua

SEQ ID NO: 598512 - RNA, 19 nt, Homo sapiens
gaacugagcuaauacuuuu

SEQ ID NO: 598513 - RNA, 19 nt, Homo sapiens
gaagagaucacaaacauau

SEQ ID NO: 598514 - RNA, 19 nt, Homo sapiens
ggaaagguaugacaugaug

SEQ ID NO: 598515 - RNA, 19 nt, Homo sapiens
guggaaagcuucaguguga

SEQ ID NO: 598516 - RNA, 19 nt, Homo sapiens
gcacaagaaccacaauuaa

SEQ ID NO: 598517 - RNA, 19 nt, Homo sapiens
gauaugguauggaucguaa

SEQ ID NO: 598518 - RNA, 19 nt, Homo sapiens
ccuguaagcuuaaaucauu

SEQ ID NO: 598519 - RNA, 19 nt, Homo sapiens
cagagaaguuccuauauau

SEQ ID NO: 598520 - RNA, 19 nt, Homo sapiens
ggaccuacauacaaugaaa

SEQ ID NO: 598521 - RNA, 19 nt, Homo sapiens
ggagggaguucauaauuca

SEQ ID NO: 598522 - RNA, 19 nt, Homo sapiens
ggauauccuugccagaaua

SEQ ID NO: 598523 - RNA, 19 nt, Homo sapiens
gaggauugcugcauuuaga

SEQ ID NO: 598524 - RNA, 19 nt, Homo sapiens
caaaaccacuugagaauuu

SEQ ID NO: 598525 - RNA, 19 nt, Homo sapiens
ggaauugugccugcuauua

SEQ ID NO: 598526 - RNA, 19 nt, Homo sapiens
gccagggaauuuacaauaa

SEQ ID NO: 598527 - RNA, 19 nt, Homo sapiens
caucaugcacgaauuaaua

SEQ ID NO: 598528 - RNA, 19 nt, Homo sapiens
gcagugauucucaaauuaa

SEQ ID NO: 598529 - RNA, 19 nt, Homo sapiens
guucauaauucauccauug

SEQ ID NO: 598530 - RNA, 19 nt, Homo sapiens
aaauuaggcuggagaaaga

SEQ ID NO: 598531 - RNA, 19 nt, Homo sapiens
cuaaucagcugccaauaau

SEQ ID NO: 598532 - RNA, 19 nt, Homo sapiens
ggaagggacuuuaaucacu

SEQ ID NO: 598533 - RNA, 19 nt, Homo sapiens
ggagacauuugcuuccauu

SEQ ID NO: 598534 - RNA, 19 nt, Homo sapiens
ggagaaagaaggaagaaau

SEQ ID NO: 598535 - RNA, 19 nt, Homo sapiens
uaauaaagcaggagcaauu

SEQ ID NO: 598536 - RNA, 19 nt, Homo sapiens
aaacagaaacugaguguga

SEQ ID NO: 598537 - RNA, 19 nt, Homo sapiens
gcaccuccuuuauauaguu

SEQ ID NO: 598538 - RNA, 19 nt, Homo sapiens
gaaauuauaacuccuugga

SEQ ID NO: 598539 - RNA, 19 nt, Homo sapiens
gacauuugcuuccauuguu

SEQ ID NO: 598540 - RNA, 19 nt, Homo sapiens
uaaagcaggagcaauuaua

SEQ ID NO: 598541 - RNA, 19 nt, Homo sapiens
cgacauguuucuccaguga

SEQ ID NO: 598542 - RNA, 19 nt, Homo sapiens
gugcacagcuaguucuaaa

SEQ ID NO: 598543 - RNA, 19 nt, Homo sapiens
gcacagcuaguucuaaaga

SEQ ID NO: 598544 - RNA, 19 nt, Homo sapiens
gaaccacaauuaagauguc

SEQ ID NO: 598545 - RNA, 19 nt, Homo sapiens
ggaacugagcuaauacuuu

SEQ ID NO: 598546 - RNA, 19 nt, Homo sapiens
guagaaacuuccagugugu

SEQ ID NO: 598547 - RNA, 19 nt, Homo sapiens
ugacagauuuggcaauugu

SEQ ID NO: 598548 - RNA, 19 nt, Homo sapiens
ugacugugauguucagaaa

SEQ ID NO: 598549 - RNA, 19 nt, Homo sapiens
ugaauugggucauaaucuu

SEQ ID NO: 598550 - RNA, 19 nt, Homo sapiens
acaaggauauagagaaaga

SEQ ID NO: 598551 - RNA, 19 nt, Homo sapiens
gagcacaucauuuaucgaa

SEQ ID NO: 598552 - RNA, 19 nt, Homo sapiens
caacaaggaagggacuuua

SEQ ID NO: 598553 - RNA, 19 nt, Homo sapiens
gaaauuaggcuggagaaag

SEQ ID NO: 598554 - RNA, 19 nt, Homo sapiens
gauaaucuaauaccuguga

SEQ ID NO: 598555 - RNA, 19 nt, Homo sapiens
aagaagagaucacaaacau

SEQ ID NO: 598556 - RNA, 19 nt, Homo sapiens
gaauugugccugcuauuau

SEQ ID NO: 598557 - RNA, 19 nt, Homo sapiens
ucuagaaucuugucuguca

SEQ ID NO: 598558 - RNA, 19 nt, Homo sapiens
ggugacagauuuggcaauu

SEQ ID NO: 598559 - RNA, 19 nt, Homo sapiens
ucacaucuuucuucuuaug

SEQ ID NO: 598560 - RNA, 19 nt, Homo sapiens
ucagaggauugcugcauuu

SEQ ID NO: 598561 - RNA, 19 nt, Homo sapiens
acaauaacauuuccguuuc

SEQ ID NO: 598562 - RNA, 19 nt, Homo sapiens
acaaggaaaugcaguaaag

SEQ ID NO: 598563 - RNA, 19 nt, Homo sapiens
ccagaguacugcaaugguu

SEQ ID NO: 598564 - RNA, 19 nt, Homo sapiens
gagcaucggguuccagaaa

SEQ ID NO: 598565 - RNA, 19 nt, Homo sapiens
cauuguugcucaugaauug

SEQ ID NO: 598566 - RNA, 19 nt, Homo sapiens
caucuuagcuguguuaaaa

SEQ ID NO: 598567 - RNA, 19 nt, Homo sapiens
gagaaagaaggaagaaaug

SEQ ID NO: 598568 - RNA, 19 nt, Homo sapiens
ugacauucguucacaauag

SEQ ID NO: 598569 - RNA, 19 nt, Homo sapiens
ccaaagauuguuucauuga

SEQ ID NO: 598570 - RNA, 19 nt, Homo sapiens
uggaugaugucuacaaaga

SEQ ID NO: 598571 - RNA, 19 nt, Homo sapiens
gaaugcgaguuaugggauu

SEQ ID NO: 598572 - RNA, 19 nt, Homo sapiens
ucacugaccaucccaauau

SEQ ID NO: 598573 - RNA, 19 nt, Homo sapiens
gaaggaaaagagcauauua

SEQ ID NO: 598574 - RNA, 19 nt, Homo sapiens
gugugagaguugugaaaua

SEQ ID NO: 598575 - RNA, 19 nt, Homo sapiens
augcuucuguucugaauua

SEQ ID NO: 598576 - RNA, 19 nt, Homo sapiens
gggaaugcuuuguguggaa

SEQ ID NO: 598577 - RNA, 19 nt, Homo sapiens
gcaugugccaguauuauga

SEQ ID NO: 598578 - RNA, 19 nt, Homo sapiens
gaagagccucccagcauga

SEQ ID NO: 598579 - RNA, 19 nt, Homo sapiens
cagaacagcucucauuuug

SEQ ID NO: 598580 - RNA, 19 nt, Homo sapiens
acaagaaccacaauuaaga

SEQ ID NO: 598581 - RNA, 19 nt, Homo sapiens
uaacuguauugguguaaga

SEQ ID NO: 598582 - RNA, 19 nt, Homo sapiens
cuuauugucugugcuauuu

SEQ ID NO: 598583 - RNA, 19 nt, Homo sapiens
ggacggacuucuggucuuc

SEQ ID NO: 598584 - RNA, 19 nt, Homo sapiens
ggaaugcuuuguguggaaa

SEQ ID NO: 598585 - RNA, 19 nt, Homo sapiens
ugcagugauucucaaauua

SEQ ID NO: 598586 - RNA, 19 nt, Homo sapiens
agacuucacuaacacagaa

SEQ ID NO: 598587 - RNA, 19 nt, Homo sapiens
aaacagauuugcaguacca

SEQ ID NO: 598588 - RNA, 19 nt, Homo sapiens
guauuaugaugcucaaugu

SEQ ID NO: 598589 - RNA, 19 nt, Homo sapiens
gaaaccugaucaacauagu

SEQ ID NO: 598590 - RNA, 19 nt, Homo sapiens
ccacaauuaagaugucaua

SEQ ID NO: 598591 - RNA, 19 nt, Homo sapiens
gaacauguuauugcaguga

SEQ ID NO: 598592 - RNA, 19 nt, Homo sapiens
caagcaaccucagcaguuc

SEQ ID NO: 598593 - RNA, 19 nt, Homo sapiens
gaaagaagagaucacaaac

SEQ ID NO: 598594 - RNA, 19 nt, Homo sapiens
gaucaacuguggagaagcu

SEQ ID NO: 598595 - RNA, 19 nt, Homo sapiens
aaagaucuguagaaacuuc

SEQ ID NO: 598596 - RNA, 19 nt, Homo sapiens
gcaaugaauacaagaagug

SEQ ID NO: 598597 - RNA, 19 nt, Homo sapiens
gcauauuauucacuuggaa

SEQ ID NO: 598598 - RNA, 19 nt, Homo sapiens
gagaggaaccugcggaauc

SEQ ID NO: 598599 - RNA, 19 nt, Homo sapiens
cagcaugacucagcuacuu

SEQ ID NO: 598600 - RNA, 19 nt, Homo sapiens
gcagagggcuucucguuca

SEQ ID NO: 598601 - RNA, 19 nt, Homo sapiens
caucauggccuauauguuu

SEQ ID NO: 598602 - RNA, 19 nt, Homo sapiens
ccauguagcugcuguguug

SEQ ID NO: 598603 - RNA, 19 nt, Homo sapiens
uaaguaaacuacagcuuug

SEQ ID NO: 598604 - RNA, 19 nt, Homo sapiens
guaaguaaacuacagcuuu

SEQ ID NO: 598605 - RNA, 19 nt, Homo sapiens
gaagagccuuugcggauuc

SEQ ID NO: 598606 - RNA, 19 nt, Homo sapiens
cauaugaucugcccugguu

SEQ ID NO: 598607 - RNA, 19 nt, Homo sapiens
gugagacagugacggauua

SEQ ID NO: 598608 - RNA, 19 nt, Homo sapiens
gcguucagauuaaguguuu

SEQ ID NO: 598609 - RNA, 19 nt, Homo sapiens
caccaugacuucuucacua

SEQ ID NO: 598610 - RNA, 19 nt, Homo sapiens
ucaaguguaugcaguagaa

SEQ ID NO: 598611 - RNA, 19 nt, Homo sapiens
uaucuugugugaucuguaa

SEQ ID NO: 598612 - RNA, 19 nt, Homo sapiens
ugagaggcauccugacuuu

SEQ ID NO: 598613 - RNA, 19 nt, Homo sapiens
uaagauggguucaccuuca

SEQ ID NO: 598614 - RNA, 19 nt, Homo sapiens
caaccuauuugaaggaaug

SEQ ID NO: 598615 - RNA, 19 nt, Homo sapiens
ugacauugcugauuguugu

SEQ ID NO: 598616 - RNA, 19 nt, Homo sapiens
guaacacagucacaucuug

SEQ ID NO: 598617 - RNA, 19 nt, Homo sapiens
gacaaugccauccauguuu

SEQ ID NO: 598618 - RNA, 19 nt, Homo sapiens
ggucucaucugaucgacaa

SEQ ID NO: 598619 - RNA, 19 nt, Homo sapiens
ggacaaugccauccauguu

SEQ ID NO: 598620 - RNA, 19 nt, Homo sapiens
ggacaaggagucagaguca

SEQ ID NO: 598621 - RNA, 19 nt, Homo sapiens
cuaauaggauucugcaugu

SEQ ID NO: 598622 - RNA, 19 nt, Homo sapiens
gagcagagggcuucucguu

SEQ ID NO: 598623 - RNA, 19 nt, Homo sapiens
aggcacagcuuagauguuu

SEQ ID NO: 598624 - RNA, 19 nt, Homo sapiens
auuagagccuugacuauuu

SEQ ID NO: 598625 - RNA, 19 nt, Homo sapiens
gauuagagccuugacuauu

SEQ ID NO: 598626 - RNA, 19 nt, Homo sapiens
ggugugacuuagacaauga

SEQ ID NO: 598627 - RNA, 19 nt, Homo sapiens
cgacugcaguucuacaugu

SEQ ID NO: 598628 - RNA, 19 nt, Homo sapiens
caucgcagacugaaaguuu

SEQ ID NO: 598629 - RNA, 19 nt, Homo sapiens
ucaggacgcucagcuggua

SEQ ID NO: 598630 - RNA, 19 nt, Homo sapiens
ggaaaacgguccggaugua

SEQ ID NO: 598631 - RNA, 19 nt, Homo sapiens
caacgucuaccacucauau

SEQ ID NO: 598632 - RNA, 19 nt, Homo sapiens
ccacaaaguccugcuuaaa

SEQ ID NO: 598633 - RNA, 19 nt, Homo sapiens
ccaccuuugucaauguaua

SEQ ID NO: 598634 - RNA, 19 nt, Homo sapiens
caugagauaaucacuauug

SEQ ID NO: 598635 - RNA, 19 nt, Homo sapiens
ugaugugcguucagauuaa

SEQ ID NO: 598636 - RNA, 19 nt, Homo sapiens
gugaugugcguucagauua

SEQ ID NO: 598637 - RNA, 19 nt, Homo sapiens
gauuucaauugcaccauga

SEQ ID NO: 598638 - RNA, 19 nt, Homo sapiens
gaaggaaugaucugguuca

SEQ ID NO: 598639 - RNA, 19 nt, Homo sapiens
gcuguguuguguauauauu

SEQ ID NO: 598640 - RNA, 19 nt, Homo sapiens
gcugcuguguuguguauau

SEQ ID NO: 598641 - RNA, 19 nt, Homo sapiens
gcuccaaugucuccuguag

SEQ ID NO: 598642 - RNA, 19 nt, Homo sapiens
acaaugccauccauguuug

SEQ ID NO: 598643 - RNA, 19 nt, Homo sapiens
ucggaggaauggaggcuua

SEQ ID NO: 598644 - RNA, 19 nt, Homo sapiens
aaacgagccuuuaaaauca

SEQ ID NO: 598645 - RNA, 19 nt, Homo sapiens
aaagguagauggagagacu

SEQ ID NO: 598646 - RNA, 19 nt, Homo sapiens
uagcugcuguguuguguau

SEQ ID NO: 598647 - RNA, 19 nt, Homo sapiens
uagaauguacuguaacuga

SEQ ID NO: 598648 - RNA, 19 nt, Homo sapiens
ggaggauucuucgcaagug

SEQ ID NO: 598649 - RNA, 19 nt, Homo sapiens
gaggcuuacuaaccaggua

SEQ ID NO: 598650 - RNA, 19 nt, Homo sapiens
ccacaugucuaggcuccaa

SEQ ID NO: 598651 - RNA, 19 nt, Homo sapiens
gcccagcuggugugacuua

SEQ ID NO: 598652 - RNA, 19 nt, Homo sapiens
ggccaccuuugucaaugua

SEQ ID NO: 598653 - RNA, 19 nt, Homo sapiens
ugugugaucuguaaugaca

SEQ ID NO: 598654 - RNA, 19 nt, Homo sapiens
uccaugagauaaucacuau

SEQ ID NO: 598655 - RNA, 19 nt, Homo sapiens
gaagauuaaaugcacacuu

SEQ ID NO: 598656 - RNA, 19 nt, Homo sapiens
gcccaggucaggaguguuu

SEQ ID NO: 598657 - RNA, 19 nt, Homo sapiens
gcaucgcucucuccaccuu

SEQ ID NO: 598658 - RNA, 19 nt, Homo sapiens
gaggaauggaggcuuacua

SEQ ID NO: 598659 - RNA, 19 nt, Homo sapiens
caggagaacaggaacagaa

SEQ ID NO: 598660 - RNA, 19 nt, Homo sapiens
caaacgagccuuuaaaauc

SEQ ID NO: 598661 - RNA, 19 nt, Homo sapiens
ggauucaaacgagccuuua

SEQ ID NO: 598662 - RNA, 19 nt, Homo sapiens
ggguacagaugcuuugucu

SEQ ID NO: 598663 - RNA, 19 nt, Homo sapiens
acacagucacaucuuguua

SEQ ID NO: 598664 - RNA, 19 nt, Homo sapiens
agaagagccuuugcggauu

SEQ ID NO: 598665 - RNA, 19 nt, Homo sapiens
gccagucucugcagaugau

SEQ ID NO: 598666 - RNA, 19 nt, Homo sapiens
gauuaaguguuuccaugag

SEQ ID NO: 598667 - RNA, 19 nt, Homo sapiens
ccaaugguuuugaugauaa

SEQ ID NO: 598668 - RNA, 19 nt, Homo sapiens
ugucuaggcuccaaugucu

SEQ ID NO: 598669 - RNA, 19 nt, Homo sapiens
ccaaaauccugcagaaugu

SEQ ID NO: 598670 - RNA, 19 nt, Homo sapiens
guauauacagucuaugugu

SEQ ID NO: 598671 - RNA, 19 nt, Homo sapiens
caucauggaucgcuuugac

SEQ ID NO: 598672 - RNA, 19 nt, Homo sapiens
gguacuuucuccugugugu

SEQ ID NO: 598673 - RNA, 19 nt, Homo sapiens
cccaucaauugaacuguuu

SEQ ID NO: 598674 - RNA, 19 nt, Homo sapiens
ggucaggaguguuuucuug

SEQ ID NO: 598675 - RNA, 19 nt, Homo sapiens
ucaacacgcugcggucuca

SEQ ID NO: 598676 - RNA, 19 nt, Homo sapiens
guacugagucuggucaaga

SEQ ID NO: 598677 - RNA, 19 nt, Homo sapiens
cuucgcaaguggauucaaa

SEQ ID NO: 598678 - RNA, 19 nt, Homo sapiens
cagcuucacuguggacugu

SEQ ID NO: 598679 - RNA, 19 nt, Homo sapiens
aauaggauucugcauguuu

SEQ ID NO: 598680 - RNA, 19 nt, Homo sapiens
accaugacuucuucacuaa

SEQ ID NO: 598681 - RNA, 19 nt, Homo sapiens
gagugugugugucuguguu

SEQ ID NO: 598682 - RNA, 19 nt, Homo sapiens
gaaagaagucacggguugu

SEQ ID NO: 598683 - RNA, 19 nt, Homo sapiens
acgcugcggucucaucuga

SEQ ID NO: 598684 - RNA, 19 nt, Homo sapiens
gauucaaacgagccuuuaa

SEQ ID NO: 598685 - RNA, 19 nt, Homo sapiens
gaagaacuggugggugaga

SEQ ID NO: 598686 - RNA, 19 nt, Homo sapiens
uaaauaccaccgguucauu

SEQ ID NO: 598687 - RNA, 19 nt, Homo sapiens
uuacagugauuucaauugc

SEQ ID NO: 598688 - RNA, 19 nt, Homo sapiens
gaauggaggcuuacuaacc

SEQ ID NO: 598689 - RNA, 19 nt, Homo sapiens
gaucagcagcuccacaucu

SEQ ID NO: 598690 - RNA, 19 nt, Homo sapiens
cuucugcuguccuauguga

SEQ ID NO: 598691 - RNA, 19 nt, Homo sapiens
gacugcaguucuacauguu

SEQ ID NO: 598692 - RNA, 19 nt, Homo sapiens
gacagugacggauuacuuc

SEQ ID NO: 598693 - RNA, 19 nt, Homo sapiens
acgcucagcugguacuuuc

SEQ ID NO: 598694 - RNA, 19 nt, Homo sapiens
uaaguguuuccaugagaua

SEQ ID NO: 598695 - RNA, 19 nt, Homo sapiens
ggagucagagucagaagca

SEQ ID NO: 598696 - RNA, 19 nt, Homo sapiens
cagguaagccuucuaugca

SEQ ID NO: 598697 - RNA, 19 nt, Homo sapiens
cuacagcuuugaguuggaa

SEQ ID NO: 598698 - RNA, 19 nt, Homo sapiens
auagggcccuuuccaacuu

SEQ ID NO: 598699 - RNA, 19 nt, Homo sapiens
uugaaggaaugaucugguu

SEQ ID NO: 598700 - RNA, 19 nt, Homo sapiens
gaaagaagcugcccagaag

SEQ ID NO: 598701 - RNA, 19 nt, Homo sapiens
gaacuuggaugacacuauu

SEQ ID NO: 598702 - RNA, 19 nt, Homo sapiens
gggaagagguggaugauga

SEQ ID NO: 598703 - RNA, 19 nt, Homo sapiens
ggaugaagcuguagcaguu

SEQ ID NO: 598704 - RNA, 19 nt, Homo sapiens
gaauucaacucaagguuug

SEQ ID NO: 598705 - RNA, 19 nt, Homo sapiens
gggugaaucucuacauuaa

SEQ ID NO: 598706 - RNA, 19 nt, Homo sapiens
gggaaggccuccauauuau

SEQ ID NO: 598707 - RNA, 19 nt, Homo sapiens
caccaaggauuacaaauug

SEQ ID NO: 598708 - RNA, 19 nt, Homo sapiens
ucaagaaccuggacaaauc

SEQ ID NO: 598709 - RNA, 19 nt, Homo sapiens
ggagagaauuagucgauau

SEQ ID NO: 598710 - RNA, 19 nt, Homo sapiens
gaugagaaauuaaggaaag

SEQ ID NO: 598711 - RNA, 19 nt, Homo sapiens
caagguggaugaagcugua

SEQ ID NO: 598712 - RNA, 19 nt, Homo sapiens
ccaaugccaucuuaaauca

SEQ ID NO: 598713 - RNA, 19 nt, Homo sapiens
gugaaucucuacauuaaga

SEQ ID NO: 598714 - RNA, 19 nt, Homo sapiens
ggaauucaacucaagguuu

SEQ ID NO: 598715 - RNA, 19 nt, Homo sapiens
uggaagagaugaauggaaa

SEQ ID NO: 598716 - RNA, 19 nt, Homo sapiens
gaaacauacuguccugcaa

SEQ ID NO: 598717 - RNA, 19 nt, Homo sapiens
gaaccuggacaaaucuaua

SEQ ID NO: 598718 - RNA, 19 nt, Homo sapiens
ggaauucaccaauguuuau

SEQ ID NO: 598719 - RNA, 19 nt, Homo sapiens
ccaaggaauucaccaaugu

SEQ ID NO: 598720 - RNA, 19 nt, Homo sapiens
ggaaggccuccauauuaua

SEQ ID NO: 598721 - RNA, 19 nt, Homo sapiens
gguaagacccuaaguguca

SEQ ID NO: 598722 - RNA, 19 nt, Homo sapiens
gaacggcucuaaggguuau

SEQ ID NO: 598723 - RNA, 19 nt, Homo sapiens
guacccaagucuuacguuu

SEQ ID NO: 598724 - RNA, 19 nt, Homo sapiens
gaacuuugaugugauuaag

SEQ ID NO: 598725 - RNA, 19 nt, Homo sapiens
gaaugcugcuggagauaga

SEQ ID NO: 598726 - RNA, 19 nt, Homo sapiens
gcaagguggugugugauga

SEQ ID NO: 598727 - RNA, 19 nt, Homo sapiens
agucuuacguuucccaaua

SEQ ID NO: 598728 - RNA, 19 nt, Homo sapiens
gcacagaugaggccuaauc

SEQ ID NO: 598729 - RNA, 19 nt, Homo sapiens
ccaauaaggcuguggaaga

SEQ ID NO: 598730 - RNA, 19 nt, Homo sapiens
ccaagaggcugccgacaag

SEQ ID NO: 598731 - RNA, 19 nt, Homo sapiens
agggaaggccuccauauua

SEQ ID NO: 598732 - RNA, 19 nt, Homo sapiens
uaacaaggcacuuuaugau

SEQ ID NO: 598733 - RNA, 19 nt, Homo sapiens
ggucgccucuuaaaggauu

SEQ ID NO: 598734 - RNA, 19 nt, Homo sapiens
gaaaggcucaccugaccaa

SEQ ID NO: 598735 - RNA, 19 nt, Homo sapiens
gcuuuggcuuugugaguua

SEQ ID NO: 598736 - RNA, 19 nt, Homo sapiens
caugaacuuugaugugauu

SEQ ID NO: 598737 - RNA, 19 nt, Homo sapiens
caaggaaugccaagugcua

SEQ ID NO: 598738 - RNA, 19 nt, Homo sapiens
gccaaggaauucaccaaug

SEQ ID NO: 598739 - RNA, 19 nt, Homo sapiens
uagcacagaugaggccuaa

SEQ ID NO: 598740 - RNA, 19 nt, Homo sapiens
caauaaggcuguggaagag

SEQ ID NO: 598741 - RNA, 19 nt, Homo sapiens
acaaggcacuuuaugauac

SEQ ID NO: 598742 - RNA, 19 nt, Homo sapiens
ggaugacacuauugaugau

SEQ ID NO: 598743 - RNA, 19 nt, Homo sapiens
uaugaagcaccuagaauuu

SEQ ID NO: 598744 - RNA, 19 nt, Homo sapiens
caacaccaaggauuacaaa

SEQ ID NO: 598745 - RNA, 19 nt, Homo sapiens
gagccaaagccaaggaauu

SEQ ID NO: 598746 - RNA, 19 nt, Homo sapiens
ucaaugaccgcaaaguauu

SEQ ID NO: 598747 - RNA, 19 nt, Homo sapiens
gcuccaagccacuauaugu

SEQ ID NO: 598748 - RNA, 19 nt, Homo sapiens
aaagagcuauucagucagu

SEQ ID NO: 598749 - RNA, 19 nt, Homo sapiens
uagauaacaaggcacuuua

SEQ ID NO: 598750 - RNA, 19 nt, Homo sapiens
ggaaagccaauccgcauca

SEQ ID NO: 598751 - RNA, 19 nt, Homo sapiens
gcccgaggccuauauuuau

SEQ ID NO: 598752 - RNA, 19 nt, Homo sapiens
aaacggaaauuugaacagu

SEQ ID NO: 598753 - RNA, 19 nt, Homo sapiens
acaccaaggauuacaaauu

SEQ ID NO: 598754 - RNA, 19 nt, Homo sapiens
uccaaacaaugcauucaaa

SEQ ID NO: 598755 - RNA, 19 nt, Homo sapiens
cccagacaguguuaacuuu

SEQ ID NO: 598756 - RNA, 19 nt, Homo sapiens
aaaggucaauuaugaagca

SEQ ID NO: 598757 - RNA, 19 nt, Homo sapiens
ccgcuuggcuauggacuuu

SEQ ID NO: 598758 - RNA, 19 nt, Homo sapiens
agaaagaagcugcccagaa

SEQ ID NO: 598759 - RNA, 19 nt, Homo sapiens
caaacaaugcauucaaauc

SEQ ID NO: 598760 - RNA, 19 nt, Homo sapiens
acgaguggcuggaaugaga

SEQ ID NO: 598761 - RNA, 19 nt, Homo sapiens
cuauggaccucaacaccaa

SEQ ID NO: 598762 - RNA, 19 nt, Homo sapiens
gaaggccuccauauuauac

SEQ ID NO: 598763 - RNA, 19 nt, Homo sapiens
gaacggcaggcagaguuaa

SEQ ID NO: 598764 - RNA, 19 nt, Homo sapiens
caaugaccgcaaaguauuu

SEQ ID NO: 598765 - RNA, 19 nt, Homo sapiens
gaugagaacggcucuaagg

SEQ ID NO: 598766 - RNA, 19 nt, Homo sapiens
auacgaauauguucuuugg

SEQ ID NO: 598767 - RNA, 19 nt, Homo sapiens
ggaaaagaaauaaguggua

SEQ ID NO: 598768 - RNA, 19 nt, Homo sapiens
acacgaggaugccaauaag

SEQ ID NO: 598769 - RNA, 19 nt, Homo sapiens
ccucaaugaccgcaaagua

SEQ ID NO: 598770 - RNA, 19 nt, Homo sapiens
gcuccucaaugaccgcaaa

SEQ ID NO: 598771 - RNA, 19 nt, Homo sapiens
ccugcaaggugguguguga

SEQ ID NO: 598772 - RNA, 19 nt, Homo sapiens
gucuuacguuucccaauaa

SEQ ID NO: 598773 - RNA, 19 nt, Homo sapiens
cuuccuagcuuguccuaug

SEQ ID NO: 598774 - RNA, 19 nt, Homo sapiens
cagggaaggccuccauauu

SEQ ID NO: 598775 - RNA, 19 nt, Homo sapiens
acaaauacgccuccagugu

SEQ ID NO: 598776 - RNA, 19 nt, Homo sapiens
gagagcacuuccugccaau

SEQ ID NO: 598777 - RNA, 19 nt, Homo sapiens
cacuauugaugaugagaaa

SEQ ID NO: 598778 - RNA, 19 nt, Homo sapiens
gagaauuagucgauaucag

SEQ ID NO: 598779 - RNA, 19 nt, Homo sapiens
acggaaauuugaacaguug

SEQ ID NO: 598780 - RNA, 19 nt, Homo sapiens
acaaggccaucgagaagau

SEQ ID NO: 598781 - RNA, 19 nt, Homo sapiens
cgacaaggccaucgagaag

SEQ ID NO: 598782 - RNA, 19 nt, Homo sapiens
gcaacgaguggcuggaaug

SEQ ID NO: 598783 - RNA, 19 nt, Homo sapiens
gaucaauuaccagugcuaa

SEQ ID NO: 598784 - RNA, 19 nt, Homo sapiens
ggaaauuugaacaguugaa

SEQ ID NO: 598785 - RNA, 19 nt, Homo sapiens
aacaaggcacuuuaugaua

SEQ ID NO: 598786 - RNA, 19 nt, Homo sapiens
uuaugaagcaccuagaauu

SEQ ID NO: 598787 - RNA, 19 nt, Homo sapiens
ucaccgaggccaugcugua

SEQ ID NO: 598788 - RNA, 19 nt, Homo sapiens
guaagacccuaagugucaa

SEQ ID NO: 598789 - RNA, 19 nt, Homo sapiens
ugggaaacgucuucaucaa

SEQ ID NO: 598790 - RNA, 19 nt, Homo sapiens
gaaagccaauccgcaucau

SEQ ID NO: 598791 - RNA, 19 nt, Homo sapiens
gccaaugccaucuuaaauc

SEQ ID NO: 598792 - RNA, 19 nt, Homo sapiens
ugaagaagcaaccaaagca

SEQ ID NO: 598793 - RNA, 19 nt, Homo sapiens
uggaugacacuauugauga

SEQ ID NO: 598794 - RNA, 19 nt, Homo sapiens
gaaacaggagagaauuagu

SEQ ID NO: 598795 - RNA, 19 nt, Homo sapiens
accaugaacuuugauguga

SEQ ID NO: 598796 - RNA, 19 nt, Homo sapiens
ugaauggcaugcuccucaa

SEQ ID NO: 598797 - RNA, 19 nt, Homo sapiens
acucugagcugcugcacau

SEQ ID NO: 598798 - RNA, 19 nt, Homo sapiens
gagcuauucagucaguuug

SEQ ID NO: 598799 - RNA, 19 nt, Homo sapiens
uuacguuucccaauaaaga

SEQ ID NO: 598800 - RNA, 19 nt, Homo sapiens
gaacuacauuccagauuua

SEQ ID NO: 598801 - RNA, 19 nt, Homo sapiens
gaaauaagaugccacacaa

SEQ ID NO: 598802 - RNA, 19 nt, Homo sapiens
gcaagaaggauauacauua

SEQ ID NO: 598803 - RNA, 19 nt, Homo sapiens
aaacagacccauugaauua

SEQ ID NO: 598804 - RNA, 19 nt, Homo sapiens
caaaugagcucuugcaaca

SEQ ID NO: 598805 - RNA, 19 nt, Homo sapiens
uaacagaagugaccaaugu

SEQ ID NO: 598806 - RNA, 19 nt, Homo sapiens
ucaagugccuuaauuguuu

SEQ ID NO: 598807 - RNA, 19 nt, Homo sapiens
gaaauuaccacacucugua

SEQ ID NO: 598808 - RNA, 19 nt, Homo sapiens
gaaaggauaccauuagugu

SEQ ID NO: 598809 - RNA, 19 nt, Homo sapiens
gcagaggcuuuaaguaguu

SEQ ID NO: 598810 - RNA, 19 nt, Homo sapiens
agaagaacgugccaaauga

SEQ ID NO: 598811 - RNA, 19 nt, Homo sapiens
gagaagaacgugccaaaug

SEQ ID NO: 598812 - RNA, 19 nt, Homo sapiens
aaaccaaucuguaucaugu

SEQ ID NO: 598813 - RNA, 19 nt, Homo sapiens
ucacaacaccuaaggauuu

SEQ ID NO: 598814 - RNA, 19 nt, Homo sapiens
gaagugaccaauguaauuu

SEQ ID NO: 598815 - RNA, 19 nt, Homo sapiens
cggagaaacuuaagcuaaa

SEQ ID NO: 598816 - RNA, 19 nt, Homo sapiens
guaacucacugaagccaaa

SEQ ID NO: 598817 - RNA, 19 nt, Homo sapiens
aaagaacagugccuuagaa

SEQ ID NO: 598818 - RNA, 19 nt, Homo sapiens
caagugccuuaauuguuua

SEQ ID NO: 598819 - RNA, 19 nt, Homo sapiens
gaacagaauugagaagaac

SEQ ID NO: 598820 - RNA, 19 nt, Homo sapiens
gcucuuggcaguuuaaauu

SEQ ID NO: 598821 - RNA, 19 nt, Homo sapiens
gcacugcucuaacaacaag

SEQ ID NO: 598822 - RNA, 19 nt, Homo sapiens
uaaaaucucuggcuucaaa

SEQ ID NO: 598823 - RNA, 19 nt, Homo sapiens
gcacuauuguaccuugaaa

SEQ ID NO: 598824 - RNA, 19 nt, Homo sapiens
cagauguucuucuaucaaa

SEQ ID NO: 598825 - RNA, 19 nt, Homo sapiens
gcuguaggauuaauucgaa

SEQ ID NO: 598826 - RNA, 19 nt, Homo sapiens
guacuaaaugguauccuua

SEQ ID NO: 598827 - RNA, 19 nt, Homo sapiens
agugagugcuguaggauua

SEQ ID NO: 598828 - RNA, 19 nt, Homo sapiens
guaaacagacccauugaau

SEQ ID NO: 598829 - RNA, 19 nt, Homo sapiens
ggucagaggauguaacuug

SEQ ID NO: 598830 - RNA, 19 nt, Homo sapiens
gaacagugccuuagaagac

SEQ ID NO: 598831 - RNA, 19 nt, Homo sapiens
caagacaguuacuacauca

SEQ ID NO: 598832 - RNA, 19 nt, Homo sapiens
uguaguaucuugagccauu

SEQ ID NO: 598833 - RNA, 19 nt, Homo sapiens
ugaaagccuucguaucuug

SEQ ID NO: 598834 - RNA, 19 nt, Homo sapiens
agaagacagugaaagguaa

SEQ ID NO: 598835 - RNA, 19 nt, Homo sapiens
gcgcccaucuccaacguaa

SEQ ID NO: 598836 - RNA, 19 nt, Homo sapiens
aauaaggacuggugauuca

SEQ ID NO: 598837 - RNA, 19 nt, Homo sapiens
gcucuaacaacaagcauaa

SEQ ID NO: 598838 - RNA, 19 nt, Homo sapiens
gcggagaaacuuaagcuaa

SEQ ID NO: 598839 - RNA, 19 nt, Homo sapiens
ugaacagaauugagaagaa

SEQ ID NO: 598840 - RNA, 19 nt, Homo sapiens
guaaagaugagagcuauug

SEQ ID NO: 598841 - RNA, 19 nt, Homo sapiens
gaugaagauuuacuguuuc

SEQ ID NO: 598842 - RNA, 19 nt, Homo sapiens
uaaacagacccauugaauu

SEQ ID NO: 598843 - RNA, 19 nt, Homo sapiens
caucagguacaacaaauaa

SEQ ID NO: 598844 - RNA, 19 nt, Homo sapiens
ugauuguccuggaugaaua

SEQ ID NO: 598845 - RNA, 19 nt, Homo sapiens
aaauuuccauggaugcaua

SEQ ID NO: 598846 - RNA, 19 nt, Homo sapiens
gagagcuauuguucacaua

SEQ ID NO: 598847 - RNA, 19 nt, Homo sapiens
gaugagagcuauuguucac

SEQ ID NO: 598848 - RNA, 19 nt, Homo sapiens
gauagaauguaaagaugag

SEQ ID NO: 598849 - RNA, 19 nt, Homo sapiens
ccaagacaguuacuacauc

SEQ ID NO: 598850 - RNA, 19 nt, Homo sapiens
ggauagaauguaaagauga

SEQ ID NO: 598851 - RNA, 19 nt, Homo sapiens
caaacucugcauuuagaua

SEQ ID NO: 598852 - RNA, 19 nt, Homo sapiens
aacaaacucugcauuuaga

SEQ ID NO: 598853 - RNA, 19 nt, Homo sapiens
gagaaucaauuagguggau

SEQ ID NO: 598854 - RNA, 19 nt, Homo sapiens
gaacgugccaaaugagaau

SEQ ID NO: 598855 - RNA, 19 nt, Homo sapiens
gcaaaucuaaagaacgaaa

SEQ ID NO: 598856 - RNA, 19 nt, Homo sapiens
acacuuuccuuuguacuuu

SEQ ID NO: 598857 - RNA, 19 nt, Homo sapiens
ggagaaacuuaagcuaaag

SEQ ID NO: 598858 - RNA, 19 nt, Homo sapiens
gccaaaugagaaucaauua

SEQ ID NO: 598859 - RNA, 19 nt, Homo sapiens
uccaggaucuuuaaauuuc

SEQ ID NO: 598860 - RNA, 19 nt, Homo sapiens
aaaguaugcuagcacuauu

SEQ ID NO: 598861 - RNA, 19 nt, Homo sapiens
cagaggauguaacuugaug

SEQ ID NO: 598862 - RNA, 19 nt, Homo sapiens
cagacccauugaauuaaua

SEQ ID NO: 598863 - RNA, 19 nt, Homo sapiens
aaugagcucuugcaacaga

SEQ ID NO: 598864 - RNA, 19 nt, Homo sapiens
ggaugcauauaggauguuu

SEQ ID NO: 598865 - RNA, 19 nt, Homo sapiens
guaguaucuugagccauua

SEQ ID NO: 598866 - RNA, 19 nt, Homo sapiens
gugcagaggcuuuaaguag

SEQ ID NO: 598867 - RNA, 19 nt, Homo sapiens
gguuucccauaguauaaua

SEQ ID NO: 598868 - RNA, 19 nt, Homo sapiens
gaauugaaagccuucguau

SEQ ID NO: 598869 - RNA, 19 nt, Homo sapiens
gaugugagcaguaguaaac

SEQ ID NO: 598870 - RNA, 19 nt, Homo sapiens
uagaagacagugaaaggua

SEQ ID NO: 598871 - RNA, 19 nt, Homo sapiens
caaaugagaaucaauuagg

SEQ ID NO: 598872 - RNA, 19 nt, Homo sapiens
ugaauucccugacacacau

SEQ ID NO: 598873 - RNA, 19 nt, Homo sapiens
gcacauuuguacauauacu

SEQ ID NO: 598874 - RNA, 19 nt, Homo sapiens
aaacaaacucugcauuuag

SEQ ID NO: 598875 - RNA, 19 nt, Homo sapiens
ggacuagugcagaggcuuu

SEQ ID NO: 598876 - RNA, 19 nt, Homo sapiens
agaagugaccaauguaauu

SEQ ID NO: 598877 - RNA, 19 nt, Homo sapiens
uaaagaacagugccuuaga

SEQ ID NO: 598878 - RNA, 19 nt, Homo sapiens
gauggaaaauguugucuug

SEQ ID NO: 598879 - RNA, 19 nt, Homo sapiens
cugcaaaucuaaagaacga

SEQ ID NO: 598880 - RNA, 19 nt, Homo sapiens
guacaacaaauaacacugu

SEQ ID NO: 598881 - RNA, 19 nt, Homo sapiens
gucaacauauguagcaaau

SEQ ID NO: 598882 - RNA, 19 nt, Homo sapiens
ccaauguaauuucacaaca

SEQ ID NO: 598883 - RNA, 19 nt, Homo sapiens
gaaagccuucguaucuuga

SEQ ID NO: 598884 - RNA, 19 nt, Homo sapiens
gucagaggauguaacuuga

SEQ ID NO: 598885 - RNA, 19 nt, Homo sapiens
uauaaagaacagugccuua

SEQ ID NO: 598886 - RNA, 19 nt, Homo sapiens
uccuguggcugucuuauuu

SEQ ID NO: 598887 - RNA, 19 nt, Homo sapiens
gcuauuccaggaucuuuaa

SEQ ID NO: 598888 - RNA, 19 nt, Homo sapiens
uaagaugccacacaaggaa

SEQ ID NO: 598889 - RNA, 19 nt, Homo sapiens
ccacauggaagacgcuauu

SEQ ID NO: 598890 - RNA, 19 nt, Homo sapiens
ucuugaaccucccaacauu

SEQ ID NO: 598891 - RNA, 19 nt, Homo sapiens
gagcaguaguaaaccuguu

SEQ ID NO: 598892 - RNA, 19 nt, Homo sapiens
gcucuagcuuaaugucuau

SEQ ID NO: 598893 - RNA, 19 nt, Homo sapiens
gcagauguucuucuaucaa

SEQ ID NO: 598894 - RNA, 19 nt, Homo sapiens
caauuugaagcuucuguaa

SEQ ID NO: 598895 - RNA, 19 nt, Homo sapiens
ggacuggugauucauuugu

SEQ ID NO: 598896 - RNA, 19 nt, Homo sapiens
ucauggcucuuggcaguuu

SEQ ID NO: 598897 - RNA, 19 nt, Homo sapiens
uggauagaauguaaagaug

SEQ ID NO: 598898 - RNA, 19 nt, Homo sapiens
uuacuucucccuugccuuu

SEQ ID NO: 598899 - RNA, 19 nt, Homo sapiens
gcaugcauacuuuaacuuc

SEQ ID NO: 598900 - RNA, 19 nt, Homo sapiens
caagugcaguccagguuau

SEQ ID NO: 598901 - RNA, 19 nt, Homo sapiens
gggaggauguaaauaucuu

SEQ ID NO: 598902 - RNA, 19 nt, Homo sapiens
ggccuaaucauauguguga

SEQ ID NO: 598903 - RNA, 19 nt, Homo sapiens
uaucuuguuucuccucaaa

SEQ ID NO: 598904 - RNA, 19 nt, Homo sapiens
gauaccacaucggaaguga

SEQ ID NO: 598905 - RNA, 19 nt, Homo sapiens
acaguuggccuaaucauau

SEQ ID NO: 598906 - RNA, 19 nt, Homo sapiens
ccaagugcaguccagguua

SEQ ID NO: 598907 - RNA, 19 nt, Homo sapiens
gagacaauacccucauuca

SEQ ID NO: 598908 - RNA, 19 nt, Homo sapiens
gaagggaggcaccgagagu

SEQ ID NO: 598909 - RNA, 19 nt, Homo sapiens
gucaugaaacaguguauuu

SEQ ID NO: 598910 - RNA, 19 nt, Homo sapiens
gaguuccucugcuggaguu

SEQ ID NO: 598911 - RNA, 19 nt, Homo sapiens
gaauucggcuccuguuuuc

SEQ ID NO: 598912 - RNA, 19 nt, Homo sapiens
gugggaggauguaaauauc

SEQ ID NO: 598913 - RNA, 19 nt, Homo sapiens
gaaggugaggccacaguca

SEQ ID NO: 598914 - RNA, 19 nt, Homo sapiens
gaggagcccaaaccacuga

SEQ ID NO: 598915 - RNA, 19 nt, Homo sapiens
ucaauggccuaagcaagug

SEQ ID NO: 598916 - RNA, 19 nt, Homo sapiens
ggagacaauacccucauuc

SEQ ID NO: 598917 - RNA, 19 nt, Homo sapiens
cacaguuggccuaaucaua

SEQ ID NO: 598918 - RNA, 19 nt, Homo sapiens
ugucugcagugccaaaugu

SEQ ID NO: 598919 - RNA, 19 nt, Homo sapiens
ucuugaggcuggugcugua

SEQ ID NO: 598920 - RNA, 19 nt, Homo sapiens
cagguuaucgugugaagga

SEQ ID NO: 598921 - RNA, 19 nt, Homo sapiens
gagcgacggcugcugaaag

SEQ ID NO: 598922 - RNA, 19 nt, Homo sapiens
gagcugacgggcacagugu

SEQ ID NO: 598923 - RNA, 19 nt, Homo sapiens
cgaggcggauucucuuucu

SEQ ID NO: 598924 - RNA, 19 nt, Homo sapiens
caguuggccuaaucauaug

SEQ ID NO: 598925 - RNA, 19 nt, Homo sapiens
uaccacaucggaagugauu

SEQ ID NO: 598926 - RNA, 19 nt, Homo sapiens
ccacugacccacagacucu

SEQ ID NO: 598927 - RNA, 19 nt, Homo sapiens
ugugggaggauguaaauau

SEQ ID NO: 598928 - RNA, 19 nt, Homo sapiens
gcugugggaggauguaaau

SEQ ID NO: 598929 - RNA, 19 nt, Homo sapiens
gcugcagugugguguuuag

SEQ ID NO: 598930 - RNA, 19 nt, Homo sapiens
uggcugcagugugguguuu

SEQ ID NO: 598931 - RNA, 19 nt, Homo sapiens
gaaaagacaggaggcagaa

SEQ ID NO: 598932 - RNA, 19 nt, Homo sapiens
ggaggauguaaauaucuug

SEQ ID NO: 598933 - RNA, 19 nt, Homo sapiens
agcgacggcugcugaaaga

SEQ ID NO: 598934 - RNA, 19 nt, Homo sapiens
caugaaacaguguauuugg

SEQ ID NO: 598935 - RNA, 19 nt, Homo sapiens
ucaugaaacaguguauuug

SEQ ID NO: 598936 - RNA, 19 nt, Homo sapiens
ccuaaucauaugugugaaa

SEQ ID NO: 598937 - RNA, 19 nt, Homo sapiens
gagccucgucaucgucauu

SEQ ID NO: 598938 - RNA, 19 nt, Homo sapiens
gguauggugguuucucuca

SEQ ID NO: 598939 - RNA, 19 nt, Homo sapiens
aggagacaauacccucauu

SEQ ID NO: 598940 - RNA, 19 nt, Homo sapiens
auuguuugcuccacaguug

SEQ ID NO: 598941 - RNA, 19 nt, Homo sapiens
ggugaggccacagucauug

SEQ ID NO: 598942 - RNA, 19 nt, Homo sapiens
ccaccucaauggccuaagc

SEQ ID NO: 598943 - RNA, 19 nt, Homo sapiens
gaggauguaaauaucuugu

SEQ ID NO: 598944 - RNA, 19 nt, Homo sapiens
ggccguggaggagacaaua

SEQ ID NO: 598945 - RNA, 19 nt, Homo sapiens
ugaggaggagcgccaguug

SEQ ID NO: 598946 - RNA, 19 nt, Homo sapiens
cuccacaguuggccuaauc

SEQ ID NO: 598947 - RNA, 19 nt, Homo sapiens
ccuccaggcaccuacauug

SEQ ID NO: 598948 - RNA, 19 nt, Homo sapiens
cggcuccuguuuucuauuu

SEQ ID NO: 598949 - RNA, 19 nt, Homo sapiens
ccacaucggaagugauuuu

SEQ ID NO: 598950 - RNA, 19 nt, Homo sapiens
ggcggauucucuuucucuu

SEQ ID NO: 598951 - RNA, 19 nt, Homo sapiens
ggagcgacggcugcugaaa

SEQ ID NO: 598952 - RNA, 19 nt, Homo sapiens
guagagaucugaaauaguu

SEQ ID NO: 598953 - RNA, 19 nt, Homo sapiens
gcaauuaguuucucauuca

SEQ ID NO: 598954 - RNA, 19 nt, Homo sapiens
gaauugcccuauaaacaua

SEQ ID NO: 598955 - RNA, 19 nt, Homo sapiens
cuaaacaucucacauauga

SEQ ID NO: 598956 - RNA, 19 nt, Homo sapiens
gaaauaguaccuugaguuu

SEQ ID NO: 598957 - RNA, 19 nt, Homo sapiens
ucagaaaugugcacacuaa

SEQ ID NO: 598958 - RNA, 19 nt, Homo sapiens
gaaaugugcacacuaauau

SEQ ID NO: 598959 - RNA, 19 nt, Homo sapiens
cagagcagcuuauagguaa

SEQ ID NO: 598960 - RNA, 19 nt, Homo sapiens
guaauacacucuucucuca

SEQ ID NO: 598961 - RNA, 19 nt, Homo sapiens
gaagagacuugugguauuc

SEQ ID NO: 598962 - RNA, 19 nt, Homo sapiens
ccaguuaaaucuuugguuu

SEQ ID NO: 598963 - RNA, 19 nt, Homo sapiens
guaggugccuuauugguuu

SEQ ID NO: 598964 - RNA, 19 nt, Homo sapiens
gcaacaaugugguuccuau

SEQ ID NO: 598965 - RNA, 19 nt, Homo sapiens
caacugcagugauacuauu

SEQ ID NO: 598966 - RNA, 19 nt, Homo sapiens
ucuaagaauugcccuauaa

SEQ ID NO: 598967 - RNA, 19 nt, Homo sapiens
ugaaagaacugagagauca

SEQ ID NO: 598968 - RNA, 19 nt, Homo sapiens
caagagcgauaucgagcua

SEQ ID NO: 598969 - RNA, 19 nt, Homo sapiens
ugaagagacuugugguauu

SEQ ID NO: 598970 - RNA, 19 nt, Homo sapiens
caagaagcauccagguuga

SEQ ID NO: 598971 - RNA, 19 nt, Homo sapiens
gcuauaacaucagcauauu

SEQ ID NO: 598972 - RNA, 19 nt, Homo sapiens
gaguacgacuaccucuuua

SEQ ID NO: 598973 - RNA, 19 nt, Homo sapiens
cagaacaucuaaggcauuu

SEQ ID NO: 598974 - RNA, 19 nt, Homo sapiens
gagauuuaccgcauuguuu

SEQ ID NO: 598975 - RNA, 19 nt, Homo sapiens
gaaagcaagagcaccauug

SEQ ID NO: 598976 - RNA, 19 nt, Homo sapiens
caagagcaccauuggagua

SEQ ID NO: 598977 - RNA, 19 nt, Homo sapiens
guagagcgauggcugaaag

SEQ ID NO: 598978 - RNA, 19 nt, Homo sapiens
guuaauuucugcucaagug

SEQ ID NO: 598979 - RNA, 19 nt, Homo sapiens
gacuaccucuuuaaaguug

SEQ ID NO: 598980 - RNA, 19 nt, Homo sapiens
ugugucaacugcagugaua

SEQ ID NO: 598981 - RNA, 19 nt, Homo sapiens
agaaaugugcacacuaaua

SEQ ID NO: 598982 - RNA, 19 nt, Homo sapiens
gaguagaguuugcaacaag

SEQ ID NO: 598983 - RNA, 19 nt, Homo sapiens
guacgacuaccucuuuaaa

SEQ ID NO: 598984 - RNA, 19 nt, Homo sapiens
ggaaggcauugcuguaguc

SEQ ID NO: 598985 - RNA, 19 nt, Homo sapiens
ccacuacauuguugaaauc

SEQ ID NO: 598986 - RNA, 19 nt, Homo sapiens
gaacaucuaaggcauuucu

SEQ ID NO: 598987 - RNA, 19 nt, Homo sapiens
ggaguagaguuugcaacaa

SEQ ID NO: 598988 - RNA, 19 nt, Homo sapiens
caguguacauuuccacaaa

SEQ ID NO: 598989 - RNA, 19 nt, Homo sapiens
cgaguacgacuaccucuuu

SEQ ID NO: 598990 - RNA, 19 nt, Homo sapiens
ggaagccugucacuguaug

SEQ ID NO: 598991 - RNA, 19 nt, Homo sapiens
ccacaaaucuaagaauugc

SEQ ID NO: 598992 - RNA, 19 nt, Homo sapiens
aauagaacuugaucacuug

SEQ ID NO: 598993 - RNA, 19 nt, Homo sapiens
ggacauaauagaacuugau

SEQ ID NO: 598994 - RNA, 19 nt, Homo sapiens
caauaaaggcacagauaug

SEQ ID NO: 598995 - RNA, 19 nt, Homo sapiens
ugaaauaguaccuugaguu

SEQ ID NO: 598996 - RNA, 19 nt, Homo sapiens
gauuguuacgguuucauua

SEQ ID NO: 598997 - RNA, 19 nt, Homo sapiens
agagcgauaucgagcuaua

SEQ ID NO: 598998 - RNA, 19 nt, Homo sapiens
gggcuugcuuagauuacua

SEQ ID NO: 598999 - RNA, 19 nt, Homo sapiens
gagguuaauuucugcucaa

SEQ ID NO: 599000 - RNA, 19 nt, Homo sapiens
aaacauagcaggauuuuga

SEQ ID NO: 599001 - RNA, 19 nt, Homo sapiens
gagcagcuuauagguaaua

SEQ ID NO: 599002 - RNA, 19 nt, Homo sapiens
gugcagugcugucagaaca

SEQ ID NO: 599003 - RNA, 19 nt, Homo sapiens
gcacuuacucugcaguuuc

SEQ ID NO: 599004 - RNA, 19 nt, Homo sapiens
gguagauuauguggcauuu

SEQ ID NO: 599005 - RNA, 19 nt, Homo sapiens
ccacagagcagcuuauagg

SEQ ID NO: 599006 - RNA, 19 nt, Homo sapiens
guaauucuugugucacuuu

SEQ ID NO: 599007 - RNA, 19 nt, Homo sapiens
gggcaguuccuacagauga

SEQ ID NO: 599008 - RNA, 19 nt, Homo sapiens
ugcaugcucuguaauuuga

SEQ ID NO: 599009 - RNA, 19 nt, Homo sapiens
guaagugaaauacaaccua

SEQ ID NO: 599010 - RNA, 19 nt, Homo sapiens
ccacuuaaaggcauguauu

SEQ ID NO: 599011 - RNA, 19 nt, Homo sapiens
gcugggaacugaagagacu

SEQ ID NO: 599012 - RNA, 19 nt, Homo sapiens
acaaugugguuccuauuca

SEQ ID NO: 599013 - RNA, 19 nt, Homo sapiens
acagagauuuaccgcauug

SEQ ID NO: 599014 - RNA, 19 nt, Homo sapiens
uaugcaugcucuguaauuu

SEQ ID NO: 599015 - RNA, 19 nt, Homo sapiens
ucuuagaaccuuccaguaa

SEQ ID NO: 599016 - RNA, 19 nt, Homo sapiens
ccauuauucuggacaugaa

SEQ ID NO: 599017 - RNA, 19 nt, Homo sapiens
ucagugcaguguacauuuc

SEQ ID NO: 599018 - RNA, 19 nt, Homo sapiens
cuauuggucuugaucaaau

SEQ ID NO: 599019 - RNA, 19 nt, Homo sapiens
cauggaagccugucacugu

SEQ ID NO: 599020 - RNA, 19 nt, Homo sapiens
cuagaaggcuguguauagu

SEQ ID NO: 599021 - RNA, 19 nt, Homo sapiens
caauaagagugaucuacgu

SEQ ID NO: 599022 - RNA, 19 nt, Homo sapiens
gcauugcuguagucaguca

SEQ ID NO: 599023 - RNA, 19 nt, Homo sapiens
agaguacagugagagguua

SEQ ID NO: 599024 - RNA, 19 nt, Homo sapiens
ccucaguuauuguuuacuu

SEQ ID NO: 599025 - RNA, 19 nt, Homo sapiens
ucccaggucugagauuuaa

SEQ ID NO: 599026 - RNA, 19 nt, Homo sapiens
ggaaagcaagagcaccauu

SEQ ID NO: 599027 - RNA, 19 nt, Homo sapiens
ccuagaaggcuguguauag

SEQ ID NO: 599028 - RNA, 19 nt, Homo sapiens
cagcagggcaagagcgaua

SEQ ID NO: 599029 - RNA, 19 nt, Homo sapiens
cgacuaccucuuuaaaguu

SEQ ID NO: 599030 - RNA, 19 nt, Homo sapiens
caaugaagcaauuaguuuc

SEQ ID NO: 599031 - RNA, 19 nt, Homo sapiens
caguaugucugaagaguac

SEQ ID NO: 599032 - RNA, 19 nt, Homo sapiens
uccaguaagugaaauacaa

SEQ ID NO: 599033 - RNA, 19 nt, Homo sapiens
gaaaaugacaugucuccaa

SEQ ID NO: 599034 - RNA, 19 nt, Homo sapiens
ugacauugcuaaacaucuc

SEQ ID NO: 599035 - RNA, 19 nt, Homo sapiens
aacaauaaaggcacagaua

SEQ ID NO: 599036 - RNA, 19 nt, Homo sapiens
ugugugggcuugcuuagau

SEQ ID NO: 599037 - RNA, 19 nt, Homo sapiens
uauuggagauucugguguu

SEQ ID NO: 599038 - RNA, 19 nt, Homo sapiens
uaaacagugcugccuggua

SEQ ID NO: 599039 - RNA, 19 nt, Homo sapiens
gcagugcugucagaacauc

SEQ ID NO: 599040 - RNA, 19 nt, Homo sapiens
ucagggcaguuccuacaga

SEQ ID NO: 599041 - RNA, 19 nt, Homo sapiens
uugcuaaacaucucacaua

SEQ ID NO: 599042 - RNA, 19 nt, Homo sapiens
ugaagcaauuaguuucuca

SEQ ID NO: 599043 - RNA, 19 nt, Homo sapiens
ggacacagcagggcaagag

SEQ ID NO: 599044 - RNA, 19 nt, Homo sapiens
acaauaaaggcacagauau

SEQ ID NO: 599045 - RNA, 19 nt, Homo sapiens
acagagcagcuuauaggua

SEQ ID NO: 599046 - RNA, 19 nt, Homo sapiens
gagauucugguguuggaaa

SEQ ID NO: 599047 - RNA, 19 nt, Homo sapiens
caacaaugugguuccuauu

SEQ ID NO: 599048 - RNA, 19 nt, Homo sapiens
acgacuaccucuuuaaagu

SEQ ID NO: 599049 - RNA, 19 nt, Homo sapiens
gcuaaacaucucacauaug

SEQ ID NO: 599050 - RNA, 19 nt, Homo sapiens
gagcaccauuggaguagag

SEQ ID NO: 599051 - RNA, 19 nt, Homo sapiens
gaaccuuccaguaagugaa

SEQ ID NO: 599052 - RNA, 19 nt, Homo sapiens
ggaauuaucucugaacaua

SEQ ID NO: 599053 - RNA, 19 nt, Homo sapiens
gaacauaccuguaaaucau

SEQ ID NO: 599054 - RNA, 19 nt, Homo sapiens
gaaaggaugucuuaagaga

SEQ ID NO: 599055 - RNA, 19 nt, Homo sapiens
gaagaaaguuugccauaug

SEQ ID NO: 599056 - RNA, 19 nt, Homo sapiens
ggacaucgaccuguuauua

SEQ ID NO: 599057 - RNA, 19 nt, Homo sapiens
caauaugacuccuccuuua

SEQ ID NO: 599058 - RNA, 19 nt, Homo sapiens
gagaacauuugaagagaua

SEQ ID NO: 599059 - RNA, 19 nt, Homo sapiens
uaaaugaacuccuacauag

SEQ ID NO: 599060 - RNA, 19 nt, Homo sapiens
gaaaguggaugggcacaaa

SEQ ID NO: 599061 - RNA, 19 nt, Homo sapiens
ggaaaucacaguugggaua

SEQ ID NO: 599062 - RNA, 19 nt, Homo sapiens
gaaagaggacuaugaacuu

SEQ ID NO: 599063 - RNA, 19 nt, Homo sapiens
ucaaagggcugcauucugu

SEQ ID NO: 599064 - RNA, 19 nt, Homo sapiens
gcucaagacuguuauuuua

SEQ ID NO: 599065 - RNA, 19 nt, Homo sapiens
gaaaguuugccauaugaua

SEQ ID NO: 599066 - RNA, 19 nt, Homo sapiens
gaaauugcccuugguguaa

SEQ ID NO: 599067 - RNA, 19 nt, Homo sapiens
gagggacaauuaucuauau

SEQ ID NO: 599068 - RNA, 19 nt, Homo sapiens
acacaaagcuagauuuagu

SEQ ID NO: 599069 - RNA, 19 nt, Homo sapiens
cguaugaucucucuaauag

SEQ ID NO: 599070 - RNA, 19 nt, Homo sapiens
ccagaaggagggacaauua

SEQ ID NO: 599071 - RNA, 19 nt, Homo sapiens
gauaauguauaguguguca

SEQ ID NO: 599072 - RNA, 19 nt, Homo sapiens
aaaugggucuucagccuua

SEQ ID NO: 599073 - RNA, 19 nt, Homo sapiens
aaacaaaguuacagagugu

SEQ ID NO: 599074 - RNA, 19 nt, Homo sapiens
gggaauaguuacugaauac

SEQ ID NO: 599075 - RNA, 19 nt, Homo sapiens
ggagggacaauuaucuaua

SEQ ID NO: 599076 - RNA, 19 nt, Homo sapiens
gaaaagcucaagacuguua

SEQ ID NO: 599077 - RNA, 19 nt, Homo sapiens
gaagaugucaccaauccuu

SEQ ID NO: 599078 - RNA, 19 nt, Homo sapiens
caagaggaaucauguggau

SEQ ID NO: 599079 - RNA, 19 nt, Homo sapiens
ugaagaaaguuugccauau

SEQ ID NO: 599080 - RNA, 19 nt, Homo sapiens
gggaagacauugugaacca

SEQ ID NO: 599081 - RNA, 19 nt, Homo sapiens
gcuaugcaguuaucacaug

SEQ ID NO: 599082 - RNA, 19 nt, Homo sapiens
gaacgucugcagccuggua

SEQ ID NO: 599083 - RNA, 19 nt, Homo sapiens
aagaaaguuugccauauga

SEQ ID NO: 599084 - RNA, 19 nt, Homo sapiens
ugaaauugcccuuggugua

SEQ ID NO: 599085 - RNA, 19 nt, Homo sapiens
cauccaaggagaagaauuu

SEQ ID NO: 599086 - RNA, 19 nt, Homo sapiens
gacaucgaccuguuauuaa

SEQ ID NO: 599087 - RNA, 19 nt, Homo sapiens
caaggacaucgaccuguua

SEQ ID NO: 599088 - RNA, 19 nt, Homo sapiens
cagauaauguauagugugu

SEQ ID NO: 599089 - RNA, 19 nt, Homo sapiens
aaagaggacuaugaacuug

SEQ ID NO: 599090 - RNA, 19 nt, Homo sapiens
gauguugcuuggccauuga

SEQ ID NO: 599091 - RNA, 19 nt, Homo sapiens
gggacuugaucaugaaaga

SEQ ID NO: 599092 - RNA, 19 nt, Homo sapiens
gaagacauugugaaccaaa

SEQ ID NO: 599093 - RNA, 19 nt, Homo sapiens
uagaaaagcucaagacugu

SEQ ID NO: 599094 - RNA, 19 nt, Homo sapiens
uaucacaugggaaguguua

SEQ ID NO: 599095 - RNA, 19 nt, Homo sapiens
ccagggacuugaucaugaa

SEQ ID NO: 599096 - RNA, 19 nt, Homo sapiens
caagugccauucaccuaug

SEQ ID NO: 599097 - RNA, 19 nt, Homo sapiens
gaccuguuauuaaugaaga

SEQ ID NO: 599098 - RNA, 19 nt, Homo sapiens
caccaauccuuugcagaua

SEQ ID NO: 599099 - RNA, 19 nt, Homo sapiens
gggaaguguuauccagaaa

SEQ ID NO: 599100 - RNA, 19 nt, Homo sapiens
gaaggagggacaauuaucu

SEQ ID NO: 599101 - RNA, 19 nt, Homo sapiens
gauugcagauuuugguuua

SEQ ID NO: 599102 - RNA, 19 nt, Homo sapiens
cuuaagagaagcugaaauu

SEQ ID NO: 599103 - RNA, 19 nt, Homo sapiens
aauagugguucuccugaaa

SEQ ID NO: 599104 - RNA, 19 nt, Homo sapiens
acaaggacaucgaccuguu

SEQ ID NO: 599105 - RNA, 19 nt, Homo sapiens
gaauacaugccaaauggau

SEQ ID NO: 599106 - RNA, 19 nt, Homo sapiens
gcauguaagugacuguuuu

SEQ ID NO: 599107 - RNA, 19 nt, Homo sapiens
ggaagacauugugaaccaa

SEQ ID NO: 599108 - RNA, 19 nt, Homo sapiens
cugaauacaugccaaaugg

SEQ ID NO: 599109 - RNA, 19 nt, Homo sapiens
ugggaauaguuacugaaua

SEQ ID NO: 599110 - RNA, 19 nt, Homo sapiens
gacaauuacuagacacuac

SEQ ID NO: 599111 - RNA, 19 nt, Homo sapiens
caugaaagaggacuaugaa

SEQ ID NO: 599112 - RNA, 19 nt, Homo sapiens
cugcaucacuguccuggaa

SEQ ID NO: 599113 - RNA, 19 nt, Homo sapiens
ucucugaacauaccuguaa

SEQ ID NO: 599114 - RNA, 19 nt, Homo sapiens
gcucgacagugaaagaaag

SEQ ID NO: 599115 - RNA, 19 nt, Homo sapiens
gacagaagccugccuuaac

SEQ ID NO: 599116 - RNA, 19 nt, Homo sapiens
ugacagaagccugccuuaa

SEQ ID NO: 599117 - RNA, 19 nt, Homo sapiens
gauuucgcauccugcauga

SEQ ID NO: 599118 - RNA, 19 nt, Homo sapiens
agaggacuaugaacuuguu

SEQ ID NO: 599119 - RNA, 19 nt, Homo sapiens
uccagggacuugaucauga

SEQ ID NO: 599120 - RNA, 19 nt, Homo sapiens
aaggaugucuuaagagaag

SEQ ID NO: 599121 - RNA, 19 nt, Homo sapiens
gcaauaauaaauccacucu

SEQ ID NO: 599122 - RNA, 19 nt, Homo sapiens
acaucgaccuguuauuaau

SEQ ID NO: 599123 - RNA, 19 nt, Homo sapiens
cgauauauauagcuaugca

SEQ ID NO: 599124 - RNA, 19 nt, Homo sapiens
caaaguggcgcaugauguc

SEQ ID NO: 599125 - RNA, 19 nt, Homo sapiens
ugacauccaaggagaagaa

SEQ ID NO: 599126 - RNA, 19 nt, Homo sapiens
gcucuucagcaauaauaaa

SEQ ID NO: 599127 - RNA, 19 nt, Homo sapiens
gcaucacuguccuggaaau

SEQ ID NO: 599128 - RNA, 19 nt, Homo sapiens
gauccucucagcuccauga

SEQ ID NO: 599129 - RNA, 19 nt, Homo sapiens
ugagaacauuugaagagau

SEQ ID NO: 599130 - RNA, 19 nt, Homo sapiens
ugccaaaguuauaguacaa

SEQ ID NO: 599131 - RNA, 19 nt, Homo sapiens
gaaaucacaguugggauag

SEQ ID NO: 599132 - RNA, 19 nt, Homo sapiens
aaauagugguucuccugaa

SEQ ID NO: 599133 - RNA, 19 nt, Homo sapiens
ccaauccuuugcagauaau

SEQ ID NO: 599134 - RNA, 19 nt, Homo sapiens
cacgauauauauagcuaug

SEQ ID NO: 599135 - RNA, 19 nt, Homo sapiens
gacuugaagacucagaaua

SEQ ID NO: 599136 - RNA, 19 nt, Homo sapiens
agacacuacugacauccaa

SEQ ID NO: 599137 - RNA, 19 nt, Homo sapiens
uaaaucaugguccacaaga

SEQ ID NO: 599138 - RNA, 19 nt, Homo sapiens
gcaugaaauugcccuuggu

SEQ ID NO: 599139 - RNA, 19 nt, Homo sapiens
acaaggaccucaaaaguca

SEQ ID NO: 599140 - RNA, 19 nt, Homo sapiens
gaucaugaaagaggacuau

SEQ ID NO: 599141 - RNA, 19 nt, Homo sapiens
aaauugcccuugguguaaa

SEQ ID NO: 599142 - RNA, 19 nt, Homo sapiens
ugaagcaccugcacaucca

SEQ ID NO: 599143 - RNA, 19 nt, Homo sapiens
acaaacaaaugggucuuca

SEQ ID NO: 599144 - RNA, 19 nt, Homo sapiens
ugaaagaggacuaugaacu

SEQ ID NO: 599145 - RNA, 19 nt, Homo sapiens
ccucucagcuccaugaaaa

SEQ ID NO: 599146 - RNA, 19 nt, Homo sapiens
uuacagaguguuucaagug

SEQ ID NO: 599147 - RNA, 19 nt, Homo sapiens
gaccaucuuucuuaaaaug

SEQ ID NO: 599148 - RNA, 19 nt, Homo sapiens
ugggaaguguuauccagaa

SEQ ID NO: 599149 - RNA, 19 nt, Homo sapiens
accaauccuuugcagauaa

SEQ ID NO: 599150 - RNA, 19 nt, Homo sapiens
ucaccaauccuuugcagau

SEQ ID NO: 599151 - RNA, 19 nt, Homo sapiens
gcuuggccauugagauuuc

SEQ ID NO: 599152 - RNA, 19 nt, Homo sapiens
ugagguuucuuaaagcuua

SEQ ID NO: 599153 - RNA, 19 nt, Homo sapiens
caggacaucuccaucaaga

SEQ ID NO: 599154 - RNA, 19 nt, Homo sapiens
ucaucgacuuuguggcuuu

SEQ ID NO: 599155 - RNA, 19 nt, Homo sapiens
gagguuucuuaaagcuuau

SEQ ID NO: 599156 - RNA, 19 nt, Homo sapiens
aaaugagguuucuuaaagc

SEQ ID NO: 599157 - RNA, 19 nt, Homo sapiens
uccaggacaucuccaucaa

SEQ ID NO: 599158 - RNA, 19 nt, Homo sapiens
accaggagcugaggagugu

SEQ ID NO: 599159 - RNA, 19 nt, Homo sapiens
uggcagaaacacccaccua

SEQ ID NO: 599160 - RNA, 19 nt, Homo sapiens
gcaccccacuugcacugaa

SEQ ID NO: 599161 - RNA, 19 nt, Homo sapiens
caggagcugaggaguguga

SEQ ID NO: 599162 - RNA, 19 nt, Homo sapiens
ggacagggcucucuaauaa

SEQ ID NO: 599163 - RNA, 19 nt, Homo sapiens
gaacccacccaacagaaua

SEQ ID NO: 599164 - RNA, 19 nt, Homo sapiens
gaucugggccugccucuga

SEQ ID NO: 599165 - RNA, 19 nt, Homo sapiens
gcacagguucagcauguuu

SEQ ID NO: 599166 - RNA, 19 nt, Homo sapiens
ggacgaggcuguggcuauc

SEQ ID NO: 599167 - RNA, 19 nt, Homo sapiens
caggguguaugacaacuuu

SEQ ID NO: 599168 - RNA, 19 nt, Homo sapiens
gggacagggcucucuaaua

SEQ ID NO: 599169 - RNA, 19 nt, Homo sapiens
gcccaguucuuccguguug

SEQ ID NO: 599170 - RNA, 19 nt, Homo sapiens
gggccaagcucuucauggu

SEQ ID NO: 599171 - RNA, 19 nt, Homo sapiens
gggaagacccagagcaaga

SEQ ID NO: 599172 - RNA, 19 nt, Homo sapiens
ggacagggccaagcucuuc

SEQ ID NO: 599173 - RNA, 19 nt, Homo sapiens
caagaacccacccaacaga

SEQ ID NO: 599174 - RNA, 19 nt, Homo sapiens
gaucucguccuuccuuaga

SEQ ID NO: 599175 - RNA, 19 nt, Homo sapiens
gggcacguguccacuuuua

SEQ ID NO: 599176 - RNA, 19 nt, Homo sapiens
caagaucucguccuuccuu

SEQ ID NO: 599177 - RNA, 19 nt, Homo sapiens
acaaggugcuggcuguguu

SEQ ID NO: 599178 - RNA, 19 nt, Homo sapiens
ccaaggcuucuaccaguuu

SEQ ID NO: 599179 - RNA, 19 nt, Homo sapiens
cuucaggccucuaggaugu

SEQ ID NO: 599180 - RNA, 19 nt, Homo sapiens
gccaagaacccacccaaca

SEQ ID NO: 599181 - RNA, 19 nt, Homo sapiens
cugcacagguucagcaugu

SEQ ID NO: 599182 - RNA, 19 nt, Homo sapiens
agagcaagaucucguccuu

SEQ ID NO: 599183 - RNA, 19 nt, Homo sapiens
gaggagggaggaagaagau

SEQ ID NO: 599184 - RNA, 19 nt, Homo sapiens
gccuguguguggaguauga

SEQ ID NO: 599185 - RNA, 19 nt, Homo sapiens
caaggcuucuaccaguuug

SEQ ID NO: 599186 - RNA, 19 nt, Homo sapiens
cuacaaggguuccgaugac

SEQ ID NO: 599187 - RNA, 19 nt, Homo sapiens
caacuuuggccaugucauc

SEQ ID NO: 599188 - RNA, 19 nt, Homo sapiens
agaugagggucuucacuuc

SEQ ID NO: 599189 - RNA, 19 nt, Homo sapiens
gagaagcccugagcuaccu

SEQ ID NO: 599190 - RNA, 19 nt, Homo sapiens
ggaagacccagagcaagau

SEQ ID NO: 599191 - RNA, 19 nt, Homo sapiens
caaggguuccgaugacuuc

SEQ ID NO: 599192 - RNA, 19 nt, Homo sapiens
gacagggcucucuaauaaa

SEQ ID NO: 599193 - RNA, 19 nt, Homo sapiens
ggaagcagagcgucaugca

SEQ ID NO: 599194 - RNA, 19 nt, Homo sapiens
aagaucucguccuuccuua

SEQ ID NO: 599195 - RNA, 19 nt, Homo sapiens
cagaugagggucuucacuu

SEQ ID NO: 599196 - RNA, 19 nt, Homo sapiens
gggacgaggcuguggcuau

SEQ ID NO: 599197 - RNA, 19 nt, Homo sapiens
accauaagcagcaguuuga

SEQ ID NO: 599198 - RNA, 19 nt, Homo sapiens
ccaggaaagcuaagagucu

SEQ ID NO: 599199 - RNA, 19 nt, Homo sapiens
cugcaaagccagaggacuu

SEQ ID NO: 599200 - RNA, 19 nt, Homo sapiens
ccaagaacccacccaacag

SEQ ID NO: 599201 - RNA, 19 nt, Homo sapiens
caccauaagcagcaguuug

SEQ ID NO: 599202 - RNA, 19 nt, Homo sapiens
agacguggcccaguucuuc

SEQ ID NO: 599203 - RNA, 19 nt, Homo sapiens
ugacagccuauaagcaaga

SEQ ID NO: 599204 - RNA, 19 nt, Homo sapiens
cgaggagggaggaagaaga

SEQ ID NO: 599205 - RNA, 19 nt, Homo sapiens
ucugagaagcccugagcua

SEQ ID NO: 599206 - RNA, 19 nt, Homo sapiens
cacccaacguggcuugauc

SEQ ID NO: 599207 - RNA, 19 nt, Homo sapiens
gaagacccagagcaagauc

SEQ ID NO: 599208 - RNA, 19 nt, Homo sapiens
gcagaugagggucuucacu

SEQ ID NO: 599209 - RNA, 19 nt, Homo sapiens
uccgagacguggcccaguu

SEQ ID NO: 599210 - RNA, 19 nt, Homo sapiens
gcacguguccacuuuuaau

SEQ ID NO: 599211 - RNA, 19 nt, Homo sapiens
cagugugcguggagaagau

SEQ ID NO: 599212 - RNA, 19 nt, Homo sapiens
caaggugcuggcuguguug

SEQ ID NO: 599213 - RNA, 19 nt, Homo sapiens
gaaagugcuuccccagaac

SEQ ID NO: 599214 - RNA, 19 nt, Homo sapiens
uccaaggcuucuaccaguu

SEQ ID NO: 599215 - RNA, 19 nt, Homo sapiens
cccugucccuccugucuga

SEQ ID NO: 599216 - RNA, 19 nt, Homo sapiens
ggacagggcucucuaauaa

SEQ ID NO: 599217 - RNA, 19 nt, Homo sapiens
gcaagucgcuccugucauu

SEQ ID NO: 599218 - RNA, 19 nt, Homo sapiens
gcagcaagccgacaucaua

SEQ ID NO: 599219 - RNA, 19 nt, Homo sapiens
ggacagucgugaucuuuga

SEQ ID NO: 599220 - RNA, 19 nt, Homo sapiens
gagggaaggugcugagcua

SEQ ID NO: 599221 - RNA, 19 nt, Homo sapiens
gaagaugugugaagaaucg

SEQ ID NO: 599222 - RNA, 19 nt, Homo sapiens
gaacccacccaacagaaua

SEQ ID NO: 599223 - RNA, 19 nt, Homo sapiens
gagaagaugugugaagaau

SEQ ID NO: 599224 - RNA, 19 nt, Homo sapiens
gaccaucagugcuuacuau

SEQ ID NO: 599225 - RNA, 19 nt, Homo sapiens
ccagggagcuacaucuuug

SEQ ID NO: 599226 - RNA, 19 nt, Homo sapiens
gaauggccguggugugauu

SEQ ID NO: 599227 - RNA, 19 nt, Homo sapiens
gaucugggccugccucuga

SEQ ID NO: 599228 - RNA, 19 nt, Homo sapiens
gcagagcacacaacauuga

SEQ ID NO: 599229 - RNA, 19 nt, Homo sapiens
ucacacaggucaucaacga

SEQ ID NO: 599230 - RNA, 19 nt, Homo sapiens
gagaguaaccaucuacaga

SEQ ID NO: 599231 - RNA, 19 nt, Homo sapiens
ccauagggauucucgaaga

SEQ ID NO: 599232 - RNA, 19 nt, Homo sapiens
ugaagaaacaagagaguaa

SEQ ID NO: 599233 - RNA, 19 nt, Homo sapiens
gaagagaacagcguugugu

SEQ ID NO: 599234 - RNA, 19 nt, Homo sapiens
gcacagguucagcauguuu

SEQ ID NO: 599235 - RNA, 19 nt, Homo sapiens
ggacgaggcuguggcuauc

SEQ ID NO: 599236 - RNA, 19 nt, Homo sapiens
caggguguaugacaacuuu

SEQ ID NO: 599237 - RNA, 19 nt, Homo sapiens
gggacagggcucucuaaua

SEQ ID NO: 599238 - RNA, 19 nt, Homo sapiens
uugcaaagcugaagaugau

SEQ ID NO: 599239 - RNA, 19 nt, Homo sapiens
ugaagaaucggcauccuuu

SEQ ID NO: 599240 - RNA, 19 nt, Homo sapiens
ggaaggugcugagcuacug

SEQ ID NO: 599241 - RNA, 19 nt, Homo sapiens
gcccaguucuuccguguug

SEQ ID NO: 599242 - RNA, 19 nt, Homo sapiens
ggaaggcucugggcaacau

SEQ ID NO: 599243 - RNA, 19 nt, Homo sapiens
ccgcagagcacacaacauu

SEQ ID NO: 599244 - RNA, 19 nt, Homo sapiens
gggccaagcucuucauggu

SEQ ID NO: 599245 - RNA, 19 nt, Homo sapiens
gggcuggacuucucagaca

SEQ ID NO: 599246 - RNA, 19 nt, Homo sapiens
caucagugcuuacuaugca

SEQ ID NO: 599247 - RNA, 19 nt, Homo sapiens
cuacaucuuugagcuguuu

SEQ ID NO: 599248 - RNA, 19 nt, Homo sapiens
ggacaucccaaagauuauu

SEQ ID NO: 599249 - RNA, 19 nt, Homo sapiens
acacggacaucccaaagau

SEQ ID NO: 599250 - RNA, 19 nt, Homo sapiens
gggaagacccagagcaaga

SEQ ID NO: 599251 - RNA, 19 nt, Homo sapiens
gaccacagguucgccuuug

SEQ ID NO: 599252 - RNA, 19 nt, Homo sapiens
ggacagggccaagcucuuc

SEQ ID NO: 599253 - RNA, 19 nt, Homo sapiens
ccuaugggcuccugaucuu

SEQ ID NO: 599254 - RNA, 19 nt, Homo sapiens
gcaagccgacaucauauuc

SEQ ID NO: 599255 - RNA, 19 nt, Homo sapiens
ggacuacggagcugucuuc

SEQ ID NO: 599256 - RNA, 19 nt, Homo sapiens
gacauuauccagauugugu

SEQ ID NO: 599257 - RNA, 19 nt, Homo sapiens
acagggcucucuaauaaag

SEQ ID NO: 599258 - RNA, 19 nt, Homo sapiens
caagaacccacccaacaga

SEQ ID NO: 599259 - RNA, 19 nt, Homo sapiens
gagcugucuuccucuguga

SEQ ID NO: 599260 - RNA, 19 nt, Homo sapiens
ggagaagaugugugaagaa

SEQ ID NO: 599261 - RNA, 19 nt, Homo sapiens
ggacuucucagacacgaau

SEQ ID NO: 599262 - RNA, 19 nt, Homo sapiens
ggagaacccacacaucauc

SEQ ID NO: 599263 - RNA, 19 nt, Homo sapiens
acggacaucccaaagauua

SEQ ID NO: 599264 - RNA, 19 nt, Homo sapiens
gaucucguccuuccuuaga

SEQ ID NO: 599265 - RNA, 19 nt, Homo sapiens
ugaauggugugaccguaga

SEQ ID NO: 599266 - RNA, 19 nt, Homo sapiens
gaagcuggcggacauuauc

SEQ ID NO: 599267 - RNA, 19 nt, Homo sapiens
gcccagaucacguuucaga

SEQ ID NO: 599268 - RNA, 19 nt, Homo sapiens
acaagagaguaaccaucua

SEQ ID NO: 599269 - RNA, 19 nt, Homo sapiens
gggcacguguccacuuuua

SEQ ID NO: 599270 - RNA, 19 nt, Homo sapiens
caagaucucguccuuccuu

SEQ ID NO: 599271 - RNA, 19 nt, Homo sapiens
gcugauaugcccaagauag

SEQ ID NO: 599272 - RNA, 19 nt, Homo sapiens
acaaggugcuggcuguguu

SEQ ID NO: 599273 - RNA, 19 nt, Homo sapiens
ccaaggcuucuaccaguuu

SEQ ID NO: 599274 - RNA, 19 nt, Homo sapiens
gaccguagacuucccuuuc

SEQ ID NO: 599275 - RNA, 19 nt, Homo sapiens
ccaagauaguccugaaugg

SEQ ID NO: 599276 - RNA, 19 nt, Homo sapiens
gaagaaucggcauccuuug

SEQ ID NO: 599277 - RNA, 19 nt, Homo sapiens
uggagaagaugugugaaga

SEQ ID NO: 599278 - RNA, 19 nt, Homo sapiens
gaaacaagagaguaaccau

SEQ ID NO: 599279 - RNA, 19 nt, Homo sapiens
ccaagguccuggaaugucu

SEQ ID NO: 599280 - RNA, 19 nt, Homo sapiens
gccaagaacccacccaaca

SEQ ID NO: 599281 - RNA, 19 nt, Homo sapiens
ccgagaccaucagugcuua

SEQ ID NO: 599282 - RNA, 19 nt, Homo sapiens
gagcuccgcguuugacaga

SEQ ID NO: 599283 - RNA, 19 nt, Homo sapiens
uauucaugccguacaauua

SEQ ID NO: 599284 - RNA, 19 nt, Homo sapiens
cugcacagguucagcaugu

SEQ ID NO: 599285 - RNA, 19 nt, Homo sapiens
caguugagcuccgcguuug

SEQ ID NO: 599286 - RNA, 19 nt, Homo sapiens
acauggagcuggaagacau

SEQ ID NO: 599287 - RNA, 19 nt, Homo sapiens
acaaaugccaacaggagua

SEQ ID NO: 599288 - RNA, 19 nt, Homo sapiens
agagcaagaucucguccuu

SEQ ID NO: 599289 - RNA, 19 nt, Homo sapiens
ggccaucgaugcuguugag

SEQ ID NO: 599290 - RNA, 19 nt, Homo sapiens
gcucugugcccuucugaga

SEQ ID NO: 599291 - RNA, 19 nt, Homo sapiens
gaggagggaggaagaagau

SEQ ID NO: 599292 - RNA, 19 nt, Homo sapiens
gccuguguguggaguauga

SEQ ID NO: 599293 - RNA, 19 nt, Homo sapiens
caaggcuucuaccaguuug

SEQ ID NO: 599294 - RNA, 19 nt, Homo sapiens
cuacaaggguuccgaugac

SEQ ID NO: 599295 - RNA, 19 nt, Homo sapiens
caacuuuggccaugucauc

SEQ ID NO: 599296 - RNA, 19 nt, Homo sapiens
gcgcugaagccgcuguuug

SEQ ID NO: 599297 - RNA, 19 nt, Homo sapiens
ccuauaaggugcacaucca

SEQ ID NO: 599298 - RNA, 19 nt, Homo sapiens
gaacauggagcuggaagac

SEQ ID NO: 599299 - RNA, 19 nt, Homo sapiens
acacaacauugaccugaag

SEQ ID NO: 599300 - RNA, 19 nt, Homo sapiens
gagaagcccugagcuaccu

SEQ ID NO: 599301 - RNA, 19 nt, Homo sapiens
gggccuuacaguccuauaa

SEQ ID NO: 599302 - RNA, 19 nt, Homo sapiens
cagaagcuggcggacauua

SEQ ID NO: 599303 - RNA, 19 nt, Homo sapiens
gccagggagcuacaucuuu

SEQ ID NO: 599304 - RNA, 19 nt, Homo sapiens
ggagagcccuacggguaca

SEQ ID NO: 599305 - RNA, 19 nt, Homo sapiens
gugaagaaacaagagagua

SEQ ID NO: 599306 - RNA, 19 nt, Homo sapiens
ggaagacccagagcaagau

SEQ ID NO: 599307 - RNA, 19 nt, Homo sapiens
caaggguuccgaugacuuc

SEQ ID NO: 599308 - RNA, 19 nt, Homo sapiens
agaugcaguuccuggauga

SEQ ID NO: 599309 - RNA, 19 nt, Homo sapiens
gaucuucuucccuuccuau

SEQ ID NO: 599310 - RNA, 19 nt, Homo sapiens
gcaccacugcagccagaaa

SEQ ID NO: 599311 - RNA, 19 nt, Homo sapiens
gaucgggccuugucauccu

SEQ ID NO: 599312 - RNA, 19 nt, Homo sapiens
gugcuggaguguucaccaa

SEQ ID NO: 599313 - RNA, 19 nt, Homo sapiens
uggaagacauugcaaagcu

SEQ ID NO: 599314 - RNA, 19 nt, Homo sapiens
cacacaacauugaccugaa

SEQ ID NO: 599315 - RNA, 19 nt, Homo sapiens
ucauauucaugccguacaa

SEQ ID NO: 599316 - RNA, 19 nt, Homo sapiens
ugagguuucuuaaagcuua

SEQ ID NO: 599317 - RNA, 19 nt, Homo sapiens
caggacaucuccaucaaga

SEQ ID NO: 599318 - RNA, 19 nt, Homo sapiens
gcacagguucagcauguuu

SEQ ID NO: 599319 - RNA, 19 nt, Homo sapiens
gggaagacccagagcaaga

SEQ ID NO: 599320 - RNA, 19 nt, Homo sapiens
gaucucguccuuccuuaga

SEQ ID NO: 599321 - RNA, 19 nt, Homo sapiens
caagaucucguccuuccuu

SEQ ID NO: 599322 - RNA, 19 nt, Homo sapiens
cugcacagguucagcaugu

SEQ ID NO: 599323 - RNA, 19 nt, Homo sapiens
agagcaagaucucguccuu

SEQ ID NO: 599324 - RNA, 19 nt, Homo sapiens
ggaagacccagagcaagau

SEQ ID NO: 599325 - RNA, 19 nt, Homo sapiens
ucaucgacuuuguggcuuu

SEQ ID NO: 599326 - RNA, 19 nt, Homo sapiens
ggaagcagagcgucaugca

SEQ ID NO: 599327 - RNA, 19 nt, Homo sapiens
aagaucucguccuuccuua

SEQ ID NO: 599328 - RNA, 19 nt, Homo sapiens
gagguuucuuaaagcuuau

SEQ ID NO: 599329 - RNA, 19 nt, Homo sapiens
cugcaaagccagaggacuu

SEQ ID NO: 599330 - RNA, 19 nt, Homo sapiens
aaaugagguuucuuaaagc

SEQ ID NO: 599331 - RNA, 19 nt, Homo sapiens
uccaggacaucuccaucaa

SEQ ID NO: 599332 - RNA, 19 nt, Homo sapiens
accaggagcugaggagugu

SEQ ID NO: 599333 - RNA, 19 nt, Homo sapiens
gaagacccagagcaagauc

SEQ ID NO: 599334 - RNA, 19 nt, Homo sapiens
uggcagaaacacccaccua

SEQ ID NO: 599335 - RNA, 19 nt, Homo sapiens
gcaccccacuugcacugaa

SEQ ID NO: 599336 - RNA, 19 nt, Homo sapiens
caggagcugaggaguguga

SEQ ID NO: 599337 - RNA, 19 nt, Homo sapiens
gcaagucgcuccugucauu

SEQ ID NO: 599338 - RNA, 19 nt, Homo sapiens
gcagcaagccgacaucaua

SEQ ID NO: 599339 - RNA, 19 nt, Homo sapiens
ggacagucgugaucuuuga

SEQ ID NO: 599340 - RNA, 19 nt, Homo sapiens
gagggaaggugcugagcua

SEQ ID NO: 599341 - RNA, 19 nt, Homo sapiens
gaagaugugugaagaaucg

SEQ ID NO: 599342 - RNA, 19 nt, Homo sapiens
ugagguuucuuaaagcuua

SEQ ID NO: 599343 - RNA, 19 nt, Homo sapiens
gagaagaugugugaagaau

SEQ ID NO: 599344 - RNA, 19 nt, Homo sapiens
gaccaucagugcuuacuau

SEQ ID NO: 599345 - RNA, 19 nt, Homo sapiens
ccagggagcuacaucuuug

SEQ ID NO: 599346 - RNA, 19 nt, Homo sapiens
gaauggccguggugugauu

SEQ ID NO: 599347 - RNA, 19 nt, Homo sapiens
gcagagcacacaacauuga

SEQ ID NO: 599348 - RNA, 19 nt, Homo sapiens
ucacacaggucaucaacga

SEQ ID NO: 599349 - RNA, 19 nt, Homo sapiens
caggacaucuccaucaaga

SEQ ID NO: 599350 - RNA, 19 nt, Homo sapiens
gagaguaaccaucuacaga

SEQ ID NO: 599351 - RNA, 19 nt, Homo sapiens
ccauagggauucucgaaga

SEQ ID NO: 599352 - RNA, 19 nt, Homo sapiens
ugaagaaacaagagaguaa

SEQ ID NO: 599353 - RNA, 19 nt, Homo sapiens
gaagagaacagcguugugu

SEQ ID NO: 599354 - RNA, 19 nt, Homo sapiens
gcacagguucagcauguuu

SEQ ID NO: 599355 - RNA, 19 nt, Homo sapiens
ggacgaggcuguggcuauc

SEQ ID NO: 599356 - RNA, 19 nt, Homo sapiens
caggguguaugacaacuuu

SEQ ID NO: 599357 - RNA, 19 nt, Homo sapiens
uugcaaagcugaagaugau

SEQ ID NO: 599358 - RNA, 19 nt, Homo sapiens
ugaagaaucggcauccuuu

SEQ ID NO: 599359 - RNA, 19 nt, Homo sapiens
ggaaggugcugagcuacug

SEQ ID NO: 599360 - RNA, 19 nt, Homo sapiens
gcccaguucuuccguguug

SEQ ID NO: 599361 - RNA, 19 nt, Homo sapiens
ggaaggcucugggcaacau

SEQ ID NO: 599362 - RNA, 19 nt, Homo sapiens
ccgcagagcacacaacauu

SEQ ID NO: 599363 - RNA, 19 nt, Homo sapiens
gggccaagcucuucauggu

SEQ ID NO: 599364 - RNA, 19 nt, Homo sapiens
gggcuggacuucucagaca

SEQ ID NO: 599365 - RNA, 19 nt, Homo sapiens
caucagugcuuacuaugca

SEQ ID NO: 599366 - RNA, 19 nt, Homo sapiens
cuacaucuuugagcuguuu

SEQ ID NO: 599367 - RNA, 19 nt, Homo sapiens
ggacaucccaaagauuauu

SEQ ID NO: 599368 - RNA, 19 nt, Homo sapiens
acacggacaucccaaagau

SEQ ID NO: 599369 - RNA, 19 nt, Homo sapiens
gggaagacccagagcaaga

SEQ ID NO: 599370 - RNA, 19 nt, Homo sapiens
gaccacagguucgccuuug

SEQ ID NO: 599371 - RNA, 19 nt, Homo sapiens
ggacagggccaagcucuuc

SEQ ID NO: 599372 - RNA, 19 nt, Homo sapiens
ccuaugggcuccugaucuu

SEQ ID NO: 599373 - RNA, 19 nt, Homo sapiens
gcaagccgacaucauauuc

SEQ ID NO: 599374 - RNA, 19 nt, Homo sapiens
ggacuacggagcugucuuc

SEQ ID NO: 599375 - RNA, 19 nt, Homo sapiens
gacauuauccagauugugu

SEQ ID NO: 599376 - RNA, 19 nt, Homo sapiens
gagcugucuuccucuguga

SEQ ID NO: 599377 - RNA, 19 nt, Homo sapiens
ggagaagaugugugaagaa

SEQ ID NO: 599378 - RNA, 19 nt, Homo sapiens
ggacuucucagacacgaau

SEQ ID NO: 599379 - RNA, 19 nt, Homo sapiens
ggagaacccacacaucauc

SEQ ID NO: 599380 - RNA, 19 nt, Homo sapiens
acggacaucccaaagauua

SEQ ID NO: 599381 - RNA, 19 nt, Homo sapiens
gaucucguccuuccuuaga

SEQ ID NO: 599382 - RNA, 19 nt, Homo sapiens
gaagcuggcggacauuauc

SEQ ID NO: 599383 - RNA, 19 nt, Homo sapiens
ugaauggugugaccguaga

SEQ ID NO: 599384 - RNA, 19 nt, Homo sapiens
gcccagaucacguuucaga

SEQ ID NO: 599385 - RNA, 19 nt, Homo sapiens
acaagagaguaaccaucua

SEQ ID NO: 599386 - RNA, 19 nt, Homo sapiens
caagaucucguccuuccuu

SEQ ID NO: 599387 - RNA, 19 nt, Homo sapiens
gaccguagacuucccuuuc

SEQ ID NO: 599388 - RNA, 19 nt, Homo sapiens
acaaggugcuggcuguguu

SEQ ID NO: 599389 - RNA, 19 nt, Homo sapiens
ccaaggcuucuaccaguuu

SEQ ID NO: 599390 - RNA, 19 nt, Homo sapiens
gcugauaugcccaagauag

SEQ ID NO: 599391 - RNA, 19 nt, Homo sapiens
ccaagauaguccugaaugg

SEQ ID NO: 599392 - RNA, 19 nt, Homo sapiens
cuucaggccucuaggaugu

SEQ ID NO: 599393 - RNA, 19 nt, Homo sapiens
gaagaaucggcauccuuug

SEQ ID NO: 599394 - RNA, 19 nt, Homo sapiens
uggagaagaugugugaaga

SEQ ID NO: 599395 - RNA, 19 nt, Homo sapiens
gaaacaagagaguaaccau

SEQ ID NO: 599396 - RNA, 19 nt, Homo sapiens
ccaagguccuggaaugucu

SEQ ID NO: 599397 - RNA, 19 nt, Homo sapiens
ccgagaccaucagugcuua

SEQ ID NO: 599398 - RNA, 19 nt, Homo sapiens
gagcuccgcguuugacaga

SEQ ID NO: 599399 - RNA, 19 nt, Homo sapiens
uauucaugccguacaauua

SEQ ID NO: 599400 - RNA, 19 nt, Homo sapiens
cugcacagguucagcaugu

SEQ ID NO: 599401 - RNA, 19 nt, Homo sapiens
acaaaugccaacaggagua

SEQ ID NO: 599402 - RNA, 19 nt, Homo sapiens
caguugagcuccgcguuug

SEQ ID NO: 599403 - RNA, 19 nt, Homo sapiens
acauggagcuggaagacau

SEQ ID NO: 599404 - RNA, 19 nt, Homo sapiens
agagcaagaucucguccuu

SEQ ID NO: 599405 - RNA, 19 nt, Homo sapiens
gcucugugcccuucugaga

SEQ ID NO: 599406 - RNA, 19 nt, Homo sapiens
ggccaucgaugcuguugag

SEQ ID NO: 599407 - RNA, 19 nt, Homo sapiens
gaggagggaggaagaagau

SEQ ID NO: 599408 - RNA, 19 nt, Homo sapiens
gccuguguguggaguauga

SEQ ID NO: 599409 - RNA, 19 nt, Homo sapiens
caaggcuucuaccaguuug

SEQ ID NO: 599410 - RNA, 19 nt, Homo sapiens
cuacaaggguuccgaugac

SEQ ID NO: 599411 - RNA, 19 nt, Homo sapiens
caacuuuggccaugucauc

SEQ ID NO: 599412 - RNA, 19 nt, Homo sapiens
gcgcugaagccgcuguuug

SEQ ID NO: 599413 - RNA, 19 nt, Homo sapiens
ccuauaaggugcacaucca

SEQ ID NO: 599414 - RNA, 19 nt, Homo sapiens
gaacauggagcuggaagac

SEQ ID NO: 599415 - RNA, 19 nt, Homo sapiens
acacaacauugaccugaag

SEQ ID NO: 599416 - RNA, 19 nt, Homo sapiens
ggagagcccuacggguaca

SEQ ID NO: 599417 - RNA, 19 nt, Homo sapiens
gggccuuacaguccuauaa

SEQ ID NO: 599418 - RNA, 19 nt, Homo sapiens
cagaagcuggcggacauua

SEQ ID NO: 599419 - RNA, 19 nt, Homo sapiens
gccagggagcuacaucuuu

SEQ ID NO: 599420 - RNA, 19 nt, Homo sapiens
gugaagaaacaagagagua

SEQ ID NO: 599421 - RNA, 19 nt, Homo sapiens
ggaagacccagagcaagau

SEQ ID NO: 599422 - RNA, 19 nt, Homo sapiens
caaggguuccgaugacuuc

SEQ ID NO: 599423 - RNA, 19 nt, Homo sapiens
gaucgggccuugucauccu

SEQ ID NO: 599424 - RNA, 19 nt, Homo sapiens
agaugcaguuccuggauga

SEQ ID NO: 599425 - RNA, 19 nt, Homo sapiens
gaucuucuucccuuccuau

SEQ ID NO: 599426 - RNA, 19 nt, Homo sapiens
gcaccacugcagccagaaa

SEQ ID NO: 599427 - RNA, 19 nt, Homo sapiens
gugcuggaguguucaccaa

SEQ ID NO: 599428 - RNA, 19 nt, Homo sapiens
uggaagacauugcaaagcu

SEQ ID NO: 599429 - RNA, 19 nt, Homo sapiens
cacacaacauugaccugaa

SEQ ID NO: 599430 - RNA, 19 nt, Homo sapiens
ucauauucaugccguacaa

SEQ ID NO: 599431 - RNA, 19 nt, Homo sapiens
ucaucgacuuuguggcuuu

SEQ ID NO: 599432 - RNA, 19 nt, Homo sapiens
ggaagcagagcgucaugca

SEQ ID NO: 599433 - RNA, 19 nt, Homo sapiens
aagaucucguccuuccuua

SEQ ID NO: 599434 - RNA, 19 nt, Homo sapiens
ggagaagagccuggaguuc

SEQ ID NO: 599435 - RNA, 19 nt, Homo sapiens
uaagauguucggagugguu

SEQ ID NO: 599436 - RNA, 19 nt, Homo sapiens
aggcugauaugcccaagau

SEQ ID NO: 599437 - RNA, 19 nt, Homo sapiens
gcacagauauuuccauuuc

SEQ ID NO: 599438 - RNA, 19 nt, Homo sapiens
ggacagaccuggacacuag

SEQ ID NO: 599439 - RNA, 19 nt, Homo sapiens
aaacacagcuuuacaacuu

SEQ ID NO: 599440 - RNA, 19 nt, Homo sapiens
gaucuugucuccacuaaau

SEQ ID NO: 599441 - RNA, 19 nt, Homo sapiens
gcagagagguggagaacug

SEQ ID NO: 599442 - RNA, 19 nt, Homo sapiens
gcaguccucuuauuccuaa

SEQ ID NO: 599443 - RNA, 19 nt, Homo sapiens
gcaauucuacaguuucuua

SEQ ID NO: 599444 - RNA, 19 nt, Homo sapiens
gggaguaguuggaaaguug

SEQ ID NO: 599445 - RNA, 19 nt, Homo sapiens
gauuauggguccugcaauu

SEQ ID NO: 599446 - RNA, 19 nt, Homo sapiens
gaacucaagcugcguuuau

SEQ ID NO: 599447 - RNA, 19 nt, Homo sapiens
acacagcacucucuaaauc

SEQ ID NO: 599448 - RNA, 19 nt, Homo sapiens
gaagguagcccagcacugu

SEQ ID NO: 599449 - RNA, 19 nt, Homo sapiens
caagcugcguuuauuaaug

SEQ ID NO: 599450 - RNA, 19 nt, Homo sapiens
guggagaacugggauuuga

SEQ ID NO: 599451 - RNA, 19 nt, Homo sapiens
gugaggugcugaugaguga

SEQ ID NO: 599452 - RNA, 19 nt, Homo sapiens
cgucauaugugauaaugug

SEQ ID NO: 599453 - RNA, 19 nt, Homo sapiens
cauuuaacgucauauguga

SEQ ID NO: 599454 - RNA, 19 nt, Homo sapiens
gaugagugauugacacaca

SEQ ID NO: 599455 - RNA, 19 nt, Homo sapiens
ggacgaauugagauaauau

SEQ ID NO: 599456 - RNA, 19 nt, Homo sapiens
ggaagaacacagagaagga

SEQ ID NO: 599457 - RNA, 19 nt, Homo sapiens
ccugguggcugaccuggua

SEQ ID NO: 599458 - RNA, 19 nt, Homo sapiens
gcagcgggaucucguaucu

SEQ ID NO: 599459 - RNA, 19 nt, Homo sapiens
uggcugaccugguacaaga

SEQ ID NO: 599460 - RNA, 19 nt, Homo sapiens
acacacagcacucucuaaa

SEQ ID NO: 599461 - RNA, 19 nt, Homo sapiens
gcauuuaacgucauaugug

SEQ ID NO: 599462 - RNA, 19 nt, Homo sapiens
agaccugugugcagcauuu

SEQ ID NO: 599463 - RNA, 19 nt, Homo sapiens
gcucagaggcccaggaauc

SEQ ID NO: 599464 - RNA, 19 nt, Homo sapiens
ucacugagaaucuggaaga

SEQ ID NO: 599465 - RNA, 19 nt, Homo sapiens
cugagaaucuggaagaaca

SEQ ID NO: 599466 - RNA, 19 nt, Homo sapiens
cuuuacaacuuccauauca

SEQ ID NO: 599467 - RNA, 19 nt, Homo sapiens
cucuaaaucuuccuuguga

SEQ ID NO: 599468 - RNA, 19 nt, Homo sapiens
agcgggaucucguaucuuu

SEQ ID NO: 599469 - RNA, 19 nt, Homo sapiens
cuugggcccugcacagaua

SEQ ID NO: 599470 - RNA, 19 nt, Homo sapiens
caacuuccauaucacaaaa

SEQ ID NO: 599471 - RNA, 19 nt, Homo sapiens
cugcacagauauuuccauu

SEQ ID NO: 599472 - RNA, 19 nt, Homo sapiens
cgggaucucguaucuuuaa

SEQ ID NO: 599473 - RNA, 19 nt, Homo sapiens
caaaaucacuaucuuucug

SEQ ID NO: 599474 - RNA, 19 nt, Homo sapiens
caggacgaauugagauaau

SEQ ID NO: 599475 - RNA, 19 nt, Homo sapiens
cuacacagccuggacuuug

SEQ ID NO: 599476 - RNA, 19 nt, Homo sapiens
gugcgggagucacugagaa

SEQ ID NO: 599477 - RNA, 19 nt, Homo sapiens
uauggguccugcaauucua

SEQ ID NO: 599478 - RNA, 19 nt, Homo sapiens
guccugcaauucuacaguu

SEQ ID NO: 599479 - RNA, 19 nt, Homo sapiens
acaccaagaucgacagcau

SEQ ID NO: 599480 - RNA, 19 nt, Homo sapiens
gaagaccugugugcagcau

SEQ ID NO: 599481 - RNA, 19 nt, Homo sapiens
acagcacucucuaaaucuu

SEQ ID NO: 599482 - RNA, 19 nt, Homo sapiens
aggacgaauugagauaaua

SEQ ID NO: 599483 - RNA, 19 nt, Homo sapiens
gccuagaccucuucuccau

SEQ ID NO: 599484 - RNA, 19 nt, Homo sapiens
gggaucucguaucuuuaaa

SEQ ID NO: 599485 - RNA, 19 nt, Homo sapiens
ugaccgagcucaaguuccu

SEQ ID NO: 599486 - RNA, 19 nt, Homo sapiens
acucaagcugcguuuauua

SEQ ID NO: 599487 - RNA, 19 nt, Homo sapiens
gggagucacugagaaucug

SEQ ID NO: 599488 - RNA, 19 nt, Homo sapiens
ccaggacgaauugagauaa

SEQ ID NO: 599489 - RNA, 19 nt, Homo sapiens
gccaggacgaauugagaua

SEQ ID NO: 599490 - RNA, 19 nt, Homo sapiens
ccacagaccaccugcuucu

SEQ ID NO: 599491 - RNA, 19 nt, Homo sapiens
ucgauuuccuguagugaau

SEQ ID NO: 599492 - RNA, 19 nt, Homo sapiens
gaggugcugaugagugauu

SEQ ID NO: 599493 - RNA, 19 nt, Homo sapiens
gaagcagagagguggagaa

SEQ ID NO: 599494 - RNA, 19 nt, Homo sapiens
aagaucuugucuccacuaa

SEQ ID NO: 599495 - RNA, 19 nt, Homo sapiens
aacgcgcucuugucgauuu

SEQ ID NO: 599496 - RNA, 19 nt, Homo sapiens
ugaguugagucuccucucu

SEQ ID NO: 599497 - RNA, 19 nt, Homo sapiens
aagcugcguuuauuaaugc

SEQ ID NO: 599498 - RNA, 19 nt, Homo sapiens
gaccacaggcaucuacaca

SEQ ID NO: 599499 - RNA, 19 nt, Homo sapiens
gaacacagagaaggagaac

SEQ ID NO: 599500 - RNA, 19 nt, Homo sapiens
uuccuaagguaauccuauu

SEQ ID NO: 599501 - RNA, 19 nt, Homo sapiens
ugacacacagcacucucua

SEQ ID NO: 599502 - RNA, 19 nt, Homo sapiens
ggagaacugggauuugaac

SEQ ID NO: 599503 - RNA, 19 nt, Homo sapiens
uuccauuucuuccucacua

SEQ ID NO: 599504 - RNA, 19 nt, Homo sapiens
gacacacagcacucucuaa

SEQ ID NO: 599505 - RNA, 19 nt, Homo sapiens
aguugagucuccucucuga

SEQ ID NO: 599506 - RNA, 19 nt, Homo sapiens
ugcagcauuuaacgucaua

SEQ ID NO: 599507 - RNA, 19 nt, Homo sapiens
cucaagcugcguuuauuaa

SEQ ID NO: 599508 - RNA, 19 nt, Homo sapiens
cagcuuuacaacuuccaua

SEQ ID NO: 599509 - RNA, 19 nt, Homo sapiens
gauaauguggggaaagauu

SEQ ID NO: 599510 - RNA, 19 nt, Homo sapiens
ucaagcugcguuuauuaau

SEQ ID NO: 599511 - RNA, 19 nt, Homo sapiens
agaaggagaacgcaacagu

SEQ ID NO: 599512 - RNA, 19 nt, Homo sapiens
gcucuuggccccuguguga

SEQ ID NO: 599513 - RNA, 19 nt, Homo sapiens
cuaugacacugagcaagau

SEQ ID NO: 599514 - RNA, 19 nt, Homo sapiens
gcgggaucucguaucuuua

SEQ ID NO: 599515 - RNA, 19 nt, Homo sapiens
ucuugucgauuuccuguag

SEQ ID NO: 599516 - RNA, 19 nt, Homo sapiens
ucugugaggugcugaugag

SEQ ID NO: 599517 - RNA, 19 nt, Homo sapiens
aacucaagcugcguuuauu

SEQ ID NO: 599518 - RNA, 19 nt, Homo sapiens
gaccugugugcagcauuua

SEQ ID NO: 599519 - RNA, 19 nt, Homo sapiens
gcagaaaggauguuuuguc

SEQ ID NO: 599520 - RNA, 19 nt, Homo sapiens
aaaacgcgcucuugucgau

SEQ ID NO: 599521 - RNA, 19 nt, Homo sapiens
gugcagaugagcagucaca

SEQ ID NO: 599522 - RNA, 19 nt, Homo sapiens
acaacuuccauaucacaaa

SEQ ID NO: 599523 - RNA, 19 nt, Homo sapiens
cagcucagaggcccaggaa

SEQ ID NO: 599524 - RNA, 19 nt, Homo sapiens
gcagaugagcagucacacu

SEQ ID NO: 599525 - RNA, 19 nt, Homo sapiens
acuaugacacugagcaaga

SEQ ID NO: 599526 - RNA, 19 nt, Homo sapiens
ggaacucagacgcaucuac

SEQ ID NO: 599527 - RNA, 19 nt, Homo sapiens
gugcagcauuuaacgucau

SEQ ID NO: 599528 - RNA, 19 nt, Homo sapiens
uaacagaacucaacaaaug

SEQ ID NO: 599529 - RNA, 19 nt, Homo sapiens
ccacaugaauucagauuua

SEQ ID NO: 599530 - RNA, 19 nt, Homo sapiens
gaacauaggcaaugagauu

SEQ ID NO: 599531 - RNA, 19 nt, Homo sapiens
caacagagaucguauugau

SEQ ID NO: 599532 - RNA, 19 nt, Homo sapiens
acagagagcucaccagauu

SEQ ID NO: 599533 - RNA, 19 nt, Homo sapiens
aaacucaccuugcaaugua

SEQ ID NO: 599534 - RNA, 19 nt, Homo sapiens
gaaacucauugacagcuaa

SEQ ID NO: 599535 - RNA, 19 nt, Homo sapiens
gaacaucugauugguauuu

SEQ ID NO: 599536 - RNA, 19 nt, Homo sapiens
cagagaagaugaaauggaa

SEQ ID NO: 599537 - RNA, 19 nt, Homo sapiens
gaagagaaccugacucaag

SEQ ID NO: 599538 - RNA, 19 nt, Homo sapiens
caucauacauugucauuag

SEQ ID NO: 599539 - RNA, 19 nt, Homo sapiens
aaagugagcuuaauuucug

SEQ ID NO: 599540 - RNA, 19 nt, Homo sapiens
cuacugcuguucuucuuua

SEQ ID NO: 599541 - RNA, 19 nt, Homo sapiens
gcaaagaaacucauugaca

SEQ ID NO: 599542 - RNA, 19 nt, Homo sapiens
guuccacgcucuucuaauu

SEQ ID NO: 599543 - RNA, 19 nt, Homo sapiens
gaauucagauuuaccucaa

SEQ ID NO: 599544 - RNA, 19 nt, Homo sapiens
agagaagacuuuaacagaa

SEQ ID NO: 599545 - RNA, 19 nt, Homo sapiens
agauuuaccucaaugcuaa

SEQ ID NO: 599546 - RNA, 19 nt, Homo sapiens
gaagaucuaguuggauaua

SEQ ID NO: 599547 - RNA, 19 nt, Homo sapiens
gagcaaagaaacucauuga

SEQ ID NO: 599548 - RNA, 19 nt, Homo sapiens
ugacaaagcauaccacaug

SEQ ID NO: 599549 - RNA, 19 nt, Homo sapiens
acgaagaucuaguuggaua

SEQ ID NO: 599550 - RNA, 19 nt, Homo sapiens
gagggaaggacaagagaua

SEQ ID NO: 599551 - RNA, 19 nt, Homo sapiens
gacaaagcauaccacauga

SEQ ID NO: 599552 - RNA, 19 nt, Homo sapiens
gaaucaagaccaucacuau

SEQ ID NO: 599553 - RNA, 19 nt, Homo sapiens
gagaagacuuuaacagaac

SEQ ID NO: 599554 - RNA, 19 nt, Homo sapiens
ccaaauaaauaaggacaug

SEQ ID NO: 599555 - RNA, 19 nt, Homo sapiens
caacuaaaccgcauagaag

SEQ ID NO: 599556 - RNA, 19 nt, Homo sapiens
caucauggauaaucuguca

SEQ ID NO: 599557 - RNA, 19 nt, Homo sapiens
uaaauaaggacaugagaga

SEQ ID NO: 599558 - RNA, 19 nt, Homo sapiens
gcuugauccuuacaauuaa

SEQ ID NO: 599559 - RNA, 19 nt, Homo sapiens
gaacucuuagugauucaua

SEQ ID NO: 599560 - RNA, 19 nt, Homo sapiens
gcaauguaguaucuaaaca

SEQ ID NO: 599561 - RNA, 19 nt, Homo sapiens
ucugugaucccauuucuua

SEQ ID NO: 599562 - RNA, 19 nt, Homo sapiens
caaagacagccaugaagaa

SEQ ID NO: 599563 - RNA, 19 nt, Homo sapiens
agacauggcccugaacaua

SEQ ID NO: 599564 - RNA, 19 nt, Homo sapiens
gagcuuaauuucugaacuc

SEQ ID NO: 599565 - RNA, 19 nt, Homo sapiens
ucaccacgcucggcuaauu

SEQ ID NO: 599566 - RNA, 19 nt, Homo sapiens
agaagaaauucaacagaga

SEQ ID NO: 599567 - RNA, 19 nt, Homo sapiens
ccacaacgaagaucuaguu

SEQ ID NO: 599568 - RNA, 19 nt, Homo sapiens
ggacaagagauaagagguu

SEQ ID NO: 599569 - RNA, 19 nt, Homo sapiens
uggcaaggcuuauaagaca

SEQ ID NO: 599570 - RNA, 19 nt, Homo sapiens
aagaugaaauggaagagaa

SEQ ID NO: 599571 - RNA, 19 nt, Homo sapiens
cagagaagacuuuaacaga

SEQ ID NO: 599572 - RNA, 19 nt, Homo sapiens
gaacaaaaggaacaacuaa

SEQ ID NO: 599573 - RNA, 19 nt, Homo sapiens
agacagccaugaagaagga

SEQ ID NO: 599574 - RNA, 19 nt, Homo sapiens
gagcucaccagauuacuga

SEQ ID NO: 599575 - RNA, 19 nt, Homo sapiens
ucacuaugcuggaugaaca

SEQ ID NO: 599576 - RNA, 19 nt, Homo sapiens
uuacacacucuuucucuua

SEQ ID NO: 599577 - RNA, 19 nt, Homo sapiens
gugaucccauuucuuauug

SEQ ID NO: 599578 - RNA, 19 nt, Homo sapiens
aaccacugcuugauccuua

SEQ ID NO: 599579 - RNA, 19 nt, Homo sapiens
ucaaagcugucagugugua

SEQ ID NO: 599580 - RNA, 19 nt, Homo sapiens
gaagaaggaagcuguagag

SEQ ID NO: 599581 - RNA, 19 nt, Homo sapiens
ggaaucaagaccaucacua

SEQ ID NO: 599582 - RNA, 19 nt, Homo sapiens
auaaaucugugaucccauu

SEQ ID NO: 599583 - RNA, 19 nt, Homo sapiens
ggaaggacaagagauaaga

SEQ ID NO: 599584 - RNA, 19 nt, Homo sapiens
acagagaucguauugauau

SEQ ID NO: 599585 - RNA, 19 nt, Homo sapiens
gagagacagagaagacuuu

SEQ ID NO: 599586 - RNA, 19 nt, Homo sapiens
gaacaacuaaaccgcauag

SEQ ID NO: 599587 - RNA, 19 nt, Homo sapiens
aaauuaugccucugguuua

SEQ ID NO: 599588 - RNA, 19 nt, Homo sapiens
agacaggguuucaccaugu

SEQ ID NO: 599589 - RNA, 19 nt, Homo sapiens
gcaguuauagccaauuuag

SEQ ID NO: 599590 - RNA, 19 nt, Homo sapiens
ccaaagacagccaugaaga

SEQ ID NO: 599591 - RNA, 19 nt, Homo sapiens
gagaagaugaaauggaaga

SEQ ID NO: 599592 - RNA, 19 nt, Homo sapiens
caaagcauaccacaugaau

SEQ ID NO: 599593 - RNA, 19 nt, Homo sapiens
aagagaaccugacucaagu

SEQ ID NO: 599594 - RNA, 19 nt, Homo sapiens
ggagaaaacucaccuugca

SEQ ID NO: 599595 - RNA, 19 nt, Homo sapiens
aagcauaccacaugaauuc

SEQ ID NO: 599596 - RNA, 19 nt, Homo sapiens
uuacaggccuauuaacauc

SEQ ID NO: 599597 - RNA, 19 nt, Homo sapiens
ccagauuacugaugagucu

SEQ ID NO: 599598 - RNA, 19 nt, Homo sapiens
uaacuaaugaugccagaga

SEQ ID NO: 599599 - RNA, 19 nt, Homo sapiens
gcaggaaucaagaccauca

SEQ ID NO: 599600 - RNA, 19 nt, Homo sapiens
ugcuugauccuuacaauua

SEQ ID NO: 599601 - RNA, 19 nt, Homo sapiens
uaaagcuacugcuguucuu

SEQ ID NO: 599602 - RNA, 19 nt, Homo sapiens
gaagaugaaauggaagaga

SEQ ID NO: 599603 - RNA, 19 nt, Homo sapiens
cauaccacaugaauucaga

SEQ ID NO: 599604 - RNA, 19 nt, Homo sapiens
ccaaaguacugggauuaca

SEQ ID NO: 599605 - RNA, 19 nt, Homo sapiens
uuaugccucugguuuaauu

SEQ ID NO: 599606 - RNA, 19 nt, Homo sapiens
aauuaugccucugguuuaa

SEQ ID NO: 599607 - RNA, 19 nt, Homo sapiens
caauucauacgcuuagauu

SEQ ID NO: 599608 - RNA, 19 nt, Homo sapiens
gcucaaaauccacaaauaa

SEQ ID NO: 599609 - RNA, 19 nt, Homo sapiens
uaaaagacauggcccugaa

SEQ ID NO: 599610 - RNA, 19 nt, Homo sapiens
gcaguauccugggaaaucu

SEQ ID NO: 599611 - RNA, 19 nt, Homo sapiens
gaaaguacgaggagaaucc

SEQ ID NO: 599612 - RNA, 19 nt, Homo sapiens
ccucaaugcuaagaauuau

SEQ ID NO: 599613 - RNA, 19 nt, Homo sapiens
gaucuaguuggauauaguu

SEQ ID NO: 599614 - RNA, 19 nt, Homo sapiens
cauaugucauguuuagugu

SEQ ID NO: 599615 - RNA, 19 nt, Homo sapiens
gagaucguauugauauugc

SEQ ID NO: 599616 - RNA, 19 nt, Homo sapiens
gccagugguggauacauua

SEQ ID NO: 599617 - RNA, 19 nt, Homo sapiens
augaacaucugauugguau

SEQ ID NO: 599618 - RNA, 19 nt, Homo sapiens
agaaacucauugacagcua

SEQ ID NO: 599619 - RNA, 19 nt, Homo sapiens
uuccguagcuccuccuuga

SEQ ID NO: 599620 - RNA, 19 nt, Homo sapiens
cagagaucguauugauauu

SEQ ID NO: 599621 - RNA, 19 nt, Homo sapiens
ugacucaagugggcaguau

SEQ ID NO: 599622 - RNA, 19 nt, Homo sapiens
ggaacaacuaaaccgcaua

SEQ ID NO: 599623 - RNA, 19 nt, Homo sapiens
gauugguauuugucacauu

SEQ ID NO: 599624 - RNA, 19 nt, Homo sapiens
caagagauaagagguuguu

SEQ ID NO: 599625 - RNA, 19 nt, Homo sapiens
acaacuaaaccgcauagaa

SEQ ID NO: 599626 - RNA, 19 nt, Homo sapiens
ugccuuccuucuaguauuu

SEQ ID NO: 599627 - RNA, 19 nt, Homo sapiens
guuacagcccuccuucuuu

SEQ ID NO: 599628 - RNA, 19 nt, Homo sapiens
uaacagaacucaacaaaug

SEQ ID NO: 599629 - RNA, 19 nt, Homo sapiens
ccacaugaauucagauuua

SEQ ID NO: 599630 - RNA, 19 nt, Homo sapiens
gaacauaggcaaugagauu

SEQ ID NO: 599631 - RNA, 19 nt, Homo sapiens
caacagagaucguauugau

SEQ ID NO: 599632 - RNA, 19 nt, Homo sapiens
acagagagcucaccagauu

SEQ ID NO: 599633 - RNA, 19 nt, Homo sapiens
gaaacucauugacagcuaa

SEQ ID NO: 599634 - RNA, 19 nt, Homo sapiens
gaacaucugauugguauuu

SEQ ID NO: 599635 - RNA, 19 nt, Homo sapiens
cagagaagaugaaauggaa

SEQ ID NO: 599636 - RNA, 19 nt, Homo sapiens
gaagagaaccugacucaag

SEQ ID NO: 599637 - RNA, 19 nt, Homo sapiens
caucauacauugucauuag

SEQ ID NO: 599638 - RNA, 19 nt, Homo sapiens
aaagugagcuuaauuucug

SEQ ID NO: 599639 - RNA, 19 nt, Homo sapiens
cuacugcuguucuucuuua

SEQ ID NO: 599640 - RNA, 19 nt, Homo sapiens
gcaaagaaacucauugaca

SEQ ID NO: 599641 - RNA, 19 nt, Homo sapiens
guuccacgcucuucuaauu

SEQ ID NO: 599642 - RNA, 19 nt, Homo sapiens
gaauucagauuuaccucaa

SEQ ID NO: 599643 - RNA, 19 nt, Homo sapiens
agagaagacuuuaacagaa

SEQ ID NO: 599644 - RNA, 19 nt, Homo sapiens
agauuuaccucaaugcuaa

SEQ ID NO: 599645 - RNA, 19 nt, Homo sapiens
gaagaucuaguuggauaua

SEQ ID NO: 599646 - RNA, 19 nt, Homo sapiens
gagcaaagaaacucauuga

SEQ ID NO: 599647 - RNA, 19 nt, Homo sapiens
ugacaaagcauaccacaug

SEQ ID NO: 599648 - RNA, 19 nt, Homo sapiens
acgaagaucuaguuggaua

SEQ ID NO: 599649 - RNA, 19 nt, Homo sapiens
gagggaaggacaagagaua

SEQ ID NO: 599650 - RNA, 19 nt, Homo sapiens
gacaaagcauaccacauga

SEQ ID NO: 599651 - RNA, 19 nt, Homo sapiens
gaaucaagaccaucacuau

SEQ ID NO: 599652 - RNA, 19 nt, Homo sapiens
gagaagacuuuaacagaac

SEQ ID NO: 599653 - RNA, 19 nt, Homo sapiens
ccaaauaaauaaggacaug

SEQ ID NO: 599654 - RNA, 19 nt, Homo sapiens
caacuaaaccgcauagaag

SEQ ID NO: 599655 - RNA, 19 nt, Homo sapiens
caucauggauaaucuguca

SEQ ID NO: 599656 - RNA, 19 nt, Homo sapiens
uaaauaaggacaugagaga

SEQ ID NO: 599657 - RNA, 19 nt, Homo sapiens
gcuugauccuuacaauuaa

SEQ ID NO: 599658 - RNA, 19 nt, Homo sapiens
gaacucuuagugauucaua

SEQ ID NO: 599659 - RNA, 19 nt, Homo sapiens
ucugugaucccauuucuua

SEQ ID NO: 599660 - RNA, 19 nt, Homo sapiens
caaagacagccaugaagaa

SEQ ID NO: 599661 - RNA, 19 nt, Homo sapiens
agacauggcccugaacaua

SEQ ID NO: 599662 - RNA, 19 nt, Homo sapiens
gagcuuaauuucugaacuc

SEQ ID NO: 599663 - RNA, 19 nt, Homo sapiens
ucaccacgcucggcuaauu

SEQ ID NO: 599664 - RNA, 19 nt, Homo sapiens
ccacaacgaagaucuaguu

SEQ ID NO: 599665 - RNA, 19 nt, Homo sapiens
ggacaagagauaagagguu

SEQ ID NO: 599666 - RNA, 19 nt, Homo sapiens
agaagaaauucaacagaga

SEQ ID NO: 599667 - RNA, 19 nt, Homo sapiens
aagaugaaauggaagagaa

SEQ ID NO: 599668 - RNA, 19 nt, Homo sapiens
cagagaagacuuuaacaga

SEQ ID NO: 599669 - RNA, 19 nt, Homo sapiens
gaacaaaaggaacaacuaa

SEQ ID NO: 599670 - RNA, 19 nt, Homo sapiens
agacagccaugaagaagga

SEQ ID NO: 599671 - RNA, 19 nt, Homo sapiens
gagcucaccagauuacuga

SEQ ID NO: 599672 - RNA, 19 nt, Homo sapiens
ucacuaugcuggaugaaca

SEQ ID NO: 599673 - RNA, 19 nt, Homo sapiens
uuacacacucuuucucuua

SEQ ID NO: 599674 - RNA, 19 nt, Homo sapiens
gugaucccauuucuuauug

SEQ ID NO: 599675 - RNA, 19 nt, Homo sapiens
aaccacugcuugauccuua

SEQ ID NO: 599676 - RNA, 19 nt, Homo sapiens
ucaaagcugucagugugua

SEQ ID NO: 599677 - RNA, 19 nt, Homo sapiens
gaagaaggaagcuguagag

SEQ ID NO: 599678 - RNA, 19 nt, Homo sapiens
ggaaucaagaccaucacua

SEQ ID NO: 599679 - RNA, 19 nt, Homo sapiens
auaaaucugugaucccauu

SEQ ID NO: 599680 - RNA, 19 nt, Homo sapiens
ggaaggacaagagauaaga

SEQ ID NO: 599681 - RNA, 19 nt, Homo sapiens
acagagaucguauugauau

SEQ ID NO: 599682 - RNA, 19 nt, Homo sapiens
gagagacagagaagacuuu

SEQ ID NO: 599683 - RNA, 19 nt, Homo sapiens
gaacaacuaaaccgcauag

SEQ ID NO: 599684 - RNA, 19 nt, Homo sapiens
aaauuaugccucugguuua

SEQ ID NO: 599685 - RNA, 19 nt, Homo sapiens
agacaggguuucaccaugu

SEQ ID NO: 599686 - RNA, 19 nt, Homo sapiens
gcaguuauagccaauuuag

SEQ ID NO: 599687 - RNA, 19 nt, Homo sapiens
ccaaagacagccaugaaga

SEQ ID NO: 599688 - RNA, 19 nt, Homo sapiens
gagaagaugaaauggaaga

SEQ ID NO: 599689 - RNA, 19 nt, Homo sapiens
caaagcauaccacaugaau

SEQ ID NO: 599690 - RNA, 19 nt, Homo sapiens
aagagaaccugacucaagu

SEQ ID NO: 599691 - RNA, 19 nt, Homo sapiens
aagcauaccacaugaauuc

SEQ ID NO: 599692 - RNA, 19 nt, Homo sapiens
uuacaggccuauuaacauc

SEQ ID NO: 599693 - RNA, 19 nt, Homo sapiens
ccagauuacugaugagucu

SEQ ID NO: 599694 - RNA, 19 nt, Homo sapiens
uaacuaaugaugccagaga

SEQ ID NO: 599695 - RNA, 19 nt, Homo sapiens
gcaggaaucaagaccauca

SEQ ID NO: 599696 - RNA, 19 nt, Homo sapiens
ugcuugauccuuacaauua

SEQ ID NO: 599697 - RNA, 19 nt, Homo sapiens
uaaagcuacugcuguucuu

SEQ ID NO: 599698 - RNA, 19 nt, Homo sapiens
gaagaugaaauggaagaga

SEQ ID NO: 599699 - RNA, 19 nt, Homo sapiens
cauaccacaugaauucaga

SEQ ID NO: 599700 - RNA, 19 nt, Homo sapiens
ccaaaguacugggauuaca

SEQ ID NO: 599701 - RNA, 19 nt, Homo sapiens
uuaugccucugguuuaauu

SEQ ID NO: 599702 - RNA, 19 nt, Homo sapiens
aauuaugccucugguuuaa

SEQ ID NO: 599703 - RNA, 19 nt, Homo sapiens
gaaaguacgaggagaaucc

SEQ ID NO: 599704 - RNA, 19 nt, Homo sapiens
caauucauacgcuuagauu

SEQ ID NO: 599705 - RNA, 19 nt, Homo sapiens
gcucaaaauccacaaauaa

SEQ ID NO: 599706 - RNA, 19 nt, Homo sapiens
uaaaagacauggcccugaa

SEQ ID NO: 599707 - RNA, 19 nt, Homo sapiens
gcaguauccugggaaaucu

SEQ ID NO: 599708 - RNA, 19 nt, Homo sapiens
ccucaaugcuaagaauuau

SEQ ID NO: 599709 - RNA, 19 nt, Homo sapiens
gaucuaguuggauauaguu

SEQ ID NO: 599710 - RNA, 19 nt, Homo sapiens
cauaugucauguuuagugu

SEQ ID NO: 599711 - RNA, 19 nt, Homo sapiens
gagaucguauugauauugc

SEQ ID NO: 599712 - RNA, 19 nt, Homo sapiens
augaacaucugauugguau

SEQ ID NO: 599713 - RNA, 19 nt, Homo sapiens
agaaacucauugacagcua

SEQ ID NO: 599714 - RNA, 19 nt, Homo sapiens
uuccguagcuccuccuuga

SEQ ID NO: 599715 - RNA, 19 nt, Homo sapiens
ggaacaacuaaaccgcaua

SEQ ID NO: 599716 - RNA, 19 nt, Homo sapiens
cagagaucguauugauauu

SEQ ID NO: 599717 - RNA, 19 nt, Homo sapiens
ugacucaagugggcaguau

SEQ ID NO: 599718 - RNA, 19 nt, Homo sapiens
gauugguauuugucacauu

SEQ ID NO: 599719 - RNA, 19 nt, Homo sapiens
caagagauaagagguuguu

SEQ ID NO: 599720 - RNA, 19 nt, Homo sapiens
ugccuuccuucuaguauuu

SEQ ID NO: 599721 - RNA, 19 nt, Homo sapiens
guuacagcccuccuucuuu

SEQ ID NO: 599722 - RNA, 19 nt, Homo sapiens
acaacuaaaccgcauagaa

SEQ ID NO: 599723 - RNA, 19 nt, Homo sapiens
cugcuguucuucuuuauca

SEQ ID NO: 599724 - RNA, 19 nt, Homo sapiens
gacauggcccugaacauag

SEQ ID NO: 599725 - RNA, 19 nt, Homo sapiens
cagauuuaccucaaugcua

SEQ ID NO: 599726 - RNA, 19 nt, Homo sapiens
gaccaucacuaugcuggau

SEQ ID NO: 599727 - RNA, 19 nt, Homo sapiens
uuacagcccuccuucuuuu

SEQ ID NO: 599728 - RNA, 19 nt, Homo sapiens
agagaaggcuguacaguua

SEQ ID NO: 599729 - RNA, 19 nt, Homo sapiens
ggauauccguacuucauua

SEQ ID NO: 599730 - RNA, 19 nt, Homo sapiens
acacagaaaugacuaugua

SEQ ID NO: 599731 - RNA, 19 nt, Homo sapiens
ucaaguacauggacaauga

SEQ ID NO: 599732 - RNA, 19 nt, Homo sapiens
gggaauagauuagggauau

SEQ ID NO: 599733 - RNA, 19 nt, Homo sapiens
aacaauugcucaagucuua

SEQ ID NO: 599734 - RNA, 19 nt, Homo sapiens
acagacagcuaauguguuu

SEQ ID NO: 599735 - RNA, 19 nt, Homo sapiens
gcaguugaauuacuaggaa

SEQ ID NO: 599736 - RNA, 19 nt, Homo sapiens
gaagaaaucaccugcaaca

SEQ ID NO: 599737 - RNA, 19 nt, Homo sapiens
cuauguagcugcagaaaga

SEQ ID NO: 599738 - RNA, 19 nt, Homo sapiens
ggacaaugauuaugcuaag

SEQ ID NO: 599739 - RNA, 19 nt, Homo sapiens
gauggcggcucagaagaua

SEQ ID NO: 599740 - RNA, 19 nt, Homo sapiens
gggaagcuguugcccauga

SEQ ID NO: 599741 - RNA, 19 nt, Homo sapiens
gaagccagauuaugacagu

SEQ ID NO: 599742 - RNA, 19 nt, Homo sapiens
ugagcaagcuggaaugaug

SEQ ID NO: 599743 - RNA, 19 nt, Homo sapiens
agaggaagaugaauacuca

SEQ ID NO: 599744 - RNA, 19 nt, Homo sapiens
guacauggacaaugauuau

SEQ ID NO: 599745 - RNA, 19 nt, Homo sapiens
ugaaggagaugcagaaacu

SEQ ID NO: 599746 - RNA, 19 nt, Homo sapiens
guacaguuauaucaacaga

SEQ ID NO: 599747 - RNA, 19 nt, Homo sapiens
ugccaaagcuuaugagcaa

SEQ ID NO: 599748 - RNA, 19 nt, Homo sapiens
caacagacagcuaaugugu

SEQ ID NO: 599749 - RNA, 19 nt, Homo sapiens
agaaggcuguacaguuaua

SEQ ID NO: 599750 - RNA, 19 nt, Homo sapiens
gcucaagucuuaguucauc

SEQ ID NO: 599751 - RNA, 19 nt, Homo sapiens
gcagagaaauaccugaaaa

SEQ ID NO: 599752 - RNA, 19 nt, Homo sapiens
aagaagaaaucaccugcaa

SEQ ID NO: 599753 - RNA, 19 nt, Homo sapiens
acaggcaguugaauuacua

SEQ ID NO: 599754 - RNA, 19 nt, Homo sapiens
gcuggaaagcuuauagaaa

SEQ ID NO: 599755 - RNA, 19 nt, Homo sapiens
uaaaauggaagccagauua

SEQ ID NO: 599756 - RNA, 19 nt, Homo sapiens
guacuucauuacagucaug

SEQ ID NO: 599757 - RNA, 19 nt, Homo sapiens
gaaaacaauugcucaaguc

SEQ ID NO: 599758 - RNA, 19 nt, Homo sapiens
ggaaaagccuccagacuac

SEQ ID NO: 599759 - RNA, 19 nt, Homo sapiens
cagugccgcuucugaauau

SEQ ID NO: 599760 - RNA, 19 nt, Homo sapiens
agacugugcugcccuggaa

SEQ ID NO: 599761 - RNA, 19 nt, Homo sapiens
acaguuauaucaacagaca

SEQ ID NO: 599762 - RNA, 19 nt, Homo sapiens
cagagaaggcuguacaguu

SEQ ID NO: 599763 - RNA, 19 nt, Homo sapiens
gagaaggccagcaugaugu

SEQ ID NO: 599764 - RNA, 19 nt, Homo sapiens
ggaagcuguugcccaugaa

SEQ ID NO: 599765 - RNA, 19 nt, Homo sapiens
aauggaagccagauuauga

SEQ ID NO: 599766 - RNA, 19 nt, Homo sapiens
guuaccaucuucccaaauc

SEQ ID NO: 599767 - RNA, 19 nt, Homo sapiens
gaaaagggaaacaaaggua

SEQ ID NO: 599768 - RNA, 19 nt, Homo sapiens
ggagauggcggcucagaag

SEQ ID NO: 599769 - RNA, 19 nt, Homo sapiens
gaaugauguugaaggagau

SEQ ID NO: 599770 - RNA, 19 nt, Homo sapiens
ugacaugccauuucaagga

SEQ ID NO: 599771 - RNA, 19 nt, Homo sapiens
ggcacucucuauucagaaa

SEQ ID NO: 599772 - RNA, 19 nt, Homo sapiens
gcggcacucucuauucaga

SEQ ID NO: 599773 - RNA, 19 nt, Homo sapiens
gaucaggugucagaugucu

SEQ ID NO: 599774 - RNA, 19 nt, Homo sapiens
cuggaaagcuuauagaaaa

SEQ ID NO: 599775 - RNA, 19 nt, Homo sapiens
aagaucaggugucagaugu

SEQ ID NO: 599776 - RNA, 19 nt, Homo sapiens
cagcuaauguguuugaaaa

SEQ ID NO: 599777 - RNA, 19 nt, Homo sapiens
ggacuugggaauagauuag

SEQ ID NO: 599778 - RNA, 19 nt, Homo sapiens
uagcaucccuggguucaau

SEQ ID NO: 599779 - RNA, 19 nt, Homo sapiens
acgacaggcaguugaauua

SEQ ID NO: 599780 - RNA, 19 nt, Homo sapiens
ugaauacucaggaggacua

SEQ ID NO: 599781 - RNA, 19 nt, Homo sapiens
uauaucaacagacagcuaa

SEQ ID NO: 599782 - RNA, 19 nt, Homo sapiens
aagcuggaaugauguugaa

SEQ ID NO: 599783 - RNA, 19 nt, Homo sapiens
uaguucaucuacacagaaa

SEQ ID NO: 599784 - RNA, 19 nt, Homo sapiens
gaaaauaauagggcucuuu

SEQ ID NO: 599785 - RNA, 19 nt, Homo sapiens
caagaucaggugucagaug

SEQ ID NO: 599786 - RNA, 19 nt, Homo sapiens
agaccaagaucagguguca

SEQ ID NO: 599787 - RNA, 19 nt, Homo sapiens
gagaauuauccaacuuguu

SEQ ID NO: 599788 - RNA, 19 nt, Homo sapiens
ugacagugccgcuucugaa

SEQ ID NO: 599789 - RNA, 19 nt, Homo sapiens
ugagaaggccagcaugaug

SEQ ID NO: 599790 - RNA, 19 nt, Homo sapiens
ggaauagauuagggauauc

SEQ ID NO: 599791 - RNA, 19 nt, Homo sapiens
ugagaauuauccaacuugu

SEQ ID NO: 599792 - RNA, 19 nt, Homo sapiens
agacagcuaauguguuuga

SEQ ID NO: 599793 - RNA, 19 nt, Homo sapiens
gggauauccguacuucauu

SEQ ID NO: 599794 - RNA, 19 nt, Homo sapiens
gaaaagaaaagggaaacaa

SEQ ID NO: 599795 - RNA, 19 nt, Homo sapiens
ugaagguuaugaccagcaa

SEQ ID NO: 599796 - RNA, 19 nt, Homo sapiens
gacaggcaguugaauuacu

SEQ ID NO: 599797 - RNA, 19 nt, Homo sapiens
gcuguacaguuauaucaac

SEQ ID NO: 599798 - RNA, 19 nt, Homo sapiens
ccguucagcuaauugagaa

SEQ ID NO: 599799 - RNA, 19 nt, Homo sapiens
gaaggagaugcagaaacua

SEQ ID NO: 599800 - RNA, 19 nt, Homo sapiens
aaagggaaacaaagguaaa

SEQ ID NO: 599801 - RNA, 19 nt, Homo sapiens
ugccacggcugcugaugaa

SEQ ID NO: 599802 - RNA, 19 nt, Homo sapiens
acucaccgcuuuucaagua

SEQ ID NO: 599803 - RNA, 19 nt, Homo sapiens
acagugccgcuucugaaua

SEQ ID NO: 599804 - RNA, 19 nt, Homo sapiens
guucaucuacacagaaaug

SEQ ID NO: 599805 - RNA, 19 nt, Homo sapiens
ugaagaggaagaugaauac

SEQ ID NO: 599806 - RNA, 19 nt, Homo sapiens
ccacggcugcugaugaaga

SEQ ID NO: 599807 - RNA, 19 nt, Homo sapiens
gaggacguagguuugauga

SEQ ID NO: 599808 - RNA, 19 nt, Homo sapiens
gcuaauguguuugaaaaug

SEQ ID NO: 599809 - RNA, 19 nt, Homo sapiens
gaagcuguugcccaugaaa

SEQ ID NO: 599810 - RNA, 19 nt, Homo sapiens
gagaaggcuguacaguuau

SEQ ID NO: 599811 - RNA, 19 nt, Homo sapiens
ccagcaugauguaucuaga

SEQ ID NO: 599812 - RNA, 19 nt, Homo sapiens
cagaggccguucagcuaau

SEQ ID NO: 599813 - RNA, 19 nt, Homo sapiens
aggcggcacucucuauuca

SEQ ID NO: 599814 - RNA, 19 nt, Homo sapiens
agcaugauguaucuagaaa

SEQ ID NO: 599815 - RNA, 19 nt, Homo sapiens
cagcaugauguaucuagaa

SEQ ID NO: 599816 - RNA, 19 nt, Homo sapiens
gcuggaacaccucgccaaa

SEQ ID NO: 599817 - RNA, 19 nt, Homo sapiens
caagcuggaaugauguuga

SEQ ID NO: 599818 - RNA, 19 nt, Homo sapiens
gagcaagcuggaaugaugu

SEQ ID NO: 599819 - RNA, 19 nt, Homo sapiens
uuagggauauccguacuuc

SEQ ID NO: 599820 - RNA, 19 nt, Homo sapiens
augaagaggaagaugaaua

SEQ ID NO: 599821 - RNA, 19 nt, Homo sapiens
ugaugaagaggaagaugaa

SEQ ID NO: 599822 - RNA, 19 nt, Homo sapiens
gucugcaacucaccgcuuu

SEQ ID NO: 599823 - RNA, 19 nt, Homo sapiens
caguugaauuacuaggaaa

SEQ ID NO: 599824 - RNA, 19 nt, Homo sapiens
gagauggcggcucagaaga

SEQ ID NO: 599825 - RNA, 19 nt, Homo sapiens
uaguuaccaucuucccaaa

SEQ ID NO: 599826 - RNA, 19 nt, Homo sapiens
gacagugccgcuucugaau

SEQ ID NO: 599827 - RNA, 19 nt, Homo sapiens
gcuaagcugggccugaguu

SEQ ID NO: 599828 - RNA, 19 nt, Homo sapiens
caaucgagaucuacacaga

SEQ ID NO: 599829 - RNA, 19 nt, Homo sapiens
gcugagaccugcuguuucu

SEQ ID NO: 599830 - RNA, 19 nt, Homo sapiens
aagaggccauuaacuguuu

SEQ ID NO: 599831 - RNA, 19 nt, Homo sapiens
gcaaacauguucaaaaugg

SEQ ID NO: 599832 - RNA, 19 nt, Homo sapiens
cuucuucucuggccucuuu

SEQ ID NO: 599833 - RNA, 19 nt, Homo sapiens
agaaggccauugacaucua

SEQ ID NO: 599834 - RNA, 19 nt, Homo sapiens
caacaagugucugcugaag

SEQ ID NO: 599835 - RNA, 19 nt, Homo sapiens
gaaugcaaguugaugaaaa

SEQ ID NO: 599836 - RNA, 19 nt, Homo sapiens
guacagcgccaaagacuac

SEQ ID NO: 599837 - RNA, 19 nt, Homo sapiens
cagcaaacauguucaaaau

SEQ ID NO: 599838 - RNA, 19 nt, Homo sapiens
acaagugucugcugaaggu

SEQ ID NO: 599839 - RNA, 19 nt, Homo sapiens
agaaggccauugcccacua

SEQ ID NO: 599840 - RNA, 19 nt, Homo sapiens
agacagaguugguggacau

SEQ ID NO: 599841 - RNA, 19 nt, Homo sapiens
acacagacaugggccgauu

SEQ ID NO: 599842 - RNA, 19 nt, Homo sapiens
ccaagaggccauuaacugu

SEQ ID NO: 599843 - RNA, 19 nt, Homo sapiens
ggaaugcaaguugaugaaa

SEQ ID NO: 599844 - RNA, 19 nt, Homo sapiens
ccauugacaucuacgaaca

SEQ ID NO: 599845 - RNA, 19 nt, Homo sapiens
caagaggccauuaacuguu

SEQ ID NO: 599846 - RNA, 19 nt, Homo sapiens
gaaggccauugacaucuac

SEQ ID NO: 599847 - RNA, 19 nt, Homo sapiens
caacagcucagccaacaag

SEQ ID NO: 599848 - RNA, 19 nt, Homo sapiens
ggaagcaugcgaaaucuac

SEQ ID NO: 599849 - RNA, 19 nt, Homo sapiens
uggcaacgcauucaagaaa

SEQ ID NO: 599850 - RNA, 19 nt, Homo sapiens
gaggaagcaugcgaaaucu

SEQ ID NO: 599851 - RNA, 19 nt, Homo sapiens
cgucuucgcugucccaucu

SEQ ID NO: 599852 - RNA, 19 nt, Homo sapiens
ucaaguacagcgccaaaga

SEQ ID NO: 599853 - RNA, 19 nt, Homo sapiens
gaacucgcaguccuucuuc

SEQ ID NO: 599854 - RNA, 19 nt, Homo sapiens
ugcugaagguggcugguua

SEQ ID NO: 599855 - RNA, 19 nt, Homo sapiens
gagcagcaaacauguucaa

SEQ ID NO: 599856 - RNA, 19 nt, Homo sapiens
gggaaugcaaguugaugaa

SEQ ID NO: 599857 - RNA, 19 nt, Homo sapiens
gaaggccauugcccacuac

SEQ ID NO: 599858 - RNA, 19 nt, Homo sapiens
agaggaagcaugcgaaauc

SEQ ID NO: 599859 - RNA, 19 nt, Homo sapiens
gccaagcucuaaagcacau

SEQ ID NO: 599860 - RNA, 19 nt, Homo sapiens
guucccagcuuucucugau

SEQ ID NO: 599861 - RNA, 19 nt, Homo sapiens
gcaacgcauucaagaaagc

SEQ ID NO: 599862 - RNA, 19 nt, Homo sapiens
ggacaucgagaaggccauu

SEQ ID NO: 599863 - RNA, 19 nt, Homo sapiens
gcacauguagccgcugaga

SEQ ID NO: 599864 - RNA, 19 nt, Homo sapiens
ucagaaggccauugacauc

SEQ ID NO: 599865 - RNA, 19 nt, Homo sapiens
cgccagagcagcaaacaug

SEQ ID NO: 599866 - RNA, 19 nt, Homo sapiens
ccgcugagaccugcuguuu

SEQ ID NO: 599867 - RNA, 19 nt, Homo sapiens
cagcucagccaacaagugu

SEQ ID NO: 599868 - RNA, 19 nt, Homo sapiens
gaucuaugagacagaguug

SEQ ID NO: 599869 - RNA, 19 nt, Homo sapiens
ggcaacgcauucaagaaag

SEQ ID NO: 599870 - RNA, 19 nt, Homo sapiens
gcuccuucccuaaugcuuu

SEQ ID NO: 599871 - RNA, 19 nt, Homo sapiens
agcagaauguggacagcua

SEQ ID NO: 599872 - RNA, 19 nt, Homo sapiens
caagcuggcuguccaaaag

SEQ ID NO: 599873 - RNA, 19 nt, Homo sapiens
gcagcaaacauguucaaaa

SEQ ID NO: 599874 - RNA, 19 nt, Homo sapiens
cagagcagcaaacauguuc

SEQ ID NO: 599875 - RNA, 19 nt, Homo sapiens
gaggaggaccugcgcuaag

SEQ ID NO: 599876 - RNA, 19 nt, Homo sapiens
cagaguugguggacaucga

SEQ ID NO: 599877 - RNA, 19 nt, Homo sapiens
ccauugcugagaucuauga

SEQ ID NO: 599878 - RNA, 19 nt, Homo sapiens
cgagaucuacacagacaug

SEQ ID NO: 599879 - RNA, 19 nt, Homo sapiens
gcuggcaacgcauucaaga

SEQ ID NO: 599880 - RNA, 19 nt, Homo sapiens
ccagagcagcaaacauguu

SEQ ID NO: 599881 - RNA, 19 nt, Homo sapiens
cccaagaggccauuaacug

SEQ ID NO: 599882 - RNA, 19 nt, Homo sapiens
uaucagaaggccauugaca

SEQ ID NO: 599883 - RNA, 19 nt, Homo sapiens
cuccauugcugagaucuau

SEQ ID NO: 599884 - RNA, 19 nt, Homo sapiens
gaugcgagcaaucgagauc

SEQ ID NO: 599885 - RNA, 19 nt, Homo sapiens
ccacuucugcaucgacaug

SEQ ID NO: 599886 - RNA, 19 nt, Homo sapiens
gaacagguggggaccaaug

SEQ ID NO: 599887 - RNA, 19 nt, Homo sapiens
ugaagaacucgcaguccuu

SEQ ID NO: 599888 - RNA, 19 nt, Homo sapiens
uccaacagcucagccaaca

SEQ ID NO: 599889 - RNA, 19 nt, Homo sapiens
ugcgagcaaucgagaucua

SEQ ID NO: 599890 - RNA, 19 nt, Homo sapiens
gaggcggagcgcaaaguga

SEQ ID NO: 599891 - RNA, 19 nt, Homo sapiens
ccaacaagugucugcugaa

SEQ ID NO: 599892 - RNA, 19 nt, Homo sapiens
ggccauuaacuguuugaug

SEQ ID NO: 599893 - RNA, 19 nt, Homo sapiens
cccuaaugcuuugagguuu

SEQ ID NO: 599894 - RNA, 19 nt, Homo sapiens
aagcaccacaucuccauug

SEQ ID NO: 599895 - RNA, 19 nt, Homo sapiens
ucccagcuuucucugauuc

SEQ ID NO: 599896 - RNA, 19 nt, Homo sapiens
ggccauugacaucuacgaa

SEQ ID NO: 599897 - RNA, 19 nt, Homo sapiens
ggacgcuggcaacgcauuc

SEQ ID NO: 599898 - RNA, 19 nt, Homo sapiens
gaaaguagcucaaagaaga

SEQ ID NO: 599899 - RNA, 19 nt, Homo sapiens
gaagaacacugaacuuuga

SEQ ID NO: 599900 - RNA, 19 nt, Homo sapiens
gagaaacaccaacauauua

SEQ ID NO: 599901 - RNA, 19 nt, Homo sapiens
gauggaagauugaaagaaa

SEQ ID NO: 599902 - RNA, 19 nt, Homo sapiens
ggacaaagaggaugaguuu

SEQ ID NO: 599903 - RNA, 19 nt, Homo sapiens
gcagauuugucuccuguua

SEQ ID NO: 599904 - RNA, 19 nt, Homo sapiens
gcacugguccugacaauuu

SEQ ID NO: 599905 - RNA, 19 nt, Homo sapiens
gaaaugcaguagaaccuuu

SEQ ID NO: 599906 - RNA, 19 nt, Homo sapiens
gaggagagcugggaauauu

SEQ ID NO: 599907 - RNA, 19 nt, Homo sapiens
ggaaauagaguuaaguuga

SEQ ID NO: 599908 - RNA, 19 nt, Homo sapiens
guagagguauugcgacaua

SEQ ID NO: 599909 - RNA, 19 nt, Homo sapiens
gaaaauggcuucaguaagu

SEQ ID NO: 599910 - RNA, 19 nt, Homo sapiens
gcagggagaccagauauua

SEQ ID NO: 599911 - RNA, 19 nt, Homo sapiens
cagcaaagaugacaguaaa

SEQ ID NO: 599912 - RNA, 19 nt, Homo sapiens
gauggucgauugcaaauug

SEQ ID NO: 599913 - RNA, 19 nt, Homo sapiens
guacagagcauuauaaaca

SEQ ID NO: 599914 - RNA, 19 nt, Homo sapiens
ggaauugacuugagaaagg

SEQ ID NO: 599915 - RNA, 19 nt, Homo sapiens
guggagauaucuaauguuu

SEQ ID NO: 599916 - RNA, 19 nt, Homo sapiens
ggaaguaaauggcauaacu

SEQ ID NO: 599917 - RNA, 19 nt, Homo sapiens
ggaccucaguucauuuaaa

SEQ ID NO: 599918 - RNA, 19 nt, Homo sapiens
cagaaugccucaucaauca

SEQ ID NO: 599919 - RNA, 19 nt, Homo sapiens
guagaugaauccacauuug

SEQ ID NO: 599920 - RNA, 19 nt, Homo sapiens
caucaaacauguucuggaa

SEQ ID NO: 599921 - RNA, 19 nt, Homo sapiens
acaacaaucuggaagagua

SEQ ID NO: 599922 - RNA, 19 nt, Homo sapiens
gacugcaucuuguccauua

SEQ ID NO: 599923 - RNA, 19 nt, Homo sapiens
gcuucuggcuuuacuauaa

SEQ ID NO: 599924 - RNA, 19 nt, Homo sapiens
cacaaaugaugcugacuua

SEQ ID NO: 599925 - RNA, 19 nt, Homo sapiens
guccaaggauuaggaauua

SEQ ID NO: 599926 - RNA, 19 nt, Homo sapiens
gcaucuggcuccauugaaa

SEQ ID NO: 599927 - RNA, 19 nt, Homo sapiens
gcagagcgcuugcaaacca

SEQ ID NO: 599928 - RNA, 19 nt, Homo sapiens
ggacuuaugugauauugag

SEQ ID NO: 599929 - RNA, 19 nt, Homo sapiens
gaagaaggguauccauuac

SEQ ID NO: 599930 - RNA, 19 nt, Homo sapiens
ucagaaaggugaagaaagu

SEQ ID NO: 599931 - RNA, 19 nt, Homo sapiens
caacuggugugauaguaaa

SEQ ID NO: 599932 - RNA, 19 nt, Homo sapiens
caaagauacuguccagcua

SEQ ID NO: 599933 - RNA, 19 nt, Homo sapiens
gaaaccugcuugugaugaa

SEQ ID NO: 599934 - RNA, 19 nt, Homo sapiens
gaauggaauugacuugaga

SEQ ID NO: 599935 - RNA, 19 nt, Homo sapiens
cagaugagcuucuagagau

SEQ ID NO: 599936 - RNA, 19 nt, Homo sapiens
gggcugacgucaagcagua

SEQ ID NO: 599937 - RNA, 19 nt, Homo sapiens
gaaauacagggauuaagaa

SEQ ID NO: 599938 - RNA, 19 nt, Homo sapiens
ggccuaggauuaaguauug

SEQ ID NO: 599939 - RNA, 19 nt, Homo sapiens
cagcagcacuaacccauuu

SEQ ID NO: 599940 - RNA, 19 nt, Homo sapiens
ugaaagaccagguaaauau

SEQ ID NO: 599941 - RNA, 19 nt, Homo sapiens
gggcaagaauuauuacaug

SEQ ID NO: 599942 - RNA, 19 nt, Homo sapiens
ggagauaucuaauguuuug

SEQ ID NO: 599943 - RNA, 19 nt, Homo sapiens
cuauugagcugcagaagaa

SEQ ID NO: 599944 - RNA, 19 nt, Homo sapiens
gaaacaaccaucgagauuu

SEQ ID NO: 599945 - RNA, 19 nt, Homo sapiens
aaaugaugcugacuuagua

SEQ ID NO: 599946 - RNA, 19 nt, Homo sapiens
gagaagaacacugaacuuu

SEQ ID NO: 599947 - RNA, 19 nt, Homo sapiens
ugaagaaagugagacauuu

SEQ ID NO: 599948 - RNA, 19 nt, Homo sapiens
uaagaacagucgaaaugaa

SEQ ID NO: 599949 - RNA, 19 nt, Homo sapiens
gcaaguagcacaaguccuu

SEQ ID NO: 599950 - RNA, 19 nt, Homo sapiens
gaaagaccagguaaauauu

SEQ ID NO: 599951 - RNA, 19 nt, Homo sapiens
caaagucggagaucagaua

SEQ ID NO: 599952 - RNA, 19 nt, Homo sapiens
caagugaaguuauaucaag

SEQ ID NO: 599953 - RNA, 19 nt, Homo sapiens
gaacaacaauaugaaugug

SEQ ID NO: 599954 - RNA, 19 nt, Homo sapiens
caaaugcuauugaacaaca

SEQ ID NO: 599955 - RNA, 19 nt, Homo sapiens
uaaaagaacugccuauaga

SEQ ID NO: 599956 - RNA, 19 nt, Homo sapiens
agaagaaggguauccauua

SEQ ID NO: 599957 - RNA, 19 nt, Homo sapiens
gcagugccguugagcauga

SEQ ID NO: 599958 - RNA, 19 nt, Homo sapiens
ccaugaaguuuaugaagaa

SEQ ID NO: 599959 - RNA, 19 nt, Homo sapiens
aaacaaccaucgagauuuc

SEQ ID NO: 599960 - RNA, 19 nt, Homo sapiens
gaaauaaagaugcagugaa

SEQ ID NO: 599961 - RNA, 19 nt, Homo sapiens
ucaaacauguucuggaaga

SEQ ID NO: 599962 - RNA, 19 nt, Homo sapiens
gaugaucguucgaagcauu

SEQ ID NO: 599963 - RNA, 19 nt, Homo sapiens
uguaaacgauguuaacuug

SEQ ID NO: 599964 - RNA, 19 nt, Homo sapiens
gcacauagagcuggagaaa

SEQ ID NO: 599965 - RNA, 19 nt, Homo sapiens
gaagaaagugagacauuug

SEQ ID NO: 599966 - RNA, 19 nt, Homo sapiens
ggugaugugccuauauuua

SEQ ID NO: 599967 - RNA, 19 nt, Homo sapiens
gauacuggcuguagaugau

SEQ ID NO: 599968 - RNA, 19 nt, Homo sapiens
ggaacuauauacccagaau

SEQ ID NO: 599969 - RNA, 19 nt, Homo sapiens
ugaggaagcuguagaagca

SEQ ID NO: 599970 - RNA, 19 nt, Homo sapiens
aaacagcagucuugaggaa

SEQ ID NO: 599971 - RNA, 19 nt, Homo sapiens
ggcuguagaugaugaaauu

SEQ ID NO: 599972 - RNA, 19 nt, Homo sapiens
caaaggauuaugggaauua

SEQ ID NO: 599973 - RNA, 19 nt, Homo sapiens
gcuaagcaauggagaagug

SEQ ID NO: 599974 - RNA, 19 nt, Homo sapiens
ggaaugacaguuagugcua

SEQ ID NO: 599975 - RNA, 19 nt, Homo sapiens
gcaaagacaggaugagaau

SEQ ID NO: 599976 - RNA, 19 nt, Homo sapiens
gcaagcacugugauuauaa

SEQ ID NO: 599977 - RNA, 19 nt, Homo sapiens
gagacgagcuauuggaagu

SEQ ID NO: 599978 - RNA, 19 nt, Homo sapiens
agaguuaaguugaugauug

SEQ ID NO: 599979 - RNA, 19 nt, Homo sapiens
gcacaaguccuuaggcaau

SEQ ID NO: 599980 - RNA, 19 nt, Homo sapiens
gaaaggucauagugguuug

SEQ ID NO: 599981 - RNA, 19 nt, Homo sapiens
ggaauggaccucagagaug

SEQ ID NO: 599982 - RNA, 19 nt, Homo sapiens
uaaacgauguuaacuugga

SEQ ID NO: 599983 - RNA, 19 nt, Homo sapiens
ggacuugguuuuagcauuu

SEQ ID NO: 599984 - RNA, 19 nt, Homo sapiens
gauacuguccagcuaguua

SEQ ID NO: 599985 - RNA, 19 nt, Homo sapiens
gcauaugucucuggaggaa

SEQ ID NO: 599986 - RNA, 19 nt, Homo sapiens
cgauugaauuggugaauga

SEQ ID NO: 599987 - RNA, 19 nt, Homo sapiens
gcgaggaccagauggcuua

SEQ ID NO: 599988 - RNA, 19 nt, Homo sapiens
gcucaaagaagaaugcauu

SEQ ID NO: 599989 - RNA, 19 nt, Homo sapiens
gaaaggccacacaugauga

SEQ ID NO: 599990 - RNA, 19 nt, Homo sapiens
cgaagaagauacacucagu

SEQ ID NO: 599991 - RNA, 19 nt, Homo sapiens
gauauugagcuaacagaaa

SEQ ID NO: 599992 - RNA, 19 nt, Homo sapiens
gcaaaggauuaugggaauu

SEQ ID NO: 599993 - RNA, 19 nt, Homo sapiens
cgagaaacaccaacauauu

SEQ ID NO: 599994 - RNA, 19 nt, Homo sapiens
gggaauauuuguucaagag

SEQ ID NO: 599995 - RNA, 19 nt, Homo sapiens
ugagaaaggccacacauga

SEQ ID NO: 599996 - RNA, 19 nt, Homo sapiens
gaagaaggagcagcaugua

SEQ ID NO: 599997 - RNA, 19 nt, Homo sapiens
aggcaacccuguagucuuu

SEQ ID NO: 599998 - RNA, 19 nt, Homo sapiens
gaaaacagaugauggaauu

SEQ ID NO: 599999 - RNA, 19 nt, Homo sapiens
gaagagcccuuguggcaau

SEQ ID NO: 600000 - RNA, 19 nt, Homo sapiens
gcaccaaccucaccuguca

SEQ ID NO: 600001 - RNA, 19 nt, Homo sapiens
agaauaagcugaacuugga

SEQ ID NO: 600002 - RNA, 19 nt, Homo sapiens
aaauauagcuaccaacaga

SEQ ID NO: 600003 - RNA, 19 nt, Homo sapiens
ugacagcccugauagagaa

SEQ ID NO: 600004 - RNA, 19 nt, Homo sapiens
gcacugucaucaagcaauu

SEQ ID NO: 600005 - RNA, 19 nt, Homo sapiens
gaaaucaacacauggaaau

SEQ ID NO: 600006 - RNA, 19 nt, Homo sapiens
gaggugggcucaaaucuag

SEQ ID NO: 600007 - RNA, 19 nt, Homo sapiens
ccucaaagguuguugugaa

SEQ ID NO: 600008 - RNA, 19 nt, Homo sapiens
ggaggugacagcccugaua

SEQ ID NO: 600009 - RNA, 19 nt, Homo sapiens
cauuaugccucccuuaguu

SEQ ID NO: 600010 - RNA, 19 nt, Homo sapiens
gaaaauggaugaugaagac

SEQ ID NO: 600011 - RNA, 19 nt, Homo sapiens
gcucagcuccgaccucaaa

SEQ ID NO: 600012 - RNA, 19 nt, Homo sapiens
aguaaggucugcagaagaa

SEQ ID NO: 600013 - RNA, 19 nt, Homo sapiens
gaucaagacaagcaaguga

SEQ ID NO: 600014 - RNA, 19 nt, Homo sapiens
gaacuguccagcucaaugu

SEQ ID NO: 600015 - RNA, 19 nt, Homo sapiens
gaagggauguaaaauauag

SEQ ID NO: 600016 - RNA, 19 nt, Homo sapiens
gaaacccgacauccacuuu

SEQ ID NO: 600017 - RNA, 19 nt, Homo sapiens
uuagagaggugggcucaaa

SEQ ID NO: 600018 - RNA, 19 nt, Homo sapiens
ccgcugggcuuccugcaaa

SEQ ID NO: 600019 - RNA, 19 nt, Homo sapiens
ucagagaucaugcaugcua

SEQ ID NO: 600020 - RNA, 19 nt, Homo sapiens
gacaagcaagugaggauuu

SEQ ID NO: 600021 - RNA, 19 nt, Homo sapiens
gggaccaccucucacauuc

SEQ ID NO: 600022 - RNA, 19 nt, Homo sapiens
gcuggcggcuugaggagaa

SEQ ID NO: 600023 - RNA, 19 nt, Homo sapiens
gcacugcagaugcuccuuu

SEQ ID NO: 600024 - RNA, 19 nt, Homo sapiens
aaacaacccagacagaaga

SEQ ID NO: 600025 - RNA, 19 nt, Homo sapiens
ggagagaggaagggaugua

SEQ ID NO: 600026 - RNA, 19 nt, Homo sapiens
aaaaggagcuccauuaugc

SEQ ID NO: 600027 - RNA, 19 nt, Homo sapiens
cggcauagcccuagagauc

SEQ ID NO: 600028 - RNA, 19 nt, Homo sapiens
caaccucaccugucagaug

SEQ ID NO: 600029 - RNA, 19 nt, Homo sapiens
ucauggcccugcucuguau

SEQ ID NO: 600030 - RNA, 19 nt, Homo sapiens
ccacagaccaucaccaucu

SEQ ID NO: 600031 - RNA, 19 nt, Homo sapiens
aaccucaccugucagauga

SEQ ID NO: 600032 - RNA, 19 nt, Homo sapiens
gagagaggaagggauguaa

SEQ ID NO: 600033 - RNA, 19 nt, Homo sapiens
gaagcgggaccaccucuca

SEQ ID NO: 600034 - RNA, 19 nt, Homo sapiens
gaggaagggauguaaaaua

SEQ ID NO: 600035 - RNA, 19 nt, Homo sapiens
cagagaaaauggaugauga

SEQ ID NO: 600036 - RNA, 19 nt, Homo sapiens
cgaguaaggucugcagaag

SEQ ID NO: 600037 - RNA, 19 nt, Homo sapiens
ggaacggcauagcccuaga

SEQ ID NO: 600038 - RNA, 19 nt, Homo sapiens
acaagcaagugaggauuug

SEQ ID NO: 600039 - RNA, 19 nt, Homo sapiens
aagaagcccuggccagaca

SEQ ID NO: 600040 - RNA, 19 nt, Homo sapiens
ggaggacacgggaagcuau

SEQ ID NO: 600041 - RNA, 19 nt, Homo sapiens
aaagaaaucaacacaugga

SEQ ID NO: 600042 - RNA, 19 nt, Homo sapiens
gcaaaacaccucauaccuu

SEQ ID NO: 600043 - RNA, 19 nt, Homo sapiens
gcagaaagaaaacagauga

SEQ ID NO: 600044 - RNA, 19 nt, Homo sapiens
ugaagucgagggagccuaa

SEQ ID NO: 600045 - RNA, 19 nt, Homo sapiens
gaccaccucucacauucuc

SEQ ID NO: 600046 - RNA, 19 nt, Homo sapiens
ggacacgggaagcuauuuc

SEQ ID NO: 600047 - RNA, 19 nt, Homo sapiens
caaacaacccagacagaag

SEQ ID NO: 600048 - RNA, 19 nt, Homo sapiens
gcaaggccuggaacaucua

SEQ ID NO: 600049 - RNA, 19 nt, Homo sapiens
ccagcucaaugucuccuau

SEQ ID NO: 600050 - RNA, 19 nt, Homo sapiens
acucggagaucaagacaag

SEQ ID NO: 600051 - RNA, 19 nt, Homo sapiens
gaacaaaaggagcuccauu

SEQ ID NO: 600052 - RNA, 19 nt, Homo sapiens
gaguaaggucugcagaaga

SEQ ID NO: 600053 - RNA, 19 nt, Homo sapiens
acaaacaacccagacagaa

SEQ ID NO: 600054 - RNA, 19 nt, Homo sapiens
agaaaucaacacauggaaa

SEQ ID NO: 600055 - RNA, 19 nt, Homo sapiens
aaacagaugauggaauuag

SEQ ID NO: 600056 - RNA, 19 nt, Homo sapiens
guaaaucagagaucaugca

SEQ ID NO: 600057 - RNA, 19 nt, Homo sapiens
ucaguuucccauucuguaa

SEQ ID NO: 600058 - RNA, 19 nt, Homo sapiens
ccaagcagagcagaaagaa

SEQ ID NO: 600059 - RNA, 19 nt, Homo sapiens
auacuacgcugagguugug

SEQ ID NO: 600060 - RNA, 19 nt, Homo sapiens
gggauguccagaagaagaa

SEQ ID NO: 600061 - RNA, 19 nt, Homo sapiens
gugaggauuugcccagagu

SEQ ID NO: 600062 - RNA, 19 nt, Homo sapiens
agagaacuguccagcucaa

SEQ ID NO: 600063 - RNA, 19 nt, Homo sapiens
uuggacauuuggagcauuu

SEQ ID NO: 600064 - RNA, 19 nt, Homo sapiens
ggaagggauguaaaauaua

SEQ ID NO: 600065 - RNA, 19 nt, Homo sapiens
aggaagggauguaaaauau

SEQ ID NO: 600066 - RNA, 19 nt, Homo sapiens
gagaggaagggauguaaaa

SEQ ID NO: 600067 - RNA, 19 nt, Homo sapiens
gaggacacgggaagcuauu

SEQ ID NO: 600068 - RNA, 19 nt, Homo sapiens
gugccucaguuucccauuc

SEQ ID NO: 600069 - RNA, 19 nt, Homo sapiens
aacagaugauggaauuaga

SEQ ID NO: 600070 - RNA, 19 nt, Homo sapiens
ccaucaccaucuucaggaa

SEQ ID NO: 600071 - RNA, 19 nt, Homo sapiens
ccucaccugucagaugaaa

SEQ ID NO: 600072 - RNA, 19 nt, Homo sapiens
agaggugggcucaaaucua

SEQ ID NO: 600073 - RNA, 19 nt, Homo sapiens
cacagaccaucaccaucuu

SEQ ID NO: 600074 - RNA, 19 nt, Homo sapiens
caagcagagcagaaagaaa

SEQ ID NO: 600075 - RNA, 19 nt, Homo sapiens
gaggauuugcccagaguuc

SEQ ID NO: 600076 - RNA, 19 nt, Homo sapiens
gaggugacagcccugauag

SEQ ID NO: 600077 - RNA, 19 nt, Homo sapiens
cacaaacaacccagacaga

SEQ ID NO: 600078 - RNA, 19 nt, Homo sapiens
cagaugauggaauuagaga

SEQ ID NO: 600079 - RNA, 19 nt, Homo sapiens
aagcagagcagaaagaaaa

SEQ ID NO: 600080 - RNA, 19 nt, Homo sapiens
gagaucaagacaagcaagu

SEQ ID NO: 600081 - RNA, 19 nt, Homo sapiens
cugcacaccugagcugguu

SEQ ID NO: 600082 - RNA, 19 nt, Homo sapiens
gcauagcccuagagauccu

SEQ ID NO: 600083 - RNA, 19 nt, Homo sapiens
gaacggcauagcccuagag

SEQ ID NO: 600084 - RNA, 19 nt, Homo sapiens
gauagagaaacccgacauc

SEQ ID NO: 600085 - RNA, 19 nt, Homo sapiens
auagcuaccaacagaauaa

SEQ ID NO: 600086 - RNA, 19 nt, Homo sapiens
gagcccuuguggcaauguu

SEQ ID NO: 600087 - RNA, 19 nt, Homo sapiens
cccuggagauccugguauu

SEQ ID NO: 600088 - RNA, 19 nt, Homo sapiens
caaaaggagcuccauuaug

SEQ ID NO: 600089 - RNA, 19 nt, Homo sapiens
ugcaaggccuggaacaucu

SEQ ID NO: 600090 - RNA, 19 nt, Homo sapiens
ggagcuucgucgaguaagg

SEQ ID NO: 600091 - RNA, 19 nt, Homo sapiens
uauagcuaccaacagaaua

SEQ ID NO: 600092 - RNA, 19 nt, Homo sapiens
aaucaacacauggaaauca

SEQ ID NO: 600093 - RNA, 19 nt, Homo sapiens
ggugacagcccugauagag

SEQ ID NO: 600094 - RNA, 19 nt, Homo sapiens
gcccuuguggcaauguuaa

SEQ ID NO: 600095 - RNA, 19 nt, Homo sapiens
ucaugcaugcuaccucaaa

SEQ ID NO: 600096 - RNA, 19 nt, Homo sapiens
gagaggugggcucaaaucu

SEQ ID NO: 600097 - RNA, 19 nt, Homo sapiens
ccacggaguacucggagau

SEQ ID NO: 600098 - RNA, 19 nt, Homo sapiens
gauagaagcuuuggagaaa

SEQ ID NO: 600099 - RNA, 19 nt, Homo sapiens
gaaagaagccuacuaucaa

SEQ ID NO: 600100 - RNA, 19 nt, Homo sapiens
caacauacuugcuuuauuc

SEQ ID NO: 600101 - RNA, 19 nt, Homo sapiens
gcaguuauaucaugaaugu

SEQ ID NO: 600102 - RNA, 19 nt, Homo sapiens
gauacuggcuuuacagaaa

SEQ ID NO: 600103 - RNA, 19 nt, Homo sapiens
gcacuucucuguaaucuca

SEQ ID NO: 600104 - RNA, 19 nt, Homo sapiens
ggacagauguguuuacaag

SEQ ID NO: 600105 - RNA, 19 nt, Homo sapiens
ccaaauauguucuuucuag

SEQ ID NO: 600106 - RNA, 19 nt, Homo sapiens
gcugaaggaccauuuauua

SEQ ID NO: 600107 - RNA, 19 nt, Homo sapiens
ggaaaggacagauguguuu

SEQ ID NO: 600108 - RNA, 19 nt, Homo sapiens
caaacaugaugaaguagua

SEQ ID NO: 600109 - RNA, 19 nt, Homo sapiens
caccaaacaugaugaagua

SEQ ID NO: 600110 - RNA, 19 nt, Homo sapiens
gcagugagcugagaucaug

SEQ ID NO: 600111 - RNA, 19 nt, Homo sapiens
gaaacccugucucuacuaa

SEQ ID NO: 600112 - RNA, 19 nt, Homo sapiens
gugaacagcuggccaaaga

SEQ ID NO: 600113 - RNA, 19 nt, Homo sapiens
gguagaugcucauuacauu

SEQ ID NO: 600114 - RNA, 19 nt, Homo sapiens
cagaauggcugacagaaau

SEQ ID NO: 600115 - RNA, 19 nt, Homo sapiens
gaacacagcaagaauggaa

SEQ ID NO: 600116 - RNA, 19 nt, Homo sapiens
gacaaucacuggcuguauu

SEQ ID NO: 600117 - RNA, 19 nt, Homo sapiens
gagguugacuggcaggaua

SEQ ID NO: 600118 - RNA, 19 nt, Homo sapiens
gaaaggaggagucaaggaa

SEQ ID NO: 600119 - RNA, 19 nt, Homo sapiens
ccaaagaauugcaguuaga

SEQ ID NO: 600120 - RNA, 19 nt, Homo sapiens
gaaacuccaucuccaggaa

SEQ ID NO: 600121 - RNA, 19 nt, Homo sapiens
gaaaaggcaucauagguuu

SEQ ID NO: 600122 - RNA, 19 nt, Homo sapiens
gucacuaccucucaucuua

SEQ ID NO: 600123 - RNA, 19 nt, Homo sapiens
gcaggaaugucucgcaguu

SEQ ID NO: 600124 - RNA, 19 nt, Homo sapiens
aaguaaagcucaauaguga

SEQ ID NO: 600125 - RNA, 19 nt, Homo sapiens
gaaggaccauuuauuacug

SEQ ID NO: 600126 - RNA, 19 nt, Homo sapiens
ccagucaacuuucagcuuu

SEQ ID NO: 600127 - RNA, 19 nt, Homo sapiens
ggguaacacuuccaaauau

SEQ ID NO: 600128 - RNA, 19 nt, Homo sapiens
gaaaggacagaauauaaga

SEQ ID NO: 600129 - RNA, 19 nt, Homo sapiens
aaagaagccuacuaucaaa

SEQ ID NO: 600130 - RNA, 19 nt, Homo sapiens
gaaguaaagcucaauagug

SEQ ID NO: 600131 - RNA, 19 nt, Homo sapiens
caaacuuucugucugguaa

SEQ ID NO: 600132 - RNA, 19 nt, Homo sapiens
gaagaucacguucagaaga

SEQ ID NO: 600133 - RNA, 19 nt, Homo sapiens
gaaaagauaucaccaccaa

SEQ ID NO: 600134 - RNA, 19 nt, Homo sapiens
caauggagauagcaaaguu

SEQ ID NO: 600135 - RNA, 19 nt, Homo sapiens
gaguuagccuuucucaauu

SEQ ID NO: 600136 - RNA, 19 nt, Homo sapiens
aaagaucgcuucaguaaac

SEQ ID NO: 600137 - RNA, 19 nt, Homo sapiens
gguaggagauggaauugga

SEQ ID NO: 600138 - RNA, 19 nt, Homo sapiens
cgucuuuccuugaauauuu

SEQ ID NO: 600139 - RNA, 19 nt, Homo sapiens
gcagagagcuggaauuccu

SEQ ID NO: 600140 - RNA, 19 nt, Homo sapiens
gaacgagaacucuucaaug

SEQ ID NO: 600141 - RNA, 19 nt, Homo sapiens
uuaaagaucgcuucaguaa

SEQ ID NO: 600142 - RNA, 19 nt, Homo sapiens
caacaugccuacucagaag

SEQ ID NO: 600143 - RNA, 19 nt, Homo sapiens
ugacagaaaucgacauaag

SEQ ID NO: 600144 - RNA, 19 nt, Homo sapiens
gaaagaacacagcaagaau

SEQ ID NO: 600145 - RNA, 19 nt, Homo sapiens
gaaaggacagauguguuua

SEQ ID NO: 600146 - RNA, 19 nt, Homo sapiens
gcucaauagugaagaaaug

SEQ ID NO: 600147 - RNA, 19 nt, Homo sapiens
gaaguaguaugugggagaa

SEQ ID NO: 600148 - RNA, 19 nt, Homo sapiens
ggaauuggaauggauuuaa

SEQ ID NO: 600149 - RNA, 19 nt, Homo sapiens
gaaaaugugugcucuuuag

SEQ ID NO: 600150 - RNA, 19 nt, Homo sapiens
ugaaagaagccuacuauca

SEQ ID NO: 600151 - RNA, 19 nt, Homo sapiens
gaaaggagucuguugucuu

SEQ ID NO: 600152 - RNA, 19 nt, Homo sapiens
gaaaucgacauaagucaug

SEQ ID NO: 600153 - RNA, 19 nt, Homo sapiens
gagaaaacauugauacuuc

SEQ ID NO: 600154 - RNA, 19 nt, Homo sapiens
gguaacacuuccaaauaug

SEQ ID NO: 600155 - RNA, 19 nt, Homo sapiens
gaaaagugcauccuuauga

SEQ ID NO: 600156 - RNA, 19 nt, Homo sapiens
gaauaugaugcacagcuua

SEQ ID NO: 600157 - RNA, 19 nt, Homo sapiens
gaacagcuggccaaagaau

SEQ ID NO: 600158 - RNA, 19 nt, Homo sapiens
ucagaagaauggaaggaaa

SEQ ID NO: 600159 - RNA, 19 nt, Homo sapiens
guaaaguuauaccuacaga

SEQ ID NO: 600160 - RNA, 19 nt, Homo sapiens
gauagcaaaguuuccauuu

SEQ ID NO: 600161 - RNA, 19 nt, Homo sapiens
ugacauauucugacaaaga

SEQ ID NO: 600162 - RNA, 19 nt, Homo sapiens
uauauuggcuuuguuagga

SEQ ID NO: 600163 - RNA, 19 nt, Homo sapiens
gccaauagcaaaugaaguu

SEQ ID NO: 600164 - RNA, 19 nt, Homo sapiens
gcacuaauacccacugcuu

SEQ ID NO: 600165 - RNA, 19 nt, Homo sapiens
gagggagcauggaggauga

SEQ ID NO: 600166 - RNA, 19 nt, Homo sapiens
ggccaaagaauugcaguua

SEQ ID NO: 600167 - RNA, 19 nt, Homo sapiens
caacuaauuugagcuaucu

SEQ ID NO: 600168 - RNA, 19 nt, Homo sapiens
gauuucagguuuaaagauc

SEQ ID NO: 600169 - RNA, 19 nt, Homo sapiens
ugaaguugcuguugcugaa

SEQ ID NO: 600170 - RNA, 19 nt, Homo sapiens
ggaaaggagucuguugucu

SEQ ID NO: 600171 - RNA, 19 nt, Homo sapiens
gaacuguguacuugauuga

SEQ ID NO: 600172 - RNA, 19 nt, Homo sapiens
caucacagcagauaaugaa

SEQ ID NO: 600173 - RNA, 19 nt, Homo sapiens
cagcaagaauggaaaauuu

SEQ ID NO: 600174 - RNA, 19 nt, Homo sapiens
ccaccucucugcucuguuc

SEQ ID NO: 600175 - RNA, 19 nt, Homo sapiens
gcaggauacucgugaugau

SEQ ID NO: 600176 - RNA, 19 nt, Homo sapiens
ucagagagguguaauuuug

SEQ ID NO: 600177 - RNA, 19 nt, Homo sapiens
aaccauguuugacguauuu

SEQ ID NO: 600178 - RNA, 19 nt, Homo sapiens
uaacuauccagucaacuuu

SEQ ID NO: 600179 - RNA, 19 nt, Homo sapiens
ucaauuauguuuccagacu

SEQ ID NO: 600180 - RNA, 19 nt, Homo sapiens
aaacuaaauccacguaaga

SEQ ID NO: 600181 - RNA, 19 nt, Homo sapiens
uaaacuaaauccacguaag

SEQ ID NO: 600182 - RNA, 19 nt, Homo sapiens
agaguuagccuuucucaau

SEQ ID NO: 600183 - RNA, 19 nt, Homo sapiens
ucugacauauucugacaaa

SEQ ID NO: 600184 - RNA, 19 nt, Homo sapiens
gggaggauuuuacaacaua

SEQ ID NO: 600185 - RNA, 19 nt, Homo sapiens
caauggugcuucugugcuu

SEQ ID NO: 600186 - RNA, 19 nt, Homo sapiens
guuuaaagaucgcuucagu

SEQ ID NO: 600187 - RNA, 19 nt, Homo sapiens
gauaucaccaccaaacaug

SEQ ID NO: 600188 - RNA, 19 nt, Homo sapiens
gacauauucugacaaagag

SEQ ID NO: 600189 - RNA, 19 nt, Homo sapiens
aagaucacguucagaagaa

SEQ ID NO: 600190 - RNA, 19 nt, Homo sapiens
aaacaucacagcagauaau

SEQ ID NO: 600191 - RNA, 19 nt, Homo sapiens
gcaaucacugugcuagaaa

SEQ ID NO: 600192 - RNA, 19 nt, Homo sapiens
cuaucuggccuuacucuua

SEQ ID NO: 600193 - RNA, 19 nt, Homo sapiens
aguuagccuuucucaauua

SEQ ID NO: 600194 - RNA, 19 nt, Homo sapiens
uagguuaucuggcugaagu

SEQ ID NO: 600195 - RNA, 19 nt, Homo sapiens
gaagaagaagcugccguuu

SEQ ID NO: 600196 - RNA, 19 nt, Homo sapiens
caaugcuguuucaggcuua

SEQ ID NO: 600197 - RNA, 19 nt, Homo sapiens
ggaauuccuuguccaacag

SEQ ID NO: 600198 - RNA, 19 nt, Homo sapiens
gauagaagcuuuggagaaa

SEQ ID NO: 600199 - RNA, 19 nt, Homo sapiens
gaaagaagccuacuaucaa

SEQ ID NO: 600200 - RNA, 19 nt, Homo sapiens
caacauacuugcuuuauuc

SEQ ID NO: 600201 - RNA, 19 nt, Homo sapiens
gcaguuauaucaugaaugu

SEQ ID NO: 600202 - RNA, 19 nt, Homo sapiens
gauacuggcuuuacagaaa

SEQ ID NO: 600203 - RNA, 19 nt, Homo sapiens
gcacuucucuguaaucuca

SEQ ID NO: 600204 - RNA, 19 nt, Homo sapiens
ggacagauguguuuacaag

SEQ ID NO: 600205 - RNA, 19 nt, Homo sapiens
ccaaauauguucuuucuag

SEQ ID NO: 600206 - RNA, 19 nt, Homo sapiens
gcugaaggaccauuuauua

SEQ ID NO: 600207 - RNA, 19 nt, Homo sapiens
ggaaaggacagauguguuu

SEQ ID NO: 600208 - RNA, 19 nt, Homo sapiens
caaacaugaugaaguagua

SEQ ID NO: 600209 - RNA, 19 nt, Homo sapiens
caccaaacaugaugaagua

SEQ ID NO: 600210 - RNA, 19 nt, Homo sapiens
gcagugagcugagaucaug

SEQ ID NO: 600211 - RNA, 19 nt, Homo sapiens
gaaacccugucucuacuaa

SEQ ID NO: 600212 - RNA, 19 nt, Homo sapiens
gugaacagcuggccaaaga

SEQ ID NO: 600213 - RNA, 19 nt, Homo sapiens
gguagaugcucauuacauu

SEQ ID NO: 600214 - RNA, 19 nt, Homo sapiens
cagaauggcugacagaaau

SEQ ID NO: 600215 - RNA, 19 nt, Homo sapiens
guaaauacaucaguucaug

SEQ ID NO: 600216 - RNA, 19 nt, Homo sapiens
gaacacagcaagaauggaa

SEQ ID NO: 600217 - RNA, 19 nt, Homo sapiens
gacaaucacuggcuguauu

SEQ ID NO: 600218 - RNA, 19 nt, Homo sapiens
gagguugacuggcaggaua

SEQ ID NO: 600219 - RNA, 19 nt, Homo sapiens
gaaaggaggagucaaggaa

SEQ ID NO: 600220 - RNA, 19 nt, Homo sapiens
ccaaagaauugcaguuaga

SEQ ID NO: 600221 - RNA, 19 nt, Homo sapiens
gaaacuccaucuccaggaa

SEQ ID NO: 600222 - RNA, 19 nt, Homo sapiens
gaaaaggcaucauagguuu

SEQ ID NO: 600223 - RNA, 19 nt, Homo sapiens
gucacuaccucucaucuua

SEQ ID NO: 600224 - RNA, 19 nt, Homo sapiens
gcaggaaugucucgcaguu

SEQ ID NO: 600225 - RNA, 19 nt, Homo sapiens
aaguaaagcucaauaguga

SEQ ID NO: 600226 - RNA, 19 nt, Homo sapiens
gaaggaccauuuauuacug

SEQ ID NO: 600227 - RNA, 19 nt, Homo sapiens
ccagucaacuuucagcuuu

SEQ ID NO: 600228 - RNA, 19 nt, Homo sapiens
ggguaacacuuccaaauau

SEQ ID NO: 600229 - RNA, 19 nt, Homo sapiens
gaaaggacagaauauaaga

SEQ ID NO: 600230 - RNA, 19 nt, Homo sapiens
aaagaagccuacuaucaaa

SEQ ID NO: 600231 - RNA, 19 nt, Homo sapiens
gaaguaaagcucaauagug

SEQ ID NO: 600232 - RNA, 19 nt, Homo sapiens
caaacuuucugucugguaa

SEQ ID NO: 600233 - RNA, 19 nt, Homo sapiens
gaagaucacguucagaaga

SEQ ID NO: 600234 - RNA, 19 nt, Homo sapiens
gaaaagauaucaccaccaa

SEQ ID NO: 600235 - RNA, 19 nt, Homo sapiens
caauggagauagcaaaguu

SEQ ID NO: 600236 - RNA, 19 nt, Homo sapiens
gaguuagccuuucucaauu

SEQ ID NO: 600237 - RNA, 19 nt, Homo sapiens
aaagaucgcuucaguaaac

SEQ ID NO: 600238 - RNA, 19 nt, Homo sapiens
gguaggagauggaauugga

SEQ ID NO: 600239 - RNA, 19 nt, Homo sapiens
cgucuuuccuugaauauuu

SEQ ID NO: 600240 - RNA, 19 nt, Homo sapiens
gcagagagcuggaauuccu

SEQ ID NO: 600241 - RNA, 19 nt, Homo sapiens
gaacgagaacucuucaaug

SEQ ID NO: 600242 - RNA, 19 nt, Homo sapiens
uuaaagaucgcuucaguaa

SEQ ID NO: 600243 - RNA, 19 nt, Homo sapiens
caacaugccuacucagaag

SEQ ID NO: 600244 - RNA, 19 nt, Homo sapiens
ugacagaaaucgacauaag

SEQ ID NO: 600245 - RNA, 19 nt, Homo sapiens
gaaagaacacagcaagaau

SEQ ID NO: 600246 - RNA, 19 nt, Homo sapiens
gaaaggacagauguguuua

SEQ ID NO: 600247 - RNA, 19 nt, Homo sapiens
gcucaauagugaagaaaug

SEQ ID NO: 600248 - RNA, 19 nt, Homo sapiens
gaaguaguaugugggagaa

SEQ ID NO: 600249 - RNA, 19 nt, Homo sapiens
ggaauuggaauggauuuaa

SEQ ID NO: 600250 - RNA, 19 nt, Homo sapiens
gaaaaugugugcucuuuag

SEQ ID NO: 600251 - RNA, 19 nt, Homo sapiens
ugaaagaagccuacuauca

SEQ ID NO: 600252 - RNA, 19 nt, Homo sapiens
gaaaggagucuguugucuu

SEQ ID NO: 600253 - RNA, 19 nt, Homo sapiens
gaaaucgacauaagucaug

SEQ ID NO: 600254 - RNA, 19 nt, Homo sapiens
gagaaaacauugauacuuc

SEQ ID NO: 600255 - RNA, 19 nt, Homo sapiens
gguaacacuuccaaauaug

SEQ ID NO: 600256 - RNA, 19 nt, Homo sapiens
ugaaauaggucugguugau

SEQ ID NO: 600257 - RNA, 19 nt, Homo sapiens
gaaaagugcauccuuauga

SEQ ID NO: 600258 - RNA, 19 nt, Homo sapiens
gaauaugaugcacagcuua

SEQ ID NO: 600259 - RNA, 19 nt, Homo sapiens
ucagaagaauggaaggaaa

SEQ ID NO: 600260 - RNA, 19 nt, Homo sapiens
guaaaguuauaccuacaga

SEQ ID NO: 600261 - RNA, 19 nt, Homo sapiens
gaacagcuggccaaagaau

SEQ ID NO: 600262 - RNA, 19 nt, Homo sapiens
gauagcaaaguuuccauuu

SEQ ID NO: 600263 - RNA, 19 nt, Homo sapiens
ugacauauucugacaaaga

SEQ ID NO: 600264 - RNA, 19 nt, Homo sapiens
uauauuggcuuuguuagga

SEQ ID NO: 600265 - RNA, 19 nt, Homo sapiens
gccaauagcaaaugaaguu

SEQ ID NO: 600266 - RNA, 19 nt, Homo sapiens
gcacuaauacccacugcuu

SEQ ID NO: 600267 - RNA, 19 nt, Homo sapiens
ggccaaagaauugcaguua

SEQ ID NO: 600268 - RNA, 19 nt, Homo sapiens
gagggagcauggaggauga

SEQ ID NO: 600269 - RNA, 19 nt, Homo sapiens
caacuaauuugagcuaucu

SEQ ID NO: 600270 - RNA, 19 nt, Homo sapiens
gauuucagguuuaaagauc

SEQ ID NO: 600271 - RNA, 19 nt, Homo sapiens
ugaaguugcuguugcugaa

SEQ ID NO: 600272 - RNA, 19 nt, Homo sapiens
ggaaaggagucuguugucu

SEQ ID NO: 600273 - RNA, 19 nt, Homo sapiens
gaacuguguacuugauuga

SEQ ID NO: 600274 - RNA, 19 nt, Homo sapiens
caucacagcagauaaugaa

SEQ ID NO: 600275 - RNA, 19 nt, Homo sapiens
cagcaagaauggaaaauuu

SEQ ID NO: 600276 - RNA, 19 nt, Homo sapiens
ccaccucucugcucuguuc

SEQ ID NO: 600277 - RNA, 19 nt, Homo sapiens
gcaggauacucgugaugau

SEQ ID NO: 600278 - RNA, 19 nt, Homo sapiens
ucagagagguguaauuuug

SEQ ID NO: 600279 - RNA, 19 nt, Homo sapiens
aaccauguuugacguauuu

SEQ ID NO: 600280 - RNA, 19 nt, Homo sapiens
uaacuauccagucaacuuu

SEQ ID NO: 600281 - RNA, 19 nt, Homo sapiens
ucaauuauguuuccagacu

SEQ ID NO: 600282 - RNA, 19 nt, Homo sapiens
aaacuaaauccacguaaga

SEQ ID NO: 600283 - RNA, 19 nt, Homo sapiens
uaaacuaaauccacguaag

SEQ ID NO: 600284 - RNA, 19 nt, Homo sapiens
agaguuagccuuucucaau

SEQ ID NO: 600285 - RNA, 19 nt, Homo sapiens
ucugacauauucugacaaa

SEQ ID NO: 600286 - RNA, 19 nt, Homo sapiens
gggaggauuuuacaacaua

SEQ ID NO: 600287 - RNA, 19 nt, Homo sapiens
caauggugcuucugugcuu

SEQ ID NO: 600288 - RNA, 19 nt, Homo sapiens
caguucauguucuguauug

SEQ ID NO: 600289 - RNA, 19 nt, Homo sapiens
guuuaaagaucgcuucagu

SEQ ID NO: 600290 - RNA, 19 nt, Homo sapiens
gauaucaccaccaaacaug

SEQ ID NO: 600291 - RNA, 19 nt, Homo sapiens
gacauauucugacaaagag

SEQ ID NO: 600292 - RNA, 19 nt, Homo sapiens
aagaucacguucagaagaa

SEQ ID NO: 600293 - RNA, 19 nt, Homo sapiens
aaacaucacagcagauaau

SEQ ID NO: 600294 - RNA, 19 nt, Homo sapiens
gaagaagaagcugccguuu

SEQ ID NO: 600295 - RNA, 19 nt, Homo sapiens
gcaaucacugugcuagaaa

SEQ ID NO: 600296 - RNA, 19 nt, Homo sapiens
cuaucuggccuuacucuua

SEQ ID NO: 600297 - RNA, 19 nt, Homo sapiens
aguuagccuuucucaauua

SEQ ID NO: 600298 - RNA, 19 nt, Homo sapiens
gaucugcacugucaaguaa

SEQ ID NO: 600299 - RNA, 19 nt, Homo sapiens
ggaaucggaugcuuucauu

SEQ ID NO: 600300 - RNA, 19 nt, Homo sapiens
gauugauacuguuugcuua

SEQ ID NO: 600301 - RNA, 19 nt, Homo sapiens
ggcaacaagucaaggauaa

SEQ ID NO: 600302 - RNA, 19 nt, Homo sapiens
gggagaaccggaagaauaa

SEQ ID NO: 600303 - RNA, 19 nt, Homo sapiens
ggaagaauaacauccauug

SEQ ID NO: 600304 - RNA, 19 nt, Homo sapiens
uaacauccauugucauaca

SEQ ID NO: 600305 - RNA, 19 nt, Homo sapiens
caaguuacacagauugaua

SEQ ID NO: 600306 - RNA, 19 nt, Homo sapiens
ggucaucagugaagaagga

SEQ ID NO: 600307 - RNA, 19 nt, Homo sapiens
agaauaacauccauuguca

SEQ ID NO: 600308 - RNA, 19 nt, Homo sapiens
gaaggaaucggaugcuuuc

SEQ ID NO: 600309 - RNA, 19 nt, Homo sapiens
gaaaugugaucaggcaaca

SEQ ID NO: 600310 - RNA, 19 nt, Homo sapiens
ggauaacgccaaaugguau

SEQ ID NO: 600311 - RNA, 19 nt, Homo sapiens
ggaggagcuuuacgacuuc

SEQ ID NO: 600312 - RNA, 19 nt, Homo sapiens
ugggagaaccggaagaaua

SEQ ID NO: 600313 - RNA, 19 nt, Homo sapiens
ccaaaugguauaucacuga

SEQ ID NO: 600314 - RNA, 19 nt, Homo sapiens
uaugaucacuaucgauuuc

SEQ ID NO: 600315 - RNA, 19 nt, Homo sapiens
aggaggagcuuuacgacuu

SEQ ID NO: 600316 - RNA, 19 nt, Homo sapiens
gauaacgccaaaugguaua

SEQ ID NO: 600317 - RNA, 19 nt, Homo sapiens
gaguggagagucaauuaaa

SEQ ID NO: 600318 - RNA, 19 nt, Homo sapiens
gauacuguuugcuuacaau

SEQ ID NO: 600319 - RNA, 19 nt, Homo sapiens
ucgauuuccuggagaguuu

SEQ ID NO: 600320 - RNA, 19 nt, Homo sapiens
ucauacagcuccaaacaac

SEQ ID NO: 600321 - RNA, 19 nt, Homo sapiens
gaagaauaacauccauugu

SEQ ID NO: 600322 - RNA, 19 nt, Homo sapiens
gcacggucaucagugaaga

SEQ ID NO: 600323 - RNA, 19 nt, Homo sapiens
ugcuuacaauugccuauua

SEQ ID NO: 600324 - RNA, 19 nt, Homo sapiens
aagaguggagagucaauua

SEQ ID NO: 600325 - RNA, 19 nt, Homo sapiens
ucaaggauaacgccaaaug

SEQ ID NO: 600326 - RNA, 19 nt, Homo sapiens
ccuauuacaacuugcuaua

SEQ ID NO: 600327 - RNA, 19 nt, Homo sapiens
acagcacggucaucaguga

SEQ ID NO: 600328 - RNA, 19 nt, Homo sapiens
gcuaccaggaggagcuuua

SEQ ID NO: 600329 - RNA, 19 nt, Homo sapiens
agucaaggauaacgccaaa

SEQ ID NO: 600330 - RNA, 19 nt, Homo sapiens
ccuuugguaugucaauaaa

SEQ ID NO: 600331 - RNA, 19 nt, Homo sapiens
ccuuuacucuuaggaauau

SEQ ID NO: 600332 - RNA, 19 nt, Homo sapiens
caagguagcgcagaagcuu

SEQ ID NO: 600333 - RNA, 19 nt, Homo sapiens
agaaggaaucggaugcuuu

SEQ ID NO: 600334 - RNA, 19 nt, Homo sapiens
ggagaguuuuguaaucuga

SEQ ID NO: 600335 - RNA, 19 nt, Homo sapiens
guuccaguauuauaugauc

SEQ ID NO: 600336 - RNA, 19 nt, Homo sapiens
acaauugccuauuacaacu

SEQ ID NO: 600337 - RNA, 19 nt, Homo sapiens
guaguuccaguauuauaug

SEQ ID NO: 600338 - RNA, 19 nt, Homo sapiens
caccuuuacucuuaggaau

SEQ ID NO: 600339 - RNA, 19 nt, Homo sapiens
cgggcacgaucgcaaggua

SEQ ID NO: 600340 - RNA, 19 nt, Homo sapiens
gagaaccggaagaauaaca

SEQ ID NO: 600341 - RNA, 19 nt, Homo sapiens
gaucaggcaacaagucaag

SEQ ID NO: 600342 - RNA, 19 nt, Homo sapiens
aggauaacgccaaauggua

SEQ ID NO: 600343 - RNA, 19 nt, Homo sapiens
ugaggaagcuuuucuacuc

SEQ ID NO: 600344 - RNA, 19 nt, Homo sapiens
gcuuacaauugccuauuac

SEQ ID NO: 600345 - RNA, 19 nt, Homo sapiens
aagaauaacauccauuguc

SEQ ID NO: 600346 - RNA, 19 nt, Homo sapiens
gaaccggaagaauaacauc

SEQ ID NO: 600347 - RNA, 19 nt, Homo sapiens
guggagagucaauuaaaca

SEQ ID NO: 600348 - RNA, 19 nt, Homo sapiens
auacagcuccaaacaacuu

SEQ ID NO: 600349 - RNA, 19 nt, Homo sapiens
agaguggagagucaauuaa

SEQ ID NO: 600350 - RNA, 19 nt, Homo sapiens
ugauacuguuugcuuacaa

SEQ ID NO: 600351 - RNA, 19 nt, Homo sapiens
gaauaacauccauugucau

SEQ ID NO: 600352 - RNA, 19 nt, Homo sapiens
guuuauccaugugucagaa

SEQ ID NO: 600353 - RNA, 19 nt, Homo sapiens
uuacaaguuacacagauug

SEQ ID NO: 600354 - RNA, 19 nt, Homo sapiens
caccugagccugggaggaa

SEQ ID NO: 600355 - RNA, 19 nt, Homo sapiens
gaaucggaugcuuucauug

SEQ ID NO: 600356 - RNA, 19 nt, Homo sapiens
uaagaguggagagucaauu

SEQ ID NO: 600357 - RNA, 19 nt, Homo sapiens
gcacugucaaguaaacuac

SEQ ID NO: 600358 - RNA, 19 nt, Homo sapiens
uccaaacaacuucagauga

SEQ ID NO: 600359 - RNA, 19 nt, Homo sapiens
gaggaagcuuuucuacuca

SEQ ID NO: 600360 - RNA, 19 nt, Homo sapiens
ugucauacagcuccaaaca

SEQ ID NO: 600361 - RNA, 19 nt, Homo sapiens
gcugggagaaccggaagaa

SEQ ID NO: 600362 - RNA, 19 nt, Homo sapiens
aagaaggaaucggaugcuu

SEQ ID NO: 600363 - RNA, 19 nt, Homo sapiens
ugaucugcacugucaagua

SEQ ID NO: 600364 - RNA, 19 nt, Homo sapiens
gaugaucugcacugucaag

SEQ ID NO: 600365 - RNA, 19 nt, Homo sapiens
caaggauaacgccaaaugg

SEQ ID NO: 600366 - RNA, 19 nt, Homo sapiens
aauugccuauuacaacuug

SEQ ID NO: 600367 - RNA, 19 nt, Homo sapiens
gugaucaggcaacaaguca

SEQ ID NO: 600368 - RNA, 19 nt, Homo sapiens
gaagaaggaaucggaugcu

SEQ ID NO: 600369 - RNA, 19 nt, Homo sapiens
aggcaacaagucaaggaua

SEQ ID NO: 600370 - RNA, 19 nt, Homo sapiens
ccacgaaggccacugcaaa

SEQ ID NO: 600371 - RNA, 19 nt, Homo sapiens
ggagagagagacacaguca

SEQ ID NO: 600372 - RNA, 19 nt, Homo sapiens
gggauucucaggucaugaa

SEQ ID NO: 600373 - RNA, 19 nt, Homo sapiens
agagagagacacagucaug

SEQ ID NO: 600374 - RNA, 19 nt, Homo sapiens
gcugugggcucuugaaacc

SEQ ID NO: 600375 - RNA, 19 nt, Homo sapiens
ggagggagagagagacaca

SEQ ID NO: 600376 - RNA, 19 nt, Homo sapiens
cgagugggacugcaugugu

SEQ ID NO: 600377 - RNA, 19 nt, Homo sapiens
caggggaaauucaguuuug

SEQ ID NO: 600378 - RNA, 19 nt, Homo sapiens
gcagaagugggugcaggaa

SEQ ID NO: 600379 - RNA, 19 nt, Homo sapiens
ucuggcagcugaggaguca

SEQ ID NO: 600380 - RNA, 19 nt, Homo sapiens
cagcuuggacugcacaucu

SEQ ID NO: 600381 - RNA, 19 nt, Homo sapiens
ccacgaaggccacugcaaa

SEQ ID NO: 600382 - RNA, 19 nt, Homo sapiens
ggagagagagacacaguca

SEQ ID NO: 600383 - RNA, 19 nt, Homo sapiens
gggauucucaggucaugaa

SEQ ID NO: 600384 - RNA, 19 nt, Homo sapiens
agagagagacacagucaug

SEQ ID NO: 600385 - RNA, 19 nt, Homo sapiens
gcugugggcucuugaaacc

SEQ ID NO: 600386 - RNA, 19 nt, Homo sapiens
ggagggagagagagacaca

SEQ ID NO: 600387 - RNA, 19 nt, Homo sapiens
cgagugggacugcaugugu

SEQ ID NO: 600388 - RNA, 19 nt, Homo sapiens
caggggaaauucaguuuug

SEQ ID NO: 600389 - RNA, 19 nt, Homo sapiens
gcagaagugggugcaggaa

SEQ ID NO: 600390 - RNA, 19 nt, Homo sapiens
ccacgaaggccacugcaaa

SEQ ID NO: 600391 - RNA, 19 nt, Homo sapiens
ggagagagagacacaguca

SEQ ID NO: 600392 - RNA, 19 nt, Homo sapiens
gggauucucaggucaugaa

SEQ ID NO: 600393 - RNA, 19 nt, Homo sapiens
agagagagacacagucaug

SEQ ID NO: 600394 - RNA, 19 nt, Homo sapiens
gcugugggcucuugaaacc

SEQ ID NO: 600395 - RNA, 19 nt, Homo sapiens
ggagggagagagagacaca

SEQ ID NO: 600396 - RNA, 19 nt, Homo sapiens
cgagugggacugcaugugu

SEQ ID NO: 600397 - RNA, 19 nt, Homo sapiens
caggggaaauucaguuuug

SEQ ID NO: 600398 - RNA, 19 nt, Homo sapiens
gcagaagugggugcaggaa

SEQ ID NO: 600399 - RNA, 19 nt, Homo sapiens
cagcuuggacugcacaucu

SEQ ID NO: 600400 - RNA, 19 nt, Homo sapiens
gcgaaagccucguggaguu

SEQ ID NO: 600401 - RNA, 19 nt, Homo sapiens
gagcaccacugcgucaauu

SEQ ID NO: 600402 - RNA, 19 nt, Homo sapiens
gugcugcgcucaguucuuu

SEQ ID NO: 600403 - RNA, 19 nt, Homo sapiens
ugacgcaccugcuggagaa

SEQ ID NO: 600404 - RNA, 19 nt, Homo sapiens
ucaguucuuuguuggauuu

SEQ ID NO: 600405 - RNA, 19 nt, Homo sapiens
gaucugguguucgugauug

SEQ ID NO: 600406 - RNA, 19 nt, Homo sapiens
gaacugcacguguccuaug

SEQ ID NO: 600407 - RNA, 19 nt, Homo sapiens
gcagagagggccaugacuu

SEQ ID NO: 600408 - RNA, 19 nt, Homo sapiens
gcagggccauugacuacug

SEQ ID NO: 600409 - RNA, 19 nt, Homo sapiens
gcugugaguuccagugugu

SEQ ID NO: 600410 - RNA, 19 nt, Homo sapiens
ggaggaaggcaucgucaug

SEQ ID NO: 600411 - RNA, 19 nt, Homo sapiens
gaaccagauuguggacuuc

SEQ ID NO: 600412 - RNA, 19 nt, Homo sapiens
gccaugagaggccuucuuu

SEQ ID NO: 600413 - RNA, 19 nt, Homo sapiens
ugaaccagauuguggacuu

SEQ ID NO: 600414 - RNA, 19 nt, Homo sapiens
aggaaggcaucgucaugua

SEQ ID NO: 600415 - RNA, 19 nt, Homo sapiens
ggaaacccagcuccaguug

SEQ ID NO: 600416 - RNA, 19 nt, Homo sapiens
gcaauccaguacgccauga

SEQ ID NO: 600417 - RNA, 19 nt, Homo sapiens
gcguuggcgugauccagua

SEQ ID NO: 600418 - RNA, 19 nt, Homo sapiens
gcucaguucuuuguuggau

SEQ ID NO: 600419 - RNA, 19 nt, Homo sapiens
gggaaacccagcuccaguu

SEQ ID NO: 600420 - RNA, 19 nt, Homo sapiens
gaaacccagcuccaguuga

SEQ ID NO: 600421 - RNA, 19 nt, Homo sapiens
cagagagggccaugacuug

SEQ ID NO: 600422 - RNA, 19 nt, Homo sapiens
gaagggacccauggaugug

SEQ ID NO: 600423 - RNA, 19 nt, Homo sapiens
ugaagggacccauggaugu

SEQ ID NO: 600424 - RNA, 19 nt, Homo sapiens
uggaggaucuggagaacca

SEQ ID NO: 600425 - RNA, 19 nt, Homo sapiens
aaacccagcuccaguugac

SEQ ID NO: 600426 - RNA, 19 nt, Homo sapiens
gaggaaggcaucgucaugu

SEQ ID NO: 600427 - RNA, 19 nt, Homo sapiens
ggaccauggcugugaguuc

SEQ ID NO: 600428 - RNA, 19 nt, Homo sapiens
agaaccagcuggccaacca

SEQ ID NO: 600429 - RNA, 19 nt, Homo sapiens
gauuguggacuuccuagau

SEQ ID NO: 600430 - RNA, 19 nt, Homo sapiens
ggaccuuguucugcugguu

SEQ ID NO: 600431 - RNA, 19 nt, Homo sapiens
cagcaugaguguguuagca

SEQ ID NO: 600432 - RNA, 19 nt, Homo sapiens
ugacgggacuggcaaucca

SEQ ID NO: 600433 - RNA, 19 nt, Homo sapiens
guucuuuguuggauuucuu

SEQ ID NO: 600434 - RNA, 19 nt, Homo sapiens
ucgagagccugacgcugaa

SEQ ID NO: 600435 - RNA, 19 nt, Homo sapiens
ggaaggcaucgucauguac

SEQ ID NO: 600436 - RNA, 19 nt, Homo sapiens
ggaguucggccugcaguuc

SEQ ID NO: 600437 - RNA, 19 nt, Homo sapiens
gcacgucuuccucguagag

SEQ ID NO: 600438 - RNA, 19 nt, Homo sapiens
gauccaguauucgagucaa

SEQ ID NO: 600439 - RNA, 19 nt, Homo sapiens
caugagaggccuucuuugc

SEQ ID NO: 600440 - RNA, 19 nt, Homo sapiens
ccacguggaccuuguucug

SEQ ID NO: 600441 - RNA, 19 nt, Homo sapiens
uuggauuucuuguuugugu

SEQ ID NO: 600442 - RNA, 19 nt, Homo sapiens
caagagcgugcguccacaa

SEQ ID NO: 600443 - RNA, 19 nt, Homo sapiens
ggaacgcggcaccaugaca

SEQ ID NO: 600444 - RNA, 19 nt, Homo sapiens
ggagcugcagggccauuga

SEQ ID NO: 600445 - RNA, 19 nt, Homo sapiens
ggauuucuuguuuguguuc

SEQ ID NO: 600446 - RNA, 19 nt, Homo sapiens
gagagggccaugacuugca

SEQ ID NO: 600447 - RNA, 19 nt, Homo sapiens
gcugcagggccauugacua

SEQ ID NO: 600448 - RNA, 19 nt, Homo sapiens
ggaucugguguucgugauu

SEQ ID NO: 600449 - RNA, 19 nt, Homo sapiens
cgugcgcccuuucgaguuc

SEQ ID NO: 600450 - RNA, 19 nt, Homo sapiens
ggaacugcacguguccuau

SEQ ID NO: 600451 - RNA, 19 nt, Homo sapiens
ccagauuguggacuuccua

SEQ ID NO: 600452 - RNA, 19 nt, Homo sapiens
ggccguggaguacauggaa

SEQ ID NO: 600453 - RNA, 19 nt, Homo sapiens
auuguggacuuccuagaug

SEQ ID NO: 600454 - RNA, 19 nt, Homo sapiens
ugucagcaugaguguguua

SEQ ID NO: 600455 - RNA, 19 nt, Homo sapiens
gcgaaagccucguggaguu

SEQ ID NO: 600456 - RNA, 19 nt, Homo sapiens
gugcugcgcucaguucuuu

SEQ ID NO: 600457 - RNA, 19 nt, Homo sapiens
ugacgcaccugcuggagaa

SEQ ID NO: 600458 - RNA, 19 nt, Homo sapiens
ucaguucuuuguuggauuu

SEQ ID NO: 600459 - RNA, 19 nt, Homo sapiens
gaucugguguucgugauug

SEQ ID NO: 600460 - RNA, 19 nt, Homo sapiens
gaacugcacguguccuaug

SEQ ID NO: 600461 - RNA, 19 nt, Homo sapiens
gcagagagggccaugacuu

SEQ ID NO: 600462 - RNA, 19 nt, Homo sapiens
gcugugaguuccagugugu

SEQ ID NO: 600463 - RNA, 19 nt, Homo sapiens
ggaggaaggcaucgucaug

SEQ ID NO: 600464 - RNA, 19 nt, Homo sapiens
gaaccagauuguggacuuc

SEQ ID NO: 600465 - RNA, 19 nt, Homo sapiens
gccaugagaggccuucuuu

SEQ ID NO: 600466 - RNA, 19 nt, Homo sapiens
ugaaccagauuguggacuu

SEQ ID NO: 600467 - RNA, 19 nt, Homo sapiens
aggaaggcaucgucaugua

SEQ ID NO: 600468 - RNA, 19 nt, Homo sapiens
ggaaacccagcuccaguug

SEQ ID NO: 600469 - RNA, 19 nt, Homo sapiens
gcaauccaguacgccauga

SEQ ID NO: 600470 - RNA, 19 nt, Homo sapiens
gcguuggcgugauccagua

SEQ ID NO: 600471 - RNA, 19 nt, Homo sapiens
gcucaguucuuuguuggau

SEQ ID NO: 600472 - RNA, 19 nt, Homo sapiens
gaaacccagcuccaguuga

SEQ ID NO: 600473 - RNA, 19 nt, Homo sapiens
gggaaacccagcuccaguu

SEQ ID NO: 600474 - RNA, 19 nt, Homo sapiens
cagagagggccaugacuug

SEQ ID NO: 600475 - RNA, 19 nt, Homo sapiens
uggaggaucuggagaacca

SEQ ID NO: 600476 - RNA, 19 nt, Homo sapiens
aaacccagcuccaguugac

SEQ ID NO: 600477 - RNA, 19 nt, Homo sapiens
gaggaaggcaucgucaugu

SEQ ID NO: 600478 - RNA, 19 nt, Homo sapiens
ggaccauggcugugaguuc

SEQ ID NO: 600479 - RNA, 19 nt, Homo sapiens
agaaccagcuggccaacca

SEQ ID NO: 600480 - RNA, 19 nt, Homo sapiens
gauuguggacuuccuagau

SEQ ID NO: 600481 - RNA, 19 nt, Homo sapiens
ggaccuuguucugcugguu

SEQ ID NO: 600482 - RNA, 19 nt, Homo sapiens
cagcaugaguguguuagca

SEQ ID NO: 600483 - RNA, 19 nt, Homo sapiens
ugacgggacuggcaaucca

SEQ ID NO: 600484 - RNA, 19 nt, Homo sapiens
guucuuuguuggauuucuu

SEQ ID NO: 600485 - RNA, 19 nt, Homo sapiens
ucgagagccugacgcugaa

SEQ ID NO: 600486 - RNA, 19 nt, Homo sapiens
ggaaggcaucgucauguac

SEQ ID NO: 600487 - RNA, 19 nt, Homo sapiens
ggaguucggccugcaguuc

SEQ ID NO: 600488 - RNA, 19 nt, Homo sapiens
gcacgucuuccucguagag

SEQ ID NO: 600489 - RNA, 19 nt, Homo sapiens
gauccaguauucgagucaa

SEQ ID NO: 600490 - RNA, 19 nt, Homo sapiens
caugagaggccuucuuugc

SEQ ID NO: 600491 - RNA, 19 nt, Homo sapiens
ccacguggaccuuguucug

SEQ ID NO: 600492 - RNA, 19 nt, Homo sapiens
uuggauuucuuguuugugu

SEQ ID NO: 600493 - RNA, 19 nt, Homo sapiens
caagagcgugcguccacaa

SEQ ID NO: 600494 - RNA, 19 nt, Homo sapiens
ggaacgcggcaccaugaca

SEQ ID NO: 600495 - RNA, 19 nt, Homo sapiens
ggauuucuuguuuguguuc

SEQ ID NO: 600496 - RNA, 19 nt, Homo sapiens
gagagggccaugacuugca

SEQ ID NO: 600497 - RNA, 19 nt, Homo sapiens
ggaacugcacguguccuau

SEQ ID NO: 600498 - RNA, 19 nt, Homo sapiens
cgugcgcccuuucgaguuc

SEQ ID NO: 600499 - RNA, 19 nt, Homo sapiens
ggaucugguguucgugauu

SEQ ID NO: 600500 - RNA, 19 nt, Homo sapiens
ccagauuguggacuuccua

SEQ ID NO: 600501 - RNA, 19 nt, Homo sapiens
ggccguggaguacauggaa

SEQ ID NO: 600502 - RNA, 19 nt, Homo sapiens
auuguggacuuccuagaug

SEQ ID NO: 600503 - RNA, 19 nt, Homo sapiens
ugucagcaugaguguguua

SEQ ID NO: 600504 - RNA, 19 nt, Homo sapiens
gcgaaagccucguggaguu

SEQ ID NO: 600505 - RNA, 19 nt, Homo sapiens
gugcugcgcucaguucuuu

SEQ ID NO: 600506 - RNA, 19 nt, Homo sapiens
ugacgcaccugcuggagaa

SEQ ID NO: 600507 - RNA, 19 nt, Homo sapiens
ucaguucuuuguuggauuu

SEQ ID NO: 600508 - RNA, 19 nt, Homo sapiens
gaucugguguucgugauug

SEQ ID NO: 600509 - RNA, 19 nt, Homo sapiens
gaacugcacguguccuaug

SEQ ID NO: 600510 - RNA, 19 nt, Homo sapiens
gcugugaguuccagugugu

SEQ ID NO: 600511 - RNA, 19 nt, Homo sapiens
ggaggaaggcaucgucaug

SEQ ID NO: 600512 - RNA, 19 nt, Homo sapiens
gaaccagauuguggacuuc

SEQ ID NO: 600513 - RNA, 19 nt, Homo sapiens
gccaugagaggccuucuuu

SEQ ID NO: 600514 - RNA, 19 nt, Homo sapiens
ugaaccagauuguggacuu

SEQ ID NO: 600515 - RNA, 19 nt, Homo sapiens
aggaaggcaucgucaugua

SEQ ID NO: 600516 - RNA, 19 nt, Homo sapiens
ggaaacccagcuccaguug

SEQ ID NO: 600517 - RNA, 19 nt, Homo sapiens
gcaauccaguacgccauga

SEQ ID NO: 600518 - RNA, 19 nt, Homo sapiens
gcguuggcgugauccagua

SEQ ID NO: 600519 - RNA, 19 nt, Homo sapiens
gcucaguucuuuguuggau

SEQ ID NO: 600520 - RNA, 19 nt, Homo sapiens
gaaacccagcuccaguuga

SEQ ID NO: 600521 - RNA, 19 nt, Homo sapiens
gggaaacccagcuccaguu

SEQ ID NO: 600522 - RNA, 19 nt, Homo sapiens
uggaggaucuggagaacca

SEQ ID NO: 600523 - RNA, 19 nt, Homo sapiens
aaacccagcuccaguugac

SEQ ID NO: 600524 - RNA, 19 nt, Homo sapiens
gaggaaggcaucgucaugu

SEQ ID NO: 600525 - RNA, 19 nt, Homo sapiens
ggaccauggcugugaguuc

SEQ ID NO: 600526 - RNA, 19 nt, Homo sapiens
agaaccagcuggccaacca

SEQ ID NO: 600527 - RNA, 19 nt, Homo sapiens
gauuguggacuuccuagau

SEQ ID NO: 600528 - RNA, 19 nt, Homo sapiens
ggaccuuguucugcugguu

SEQ ID NO: 600529 - RNA, 19 nt, Homo sapiens
ugacgggacuggcaaucca

SEQ ID NO: 600530 - RNA, 19 nt, Homo sapiens
guucuuuguuggauuucuu

SEQ ID NO: 600531 - RNA, 19 nt, Homo sapiens
ucgagagccugacgcugaa

SEQ ID NO: 600532 - RNA, 19 nt, Homo sapiens
ggaaggcaucgucauguac

SEQ ID NO: 600533 - RNA, 19 nt, Homo sapiens
ggaguucggccugcaguuc

SEQ ID NO: 600534 - RNA, 19 nt, Homo sapiens
gcacgucuuccucguagag

SEQ ID NO: 600535 - RNA, 19 nt, Homo sapiens
gauccaguauucgagucaa

SEQ ID NO: 600536 - RNA, 19 nt, Homo sapiens
ccacguggaccuuguucug

SEQ ID NO: 600537 - RNA, 19 nt, Homo sapiens
caugagaggccuucuuugc

SEQ ID NO: 600538 - RNA, 19 nt, Homo sapiens
uuggauuucuuguuugugu

SEQ ID NO: 600539 - RNA, 19 nt, Homo sapiens
caagagcgugcguccacaa

SEQ ID NO: 600540 - RNA, 19 nt, Homo sapiens
ggaacgcggcaccaugaca

SEQ ID NO: 600541 - RNA, 19 nt, Homo sapiens
ggauuucuuguuuguguuc

SEQ ID NO: 600542 - RNA, 19 nt, Homo sapiens
cgugcgcccuuucgaguuc

SEQ ID NO: 600543 - RNA, 19 nt, Homo sapiens
ggaacugcacguguccuau

SEQ ID NO: 600544 - RNA, 19 nt, Homo sapiens
ggaucugguguucgugauu

SEQ ID NO: 600545 - RNA, 19 nt, Homo sapiens
ccagauuguggacuuccua

SEQ ID NO: 600546 - RNA, 19 nt, Homo sapiens
ggccguggaguacauggaa

SEQ ID NO: 600547 - RNA, 19 nt, Homo sapiens
auuguggacuuccuagaug

SEQ ID NO: 600548 - RNA, 19 nt, Homo sapiens
caaacgcguuccagaauuu

SEQ ID NO: 600549 - RNA, 19 nt, Homo sapiens
caagguuccugaagucuga

SEQ ID NO: 600550 - RNA, 19 nt, Homo sapiens
ccaaacgcguuccagaauu

SEQ ID NO: 600551 - RNA, 19 nt, Homo sapiens
ggacccugguggauuauga

SEQ ID NO: 600552 - RNA, 19 nt, Homo sapiens
gaagaggacccaagagagu

SEQ ID NO: 600553 - RNA, 19 nt, Homo sapiens
gaccaagagugcagauuuc

SEQ ID NO: 600554 - RNA, 19 nt, Homo sapiens
guaaaucagccagcgaaua

SEQ ID NO: 600555 - RNA, 19 nt, Homo sapiens
ccaucuaccuggccaagaa

SEQ ID NO: 600556 - RNA, 19 nt, Homo sapiens
gugaggagcuucgauaugg

SEQ ID NO: 600557 - RNA, 19 nt, Homo sapiens
ccacacacccgucacaaga

SEQ ID NO: 600558 - RNA, 19 nt, Homo sapiens
ccaagaagaacauccgaaa

SEQ ID NO: 600559 - RNA, 19 nt, Homo sapiens
cugcagagcuggacuaugc

SEQ ID NO: 600560 - RNA, 19 nt, Homo sapiens
gacgaggcccgauuccaua

SEQ ID NO: 600561 - RNA, 19 nt, Homo sapiens
acgcccagcugcacauaua

SEQ ID NO: 600562 - RNA, 19 nt, Homo sapiens
uaaaucagccagcgaauac

SEQ ID NO: 600563 - RNA, 19 nt, Homo sapiens
agacgcguguucccguuua

SEQ ID NO: 600564 - RNA, 19 nt, Homo sapiens
ggaucccgcuggagaugaa

SEQ ID NO: 600565 - RNA, 19 nt, Homo sapiens
ugaccaagagugcagauuu

SEQ ID NO: 600566 - RNA, 19 nt, Homo sapiens
gauccucccugcccaaguc

SEQ ID NO: 600567 - RNA, 19 nt, Homo sapiens
gaucgaguacuucaggaaa

SEQ ID NO: 600568 - RNA, 19 nt, Homo sapiens
gagugcagauuuccauaag

SEQ ID NO: 600569 - RNA, 19 nt, Homo sapiens
ccauagggcuggcucacau

SEQ ID NO: 600570 - RNA, 19 nt, Homo sapiens
auagacaacucugacauug

SEQ ID NO: 600571 - RNA, 19 nt, Homo sapiens
acagggagcuccaccuucu

SEQ ID NO: 600572 - RNA, 19 nt, Homo sapiens
caugugaggagcuucgaua

SEQ ID NO: 600573 - RNA, 19 nt, Homo sapiens
agguacagcuggcuccuuu

SEQ ID NO: 600574 - RNA, 19 nt, Homo sapiens
ccugaagucugacauguac

SEQ ID NO: 600575 - RNA, 19 nt, Homo sapiens
cgaauacccggaagcaaga

SEQ ID NO: 600576 - RNA, 19 nt, Homo sapiens
gcuaugaccggcuacacaa

SEQ ID NO: 600577 - RNA, 19 nt, Homo sapiens
gcguccagcacacaaauaa

SEQ ID NO: 600578 - RNA, 19 nt, Homo sapiens
gccaaacgcguuccagaau

SEQ ID NO: 600579 - RNA, 19 nt, Homo sapiens
gggacaggcuggucauugc

SEQ ID NO: 600580 - RNA, 19 nt, Homo sapiens
ggaggcaugugaggagcuu

SEQ ID NO: 600581 - RNA, 19 nt, Homo sapiens
caugggaccuggugcugau

SEQ ID NO: 600582 - RNA, 19 nt, Homo sapiens
uauagacaacucugacauu

SEQ ID NO: 600583 - RNA, 19 nt, Homo sapiens
gagcuggacuaugccaucu

SEQ ID NO: 600584 - RNA, 19 nt, Homo sapiens
gcuggacuaugccaucuac

SEQ ID NO: 600585 - RNA, 19 nt, Homo sapiens
gagaugggguggccuagug

SEQ ID NO: 600586 - RNA, 19 nt, Homo sapiens
gccgugugcucaugaccaa

SEQ ID NO: 600587 - RNA, 19 nt, Homo sapiens
ccacagggagcuccaccuu

SEQ ID NO: 600588 - RNA, 19 nt, Homo sapiens
gaugaagagacgcguguuc

SEQ ID NO: 600589 - RNA, 19 nt, Homo sapiens
ccaccgcuauguccuggau

SEQ ID NO: 600590 - RNA, 19 nt, Homo sapiens
caagagugcagauuuccau

SEQ ID NO: 600591 - RNA, 19 nt, Homo sapiens
ccacugacgaggcccgauu

SEQ ID NO: 600592 - RNA, 19 nt, Homo sapiens
gccaggagcagaccuacug

SEQ ID NO: 600593 - RNA, 19 nt, Homo sapiens
ccugguggauuaugagaag

SEQ ID NO: 600594 - RNA, 19 nt, Homo sapiens
uggaagaggacccaagaga

SEQ ID NO: 600595 - RNA, 19 nt, Homo sapiens
uacccaagguuccugaagu

SEQ ID NO: 600596 - RNA, 19 nt, Homo sapiens
cagacugggugaagguaca

SEQ ID NO: 600597 - RNA, 19 nt, Homo sapiens
ugacgaggcccgauuccau

SEQ ID NO: 600598 - RNA, 19 nt, Homo sapiens
ugaagucugacauguacaa

SEQ ID NO: 600599 - RNA, 19 nt, Homo sapiens
agagugcagauuuccauaa

SEQ ID NO: 600600 - RNA, 19 nt, Homo sapiens
gcagagccuguuaccugaa

SEQ ID NO: 600601 - RNA, 19 nt, Homo sapiens
ucuagucccugcagcucaa

SEQ ID NO: 600602 - RNA, 19 nt, Homo sapiens
ugaggagcuucgauaugga

SEQ ID NO: 600603 - RNA, 19 nt, Homo sapiens
caacagcguccagcacaca

SEQ ID NO: 600604 - RNA, 19 nt, Homo sapiens
gagacgcguguucccguuu

SEQ ID NO: 600605 - RNA, 19 nt, Homo sapiens
ccuacuggcuggugaacag

SEQ ID NO: 600606 - RNA, 19 nt, Homo sapiens
uaguggaccuggcccaucu

SEQ ID NO: 600607 - RNA, 19 nt, Homo sapiens
ccuacugggucaugaaugc

SEQ ID NO: 600608 - RNA, 19 nt, Homo sapiens
cagagccuguuaccugaag

SEQ ID NO: 600609 - RNA, 19 nt, Homo sapiens
cgccaaacgcguuccagaa

SEQ ID NO: 600610 - RNA, 19 nt, Homo sapiens
gcgacgucgugcagugguu

SEQ ID NO: 600611 - RNA, 19 nt, Homo sapiens
ggaguucaguggagaaaac

SEQ ID NO: 600612 - RNA, 19 nt, Homo sapiens
ggugcagcauggcuacauc

SEQ ID NO: 600613 - RNA, 19 nt, Homo sapiens
agcgggagaucgaguacuu

SEQ ID NO: 600614 - RNA, 19 nt, Homo sapiens
ucaacguccugcgugaaug

SEQ ID NO: 600615 - RNA, 19 nt, Homo sapiens
gggcccacuucauggacuu

SEQ ID NO: 600616 - RNA, 19 nt, Homo sapiens
gcaggacccgagugaaguc

SEQ ID NO: 600617 - RNA, 19 nt, Homo sapiens
acgagacgcccuacagguu

SEQ ID NO: 600618 - RNA, 19 nt, Homo sapiens
gauuuauagacaacucuga

SEQ ID NO: 600619 - RNA, 19 nt, Homo sapiens
caccuucucuggucuucag

SEQ ID NO: 600620 - RNA, 19 nt, Homo sapiens
uaugaccggcuacacaaga

SEQ ID NO: 600621 - RNA, 19 nt, Homo sapiens
ccugguggaugccguguac

SEQ ID NO: 600622 - RNA, 19 nt, Homo sapiens
gaccggcuacacaagaaga

SEQ ID NO: 600623 - RNA, 19 nt, Homo sapiens
ggacuuaaaugccaaauug

SEQ ID NO: 600624 - RNA, 19 nt, Homo sapiens
gagcaaaguuacaguggua

SEQ ID NO: 600625 - RNA, 19 nt, Homo sapiens
ggagaaauccuaucuuuua

SEQ ID NO: 600626 - RNA, 19 nt, Homo sapiens
ugacaccaguuucaaauuu

SEQ ID NO: 600627 - RNA, 19 nt, Homo sapiens
gacaccaguuucaaauuua

SEQ ID NO: 600628 - RNA, 19 nt, Homo sapiens
agaaugcucuggcugguua

SEQ ID NO: 600629 - RNA, 19 nt, Homo sapiens
gcauuugggugacauuuga

SEQ ID NO: 600630 - RNA, 19 nt, Homo sapiens
uaauugaucuuggccuuua

SEQ ID NO: 600631 - RNA, 19 nt, Homo sapiens
ggagaucaguccaaaguca

SEQ ID NO: 600632 - RNA, 19 nt, Homo sapiens
caaaaucucuugcuuggua

SEQ ID NO: 600633 - RNA, 19 nt, Homo sapiens
uaccaugccuggcuaauuu

SEQ ID NO: 600634 - RNA, 19 nt, Homo sapiens
ggacacacuugcucgagaa

SEQ ID NO: 600635 - RNA, 19 nt, Homo sapiens
gcgaggaucugaaguaugg

SEQ ID NO: 600636 - RNA, 19 nt, Homo sapiens
gaaauacagugagcaguuc

SEQ ID NO: 600637 - RNA, 19 nt, Homo sapiens
ugggagggauugugaaaua

SEQ ID NO: 600638 - RNA, 19 nt, Homo sapiens
caagagaguagcaaacuuu

SEQ ID NO: 600639 - RNA, 19 nt, Homo sapiens
gcacaaacccacauuuaca

SEQ ID NO: 600640 - RNA, 19 nt, Homo sapiens
ggagaaagcagaggagauu

SEQ ID NO: 600641 - RNA, 19 nt, Homo sapiens
cgacagagcuuccaguacu

SEQ ID NO: 600642 - RNA, 19 nt, Homo sapiens
gcacuaugcuaaacugaca

SEQ ID NO: 600643 - RNA, 19 nt, Homo sapiens
gggagagccuguaaggaaa

SEQ ID NO: 600644 - RNA, 19 nt, Homo sapiens
gacuuucccugcugccuua

SEQ ID NO: 600645 - RNA, 19 nt, Homo sapiens
gaucauguauuaccaacag

SEQ ID NO: 600646 - RNA, 19 nt, Homo sapiens
gcgaggcgcuggaucaaca

SEQ ID NO: 600647 - RNA, 19 nt, Homo sapiens
aaacgcauguggaccagaa

SEQ ID NO: 600648 - RNA, 19 nt, Homo sapiens
agaaagcagaggagauuua

SEQ ID NO: 600649 - RNA, 19 nt, Homo sapiens
ggaaaucccaaccaagaug

SEQ ID NO: 600650 - RNA, 19 nt, Homo sapiens
gguagauuguggcaaagaa

SEQ ID NO: 600651 - RNA, 19 nt, Homo sapiens
ccgcacaaacccacauuua

SEQ ID NO: 600652 - RNA, 19 nt, Homo sapiens
cagaggagauuuacaagcu

SEQ ID NO: 600653 - RNA, 19 nt, Homo sapiens
gaauagaguggaggcagua

SEQ ID NO: 600654 - RNA, 19 nt, Homo sapiens
ccaaagugcugggauuaca

SEQ ID NO: 600655 - RNA, 19 nt, Homo sapiens
ccaagagaguagcaaacuu

SEQ ID NO: 600656 - RNA, 19 nt, Homo sapiens
caccucagccucccaagua

SEQ ID NO: 600657 - RNA, 19 nt, Homo sapiens
caguagacauggagaaauc

SEQ ID NO: 600658 - RNA, 19 nt, Homo sapiens
uugaugagguccacaguga

SEQ ID NO: 600659 - RNA, 19 nt, Homo sapiens
gcuauugacccucaggaaa

SEQ ID NO: 600660 - RNA, 19 nt, Homo sapiens
ugaaauacagugagcaguu

SEQ ID NO: 600661 - RNA, 19 nt, Homo sapiens
auggagaaauccuaucuuu

SEQ ID NO: 600662 - RNA, 19 nt, Homo sapiens
guggaaaucccaaccaaga

SEQ ID NO: 600663 - RNA, 19 nt, Homo sapiens
gagcgggaccugcuugaug

SEQ ID NO: 600664 - RNA, 19 nt, Homo sapiens
gagaagcagccaacacugu

SEQ ID NO: 600665 - RNA, 19 nt, Homo sapiens
ugacagaugccaugguaug

SEQ ID NO: 600666 - RNA, 19 nt, Homo sapiens
gacagagcuuccaguacuu

SEQ ID NO: 600667 - RNA, 19 nt, Homo sapiens
caacuucagcgaauugauc

SEQ ID NO: 600668 - RNA, 19 nt, Homo sapiens
ugggagagccuguaaggaa

SEQ ID NO: 600669 - RNA, 19 nt, Homo sapiens
gcagcugccacgauugaaa

SEQ ID NO: 600670 - RNA, 19 nt, Homo sapiens
aaucuccgaucuauaagga

SEQ ID NO: 600671 - RNA, 19 nt, Homo sapiens
gaucaacauagauggcaaa

SEQ ID NO: 600672 - RNA, 19 nt, Homo sapiens
gaaagcagaggagauuuac

SEQ ID NO: 600673 - RNA, 19 nt, Homo sapiens
gaaacaaacagucguugcu

SEQ ID NO: 600674 - RNA, 19 nt, Homo sapiens
caacauagauggcaaaacc

SEQ ID NO: 600675 - RNA, 19 nt, Homo sapiens
aagcagaggagauuuacaa

SEQ ID NO: 600676 - RNA, 19 nt, Homo sapiens
cgaugggccuucaacuuca

SEQ ID NO: 600677 - RNA, 19 nt, Homo sapiens
auagguguuugaacuguaa

SEQ ID NO: 600678 - RNA, 19 nt, Homo sapiens
ggugacauuugaagauugg

SEQ ID NO: 600679 - RNA, 19 nt, Homo sapiens
ucaggaaacaaccaagaaa

SEQ ID NO: 600680 - RNA, 19 nt, Homo sapiens
gacaucugccuaacgguuu

SEQ ID NO: 600681 - RNA, 19 nt, Homo sapiens
gggugacauuugaagauug

SEQ ID NO: 600682 - RNA, 19 nt, Homo sapiens
gcaguucucauccaacgau

SEQ ID NO: 600683 - RNA, 19 nt, Homo sapiens
ccaacuccuucuccucuuc

SEQ ID NO: 600684 - RNA, 19 nt, Homo sapiens
cgagaaccaaagugcauuu

SEQ ID NO: 600685 - RNA, 19 nt, Homo sapiens
gagagccuguaaggaaaga

SEQ ID NO: 600686 - RNA, 19 nt, Homo sapiens
gcauggcucuguccuucag

SEQ ID NO: 600687 - RNA, 19 nt, Homo sapiens
gagaaagcagaggagauuu

SEQ ID NO: 600688 - RNA, 19 nt, Homo sapiens
aauagguguuugaacugua

SEQ ID NO: 600689 - RNA, 19 nt, Homo sapiens
aaauagguguuugaacugu

SEQ ID NO: 600690 - RNA, 19 nt, Homo sapiens
ucucuugcuugguauuuau

SEQ ID NO: 600691 - RNA, 19 nt, Homo sapiens
caucgggcuuggagcagaa

SEQ ID NO: 600692 - RNA, 19 nt, Homo sapiens
uucuuaugcucgcuauuua

SEQ ID NO: 600693 - RNA, 19 nt, Homo sapiens
gagaucaguccaaagucaa

SEQ ID NO: 600694 - RNA, 19 nt, Homo sapiens
uccaguacuuccucaagaa

SEQ ID NO: 600695 - RNA, 19 nt, Homo sapiens
ugggugacauuugaagauu

SEQ ID NO: 600696 - RNA, 19 nt, Homo sapiens
ggauucuuaugcucgcuau

SEQ ID NO: 600697 - RNA, 19 nt, Homo sapiens
ggcgcuggaucaacauaga

SEQ ID NO: 600698 - RNA, 19 nt, Homo sapiens
ggagggauugugaaauaca

SEQ ID NO: 600699 - RNA, 19 nt, Homo sapiens
gcaguagacauggagaaau

SEQ ID NO: 600700 - RNA, 19 nt, Homo sapiens
ccaguacuuccucaagaaa

SEQ ID NO: 600701 - RNA, 19 nt, Homo sapiens
gaugagguccacagugaag

SEQ ID NO: 600702 - RNA, 19 nt, Homo sapiens
aguccaaagucaaggagaa

SEQ ID NO: 600703 - RNA, 19 nt, Homo sapiens
acaccaguuucaaauuuag

SEQ ID NO: 600704 - RNA, 19 nt, Homo sapiens
ccaaaggucgacagagcuu

SEQ ID NO: 600705 - RNA, 19 nt, Homo sapiens
gggcagaagaaacgcaugu

SEQ ID NO: 600706 - RNA, 19 nt, Homo sapiens
gaaauccaagagaguagca

SEQ ID NO: 600707 - RNA, 19 nt, Homo sapiens
ggacaugcaggccaaagcu

SEQ ID NO: 600708 - RNA, 19 nt, Homo sapiens
aguacuuccucaagaaaga

SEQ ID NO: 600709 - RNA, 19 nt, Homo sapiens
gaacgaugggccuucaacu

SEQ ID NO: 600710 - RNA, 19 nt, Homo sapiens
gagggauugugaaauacag

SEQ ID NO: 600711 - RNA, 19 nt, Homo sapiens
ggaagccaaggcccgagaa

SEQ ID NO: 600712 - RNA, 19 nt, Homo sapiens
cuuaugcucgcuauuuaaa

SEQ ID NO: 600713 - RNA, 19 nt, Homo sapiens
gccuucaacuucagcgaau

SEQ ID NO: 600714 - RNA, 19 nt, Homo sapiens
ggauugugaaauacaguga

SEQ ID NO: 600715 - RNA, 19 nt, Homo sapiens
gggagggauugugaaauac

SEQ ID NO: 600716 - RNA, 19 nt, Homo sapiens
ucuguaggcacuaugcuaa

SEQ ID NO: 600717 - RNA, 19 nt, Homo sapiens
agacauggagaaauccuau

SEQ ID NO: 600718 - RNA, 19 nt, Homo sapiens
ggcaguagacauggagaaa

SEQ ID NO: 600719 - RNA, 19 nt, Homo sapiens
gacaugcaggccaaagcua

SEQ ID NO: 600720 - RNA, 19 nt, Homo sapiens
cugcgaggaucugaaguau

SEQ ID NO: 600721 - RNA, 19 nt, Homo sapiens
ccugcgaggaucugaagua

SEQ ID NO: 600722 - RNA, 19 nt, Homo sapiens
uuucaugacaucugccuaa

SEQ ID NO: 600723 - RNA, 19 nt, Homo sapiens
ugaaagagcucaacaagaa

SEQ ID NO: 600724 - RNA, 19 nt, Homo sapiens
ggaaaggacugccagaaaa

SEQ ID NO: 600725 - RNA, 19 nt, Homo sapiens
gcaccugcguggaugauga

SEQ ID NO: 600726 - RNA, 19 nt, Homo sapiens
acgcuacgcuuacauauau

SEQ ID NO: 600727 - RNA, 19 nt, Homo sapiens
gggaaaggacugccagaaa

SEQ ID NO: 600728 - RNA, 19 nt, Homo sapiens
gaaagagcucaacaagaaa

SEQ ID NO: 600729 - RNA, 19 nt, Homo sapiens
ggucucaccugugucaaga

SEQ ID NO: 600730 - RNA, 19 nt, Homo sapiens
gaacgcuacgcuuacauau

SEQ ID NO: 600731 - RNA, 19 nt, Homo sapiens
ggaccuggccgucaacauc

SEQ ID NO: 600732 - RNA, 19 nt, Homo sapiens
gguaucgucuuccucaaca

SEQ ID NO: 600733 - RNA, 19 nt, Homo sapiens
cuuaaugcaugauacagaa

SEQ ID NO: 600734 - RNA, 19 nt, Homo sapiens
gguguucgcuaucucuugu

SEQ ID NO: 600735 - RNA, 19 nt, Homo sapiens
agaaccugcugcuucagua

SEQ ID NO: 600736 - RNA, 19 nt, Homo sapiens
ggucuguccuaaucuuugu

SEQ ID NO: 600737 - RNA, 19 nt, Homo sapiens
ugaacgcuacgcuuacaua

SEQ ID NO: 600738 - RNA, 19 nt, Homo sapiens
cgcuaucucuugugucaaa

SEQ ID NO: 600739 - RNA, 19 nt, Homo sapiens
gaagaagaaccugcugcuu

SEQ ID NO: 600740 - RNA, 19 nt, Homo sapiens
ggugaacgcuacgcuuaca

SEQ ID NO: 600741 - RNA, 19 nt, Homo sapiens
gcgaggaugacaauguuug

SEQ ID NO: 600742 - RNA, 19 nt, Homo sapiens
cugcgaggaugacaauguu

SEQ ID NO: 600743 - RNA, 19 nt, Homo sapiens
uauacgcggucuguccuaa

SEQ ID NO: 600744 - RNA, 19 nt, Homo sapiens
ccucuagauucuuggaguu

SEQ ID NO: 600745 - RNA, 19 nt, Homo sapiens
caugaaagagcucaacaag

SEQ ID NO: 600746 - RNA, 19 nt, Homo sapiens
gugacaaacgcaaugcaaa

SEQ ID NO: 600747 - RNA, 19 nt, Homo sapiens
ucuuugugcugcuguguga

SEQ ID NO: 600748 - RNA, 19 nt, Homo sapiens
gaagguguccaugaaagag

SEQ ID NO: 600749 - RNA, 19 nt, Homo sapiens
ucacggacucuguggagaa

SEQ ID NO: 600750 - RNA, 19 nt, Homo sapiens
cuggugaacgcuacgcuua

SEQ ID NO: 600751 - RNA, 19 nt, Homo sapiens
gaccuggccgucaacauca

SEQ ID NO: 600752 - RNA, 19 nt, Homo sapiens
ugaagguguccaugaaaga

SEQ ID NO: 600753 - RNA, 19 nt, Homo sapiens
ccuaaucuuugugguguuc

SEQ ID NO: 600754 - RNA, 19 nt, Homo sapiens
gcuacgcuuacauauauug

SEQ ID NO: 600755 - RNA, 19 nt, Homo sapiens
uguccaaccugcgcuacaa

SEQ ID NO: 600756 - RNA, 19 nt, Homo sapiens
cugaagguguccaugaaag

SEQ ID NO: 600757 - RNA, 19 nt, Homo sapiens
gcacuguggguaucgucuu

SEQ ID NO: 600758 - RNA, 19 nt, Homo sapiens
ccaugaaagagcucaacaa

SEQ ID NO: 600759 - RNA, 19 nt, Homo sapiens
cucuuucucucucuuaaug

SEQ ID NO: 600760 - RNA, 19 nt, Homo sapiens
acgcuuacauauauugucu

SEQ ID NO: 600761 - RNA, 19 nt, Homo sapiens
uccugaagguguccaugaa

SEQ ID NO: 600762 - RNA, 19 nt, Homo sapiens
ugacaaacgcaaugcaaaa

SEQ ID NO: 600763 - RNA, 19 nt, Homo sapiens
uaucucuugugucaaaucu

SEQ ID NO: 600764 - RNA, 19 nt, Homo sapiens
gaaccugcugcuucaguac

SEQ ID NO: 600765 - RNA, 19 nt, Homo sapiens
ggaaauacguggucugcuu

SEQ ID NO: 600766 - RNA, 19 nt, Homo sapiens
aaacagagaugguagcuau

SEQ ID NO: 600767 - RNA, 19 nt, Homo sapiens
gcaggcagcuagcgaguuu

SEQ ID NO: 600768 - RNA, 19 nt, Homo sapiens
cagaggaugugcaggaaua

SEQ ID NO: 600769 - RNA, 19 nt, Homo sapiens
gacccuaaaugaacgauaa

SEQ ID NO: 600770 - RNA, 19 nt, Homo sapiens
gagaugaggugaagaaacu

SEQ ID NO: 600771 - RNA, 19 nt, Homo sapiens
gugaaggacuagaaauaaa

SEQ ID NO: 600772 - RNA, 19 nt, Homo sapiens
gaaauacguggucugcuuu

SEQ ID NO: 600773 - RNA, 19 nt, Homo sapiens
cacaugcccucuucuguuu

SEQ ID NO: 600774 - RNA, 19 nt, Homo sapiens
ccaauucccuggugaucaa

SEQ ID NO: 600775 - RNA, 19 nt, Homo sapiens
gaagaaacuggaugugcua

SEQ ID NO: 600776 - RNA, 19 nt, Homo sapiens
gcgauucuauggucaaugu

SEQ ID NO: 600777 - RNA, 19 nt, Homo sapiens
guccaauccuccuauagua

SEQ ID NO: 600778 - RNA, 19 nt, Homo sapiens
gaaaaggauuugaagcauu

SEQ ID NO: 600779 - RNA, 19 nt, Homo sapiens
aggaauaucucaccugugu

SEQ ID NO: 600780 - RNA, 19 nt, Homo sapiens
gaaccaucuuugccaucua

SEQ ID NO: 600781 - RNA, 19 nt, Homo sapiens
gaauaaggacgccaucauc

SEQ ID NO: 600782 - RNA, 19 nt, Homo sapiens
guaaauccacuuaaucaca

SEQ ID NO: 600783 - RNA, 19 nt, Homo sapiens
gaggaugagccuucugaaa

SEQ ID NO: 600784 - RNA, 19 nt, Homo sapiens
ggaaucgcaggaagcguua

SEQ ID NO: 600785 - RNA, 19 nt, Homo sapiens
gagaugguagcuaugagua

SEQ ID NO: 600786 - RNA, 19 nt, Homo sapiens
gaagagcaacaacaaacug

SEQ ID NO: 600787 - RNA, 19 nt, Homo sapiens
ccacaugcccucuucuguu

SEQ ID NO: 600788 - RNA, 19 nt, Homo sapiens
ggaaccaucuuugccaucu

SEQ ID NO: 600789 - RNA, 19 nt, Homo sapiens
gcaaucccguggccuacau

SEQ ID NO: 600790 - RNA, 19 nt, Homo sapiens
ggauggcagugcucccuau

SEQ ID NO: 600791 - RNA, 19 nt, Homo sapiens
ugagggcuaugccaaguau

SEQ ID NO: 600792 - RNA, 19 nt, Homo sapiens
gaagaaaggaaagauuuac

SEQ ID NO: 600793 - RNA, 19 nt, Homo sapiens
gaauuuguccugguggaaa

SEQ ID NO: 600794 - RNA, 19 nt, Homo sapiens
gcaguguggccgcaauauu

SEQ ID NO: 600795 - RNA, 19 nt, Homo sapiens
aaugaacgauaaacagaga

SEQ ID NO: 600796 - RNA, 19 nt, Homo sapiens
ggccaccacugaauaugug

SEQ ID NO: 600797 - RNA, 19 nt, Homo sapiens
caguguggccgcaauauug

SEQ ID NO: 600798 - RNA, 19 nt, Homo sapiens
caaaagguaaauccacuua

SEQ ID NO: 600799 - RNA, 19 nt, Homo sapiens
ucuaaggacccuaaaugaa

SEQ ID NO: 600800 - RNA, 19 nt, Homo sapiens
ugacccggcucuuggugaa

SEQ ID NO: 600801 - RNA, 19 nt, Homo sapiens
ugugaaggacuagaaauaa

SEQ ID NO: 600802 - RNA, 19 nt, Homo sapiens
gcuccuguaugaaugcaau

SEQ ID NO: 600803 - RNA, 19 nt, Homo sapiens
ccacuuaaucacauacaga

SEQ ID NO: 600804 - RNA, 19 nt, Homo sapiens
gaugucaagauuaagaaga

SEQ ID NO: 600805 - RNA, 19 nt, Homo sapiens
gcaaggcguggaccucuuc

SEQ ID NO: 600806 - RNA, 19 nt, Homo sapiens
ucagaaguaagcaagguuu

SEQ ID NO: 600807 - RNA, 19 nt, Homo sapiens
gguccaauccuccuauagu

SEQ ID NO: 600808 - RNA, 19 nt, Homo sapiens
cuaaggacccuaaaugaac

SEQ ID NO: 600809 - RNA, 19 nt, Homo sapiens
gcaccgcacccuggucuau

SEQ ID NO: 600810 - RNA, 19 nt, Homo sapiens
ccacugaauaugugcagaa

SEQ ID NO: 600811 - RNA, 19 nt, Homo sapiens
caaugugaaggacuagaaa

SEQ ID NO: 600812 - RNA, 19 nt, Homo sapiens
cagaagagcaacaacaaac

SEQ ID NO: 600813 - RNA, 19 nt, Homo sapiens
gacgggagaugaggugaag

SEQ ID NO: 600814 - RNA, 19 nt, Homo sapiens
ucaaugugaaggacuagaa

SEQ ID NO: 600815 - RNA, 19 nt, Homo sapiens
ugucuaaggacccuaaaug

SEQ ID NO: 600816 - RNA, 19 nt, Homo sapiens
aaaaggauuugaagcauuc

SEQ ID NO: 600817 - RNA, 19 nt, Homo sapiens
caucuuugccaucuauaga

SEQ ID NO: 600818 - RNA, 19 nt, Homo sapiens
aaccaucuuugccaucuau

SEQ ID NO: 600819 - RNA, 19 nt, Homo sapiens
gauucuauggucaauguga

SEQ ID NO: 600820 - RNA, 19 nt, Homo sapiens
ggaugagccuucugaaaag

SEQ ID NO: 600821 - RNA, 19 nt, Homo sapiens
acccugacccgcuacguua

SEQ ID NO: 600822 - RNA, 19 nt, Homo sapiens
acagagaugguagcuauga

SEQ ID NO: 600823 - RNA, 19 nt, Homo sapiens
gucuaaggacccuaaauga

SEQ ID NO: 600824 - RNA, 19 nt, Homo sapiens
aaagaaauucccugaggau

SEQ ID NO: 600825 - RNA, 19 nt, Homo sapiens
ucuuugccaucuauagaaa

SEQ ID NO: 600826 - RNA, 19 nt, Homo sapiens
cuuaaucacauacagaaga

SEQ ID NO: 600827 - RNA, 19 nt, Homo sapiens
gcaagcuccggcuccugua

SEQ ID NO: 600828 - RNA, 19 nt, Homo sapiens
agauuuacagccugaauga

SEQ ID NO: 600829 - RNA, 19 nt, Homo sapiens
ggcaaggcguggaccucuu

SEQ ID NO: 600830 - RNA, 19 nt, Homo sapiens
gagaaaaggauuugaagca

SEQ ID NO: 600831 - RNA, 19 nt, Homo sapiens
acagaagagcaacaacaaa

SEQ ID NO: 600832 - RNA, 19 nt, Homo sapiens
uacagaagagcaacaacaa

SEQ ID NO: 600833 - RNA, 19 nt, Homo sapiens
uuaaucacauacagaagag

SEQ ID NO: 600834 - RNA, 19 nt, Homo sapiens
cacugaauaugugcagaaa

SEQ ID NO: 600835 - RNA, 19 nt, Homo sapiens
aauaaggacgccaucauca

SEQ ID NO: 600836 - RNA, 19 nt, Homo sapiens
gagaauaaggacgccauca

SEQ ID NO: 600837 - RNA, 19 nt, Homo sapiens
ugaucaacaugguccaauc

SEQ ID NO: 600838 - RNA, 19 nt, Homo sapiens
ggagaugaggugaagaaac

SEQ ID NO: 600839 - RNA, 19 nt, Homo sapiens
cuaaaugaacgauaaacag

SEQ ID NO: 600840 - RNA, 19 nt, Homo sapiens
ggaagccacaggcgauucu

SEQ ID NO: 600841 - RNA, 19 nt, Homo sapiens
ggacccuaaaugaacgaua

SEQ ID NO: 600842 - RNA, 19 nt, Homo sapiens
caugcccucuucuguuugu

SEQ ID NO: 600843 - RNA, 19 nt, Homo sapiens
ucccguggccuacaucauu

SEQ ID NO: 600844 - RNA, 19 nt, Homo sapiens
guacccagccaaccagaag

SEQ ID NO: 600845 - RNA, 19 nt, Homo sapiens
cgggagaugaggugaagaa

SEQ ID NO: 600846 - RNA, 19 nt, Homo sapiens
gcguggaccucuucaugcu

SEQ ID NO: 600847 - RNA, 19 nt, Homo sapiens
uugaagcauuccagccaaa

SEQ ID NO: 600848 - RNA, 19 nt, Homo sapiens
ccuaaaugaacgauaaaca

SEQ ID NO: 600849 - RNA, 19 nt, Homo sapiens
ccucagaaguaagcaaggu

SEQ ID NO: 600850 - RNA, 19 nt, Homo sapiens
ucucaccugugugcagaaa

SEQ ID NO: 600851 - RNA, 19 nt, Homo sapiens
cccguggccuacaucauug

SEQ ID NO: 600852 - RNA, 19 nt, Homo sapiens
ggucuauggaggaaucuuc

SEQ ID NO: 600853 - RNA, 19 nt, Homo sapiens
cacuuaaucacauacagaa

SEQ ID NO: 600854 - RNA, 19 nt, Homo sapiens
agguaaauccacuuaauca

SEQ ID NO: 600855 - RNA, 19 nt, Homo sapiens
acgauaaacagagauggua

SEQ ID NO: 600856 - RNA, 19 nt, Homo sapiens
uaacgugacgggagaugag

SEQ ID NO: 600857 - RNA, 19 nt, Homo sapiens
ccagguaugugggcuccau

SEQ ID NO: 600858 - RNA, 19 nt, Homo sapiens
gacccgcuacguuauggaa

SEQ ID NO: 600859 - RNA, 19 nt, Homo sapiens
uggucaaugugaaggacua

SEQ ID NO: 600860 - RNA, 19 nt, Homo sapiens
gaagccacaggcgauucua

SEQ ID NO: 600861 - RNA, 19 nt, Homo sapiens
auacagaagagcaacaaca

SEQ ID NO: 600862 - RNA, 19 nt, Homo sapiens
ccuggucuauggaggaauc

SEQ ID NO: 600863 - RNA, 19 nt, Homo sapiens
agggcuaugccaaguauuu

SEQ ID NO: 600864 - RNA, 19 nt, Homo sapiens
ggacauaguugcaauaaca

SEQ ID NO: 600865 - RNA, 19 nt, Homo sapiens
gaaaugaggcagagaauau

SEQ ID NO: 600866 - RNA, 19 nt, Homo sapiens
ggagauaaauggaauucuu

SEQ ID NO: 600867 - RNA, 19 nt, Homo sapiens
ggggaaaacugcauuauua

SEQ ID NO: 600868 - RNA, 19 nt, Homo sapiens
gcuagaaucucaaguuaug

SEQ ID NO: 600869 - RNA, 19 nt, Homo sapiens
acaaagaccucugaaauug

SEQ ID NO: 600870 - RNA, 19 nt, Homo sapiens
gaacaaccgaagaauauuu

SEQ ID NO: 600871 - RNA, 19 nt, Homo sapiens
aagcauaccuuuggaauuu

SEQ ID NO: 600872 - RNA, 19 nt, Homo sapiens
cagaggauguuaugucuuu

SEQ ID NO: 600873 - RNA, 19 nt, Homo sapiens
gcacuucucuccucaacug

SEQ ID NO: 600874 - RNA, 19 nt, Homo sapiens
ccucugaaauugaugauaa

SEQ ID NO: 600875 - RNA, 19 nt, Homo sapiens
gcuuaaagaugaauagaug

SEQ ID NO: 600876 - RNA, 19 nt, Homo sapiens
caucacaugucauuaaaga

SEQ ID NO: 600877 - RNA, 19 nt, Homo sapiens
cagaaaagcugaaaagaaa

SEQ ID NO: 600878 - RNA, 19 nt, Homo sapiens
guuauaacaucccuaaaga

SEQ ID NO: 600879 - RNA, 19 nt, Homo sapiens
guucuuacauccuaacaaa

SEQ ID NO: 600880 - RNA, 19 nt, Homo sapiens
aaaggaacaucacuaaaug

SEQ ID NO: 600881 - RNA, 19 nt, Homo sapiens
ccagugaaguucuaaguau

SEQ ID NO: 600882 - RNA, 19 nt, Homo sapiens
gaagugguaguaauaauug

SEQ ID NO: 600883 - RNA, 19 nt, Homo sapiens
cauugccgaucuuaaauua

SEQ ID NO: 600884 - RNA, 19 nt, Homo sapiens
ggaguucaauaucacguuu

SEQ ID NO: 600885 - RNA, 19 nt, Homo sapiens
ggaacuugcuuacaaccaa

SEQ ID NO: 600886 - RNA, 19 nt, Homo sapiens
gaguaacauuccagagaua

SEQ ID NO: 600887 - RNA, 19 nt, Homo sapiens
cagagaauauuucaucuuc

SEQ ID NO: 600888 - RNA, 19 nt, Homo sapiens
acacugagcugugaaauag

SEQ ID NO: 600889 - RNA, 19 nt, Homo sapiens
gacuaugucuacacagaua

SEQ ID NO: 600890 - RNA, 19 nt, Homo sapiens
ggaagugguaguaauaauu

SEQ ID NO: 600891 - RNA, 19 nt, Homo sapiens
acacacauaugcacacaaa

SEQ ID NO: 600892 - RNA, 19 nt, Homo sapiens
gaagaaaugcuuaucuaca

SEQ ID NO: 600893 - RNA, 19 nt, Homo sapiens
gcuaagaggcaaacuugua

SEQ ID NO: 600894 - RNA, 19 nt, Homo sapiens
cagaugaacugacuuuagu

SEQ ID NO: 600895 - RNA, 19 nt, Homo sapiens
uaaagaagagucagaguug

SEQ ID NO: 600896 - RNA, 19 nt, Homo sapiens
uaccacacauggaguauuu

SEQ ID NO: 600897 - RNA, 19 nt, Homo sapiens
gcucauccuucuaguuuga

SEQ ID NO: 600898 - RNA, 19 nt, Homo sapiens
aauuaaagcuagccaugua

SEQ ID NO: 600899 - RNA, 19 nt, Homo sapiens
uggcuagaaucucaaguua

SEQ ID NO: 600900 - RNA, 19 nt, Homo sapiens
ugacaaaccuggcuuuacu

SEQ ID NO: 600901 - RNA, 19 nt, Homo sapiens
ucagaguaguguaggaaua

SEQ ID NO: 600902 - RNA, 19 nt, Homo sapiens
gagcuaagaggcaaacuug

SEQ ID NO: 600903 - RNA, 19 nt, Homo sapiens
uaacuagucugugcuacuu

SEQ ID NO: 600904 - RNA, 19 nt, Homo sapiens
gauaauacacaggugauaa

SEQ ID NO: 600905 - RNA, 19 nt, Homo sapiens
guacauugauuuccccuua

SEQ ID NO: 600906 - RNA, 19 nt, Homo sapiens
gaaaagcuauauggagaua

SEQ ID NO: 600907 - RNA, 19 nt, Homo sapiens
ugacauugccgaucuuaaa

SEQ ID NO: 600908 - RNA, 19 nt, Homo sapiens
aaaccuggcuuuacugcuu

SEQ ID NO: 600909 - RNA, 19 nt, Homo sapiens
gugaaaacauugucagaua

SEQ ID NO: 600910 - RNA, 19 nt, Homo sapiens
gacauuacuugcauuaucu

SEQ ID NO: 600911 - RNA, 19 nt, Homo sapiens
gcucaguuguggaguauuc

SEQ ID NO: 600912 - RNA, 19 nt, Homo sapiens
auccauagcugacaaauuc

SEQ ID NO: 600913 - RNA, 19 nt, Homo sapiens
uaccucagauaacaguuua

SEQ ID NO: 600914 - RNA, 19 nt, Homo sapiens
auaaguugcuguccauuga

SEQ ID NO: 600915 - RNA, 19 nt, Homo sapiens
ggagaauucugggacauag

SEQ ID NO: 600916 - RNA, 19 nt, Homo sapiens
aauggaggaucaacacuuu

SEQ ID NO: 600917 - RNA, 19 nt, Homo sapiens
ucaagaagcaggcaggaaa

SEQ ID NO: 600918 - RNA, 19 nt, Homo sapiens
caaggagaagauacaaaua

SEQ ID NO: 600919 - RNA, 19 nt, Homo sapiens
uuacuugcauuaucuccua

SEQ ID NO: 600920 - RNA, 19 nt, Homo sapiens
agacauuacuugcauuauc

SEQ ID NO: 600921 - RNA, 19 nt, Homo sapiens
aaagaccucugaaauugau

SEQ ID NO: 600922 - RNA, 19 nt, Homo sapiens
uacaaagaccucugaaauu

SEQ ID NO: 600923 - RNA, 19 nt, Homo sapiens
aacaggaacuugcuuacaa

SEQ ID NO: 600924 - RNA, 19 nt, Homo sapiens
ggaauacuguagaaauacu

SEQ ID NO: 600925 - RNA, 19 nt, Homo sapiens
uagcucauccuucuaguuu

SEQ ID NO: 600926 - RNA, 19 nt, Homo sapiens
ccaaggagaagauacaaau

SEQ ID NO: 600927 - RNA, 19 nt, Homo sapiens
caaaugcagacaucaagaa

SEQ ID NO: 600928 - RNA, 19 nt, Homo sapiens
gggaagugguaguaauaau

SEQ ID NO: 600929 - RNA, 19 nt, Homo sapiens
caaagaccucugaaauuga

SEQ ID NO: 600930 - RNA, 19 nt, Homo sapiens
gcuauaaguugcuguccau

SEQ ID NO: 600931 - RNA, 19 nt, Homo sapiens
ccaguuuguucuucuuuga

SEQ ID NO: 600932 - RNA, 19 nt, Homo sapiens
caaaacauccuguaucauu

SEQ ID NO: 600933 - RNA, 19 nt, Homo sapiens
ugccaucguuuccuucaua

SEQ ID NO: 600934 - RNA, 19 nt, Homo sapiens
gauguuaugucuuugucau

SEQ ID NO: 600935 - RNA, 19 nt, Homo sapiens
acuagucugugcuacuuua

SEQ ID NO: 600936 - RNA, 19 nt, Homo sapiens
guaggaauacuguagaaau

SEQ ID NO: 600937 - RNA, 19 nt, Homo sapiens
cauacuggauucaagaugu

SEQ ID NO: 600938 - RNA, 19 nt, Homo sapiens
ugaguaacauuccagagau

SEQ ID NO: 600939 - RNA, 19 nt, Homo sapiens
cauaagcccagcauagaaa

SEQ ID NO: 600940 - RNA, 19 nt, Homo sapiens
gaugcuagaauuaaagcua

SEQ ID NO: 600941 - RNA, 19 nt, Homo sapiens
gcccuucaauguuuggaaa

SEQ ID NO: 600942 - RNA, 19 nt, Homo sapiens
gauacaaagaccucugaaa

SEQ ID NO: 600943 - RNA, 19 nt, Homo sapiens
cagugaaguucuaaguauu

SEQ ID NO: 600944 - RNA, 19 nt, Homo sapiens
uggaacaaccgaagaauau

SEQ ID NO: 600945 - RNA, 19 nt, Homo sapiens
guagaaaugaggcagagaa

SEQ ID NO: 600946 - RNA, 19 nt, Homo sapiens
aaacauagagaccuugaau

SEQ ID NO: 600947 - RNA, 19 nt, Homo sapiens
auacaaagaccucugaaau

SEQ ID NO: 600948 - RNA, 19 nt, Homo sapiens
uaacuuacagggaacaaau

SEQ ID NO: 600949 - RNA, 19 nt, Homo sapiens
gcacgcauuuucccaguuu

SEQ ID NO: 600950 - RNA, 19 nt, Homo sapiens
gagaagccacccagcgaaa

SEQ ID NO: 600951 - RNA, 19 nt, Homo sapiens
gcagagaauauuucaucuu

SEQ ID NO: 600952 - RNA, 19 nt, Homo sapiens
agucagaguugguagaaau

SEQ ID NO: 600953 - RNA, 19 nt, Homo sapiens
ccucaacuguaauucuauu

SEQ ID NO: 600954 - RNA, 19 nt, Homo sapiens
ucaauucuuuggagucugu

SEQ ID NO: 600955 - RNA, 19 nt, Homo sapiens
gcuuacaguccauaacuuu

SEQ ID NO: 600956 - RNA, 19 nt, Homo sapiens
aaagucagagcucggcuua

SEQ ID NO: 600957 - RNA, 19 nt, Homo sapiens
gacgauagguaccacacau

SEQ ID NO: 600958 - RNA, 19 nt, Homo sapiens
ggaacaaccgaagaauauu

SEQ ID NO: 600959 - RNA, 19 nt, Homo sapiens
gagcaacuguggaguacac

SEQ ID NO: 600960 - RNA, 19 nt, Homo sapiens
auagagaccuugaauacag

SEQ ID NO: 600961 - RNA, 19 nt, Homo sapiens
gcagaugauauugaacuuu

SEQ ID NO: 600962 - RNA, 19 nt, Homo sapiens
uuugugcccuucaauguuu

SEQ ID NO: 600963 - RNA, 19 nt, Homo sapiens
ccaagacuaaguugagaaa

SEQ ID NO: 600964 - RNA, 19 nt, Homo sapiens
gaaaguacaugucuucuaa

SEQ ID NO: 600965 - RNA, 19 nt, Homo sapiens
ggaaagcacucacagcuaa

SEQ ID NO: 600966 - RNA, 19 nt, Homo sapiens
gaacuaagcucaguaugug

SEQ ID NO: 600967 - RNA, 19 nt, Homo sapiens
ggagauaguugcuaaguug

SEQ ID NO: 600968 - RNA, 19 nt, Homo sapiens
gcagaucgcuccuccaugu

SEQ ID NO: 600969 - RNA, 19 nt, Homo sapiens
ggaaagggcuaaacaugug

SEQ ID NO: 600970 - RNA, 19 nt, Homo sapiens
gcacucagguacuugguaa

SEQ ID NO: 600971 - RNA, 19 nt, Homo sapiens
guacaugucuucuaaaugc

SEQ ID NO: 600972 - RNA, 19 nt, Homo sapiens
ggacggugcuguaacaaau

SEQ ID NO: 600973 - RNA, 19 nt, Homo sapiens
gaaagagaguagaacauca

SEQ ID NO: 600974 - RNA, 19 nt, Homo sapiens
gaaguucaaggaagaauaa

SEQ ID NO: 600975 - RNA, 19 nt, Homo sapiens
gaagacauuuccagaagau

SEQ ID NO: 600976 - RNA, 19 nt, Homo sapiens
gagaagacauuuccagaag

SEQ ID NO: 600977 - RNA, 19 nt, Homo sapiens
gcauaaaguuugugauaca

SEQ ID NO: 600978 - RNA, 19 nt, Homo sapiens
cuacuucucugaugccuuu

SEQ ID NO: 600979 - RNA, 19 nt, Homo sapiens
cagcuuggcauucuucuua

SEQ ID NO: 600980 - RNA, 19 nt, Homo sapiens
aaggaaacccgauuuauuu

SEQ ID NO: 600981 - RNA, 19 nt, Homo sapiens
caaacucgcagcaguaauu

SEQ ID NO: 600982 - RNA, 19 nt, Homo sapiens
cacagaagaugaauacaug

SEQ ID NO: 600983 - RNA, 19 nt, Homo sapiens
aaaggaaacccgauuuauu

SEQ ID NO: 600984 - RNA, 19 nt, Homo sapiens
gaacauguggugggacuuu

SEQ ID NO: 600985 - RNA, 19 nt, Homo sapiens
uuacuugcccgguuuaaua

SEQ ID NO: 600986 - RNA, 19 nt, Homo sapiens
caaaugaaccccauguuua

SEQ ID NO: 600987 - RNA, 19 nt, Homo sapiens
ggaaaguacaugucuucua

SEQ ID NO: 600988 - RNA, 19 nt, Homo sapiens
ggagaagacauuuccagaa

SEQ ID NO: 600989 - RNA, 19 nt, Homo sapiens
ggaaugaagaagauaaaug

SEQ ID NO: 600990 - RNA, 19 nt, Homo sapiens
caaggaagaauaaaguuga

SEQ ID NO: 600991 - RNA, 19 nt, Homo sapiens
gcaguaauuuguggcacua

SEQ ID NO: 600992 - RNA, 19 nt, Homo sapiens
gcaaauccacaccuccuuu

SEQ ID NO: 600993 - RNA, 19 nt, Homo sapiens
ccagugagaagcauuauga

SEQ ID NO: 600994 - RNA, 19 nt, Homo sapiens
ucagacagaugcccacaga

SEQ ID NO: 600995 - RNA, 19 nt, Homo sapiens
gcagguggcuuugcagauc

SEQ ID NO: 600996 - RNA, 19 nt, Homo sapiens
gauaguugcuaaguugcua

SEQ ID NO: 600997 - RNA, 19 nt, Homo sapiens
ggaaguucaaggaagaaua

SEQ ID NO: 600998 - RNA, 19 nt, Homo sapiens
gaaaagauggagaaaauga

SEQ ID NO: 600999 - RNA, 19 nt, Homo sapiens
ggaaagagaguagaacauc

SEQ ID NO: 601000 - RNA, 19 nt, Homo sapiens
gauaugugcuacccagauc

SEQ ID NO: 601001 - RNA, 19 nt, Homo sapiens
gaacaucaugggacagaga

SEQ ID NO: 601002 - RNA, 19 nt, Homo sapiens
ccacaccuccuuucucuga

SEQ ID NO: 601003 - RNA, 19 nt, Homo sapiens
gaaugaagaagauaaaugc

SEQ ID NO: 601004 - RNA, 19 nt, Homo sapiens
guacuugguaagcaaauuu

SEQ ID NO: 601005 - RNA, 19 nt, Homo sapiens
gcagaacuaagcucaguau

SEQ ID NO: 601006 - RNA, 19 nt, Homo sapiens
gugcaguggugcgauuaua

SEQ ID NO: 601007 - RNA, 19 nt, Homo sapiens
gcagggagcaugugaaggu

SEQ ID NO: 601008 - RNA, 19 nt, Homo sapiens
gcaggcuacuucucugaug

SEQ ID NO: 601009 - RNA, 19 nt, Homo sapiens
guaccagugagaagcauua

SEQ ID NO: 601010 - RNA, 19 nt, Homo sapiens
gcuaggugguuaauuuauc

SEQ ID NO: 601011 - RNA, 19 nt, Homo sapiens
cccgcuaggugguuaauuu

SEQ ID NO: 601012 - RNA, 19 nt, Homo sapiens
gggaaagggcuaaacaugu

SEQ ID NO: 601013 - RNA, 19 nt, Homo sapiens
caguguguguucauuguaa

SEQ ID NO: 601014 - RNA, 19 nt, Homo sapiens
guacacacacggcaaacuu

SEQ ID NO: 601015 - RNA, 19 nt, Homo sapiens
ggugagggucucuuucuuu

SEQ ID NO: 601016 - RNA, 19 nt, Homo sapiens
gcgggcaggugaugaacuu

SEQ ID NO: 601017 - RNA, 19 nt, Homo sapiens
gagauggcuuucccagugu

SEQ ID NO: 601018 - RNA, 19 nt, Homo sapiens
gcauucuucuuauucuaga

SEQ ID NO: 601019 - RNA, 19 nt, Homo sapiens
cgauuuauuucuccugaau

SEQ ID NO: 601020 - RNA, 19 nt, Homo sapiens
gaaacaguaacuccacguu

SEQ ID NO: 601021 - RNA, 19 nt, Homo sapiens
cugcauaaaguuugugaua

SEQ ID NO: 601022 - RNA, 19 nt, Homo sapiens
gaaagggcuaaacauguga

SEQ ID NO: 601023 - RNA, 19 nt, Homo sapiens
ccaaaguacugggauuaca

SEQ ID NO: 601024 - RNA, 19 nt, Homo sapiens
agaccgagauagaggaaga

SEQ ID NO: 601025 - RNA, 19 nt, Homo sapiens
gcacucacagcuaauuugu

SEQ ID NO: 601026 - RNA, 19 nt, Homo sapiens
gggaaagcacucacagcua

SEQ ID NO: 601027 - RNA, 19 nt, Homo sapiens
uuggauagcuggaaugaag

SEQ ID NO: 601028 - RNA, 19 nt, Homo sapiens
gccuggagauaguugcuaa

SEQ ID NO: 601029 - RNA, 19 nt, Homo sapiens
gaacuucaagggcgacauc

SEQ ID NO: 601030 - RNA, 19 nt, Homo sapiens
gaccaacuguaccuuccuu

SEQ ID NO: 601031 - RNA, 19 nt, Homo sapiens
ccggaugaauacuuggaua

SEQ ID NO: 601032 - RNA, 19 nt, Homo sapiens
gcucaagcaauccaaguga

SEQ ID NO: 601033 - RNA, 19 nt, Homo sapiens
guaauuuguggcacuauga

SEQ ID NO: 601034 - RNA, 19 nt, Homo sapiens
cuggaaaugugacuggaaa

SEQ ID NO: 601035 - RNA, 19 nt, Homo sapiens
ccacagaagaugaauacau

SEQ ID NO: 601036 - RNA, 19 nt, Homo sapiens
agaagacauuuccagaaga

SEQ ID NO: 601037 - RNA, 19 nt, Homo sapiens
uagcuggaaugaagaagau

SEQ ID NO: 601038 - RNA, 19 nt, Homo sapiens
cggaguagcugggaucaca

SEQ ID NO: 601039 - RNA, 19 nt, Homo sapiens
gagcacaguggguucagaa

SEQ ID NO: 601040 - RNA, 19 nt, Homo sapiens
gaaccaggaaaguacaugu

SEQ ID NO: 601041 - RNA, 19 nt, Homo sapiens
uggaaaagauggagaaaau

SEQ ID NO: 601042 - RNA, 19 nt, Homo sapiens
ucagguacuugguaagcaa

SEQ ID NO: 601043 - RNA, 19 nt, Homo sapiens
cagaggcacucagguacuu

SEQ ID NO: 601044 - RNA, 19 nt, Homo sapiens
aaguuugugucguuccuua

SEQ ID NO: 601045 - RNA, 19 nt, Homo sapiens
aacaguaacuccacguuca

SEQ ID NO: 601046 - RNA, 19 nt, Homo sapiens
ccgggaaguucaaggaaga

SEQ ID NO: 601047 - RNA, 19 nt, Homo sapiens
guugcuaaguugcuaggaa

SEQ ID NO: 601048 - RNA, 19 nt, Homo sapiens
caugugaggccuggagaua

SEQ ID NO: 601049 - RNA, 19 nt, Homo sapiens
ggaaaugugacuggaaaca

SEQ ID NO: 601050 - RNA, 19 nt, Homo sapiens
ugagaagcauuaugagcau

SEQ ID NO: 601051 - RNA, 19 nt, Homo sapiens
gacagaugcccacagaaga

SEQ ID NO: 601052 - RNA, 19 nt, Homo sapiens
caacuguaccuuccuugga

SEQ ID NO: 601053 - RNA, 19 nt, Homo sapiens
ucaaggaagaauaaaguug

SEQ ID NO: 601054 - RNA, 19 nt, Homo sapiens
gcuuggcauucuucuuauu

SEQ ID NO: 601055 - RNA, 19 nt, Homo sapiens
ccgcuaggugguuaauuua

SEQ ID NO: 601056 - RNA, 19 nt, Homo sapiens
ccaggaaaguacaugucuu

SEQ ID NO: 601057 - RNA, 19 nt, Homo sapiens
ucacugagccuggaagcaa

SEQ ID NO: 601058 - RNA, 19 nt, Homo sapiens
gcuggaaugaagaagauaa

SEQ ID NO: 601059 - RNA, 19 nt, Homo sapiens
guucaaggaagaauaaagu

SEQ ID NO: 601060 - RNA, 19 nt, Homo sapiens
ggugggacuuucauauucu

SEQ ID NO: 601061 - RNA, 19 nt, Homo sapiens
caccucaaccuucggagua

SEQ ID NO: 601062 - RNA, 19 nt, Homo sapiens
ccucaaacucgcagcagua

SEQ ID NO: 601063 - RNA, 19 nt, Homo sapiens
gcacaguggguucagaaag

SEQ ID NO: 601064 - RNA, 19 nt, Homo sapiens
gaaacuccaucucaauuua

SEQ ID NO: 601065 - RNA, 19 nt, Homo sapiens
gcaacgagacccugaguaa

SEQ ID NO: 601066 - RNA, 19 nt, Homo sapiens
gacgauuucugauugauuu

SEQ ID NO: 601067 - RNA, 19 nt, Homo sapiens
aaccagagcuucccucauu

SEQ ID NO: 601068 - RNA, 19 nt, Homo sapiens
ggagugacaucaagugcaa

SEQ ID NO: 601069 - RNA, 19 nt, Homo sapiens
gaaauacugcgugugauaa

SEQ ID NO: 601070 - RNA, 19 nt, Homo sapiens
uaacgcacuuggaguaauu

SEQ ID NO: 601071 - RNA, 19 nt, Homo sapiens
auucuuggcugcauaguua

SEQ ID NO: 601072 - RNA, 19 nt, Homo sapiens
gggagaaauuuauaucaga

SEQ ID NO: 601073 - RNA, 19 nt, Homo sapiens
ggaagcagccuggaagaaa

SEQ ID NO: 601074 - RNA, 19 nt, Homo sapiens
caaacucuacuauccaaua

SEQ ID NO: 601075 - RNA, 19 nt, Homo sapiens
gcaaacgggagaaauuuau

SEQ ID NO: 601076 - RNA, 19 nt, Homo sapiens
agaaggacaugcaaaggaa

SEQ ID NO: 601077 - RNA, 19 nt, Homo sapiens
guaaaucaggucaaacaaa

SEQ ID NO: 601078 - RNA, 19 nt, Homo sapiens
ccaacaauuugccuucuug

SEQ ID NO: 601079 - RNA, 19 nt, Homo sapiens
gaacuuuguuaacgcacuu

SEQ ID NO: 601080 - RNA, 19 nt, Homo sapiens
ucacuaccuuaucaucaua

SEQ ID NO: 601081 - RNA, 19 nt, Homo sapiens
gaaacaguccaguacuuga

SEQ ID NO: 601082 - RNA, 19 nt, Homo sapiens
ugaaauacugcgugugaua

SEQ ID NO: 601083 - RNA, 19 nt, Homo sapiens
ggaagaaacaguccaguac

SEQ ID NO: 601084 - RNA, 19 nt, Homo sapiens
ggaaacaauucaggaccaa

SEQ ID NO: 601085 - RNA, 19 nt, Homo sapiens
gaagcagccuggaagaaac

SEQ ID NO: 601086 - RNA, 19 nt, Homo sapiens
ggaagaaggacaugcaaag

SEQ ID NO: 601087 - RNA, 19 nt, Homo sapiens
caaacgggagaaauuuaua

SEQ ID NO: 601088 - RNA, 19 nt, Homo sapiens
uaagcaaacgggagaaauu

SEQ ID NO: 601089 - RNA, 19 nt, Homo sapiens
ccaacaaacucuacuaucc

SEQ ID NO: 601090 - RNA, 19 nt, Homo sapiens
ccagagcuucccucauuua

SEQ ID NO: 601091 - RNA, 19 nt, Homo sapiens
ccaaugguccuagaacuuu

SEQ ID NO: 601092 - RNA, 19 nt, Homo sapiens
ccagagggauggucaaggu

SEQ ID NO: 601093 - RNA, 19 nt, Homo sapiens
cugcauaguuauacgauug

SEQ ID NO: 601094 - RNA, 19 nt, Homo sapiens
gagaugugccggacgugua

SEQ ID NO: 601095 - RNA, 19 nt, Homo sapiens
gguccuagaacuuuguuaa

SEQ ID NO: 601096 - RNA, 19 nt, Homo sapiens
ugaaacuccaucucaauuu

SEQ ID NO: 601097 - RNA, 19 nt, Homo sapiens
aagaaacaguccaguacuu

SEQ ID NO: 601098 - RNA, 19 nt, Homo sapiens
gagcuucccucauuuaccu

SEQ ID NO: 601099 - RNA, 19 nt, Homo sapiens
gugaaacuccaucucaauu

SEQ ID NO: 601100 - RNA, 19 nt, Homo sapiens
uaugaaauacugcguguga

SEQ ID NO: 601101 - RNA, 19 nt, Homo sapiens
ggaacaggcagaagcugaa

SEQ ID NO: 601102 - RNA, 19 nt, Homo sapiens
ggacgauuucugauugauu

SEQ ID NO: 601103 - RNA, 19 nt, Homo sapiens
ucagauucuuggcugcaua

SEQ ID NO: 601104 - RNA, 19 nt, Homo sapiens
gagaccagccucaucaaca

SEQ ID NO: 601105 - RNA, 19 nt, Homo sapiens
ugaggcagguggauugcuu

SEQ ID NO: 601106 - RNA, 19 nt, Homo sapiens
ccaggucucugagcaggaa

SEQ ID NO: 601107 - RNA, 19 nt, Homo sapiens
uuuaggaugucauucuuug

SEQ ID NO: 601108 - RNA, 19 nt, Homo sapiens
cagugaaacuccaucucaa

SEQ ID NO: 601109 - RNA, 19 nt, Homo sapiens
gaagaaacaguccaguacu

SEQ ID NO: 601110 - RNA, 19 nt, Homo sapiens
gaaggacaugcaaaggaaa

SEQ ID NO: 601111 - RNA, 19 nt, Homo sapiens
gucaaggucaguaauugua

SEQ ID NO: 601112 - RNA, 19 nt, Homo sapiens
caaugguccuagaacuuug

SEQ ID NO: 601113 - RNA, 19 nt, Homo sapiens
caacaaacucuacuaucca

SEQ ID NO: 601114 - RNA, 19 nt, Homo sapiens
gauaagcaaacgggagaaa

SEQ ID NO: 601115 - RNA, 19 nt, Homo sapiens
ugccugcuauguacaguuu

SEQ ID NO: 601116 - RNA, 19 nt, Homo sapiens
gaauauacuggagccugua

SEQ ID NO: 601117 - RNA, 19 nt, Homo sapiens
aagcaaacgggagaaauuu

SEQ ID NO: 601118 - RNA, 19 nt, Homo sapiens
aacaaacucuacuauccaa

SEQ ID NO: 601119 - RNA, 19 nt, Homo sapiens
ucauuuaccuuuucuccua

SEQ ID NO: 601120 - RNA, 19 nt, Homo sapiens
gaagaaggacaugcaaagg

SEQ ID NO: 601121 - RNA, 19 nt, Homo sapiens
ccaagauccuuaaguucgu

SEQ ID NO: 601122 - RNA, 19 nt, Homo sapiens
gcagagcuaacagguguga

SEQ ID NO: 601123 - RNA, 19 nt, Homo sapiens
uguaaucccagcacuuuga

SEQ ID NO: 601124 - RNA, 19 nt, Homo sapiens
caacuggugggcuccgaaa

SEQ ID NO: 601125 - RNA, 19 nt, Homo sapiens
gaugucauucuuugcaguu

SEQ ID NO: 601126 - RNA, 19 nt, Homo sapiens
ccuguaaucccagcacuuu

SEQ ID NO: 601127 - RNA, 19 nt, Homo sapiens
ggucaaggucaguaauugu

SEQ ID NO: 601128 - RNA, 19 nt, Homo sapiens
cgggagaaauuuauaucag

SEQ ID NO: 601129 - RNA, 19 nt, Homo sapiens
gcuacguccugccugugaa

SEQ ID NO: 601130 - RNA, 19 nt, Homo sapiens
ggacaugcaaaggaaacaa

SEQ ID NO: 601131 - RNA, 19 nt, Homo sapiens
ugcuugagcucgggaguuu

SEQ ID NO: 601132 - RNA, 19 nt, Homo sapiens
gcugcauaguuauacgauu

SEQ ID NO: 601133 - RNA, 19 nt, Homo sapiens
gggaagcagccuggaagaa

SEQ ID NO: 601134 - RNA, 19 nt, Homo sapiens
cguccugccugugaaagaa

SEQ ID NO: 601135 - RNA, 19 nt, Homo sapiens
acagugaaacuccaucuca

SEQ ID NO: 601136 - RNA, 19 nt, Homo sapiens
acucuacuauccaauaugg

SEQ ID NO: 601137 - RNA, 19 nt, Homo sapiens
agaaacaguccaguacuug

SEQ ID NO: 601138 - RNA, 19 nt, Homo sapiens
aagaaggacaugcaaagga

SEQ ID NO: 601139 - RNA, 19 nt, Homo sapiens
cuucuugccugcuauguac

SEQ ID NO: 601140 - RNA, 19 nt, Homo sapiens
ccucaucaacacagugaaa

SEQ ID NO: 601141 - RNA, 19 nt, Homo sapiens
uguuaacgcacuuggagua

SEQ ID NO: 601142 - RNA, 19 nt, Homo sapiens
cccuaucacuaccuuauca

SEQ ID NO: 601143 - RNA, 19 nt, Homo sapiens
ggauggucaaggucaguaa

SEQ ID NO: 601144 - RNA, 19 nt, Homo sapiens
uaaguucgucgucuucauc

SEQ ID NO: 601145 - RNA, 19 nt, Homo sapiens
gaugcuugccucucccuau

SEQ ID NO: 601146 - RNA, 19 nt, Homo sapiens
ccacccuccucccuucuca

SEQ ID NO: 601147 - RNA, 19 nt, Homo sapiens
gacaugcaaaggaaacaau

SEQ ID NO: 601148 - RNA, 19 nt, Homo sapiens
uaucacuaccuuaucauca

SEQ ID NO: 601149 - RNA, 19 nt, Homo sapiens
gcauaguuauacgauugug

SEQ ID NO: 601150 - RNA, 19 nt, Homo sapiens
agcaaacgggagaaauuua

SEQ ID NO: 601151 - RNA, 19 nt, Homo sapiens
guuaacgcacuuggaguaa

SEQ ID NO: 601152 - RNA, 19 nt, Homo sapiens
uggaggaggucccgaacgu

SEQ ID NO: 601153 - RNA, 19 nt, Homo sapiens
uggucaaggucaguaauug

SEQ ID NO: 601154 - RNA, 19 nt, Homo sapiens
gaacaggcagaagcugaag

SEQ ID NO: 601155 - RNA, 19 nt, Homo sapiens
aacgagacccugaguaaca

SEQ ID NO: 601156 - RNA, 19 nt, Homo sapiens
aaagggaagcagccuggaa

SEQ ID NO: 601157 - RNA, 19 nt, Homo sapiens
gggacgauuucugauugau

SEQ ID NO: 601158 - RNA, 19 nt, Homo sapiens
ucauguccuucacgaguuc

SEQ ID NO: 601159 - RNA, 19 nt, Homo sapiens
gucauucuuugcaguucuu

SEQ ID NO: 601160 - RNA, 19 nt, Homo sapiens
caacacagugaaacuccau

SEQ ID NO: 601161 - RNA, 19 nt, Homo sapiens
gacccugaguaacagauac

SEQ ID NO: 601162 - RNA, 19 nt, Homo sapiens
gauucuuggcugcauaguu

SEQ ID NO: 601163 - RNA, 19 nt, Homo sapiens
uuaacgcacuuggaguaau

SEQ ID NO: 601164 - RNA, 19 nt, Homo sapiens
gaucauaguucuaauugug

SEQ ID NO: 601165 - RNA, 19 nt, Homo sapiens
ucucauagaucagaacaua

SEQ ID NO: 601166 - RNA, 19 nt, Homo sapiens
gaacucagccaacgauuuc

SEQ ID NO: 601167 - RNA, 19 nt, Homo sapiens
gaaguggucacgggauuua

SEQ ID NO: 601168 - RNA, 19 nt, Homo sapiens
gagaaguggucacgggauu

SEQ ID NO: 601169 - RNA, 19 nt, Homo sapiens
gaugauauccaguguguug

SEQ ID NO: 601170 - RNA, 19 nt, Homo sapiens
ccaguguguugaagaauuu

SEQ ID NO: 601171 - RNA, 19 nt, Homo sapiens
caccaacgcuuccaacaau

SEQ ID NO: 601172 - RNA, 19 nt, Homo sapiens
uaauugugcuucugauugu

SEQ ID NO: 601173 - RNA, 19 nt, Homo sapiens
gaaguccaagucaguaauu

SEQ ID NO: 601174 - RNA, 19 nt, Homo sapiens
guagggaucauaguucuaa

SEQ ID NO: 601175 - RNA, 19 nt, Homo sapiens
gagaugugccggaagugua

SEQ ID NO: 601176 - RNA, 19 nt, Homo sapiens
gaacauacuggagccugua

SEQ ID NO: 601177 - RNA, 19 nt, Homo sapiens
caacagaggcacagcuuca

SEQ ID NO: 601178 - RNA, 19 nt, Homo sapiens
ccagagaugugccggaagu

SEQ ID NO: 601179 - RNA, 19 nt, Homo sapiens
gaaagacuucacuguggaa

SEQ ID NO: 601180 - RNA, 19 nt, Homo sapiens
gggaucauaguucuaauug

SEQ ID NO: 601181 - RNA, 19 nt, Homo sapiens
acaaugaaccuucuugcuu

SEQ ID NO: 601182 - RNA, 19 nt, Homo sapiens
uauccaguguguugaagaa

SEQ ID NO: 601183 - RNA, 19 nt, Homo sapiens
cgaacucagccaacgauuu

SEQ ID NO: 601184 - RNA, 19 nt, Homo sapiens
cuaauugugcuucugauug

SEQ ID NO: 601185 - RNA, 19 nt, Homo sapiens
caacgauuucugauagauu

SEQ ID NO: 601186 - RNA, 19 nt, Homo sapiens
guccaagucaguaauugua

SEQ ID NO: 601187 - RNA, 19 nt, Homo sapiens
cagccaacgauuucugaua

SEQ ID NO: 601188 - RNA, 19 nt, Homo sapiens
caucguagggaucauaguu

SEQ ID NO: 601189 - RNA, 19 nt, Homo sapiens
ggagcgcuuccuaccguua

SEQ ID NO: 601190 - RNA, 19 nt, Homo sapiens
gccaguuccucccaucuuc

SEQ ID NO: 601191 - RNA, 19 nt, Homo sapiens
ggaucauaguucuaauugu

SEQ ID NO: 601192 - RNA, 19 nt, Homo sapiens
gggaaguccaagucaguaa

SEQ ID NO: 601193 - RNA, 19 nt, Homo sapiens
ccaacgauuucugauagau

SEQ ID NO: 601194 - RNA, 19 nt, Homo sapiens
ggacuccugccucuucuca

SEQ ID NO: 601195 - RNA, 19 nt, Homo sapiens
ggaaguccaagucaguaau

SEQ ID NO: 601196 - RNA, 19 nt, Homo sapiens
gccaacgauuucugauaga

SEQ ID NO: 601197 - RNA, 19 nt, Homo sapiens
uguagcaggugcccuagug

SEQ ID NO: 601198 - RNA, 19 nt, Homo sapiens
caagagggcagggccaguu

SEQ ID NO: 601199 - RNA, 19 nt, Homo sapiens
gauuguguuuguuugaaag

SEQ ID NO: 601200 - RNA, 19 nt, Homo sapiens
uccaguguguugaagaauu

SEQ ID NO: 601201 - RNA, 19 nt, Homo sapiens
ccaagacccuaaaguucgu

SEQ ID NO: 601202 - RNA, 19 nt, Homo sapiens
ugacaagggugaggaugag

SEQ ID NO: 601203 - RNA, 19 nt, Homo sapiens
acuccugccucuucucauu

SEQ ID NO: 601204 - RNA, 19 nt, Homo sapiens
ccaacgcuuccaacaauga

SEQ ID NO: 601205 - RNA, 19 nt, Homo sapiens
agccaacgauuucugauag

SEQ ID NO: 601206 - RNA, 19 nt, Homo sapiens
gcacgaacucagccaacga

SEQ ID NO: 601207 - RNA, 19 nt, Homo sapiens
aaaaguuccugcaccauga

SEQ ID NO: 601208 - RNA, 19 nt, Homo sapiens
agaaauuccuuccuuaccu

SEQ ID NO: 601209 - RNA, 19 nt, Homo sapiens
guucuaauugugcuucuga

SEQ ID NO: 601210 - RNA, 19 nt, Homo sapiens
gauauccaguguguugaag

SEQ ID NO: 601211 - RNA, 19 nt, Homo sapiens
gugacaagggugaggauga

SEQ ID NO: 601212 - RNA, 19 nt, Homo sapiens
aaugaaaacuccccagaga

SEQ ID NO: 601213 - RNA, 19 nt, Homo sapiens
ccuucuugcuucccaugua

SEQ ID NO: 601214 - RNA, 19 nt, Homo sapiens
ccaacaaugaaccuucuug

SEQ ID NO: 601215 - RNA, 19 nt, Homo sapiens
guacguccugggaugauau

SEQ ID NO: 601216 - RNA, 19 nt, Homo sapiens
caacgcuuccaacaaugaa

SEQ ID NO: 601217 - RNA, 19 nt, Homo sapiens
uaaaguucgucgucgucau

SEQ ID NO: 601218 - RNA, 19 nt, Homo sapiens
acaccaacgcuuccaacaa

SEQ ID NO: 601219 - RNA, 19 nt, Homo sapiens
cuucugauuguguuuguuu

SEQ ID NO: 601220 - RNA, 19 nt, Homo sapiens
uguacguccugggaugaua

SEQ ID NO: 601221 - RNA, 19 nt, Homo sapiens
gcucuaucuuccuccuugu

SEQ ID NO: 601222 - RNA, 19 nt, Homo sapiens
cugauuguguuuguuugaa

SEQ ID NO: 601223 - RNA, 19 nt, Homo sapiens
ucauagaucagaacauacu

SEQ ID NO: 601224 - RNA, 19 nt, Homo sapiens
gcugaagagacaaugaaca

SEQ ID NO: 601225 - RNA, 19 nt, Homo sapiens
gcugaagagacaaugaaca

SEQ ID NO: 601226 - RNA, 19 nt, Homo sapiens
ggccuuaccuuucuacuuu

SEQ ID NO: 601227 - RNA, 19 nt, Homo sapiens
ucaaugagaucgugaguau

SEQ ID NO: 601228 - RNA, 19 nt, Homo sapiens
ggacaaccuuacaaguaua

SEQ ID NO: 601229 - RNA, 19 nt, Homo sapiens
cgacuucacuugauacuau

SEQ ID NO: 601230 - RNA, 19 nt, Homo sapiens
ccaaagcgguggaauuaga

SEQ ID NO: 601231 - RNA, 19 nt, Homo sapiens
guaggaaagugccacaauu

SEQ ID NO: 601232 - RNA, 19 nt, Homo sapiens
ugacgagacucuuauuuau

SEQ ID NO: 601233 - RNA, 19 nt, Homo sapiens
gaaaguucauguaucuaga

SEQ ID NO: 601234 - RNA, 19 nt, Homo sapiens
ggacagccauaguauagug

SEQ ID NO: 601235 - RNA, 19 nt, Homo sapiens
gaucacacauucagacugu

SEQ ID NO: 601236 - RNA, 19 nt, Homo sapiens
cagcaaacccuucuccaua

SEQ ID NO: 601237 - RNA, 19 nt, Homo sapiens
gguaguuguuuacauauga

SEQ ID NO: 601238 - RNA, 19 nt, Homo sapiens
gaaagugccacaauuguca

SEQ ID NO: 601239 - RNA, 19 nt, Homo sapiens
guaagcaucugacucaucu

SEQ ID NO: 601240 - RNA, 19 nt, Homo sapiens
uggguuagaucacacauaa

SEQ ID NO: 601241 - RNA, 19 nt, Homo sapiens
caccacgccuggcuaauuu

SEQ ID NO: 601242 - RNA, 19 nt, Homo sapiens
ggacagaagcucacaacga

SEQ ID NO: 601243 - RNA, 19 nt, Homo sapiens
gaccuuggccgcucuguaa

SEQ ID NO: 601244 - RNA, 19 nt, Homo sapiens
ucauguaucuagaagguaa

SEQ ID NO: 601245 - RNA, 19 nt, Homo sapiens
gcaaauauggacaggacua

SEQ ID NO: 601246 - RNA, 19 nt, Homo sapiens
gcagauggguuagaucaca

SEQ ID NO: 601247 - RNA, 19 nt, Homo sapiens
gacagaggcagauggguua

SEQ ID NO: 601248 - RNA, 19 nt, Homo sapiens
acgagacucuuauuuauug

SEQ ID NO: 601249 - RNA, 19 nt, Homo sapiens
gaugcccgaucuacuuuaa

SEQ ID NO: 601250 - RNA, 19 nt, Homo sapiens
gccaacaggugucaacaug

SEQ ID NO: 601251 - RNA, 19 nt, Homo sapiens
aagaguagauggugcuuga

SEQ ID NO: 601252 - RNA, 19 nt, Homo sapiens
gaagauugaggaccacuug

SEQ ID NO: 601253 - RNA, 19 nt, Homo sapiens
gcaagucuuuacuguggaa

SEQ ID NO: 601254 - RNA, 19 nt, Homo sapiens
ugacucaucucagaaaugu

SEQ ID NO: 601255 - RNA, 19 nt, Homo sapiens
gaacuggacaaccuuacaa

SEQ ID NO: 601256 - RNA, 19 nt, Homo sapiens
gaacaugaagaaacuuuag

SEQ ID NO: 601257 - RNA, 19 nt, Homo sapiens
gauaaagugggucaacaaa

SEQ ID NO: 601258 - RNA, 19 nt, Homo sapiens
cuuguguccuguucuauua

SEQ ID NO: 601259 - RNA, 19 nt, Homo sapiens
acacgaugcugauaaagug

SEQ ID NO: 601260 - RNA, 19 nt, Homo sapiens
gaaacucucccauccaaca

SEQ ID NO: 601261 - RNA, 19 nt, Homo sapiens
ggaaaguucauguaucuag

SEQ ID NO: 601262 - RNA, 19 nt, Homo sapiens
guugagcucuggaaaguuc

SEQ ID NO: 601263 - RNA, 19 nt, Homo sapiens
caaagaaucagguacaaag

SEQ ID NO: 601264 - RNA, 19 nt, Homo sapiens
ccacagaggccuuccuaga

SEQ ID NO: 601265 - RNA, 19 nt, Homo sapiens
gugcguacuuugagauuug

SEQ ID NO: 601266 - RNA, 19 nt, Homo sapiens
acacaggacagccauagua

SEQ ID NO: 601267 - RNA, 19 nt, Homo sapiens
ggguacagauugccuacuu

SEQ ID NO: 601268 - RNA, 19 nt, Homo sapiens
uggacaaccuuacaaguau

SEQ ID NO: 601269 - RNA, 19 nt, Homo sapiens
ucacugcacuuggcauuau

SEQ ID NO: 601270 - RNA, 19 nt, Homo sapiens
gauuguggcuguguuuguu

SEQ ID NO: 601271 - RNA, 19 nt, Homo sapiens
caccucagccauccaaaua

SEQ ID NO: 601272 - RNA, 19 nt, Homo sapiens
uggaacauccuguaacuuu

SEQ ID NO: 601273 - RNA, 19 nt, Homo sapiens
caaggucggugauuguaca

SEQ ID NO: 601274 - RNA, 19 nt, Homo sapiens
acauuaggcuuugcuauau

SEQ ID NO: 601275 - RNA, 19 nt, Homo sapiens
cgaaagugcugggauuaca

SEQ ID NO: 601276 - RNA, 19 nt, Homo sapiens
gcaaacccuucuccauagu

SEQ ID NO: 601277 - RNA, 19 nt, Homo sapiens
agaauggugugaaaugguu

SEQ ID NO: 601278 - RNA, 19 nt, Homo sapiens
aagaaacucucccauccaa

SEQ ID NO: 601279 - RNA, 19 nt, Homo sapiens
ccagagggauggucaaggu

SEQ ID NO: 601280 - RNA, 19 nt, Homo sapiens
uacauuaggcuuugcuaua

SEQ ID NO: 601281 - RNA, 19 nt, Homo sapiens
cugacgacaugaaauaauu

SEQ ID NO: 601282 - RNA, 19 nt, Homo sapiens
gaucacacauaacaauagg

SEQ ID NO: 601283 - RNA, 19 nt, Homo sapiens
gaagaaguccccuguaaga

SEQ ID NO: 601284 - RNA, 19 nt, Homo sapiens
ucccaaagcgguggaauua

SEQ ID NO: 601285 - RNA, 19 nt, Homo sapiens
uaaggacacuauggaaaug

SEQ ID NO: 601286 - RNA, 19 nt, Homo sapiens
caucauaggagucacaguu

SEQ ID NO: 601287 - RNA, 19 nt, Homo sapiens
ggaaugaccuccuuuucug

SEQ ID NO: 601288 - RNA, 19 nt, Homo sapiens
ccacgggccugagagacua

SEQ ID NO: 601289 - RNA, 19 nt, Homo sapiens
gaacuugagcccuguuugg

SEQ ID NO: 601290 - RNA, 19 nt, Homo sapiens
gacgagacucuuauuuauu

SEQ ID NO: 601291 - RNA, 19 nt, Homo sapiens
gaucauuuaugcagguagu

SEQ ID NO: 601292 - RNA, 19 nt, Homo sapiens
guacagauugccuacuuga

SEQ ID NO: 601293 - RNA, 19 nt, Homo sapiens
uacuuuggcuucaaugauu

SEQ ID NO: 601294 - RNA, 19 nt, Homo sapiens
gauguacuuuggcuucaau

SEQ ID NO: 601295 - RNA, 19 nt, Homo sapiens
gguuugggaugucauuguu

SEQ ID NO: 601296 - RNA, 19 nt, Homo sapiens
guucauguaucuagaaggu

SEQ ID NO: 601297 - RNA, 19 nt, Homo sapiens
gaauccaugaccaaauuaa

SEQ ID NO: 601298 - RNA, 19 nt, Homo sapiens
caaacaaggaagcacauug

SEQ ID NO: 601299 - RNA, 19 nt, Homo sapiens
gcaacaggaccuagaaugg

SEQ ID NO: 601300 - RNA, 19 nt, Homo sapiens
gcuugagaauggugugaaa

SEQ ID NO: 601301 - RNA, 19 nt, Homo sapiens
gauaauaaggacacuaugg

SEQ ID NO: 601302 - RNA, 19 nt, Homo sapiens
ccacugagacucugagaca

SEQ ID NO: 601303 - RNA, 19 nt, Homo sapiens
gacaccauaucucagaaga

SEQ ID NO: 601304 - RNA, 19 nt, Homo sapiens
gccugaagaucacacauuc

SEQ ID NO: 601305 - RNA, 19 nt, Homo sapiens
gguagucauuccaggaguu

SEQ ID NO: 601306 - RNA, 19 nt, Homo sapiens
gagauuugguuugggaugu

SEQ ID NO: 601307 - RNA, 19 nt, Homo sapiens
ggaaagugccacaauuguc

SEQ ID NO: 601308 - RNA, 19 nt, Homo sapiens
augaauccaugaccaaauu

SEQ ID NO: 601309 - RNA, 19 nt, Homo sapiens
gcauuaagguuuucuucuu

SEQ ID NO: 601310 - RNA, 19 nt, Homo sapiens
gacuucacuugauacuaua

SEQ ID NO: 601311 - RNA, 19 nt, Homo sapiens
ccacaaagaaucagguaca

SEQ ID NO: 601312 - RNA, 19 nt, Homo sapiens
uugacgagacucuuauuua

SEQ ID NO: 601313 - RNA, 19 nt, Homo sapiens
uguccgacuucacuugaua

SEQ ID NO: 601314 - RNA, 19 nt, Homo sapiens
ggaacauccuguaacuuuu

SEQ ID NO: 601315 - RNA, 19 nt, Homo sapiens
uguacacgaugcugauaaa

SEQ ID NO: 601316 - RNA, 19 nt, Homo sapiens
ucacuggaaugaccuccuu

SEQ ID NO: 601317 - RNA, 19 nt, Homo sapiens
ucagaagacgguagagauu

SEQ ID NO: 601318 - RNA, 19 nt, Homo sapiens
cacagaggccuuccuagaa

SEQ ID NO: 601319 - RNA, 19 nt, Homo sapiens
uagaauugccugaagauca

SEQ ID NO: 601320 - RNA, 19 nt, Homo sapiens
cucaaggcauuguguguuu

SEQ ID NO: 601321 - RNA, 19 nt, Homo sapiens
gguacagauugccuacuug

SEQ ID NO: 601322 - RNA, 19 nt, Homo sapiens
ucaggguggucucgaauuc

SEQ ID NO: 601323 - RNA, 19 nt, Homo sapiens
gaaggugaucccacugaga

SEQ ID NO: 601324 - RNA, 19 nt, Homo sapiens
caggacagccauaguauag

SEQ ID NO: 601325 - RNA, 19 nt, Homo sapiens
gauugaggaccacuuguug

SEQ ID NO: 601326 - RNA, 19 nt, Homo sapiens
ggccuuaccuuucuacuuu

SEQ ID NO: 601327 - RNA, 19 nt, Homo sapiens
ucaaugagaucgugaguau

SEQ ID NO: 601328 - RNA, 19 nt, Homo sapiens
ggacaaccuuacaaguaua

SEQ ID NO: 601329 - RNA, 19 nt, Homo sapiens
cgacuucacuugauacuau

SEQ ID NO: 601330 - RNA, 19 nt, Homo sapiens
ccaaagcgguggaauuaga

SEQ ID NO: 601331 - RNA, 19 nt, Homo sapiens
guaggaaagugccacaauu

SEQ ID NO: 601332 - RNA, 19 nt, Homo sapiens
ugacgagacucuuauuuau

SEQ ID NO: 601333 - RNA, 19 nt, Homo sapiens
gaaaguucauguaucuaga

SEQ ID NO: 601334 - RNA, 19 nt, Homo sapiens
ggacagccauaguauagug

SEQ ID NO: 601335 - RNA, 19 nt, Homo sapiens
gaucacacauucagacugu

SEQ ID NO: 601336 - RNA, 19 nt, Homo sapiens
cagcaaacccuucuccaua

SEQ ID NO: 601337 - RNA, 19 nt, Homo sapiens
gguaguuguuuacauauga

SEQ ID NO: 601338 - RNA, 19 nt, Homo sapiens
gaaagugccacaauuguca

SEQ ID NO: 601339 - RNA, 19 nt, Homo sapiens
guaagcaucugacucaucu

SEQ ID NO: 601340 - RNA, 19 nt, Homo sapiens
uggguuagaucacacauaa

SEQ ID NO: 601341 - RNA, 19 nt, Homo sapiens
caccacgccuggcuaauuu

SEQ ID NO: 601342 - RNA, 19 nt, Homo sapiens
ggacagaagcucacaacga

SEQ ID NO: 601343 - RNA, 19 nt, Homo sapiens
gaccuuggccgcucuguaa

SEQ ID NO: 601344 - RNA, 19 nt, Homo sapiens
ucauguaucuagaagguaa

SEQ ID NO: 601345 - RNA, 19 nt, Homo sapiens
gcaaauauggacaggacua

SEQ ID NO: 601346 - RNA, 19 nt, Homo sapiens
gcagauggguuagaucaca

SEQ ID NO: 601347 - RNA, 19 nt, Homo sapiens
gacagaggcagauggguua

SEQ ID NO: 601348 - RNA, 19 nt, Homo sapiens
acgagacucuuauuuauug

SEQ ID NO: 601349 - RNA, 19 nt, Homo sapiens
gaugcccgaucuacuuuaa

SEQ ID NO: 601350 - RNA, 19 nt, Homo sapiens
gccaacaggugucaacaug

SEQ ID NO: 601351 - RNA, 19 nt, Homo sapiens
aagaguagauggugcuuga

SEQ ID NO: 601352 - RNA, 19 nt, Homo sapiens
gaagauugaggaccacuug

SEQ ID NO: 601353 - RNA, 19 nt, Homo sapiens
gcaagucuuuacuguggaa

SEQ ID NO: 601354 - RNA, 19 nt, Homo sapiens
ugacucaucucagaaaugu

SEQ ID NO: 601355 - RNA, 19 nt, Homo sapiens
gaacuggacaaccuuacaa

SEQ ID NO: 601356 - RNA, 19 nt, Homo sapiens
gaacaugaagaaacuuuag

SEQ ID NO: 601357 - RNA, 19 nt, Homo sapiens
gauaaagugggucaacaaa

SEQ ID NO: 601358 - RNA, 19 nt, Homo sapiens
cuuguguccuguucuauua

SEQ ID NO: 601359 - RNA, 19 nt, Homo sapiens
acacgaugcugauaaagug

SEQ ID NO: 601360 - RNA, 19 nt, Homo sapiens
gaaacucucccauccaaca

SEQ ID NO: 601361 - RNA, 19 nt, Homo sapiens
ggaaaguucauguaucuag

SEQ ID NO: 601362 - RNA, 19 nt, Homo sapiens
guugagcucuggaaaguuc

SEQ ID NO: 601363 - RNA, 19 nt, Homo sapiens
caaagaaucaggcaucauc

SEQ ID NO: 601364 - RNA, 19 nt, Homo sapiens
ccacagaggccuuccuaga

SEQ ID NO: 601365 - RNA, 19 nt, Homo sapiens
gugcguacuuugagauuug

SEQ ID NO: 601366 - RNA, 19 nt, Homo sapiens
acacaggacagccauagua

SEQ ID NO: 601367 - RNA, 19 nt, Homo sapiens
ggguacagauugccuacuu

SEQ ID NO: 601368 - RNA, 19 nt, Homo sapiens
uggacaaccuuacaaguau

SEQ ID NO: 601369 - RNA, 19 nt, Homo sapiens
ucacugcacuuggcauuau

SEQ ID NO: 601370 - RNA, 19 nt, Homo sapiens
gauuguggcuguguuuguu

SEQ ID NO: 601371 - RNA, 19 nt, Homo sapiens
caccucagccauccaaaua

SEQ ID NO: 601372 - RNA, 19 nt, Homo sapiens
uggaacauccuguaacuuu

SEQ ID NO: 601373 - RNA, 19 nt, Homo sapiens
caaggucggugauuguaca

SEQ ID NO: 601374 - RNA, 19 nt, Homo sapiens
acauuaggcuuugcuauau

SEQ ID NO: 601375 - RNA, 19 nt, Homo sapiens
cgaaagugcugggauuaca

SEQ ID NO: 601376 - RNA, 19 nt, Homo sapiens
gcaaacccuucuccauagu

SEQ ID NO: 601377 - RNA, 19 nt, Homo sapiens
agaauggugugaaaugguu

SEQ ID NO: 601378 - RNA, 19 nt, Homo sapiens
aagaaacucucccauccaa

SEQ ID NO: 601379 - RNA, 19 nt, Homo sapiens
ccagagggauggucaaggu

SEQ ID NO: 601380 - RNA, 19 nt, Homo sapiens
uacauuaggcuuugcuaua

SEQ ID NO: 601381 - RNA, 19 nt, Homo sapiens
cugacgacaugaaauaauu

SEQ ID NO: 601382 - RNA, 19 nt, Homo sapiens
gaucacacauaacaauagg

SEQ ID NO: 601383 - RNA, 19 nt, Homo sapiens
gaagaaguccccuguaaga

SEQ ID NO: 601384 - RNA, 19 nt, Homo sapiens
ucccaaagcgguggaauua

SEQ ID NO: 601385 - RNA, 19 nt, Homo sapiens
uaaggacacuauggaaaug

SEQ ID NO: 601386 - RNA, 19 nt, Homo sapiens
caucauaggagucacaguu

SEQ ID NO: 601387 - RNA, 19 nt, Homo sapiens
ggaaugaccuccuuuucug

SEQ ID NO: 601388 - RNA, 19 nt, Homo sapiens
ccacgggccugagagacua

SEQ ID NO: 601389 - RNA, 19 nt, Homo sapiens
gaacuugagcccuguuugg

SEQ ID NO: 601390 - RNA, 19 nt, Homo sapiens
gacgagacucuuauuuauu

SEQ ID NO: 601391 - RNA, 19 nt, Homo sapiens
gaucauuuaugcagguagu

SEQ ID NO: 601392 - RNA, 19 nt, Homo sapiens
guacagauugccuacuuga

SEQ ID NO: 601393 - RNA, 19 nt, Homo sapiens
uacuuuggcuucaaugauu

SEQ ID NO: 601394 - RNA, 19 nt, Homo sapiens
gauguacuuuggcuucaau

SEQ ID NO: 601395 - RNA, 19 nt, Homo sapiens
gguuugggaugucauuguu

SEQ ID NO: 601396 - RNA, 19 nt, Homo sapiens
guucauguaucuagaaggu

SEQ ID NO: 601397 - RNA, 19 nt, Homo sapiens
agaaucaggcaucaucaua

SEQ ID NO: 601398 - RNA, 19 nt, Homo sapiens
gaauccaugaccaaauuaa

SEQ ID NO: 601399 - RNA, 19 nt, Homo sapiens
caaacaaggaagcacauug

SEQ ID NO: 601400 - RNA, 19 nt, Homo sapiens
gcaacaggaccuagaaugg

SEQ ID NO: 601401 - RNA, 19 nt, Homo sapiens
gcuugagaauggugugaaa

SEQ ID NO: 601402 - RNA, 19 nt, Homo sapiens
gauaauaaggacacuaugg

SEQ ID NO: 601403 - RNA, 19 nt, Homo sapiens
ccacugagacucugagaca

SEQ ID NO: 601404 - RNA, 19 nt, Homo sapiens
gacaccauaucucagaaga

SEQ ID NO: 601405 - RNA, 19 nt, Homo sapiens
gccugaagaucacacauuc

SEQ ID NO: 601406 - RNA, 19 nt, Homo sapiens
gguagucauuccaggaguu

SEQ ID NO: 601407 - RNA, 19 nt, Homo sapiens
gagauuugguuugggaugu

SEQ ID NO: 601408 - RNA, 19 nt, Homo sapiens
ggaaagugccacaauuguc

SEQ ID NO: 601409 - RNA, 19 nt, Homo sapiens
augaauccaugaccaaauu

SEQ ID NO: 601410 - RNA, 19 nt, Homo sapiens
gcauuaagguuuucuucuu

SEQ ID NO: 601411 - RNA, 19 nt, Homo sapiens
gacuucacuugauacuaua

SEQ ID NO: 601412 - RNA, 19 nt, Homo sapiens
gaaucaggcaucaucauag

SEQ ID NO: 601413 - RNA, 19 nt, Homo sapiens
uugacgagacucuuauuua

SEQ ID NO: 601414 - RNA, 19 nt, Homo sapiens
uguccgacuucacuugaua

SEQ ID NO: 601415 - RNA, 19 nt, Homo sapiens
ggaacauccuguaacuuuu

SEQ ID NO: 601416 - RNA, 19 nt, Homo sapiens
uguacacgaugcugauaaa

SEQ ID NO: 601417 - RNA, 19 nt, Homo sapiens
ucacuggaaugaccuccuu

SEQ ID NO: 601418 - RNA, 19 nt, Homo sapiens
ucagaagacgguagagauu

SEQ ID NO: 601419 - RNA, 19 nt, Homo sapiens
cacagaggccuuccuagaa

SEQ ID NO: 601420 - RNA, 19 nt, Homo sapiens
uagaauugccugaagauca

SEQ ID NO: 601421 - RNA, 19 nt, Homo sapiens
cucaaggcauuguguguuu

SEQ ID NO: 601422 - RNA, 19 nt, Homo sapiens
gguacagauugccuacuug

SEQ ID NO: 601423 - RNA, 19 nt, Homo sapiens
ucaggguggucucgaauuc

SEQ ID NO: 601424 - RNA, 19 nt, Homo sapiens
gaaggugaucccacugaga

SEQ ID NO: 601425 - RNA, 19 nt, Homo sapiens
caggacagccauaguauag

SEQ ID NO: 601426 - RNA, 19 nt, Homo sapiens
caacagaucugcugaaaga

SEQ ID NO: 601427 - RNA, 19 nt, Homo sapiens
ggacauauguggagaauag

SEQ ID NO: 601428 - RNA, 19 nt, Homo sapiens
ccaaagaccuuaauaacuu

SEQ ID NO: 601429 - RNA, 19 nt, Homo sapiens
caaaguaaauccugcagua

SEQ ID NO: 601430 - RNA, 19 nt, Homo sapiens
gaaacgcccugaagaagaa

SEQ ID NO: 601431 - RNA, 19 nt, Homo sapiens
gauaacaguuggauaaaga

SEQ ID NO: 601432 - RNA, 19 nt, Homo sapiens
gcagauacauccaccuaaa

SEQ ID NO: 601433 - RNA, 19 nt, Homo sapiens
caaauuugcugccauucua

SEQ ID NO: 601434 - RNA, 19 nt, Homo sapiens
uaaagugacuccugaaaga

SEQ ID NO: 601435 - RNA, 19 nt, Homo sapiens
aaagagauaugugcacuua

SEQ ID NO: 601436 - RNA, 19 nt, Homo sapiens
gaaguaaauucucaugugu

SEQ ID NO: 601437 - RNA, 19 nt, Homo sapiens
gaaaagcacucauuaagga

SEQ ID NO: 601438 - RNA, 19 nt, Homo sapiens
caaggugaauccugaaauu

SEQ ID NO: 601439 - RNA, 19 nt, Homo sapiens
gaaaguaaaugagagagau

SEQ ID NO: 601440 - RNA, 19 nt, Homo sapiens
gaagugaagaccuugauaa

SEQ ID NO: 601441 - RNA, 19 nt, Homo sapiens
ggaaguccgauuaaaguua

SEQ ID NO: 601442 - RNA, 19 nt, Homo sapiens
gaacuuucuuacaggauaa

SEQ ID NO: 601443 - RNA, 19 nt, Homo sapiens
uaaaguggauccugaaaca

SEQ ID NO: 601444 - RNA, 19 nt, Homo sapiens
gauaaucucaucaaaguga

SEQ ID NO: 601445 - RNA, 19 nt, Homo sapiens
cgacauaauucccaugaug

SEQ ID NO: 601446 - RNA, 19 nt, Homo sapiens
ggcagcauguccaauguua

SEQ ID NO: 601447 - RNA, 19 nt, Homo sapiens
gaucaacucuuguacaaaa

SEQ ID NO: 601448 - RNA, 19 nt, Homo sapiens
ugaaguaaaucccaaagga

SEQ ID NO: 601449 - RNA, 19 nt, Homo sapiens
gauaaccaacuaaccaaua

SEQ ID NO: 601450 - RNA, 19 nt, Homo sapiens
gugaagaccuugauaaugc

SEQ ID NO: 601451 - RNA, 19 nt, Homo sapiens
acaaggaaaucaagaugaa

SEQ ID NO: 601452 - RNA, 19 nt, Homo sapiens
ugaaguaaauucucaugug

SEQ ID NO: 601453 - RNA, 19 nt, Homo sapiens
gaauaggaaucaaggucuu

SEQ ID NO: 601454 - RNA, 19 nt, Homo sapiens
cagaagaagugaagaccuu

SEQ ID NO: 601455 - RNA, 19 nt, Homo sapiens
cagagcaaauccaaaggua

SEQ ID NO: 601456 - RNA, 19 nt, Homo sapiens
gaaggcagcauguccaaug

SEQ ID NO: 601457 - RNA, 19 nt, Homo sapiens
caaaguguauccaggaaca

SEQ ID NO: 601458 - RNA, 19 nt, Homo sapiens
agauaaagauggcaaagga

SEQ ID NO: 601459 - RNA, 19 nt, Homo sapiens
gacaggaucucagacagaa

SEQ ID NO: 601460 - RNA, 19 nt, Homo sapiens
caggauaacaguuggauaa

SEQ ID NO: 601461 - RNA, 19 nt, Homo sapiens
ucucgaaucuguugcuaaa

SEQ ID NO: 601462 - RNA, 19 nt, Homo sapiens
gagcaaauccaaagguaga

SEQ ID NO: 601463 - RNA, 19 nt, Homo sapiens
gauaauaggcagauacauc

SEQ ID NO: 601464 - RNA, 19 nt, Homo sapiens
ggugauaguauuuggauuu

SEQ ID NO: 601465 - RNA, 19 nt, Homo sapiens
uaaauucucaugugucuga

SEQ ID NO: 601466 - RNA, 19 nt, Homo sapiens
cagaaaugaugcugcuaaa

SEQ ID NO: 601467 - RNA, 19 nt, Homo sapiens
gaaccuugcuacucuaaaa

SEQ ID NO: 601468 - RNA, 19 nt, Homo sapiens
uuacaaauuugcugccauu

SEQ ID NO: 601469 - RNA, 19 nt, Homo sapiens
ugauaggucugucauugaa

SEQ ID NO: 601470 - RNA, 19 nt, Homo sapiens
gaagaggcaguccugguuu

SEQ ID NO: 601471 - RNA, 19 nt, Homo sapiens
gaauaucucuggaaaauac

SEQ ID NO: 601472 - RNA, 19 nt, Homo sapiens
gcaguaaucagaaacaauc

SEQ ID NO: 601473 - RNA, 19 nt, Homo sapiens
ucacaaacaaccaaagaaa

SEQ ID NO: 601474 - RNA, 19 nt, Homo sapiens
caacaccuccaacaccaua

SEQ ID NO: 601475 - RNA, 19 nt, Homo sapiens
uaaagaaacgcccugaaga

SEQ ID NO: 601476 - RNA, 19 nt, Homo sapiens
gcuaaccucaucaaaguaa

SEQ ID NO: 601477 - RNA, 19 nt, Homo sapiens
caaagaccuuaauaacuuc

SEQ ID NO: 601478 - RNA, 19 nt, Homo sapiens
gugaagaauuggauaaucu

SEQ ID NO: 601479 - RNA, 19 nt, Homo sapiens
gcacaaggaaaucaagaug

SEQ ID NO: 601480 - RNA, 19 nt, Homo sapiens
gugaaugccaggaugaaua

SEQ ID NO: 601481 - RNA, 19 nt, Homo sapiens
gacaaaaucucgaaucugu

SEQ ID NO: 601482 - RNA, 19 nt, Homo sapiens
gcauuggacaggaaaguaa

SEQ ID NO: 601483 - RNA, 19 nt, Homo sapiens
gaaacaaucagagccaaga

SEQ ID NO: 601484 - RNA, 19 nt, Homo sapiens
gaaagaaacagaacuaacc

SEQ ID NO: 601485 - RNA, 19 nt, Homo sapiens
aaagaaacgcccugaagaa

SEQ ID NO: 601486 - RNA, 19 nt, Homo sapiens
guacaguucugaugacacu

SEQ ID NO: 601487 - RNA, 19 nt, Homo sapiens
cuacuacuccuguaaagaa

SEQ ID NO: 601488 - RNA, 19 nt, Homo sapiens
gcaagcagccuuuggaaaa

SEQ ID NO: 601489 - RNA, 19 nt, Homo sapiens
ggacaggaucucagacaga

SEQ ID NO: 601490 - RNA, 19 nt, Homo sapiens
gugcucaaccgacauaauu

SEQ ID NO: 601491 - RNA, 19 nt, Homo sapiens
ggauaacaguuggauaaag

SEQ ID NO: 601492 - RNA, 19 nt, Homo sapiens
ggauggauaucaggagaau

SEQ ID NO: 601493 - RNA, 19 nt, Homo sapiens
gccagagccuugauaaucu

SEQ ID NO: 601494 - RNA, 19 nt, Homo sapiens
gaccuugaugggcuuauua

SEQ ID NO: 601495 - RNA, 19 nt, Homo sapiens
ugaaugccaggaugaauaa

SEQ ID NO: 601496 - RNA, 19 nt, Homo sapiens
cagcugagacaggauaaua

SEQ ID NO: 601497 - RNA, 19 nt, Homo sapiens
aaagagaaguaaccaaggu

SEQ ID NO: 601498 - RNA, 19 nt, Homo sapiens
gguagaagaaagagagaaa

SEQ ID NO: 601499 - RNA, 19 nt, Homo sapiens
guucaaaugguuccagaaa

SEQ ID NO: 601500 - RNA, 19 nt, Homo sapiens
ucugauaggucugucauug

SEQ ID NO: 601501 - RNA, 19 nt, Homo sapiens
ggucuugaugaacauauua

SEQ ID NO: 601502 - RNA, 19 nt, Homo sapiens
cagaucugcugaaagaaau

SEQ ID NO: 601503 - RNA, 19 nt, Homo sapiens
aaacauauaaggccaauac

SEQ ID NO: 601504 - RNA, 19 nt, Homo sapiens
ggaaaguaaaugagagaga

SEQ ID NO: 601505 - RNA, 19 nt, Homo sapiens
ggucugucauugaaagaga

SEQ ID NO: 601506 - RNA, 19 nt, Homo sapiens
uugaugggcuuauuaaagu

SEQ ID NO: 601507 - RNA, 19 nt, Homo sapiens
gaagaagugaagaccuuga

SEQ ID NO: 601508 - RNA, 19 nt, Homo sapiens
ggccagagccuugauaauc

SEQ ID NO: 601509 - RNA, 19 nt, Homo sapiens
agaauuggauaaucucauc

SEQ ID NO: 601510 - RNA, 19 nt, Homo sapiens
uugcuaaccucaucaaagu

SEQ ID NO: 601511 - RNA, 19 nt, Homo sapiens
guuccaaagaccuuaauaa

SEQ ID NO: 601512 - RNA, 19 nt, Homo sapiens
caaagugaccccugaagua

SEQ ID NO: 601513 - RNA, 19 nt, Homo sapiens
gcugaaagaaauauaagug

SEQ ID NO: 601514 - RNA, 19 nt, Homo sapiens
aaagugaucccuucagcaa

SEQ ID NO: 601515 - RNA, 19 nt, Homo sapiens
uaauucccaugaugcauug

SEQ ID NO: 601516 - RNA, 19 nt, Homo sapiens
gaaagagauaugugcacuu

SEQ ID NO: 601517 - RNA, 19 nt, Homo sapiens
guaaucagaaacaaucaga

SEQ ID NO: 601518 - RNA, 19 nt, Homo sapiens
ucgaaucuguugcuaaagu

SEQ ID NO: 601519 - RNA, 19 nt, Homo sapiens
aacaaaagcuugaauagga

SEQ ID NO: 601520 - RNA, 19 nt, Homo sapiens
gacaggaaaguaaaugaga

SEQ ID NO: 601521 - RNA, 19 nt, Homo sapiens
gauaaagauggcaaaggaa

SEQ ID NO: 601522 - RNA, 19 nt, Homo sapiens
ccaguucuccuguuucuuc

SEQ ID NO: 601523 - RNA, 19 nt, Homo sapiens
ggaaguaacaaaguugcaa

SEQ ID NO: 601524 - RNA, 19 nt, Homo sapiens
cacggaagcagcaggauuu

SEQ ID NO: 601525 - RNA, 19 nt, Homo sapiens
acaauuagucgguacaguu

SEQ ID NO: 601526 - RNA, 19 nt, Homo sapiens
caacagaucugcugaaaga

SEQ ID NO: 601527 - RNA, 19 nt, Homo sapiens
ggacauauguggagaauag

SEQ ID NO: 601528 - RNA, 19 nt, Homo sapiens
ugacaaaggugaagaauug

SEQ ID NO: 601529 - RNA, 19 nt, Homo sapiens
ccaaagaccuuaauaacuu

SEQ ID NO: 601530 - RNA, 19 nt, Homo sapiens
caaaguaaauccugcagua

SEQ ID NO: 601531 - RNA, 19 nt, Homo sapiens
gaaacgcccugaagaagaa

SEQ ID NO: 601532 - RNA, 19 nt, Homo sapiens
gauaacaguuggauaaaga

SEQ ID NO: 601533 - RNA, 19 nt, Homo sapiens
gcagauacauccaccuaaa

SEQ ID NO: 601534 - RNA, 19 nt, Homo sapiens
caaauuugcugccauucua

SEQ ID NO: 601535 - RNA, 19 nt, Homo sapiens
uaaagugacuccugaaaga

SEQ ID NO: 601536 - RNA, 19 nt, Homo sapiens
aaagagauaugugcacuua

SEQ ID NO: 601537 - RNA, 19 nt, Homo sapiens
gaaguaaauucucaugugu

SEQ ID NO: 601538 - RNA, 19 nt, Homo sapiens
gaaaagcacucauuaagga

SEQ ID NO: 601539 - RNA, 19 nt, Homo sapiens
caaggugaauccugaaauu

SEQ ID NO: 601540 - RNA, 19 nt, Homo sapiens
gaaaguaaaugagagagau

SEQ ID NO: 601541 - RNA, 19 nt, Homo sapiens
gaagugaagaccuugauaa

SEQ ID NO: 601542 - RNA, 19 nt, Homo sapiens
ggaaguccgauuaaaguua

SEQ ID NO: 601543 - RNA, 19 nt, Homo sapiens
gaacuuucuuacaggauaa

SEQ ID NO: 601544 - RNA, 19 nt, Homo sapiens
uaaaguggauccugaaaca

SEQ ID NO: 601545 - RNA, 19 nt, Homo sapiens
gauaaucucaucaaaguga

SEQ ID NO: 601546 - RNA, 19 nt, Homo sapiens
cgacauaauucccaugaug

SEQ ID NO: 601547 - RNA, 19 nt, Homo sapiens
ggcagcauguccaauguua

SEQ ID NO: 601548 - RNA, 19 nt, Homo sapiens
gaucaacucuuguacaaaa

SEQ ID NO: 601549 - RNA, 19 nt, Homo sapiens
ugaaguaaaucccaaagga

SEQ ID NO: 601550 - RNA, 19 nt, Homo sapiens
gauaaccaacuaaccaaua

SEQ ID NO: 601551 - RNA, 19 nt, Homo sapiens
gugaagaccuugauaaugc

SEQ ID NO: 601552 - RNA, 19 nt, Homo sapiens
acaaggaaaucaagaugaa

SEQ ID NO: 601553 - RNA, 19 nt, Homo sapiens
ugaaguaaauucucaugug

SEQ ID NO: 601554 - RNA, 19 nt, Homo sapiens
gaauaggaaucaaggucuu

SEQ ID NO: 601555 - RNA, 19 nt, Homo sapiens
ggagucaggaucuugauaa

SEQ ID NO: 601556 - RNA, 19 nt, Homo sapiens
cagaagaagugaagaccuu

SEQ ID NO: 601557 - RNA, 19 nt, Homo sapiens
cagagcaaauccaaaggua

SEQ ID NO: 601558 - RNA, 19 nt, Homo sapiens
gaaggcagcauguccaaug

SEQ ID NO: 601559 - RNA, 19 nt, Homo sapiens
caaaguguauccaggaaca

SEQ ID NO: 601560 - RNA, 19 nt, Homo sapiens
agauaaagauggcaaagga

SEQ ID NO: 601561 - RNA, 19 nt, Homo sapiens
gacaggaucucagacagaa

SEQ ID NO: 601562 - RNA, 19 nt, Homo sapiens
caggauaacaguuggauaa

SEQ ID NO: 601563 - RNA, 19 nt, Homo sapiens
ucucgaaucuguugcuaaa

SEQ ID NO: 601564 - RNA, 19 nt, Homo sapiens
gagcaaauccaaagguaga

SEQ ID NO: 601565 - RNA, 19 nt, Homo sapiens
gauaauaggcagauacauc

SEQ ID NO: 601566 - RNA, 19 nt, Homo sapiens
ggugauaguauuuggauuu

SEQ ID NO: 601567 - RNA, 19 nt, Homo sapiens
uaaauucucaugugucuga

SEQ ID NO: 601568 - RNA, 19 nt, Homo sapiens
cagaaaugaugcugcuaaa

SEQ ID NO: 601569 - RNA, 19 nt, Homo sapiens
gaaccuugcuacucuaaaa

SEQ ID NO: 601570 - RNA, 19 nt, Homo sapiens
uuacaaauuugcugccauu

SEQ ID NO: 601571 - RNA, 19 nt, Homo sapiens
ugauaggucugucauugaa

SEQ ID NO: 601572 - RNA, 19 nt, Homo sapiens
gaagaggcaguccugguuu

SEQ ID NO: 601573 - RNA, 19 nt, Homo sapiens
gaauaucucuggaaaauac

SEQ ID NO: 601574 - RNA, 19 nt, Homo sapiens
gcaguaaucagaaacaauc

SEQ ID NO: 601575 - RNA, 19 nt, Homo sapiens
ucacaaacaaccaaagaaa

SEQ ID NO: 601576 - RNA, 19 nt, Homo sapiens
caacaccuccaacaccaua

SEQ ID NO: 601577 - RNA, 19 nt, Homo sapiens
uaaagaaacgcccugaaga

SEQ ID NO: 601578 - RNA, 19 nt, Homo sapiens
gcuaaccucaucaaaguaa

SEQ ID NO: 601579 - RNA, 19 nt, Homo sapiens
caaagaccuuaauaacuuc

SEQ ID NO: 601580 - RNA, 19 nt, Homo sapiens
gugaagaauuggauaaucu

SEQ ID NO: 601581 - RNA, 19 nt, Homo sapiens
gcacaaggaaaucaagaug

SEQ ID NO: 601582 - RNA, 19 nt, Homo sapiens
gugaaugccaggaugaaua

SEQ ID NO: 601583 - RNA, 19 nt, Homo sapiens
gacaaaaucucgaaucugu

SEQ ID NO: 601584 - RNA, 19 nt, Homo sapiens
gcauuggacaggaaaguaa

SEQ ID NO: 601585 - RNA, 19 nt, Homo sapiens
gaaacaaucagagccaaga

SEQ ID NO: 601586 - RNA, 19 nt, Homo sapiens
gaaagaaacagaacuaacc

SEQ ID NO: 601587 - RNA, 19 nt, Homo sapiens
ucagagaagugacaaaggu

SEQ ID NO: 601588 - RNA, 19 nt, Homo sapiens
aaagaaacgcccugaagaa

SEQ ID NO: 601589 - RNA, 19 nt, Homo sapiens
guacaguucugaugacacu

SEQ ID NO: 601590 - RNA, 19 nt, Homo sapiens
cuacuacuccuguaaagaa

SEQ ID NO: 601591 - RNA, 19 nt, Homo sapiens
gcaagcagccuuuggaaaa

SEQ ID NO: 601592 - RNA, 19 nt, Homo sapiens
ggacaggaucucagacaga

SEQ ID NO: 601593 - RNA, 19 nt, Homo sapiens
gugcucaaccgacauaauu

SEQ ID NO: 601594 - RNA, 19 nt, Homo sapiens
ggauaacaguuggauaaag

SEQ ID NO: 601595 - RNA, 19 nt, Homo sapiens
ggauggauaucaggagaau

SEQ ID NO: 601596 - RNA, 19 nt, Homo sapiens
gccagagccuugauaaucu

SEQ ID NO: 601597 - RNA, 19 nt, Homo sapiens
gaccuugaugggcuuauua

SEQ ID NO: 601598 - RNA, 19 nt, Homo sapiens
ugaaugccaggaugaauaa

SEQ ID NO: 601599 - RNA, 19 nt, Homo sapiens
gucaggaucuugauaacau

SEQ ID NO: 601600 - RNA, 19 nt, Homo sapiens
cagcugagacaggauaaua

SEQ ID NO: 601601 - RNA, 19 nt, Homo sapiens
aaagagaaguaaccaaggu

SEQ ID NO: 601602 - RNA, 19 nt, Homo sapiens
gguagaagaaagagagaaa

SEQ ID NO: 601603 - RNA, 19 nt, Homo sapiens
guucaaaugguuccagaaa

SEQ ID NO: 601604 - RNA, 19 nt, Homo sapiens
ucugauaggucugucauug

SEQ ID NO: 601605 - RNA, 19 nt, Homo sapiens
ggucuugaugaacauauua

SEQ ID NO: 601606 - RNA, 19 nt, Homo sapiens
cagaucugcugaaagaaau

SEQ ID NO: 601607 - RNA, 19 nt, Homo sapiens
aaacauauaaggccaauac

SEQ ID NO: 601608 - RNA, 19 nt, Homo sapiens
ggaaaguaaaugagagaga

SEQ ID NO: 601609 - RNA, 19 nt, Homo sapiens
ggucugucauugaaagaga

SEQ ID NO: 601610 - RNA, 19 nt, Homo sapiens
uugaugggcuuauuaaagu

SEQ ID NO: 601611 - RNA, 19 nt, Homo sapiens
gaagaagugaagaccuuga

SEQ ID NO: 601612 - RNA, 19 nt, Homo sapiens
ggccagagccuugauaauc

SEQ ID NO: 601613 - RNA, 19 nt, Homo sapiens
agaauuggauaaucucauc

SEQ ID NO: 601614 - RNA, 19 nt, Homo sapiens
ggugaagaauuggauaauc

SEQ ID NO: 601615 - RNA, 19 nt, Homo sapiens
gcugaaagaaauauaagga

SEQ ID NO: 601616 - RNA, 19 nt, Homo sapiens
uugcuaaccucaucaaagu

SEQ ID NO: 601617 - RNA, 19 nt, Homo sapiens
guuccaaagaccuuaauaa

SEQ ID NO: 601618 - RNA, 19 nt, Homo sapiens
caaagugaccccugaagua

SEQ ID NO: 601619 - RNA, 19 nt, Homo sapiens
aaagugaucccuucagcaa

SEQ ID NO: 601620 - RNA, 19 nt, Homo sapiens
uaauucccaugaugcauug

SEQ ID NO: 601621 - RNA, 19 nt, Homo sapiens
gaaagagauaugugcacuu

SEQ ID NO: 601622 - RNA, 19 nt, Homo sapiens
guaaucagaaacaaucaga

SEQ ID NO: 601623 - RNA, 19 nt, Homo sapiens
ucgaaucuguugcuaaagu

SEQ ID NO: 601624 - RNA, 19 nt, Homo sapiens
aacaaaagcuugaauagga

SEQ ID NO: 601625 - RNA, 19 nt, Homo sapiens
gacaggaaaguaaaugaga

SEQ ID NO: 601626 - RNA, 19 nt, Homo sapiens
gaaguucugucuugucaua

SEQ ID NO: 601627 - RNA, 19 nt, Homo sapiens
gaaaugccgucuuuacaaa

SEQ ID NO: 601628 - RNA, 19 nt, Homo sapiens
ccacaagaccuucaaguuu

SEQ ID NO: 601629 - RNA, 19 nt, Homo sapiens
cacaagaccuucaaguuug

SEQ ID NO: 601630 - RNA, 19 nt, Homo sapiens
cagacucgcuguccacuuu

SEQ ID NO: 601631 - RNA, 19 nt, Homo sapiens
gcacgcugcuucuuggauu

SEQ ID NO: 601632 - RNA, 19 nt, Homo sapiens
uaaaucagaugaagaagag

SEQ ID NO: 601633 - RNA, 19 nt, Homo sapiens
ugacaauucugcugagaug

SEQ ID NO: 601634 - RNA, 19 nt, Homo sapiens
gcgaaguucugucuuguca

SEQ ID NO: 601635 - RNA, 19 nt, Homo sapiens
ugaccaacaucgugaaaug

SEQ ID NO: 601636 - RNA, 19 nt, Homo sapiens
gccaggagccggcagauuu

SEQ ID NO: 601637 - RNA, 19 nt, Homo sapiens
gaugaaaugggucaacaaa

SEQ ID NO: 601638 - RNA, 19 nt, Homo sapiens
acacagcaaugggaacaua

SEQ ID NO: 601639 - RNA, 19 nt, Homo sapiens
gcuguucuuugacaaguuu

SEQ ID NO: 601640 - RNA, 19 nt, Homo sapiens
caaagaaucaggcaaugga

SEQ ID NO: 601641 - RNA, 19 nt, Homo sapiens
gguggacucuggaaaguuc

SEQ ID NO: 601642 - RNA, 19 nt, Homo sapiens
ccaaugcuuccaacaauuu

SEQ ID NO: 601643 - RNA, 19 nt, Homo sapiens
caccaaugcuuccaacaau

SEQ ID NO: 601644 - RNA, 19 nt, Homo sapiens
guaaaucagaugaagaaga

SEQ ID NO: 601645 - RNA, 19 nt, Homo sapiens
gguuuccucuuagguguua

SEQ ID NO: 601646 - RNA, 19 nt, Homo sapiens
acaacgagauucugagcaa

SEQ ID NO: 601647 - RNA, 19 nt, Homo sapiens
ggcaauggacauaauauau

SEQ ID NO: 601648 - RNA, 19 nt, Homo sapiens
ccagagggauggucaaggu

SEQ ID NO: 601649 - RNA, 19 nt, Homo sapiens
ccacaaagaaucaggcaau

SEQ ID NO: 601650 - RNA, 19 nt, Homo sapiens
gaacuuuccggaaugacaa

SEQ ID NO: 601651 - RNA, 19 nt, Homo sapiens
ugaaaugccgucuuuacaa

SEQ ID NO: 601652 - RNA, 19 nt, Homo sapiens
gcgcuugggucuccuacga

SEQ ID NO: 601653 - RNA, 19 nt, Homo sapiens
gcugagaugugccggaagu

SEQ ID NO: 601654 - RNA, 19 nt, Homo sapiens
gcauggacaggguguguuu

SEQ ID NO: 601655 - RNA, 19 nt, Homo sapiens
ugagaucgauguggucaga

SEQ ID NO: 601656 - RNA, 19 nt, Homo sapiens
gcucacaacgagauucuga

SEQ ID NO: 601657 - RNA, 19 nt, Homo sapiens
guugguggcugugcugauu

SEQ ID NO: 601658 - RNA, 19 nt, Homo sapiens
augcaaugcugaugaaaug

SEQ ID NO: 601659 - RNA, 19 nt, Homo sapiens
gaaucaggcaauggacaua

SEQ ID NO: 601660 - RNA, 19 nt, Homo sapiens
gcucugccguguccuugga

SEQ ID NO: 601661 - RNA, 19 nt, Homo sapiens
gcagcuggaccucacgaaa

SEQ ID NO: 601662 - RNA, 19 nt, Homo sapiens
ucuuagguguuaggaguua

SEQ ID NO: 601663 - RNA, 19 nt, Homo sapiens
uguaugcaaugcugaugaa

SEQ ID NO: 601664 - RNA, 19 nt, Homo sapiens
gcaaccaucaaacuucaug

SEQ ID NO: 601665 - RNA, 19 nt, Homo sapiens
gugcaaaccaggaacuuuc

SEQ ID NO: 601666 - RNA, 19 nt, Homo sapiens
gcacacagcaaugggaaca

SEQ ID NO: 601667 - RNA, 19 nt, Homo sapiens
aaugcgaaguucugucuug

SEQ ID NO: 601668 - RNA, 19 nt, Homo sapiens
gggaugccuuguaugcaau

SEQ ID NO: 601669 - RNA, 19 nt, Homo sapiens
gguugugacuuugguuguu

SEQ ID NO: 601670 - RNA, 19 nt, Homo sapiens
ucaggcaauggacauaaua

SEQ ID NO: 601671 - RNA, 19 nt, Homo sapiens
gagggauggucaaggucaa

SEQ ID NO: 601672 - RNA, 19 nt, Homo sapiens
gugaaaugccgucuuuaca

SEQ ID NO: 601673 - RNA, 19 nt, Homo sapiens
gguguuaggaguuaauaca

SEQ ID NO: 601674 - RNA, 19 nt, Homo sapiens
ggagaggauggaagagaga

SEQ ID NO: 601675 - RNA, 19 nt, Homo sapiens
cacaaagaaucaggcaaug

SEQ ID NO: 601676 - RNA, 19 nt, Homo sapiens
ccuguaaucccagcacuuu

SEQ ID NO: 601677 - RNA, 19 nt, Homo sapiens
ugaaaugggucaacaaaac

SEQ ID NO: 601678 - RNA, 19 nt, Homo sapiens
cugagacucugaugcuguu

SEQ ID NO: 601679 - RNA, 19 nt, Homo sapiens
gcuguccacuuucgucucu

SEQ ID NO: 601680 - RNA, 19 nt, Homo sapiens
agaccagccugaccaacau

SEQ ID NO: 601681 - RNA, 19 nt, Homo sapiens
gauguggucagagcuggua

SEQ ID NO: 601682 - RNA, 19 nt, Homo sapiens
cugcaaccaucaaacuuca

SEQ ID NO: 601683 - RNA, 19 nt, Homo sapiens
ccaggagccggcagauuug

SEQ ID NO: 601684 - RNA, 19 nt, Homo sapiens
uggucaaggucaaggauug

SEQ ID NO: 601685 - RNA, 19 nt, Homo sapiens
gcugcaaccaucaaacuuc

SEQ ID NO: 601686 - RNA, 19 nt, Homo sapiens
ugaggcggguggaucacuu

SEQ ID NO: 601687 - RNA, 19 nt, Homo sapiens
ccacugagacucugaugcu

SEQ ID NO: 601688 - RNA, 19 nt, Homo sapiens
ucucugagcagcaaaugga

SEQ ID NO: 601689 - RNA, 19 nt, Homo sapiens
aggcaauggacauaauaua

SEQ ID NO: 601690 - RNA, 19 nt, Homo sapiens
gcuuguaaaucagaugaag

SEQ ID NO: 601691 - RNA, 19 nt, Homo sapiens
acaccaaugcuuccaacaa

SEQ ID NO: 601692 - RNA, 19 nt, Homo sapiens
cugauugucuguuguugca

SEQ ID NO: 601693 - RNA, 19 nt, Homo sapiens
accaaugcuuccaacaauu

SEQ ID NO: 601694 - RNA, 19 nt, Homo sapiens
cgaaugcgaaguucugucu

SEQ ID NO: 601695 - RNA, 19 nt, Homo sapiens
ggggaugccuuguaugcaa

SEQ ID NO: 601696 - RNA, 19 nt, Homo sapiens
agacucugaugcuguucuu

SEQ ID NO: 601697 - RNA, 19 nt, Homo sapiens
ccaggaacacagcauguca

SEQ ID NO: 601698 - RNA, 19 nt, Homo sapiens
guugugacuuugguuguuc

SEQ ID NO: 601699 - RNA, 19 nt, Homo sapiens
gaccaggaacacagcaugu

SEQ ID NO: 601700 - RNA, 19 nt, Homo sapiens
cacagcaugucagugcaaa

SEQ ID NO: 601701 - RNA, 19 nt, Homo sapiens
aucgugaaaugccgucuuu

SEQ ID NO: 601702 - RNA, 19 nt, Homo sapiens
gcucagcugcaaccaucaa

SEQ ID NO: 601703 - RNA, 19 nt, Homo sapiens
cugaugcuguucuuugaca

SEQ ID NO: 601704 - RNA, 19 nt, Homo sapiens
cagcuuguaaaucagauga

SEQ ID NO: 601705 - RNA, 19 nt, Homo sapiens
ggagccggcagauuugaca

SEQ ID NO: 601706 - RNA, 19 nt, Homo sapiens
gccaccaccagcuagagua

SEQ ID NO: 601707 - RNA, 19 nt, Homo sapiens
ucaaacuucaugaucaauc

SEQ ID NO: 601708 - RNA, 19 nt, Homo sapiens
gauggaagagagacaugca

SEQ ID NO: 601709 - RNA, 19 nt, Homo sapiens
uguccacuuucgucucuga

SEQ ID NO: 601710 - RNA, 19 nt, Homo sapiens
ugauuuugguugugacuuu

SEQ ID NO: 601711 - RNA, 19 nt, Homo sapiens
uccacaagaccuucaaguu

SEQ ID NO: 601712 - RNA, 19 nt, Homo sapiens
acaauucugcugagaugug

SEQ ID NO: 601713 - RNA, 19 nt, Homo sapiens
gaugaagaagagagaaguc

SEQ ID NO: 601714 - RNA, 19 nt, Homo sapiens
gcucaaggcuucagaaaua

SEQ ID NO: 601715 - RNA, 19 nt, Homo sapiens
gagcauggcuucuaucuga

SEQ ID NO: 601716 - RNA, 19 nt, Homo sapiens
gcacggagcugacacuguu

SEQ ID NO: 601717 - RNA, 19 nt, Homo sapiens
agacagcacuuauauugua

SEQ ID NO: 601718 - RNA, 19 nt, Homo sapiens
caaagagacuacagagaaa

SEQ ID NO: 601719 - RNA, 19 nt, Homo sapiens
ggaaucaacuuguaugagu

SEQ ID NO: 601720 - RNA, 19 nt, Homo sapiens
gaggagaagucaccaaaga

SEQ ID NO: 601721 - RNA, 19 nt, Homo sapiens
agacagacauucuuugauu

SEQ ID NO: 601722 - RNA, 19 nt, Homo sapiens
cgacacggcuccugagaaa

SEQ ID NO: 601723 - RNA, 19 nt, Homo sapiens
gcaagaaaguccugcugaa

SEQ ID NO: 601724 - RNA, 19 nt, Homo sapiens
guacaauacuucagacugu

SEQ ID NO: 601725 - RNA, 19 nt, Homo sapiens
gaaagaaggacaaagacaa

SEQ ID NO: 601726 - RNA, 19 nt, Homo sapiens
ccaaagagacuacagagaa

SEQ ID NO: 601727 - RNA, 19 nt, Homo sapiens
gcagaggcccuaaagcuuu

SEQ ID NO: 601728 - RNA, 19 nt, Homo sapiens
ccagugauuuguauuaaga

SEQ ID NO: 601729 - RNA, 19 nt, Homo sapiens
agaaccagcugucuccaua

SEQ ID NO: 601730 - RNA, 19 nt, Homo sapiens
ggagacagacauucuuuga

SEQ ID NO: 601731 - RNA, 19 nt, Homo sapiens
guugaaagccugcagcuaa

SEQ ID NO: 601732 - RNA, 19 nt, Homo sapiens
gaaucaagcucacaaucag

SEQ ID NO: 601733 - RNA, 19 nt, Homo sapiens
ggaucaagcuguuaugaac

SEQ ID NO: 601734 - RNA, 19 nt, Homo sapiens
gguagacgcucccaagaag

SEQ ID NO: 601735 - RNA, 19 nt, Homo sapiens
gggccaagccucuguuaaa

SEQ ID NO: 601736 - RNA, 19 nt, Homo sapiens
uguaugaguugaugaagaa

SEQ ID NO: 601737 - RNA, 19 nt, Homo sapiens
guaagcuucccacacauua

SEQ ID NO: 601738 - RNA, 19 nt, Homo sapiens
cgaagcauguucagcauuc

SEQ ID NO: 601739 - RNA, 19 nt, Homo sapiens
ccugagaaauuuagcaaga

SEQ ID NO: 601740 - RNA, 19 nt, Homo sapiens
ccaccagugauuuguauua

SEQ ID NO: 601741 - RNA, 19 nt, Homo sapiens
ccaaggaccucacgauggu

SEQ ID NO: 601742 - RNA, 19 nt, Homo sapiens
gcgcuucacucucucuguu

SEQ ID NO: 601743 - RNA, 19 nt, Homo sapiens
ucagaaagaaggacaaaga

SEQ ID NO: 601744 - RNA, 19 nt, Homo sapiens
gaagucaucccugcuguau

SEQ ID NO: 601745 - RNA, 19 nt, Homo sapiens
ugucaucacucgagcagaa

SEQ ID NO: 601746 - RNA, 19 nt, Homo sapiens
guucaaggcugucaucacu

SEQ ID NO: 601747 - RNA, 19 nt, Homo sapiens
ucagcugccucaacuggua

SEQ ID NO: 601748 - RNA, 19 nt, Homo sapiens
ccaagccucuguuaaaguc

SEQ ID NO: 601749 - RNA, 19 nt, Homo sapiens
ugaagguucugcaugauca

SEQ ID NO: 601750 - RNA, 19 nt, Homo sapiens
caccagugauuuguauuaa

SEQ ID NO: 601751 - RNA, 19 nt, Homo sapiens
ccagcugucuccauaugaa

SEQ ID NO: 601752 - RNA, 19 nt, Homo sapiens
agucaucccugcuguauca

SEQ ID NO: 601753 - RNA, 19 nt, Homo sapiens
gacagacauucuuugauuc

SEQ ID NO: 601754 - RNA, 19 nt, Homo sapiens
ggaagaagaauacgguaag

SEQ ID NO: 601755 - RNA, 19 nt, Homo sapiens
uuucaaggcuucagucugu

SEQ ID NO: 601756 - RNA, 19 nt, Homo sapiens
guauacacguacauccaaa

SEQ ID NO: 601757 - RNA, 19 nt, Homo sapiens
ccuggaagcucucagaaag

SEQ ID NO: 601758 - RNA, 19 nt, Homo sapiens
acacggcuccugagaaauu

SEQ ID NO: 601759 - RNA, 19 nt, Homo sapiens
cgcaaucacuucugcauca

SEQ ID NO: 601760 - RNA, 19 nt, Homo sapiens
acaauguggugcauaugaa

SEQ ID NO: 601761 - RNA, 19 nt, Homo sapiens
uggaagcucucagaaagaa

SEQ ID NO: 601762 - RNA, 19 nt, Homo sapiens
gaaaguauacacguacauc

SEQ ID NO: 601763 - RNA, 19 nt, Homo sapiens
gggaagaagaauacgguaa

SEQ ID NO: 601764 - RNA, 19 nt, Homo sapiens
guucggcgcuucacucucu

SEQ ID NO: 601765 - RNA, 19 nt, Homo sapiens
ccuacaauguggugcauau

SEQ ID NO: 601766 - RNA, 19 nt, Homo sapiens
ggagaagucaccaaagaag

SEQ ID NO: 601767 - RNA, 19 nt, Homo sapiens
aaagauacccagauuccaa

SEQ ID NO: 601768 - RNA, 19 nt, Homo sapiens
ccagccggcuucauucaga

SEQ ID NO: 601769 - RNA, 19 nt, Homo sapiens
agaaaguccugcugaaguc

SEQ ID NO: 601770 - RNA, 19 nt, Homo sapiens
ucacauugccuaccgcuau

SEQ ID NO: 601771 - RNA, 19 nt, Homo sapiens
gguauguccugcuccuuuc

SEQ ID NO: 601772 - RNA, 19 nt, Homo sapiens
uugaaagccugcagcuaaa

SEQ ID NO: 601773 - RNA, 19 nt, Homo sapiens
cgacguggccauugacaug

SEQ ID NO: 601774 - RNA, 19 nt, Homo sapiens
ggccaagccucuguuaaag

SEQ ID NO: 601775 - RNA, 19 nt, Homo sapiens
gaagaagaauacgguaagc

SEQ ID NO: 601776 - RNA, 19 nt, Homo sapiens
gagcucaaggcuucagaaa

SEQ ID NO: 601777 - RNA, 19 nt, Homo sapiens
aaagacaacaccuacaaug

SEQ ID NO: 601778 - RNA, 19 nt, Homo sapiens
ggguauguccugcuccuuu

SEQ ID NO: 601779 - RNA, 19 nt, Homo sapiens
caagaacacaaacguuuua

SEQ ID NO: 601780 - RNA, 19 nt, Homo sapiens
caaggaaggacaagguuca

SEQ ID NO: 601781 - RNA, 19 nt, Homo sapiens
gguaagcuucccacacauu

SEQ ID NO: 601782 - RNA, 19 nt, Homo sapiens
ccuacgacguggccauuga

SEQ ID NO: 601783 - RNA, 19 nt, Homo sapiens
agacaacaccuacaaugug

SEQ ID NO: 601784 - RNA, 19 nt, Homo sapiens
acaaagacaacaccuacaa

SEQ ID NO: 601785 - RNA, 19 nt, Homo sapiens
ggaacaagaagagguuuca

SEQ ID NO: 601786 - RNA, 19 nt, Homo sapiens
gaaagccugcagcuaaaca

SEQ ID NO: 601787 - RNA, 19 nt, Homo sapiens
gagaaucaagcucacaauc

SEQ ID NO: 601788 - RNA, 19 nt, Homo sapiens
gacuuuggaucaagcuguu

SEQ ID NO: 601789 - RNA, 19 nt, Homo sapiens
cagaggagaagucaccaaa

SEQ ID NO: 601790 - RNA, 19 nt, Homo sapiens
gaaccuucucuucgcauga

SEQ ID NO: 601791 - RNA, 19 nt, Homo sapiens
cagaagguguuugguaugg

SEQ ID NO: 601792 - RNA, 19 nt, Homo sapiens
gcaucacggcggaguugua

SEQ ID NO: 601793 - RNA, 19 nt, Homo sapiens
guuaugaacaccagaaagu

SEQ ID NO: 601794 - RNA, 19 nt, Homo sapiens
ccuuugagcuccugggaau

SEQ ID NO: 601795 - RNA, 19 nt, Homo sapiens
caaagacaacaccuacaau

SEQ ID NO: 601796 - RNA, 19 nt, Homo sapiens
ugaugagcauggcuucuau

SEQ ID NO: 601797 - RNA, 19 nt, Homo sapiens
gaagcauguucagcauuca

SEQ ID NO: 601798 - RNA, 19 nt, Homo sapiens
ggaccaggcccucaagcau

SEQ ID NO: 601799 - RNA, 19 nt, Homo sapiens
cucagaagguguuugguau

SEQ ID NO: 601800 - RNA, 19 nt, Homo sapiens
ucucagaagguguuuggua

SEQ ID NO: 601801 - RNA, 19 nt, Homo sapiens
acgguaagcuucccacaca

SEQ ID NO: 601802 - RNA, 19 nt, Homo sapiens
gaaccagcugucuccauau

SEQ ID NO: 601803 - RNA, 19 nt, Homo sapiens
gaccuuugcugaggguaug

SEQ ID NO: 601804 - RNA, 19 nt, Homo sapiens
caggagacagacauucuuu

SEQ ID NO: 601805 - RNA, 19 nt, Homo sapiens
cagaaaguauacacguaca

SEQ ID NO: 601806 - RNA, 19 nt, Homo sapiens
agaaucaagcucacaauca

SEQ ID NO: 601807 - RNA, 19 nt, Homo sapiens
gcagaugcuuucgguagag

SEQ ID NO: 601808 - RNA, 19 nt, Homo sapiens
gguucugcaugaucacauu

SEQ ID NO: 601809 - RNA, 19 nt, Homo sapiens
gcaagacgaguuuugauga

SEQ ID NO: 601810 - RNA, 19 nt, Homo sapiens
aaauuuagcaagacgaguu

SEQ ID NO: 601811 - RNA, 19 nt, Homo sapiens
agaagaauacgguaagcuu

SEQ ID NO: 601812 - RNA, 19 nt, Homo sapiens
agacauucuuugauuccaa

SEQ ID NO: 601813 - RNA, 19 nt, Homo sapiens
uaugaacaccagaaaguau

SEQ ID NO: 601814 - RNA, 19 nt, Homo sapiens
gagcaagccuuucagguaa

SEQ ID NO: 601815 - RNA, 19 nt, Homo sapiens
caaccucgcucaucauuug

SEQ ID NO: 601816 - RNA, 19 nt, Homo sapiens
caaaagagcuguucaccua

SEQ ID NO: 601817 - RNA, 19 nt, Homo sapiens
gaauucuacucuuugguua

SEQ ID NO: 601818 - RNA, 19 nt, Homo sapiens
aaagaugacucgugaaguu

SEQ ID NO: 601819 - RNA, 19 nt, Homo sapiens
ucacagagguggcuuaugg

SEQ ID NO: 601820 - RNA, 19 nt, Homo sapiens
guuaauaggaugucucuaa

SEQ ID NO: 601821 - RNA, 19 nt, Homo sapiens
gguucuaacugccuucuuu

SEQ ID NO: 601822 - RNA, 19 nt, Homo sapiens
uauaagguuuggccuguaa

SEQ ID NO: 601823 - RNA, 19 nt, Homo sapiens
ggaugucucuaauuucuag

SEQ ID NO: 601824 - RNA, 19 nt, Homo sapiens
guacuucgccugugacaau

SEQ ID NO: 601825 - RNA, 19 nt, Homo sapiens
acaccuaccuucagauuuc

SEQ ID NO: 601826 - RNA, 19 nt, Homo sapiens
gcucaucauuuggcccuua

SEQ ID NO: 601827 - RNA, 19 nt, Homo sapiens
ucaccaaccucgcucauca

SEQ ID NO: 601828 - RNA, 19 nt, Homo sapiens
gaaacagauucgacaacug

SEQ ID NO: 601829 - RNA, 19 nt, Homo sapiens
gcccuuauccuuccuugua

SEQ ID NO: 601830 - RNA, 19 nt, Homo sapiens
ccuucaaacuccaaacaua

SEQ ID NO: 601831 - RNA, 19 nt, Homo sapiens
ggucagaaaugccugugau

SEQ ID NO: 601832 - RNA, 19 nt, Homo sapiens
ccagaaugaugcuaugugu

SEQ ID NO: 601833 - RNA, 19 nt, Homo sapiens
gaccugaauuggugagaug

SEQ ID NO: 601834 - RNA, 19 nt, Homo sapiens
ggaaagaugacucgugaag

SEQ ID NO: 601835 - RNA, 19 nt, Homo sapiens
ccaacuggcucugaaacuu

SEQ ID NO: 601836 - RNA, 19 nt, Homo sapiens
guccugagauucugcauca

SEQ ID NO: 601837 - RNA, 19 nt, Homo sapiens
guacaccuaccuucagauu

SEQ ID NO: 601838 - RNA, 19 nt, Homo sapiens
agagcaagccuuucaggua

SEQ ID NO: 601839 - RNA, 19 nt, Homo sapiens
gauuucugcuuacacuuug

SEQ ID NO: 601840 - RNA, 19 nt, Homo sapiens
gcuccuggcucgaguccuu

SEQ ID NO: 601841 - RNA, 19 nt, Homo sapiens
uaggaugucucuaauuucu

SEQ ID NO: 601842 - RNA, 19 nt, Homo sapiens
gaagaugagguaaggaaag

SEQ ID NO: 601843 - RNA, 19 nt, Homo sapiens
ggaagaugagguaaggaaa

SEQ ID NO: 601844 - RNA, 19 nt, Homo sapiens
uaaugaagagcaagccuuu

SEQ ID NO: 601845 - RNA, 19 nt, Homo sapiens
gggaagaugagguaaggaa

SEQ ID NO: 601846 - RNA, 19 nt, Homo sapiens
guauaagguuuggccugua

SEQ ID NO: 601847 - RNA, 19 nt, Homo sapiens
gugucucucuugaauauau

SEQ ID NO: 601848 - RNA, 19 nt, Homo sapiens
ugccugagcuucuguucuu

SEQ ID NO: 601849 - RNA, 19 nt, Homo sapiens
cgaauucuacucuuugguu

SEQ ID NO: 601850 - RNA, 19 nt, Homo sapiens
cagauguuguccugagauu

SEQ ID NO: 601851 - RNA, 19 nt, Homo sapiens
gguaagcaaauuaaaguuc

SEQ ID NO: 601852 - RNA, 19 nt, Homo sapiens
uggagccaguccugaguua

SEQ ID NO: 601853 - RNA, 19 nt, Homo sapiens
ccaguaugcuugcucucuu

SEQ ID NO: 601854 - RNA, 19 nt, Homo sapiens
aagaugagguaaggaaaga

SEQ ID NO: 601855 - RNA, 19 nt, Homo sapiens
cauucgaauucuacucuuu

SEQ ID NO: 601856 - RNA, 19 nt, Homo sapiens
gaagugggcccagcguuca

SEQ ID NO: 601857 - RNA, 19 nt, Homo sapiens
cuucaaacuccaaacauaa

SEQ ID NO: 601858 - RNA, 19 nt, Homo sapiens
gaugacucgugaaguuaau

SEQ ID NO: 601859 - RNA, 19 nt, Homo sapiens
gcccugaccuuccgguaca

SEQ ID NO: 601860 - RNA, 19 nt, Homo sapiens
aaagagcuguucaccuauc

SEQ ID NO: 601861 - RNA, 19 nt, Homo sapiens
uuauaucucugcaccacaa

SEQ ID NO: 601862 - RNA, 19 nt, Homo sapiens
uaugcuugcucucuucuug

SEQ ID NO: 601863 - RNA, 19 nt, Homo sapiens
agaaaugccugugaucucu

SEQ ID NO: 601864 - RNA, 19 nt, Homo sapiens
guucauucagguacuauuu

SEQ ID NO: 601865 - RNA, 19 nt, Homo sapiens
agaaugaugcuauguguag

SEQ ID NO: 601866 - RNA, 19 nt, Homo sapiens
agucuguucuuacuccuuu

SEQ ID NO: 601867 - RNA, 19 nt, Homo sapiens
caccugagccuuggaagaa

SEQ ID NO: 601868 - RNA, 19 nt, Homo sapiens
ggaccugaauuggugagau

SEQ ID NO: 601869 - RNA, 19 nt, Homo sapiens
ccgugaugcuuaugagauu

SEQ ID NO: 601870 - RNA, 19 nt, Homo sapiens
gcuguucaccuaucagaug

SEQ ID NO: 601871 - RNA, 19 nt, Homo sapiens
gguggcuuauggcagauuu

SEQ ID NO: 601872 - RNA, 19 nt, Homo sapiens
gcaucucucucuuucuuuu

SEQ ID NO: 601873 - RNA, 19 nt, Homo sapiens
gaaagaugacucgugaagu

SEQ ID NO: 601874 - RNA, 19 nt, Homo sapiens
gaugagguaaggaaagaug

SEQ ID NO: 601875 - RNA, 19 nt, Homo sapiens
caacuggcucugaaacuuc

SEQ ID NO: 601876 - RNA, 19 nt, Homo sapiens
guucaccuaucagauguug

SEQ ID NO: 601877 - RNA, 19 nt, Homo sapiens
cagguaagcaaauuaaagu

SEQ ID NO: 601878 - RNA, 19 nt, Homo sapiens
ucauucagguacuauuugu

SEQ ID NO: 601879 - RNA, 19 nt, Homo sapiens
gauguuguccugagauucu

SEQ ID NO: 601880 - RNA, 19 nt, Homo sapiens
cuaugcaucucucucuuuc

SEQ ID NO: 601881 - RNA, 19 nt, Homo sapiens
guccugaguuacagaaaca

SEQ ID NO: 601882 - RNA, 19 nt, Homo sapiens
cuuugucgcuuauccagaa

SEQ ID NO: 601883 - RNA, 19 nt, Homo sapiens
gagcuguucaccuaucaga

SEQ ID NO: 601884 - RNA, 19 nt, Homo sapiens
agaaacagauucgacaacu

SEQ ID NO: 601885 - RNA, 19 nt, Homo sapiens
cagccucauucgaauucua

SEQ ID NO: 601886 - RNA, 19 nt, Homo sapiens
ggaggagucccaggaggaa

SEQ ID NO: 601887 - RNA, 19 nt, Homo sapiens
caaucgagccuuguacuuc

SEQ ID NO: 601888 - RNA, 19 nt, Homo sapiens
gaccuuccgguacaggaua

SEQ ID NO: 601889 - RNA, 19 nt, Homo sapiens
gaaaugccugugaucucuu

SEQ ID NO: 601890 - RNA, 19 nt, Homo sapiens
uaugagauucgccuacuga

SEQ ID NO: 601891 - RNA, 19 nt, Homo sapiens
ccugugggcuggaaagucu

SEQ ID NO: 601892 - RNA, 19 nt, Homo sapiens
gagccaguccugaguuaca

SEQ ID NO: 601893 - RNA, 19 nt, Homo sapiens
augcaucucucucuuucuu

SEQ ID NO: 601894 - RNA, 19 nt, Homo sapiens
uugugucucucuugaauau

SEQ ID NO: 601895 - RNA, 19 nt, Homo sapiens
aagaugacucgugaaguua

SEQ ID NO: 601896 - RNA, 19 nt, Homo sapiens
guaaauccuguacaaugau

SEQ ID NO: 601897 - RNA, 19 nt, Homo sapiens
gugccagccucauucgaau

SEQ ID NO: 601898 - RNA, 19 nt, Homo sapiens
cuucauuccucuggacaaa

SEQ ID NO: 601899 - RNA, 19 nt, Homo sapiens
cuuacuccuuugucgcuua

SEQ ID NO: 601900 - RNA, 19 nt, Homo sapiens
gaauuggugagauggaauc

SEQ ID NO: 601901 - RNA, 19 nt, Homo sapiens
ugaguuacagaaacagauu

SEQ ID NO: 601902 - RNA, 19 nt, Homo sapiens
aaaguucaguuugcucauc

SEQ ID NO: 601903 - RNA, 19 nt, Homo sapiens
cagaaugaugcuaugugua

SEQ ID NO: 601904 - RNA, 19 nt, Homo sapiens
uauccagaaugaugcuaug

SEQ ID NO: 601905 - RNA, 19 nt, Homo sapiens
agauuucugcuuacacuuu

SEQ ID NO: 601906 - RNA, 19 nt, Homo sapiens
ucauuuggcccuuauccuu

SEQ ID NO: 601907 - RNA, 19 nt, Homo sapiens
ugcuagacguggucagaaa

SEQ ID NO: 601908 - RNA, 19 nt, Homo sapiens
gagccgugaugcuuaugag

SEQ ID NO: 601909 - RNA, 19 nt, Homo sapiens
gagauucugcaucacuguu

SEQ ID NO: 601910 - RNA, 19 nt, Homo sapiens
ucagguaagcaaauuaaag

SEQ ID NO: 601911 - RNA, 19 nt, Homo sapiens
caguaugcuugcucucuuc

SEQ ID NO: 601912 - RNA, 19 nt, Homo sapiens
ugccugugaucucuucauu

SEQ ID NO: 601913 - RNA, 19 nt, Homo sapiens
ucgcuuauccagaaugaug

SEQ ID NO: 601914 - RNA, 19 nt, Homo sapiens
guaccucgcuuaugcuuaa

SEQ ID NO: 601915 - RNA, 19 nt, Homo sapiens
gugaagaaccuuugugaua

SEQ ID NO: 601916 - RNA, 19 nt, Homo sapiens
gcauguugcuuagauauuu

SEQ ID NO: 601917 - RNA, 19 nt, Homo sapiens
ggacagacauuuguauaag

SEQ ID NO: 601918 - RNA, 19 nt, Homo sapiens
caugaagaguuguauguuu

SEQ ID NO: 601919 - RNA, 19 nt, Homo sapiens
gaagaaccuuugugauauc

SEQ ID NO: 601920 - RNA, 19 nt, Homo sapiens
ugaagaaccuuugugauau

SEQ ID NO: 601921 - RNA, 19 nt, Homo sapiens
uggagugacuugugaauuu

SEQ ID NO: 601922 - RNA, 19 nt, Homo sapiens
ggaggagcaugaagaguug

SEQ ID NO: 601923 - RNA, 19 nt, Homo sapiens
cagaauggcuccaauccuu

SEQ ID NO: 601924 - RNA, 19 nt, Homo sapiens
uaaugaagcucaagaaacu

SEQ ID NO: 601925 - RNA, 19 nt, Homo sapiens
gcccaaagcuggcaaagag

SEQ ID NO: 601926 - RNA, 19 nt, Homo sapiens
ucagggaucuguaugaaau

SEQ ID NO: 601927 - RNA, 19 nt, Homo sapiens
gaaacagaauggcuccaau

SEQ ID NO: 601928 - RNA, 19 nt, Homo sapiens
gcaaagagaaggugguaau

SEQ ID NO: 601929 - RNA, 19 nt, Homo sapiens
ugaaacgaguuacauguga

SEQ ID NO: 601930 - RNA, 19 nt, Homo sapiens
gaagggaggagcaugaaga

SEQ ID NO: 601931 - RNA, 19 nt, Homo sapiens
aaagagaaauggcgaacga

SEQ ID NO: 601932 - RNA, 19 nt, Homo sapiens
aagagaaggugguaaugaa

SEQ ID NO: 601933 - RNA, 19 nt, Homo sapiens
gcagagaugaggccaagaa

SEQ ID NO: 601934 - RNA, 19 nt, Homo sapiens
ugaaccgugugauuuauuu

SEQ ID NO: 601935 - RNA, 19 nt, Homo sapiens
ggucuuguguccucuauag

SEQ ID NO: 601936 - RNA, 19 nt, Homo sapiens
ucgcuuaugcuuaacauua

SEQ ID NO: 601937 - RNA, 19 nt, Homo sapiens
gcacuggucguaaaugguu

SEQ ID NO: 601938 - RNA, 19 nt, Homo sapiens
ggagaagggaggagcauga

SEQ ID NO: 601939 - RNA, 19 nt, Homo sapiens
gcucaccacuacuacuauu

SEQ ID NO: 601940 - RNA, 19 nt, Homo sapiens
ggagugacuugugaauuuc

SEQ ID NO: 601941 - RNA, 19 nt, Homo sapiens
gggaggagcaugaagaguu

SEQ ID NO: 601942 - RNA, 19 nt, Homo sapiens
gggacagacauuuguauaa

SEQ ID NO: 601943 - RNA, 19 nt, Homo sapiens
cuuaguauuugcugaauga

SEQ ID NO: 601944 - RNA, 19 nt, Homo sapiens
gugauauccugaacccuuu

SEQ ID NO: 601945 - RNA, 19 nt, Homo sapiens
caacugagcagagcauuca

SEQ ID NO: 601946 - RNA, 19 nt, Homo sapiens
gagcacuggucguaaaugg

SEQ ID NO: 601947 - RNA, 19 nt, Homo sapiens
caugaucacuguggcauau

SEQ ID NO: 601948 - RNA, 19 nt, Homo sapiens
caucuaacauugauugaac

SEQ ID NO: 601949 - RNA, 19 nt, Homo sapiens
gugcuggagugacuuguga

SEQ ID NO: 601950 - RNA, 19 nt, Homo sapiens
gacagacauuuguauaagu

SEQ ID NO: 601951 - RNA, 19 nt, Homo sapiens
ggacuuggaggucuugugu

SEQ ID NO: 601952 - RNA, 19 nt, Homo sapiens
gcuccaauccuuucuacuu

SEQ ID NO: 601953 - RNA, 19 nt, Homo sapiens
gguaaugaagcucaagaaa

SEQ ID NO: 601954 - RNA, 19 nt, Homo sapiens
gaugaaacgaguuacaugu

SEQ ID NO: 601955 - RNA, 19 nt, Homo sapiens
ccucuggcaucaacaaaga

SEQ ID NO: 601956 - RNA, 19 nt, Homo sapiens
uggcauauccucagaugaa

SEQ ID NO: 601957 - RNA, 19 nt, Homo sapiens
uagcaggcaugaucacugu

SEQ ID NO: 601958 - RNA, 19 nt, Homo sapiens
gggcaaagaaagagaaauc

SEQ ID NO: 601959 - RNA, 19 nt, Homo sapiens
gagcuuaguauuugcugaa

SEQ ID NO: 601960 - RNA, 19 nt, Homo sapiens
ggucucaccucuggcauca

SEQ ID NO: 601961 - RNA, 19 nt, Homo sapiens
cguaaaugguucagacuag

SEQ ID NO: 601962 - RNA, 19 nt, Homo sapiens
agugggagcuuaguauuug

SEQ ID NO: 601963 - RNA, 19 nt, Homo sapiens
gucauacugugcuuccuuu

SEQ ID NO: 601964 - RNA, 19 nt, Homo sapiens
ugugagcacuggucguaaa

SEQ ID NO: 601965 - RNA, 19 nt, Homo sapiens
caaccugaaccgugugauu

SEQ ID NO: 601966 - RNA, 19 nt, Homo sapiens
guaaugaagcucaagaaac

SEQ ID NO: 601967 - RNA, 19 nt, Homo sapiens
agucacaggccaugucaua

SEQ ID NO: 601968 - RNA, 19 nt, Homo sapiens
ggaaacagaauggcuccaa

SEQ ID NO: 601969 - RNA, 19 nt, Homo sapiens
gggcugcucaccacuacua

SEQ ID NO: 601970 - RNA, 19 nt, Homo sapiens
ucaugccacugaccuggua

SEQ ID NO: 601971 - RNA, 19 nt, Homo sapiens
aaagagaaggugguaauga

SEQ ID NO: 601972 - RNA, 19 nt, Homo sapiens
caugcauguugcuuagaua

SEQ ID NO: 601973 - RNA, 19 nt, Homo sapiens
gcauagugggagcuuagua

SEQ ID NO: 601974 - RNA, 19 nt, Homo sapiens
gcuuagauauuuguuagag

SEQ ID NO: 601975 - RNA, 19 nt, Homo sapiens
auacugugcuuccuuucuu

SEQ ID NO: 601976 - RNA, 19 nt, Homo sapiens
ccaaagcuggcaaagagaa

SEQ ID NO: 601977 - RNA, 19 nt, Homo sapiens
gcagaugaaacgaguuaca

SEQ ID NO: 601978 - RNA, 19 nt, Homo sapiens
ugucagggaucuguaugaa

SEQ ID NO: 601979 - RNA, 19 nt, Homo sapiens
cuacuacuauucucuucug

SEQ ID NO: 601980 - RNA, 19 nt, Homo sapiens
cagacuaggcaauguggua

SEQ ID NO: 601981 - RNA, 19 nt, Homo sapiens
gcaugaagaguuguauguu

SEQ ID NO: 601982 - RNA, 19 nt, Homo sapiens
acagacauuuguauaaguc

SEQ ID NO: 601983 - RNA, 19 nt, Homo sapiens
gaauggcuccaauccuuuc

SEQ ID NO: 601984 - RNA, 19 nt, Homo sapiens
ccaauccuuucuacuucuu

SEQ ID NO: 601985 - RNA, 19 nt, Homo sapiens
ccugguaccucgcuuaugc

SEQ ID NO: 601986 - RNA, 19 nt, Homo sapiens
gagaagggaggagcaugaa

SEQ ID NO: 601987 - RNA, 19 nt, Homo sapiens
gcaaagaaagagaaaucag

SEQ ID NO: 601988 - RNA, 19 nt, Homo sapiens
cugcagaugaaacgaguua

SEQ ID NO: 601989 - RNA, 19 nt, Homo sapiens
cauguugcuuagauauuug

SEQ ID NO: 601990 - RNA, 19 nt, Homo sapiens
uaacauuagccaaccugaa

SEQ ID NO: 601991 - RNA, 19 nt, Homo sapiens
cauagugggagcuuaguau

SEQ ID NO: 601992 - RNA, 19 nt, Homo sapiens
gcaugaucacuguggcaua

SEQ ID NO: 601993 - RNA, 19 nt, Homo sapiens
ugauugaacaucucuuaug

SEQ ID NO: 601994 - RNA, 19 nt, Homo sapiens
caaagagaaggugguaaug

SEQ ID NO: 601995 - RNA, 19 nt, Homo sapiens
gagggcugcucaccacuac

SEQ ID NO: 601996 - RNA, 19 nt, Homo sapiens
gagccacucaguacacaug

SEQ ID NO: 601997 - RNA, 19 nt, Homo sapiens
cagugaagaaccuuuguga

SEQ ID NO: 601998 - RNA, 19 nt, Homo sapiens
caugugagcauuuaacaac

SEQ ID NO: 601999 - RNA, 19 nt, Homo sapiens
aaacagaauggcuccaauc

SEQ ID NO: 602000 - RNA, 19 nt, Homo sapiens
ccacuacuacuauucucuu

SEQ ID NO: 602001 - RNA, 19 nt, Homo sapiens
ccugaaccgugugauuuau

SEQ ID NO: 602002 - RNA, 19 nt, Homo sapiens
gcaacugagcagagcauuc

SEQ ID NO: 602003 - RNA, 19 nt, Homo sapiens
gcuuaguauuugcugaaug

SEQ ID NO: 602004 - RNA, 19 nt, Homo sapiens
gagcaugaagaguuguaug

SEQ ID NO: 602005 - RNA, 19 nt, Homo sapiens
gugcuuccuuucuuguuca

SEQ ID NO: 602006 - RNA, 19 nt, Homo sapiens
ggugggacagacauuugua

SEQ ID NO: 602007 - RNA, 19 nt, Homo sapiens
caugugacagggcaaagaa

SEQ ID NO: 602008 - RNA, 19 nt, Homo sapiens
uagugggagcuuaguauuu

SEQ ID NO: 602009 - RNA, 19 nt, Homo sapiens
ggagugcuggagugacuug

SEQ ID NO: 602010 - RNA, 19 nt, Homo sapiens
ugggacagacauuuguaua

SEQ ID NO: 602011 - RNA, 19 nt, Homo sapiens
cuccaauccuuucuacuuc

SEQ ID NO: 602012 - RNA, 19 nt, Homo sapiens
cccaggauccucuuugguu

SEQ ID NO: 602013 - RNA, 19 nt, Homo sapiens
gcaucaacaaagagaaaug

SEQ ID NO: 602014 - RNA, 19 nt, Homo sapiens
uggaagauguccugaauua

SEQ ID NO: 602015 - RNA, 19 nt, Homo sapiens
gaucaugccuggccauauu

SEQ ID NO: 602016 - RNA, 19 nt, Homo sapiens
gaaccacgaucuacaagga

SEQ ID NO: 602017 - RNA, 19 nt, Homo sapiens
agagaaugcugcagaauuu

SEQ ID NO: 602018 - RNA, 19 nt, Homo sapiens
gaaauucccuugguugugu

SEQ ID NO: 602019 - RNA, 19 nt, Homo sapiens
gggcuuaccugucuuuaau

SEQ ID NO: 602020 - RNA, 19 nt, Homo sapiens
ggaagaugcuaugaaagaa

SEQ ID NO: 602021 - RNA, 19 nt, Homo sapiens
agaggaagaugcuaugaaa

SEQ ID NO: 602022 - RNA, 19 nt, Homo sapiens
gaagauguccugaauuaag

SEQ ID NO: 602023 - RNA, 19 nt, Homo sapiens
gaucuggcacccugacuua

SEQ ID NO: 602024 - RNA, 19 nt, Homo sapiens
caacugcccuggagucauc

SEQ ID NO: 602025 - RNA, 19 nt, Homo sapiens
caacggcuucugucauuua

SEQ ID NO: 602026 - RNA, 19 nt, Homo sapiens
gguggaagauguccugaau

SEQ ID NO: 602027 - RNA, 19 nt, Homo sapiens
caacauaauucagguccaa

SEQ ID NO: 602028 - RNA, 19 nt, Homo sapiens
caucaauccuggagaaugu

SEQ ID NO: 602029 - RNA, 19 nt, Homo sapiens
gaagaugcuaugaaagaaa

SEQ ID NO: 602030 - RNA, 19 nt, Homo sapiens
gaaaagacaaggcuaauug

SEQ ID NO: 602031 - RNA, 19 nt, Homo sapiens
gcaguuugcuucuguuguc

SEQ ID NO: 602032 - RNA, 19 nt, Homo sapiens
gcaaacagggcaccuuuca

SEQ ID NO: 602033 - RNA, 19 nt, Homo sapiens
ccacagaaggcaucauauu

SEQ ID NO: 602034 - RNA, 19 nt, Homo sapiens
guguaucacugaaggaauu

SEQ ID NO: 602035 - RNA, 19 nt, Homo sapiens
gcaacggcuucugucauuu

SEQ ID NO: 602036 - RNA, 19 nt, Homo sapiens
caucugggcuuaccugucu

SEQ ID NO: 602037 - RNA, 19 nt, Homo sapiens
aagauguccugaauuaaga

SEQ ID NO: 602038 - RNA, 19 nt, Homo sapiens
acagaaggcaucauauuga

SEQ ID NO: 602039 - RNA, 19 nt, Homo sapiens
agaagagaaugcugcagaa

SEQ ID NO: 602040 - RNA, 19 nt, Homo sapiens
caaacucguuggaggaaca

SEQ ID NO: 602041 - RNA, 19 nt, Homo sapiens
ggaagauguccugaauuaa

SEQ ID NO: 602042 - RNA, 19 nt, Homo sapiens
ugaaauuggugguaaugca

SEQ ID NO: 602043 - RNA, 19 nt, Homo sapiens
gaaaggaggccagacacau

SEQ ID NO: 602044 - RNA, 19 nt, Homo sapiens
ggcagaaauucccuugguu

SEQ ID NO: 602045 - RNA, 19 nt, Homo sapiens
cggcuucugucauuuaugu

SEQ ID NO: 602046 - RNA, 19 nt, Homo sapiens
gaucuacaaggaauuugaa

SEQ ID NO: 602047 - RNA, 19 nt, Homo sapiens
guccuucauugcugguuua

SEQ ID NO: 602048 - RNA, 19 nt, Homo sapiens
aaacagggcaccuuucaca

SEQ ID NO: 602049 - RNA, 19 nt, Homo sapiens
cacagaaggcaucauauug

SEQ ID NO: 602050 - RNA, 19 nt, Homo sapiens
ggaaggauuggcauugugu

SEQ ID NO: 602051 - RNA, 19 nt, Homo sapiens
gaaggaggccaaagaacag

SEQ ID NO: 602052 - RNA, 19 nt, Homo sapiens
gaaaagaggaagaugcuau

SEQ ID NO: 602053 - RNA, 19 nt, Homo sapiens
ugaaggaggccaaagaaca

SEQ ID NO: 602054 - RNA, 19 nt, Homo sapiens
uuaccugucuuuaauacug

SEQ ID NO: 602055 - RNA, 19 nt, Homo sapiens
gaauggaucacguagacau

SEQ ID NO: 602056 - RNA, 19 nt, Homo sapiens
ggaguuguggucaguaugu

SEQ ID NO: 602057 - RNA, 19 nt, Homo sapiens
cagcaggcauuggaauaug

SEQ ID NO: 602058 - RNA, 19 nt, Homo sapiens
agcaacggcuucugucauu

SEQ ID NO: 602059 - RNA, 19 nt, Homo sapiens
gaagagaaugcugcagaau

SEQ ID NO: 602060 - RNA, 19 nt, Homo sapiens
uuuauugacugccucgaaa

SEQ ID NO: 602061 - RNA, 19 nt, Homo sapiens
ggacaugguacgagucaag

SEQ ID NO: 602062 - RNA, 19 nt, Homo sapiens
ggaaaggaggccagacaca

SEQ ID NO: 602063 - RNA, 19 nt, Homo sapiens
aggaagaugcuaugaaaga

SEQ ID NO: 602064 - RNA, 19 nt, Homo sapiens
caggaguuguggucaguau

SEQ ID NO: 602065 - RNA, 19 nt, Homo sapiens
ccuguaguguccuucauug

SEQ ID NO: 602066 - RNA, 19 nt, Homo sapiens
ugacugccucgaaaucuuu

SEQ ID NO: 602067 - RNA, 19 nt, Homo sapiens
agucaucaauccuggagaa

SEQ ID NO: 602068 - RNA, 19 nt, Homo sapiens
gccagcaggcauuggaaua

SEQ ID NO: 602069 - RNA, 19 nt, Homo sapiens
gaauucggcauuguuccua

SEQ ID NO: 602070 - RNA, 19 nt, Homo sapiens
cuucauugcugguuuaacu

SEQ ID NO: 602071 - RNA, 19 nt, Homo sapiens
aagagaaugcugcagaauu

SEQ ID NO: 602072 - RNA, 19 nt, Homo sapiens
gcuuaccugucuuuaauac

SEQ ID NO: 602073 - RNA, 19 nt, Homo sapiens
uggaucacguagacaugua

SEQ ID NO: 602074 - RNA, 19 nt, Homo sapiens
aaaacaagguggaagaugu

SEQ ID NO: 602075 - RNA, 19 nt, Homo sapiens
gcauuggaggugauccuuu

SEQ ID NO: 602076 - RNA, 19 nt, Homo sapiens
ggaucacguagacauguaa

SEQ ID NO: 602077 - RNA, 19 nt, Homo sapiens
gagcaacggcuucugucau

SEQ ID NO: 602078 - RNA, 19 nt, Homo sapiens
uggaauggaucacguagac

SEQ ID NO: 602079 - RNA, 19 nt, Homo sapiens
cuggcacccugacuuauga

SEQ ID NO: 602080 - RNA, 19 nt, Homo sapiens
gaaaagguggagcuaaaga

SEQ ID NO: 602081 - RNA, 19 nt, Homo sapiens
aaaggaaggauuggcauug

SEQ ID NO: 602082 - RNA, 19 nt, Homo sapiens
aaacugcugcgccaggaaa

SEQ ID NO: 602083 - RNA, 19 nt, Homo sapiens
aaagguggagcuaaagaga

SEQ ID NO: 602084 - RNA, 19 nt, Homo sapiens
cacccugacuuaugaagca

SEQ ID NO: 602085 - RNA, 19 nt, Homo sapiens
ggagcaacggcuucuguca

SEQ ID NO: 602086 - RNA, 19 nt, Homo sapiens
uguccugaauuaagacguu

SEQ ID NO: 602087 - RNA, 19 nt, Homo sapiens
gggagaagaaugggucaug

SEQ ID NO: 602088 - RNA, 19 nt, Homo sapiens
aaggaaggauuggcauugu

SEQ ID NO: 602089 - RNA, 19 nt, Homo sapiens
cagaaauucccuugguugu

SEQ ID NO: 602090 - RNA, 19 nt, Homo sapiens
ccaagccuguaguguccuu

SEQ ID NO: 602091 - RNA, 19 nt, Homo sapiens
uggcaaacagggcaccuuu

SEQ ID NO: 602092 - RNA, 19 nt, Homo sapiens
cauuggaggugauccuuuu

SEQ ID NO: 602093 - RNA, 19 nt, Homo sapiens
gaagcaguucaccaaacaa

SEQ ID NO: 602094 - RNA, 19 nt, Homo sapiens
ggcauuguguccagaucug

SEQ ID NO: 602095 - RNA, 19 nt, Homo sapiens
ggaaaagacaaggcuaauu

SEQ ID NO: 602096 - RNA, 19 nt, Homo sapiens
aggcagaaauucccuuggu

SEQ ID NO: 602097 - RNA, 19 nt, Homo sapiens
ccauuaaugaagcuauuga

SEQ ID NO: 602098 - RNA, 19 nt, Homo sapiens
ccagcaggcauuggaauau

SEQ ID NO: 602099 - RNA, 19 nt, Homo sapiens
ccgcugacaucgcuaccau

SEQ ID NO: 602100 - RNA, 19 nt, Homo sapiens
aggaaaagguggagcuaaa

SEQ ID NO: 602101 - RNA, 19 nt, Homo sapiens
ggaauauggcaccaaacuc

SEQ ID NO: 602102 - RNA, 19 nt, Homo sapiens
gaggugauccuuuuaaugg

SEQ ID NO: 602103 - RNA, 19 nt, Homo sapiens
gggaucaugccuggccaua

SEQ ID NO: 602104 - RNA, 19 nt, Homo sapiens
ugccauuaaugaagcuauu

SEQ ID NO: 602105 - RNA, 19 nt, Homo sapiens
ucuguuguccacugauuaa

SEQ ID NO: 602106 - RNA, 19 nt, Homo sapiens
cuucuguuguccacugauu

SEQ ID NO: 602107 - RNA, 19 nt, Homo sapiens
aaaggaggccagacacauc

SEQ ID NO: 602108 - RNA, 19 nt, Homo sapiens
cgaucuacaaggaauuuga

SEQ ID NO: 602109 - RNA, 19 nt, Homo sapiens
guccugaauuaagacguuu

SEQ ID NO: 602110 - RNA, 19 nt, Homo sapiens
caaauuccaagccuguagu

SEQ ID NO: 602111 - RNA, 19 nt, Homo sapiens
ccaaauuccaagccuguag

SEQ ID NO: 602112 - RNA, 19 nt, Homo sapiens
ggugaaauuggugguaaug

SEQ ID NO: 602113 - RNA, 19 nt, Homo sapiens
uuggugaaauuggugguaa

SEQ ID NO: 602114 - RNA, 19 nt, Homo sapiens
gcaguuaucuucuuucuuu

SEQ ID NO: 602115 - RNA, 19 nt, Homo sapiens
aaacguaacuugcaauuug

SEQ ID NO: 602116 - RNA, 19 nt, Homo sapiens
gcaaaggaaucucucacua

SEQ ID NO: 602117 - RNA, 19 nt, Homo sapiens
ggaugaagcugcuagaaug

SEQ ID NO: 602118 - RNA, 19 nt, Homo sapiens
ggacaaagaugcugcuaag

SEQ ID NO: 602119 - RNA, 19 nt, Homo sapiens
ucaagguccuguauuaaua

SEQ ID NO: 602120 - RNA, 19 nt, Homo sapiens
gauacaaaguucuucauug

SEQ ID NO: 602121 - RNA, 19 nt, Homo sapiens
gggaaguucuggauuguuu

SEQ ID NO: 602122 - RNA, 19 nt, Homo sapiens
guacgaagcauguauaaug

SEQ ID NO: 602123 - RNA, 19 nt, Homo sapiens
guaaagcucucugaaauag

SEQ ID NO: 602124 - RNA, 19 nt, Homo sapiens
aaacagagcuuucaaacac

SEQ ID NO: 602125 - RNA, 19 nt, Homo sapiens
agaugaagcuuaugcaauu

SEQ ID NO: 602126 - RNA, 19 nt, Homo sapiens
cauuuaagcuuaucacuuc

SEQ ID NO: 602127 - RNA, 19 nt, Homo sapiens
caaaagaugucgugauaaa

SEQ ID NO: 602128 - RNA, 19 nt, Homo sapiens
ucuaauaacuagccucauu

SEQ ID NO: 602129 - RNA, 19 nt, Homo sapiens
gcaaaucucaacuacauug

SEQ ID NO: 602130 - RNA, 19 nt, Homo sapiens
ucaaguaacagaagcauuu

SEQ ID NO: 602131 - RNA, 19 nt, Homo sapiens
gcauuuaauuguaccauuc

SEQ ID NO: 602132 - RNA, 19 nt, Homo sapiens
ggauuuggacugcauuuaa

SEQ ID NO: 602133 - RNA, 19 nt, Homo sapiens
caaacacuccucagaauau

SEQ ID NO: 602134 - RNA, 19 nt, Homo sapiens
cagaauaugcaaucaagua

SEQ ID NO: 602135 - RNA, 19 nt, Homo sapiens
caaaggaggagugaagaua

SEQ ID NO: 602136 - RNA, 19 nt, Homo sapiens
ggacugcauuuaauuguac

SEQ ID NO: 602137 - RNA, 19 nt, Homo sapiens
gauuuggacugcauuuaau

SEQ ID NO: 602138 - RNA, 19 nt, Homo sapiens
gguggaagauucagaugga

SEQ ID NO: 602139 - RNA, 19 nt, Homo sapiens
gaaguucuggauuguuuaa

SEQ ID NO: 602140 - RNA, 19 nt, Homo sapiens
aauacuguguucuguguua

SEQ ID NO: 602141 - RNA, 19 nt, Homo sapiens
caggagagaauacuacuuu

SEQ ID NO: 602142 - RNA, 19 nt, Homo sapiens
agauggagcuguauugugu

SEQ ID NO: 602143 - RNA, 19 nt, Homo sapiens
aaaggaaucucucacuaca

SEQ ID NO: 602144 - RNA, 19 nt, Homo sapiens
gugguacgguuacaaggua

SEQ ID NO: 602145 - RNA, 19 nt, Homo sapiens
gaagcaagcacauguggau

SEQ ID NO: 602146 - RNA, 19 nt, Homo sapiens
ggauuuccaccuaauauug

SEQ ID NO: 602147 - RNA, 19 nt, Homo sapiens
caaaggauauguggcaaag

SEQ ID NO: 602148 - RNA, 19 nt, Homo sapiens
ucaaacacuccucagaaua

SEQ ID NO: 602149 - RNA, 19 nt, Homo sapiens
gaaauuucaguugccaaua

SEQ ID NO: 602150 - RNA, 19 nt, Homo sapiens
aaagcucucugaaauagug

SEQ ID NO: 602151 - RNA, 19 nt, Homo sapiens
ggagcuguauuguguaugg

SEQ ID NO: 602152 - RNA, 19 nt, Homo sapiens
ugagucuccugaagcaaua

SEQ ID NO: 602153 - RNA, 19 nt, Homo sapiens
cugcaagucuucaugauuc

SEQ ID NO: 602154 - RNA, 19 nt, Homo sapiens
aaacacugauuaacugcaa

SEQ ID NO: 602155 - RNA, 19 nt, Homo sapiens
gcaccaaauacaugauaaa

SEQ ID NO: 602156 - RNA, 19 nt, Homo sapiens
ggauacaaaguucuucauu

SEQ ID NO: 602157 - RNA, 19 nt, Homo sapiens
uggccucgauggaaauaua

SEQ ID NO: 602158 - RNA, 19 nt, Homo sapiens
aggcaaaucucaacuacau

SEQ ID NO: 602159 - RNA, 19 nt, Homo sapiens
gaugcaaccaugauagaaa

SEQ ID NO: 602160 - RNA, 19 nt, Homo sapiens
aagaugggauuuccaccua

SEQ ID NO: 602161 - RNA, 19 nt, Homo sapiens
gaaaauaucccaggagaga

SEQ ID NO: 602162 - RNA, 19 nt, Homo sapiens
aaacacuccucagaauauu

SEQ ID NO: 602163 - RNA, 19 nt, Homo sapiens
gcaaccaugauagaaauaa

SEQ ID NO: 602164 - RNA, 19 nt, Homo sapiens
aaaggaacauuugaaagug

SEQ ID NO: 602165 - RNA, 19 nt, Homo sapiens
gauuguaauugccaucuag

SEQ ID NO: 602166 - RNA, 19 nt, Homo sapiens
ggacaguggacuuaaaaua

SEQ ID NO: 602167 - RNA, 19 nt, Homo sapiens
caaguaacagaagcauuua

SEQ ID NO: 602168 - RNA, 19 nt, Homo sapiens
gcuauggccacaauggaua

SEQ ID NO: 602169 - RNA, 19 nt, Homo sapiens
aggaaucucucacuacaug

SEQ ID NO: 602170 - RNA, 19 nt, Homo sapiens
gaugaagcuuaugcaauug

SEQ ID NO: 602171 - RNA, 19 nt, Homo sapiens
gcauuuaagcuuaucacuu

SEQ ID NO: 602172 - RNA, 19 nt, Homo sapiens
ccagccaacuuccuugaug

SEQ ID NO: 602173 - RNA, 19 nt, Homo sapiens
gaugaaagggacaaagaug

SEQ ID NO: 602174 - RNA, 19 nt, Homo sapiens
gaugggauuuccaccuaau

SEQ ID NO: 602175 - RNA, 19 nt, Homo sapiens
gcacagaagaugggauuuc

SEQ ID NO: 602176 - RNA, 19 nt, Homo sapiens
ggcagaauaugcaaucaag

SEQ ID NO: 602177 - RNA, 19 nt, Homo sapiens
ggaaguucuggauuguuua

SEQ ID NO: 602178 - RNA, 19 nt, Homo sapiens
ggaaaaggaacauuugaaa

SEQ ID NO: 602179 - RNA, 19 nt, Homo sapiens
uuguaaagcucucugaaau

SEQ ID NO: 602180 - RNA, 19 nt, Homo sapiens
gcuauucuggucaacauuu

SEQ ID NO: 602181 - RNA, 19 nt, Homo sapiens
caacuacauuggccucgau

SEQ ID NO: 602182 - RNA, 19 nt, Homo sapiens
uaaggcaaaucucaacuac

SEQ ID NO: 602183 - RNA, 19 nt, Homo sapiens
caccuaauauuguggaauc

SEQ ID NO: 602184 - RNA, 19 nt, Homo sapiens
uaacugcaagucuucauga

SEQ ID NO: 602185 - RNA, 19 nt, Homo sapiens
guauagucauggcaguaaa

SEQ ID NO: 602186 - RNA, 19 nt, Homo sapiens
ggccacaauggauauaaua

SEQ ID NO: 602187 - RNA, 19 nt, Homo sapiens
auuucaagguccuguauua

SEQ ID NO: 602188 - RNA, 19 nt, Homo sapiens
gcuguuucuucacaaauga

SEQ ID NO: 602189 - RNA, 19 nt, Homo sapiens
aggaaacacugauuaacug

SEQ ID NO: 602190 - RNA, 19 nt, Homo sapiens
uguaaagcucucugaaaua

SEQ ID NO: 602191 - RNA, 19 nt, Homo sapiens
guauggaauuauugcaaga

SEQ ID NO: 602192 - RNA, 19 nt, Homo sapiens
gaaaacauggucaagcuuu

SEQ ID NO: 602193 - RNA, 19 nt, Homo sapiens
gagagaauacuacuuugca

SEQ ID NO: 602194 - RNA, 19 nt, Homo sapiens
gcuacaguccaucaaguaa

SEQ ID NO: 602195 - RNA, 19 nt, Homo sapiens
cauuaggaaacacugauua

SEQ ID NO: 602196 - RNA, 19 nt, Homo sapiens
agauucagauggagcugua

SEQ ID NO: 602197 - RNA, 19 nt, Homo sapiens
gagaauacuacuuugcaau

SEQ ID NO: 602198 - RNA, 19 nt, Homo sapiens
ggaggagugaagauaguuu

SEQ ID NO: 602199 - RNA, 19 nt, Homo sapiens
cugauuaacugcaagucuu

SEQ ID NO: 602200 - RNA, 19 nt, Homo sapiens
ucugggaaguucuggauug

SEQ ID NO: 602201 - RNA, 19 nt, Homo sapiens
uggacugcauuuaauugua

SEQ ID NO: 602202 - RNA, 19 nt, Homo sapiens
ugaagcugcuagaaugguu

SEQ ID NO: 602203 - RNA, 19 nt, Homo sapiens
gaggaaucaugcgcuguga

SEQ ID NO: 602204 - RNA, 19 nt, Homo sapiens
guacagcagcaacagcaaa

SEQ ID NO: 602205 - RNA, 19 nt, Homo sapiens
gaaaaucuuugaucuacag

SEQ ID NO: 602206 - RNA, 19 nt, Homo sapiens
gaaucucucacuacaugaa

SEQ ID NO: 602207 - RNA, 19 nt, Homo sapiens
aaagcuguuucuucacaaa

SEQ ID NO: 602208 - RNA, 19 nt, Homo sapiens
caaaagcuguuucuucaca

SEQ ID NO: 602209 - RNA, 19 nt, Homo sapiens
cagcaccaaauacaugaua

SEQ ID NO: 602210 - RNA, 19 nt, Homo sapiens
caaaggaaucucucacuac

SEQ ID NO: 602211 - RNA, 19 nt, Homo sapiens
gguauagucauggcaguaa

SEQ ID NO: 602212 - RNA, 19 nt, Homo sapiens
aaggauauguggcaaaguc

SEQ ID NO: 602213 - RNA, 19 nt, Homo sapiens
ccucauuaguagagcagua

SEQ ID NO: 602214 - RNA, 19 nt, Homo sapiens
caauagaguugaccuguua

SEQ ID NO: 602215 - RNA, 19 nt, Homo sapiens
ccaaaucucuuaauagcuu

SEQ ID NO: 602216 - RNA, 19 nt, Homo sapiens
gcaaagcauucguuauuca

SEQ ID NO: 602217 - RNA, 19 nt, Homo sapiens
caagaaacauggauuugau

SEQ ID NO: 602218 - RNA, 19 nt, Homo sapiens
ucaagccacugaauccuua

SEQ ID NO: 602219 - RNA, 19 nt, Homo sapiens
ggaaagcgucccagaauau

SEQ ID NO: 602220 - RNA, 19 nt, Homo sapiens
ccauauacaugauuucaga

SEQ ID NO: 602221 - RNA, 19 nt, Homo sapiens
gaguauguguucuuuauuc

SEQ ID NO: 602222 - RNA, 19 nt, Homo sapiens
gaggaaaugucaggaauca

SEQ ID NO: 602223 - RNA, 19 nt, Homo sapiens
cauaauugguucuuugcua

SEQ ID NO: 602224 - RNA, 19 nt, Homo sapiens
gcagcggcgugcccuauuu

SEQ ID NO: 602225 - RNA, 19 nt, Homo sapiens
gaagguaguugaguaugug

SEQ ID NO: 602226 - RNA, 19 nt, Homo sapiens
caaggugaaugaaacagaa

SEQ ID NO: 602227 - RNA, 19 nt, Homo sapiens
gcaagaaacauggauuuga

SEQ ID NO: 602228 - RNA, 19 nt, Homo sapiens
uaacugagauccagcaaac

SEQ ID NO: 602229 - RNA, 19 nt, Homo sapiens
gaguugaccuguuauugga

SEQ ID NO: 602230 - RNA, 19 nt, Homo sapiens
gaauuuagcaacacuuaug

SEQ ID NO: 602231 - RNA, 19 nt, Homo sapiens
aaacagaaauggauauugc

SEQ ID NO: 602232 - RNA, 19 nt, Homo sapiens
agaaagaggagaagaauau

SEQ ID NO: 602233 - RNA, 19 nt, Homo sapiens
uggaaagcgucccagaaua

SEQ ID NO: 602234 - RNA, 19 nt, Homo sapiens
ggaaaugucaggaaucaag

SEQ ID NO: 602235 - RNA, 19 nt, Homo sapiens
gaaagcgucccagaauauu

SEQ ID NO: 602236 - RNA, 19 nt, Homo sapiens
agauggagcuuccuacuca

SEQ ID NO: 602237 - RNA, 19 nt, Homo sapiens
gaagcagacuguggugaau

SEQ ID NO: 602238 - RNA, 19 nt, Homo sapiens
cuaagucgagacaguauua

SEQ ID NO: 602239 - RNA, 19 nt, Homo sapiens
gaaugaaacagaaauggau

SEQ ID NO: 602240 - RNA, 19 nt, Homo sapiens
ggaaugaguaccaguuuua

SEQ ID NO: 602241 - RNA, 19 nt, Homo sapiens
ccaauagaguugaccuguu

SEQ ID NO: 602242 - RNA, 19 nt, Homo sapiens
cagaagaugacauaagauu

SEQ ID NO: 602243 - RNA, 19 nt, Homo sapiens
gaaagaggagaagaauauu

SEQ ID NO: 602244 - RNA, 19 nt, Homo sapiens
gaacugugaccaaggugaa

SEQ ID NO: 602245 - RNA, 19 nt, Homo sapiens
gauuucagaagaugacaua

SEQ ID NO: 602246 - RNA, 19 nt, Homo sapiens
ugagcaaccugcaggagaa

SEQ ID NO: 602247 - RNA, 19 nt, Homo sapiens
agaaauggauauugcaaag

SEQ ID NO: 602248 - RNA, 19 nt, Homo sapiens
gaaacagaaauggauauug

SEQ ID NO: 602249 - RNA, 19 nt, Homo sapiens
ugacaccagaagaauauua

SEQ ID NO: 602250 - RNA, 19 nt, Homo sapiens
gaggaaugaguaccaguuu

SEQ ID NO: 602251 - RNA, 19 nt, Homo sapiens
ugaagguaguugaguaugu

SEQ ID NO: 602252 - RNA, 19 nt, Homo sapiens
gucacaugcugguuuguuu

SEQ ID NO: 602253 - RNA, 19 nt, Homo sapiens
ggaaucaagccacugaauc

SEQ ID NO: 602254 - RNA, 19 nt, Homo sapiens
uucagaagaugacauaaga

SEQ ID NO: 602255 - RNA, 19 nt, Homo sapiens
aaaccacucuccacagcuu

SEQ ID NO: 602256 - RNA, 19 nt, Homo sapiens
caaacaaugaugaaacuca

SEQ ID NO: 602257 - RNA, 19 nt, Homo sapiens
ccagaauauuagccaguuu

SEQ ID NO: 602258 - RNA, 19 nt, Homo sapiens
gugaauuuagcaacacuua

SEQ ID NO: 602259 - RNA, 19 nt, Homo sapiens
uugcaaagcauucguuauu

SEQ ID NO: 602260 - RNA, 19 nt, Homo sapiens
aaauggauauugcaaagca

SEQ ID NO: 602261 - RNA, 19 nt, Homo sapiens
ugaccaaggugaaugaaac

SEQ ID NO: 602262 - RNA, 19 nt, Homo sapiens
gccacugaauccuuaaaga

SEQ ID NO: 602263 - RNA, 19 nt, Homo sapiens
ccaccuaagucgagacagu

SEQ ID NO: 602264 - RNA, 19 nt, Homo sapiens
aaagugauacucagaacaa

SEQ ID NO: 602265 - RNA, 19 nt, Homo sapiens
gaagaugacauaagauucc

SEQ ID NO: 602266 - RNA, 19 nt, Homo sapiens
uuuguuugcuugcuuguuu

SEQ ID NO: 602267 - RNA, 19 nt, Homo sapiens
gagaaaaguugaauaugag

SEQ ID NO: 602268 - RNA, 19 nt, Homo sapiens
gaagaugugguagcuacuu

SEQ ID NO: 602269 - RNA, 19 nt, Homo sapiens
cuuguuuacuugcuuguuu

SEQ ID NO: 602270 - RNA, 19 nt, Homo sapiens
aagaggaaaugucaggaau

SEQ ID NO: 602271 - RNA, 19 nt, Homo sapiens
aagaugugguagcuacuuu

SEQ ID NO: 602272 - RNA, 19 nt, Homo sapiens
aaagcgucccagaauauua

SEQ ID NO: 602273 - RNA, 19 nt, Homo sapiens
ccauuggcauuugaaggua

SEQ ID NO: 602274 - RNA, 19 nt, Homo sapiens
guugaccuguuauuggauu

SEQ ID NO: 602275 - RNA, 19 nt, Homo sapiens
gcuuaauguuucucuggaa

SEQ ID NO: 602276 - RNA, 19 nt, Homo sapiens
aagcauucguuauucauuc

SEQ ID NO: 602277 - RNA, 19 nt, Homo sapiens
cuacacugaccaugacuuu

SEQ ID NO: 602278 - RNA, 19 nt, Homo sapiens
ggagaagaauauuuugugu

SEQ ID NO: 602279 - RNA, 19 nt, Homo sapiens
gcaggagaauccauaugcu

SEQ ID NO: 602280 - RNA, 19 nt, Homo sapiens
ucgagacaguauuaucaaa

SEQ ID NO: 602281 - RNA, 19 nt, Homo sapiens
ccacugugcuugguagagu

SEQ ID NO: 602282 - RNA, 19 nt, Homo sapiens
agcagacuguggugaauuu

SEQ ID NO: 602283 - RNA, 19 nt, Homo sapiens
ucugaaaacugcaaaguga

SEQ ID NO: 602284 - RNA, 19 nt, Homo sapiens
aaaacuggauugcaaaaga

SEQ ID NO: 602285 - RNA, 19 nt, Homo sapiens
caggagaauccauaugcua

SEQ ID NO: 602286 - RNA, 19 nt, Homo sapiens
acugaauccuuaaagagaa

SEQ ID NO: 602287 - RNA, 19 nt, Homo sapiens
aaagaaagaggagaagaau

SEQ ID NO: 602288 - RNA, 19 nt, Homo sapiens
gcagacuguggugaauuua

SEQ ID NO: 602289 - RNA, 19 nt, Homo sapiens
gaaucaagccacugaaucc

SEQ ID NO: 602290 - RNA, 19 nt, Homo sapiens
guugauuuaugucucacaa

SEQ ID NO: 602291 - RNA, 19 nt, Homo sapiens
cagaaauggauauugcaaa

SEQ ID NO: 602292 - RNA, 19 nt, Homo sapiens
gaguaccaguuuuaaauug

SEQ ID NO: 602293 - RNA, 19 nt, Homo sapiens
ugaaugaaacagaaaugga

SEQ ID NO: 602294 - RNA, 19 nt, Homo sapiens
caggaacugugaccaaggu

SEQ ID NO: 602295 - RNA, 19 nt, Homo sapiens
ugaagcagacuguggugaa

SEQ ID NO: 602296 - RNA, 19 nt, Homo sapiens
gacaccagaagaauauuau

SEQ ID NO: 602297 - RNA, 19 nt, Homo sapiens
cgugacaccagaagaauau

SEQ ID NO: 602298 - RNA, 19 nt, Homo sapiens
ggacuucuuauucaaagca

SEQ ID NO: 602299 - RNA, 19 nt, Homo sapiens
cugaauccuuaaagagaaa

SEQ ID NO: 602300 - RNA, 19 nt, Homo sapiens
gacaaaauccccucccaaa

SEQ ID NO: 602301 - RNA, 19 nt, Homo sapiens
uuacuugcuuguuuaccaa

SEQ ID NO: 602302 - RNA, 19 nt, Homo sapiens
ccacugaauccuuaaagag

SEQ ID NO: 602303 - RNA, 19 nt, Homo sapiens
cacauaaugcugucaggaa

SEQ ID NO: 602304 - RNA, 19 nt, Homo sapiens
guucuuugcuaaguugaau

SEQ ID NO: 602305 - RNA, 19 nt, Homo sapiens
aaagaggaaaugucaggaa

SEQ ID NO: 602306 - RNA, 19 nt, Homo sapiens
aagaaagaggagaagaaua

SEQ ID NO: 602307 - RNA, 19 nt, Homo sapiens
ggagaauccauaugcuaca

SEQ ID NO: 602308 - RNA, 19 nt, Homo sapiens
agccauaauugguucuuug

SEQ ID NO: 602309 - RNA, 19 nt, Homo sapiens
uagugcugcuacaaucuaa

SEQ ID NO: 602310 - RNA, 19 nt, Homo sapiens
cuaaagugauacucagaac

SEQ ID NO: 602311 - RNA, 19 nt, Homo sapiens
ccaaggugaaugaaacaga

SEQ ID NO: 602312 - RNA, 19 nt, Homo sapiens
cagccauaauugguucuuu

SEQ ID NO: 602313 - RNA, 19 nt, Homo sapiens
aaacuggauugcaaaagaa

SEQ ID NO: 602314 - RNA, 19 nt, Homo sapiens
gagcauagauaccaauuua

SEQ ID NO: 602315 - RNA, 19 nt, Homo sapiens
caacuuagguucuuuagua

SEQ ID NO: 602316 - RNA, 19 nt, Homo sapiens
gcaaacgacugauuacaua

SEQ ID NO: 602317 - RNA, 19 nt, Homo sapiens
gaagaacgccaguugcuua

SEQ ID NO: 602318 - RNA, 19 nt, Homo sapiens
gaacaguacuccacaaaca

SEQ ID NO: 602319 - RNA, 19 nt, Homo sapiens
gaacuccucugcugugaaa

SEQ ID NO: 602320 - RNA, 19 nt, Homo sapiens
gaucauagauacacuaauc

SEQ ID NO: 602321 - RNA, 19 nt, Homo sapiens
uaacugugccugauuauua

SEQ ID NO: 602322 - RNA, 19 nt, Homo sapiens
gccaguugcuuaaauaaua

SEQ ID NO: 602323 - RNA, 19 nt, Homo sapiens
gaaagaaggagaugaauag

SEQ ID NO: 602324 - RNA, 19 nt, Homo sapiens
caacaacaccauccaauuu

SEQ ID NO: 602325 - RNA, 19 nt, Homo sapiens
uaagauggcaacuguauua

SEQ ID NO: 602326 - RNA, 19 nt, Homo sapiens
gaccaucgcaugaaacuua

SEQ ID NO: 602327 - RNA, 19 nt, Homo sapiens
gcaagaaucagaugaagaa

SEQ ID NO: 602328 - RNA, 19 nt, Homo sapiens
gaagaaagaagccauugaa

SEQ ID NO: 602329 - RNA, 19 nt, Homo sapiens
ggaaagaaggagaugaaua

SEQ ID NO: 602330 - RNA, 19 nt, Homo sapiens
ggaacaggauauuaaaguu

SEQ ID NO: 602331 - RNA, 19 nt, Homo sapiens
gaacgccaguugcuuaaau

SEQ ID NO: 602332 - RNA, 19 nt, Homo sapiens
ggaaguggcuggacucucu

SEQ ID NO: 602333 - RNA, 19 nt, Homo sapiens
gaacauaccacgacaagca

SEQ ID NO: 602334 - RNA, 19 nt, Homo sapiens
gaaggacacuacugagguu

SEQ ID NO: 602335 - RNA, 19 nt, Homo sapiens
ugaaggccuuguuaaguua

SEQ ID NO: 602336 - RNA, 19 nt, Homo sapiens
caacugagauauccaccaa

SEQ ID NO: 602337 - RNA, 19 nt, Homo sapiens
gcagaauccugucguggaa

SEQ ID NO: 602338 - RNA, 19 nt, Homo sapiens
gagagacacaucauagaua

SEQ ID NO: 602339 - RNA, 19 nt, Homo sapiens
ccaagaaugugcagagaga

SEQ ID NO: 602340 - RNA, 19 nt, Homo sapiens
gauggcaacuguauuaaag

SEQ ID NO: 602341 - RNA, 19 nt, Homo sapiens
gaagaacaguacuccacaa

SEQ ID NO: 602342 - RNA, 19 nt, Homo sapiens
ggaaugaaucagaagauaa

SEQ ID NO: 602343 - RNA, 19 nt, Homo sapiens
gcaaaggaccaucgcauga

SEQ ID NO: 602344 - RNA, 19 nt, Homo sapiens
gaacaggauauuaaaguug

SEQ ID NO: 602345 - RNA, 19 nt, Homo sapiens
agagacacaucauagauaa

SEQ ID NO: 602346 - RNA, 19 nt, Homo sapiens
gaucagccuagcucaauua

SEQ ID NO: 602347 - RNA, 19 nt, Homo sapiens
gaacauaaagagcauagau

SEQ ID NO: 602348 - RNA, 19 nt, Homo sapiens
aaacugugcugaauucaau

SEQ ID NO: 602349 - RNA, 19 nt, Homo sapiens
aaccagaaguugaauauga

SEQ ID NO: 602350 - RNA, 19 nt, Homo sapiens
agacuuaucuaaaccagaa

SEQ ID NO: 602351 - RNA, 19 nt, Homo sapiens
uaauagcccauuucuguua

SEQ ID NO: 602352 - RNA, 19 nt, Homo sapiens
agaaggaguuugugacuau

SEQ ID NO: 602353 - RNA, 19 nt, Homo sapiens
ugauucagaugaugacuuu

SEQ ID NO: 602354 - RNA, 19 nt, Homo sapiens
aaacaugggugguaacaag

SEQ ID NO: 602355 - RNA, 19 nt, Homo sapiens
ggccugacaauaugaauua

SEQ ID NO: 602356 - RNA, 19 nt, Homo sapiens
guacagcauuacuuuauag

SEQ ID NO: 602357 - RNA, 19 nt, Homo sapiens
gaaaagcucuacugcauca

SEQ ID NO: 602358 - RNA, 19 nt, Homo sapiens
ccacuacccgugaauuaua

SEQ ID NO: 602359 - RNA, 19 nt, Homo sapiens
gaaagaaaggaaagaagga

SEQ ID NO: 602360 - RNA, 19 nt, Homo sapiens
gggagggucuuauaaucuu

SEQ ID NO: 602361 - RNA, 19 nt, Homo sapiens
guucaccuaugaucgauuu

SEQ ID NO: 602362 - RNA, 19 nt, Homo sapiens
aaagagagccagccacaaa

SEQ ID NO: 602363 - RNA, 19 nt, Homo sapiens
gccaaacggugcaacagaa

SEQ ID NO: 602364 - RNA, 19 nt, Homo sapiens
gaaagaaaauggaaagaag

SEQ ID NO: 602365 - RNA, 19 nt, Homo sapiens
agaaggagaugaauagaag

SEQ ID NO: 602366 - RNA, 19 nt, Homo sapiens
gcagagagacacaucauag

SEQ ID NO: 602367 - RNA, 19 nt, Homo sapiens
gaagcaagaaucagaugaa

SEQ ID NO: 602368 - RNA, 19 nt, Homo sapiens
ggacaacgcagaagccaau

SEQ ID NO: 602369 - RNA, 19 nt, Homo sapiens
cauguaagauggcaacugu

SEQ ID NO: 602370 - RNA, 19 nt, Homo sapiens
ugaauuauauggccugaca

SEQ ID NO: 602371 - RNA, 19 nt, Homo sapiens
ggagaugaauagaagaaag

SEQ ID NO: 602372 - RNA, 19 nt, Homo sapiens
gcccauuucuguuaaccua

SEQ ID NO: 602373 - RNA, 19 nt, Homo sapiens
ucaagacccuguuccucua

SEQ ID NO: 602374 - RNA, 19 nt, Homo sapiens
gugcuuuaauucagcuuua

SEQ ID NO: 602375 - RNA, 19 nt, Homo sapiens
ggacaauuccucaaaugga

SEQ ID NO: 602376 - RNA, 19 nt, Homo sapiens
ucaccucccugcucuuaaa

SEQ ID NO: 602377 - RNA, 19 nt, Homo sapiens
ccaauacguucaccuagug

SEQ ID NO: 602378 - RNA, 19 nt, Homo sapiens
gacaagcaauaaagccaaa

SEQ ID NO: 602379 - RNA, 19 nt, Homo sapiens
caaaccaguuauccaaguu

SEQ ID NO: 602380 - RNA, 19 nt, Homo sapiens
cagcauuacuuuauagcaa

SEQ ID NO: 602381 - RNA, 19 nt, Homo sapiens
cugaaggccuuguuaaguu

SEQ ID NO: 602382 - RNA, 19 nt, Homo sapiens
ccaagugguuuaucaucaa

SEQ ID NO: 602383 - RNA, 19 nt, Homo sapiens
gcuggacucucuaaacaau

SEQ ID NO: 602384 - RNA, 19 nt, Homo sapiens
ggaagaaagaagccauuga

SEQ ID NO: 602385 - RNA, 19 nt, Homo sapiens
gaaggaguuugugacuauu

SEQ ID NO: 602386 - RNA, 19 nt, Homo sapiens
ggagcugacucuacacaca

SEQ ID NO: 602387 - RNA, 19 nt, Homo sapiens
gcaaccgccuccacguuug

SEQ ID NO: 602388 - RNA, 19 nt, Homo sapiens
caagugguuuaucaucaaa

SEQ ID NO: 602389 - RNA, 19 nt, Homo sapiens
uauagcaaacgacugauua

SEQ ID NO: 602390 - RNA, 19 nt, Homo sapiens
uggcagcaguacagcauua

SEQ ID NO: 602391 - RNA, 19 nt, Homo sapiens
aaaggaccaucgcaugaaa

SEQ ID NO: 602392 - RNA, 19 nt, Homo sapiens
gcaacagaaggguagguua

SEQ ID NO: 602393 - RNA, 19 nt, Homo sapiens
gaaaagugccccaaaguau

SEQ ID NO: 602394 - RNA, 19 nt, Homo sapiens
aaacagaacgguccaguca

SEQ ID NO: 602395 - RNA, 19 nt, Homo sapiens
cagaaagugaucauagaua

SEQ ID NO: 602396 - RNA, 19 nt, Homo sapiens
ugacuauucucaucucugu

SEQ ID NO: 602397 - RNA, 19 nt, Homo sapiens
caagaagauuauuccaugu

SEQ ID NO: 602398 - RNA, 19 nt, Homo sapiens
guugcuauauuuacacuga

SEQ ID NO: 602399 - RNA, 19 nt, Homo sapiens
agaaggcacuuaauaguac

SEQ ID NO: 602400 - RNA, 19 nt, Homo sapiens
gguuagaugcuauuaagaa

SEQ ID NO: 602401 - RNA, 19 nt, Homo sapiens
gagaugaauagaagaaaga

SEQ ID NO: 602402 - RNA, 19 nt, Homo sapiens
acacuaaucaccaaacuga

SEQ ID NO: 602403 - RNA, 19 nt, Homo sapiens
uaaagagcauagauaccaa

SEQ ID NO: 602404 - RNA, 19 nt, Homo sapiens
cuuaauagcccauuucugu

SEQ ID NO: 602405 - RNA, 19 nt, Homo sapiens
gaaguugaauaugauugug

SEQ ID NO: 602406 - RNA, 19 nt, Homo sapiens
aagaaggcacuuaauagua

SEQ ID NO: 602407 - RNA, 19 nt, Homo sapiens
uagguuagaugcuauuaag

SEQ ID NO: 602408 - RNA, 19 nt, Homo sapiens
gaaagaggaugaccccaau

SEQ ID NO: 602409 - RNA, 19 nt, Homo sapiens
gaacgguccagucaccaaa

SEQ ID NO: 602410 - RNA, 19 nt, Homo sapiens
guacuauuaugcuggacaa

SEQ ID NO: 602411 - RNA, 19 nt, Homo sapiens
agaagaagcuuuucagaau

SEQ ID NO: 602412 - RNA, 19 nt, Homo sapiens
aaacugaaggccuuguuaa

SEQ ID NO: 602413 - RNA, 19 nt, Homo sapiens
gugcccacauugacaaauu

SEQ ID NO: 602414 - RNA, 19 nt, Homo sapiens
gcaaaggaaugaaguuauu

SEQ ID NO: 602415 - RNA, 19 nt, Homo sapiens
agaauuaccucuaggauuu

SEQ ID NO: 602416 - RNA, 19 nt, Homo sapiens
gaaaucgacucucaccaaa

SEQ ID NO: 602417 - RNA, 19 nt, Homo sapiens
caucaaagauucugaccua

SEQ ID NO: 602418 - RNA, 19 nt, Homo sapiens
ggaugaaguuuaugacuau

SEQ ID NO: 602419 - RNA, 19 nt, Homo sapiens
ggauugagacugugguuua

SEQ ID NO: 602420 - RNA, 19 nt, Homo sapiens
gaagacauugugagcauua

SEQ ID NO: 602421 - RNA, 19 nt, Homo sapiens
ccacagaaaucgacucuca

SEQ ID NO: 602422 - RNA, 19 nt, Homo sapiens
gauaggaaauucaaagagu

SEQ ID NO: 602423 - RNA, 19 nt, Homo sapiens
gcaggaaguuuguuugcuu

SEQ ID NO: 602424 - RNA, 19 nt, Homo sapiens
gaaaucagaagcuuugaga

SEQ ID NO: 602425 - RNA, 19 nt, Homo sapiens
agagacagcugaaggugua

SEQ ID NO: 602426 - RNA, 19 nt, Homo sapiens
ggagugggauugagacugu

SEQ ID NO: 602427 - RNA, 19 nt, Homo sapiens
uaucugauguccaauggua

SEQ ID NO: 602428 - RNA, 19 nt, Homo sapiens
gaucaaacacugaaacuca

SEQ ID NO: 602429 - RNA, 19 nt, Homo sapiens
gaaaucauugagcguaaua

SEQ ID NO: 602430 - RNA, 19 nt, Homo sapiens
gggagacacuaaacucaaa

SEQ ID NO: 602431 - RNA, 19 nt, Homo sapiens
gcgguaaccugguacaaga

SEQ ID NO: 602432 - RNA, 19 nt, Homo sapiens
gauguagccuguuguguca

SEQ ID NO: 602433 - RNA, 19 nt, Homo sapiens
caaauguacccuucacuuu

SEQ ID NO: 602434 - RNA, 19 nt, Homo sapiens
gacauugugagcauuauua

SEQ ID NO: 602435 - RNA, 19 nt, Homo sapiens
gcacaaaguccagcgguaa

SEQ ID NO: 602436 - RNA, 19 nt, Homo sapiens
cgaccuaucugauguccaa

SEQ ID NO: 602437 - RNA, 19 nt, Homo sapiens
guaacgaccuaucugaugu

SEQ ID NO: 602438 - RNA, 19 nt, Homo sapiens
ccaaagugaugcacaaagu

SEQ ID NO: 602439 - RNA, 19 nt, Homo sapiens
ggaaaggacucaguagaac

SEQ ID NO: 602440 - RNA, 19 nt, Homo sapiens
agucagagcuguuguucaa

SEQ ID NO: 602441 - RNA, 19 nt, Homo sapiens
gagagcgaauuaaaggauu

SEQ ID NO: 602442 - RNA, 19 nt, Homo sapiens
ggaaccagcucagaauuac

SEQ ID NO: 602443 - RNA, 19 nt, Homo sapiens
caaagauucugaccuagag

SEQ ID NO: 602444 - RNA, 19 nt, Homo sapiens
gaaaggagcaaccgaaucg

SEQ ID NO: 602445 - RNA, 19 nt, Homo sapiens
ccuaaggaauggugaaaug

SEQ ID NO: 602446 - RNA, 19 nt, Homo sapiens
ggauauagccuguguuugc

SEQ ID NO: 602447 - RNA, 19 nt, Homo sapiens
cguaguggaugaaguuuau

SEQ ID NO: 602448 - RNA, 19 nt, Homo sapiens
caauggacccaguaucuuu

SEQ ID NO: 602449 - RNA, 19 nt, Homo sapiens
gagccuauuuccugauguu

SEQ ID NO: 602450 - RNA, 19 nt, Homo sapiens
uggaugaaguuuaugacua

SEQ ID NO: 602451 - RNA, 19 nt, Homo sapiens
gaacugucaugucuaccau

SEQ ID NO: 602452 - RNA, 19 nt, Homo sapiens
ggacucaguagaacagaaa

SEQ ID NO: 602453 - RNA, 19 nt, Homo sapiens
gacccaagaugauuaagag

SEQ ID NO: 602454 - RNA, 19 nt, Homo sapiens
gaaaagcuauccucacauc

SEQ ID NO: 602455 - RNA, 19 nt, Homo sapiens
cuuaagagcaggaaauaaa

SEQ ID NO: 602456 - RNA, 19 nt, Homo sapiens
ggaaaucuucauccucuga

SEQ ID NO: 602457 - RNA, 19 nt, Homo sapiens
aagcagaagaggaauauuu

SEQ ID NO: 602458 - RNA, 19 nt, Homo sapiens
gagaagcagaagaggaaua

SEQ ID NO: 602459 - RNA, 19 nt, Homo sapiens
gaaguuuguuugcuuuguc

SEQ ID NO: 602460 - RNA, 19 nt, Homo sapiens
aaacgcaucuggaaaauug

SEQ ID NO: 602461 - RNA, 19 nt, Homo sapiens
cagaagacauugugagcau

SEQ ID NO: 602462 - RNA, 19 nt, Homo sapiens
uacaggcacuggauugaaa

SEQ ID NO: 602463 - RNA, 19 nt, Homo sapiens
caggaaguuuguuugcuuu

SEQ ID NO: 602464 - RNA, 19 nt, Homo sapiens
ggacacacuggaaguagaa

SEQ ID NO: 602465 - RNA, 19 nt, Homo sapiens
gcacuggcucuauuucuug

SEQ ID NO: 602466 - RNA, 19 nt, Homo sapiens
cguaauaucaucuuggaaa

SEQ ID NO: 602467 - RNA, 19 nt, Homo sapiens
guuuagagccuuugauuuc

SEQ ID NO: 602468 - RNA, 19 nt, Homo sapiens
ggacaaauguacccuucac

SEQ ID NO: 602469 - RNA, 19 nt, Homo sapiens
ggaaguuuguuugcuuugu

SEQ ID NO: 602470 - RNA, 19 nt, Homo sapiens
ucacaucauucaggacaaa

SEQ ID NO: 602471 - RNA, 19 nt, Homo sapiens
ccaacaaccuucgaaugga

SEQ ID NO: 602472 - RNA, 19 nt, Homo sapiens
cuagggaacugucaugucu

SEQ ID NO: 602473 - RNA, 19 nt, Homo sapiens
gaaaggacucaguagaaca

SEQ ID NO: 602474 - RNA, 19 nt, Homo sapiens
gaacuacaagcagcaguga

SEQ ID NO: 602475 - RNA, 19 nt, Homo sapiens
aaacuccuuuggacauauu

SEQ ID NO: 602476 - RNA, 19 nt, Homo sapiens
gaagcgauucuguagauuc

SEQ ID NO: 602477 - RNA, 19 nt, Homo sapiens
gcagaagaggaauauuuau

SEQ ID NO: 602478 - RNA, 19 nt, Homo sapiens
ccuaugauguagccuguug

SEQ ID NO: 602479 - RNA, 19 nt, Homo sapiens
guaguaacgaccuaucuga

SEQ ID NO: 602480 - RNA, 19 nt, Homo sapiens
caacugaaagggaaaucuu

SEQ ID NO: 602481 - RNA, 19 nt, Homo sapiens
ggagagcgaauuaaaggau

SEQ ID NO: 602482 - RNA, 19 nt, Homo sapiens
gaacacgggagaacaaugc

SEQ ID NO: 602483 - RNA, 19 nt, Homo sapiens
gaaguuauuggagugauga

SEQ ID NO: 602484 - RNA, 19 nt, Homo sapiens
ggacugacggcgagugaau

SEQ ID NO: 602485 - RNA, 19 nt, Homo sapiens
aaugguacaucaaagauuc

SEQ ID NO: 602486 - RNA, 19 nt, Homo sapiens
acaaaugcauccugugagu

SEQ ID NO: 602487 - RNA, 19 nt, Homo sapiens
aagcuauccucacaucauu

SEQ ID NO: 602488 - RNA, 19 nt, Homo sapiens
ggagugaagaggaauuugu

SEQ ID NO: 602489 - RNA, 19 nt, Homo sapiens
gguccgagcagaaucagaa

SEQ ID NO: 602490 - RNA, 19 nt, Homo sapiens
uggaaccagcucagaauua

SEQ ID NO: 602491 - RNA, 19 nt, Homo sapiens
cagugaaucuugccuugga

SEQ ID NO: 602492 - RNA, 19 nt, Homo sapiens
gaguauuccgcaucacaua

SEQ ID NO: 602493 - RNA, 19 nt, Homo sapiens
agacaaaugcauccuguga

SEQ ID NO: 602494 - RNA, 19 nt, Homo sapiens
ggucuuuaacccugucaua

SEQ ID NO: 602495 - RNA, 19 nt, Homo sapiens
ucagagcuguuguucaagu

SEQ ID NO: 602496 - RNA, 19 nt, Homo sapiens
aaacuccucucuguggaaa

SEQ ID NO: 602497 - RNA, 19 nt, Homo sapiens
agucucagcugccaaagug

SEQ ID NO: 602498 - RNA, 19 nt, Homo sapiens
ggauauuucuuuggcuugu

SEQ ID NO: 602499 - RNA, 19 nt, Homo sapiens
guagacccaagaugauuaa

SEQ ID NO: 602500 - RNA, 19 nt, Homo sapiens
uacaaggagugaagaggaa

SEQ ID NO: 602501 - RNA, 19 nt, Homo sapiens
gaccuuggguacuuucagu

SEQ ID NO: 602502 - RNA, 19 nt, Homo sapiens
caagcuugauggacaaugg

SEQ ID NO: 602503 - RNA, 19 nt, Homo sapiens
uuacugaaauaaggacuug

SEQ ID NO: 602504 - RNA, 19 nt, Homo sapiens
cagaauuaccucuaggauu

SEQ ID NO: 602505 - RNA, 19 nt, Homo sapiens
ggaaaggagcaaccgaauc

SEQ ID NO: 602506 - RNA, 19 nt, Homo sapiens
gcaggagagcgaauuaaag

SEQ ID NO: 602507 - RNA, 19 nt, Homo sapiens
uacagcuacuucugccuua

SEQ ID NO: 602508 - RNA, 19 nt, Homo sapiens
gauugagacugugguuuag

SEQ ID NO: 602509 - RNA, 19 nt, Homo sapiens
guagaacccuuugaaaaug

SEQ ID NO: 602510 - RNA, 19 nt, Homo sapiens
uauaguagaacccuuugaa

SEQ ID NO: 602511 - RNA, 19 nt, Homo sapiens
uggaaaggacucaguagaa

SEQ ID NO: 602512 - RNA, 19 nt, Homo sapiens
agcagaagaggaauauuua

SEQ ID NO: 602513 - RNA, 19 nt, Homo sapiens
aagagaagcagaagaggaa

SEQ ID NO: 602514 - RNA, 19 nt, Homo sapiens
gaacuaggcucaagaagaa

SEQ ID NO: 602515 - RNA, 19 nt, Homo sapiens
gcuggaagaugacuuguuu

SEQ ID NO: 602516 - RNA, 19 nt, Homo sapiens
agaaagagcuggauaugga

SEQ ID NO: 602517 - RNA, 19 nt, Homo sapiens
uaacagacaccaaggauaa

SEQ ID NO: 602518 - RNA, 19 nt, Homo sapiens
ugaagaaccugucagaaga

SEQ ID NO: 602519 - RNA, 19 nt, Homo sapiens
ggaaauaccuaggcaugga

SEQ ID NO: 602520 - RNA, 19 nt, Homo sapiens
guaugacgccuaugucuua

SEQ ID NO: 602521 - RNA, 19 nt, Homo sapiens
acacuuugguggaugauua

SEQ ID NO: 602522 - RNA, 19 nt, Homo sapiens
gagagacaauguggauaua

SEQ ID NO: 602523 - RNA, 19 nt, Homo sapiens
agaaagaaguguacucuca

SEQ ID NO: 602524 - RNA, 19 nt, Homo sapiens
ccaauaaagugguauaagg

SEQ ID NO: 602525 - RNA, 19 nt, Homo sapiens
ggagagacaauguggauau

SEQ ID NO: 602526 - RNA, 19 nt, Homo sapiens
gaagcuguaugacgccuau

SEQ ID NO: 602527 - RNA, 19 nt, Homo sapiens
aaacaucaccuucuuggaa

SEQ ID NO: 602528 - RNA, 19 nt, Homo sapiens
gagagucaauaacacuuug

SEQ ID NO: 602529 - RNA, 19 nt, Homo sapiens
gcaggaggcugauugucau

SEQ ID NO: 602530 - RNA, 19 nt, Homo sapiens
gacaagccguggccaaugu

SEQ ID NO: 602531 - RNA, 19 nt, Homo sapiens
gagacaauguggauauaag

SEQ ID NO: 602532 - RNA, 19 nt, Homo sapiens
gaaccugucagaagaacaa

SEQ ID NO: 602533 - RNA, 19 nt, Homo sapiens
cgacauuguucuuugguau

SEQ ID NO: 602534 - RNA, 19 nt, Homo sapiens
gcaaauauuacaucuugga

SEQ ID NO: 602535 - RNA, 19 nt, Homo sapiens
guccacagcauacauuaua

SEQ ID NO: 602536 - RNA, 19 nt, Homo sapiens
ugaagguuauucucauuga

SEQ ID NO: 602537 - RNA, 19 nt, Homo sapiens
gaagaaccugucagaagaa

SEQ ID NO: 602538 - RNA, 19 nt, Homo sapiens
gcuuuggccuguugaagaa

SEQ ID NO: 602539 - RNA, 19 nt, Homo sapiens
gauuauggccuuccuuuca

SEQ ID NO: 602540 - RNA, 19 nt, Homo sapiens
gaacaaaucgcggucuaca

SEQ ID NO: 602541 - RNA, 19 nt, Homo sapiens
uaaggacuguaacgagauu

SEQ ID NO: 602542 - RNA, 19 nt, Homo sapiens
gaagaaagaaguguacucu

SEQ ID NO: 602543 - RNA, 19 nt, Homo sapiens
ggagagucaauaacacuuu

SEQ ID NO: 602544 - RNA, 19 nt, Homo sapiens
cuaccaauguguuauaaag

SEQ ID NO: 602545 - RNA, 19 nt, Homo sapiens
ggagucuaccaauguguua

SEQ ID NO: 602546 - RNA, 19 nt, Homo sapiens
uaugaugaauccaaacgaa

SEQ ID NO: 602547 - RNA, 19 nt, Homo sapiens
cuacgaugcuggagaguca

SEQ ID NO: 602548 - RNA, 19 nt, Homo sapiens
ggaaacccaugucucuuuu

SEQ ID NO: 602549 - RNA, 19 nt, Homo sapiens
caccaaggauaauacaaau

SEQ ID NO: 602550 - RNA, 19 nt, Homo sapiens
caauaacacuuugguggau

SEQ ID NO: 602551 - RNA, 19 nt, Homo sapiens
guaacagacaccaaggaua

SEQ ID NO: 602552 - RNA, 19 nt, Homo sapiens
caauaaagugguauaagga

SEQ ID NO: 602553 - RNA, 19 nt, Homo sapiens
gaaauaccuaggcauggaa

SEQ ID NO: 602554 - RNA, 19 nt, Homo sapiens
ggaggcugauugucauugu

SEQ ID NO: 602555 - RNA, 19 nt, Homo sapiens
ucgugucccugucauauuu

SEQ ID NO: 602556 - RNA, 19 nt, Homo sapiens
ucagaugaguacaagcaaa

SEQ ID NO: 602557 - RNA, 19 nt, Homo sapiens
gaucgacauuguucuuugg

SEQ ID NO: 602558 - RNA, 19 nt, Homo sapiens
caauguggauauaaguugu

SEQ ID NO: 602559 - RNA, 19 nt, Homo sapiens
ugucuguuguguacauaua

SEQ ID NO: 602560 - RNA, 19 nt, Homo sapiens
caguaaacaucaccuucuu

SEQ ID NO: 602561 - RNA, 19 nt, Homo sapiens
gaauacauguaaaccuaac

SEQ ID NO: 602562 - RNA, 19 nt, Homo sapiens
ggacgagacuuggauuuug

SEQ ID NO: 602563 - RNA, 19 nt, Homo sapiens
ucaagaagaaagaagugua

SEQ ID NO: 602564 - RNA, 19 nt, Homo sapiens
cuacgcgugucaagccaua

SEQ ID NO: 602565 - RNA, 19 nt, Homo sapiens
ggaagacagugagauacca

SEQ ID NO: 602566 - RNA, 19 nt, Homo sapiens
gagcagucacaguguauga

SEQ ID NO: 602567 - RNA, 19 nt, Homo sapiens
cagaaggugucggccguuu

SEQ ID NO: 602568 - RNA, 19 nt, Homo sapiens
uacauucccucccauaaca

SEQ ID NO: 602569 - RNA, 19 nt, Homo sapiens
cagagucaauucaguacau

SEQ ID NO: 602570 - RNA, 19 nt, Homo sapiens
aagaacaaaucgcggucua

SEQ ID NO: 602571 - RNA, 19 nt, Homo sapiens
ccacagcauacauuauauu

SEQ ID NO: 602572 - RNA, 19 nt, Homo sapiens
ccaaggauaauacaaaucu

SEQ ID NO: 602573 - RNA, 19 nt, Homo sapiens
ggaagugucccuaaaauca

SEQ ID NO: 602574 - RNA, 19 nt, Homo sapiens
uggaggaagugucccuaaa

SEQ ID NO: 602575 - RNA, 19 nt, Homo sapiens
gggaagcaguacgagguuu

SEQ ID NO: 602576 - RNA, 19 nt, Homo sapiens
gaugauagucucacauguc

SEQ ID NO: 602577 - RNA, 19 nt, Homo sapiens
gaagaugacuuguuuugcu

SEQ ID NO: 602578 - RNA, 19 nt, Homo sapiens
ggucuacagugcccugauc

SEQ ID NO: 602579 - RNA, 19 nt, Homo sapiens
ggacaagccguggccaaug

SEQ ID NO: 602580 - RNA, 19 nt, Homo sapiens
acaccaaggauaauacaaa

SEQ ID NO: 602581 - RNA, 19 nt, Homo sapiens
gauagucucacaugucauc

SEQ ID NO: 602582 - RNA, 19 nt, Homo sapiens
gaugaguacaagcaaauau

SEQ ID NO: 602583 - RNA, 19 nt, Homo sapiens
ucauugagcuggagaaaau

SEQ ID NO: 602584 - RNA, 19 nt, Homo sapiens
uggaugcccugguguugaa

SEQ ID NO: 602585 - RNA, 19 nt, Homo sapiens
ggggagcgguucacuguuu

SEQ ID NO: 602586 - RNA, 19 nt, Homo sapiens
gggaugaagguuauucuca

SEQ ID NO: 602587 - RNA, 19 nt, Homo sapiens
ugacgccuaugucuuauac

SEQ ID NO: 602588 - RNA, 19 nt, Homo sapiens
uggaaacccaugucucuuu

SEQ ID NO: 602589 - RNA, 19 nt, Homo sapiens
gaugcuggagagucaauaa

SEQ ID NO: 602590 - RNA, 19 nt, Homo sapiens
ggacuguaacgagauuaaa

SEQ ID NO: 602591 - RNA, 19 nt, Homo sapiens
ccucauuccuacaccuauu

SEQ ID NO: 602592 - RNA, 19 nt, Homo sapiens
agaacuaggcucaagaaga

SEQ ID NO: 602593 - RNA, 19 nt, Homo sapiens
gacaauguggauauaaguu

SEQ ID NO: 602594 - RNA, 19 nt, Homo sapiens
ccagaggcaugccguggau

SEQ ID NO: 602595 - RNA, 19 nt, Homo sapiens
uagaugggaagcuguauga

SEQ ID NO: 602596 - RNA, 19 nt, Homo sapiens
gguggaugauuacuaugau

SEQ ID NO: 602597 - RNA, 19 nt, Homo sapiens
ccaaauuuaucagaugagu

SEQ ID NO: 602598 - RNA, 19 nt, Homo sapiens
ccagaacuaggcucaagaa

SEQ ID NO: 602599 - RNA, 19 nt, Homo sapiens
ggaacauaauuuguacaca

SEQ ID NO: 602600 - RNA, 19 nt, Homo sapiens
gaggaagugucccuaaaau

SEQ ID NO: 602601 - RNA, 19 nt, Homo sapiens
uuacagaaagagcuggaua

SEQ ID NO: 602602 - RNA, 19 nt, Homo sapiens
ucacaugucaucugcacuu

SEQ ID NO: 602603 - RNA, 19 nt, Homo sapiens
ucaggagucuaccaaugug

SEQ ID NO: 602604 - RNA, 19 nt, Homo sapiens
caggaugaggcuaggguua

SEQ ID NO: 602605 - RNA, 19 nt, Homo sapiens
ccaugucuccucauuccua

SEQ ID NO: 602606 - RNA, 19 nt, Homo sapiens
gaaaaucgaggacuacaca

SEQ ID NO: 602607 - RNA, 19 nt, Homo sapiens
acaaaucgcggucuacagu

SEQ ID NO: 602608 - RNA, 19 nt, Homo sapiens
gcugggcuuuggccuguug

SEQ ID NO: 602609 - RNA, 19 nt, Homo sapiens
accuauggcuggaagauga

SEQ ID NO: 602610 - RNA, 19 nt, Homo sapiens
cacaguguaugaagaccaa

SEQ ID NO: 602611 - RNA, 19 nt, Homo sapiens
ccgaaucgcugggcuuugg

SEQ ID NO: 602612 - RNA, 19 nt, Homo sapiens
gaugaauccaaacgaauca

SEQ ID NO: 602613 - RNA, 19 nt, Homo sapiens
uuugguggaugauuacuau

SEQ ID NO: 602614 - RNA, 19 nt, Homo sapiens
gagaagagaugaaacauua

SEQ ID NO: 602615 - RNA, 19 nt, Homo sapiens
gaccaaagcuuaaccaugu

SEQ ID NO: 602616 - RNA, 19 nt, Homo sapiens
gcacaucauuguauaagaa

SEQ ID NO: 602617 - RNA, 19 nt, Homo sapiens
cagaauagcucuuuaucuu

SEQ ID NO: 602618 - RNA, 19 nt, Homo sapiens
ggaaugagacuaaagauug

SEQ ID NO: 602619 - RNA, 19 nt, Homo sapiens
gauaguuacuugcuuguuu

SEQ ID NO: 602620 - RNA, 19 nt, Homo sapiens
gaauagcucuuuaucuuuc

SEQ ID NO: 602621 - RNA, 19 nt, Homo sapiens
gaauuacccuugacccuuu

SEQ ID NO: 602622 - RNA, 19 nt, Homo sapiens
gcaaauggcaugcuucaaa

SEQ ID NO: 602623 - RNA, 19 nt, Homo sapiens
cgaaagauaucucuccauu

SEQ ID NO: 602624 - RNA, 19 nt, Homo sapiens
gaaauccacucacugauag

SEQ ID NO: 602625 - RNA, 19 nt, Homo sapiens
gaugaaacauuaacagaug

SEQ ID NO: 602626 - RNA, 19 nt, Homo sapiens
gaagaucgcaguaauauag

SEQ ID NO: 602627 - RNA, 19 nt, Homo sapiens
gaaagacaaguaacuagua

SEQ ID NO: 602628 - RNA, 19 nt, Homo sapiens
aaagauaucucuccauugu

SEQ ID NO: 602629 - RNA, 19 nt, Homo sapiens
aagcagagauuguuucaaa

SEQ ID NO: 602630 - RNA, 19 nt, Homo sapiens
gaaugaagaggauguaauu

SEQ ID NO: 602631 - RNA, 19 nt, Homo sapiens
cagaagaccuggaauucaa

SEQ ID NO: 602632 - RNA, 19 nt, Homo sapiens
guccugaguuugcuacuua

SEQ ID NO: 602633 - RNA, 19 nt, Homo sapiens
gaggagcuguuguugauga

SEQ ID NO: 602634 - RNA, 19 nt, Homo sapiens
ggaaugaucauagcuguuu

SEQ ID NO: 602635 - RNA, 19 nt, Homo sapiens
ucaaauggguguaguagau

SEQ ID NO: 602636 - RNA, 19 nt, Homo sapiens
caagagacacaaauucuaa

SEQ ID NO: 602637 - RNA, 19 nt, Homo sapiens
gcaguagugugccuaguga

SEQ ID NO: 602638 - RNA, 19 nt, Homo sapiens
cuaaugaggucagguauga

SEQ ID NO: 602639 - RNA, 19 nt, Homo sapiens
gagaaaagccgaagacuaa

SEQ ID NO: 602640 - RNA, 19 nt, Homo sapiens
gcucacaauuugaagauga

SEQ ID NO: 602641 - RNA, 19 nt, Homo sapiens
gaagaacgccgaguuugaa

SEQ ID NO: 602642 - RNA, 19 nt, Homo sapiens
caaaggcugugacucgaaa

SEQ ID NO: 602643 - RNA, 19 nt, Homo sapiens
gaauugcuuugcaugauug

SEQ ID NO: 602644 - RNA, 19 nt, Homo sapiens
ggucagguaugaacuugaa

SEQ ID NO: 602645 - RNA, 19 nt, Homo sapiens
gaugaaauccacucacuga

SEQ ID NO: 602646 - RNA, 19 nt, Homo sapiens
gaaggcaaauggcaugcuu

SEQ ID NO: 602647 - RNA, 19 nt, Homo sapiens
caacagcacaucauuguau

SEQ ID NO: 602648 - RNA, 19 nt, Homo sapiens
gaaccuucuuuacuuaaug

SEQ ID NO: 602649 - RNA, 19 nt, Homo sapiens
gaggagguuugcacaugua

SEQ ID NO: 602650 - RNA, 19 nt, Homo sapiens
gaagagaaagaaaugagaa

SEQ ID NO: 602651 - RNA, 19 nt, Homo sapiens
gagcuccaguccugaguuu

SEQ ID NO: 602652 - RNA, 19 nt, Homo sapiens
uggaugcucugaaacauuu

SEQ ID NO: 602653 - RNA, 19 nt, Homo sapiens
ugaaauccacucacugaua

SEQ ID NO: 602654 - RNA, 19 nt, Homo sapiens
caaaagaaauggagcuauu

SEQ ID NO: 602655 - RNA, 19 nt, Homo sapiens
gagcugaacccaaggaguu

SEQ ID NO: 602656 - RNA, 19 nt, Homo sapiens
gcucugcuuugcugaauga

SEQ ID NO: 602657 - RNA, 19 nt, Homo sapiens
gagaauugcuuugcaugau

SEQ ID NO: 602658 - RNA, 19 nt, Homo sapiens
gcagagauuguuucaaaug

SEQ ID NO: 602659 - RNA, 19 nt, Homo sapiens
uaaaguacuuacagugguu

SEQ ID NO: 602660 - RNA, 19 nt, Homo sapiens
aagcagacauggcugauau

SEQ ID NO: 602661 - RNA, 19 nt, Homo sapiens
ggugaaagcaaucuaaaug

SEQ ID NO: 602662 - RNA, 19 nt, Homo sapiens
ugacacaggaucuuacuuu

SEQ ID NO: 602663 - RNA, 19 nt, Homo sapiens
gcacauguagagaagcaua

SEQ ID NO: 602664 - RNA, 19 nt, Homo sapiens
uaucugggccuuucacuuu

SEQ ID NO: 602665 - RNA, 19 nt, Homo sapiens
agagugagauugucagugu

SEQ ID NO: 602666 - RNA, 19 nt, Homo sapiens
ggagaaacauuuuggguau

SEQ ID NO: 602667 - RNA, 19 nt, Homo sapiens
cauagucucuaauacauag

SEQ ID NO: 602668 - RNA, 19 nt, Homo sapiens
ccgauaaaucucuuucuua

SEQ ID NO: 602669 - RNA, 19 nt, Homo sapiens
gugcauuuccuucaucaua

SEQ ID NO: 602670 - RNA, 19 nt, Homo sapiens
gaaagauaucucuccauug

SEQ ID NO: 602671 - RNA, 19 nt, Homo sapiens
gaagcauacuggagaagca

SEQ ID NO: 602672 - RNA, 19 nt, Homo sapiens
ccucaucugugaaauuaga

SEQ ID NO: 602673 - RNA, 19 nt, Homo sapiens
gagaugaaacauuaacaga

SEQ ID NO: 602674 - RNA, 19 nt, Homo sapiens
ggaagaucgcaguaauaua

SEQ ID NO: 602675 - RNA, 19 nt, Homo sapiens
ucaguuuccucaucuguga

SEQ ID NO: 602676 - RNA, 19 nt, Homo sapiens
gaaugagacuaaagauugc

SEQ ID NO: 602677 - RNA, 19 nt, Homo sapiens
gccgauaaaucucuuucuu

SEQ ID NO: 602678 - RNA, 19 nt, Homo sapiens
aagcauugguggaaagaaa

SEQ ID NO: 602679 - RNA, 19 nt, Homo sapiens
gagcuguuguugaugaaau

SEQ ID NO: 602680 - RNA, 19 nt, Homo sapiens
gaauccaaaccaugaauug

SEQ ID NO: 602681 - RNA, 19 nt, Homo sapiens
uaaagaagaacgccgaguu

SEQ ID NO: 602682 - RNA, 19 nt, Homo sapiens
ggaaggcaguuuugauuug

SEQ ID NO: 602683 - RNA, 19 nt, Homo sapiens
ggaugcagcugcucauacu

SEQ ID NO: 602684 - RNA, 19 nt, Homo sapiens
gaaguggaaggccgauaaa

SEQ ID NO: 602685 - RNA, 19 nt, Homo sapiens
uuugaaaucucacagaguu

SEQ ID NO: 602686 - RNA, 19 nt, Homo sapiens
uggaggagcuguuguugau

SEQ ID NO: 602687 - RNA, 19 nt, Homo sapiens
aaagaaugccgaccugaaa

SEQ ID NO: 602688 - RNA, 19 nt, Homo sapiens
gauugucaguguaagaaug

SEQ ID NO: 602689 - RNA, 19 nt, Homo sapiens
cguguucacuugcacauga

SEQ ID NO: 602690 - RNA, 19 nt, Homo sapiens
gaaggccgauaaaucucuu

SEQ ID NO: 602691 - RNA, 19 nt, Homo sapiens
gaguugacuugguucuauu

SEQ ID NO: 602692 - RNA, 19 nt, Homo sapiens
agaauugcuuugcaugauu

SEQ ID NO: 602693 - RNA, 19 nt, Homo sapiens
gcacugggagccuucuuga

SEQ ID NO: 602694 - RNA, 19 nt, Homo sapiens
cauacucaaucccauauuc

SEQ ID NO: 602695 - RNA, 19 nt, Homo sapiens
gcauuuccuucaucauaau

SEQ ID NO: 602696 - RNA, 19 nt, Homo sapiens
aaagaagaacgccgaguuu

SEQ ID NO: 602697 - RNA, 19 nt, Homo sapiens
gcauagucucuaauacaua

SEQ ID NO: 602698 - RNA, 19 nt, Homo sapiens
gaagcagaauccaaaccau

SEQ ID NO: 602699 - RNA, 19 nt, Homo sapiens
gcucauacucaaucccaua

SEQ ID NO: 602700 - RNA, 19 nt, Homo sapiens
ggacugagcauaugaaccu

SEQ ID NO: 602701 - RNA, 19 nt, Homo sapiens
uuauagaguugacuugguu

SEQ ID NO: 602702 - RNA, 19 nt, Homo sapiens
caaauggcaugcuucaaaa

SEQ ID NO: 602703 - RNA, 19 nt, Homo sapiens
gaacgccgaguuugaagau

SEQ ID NO: 602704 - RNA, 19 nt, Homo sapiens
uguaagcacugcagaaucu

SEQ ID NO: 602705 - RNA, 19 nt, Homo sapiens
caaauggguguaguagaua

SEQ ID NO: 602706 - RNA, 19 nt, Homo sapiens
uuccucaucugugaaauua

SEQ ID NO: 602707 - RNA, 19 nt, Homo sapiens
ugaaugacacaggaucuua

SEQ ID NO: 602708 - RNA, 19 nt, Homo sapiens
ugaguuugcuacuuacuuc

SEQ ID NO: 602709 - RNA, 19 nt, Homo sapiens
gaaauggagcuauucuuuu

SEQ ID NO: 602710 - RNA, 19 nt, Homo sapiens
gggaaugagacuaaagauu

SEQ ID NO: 602711 - RNA, 19 nt, Homo sapiens
gcugugacucgaaauaauu

SEQ ID NO: 602712 - RNA, 19 nt, Homo sapiens
gaggucagguaugaacuug

SEQ ID NO: 602713 - RNA, 19 nt, Homo sapiens
gaaggcugguuagaacaug

SEQ ID NO: 602714 - RNA, 19 nt, Homo sapiens
ucacagaguuggagucauu

SEQ ID NO: 602715 - RNA, 19 nt, Homo sapiens
gcugggaugucacagaguu

SEQ ID NO: 602716 - RNA, 19 nt, Homo sapiens
gcaccuucgucuucagcua

SEQ ID NO: 602717 - RNA, 19 nt, Homo sapiens
ggcccuaccugagcuacua

SEQ ID NO: 602718 - RNA, 19 nt, Homo sapiens
gcaaaggcuuccgcacgau

SEQ ID NO: 602719 - RNA, 19 nt, Homo sapiens
ucucgcaccuggucuccua

SEQ ID NO: 602720 - RNA, 19 nt, Homo sapiens
gcucuucgcgcucaucuuc

SEQ ID NO: 602721 - RNA, 19 nt, Homo sapiens
gcggugcacuuccucaucu

SEQ ID NO: 602722 - RNA, 19 nt, Homo sapiens
gcaaggcggugcacuuccu

SEQ ID NO: 602723 - RNA, 19 nt, Homo sapiens
ccagcgaccuguugcacau

SEQ ID NO: 602724 - RNA, 19 nt, Homo sapiens
caucugcaccuucgucuuc

SEQ ID NO: 602725 - RNA, 19 nt, Homo sapiens
cgguugauguggccugaaa

SEQ ID NO: 602726 - RNA, 19 nt, Homo sapiens
ccaaccuguucauccuuaa

SEQ ID NO: 602727 - RNA, 19 nt, Homo sapiens
accaaccuguucauccuua

SEQ ID NO: 602728 - RNA, 19 nt, Homo sapiens
caaggugacacgcaugauc

SEQ ID NO: 602729 - RNA, 19 nt, Homo sapiens
agaguuggagucauuguug

SEQ ID NO: 602730 - RNA, 19 nt, Homo sapiens
uccaagcacuuccgcaaag

SEQ ID NO: 602731 - RNA, 19 nt, Homo sapiens
gcacuaccaaccuguucau

SEQ ID NO: 602732 - RNA, 19 nt, Homo sapiens
ccauggacaucugcaccuu

SEQ ID NO: 602733 - RNA, 19 nt, Homo sapiens
cuaccaaccuguucauccu

SEQ ID NO: 602734 - RNA, 19 nt, Homo sapiens
acagcauccugacgguuga

SEQ ID NO: 602735 - RNA, 19 nt, Homo sapiens
uuuacgcgcuggucuccaa

SEQ ID NO: 602736 - RNA, 19 nt, Homo sapiens
gcaagacaguugaauuaua

SEQ ID NO: 602737 - RNA, 19 nt, Homo sapiens
gggaggaaaugaaauagua

SEQ ID NO: 602738 - RNA, 19 nt, Homo sapiens
gaacaaauauucggugcuu

SEQ ID NO: 602739 - RNA, 19 nt, Homo sapiens
caaaggaaauggaggugua

SEQ ID NO: 602740 - RNA, 19 nt, Homo sapiens
acaggaaacuacaucauua

SEQ ID NO: 602741 - RNA, 19 nt, Homo sapiens
gggcaagacaguugaauua

SEQ ID NO: 602742 - RNA, 19 nt, Homo sapiens
uaaaguugcuggccuaaug

SEQ ID NO: 602743 - RNA, 19 nt, Homo sapiens
aaagaagccugguuacuga

SEQ ID NO: 602744 - RNA, 19 nt, Homo sapiens
ggaacucgcuacaaaggaa

SEQ ID NO: 602745 - RNA, 19 nt, Homo sapiens
gaaagaagccugguuacug

SEQ ID NO: 602746 - RNA, 19 nt, Homo sapiens
caagacaguugaauuauac

SEQ ID NO: 602747 - RNA, 19 nt, Homo sapiens
aacaggaaguuucagauua

SEQ ID NO: 602748 - RNA, 19 nt, Homo sapiens
guauauggcugggauuuga

SEQ ID NO: 602749 - RNA, 19 nt, Homo sapiens
gaagccugguuacugauuu

SEQ ID NO: 602750 - RNA, 19 nt, Homo sapiens
acuaggaacugcauauauu

SEQ ID NO: 602751 - RNA, 19 nt, Homo sapiens
caugaaagaagccugguua

SEQ ID NO: 602752 - RNA, 19 nt, Homo sapiens
ggaacugcauauauucaug

SEQ ID NO: 602753 - RNA, 19 nt, Homo sapiens
ggacuaggaacugcauaua

SEQ ID NO: 602754 - RNA, 19 nt, Homo sapiens
acaggaaguuucagauuau

SEQ ID NO: 602755 - RNA, 19 nt, Homo sapiens
agaguggaaucaacuauga

SEQ ID NO: 602756 - RNA, 19 nt, Homo sapiens
cauuucagguuaaacauga

SEQ ID NO: 602757 - RNA, 19 nt, Homo sapiens
uuacguucauuucagguua

SEQ ID NO: 602758 - RNA, 19 nt, Homo sapiens
uaacaggaaguuucagauu

SEQ ID NO: 602759 - RNA, 19 nt, Homo sapiens
gaaauggagguguauaugg

SEQ ID NO: 602760 - RNA, 19 nt, Homo sapiens
ccaggagcaucugauuuaa

SEQ ID NO: 602761 - RNA, 19 nt, Homo sapiens
ggaaauggagguguauaug

SEQ ID NO: 602762 - RNA, 19 nt, Homo sapiens
gagcaauguucucaauuuu

SEQ ID NO: 602763 - RNA, 19 nt, Homo sapiens
caggaaguuucagauuaua

SEQ ID NO: 602764 - RNA, 19 nt, Homo sapiens
gauggaagcccagauggaa

SEQ ID NO: 602765 - RNA, 19 nt, Homo sapiens
gauauugucucuggaacuc

SEQ ID NO: 602766 - RNA, 19 nt, Homo sapiens
guugggaggaaaugaaaua

SEQ ID NO: 602767 - RNA, 19 nt, Homo sapiens
accaggagcaucugauuua

SEQ ID NO: 602768 - RNA, 19 nt, Homo sapiens
gaccaggagcaucugauuu

SEQ ID NO: 602769 - RNA, 19 nt, Homo sapiens
ugaaacaugccacaggaaa

SEQ ID NO: 602770 - RNA, 19 nt, Homo sapiens
ucuaagaccacgagagaaa

SEQ ID NO: 602771 - RNA, 19 nt, Homo sapiens
gcaucugauuuaacaggaa

SEQ ID NO: 602772 - RNA, 19 nt, Homo sapiens
uauggaugcugaucucuca

SEQ ID NO: 602773 - RNA, 19 nt, Homo sapiens
gcgagaaccugccgcucau

SEQ ID NO: 602774 - RNA, 19 nt, Homo sapiens
caaguugggaggaaaugaa

SEQ ID NO: 602775 - RNA, 19 nt, Homo sapiens
aggagcaucugauuuaaca

SEQ ID NO: 602776 - RNA, 19 nt, Homo sapiens
gcugaacaguuggagaaga

SEQ ID NO: 602777 - RNA, 19 nt, Homo sapiens
ggaggaaaugaaauaguau

SEQ ID NO: 602778 - RNA, 19 nt, Homo sapiens
guccacgacagaacaaaua

SEQ ID NO: 602779 - RNA, 19 nt, Homo sapiens
cacaggaaacuacaucauu

SEQ ID NO: 602780 - RNA, 19 nt, Homo sapiens
gaugauggaagcccagaug

SEQ ID NO: 602781 - RNA, 19 nt, Homo sapiens
ccugguuacugauuuguau

SEQ ID NO: 602782 - RNA, 19 nt, Homo sapiens
gagaguggaaucaacuaug

SEQ ID NO: 602783 - RNA, 19 nt, Homo sapiens
gagguuccaauaucauuug

SEQ ID NO: 602784 - RNA, 19 nt, Homo sapiens
gacuaggaacugcauauau

SEQ ID NO: 602785 - RNA, 19 nt, Homo sapiens
uggcgagguuccaauauca

SEQ ID NO: 602786 - RNA, 19 nt, Homo sapiens
gaugauuguucgggcaaga

SEQ ID NO: 602787 - RNA, 19 nt, Homo sapiens
gaacucgcuacaaaggaaa

SEQ ID NO: 602788 - RNA, 19 nt, Homo sapiens
ugaaaggauuauugacucu

SEQ ID NO: 602789 - RNA, 19 nt, Homo sapiens
ggaggguaauuuugauauu

SEQ ID NO: 602790 - RNA, 19 nt, Homo sapiens
cugaacaguuggagaagau

SEQ ID NO: 602791 - RNA, 19 nt, Homo sapiens
gaaaggauuauugacucuu

SEQ ID NO: 602792 - RNA, 19 nt, Homo sapiens
gauuuaacaggaaguuuca

SEQ ID NO: 602793 - RNA, 19 nt, Homo sapiens
gcgagguuccaauaucauu

SEQ ID NO: 602794 - RNA, 19 nt, Homo sapiens
gaggguaauuuugauauug

SEQ ID NO: 602795 - RNA, 19 nt, Homo sapiens
gaucuaugggucagacaga

SEQ ID NO: 602796 - RNA, 19 nt, Homo sapiens
gcuguauugagaccuauaa

SEQ ID NO: 602797 - RNA, 19 nt, Homo sapiens
gaaacaugccacaggaaac

SEQ ID NO: 602798 - RNA, 19 nt, Homo sapiens
gaucguguuuauggugaau

SEQ ID NO: 602799 - RNA, 19 nt, Homo sapiens
caggaaacuacaucauuau

SEQ ID NO: 602800 - RNA, 19 nt, Homo sapiens
ccacgacagaacaaauauu

SEQ ID NO: 602801 - RNA, 19 nt, Homo sapiens
gcugggauuugaaaagaaa

SEQ ID NO: 602802 - RNA, 19 nt, Homo sapiens
cacgacagaacaaauauuc

SEQ ID NO: 602803 - RNA, 19 nt, Homo sapiens
gaacaguuggagaagaucu

SEQ ID NO: 602804 - RNA, 19 nt, Homo sapiens
guucauuucagguuaaaca

SEQ ID NO: 602805 - RNA, 19 nt, Homo sapiens
uacguucauuucagguuaa

SEQ ID NO: 602806 - RNA, 19 nt, Homo sapiens
gaggaaaugaaauaguauc

SEQ ID NO: 602807 - RNA, 19 nt, Homo sapiens
ggaucguguuuauggugaa

SEQ ID NO: 602808 - RNA, 19 nt, Homo sapiens
cgagguuccaauaucauuu

SEQ ID NO: 602809 - RNA, 19 nt, Homo sapiens
ggcaagacaguugaauuau

SEQ ID NO: 602810 - RNA, 19 nt, Homo sapiens
gcugagaccaggagcaucu

SEQ ID NO: 602811 - RNA, 19 nt, Homo sapiens
cuucuaagaccacgagaga

SEQ ID NO: 602812 - RNA, 19 nt, Homo sapiens
gcaauguucucaauuuucg

SEQ ID NO: 602813 - RNA, 19 nt, Homo sapiens
cucuggaacucgcuacaaa

SEQ ID NO: 602814 - RNA, 19 nt, Homo sapiens
gggacuaggaacugcauau

SEQ ID NO: 602815 - RNA, 19 nt, Homo sapiens
ugauuuaacaggaaguuuc

SEQ ID NO: 602816 - RNA, 19 nt, Homo sapiens
ggccuaaugagcaauguuc

SEQ ID NO: 602817 - RNA, 19 nt, Homo sapiens
aaaguugcuggccuaauga

SEQ ID NO: 602818 - RNA, 19 nt, Homo sapiens
caaauauucggugcuuuua

SEQ ID NO: 602819 - RNA, 19 nt, Homo sapiens
gcaguccacgacagaacaa

SEQ ID NO: 602820 - RNA, 19 nt, Homo sapiens
cagauuauaccgaaaagaa

SEQ ID NO: 602821 - RNA, 19 nt, Homo sapiens
uauuauggaugcugaucuc

SEQ ID NO: 602822 - RNA, 19 nt, Homo sapiens
cuaggaacugcauauauuc

SEQ ID NO: 602823 - RNA, 19 nt, Homo sapiens
aagccugguuacugauuug

SEQ ID NO: 602824 - RNA, 19 nt, Homo sapiens
cagguuaaacaugaaagaa

SEQ ID NO: 602825 - RNA, 19 nt, Homo sapiens
cagauggagaugauuguuc

SEQ ID NO: 602826 - RNA, 19 nt, Homo sapiens
agaccaggagcaucugauu

SEQ ID NO: 602827 - RNA, 19 nt, Homo sapiens
cgagaguggaaucaacuau

SEQ ID NO: 602828 - RNA, 19 nt, Homo sapiens
gaguggaaucaacuaugaa

SEQ ID NO: 602829 - RNA, 19 nt, Homo sapiens
ggaagcaaaaggaggguaa

SEQ ID NO: 602830 - RNA, 19 nt, Homo sapiens
ucacaccauccaaaauuua

SEQ ID NO: 602831 - RNA, 19 nt, Homo sapiens
ucguguggcugcuggugaa

SEQ ID NO: 602832 - RNA, 19 nt, Homo sapiens
ccacaggaaacuacaucau

SEQ ID NO: 602833 - RNA, 19 nt, Homo sapiens
gcaauuggcugugucuuug

SEQ ID NO: 602834 - RNA, 19 nt, Homo sapiens
gaagauuuauuccucuaug

SEQ ID NO: 602835 - RNA, 19 nt, Homo sapiens
gagcauaacuuggcagaca

SEQ ID NO: 602836 - RNA, 19 nt, Homo sapiens
uaaaggagcuaaggagaga

SEQ ID NO: 602837 - RNA, 19 nt, Homo sapiens
caaggaagacccuaagaaa

SEQ ID NO: 602838 - RNA, 19 nt, Homo sapiens
gauuaagcuuugugacuuu

SEQ ID NO: 602839 - RNA, 19 nt, Homo sapiens
cugaaaggcugacauguga

SEQ ID NO: 602840 - RNA, 19 nt, Homo sapiens
uauggaaccacuugaauua

SEQ ID NO: 602841 - RNA, 19 nt, Homo sapiens
gaagauauggaaccacuug

SEQ ID NO: 602842 - RNA, 19 nt, Homo sapiens
caauagaugcuuugaagaa

SEQ ID NO: 602843 - RNA, 19 nt, Homo sapiens
gcagcauccuuccagcuuu

SEQ ID NO: 602844 - RNA, 19 nt, Homo sapiens
ccucuaugauggagaagua

SEQ ID NO: 602845 - RNA, 19 nt, Homo sapiens
uggaaccacuugaauuaaa

SEQ ID NO: 602846 - RNA, 19 nt, Homo sapiens
cgaaacauuccgugauuaa

SEQ ID NO: 602847 - RNA, 19 nt, Homo sapiens
cagaacaucucgugaagag

SEQ ID NO: 602848 - RNA, 19 nt, Homo sapiens
gaacacgacaaaccaacaa

SEQ ID NO: 602849 - RNA, 19 nt, Homo sapiens
acacaguucuccaugaguu

SEQ ID NO: 602850 - RNA, 19 nt, Homo sapiens
gaaggauccuauggaguug

SEQ ID NO: 602851 - RNA, 19 nt, Homo sapiens
caccacugcuuuacagaaa

SEQ ID NO: 602852 - RNA, 19 nt, Homo sapiens
ggauguggaucagcuguau

SEQ ID NO: 602853 - RNA, 19 nt, Homo sapiens
ggacacgggucagauugug

SEQ ID NO: 602854 - RNA, 19 nt, Homo sapiens
ugauuaagcuuugugacuu

SEQ ID NO: 602855 - RNA, 19 nt, Homo sapiens
aaacauccaaguugcagua

SEQ ID NO: 602856 - RNA, 19 nt, Homo sapiens
agaaggauccuauggaguu

SEQ ID NO: 602857 - RNA, 19 nt, Homo sapiens
ggaagacccuaagaaagag

SEQ ID NO: 602858 - RNA, 19 nt, Homo sapiens
gcuguugcaucacccauau

SEQ ID NO: 602859 - RNA, 19 nt, Homo sapiens
gagcuaaggagagaugauu

SEQ ID NO: 602860 - RNA, 19 nt, Homo sapiens
ugugauaccaagaaacuua

SEQ ID NO: 602861 - RNA, 19 nt, Homo sapiens
ccauaaacacaauugcaua

SEQ ID NO: 602862 - RNA, 19 nt, Homo sapiens
cuacugugauaccaagaaa

SEQ ID NO: 602863 - RNA, 19 nt, Homo sapiens
aggaagacccuaagaaaga

SEQ ID NO: 602864 - RNA, 19 nt, Homo sapiens
ccacauggacccuacugaa

SEQ ID NO: 602865 - RNA, 19 nt, Homo sapiens
gcaaguguuuagcacgaau

SEQ ID NO: 602866 - RNA, 19 nt, Homo sapiens
ggaaccacuugaauuaaaa

SEQ ID NO: 602867 - RNA, 19 nt, Homo sapiens
gauauggaaccacuugaau

SEQ ID NO: 602868 - RNA, 19 nt, Homo sapiens
ggaccgagugacuacuaua

SEQ ID NO: 602869 - RNA, 19 nt, Homo sapiens
ccacacaguucuccaugag

SEQ ID NO: 602870 - RNA, 19 nt, Homo sapiens
gcaccacugcuuuacagaa

SEQ ID NO: 602871 - RNA, 19 nt, Homo sapiens
ggaguuguuuucaaaugua

SEQ ID NO: 602872 - RNA, 19 nt, Homo sapiens
acaauugcauacauagaga

SEQ ID NO: 602873 - RNA, 19 nt, Homo sapiens
cagcauccuuccagcuuug

SEQ ID NO: 602874 - RNA, 19 nt, Homo sapiens
uuacagaaacauccaaguu

SEQ ID NO: 602875 - RNA, 19 nt, Homo sapiens
ggcaauuggcugugucuuu

SEQ ID NO: 602876 - RNA, 19 nt, Homo sapiens
aagcaucccaaccuuguua

SEQ ID NO: 602877 - RNA, 19 nt, Homo sapiens
ggaaucaauagaugcuuug

SEQ ID NO: 602878 - RNA, 19 nt, Homo sapiens
aaagggcugucuccacaug

SEQ ID NO: 602879 - RNA, 19 nt, Homo sapiens
gcacgaaucaguacuucag

SEQ ID NO: 602880 - RNA, 19 nt, Homo sapiens
gaaaaucggauguggauca

SEQ ID NO: 602881 - RNA, 19 nt, Homo sapiens
acgaaacauuccgugauua

SEQ ID NO: 602882 - RNA, 19 nt, Homo sapiens
aggaaucaauagaugcuuu

SEQ ID NO: 602883 - RNA, 19 nt, Homo sapiens
ccacugcuuuacagaaaca

SEQ ID NO: 602884 - RNA, 19 nt, Homo sapiens
gaaaacaucagagaaauag

SEQ ID NO: 602885 - RNA, 19 nt, Homo sapiens
caacaaggaagacccuaag

SEQ ID NO: 602886 - RNA, 19 nt, Homo sapiens
uacagaaacauccaaguug

SEQ ID NO: 602887 - RNA, 19 nt, Homo sapiens
acaaggaagacccuaagaa

SEQ ID NO: 602888 - RNA, 19 nt, Homo sapiens
ccaacaaggaagacccuaa

SEQ ID NO: 602889 - RNA, 19 nt, Homo sapiens
gacaaaccaacaaggaaga

SEQ ID NO: 602890 - RNA, 19 nt, Homo sapiens
cacauggacccuacugaaa

SEQ ID NO: 602891 - RNA, 19 nt, Homo sapiens
ugacuacuauacagacuac

SEQ ID NO: 602892 - RNA, 19 nt, Homo sapiens
gaaaggcugacaugugaac

SEQ ID NO: 602893 - RNA, 19 nt, Homo sapiens
gauuuauuccucuaugaug

SEQ ID NO: 602894 - RNA, 19 nt, Homo sapiens
guggauguuugggcaauug

SEQ ID NO: 602895 - RNA, 19 nt, Homo sapiens
gcuuugugacuuuggauuu

SEQ ID NO: 602896 - RNA, 19 nt, Homo sapiens
cagcuuuggauaauaagaa

SEQ ID NO: 602897 - RNA, 19 nt, Homo sapiens
caucagagaaauagaggau

SEQ ID NO: 602898 - RNA, 19 nt, Homo sapiens
uccagacccugaagauaug

SEQ ID NO: 602899 - RNA, 19 nt, Homo sapiens
gugauaccaagaaacuuaa

SEQ ID NO: 602900 - RNA, 19 nt, Homo sapiens
uaagaaagagccgaaagca

SEQ ID NO: 602901 - RNA, 19 nt, Homo sapiens
aaacaucagagaaauagag

SEQ ID NO: 602902 - RNA, 19 nt, Homo sapiens
gaaacauuccgugauuaag

SEQ ID NO: 602903 - RNA, 19 nt, Homo sapiens
aaaauauccucaucacgaa

SEQ ID NO: 602904 - RNA, 19 nt, Homo sapiens
aaauugcccuucgggaaau

SEQ ID NO: 602905 - RNA, 19 nt, Homo sapiens
ggaggaaacggaggcuuca

SEQ ID NO: 602906 - RNA, 19 nt, Homo sapiens
cuacugaaaggcugacaug

SEQ ID NO: 602907 - RNA, 19 nt, Homo sapiens
ugacuggaccgagugacua

SEQ ID NO: 602908 - RNA, 19 nt, Homo sapiens
acugcaagcuguaaauuuu

SEQ ID NO: 602909 - RNA, 19 nt, Homo sapiens
uaagcuuugugacuuugga

SEQ ID NO: 602910 - RNA, 19 nt, Homo sapiens
uaccagaacaucucgugaa

SEQ ID NO: 602911 - RNA, 19 nt, Homo sapiens
cauggacccuacugaaagg

SEQ ID NO: 602912 - RNA, 19 nt, Homo sapiens
acucaagcaucccaaccuu

SEQ ID NO: 602913 - RNA, 19 nt, Homo sapiens
uuccagacccugaagauau

SEQ ID NO: 602914 - RNA, 19 nt, Homo sapiens
uagcacgaaucaguacuuc

SEQ ID NO: 602915 - RNA, 19 nt, Homo sapiens
cauaaacacaauugcauac

SEQ ID NO: 602916 - RNA, 19 nt, Homo sapiens
aaagaacacgacaaaccaa

SEQ ID NO: 602917 - RNA, 19 nt, Homo sapiens
gaaaauuccagacccugaa

SEQ ID NO: 602918 - RNA, 19 nt, Homo sapiens
agcuguaucugauuaggaa

SEQ ID NO: 602919 - RNA, 19 nt, Homo sapiens
gguggauguuugggcaauu

SEQ ID NO: 602920 - RNA, 19 nt, Homo sapiens
cgagugacuacuauacaga

SEQ ID NO: 602921 - RNA, 19 nt, Homo sapiens
gccauaaacacaauugcau

SEQ ID NO: 602922 - RNA, 19 nt, Homo sapiens
gauuguggccaucaagaag

SEQ ID NO: 602923 - RNA, 19 nt, Homo sapiens
gugccucuguggccaggaa

SEQ ID NO: 602924 - RNA, 19 nt, Homo sapiens
cacugcaagcuguaaauuu

SEQ ID NO: 602925 - RNA, 19 nt, Homo sapiens
ccaaagagggguaccagaa

SEQ ID NO: 602926 - RNA, 19 nt, Homo sapiens
cuauggaguuguuuucaaa

SEQ ID NO: 602927 - RNA, 19 nt, Homo sapiens
ucccaaacaucucuuaucc

SEQ ID NO: 602928 - RNA, 19 nt, Homo sapiens
ccugguguuugaauauugu

SEQ ID NO: 602929 - RNA, 19 nt, Homo sapiens
ggcaaaagaacacgacaaa

SEQ ID NO: 602930 - RNA, 19 nt, Homo sapiens
cagggacacgggucagauu

SEQ ID NO: 602931 - RNA, 19 nt, Homo sapiens
ccgagugacuacuauacag

SEQ ID NO: 602932 - RNA, 19 nt, Homo sapiens
gcuaaggagagaugauuuu

SEQ ID NO: 602933 - RNA, 19 nt, Homo sapiens
gcaagaagcuggaggaaag

SEQ ID NO: 602934 - RNA, 19 nt, Homo sapiens
ggaaaggagcgccuacuaa

SEQ ID NO: 602935 - RNA, 19 nt, Homo sapiens
aaagauugcuauugucgua

SEQ ID NO: 602936 - RNA, 19 nt, Homo sapiens
ggauuaagccugaucaaga

SEQ ID NO: 602937 - RNA, 19 nt, Homo sapiens
gauuaagccugaucaagau

SEQ ID NO: 602938 - RNA, 19 nt, Homo sapiens
caacguggaauguuucuuu

SEQ ID NO: 602939 - RNA, 19 nt, Homo sapiens
gaaaggagcgccuacuaag

SEQ ID NO: 602940 - RNA, 19 nt, Homo sapiens
ucacuguccuuguaaaguu

SEQ ID NO: 602941 - RNA, 19 nt, Homo sapiens
gauaccauuuggcuccuuu

SEQ ID NO: 602942 - RNA, 19 nt, Homo sapiens
ccagguccgucaagccuaa

SEQ ID NO: 602943 - RNA, 19 nt, Homo sapiens
ggaaagggguuuugacaag

SEQ ID NO: 602944 - RNA, 19 nt, Homo sapiens
gagaagcgagaccuuagaa

SEQ ID NO: 602945 - RNA, 19 nt, Homo sapiens
ccucaacucuauagcucua

SEQ ID NO: 602946 - RNA, 19 nt, Homo sapiens
gugcgacgccuucuuguga

SEQ ID NO: 602947 - RNA, 19 nt, Homo sapiens
gugaaguccugggcaagaa

SEQ ID NO: 602948 - RNA, 19 nt, Homo sapiens
gacgugagucugagucuga

SEQ ID NO: 602949 - RNA, 19 nt, Homo sapiens
cccuaaccauuucaacuuu

SEQ ID NO: 602950 - RNA, 19 nt, Homo sapiens
ucuaguggcuugagguauc

SEQ ID NO: 602951 - RNA, 19 nt, Homo sapiens
aagccuaaguccuugaguu

SEQ ID NO: 602952 - RNA, 19 nt, Homo sapiens
ugcccaacguggaauguuu

SEQ ID NO: 602953 - RNA, 19 nt, Homo sapiens
aggccuaucucccucagaa

SEQ ID NO: 602954 - RNA, 19 nt, Homo sapiens
aagcggaaguggaagaaag

SEQ ID NO: 602955 - RNA, 19 nt, Homo sapiens
gguccgggcagcagagaaa

SEQ ID NO: 602956 - RNA, 19 nt, Homo sapiens
ggaaaagauugcuauuguc

SEQ ID NO: 602957 - RNA, 19 nt, Homo sapiens
ggaagcggaaguggaagaa

SEQ ID NO: 602958 - RNA, 19 nt, Homo sapiens
aaggagcgccuacuaagga

SEQ ID NO: 602959 - RNA, 19 nt, Homo sapiens
cggaaaggagcgccuacua

SEQ ID NO: 602960 - RNA, 19 nt, Homo sapiens
gcgagaagcgagaccuuag

SEQ ID NO: 602961 - RNA, 19 nt, Homo sapiens
cacuguccuuguaaaguuu

SEQ ID NO: 602962 - RNA, 19 nt, Homo sapiens
gcgacgccuucuugugaug

SEQ ID NO: 602963 - RNA, 19 nt, Homo sapiens
aggaaaagauugcuauugu

SEQ ID NO: 602964 - RNA, 19 nt, Homo sapiens
gaagcggaaguggaagaaa

SEQ ID NO: 602965 - RNA, 19 nt, Homo sapiens
ucccuuguccgucuucuaa

SEQ ID NO: 602966 - RNA, 19 nt, Homo sapiens
ggcaagaagcuggaggaaa

SEQ ID NO: 602967 - RNA, 19 nt, Homo sapiens
ggugaaguccugggcaaga

SEQ ID NO: 602968 - RNA, 19 nt, Homo sapiens
guucuaguggcuugaggua

SEQ ID NO: 602969 - RNA, 19 nt, Homo sapiens
cgagaagcgagaccuuaga

SEQ ID NO: 602970 - RNA, 19 nt, Homo sapiens
cagcccucauccagaguuu

SEQ ID NO: 602971 - RNA, 19 nt, Homo sapiens
uuuaaaggcggcucuugaa

SEQ ID NO: 602972 - RNA, 19 nt, Homo sapiens
caauccguuugauaccauu

SEQ ID NO: 602973 - RNA, 19 nt, Homo sapiens
agaagugcccaacguggaa

SEQ ID NO: 602974 - RNA, 19 nt, Homo sapiens
gaaggaaaagauugcuauu

SEQ ID NO: 602975 - RNA, 19 nt, Homo sapiens
guggugcgacgccuucuug

SEQ ID NO: 602976 - RNA, 19 nt, Homo sapiens
gcuaaagaaagaugaagac

SEQ ID NO: 602977 - RNA, 19 nt, Homo sapiens
gaaaguucuaguggcuuga

SEQ ID NO: 602978 - RNA, 19 nt, Homo sapiens
ggcuagaagugcccaacgu

SEQ ID NO: 602979 - RNA, 19 nt, Homo sapiens
gcaaggagacggaauucua

SEQ ID NO: 602980 - RNA, 19 nt, Homo sapiens
caaagguucugaaaggaaa

SEQ ID NO: 602981 - RNA, 19 nt, Homo sapiens
uaaggaagaagcucuauuu

SEQ ID NO: 602982 - RNA, 19 nt, Homo sapiens
gaacagacaacucuaaacu

SEQ ID NO: 602983 - RNA, 19 nt, Homo sapiens
ggacgugcauuucaugaag

SEQ ID NO: 602984 - RNA, 19 nt, Homo sapiens
gaaaccaacacuuugagaa

SEQ ID NO: 602985 - RNA, 19 nt, Homo sapiens
gcacuugccuguguuuaca

SEQ ID NO: 602986 - RNA, 19 nt, Homo sapiens
gaggaaaccaacacuuuga

SEQ ID NO: 602987 - RNA, 19 nt, Homo sapiens
cagaggaggacuugaauga

SEQ ID NO: 602988 - RNA, 19 nt, Homo sapiens
aaaccaacacuuugagaaa

SEQ ID NO: 602989 - RNA, 19 nt, Homo sapiens
gcuugucucucucuaggaa

SEQ ID NO: 602990 - RNA, 19 nt, Homo sapiens
ggaaaccaacacuuugaga

SEQ ID NO: 602991 - RNA, 19 nt, Homo sapiens
caacuacacggcccugaug

SEQ ID NO: 602992 - RNA, 19 nt, Homo sapiens
gaauucuaccugugcauga

SEQ ID NO: 602993 - RNA, 19 nt, Homo sapiens
gggacgaugugagccguaa

SEQ ID NO: 602994 - RNA, 19 nt, Homo sapiens
ccaaagguucugaaaggaa

SEQ ID NO: 602995 - RNA, 19 nt, Homo sapiens
uacgugggcuucaccaaga

SEQ ID NO: 602996 - RNA, 19 nt, Homo sapiens
ucccaaagguucugaaagg

SEQ ID NO: 602997 - RNA, 19 nt, Homo sapiens
ugaggaaaccaacacuuug

SEQ ID NO: 602998 - RNA, 19 nt, Homo sapiens
aaacugcaucagaggaaua

SEQ ID NO: 602999 - RNA, 19 nt, Homo sapiens
acacgacggugaccaagag

SEQ ID NO: 603000 - RNA, 19 nt, Homo sapiens
gcaaggaguguguguucau

SEQ ID NO: 603001 - RNA, 19 nt, Homo sapiens
caaggaguguguguucauc

SEQ ID NO: 603002 - RNA, 19 nt, Homo sapiens
gacaaaagacucacgcaaa

SEQ ID NO: 603003 - RNA, 19 nt, Homo sapiens
gcaggacgugcauuucaug

SEQ ID NO: 603004 - RNA, 19 nt, Homo sapiens
cagcaggacgugcauuuca

SEQ ID NO: 603005 - RNA, 19 nt, Homo sapiens
cagcaaggaguguguguuc

SEQ ID NO: 603006 - RNA, 19 nt, Homo sapiens
cugcaucagaggaauauuu

SEQ ID NO: 603007 - RNA, 19 nt, Homo sapiens
caaguaugcccagcuccua

SEQ ID NO: 603008 - RNA, 19 nt, Homo sapiens
ggacuugaaugaggaaacc

SEQ ID NO: 603009 - RNA, 19 nt, Homo sapiens
uaggaacagacaacucuaa

SEQ ID NO: 603010 - RNA, 19 nt, Homo sapiens
gaaaacugcaucagaggaa

SEQ ID NO: 603011 - RNA, 19 nt, Homo sapiens
acacucacacucccagaaa

SEQ ID NO: 603012 - RNA, 19 nt, Homo sapiens
guagucaaguccggaucaa

SEQ ID NO: 603013 - RNA, 19 nt, Homo sapiens
caaggagacggaauucuac

SEQ ID NO: 603014 - RNA, 19 nt, Homo sapiens
acagacaccuucgguaguc

SEQ ID NO: 603015 - RNA, 19 nt, Homo sapiens
cacaggugcuugucucucu

SEQ ID NO: 603016 - RNA, 19 nt, Homo sapiens
gcccugaugucggcuaagu

SEQ ID NO: 603017 - RNA, 19 nt, Homo sapiens
aaauaaggaagaagcucua

SEQ ID NO: 603018 - RNA, 19 nt, Homo sapiens
gagcgcaacucggcuucca

SEQ ID NO: 603019 - RNA, 19 nt, Homo sapiens
cgccugcacuugccugugu

SEQ ID NO: 603020 - RNA, 19 nt, Homo sapiens
ggaacagacaacucuaaac

SEQ ID NO: 603021 - RNA, 19 nt, Homo sapiens
acaaaagacucacgcaaag

SEQ ID NO: 603022 - RNA, 19 nt, Homo sapiens
caccuucgguagucaaguc

SEQ ID NO: 603023 - RNA, 19 nt, Homo sapiens
augaggaaaccaacacuuu

SEQ ID NO: 603024 - RNA, 19 nt, Homo sapiens
gcaccagcaaggagugugu

SEQ ID NO: 603025 - RNA, 19 nt, Homo sapiens
cccaaagguucugaaagga

SEQ ID NO: 603026 - RNA, 19 nt, Homo sapiens
gacagacaccuucgguagu

SEQ ID NO: 603027 - RNA, 19 nt, Homo sapiens
gguagucaaguccggauca

SEQ ID NO: 603028 - RNA, 19 nt, Homo sapiens
gcugcugugcuuccaggua

SEQ ID NO: 603029 - RNA, 19 nt, Homo sapiens
cuaaguacuccggcuggua

SEQ ID NO: 603030 - RNA, 19 nt, Homo sapiens
gcaaggagacggaauucua

SEQ ID NO: 603031 - RNA, 19 nt, Homo sapiens
caaagguucugaaaggaaa

SEQ ID NO: 603032 - RNA, 19 nt, Homo sapiens
gaacagacaacucuaaacu

SEQ ID NO: 603033 - RNA, 19 nt, Homo sapiens
ggacgugcauuucaugaag

SEQ ID NO: 603034 - RNA, 19 nt, Homo sapiens
gaaaccaacacuuugagaa

SEQ ID NO: 603035 - RNA, 19 nt, Homo sapiens
gcacuugccuguguuuaca

SEQ ID NO: 603036 - RNA, 19 nt, Homo sapiens
gaggaaaccaacacuuuga

SEQ ID NO: 603037 - RNA, 19 nt, Homo sapiens
cagaggaggacuugaauga

SEQ ID NO: 603038 - RNA, 19 nt, Homo sapiens
aaaccaacacuuugagaaa

SEQ ID NO: 603039 - RNA, 19 nt, Homo sapiens
gcuugucucucucuaggaa

SEQ ID NO: 603040 - RNA, 19 nt, Homo sapiens
ggaaaccaacacuuugaga

SEQ ID NO: 603041 - RNA, 19 nt, Homo sapiens
caacuacacggcccugaug

SEQ ID NO: 603042 - RNA, 19 nt, Homo sapiens
gaauucuaccugugcauga

SEQ ID NO: 603043 - RNA, 19 nt, Homo sapiens
gggacgaugugagccguaa

SEQ ID NO: 603044 - RNA, 19 nt, Homo sapiens
ccaaagguucugaaaggaa

SEQ ID NO: 603045 - RNA, 19 nt, Homo sapiens
uacgugggcuucaccaaga

SEQ ID NO: 603046 - RNA, 19 nt, Homo sapiens
ucccaaagguucugaaagg

SEQ ID NO: 603047 - RNA, 19 nt, Homo sapiens
ugaggaaaccaacacuuug

SEQ ID NO: 603048 - RNA, 19 nt, Homo sapiens
aaacugcaucagaggaaua

SEQ ID NO: 603049 - RNA, 19 nt, Homo sapiens
acacgacggugaccaagag

SEQ ID NO: 603050 - RNA, 19 nt, Homo sapiens
gcaaggaguguguguucau

SEQ ID NO: 603051 - RNA, 19 nt, Homo sapiens
caaggaguguguguucauc

SEQ ID NO: 603052 - RNA, 19 nt, Homo sapiens
gacaaaagacucacgcaaa

SEQ ID NO: 603053 - RNA, 19 nt, Homo sapiens
gcaggacgugcauuucaug

SEQ ID NO: 603054 - RNA, 19 nt, Homo sapiens
cagcaggacgugcauuuca

SEQ ID NO: 603055 - RNA, 19 nt, Homo sapiens
cagcaaggaguguguguuc

SEQ ID NO: 603056 - RNA, 19 nt, Homo sapiens
cugcaucagaggaauauuu

SEQ ID NO: 603057 - RNA, 19 nt, Homo sapiens
caaguaugcccagcuccua

SEQ ID NO: 603058 - RNA, 19 nt, Homo sapiens
ggacuugaaugaggaaacc

SEQ ID NO: 603059 - RNA, 19 nt, Homo sapiens
uaggaacagacaacucuaa

SEQ ID NO: 603060 - RNA, 19 nt, Homo sapiens
gaaaacugcaucagaggaa

SEQ ID NO: 603061 - RNA, 19 nt, Homo sapiens
acacucacacucccagaaa

SEQ ID NO: 603062 - RNA, 19 nt, Homo sapiens
guagucaaguccggaucaa

SEQ ID NO: 603063 - RNA, 19 nt, Homo sapiens
caaggagacggaauucuac

SEQ ID NO: 603064 - RNA, 19 nt, Homo sapiens
acagacaccuucgguaguc

SEQ ID NO: 603065 - RNA, 19 nt, Homo sapiens
cacaggugcuugucucucu

SEQ ID NO: 603066 - RNA, 19 nt, Homo sapiens
gcccugaugucggcuaagu

SEQ ID NO: 603067 - RNA, 19 nt, Homo sapiens
cgccugcacuugccugugu

SEQ ID NO: 603068 - RNA, 19 nt, Homo sapiens
gagcgcaacucggcuucca

SEQ ID NO: 603069 - RNA, 19 nt, Homo sapiens
ggaacagacaacucuaaac

SEQ ID NO: 603070 - RNA, 19 nt, Homo sapiens
acaaaagacucacgcaaag

SEQ ID NO: 603071 - RNA, 19 nt, Homo sapiens
caccuucgguagucaaguc

SEQ ID NO: 603072 - RNA, 19 nt, Homo sapiens
augaggaaaccaacacuuu

SEQ ID NO: 603073 - RNA, 19 nt, Homo sapiens
gcaccagcaaggagugugu

SEQ ID NO: 603074 - RNA, 19 nt, Homo sapiens
cccaaagguucugaaagga

SEQ ID NO: 603075 - RNA, 19 nt, Homo sapiens
gacagacaccuucgguagu

SEQ ID NO: 603076 - RNA, 19 nt, Homo sapiens
gguagucaaguccggauca

SEQ ID NO: 603077 - RNA, 19 nt, Homo sapiens
gcugcugugcuuccaggua

SEQ ID NO: 603078 - RNA, 19 nt, Homo sapiens
cuaaguacuccggcuggua

SEQ ID NO: 603079 - RNA, 19 nt, Homo sapiens
ugggacagcugaccaauaa

SEQ ID NO: 603080 - RNA, 19 nt, Homo sapiens
cagacucccugccaccuuu

SEQ ID NO: 603081 - RNA, 19 nt, Homo sapiens
gcugaccaauaaacacuga

SEQ ID NO: 603082 - RNA, 19 nt, Homo sapiens
ccaagaaggcucagugaag

SEQ ID NO: 603083 - RNA, 19 nt, Homo sapiens
ggacagcugaccaauaaac

SEQ ID NO: 603084 - RNA, 19 nt, Homo sapiens
guucuaaggccacaugugu

SEQ ID NO: 603085 - RNA, 19 nt, Homo sapiens
ugaccucucugacuucucu

SEQ ID NO: 603086 - RNA, 19 nt, Homo sapiens
ugugugaccucucugacuu

SEQ ID NO: 603087 - RNA, 19 nt, Homo sapiens
gaccaagaaggcucaguga

SEQ ID NO: 603088 - RNA, 19 nt, Homo sapiens
gccguuagccugaucaucu

SEQ ID NO: 603089 - RNA, 19 nt, Homo sapiens
gcaugucauccacaaguau

SEQ ID NO: 603090 - RNA, 19 nt, Homo sapiens
gcucagggccuaaaagaug

SEQ ID NO: 603091 - RNA, 19 nt, Homo sapiens
agacuccggucaccuccuu

SEQ ID NO: 603092 - RNA, 19 nt, Homo sapiens
gagggagggauaccuggaa

SEQ ID NO: 603093 - RNA, 19 nt, Homo sapiens
ggagcuuacaccugacuga

SEQ ID NO: 603094 - RNA, 19 nt, Homo sapiens
ccuggguucugccgucuug

SEQ ID NO: 603095 - RNA, 19 nt, Homo sapiens
caagagagugaccaagaag

SEQ ID NO: 603096 - RNA, 19 nt, Homo sapiens
cagcaugucauccacaagu

SEQ ID NO: 603097 - RNA, 19 nt, Homo sapiens
gucagcaugucauccacaa

SEQ ID NO: 603098 - RNA, 19 nt, Homo sapiens
caugucauccacaaguauu

SEQ ID NO: 603099 - RNA, 19 nt, Homo sapiens
gaucaucuucaccuacuac

SEQ ID NO: 603100 - RNA, 19 nt, Homo sapiens
ccguuagccugaucaucuu

SEQ ID NO: 603101 - RNA, 19 nt, Homo sapiens
aagcuaggagggagggaua

SEQ ID NO: 603102 - RNA, 19 nt, Homo sapiens
agcaugucauccacaagua

SEQ ID NO: 603103 - RNA, 19 nt, Homo sapiens
caugcugacguuggacuua

SEQ ID NO: 603104 - RNA, 19 nt, Homo sapiens
gacagcugaccaauaaaca

SEQ ID NO: 603105 - RNA, 19 nt, Homo sapiens
gcacggcgcuggcuucauu

SEQ ID NO: 603106 - RNA, 19 nt, Homo sapiens
ugggacagcugaccaauaa

SEQ ID NO: 603107 - RNA, 19 nt, Homo sapiens
caaaugccguaaucuuaaa

SEQ ID NO: 603108 - RNA, 19 nt, Homo sapiens
caaagcaagugcccgguaa

SEQ ID NO: 603109 - RNA, 19 nt, Homo sapiens
gugaaggccuuuaggauau

SEQ ID NO: 603110 - RNA, 19 nt, Homo sapiens
agaaggaucuggcccaaga

SEQ ID NO: 603111 - RNA, 19 nt, Homo sapiens
ccaaaugccguaaucuuaa

SEQ ID NO: 603112 - RNA, 19 nt, Homo sapiens
gcaaacgccagugauauuu

SEQ ID NO: 603113 - RNA, 19 nt, Homo sapiens
gcccaagauugcauccuua

SEQ ID NO: 603114 - RNA, 19 nt, Homo sapiens
ccagagcaacuacuauaua

SEQ ID NO: 603115 - RNA, 19 nt, Homo sapiens
gaacuugguauccuuuaga

SEQ ID NO: 603116 - RNA, 19 nt, Homo sapiens
gguuauugcuuaagaagug

SEQ ID NO: 603117 - RNA, 19 nt, Homo sapiens
gcaagugcccgguaaauac

SEQ ID NO: 603118 - RNA, 19 nt, Homo sapiens
cagagcaacuacuauauag

SEQ ID NO: 603119 - RNA, 19 nt, Homo sapiens
gaaggccuuuaggauauuu

SEQ ID NO: 603120 - RNA, 19 nt, Homo sapiens
cccaaaugccguaaucuua

SEQ ID NO: 603121 - RNA, 19 nt, Homo sapiens
ccagagcucuucccucgau

SEQ ID NO: 603122 - RNA, 19 nt, Homo sapiens
cagacucccugccaccuuu

SEQ ID NO: 603123 - RNA, 19 nt, Homo sapiens
gggagucagucgaggauuc

SEQ ID NO: 603124 - RNA, 19 nt, Homo sapiens
ggcaaacgccagugauauu

SEQ ID NO: 603125 - RNA, 19 nt, Homo sapiens
ugggaaaacuuguugguua

SEQ ID NO: 603126 - RNA, 19 nt, Homo sapiens
ugugaaggccuuuaggaua

SEQ ID NO: 603127 - RNA, 19 nt, Homo sapiens
gcagaacuugguauccuuu

SEQ ID NO: 603128 - RNA, 19 nt, Homo sapiens
cuuaagaagugcagugugu

SEQ ID NO: 603129 - RNA, 19 nt, Homo sapiens
gcugaccaauaaacacuga

SEQ ID NO: 603130 - RNA, 19 nt, Homo sapiens
ccaagaaggcucagugaag

SEQ ID NO: 603131 - RNA, 19 nt, Homo sapiens
gaaaacuuguugguuauug

SEQ ID NO: 603132 - RNA, 19 nt, Homo sapiens
aaacgccagugauauuugu

SEQ ID NO: 603133 - RNA, 19 nt, Homo sapiens
ggcccaagauugcauccuu

SEQ ID NO: 603134 - RNA, 19 nt, Homo sapiens
cuugaacucuccagaacaa

SEQ ID NO: 603135 - RNA, 19 nt, Homo sapiens
ggacagcugaccaauaaac

SEQ ID NO: 603136 - RNA, 19 nt, Homo sapiens
ccgcuacacuuauaacucu

SEQ ID NO: 603137 - RNA, 19 nt, Homo sapiens
guucuaaggccacaugugu

SEQ ID NO: 603138 - RNA, 19 nt, Homo sapiens
ugaccucucugacuucucu

SEQ ID NO: 603139 - RNA, 19 nt, Homo sapiens
cgccagagcaacuacuaua

SEQ ID NO: 603140 - RNA, 19 nt, Homo sapiens
ugugugaccucucugacuu

SEQ ID NO: 603141 - RNA, 19 nt, Homo sapiens
gaccaagaaggcucaguga

SEQ ID NO: 603142 - RNA, 19 nt, Homo sapiens
uggaggaggugggacguuu

SEQ ID NO: 603143 - RNA, 19 nt, Homo sapiens
ugaaggccuuuaggauauu

SEQ ID NO: 603144 - RNA, 19 nt, Homo sapiens
guuagccugcugacucuua

SEQ ID NO: 603145 - RNA, 19 nt, Homo sapiens
cuugugcccuguucucuug

SEQ ID NO: 603146 - RNA, 19 nt, Homo sapiens
ccucaaguaccauuugcua

SEQ ID NO: 603147 - RNA, 19 nt, Homo sapiens
gggaaaacuuguugguuau

SEQ ID NO: 603148 - RNA, 19 nt, Homo sapiens
gcaaggcaagcaagacaca

SEQ ID NO: 603149 - RNA, 19 nt, Homo sapiens
gaggaagaugccaguggua

SEQ ID NO: 603150 - RNA, 19 nt, Homo sapiens
acacccaaaugccguaauc

SEQ ID NO: 603151 - RNA, 19 nt, Homo sapiens
gcaugucauccacaaguau

SEQ ID NO: 603152 - RNA, 19 nt, Homo sapiens
gccguuagccugaucaucu

SEQ ID NO: 603153 - RNA, 19 nt, Homo sapiens
acuuguugguuauugcuua

SEQ ID NO: 603154 - RNA, 19 nt, Homo sapiens
gcucagggccuaaaagaug

SEQ ID NO: 603155 - RNA, 19 nt, Homo sapiens
agacuccggucaccuccuu

SEQ ID NO: 603156 - RNA, 19 nt, Homo sapiens
gagggagggauaccuggaa

SEQ ID NO: 603157 - RNA, 19 nt, Homo sapiens
ggagcuuacaccugacuga

SEQ ID NO: 603158 - RNA, 19 nt, Homo sapiens
guugguuauugcuuaagaa

SEQ ID NO: 603159 - RNA, 19 nt, Homo sapiens
gugauucucuugguauguc

SEQ ID NO: 603160 - RNA, 19 nt, Homo sapiens
cuugguauccuuuagagaa

SEQ ID NO: 603161 - RNA, 19 nt, Homo sapiens
cagaacuugguauccuuua

SEQ ID NO: 603162 - RNA, 19 nt, Homo sapiens
ggguuagccugcugacucu

SEQ ID NO: 603163 - RNA, 19 nt, Homo sapiens
ccuggguucugccgucuug

SEQ ID NO: 603164 - RNA, 19 nt, Homo sapiens
caagagagugaccaagaag

SEQ ID NO: 603165 - RNA, 19 nt, Homo sapiens
cagcaugucauccacaagu

SEQ ID NO: 603166 - RNA, 19 nt, Homo sapiens
ggaggaggugggacguuug

SEQ ID NO: 603167 - RNA, 19 nt, Homo sapiens
aaaccacgacacccaaaug

SEQ ID NO: 603168 - RNA, 19 nt, Homo sapiens
uugguauccuuuagagaaa

SEQ ID NO: 603169 - RNA, 19 nt, Homo sapiens
gggugauucucuugguaug

SEQ ID NO: 603170 - RNA, 19 nt, Homo sapiens
gccagagcaacuacuauau

SEQ ID NO: 603171 - RNA, 19 nt, Homo sapiens
acacuuauaacucuguuuc

SEQ ID NO: 603172 - RNA, 19 nt, Homo sapiens
gucagcaugucauccacaa

SEQ ID NO: 603173 - RNA, 19 nt, Homo sapiens
gaacucuccagaacaacuc

SEQ ID NO: 603174 - RNA, 19 nt, Homo sapiens
ugccagugguaccgcauuu

SEQ ID NO: 603175 - RNA, 19 nt, Homo sapiens
caugucauccacaaguauu

SEQ ID NO: 603176 - RNA, 19 nt, Homo sapiens
ggucucuugugcccuguuc

SEQ ID NO: 603177 - RNA, 19 nt, Homo sapiens
cuccagaacaacucuauga

SEQ ID NO: 603178 - RNA, 19 nt, Homo sapiens
uugccugccucaucucuug

SEQ ID NO: 603179 - RNA, 19 nt, Homo sapiens
cuuguugguuauugcuuaa

SEQ ID NO: 603180 - RNA, 19 nt, Homo sapiens
gugcagaacuugguauccu

SEQ ID NO: 603181 - RNA, 19 nt, Homo sapiens
gaucaucuucaccuacuac

SEQ ID NO: 603182 - RNA, 19 nt, Homo sapiens
aagcuaggagggagggaua

SEQ ID NO: 603183 - RNA, 19 nt, Homo sapiens
agcaugucauccacaagua

SEQ ID NO: 603184 - RNA, 19 nt, Homo sapiens
ccguuagccugaucaucuu

SEQ ID NO: 603185 - RNA, 19 nt, Homo sapiens
cuacacuuauaacucuguu

SEQ ID NO: 603186 - RNA, 19 nt, Homo sapiens
caugcugacguuggacuua

SEQ ID NO: 603187 - RNA, 19 nt, Homo sapiens
caaaccacgacacccaaau

SEQ ID NO: 603188 - RNA, 19 nt, Homo sapiens
agaacuugguauccuuuag

SEQ ID NO: 603189 - RNA, 19 nt, Homo sapiens
agaacaacucuaugaggaa

SEQ ID NO: 603190 - RNA, 19 nt, Homo sapiens
ccagugguaccgcauuuua

SEQ ID NO: 603191 - RNA, 19 nt, Homo sapiens
agcaagugcccgguaaaua

SEQ ID NO: 603192 - RNA, 19 nt, Homo sapiens
ccuuagggcaggucucuug

SEQ ID NO: 603193 - RNA, 19 nt, Homo sapiens
acaacucuaugaggaagau

SEQ ID NO: 603194 - RNA, 19 nt, Homo sapiens
cugggugauucucuuggua

SEQ ID NO: 603195 - RNA, 19 nt, Homo sapiens
gacagcugaccaauaaaca

SEQ ID NO: 603196 - RNA, 19 nt, Homo sapiens
cgccagugauauuugugaa

SEQ ID NO: 603197 - RNA, 19 nt, Homo sapiens
gauaguugguugccacuuu

SEQ ID NO: 603198 - RNA, 19 nt, Homo sapiens
caaggcaucuuuacauaug

SEQ ID NO: 603199 - RNA, 19 nt, Homo sapiens
gcaagaggauccagaagag

SEQ ID NO: 603200 - RNA, 19 nt, Homo sapiens
gacguggaauugagacuaa

SEQ ID NO: 603201 - RNA, 19 nt, Homo sapiens
guaaauacacuuaggagau

SEQ ID NO: 603202 - RNA, 19 nt, Homo sapiens
gaccaggacuuaauaaagc

SEQ ID NO: 603203 - RNA, 19 nt, Homo sapiens
cgcaaggcaucuuuacaua

SEQ ID NO: 603204 - RNA, 19 nt, Homo sapiens
cgaaacagaagaaagagaa

SEQ ID NO: 603205 - RNA, 19 nt, Homo sapiens
gcaaggcaucuuuacauau

SEQ ID NO: 603206 - RNA, 19 nt, Homo sapiens
agaagaaggugaagaucga

SEQ ID NO: 603207 - RNA, 19 nt, Homo sapiens
gaaaagggagugaugauga

SEQ ID NO: 603208 - RNA, 19 nt, Homo sapiens
gaagaaugacaagaacaaa

SEQ ID NO: 603209 - RNA, 19 nt, Homo sapiens
ccucagcacuguccacugu

SEQ ID NO: 603210 - RNA, 19 nt, Homo sapiens
gaaacagaagaaagagaaa

SEQ ID NO: 603211 - RNA, 19 nt, Homo sapiens
guucgaaacagaagaaaga

SEQ ID NO: 603212 - RNA, 19 nt, Homo sapiens
auaguugguugccacuuua

SEQ ID NO: 603213 - RNA, 19 nt, Homo sapiens
gugaagaucgagcuggaua

SEQ ID NO: 603214 - RNA, 19 nt, Homo sapiens
aagagcaucucccagaaga

SEQ ID NO: 603215 - RNA, 19 nt, Homo sapiens
ccccagagguugauuuaua

SEQ ID NO: 603216 - RNA, 19 nt, Homo sapiens
ugauucaccuguucaagau

SEQ ID NO: 603217 - RNA, 19 nt, Homo sapiens
agaagagcaucucccagaa

SEQ ID NO: 603218 - RNA, 19 nt, Homo sapiens
ucagcacuguccacuguuu

SEQ ID NO: 603219 - RNA, 19 nt, Homo sapiens
ccaaccagaccaggacuua

SEQ ID NO: 603220 - RNA, 19 nt, Homo sapiens
caaaagacacuucaagcua

SEQ ID NO: 603221 - RNA, 19 nt, Homo sapiens
gagguugauuuauaccaau

SEQ ID NO: 603222 - RNA, 19 nt, Homo sapiens
gcgcaaggcaucuuuacau

SEQ ID NO: 603223 - RNA, 19 nt, Homo sapiens
gacaagaacaaaucagauc

SEQ ID NO: 603224 - RNA, 19 nt, Homo sapiens
ucuacucagugaagaauga

SEQ ID NO: 603225 - RNA, 19 nt, Homo sapiens
ugaagaaugacaagaacaa

SEQ ID NO: 603226 - RNA, 19 nt, Homo sapiens
ggaauugagacuaauaacu

SEQ ID NO: 603227 - RNA, 19 nt, Homo sapiens
uauuucaucuacucaguga

SEQ ID NO: 603228 - RNA, 19 nt, Homo sapiens
gaaugacaagaacaaauca

SEQ ID NO: 603229 - RNA, 19 nt, Homo sapiens
gaagagcaucucccagaag

SEQ ID NO: 603230 - RNA, 19 nt, Homo sapiens
gaagaucgagcuggauaag

SEQ ID NO: 603231 - RNA, 19 nt, Homo sapiens
agagguugauuuauaccaa

SEQ ID NO: 603232 - RNA, 19 nt, Homo sapiens
agaucgagcuggauaagag

SEQ ID NO: 603233 - RNA, 19 nt, Homo sapiens
cuuaauaaagcacaacuug

SEQ ID NO: 603234 - RNA, 19 nt, Homo sapiens
gagcaucucccagaagaag

SEQ ID NO: 603235 - RNA, 19 nt, Homo sapiens
agaaugacaagaacaaauc

SEQ ID NO: 603236 - RNA, 19 nt, Homo sapiens
cauauuucaucuacucagu

SEQ ID NO: 603237 - RNA, 19 nt, Homo sapiens
gguugccacuuuaggucua

SEQ ID NO: 603238 - RNA, 19 nt, Homo sapiens
uaggagacguggaauugag

SEQ ID NO: 603239 - RNA, 19 nt, Homo sapiens
cagugaagaaugacaagaa

SEQ ID NO: 603240 - RNA, 19 nt, Homo sapiens
ccagaccaggacuuaauaa

SEQ ID NO: 603241 - RNA, 19 nt, Homo sapiens
agacuaauaacuuggaugu

SEQ ID NO: 603242 - RNA, 19 nt, Homo sapiens
guggaauugagacuaauaa

SEQ ID NO: 603243 - RNA, 19 nt, Homo sapiens
caccuuaacauauuucauc

SEQ ID NO: 603244 - RNA, 19 nt, Homo sapiens
uaauucagaguguucgaaa

SEQ ID NO: 603245 - RNA, 19 nt, Homo sapiens
gcaggcaacgccagcuuca

SEQ ID NO: 603246 - RNA, 19 nt, Homo sapiens
uuaggucuauuccagugaa

SEQ ID NO: 603247 - RNA, 19 nt, Homo sapiens
cuucacgccugacgagaug

SEQ ID NO: 603248 - RNA, 19 nt, Homo sapiens
cagaccaggacuuaauaaa

SEQ ID NO: 603249 - RNA, 19 nt, Homo sapiens
caaccagaccaggacuuaa

SEQ ID NO: 603250 - RNA, 19 nt, Homo sapiens
ugacaagaacaaaucagau

SEQ ID NO: 603251 - RNA, 19 nt, Homo sapiens
ggagagaggggauuucugu

SEQ ID NO: 603252 - RNA, 19 nt, Homo sapiens
cccagagguugauuuauac

SEQ ID NO: 603253 - RNA, 19 nt, Homo sapiens
ugaagaucgagcuggauaa

SEQ ID NO: 603254 - RNA, 19 nt, Homo sapiens
agaccaggacuuaauaaag

SEQ ID NO: 603255 - RNA, 19 nt, Homo sapiens
ucagcaagaggauccagaa

SEQ ID NO: 603256 - RNA, 19 nt, Homo sapiens
acuaggagacguggaauug

SEQ ID NO: 603257 - RNA, 19 nt, Homo sapiens
auucaccuguucaagauau

SEQ ID NO: 603258 - RNA, 19 nt, Homo sapiens
cguggaauugagacuaaua

SEQ ID NO: 603259 - RNA, 19 nt, Homo sapiens
aacgccagcuucagcaaga

SEQ ID NO: 603260 - RNA, 19 nt, Homo sapiens
ccgugccgcugucuaacuu

SEQ ID NO: 603261 - RNA, 19 nt, Homo sapiens
gcaacgccagcuucagcaa

SEQ ID NO: 603262 - RNA, 19 nt, Homo sapiens
aaccagaccaggacuuaau

SEQ ID NO: 603263 - RNA, 19 nt, Homo sapiens
cgggacaguugguguuugg

SEQ ID NO: 603264 - RNA, 19 nt, Homo sapiens
acuuggauguuaacacugu

SEQ ID NO: 603265 - RNA, 19 nt, Homo sapiens
acacuuaggagauacaaaa

SEQ ID NO: 603266 - RNA, 19 nt, Homo sapiens
gauucaccuguucaagaua

SEQ ID NO: 603267 - RNA, 19 nt, Homo sapiens
gaugaugauggaggugauu

SEQ ID NO: 603268 - RNA, 19 nt, Homo sapiens
gagcgcaaggcaucuuuac

SEQ ID NO: 603269 - RNA, 19 nt, Homo sapiens
gaaagacuguguuccauua

SEQ ID NO: 603270 - RNA, 19 nt, Homo sapiens
acacaaaucugcuggaaua

SEQ ID NO: 603271 - RNA, 19 nt, Homo sapiens
agaaagagcuucgaaauau

SEQ ID NO: 603272 - RNA, 19 nt, Homo sapiens
gaaagaugguaacuuaugu

SEQ ID NO: 603273 - RNA, 19 nt, Homo sapiens
gaaagagcuucgaaauaug

SEQ ID NO: 603274 - RNA, 19 nt, Homo sapiens
agggaaagaugguaacuua

SEQ ID NO: 603275 - RNA, 19 nt, Homo sapiens
guaaacugcuauccuggua

SEQ ID NO: 603276 - RNA, 19 nt, Homo sapiens
gaugguaacuuaugucuac

SEQ ID NO: 603277 - RNA, 19 nt, Homo sapiens
gcuaauuacuugcaaacaa

SEQ ID NO: 603278 - RNA, 19 nt, Homo sapiens
ggaaagaugguaacuuaug

SEQ ID NO: 603279 - RNA, 19 nt, Homo sapiens
aaaccagauugaaguguua

SEQ ID NO: 603280 - RNA, 19 nt, Homo sapiens
aaagagaguugaguuggua

SEQ ID NO: 603281 - RNA, 19 nt, Homo sapiens
caacacaaaucugcuggaa

SEQ ID NO: 603282 - RNA, 19 nt, Homo sapiens
gaagaaagacuguguucca

SEQ ID NO: 603283 - RNA, 19 nt, Homo sapiens
ccauagagaaucacaguuu

SEQ ID NO: 603284 - RNA, 19 nt, Homo sapiens
gaagaucccagcccuauac

SEQ ID NO: 603285 - RNA, 19 nt, Homo sapiens
uagagaaaguuaagucugu

SEQ ID NO: 603286 - RNA, 19 nt, Homo sapiens
gaaucacaguuucuaaugg

SEQ ID NO: 603287 - RNA, 19 nt, Homo sapiens
gugcaucacuucuuuagag

SEQ ID NO: 603288 - RNA, 19 nt, Homo sapiens
aagaaagagcuucgaaaua

SEQ ID NO: 603289 - RNA, 19 nt, Homo sapiens
gaaaaggucccauagagaa

SEQ ID NO: 603290 - RNA, 19 nt, Homo sapiens
agagaagacuuagcucaaa

SEQ ID NO: 603291 - RNA, 19 nt, Homo sapiens
gggcaaguguucauugaca

SEQ ID NO: 603292 - RNA, 19 nt, Homo sapiens
ggaagaucccagcccuaua

SEQ ID NO: 603293 - RNA, 19 nt, Homo sapiens
gaaucuagaggaagacaga

SEQ ID NO: 603294 - RNA, 19 nt, Homo sapiens
aaggugaacugcaggaaga

SEQ ID NO: 603295 - RNA, 19 nt, Homo sapiens
gaguugaguugguauagag

SEQ ID NO: 603296 - RNA, 19 nt, Homo sapiens
gaaaguuaagucuguguuc

SEQ ID NO: 603297 - RNA, 19 nt, Homo sapiens
aaagagcuucgaaauauga

SEQ ID NO: 603298 - RNA, 19 nt, Homo sapiens
cauagagaaucacaguuuc

SEQ ID NO: 603299 - RNA, 19 nt, Homo sapiens
gagaagacuuagcucaaaa

SEQ ID NO: 603300 - RNA, 19 nt, Homo sapiens
agacuguguuccauuaaug

SEQ ID NO: 603301 - RNA, 19 nt, Homo sapiens
gaaaacaaacccucaacuu

SEQ ID NO: 603302 - RNA, 19 nt, Homo sapiens
gaagaccaagaacugcuuu

SEQ ID NO: 603303 - RNA, 19 nt, Homo sapiens
aaacugcuauccugguauc

SEQ ID NO: 603304 - RNA, 19 nt, Homo sapiens
cgauauuagagaagacuua

SEQ ID NO: 603305 - RNA, 19 nt, Homo sapiens
guaucgauauuagagaaga

SEQ ID NO: 603306 - RNA, 19 nt, Homo sapiens
gcagaggccagagcuguug

SEQ ID NO: 603307 - RNA, 19 nt, Homo sapiens
uuaagucuguguucugcuu

SEQ ID NO: 603308 - RNA, 19 nt, Homo sapiens
aauugaaucuagaggaaga

SEQ ID NO: 603309 - RNA, 19 nt, Homo sapiens
gcaaguguucauugacaug

SEQ ID NO: 603310 - RNA, 19 nt, Homo sapiens
cagauugaaguguuagaaa

SEQ ID NO: 603311 - RNA, 19 nt, Homo sapiens
uauagaggccgaagaccaa

SEQ ID NO: 603312 - RNA, 19 nt, Homo sapiens
acccucaacuugcuccuuu

SEQ ID NO: 603313 - RNA, 19 nt, Homo sapiens
gcuaaaacuuucuaagaca

SEQ ID NO: 603314 - RNA, 19 nt, Homo sapiens
uagagaagacuuagcucaa

SEQ ID NO: 603315 - RNA, 19 nt, Homo sapiens
agaaagacuguguuccauu

SEQ ID NO: 603316 - RNA, 19 nt, Homo sapiens
gacaggauuuuaauuagug

SEQ ID NO: 603317 - RNA, 19 nt, Homo sapiens
ugguaucgauauuagagaa

SEQ ID NO: 603318 - RNA, 19 nt, Homo sapiens
ggccgaagaccaagaacug

SEQ ID NO: 603319 - RNA, 19 nt, Homo sapiens
cagaagaaagacuguguuc

SEQ ID NO: 603320 - RNA, 19 nt, Homo sapiens
aaaguuaagucuguguucu

SEQ ID NO: 603321 - RNA, 19 nt, Homo sapiens
gauauuagagaagacuuag

SEQ ID NO: 603322 - RNA, 19 nt, Homo sapiens
ggagcuauaaggugaacug

SEQ ID NO: 603323 - RNA, 19 nt, Homo sapiens
agaguugaguugguauaga

SEQ ID NO: 603324 - RNA, 19 nt, Homo sapiens
gggaaagaugguaacuuau

SEQ ID NO: 603325 - RNA, 19 nt, Homo sapiens
aagacuguguuccauuaau

SEQ ID NO: 603326 - RNA, 19 nt, Homo sapiens
aagaaagacuguguuccau

SEQ ID NO: 603327 - RNA, 19 nt, Homo sapiens
gcgcucagcucggggaaaa

SEQ ID NO: 603328 - RNA, 19 nt, Homo sapiens
gugcagaccacgagaggau

SEQ ID NO: 603329 - RNA, 19 nt, Homo sapiens
cugggcaaguguucauuga

SEQ ID NO: 603330 - RNA, 19 nt, Homo sapiens
cccaaugccagaagaaaga

SEQ ID NO: 603331 - RNA, 19 nt, Homo sapiens
aaaacaaacccucaacuug

SEQ ID NO: 603332 - RNA, 19 nt, Homo sapiens
gcagaccacgagaggaugu

SEQ ID NO: 603333 - RNA, 19 nt, Homo sapiens
ggcaaguguucauugacau

SEQ ID NO: 603334 - RNA, 19 nt, Homo sapiens
gagaaaguuaagucugugu

SEQ ID NO: 603335 - RNA, 19 nt, Homo sapiens
gacuguguuccauuaauga

SEQ ID NO: 603336 - RNA, 19 nt, Homo sapiens
ccagauugaaguguuagaa

SEQ ID NO: 603337 - RNA, 19 nt, Homo sapiens
aaagacuguguuccauuaa

SEQ ID NO: 603338 - RNA, 19 nt, Homo sapiens
ccagaagaaagacuguguu

SEQ ID NO: 603339 - RNA, 19 nt, Homo sapiens
gagaguugaguugguauag

SEQ ID NO: 603340 - RNA, 19 nt, Homo sapiens
gcugggcaaguguucauug

SEQ ID NO: 603341 - RNA, 19 nt, Homo sapiens
aaaaccagauugaaguguu

SEQ ID NO: 603342 - RNA, 19 nt, Homo sapiens
cgaagaccaagaacugcuu

SEQ ID NO: 603343 - RNA, 19 nt, Homo sapiens
ggaccagaagaaagacugu

SEQ ID NO: 603344 - RNA, 19 nt, Homo sapiens
aaacugaaaaggucccaua

SEQ ID NO: 603345 - RNA, 19 nt, Homo sapiens
caagaacugcuuuuacuca

SEQ ID NO: 603346 - RNA, 19 nt, Homo sapiens
ucaauugagagaaucuuag

SEQ ID NO: 603347 - RNA, 19 nt, Homo sapiens
ccagacagcuugaagaauu

SEQ ID NO: 603348 - RNA, 19 nt, Homo sapiens
uaucagaucuuuaguguga

SEQ ID NO: 603349 - RNA, 19 nt, Homo sapiens
caacaucaaucaacuacaa

SEQ ID NO: 603350 - RNA, 19 nt, Homo sapiens
gaaagaugcucucuacgau

SEQ ID NO: 603351 - RNA, 19 nt, Homo sapiens
gaacccaguauguaaauua

SEQ ID NO: 603352 - RNA, 19 nt, Homo sapiens
gagaauguacugaagaaua

SEQ ID NO: 603353 - RNA, 19 nt, Homo sapiens
gauaucagaucuuuagugu

SEQ ID NO: 603354 - RNA, 19 nt, Homo sapiens
gcagaaaccaggagauaaa

SEQ ID NO: 603355 - RNA, 19 nt, Homo sapiens
gggcagcacuuucuuccua

SEQ ID NO: 603356 - RNA, 19 nt, Homo sapiens
uaaagaacccaguauguaa

SEQ ID NO: 603357 - RNA, 19 nt, Homo sapiens
caaaggaaguucucagcaa

SEQ ID NO: 603358 - RNA, 19 nt, Homo sapiens
aaagaugccuccugauuau

SEQ ID NO: 603359 - RNA, 19 nt, Homo sapiens
ccagaagacuccaaaugaa

SEQ ID NO: 603360 - RNA, 19 nt, Homo sapiens
gaagguugaucauggaaau

SEQ ID NO: 603361 - RNA, 19 nt, Homo sapiens
ggaagcuacuccauagauu

SEQ ID NO: 603362 - RNA, 19 nt, Homo sapiens
acacagcccucacuugaaa

SEQ ID NO: 603363 - RNA, 19 nt, Homo sapiens
gaacugacauuuggacaag

SEQ ID NO: 603364 - RNA, 19 nt, Homo sapiens
guacacagcccucacuuga

SEQ ID NO: 603365 - RNA, 19 nt, Homo sapiens
gacaguugcuucaugugua

SEQ ID NO: 603366 - RNA, 19 nt, Homo sapiens
gagagcugcugaagucaaa

SEQ ID NO: 603367 - RNA, 19 nt, Homo sapiens
gaagccaaauccaaugaug

SEQ ID NO: 603368 - RNA, 19 nt, Homo sapiens
gaucaaauggugaauaugu

SEQ ID NO: 603369 - RNA, 19 nt, Homo sapiens
ugauuucccuucacauuaa

SEQ ID NO: 603370 - RNA, 19 nt, Homo sapiens
ucuaugaugucaaggauaa

SEQ ID NO: 603371 - RNA, 19 nt, Homo sapiens
gaaccuucauuaacagaug

SEQ ID NO: 603372 - RNA, 19 nt, Homo sapiens
ggaagagccugaacugcau

SEQ ID NO: 603373 - RNA, 19 nt, Homo sapiens
gaagcuacuccauagauuu

SEQ ID NO: 603374 - RNA, 19 nt, Homo sapiens
ccggauaccaguuuauuua

SEQ ID NO: 603375 - RNA, 19 nt, Homo sapiens
gugaucaaauggugaauau

SEQ ID NO: 603376 - RNA, 19 nt, Homo sapiens
gaauugauuucccuucaca

SEQ ID NO: 603377 - RNA, 19 nt, Homo sapiens
caaaugaaccgcaguugga

SEQ ID NO: 603378 - RNA, 19 nt, Homo sapiens
gaacugcauuauugcuaug

SEQ ID NO: 603379 - RNA, 19 nt, Homo sapiens
gaaguuggccgaaguuucu

SEQ ID NO: 603380 - RNA, 19 nt, Homo sapiens
gugaauauguuccaagaca

SEQ ID NO: 603381 - RNA, 19 nt, Homo sapiens
gaaaagaugccuccugauu

SEQ ID NO: 603382 - RNA, 19 nt, Homo sapiens
ccauagauuugaaacagaa

SEQ ID NO: 603383 - RNA, 19 nt, Homo sapiens
gcaagaaaguauuaaucag

SEQ ID NO: 603384 - RNA, 19 nt, Homo sapiens
ggacaaacugauugaaaga

SEQ ID NO: 603385 - RNA, 19 nt, Homo sapiens
gaaguucucagcaacauca

SEQ ID NO: 603386 - RNA, 19 nt, Homo sapiens
uagagaauguacugaagaa

SEQ ID NO: 603387 - RNA, 19 nt, Homo sapiens
gagagaugagcaccaguua

SEQ ID NO: 603388 - RNA, 19 nt, Homo sapiens
gauuaaagaaggacaguug

SEQ ID NO: 603389 - RNA, 19 nt, Homo sapiens
caagagaggacugguauga

SEQ ID NO: 603390 - RNA, 19 nt, Homo sapiens
gagaugagcaccaguuaca

SEQ ID NO: 603391 - RNA, 19 nt, Homo sapiens
caacuacaaccucuuauag

SEQ ID NO: 603392 - RNA, 19 nt, Homo sapiens
guacauacagcgaugaaau

SEQ ID NO: 603393 - RNA, 19 nt, Homo sapiens
gauaguacaauaugaagga

SEQ ID NO: 603394 - RNA, 19 nt, Homo sapiens
uuaaagaacccaguaugua

SEQ ID NO: 603395 - RNA, 19 nt, Homo sapiens
ugaauacacuggugcagau

SEQ ID NO: 603396 - RNA, 19 nt, Homo sapiens
gaaccgcaguuggaauuca

SEQ ID NO: 603397 - RNA, 19 nt, Homo sapiens
gcauagagaauguacugaa

SEQ ID NO: 603398 - RNA, 19 nt, Homo sapiens
gucacuaccucuacagauu

SEQ ID NO: 603399 - RNA, 19 nt, Homo sapiens
agccugaacugcauuauug

SEQ ID NO: 603400 - RNA, 19 nt, Homo sapiens
aaagaagauuugugcagaa

SEQ ID NO: 603401 - RNA, 19 nt, Homo sapiens
ucacuaccucuacagauua

SEQ ID NO: 603402 - RNA, 19 nt, Homo sapiens
uggaaaagcugacaccuaa

SEQ ID NO: 603403 - RNA, 19 nt, Homo sapiens
ggugagcuuucuccacauu

SEQ ID NO: 603404 - RNA, 19 nt, Homo sapiens
gguauucguuucaccuguu

SEQ ID NO: 603405 - RNA, 19 nt, Homo sapiens
acgagaacauuacguggua

SEQ ID NO: 603406 - RNA, 19 nt, Homo sapiens
auacagcgaugaaauugga

SEQ ID NO: 603407 - RNA, 19 nt, Homo sapiens
caaaggagagaaaacauua

SEQ ID NO: 603408 - RNA, 19 nt, Homo sapiens
gaagaagggcagcacuuuc

SEQ ID NO: 603409 - RNA, 19 nt, Homo sapiens
acaaacugauugaaagaga

SEQ ID NO: 603410 - RNA, 19 nt, Homo sapiens
ugggagagcugcugaaguc

SEQ ID NO: 603411 - RNA, 19 nt, Homo sapiens
aagcugacaccuaaguuua

SEQ ID NO: 603412 - RNA, 19 nt, Homo sapiens
caggaagacgagaacauua

SEQ ID NO: 603413 - RNA, 19 nt, Homo sapiens
gcagugguggcaacaauga

SEQ ID NO: 603414 - RNA, 19 nt, Homo sapiens
ccaggaggcauucuuaaga

SEQ ID NO: 603415 - RNA, 19 nt, Homo sapiens
agagagcauucuuuccuuu

SEQ ID NO: 603416 - RNA, 19 nt, Homo sapiens
ucaacuacaaccucuuaua

SEQ ID NO: 603417 - RNA, 19 nt, Homo sapiens
uuucagggauuuaagaaug

SEQ ID NO: 603418 - RNA, 19 nt, Homo sapiens
gaagucaaaggagcaauug

SEQ ID NO: 603419 - RNA, 19 nt, Homo sapiens
cugaguaucccaucuauga

SEQ ID NO: 603420 - RNA, 19 nt, Homo sapiens
ggacaguugcuucaugugu

SEQ ID NO: 603421 - RNA, 19 nt, Homo sapiens
gguugaucauggaaauuaa

SEQ ID NO: 603422 - RNA, 19 nt, Homo sapiens
ugaacugcauuauugcuau

SEQ ID NO: 603423 - RNA, 19 nt, Homo sapiens
aaucaacuacaaccucuua

SEQ ID NO: 603424 - RNA, 19 nt, Homo sapiens
gaaauaccggauaccaguu

SEQ ID NO: 603425 - RNA, 19 nt, Homo sapiens
ugaaagaugcucucuacga

SEQ ID NO: 603426 - RNA, 19 nt, Homo sapiens
ucaaggauaagucucauga

SEQ ID NO: 603427 - RNA, 19 nt, Homo sapiens
caaacugauugaaagagau

SEQ ID NO: 603428 - RNA, 19 nt, Homo sapiens
gaagaaauaccggauacca

SEQ ID NO: 603429 - RNA, 19 nt, Homo sapiens
aagaugcucucuacgaugu

SEQ ID NO: 603430 - RNA, 19 nt, Homo sapiens
cuacagcccaggccaauga

SEQ ID NO: 603431 - RNA, 19 nt, Homo sapiens
gugcagaaaccaggagaua

SEQ ID NO: 603432 - RNA, 19 nt, Homo sapiens
gaagauuugugcagaaacc

SEQ ID NO: 603433 - RNA, 19 nt, Homo sapiens
aagaagauuugugcagaaa

SEQ ID NO: 603434 - RNA, 19 nt, Homo sapiens
ugaacaaugcucaaucuug

SEQ ID NO: 603435 - RNA, 19 nt, Homo sapiens
gccgcaaacugaaugguau

SEQ ID NO: 603436 - RNA, 19 nt, Homo sapiens
gaugccuccugauuauauu

SEQ ID NO: 603437 - RNA, 19 nt, Homo sapiens
uggcaacaaugauggagaa

SEQ ID NO: 603438 - RNA, 19 nt, Homo sapiens
aaacacagccaaagcaaag

SEQ ID NO: 603439 - RNA, 19 nt, Homo sapiens
ucacaaguauccagaagac

SEQ ID NO: 603440 - RNA, 19 nt, Homo sapiens
aaagaagaaauaccggaua

SEQ ID NO: 603441 - RNA, 19 nt, Homo sapiens
aaagaacccaguauguaaa

SEQ ID NO: 603442 - RNA, 19 nt, Homo sapiens
gagcggaaaagauaacuua

SEQ ID NO: 603443 - RNA, 19 nt, Homo sapiens
aaacuaacagucuaugaug

SEQ ID NO: 603444 - RNA, 19 nt, Homo sapiens
cauagagaauguacugaag

SEQ ID NO: 603445 - RNA, 19 nt, Homo sapiens
gcgcuggauugcaugagaa

SEQ ID NO: 603446 - RNA, 19 nt, Homo sapiens
gcacuugcuggauugguuu

SEQ ID NO: 603447 - RNA, 19 nt, Homo sapiens
caaccucacucugugcuua

SEQ ID NO: 603448 - RNA, 19 nt, Homo sapiens
gagcaaagacugcguguuc

SEQ ID NO: 603449 - RNA, 19 nt, Homo sapiens
gggcugagagugagaagua

SEQ ID NO: 603450 - RNA, 19 nt, Homo sapiens
gcagaagcaguucgaguuu

SEQ ID NO: 603451 - RNA, 19 nt, Homo sapiens
cugauucucugcugucaaa

SEQ ID NO: 603452 - RNA, 19 nt, Homo sapiens
aaucacccgucuccuaauu

SEQ ID NO: 603453 - RNA, 19 nt, Homo sapiens
agaaucacccgucuccuaa

SEQ ID NO: 603454 - RNA, 19 nt, Homo sapiens
agaagcaguucgaguuugu

SEQ ID NO: 603455 - RNA, 19 nt, Homo sapiens
caaguuugccaagcucaua

SEQ ID NO: 603456 - RNA, 19 nt, Homo sapiens
cagaagcaguucgaguuug

SEQ ID NO: 603457 - RNA, 19 nt, Homo sapiens
gcacgagggcugguucaug

SEQ ID NO: 603458 - RNA, 19 nt, Homo sapiens
cgaggacggcaacaaguuu

SEQ ID NO: 603459 - RNA, 19 nt, Homo sapiens
ccgagaagcagaagcaguu

SEQ ID NO: 603460 - RNA, 19 nt, Homo sapiens
cagccggguucgcaucaaa

SEQ ID NO: 603461 - RNA, 19 nt, Homo sapiens
gaggacggcaacaaguuug

SEQ ID NO: 603462 - RNA, 19 nt, Homo sapiens
caucaagcgccucuaccaa

SEQ ID NO: 603463 - RNA, 19 nt, Homo sapiens
gcagauccgcgaguaccaa

SEQ ID NO: 603464 - RNA, 19 nt, Homo sapiens
ucacccgucuccuaauuuu

SEQ ID NO: 603465 - RNA, 19 nt, Homo sapiens
gaaucacccgucuccuaau

SEQ ID NO: 603466 - RNA, 19 nt, Homo sapiens
gcgaggcccacuucaucaa

SEQ ID NO: 603467 - RNA, 19 nt, Homo sapiens
agaucgugcuggagaacaa

SEQ ID NO: 603468 - RNA, 19 nt, Homo sapiens
ucaaaggggcugagaguga

SEQ ID NO: 603469 - RNA, 19 nt, Homo sapiens
gcagccggguucgcaucaa

SEQ ID NO: 603470 - RNA, 19 nt, Homo sapiens
cggagaucgugcuggagaa

SEQ ID NO: 603471 - RNA, 19 nt, Homo sapiens
ccgaggacggcaacaaguu

SEQ ID NO: 603472 - RNA, 19 nt, Homo sapiens
gaagaaaacugguacaaca

SEQ ID NO: 603473 - RNA, 19 nt, Homo sapiens
guacaaacauucggacuca

SEQ ID NO: 603474 - RNA, 19 nt, Homo sapiens
ggacuaaacgacaccagaa

SEQ ID NO: 603475 - RNA, 19 nt, Homo sapiens
acucagagagacaguauua

SEQ ID NO: 603476 - RNA, 19 nt, Homo sapiens
ccagaaauucacucacuuu

SEQ ID NO: 603477 - RNA, 19 nt, Homo sapiens
ggacucagagagacaguau

SEQ ID NO: 603478 - RNA, 19 nt, Homo sapiens
cuaaacgacaccagaaauu

SEQ ID NO: 603479 - RNA, 19 nt, Homo sapiens
gggaacaguuugaagaaaa

SEQ ID NO: 603480 - RNA, 19 nt, Homo sapiens
caccagaaauucacucacu

SEQ ID NO: 603481 - RNA, 19 nt, Homo sapiens
ccucaaccuuguacaaaca

SEQ ID NO: 603482 - RNA, 19 nt, Homo sapiens
aaacgacaccagaaauuca

SEQ ID NO: 603483 - RNA, 19 nt, Homo sapiens
uaaacgacaccagaaauuc

SEQ ID NO: 603484 - RNA, 19 nt, Homo sapiens
cgggagggauacaggacua

SEQ ID NO: 603485 - RNA, 19 nt, Homo sapiens
ucggaauccuggaguuuau

SEQ ID NO: 603486 - RNA, 19 nt, Homo sapiens
cgggaacaguuugaagaaa

SEQ ID NO: 603487 - RNA, 19 nt, Homo sapiens
gacuaaacgacaccagaaa

SEQ ID NO: 603488 - RNA, 19 nt, Homo sapiens
uuacguggcccugaacaaa

SEQ ID NO: 603489 - RNA, 19 nt, Homo sapiens
ggaauccuggaguuuauca

SEQ ID NO: 603490 - RNA, 19 nt, Homo sapiens
ggagggauacaggacuaaa

SEQ ID NO: 603491 - RNA, 19 nt, Homo sapiens
aguauuacguggcccugaa

SEQ ID NO: 603492 - RNA, 19 nt, Homo sapiens
ccacagccgcuucggaauc

SEQ ID NO: 603493 - RNA, 19 nt, Homo sapiens
acaaacauucggacucaga

SEQ ID NO: 603494 - RNA, 19 nt, Homo sapiens
gagaccucuuucacuauag

SEQ ID NO: 603495 - RNA, 19 nt, Homo sapiens
aaacugguacaacaccuau

SEQ ID NO: 603496 - RNA, 19 nt, Homo sapiens
ugagcgaggagaacucuau

SEQ ID NO: 603497 - RNA, 19 nt, Homo sapiens
gagcgaggagaacucuaug

SEQ ID NO: 603498 - RNA, 19 nt, Homo sapiens
ggacucuggccuguaccua

SEQ ID NO: 603499 - RNA, 19 nt, Homo sapiens
acguggcccugaacaaaga

SEQ ID NO: 603500 - RNA, 19 nt, Homo sapiens
ucaaccuuguacaaacauu

SEQ ID NO: 603501 - RNA, 19 nt, Homo sapiens
gaacucuaugggucgaaga

SEQ ID NO: 603502 - RNA, 19 nt, Homo sapiens
gccuguaccuaggaaugaa

SEQ ID NO: 603503 - RNA, 19 nt, Homo sapiens
gcuucggaauccuggaguu

SEQ ID NO: 603504 - RNA, 19 nt, Homo sapiens
ccucuuucacuauagguaa

SEQ ID NO: 603505 - RNA, 19 nt, Homo sapiens
cuucuaaguugcccuccau

SEQ ID NO: 603506 - RNA, 19 nt, Homo sapiens
caaccuuguacaaacauuc

SEQ ID NO: 603507 - RNA, 19 nt, Homo sapiens
ccgggaacaguuugaagaa

SEQ ID NO: 603508 - RNA, 19 nt, Homo sapiens
ggccuguaccuaggaauga

SEQ ID NO: 603509 - RNA, 19 nt, Homo sapiens
gcaggaagaugaugaagua

SEQ ID NO: 603510 - RNA, 19 nt, Homo sapiens
uaacaagccuuucaagaug

SEQ ID NO: 603511 - RNA, 19 nt, Homo sapiens
gaggagauucuugcaauua

SEQ ID NO: 603512 - RNA, 19 nt, Homo sapiens
ggaagaugaugaaguacug

SEQ ID NO: 603513 - RNA, 19 nt, Homo sapiens
gaauaucgcccacuuugga

SEQ ID NO: 603514 - RNA, 19 nt, Homo sapiens
agaaagaaguugauuccuu

SEQ ID NO: 603515 - RNA, 19 nt, Homo sapiens
gaagcuaaauaggaaaguu

SEQ ID NO: 603516 - RNA, 19 nt, Homo sapiens
uggcauggcuuccuuguau

SEQ ID NO: 603517 - RNA, 19 nt, Homo sapiens
gcaauuaacaagccuuuca

SEQ ID NO: 603518 - RNA, 19 nt, Homo sapiens
agaaggaaauggacagaga

SEQ ID NO: 603519 - RNA, 19 nt, Homo sapiens
cagcuaagcaggaagauga

SEQ ID NO: 603520 - RNA, 19 nt, Homo sapiens
aaagagagagugugugauu

SEQ ID NO: 603521 - RNA, 19 nt, Homo sapiens
gagagugugugauuagaag

SEQ ID NO: 603522 - RNA, 19 nt, Homo sapiens
cgaggagccugaagagaga

SEQ ID NO: 603523 - RNA, 19 nt, Homo sapiens
ucaagucagugaggaguaa

SEQ ID NO: 603524 - RNA, 19 nt, Homo sapiens
gcucuaaccugccggugau

SEQ ID NO: 603525 - RNA, 19 nt, Homo sapiens
gagagagugugugauuaga

SEQ ID NO: 603526 - RNA, 19 nt, Homo sapiens
uaaauucacugaggaagag

SEQ ID NO: 603527 - RNA, 19 nt, Homo sapiens
gcuggccucugccgacuuu

SEQ ID NO: 603528 - RNA, 19 nt, Homo sapiens
aagagagagugugugauua

SEQ ID NO: 603529 - RNA, 19 nt, Homo sapiens
gcaacuacauuaaauucac

SEQ ID NO: 603530 - RNA, 19 nt, Homo sapiens
gggccaacuuugcgagaaa

SEQ ID NO: 603531 - RNA, 19 nt, Homo sapiens
cagaauaucgcccacuuug

SEQ ID NO: 603532 - RNA, 19 nt, Homo sapiens
guccagaaguugauuccuu

SEQ ID NO: 603533 - RNA, 19 nt, Homo sapiens
aggagauucuugcaauuaa

SEQ ID NO: 603534 - RNA, 19 nt, Homo sapiens
gggcaacuacauuaaauuc

SEQ ID NO: 603535 - RNA, 19 nt, Homo sapiens
ccagcuggcucaagaacau

SEQ ID NO: 603536 - RNA, 19 nt, Homo sapiens
uuaacaagccuuucaagau

SEQ ID NO: 603537 - RNA, 19 nt, Homo sapiens
gcagaauaucgcccacuuu

SEQ ID NO: 603538 - RNA, 19 nt, Homo sapiens
uguuaacgcugcugauguu

SEQ ID NO: 603539 - RNA, 19 nt, Homo sapiens
agaauuuacucaggcauga

SEQ ID NO: 603540 - RNA, 19 nt, Homo sapiens
ucacuucgccauucauuca

SEQ ID NO: 603541 - RNA, 19 nt, Homo sapiens
ucacuucgccauucauuca

SEQ ID NO: 603542 - RNA, 19 nt, Homo sapiens
gugaugagcuuccuuuugu

SEQ ID NO: 603543 - RNA, 19 nt, Homo sapiens
gaaggcagaccauggugau

SEQ ID NO: 603544 - RNA, 19 nt, Homo sapiens
gaucuaugauacccagaag

SEQ ID NO: 603545 - RNA, 19 nt, Homo sapiens
ccacuaaggagaaagaagu

SEQ ID NO: 603546 - RNA, 19 nt, Homo sapiens
gugaccaaguugacucuga

SEQ ID NO: 603547 - RNA, 19 nt, Homo sapiens
ggagaaagaaguugauucc

SEQ ID NO: 603548 - RNA, 19 nt, Homo sapiens
gagcagcuaagcaggaaga

SEQ ID NO: 603549 - RNA, 19 nt, Homo sapiens
gaagaggagcagcuaagca

SEQ ID NO: 603550 - RNA, 19 nt, Homo sapiens
gagugugucuucgcuuguu

SEQ ID NO: 603551 - RNA, 19 nt, Homo sapiens
gcauggcuuccuuguauga

SEQ ID NO: 603552 - RNA, 19 nt, Homo sapiens
gcaguggagucagaguuuc

SEQ ID NO: 603553 - RNA, 19 nt, Homo sapiens
agcaauaccugcagcugaa

SEQ ID NO: 603554 - RNA, 19 nt, Homo sapiens
cugcugauguugccuccua

SEQ ID NO: 603555 - RNA, 19 nt, Homo sapiens
uaugauacccagaaggaaa

SEQ ID NO: 603556 - RNA, 19 nt, Homo sapiens
ggagauucuugcaauuaac

SEQ ID NO: 603557 - RNA, 19 nt, Homo sapiens
agaggagauucuugcaauu

SEQ ID NO: 603558 - RNA, 19 nt, Homo sapiens
gcucagucccgcucuccua

SEQ ID NO: 603559 - RNA, 19 nt, Homo sapiens
aacaagccuuucaagauga

SEQ ID NO: 603560 - RNA, 19 nt, Homo sapiens
auacuuccguccauccauu

SEQ ID NO: 603561 - RNA, 19 nt, Homo sapiens
ggagucuuguccaugugaa

SEQ ID NO: 603562 - RNA, 19 nt, Homo sapiens
gggcuucugcugcuucuug

SEQ ID NO: 603563 - RNA, 19 nt, Homo sapiens
gaucccugcacuccaagua

SEQ ID NO: 603564 - RNA, 19 nt, Homo sapiens
agaaggcgcugccccaaaa

SEQ ID NO: 603565 - RNA, 19 nt, Homo sapiens
cagaguuucuuagccaguu

SEQ ID NO: 603566 - RNA, 19 nt, Homo sapiens
ucaccgcaguggagucaga

SEQ ID NO: 603567 - RNA, 19 nt, Homo sapiens
cuaaggagaaagaaguuga

SEQ ID NO: 603568 - RNA, 19 nt, Homo sapiens
ugugaucccugcacuccaa

SEQ ID NO: 603569 - RNA, 19 nt, Homo sapiens
ccaaggucaugaggaucua

SEQ ID NO: 603570 - RNA, 19 nt, Homo sapiens
cuucagcacuggagacaag

SEQ ID NO: 603571 - RNA, 19 nt, Homo sapiens
gcacaugaaggcagaccau

SEQ ID NO: 603572 - RNA, 19 nt, Homo sapiens
gagauucuugcaauuaaca

SEQ ID NO: 603573 - RNA, 19 nt, Homo sapiens
gccuguaccucagcaucua

SEQ ID NO: 603574 - RNA, 19 nt, Homo sapiens
gcccacacacacccacuaa

SEQ ID NO: 603575 - RNA, 19 nt, Homo sapiens
ucuacgaguuccagcauca

SEQ ID NO: 603576 - RNA, 19 nt, Homo sapiens
caauuaacaagccuuucaa

SEQ ID NO: 603577 - RNA, 19 nt, Homo sapiens
ccacacacacccacuaagg

SEQ ID NO: 603578 - RNA, 19 nt, Homo sapiens
gaggaagaggagcagcuaa

SEQ ID NO: 603579 - RNA, 19 nt, Homo sapiens
ggaucuaugauacccagaa

SEQ ID NO: 603580 - RNA, 19 nt, Homo sapiens
cagccugucccuagcauug

SEQ ID NO: 603581 - RNA, 19 nt, Homo sapiens
guugauuccuucauucacu

SEQ ID NO: 603582 - RNA, 19 nt, Homo sapiens
guugauuccuucauucacu

SEQ ID NO: 603583 - RNA, 19 nt, Homo sapiens
cuuagccaguucaacauga

SEQ ID NO: 603584 - RNA, 19 nt, Homo sapiens
cgccauucauucauacuuc

SEQ ID NO: 603585 - RNA, 19 nt, Homo sapiens
cgccauucauucauacuuc

SEQ ID NO: 603586 - RNA, 19 nt, Homo sapiens
cuaagcaggaagaugauga

SEQ ID NO: 603587 - RNA, 19 nt, Homo sapiens
uaagcaggaagaugaugaa

SEQ ID NO: 603588 - RNA, 19 nt, Homo sapiens
gcacuccaaguagcacauu

SEQ ID NO: 603589 - RNA, 19 nt, Homo sapiens
ucuaugauacccagaagga

SEQ ID NO: 603590 - RNA, 19 nt, Homo sapiens
gcaagaguaaagaggagau

SEQ ID NO: 603591 - RNA, 19 nt, Homo sapiens
agagagagugugugauuag

SEQ ID NO: 603592 - RNA, 19 nt, Homo sapiens
uuaaauucacugaggaaga

SEQ ID NO: 603593 - RNA, 19 nt, Homo sapiens
ugucaacaacaaugaauuc

SEQ ID NO: 603594 - RNA, 19 nt, Homo sapiens
gaacguggugguggucauc

SEQ ID NO: 603595 - RNA, 19 nt, Homo sapiens
ggccaacuuugcgagaaau

SEQ ID NO: 603596 - RNA, 19 nt, Homo sapiens
gcugagggaggaguacauu

SEQ ID NO: 603597 - RNA, 19 nt, Homo sapiens
ggcauggcuuccuuguaug

SEQ ID NO: 603598 - RNA, 19 nt, Homo sapiens
cuuguaaucccagcuauug

SEQ ID NO: 603599 - RNA, 19 nt, Homo sapiens
guccauccauucagaaagc

SEQ ID NO: 603600 - RNA, 19 nt, Homo sapiens
ucauucacuucgccauuca

SEQ ID NO: 603601 - RNA, 19 nt, Homo sapiens
ucauucacuucgccauuca

SEQ ID NO: 603602 - RNA, 19 nt, Homo sapiens
acacacccacuaaggagaa

SEQ ID NO: 603603 - RNA, 19 nt, Homo sapiens
agaccauggugaugagcuu

SEQ ID NO: 603604 - RNA, 19 nt, Homo sapiens
gaugagcuuccuuuuguuu

SEQ ID NO: 603605 - RNA, 19 nt, Homo sapiens
gccugucccuagcauuguu

SEQ ID NO: 603606 - RNA, 19 nt, Homo sapiens
caagaguaaagaggagauu

SEQ ID NO: 603607 - RNA, 19 nt, Homo sapiens
gggagucuuguccauguga

SEQ ID NO: 603608 - RNA, 19 nt, Homo sapiens
ggagucagaguuucuuagc

SEQ ID NO: 603609 - RNA, 19 nt, Homo sapiens
ggacagagauguugcaaga

SEQ ID NO: 603610 - RNA, 19 nt, Homo sapiens
ugagaaagcuguggaacua

SEQ ID NO: 603611 - RNA, 19 nt, Homo sapiens
acaggaaucuggagaagua

SEQ ID NO: 603612 - RNA, 19 nt, Homo sapiens
cgagagguguaucaauaua

SEQ ID NO: 603613 - RNA, 19 nt, Homo sapiens
gaucaaacauccgauaguc

SEQ ID NO: 603614 - RNA, 19 nt, Homo sapiens
guuaauggcugucccgaau

SEQ ID NO: 603615 - RNA, 19 nt, Homo sapiens
ggaaagcuacuugaucaaa

SEQ ID NO: 603616 - RNA, 19 nt, Homo sapiens
gagaccagcugcuaucagu

SEQ ID NO: 603617 - RNA, 19 nt, Homo sapiens
gaaagcuacuugaucaaac

SEQ ID NO: 603618 - RNA, 19 nt, Homo sapiens
cggcagacauggcgacauu

SEQ ID NO: 603619 - RNA, 19 nt, Homo sapiens
uucgagagguguaucaaua

SEQ ID NO: 603620 - RNA, 19 nt, Homo sapiens
gaaacaguguaagaagaau

SEQ ID NO: 603621 - RNA, 19 nt, Homo sapiens
gaacggagugaguguggaa

SEQ ID NO: 603622 - RNA, 19 nt, Homo sapiens
gaaauggaggcucgcuuug

SEQ ID NO: 603623 - RNA, 19 nt, Homo sapiens
gcaacucaacaccuucuuu

SEQ ID NO: 603624 - RNA, 19 nt, Homo sapiens
gcagacauggcgacauuga

SEQ ID NO: 603625 - RNA, 19 nt, Homo sapiens
agggaaagcuacuugauca

SEQ ID NO: 603626 - RNA, 19 nt, Homo sapiens
ugaaacaguguaagaagaa

SEQ ID NO: 603627 - RNA, 19 nt, Homo sapiens
uuucuagucugcaaacuga

SEQ ID NO: 603628 - RNA, 19 nt, Homo sapiens
aauggaggcucgcuuugaa

SEQ ID NO: 603629 - RNA, 19 nt, Homo sapiens
gaccagcugcuaucaguga

SEQ ID NO: 603630 - RNA, 19 nt, Homo sapiens
uaauggcugucccgaauuc

SEQ ID NO: 603631 - RNA, 19 nt, Homo sapiens
ucaagcugguggugcgaua

SEQ ID NO: 603632 - RNA, 19 nt, Homo sapiens
gaugaaggccuugguuuua

SEQ ID NO: 603633 - RNA, 19 nt, Homo sapiens
caacucaacaccuucuuuc

SEQ ID NO: 603634 - RNA, 19 nt, Homo sapiens
aauuauaccugucaagaag

SEQ ID NO: 603635 - RNA, 19 nt, Homo sapiens
gaaggagaacaccaugaga

SEQ ID NO: 603636 - RNA, 19 nt, Homo sapiens
agagguguaucaauauaug

SEQ ID NO: 603637 - RNA, 19 nt, Homo sapiens
cugaaacaguguaagaaga

SEQ ID NO: 603638 - RNA, 19 nt, Homo sapiens
gaacuacucaaggcugcua

SEQ ID NO: 603639 - RNA, 19 nt, Homo sapiens
ggaaggagaacaccaugag

SEQ ID NO: 603640 - RNA, 19 nt, Homo sapiens
aaagcuacuugaucaaaca

SEQ ID NO: 603641 - RNA, 19 nt, Homo sapiens
gaacugccaaagacugaug

SEQ ID NO: 603642 - RNA, 19 nt, Homo sapiens
agaaauggaggcucgcuuu

SEQ ID NO: 603643 - RNA, 19 nt, Homo sapiens
cacgugggcuuuacauaca

SEQ ID NO: 603644 - RNA, 19 nt, Homo sapiens
cagcaacaaacacaacaaa

SEQ ID NO: 603645 - RNA, 19 nt, Homo sapiens
gagagguguaucaauauau

SEQ ID NO: 603646 - RNA, 19 nt, Homo sapiens
caagcuacaaucccucaaa

SEQ ID NO: 603647 - RNA, 19 nt, Homo sapiens
guaaaagacaacacugaua

SEQ ID NO: 603648 - RNA, 19 nt, Homo sapiens
cauccgauagucacaaauu

SEQ ID NO: 603649 - RNA, 19 nt, Homo sapiens
gagggaaagcuacuugauc

SEQ ID NO: 603650 - RNA, 19 nt, Homo sapiens
acucaaggcugcuaaagac

SEQ ID NO: 603651 - RNA, 19 nt, Homo sapiens
gcaugaaacgauaacuguu

SEQ ID NO: 603652 - RNA, 19 nt, Homo sapiens
gagaacaccaugagaaagc

SEQ ID NO: 603653 - RNA, 19 nt, Homo sapiens
ccgauagucacaaauuuga

SEQ ID NO: 603654 - RNA, 19 nt, Homo sapiens
gaggagaccagcugcuauc

SEQ ID NO: 603655 - RNA, 19 nt, Homo sapiens
caacagcaaaggcaacagu

SEQ ID NO: 603656 - RNA, 19 nt, Homo sapiens
gaaaccgugcuucagaauc

SEQ ID NO: 603657 - RNA, 19 nt, Homo sapiens
gagaaguaccagugcacaa

SEQ ID NO: 603658 - RNA, 19 nt, Homo sapiens
gaggaaaggagcaaaauuc

SEQ ID NO: 603659 - RNA, 19 nt, Homo sapiens
aaaccgugcuucagaaucc

SEQ ID NO: 603660 - RNA, 19 nt, Homo sapiens
aaggagaacaccaugagaa

SEQ ID NO: 603661 - RNA, 19 nt, Homo sapiens
ucacgugggcuuuacauac

SEQ ID NO: 603662 - RNA, 19 nt, Homo sapiens
gaaucccagcacauaguaa

SEQ ID NO: 603663 - RNA, 19 nt, Homo sapiens
cagcagcagcagcaacaaa

SEQ ID NO: 603664 - RNA, 19 nt, Homo sapiens
ggagaacaccaugagaaag

SEQ ID NO: 603665 - RNA, 19 nt, Homo sapiens
cuacaggaaucuggagaag

SEQ ID NO: 603666 - RNA, 19 nt, Homo sapiens
gcagcaacaaacacaacaa

SEQ ID NO: 603667 - RNA, 19 nt, Homo sapiens
agaaagcuguggaacuacu

SEQ ID NO: 603668 - RNA, 19 nt, Homo sapiens
uuaaugugaugggaggaaa

SEQ ID NO: 603669 - RNA, 19 nt, Homo sapiens
cucaacaccuucuuucucu

SEQ ID NO: 603670 - RNA, 19 nt, Homo sapiens
agaaucccagcacauagua

SEQ ID NO: 603671 - RNA, 19 nt, Homo sapiens
cagaaucccagcacauagu

SEQ ID NO: 603672 - RNA, 19 nt, Homo sapiens
uaauucagcagcagcaaca

SEQ ID NO: 603673 - RNA, 19 nt, Homo sapiens
aaauggaggcucgcuuuga

SEQ ID NO: 603674 - RNA, 19 nt, Homo sapiens
aggagaacaccaugagaaa

SEQ ID NO: 603675 - RNA, 19 nt, Homo sapiens
agacauggcgacauugaca

SEQ ID NO: 603676 - RNA, 19 nt, Homo sapiens
cagugggaauucucagugu

SEQ ID NO: 603677 - RNA, 19 nt, Homo sapiens
uacauugaccuuccauuca

SEQ ID NO: 603678 - RNA, 19 nt, Homo sapiens
caacacugauaauuauacc

SEQ ID NO: 603679 - RNA, 19 nt, Homo sapiens
aacauccgauagucacaaa

SEQ ID NO: 603680 - RNA, 19 nt, Homo sapiens
gaagaauaaagucuaugac

SEQ ID NO: 603681 - RNA, 19 nt, Homo sapiens
auacauugaccuuccauuc

SEQ ID NO: 603682 - RNA, 19 nt, Homo sapiens
ggccuugguuuuaauguga

SEQ ID NO: 603683 - RNA, 19 nt, Homo sapiens
caauauaugcaugaaacga

SEQ ID NO: 603684 - RNA, 19 nt, Homo sapiens
cacaugguguauaaauucu

SEQ ID NO: 603685 - RNA, 19 nt, Homo sapiens
caaauuugaaaccgugcuu

SEQ ID NO: 603686 - RNA, 19 nt, Homo sapiens
aaucccagcacauaguaaa

SEQ ID NO: 603687 - RNA, 19 nt, Homo sapiens
gcagcagcagcaacaaaca

SEQ ID NO: 603688 - RNA, 19 nt, Homo sapiens
gcgauacaccccaaaaguu

SEQ ID NO: 603689 - RNA, 19 nt, Homo sapiens
ggaggaaaggagcaaaauu

SEQ ID NO: 603690 - RNA, 19 nt, Homo sapiens
cgugggcuuuacauacauu

SEQ ID NO: 603691 - RNA, 19 nt, Homo sapiens
auccgauagucacaaauuu

SEQ ID NO: 603692 - RNA, 19 nt, Homo sapiens
gggaaagcuacuugaucaa

SEQ ID NO: 603693 - RNA, 19 nt, Homo sapiens
aacaaaaccacaugucaua

SEQ ID NO: 603694 - RNA, 19 nt, Homo sapiens
aagaggagaccagcugcua

SEQ ID NO: 603695 - RNA, 19 nt, Homo sapiens
ggaaagcucuggcaauuua

SEQ ID NO: 603696 - RNA, 19 nt, Homo sapiens
gcacauaguugccuuugua

SEQ ID NO: 603697 - RNA, 19 nt, Homo sapiens
ggagagaccuugacugaaa

SEQ ID NO: 603698 - RNA, 19 nt, Homo sapiens
gagagaaguuggaagcuua

SEQ ID NO: 603699 - RNA, 19 nt, Homo sapiens
gaaagaacaugccaagaug

SEQ ID NO: 603700 - RNA, 19 nt, Homo sapiens
gcaaagaccuagccaacaa

SEQ ID NO: 603701 - RNA, 19 nt, Homo sapiens
gaacguggcuuaugaguac

SEQ ID NO: 603702 - RNA, 19 nt, Homo sapiens
guuuacagcuccuuuaaua

SEQ ID NO: 603703 - RNA, 19 nt, Homo sapiens
ggauuuaucugcaguguug

SEQ ID NO: 603704 - RNA, 19 nt, Homo sapiens
gcagguggauuacuauaaa

SEQ ID NO: 603705 - RNA, 19 nt, Homo sapiens
caagcaaacugcccuauga

SEQ ID NO: 603706 - RNA, 19 nt, Homo sapiens
gaacaguugucugauauga

SEQ ID NO: 603707 - RNA, 19 nt, Homo sapiens
cgaaccaucuuacugaaua

SEQ ID NO: 603708 - RNA, 19 nt, Homo sapiens
gagauuggauugccuaaga

SEQ ID NO: 603709 - RNA, 19 nt, Homo sapiens
gaagaaaucaacaacauga

SEQ ID NO: 603710 - RNA, 19 nt, Homo sapiens
ggaaguaauugaucguuug

SEQ ID NO: 603711 - RNA, 19 nt, Homo sapiens
caauugagcaguucaguua

SEQ ID NO: 603712 - RNA, 19 nt, Homo sapiens
gauauagaauuguggcuuu

SEQ ID NO: 603713 - RNA, 19 nt, Homo sapiens
ugacaaaucucucaacauc

SEQ ID NO: 603714 - RNA, 19 nt, Homo sapiens
gggaugaaccuccaaauuu

SEQ ID NO: 603715 - RNA, 19 nt, Homo sapiens
ugaaggaaauuauggauga

SEQ ID NO: 603716 - RNA, 19 nt, Homo sapiens
ucugaacucuugaaacuua

SEQ ID NO: 603717 - RNA, 19 nt, Homo sapiens
gaagguagaucagauucaa

SEQ ID NO: 603718 - RNA, 19 nt, Homo sapiens
caacuagcauugccucaaa

SEQ ID NO: 603719 - RNA, 19 nt, Homo sapiens
uaaaugcauuggagaagua

SEQ ID NO: 603720 - RNA, 19 nt, Homo sapiens
gaagauuauugguaacuug

SEQ ID NO: 603721 - RNA, 19 nt, Homo sapiens
ugaagcagcuccugaguga

SEQ ID NO: 603722 - RNA, 19 nt, Homo sapiens
ucccagagcuucaggauaa

SEQ ID NO: 603723 - RNA, 19 nt, Homo sapiens
gaagaaggcauaucaagau

SEQ ID NO: 603724 - RNA, 19 nt, Homo sapiens
agacugaguuggagaagua

SEQ ID NO: 603725 - RNA, 19 nt, Homo sapiens
gcaauaaugagcagaguuu

SEQ ID NO: 603726 - RNA, 19 nt, Homo sapiens
caacagcaccucaaucuga

SEQ ID NO: 603727 - RNA, 19 nt, Homo sapiens
gcaagugaaucaguuuaaa

SEQ ID NO: 603728 - RNA, 19 nt, Homo sapiens
gaaauccuacgguuauuaa

SEQ ID NO: 603729 - RNA, 19 nt, Homo sapiens
caacaaagacacccaagaa

SEQ ID NO: 603730 - RNA, 19 nt, Homo sapiens
ugucaacccuguuuccuua

SEQ ID NO: 603731 - RNA, 19 nt, Homo sapiens
gacaaaguccugaacauaa

SEQ ID NO: 603732 - RNA, 19 nt, Homo sapiens
uuaggaaucuuugccauua

SEQ ID NO: 603733 - RNA, 19 nt, Homo sapiens
aaauucagcuacucagaua

SEQ ID NO: 603734 - RNA, 19 nt, Homo sapiens
gggagcagguggauuacua

SEQ ID NO: 603735 - RNA, 19 nt, Homo sapiens
gaccuugacugaaauccua

SEQ ID NO: 603736 - RNA, 19 nt, Homo sapiens
gaugagcugcugaagauua

SEQ ID NO: 603737 - RNA, 19 nt, Homo sapiens
uuacucaggugcaugguua

SEQ ID NO: 603738 - RNA, 19 nt, Homo sapiens
gagaugcacuggccuuguu

SEQ ID NO: 603739 - RNA, 19 nt, Homo sapiens
gggcaauucuguuugugua

SEQ ID NO: 603740 - RNA, 19 nt, Homo sapiens
ggaaaugaaaggaaagaaa

SEQ ID NO: 603741 - RNA, 19 nt, Homo sapiens
gagaaaggccgaacuagug

SEQ ID NO: 603742 - RNA, 19 nt, Homo sapiens
ggaugaauuuccugaagaa

SEQ ID NO: 603743 - RNA, 19 nt, Homo sapiens
caauagggaugguaggauu

SEQ ID NO: 603744 - RNA, 19 nt, Homo sapiens
gcaaaccaaucccaccuau

SEQ ID NO: 603745 - RNA, 19 nt, Homo sapiens
cuacaagacucucaucaau

SEQ ID NO: 603746 - RNA, 19 nt, Homo sapiens
gggaggagauccagaguuc

SEQ ID NO: 603747 - RNA, 19 nt, Homo sapiens
cgaccuggcuuuagaacaa

SEQ ID NO: 603748 - RNA, 19 nt, Homo sapiens
gcucuguccuggauaauga

SEQ ID NO: 603749 - RNA, 19 nt, Homo sapiens
gaccagccaucaugacauu

SEQ ID NO: 603750 - RNA, 19 nt, Homo sapiens
gaucuuccuucucaacaaa

SEQ ID NO: 603751 - RNA, 19 nt, Homo sapiens
gggagauaaugcccacuua

SEQ ID NO: 603752 - RNA, 19 nt, Homo sapiens
gcacagaaguuugccuuag

SEQ ID NO: 603753 - RNA, 19 nt, Homo sapiens
ugaaaucaguccaacagaa

SEQ ID NO: 603754 - RNA, 19 nt, Homo sapiens
acaaaucucucaacaucaa

SEQ ID NO: 603755 - RNA, 19 nt, Homo sapiens
ggaaauccuacgguuauua

SEQ ID NO: 603756 - RNA, 19 nt, Homo sapiens
cgaaagcgcuaucgagauc

SEQ ID NO: 603757 - RNA, 19 nt, Homo sapiens
gagaaagagauguuuauga

SEQ ID NO: 603758 - RNA, 19 nt, Homo sapiens
cuuauaaacuccauucuug

SEQ ID NO: 603759 - RNA, 19 nt, Homo sapiens
gcagcaagacuacaugaaa

SEQ ID NO: 603760 - RNA, 19 nt, Homo sapiens
ggaugaguacucugauuua

SEQ ID NO: 603761 - RNA, 19 nt, Homo sapiens
ucaacaacaugaagacuga

SEQ ID NO: 603762 - RNA, 19 nt, Homo sapiens
gggaaguaauugaucguuu

SEQ ID NO: 603763 - RNA, 19 nt, Homo sapiens
gaguucaaauggagacuuu

SEQ ID NO: 603764 - RNA, 19 nt, Homo sapiens
gaagauccagacagguuua

SEQ ID NO: 603765 - RNA, 19 nt, Homo sapiens
ggaugaaccuccaaauuuu

SEQ ID NO: 603766 - RNA, 19 nt, Homo sapiens
agaaagagauguuuaugag

SEQ ID NO: 603767 - RNA, 19 nt, Homo sapiens
gaaaucaacaacaugaaga

SEQ ID NO: 603768 - RNA, 19 nt, Homo sapiens
aaaggaagcauuucuagaa

SEQ ID NO: 603769 - RNA, 19 nt, Homo sapiens
gacaggagcuaauggaagu

SEQ ID NO: 603770 - RNA, 19 nt, Homo sapiens
gaguugcagucaugaaauu

SEQ ID NO: 603771 - RNA, 19 nt, Homo sapiens
gagaagauccagacagguu

SEQ ID NO: 603772 - RNA, 19 nt, Homo sapiens
gguaaaagguggauauuau

SEQ ID NO: 603773 - RNA, 19 nt, Homo sapiens
cgacaaaguccugaacaua

SEQ ID NO: 603774 - RNA, 19 nt, Homo sapiens
ggagugccauggaaggauu

SEQ ID NO: 603775 - RNA, 19 nt, Homo sapiens
ccucacagcuccuuucuag

SEQ ID NO: 603776 - RNA, 19 nt, Homo sapiens
gaacaaauaccaggaacug

SEQ ID NO: 603777 - RNA, 19 nt, Homo sapiens
ccaagaagcacagaaguuu

SEQ ID NO: 603778 - RNA, 19 nt, Homo sapiens
ggaugagucagcuguguua

SEQ ID NO: 603779 - RNA, 19 nt, Homo sapiens
uuuauuagcuguagcauuc

SEQ ID NO: 603780 - RNA, 19 nt, Homo sapiens
ugaaggaguugcagucaug

SEQ ID NO: 603781 - RNA, 19 nt, Homo sapiens
uaaaugacccaaauaagga

SEQ ID NO: 603782 - RNA, 19 nt, Homo sapiens
ggcgcuagcucaugaagaa

SEQ ID NO: 603783 - RNA, 19 nt, Homo sapiens
aaacugacccuguggauau

SEQ ID NO: 603784 - RNA, 19 nt, Homo sapiens
gaugacaaaucucucaaca

SEQ ID NO: 603785 - RNA, 19 nt, Homo sapiens
agagguaucucgaugaguu

SEQ ID NO: 603786 - RNA, 19 nt, Homo sapiens
ggacugcagcaacagaaua

SEQ ID NO: 603787 - RNA, 19 nt, Homo sapiens
cgaaugccaugcuuguaaa

SEQ ID NO: 603788 - RNA, 19 nt, Homo sapiens
gaacugaucaacgacauug

SEQ ID NO: 603789 - RNA, 19 nt, Homo sapiens
ccagacagguuuaaagaag

SEQ ID NO: 603790 - RNA, 19 nt, Homo sapiens
gaggccagcuuaccacaga

SEQ ID NO: 603791 - RNA, 19 nt, Homo sapiens
ggaccaaagugaccaggau

SEQ ID NO: 603792 - RNA, 19 nt, Homo sapiens
gagaucgccugcaguacuu

SEQ ID NO: 603793 - RNA, 19 nt, Homo sapiens
cuucuucucucccaaagua

SEQ ID NO: 603794 - RNA, 19 nt, Homo sapiens
gagcuaaaguaaaugucaa

SEQ ID NO: 603795 - RNA, 19 nt, Homo sapiens
gcuuggagcuguugcauua

SEQ ID NO: 603796 - RNA, 19 nt, Homo sapiens
gcacagaacuaauacuaau

SEQ ID NO: 603797 - RNA, 19 nt, Homo sapiens
cagaagaaaugacagcaua

SEQ ID NO: 603798 - RNA, 19 nt, Homo sapiens
gaaaggacauaaucaucaa

SEQ ID NO: 603799 - RNA, 19 nt, Homo sapiens
gcaaauaagagccguuuaa

SEQ ID NO: 603800 - RNA, 19 nt, Homo sapiens
aaacgaggcacuuguauua

SEQ ID NO: 603801 - RNA, 19 nt, Homo sapiens
caagaacgguagcgauuaa

SEQ ID NO: 603802 - RNA, 19 nt, Homo sapiens
guugaucacucacauuuaa

SEQ ID NO: 603803 - RNA, 19 nt, Homo sapiens
gaaauauguugaucacuca

SEQ ID NO: 603804 - RNA, 19 nt, Homo sapiens
uaagagccguuuaagagua

SEQ ID NO: 603805 - RNA, 19 nt, Homo sapiens
ggaauuagucagauacuuu

SEQ ID NO: 603806 - RNA, 19 nt, Homo sapiens
ccaguuugguuacaguuua

SEQ ID NO: 603807 - RNA, 19 nt, Homo sapiens
ccucgacaauuuagaguua

SEQ ID NO: 603808 - RNA, 19 nt, Homo sapiens
cgauguacuuugacaauuu

SEQ ID NO: 603809 - RNA, 19 nt, Homo sapiens
ccaaauaacuaguaauucg

SEQ ID NO: 603810 - RNA, 19 nt, Homo sapiens
gaacagcccgcuagagguu

SEQ ID NO: 603811 - RNA, 19 nt, Homo sapiens
gagaaauaguauaccauga

SEQ ID NO: 603812 - RNA, 19 nt, Homo sapiens
cagauuaugugcaacuuga

SEQ ID NO: 603813 - RNA, 19 nt, Homo sapiens
gagaacccaugaaacaaga

SEQ ID NO: 603814 - RNA, 19 nt, Homo sapiens
uaauaaggcuuggcaguau

SEQ ID NO: 603815 - RNA, 19 nt, Homo sapiens
gaagaaaugacagcauauu

SEQ ID NO: 603816 - RNA, 19 nt, Homo sapiens
guauuuggauugauuggaa

SEQ ID NO: 603817 - RNA, 19 nt, Homo sapiens
uaauaucggugcacaaaca

SEQ ID NO: 603818 - RNA, 19 nt, Homo sapiens
uagcauguauuagacguua

SEQ ID NO: 603819 - RNA, 19 nt, Homo sapiens
gauuggaauuagucagaua

SEQ ID NO: 603820 - RNA, 19 nt, Homo sapiens
gagcuuaaacaaacaggua

SEQ ID NO: 603821 - RNA, 19 nt, Homo sapiens
ggcaguaugucagaguuua

SEQ ID NO: 603822 - RNA, 19 nt, Homo sapiens
aacacaaccucgacaauuu

SEQ ID NO: 603823 - RNA, 19 nt, Homo sapiens
gaacucgucaugacacuug

SEQ ID NO: 603824 - RNA, 19 nt, Homo sapiens
caagccaaauaacuaguaa

SEQ ID NO: 603825 - RNA, 19 nt, Homo sapiens
gaaauaguauaccaugacu

SEQ ID NO: 603826 - RNA, 19 nt, Homo sapiens
aaacaaacagguaaucuug

SEQ ID NO: 603827 - RNA, 19 nt, Homo sapiens
gcacaaacagaagaaauga

SEQ ID NO: 603828 - RNA, 19 nt, Homo sapiens
acgauucgcuuacaucaaa

SEQ ID NO: 603829 - RNA, 19 nt, Homo sapiens
caaagcagaugauauucca

SEQ ID NO: 603830 - RNA, 19 nt, Homo sapiens
ugagaaauaugccauugau

SEQ ID NO: 603831 - RNA, 19 nt, Homo sapiens
ggaagagcuuaaacaaaca

SEQ ID NO: 603832 - RNA, 19 nt, Homo sapiens
cagaaugacaagccaaaua

SEQ ID NO: 603833 - RNA, 19 nt, Homo sapiens
guuagagcguaaugugaua

SEQ ID NO: 603834 - RNA, 19 nt, Homo sapiens
gaggaagagcuuaaacaaa

SEQ ID NO: 603835 - RNA, 19 nt, Homo sapiens
guugcuacaugguauaauu

SEQ ID NO: 603836 - RNA, 19 nt, Homo sapiens
agaaugacaagccaaauaa

SEQ ID NO: 603837 - RNA, 19 nt, Homo sapiens
ggagugcguuaucaugguu

SEQ ID NO: 603838 - RNA, 19 nt, Homo sapiens
gaacgauucgcuuacauca

SEQ ID NO: 603839 - RNA, 19 nt, Homo sapiens
gacaagaacgguagcgauu

SEQ ID NO: 603840 - RNA, 19 nt, Homo sapiens
aggaagagcuuaaacaaac

SEQ ID NO: 603841 - RNA, 19 nt, Homo sapiens
uacgaccguugcagaauua

SEQ ID NO: 603842 - RNA, 19 nt, Homo sapiens
uggcaaagcagaugauauu

SEQ ID NO: 603843 - RNA, 19 nt, Homo sapiens
cgaaaggacauaaucauca

SEQ ID NO: 603844 - RNA, 19 nt, Homo sapiens
acacaaccucgacaauuua

SEQ ID NO: 603845 - RNA, 19 nt, Homo sapiens
uuagaaggauugcgguuug

SEQ ID NO: 603846 - RNA, 19 nt, Homo sapiens
gcgccaaauucgucuuuau

SEQ ID NO: 603847 - RNA, 19 nt, Homo sapiens
gaugaaauauguugaucac

SEQ ID NO: 603848 - RNA, 19 nt, Homo sapiens
aaacacaaccucgacaauu

SEQ ID NO: 603849 - RNA, 19 nt, Homo sapiens
acaaacagguaaucuugau

SEQ ID NO: 603850 - RNA, 19 nt, Homo sapiens
ucaugacacuugugguaaa

SEQ ID NO: 603851 - RNA, 19 nt, Homo sapiens
aauaagagccguuuaagag

SEQ ID NO: 603852 - RNA, 19 nt, Homo sapiens
uggcuuagaacgcaaauaa

SEQ ID NO: 603853 - RNA, 19 nt, Homo sapiens
ggguagaacgaauugauaa

SEQ ID NO: 603854 - RNA, 19 nt, Homo sapiens
ucacagcuacuaaggauau

SEQ ID NO: 603855 - RNA, 19 nt, Homo sapiens
gagaaauaugccauugaua

SEQ ID NO: 603856 - RNA, 19 nt, Homo sapiens
uuagaagaauugugguuug

SEQ ID NO: 603857 - RNA, 19 nt, Homo sapiens
uagauagcaugcuugcaaa

SEQ ID NO: 603858 - RNA, 19 nt, Homo sapiens
cagacgguauuacugauug

SEQ ID NO: 603859 - RNA, 19 nt, Homo sapiens
gauauuccagacgguauua

SEQ ID NO: 603860 - RNA, 19 nt, Homo sapiens
caaauucgucuuuaugaca

SEQ ID NO: 603861 - RNA, 19 nt, Homo sapiens
gauauucucacagcuacua

SEQ ID NO: 603862 - RNA, 19 nt, Homo sapiens
caaacgaggcacuuguauu

SEQ ID NO: 603863 - RNA, 19 nt, Homo sapiens
gcagaauuaucucucaaaa

SEQ ID NO: 603864 - RNA, 19 nt, Homo sapiens
aaacguagaacucgucaug

SEQ ID NO: 603865 - RNA, 19 nt, Homo sapiens
cuagauagcaugcuugcaa

SEQ ID NO: 603866 - RNA, 19 nt, Homo sapiens
aagaagaaguaauggacaa

SEQ ID NO: 603867 - RNA, 19 nt, Homo sapiens
gaacccaugaaacaagaaa

SEQ ID NO: 603868 - RNA, 19 nt, Homo sapiens
ggagaacccaugaaacaag

SEQ ID NO: 603869 - RNA, 19 nt, Homo sapiens
uuaacgcacagaacuaaua

SEQ ID NO: 603870 - RNA, 19 nt, Homo sapiens
uauaauaucggugcacaaa

SEQ ID NO: 603871 - RNA, 19 nt, Homo sapiens
gccaaauucgucuuuauga

SEQ ID NO: 603872 - RNA, 19 nt, Homo sapiens
ggacgauugacaugauaaa

SEQ ID NO: 603873 - RNA, 19 nt, Homo sapiens
gaacgaauugauaauaagg

SEQ ID NO: 603874 - RNA, 19 nt, Homo sapiens
ucucacagcuacuaaggau

SEQ ID NO: 603875 - RNA, 19 nt, Homo sapiens
guacauagucuccagaaaa

SEQ ID NO: 603876 - RNA, 19 nt, Homo sapiens
acaacuagauagcaugcuu

SEQ ID NO: 603877 - RNA, 19 nt, Homo sapiens
uugcagagacaacuagaua

SEQ ID NO: 603878 - RNA, 19 nt, Homo sapiens
auacgaccguugcagaauu

SEQ ID NO: 603879 - RNA, 19 nt, Homo sapiens
uguauuagacguuaacgaa

SEQ ID NO: 603880 - RNA, 19 nt, Homo sapiens
gagugaaucugcguuagag

SEQ ID NO: 603881 - RNA, 19 nt, Homo sapiens
guggcaagguugagucaug

SEQ ID NO: 603882 - RNA, 19 nt, Homo sapiens
uggaguaacuagagauauc

SEQ ID NO: 603883 - RNA, 19 nt, Homo sapiens
acaucaacuugcaacguua

SEQ ID NO: 603884 - RNA, 19 nt, Homo sapiens
aacaucaacuugcaacguu

SEQ ID NO: 603885 - RNA, 19 nt, Homo sapiens
caguuugguuacaguuuaa

SEQ ID NO: 603886 - RNA, 19 nt, Homo sapiens
cgucaugacacuuguggua

SEQ ID NO: 603887 - RNA, 19 nt, Homo sapiens
guaauucgcccguaaaaug

SEQ ID NO: 603888 - RNA, 19 nt, Homo sapiens
ugagagugaaucugcguua

SEQ ID NO: 603889 - RNA, 19 nt, Homo sapiens
ugaggaagagcuuaaacaa

SEQ ID NO: 603890 - RNA, 19 nt, Homo sapiens
guuaaugccgauaaauuug

SEQ ID NO: 603891 - RNA, 19 nt, Homo sapiens
uaacccgaaucaucuuuua

SEQ ID NO: 603892 - RNA, 19 nt, Homo sapiens
acaagaacgguagcgauua

SEQ ID NO: 603893 - RNA, 19 nt, Homo sapiens
ggauugcgguuugcaugga

SEQ ID NO: 603894 - RNA, 19 nt, Homo sapiens
gaaauacuuuugcaacaag

SEQ ID NO: 603895 - RNA, 19 nt, Homo sapiens
gcaccacacuggagaacua

SEQ ID NO: 603896 - RNA, 19 nt, Homo sapiens
caacugaggugguucugaa

SEQ ID NO: 603897 - RNA, 19 nt, Homo sapiens
caucgaaucuccuggguuu

SEQ ID NO: 603898 - RNA, 19 nt, Homo sapiens
gaaaagagcuggcuguaca

SEQ ID NO: 603899 - RNA, 19 nt, Homo sapiens
gagguggacuggagcaauu

SEQ ID NO: 603900 - RNA, 19 nt, Homo sapiens
caaagaugcuggcuauauc

SEQ ID NO: 603901 - RNA, 19 nt, Homo sapiens
agaaggauaugaagaugaa

SEQ ID NO: 603902 - RNA, 19 nt, Homo sapiens
ccggagagauugccauuga

SEQ ID NO: 603903 - RNA, 19 nt, Homo sapiens
caacuuggacugcaccuuu

SEQ ID NO: 603904 - RNA, 19 nt, Homo sapiens
caacuucaacccucacuuu

SEQ ID NO: 603905 - RNA, 19 nt, Homo sapiens
gcuacuacgucaaauccua

SEQ ID NO: 603906 - RNA, 19 nt, Homo sapiens
gaacccaaccagaagauug

SEQ ID NO: 603907 - RNA, 19 nt, Homo sapiens
agaaauacaugagagagaa

SEQ ID NO: 603908 - RNA, 19 nt, Homo sapiens
gaagggaacaugcacuaug

SEQ ID NO: 603909 - RNA, 19 nt, Homo sapiens
gggauucaauugcaacuuc

SEQ ID NO: 603910 - RNA, 19 nt, Homo sapiens
gaccggacguuuccagaug

SEQ ID NO: 603911 - RNA, 19 nt, Homo sapiens
gagagaaggauaugaagau

SEQ ID NO: 603912 - RNA, 19 nt, Homo sapiens
ggacaucccagaaauacau

SEQ ID NO: 603913 - RNA, 19 nt, Homo sapiens
gaagcacgacugcaaguau

SEQ ID NO: 603914 - RNA, 19 nt, Homo sapiens
gugcggaggucguuugaau

SEQ ID NO: 603915 - RNA, 19 nt, Homo sapiens
ccaaagaugcuggcuauau

SEQ ID NO: 603916 - RNA, 19 nt, Homo sapiens
cgacauggaguaccagauu

SEQ ID NO: 603917 - RNA, 19 nt, Homo sapiens
aagggaacaugcacuauga

SEQ ID NO: 603918 - RNA, 19 nt, Homo sapiens
gaauggcuacuacgucaaa

SEQ ID NO: 603919 - RNA, 19 nt, Homo sapiens
uuucuuagcccucuacuuu

SEQ ID NO: 603920 - RNA, 19 nt, Homo sapiens
gcaguggacaucccagaaa

SEQ ID NO: 603921 - RNA, 19 nt, Homo sapiens
gaacugcagcuuugaggau

SEQ ID NO: 603922 - RNA, 19 nt, Homo sapiens
caagacaggcucugaagau

SEQ ID NO: 603923 - RNA, 19 nt, Homo sapiens
gagcauuugugcgcaaguu

SEQ ID NO: 603924 - RNA, 19 nt, Homo sapiens
gcucuacgauggccuuaag

SEQ ID NO: 603925 - RNA, 19 nt, Homo sapiens
gacauggaguaccagauug

SEQ ID NO: 603926 - RNA, 19 nt, Homo sapiens
gggauggcauuccacaugu

SEQ ID NO: 603927 - RNA, 19 nt, Homo sapiens
gaagaugaaauugaugaug

SEQ ID NO: 603928 - RNA, 19 nt, Homo sapiens
gagaaggauaugaagauga

SEQ ID NO: 603929 - RNA, 19 nt, Homo sapiens
ugagagagaaggauaugaa

SEQ ID NO: 603930 - RNA, 19 nt, Homo sapiens
gaacugcgaguggauuguu

SEQ ID NO: 603931 - RNA, 19 nt, Homo sapiens
ggagagauugccauugaug

SEQ ID NO: 603932 - RNA, 19 nt, Homo sapiens
ccagagagagggccaguau

SEQ ID NO: 603933 - RNA, 19 nt, Homo sapiens
gaacuuucagugcaauguu

SEQ ID NO: 603934 - RNA, 19 nt, Homo sapiens
gcuccaugcucuacaucaa

SEQ ID NO: 603935 - RNA, 19 nt, Homo sapiens
gaggagcccugugguugga

SEQ ID NO: 603936 - RNA, 19 nt, Homo sapiens
ucaauugcaacuucgauuu

SEQ ID NO: 603937 - RNA, 19 nt, Homo sapiens
gaacacccaagacagugaa

SEQ ID NO: 603938 - RNA, 19 nt, Homo sapiens
cauggagucuggccggauu

SEQ ID NO: 603939 - RNA, 19 nt, Homo sapiens
caaguacugugggaccaaa

SEQ ID NO: 603940 - RNA, 19 nt, Homo sapiens
ggauggcauuccacauguu

SEQ ID NO: 603941 - RNA, 19 nt, Homo sapiens
guuagaauccgcccucaga

SEQ ID NO: 603942 - RNA, 19 nt, Homo sapiens
aaacacagaauggcuacua

SEQ ID NO: 603943 - RNA, 19 nt, Homo sapiens
gaacagaucagugccucau

SEQ ID NO: 603944 - RNA, 19 nt, Homo sapiens
ucuuugaccuggagcauga

SEQ ID NO: 603945 - RNA, 19 nt, Homo sapiens
gacaggcucugaagauugc

SEQ ID NO: 603946 - RNA, 19 nt, Homo sapiens
ggaggucguuugaauucca

SEQ ID NO: 603947 - RNA, 19 nt, Homo sapiens
gagagauugccauugauga

SEQ ID NO: 603948 - RNA, 19 nt, Homo sapiens
gcggaggucguuugaauuc

SEQ ID NO: 603949 - RNA, 19 nt, Homo sapiens
agugaaaggugucaucauc

SEQ ID NO: 603950 - RNA, 19 nt, Homo sapiens
gaugcucccugcuccaaca

SEQ ID NO: 603951 - RNA, 19 nt, Homo sapiens
caacacagggagcgauuuc

SEQ ID NO: 603952 - RNA, 19 nt, Homo sapiens
uagagaacuuucagugcaa

SEQ ID NO: 603953 - RNA, 19 nt, Homo sapiens
gaacccaucucggcuuuug

SEQ ID NO: 603954 - RNA, 19 nt, Homo sapiens
ggaacacccaagacaguga

SEQ ID NO: 603955 - RNA, 19 nt, Homo sapiens
ggggagaacugcagcuuug

SEQ ID NO: 603956 - RNA, 19 nt, Homo sapiens
caaggacugggaauacauu

SEQ ID NO: 603957 - RNA, 19 nt, Homo sapiens
ugaaaggugucaucaucca

SEQ ID NO: 603958 - RNA, 19 nt, Homo sapiens
ucagguagaucugggaaca

SEQ ID NO: 603959 - RNA, 19 nt, Homo sapiens
aagacaggcucugaagauu

SEQ ID NO: 603960 - RNA, 19 nt, Homo sapiens
guaugacuuuaucgagauu

SEQ ID NO: 603961 - RNA, 19 nt, Homo sapiens
uuccaaagaugcuggcuau

SEQ ID NO: 603962 - RNA, 19 nt, Homo sapiens
uguggaagccagagcauuu

SEQ ID NO: 603963 - RNA, 19 nt, Homo sapiens
caacgggaccaucgaaucu

SEQ ID NO: 603964 - RNA, 19 nt, Homo sapiens
ggcaaacacugugggaaca

SEQ ID NO: 603965 - RNA, 19 nt, Homo sapiens
caacuucgagcucuacgau

SEQ ID NO: 603966 - RNA, 19 nt, Homo sapiens
gauugccauugaugacauu

SEQ ID NO: 603967 - RNA, 19 nt, Homo sapiens
gaagaggaggccacagagu

SEQ ID NO: 603968 - RNA, 19 nt, Homo sapiens
ggcaaggacugggaauaca

SEQ ID NO: 603969 - RNA, 19 nt, Homo sapiens
aggaguggcuucagguaga

SEQ ID NO: 603970 - RNA, 19 nt, Homo sapiens
ccaacaacgaugcaacuga

SEQ ID NO: 603971 - RNA, 19 nt, Homo sapiens
gagaggacuggauggugua

SEQ ID NO: 603972 - RNA, 19 nt, Homo sapiens
ggaagucagcacuaaugga

SEQ ID NO: 603973 - RNA, 19 nt, Homo sapiens
gcuccauggugaugacaau

SEQ ID NO: 603974 - RNA, 19 nt, Homo sapiens
caaaacacccucugaacuu

SEQ ID NO: 603975 - RNA, 19 nt, Homo sapiens
aacuuggacugcaccuuua

SEQ ID NO: 603976 - RNA, 19 nt, Homo sapiens
agaagauuguccucaacuu

SEQ ID NO: 603977 - RNA, 19 nt, Homo sapiens
gcuacgacauggaguacca

SEQ ID NO: 603978 - RNA, 19 nt, Homo sapiens
ucacggccaucgcaacaca

SEQ ID NO: 603979 - RNA, 19 nt, Homo sapiens
aagcacgacugcaaguaug

SEQ ID NO: 603980 - RNA, 19 nt, Homo sapiens
ccucaucuaccuacucuga

SEQ ID NO: 603981 - RNA, 19 nt, Homo sapiens
ugagaaguauccacacaac

SEQ ID NO: 603982 - RNA, 19 nt, Homo sapiens
caaguucaccuccgacuac

SEQ ID NO: 603983 - RNA, 19 nt, Homo sapiens
agagaaggauaugaagaug

SEQ ID NO: 603984 - RNA, 19 nt, Homo sapiens
caguggacaucccagaaau

SEQ ID NO: 603985 - RNA, 19 nt, Homo sapiens
gcagagugacagccagaga

SEQ ID NO: 603986 - RNA, 19 nt, Homo sapiens
gcaaggacugggaauacau

SEQ ID NO: 603987 - RNA, 19 nt, Homo sapiens
uggaacccaucucggcuuu

SEQ ID NO: 603988 - RNA, 19 nt, Homo sapiens
aaagucuccuacagccuaa

SEQ ID NO: 603989 - RNA, 19 nt, Homo sapiens
ggaguggcuucagguagau

SEQ ID NO: 603990 - RNA, 19 nt, Homo sapiens
gauccucucccugaccuuu

SEQ ID NO: 603991 - RNA, 19 nt, Homo sapiens
caaacacugugggaacauc

SEQ ID NO: 603992 - RNA, 19 nt, Homo sapiens
ggauaugaagaugaaauug

SEQ ID NO: 603993 - RNA, 19 nt, Homo sapiens
cagaaauacaugagagaga

SEQ ID NO: 603994 - RNA, 19 nt, Homo sapiens
caauugcaacuucgauuuc

SEQ ID NO: 603995 - RNA, 19 nt, Homo sapiens
ccaaagaugucagagauua

SEQ ID NO: 603996 - RNA, 19 nt, Homo sapiens
caagagagguccugaaugu

SEQ ID NO: 603997 - RNA, 19 nt, Homo sapiens
ggacagagacugcaaguau

SEQ ID NO: 603998 - RNA, 19 nt, Homo sapiens
aaucagaguuuccaacaua

SEQ ID NO: 603999 - RNA, 19 nt, Homo sapiens
ggaaaguucuguggaaaga

SEQ ID NO: 604000 - RNA, 19 nt, Homo sapiens
ggagaacuauaacuuugaa

SEQ ID NO: 604001 - RNA, 19 nt, Homo sapiens
gcacuuauauugucuuugc

SEQ ID NO: 604002 - RNA, 19 nt, Homo sapiens
gaauguggcgauacuauaa

SEQ ID NO: 604003 - RNA, 19 nt, Homo sapiens
gcagagcagugucucagaa

SEQ ID NO: 604004 - RNA, 19 nt, Homo sapiens
aaaguucuguggaaagaua

SEQ ID NO: 604005 - RNA, 19 nt, Homo sapiens
guugcaagauaacagauua

SEQ ID NO: 604006 - RNA, 19 nt, Homo sapiens
guggaugacauuaguauua

SEQ ID NO: 604007 - RNA, 19 nt, Homo sapiens
gaaggaagggcgugucuug

SEQ ID NO: 604008 - RNA, 19 nt, Homo sapiens
gguauggugucuggacuua

SEQ ID NO: 604009 - RNA, 19 nt, Homo sapiens
ggucauagacagcaccaua

SEQ ID NO: 604010 - RNA, 19 nt, Homo sapiens
ggcauucucuccaugguuu

SEQ ID NO: 604011 - RNA, 19 nt, Homo sapiens
gagauuauccuggaauuug

SEQ ID NO: 604012 - RNA, 19 nt, Homo sapiens
caccugagcugcggacuuu

SEQ ID NO: 604013 - RNA, 19 nt, Homo sapiens
gaacuugguggaugaaugu

SEQ ID NO: 604014 - RNA, 19 nt, Homo sapiens
ggaacuugguggaugaaug

SEQ ID NO: 604015 - RNA, 19 nt, Homo sapiens
gaaacuggaugccugaaaa

SEQ ID NO: 604016 - RNA, 19 nt, Homo sapiens
ucaaauuugucucugacua

SEQ ID NO: 604017 - RNA, 19 nt, Homo sapiens
acaagaacaucuccaggaa

SEQ ID NO: 604018 - RNA, 19 nt, Homo sapiens
gaaaacauccgccugguaa

SEQ ID NO: 604019 - RNA, 19 nt, Homo sapiens
ugucuggacuuauuucuga

SEQ ID NO: 604020 - RNA, 19 nt, Homo sapiens
gcaauguguugaagaccuu

SEQ ID NO: 604021 - RNA, 19 nt, Homo sapiens
auacgaaggugaaggagaa

SEQ ID NO: 604022 - RNA, 19 nt, Homo sapiens
gaagacuggaucaccauaa

SEQ ID NO: 604023 - RNA, 19 nt, Homo sapiens
ugaaugcacuuauauuguc

SEQ ID NO: 604024 - RNA, 19 nt, Homo sapiens
gacagagacugcaaguaug

SEQ ID NO: 604025 - RNA, 19 nt, Homo sapiens
uaaccacauuucacaagaa

SEQ ID NO: 604026 - RNA, 19 nt, Homo sapiens
gagaguggauacagguaga

SEQ ID NO: 604027 - RNA, 19 nt, Homo sapiens
caacaacaacuaugauaca

SEQ ID NO: 604028 - RNA, 19 nt, Homo sapiens
uauggugucuggacuuauu

SEQ ID NO: 604029 - RNA, 19 nt, Homo sapiens
cacaggagauggcaacuuc

SEQ ID NO: 604030 - RNA, 19 nt, Homo sapiens
ugaauacacagaguacuua

SEQ ID NO: 604031 - RNA, 19 nt, Homo sapiens
gcaccucauuccuacauca

SEQ ID NO: 604032 - RNA, 19 nt, Homo sapiens
cugguuauccucauucuua

SEQ ID NO: 604033 - RNA, 19 nt, Homo sapiens
gcucuggaauguuggguau

SEQ ID NO: 604034 - RNA, 19 nt, Homo sapiens
ugucugcccuggagaacua

SEQ ID NO: 604035 - RNA, 19 nt, Homo sapiens
ggugagcccugugguuuau

SEQ ID NO: 604036 - RNA, 19 nt, Homo sapiens
gaucacaucauccaaccaa

SEQ ID NO: 604037 - RNA, 19 nt, Homo sapiens
ugucaagacuuacaagauc

SEQ ID NO: 604038 - RNA, 19 nt, Homo sapiens
caaaagaaaccaagaagaa

SEQ ID NO: 604039 - RNA, 19 nt, Homo sapiens
cauggaaucaggagaaauu

SEQ ID NO: 604040 - RNA, 19 nt, Homo sapiens
cauaaugggaugucagaaa

SEQ ID NO: 604041 - RNA, 19 nt, Homo sapiens
uggaacaggugaugacuuc

SEQ ID NO: 604042 - RNA, 19 nt, Homo sapiens
ggcaacaacaacuaugaua

SEQ ID NO: 604043 - RNA, 19 nt, Homo sapiens
ccacugauaacucgauuug

SEQ ID NO: 604044 - RNA, 19 nt, Homo sapiens
gauuauccuugcucuggaa

SEQ ID NO: 604045 - RNA, 19 nt, Homo sapiens
cagagauuauccuggaauu

SEQ ID NO: 604046 - RNA, 19 nt, Homo sapiens
aagacaaacugaauacaca

SEQ ID NO: 604047 - RNA, 19 nt, Homo sapiens
gaagccaggcaauguguug

SEQ ID NO: 604048 - RNA, 19 nt, Homo sapiens
caccauacaaucagaguuu

SEQ ID NO: 604049 - RNA, 19 nt, Homo sapiens
caacuucaacccucacuuc

SEQ ID NO: 604050 - RNA, 19 nt, Homo sapiens
caaugaguggcuccaaaua

SEQ ID NO: 604051 - RNA, 19 nt, Homo sapiens
acaaaccuguucucuuuca

SEQ ID NO: 604052 - RNA, 19 nt, Homo sapiens
ggaagacuggaucaccaua

SEQ ID NO: 604053 - RNA, 19 nt, Homo sapiens
cuagaaaucugggauggau

SEQ ID NO: 604054 - RNA, 19 nt, Homo sapiens
aaacugaauacacagagua

SEQ ID NO: 604055 - RNA, 19 nt, Homo sapiens
cuggagaacuauaacuuug

SEQ ID NO: 604056 - RNA, 19 nt, Homo sapiens
aagacuggaucaccauaaa

SEQ ID NO: 604057 - RNA, 19 nt, Homo sapiens
gacccauaccagagaauua

SEQ ID NO: 604058 - RNA, 19 nt, Homo sapiens
ccuggaauuugaaagcuuu

SEQ ID NO: 604059 - RNA, 19 nt, Homo sapiens
ugaauguggcgauacuaua

SEQ ID NO: 604060 - RNA, 19 nt, Homo sapiens
ggaguguguugaccagcaa

SEQ ID NO: 604061 - RNA, 19 nt, Homo sapiens
uaccuuacaucuccugguu

SEQ ID NO: 604062 - RNA, 19 nt, Homo sapiens
ggaagcaccgagagaacaa

SEQ ID NO: 604063 - RNA, 19 nt, Homo sapiens
agacagcaccauacaauca

SEQ ID NO: 604064 - RNA, 19 nt, Homo sapiens
caaacugaauacacagagu

SEQ ID NO: 604065 - RNA, 19 nt, Homo sapiens
cagcucaaguggagugugu

SEQ ID NO: 604066 - RNA, 19 nt, Homo sapiens
gcugggcugugaaguggaa

SEQ ID NO: 604067 - RNA, 19 nt, Homo sapiens
gggaaacuggcauaucuau

SEQ ID NO: 604068 - RNA, 19 nt, Homo sapiens
ucacagcuucuucccagua

SEQ ID NO: 604069 - RNA, 19 nt, Homo sapiens
gggcauggaaucaggagaa

SEQ ID NO: 604070 - RNA, 19 nt, Homo sapiens
agauuauccuggaauuuga

SEQ ID NO: 604071 - RNA, 19 nt, Homo sapiens
gcaacaacaacuaugauac

SEQ ID NO: 604072 - RNA, 19 nt, Homo sapiens
gaaugcacuuauauugucu

SEQ ID NO: 604073 - RNA, 19 nt, Homo sapiens
ccuuacaucuccugguuau

SEQ ID NO: 604074 - RNA, 19 nt, Homo sapiens
acugauaacucgauuuguc

SEQ ID NO: 604075 - RNA, 19 nt, Homo sapiens
ugaacuacccugagaaugg

SEQ ID NO: 604076 - RNA, 19 nt, Homo sapiens
caaguaugacuacguggaa

SEQ ID NO: 604077 - RNA, 19 nt, Homo sapiens
auacacagaguacuuauuc

SEQ ID NO: 604078 - RNA, 19 nt, Homo sapiens
gaauacacagaguacuuau

SEQ ID NO: 604079 - RNA, 19 nt, Homo sapiens
gaugucagaaagaaacuug

SEQ ID NO: 604080 - RNA, 19 nt, Homo sapiens
auaaugggaugucagaaag

SEQ ID NO: 604081 - RNA, 19 nt, Homo sapiens
ccacauuucacaagaagau

SEQ ID NO: 604082 - RNA, 19 nt, Homo sapiens
gaacaggugaugacuucca

SEQ ID NO: 604083 - RNA, 19 nt, Homo sapiens
augaguggcuccaaauaga

SEQ ID NO: 604084 - RNA, 19 nt, Homo sapiens
agccuugaaugcacuuaua

SEQ ID NO: 604085 - RNA, 19 nt, Homo sapiens
gaacuuguggaugguguga

SEQ ID NO: 604086 - RNA, 19 nt, Homo sapiens
ggauugcuguggaugacau

SEQ ID NO: 604087 - RNA, 19 nt, Homo sapiens
uaccagagaauuaugauca

SEQ ID NO: 604088 - RNA, 19 nt, Homo sapiens
cuucaacccucacuucgau

SEQ ID NO: 604089 - RNA, 19 nt, Homo sapiens
ggcauggaaucaggagaaa

SEQ ID NO: 604090 - RNA, 19 nt, Homo sapiens
gaaggugacaagaacaucu

SEQ ID NO: 604091 - RNA, 19 nt, Homo sapiens
gcaugaccuucugguauca

SEQ ID NO: 604092 - RNA, 19 nt, Homo sapiens
gcaagacgggacccauuca

SEQ ID NO: 604093 - RNA, 19 nt, Homo sapiens
acaagguguucaugaggaa

SEQ ID NO: 604094 - RNA, 19 nt, Homo sapiens
agagagguccugaauguuc

SEQ ID NO: 604095 - RNA, 19 nt, Homo sapiens
uaacaacccugcccaguaa

SEQ ID NO: 604096 - RNA, 19 nt, Homo sapiens
aaagguaccucuucuguaa

SEQ ID NO: 604097 - RNA, 19 nt, Homo sapiens
gaacugaccagcuuauauu

SEQ ID NO: 604098 - RNA, 19 nt, Homo sapiens
gcacagacacuacaguuaa

SEQ ID NO: 604099 - RNA, 19 nt, Homo sapiens
ugaaaugacucccuucuga

SEQ ID NO: 604100 - RNA, 19 nt, Homo sapiens
gaagugcaguuugcugaua

SEQ ID NO: 604101 - RNA, 19 nt, Homo sapiens
gaacuacaaucuggucauu

SEQ ID NO: 604102 - RNA, 19 nt, Homo sapiens
gcuaugaaauugugaucua

SEQ ID NO: 604103 - RNA, 19 nt, Homo sapiens
gcaauuaggcagauaaaga

SEQ ID NO: 604104 - RNA, 19 nt, Homo sapiens
gaaugugggcugcauauaa

SEQ ID NO: 604105 - RNA, 19 nt, Homo sapiens
gcaguuugcugauaagaug

SEQ ID NO: 604106 - RNA, 19 nt, Homo sapiens
gaugaaauuuggauagaga

SEQ ID NO: 604107 - RNA, 19 nt, Homo sapiens
gagcaagacauucauauga

SEQ ID NO: 604108 - RNA, 19 nt, Homo sapiens
ggucaggaguucgagauua

SEQ ID NO: 604109 - RNA, 19 nt, Homo sapiens
gcaaugggcugcaauuagg

SEQ ID NO: 604110 - RNA, 19 nt, Homo sapiens
gggcauaacaggcuuagua

SEQ ID NO: 604111 - RNA, 19 nt, Homo sapiens
gcaaugggcuuccguacuc

SEQ ID NO: 604112 - RNA, 19 nt, Homo sapiens
gcuacaaccugcaaaucua

SEQ ID NO: 604113 - RNA, 19 nt, Homo sapiens
uagaagaugugcauaaugu

SEQ ID NO: 604114 - RNA, 19 nt, Homo sapiens
caucauagcacauguagaa

SEQ ID NO: 604115 - RNA, 19 nt, Homo sapiens
caagaaccacggcaaguua

SEQ ID NO: 604116 - RNA, 19 nt, Homo sapiens
gaaggaacuugggagauga

SEQ ID NO: 604117 - RNA, 19 nt, Homo sapiens
ucagaagccuuauaggauu

SEQ ID NO: 604118 - RNA, 19 nt, Homo sapiens
cuacaaagcagacauaaau

SEQ ID NO: 604119 - RNA, 19 nt, Homo sapiens
guaauagcaugaacaguca

SEQ ID NO: 604120 - RNA, 19 nt, Homo sapiens
guguuucccuuauguguua

SEQ ID NO: 604121 - RNA, 19 nt, Homo sapiens
ggcauuaacucuccucaau

SEQ ID NO: 604122 - RNA, 19 nt, Homo sapiens
ccacgcaucuugagcaaau

SEQ ID NO: 604123 - RNA, 19 nt, Homo sapiens
cagaaucuaugaugaaauc

SEQ ID NO: 604124 - RNA, 19 nt, Homo sapiens
cauaaugucugcucuugug

SEQ ID NO: 604125 - RNA, 19 nt, Homo sapiens
gcaagacauucauaugauc

SEQ ID NO: 604126 - RNA, 19 nt, Homo sapiens
uagaagaccuugcaagaag

SEQ ID NO: 604127 - RNA, 19 nt, Homo sapiens
uaagcacacucaucccuuu

SEQ ID NO: 604128 - RNA, 19 nt, Homo sapiens
guaacaacccugcccagua

SEQ ID NO: 604129 - RNA, 19 nt, Homo sapiens
guaauguccuucaaaucuu

SEQ ID NO: 604130 - RNA, 19 nt, Homo sapiens
gaaacagcacccguaguua

SEQ ID NO: 604131 - RNA, 19 nt, Homo sapiens
guaaagcuuucccugguau

SEQ ID NO: 604132 - RNA, 19 nt, Homo sapiens
caacuaccauuagcacuau

SEQ ID NO: 604133 - RNA, 19 nt, Homo sapiens
gcaagaagcagagucauuc

SEQ ID NO: 604134 - RNA, 19 nt, Homo sapiens
gccaagauuuccuucugua

SEQ ID NO: 604135 - RNA, 19 nt, Homo sapiens
cuauggaucuugcuccuuu

SEQ ID NO: 604136 - RNA, 19 nt, Homo sapiens
guaaaugaauccauagacu

SEQ ID NO: 604137 - RNA, 19 nt, Homo sapiens
gaaaugacucccuucugaa

SEQ ID NO: 604138 - RNA, 19 nt, Homo sapiens
caacugagcaagacauuca

SEQ ID NO: 604139 - RNA, 19 nt, Homo sapiens
ggaacuggguauaauccaa

SEQ ID NO: 604140 - RNA, 19 nt, Homo sapiens
gacaagaugcugccucaaa

SEQ ID NO: 604141 - RNA, 19 nt, Homo sapiens
ggauagagaaugaggaaga

SEQ ID NO: 604142 - RNA, 19 nt, Homo sapiens
ggauaaacaagcaagauug

SEQ ID NO: 604143 - RNA, 19 nt, Homo sapiens
caaacuucuucccaucaua

SEQ ID NO: 604144 - RNA, 19 nt, Homo sapiens
cccaguaaaugaauccaua

SEQ ID NO: 604145 - RNA, 19 nt, Homo sapiens
ggaacugaccagcuuauau

SEQ ID NO: 604146 - RNA, 19 nt, Homo sapiens
gaucuucucugcccaacuc

SEQ ID NO: 604147 - RNA, 19 nt, Homo sapiens
agacaucagucccaguaaa

SEQ ID NO: 604148 - RNA, 19 nt, Homo sapiens
cagaagccuuauaggauuu

SEQ ID NO: 604149 - RNA, 19 nt, Homo sapiens
gguaauguccuucaaaucu

SEQ ID NO: 604150 - RNA, 19 nt, Homo sapiens
gaaggauggaugaaauuug

SEQ ID NO: 604151 - RNA, 19 nt, Homo sapiens
gagaugauggugcagauga

SEQ ID NO: 604152 - RNA, 19 nt, Homo sapiens
ccaagcagccucagcagaa

SEQ ID NO: 604153 - RNA, 19 nt, Homo sapiens
ccaaggugcuucccuccaa

SEQ ID NO: 604154 - RNA, 19 nt, Homo sapiens
gugccuaaauggacaaaug

SEQ ID NO: 604155 - RNA, 19 nt, Homo sapiens
agaaggaacuugggagaug

SEQ ID NO: 604156 - RNA, 19 nt, Homo sapiens
acacugacaugcucuguag

SEQ ID NO: 604157 - RNA, 19 nt, Homo sapiens
gagcaccucuccagaugca

SEQ ID NO: 604158 - RNA, 19 nt, Homo sapiens
ccaaagacucagagaacua

SEQ ID NO: 604159 - RNA, 19 nt, Homo sapiens
gaagcagccaugcccagua

SEQ ID NO: 604160 - RNA, 19 nt, Homo sapiens
uagacacacucuccaaaug

SEQ ID NO: 604161 - RNA, 19 nt, Homo sapiens
ucagucacuuucccuguaa

SEQ ID NO: 604162 - RNA, 19 nt, Homo sapiens
agaaacagcacccguaguu

SEQ ID NO: 604163 - RNA, 19 nt, Homo sapiens
aaagacaucagucccagua

SEQ ID NO: 604164 - RNA, 19 nt, Homo sapiens
gggauaaacaagcaagauu

SEQ ID NO: 604165 - RNA, 19 nt, Homo sapiens
gcauacccuuccugaaaug

SEQ ID NO: 604166 - RNA, 19 nt, Homo sapiens
cauucugucuucaguguuu

SEQ ID NO: 604167 - RNA, 19 nt, Homo sapiens
ccauuuacauguccuucaa

SEQ ID NO: 604168 - RNA, 19 nt, Homo sapiens
cacagucccuugccuaugu

SEQ ID NO: 604169 - RNA, 19 nt, Homo sapiens
uauaaucggcuaacuccua

SEQ ID NO: 604170 - RNA, 19 nt, Homo sapiens
ucacuuucccuguaaauau

SEQ ID NO: 604171 - RNA, 19 nt, Homo sapiens
caaauggaguguuggaaaa

SEQ ID NO: 604172 - RNA, 19 nt, Homo sapiens
gucagucacuuucccugua

SEQ ID NO: 604173 - RNA, 19 nt, Homo sapiens
ggaagacgcaggagacuac

SEQ ID NO: 604174 - RNA, 19 nt, Homo sapiens
gaaaccccaucucuacuaa

SEQ ID NO: 604175 - RNA, 19 nt, Homo sapiens
ggaaaagacucagaaaucu

SEQ ID NO: 604176 - RNA, 19 nt, Homo sapiens
ccaacuaccauuagcacua

SEQ ID NO: 604177 - RNA, 19 nt, Homo sapiens
auaaucggcuaacuccuaa

SEQ ID NO: 604178 - RNA, 19 nt, Homo sapiens
gcuuauauuucucacacuu

SEQ ID NO: 604179 - RNA, 19 nt, Homo sapiens
aagauuuccuucuguauca

SEQ ID NO: 604180 - RNA, 19 nt, Homo sapiens
gguuagacccugaaagaga

SEQ ID NO: 604181 - RNA, 19 nt, Homo sapiens
ugaguuacaaccaccaaua

SEQ ID NO: 604182 - RNA, 19 nt, Homo sapiens
guuagacccugaaagagau

SEQ ID NO: 604183 - RNA, 19 nt, Homo sapiens
gagaaggggaucaauauuu

SEQ ID NO: 604184 - RNA, 19 nt, Homo sapiens
ugaaugacaaagcagguua

SEQ ID NO: 604185 - RNA, 19 nt, Homo sapiens
ugaauucucccucuggaaa

SEQ ID NO: 604186 - RNA, 19 nt, Homo sapiens
uguaaagcuuucccuggua

SEQ ID NO: 604187 - RNA, 19 nt, Homo sapiens
gaagaugugcauaaugucu

SEQ ID NO: 604188 - RNA, 19 nt, Homo sapiens
caaaguagaagaugugcau

SEQ ID NO: 604189 - RNA, 19 nt, Homo sapiens
cagaucaccagccagcuua

SEQ ID NO: 604190 - RNA, 19 nt, Homo sapiens
gguauaauccaaccaucaa

SEQ ID NO: 604191 - RNA, 19 nt, Homo sapiens
caaagcagacauaaauaca

SEQ ID NO: 604192 - RNA, 19 nt, Homo sapiens
cauucagccuuacagcaua

SEQ ID NO: 604193 - RNA, 19 nt, Homo sapiens
gaaauuuggauagagaaug

SEQ ID NO: 604194 - RNA, 19 nt, Homo sapiens
gaacuugggagaugauggu

SEQ ID NO: 604195 - RNA, 19 nt, Homo sapiens
gaacaaggauuccgugcua

SEQ ID NO: 604196 - RNA, 19 nt, Homo sapiens
caaaguagcugauggauuc

SEQ ID NO: 604197 - RNA, 19 nt, Homo sapiens
acacagagcucaucagaaa

SEQ ID NO: 604198 - RNA, 19 nt, Homo sapiens
ugaaggagcuguugucauu

SEQ ID NO: 604199 - RNA, 19 nt, Homo sapiens
gaaagugcaucccuuguug

SEQ ID NO: 604200 - RNA, 19 nt, Homo sapiens
gcaaugagaucccuguaga

SEQ ID NO: 604201 - RNA, 19 nt, Homo sapiens
gaaguuggccuuacagaaa

SEQ ID NO: 604202 - RNA, 19 nt, Homo sapiens
guaugcagaugaugaauaa

SEQ ID NO: 604203 - RNA, 19 nt, Homo sapiens
gaacagagaacuugagugu

SEQ ID NO: 604204 - RNA, 19 nt, Homo sapiens
gagaagcugaugcaaauua

SEQ ID NO: 604205 - RNA, 19 nt, Homo sapiens
gaaccuuuauuacuaguga

SEQ ID NO: 604206 - RNA, 19 nt, Homo sapiens
uaaagaaccuccuacagau

SEQ ID NO: 604207 - RNA, 19 nt, Homo sapiens
acagagaacuugaguguau

SEQ ID NO: 604208 - RNA, 19 nt, Homo sapiens
gaaccaagaacaagucauu

SEQ ID NO: 604209 - RNA, 19 nt, Homo sapiens
gaagauuccugguauuucu

SEQ ID NO: 604210 - RNA, 19 nt, Homo sapiens
ccacauacccuauuacaga

SEQ ID NO: 604211 - RNA, 19 nt, Homo sapiens
uagaaccucugaaagauuu

SEQ ID NO: 604212 - RNA, 19 nt, Homo sapiens
caacaacccuaccaauauc

SEQ ID NO: 604213 - RNA, 19 nt, Homo sapiens
ccugguauuucucgaauua

SEQ ID NO: 604214 - RNA, 19 nt, Homo sapiens
uaauagaaccucugaaaga

SEQ ID NO: 604215 - RNA, 19 nt, Homo sapiens
ugaaguaauuggagaaaug

SEQ ID NO: 604216 - RNA, 19 nt, Homo sapiens
ugaagaugcucccugguuu

SEQ ID NO: 604217 - RNA, 19 nt, Homo sapiens
uuaagaagauuccugguau

SEQ ID NO: 604218 - RNA, 19 nt, Homo sapiens
caaauuaccagucugcauu

SEQ ID NO: 604219 - RNA, 19 nt, Homo sapiens
gcugaagaaccuuauauuu

SEQ ID NO: 604220 - RNA, 19 nt, Homo sapiens
uggcaaagcugaacucauc

SEQ ID NO: 604221 - RNA, 19 nt, Homo sapiens
gcuuauaccucgcaugugu

SEQ ID NO: 604222 - RNA, 19 nt, Homo sapiens
gaacaacaacccuaccaau

SEQ ID NO: 604223 - RNA, 19 nt, Homo sapiens
cgagaaagccagucuguug

SEQ ID NO: 604224 - RNA, 19 nt, Homo sapiens
aaagccacauacccuauua

SEQ ID NO: 604225 - RNA, 19 nt, Homo sapiens
aguaauaugugcugaagaa

SEQ ID NO: 604226 - RNA, 19 nt, Homo sapiens
gaauucaggucaaagugau

SEQ ID NO: 604227 - RNA, 19 nt, Homo sapiens
gacugggaaucacuuauuu

SEQ ID NO: 604228 - RNA, 19 nt, Homo sapiens
aaacauaguagcaggcaua

SEQ ID NO: 604229 - RNA, 19 nt, Homo sapiens
gaucgggacccacuucaaa

SEQ ID NO: 604230 - RNA, 19 nt, Homo sapiens
ccacaaguccugaagagaa

SEQ ID NO: 604231 - RNA, 19 nt, Homo sapiens
uaagaagauuccugguauu

SEQ ID NO: 604232 - RNA, 19 nt, Homo sapiens
gcauagcaaaugaaucuaa

SEQ ID NO: 604233 - RNA, 19 nt, Homo sapiens
uuaaagaaccuccuacaga

SEQ ID NO: 604234 - RNA, 19 nt, Homo sapiens
ggaauucaggucaaaguga

SEQ ID NO: 604235 - RNA, 19 nt, Homo sapiens
caaggauuccgugcuauua

SEQ ID NO: 604236 - RNA, 19 nt, Homo sapiens
aggagaagcugaugcaaau

SEQ ID NO: 604237 - RNA, 19 nt, Homo sapiens
gaaguaauuggagaaauga

SEQ ID NO: 604238 - RNA, 19 nt, Homo sapiens
uagcaggcauagcaaauga

SEQ ID NO: 604239 - RNA, 19 nt, Homo sapiens
ucacaacguuaacagaguu

SEQ ID NO: 604240 - RNA, 19 nt, Homo sapiens
cacaaguccugaagagaaa

SEQ ID NO: 604241 - RNA, 19 nt, Homo sapiens
gagaaagccagucuguuga

SEQ ID NO: 604242 - RNA, 19 nt, Homo sapiens
gagauaguguagacaaagu

SEQ ID NO: 604243 - RNA, 19 nt, Homo sapiens
cugaagaaccuuauauuug

SEQ ID NO: 604244 - RNA, 19 nt, Homo sapiens
gcaaucagaguaauaugug

SEQ ID NO: 604245 - RNA, 19 nt, Homo sapiens
gaccaggccuccuucucaa

SEQ ID NO: 604246 - RNA, 19 nt, Homo sapiens
acaacaacccuaccaauau

SEQ ID NO: 604247 - RNA, 19 nt, Homo sapiens
guacagcuuugcuaaaucg

SEQ ID NO: 604248 - RNA, 19 nt, Homo sapiens
ggaagaaguuguuuugcuu

SEQ ID NO: 604249 - RNA, 19 nt, Homo sapiens
ccugaaaccaacaauauuu

SEQ ID NO: 604250 - RNA, 19 nt, Homo sapiens
ggcacguucuggaaacaua

SEQ ID NO: 604251 - RNA, 19 nt, Homo sapiens
cuguagaggugguauuaaa

SEQ ID NO: 604252 - RNA, 19 nt, Homo sapiens
gagcucaucagaaaguuga

SEQ ID NO: 604253 - RNA, 19 nt, Homo sapiens
gguaugcagaugaugaaua

SEQ ID NO: 604254 - RNA, 19 nt, Homo sapiens
ggaauuugcuaugguaugc

SEQ ID NO: 604255 - RNA, 19 nt, Homo sapiens
gaagaugcucccugguuug

SEQ ID NO: 604256 - RNA, 19 nt, Homo sapiens
ggccugaucuaauugaaag

SEQ ID NO: 604257 - RNA, 19 nt, Homo sapiens
gauggaguuuucaacauua

SEQ ID NO: 604258 - RNA, 19 nt, Homo sapiens
guagaggugguauuaaaga

SEQ ID NO: 604259 - RNA, 19 nt, Homo sapiens
cagaagaggaucaggagaa

SEQ ID NO: 604260 - RNA, 19 nt, Homo sapiens
gaccacaaguccugaagag

SEQ ID NO: 604261 - RNA, 19 nt, Homo sapiens
aacaacaacccuaccaaua

SEQ ID NO: 604262 - RNA, 19 nt, Homo sapiens
gaaagucauagaccgaaga

SEQ ID NO: 604263 - RNA, 19 nt, Homo sapiens
gaaccuccuacagauguua

SEQ ID NO: 604264 - RNA, 19 nt, Homo sapiens
aauagaaccucugaaagau

SEQ ID NO: 604265 - RNA, 19 nt, Homo sapiens
gaaagccagucuguugaag

SEQ ID NO: 604266 - RNA, 19 nt, Homo sapiens
gcuaugguaugcagaugau

SEQ ID NO: 604267 - RNA, 19 nt, Homo sapiens
cugaagaauuuccuuuaug

SEQ ID NO: 604268 - RNA, 19 nt, Homo sapiens
gaaggaagaaguuguuuug

SEQ ID NO: 604269 - RNA, 19 nt, Homo sapiens
gaugcucccugguuugauc

SEQ ID NO: 604270 - RNA, 19 nt, Homo sapiens
ggaccuaauucuguguaug

SEQ ID NO: 604271 - RNA, 19 nt, Homo sapiens
auauuuggcccaccaguua

SEQ ID NO: 604272 - RNA, 19 nt, Homo sapiens
gaagagugagggaacuguu

SEQ ID NO: 604273 - RNA, 19 nt, Homo sapiens
gggcagagaacuuggacuu

SEQ ID NO: 604274 - RNA, 19 nt, Homo sapiens
gcagaugaugaauaaggua

SEQ ID NO: 604275 - RNA, 19 nt, Homo sapiens
ugacugggaaucacuuauu

SEQ ID NO: 604276 - RNA, 19 nt, Homo sapiens
ucauugcugugcacauuga

SEQ ID NO: 604277 - RNA, 19 nt, Homo sapiens
gcacaacagaagaggauca

SEQ ID NO: 604278 - RNA, 19 nt, Homo sapiens
aguaauagaaccucugaaa

SEQ ID NO: 604279 - RNA, 19 nt, Homo sapiens
ugacacagagcucaucaga

SEQ ID NO: 604280 - RNA, 19 nt, Homo sapiens
gauagaaccccacggaaaa

SEQ ID NO: 604281 - RNA, 19 nt, Homo sapiens
cauaguagcaggcauagca

SEQ ID NO: 604282 - RNA, 19 nt, Homo sapiens
gaagaaguuguuuugcuua

SEQ ID NO: 604283 - RNA, 19 nt, Homo sapiens
ugaaagugcaucccuuguu

SEQ ID NO: 604284 - RNA, 19 nt, Homo sapiens
uuuacggccugaucuaauu

SEQ ID NO: 604285 - RNA, 19 nt, Homo sapiens
uuggagaaaugaacuugaa

SEQ ID NO: 604286 - RNA, 19 nt, Homo sapiens
gagugggaguaauaaacuu

SEQ ID NO: 604287 - RNA, 19 nt, Homo sapiens
caggagaagcugaugcaaa

SEQ ID NO: 604288 - RNA, 19 nt, Homo sapiens
gaaaagaauuagcaaaacg

SEQ ID NO: 604289 - RNA, 19 nt, Homo sapiens
guaggcacgucaaaaguuu

SEQ ID NO: 604290 - RNA, 19 nt, Homo sapiens
cagagaacuugaguguauu

SEQ ID NO: 604291 - RNA, 19 nt, Homo sapiens
gguuugauccagcaauauu

SEQ ID NO: 604292 - RNA, 19 nt, Homo sapiens
aagaagauuccugguauuu

SEQ ID NO: 604293 - RNA, 19 nt, Homo sapiens
guaauagaaccucugaaag

SEQ ID NO: 604294 - RNA, 19 nt, Homo sapiens
gcaaagcugaacucaucaa

SEQ ID NO: 604295 - RNA, 19 nt, Homo sapiens
cagaagcuauugaucauua

SEQ ID NO: 604296 - RNA, 19 nt, Homo sapiens
gcagguguuuggcuuagua

SEQ ID NO: 604297 - RNA, 19 nt, Homo sapiens
gaacagggagcgaagcaaa

SEQ ID NO: 604298 - RNA, 19 nt, Homo sapiens
gaaagagacugcacaacac

SEQ ID NO: 604299 - RNA, 19 nt, Homo sapiens
gcaaguaccaaguggagua

SEQ ID NO: 604300 - RNA, 19 nt, Homo sapiens
cgaacucuaugccguauga

SEQ ID NO: 604301 - RNA, 19 nt, Homo sapiens
gaagauuuacgaacucuau

SEQ ID NO: 604302 - RNA, 19 nt, Homo sapiens
ggaguacgacgccuauaaa

SEQ ID NO: 604303 - RNA, 19 nt, Homo sapiens
gcgcugcccuuagauuauu

SEQ ID NO: 604304 - RNA, 19 nt, Homo sapiens
gcaguggaaugcugaugga

SEQ ID NO: 604305 - RNA, 19 nt, Homo sapiens
guacgacgccuauaaacug

SEQ ID NO: 604306 - RNA, 19 nt, Homo sapiens
acacuaagauguggauuuc

SEQ ID NO: 604307 - RNA, 19 nt, Homo sapiens
gcaacugccugcacaagac

SEQ ID NO: 604308 - RNA, 19 nt, Homo sapiens
gguguuuggcuuaguauuu

SEQ ID NO: 604309 - RNA, 19 nt, Homo sapiens
cacaagagacaacagagua

SEQ ID NO: 604310 - RNA, 19 nt, Homo sapiens
gccacagacugcuacauug

SEQ ID NO: 604311 - RNA, 19 nt, Homo sapiens
ggauuuccauaacccaaga

SEQ ID NO: 604312 - RNA, 19 nt, Homo sapiens
agaaagagacugcacaaca

SEQ ID NO: 604313 - RNA, 19 nt, Homo sapiens
gcccugguguacuguguaa

SEQ ID NO: 604314 - RNA, 19 nt, Homo sapiens
gcaagcagagugucuccaa

SEQ ID NO: 604315 - RNA, 19 nt, Homo sapiens
ggccacagacugcuacauu

SEQ ID NO: 604316 - RNA, 19 nt, Homo sapiens
gauuauucccacuacauuu

SEQ ID NO: 604317 - RNA, 19 nt, Homo sapiens
guguuuggcuuaguauuug

SEQ ID NO: 604318 - RNA, 19 nt, Homo sapiens
gaaggacgaccugcacaga

SEQ ID NO: 604319 - RNA, 19 nt, Homo sapiens
aggacgaccugcacagaaa

SEQ ID NO: 604320 - RNA, 19 nt, Homo sapiens
cccaagaccaguuugagua

SEQ ID NO: 604321 - RNA, 19 nt, Homo sapiens
ugcaugagaucuacaaugg

SEQ ID NO: 604322 - RNA, 19 nt, Homo sapiens
uggaagcccaguacaagua

SEQ ID NO: 604323 - RNA, 19 nt, Homo sapiens
gggaggucuuuaagucuau

SEQ ID NO: 604324 - RNA, 19 nt, Homo sapiens
gguguacuguguaaagaag

SEQ ID NO: 604325 - RNA, 19 nt, Homo sapiens
caccagaagcuauugauca

SEQ ID NO: 604326 - RNA, 19 nt, Homo sapiens
gcagagugucuccaagaug

SEQ ID NO: 604327 - RNA, 19 nt, Homo sapiens
ggucugaggcuguggaagu

SEQ ID NO: 604328 - RNA, 19 nt, Homo sapiens
gacaacagaguauucagau

SEQ ID NO: 604329 - RNA, 19 nt, Homo sapiens
caagagacaacagaguauu

SEQ ID NO: 604330 - RNA, 19 nt, Homo sapiens
aaagaagauuuacgaacuc

SEQ ID NO: 604331 - RNA, 19 nt, Homo sapiens
gggaucuccuggcaguuug

SEQ ID NO: 604332 - RNA, 19 nt, Homo sapiens
gagagagggugagcuuguc

SEQ ID NO: 604333 - RNA, 19 nt, Homo sapiens
gaaugcccaagaccaguuu

SEQ ID NO: 604334 - RNA, 19 nt, Homo sapiens
ggaggucuuuaagucuauu

SEQ ID NO: 604335 - RNA, 19 nt, Homo sapiens
gcucauuacacuaagaugu

SEQ ID NO: 604336 - RNA, 19 nt, Homo sapiens
uuucagcucauuacacuaa

SEQ ID NO: 604337 - RNA, 19 nt, Homo sapiens
uaacagaucacggguguac

SEQ ID NO: 604338 - RNA, 19 nt, Homo sapiens
ccacagacugcuacauugu

SEQ ID NO: 604339 - RNA, 19 nt, Homo sapiens
acucuaugccguaugauuu

SEQ ID NO: 604340 - RNA, 19 nt, Homo sapiens
gagacugcacaacacgaua

SEQ ID NO: 604341 - RNA, 19 nt, Homo sapiens
uggaguacgacgccuauaa

SEQ ID NO: 604342 - RNA, 19 nt, Homo sapiens
guauucagaucgccacacu

SEQ ID NO: 604343 - RNA, 19 nt, Homo sapiens
ccguaugauuucaguagaa

SEQ ID NO: 604344 - RNA, 19 nt, Homo sapiens
cgagagagggugagcuugu

SEQ ID NO: 604345 - RNA, 19 nt, Homo sapiens
ggggaggucuuuaagucua

SEQ ID NO: 604346 - RNA, 19 nt, Homo sapiens
gggcagguguuuggcuuag

SEQ ID NO: 604347 - RNA, 19 nt, Homo sapiens
uggcgcugcccuuagauua

SEQ ID NO: 604348 - RNA, 19 nt, Homo sapiens
cguuggcgcugcccuuaga

SEQ ID NO: 604349 - RNA, 19 nt, Homo sapiens
gagcccaccagaagcuauu

SEQ ID NO: 604350 - RNA, 19 nt, Homo sapiens
agacaacagaguauucaga

SEQ ID NO: 604351 - RNA, 19 nt, Homo sapiens
gccguaugauuucaguaga

SEQ ID NO: 604352 - RNA, 19 nt, Homo sapiens
acugcuacauugugcauga

SEQ ID NO: 604353 - RNA, 19 nt, Homo sapiens
ccacaagagacaacagagu

SEQ ID NO: 604354 - RNA, 19 nt, Homo sapiens
ucagcucauuacacuaaga

SEQ ID NO: 604355 - RNA, 19 nt, Homo sapiens
gugcaugagaucuacaaug

SEQ ID NO: 604356 - RNA, 19 nt, Homo sapiens
aagcagagugucuccaaga

SEQ ID NO: 604357 - RNA, 19 nt, Homo sapiens
acaagagacaacagaguau

SEQ ID NO: 604358 - RNA, 19 nt, Homo sapiens
gcaggccggacuacacuuc

SEQ ID NO: 604359 - RNA, 19 nt, Homo sapiens
gcuacauugugcaugagau

SEQ ID NO: 604360 - RNA, 19 nt, Homo sapiens
accagaagcuauugaucau

SEQ ID NO: 604361 - RNA, 19 nt, Homo sapiens
uacacuaagauguggauuu

SEQ ID NO: 604362 - RNA, 19 nt, Homo sapiens
ggucuuuaagucuauuguu

SEQ ID NO: 604363 - RNA, 19 nt, Homo sapiens
caaguacauugugauugag

SEQ ID NO: 604364 - RNA, 19 nt, Homo sapiens
acaacagaguauucagauc

SEQ ID NO: 604365 - RNA, 19 nt, Homo sapiens
gauugagcccacucgcauu

SEQ ID NO: 604366 - RNA, 19 nt, Homo sapiens
acagaaagagacugcacaa

SEQ ID NO: 604367 - RNA, 19 nt, Homo sapiens
gcccacaagagacaacaga

SEQ ID NO: 604368 - RNA, 19 nt, Homo sapiens
gcccaagaccaguuugagu

SEQ ID NO: 604369 - RNA, 19 nt, Homo sapiens
aagaccaguuugaguacga

SEQ ID NO: 604370 - RNA, 19 nt, Homo sapiens
uacgacgccuauaaacugu

SEQ ID NO: 604371 - RNA, 19 nt, Homo sapiens
agauuauucccacuacauu

SEQ ID NO: 604372 - RNA, 19 nt, Homo sapiens
ggaaauggcuuuagaaaua

SEQ ID NO: 604373 - RNA, 19 nt, Homo sapiens
gaaggaacuuucuugauua

SEQ ID NO: 604374 - RNA, 19 nt, Homo sapiens
ggagaugaguuuccacuaa

SEQ ID NO: 604375 - RNA, 19 nt, Homo sapiens
gagcagugaugcaauagaa

SEQ ID NO: 604376 - RNA, 19 nt, Homo sapiens
guucagaugugcaaggaua

SEQ ID NO: 604377 - RNA, 19 nt, Homo sapiens
gaaguaugacuguuaauga

SEQ ID NO: 604378 - RNA, 19 nt, Homo sapiens
gaacuuucuugauuagaga

SEQ ID NO: 604379 - RNA, 19 nt, Homo sapiens
gcagugaugcaauagaaua

SEQ ID NO: 604380 - RNA, 19 nt, Homo sapiens
ugagugcucuggauaacua

SEQ ID NO: 604381 - RNA, 19 nt, Homo sapiens
caagaccuguugauccuuu

SEQ ID NO: 604382 - RNA, 19 nt, Homo sapiens
uguaggaacucucauguga

SEQ ID NO: 604383 - RNA, 19 nt, Homo sapiens
guagcuagguguuuaaagu

SEQ ID NO: 604384 - RNA, 19 nt, Homo sapiens
ggacugccuuuaccaacaa

SEQ ID NO: 604385 - RNA, 19 nt, Homo sapiens
agagguagcuagguguuua

SEQ ID NO: 604386 - RNA, 19 nt, Homo sapiens
ucuguaggcucaccauuaa

SEQ ID NO: 604387 - RNA, 19 nt, Homo sapiens
cgacuacuauguucagaug

SEQ ID NO: 604388 - RNA, 19 nt, Homo sapiens
cagauuggacucuaucaua

SEQ ID NO: 604389 - RNA, 19 nt, Homo sapiens
aaacagaugauguauguga

SEQ ID NO: 604390 - RNA, 19 nt, Homo sapiens
agaaagaacuccucauagg

SEQ ID NO: 604391 - RNA, 19 nt, Homo sapiens
guaggucacauuucaagua

SEQ ID NO: 604392 - RNA, 19 nt, Homo sapiens
gugaugcaauagaauagua

SEQ ID NO: 604393 - RNA, 19 nt, Homo sapiens
agagaaagaacuccucaua

SEQ ID NO: 604394 - RNA, 19 nt, Homo sapiens
gagaugaguuuccacuaag

SEQ ID NO: 604395 - RNA, 19 nt, Homo sapiens
gcauucagacuaccuacua

SEQ ID NO: 604396 - RNA, 19 nt, Homo sapiens
ggaacuuucuugauuagag

SEQ ID NO: 604397 - RNA, 19 nt, Homo sapiens
uaaugaagccaaagagaaa

SEQ ID NO: 604398 - RNA, 19 nt, Homo sapiens
gugaguauuuaucccauuu

SEQ ID NO: 604399 - RNA, 19 nt, Homo sapiens
gaugauguaugugaguauu

SEQ ID NO: 604400 - RNA, 19 nt, Homo sapiens
gguccaggcuccaguagga

SEQ ID NO: 604401 - RNA, 19 nt, Homo sapiens
ucaaguaggucauauuucg

SEQ ID NO: 604402 - RNA, 19 nt, Homo sapiens
agacaagaauaucaugcua

SEQ ID NO: 604403 - RNA, 19 nt, Homo sapiens
cauucuacccuuugaaaua

SEQ ID NO: 604404 - RNA, 19 nt, Homo sapiens
uaggaacucucaugugaau

SEQ ID NO: 604405 - RNA, 19 nt, Homo sapiens
gaggugagaaucccaggua

SEQ ID NO: 604406 - RNA, 19 nt, Homo sapiens
ggaaguaugacuguuaaug

SEQ ID NO: 604407 - RNA, 19 nt, Homo sapiens
ugaauugucuaaccaugga

SEQ ID NO: 604408 - RNA, 19 nt, Homo sapiens
accaugaaguccuguauuu

SEQ ID NO: 604409 - RNA, 19 nt, Homo sapiens
gagaaagaacuccucauag

SEQ ID NO: 604410 - RNA, 19 nt, Homo sapiens
cagaugauguaugugagua

SEQ ID NO: 604411 - RNA, 19 nt, Homo sapiens
acacaggccucacugcaau

SEQ ID NO: 604412 - RNA, 19 nt, Homo sapiens
cauagaguaucuccgaaug

SEQ ID NO: 604413 - RNA, 19 nt, Homo sapiens
cagacuaccuacuaacaau

SEQ ID NO: 604414 - RNA, 19 nt, Homo sapiens
agagauagcucgcauucag

SEQ ID NO: 604415 - RNA, 19 nt, Homo sapiens
ccauggacauaaacaguug

SEQ ID NO: 604416 - RNA, 19 nt, Homo sapiens
gcuaaagacaagaauauca

SEQ ID NO: 604417 - RNA, 19 nt, Homo sapiens
agauuggacucuaucauau

SEQ ID NO: 604418 - RNA, 19 nt, Homo sapiens
ggggauaccugccuguuuu

SEQ ID NO: 604419 - RNA, 19 nt, Homo sapiens
ugugucaaauccaagcuua

SEQ ID NO: 604420 - RNA, 19 nt, Homo sapiens
uaucauaugugucaaaucc

SEQ ID NO: 604421 - RNA, 19 nt, Homo sapiens
aaaaguaggucacauuuca

SEQ ID NO: 604422 - RNA, 19 nt, Homo sapiens
gaagccaaagagaaauuaa

SEQ ID NO: 604423 - RNA, 19 nt, Homo sapiens
ggguagaggugccgagauc

SEQ ID NO: 604424 - RNA, 19 nt, Homo sapiens
ucauaggaauacugaagaa

SEQ ID NO: 604425 - RNA, 19 nt, Homo sapiens
gaagagguagcuagguguu

SEQ ID NO: 604426 - RNA, 19 nt, Homo sapiens
ggucacauuucaaguaggu

SEQ ID NO: 604427 - RNA, 19 nt, Homo sapiens
uaggaauacugaagaagug

SEQ ID NO: 604428 - RNA, 19 nt, Homo sapiens
aaacuugagugcucuggau

SEQ ID NO: 604429 - RNA, 19 nt, Homo sapiens
uauaggcauucuacccuuu

SEQ ID NO: 604430 - RNA, 19 nt, Homo sapiens
gaaguccuguauuugucuu

SEQ ID NO: 604431 - RNA, 19 nt, Homo sapiens
gggacugccuuuaccaaca

SEQ ID NO: 604432 - RNA, 19 nt, Homo sapiens
cagacaaggagaugaguuu

SEQ ID NO: 604433 - RNA, 19 nt, Homo sapiens
uaaaguuccuccagauacu

SEQ ID NO: 604434 - RNA, 19 nt, Homo sapiens
ucauaugugucaaauccaa

SEQ ID NO: 604435 - RNA, 19 nt, Homo sapiens
ucaaacuggugcaaaugga

SEQ ID NO: 604436 - RNA, 19 nt, Homo sapiens
guaccuaggaguuuuguua

SEQ ID NO: 604437 - RNA, 19 nt, Homo sapiens
gacuuucucuuuuccuuua

SEQ ID NO: 604438 - RNA, 19 nt, Homo sapiens
caugaaguccuguauuugu

SEQ ID NO: 604439 - RNA, 19 nt, Homo sapiens
caccaucucugcagcaucu

SEQ ID NO: 604440 - RNA, 19 nt, Homo sapiens
gcacuguucaccuuuaucu

SEQ ID NO: 604441 - RNA, 19 nt, Homo sapiens
cauucagacuaccuacuaa

SEQ ID NO: 604442 - RNA, 19 nt, Homo sapiens
uuaaugaagccaaagagaa

SEQ ID NO: 604443 - RNA, 19 nt, Homo sapiens
ggugacccuucucucauga

SEQ ID NO: 604444 - RNA, 19 nt, Homo sapiens
gacaagaauaucaugcuau

SEQ ID NO: 604445 - RNA, 19 nt, Homo sapiens
ggaaggaaccaagcugaca

SEQ ID NO: 604446 - RNA, 19 nt, Homo sapiens
guuuaaaguuccuccagau

SEQ ID NO: 604447 - RNA, 19 nt, Homo sapiens
uauggaaugcuuucuaaga

SEQ ID NO: 604448 - RNA, 19 nt, Homo sapiens
cuggauaacuauauggaau

SEQ ID NO: 604449 - RNA, 19 nt, Homo sapiens
gacgcgaacccuucucuga

SEQ ID NO: 604450 - RNA, 19 nt, Homo sapiens
acaguugucucccuucuac

SEQ ID NO: 604451 - RNA, 19 nt, Homo sapiens
uuaacagcuugaagaggua

SEQ ID NO: 604452 - RNA, 19 nt, Homo sapiens
caaauccaagcuuaaacaa

SEQ ID NO: 604453 - RNA, 19 nt, Homo sapiens
ucaaauccaagcuuaaaca

SEQ ID NO: 604454 - RNA, 19 nt, Homo sapiens
ugaagccaaagagaaauua

SEQ ID NO: 604455 - RNA, 19 nt, Homo sapiens
gaagucgcguuuuaucaga

SEQ ID NO: 604456 - RNA, 19 nt, Homo sapiens
gucuaaccauggacauaaa

SEQ ID NO: 604457 - RNA, 19 nt, Homo sapiens
ggcauucuacccuuugaaa

SEQ ID NO: 604458 - RNA, 19 nt, Homo sapiens
cuauacaggugcaacucaa

SEQ ID NO: 604459 - RNA, 19 nt, Homo sapiens
gaccaugaaguccuguauu

SEQ ID NO: 604460 - RNA, 19 nt, Homo sapiens
gcugaagcuaaucuaauuu

SEQ ID NO: 604461 - RNA, 19 nt, Homo sapiens
uagaguaucuccgaaugca

SEQ ID NO: 604462 - RNA, 19 nt, Homo sapiens
gcagacaaggagaugaguu

SEQ ID NO: 604463 - RNA, 19 nt, Homo sapiens
aaauucagauuggacucua

SEQ ID NO: 604464 - RNA, 19 nt, Homo sapiens
gagauagcucgcauucaga

SEQ ID NO: 604465 - RNA, 19 nt, Homo sapiens
uaggucacauuucaaguag

SEQ ID NO: 604466 - RNA, 19 nt, Homo sapiens
gauucgcacugacuucaag

SEQ ID NO: 604467 - RNA, 19 nt, Homo sapiens
aggccucacugcaauuuga

SEQ ID NO: 604468 - RNA, 19 nt, Homo sapiens
ggauaacuauauggaaugc

SEQ ID NO: 604469 - RNA, 19 nt, Homo sapiens
ggggaaguaugacuguuaa

SEQ ID NO: 604470 - RNA, 19 nt, Homo sapiens
gccgagauccuuccgaauc

SEQ ID NO: 604471 - RNA, 19 nt, Homo sapiens
cugaagaagugggaaggaa

SEQ ID NO: 604472 - RNA, 19 nt, Homo sapiens
gcagaauguuccagaauuu

SEQ ID NO: 604473 - RNA, 19 nt, Homo sapiens
gcacaugccuuggauuuga

SEQ ID NO: 604474 - RNA, 19 nt, Homo sapiens
gaacuucacuggaggucaa

SEQ ID NO: 604475 - RNA, 19 nt, Homo sapiens
uagaauaacuugcuacuca

SEQ ID NO: 604476 - RNA, 19 nt, Homo sapiens
ggagagugcuuauuaacug

SEQ ID NO: 604477 - RNA, 19 nt, Homo sapiens
gagaaagcauugauuuauc

SEQ ID NO: 604478 - RNA, 19 nt, Homo sapiens
ggagaaagcauugauuuau

SEQ ID NO: 604479 - RNA, 19 nt, Homo sapiens
aaauacagauggcaagauu

SEQ ID NO: 604480 - RNA, 19 nt, Homo sapiens
gaggagaaagcauugauuu

SEQ ID NO: 604481 - RNA, 19 nt, Homo sapiens
gagaaagacuaugaaauac

SEQ ID NO: 604482 - RNA, 19 nt, Homo sapiens
ggaaaagccuucuuauauc

SEQ ID NO: 604483 - RNA, 19 nt, Homo sapiens
gagcuuucacugcugauua

SEQ ID NO: 604484 - RNA, 19 nt, Homo sapiens
gcccaucaucggaauauua

SEQ ID NO: 604485 - RNA, 19 nt, Homo sapiens
agacauaaauagagugcuu

SEQ ID NO: 604486 - RNA, 19 nt, Homo sapiens
ucaguucaguccaauuuau

SEQ ID NO: 604487 - RNA, 19 nt, Homo sapiens
ccaguggcauccagagaaa

SEQ ID NO: 604488 - RNA, 19 nt, Homo sapiens
gaaaagccuucuuauaucu

SEQ ID NO: 604489 - RNA, 19 nt, Homo sapiens
gaguuuauuucaacaaugg

SEQ ID NO: 604490 - RNA, 19 nt, Homo sapiens
uuacagagaaagacuauga

SEQ ID NO: 604491 - RNA, 19 nt, Homo sapiens
uaguggagagugcuuauua

SEQ ID NO: 604492 - RNA, 19 nt, Homo sapiens
guuaacagagcaaauuuga

SEQ ID NO: 604493 - RNA, 19 nt, Homo sapiens
uuucaacaauggaaggaua

SEQ ID NO: 604494 - RNA, 19 nt, Homo sapiens
gaauuuggauggcauuucc

SEQ ID NO: 604495 - RNA, 19 nt, Homo sapiens
ggcuggaucuuacagagaa

SEQ ID NO: 604496 - RNA, 19 nt, Homo sapiens
uaucaguucaguccaauuu

SEQ ID NO: 604497 - RNA, 19 nt, Homo sapiens
caacaauggaaggauauaa

SEQ ID NO: 604498 - RNA, 19 nt, Homo sapiens
caauggaaggauauaagua

SEQ ID NO: 604499 - RNA, 19 nt, Homo sapiens
cagagaaagcaccuuauga

SEQ ID NO: 604500 - RNA, 19 nt, Homo sapiens
cuuauuaacugccacagau

SEQ ID NO: 604501 - RNA, 19 nt, Homo sapiens
gaccucagacgcucagauu

SEQ ID NO: 604502 - RNA, 19 nt, Homo sapiens
gagaaagcaccuuaugagu

SEQ ID NO: 604503 - RNA, 19 nt, Homo sapiens
ggcaagauugaguuuauuu

SEQ ID NO: 604504 - RNA, 19 nt, Homo sapiens
ugcgagaguuguaccagua

SEQ ID NO: 604505 - RNA, 19 nt, Homo sapiens
ugacugccaauuuccauaa

SEQ ID NO: 604506 - RNA, 19 nt, Homo sapiens
caucaucggaauauuaaug

SEQ ID NO: 604507 - RNA, 19 nt, Homo sapiens
ccuuaugaguggaagaauu

SEQ ID NO: 604508 - RNA, 19 nt, Homo sapiens
acgcucagauuaugcuaaa

SEQ ID NO: 604509 - RNA, 19 nt, Homo sapiens
aaagccuucuuauaucuga

SEQ ID NO: 604510 - RNA, 19 nt, Homo sapiens
gaauaacuugcuacucaug

SEQ ID NO: 604511 - RNA, 19 nt, Homo sapiens
gcaagauugaguuuauuuc

SEQ ID NO: 604512 - RNA, 19 nt, Homo sapiens
ccucagacgcucagauuau

SEQ ID NO: 604513 - RNA, 19 nt, Homo sapiens
uggaaaagccuucuuauau

SEQ ID NO: 604514 - RNA, 19 nt, Homo sapiens
aggagaaagcauugauuua

SEQ ID NO: 604515 - RNA, 19 nt, Homo sapiens
cuuaugaguggaagaauuu

SEQ ID NO: 604516 - RNA, 19 nt, Homo sapiens
ccagagaaagcaccuuaug

SEQ ID NO: 604517 - RNA, 19 nt, Homo sapiens
gaagaggagaaagcauuga

SEQ ID NO: 604518 - RNA, 19 nt, Homo sapiens
gaagaauuuggauggcauu

SEQ ID NO: 604519 - RNA, 19 nt, Homo sapiens
agcagaauguuccagaauu

SEQ ID NO: 604520 - RNA, 19 nt, Homo sapiens
ggaagucacagauucuuuu

SEQ ID NO: 604521 - RNA, 19 nt, Homo sapiens
gauuaggaagucacagauu

SEQ ID NO: 604522 - RNA, 19 nt, Homo sapiens
auacagauggcaagauuga

SEQ ID NO: 604523 - RNA, 19 nt, Homo sapiens
aguggagagugcuuauuaa

SEQ ID NO: 604524 - RNA, 19 nt, Homo sapiens
gcucagauuaugcuaaagu

SEQ ID NO: 604525 - RNA, 19 nt, Homo sapiens
caauugcacagcagaaugu

SEQ ID NO: 604526 - RNA, 19 nt, Homo sapiens
uaacuuguccauacagagu

SEQ ID NO: 604527 - RNA, 19 nt, Homo sapiens
uauaacuuguccauacaga

SEQ ID NO: 604528 - RNA, 19 nt, Homo sapiens
gcuacucauggcaagauua

SEQ ID NO: 604529 - RNA, 19 nt, Homo sapiens
caguucaguccaauuuaua

SEQ ID NO: 604530 - RNA, 19 nt, Homo sapiens
gauggcaagauugaguuua

SEQ ID NO: 604531 - RNA, 19 nt, Homo sapiens
gccucuccgugaagaauuu

SEQ ID NO: 604532 - RNA, 19 nt, Homo sapiens
uaaugugccuggcucugau

SEQ ID NO: 604533 - RNA, 19 nt, Homo sapiens
cguccuauguaaaguacuu

SEQ ID NO: 604534 - RNA, 19 nt, Homo sapiens
gaaccucugacugccaauu

SEQ ID NO: 604535 - RNA, 19 nt, Homo sapiens
cagagaaagacuaugaaau

SEQ ID NO: 604536 - RNA, 19 nt, Homo sapiens
gaauuuuccuacugaguug

SEQ ID NO: 604537 - RNA, 19 nt, Homo sapiens
acagagaaagacuaugaaa

SEQ ID NO: 604538 - RNA, 19 nt, Homo sapiens
ugaagaggagaaagcauug

SEQ ID NO: 604539 - RNA, 19 nt, Homo sapiens
agagaaagcaccuuaugag

SEQ ID NO: 604540 - RNA, 19 nt, Homo sapiens
gcgagaguuguaccaguaa

SEQ ID NO: 604541 - RNA, 19 nt, Homo sapiens
cccaucaucggaauauuaa

SEQ ID NO: 604542 - RNA, 19 nt, Homo sapiens
auuaggaagucacagauuc

SEQ ID NO: 604543 - RNA, 19 nt, Homo sapiens
gaagcccaucaucggaaua

SEQ ID NO: 604544 - RNA, 19 nt, Homo sapiens
auaaguauccaguauaugg

SEQ ID NO: 604545 - RNA, 19 nt, Homo sapiens
uggcaagauugaguuuauu

SEQ ID NO: 604546 - RNA, 19 nt, Homo sapiens
cacaugccuuggauuugaa

SEQ ID NO: 604547 - RNA, 19 nt, Homo sapiens
agaauaacuugcuacucau

SEQ ID NO: 604548 - RNA, 19 nt, Homo sapiens
cugaagaggagaaagcauu

SEQ ID NO: 604549 - RNA, 19 nt, Homo sapiens
acagcagaauguuccagaa

SEQ ID NO: 604550 - RNA, 19 nt, Homo sapiens
cuauauugcugcguccuau

SEQ ID NO: 604551 - RNA, 19 nt, Homo sapiens
gugccuggcucugauucuu

SEQ ID NO: 604552 - RNA, 19 nt, Homo sapiens
gcaagauuaggaagucaca

SEQ ID NO: 604553 - RNA, 19 nt, Homo sapiens
cagcagaauguuccagaau

SEQ ID NO: 604554 - RNA, 19 nt, Homo sapiens
gauuaguggagagugcuua

SEQ ID NO: 604555 - RNA, 19 nt, Homo sapiens
gacauaaauagagugcuuu

SEQ ID NO: 604556 - RNA, 19 nt, Homo sapiens
auggcaagauugaguuuau

SEQ ID NO: 604557 - RNA, 19 nt, Homo sapiens
gccuggcucugauucuuca

SEQ ID NO: 604558 - RNA, 19 nt, Homo sapiens
agugagacauaaauagagu

SEQ ID NO: 604559 - RNA, 19 nt, Homo sapiens
agucacagauucuuuucua

SEQ ID NO: 604560 - RNA, 19 nt, Homo sapiens
gcuggaucuuacagagaaa

SEQ ID NO: 604561 - RNA, 19 nt, Homo sapiens
caaauacagauggcaagau

SEQ ID NO: 604562 - RNA, 19 nt, Homo sapiens
cugaguuguugcugucauu

SEQ ID NO: 604563 - RNA, 19 nt, Homo sapiens
ucaacaauggaaggauaua

SEQ ID NO: 604564 - RNA, 19 nt, Homo sapiens
agaagcccaucaucggaau

SEQ ID NO: 604565 - RNA, 19 nt, Homo sapiens
ucaauugcacagcagaaug

SEQ ID NO: 604566 - RNA, 19 nt, Homo sapiens
aggaaguguugaccucaga

SEQ ID NO: 604567 - RNA, 19 nt, Homo sapiens
cucagacgcucagauuaug

SEQ ID NO: 604568 - RNA, 19 nt, Homo sapiens
caucggaauauuaaugcaa

SEQ ID NO: 604569 - RNA, 19 nt, Homo sapiens
gagccucuccgugaagaau

SEQ ID NO: 604570 - RNA, 19 nt, Homo sapiens
gugcugggccugcuacucu

SEQ ID NO: 604571 - RNA, 19 nt, Homo sapiens
aagauuaggaagucacaga

SEQ ID NO: 604572 - RNA, 19 nt, Homo sapiens
gaauagaccugaagacaaa

SEQ ID NO: 604573 - RNA, 19 nt, Homo sapiens
gaagagagauacaagauga

SEQ ID NO: 604574 - RNA, 19 nt, Homo sapiens
gagcauaccugaagagaga

SEQ ID NO: 604575 - RNA, 19 nt, Homo sapiens
gcuaugaaguccagaaauu

SEQ ID NO: 604576 - RNA, 19 nt, Homo sapiens
gauguguccucauuaauuu

SEQ ID NO: 604577 - RNA, 19 nt, Homo sapiens
gaagaaauccauucaggaa

SEQ ID NO: 604578 - RNA, 19 nt, Homo sapiens
cuaggaaucugccugauaa

SEQ ID NO: 604579 - RNA, 19 nt, Homo sapiens
guaccuguguucccaguua

SEQ ID NO: 604580 - RNA, 19 nt, Homo sapiens
uaaagaacauccacagaau

SEQ ID NO: 604581 - RNA, 19 nt, Homo sapiens
cagaucaacuggauuuauu

SEQ ID NO: 604582 - RNA, 19 nt, Homo sapiens
gauacaagaugaagagcaa

SEQ ID NO: 604583 - RNA, 19 nt, Homo sapiens
gagcuucccuagucuaaga

SEQ ID NO: 604584 - RNA, 19 nt, Homo sapiens
gaagucagcccucagaaau

SEQ ID NO: 604585 - RNA, 19 nt, Homo sapiens
ucagggaccuucuggauau

SEQ ID NO: 604586 - RNA, 19 nt, Homo sapiens
uaaacgcugucccuaguaa

SEQ ID NO: 604587 - RNA, 19 nt, Homo sapiens
ggaaagagguaagcugucu

SEQ ID NO: 604588 - RNA, 19 nt, Homo sapiens
gguaaacgcugucccuagu

SEQ ID NO: 604589 - RNA, 19 nt, Homo sapiens
uggaaaggauucugaaaga

SEQ ID NO: 604590 - RNA, 19 nt, Homo sapiens
ggccagcgaugaagaaugu

SEQ ID NO: 604591 - RNA, 19 nt, Homo sapiens
aagaagcacuugauacaga

SEQ ID NO: 604592 - RNA, 19 nt, Homo sapiens
caagcagucuguucaagga

SEQ ID NO: 604593 - RNA, 19 nt, Homo sapiens
gcccggagcuguacugcaa

SEQ ID NO: 604594 - RNA, 19 nt, Homo sapiens
ccagauucuuggccaauuu

SEQ ID NO: 604595 - RNA, 19 nt, Homo sapiens
ucacuucccugggcuauga

SEQ ID NO: 604596 - RNA, 19 nt, Homo sapiens
aaucugauguguccucauu

SEQ ID NO: 604597 - RNA, 19 nt, Homo sapiens
gaaacugagacaagaaaga

SEQ ID NO: 604598 - RNA, 19 nt, Homo sapiens
cuaaagaacauccacagaa

SEQ ID NO: 604599 - RNA, 19 nt, Homo sapiens
caggaacccucaccuuguu

SEQ ID NO: 604600 - RNA, 19 nt, Homo sapiens
aaaccaagccauagcauga

SEQ ID NO: 604601 - RNA, 19 nt, Homo sapiens
cgacgagucucaacuaaaa

SEQ ID NO: 604602 - RNA, 19 nt, Homo sapiens
gauuggaacagcagaguuu

SEQ ID NO: 604603 - RNA, 19 nt, Homo sapiens
gaaucugccugauaaucga

SEQ ID NO: 604604 - RNA, 19 nt, Homo sapiens
ggagauucaugcccuuauc

SEQ ID NO: 604605 - RNA, 19 nt, Homo sapiens
caugguauaucccagauuc

SEQ ID NO: 604606 - RNA, 19 nt, Homo sapiens
ucugauguguccucauuaa

SEQ ID NO: 604607 - RNA, 19 nt, Homo sapiens
ccaaggagaaauauuaugu

SEQ ID NO: 604608 - RNA, 19 nt, Homo sapiens
aaagaacauccacagaaua

SEQ ID NO: 604609 - RNA, 19 nt, Homo sapiens
uaagcaaggagaagaguuu

SEQ ID NO: 604610 - RNA, 19 nt, Homo sapiens
gugcacaguucaccgagaa

SEQ ID NO: 604611 - RNA, 19 nt, Homo sapiens
gcagggaagccaaagaugu

SEQ ID NO: 604612 - RNA, 19 nt, Homo sapiens
gugccgggauguugcuaua

SEQ ID NO: 604613 - RNA, 19 nt, Homo sapiens
agaaggagaugcugcucuu

SEQ ID NO: 604614 - RNA, 19 nt, Homo sapiens
ugaagaagcacuugauaca

SEQ ID NO: 604615 - RNA, 19 nt, Homo sapiens
agaacuauguggugucaga

SEQ ID NO: 604616 - RNA, 19 nt, Homo sapiens
ggauguugcuauagaugug

SEQ ID NO: 604617 - RNA, 19 nt, Homo sapiens
ggucauagcaugcugugau

SEQ ID NO: 604618 - RNA, 19 nt, Homo sapiens
uuacaggaauguucuccaa

SEQ ID NO: 604619 - RNA, 19 nt, Homo sapiens
gagaaguaaagaacaaaga

SEQ ID NO: 604620 - RNA, 19 nt, Homo sapiens
aaacuuauccucuccuaca

SEQ ID NO: 604621 - RNA, 19 nt, Homo sapiens
cugccaaggagaaauauua

SEQ ID NO: 604622 - RNA, 19 nt, Homo sapiens
gaacauccacagaauagac

SEQ ID NO: 604623 - RNA, 19 nt, Homo sapiens
ugauguguccucauuaauu

SEQ ID NO: 604624 - RNA, 19 nt, Homo sapiens
agucagcccucagaaauga

SEQ ID NO: 604625 - RNA, 19 nt, Homo sapiens
gugauugugccuacgaaua

SEQ ID NO: 604626 - RNA, 19 nt, Homo sapiens
gaacucaauggcuacaugu

SEQ ID NO: 604627 - RNA, 19 nt, Homo sapiens
aaacugagacaagaaagaa

SEQ ID NO: 604628 - RNA, 19 nt, Homo sapiens
ggagaacagcagccucuug

SEQ ID NO: 604629 - RNA, 19 nt, Homo sapiens
ggacucggccucacacagu

SEQ ID NO: 604630 - RNA, 19 nt, Homo sapiens
caacaagaaccagugaaga

SEQ ID NO: 604631 - RNA, 19 nt, Homo sapiens
aacaaagacuuaaggaaca

SEQ ID NO: 604632 - RNA, 19 nt, Homo sapiens
gggacaaguuacaggaaug

SEQ ID NO: 604633 - RNA, 19 nt, Homo sapiens
ggagaaacuaaauuugguu

SEQ ID NO: 604634 - RNA, 19 nt, Homo sapiens
uaggaugucugcugaaguc

SEQ ID NO: 604635 - RNA, 19 nt, Homo sapiens
ugaacucaauggcuacaug

SEQ ID NO: 604636 - RNA, 19 nt, Homo sapiens
gcaaugagacagagcuucu

SEQ ID NO: 604637 - RNA, 19 nt, Homo sapiens
gccgggauguugcuauaga

SEQ ID NO: 604638 - RNA, 19 nt, Homo sapiens
auaccaaccugggcaauau

SEQ ID NO: 604639 - RNA, 19 nt, Homo sapiens
gucauagcaugcugugauu

SEQ ID NO: 604640 - RNA, 19 nt, Homo sapiens
uauccucuccuacacauaa

SEQ ID NO: 604641 - RNA, 19 nt, Homo sapiens
cgaugaagaauguggaauu

SEQ ID NO: 604642 - RNA, 19 nt, Homo sapiens
ccugcuggcuuuccuguug

SEQ ID NO: 604643 - RNA, 19 nt, Homo sapiens
guaaacgcugucccuagua

SEQ ID NO: 604644 - RNA, 19 nt, Homo sapiens
agaaacuuauccucuccua

SEQ ID NO: 604645 - RNA, 19 nt, Homo sapiens
acucugagaaagaaacuua

SEQ ID NO: 604646 - RNA, 19 nt, Homo sapiens
cagaaacugagacaagaaa

SEQ ID NO: 604647 - RNA, 19 nt, Homo sapiens
gaaauucuugcaucucagu

SEQ ID NO: 604648 - RNA, 19 nt, Homo sapiens
caagaaccagugaagaaau

SEQ ID NO: 604649 - RNA, 19 nt, Homo sapiens
gaggcaagauaagcaagga

SEQ ID NO: 604650 - RNA, 19 nt, Homo sapiens
cuugugagcuucccuaguc

SEQ ID NO: 604651 - RNA, 19 nt, Homo sapiens
cagggaagccaaagauguu

SEQ ID NO: 604652 - RNA, 19 nt, Homo sapiens
ggaaucugccugauaaucg

SEQ ID NO: 604653 - RNA, 19 nt, Homo sapiens
guugaagaagcacuugaua

SEQ ID NO: 604654 - RNA, 19 nt, Homo sapiens
gcagcacacucugagaaag

SEQ ID NO: 604655 - RNA, 19 nt, Homo sapiens
ucagaacuaugugguguca

SEQ ID NO: 604656 - RNA, 19 nt, Homo sapiens
ccuaggaaucugccugaua

SEQ ID NO: 604657 - RNA, 19 nt, Homo sapiens
ugaagucagcccucagaaa

SEQ ID NO: 604658 - RNA, 19 nt, Homo sapiens
ugggagaaguaaagaacaa

SEQ ID NO: 604659 - RNA, 19 nt, Homo sapiens
cauaaugggagaaguaaag

SEQ ID NO: 604660 - RNA, 19 nt, Homo sapiens
guacaagcagucuguucaa

SEQ ID NO: 604661 - RNA, 19 nt, Homo sapiens
gaucaacuggauuuauuag

SEQ ID NO: 604662 - RNA, 19 nt, Homo sapiens
cccagaaacugagacaaga

SEQ ID NO: 604663 - RNA, 19 nt, Homo sapiens
gcagugccucucccagaaa

SEQ ID NO: 604664 - RNA, 19 nt, Homo sapiens
aagaaccagugaagaaauc

SEQ ID NO: 604665 - RNA, 19 nt, Homo sapiens
ccacuggaaaggauucuga

SEQ ID NO: 604666 - RNA, 19 nt, Homo sapiens
aacaagaaccagugaagaa

SEQ ID NO: 604667 - RNA, 19 nt, Homo sapiens
gcaagauaagcaaggagaa

SEQ ID NO: 604668 - RNA, 19 nt, Homo sapiens
cugcugaagucauccauca

SEQ ID NO: 604669 - RNA, 19 nt, Homo sapiens
gaauagccacugcauacca

SEQ ID NO: 604670 - RNA, 19 nt, Homo sapiens
cuacacauaagaaaccaaa

SEQ ID NO: 604671 - RNA, 19 nt, Homo sapiens
gaggagguguaggagagaa

SEQ ID NO: 604672 - RNA, 19 nt, Homo sapiens
cagagaaccuggagauaua

SEQ ID NO: 604673 - RNA, 19 nt, Homo sapiens
ggaaagugcucgcccauuc

SEQ ID NO: 604674 - RNA, 19 nt, Homo sapiens
ggaauaugcuuggauaaga

SEQ ID NO: 604675 - RNA, 19 nt, Homo sapiens
caaugaagcugaccucugu

SEQ ID NO: 604676 - RNA, 19 nt, Homo sapiens
gaaggcagguuauuagaag

SEQ ID NO: 604677 - RNA, 19 nt, Homo sapiens
gaugcuguaucccuaauaa

SEQ ID NO: 604678 - RNA, 19 nt, Homo sapiens
caauaaagauucccaaagg

SEQ ID NO: 604679 - RNA, 19 nt, Homo sapiens
gcaaaugcccucagcagaa

SEQ ID NO: 604680 - RNA, 19 nt, Homo sapiens
ggaaagaagucugaucagu

SEQ ID NO: 604681 - RNA, 19 nt, Homo sapiens
aaagaagucugaucaguca

SEQ ID NO: 604682 - RNA, 19 nt, Homo sapiens
acagggcacuggaccauua

SEQ ID NO: 604683 - RNA, 19 nt, Homo sapiens
guuagucaauccugucaua

SEQ ID NO: 604684 - RNA, 19 nt, Homo sapiens
gauuacaucuugugugugu

SEQ ID NO: 604685 - RNA, 19 nt, Homo sapiens
guacgagacuggagugugu

SEQ ID NO: 604686 - RNA, 19 nt, Homo sapiens
gcagagaaccuggagauau

SEQ ID NO: 604687 - RNA, 19 nt, Homo sapiens
agucaauccugucauauaa

SEQ ID NO: 604688 - RNA, 19 nt, Homo sapiens
cgacagcaauauauuaaag

SEQ ID NO: 604689 - RNA, 19 nt, Homo sapiens
cagcaacugugaaaugaga

SEQ ID NO: 604690 - RNA, 19 nt, Homo sapiens
cuaacagggugaccaauga

SEQ ID NO: 604691 - RNA, 19 nt, Homo sapiens
auagaaaucucccacuuau

SEQ ID NO: 604692 - RNA, 19 nt, Homo sapiens
uggaagaugcuguggauua

SEQ ID NO: 604693 - RNA, 19 nt, Homo sapiens
gaauaugcuuggauaagag

SEQ ID NO: 604694 - RNA, 19 nt, Homo sapiens
ggaagaugcuguggauuac

SEQ ID NO: 604695 - RNA, 19 nt, Homo sapiens
uauagaaaucucccacuua

SEQ ID NO: 604696 - RNA, 19 nt, Homo sapiens
gcccauuccugaccuguga

SEQ ID NO: 604697 - RNA, 19 nt, Homo sapiens
aaacaugccaaccuacuuu

SEQ ID NO: 604698 - RNA, 19 nt, Homo sapiens
uuagaagagucccaugaaa

SEQ ID NO: 604699 - RNA, 19 nt, Homo sapiens
cagagaaacugcagagaac

SEQ ID NO: 604700 - RNA, 19 nt, Homo sapiens
uguggaauaugcuuggaua

SEQ ID NO: 604701 - RNA, 19 nt, Homo sapiens
gaacaugugggaugggaau

SEQ ID NO: 604702 - RNA, 19 nt, Homo sapiens
ucaaccagguacauuauca

SEQ ID NO: 604703 - RNA, 19 nt, Homo sapiens
gagugagccuggugagaga

SEQ ID NO: 604704 - RNA, 19 nt, Homo sapiens
caaaugcccucagcagaag

SEQ ID NO: 604705 - RNA, 19 nt, Homo sapiens
aaacaaugccagcuuauag

SEQ ID NO: 604706 - RNA, 19 nt, Homo sapiens
caaccuacuuuccaacucu

SEQ ID NO: 604707 - RNA, 19 nt, Homo sapiens
gaaaagacuguguuacauu

SEQ ID NO: 604708 - RNA, 19 nt, Homo sapiens
acaaaacaaugccagcuua

SEQ ID NO: 604709 - RNA, 19 nt, Homo sapiens
ucagagaaacugcagagaa

SEQ ID NO: 604710 - RNA, 19 nt, Homo sapiens
uggauuacaucuugugugu

SEQ ID NO: 604711 - RNA, 19 nt, Homo sapiens
gcacaccucuguucauacc

SEQ ID NO: 604712 - RNA, 19 nt, Homo sapiens
uuucugagcucaagauucu

SEQ ID NO: 604713 - RNA, 19 nt, Homo sapiens
gagaugcuguaucccuaau

SEQ ID NO: 604714 - RNA, 19 nt, Homo sapiens
cagaugcaccucagcguaa

SEQ ID NO: 604715 - RNA, 19 nt, Homo sapiens
gcacuggaccauuagauac

SEQ ID NO: 604716 - RNA, 19 nt, Homo sapiens
aauaaagauucccaaagga

SEQ ID NO: 604717 - RNA, 19 nt, Homo sapiens
gacaauaaagauucccaaa

SEQ ID NO: 604718 - RNA, 19 nt, Homo sapiens
uacagcagcuuucaacaag

SEQ ID NO: 604719 - RNA, 19 nt, Homo sapiens
gaaggaaggccuggagaag

SEQ ID NO: 604720 - RNA, 19 nt, Homo sapiens
ggcacuggaccauuagaua

SEQ ID NO: 604721 - RNA, 19 nt, Homo sapiens
uuauagaaaucucccacuu

SEQ ID NO: 604722 - RNA, 19 nt, Homo sapiens
aaugccagcuuauagaaau

SEQ ID NO: 604723 - RNA, 19 nt, Homo sapiens
gagcuaaagguggaaagaa

SEQ ID NO: 604724 - RNA, 19 nt, Homo sapiens
agacuggagugugugcaua

SEQ ID NO: 604725 - RNA, 19 nt, Homo sapiens
gagcucaagauucuguaaa

SEQ ID NO: 604726 - RNA, 19 nt, Homo sapiens
cgaaggcagguuauuagaa

SEQ ID NO: 604727 - RNA, 19 nt, Homo sapiens
augcacaccucuguucaua

SEQ ID NO: 604728 - RNA, 19 nt, Homo sapiens
uagucaauccugucauaua

SEQ ID NO: 604729 - RNA, 19 nt, Homo sapiens
ucaacaagcuacaaaacaa

SEQ ID NO: 604730 - RNA, 19 nt, Homo sapiens
aggaaggccuggagaagug

SEQ ID NO: 604731 - RNA, 19 nt, Homo sapiens
aauggaagaugcuguggau

SEQ ID NO: 604732 - RNA, 19 nt, Homo sapiens
cuacagcagcuuucaacaa

SEQ ID NO: 604733 - RNA, 19 nt, Homo sapiens
gagaaaagacuguguuaca

SEQ ID NO: 604734 - RNA, 19 nt, Homo sapiens
gcaacugugaaaugagaaa

SEQ ID NO: 604735 - RNA, 19 nt, Homo sapiens
ucauaauggccaaguguuu

SEQ ID NO: 604736 - RNA, 19 nt, Homo sapiens
ccacacaaagggcuguauu

SEQ ID NO: 604737 - RNA, 19 nt, Homo sapiens
gggaugggaauaucuaaca

SEQ ID NO: 604738 - RNA, 19 nt, Homo sapiens
guggaaagaagucugauca

SEQ ID NO: 604739 - RNA, 19 nt, Homo sapiens
gcuguauugugacuacuca

SEQ ID NO: 604740 - RNA, 19 nt, Homo sapiens
uaaaaucugugccaagcaa

SEQ ID NO: 604741 - RNA, 19 nt, Homo sapiens
gcgaaggcagguuauuaga

SEQ ID NO: 604742 - RNA, 19 nt, Homo sapiens
ggaaaucugcaaugaagcu

SEQ ID NO: 604743 - RNA, 19 nt, Homo sapiens
ggggaaaucugcaaugaag

SEQ ID NO: 604744 - RNA, 19 nt, Homo sapiens
gagaaccuggagauauauu

SEQ ID NO: 604745 - RNA, 19 nt, Homo sapiens
gaaccuggagauauauuuu

SEQ ID NO: 604746 - RNA, 19 nt, Homo sapiens
gauacaacaccugaaggaa

SEQ ID NO: 604747 - RNA, 19 nt, Homo sapiens
uaacagggugaccaaugaa

SEQ ID NO: 604748 - RNA, 19 nt, Homo sapiens
uagaagagucccaugaaag

SEQ ID NO: 604749 - RNA, 19 nt, Homo sapiens
gucaaacuguagccuggaa

SEQ ID NO: 604750 - RNA, 19 nt, Homo sapiens
guucaaccagguacauuau

SEQ ID NO: 604751 - RNA, 19 nt, Homo sapiens
ugaaggaaggccuggagaa

SEQ ID NO: 604752 - RNA, 19 nt, Homo sapiens
gcgacagcaauauauuaaa

SEQ ID NO: 604753 - RNA, 19 nt, Homo sapiens
aaaagacuguguuacauuc

SEQ ID NO: 604754 - RNA, 19 nt, Homo sapiens
caaugccagcuuauagaaa

SEQ ID NO: 604755 - RNA, 19 nt, Homo sapiens
gaagucugaucagucaaac

SEQ ID NO: 604756 - RNA, 19 nt, Homo sapiens
acaccucuguucauaccaa

SEQ ID NO: 604757 - RNA, 19 nt, Homo sapiens
caccucagcguaaacaguu

SEQ ID NO: 604758 - RNA, 19 nt, Homo sapiens
ggaugggaauaucuaacag

SEQ ID NO: 604759 - RNA, 19 nt, Homo sapiens
acaaugccagcuuauagaa

SEQ ID NO: 604760 - RNA, 19 nt, Homo sapiens
ggagcuaaagguggaaaga

SEQ ID NO: 604761 - RNA, 19 nt, Homo sapiens
gcaccucagcguaaacagu

SEQ ID NO: 604762 - RNA, 19 nt, Homo sapiens
aagaugcuguggauuacau

SEQ ID NO: 604763 - RNA, 19 nt, Homo sapiens
acuguagccuggaaccauu

SEQ ID NO: 604764 - RNA, 19 nt, Homo sapiens
agaagucugaucagucaaa

SEQ ID NO: 604765 - RNA, 19 nt, Homo sapiens
aaccagguacauuaucaua

SEQ ID NO: 604766 - RNA, 19 nt, Homo sapiens
gcuaaagguggaaagaagu

SEQ ID NO: 604767 - RNA, 19 nt, Homo sapiens
cauaauggccaaguguuuc

SEQ ID NO: 604768 - RNA, 19 nt, Homo sapiens
caguagacaggccuaggua

SEQ ID NO: 604769 - RNA, 19 nt, Homo sapiens
agaguuacaaacccacuuu

SEQ ID NO: 604770 - RNA, 19 nt, Homo sapiens
gcuguugggugcgaguuca

SEQ ID NO: 604771 - RNA, 19 nt, Homo sapiens
uauuagaagagucccauga

SEQ ID NO: 604772 - RNA, 19 nt, Homo sapiens
cagagaaccuggagauaua

SEQ ID NO: 604773 - RNA, 19 nt, Homo sapiens
ggaauaugcuuggauaaga

SEQ ID NO: 604774 - RNA, 19 nt, Homo sapiens
caaugaagcugaccucugu

SEQ ID NO: 604775 - RNA, 19 nt, Homo sapiens
gaugcuguaucccuaauaa

SEQ ID NO: 604776 - RNA, 19 nt, Homo sapiens
caauaaagauucccaaagg

SEQ ID NO: 604777 - RNA, 19 nt, Homo sapiens
gcaaaugcccucagcagaa

SEQ ID NO: 604778 - RNA, 19 nt, Homo sapiens
ggaaagaagucugaucagu

SEQ ID NO: 604779 - RNA, 19 nt, Homo sapiens
aaagaagucugaucaguca

SEQ ID NO: 604780 - RNA, 19 nt, Homo sapiens
guuagucaauccugucaua

SEQ ID NO: 604781 - RNA, 19 nt, Homo sapiens
gauuacaucuugugugugu

SEQ ID NO: 604782 - RNA, 19 nt, Homo sapiens
guacgagacuggagugugu

SEQ ID NO: 604783 - RNA, 19 nt, Homo sapiens
gcagagaaccuggagauau

SEQ ID NO: 604784 - RNA, 19 nt, Homo sapiens
agucaauccugucauauaa

SEQ ID NO: 604785 - RNA, 19 nt, Homo sapiens
cgacagcaauauauuaaag

SEQ ID NO: 604786 - RNA, 19 nt, Homo sapiens
cagcaacugugaaaugaga

SEQ ID NO: 604787 - RNA, 19 nt, Homo sapiens
cuaacagggugaccaauga

SEQ ID NO: 604788 - RNA, 19 nt, Homo sapiens
auagaaaucucccacuuau

SEQ ID NO: 604789 - RNA, 19 nt, Homo sapiens
uggaagaugcuguggauua

SEQ ID NO: 604790 - RNA, 19 nt, Homo sapiens
gaauaugcuuggauaagag

SEQ ID NO: 604791 - RNA, 19 nt, Homo sapiens
ggaagaugcuguggauuac

SEQ ID NO: 604792 - RNA, 19 nt, Homo sapiens
uauagaaaucucccacuua

SEQ ID NO: 604793 - RNA, 19 nt, Homo sapiens
aaacaugccaaccuacuuu

SEQ ID NO: 604794 - RNA, 19 nt, Homo sapiens
cagagaaacugcagagaac

SEQ ID NO: 604795 - RNA, 19 nt, Homo sapiens
uguggaauaugcuuggaua

SEQ ID NO: 604796 - RNA, 19 nt, Homo sapiens
gaacaugugggaugggaau

SEQ ID NO: 604797 - RNA, 19 nt, Homo sapiens
ucaaccagguacauuauca

SEQ ID NO: 604798 - RNA, 19 nt, Homo sapiens
gagugagccuggugagaga

SEQ ID NO: 604799 - RNA, 19 nt, Homo sapiens
caaaugcccucagcagaag

SEQ ID NO: 604800 - RNA, 19 nt, Homo sapiens
aaacaaugccagcuuauag

SEQ ID NO: 604801 - RNA, 19 nt, Homo sapiens
caaccuacuuuccaacucu

SEQ ID NO: 604802 - RNA, 19 nt, Homo sapiens
gaaaagacuguguuacauu

SEQ ID NO: 604803 - RNA, 19 nt, Homo sapiens
acaaaacaaugccagcuua

SEQ ID NO: 604804 - RNA, 19 nt, Homo sapiens
ucagagaaacugcagagaa

SEQ ID NO: 604805 - RNA, 19 nt, Homo sapiens
uggauuacaucuugugugu

SEQ ID NO: 604806 - RNA, 19 nt, Homo sapiens
gcacaccucuguucauacc

SEQ ID NO: 604807 - RNA, 19 nt, Homo sapiens
uuucugagcucaagauucu

SEQ ID NO: 604808 - RNA, 19 nt, Homo sapiens
gagaugcuguaucccuaau

SEQ ID NO: 604809 - RNA, 19 nt, Homo sapiens
aauaaagauucccaaagga

SEQ ID NO: 604810 - RNA, 19 nt, Homo sapiens
gacaauaaagauucccaaa

SEQ ID NO: 604811 - RNA, 19 nt, Homo sapiens
uacagcagcuuucaacaag

SEQ ID NO: 604812 - RNA, 19 nt, Homo sapiens
uuauagaaaucucccacuu

SEQ ID NO: 604813 - RNA, 19 nt, Homo sapiens
aaugccagcuuauagaaau

SEQ ID NO: 604814 - RNA, 19 nt, Homo sapiens
gagcuaaagguggaaagaa

SEQ ID NO: 604815 - RNA, 19 nt, Homo sapiens
gagcucaagauucuguaaa

SEQ ID NO: 604816 - RNA, 19 nt, Homo sapiens
augcacaccucuguucaua

SEQ ID NO: 604817 - RNA, 19 nt, Homo sapiens
uagucaauccugucauaua

SEQ ID NO: 604818 - RNA, 19 nt, Homo sapiens
ucaacaagcuacaaaacaa

SEQ ID NO: 604819 - RNA, 19 nt, Homo sapiens
aauggaagaugcuguggau

SEQ ID NO: 604820 - RNA, 19 nt, Homo sapiens
cuacagcagcuuucaacaa

SEQ ID NO: 604821 - RNA, 19 nt, Homo sapiens
gagaaaagacuguguuaca

SEQ ID NO: 604822 - RNA, 19 nt, Homo sapiens
gcaacugugaaaugagaaa

SEQ ID NO: 604823 - RNA, 19 nt, Homo sapiens
ucauaauggccaaguguuu

SEQ ID NO: 604824 - RNA, 19 nt, Homo sapiens
ccacacaaagggcuguauu

SEQ ID NO: 604825 - RNA, 19 nt, Homo sapiens
uaaaaucugugccaagcaa

SEQ ID NO: 604826 - RNA, 19 nt, Homo sapiens
gggaugggaauaucuaaca

SEQ ID NO: 604827 - RNA, 19 nt, Homo sapiens
guggaaagaagucugauca

SEQ ID NO: 604828 - RNA, 19 nt, Homo sapiens
gcuguauugugacuacuca

SEQ ID NO: 604829 - RNA, 19 nt, Homo sapiens
ggggaaaucugcaaugaag

SEQ ID NO: 604830 - RNA, 19 nt, Homo sapiens
ggaaaucugcaaugaagcu

SEQ ID NO: 604831 - RNA, 19 nt, Homo sapiens
gagaaccuggagauauauu

SEQ ID NO: 604832 - RNA, 19 nt, Homo sapiens
gaaccuggagauauauuuu

SEQ ID NO: 604833 - RNA, 19 nt, Homo sapiens
gagugugcuuggagucaga

SEQ ID NO: 604834 - RNA, 19 nt, Homo sapiens
uaacagggugaccaaugaa

SEQ ID NO: 604835 - RNA, 19 nt, Homo sapiens
gucaaacuguagccuggaa

SEQ ID NO: 604836 - RNA, 19 nt, Homo sapiens
guucaaccagguacauuau

SEQ ID NO: 604837 - RNA, 19 nt, Homo sapiens
gcgacagcaauauauuaaa

SEQ ID NO: 604838 - RNA, 19 nt, Homo sapiens
aaaagacuguguuacauuc

SEQ ID NO: 604839 - RNA, 19 nt, Homo sapiens
ugguguggcuggucguaaa

SEQ ID NO: 604840 - RNA, 19 nt, Homo sapiens
caaugccagcuuauagaaa

SEQ ID NO: 604841 - RNA, 19 nt, Homo sapiens
gaagucugaucagucaaac

SEQ ID NO: 604842 - RNA, 19 nt, Homo sapiens
acaccucuguucauaccaa

SEQ ID NO: 604843 - RNA, 19 nt, Homo sapiens
ggaugggaauaucuaacag

SEQ ID NO: 604844 - RNA, 19 nt, Homo sapiens
acaaugccagcuuauagaa

SEQ ID NO: 604845 - RNA, 19 nt, Homo sapiens
ggagcuaaagguggaaaga

SEQ ID NO: 604846 - RNA, 19 nt, Homo sapiens
aagaugcuguggauuacau

SEQ ID NO: 604847 - RNA, 19 nt, Homo sapiens
acuguagccuggaaccauu

SEQ ID NO: 604848 - RNA, 19 nt, Homo sapiens
agaagucugaucagucaaa

SEQ ID NO: 604849 - RNA, 19 nt, Homo sapiens
aaccagguacauuaucaua

SEQ ID NO: 604850 - RNA, 19 nt, Homo sapiens
caguagacaggccuaggua

SEQ ID NO: 604851 - RNA, 19 nt, Homo sapiens
gcuaaagguggaaagaagu

SEQ ID NO: 604852 - RNA, 19 nt, Homo sapiens
cauaauggccaaguguuuc

SEQ ID NO: 604853 - RNA, 19 nt, Homo sapiens
agaguuacaaacccacuuu

SEQ ID NO: 604854 - RNA, 19 nt, Homo sapiens
ugcgacagcaauauauuaa

SEQ ID NO: 604855 - RNA, 19 nt, Homo sapiens
caugugggaugggaauauc

SEQ ID NO: 604856 - RNA, 19 nt, Homo sapiens
ucacuggcccugcaaaugc

SEQ ID NO: 604857 - RNA, 19 nt, Homo sapiens
acaauaaagauucccaaag

SEQ ID NO: 604858 - RNA, 19 nt, Homo sapiens
uaucauaauggccaagugu

SEQ ID NO: 604859 - RNA, 19 nt, Homo sapiens
gaagaugcuguggauuaca

SEQ ID NO: 604860 - RNA, 19 nt, Homo sapiens
uagccuggaaccauuacua

SEQ ID NO: 604861 - RNA, 19 nt, Homo sapiens
ggaugcacaccucuguuca

SEQ ID NO: 604862 - RNA, 19 nt, Homo sapiens
ugcuguggauuacaucuug

SEQ ID NO: 604863 - RNA, 19 nt, Homo sapiens
ccaacucuccaaagcugaa

SEQ ID NO: 604864 - RNA, 19 nt, Homo sapiens
cacacaaagggcuguauug

SEQ ID NO: 604865 - RNA, 19 nt, Homo sapiens
gcuguaucccuaauaaguc

SEQ ID NO: 604866 - RNA, 19 nt, Homo sapiens
ccaaccuacuuuccaacuc

SEQ ID NO: 604867 - RNA, 19 nt, Homo sapiens
ucuaacagggugaccaaug

SEQ ID NO: 604868 - RNA, 19 nt, Homo sapiens
uagaaaucucccacuuauu

SEQ ID NO: 604869 - RNA, 19 nt, Homo sapiens
agaaccuggagauauauuu

SEQ ID NO: 604870 - RNA, 19 nt, Homo sapiens
agagauggcuguggaugcu

SEQ ID NO: 604871 - RNA, 19 nt, Homo sapiens
ggagugugugcauguaagu

SEQ ID NO: 604872 - RNA, 19 nt, Homo sapiens
gacaagcagucccuuaaua

SEQ ID NO: 604873 - RNA, 19 nt, Homo sapiens
acacacagccuauaucaaa

SEQ ID NO: 604874 - RNA, 19 nt, Homo sapiens
augcagaacaccaauauua

SEQ ID NO: 604875 - RNA, 19 nt, Homo sapiens
caagcagucccuuaauauu

SEQ ID NO: 604876 - RNA, 19 nt, Homo sapiens
ccucacagcugccggaaca

SEQ ID NO: 604877 - RNA, 19 nt, Homo sapiens
gagaaggcacacagagauu

SEQ ID NO: 604878 - RNA, 19 nt, Homo sapiens
gcagaacaccaauauuaac

SEQ ID NO: 604879 - RNA, 19 nt, Homo sapiens
gggcuggacuggccauuuu

SEQ ID NO: 604880 - RNA, 19 nt, Homo sapiens
aagcagucccuuaauauug

SEQ ID NO: 604881 - RNA, 19 nt, Homo sapiens
agcagucccuuaauauuga

SEQ ID NO: 604882 - RNA, 19 nt, Homo sapiens
acaagcagucccuuaauau

SEQ ID NO: 604883 - RNA, 19 nt, Homo sapiens
gcaggcaacacuuuagcuu

SEQ ID NO: 604884 - RNA, 19 nt, Homo sapiens
ucacagcugccggaacaua

SEQ ID NO: 604885 - RNA, 19 nt, Homo sapiens
cuacacacacagccuauau

SEQ ID NO: 604886 - RNA, 19 nt, Homo sapiens
gccggaacauaaagacuca

SEQ ID NO: 604887 - RNA, 19 nt, Homo sapiens
cagaacaccaauauuaaca

SEQ ID NO: 604888 - RNA, 19 nt, Homo sapiens
ugcagaacaccaauauuaa

SEQ ID NO: 604889 - RNA, 19 nt, Homo sapiens
acacacacagccuauauca

SEQ ID NO: 604890 - RNA, 19 nt, Homo sapiens
ccaugcagaacaccaauau

SEQ ID NO: 604891 - RNA, 19 nt, Homo sapiens
uuucuggccuugucucuuc

SEQ ID NO: 604892 - RNA, 19 nt, Homo sapiens
gaaggcacacagagauucu

SEQ ID NO: 604893 - RNA, 19 nt, Homo sapiens
cgagcuuucucuccgacuu

SEQ ID NO: 604894 - RNA, 19 nt, Homo sapiens
cacagcugccggaacauaa

SEQ ID NO: 604895 - RNA, 19 nt, Homo sapiens
agagaaggcacacagagau

SEQ ID NO: 604896 - RNA, 19 nt, Homo sapiens
auacaagccuaugcgugaa

SEQ ID NO: 604897 - RNA, 19 nt, Homo sapiens
uggaucuccugcugccuuu

SEQ ID NO: 604898 - RNA, 19 nt, Homo sapiens
aagagaaggcacacagaga

SEQ ID NO: 604899 - RNA, 19 nt, Homo sapiens
gcaagagaugggacaagca

SEQ ID NO: 604900 - RNA, 19 nt, Homo sapiens
ugaagagaaggcacacaga

SEQ ID NO: 604901 - RNA, 19 nt, Homo sapiens
gcacacgggcgagcuuucu

SEQ ID NO: 604902 - RNA, 19 nt, Homo sapiens
acaaaacagugccuucuag

SEQ ID NO: 604903 - RNA, 19 nt, Homo sapiens
gcagucccuuaauauugag

SEQ ID NO: 604904 - RNA, 19 nt, Homo sapiens
gaacacuccucuacucuua

SEQ ID NO: 604905 - RNA, 19 nt, Homo sapiens
gcacaaaucuugggucuug

SEQ ID NO: 604906 - RNA, 19 nt, Homo sapiens
guaggaagauggagguuua

SEQ ID NO: 604907 - RNA, 19 nt, Homo sapiens
gaaauuggacugucuuuau

SEQ ID NO: 604908 - RNA, 19 nt, Homo sapiens
gauggaauuuggaacaaua

SEQ ID NO: 604909 - RNA, 19 nt, Homo sapiens
ggaaaguuguauccauuaa

SEQ ID NO: 604910 - RNA, 19 nt, Homo sapiens
caagugaguugaauaguug

SEQ ID NO: 604911 - RNA, 19 nt, Homo sapiens
ggacauccauacacucauu

SEQ ID NO: 604912 - RNA, 19 nt, Homo sapiens
acucggaucuccaauguua

SEQ ID NO: 604913 - RNA, 19 nt, Homo sapiens
ggaaucagguagacuuuua

SEQ ID NO: 604914 - RNA, 19 nt, Homo sapiens
guuuaaagcugaagagguu

SEQ ID NO: 604915 - RNA, 19 nt, Homo sapiens
ccaagugaguugaauaguu

SEQ ID NO: 604916 - RNA, 19 nt, Homo sapiens
gccaagagguacuguaaug

SEQ ID NO: 604917 - RNA, 19 nt, Homo sapiens
cugaagagguugaagcuaa

SEQ ID NO: 604918 - RNA, 19 nt, Homo sapiens
gaaaugaccaagacagguu

SEQ ID NO: 604919 - RNA, 19 nt, Homo sapiens
ucucagaaauugccaacua

SEQ ID NO: 604920 - RNA, 19 nt, Homo sapiens
gagguuaaguuucucuuca

SEQ ID NO: 604921 - RNA, 19 nt, Homo sapiens
gagaaguucccauuauuau

SEQ ID NO: 604922 - RNA, 19 nt, Homo sapiens
ugagaaguucccauuauua

SEQ ID NO: 604923 - RNA, 19 nt, Homo sapiens
guugagaaguucccauuau

SEQ ID NO: 604924 - RNA, 19 nt, Homo sapiens
uguauuagcucacugaauc

SEQ ID NO: 604925 - RNA, 19 nt, Homo sapiens
aaacuauccugauuccaaa

SEQ ID NO: 604926 - RNA, 19 nt, Homo sapiens
gaaucccaaugacaucuuu

SEQ ID NO: 604927 - RNA, 19 nt, Homo sapiens
ucaaggucaucaaacauuu

SEQ ID NO: 604928 - RNA, 19 nt, Homo sapiens
ugaguugaauaguugcuua

SEQ ID NO: 604929 - RNA, 19 nt, Homo sapiens
caucuuugcugacuuggaa

SEQ ID NO: 604930 - RNA, 19 nt, Homo sapiens
ugacaucuuugcugacuug

SEQ ID NO: 604931 - RNA, 19 nt, Homo sapiens
agaagugucuggcugugua

SEQ ID NO: 604932 - RNA, 19 nt, Homo sapiens
ggauucagaucgaaauugg

SEQ ID NO: 604933 - RNA, 19 nt, Homo sapiens
ugaagagguugaagcuaaa

SEQ ID NO: 604934 - RNA, 19 nt, Homo sapiens
ccacucggaucuccaaugu

SEQ ID NO: 604935 - RNA, 19 nt, Homo sapiens
ugcaauaaauggcuugauu

SEQ ID NO: 604936 - RNA, 19 nt, Homo sapiens
uuccaaaugugucagaaua

SEQ ID NO: 604937 - RNA, 19 nt, Homo sapiens
gagguacuguaauggguaa

SEQ ID NO: 604938 - RNA, 19 nt, Homo sapiens
caagaaauggaaucaggua

SEQ ID NO: 604939 - RNA, 19 nt, Homo sapiens
gaucgaaauuggacugucu

SEQ ID NO: 604940 - RNA, 19 nt, Homo sapiens
gaauagauggaauuuggaa

SEQ ID NO: 604941 - RNA, 19 nt, Homo sapiens
gauccagccuuuccaaguc

SEQ ID NO: 604942 - RNA, 19 nt, Homo sapiens
caacuaggcaggcacaaau

SEQ ID NO: 604943 - RNA, 19 nt, Homo sapiens
caaccagagucacccaguu

SEQ ID NO: 604944 - RNA, 19 nt, Homo sapiens
gaaauggaaucagguagac

SEQ ID NO: 604945 - RNA, 19 nt, Homo sapiens
gugaagcagucagcccuua

SEQ ID NO: 604946 - RNA, 19 nt, Homo sapiens
guucaggacacaucuauug

SEQ ID NO: 604947 - RNA, 19 nt, Homo sapiens
gaagugggugcccuuggua

SEQ ID NO: 604948 - RNA, 19 nt, Homo sapiens
ccacugaaaugaccaagac

SEQ ID NO: 604949 - RNA, 19 nt, Homo sapiens
cgccagguccuauggauua

SEQ ID NO: 604950 - RNA, 19 nt, Homo sapiens
gaguuugcauggacaauag

SEQ ID NO: 604951 - RNA, 19 nt, Homo sapiens
ggaguuugcauggacaaua

SEQ ID NO: 604952 - RNA, 19 nt, Homo sapiens
cagcaucuacucuaaagaa

SEQ ID NO: 604953 - RNA, 19 nt, Homo sapiens
gccaggcucuuccuugaau

SEQ ID NO: 604954 - RNA, 19 nt, Homo sapiens
ucucagugcuuugcaugua

SEQ ID NO: 604955 - RNA, 19 nt, Homo sapiens
gaugugcgcucagcagcuu

SEQ ID NO: 604956 - RNA, 19 nt, Homo sapiens
guacuguaauggguaauuc

SEQ ID NO: 604957 - RNA, 19 nt, Homo sapiens
ggaauuuggaacaauagaa

SEQ ID NO: 604958 - RNA, 19 nt, Homo sapiens
aaccugagcuguaggaauc

SEQ ID NO: 604959 - RNA, 19 nt, Homo sapiens
gaaggguacagauuagguu

SEQ ID NO: 604960 - RNA, 19 nt, Homo sapiens
uugagaaguucccauuauu

SEQ ID NO: 604961 - RNA, 19 nt, Homo sapiens
gccuaaaucccaagaaaug

SEQ ID NO: 604962 - RNA, 19 nt, Homo sapiens
auuaaugccugcuucugua

SEQ ID NO: 604963 - RNA, 19 nt, Homo sapiens
gcuccuaucaacccaagua

SEQ ID NO: 604964 - RNA, 19 nt, Homo sapiens
gccaagaggccacgcaaga

SEQ ID NO: 604965 - RNA, 19 nt, Homo sapiens
cgaaauuggacugucuuua

SEQ ID NO: 604966 - RNA, 19 nt, Homo sapiens
ucacgacaauguugagaag

SEQ ID NO: 604967 - RNA, 19 nt, Homo sapiens
cagccuaacugcaaguaca

SEQ ID NO: 604968 - RNA, 19 nt, Homo sapiens
gccaauaacuuuucaccaa

SEQ ID NO: 604969 - RNA, 19 nt, Homo sapiens
cgacaauguugagaaguuc

SEQ ID NO: 604970 - RNA, 19 nt, Homo sapiens
ugagaguggugcccuggaa

SEQ ID NO: 604971 - RNA, 19 nt, Homo sapiens
ccauuaaccugggcauugu

SEQ ID NO: 604972 - RNA, 19 nt, Homo sapiens
caccaaugagccuuaguua

SEQ ID NO: 604973 - RNA, 19 nt, Homo sapiens
augaauagauggaauuugg

SEQ ID NO: 604974 - RNA, 19 nt, Homo sapiens
gaagcagucagcccuuaug

SEQ ID NO: 604975 - RNA, 19 nt, Homo sapiens
guaggaaucccaaugacau

SEQ ID NO: 604976 - RNA, 19 nt, Homo sapiens
gcuguaggaaucccaauga

SEQ ID NO: 604977 - RNA, 19 nt, Homo sapiens
gauuaaugccugcuucugu

SEQ ID NO: 604978 - RNA, 19 nt, Homo sapiens
ggaacacuccucuacucuu

SEQ ID NO: 604979 - RNA, 19 nt, Homo sapiens
caauugacucucacacuga

SEQ ID NO: 604980 - RNA, 19 nt, Homo sapiens
ggaauccuacccugacuuc

SEQ ID NO: 604981 - RNA, 19 nt, Homo sapiens
cgacguguccuuccagugu

SEQ ID NO: 604982 - RNA, 19 nt, Homo sapiens
caaguacuguggaguuugc

SEQ ID NO: 604983 - RNA, 19 nt, Homo sapiens
ugugagugcuguaagaugu

SEQ ID NO: 604984 - RNA, 19 nt, Homo sapiens
gcagggcuuugggcaguug

SEQ ID NO: 604985 - RNA, 19 nt, Homo sapiens
ucagaugaauagauggaau

SEQ ID NO: 604986 - RNA, 19 nt, Homo sapiens
cauucagcaucuacucuaa

SEQ ID NO: 604987 - RNA, 19 nt, Homo sapiens
guuggugacugggaaaguu

SEQ ID NO: 604988 - RNA, 19 nt, Homo sapiens
acgacaauguugagaaguu

SEQ ID NO: 604989 - RNA, 19 nt, Homo sapiens
gcauguauuagcucacuga

SEQ ID NO: 604990 - RNA, 19 nt, Homo sapiens
ucagugcuuugcauguauu

SEQ ID NO: 604991 - RNA, 19 nt, Homo sapiens
ggguacagauuagguuugu

SEQ ID NO: 604992 - RNA, 19 nt, Homo sapiens
aaauauguaugcaccucaa

SEQ ID NO: 604993 - RNA, 19 nt, Homo sapiens
caccaaaacuauccugauu

SEQ ID NO: 604994 - RNA, 19 nt, Homo sapiens
caagccugauccagccuuu

SEQ ID NO: 604995 - RNA, 19 nt, Homo sapiens
gcucaggcccaugcuauga

SEQ ID NO: 604996 - RNA, 19 nt, Homo sapiens
cagguccuauggauuaaug

SEQ ID NO: 604997 - RNA, 19 nt, Homo sapiens
ccaaaugugucagaauagg

SEQ ID NO: 604998 - RNA, 19 nt, Homo sapiens
cacggaggcugccaucugu

SEQ ID NO: 604999 - RNA, 19 nt, Homo sapiens
ggaaaguuaggauucagau

SEQ ID NO: 605000 - RNA, 19 nt, Homo sapiens
uggccaggcucuuccuuga

SEQ ID NO: 605001 - RNA, 19 nt, Homo sapiens
gccaguccuuccagccuaa

SEQ ID NO: 605002 - RNA, 19 nt, Homo sapiens
cuacgaccauggacuuuac

SEQ ID NO: 605003 - RNA, 19 nt, Homo sapiens
gaacugcauagccuacaca

SEQ ID NO: 605004 - RNA, 19 nt, Homo sapiens
gcacaaaucuugggucuug

SEQ ID NO: 605005 - RNA, 19 nt, Homo sapiens
ggacauccauacacucauu

SEQ ID NO: 605006 - RNA, 19 nt, Homo sapiens
acucggaucuccaauguua

SEQ ID NO: 605007 - RNA, 19 nt, Homo sapiens
ucucagaaauugccaacua

SEQ ID NO: 605008 - RNA, 19 nt, Homo sapiens
gaaucccaaugacaucuuu

SEQ ID NO: 605009 - RNA, 19 nt, Homo sapiens
caucuuugcugacuuggaa

SEQ ID NO: 605010 - RNA, 19 nt, Homo sapiens
ugacaucuuugcugacuug

SEQ ID NO: 605011 - RNA, 19 nt, Homo sapiens
agaagugucuggcugugua

SEQ ID NO: 605012 - RNA, 19 nt, Homo sapiens
ccacucggaucuccaaugu

SEQ ID NO: 605013 - RNA, 19 nt, Homo sapiens
caacuaggcaggcacaaau

SEQ ID NO: 605014 - RNA, 19 nt, Homo sapiens
gugaagcagucagcccuua

SEQ ID NO: 605015 - RNA, 19 nt, Homo sapiens
cgccagguccuauggauua

SEQ ID NO: 605016 - RNA, 19 nt, Homo sapiens
gaguuugcauggacaauag

SEQ ID NO: 605017 - RNA, 19 nt, Homo sapiens
ggaguuugcauggacaaua

SEQ ID NO: 605018 - RNA, 19 nt, Homo sapiens
aaccugagcuguaggaauc

SEQ ID NO: 605019 - RNA, 19 nt, Homo sapiens
gaugugcgcucagcagcuu

SEQ ID NO: 605020 - RNA, 19 nt, Homo sapiens
auuaaugccugcuucugua

SEQ ID NO: 605021 - RNA, 19 nt, Homo sapiens
gcuccuaucaacccaagua

SEQ ID NO: 605022 - RNA, 19 nt, Homo sapiens
gccaauaacuuuucaccaa

SEQ ID NO: 605023 - RNA, 19 nt, Homo sapiens
caccaaugagccuuaguua

SEQ ID NO: 605024 - RNA, 19 nt, Homo sapiens
gaagcagucagcccuuaug

SEQ ID NO: 605025 - RNA, 19 nt, Homo sapiens
guaggaaucccaaugacau

SEQ ID NO: 605026 - RNA, 19 nt, Homo sapiens
gcuguaggaaucccaauga

SEQ ID NO: 605027 - RNA, 19 nt, Homo sapiens
gauuaaugccugcuucugu

SEQ ID NO: 605028 - RNA, 19 nt, Homo sapiens
ggaauccuacccugacuuc

SEQ ID NO: 605029 - RNA, 19 nt, Homo sapiens
cgacguguccuuccagugu

SEQ ID NO: 605030 - RNA, 19 nt, Homo sapiens
caaguacuguggaguuugc

SEQ ID NO: 605031 - RNA, 19 nt, Homo sapiens
ugugagugcuguaagaugu

SEQ ID NO: 605032 - RNA, 19 nt, Homo sapiens
cagguccuauggauuaaug

SEQ ID NO: 605033 - RNA, 19 nt, Homo sapiens
cacggaggcugccaucugu

SEQ ID NO: 605034 - RNA, 19 nt, Homo sapiens
ccaaugagccuuaguuacc

SEQ ID NO: 605035 - RNA, 19 nt, Homo sapiens
cuacgaccauggacuuuac

SEQ ID NO: 605036 - RNA, 19 nt, Homo sapiens
cccaaguacuguggaguuu

SEQ ID NO: 605037 - RNA, 19 nt, Homo sapiens
ccagaggcauccaugaacu

SEQ ID NO: 605038 - RNA, 19 nt, Homo sapiens
gacauccauacacucauua

SEQ ID NO: 605039 - RNA, 19 nt, Homo sapiens
gaacugcauagccuacaca

SEQ ID NO: 605040 - RNA, 19 nt, Homo sapiens
gagccuuaguuacccugaa

SEQ ID NO: 605041 - RNA, 19 nt, Homo sapiens
gggucagccucaucacaga

SEQ ID NO: 605042 - RNA, 19 nt, Homo sapiens
gccagguccuauggauuaa

SEQ ID NO: 605043 - RNA, 19 nt, Homo sapiens
caucagcacacgcuccuau

SEQ ID NO: 605044 - RNA, 19 nt, Homo sapiens
ucaccaaugagccuuaguu

SEQ ID NO: 605045 - RNA, 19 nt, Homo sapiens
ggcugugagugcuguaaga

SEQ ID NO: 605046 - RNA, 19 nt, Homo sapiens
uugcugacuuggaauccua

SEQ ID NO: 605047 - RNA, 19 nt, Homo sapiens
ggaaucccaaugacaucuu

SEQ ID NO: 605048 - RNA, 19 nt, Homo sapiens
ucuguaaccugagcuguag

SEQ ID NO: 605049 - RNA, 19 nt, Homo sapiens
ccaauaacuuuucaccaau

SEQ ID NO: 605050 - RNA, 19 nt, Homo sapiens
ccaacuaggcaggcacaaa

SEQ ID NO: 605051 - RNA, 19 nt, Homo sapiens
agccuuaguuacccugaaa

SEQ ID NO: 605052 - RNA, 19 nt, Homo sapiens
cagcacacgcuccuaucaa

SEQ ID NO: 605053 - RNA, 19 nt, Homo sapiens
caauaacuuuucaccaaug

SEQ ID NO: 605054 - RNA, 19 nt, Homo sapiens
ccuacgaccauggacuuua

SEQ ID NO: 605055 - RNA, 19 nt, Homo sapiens
ggaacugcauagccuacac

SEQ ID NO: 605056 - RNA, 19 nt, Homo sapiens
ccuaucaacccaaguacug

SEQ ID NO: 605057 - RNA, 19 nt, Homo sapiens
uuaaugccugcuucuguaa

SEQ ID NO: 605058 - RNA, 19 nt, Homo sapiens
uaaccugagcuguaggaau

SEQ ID NO: 605059 - RNA, 19 nt, Homo sapiens
gagccgccucugcaacuug

SEQ ID NO: 605060 - RNA, 19 nt, Homo sapiens
uaggcaggcacaaaucuug

SEQ ID NO: 605061 - RNA, 19 nt, Homo sapiens
guccaggcaugaggugguu

SEQ ID NO: 605062 - RNA, 19 nt, Homo sapiens
guacgcaauaggagugugu

SEQ ID NO: 605063 - RNA, 19 nt, Homo sapiens
ggacugagauugccucuga

SEQ ID NO: 605064 - RNA, 19 nt, Homo sapiens
ggaaagcgauguggagauu

SEQ ID NO: 605065 - RNA, 19 nt, Homo sapiens
caacccagcugaacaacaa

SEQ ID NO: 605066 - RNA, 19 nt, Homo sapiens
ccaagaccguggccuauuu

SEQ ID NO: 605067 - RNA, 19 nt, Homo sapiens
aaagcgauguggagauuua

SEQ ID NO: 605068 - RNA, 19 nt, Homo sapiens
gugaggagcuucccuauag

SEQ ID NO: 605069 - RNA, 19 nt, Homo sapiens
gggaaugcguugaauaugu

SEQ ID NO: 605070 - RNA, 19 nt, Homo sapiens
gcacaggugacauguauga

SEQ ID NO: 605071 - RNA, 19 nt, Homo sapiens
agacaucgcugcugguaga

SEQ ID NO: 605072 - RNA, 19 nt, Homo sapiens
gcauugaugaccagaguua

SEQ ID NO: 605073 - RNA, 19 nt, Homo sapiens
gagcuucccuauagugaau

SEQ ID NO: 605074 - RNA, 19 nt, Homo sapiens
ggaaugcguugaauauguc

SEQ ID NO: 605075 - RNA, 19 nt, Homo sapiens
aacaagaucugugauauug

SEQ ID NO: 605076 - RNA, 19 nt, Homo sapiens
gaagagagagagauuugga

SEQ ID NO: 605077 - RNA, 19 nt, Homo sapiens
cagggaagaugaagagaga

SEQ ID NO: 605078 - RNA, 19 nt, Homo sapiens
ggagauacagacaaggaua

SEQ ID NO: 605079 - RNA, 19 nt, Homo sapiens
uagaagaggccauuaguga

SEQ ID NO: 605080 - RNA, 19 nt, Homo sapiens
caacaagaucugugauauu

SEQ ID NO: 605081 - RNA, 19 nt, Homo sapiens
ggaaguauguuuucaagug

SEQ ID NO: 605082 - RNA, 19 nt, Homo sapiens
ucugugauauugccauuaa

SEQ ID NO: 605083 - RNA, 19 nt, Homo sapiens
cgaaccaucuaccugcuuu

SEQ ID NO: 605084 - RNA, 19 nt, Homo sapiens
cugcagaccuccugaccua

SEQ ID NO: 605085 - RNA, 19 nt, Homo sapiens
gucaagagcuucaauaucc

SEQ ID NO: 605086 - RNA, 19 nt, Homo sapiens
gaucugugauauugccauu

SEQ ID NO: 605087 - RNA, 19 nt, Homo sapiens
gcauuacggucucuauaag

SEQ ID NO: 605088 - RNA, 19 nt, Homo sapiens
ggauggagauacagacaag

SEQ ID NO: 605089 - RNA, 19 nt, Homo sapiens
gaugaugggaaguauguuu

SEQ ID NO: 605090 - RNA, 19 nt, Homo sapiens
auagcuaucugggacauua

SEQ ID NO: 605091 - RNA, 19 nt, Homo sapiens
gagcuucaauaucccucua

SEQ ID NO: 605092 - RNA, 19 nt, Homo sapiens
uggcacaggugacauguau

SEQ ID NO: 605093 - RNA, 19 nt, Homo sapiens
auacggaaauuacuucuuc

SEQ ID NO: 605094 - RNA, 19 nt, Homo sapiens
gcacccgcaucgagaauca

SEQ ID NO: 605095 - RNA, 19 nt, Homo sapiens
ccacaaauacggaaauuac

SEQ ID NO: 605096 - RNA, 19 nt, Homo sapiens
acaacaagaucugugauau

SEQ ID NO: 605097 - RNA, 19 nt, Homo sapiens
gaccagauccgccagacaa

SEQ ID NO: 605098 - RNA, 19 nt, Homo sapiens
gagcaacccagcugaacaa

SEQ ID NO: 605099 - RNA, 19 nt, Homo sapiens
aauguucuguucucacuuu

SEQ ID NO: 605100 - RNA, 19 nt, Homo sapiens
gaagaugaagagagagaga

SEQ ID NO: 605101 - RNA, 19 nt, Homo sapiens
ugacaaugguaccuauuag

SEQ ID NO: 605102 - RNA, 19 nt, Homo sapiens
ggccagaggcacccaauga

SEQ ID NO: 605103 - RNA, 19 nt, Homo sapiens
caaauacggaaauuacuuc

SEQ ID NO: 605104 - RNA, 19 nt, Homo sapiens
augcaaggcuucaccaaga

SEQ ID NO: 605105 - RNA, 19 nt, Homo sapiens
ccaugacaaugacaaggaa

SEQ ID NO: 605106 - RNA, 19 nt, Homo sapiens
caucgcugcugguagaaga

SEQ ID NO: 605107 - RNA, 19 nt, Homo sapiens
ucaacgacauugugauugg

SEQ ID NO: 605108 - RNA, 19 nt, Homo sapiens
acaccugaaucccagauga

SEQ ID NO: 605109 - RNA, 19 nt, Homo sapiens
gaugcugugucccaaggaa

SEQ ID NO: 605110 - RNA, 19 nt, Homo sapiens
gcaccuaguguccagauuc

SEQ ID NO: 605111 - RNA, 19 nt, Homo sapiens
ggagcuggacacccuauga

SEQ ID NO: 605112 - RNA, 19 nt, Homo sapiens
gagcuggacacccuaugaa

SEQ ID NO: 605113 - RNA, 19 nt, Homo sapiens
caggugacauguaugaagu

SEQ ID NO: 605114 - RNA, 19 nt, Homo sapiens
gcagaccuccugaccuaug

SEQ ID NO: 605115 - RNA, 19 nt, Homo sapiens
gaauaugucaagagcuuca

SEQ ID NO: 605116 - RNA, 19 nt, Homo sapiens
gaccguggccuauuucuac

SEQ ID NO: 605117 - RNA, 19 nt, Homo sapiens
cccaaugaguucuaugaug

SEQ ID NO: 605118 - RNA, 19 nt, Homo sapiens
gaucgauugggcugcuuua

SEQ ID NO: 605119 - RNA, 19 nt, Homo sapiens
gacgguguccuuccacaaa

SEQ ID NO: 605120 - RNA, 19 nt, Homo sapiens
gcaccaugccaagaaguuu

SEQ ID NO: 605121 - RNA, 19 nt, Homo sapiens
gaacaacaagaucugugau

SEQ ID NO: 605122 - RNA, 19 nt, Homo sapiens
gggaggauaugaaaauguu

SEQ ID NO: 605123 - RNA, 19 nt, Homo sapiens
gaugaagagagagagauuu

SEQ ID NO: 605124 - RNA, 19 nt, Homo sapiens
ugagauugccucugacuuc

SEQ ID NO: 605125 - RNA, 19 nt, Homo sapiens
gggaugaacggguagacaa

SEQ ID NO: 605126 - RNA, 19 nt, Homo sapiens
guuauacuguccgaaaugu

SEQ ID NO: 605127 - RNA, 19 nt, Homo sapiens
cugacaaugguaccuauua

SEQ ID NO: 605128 - RNA, 19 nt, Homo sapiens
cagaccuccugaccuauga

SEQ ID NO: 605129 - RNA, 19 nt, Homo sapiens
gaaguauguuuucaagugu

SEQ ID NO: 605130 - RNA, 19 nt, Homo sapiens
cagaugaugggaaguaugu

SEQ ID NO: 605131 - RNA, 19 nt, Homo sapiens
uauuagggauggagauaca

SEQ ID NO: 605132 - RNA, 19 nt, Homo sapiens
gaaagcgauguggagauuu

SEQ ID NO: 605133 - RNA, 19 nt, Homo sapiens
cagaggcacccaaugaguu

SEQ ID NO: 605134 - RNA, 19 nt, Homo sapiens
ucagaacucacgccaguau

SEQ ID NO: 605135 - RNA, 19 nt, Homo sapiens
ugaacaacaagaucuguga

SEQ ID NO: 605136 - RNA, 19 nt, Homo sapiens
gggaagaugaagagagaga

SEQ ID NO: 605137 - RNA, 19 nt, Homo sapiens
caccuaguguccagauuca

SEQ ID NO: 605138 - RNA, 19 nt, Homo sapiens
caucgagaaucagaacuca

SEQ ID NO: 605139 - RNA, 19 nt, Homo sapiens
gguagaagaggccauuagu

SEQ ID NO: 605140 - RNA, 19 nt, Homo sapiens
uauacuguccgaaauguug

SEQ ID NO: 605141 - RNA, 19 nt, Homo sapiens
cgguguccuuccacaaaua

SEQ ID NO: 605142 - RNA, 19 nt, Homo sapiens
gagauacagacaaggauag

SEQ ID NO: 605143 - RNA, 19 nt, Homo sapiens
gcugaaccaugcaccuagu

SEQ ID NO: 605144 - RNA, 19 nt, Homo sapiens
cgccuggcauugacccaua

SEQ ID NO: 605145 - RNA, 19 nt, Homo sapiens
guagaagaggccauuagug

SEQ ID NO: 605146 - RNA, 19 nt, Homo sapiens
guagacaaggacugagauu

SEQ ID NO: 605147 - RNA, 19 nt, Homo sapiens
auacagacaaggauagcua

SEQ ID NO: 605148 - RNA, 19 nt, Homo sapiens
gcgauguggagauuuaaga

SEQ ID NO: 605149 - RNA, 19 nt, Homo sapiens
gcugggugguggugguuau

SEQ ID NO: 605150 - RNA, 19 nt, Homo sapiens
ccacuccgaggacuacauu

SEQ ID NO: 605151 - RNA, 19 nt, Homo sapiens
auuacggucucuauaagaa

SEQ ID NO: 605152 - RNA, 19 nt, Homo sapiens
gcccgcugcuggacauaug

SEQ ID NO: 605153 - RNA, 19 nt, Homo sapiens
ucaaccagguaguggacuu

SEQ ID NO: 605154 - RNA, 19 nt, Homo sapiens
ggagcaacccagcugaaca

SEQ ID NO: 605155 - RNA, 19 nt, Homo sapiens
gaggagcuucccuauagug

SEQ ID NO: 605156 - RNA, 19 nt, Homo sapiens
ugcauuacggucucuauaa

SEQ ID NO: 605157 - RNA, 19 nt, Homo sapiens
gagaguggccgcuacuacu

SEQ ID NO: 605158 - RNA, 19 nt, Homo sapiens
gaguucugcucgcguuaca

SEQ ID NO: 605159 - RNA, 19 nt, Homo sapiens
ccuaugacaggacugauga

SEQ ID NO: 605160 - RNA, 19 nt, Homo sapiens
gaacucacgccaguaucug

SEQ ID NO: 605161 - RNA, 19 nt, Homo sapiens
gugguuauacuguccgaaa

SEQ ID NO: 605162 - RNA, 19 nt, Homo sapiens
uaugucaagagcuucaaua

SEQ ID NO: 605163 - RNA, 19 nt, Homo sapiens
gccagaaacuguaaucuua

SEQ ID NO: 605164 - RNA, 19 nt, Homo sapiens
ucacagaucugaacaguau

SEQ ID NO: 605165 - RNA, 19 nt, Homo sapiens
cagaacagcuucaauauca

SEQ ID NO: 605166 - RNA, 19 nt, Homo sapiens
gugaacaucucaacauuaa

SEQ ID NO: 605167 - RNA, 19 nt, Homo sapiens
uaacaaaugugguggagaa

SEQ ID NO: 605168 - RNA, 19 nt, Homo sapiens
ggagaacaauaauaggaua

SEQ ID NO: 605169 - RNA, 19 nt, Homo sapiens
cuaaauaagucaccauuga

SEQ ID NO: 605170 - RNA, 19 nt, Homo sapiens
gcucagaacuucaucacaa

SEQ ID NO: 605171 - RNA, 19 nt, Homo sapiens
gaaugaaacuccagagcaa

SEQ ID NO: 605172 - RNA, 19 nt, Homo sapiens
gaaaugcuguucguucaaa

SEQ ID NO: 605173 - RNA, 19 nt, Homo sapiens
caacaaaguacacagcuua

SEQ ID NO: 605174 - RNA, 19 nt, Homo sapiens
gaaggcauaugaauccaaa

SEQ ID NO: 605175 - RNA, 19 nt, Homo sapiens
ugauauaccugacagagua

SEQ ID NO: 605176 - RNA, 19 nt, Homo sapiens
ccauaaagcuggacccauu

SEQ ID NO: 605177 - RNA, 19 nt, Homo sapiens
gaacaucucaacauuaaug

SEQ ID NO: 605178 - RNA, 19 nt, Homo sapiens
caauuacgguguacaguuu

SEQ ID NO: 605179 - RNA, 19 nt, Homo sapiens
cagcauggaugaaaccuuu

SEQ ID NO: 605180 - RNA, 19 nt, Homo sapiens
caaaugugauggcuagauu

SEQ ID NO: 605181 - RNA, 19 nt, Homo sapiens
gagaaaugcuguucguuca

SEQ ID NO: 605182 - RNA, 19 nt, Homo sapiens
gauacacccuacuuacuaa

SEQ ID NO: 605183 - RNA, 19 nt, Homo sapiens
gagaagauccugucacaau

SEQ ID NO: 605184 - RNA, 19 nt, Homo sapiens
gaacuugacaacguuaaua

SEQ ID NO: 605185 - RNA, 19 nt, Homo sapiens
cgaacucucuugaaugaaa

SEQ ID NO: 605186 - RNA, 19 nt, Homo sapiens
caaaugugguggagaaaug

SEQ ID NO: 605187 - RNA, 19 nt, Homo sapiens
gaaagcacaagguaaauau

SEQ ID NO: 605188 - RNA, 19 nt, Homo sapiens
gaaaagagaugcacaaacu

SEQ ID NO: 605189 - RNA, 19 nt, Homo sapiens
ggaauagacagaaugaauu

SEQ ID NO: 605190 - RNA, 19 nt, Homo sapiens
aaaguuacauccacagaaa

SEQ ID NO: 605191 - RNA, 19 nt, Homo sapiens
guucagauaucgacaaugu

SEQ ID NO: 605192 - RNA, 19 nt, Homo sapiens
gaucugaacaguaucaauu

SEQ ID NO: 605193 - RNA, 19 nt, Homo sapiens
agagagaucuugagagaga

SEQ ID NO: 605194 - RNA, 19 nt, Homo sapiens
uggaaaggaucacagauuu

SEQ ID NO: 605195 - RNA, 19 nt, Homo sapiens
gagaguaacuaggauucua

SEQ ID NO: 605196 - RNA, 19 nt, Homo sapiens
cauaugaucuagaagcaaa

SEQ ID NO: 605197 - RNA, 19 nt, Homo sapiens
agagagagaucuugagaga

SEQ ID NO: 605198 - RNA, 19 nt, Homo sapiens
ggauacacccuacuuacua

SEQ ID NO: 605199 - RNA, 19 nt, Homo sapiens
gaucagcaaugaagaacug

SEQ ID NO: 605200 - RNA, 19 nt, Homo sapiens
ccacagaaauuuaccuaca

SEQ ID NO: 605201 - RNA, 19 nt, Homo sapiens
uaacguugauguaauggaa

SEQ ID NO: 605202 - RNA, 19 nt, Homo sapiens
gauccugucacaauucuua

SEQ ID NO: 605203 - RNA, 19 nt, Homo sapiens
ugaacacaaucacguuaua

SEQ ID NO: 605204 - RNA, 19 nt, Homo sapiens
gguagugcuuuaagaauga

SEQ ID NO: 605205 - RNA, 19 nt, Homo sapiens
cauguuggaucugucauua

SEQ ID NO: 605206 - RNA, 19 nt, Homo sapiens
guugaugucuuucugugua

SEQ ID NO: 605207 - RNA, 19 nt, Homo sapiens
uggauuaaguuuccucuuu

SEQ ID NO: 605208 - RNA, 19 nt, Homo sapiens
gcaacgaguccuuccuaua

SEQ ID NO: 605209 - RNA, 19 nt, Homo sapiens
gaaauuuaccuacauugga

SEQ ID NO: 605210 - RNA, 19 nt, Homo sapiens
gggcugcuguuuauuauuc

SEQ ID NO: 605211 - RNA, 19 nt, Homo sapiens
cauaagcagugaauuggaa

SEQ ID NO: 605212 - RNA, 19 nt, Homo sapiens
cagaagauacuuugagaaa

SEQ ID NO: 605213 - RNA, 19 nt, Homo sapiens
ggacaaaauuuaacguuga

SEQ ID NO: 605214 - RNA, 19 nt, Homo sapiens
gaucauguauaugguauuc

SEQ ID NO: 605215 - RNA, 19 nt, Homo sapiens
gagcauacuggaagcauaa

SEQ ID NO: 605216 - RNA, 19 nt, Homo sapiens
gugcauccaucaagugaaa

SEQ ID NO: 605217 - RNA, 19 nt, Homo sapiens
gucuaaagauugucuacua

SEQ ID NO: 605218 - RNA, 19 nt, Homo sapiens
caacgaguccuuccuauag

SEQ ID NO: 605219 - RNA, 19 nt, Homo sapiens
ggacaaggcguucacagau

SEQ ID NO: 605220 - RNA, 19 nt, Homo sapiens
gaaaugcaccagcgacaga

SEQ ID NO: 605221 - RNA, 19 nt, Homo sapiens
acacugaguuucuauuuag

SEQ ID NO: 605222 - RNA, 19 nt, Homo sapiens
gaaaguggcaucgugcaaa

SEQ ID NO: 605223 - RNA, 19 nt, Homo sapiens
aaacugaucugugaaccuu

SEQ ID NO: 605224 - RNA, 19 nt, Homo sapiens
gaaaguuacauccacagaa

SEQ ID NO: 605225 - RNA, 19 nt, Homo sapiens
gcaaaucaccagguaagaa

SEQ ID NO: 605226 - RNA, 19 nt, Homo sapiens
ugaguuuggucccuaaauu

SEQ ID NO: 605227 - RNA, 19 nt, Homo sapiens
gguauucacaauccuguua

SEQ ID NO: 605228 - RNA, 19 nt, Homo sapiens
gauucuagcuucucuggau

SEQ ID NO: 605229 - RNA, 19 nt, Homo sapiens
gagaugcacaaacuauuaa

SEQ ID NO: 605230 - RNA, 19 nt, Homo sapiens
uggaaagucugaagguaaa

SEQ ID NO: 605231 - RNA, 19 nt, Homo sapiens
ucagauaucgacaauguaa

SEQ ID NO: 605232 - RNA, 19 nt, Homo sapiens
uaagccagcugaauagcaa

SEQ ID NO: 605233 - RNA, 19 nt, Homo sapiens
uggaggaucuugcuagcua

SEQ ID NO: 605234 - RNA, 19 nt, Homo sapiens
gguaagaacccggaucaaa

SEQ ID NO: 605235 - RNA, 19 nt, Homo sapiens
uaucaaagauuggccaugu

SEQ ID NO: 605236 - RNA, 19 nt, Homo sapiens
uaaguacuaucgucgaaug

SEQ ID NO: 605237 - RNA, 19 nt, Homo sapiens
gcagugaauuggaaagucu

SEQ ID NO: 605238 - RNA, 19 nt, Homo sapiens
gaacaaguuuacagugacu

SEQ ID NO: 605239 - RNA, 19 nt, Homo sapiens
guucuuaccuuugucuuug

SEQ ID NO: 605240 - RNA, 19 nt, Homo sapiens
caugaaagcacaagguaaa

SEQ ID NO: 605241 - RNA, 19 nt, Homo sapiens
agaagauccugucacaauu

SEQ ID NO: 605242 - RNA, 19 nt, Homo sapiens
gcagcuaacaugaguauca

SEQ ID NO: 605243 - RNA, 19 nt, Homo sapiens
ggguagugcuuuaagaaug

SEQ ID NO: 605244 - RNA, 19 nt, Homo sapiens
ucacaauccuguuaugaca

SEQ ID NO: 605245 - RNA, 19 nt, Homo sapiens
gcuaaguacuaucgucgaa

SEQ ID NO: 605246 - RNA, 19 nt, Homo sapiens
gaaguaugggagaacaaua

SEQ ID NO: 605247 - RNA, 19 nt, Homo sapiens
gaaacuggcagauagcaau

SEQ ID NO: 605248 - RNA, 19 nt, Homo sapiens
uacaaggacuuuccaaauc

SEQ ID NO: 605249 - RNA, 19 nt, Homo sapiens
auugauagcugauguugaa

SEQ ID NO: 605250 - RNA, 19 nt, Homo sapiens
caaauuaugagacccaaga

SEQ ID NO: 605251 - RNA, 19 nt, Homo sapiens
agagaugcacaaacuauua

SEQ ID NO: 605252 - RNA, 19 nt, Homo sapiens
ucucagcauucucuguuua

SEQ ID NO: 605253 - RNA, 19 nt, Homo sapiens
cagcuuagcagcagucuga

SEQ ID NO: 605254 - RNA, 19 nt, Homo sapiens
ccagagcaaaucaaauaua

SEQ ID NO: 605255 - RNA, 19 nt, Homo sapiens
gcauaugaauccaaaauug

SEQ ID NO: 605256 - RNA, 19 nt, Homo sapiens
gaagauccugucacaauuc

SEQ ID NO: 605257 - RNA, 19 nt, Homo sapiens
ucucuaagccagcugaaua

SEQ ID NO: 605258 - RNA, 19 nt, Homo sapiens
cgacugagacccaacauca

SEQ ID NO: 605259 - RNA, 19 nt, Homo sapiens
ggaaaugcuuugcaaucuc

SEQ ID NO: 605260 - RNA, 19 nt, Homo sapiens
ugugaaaccuacagcauau

SEQ ID NO: 605261 - RNA, 19 nt, Homo sapiens
ggacguguacgaugauguu

SEQ ID NO: 605262 - RNA, 19 nt, Homo sapiens
aggaaaagcuacuguauuu

SEQ ID NO: 605263 - RNA, 19 nt, Homo sapiens
gaaauggacucagggaaga

SEQ ID NO: 605264 - RNA, 19 nt, Homo sapiens
ugaacaagaucuccaauug

SEQ ID NO: 605265 - RNA, 19 nt, Homo sapiens
ggcaguagcugacuuucua

SEQ ID NO: 605266 - RNA, 19 nt, Homo sapiens
ggaagagacucacaugcuu

SEQ ID NO: 605267 - RNA, 19 nt, Homo sapiens
caggugagccagauaauaa

SEQ ID NO: 605268 - RNA, 19 nt, Homo sapiens
aagaagaacugcugugugu

SEQ ID NO: 605269 - RNA, 19 nt, Homo sapiens
gaagagacucacaugcuuu

SEQ ID NO: 605270 - RNA, 19 nt, Homo sapiens
caauucaucuuucagacaa

SEQ ID NO: 605271 - RNA, 19 nt, Homo sapiens
gagaucuacuugugacuug

SEQ ID NO: 605272 - RNA, 19 nt, Homo sapiens
gcaauccauuccucucuug

SEQ ID NO: 605273 - RNA, 19 nt, Homo sapiens
gaagaugggcaaauuguag

SEQ ID NO: 605274 - RNA, 19 nt, Homo sapiens
cagcagccaucaucucuug

SEQ ID NO: 605275 - RNA, 19 nt, Homo sapiens
ggugauaucuagccugcuu

SEQ ID NO: 605276 - RNA, 19 nt, Homo sapiens
aaacuugcuucaucucuga

SEQ ID NO: 605277 - RNA, 19 nt, Homo sapiens
gaccuggcguucuuuauca

SEQ ID NO: 605278 - RNA, 19 nt, Homo sapiens
agaaguugcugauccagaa

SEQ ID NO: 605279 - RNA, 19 nt, Homo sapiens
gacugaagaugggcaaauu

SEQ ID NO: 605280 - RNA, 19 nt, Homo sapiens
gggcuggaguuuaucuuug

SEQ ID NO: 605281 - RNA, 19 nt, Homo sapiens
gcagaauugugaaguguac

SEQ ID NO: 605282 - RNA, 19 nt, Homo sapiens
gaacaagaucuccaauugg

SEQ ID NO: 605283 - RNA, 19 nt, Homo sapiens
gcuguugcaucgaguaaug

SEQ ID NO: 605284 - RNA, 19 nt, Homo sapiens
caucaucucuugccuucug

SEQ ID NO: 605285 - RNA, 19 nt, Homo sapiens
gauaaggagagcugagauu

SEQ ID NO: 605286 - RNA, 19 nt, Homo sapiens
gcccaggcaucauuaaaca

SEQ ID NO: 605287 - RNA, 19 nt, Homo sapiens
ccauuccucucuuguuuau

SEQ ID NO: 605288 - RNA, 19 nt, Homo sapiens
agacucacaugcuuugguu

SEQ ID NO: 605289 - RNA, 19 nt, Homo sapiens
gaacuuccagauucagaga

SEQ ID NO: 605290 - RNA, 19 nt, Homo sapiens
uaaaacggcuucaggauag

SEQ ID NO: 605291 - RNA, 19 nt, Homo sapiens
ggaccggcaugccaagauc

SEQ ID NO: 605292 - RNA, 19 nt, Homo sapiens
cagaagggacugagcuaaa

SEQ ID NO: 605293 - RNA, 19 nt, Homo sapiens
ggaaauagacaagaagaac

SEQ ID NO: 605294 - RNA, 19 nt, Homo sapiens
aaggagagcugagauugga

SEQ ID NO: 605295 - RNA, 19 nt, Homo sapiens
ggaccuggcguucuuuauc

SEQ ID NO: 605296 - RNA, 19 nt, Homo sapiens
ggugguggccaucgucuuu

SEQ ID NO: 605297 - RNA, 19 nt, Homo sapiens
gcuuguguuucuguacuua

SEQ ID NO: 605298 - RNA, 19 nt, Homo sapiens
gaaauagacaagaagaacu

SEQ ID NO: 605299 - RNA, 19 nt, Homo sapiens
ggccuugcccuguggauuu

SEQ ID NO: 605300 - RNA, 19 nt, Homo sapiens
ccaacuucuucuccacuuu

SEQ ID NO: 605301 - RNA, 19 nt, Homo sapiens
ccucucuuguuuauaguaa

SEQ ID NO: 605302 - RNA, 19 nt, Homo sapiens
caacuucuucuccacuuug

SEQ ID NO: 605303 - RNA, 19 nt, Homo sapiens
ucacuagccgcacucauga

SEQ ID NO: 605304 - RNA, 19 nt, Homo sapiens
gcccauccuuucccaacuu

SEQ ID NO: 605305 - RNA, 19 nt, Homo sapiens
gaccaauucaucuuucaga

SEQ ID NO: 605306 - RNA, 19 nt, Homo sapiens
ggcaccaucugcaggauca

SEQ ID NO: 605307 - RNA, 19 nt, Homo sapiens
gagauuggagggaauugug

SEQ ID NO: 605308 - RNA, 19 nt, Homo sapiens
guuauuaugggaaaggaaa

SEQ ID NO: 605309 - RNA, 19 nt, Homo sapiens
agccagagaucuacuugug

SEQ ID NO: 605310 - RNA, 19 nt, Homo sapiens
ugaagaugggcaaauugua

SEQ ID NO: 605311 - RNA, 19 nt, Homo sapiens
ggacugaagaugggcaaau

SEQ ID NO: 605312 - RNA, 19 nt, Homo sapiens
ucaccuacaugaacagcau

SEQ ID NO: 605313 - RNA, 19 nt, Homo sapiens
uggcuuccguggaccaauu

SEQ ID NO: 605314 - RNA, 19 nt, Homo sapiens
agaagaaguugcugaucca

SEQ ID NO: 605315 - RNA, 19 nt, Homo sapiens
gaagaagaaguugcugauc

SEQ ID NO: 605316 - RNA, 19 nt, Homo sapiens
acaguguuauuaugggaaa

SEQ ID NO: 605317 - RNA, 19 nt, Homo sapiens
gaagggacugagcuaaaca

SEQ ID NO: 605318 - RNA, 19 nt, Homo sapiens
gcaggaucacuuucuggaa

SEQ ID NO: 605319 - RNA, 19 nt, Homo sapiens
caguccaccuccugaagaa

SEQ ID NO: 605320 - RNA, 19 nt, Homo sapiens
ggacagcagccaucaucuc

SEQ ID NO: 605321 - RNA, 19 nt, Homo sapiens
gggaagagacucacaugcu

SEQ ID NO: 605322 - RNA, 19 nt, Homo sapiens
caccucaaguccuggaaau

SEQ ID NO: 605323 - RNA, 19 nt, Homo sapiens
uuucccaccuguuucguuu

SEQ ID NO: 605324 - RNA, 19 nt, Homo sapiens
gcuuucaaccagcgacuaa

SEQ ID NO: 605325 - RNA, 19 nt, Homo sapiens
ucacggugguggcgguaga

SEQ ID NO: 605326 - RNA, 19 nt, Homo sapiens
auccauuccucucuuguuu

SEQ ID NO: 605327 - RNA, 19 nt, Homo sapiens
uggcauugcugcuuucaac

SEQ ID NO: 605328 - RNA, 19 nt, Homo sapiens
gaucuacuugugacuuguu

SEQ ID NO: 605329 - RNA, 19 nt, Homo sapiens
acucucagcuucaccuaca

SEQ ID NO: 605330 - RNA, 19 nt, Homo sapiens
uaacaguccaccuccugaa

SEQ ID NO: 605331 - RNA, 19 nt, Homo sapiens
cuggugcucuucauguuug

SEQ ID NO: 605332 - RNA, 19 nt, Homo sapiens
gcuggugcucuucauguuu

SEQ ID NO: 605333 - RNA, 19 nt, Homo sapiens
agaagggacugagcuaaac

SEQ ID NO: 605334 - RNA, 19 nt, Homo sapiens
ggagccagagaucuacuug

SEQ ID NO: 605335 - RNA, 19 nt, Homo sapiens
ugcaucagcuucagcaucu

SEQ ID NO: 605336 - RNA, 19 nt, Homo sapiens
ugaagaagaaguugcugau

SEQ ID NO: 605337 - RNA, 19 nt, Homo sapiens
ggcuggugcucuucauguu

SEQ ID NO: 605338 - RNA, 19 nt, Homo sapiens
uagcugacuuucuacugau

SEQ ID NO: 605339 - RNA, 19 nt, Homo sapiens
ccagaagggacugagcuaa

SEQ ID NO: 605340 - RNA, 19 nt, Homo sapiens
guggaccaauucaucuuuc

SEQ ID NO: 605341 - RNA, 19 nt, Homo sapiens
gggauaaggagagcugaga

SEQ ID NO: 605342 - RNA, 19 nt, Homo sapiens
acaggugagccagauaaua

SEQ ID NO: 605343 - RNA, 19 nt, Homo sapiens
gcacgcagaauugugaagu

SEQ ID NO: 605344 - RNA, 19 nt, Homo sapiens
auuccucucuuguuuauag

SEQ ID NO: 605345 - RNA, 19 nt, Homo sapiens
gacagcagccaucaucucu

SEQ ID NO: 605346 - RNA, 19 nt, Homo sapiens
ccaauucaucuuucagaca

SEQ ID NO: 605347 - RNA, 19 nt, Homo sapiens
auaucuagccugcuuguga

SEQ ID NO: 605348 - RNA, 19 nt, Homo sapiens
ggcuggaguuuaucuuugg

SEQ ID NO: 605349 - RNA, 19 nt, Homo sapiens
aaauagacaagaagaacug

SEQ ID NO: 605350 - RNA, 19 nt, Homo sapiens
uagccgcacucaugaaucg

SEQ ID NO: 605351 - RNA, 19 nt, Homo sapiens
ggcccaaccucaaauaacc

SEQ ID NO: 605352 - RNA, 19 nt, Homo sapiens
agagagccaucaccuucau

SEQ ID NO: 605353 - RNA, 19 nt, Homo sapiens
ccaggcaucauuaaacaag

SEQ ID NO: 605354 - RNA, 19 nt, Homo sapiens
gcucuagcagggauaagga

SEQ ID NO: 605355 - RNA, 19 nt, Homo sapiens
uaucugggcccaaccucaa

SEQ ID NO: 605356 - RNA, 19 nt, Homo sapiens
gcuguguguuccgagauga

SEQ ID NO: 605357 - RNA, 19 nt, Homo sapiens
cgguggaccuggcguucuu

SEQ ID NO: 605358 - RNA, 19 nt, Homo sapiens
gaaguugcugauccagaau

SEQ ID NO: 605359 - RNA, 19 nt, Homo sapiens
uuaaaacggcuucaggaua

SEQ ID NO: 605360 - RNA, 19 nt, Homo sapiens
ggauaaggagagcugagau

SEQ ID NO: 605361 - RNA, 19 nt, Homo sapiens
gccagagaucuacuuguga

SEQ ID NO: 605362 - RNA, 19 nt, Homo sapiens
ucacuggacucggccuaag

SEQ ID NO: 605363 - RNA, 19 nt, Homo sapiens
gaagugaguuuccauguuu

SEQ ID NO: 605364 - RNA, 19 nt, Homo sapiens
gcaaagaguuccugaggua

SEQ ID NO: 605365 - RNA, 19 nt, Homo sapiens
gaucaaaucucagcuaaau

SEQ ID NO: 605366 - RNA, 19 nt, Homo sapiens
gggaagaacucauuguuga

SEQ ID NO: 605367 - RNA, 19 nt, Homo sapiens
gaagaauccuuuacacaug

SEQ ID NO: 605368 - RNA, 19 nt, Homo sapiens
gaaacagugccuuaaguua

SEQ ID NO: 605369 - RNA, 19 nt, Homo sapiens
ccagaaaccuaauguaugu

SEQ ID NO: 605370 - RNA, 19 nt, Homo sapiens
gcacaguggugacaucaug

SEQ ID NO: 605371 - RNA, 19 nt, Homo sapiens
caaacucccuguuggcuuu

SEQ ID NO: 605372 - RNA, 19 nt, Homo sapiens
caaaggcuauccuggguuu

SEQ ID NO: 605373 - RNA, 19 nt, Homo sapiens
gaagaccgcucguguuaac

SEQ ID NO: 605374 - RNA, 19 nt, Homo sapiens
gcaagccuauggacucaaa

SEQ ID NO: 605375 - RNA, 19 nt, Homo sapiens
cauguuggcuguaauguau

SEQ ID NO: 605376 - RNA, 19 nt, Homo sapiens
cauggucuguuccuaguua

SEQ ID NO: 605377 - RNA, 19 nt, Homo sapiens
acacacacaugucuaaaga

SEQ ID NO: 605378 - RNA, 19 nt, Homo sapiens
ggaagaauccuuuacacau

SEQ ID NO: 605379 - RNA, 19 nt, Homo sapiens
ccucaggcaucaucaaauu

SEQ ID NO: 605380 - RNA, 19 nt, Homo sapiens
aacagugccuuaaguuaua

SEQ ID NO: 605381 - RNA, 19 nt, Homo sapiens
cccgagagauucaauggua

SEQ ID NO: 605382 - RNA, 19 nt, Homo sapiens
cuaaaugugucuucuguca

SEQ ID NO: 605383 - RNA, 19 nt, Homo sapiens
gaccagaauuucccucuag

SEQ ID NO: 605384 - RNA, 19 nt, Homo sapiens
ucagugagcagaaugcaua

SEQ ID NO: 605385 - RNA, 19 nt, Homo sapiens
gugaucaaaucucagcuaa

SEQ ID NO: 605386 - RNA, 19 nt, Homo sapiens
aaagagacaucaguacaga

SEQ ID NO: 605387 - RNA, 19 nt, Homo sapiens
ugagcuagaucacuccaaa

SEQ ID NO: 605388 - RNA, 19 nt, Homo sapiens
gaagagacccaagaucugu

SEQ ID NO: 605389 - RNA, 19 nt, Homo sapiens
ggaauuuaguuucucuaca

SEQ ID NO: 605390 - RNA, 19 nt, Homo sapiens
aaacagugccuuaaguuau

SEQ ID NO: 605391 - RNA, 19 nt, Homo sapiens
ucaaaucucagcuaaaugu

SEQ ID NO: 605392 - RNA, 19 nt, Homo sapiens
ccaaggagguauguucuuc

SEQ ID NO: 605393 - RNA, 19 nt, Homo sapiens
uaauguauguugagaaguc

SEQ ID NO: 605394 - RNA, 19 nt, Homo sapiens
ccaaacccuugcugucauu

SEQ ID NO: 605395 - RNA, 19 nt, Homo sapiens
gaaauacucagcagaucau

SEQ ID NO: 605396 - RNA, 19 nt, Homo sapiens
aagaauccuuuacacauga

SEQ ID NO: 605397 - RNA, 19 nt, Homo sapiens
ugaccagaauagcgaagua

SEQ ID NO: 605398 - RNA, 19 nt, Homo sapiens
gugaaacagugccuuaagu

SEQ ID NO: 605399 - RNA, 19 nt, Homo sapiens
cacuccaucugguaauuua

SEQ ID NO: 605400 - RNA, 19 nt, Homo sapiens
agaagugaguuuccauguu

SEQ ID NO: 605401 - RNA, 19 nt, Homo sapiens
ccucugcuauuuccuuuga

SEQ ID NO: 605402 - RNA, 19 nt, Homo sapiens
ucagagaaguguuugacau

SEQ ID NO: 605403 - RNA, 19 nt, Homo sapiens
gcagaucauuacacaccuu

SEQ ID NO: 605404 - RNA, 19 nt, Homo sapiens
acacaugucuaaagaagag

SEQ ID NO: 605405 - RNA, 19 nt, Homo sapiens
gaagaacucauuguugauc

SEQ ID NO: 605406 - RNA, 19 nt, Homo sapiens
uaccguaaaugaucauguu

SEQ ID NO: 605407 - RNA, 19 nt, Homo sapiens
uaagaaauacucagcagau

SEQ ID NO: 605408 - RNA, 19 nt, Homo sapiens
aaagaguuccugagguaua

SEQ ID NO: 605409 - RNA, 19 nt, Homo sapiens
acacacaugucuaaagaag

SEQ ID NO: 605410 - RNA, 19 nt, Homo sapiens
uauguaaccuggacacaca

SEQ ID NO: 605411 - RNA, 19 nt, Homo sapiens
uugaagaccgcucguguua

SEQ ID NO: 605412 - RNA, 19 nt, Homo sapiens
gacauggucuguuccuagu

SEQ ID NO: 605413 - RNA, 19 nt, Homo sapiens
aaacagagacagggaagaa

SEQ ID NO: 605414 - RNA, 19 nt, Homo sapiens
guggugacaucaugauaau

SEQ ID NO: 605415 - RNA, 19 nt, Homo sapiens
gguauaaagaagcgacuaa

SEQ ID NO: 605416 - RNA, 19 nt, Homo sapiens
gaagguagaagugaguuuc

SEQ ID NO: 605417 - RNA, 19 nt, Homo sapiens
ugaccuggguuuccucuca

SEQ ID NO: 605418 - RNA, 19 nt, Homo sapiens
aagaguuccugagguauaa

SEQ ID NO: 605419 - RNA, 19 nt, Homo sapiens
gcaaguggcaagccuaugg

SEQ ID NO: 605420 - RNA, 19 nt, Homo sapiens
gagaaguguuugacauggu

SEQ ID NO: 605421 - RNA, 19 nt, Homo sapiens
gggaacagagcaaagaguu

SEQ ID NO: 605422 - RNA, 19 nt, Homo sapiens
ugaaacagugccuuaaguu

SEQ ID NO: 605423 - RNA, 19 nt, Homo sapiens
agacagggaagaacucauu

SEQ ID NO: 605424 - RNA, 19 nt, Homo sapiens
uuacacaccuuucccuucu

SEQ ID NO: 605425 - RNA, 19 nt, Homo sapiens
uggcgacucuggcgacuga

SEQ ID NO: 605426 - RNA, 19 nt, Homo sapiens
uaaagaagagacccaagau

SEQ ID NO: 605427 - RNA, 19 nt, Homo sapiens
aaaugugucuucugucagu

SEQ ID NO: 605428 - RNA, 19 nt, Homo sapiens
gaacccacgcagaaguaaa

SEQ ID NO: 605429 - RNA, 19 nt, Homo sapiens
gggaauccacguagacaga

SEQ ID NO: 605430 - RNA, 19 nt, Homo sapiens
acacaccuuucccuucuga

SEQ ID NO: 605431 - RNA, 19 nt, Homo sapiens
ggaaaggggaauuuaguuu

SEQ ID NO: 605432 - RNA, 19 nt, Homo sapiens
cuauuagucucaucuucuu

SEQ ID NO: 605433 - RNA, 19 nt, Homo sapiens
gcauauagagcaggucuuc

SEQ ID NO: 605434 - RNA, 19 nt, Homo sapiens
cuaaagaagagacccaaga

SEQ ID NO: 605435 - RNA, 19 nt, Homo sapiens
uauauucccagaaaccuaa

SEQ ID NO: 605436 - RNA, 19 nt, Homo sapiens
aacuaucucucuugccuaa

SEQ ID NO: 605437 - RNA, 19 nt, Homo sapiens
caucugguaauuuauggua

SEQ ID NO: 605438 - RNA, 19 nt, Homo sapiens
gagguauguucuuccacaa

SEQ ID NO: 605439 - RNA, 19 nt, Homo sapiens
uguaauguauguugagaag

SEQ ID NO: 605440 - RNA, 19 nt, Homo sapiens
gcuguaauguauguugaga

SEQ ID NO: 605441 - RNA, 19 nt, Homo sapiens
ggaagaacucauuguugau

SEQ ID NO: 605442 - RNA, 19 nt, Homo sapiens
aaucacaacuaucucucuu

SEQ ID NO: 605443 - RNA, 19 nt, Homo sapiens
caauggaacuggaaaaucu

SEQ ID NO: 605444 - RNA, 19 nt, Homo sapiens
ggaagguagaagugaguuu

SEQ ID NO: 605445 - RNA, 19 nt, Homo sapiens
ccuguggauuugaggauuu

SEQ ID NO: 605446 - RNA, 19 nt, Homo sapiens
ugagcagaaugcauauaga

SEQ ID NO: 605447 - RNA, 19 nt, Homo sapiens
cauguuugcagaguauuua

SEQ ID NO: 605448 - RNA, 19 nt, Homo sapiens
ccacgcagaaguaaacuca

SEQ ID NO: 605449 - RNA, 19 nt, Homo sapiens
ucacacuguugccuuggaa

SEQ ID NO: 605450 - RNA, 19 nt, Homo sapiens
guauaaagaagcgacuaaa

SEQ ID NO: 605451 - RNA, 19 nt, Homo sapiens
gagcagaaugcauauagag

SEQ ID NO: 605452 - RNA, 19 nt, Homo sapiens
ucccaaggguguuuuguua

SEQ ID NO: 605453 - RNA, 19 nt, Homo sapiens
gaccagaauagcgaaguaa

SEQ ID NO: 605454 - RNA, 19 nt, Homo sapiens
gaaccagcuauuagucuca

SEQ ID NO: 605455 - RNA, 19 nt, Homo sapiens
guaaaacgggccaggauaa

SEQ ID NO: 605456 - RNA, 19 nt, Homo sapiens
agacaucaguacagaaggu

SEQ ID NO: 605457 - RNA, 19 nt, Homo sapiens
gaauccacguagacagauc

SEQ ID NO: 605458 - RNA, 19 nt, Homo sapiens
ucucauggaagaauccuuu

SEQ ID NO: 605459 - RNA, 19 nt, Homo sapiens
ugagaagucaguccaagga

SEQ ID NO: 605460 - RNA, 19 nt, Homo sapiens
agaccagaauuucccucua

SEQ ID NO: 605461 - RNA, 19 nt, Homo sapiens
cagagaaguguuugacaug

SEQ ID NO: 605462 - RNA, 19 nt, Homo sapiens
guaaacucauccacuuugc

SEQ ID NO: 605463 - RNA, 19 nt, Homo sapiens
gacaugagauuaagguuua

SEQ ID NO: 605464 - RNA, 19 nt, Homo sapiens
gucaagggauuacuuauaa

SEQ ID NO: 605465 - RNA, 19 nt, Homo sapiens
gaaugaagaccacaauaaa

SEQ ID NO: 605466 - RNA, 19 nt, Homo sapiens
ugaagaaucuccuuguuau

SEQ ID NO: 605467 - RNA, 19 nt, Homo sapiens
gguuagauguugagaaauu

SEQ ID NO: 605468 - RNA, 19 nt, Homo sapiens
auagagagguacacauuua

SEQ ID NO: 605469 - RNA, 19 nt, Homo sapiens
gaagcaaugaagucuauua

SEQ ID NO: 605470 - RNA, 19 nt, Homo sapiens
gauacagcuucuuauagua

SEQ ID NO: 605471 - RNA, 19 nt, Homo sapiens
gaguuugccuguuuccaua

SEQ ID NO: 605472 - RNA, 19 nt, Homo sapiens
gagaagaaauaagagacua

SEQ ID NO: 605473 - RNA, 19 nt, Homo sapiens
gaccuaaacuuuugagaua

SEQ ID NO: 605474 - RNA, 19 nt, Homo sapiens
gagaguauagcgccacuua

SEQ ID NO: 605475 - RNA, 19 nt, Homo sapiens
ccacuuagcacgaaugauu

SEQ ID NO: 605476 - RNA, 19 nt, Homo sapiens
gcaauucuuaccuuucuua

SEQ ID NO: 605477 - RNA, 19 nt, Homo sapiens
gaagaaaugccaacugcuu

SEQ ID NO: 605478 - RNA, 19 nt, Homo sapiens
ggacugaauaccuauaauu

SEQ ID NO: 605479 - RNA, 19 nt, Homo sapiens
ugagaaagcuuaaauacac

SEQ ID NO: 605480 - RNA, 19 nt, Homo sapiens
gaaauaagagacuaucauc

SEQ ID NO: 605481 - RNA, 19 nt, Homo sapiens
gagagguacacauuuauuu

SEQ ID NO: 605482 - RNA, 19 nt, Homo sapiens
ucagagauacagcuucuua

SEQ ID NO: 605483 - RNA, 19 nt, Homo sapiens
gcuauaggguuagauguug

SEQ ID NO: 605484 - RNA, 19 nt, Homo sapiens
guacauucccaucuacuaa

SEQ ID NO: 605485 - RNA, 19 nt, Homo sapiens
ggauguauucuguaucuuu

SEQ ID NO: 605486 - RNA, 19 nt, Homo sapiens
guuauuggauguauucugu

SEQ ID NO: 605487 - RNA, 19 nt, Homo sapiens
gcucagcaauucuuaccuu

SEQ ID NO: 605488 - RNA, 19 nt, Homo sapiens
gauaaccuguccgagagua

SEQ ID NO: 605489 - RNA, 19 nt, Homo sapiens
cagccucacuucuuugauu

SEQ ID NO: 605490 - RNA, 19 nt, Homo sapiens
guaggacuuugaauaaugu

SEQ ID NO: 605491 - RNA, 19 nt, Homo sapiens
gauguauucuguaucuuuc

SEQ ID NO: 605492 - RNA, 19 nt, Homo sapiens
agaaugaagaccacaauaa

SEQ ID NO: 605493 - RNA, 19 nt, Homo sapiens
uaaguuuccuugugauuag

SEQ ID NO: 605494 - RNA, 19 nt, Homo sapiens
gaagaaucuccuuguuauu

SEQ ID NO: 605495 - RNA, 19 nt, Homo sapiens
gaguauagcgccacuuaug

SEQ ID NO: 605496 - RNA, 19 nt, Homo sapiens
uuacacaugucaagggauu

SEQ ID NO: 605497 - RNA, 19 nt, Homo sapiens
agauacagcuucuuauagu

SEQ ID NO: 605498 - RNA, 19 nt, Homo sapiens
gagauacagcuucuuauag

SEQ ID NO: 605499 - RNA, 19 nt, Homo sapiens
agagauacagcuucuuaua

SEQ ID NO: 605500 - RNA, 19 nt, Homo sapiens
uaauuggacccuuguguuu

SEQ ID NO: 605501 - RNA, 19 nt, Homo sapiens
uaagagacuaucaucagua

SEQ ID NO: 605502 - RNA, 19 nt, Homo sapiens
guuuguaaauucucccuuu

SEQ ID NO: 605503 - RNA, 19 nt, Homo sapiens
aggguuagauguugagaaa

SEQ ID NO: 605504 - RNA, 19 nt, Homo sapiens
uacagauucuccucuaauu

SEQ ID NO: 605505 - RNA, 19 nt, Homo sapiens
cuaauagcuugaacccuuu

SEQ ID NO: 605506 - RNA, 19 nt, Homo sapiens
gaacagccucacuucuuug

SEQ ID NO: 605507 - RNA, 19 nt, Homo sapiens
gcuaacauuuucagagaua

SEQ ID NO: 605508 - RNA, 19 nt, Homo sapiens
gagcuaacauuuucagaga

SEQ ID NO: 605509 - RNA, 19 nt, Homo sapiens
gaaucuccuuguuauuugu

SEQ ID NO: 605510 - RNA, 19 nt, Homo sapiens
agaaucuccuuguuauuug

SEQ ID NO: 605511 - RNA, 19 nt, Homo sapiens
uguaggacuuugaauaaug

SEQ ID NO: 605512 - RNA, 19 nt, Homo sapiens
agauuuggcucuaguaagu

SEQ ID NO: 605513 - RNA, 19 nt, Homo sapiens
guuuagguacugaagauua

SEQ ID NO: 605514 - RNA, 19 nt, Homo sapiens
cagcaauucuuaccuuucu

SEQ ID NO: 605515 - RNA, 19 nt, Homo sapiens
cauaaugcauuggaacaug

SEQ ID NO: 605516 - RNA, 19 nt, Homo sapiens
guucaacaagcaacauuaa

SEQ ID NO: 605517 - RNA, 19 nt, Homo sapiens
guacagauucuccucuaau

SEQ ID NO: 605518 - RNA, 19 nt, Homo sapiens
ugucaagggauuacuuaua

SEQ ID NO: 605519 - RNA, 19 nt, Homo sapiens
ugacaugagauuaagguuu

SEQ ID NO: 605520 - RNA, 19 nt, Homo sapiens
guacugaagauuaucacuu

SEQ ID NO: 605521 - RNA, 19 nt, Homo sapiens
uugaagaaucuccuuguua

SEQ ID NO: 605522 - RNA, 19 nt, Homo sapiens
gccaacugcuugaagaauc

SEQ ID NO: 605523 - RNA, 19 nt, Homo sapiens
ucuguaggacuuugaauaa

SEQ ID NO: 605524 - RNA, 19 nt, Homo sapiens
gaagaaauaagagacuauc

SEQ ID NO: 605525 - RNA, 19 nt, Homo sapiens
uaguacagauucuccucua

SEQ ID NO: 605526 - RNA, 19 nt, Homo sapiens
caugucaagggauuacuua

SEQ ID NO: 605527 - RNA, 19 nt, Homo sapiens
auaaugcauuggaacauga

SEQ ID NO: 605528 - RNA, 19 nt, Homo sapiens
gauucuagcuuagucuaca

SEQ ID NO: 605529 - RNA, 19 nt, Homo sapiens
gaaaugccaacugcuugaa

SEQ ID NO: 605530 - RNA, 19 nt, Homo sapiens
ccaccagaaauuuaaguuu

SEQ ID NO: 605531 - RNA, 19 nt, Homo sapiens
ucucagguauuucggaugu

SEQ ID NO: 605532 - RNA, 19 nt, Homo sapiens
gagacuaucaucaguacau

SEQ ID NO: 605533 - RNA, 19 nt, Homo sapiens
uugcauaucugggagaaga

SEQ ID NO: 605534 - RNA, 19 nt, Homo sapiens
uuugaaagguguacugcaa

SEQ ID NO: 605535 - RNA, 19 nt, Homo sapiens
uaaccuguccgagaguaua

SEQ ID NO: 605536 - RNA, 19 nt, Homo sapiens
gguacacauuuauuuacug

SEQ ID NO: 605537 - RNA, 19 nt, Homo sapiens
uagaaugaagaccacaaua

SEQ ID NO: 605538 - RNA, 19 nt, Homo sapiens
gagguacacauuuauuuac

SEQ ID NO: 605539 - RNA, 19 nt, Homo sapiens
uauagagagguacacauuu

SEQ ID NO: 605540 - RNA, 19 nt, Homo sapiens
augaagcaaugaagucuau

SEQ ID NO: 605541 - RNA, 19 nt, Homo sapiens
aguuuaaguuuccuuguga

SEQ ID NO: 605542 - RNA, 19 nt, Homo sapiens
ucuuuggacugaauaccua

SEQ ID NO: 605543 - RNA, 19 nt, Homo sapiens
ccaacugcuugaagaaucu

SEQ ID NO: 605544 - RNA, 19 nt, Homo sapiens
cuaagccuauaugaaauga

SEQ ID NO: 605545 - RNA, 19 nt, Homo sapiens
gauagaaugaagaccacaa

SEQ ID NO: 605546 - RNA, 19 nt, Homo sapiens
ccauaauugagaaagcuua

SEQ ID NO: 605547 - RNA, 19 nt, Homo sapiens
uaguuuaaguuuccuugug

SEQ ID NO: 605548 - RNA, 19 nt, Homo sapiens
uuaaaucgccccagaguuu

SEQ ID NO: 605549 - RNA, 19 nt, Homo sapiens
ccuaacuccuccaccagaa

SEQ ID NO: 605550 - RNA, 19 nt, Homo sapiens
agggauuacuuauaacuuc

SEQ ID NO: 605551 - RNA, 19 nt, Homo sapiens
uaagccaguuuuacacuaa

SEQ ID NO: 605552 - RNA, 19 nt, Homo sapiens
cuauaggguuagauguuga

SEQ ID NO: 605553 - RNA, 19 nt, Homo sapiens
cuugaagaaucuccuuguu

SEQ ID NO: 605554 - RNA, 19 nt, Homo sapiens
ggacuuugaauaaugugau

SEQ ID NO: 605555 - RNA, 19 nt, Homo sapiens
agacuaucaucaguacauu

SEQ ID NO: 605556 - RNA, 19 nt, Homo sapiens
auaagagacuaucaucagu

SEQ ID NO: 605557 - RNA, 19 nt, Homo sapiens
guuagauguugagaaauuc

SEQ ID NO: 605558 - RNA, 19 nt, Homo sapiens
cagauucuccucuaauucu

SEQ ID NO: 605559 - RNA, 19 nt, Homo sapiens
aaugccaacugcuugaaga

SEQ ID NO: 605560 - RNA, 19 nt, Homo sapiens
ggagaagaaauaagagacu

SEQ ID NO: 605561 - RNA, 19 nt, Homo sapiens
gcauaucugggagaagaaa

SEQ ID NO: 605562 - RNA, 19 nt, Homo sapiens
auccuuagcucagcaauuc

SEQ ID NO: 605563 - RNA, 19 nt, Homo sapiens
caauugagcugguugaaua

SEQ ID NO: 605564 - RNA, 19 nt, Homo sapiens
gaagcuggguuucuuuaaa

SEQ ID NO: 605565 - RNA, 19 nt, Homo sapiens
gcauaucaccuguauagua

SEQ ID NO: 605566 - RNA, 19 nt, Homo sapiens
guacaaauuugacaacugu

SEQ ID NO: 605567 - RNA, 19 nt, Homo sapiens
gaacugaacagacggagaa

SEQ ID NO: 605568 - RNA, 19 nt, Homo sapiens
gaaagagacgugagacuga

SEQ ID NO: 605569 - RNA, 19 nt, Homo sapiens
cauaugccauuaucucuuu

SEQ ID NO: 605570 - RNA, 19 nt, Homo sapiens
agaguucacuguacaaauu

SEQ ID NO: 605571 - RNA, 19 nt, Homo sapiens
gcggaaagccagaagauuu

SEQ ID NO: 605572 - RNA, 19 nt, Homo sapiens
ucaaagagcaaaucaaaga

SEQ ID NO: 605573 - RNA, 19 nt, Homo sapiens
gaacuugaaaggaggguaa

SEQ ID NO: 605574 - RNA, 19 nt, Homo sapiens
gagcaaaucaaagaacuaa

SEQ ID NO: 605575 - RNA, 19 nt, Homo sapiens
cauaucaccuguauaguag

SEQ ID NO: 605576 - RNA, 19 nt, Homo sapiens
agacugacauaugccauua

SEQ ID NO: 605577 - RNA, 19 nt, Homo sapiens
cauguucucuacacaauug

SEQ ID NO: 605578 - RNA, 19 nt, Homo sapiens
gaaucugccuccacaguca

SEQ ID NO: 605579 - RNA, 19 nt, Homo sapiens
gaacagacggagaagaugu

SEQ ID NO: 605580 - RNA, 19 nt, Homo sapiens
gaaaagccauuugauguau

SEQ ID NO: 605581 - RNA, 19 nt, Homo sapiens
cgauggaucuaggaguuua

SEQ ID NO: 605582 - RNA, 19 nt, Homo sapiens
gaggagguguggacuuuua

SEQ ID NO: 605583 - RNA, 19 nt, Homo sapiens
ucaugcagcuuggcagaua

SEQ ID NO: 605584 - RNA, 19 nt, Homo sapiens
caagugugguagcuauuga

SEQ ID NO: 605585 - RNA, 19 nt, Homo sapiens
auacaaggcugcugguguu

SEQ ID NO: 605586 - RNA, 19 nt, Homo sapiens
ccucaaagagcaaaucaaa

SEQ ID NO: 605587 - RNA, 19 nt, Homo sapiens
ugaaaacgcuucugugaga

SEQ ID NO: 605588 - RNA, 19 nt, Homo sapiens
uaaggugucacuguauuua

SEQ ID NO: 605589 - RNA, 19 nt, Homo sapiens
ugagcugguugaauacuuu

SEQ ID NO: 605590 - RNA, 19 nt, Homo sapiens
uguguaaucugaaaucuag

SEQ ID NO: 605591 - RNA, 19 nt, Homo sapiens
guacugugccucuuucuuc

SEQ ID NO: 605592 - RNA, 19 nt, Homo sapiens
ggcgauggaucuaggaguu

SEQ ID NO: 605593 - RNA, 19 nt, Homo sapiens
uuaagaauuuggcacaguu

SEQ ID NO: 605594 - RNA, 19 nt, Homo sapiens
uaggcuaucuuaccaugaa

SEQ ID NO: 605595 - RNA, 19 nt, Homo sapiens
gcuuauggcuuggagaaau

SEQ ID NO: 605596 - RNA, 19 nt, Homo sapiens
gcacaguuacucacuuugu

SEQ ID NO: 605597 - RNA, 19 nt, Homo sapiens
gaagaugugcuagggagaa

SEQ ID NO: 605598 - RNA, 19 nt, Homo sapiens
ggagaacaaucugcugaag

SEQ ID NO: 605599 - RNA, 19 nt, Homo sapiens
cgagcaagcuauggaucua

SEQ ID NO: 605600 - RNA, 19 nt, Homo sapiens
gugcaagugugguagcuau

SEQ ID NO: 605601 - RNA, 19 nt, Homo sapiens
gaccuaggcuaucuuacca

SEQ ID NO: 605602 - RNA, 19 nt, Homo sapiens
uggcacaguuacucacuuu

SEQ ID NO: 605603 - RNA, 19 nt, Homo sapiens
cuauuuagguuguacagau

SEQ ID NO: 605604 - RNA, 19 nt, Homo sapiens
uaaauuagggcugccguuu

SEQ ID NO: 605605 - RNA, 19 nt, Homo sapiens
gagaacaaucugcugaaga

SEQ ID NO: 605606 - RNA, 19 nt, Homo sapiens
ucacuguauuuaacuguug

SEQ ID NO: 605607 - RNA, 19 nt, Homo sapiens
guaaggugucacuguauuu

SEQ ID NO: 605608 - RNA, 19 nt, Homo sapiens
uguaaggugucacuguauu

SEQ ID NO: 605609 - RNA, 19 nt, Homo sapiens
gguguggacuuuuauauau

SEQ ID NO: 605610 - RNA, 19 nt, Homo sapiens
aaacaauggaugacacaaa

SEQ ID NO: 605611 - RNA, 19 nt, Homo sapiens
aagcuggguuucuuuaaau

SEQ ID NO: 605612 - RNA, 19 nt, Homo sapiens
gcuggguuucuuuaaauua

SEQ ID NO: 605613 - RNA, 19 nt, Homo sapiens
gcacugggauccgcaucug

SEQ ID NO: 605614 - RNA, 19 nt, Homo sapiens
gcaagugugguagcuauug

SEQ ID NO: 605615 - RNA, 19 nt, Homo sapiens
uaucaccuguauaguaguu

SEQ ID NO: 605616 - RNA, 19 nt, Homo sapiens
uaagaauuuggcacaguua

SEQ ID NO: 605617 - RNA, 19 nt, Homo sapiens
cugaggagguguggacuuu

SEQ ID NO: 605618 - RNA, 19 nt, Homo sapiens
ucacuggacucgccucucu

SEQ ID NO: 605619 - RNA, 19 nt, Homo sapiens
gacgugagacugacauaug

SEQ ID NO: 605620 - RNA, 19 nt, Homo sapiens
caaagagcaaaucaaagaa

SEQ ID NO: 605621 - RNA, 19 nt, Homo sapiens
cugagcagcuugcccaguu

SEQ ID NO: 605622 - RNA, 19 nt, Homo sapiens
ucugugagacuugauaaua

SEQ ID NO: 605623 - RNA, 19 nt, Homo sapiens
agaacaaucugcugaagac

SEQ ID NO: 605624 - RNA, 19 nt, Homo sapiens
gagaauuagcauggauaua

SEQ ID NO: 605625 - RNA, 19 nt, Homo sapiens
caauuucuuucuugucauc

SEQ ID NO: 605626 - RNA, 19 nt, Homo sapiens
guagaccaguggcgaugga

SEQ ID NO: 605627 - RNA, 19 nt, Homo sapiens
ccuccacagucacccauuu

SEQ ID NO: 605628 - RNA, 19 nt, Homo sapiens
agacggagaagaugugcua

SEQ ID NO: 605629 - RNA, 19 nt, Homo sapiens
cugcugguguucccucuuu

SEQ ID NO: 605630 - RNA, 19 nt, Homo sapiens
cauuaucucuuuuccagua

SEQ ID NO: 605631 - RNA, 19 nt, Homo sapiens
gagacugacauaugccauu

SEQ ID NO: 605632 - RNA, 19 nt, Homo sapiens
cacagucacccauuucauu

SEQ ID NO: 605633 - RNA, 19 nt, Homo sapiens
gagaaucugccuccacagu

SEQ ID NO: 605634 - RNA, 19 nt, Homo sapiens
agaauuagcauggauauac

SEQ ID NO: 605635 - RNA, 19 nt, Homo sapiens
cuuauggcuuggagaaauu

SEQ ID NO: 605636 - RNA, 19 nt, Homo sapiens
auuguaaggugucacugua

SEQ ID NO: 605637 - RNA, 19 nt, Homo sapiens
gaguucacuguacaaauuu

SEQ ID NO: 605638 - RNA, 19 nt, Homo sapiens
gauguaugcggucagagaa

SEQ ID NO: 605639 - RNA, 19 nt, Homo sapiens
gguagcuauugacaacaaa

SEQ ID NO: 605640 - RNA, 19 nt, Homo sapiens
ucaccuguauaguaguuau

SEQ ID NO: 605641 - RNA, 19 nt, Homo sapiens
gaauuagcauggauauacc

SEQ ID NO: 605642 - RNA, 19 nt, Homo sapiens
guauuaaacacucauaugc

SEQ ID NO: 605643 - RNA, 19 nt, Homo sapiens
gggcugccguuuucuguuu

SEQ ID NO: 605644 - RNA, 19 nt, Homo sapiens
gugccucuuucuucucaaa

SEQ ID NO: 605645 - RNA, 19 nt, Homo sapiens
gcgcuuaguguccuacaug

SEQ ID NO: 605646 - RNA, 19 nt, Homo sapiens
ugacauaugccauuaucuc

SEQ ID NO: 605647 - RNA, 19 nt, Homo sapiens
gaucaucaagcccuagaag

SEQ ID NO: 605648 - RNA, 19 nt, Homo sapiens
ugagcagcuugcccaguuu

SEQ ID NO: 605649 - RNA, 19 nt, Homo sapiens
uuucuuaguugggugaauu

SEQ ID NO: 605650 - RNA, 19 nt, Homo sapiens
ggaucuaggaguuuaccaa

SEQ ID NO: 605651 - RNA, 19 nt, Homo sapiens
gcugggaccuaggcuaucu

SEQ ID NO: 605652 - RNA, 19 nt, Homo sapiens
ucgcagggcucaggaccaa

SEQ ID NO: 605653 - RNA, 19 nt, Homo sapiens
caagcuauggaucuaguga

SEQ ID NO: 605654 - RNA, 19 nt, Homo sapiens
uuuaccaacugagacauuu

SEQ ID NO: 605655 - RNA, 19 nt, Homo sapiens
gguuguacagauugaaauu

SEQ ID NO: 605656 - RNA, 19 nt, Homo sapiens
cugugagacuugauaauag

SEQ ID NO: 605657 - RNA, 19 nt, Homo sapiens
gaagguuguuuugcuuauu

SEQ ID NO: 605658 - RNA, 19 nt, Homo sapiens
ugaaaagccauuugaugua

SEQ ID NO: 605659 - RNA, 19 nt, Homo sapiens
ugugguagcuauugacaac

SEQ ID NO: 605660 - RNA, 19 nt, Homo sapiens
gaauuuggcacaguuacuc

SEQ ID NO: 605661 - RNA, 19 nt, Homo sapiens
caauaguacugugccucuu

SEQ ID NO: 605662 - RNA, 19 nt, Homo sapiens
gagacgugagacugacaua

SEQ ID NO: 605663 - RNA, 19 nt, Homo sapiens
uaaggaagcuggauuaauu

SEQ ID NO: 605664 - RNA, 19 nt, Homo sapiens
gaacagaagcuccaggaua

SEQ ID NO: 605665 - RNA, 19 nt, Homo sapiens
gcaauuggauacuuuaaga

SEQ ID NO: 605666 - RNA, 19 nt, Homo sapiens
gcaaauaauugucagucua

SEQ ID NO: 605667 - RNA, 19 nt, Homo sapiens
gcaauucccucaaccagaa

SEQ ID NO: 605668 - RNA, 19 nt, Homo sapiens
ccaauauccuggagaaauu

SEQ ID NO: 605669 - RNA, 19 nt, Homo sapiens
gaacagacuccugggaaua

SEQ ID NO: 605670 - RNA, 19 nt, Homo sapiens
cuacgugucuaagaaauua

SEQ ID NO: 605671 - RNA, 19 nt, Homo sapiens
ucacacggcucgucuuuga

SEQ ID NO: 605672 - RNA, 19 nt, Homo sapiens
ugaauaacuuugugcagua

SEQ ID NO: 605673 - RNA, 19 nt, Homo sapiens
gauguggaauaucucuuua

SEQ ID NO: 605674 - RNA, 19 nt, Homo sapiens
gaagcuggauuaauugaca

SEQ ID NO: 605675 - RNA, 19 nt, Homo sapiens
ccaagaaacuggagaaacu

SEQ ID NO: 605676 - RNA, 19 nt, Homo sapiens
cagcgagucuuuaccaauu

SEQ ID NO: 605677 - RNA, 19 nt, Homo sapiens
uaucaaggauuaugaagga

SEQ ID NO: 605678 - RNA, 19 nt, Homo sapiens
gcagaugaauaugcaauug

SEQ ID NO: 605679 - RNA, 19 nt, Homo sapiens
guugaaggcucuuuggaaa

SEQ ID NO: 605680 - RNA, 19 nt, Homo sapiens
gagguuaugucuaccauca

SEQ ID NO: 605681 - RNA, 19 nt, Homo sapiens
cgaggagucuuguaaaugu

SEQ ID NO: 605682 - RNA, 19 nt, Homo sapiens
ucacauaugcagaugaaua

SEQ ID NO: 605683 - RNA, 19 nt, Homo sapiens
gaaaggcaaacaauaguug

SEQ ID NO: 605684 - RNA, 19 nt, Homo sapiens
gguacuacgugucuaagaa

SEQ ID NO: 605685 - RNA, 19 nt, Homo sapiens
gauaaacugccucuugaaa

SEQ ID NO: 605686 - RNA, 19 nt, Homo sapiens
gaacaagcaagacaggaaa

SEQ ID NO: 605687 - RNA, 19 nt, Homo sapiens
gcuagaagaagaaguauau

SEQ ID NO: 605688 - RNA, 19 nt, Homo sapiens
gagccgaccugcagcaaau

SEQ ID NO: 605689 - RNA, 19 nt, Homo sapiens
cuacaaaugugccaauauc

SEQ ID NO: 605690 - RNA, 19 nt, Homo sapiens
aacagaagcuccaggauau

SEQ ID NO: 605691 - RNA, 19 nt, Homo sapiens
cgacagauuccuauagaaa

SEQ ID NO: 605692 - RNA, 19 nt, Homo sapiens
ugaaggagccacuuuaaug

SEQ ID NO: 605693 - RNA, 19 nt, Homo sapiens
gaacucuaauccucacuca

SEQ ID NO: 605694 - RNA, 19 nt, Homo sapiens
gcagaaggagauaauuaaa

SEQ ID NO: 605695 - RNA, 19 nt, Homo sapiens
acaagaagauccugaugug

SEQ ID NO: 605696 - RNA, 19 nt, Homo sapiens
caaagccucuucuggacuu

SEQ ID NO: 605697 - RNA, 19 nt, Homo sapiens
aaagagaacuacacaaggu

SEQ ID NO: 605698 - RNA, 19 nt, Homo sapiens
gaauuaaucaacgagguua

SEQ ID NO: 605699 - RNA, 19 nt, Homo sapiens
ggaagaagaugcagauacc

SEQ ID NO: 605700 - RNA, 19 nt, Homo sapiens
gagagugaauacuacaaau

SEQ ID NO: 605701 - RNA, 19 nt, Homo sapiens
gaggagucuuguaaaugua

SEQ ID NO: 605702 - RNA, 19 nt, Homo sapiens
uaaaccgcaucaacuauug

SEQ ID NO: 605703 - RNA, 19 nt, Homo sapiens
cagaagcuccaggauauua

SEQ ID NO: 605704 - RNA, 19 nt, Homo sapiens
gcaaacaauaguugaguug

SEQ ID NO: 605705 - RNA, 19 nt, Homo sapiens
uaaauguaauggcuggaaa

SEQ ID NO: 605706 - RNA, 19 nt, Homo sapiens
gugaacgccucaagaauag

SEQ ID NO: 605707 - RNA, 19 nt, Homo sapiens
aaagauggccguguuauug

SEQ ID NO: 605708 - RNA, 19 nt, Homo sapiens
gaagaagaaguauauaguc

SEQ ID NO: 605709 - RNA, 19 nt, Homo sapiens
ggaacaagcaagacaggaa

SEQ ID NO: 605710 - RNA, 19 nt, Homo sapiens
guacaacgccgcugagagu

SEQ ID NO: 605711 - RNA, 19 nt, Homo sapiens
gcacaaauucgaaaaguuu

SEQ ID NO: 605712 - RNA, 19 nt, Homo sapiens
aagcagaaggagauaauua

SEQ ID NO: 605713 - RNA, 19 nt, Homo sapiens
aaagaaaggcaaacaauag

SEQ ID NO: 605714 - RNA, 19 nt, Homo sapiens
ggauguggaauaucucuuu

SEQ ID NO: 605715 - RNA, 19 nt, Homo sapiens
caagguggcuguguuacug

SEQ ID NO: 605716 - RNA, 19 nt, Homo sapiens
gaaggagccacuuuaaugg

SEQ ID NO: 605717 - RNA, 19 nt, Homo sapiens
ucaacgagguuaugucuac

SEQ ID NO: 605718 - RNA, 19 nt, Homo sapiens
gaacagggugugaauaacu

SEQ ID NO: 605719 - RNA, 19 nt, Homo sapiens
uggauuaauugacaaguga

SEQ ID NO: 605720 - RNA, 19 nt, Homo sapiens
ccucacauaugcagaugaa

SEQ ID NO: 605721 - RNA, 19 nt, Homo sapiens
ggaauuaaucaacgagguu

SEQ ID NO: 605722 - RNA, 19 nt, Homo sapiens
agacugcgaucucccaaug

SEQ ID NO: 605723 - RNA, 19 nt, Homo sapiens
caacgccgcugagagugaa

SEQ ID NO: 605724 - RNA, 19 nt, Homo sapiens
gaugauauuucuggauaca

SEQ ID NO: 605725 - RNA, 19 nt, Homo sapiens
ggaguucgacagauuccua

SEQ ID NO: 605726 - RNA, 19 nt, Homo sapiens
uuaaugggaugugagcuaa

SEQ ID NO: 605727 - RNA, 19 nt, Homo sapiens
ggcaaacaauaguugaguu

SEQ ID NO: 605728 - RNA, 19 nt, Homo sapiens
gagugaauacuacaaaugu

SEQ ID NO: 605729 - RNA, 19 nt, Homo sapiens
guacuacgugucuaagaaa

SEQ ID NO: 605730 - RNA, 19 nt, Homo sapiens
agugaacgccucaagaaua

SEQ ID NO: 605731 - RNA, 19 nt, Homo sapiens
uccaggauauuaugaaguu

SEQ ID NO: 605732 - RNA, 19 nt, Homo sapiens
cauggaaccugugaagaga

SEQ ID NO: 605733 - RNA, 19 nt, Homo sapiens
ggaacacaccugaugaauc

SEQ ID NO: 605734 - RNA, 19 nt, Homo sapiens
uaaagauggccguguuauu

SEQ ID NO: 605735 - RNA, 19 nt, Homo sapiens
acacaaaacccuugcuuua

SEQ ID NO: 605736 - RNA, 19 nt, Homo sapiens
cuaggcauccaaacaguua

SEQ ID NO: 605737 - RNA, 19 nt, Homo sapiens
gccgaggagucuuguaaau

SEQ ID NO: 605738 - RNA, 19 nt, Homo sapiens
uuggcuauaucaaggauua

SEQ ID NO: 605739 - RNA, 19 nt, Homo sapiens
cagagacccugaccagcuu

SEQ ID NO: 605740 - RNA, 19 nt, Homo sapiens
agauggaguucgacagauu

SEQ ID NO: 605741 - RNA, 19 nt, Homo sapiens
caaaacccuugcuuuaauu

SEQ ID NO: 605742 - RNA, 19 nt, Homo sapiens
gggaugaggcggcaagguu

SEQ ID NO: 605743 - RNA, 19 nt, Homo sapiens
uuuaagcucuugagaaagu

SEQ ID NO: 605744 - RNA, 19 nt, Homo sapiens
cuuagaaacucaccaagca

SEQ ID NO: 605745 - RNA, 19 nt, Homo sapiens
gugccaauauccuggagaa

SEQ ID NO: 605746 - RNA, 19 nt, Homo sapiens
guucccaucucaaggauuc

SEQ ID NO: 605747 - RNA, 19 nt, Homo sapiens
ggagaaaagaggaaaauga

SEQ ID NO: 605748 - RNA, 19 nt, Homo sapiens
acccuggacuuucauguuu

SEQ ID NO: 605749 - RNA, 19 nt, Homo sapiens
gcucgucuuugacccgaaa

SEQ ID NO: 605750 - RNA, 19 nt, Homo sapiens
caugcuagaagaagaagua

SEQ ID NO: 605751 - RNA, 19 nt, Homo sapiens
ggcaccaucucaacgaaga

SEQ ID NO: 605752 - RNA, 19 nt, Homo sapiens
uuagucaccugccagcaaa

SEQ ID NO: 605753 - RNA, 19 nt, Homo sapiens
gaauaacuuugugcaguac

SEQ ID NO: 605754 - RNA, 19 nt, Homo sapiens
gaauagguacuacgugucu

SEQ ID NO: 605755 - RNA, 19 nt, Homo sapiens
ccacuuuaaugggauguga

SEQ ID NO: 605756 - RNA, 19 nt, Homo sapiens
aauuaaagauggccguguu

SEQ ID NO: 605757 - RNA, 19 nt, Homo sapiens
gaggcaccaucucaacgaa

SEQ ID NO: 605758 - RNA, 19 nt, Homo sapiens
ccgcugagagugaauacua

SEQ ID NO: 605759 - RNA, 19 nt, Homo sapiens
ugaacagacuccugggaau

SEQ ID NO: 605760 - RNA, 19 nt, Homo sapiens
uaugaaggagccacuuuaa

SEQ ID NO: 605761 - RNA, 19 nt, Homo sapiens
ggcgacaacuccuggaaca

SEQ ID NO: 605762 - RNA, 19 nt, Homo sapiens
caacgaagacugcgaucuc

SEQ ID NO: 605763 - RNA, 19 nt, Homo sapiens
caaagaugcugcagauaaa

SEQ ID NO: 605764 - RNA, 19 nt, Homo sapiens
ucacgcaccucaacaauga

SEQ ID NO: 605765 - RNA, 19 nt, Homo sapiens
gcucaaagaugcugcagau

SEQ ID NO: 605766 - RNA, 19 nt, Homo sapiens
ucaaagaugcugcagauaa

SEQ ID NO: 605767 - RNA, 19 nt, Homo sapiens
gcgccaaccuguccacauu

SEQ ID NO: 605768 - RNA, 19 nt, Homo sapiens
cgucauggcucaaggauuc

SEQ ID NO: 605769 - RNA, 19 nt, Homo sapiens
gcucaaggauucaaugcau

SEQ ID NO: 605770 - RNA, 19 nt, Homo sapiens
gaagaagaacuccaagaag

SEQ ID NO: 605771 - RNA, 19 nt, Homo sapiens
ggaaggccacgcuguuuga

SEQ ID NO: 605772 - RNA, 19 nt, Homo sapiens
gcaagaacgccaaggacaa

SEQ ID NO: 605773 - RNA, 19 nt, Homo sapiens
acaaugagaaccugaagaa

SEQ ID NO: 605774 - RNA, 19 nt, Homo sapiens
agaagaagaacuccaagaa

SEQ ID NO: 605775 - RNA, 19 nt, Homo sapiens
ccaagaagaagaacuccaa

SEQ ID NO: 605776 - RNA, 19 nt, Homo sapiens
ucaaggauucaaugcauuu

SEQ ID NO: 605777 - RNA, 19 nt, Homo sapiens
ccaacguggucuuccucua

SEQ ID NO: 605778 - RNA, 19 nt, Homo sapiens
caacaucacgcaccucaac

SEQ ID NO: 605779 - RNA, 19 nt, Homo sapiens
caagaagcggcuccuccua

SEQ ID NO: 605780 - RNA, 19 nt, Homo sapiens
gcagcuaccagaacaacau

SEQ ID NO: 605781 - RNA, 19 nt, Homo sapiens
ucuccgaccugaagaacga

SEQ ID NO: 605782 - RNA, 19 nt, Homo sapiens
uaaaugccgacccacacua

SEQ ID NO: 605783 - RNA, 19 nt, Homo sapiens
gaccguugccucucuguca

SEQ ID NO: 605784 - RNA, 19 nt, Homo sapiens
caacguggucuuccucuac

SEQ ID NO: 605785 - RNA, 19 nt, Homo sapiens
ccaaggacaagaaccugaa

SEQ ID NO: 605786 - RNA, 19 nt, Homo sapiens
augagaaccugaagaaguc

SEQ ID NO: 605787 - RNA, 19 nt, Homo sapiens
aaugagaaccugaagaagu

SEQ ID NO: 605788 - RNA, 19 nt, Homo sapiens
gugcugccuuggaagagaa

SEQ ID NO: 605789 - RNA, 19 nt, Homo sapiens
gaagcgccacuccaucauc

SEQ ID NO: 605790 - RNA, 19 nt, Homo sapiens
caagaacgccaaggacaag

SEQ ID NO: 605791 - RNA, 19 nt, Homo sapiens
ccucaugagcucaaagaug

SEQ ID NO: 605792 - RNA, 19 nt, Homo sapiens
gccuguaccucuccuacuc

SEQ ID NO: 605793 - RNA, 19 nt, Homo sapiens
caacaaugagaaccugaag

SEQ ID NO: 605794 - RNA, 19 nt, Homo sapiens
aacagcagcuaccagaaca

SEQ ID NO: 605795 - RNA, 19 nt, Homo sapiens
ucuccgugcugccuuggaa

SEQ ID NO: 605796 - RNA, 19 nt, Homo sapiens
cacuguagccugcgucaug

SEQ ID NO: 605797 - RNA, 19 nt, Homo sapiens
cuacaugggcaacgagauc

SEQ ID NO: 605798 - RNA, 19 nt, Homo sapiens
cucaaggauucaaugcauu

SEQ ID NO: 605799 - RNA, 19 nt, Homo sapiens
gaacgccaaggacaagaac

SEQ ID NO: 605800 - RNA, 19 nt, Homo sapiens
ucaacaaugagaaccugaa

SEQ ID NO: 605801 - RNA, 19 nt, Homo sapiens
caucacgcaccucaacaau

SEQ ID NO: 605802 - RNA, 19 nt, Homo sapiens
cggaaggccacgcuguuug

SEQ ID NO: 605803 - RNA, 19 nt, Homo sapiens
gcaggaccagggcuucauc

SEQ ID NO: 605804 - RNA, 19 nt, Homo sapiens
aagaagaagaacuccaaga

SEQ ID NO: 605805 - RNA, 19 nt, Homo sapiens
gaaagucggugaacacauu

SEQ ID NO: 605806 - RNA, 19 nt, Homo sapiens
caugaaagcugaaaugaaa

SEQ ID NO: 605807 - RNA, 19 nt, Homo sapiens
gaagaagacuguccugguu

SEQ ID NO: 605808 - RNA, 19 nt, Homo sapiens
ugaagaaccugcauaauau

SEQ ID NO: 605809 - RNA, 19 nt, Homo sapiens
gaacagaccucaaaaccua

SEQ ID NO: 605810 - RNA, 19 nt, Homo sapiens
caagauugcuucugaaaug

SEQ ID NO: 605811 - RNA, 19 nt, Homo sapiens
ucagugaucuccagaagua

SEQ ID NO: 605812 - RNA, 19 nt, Homo sapiens
aaucagugcucuacaaaua

SEQ ID NO: 605813 - RNA, 19 nt, Homo sapiens
ucaacaaacugggaaauaa

SEQ ID NO: 605814 - RNA, 19 nt, Homo sapiens
gcaaggggcucaugguuua

SEQ ID NO: 605815 - RNA, 19 nt, Homo sapiens
uguaagaggugucaacaaa

SEQ ID NO: 605816 - RNA, 19 nt, Homo sapiens
gcaguugccugugaaugua

SEQ ID NO: 605817 - RNA, 19 nt, Homo sapiens
ccaauacacuugagcaguu

SEQ ID NO: 605818 - RNA, 19 nt, Homo sapiens
gaucaaugcuuccacagau

SEQ ID NO: 605819 - RNA, 19 nt, Homo sapiens
gggcaaagauacaugugaa

SEQ ID NO: 605820 - RNA, 19 nt, Homo sapiens
caaacaagcucccucugau

SEQ ID NO: 605821 - RNA, 19 nt, Homo sapiens
ugaaacaacuagaaucuca

SEQ ID NO: 605822 - RNA, 19 nt, Homo sapiens
gaucaggaccggaaaguga

SEQ ID NO: 605823 - RNA, 19 nt, Homo sapiens
ggaaucagagucuugaauu

SEQ ID NO: 605824 - RNA, 19 nt, Homo sapiens
gaacaaagagagaaucagu

SEQ ID NO: 605825 - RNA, 19 nt, Homo sapiens
acaaugaugucugaugaua

SEQ ID NO: 605826 - RNA, 19 nt, Homo sapiens
cuacaaugaugucugauga

SEQ ID NO: 605827 - RNA, 19 nt, Homo sapiens
caagcagccucggcaaaua

SEQ ID NO: 605828 - RNA, 19 nt, Homo sapiens
caagcgaacgggcaauuua

SEQ ID NO: 605829 - RNA, 19 nt, Homo sapiens
ugacaaagcggaagaacaa

SEQ ID NO: 605830 - RNA, 19 nt, Homo sapiens
gugaacacauucucaaaga

SEQ ID NO: 605831 - RNA, 19 nt, Homo sapiens
gcucaugguuuaugcaaau

SEQ ID NO: 605832 - RNA, 19 nt, Homo sapiens
aaaccuacgucuagaaaug

SEQ ID NO: 605833 - RNA, 19 nt, Homo sapiens
caaggacacugagaagaaa

SEQ ID NO: 605834 - RNA, 19 nt, Homo sapiens
caacaaacugggaaauaaa

SEQ ID NO: 605835 - RNA, 19 nt, Homo sapiens
gcaugaagaaccugcauaa

SEQ ID NO: 605836 - RNA, 19 nt, Homo sapiens
ccgacuaucuucucuggua

SEQ ID NO: 605837 - RNA, 19 nt, Homo sapiens
ccacagaacuaucaagacu

SEQ ID NO: 605838 - RNA, 19 nt, Homo sapiens
agaaacugcuuaaugagaa

SEQ ID NO: 605839 - RNA, 19 nt, Homo sapiens
gagcaaaaguggagacaaa

SEQ ID NO: 605840 - RNA, 19 nt, Homo sapiens
ccugugagcugauccuuga

SEQ ID NO: 605841 - RNA, 19 nt, Homo sapiens
cagggaagguggccagaaa

SEQ ID NO: 605842 - RNA, 19 nt, Homo sapiens
ucagaguacucaauaugaa

SEQ ID NO: 605843 - RNA, 19 nt, Homo sapiens
gaagaaccugcauaauauu

SEQ ID NO: 605844 - RNA, 19 nt, Homo sapiens
gagauuguguccgauuuga

SEQ ID NO: 605845 - RNA, 19 nt, Homo sapiens
gagagagagcaaagaauuu

SEQ ID NO: 605846 - RNA, 19 nt, Homo sapiens
gcauccaaaucaacaagaa

SEQ ID NO: 605847 - RNA, 19 nt, Homo sapiens
augaagaaccugcauaaua

SEQ ID NO: 605848 - RNA, 19 nt, Homo sapiens
cagauucacuggccaagga

SEQ ID NO: 605849 - RNA, 19 nt, Homo sapiens
caagguggcuaccaaagca

SEQ ID NO: 605850 - RNA, 19 nt, Homo sapiens
agagaaaucuguucaacca

SEQ ID NO: 605851 - RNA, 19 nt, Homo sapiens
gaacugacagcugcagaaa

SEQ ID NO: 605852 - RNA, 19 nt, Homo sapiens
gauugcagccucccaguuu

SEQ ID NO: 605853 - RNA, 19 nt, Homo sapiens
uucagaaacugcuuaauga

SEQ ID NO: 605854 - RNA, 19 nt, Homo sapiens
caucacagcauccaaauca

SEQ ID NO: 605855 - RNA, 19 nt, Homo sapiens
gauggucucucucaugaag

SEQ ID NO: 605856 - RNA, 19 nt, Homo sapiens
cuucugaaauggccuauga

SEQ ID NO: 605857 - RNA, 19 nt, Homo sapiens
gaacgggcaauuuauagau

SEQ ID NO: 605858 - RNA, 19 nt, Homo sapiens
gcaaagauacaugugaaga

SEQ ID NO: 605859 - RNA, 19 nt, Homo sapiens
gcucagaaggcaacuuaaa

SEQ ID NO: 605860 - RNA, 19 nt, Homo sapiens
ggacaaaggcaaaaugaaa

SEQ ID NO: 605861 - RNA, 19 nt, Homo sapiens
auaaggaaaucaaggagaa

SEQ ID NO: 605862 - RNA, 19 nt, Homo sapiens
gugaugaagcucugccuua

SEQ ID NO: 605863 - RNA, 19 nt, Homo sapiens
caaagauacaugugaagaa

SEQ ID NO: 605864 - RNA, 19 nt, Homo sapiens
cccuuaagcugauccagua

SEQ ID NO: 605865 - RNA, 19 nt, Homo sapiens
acugacagcugcagaaaug

SEQ ID NO: 605866 - RNA, 19 nt, Homo sapiens
cagcucagaaggcaacuua

SEQ ID NO: 605867 - RNA, 19 nt, Homo sapiens
uaagaggugucaacaaacu

SEQ ID NO: 605868 - RNA, 19 nt, Homo sapiens
caagaggucaugaaguuug

SEQ ID NO: 605869 - RNA, 19 nt, Homo sapiens
aauaaucagugcucuacaa

SEQ ID NO: 605870 - RNA, 19 nt, Homo sapiens
cuaaccaucuggaaccaaa

SEQ ID NO: 605871 - RNA, 19 nt, Homo sapiens
ucaaggacacugagaagaa

SEQ ID NO: 605872 - RNA, 19 nt, Homo sapiens
ucugucauaugcaucuuua

SEQ ID NO: 605873 - RNA, 19 nt, Homo sapiens
caagagaaaucuguucaac

SEQ ID NO: 605874 - RNA, 19 nt, Homo sapiens
auacuacaaugaugucuga

SEQ ID NO: 605875 - RNA, 19 nt, Homo sapiens
gaaccugcauaauauuacu

SEQ ID NO: 605876 - RNA, 19 nt, Homo sapiens
ccgauuugauugauucuug

SEQ ID NO: 605877 - RNA, 19 nt, Homo sapiens
ggaaaucaaggagaaguug

SEQ ID NO: 605878 - RNA, 19 nt, Homo sapiens
acacagagggcgaauauca

SEQ ID NO: 605879 - RNA, 19 nt, Homo sapiens
gauaugcuuugucgaugug

SEQ ID NO: 605880 - RNA, 19 nt, Homo sapiens
gcugcucgcuaaccuguga

SEQ ID NO: 605881 - RNA, 19 nt, Homo sapiens
ccaggagcaucaagaacuu

SEQ ID NO: 605882 - RNA, 19 nt, Homo sapiens
ugucaaacaucguucuaau

SEQ ID NO: 605883 - RNA, 19 nt, Homo sapiens
caaagcaugcagcaauaaa

SEQ ID NO: 605884 - RNA, 19 nt, Homo sapiens
gugaggagaaggagacuaa

SEQ ID NO: 605885 - RNA, 19 nt, Homo sapiens
gauuguguccgauuugauu

SEQ ID NO: 605886 - RNA, 19 nt, Homo sapiens
agagagagagcaaagaauu

SEQ ID NO: 605887 - RNA, 19 nt, Homo sapiens
uguaggaggucuucuucaa

SEQ ID NO: 605888 - RNA, 19 nt, Homo sapiens
ugaugaagcucugccuuau

SEQ ID NO: 605889 - RNA, 19 nt, Homo sapiens
aaagauacaugugaagaag

SEQ ID NO: 605890 - RNA, 19 nt, Homo sapiens
aggagaaguuggaagguaa

SEQ ID NO: 605891 - RNA, 19 nt, Homo sapiens
cgacuaucuucucugguaa

SEQ ID NO: 605892 - RNA, 19 nt, Homo sapiens
gaucaagugaacauagauu

SEQ ID NO: 605893 - RNA, 19 nt, Homo sapiens
ucaaacaagcucccucuga

SEQ ID NO: 605894 - RNA, 19 nt, Homo sapiens
ugggaaagguggccaggaa

SEQ ID NO: 605895 - RNA, 19 nt, Homo sapiens
ucaugaaguuugccaagga

SEQ ID NO: 605896 - RNA, 19 nt, Homo sapiens
gcucagaguacucaauaug

SEQ ID NO: 605897 - RNA, 19 nt, Homo sapiens
cagcaucugugguccugaa

SEQ ID NO: 605898 - RNA, 19 nt, Homo sapiens
ccagagagagagcaaagaa

SEQ ID NO: 605899 - RNA, 19 nt, Homo sapiens
ucuuggacaugaaguaauu

SEQ ID NO: 605900 - RNA, 19 nt, Homo sapiens
gcaagcgaacgggcaauuu

SEQ ID NO: 605901 - RNA, 19 nt, Homo sapiens
ugaauucuccaccaugaaa

SEQ ID NO: 605902 - RNA, 19 nt, Homo sapiens
gaucccaaaugcaggaauc

SEQ ID NO: 605903 - RNA, 19 nt, Homo sapiens
agaaguaugccuuggguuu

SEQ ID NO: 605904 - RNA, 19 nt, Homo sapiens
ugacuccucuucaucuuag

SEQ ID NO: 605905 - RNA, 19 nt, Homo sapiens
gaaagucggugaacacauu

SEQ ID NO: 605906 - RNA, 19 nt, Homo sapiens
caugaaagcugaaaugaaa

SEQ ID NO: 605907 - RNA, 19 nt, Homo sapiens
gaagaagacuguccugguu

SEQ ID NO: 605908 - RNA, 19 nt, Homo sapiens
caagaugucugaugauauu

SEQ ID NO: 605909 - RNA, 19 nt, Homo sapiens
ugaagaaccugcauaauau

SEQ ID NO: 605910 - RNA, 19 nt, Homo sapiens
gaacagaccucaaaaccua

SEQ ID NO: 605911 - RNA, 19 nt, Homo sapiens
caagauugcuucugaaaug

SEQ ID NO: 605912 - RNA, 19 nt, Homo sapiens
ucagugaucuccagaagua

SEQ ID NO: 605913 - RNA, 19 nt, Homo sapiens
aaucagugcucuacaaaua

SEQ ID NO: 605914 - RNA, 19 nt, Homo sapiens
ucaacaaacugggaaauaa

SEQ ID NO: 605915 - RNA, 19 nt, Homo sapiens
gcaaggggcucaugguuua

SEQ ID NO: 605916 - RNA, 19 nt, Homo sapiens
uguaagaggugucaacaaa

SEQ ID NO: 605917 - RNA, 19 nt, Homo sapiens
gcaguugccugugaaugua

SEQ ID NO: 605918 - RNA, 19 nt, Homo sapiens
ccaauacacuugagcaguu

SEQ ID NO: 605919 - RNA, 19 nt, Homo sapiens
gaucaaugcuuccacagau

SEQ ID NO: 605920 - RNA, 19 nt, Homo sapiens
gggcaaagauacaugugaa

SEQ ID NO: 605921 - RNA, 19 nt, Homo sapiens
caaacaagcucccucugau

SEQ ID NO: 605922 - RNA, 19 nt, Homo sapiens
ugaaacaacuagaaucuca

SEQ ID NO: 605923 - RNA, 19 nt, Homo sapiens
gaucaggaccggaaaguga

SEQ ID NO: 605924 - RNA, 19 nt, Homo sapiens
ggaaucagagucuugaauu

SEQ ID NO: 605925 - RNA, 19 nt, Homo sapiens
gaacaaagagagaaucagu

SEQ ID NO: 605926 - RNA, 19 nt, Homo sapiens
caagcagccucggcaaaua

SEQ ID NO: 605927 - RNA, 19 nt, Homo sapiens
caagcgaacgggcaauuua

SEQ ID NO: 605928 - RNA, 19 nt, Homo sapiens
ugacaaagcggaagaacaa

SEQ ID NO: 605929 - RNA, 19 nt, Homo sapiens
gugaacacauucucaaaga

SEQ ID NO: 605930 - RNA, 19 nt, Homo sapiens
gcucaugguuuaugcaaau

SEQ ID NO: 605931 - RNA, 19 nt, Homo sapiens
aaaccuacgucuagaaaug

SEQ ID NO: 605932 - RNA, 19 nt, Homo sapiens
caaggacacugagaagaaa

SEQ ID NO: 605933 - RNA, 19 nt, Homo sapiens
caacaaacugggaaauaaa

SEQ ID NO: 605934 - RNA, 19 nt, Homo sapiens
gcaugaagaaccugcauaa

SEQ ID NO: 605935 - RNA, 19 nt, Homo sapiens
gaacuuggcacuucucagu

SEQ ID NO: 605936 - RNA, 19 nt, Homo sapiens
ccgacuaucuucucuggua

SEQ ID NO: 605937 - RNA, 19 nt, Homo sapiens
ccacagaacuaucaagacu

SEQ ID NO: 605938 - RNA, 19 nt, Homo sapiens
agaaacugcuuaaugagaa

SEQ ID NO: 605939 - RNA, 19 nt, Homo sapiens
gagcaaaaguggagacaaa

SEQ ID NO: 605940 - RNA, 19 nt, Homo sapiens
ccugugagcugauccuuga

SEQ ID NO: 605941 - RNA, 19 nt, Homo sapiens
cagggaagguggccagaaa

SEQ ID NO: 605942 - RNA, 19 nt, Homo sapiens
ucagaguacucaauaugaa

SEQ ID NO: 605943 - RNA, 19 nt, Homo sapiens
gaagaaccugcauaauauu

SEQ ID NO: 605944 - RNA, 19 nt, Homo sapiens
gagauuguguccgauuuga

SEQ ID NO: 605945 - RNA, 19 nt, Homo sapiens
gagagagagcaaagaauuu

SEQ ID NO: 605946 - RNA, 19 nt, Homo sapiens
augaagaaccugcauaaua

SEQ ID NO: 605947 - RNA, 19 nt, Homo sapiens
cagauucacuggccaagga

SEQ ID NO: 605948 - RNA, 19 nt, Homo sapiens
caagguggcuaccaaagca

SEQ ID NO: 605949 - RNA, 19 nt, Homo sapiens
agagaaaucuguucaacca

SEQ ID NO: 605950 - RNA, 19 nt, Homo sapiens
gaacugacagcugcagaaa

SEQ ID NO: 605951 - RNA, 19 nt, Homo sapiens
gauugcagccucccaguuu

SEQ ID NO: 605952 - RNA, 19 nt, Homo sapiens
uucagaaacugcuuaauga

SEQ ID NO: 605953 - RNA, 19 nt, Homo sapiens
gauggucucucucaugaag

SEQ ID NO: 605954 - RNA, 19 nt, Homo sapiens
cuucugaaauggccuauga

SEQ ID NO: 605955 - RNA, 19 nt, Homo sapiens
gaacgggcaauuuauagau

SEQ ID NO: 605956 - RNA, 19 nt, Homo sapiens
gcaaagauacaugugaaga

SEQ ID NO: 605957 - RNA, 19 nt, Homo sapiens
gcucagaaggcaacuuaaa

SEQ ID NO: 605958 - RNA, 19 nt, Homo sapiens
ggacaaaggcaaaaugaaa

SEQ ID NO: 605959 - RNA, 19 nt, Homo sapiens
auaaggaaaucaaggagaa

SEQ ID NO: 605960 - RNA, 19 nt, Homo sapiens
gugaugaagcucugccuua

SEQ ID NO: 605961 - RNA, 19 nt, Homo sapiens
caaagauacaugugaagaa

SEQ ID NO: 605962 - RNA, 19 nt, Homo sapiens
cccuuaagcugauccagua

SEQ ID NO: 605963 - RNA, 19 nt, Homo sapiens
acugacagcugcagaaaug

SEQ ID NO: 605964 - RNA, 19 nt, Homo sapiens
cagcucagaaggcaacuua

SEQ ID NO: 605965 - RNA, 19 nt, Homo sapiens
uaagaggugucaacaaacu

SEQ ID NO: 605966 - RNA, 19 nt, Homo sapiens
caagaggucaugaaguuug

SEQ ID NO: 605967 - RNA, 19 nt, Homo sapiens
aauaaucagugcucuacaa

SEQ ID NO: 605968 - RNA, 19 nt, Homo sapiens
cuaaccaucuggaaccaaa

SEQ ID NO: 605969 - RNA, 19 nt, Homo sapiens
ucaaggacacugagaagaa

SEQ ID NO: 605970 - RNA, 19 nt, Homo sapiens
ucugucauaugcaucuuua

SEQ ID NO: 605971 - RNA, 19 nt, Homo sapiens
caagagaaaucuguucaac

SEQ ID NO: 605972 - RNA, 19 nt, Homo sapiens
gaaccugcauaauauuacu

SEQ ID NO: 605973 - RNA, 19 nt, Homo sapiens
ccgauuugauugauucuug

SEQ ID NO: 605974 - RNA, 19 nt, Homo sapiens
ggaaaucaaggagaaguug

SEQ ID NO: 605975 - RNA, 19 nt, Homo sapiens
acacagagggcgaauauca

SEQ ID NO: 605976 - RNA, 19 nt, Homo sapiens
gauaugcuuugucgaugug

SEQ ID NO: 605977 - RNA, 19 nt, Homo sapiens
gcugcucgcuaaccuguga

SEQ ID NO: 605978 - RNA, 19 nt, Homo sapiens
ccaggagcaucaagaacuu

SEQ ID NO: 605979 - RNA, 19 nt, Homo sapiens
ugucaaacaucguucuaau

SEQ ID NO: 605980 - RNA, 19 nt, Homo sapiens
caaagcaugcagcaauaaa

SEQ ID NO: 605981 - RNA, 19 nt, Homo sapiens
gugaggagaaggagacuaa

SEQ ID NO: 605982 - RNA, 19 nt, Homo sapiens
gauuguguccgauuugauu

SEQ ID NO: 605983 - RNA, 19 nt, Homo sapiens
agagagagagcaaagaauu

SEQ ID NO: 605984 - RNA, 19 nt, Homo sapiens
uguaggaggucuucuucaa

SEQ ID NO: 605985 - RNA, 19 nt, Homo sapiens
ugaugaagcucugccuuau

SEQ ID NO: 605986 - RNA, 19 nt, Homo sapiens
aaagauacaugugaagaag

SEQ ID NO: 605987 - RNA, 19 nt, Homo sapiens
aggagaaguuggaagguaa

SEQ ID NO: 605988 - RNA, 19 nt, Homo sapiens
cgacuaucuucucugguaa

SEQ ID NO: 605989 - RNA, 19 nt, Homo sapiens
gaucaagugaacauagauu

SEQ ID NO: 605990 - RNA, 19 nt, Homo sapiens
ucaaacaagcucccucuga

SEQ ID NO: 605991 - RNA, 19 nt, Homo sapiens
ugggaaagguggccaggaa

SEQ ID NO: 605992 - RNA, 19 nt, Homo sapiens
ucaugaaguuugccaagga

SEQ ID NO: 605993 - RNA, 19 nt, Homo sapiens
gcucagaguacucaauaug

SEQ ID NO: 605994 - RNA, 19 nt, Homo sapiens
cagcaucugugguccugaa

SEQ ID NO: 605995 - RNA, 19 nt, Homo sapiens
ccagagagagagcaaagaa

SEQ ID NO: 605996 - RNA, 19 nt, Homo sapiens
ucuuggacaugaaguaauu

SEQ ID NO: 605997 - RNA, 19 nt, Homo sapiens
gcaagcgaacgggcaauuu

SEQ ID NO: 605998 - RNA, 19 nt, Homo sapiens
ugaauucuccaccaugaaa

SEQ ID NO: 605999 - RNA, 19 nt, Homo sapiens
gaucccaaaugcaggaauc

SEQ ID NO: 606000 - RNA, 19 nt, Homo sapiens
agaaguaugccuuggguuu

SEQ ID NO: 606001 - RNA, 19 nt, Homo sapiens
ugacuccucuucaucuuag

SEQ ID NO: 606002 - RNA, 19 nt, Homo sapiens
uggacuggcugcucgcuaa

SEQ ID NO: 606003 - RNA, 19 nt, Homo sapiens
cuacaaauagcuugcagaa

SEQ ID NO: 606004 - RNA, 19 nt, Homo sapiens
cugaugauauugacugguu

SEQ ID NO: 606005 - RNA, 19 nt, Homo sapiens
gaacaggaaugucaaauau

SEQ ID NO: 606006 - RNA, 19 nt, Homo sapiens
ugacagaacuuaccacuuu

SEQ ID NO: 606007 - RNA, 19 nt, Homo sapiens
gcucugaacuuucucgaua

SEQ ID NO: 606008 - RNA, 19 nt, Homo sapiens
gcaagacuguguagaguuu

SEQ ID NO: 606009 - RNA, 19 nt, Homo sapiens
ggaagaagcacgcggauaa

SEQ ID NO: 606010 - RNA, 19 nt, Homo sapiens
gaaagaggacucccaaauu

SEQ ID NO: 606011 - RNA, 19 nt, Homo sapiens
aggauuagguugucuauua

SEQ ID NO: 606012 - RNA, 19 nt, Homo sapiens
ccaaccagcuucagucuaa

SEQ ID NO: 606013 - RNA, 19 nt, Homo sapiens
cagcacaacuguauauauu

SEQ ID NO: 606014 - RNA, 19 nt, Homo sapiens
gaacuccagucccaaacua

SEQ ID NO: 606015 - RNA, 19 nt, Homo sapiens
gaaccucucuucacauugu

SEQ ID NO: 606016 - RNA, 19 nt, Homo sapiens
gaagaagcuuuaaacaaug

SEQ ID NO: 606017 - RNA, 19 nt, Homo sapiens
guacacagacuaagaguaa

SEQ ID NO: 606018 - RNA, 19 nt, Homo sapiens
gaacauguacacagacuaa

SEQ ID NO: 606019 - RNA, 19 nt, Homo sapiens
guacauaaauaccuaggaa

SEQ ID NO: 606020 - RNA, 19 nt, Homo sapiens
gaagugcguuccugaaguu

SEQ ID NO: 606021 - RNA, 19 nt, Homo sapiens
cgacauggaugagaaauug

SEQ ID NO: 606022 - RNA, 19 nt, Homo sapiens
gcacagcccugcacuacug

SEQ ID NO: 606023 - RNA, 19 nt, Homo sapiens
gaucgaaccucucuucaca

SEQ ID NO: 606024 - RNA, 19 nt, Homo sapiens
gaagaaagaaggcaguuga

SEQ ID NO: 606025 - RNA, 19 nt, Homo sapiens
ugaaagcgcucuauaacug

SEQ ID NO: 606026 - RNA, 19 nt, Homo sapiens
gaagugcuuugaccuuauu

SEQ ID NO: 606027 - RNA, 19 nt, Homo sapiens
gagaauguuuacucaguuu

SEQ ID NO: 606028 - RNA, 19 nt, Homo sapiens
gcaaugacgucugcuguga

SEQ ID NO: 606029 - RNA, 19 nt, Homo sapiens
gcuguuaacugcauuuguu

SEQ ID NO: 606030 - RNA, 19 nt, Homo sapiens
aaagaggacucccaaauuc

SEQ ID NO: 606031 - RNA, 19 nt, Homo sapiens
cugcuaauauccuuucuua

SEQ ID NO: 606032 - RNA, 19 nt, Homo sapiens
gagcggaaauugccgaaga

SEQ ID NO: 606033 - RNA, 19 nt, Homo sapiens
gaaauaagcggagcggaaa

SEQ ID NO: 606034 - RNA, 19 nt, Homo sapiens
ggaaauugccgaagagaug

SEQ ID NO: 606035 - RNA, 19 nt, Homo sapiens
gaugauggcucagaacaug

SEQ ID NO: 606036 - RNA, 19 nt, Homo sapiens
gguugcagcuaucauuaua

SEQ ID NO: 606037 - RNA, 19 nt, Homo sapiens
gaaauccacccaguguuua

SEQ ID NO: 606038 - RNA, 19 nt, Homo sapiens
cuacauggcuuuccaccaa

SEQ ID NO: 606039 - RNA, 19 nt, Homo sapiens
cagguucacugguacauaa

SEQ ID NO: 606040 - RNA, 19 nt, Homo sapiens
gcagagaugacccagauuu

SEQ ID NO: 606041 - RNA, 19 nt, Homo sapiens
ggagaauguuuacucaguu

SEQ ID NO: 606042 - RNA, 19 nt, Homo sapiens
ccaaaacucuugccagaua

SEQ ID NO: 606043 - RNA, 19 nt, Homo sapiens
ucauucaccugauuacuuu

SEQ ID NO: 606044 - RNA, 19 nt, Homo sapiens
ggauuagguugucuauuau

SEQ ID NO: 606045 - RNA, 19 nt, Homo sapiens
uaacgacccugcuaauauc

SEQ ID NO: 606046 - RNA, 19 nt, Homo sapiens
gagaauaaauaggcauaug

SEQ ID NO: 606047 - RNA, 19 nt, Homo sapiens
gaaccuggauaaacagaca

SEQ ID NO: 606048 - RNA, 19 nt, Homo sapiens
gaagaaauccgugaaagca

SEQ ID NO: 606049 - RNA, 19 nt, Homo sapiens
gaagacaaacucuguaagu

SEQ ID NO: 606050 - RNA, 19 nt, Homo sapiens
gaauaugaauggcgacuac

SEQ ID NO: 606051 - RNA, 19 nt, Homo sapiens
gaaagaaggcaguugauac

SEQ ID NO: 606052 - RNA, 19 nt, Homo sapiens
ggaaugcaggcuuuaauga

SEQ ID NO: 606053 - RNA, 19 nt, Homo sapiens
gcgaguaucugcugaaggu

SEQ ID NO: 606054 - RNA, 19 nt, Homo sapiens
gaaacauugcuaugcauuu

SEQ ID NO: 606055 - RNA, 19 nt, Homo sapiens
gcaaagcucaaccugcuaa

SEQ ID NO: 606056 - RNA, 19 nt, Homo sapiens
guucacugguacauaaaua

SEQ ID NO: 606057 - RNA, 19 nt, Homo sapiens
gccaucauaucauucuuaa

SEQ ID NO: 606058 - RNA, 19 nt, Homo sapiens
gaauuugccuucuugaacu

SEQ ID NO: 606059 - RNA, 19 nt, Homo sapiens
gccaucaguucaccuuuaa

SEQ ID NO: 606060 - RNA, 19 nt, Homo sapiens
aagaagugcuuugaccuua

SEQ ID NO: 606061 - RNA, 19 nt, Homo sapiens
gaggguaagauucauagua

SEQ ID NO: 606062 - RNA, 19 nt, Homo sapiens
ugucauaccucuauuuagu

SEQ ID NO: 606063 - RNA, 19 nt, Homo sapiens
acacaucacuugcuguuuc

SEQ ID NO: 606064 - RNA, 19 nt, Homo sapiens
cgcagaccaugcuguauua

SEQ ID NO: 606065 - RNA, 19 nt, Homo sapiens
gaugguuuaugacaacgua

SEQ ID NO: 606066 - RNA, 19 nt, Homo sapiens
aaacugcauuuccugaauu

SEQ ID NO: 606067 - RNA, 19 nt, Homo sapiens
agacacacauuccuuugaa

SEQ ID NO: 606068 - RNA, 19 nt, Homo sapiens
ugaaagugaugacgacaug

SEQ ID NO: 606069 - RNA, 19 nt, Homo sapiens
gaaggccuccaucgagaua

SEQ ID NO: 606070 - RNA, 19 nt, Homo sapiens
cgacaugaaugcaagaaag

SEQ ID NO: 606071 - RNA, 19 nt, Homo sapiens
gaaggacuaugaaacaaaa

SEQ ID NO: 606072 - RNA, 19 nt, Homo sapiens
ggaaggacuaugaaacaaa

SEQ ID NO: 606073 - RNA, 19 nt, Homo sapiens
gaaucuguccaucuguuua

SEQ ID NO: 606074 - RNA, 19 nt, Homo sapiens
ccacugcucuguuuuaaaa

SEQ ID NO: 606075 - RNA, 19 nt, Homo sapiens
uaaugccacugcucuguuu

SEQ ID NO: 606076 - RNA, 19 nt, Homo sapiens
gcuccaagcuuaugcugau

SEQ ID NO: 606077 - RNA, 19 nt, Homo sapiens
gaagaagugcuuugaccuu

SEQ ID NO: 606078 - RNA, 19 nt, Homo sapiens
cuacggaucuucacacgau

SEQ ID NO: 606079 - RNA, 19 nt, Homo sapiens
acagugcacuuaugucuau

SEQ ID NO: 606080 - RNA, 19 nt, Homo sapiens
cauauaggcuuggaaagug

SEQ ID NO: 606081 - RNA, 19 nt, Homo sapiens
auauauaggucccagguaa

SEQ ID NO: 606082 - RNA, 19 nt, Homo sapiens
guccaucuguuuauaauca

SEQ ID NO: 606083 - RNA, 19 nt, Homo sapiens
ugaaauccacccaguguuu

SEQ ID NO: 606084 - RNA, 19 nt, Homo sapiens
gcuaugcauuuauuaggaa

SEQ ID NO: 606085 - RNA, 19 nt, Homo sapiens
gagaggagauacgcaagga

SEQ ID NO: 606086 - RNA, 19 nt, Homo sapiens
uccaagaacugacaaagga

SEQ ID NO: 606087 - RNA, 19 nt, Homo sapiens
gcuuugaccuuauuucaca

SEQ ID NO: 606088 - RNA, 19 nt, Homo sapiens
ugauacagcuucgagauau

SEQ ID NO: 606089 - RNA, 19 nt, Homo sapiens
uaccagaggagaaauuaua

SEQ ID NO: 606090 - RNA, 19 nt, Homo sapiens
ccagcuauauaaggaauaa

SEQ ID NO: 606091 - RNA, 19 nt, Homo sapiens
cagcuugucuuuauuaugc

SEQ ID NO: 606092 - RNA, 19 nt, Homo sapiens
gagguugcagcuaucauua

SEQ ID NO: 606093 - RNA, 19 nt, Homo sapiens
cagauaaccaguuucauga

SEQ ID NO: 606094 - RNA, 19 nt, Homo sapiens
gcaaacgagucaggagaga

SEQ ID NO: 606095 - RNA, 19 nt, Homo sapiens
gugggaaccuggauaaaca

SEQ ID NO: 606096 - RNA, 19 nt, Homo sapiens
gauacagcuucgagauauu

SEQ ID NO: 606097 - RNA, 19 nt, Homo sapiens
cccaacaggugaacugaaa

SEQ ID NO: 606098 - RNA, 19 nt, Homo sapiens
ugaacaggaaugucaaaua

SEQ ID NO: 606099 - RNA, 19 nt, Homo sapiens
ucaaacaggcccaggauga

SEQ ID NO: 606100 - RNA, 19 nt, Homo sapiens
aaacuaaggaugauggauu

SEQ ID NO: 606101 - RNA, 19 nt, Homo sapiens
ccagauaaccaguuucaug

SEQ ID NO: 606102 - RNA, 19 nt, Homo sapiens
ggaagucgcaggcaaccaa

SEQ ID NO: 606103 - RNA, 19 nt, Homo sapiens
gcuaacacccuguggaaga

SEQ ID NO: 606104 - RNA, 19 nt, Homo sapiens
cacacugucuugaaauuga

SEQ ID NO: 606105 - RNA, 19 nt, Homo sapiens
uaagggagcuguauuauuu

SEQ ID NO: 606106 - RNA, 19 nt, Homo sapiens
gaaauuaaguacaccaaga

SEQ ID NO: 606107 - RNA, 19 nt, Homo sapiens
gagccacgguccuuacuua

SEQ ID NO: 606108 - RNA, 19 nt, Homo sapiens
caacgucacugaugauaug

SEQ ID NO: 606109 - RNA, 19 nt, Homo sapiens
guaagaaccugggauauuc

SEQ ID NO: 606110 - RNA, 19 nt, Homo sapiens
ggagagaaaugggagaauu

SEQ ID NO: 606111 - RNA, 19 nt, Homo sapiens
ggacauagccacuaaccaa

SEQ ID NO: 606112 - RNA, 19 nt, Homo sapiens
gcagcugucuuuacuaaug

SEQ ID NO: 606113 - RNA, 19 nt, Homo sapiens
gcaaaggacugggccgaaa

SEQ ID NO: 606114 - RNA, 19 nt, Homo sapiens
gaaguaauuugaagagagu

SEQ ID NO: 606115 - RNA, 19 nt, Homo sapiens
uuagauuccuucucaguua

SEQ ID NO: 606116 - RNA, 19 nt, Homo sapiens
cgaguaggcccaagaauuu

SEQ ID NO: 606117 - RNA, 19 nt, Homo sapiens
cagaagaacuccuaagaag

SEQ ID NO: 606118 - RNA, 19 nt, Homo sapiens
caaggcagauauagacaaa

SEQ ID NO: 606119 - RNA, 19 nt, Homo sapiens
uagcagcugucuuuacuaa

SEQ ID NO: 606120 - RNA, 19 nt, Homo sapiens
cgaaagagccaauaacuca

SEQ ID NO: 606121 - RNA, 19 nt, Homo sapiens
ccugacagaugccguauuu

SEQ ID NO: 606122 - RNA, 19 nt, Homo sapiens
ggaugaaguuaucgaaaga

SEQ ID NO: 606123 - RNA, 19 nt, Homo sapiens
gcagacacauccaguaucu

SEQ ID NO: 606124 - RNA, 19 nt, Homo sapiens
agcaauagcuucucacauu

SEQ ID NO: 606125 - RNA, 19 nt, Homo sapiens
ggacagaucaucccaugga

SEQ ID NO: 606126 - RNA, 19 nt, Homo sapiens
gccaauaacucagacuuug

SEQ ID NO: 606127 - RNA, 19 nt, Homo sapiens
ggagcuguauuauuucaug

SEQ ID NO: 606128 - RNA, 19 nt, Homo sapiens
gauucaagaugucuggaaa

SEQ ID NO: 606129 - RNA, 19 nt, Homo sapiens
ggauaagcuugcagacuug

SEQ ID NO: 606130 - RNA, 19 nt, Homo sapiens
uguauuagauuccuucuca

SEQ ID NO: 606131 - RNA, 19 nt, Homo sapiens
guaguaagaaccugggaua

SEQ ID NO: 606132 - RNA, 19 nt, Homo sapiens
gauuuaagacgauggauga

SEQ ID NO: 606133 - RNA, 19 nt, Homo sapiens
uggauaagcuugcagacuu

SEQ ID NO: 606134 - RNA, 19 nt, Homo sapiens
ccaagaagcagcuggaaga

SEQ ID NO: 606135 - RNA, 19 nt, Homo sapiens
cgcccaaucucgaaauuaa

SEQ ID NO: 606136 - RNA, 19 nt, Homo sapiens
gguccuuacuuaaagauug

SEQ ID NO: 606137 - RNA, 19 nt, Homo sapiens
gacgauggaugaaguuauc

SEQ ID NO: 606138 - RNA, 19 nt, Homo sapiens
gagaacaggugugugaagu

SEQ ID NO: 606139 - RNA, 19 nt, Homo sapiens
uuaagacggugacaguaaa

SEQ ID NO: 606140 - RNA, 19 nt, Homo sapiens
gcuggaauguggaggcaaa

SEQ ID NO: 606141 - RNA, 19 nt, Homo sapiens
ggaagaaguaauuugaaga

SEQ ID NO: 606142 - RNA, 19 nt, Homo sapiens
agaagcagcuggaagaagu

SEQ ID NO: 606143 - RNA, 19 nt, Homo sapiens
uacaagacaugaacccauu

SEQ ID NO: 606144 - RNA, 19 nt, Homo sapiens
ggagaguguucccugucua

SEQ ID NO: 606145 - RNA, 19 nt, Homo sapiens
ggagaucuuuggcccuguu

SEQ ID NO: 606146 - RNA, 19 nt, Homo sapiens
cacuguacaucuaucauaa

SEQ ID NO: 606147 - RNA, 19 nt, Homo sapiens
ccacgguccuuacuuaaag

SEQ ID NO: 606148 - RNA, 19 nt, Homo sapiens
cuguuuggaucaauuguua

SEQ ID NO: 606149 - RNA, 19 nt, Homo sapiens
gauaagaaacaguacaaca

SEQ ID NO: 606150 - RNA, 19 nt, Homo sapiens
ggcaaaaguccuaauauua

SEQ ID NO: 606151 - RNA, 19 nt, Homo sapiens
gauggaugcuucagaaagg

SEQ ID NO: 606152 - RNA, 19 nt, Homo sapiens
gcagacaucauucaguuuc

SEQ ID NO: 606153 - RNA, 19 nt, Homo sapiens
guucaccgcuucugagcuu

SEQ ID NO: 606154 - RNA, 19 nt, Homo sapiens
guuaagacggugacaguaa

SEQ ID NO: 606155 - RNA, 19 nt, Homo sapiens
gaagaaguaauuugaagag

SEQ ID NO: 606156 - RNA, 19 nt, Homo sapiens
ggacagggcaguucuugca

SEQ ID NO: 606157 - RNA, 19 nt, Homo sapiens
gcccaagaauuugauaaug

SEQ ID NO: 606158 - RNA, 19 nt, Homo sapiens
gcuggaagaaguaauuuga

SEQ ID NO: 606159 - RNA, 19 nt, Homo sapiens
gcagcuggaagaaguaauu

SEQ ID NO: 606160 - RNA, 19 nt, Homo sapiens
gcauagacaagauugcauu

SEQ ID NO: 606161 - RNA, 19 nt, Homo sapiens
ucugagugcuuccauguga

SEQ ID NO: 606162 - RNA, 19 nt, Homo sapiens
caaaccagcuggguacagu

SEQ ID NO: 606163 - RNA, 19 nt, Homo sapiens
ccagaagaacuccuaagaa

SEQ ID NO: 606164 - RNA, 19 nt, Homo sapiens
cgggaguacucagaaguua

SEQ ID NO: 606165 - RNA, 19 nt, Homo sapiens
cacagugucuucugcaaug

SEQ ID NO: 606166 - RNA, 19 nt, Homo sapiens
gggcagcaauagcuucuca

SEQ ID NO: 606167 - RNA, 19 nt, Homo sapiens
ggaugaccauuccuguaga

SEQ ID NO: 606168 - RNA, 19 nt, Homo sapiens
guacaccaagaucuuuaua

SEQ ID NO: 606169 - RNA, 19 nt, Homo sapiens
gaguguucccugucuauaa

SEQ ID NO: 606170 - RNA, 19 nt, Homo sapiens
cugaaccucuacaccaaua

SEQ ID NO: 606171 - RNA, 19 nt, Homo sapiens
cuaagaaggccaagaagga

SEQ ID NO: 606172 - RNA, 19 nt, Homo sapiens
gcuuugugcuguggcaaua

SEQ ID NO: 606173 - RNA, 19 nt, Homo sapiens
aaggauggaugcuucagaa

SEQ ID NO: 606174 - RNA, 19 nt, Homo sapiens
ccucugugcuagcaauaaa

SEQ ID NO: 606175 - RNA, 19 nt, Homo sapiens
caaauccaauccagucucu

SEQ ID NO: 606176 - RNA, 19 nt, Homo sapiens
cagcugucuuuacuaauga

SEQ ID NO: 606177 - RNA, 19 nt, Homo sapiens
gcugauguuugccuggaaa

SEQ ID NO: 606178 - RNA, 19 nt, Homo sapiens
uugcagacaucauucaguu

SEQ ID NO: 606179 - RNA, 19 nt, Homo sapiens
gggcccagcucucaggaau

SEQ ID NO: 606180 - RNA, 19 nt, Homo sapiens
caggagaacagguguguga

SEQ ID NO: 606181 - RNA, 19 nt, Homo sapiens
ggaaaugggagagaaaugg

SEQ ID NO: 606182 - RNA, 19 nt, Homo sapiens
gggacuguuuggaucaauu

SEQ ID NO: 606183 - RNA, 19 nt, Homo sapiens
uuaagacgauggaugaagu

SEQ ID NO: 606184 - RNA, 19 nt, Homo sapiens
gagcacaggaugaaauaag

SEQ ID NO: 606185 - RNA, 19 nt, Homo sapiens
ucucaggaauacaaaguug

SEQ ID NO: 606186 - RNA, 19 nt, Homo sapiens
guccaucuaugaggaguuu

SEQ ID NO: 606187 - RNA, 19 nt, Homo sapiens
gaagcagcuggaagaagua

SEQ ID NO: 606188 - RNA, 19 nt, Homo sapiens
caucccuucuuccaucuuu

SEQ ID NO: 606189 - RNA, 19 nt, Homo sapiens
aaugugcccuguaucuauu

SEQ ID NO: 606190 - RNA, 19 nt, Homo sapiens
ccgaguaggcccaagaauu

SEQ ID NO: 606191 - RNA, 19 nt, Homo sapiens
ccaccuuaaucauaccaaa

SEQ ID NO: 606192 - RNA, 19 nt, Homo sapiens
aagaaacaguacaacaaga

SEQ ID NO: 606193 - RNA, 19 nt, Homo sapiens
gaugaccauuccuguagau

SEQ ID NO: 606194 - RNA, 19 nt, Homo sapiens
ccagugacuccaccaguuu

SEQ ID NO: 606195 - RNA, 19 nt, Homo sapiens
uaaugugcccuguaucuau

SEQ ID NO: 606196 - RNA, 19 nt, Homo sapiens
acacuguacaucuaucaua

SEQ ID NO: 606197 - RNA, 19 nt, Homo sapiens
uggaaucuguaccuucuga

SEQ ID NO: 606198 - RNA, 19 nt, Homo sapiens
agacaucauucaguuucua

SEQ ID NO: 606199 - RNA, 19 nt, Homo sapiens
ccaagaauuugauaaugcu

SEQ ID NO: 606200 - RNA, 19 nt, Homo sapiens
ccucucugcuuucucugua

SEQ ID NO: 606201 - RNA, 19 nt, Homo sapiens
acucguagcagcugucuuu

SEQ ID NO: 606202 - RNA, 19 nt, Homo sapiens
agacaagauugcauucaca

SEQ ID NO: 606203 - RNA, 19 nt, Homo sapiens
caucaaggaggcuggcuuu

SEQ ID NO: 606204 - RNA, 19 nt, Homo sapiens
gacagaucaucccauggaa

SEQ ID NO: 606205 - RNA, 19 nt, Homo sapiens
uaagggagcuguauuauuu

SEQ ID NO: 606206 - RNA, 19 nt, Homo sapiens
gaaauuaaguacaccaaga

SEQ ID NO: 606207 - RNA, 19 nt, Homo sapiens
gagccacgguccuuacuua

SEQ ID NO: 606208 - RNA, 19 nt, Homo sapiens
caacgucacugaugauaug

SEQ ID NO: 606209 - RNA, 19 nt, Homo sapiens
guaagaaccugggauauuc

SEQ ID NO: 606210 - RNA, 19 nt, Homo sapiens
ggagagaaaugggagaauu

SEQ ID NO: 606211 - RNA, 19 nt, Homo sapiens
ggacauagccacuaaccaa

SEQ ID NO: 606212 - RNA, 19 nt, Homo sapiens
gcagcugucuuuacuaaug

SEQ ID NO: 606213 - RNA, 19 nt, Homo sapiens
gcaaaggacugggccgaaa

SEQ ID NO: 606214 - RNA, 19 nt, Homo sapiens
gaaguaauuugaagagagu

SEQ ID NO: 606215 - RNA, 19 nt, Homo sapiens
uuagauuccuucucaguua

SEQ ID NO: 606216 - RNA, 19 nt, Homo sapiens
cgaguaggcccaagaauuu

SEQ ID NO: 606217 - RNA, 19 nt, Homo sapiens
cagaagaacuccuaagaag

SEQ ID NO: 606218 - RNA, 19 nt, Homo sapiens
caaggcagauauagacaaa

SEQ ID NO: 606219 - RNA, 19 nt, Homo sapiens
uagcagcugucuuuacuaa

SEQ ID NO: 606220 - RNA, 19 nt, Homo sapiens
cgaaagagccaauaacuca

SEQ ID NO: 606221 - RNA, 19 nt, Homo sapiens
ccugacagaugccguauuu

SEQ ID NO: 606222 - RNA, 19 nt, Homo sapiens
ggaugaaguuaucgaaaga

SEQ ID NO: 606223 - RNA, 19 nt, Homo sapiens
gcagacacauccaguaucu

SEQ ID NO: 606224 - RNA, 19 nt, Homo sapiens
ggacagaucaucccaugga

SEQ ID NO: 606225 - RNA, 19 nt, Homo sapiens
gccaauaacucagacuuug

SEQ ID NO: 606226 - RNA, 19 nt, Homo sapiens
ggagcuguauuauuucaug

SEQ ID NO: 606227 - RNA, 19 nt, Homo sapiens
gauucaagaugucuggaaa

SEQ ID NO: 606228 - RNA, 19 nt, Homo sapiens
ggauaagcuugcagacuug

SEQ ID NO: 606229 - RNA, 19 nt, Homo sapiens
uguauuagauuccuucuca

SEQ ID NO: 606230 - RNA, 19 nt, Homo sapiens
guaguaagaaccugggaua

SEQ ID NO: 606231 - RNA, 19 nt, Homo sapiens
gauuuaagacgauggauga

SEQ ID NO: 606232 - RNA, 19 nt, Homo sapiens
uggauaagcuugcagacuu

SEQ ID NO: 606233 - RNA, 19 nt, Homo sapiens
ccaagaagcagcuggaaga

SEQ ID NO: 606234 - RNA, 19 nt, Homo sapiens
cgcccaaucucgaaauuaa

SEQ ID NO: 606235 - RNA, 19 nt, Homo sapiens
gguccuuacuuaaagauug

SEQ ID NO: 606236 - RNA, 19 nt, Homo sapiens
gacgauggaugaaguuauc

SEQ ID NO: 606237 - RNA, 19 nt, Homo sapiens
gagaacaggugugugaagu

SEQ ID NO: 606238 - RNA, 19 nt, Homo sapiens
uuaagacggugacaguaaa

SEQ ID NO: 606239 - RNA, 19 nt, Homo sapiens
gcuggaauguggaggcaaa

SEQ ID NO: 606240 - RNA, 19 nt, Homo sapiens
ggaagaaguaauuugaaga

SEQ ID NO: 606241 - RNA, 19 nt, Homo sapiens
agaagcagcuggaagaagu

SEQ ID NO: 606242 - RNA, 19 nt, Homo sapiens
uacaagacaugaacccauu

SEQ ID NO: 606243 - RNA, 19 nt, Homo sapiens
ggagaguguucccugucua

SEQ ID NO: 606244 - RNA, 19 nt, Homo sapiens
ggagaucuuuggcccuguu

SEQ ID NO: 606245 - RNA, 19 nt, Homo sapiens
cacuguacaucuaucauaa

SEQ ID NO: 606246 - RNA, 19 nt, Homo sapiens
ccacgguccuuacuuaaag

SEQ ID NO: 606247 - RNA, 19 nt, Homo sapiens
cuguuuggaucaauuguua

SEQ ID NO: 606248 - RNA, 19 nt, Homo sapiens
gauaagaaacaguacaaca

SEQ ID NO: 606249 - RNA, 19 nt, Homo sapiens
ggcaaaaguccuaauauua

SEQ ID NO: 606250 - RNA, 19 nt, Homo sapiens
gauggaugcuucagaaagg

SEQ ID NO: 606251 - RNA, 19 nt, Homo sapiens
gcagacaucauucaguuuc

SEQ ID NO: 606252 - RNA, 19 nt, Homo sapiens
guucaccgcuucugagcuu

SEQ ID NO: 606253 - RNA, 19 nt, Homo sapiens
guuaagacggugacaguaa

SEQ ID NO: 606254 - RNA, 19 nt, Homo sapiens
gaagaaguaauuugaagag

SEQ ID NO: 606255 - RNA, 19 nt, Homo sapiens
ggacagggcaguucuugca

SEQ ID NO: 606256 - RNA, 19 nt, Homo sapiens
gcccaagaauuugauaaug

SEQ ID NO: 606257 - RNA, 19 nt, Homo sapiens
gcuggaagaaguaauuuga

SEQ ID NO: 606258 - RNA, 19 nt, Homo sapiens
gcagcuggaagaaguaauu

SEQ ID NO: 606259 - RNA, 19 nt, Homo sapiens
caaggagguuggaaagcuu

SEQ ID NO: 606260 - RNA, 19 nt, Homo sapiens
ucugagugcuuccauguga

SEQ ID NO: 606261 - RNA, 19 nt, Homo sapiens
caaaccagcuggguacagu

SEQ ID NO: 606262 - RNA, 19 nt, Homo sapiens
ccagaagaacuccuaagaa

SEQ ID NO: 606263 - RNA, 19 nt, Homo sapiens
cgggaguacucagaaguua

SEQ ID NO: 606264 - RNA, 19 nt, Homo sapiens
cacagugucuucugcaaug

SEQ ID NO: 606265 - RNA, 19 nt, Homo sapiens
ggaugaccauuccuguaga

SEQ ID NO: 606266 - RNA, 19 nt, Homo sapiens
cugaaccucuacaccaaua

SEQ ID NO: 606267 - RNA, 19 nt, Homo sapiens
guacaccaagaucuuuaua

SEQ ID NO: 606268 - RNA, 19 nt, Homo sapiens
gaguguucccugucuauaa

SEQ ID NO: 606269 - RNA, 19 nt, Homo sapiens
cuaagaaggccaagaagga

SEQ ID NO: 606270 - RNA, 19 nt, Homo sapiens
gcuuugugcuguggcaaua

SEQ ID NO: 606271 - RNA, 19 nt, Homo sapiens
aaggauggaugcuucagaa

SEQ ID NO: 606272 - RNA, 19 nt, Homo sapiens
ccucugugcuagcaauaaa

SEQ ID NO: 606273 - RNA, 19 nt, Homo sapiens
caaauccaauccagucucu

SEQ ID NO: 606274 - RNA, 19 nt, Homo sapiens
cagcugucuuuacuaauga

SEQ ID NO: 606275 - RNA, 19 nt, Homo sapiens
gcugauguuugccuggaaa

SEQ ID NO: 606276 - RNA, 19 nt, Homo sapiens
uugcagacaucauucaguu

SEQ ID NO: 606277 - RNA, 19 nt, Homo sapiens
gggcccagcucucaggaau

SEQ ID NO: 606278 - RNA, 19 nt, Homo sapiens
caggagaacagguguguga

SEQ ID NO: 606279 - RNA, 19 nt, Homo sapiens
ggaaaugggagagaaaugg

SEQ ID NO: 606280 - RNA, 19 nt, Homo sapiens
gggacuguuuggaucaauu

SEQ ID NO: 606281 - RNA, 19 nt, Homo sapiens
uuaagacgauggaugaagu

SEQ ID NO: 606282 - RNA, 19 nt, Homo sapiens
gagcacaggaugaaauaag

SEQ ID NO: 606283 - RNA, 19 nt, Homo sapiens
ucucaggaauacaaaguug

SEQ ID NO: 606284 - RNA, 19 nt, Homo sapiens
guccaucuaugaggaguuu

SEQ ID NO: 606285 - RNA, 19 nt, Homo sapiens
gaagcagcuggaagaagua

SEQ ID NO: 606286 - RNA, 19 nt, Homo sapiens
caucccuucuuccaucuuu

SEQ ID NO: 606287 - RNA, 19 nt, Homo sapiens
aaugugcccuguaucuauu

SEQ ID NO: 606288 - RNA, 19 nt, Homo sapiens
ccgaguaggcccaagaauu

SEQ ID NO: 606289 - RNA, 19 nt, Homo sapiens
ccaccuuaaucauaccaaa

SEQ ID NO: 606290 - RNA, 19 nt, Homo sapiens
aagaaacaguacaacaaga

SEQ ID NO: 606291 - RNA, 19 nt, Homo sapiens
gaugaccauuccuguagau

SEQ ID NO: 606292 - RNA, 19 nt, Homo sapiens
ccagugacuccaccaguuu

SEQ ID NO: 606293 - RNA, 19 nt, Homo sapiens
uaaugugcccuguaucuau

SEQ ID NO: 606294 - RNA, 19 nt, Homo sapiens
acacuguacaucuaucaua

SEQ ID NO: 606295 - RNA, 19 nt, Homo sapiens
uggaaucuguaccuucuga

SEQ ID NO: 606296 - RNA, 19 nt, Homo sapiens
agacaucauucaguuucua

SEQ ID NO: 606297 - RNA, 19 nt, Homo sapiens
ccaagaauuugauaaugcu

SEQ ID NO: 606298 - RNA, 19 nt, Homo sapiens
ccucucugcuuucucugua

SEQ ID NO: 606299 - RNA, 19 nt, Homo sapiens
acucguagcagcugucuuu

SEQ ID NO: 606300 - RNA, 19 nt, Homo sapiens
gacagaucaucccauggaa

SEQ ID NO: 606301 - RNA, 19 nt, Homo sapiens
gggaugaccauuccuguag

SEQ ID NO: 606302 - RNA, 19 nt, Homo sapiens
aaccauuccugcaagcuuu

SEQ ID NO: 606303 - RNA, 19 nt, Homo sapiens
gggcaguucuugcaaccau

SEQ ID NO: 606304 - RNA, 19 nt, Homo sapiens
gcagugaccuuggaaaauc

SEQ ID NO: 606305 - RNA, 19 nt, Homo sapiens
uaagggagcuguauuauuu

SEQ ID NO: 606306 - RNA, 19 nt, Homo sapiens
gagccacgguccuuacuua

SEQ ID NO: 606307 - RNA, 19 nt, Homo sapiens
caacgucacugaugauaug

SEQ ID NO: 606308 - RNA, 19 nt, Homo sapiens
guaagaaccugggauauuc

SEQ ID NO: 606309 - RNA, 19 nt, Homo sapiens
ggagagaaaugggagaauu

SEQ ID NO: 606310 - RNA, 19 nt, Homo sapiens
ggacauagccacuaaccaa

SEQ ID NO: 606311 - RNA, 19 nt, Homo sapiens
gcagcugucuuuacuaaug

SEQ ID NO: 606312 - RNA, 19 nt, Homo sapiens
gcaaaggacugggccgaaa

SEQ ID NO: 606313 - RNA, 19 nt, Homo sapiens
gaaguaauuugaagagagu

SEQ ID NO: 606314 - RNA, 19 nt, Homo sapiens
uuagauuccuucucaguua

SEQ ID NO: 606315 - RNA, 19 nt, Homo sapiens
cgaguaggcccaagaauuu

SEQ ID NO: 606316 - RNA, 19 nt, Homo sapiens
cagaagaacuccuaagaag

SEQ ID NO: 606317 - RNA, 19 nt, Homo sapiens
uagcagcugucuuuacuaa

SEQ ID NO: 606318 - RNA, 19 nt, Homo sapiens
cgaaagagccaauaacuca

SEQ ID NO: 606319 - RNA, 19 nt, Homo sapiens
ccugacagaugccguauuu

SEQ ID NO: 606320 - RNA, 19 nt, Homo sapiens
ggaugaaguuaucgaaaga

SEQ ID NO: 606321 - RNA, 19 nt, Homo sapiens
gcagacacauccaguaucu

SEQ ID NO: 606322 - RNA, 19 nt, Homo sapiens
agcaauagcuucucacauu

SEQ ID NO: 606323 - RNA, 19 nt, Homo sapiens
ggacagaucaucccaugga

SEQ ID NO: 606324 - RNA, 19 nt, Homo sapiens
gccaauaacucagacuuug

SEQ ID NO: 606325 - RNA, 19 nt, Homo sapiens
ggagcuguauuauuucaug

SEQ ID NO: 606326 - RNA, 19 nt, Homo sapiens
gauucaagaugucuggaaa

SEQ ID NO: 606327 - RNA, 19 nt, Homo sapiens
ggauaagcuugcagacuug

SEQ ID NO: 606328 - RNA, 19 nt, Homo sapiens
uguauuagauuccuucuca

SEQ ID NO: 606329 - RNA, 19 nt, Homo sapiens
guaguaagaaccugggaua

SEQ ID NO: 606330 - RNA, 19 nt, Homo sapiens
gauuuaagacgauggauga

SEQ ID NO: 606331 - RNA, 19 nt, Homo sapiens
uggauaagcuugcagacuu

SEQ ID NO: 606332 - RNA, 19 nt, Homo sapiens
ccaagaagcagcuggaaga

SEQ ID NO: 606333 - RNA, 19 nt, Homo sapiens
gguccuuacuuaaagauug

SEQ ID NO: 606334 - RNA, 19 nt, Homo sapiens
gacgauggaugaaguuauc

SEQ ID NO: 606335 - RNA, 19 nt, Homo sapiens
uuaagacggugacaguaaa

SEQ ID NO: 606336 - RNA, 19 nt, Homo sapiens
gcuggaauguggaggcaaa

SEQ ID NO: 606337 - RNA, 19 nt, Homo sapiens
ggaagaaguaauuugaaga

SEQ ID NO: 606338 - RNA, 19 nt, Homo sapiens
agaagcagcuggaagaagu

SEQ ID NO: 606339 - RNA, 19 nt, Homo sapiens
uacaagacaugaacccauu

SEQ ID NO: 606340 - RNA, 19 nt, Homo sapiens
ggagaucuuuggcccuguu

SEQ ID NO: 606341 - RNA, 19 nt, Homo sapiens
cacuguacaucuaucauaa

SEQ ID NO: 606342 - RNA, 19 nt, Homo sapiens
ccacgguccuuacuuaaag

SEQ ID NO: 606343 - RNA, 19 nt, Homo sapiens
cuguuuggaucaauuguua

SEQ ID NO: 606344 - RNA, 19 nt, Homo sapiens
gauaagaaacaguacaaca

SEQ ID NO: 606345 - RNA, 19 nt, Homo sapiens
ggcaaaaguccuaauauua

SEQ ID NO: 606346 - RNA, 19 nt, Homo sapiens
gauggaugcuucagaaagg

SEQ ID NO: 606347 - RNA, 19 nt, Homo sapiens
gcagacaucauucaguuuc

SEQ ID NO: 606348 - RNA, 19 nt, Homo sapiens
guucaccgcuucugagcuu

SEQ ID NO: 606349 - RNA, 19 nt, Homo sapiens
guuaagacggugacaguaa

SEQ ID NO: 606350 - RNA, 19 nt, Homo sapiens
gaagaaguaauuugaagag

SEQ ID NO: 606351 - RNA, 19 nt, Homo sapiens
ggacagggcaguucuugca

SEQ ID NO: 606352 - RNA, 19 nt, Homo sapiens
gcccaagaauuugauaaug

SEQ ID NO: 606353 - RNA, 19 nt, Homo sapiens
gcuggaagaaguaauuuga

SEQ ID NO: 606354 - RNA, 19 nt, Homo sapiens
gcagcuggaagaaguaauu

SEQ ID NO: 606355 - RNA, 19 nt, Homo sapiens
gcauagacaagauugcauu

SEQ ID NO: 606356 - RNA, 19 nt, Homo sapiens
ucugagugcuuccauguga

SEQ ID NO: 606357 - RNA, 19 nt, Homo sapiens
caaaccagcuggguacagu

SEQ ID NO: 606358 - RNA, 19 nt, Homo sapiens
ccagaagaacuccuaagaa

SEQ ID NO: 606359 - RNA, 19 nt, Homo sapiens
cgggaguacucagaaguua

SEQ ID NO: 606360 - RNA, 19 nt, Homo sapiens
cacagugucuucugcaaug

SEQ ID NO: 606361 - RNA, 19 nt, Homo sapiens
acaggcagauauagacaaa

SEQ ID NO: 606362 - RNA, 19 nt, Homo sapiens
gggcagcaauagcuucuca

SEQ ID NO: 606363 - RNA, 19 nt, Homo sapiens
ggaugaccauuccuguaga

SEQ ID NO: 606364 - RNA, 19 nt, Homo sapiens
cugaaccucuacaccaaua

SEQ ID NO: 606365 - RNA, 19 nt, Homo sapiens
cuaagaaggccaagaagga

SEQ ID NO: 606366 - RNA, 19 nt, Homo sapiens
aaggauggaugcuucagaa

SEQ ID NO: 606367 - RNA, 19 nt, Homo sapiens
gcuuugugcuguggcaaua

SEQ ID NO: 606368 - RNA, 19 nt, Homo sapiens
ccucugugcuagcaauaaa

SEQ ID NO: 606369 - RNA, 19 nt, Homo sapiens
caaauccaauccagucucu

SEQ ID NO: 606370 - RNA, 19 nt, Homo sapiens
cagcugucuuuacuaauga

SEQ ID NO: 606371 - RNA, 19 nt, Homo sapiens
gcugauguuugccuggaaa

SEQ ID NO: 606372 - RNA, 19 nt, Homo sapiens
uugcagacaucauucaguu

SEQ ID NO: 606373 - RNA, 19 nt, Homo sapiens
gggcccagcucucaggaau

SEQ ID NO: 606374 - RNA, 19 nt, Homo sapiens
ggaaaugggagagaaaugg

SEQ ID NO: 606375 - RNA, 19 nt, Homo sapiens
gggacuguuuggaucaauu

SEQ ID NO: 606376 - RNA, 19 nt, Homo sapiens
uuaagacgauggaugaagu

SEQ ID NO: 606377 - RNA, 19 nt, Homo sapiens
gagcacaggaugaaauaag

SEQ ID NO: 606378 - RNA, 19 nt, Homo sapiens
ucucaggaauacaaaguug

SEQ ID NO: 606379 - RNA, 19 nt, Homo sapiens
guccaucuaugaggaguuu

SEQ ID NO: 606380 - RNA, 19 nt, Homo sapiens
gaagcagcuggaagaagua

SEQ ID NO: 606381 - RNA, 19 nt, Homo sapiens
caucccuucuuccaucuuu

SEQ ID NO: 606382 - RNA, 19 nt, Homo sapiens
aaugugcccuguaucuauu

SEQ ID NO: 606383 - RNA, 19 nt, Homo sapiens
ccgaguaggcccaagaauu

SEQ ID NO: 606384 - RNA, 19 nt, Homo sapiens
ccaccuuaaucauaccaaa

SEQ ID NO: 606385 - RNA, 19 nt, Homo sapiens
aagaaacaguacaacaaga

SEQ ID NO: 606386 - RNA, 19 nt, Homo sapiens
gaugaccauuccuguagau

SEQ ID NO: 606387 - RNA, 19 nt, Homo sapiens
gggcaguucuugcaaccau

SEQ ID NO: 606388 - RNA, 19 nt, Homo sapiens
ccagugacuccaccaguuu

SEQ ID NO: 606389 - RNA, 19 nt, Homo sapiens
uaaugugcccuguaucuau

SEQ ID NO: 606390 - RNA, 19 nt, Homo sapiens
acacuguacaucuaucaua

SEQ ID NO: 606391 - RNA, 19 nt, Homo sapiens
uggaaucuguaccuucuga

SEQ ID NO: 606392 - RNA, 19 nt, Homo sapiens
agacaucauucaguuucua

SEQ ID NO: 606393 - RNA, 19 nt, Homo sapiens
ccaagaauuugauaaugcu

SEQ ID NO: 606394 - RNA, 19 nt, Homo sapiens
ccucucugcuuucucugua

SEQ ID NO: 606395 - RNA, 19 nt, Homo sapiens
acucguagcagcugucuuu

SEQ ID NO: 606396 - RNA, 19 nt, Homo sapiens
agacaagauugcauucaca

SEQ ID NO: 606397 - RNA, 19 nt, Homo sapiens
caucaaggaggcuggcuuu

SEQ ID NO: 606398 - RNA, 19 nt, Homo sapiens
gacagaucaucccauggaa

SEQ ID NO: 606399 - RNA, 19 nt, Homo sapiens
aaccauuccugcaagcuuu

SEQ ID NO: 606400 - RNA, 19 nt, Homo sapiens
gggaugaccauuccuguag

SEQ ID NO: 606401 - RNA, 19 nt, Homo sapiens
gcagugaccuuggaaaauc

SEQ ID NO: 606402 - RNA, 19 nt, Homo sapiens
guuggaaucuguaccuucu

SEQ ID NO: 606403 - RNA, 19 nt, Homo sapiens
guccuuacuuaaagauuga

SEQ ID NO: 606404 - RNA, 19 nt, Homo sapiens
ggacuguuuggaucaauug

SEQ ID NO: 606405 - RNA, 19 nt, Homo sapiens
gaaagugccugccuuguuu

SEQ ID NO: 606406 - RNA, 19 nt, Homo sapiens
gcaaagaacuuaccaccaa

SEQ ID NO: 606407 - RNA, 19 nt, Homo sapiens
guacacaucuauucucaaa

SEQ ID NO: 606408 - RNA, 19 nt, Homo sapiens
gaagacaacuguggucauu

SEQ ID NO: 606409 - RNA, 19 nt, Homo sapiens
gaagagaccugaaagaaaa

SEQ ID NO: 606410 - RNA, 19 nt, Homo sapiens
gcaagagaauaagcuaaua

SEQ ID NO: 606411 - RNA, 19 nt, Homo sapiens
caacaaaggaggaaguaua

SEQ ID NO: 606412 - RNA, 19 nt, Homo sapiens
caaauuggauagagaagaa

SEQ ID NO: 606413 - RNA, 19 nt, Homo sapiens
ugaaaugcacucagaauua

SEQ ID NO: 606414 - RNA, 19 nt, Homo sapiens
guaaggaaguccaaauguu

SEQ ID NO: 606415 - RNA, 19 nt, Homo sapiens
gaagaaacacauccuggua

SEQ ID NO: 606416 - RNA, 19 nt, Homo sapiens
gaaaugcacucagaauuac

SEQ ID NO: 606417 - RNA, 19 nt, Homo sapiens
gaagaaccauuuacaugca

SEQ ID NO: 606418 - RNA, 19 nt, Homo sapiens
caaauacgguaaucucuuc

SEQ ID NO: 606419 - RNA, 19 nt, Homo sapiens
gcagugagcuguguaagca

SEQ ID NO: 606420 - RNA, 19 nt, Homo sapiens
gagaagaaccauuuacaug

SEQ ID NO: 606421 - RNA, 19 nt, Homo sapiens
ccaauauccucaugacauu

SEQ ID NO: 606422 - RNA, 19 nt, Homo sapiens
gauggacgcucagaugaaa

SEQ ID NO: 606423 - RNA, 19 nt, Homo sapiens
ucagaaaugugacuggaaa

SEQ ID NO: 606424 - RNA, 19 nt, Homo sapiens
ugacuuggacugaaauaua

SEQ ID NO: 606425 - RNA, 19 nt, Homo sapiens
gaacaaauacgguaaucuc

SEQ ID NO: 606426 - RNA, 19 nt, Homo sapiens
ucucaaagcuaaaggguau

SEQ ID NO: 606427 - RNA, 19 nt, Homo sapiens
caucuauucucaaagcuaa

SEQ ID NO: 606428 - RNA, 19 nt, Homo sapiens
gacacuaccuucucccauu

SEQ ID NO: 606429 - RNA, 19 nt, Homo sapiens
ggagaucuagguucaaauu

SEQ ID NO: 606430 - RNA, 19 nt, Homo sapiens
ggaaguauaaggagaucua

SEQ ID NO: 606431 - RNA, 19 nt, Homo sapiens
ucaauacuuugcucacuuu

SEQ ID NO: 606432 - RNA, 19 nt, Homo sapiens
gcaccgucauaaaucaaua

SEQ ID NO: 606433 - RNA, 19 nt, Homo sapiens
aaacaaagcaaguagaaga

SEQ ID NO: 606434 - RNA, 19 nt, Homo sapiens
uauagccacuugugaguaa

SEQ ID NO: 606435 - RNA, 19 nt, Homo sapiens
aaggagaaaugauaaguga

SEQ ID NO: 606436 - RNA, 19 nt, Homo sapiens
gaggugagacccaaagaaa

SEQ ID NO: 606437 - RNA, 19 nt, Homo sapiens
gagaaaagcaagagaauaa

SEQ ID NO: 606438 - RNA, 19 nt, Homo sapiens
gugcuggacuugggacuua

SEQ ID NO: 606439 - RNA, 19 nt, Homo sapiens
gguugaggcugaagaguga

SEQ ID NO: 606440 - RNA, 19 nt, Homo sapiens
caccuuauauuucugugua

SEQ ID NO: 606441 - RNA, 19 nt, Homo sapiens
gcacucagaauuacuuaga

SEQ ID NO: 606442 - RNA, 19 nt, Homo sapiens
caaccuacauguucaaagg

SEQ ID NO: 606443 - RNA, 19 nt, Homo sapiens
caucugacuuggacugaaa

SEQ ID NO: 606444 - RNA, 19 nt, Homo sapiens
gggaggugguuucaacaaa

SEQ ID NO: 606445 - RNA, 19 nt, Homo sapiens
ccauuacucugaaguccua

SEQ ID NO: 606446 - RNA, 19 nt, Homo sapiens
caggagcaauucgccauua

SEQ ID NO: 606447 - RNA, 19 nt, Homo sapiens
gaaauguagcccuggguuu

SEQ ID NO: 606448 - RNA, 19 nt, Homo sapiens
gcucacagaguuuauaguu

SEQ ID NO: 606449 - RNA, 19 nt, Homo sapiens
cagcauugacucagauaua

SEQ ID NO: 606450 - RNA, 19 nt, Homo sapiens
ugaagagaccugaaagaaa

SEQ ID NO: 606451 - RNA, 19 nt, Homo sapiens
ggacagagacccucagacu

SEQ ID NO: 606452 - RNA, 19 nt, Homo sapiens
gauuaaagcauguacuuca

SEQ ID NO: 606453 - RNA, 19 nt, Homo sapiens
ucaaaggcaucaucagcuu

SEQ ID NO: 606454 - RNA, 19 nt, Homo sapiens
gacuuggacugaaauauag

SEQ ID NO: 606455 - RNA, 19 nt, Homo sapiens
ggaggugguuucaacaaag

SEQ ID NO: 606456 - RNA, 19 nt, Homo sapiens
gggaauuccugcuaugaca

SEQ ID NO: 606457 - RNA, 19 nt, Homo sapiens
ggcagcggcuccuugguaa

SEQ ID NO: 606458 - RNA, 19 nt, Homo sapiens
gguaaucucuucauuugcu

SEQ ID NO: 606459 - RNA, 19 nt, Homo sapiens
ggagaaaugauaagugaca

SEQ ID NO: 606460 - RNA, 19 nt, Homo sapiens
gagaucuagguucaaauua

SEQ ID NO: 606461 - RNA, 19 nt, Homo sapiens
gcaaguagaagaaacacau

SEQ ID NO: 606462 - RNA, 19 nt, Homo sapiens
aaauguagcccuggguuua

SEQ ID NO: 606463 - RNA, 19 nt, Homo sapiens
ccauuuacaugcaccuuau

SEQ ID NO: 606464 - RNA, 19 nt, Homo sapiens
acacuaccuucucccauuu

SEQ ID NO: 606465 - RNA, 19 nt, Homo sapiens
acgguaaucucuucauuug

SEQ ID NO: 606466 - RNA, 19 nt, Homo sapiens
gagaacaaauacgguaauc

SEQ ID NO: 606467 - RNA, 19 nt, Homo sapiens
gagaacauaaugagaacaa

SEQ ID NO: 606468 - RNA, 19 nt, Homo sapiens
gccagaggcuuguacuugu

SEQ ID NO: 606469 - RNA, 19 nt, Homo sapiens
ccauguggauaaucagaaa

SEQ ID NO: 606470 - RNA, 19 nt, Homo sapiens
gcuaaaggguaugaaagug

SEQ ID NO: 606471 - RNA, 19 nt, Homo sapiens
uaaacacaccggagaagaa

SEQ ID NO: 606472 - RNA, 19 nt, Homo sapiens
caacgcagaugaggaaguc

SEQ ID NO: 606473 - RNA, 19 nt, Homo sapiens
aaauauaggugagagacaa

SEQ ID NO: 606474 - RNA, 19 nt, Homo sapiens
auaaggagaucuagguuca

SEQ ID NO: 606475 - RNA, 19 nt, Homo sapiens
ggaaaucccagccucaagu

SEQ ID NO: 606476 - RNA, 19 nt, Homo sapiens
ccaaaucugccguguaugu

SEQ ID NO: 606477 - RNA, 19 nt, Homo sapiens
gcaccggauuguucaaagu

SEQ ID NO: 606478 - RNA, 19 nt, Homo sapiens
ggauagagaagaaaccaau

SEQ ID NO: 606479 - RNA, 19 nt, Homo sapiens
ggagaagaaccauuuacau

SEQ ID NO: 606480 - RNA, 19 nt, Homo sapiens
gugccugccuuguuuauag

SEQ ID NO: 606481 - RNA, 19 nt, Homo sapiens
gcauccauuugaacacauu

SEQ ID NO: 606482 - RNA, 19 nt, Homo sapiens
ggaggaguaugugcugaug

SEQ ID NO: 606483 - RNA, 19 nt, Homo sapiens
ggagccagguccggaaaga

SEQ ID NO: 606484 - RNA, 19 nt, Homo sapiens
gggaagaagcugccaagug

SEQ ID NO: 606485 - RNA, 19 nt, Homo sapiens
ggcuaucacuucaauguca

SEQ ID NO: 606486 - RNA, 19 nt, Homo sapiens
gcaauggagccgcuuagug

SEQ ID NO: 606487 - RNA, 19 nt, Homo sapiens
gugaagagaccugaaagaa

SEQ ID NO: 606488 - RNA, 19 nt, Homo sapiens
ccagaggcuuguacuuguu

SEQ ID NO: 606489 - RNA, 19 nt, Homo sapiens
uaaggaaguccaaauguuc

SEQ ID NO: 606490 - RNA, 19 nt, Homo sapiens
ugaaagugccugccuuguu

SEQ ID NO: 606491 - RNA, 19 nt, Homo sapiens
gagaaaugauaagugacaa

SEQ ID NO: 606492 - RNA, 19 nt, Homo sapiens
gugaagccacagacucuua

SEQ ID NO: 606493 - RNA, 19 nt, Homo sapiens
acucugaaguccuacauug

SEQ ID NO: 606494 - RNA, 19 nt, Homo sapiens
ggagaagucggagcaaaga

SEQ ID NO: 606495 - RNA, 19 nt, Homo sapiens
guaaagcuacuccuugauc

SEQ ID NO: 606496 - RNA, 19 nt, Homo sapiens
ugguaaagcuacuccuuga

SEQ ID NO: 606497 - RNA, 19 nt, Homo sapiens
gggaagugcaaauuggaua

SEQ ID NO: 606498 - RNA, 19 nt, Homo sapiens
gggcuggaaugcuggguau

SEQ ID NO: 606499 - RNA, 19 nt, Homo sapiens
ccucagaucccacuaaagu

SEQ ID NO: 606500 - RNA, 19 nt, Homo sapiens
gaggagcagcggaugauga

SEQ ID NO: 606501 - RNA, 19 nt, Homo sapiens
caagaggcccagaagcaaa

SEQ ID NO: 606502 - RNA, 19 nt, Homo sapiens
guagugaagagaccugaaa

SEQ ID NO: 606503 - RNA, 19 nt, Homo sapiens
gaugaaaugcacucagaau

SEQ ID NO: 606504 - RNA, 19 nt, Homo sapiens
ccagggaggugguuucaac

SEQ ID NO: 606505 - RNA, 19 nt, Homo sapiens
gaaagugccugccuuguuu

SEQ ID NO: 606506 - RNA, 19 nt, Homo sapiens
guacacaucuauucucaaa

SEQ ID NO: 606507 - RNA, 19 nt, Homo sapiens
gaagaaccauuuacaugca

SEQ ID NO: 606508 - RNA, 19 nt, Homo sapiens
gagaagaaccauuuacaug

SEQ ID NO: 606509 - RNA, 19 nt, Homo sapiens
gauggacgcucagaugaaa

SEQ ID NO: 606510 - RNA, 19 nt, Homo sapiens
ucucaaagcuaaaggguau

SEQ ID NO: 606511 - RNA, 19 nt, Homo sapiens
caucuauucucaaagcuaa

SEQ ID NO: 606512 - RNA, 19 nt, Homo sapiens
gacacuaccuucucccauu

SEQ ID NO: 606513 - RNA, 19 nt, Homo sapiens
uauagccacuugugaguaa

SEQ ID NO: 606514 - RNA, 19 nt, Homo sapiens
aaggagaaaugauaaguga

SEQ ID NO: 606515 - RNA, 19 nt, Homo sapiens
gaggugagacccaaagaaa

SEQ ID NO: 606516 - RNA, 19 nt, Homo sapiens
caccuuauauuucugugua

SEQ ID NO: 606517 - RNA, 19 nt, Homo sapiens
caaccuacauguucaaagg

SEQ ID NO: 606518 - RNA, 19 nt, Homo sapiens
ccauuacucugaaguccua

SEQ ID NO: 606519 - RNA, 19 nt, Homo sapiens
caggagcaauucgccauua

SEQ ID NO: 606520 - RNA, 19 nt, Homo sapiens
gaaauguagcccuggguuu

SEQ ID NO: 606521 - RNA, 19 nt, Homo sapiens
gcucacagaguuuauaguu

SEQ ID NO: 606522 - RNA, 19 nt, Homo sapiens
cagcauugacucagauaua

SEQ ID NO: 606523 - RNA, 19 nt, Homo sapiens
ccucagagcaccugccaua

SEQ ID NO: 606524 - RNA, 19 nt, Homo sapiens
ucaaaggcaucaucagcuu

SEQ ID NO: 606525 - RNA, 19 nt, Homo sapiens
gggaauuccugcuaugaca

SEQ ID NO: 606526 - RNA, 19 nt, Homo sapiens
cggcugaguuggcuucaaa

SEQ ID NO: 606527 - RNA, 19 nt, Homo sapiens
ggacucaccacuucaagga

SEQ ID NO: 606528 - RNA, 19 nt, Homo sapiens
ggagaaaugauaagugaca

SEQ ID NO: 606529 - RNA, 19 nt, Homo sapiens
aaauguagcccuggguuua

SEQ ID NO: 606530 - RNA, 19 nt, Homo sapiens
ccauuuacaugcaccuuau

SEQ ID NO: 606531 - RNA, 19 nt, Homo sapiens
acacuaccuucucccauuu

SEQ ID NO: 606532 - RNA, 19 nt, Homo sapiens
gcuaaaggguaugaaagug

SEQ ID NO: 606533 - RNA, 19 nt, Homo sapiens
caccaggacucaccacuuc

SEQ ID NO: 606534 - RNA, 19 nt, Homo sapiens
uaaacacaccggagaagaa

SEQ ID NO: 606535 - RNA, 19 nt, Homo sapiens
caacgcagaugaggaaguc

SEQ ID NO: 606536 - RNA, 19 nt, Homo sapiens
ccaaaucugccguguaugu

SEQ ID NO: 606537 - RNA, 19 nt, Homo sapiens
ugaguuggcuucaaaccau

SEQ ID NO: 606538 - RNA, 19 nt, Homo sapiens
ggagaagaaccauuuacau

SEQ ID NO: 606539 - RNA, 19 nt, Homo sapiens
gugccugccuuguuuauag

SEQ ID NO: 606540 - RNA, 19 nt, Homo sapiens
gcauccauuugaacacauu

SEQ ID NO: 606541 - RNA, 19 nt, Homo sapiens
ggaggaguaugugcugaug

SEQ ID NO: 606542 - RNA, 19 nt, Homo sapiens
ggagccagguccggaaaga

SEQ ID NO: 606543 - RNA, 19 nt, Homo sapiens
gggaagaagcugccaagug

SEQ ID NO: 606544 - RNA, 19 nt, Homo sapiens
ggcuaucacuucaauguca

SEQ ID NO: 606545 - RNA, 19 nt, Homo sapiens
ugaaagugccugccuuguu

SEQ ID NO: 606546 - RNA, 19 nt, Homo sapiens
gagaaaugauaagugacaa

SEQ ID NO: 606547 - RNA, 19 nt, Homo sapiens
gugaagccacagacucuua

SEQ ID NO: 606548 - RNA, 19 nt, Homo sapiens
acucugaaguccuacauug

SEQ ID NO: 606549 - RNA, 19 nt, Homo sapiens
caagaggcccagaagcaaa

SEQ ID NO: 606550 - RNA, 19 nt, Homo sapiens
gggcuggaaugcuggguau

SEQ ID NO: 606551 - RNA, 19 nt, Homo sapiens
ccucagaucccacuaaagu

SEQ ID NO: 606552 - RNA, 19 nt, Homo sapiens
gaggagcagcggaugauga

SEQ ID NO: 606553 - RNA, 19 nt, Homo sapiens
gagagugcacugaccugua

SEQ ID NO: 606554 - RNA, 19 nt, Homo sapiens
ugacaaggcuacgcugaca

SEQ ID NO: 606555 - RNA, 19 nt, Homo sapiens
gaagggaccaagcgaccaa

SEQ ID NO: 606556 - RNA, 19 nt, Homo sapiens
uaugacagcuggcuagcau

SEQ ID NO: 606557 - RNA, 19 nt, Homo sapiens
ccacauacccacguuuguu

SEQ ID NO: 606558 - RNA, 19 nt, Homo sapiens
acacaucuauucucaaagc

SEQ ID NO: 606559 - RNA, 19 nt, Homo sapiens
caccggagaagaaccauuu

SEQ ID NO: 606560 - RNA, 19 nt, Homo sapiens
cucacagaguuuauaguua

SEQ ID NO: 606561 - RNA, 19 nt, Homo sapiens
agagugcacugaccuguag

SEQ ID NO: 606562 - RNA, 19 nt, Homo sapiens
ucucccauuucaagaauuu

SEQ ID NO: 606563 - RNA, 19 nt, Homo sapiens
gacaguggcgggaaagaga

SEQ ID NO: 606564 - RNA, 19 nt, Homo sapiens
ggaggugagacccaaagaa

SEQ ID NO: 606565 - RNA, 19 nt, Homo sapiens
gaacuaguuuugggaaaug

SEQ ID NO: 606566 - RNA, 19 nt, Homo sapiens
ggaccaagcgaccaaggau

SEQ ID NO: 606567 - RNA, 19 nt, Homo sapiens
guguacacaucuauucuca

SEQ ID NO: 606568 - RNA, 19 nt, Homo sapiens
gagcuccgcagcaucaaug

SEQ ID NO: 606569 - RNA, 19 nt, Homo sapiens
gccaaggacagcagcauga

SEQ ID NO: 606570 - RNA, 19 nt, Homo sapiens
uauacagcauugacucaga

SEQ ID NO: 606571 - RNA, 19 nt, Homo sapiens
caccaaaugucagaagcuu

SEQ ID NO: 606572 - RNA, 19 nt, Homo sapiens
cgagcugugucaacugaga

SEQ ID NO: 606573 - RNA, 19 nt, Homo sapiens
ggcagugucuggaacuaca

SEQ ID NO: 606574 - RNA, 19 nt, Homo sapiens
caaacagaaacacaaacaa

SEQ ID NO: 606575 - RNA, 19 nt, Homo sapiens
ccuagggaauuccugcuau

SEQ ID NO: 606576 - RNA, 19 nt, Homo sapiens
auccugagcucacagaguu

SEQ ID NO: 606577 - RNA, 19 nt, Homo sapiens
uggagcccaugcugaaauu

SEQ ID NO: 606578 - RNA, 19 nt, Homo sapiens
aaagcuaaaggguaugaaa

SEQ ID NO: 606579 - RNA, 19 nt, Homo sapiens
ugucaacgcagaugaggaa

SEQ ID NO: 606580 - RNA, 19 nt, Homo sapiens
acaugcaccuuauauuucu

SEQ ID NO: 606581 - RNA, 19 nt, Homo sapiens
gagugcgugugugugauuu

SEQ ID NO: 606582 - RNA, 19 nt, Homo sapiens
ggagcaagggcacaaacug

SEQ ID NO: 606583 - RNA, 19 nt, Homo sapiens
gacaaaagcagcacaagga

SEQ ID NO: 606584 - RNA, 19 nt, Homo sapiens
gcaggagcaauucgccauu

SEQ ID NO: 606585 - RNA, 19 nt, Homo sapiens
ccaagaggcccagaagcaa

SEQ ID NO: 606586 - RNA, 19 nt, Homo sapiens
guaggucuguuugccacuu

SEQ ID NO: 606587 - RNA, 19 nt, Homo sapiens
gcauugacucagauauaga

SEQ ID NO: 606588 - RNA, 19 nt, Homo sapiens
cuagggaauuccugcuaug

SEQ ID NO: 606589 - RNA, 19 nt, Homo sapiens
auaaggcauuccacaccua

SEQ ID NO: 606590 - RNA, 19 nt, Homo sapiens
gguguagguaggucuguuu

SEQ ID NO: 606591 - RNA, 19 nt, Homo sapiens
gagcucacagaguuuauag

SEQ ID NO: 606592 - RNA, 19 nt, Homo sapiens
ucccucagaucccacuaaa

SEQ ID NO: 606593 - RNA, 19 nt, Homo sapiens
caauucgccauuacucuga

SEQ ID NO: 606594 - RNA, 19 nt, Homo sapiens
uacaugcaccuuauauuuc

SEQ ID NO: 606595 - RNA, 19 nt, Homo sapiens
acaaacagaaacacaaaca

SEQ ID NO: 606596 - RNA, 19 nt, Homo sapiens
ucaccgagcuccgcagcau

SEQ ID NO: 606597 - RNA, 19 nt, Homo sapiens
ucugaaguccuacauugaa

SEQ ID NO: 606598 - RNA, 19 nt, Homo sapiens
aaagugccugccuuguuua

SEQ ID NO: 606599 - RNA, 19 nt, Homo sapiens
ccccaaaucugccguguau

SEQ ID NO: 606600 - RNA, 19 nt, Homo sapiens
auacagcauugacucagau

SEQ ID NO: 606601 - RNA, 19 nt, Homo sapiens
caaagaaagcuggaaccau

SEQ ID NO: 606602 - RNA, 19 nt, Homo sapiens
ugacagcuggcuagcauuc

SEQ ID NO: 606603 - RNA, 19 nt, Homo sapiens
gagcaauucgccauuacuc

SEQ ID NO: 606604 - RNA, 19 nt, Homo sapiens
uugccaaagucaucuccua

SEQ ID NO: 606605 - RNA, 19 nt, Homo sapiens
gaaagugccugccuuguuu

SEQ ID NO: 606606 - RNA, 19 nt, Homo sapiens
gcaaagaacuuaccaccaa

SEQ ID NO: 606607 - RNA, 19 nt, Homo sapiens
guacacaucuauucucaaa

SEQ ID NO: 606608 - RNA, 19 nt, Homo sapiens
gaagacaacuguggucauu

SEQ ID NO: 606609 - RNA, 19 nt, Homo sapiens
gaagagaccugaaagaaaa

SEQ ID NO: 606610 - RNA, 19 nt, Homo sapiens
gcaagagaauaagcuaaua

SEQ ID NO: 606611 - RNA, 19 nt, Homo sapiens
caacaaaggaggaaguaua

SEQ ID NO: 606612 - RNA, 19 nt, Homo sapiens
caaauuggauagagaagaa

SEQ ID NO: 606613 - RNA, 19 nt, Homo sapiens
ugaaaugcacucagaauua

SEQ ID NO: 606614 - RNA, 19 nt, Homo sapiens
guaaggaaguccaaauguu

SEQ ID NO: 606615 - RNA, 19 nt, Homo sapiens
gaagaaacacauccuggua

SEQ ID NO: 606616 - RNA, 19 nt, Homo sapiens
gaaaugcacucagaauuac

SEQ ID NO: 606617 - RNA, 19 nt, Homo sapiens
gaagaaccauuuacaugca

SEQ ID NO: 606618 - RNA, 19 nt, Homo sapiens
caaauacgguaaucucuuc

SEQ ID NO: 606619 - RNA, 19 nt, Homo sapiens
gcagugagcuguguaagca

SEQ ID NO: 606620 - RNA, 19 nt, Homo sapiens
gagaagaaccauuuacaug

SEQ ID NO: 606621 - RNA, 19 nt, Homo sapiens
ccaauauccucaugacauu

SEQ ID NO: 606622 - RNA, 19 nt, Homo sapiens
gauggacgcucagaugaaa

SEQ ID NO: 606623 - RNA, 19 nt, Homo sapiens
ucagaaaugugacuggaaa

SEQ ID NO: 606624 - RNA, 19 nt, Homo sapiens
ugacuuggacugaaauaua

SEQ ID NO: 606625 - RNA, 19 nt, Homo sapiens
gaacaaauacgguaaucuc

SEQ ID NO: 606626 - RNA, 19 nt, Homo sapiens
ucucaaagcuaaaggguau

SEQ ID NO: 606627 - RNA, 19 nt, Homo sapiens
caucuauucucaaagcuaa

SEQ ID NO: 606628 - RNA, 19 nt, Homo sapiens
gacacuaccuucucccauu

SEQ ID NO: 606629 - RNA, 19 nt, Homo sapiens
ggagaucuagguucaaauu

SEQ ID NO: 606630 - RNA, 19 nt, Homo sapiens
ggaaguauaaggagaucua

SEQ ID NO: 606631 - RNA, 19 nt, Homo sapiens
ucaauacuuugcucacuuu

SEQ ID NO: 606632 - RNA, 19 nt, Homo sapiens
gcaccgucauaaaucaaua

SEQ ID NO: 606633 - RNA, 19 nt, Homo sapiens
aaacaaagcaaguagaaga

SEQ ID NO: 606634 - RNA, 19 nt, Homo sapiens
uauagccacuugugaguaa

SEQ ID NO: 606635 - RNA, 19 nt, Homo sapiens
aaggagaaaugauaaguga

SEQ ID NO: 606636 - RNA, 19 nt, Homo sapiens
gaggugagacccaaagaaa

SEQ ID NO: 606637 - RNA, 19 nt, Homo sapiens
gagaaaagcaagagaauaa

SEQ ID NO: 606638 - RNA, 19 nt, Homo sapiens
gugcuggacuugggacuua

SEQ ID NO: 606639 - RNA, 19 nt, Homo sapiens
gguugaggcugaagaguga

SEQ ID NO: 606640 - RNA, 19 nt, Homo sapiens
caccuuauauuucugugua

SEQ ID NO: 606641 - RNA, 19 nt, Homo sapiens
gcacucagaauuacuuaga

SEQ ID NO: 606642 - RNA, 19 nt, Homo sapiens
caaccuacauguucaaagg

SEQ ID NO: 606643 - RNA, 19 nt, Homo sapiens
caucugacuuggacugaaa

SEQ ID NO: 606644 - RNA, 19 nt, Homo sapiens
gggaggugguuucaacaaa

SEQ ID NO: 606645 - RNA, 19 nt, Homo sapiens
ccauuacucugaaguccua

SEQ ID NO: 606646 - RNA, 19 nt, Homo sapiens
caggagcaauucgccauua

SEQ ID NO: 606647 - RNA, 19 nt, Homo sapiens
gaaauguagcccuggguuu

SEQ ID NO: 606648 - RNA, 19 nt, Homo sapiens
gcucacagaguuuauaguu

SEQ ID NO: 606649 - RNA, 19 nt, Homo sapiens
cagcauugacucagauaua

SEQ ID NO: 606650 - RNA, 19 nt, Homo sapiens
ugaagagaccugaaagaaa

SEQ ID NO: 606651 - RNA, 19 nt, Homo sapiens
ggacagagacccucagacu

SEQ ID NO: 606652 - RNA, 19 nt, Homo sapiens
gauuaaagcauguacuuca

SEQ ID NO: 606653 - RNA, 19 nt, Homo sapiens
ucaaaggcaucaucagcuu

SEQ ID NO: 606654 - RNA, 19 nt, Homo sapiens
gacuuggacugaaauauag

SEQ ID NO: 606655 - RNA, 19 nt, Homo sapiens
ggaggugguuucaacaaag

SEQ ID NO: 606656 - RNA, 19 nt, Homo sapiens
gggaauuccugcuaugaca

SEQ ID NO: 606657 - RNA, 19 nt, Homo sapiens
ggcagcggcuccuugguaa

SEQ ID NO: 606658 - RNA, 19 nt, Homo sapiens
gguaaucucuucauuugcu

SEQ ID NO: 606659 - RNA, 19 nt, Homo sapiens
ggagaaaugauaagugaca

SEQ ID NO: 606660 - RNA, 19 nt, Homo sapiens
gagaucuagguucaaauua

SEQ ID NO: 606661 - RNA, 19 nt, Homo sapiens
gcaaguagaagaaacacau

SEQ ID NO: 606662 - RNA, 19 nt, Homo sapiens
aaauguagcccuggguuua

SEQ ID NO: 606663 - RNA, 19 nt, Homo sapiens
ccauuuacaugcaccuuau

SEQ ID NO: 606664 - RNA, 19 nt, Homo sapiens
acacuaccuucucccauuu

SEQ ID NO: 606665 - RNA, 19 nt, Homo sapiens
acgguaaucucuucauuug

SEQ ID NO: 606666 - RNA, 19 nt, Homo sapiens
gagaacaaauacgguaauc

SEQ ID NO: 606667 - RNA, 19 nt, Homo sapiens
gagaacauaaugagaacaa

SEQ ID NO: 606668 - RNA, 19 nt, Homo sapiens
gccagaggcuuguacuugu

SEQ ID NO: 606669 - RNA, 19 nt, Homo sapiens
ccauguggauaaucagaaa

SEQ ID NO: 606670 - RNA, 19 nt, Homo sapiens
gcuaaaggguaugaaagug

SEQ ID NO: 606671 - RNA, 19 nt, Homo sapiens
uaaacacaccggagaagaa

SEQ ID NO: 606672 - RNA, 19 nt, Homo sapiens
caacgcagaugaggaaguc

SEQ ID NO: 606673 - RNA, 19 nt, Homo sapiens
aaauauaggugagagacaa

SEQ ID NO: 606674 - RNA, 19 nt, Homo sapiens
auaaggagaucuagguuca

SEQ ID NO: 606675 - RNA, 19 nt, Homo sapiens
ggaaaucccagccucaagu

SEQ ID NO: 606676 - RNA, 19 nt, Homo sapiens
ccaaaucugccguguaugu

SEQ ID NO: 606677 - RNA, 19 nt, Homo sapiens
gcaccggauuguucaaagu

SEQ ID NO: 606678 - RNA, 19 nt, Homo sapiens
ggauagagaagaaaccaau

SEQ ID NO: 606679 - RNA, 19 nt, Homo sapiens
ggagaagaaccauuuacau

SEQ ID NO: 606680 - RNA, 19 nt, Homo sapiens
gugccugccuuguuuauag

SEQ ID NO: 606681 - RNA, 19 nt, Homo sapiens
gcauccauuugaacacauu

SEQ ID NO: 606682 - RNA, 19 nt, Homo sapiens
ggaggaguaugugcugaug

SEQ ID NO: 606683 - RNA, 19 nt, Homo sapiens
ggcuaucacuucaauguca

SEQ ID NO: 606684 - RNA, 19 nt, Homo sapiens
gcaauggagccgcuuagug

SEQ ID NO: 606685 - RNA, 19 nt, Homo sapiens
gugaagagaccugaaagaa

SEQ ID NO: 606686 - RNA, 19 nt, Homo sapiens
ccagaggcuuguacuuguu

SEQ ID NO: 606687 - RNA, 19 nt, Homo sapiens
uaaggaaguccaaauguuc

SEQ ID NO: 606688 - RNA, 19 nt, Homo sapiens
ugaaagugccugccuuguu

SEQ ID NO: 606689 - RNA, 19 nt, Homo sapiens
gagaaaugauaagugacaa

SEQ ID NO: 606690 - RNA, 19 nt, Homo sapiens
gugaagccacagacucuua

SEQ ID NO: 606691 - RNA, 19 nt, Homo sapiens
acucugaaguccuacauug

SEQ ID NO: 606692 - RNA, 19 nt, Homo sapiens
ggagaagucggagcaaaga

SEQ ID NO: 606693 - RNA, 19 nt, Homo sapiens
guaaagcuacuccuugauc

SEQ ID NO: 606694 - RNA, 19 nt, Homo sapiens
ugguaaagcuacuccuuga

SEQ ID NO: 606695 - RNA, 19 nt, Homo sapiens
gggaagugcaaauuggaua

SEQ ID NO: 606696 - RNA, 19 nt, Homo sapiens
gggcuggaaugcuggguau

SEQ ID NO: 606697 - RNA, 19 nt, Homo sapiens
ccucagaucccacuaaagu

SEQ ID NO: 606698 - RNA, 19 nt, Homo sapiens
gaggagcagcggaugauga

SEQ ID NO: 606699 - RNA, 19 nt, Homo sapiens
caagaggcccagaagcaaa

SEQ ID NO: 606700 - RNA, 19 nt, Homo sapiens
guagugaagagaccugaaa

SEQ ID NO: 606701 - RNA, 19 nt, Homo sapiens
gaugaaaugcacucagaau

SEQ ID NO: 606702 - RNA, 19 nt, Homo sapiens
ccagggaggugguuucaac

SEQ ID NO: 606703 - RNA, 19 nt, Homo sapiens
gagagugcacugaccugua

SEQ ID NO: 606704 - RNA, 19 nt, Homo sapiens
gauauuugccacucucuuc

SEQ ID NO: 606705 - RNA, 19 nt, Homo sapiens
gaagaaaucugugucuaug

SEQ ID NO: 606706 - RNA, 19 nt, Homo sapiens
ggaacucuuuaucucaaua

SEQ ID NO: 606707 - RNA, 19 nt, Homo sapiens
gaucaugaacuaacugaaa

SEQ ID NO: 606708 - RNA, 19 nt, Homo sapiens
ucaccaaggucuccaggua

SEQ ID NO: 606709 - RNA, 19 nt, Homo sapiens
aaacucagcuagccagaau

SEQ ID NO: 606710 - RNA, 19 nt, Homo sapiens
caagagaaguguuugaaaa

SEQ ID NO: 606711 - RNA, 19 nt, Homo sapiens
agaaaucugugucuaugaa

SEQ ID NO: 606712 - RNA, 19 nt, Homo sapiens
guuaacaaauuccgaagga

SEQ ID NO: 606713 - RNA, 19 nt, Homo sapiens
gcaagagaaguguuugaaa

SEQ ID NO: 606714 - RNA, 19 nt, Homo sapiens
gaaaacaugagauacguua

SEQ ID NO: 606715 - RNA, 19 nt, Homo sapiens
gguacucacucugguuuaa

SEQ ID NO: 606716 - RNA, 19 nt, Homo sapiens
acacagaggcuccugguuu

SEQ ID NO: 606717 - RNA, 19 nt, Homo sapiens
gcacugaccugggcaacuc

SEQ ID NO: 606718 - RNA, 19 nt, Homo sapiens
gaugaauucuggagacgau

SEQ ID NO: 606719 - RNA, 19 nt, Homo sapiens
gcagguaaaguuaacaaau

SEQ ID NO: 606720 - RNA, 19 nt, Homo sapiens
gagaaguguuugaaaauga

SEQ ID NO: 606721 - RNA, 19 nt, Homo sapiens
aguagucacugaugaauuc

SEQ ID NO: 606722 - RNA, 19 nt, Homo sapiens
ugaagaagcaagagaagug

SEQ ID NO: 606723 - RNA, 19 nt, Homo sapiens
cacagaggcuccugguuuc

SEQ ID NO: 606724 - RNA, 19 nt, Homo sapiens
cuucuguggugguguuaua

SEQ ID NO: 606725 - RNA, 19 nt, Homo sapiens
ugaagaaaucugugucuau

SEQ ID NO: 606726 - RNA, 19 nt, Homo sapiens
gcacugugaccuuucuuuc

SEQ ID NO: 606727 - RNA, 19 nt, Homo sapiens
gaauucuggagacgauaua

SEQ ID NO: 606728 - RNA, 19 nt, Homo sapiens
gaaguagucacugaugaau

SEQ ID NO: 606729 - RNA, 19 nt, Homo sapiens
gggcuccuaucuucuggaa

SEQ ID NO: 606730 - RNA, 19 nt, Homo sapiens
caagauaacgcacguccau

SEQ ID NO: 606731 - RNA, 19 nt, Homo sapiens
caauagagaccuuaaaaga

SEQ ID NO: 606732 - RNA, 19 nt, Homo sapiens
gccguuugcuggguuguuu

SEQ ID NO: 606733 - RNA, 19 nt, Homo sapiens
ccaccaggaccuacuguga

SEQ ID NO: 606734 - RNA, 19 nt, Homo sapiens
aaaaugaaguagucacuga

SEQ ID NO: 606735 - RNA, 19 nt, Homo sapiens
gaaacucagcuagccagaa

SEQ ID NO: 606736 - RNA, 19 nt, Homo sapiens
aaacagaucaugaacuaac

SEQ ID NO: 606737 - RNA, 19 nt, Homo sapiens
gguuuaaacagaucaugaa

SEQ ID NO: 606738 - RNA, 19 nt, Homo sapiens
gaagaagcaagagaagugu

SEQ ID NO: 606739 - RNA, 19 nt, Homo sapiens
gccaagacccgcugaugau

SEQ ID NO: 606740 - RNA, 19 nt, Homo sapiens
agcaaaauguucacuguua

SEQ ID NO: 606741 - RNA, 19 nt, Homo sapiens
agacuucuguggugguguu

SEQ ID NO: 606742 - RNA, 19 nt, Homo sapiens
ugaaguagucacugaugaa

SEQ ID NO: 606743 - RNA, 19 nt, Homo sapiens
cuguggugguguuauaaua

SEQ ID NO: 606744 - RNA, 19 nt, Homo sapiens
gcaacugcgagcuggcuaa

SEQ ID NO: 606745 - RNA, 19 nt, Homo sapiens
guggagcccucaguauuuc

SEQ ID NO: 606746 - RNA, 19 nt, Homo sapiens
uguggagcccucaguauuu

SEQ ID NO: 606747 - RNA, 19 nt, Homo sapiens
gguguuauaauacgggaaa

SEQ ID NO: 606748 - RNA, 19 nt, Homo sapiens
agaagcaagagaaguguuu

SEQ ID NO: 606749 - RNA, 19 nt, Homo sapiens
aaaucugugucuaugaaga

SEQ ID NO: 606750 - RNA, 19 nt, Homo sapiens
gaacucuuuaucucaauag

SEQ ID NO: 606751 - RNA, 19 nt, Homo sapiens
uaacagaacgagccaagac

SEQ ID NO: 606752 - RNA, 19 nt, Homo sapiens
gaagcaagagaaguguuug

SEQ ID NO: 606753 - RNA, 19 nt, Homo sapiens
cuggaacucuuuaucucaa

SEQ ID NO: 606754 - RNA, 19 nt, Homo sapiens
guguggagcccucaguauu

SEQ ID NO: 606755 - RNA, 19 nt, Homo sapiens
cgugcgggcuccuaucuuc

SEQ ID NO: 606756 - RNA, 19 nt, Homo sapiens
guacucacucugguuuaaa

SEQ ID NO: 606757 - RNA, 19 nt, Homo sapiens
gcucacaugguccuuguca

SEQ ID NO: 606758 - RNA, 19 nt, Homo sapiens
gaagcgugcgggcuccuau

SEQ ID NO: 606759 - RNA, 19 nt, Homo sapiens
gauaacgcacguccaugug

SEQ ID NO: 606760 - RNA, 19 nt, Homo sapiens
ggaaaauuuuguacugaca

SEQ ID NO: 606761 - RNA, 19 nt, Homo sapiens
ggacugaugggugucaaca

SEQ ID NO: 606762 - RNA, 19 nt, Homo sapiens
caacugcgagcuggcuaaa

SEQ ID NO: 606763 - RNA, 19 nt, Homo sapiens
cagguacucacucugguuu

SEQ ID NO: 606764 - RNA, 19 nt, Homo sapiens
gagccaagacccgcugaug

SEQ ID NO: 606765 - RNA, 19 nt, Homo sapiens
aaacuucaucacacacuga

SEQ ID NO: 606766 - RNA, 19 nt, Homo sapiens
gaaaucugugucuaugaag

SEQ ID NO: 606767 - RNA, 19 nt, Homo sapiens
gcaaaauguucacuguuac

SEQ ID NO: 606768 - RNA, 19 nt, Homo sapiens
cuaugaagaagcaagagaa

SEQ ID NO: 606769 - RNA, 19 nt, Homo sapiens
accaggaccuacugugaga

SEQ ID NO: 606770 - RNA, 19 nt, Homo sapiens
augaaguagucacugauga

SEQ ID NO: 606771 - RNA, 19 nt, Homo sapiens
augaagaaaucugugucua

SEQ ID NO: 606772 - RNA, 19 nt, Homo sapiens
gaagcgugcaccggaucua

SEQ ID NO: 606773 - RNA, 19 nt, Homo sapiens
cgagcacugugaccuuucu

SEQ ID NO: 606774 - RNA, 19 nt, Homo sapiens
cagaucaugaacuaacuga

SEQ ID NO: 606775 - RNA, 19 nt, Homo sapiens
gcacuggauggauggaagu

SEQ ID NO: 606776 - RNA, 19 nt, Homo sapiens
ggaccuacugugagagaag

SEQ ID NO: 606777 - RNA, 19 nt, Homo sapiens
agauaacgcacguccaugu

SEQ ID NO: 606778 - RNA, 19 nt, Homo sapiens
ggugaggaccacaaacagu

SEQ ID NO: 606779 - RNA, 19 nt, Homo sapiens
acacugagaggccgucaca

SEQ ID NO: 606780 - RNA, 19 nt, Homo sapiens
cagcuagccagaaugaaca

SEQ ID NO: 606781 - RNA, 19 nt, Homo sapiens
ggucaccagagaacacaga

SEQ ID NO: 606782 - RNA, 19 nt, Homo sapiens
ugaauucuggagacgauau

SEQ ID NO: 606783 - RNA, 19 nt, Homo sapiens
guuaugaagaaaucugugu

SEQ ID NO: 606784 - RNA, 19 nt, Homo sapiens
acucagcuagccagaauga

SEQ ID NO: 606785 - RNA, 19 nt, Homo sapiens
caaggucuccagguacuca

SEQ ID NO: 606786 - RNA, 19 nt, Homo sapiens
agaggcuccugguuucuca

SEQ ID NO: 606787 - RNA, 19 nt, Homo sapiens
gcuguucccuuucguguaa

SEQ ID NO: 606788 - RNA, 19 nt, Homo sapiens
gaaaguggaaccagaaaug

SEQ ID NO: 606789 - RNA, 19 nt, Homo sapiens
ccggagaccuuuggaguua

SEQ ID NO: 606790 - RNA, 19 nt, Homo sapiens
cgaaggagguugacaccaa

SEQ ID NO: 606791 - RNA, 19 nt, Homo sapiens
gcagugagguuaggaagga

SEQ ID NO: 606792 - RNA, 19 nt, Homo sapiens
ggagauucaucaaguacuu

SEQ ID NO: 606793 - RNA, 19 nt, Homo sapiens
gaaauaggaaggugggauu

SEQ ID NO: 606794 - RNA, 19 nt, Homo sapiens
gggaacugcuccuaucaga

SEQ ID NO: 606795 - RNA, 19 nt, Homo sapiens
ccagagacaugaagauucu

SEQ ID NO: 606796 - RNA, 19 nt, Homo sapiens
gcugggagauucaucaagu

SEQ ID NO: 606797 - RNA, 19 nt, Homo sapiens
cgacuuggaugcccaugga

SEQ ID NO: 606798 - RNA, 19 nt, Homo sapiens
acacagaccuuuggcuuca

SEQ ID NO: 606799 - RNA, 19 nt, Homo sapiens
gaaauuucuagcuucagua

SEQ ID NO: 606800 - RNA, 19 nt, Homo sapiens
ggcuguggcuguucccuuu

SEQ ID NO: 606801 - RNA, 19 nt, Homo sapiens
ucucuucccuccauuccua

SEQ ID NO: 606802 - RNA, 19 nt, Homo sapiens
agaauccaguuaccucaaa

SEQ ID NO: 606803 - RNA, 19 nt, Homo sapiens
cuaguggacugcaucucua

SEQ ID NO: 606804 - RNA, 19 nt, Homo sapiens
gaagauucugcucaucauu

SEQ ID NO: 606805 - RNA, 19 nt, Homo sapiens
ccaaaugacacagaccuuu

SEQ ID NO: 606806 - RNA, 19 nt, Homo sapiens
ccucaaagcuccccaacuu

SEQ ID NO: 606807 - RNA, 19 nt, Homo sapiens
ggagaccuuuggaguuaag

SEQ ID NO: 606808 - RNA, 19 nt, Homo sapiens
gcgcucagaucaagaaucc

SEQ ID NO: 606809 - RNA, 19 nt, Homo sapiens
gaucaagaauccaguuacc

SEQ ID NO: 606810 - RNA, 19 nt, Homo sapiens
cagaucaagaauccaguua

SEQ ID NO: 606811 - RNA, 19 nt, Homo sapiens
ggaaaguggaaccagaaau

SEQ ID NO: 606812 - RNA, 19 nt, Homo sapiens
gacugcaucucuaccacuu

SEQ ID NO: 606813 - RNA, 19 nt, Homo sapiens
ugaagauucugcucaucau

SEQ ID NO: 606814 - RNA, 19 nt, Homo sapiens
ggaugcccauggaauuauc

SEQ ID NO: 606815 - RNA, 19 nt, Homo sapiens
acucagaaaucacgcaucu

SEQ ID NO: 606816 - RNA, 19 nt, Homo sapiens
gaauccaguuaccucaaag

SEQ ID NO: 606817 - RNA, 19 nt, Homo sapiens
guuauuacucugucuugaa

SEQ ID NO: 606818 - RNA, 19 nt, Homo sapiens
caaaugcagugagguuagg

SEQ ID NO: 606819 - RNA, 19 nt, Homo sapiens
gccuggagcugggagauuc

SEQ ID NO: 606820 - RNA, 19 nt, Homo sapiens
gacuagaagagcugcauga

SEQ ID NO: 606821 - RNA, 19 nt, Homo sapiens
gagauucaucaaguacuuu

SEQ ID NO: 606822 - RNA, 19 nt, Homo sapiens
gcugcuguuugccugguuu

SEQ ID NO: 606823 - RNA, 19 nt, Homo sapiens
cugggagauucaucaagua

SEQ ID NO: 606824 - RNA, 19 nt, Homo sapiens
ggagcugggagauucauca

SEQ ID NO: 606825 - RNA, 19 nt, Homo sapiens
agaugugacugcugcuguu

SEQ ID NO: 606826 - RNA, 19 nt, Homo sapiens
uaucuucacugaggacuac

SEQ ID NO: 606827 - RNA, 19 nt, Homo sapiens
cagguucucuucccuccau

SEQ ID NO: 606828 - RNA, 19 nt, Homo sapiens
cuguuugccugguuucuga

SEQ ID NO: 606829 - RNA, 19 nt, Homo sapiens
cugcaucucuaccacuuca

SEQ ID NO: 606830 - RNA, 19 nt, Homo sapiens
gcuaguggacugcaucucu

SEQ ID NO: 606831 - RNA, 19 nt, Homo sapiens
uugcucagcuccucagagu

SEQ ID NO: 606832 - RNA, 19 nt, Homo sapiens
aagauucugcucaucauug

SEQ ID NO: 606833 - RNA, 19 nt, Homo sapiens
gcccauggaauuaucuuca

SEQ ID NO: 606834 - RNA, 19 nt, Homo sapiens
ccaaaugcagugagguuag

SEQ ID NO: 606835 - RNA, 19 nt, Homo sapiens
gaugugacugcugcuguuu

SEQ ID NO: 606836 - RNA, 19 nt, Homo sapiens
cuagaagagcugcaugaug

SEQ ID NO: 606837 - RNA, 19 nt, Homo sapiens
gccagagacaugaagauuc

SEQ ID NO: 606838 - RNA, 19 nt, Homo sapiens
gagcugggagauucaucaa

SEQ ID NO: 606839 - RNA, 19 nt, Homo sapiens
ccagcugggcuucgacuug

SEQ ID NO: 606840 - RNA, 19 nt, Homo sapiens
cagaacucaugcagcuguu

SEQ ID NO: 606841 - RNA, 19 nt, Homo sapiens
gcggcugucucagaacuca

SEQ ID NO: 606842 - RNA, 19 nt, Homo sapiens
cuucagggacucagaaauc

SEQ ID NO: 606843 - RNA, 19 nt, Homo sapiens
auuucuagcuucaguacuu

SEQ ID NO: 606844 - RNA, 19 nt, Homo sapiens
aaaguaccucugccuguga

SEQ ID NO: 606845 - RNA, 19 nt, Homo sapiens
gaaggagggcaggguucuu

SEQ ID NO: 606846 - RNA, 19 nt, Homo sapiens
gcugagacagggucaccuu

SEQ ID NO: 606847 - RNA, 19 nt, Homo sapiens
gcaaucauucagcgacagu

SEQ ID NO: 606848 - RNA, 19 nt, Homo sapiens
gugucgggcucucgugugu

SEQ ID NO: 606849 - RNA, 19 nt, Homo sapiens
ccaugugcacgaccucauu

SEQ ID NO: 606850 - RNA, 19 nt, Homo sapiens
cggagaccuuuggaguuaa

SEQ ID NO: 606851 - RNA, 19 nt, Homo sapiens
aaggagggcaggguucuuu

SEQ ID NO: 606852 - RNA, 19 nt, Homo sapiens
uuggaugcccauggaauua

SEQ ID NO: 606853 - RNA, 19 nt, Homo sapiens
gcaugguccggaaggcaaa

SEQ ID NO: 606854 - RNA, 19 nt, Homo sapiens
gccaggcuguccuuagcau

SEQ ID NO: 606855 - RNA, 19 nt, Homo sapiens
gcuguucccuuucguguaa

SEQ ID NO: 606856 - RNA, 19 nt, Homo sapiens
gaaaguggaaccagaaaug

SEQ ID NO: 606857 - RNA, 19 nt, Homo sapiens
ccggagaccuuuggaguua

SEQ ID NO: 606858 - RNA, 19 nt, Homo sapiens
cgaaggagguugacaccaa

SEQ ID NO: 606859 - RNA, 19 nt, Homo sapiens
gcagugagguuaggaagga

SEQ ID NO: 606860 - RNA, 19 nt, Homo sapiens
ggagauucaucaaguacuu

SEQ ID NO: 606861 - RNA, 19 nt, Homo sapiens
gaaauaggaaggugggauu

SEQ ID NO: 606862 - RNA, 19 nt, Homo sapiens
gggaacugcuccuaucaga

SEQ ID NO: 606863 - RNA, 19 nt, Homo sapiens
ccagagacaugaagauucu

SEQ ID NO: 606864 - RNA, 19 nt, Homo sapiens
gcugggagauucaucaagu

SEQ ID NO: 606865 - RNA, 19 nt, Homo sapiens
cgacuuggaugcccaugga

SEQ ID NO: 606866 - RNA, 19 nt, Homo sapiens
acacagaccuuuggcuuca

SEQ ID NO: 606867 - RNA, 19 nt, Homo sapiens
gaaauuucuagcuucagua

SEQ ID NO: 606868 - RNA, 19 nt, Homo sapiens
ggcuguggcuguucccuuu

SEQ ID NO: 606869 - RNA, 19 nt, Homo sapiens
ucucuucccuccauuccua

SEQ ID NO: 606870 - RNA, 19 nt, Homo sapiens
agaauccaguuaccucaaa

SEQ ID NO: 606871 - RNA, 19 nt, Homo sapiens
cuaguggacugcaucucua

SEQ ID NO: 606872 - RNA, 19 nt, Homo sapiens
gaagauucugcucaucauu

SEQ ID NO: 606873 - RNA, 19 nt, Homo sapiens
ccaaaugacacagaccuuu

SEQ ID NO: 606874 - RNA, 19 nt, Homo sapiens
ggacuacaggaccagagua

SEQ ID NO: 606875 - RNA, 19 nt, Homo sapiens
ccucaaagcuccccaacuu

SEQ ID NO: 606876 - RNA, 19 nt, Homo sapiens
ggagaccuuuggaguuaag

SEQ ID NO: 606877 - RNA, 19 nt, Homo sapiens
gcgcucagaucaagaaucc

SEQ ID NO: 606878 - RNA, 19 nt, Homo sapiens
gaucaagaauccaguuacc

SEQ ID NO: 606879 - RNA, 19 nt, Homo sapiens
cagaucaagaauccaguua

SEQ ID NO: 606880 - RNA, 19 nt, Homo sapiens
gaccagaguaugugacugu

SEQ ID NO: 606881 - RNA, 19 nt, Homo sapiens
cuacaggaccagaguaugu

SEQ ID NO: 606882 - RNA, 19 nt, Homo sapiens
ggaaaguggaaccagaaau

SEQ ID NO: 606883 - RNA, 19 nt, Homo sapiens
gacugcaucucuaccacuu

SEQ ID NO: 606884 - RNA, 19 nt, Homo sapiens
ugaagauucugcucaucau

SEQ ID NO: 606885 - RNA, 19 nt, Homo sapiens
ggaugcccauggaauuauc

SEQ ID NO: 606886 - RNA, 19 nt, Homo sapiens
acucagaaaucacgcaucu

SEQ ID NO: 606887 - RNA, 19 nt, Homo sapiens
gaauccaguuaccucaaag

SEQ ID NO: 606888 - RNA, 19 nt, Homo sapiens
guuauuacucugucuugaa

SEQ ID NO: 606889 - RNA, 19 nt, Homo sapiens
caaaugcagugagguuagg

SEQ ID NO: 606890 - RNA, 19 nt, Homo sapiens
gccuggagcugggagauuc

SEQ ID NO: 606891 - RNA, 19 nt, Homo sapiens
gacuagaagagcugcauga

SEQ ID NO: 606892 - RNA, 19 nt, Homo sapiens
gagauucaucaaguacuuu

SEQ ID NO: 606893 - RNA, 19 nt, Homo sapiens
gcugcuguuugccugguuu

SEQ ID NO: 606894 - RNA, 19 nt, Homo sapiens
cugggagauucaucaagua

SEQ ID NO: 606895 - RNA, 19 nt, Homo sapiens
ggagcugggagauucauca

SEQ ID NO: 606896 - RNA, 19 nt, Homo sapiens
agaugugacugcugcuguu

SEQ ID NO: 606897 - RNA, 19 nt, Homo sapiens
uaucuucacugaggacuac

SEQ ID NO: 606898 - RNA, 19 nt, Homo sapiens
cagguucucuucccuccau

SEQ ID NO: 606899 - RNA, 19 nt, Homo sapiens
cuguuugccugguuucuga

SEQ ID NO: 606900 - RNA, 19 nt, Homo sapiens
cugcaucucuaccacuuca

SEQ ID NO: 606901 - RNA, 19 nt, Homo sapiens
gcuaguggacugcaucucu

SEQ ID NO: 606902 - RNA, 19 nt, Homo sapiens
uugcucagcuccucagagu

SEQ ID NO: 606903 - RNA, 19 nt, Homo sapiens
aagauucugcucaucauug

SEQ ID NO: 606904 - RNA, 19 nt, Homo sapiens
gcccauggaauuaucuuca

SEQ ID NO: 606905 - RNA, 19 nt, Homo sapiens
ccaaaugcagugagguuag

SEQ ID NO: 606906 - RNA, 19 nt, Homo sapiens
gaugugacugcugcuguuu

SEQ ID NO: 606907 - RNA, 19 nt, Homo sapiens
cuagaagagcugcaugaug

SEQ ID NO: 606908 - RNA, 19 nt, Homo sapiens
gccagagacaugaagauuc

SEQ ID NO: 606909 - RNA, 19 nt, Homo sapiens
gagcugggagauucaucaa

SEQ ID NO: 606910 - RNA, 19 nt, Homo sapiens
ccagcugggcuucgacuug

SEQ ID NO: 606911 - RNA, 19 nt, Homo sapiens
gacuacaggaccagaguau

SEQ ID NO: 606912 - RNA, 19 nt, Homo sapiens
cagaacucaugcagcuguu

SEQ ID NO: 606913 - RNA, 19 nt, Homo sapiens
gcggcugucucagaacuca

SEQ ID NO: 606914 - RNA, 19 nt, Homo sapiens
cuucagggacucagaaauc

SEQ ID NO: 606915 - RNA, 19 nt, Homo sapiens
auuucuagcuucaguacuu

SEQ ID NO: 606916 - RNA, 19 nt, Homo sapiens
aaaguaccucugccuguga

SEQ ID NO: 606917 - RNA, 19 nt, Homo sapiens
gaaggagggcaggguucuu

SEQ ID NO: 606918 - RNA, 19 nt, Homo sapiens
gcugagacagggucaccuu

SEQ ID NO: 606919 - RNA, 19 nt, Homo sapiens
gcaaucauucagcgacagu

SEQ ID NO: 606920 - RNA, 19 nt, Homo sapiens
gugucgggcucucgugugu

SEQ ID NO: 606921 - RNA, 19 nt, Homo sapiens
ccaugugcacgaccucauu

SEQ ID NO: 606922 - RNA, 19 nt, Homo sapiens
cggagaccuuuggaguuaa

SEQ ID NO: 606923 - RNA, 19 nt, Homo sapiens
aaggagggcaggguucuuu

SEQ ID NO: 606924 - RNA, 19 nt, Homo sapiens
uuggaugcccauggaauua

SEQ ID NO: 606925 - RNA, 19 nt, Homo sapiens
gcaugguccggaaggcaaa

SEQ ID NO: 606926 - RNA, 19 nt, Homo sapiens
gccaggcuguccuuagcau

SEQ ID NO: 606927 - RNA, 19 nt, Homo sapiens
gacaugagcugcugaaguu

SEQ ID NO: 606928 - RNA, 19 nt, Homo sapiens
ccaaagagauauaccauug

SEQ ID NO: 606929 - RNA, 19 nt, Homo sapiens
caaccaaacugacuacaga

SEQ ID NO: 606930 - RNA, 19 nt, Homo sapiens
cuacggagcuguacuaugu

SEQ ID NO: 606931 - RNA, 19 nt, Homo sapiens
caaacugacuacagaauau

SEQ ID NO: 606932 - RNA, 19 nt, Homo sapiens
gagcuguacuauguucuua

SEQ ID NO: 606933 - RNA, 19 nt, Homo sapiens
ucacaggccucccaguaaa

SEQ ID NO: 606934 - RNA, 19 nt, Homo sapiens
gaggacagcuuuaacaacu

SEQ ID NO: 606935 - RNA, 19 nt, Homo sapiens
ggugugggcuguccaauuc

SEQ ID NO: 606936 - RNA, 19 nt, Homo sapiens
caaagucauucaagcugua

SEQ ID NO: 606937 - RNA, 19 nt, Homo sapiens
gggaaaccuugcaaacaaa

SEQ ID NO: 606938 - RNA, 19 nt, Homo sapiens
gaagagacugagcaucuaa

SEQ ID NO: 606939 - RNA, 19 nt, Homo sapiens
gcagaagacagaaugaaga

SEQ ID NO: 606940 - RNA, 19 nt, Homo sapiens
cuaggcagcugguaauaga

SEQ ID NO: 606941 - RNA, 19 nt, Homo sapiens
gggaggaacuggacucucu

SEQ ID NO: 606942 - RNA, 19 nt, Homo sapiens
gagcggagcagccauuguu

SEQ ID NO: 606943 - RNA, 19 nt, Homo sapiens
ccaaacugacuacagaaua

SEQ ID NO: 606944 - RNA, 19 nt, Homo sapiens
acaaacggcuucagaacug

SEQ ID NO: 606945 - RNA, 19 nt, Homo sapiens
ugaagagacugagcaucua

SEQ ID NO: 606946 - RNA, 19 nt, Homo sapiens
gacaugaugcggauaaaga

SEQ ID NO: 606947 - RNA, 19 nt, Homo sapiens
gggcccaacucccauguau

SEQ ID NO: 606948 - RNA, 19 nt, Homo sapiens
ccaauuccacucucaacua

SEQ ID NO: 606949 - RNA, 19 nt, Homo sapiens
gaaguggcagcgcauggua

SEQ ID NO: 606950 - RNA, 19 nt, Homo sapiens
gggaugcauucacgacuga

SEQ ID NO: 606951 - RNA, 19 nt, Homo sapiens
agggaaaccuugcaaacaa

SEQ ID NO: 606952 - RNA, 19 nt, Homo sapiens
guaccuggaguucauguuu

SEQ ID NO: 606953 - RNA, 19 nt, Homo sapiens
ucauguggaugccuacuug

SEQ ID NO: 606954 - RNA, 19 nt, Homo sapiens
ggacagaggagugugacaa

SEQ ID NO: 606955 - RNA, 19 nt, Homo sapiens
ggacaugagcugcugaagu

SEQ ID NO: 606956 - RNA, 19 nt, Homo sapiens
ccagggagcagaagacaga

SEQ ID NO: 606957 - RNA, 19 nt, Homo sapiens
auaaagacguggcacuuca

SEQ ID NO: 606958 - RNA, 19 nt, Homo sapiens
ugaggaugaugccauguug

SEQ ID NO: 606959 - RNA, 19 nt, Homo sapiens
caguggccauuguaacuuu

SEQ ID NO: 606960 - RNA, 19 nt, Homo sapiens
gaacuggacagaggagugu

SEQ ID NO: 606961 - RNA, 19 nt, Homo sapiens
gaggauggaccaaagagau

SEQ ID NO: 606962 - RNA, 19 nt, Homo sapiens
gagcagaagacagaaugaa

SEQ ID NO: 606963 - RNA, 19 nt, Homo sapiens
caauuccacucucaacuac

SEQ ID NO: 606964 - RNA, 19 nt, Homo sapiens
ggauaaagacguggcacuu

SEQ ID NO: 606965 - RNA, 19 nt, Homo sapiens
gcuguacuauguucuuaag

SEQ ID NO: 606966 - RNA, 19 nt, Homo sapiens
gauaaagacguggcacuuc

SEQ ID NO: 606967 - RNA, 19 nt, Homo sapiens
gagggaaaccuugcaaaca

SEQ ID NO: 606968 - RNA, 19 nt, Homo sapiens
cgucacaggccucccagua

SEQ ID NO: 606969 - RNA, 19 nt, Homo sapiens
gguuguaccuggaguucau

SEQ ID NO: 606970 - RNA, 19 nt, Homo sapiens
gacgacaugaugcggauaa

SEQ ID NO: 606971 - RNA, 19 nt, Homo sapiens
gauggaccaaagagauaua

SEQ ID NO: 606972 - RNA, 19 nt, Homo sapiens
ggaggcagaggcagcaaga

SEQ ID NO: 606973 - RNA, 19 nt, Homo sapiens
ccacuuaucccagcuccaa

SEQ ID NO: 606974 - RNA, 19 nt, Homo sapiens
ugacgacgaggacagcuuu

SEQ ID NO: 606975 - RNA, 19 nt, Homo sapiens
gaaggaggaggaggagaga

SEQ ID NO: 606976 - RNA, 19 nt, Homo sapiens
gacagaaugaagagacuga

SEQ ID NO: 606977 - RNA, 19 nt, Homo sapiens
ugacgcagccaacggcauu

SEQ ID NO: 606978 - RNA, 19 nt, Homo sapiens
uaacaaacggcuucagaac

SEQ ID NO: 606979 - RNA, 19 nt, Homo sapiens
ggacuccucugggcuugca

SEQ ID NO: 606980 - RNA, 19 nt, Homo sapiens
caacagcaacagcaagaag

SEQ ID NO: 606981 - RNA, 19 nt, Homo sapiens
gacgaggacagcuuuaaca

SEQ ID NO: 606982 - RNA, 19 nt, Homo sapiens
uaccuggaguucauguuug

SEQ ID NO: 606983 - RNA, 19 nt, Homo sapiens
uguacuauguucuuaagca

SEQ ID NO: 606984 - RNA, 19 nt, Homo sapiens
ccauguugaccaucacuuu

SEQ ID NO: 606985 - RNA, 19 nt, Homo sapiens
cagaauauuugagcuuaac

SEQ ID NO: 606986 - RNA, 19 nt, Homo sapiens
ccagguuguuccucaaagu

SEQ ID NO: 606987 - RNA, 19 nt, Homo sapiens
gggagcagaagacagaaug

SEQ ID NO: 606988 - RNA, 19 nt, Homo sapiens
gucacaggccucccaguaa

SEQ ID NO: 606989 - RNA, 19 nt, Homo sapiens
gaaaccuugcaaacaaaga

SEQ ID NO: 606990 - RNA, 19 nt, Homo sapiens
ggaccaaagagauauacca

SEQ ID NO: 606991 - RNA, 19 nt, Homo sapiens
ucacgacugaguucuuuga

SEQ ID NO: 606992 - RNA, 19 nt, Homo sapiens
ggagcagaagacagaauga

SEQ ID NO: 606993 - RNA, 19 nt, Homo sapiens
caacuaccuccgacucugu

SEQ ID NO: 606994 - RNA, 19 nt, Homo sapiens
gugcuacggagcuguacua

SEQ ID NO: 606995 - RNA, 19 nt, Homo sapiens
gaccaaagagauauaccau

SEQ ID NO: 606996 - RNA, 19 nt, Homo sapiens
ggaggauggaccaaagaga

SEQ ID NO: 606997 - RNA, 19 nt, Homo sapiens
gaaugaagagacugagcau

SEQ ID NO: 606998 - RNA, 19 nt, Homo sapiens
uggagaacacccaguuuga

SEQ ID NO: 606999 - RNA, 19 nt, Homo sapiens
gcggagcagccauuguuga

SEQ ID NO: 607000 - RNA, 19 nt, Homo sapiens
ggagcuguacuauguucuu

SEQ ID NO: 607001 - RNA, 19 nt, Homo sapiens
cuacuuccgcagcaucuuu

SEQ ID NO: 607002 - RNA, 19 nt, Homo sapiens
gacagaggagugugacaau

SEQ ID NO: 607003 - RNA, 19 nt, Homo sapiens
aaagagcggagcagccauu

SEQ ID NO: 607004 - RNA, 19 nt, Homo sapiens
uuaacaaacggcuucagaa

SEQ ID NO: 607005 - RNA, 19 nt, Homo sapiens
cauauggcaaccaaacuga

SEQ ID NO: 607006 - RNA, 19 nt, Homo sapiens
gggaggcacacaccauaug

SEQ ID NO: 607007 - RNA, 19 nt, Homo sapiens
uaucccagcuccaaguuuu

SEQ ID NO: 607008 - RNA, 19 nt, Homo sapiens
gcucaugucacgccacaag

SEQ ID NO: 607009 - RNA, 19 nt, Homo sapiens
ggauggaccaaagagauau

SEQ ID NO: 607010 - RNA, 19 nt, Homo sapiens
auucacgacugaguucuuu

SEQ ID NO: 607011 - RNA, 19 nt, Homo sapiens
cuacagaauauuugagcuu

SEQ ID NO: 607012 - RNA, 19 nt, Homo sapiens
agacugagcaucuaaaaug

SEQ ID NO: 607013 - RNA, 19 nt, Homo sapiens
aagaagagcccagcuagca

SEQ ID NO: 607014 - RNA, 19 nt, Homo sapiens
aagaagaagagcccagcua

SEQ ID NO: 607015 - RNA, 19 nt, Homo sapiens
gcaacaccaacaacagcaa

SEQ ID NO: 607016 - RNA, 19 nt, Homo sapiens
ggcauuccacagcaacuuu

SEQ ID NO: 607017 - RNA, 19 nt, Homo sapiens
aaaccuugcaaacaaagaa

SEQ ID NO: 607018 - RNA, 19 nt, Homo sapiens
aggauggaccaaagagaua

SEQ ID NO: 607019 - RNA, 19 nt, Homo sapiens
ggaaaccuugcaaacaaag

SEQ ID NO: 607020 - RNA, 19 nt, Homo sapiens
gcauuccacagcaacuuug

SEQ ID NO: 607021 - RNA, 19 nt, Homo sapiens
gaggaugaugccauguuga

SEQ ID NO: 607022 - RNA, 19 nt, Homo sapiens
gcugugcgugcgagucuuu

SEQ ID NO: 607023 - RNA, 19 nt, Homo sapiens
cagccauuguugagggaaa

SEQ ID NO: 607024 - RNA, 19 nt, Homo sapiens
gcaaccaaacugacuacag

SEQ ID NO: 607025 - RNA, 19 nt, Homo sapiens
ggaggcacacaccauaugg

SEQ ID NO: 607026 - RNA, 19 nt, Homo sapiens
gauacucgagcccaugcaa

SEQ ID NO: 607027 - RNA, 19 nt, Homo sapiens
uaagaaagcugggagauag

SEQ ID NO: 607028 - RNA, 19 nt, Homo sapiens
gcugugaacuguccuguug

SEQ ID NO: 607029 - RNA, 19 nt, Homo sapiens
ggccugacauggcuauaua

SEQ ID NO: 607030 - RNA, 19 nt, Homo sapiens
ggagugaccugcucagagu

SEQ ID NO: 607031 - RNA, 19 nt, Homo sapiens
gaggcaagcuggcugugaa

SEQ ID NO: 607032 - RNA, 19 nt, Homo sapiens
gcagggaggucggaggaaa

SEQ ID NO: 607033 - RNA, 19 nt, Homo sapiens
gaacagaaggaaggaaaga

SEQ ID NO: 607034 - RNA, 19 nt, Homo sapiens
caagaaucacagaauguua

SEQ ID NO: 607035 - RNA, 19 nt, Homo sapiens
gagaggaggcugcagaaga

SEQ ID NO: 607036 - RNA, 19 nt, Homo sapiens
guaaagauuguucugugua

SEQ ID NO: 607037 - RNA, 19 nt, Homo sapiens
gaaggaaggagggaagaaa

SEQ ID NO: 607038 - RNA, 19 nt, Homo sapiens
gcagccagccgcuaagaaa

SEQ ID NO: 607039 - RNA, 19 nt, Homo sapiens
ggagauagggaacagaaga

SEQ ID NO: 607040 - RNA, 19 nt, Homo sapiens
caucagcguuugcucaguu

SEQ ID NO: 607041 - RNA, 19 nt, Homo sapiens
ugaaguggguggagcauca

SEQ ID NO: 607042 - RNA, 19 nt, Homo sapiens
ucucccaucuccuacuuua

SEQ ID NO: 607043 - RNA, 19 nt, Homo sapiens
ucacuucucuugccuuagu

SEQ ID NO: 607044 - RNA, 19 nt, Homo sapiens
gaaagaaagaugggaggaa

SEQ ID NO: 607045 - RNA, 19 nt, Homo sapiens
caggagcucuggugaagug

SEQ ID NO: 607046 - RNA, 19 nt, Homo sapiens
gaagggaagggcagaagga

SEQ ID NO: 607047 - RNA, 19 nt, Homo sapiens
ugucacuucucuugccuua

SEQ ID NO: 607048 - RNA, 19 nt, Homo sapiens
ccaaggagcagcaugaauc

SEQ ID NO: 607049 - RNA, 19 nt, Homo sapiens
gcuccuggcuguaguuugg

SEQ ID NO: 607050 - RNA, 19 nt, Homo sapiens
caagcuggcugugaacugu

SEQ ID NO: 607051 - RNA, 19 nt, Homo sapiens
gaaagcaaaggaacagaag

SEQ ID NO: 607052 - RNA, 19 nt, Homo sapiens
gagguagccuucaaucacu

SEQ ID NO: 607053 - RNA, 19 nt, Homo sapiens
auuaaggcccuguucauua

SEQ ID NO: 607054 - RNA, 19 nt, Homo sapiens
ggagaaagagaagacaaga

SEQ ID NO: 607055 - RNA, 19 nt, Homo sapiens
uccagcagaucccuuguuu

SEQ ID NO: 607056 - RNA, 19 nt, Homo sapiens
cuaagaaagcugggagaua

SEQ ID NO: 607057 - RNA, 19 nt, Homo sapiens
cacaauagccccaauguuu

SEQ ID NO: 607058 - RNA, 19 nt, Homo sapiens
ggaagugccagggugguuu

SEQ ID NO: 607059 - RNA, 19 nt, Homo sapiens
gaaggaaggaaagaaagau

SEQ ID NO: 607060 - RNA, 19 nt, Homo sapiens
ccaagaaucacagaauguu

SEQ ID NO: 607061 - RNA, 19 nt, Homo sapiens
gaugauucccguucucuca

SEQ ID NO: 607062 - RNA, 19 nt, Homo sapiens
agaggaggcugcagaagag

SEQ ID NO: 607063 - RNA, 19 nt, Homo sapiens
gauauuaaggcccuguuca

SEQ ID NO: 607064 - RNA, 19 nt, Homo sapiens
ggucucccaucuccuacuu

SEQ ID NO: 607065 - RNA, 19 nt, Homo sapiens
gagcugacaggacccuuga

SEQ ID NO: 607066 - RNA, 19 nt, Homo sapiens
gcuguaguuuggaugauuc

SEQ ID NO: 607067 - RNA, 19 nt, Homo sapiens
ccucuucccucuugaugau

SEQ ID NO: 607068 - RNA, 19 nt, Homo sapiens
ccaggucucccaucuccua

SEQ ID NO: 607069 - RNA, 19 nt, Homo sapiens
ggguggagcaucagcguuu

SEQ ID NO: 607070 - RNA, 19 nt, Homo sapiens
acagaaggaaggaaagaaa

SEQ ID NO: 607071 - RNA, 19 nt, Homo sapiens
gaaagccucccuucuucuc

SEQ ID NO: 607072 - RNA, 19 nt, Homo sapiens
uguaaagauuguucugugu

SEQ ID NO: 607073 - RNA, 19 nt, Homo sapiens
ggccuucccuucguguuga

SEQ ID NO: 607074 - RNA, 19 nt, Homo sapiens
gcgguuaugucuccuccau

SEQ ID NO: 607075 - RNA, 19 nt, Homo sapiens
agggaagaaugcagagaaa

SEQ ID NO: 607076 - RNA, 19 nt, Homo sapiens
gggcugccuuauuuaaagu

SEQ ID NO: 607077 - RNA, 19 nt, Homo sapiens
ggacccaugccuuucugaa

SEQ ID NO: 607078 - RNA, 19 nt, Homo sapiens
gggccuuccuuccucaugu

SEQ ID NO: 607079 - RNA, 19 nt, Homo sapiens
gacgcccucuucccucuug

SEQ ID NO: 607080 - RNA, 19 nt, Homo sapiens
ugccaagaaucacagaaug

SEQ ID NO: 607081 - RNA, 19 nt, Homo sapiens
cccagagggucaaggaaug

SEQ ID NO: 607082 - RNA, 19 nt, Homo sapiens
uuaccuaugcugcugcuaa

SEQ ID NO: 607083 - RNA, 19 nt, Homo sapiens
ggaagugcagcaggaauag

SEQ ID NO: 607084 - RNA, 19 nt, Homo sapiens
aggaagugcagcaggaaua

SEQ ID NO: 607085 - RNA, 19 nt, Homo sapiens
agaaagcaaaggaacagaa

SEQ ID NO: 607086 - RNA, 19 nt, Homo sapiens
gcaaacgccugcaaaacag

SEQ ID NO: 607087 - RNA, 19 nt, Homo sapiens
cagggaagaaugcagagaa

SEQ ID NO: 607088 - RNA, 19 nt, Homo sapiens
ggcuguaguuuggaugauu

SEQ ID NO: 607089 - RNA, 19 nt, Homo sapiens
agaaggaaggaaagaaaga

SEQ ID NO: 607090 - RNA, 19 nt, Homo sapiens
ucaccucgcaccugcugua

SEQ ID NO: 607091 - RNA, 19 nt, Homo sapiens
gccaagaaucacagaaugu

SEQ ID NO: 607092 - RNA, 19 nt, Homo sapiens
uauuaaggcccuguucauu

SEQ ID NO: 607093 - RNA, 19 nt, Homo sapiens
ucccaauacucccuucuuc

SEQ ID NO: 607094 - RNA, 19 nt, Homo sapiens
gacugacuuuggagaccua

SEQ ID NO: 607095 - RNA, 19 nt, Homo sapiens
ccaggagggagaaagagaa

SEQ ID NO: 607096 - RNA, 19 nt, Homo sapiens
ggaggaagugcagcaggaa

SEQ ID NO: 607097 - RNA, 19 nt, Homo sapiens
ggaggccucacguccauuc

SEQ ID NO: 607098 - RNA, 19 nt, Homo sapiens
gggagaggaggcugcagaa

SEQ ID NO: 607099 - RNA, 19 nt, Homo sapiens
gcccagagggucaaggaau

SEQ ID NO: 607100 - RNA, 19 nt, Homo sapiens
gagcagccagccgcuaaga

SEQ ID NO: 607101 - RNA, 19 nt, Homo sapiens
aagcaaaggaacagaagga

SEQ ID NO: 607102 - RNA, 19 nt, Homo sapiens
gcaagcuggcugugaacug

SEQ ID NO: 607103 - RNA, 19 nt, Homo sapiens
aagcaaaugaagugccuuu

SEQ ID NO: 607104 - RNA, 19 nt, Homo sapiens
cccgugaaguccuuuguca

SEQ ID NO: 607105 - RNA, 19 nt, Homo sapiens
gcuggaagacggcaauguc

SEQ ID NO: 607106 - RNA, 19 nt, Homo sapiens
gagccugaugcccaacuuu

SEQ ID NO: 607107 - RNA, 19 nt, Homo sapiens
gggagaaagagaagacaag

SEQ ID NO: 607108 - RNA, 19 nt, Homo sapiens
cgagguagccuucaaucac

SEQ ID NO: 607109 - RNA, 19 nt, Homo sapiens
cuuagugugccucccaaua

SEQ ID NO: 607110 - RNA, 19 nt, Homo sapiens
gguggagcaucagcguuug

SEQ ID NO: 607111 - RNA, 19 nt, Homo sapiens
cagcagaucccuuguuuuc

SEQ ID NO: 607112 - RNA, 19 nt, Homo sapiens
gagaaagagaagacaagag

SEQ ID NO: 607113 - RNA, 19 nt, Homo sapiens
ggagggagaaagagaagac

SEQ ID NO: 607114 - RNA, 19 nt, Homo sapiens
aagaauccguccaguccau

SEQ ID NO: 607115 - RNA, 19 nt, Homo sapiens
ggaacagaaggaaggaaag

SEQ ID NO: 607116 - RNA, 19 nt, Homo sapiens
ccccauaacuggcagcauu

SEQ ID NO: 607117 - RNA, 19 nt, Homo sapiens
ugugaacuguccuguugug

SEQ ID NO: 607118 - RNA, 19 nt, Homo sapiens
gcaaaugaagugccuuuuc

SEQ ID NO: 607119 - RNA, 19 nt, Homo sapiens
cccaucuccuacuuuauga

SEQ ID NO: 607120 - RNA, 19 nt, Homo sapiens
gaccugcucagagucauug

SEQ ID NO: 607121 - RNA, 19 nt, Homo sapiens
ggcccaaggagcagcauga

SEQ ID NO: 607122 - RNA, 19 nt, Homo sapiens
ucccaucuccuacuuuaug

SEQ ID NO: 607123 - RNA, 19 nt, Homo sapiens
ucccuggacugacuuugga

SEQ ID NO: 607124 - RNA, 19 nt, Homo sapiens
aagaaucacagaauguuag

SEQ ID NO: 607125 - RNA, 19 nt, Homo sapiens
caaggagcagcaugaaucu

SEQ ID NO: 607126 - RNA, 19 nt, Homo sapiens
gauccagacagggcacauu

SEQ ID NO: 607127 - RNA, 19 nt, Homo sapiens
gaagacagcuguugaguga

SEQ ID NO: 607128 - RNA, 19 nt, Homo sapiens
gaacaucgauccuaagcua

SEQ ID NO: 607129 - RNA, 19 nt, Homo sapiens
gagcaaagcuaaauauuca

SEQ ID NO: 607130 - RNA, 19 nt, Homo sapiens
ccaaagagcugcacgguau

SEQ ID NO: 607131 - RNA, 19 nt, Homo sapiens
guagaucccuuuccuauug

SEQ ID NO: 607132 - RNA, 19 nt, Homo sapiens
gagauuggauggccucuaa

SEQ ID NO: 607133 - RNA, 19 nt, Homo sapiens
ucagugaccuucuguagua

SEQ ID NO: 607134 - RNA, 19 nt, Homo sapiens
caaauaaacucuguacaug

SEQ ID NO: 607135 - RNA, 19 nt, Homo sapiens
ggucagaggucaaaauuua

SEQ ID NO: 607136 - RNA, 19 nt, Homo sapiens
guauauaccuuacuaguag

SEQ ID NO: 607137 - RNA, 19 nt, Homo sapiens
caaacugaguauuguguua

SEQ ID NO: 607138 - RNA, 19 nt, Homo sapiens
gaugaacgauaaugacaaa

SEQ ID NO: 607139 - RNA, 19 nt, Homo sapiens
gaacgagcccacuaaauga

SEQ ID NO: 607140 - RNA, 19 nt, Homo sapiens
gcaguuccaugcaaauauu

SEQ ID NO: 607141 - RNA, 19 nt, Homo sapiens
aaacggagacuacaucaua

SEQ ID NO: 607142 - RNA, 19 nt, Homo sapiens
gaagugagugugauuguuu

SEQ ID NO: 607143 - RNA, 19 nt, Homo sapiens
gagcccaucuggagaauga

SEQ ID NO: 607144 - RNA, 19 nt, Homo sapiens
gagaauccaucccauccua

SEQ ID NO: 607145 - RNA, 19 nt, Homo sapiens
auaaauagcucucauaguc

SEQ ID NO: 607146 - RNA, 19 nt, Homo sapiens
gagcagaauuauguugaua

SEQ ID NO: 607147 - RNA, 19 nt, Homo sapiens
gaaaguguaucuccuguac

SEQ ID NO: 607148 - RNA, 19 nt, Homo sapiens
agagguauguguaucuuua

SEQ ID NO: 607149 - RNA, 19 nt, Homo sapiens
guaaaugcguccugauaau

SEQ ID NO: 607150 - RNA, 19 nt, Homo sapiens
uggcuaagguguauaauug

SEQ ID NO: 607151 - RNA, 19 nt, Homo sapiens
gcagcaaucucaggacgua

SEQ ID NO: 607152 - RNA, 19 nt, Homo sapiens
guugauaaauuccgagaaa

SEQ ID NO: 607153 - RNA, 19 nt, Homo sapiens
aaucagaaaugccaacaaa

SEQ ID NO: 607154 - RNA, 19 nt, Homo sapiens
guaguugaauugucuucua

SEQ ID NO: 607155 - RNA, 19 nt, Homo sapiens
gaaagcaggagcaaagcua

SEQ ID NO: 607156 - RNA, 19 nt, Homo sapiens
gauccugaaucguaagaaa

SEQ ID NO: 607157 - RNA, 19 nt, Homo sapiens
gcuacaacauuccagcuuu

SEQ ID NO: 607158 - RNA, 19 nt, Homo sapiens
gcagacaccugagcgcauu

SEQ ID NO: 607159 - RNA, 19 nt, Homo sapiens
gccaguagauugucuguca

SEQ ID NO: 607160 - RNA, 19 nt, Homo sapiens
ggccuauucuuguaaguuu

SEQ ID NO: 607161 - RNA, 19 nt, Homo sapiens
agaaggaagagcagaauua

SEQ ID NO: 607162 - RNA, 19 nt, Homo sapiens
gaauggugguggugaaugu

SEQ ID NO: 607163 - RNA, 19 nt, Homo sapiens
gaagguuagugcacauuuc

SEQ ID NO: 607164 - RNA, 19 nt, Homo sapiens
uaaggugucagaacuauuu

SEQ ID NO: 607165 - RNA, 19 nt, Homo sapiens
ccagugaaauucugaaagu

SEQ ID NO: 607166 - RNA, 19 nt, Homo sapiens
gaagagcccaucuggagaa

SEQ ID NO: 607167 - RNA, 19 nt, Homo sapiens
gacagccucuucugcgaua

SEQ ID NO: 607168 - RNA, 19 nt, Homo sapiens
cgaacgagcccacuaaaug

SEQ ID NO: 607169 - RNA, 19 nt, Homo sapiens
uaucaugguuguccaagaa

SEQ ID NO: 607170 - RNA, 19 nt, Homo sapiens
ggaagcagcgacagcagua

SEQ ID NO: 607171 - RNA, 19 nt, Homo sapiens
caaggcagaugauguccaa

SEQ ID NO: 607172 - RNA, 19 nt, Homo sapiens
gucagcagcucuacauuga

SEQ ID NO: 607173 - RNA, 19 nt, Homo sapiens
acaguuaacucuuucuuuc

SEQ ID NO: 607174 - RNA, 19 nt, Homo sapiens
uagcacauacuguccauua

SEQ ID NO: 607175 - RNA, 19 nt, Homo sapiens
guacaaauacaacuucuuc

SEQ ID NO: 607176 - RNA, 19 nt, Homo sapiens
cugaagagcuacaacauuc

SEQ ID NO: 607177 - RNA, 19 nt, Homo sapiens
gcauuugcauguguaauau

SEQ ID NO: 607178 - RNA, 19 nt, Homo sapiens
gaaggaagagcagaauuau

SEQ ID NO: 607179 - RNA, 19 nt, Homo sapiens
ugacaaagacauaacagaa

SEQ ID NO: 607180 - RNA, 19 nt, Homo sapiens
gaacaacuggacccaaaga

SEQ ID NO: 607181 - RNA, 19 nt, Homo sapiens
gaucauugcgcacucauau

SEQ ID NO: 607182 - RNA, 19 nt, Homo sapiens
gaccuucuguaguaauaaa

SEQ ID NO: 607183 - RNA, 19 nt, Homo sapiens
ccaaaacaguuaacucuuu

SEQ ID NO: 607184 - RNA, 19 nt, Homo sapiens
ggagcaaagcuaaauauuc

SEQ ID NO: 607185 - RNA, 19 nt, Homo sapiens
caagaaagcaggagcaaag

SEQ ID NO: 607186 - RNA, 19 nt, Homo sapiens
caacauuccagcuuugaaa

SEQ ID NO: 607187 - RNA, 19 nt, Homo sapiens
gaacgauaaugacaaagac

SEQ ID NO: 607188 - RNA, 19 nt, Homo sapiens
gaaucuuacuucucuuugu

SEQ ID NO: 607189 - RNA, 19 nt, Homo sapiens
gagaaaagauccugucauc

SEQ ID NO: 607190 - RNA, 19 nt, Homo sapiens
gaagagcagaauuauguug

SEQ ID NO: 607191 - RNA, 19 nt, Homo sapiens
gaagacagaaagcaagaga

SEQ ID NO: 607192 - RNA, 19 nt, Homo sapiens
guaaccuguugucuuuaua

SEQ ID NO: 607193 - RNA, 19 nt, Homo sapiens
cacaacacauuagcacaua

SEQ ID NO: 607194 - RNA, 19 nt, Homo sapiens
gaagaaaugccaccuacag

SEQ ID NO: 607195 - RNA, 19 nt, Homo sapiens
gguuaaagaaguuguacua

SEQ ID NO: 607196 - RNA, 19 nt, Homo sapiens
gaaagcaagagaaguguca

SEQ ID NO: 607197 - RNA, 19 nt, Homo sapiens
ucagaaaugccaacaaaug

SEQ ID NO: 607198 - RNA, 19 nt, Homo sapiens
gcacagcccauccuaucaa

SEQ ID NO: 607199 - RNA, 19 nt, Homo sapiens
ugaacaggcugcuuugauc

SEQ ID NO: 607200 - RNA, 19 nt, Homo sapiens
uuagagaagucccugauuc

SEQ ID NO: 607201 - RNA, 19 nt, Homo sapiens
uuagagugcuugaagaaau

SEQ ID NO: 607202 - RNA, 19 nt, Homo sapiens
gcuaagguguauaauugga

SEQ ID NO: 607203 - RNA, 19 nt, Homo sapiens
ugagaggguuaaagaaguu

SEQ ID NO: 607204 - RNA, 19 nt, Homo sapiens
gaacagcaagaucgaaaca

SEQ ID NO: 607205 - RNA, 19 nt, Homo sapiens
gcaggagcaaagcuaaaua

SEQ ID NO: 607206 - RNA, 19 nt, Homo sapiens
uggaacaacuggacccaaa

SEQ ID NO: 607207 - RNA, 19 nt, Homo sapiens
gcuuugauccugaaucgua

SEQ ID NO: 607208 - RNA, 19 nt, Homo sapiens
gugaccuucuguaguaaua

SEQ ID NO: 607209 - RNA, 19 nt, Homo sapiens
cgacagcaguauauaccuu

SEQ ID NO: 607210 - RNA, 19 nt, Homo sapiens
gagcacagcccauccuauc

SEQ ID NO: 607211 - RNA, 19 nt, Homo sapiens
ugaaugugcuccggugaaa

SEQ ID NO: 607212 - RNA, 19 nt, Homo sapiens
uugaggagcuggccacuau

SEQ ID NO: 607213 - RNA, 19 nt, Homo sapiens
ugaagaacuuaucaugguu

SEQ ID NO: 607214 - RNA, 19 nt, Homo sapiens
ccaugggccuauucuugua

SEQ ID NO: 607215 - RNA, 19 nt, Homo sapiens
agaaguauagcuagaauga

SEQ ID NO: 607216 - RNA, 19 nt, Homo sapiens
ggagcuggcuaagguguau

SEQ ID NO: 607217 - RNA, 19 nt, Homo sapiens
ccacggcgaugcugagcuu

SEQ ID NO: 607218 - RNA, 19 nt, Homo sapiens
uaagccuucuguucucuaa

SEQ ID NO: 607219 - RNA, 19 nt, Homo sapiens
acagcaagaucgaaacaga

SEQ ID NO: 607220 - RNA, 19 nt, Homo sapiens
aaccuuagccucauuuauu

SEQ ID NO: 607221 - RNA, 19 nt, Homo sapiens
aagaauccaucccauccua

SEQ ID NO: 607222 - RNA, 19 nt, Homo sapiens
aagaauccaucccauccua

SEQ ID NO: 607223 - RNA, 19 nt, Homo sapiens
gcucacccuugcaguuaaa

SEQ ID NO: 607224 - RNA, 19 nt, Homo sapiens
ggacagcagccacagugaa

SEQ ID NO: 607225 - RNA, 19 nt, Homo sapiens
gaccaaaucaucauucaag

SEQ ID NO: 607226 - RNA, 19 nt, Homo sapiens
ggaagguuagugcacauuu

SEQ ID NO: 607227 - RNA, 19 nt, Homo sapiens
gaagaaugccgauauguuu

SEQ ID NO: 607228 - RNA, 19 nt, Homo sapiens
gaacacaacccaucuacaa

SEQ ID NO: 607229 - RNA, 19 nt, Homo sapiens
guacaucucugaccagguu

SEQ ID NO: 607230 - RNA, 19 nt, Homo sapiens
gaaagccaaugaagaguau

SEQ ID NO: 607231 - RNA, 19 nt, Homo sapiens
gagcagacgugcccuccua

SEQ ID NO: 607232 - RNA, 19 nt, Homo sapiens
gaaaguggacacacacaaa

SEQ ID NO: 607233 - RNA, 19 nt, Homo sapiens
gagaguacaucacguugga

SEQ ID NO: 607234 - RNA, 19 nt, Homo sapiens
gaaaaucuccuucaucauu

SEQ ID NO: 607235 - RNA, 19 nt, Homo sapiens
gcauggaggagaaaucuuu

SEQ ID NO: 607236 - RNA, 19 nt, Homo sapiens
gaauggauacgcggaauuu

SEQ ID NO: 607237 - RNA, 19 nt, Homo sapiens
cuucagcgaugccaaguuu

SEQ ID NO: 607238 - RNA, 19 nt, Homo sapiens
gcauccauauuucacugua

SEQ ID NO: 607239 - RNA, 19 nt, Homo sapiens
ccaacaaggugcugagagu

SEQ ID NO: 607240 - RNA, 19 nt, Homo sapiens
ggacaugagaccaacgaaa

SEQ ID NO: 607241 - RNA, 19 nt, Homo sapiens
ccagguugcauccauauuu

SEQ ID NO: 607242 - RNA, 19 nt, Homo sapiens
ugaccagguugcauccaua

SEQ ID NO: 607243 - RNA, 19 nt, Homo sapiens
gaggagauggagagcguua

SEQ ID NO: 607244 - RNA, 19 nt, Homo sapiens
gcaguggagcagauucuuu

SEQ ID NO: 607245 - RNA, 19 nt, Homo sapiens
ggaaaagccacgagaauga

SEQ ID NO: 607246 - RNA, 19 nt, Homo sapiens
ugaaagccaaugaagagua

SEQ ID NO: 607247 - RNA, 19 nt, Homo sapiens
aagaaugcauggaggagaa

SEQ ID NO: 607248 - RNA, 19 nt, Homo sapiens
ugaagaaugccgauauguu

SEQ ID NO: 607249 - RNA, 19 nt, Homo sapiens
ggugaaagccaaugaagag

SEQ ID NO: 607250 - RNA, 19 nt, Homo sapiens
ggacacacacaaagaacug

SEQ ID NO: 607251 - RNA, 19 nt, Homo sapiens
gcagggugcgcucguuuga

SEQ ID NO: 607252 - RNA, 19 nt, Homo sapiens
gcgggcagccuuucgacua

SEQ ID NO: 607253 - RNA, 19 nt, Homo sapiens
cagguugcauccauauuuc

SEQ ID NO: 607254 - RNA, 19 nt, Homo sapiens
cgaccagucuucgaaagug

SEQ ID NO: 607255 - RNA, 19 nt, Homo sapiens
caaccacccauacaccaaa

SEQ ID NO: 607256 - RNA, 19 nt, Homo sapiens
cauccauauuucacuguaa

SEQ ID NO: 607257 - RNA, 19 nt, Homo sapiens
ccaccucccugcagacaag

SEQ ID NO: 607258 - RNA, 19 nt, Homo sapiens
gaugaaaguccugcaguca

SEQ ID NO: 607259 - RNA, 19 nt, Homo sapiens
acacacaaagaacugauaa

SEQ ID NO: 607260 - RNA, 19 nt, Homo sapiens
gggugggcccuuugaauga

SEQ ID NO: 607261 - RNA, 19 nt, Homo sapiens
gcaggugaaagccaaugaa

SEQ ID NO: 607262 - RNA, 19 nt, Homo sapiens
gggcagccuuucgacuauu

SEQ ID NO: 607263 - RNA, 19 nt, Homo sapiens
aagccaaugaagaguauua

SEQ ID NO: 607264 - RNA, 19 nt, Homo sapiens
cacaacccaucuacaagug

SEQ ID NO: 607265 - RNA, 19 nt, Homo sapiens
ccagaguccagauaccuuu

SEQ ID NO: 607266 - RNA, 19 nt, Homo sapiens
ccagagcccagcaugaaug

SEQ ID NO: 607267 - RNA, 19 nt, Homo sapiens
ugugaagaaugccgauaug

SEQ ID NO: 607268 - RNA, 19 nt, Homo sapiens
guagcgaccagucuucgaa

SEQ ID NO: 607269 - RNA, 19 nt, Homo sapiens
gacaugagaccaacgaaaa

SEQ ID NO: 607270 - RNA, 19 nt, Homo sapiens
ccacccauacaccaaauug

SEQ ID NO: 607271 - RNA, 19 nt, Homo sapiens
ccuagaauuccuccugaaa

SEQ ID NO: 607272 - RNA, 19 nt, Homo sapiens
gagcccagcaugaauggau

SEQ ID NO: 607273 - RNA, 19 nt, Homo sapiens
cccauacaccaaauuguuu

SEQ ID NO: 607274 - RNA, 19 nt, Homo sapiens
ccaaugaagaguauuacca

SEQ ID NO: 607275 - RNA, 19 nt, Homo sapiens
cuucgaaaguggacacaca

SEQ ID NO: 607276 - RNA, 19 nt, Homo sapiens
gcaguagcgaccagucuuc

SEQ ID NO: 607277 - RNA, 19 nt, Homo sapiens
cagaguccagauaccuuua

SEQ ID NO: 607278 - RNA, 19 nt, Homo sapiens
cgggcagccuuucgacuau

SEQ ID NO: 607279 - RNA, 19 nt, Homo sapiens
ggcaaaaucugaacacaac

SEQ ID NO: 607280 - RNA, 19 nt, Homo sapiens
ggcagccuuucgacuauuc

SEQ ID NO: 607281 - RNA, 19 nt, Homo sapiens
agaaugaaauccgcuacca

SEQ ID NO: 607282 - RNA, 19 nt, Homo sapiens
gaaaagccacgagaaugaa

SEQ ID NO: 607283 - RNA, 19 nt, Homo sapiens
cugggaagauccuguacau

SEQ ID NO: 607284 - RNA, 19 nt, Homo sapiens
cgaaaguggacacacacaa

SEQ ID NO: 607285 - RNA, 19 nt, Homo sapiens
acacaacccaucuacaagu

SEQ ID NO: 607286 - RNA, 19 nt, Homo sapiens
aaaaucuccuucaucauug

SEQ ID NO: 607287 - RNA, 19 nt, Homo sapiens
uuucgacuauucucccauu

SEQ ID NO: 607288 - RNA, 19 nt, Homo sapiens
gagcagauucuuuuacuca

SEQ ID NO: 607289 - RNA, 19 nt, Homo sapiens
gaccagguugcauccauau

SEQ ID NO: 607290 - RNA, 19 nt, Homo sapiens
caugugcaguggagcagau

SEQ ID NO: 607291 - RNA, 19 nt, Homo sapiens
gagcgugaagcaggugaaa

SEQ ID NO: 607292 - RNA, 19 nt, Homo sapiens
caaggugcgggaccaacaa

SEQ ID NO: 607293 - RNA, 19 nt, Homo sapiens
ggaaggagcuggggaugcu

SEQ ID NO: 607294 - RNA, 19 nt, Homo sapiens
ccaguggacaugagaccaa

SEQ ID NO: 607295 - RNA, 19 nt, Homo sapiens
guacgcuggccaccuugaa

SEQ ID NO: 607296 - RNA, 19 nt, Homo sapiens
agugcacucugguuaugaa

SEQ ID NO: 607297 - RNA, 19 nt, Homo sapiens
aagaaugccgauauguuug

SEQ ID NO: 607298 - RNA, 19 nt, Homo sapiens
cguuaccucugagcacauu

SEQ ID NO: 607299 - RNA, 19 nt, Homo sapiens
gccaagggcaaggccagua

SEQ ID NO: 607300 - RNA, 19 nt, Homo sapiens
cacacacaaagaacugaua

SEQ ID NO: 607301 - RNA, 19 nt, Homo sapiens
ugaauggauacgcggaauu

SEQ ID NO: 607302 - RNA, 19 nt, Homo sapiens
gaagaacaguugacuuaaa

SEQ ID NO: 607303 - RNA, 19 nt, Homo sapiens
gaagaaugccgauauguuu

SEQ ID NO: 607304 - RNA, 19 nt, Homo sapiens
ccacugaaauggacacaua

SEQ ID NO: 607305 - RNA, 19 nt, Homo sapiens
gcgcuaagguccagugaua

SEQ ID NO: 607306 - RNA, 19 nt, Homo sapiens
ccaagcaguugacuuaaua

SEQ ID NO: 607307 - RNA, 19 nt, Homo sapiens
gaacacaacccaucuacaa

SEQ ID NO: 607308 - RNA, 19 nt, Homo sapiens
gaggugaaaucucuuugua

SEQ ID NO: 607309 - RNA, 19 nt, Homo sapiens
guacaucucugaccagguu

SEQ ID NO: 607310 - RNA, 19 nt, Homo sapiens
ggucaaaccucgagacuca

SEQ ID NO: 607311 - RNA, 19 nt, Homo sapiens
gaaagccaaugaagaguau

SEQ ID NO: 607312 - RNA, 19 nt, Homo sapiens
gagcagacgugcccuccua

SEQ ID NO: 607313 - RNA, 19 nt, Homo sapiens
ccgaagagauauguaaaua

SEQ ID NO: 607314 - RNA, 19 nt, Homo sapiens
ggugaaaucucuuuguaau

SEQ ID NO: 607315 - RNA, 19 nt, Homo sapiens
gcaguugacuuaauaggau

SEQ ID NO: 607316 - RNA, 19 nt, Homo sapiens
caucuaagguuacaguuau

SEQ ID NO: 607317 - RNA, 19 nt, Homo sapiens
gaaaguggacacacacaaa

SEQ ID NO: 607318 - RNA, 19 nt, Homo sapiens
cagaauguguuuacuguga

SEQ ID NO: 607319 - RNA, 19 nt, Homo sapiens
gaggagagccgaaauuugu

SEQ ID NO: 607320 - RNA, 19 nt, Homo sapiens
gcaaaccaaacuuucuuua

SEQ ID NO: 607321 - RNA, 19 nt, Homo sapiens
uaaagaagccuagugguuu

SEQ ID NO: 607322 - RNA, 19 nt, Homo sapiens
gcacagcccucauucuuuu

SEQ ID NO: 607323 - RNA, 19 nt, Homo sapiens
aagaaauacuuccggaaua

SEQ ID NO: 607324 - RNA, 19 nt, Homo sapiens
gcagaaguucaaagaaaua

SEQ ID NO: 607325 - RNA, 19 nt, Homo sapiens
gagaguacaucacguugga

SEQ ID NO: 607326 - RNA, 19 nt, Homo sapiens
aggaucaucuugugaauuu

SEQ ID NO: 607327 - RNA, 19 nt, Homo sapiens
gaaaaucuccuucaucauu

SEQ ID NO: 607328 - RNA, 19 nt, Homo sapiens
ccacugccauuacuacuug

SEQ ID NO: 607329 - RNA, 19 nt, Homo sapiens
gaauggauacgcggaauuu

SEQ ID NO: 607330 - RNA, 19 nt, Homo sapiens
gaacacugguauggaagaa

SEQ ID NO: 607331 - RNA, 19 nt, Homo sapiens
gcauggaggagaaaucuuu

SEQ ID NO: 607332 - RNA, 19 nt, Homo sapiens
gugccaagcaguugacuua

SEQ ID NO: 607333 - RNA, 19 nt, Homo sapiens
cugaagaacaguugacuua

SEQ ID NO: 607334 - RNA, 19 nt, Homo sapiens
ugucaucagucaucucuuu

SEQ ID NO: 607335 - RNA, 19 nt, Homo sapiens
gaauguguuuacugugaaa

SEQ ID NO: 607336 - RNA, 19 nt, Homo sapiens
ggaaagaacagaaaauuga

SEQ ID NO: 607337 - RNA, 19 nt, Homo sapiens
cugcagaaguucaaagaaa

SEQ ID NO: 607338 - RNA, 19 nt, Homo sapiens
ucaugaaucuggagaacaa

SEQ ID NO: 607339 - RNA, 19 nt, Homo sapiens
acaaacuccuugccucuaa

SEQ ID NO: 607340 - RNA, 19 nt, Homo sapiens
cuucagcgaugccaaguuu

SEQ ID NO: 607341 - RNA, 19 nt, Homo sapiens
ugguggaaauucaaaguua

SEQ ID NO: 607342 - RNA, 19 nt, Homo sapiens
gaguuucugugaugauuug

SEQ ID NO: 607343 - RNA, 19 nt, Homo sapiens
uuuaauaugugcucacuga

SEQ ID NO: 607344 - RNA, 19 nt, Homo sapiens
ucaaaguuaucacugaaga

SEQ ID NO: 607345 - RNA, 19 nt, Homo sapiens
aaagaagccuagugguuug

SEQ ID NO: 607346 - RNA, 19 nt, Homo sapiens
aauaugugcucacugauug

SEQ ID NO: 607347 - RNA, 19 nt, Homo sapiens
ucuuaugccugacuauuaa

SEQ ID NO: 607348 - RNA, 19 nt, Homo sapiens
ggacagcagcgucaugaug

SEQ ID NO: 607349 - RNA, 19 nt, Homo sapiens
ggaccaggguuuucuguuu

SEQ ID NO: 607350 - RNA, 19 nt, Homo sapiens
cauguugcauuguauauuc

SEQ ID NO: 607351 - RNA, 19 nt, Homo sapiens
ggcagaauguguuuacugu

SEQ ID NO: 607352 - RNA, 19 nt, Homo sapiens
uaaaccuccugcugaauga

SEQ ID NO: 607353 - RNA, 19 nt, Homo sapiens
gcauccauauuucacugua

SEQ ID NO: 607354 - RNA, 19 nt, Homo sapiens
gcaauagauuuguuugacu

SEQ ID NO: 607355 - RNA, 19 nt, Homo sapiens
ccaagacuaugaggcuuaa

SEQ ID NO: 607356 - RNA, 19 nt, Homo sapiens
ggacaugagaccaacgaaa

SEQ ID NO: 607357 - RNA, 19 nt, Homo sapiens
caagucauaccagcaaaua

SEQ ID NO: 607358 - RNA, 19 nt, Homo sapiens
ccaacaaggugcugagagu

SEQ ID NO: 607359 - RNA, 19 nt, Homo sapiens
gccauuagauguuacaaac

SEQ ID NO: 607360 - RNA, 19 nt, Homo sapiens
gguggaaauucaaaguuau

SEQ ID NO: 607361 - RNA, 19 nt, Homo sapiens
gcauuauucuugucuccuu

SEQ ID NO: 607362 - RNA, 19 nt, Homo sapiens
ugacauagguuuuguuugu

SEQ ID NO: 607363 - RNA, 19 nt, Homo sapiens
aaugaacacugguauggaa

SEQ ID NO: 607364 - RNA, 19 nt, Homo sapiens
gaagaggaaaugcgaguuc

SEQ ID NO: 607365 - RNA, 19 nt, Homo sapiens
agggauagguguucaucua

SEQ ID NO: 607366 - RNA, 19 nt, Homo sapiens
uggccaauauggagauuaa

SEQ ID NO: 607367 - RNA, 19 nt, Homo sapiens
ggagagccgaaauuuguaa

SEQ ID NO: 607368 - RNA, 19 nt, Homo sapiens
ccagguugcauccauauuu

SEQ ID NO: 607369 - RNA, 19 nt, Homo sapiens
ugaccagguugcauccaua

SEQ ID NO: 607370 - RNA, 19 nt, Homo sapiens
uuaauaggaucaucuugug

SEQ ID NO: 607371 - RNA, 19 nt, Homo sapiens
gccaagcaguugacuuaau

SEQ ID NO: 607372 - RNA, 19 nt, Homo sapiens
ccaaagugcugggauuaca

SEQ ID NO: 607373 - RNA, 19 nt, Homo sapiens
gguacucgcugcacacaca

SEQ ID NO: 607374 - RNA, 19 nt, Homo sapiens
gcaaacgucccagcgcuaa

SEQ ID NO: 607375 - RNA, 19 nt, Homo sapiens
gaggagauggagagcguua

SEQ ID NO: 607376 - RNA, 19 nt, Homo sapiens
caaacuccuugccucuaaa

SEQ ID NO: 607377 - RNA, 19 nt, Homo sapiens
agacaggguuucaccaugu

SEQ ID NO: 607378 - RNA, 19 nt, Homo sapiens
acacaaaacugccaaaauc

SEQ ID NO: 607379 - RNA, 19 nt, Homo sapiens
ggauagguguucaucuaag

SEQ ID NO: 607380 - RNA, 19 nt, Homo sapiens
caucagucaucucuuuaug

SEQ ID NO: 607381 - RNA, 19 nt, Homo sapiens
cuaaagaagccuagugguu

SEQ ID NO: 607382 - RNA, 19 nt, Homo sapiens
gaucgaagagcagacguaa

SEQ ID NO: 607383 - RNA, 19 nt, Homo sapiens
aaacaggaaagaacagaaa

SEQ ID NO: 607384 - RNA, 19 nt, Homo sapiens
agaaauacuuccggaauag

SEQ ID NO: 607385 - RNA, 19 nt, Homo sapiens
uaagaaauacuuccggaau

SEQ ID NO: 607386 - RNA, 19 nt, Homo sapiens
ggaggagagccgaaauuug

SEQ ID NO: 607387 - RNA, 19 nt, Homo sapiens
gcaguggagcagauucuuu

SEQ ID NO: 607388 - RNA, 19 nt, Homo sapiens
ugaauuuguuuacgugaug

SEQ ID NO: 607389 - RNA, 19 nt, Homo sapiens
gggaagagauuuuaguugu

SEQ ID NO: 607390 - RNA, 19 nt, Homo sapiens
cagcugccuucccgaaauu

SEQ ID NO: 607391 - RNA, 19 nt, Homo sapiens
gaacagccgcacgggagua

SEQ ID NO: 607392 - RNA, 19 nt, Homo sapiens
ggaaaagccacgagaauga

SEQ ID NO: 607393 - RNA, 19 nt, Homo sapiens
ugaaagccaaugaagagua

SEQ ID NO: 607394 - RNA, 19 nt, Homo sapiens
caccacacccagcuaauuu

SEQ ID NO: 607395 - RNA, 19 nt, Homo sapiens
aagaaugcauggaggagaa

SEQ ID NO: 607396 - RNA, 19 nt, Homo sapiens
ugaagaaugccgauauguu

SEQ ID NO: 607397 - RNA, 19 nt, Homo sapiens
gcucacugauuguuaacug

SEQ ID NO: 607398 - RNA, 19 nt, Homo sapiens
caaaacugccaaaaucuua

SEQ ID NO: 607399 - RNA, 19 nt, Homo sapiens
ugaaaucucuuuguaaucc

SEQ ID NO: 607400 - RNA, 19 nt, Homo sapiens
uuccaaagaugguucagaa

SEQ ID NO: 607401 - RNA, 19 nt, Homo sapiens
gagaauaaucacaaagcaa

SEQ ID NO: 607402 - RNA, 19 nt, Homo sapiens
gaaauacucugaauaguga

SEQ ID NO: 607403 - RNA, 19 nt, Homo sapiens
gcacagaguucuccuauug

SEQ ID NO: 607404 - RNA, 19 nt, Homo sapiens
ggacaaauccuuucaguga

SEQ ID NO: 607405 - RNA, 19 nt, Homo sapiens
gaacuuauaugguagacaa

SEQ ID NO: 607406 - RNA, 19 nt, Homo sapiens
gaagaucugucauuuaauc

SEQ ID NO: 607407 - RNA, 19 nt, Homo sapiens
gaacagacaacugauaaua

SEQ ID NO: 607408 - RNA, 19 nt, Homo sapiens
gagaucaacuuaucaauca

SEQ ID NO: 607409 - RNA, 19 nt, Homo sapiens
guacuuagaugacucaguu

SEQ ID NO: 607410 - RNA, 19 nt, Homo sapiens
guuggaagcucuugguuua

SEQ ID NO: 607411 - RNA, 19 nt, Homo sapiens
ggaagaaugucucauguuc

SEQ ID NO: 607412 - RNA, 19 nt, Homo sapiens
gaacaacaaggaaagauaa

SEQ ID NO: 607413 - RNA, 19 nt, Homo sapiens
gaacauaugcuaaguaaag

SEQ ID NO: 607414 - RNA, 19 nt, Homo sapiens
gaauugugaugacugguua

SEQ ID NO: 607415 - RNA, 19 nt, Homo sapiens
gaaguaagccaacugauau

SEQ ID NO: 607416 - RNA, 19 nt, Homo sapiens
ugacaaagcucgagcacuu

SEQ ID NO: 607417 - RNA, 19 nt, Homo sapiens
ggaugcauauggacucuua

SEQ ID NO: 607418 - RNA, 19 nt, Homo sapiens
uuaaagagcucauaagaca

SEQ ID NO: 607419 - RNA, 19 nt, Homo sapiens
ccaaaguacuggaugcaua

SEQ ID NO: 607420 - RNA, 19 nt, Homo sapiens
ccaaagagguugauucagu

SEQ ID NO: 607421 - RNA, 19 nt, Homo sapiens
gaagcaauuucgcagcaua

SEQ ID NO: 607422 - RNA, 19 nt, Homo sapiens
gaugaugccuugauugaug

SEQ ID NO: 607423 - RNA, 19 nt, Homo sapiens
cgaagcaggucaucccaua

SEQ ID NO: 607424 - RNA, 19 nt, Homo sapiens
gcacuuugcugcacuaugg

SEQ ID NO: 607425 - RNA, 19 nt, Homo sapiens
gaugcuagcuaaacaguug

SEQ ID NO: 607426 - RNA, 19 nt, Homo sapiens
gugaacauaugcuaaguaa

SEQ ID NO: 607427 - RNA, 19 nt, Homo sapiens
uaaggaaggugaacauaug

SEQ ID NO: 607428 - RNA, 19 nt, Homo sapiens
gcaggcauuucuuggcuua

SEQ ID NO: 607429 - RNA, 19 nt, Homo sapiens
gaagaaaugaguuuagaga

SEQ ID NO: 607430 - RNA, 19 nt, Homo sapiens
gaacaaacugcuuggauug

SEQ ID NO: 607431 - RNA, 19 nt, Homo sapiens
ggaaucagucuuugcauuu

SEQ ID NO: 607432 - RNA, 19 nt, Homo sapiens
caaagagguugauucaguu

SEQ ID NO: 607433 - RNA, 19 nt, Homo sapiens
cgaaugcucuuccauacaa

SEQ ID NO: 607434 - RNA, 19 nt, Homo sapiens
cgaacaaacugcuuggauu

SEQ ID NO: 607435 - RNA, 19 nt, Homo sapiens
gaaaggaauuuggagguau

SEQ ID NO: 607436 - RNA, 19 nt, Homo sapiens
gcucugggcuguagaacuu

SEQ ID NO: 607437 - RNA, 19 nt, Homo sapiens
gaagagcccguuacuauca

SEQ ID NO: 607438 - RNA, 19 nt, Homo sapiens
acacuggacuuuacagaaa

SEQ ID NO: 607439 - RNA, 19 nt, Homo sapiens
guucugagccuaaauggua

SEQ ID NO: 607440 - RNA, 19 nt, Homo sapiens
gaaguuaaagagcucauaa

SEQ ID NO: 607441 - RNA, 19 nt, Homo sapiens
ggaaauacucugaauagug

SEQ ID NO: 607442 - RNA, 19 nt, Homo sapiens
caaauagugugcaggcauu

SEQ ID NO: 607443 - RNA, 19 nt, Homo sapiens
caaaagagaaucaccauua

SEQ ID NO: 607444 - RNA, 19 nt, Homo sapiens
ggaacaacaaggaaagaua

SEQ ID NO: 607445 - RNA, 19 nt, Homo sapiens
ccuaaaugguaaagaguua

SEQ ID NO: 607446 - RNA, 19 nt, Homo sapiens
gaaauggccuuuugauaga

SEQ ID NO: 607447 - RNA, 19 nt, Homo sapiens
gaaucgaucucccuaacga

SEQ ID NO: 607448 - RNA, 19 nt, Homo sapiens
gucagcaucuucuaaagua

SEQ ID NO: 607449 - RNA, 19 nt, Homo sapiens
gagaauggcguucaguaaa

SEQ ID NO: 607450 - RNA, 19 nt, Homo sapiens
guaaagaguuauugaaucg

SEQ ID NO: 607451 - RNA, 19 nt, Homo sapiens
gggaagcucugccuugaau

SEQ ID NO: 607452 - RNA, 19 nt, Homo sapiens
cagaacagguuguguacuu

SEQ ID NO: 607453 - RNA, 19 nt, Homo sapiens
gcuccaaccugacauugaa

SEQ ID NO: 607454 - RNA, 19 nt, Homo sapiens
cauuaaagauugacccauu

SEQ ID NO: 607455 - RNA, 19 nt, Homo sapiens
ggaagaagaaaugaguuua

SEQ ID NO: 607456 - RNA, 19 nt, Homo sapiens
gagggaagcucugccuuga

SEQ ID NO: 607457 - RNA, 19 nt, Homo sapiens
gaagaaaugguagaauuga

SEQ ID NO: 607458 - RNA, 19 nt, Homo sapiens
gaagggaaagcgaaguuaa

SEQ ID NO: 607459 - RNA, 19 nt, Homo sapiens
gcaacgcaaaguaauguua

SEQ ID NO: 607460 - RNA, 19 nt, Homo sapiens
gguaaagaguuauugaauc

SEQ ID NO: 607461 - RNA, 19 nt, Homo sapiens
ggagaauggcguucaguaa

SEQ ID NO: 607462 - RNA, 19 nt, Homo sapiens
gaaguuugcguguuucuga

SEQ ID NO: 607463 - RNA, 19 nt, Homo sapiens
gaggaucuguuccauuguu

SEQ ID NO: 607464 - RNA, 19 nt, Homo sapiens
ccgaggaucuguuccauug

SEQ ID NO: 607465 - RNA, 19 nt, Homo sapiens
acagacaacugauaauaga

SEQ ID NO: 607466 - RNA, 19 nt, Homo sapiens
ucuccaaacccauuuauua

SEQ ID NO: 607467 - RNA, 19 nt, Homo sapiens
ucagaaacgucgaaagguu

SEQ ID NO: 607468 - RNA, 19 nt, Homo sapiens
aaacagaacagguugugua

SEQ ID NO: 607469 - RNA, 19 nt, Homo sapiens
gcaagaggccauugauguu

SEQ ID NO: 607470 - RNA, 19 nt, Homo sapiens
guaaagcuuuccagaguca

SEQ ID NO: 607471 - RNA, 19 nt, Homo sapiens
guucugcgguuaaaucuug

SEQ ID NO: 607472 - RNA, 19 nt, Homo sapiens
guucaaacgucaccuguuc

SEQ ID NO: 607473 - RNA, 19 nt, Homo sapiens
gaaucggacuauaacuauu

SEQ ID NO: 607474 - RNA, 19 nt, Homo sapiens
gaaucagucuuugcauuug

SEQ ID NO: 607475 - RNA, 19 nt, Homo sapiens
uaucagggauguugcaguu

SEQ ID NO: 607476 - RNA, 19 nt, Homo sapiens
cagcauagcuuuuaagaau

SEQ ID NO: 607477 - RNA, 19 nt, Homo sapiens
cuaaagagcaugugugaga

SEQ ID NO: 607478 - RNA, 19 nt, Homo sapiens
caagaacagacaacugaua

SEQ ID NO: 607479 - RNA, 19 nt, Homo sapiens
aagaagagcccguuacuau

SEQ ID NO: 607480 - RNA, 19 nt, Homo sapiens
gaagauaaaauguggguua

SEQ ID NO: 607481 - RNA, 19 nt, Homo sapiens
gaagagaggcaaaacauuu

SEQ ID NO: 607482 - RNA, 19 nt, Homo sapiens
guuauuacgucuuaugugu

SEQ ID NO: 607483 - RNA, 19 nt, Homo sapiens
gcucagcuaucuguucaaa

SEQ ID NO: 607484 - RNA, 19 nt, Homo sapiens
ccagucaccuacaauauca

SEQ ID NO: 607485 - RNA, 19 nt, Homo sapiens
agaaguaagccaacugaua

SEQ ID NO: 607486 - RNA, 19 nt, Homo sapiens
gagcaugugugagaauuuc

SEQ ID NO: 607487 - RNA, 19 nt, Homo sapiens
uaagauauaugcaggaacu

SEQ ID NO: 607488 - RNA, 19 nt, Homo sapiens
gaaguucuccaaacccauu

SEQ ID NO: 607489 - RNA, 19 nt, Homo sapiens
gagaaucaccauuaaagau

SEQ ID NO: 607490 - RNA, 19 nt, Homo sapiens
gcauugccaucaucaacaa

SEQ ID NO: 607491 - RNA, 19 nt, Homo sapiens
gaagaagaaaugaguuuag

SEQ ID NO: 607492 - RNA, 19 nt, Homo sapiens
ggacuauaacuauugcuuu

SEQ ID NO: 607493 - RNA, 19 nt, Homo sapiens
gcagggcagucacaaguca

SEQ ID NO: 607494 - RNA, 19 nt, Homo sapiens
gaaggugaacauaugcuaa

SEQ ID NO: 607495 - RNA, 19 nt, Homo sapiens
ggaaauaagggagcaguug

SEQ ID NO: 607496 - RNA, 19 nt, Homo sapiens
gaccacagcaugcuccuuu

SEQ ID NO: 607497 - RNA, 19 nt, Homo sapiens
gaaagggaagucaaaguca

SEQ ID NO: 607498 - RNA, 19 nt, Homo sapiens
uggaaucucugauggcaaa

SEQ ID NO: 607499 - RNA, 19 nt, Homo sapiens
agaaaggaauuuggaggua

SEQ ID NO: 607500 - RNA, 19 nt, Homo sapiens
gagccuaaaugguaaagag

SEQ ID NO: 607501 - RNA, 19 nt, Homo sapiens
caaagaugccagaguggua

SEQ ID NO: 607502 - RNA, 19 nt, Homo sapiens
ugucugaccuugaauauua

SEQ ID NO: 607503 - RNA, 19 nt, Homo sapiens
gaauacagguaacuaauug

SEQ ID NO: 607504 - RNA, 19 nt, Homo sapiens
gggaaacacugaaaugaaa

SEQ ID NO: 607505 - RNA, 19 nt, Homo sapiens
aaagagagcucagaaauau

SEQ ID NO: 607506 - RNA, 19 nt, Homo sapiens
gaaaccaaguuccucuuaa

SEQ ID NO: 607507 - RNA, 19 nt, Homo sapiens
ccaguucgauguugugaua

SEQ ID NO: 607508 - RNA, 19 nt, Homo sapiens
caauggcgcuguuauuuga

SEQ ID NO: 607509 - RNA, 19 nt, Homo sapiens
ggaaagacuucucaaagag

SEQ ID NO: 607510 - RNA, 19 nt, Homo sapiens
ggaaugucgucccaaguuu

SEQ ID NO: 607511 - RNA, 19 nt, Homo sapiens
gagaaggcccagcuuguua

SEQ ID NO: 607512 - RNA, 19 nt, Homo sapiens
gaacaccuuugcacuacuu

SEQ ID NO: 607513 - RNA, 19 nt, Homo sapiens
uaaagagagcucagaaaua

SEQ ID NO: 607514 - RNA, 19 nt, Homo sapiens
cagaacauguuggaaauaa

SEQ ID NO: 607515 - RNA, 19 nt, Homo sapiens
guacauugcuuguguuugg

SEQ ID NO: 607516 - RNA, 19 nt, Homo sapiens
ugaaaucuucccaguauua

SEQ ID NO: 607517 - RNA, 19 nt, Homo sapiens
gaguguggauccuuuauau

SEQ ID NO: 607518 - RNA, 19 nt, Homo sapiens
aaugaaaucuucccaguau

SEQ ID NO: 607519 - RNA, 19 nt, Homo sapiens
aaaccaaguuccucuuaaa

SEQ ID NO: 607520 - RNA, 19 nt, Homo sapiens
uggaaagacuucucaaaga

SEQ ID NO: 607521 - RNA, 19 nt, Homo sapiens
acacugaaaugaaaucuuc

SEQ ID NO: 607522 - RNA, 19 nt, Homo sapiens
gcacauugaauacagguaa

SEQ ID NO: 607523 - RNA, 19 nt, Homo sapiens
guaaagagagcucagaaau

SEQ ID NO: 607524 - RNA, 19 nt, Homo sapiens
ggaauaauguuuugggaaa

SEQ ID NO: 607525 - RNA, 19 nt, Homo sapiens
ugacagccuucuugaugua

SEQ ID NO: 607526 - RNA, 19 nt, Homo sapiens
gaggaauacugcacggauu

SEQ ID NO: 607527 - RNA, 19 nt, Homo sapiens
uaaaagacauccucaaaug

SEQ ID NO: 607528 - RNA, 19 nt, Homo sapiens
ggccuucccugcaauggua

SEQ ID NO: 607529 - RNA, 19 nt, Homo sapiens
uagaaucugugaccucuga

SEQ ID NO: 607530 - RNA, 19 nt, Homo sapiens
guaacgauguuguauugau

SEQ ID NO: 607531 - RNA, 19 nt, Homo sapiens
cgaccucccugaacacuug

SEQ ID NO: 607532 - RNA, 19 nt, Homo sapiens
gaauccaguuaucaucaaa

SEQ ID NO: 607533 - RNA, 19 nt, Homo sapiens
uccaaugacuuauuuguug

SEQ ID NO: 607534 - RNA, 19 nt, Homo sapiens
aggcauugaucgugaauuu

SEQ ID NO: 607535 - RNA, 19 nt, Homo sapiens
ugucauugccguugucuua

SEQ ID NO: 607536 - RNA, 19 nt, Homo sapiens
ggaagcagguggcagaaaa

SEQ ID NO: 607537 - RNA, 19 nt, Homo sapiens
guuaaacagugcaccaguu

SEQ ID NO: 607538 - RNA, 19 nt, Homo sapiens
ccagaacaccuuugcacua

SEQ ID NO: 607539 - RNA, 19 nt, Homo sapiens
ugacuuauuuguugcuguu

SEQ ID NO: 607540 - RNA, 19 nt, Homo sapiens
ggaguguggauccuuuaua

SEQ ID NO: 607541 - RNA, 19 nt, Homo sapiens
aggcccagcuuguuauuaa

SEQ ID NO: 607542 - RNA, 19 nt, Homo sapiens
ugucggcgcugugugguua

SEQ ID NO: 607543 - RNA, 19 nt, Homo sapiens
gaaguucuccaguaaaguc

SEQ ID NO: 607544 - RNA, 19 nt, Homo sapiens
ccaguuaucaucaaagaga

SEQ ID NO: 607545 - RNA, 19 nt, Homo sapiens
gugcaccaguugagggaua

SEQ ID NO: 607546 - RNA, 19 nt, Homo sapiens
ggucacaacccuucucugu

SEQ ID NO: 607547 - RNA, 19 nt, Homo sapiens
ccaaaacauuucaggauuu

SEQ ID NO: 607548 - RNA, 19 nt, Homo sapiens
gauuucaacuggcuucaag

SEQ ID NO: 607549 - RNA, 19 nt, Homo sapiens
gaaaucuucccaguauuau

SEQ ID NO: 607550 - RNA, 19 nt, Homo sapiens
ugaguacaccuaugugaaa

SEQ ID NO: 607551 - RNA, 19 nt, Homo sapiens
ugagggauauucagaacau

SEQ ID NO: 607552 - RNA, 19 nt, Homo sapiens
ggagagggacauagaaucu

SEQ ID NO: 607553 - RNA, 19 nt, Homo sapiens
gaggggaggucacucuuuu

SEQ ID NO: 607554 - RNA, 19 nt, Homo sapiens
gagcaaugccaagugagua

SEQ ID NO: 607555 - RNA, 19 nt, Homo sapiens
ccaaguacgauccuccuuu

SEQ ID NO: 607556 - RNA, 19 nt, Homo sapiens
gccgagcaaugccaaguga

SEQ ID NO: 607557 - RNA, 19 nt, Homo sapiens
ggaggucacucuuuugaug

SEQ ID NO: 607558 - RNA, 19 nt, Homo sapiens
cagaaaaccucaguugaaa

SEQ ID NO: 607559 - RNA, 19 nt, Homo sapiens
gaccaugcauaaugugaca

SEQ ID NO: 607560 - RNA, 19 nt, Homo sapiens
ccuuugacauccuucagua

SEQ ID NO: 607561 - RNA, 19 nt, Homo sapiens
caagugaguacaccuaugu

SEQ ID NO: 607562 - RNA, 19 nt, Homo sapiens
caaguacgauccuccuuuu

SEQ ID NO: 607563 - RNA, 19 nt, Homo sapiens
agacaucaauggcgcuguu

SEQ ID NO: 607564 - RNA, 19 nt, Homo sapiens
uuacacugcacauugaaua

SEQ ID NO: 607565 - RNA, 19 nt, Homo sapiens
gaaugucgucccaaguuug

SEQ ID NO: 607566 - RNA, 19 nt, Homo sapiens
cguuuacacugcacauuga

SEQ ID NO: 607567 - RNA, 19 nt, Homo sapiens
gaaaaccucaguugaaaau

SEQ ID NO: 607568 - RNA, 19 nt, Homo sapiens
cagaacaccuuugcacuac

SEQ ID NO: 607569 - RNA, 19 nt, Homo sapiens
ugaauccaguuaucaucaa

SEQ ID NO: 607570 - RNA, 19 nt, Homo sapiens
gauguugugauaagguuaa

SEQ ID NO: 607571 - RNA, 19 nt, Homo sapiens
cggaaguucuccaguaaag

SEQ ID NO: 607572 - RNA, 19 nt, Homo sapiens
guacaccuaugugaaacug

SEQ ID NO: 607573 - RNA, 19 nt, Homo sapiens
cagccuucuugauguauuu

SEQ ID NO: 607574 - RNA, 19 nt, Homo sapiens
aagagggaguggugaaaga

SEQ ID NO: 607575 - RNA, 19 nt, Homo sapiens
caucaauggcgcuguuauu

SEQ ID NO: 607576 - RNA, 19 nt, Homo sapiens
gaaacacugaaaugaaauc

SEQ ID NO: 607577 - RNA, 19 nt, Homo sapiens
ugucugaggugacuuaaaa

SEQ ID NO: 607578 - RNA, 19 nt, Homo sapiens
ggucggagagggacauaga

SEQ ID NO: 607579 - RNA, 19 nt, Homo sapiens
gaaggcccagcuuguuauu

SEQ ID NO: 607580 - RNA, 19 nt, Homo sapiens
ccaaguuccucuuaaagcu

SEQ ID NO: 607581 - RNA, 19 nt, Homo sapiens
ggauaugaccucaaucaac

SEQ ID NO: 607582 - RNA, 19 nt, Homo sapiens
gugaagcugaguccaagua

SEQ ID NO: 607583 - RNA, 19 nt, Homo sapiens
ucaauggcgcuguuauuug

SEQ ID NO: 607584 - RNA, 19 nt, Homo sapiens
ccaagugaguacaccuaug

SEQ ID NO: 607585 - RNA, 19 nt, Homo sapiens
ggaaacacugaaaugaaau

SEQ ID NO: 607586 - RNA, 19 nt, Homo sapiens
ccagagucaugggagagua

SEQ ID NO: 607587 - RNA, 19 nt, Homo sapiens
gaauuggaaagacuucuca

SEQ ID NO: 607588 - RNA, 19 nt, Homo sapiens
ugaagugcagcucauguuu

SEQ ID NO: 607589 - RNA, 19 nt, Homo sapiens
caaagagggaguggugaaa

SEQ ID NO: 607590 - RNA, 19 nt, Homo sapiens
guacucagagccucaguca

SEQ ID NO: 607591 - RNA, 19 nt, Homo sapiens
guacgacucuucuuuugga

SEQ ID NO: 607592 - RNA, 19 nt, Homo sapiens
gccacacccugaaccaguu

SEQ ID NO: 607593 - RNA, 19 nt, Homo sapiens
ugacaacggaaaccaaguu

SEQ ID NO: 607594 - RNA, 19 nt, Homo sapiens
gucaaugcauggcugcuau

SEQ ID NO: 607595 - RNA, 19 nt, Homo sapiens
gccaaaacauuucaggauu

SEQ ID NO: 607596 - RNA, 19 nt, Homo sapiens
uccggaaguucuccaguaa

SEQ ID NO: 607597 - RNA, 19 nt, Homo sapiens
ugacauccuucaguacuca

SEQ ID NO: 607598 - RNA, 19 nt, Homo sapiens
aaaugaaaucuucccagua

SEQ ID NO: 607599 - RNA, 19 nt, Homo sapiens
agagggacauagaaucugu

SEQ ID NO: 607600 - RNA, 19 nt, Homo sapiens
auguaacgauguuguauug

SEQ ID NO: 607601 - RNA, 19 nt, Homo sapiens
ucccagcaauuauuacaau

SEQ ID NO: 607602 - RNA, 19 nt, Homo sapiens
gagcgucguuaauuuauuu

SEQ ID NO: 607603 - RNA, 19 nt, Homo sapiens
ggagagcgucguuaauuua

SEQ ID NO: 607604 - RNA, 19 nt, Homo sapiens
caaaguaggagaagaaaug

SEQ ID NO: 607605 - RNA, 19 nt, Homo sapiens
ggaaggagagcgucguuaa

SEQ ID NO: 607606 - RNA, 19 nt, Homo sapiens
gguggugggucguaaguuu

SEQ ID NO: 607607 - RNA, 19 nt, Homo sapiens
ggagauguguacguaauau

SEQ ID NO: 607608 - RNA, 19 nt, Homo sapiens
gcacuuuccuccagcaaca

SEQ ID NO: 607609 - RNA, 19 nt, Homo sapiens
gaacugcggcaaaguagga

SEQ ID NO: 607610 - RNA, 19 nt, Homo sapiens
agacuucggcggaccauua

SEQ ID NO: 607611 - RNA, 19 nt, Homo sapiens
gcaagggugugagauguuc

SEQ ID NO: 607612 - RNA, 19 nt, Homo sapiens
ugauggagauguguacgua

SEQ ID NO: 607613 - RNA, 19 nt, Homo sapiens
aggagagcgucguuaauuu

SEQ ID NO: 607614 - RNA, 19 nt, Homo sapiens
gaaggagagcgucguuaau

SEQ ID NO: 607615 - RNA, 19 nt, Homo sapiens
gaggcaacuugaacucaga

SEQ ID NO: 607616 - RNA, 19 nt, Homo sapiens
ggacuuccgaggcaacuug

SEQ ID NO: 607617 - RNA, 19 nt, Homo sapiens
guccugagaucuucaccuu

SEQ ID NO: 607618 - RNA, 19 nt, Homo sapiens
gagagcgucguuaauuuau

SEQ ID NO: 607619 - RNA, 19 nt, Homo sapiens
aaggagagcgucguuaauu

SEQ ID NO: 607620 - RNA, 19 nt, Homo sapiens
cgccuaguauguucuguga

SEQ ID NO: 607621 - RNA, 19 nt, Homo sapiens
cucgagcccuuuaaucuga

SEQ ID NO: 607622 - RNA, 19 nt, Homo sapiens
cggcaaaguaggagaagaa

SEQ ID NO: 607623 - RNA, 19 nt, Homo sapiens
gagauguguacguaauauu

SEQ ID NO: 607624 - RNA, 19 nt, Homo sapiens
cuucggagcccucggacua

SEQ ID NO: 607625 - RNA, 19 nt, Homo sapiens
guggugggucguaaguuua

SEQ ID NO: 607626 - RNA, 19 nt, Homo sapiens
gcaaaguaggagaagaaau

SEQ ID NO: 607627 - RNA, 19 nt, Homo sapiens
gcucuggaccucagcacuu

SEQ ID NO: 607628 - RNA, 19 nt, Homo sapiens
gaaccgaacccagccaaaa

SEQ ID NO: 607629 - RNA, 19 nt, Homo sapiens
gggaaggagagcgucguua

SEQ ID NO: 607630 - RNA, 19 nt, Homo sapiens
ucucaacuccgucugucua

SEQ ID NO: 607631 - RNA, 19 nt, Homo sapiens
gauggagauguguacguaa

SEQ ID NO: 607632 - RNA, 19 nt, Homo sapiens
agaccgaggcgcauagaga

SEQ ID NO: 607633 - RNA, 19 nt, Homo sapiens
agagcgucguuaauuuauu

SEQ ID NO: 607634 - RNA, 19 nt, Homo sapiens
ggaaccgaacccagccaaa

SEQ ID NO: 607635 - RNA, 19 nt, Homo sapiens
gauccuuccaucuucuuga

SEQ ID NO: 607636 - RNA, 19 nt, Homo sapiens
caacuccgucugucuacug

SEQ ID NO: 607637 - RNA, 19 nt, Homo sapiens
ccuaggugauggagaugug

SEQ ID NO: 607638 - RNA, 19 nt, Homo sapiens
gcaacuugaacucagaaca

SEQ ID NO: 607639 - RNA, 19 nt, Homo sapiens
caacuugaacucagaacac

SEQ ID NO: 607640 - RNA, 19 nt, Homo sapiens
gguauuuauugagcuuugu

SEQ ID NO: 607641 - RNA, 19 nt, Homo sapiens
cuggaacugcggcaaagua

SEQ ID NO: 607642 - RNA, 19 nt, Homo sapiens
uggagauguguacguaaua

SEQ ID NO: 607643 - RNA, 19 nt, Homo sapiens
gcuccgguccugagaucuu

SEQ ID NO: 607644 - RNA, 19 nt, Homo sapiens
ggcaaaguaggagaagaaa

SEQ ID NO: 607645 - RNA, 19 nt, Homo sapiens
gagcgucguuaauuuauuu

SEQ ID NO: 607646 - RNA, 19 nt, Homo sapiens
ggagagcgucguuaauuua

SEQ ID NO: 607647 - RNA, 19 nt, Homo sapiens
caaaguaggagaagaaaug

SEQ ID NO: 607648 - RNA, 19 nt, Homo sapiens
ggaaggagagcgucguuaa

SEQ ID NO: 607649 - RNA, 19 nt, Homo sapiens
gguggugggucguaaguuu

SEQ ID NO: 607650 - RNA, 19 nt, Homo sapiens
gauguucccucugcuguaa

SEQ ID NO: 607651 - RNA, 19 nt, Homo sapiens
ggagauguguacguaauau

SEQ ID NO: 607652 - RNA, 19 nt, Homo sapiens
gcacuuuccuccagcaaca

SEQ ID NO: 607653 - RNA, 19 nt, Homo sapiens
gaacugcggcaaaguagga

SEQ ID NO: 607654 - RNA, 19 nt, Homo sapiens
agacuucggcggaccauua

SEQ ID NO: 607655 - RNA, 19 nt, Homo sapiens
gcaagggugugagauguuc

SEQ ID NO: 607656 - RNA, 19 nt, Homo sapiens
ugauggagauguguacgua

SEQ ID NO: 607657 - RNA, 19 nt, Homo sapiens
aggagagcgucguuaauuu

SEQ ID NO: 607658 - RNA, 19 nt, Homo sapiens
gaaggagagcgucguuaau

SEQ ID NO: 607659 - RNA, 19 nt, Homo sapiens
gaggcaacuugaacucaga

SEQ ID NO: 607660 - RNA, 19 nt, Homo sapiens
guccugagaucuucaccuu

SEQ ID NO: 607661 - RNA, 19 nt, Homo sapiens
ggacuuccgaggcaacuug

SEQ ID NO: 607662 - RNA, 19 nt, Homo sapiens
gagagcgucguuaauuuau

SEQ ID NO: 607663 - RNA, 19 nt, Homo sapiens
ccugaccugucuccuguuu

SEQ ID NO: 607664 - RNA, 19 nt, Homo sapiens
aaggagagcgucguuaauu

SEQ ID NO: 607665 - RNA, 19 nt, Homo sapiens
cgccuaguauguucuguga

SEQ ID NO: 607666 - RNA, 19 nt, Homo sapiens
cucgagcccuuuaaucuga

SEQ ID NO: 607667 - RNA, 19 nt, Homo sapiens
cggcaaaguaggagaagaa

SEQ ID NO: 607668 - RNA, 19 nt, Homo sapiens
gagauguguacguaauauu

SEQ ID NO: 607669 - RNA, 19 nt, Homo sapiens
cuucggagcccucggacua

SEQ ID NO: 607670 - RNA, 19 nt, Homo sapiens
guggugggucguaaguuua

SEQ ID NO: 607671 - RNA, 19 nt, Homo sapiens
gcaaaguaggagaagaaau

SEQ ID NO: 607672 - RNA, 19 nt, Homo sapiens
gcucuggaccucagcacuu

SEQ ID NO: 607673 - RNA, 19 nt, Homo sapiens
gggaaggagagcgucguua

SEQ ID NO: 607674 - RNA, 19 nt, Homo sapiens
gaaccgaacccagccaaaa

SEQ ID NO: 607675 - RNA, 19 nt, Homo sapiens
ucucaacuccgucugucua

SEQ ID NO: 607676 - RNA, 19 nt, Homo sapiens
gauggagauguguacguaa

SEQ ID NO: 607677 - RNA, 19 nt, Homo sapiens
agaccgaggcgcauagaga

SEQ ID NO: 607678 - RNA, 19 nt, Homo sapiens
agagcgucguuaauuuauu

SEQ ID NO: 607679 - RNA, 19 nt, Homo sapiens
ggaaccgaacccagccaaa

SEQ ID NO: 607680 - RNA, 19 nt, Homo sapiens
gauccuuccaucuucuuga

SEQ ID NO: 607681 - RNA, 19 nt, Homo sapiens
ugaccugucuccuguuuug

SEQ ID NO: 607682 - RNA, 19 nt, Homo sapiens
caacuccgucugucuacug

SEQ ID NO: 607683 - RNA, 19 nt, Homo sapiens
ccuaggugauggagaugug

SEQ ID NO: 607684 - RNA, 19 nt, Homo sapiens
gcaacuugaacucagaaca

SEQ ID NO: 607685 - RNA, 19 nt, Homo sapiens
caacuugaacucagaacac

SEQ ID NO: 607686 - RNA, 19 nt, Homo sapiens
gguauuuauugagcuuugu

SEQ ID NO: 607687 - RNA, 19 nt, Homo sapiens
cuggaacugcggcaaagua

SEQ ID NO: 607688 - RNA, 19 nt, Homo sapiens
gcuccgguccugagaucuu

SEQ ID NO: 607689 - RNA, 19 nt, Homo sapiens
uggagauguguacguaaua

SEQ ID NO: 607690 - RNA, 19 nt, Homo sapiens
ggcaaaguaggagaagaaa

SEQ ID NO: 607691 - RNA, 19 nt, Homo sapiens
gaucguggcugucaaauuu

SEQ ID NO: 607692 - RNA, 19 nt, Homo sapiens
ccacagagcuagacagaua

SEQ ID NO: 607693 - RNA, 19 nt, Homo sapiens
gcauugaucuuacuuauga

SEQ ID NO: 607694 - RNA, 19 nt, Homo sapiens
gaucaagugucaucccuua

SEQ ID NO: 607695 - RNA, 19 nt, Homo sapiens
caacagcacuucucaccua

SEQ ID NO: 607696 - RNA, 19 nt, Homo sapiens
gaagaaacaucccuuugau

SEQ ID NO: 607697 - RNA, 19 nt, Homo sapiens
agacagagcagaugauuua

SEQ ID NO: 607698 - RNA, 19 nt, Homo sapiens
gcauuuacgugcuuuauau

SEQ ID NO: 607699 - RNA, 19 nt, Homo sapiens
gaaccuuccuguuaaauuc

SEQ ID NO: 607700 - RNA, 19 nt, Homo sapiens
cagauaagaugcauaguug

SEQ ID NO: 607701 - RNA, 19 nt, Homo sapiens
ggacagcacugcagguguu

SEQ ID NO: 607702 - RNA, 19 nt, Homo sapiens
gcagauuacuuaaauaugg

SEQ ID NO: 607703 - RNA, 19 nt, Homo sapiens
gcacagcagugaucaagug

SEQ ID NO: 607704 - RNA, 19 nt, Homo sapiens
cagaagagacaucuauuua

SEQ ID NO: 607705 - RNA, 19 nt, Homo sapiens
guagugaaaucuuacugua

SEQ ID NO: 607706 - RNA, 19 nt, Homo sapiens
uaaauucgguguauggauu

SEQ ID NO: 607707 - RNA, 19 nt, Homo sapiens
ccucauagcuuugaagaaa

SEQ ID NO: 607708 - RNA, 19 nt, Homo sapiens
aaaggaaucuagccaauga

SEQ ID NO: 607709 - RNA, 19 nt, Homo sapiens
ggaagaaacaucccuuuga

SEQ ID NO: 607710 - RNA, 19 nt, Homo sapiens
caacauagauuggauuugg

SEQ ID NO: 607711 - RNA, 19 nt, Homo sapiens
gaagguugauguauaaagu

SEQ ID NO: 607712 - RNA, 19 nt, Homo sapiens
cgaaggagccauuaacuuu

SEQ ID NO: 607713 - RNA, 19 nt, Homo sapiens
uuaaauggcuguucaguuc

SEQ ID NO: 607714 - RNA, 19 nt, Homo sapiens
ggaugccacuguuguagua

SEQ ID NO: 607715 - RNA, 19 nt, Homo sapiens
cuacagaaaucaaguggaa

SEQ ID NO: 607716 - RNA, 19 nt, Homo sapiens
gacaaucagugaccaagaa

SEQ ID NO: 607717 - RNA, 19 nt, Homo sapiens
gugggaagcuagagaaauu

SEQ ID NO: 607718 - RNA, 19 nt, Homo sapiens
cgacagcgauggcaccaaa

SEQ ID NO: 607719 - RNA, 19 nt, Homo sapiens
ucacaaguuuggacuauga

SEQ ID NO: 607720 - RNA, 19 nt, Homo sapiens
gcagagcagugaagauuag

SEQ ID NO: 607721 - RNA, 19 nt, Homo sapiens
gaauugagcgcagggaaua

SEQ ID NO: 607722 - RNA, 19 nt, Homo sapiens
uaaaugggacagagaauaa

SEQ ID NO: 607723 - RNA, 19 nt, Homo sapiens
aaaguaagcuccuccaaag

SEQ ID NO: 607724 - RNA, 19 nt, Homo sapiens
gaacucaaccuucuagaca

SEQ ID NO: 607725 - RNA, 19 nt, Homo sapiens
agaaacaucccuuugauaa

SEQ ID NO: 607726 - RNA, 19 nt, Homo sapiens
acgaggaguuuaagaguua

SEQ ID NO: 607727 - RNA, 19 nt, Homo sapiens
ccaaugagguccaagaagu

SEQ ID NO: 607728 - RNA, 19 nt, Homo sapiens
acccuaaacuguugaauaa

SEQ ID NO: 607729 - RNA, 19 nt, Homo sapiens
ccugaagguugauguauaa

SEQ ID NO: 607730 - RNA, 19 nt, Homo sapiens
ggcagaugcugguaacuuu

SEQ ID NO: 607731 - RNA, 19 nt, Homo sapiens
gaaacaucccuuugauaaa

SEQ ID NO: 607732 - RNA, 19 nt, Homo sapiens
uaaacagaaugguccuuaa

SEQ ID NO: 607733 - RNA, 19 nt, Homo sapiens
gauggaaagugcuaugugu

SEQ ID NO: 607734 - RNA, 19 nt, Homo sapiens
acaaggagaucacccagaa

SEQ ID NO: 607735 - RNA, 19 nt, Homo sapiens
cauugucacugucaagaua

SEQ ID NO: 607736 - RNA, 19 nt, Homo sapiens
aauaagaaguucaguagug

SEQ ID NO: 607737 - RNA, 19 nt, Homo sapiens
agacaucccuccaccagaa

SEQ ID NO: 607738 - RNA, 19 nt, Homo sapiens
gaacaacauagauuggauu

SEQ ID NO: 607739 - RNA, 19 nt, Homo sapiens
gaauaacacuuggcuuucu

SEQ ID NO: 607740 - RNA, 19 nt, Homo sapiens
uugaagagaugguggaauu

SEQ ID NO: 607741 - RNA, 19 nt, Homo sapiens
aaagcugacugcuaggaua

SEQ ID NO: 607742 - RNA, 19 nt, Homo sapiens
ggacguagccaucgacaca

SEQ ID NO: 607743 - RNA, 19 nt, Homo sapiens
gaagagaugguggaauuga

SEQ ID NO: 607744 - RNA, 19 nt, Homo sapiens
gaaauuggagacccucuug

SEQ ID NO: 607745 - RNA, 19 nt, Homo sapiens
acacgccuaugaucaauuu

SEQ ID NO: 607746 - RNA, 19 nt, Homo sapiens
gaaguucucacccauugaa

SEQ ID NO: 607747 - RNA, 19 nt, Homo sapiens
cuggugcccugcaguauua

SEQ ID NO: 607748 - RNA, 19 nt, Homo sapiens
gaaggagccauuaacuuug

SEQ ID NO: 607749 - RNA, 19 nt, Homo sapiens
ggaauuugaucaacuacag

SEQ ID NO: 607750 - RNA, 19 nt, Homo sapiens
ggaaugaagacuacaagga

SEQ ID NO: 607751 - RNA, 19 nt, Homo sapiens
gcgaggagguggcagacaa

SEQ ID NO: 607752 - RNA, 19 nt, Homo sapiens
gagaggaggugcucaacag

SEQ ID NO: 607753 - RNA, 19 nt, Homo sapiens
guaagcuccuccaaaguug

SEQ ID NO: 607754 - RNA, 19 nt, Homo sapiens
guaacaaccagucaaagaa

SEQ ID NO: 607755 - RNA, 19 nt, Homo sapiens
uuagacaucuggaauuuca

SEQ ID NO: 607756 - RNA, 19 nt, Homo sapiens
uugcaugcccuaucaauua

SEQ ID NO: 607757 - RNA, 19 nt, Homo sapiens
gacauugcaugcccuauca

SEQ ID NO: 607758 - RNA, 19 nt, Homo sapiens
acacuuggcuuucuaagag

SEQ ID NO: 607759 - RNA, 19 nt, Homo sapiens
cauggacaguauucaauuu

SEQ ID NO: 607760 - RNA, 19 nt, Homo sapiens
gauacauucuguugacuuc

SEQ ID NO: 607761 - RNA, 19 nt, Homo sapiens
gaaagcaguuccggagcaa

SEQ ID NO: 607762 - RNA, 19 nt, Homo sapiens
cuaugccacugucuuguua

SEQ ID NO: 607763 - RNA, 19 nt, Homo sapiens
guuagaauauggagagugu

SEQ ID NO: 607764 - RNA, 19 nt, Homo sapiens
gcauacaccguuagcuuaa

SEQ ID NO: 607765 - RNA, 19 nt, Homo sapiens
cagaggaccugcguacuga

SEQ ID NO: 607766 - RNA, 19 nt, Homo sapiens
gauuucaacuaccgcauug

SEQ ID NO: 607767 - RNA, 19 nt, Homo sapiens
ucucauagauacauucugu

SEQ ID NO: 607768 - RNA, 19 nt, Homo sapiens
gaaugguccuuaacagagu

SEQ ID NO: 607769 - RNA, 19 nt, Homo sapiens
caccaucuaguccuuauua

SEQ ID NO: 607770 - RNA, 19 nt, Homo sapiens
ggcauacaccguuagcuua

SEQ ID NO: 607771 - RNA, 19 nt, Homo sapiens
ccagaagagacaucuauuu

SEQ ID NO: 607772 - RNA, 19 nt, Homo sapiens
acagugaucuagauguuga

SEQ ID NO: 607773 - RNA, 19 nt, Homo sapiens
agacagugaucuagauguu

SEQ ID NO: 607774 - RNA, 19 nt, Homo sapiens
ugaaggagcggaaugaaga

SEQ ID NO: 607775 - RNA, 19 nt, Homo sapiens
gaacgacgacggccaugug

SEQ ID NO: 607776 - RNA, 19 nt, Homo sapiens
ggaacuccuucuucuggaa

SEQ ID NO: 607777 - RNA, 19 nt, Homo sapiens
uuacaacacguaucucuuu

SEQ ID NO: 607778 - RNA, 19 nt, Homo sapiens
aaacaugacugagcagcuu

SEQ ID NO: 607779 - RNA, 19 nt, Homo sapiens
ggacccaccuacaaguaug

SEQ ID NO: 607780 - RNA, 19 nt, Homo sapiens
aauaugugcucaucuccua

SEQ ID NO: 607781 - RNA, 19 nt, Homo sapiens
gaagcugauuugccaagau

SEQ ID NO: 607782 - RNA, 19 nt, Homo sapiens
ggagauuugucuuuuguuu

SEQ ID NO: 607783 - RNA, 19 nt, Homo sapiens
gaagccagcaucagacgaa

SEQ ID NO: 607784 - RNA, 19 nt, Homo sapiens
ggaagaacaguuugagcaa

SEQ ID NO: 607785 - RNA, 19 nt, Homo sapiens
ugaagacgaugaagacuac

SEQ ID NO: 607786 - RNA, 19 nt, Homo sapiens
gugggcgucugucuuuaua

SEQ ID NO: 607787 - RNA, 19 nt, Homo sapiens
gugcucaucuccuaaguag

SEQ ID NO: 607788 - RNA, 19 nt, Homo sapiens
cagcagugaucaaguguca

SEQ ID NO: 607789 - RNA, 19 nt, Homo sapiens
gcacuucucaccuauucaa

SEQ ID NO: 607790 - RNA, 19 nt, Homo sapiens
gaaaggaaucuagccaaug

SEQ ID NO: 607791 - RNA, 19 nt, Homo sapiens
gggaagaacugauaucuga

SEQ ID NO: 607792 - RNA, 19 nt, Homo sapiens
gaaauacaguggucugaug

SEQ ID NO: 607793 - RNA, 19 nt, Homo sapiens
gaagaguccuugaaccaaa

SEQ ID NO: 607794 - RNA, 19 nt, Homo sapiens
ggacuuugcuacuuguaaa

SEQ ID NO: 607795 - RNA, 19 nt, Homo sapiens
gaacugauaucugagaaca

SEQ ID NO: 607796 - RNA, 19 nt, Homo sapiens
gagggacgcucacaagcua

SEQ ID NO: 607797 - RNA, 19 nt, Homo sapiens
ggagggacuuugcuacuug

SEQ ID NO: 607798 - RNA, 19 nt, Homo sapiens
caaagagacuacacacaau

SEQ ID NO: 607799 - RNA, 19 nt, Homo sapiens
ggauagcaaugaauaguuc

SEQ ID NO: 607800 - RNA, 19 nt, Homo sapiens
gaauaguucucugaaaugu

SEQ ID NO: 607801 - RNA, 19 nt, Homo sapiens
ugaugaagcagaagaaaua

SEQ ID NO: 607802 - RNA, 19 nt, Homo sapiens
gaaauucgcagaugcauac

SEQ ID NO: 607803 - RNA, 19 nt, Homo sapiens
ggucuuccuucuugcuuua

SEQ ID NO: 607804 - RNA, 19 nt, Homo sapiens
gggaagguguggcucauug

SEQ ID NO: 607805 - RNA, 19 nt, Homo sapiens
ucaagaaacacauacagua

SEQ ID NO: 607806 - RNA, 19 nt, Homo sapiens
gggcugaguuucgauguuu

SEQ ID NO: 607807 - RNA, 19 nt, Homo sapiens
gaagaacugauaucugaga

SEQ ID NO: 607808 - RNA, 19 nt, Homo sapiens
gaaaacaagcuuauuggua

SEQ ID NO: 607809 - RNA, 19 nt, Homo sapiens
ccagauccauguauagaau

SEQ ID NO: 607810 - RNA, 19 nt, Homo sapiens
gcaaugaauaguucucuga

SEQ ID NO: 607811 - RNA, 19 nt, Homo sapiens
gaaggauuauuuacucgau

SEQ ID NO: 607812 - RNA, 19 nt, Homo sapiens
gggcgaagacggaguugua

SEQ ID NO: 607813 - RNA, 19 nt, Homo sapiens
gcagaugcauacaagacuu

SEQ ID NO: 607814 - RNA, 19 nt, Homo sapiens
ucaaagagacuacacacaa

SEQ ID NO: 607815 - RNA, 19 nt, Homo sapiens
gagaacacagccacgcuua

SEQ ID NO: 607816 - RNA, 19 nt, Homo sapiens
cucagaaugugaaggauua

SEQ ID NO: 607817 - RNA, 19 nt, Homo sapiens
gcuaauagacuuccuuaag

SEQ ID NO: 607818 - RNA, 19 nt, Homo sapiens
gcaggaggacgacugauga

SEQ ID NO: 607819 - RNA, 19 nt, Homo sapiens
ugacuucacucagccguuu

SEQ ID NO: 607820 - RNA, 19 nt, Homo sapiens
gcuggaggaugaagaagga

SEQ ID NO: 607821 - RNA, 19 nt, Homo sapiens
ucacucagccguuuauuca

SEQ ID NO: 607822 - RNA, 19 nt, Homo sapiens
gcaccagaauuuccugagu

SEQ ID NO: 607823 - RNA, 19 nt, Homo sapiens
gaugauccaccaacacauu

SEQ ID NO: 607824 - RNA, 19 nt, Homo sapiens
agaaacacauacaguacaa

SEQ ID NO: 607825 - RNA, 19 nt, Homo sapiens
aaagagacuacacacaaua

SEQ ID NO: 607826 - RNA, 19 nt, Homo sapiens
acacauacaguacaaauuc

SEQ ID NO: 607827 - RNA, 19 nt, Homo sapiens
gaagaaauucgcagaugca

SEQ ID NO: 607828 - RNA, 19 nt, Homo sapiens
gagacuacacacaauacua

SEQ ID NO: 607829 - RNA, 19 nt, Homo sapiens
caccagaauuuccugaguu

SEQ ID NO: 607830 - RNA, 19 nt, Homo sapiens
uccuuaagcugaagagaaa

SEQ ID NO: 607831 - RNA, 19 nt, Homo sapiens
cuaauagacuuccuuaagc

SEQ ID NO: 607832 - RNA, 19 nt, Homo sapiens
caguacaaauucuuagaug

SEQ ID NO: 607833 - RNA, 19 nt, Homo sapiens
acucagccguuuauucauu

SEQ ID NO: 607834 - RNA, 19 nt, Homo sapiens
gauaucugagaacaacuua

SEQ ID NO: 607835 - RNA, 19 nt, Homo sapiens
uauagaauaugagcucguu

SEQ ID NO: 607836 - RNA, 19 nt, Homo sapiens
gcuuacggcaccagaauuu

SEQ ID NO: 607837 - RNA, 19 nt, Homo sapiens
caacuuaaacggcgauuuu

SEQ ID NO: 607838 - RNA, 19 nt, Homo sapiens
ucucgacacuucgguaauu

SEQ ID NO: 607839 - RNA, 19 nt, Homo sapiens
agacagugaugaugaagca

SEQ ID NO: 607840 - RNA, 19 nt, Homo sapiens
gccagacagugaugaugaa

SEQ ID NO: 607841 - RNA, 19 nt, Homo sapiens
ggaagaguccuugaaccaa

SEQ ID NO: 607842 - RNA, 19 nt, Homo sapiens
caagaaacacauacaguac

SEQ ID NO: 607843 - RNA, 19 nt, Homo sapiens
ggaugaagaaggagcaugu

SEQ ID NO: 607844 - RNA, 19 nt, Homo sapiens
caagaguuccgauuucauc

SEQ ID NO: 607845 - RNA, 19 nt, Homo sapiens
cacaaacagugaagugaca

SEQ ID NO: 607846 - RNA, 19 nt, Homo sapiens
gcagcuggaggaugaagaa

SEQ ID NO: 607847 - RNA, 19 nt, Homo sapiens
uaauagacuuccuuaagcu

SEQ ID NO: 607848 - RNA, 19 nt, Homo sapiens
gauauauacagagacagua

SEQ ID NO: 607849 - RNA, 19 nt, Homo sapiens
gaagacuuuguguucgaua

SEQ ID NO: 607850 - RNA, 19 nt, Homo sapiens
agacuacacacaauacuau

SEQ ID NO: 607851 - RNA, 19 nt, Homo sapiens
ugauggaacucuggugguu

SEQ ID NO: 607852 - RNA, 19 nt, Homo sapiens
aaacggagggacuuugcua

SEQ ID NO: 607853 - RNA, 19 nt, Homo sapiens
gacuuuguguucgauauau

SEQ ID NO: 607854 - RNA, 19 nt, Homo sapiens
caagggaugcguauuggau

SEQ ID NO: 607855 - RNA, 19 nt, Homo sapiens
uuccugaguuugccacuaa

SEQ ID NO: 607856 - RNA, 19 nt, Homo sapiens
gcucaucagccgcaacuuc

SEQ ID NO: 607857 - RNA, 19 nt, Homo sapiens
ggaagguguggcucauuga

SEQ ID NO: 607858 - RNA, 19 nt, Homo sapiens
agcgacaucuuucugcuuu

SEQ ID NO: 607859 - RNA, 19 nt, Homo sapiens
ugaauaguucucugaaaug

SEQ ID NO: 607860 - RNA, 19 nt, Homo sapiens
accagaauuuccugaguuu

SEQ ID NO: 607861 - RNA, 19 nt, Homo sapiens
ugugaaggauuauuuacuc

SEQ ID NO: 607862 - RNA, 19 nt, Homo sapiens
gagggacuuugcuacuugu

SEQ ID NO: 607863 - RNA, 19 nt, Homo sapiens
gcgaagacggaguuguaaa

SEQ ID NO: 607864 - RNA, 19 nt, Homo sapiens
caccugggaagaacugaua

SEQ ID NO: 607865 - RNA, 19 nt, Homo sapiens
gaaacacauacaguacaaa

SEQ ID NO: 607866 - RNA, 19 nt, Homo sapiens
ggcagugucuuuccuaagc

SEQ ID NO: 607867 - RNA, 19 nt, Homo sapiens
aagcuaauagacuuccuua

SEQ ID NO: 607868 - RNA, 19 nt, Homo sapiens
uuucaagaguuccgauuuc

SEQ ID NO: 607869 - RNA, 19 nt, Homo sapiens
gaugaugaagcagaagaaa

SEQ ID NO: 607870 - RNA, 19 nt, Homo sapiens
aggauuauuuacucgauga

SEQ ID NO: 607871 - RNA, 19 nt, Homo sapiens
uguguucgauauauacaga

SEQ ID NO: 607872 - RNA, 19 nt, Homo sapiens
aggaagaaauucgcagaug

SEQ ID NO: 607873 - RNA, 19 nt, Homo sapiens
caaugaauaguucucugaa

SEQ ID NO: 607874 - RNA, 19 nt, Homo sapiens
uccaggaaccuaucaauuc

SEQ ID NO: 607875 - RNA, 19 nt, Homo sapiens
gaacacagccacgcuuacg

SEQ ID NO: 607876 - RNA, 19 nt, Homo sapiens
gcguuaccaucaagagugu

SEQ ID NO: 607877 - RNA, 19 nt, Homo sapiens
cggagggacuuugcuacuu

SEQ ID NO: 607878 - RNA, 19 nt, Homo sapiens
agaugaagacuuuguguuc

SEQ ID NO: 607879 - RNA, 19 nt, Homo sapiens
gaccggaagaguccuugaa

SEQ ID NO: 607880 - RNA, 19 nt, Homo sapiens
aaacggcgauuuuagugaa

SEQ ID NO: 607881 - RNA, 19 nt, Homo sapiens
cgaaaauggugugaauuga

SEQ ID NO: 607882 - RNA, 19 nt, Homo sapiens
guccaggaaccuaucaauu

SEQ ID NO: 607883 - RNA, 19 nt, Homo sapiens
gggacuuugcuacuuguaa

SEQ ID NO: 607884 - RNA, 19 nt, Homo sapiens
ggacgcucacaagcuaaua

SEQ ID NO: 607885 - RNA, 19 nt, Homo sapiens
ugacuuuaauccauuuggu

SEQ ID NO: 607886 - RNA, 19 nt, Homo sapiens
agacuuuguguucgauaua

SEQ ID NO: 607887 - RNA, 19 nt, Homo sapiens
gcgugugugucaagcguau

SEQ ID NO: 607888 - RNA, 19 nt, Homo sapiens
acaguggucugaugaugag

SEQ ID NO: 607889 - RNA, 19 nt, Homo sapiens
cagugaugaugaagcagaa

SEQ ID NO: 607890 - RNA, 19 nt, Homo sapiens
ggaaaaccauacuguucug

SEQ ID NO: 607891 - RNA, 19 nt, Homo sapiens
gaagaaaucucuagaggaa

SEQ ID NO: 607892 - RNA, 19 nt, Homo sapiens
ggaagaagaugcucagauu

SEQ ID NO: 607893 - RNA, 19 nt, Homo sapiens
gaagagcccucccaaagga

SEQ ID NO: 607894 - RNA, 19 nt, Homo sapiens
gagaugaagccauuucuua

SEQ ID NO: 607895 - RNA, 19 nt, Homo sapiens
caaagaaucugcuccacaa

SEQ ID NO: 607896 - RNA, 19 nt, Homo sapiens
ucaaagagcucgagagaca

SEQ ID NO: 607897 - RNA, 19 nt, Homo sapiens
ggugggaacuugauauaaa

SEQ ID NO: 607898 - RNA, 19 nt, Homo sapiens
gcaaagaccuggagaagcu

SEQ ID NO: 607899 - RNA, 19 nt, Homo sapiens
ggagggcgaugacauuaaa

SEQ ID NO: 607900 - RNA, 19 nt, Homo sapiens
cuaaagaacuucagacugu

SEQ ID NO: 607901 - RNA, 19 nt, Homo sapiens
ugaaagucauugaagcuua

SEQ ID NO: 607902 - RNA, 19 nt, Homo sapiens
gcagaccagugagaaguua

SEQ ID NO: 607903 - RNA, 19 nt, Homo sapiens
caacuuagcagaucauuca

SEQ ID NO: 607904 - RNA, 19 nt, Homo sapiens
cagcaagaauaaagcaaua

SEQ ID NO: 607905 - RNA, 19 nt, Homo sapiens
ggaaaguccugaagaacau

SEQ ID NO: 607906 - RNA, 19 nt, Homo sapiens
agagacacauggaggauua

SEQ ID NO: 607907 - RNA, 19 nt, Homo sapiens
gaaguuaaguucagcaaac

SEQ ID NO: 607908 - RNA, 19 nt, Homo sapiens
guaguaagagcaaaguuua

SEQ ID NO: 607909 - RNA, 19 nt, Homo sapiens
aaacgaaggucacgucugu

SEQ ID NO: 607910 - RNA, 19 nt, Homo sapiens
gggaugagaccaaucuaua

SEQ ID NO: 607911 - RNA, 19 nt, Homo sapiens
agacugugcuuucaacgua

SEQ ID NO: 607912 - RNA, 19 nt, Homo sapiens
gaccugagcuacaucaauc

SEQ ID NO: 607913 - RNA, 19 nt, Homo sapiens
ccaccuugcucucuguaua

SEQ ID NO: 607914 - RNA, 19 nt, Homo sapiens
uagcaacaaucaacuggua

SEQ ID NO: 607915 - RNA, 19 nt, Homo sapiens
gaacagagagcccgcaaag

SEQ ID NO: 607916 - RNA, 19 nt, Homo sapiens
cgaaguauuucacaagaau

SEQ ID NO: 607917 - RNA, 19 nt, Homo sapiens
ggaugagaccaaucuauaa

SEQ ID NO: 607918 - RNA, 19 nt, Homo sapiens
guacugugauucucagaug

SEQ ID NO: 607919 - RNA, 19 nt, Homo sapiens
caggagggauugacucuga

SEQ ID NO: 607920 - RNA, 19 nt, Homo sapiens
guauauaacugugucuguu

SEQ ID NO: 607921 - RNA, 19 nt, Homo sapiens
uggagaagcuggugaggaa

SEQ ID NO: 607922 - RNA, 19 nt, Homo sapiens
agaaaucucuagaggaaga

SEQ ID NO: 607923 - RNA, 19 nt, Homo sapiens
gaaagucauugaagcuuac

SEQ ID NO: 607924 - RNA, 19 nt, Homo sapiens
gcaccugaauccuuugugu

SEQ ID NO: 607925 - RNA, 19 nt, Homo sapiens
agauuugacucucugauuu

SEQ ID NO: 607926 - RNA, 19 nt, Homo sapiens
uguauaggcuaguucagua

SEQ ID NO: 607927 - RNA, 19 nt, Homo sapiens
ccagcuacgugaauaagaa

SEQ ID NO: 607928 - RNA, 19 nt, Homo sapiens
gcacagcugcuuuggaaga

SEQ ID NO: 607929 - RNA, 19 nt, Homo sapiens
ucaugcgccuggauaaaua

SEQ ID NO: 607930 - RNA, 19 nt, Homo sapiens
ggacgagcuuuccuucuca

SEQ ID NO: 607931 - RNA, 19 nt, Homo sapiens
ggaacuugauauaaacguu

SEQ ID NO: 607932 - RNA, 19 nt, Homo sapiens
gagcaugauugagcggaua

SEQ ID NO: 607933 - RNA, 19 nt, Homo sapiens
acuagaaccuguaaauaga

SEQ ID NO: 607934 - RNA, 19 nt, Homo sapiens
ggcaaacacucaauucaag

SEQ ID NO: 607935 - RNA, 19 nt, Homo sapiens
gcucucaccuuguauggau

SEQ ID NO: 607936 - RNA, 19 nt, Homo sapiens
acaaggaggaucuuaguaa

SEQ ID NO: 607937 - RNA, 19 nt, Homo sapiens
gguaguaagagcaaaguuu

SEQ ID NO: 607938 - RNA, 19 nt, Homo sapiens
ccaaucauuucuucacuuc

SEQ ID NO: 607939 - RNA, 19 nt, Homo sapiens
agagagaucuuacuagaac

SEQ ID NO: 607940 - RNA, 19 nt, Homo sapiens
cuacaucaauccacucugu

SEQ ID NO: 607941 - RNA, 19 nt, Homo sapiens
caauucaaguucacgcaaa

SEQ ID NO: 607942 - RNA, 19 nt, Homo sapiens
gauaauagcaacaaucaac

SEQ ID NO: 607943 - RNA, 19 nt, Homo sapiens
auuuauaccugcagagaua

SEQ ID NO: 607944 - RNA, 19 nt, Homo sapiens
gaaauaucagggagcauga

SEQ ID NO: 607945 - RNA, 19 nt, Homo sapiens
ggaacacagugaggaguug

SEQ ID NO: 607946 - RNA, 19 nt, Homo sapiens
gcccgaagcucagcagaga

SEQ ID NO: 607947 - RNA, 19 nt, Homo sapiens
aaugggaaaucuagaagaa

SEQ ID NO: 607948 - RNA, 19 nt, Homo sapiens
guuuggacaugaccgauaa

SEQ ID NO: 607949 - RNA, 19 nt, Homo sapiens
agaaucugcuccacaaguu

SEQ ID NO: 607950 - RNA, 19 nt, Homo sapiens
uuaacaagguccucaguuc

SEQ ID NO: 607951 - RNA, 19 nt, Homo sapiens
ccauaaagccucauucagu

SEQ ID NO: 607952 - RNA, 19 nt, Homo sapiens
uaaaguaacagcagacauc

SEQ ID NO: 607953 - RNA, 19 nt, Homo sapiens
ccaaauugcccuuuaacug

SEQ ID NO: 607954 - RNA, 19 nt, Homo sapiens
agaauguccuuuccagcua

SEQ ID NO: 607955 - RNA, 19 nt, Homo sapiens
ccucaguucuuucuguuga

SEQ ID NO: 607956 - RNA, 19 nt, Homo sapiens
gcucguuccuucacacuca

SEQ ID NO: 607957 - RNA, 19 nt, Homo sapiens
ggaguucgcgucccggaaa

SEQ ID NO: 607958 - RNA, 19 nt, Homo sapiens
gaaugacaaucacaaagcu

SEQ ID NO: 607959 - RNA, 19 nt, Homo sapiens
gaugaguggcuuuaucuau

SEQ ID NO: 607960 - RNA, 19 nt, Homo sapiens
guucagcaaacauuucaua

SEQ ID NO: 607961 - RNA, 19 nt, Homo sapiens
ugacaaguguggagaaacu

SEQ ID NO: 607962 - RNA, 19 nt, Homo sapiens
gaauguagcaucagaagcu

SEQ ID NO: 607963 - RNA, 19 nt, Homo sapiens
uccuugcccuugcuaauua

SEQ ID NO: 607964 - RNA, 19 nt, Homo sapiens
cuaaguaacauaggcauaa

SEQ ID NO: 607965 - RNA, 19 nt, Homo sapiens
gcucuuguccgcugucuga

SEQ ID NO: 607966 - RNA, 19 nt, Homo sapiens
cuucuacucuucccaaaug

SEQ ID NO: 607967 - RNA, 19 nt, Homo sapiens
ggaggauuaucauacagau

SEQ ID NO: 607968 - RNA, 19 nt, Homo sapiens
ugggaaaucuagaagaaau

SEQ ID NO: 607969 - RNA, 19 nt, Homo sapiens
gaacuucagacugugcuuu

SEQ ID NO: 607970 - RNA, 19 nt, Homo sapiens
ggacaugaccgauaauagc

SEQ ID NO: 607971 - RNA, 19 nt, Homo sapiens
aaccugcccuguuguauau

SEQ ID NO: 607972 - RNA, 19 nt, Homo sapiens
aaaccugcccuguuguaua

SEQ ID NO: 607973 - RNA, 19 nt, Homo sapiens
ucugugaacaucucaguua

SEQ ID NO: 607974 - RNA, 19 nt, Homo sapiens
gcccucgucucaccgcaua

SEQ ID NO: 607975 - RNA, 19 nt, Homo sapiens
gaagaagaugcucagauuc

SEQ ID NO: 607976 - RNA, 19 nt, Homo sapiens
ggauauuagugucgugcaa

SEQ ID NO: 607977 - RNA, 19 nt, Homo sapiens
gcucguacagucuuuagaa

SEQ ID NO: 607978 - RNA, 19 nt, Homo sapiens
uaucggaguuuggacauga

SEQ ID NO: 607979 - RNA, 19 nt, Homo sapiens
ucacuagaauugccagcuu

SEQ ID NO: 607980 - RNA, 19 nt, Homo sapiens
uaacugcaccugaauccuu

SEQ ID NO: 607981 - RNA, 19 nt, Homo sapiens
ggacuuugcuuuugguuuc

SEQ ID NO: 607982 - RNA, 19 nt, Homo sapiens
uugguaagcuugaguuuua

SEQ ID NO: 607983 - RNA, 19 nt, Homo sapiens
gaucuuacuagaaccugua

SEQ ID NO: 607984 - RNA, 19 nt, Homo sapiens
uaccguauaugcauuaaag

SEQ ID NO: 607985 - RNA, 19 nt, Homo sapiens
gcgcuugugcucuguauug

SEQ ID NO: 607986 - RNA, 19 nt, Homo sapiens
cauggaggauuaucauaca

SEQ ID NO: 607987 - RNA, 19 nt, Homo sapiens
gggaaaucuagaagaaaua

SEQ ID NO: 607988 - RNA, 19 nt, Homo sapiens
acaauguggugcuacagaa

SEQ ID NO: 607989 - RNA, 19 nt, Homo sapiens
caaaagcuauuacaaugug

SEQ ID NO: 607990 - RNA, 19 nt, Homo sapiens
ggucucagaacaacucauu

SEQ ID NO: 607991 - RNA, 19 nt, Homo sapiens
gcacugaccugaugcauaa

SEQ ID NO: 607992 - RNA, 19 nt, Homo sapiens
ggaagaagaugcucagauu

SEQ ID NO: 607993 - RNA, 19 nt, Homo sapiens
gaacacugaucaaguaguu

SEQ ID NO: 607994 - RNA, 19 nt, Homo sapiens
gcaaccagcugcagugaaa

SEQ ID NO: 607995 - RNA, 19 nt, Homo sapiens
gaagagcccucccaaagga

SEQ ID NO: 607996 - RNA, 19 nt, Homo sapiens
uaagaucacugcagaagaa

SEQ ID NO: 607997 - RNA, 19 nt, Homo sapiens
gcaguagccuuucucguuu

SEQ ID NO: 607998 - RNA, 19 nt, Homo sapiens
ccauguggcucacuuauuu

SEQ ID NO: 607999 - RNA, 19 nt, Homo sapiens
gcagugauuucuguuauaa

SEQ ID NO: 608000 - RNA, 19 nt, Homo sapiens
ucaaagagcucgagagaca

SEQ ID NO: 608001 - RNA, 19 nt, Homo sapiens
ggagggcgaugacauuaaa

SEQ ID NO: 608002 - RNA, 19 nt, Homo sapiens
cuaaagaacuucagacugu

SEQ ID NO: 608003 - RNA, 19 nt, Homo sapiens
uaugaacacugaucaagua

SEQ ID NO: 608004 - RNA, 19 nt, Homo sapiens
gcaaggcacugaccugaug

SEQ ID NO: 608005 - RNA, 19 nt, Homo sapiens
gaacuagaagguagguuua

SEQ ID NO: 608006 - RNA, 19 nt, Homo sapiens
guaaugggauauugaaguu

SEQ ID NO: 608007 - RNA, 19 nt, Homo sapiens
gcaacuguuugauuucuuu

SEQ ID NO: 608008 - RNA, 19 nt, Homo sapiens
ugaagagucugaacuagaa

SEQ ID NO: 608009 - RNA, 19 nt, Homo sapiens
gcacuuggauuuuccuuua

SEQ ID NO: 608010 - RNA, 19 nt, Homo sapiens
ggagggaggugguguguuc

SEQ ID NO: 608011 - RNA, 19 nt, Homo sapiens
caacggcuguguucuggua

SEQ ID NO: 608012 - RNA, 19 nt, Homo sapiens
ggaggagacucuggccuua

SEQ ID NO: 608013 - RNA, 19 nt, Homo sapiens
ugaaagucauugaagcuua

SEQ ID NO: 608014 - RNA, 19 nt, Homo sapiens
gcagaccagugagaaguua

SEQ ID NO: 608015 - RNA, 19 nt, Homo sapiens
uaaaugguguucccuuuga

SEQ ID NO: 608016 - RNA, 19 nt, Homo sapiens
agagacacauggaggauua

SEQ ID NO: 608017 - RNA, 19 nt, Homo sapiens
gaaguuaaguucagcaaac

SEQ ID NO: 608018 - RNA, 19 nt, Homo sapiens
guaguaagagcaaaguuua

SEQ ID NO: 608019 - RNA, 19 nt, Homo sapiens
gaaacuccauuuacagcaa

SEQ ID NO: 608020 - RNA, 19 nt, Homo sapiens
gaagagccauggacacauc

SEQ ID NO: 608021 - RNA, 19 nt, Homo sapiens
gguguucccuuugaaauaa

SEQ ID NO: 608022 - RNA, 19 nt, Homo sapiens
ggagagaugagaagaauau

SEQ ID NO: 608023 - RNA, 19 nt, Homo sapiens
aaacgaaggucacgucugu

SEQ ID NO: 608024 - RNA, 19 nt, Homo sapiens
gcaaugaaguguuuguuuu

SEQ ID NO: 608025 - RNA, 19 nt, Homo sapiens
gaucacugcagaagaauaa

SEQ ID NO: 608026 - RNA, 19 nt, Homo sapiens
agacugugcuuucaacgua

SEQ ID NO: 608027 - RNA, 19 nt, Homo sapiens
gaauugcagugauuucugu

SEQ ID NO: 608028 - RNA, 19 nt, Homo sapiens
uguagcaacuguuugauuu

SEQ ID NO: 608029 - RNA, 19 nt, Homo sapiens
uagcaacaaucaacuggua

SEQ ID NO: 608030 - RNA, 19 nt, Homo sapiens
gaaaggaugaagagucuga

SEQ ID NO: 608031 - RNA, 19 nt, Homo sapiens
ggcaguagcacguuguuua

SEQ ID NO: 608032 - RNA, 19 nt, Homo sapiens
aaaguuggguggcuucauu

SEQ ID NO: 608033 - RNA, 19 nt, Homo sapiens
gagaugagaagaauauaug

SEQ ID NO: 608034 - RNA, 19 nt, Homo sapiens
gaaagucauugaagcuuac

SEQ ID NO: 608035 - RNA, 19 nt, Homo sapiens
ggaugaagagucugaacua

SEQ ID NO: 608036 - RNA, 19 nt, Homo sapiens
ucucuacacuaacaguuua

SEQ ID NO: 608037 - RNA, 19 nt, Homo sapiens
gcacauagcaagccuguac

SEQ ID NO: 608038 - RNA, 19 nt, Homo sapiens
ggaagacucugacuaugac

SEQ ID NO: 608039 - RNA, 19 nt, Homo sapiens
gcacagcugcuuuggaaga

SEQ ID NO: 608040 - RNA, 19 nt, Homo sapiens
ucaugcgccuggauaaaua

SEQ ID NO: 608041 - RNA, 19 nt, Homo sapiens
ggacgagcuuuccuucuca

SEQ ID NO: 608042 - RNA, 19 nt, Homo sapiens
ggauguauaucugaauguu

SEQ ID NO: 608043 - RNA, 19 nt, Homo sapiens
ucacaccauuggaagauuu

SEQ ID NO: 608044 - RNA, 19 nt, Homo sapiens
gcacguuguuuagaaaguu

SEQ ID NO: 608045 - RNA, 19 nt, Homo sapiens
gagcaugauugagcggaua

SEQ ID NO: 608046 - RNA, 19 nt, Homo sapiens
aaaacaagaugccauagua

SEQ ID NO: 608047 - RNA, 19 nt, Homo sapiens
aaacacaguugcugcacuu

SEQ ID NO: 608048 - RNA, 19 nt, Homo sapiens
gggcagcuguuaauuccaa

SEQ ID NO: 608049 - RNA, 19 nt, Homo sapiens
guagcacguuguuuagaaa

SEQ ID NO: 608050 - RNA, 19 nt, Homo sapiens
gcauucaguuguagcauca

SEQ ID NO: 608051 - RNA, 19 nt, Homo sapiens
cccgaaagcugaagcauuc

SEQ ID NO: 608052 - RNA, 19 nt, Homo sapiens
gcucugugcucuucugugu

SEQ ID NO: 608053 - RNA, 19 nt, Homo sapiens
ccugauauuucccauugua

SEQ ID NO: 608054 - RNA, 19 nt, Homo sapiens
caagaugccauaguaaauu

SEQ ID NO: 608055 - RNA, 19 nt, Homo sapiens
acaaggaggaucuuaguaa

SEQ ID NO: 608056 - RNA, 19 nt, Homo sapiens
gguaguaagagcaaaguuu

SEQ ID NO: 608057 - RNA, 19 nt, Homo sapiens
ucaauuggauguauaucug

SEQ ID NO: 608058 - RNA, 19 nt, Homo sapiens
gaaauaacgcuugccacaa

SEQ ID NO: 608059 - RNA, 19 nt, Homo sapiens
ccuaaaugguguucccuuu

SEQ ID NO: 608060 - RNA, 19 nt, Homo sapiens
gauaauagcaacaaucaac

SEQ ID NO: 608061 - RNA, 19 nt, Homo sapiens
gugaucugguuaagaagua

SEQ ID NO: 608062 - RNA, 19 nt, Homo sapiens
ggagaaauaagauaacuac

SEQ ID NO: 608063 - RNA, 19 nt, Homo sapiens
auacuuauguugucuggaa

SEQ ID NO: 608064 - RNA, 19 nt, Homo sapiens
cuaaugcacuucugagcuu

SEQ ID NO: 608065 - RNA, 19 nt, Homo sapiens
gaaaccagcuucagaaaac

SEQ ID NO: 608066 - RNA, 19 nt, Homo sapiens
caccagaacuaaugcacuu

SEQ ID NO: 608067 - RNA, 19 nt, Homo sapiens
gaaauaucagggagcauga

SEQ ID NO: 608068 - RNA, 19 nt, Homo sapiens
ggaacacagugaggaguug

SEQ ID NO: 608069 - RNA, 19 nt, Homo sapiens
gcccgaagcucagcagaga

SEQ ID NO: 608070 - RNA, 19 nt, Homo sapiens
aaugggaaaucuagaagaa

SEQ ID NO: 608071 - RNA, 19 nt, Homo sapiens
guuuggacaugaccgauaa

SEQ ID NO: 608072 - RNA, 19 nt, Homo sapiens
gauauucuauacaccaaag

SEQ ID NO: 608073 - RNA, 19 nt, Homo sapiens
agugaacucugaugcagua

SEQ ID NO: 608074 - RNA, 19 nt, Homo sapiens
uuaacaagguccucaguuc

SEQ ID NO: 608075 - RNA, 19 nt, Homo sapiens
aagaauauaugcagcaaag

SEQ ID NO: 608076 - RNA, 19 nt, Homo sapiens
ccauaaagccucauucagu

SEQ ID NO: 608077 - RNA, 19 nt, Homo sapiens
uuugugaucugguuaagaa

SEQ ID NO: 608078 - RNA, 19 nt, Homo sapiens
gaacugcucacaccauugg

SEQ ID NO: 608079 - RNA, 19 nt, Homo sapiens
cauggacacaucauuauuu

SEQ ID NO: 608080 - RNA, 19 nt, Homo sapiens
ggacuguaguagaggcauu

SEQ ID NO: 608081 - RNA, 19 nt, Homo sapiens
ucaaguaguuguggagaga

SEQ ID NO: 608082 - RNA, 19 nt, Homo sapiens
uaaaguaacagcagacauc

SEQ ID NO: 608083 - RNA, 19 nt, Homo sapiens
ugagaguguuccugauauu

SEQ ID NO: 608084 - RNA, 19 nt, Homo sapiens
ggcaaacacucaauucaac

SEQ ID NO: 608085 - RNA, 19 nt, Homo sapiens
ggaguucgcgucccggaaa

SEQ ID NO: 608086 - RNA, 19 nt, Homo sapiens
gaaugacaaucacaaagcu

SEQ ID NO: 608087 - RNA, 19 nt, Homo sapiens
gaugaguggcuuuaucuau

SEQ ID NO: 608088 - RNA, 19 nt, Homo sapiens
guucagcaaacauuucaua

SEQ ID NO: 608089 - RNA, 19 nt, Homo sapiens
gaugaagagucugaacuag

SEQ ID NO: 608090 - RNA, 19 nt, Homo sapiens
gggccauuguuucuacuuu

SEQ ID NO: 608091 - RNA, 19 nt, Homo sapiens
gagcuuugcugucauuuaa

SEQ ID NO: 608092 - RNA, 19 nt, Homo sapiens
ggaaagagccuggguguuu

SEQ ID NO: 608093 - RNA, 19 nt, Homo sapiens
gaacgagaauauagacauu

SEQ ID NO: 608094 - RNA, 19 nt, Homo sapiens
ugaauucccuuugacauua

SEQ ID NO: 608095 - RNA, 19 nt, Homo sapiens
gaccagcaauucagcaaua

SEQ ID NO: 608096 - RNA, 19 nt, Homo sapiens
gcaauaacuuaccugcuaa

SEQ ID NO: 608097 - RNA, 19 nt, Homo sapiens
gcaauucagcaauaacuua

SEQ ID NO: 608098 - RNA, 19 nt, Homo sapiens
gcagggugcucgaaucauu

SEQ ID NO: 608099 - RNA, 19 nt, Homo sapiens
gaaagagccuggguguuug

SEQ ID NO: 608100 - RNA, 19 nt, Homo sapiens
gaggaugccuugaaucuca

SEQ ID NO: 608101 - RNA, 19 nt, Homo sapiens
gacaggaagugguauuuau

SEQ ID NO: 608102 - RNA, 19 nt, Homo sapiens
ucacucagcuucugcauca

SEQ ID NO: 608103 - RNA, 19 nt, Homo sapiens
gaucauagcuuugcaaaau

SEQ ID NO: 608104 - RNA, 19 nt, Homo sapiens
caucaugucagccuaaaua

SEQ ID NO: 608105 - RNA, 19 nt, Homo sapiens
gaauucccuuugacauuaa

SEQ ID NO: 608106 - RNA, 19 nt, Homo sapiens
caucaaaccauuuccagua

SEQ ID NO: 608107 - RNA, 19 nt, Homo sapiens
caaauggucccaaagugua

SEQ ID NO: 608108 - RNA, 19 nt, Homo sapiens
gaaacugcuucuacaagau

SEQ ID NO: 608109 - RNA, 19 nt, Homo sapiens
cuacuaauuugacaacuug

SEQ ID NO: 608110 - RNA, 19 nt, Homo sapiens
gucccaaaguguaucauua

SEQ ID NO: 608111 - RNA, 19 nt, Homo sapiens
gcaaugggaaugggaguua

SEQ ID NO: 608112 - RNA, 19 nt, Homo sapiens
gaagagaauaguaaugaug

SEQ ID NO: 608113 - RNA, 19 nt, Homo sapiens
gaaagaugggcguuuggua

SEQ ID NO: 608114 - RNA, 19 nt, Homo sapiens
caugucagccuaaauauga

SEQ ID NO: 608115 - RNA, 19 nt, Homo sapiens
ccuaauggcuacuuucaau

SEQ ID NO: 608116 - RNA, 19 nt, Homo sapiens
gaagggcuauuucaguagu

SEQ ID NO: 608117 - RNA, 19 nt, Homo sapiens
ccacagauuuggucacaca

SEQ ID NO: 608118 - RNA, 19 nt, Homo sapiens
gaauaguaaugaugggaau

SEQ ID NO: 608119 - RNA, 19 nt, Homo sapiens
aaacaagaauggaucaucu

SEQ ID NO: 608120 - RNA, 19 nt, Homo sapiens
ggaaugggaguuaaucuuc

SEQ ID NO: 608121 - RNA, 19 nt, Homo sapiens
gaagaugcacuuuauggau

SEQ ID NO: 608122 - RNA, 19 nt, Homo sapiens
gaccagugaguccuaaaua

SEQ ID NO: 608123 - RNA, 19 nt, Homo sapiens
gcugaaagaugggcguuug

SEQ ID NO: 608124 - RNA, 19 nt, Homo sapiens
gaaugaaguauacguucua

SEQ ID NO: 608125 - RNA, 19 nt, Homo sapiens
ggaauuuagagguuuauga

SEQ ID NO: 608126 - RNA, 19 nt, Homo sapiens
gcugugcccuugaagagaa

SEQ ID NO: 608127 - RNA, 19 nt, Homo sapiens
gaaaaugcaggaaaccuua

SEQ ID NO: 608128 - RNA, 19 nt, Homo sapiens
ucacgugcuuugauauauu

SEQ ID NO: 608129 - RNA, 19 nt, Homo sapiens
gaugggaauuuagagguuu

SEQ ID NO: 608130 - RNA, 19 nt, Homo sapiens
gcaggaaaccuuacagucu

SEQ ID NO: 608131 - RNA, 19 nt, Homo sapiens
guaaugaugggaauuuaga

SEQ ID NO: 608132 - RNA, 19 nt, Homo sapiens
uggcuacucugaaauguug

SEQ ID NO: 608133 - RNA, 19 nt, Homo sapiens
guuauagggcgucucuuua

SEQ ID NO: 608134 - RNA, 19 nt, Homo sapiens
aaagaugggcguuugguaa

SEQ ID NO: 608135 - RNA, 19 nt, Homo sapiens
ccagugaguccuaaauauu

SEQ ID NO: 608136 - RNA, 19 nt, Homo sapiens
ccacauguccuccuaaugg

SEQ ID NO: 608137 - RNA, 19 nt, Homo sapiens
cagugaguccuaaauauuu

SEQ ID NO: 608138 - RNA, 19 nt, Homo sapiens
uuacauggccgaaggagaa

SEQ ID NO: 608139 - RNA, 19 nt, Homo sapiens
agaagagaaugaaguauac

SEQ ID NO: 608140 - RNA, 19 nt, Homo sapiens
ggagcuuugcugucauuua

SEQ ID NO: 608141 - RNA, 19 nt, Homo sapiens
gaaugggaguuaaucuucu

SEQ ID NO: 608142 - RNA, 19 nt, Homo sapiens
uccagaagaugcacuuuau

SEQ ID NO: 608143 - RNA, 19 nt, Homo sapiens
aauuugaggugcugaaaga

SEQ ID NO: 608144 - RNA, 19 nt, Homo sapiens
ugaaguauacguucuagga

SEQ ID NO: 608145 - RNA, 19 nt, Homo sapiens
ugaacuggauuccguguca

SEQ ID NO: 608146 - RNA, 19 nt, Homo sapiens
ucaggaggaugccuugaau

SEQ ID NO: 608147 - RNA, 19 nt, Homo sapiens
ccaccaccaucaaaccauu

SEQ ID NO: 608148 - RNA, 19 nt, Homo sapiens
caaggacaacucuaucuau

SEQ ID NO: 608149 - RNA, 19 nt, Homo sapiens
ugacaggaagugguauuua

SEQ ID NO: 608150 - RNA, 19 nt, Homo sapiens
uuugacagcuauugaauuc

SEQ ID NO: 608151 - RNA, 19 nt, Homo sapiens
gcuccagccucauuugcuu

SEQ ID NO: 608152 - RNA, 19 nt, Homo sapiens
gcacauuuggaacagagua

SEQ ID NO: 608153 - RNA, 19 nt, Homo sapiens
ccaaggacaacucuaucua

SEQ ID NO: 608154 - RNA, 19 nt, Homo sapiens
aaggacaacucuaucuaug

SEQ ID NO: 608155 - RNA, 19 nt, Homo sapiens
gaacuggauuccgugucaa

SEQ ID NO: 608156 - RNA, 19 nt, Homo sapiens
gaaauguugcaguguggaa

SEQ ID NO: 608157 - RNA, 19 nt, Homo sapiens
uuucagagguggauucaca

SEQ ID NO: 608158 - RNA, 19 nt, Homo sapiens
ccaaauggucccaaagugu

SEQ ID NO: 608159 - RNA, 19 nt, Homo sapiens
caaugggaaugggaguuaa

SEQ ID NO: 608160 - RNA, 19 nt, Homo sapiens
guguuacccuggugaaaga

SEQ ID NO: 608161 - RNA, 19 nt, Homo sapiens
guaugggagugaggaguuu

SEQ ID NO: 608162 - RNA, 19 nt, Homo sapiens
ugacagcuauugaauucca

SEQ ID NO: 608163 - RNA, 19 nt, Homo sapiens
ucaauacaauaccaaugug

SEQ ID NO: 608164 - RNA, 19 nt, Homo sapiens
gcuugagacuuugugugua

SEQ ID NO: 608165 - RNA, 19 nt, Homo sapiens
uuuaucggcuucccaaguu

SEQ ID NO: 608166 - RNA, 19 nt, Homo sapiens
agagguuuaugacugaauu

SEQ ID NO: 608167 - RNA, 19 nt, Homo sapiens
gaauuuagagguuuaugac

SEQ ID NO: 608168 - RNA, 19 nt, Homo sapiens
uggaucaucugggccuaua

SEQ ID NO: 608169 - RNA, 19 nt, Homo sapiens
aaacugcuucuacaagauu

SEQ ID NO: 608170 - RNA, 19 nt, Homo sapiens
gugcuuugauauauucuuc

SEQ ID NO: 608171 - RNA, 19 nt, Homo sapiens
ucuaugucuuggcaaauuu

SEQ ID NO: 608172 - RNA, 19 nt, Homo sapiens
ccuugaaucucaugaacga

SEQ ID NO: 608173 - RNA, 19 nt, Homo sapiens
cauugugacuccagaagau

SEQ ID NO: 608174 - RNA, 19 nt, Homo sapiens
uuuagagguuuaugacuga

SEQ ID NO: 608175 - RNA, 19 nt, Homo sapiens
ugaugggaauuuagagguu

SEQ ID NO: 608176 - RNA, 19 nt, Homo sapiens
cuugagacuuuguguguau

SEQ ID NO: 608177 - RNA, 19 nt, Homo sapiens
guacacaaaggacucacuu

SEQ ID NO: 608178 - RNA, 19 nt, Homo sapiens
gggaguuaaucuucuugug

SEQ ID NO: 608179 - RNA, 19 nt, Homo sapiens
gggaaugggaguuaaucuu

SEQ ID NO: 608180 - RNA, 19 nt, Homo sapiens
cagggccauugcaaacaua

SEQ ID NO: 608181 - RNA, 19 nt, Homo sapiens
uuuggaagguuuggcauuu

SEQ ID NO: 608182 - RNA, 19 nt, Homo sapiens
uaccgaaauucaucuguca

SEQ ID NO: 608183 - RNA, 19 nt, Homo sapiens
cagaagaugcacuuuaugg

SEQ ID NO: 608184 - RNA, 19 nt, Homo sapiens
agccggaguuggugacuuu

SEQ ID NO: 608185 - RNA, 19 nt, Homo sapiens
uagcugcaguguaugaaca

SEQ ID NO: 608186 - RNA, 19 nt, Homo sapiens
aaacuuugaagggcuauuu

SEQ ID NO: 608187 - RNA, 19 nt, Homo sapiens
uauagggcgucucuuuauc

SEQ ID NO: 608188 - RNA, 19 nt, Homo sapiens
auuaugacaugaagacaga

SEQ ID NO: 608189 - RNA, 19 nt, Homo sapiens
cagcuuggaugaacguuuu

SEQ ID NO: 608190 - RNA, 19 nt, Homo sapiens
uuacccuggugaaagauuu

SEQ ID NO: 608191 - RNA, 19 nt, Homo sapiens
gagcuuugcugucauuuaa

SEQ ID NO: 608192 - RNA, 19 nt, Homo sapiens
ggaaagagccuggguguuu

SEQ ID NO: 608193 - RNA, 19 nt, Homo sapiens
gaacgagaauauagacauu

SEQ ID NO: 608194 - RNA, 19 nt, Homo sapiens
ugaauucccuuugacauua

SEQ ID NO: 608195 - RNA, 19 nt, Homo sapiens
gaccagcaauucagcaaua

SEQ ID NO: 608196 - RNA, 19 nt, Homo sapiens
gcaauaacuuaccugcuaa

SEQ ID NO: 608197 - RNA, 19 nt, Homo sapiens
gcaauucagcaauaacuua

SEQ ID NO: 608198 - RNA, 19 nt, Homo sapiens
gcagggugcucgaaucauu

SEQ ID NO: 608199 - RNA, 19 nt, Homo sapiens
gaaagagccuggguguuug

SEQ ID NO: 608200 - RNA, 19 nt, Homo sapiens
gaggaugccuugaaucuca

SEQ ID NO: 608201 - RNA, 19 nt, Homo sapiens
gacaggaagugguauuuau

SEQ ID NO: 608202 - RNA, 19 nt, Homo sapiens
ucacucagcuucugcauca

SEQ ID NO: 608203 - RNA, 19 nt, Homo sapiens
gaucauagcuuugcaaaau

SEQ ID NO: 608204 - RNA, 19 nt, Homo sapiens
caucaugucagccuaaaua

SEQ ID NO: 608205 - RNA, 19 nt, Homo sapiens
gaauucccuuugacauuaa

SEQ ID NO: 608206 - RNA, 19 nt, Homo sapiens
caucaaaccauuuccagua

SEQ ID NO: 608207 - RNA, 19 nt, Homo sapiens
caaauggucccaaagugua

SEQ ID NO: 608208 - RNA, 19 nt, Homo sapiens
gaaacugcuucuacaagau

SEQ ID NO: 608209 - RNA, 19 nt, Homo sapiens
cuacuaauuugacaacuug

SEQ ID NO: 608210 - RNA, 19 nt, Homo sapiens
gucccaaaguguaucauua

SEQ ID NO: 608211 - RNA, 19 nt, Homo sapiens
gcaaugggaaugggaguua

SEQ ID NO: 608212 - RNA, 19 nt, Homo sapiens
gaagagaauaguaaugaug

SEQ ID NO: 608213 - RNA, 19 nt, Homo sapiens
gaaagaugggcguuuggua

SEQ ID NO: 608214 - RNA, 19 nt, Homo sapiens
caugucagccuaaauauga

SEQ ID NO: 608215 - RNA, 19 nt, Homo sapiens
ccuaauggcuacuuucaau

SEQ ID NO: 608216 - RNA, 19 nt, Homo sapiens
gaagggcuauuucaguagu

SEQ ID NO: 608217 - RNA, 19 nt, Homo sapiens
ccacagauuuggucacaca

SEQ ID NO: 608218 - RNA, 19 nt, Homo sapiens
gaauaguaaugaugggaau

SEQ ID NO: 608219 - RNA, 19 nt, Homo sapiens
aaacaagaauggaucaucu

SEQ ID NO: 608220 - RNA, 19 nt, Homo sapiens
ggaaugggaguuaaucuuc

SEQ ID NO: 608221 - RNA, 19 nt, Homo sapiens
gaagaugcacuuuauggau

SEQ ID NO: 608222 - RNA, 19 nt, Homo sapiens
gaccagugaguccuaaaua

SEQ ID NO: 608223 - RNA, 19 nt, Homo sapiens
gcugaaagaugggcguuug

SEQ ID NO: 608224 - RNA, 19 nt, Homo sapiens
gaaugaaguauacguucua

SEQ ID NO: 608225 - RNA, 19 nt, Homo sapiens
ggaauuuagagguuuauga

SEQ ID NO: 608226 - RNA, 19 nt, Homo sapiens
gcugugcccuugaagagaa

SEQ ID NO: 608227 - RNA, 19 nt, Homo sapiens
gaaaaugcaggaaaccuua

SEQ ID NO: 608228 - RNA, 19 nt, Homo sapiens
ucacgugcuuugauauauu

SEQ ID NO: 608229 - RNA, 19 nt, Homo sapiens
gaugggaauuuagagguuu

SEQ ID NO: 608230 - RNA, 19 nt, Homo sapiens
gcaggaaaccuuacagucu

SEQ ID NO: 608231 - RNA, 19 nt, Homo sapiens
guaaugaugggaauuuaga

SEQ ID NO: 608232 - RNA, 19 nt, Homo sapiens
uggcuacucugaaauguug

SEQ ID NO: 608233 - RNA, 19 nt, Homo sapiens
guuauagggcgucucuuua

SEQ ID NO: 608234 - RNA, 19 nt, Homo sapiens
aaagaugggcguuugguaa

SEQ ID NO: 608235 - RNA, 19 nt, Homo sapiens
ccagugaguccuaaauauu

SEQ ID NO: 608236 - RNA, 19 nt, Homo sapiens
ccacauguccuccuaaugg

SEQ ID NO: 608237 - RNA, 19 nt, Homo sapiens
gaaaggaaagcagcugaga

SEQ ID NO: 608238 - RNA, 19 nt, Homo sapiens
cagugaguccuaaauauuu

SEQ ID NO: 608239 - RNA, 19 nt, Homo sapiens
uuacauggccgaaggagaa

SEQ ID NO: 608240 - RNA, 19 nt, Homo sapiens
agaagagaaugaaguauac

SEQ ID NO: 608241 - RNA, 19 nt, Homo sapiens
ggagcuuugcugucauuua

SEQ ID NO: 608242 - RNA, 19 nt, Homo sapiens
gaaugggaguuaaucuucu

SEQ ID NO: 608243 - RNA, 19 nt, Homo sapiens
uccagaagaugcacuuuau

SEQ ID NO: 608244 - RNA, 19 nt, Homo sapiens
aauuugaggugcugaaaga

SEQ ID NO: 608245 - RNA, 19 nt, Homo sapiens
ugaaguauacguucuagga

SEQ ID NO: 608246 - RNA, 19 nt, Homo sapiens
ugaacuggauuccguguca

SEQ ID NO: 608247 - RNA, 19 nt, Homo sapiens
ccaccaccaucaaaccauu

SEQ ID NO: 608248 - RNA, 19 nt, Homo sapiens
ucaggaggaugccuugaau

SEQ ID NO: 608249 - RNA, 19 nt, Homo sapiens
caaggacaacucuaucuau

SEQ ID NO: 608250 - RNA, 19 nt, Homo sapiens
ugacaggaagugguauuua

SEQ ID NO: 608251 - RNA, 19 nt, Homo sapiens
uuugacagcuauugaauuc

SEQ ID NO: 608252 - RNA, 19 nt, Homo sapiens
gcuccagccucauuugcuu

SEQ ID NO: 608253 - RNA, 19 nt, Homo sapiens
gcacauuuggaacagagua

SEQ ID NO: 608254 - RNA, 19 nt, Homo sapiens
ccaaggacaacucuaucua

SEQ ID NO: 608255 - RNA, 19 nt, Homo sapiens
gagcacaggccuuggaaag

SEQ ID NO: 608256 - RNA, 19 nt, Homo sapiens
aaggacaacucuaucuaug

SEQ ID NO: 608257 - RNA, 19 nt, Homo sapiens
gaacuggauuccgugucaa

SEQ ID NO: 608258 - RNA, 19 nt, Homo sapiens
gaaauguugcaguguggaa

SEQ ID NO: 608259 - RNA, 19 nt, Homo sapiens
uuucagagguggauucaca

SEQ ID NO: 608260 - RNA, 19 nt, Homo sapiens
ccaaauggucccaaagugu

SEQ ID NO: 608261 - RNA, 19 nt, Homo sapiens
caaugggaaugggaguuaa

SEQ ID NO: 608262 - RNA, 19 nt, Homo sapiens
guguuacccuggugaaaga

SEQ ID NO: 608263 - RNA, 19 nt, Homo sapiens
guaugggagugaggaguuu

SEQ ID NO: 608264 - RNA, 19 nt, Homo sapiens
ugacagcuauugaauucca

SEQ ID NO: 608265 - RNA, 19 nt, Homo sapiens
ucaauacaauaccaaugug

SEQ ID NO: 608266 - RNA, 19 nt, Homo sapiens
gcuugagacuuugugugua

SEQ ID NO: 608267 - RNA, 19 nt, Homo sapiens
uuuaucggcuucccaaguu

SEQ ID NO: 608268 - RNA, 19 nt, Homo sapiens
agagguuuaugacugaauu

SEQ ID NO: 608269 - RNA, 19 nt, Homo sapiens
gaauuuagagguuuaugac

SEQ ID NO: 608270 - RNA, 19 nt, Homo sapiens
cauugugacuccagaagau

SEQ ID NO: 608271 - RNA, 19 nt, Homo sapiens
uggaucaucugggccuaua

SEQ ID NO: 608272 - RNA, 19 nt, Homo sapiens
aaacugcuucuacaagauu

SEQ ID NO: 608273 - RNA, 19 nt, Homo sapiens
gugcuuugauauauucuuc

SEQ ID NO: 608274 - RNA, 19 nt, Homo sapiens
ucuaugucuuggcaaauuu

SEQ ID NO: 608275 - RNA, 19 nt, Homo sapiens
ccuugaaucucaugaacga

SEQ ID NO: 608276 - RNA, 19 nt, Homo sapiens
uuuagagguuuaugacuga

SEQ ID NO: 608277 - RNA, 19 nt, Homo sapiens
ugaugggaauuuagagguu

SEQ ID NO: 608278 - RNA, 19 nt, Homo sapiens
cuugagacuuuguguguau

SEQ ID NO: 608279 - RNA, 19 nt, Homo sapiens
guacacaaaggacucacuu

SEQ ID NO: 608280 - RNA, 19 nt, Homo sapiens
gggaguuaaucuucuugug

SEQ ID NO: 608281 - RNA, 19 nt, Homo sapiens
gggaaugggaguuaaucuu

SEQ ID NO: 608282 - RNA, 19 nt, Homo sapiens
cagggccauugcaaacaua

SEQ ID NO: 608283 - RNA, 19 nt, Homo sapiens
uuuggaagguuuggcauuu

SEQ ID NO: 608284 - RNA, 19 nt, Homo sapiens
ggaaagcagcugagaucca

SEQ ID NO: 608285 - RNA, 19 nt, Homo sapiens
uaccgaaauucaucuguca

SEQ ID NO: 608286 - RNA, 19 nt, Homo sapiens
cagaagaugcacuuuaugg

SEQ ID NO: 608287 - RNA, 19 nt, Homo sapiens
agccggaguuggugacuuu

SEQ ID NO: 608288 - RNA, 19 nt, Homo sapiens
aaacuuugaagggcuauuu

SEQ ID NO: 608289 - RNA, 19 nt, Homo sapiens
uauagggcgucucuuuauc

SEQ ID NO: 608290 - RNA, 19 nt, Homo sapiens
ucagcugccuggccaagga

SEQ ID NO: 608291 - RNA, 19 nt, Homo sapiens
gauagacccuaauucaaua

SEQ ID NO: 608292 - RNA, 19 nt, Homo sapiens
gcaauucucuguauucuca

SEQ ID NO: 608293 - RNA, 19 nt, Homo sapiens
gaaagcccauaauguauuu

SEQ ID NO: 608294 - RNA, 19 nt, Homo sapiens
uaagaaagcccauaaugua

SEQ ID NO: 608295 - RNA, 19 nt, Homo sapiens
gcacaagcaagaauaauaa

SEQ ID NO: 608296 - RNA, 19 nt, Homo sapiens
gauggacaauuacauagua

SEQ ID NO: 608297 - RNA, 19 nt, Homo sapiens
ccaaugacuuuguuuguuu

SEQ ID NO: 608298 - RNA, 19 nt, Homo sapiens
gaucucugcugucauuuaa

SEQ ID NO: 608299 - RNA, 19 nt, Homo sapiens
caaaauaucucccaacuga

SEQ ID NO: 608300 - RNA, 19 nt, Homo sapiens
gugauaggcuugaauuauu

SEQ ID NO: 608301 - RNA, 19 nt, Homo sapiens
gaacauaccaaaugaagug

SEQ ID NO: 608302 - RNA, 19 nt, Homo sapiens
gcaggaaauuauacaguuu

SEQ ID NO: 608303 - RNA, 19 nt, Homo sapiens
gauagacucugagcacuaa

SEQ ID NO: 608304 - RNA, 19 nt, Homo sapiens
gcacaaagggagaccauaa

SEQ ID NO: 608305 - RNA, 19 nt, Homo sapiens
ggacaacucuuuacaagcu

SEQ ID NO: 608306 - RNA, 19 nt, Homo sapiens
aaagaucucugcugucauu

SEQ ID NO: 608307 - RNA, 19 nt, Homo sapiens
caacaucauuuaagccaaa

SEQ ID NO: 608308 - RNA, 19 nt, Homo sapiens
gcugauggauugauaguga

SEQ ID NO: 608309 - RNA, 19 nt, Homo sapiens
gaaugugacuguauuugga

SEQ ID NO: 608310 - RNA, 19 nt, Homo sapiens
gaucagggugcgcauauua

SEQ ID NO: 608311 - RNA, 19 nt, Homo sapiens
gaaacaacaucauuuaagc

SEQ ID NO: 608312 - RNA, 19 nt, Homo sapiens
gaagggcgcuauuaucuac

SEQ ID NO: 608313 - RNA, 19 nt, Homo sapiens
gauauacucuuccaugauc

SEQ ID NO: 608314 - RNA, 19 nt, Homo sapiens
ugaggaggcuuuggcauua

SEQ ID NO: 608315 - RNA, 19 nt, Homo sapiens
gaagcgcucucaucaggaa

SEQ ID NO: 608316 - RNA, 19 nt, Homo sapiens
caacacugaugugguauuu

SEQ ID NO: 608317 - RNA, 19 nt, Homo sapiens
auacaacacugauguggua

SEQ ID NO: 608318 - RNA, 19 nt, Homo sapiens
gaugauggacaauuacaua

SEQ ID NO: 608319 - RNA, 19 nt, Homo sapiens
ggacgugagcuaauuauau

SEQ ID NO: 608320 - RNA, 19 nt, Homo sapiens
acacugaugugguauuuga

SEQ ID NO: 608321 - RNA, 19 nt, Homo sapiens
ggauagacccuaauucaau

SEQ ID NO: 608322 - RNA, 19 nt, Homo sapiens
gcuugcaccuggagaauuu

SEQ ID NO: 608323 - RNA, 19 nt, Homo sapiens
gacaggaaguggcaucuau

SEQ ID NO: 608324 - RNA, 19 nt, Homo sapiens
cuacucaguugccagcuua

SEQ ID NO: 608325 - RNA, 19 nt, Homo sapiens
cgacuaauuuaaacacuug

SEQ ID NO: 608326 - RNA, 19 nt, Homo sapiens
cagcaugacuacucaguug

SEQ ID NO: 608327 - RNA, 19 nt, Homo sapiens
gggacucucucuacccaua

SEQ ID NO: 608328 - RNA, 19 nt, Homo sapiens
gacauuaacugacauuugc

SEQ ID NO: 608329 - RNA, 19 nt, Homo sapiens
gaggaaggacaacucuuua

SEQ ID NO: 608330 - RNA, 19 nt, Homo sapiens
gacgugagcuaauuauauc

SEQ ID NO: 608331 - RNA, 19 nt, Homo sapiens
gacaagaagccaugcgaua

SEQ ID NO: 608332 - RNA, 19 nt, Homo sapiens
cagaaucucuugacauuac

SEQ ID NO: 608333 - RNA, 19 nt, Homo sapiens
ccuauuguaugcucauuaa

SEQ ID NO: 608334 - RNA, 19 nt, Homo sapiens
agaaagaucucugcuguca

SEQ ID NO: 608335 - RNA, 19 nt, Homo sapiens
ccaaggagccugagauugu

SEQ ID NO: 608336 - RNA, 19 nt, Homo sapiens
ggaaggagcgaucacauca

SEQ ID NO: 608337 - RNA, 19 nt, Homo sapiens
acacacaccagauaauaua

SEQ ID NO: 608338 - RNA, 19 nt, Homo sapiens
ucugagcacuaauaucaua

SEQ ID NO: 608339 - RNA, 19 nt, Homo sapiens
gaaggacaacucuuuacaa

SEQ ID NO: 608340 - RNA, 19 nt, Homo sapiens
gauaaugucuccccaaaau

SEQ ID NO: 608341 - RNA, 19 nt, Homo sapiens
gaaagauugguccggguua

SEQ ID NO: 608342 - RNA, 19 nt, Homo sapiens
ggaguugcaggaaauuaua

SEQ ID NO: 608343 - RNA, 19 nt, Homo sapiens
ucacaggaguugcaggaaa

SEQ ID NO: 608344 - RNA, 19 nt, Homo sapiens
ggacgcuuguuuagucuga

SEQ ID NO: 608345 - RNA, 19 nt, Homo sapiens
ucaagagcauuucauuaug

SEQ ID NO: 608346 - RNA, 19 nt, Homo sapiens
caagaacaacucuaucuau

SEQ ID NO: 608347 - RNA, 19 nt, Homo sapiens
gagaaggacugggcaucaa

SEQ ID NO: 608348 - RNA, 19 nt, Homo sapiens
ggaagggcgcuauuaucua

SEQ ID NO: 608349 - RNA, 19 nt, Homo sapiens
aagaacaacucuaucuaug

SEQ ID NO: 608350 - RNA, 19 nt, Homo sapiens
gauugcugauggauugaua

SEQ ID NO: 608351 - RNA, 19 nt, Homo sapiens
gacggacgcuuguuuaguc

SEQ ID NO: 608352 - RNA, 19 nt, Homo sapiens
aggcagcccuggcaaauga

SEQ ID NO: 608353 - RNA, 19 nt, Homo sapiens
gugaaaccauuagaucauu

SEQ ID NO: 608354 - RNA, 19 nt, Homo sapiens
aaggauugcugauggauug

SEQ ID NO: 608355 - RNA, 19 nt, Homo sapiens
ggguuaauauuauccucua

SEQ ID NO: 608356 - RNA, 19 nt, Homo sapiens
gaggaggcuuuggcauuaa

SEQ ID NO: 608357 - RNA, 19 nt, Homo sapiens
uccagaagaugcuauuuau

SEQ ID NO: 608358 - RNA, 19 nt, Homo sapiens
caggaaacaaggaauuuaa

SEQ ID NO: 608359 - RNA, 19 nt, Homo sapiens
ccacguggacaccauagua

SEQ ID NO: 608360 - RNA, 19 nt, Homo sapiens
agccugagauugugacuuu

SEQ ID NO: 608361 - RNA, 19 nt, Homo sapiens
ggacaucccagacccugaa

SEQ ID NO: 608362 - RNA, 19 nt, Homo sapiens
gaaacaaggaauuuaaagg

SEQ ID NO: 608363 - RNA, 19 nt, Homo sapiens
ccacucagcuugggcuaug

SEQ ID NO: 608364 - RNA, 19 nt, Homo sapiens
caacagggacucucucuac

SEQ ID NO: 608365 - RNA, 19 nt, Homo sapiens
agcagaaucucuugacauu

SEQ ID NO: 608366 - RNA, 19 nt, Homo sapiens
gaaaccauuagaucauuga

SEQ ID NO: 608367 - RNA, 19 nt, Homo sapiens
guacccuguugaaauguaa

SEQ ID NO: 608368 - RNA, 19 nt, Homo sapiens
ucaauuuccuugcauccaa

SEQ ID NO: 608369 - RNA, 19 nt, Homo sapiens
cagaagaugcuauuuaugg

SEQ ID NO: 608370 - RNA, 19 nt, Homo sapiens
ggugauaggcuugaauuau

SEQ ID NO: 608371 - RNA, 19 nt, Homo sapiens
gagcaauucucuguauucu

SEQ ID NO: 608372 - RNA, 19 nt, Homo sapiens
gcagaaucucuugacauua

SEQ ID NO: 608373 - RNA, 19 nt, Homo sapiens
caaagacccauuccuguuc

SEQ ID NO: 608374 - RNA, 19 nt, Homo sapiens
ggaaggacaacucuuuaca

SEQ ID NO: 608375 - RNA, 19 nt, Homo sapiens
acacacacaccagauaaua

SEQ ID NO: 608376 - RNA, 19 nt, Homo sapiens
cugagaacauaccaaauga

SEQ ID NO: 608377 - RNA, 19 nt, Homo sapiens
ggaaacaaggaauuuaaag

SEQ ID NO: 608378 - RNA, 19 nt, Homo sapiens
uuaccuuggugaaagauuu

SEQ ID NO: 608379 - RNA, 19 nt, Homo sapiens
ccaagaacaacucuaucua

SEQ ID NO: 608380 - RNA, 19 nt, Homo sapiens
caaugacuuuguuuguuug

SEQ ID NO: 608381 - RNA, 19 nt, Homo sapiens
gagaacauaccaaaugaag

SEQ ID NO: 608382 - RNA, 19 nt, Homo sapiens
gaaucggaaucuggacauu

SEQ ID NO: 608383 - RNA, 19 nt, Homo sapiens
ucaaagacccauuccuguu

SEQ ID NO: 608384 - RNA, 19 nt, Homo sapiens
ccacauuugucagcuguug

SEQ ID NO: 608385 - RNA, 19 nt, Homo sapiens
ugaaaccauuagaucauug

SEQ ID NO: 608386 - RNA, 19 nt, Homo sapiens
ccaggacacuuucauugca

SEQ ID NO: 608387 - RNA, 19 nt, Homo sapiens
aaagauugguccggguuaa

SEQ ID NO: 608388 - RNA, 19 nt, Homo sapiens
uauagaagcgcucucauca

SEQ ID NO: 608389 - RNA, 19 nt, Homo sapiens
uuugucagcuguugaauuc

SEQ ID NO: 608390 - RNA, 19 nt, Homo sapiens
agcauuguguguucuauuu

SEQ ID NO: 608391 - RNA, 19 nt, Homo sapiens
ggacguggccucuuugguu

SEQ ID NO: 608392 - RNA, 19 nt, Homo sapiens
gggcccagcugccuaugua

SEQ ID NO: 608393 - RNA, 19 nt, Homo sapiens
cagcuuccuugaaccauua

SEQ ID NO: 608394 - RNA, 19 nt, Homo sapiens
cgaaccaaauccaaauaaa

SEQ ID NO: 608395 - RNA, 19 nt, Homo sapiens
gacguggccucuuugguuu

SEQ ID NO: 608396 - RNA, 19 nt, Homo sapiens
gaaccauuaugcuggcuau

SEQ ID NO: 608397 - RNA, 19 nt, Homo sapiens
gaaccaaauccaaauaaag

SEQ ID NO: 608398 - RNA, 19 nt, Homo sapiens
gugagaagguggaggcuau

SEQ ID NO: 608399 - RNA, 19 nt, Homo sapiens
uguaaggccuucuaguuug

SEQ ID NO: 608400 - RNA, 19 nt, Homo sapiens
gagaagggcaggcauaugg

SEQ ID NO: 608401 - RNA, 19 nt, Homo sapiens
gcagcuuccuugaaccauu

SEQ ID NO: 608402 - RNA, 19 nt, Homo sapiens
guaaggccuucuaguuugu

SEQ ID NO: 608403 - RNA, 19 nt, Homo sapiens
ggacaggccagaaugaagu

SEQ ID NO: 608404 - RNA, 19 nt, Homo sapiens
cgacgaggacuuugugcua

SEQ ID NO: 608405 - RNA, 19 nt, Homo sapiens
gccagaagagcccuuauga

SEQ ID NO: 608406 - RNA, 19 nt, Homo sapiens
gcuaugagcaggucaccaa

SEQ ID NO: 608407 - RNA, 19 nt, Homo sapiens
gauggggaauugaugguua

SEQ ID NO: 608408 - RNA, 19 nt, Homo sapiens
ccaugaaccugcugucucu

SEQ ID NO: 608409 - RNA, 19 nt, Homo sapiens
ccaaauccaaauaaaguga

SEQ ID NO: 608410 - RNA, 19 nt, Homo sapiens
uauguaaggccuucuaguu

SEQ ID NO: 608411 - RNA, 19 nt, Homo sapiens
gaagguggaggcuaugcuu

SEQ ID NO: 608412 - RNA, 19 nt, Homo sapiens
gcugcgaaguugagcgaaa

SEQ ID NO: 608413 - RNA, 19 nt, Homo sapiens
gaaguugagcgaaaaguuu

SEQ ID NO: 608414 - RNA, 19 nt, Homo sapiens
ucacgcugaugcucacuga

SEQ ID NO: 608415 - RNA, 19 nt, Homo sapiens
gaagaccuccugaccaacu

SEQ ID NO: 608416 - RNA, 19 nt, Homo sapiens
gagcaggucaccaaugaag

SEQ ID NO: 608417 - RNA, 19 nt, Homo sapiens
ccacgaaccaaauccaaau

SEQ ID NO: 608418 - RNA, 19 nt, Homo sapiens
ggaugggaaagguguguuu

SEQ ID NO: 608419 - RNA, 19 nt, Homo sapiens
gggcaggcauauggaguau

SEQ ID NO: 608420 - RNA, 19 nt, Homo sapiens
cggcugcugucacccauga

SEQ ID NO: 608421 - RNA, 19 nt, Homo sapiens
augaagaccuccugaccaa

SEQ ID NO: 608422 - RNA, 19 nt, Homo sapiens
augagcaggucaccaauga

SEQ ID NO: 608423 - RNA, 19 nt, Homo sapiens
uugcggacguggccucuuu

SEQ ID NO: 608424 - RNA, 19 nt, Homo sapiens
ugacaccggugcuccuaca

SEQ ID NO: 608425 - RNA, 19 nt, Homo sapiens
ugacauucccagccugaaa

SEQ ID NO: 608426 - RNA, 19 nt, Homo sapiens
aagaguggguuccaagaca

SEQ ID NO: 608427 - RNA, 19 nt, Homo sapiens
gggcuucauugcugaugug

SEQ ID NO: 608428 - RNA, 19 nt, Homo sapiens
gcaccgauaaggagcugaa

SEQ ID NO: 608429 - RNA, 19 nt, Homo sapiens
ggagaccgccauccagaag

SEQ ID NO: 608430 - RNA, 19 nt, Homo sapiens
gcaccugggcagugagaug

SEQ ID NO: 608431 - RNA, 19 nt, Homo sapiens
ggagaagggcaggcauaug

SEQ ID NO: 608432 - RNA, 19 nt, Homo sapiens
ccuagagagugagaaguau

SEQ ID NO: 608433 - RNA, 19 nt, Homo sapiens
ggaccuagagagugagaag

SEQ ID NO: 608434 - RNA, 19 nt, Homo sapiens
gaagaguggguuccaagac

SEQ ID NO: 608435 - RNA, 19 nt, Homo sapiens
ccauuaugcuggcuaugag

SEQ ID NO: 608436 - RNA, 19 nt, Homo sapiens
ucaugcaucuguucuacgu

SEQ ID NO: 608437 - RNA, 19 nt, Homo sapiens
cagcuggcgucaugcaucu

SEQ ID NO: 608438 - RNA, 19 nt, Homo sapiens
ccaaauaaagugacauucc

SEQ ID NO: 608439 - RNA, 19 nt, Homo sapiens
cacgaaccaaauccaaaua

SEQ ID NO: 608440 - RNA, 19 nt, Homo sapiens
gugccuuagugucuacuug

SEQ ID NO: 608441 - RNA, 19 nt, Homo sapiens
caaacuacuucuggauggu

SEQ ID NO: 608442 - RNA, 19 nt, Homo sapiens
gccaggugcacccaaacua

SEQ ID NO: 608443 - RNA, 19 nt, Homo sapiens
ccugggcagugagauguuu

SEQ ID NO: 608444 - RNA, 19 nt, Homo sapiens
cccgguagaugcacaccuu

SEQ ID NO: 608445 - RNA, 19 nt, Homo sapiens
gaccaacugcacgcuauug

SEQ ID NO: 608446 - RNA, 19 nt, Homo sapiens
gggagaccgccauccagaa

SEQ ID NO: 608447 - RNA, 19 nt, Homo sapiens
cuucuaguuuguucugaga

SEQ ID NO: 608448 - RNA, 19 nt, Homo sapiens
gguggaggcuaugcuuugg

SEQ ID NO: 608449 - RNA, 19 nt, Homo sapiens
gcaggucaccaaugaagac

SEQ ID NO: 608450 - RNA, 19 nt, Homo sapiens
acgaaccaaauccaaauaa

SEQ ID NO: 608451 - RNA, 19 nt, Homo sapiens
auguaaggccuucuaguuu

SEQ ID NO: 608452 - RNA, 19 nt, Homo sapiens
gcgcugugccuuagugucu

SEQ ID NO: 608453 - RNA, 19 nt, Homo sapiens
uugcugauguggaccuaga

SEQ ID NO: 608454 - RNA, 19 nt, Homo sapiens
gaugggaaagguguguuug

SEQ ID NO: 608455 - RNA, 19 nt, Homo sapiens
ugaaugccccuacuuggua

SEQ ID NO: 608456 - RNA, 19 nt, Homo sapiens
cgucaugcaucuguucuac

SEQ ID NO: 608457 - RNA, 19 nt, Homo sapiens
cugaccaacugcacgcuau

SEQ ID NO: 608458 - RNA, 19 nt, Homo sapiens
gggacgcucugguggucau

SEQ ID NO: 608459 - RNA, 19 nt, Homo sapiens
ugggaaagguguguuugca

SEQ ID NO: 608460 - RNA, 19 nt, Homo sapiens
acucgcaccugggcaguga

SEQ ID NO: 608461 - RNA, 19 nt, Homo sapiens
cugugcagcuggcgucaug

SEQ ID NO: 608462 - RNA, 19 nt, Homo sapiens
gcacauagcuugccuaaug

SEQ ID NO: 608463 - RNA, 19 nt, Homo sapiens
gagaaaugauugacaguaa

SEQ ID NO: 608464 - RNA, 19 nt, Homo sapiens
ggacccaucugucuucaaa

SEQ ID NO: 608465 - RNA, 19 nt, Homo sapiens
gaacagauggagucggaua

SEQ ID NO: 608466 - RNA, 19 nt, Homo sapiens
gaacuccagucccuacaga

SEQ ID NO: 608467 - RNA, 19 nt, Homo sapiens
acaaguguaucucgauuaa

SEQ ID NO: 608468 - RNA, 19 nt, Homo sapiens
uaacaaguguaucucgauu

SEQ ID NO: 608469 - RNA, 19 nt, Homo sapiens
guguuaagcuugcguagaa

SEQ ID NO: 608470 - RNA, 19 nt, Homo sapiens
gaccuuggcugcucacugu

SEQ ID NO: 608471 - RNA, 19 nt, Homo sapiens
ccuaauggcuuucacuuuc

SEQ ID NO: 608472 - RNA, 19 nt, Homo sapiens
ugagaaagaucgccuugga

SEQ ID NO: 608473 - RNA, 19 nt, Homo sapiens
gccaugcccuccauuugua

SEQ ID NO: 608474 - RNA, 19 nt, Homo sapiens
gaucacacaucaucaucga

SEQ ID NO: 608475 - RNA, 19 nt, Homo sapiens
gcaagacaaagcaaauaaa

SEQ ID NO: 608476 - RNA, 19 nt, Homo sapiens
auaaagaggucacauaguc

SEQ ID NO: 608477 - RNA, 19 nt, Homo sapiens
uaaugguucuuacagagua

SEQ ID NO: 608478 - RNA, 19 nt, Homo sapiens
gaaauggguccaccaggaa

SEQ ID NO: 608479 - RNA, 19 nt, Homo sapiens
gaucugcgauggcugcaau

SEQ ID NO: 608480 - RNA, 19 nt, Homo sapiens
gcauagagagaaaugauug

SEQ ID NO: 608481 - RNA, 19 nt, Homo sapiens
uagccauccuguuaaauuu

SEQ ID NO: 608482 - RNA, 19 nt, Homo sapiens
gcauugaaguugauaucga

SEQ ID NO: 608483 - RNA, 19 nt, Homo sapiens
ccaaugacguuugcauaga

SEQ ID NO: 608484 - RNA, 19 nt, Homo sapiens
ggaacccugucccuccuaa

SEQ ID NO: 608485 - RNA, 19 nt, Homo sapiens
guagccauccuguuaaauu

SEQ ID NO: 608486 - RNA, 19 nt, Homo sapiens
ccugacauuuaguugauua

SEQ ID NO: 608487 - RNA, 19 nt, Homo sapiens
cauaggucccugacauuua

SEQ ID NO: 608488 - RNA, 19 nt, Homo sapiens
ggacaggcuuugauuuuga

SEQ ID NO: 608489 - RNA, 19 nt, Homo sapiens
guuauaaagaggucacaua

SEQ ID NO: 608490 - RNA, 19 nt, Homo sapiens
aaaguaagccuagguguug

SEQ ID NO: 608491 - RNA, 19 nt, Homo sapiens
uagcuugccuaauggcuuu

SEQ ID NO: 608492 - RNA, 19 nt, Homo sapiens
gaaaugauugacaguaagu

SEQ ID NO: 608493 - RNA, 19 nt, Homo sapiens
uaaaguaagccuagguguu

SEQ ID NO: 608494 - RNA, 19 nt, Homo sapiens
ccucuucugucucauaguu

SEQ ID NO: 608495 - RNA, 19 nt, Homo sapiens
ggagucggauaacuguuca

SEQ ID NO: 608496 - RNA, 19 nt, Homo sapiens
gcaauguugguuucacuga

SEQ ID NO: 608497 - RNA, 19 nt, Homo sapiens
guuagcagcccagcacaua

SEQ ID NO: 608498 - RNA, 19 nt, Homo sapiens
agacaaagcaaauaaaugc

SEQ ID NO: 608499 - RNA, 19 nt, Homo sapiens
gcugaggccuucucuugag

SEQ ID NO: 608500 - RNA, 19 nt, Homo sapiens
ggugaaacacggacacuuc

SEQ ID NO: 608501 - RNA, 19 nt, Homo sapiens
gcugcucacuguccacaug

SEQ ID NO: 608502 - RNA, 19 nt, Homo sapiens
ggacccgucuacaggugaa

SEQ ID NO: 608503 - RNA, 19 nt, Homo sapiens
gaaguggacccgucuacag

SEQ ID NO: 608504 - RNA, 19 nt, Homo sapiens
caaugacguuugcauagag

SEQ ID NO: 608505 - RNA, 19 nt, Homo sapiens
caguuucucugccuucuuc

SEQ ID NO: 608506 - RNA, 19 nt, Homo sapiens
uagcaagacaaagcaaaua

SEQ ID NO: 608507 - RNA, 19 nt, Homo sapiens
caaaacaagugacaugaag

SEQ ID NO: 608508 - RNA, 19 nt, Homo sapiens
uccaugggcuucucugaug

SEQ ID NO: 608509 - RNA, 19 nt, Homo sapiens
gugugaauuuccugaagaa

SEQ ID NO: 608510 - RNA, 19 nt, Homo sapiens
caaugggccugugguagga

SEQ ID NO: 608511 - RNA, 19 nt, Homo sapiens
guucuuacagaguaucuuu

SEQ ID NO: 608512 - RNA, 19 nt, Homo sapiens
cuuuguagccauccuguua

SEQ ID NO: 608513 - RNA, 19 nt, Homo sapiens
uggcggagcagaugagaaa

SEQ ID NO: 608514 - RNA, 19 nt, Homo sapiens
cauugaaguugauaucgau

SEQ ID NO: 608515 - RNA, 19 nt, Homo sapiens
ugaauuuccugaagaacgu

SEQ ID NO: 608516 - RNA, 19 nt, Homo sapiens
gaccaagaacuaugacauc

SEQ ID NO: 608517 - RNA, 19 nt, Homo sapiens
gagugugaauuuccugaag

SEQ ID NO: 608518 - RNA, 19 nt, Homo sapiens
gcacaccaagcucgcauuc

SEQ ID NO: 608519 - RNA, 19 nt, Homo sapiens
gccauccuguuaaauuugu

SEQ ID NO: 608520 - RNA, 19 nt, Homo sapiens
acucauaggucccugacau

SEQ ID NO: 608521 - RNA, 19 nt, Homo sapiens
cagcacauagcuugccuaa

SEQ ID NO: 608522 - RNA, 19 nt, Homo sapiens
ugaaguugauaucgaugug

SEQ ID NO: 608523 - RNA, 19 nt, Homo sapiens
gccugucccugaaagagaa

SEQ ID NO: 608524 - RNA, 19 nt, Homo sapiens
agaaaugauugacaguaag

SEQ ID NO: 608525 - RNA, 19 nt, Homo sapiens
auaggucccugacauuuag

SEQ ID NO: 608526 - RNA, 19 nt, Homo sapiens
ccaugggcuucucugauga

SEQ ID NO: 608527 - RNA, 19 nt, Homo sapiens
gauggagucggauaacugu

SEQ ID NO: 608528 - RNA, 19 nt, Homo sapiens
ggccaugcccuccauuugu

SEQ ID NO: 608529 - RNA, 19 nt, Homo sapiens
ucauaggucccugacauuu

SEQ ID NO: 608530 - RNA, 19 nt, Homo sapiens
aauguugguuucacugaga

SEQ ID NO: 608531 - RNA, 19 nt, Homo sapiens
gcugggacaggcuuugauu

SEQ ID NO: 608532 - RNA, 19 nt, Homo sapiens
agagaaaugauugacagua

SEQ ID NO: 608533 - RNA, 19 nt, Homo sapiens
gcuuugauuuugaggguua

SEQ ID NO: 608534 - RNA, 19 nt, Homo sapiens
gguacacucugauuuuaga

SEQ ID NO: 608535 - RNA, 19 nt, Homo sapiens
cuaauggcuuucacuuucu

SEQ ID NO: 608536 - RNA, 19 nt, Homo sapiens
ucauaguuguguuaagcuu

SEQ ID NO: 608537 - RNA, 19 nt, Homo sapiens
cggagcagaugagaaagau

SEQ ID NO: 608538 - RNA, 19 nt, Homo sapiens
gcggagcagaugagaaaga

SEQ ID NO: 608539 - RNA, 19 nt, Homo sapiens
cugcugaggccuucucuug

SEQ ID NO: 608540 - RNA, 19 nt, Homo sapiens
uguuaaugguucuuacaga

SEQ ID NO: 608541 - RNA, 19 nt, Homo sapiens
gaccugguacacucugauu

SEQ ID NO: 608542 - RNA, 19 nt, Homo sapiens
gcaaaacaagugacaugaa

SEQ ID NO: 608543 - RNA, 19 nt, Homo sapiens
gccuaauggcuuucacuuu

SEQ ID NO: 608544 - RNA, 19 nt, Homo sapiens
uagaauugcaggucucugu

SEQ ID NO: 608545 - RNA, 19 nt, Homo sapiens
cgaaucuacauuaaagaga

SEQ ID NO: 608546 - RNA, 19 nt, Homo sapiens
ggccauguccuacgugaag

SEQ ID NO: 608547 - RNA, 19 nt, Homo sapiens
uguuucaccuuccauguca

SEQ ID NO: 608548 - RNA, 19 nt, Homo sapiens
gggcugcugccuuguuuca

SEQ ID NO: 608549 - RNA, 19 nt, Homo sapiens
uuauaaagaggucacauag

SEQ ID NO: 608550 - RNA, 19 nt, Homo sapiens
uuccgaaucuacauuaaag

SEQ ID NO: 608551 - RNA, 19 nt, Homo sapiens
caauggccauguccuacgu

SEQ ID NO: 608552 - RNA, 19 nt, Homo sapiens
aaccaaugacguuugcaua

SEQ ID NO: 608553 - RNA, 19 nt, Homo sapiens
ucccugacauuuaguugau

SEQ ID NO: 608554 - RNA, 19 nt, Homo sapiens
guuaagcuugcguagaauu

SEQ ID NO: 608555 - RNA, 19 nt, Homo sapiens
ugacuggacccaucugucu

SEQ ID NO: 608556 - RNA, 19 nt, Homo sapiens
gggacaggcuuugauuuug

SEQ ID NO: 608557 - RNA, 19 nt, Homo sapiens
uagaggauguggcuguaac

SEQ ID NO: 608558 - RNA, 19 nt, Homo sapiens
agugugaauuuccugaaga

SEQ ID NO: 608559 - RNA, 19 nt, Homo sapiens
gaggauccgagugugaauu

SEQ ID NO: 608560 - RNA, 19 nt, Homo sapiens
cauccaguauucaaagcau

SEQ ID NO: 608561 - RNA, 19 nt, Homo sapiens
ggacaccauccaguauuca

SEQ ID NO: 608562 - RNA, 19 nt, Homo sapiens
gaauaugguugcagaauug

SEQ ID NO: 608563 - RNA, 19 nt, Homo sapiens
ggacaaagaguaugugaaa

SEQ ID NO: 608564 - RNA, 19 nt, Homo sapiens
gagcacaacucaagauaga

SEQ ID NO: 608565 - RNA, 19 nt, Homo sapiens
gaacaugucauuccugaaa

SEQ ID NO: 608566 - RNA, 19 nt, Homo sapiens
gaucaaaacuccagaaauu

SEQ ID NO: 608567 - RNA, 19 nt, Homo sapiens
ggaauaugguugcagaauu

SEQ ID NO: 608568 - RNA, 19 nt, Homo sapiens
gaagagcuaucuccaggaa

SEQ ID NO: 608569 - RNA, 19 nt, Homo sapiens
caagauagaggcagaaauu

SEQ ID NO: 608570 - RNA, 19 nt, Homo sapiens
gagaaucugucacucaaau

SEQ ID NO: 608571 - RNA, 19 nt, Homo sapiens
caagacaaguugaacaaga

SEQ ID NO: 608572 - RNA, 19 nt, Homo sapiens
uggagaaacuuaaggagua

SEQ ID NO: 608573 - RNA, 19 nt, Homo sapiens
ccaggaagaugcccauuau

SEQ ID NO: 608574 - RNA, 19 nt, Homo sapiens
caucuggucuugcuccaua

SEQ ID NO: 608575 - RNA, 19 nt, Homo sapiens
gaaaguggacaaagaguau

SEQ ID NO: 608576 - RNA, 19 nt, Homo sapiens
gaacuuggacccuuucuag

SEQ ID NO: 608577 - RNA, 19 nt, Homo sapiens
ucacucaaaucaugaagaa

SEQ ID NO: 608578 - RNA, 19 nt, Homo sapiens
gcucaucauugguguugua

SEQ ID NO: 608579 - RNA, 19 nt, Homo sapiens
gcucugggaucccgugauu

SEQ ID NO: 608580 - RNA, 19 nt, Homo sapiens
caagcuggcugucaaauac

SEQ ID NO: 608581 - RNA, 19 nt, Homo sapiens
ccacaaaagccaagaauua

SEQ ID NO: 608582 - RNA, 19 nt, Homo sapiens
gaacggcuauguugaagcu

SEQ ID NO: 608583 - RNA, 19 nt, Homo sapiens
caucauugguguuguauag

SEQ ID NO: 608584 - RNA, 19 nt, Homo sapiens
caagauagaccaugagaca

SEQ ID NO: 608585 - RNA, 19 nt, Homo sapiens
gaacagaaagcauacugau

SEQ ID NO: 608586 - RNA, 19 nt, Homo sapiens
aagaguaugugaaagcuuu

SEQ ID NO: 608587 - RNA, 19 nt, Homo sapiens
gauauuagcaagaacaugu

SEQ ID NO: 608588 - RNA, 19 nt, Homo sapiens
acgaguagcuauacaauuc

SEQ ID NO: 608589 - RNA, 19 nt, Homo sapiens
gaaacgaguagcuauacaa

SEQ ID NO: 608590 - RNA, 19 nt, Homo sapiens
ccagagaguuuauggucaa

SEQ ID NO: 608591 - RNA, 19 nt, Homo sapiens
gauaugaguuugucuucca

SEQ ID NO: 608592 - RNA, 19 nt, Homo sapiens
uaugagcccuggcagcuaa

SEQ ID NO: 608593 - RNA, 19 nt, Homo sapiens
cagagaauuccauuacaua

SEQ ID NO: 608594 - RNA, 19 nt, Homo sapiens
cagcugacacccauaagua

SEQ ID NO: 608595 - RNA, 19 nt, Homo sapiens
ggaaacgaguagcuauaca

SEQ ID NO: 608596 - RNA, 19 nt, Homo sapiens
ccagagaauuccauuacau

SEQ ID NO: 608597 - RNA, 19 nt, Homo sapiens
caaaccugaugacugcuaa

SEQ ID NO: 608598 - RNA, 19 nt, Homo sapiens
ggacauugcaccaaguaug

SEQ ID NO: 608599 - RNA, 19 nt, Homo sapiens
ggugagaacggcuauguug

SEQ ID NO: 608600 - RNA, 19 nt, Homo sapiens
gcaagaacaugucauuccu

SEQ ID NO: 608601 - RNA, 19 nt, Homo sapiens
gaaauugugaggauagcuu

SEQ ID NO: 608602 - RNA, 19 nt, Homo sapiens
ugaacaagaccaaggauga

SEQ ID NO: 608603 - RNA, 19 nt, Homo sapiens
ggaagaugcccauuauugg

SEQ ID NO: 608604 - RNA, 19 nt, Homo sapiens
gcuauacaauuccuaaagg

SEQ ID NO: 608605 - RNA, 19 nt, Homo sapiens
gauagaggcagaaauugug

SEQ ID NO: 608606 - RNA, 19 nt, Homo sapiens
gacauugcaccaaguauga

SEQ ID NO: 608607 - RNA, 19 nt, Homo sapiens
gagcucaucugcuguuuug

SEQ ID NO: 608608 - RNA, 19 nt, Homo sapiens
cauuauuggucguaagauu

SEQ ID NO: 608609 - RNA, 19 nt, Homo sapiens
gcagaauuguccucagucu

SEQ ID NO: 608610 - RNA, 19 nt, Homo sapiens
ccaagcuggcugucaaaua

SEQ ID NO: 608611 - RNA, 19 nt, Homo sapiens
gaccaaggaugauauuagc

SEQ ID NO: 608612 - RNA, 19 nt, Homo sapiens
gaacaagaccaaggaugau

SEQ ID NO: 608613 - RNA, 19 nt, Homo sapiens
gaagaugcccauuauuggu

SEQ ID NO: 608614 - RNA, 19 nt, Homo sapiens
gaacaggccgugcacaacu

SEQ ID NO: 608615 - RNA, 19 nt, Homo sapiens
ugacaucuaccgacuauca

SEQ ID NO: 608616 - RNA, 19 nt, Homo sapiens
gaagcuaccaaacagauca

SEQ ID NO: 608617 - RNA, 19 nt, Homo sapiens
gggaggagaagcucacuga

SEQ ID NO: 608618 - RNA, 19 nt, Homo sapiens
gaaucugucacucaaauca

SEQ ID NO: 608619 - RNA, 19 nt, Homo sapiens
ggaaguauacuccacaaaa

SEQ ID NO: 608620 - RNA, 19 nt, Homo sapiens
gagaacggcuauguugaag

SEQ ID NO: 608621 - RNA, 19 nt, Homo sapiens
gcaaugagaagagcuaucu

SEQ ID NO: 608622 - RNA, 19 nt, Homo sapiens
gcagaaauugugaggauag

SEQ ID NO: 608623 - RNA, 19 nt, Homo sapiens
ggaagaugccuagcacaga

SEQ ID NO: 608624 - RNA, 19 nt, Homo sapiens
ggaacagaaagcauacuga

SEQ ID NO: 608625 - RNA, 19 nt, Homo sapiens
ggcagaaauugugaggaua

SEQ ID NO: 608626 - RNA, 19 nt, Homo sapiens
ugugaaggcuuauggagau

SEQ ID NO: 608627 - RNA, 19 nt, Homo sapiens
gccaagaauuauguaaaug

SEQ ID NO: 608628 - RNA, 19 nt, Homo sapiens
gacaagaaguacaggaacu

SEQ ID NO: 608629 - RNA, 19 nt, Homo sapiens
ugaaaguggacaaagagua

SEQ ID NO: 608630 - RNA, 19 nt, Homo sapiens
gucguaagauucaagacaa

SEQ ID NO: 608631 - RNA, 19 nt, Homo sapiens
ucgagaaucugucacucaa

SEQ ID NO: 608632 - RNA, 19 nt, Homo sapiens
gcaguucccacccaguauu

SEQ ID NO: 608633 - RNA, 19 nt, Homo sapiens
agucagaacuggaaaauau

SEQ ID NO: 608634 - RNA, 19 nt, Homo sapiens
ugagaacggcuauguugaa

SEQ ID NO: 608635 - RNA, 19 nt, Homo sapiens
gagcccuacuuagagauuu

SEQ ID NO: 608636 - RNA, 19 nt, Homo sapiens
gaaguauacuccacaaaag

SEQ ID NO: 608637 - RNA, 19 nt, Homo sapiens
gagaguuuauggucaaggu

SEQ ID NO: 608638 - RNA, 19 nt, Homo sapiens
gaugaaugguucuccaaaa

SEQ ID NO: 608639 - RNA, 19 nt, Homo sapiens
acaguuuccucauggugua

SEQ ID NO: 608640 - RNA, 19 nt, Homo sapiens
ggagaaacuuaaggaguac

SEQ ID NO: 608641 - RNA, 19 nt, Homo sapiens
guagcuauacaauuccuaa

SEQ ID NO: 608642 - RNA, 19 nt, Homo sapiens
aggaagaugcccauuauug

SEQ ID NO: 608643 - RNA, 19 nt, Homo sapiens
gcccuuguuauaaauguua

SEQ ID NO: 608644 - RNA, 19 nt, Homo sapiens
caaaucaugaagaauccua

SEQ ID NO: 608645 - RNA, 19 nt, Homo sapiens
gcauacugauggccugcaa

SEQ ID NO: 608646 - RNA, 19 nt, Homo sapiens
ggaccagauucguguggau

SEQ ID NO: 608647 - RNA, 19 nt, Homo sapiens
gauagcuuguucccuguuc

SEQ ID NO: 608648 - RNA, 19 nt, Homo sapiens
gaguuuauggucaagguuu

SEQ ID NO: 608649 - RNA, 19 nt, Homo sapiens
ccauagagcacaacucaag

SEQ ID NO: 608650 - RNA, 19 nt, Homo sapiens
gugcacaacuuugacaucu

SEQ ID NO: 608651 - RNA, 19 nt, Homo sapiens
agaauuguccucagucuuc

SEQ ID NO: 608652 - RNA, 19 nt, Homo sapiens
gcuaagggguggaacuuga

SEQ ID NO: 608653 - RNA, 19 nt, Homo sapiens
ccaaacagaucaucaaaac

SEQ ID NO: 608654 - RNA, 19 nt, Homo sapiens
agagcuaucuccaggaaca

SEQ ID NO: 608655 - RNA, 19 nt, Homo sapiens
ccaguuacuuugggaugaa

SEQ ID NO: 608656 - RNA, 19 nt, Homo sapiens
ccaaggaugauauuagcaa

SEQ ID NO: 608657 - RNA, 19 nt, Homo sapiens
caagaccaaggaugauauu

SEQ ID NO: 608658 - RNA, 19 nt, Homo sapiens
agaaguacaggaacuauca

SEQ ID NO: 608659 - RNA, 19 nt, Homo sapiens
ucauugguguuguauagug

SEQ ID NO: 608660 - RNA, 19 nt, Homo sapiens
gaaggcuuauggagauuuu

SEQ ID NO: 608661 - RNA, 19 nt, Homo sapiens
caaagaguaugugaaagcu

SEQ ID NO: 608662 - RNA, 19 nt, Homo sapiens
gaauagaacuucagagaaa

SEQ ID NO: 608663 - RNA, 19 nt, Homo sapiens
ggacaucacugaauucaaa

SEQ ID NO: 608664 - RNA, 19 nt, Homo sapiens
gaacagaucucacgcauac

SEQ ID NO: 608665 - RNA, 19 nt, Homo sapiens
gaaaggauagcacaaauaa

SEQ ID NO: 608666 - RNA, 19 nt, Homo sapiens
gaaagguccuguauguuaa

SEQ ID NO: 608667 - RNA, 19 nt, Homo sapiens
gauaggagguuaauauuuc

SEQ ID NO: 608668 - RNA, 19 nt, Homo sapiens
ugacaaaccucuuaggauu

SEQ ID NO: 608669 - RNA, 19 nt, Homo sapiens
ggaacgggcuggaguuaaa

SEQ ID NO: 608670 - RNA, 19 nt, Homo sapiens
gaaaugcaguucaagaaau

SEQ ID NO: 608671 - RNA, 19 nt, Homo sapiens
ggaaaugguguuagaguua

SEQ ID NO: 608672 - RNA, 19 nt, Homo sapiens
gaaaugguguuagaguuaa

SEQ ID NO: 608673 - RNA, 19 nt, Homo sapiens
gaacacuggugcugacaaa

SEQ ID NO: 608674 - RNA, 19 nt, Homo sapiens
caaagcagaucuguaauga

SEQ ID NO: 608675 - RNA, 19 nt, Homo sapiens
gcagggacaucacugaauu

SEQ ID NO: 608676 - RNA, 19 nt, Homo sapiens
ccagaaagguccuguaugu

SEQ ID NO: 608677 - RNA, 19 nt, Homo sapiens
gcagacgacuugaugaaga

SEQ ID NO: 608678 - RNA, 19 nt, Homo sapiens
agaaagguccuguauguua

SEQ ID NO: 608679 - RNA, 19 nt, Homo sapiens
cagcaaagcagaucuguaa

SEQ ID NO: 608680 - RNA, 19 nt, Homo sapiens
ccaaggaaaugguguuaga

SEQ ID NO: 608681 - RNA, 19 nt, Homo sapiens
caacuacaacucaaacuaa

SEQ ID NO: 608682 - RNA, 19 nt, Homo sapiens
gagaaauccuccaccaaau

SEQ ID NO: 608683 - RNA, 19 nt, Homo sapiens
gcagucuggugcaagaaua

SEQ ID NO: 608684 - RNA, 19 nt, Homo sapiens
gaguaugggucaagaauag

SEQ ID NO: 608685 - RNA, 19 nt, Homo sapiens
ggaagaguacuacaagaaa

SEQ ID NO: 608686 - RNA, 19 nt, Homo sapiens
ucaacaugcugcagaaauu

SEQ ID NO: 608687 - RNA, 19 nt, Homo sapiens
gaaaugaagggauagaugu

SEQ ID NO: 608688 - RNA, 19 nt, Homo sapiens
ggaaaugcaguucaagaaa

SEQ ID NO: 608689 - RNA, 19 nt, Homo sapiens
gaaaguugcuccucaaaau

SEQ ID NO: 608690 - RNA, 19 nt, Homo sapiens
gacaacaagcagccuauua

SEQ ID NO: 608691 - RNA, 19 nt, Homo sapiens
acagauagcuccugacagu

SEQ ID NO: 608692 - RNA, 19 nt, Homo sapiens
gacaacacccgaaaggaua

SEQ ID NO: 608693 - RNA, 19 nt, Homo sapiens
ucagagaaguucggaauga

SEQ ID NO: 608694 - RNA, 19 nt, Homo sapiens
gacaaaccucuuaggauua

SEQ ID NO: 608695 - RNA, 19 nt, Homo sapiens
ucaaccagaugcuaagaaa

SEQ ID NO: 608696 - RNA, 19 nt, Homo sapiens
acaggaaucuggaugcaaa

SEQ ID NO: 608697 - RNA, 19 nt, Homo sapiens
aagcagaucuguaaugaca

SEQ ID NO: 608698 - RNA, 19 nt, Homo sapiens
gcaaagcagaucuguaaug

SEQ ID NO: 608699 - RNA, 19 nt, Homo sapiens
uaagaaaguugcuccucaa

SEQ ID NO: 608700 - RNA, 19 nt, Homo sapiens
aaagauugguggcccagua

SEQ ID NO: 608701 - RNA, 19 nt, Homo sapiens
ucaaggcgguuucagagaa

SEQ ID NO: 608702 - RNA, 19 nt, Homo sapiens
guugaugcuuugugauaua

SEQ ID NO: 608703 - RNA, 19 nt, Homo sapiens
caacaugcugcagaaauua

SEQ ID NO: 608704 - RNA, 19 nt, Homo sapiens
ggacaacacccgaaaggau

SEQ ID NO: 608705 - RNA, 19 nt, Homo sapiens
cuuauuacgcucacuauua

SEQ ID NO: 608706 - RNA, 19 nt, Homo sapiens
aaaaggaggugaaaccaua

SEQ ID NO: 608707 - RNA, 19 nt, Homo sapiens
gguguucgcauucaguuua

SEQ ID NO: 608708 - RNA, 19 nt, Homo sapiens
gcuccuggcuuccaucaug

SEQ ID NO: 608709 - RNA, 19 nt, Homo sapiens
gacagaagaauacaaaguu

SEQ ID NO: 608710 - RNA, 19 nt, Homo sapiens
aauaagaaguggacaauac

SEQ ID NO: 608711 - RNA, 19 nt, Homo sapiens
cauacaacccugcaccuua

SEQ ID NO: 608712 - RNA, 19 nt, Homo sapiens
ccaaaugcagauccuaaua

SEQ ID NO: 608713 - RNA, 19 nt, Homo sapiens
cgaaaggauagcacaaaua

SEQ ID NO: 608714 - RNA, 19 nt, Homo sapiens
cugcagaaauuauuacaga

SEQ ID NO: 608715 - RNA, 19 nt, Homo sapiens
ggaaaugaagggauagaug

SEQ ID NO: 608716 - RNA, 19 nt, Homo sapiens
gagaaguucggaaugagua

SEQ ID NO: 608717 - RNA, 19 nt, Homo sapiens
cagaggaggugaacagauc

SEQ ID NO: 608718 - RNA, 19 nt, Homo sapiens
gaagaguacuacaagaaaa

SEQ ID NO: 608719 - RNA, 19 nt, Homo sapiens
gagaucaaccagaugcuaa

SEQ ID NO: 608720 - RNA, 19 nt, Homo sapiens
caaaugcagauccuaauau

SEQ ID NO: 608721 - RNA, 19 nt, Homo sapiens
ugggaaaacuggauuaaua

SEQ ID NO: 608722 - RNA, 19 nt, Homo sapiens
ggagacccauauaaaguuc

SEQ ID NO: 608723 - RNA, 19 nt, Homo sapiens
gggaagaguacuacaagaa

SEQ ID NO: 608724 - RNA, 19 nt, Homo sapiens
cagcuggacagguugauua

SEQ ID NO: 608725 - RNA, 19 nt, Homo sapiens
ggaaaugcauauccacacu

SEQ ID NO: 608726 - RNA, 19 nt, Homo sapiens
gaauucaaaugacuauggu

SEQ ID NO: 608727 - RNA, 19 nt, Homo sapiens
gggagaaacuauuaaacag

SEQ ID NO: 608728 - RNA, 19 nt, Homo sapiens
gaaaaugggucaggcaguu

SEQ ID NO: 608729 - RNA, 19 nt, Homo sapiens
ucaaaugacuaugguuaug

SEQ ID NO: 608730 - RNA, 19 nt, Homo sapiens
gugcaaccauggcagacua

SEQ ID NO: 608731 - RNA, 19 nt, Homo sapiens
gcaagaauagaacuucaga

SEQ ID NO: 608732 - RNA, 19 nt, Homo sapiens
gaaugaguaugggucaaga

SEQ ID NO: 608733 - RNA, 19 nt, Homo sapiens
gggaaaugcaguucaagaa

SEQ ID NO: 608734 - RNA, 19 nt, Homo sapiens
auacaacccugcaccuuau

SEQ ID NO: 608735 - RNA, 19 nt, Homo sapiens
aaaugcagauccuaauaug

SEQ ID NO: 608736 - RNA, 19 nt, Homo sapiens
gaaguguucaggcugguaa

SEQ ID NO: 608737 - RNA, 19 nt, Homo sapiens
gaaauggagagaugaucaa

SEQ ID NO: 608738 - RNA, 19 nt, Homo sapiens
agagaaauccuccaccaaa

SEQ ID NO: 608739 - RNA, 19 nt, Homo sapiens
aggaggaaaugaagggaua

SEQ ID NO: 608740 - RNA, 19 nt, Homo sapiens
cagauggaaugguuggauu

SEQ ID NO: 608741 - RNA, 19 nt, Homo sapiens
gcaggaacggauccaaauu

SEQ ID NO: 608742 - RNA, 19 nt, Homo sapiens
gaauacaaaguuccagaug

SEQ ID NO: 608743 - RNA, 19 nt, Homo sapiens
caacaagcagccuauuaug

SEQ ID NO: 608744 - RNA, 19 nt, Homo sapiens
acaaggagaucagcagaau

SEQ ID NO: 608745 - RNA, 19 nt, Homo sapiens
ggcagcggcucuuauagug

SEQ ID NO: 608746 - RNA, 19 nt, Homo sapiens
gaagaaauggagagaugau

SEQ ID NO: 608747 - RNA, 19 nt, Homo sapiens
aagauuugcuguuggcauu

SEQ ID NO: 608748 - RNA, 19 nt, Homo sapiens
uacaguauuugcuucauug

SEQ ID NO: 608749 - RNA, 19 nt, Homo sapiens
aggaagaaauggagagaug

SEQ ID NO: 608750 - RNA, 19 nt, Homo sapiens
caaggcaggauuagucauu

SEQ ID NO: 608751 - RNA, 19 nt, Homo sapiens
ccaacuacaacucaaacua

SEQ ID NO: 608752 - RNA, 19 nt, Homo sapiens
gcaccaacuacaacucaaa

SEQ ID NO: 608753 - RNA, 19 nt, Homo sapiens
ccgaaaggauagcacaaau

SEQ ID NO: 608754 - RNA, 19 nt, Homo sapiens
uuacaggagacccauauaa

SEQ ID NO: 608755 - RNA, 19 nt, Homo sapiens
acaacaagcagccuauuau

SEQ ID NO: 608756 - RNA, 19 nt, Homo sapiens
caacaggaaucuggaugca

SEQ ID NO: 608757 - RNA, 19 nt, Homo sapiens
cagguggucagccagauua

SEQ ID NO: 608758 - RNA, 19 nt, Homo sapiens
ucaaacuaauggacaagga

SEQ ID NO: 608759 - RNA, 19 nt, Homo sapiens
aagaauagaacuucagaga

SEQ ID NO: 608760 - RNA, 19 nt, Homo sapiens
aaggauagcacaaauaaca

SEQ ID NO: 608761 - RNA, 19 nt, Homo sapiens
ggaagaaauggagagauga

SEQ ID NO: 608762 - RNA, 19 nt, Homo sapiens
gaagaaaccuuugaaauug

SEQ ID NO: 608763 - RNA, 19 nt, Homo sapiens
gaaaguggcuucaaagauc

SEQ ID NO: 608764 - RNA, 19 nt, Homo sapiens
ggaagaaaccuuugaaauu

SEQ ID NO: 608765 - RNA, 19 nt, Homo sapiens
guagauggcuugcaagaga

SEQ ID NO: 608766 - RNA, 19 nt, Homo sapiens
uaaaguagcuucacucucu

SEQ ID NO: 608767 - RNA, 19 nt, Homo sapiens
gagcagacauuaaagacaa

SEQ ID NO: 608768 - RNA, 19 nt, Homo sapiens
gaauaaagccaaugaacuu

SEQ ID NO: 608769 - RNA, 19 nt, Homo sapiens
gaacagagacccgccuuaa

SEQ ID NO: 608770 - RNA, 19 nt, Homo sapiens
gaaugaaagugacaugaug

SEQ ID NO: 608771 - RNA, 19 nt, Homo sapiens
ggucaucccugaaucugua

SEQ ID NO: 608772 - RNA, 19 nt, Homo sapiens
gcuacaagcuuacuucugu

SEQ ID NO: 608773 - RNA, 19 nt, Homo sapiens
uggaagagcccaucaauaa

SEQ ID NO: 608774 - RNA, 19 nt, Homo sapiens
gaagauaucucagcaaagc

SEQ ID NO: 608775 - RNA, 19 nt, Homo sapiens
ggaacgagguaacaguuga

SEQ ID NO: 608776 - RNA, 19 nt, Homo sapiens
cagaagauaucucagcaaa

SEQ ID NO: 608777 - RNA, 19 nt, Homo sapiens
caaauuguaugaagcaugu

SEQ ID NO: 608778 - RNA, 19 nt, Homo sapiens
guaucaaagugcucuauuu

SEQ ID NO: 608779 - RNA, 19 nt, Homo sapiens
gcugagagacauuauuaua

SEQ ID NO: 608780 - RNA, 19 nt, Homo sapiens
gcagcuaggugccauuaug

SEQ ID NO: 608781 - RNA, 19 nt, Homo sapiens
guacauuggugauucugaa

SEQ ID NO: 608782 - RNA, 19 nt, Homo sapiens
gaacaugccagaagauauc

SEQ ID NO: 608783 - RNA, 19 nt, Homo sapiens
gaaaaucuaugaugcucua

SEQ ID NO: 608784 - RNA, 19 nt, Homo sapiens
ggaagagcccaucaauaaa

SEQ ID NO: 608785 - RNA, 19 nt, Homo sapiens
gguaacaguugacaaaugg

SEQ ID NO: 608786 - RNA, 19 nt, Homo sapiens
uagcugagagacauuauua

SEQ ID NO: 608787 - RNA, 19 nt, Homo sapiens
cuauggaccugcauggaua

SEQ ID NO: 608788 - RNA, 19 nt, Homo sapiens
gcagugggauguuacuauc

SEQ ID NO: 608789 - RNA, 19 nt, Homo sapiens
gaagcuugaugucuacugu

SEQ ID NO: 608790 - RNA, 19 nt, Homo sapiens
cucauaaacugguggauuu

SEQ ID NO: 608791 - RNA, 19 nt, Homo sapiens
uuagcaagcuguguaauga

SEQ ID NO: 608792 - RNA, 19 nt, Homo sapiens
gaauaaagaagguaaacca

SEQ ID NO: 608793 - RNA, 19 nt, Homo sapiens
ggaagacccuuuuguuaug

SEQ ID NO: 608794 - RNA, 19 nt, Homo sapiens
guaauccugugucuugguu

SEQ ID NO: 608795 - RNA, 19 nt, Homo sapiens
cagggaauuugaaguagaa

SEQ ID NO: 608796 - RNA, 19 nt, Homo sapiens
gcaaguuguuuaccuguac

SEQ ID NO: 608797 - RNA, 19 nt, Homo sapiens
cgagguaacaguugacaaa

SEQ ID NO: 608798 - RNA, 19 nt, Homo sapiens
gcaaagccacaacacuuga

SEQ ID NO: 608799 - RNA, 19 nt, Homo sapiens
gaagagcccaucaauaaaa

SEQ ID NO: 608800 - RNA, 19 nt, Homo sapiens
gcacaccuuugcaacagau

SEQ ID NO: 608801 - RNA, 19 nt, Homo sapiens
aaaugaacaugccagaaga

SEQ ID NO: 608802 - RNA, 19 nt, Homo sapiens
ccaaugaacuuuucuaucu

SEQ ID NO: 608803 - RNA, 19 nt, Homo sapiens
gcaagagaaucuggaugug

SEQ ID NO: 608804 - RNA, 19 nt, Homo sapiens
acagagacccgccuuaaga

SEQ ID NO: 608805 - RNA, 19 nt, Homo sapiens
cuaguaauccugugucuug

SEQ ID NO: 608806 - RNA, 19 nt, Homo sapiens
caagcuguguaaugaagaa

SEQ ID NO: 608807 - RNA, 19 nt, Homo sapiens
cagcaaagccacaacacuu

SEQ ID NO: 608808 - RNA, 19 nt, Homo sapiens
gaaacggucaucccugaau

SEQ ID NO: 608809 - RNA, 19 nt, Homo sapiens
cagcaacaguaucaaagug

SEQ ID NO: 608810 - RNA, 19 nt, Homo sapiens
guaaugaagaacaggaauu

SEQ ID NO: 608811 - RNA, 19 nt, Homo sapiens
gaacgcauccaccuacucu

SEQ ID NO: 608812 - RNA, 19 nt, Homo sapiens
aaaaugugcuacaagcuua

SEQ ID NO: 608813 - RNA, 19 nt, Homo sapiens
gaaucuggaugugguagug

SEQ ID NO: 608814 - RNA, 19 nt, Homo sapiens
ggaacagagacccgccuua

SEQ ID NO: 608815 - RNA, 19 nt, Homo sapiens
ccacacagcccuuggucuu

SEQ ID NO: 608816 - RNA, 19 nt, Homo sapiens
gcauccaccuacucugcua

SEQ ID NO: 608817 - RNA, 19 nt, Homo sapiens
ggauuagaauaugguuuga

SEQ ID NO: 608818 - RNA, 19 nt, Homo sapiens
gguuugcagugggauguua

SEQ ID NO: 608819 - RNA, 19 nt, Homo sapiens
ugaagcaugucguuaccuu

SEQ ID NO: 608820 - RNA, 19 nt, Homo sapiens
cacgaaaacuggacaaauu

SEQ ID NO: 608821 - RNA, 19 nt, Homo sapiens
gaaaugaaugaaagugaca

SEQ ID NO: 608822 - RNA, 19 nt, Homo sapiens
gcccaucaauaaaagauua

SEQ ID NO: 608823 - RNA, 19 nt, Homo sapiens
gauggcugcuuacuucaca

SEQ ID NO: 608824 - RNA, 19 nt, Homo sapiens
ggaaaugucacagucuuca

SEQ ID NO: 608825 - RNA, 19 nt, Homo sapiens
gggcuuacgccauuggaaa

SEQ ID NO: 608826 - RNA, 19 nt, Homo sapiens
ucagggaauuugaaguaga

SEQ ID NO: 608827 - RNA, 19 nt, Homo sapiens
cuacucugcuauuggauau

SEQ ID NO: 608828 - RNA, 19 nt, Homo sapiens
cauuugcgguggagaguga

SEQ ID NO: 608829 - RNA, 19 nt, Homo sapiens
cuuugaagcuugaugucua

SEQ ID NO: 608830 - RNA, 19 nt, Homo sapiens
caccuacucugcuauugga

SEQ ID NO: 608831 - RNA, 19 nt, Homo sapiens
aaugguuucuugaugcuuu

SEQ ID NO: 608832 - RNA, 19 nt, Homo sapiens
gcuguauauuggauuagaa

SEQ ID NO: 608833 - RNA, 19 nt, Homo sapiens
gaccagcaacaguaucaaa

SEQ ID NO: 608834 - RNA, 19 nt, Homo sapiens
aaacggggcuuacgccauu

SEQ ID NO: 608835 - RNA, 19 nt, Homo sapiens
augcugaggccuuggauua

SEQ ID NO: 608836 - RNA, 19 nt, Homo sapiens
cccaggacaucuauugguu

SEQ ID NO: 608837 - RNA, 19 nt, Homo sapiens
uaaugaagaacaggaauug

SEQ ID NO: 608838 - RNA, 19 nt, Homo sapiens
ccacaacacuugagaaaac

SEQ ID NO: 608839 - RNA, 19 nt, Homo sapiens
gaaaugucacagucuucaa

SEQ ID NO: 608840 - RNA, 19 nt, Homo sapiens
gauaaaguagcuucacucu

SEQ ID NO: 608841 - RNA, 19 nt, Homo sapiens
gcaauugggaacgagguaa

SEQ ID NO: 608842 - RNA, 19 nt, Homo sapiens
ucucugaaccuacaaaaua

SEQ ID NO: 608843 - RNA, 19 nt, Homo sapiens
uggaagaaaccuuugaaau

SEQ ID NO: 608844 - RNA, 19 nt, Homo sapiens
aaaacagacugcagaagaa

SEQ ID NO: 608845 - RNA, 19 nt, Homo sapiens
acacagcccuuggucuuag

SEQ ID NO: 608846 - RNA, 19 nt, Homo sapiens
uaauaagccuagugaaacg

SEQ ID NO: 608847 - RNA, 19 nt, Homo sapiens
gucacagucuucaauaaag

SEQ ID NO: 608848 - RNA, 19 nt, Homo sapiens
ugucacagucuucaauaaa

SEQ ID NO: 608849 - RNA, 19 nt, Homo sapiens
uggaugugguagugucuuu

SEQ ID NO: 608850 - RNA, 19 nt, Homo sapiens
uagauggcuugcaagagaa

SEQ ID NO: 608851 - RNA, 19 nt, Homo sapiens
aacaggaauugcugcguuu

SEQ ID NO: 608852 - RNA, 19 nt, Homo sapiens
aaugggaaccuuuguugaa

SEQ ID NO: 608853 - RNA, 19 nt, Homo sapiens
ggucggcgugguugcauuu

SEQ ID NO: 608854 - RNA, 19 nt, Homo sapiens
cagauaaaguagcuucacu

SEQ ID NO: 608855 - RNA, 19 nt, Homo sapiens
gcaggcccuugauguucuu

SEQ ID NO: 608856 - RNA, 19 nt, Homo sapiens
aaacagacugcagaagaaa

SEQ ID NO: 608857 - RNA, 19 nt, Homo sapiens
uuaaagcaauugggaacga

SEQ ID NO: 608858 - RNA, 19 nt, Homo sapiens
ccagcaggcccuugauguu

SEQ ID NO: 608859 - RNA, 19 nt, Homo sapiens
agcgauggcugcuuacuuc

SEQ ID NO: 608860 - RNA, 19 nt, Homo sapiens
aaacggucaucccugaauc

SEQ ID NO: 608861 - RNA, 19 nt, Homo sapiens
gacuggaucgcacaccuuu

SEQ ID NO: 608862 - RNA, 19 nt, Homo sapiens
guacaaaucccucacuuua

SEQ ID NO: 608863 - RNA, 19 nt, Homo sapiens
gaaaugaagugcuccaguu

SEQ ID NO: 608864 - RNA, 19 nt, Homo sapiens
gagaaguggugaagacuga

SEQ ID NO: 608865 - RNA, 19 nt, Homo sapiens
ugaaagaauugaugaguuc

SEQ ID NO: 608866 - RNA, 19 nt, Homo sapiens
ucaaugacaugaagacaga

SEQ ID NO: 608867 - RNA, 19 nt, Homo sapiens
ggaggaaacccagaaauga

SEQ ID NO: 608868 - RNA, 19 nt, Homo sapiens
ccagagaccuccucaaguc

SEQ ID NO: 608869 - RNA, 19 nt, Homo sapiens
uggaagggcugcugaaaga

SEQ ID NO: 608870 - RNA, 19 nt, Homo sapiens
agaugaagguggagcguua

SEQ ID NO: 608871 - RNA, 19 nt, Homo sapiens
ugaaggagcuaaagcaagu

SEQ ID NO: 608872 - RNA, 19 nt, Homo sapiens
aggaagaucucagaaauga

SEQ ID NO: 608873 - RNA, 19 nt, Homo sapiens
agagaucugugcacacuuu

SEQ ID NO: 608874 - RNA, 19 nt, Homo sapiens
ucccagagcuagaauuuga

SEQ ID NO: 608875 - RNA, 19 nt, Homo sapiens
caaagaugcuacagcugaa

SEQ ID NO: 608876 - RNA, 19 nt, Homo sapiens
gaagaucucagaaaugaag

SEQ ID NO: 608877 - RNA, 19 nt, Homo sapiens
uuaaacagcuugugaugca

SEQ ID NO: 608878 - RNA, 19 nt, Homo sapiens
ccucagauaugaccagaga

SEQ ID NO: 608879 - RNA, 19 nt, Homo sapiens
acagaugccucagauauga

SEQ ID NO: 608880 - RNA, 19 nt, Homo sapiens
acaaaucccucacuuuaag

SEQ ID NO: 608881 - RNA, 19 nt, Homo sapiens
gaggaaacccagaaaugaa

SEQ ID NO: 608882 - RNA, 19 nt, Homo sapiens
agaggaagaucucagaaau

SEQ ID NO: 608883 - RNA, 19 nt, Homo sapiens
caugaaggcccacuuuauu

SEQ ID NO: 608884 - RNA, 19 nt, Homo sapiens
ggaaaucccagagcuagaa

SEQ ID NO: 608885 - RNA, 19 nt, Homo sapiens
uaacaugaaggcccacuuu

SEQ ID NO: 608886 - RNA, 19 nt, Homo sapiens
ucacagaugccucagauau

SEQ ID NO: 608887 - RNA, 19 nt, Homo sapiens
gaacagagaaguggugaag

SEQ ID NO: 608888 - RNA, 19 nt, Homo sapiens
gaucaucgaagguaacaug

SEQ ID NO: 608889 - RNA, 19 nt, Homo sapiens
gugugagccuauuguguua

SEQ ID NO: 608890 - RNA, 19 nt, Homo sapiens
caacaugaagcuaguacaa

SEQ ID NO: 608891 - RNA, 19 nt, Homo sapiens
acaugaagcuaguacaaau

SEQ ID NO: 608892 - RNA, 19 nt, Homo sapiens
gcacaaacugcccagaaug

SEQ ID NO: 608893 - RNA, 19 nt, Homo sapiens
gcacgaagggcaaacaaag

SEQ ID NO: 608894 - RNA, 19 nt, Homo sapiens
ggacaugaacagagaagug

SEQ ID NO: 608895 - RNA, 19 nt, Homo sapiens
uggagaagguggaauaaag

SEQ ID NO: 608896 - RNA, 19 nt, Homo sapiens
gaauuggccuaggaggaaa

SEQ ID NO: 608897 - RNA, 19 nt, Homo sapiens
ugaagaugauccugagaug

SEQ ID NO: 608898 - RNA, 19 nt, Homo sapiens
gaccagaucaucgaaggua

SEQ ID NO: 608899 - RNA, 19 nt, Homo sapiens
gccagaagauggaccagau

SEQ ID NO: 608900 - RNA, 19 nt, Homo sapiens
gaaaucuggaggagcagua

SEQ ID NO: 608901 - RNA, 19 nt, Homo sapiens
gaagaugauccugagauga

SEQ ID NO: 608902 - RNA, 19 nt, Homo sapiens
caucgaagguaacaugaag

SEQ ID NO: 608903 - RNA, 19 nt, Homo sapiens
uuaaggagguuaucaucau

SEQ ID NO: 608904 - RNA, 19 nt, Homo sapiens
ggauugaucacccgugcua

SEQ ID NO: 608905 - RNA, 19 nt, Homo sapiens
gaagaggaagaucucagaa

SEQ ID NO: 608906 - RNA, 19 nt, Homo sapiens
cagcgcugcucuuucugua

SEQ ID NO: 608907 - RNA, 19 nt, Homo sapiens
acaguuacuugcagaaugu

SEQ ID NO: 608908 - RNA, 19 nt, Homo sapiens
cgcuaugcaugaacuguua

SEQ ID NO: 608909 - RNA, 19 nt, Homo sapiens
uaaggagguuaucaucaug

SEQ ID NO: 608910 - RNA, 19 nt, Homo sapiens
gagaagguggaauaaaguu

SEQ ID NO: 608911 - RNA, 19 nt, Homo sapiens
gaaggcccacuuuauuaug

SEQ ID NO: 608912 - RNA, 19 nt, Homo sapiens
gaagaagcaccagcagaga

SEQ ID NO: 608913 - RNA, 19 nt, Homo sapiens
cugaaagaauugaugaguu

SEQ ID NO: 608914 - RNA, 19 nt, Homo sapiens
gaucacccgugcuaucucu

SEQ ID NO: 608915 - RNA, 19 nt, Homo sapiens
gaccacuguugaaggauug

SEQ ID NO: 608916 - RNA, 19 nt, Homo sapiens
ggagaagguggaauaaagu

SEQ ID NO: 608917 - RNA, 19 nt, Homo sapiens
ggagagacuacaggaguuu

SEQ ID NO: 608918 - RNA, 19 nt, Homo sapiens
gaccagagaccuccucaag

SEQ ID NO: 608919 - RNA, 19 nt, Homo sapiens
cagcagagaagccagaaga

SEQ ID NO: 608920 - RNA, 19 nt, Homo sapiens
ugcuacagcugaaagaauu

SEQ ID NO: 608921 - RNA, 19 nt, Homo sapiens
ucacccuccuuccacauaa

SEQ ID NO: 608922 - RNA, 19 nt, Homo sapiens
guuacaagcgcaccuuuga

SEQ ID NO: 608923 - RNA, 19 nt, Homo sapiens
caugaacuguuacugcaau

SEQ ID NO: 608924 - RNA, 19 nt, Homo sapiens
ggaccaaugaggugaaauc

SEQ ID NO: 608925 - RNA, 19 nt, Homo sapiens
gaggaagaucucagaaaug

SEQ ID NO: 608926 - RNA, 19 nt, Homo sapiens
uggaggacaugaacagaga

SEQ ID NO: 608927 - RNA, 19 nt, Homo sapiens
ugaccacuguugaaggauu

SEQ ID NO: 608928 - RNA, 19 nt, Homo sapiens
gaagguggaauaaaguuac

SEQ ID NO: 608929 - RNA, 19 nt, Homo sapiens
gaagacagagggcuaugag

SEQ ID NO: 608930 - RNA, 19 nt, Homo sapiens
aagaugauccugagaugaa

SEQ ID NO: 608931 - RNA, 19 nt, Homo sapiens
gaauguguaugcgccugaa

SEQ ID NO: 608932 - RNA, 19 nt, Homo sapiens
gaagggcugcugaaagaca

SEQ ID NO: 608933 - RNA, 19 nt, Homo sapiens
gaagguggagcguuacaag

SEQ ID NO: 608934 - RNA, 19 nt, Homo sapiens
uguaugcgccugaagauga

SEQ ID NO: 608935 - RNA, 19 nt, Homo sapiens
ugaaggcccacuuuauuau

SEQ ID NO: 608936 - RNA, 19 nt, Homo sapiens
augaaggcccacuuuauua

SEQ ID NO: 608937 - RNA, 19 nt, Homo sapiens
gcaagugugagccuauugu

SEQ ID NO: 608938 - RNA, 19 nt, Homo sapiens
gaaacaguuacuugcagaa

SEQ ID NO: 608939 - RNA, 19 nt, Homo sapiens
caaguucaccacacuggaa

SEQ ID NO: 608940 - RNA, 19 nt, Homo sapiens
uacaaaucccucacuuuaa

SEQ ID NO: 608941 - RNA, 19 nt, Homo sapiens
gcaaguagccuccccuuuc

SEQ ID NO: 608942 - RNA, 19 nt, Homo sapiens
uguguuacuugaccuuauu

SEQ ID NO: 608943 - RNA, 19 nt, Homo sapiens
gagagacuacaggaguuua

SEQ ID NO: 608944 - RNA, 19 nt, Homo sapiens
aaggagcucugaccacugu

SEQ ID NO: 608945 - RNA, 19 nt, Homo sapiens
ugaauuggccuaggaggaa

SEQ ID NO: 608946 - RNA, 19 nt, Homo sapiens
acagagaaguggugaagac

SEQ ID NO: 608947 - RNA, 19 nt, Homo sapiens
cggagagacuacaggaguu

SEQ ID NO: 608948 - RNA, 19 nt, Homo sapiens
ggacagacggagagacuac

SEQ ID NO: 608949 - RNA, 19 nt, Homo sapiens
agaagguggaauaaaguua

SEQ ID NO: 608950 - RNA, 19 nt, Homo sapiens
gagccuauuguguuacuug

SEQ ID NO: 608951 - RNA, 19 nt, Homo sapiens
cacaugcuccucagaaaga

SEQ ID NO: 608952 - RNA, 19 nt, Homo sapiens
ugaaauuccugccuuuagc

SEQ ID NO: 608953 - RNA, 19 nt, Homo sapiens
ugaaagacauccgggaacu

SEQ ID NO: 608954 - RNA, 19 nt, Homo sapiens
gagaucgagucgcuaugca

SEQ ID NO: 608955 - RNA, 19 nt, Homo sapiens
cagcacaaacugcccagaa

SEQ ID NO: 608956 - RNA, 19 nt, Homo sapiens
cagcugaaagaauugauga

SEQ ID NO: 608957 - RNA, 19 nt, Homo sapiens
ucugaccacuguugaagga

SEQ ID NO: 608958 - RNA, 19 nt, Homo sapiens
guaugcgccugaagaugau

SEQ ID NO: 608959 - RNA, 19 nt, Homo sapiens
caaguagccuccccuuuca

SEQ ID NO: 608960 - RNA, 19 nt, Homo sapiens
ggauuccugagcuagauuu

SEQ ID NO: 608961 - RNA, 19 nt, Homo sapiens
gaaggcugggagugucuuu

SEQ ID NO: 608962 - RNA, 19 nt, Homo sapiens
gaugaucgcugcauaaaua

SEQ ID NO: 608963 - RNA, 19 nt, Homo sapiens
gcaagaggcuuuagaaucu

SEQ ID NO: 608964 - RNA, 19 nt, Homo sapiens
caaacagacuccaucauuu

SEQ ID NO: 608965 - RNA, 19 nt, Homo sapiens
ugaaacaaauggacgaaua

SEQ ID NO: 608966 - RNA, 19 nt, Homo sapiens
gcaagcaccuuaaguagug

SEQ ID NO: 608967 - RNA, 19 nt, Homo sapiens
ggaauaugguuuaucugua

SEQ ID NO: 608968 - RNA, 19 nt, Homo sapiens
guaaucauguugccaaauu

SEQ ID NO: 608969 - RNA, 19 nt, Homo sapiens
aaggagagcugcuaaauug

SEQ ID NO: 608970 - RNA, 19 nt, Homo sapiens
gcauaaauaucaccaaaca

SEQ ID NO: 608971 - RNA, 19 nt, Homo sapiens
gcucauguuugccuaauaa

SEQ ID NO: 608972 - RNA, 19 nt, Homo sapiens
gaacacagcacuaaauaca

SEQ ID NO: 608973 - RNA, 19 nt, Homo sapiens
gcacagugguauagugaaa

SEQ ID NO: 608974 - RNA, 19 nt, Homo sapiens
aaagaggacuucagagauu

SEQ ID NO: 608975 - RNA, 19 nt, Homo sapiens
gaagauauaggaaaguuga

SEQ ID NO: 608976 - RNA, 19 nt, Homo sapiens
caaagagggucaaggaaau

SEQ ID NO: 608977 - RNA, 19 nt, Homo sapiens
cauauggacuaguugguua

SEQ ID NO: 608978 - RNA, 19 nt, Homo sapiens
gagagcugcuaaauuguuu

SEQ ID NO: 608979 - RNA, 19 nt, Homo sapiens
caccuuaaguaguguguua

SEQ ID NO: 608980 - RNA, 19 nt, Homo sapiens
gaacauccaguaauagaau

SEQ ID NO: 608981 - RNA, 19 nt, Homo sapiens
ggugaaagaugauuauguc

SEQ ID NO: 608982 - RNA, 19 nt, Homo sapiens
ggguagauauccaggagua

SEQ ID NO: 608983 - RNA, 19 nt, Homo sapiens
gaauaugguuuggauacaa

SEQ ID NO: 608984 - RNA, 19 nt, Homo sapiens
gauuuuagcucgugccuua

SEQ ID NO: 608985 - RNA, 19 nt, Homo sapiens
ggauugugaucauagcuaa

SEQ ID NO: 608986 - RNA, 19 nt, Homo sapiens
caaggaaauuuaccuguuc

SEQ ID NO: 608987 - RNA, 19 nt, Homo sapiens
ccaaacagacuccaucauu

SEQ ID NO: 608988 - RNA, 19 nt, Homo sapiens
uaggaaaguugaagucuug

SEQ ID NO: 608989 - RNA, 19 nt, Homo sapiens
ucaaggaaauuuaccuguu

SEQ ID NO: 608990 - RNA, 19 nt, Homo sapiens
ugggaaagcugcucaagga

SEQ ID NO: 608991 - RNA, 19 nt, Homo sapiens
gguauugguucguuuacaa

SEQ ID NO: 608992 - RNA, 19 nt, Homo sapiens
ugaagaauaugguuuggau

SEQ ID NO: 608993 - RNA, 19 nt, Homo sapiens
cacaauuccugauaugauu

SEQ ID NO: 608994 - RNA, 19 nt, Homo sapiens
caagcaguauugaagauau

SEQ ID NO: 608995 - RNA, 19 nt, Homo sapiens
ugaagaagauauaggaaag

SEQ ID NO: 608996 - RNA, 19 nt, Homo sapiens
ccaaagagggucaaggaaa

SEQ ID NO: 608997 - RNA, 19 nt, Homo sapiens
ggacaauccagauaaugaa

SEQ ID NO: 608998 - RNA, 19 nt, Homo sapiens
uaccauugcugcauucuug

SEQ ID NO: 608999 - RNA, 19 nt, Homo sapiens
ccaaauugcugcaguccau

SEQ ID NO: 609000 - RNA, 19 nt, Homo sapiens
ggacuucagagauuugauu

SEQ ID NO: 609001 - RNA, 19 nt, Homo sapiens
gauaagccauuuccugaac

SEQ ID NO: 609002 - RNA, 19 nt, Homo sapiens
ggacuaguugguuauauga

SEQ ID NO: 609003 - RNA, 19 nt, Homo sapiens
ucacuacgcuuagcagaug

SEQ ID NO: 609004 - RNA, 19 nt, Homo sapiens
gaagaugcuggaaacaauu

SEQ ID NO: 609005 - RNA, 19 nt, Homo sapiens
cacaggaacugaaauucuu

SEQ ID NO: 609006 - RNA, 19 nt, Homo sapiens
ggagagcugcuaaauuguu

SEQ ID NO: 609007 - RNA, 19 nt, Homo sapiens
ucaggaauaugguuuaucu

SEQ ID NO: 609008 - RNA, 19 nt, Homo sapiens
gcagauucaggcaaauaua

SEQ ID NO: 609009 - RNA, 19 nt, Homo sapiens
gcacaauuccugauaugau

SEQ ID NO: 609010 - RNA, 19 nt, Homo sapiens
cagaagaugaagagaauuu

SEQ ID NO: 609011 - RNA, 19 nt, Homo sapiens
gaagcaguaucggcaagaa

SEQ ID NO: 609012 - RNA, 19 nt, Homo sapiens
uaaugaugaucgcugcaua

SEQ ID NO: 609013 - RNA, 19 nt, Homo sapiens
agaagaugcuggaaacaau

SEQ ID NO: 609014 - RNA, 19 nt, Homo sapiens
guuacgggcuguugauaga

SEQ ID NO: 609015 - RNA, 19 nt, Homo sapiens
auccuuagcugaagaauau

SEQ ID NO: 609016 - RNA, 19 nt, Homo sapiens
gugaacacagcacuaaaua

SEQ ID NO: 609017 - RNA, 19 nt, Homo sapiens
caaauggacgaauaccuaa

SEQ ID NO: 609018 - RNA, 19 nt, Homo sapiens
gaagaauaugguuuggaua

SEQ ID NO: 609019 - RNA, 19 nt, Homo sapiens
cagcaauucugcauuucuu

SEQ ID NO: 609020 - RNA, 19 nt, Homo sapiens
gcacuaaauacaacucaga

SEQ ID NO: 609021 - RNA, 19 nt, Homo sapiens
ucagagauuugauuagaca

SEQ ID NO: 609022 - RNA, 19 nt, Homo sapiens
acaaauggacgaauaccua

SEQ ID NO: 609023 - RNA, 19 nt, Homo sapiens
uaggacauauggacuaguu

SEQ ID NO: 609024 - RNA, 19 nt, Homo sapiens
cagaguccauuucagagaa

SEQ ID NO: 609025 - RNA, 19 nt, Homo sapiens
ucacaaacuucagcaacuu

SEQ ID NO: 609026 - RNA, 19 nt, Homo sapiens
uuuagaaucugcucauguu

SEQ ID NO: 609027 - RNA, 19 nt, Homo sapiens
gaggcacaauuccugauau

SEQ ID NO: 609028 - RNA, 19 nt, Homo sapiens
cuucagagauuugauuaga

SEQ ID NO: 609029 - RNA, 19 nt, Homo sapiens
gagaagaugcuggaaacaa

SEQ ID NO: 609030 - RNA, 19 nt, Homo sapiens
guaauugccuucggguugu

SEQ ID NO: 609031 - RNA, 19 nt, Homo sapiens
cauacuccauggauuguga

SEQ ID NO: 609032 - RNA, 19 nt, Homo sapiens
guaguguguuaaugauuga

SEQ ID NO: 609033 - RNA, 19 nt, Homo sapiens
caagaggucaucaaaauaa

SEQ ID NO: 609034 - RNA, 19 nt, Homo sapiens
gcaaaacguuuaccgugaa

SEQ ID NO: 609035 - RNA, 19 nt, Homo sapiens
acucagaucccaagcagua

SEQ ID NO: 609036 - RNA, 19 nt, Homo sapiens
ucaaggagcagaaguacga

SEQ ID NO: 609037 - RNA, 19 nt, Homo sapiens
cugcauaaauaucaccaaa

SEQ ID NO: 609038 - RNA, 19 nt, Homo sapiens
gaaacaaauggacgaauac

SEQ ID NO: 609039 - RNA, 19 nt, Homo sapiens
uagguuuacuguuguaguu

SEQ ID NO: 609040 - RNA, 19 nt, Homo sapiens
ggcaagaggcuuuagaauc

SEQ ID NO: 609041 - RNA, 19 nt, Homo sapiens
uaaaggagagcugcuaaau

SEQ ID NO: 609042 - RNA, 19 nt, Homo sapiens
uaucuguaauggugaaaga

SEQ ID NO: 609043 - RNA, 19 nt, Homo sapiens
gauccuuagcugaagaaua

SEQ ID NO: 609044 - RNA, 19 nt, Homo sapiens
gccauuuccugaacugaga

SEQ ID NO: 609045 - RNA, 19 nt, Homo sapiens
aaaggagagcugcuaaauu

SEQ ID NO: 609046 - RNA, 19 nt, Homo sapiens
gaaaguugaagucuugucu

SEQ ID NO: 609047 - RNA, 19 nt, Homo sapiens
uaaacaacaggguagauau

SEQ ID NO: 609048 - RNA, 19 nt, Homo sapiens
ccagguauugguucguuua

SEQ ID NO: 609049 - RNA, 19 nt, Homo sapiens
gaucgcugcauaaauauca

SEQ ID NO: 609050 - RNA, 19 nt, Homo sapiens
uccagaagaugaagagaau

SEQ ID NO: 609051 - RNA, 19 nt, Homo sapiens
cauguuugccuaauaaaug

SEQ ID NO: 609052 - RNA, 19 nt, Homo sapiens
aguaguguguuaaugauug

SEQ ID NO: 609053 - RNA, 19 nt, Homo sapiens
ggauacaauuaacaaggau

SEQ ID NO: 609054 - RNA, 19 nt, Homo sapiens
uggauacaauuaacaagga

SEQ ID NO: 609055 - RNA, 19 nt, Homo sapiens
acacagcacuaaauacaac

SEQ ID NO: 609056 - RNA, 19 nt, Homo sapiens
ggguugugcuuuagucugu

SEQ ID NO: 609057 - RNA, 19 nt, Homo sapiens
gagaacauuuucaguccua

SEQ ID NO: 609058 - RNA, 19 nt, Homo sapiens
cacauaccauugcugcauu

SEQ ID NO: 609059 - RNA, 19 nt, Homo sapiens
augauuauguccacgaauu

SEQ ID NO: 609060 - RNA, 19 nt, Homo sapiens
uaaucauguugccaaauug

SEQ ID NO: 609061 - RNA, 19 nt, Homo sapiens
aagaggacuucagagauuu

SEQ ID NO: 609062 - RNA, 19 nt, Homo sapiens
gauaauggcuucugauuca

SEQ ID NO: 609063 - RNA, 19 nt, Homo sapiens
ccucugagauggacacuua

SEQ ID NO: 609064 - RNA, 19 nt, Homo sapiens
aaacagcacucugguuaua

SEQ ID NO: 609065 - RNA, 19 nt, Homo sapiens
ugaaguaaguggcuagaaa

SEQ ID NO: 609066 - RNA, 19 nt, Homo sapiens
ggacaggccuggaugaucu

SEQ ID NO: 609067 - RNA, 19 nt, Homo sapiens
gggaauagaagauccauuu

SEQ ID NO: 609068 - RNA, 19 nt, Homo sapiens
caacauagccauaguccuu

SEQ ID NO: 609069 - RNA, 19 nt, Homo sapiens
ucagagaucuaccgauuug

SEQ ID NO: 609070 - RNA, 19 nt, Homo sapiens
cgucagagaucuaccgauu

SEQ ID NO: 609071 - RNA, 19 nt, Homo sapiens
agaaacagcacucugguua

SEQ ID NO: 609072 - RNA, 19 nt, Homo sapiens
gcugauaccugcacacauc

SEQ ID NO: 609073 - RNA, 19 nt, Homo sapiens
gagcuucgauucaauaaaa

SEQ ID NO: 609074 - RNA, 19 nt, Homo sapiens
ggacugacucuccaccaua

SEQ ID NO: 609075 - RNA, 19 nt, Homo sapiens
ucaugaugcucuccuuaua

SEQ ID NO: 609076 - RNA, 19 nt, Homo sapiens
gacugacucuccaccauaa

SEQ ID NO: 609077 - RNA, 19 nt, Homo sapiens
ugaucuagcucauaccaaa

SEQ ID NO: 609078 - RNA, 19 nt, Homo sapiens
ggacucuucugccuuggaa

SEQ ID NO: 609079 - RNA, 19 nt, Homo sapiens
gcuaugggcugcuuugucu

SEQ ID NO: 609080 - RNA, 19 nt, Homo sapiens
gaauagaagauccauuugu

SEQ ID NO: 609081 - RNA, 19 nt, Homo sapiens
ccucgacacuggccuguuu

SEQ ID NO: 609082 - RNA, 19 nt, Homo sapiens
cugcugugcucuccuguua

SEQ ID NO: 609083 - RNA, 19 nt, Homo sapiens
gccauaguccuuugaagua

SEQ ID NO: 609084 - RNA, 19 nt, Homo sapiens
ugucauccgugcucuguuu

SEQ ID NO: 609085 - RNA, 19 nt, Homo sapiens
gcaaauguggauccaagaa

SEQ ID NO: 609086 - RNA, 19 nt, Homo sapiens
gcugugcucuccuguuaug

SEQ ID NO: 609087 - RNA, 19 nt, Homo sapiens
gaacugugaccuucaucuu

SEQ ID NO: 609088 - RNA, 19 nt, Homo sapiens
aaacuaccauuggaccuaa

SEQ ID NO: 609089 - RNA, 19 nt, Homo sapiens
ccauaguccuuugaaguaa

SEQ ID NO: 609090 - RNA, 19 nt, Homo sapiens
gcucuaugcuccgucauug

SEQ ID NO: 609091 - RNA, 19 nt, Homo sapiens
gaaacagcacucugguuau

SEQ ID NO: 609092 - RNA, 19 nt, Homo sapiens
caagaaaccagggccauga

SEQ ID NO: 609093 - RNA, 19 nt, Homo sapiens
gagauggacacuuaagaga

SEQ ID NO: 609094 - RNA, 19 nt, Homo sapiens
gaccuugguucccugaguu

SEQ ID NO: 609095 - RNA, 19 nt, Homo sapiens
aauagaagauccauuuguc

SEQ ID NO: 609096 - RNA, 19 nt, Homo sapiens
ggucgcggcuucgcagaaa

SEQ ID NO: 609097 - RNA, 19 nt, Homo sapiens
gcaggaucaugccagaaau

SEQ ID NO: 609098 - RNA, 19 nt, Homo sapiens
gucauggccuucuggauug

SEQ ID NO: 609099 - RNA, 19 nt, Homo sapiens
caaauguggauccaagaaa

SEQ ID NO: 609100 - RNA, 19 nt, Homo sapiens
ggaauagaagauccauuug

SEQ ID NO: 609101 - RNA, 19 nt, Homo sapiens
ccugaacccugcaaccauu

SEQ ID NO: 609102 - RNA, 19 nt, Homo sapiens
gcagcaaucagcaucuuug

SEQ ID NO: 609103 - RNA, 19 nt, Homo sapiens
gaguuucuucuccacauua

SEQ ID NO: 609104 - RNA, 19 nt, Homo sapiens
cagcaucuuuggcaugguu

SEQ ID NO: 609105 - RNA, 19 nt, Homo sapiens
gcacucugguuauaauugc

SEQ ID NO: 609106 - RNA, 19 nt, Homo sapiens
cgucauggccuucuggauu

SEQ ID NO: 609107 - RNA, 19 nt, Homo sapiens
gcaacuggcugcagaucac

SEQ ID NO: 609108 - RNA, 19 nt, Homo sapiens
gagcucacccuggacagua

SEQ ID NO: 609109 - RNA, 19 nt, Homo sapiens
aggagaagcugucacaucu

SEQ ID NO: 609110 - RNA, 19 nt, Homo sapiens
ggaugagucuugguguguu

SEQ ID NO: 609111 - RNA, 19 nt, Homo sapiens
gugcagcgguaccucaguu

SEQ ID NO: 609112 - RNA, 19 nt, Homo sapiens
ucucgucgcuugccaaucu

SEQ ID NO: 609113 - RNA, 19 nt, Homo sapiens
caacuccaccacagugauu

SEQ ID NO: 609114 - RNA, 19 nt, Homo sapiens
gggcugcuuugucuaggaa

SEQ ID NO: 609115 - RNA, 19 nt, Homo sapiens
gcacaagcgugggcauguc

SEQ ID NO: 609116 - RNA, 19 nt, Homo sapiens
gcacuauauccucugcuuu

SEQ ID NO: 609117 - RNA, 19 nt, Homo sapiens
ucauuggccuggucauguu

SEQ ID NO: 609118 - RNA, 19 nt, Homo sapiens
ggaggaagacugugagacu

SEQ ID NO: 609119 - RNA, 19 nt, Homo sapiens
gaaaagggagcgauguuga

SEQ ID NO: 609120 - RNA, 19 nt, Homo sapiens
gaaguaaguggcuagaaac

SEQ ID NO: 609121 - RNA, 19 nt, Homo sapiens
gaugagucuugguguguuc

SEQ ID NO: 609122 - RNA, 19 nt, Homo sapiens
gcaaccauuuacccagugu

SEQ ID NO: 609123 - RNA, 19 nt, Homo sapiens
cagaggccacccuguagua

SEQ ID NO: 609124 - RNA, 19 nt, Homo sapiens
acacugaugcccuugacua

SEQ ID NO: 609125 - RNA, 19 nt, Homo sapiens
acagcacucugguuauaau

SEQ ID NO: 609126 - RNA, 19 nt, Homo sapiens
gguucuauuccuugucuua

SEQ ID NO: 609127 - RNA, 19 nt, Homo sapiens
caacuguuacgauggaaga

SEQ ID NO: 609128 - RNA, 19 nt, Homo sapiens
cagaccaguucguccugua

SEQ ID NO: 609129 - RNA, 19 nt, Homo sapiens
caugggaguugugcucuau

SEQ ID NO: 609130 - RNA, 19 nt, Homo sapiens
caggaucaugccagaaaua

SEQ ID NO: 609131 - RNA, 19 nt, Homo sapiens
gguucucucucuugccauu

SEQ ID NO: 609132 - RNA, 19 nt, Homo sapiens
ccauuugucuuuguguaga

SEQ ID NO: 609133 - RNA, 19 nt, Homo sapiens
uuaauucauuggcaacugu

SEQ ID NO: 609134 - RNA, 19 nt, Homo sapiens
uaccaggaguaucccauga

SEQ ID NO: 609135 - RNA, 19 nt, Homo sapiens
gcagcuggcaguuaucauc

SEQ ID NO: 609136 - RNA, 19 nt, Homo sapiens
gugacuggcuuugaucugu

SEQ ID NO: 609137 - RNA, 19 nt, Homo sapiens
gaagcugucacaucucaag

SEQ ID NO: 609138 - RNA, 19 nt, Homo sapiens
agaccucccugugauguug

SEQ ID NO: 609139 - RNA, 19 nt, Homo sapiens
gaagaccugauucgaccuu

SEQ ID NO: 609140 - RNA, 19 nt, Homo sapiens
gaguaucccaugagcauuc

SEQ ID NO: 609141 - RNA, 19 nt, Homo sapiens
acugugaccuucaucuuuc

SEQ ID NO: 609142 - RNA, 19 nt, Homo sapiens
gcgguucuauuccuugucu

SEQ ID NO: 609143 - RNA, 19 nt, Homo sapiens
uggcaacuguuacgaugga

SEQ ID NO: 609144 - RNA, 19 nt, Homo sapiens
ucgggcagcuggcaguuau

SEQ ID NO: 609145 - RNA, 19 nt, Homo sapiens
uccgugcucuguuuccuuu

SEQ ID NO: 609146 - RNA, 19 nt, Homo sapiens
aaauguggauccaagaaac

SEQ ID NO: 609147 - RNA, 19 nt, Homo sapiens
guguagagcaagcacguuu

SEQ ID NO: 609148 - RNA, 19 nt, Homo sapiens
ccacagugagccccuauua

SEQ ID NO: 609149 - RNA, 19 nt, Homo sapiens
aagauaauggcuucugauu

SEQ ID NO: 609150 - RNA, 19 nt, Homo sapiens
ugcgugggcugccucauug

SEQ ID NO: 609151 - RNA, 19 nt, Homo sapiens
ggccgcaucucuggguuug

SEQ ID NO: 609152 - RNA, 19 nt, Homo sapiens
ucaccagugccuaugagua

SEQ ID NO: 609153 - RNA, 19 nt, Homo sapiens
gagccccuauuauuacuuu

SEQ ID NO: 609154 - RNA, 19 nt, Homo sapiens
ucuauuccuugucuuacuu

SEQ ID NO: 609155 - RNA, 19 nt, Homo sapiens
ugugauggaucuccugaag

SEQ ID NO: 609156 - RNA, 19 nt, Homo sapiens
gccguggugucauuucugu

SEQ ID NO: 609157 - RNA, 19 nt, Homo sapiens
gcggcucucucagcacuau

SEQ ID NO: 609158 - RNA, 19 nt, Homo sapiens
guaccuggagcuucgauuc

SEQ ID NO: 609159 - RNA, 19 nt, Homo sapiens
cugucuaccuccauucuga

SEQ ID NO: 609160 - RNA, 19 nt, Homo sapiens
gauucaacauagccauagu

SEQ ID NO: 609161 - RNA, 19 nt, Homo sapiens
gcugucacaucucaagcau

SEQ ID NO: 609162 - RNA, 19 nt, Homo sapiens
gaagaggaauuaaagcaaa

SEQ ID NO: 609163 - RNA, 19 nt, Homo sapiens
ccagaaauccacuguauua

SEQ ID NO: 609164 - RNA, 19 nt, Homo sapiens
gggcaugccuugcucauuu

SEQ ID NO: 609165 - RNA, 19 nt, Homo sapiens
gcaaugcagucuuccaauu

SEQ ID NO: 609166 - RNA, 19 nt, Homo sapiens
ggacuuaccuaacaagagu

SEQ ID NO: 609167 - RNA, 19 nt, Homo sapiens
gaaauaccacuaugaguug

SEQ ID NO: 609168 - RNA, 19 nt, Homo sapiens
gaagucgacuggauuguuc

SEQ ID NO: 609169 - RNA, 19 nt, Homo sapiens
caaggaauaucugguguuu

SEQ ID NO: 609170 - RNA, 19 nt, Homo sapiens
ccaagaaaguugagaaauc

SEQ ID NO: 609171 - RNA, 19 nt, Homo sapiens
gcauauaagucauacauac

SEQ ID NO: 609172 - RNA, 19 nt, Homo sapiens
uuaaggagcugaugacuca

SEQ ID NO: 609173 - RNA, 19 nt, Homo sapiens
gaagaaacaaugggaagua

SEQ ID NO: 609174 - RNA, 19 nt, Homo sapiens
gaucugaacgucaacagua

SEQ ID NO: 609175 - RNA, 19 nt, Homo sapiens
cgaugaaacuccugcguaa

SEQ ID NO: 609176 - RNA, 19 nt, Homo sapiens
aagaagcaccuuaagauua

SEQ ID NO: 609177 - RNA, 19 nt, Homo sapiens
gaagccagauaaugaugaa

SEQ ID NO: 609178 - RNA, 19 nt, Homo sapiens
gcacagaaacuugguaaug

SEQ ID NO: 609179 - RNA, 19 nt, Homo sapiens
gaaacaaugggaaguagaa

SEQ ID NO: 609180 - RNA, 19 nt, Homo sapiens
ugaaaaugcugcaguauaa

SEQ ID NO: 609181 - RNA, 19 nt, Homo sapiens
gaaagugccgagacuacua

SEQ ID NO: 609182 - RNA, 19 nt, Homo sapiens
gaacacaugccuuccuuuc

SEQ ID NO: 609183 - RNA, 19 nt, Homo sapiens
uaaauaucccucccucaua

SEQ ID NO: 609184 - RNA, 19 nt, Homo sapiens
gaaauccacuguauuaacc

SEQ ID NO: 609185 - RNA, 19 nt, Homo sapiens
gaagcagugggaaauauaa

SEQ ID NO: 609186 - RNA, 19 nt, Homo sapiens
ugaaauaccacuaugaguu

SEQ ID NO: 609187 - RNA, 19 nt, Homo sapiens
gaaagaagaagcuuauggu

SEQ ID NO: 609188 - RNA, 19 nt, Homo sapiens
agggaaaucugaagaagaa

SEQ ID NO: 609189 - RNA, 19 nt, Homo sapiens
ucacgucucucuuuuauuu

SEQ ID NO: 609190 - RNA, 19 nt, Homo sapiens
gcacugagcacuguuacuu

SEQ ID NO: 609191 - RNA, 19 nt, Homo sapiens
gaggauacuucguuugcuu

SEQ ID NO: 609192 - RNA, 19 nt, Homo sapiens
aaugugggcuuaucagaaa

SEQ ID NO: 609193 - RNA, 19 nt, Homo sapiens
cggaugacccuaaggaaua

SEQ ID NO: 609194 - RNA, 19 nt, Homo sapiens
guaaugggaucaacaucau

SEQ ID NO: 609195 - RNA, 19 nt, Homo sapiens
agaagcaccuuaagauuag

SEQ ID NO: 609196 - RNA, 19 nt, Homo sapiens
gaacgucaacaguaaugaa

SEQ ID NO: 609197 - RNA, 19 nt, Homo sapiens
gaauaucugguguuucuug

SEQ ID NO: 609198 - RNA, 19 nt, Homo sapiens
gaagaccuggcaaggauuu

SEQ ID NO: 609199 - RNA, 19 nt, Homo sapiens
gaaugugggcuuaucagaa

SEQ ID NO: 609200 - RNA, 19 nt, Homo sapiens
gaagcggaaccucaaauug

SEQ ID NO: 609201 - RNA, 19 nt, Homo sapiens
gagauuccuucugcucuuu

SEQ ID NO: 609202 - RNA, 19 nt, Homo sapiens
gauaauggguggcaguaac

SEQ ID NO: 609203 - RNA, 19 nt, Homo sapiens
cuuauucucucaccuacua

SEQ ID NO: 609204 - RNA, 19 nt, Homo sapiens
uaucugguguuucuuguga

SEQ ID NO: 609205 - RNA, 19 nt, Homo sapiens
ccucaaaucugacccuauc

SEQ ID NO: 609206 - RNA, 19 nt, Homo sapiens
acaaguguauguuaccauu

SEQ ID NO: 609207 - RNA, 19 nt, Homo sapiens
ccaggaagcauauaaguca

SEQ ID NO: 609208 - RNA, 19 nt, Homo sapiens
ggaugacccuaaggaauau

SEQ ID NO: 609209 - RNA, 19 nt, Homo sapiens
gaagaaagugccgagacua

SEQ ID NO: 609210 - RNA, 19 nt, Homo sapiens
ucagguugcucugucauuu

SEQ ID NO: 609211 - RNA, 19 nt, Homo sapiens
gaaaagagucucagguuau

SEQ ID NO: 609212 - RNA, 19 nt, Homo sapiens
aagaagaaccgaaagaaga

SEQ ID NO: 609213 - RNA, 19 nt, Homo sapiens
ugaugaagcugaucguauc

SEQ ID NO: 609214 - RNA, 19 nt, Homo sapiens
ucucaucccugcaguugaa

SEQ ID NO: 609215 - RNA, 19 nt, Homo sapiens
ggaggcaugucucaagaag

SEQ ID NO: 609216 - RNA, 19 nt, Homo sapiens
gaaaguugagaaauccaaa

SEQ ID NO: 609217 - RNA, 19 nt, Homo sapiens
uggagaagccagauaauga

SEQ ID NO: 609218 - RNA, 19 nt, Homo sapiens
caaagggaaaucugaagaa

SEQ ID NO: 609219 - RNA, 19 nt, Homo sapiens
caagaagcagugggaaaua

SEQ ID NO: 609220 - RNA, 19 nt, Homo sapiens
uuucucagguguugcauuu

SEQ ID NO: 609221 - RNA, 19 nt, Homo sapiens
caaccacauucuuccaguu

SEQ ID NO: 609222 - RNA, 19 nt, Homo sapiens
ucuaaugacuccuccugaa

SEQ ID NO: 609223 - RNA, 19 nt, Homo sapiens
aggaauaucugguguuucu

SEQ ID NO: 609224 - RNA, 19 nt, Homo sapiens
acacaugccuuccuuucau

SEQ ID NO: 609225 - RNA, 19 nt, Homo sapiens
caagaaaguugagaaaucc

SEQ ID NO: 609226 - RNA, 19 nt, Homo sapiens
guaaugaaggcaagcagaa

SEQ ID NO: 609227 - RNA, 19 nt, Homo sapiens
acagggauauguuguuugu

SEQ ID NO: 609228 - RNA, 19 nt, Homo sapiens
gcagcggaaccuaaaguuu

SEQ ID NO: 609229 - RNA, 19 nt, Homo sapiens
ugucacaccugccgaugaa

SEQ ID NO: 609230 - RNA, 19 nt, Homo sapiens
ggaccuugacaguaucuaa

SEQ ID NO: 609231 - RNA, 19 nt, Homo sapiens
uugcugaacuacauugauu

SEQ ID NO: 609232 - RNA, 19 nt, Homo sapiens
caucuuguaugucugugaa

SEQ ID NO: 609233 - RNA, 19 nt, Homo sapiens
ggagaagccagauaaugau

SEQ ID NO: 609234 - RNA, 19 nt, Homo sapiens
agaaaagagucucagguua

SEQ ID NO: 609235 - RNA, 19 nt, Homo sapiens
aaauaucccucccucauac

SEQ ID NO: 609236 - RNA, 19 nt, Homo sapiens
uaaauugacuuggguugca

SEQ ID NO: 609237 - RNA, 19 nt, Homo sapiens
uggcaaggauuucucugaa

SEQ ID NO: 609238 - RNA, 19 nt, Homo sapiens
cagauaaugaugaagauga

SEQ ID NO: 609239 - RNA, 19 nt, Homo sapiens
gacuagacauuccugaagu

SEQ ID NO: 609240 - RNA, 19 nt, Homo sapiens
ggacuagacauuccugaag

SEQ ID NO: 609241 - RNA, 19 nt, Homo sapiens
gaugauaaagcgaaugcaa

SEQ ID NO: 609242 - RNA, 19 nt, Homo sapiens
gguaaugggaucaacauca

SEQ ID NO: 609243 - RNA, 19 nt, Homo sapiens
aaacaaagggaaaucugaa

SEQ ID NO: 609244 - RNA, 19 nt, Homo sapiens
ggauuuggcuaccagaaaa

SEQ ID NO: 609245 - RNA, 19 nt, Homo sapiens
ggaagcauauaagucauac

SEQ ID NO: 609246 - RNA, 19 nt, Homo sapiens
ggaaagcaaaagcaaaaua

SEQ ID NO: 609247 - RNA, 19 nt, Homo sapiens
aaggagccauuguauguug

SEQ ID NO: 609248 - RNA, 19 nt, Homo sapiens
cacagaaacuugguaaugg

SEQ ID NO: 609249 - RNA, 19 nt, Homo sapiens
gaaaucugaagaagaaagu

SEQ ID NO: 609250 - RNA, 19 nt, Homo sapiens
caagcacugagcacuguua

SEQ ID NO: 609251 - RNA, 19 nt, Homo sapiens
ugcagugucugguuauuga

SEQ ID NO: 609252 - RNA, 19 nt, Homo sapiens
aagaagcagugggaaauau

SEQ ID NO: 609253 - RNA, 19 nt, Homo sapiens
ugaaacuccugcguaagaa

SEQ ID NO: 609254 - RNA, 19 nt, Homo sapiens
acuauggguuguaauuuga

SEQ ID NO: 609255 - RNA, 19 nt, Homo sapiens
ggcuuuaaguuucuugguu

SEQ ID NO: 609256 - RNA, 19 nt, Homo sapiens
uaagguucaugaccaggaa

SEQ ID NO: 609257 - RNA, 19 nt, Homo sapiens
gacaggagcuuuugaggau

SEQ ID NO: 609258 - RNA, 19 nt, Homo sapiens
aagcagcaaugcagucuuc

SEQ ID NO: 609259 - RNA, 19 nt, Homo sapiens
cagcggaaccuaaaguuuc

SEQ ID NO: 609260 - RNA, 19 nt, Homo sapiens
ucuuggaccuugacaguau

SEQ ID NO: 609261 - RNA, 19 nt, Homo sapiens
gcaaggaauaucugguguu

SEQ ID NO: 609262 - RNA, 19 nt, Homo sapiens
gauauuaccuuccaaauga

SEQ ID NO: 609263 - RNA, 19 nt, Homo sapiens
aaagagaacuuaaccauga

SEQ ID NO: 609264 - RNA, 19 nt, Homo sapiens
gagcaugacuacuaaauau

SEQ ID NO: 609265 - RNA, 19 nt, Homo sapiens
gagaacaacuugaauguca

SEQ ID NO: 609266 - RNA, 19 nt, Homo sapiens
gaagagaaguugaagaucu

SEQ ID NO: 609267 - RNA, 19 nt, Homo sapiens
caaagaaauugcugacaaa

SEQ ID NO: 609268 - RNA, 19 nt, Homo sapiens
gaacaaagaaagcgugauu

SEQ ID NO: 609269 - RNA, 19 nt, Homo sapiens
guacugcucgugauuauua

SEQ ID NO: 609270 - RNA, 19 nt, Homo sapiens
gaagauauugugucaguaa

SEQ ID NO: 609271 - RNA, 19 nt, Homo sapiens
guauuagugugcuagauua

SEQ ID NO: 609272 - RNA, 19 nt, Homo sapiens
gcaguucccuccugacuau

SEQ ID NO: 609273 - RNA, 19 nt, Homo sapiens
ccaaagaaauugcugacaa

SEQ ID NO: 609274 - RNA, 19 nt, Homo sapiens
uaucaguucuguuacguua

SEQ ID NO: 609275 - RNA, 19 nt, Homo sapiens
gcagaauauucacaaguuu

SEQ ID NO: 609276 - RNA, 19 nt, Homo sapiens
gggcaagucugugaaauga

SEQ ID NO: 609277 - RNA, 19 nt, Homo sapiens
gaucaacagucaauugugu

SEQ ID NO: 609278 - RNA, 19 nt, Homo sapiens
ugucagagguccagacuuu

SEQ ID NO: 609279 - RNA, 19 nt, Homo sapiens
caccuuaacuccauauauu

SEQ ID NO: 609280 - RNA, 19 nt, Homo sapiens
gcaaagaagaugagaaugu

SEQ ID NO: 609281 - RNA, 19 nt, Homo sapiens
aaauggagcugaaauggaa

SEQ ID NO: 609282 - RNA, 19 nt, Homo sapiens
gaaaugaccaaagaaauug

SEQ ID NO: 609283 - RNA, 19 nt, Homo sapiens
gaaacuccgucuucagaug

SEQ ID NO: 609284 - RNA, 19 nt, Homo sapiens
uggcagaacuuaaacuaaa

SEQ ID NO: 609285 - RNA, 19 nt, Homo sapiens
ugaaguaacacaaagcuua

SEQ ID NO: 609286 - RNA, 19 nt, Homo sapiens
gagcaaauuugaagaacau

SEQ ID NO: 609287 - RNA, 19 nt, Homo sapiens
caaagaagaugagaaugug

SEQ ID NO: 609288 - RNA, 19 nt, Homo sapiens
gaaguaacacaaagcuuaa

SEQ ID NO: 609289 - RNA, 19 nt, Homo sapiens
ucagaucaaucagcuaaua

SEQ ID NO: 609290 - RNA, 19 nt, Homo sapiens
aggaaauucugacauguua

SEQ ID NO: 609291 - RNA, 19 nt, Homo sapiens
ugaaggaaauucugacaug

SEQ ID NO: 609292 - RNA, 19 nt, Homo sapiens
ugaagaacauguugaaagu

SEQ ID NO: 609293 - RNA, 19 nt, Homo sapiens
gaaugaugcuucaguaaac

SEQ ID NO: 609294 - RNA, 19 nt, Homo sapiens
gaacuuuccugcuuacaac

SEQ ID NO: 609295 - RNA, 19 nt, Homo sapiens
gauugagcaugacuacuaa

SEQ ID NO: 609296 - RNA, 19 nt, Homo sapiens
gaguuaauguuuccuccua

SEQ ID NO: 609297 - RNA, 19 nt, Homo sapiens
gcaauaugguaauccuuau

SEQ ID NO: 609298 - RNA, 19 nt, Homo sapiens
uaaaggagcaacuucguaa

SEQ ID NO: 609299 - RNA, 19 nt, Homo sapiens
aagaagagguucagugaug

SEQ ID NO: 609300 - RNA, 19 nt, Homo sapiens
gcaauaaauaugcugauga

SEQ ID NO: 609301 - RNA, 19 nt, Homo sapiens
gaaagaaagaugugaccaa

SEQ ID NO: 609302 - RNA, 19 nt, Homo sapiens
gaaggaaauucugacaugu

SEQ ID NO: 609303 - RNA, 19 nt, Homo sapiens
aaacguguauguauuagug

SEQ ID NO: 609304 - RNA, 19 nt, Homo sapiens
ggaaucagcagaaagugaa

SEQ ID NO: 609305 - RNA, 19 nt, Homo sapiens
gaauaaaggauacaaggau

SEQ ID NO: 609306 - RNA, 19 nt, Homo sapiens
gaaguacaggacaauuaua

SEQ ID NO: 609307 - RNA, 19 nt, Homo sapiens
auaccaagcuuaugucaga

SEQ ID NO: 609308 - RNA, 19 nt, Homo sapiens
caagaaggcacaacaugaa

SEQ ID NO: 609309 - RNA, 19 nt, Homo sapiens
ggaaagagaacuuaaccau

SEQ ID NO: 609310 - RNA, 19 nt, Homo sapiens
caauguuacugcacugaaa

SEQ ID NO: 609311 - RNA, 19 nt, Homo sapiens
gcuuugauguucacaagaa

SEQ ID NO: 609312 - RNA, 19 nt, Homo sapiens
gcagaccauuauaaagaaa

SEQ ID NO: 609313 - RNA, 19 nt, Homo sapiens
gaaauucguggagcaagua

SEQ ID NO: 609314 - RNA, 19 nt, Homo sapiens
gaucagagcaaauuugaag

SEQ ID NO: 609315 - RNA, 19 nt, Homo sapiens
gaaauggaaagaacaagug

SEQ ID NO: 609316 - RNA, 19 nt, Homo sapiens
gagcugaaauggaaagaac

SEQ ID NO: 609317 - RNA, 19 nt, Homo sapiens
ugaaagagaacaacuugaa

SEQ ID NO: 609318 - RNA, 19 nt, Homo sapiens
agaaagaugugaccaacug

SEQ ID NO: 609319 - RNA, 19 nt, Homo sapiens
gcaguuauguuuggcugaa

SEQ ID NO: 609320 - RNA, 19 nt, Homo sapiens
ugaacuagcugaaguacag

SEQ ID NO: 609321 - RNA, 19 nt, Homo sapiens
gaaagagaacaacuugaau

SEQ ID NO: 609322 - RNA, 19 nt, Homo sapiens
ugaggaagauauuguguca

SEQ ID NO: 609323 - RNA, 19 nt, Homo sapiens
uauggaagaugaaggaaau

SEQ ID NO: 609324 - RNA, 19 nt, Homo sapiens
gccaagaguuaccuuccua

SEQ ID NO: 609325 - RNA, 19 nt, Homo sapiens
cacaaccaguucugcaaua

SEQ ID NO: 609326 - RNA, 19 nt, Homo sapiens
guaaagccaucaccuucug

SEQ ID NO: 609327 - RNA, 19 nt, Homo sapiens
gagaacaaguugggagaau

SEQ ID NO: 609328 - RNA, 19 nt, Homo sapiens
gaguacugcucgugauuau

SEQ ID NO: 609329 - RNA, 19 nt, Homo sapiens
ggaguacugcucgugauua

SEQ ID NO: 609330 - RNA, 19 nt, Homo sapiens
cgugauuacucauuucaaa

SEQ ID NO: 609331 - RNA, 19 nt, Homo sapiens
gaaagcgugauuacucauu

SEQ ID NO: 609332 - RNA, 19 nt, Homo sapiens
gaaggcacaacaugaaaga

SEQ ID NO: 609333 - RNA, 19 nt, Homo sapiens
ggaagauauugugucagua

SEQ ID NO: 609334 - RNA, 19 nt, Homo sapiens
gaacuuaaccaugagaaag

SEQ ID NO: 609335 - RNA, 19 nt, Homo sapiens
aaguacaccuuuccaguuu

SEQ ID NO: 609336 - RNA, 19 nt, Homo sapiens
ucuguuacguuacccauaa

SEQ ID NO: 609337 - RNA, 19 nt, Homo sapiens
ggauauuaccuuccaaaug

SEQ ID NO: 609338 - RNA, 19 nt, Homo sapiens
guacuagcauuccaaggau

SEQ ID NO: 609339 - RNA, 19 nt, Homo sapiens
ggaaggaucaacagucaau

SEQ ID NO: 609340 - RNA, 19 nt, Homo sapiens
gaucugaaacuccgucuuc

SEQ ID NO: 609341 - RNA, 19 nt, Homo sapiens
aaagcgugauuacucauuu

SEQ ID NO: 609342 - RNA, 19 nt, Homo sapiens
gaaaauaccaagcuuaugu

SEQ ID NO: 609343 - RNA, 19 nt, Homo sapiens
aagcaggccuucuugaguu

SEQ ID NO: 609344 - RNA, 19 nt, Homo sapiens
gaacacgaacuaagaagag

SEQ ID NO: 609345 - RNA, 19 nt, Homo sapiens
cgaauuagacaguuuaaag

SEQ ID NO: 609346 - RNA, 19 nt, Homo sapiens
gaaaccgaauuagacaguu

SEQ ID NO: 609347 - RNA, 19 nt, Homo sapiens
caaguacaccuuuccaguu

SEQ ID NO: 609348 - RNA, 19 nt, Homo sapiens
uaacuaugaucagagcaaa

SEQ ID NO: 609349 - RNA, 19 nt, Homo sapiens
ucaagaaggcacaacauga

SEQ ID NO: 609350 - RNA, 19 nt, Homo sapiens
gaauggaaagagaacuuaa

SEQ ID NO: 609351 - RNA, 19 nt, Homo sapiens
guggaaggaucaacaguca

SEQ ID NO: 609352 - RNA, 19 nt, Homo sapiens
ugauugagcaugacuacua

SEQ ID NO: 609353 - RNA, 19 nt, Homo sapiens
aagaacauguugaaaguca

SEQ ID NO: 609354 - RNA, 19 nt, Homo sapiens
acaaugacauccuuucaag

SEQ ID NO: 609355 - RNA, 19 nt, Homo sapiens
agaguuaccuuccuaaugc

SEQ ID NO: 609356 - RNA, 19 nt, Homo sapiens
gaaauucugacauguuagu

SEQ ID NO: 609357 - RNA, 19 nt, Homo sapiens
ccagaguccucaauguuuc

SEQ ID NO: 609358 - RNA, 19 nt, Homo sapiens
gaacaaguugggagaaugg

SEQ ID NO: 609359 - RNA, 19 nt, Homo sapiens
gagaaaaccaugaaagaaa

SEQ ID NO: 609360 - RNA, 19 nt, Homo sapiens
ucaauuguguacuagcauu

SEQ ID NO: 609361 - RNA, 19 nt, Homo sapiens
cagugaugcugucaacgua

SEQ ID NO: 609362 - RNA, 19 nt, Homo sapiens
acaagaagcuggagaaaua

SEQ ID NO: 609363 - RNA, 19 nt, Homo sapiens
ggaagaaacugaaaguaga

SEQ ID NO: 609364 - RNA, 19 nt, Homo sapiens
gaagaagugucuaaggaaa

SEQ ID NO: 609365 - RNA, 19 nt, Homo sapiens
gcaagaacaucccugacua

SEQ ID NO: 609366 - RNA, 19 nt, Homo sapiens
ggaccuaagucaauauuug

SEQ ID NO: 609367 - RNA, 19 nt, Homo sapiens
gagugaagauggucagaua

SEQ ID NO: 609368 - RNA, 19 nt, Homo sapiens
ccaaauugcuucuggguuu

SEQ ID NO: 609369 - RNA, 19 nt, Homo sapiens
caagacagcucaccagaug

SEQ ID NO: 609370 - RNA, 19 nt, Homo sapiens
gagaggaccuaagucaaua

SEQ ID NO: 609371 - RNA, 19 nt, Homo sapiens
ggaugucugugcccacuua

SEQ ID NO: 609372 - RNA, 19 nt, Homo sapiens
gaggaaagguugaaacaag

SEQ ID NO: 609373 - RNA, 19 nt, Homo sapiens
ggaagucgguguuuauuac

SEQ ID NO: 609374 - RNA, 19 nt, Homo sapiens
gaaccgaucuggacaaagc

SEQ ID NO: 609375 - RNA, 19 nt, Homo sapiens
gaaaccaggugacggugaa

SEQ ID NO: 609376 - RNA, 19 nt, Homo sapiens
gaagagaggaccuaaguca

SEQ ID NO: 609377 - RNA, 19 nt, Homo sapiens
gcuagcagccuccugaaua

SEQ ID NO: 609378 - RNA, 19 nt, Homo sapiens
gaaacuggcuuuguugagu

SEQ ID NO: 609379 - RNA, 19 nt, Homo sapiens
cgagaucccugauaccauu

SEQ ID NO: 609380 - RNA, 19 nt, Homo sapiens
gaacccaacuaauccuuuc

SEQ ID NO: 609381 - RNA, 19 nt, Homo sapiens
gcacauugcagcugaagaa

SEQ ID NO: 609382 - RNA, 19 nt, Homo sapiens
uaagagaaguacaacaguu

SEQ ID NO: 609383 - RNA, 19 nt, Homo sapiens
gaagagaacaagagguuug

SEQ ID NO: 609384 - RNA, 19 nt, Homo sapiens
gccagacucucauucagua

SEQ ID NO: 609385 - RNA, 19 nt, Homo sapiens
gcagugcaguggcugguuu

SEQ ID NO: 609386 - RNA, 19 nt, Homo sapiens
ggaaacacaggauuuaguu

SEQ ID NO: 609387 - RNA, 19 nt, Homo sapiens
gaacaagagguuugaagau

SEQ ID NO: 609388 - RNA, 19 nt, Homo sapiens
ggucagauauguguguauu

SEQ ID NO: 609389 - RNA, 19 nt, Homo sapiens
gaucuuaucgccuugugua

SEQ ID NO: 609390 - RNA, 19 nt, Homo sapiens
agagagagcugguguuaag

SEQ ID NO: 609391 - RNA, 19 nt, Homo sapiens
guacauuucuuugaucaug

SEQ ID NO: 609392 - RNA, 19 nt, Homo sapiens
gagaaccgaucuggacaaa

SEQ ID NO: 609393 - RNA, 19 nt, Homo sapiens
gaaagaaggggaaaaguuu

SEQ ID NO: 609394 - RNA, 19 nt, Homo sapiens
gagggacguuuggcaauaa

SEQ ID NO: 609395 - RNA, 19 nt, Homo sapiens
gcaccugccuggauaugug

SEQ ID NO: 609396 - RNA, 19 nt, Homo sapiens
cuagcagccuccugaauaa

SEQ ID NO: 609397 - RNA, 19 nt, Homo sapiens
guagagagaagaaagaaga

SEQ ID NO: 609398 - RNA, 19 nt, Homo sapiens
caacaagggagacauccua

SEQ ID NO: 609399 - RNA, 19 nt, Homo sapiens
gaaaguagagagaagaaag

SEQ ID NO: 609400 - RNA, 19 nt, Homo sapiens
gaauaaagaggaagaaacu

SEQ ID NO: 609401 - RNA, 19 nt, Homo sapiens
gagaagagaggaccuaagu

SEQ ID NO: 609402 - RNA, 19 nt, Homo sapiens
gagcacacuuccaccuuug

SEQ ID NO: 609403 - RNA, 19 nt, Homo sapiens
aagaucagcuucagcaaug

SEQ ID NO: 609404 - RNA, 19 nt, Homo sapiens
gagagcugguguuaaguga

SEQ ID NO: 609405 - RNA, 19 nt, Homo sapiens
gcagagggacugugaggaa

SEQ ID NO: 609406 - RNA, 19 nt, Homo sapiens
ggaaaaguuugcauaaaga

SEQ ID NO: 609407 - RNA, 19 nt, Homo sapiens
gggaagagcucgggauuuu

SEQ ID NO: 609408 - RNA, 19 nt, Homo sapiens
aaacaucuguaacuacuag

SEQ ID NO: 609409 - RNA, 19 nt, Homo sapiens
gaagaugaacccaacuaau

SEQ ID NO: 609410 - RNA, 19 nt, Homo sapiens
gaaccgcacgcguggcaua

SEQ ID NO: 609411 - RNA, 19 nt, Homo sapiens
gguaugacuucguguggaa

SEQ ID NO: 609412 - RNA, 19 nt, Homo sapiens
aauaaaagcucuccaguga

SEQ ID NO: 609413 - RNA, 19 nt, Homo sapiens
gauuucagauuacacuguu

SEQ ID NO: 609414 - RNA, 19 nt, Homo sapiens
ggacuugguuucagcuaag

SEQ ID NO: 609415 - RNA, 19 nt, Homo sapiens
gcaaauugguuaaaaguca

SEQ ID NO: 609416 - RNA, 19 nt, Homo sapiens
gaagaaugcaguagagaca

SEQ ID NO: 609417 - RNA, 19 nt, Homo sapiens
ccugaacgcuugucuuuua

SEQ ID NO: 609418 - RNA, 19 nt, Homo sapiens
gaaaacagaauucagcuuu

SEQ ID NO: 609419 - RNA, 19 nt, Homo sapiens
caggagcauuuacggauuu

SEQ ID NO: 609420 - RNA, 19 nt, Homo sapiens
ggagacauccuaagagaag

SEQ ID NO: 609421 - RNA, 19 nt, Homo sapiens
caagggagacauccuaaga

SEQ ID NO: 609422 - RNA, 19 nt, Homo sapiens
ucaugcagauaaaccauuu

SEQ ID NO: 609423 - RNA, 19 nt, Homo sapiens
acagcgaucuaccaucuuu

SEQ ID NO: 609424 - RNA, 19 nt, Homo sapiens
gaggugaaauuugcuguuc

SEQ ID NO: 609425 - RNA, 19 nt, Homo sapiens
gaucaauaaugagaacaug

SEQ ID NO: 609426 - RNA, 19 nt, Homo sapiens
gggcuugucucccucugaa

SEQ ID NO: 609427 - RNA, 19 nt, Homo sapiens
cagcuaccacuucaaauuu

SEQ ID NO: 609428 - RNA, 19 nt, Homo sapiens
gaaaacaucuguaacuacu

SEQ ID NO: 609429 - RNA, 19 nt, Homo sapiens
caucugaggugaaauuugc

SEQ ID NO: 609430 - RNA, 19 nt, Homo sapiens
ggauauguguccugagaag

SEQ ID NO: 609431 - RNA, 19 nt, Homo sapiens
gaagagaagagaggaccua

SEQ ID NO: 609432 - RNA, 19 nt, Homo sapiens
guucaucugugcugggaaa

SEQ ID NO: 609433 - RNA, 19 nt, Homo sapiens
acccaaaccucaaguguug

SEQ ID NO: 609434 - RNA, 19 nt, Homo sapiens
gaucuacaagguucaacua

SEQ ID NO: 609435 - RNA, 19 nt, Homo sapiens
ccagagaguuguggcagaa

SEQ ID NO: 609436 - RNA, 19 nt, Homo sapiens
ccacuucccagccuaauga

SEQ ID NO: 609437 - RNA, 19 nt, Homo sapiens
ucuaauaauuggagcagaa

SEQ ID NO: 609438 - RNA, 19 nt, Homo sapiens
ucacagguauccagcuuuc

SEQ ID NO: 609439 - RNA, 19 nt, Homo sapiens
caacucacuuagcagcaaa

SEQ ID NO: 609440 - RNA, 19 nt, Homo sapiens
cugaagaagugucuaagga

SEQ ID NO: 609441 - RNA, 19 nt, Homo sapiens
gcaugcugcuguucagaga

SEQ ID NO: 609442 - RNA, 19 nt, Homo sapiens
cacagaggaugcacccuuu

SEQ ID NO: 609443 - RNA, 19 nt, Homo sapiens
ugagcacacuuccaccuuu

SEQ ID NO: 609444 - RNA, 19 nt, Homo sapiens
gaaaggcugauccggaguu

SEQ ID NO: 609445 - RNA, 19 nt, Homo sapiens
ugaagacucaggagcauuu

SEQ ID NO: 609446 - RNA, 19 nt, Homo sapiens
acaagagguuugaagauca

SEQ ID NO: 609447 - RNA, 19 nt, Homo sapiens
agagggacguuuggcaaua

SEQ ID NO: 609448 - RNA, 19 nt, Homo sapiens
gcuccaugguuguccagua

SEQ ID NO: 609449 - RNA, 19 nt, Homo sapiens
cauugcagcugaagaagug

SEQ ID NO: 609450 - RNA, 19 nt, Homo sapiens
ggagaggagugugguguag

SEQ ID NO: 609451 - RNA, 19 nt, Homo sapiens
acacagcgaucuaccaucu

SEQ ID NO: 609452 - RNA, 19 nt, Homo sapiens
aaaauaagccccaauaaga

SEQ ID NO: 609453 - RNA, 19 nt, Homo sapiens
ucacagccauccagugcaa

SEQ ID NO: 609454 - RNA, 19 nt, Homo sapiens
gagagaagaaagaagauuc

SEQ ID NO: 609455 - RNA, 19 nt, Homo sapiens
gaaacugaaaguagagaga

SEQ ID NO: 609456 - RNA, 19 nt, Homo sapiens
gaugcuugaugcacuguug

SEQ ID NO: 609457 - RNA, 19 nt, Homo sapiens
cagaggcgcugagugaaga

SEQ ID NO: 609458 - RNA, 19 nt, Homo sapiens
gggauuggccaugaguuua

SEQ ID NO: 609459 - RNA, 19 nt, Homo sapiens
aguagaagauggucugaug

SEQ ID NO: 609460 - RNA, 19 nt, Homo sapiens
gaaauagugaacucugguu

SEQ ID NO: 609461 - RNA, 19 nt, Homo sapiens
ccucuucagugcaaacauu

SEQ ID NO: 609462 - RNA, 19 nt, Homo sapiens
ccagggaucuagugaauaa

SEQ ID NO: 609463 - RNA, 19 nt, Homo sapiens
ggagggaaaugaccaaaga

SEQ ID NO: 609464 - RNA, 19 nt, Homo sapiens
ggaaacacaggguuaauaa

SEQ ID NO: 609465 - RNA, 19 nt, Homo sapiens
ggaaaugaccaaagaagaa

SEQ ID NO: 609466 - RNA, 19 nt, Homo sapiens
gagaugugauccugguaua

SEQ ID NO: 609467 - RNA, 19 nt, Homo sapiens
caagagcagugaccaguga

SEQ ID NO: 609468 - RNA, 19 nt, Homo sapiens
cugaugaucugcaauguaa

SEQ ID NO: 609469 - RNA, 19 nt, Homo sapiens
gcacaacgccaucaaguuc

SEQ ID NO: 609470 - RNA, 19 nt, Homo sapiens
ccagagaacugccagaauc

SEQ ID NO: 609471 - RNA, 19 nt, Homo sapiens
gaagaucaguaauggagau

SEQ ID NO: 609472 - RNA, 19 nt, Homo sapiens
gauuauggauccaaaguca

SEQ ID NO: 609473 - RNA, 19 nt, Homo sapiens
caacaccgccuaaugaaga

SEQ ID NO: 609474 - RNA, 19 nt, Homo sapiens
gaaaugaccaaagaagaaa

SEQ ID NO: 609475 - RNA, 19 nt, Homo sapiens
gcuagcagcucaggcaauu

SEQ ID NO: 609476 - RNA, 19 nt, Homo sapiens
uaaaugccauacucccuaa

SEQ ID NO: 609477 - RNA, 19 nt, Homo sapiens
aaacauacaaguucuguga

SEQ ID NO: 609478 - RNA, 19 nt, Homo sapiens
ugaagcgucucccugagua

SEQ ID NO: 609479 - RNA, 19 nt, Homo sapiens
gaaacacaggguuaauaaa

SEQ ID NO: 609480 - RNA, 19 nt, Homo sapiens
gguagggacagcacaguua

SEQ ID NO: 609481 - RNA, 19 nt, Homo sapiens
acacaacaccgccuaauga

SEQ ID NO: 609482 - RNA, 19 nt, Homo sapiens
gagacuggcucugcuguau

SEQ ID NO: 609483 - RNA, 19 nt, Homo sapiens
gggaaacacaggguuaaua

SEQ ID NO: 609484 - RNA, 19 nt, Homo sapiens
agaaacagcagaagaagaa

SEQ ID NO: 609485 - RNA, 19 nt, Homo sapiens
guuaauaaaugccauacuc

SEQ ID NO: 609486 - RNA, 19 nt, Homo sapiens
ggaaggaaggcacacacua

SEQ ID NO: 609487 - RNA, 19 nt, Homo sapiens
caaagucagucucuucucu

SEQ ID NO: 609488 - RNA, 19 nt, Homo sapiens
caauuucacgcuuugcuua

SEQ ID NO: 609489 - RNA, 19 nt, Homo sapiens
gaugaucccuugcaguucu

SEQ ID NO: 609490 - RNA, 19 nt, Homo sapiens
gaucaguaauggagaugug

SEQ ID NO: 609491 - RNA, 19 nt, Homo sapiens
acaaggaaaucaccagugu

SEQ ID NO: 609492 - RNA, 19 nt, Homo sapiens
ggaaggcacacacuacguu

SEQ ID NO: 609493 - RNA, 19 nt, Homo sapiens
gaacuucgagcagccauug

SEQ ID NO: 609494 - RNA, 19 nt, Homo sapiens
gaaggaaggcacacacuac

SEQ ID NO: 609495 - RNA, 19 nt, Homo sapiens
gaagaaacggaaggaagaa

SEQ ID NO: 609496 - RNA, 19 nt, Homo sapiens
ggaagaggaggccaaguca

SEQ ID NO: 609497 - RNA, 19 nt, Homo sapiens
gaaaagaaacagcagaaga

SEQ ID NO: 609498 - RNA, 19 nt, Homo sapiens
caacagguuccuacacgaa

SEQ ID NO: 609499 - RNA, 19 nt, Homo sapiens
guugaugaccuacuucuga

SEQ ID NO: 609500 - RNA, 19 nt, Homo sapiens
ccaucaaguuccuuaacaa

SEQ ID NO: 609501 - RNA, 19 nt, Homo sapiens
gccaucaaguuccuuaaca

SEQ ID NO: 609502 - RNA, 19 nt, Homo sapiens
gggaaaugaccaaagaaga

SEQ ID NO: 609503 - RNA, 19 nt, Homo sapiens
gcaguucuguaccuguugu

SEQ ID NO: 609504 - RNA, 19 nt, Homo sapiens
gaugugauccugguauaug

SEQ ID NO: 609505 - RNA, 19 nt, Homo sapiens
ucaggcaauuucacgcuuu

SEQ ID NO: 609506 - RNA, 19 nt, Homo sapiens
gcagacugaugccuuuguc

SEQ ID NO: 609507 - RNA, 19 nt, Homo sapiens
agaagaaacggaaggaaga

SEQ ID NO: 609508 - RNA, 19 nt, Homo sapiens
gcaagagaagauugugcua

SEQ ID NO: 609509 - RNA, 19 nt, Homo sapiens
gaagaagaaacggaaggaa

SEQ ID NO: 609510 - RNA, 19 nt, Homo sapiens
gugcugguuugcugugaaa

SEQ ID NO: 609511 - RNA, 19 nt, Homo sapiens
ucucugguaucacgaauuc

SEQ ID NO: 609512 - RNA, 19 nt, Homo sapiens
ggagaugugauccugguau

SEQ ID NO: 609513 - RNA, 19 nt, Homo sapiens
gauucaggauuacacaaca

SEQ ID NO: 609514 - RNA, 19 nt, Homo sapiens
ucucugacccaguuuauga

SEQ ID NO: 609515 - RNA, 19 nt, Homo sapiens
gcacacacuacguucucua

SEQ ID NO: 609516 - RNA, 19 nt, Homo sapiens
agcaggugauucaggauua

SEQ ID NO: 609517 - RNA, 19 nt, Homo sapiens
gcugugaaacauacaaguu

SEQ ID NO: 609518 - RNA, 19 nt, Homo sapiens
acacaggguuaauaaaugc

SEQ ID NO: 609519 - RNA, 19 nt, Homo sapiens
aacacaggguuaauaaaug

SEQ ID NO: 609520 - RNA, 19 nt, Homo sapiens
gggaagaggaggccaaguc

SEQ ID NO: 609521 - RNA, 19 nt, Homo sapiens
gauccaaagucagucucuu

SEQ ID NO: 609522 - RNA, 19 nt, Homo sapiens
gacuggcucugcuguaucu

SEQ ID NO: 609523 - RNA, 19 nt, Homo sapiens
cugaugccuuugucucuaa

SEQ ID NO: 609524 - RNA, 19 nt, Homo sapiens
ucccagagguuuccaaggu

SEQ ID NO: 609525 - RNA, 19 nt, Homo sapiens
gugagcgugugcagacuga

SEQ ID NO: 609526 - RNA, 19 nt, Homo sapiens
ugagcuagaugacccugau

SEQ ID NO: 609527 - RNA, 19 nt, Homo sapiens
gggagcucaugcacucuug

SEQ ID NO: 609528 - RNA, 19 nt, Homo sapiens
gaaacagcagaagaagaaa

SEQ ID NO: 609529 - RNA, 19 nt, Homo sapiens
ugugcagacugaugccuuu

SEQ ID NO: 609530 - RNA, 19 nt, Homo sapiens
uaccagaagaucaguaaug

SEQ ID NO: 609531 - RNA, 19 nt, Homo sapiens
aagaggaggccaagucaga

SEQ ID NO: 609532 - RNA, 19 nt, Homo sapiens
aaaagaaacagcagaagaa

SEQ ID NO: 609533 - RNA, 19 nt, Homo sapiens
cuccagggaucuagugaau

SEQ ID NO: 609534 - RNA, 19 nt, Homo sapiens
caggcaauuucacgcuuug

SEQ ID NO: 609535 - RNA, 19 nt, Homo sapiens
uagcagcucaggcaauuuc

SEQ ID NO: 609536 - RNA, 19 nt, Homo sapiens
aaacuaaaacccuacauga

SEQ ID NO: 609537 - RNA, 19 nt, Homo sapiens
gcaggugauucaggauuac

SEQ ID NO: 609538 - RNA, 19 nt, Homo sapiens
cacaacaccgccuaaugaa

SEQ ID NO: 609539 - RNA, 19 nt, Homo sapiens
gagggaaaugaccaaagaa

SEQ ID NO: 609540 - RNA, 19 nt, Homo sapiens
gagcgugugcagacugaug

SEQ ID NO: 609541 - RNA, 19 nt, Homo sapiens
ucugagaaggcuuguuaaa

SEQ ID NO: 609542 - RNA, 19 nt, Homo sapiens
cagcaggugauucaggauu

SEQ ID NO: 609543 - RNA, 19 nt, Homo sapiens
gggaucuagugaauaaacu

SEQ ID NO: 609544 - RNA, 19 nt, Homo sapiens
uugcaguucuguaccuguu

SEQ ID NO: 609545 - RNA, 19 nt, Homo sapiens
ccugaugaucugcaaugua

SEQ ID NO: 609546 - RNA, 19 nt, Homo sapiens
acgcuuugcuuaccagaag

SEQ ID NO: 609547 - RNA, 19 nt, Homo sapiens
uucuguaccuguuguucua

SEQ ID NO: 609548 - RNA, 19 nt, Homo sapiens
acugaugccuuugucucua

SEQ ID NO: 609549 - RNA, 19 nt, Homo sapiens
gcucgagcccauaauguac

SEQ ID NO: 609550 - RNA, 19 nt, Homo sapiens
guagggacagcacaguuag

SEQ ID NO: 609551 - RNA, 19 nt, Homo sapiens
gguaugugcaagagaagau

SEQ ID NO: 609552 - RNA, 19 nt, Homo sapiens
caucaaguuccuuaacaag

SEQ ID NO: 609553 - RNA, 19 nt, Homo sapiens
ugugaaacauacaaguucu

SEQ ID NO: 609554 - RNA, 19 nt, Homo sapiens
ugacccugaugaucugcaa

SEQ ID NO: 609555 - RNA, 19 nt, Homo sapiens
gcuagaugacccugaugau

SEQ ID NO: 609556 - RNA, 19 nt, Homo sapiens
cuuugucucuaaugagcua

SEQ ID NO: 609557 - RNA, 19 nt, Homo sapiens
ugaaacauacaaguucugu

SEQ ID NO: 609558 - RNA, 19 nt, Homo sapiens
accagaagaucaguaaugg

SEQ ID NO: 609559 - RNA, 19 nt, Homo sapiens
gaacucuccagggaucuag

SEQ ID NO: 609560 - RNA, 19 nt, Homo sapiens
ggagagaagucauccauua

SEQ ID NO: 609561 - RNA, 19 nt, Homo sapiens
ggagugaacugauuccaua

SEQ ID NO: 609562 - RNA, 19 nt, Homo sapiens
gagcugaaguccuuagaua

SEQ ID NO: 609563 - RNA, 19 nt, Homo sapiens
gauaacagacguugccuua

SEQ ID NO: 609564 - RNA, 19 nt, Homo sapiens
gaaccuggcucccuaugau

SEQ ID NO: 609565 - RNA, 19 nt, Homo sapiens
gaaaaugggucaauaacuu

SEQ ID NO: 609566 - RNA, 19 nt, Homo sapiens
gaagaagucauugugguua

SEQ ID NO: 609567 - RNA, 19 nt, Homo sapiens
ccaauugccuucucaugaa

SEQ ID NO: 609568 - RNA, 19 nt, Homo sapiens
gcugagcugugaucugaua

SEQ ID NO: 609569 - RNA, 19 nt, Homo sapiens
gggaacaaaccuuuaauuu

SEQ ID NO: 609570 - RNA, 19 nt, Homo sapiens
uaacagacguugccuuaca

SEQ ID NO: 609571 - RNA, 19 nt, Homo sapiens
gaacugauuccauauuuag

SEQ ID NO: 609572 - RNA, 19 nt, Homo sapiens
acagaagcauccuagaaua

SEQ ID NO: 609573 - RNA, 19 nt, Homo sapiens
gugaacugauuccauauuu

SEQ ID NO: 609574 - RNA, 19 nt, Homo sapiens
acagacaggugcccaaauu

SEQ ID NO: 609575 - RNA, 19 nt, Homo sapiens
caucguggauuuccuaaug

SEQ ID NO: 609576 - RNA, 19 nt, Homo sapiens
ggaaguggccagaggauug

SEQ ID NO: 609577 - RNA, 19 nt, Homo sapiens
gugcugagcugugaucuga

SEQ ID NO: 609578 - RNA, 19 nt, Homo sapiens
gagugacuauuaccaauug

SEQ ID NO: 609579 - RNA, 19 nt, Homo sapiens
gaucacaggugcgcugcua

SEQ ID NO: 609580 - RNA, 19 nt, Homo sapiens
gagagaagucauccauuaa

SEQ ID NO: 609581 - RNA, 19 nt, Homo sapiens
gaagccagauauugugugu

SEQ ID NO: 609582 - RNA, 19 nt, Homo sapiens
agaggaggaucuaaagaaa

SEQ ID NO: 609583 - RNA, 19 nt, Homo sapiens
agaccuaacuuccagcauu

SEQ ID NO: 609584 - RNA, 19 nt, Homo sapiens
ggagcagcgugacuucauu

SEQ ID NO: 609585 - RNA, 19 nt, Homo sapiens
gguggaggaucucggauga

SEQ ID NO: 609586 - RNA, 19 nt, Homo sapiens
ggauugaagccaaagcuaa

SEQ ID NO: 609587 - RNA, 19 nt, Homo sapiens
uaacuucuauccggaguga

SEQ ID NO: 609588 - RNA, 19 nt, Homo sapiens
guuuagagcuuaugaugca

SEQ ID NO: 609589 - RNA, 19 nt, Homo sapiens
cgagaagggugcagacauc

SEQ ID NO: 609590 - RNA, 19 nt, Homo sapiens
gggaagacuuguccagauc

SEQ ID NO: 609591 - RNA, 19 nt, Homo sapiens
gaccuaacuuccagcauuc

SEQ ID NO: 609592 - RNA, 19 nt, Homo sapiens
gauugaagccaaagcuaaa

SEQ ID NO: 609593 - RNA, 19 nt, Homo sapiens
agacacagauuggagagaa

SEQ ID NO: 609594 - RNA, 19 nt, Homo sapiens
ggaguugacagccucauug

SEQ ID NO: 609595 - RNA, 19 nt, Homo sapiens
gggcucugcucucgaguga

SEQ ID NO: 609596 - RNA, 19 nt, Homo sapiens
uaugaugccugcuggaaug

SEQ ID NO: 609597 - RNA, 19 nt, Homo sapiens
ggaaggaagcaauauccaa

SEQ ID NO: 609598 - RNA, 19 nt, Homo sapiens
ccagaggauugaagccaaa

SEQ ID NO: 609599 - RNA, 19 nt, Homo sapiens
caacagggacaagaagaaa

SEQ ID NO: 609600 - RNA, 19 nt, Homo sapiens
gaagcagacuuggaugaag

SEQ ID NO: 609601 - RNA, 19 nt, Homo sapiens
gcuugagcguguuggauuu

SEQ ID NO: 609602 - RNA, 19 nt, Homo sapiens
acaaugcugugaucgagaa

SEQ ID NO: 609603 - RNA, 19 nt, Homo sapiens
gaagaaccaccaguccauu

SEQ ID NO: 609604 - RNA, 19 nt, Homo sapiens
gacccgguuugguuuguaa

SEQ ID NO: 609605 - RNA, 19 nt, Homo sapiens
gcccaccucuacuguuuga

SEQ ID NO: 609606 - RNA, 19 nt, Homo sapiens
aagcagacuuggaugaaga

SEQ ID NO: 609607 - RNA, 19 nt, Homo sapiens
caugggaacugcagauucu

SEQ ID NO: 609608 - RNA, 19 nt, Homo sapiens
aauggaauuucaagcagua

SEQ ID NO: 609609 - RNA, 19 nt, Homo sapiens
gagcugugaucugauaaca

SEQ ID NO: 609610 - RNA, 19 nt, Homo sapiens
ggcaguagguggaggaucu

SEQ ID NO: 609611 - RNA, 19 nt, Homo sapiens
gaaguggccagaggauuga

SEQ ID NO: 609612 - RNA, 19 nt, Homo sapiens
cuacagaagcauccuagaa

SEQ ID NO: 609613 - RNA, 19 nt, Homo sapiens
gaaaaugaagccagauauu

SEQ ID NO: 609614 - RNA, 19 nt, Homo sapiens
gaggaucucggaugacaga

SEQ ID NO: 609615 - RNA, 19 nt, Homo sapiens
gagaagucauccauuaagc

SEQ ID NO: 609616 - RNA, 19 nt, Homo sapiens
gauuccauauuuagugaga

SEQ ID NO: 609617 - RNA, 19 nt, Homo sapiens
gaagagcuggucauuaagg

SEQ ID NO: 609618 - RNA, 19 nt, Homo sapiens
ccagauauuguguguauuc

SEQ ID NO: 609619 - RNA, 19 nt, Homo sapiens
agccagauauuguguguau

SEQ ID NO: 609620 - RNA, 19 nt, Homo sapiens
ggaguggacagcacaggaa

SEQ ID NO: 609621 - RNA, 19 nt, Homo sapiens
ggaccuguuuagagcuuau

SEQ ID NO: 609622 - RNA, 19 nt, Homo sapiens
uuaauuugguacccauuga

SEQ ID NO: 609623 - RNA, 19 nt, Homo sapiens
uggcucauccugucucaua

SEQ ID NO: 609624 - RNA, 19 nt, Homo sapiens
gcugaaguccuuagauauc

SEQ ID NO: 609625 - RNA, 19 nt, Homo sapiens
gcaacaaugcugugaucga

SEQ ID NO: 609626 - RNA, 19 nt, Homo sapiens
uagagugacuauuaccaau

SEQ ID NO: 609627 - RNA, 19 nt, Homo sapiens
aaaugaagccagauauugu

SEQ ID NO: 609628 - RNA, 19 nt, Homo sapiens
gaagggugcagacaucaag

SEQ ID NO: 609629 - RNA, 19 nt, Homo sapiens
auuaagcgcucagucauug

SEQ ID NO: 609630 - RNA, 19 nt, Homo sapiens
cuacauggaagcaaacaga

SEQ ID NO: 609631 - RNA, 19 nt, Homo sapiens
aaagaagccaauacacuga

SEQ ID NO: 609632 - RNA, 19 nt, Homo sapiens
uauccggagugaacugauu

SEQ ID NO: 609633 - RNA, 19 nt, Homo sapiens
augcaucacuugcuauguu

SEQ ID NO: 609634 - RNA, 19 nt, Homo sapiens
aagcuaaacgagugaauga

SEQ ID NO: 609635 - RNA, 19 nt, Homo sapiens
gacucuacauggaagcaaa

SEQ ID NO: 609636 - RNA, 19 nt, Homo sapiens
aagaggaggaucuaaagaa

SEQ ID NO: 609637 - RNA, 19 nt, Homo sapiens
ccaccucuacuguuugaaa

SEQ ID NO: 609638 - RNA, 19 nt, Homo sapiens
uaaugaagcagacuuggau

SEQ ID NO: 609639 - RNA, 19 nt, Homo sapiens
gaaccugcuugagcguguu

SEQ ID NO: 609640 - RNA, 19 nt, Homo sapiens
ggaggaaggaagcaauauc

SEQ ID NO: 609641 - RNA, 19 nt, Homo sapiens
cagcccagauugucagcaa

SEQ ID NO: 609642 - RNA, 19 nt, Homo sapiens
gaagcauccuagaauacgu

SEQ ID NO: 609643 - RNA, 19 nt, Homo sapiens
gagcagcgugacuucauug

SEQ ID NO: 609644 - RNA, 19 nt, Homo sapiens
guugggaacaaaccuuuaa

SEQ ID NO: 609645 - RNA, 19 nt, Homo sapiens
ugaagaagucauugugguu

SEQ ID NO: 609646 - RNA, 19 nt, Homo sapiens
aaggacugcuugauuggaa

SEQ ID NO: 609647 - RNA, 19 nt, Homo sapiens
gcagauucuuugcgcuaca

SEQ ID NO: 609648 - RNA, 19 nt, Homo sapiens
ccaccuguuuaacucugua

SEQ ID NO: 609649 - RNA, 19 nt, Homo sapiens
gcucauccugucucauaaa

SEQ ID NO: 609650 - RNA, 19 nt, Homo sapiens
gaauuucaagcaguaguga

SEQ ID NO: 609651 - RNA, 19 nt, Homo sapiens
ggaagacuuguccagauca

SEQ ID NO: 609652 - RNA, 19 nt, Homo sapiens
cugauuccauauuuaguga

SEQ ID NO: 609653 - RNA, 19 nt, Homo sapiens
ggaauuucaagcaguagug

SEQ ID NO: 609654 - RNA, 19 nt, Homo sapiens
aggccaagauagcauagaa

SEQ ID NO: 609655 - RNA, 19 nt, Homo sapiens
uacagaagcauccuagaau

SEQ ID NO: 609656 - RNA, 19 nt, Homo sapiens
auggagaucugaguucuga

SEQ ID NO: 609657 - RNA, 19 nt, Homo sapiens
guggaggaaggaagcaaua

SEQ ID NO: 609658 - RNA, 19 nt, Homo sapiens
ugggaagacuuguccagau

SEQ ID NO: 609659 - RNA, 19 nt, Homo sapiens
gauccauccuacagaagca

SEQ ID NO: 609660 - RNA, 19 nt, Homo sapiens
gaagaagacucauuucaua

SEQ ID NO: 609661 - RNA, 19 nt, Homo sapiens
gaaauuccaugucauugua

SEQ ID NO: 609662 - RNA, 19 nt, Homo sapiens
gggcuuaacuuguugauuu

SEQ ID NO: 609663 - RNA, 19 nt, Homo sapiens
gcaccuauguucaaacuuu

SEQ ID NO: 609664 - RNA, 19 nt, Homo sapiens
ggagagugcucaagauuau

SEQ ID NO: 609665 - RNA, 19 nt, Homo sapiens
gaacuuaaacuuucugguu

SEQ ID NO: 609666 - RNA, 19 nt, Homo sapiens
cagcagggcuuaacuuguu

SEQ ID NO: 609667 - RNA, 19 nt, Homo sapiens
gaagaaguccugccauuca

SEQ ID NO: 609668 - RNA, 19 nt, Homo sapiens
caaagaggcugcccgaaag

SEQ ID NO: 609669 - RNA, 19 nt, Homo sapiens
gauuucagcuuccauuaug

SEQ ID NO: 609670 - RNA, 19 nt, Homo sapiens
uaaacuuucugguucagua

SEQ ID NO: 609671 - RNA, 19 nt, Homo sapiens
gaaugcaccuuccuacauc

SEQ ID NO: 609672 - RNA, 19 nt, Homo sapiens
gaagacucauuucauaagu

SEQ ID NO: 609673 - RNA, 19 nt, Homo sapiens
gaaauggcuaugacacuuu

SEQ ID NO: 609674 - RNA, 19 nt, Homo sapiens
caaagcagguauugagaca

SEQ ID NO: 609675 - RNA, 19 nt, Homo sapiens
gcagauugcuuaggcagau

SEQ ID NO: 609676 - RNA, 19 nt, Homo sapiens
ucaaagaggcugcccgaaa

SEQ ID NO: 609677 - RNA, 19 nt, Homo sapiens
agaggagacuugaguguug

SEQ ID NO: 609678 - RNA, 19 nt, Homo sapiens
gaggugaucaugaccauug

SEQ ID NO: 609679 - RNA, 19 nt, Homo sapiens
caacuccaguccaacauca

SEQ ID NO: 609680 - RNA, 19 nt, Homo sapiens
gucaggaacuuaaacuuuc

SEQ ID NO: 609681 - RNA, 19 nt, Homo sapiens
caacaucauugaggcgauu

SEQ ID NO: 609682 - RNA, 19 nt, Homo sapiens
guuuguggcuccugaagaa

SEQ ID NO: 609683 - RNA, 19 nt, Homo sapiens
ucaacaaggugaucauugg

SEQ ID NO: 609684 - RNA, 19 nt, Homo sapiens
uuaggcagauacagaauga

SEQ ID NO: 609685 - RNA, 19 nt, Homo sapiens
gaagaggagacuugagugu

SEQ ID NO: 609686 - RNA, 19 nt, Homo sapiens
gcgaagggcucggaguugu

SEQ ID NO: 609687 - RNA, 19 nt, Homo sapiens
gcucagaaauggcuaugac

SEQ ID NO: 609688 - RNA, 19 nt, Homo sapiens
ugaauaccuuacugggaua

SEQ ID NO: 609689 - RNA, 19 nt, Homo sapiens
agaaauggcuaugacacuu

SEQ ID NO: 609690 - RNA, 19 nt, Homo sapiens
acauaacacugaauaccuu

SEQ ID NO: 609691 - RNA, 19 nt, Homo sapiens
cagagaggaucgagagcuu

SEQ ID NO: 609692 - RNA, 19 nt, Homo sapiens
cugaagaaguccugccauu

SEQ ID NO: 609693 - RNA, 19 nt, Homo sapiens
gagcucauuacccucuuua

SEQ ID NO: 609694 - RNA, 19 nt, Homo sapiens
gccguuaugucaagaguca

SEQ ID NO: 609695 - RNA, 19 nt, Homo sapiens
gaaugaagaggagacuuga

SEQ ID NO: 609696 - RNA, 19 nt, Homo sapiens
cggagagugcucaagauua

SEQ ID NO: 609697 - RNA, 19 nt, Homo sapiens
ugucaggaacuuaaacuuu

SEQ ID NO: 609698 - RNA, 19 nt, Homo sapiens
ugaagcacauccuugcaau

SEQ ID NO: 609699 - RNA, 19 nt, Homo sapiens
ggauuucagcuuccauuau

SEQ ID NO: 609700 - RNA, 19 nt, Homo sapiens
gcggagagugcucaagauu

SEQ ID NO: 609701 - RNA, 19 nt, Homo sapiens
gucaugaaauggcugugaa

SEQ ID NO: 609702 - RNA, 19 nt, Homo sapiens
gagcagcagggcuuaacuu

SEQ ID NO: 609703 - RNA, 19 nt, Homo sapiens
agagagggcaggaggauga

SEQ ID NO: 609704 - RNA, 19 nt, Homo sapiens
gcagauacagaaugaagag

SEQ ID NO: 609705 - RNA, 19 nt, Homo sapiens
uaaacgaggauuucagcuu

SEQ ID NO: 609706 - RNA, 19 nt, Homo sapiens
cugguucaguaguguguua

SEQ ID NO: 609707 - RNA, 19 nt, Homo sapiens
ccuuucagaucuuaacaga

SEQ ID NO: 609708 - RNA, 19 nt, Homo sapiens
gcgcagcuccgaggaaaug

SEQ ID NO: 609709 - RNA, 19 nt, Homo sapiens
gaccacacguguccuaagc

SEQ ID NO: 609710 - RNA, 19 nt, Homo sapiens
gcucauuacccucuuuauc

SEQ ID NO: 609711 - RNA, 19 nt, Homo sapiens
caucgucugugcaccuaug

SEQ ID NO: 609712 - RNA, 19 nt, Homo sapiens
cauaacacugaauaccuua

SEQ ID NO: 609713 - RNA, 19 nt, Homo sapiens
agaaugaagaggagacuug

SEQ ID NO: 609714 - RNA, 19 nt, Homo sapiens
gagaaggucagcgugcauu

SEQ ID NO: 609715 - RNA, 19 nt, Homo sapiens
gaggauuucagcuuccauu

SEQ ID NO: 609716 - RNA, 19 nt, Homo sapiens
gaagggcucggaguuguca

SEQ ID NO: 609717 - RNA, 19 nt, Homo sapiens
ugucuugccuuucagaucu

SEQ ID NO: 609718 - RNA, 19 nt, Homo sapiens
gaagcacauccuugcaaug

SEQ ID NO: 609719 - RNA, 19 nt, Homo sapiens
cagauugcuuaggcagaua

SEQ ID NO: 609720 - RNA, 19 nt, Homo sapiens
cucuuuaucuccaacauug

SEQ ID NO: 609721 - RNA, 19 nt, Homo sapiens
caugacugaugcugccauu

SEQ ID NO: 609722 - RNA, 19 nt, Homo sapiens
ugucaagagucaacaaggu

SEQ ID NO: 609723 - RNA, 19 nt, Homo sapiens
uggcuucucccgaacagua

SEQ ID NO: 609724 - RNA, 19 nt, Homo sapiens
gaagggacaauggagaaca

SEQ ID NO: 609725 - RNA, 19 nt, Homo sapiens
gcagcagggcuuaacuugu

SEQ ID NO: 609726 - RNA, 19 nt, Homo sapiens
gcagagagggcaggaggau

SEQ ID NO: 609727 - RNA, 19 nt, Homo sapiens
gugcaccuauguucaaacu

SEQ ID NO: 609728 - RNA, 19 nt, Homo sapiens
cagcgaagggcucggaguu

SEQ ID NO: 609729 - RNA, 19 nt, Homo sapiens
gugcggagagugcucaaga

SEQ ID NO: 609730 - RNA, 19 nt, Homo sapiens
cugccagggucaugaaaug

SEQ ID NO: 609731 - RNA, 19 nt, Homo sapiens
uuacugggauacagauuuu

SEQ ID NO: 609732 - RNA, 19 nt, Homo sapiens
gcaacauggugcggagagu

SEQ ID NO: 609733 - RNA, 19 nt, Homo sapiens
ucaggaacuuaaacuuucu

SEQ ID NO: 609734 - RNA, 19 nt, Homo sapiens
ugcacaaacuguugacauc

SEQ ID NO: 609735 - RNA, 19 nt, Homo sapiens
ucuaccgccugaugaguga

SEQ ID NO: 609736 - RNA, 19 nt, Homo sapiens
ucauuacccucuuuaucuc

SEQ ID NO: 609737 - RNA, 19 nt, Homo sapiens
aagcagguauugagacaac

SEQ ID NO: 609738 - RNA, 19 nt, Homo sapiens
caugaaauggcugugaauu

SEQ ID NO: 609739 - RNA, 19 nt, Homo sapiens
ggucaugaaauggcuguga

SEQ ID NO: 609740 - RNA, 19 nt, Homo sapiens
ugaagaaguccugccauuc

SEQ ID NO: 609741 - RNA, 19 nt, Homo sapiens
ugacaggaacucacacucu

SEQ ID NO: 609742 - RNA, 19 nt, Homo sapiens
acacguguccuaagcagau

SEQ ID NO: 609743 - RNA, 19 nt, Homo sapiens
ugacugaugcugccauuuu

SEQ ID NO: 609744 - RNA, 19 nt, Homo sapiens
guccaaagcagguauugag

SEQ ID NO: 609745 - RNA, 19 nt, Homo sapiens
gagcuggaagggacaaugg

SEQ ID NO: 609746 - RNA, 19 nt, Homo sapiens
agaagacucauuucauaag

SEQ ID NO: 609747 - RNA, 19 nt, Homo sapiens
uaacaagggcacacaucca

SEQ ID NO: 609748 - RNA, 19 nt, Homo sapiens
gcauugcccuguguuugac

SEQ ID NO: 609749 - RNA, 19 nt, Homo sapiens
caccuauguucaaacuuuc

SEQ ID NO: 609750 - RNA, 19 nt, Homo sapiens
gucaacaaggugaucauug

SEQ ID NO: 609751 - RNA, 19 nt, Homo sapiens
gauacuguugccugccuuu

SEQ ID NO: 609752 - RNA, 19 nt, Homo sapiens
gugcauugcccuguguuug

SEQ ID NO: 609753 - RNA, 19 nt, Homo sapiens
ggcgauuaaugagcugcua

SEQ ID NO: 609754 - RNA, 19 nt, Homo sapiens
aggagucccugcacaaacu

SEQ ID NO: 609755 - RNA, 19 nt, Homo sapiens
ugcauugcccuguguuuga

SEQ ID NO: 609756 - RNA, 19 nt, Homo sapiens
gcagguauugagacaacug

SEQ ID NO: 609757 - RNA, 19 nt, Homo sapiens
uggaagggacaauggagaa

SEQ ID NO: 609758 - RNA, 19 nt, Homo sapiens
gaagaagccuuuuauguua

SEQ ID NO: 609759 - RNA, 19 nt, Homo sapiens
gaugguaucucauucagua

SEQ ID NO: 609760 - RNA, 19 nt, Homo sapiens
ccaaacaucuccuugcauu

SEQ ID NO: 609761 - RNA, 19 nt, Homo sapiens
ugccaaagcuaacuaauuu

SEQ ID NO: 609762 - RNA, 19 nt, Homo sapiens
gguaauaaccaacuuguaa

SEQ ID NO: 609763 - RNA, 19 nt, Homo sapiens
gcaagacgcugaugcucaa

SEQ ID NO: 609764 - RNA, 19 nt, Homo sapiens
caacugaggacaaggauuu

SEQ ID NO: 609765 - RNA, 19 nt, Homo sapiens
caacagaaacagauagaaa

SEQ ID NO: 609766 - RNA, 19 nt, Homo sapiens
ggacagguuugccaucaga

SEQ ID NO: 609767 - RNA, 19 nt, Homo sapiens
gaggaugaccuugacauua

SEQ ID NO: 609768 - RNA, 19 nt, Homo sapiens
caacugaaccagaggauga

SEQ ID NO: 609769 - RNA, 19 nt, Homo sapiens
ugaagaagguguaaaggau

SEQ ID NO: 609770 - RNA, 19 nt, Homo sapiens
gacuugaacuucuuuaauc

SEQ ID NO: 609771 - RNA, 19 nt, Homo sapiens
gaaagaugaagcucuagaa

SEQ ID NO: 609772 - RNA, 19 nt, Homo sapiens
cuaauuugcuaaucacuga

SEQ ID NO: 609773 - RNA, 19 nt, Homo sapiens
caugaaaccuccacaaguc

SEQ ID NO: 609774 - RNA, 19 nt, Homo sapiens
guucauagacuucuguaaa

SEQ ID NO: 609775 - RNA, 19 nt, Homo sapiens
gauguucuguugccaguau

SEQ ID NO: 609776 - RNA, 19 nt, Homo sapiens
gaaggacacacgacucuau

SEQ ID NO: 609777 - RNA, 19 nt, Homo sapiens
gaaagagacuacacauacg

SEQ ID NO: 609778 - RNA, 19 nt, Homo sapiens
agaugaagcucuagaagau

SEQ ID NO: 609779 - RNA, 19 nt, Homo sapiens
gaguggauauaccguugua

SEQ ID NO: 609780 - RNA, 19 nt, Homo sapiens
ggguacaagugguucuaua

SEQ ID NO: 609781 - RNA, 19 nt, Homo sapiens
ggacaaggauuuggaagcu

SEQ ID NO: 609782 - RNA, 19 nt, Homo sapiens
ggaaaagaauccagauaug

SEQ ID NO: 609783 - RNA, 19 nt, Homo sapiens
aggaugaccuugacauuau

SEQ ID NO: 609784 - RNA, 19 nt, Homo sapiens
ugaugaagcugaagaaggu

SEQ ID NO: 609785 - RNA, 19 nt, Homo sapiens
agaugaggaugaaauacua

SEQ ID NO: 609786 - RNA, 19 nt, Homo sapiens
gauagaaaaugucuugaga

SEQ ID NO: 609787 - RNA, 19 nt, Homo sapiens
gaaauacuagagaaagaug

SEQ ID NO: 609788 - RNA, 19 nt, Homo sapiens
gacauuaugcuuggcaaua

SEQ ID NO: 609789 - RNA, 19 nt, Homo sapiens
cauucuagauguucuguug

SEQ ID NO: 609790 - RNA, 19 nt, Homo sapiens
ggacacacgacucuauuuc

SEQ ID NO: 609791 - RNA, 19 nt, Homo sapiens
acaagugguucuauagaug

SEQ ID NO: 609792 - RNA, 19 nt, Homo sapiens
cagaaagagacuacacaua

SEQ ID NO: 609793 - RNA, 19 nt, Homo sapiens
gaagguguaaaggaucuua

SEQ ID NO: 609794 - RNA, 19 nt, Homo sapiens
agaagaagaagaagccuuu

SEQ ID NO: 609795 - RNA, 19 nt, Homo sapiens
guacaagugguucuauaga

SEQ ID NO: 609796 - RNA, 19 nt, Homo sapiens
ggaaauuugucaugaaacc

SEQ ID NO: 609797 - RNA, 19 nt, Homo sapiens
agaaagagacuacacauac

SEQ ID NO: 609798 - RNA, 19 nt, Homo sapiens
gaaacccagccuucagaaa

SEQ ID NO: 609799 - RNA, 19 nt, Homo sapiens
uuuaacaccugucagagaa

SEQ ID NO: 609800 - RNA, 19 nt, Homo sapiens
cauacucauugccuacuuu

SEQ ID NO: 609801 - RNA, 19 nt, Homo sapiens
caacuuguaaucaaaggaa

SEQ ID NO: 609802 - RNA, 19 nt, Homo sapiens
ggaugaccuugacauuaug

SEQ ID NO: 609803 - RNA, 19 nt, Homo sapiens
gaagauuccaacagaaaca

SEQ ID NO: 609804 - RNA, 19 nt, Homo sapiens
aaacuugucauucuagaug

SEQ ID NO: 609805 - RNA, 19 nt, Homo sapiens
gcccaaacaucuccuugca

SEQ ID NO: 609806 - RNA, 19 nt, Homo sapiens
cuagaugacuugaacuucu

SEQ ID NO: 609807 - RNA, 19 nt, Homo sapiens
agauguggcuggacagguu

SEQ ID NO: 609808 - RNA, 19 nt, Homo sapiens
cgaaacuugucauucuaga

SEQ ID NO: 609809 - RNA, 19 nt, Homo sapiens
ggaugaaauacuagagaaa

SEQ ID NO: 609810 - RNA, 19 nt, Homo sapiens
gaagaggacacuaggaaaa

SEQ ID NO: 609811 - RNA, 19 nt, Homo sapiens
gugccaaagcuaacuaauu

SEQ ID NO: 609812 - RNA, 19 nt, Homo sapiens
aauguuaaguucccagaug

SEQ ID NO: 609813 - RNA, 19 nt, Homo sapiens
uagaugacuugaacuucuu

SEQ ID NO: 609814 - RNA, 19 nt, Homo sapiens
gaggaugaaauacuagaga

SEQ ID NO: 609815 - RNA, 19 nt, Homo sapiens
ggaaacccagccuucagaa

SEQ ID NO: 609816 - RNA, 19 nt, Homo sapiens
uacaagugguucuauagau

SEQ ID NO: 609817 - RNA, 19 nt, Homo sapiens
ccacaagucguccgaguag

SEQ ID NO: 609818 - RNA, 19 nt, Homo sapiens
ucuagaagaugaagacaac

SEQ ID NO: 609819 - RNA, 19 nt, Homo sapiens
ugauauugaugaagcugaa

SEQ ID NO: 609820 - RNA, 19 nt, Homo sapiens
gggcugacccgucugacuu

SEQ ID NO: 609821 - RNA, 19 nt, Homo sapiens
gcuguugacauacucauug

SEQ ID NO: 609822 - RNA, 19 nt, Homo sapiens
gugguucuauagaugguaa

SEQ ID NO: 609823 - RNA, 19 nt, Homo sapiens
gaaaaggaaauuugucaug

SEQ ID NO: 609824 - RNA, 19 nt, Homo sapiens
acgaggagcugcugaaucg

SEQ ID NO: 609825 - RNA, 19 nt, Homo sapiens
augaagcucuagaagauga

SEQ ID NO: 609826 - RNA, 19 nt, Homo sapiens
gaugaaauacuagagaaag

SEQ ID NO: 609827 - RNA, 19 nt, Homo sapiens
cugaugaucuagaugacuu

SEQ ID NO: 609828 - RNA, 19 nt, Homo sapiens
ggauuuggaagcugaugaa

SEQ ID NO: 609829 - RNA, 19 nt, Homo sapiens
gaauuggguacaagugguu

SEQ ID NO: 609830 - RNA, 19 nt, Homo sapiens
gguaucucauucaguaauc

SEQ ID NO: 609831 - RNA, 19 nt, Homo sapiens
caaagcuuguuguggagau

SEQ ID NO: 609832 - RNA, 19 nt, Homo sapiens
ggaaggggauacccaaaca

SEQ ID NO: 609833 - RNA, 19 nt, Homo sapiens
aggaugaaauacuagagaa

SEQ ID NO: 609834 - RNA, 19 nt, Homo sapiens
uuuggaagcugaugaagag

SEQ ID NO: 609835 - RNA, 19 nt, Homo sapiens
gcuaacuaauuugcuaauc

SEQ ID NO: 609836 - RNA, 19 nt, Homo sapiens
gaaacuugucauucuagau

SEQ ID NO: 609837 - RNA, 19 nt, Homo sapiens
caaacaucuccuugcauuu

SEQ ID NO: 609838 - RNA, 19 nt, Homo sapiens
ugaagaggacacuaggaaa

SEQ ID NO: 609839 - RNA, 19 nt, Homo sapiens
agaagaagccuuuuauguu

SEQ ID NO: 609840 - RNA, 19 nt, Homo sapiens
gguacaagugguucuauag

SEQ ID NO: 609841 - RNA, 19 nt, Homo sapiens
gcugcugaaucgaguguuc

SEQ ID NO: 609842 - RNA, 19 nt, Homo sapiens
aaagaauccagauaugguu

SEQ ID NO: 609843 - RNA, 19 nt, Homo sapiens
gggaaaagaauccagauau

SEQ ID NO: 609844 - RNA, 19 nt, Homo sapiens
aagaugaagcucuagaaga

SEQ ID NO: 609845 - RNA, 19 nt, Homo sapiens
gguguaaaggaucuuaaga

SEQ ID NO: 609846 - RNA, 19 nt, Homo sapiens
ugaucuagaugacuugaac

SEQ ID NO: 609847 - RNA, 19 nt, Homo sapiens
cuacuaugagcaagaagaa

SEQ ID NO: 609848 - RNA, 19 nt, Homo sapiens
aaacaucuccuugcauuuu

SEQ ID NO: 609849 - RNA, 19 nt, Homo sapiens
gagaaaaggaaauuuguca

SEQ ID NO: 609850 - RNA, 19 nt, Homo sapiens
gaaaagaauccagauaugg

SEQ ID NO: 609851 - RNA, 19 nt, Homo sapiens
gauccuacuaugagcaaga

SEQ ID NO: 609852 - RNA, 19 nt, Homo sapiens
gaagaugaagacaacaaaa

SEQ ID NO: 609853 - RNA, 19 nt, Homo sapiens
agaagaugaagacaacaaa

SEQ ID NO: 609854 - RNA, 19 nt, Homo sapiens
uagaagaugaagacaacaa

SEQ ID NO: 609855 - RNA, 19 nt, Homo sapiens
uaacaccugucagagaaac

SEQ ID NO: 609856 - RNA, 19 nt, Homo sapiens
guucccagaugaggaugaa

SEQ ID NO: 609857 - RNA, 19 nt, Homo sapiens
gaagaagaagccuuuuaug

SEQ ID NO: 609858 - RNA, 19 nt, Homo sapiens
gaagugagcuuaucuguuu

SEQ ID NO: 609859 - RNA, 19 nt, Homo sapiens
gcagacagcuucucaauau

SEQ ID NO: 609860 - RNA, 19 nt, Homo sapiens
ggaaagcugucuucacuaa

SEQ ID NO: 609861 - RNA, 19 nt, Homo sapiens
gagcaagacuuucaggaua

SEQ ID NO: 609862 - RNA, 19 nt, Homo sapiens
gcacauuccuugacuauau

SEQ ID NO: 609863 - RNA, 19 nt, Homo sapiens
ggaaaugacacauaaagua

SEQ ID NO: 609864 - RNA, 19 nt, Homo sapiens
caacugaacucaagacaug

SEQ ID NO: 609865 - RNA, 19 nt, Homo sapiens
gaucagagauuuacaacug

SEQ ID NO: 609866 - RNA, 19 nt, Homo sapiens
gcacagaggaaauaauaua

SEQ ID NO: 609867 - RNA, 19 nt, Homo sapiens
cagaaaggauuaagaauug

SEQ ID NO: 609868 - RNA, 19 nt, Homo sapiens
ccauuaagguggaguguua

SEQ ID NO: 609869 - RNA, 19 nt, Homo sapiens
gauaagaggaccaaacaua

SEQ ID NO: 609870 - RNA, 19 nt, Homo sapiens
gcacucaacuugggacuuu

SEQ ID NO: 609871 - RNA, 19 nt, Homo sapiens
guaaaucucuuucucuaug

SEQ ID NO: 609872 - RNA, 19 nt, Homo sapiens
gcagguaucacaugaauuu

SEQ ID NO: 609873 - RNA, 19 nt, Homo sapiens
gaacugugauuccagcaaa

SEQ ID NO: 609874 - RNA, 19 nt, Homo sapiens
ucacaugaauuuccaauga

SEQ ID NO: 609875 - RNA, 19 nt, Homo sapiens
gauaagauguuuccagcuu

SEQ ID NO: 609876 - RNA, 19 nt, Homo sapiens
gcacagaaaggauuaagaa

SEQ ID NO: 609877 - RNA, 19 nt, Homo sapiens
gaaacuggcuaaugguuca

SEQ ID NO: 609878 - RNA, 19 nt, Homo sapiens
gaaggcaucuaacuaguag

SEQ ID NO: 609879 - RNA, 19 nt, Homo sapiens
ccaguuaucuguuaaucaa

SEQ ID NO: 609880 - RNA, 19 nt, Homo sapiens
gaauuccguuuccuucuaa

SEQ ID NO: 609881 - RNA, 19 nt, Homo sapiens
gaaguggccaucagagaua

SEQ ID NO: 609882 - RNA, 19 nt, Homo sapiens
gauggaaacuggcuaaugg

SEQ ID NO: 609883 - RNA, 19 nt, Homo sapiens
ccaauggcguuaaugagua

SEQ ID NO: 609884 - RNA, 19 nt, Homo sapiens
gagugaugaugacuucuua

SEQ ID NO: 609885 - RNA, 19 nt, Homo sapiens
gcuaaggucccauauauug

SEQ ID NO: 609886 - RNA, 19 nt, Homo sapiens
ggacuucacuggcuccaau

SEQ ID NO: 609887 - RNA, 19 nt, Homo sapiens
aagcucaccuguugaauuu

SEQ ID NO: 609888 - RNA, 19 nt, Homo sapiens
aaacuaacccuucuucuga

SEQ ID NO: 609889 - RNA, 19 nt, Homo sapiens
ucacaaagguggcgcugaa

SEQ ID NO: 609890 - RNA, 19 nt, Homo sapiens
gaugguagguuguccugaa

SEQ ID NO: 609891 - RNA, 19 nt, Homo sapiens
gaggaugucagcugaauuu

SEQ ID NO: 609892 - RNA, 19 nt, Homo sapiens
gugaaacagugugagauua

SEQ ID NO: 609893 - RNA, 19 nt, Homo sapiens
gaauucagguguuaucagu

SEQ ID NO: 609894 - RNA, 19 nt, Homo sapiens
ggaaauaauauaccagcua

SEQ ID NO: 609895 - RNA, 19 nt, Homo sapiens
gguaaucacugucaauugg

SEQ ID NO: 609896 - RNA, 19 nt, Homo sapiens
cacaguguauguuguauaa

SEQ ID NO: 609897 - RNA, 19 nt, Homo sapiens
gaaagcuuauucuguuguu

SEQ ID NO: 609898 - RNA, 19 nt, Homo sapiens
ucagagauauuguccaguu

SEQ ID NO: 609899 - RNA, 19 nt, Homo sapiens
cagcuaaucuagucaccua

SEQ ID NO: 609900 - RNA, 19 nt, Homo sapiens
uaagaggaccaaacauaua

SEQ ID NO: 609901 - RNA, 19 nt, Homo sapiens
caucauaauuguuggaguu

SEQ ID NO: 609902 - RNA, 19 nt, Homo sapiens
ucacagaccuugaugaaac

SEQ ID NO: 609903 - RNA, 19 nt, Homo sapiens
aaagggagcauuacgauuu

SEQ ID NO: 609904 - RNA, 19 nt, Homo sapiens
ggaaggcaucuaacuagua

SEQ ID NO: 609905 - RNA, 19 nt, Homo sapiens
ggacuggucauucaagauu

SEQ ID NO: 609906 - RNA, 19 nt, Homo sapiens
ccacgaaacucagguugaa

SEQ ID NO: 609907 - RNA, 19 nt, Homo sapiens
agacauggcugcccagugu

SEQ ID NO: 609908 - RNA, 19 nt, Homo sapiens
gaagcucaccuguugaauu

SEQ ID NO: 609909 - RNA, 19 nt, Homo sapiens
caaauuguuuccagcaaga

SEQ ID NO: 609910 - RNA, 19 nt, Homo sapiens
ugucucagauguucuaauu

SEQ ID NO: 609911 - RNA, 19 nt, Homo sapiens
guggugggcuacuucaaua

SEQ ID NO: 609912 - RNA, 19 nt, Homo sapiens
gaugaaaccagacaagcua

SEQ ID NO: 609913 - RNA, 19 nt, Homo sapiens
gcucaccuguugaauuuga

SEQ ID NO: 609914 - RNA, 19 nt, Homo sapiens
cagacaagcuauaguuaau

SEQ ID NO: 609915 - RNA, 19 nt, Homo sapiens
gaaaugacacauaaaguac

SEQ ID NO: 609916 - RNA, 19 nt, Homo sapiens
gcaagacuuucaggauauu

SEQ ID NO: 609917 - RNA, 19 nt, Homo sapiens
agaguggucuuguuugaaa

SEQ ID NO: 609918 - RNA, 19 nt, Homo sapiens
gaauguacccuuggacaaa

SEQ ID NO: 609919 - RNA, 19 nt, Homo sapiens
caacugcugcauuaagaua

SEQ ID NO: 609920 - RNA, 19 nt, Homo sapiens
uaaaucacguggccagguu

SEQ ID NO: 609921 - RNA, 19 nt, Homo sapiens
uacaagaauucagguguua

SEQ ID NO: 609922 - RNA, 19 nt, Homo sapiens
caacuugaauccuguuugg

SEQ ID NO: 609923 - RNA, 19 nt, Homo sapiens
uaguauggcucaauagaug

SEQ ID NO: 609924 - RNA, 19 nt, Homo sapiens
uccagaagcucaccuguug

SEQ ID NO: 609925 - RNA, 19 nt, Homo sapiens
gaauacaaguggucaacag

SEQ ID NO: 609926 - RNA, 19 nt, Homo sapiens
uugcuaaggucccauauau

SEQ ID NO: 609927 - RNA, 19 nt, Homo sapiens
uguccugaauucuacauua

SEQ ID NO: 609928 - RNA, 19 nt, Homo sapiens
ggucuugucuuccucagau

SEQ ID NO: 609929 - RNA, 19 nt, Homo sapiens
cuauugagcugagugauga

SEQ ID NO: 609930 - RNA, 19 nt, Homo sapiens
uaaaguacgccagaaguuu

SEQ ID NO: 609931 - RNA, 19 nt, Homo sapiens
gcacucaaccucaucauac

SEQ ID NO: 609932 - RNA, 19 nt, Homo sapiens
uuacacaacugaacucaag

SEQ ID NO: 609933 - RNA, 19 nt, Homo sapiens
uaacugagcaagacuuuca

SEQ ID NO: 609934 - RNA, 19 nt, Homo sapiens
guaaacauggucagauuug

SEQ ID NO: 609935 - RNA, 19 nt, Homo sapiens
gaacuucaacccauccaau

SEQ ID NO: 609936 - RNA, 19 nt, Homo sapiens
gguggaguguuaugauuau

SEQ ID NO: 609937 - RNA, 19 nt, Homo sapiens
gggaaagcuuauucuguug

SEQ ID NO: 609938 - RNA, 19 nt, Homo sapiens
cacauuccuugacuauaua

SEQ ID NO: 609939 - RNA, 19 nt, Homo sapiens
gaaacagugugagauuaca

SEQ ID NO: 609940 - RNA, 19 nt, Homo sapiens
cuacaagaauucagguguu

SEQ ID NO: 609941 - RNA, 19 nt, Homo sapiens
uaauagaguggucuuguuu

SEQ ID NO: 609942 - RNA, 19 nt, Homo sapiens
cuauauaugugguuaguag

SEQ ID NO: 609943 - RNA, 19 nt, Homo sapiens
caacuugggacuuuaugaa

SEQ ID NO: 609944 - RNA, 19 nt, Homo sapiens
gagauauuguccaguuugu

SEQ ID NO: 609945 - RNA, 19 nt, Homo sapiens
agacagcuucucaauauuu

SEQ ID NO: 609946 - RNA, 19 nt, Homo sapiens
gacuggucauucaagauua

SEQ ID NO: 609947 - RNA, 19 nt, Homo sapiens
ucucuuaacucacuguguu

SEQ ID NO: 609948 - RNA, 19 nt, Homo sapiens
ggucuuguuugaaauggaa

SEQ ID NO: 609949 - RNA, 19 nt, Homo sapiens
uggcacagaggaaauaaua

SEQ ID NO: 609950 - RNA, 19 nt, Homo sapiens
ccagcaaacuaggguaauu

SEQ ID NO: 609951 - RNA, 19 nt, Homo sapiens
ucaauuggauuuggucuuc

SEQ ID NO: 609952 - RNA, 19 nt, Homo sapiens
uagcccagaugagcauuua

SEQ ID NO: 609953 - RNA, 19 nt, Homo sapiens
ucuacagcauaccuuauua

SEQ ID NO: 609954 - RNA, 19 nt, Homo sapiens
ccagacaagcuauaguuaa

SEQ ID NO: 609955 - RNA, 19 nt, Homo sapiens
gcugagugaugaugacuuc

SEQ ID NO: 609956 - RNA, 19 nt, Homo sapiens
gauggaacguguuagaaac

SEQ ID NO: 609957 - RNA, 19 nt, Homo sapiens
cauauccuccuucuccuua

SEQ ID NO: 609958 - RNA, 19 nt, Homo sapiens
gagagaagcugaaacagaa

SEQ ID NO: 609959 - RNA, 19 nt, Homo sapiens
gaaagcacauccuaagauc

SEQ ID NO: 609960 - RNA, 19 nt, Homo sapiens
ggaaagcacauccuaagau

SEQ ID NO: 609961 - RNA, 19 nt, Homo sapiens
gaugagagaagcugaaaca

SEQ ID NO: 609962 - RNA, 19 nt, Homo sapiens
aaagaaggcuuagcagaca

SEQ ID NO: 609963 - RNA, 19 nt, Homo sapiens
gcagagacgagagaucuuu

SEQ ID NO: 609964 - RNA, 19 nt, Homo sapiens
caggauggcugggaguuga

SEQ ID NO: 609965 - RNA, 19 nt, Homo sapiens
gaaagaggaaaguggaauc

SEQ ID NO: 609966 - RNA, 19 nt, Homo sapiens
ugagagaagcugaaacaga

SEQ ID NO: 609967 - RNA, 19 nt, Homo sapiens
gaaagccuacagcagagaa

SEQ ID NO: 609968 - RNA, 19 nt, Homo sapiens
cuacaucuucgaccucuuu

SEQ ID NO: 609969 - RNA, 19 nt, Homo sapiens
gagcugaacaagaauccaa

SEQ ID NO: 609970 - RNA, 19 nt, Homo sapiens
ggaaagaggaaaguggaau

SEQ ID NO: 609971 - RNA, 19 nt, Homo sapiens
gagaacucuuagauauaug

SEQ ID NO: 609972 - RNA, 19 nt, Homo sapiens
gaaucucuguggcccaucu

SEQ ID NO: 609973 - RNA, 19 nt, Homo sapiens
gcacauccuaagaucuuug

SEQ ID NO: 609974 - RNA, 19 nt, Homo sapiens
cagaaccgcaugagggaaa

SEQ ID NO: 609975 - RNA, 19 nt, Homo sapiens
caacugcagagacgagaga

SEQ ID NO: 609976 - RNA, 19 nt, Homo sapiens
aaagcaagguauaggaaac

SEQ ID NO: 609977 - RNA, 19 nt, Homo sapiens
caggauccaccaccagaaa

SEQ ID NO: 609978 - RNA, 19 nt, Homo sapiens
aagcacauccuaagaucuu

SEQ ID NO: 609979 - RNA, 19 nt, Homo sapiens
gaaaacccgcuacaucuuc

SEQ ID NO: 609980 - RNA, 19 nt, Homo sapiens
ggaaagccuacagcagaga

SEQ ID NO: 609981 - RNA, 19 nt, Homo sapiens
ucuauacucuuggaaagca

SEQ ID NO: 609982 - RNA, 19 nt, Homo sapiens
ugucuauacucuuggaaag

SEQ ID NO: 609983 - RNA, 19 nt, Homo sapiens
uuuuagagcugaacaagaa

SEQ ID NO: 609984 - RNA, 19 nt, Homo sapiens
ugccugcggugcauucaga

SEQ ID NO: 609985 - RNA, 19 nt, Homo sapiens
gggaaagaggaaaguggaa

SEQ ID NO: 609986 - RNA, 19 nt, Homo sapiens
ucugcugucuauacucuug

SEQ ID NO: 609987 - RNA, 19 nt, Homo sapiens
aaagaugagagaagcugaa

SEQ ID NO: 609988 - RNA, 19 nt, Homo sapiens
agaucuuucugcugucuau

SEQ ID NO: 609989 - RNA, 19 nt, Homo sapiens
gggauguguucgggcuuug

SEQ ID NO: 609990 - RNA, 19 nt, Homo sapiens
ugggauguguucgggcuuu

SEQ ID NO: 609991 - RNA, 19 nt, Homo sapiens
uuauaaagaaggcuuagca

SEQ ID NO: 609992 - RNA, 19 nt, Homo sapiens
uggaaagcacauccuaaga

SEQ ID NO: 609993 - RNA, 19 nt, Homo sapiens
gaaucagccuuuagaguua

SEQ ID NO: 609994 - RNA, 19 nt, Homo sapiens
gaacacuucucgagacuuu

SEQ ID NO: 609995 - RNA, 19 nt, Homo sapiens
gcauguaacuucaagguuu

SEQ ID NO: 609996 - RNA, 19 nt, Homo sapiens
gauaugagcuggccucugu

SEQ ID NO: 609997 - RNA, 19 nt, Homo sapiens
caaauaaaguugaguguuc

SEQ ID NO: 609998 - RNA, 19 nt, Homo sapiens
gaaaucagcgcuucuggua

SEQ ID NO: 609999 - RNA, 19 nt, Homo sapiens
gaucuugccuuguaaauag

SEQ ID NO: 610000 - RNA, 19 nt, Homo sapiens
caaauuaugugguagcuau

SEQ ID NO: 610001 - RNA, 19 nt, Homo sapiens
gaaauggaguggcuggauu

SEQ ID NO: 610002 - RNA, 19 nt, Homo sapiens
cuccauagcuguacauaua

SEQ ID NO: 610003 - RNA, 19 nt, Homo sapiens
gaacucggaugaucugaau

SEQ ID NO: 610004 - RNA, 19 nt, Homo sapiens
ucauagaucuugccuugua

SEQ ID NO: 610005 - RNA, 19 nt, Homo sapiens
gaacauuccugugcaacaa

SEQ ID NO: 610006 - RNA, 19 nt, Homo sapiens
acaaagaacuggaaagugu

SEQ ID NO: 610007 - RNA, 19 nt, Homo sapiens
gaaacaggguguaguucuu

SEQ ID NO: 610008 - RNA, 19 nt, Homo sapiens
gcgaaugcccagaguauua

SEQ ID NO: 610009 - RNA, 19 nt, Homo sapiens
ucauggaucuucccuuuaa

SEQ ID NO: 610010 - RNA, 19 nt, Homo sapiens
gaacaacgccuggaggauu

SEQ ID NO: 610011 - RNA, 19 nt, Homo sapiens
gaaagccagugcuaacaug

SEQ ID NO: 610012 - RNA, 19 nt, Homo sapiens
gggaugaggugacuucaau

SEQ ID NO: 610013 - RNA, 19 nt, Homo sapiens
ggacaguucuacagacaug

SEQ ID NO: 610014 - RNA, 19 nt, Homo sapiens
gaagguuggagaagaguua

SEQ ID NO: 610015 - RNA, 19 nt, Homo sapiens
gaccaaacguggacaguuc

SEQ ID NO: 610016 - RNA, 19 nt, Homo sapiens
caacagcgccugcgucaga

SEQ ID NO: 610017 - RNA, 19 nt, Homo sapiens
gaacccagcccuucagaga

SEQ ID NO: 610018 - RNA, 19 nt, Homo sapiens
cauguaacuucaagguuua

SEQ ID NO: 610019 - RNA, 19 nt, Homo sapiens
ucauuugacuucaccauaa

SEQ ID NO: 610020 - RNA, 19 nt, Homo sapiens
ccucacagauggauaaaug

SEQ ID NO: 610021 - RNA, 19 nt, Homo sapiens
ggacgaugauggcauguca

SEQ ID NO: 610022 - RNA, 19 nt, Homo sapiens
aaucauggaucuucccuuu

SEQ ID NO: 610023 - RNA, 19 nt, Homo sapiens
uaaaugaggcugauguuug

SEQ ID NO: 610024 - RNA, 19 nt, Homo sapiens
gcagccaccuggacgauga

SEQ ID NO: 610025 - RNA, 19 nt, Homo sapiens
gaaagaagagagccuuguu

SEQ ID NO: 610026 - RNA, 19 nt, Homo sapiens
ggucugauguacaguguga

SEQ ID NO: 610027 - RNA, 19 nt, Homo sapiens
gaagugacauggccuugag

SEQ ID NO: 610028 - RNA, 19 nt, Homo sapiens
gaccagcucccuacacuuu

SEQ ID NO: 610029 - RNA, 19 nt, Homo sapiens
uggcaaacauucauucuau

SEQ ID NO: 610030 - RNA, 19 nt, Homo sapiens
ggaaccaccuguacagagu

SEQ ID NO: 610031 - RNA, 19 nt, Homo sapiens
ucagugagcuuugauaugg

SEQ ID NO: 610032 - RNA, 19 nt, Homo sapiens
ccacuggauuguagauuga

SEQ ID NO: 610033 - RNA, 19 nt, Homo sapiens
gggagcagguggauaaaca

SEQ ID NO: 610034 - RNA, 19 nt, Homo sapiens
ggagaagaguuagguuugu

SEQ ID NO: 610035 - RNA, 19 nt, Homo sapiens
gaagaaagccagugcuaac

SEQ ID NO: 610036 - RNA, 19 nt, Homo sapiens
ggaagaaagccagugcuaa

SEQ ID NO: 610037 - RNA, 19 nt, Homo sapiens
gcuaucagcucuugaaagc

SEQ ID NO: 610038 - RNA, 19 nt, Homo sapiens
gcaaacauucauucuauuc

SEQ ID NO: 610039 - RNA, 19 nt, Homo sapiens
ggagagagcacagaguuug

SEQ ID NO: 610040 - RNA, 19 nt, Homo sapiens
ggaugagaaucuucagguu

SEQ ID NO: 610041 - RNA, 19 nt, Homo sapiens
gugcuaacaugcaaccauu

SEQ ID NO: 610042 - RNA, 19 nt, Homo sapiens
gcugggagcagguggauaa

SEQ ID NO: 610043 - RNA, 19 nt, Homo sapiens
gcaaaguuaucagguguca

SEQ ID NO: 610044 - RNA, 19 nt, Homo sapiens
gcaaagacugcaaaguuau

SEQ ID NO: 610045 - RNA, 19 nt, Homo sapiens
cauuacagcuuauagaaag

SEQ ID NO: 610046 - RNA, 19 nt, Homo sapiens
gauguacagugugaauaaa

SEQ ID NO: 610047 - RNA, 19 nt, Homo sapiens
gcaugucaguguacacaga

SEQ ID NO: 610048 - RNA, 19 nt, Homo sapiens
ggagcaguuucgaauagaa

SEQ ID NO: 610049 - RNA, 19 nt, Homo sapiens
caacaucaaugagaaguac

SEQ ID NO: 610050 - RNA, 19 nt, Homo sapiens
ggaggucuaugccagugaa

SEQ ID NO: 610051 - RNA, 19 nt, Homo sapiens
caucugagcacgucucuga

SEQ ID NO: 610052 - RNA, 19 nt, Homo sapiens
agaguuagguuugugcuuu

SEQ ID NO: 610053 - RNA, 19 nt, Homo sapiens
acacuuuaauggagacuuu

SEQ ID NO: 610054 - RNA, 19 nt, Homo sapiens
guagaaacuuugaagaaac

SEQ ID NO: 610055 - RNA, 19 nt, Homo sapiens
ccagcucccuacacuuuaa

SEQ ID NO: 610056 - RNA, 19 nt, Homo sapiens
gagaagaguuagguuugug

SEQ ID NO: 610057 - RNA, 19 nt, Homo sapiens
gagcaggucccauacaauc

SEQ ID NO: 610058 - RNA, 19 nt, Homo sapiens
gauaaggugaagucaguaa

SEQ ID NO: 610059 - RNA, 19 nt, Homo sapiens
gagcuggccucuguucuca

SEQ ID NO: 610060 - RNA, 19 nt, Homo sapiens
uggaaaguguaucaaguuu

SEQ ID NO: 610061 - RNA, 19 nt, Homo sapiens
gcaaauaaaguugaguguu

SEQ ID NO: 610062 - RNA, 19 nt, Homo sapiens
gaagauugugcauuuccua

SEQ ID NO: 610063 - RNA, 19 nt, Homo sapiens
aaacagccuuaaaucaaga

SEQ ID NO: 610064 - RNA, 19 nt, Homo sapiens
agaaucagccuuuagaguu

SEQ ID NO: 610065 - RNA, 19 nt, Homo sapiens
guacagagugacagauuug

SEQ ID NO: 610066 - RNA, 19 nt, Homo sapiens
gaugauggcaugucagugu

SEQ ID NO: 610067 - RNA, 19 nt, Homo sapiens
ggcaaacauucauucuauu

SEQ ID NO: 610068 - RNA, 19 nt, Homo sapiens
gacauggccuugaggagau

SEQ ID NO: 610069 - RNA, 19 nt, Homo sapiens
gguagaaucagccuuuaga

SEQ ID NO: 610070 - RNA, 19 nt, Homo sapiens
ugugaaaccuccuaguaga

SEQ ID NO: 610071 - RNA, 19 nt, Homo sapiens
cccacaagcuccagcauug

SEQ ID NO: 610072 - RNA, 19 nt, Homo sapiens
gggcaggcauugagauaca

SEQ ID NO: 610073 - RNA, 19 nt, Homo sapiens
uaccaaagacuagaucaua

SEQ ID NO: 610074 - RNA, 19 nt, Homo sapiens
gcaauccgaccaccugcua

SEQ ID NO: 610075 - RNA, 19 nt, Homo sapiens
ugaaugccgagauauauuu

SEQ ID NO: 610076 - RNA, 19 nt, Homo sapiens
ggaaggugguucugugcau

SEQ ID NO: 610077 - RNA, 19 nt, Homo sapiens
aagaauauuuguggaggua

SEQ ID NO: 610078 - RNA, 19 nt, Homo sapiens
aagcaccacugcaggaauu

SEQ ID NO: 610079 - RNA, 19 nt, Homo sapiens
aagauaaggugaagucagu

SEQ ID NO: 610080 - RNA, 19 nt, Homo sapiens
cgacagcugugcaccauac

SEQ ID NO: 610081 - RNA, 19 nt, Homo sapiens
cuaguacacugcucagaug

SEQ ID NO: 610082 - RNA, 19 nt, Homo sapiens
caaagaacuggaaagugua

SEQ ID NO: 610083 - RNA, 19 nt, Homo sapiens
cuggaucacugacaaagaa

SEQ ID NO: 610084 - RNA, 19 nt, Homo sapiens
uauagaaaguguugaaugc

SEQ ID NO: 610085 - RNA, 19 nt, Homo sapiens
acugagggauggcuuguuu

SEQ ID NO: 610086 - RNA, 19 nt, Homo sapiens
caaagaggagaguggagua

SEQ ID NO: 610087 - RNA, 19 nt, Homo sapiens
caacaacgccaaggagaga

SEQ ID NO: 610088 - RNA, 19 nt, Homo sapiens
gauugugcauuuccuagug

SEQ ID NO: 610089 - RNA, 19 nt, Homo sapiens
gaguuagguuugugcuuug

SEQ ID NO: 610090 - RNA, 19 nt, Homo sapiens
guggguagccgucauguug

SEQ ID NO: 610091 - RNA, 19 nt, Homo sapiens
aaaugaggcugauguuugg

SEQ ID NO: 610092 - RNA, 19 nt, Homo sapiens
ggaauugugggaacguauu

SEQ ID NO: 610093 - RNA, 19 nt, Homo sapiens
gaaucagccuuuagaguua

SEQ ID NO: 610094 - RNA, 19 nt, Homo sapiens
gaacacuucucgagacuuu

SEQ ID NO: 610095 - RNA, 19 nt, Homo sapiens
gcauguaacuucaagguuu

SEQ ID NO: 610096 - RNA, 19 nt, Homo sapiens
gauaugagcuggccucugu

SEQ ID NO: 610097 - RNA, 19 nt, Homo sapiens
caaauaaaguugaguguuc

SEQ ID NO: 610098 - RNA, 19 nt, Homo sapiens
gaaaucagcgcuucuggua

SEQ ID NO: 610099 - RNA, 19 nt, Homo sapiens
gaucuugccuuguaaauag

SEQ ID NO: 610100 - RNA, 19 nt, Homo sapiens
caaauuaugugguagcuau

SEQ ID NO: 610101 - RNA, 19 nt, Homo sapiens
gaaauggaguggcuggauu

SEQ ID NO: 610102 - RNA, 19 nt, Homo sapiens
cuccauagcuguacauaua

SEQ ID NO: 610103 - RNA, 19 nt, Homo sapiens
gaacucggaugaucugaau

SEQ ID NO: 610104 - RNA, 19 nt, Homo sapiens
ucauagaucuugccuugua

SEQ ID NO: 610105 - RNA, 19 nt, Homo sapiens
gaucaaacguggaauugug

SEQ ID NO: 610106 - RNA, 19 nt, Homo sapiens
gaacauuccugugcaacaa

SEQ ID NO: 610107 - RNA, 19 nt, Homo sapiens
acaaagaacuggaaagugu

SEQ ID NO: 610108 - RNA, 19 nt, Homo sapiens
gaaacaggguguaguucuu

SEQ ID NO: 610109 - RNA, 19 nt, Homo sapiens
gcgaaugcccagaguauua

SEQ ID NO: 610110 - RNA, 19 nt, Homo sapiens
ucauggaucuucccuuuaa

SEQ ID NO: 610111 - RNA, 19 nt, Homo sapiens
gaacaacgccuggaggauu

SEQ ID NO: 610112 - RNA, 19 nt, Homo sapiens
gaaagccagugcuaacaug

SEQ ID NO: 610113 - RNA, 19 nt, Homo sapiens
ggacaguucuacagacaug

SEQ ID NO: 610114 - RNA, 19 nt, Homo sapiens
gaagguuggagaagaguua

SEQ ID NO: 610115 - RNA, 19 nt, Homo sapiens
gaccaaacguggacaguuc

SEQ ID NO: 610116 - RNA, 19 nt, Homo sapiens
caacagcgccugcgucaga

SEQ ID NO: 610117 - RNA, 19 nt, Homo sapiens
gaacccagcccuucagaga

SEQ ID NO: 610118 - RNA, 19 nt, Homo sapiens
cauguaacuucaagguuua

SEQ ID NO: 610119 - RNA, 19 nt, Homo sapiens
ucauuugacuucaccauaa

SEQ ID NO: 610120 - RNA, 19 nt, Homo sapiens
ccucacagauggauaaaug

SEQ ID NO: 610121 - RNA, 19 nt, Homo sapiens
ggacgaugauggcauguca

SEQ ID NO: 610122 - RNA, 19 nt, Homo sapiens
aaucauggaucuucccuuu

SEQ ID NO: 610123 - RNA, 19 nt, Homo sapiens
uaaaugaggcugauguuug

SEQ ID NO: 610124 - RNA, 19 nt, Homo sapiens
gcagccaccuggacgauga

SEQ ID NO: 610125 - RNA, 19 nt, Homo sapiens
gaaagaagagagccuuguu

SEQ ID NO: 610126 - RNA, 19 nt, Homo sapiens
ggucugauguacaguguga

SEQ ID NO: 610127 - RNA, 19 nt, Homo sapiens
gaagugacauggccuugag

SEQ ID NO: 610128 - RNA, 19 nt, Homo sapiens
gaccagcucccuacacuuu

SEQ ID NO: 610129 - RNA, 19 nt, Homo sapiens
uggcaaacauucauucuau

SEQ ID NO: 610130 - RNA, 19 nt, Homo sapiens
ggaaccaccuguacagagu

SEQ ID NO: 610131 - RNA, 19 nt, Homo sapiens
ucagugagcuuugauaugg

SEQ ID NO: 610132 - RNA, 19 nt, Homo sapiens
ccacuggauuguagauuga

SEQ ID NO: 610133 - RNA, 19 nt, Homo sapiens
ggagaagaguuagguuugu

SEQ ID NO: 610134 - RNA, 19 nt, Homo sapiens
gaagaaagccagugcuaac

SEQ ID NO: 610135 - RNA, 19 nt, Homo sapiens
ggaagaaagccagugcuaa

SEQ ID NO: 610136 - RNA, 19 nt, Homo sapiens
gcuaucagcucuugaaagc

SEQ ID NO: 610137 - RNA, 19 nt, Homo sapiens
gcaaacauucauucuauuc

SEQ ID NO: 610138 - RNA, 19 nt, Homo sapiens
ggagagagcacagaguuug

SEQ ID NO: 610139 - RNA, 19 nt, Homo sapiens
ggaugagaaucuucagguu

SEQ ID NO: 610140 - RNA, 19 nt, Homo sapiens
gugcuaacaugcaaccauu

SEQ ID NO: 610141 - RNA, 19 nt, Homo sapiens
gcaaaguuaucagguguca

SEQ ID NO: 610142 - RNA, 19 nt, Homo sapiens
gcaaagacugcaaaguuau

SEQ ID NO: 610143 - RNA, 19 nt, Homo sapiens
cauuacagcuuauagaaag

SEQ ID NO: 610144 - RNA, 19 nt, Homo sapiens
gauguacagugugaauaaa

SEQ ID NO: 610145 - RNA, 19 nt, Homo sapiens
gcaugucaguguacacaga

SEQ ID NO: 610146 - RNA, 19 nt, Homo sapiens
ggagcaguuucgaauagaa

SEQ ID NO: 610147 - RNA, 19 nt, Homo sapiens
caacaucaaugagaaguac

SEQ ID NO: 610148 - RNA, 19 nt, Homo sapiens
ggaggucuaugccagugaa

SEQ ID NO: 610149 - RNA, 19 nt, Homo sapiens
caucugagcacgucucuga

SEQ ID NO: 610150 - RNA, 19 nt, Homo sapiens
agaguuagguuugugcuuu

SEQ ID NO: 610151 - RNA, 19 nt, Homo sapiens
acacuuuaauggagacuuu

SEQ ID NO: 610152 - RNA, 19 nt, Homo sapiens
guagaaacuuugaagaaac

SEQ ID NO: 610153 - RNA, 19 nt, Homo sapiens
ccagcucccuacacuuuaa

SEQ ID NO: 610154 - RNA, 19 nt, Homo sapiens
gagaagaguuagguuugug

SEQ ID NO: 610155 - RNA, 19 nt, Homo sapiens
gagcaggucccauacaauc

SEQ ID NO: 610156 - RNA, 19 nt, Homo sapiens
gauaaggugaagucaguaa

SEQ ID NO: 610157 - RNA, 19 nt, Homo sapiens
gagcuggccucuguucuca

SEQ ID NO: 610158 - RNA, 19 nt, Homo sapiens
uggaaaguguaucaaguuu

SEQ ID NO: 610159 - RNA, 19 nt, Homo sapiens
gcaaauaaaguugaguguu

SEQ ID NO: 610160 - RNA, 19 nt, Homo sapiens
gaagauugugcauuuccua

SEQ ID NO: 610161 - RNA, 19 nt, Homo sapiens
aaacagccuuaaaucaaga

SEQ ID NO: 610162 - RNA, 19 nt, Homo sapiens
agaaucagccuuuagaguu

SEQ ID NO: 610163 - RNA, 19 nt, Homo sapiens
guacagagugacagauuug

SEQ ID NO: 610164 - RNA, 19 nt, Homo sapiens
gaugauggcaugucagugu

SEQ ID NO: 610165 - RNA, 19 nt, Homo sapiens
ggcaaacauucauucuauu

SEQ ID NO: 610166 - RNA, 19 nt, Homo sapiens
gacauggccuugaggagau

SEQ ID NO: 610167 - RNA, 19 nt, Homo sapiens
gguagaaucagccuuuaga

SEQ ID NO: 610168 - RNA, 19 nt, Homo sapiens
cccacaagcuccagcauug

SEQ ID NO: 610169 - RNA, 19 nt, Homo sapiens
gggcaggcauugagauaca

SEQ ID NO: 610170 - RNA, 19 nt, Homo sapiens
uaccaaagacuagaucaua

SEQ ID NO: 610171 - RNA, 19 nt, Homo sapiens
ugugaaaccuccuaguaga

SEQ ID NO: 610172 - RNA, 19 nt, Homo sapiens
gcaauccgaccaccugcua

SEQ ID NO: 610173 - RNA, 19 nt, Homo sapiens
ugaaugccgagauauauuu

SEQ ID NO: 610174 - RNA, 19 nt, Homo sapiens
ggaaggugguucugugcau

SEQ ID NO: 610175 - RNA, 19 nt, Homo sapiens
aagaauauuuguggaggua

SEQ ID NO: 610176 - RNA, 19 nt, Homo sapiens
aagauaaggugaagucagu

SEQ ID NO: 610177 - RNA, 19 nt, Homo sapiens
cgacagcugugcaccauac

SEQ ID NO: 610178 - RNA, 19 nt, Homo sapiens
cuaguacacugcucagaug

SEQ ID NO: 610179 - RNA, 19 nt, Homo sapiens
caaagaacuggaaagugua

SEQ ID NO: 610180 - RNA, 19 nt, Homo sapiens
cuggaucacugacaaagaa

SEQ ID NO: 610181 - RNA, 19 nt, Homo sapiens
uauagaaaguguugaaugc

SEQ ID NO: 610182 - RNA, 19 nt, Homo sapiens
acugagggauggcuuguuu

SEQ ID NO: 610183 - RNA, 19 nt, Homo sapiens
caaagaggagaguggagua

SEQ ID NO: 610184 - RNA, 19 nt, Homo sapiens
caacaacgccaaggagaga

SEQ ID NO: 610185 - RNA, 19 nt, Homo sapiens
gauugugcauuuccuagug

SEQ ID NO: 610186 - RNA, 19 nt, Homo sapiens
gaguuagguuugugcuuug

SEQ ID NO: 610187 - RNA, 19 nt, Homo sapiens
guggguagccgucauguug

SEQ ID NO: 610188 - RNA, 19 nt, Homo sapiens
aaaugaggcugauguuugg

SEQ ID NO: 610189 - RNA, 19 nt, Homo sapiens
ggaauugugggaacguauu

SEQ ID NO: 610190 - RNA, 19 nt, Homo sapiens
gccgucagcugucugcuau

SEQ ID NO: 610191 - RNA, 19 nt, Homo sapiens
gagguuaugauacggguuu

SEQ ID NO: 610192 - RNA, 19 nt, Homo sapiens
guuaaggcguggcccagaa

SEQ ID NO: 610193 - RNA, 19 nt, Homo sapiens
gaaucagccuuuagaguua

SEQ ID NO: 610194 - RNA, 19 nt, Homo sapiens
gaacacuucucgagacuuu

SEQ ID NO: 610195 - RNA, 19 nt, Homo sapiens
gcauguaacuucaagguuu

SEQ ID NO: 610196 - RNA, 19 nt, Homo sapiens
gauaugagcuggccucugu

SEQ ID NO: 610197 - RNA, 19 nt, Homo sapiens
caaauaaaguugaguguuc

SEQ ID NO: 610198 - RNA, 19 nt, Homo sapiens
gaaaucagcgcuucuggua

SEQ ID NO: 610199 - RNA, 19 nt, Homo sapiens
gaucuugccuuguaaauag

SEQ ID NO: 610200 - RNA, 19 nt, Homo sapiens
caaauuaugugguagcuau

SEQ ID NO: 610201 - RNA, 19 nt, Homo sapiens
gaaauggaguggcuggauu

SEQ ID NO: 610202 - RNA, 19 nt, Homo sapiens
cuccauagcuguacauaua

SEQ ID NO: 610203 - RNA, 19 nt, Homo sapiens
gaacucggaugaucugaau

SEQ ID NO: 610204 - RNA, 19 nt, Homo sapiens
ucauagaucuugccuugua

SEQ ID NO: 610205 - RNA, 19 nt, Homo sapiens
gaacauuccugugcaacaa

SEQ ID NO: 610206 - RNA, 19 nt, Homo sapiens
acaaagaacuggaaagugu

SEQ ID NO: 610207 - RNA, 19 nt, Homo sapiens
gaaacaggguguaguucuu

SEQ ID NO: 610208 - RNA, 19 nt, Homo sapiens
gcgaaugcccagaguauua

SEQ ID NO: 610209 - RNA, 19 nt, Homo sapiens
ucauggaucuucccuuuaa

SEQ ID NO: 610210 - RNA, 19 nt, Homo sapiens
gaacaacgccuggaggauu

SEQ ID NO: 610211 - RNA, 19 nt, Homo sapiens
gaaagccagugcuaacaug

SEQ ID NO: 610212 - RNA, 19 nt, Homo sapiens
ggacaguucuacagacaug

SEQ ID NO: 610213 - RNA, 19 nt, Homo sapiens
gaagguuggagaagaguua

SEQ ID NO: 610214 - RNA, 19 nt, Homo sapiens
gaccaaacguggacaguuc

SEQ ID NO: 610215 - RNA, 19 nt, Homo sapiens
caacagcgccugcgucaga

SEQ ID NO: 610216 - RNA, 19 nt, Homo sapiens
gaacccagcccuucagaga

SEQ ID NO: 610217 - RNA, 19 nt, Homo sapiens
cauguaacuucaagguuua

SEQ ID NO: 610218 - RNA, 19 nt, Homo sapiens
ucauuugacuucaccauaa

SEQ ID NO: 610219 - RNA, 19 nt, Homo sapiens
ccucacagauggauaaaug

SEQ ID NO: 610220 - RNA, 19 nt, Homo sapiens
ggacgaugauggcauguca

SEQ ID NO: 610221 - RNA, 19 nt, Homo sapiens
aaucauggaucuucccuuu

SEQ ID NO: 610222 - RNA, 19 nt, Homo sapiens
uaaaugaggcugauguuug

SEQ ID NO: 610223 - RNA, 19 nt, Homo sapiens
gcagccaccuggacgauga

SEQ ID NO: 610224 - RNA, 19 nt, Homo sapiens
gaaagaagagagccuuguu

SEQ ID NO: 610225 - RNA, 19 nt, Homo sapiens
ggucugauguacaguguga

SEQ ID NO: 610226 - RNA, 19 nt, Homo sapiens
gaagugacauggccuugag

SEQ ID NO: 610227 - RNA, 19 nt, Homo sapiens
gaccagcucccuacacuuu

SEQ ID NO: 610228 - RNA, 19 nt, Homo sapiens
uggcaaacauucauucuau

SEQ ID NO: 610229 - RNA, 19 nt, Homo sapiens
ggaaccaccuguacagagu

SEQ ID NO: 610230 - RNA, 19 nt, Homo sapiens
ucagugagcuuugauaugg

SEQ ID NO: 610231 - RNA, 19 nt, Homo sapiens
ccacuggauuguagauuga

SEQ ID NO: 610232 - RNA, 19 nt, Homo sapiens
ggagaagaguuagguuugu

SEQ ID NO: 610233 - RNA, 19 nt, Homo sapiens
gaagaaagccagugcuaac

SEQ ID NO: 610234 - RNA, 19 nt, Homo sapiens
ggaagaaagccagugcuaa

SEQ ID NO: 610235 - RNA, 19 nt, Homo sapiens
gcuaucagcucuugaaagc

SEQ ID NO: 610236 - RNA, 19 nt, Homo sapiens
gcaaacauucauucuauuc

SEQ ID NO: 610237 - RNA, 19 nt, Homo sapiens
ggagagagcacagaguuug

SEQ ID NO: 610238 - RNA, 19 nt, Homo sapiens
ggaugagaaucuucagguu

SEQ ID NO: 610239 - RNA, 19 nt, Homo sapiens
gugcuaacaugcaaccauu

SEQ ID NO: 610240 - RNA, 19 nt, Homo sapiens
gcaaaguuaucagguguca

SEQ ID NO: 610241 - RNA, 19 nt, Homo sapiens
gcaaagacugcaaaguuau

SEQ ID NO: 610242 - RNA, 19 nt, Homo sapiens
cauuacagcuuauagaaag

SEQ ID NO: 610243 - RNA, 19 nt, Homo sapiens
gauguacagugugaauaaa

SEQ ID NO: 610244 - RNA, 19 nt, Homo sapiens
gcaugucaguguacacaga

SEQ ID NO: 610245 - RNA, 19 nt, Homo sapiens
ggagcaguuucgaauagaa

SEQ ID NO: 610246 - RNA, 19 nt, Homo sapiens
caacaucaaugagaaguac

SEQ ID NO: 610247 - RNA, 19 nt, Homo sapiens
ggaggucuaugccagugaa

SEQ ID NO: 610248 - RNA, 19 nt, Homo sapiens
caucugagcacgucucuga

SEQ ID NO: 610249 - RNA, 19 nt, Homo sapiens
agaguuagguuugugcuuu

SEQ ID NO: 610250 - RNA, 19 nt, Homo sapiens
acacuuuaauggagacuuu

SEQ ID NO: 610251 - RNA, 19 nt, Homo sapiens
guagaaacuuugaagaaac

SEQ ID NO: 610252 - RNA, 19 nt, Homo sapiens
ccagcucccuacacuuuaa

SEQ ID NO: 610253 - RNA, 19 nt, Homo sapiens
gagaagaguuagguuugug

SEQ ID NO: 610254 - RNA, 19 nt, Homo sapiens
gagcaggucccauacaauc

SEQ ID NO: 610255 - RNA, 19 nt, Homo sapiens
gauaaggugaagucaguaa

SEQ ID NO: 610256 - RNA, 19 nt, Homo sapiens
gagcuggccucuguucuca

SEQ ID NO: 610257 - RNA, 19 nt, Homo sapiens
uggaaaguguaucaaguuu

SEQ ID NO: 610258 - RNA, 19 nt, Homo sapiens
gcaaauaaaguugaguguu

SEQ ID NO: 610259 - RNA, 19 nt, Homo sapiens
gaagauugugcauuuccua

SEQ ID NO: 610260 - RNA, 19 nt, Homo sapiens
aaacagccuuaaaucaaga

SEQ ID NO: 610261 - RNA, 19 nt, Homo sapiens
agaaucagccuuuagaguu

SEQ ID NO: 610262 - RNA, 19 nt, Homo sapiens
guacagagugacagauuug

SEQ ID NO: 610263 - RNA, 19 nt, Homo sapiens
gaugauggcaugucagugu

SEQ ID NO: 610264 - RNA, 19 nt, Homo sapiens
ggcaaacauucauucuauu

SEQ ID NO: 610265 - RNA, 19 nt, Homo sapiens
gacauggccuugaggagau

SEQ ID NO: 610266 - RNA, 19 nt, Homo sapiens
gguagaaucagccuuuaga

SEQ ID NO: 610267 - RNA, 19 nt, Homo sapiens
ugugaaaccuccuaguaga

SEQ ID NO: 610268 - RNA, 19 nt, Homo sapiens
cccacaagcuccagcauug

SEQ ID NO: 610269 - RNA, 19 nt, Homo sapiens
gggcaggcauugagauaca

SEQ ID NO: 610270 - RNA, 19 nt, Homo sapiens
uaccaaagacuagaucaua

SEQ ID NO: 610271 - RNA, 19 nt, Homo sapiens
gcaauccgaccaccugcua

SEQ ID NO: 610272 - RNA, 19 nt, Homo sapiens
ugaaugccgagauauauuu

SEQ ID NO: 610273 - RNA, 19 nt, Homo sapiens
ggaaggugguucugugcau

SEQ ID NO: 610274 - RNA, 19 nt, Homo sapiens
aagaauauuuguggaggua

SEQ ID NO: 610275 - RNA, 19 nt, Homo sapiens
aagcaccacugcaggaauu

SEQ ID NO: 610276 - RNA, 19 nt, Homo sapiens
aagauaaggugaagucagu

SEQ ID NO: 610277 - RNA, 19 nt, Homo sapiens
cgacagcugugcaccauac

SEQ ID NO: 610278 - RNA, 19 nt, Homo sapiens
cuaguacacugcucagaug

SEQ ID NO: 610279 - RNA, 19 nt, Homo sapiens
caaagaacuggaaagugua

SEQ ID NO: 610280 - RNA, 19 nt, Homo sapiens
cuggaucacugacaaagaa

SEQ ID NO: 610281 - RNA, 19 nt, Homo sapiens
uauagaaaguguugaaugc

SEQ ID NO: 610282 - RNA, 19 nt, Homo sapiens
acugagggauggcuuguuu

SEQ ID NO: 610283 - RNA, 19 nt, Homo sapiens
caaagaggagaguggagua

SEQ ID NO: 610284 - RNA, 19 nt, Homo sapiens
caacaacgccaaggagaga

SEQ ID NO: 610285 - RNA, 19 nt, Homo sapiens
gauugugcauuuccuagug

SEQ ID NO: 610286 - RNA, 19 nt, Homo sapiens
gaguuagguuugugcuuug

SEQ ID NO: 610287 - RNA, 19 nt, Homo sapiens
guggguagccgucauguug

SEQ ID NO: 610288 - RNA, 19 nt, Homo sapiens
aaaugaggcugauguuugg

SEQ ID NO: 610289 - RNA, 19 nt, Homo sapiens
ggaauugugggaacguauu

SEQ ID NO: 610290 - RNA, 19 nt, Homo sapiens
gccgucagcugucugcuau

SEQ ID NO: 610291 - RNA, 19 nt, Homo sapiens
gagguuaugauacggguuu

SEQ ID NO: 610292 - RNA, 19 nt, Homo sapiens
guuaaggcguggcccagaa

SEQ ID NO: 610293 - RNA, 19 nt, Homo sapiens
ggacaucgauuucaacuaa

SEQ ID NO: 610294 - RNA, 19 nt, Homo sapiens
ccacaagucuguaaacaua

SEQ ID NO: 610295 - RNA, 19 nt, Homo sapiens
aaugaaagcuggagaauaa

SEQ ID NO: 610296 - RNA, 19 nt, Homo sapiens
gaaguacugugcucaaauu

SEQ ID NO: 610297 - RNA, 19 nt, Homo sapiens
ugaaguaacuccauaugua

SEQ ID NO: 610298 - RNA, 19 nt, Homo sapiens
gaaacuguguguaaggaua

SEQ ID NO: 610299 - RNA, 19 nt, Homo sapiens
cugaagagaucaagaauuu

SEQ ID NO: 610300 - RNA, 19 nt, Homo sapiens
gaacauuccucuguaauag

SEQ ID NO: 610301 - RNA, 19 nt, Homo sapiens
gagaaagaauggcuaaguu

SEQ ID NO: 610302 - RNA, 19 nt, Homo sapiens
gaaacucacugguugucua

SEQ ID NO: 610303 - RNA, 19 nt, Homo sapiens
caauaaagcucuguuacaa

SEQ ID NO: 610304 - RNA, 19 nt, Homo sapiens
gcagaagucuccaauaugg

SEQ ID NO: 610305 - RNA, 19 nt, Homo sapiens
ccagaaacaucaugaaaga

SEQ ID NO: 610306 - RNA, 19 nt, Homo sapiens
gaagauccauauuugagaa

SEQ ID NO: 610307 - RNA, 19 nt, Homo sapiens
gcuagcaaaucaguaauua

SEQ ID NO: 610308 - RNA, 19 nt, Homo sapiens
cagcaaauauuccugauga

SEQ ID NO: 610309 - RNA, 19 nt, Homo sapiens
acaagaagauccauauuug

SEQ ID NO: 610310 - RNA, 19 nt, Homo sapiens
gaaguaacuccauauguaa

SEQ ID NO: 610311 - RNA, 19 nt, Homo sapiens
uuaaaucucucuaggauga

SEQ ID NO: 610312 - RNA, 19 nt, Homo sapiens
uagaaagucuucggaauuu

SEQ ID NO: 610313 - RNA, 19 nt, Homo sapiens
ggccaaagauguaacuuau

SEQ ID NO: 610314 - RNA, 19 nt, Homo sapiens
caacuguucucccuuguga

SEQ ID NO: 610315 - RNA, 19 nt, Homo sapiens
uguccaaacuguuguauaa

SEQ ID NO: 610316 - RNA, 19 nt, Homo sapiens
guacugugcucaaauuuua

SEQ ID NO: 610317 - RNA, 19 nt, Homo sapiens
gcagguggcuuaagugaag

SEQ ID NO: 610318 - RNA, 19 nt, Homo sapiens
uaagugaaguaacuccaua

SEQ ID NO: 610319 - RNA, 19 nt, Homo sapiens
gacaagaagauccauauuu

SEQ ID NO: 610320 - RNA, 19 nt, Homo sapiens
uuaaagacauggccaaaga

SEQ ID NO: 610321 - RNA, 19 nt, Homo sapiens
gauuaagucuaccaaagaa

SEQ ID NO: 610322 - RNA, 19 nt, Homo sapiens
gauaugaacuuugugauac

SEQ ID NO: 610323 - RNA, 19 nt, Homo sapiens
gcagggaauuccaaaugaa

SEQ ID NO: 610324 - RNA, 19 nt, Homo sapiens
aaagaaguauucccugaaa

SEQ ID NO: 610325 - RNA, 19 nt, Homo sapiens
gcacuugggcauuuaauau

SEQ ID NO: 610326 - RNA, 19 nt, Homo sapiens
ucacuguggucuuacauaa

SEQ ID NO: 610327 - RNA, 19 nt, Homo sapiens
gaaaauggguggaagcuau

SEQ ID NO: 610328 - RNA, 19 nt, Homo sapiens
caaguuagcagaaauggaa

SEQ ID NO: 610329 - RNA, 19 nt, Homo sapiens
ccacugcaauucacauuau

SEQ ID NO: 610330 - RNA, 19 nt, Homo sapiens
uuagagaccaguaugauua

SEQ ID NO: 610331 - RNA, 19 nt, Homo sapiens
gagaaguacugugcucaaa

SEQ ID NO: 610332 - RNA, 19 nt, Homo sapiens
gcaaaugcuguuacaaauu

SEQ ID NO: 610333 - RNA, 19 nt, Homo sapiens
uagaauggcugaagagauc

SEQ ID NO: 610334 - RNA, 19 nt, Homo sapiens
guagaaagucuucggaauu

SEQ ID NO: 610335 - RNA, 19 nt, Homo sapiens
gaagacgucugugguagug

SEQ ID NO: 610336 - RNA, 19 nt, Homo sapiens
gaagaugccuaucaaaaug

SEQ ID NO: 610337 - RNA, 19 nt, Homo sapiens
ggagggaggaggaauacua

SEQ ID NO: 610338 - RNA, 19 nt, Homo sapiens
ggcaaaugcuguuacaaau

SEQ ID NO: 610339 - RNA, 19 nt, Homo sapiens
caacagauacaaagaacuu

SEQ ID NO: 610340 - RNA, 19 nt, Homo sapiens
uaggauugcugacaaggua

SEQ ID NO: 610341 - RNA, 19 nt, Homo sapiens
gcauuuaaguggcuagcaa

SEQ ID NO: 610342 - RNA, 19 nt, Homo sapiens
aaaaucagcuucuguugua

SEQ ID NO: 610343 - RNA, 19 nt, Homo sapiens
gcagaugacaagacaguuu

SEQ ID NO: 610344 - RNA, 19 nt, Homo sapiens
gaaagucaagccacaauca

SEQ ID NO: 610345 - RNA, 19 nt, Homo sapiens
gaagcuauaugacccucuu

SEQ ID NO: 610346 - RNA, 19 nt, Homo sapiens
ucuaauaaccugccucuuu

SEQ ID NO: 610347 - RNA, 19 nt, Homo sapiens
gcaauaaagcucuguuaca

SEQ ID NO: 610348 - RNA, 19 nt, Homo sapiens
acaauugccucauguaauc

SEQ ID NO: 610349 - RNA, 19 nt, Homo sapiens
uuaaguggcuagcaaauca

SEQ ID NO: 610350 - RNA, 19 nt, Homo sapiens
gcuauacacucuugauuac

SEQ ID NO: 610351 - RNA, 19 nt, Homo sapiens
auaaaggacuguaagauca

SEQ ID NO: 610352 - RNA, 19 nt, Homo sapiens
agaauucagugcauacaaa

SEQ ID NO: 610353 - RNA, 19 nt, Homo sapiens
guaauguacuguaacaaag

SEQ ID NO: 610354 - RNA, 19 nt, Homo sapiens
cugcagaagucuccaauau

SEQ ID NO: 610355 - RNA, 19 nt, Homo sapiens
gauauuacauaagguggaa

SEQ ID NO: 610356 - RNA, 19 nt, Homo sapiens
gaacuaguuuuccuggaua

SEQ ID NO: 610357 - RNA, 19 nt, Homo sapiens
ggcagggaauuccaaauga

SEQ ID NO: 610358 - RNA, 19 nt, Homo sapiens
cuaauucacuauacagaga

SEQ ID NO: 610359 - RNA, 19 nt, Homo sapiens
gauuuaccuugaucacuuu

SEQ ID NO: 610360 - RNA, 19 nt, Homo sapiens
ugauaucccuuucuccauu

SEQ ID NO: 610361 - RNA, 19 nt, Homo sapiens
gaacuacagagagagauuu

SEQ ID NO: 610362 - RNA, 19 nt, Homo sapiens
cauguuggauggauacuau

SEQ ID NO: 610363 - RNA, 19 nt, Homo sapiens
ugucacgaauuauagguua

SEQ ID NO: 610364 - RNA, 19 nt, Homo sapiens
cugcauaccucaacuuuua

SEQ ID NO: 610365 - RNA, 19 nt, Homo sapiens
uagaaacauuugacucuga

SEQ ID NO: 610366 - RNA, 19 nt, Homo sapiens
gcuagaacauauuaagcuu

SEQ ID NO: 610367 - RNA, 19 nt, Homo sapiens
ggcaucaucucuuccuuug

SEQ ID NO: 610368 - RNA, 19 nt, Homo sapiens
ccaguaugauuaaguugaa

SEQ ID NO: 610369 - RNA, 19 nt, Homo sapiens
gaacacacagaagcuaauu

SEQ ID NO: 610370 - RNA, 19 nt, Homo sapiens
ccaauuaccagaaacauca

SEQ ID NO: 610371 - RNA, 19 nt, Homo sapiens
uacaggaguucaaagaauu

SEQ ID NO: 610372 - RNA, 19 nt, Homo sapiens
uagaggaacuacagagaga

SEQ ID NO: 610373 - RNA, 19 nt, Homo sapiens
caaauauuccugaugaaga

SEQ ID NO: 610374 - RNA, 19 nt, Homo sapiens
ugaacgauaugaacuuugu

SEQ ID NO: 610375 - RNA, 19 nt, Homo sapiens
ggaagaaccacccuugcuu

SEQ ID NO: 610376 - RNA, 19 nt, Homo sapiens
ucagagaauucagugcaua

SEQ ID NO: 610377 - RNA, 19 nt, Homo sapiens
gaaagucuucggaauuuag

SEQ ID NO: 610378 - RNA, 19 nt, Homo sapiens
ggcaaaggguggagguuau

SEQ ID NO: 610379 - RNA, 19 nt, Homo sapiens
uaaagagaguggcauccuu

SEQ ID NO: 610380 - RNA, 19 nt, Homo sapiens
cgauaugaacuuugugaua

SEQ ID NO: 610381 - RNA, 19 nt, Homo sapiens
ggacaagaagauccauauu

SEQ ID NO: 610382 - RNA, 19 nt, Homo sapiens
gaauugacaguuacauguu

SEQ ID NO: 610383 - RNA, 19 nt, Homo sapiens
guauuucacuugucuugug

SEQ ID NO: 610384 - RNA, 19 nt, Homo sapiens
caagaagauccauauuuga

SEQ ID NO: 610385 - RNA, 19 nt, Homo sapiens
gacuagaaacuguguguaa

SEQ ID NO: 610386 - RNA, 19 nt, Homo sapiens
cagauuccauuucaacuuc

SEQ ID NO: 610387 - RNA, 19 nt, Homo sapiens
ucacaugucuaccacaagu

SEQ ID NO: 610388 - RNA, 19 nt, Homo sapiens
ucacuugucuugugugucu

SEQ ID NO: 610389 - RNA, 19 nt, Homo sapiens
gaaaauuauugccgucauu

SEQ ID NO: 610390 - RNA, 19 nt, Homo sapiens
ucacuaauccucucuaugg

SEQ ID NO: 610391 - RNA, 19 nt, Homo sapiens
ccacaauauucauguuaug

SEQ ID NO: 610392 - RNA, 19 nt, Homo sapiens
gagaguggcauccuucaga

SEQ ID NO: 610393 - RNA, 19 nt, Homo sapiens
ggaaauaggucuaguacua

SEQ ID NO: 610394 - RNA, 19 nt, Homo sapiens
guagaaaccucguuauuaa

SEQ ID NO: 610395 - RNA, 19 nt, Homo sapiens
ugaagaaccuuuccauuua

SEQ ID NO: 610396 - RNA, 19 nt, Homo sapiens
agaaguagaucucccauua

SEQ ID NO: 610397 - RNA, 19 nt, Homo sapiens
gaggaagcaugauauauuu

SEQ ID NO: 610398 - RNA, 19 nt, Homo sapiens
gaaagaaagccauauauuc

SEQ ID NO: 610399 - RNA, 19 nt, Homo sapiens
gaacagagaagaauccaaa

SEQ ID NO: 610400 - RNA, 19 nt, Homo sapiens
caucuuauauucacccuua

SEQ ID NO: 610401 - RNA, 19 nt, Homo sapiens
ggaaagaugccaaauaaga

SEQ ID NO: 610402 - RNA, 19 nt, Homo sapiens
uagaguagcuguaugcuuu

SEQ ID NO: 610403 - RNA, 19 nt, Homo sapiens
gcaaaagacugguuuaaaa

SEQ ID NO: 610404 - RNA, 19 nt, Homo sapiens
cagcauauauucaacauga

SEQ ID NO: 610405 - RNA, 19 nt, Homo sapiens
aaggaaagaugccaaauaa

SEQ ID NO: 610406 - RNA, 19 nt, Homo sapiens
aaacagagagccuugauua

SEQ ID NO: 610407 - RNA, 19 nt, Homo sapiens
gcgaguagcugcugauguu

SEQ ID NO: 610408 - RNA, 19 nt, Homo sapiens
caauugggcuucauaaaug

SEQ ID NO: 610409 - RNA, 19 nt, Homo sapiens
aagcagaacucuagcuaua

SEQ ID NO: 610410 - RNA, 19 nt, Homo sapiens
guggucaacuuuaguaaua

SEQ ID NO: 610411 - RNA, 19 nt, Homo sapiens
uaagguuucuguccuauaa

SEQ ID NO: 610412 - RNA, 19 nt, Homo sapiens
ggacccagcuaaacgaauu

SEQ ID NO: 610413 - RNA, 19 nt, Homo sapiens
ggaaagaaagccauauauu

SEQ ID NO: 610414 - RNA, 19 nt, Homo sapiens
ggagaaaguuacuguuaug

SEQ ID NO: 610415 - RNA, 19 nt, Homo sapiens
uauggaagcugauuucuga

SEQ ID NO: 610416 - RNA, 19 nt, Homo sapiens
gcagaacucuagcuauaug

SEQ ID NO: 610417 - RNA, 19 nt, Homo sapiens
caauggaucucaaaggaaa

SEQ ID NO: 610418 - RNA, 19 nt, Homo sapiens
gaacuuacgagagguguua

SEQ ID NO: 610419 - RNA, 19 nt, Homo sapiens
gauguuggucuucauauua

SEQ ID NO: 610420 - RNA, 19 nt, Homo sapiens
ugaagaagcccuaauagaa

SEQ ID NO: 610421 - RNA, 19 nt, Homo sapiens
gaagaaccuuuccauuuag

SEQ ID NO: 610422 - RNA, 19 nt, Homo sapiens
ggauagacuuuauucuuga

SEQ ID NO: 610423 - RNA, 19 nt, Homo sapiens
ucacagcaguuuauuaaug

SEQ ID NO: 610424 - RNA, 19 nt, Homo sapiens
gaaauguucacgacaaauu

SEQ ID NO: 610425 - RNA, 19 nt, Homo sapiens
uaagucagguaaaccauaa

SEQ ID NO: 610426 - RNA, 19 nt, Homo sapiens
gcauaaaccuuccacucuu

SEQ ID NO: 610427 - RNA, 19 nt, Homo sapiens
auaaauaccuugcugaaga

SEQ ID NO: 610428 - RNA, 19 nt, Homo sapiens
gagaugauauccucaguag

SEQ ID NO: 610429 - RNA, 19 nt, Homo sapiens
gaagagaacgcgcuugaug

SEQ ID NO: 610430 - RNA, 19 nt, Homo sapiens
uggaacaacugacaaauga

SEQ ID NO: 610431 - RNA, 19 nt, Homo sapiens
gaaaagguguguucaaaga

SEQ ID NO: 610432 - RNA, 19 nt, Homo sapiens
ggaagaugcuaauucugaa

SEQ ID NO: 610433 - RNA, 19 nt, Homo sapiens
ccaauuaaaucucccucua

SEQ ID NO: 610434 - RNA, 19 nt, Homo sapiens
guacggcucucaaagaugu

SEQ ID NO: 610435 - RNA, 19 nt, Homo sapiens
guaaagaucaucagaaaca

SEQ ID NO: 610436 - RNA, 19 nt, Homo sapiens
caagguguauucaguaaug

SEQ ID NO: 610437 - RNA, 19 nt, Homo sapiens
gaagcaaaguaaaggaaga

SEQ ID NO: 610438 - RNA, 19 nt, Homo sapiens
ucucaaagauguuacaguu

SEQ ID NO: 610439 - RNA, 19 nt, Homo sapiens
gaaguaagucucaagauca

SEQ ID NO: 610440 - RNA, 19 nt, Homo sapiens
gauggaagaugcuaauucu

SEQ ID NO: 610441 - RNA, 19 nt, Homo sapiens
gaaaggaacccuaucaacu

SEQ ID NO: 610442 - RNA, 19 nt, Homo sapiens
gggagaaaguuacuguuau

SEQ ID NO: 610443 - RNA, 19 nt, Homo sapiens
acaauauccugguuaauga

SEQ ID NO: 610444 - RNA, 19 nt, Homo sapiens
gauaaacguuacaaugugu

SEQ ID NO: 610445 - RNA, 19 nt, Homo sapiens
agaagcaggucuccacuuu

SEQ ID NO: 610446 - RNA, 19 nt, Homo sapiens
agaacgcgcuugauggaua

SEQ ID NO: 610447 - RNA, 19 nt, Homo sapiens
aauauugggugguugauuu

SEQ ID NO: 610448 - RNA, 19 nt, Homo sapiens
gaaauuucacagcaguuua

SEQ ID NO: 610449 - RNA, 19 nt, Homo sapiens
gcaggcaauuguucagaaa

SEQ ID NO: 610450 - RNA, 19 nt, Homo sapiens
gaaagaugccaaauaagau

SEQ ID NO: 610451 - RNA, 19 nt, Homo sapiens
gaaugcuccugaauaaaug

SEQ ID NO: 610452 - RNA, 19 nt, Homo sapiens
ggguauaauucaggauuua

SEQ ID NO: 610453 - RNA, 19 nt, Homo sapiens
ccaaggguuugaguaaaua

SEQ ID NO: 610454 - RNA, 19 nt, Homo sapiens
caaauuucauugucugaga

SEQ ID NO: 610455 - RNA, 19 nt, Homo sapiens
gcaaaguaaaggaagauaa

SEQ ID NO: 610456 - RNA, 19 nt, Homo sapiens
guaagggacuguucugaag

SEQ ID NO: 610457 - RNA, 19 nt, Homo sapiens
gcgaaguaguuaagaaaug

SEQ ID NO: 610458 - RNA, 19 nt, Homo sapiens
gacacucacuuauuguaaa

SEQ ID NO: 610459 - RNA, 19 nt, Homo sapiens
guuggcaccugauauguuu

SEQ ID NO: 610460 - RNA, 19 nt, Homo sapiens
ugugauaacugaucuuguu

SEQ ID NO: 610461 - RNA, 19 nt, Homo sapiens
gcuguaagauccuauaguc

SEQ ID NO: 610462 - RNA, 19 nt, Homo sapiens
gaacacgaccucgagauga

SEQ ID NO: 610463 - RNA, 19 nt, Homo sapiens
gagccgauccuuagaaaga

SEQ ID NO: 610464 - RNA, 19 nt, Homo sapiens
cauauuugcauuccucuua

SEQ ID NO: 610465 - RNA, 19 nt, Homo sapiens
agugaaugcuccugaauaa

SEQ ID NO: 610466 - RNA, 19 nt, Homo sapiens
caguaugcaucacuagaua

SEQ ID NO: 610467 - RNA, 19 nt, Homo sapiens
cugaaaguccucauauuua

SEQ ID NO: 610468 - RNA, 19 nt, Homo sapiens
ucaacuugcuauagacuuu

SEQ ID NO: 610469 - RNA, 19 nt, Homo sapiens
ggaagcaugauauauuuga

SEQ ID NO: 610470 - RNA, 19 nt, Homo sapiens
gacaauauccugguuaaug

SEQ ID NO: 610471 - RNA, 19 nt, Homo sapiens
cagacaauauccugguuaa

SEQ ID NO: 610472 - RNA, 19 nt, Homo sapiens
agaaguggcuguaaagauc

SEQ ID NO: 610473 - RNA, 19 nt, Homo sapiens
uagcaggucuccaagaaga

SEQ ID NO: 610474 - RNA, 19 nt, Homo sapiens
gaaggucacgguccaaaga

SEQ ID NO: 610475 - RNA, 19 nt, Homo sapiens
ucugauagaugucauuaug

SEQ ID NO: 610476 - RNA, 19 nt, Homo sapiens
uaugguaugugguagagua

SEQ ID NO: 610477 - RNA, 19 nt, Homo sapiens
uggauagacuuuauucuug

SEQ ID NO: 610478 - RNA, 19 nt, Homo sapiens
ccuaucaacugucuuaugu

SEQ ID NO: 610479 - RNA, 19 nt, Homo sapiens
uguagaaaccucguuauua

SEQ ID NO: 610480 - RNA, 19 nt, Homo sapiens
gcagcucaguggaagauga

SEQ ID NO: 610481 - RNA, 19 nt, Homo sapiens
ggugguugauuuguucuua

SEQ ID NO: 610482 - RNA, 19 nt, Homo sapiens
ggcaagguguauucaguaa

SEQ ID NO: 610483 - RNA, 19 nt, Homo sapiens
gguaccauuugaauuguaa

SEQ ID NO: 610484 - RNA, 19 nt, Homo sapiens
uagcagacuuggcuucauu

SEQ ID NO: 610485 - RNA, 19 nt, Homo sapiens
ugaggaagcaugauauauu

SEQ ID NO: 610486 - RNA, 19 nt, Homo sapiens
aaaggaaagaugccaaaua

SEQ ID NO: 610487 - RNA, 19 nt, Homo sapiens
caccuuaucuugucaguag

SEQ ID NO: 610488 - RNA, 19 nt, Homo sapiens
caacaugucugugccaucu

SEQ ID NO: 610489 - RNA, 19 nt, Homo sapiens
gaagaagcccuaauagaac

SEQ ID NO: 610490 - RNA, 19 nt, Homo sapiens
ccagagaggagacgacuuu

SEQ ID NO: 610491 - RNA, 19 nt, Homo sapiens
ggucugaaacugauaaaga

SEQ ID NO: 610492 - RNA, 19 nt, Homo sapiens
cugaagaaccuuuccauuu

SEQ ID NO: 610493 - RNA, 19 nt, Homo sapiens
gauauauccuccugaagua

SEQ ID NO: 610494 - RNA, 19 nt, Homo sapiens
gaauuuaguuucccuuaga

SEQ ID NO: 610495 - RNA, 19 nt, Homo sapiens
gaacuucaccuccauauca

SEQ ID NO: 610496 - RNA, 19 nt, Homo sapiens
gaaccuggcuaaguacgua

SEQ ID NO: 610497 - RNA, 19 nt, Homo sapiens
gcagauccauucuugaaau

SEQ ID NO: 610498 - RNA, 19 nt, Homo sapiens
ucacaagaaucagguguua

SEQ ID NO: 610499 - RNA, 19 nt, Homo sapiens
ugaagcagauccauucuug

SEQ ID NO: 610500 - RNA, 19 nt, Homo sapiens
cauaaagcguaccuugaua

SEQ ID NO: 610501 - RNA, 19 nt, Homo sapiens
ggacugagaaccuggcuaa

SEQ ID NO: 610502 - RNA, 19 nt, Homo sapiens
cagaaacccuugcugcauu

SEQ ID NO: 610503 - RNA, 19 nt, Homo sapiens
cugagaaccuggcuaagua

SEQ ID NO: 610504 - RNA, 19 nt, Homo sapiens
uaaacugcuugucuuauga

SEQ ID NO: 610505 - RNA, 19 nt, Homo sapiens
caauaaacugcuugucuua

SEQ ID NO: 610506 - RNA, 19 nt, Homo sapiens
uaucagaagugccaauaau

SEQ ID NO: 610507 - RNA, 19 nt, Homo sapiens
gagcagagacccuguaucu

SEQ ID NO: 610508 - RNA, 19 nt, Homo sapiens
acaauaaguuucugaaugg

SEQ ID NO: 610509 - RNA, 19 nt, Homo sapiens
cagauccauucuugaaaua

SEQ ID NO: 610510 - RNA, 19 nt, Homo sapiens
gcacccugcucgucacuug

SEQ ID NO: 610511 - RNA, 19 nt, Homo sapiens
gacugaauaugcugaagaa

SEQ ID NO: 610512 - RNA, 19 nt, Homo sapiens
cuacauggaugaacuagag

SEQ ID NO: 610513 - RNA, 19 nt, Homo sapiens
caaacuauacugugaacaa

SEQ ID NO: 610514 - RNA, 19 nt, Homo sapiens
uagggaagcugaaauaagg

SEQ ID NO: 610515 - RNA, 19 nt, Homo sapiens
uaaagcguaccuugauaua

SEQ ID NO: 610516 - RNA, 19 nt, Homo sapiens
agagauauauccuccugaa

SEQ ID NO: 610517 - RNA, 19 nt, Homo sapiens
guaucuggcugucaacuuc

SEQ ID NO: 610518 - RNA, 19 nt, Homo sapiens
gcaaggguuugacaucuac

SEQ ID NO: 610519 - RNA, 19 nt, Homo sapiens
gauccauucuugaaauauc

SEQ ID NO: 610520 - RNA, 19 nt, Homo sapiens
gcaaucauguacccuggau

SEQ ID NO: 610521 - RNA, 19 nt, Homo sapiens
ggagccaccugcaguucuu

SEQ ID NO: 610522 - RNA, 19 nt, Homo sapiens
ccaaagcacacuacaugaa

SEQ ID NO: 610523 - RNA, 19 nt, Homo sapiens
acaagaaucagguguuauu

SEQ ID NO: 610524 - RNA, 19 nt, Homo sapiens
gcucccagauuucgucuuc

SEQ ID NO: 610525 - RNA, 19 nt, Homo sapiens
ccggacacauagaaagaua

SEQ ID NO: 610526 - RNA, 19 nt, Homo sapiens
agaaacccuugcugcauuu

SEQ ID NO: 610527 - RNA, 19 nt, Homo sapiens
ggacagguuccuuucaugu

SEQ ID NO: 610528 - RNA, 19 nt, Homo sapiens
gcagagcugagucuacuug

SEQ ID NO: 610529 - RNA, 19 nt, Homo sapiens
gaaggcaugcgcacgauuc

SEQ ID NO: 610530 - RNA, 19 nt, Homo sapiens
ucccgaugcuugucagaua

SEQ ID NO: 610531 - RNA, 19 nt, Homo sapiens
gaaagcacucccugacugu

SEQ ID NO: 610532 - RNA, 19 nt, Homo sapiens
uaguuucccuuagacuuua

SEQ ID NO: 610533 - RNA, 19 nt, Homo sapiens
gacagguuccuuucaugua

SEQ ID NO: 610534 - RNA, 19 nt, Homo sapiens
gagaggggauggcauuuga

SEQ ID NO: 610535 - RNA, 19 nt, Homo sapiens
caguucuucuucuacaaua

SEQ ID NO: 610536 - RNA, 19 nt, Homo sapiens
acagguuccuuucauguau

SEQ ID NO: 610537 - RNA, 19 nt, Homo sapiens
gagcugagucuacuugaag

SEQ ID NO: 610538 - RNA, 19 nt, Homo sapiens
gaagaagcagccagacauc

SEQ ID NO: 610539 - RNA, 19 nt, Homo sapiens
gguuugacaucuacaugga

SEQ ID NO: 610540 - RNA, 19 nt, Homo sapiens
gcaauuagggagaaguaca

SEQ ID NO: 610541 - RNA, 19 nt, Homo sapiens
ucauguaugucuguucuga

SEQ ID NO: 610542 - RNA, 19 nt, Homo sapiens
aaagcacacuacaugaaga

SEQ ID NO: 610543 - RNA, 19 nt, Homo sapiens
ggauggcauuugaggaugu

SEQ ID NO: 610544 - RNA, 19 nt, Homo sapiens
gaaacugcagcucguagga

SEQ ID NO: 610545 - RNA, 19 nt, Homo sapiens
aagcagauccauucuugaa

SEQ ID NO: 610546 - RNA, 19 nt, Homo sapiens
gaacacuugcuucugaaag

SEQ ID NO: 610547 - RNA, 19 nt, Homo sapiens
ggauguguaugaaguagac

SEQ ID NO: 610548 - RNA, 19 nt, Homo sapiens
cauuugaggauguguauga

SEQ ID NO: 610549 - RNA, 19 nt, Homo sapiens
aguacaaggcuucaaagua

SEQ ID NO: 610550 - RNA, 19 nt, Homo sapiens
ccaaccaguuucuccuuca

SEQ ID NO: 610551 - RNA, 19 nt, Homo sapiens
caaagcacacuacaugaag

SEQ ID NO: 610552 - RNA, 19 nt, Homo sapiens
cguggagucugaagcaaug

SEQ ID NO: 610553 - RNA, 19 nt, Homo sapiens
gcucgucacuugggaugga

SEQ ID NO: 610554 - RNA, 19 nt, Homo sapiens
gaguugugcuggcuacagu

SEQ ID NO: 610555 - RNA, 19 nt, Homo sapiens
ccuuagacuuuaguaguuu

SEQ ID NO: 610556 - RNA, 19 nt, Homo sapiens
gcaguucuucuucuacaau

SEQ ID NO: 610557 - RNA, 19 nt, Homo sapiens
ucaaaguaccugugugugu

SEQ ID NO: 610558 - RNA, 19 nt, Homo sapiens
ucauaaagcguaccuugau

SEQ ID NO: 610559 - RNA, 19 nt, Homo sapiens
gaagcagauccauucuuga

SEQ ID NO: 610560 - RNA, 19 nt, Homo sapiens
uagcagagcugagucuacu

SEQ ID NO: 610561 - RNA, 19 nt, Homo sapiens
cucccagucugaagauaua

SEQ ID NO: 610562 - RNA, 19 nt, Homo sapiens
guagacaccggcacacuca

SEQ ID NO: 610563 - RNA, 19 nt, Homo sapiens
gaggauguguaugaaguag

SEQ ID NO: 610564 - RNA, 19 nt, Homo sapiens
ugaauuuaguuucccuuag

SEQ ID NO: 610565 - RNA, 19 nt, Homo sapiens
cauaucagaagugccaaua

SEQ ID NO: 610566 - RNA, 19 nt, Homo sapiens
auggaacacuugcuucuga

SEQ ID NO: 610567 - RNA, 19 nt, Homo sapiens
acacauagaaagauaacga

SEQ ID NO: 610568 - RNA, 19 nt, Homo sapiens
gaaacccuugcugcauuua

SEQ ID NO: 610569 - RNA, 19 nt, Homo sapiens
aaacuauacugugaacaag

SEQ ID NO: 610570 - RNA, 19 nt, Homo sapiens
guacguagcagagcugagu

SEQ ID NO: 610571 - RNA, 19 nt, Homo sapiens
ggaacacuugcuucugaaa

SEQ ID NO: 610572 - RNA, 19 nt, Homo sapiens
ucauguacccuggaucuuu

SEQ ID NO: 610573 - RNA, 19 nt, Homo sapiens
ccuuagggaagcugaaaua

SEQ ID NO: 610574 - RNA, 19 nt, Homo sapiens
caacacaguuuccccuaug

SEQ ID NO: 610575 - RNA, 19 nt, Homo sapiens
caauaaguuucugaaugga

SEQ ID NO: 610576 - RNA, 19 nt, Homo sapiens
uacaggguauucauuaagu

SEQ ID NO: 610577 - RNA, 19 nt, Homo sapiens
ugaagaagcagccagacau

SEQ ID NO: 610578 - RNA, 19 nt, Homo sapiens
uaaaugugacugaauaugc

SEQ ID NO: 610579 - RNA, 19 nt, Homo sapiens
cccuuagacuuuaguaguu

SEQ ID NO: 610580 - RNA, 19 nt, Homo sapiens
caauuagggagaaguacaa

SEQ ID NO: 610581 - RNA, 19 nt, Homo sapiens
cgaccucagcaagcaauua

SEQ ID NO: 610582 - RNA, 19 nt, Homo sapiens
uuaguuucccuuagacuuu

SEQ ID NO: 610583 - RNA, 19 nt, Homo sapiens
ccgaugauacauacacaaa

SEQ ID NO: 610584 - RNA, 19 nt, Homo sapiens
acagaugugauaaauguga

SEQ ID NO: 610585 - RNA, 19 nt, Homo sapiens
cuggcaaacuauacuguga

SEQ ID NO: 610586 - RNA, 19 nt, Homo sapiens
agauauauccuccugaagu

SEQ ID NO: 610587 - RNA, 19 nt, Homo sapiens
cacacuacaugaagaagca

SEQ ID NO: 610588 - RNA, 19 nt, Homo sapiens
cugaauaugcugaagaaau

SEQ ID NO: 610589 - RNA, 19 nt, Homo sapiens
caagcaaggguuugacauc

SEQ ID NO: 610590 - RNA, 19 nt, Homo sapiens
ggacacauagaaagauaac

SEQ ID NO: 610591 - RNA, 19 nt, Homo sapiens
aaauaucuuccuucacuga

SEQ ID NO: 610592 - RNA, 19 nt, Homo sapiens
ugugauaaaugugacugaa

SEQ ID NO: 610593 - RNA, 19 nt, Homo sapiens
gaaaugaggcugacuauaa

SEQ ID NO: 610594 - RNA, 19 nt, Homo sapiens
ccacacaacuggucucaua

SEQ ID NO: 610595 - RNA, 19 nt, Homo sapiens
ugacaacccucauucaaua

SEQ ID NO: 610596 - RNA, 19 nt, Homo sapiens
gaucugaggucaucaagaa

SEQ ID NO: 610597 - RNA, 19 nt, Homo sapiens
ggucucagcucaggaauua

SEQ ID NO: 610598 - RNA, 19 nt, Homo sapiens
ccagaaaccuagauaagaa

SEQ ID NO: 610599 - RNA, 19 nt, Homo sapiens
caacuggucucauacuuca

SEQ ID NO: 610600 - RNA, 19 nt, Homo sapiens
ggacuucacuggcuccaau

SEQ ID NO: 610601 - RNA, 19 nt, Homo sapiens
guacagaucugaggucauc

SEQ ID NO: 610602 - RNA, 19 nt, Homo sapiens
uaagaaagguaugcuagaa

SEQ ID NO: 610603 - RNA, 19 nt, Homo sapiens
gcaggucucgcaugaauuu

SEQ ID NO: 610604 - RNA, 19 nt, Homo sapiens
aaaggacaaucguguagua

SEQ ID NO: 610605 - RNA, 19 nt, Homo sapiens
caagaacucuggaacuauc

SEQ ID NO: 610606 - RNA, 19 nt, Homo sapiens
ggcaaucgcuuuauucaag

SEQ ID NO: 610607 - RNA, 19 nt, Homo sapiens
caacaggggucaaugagua

SEQ ID NO: 610608 - RNA, 19 nt, Homo sapiens
uacaagaacucuggaacua

SEQ ID NO: 610609 - RNA, 19 nt, Homo sapiens
gcugagggaugaugacuuc

SEQ ID NO: 610610 - RNA, 19 nt, Homo sapiens
gcaugaauuugccuugaau

SEQ ID NO: 610611 - RNA, 19 nt, Homo sapiens
uuacaaagauggauguucu

SEQ ID NO: 610612 - RNA, 19 nt, Homo sapiens
guacaugggcaaucgcuuu

SEQ ID NO: 610613 - RNA, 19 nt, Homo sapiens
gagggaugaugacuuccua

SEQ ID NO: 610614 - RNA, 19 nt, Homo sapiens
agagggaaaugauacuaaa

SEQ ID NO: 610615 - RNA, 19 nt, Homo sapiens
cuauaaggcugcucugugu

SEQ ID NO: 610616 - RNA, 19 nt, Homo sapiens
ggacaggcauugguucagu

SEQ ID NO: 610617 - RNA, 19 nt, Homo sapiens
guacauguucuuguugaua

SEQ ID NO: 610618 - RNA, 19 nt, Homo sapiens
cgccagagcugagggauga

SEQ ID NO: 610619 - RNA, 19 nt, Homo sapiens
ggacaucggcuccaagucu

SEQ ID NO: 610620 - RNA, 19 nt, Homo sapiens
gaacuauccgugucaagau

SEQ ID NO: 610621 - RNA, 19 nt, Homo sapiens
ggaacuauccgugucaaga

SEQ ID NO: 610622 - RNA, 19 nt, Homo sapiens
aggcauugguucaguuuaa

SEQ ID NO: 610623 - RNA, 19 nt, Homo sapiens
gcugcucugugucgucaua

SEQ ID NO: 610624 - RNA, 19 nt, Homo sapiens
cugcagaacuucagcuaug

SEQ ID NO: 610625 - RNA, 19 nt, Homo sapiens
gcagcgugguucaggacua

SEQ ID NO: 610626 - RNA, 19 nt, Homo sapiens
caagauuugucggguagaa

SEQ ID NO: 610627 - RNA, 19 nt, Homo sapiens
gcaaucgcuuuauucaagu

SEQ ID NO: 610628 - RNA, 19 nt, Homo sapiens
aaaugaggcugacuauaag

SEQ ID NO: 610629 - RNA, 19 nt, Homo sapiens
caauaaagaccagugaaga

SEQ ID NO: 610630 - RNA, 19 nt, Homo sapiens
gcuguucccugcauuugga

SEQ ID NO: 610631 - RNA, 19 nt, Homo sapiens
cgaaggcuuuguagaguuc

SEQ ID NO: 610632 - RNA, 19 nt, Homo sapiens
caaguucauccaauuacua

SEQ ID NO: 610633 - RNA, 19 nt, Homo sapiens
agaaacagaguacuccuuu

SEQ ID NO: 610634 - RNA, 19 nt, Homo sapiens
caugggcaaucgcuuuauu

SEQ ID NO: 610635 - RNA, 19 nt, Homo sapiens
gguagaggccagaaaccua

SEQ ID NO: 610636 - RNA, 19 nt, Homo sapiens
aaaugaagaugaugcacau

SEQ ID NO: 610637 - RNA, 19 nt, Homo sapiens
gauggauguucuucaguuc

SEQ ID NO: 610638 - RNA, 19 nt, Homo sapiens
uggcaggucucgcaugaau

SEQ ID NO: 610639 - RNA, 19 nt, Homo sapiens
gugcaaugcuccgauuaug

SEQ ID NO: 610640 - RNA, 19 nt, Homo sapiens
ugaaaaugcuguacauguu

SEQ ID NO: 610641 - RNA, 19 nt, Homo sapiens
ccauucagcauuacaaaga

SEQ ID NO: 610642 - RNA, 19 nt, Homo sapiens
ugucaacucugccaaaguc

SEQ ID NO: 610643 - RNA, 19 nt, Homo sapiens
gacaggcauugguucaguu

SEQ ID NO: 610644 - RNA, 19 nt, Homo sapiens
cuauggcccuaccaacuuu

SEQ ID NO: 610645 - RNA, 19 nt, Homo sapiens
gaaugcauccacccugaga

SEQ ID NO: 610646 - RNA, 19 nt, Homo sapiens
gccagaaaccuagauaaga

SEQ ID NO: 610647 - RNA, 19 nt, Homo sapiens
ggacaaucguguaguaacc

SEQ ID NO: 610648 - RNA, 19 nt, Homo sapiens
ggcauugguucaguuuaaa

SEQ ID NO: 610649 - RNA, 19 nt, Homo sapiens
agauggauguucuucaguu

SEQ ID NO: 610650 - RNA, 19 nt, Homo sapiens
gaugggaggcugucagauc

SEQ ID NO: 610651 - RNA, 19 nt, Homo sapiens
gcuacgcuuuggaaucuau

SEQ ID NO: 610652 - RNA, 19 nt, Homo sapiens
gugaccaucucauugacaa

SEQ ID NO: 610653 - RNA, 19 nt, Homo sapiens
gaugucaacucugccaaag

SEQ ID NO: 610654 - RNA, 19 nt, Homo sapiens
ggacugccucgcaauacuu

SEQ ID NO: 610655 - RNA, 19 nt, Homo sapiens
gacaagcuguucccugcau

SEQ ID NO: 610656 - RNA, 19 nt, Homo sapiens
ccaauuacuaagaaaggua

SEQ ID NO: 610657 - RNA, 19 nt, Homo sapiens
gacccacucugcguccuuu

SEQ ID NO: 610658 - RNA, 19 nt, Homo sapiens
aaagaccagugaagaccaa

SEQ ID NO: 610659 - RNA, 19 nt, Homo sapiens
guucauccaauuacuaaga

SEQ ID NO: 610660 - RNA, 19 nt, Homo sapiens
cagagggaaaugauacuaa

SEQ ID NO: 610661 - RNA, 19 nt, Homo sapiens
gacaacccucauucaauaa

SEQ ID NO: 610662 - RNA, 19 nt, Homo sapiens
ccaugucagugaucauugu

SEQ ID NO: 610663 - RNA, 19 nt, Homo sapiens
agaaagguaugcuagaaaa

SEQ ID NO: 610664 - RNA, 19 nt, Homo sapiens
caacuuugcacccaucauc

SEQ ID NO: 610665 - RNA, 19 nt, Homo sapiens
gugcccacauaacaaauau

SEQ ID NO: 610666 - RNA, 19 nt, Homo sapiens
ccucgaaccugcccauguc

SEQ ID NO: 610667 - RNA, 19 nt, Homo sapiens
ggaauuaaaggacaaucgu

SEQ ID NO: 610668 - RNA, 19 nt, Homo sapiens
gagcuuggccggacugaac

SEQ ID NO: 610669 - RNA, 19 nt, Homo sapiens
ucgcagaagugcccacaca

SEQ ID NO: 610670 - RNA, 19 nt, Homo sapiens
caggugcaaugcuccgauu

SEQ ID NO: 610671 - RNA, 19 nt, Homo sapiens
uaacaaugggcaaggucua

SEQ ID NO: 610672 - RNA, 19 nt, Homo sapiens
gcccacauaacaaauauuc

SEQ ID NO: 610673 - RNA, 19 nt, Homo sapiens
ggaugucaacucugccaaa

SEQ ID NO: 610674 - RNA, 19 nt, Homo sapiens
gggaaaugauacuaaaucc

SEQ ID NO: 610675 - RNA, 19 nt, Homo sapiens
caacccucauucaauaaag

SEQ ID NO: 610676 - RNA, 19 nt, Homo sapiens
aaacagaguacuccuuucu

SEQ ID NO: 610677 - RNA, 19 nt, Homo sapiens
ucucagcucaggaauuaaa

SEQ ID NO: 610678 - RNA, 19 nt, Homo sapiens
ccacauaacaaauauucca

SEQ ID NO: 610679 - RNA, 19 nt, Homo sapiens
cacaacuggucucauacuu

SEQ ID NO: 610680 - RNA, 19 nt, Homo sapiens
cgcaauacuucaugcuguu

SEQ ID NO: 610681 - RNA, 19 nt, Homo sapiens
guacuccuuucuggacuau

SEQ ID NO: 610682 - RNA, 19 nt, Homo sapiens
gauuguguccagccaggua

SEQ ID NO: 610683 - RNA, 19 nt, Homo sapiens
cagcuugaguaccgcuuug

SEQ ID NO: 610684 - RNA, 19 nt, Homo sapiens
cgcaugaauuugccuugaa

SEQ ID NO: 610685 - RNA, 19 nt, Homo sapiens
cagcgugguucaggacuau

SEQ ID NO: 610686 - RNA, 19 nt, Homo sapiens
caaucgcuuuauucaaguu

SEQ ID NO: 610687 - RNA, 19 nt, Homo sapiens
ggagguagaggccagaaac

SEQ ID NO: 610688 - RNA, 19 nt, Homo sapiens
ugaccagagggaaaugaua

SEQ ID NO: 610689 - RNA, 19 nt, Homo sapiens
ugguucagcuguccauuuc

SEQ ID NO: 610690 - RNA, 19 nt, Homo sapiens
gaccagagggaaaugauac

SEQ ID NO: 610691 - RNA, 19 nt, Homo sapiens
caagcuguucccugcauuu

SEQ ID NO: 610692 - RNA, 19 nt, Homo sapiens
uacaugggcaaucgcuuua

SEQ ID NO: 610693 - RNA, 19 nt, Homo sapiens
ccacacaacuggucucaua

SEQ ID NO: 610694 - RNA, 19 nt, Homo sapiens
ugacaacccucauucaaua

SEQ ID NO: 610695 - RNA, 19 nt, Homo sapiens
gaucugaggucaucaagaa

SEQ ID NO: 610696 - RNA, 19 nt, Homo sapiens
ggucucagcucaggaauua

SEQ ID NO: 610697 - RNA, 19 nt, Homo sapiens
ccagaaaccuagauaagaa

SEQ ID NO: 610698 - RNA, 19 nt, Homo sapiens
caacuggucucauacuuca

SEQ ID NO: 610699 - RNA, 19 nt, Homo sapiens
ggacuucacuggcuccaau

SEQ ID NO: 610700 - RNA, 19 nt, Homo sapiens
guacagaucugaggucauc

SEQ ID NO: 610701 - RNA, 19 nt, Homo sapiens
gcaggucucgcaugaauuu

SEQ ID NO: 610702 - RNA, 19 nt, Homo sapiens
aaaggacaaucguguagua

SEQ ID NO: 610703 - RNA, 19 nt, Homo sapiens
caagaacucuggaacuauc

SEQ ID NO: 610704 - RNA, 19 nt, Homo sapiens
caacaggggucaaugagua

SEQ ID NO: 610705 - RNA, 19 nt, Homo sapiens
uacaagaacucuggaacua

SEQ ID NO: 610706 - RNA, 19 nt, Homo sapiens
gcugagggaugaugacuuc

SEQ ID NO: 610707 - RNA, 19 nt, Homo sapiens
gcaugaauuugccuugaau

SEQ ID NO: 610708 - RNA, 19 nt, Homo sapiens
gagggaugaugacuuccua

SEQ ID NO: 610709 - RNA, 19 nt, Homo sapiens
cgccagagcugagggauga

SEQ ID NO: 610710 - RNA, 19 nt, Homo sapiens
ggacaucggcuccaagucu

SEQ ID NO: 610711 - RNA, 19 nt, Homo sapiens
gaacuauccgugucaagau

SEQ ID NO: 610712 - RNA, 19 nt, Homo sapiens
ggaacuauccgugucaaga

SEQ ID NO: 610713 - RNA, 19 nt, Homo sapiens
gcagcgugguucaggacua

SEQ ID NO: 610714 - RNA, 19 nt, Homo sapiens
caagauuugucggguagaa

SEQ ID NO: 610715 - RNA, 19 nt, Homo sapiens
caauaaagaccagugaaga

SEQ ID NO: 610716 - RNA, 19 nt, Homo sapiens
gcuguucccugcauuugga

SEQ ID NO: 610717 - RNA, 19 nt, Homo sapiens
agaaacagaguacuccuuu

SEQ ID NO: 610718 - RNA, 19 nt, Homo sapiens
gguagaggccagaaaccua

SEQ ID NO: 610719 - RNA, 19 nt, Homo sapiens
uggcaggucucgcaugaau

SEQ ID NO: 610720 - RNA, 19 nt, Homo sapiens
gugcaaugcuccgauuaug

SEQ ID NO: 610721 - RNA, 19 nt, Homo sapiens
cuauggcccuaccaacuuu

SEQ ID NO: 610722 - RNA, 19 nt, Homo sapiens
gaaugcauccacccugaga

SEQ ID NO: 610723 - RNA, 19 nt, Homo sapiens
gccagaaaccuagauaaga

SEQ ID NO: 610724 - RNA, 19 nt, Homo sapiens
ggacaaucguguaguaacc

SEQ ID NO: 610725 - RNA, 19 nt, Homo sapiens
gaugggaggcugucagauc

SEQ ID NO: 610726 - RNA, 19 nt, Homo sapiens
gugaccaucucauugacaa

SEQ ID NO: 610727 - RNA, 19 nt, Homo sapiens
gcuacgcuuuggaaucuau

SEQ ID NO: 610728 - RNA, 19 nt, Homo sapiens
ggacugccucgcaauacuu

SEQ ID NO: 610729 - RNA, 19 nt, Homo sapiens
gacaagcuguucccugcau

SEQ ID NO: 610730 - RNA, 19 nt, Homo sapiens
gacccacucugcguccuuu

SEQ ID NO: 610731 - RNA, 19 nt, Homo sapiens
aaagaccagugaagaccaa

SEQ ID NO: 610732 - RNA, 19 nt, Homo sapiens
gacaacccucauucaauaa

SEQ ID NO: 610733 - RNA, 19 nt, Homo sapiens
ccaugucagugaucauugu

SEQ ID NO: 610734 - RNA, 19 nt, Homo sapiens
caacuuugcacccaucauc

SEQ ID NO: 610735 - RNA, 19 nt, Homo sapiens
ccucgaaccugcccauguc

SEQ ID NO: 610736 - RNA, 19 nt, Homo sapiens
ggaauuaaaggacaaucgu

SEQ ID NO: 610737 - RNA, 19 nt, Homo sapiens
gagcuuggccggacugaac

SEQ ID NO: 610738 - RNA, 19 nt, Homo sapiens
ucgcagaagugcccacaca

SEQ ID NO: 610739 - RNA, 19 nt, Homo sapiens
caggugcaaugcuccgauu

SEQ ID NO: 610740 - RNA, 19 nt, Homo sapiens
caacccucauucaauaaag

SEQ ID NO: 610741 - RNA, 19 nt, Homo sapiens
aaacagaguacuccuuucu

SEQ ID NO: 610742 - RNA, 19 nt, Homo sapiens
ucucagcucaggaauuaaa

SEQ ID NO: 610743 - RNA, 19 nt, Homo sapiens
cacaacuggucucauacuu

SEQ ID NO: 610744 - RNA, 19 nt, Homo sapiens
cgcaauacuucaugcuguu

SEQ ID NO: 610745 - RNA, 19 nt, Homo sapiens
guacuccuuucuggacuau

SEQ ID NO: 610746 - RNA, 19 nt, Homo sapiens
gauuguguccagccaggua

SEQ ID NO: 610747 - RNA, 19 nt, Homo sapiens
cagcuugaguaccgcuuug

SEQ ID NO: 610748 - RNA, 19 nt, Homo sapiens
cgcaugaauuugccuugaa

SEQ ID NO: 610749 - RNA, 19 nt, Homo sapiens
cagcgugguucaggacuau

SEQ ID NO: 610750 - RNA, 19 nt, Homo sapiens
ggagguagaggccagaaac

SEQ ID NO: 610751 - RNA, 19 nt, Homo sapiens
ugguucagcuguccauuuc

SEQ ID NO: 610752 - RNA, 19 nt, Homo sapiens
caagcuguucccugcauuu

SEQ ID NO: 610753 - RNA, 19 nt, Homo sapiens
ggucaaugaguaccugaug

SEQ ID NO: 610754 - RNA, 19 nt, Homo sapiens
cggcugaguuugaaugcau

SEQ ID NO: 610755 - RNA, 19 nt, Homo sapiens
ggcagucccggcugaguuu

SEQ ID NO: 610756 - RNA, 19 nt, Homo sapiens
cauggaagcguuucucagu

SEQ ID NO: 610757 - RNA, 19 nt, Homo sapiens
ggccagaaaccuagauaag

SEQ ID NO: 610758 - RNA, 19 nt, Homo sapiens
gaggccagaaaccuagaua

SEQ ID NO: 610759 - RNA, 19 nt, Homo sapiens
uguggguggugcugacuuu

SEQ ID NO: 610760 - RNA, 19 nt, Homo sapiens
gcccugaguucuccaagac

SEQ ID NO: 610761 - RNA, 19 nt, Homo sapiens
acaaggacaucggcuccaa

SEQ ID NO: 610762 - RNA, 19 nt, Homo sapiens
ccugugaccaucucauuga

SEQ ID NO: 610763 - RNA, 19 nt, Homo sapiens
gcagaagugcccacacaac

SEQ ID NO: 610764 - RNA, 19 nt, Homo sapiens
gcaauacuucaugcuguug

SEQ ID NO: 610765 - RNA, 19 nt, Homo sapiens
gcaggcauccagggcauug

SEQ ID NO: 610766 - RNA, 19 nt, Homo sapiens
ucgcaugaauuugccuuga

SEQ ID NO: 610767 - RNA, 19 nt, Homo sapiens
ccgccagggugaugggaaa

SEQ ID NO: 610768 - RNA, 19 nt, Homo sapiens
cuccaagacucuacagcuu

SEQ ID NO: 610769 - RNA, 19 nt, Homo sapiens
gggacugccucgcaauacu

SEQ ID NO: 610770 - RNA, 19 nt, Homo sapiens
acuggcaggucucgcauga

SEQ ID NO: 610771 - RNA, 19 nt, Homo sapiens
ucaccugacucccuacacu

SEQ ID NO: 610772 - RNA, 19 nt, Homo sapiens
ggugcaaugcuccgauuau

SEQ ID NO: 610773 - RNA, 19 nt, Homo sapiens
ucaauaaagaccagugaag

SEQ ID NO: 610774 - RNA, 19 nt, Homo sapiens
gcgacauugugcaguuugu

SEQ ID NO: 610775 - RNA, 19 nt, Homo sapiens
gcuuugagacaguccagaa

SEQ ID NO: 610776 - RNA, 19 nt, Homo sapiens
gcccaugucagugaucauu

SEQ ID NO: 610777 - RNA, 19 nt, Homo sapiens
gaacaaccugaacccuaca

SEQ ID NO: 610778 - RNA, 19 nt, Homo sapiens
gaaaccuagauaagaagga

SEQ ID NO: 610779 - RNA, 19 nt, Homo sapiens
uaguaaccauggagguaga

SEQ ID NO: 610780 - RNA, 19 nt, Homo sapiens
agaccgugcucgcagaagu

SEQ ID NO: 610781 - RNA, 19 nt, Homo sapiens
ccgcgacauugugcaguuu

SEQ ID NO: 610782 - RNA, 19 nt, Homo sapiens
gaggcugucagaucaacuu

SEQ ID NO: 610783 - RNA, 19 nt, Homo sapiens
aacuauccgugucaagauu

SEQ ID NO: 610784 - RNA, 19 nt, Homo sapiens
caacccaacccuucucacu

SEQ ID NO: 610785 - RNA, 19 nt, Homo sapiens
cgacauugugcaguuugua

SEQ ID NO: 610786 - RNA, 19 nt, Homo sapiens
gcuuuggaaucuaugacau

SEQ ID NO: 610787 - RNA, 19 nt, Homo sapiens
ccugacaacccucauucaa

SEQ ID NO: 610788 - RNA, 19 nt, Homo sapiens
gcugucagaucaacuucac

SEQ ID NO: 610789 - RNA, 19 nt, Homo sapiens
uguaguaaccauggaggua

SEQ ID NO: 610790 - RNA, 19 nt, Homo sapiens
aggccuagguucccuugga

SEQ ID NO: 610791 - RNA, 19 nt, Homo sapiens
ucuauggcccuaccaacuu

SEQ ID NO: 610792 - RNA, 19 nt, Homo sapiens
augggaggcugucagauca

SEQ ID NO: 610793 - RNA, 19 nt, Homo sapiens
ccacacaacuggucucaua

SEQ ID NO: 610794 - RNA, 19 nt, Homo sapiens
ugacaacccucauucaaua

SEQ ID NO: 610795 - RNA, 19 nt, Homo sapiens
gaucugaggucaucaagaa

SEQ ID NO: 610796 - RNA, 19 nt, Homo sapiens
ggucucagcucaggaauua

SEQ ID NO: 610797 - RNA, 19 nt, Homo sapiens
ccagaaaccuagauaagaa

SEQ ID NO: 610798 - RNA, 19 nt, Homo sapiens
caacuggucucauacuuca

SEQ ID NO: 610799 - RNA, 19 nt, Homo sapiens
ggacuucacuggcuccaau

SEQ ID NO: 610800 - RNA, 19 nt, Homo sapiens
guacagaucugaggucauc

SEQ ID NO: 610801 - RNA, 19 nt, Homo sapiens
gcaggucucgcaugaauuu

SEQ ID NO: 610802 - RNA, 19 nt, Homo sapiens
aaaggacaaucguguagua

SEQ ID NO: 610803 - RNA, 19 nt, Homo sapiens
caagaacucuggaacuauc

SEQ ID NO: 610804 - RNA, 19 nt, Homo sapiens
caacaggggucaaugagua

SEQ ID NO: 610805 - RNA, 19 nt, Homo sapiens
uacaagaacucuggaacua

SEQ ID NO: 610806 - RNA, 19 nt, Homo sapiens
gcugagggaugaugacuuc

SEQ ID NO: 610807 - RNA, 19 nt, Homo sapiens
gcaugaauuugccuugaau

SEQ ID NO: 610808 - RNA, 19 nt, Homo sapiens
gagggaugaugacuuccua

SEQ ID NO: 610809 - RNA, 19 nt, Homo sapiens
cgccagagcugagggauga

SEQ ID NO: 610810 - RNA, 19 nt, Homo sapiens
ggacaucggcuccaagucu

SEQ ID NO: 610811 - RNA, 19 nt, Homo sapiens
gaacuauccgugucaagau

SEQ ID NO: 610812 - RNA, 19 nt, Homo sapiens
ggaacuauccgugucaaga

SEQ ID NO: 610813 - RNA, 19 nt, Homo sapiens
gcagcgugguucaggacua

SEQ ID NO: 610814 - RNA, 19 nt, Homo sapiens
caagauuugucggguagaa

SEQ ID NO: 610815 - RNA, 19 nt, Homo sapiens
caauaaagaccagugaaga

SEQ ID NO: 610816 - RNA, 19 nt, Homo sapiens
gcuguucccugcauuugga

SEQ ID NO: 610817 - RNA, 19 nt, Homo sapiens
agaaacagaguacuccuuu

SEQ ID NO: 610818 - RNA, 19 nt, Homo sapiens
gguagaggccagaaaccua

SEQ ID NO: 610819 - RNA, 19 nt, Homo sapiens
uggcaggucucgcaugaau

SEQ ID NO: 610820 - RNA, 19 nt, Homo sapiens
gugcaaugcuccgauuaug

SEQ ID NO: 610821 - RNA, 19 nt, Homo sapiens
cuauggcccuaccaacuuu

SEQ ID NO: 610822 - RNA, 19 nt, Homo sapiens
gaaugcauccacccugaga

SEQ ID NO: 610823 - RNA, 19 nt, Homo sapiens
gccagaaaccuagauaaga

SEQ ID NO: 610824 - RNA, 19 nt, Homo sapiens
ggacaaucguguaguaacc

SEQ ID NO: 610825 - RNA, 19 nt, Homo sapiens
gaugggaggcugucagauc

SEQ ID NO: 610826 - RNA, 19 nt, Homo sapiens
gugaccaucucauugacaa

SEQ ID NO: 610827 - RNA, 19 nt, Homo sapiens
gcuacgcuuuggaaucuau

SEQ ID NO: 610828 - RNA, 19 nt, Homo sapiens
ggacugccucgcaauacuu

SEQ ID NO: 610829 - RNA, 19 nt, Homo sapiens
gacaagcuguucccugcau

SEQ ID NO: 610830 - RNA, 19 nt, Homo sapiens
gacccacucugcguccuuu

SEQ ID NO: 610831 - RNA, 19 nt, Homo sapiens
aaagaccagugaagaccaa

SEQ ID NO: 610832 - RNA, 19 nt, Homo sapiens
gacaacccucauucaauaa

SEQ ID NO: 610833 - RNA, 19 nt, Homo sapiens
ccaugucagugaucauugu

SEQ ID NO: 610834 - RNA, 19 nt, Homo sapiens
caacuuugcacccaucauc

SEQ ID NO: 610835 - RNA, 19 nt, Homo sapiens
ccucgaaccugcccauguc

SEQ ID NO: 610836 - RNA, 19 nt, Homo sapiens
ggaauuaaaggacaaucgu

SEQ ID NO: 610837 - RNA, 19 nt, Homo sapiens
gagcuuggccggacugaac

SEQ ID NO: 610838 - RNA, 19 nt, Homo sapiens
ucgcagaagugcccacaca

SEQ ID NO: 610839 - RNA, 19 nt, Homo sapiens
caggugcaaugcuccgauu

SEQ ID NO: 610840 - RNA, 19 nt, Homo sapiens
caacccucauucaauaaag

SEQ ID NO: 610841 - RNA, 19 nt, Homo sapiens
aaacagaguacuccuuucu

SEQ ID NO: 610842 - RNA, 19 nt, Homo sapiens
ucucagcucaggaauuaaa

SEQ ID NO: 610843 - RNA, 19 nt, Homo sapiens
cacaacuggucucauacuu

SEQ ID NO: 610844 - RNA, 19 nt, Homo sapiens
cgcaauacuucaugcuguu

SEQ ID NO: 610845 - RNA, 19 nt, Homo sapiens
guacuccuuucuggacuau

SEQ ID NO: 610846 - RNA, 19 nt, Homo sapiens
gauuguguccagccaggua

SEQ ID NO: 610847 - RNA, 19 nt, Homo sapiens
cagcuugaguaccgcuuug

SEQ ID NO: 610848 - RNA, 19 nt, Homo sapiens
cgcaugaauuugccuugaa

SEQ ID NO: 610849 - RNA, 19 nt, Homo sapiens
cagcgugguucaggacuau

SEQ ID NO: 610850 - RNA, 19 nt, Homo sapiens
ugguucagcuguccauuuc

SEQ ID NO: 610851 - RNA, 19 nt, Homo sapiens
ggagguagaggccagaaac

SEQ ID NO: 610852 - RNA, 19 nt, Homo sapiens
caagcuguucccugcauuu

SEQ ID NO: 610853 - RNA, 19 nt, Homo sapiens
ggucaaugaguaccugaug

SEQ ID NO: 610854 - RNA, 19 nt, Homo sapiens
cggcugaguuugaaugcau

SEQ ID NO: 610855 - RNA, 19 nt, Homo sapiens
ggcagucccggcugaguuu

SEQ ID NO: 610856 - RNA, 19 nt, Homo sapiens
cauggaagcguuucucagu

SEQ ID NO: 610857 - RNA, 19 nt, Homo sapiens
ggccagaaaccuagauaag

SEQ ID NO: 610858 - RNA, 19 nt, Homo sapiens
gaggccagaaaccuagaua

SEQ ID NO: 610859 - RNA, 19 nt, Homo sapiens
ccugugaccaucucauuga

SEQ ID NO: 610860 - RNA, 19 nt, Homo sapiens
uguggguggugcugacuuu

SEQ ID NO: 610861 - RNA, 19 nt, Homo sapiens
gcccugaguucuccaagac

SEQ ID NO: 610862 - RNA, 19 nt, Homo sapiens
acaaggacaucggcuccaa

SEQ ID NO: 610863 - RNA, 19 nt, Homo sapiens
gcagaagugcccacacaac

SEQ ID NO: 610864 - RNA, 19 nt, Homo sapiens
gcaauacuucaugcuguug

SEQ ID NO: 610865 - RNA, 19 nt, Homo sapiens
gcaggcauccagggcauug

SEQ ID NO: 610866 - RNA, 19 nt, Homo sapiens
ucgcaugaauuugccuuga

SEQ ID NO: 610867 - RNA, 19 nt, Homo sapiens
cuccaagacucuacagcuu

SEQ ID NO: 610868 - RNA, 19 nt, Homo sapiens
ccgccagggugaugggaaa

SEQ ID NO: 610869 - RNA, 19 nt, Homo sapiens
gggacugccucgcaauacu

SEQ ID NO: 610870 - RNA, 19 nt, Homo sapiens
acuggcaggucucgcauga

SEQ ID NO: 610871 - RNA, 19 nt, Homo sapiens
ucaccugacucccuacacu

SEQ ID NO: 610872 - RNA, 19 nt, Homo sapiens
ggugcaaugcuccgauuau

SEQ ID NO: 610873 - RNA, 19 nt, Homo sapiens
ucaauaaagaccagugaag

SEQ ID NO: 610874 - RNA, 19 nt, Homo sapiens
gcgacauugugcaguuugu

SEQ ID NO: 610875 - RNA, 19 nt, Homo sapiens
gcccaugucagugaucauu

SEQ ID NO: 610876 - RNA, 19 nt, Homo sapiens
gaacaaccugaacccuaca

SEQ ID NO: 610877 - RNA, 19 nt, Homo sapiens
gaaaccuagauaagaagga

SEQ ID NO: 610878 - RNA, 19 nt, Homo sapiens
gcuuugagacaguccagaa

SEQ ID NO: 610879 - RNA, 19 nt, Homo sapiens
uaguaaccauggagguaga

SEQ ID NO: 610880 - RNA, 19 nt, Homo sapiens
agaccgugcucgcagaagu

SEQ ID NO: 610881 - RNA, 19 nt, Homo sapiens
ccgcgacauugugcaguuu

SEQ ID NO: 610882 - RNA, 19 nt, Homo sapiens
gaggcugucagaucaacuu

SEQ ID NO: 610883 - RNA, 19 nt, Homo sapiens
aacuauccgugucaagauu

SEQ ID NO: 610884 - RNA, 19 nt, Homo sapiens
caacccaacccuucucacu

SEQ ID NO: 610885 - RNA, 19 nt, Homo sapiens
cgacauugugcaguuugua

SEQ ID NO: 610886 - RNA, 19 nt, Homo sapiens
gcuuuggaaucuaugacau

SEQ ID NO: 610887 - RNA, 19 nt, Homo sapiens
ccugacaacccucauucaa

SEQ ID NO: 610888 - RNA, 19 nt, Homo sapiens
gcugucagaucaacuucac

SEQ ID NO: 610889 - RNA, 19 nt, Homo sapiens
uguaguaaccauggaggua

SEQ ID NO: 610890 - RNA, 19 nt, Homo sapiens
aggccuagguucccuugga

SEQ ID NO: 610891 - RNA, 19 nt, Homo sapiens
ucuauggcccuaccaacuu

SEQ ID NO: 610892 - RNA, 19 nt, Homo sapiens
augggaggcugucagauca

SEQ ID NO: 610893 - RNA, 19 nt, Homo sapiens
ccacacaacuggucucaua

SEQ ID NO: 610894 - RNA, 19 nt, Homo sapiens
ugacaacccucauucaaua

SEQ ID NO: 610895 - RNA, 19 nt, Homo sapiens
gaucugaggucaucaagaa

SEQ ID NO: 610896 - RNA, 19 nt, Homo sapiens
ggucucagcucaggaauua

SEQ ID NO: 610897 - RNA, 19 nt, Homo sapiens
ggaaauucaucucuuguuu

SEQ ID NO: 610898 - RNA, 19 nt, Homo sapiens
ccagaaaccuagauaagaa

SEQ ID NO: 610899 - RNA, 19 nt, Homo sapiens
caacuggucucauacuuca

SEQ ID NO: 610900 - RNA, 19 nt, Homo sapiens
ggacuucacuggcuccaau

SEQ ID NO: 610901 - RNA, 19 nt, Homo sapiens
guacagaucugaggucauc

SEQ ID NO: 610902 - RNA, 19 nt, Homo sapiens
gcaggucucgcaugaauuu

SEQ ID NO: 610903 - RNA, 19 nt, Homo sapiens
aaaggacaaucguguagua

SEQ ID NO: 610904 - RNA, 19 nt, Homo sapiens
uaaggaaauucaucucuug

SEQ ID NO: 610905 - RNA, 19 nt, Homo sapiens
caagaacucuggaacuauc

SEQ ID NO: 610906 - RNA, 19 nt, Homo sapiens
caacaggggucaaugagua

SEQ ID NO: 610907 - RNA, 19 nt, Homo sapiens
uacaagaacucuggaacua

SEQ ID NO: 610908 - RNA, 19 nt, Homo sapiens
gcugagggaugaugacuuc

SEQ ID NO: 610909 - RNA, 19 nt, Homo sapiens
gcaugaauuugccuugaau

SEQ ID NO: 610910 - RNA, 19 nt, Homo sapiens
gagggaugaugacuuccua

SEQ ID NO: 610911 - RNA, 19 nt, Homo sapiens
cgccagagcugagggauga

SEQ ID NO: 610912 - RNA, 19 nt, Homo sapiens
ggacaucggcuccaagucu

SEQ ID NO: 610913 - RNA, 19 nt, Homo sapiens
gaacuauccgugucaagau

SEQ ID NO: 610914 - RNA, 19 nt, Homo sapiens
ggaacuauccgugucaaga

SEQ ID NO: 610915 - RNA, 19 nt, Homo sapiens
gcagcgugguucaggacua

SEQ ID NO: 610916 - RNA, 19 nt, Homo sapiens
caagauuugucggguagaa

SEQ ID NO: 610917 - RNA, 19 nt, Homo sapiens
caauaaagaccagugaaga

SEQ ID NO: 610918 - RNA, 19 nt, Homo sapiens
gcuguucccugcauuugga

SEQ ID NO: 610919 - RNA, 19 nt, Homo sapiens
agaaacagaguacuccuuu

SEQ ID NO: 610920 - RNA, 19 nt, Homo sapiens
gguagaggccagaaaccua

SEQ ID NO: 610921 - RNA, 19 nt, Homo sapiens
uggcaggucucgcaugaau

SEQ ID NO: 610922 - RNA, 19 nt, Homo sapiens
gugcaaugcuccgauuaug

SEQ ID NO: 610923 - RNA, 19 nt, Homo sapiens
ggccucuacuucuuguuaa

SEQ ID NO: 610924 - RNA, 19 nt, Homo sapiens
cuauggcccuaccaacuuu

SEQ ID NO: 610925 - RNA, 19 nt, Homo sapiens
ggauugacuuggccucuac

SEQ ID NO: 610926 - RNA, 19 nt, Homo sapiens
gaaugcauccacccugaga

SEQ ID NO: 610927 - RNA, 19 nt, Homo sapiens
gccagaaaccuagauaaga

SEQ ID NO: 610928 - RNA, 19 nt, Homo sapiens
ggacaaucguguaguaacc

SEQ ID NO: 610929 - RNA, 19 nt, Homo sapiens
gaugggaggcugucagauc

SEQ ID NO: 610930 - RNA, 19 nt, Homo sapiens
gcuacgcuuuggaaucuau

SEQ ID NO: 610931 - RNA, 19 nt, Homo sapiens
gugaccaucucauugacaa

SEQ ID NO: 610932 - RNA, 19 nt, Homo sapiens
ggacugccucgcaauacuu

SEQ ID NO: 610933 - RNA, 19 nt, Homo sapiens
gacaagcuguucccugcau

SEQ ID NO: 610934 - RNA, 19 nt, Homo sapiens
gacccacucugcguccuuu

SEQ ID NO: 610935 - RNA, 19 nt, Homo sapiens
aaagaccagugaagaccaa

SEQ ID NO: 610936 - RNA, 19 nt, Homo sapiens
gacaacccucauucaauaa

SEQ ID NO: 610937 - RNA, 19 nt, Homo sapiens
ccaugucagugaucauugu

SEQ ID NO: 610938 - RNA, 19 nt, Homo sapiens
caacuuugcacccaucauc

SEQ ID NO: 610939 - RNA, 19 nt, Homo sapiens
ccucgaaccugcccauguc

SEQ ID NO: 610940 - RNA, 19 nt, Homo sapiens
gacuuggccucuacuucuu

SEQ ID NO: 610941 - RNA, 19 nt, Homo sapiens
ggaauuaaaggacaaucgu

SEQ ID NO: 610942 - RNA, 19 nt, Homo sapiens
gagcuuggccggacugaac

SEQ ID NO: 610943 - RNA, 19 nt, Homo sapiens
ucgcagaagugcccacaca

SEQ ID NO: 610944 - RNA, 19 nt, Homo sapiens
caggugcaaugcuccgauu

SEQ ID NO: 610945 - RNA, 19 nt, Homo sapiens
caacccucauucaauaaag

SEQ ID NO: 610946 - RNA, 19 nt, Homo sapiens
aaacagaguacuccuuucu

SEQ ID NO: 610947 - RNA, 19 nt, Homo sapiens
ucucagcucaggaauuaaa

SEQ ID NO: 610948 - RNA, 19 nt, Homo sapiens
cacaacuggucucauacuu

SEQ ID NO: 610949 - RNA, 19 nt, Homo sapiens
cgcaauacuucaugcuguu

SEQ ID NO: 610950 - RNA, 19 nt, Homo sapiens
guacuccuuucuggacuau

SEQ ID NO: 610951 - RNA, 19 nt, Homo sapiens
gauuguguccagccaggua

SEQ ID NO: 610952 - RNA, 19 nt, Homo sapiens
cagcuugaguaccgcuuug

SEQ ID NO: 610953 - RNA, 19 nt, Homo sapiens
cgcaugaauuugccuugaa

SEQ ID NO: 610954 - RNA, 19 nt, Homo sapiens
cagcgugguucaggacuau

SEQ ID NO: 610955 - RNA, 19 nt, Homo sapiens
ugguucagcuguccauuuc

SEQ ID NO: 610956 - RNA, 19 nt, Homo sapiens
ggagguagaggccagaaac

SEQ ID NO: 610957 - RNA, 19 nt, Homo sapiens
caagcuguucccugcauuu

SEQ ID NO: 610958 - RNA, 19 nt, Homo sapiens
ggucaaugaguaccugaug

SEQ ID NO: 610959 - RNA, 19 nt, Homo sapiens
ugacuuggccucuacuucu

SEQ ID NO: 610960 - RNA, 19 nt, Homo sapiens
cggcugaguuugaaugcau

SEQ ID NO: 610961 - RNA, 19 nt, Homo sapiens
ggcagucccggcugaguuu

SEQ ID NO: 610962 - RNA, 19 nt, Homo sapiens
cauggaagcguuucucagu

SEQ ID NO: 610963 - RNA, 19 nt, Homo sapiens
ggccagaaaccuagauaag

SEQ ID NO: 610964 - RNA, 19 nt, Homo sapiens
gaggccagaaaccuagaua

SEQ ID NO: 610965 - RNA, 19 nt, Homo sapiens
uguggguggugcugacuuu

SEQ ID NO: 610966 - RNA, 19 nt, Homo sapiens
ccugugaccaucucauuga

SEQ ID NO: 610967 - RNA, 19 nt, Homo sapiens
gcccugaguucuccaagac

SEQ ID NO: 610968 - RNA, 19 nt, Homo sapiens
acaaggacaucggcuccaa

SEQ ID NO: 610969 - RNA, 19 nt, Homo sapiens
gcagaagugcccacacaac

SEQ ID NO: 610970 - RNA, 19 nt, Homo sapiens
gcaauacuucaugcuguug

SEQ ID NO: 610971 - RNA, 19 nt, Homo sapiens
uggccucuacuucuuguua

SEQ ID NO: 610972 - RNA, 19 nt, Homo sapiens
gcaggcauccagggcauug

SEQ ID NO: 610973 - RNA, 19 nt, Homo sapiens
ucgcaugaauuugccuuga

SEQ ID NO: 610974 - RNA, 19 nt, Homo sapiens
ccgccagggugaugggaaa

SEQ ID NO: 610975 - RNA, 19 nt, Homo sapiens
cuccaagacucuacagcuu

SEQ ID NO: 610976 - RNA, 19 nt, Homo sapiens
gggacugccucgcaauacu

SEQ ID NO: 610977 - RNA, 19 nt, Homo sapiens
acuggcaggucucgcauga

SEQ ID NO: 610978 - RNA, 19 nt, Homo sapiens
ucaccugacucccuacacu

SEQ ID NO: 610979 - RNA, 19 nt, Homo sapiens
ggugcaaugcuccgauuau

SEQ ID NO: 610980 - RNA, 19 nt, Homo sapiens
ucaauaaagaccagugaag

SEQ ID NO: 610981 - RNA, 19 nt, Homo sapiens
gcgacauugugcaguuugu

SEQ ID NO: 610982 - RNA, 19 nt, Homo sapiens
gcccaugucagugaucauu

SEQ ID NO: 610983 - RNA, 19 nt, Homo sapiens
gaacaaccugaacccuaca

SEQ ID NO: 610984 - RNA, 19 nt, Homo sapiens
gaaaccuagauaagaagga

SEQ ID NO: 610985 - RNA, 19 nt, Homo sapiens
uaguaaccauggagguaga

SEQ ID NO: 610986 - RNA, 19 nt, Homo sapiens
gcuuugagacaguccagaa

SEQ ID NO: 610987 - RNA, 19 nt, Homo sapiens
agaccgugcucgcagaagu

SEQ ID NO: 610988 - RNA, 19 nt, Homo sapiens
ccgcgacauugugcaguuu

SEQ ID NO: 610989 - RNA, 19 nt, Homo sapiens
gaggcugucagaucaacuu

SEQ ID NO: 610990 - RNA, 19 nt, Homo sapiens
aacuauccgugucaagauu

SEQ ID NO: 610991 - RNA, 19 nt, Homo sapiens
caacccaacccuucucacu

SEQ ID NO: 610992 - RNA, 19 nt, Homo sapiens
cgacauugugcaguuugua

SEQ ID NO: 610993 - RNA, 19 nt, Homo sapiens
ccacacaacuggucucaua

SEQ ID NO: 610994 - RNA, 19 nt, Homo sapiens
ugacaacccucauucaaua

SEQ ID NO: 610995 - RNA, 19 nt, Homo sapiens
gaucugaggucaucaagaa

SEQ ID NO: 610996 - RNA, 19 nt, Homo sapiens
ggucucagcucaggaauua

SEQ ID NO: 610997 - RNA, 19 nt, Homo sapiens
ggaaauucaucucuuguuu

SEQ ID NO: 610998 - RNA, 19 nt, Homo sapiens
ccagaaaccuagauaagaa

SEQ ID NO: 610999 - RNA, 19 nt, Homo sapiens
caacuggucucauacuuca

SEQ ID NO: 611000 - RNA, 19 nt, Homo sapiens
ggacuucacuggcuccaau

SEQ ID NO: 611001 - RNA, 19 nt, Homo sapiens
guacagaucugaggucauc

SEQ ID NO: 611002 - RNA, 19 nt, Homo sapiens
gcaggucucgcaugaauuu

SEQ ID NO: 611003 - RNA, 19 nt, Homo sapiens
aaaggacaaucguguagua

SEQ ID NO: 611004 - RNA, 19 nt, Homo sapiens
uaaggaaauucaucucuug

SEQ ID NO: 611005 - RNA, 19 nt, Homo sapiens
caagaacucuggaacuauc

SEQ ID NO: 611006 - RNA, 19 nt, Homo sapiens
caacaggggucaaugagua

SEQ ID NO: 611007 - RNA, 19 nt, Homo sapiens
uacaagaacucuggaacua

SEQ ID NO: 611008 - RNA, 19 nt, Homo sapiens
gcugagggaugaugacuuc

SEQ ID NO: 611009 - RNA, 19 nt, Homo sapiens
gcaugaauuugccuugaau

SEQ ID NO: 611010 - RNA, 19 nt, Homo sapiens
gagggaugaugacuuccua

SEQ ID NO: 611011 - RNA, 19 nt, Homo sapiens
cgccagagcugagggauga

SEQ ID NO: 611012 - RNA, 19 nt, Homo sapiens
ggacaucggcuccaagucu

SEQ ID NO: 611013 - RNA, 19 nt, Homo sapiens
gaacuauccgugucaagau

SEQ ID NO: 611014 - RNA, 19 nt, Homo sapiens
ggaacuauccgugucaaga

SEQ ID NO: 611015 - RNA, 19 nt, Homo sapiens
gcagcgugguucaggacua

SEQ ID NO: 611016 - RNA, 19 nt, Homo sapiens
caagauuugucggguagaa

SEQ ID NO: 611017 - RNA, 19 nt, Homo sapiens
caauaaagaccagugaaga

SEQ ID NO: 611018 - RNA, 19 nt, Homo sapiens
gcuguucccugcauuugga

SEQ ID NO: 611019 - RNA, 19 nt, Homo sapiens
agaaacagaguacuccuuu

SEQ ID NO: 611020 - RNA, 19 nt, Homo sapiens
gguagaggccagaaaccua

SEQ ID NO: 611021 - RNA, 19 nt, Homo sapiens
uggcaggucucgcaugaau

SEQ ID NO: 611022 - RNA, 19 nt, Homo sapiens
gugcaaugcuccgauuaug

SEQ ID NO: 611023 - RNA, 19 nt, Homo sapiens
ggccucuacuucuuguuaa

SEQ ID NO: 611024 - RNA, 19 nt, Homo sapiens
cuauggcccuaccaacuuu

SEQ ID NO: 611025 - RNA, 19 nt, Homo sapiens
ggauugacuuggccucuac

SEQ ID NO: 611026 - RNA, 19 nt, Homo sapiens
gaaugcauccacccugaga

SEQ ID NO: 611027 - RNA, 19 nt, Homo sapiens
gccagaaaccuagauaaga

SEQ ID NO: 611028 - RNA, 19 nt, Homo sapiens
ggacaaucguguaguaacc

SEQ ID NO: 611029 - RNA, 19 nt, Homo sapiens
gaugggaggcugucagauc

SEQ ID NO: 611030 - RNA, 19 nt, Homo sapiens
gcuacgcuuuggaaucuau

SEQ ID NO: 611031 - RNA, 19 nt, Homo sapiens
gugaccaucucauugacaa

SEQ ID NO: 611032 - RNA, 19 nt, Homo sapiens
ggacugccucgcaauacuu

SEQ ID NO: 611033 - RNA, 19 nt, Homo sapiens
gacaagcuguucccugcau

SEQ ID NO: 611034 - RNA, 19 nt, Homo sapiens
gacccacucugcguccuuu

SEQ ID NO: 611035 - RNA, 19 nt, Homo sapiens
aaagaccagugaagaccaa

SEQ ID NO: 611036 - RNA, 19 nt, Homo sapiens
gacaacccucauucaauaa

SEQ ID NO: 611037 - RNA, 19 nt, Homo sapiens
ccaugucagugaucauugu

SEQ ID NO: 611038 - RNA, 19 nt, Homo sapiens
caacuuugcacccaucauc

SEQ ID NO: 611039 - RNA, 19 nt, Homo sapiens
ccucgaaccugcccauguc

SEQ ID NO: 611040 - RNA, 19 nt, Homo sapiens
ggaauuaaaggacaaucgu

SEQ ID NO: 611041 - RNA, 19 nt, Homo sapiens
gacuuggccucuacuucuu

SEQ ID NO: 611042 - RNA, 19 nt, Homo sapiens
gagcuuggccggacugaac

SEQ ID NO: 611043 - RNA, 19 nt, Homo sapiens
ucgcagaagugcccacaca

SEQ ID NO: 611044 - RNA, 19 nt, Homo sapiens
caggugcaaugcuccgauu

SEQ ID NO: 611045 - RNA, 19 nt, Homo sapiens
caacccucauucaauaaag

SEQ ID NO: 611046 - RNA, 19 nt, Homo sapiens
aaacagaguacuccuuucu

SEQ ID NO: 611047 - RNA, 19 nt, Homo sapiens
ucucagcucaggaauuaaa

SEQ ID NO: 611048 - RNA, 19 nt, Homo sapiens
cacaacuggucucauacuu

SEQ ID NO: 611049 - RNA, 19 nt, Homo sapiens
cgcaauacuucaugcuguu

SEQ ID NO: 611050 - RNA, 19 nt, Homo sapiens
guacuccuuucuggacuau

SEQ ID NO: 611051 - RNA, 19 nt, Homo sapiens
gauuguguccagccaggua

SEQ ID NO: 611052 - RNA, 19 nt, Homo sapiens
cagcuugaguaccgcuuug

SEQ ID NO: 611053 - RNA, 19 nt, Homo sapiens
cgcaugaauuugccuugaa

SEQ ID NO: 611054 - RNA, 19 nt, Homo sapiens
cagcgugguucaggacuau

SEQ ID NO: 611055 - RNA, 19 nt, Homo sapiens
ggagguagaggccagaaac

SEQ ID NO: 611056 - RNA, 19 nt, Homo sapiens
ugguucagcuguccauuuc

SEQ ID NO: 611057 - RNA, 19 nt, Homo sapiens
caagcuguucccugcauuu

SEQ ID NO: 611058 - RNA, 19 nt, Homo sapiens
ggucaaugaguaccugaug

SEQ ID NO: 611059 - RNA, 19 nt, Homo sapiens
cggcugaguuugaaugcau

SEQ ID NO: 611060 - RNA, 19 nt, Homo sapiens
ggcagucccggcugaguuu

SEQ ID NO: 611061 - RNA, 19 nt, Homo sapiens
cauggaagcguuucucagu

SEQ ID NO: 611062 - RNA, 19 nt, Homo sapiens
ggccagaaaccuagauaag

SEQ ID NO: 611063 - RNA, 19 nt, Homo sapiens
gaggccagaaaccuagaua

SEQ ID NO: 611064 - RNA, 19 nt, Homo sapiens
ugacuuggccucuacuucu

SEQ ID NO: 611065 - RNA, 19 nt, Homo sapiens
uguggguggugcugacuuu

SEQ ID NO: 611066 - RNA, 19 nt, Homo sapiens
acaaggacaucggcuccaa

SEQ ID NO: 611067 - RNA, 19 nt, Homo sapiens
ccugugaccaucucauuga

SEQ ID NO: 611068 - RNA, 19 nt, Homo sapiens
gcccugaguucuccaagac

SEQ ID NO: 611069 - RNA, 19 nt, Homo sapiens
gcagaagugcccacacaac

SEQ ID NO: 611070 - RNA, 19 nt, Homo sapiens
gcaauacuucaugcuguug

SEQ ID NO: 611071 - RNA, 19 nt, Homo sapiens
gcaggcauccagggcauug

SEQ ID NO: 611072 - RNA, 19 nt, Homo sapiens
ucgcaugaauuugccuuga

SEQ ID NO: 611073 - RNA, 19 nt, Homo sapiens
uggccucuacuucuuguua

SEQ ID NO: 611074 - RNA, 19 nt, Homo sapiens
cggauugacuuggccucua

SEQ ID NO: 611075 - RNA, 19 nt, Homo sapiens
ccgccagggugaugggaaa

SEQ ID NO: 611076 - RNA, 19 nt, Homo sapiens
cuccaagacucuacagcuu

SEQ ID NO: 611077 - RNA, 19 nt, Homo sapiens
gggacugccucgcaauacu

SEQ ID NO: 611078 - RNA, 19 nt, Homo sapiens
acuggcaggucucgcauga

SEQ ID NO: 611079 - RNA, 19 nt, Homo sapiens
ucaccugacucccuacacu

SEQ ID NO: 611080 - RNA, 19 nt, Homo sapiens
ggugcaaugcuccgauuau

SEQ ID NO: 611081 - RNA, 19 nt, Homo sapiens
ucaauaaagaccagugaag

SEQ ID NO: 611082 - RNA, 19 nt, Homo sapiens
gcgacauugugcaguuugu

SEQ ID NO: 611083 - RNA, 19 nt, Homo sapiens
gcccaugucagugaucauu

SEQ ID NO: 611084 - RNA, 19 nt, Homo sapiens
gaacaaccugaacccuaca

SEQ ID NO: 611085 - RNA, 19 nt, Homo sapiens
gaaaccuagauaagaagga

SEQ ID NO: 611086 - RNA, 19 nt, Homo sapiens
uaguaaccauggagguaga

SEQ ID NO: 611087 - RNA, 19 nt, Homo sapiens
gcuuugagacaguccagaa

SEQ ID NO: 611088 - RNA, 19 nt, Homo sapiens
agaccgugcucgcagaagu

SEQ ID NO: 611089 - RNA, 19 nt, Homo sapiens
ccgcgacauugugcaguuu

SEQ ID NO: 611090 - RNA, 19 nt, Homo sapiens
gaggcugucagaucaacuu

SEQ ID NO: 611091 - RNA, 19 nt, Homo sapiens
aacuauccgugucaagauu

SEQ ID NO: 611092 - RNA, 19 nt, Homo sapiens
caacccaacccuucucacu

SEQ ID NO: 611093 - RNA, 19 nt, Homo sapiens
ccacacaacuggucucaua

SEQ ID NO: 611094 - RNA, 19 nt, Homo sapiens
ugacaacccucauucaaua

SEQ ID NO: 611095 - RNA, 19 nt, Homo sapiens
gaucugaggucaucaagaa

SEQ ID NO: 611096 - RNA, 19 nt, Homo sapiens
ggucucagcucaggaauua

SEQ ID NO: 611097 - RNA, 19 nt, Homo sapiens
ccagaaaccuagauaagaa

SEQ ID NO: 611098 - RNA, 19 nt, Homo sapiens
caacuggucucauacuuca

SEQ ID NO: 611099 - RNA, 19 nt, Homo sapiens
ggacuucacuggcuccaau

SEQ ID NO: 611100 - RNA, 19 nt, Homo sapiens
guacagaucugaggucauc

SEQ ID NO: 611101 - RNA, 19 nt, Homo sapiens
gcaggucucgcaugaauuu

SEQ ID NO: 611102 - RNA, 19 nt, Homo sapiens
aaaggacaaucguguagua

SEQ ID NO: 611103 - RNA, 19 nt, Homo sapiens
caagaacucuggaacuauc

SEQ ID NO: 611104 - RNA, 19 nt, Homo sapiens
caacaggggucaaugagua

SEQ ID NO: 611105 - RNA, 19 nt, Homo sapiens
uacaagaacucuggaacua

SEQ ID NO: 611106 - RNA, 19 nt, Homo sapiens
gcugagggaugaugacuuc

SEQ ID NO: 611107 - RNA, 19 nt, Homo sapiens
gcaugaauuugccuugaau

SEQ ID NO: 611108 - RNA, 19 nt, Homo sapiens
gagggaugaugacuuccua

SEQ ID NO: 611109 - RNA, 19 nt, Homo sapiens
cgccagagcugagggauga

SEQ ID NO: 611110 - RNA, 19 nt, Homo sapiens
ggacaucggcuccaagucu

SEQ ID NO: 611111 - RNA, 19 nt, Homo sapiens
gaacuauccgugucaagau

SEQ ID NO: 611112 - RNA, 19 nt, Homo sapiens
ggaacuauccgugucaaga

SEQ ID NO: 611113 - RNA, 19 nt, Homo sapiens
gcagcgugguucaggacua

SEQ ID NO: 611114 - RNA, 19 nt, Homo sapiens
caagauuugucggguagaa

SEQ ID NO: 611115 - RNA, 19 nt, Homo sapiens
caauaaagaccagugaaga

SEQ ID NO: 611116 - RNA, 19 nt, Homo sapiens
gcuguucccugcauuugga

SEQ ID NO: 611117 - RNA, 19 nt, Homo sapiens
agaaacagaguacuccuuu

SEQ ID NO: 611118 - RNA, 19 nt, Homo sapiens
ggauugaccauuccugaug

SEQ ID NO: 611119 - RNA, 19 nt, Homo sapiens
ggacauucgccacuucuuc

SEQ ID NO: 611120 - RNA, 19 nt, Homo sapiens
gguagaggccagaaaccua

SEQ ID NO: 611121 - RNA, 19 nt, Homo sapiens
uggcaggucucgcaugaau

SEQ ID NO: 611122 - RNA, 19 nt, Homo sapiens
gugcaaugcuccgauuaug

SEQ ID NO: 611123 - RNA, 19 nt, Homo sapiens
cuauggcccuaccaacuuu

SEQ ID NO: 611124 - RNA, 19 nt, Homo sapiens
gaaugcauccacccugaga

SEQ ID NO: 611125 - RNA, 19 nt, Homo sapiens
gccagaaaccuagauaaga

SEQ ID NO: 611126 - RNA, 19 nt, Homo sapiens
ggacaaucguguaguaacc

SEQ ID NO: 611127 - RNA, 19 nt, Homo sapiens
gaugggaggcugucagauc

SEQ ID NO: 611128 - RNA, 19 nt, Homo sapiens
gcuacgcuuuggaaucuau

SEQ ID NO: 611129 - RNA, 19 nt, Homo sapiens
gugaccaucucauugacaa

SEQ ID NO: 611130 - RNA, 19 nt, Homo sapiens
ggacugccucgcaauacuu

SEQ ID NO: 611131 - RNA, 19 nt, Homo sapiens
gacaagcuguucccugcau

SEQ ID NO: 611132 - RNA, 19 nt, Homo sapiens
gacccacucugcguccuuu

SEQ ID NO: 611133 - RNA, 19 nt, Homo sapiens
aaagaccagugaagaccaa

SEQ ID NO: 611134 - RNA, 19 nt, Homo sapiens
gacaacccucauucaauaa

SEQ ID NO: 611135 - RNA, 19 nt, Homo sapiens
ccaugucagugaucauugu

SEQ ID NO: 611136 - RNA, 19 nt, Homo sapiens
caacuuugcacccaucauc

SEQ ID NO: 611137 - RNA, 19 nt, Homo sapiens
ccucgaaccugcccauguc

SEQ ID NO: 611138 - RNA, 19 nt, Homo sapiens
ugcaaggucucccaauugu

SEQ ID NO: 611139 - RNA, 19 nt, Homo sapiens
ggaauuaaaggacaaucgu

SEQ ID NO: 611140 - RNA, 19 nt, Homo sapiens
gagcuuggccggacugaac

SEQ ID NO: 611141 - RNA, 19 nt, Homo sapiens
ucgcagaagugcccacaca

SEQ ID NO: 611142 - RNA, 19 nt, Homo sapiens
ccacuucuucucuggauug

SEQ ID NO: 611143 - RNA, 19 nt, Homo sapiens
caggugcaaugcuccgauu

SEQ ID NO: 611144 - RNA, 19 nt, Homo sapiens
caacccucauucaauaaag

SEQ ID NO: 611145 - RNA, 19 nt, Homo sapiens
aaacagaguacuccuuucu

SEQ ID NO: 611146 - RNA, 19 nt, Homo sapiens
ggucauccguuugcaaggu

SEQ ID NO: 611147 - RNA, 19 nt, Homo sapiens
ucucagcucaggaauuaaa

SEQ ID NO: 611148 - RNA, 19 nt, Homo sapiens
cacaacuggucucauacuu

SEQ ID NO: 611149 - RNA, 19 nt, Homo sapiens
cgcaauacuucaugcuguu

SEQ ID NO: 611150 - RNA, 19 nt, Homo sapiens
guacuccuuucuggacuau

SEQ ID NO: 611151 - RNA, 19 nt, Homo sapiens
gauuguguccagccaggua

SEQ ID NO: 611152 - RNA, 19 nt, Homo sapiens
cagcuugaguaccgcuuug

SEQ ID NO: 611153 - RNA, 19 nt, Homo sapiens
uggcuguggucauccguuu

SEQ ID NO: 611154 - RNA, 19 nt, Homo sapiens
cgcaugaauuugccuugaa

SEQ ID NO: 611155 - RNA, 19 nt, Homo sapiens
cagcgugguucaggacuau

SEQ ID NO: 611156 - RNA, 19 nt, Homo sapiens
ggagguagaggccagaaac

SEQ ID NO: 611157 - RNA, 19 nt, Homo sapiens
ugguucagcuguccauuuc

SEQ ID NO: 611158 - RNA, 19 nt, Homo sapiens
caagcuguucccugcauuu

SEQ ID NO: 611159 - RNA, 19 nt, Homo sapiens
ggucaaugaguaccugaug

SEQ ID NO: 611160 - RNA, 19 nt, Homo sapiens
cggcugaguuugaaugcau

SEQ ID NO: 611161 - RNA, 19 nt, Homo sapiens
ggcagucccggcugaguuu

SEQ ID NO: 611162 - RNA, 19 nt, Homo sapiens
cauggaagcguuucucagu

SEQ ID NO: 611163 - RNA, 19 nt, Homo sapiens
ggccagaaaccuagauaag

SEQ ID NO: 611164 - RNA, 19 nt, Homo sapiens
gaggccagaaaccuagaua

SEQ ID NO: 611165 - RNA, 19 nt, Homo sapiens
uguggguggugcugacuuu

SEQ ID NO: 611166 - RNA, 19 nt, Homo sapiens
acaaggacaucggcuccaa

SEQ ID NO: 611167 - RNA, 19 nt, Homo sapiens
ccugugaccaucucauuga

SEQ ID NO: 611168 - RNA, 19 nt, Homo sapiens
uuugcaaggucucccaauu

SEQ ID NO: 611169 - RNA, 19 nt, Homo sapiens
gcccugaguucuccaagac

SEQ ID NO: 611170 - RNA, 19 nt, Homo sapiens
gcagaagugcccacacaac

SEQ ID NO: 611171 - RNA, 19 nt, Homo sapiens
gcaauacuucaugcuguug

SEQ ID NO: 611172 - RNA, 19 nt, Homo sapiens
gcaggcauccagggcauug

SEQ ID NO: 611173 - RNA, 19 nt, Homo sapiens
ucgcaugaauuugccuuga

SEQ ID NO: 611174 - RNA, 19 nt, Homo sapiens
ccgccagggugaugggaaa

SEQ ID NO: 611175 - RNA, 19 nt, Homo sapiens
cuccaagacucuacagcuu

SEQ ID NO: 611176 - RNA, 19 nt, Homo sapiens
gggacugccucgcaauacu

SEQ ID NO: 611177 - RNA, 19 nt, Homo sapiens
acuggcaggucucgcauga

SEQ ID NO: 611178 - RNA, 19 nt, Homo sapiens
ucaccugacucccuacacu

SEQ ID NO: 611179 - RNA, 19 nt, Homo sapiens
ggugcaaugcuccgauuau

SEQ ID NO: 611180 - RNA, 19 nt, Homo sapiens
ucaauaaagaccagugaag

SEQ ID NO: 611181 - RNA, 19 nt, Homo sapiens
gcgacauugugcaguuugu

SEQ ID NO: 611182 - RNA, 19 nt, Homo sapiens
gcccaugucagugaucauu

SEQ ID NO: 611183 - RNA, 19 nt, Homo sapiens
cauggacauucgccacuuc

SEQ ID NO: 611184 - RNA, 19 nt, Homo sapiens
gaacaaccugaacccuaca

SEQ ID NO: 611185 - RNA, 19 nt, Homo sapiens
gaaaccuagauaagaagga

SEQ ID NO: 611186 - RNA, 19 nt, Homo sapiens
uaguaaccauggagguaga

SEQ ID NO: 611187 - RNA, 19 nt, Homo sapiens
gcuuugagacaguccagaa

SEQ ID NO: 611188 - RNA, 19 nt, Homo sapiens
agaccgugcucgcagaagu

SEQ ID NO: 611189 - RNA, 19 nt, Homo sapiens
ccgcgacauugugcaguuu

SEQ ID NO: 611190 - RNA, 19 nt, Homo sapiens
gaggcugucagaucaacuu

SEQ ID NO: 611191 - RNA, 19 nt, Homo sapiens
aacuauccgugucaagauu

SEQ ID NO: 611192 - RNA, 19 nt, Homo sapiens
caacccaacccuucucacu

SEQ ID NO: 611193 - RNA, 19 nt, Homo sapiens
ccacacaacuggucucaua

SEQ ID NO: 611194 - RNA, 19 nt, Homo sapiens
ugacaacccucauucaaua

SEQ ID NO: 611195 - RNA, 19 nt, Homo sapiens
gaucugaggucaucaagaa

SEQ ID NO: 611196 - RNA, 19 nt, Homo sapiens
ggucucagcucaggaauua

SEQ ID NO: 611197 - RNA, 19 nt, Homo sapiens
ggaaauucaucucuuguuu

SEQ ID NO: 611198 - RNA, 19 nt, Homo sapiens
ccagaaaccuagauaagaa

SEQ ID NO: 611199 - RNA, 19 nt, Homo sapiens
caacuggucucauacuuca

SEQ ID NO: 611200 - RNA, 19 nt, Homo sapiens
ggacuucacuggcuccaau

SEQ ID NO: 611201 - RNA, 19 nt, Homo sapiens
guacagaucugaggucauc

SEQ ID NO: 611202 - RNA, 19 nt, Homo sapiens
gcaggucucgcaugaauuu

SEQ ID NO: 611203 - RNA, 19 nt, Homo sapiens
aaaggacaaucguguagua

SEQ ID NO: 611204 - RNA, 19 nt, Homo sapiens
uaaggaaauucaucucuug

SEQ ID NO: 611205 - RNA, 19 nt, Homo sapiens
caagaacucuggaacuauc

SEQ ID NO: 611206 - RNA, 19 nt, Homo sapiens
caacaggggucaaugagua

SEQ ID NO: 611207 - RNA, 19 nt, Homo sapiens
uacaagaacucuggaacua

SEQ ID NO: 611208 - RNA, 19 nt, Homo sapiens
gcugagggaugaugacuuc

SEQ ID NO: 611209 - RNA, 19 nt, Homo sapiens
gcaugaauuugccuugaau

SEQ ID NO: 611210 - RNA, 19 nt, Homo sapiens
gagggaugaugacuuccua

SEQ ID NO: 611211 - RNA, 19 nt, Homo sapiens
cgccagagcugagggauga

SEQ ID NO: 611212 - RNA, 19 nt, Homo sapiens
ggacaucggcuccaagucu

SEQ ID NO: 611213 - RNA, 19 nt, Homo sapiens
gaacuauccgugucaagau

SEQ ID NO: 611214 - RNA, 19 nt, Homo sapiens
ggaacuauccgugucaaga

SEQ ID NO: 611215 - RNA, 19 nt, Homo sapiens
gcagcgugguucaggacua

SEQ ID NO: 611216 - RNA, 19 nt, Homo sapiens
caagauuugucggguagaa

SEQ ID NO: 611217 - RNA, 19 nt, Homo sapiens
caauaaagaccagugaaga

SEQ ID NO: 611218 - RNA, 19 nt, Homo sapiens
gcuguucccugcauuugga

SEQ ID NO: 611219 - RNA, 19 nt, Homo sapiens
agaaacagaguacuccuuu

SEQ ID NO: 611220 - RNA, 19 nt, Homo sapiens
ggauugaccauuccugaug

SEQ ID NO: 611221 - RNA, 19 nt, Homo sapiens
gguagaggccagaaaccua

SEQ ID NO: 611222 - RNA, 19 nt, Homo sapiens
ggacauucgccacuucuuc

SEQ ID NO: 611223 - RNA, 19 nt, Homo sapiens
uggcaggucucgcaugaau

SEQ ID NO: 611224 - RNA, 19 nt, Homo sapiens
gugcaaugcuccgauuaug

SEQ ID NO: 611225 - RNA, 19 nt, Homo sapiens
uaucaggugugugugguuu

SEQ ID NO: 611226 - RNA, 19 nt, Homo sapiens
ggccucuacuucuuguuaa

SEQ ID NO: 611227 - RNA, 19 nt, Homo sapiens
cuauggcccuaccaacuuu

SEQ ID NO: 611228 - RNA, 19 nt, Homo sapiens
ggauugacuuggccucuac

SEQ ID NO: 611229 - RNA, 19 nt, Homo sapiens
gaaugcauccacccugaga

SEQ ID NO: 611230 - RNA, 19 nt, Homo sapiens
gccagaaaccuagauaaga

SEQ ID NO: 611231 - RNA, 19 nt, Homo sapiens
ggacaaucguguaguaacc

SEQ ID NO: 611232 - RNA, 19 nt, Homo sapiens
gaugggaggcugucagauc

SEQ ID NO: 611233 - RNA, 19 nt, Homo sapiens
gcuacgcuuuggaaucuau

SEQ ID NO: 611234 - RNA, 19 nt, Homo sapiens
gugaccaucucauugacaa

SEQ ID NO: 611235 - RNA, 19 nt, Homo sapiens
ggacugccucgcaauacuu

SEQ ID NO: 611236 - RNA, 19 nt, Homo sapiens
gacaagcuguucccugcau

SEQ ID NO: 611237 - RNA, 19 nt, Homo sapiens
gacccacucugcguccuuu

SEQ ID NO: 611238 - RNA, 19 nt, Homo sapiens
aaagaccagugaagaccaa

SEQ ID NO: 611239 - RNA, 19 nt, Homo sapiens
gacaacccucauucaauaa

SEQ ID NO: 611240 - RNA, 19 nt, Homo sapiens
ccaugucagugaucauugu

SEQ ID NO: 611241 - RNA, 19 nt, Homo sapiens
caacuuugcacccaucauc

SEQ ID NO: 611242 - RNA, 19 nt, Homo sapiens
ccucgaaccugcccauguc

SEQ ID NO: 611243 - RNA, 19 nt, Homo sapiens
ggaauuaaaggacaaucgu

SEQ ID NO: 611244 - RNA, 19 nt, Homo sapiens
gagcuuggccggacugaac

SEQ ID NO: 611245 - RNA, 19 nt, Homo sapiens
gacuuggccucuacuucuu

SEQ ID NO: 611246 - RNA, 19 nt, Homo sapiens
ugcaaggucucccaauugu

SEQ ID NO: 611247 - RNA, 19 nt, Homo sapiens
ucgcagaagugcccacaca

SEQ ID NO: 611248 - RNA, 19 nt, Homo sapiens
caggugcaaugcuccgauu

SEQ ID NO: 611249 - RNA, 19 nt, Homo sapiens
ccacuucuucucuggauug

SEQ ID NO: 611250 - RNA, 19 nt, Homo sapiens
caacccucauucaauaaag

SEQ ID NO: 611251 - RNA, 19 nt, Homo sapiens
aaacagaguacuccuuucu

SEQ ID NO: 611252 - RNA, 19 nt, Homo sapiens
ucucagcucaggaauuaaa

SEQ ID NO: 611253 - RNA, 19 nt, Homo sapiens
ggucauccguuugcaaggu

SEQ ID NO: 611254 - RNA, 19 nt, Homo sapiens
cacaacuggucucauacuu

SEQ ID NO: 611255 - RNA, 19 nt, Homo sapiens
cgcaauacuucaugcuguu

SEQ ID NO: 611256 - RNA, 19 nt, Homo sapiens
guacuccuuucuggacuau

SEQ ID NO: 611257 - RNA, 19 nt, Homo sapiens
gauuguguccagccaggua

SEQ ID NO: 611258 - RNA, 19 nt, Homo sapiens
cagcuugaguaccgcuuug

SEQ ID NO: 611259 - RNA, 19 nt, Homo sapiens
cgcaugaauuugccuugaa

SEQ ID NO: 611260 - RNA, 19 nt, Homo sapiens
cagcgugguucaggacuau

SEQ ID NO: 611261 - RNA, 19 nt, Homo sapiens
uggcuguggucauccguuu

SEQ ID NO: 611262 - RNA, 19 nt, Homo sapiens
ggagguagaggccagaaac

SEQ ID NO: 611263 - RNA, 19 nt, Homo sapiens
ugguucagcuguccauuuc

SEQ ID NO: 611264 - RNA, 19 nt, Homo sapiens
caagcuguucccugcauuu

SEQ ID NO: 611265 - RNA, 19 nt, Homo sapiens
ggucaaugaguaccugaug

SEQ ID NO: 611266 - RNA, 19 nt, Homo sapiens
ugacuuggccucuacuucu

SEQ ID NO: 611267 - RNA, 19 nt, Homo sapiens
cggcugaguuugaaugcau

SEQ ID NO: 611268 - RNA, 19 nt, Homo sapiens
ggcagucccggcugaguuu

SEQ ID NO: 611269 - RNA, 19 nt, Homo sapiens
cauggaagcguuucucagu

SEQ ID NO: 611270 - RNA, 19 nt, Homo sapiens
ggccagaaaccuagauaag

SEQ ID NO: 611271 - RNA, 19 nt, Homo sapiens
gaggccagaaaccuagaua

SEQ ID NO: 611272 - RNA, 19 nt, Homo sapiens
uguggguggugcugacuuu

SEQ ID NO: 611273 - RNA, 19 nt, Homo sapiens
uuugcaaggucucccaauu

SEQ ID NO: 611274 - RNA, 19 nt, Homo sapiens
gcccugaguucuccaagac

SEQ ID NO: 611275 - RNA, 19 nt, Homo sapiens
acaaggacaucggcuccaa

SEQ ID NO: 611276 - RNA, 19 nt, Homo sapiens
ccugugaccaucucauuga

SEQ ID NO: 611277 - RNA, 19 nt, Homo sapiens
gcagaagugcccacacaac

SEQ ID NO: 611278 - RNA, 19 nt, Homo sapiens
gcaauacuucaugcuguug

SEQ ID NO: 611279 - RNA, 19 nt, Homo sapiens
gcaggcauccagggcauug

SEQ ID NO: 611280 - RNA, 19 nt, Homo sapiens
ucgcaugaauuugccuuga

SEQ ID NO: 611281 - RNA, 19 nt, Homo sapiens
uggccucuacuucuuguua

SEQ ID NO: 611282 - RNA, 19 nt, Homo sapiens
ccgccagggugaugggaaa

SEQ ID NO: 611283 - RNA, 19 nt, Homo sapiens
cuccaagacucuacagcuu

SEQ ID NO: 611284 - RNA, 19 nt, Homo sapiens
gggacugccucgcaauacu

SEQ ID NO: 611285 - RNA, 19 nt, Homo sapiens
acuggcaggucucgcauga

SEQ ID NO: 611286 - RNA, 19 nt, Homo sapiens
ucaccugacucccuacacu

SEQ ID NO: 611287 - RNA, 19 nt, Homo sapiens
ggugcaaugcuccgauuau

SEQ ID NO: 611288 - RNA, 19 nt, Homo sapiens
ucaauaaagaccagugaag

SEQ ID NO: 611289 - RNA, 19 nt, Homo sapiens
gcgacauugugcaguuugu

SEQ ID NO: 611290 - RNA, 19 nt, Homo sapiens
gcccaugucagugaucauu

SEQ ID NO: 611291 - RNA, 19 nt, Homo sapiens
gaacaaccugaacccuaca

SEQ ID NO: 611292 - RNA, 19 nt, Homo sapiens
gaaaccuagauaagaagga

SEQ ID NO: 611293 - RNA, 19 nt, Homo sapiens
ccacacaacuggucucaua

SEQ ID NO: 611294 - RNA, 19 nt, Homo sapiens
ugacaacccucauucaaua

SEQ ID NO: 611295 - RNA, 19 nt, Homo sapiens
gaucugaggucaucaagaa

SEQ ID NO: 611296 - RNA, 19 nt, Homo sapiens
ggucucagcucaggaauua

SEQ ID NO: 611297 - RNA, 19 nt, Homo sapiens
ggaaauucaucucuuguuu

SEQ ID NO: 611298 - RNA, 19 nt, Homo sapiens
ccagaaaccuagauaagaa

SEQ ID NO: 611299 - RNA, 19 nt, Homo sapiens
caacuggucucauacuuca

SEQ ID NO: 611300 - RNA, 19 nt, Homo sapiens
ggacuucacuggcuccaau

SEQ ID NO: 611301 - RNA, 19 nt, Homo sapiens
guacagaucugaggucauc

SEQ ID NO: 611302 - RNA, 19 nt, Homo sapiens
gcaggucucgcaugaauuu

SEQ ID NO: 611303 - RNA, 19 nt, Homo sapiens
aaaggacaaucguguagua

SEQ ID NO: 611304 - RNA, 19 nt, Homo sapiens
uaaggaaauucaucucuug

SEQ ID NO: 611305 - RNA, 19 nt, Homo sapiens
caagaacucuggaacuauc

SEQ ID NO: 611306 - RNA, 19 nt, Homo sapiens
caacaggggucaaugagua

SEQ ID NO: 611307 - RNA, 19 nt, Homo sapiens
uacaagaacucuggaacua

SEQ ID NO: 611308 - RNA, 19 nt, Homo sapiens
gcugagggaugaugacuuc

SEQ ID NO: 611309 - RNA, 19 nt, Homo sapiens
gcaugaauuugccuugaau

SEQ ID NO: 611310 - RNA, 19 nt, Homo sapiens
gagggaugaugacuuccua

SEQ ID NO: 611311 - RNA, 19 nt, Homo sapiens
cgccagagcugagggauga

SEQ ID NO: 611312 - RNA, 19 nt, Homo sapiens
ggacaucggcuccaagucu

SEQ ID NO: 611313 - RNA, 19 nt, Homo sapiens
gaacuauccgugucaagau

SEQ ID NO: 611314 - RNA, 19 nt, Homo sapiens
ggaacuauccgugucaaga

SEQ ID NO: 611315 - RNA, 19 nt, Homo sapiens
gcagcgugguucaggacua

SEQ ID NO: 611316 - RNA, 19 nt, Homo sapiens
caagauuugucggguagaa

SEQ ID NO: 611317 - RNA, 19 nt, Homo sapiens
caauaaagaccagugaaga

SEQ ID NO: 611318 - RNA, 19 nt, Homo sapiens
gcuguucccugcauuugga

SEQ ID NO: 611319 - RNA, 19 nt, Homo sapiens
agaaacagaguacuccuuu

SEQ ID NO: 611320 - RNA, 19 nt, Homo sapiens
ggauugaccauuccugaug

SEQ ID NO: 611321 - RNA, 19 nt, Homo sapiens
gguagaggccagaaaccua

SEQ ID NO: 611322 - RNA, 19 nt, Homo sapiens
ggacauucgccacuucuuc

SEQ ID NO: 611323 - RNA, 19 nt, Homo sapiens
uggcaggucucgcaugaau

SEQ ID NO: 611324 - RNA, 19 nt, Homo sapiens
gugcaaugcuccgauuaug

SEQ ID NO: 611325 - RNA, 19 nt, Homo sapiens
uaucaggugugugugguuu

SEQ ID NO: 611326 - RNA, 19 nt, Homo sapiens
ggccucuacuucuuguuaa

SEQ ID NO: 611327 - RNA, 19 nt, Homo sapiens
cuauggcccuaccaacuuu

SEQ ID NO: 611328 - RNA, 19 nt, Homo sapiens
ggauugacuuggccucuac

SEQ ID NO: 611329 - RNA, 19 nt, Homo sapiens
gaaugcauccacccugaga

SEQ ID NO: 611330 - RNA, 19 nt, Homo sapiens
gccagaaaccuagauaaga

SEQ ID NO: 611331 - RNA, 19 nt, Homo sapiens
ggacaaucguguaguaacc

SEQ ID NO: 611332 - RNA, 19 nt, Homo sapiens
gaugggaggcugucagauc

SEQ ID NO: 611333 - RNA, 19 nt, Homo sapiens
gcuacgcuuuggaaucuau

SEQ ID NO: 611334 - RNA, 19 nt, Homo sapiens
gugaccaucucauugacaa

SEQ ID NO: 611335 - RNA, 19 nt, Homo sapiens
ggacugccucgcaauacuu

SEQ ID NO: 611336 - RNA, 19 nt, Homo sapiens
gacaagcuguucccugcau

SEQ ID NO: 611337 - RNA, 19 nt, Homo sapiens
gacccacucugcguccuuu

SEQ ID NO: 611338 - RNA, 19 nt, Homo sapiens
aaagaccagugaagaccaa

SEQ ID NO: 611339 - RNA, 19 nt, Homo sapiens
gacaacccucauucaauaa

SEQ ID NO: 611340 - RNA, 19 nt, Homo sapiens
ccaugucagugaucauugu

SEQ ID NO: 611341 - RNA, 19 nt, Homo sapiens
caacuuugcacccaucauc

SEQ ID NO: 611342 - RNA, 19 nt, Homo sapiens
ccucgaaccugcccauguc

SEQ ID NO: 611343 - RNA, 19 nt, Homo sapiens
ggaauuaaaggacaaucgu

SEQ ID NO: 611344 - RNA, 19 nt, Homo sapiens
gacuuggccucuacuucuu

SEQ ID NO: 611345 - RNA, 19 nt, Homo sapiens
gagcuuggccggacugaac

SEQ ID NO: 611346 - RNA, 19 nt, Homo sapiens
ugcaaggucucccaauugu

SEQ ID NO: 611347 - RNA, 19 nt, Homo sapiens
ucgcagaagugcccacaca

SEQ ID NO: 611348 - RNA, 19 nt, Homo sapiens
caggugcaaugcuccgauu

SEQ ID NO: 611349 - RNA, 19 nt, Homo sapiens
ccacuucuucucuggauug

SEQ ID NO: 611350 - RNA, 19 nt, Homo sapiens
caacccucauucaauaaag

SEQ ID NO: 611351 - RNA, 19 nt, Homo sapiens
aaacagaguacuccuuucu

SEQ ID NO: 611352 - RNA, 19 nt, Homo sapiens
ucucagcucaggaauuaaa

SEQ ID NO: 611353 - RNA, 19 nt, Homo sapiens
ggucauccguuugcaaggu

SEQ ID NO: 611354 - RNA, 19 nt, Homo sapiens
cacaacuggucucauacuu

SEQ ID NO: 611355 - RNA, 19 nt, Homo sapiens
cgcaauacuucaugcuguu

SEQ ID NO: 611356 - RNA, 19 nt, Homo sapiens
guacuccuuucuggacuau

SEQ ID NO: 611357 - RNA, 19 nt, Homo sapiens
gauuguguccagccaggua

SEQ ID NO: 611358 - RNA, 19 nt, Homo sapiens
cagcuugaguaccgcuuug

SEQ ID NO: 611359 - RNA, 19 nt, Homo sapiens
uggcuguggucauccguuu

SEQ ID NO: 611360 - RNA, 19 nt, Homo sapiens
cgcaugaauuugccuugaa

SEQ ID NO: 611361 - RNA, 19 nt, Homo sapiens
cagcgugguucaggacuau

SEQ ID NO: 611362 - RNA, 19 nt, Homo sapiens
ggagguagaggccagaaac

SEQ ID NO: 611363 - RNA, 19 nt, Homo sapiens
ugguucagcuguccauuuc

SEQ ID NO: 611364 - RNA, 19 nt, Homo sapiens
caagcuguucccugcauuu

SEQ ID NO: 611365 - RNA, 19 nt, Homo sapiens
ggucaaugaguaccugaug

SEQ ID NO: 611366 - RNA, 19 nt, Homo sapiens
cggcugaguuugaaugcau

SEQ ID NO: 611367 - RNA, 19 nt, Homo sapiens
ggcagucccggcugaguuu

SEQ ID NO: 611368 - RNA, 19 nt, Homo sapiens
cauggaagcguuucucagu

SEQ ID NO: 611369 - RNA, 19 nt, Homo sapiens
ggccagaaaccuagauaag

SEQ ID NO: 611370 - RNA, 19 nt, Homo sapiens
gaggccagaaaccuagaua

SEQ ID NO: 611371 - RNA, 19 nt, Homo sapiens
ugacuuggccucuacuucu

SEQ ID NO: 611372 - RNA, 19 nt, Homo sapiens
uguggguggugcugacuuu

SEQ ID NO: 611373 - RNA, 19 nt, Homo sapiens
uuugcaaggucucccaauu

SEQ ID NO: 611374 - RNA, 19 nt, Homo sapiens
gcccugaguucuccaagac

SEQ ID NO: 611375 - RNA, 19 nt, Homo sapiens
acaaggacaucggcuccaa

SEQ ID NO: 611376 - RNA, 19 nt, Homo sapiens
ccugugaccaucucauuga

SEQ ID NO: 611377 - RNA, 19 nt, Homo sapiens
gcagaagugcccacacaac

SEQ ID NO: 611378 - RNA, 19 nt, Homo sapiens
gcaauacuucaugcuguug

SEQ ID NO: 611379 - RNA, 19 nt, Homo sapiens
gcaggcauccagggcauug

SEQ ID NO: 611380 - RNA, 19 nt, Homo sapiens
ucgcaugaauuugccuuga

SEQ ID NO: 611381 - RNA, 19 nt, Homo sapiens
uggccucuacuucuuguua

SEQ ID NO: 611382 - RNA, 19 nt, Homo sapiens
cggauugacuuggccucua

SEQ ID NO: 611383 - RNA, 19 nt, Homo sapiens
ccgccagggugaugggaaa

SEQ ID NO: 611384 - RNA, 19 nt, Homo sapiens
cuccaagacucuacagcuu

SEQ ID NO: 611385 - RNA, 19 nt, Homo sapiens
gggacugccucgcaauacu

SEQ ID NO: 611386 - RNA, 19 nt, Homo sapiens
acuggcaggucucgcauga

SEQ ID NO: 611387 - RNA, 19 nt, Homo sapiens
ucaccugacucccuacacu

SEQ ID NO: 611388 - RNA, 19 nt, Homo sapiens
ggugcaaugcuccgauuau

SEQ ID NO: 611389 - RNA, 19 nt, Homo sapiens
ucaauaaagaccagugaag

SEQ ID NO: 611390 - RNA, 19 nt, Homo sapiens
gcgacauugugcaguuugu

SEQ ID NO: 611391 - RNA, 19 nt, Homo sapiens
gcccaugucagugaucauu

SEQ ID NO: 611392 - RNA, 19 nt, Homo sapiens
gaacaaccugaacccuaca

SEQ ID NO: 611393 - RNA, 19 nt, Homo sapiens
gagccuaucuacacauuua

SEQ ID NO: 611394 - RNA, 19 nt, Homo sapiens
ggauuaagcuuuguuguga

SEQ ID NO: 611395 - RNA, 19 nt, Homo sapiens
gaugaugucuugucaguau

SEQ ID NO: 611396 - RNA, 19 nt, Homo sapiens
caagauacaugguggaaga

SEQ ID NO: 611397 - RNA, 19 nt, Homo sapiens
ugacuaaauuggagugaua

SEQ ID NO: 611398 - RNA, 19 nt, Homo sapiens
gaaaauggcacaucauaua

SEQ ID NO: 611399 - RNA, 19 nt, Homo sapiens
gaauuagaauggugcagaa

SEQ ID NO: 611400 - RNA, 19 nt, Homo sapiens
gaauauggugguuguuaua

SEQ ID NO: 611401 - RNA, 19 nt, Homo sapiens
cuuaucacaucgccaauua

SEQ ID NO: 611402 - RNA, 19 nt, Homo sapiens
cuaguuaacagaagucuua

SEQ ID NO: 611403 - RNA, 19 nt, Homo sapiens
cuaauuacccuggaaauaa

SEQ ID NO: 611404 - RNA, 19 nt, Homo sapiens
ucaggacaaugaacuaauu

SEQ ID NO: 611405 - RNA, 19 nt, Homo sapiens
gauaugcuagucuguauuu

SEQ ID NO: 611406 - RNA, 19 nt, Homo sapiens
gaauggaaacuuuguugaa

SEQ ID NO: 611407 - RNA, 19 nt, Homo sapiens
gauggucacucccuucaug

SEQ ID NO: 611408 - RNA, 19 nt, Homo sapiens
gagagccuaucuacacauu

SEQ ID NO: 611409 - RNA, 19 nt, Homo sapiens
aaaggucaguuucucuuaa

SEQ ID NO: 611410 - RNA, 19 nt, Homo sapiens
gaacuaauuacccuggaaa

SEQ ID NO: 611411 - RNA, 19 nt, Homo sapiens
ucacaucgccaauuaguug

SEQ ID NO: 611412 - RNA, 19 nt, Homo sapiens
gaaauuggacugacauaac

SEQ ID NO: 611413 - RNA, 19 nt, Homo sapiens
uauaagcacacacaagaua

SEQ ID NO: 611414 - RNA, 19 nt, Homo sapiens
ucuaaggagucuucaugua

SEQ ID NO: 611415 - RNA, 19 nt, Homo sapiens
gaucuaaggagucuucaug

SEQ ID NO: 611416 - RNA, 19 nt, Homo sapiens
cgugagcacugucuuauca

SEQ ID NO: 611417 - RNA, 19 nt, Homo sapiens
ugacaaaggaaacucuuaa

SEQ ID NO: 611418 - RNA, 19 nt, Homo sapiens
ggaauucuucauaacagua

SEQ ID NO: 611419 - RNA, 19 nt, Homo sapiens
caaauuuacuccaaagacu

SEQ ID NO: 611420 - RNA, 19 nt, Homo sapiens
gaugacuucuuguggcauu

SEQ ID NO: 611421 - RNA, 19 nt, Homo sapiens
uaacucuccucccuuguug

SEQ ID NO: 611422 - RNA, 19 nt, Homo sapiens
ggaaagcuucgacugcaaa

SEQ ID NO: 611423 - RNA, 19 nt, Homo sapiens
guuauaagcacacacaaga

SEQ ID NO: 611424 - RNA, 19 nt, Homo sapiens
ugaauauggugguuguuau

SEQ ID NO: 611425 - RNA, 19 nt, Homo sapiens
uaaaggucaguuucucuua

SEQ ID NO: 611426 - RNA, 19 nt, Homo sapiens
auucaugccuacacaauuu

SEQ ID NO: 611427 - RNA, 19 nt, Homo sapiens
ugccaggaauucuucauaa

SEQ ID NO: 611428 - RNA, 19 nt, Homo sapiens
ccacgugagcacugucuua

SEQ ID NO: 611429 - RNA, 19 nt, Homo sapiens
uaaauuggagugauacuuc

SEQ ID NO: 611430 - RNA, 19 nt, Homo sapiens
aaagacuagugcagcauuu

SEQ ID NO: 611431 - RNA, 19 nt, Homo sapiens
uuagaauggugcagaaaga

SEQ ID NO: 611432 - RNA, 19 nt, Homo sapiens
ugaagaaauuggacugaca

SEQ ID NO: 611433 - RNA, 19 nt, Homo sapiens
gaucaggacaaugaacuaa

SEQ ID NO: 611434 - RNA, 19 nt, Homo sapiens
ucacaauaguaagcacaua

SEQ ID NO: 611435 - RNA, 19 nt, Homo sapiens
gugcagcauuucagcauau

SEQ ID NO: 611436 - RNA, 19 nt, Homo sapiens
ucaggaaacauccaagaaa

SEQ ID NO: 611437 - RNA, 19 nt, Homo sapiens
ucacauaucaaaugaaugg

SEQ ID NO: 611438 - RNA, 19 nt, Homo sapiens
gacaaaggaaacucuuaaa

SEQ ID NO: 611439 - RNA, 19 nt, Homo sapiens
uacagcagcuuccuuucuu

SEQ ID NO: 611440 - RNA, 19 nt, Homo sapiens
gcugugcuauugaggauca

SEQ ID NO: 611441 - RNA, 19 nt, Homo sapiens
gggaaagcuucgacugcaa

SEQ ID NO: 611442 - RNA, 19 nt, Homo sapiens
aagauaugcuagucuguau

SEQ ID NO: 611443 - RNA, 19 nt, Homo sapiens
cagagcugcugaaggaaga

SEQ ID NO: 611444 - RNA, 19 nt, Homo sapiens
caucgccaauuaguuguaa

SEQ ID NO: 611445 - RNA, 19 nt, Homo sapiens
gaagaaauuggacugacau

SEQ ID NO: 611446 - RNA, 19 nt, Homo sapiens
guugcucucuucacaguau

SEQ ID NO: 611447 - RNA, 19 nt, Homo sapiens
gggaugagaaacaggauug

SEQ ID NO: 611448 - RNA, 19 nt, Homo sapiens
cagcauuucagcauaugua

SEQ ID NO: 611449 - RNA, 19 nt, Homo sapiens
ugagcaggcugaucuacug

SEQ ID NO: 611450 - RNA, 19 nt, Homo sapiens
aaagauaugcuagucugua

SEQ ID NO: 611451 - RNA, 19 nt, Homo sapiens
uaaggagucuucauguacu

SEQ ID NO: 611452 - RNA, 19 nt, Homo sapiens
guuuaaagcacgaauguuc

SEQ ID NO: 611453 - RNA, 19 nt, Homo sapiens
gcacauuugacuccugaga

SEQ ID NO: 611454 - RNA, 19 nt, Homo sapiens
caaagacuagugcagcauu

SEQ ID NO: 611455 - RNA, 19 nt, Homo sapiens
ucuccucccuuguugauga

SEQ ID NO: 611456 - RNA, 19 nt, Homo sapiens
aaauuggacugacauaacu

SEQ ID NO: 611457 - RNA, 19 nt, Homo sapiens
gauacaugguggaagaucu

SEQ ID NO: 611458 - RNA, 19 nt, Homo sapiens
uauaugcugggcuggauua

SEQ ID NO: 611459 - RNA, 19 nt, Homo sapiens
acauuugacuccugagaug

SEQ ID NO: 611460 - RNA, 19 nt, Homo sapiens
cacaauaguaagcacauaa

SEQ ID NO: 611461 - RNA, 19 nt, Homo sapiens
gagauaccuuuucuggaua

SEQ ID NO: 611462 - RNA, 19 nt, Homo sapiens
caggaaacauccaagaaaa

SEQ ID NO: 611463 - RNA, 19 nt, Homo sapiens
caggacaaugaacuaauua

SEQ ID NO: 611464 - RNA, 19 nt, Homo sapiens
caaagacuuguauuggaaa

SEQ ID NO: 611465 - RNA, 19 nt, Homo sapiens
gcacggaaaccuaaaaugu

SEQ ID NO: 611466 - RNA, 19 nt, Homo sapiens
gucuucauguacuucauua

SEQ ID NO: 611467 - RNA, 19 nt, Homo sapiens
gugauacuucuuacacuaa

SEQ ID NO: 611468 - RNA, 19 nt, Homo sapiens
gcaaauuuacuccaaagac

SEQ ID NO: 611469 - RNA, 19 nt, Homo sapiens
ugaacuaauuacccuggaa

SEQ ID NO: 611470 - RNA, 19 nt, Homo sapiens
ugacuccugagaugaauuu

SEQ ID NO: 611471 - RNA, 19 nt, Homo sapiens
aaucaggcaguauacauuu

SEQ ID NO: 611472 - RNA, 19 nt, Homo sapiens
caauugagcaggcugaucu

SEQ ID NO: 611473 - RNA, 19 nt, Homo sapiens
ggaucaggacaaugaacua

SEQ ID NO: 611474 - RNA, 19 nt, Homo sapiens
gcacugccuaguuaacaga

SEQ ID NO: 611475 - RNA, 19 nt, Homo sapiens
ggguacuuguuaaagcuaa

SEQ ID NO: 611476 - RNA, 19 nt, Homo sapiens
uaucagacaaagagaagaa

SEQ ID NO: 611477 - RNA, 19 nt, Homo sapiens
gauuaagcuuuguugugau

SEQ ID NO: 611478 - RNA, 19 nt, Homo sapiens
caggaauucuucauaacag

SEQ ID NO: 611479 - RNA, 19 nt, Homo sapiens
ccaggaauucuucauaaca

SEQ ID NO: 611480 - RNA, 19 nt, Homo sapiens
gaauggugcagaaagagau

SEQ ID NO: 611481 - RNA, 19 nt, Homo sapiens
ugaugucuugucaguauua

SEQ ID NO: 611482 - RNA, 19 nt, Homo sapiens
ggcagugucugugaacuag

SEQ ID NO: 611483 - RNA, 19 nt, Homo sapiens
ucaucguuauguggaauua

SEQ ID NO: 611484 - RNA, 19 nt, Homo sapiens
aaugguaauuugccaggaa

SEQ ID NO: 611485 - RNA, 19 nt, Homo sapiens
gaaucugggaugagaaaca

SEQ ID NO: 611486 - RNA, 19 nt, Homo sapiens
ggagugauacuucuuacac

SEQ ID NO: 611487 - RNA, 19 nt, Homo sapiens
gcauuucagcauauguaaa

SEQ ID NO: 611488 - RNA, 19 nt, Homo sapiens
gcauuucacacacuguaga

SEQ ID NO: 611489 - RNA, 19 nt, Homo sapiens
uaagcuuuguugugauugu

SEQ ID NO: 611490 - RNA, 19 nt, Homo sapiens
acagcagcuuccuuucuuu

SEQ ID NO: 611491 - RNA, 19 nt, Homo sapiens
aaagaucacaagagaacuu

SEQ ID NO: 611492 - RNA, 19 nt, Homo sapiens
caggcaguauacauuuauu

SEQ ID NO: 611493 - RNA, 19 nt, Homo sapiens
gaaaugcgguccuguuuga

SEQ ID NO: 611494 - RNA, 19 nt, Homo sapiens
gcagugagaccaugaauga

SEQ ID NO: 611495 - RNA, 19 nt, Homo sapiens
caauaaagccugagaagug

SEQ ID NO: 611496 - RNA, 19 nt, Homo sapiens
gcagagagguuugcuccaa

SEQ ID NO: 611497 - RNA, 19 nt, Homo sapiens
gguucuagcugucaacauu

SEQ ID NO: 611498 - RNA, 19 nt, Homo sapiens
ccaacagcaucaagaauga

SEQ ID NO: 611499 - RNA, 19 nt, Homo sapiens
ucagaauccucaauccuaa

SEQ ID NO: 611500 - RNA, 19 nt, Homo sapiens
caaauaaagcccaauaaag

SEQ ID NO: 611501 - RNA, 19 nt, Homo sapiens
gcucagcacucgccucugu

SEQ ID NO: 611502 - RNA, 19 nt, Homo sapiens
ccacaaauaaagcccaaua

SEQ ID NO: 611503 - RNA, 19 nt, Homo sapiens
ggagagcccuggaacuaag

SEQ ID NO: 611504 - RNA, 19 nt, Homo sapiens
ucacccagcucuucagaau

SEQ ID NO: 611505 - RNA, 19 nt, Homo sapiens
guaacugucuccacucaca

SEQ ID NO: 611506 - RNA, 19 nt, Homo sapiens
aauaaagccugagaaguga

SEQ ID NO: 611507 - RNA, 19 nt, Homo sapiens
gaacaacuugccuguggaa

SEQ ID NO: 611508 - RNA, 19 nt, Homo sapiens
aaacccugcuuugcuguua

SEQ ID NO: 611509 - RNA, 19 nt, Homo sapiens
gagcggaguugaggcagaa

SEQ ID NO: 611510 - RNA, 19 nt, Homo sapiens
ggaaaugcgguccuguuug

SEQ ID NO: 611511 - RNA, 19 nt, Homo sapiens
ccucacagcuccuggaucu

SEQ ID NO: 611512 - RNA, 19 nt, Homo sapiens
ggaagcaaaggaaagcaaa

SEQ ID NO: 611513 - RNA, 19 nt, Homo sapiens
gacacacucuuccggaaau

SEQ ID NO: 611514 - RNA, 19 nt, Homo sapiens
ggagcuacaugccuacucu

SEQ ID NO: 611515 - RNA, 19 nt, Homo sapiens
gugcccaacugcuucauga

SEQ ID NO: 611516 - RNA, 19 nt, Homo sapiens
caacuugccuguggaaucg

SEQ ID NO: 611517 - RNA, 19 nt, Homo sapiens
ucccagaucucaaaguguu

SEQ ID NO: 611518 - RNA, 19 nt, Homo sapiens
ucacagcccucaugaagcu

SEQ ID NO: 611519 - RNA, 19 nt, Homo sapiens
gaugcccaccugcucauua

SEQ ID NO: 611520 - RNA, 19 nt, Homo sapiens
caucccagaucucaaagug

SEQ ID NO: 611521 - RNA, 19 nt, Homo sapiens
aaauaaagcccaauaaagc

SEQ ID NO: 611522 - RNA, 19 nt, Homo sapiens
gcaaaggaaagcaaagaag

SEQ ID NO: 611523 - RNA, 19 nt, Homo sapiens
ggaaauacgaccacaugag

SEQ ID NO: 611524 - RNA, 19 nt, Homo sapiens
caugcugucucuccgcuaa

SEQ ID NO: 611525 - RNA, 19 nt, Homo sapiens
aagaggaagugcuggcauu

SEQ ID NO: 611526 - RNA, 19 nt, Homo sapiens
caugggcucugcugagaug

SEQ ID NO: 611527 - RNA, 19 nt, Homo sapiens
gggccaugcuucuauugga

SEQ ID NO: 611528 - RNA, 19 nt, Homo sapiens
ccacucacagccugaaauu

SEQ ID NO: 611529 - RNA, 19 nt, Homo sapiens
gccagccacucgaggauau

SEQ ID NO: 611530 - RNA, 19 nt, Homo sapiens
gugcuggcauugcuggaaa

SEQ ID NO: 611531 - RNA, 19 nt, Homo sapiens
gacaggaacauuagguaug

SEQ ID NO: 611532 - RNA, 19 nt, Homo sapiens
gaacuccaggccuaucaug

SEQ ID NO: 611533 - RNA, 19 nt, Homo sapiens
cagccgaaaugccggaaau

SEQ ID NO: 611534 - RNA, 19 nt, Homo sapiens
ggaccucaucgaagagauu

SEQ ID NO: 611535 - RNA, 19 nt, Homo sapiens
gaugaggaagcaaaggaaa

SEQ ID NO: 611536 - RNA, 19 nt, Homo sapiens
guccugcccuccugaccua

SEQ ID NO: 611537 - RNA, 19 nt, Homo sapiens
gcgauggcuucaaauccaa

SEQ ID NO: 611538 - RNA, 19 nt, Homo sapiens
gugagaccaugaaugacuu

SEQ ID NO: 611539 - RNA, 19 nt, Homo sapiens
gcucuacguccacauguug

SEQ ID NO: 611540 - RNA, 19 nt, Homo sapiens
ucuuugaggugaacaacuu

SEQ ID NO: 611541 - RNA, 19 nt, Homo sapiens
gccaggugguguccaucua

SEQ ID NO: 611542 - RNA, 19 nt, Homo sapiens
ggaacugcgaggagauuga

SEQ ID NO: 611543 - RNA, 19 nt, Homo sapiens
accaaacgcuggcacauag

SEQ ID NO: 611544 - RNA, 19 nt, Homo sapiens
cggaaaugcgguccuguuu

SEQ ID NO: 611545 - RNA, 19 nt, Homo sapiens
gaucgccuccuccagauuc

SEQ ID NO: 611546 - RNA, 19 nt, Homo sapiens
ggcuucaaauccaaacuga

SEQ ID NO: 611547 - RNA, 19 nt, Homo sapiens
gccuggcucugguaaauag

SEQ ID NO: 611548 - RNA, 19 nt, Homo sapiens
ccggagagcccuggaacua

SEQ ID NO: 611549 - RNA, 19 nt, Homo sapiens
aacagugacaggaacauua

SEQ ID NO: 611550 - RNA, 19 nt, Homo sapiens
gggauugucaucuccuuug

SEQ ID NO: 611551 - RNA, 19 nt, Homo sapiens
ucccugaacucuccagugu

SEQ ID NO: 611552 - RNA, 19 nt, Homo sapiens
caaccugacccagcugauu

SEQ ID NO: 611553 - RNA, 19 nt, Homo sapiens
caacagugacaggaacauu

SEQ ID NO: 611554 - RNA, 19 nt, Homo sapiens
cuuggucgcuuccuacuca

SEQ ID NO: 611555 - RNA, 19 nt, Homo sapiens
agacaguacucaccaucau

SEQ ID NO: 611556 - RNA, 19 nt, Homo sapiens
ccacagaacacagcauauc

SEQ ID NO: 611557 - RNA, 19 nt, Homo sapiens
ccugaacucuccagugucu

SEQ ID NO: 611558 - RNA, 19 nt, Homo sapiens
cacaaauaaagcccaauaa

SEQ ID NO: 611559 - RNA, 19 nt, Homo sapiens
gugcugcagucccacaugu

SEQ ID NO: 611560 - RNA, 19 nt, Homo sapiens
guggcagccuggugcauug

SEQ ID NO: 611561 - RNA, 19 nt, Homo sapiens
ggugcagucugaucacagu

SEQ ID NO: 611562 - RNA, 19 nt, Homo sapiens
cccagcagcuucgaaccua

SEQ ID NO: 611563 - RNA, 19 nt, Homo sapiens
acacacucuuccggaaaua

SEQ ID NO: 611564 - RNA, 19 nt, Homo sapiens
ggccaugcuucuauuggau

SEQ ID NO: 611565 - RNA, 19 nt, Homo sapiens
uucaggaccucaucgaaga

SEQ ID NO: 611566 - RNA, 19 nt, Homo sapiens
acagauggagugccugaaa

SEQ ID NO: 611567 - RNA, 19 nt, Homo sapiens
ggauugucaucuccuuugg

SEQ ID NO: 611568 - RNA, 19 nt, Homo sapiens
ggagaucuuugaggugaac

SEQ ID NO: 611569 - RNA, 19 nt, Homo sapiens
ccucacagcccucaugaag

SEQ ID NO: 611570 - RNA, 19 nt, Homo sapiens
agaagacauuucccagcaa

SEQ ID NO: 611571 - RNA, 19 nt, Homo sapiens
ugacaggaacauuagguau

SEQ ID NO: 611572 - RNA, 19 nt, Homo sapiens
gagacaguacucaccauca

SEQ ID NO: 611573 - RNA, 19 nt, Homo sapiens
gaagaacuccaggccuauc

SEQ ID NO: 611574 - RNA, 19 nt, Homo sapiens
ugacacacucuuccggaaa

SEQ ID NO: 611575 - RNA, 19 nt, Homo sapiens
uaaagcugcgccucaccua

SEQ ID NO: 611576 - RNA, 19 nt, Homo sapiens
ggcccgaggucagaggauu

SEQ ID NO: 611577 - RNA, 19 nt, Homo sapiens
ucagguggacgaagaggaa

SEQ ID NO: 611578 - RNA, 19 nt, Homo sapiens
gagcgggaggugauccaaa

SEQ ID NO: 611579 - RNA, 19 nt, Homo sapiens
gagagcagugagaccauga

SEQ ID NO: 611580 - RNA, 19 nt, Homo sapiens
ggcagaagccagucaggau

SEQ ID NO: 611581 - RNA, 19 nt, Homo sapiens
ccaugcuucuauuggauga

SEQ ID NO: 611582 - RNA, 19 nt, Homo sapiens
ccucaccuacgaccacuuu

SEQ ID NO: 611583 - RNA, 19 nt, Homo sapiens
gcuugaccuucccugugua

SEQ ID NO: 611584 - RNA, 19 nt, Homo sapiens
gaagcaaaggaaagcaaag

SEQ ID NO: 611585 - RNA, 19 nt, Homo sapiens
gaacugcgaggagauugag

SEQ ID NO: 611586 - RNA, 19 nt, Homo sapiens
gugacaggaacauuaggua

SEQ ID NO: 611587 - RNA, 19 nt, Homo sapiens
gcacuuccgaaagguggua

SEQ ID NO: 611588 - RNA, 19 nt, Homo sapiens
ccaauaaagccugagaagu

SEQ ID NO: 611589 - RNA, 19 nt, Homo sapiens
cagauggagugccugaaac

SEQ ID NO: 611590 - RNA, 19 nt, Homo sapiens
gcagaggagcggaguugag

SEQ ID NO: 611591 - RNA, 19 nt, Homo sapiens
ccggaaauacgaccacaug

SEQ ID NO: 611592 - RNA, 19 nt, Homo sapiens
uagacaccauccugcaugu

SEQ ID NO: 611593 - RNA, 19 nt, Homo sapiens
gaaaugcgguccuguuuga

SEQ ID NO: 611594 - RNA, 19 nt, Homo sapiens
ggaggaagcucgcggaaga

SEQ ID NO: 611595 - RNA, 19 nt, Homo sapiens
gcagugagaccaugaauga

SEQ ID NO: 611596 - RNA, 19 nt, Homo sapiens
caauaaagccugagaagug

SEQ ID NO: 611597 - RNA, 19 nt, Homo sapiens
gcagagagguuugcuccaa

SEQ ID NO: 611598 - RNA, 19 nt, Homo sapiens
gguucuagcugucaacauu

SEQ ID NO: 611599 - RNA, 19 nt, Homo sapiens
ccaacagcaucaagaauga

SEQ ID NO: 611600 - RNA, 19 nt, Homo sapiens
ucagaauccucaauccuaa

SEQ ID NO: 611601 - RNA, 19 nt, Homo sapiens
gaaacgguagagagaaaua

SEQ ID NO: 611602 - RNA, 19 nt, Homo sapiens
caaauaaagcccaauaaag

SEQ ID NO: 611603 - RNA, 19 nt, Homo sapiens
gcucagcacucgccucugu

SEQ ID NO: 611604 - RNA, 19 nt, Homo sapiens
ccacaaauaaagcccaaua

SEQ ID NO: 611605 - RNA, 19 nt, Homo sapiens
ggagagcccuggaacuaag

SEQ ID NO: 611606 - RNA, 19 nt, Homo sapiens
ucacccagcucuucagaau

SEQ ID NO: 611607 - RNA, 19 nt, Homo sapiens
ggaggaaacgguagagaga

SEQ ID NO: 611608 - RNA, 19 nt, Homo sapiens
guaacugucuccacucaca

SEQ ID NO: 611609 - RNA, 19 nt, Homo sapiens
aauaaagccugagaaguga

SEQ ID NO: 611610 - RNA, 19 nt, Homo sapiens
gaacaacuugccuguggaa

SEQ ID NO: 611611 - RNA, 19 nt, Homo sapiens
aaacccugcuuugcuguua

SEQ ID NO: 611612 - RNA, 19 nt, Homo sapiens
gagcggaguugaggcagaa

SEQ ID NO: 611613 - RNA, 19 nt, Homo sapiens
ggaaaugcgguccuguuug

SEQ ID NO: 611614 - RNA, 19 nt, Homo sapiens
gaagcucgcggaagaaaca

SEQ ID NO: 611615 - RNA, 19 nt, Homo sapiens
ccucacagcuccuggaucu

SEQ ID NO: 611616 - RNA, 19 nt, Homo sapiens
ggaagcaaaggaaagcaaa

SEQ ID NO: 611617 - RNA, 19 nt, Homo sapiens
gacacacucuuccggaaau

SEQ ID NO: 611618 - RNA, 19 nt, Homo sapiens
ggagcuacaugccuacucu

SEQ ID NO: 611619 - RNA, 19 nt, Homo sapiens
gugcccaacugcuucauga

SEQ ID NO: 611620 - RNA, 19 nt, Homo sapiens
caacuugccuguggaaucg

SEQ ID NO: 611621 - RNA, 19 nt, Homo sapiens
ucccagaucucaaaguguu

SEQ ID NO: 611622 - RNA, 19 nt, Homo sapiens
ucacagcccucaugaagcu

SEQ ID NO: 611623 - RNA, 19 nt, Homo sapiens
gaugcccaccugcucauua

SEQ ID NO: 611624 - RNA, 19 nt, Homo sapiens
caucccagaucucaaagug

SEQ ID NO: 611625 - RNA, 19 nt, Homo sapiens
aaauaaagcccaauaaagc

SEQ ID NO: 611626 - RNA, 19 nt, Homo sapiens
caugcugucucuccgcuaa

SEQ ID NO: 611627 - RNA, 19 nt, Homo sapiens
gcaaaggaaagcaaagaag

SEQ ID NO: 611628 - RNA, 19 nt, Homo sapiens
ggaaauacgaccacaugag

SEQ ID NO: 611629 - RNA, 19 nt, Homo sapiens
aagaggaagugcuggcauu

SEQ ID NO: 611630 - RNA, 19 nt, Homo sapiens
caugggcucugcugagaug

SEQ ID NO: 611631 - RNA, 19 nt, Homo sapiens
gggccaugcuucuauugga

SEQ ID NO: 611632 - RNA, 19 nt, Homo sapiens
aggaaacgguagagagaaa

SEQ ID NO: 611633 - RNA, 19 nt, Homo sapiens
ccacucacagccugaaauu

SEQ ID NO: 611634 - RNA, 19 nt, Homo sapiens
gccagccacucgaggauau

SEQ ID NO: 611635 - RNA, 19 nt, Homo sapiens
gugcuggcauugcuggaaa

SEQ ID NO: 611636 - RNA, 19 nt, Homo sapiens
gacaggaacauuagguaug

SEQ ID NO: 611637 - RNA, 19 nt, Homo sapiens
gaacuccaggccuaucaug

SEQ ID NO: 611638 - RNA, 19 nt, Homo sapiens
cagccgaaaugccggaaau

SEQ ID NO: 611639 - RNA, 19 nt, Homo sapiens
ggaccucaucgaagagauu

SEQ ID NO: 611640 - RNA, 19 nt, Homo sapiens
gaugaggaagcaaaggaaa

SEQ ID NO: 611641 - RNA, 19 nt, Homo sapiens
gcgauggcuucaaauccaa

SEQ ID NO: 611642 - RNA, 19 nt, Homo sapiens
guccugcccuccugaccua

SEQ ID NO: 611643 - RNA, 19 nt, Homo sapiens
gugagaccaugaaugacuu

SEQ ID NO: 611644 - RNA, 19 nt, Homo sapiens
gcucuacguccacauguug

SEQ ID NO: 611645 - RNA, 19 nt, Homo sapiens
ucuuugaggugaacaacuu

SEQ ID NO: 611646 - RNA, 19 nt, Homo sapiens
gccaggugguguccaucua

SEQ ID NO: 611647 - RNA, 19 nt, Homo sapiens
ggaacugcgaggagauuga

SEQ ID NO: 611648 - RNA, 19 nt, Homo sapiens
accaaacgcuggcacauag

SEQ ID NO: 611649 - RNA, 19 nt, Homo sapiens
cggaaaugcgguccuguuu

SEQ ID NO: 611650 - RNA, 19 nt, Homo sapiens
gaucgccuccuccagauuc

SEQ ID NO: 611651 - RNA, 19 nt, Homo sapiens
ggagacccacuucgggaaa

SEQ ID NO: 611652 - RNA, 19 nt, Homo sapiens
ggcuucaaauccaaacuga

SEQ ID NO: 611653 - RNA, 19 nt, Homo sapiens
gccuggcucugguaaauag

SEQ ID NO: 611654 - RNA, 19 nt, Homo sapiens
ccggagagcccuggaacua

SEQ ID NO: 611655 - RNA, 19 nt, Homo sapiens
aacagugacaggaacauua

SEQ ID NO: 611656 - RNA, 19 nt, Homo sapiens
ucccugaacucuccagugu

SEQ ID NO: 611657 - RNA, 19 nt, Homo sapiens
gggauugucaucuccuuug

SEQ ID NO: 611658 - RNA, 19 nt, Homo sapiens
caaccugacccagcugauu

SEQ ID NO: 611659 - RNA, 19 nt, Homo sapiens
caacagugacaggaacauu

SEQ ID NO: 611660 - RNA, 19 nt, Homo sapiens
cuuggucgcuuccuacuca

SEQ ID NO: 611661 - RNA, 19 nt, Homo sapiens
agacaguacucaccaucau

SEQ ID NO: 611662 - RNA, 19 nt, Homo sapiens
ccacagaacacagcauauc

SEQ ID NO: 611663 - RNA, 19 nt, Homo sapiens
gggaugggguaccagguua

SEQ ID NO: 611664 - RNA, 19 nt, Homo sapiens
ccugaacucuccagugucu

SEQ ID NO: 611665 - RNA, 19 nt, Homo sapiens
cacaaauaaagcccaauaa

SEQ ID NO: 611666 - RNA, 19 nt, Homo sapiens
gugcugcagucccacaugu

SEQ ID NO: 611667 - RNA, 19 nt, Homo sapiens
guggcagccuggugcauug

SEQ ID NO: 611668 - RNA, 19 nt, Homo sapiens
ggugcagucugaucacagu

SEQ ID NO: 611669 - RNA, 19 nt, Homo sapiens
gaauuuggagacccacuuc

SEQ ID NO: 611670 - RNA, 19 nt, Homo sapiens
ggaauuuggagacccacuu

SEQ ID NO: 611671 - RNA, 19 nt, Homo sapiens
cccagcagcuucgaaccua

SEQ ID NO: 611672 - RNA, 19 nt, Homo sapiens
acacacucuuccggaaaua

SEQ ID NO: 611673 - RNA, 19 nt, Homo sapiens
ggccaugcuucuauuggau

SEQ ID NO: 611674 - RNA, 19 nt, Homo sapiens
acagauggagugccugaaa

SEQ ID NO: 611675 - RNA, 19 nt, Homo sapiens
uucaggaccucaucgaaga

SEQ ID NO: 611676 - RNA, 19 nt, Homo sapiens
gaggaaacgguagagagaa

SEQ ID NO: 611677 - RNA, 19 nt, Homo sapiens
ggagaucuuugaggugaac

SEQ ID NO: 611678 - RNA, 19 nt, Homo sapiens
ccucacagcccucaugaag

SEQ ID NO: 611679 - RNA, 19 nt, Homo sapiens
agaagacauuucccagcaa

SEQ ID NO: 611680 - RNA, 19 nt, Homo sapiens
ugacaggaacauuagguau

SEQ ID NO: 611681 - RNA, 19 nt, Homo sapiens
gagacaguacucaccauca

SEQ ID NO: 611682 - RNA, 19 nt, Homo sapiens
ggauugucaucuccuuugg

SEQ ID NO: 611683 - RNA, 19 nt, Homo sapiens
cagcggaggguucguggaa

SEQ ID NO: 611684 - RNA, 19 nt, Homo sapiens
gaagaacuccaggccuauc

SEQ ID NO: 611685 - RNA, 19 nt, Homo sapiens
ugacacacucuuccggaaa

SEQ ID NO: 611686 - RNA, 19 nt, Homo sapiens
uaaagcugcgccucaccua

SEQ ID NO: 611687 - RNA, 19 nt, Homo sapiens
ggcccgaggucagaggauu

SEQ ID NO: 611688 - RNA, 19 nt, Homo sapiens
ucagguggacgaagaggaa

SEQ ID NO: 611689 - RNA, 19 nt, Homo sapiens
gagagcagugagaccauga

SEQ ID NO: 611690 - RNA, 19 nt, Homo sapiens
gagcgggaggugauccaaa

SEQ ID NO: 611691 - RNA, 19 nt, Homo sapiens
ccacuucgggaaagguaaa

SEQ ID NO: 611692 - RNA, 19 nt, Homo sapiens
ccaugcuucuauuggauga

SEQ ID NO: 611693 - RNA, 19 nt, Homo sapiens
gaacuugucuuugugcauu

SEQ ID NO: 611694 - RNA, 19 nt, Homo sapiens
ucaaguaucggaagaauga

SEQ ID NO: 611695 - RNA, 19 nt, Homo sapiens
gaagaucauugagaagagu

SEQ ID NO: 611696 - RNA, 19 nt, Homo sapiens
gagcauccgggacaacuuu

SEQ ID NO: 611697 - RNA, 19 nt, Homo sapiens
ucacucagccagaucagua

SEQ ID NO: 611698 - RNA, 19 nt, Homo sapiens
caacgacaagguccucuuu

SEQ ID NO: 611699 - RNA, 19 nt, Homo sapiens
cgagaucccuuacuucacu

SEQ ID NO: 611700 - RNA, 19 nt, Homo sapiens
ugucagagguggagcacuu

SEQ ID NO: 611701 - RNA, 19 nt, Homo sapiens
gagaucgugugguccauca

SEQ ID NO: 611702 - RNA, 19 nt, Homo sapiens
gagaaugaccgcaccaucu

SEQ ID NO: 611703 - RNA, 19 nt, Homo sapiens
uaucacgcuucgagaauga

SEQ ID NO: 611704 - RNA, 19 nt, Homo sapiens
gagagacgccagccucaga

SEQ ID NO: 611705 - RNA, 19 nt, Homo sapiens
cgucgacacucgucucaga

SEQ ID NO: 611706 - RNA, 19 nt, Homo sapiens
ucacgcagaauggagauua

SEQ ID NO: 611707 - RNA, 19 nt, Homo sapiens
gacaagguccucuuugaca

SEQ ID NO: 611708 - RNA, 19 nt, Homo sapiens
caucaaguaucggaagaau

SEQ ID NO: 611709 - RNA, 19 nt, Homo sapiens
gacgccagccucagacuuu

SEQ ID NO: 611710 - RNA, 19 nt, Homo sapiens
guugaacguuauggguuua

SEQ ID NO: 611711 - RNA, 19 nt, Homo sapiens
gcccaaugaugccgacuca

SEQ ID NO: 611712 - RNA, 19 nt, Homo sapiens
acgacaagguccucuuuga

SEQ ID NO: 611713 - RNA, 19 nt, Homo sapiens
uggacgagcucauggacuu

SEQ ID NO: 611714 - RNA, 19 nt, Homo sapiens
caacuuuguuaucaucuac

SEQ ID NO: 611715 - RNA, 19 nt, Homo sapiens
ggggaaggaugugaaauuu

SEQ ID NO: 611716 - RNA, 19 nt, Homo sapiens
gguccgaaggcaucaagua

SEQ ID NO: 611717 - RNA, 19 nt, Homo sapiens
gagaucccuuacuucacua

SEQ ID NO: 611718 - RNA, 19 nt, Homo sapiens
acaagguccucuuugacaa

SEQ ID NO: 611719 - RNA, 19 nt, Homo sapiens
ucaaacacaacaaccugua

SEQ ID NO: 611720 - RNA, 19 nt, Homo sapiens
gugcauucguugcuguuug

SEQ ID NO: 611721 - RNA, 19 nt, Homo sapiens
ccguggagcuggaggaugu

SEQ ID NO: 611722 - RNA, 19 nt, Homo sapiens
acacccacgucaagccuuu

SEQ ID NO: 611723 - RNA, 19 nt, Homo sapiens
gcuggaggaugugaaguuc

SEQ ID NO: 611724 - RNA, 19 nt, Homo sapiens
ucagccagaucaguauuga

SEQ ID NO: 611725 - RNA, 19 nt, Homo sapiens
cagccugggucacgagaug

SEQ ID NO: 611726 - RNA, 19 nt, Homo sapiens
uguugaacguuauggguuu

SEQ ID NO: 611727 - RNA, 19 nt, Homo sapiens
gaucgugggcuccaucaag

SEQ ID NO: 611728 - RNA, 19 nt, Homo sapiens
gacgagcccucacccuucu

SEQ ID NO: 611729 - RNA, 19 nt, Homo sapiens
caaacacaacaaccuguau

SEQ ID NO: 611730 - RNA, 19 nt, Homo sapiens
ggcaucaaguaucggaaga

SEQ ID NO: 611731 - RNA, 19 nt, Homo sapiens
ugaagaucauugagaagag

SEQ ID NO: 611732 - RNA, 19 nt, Homo sapiens
ggucagcgccaacggcaau

SEQ ID NO: 611733 - RNA, 19 nt, Homo sapiens
gaaggccacaagcuggaaa

SEQ ID NO: 611734 - RNA, 19 nt, Homo sapiens
gaacguuauggguuuaugg

SEQ ID NO: 611735 - RNA, 19 nt, Homo sapiens
gcuguugagcucccaggua

SEQ ID NO: 611736 - RNA, 19 nt, Homo sapiens
aguucgagcucauguccua

SEQ ID NO: 611737 - RNA, 19 nt, Homo sapiens
ccgaaggcaucaaguaucg

SEQ ID NO: 611738 - RNA, 19 nt, Homo sapiens
ggucuuuucuuuccucuau

SEQ ID NO: 611739 - RNA, 19 nt, Homo sapiens
ucaaguucgagaucccuua

SEQ ID NO: 611740 - RNA, 19 nt, Homo sapiens
gcuaucacgcuucgagaau

SEQ ID NO: 611741 - RNA, 19 nt, Homo sapiens
gugcucaucugccggaacu

SEQ ID NO: 611742 - RNA, 19 nt, Homo sapiens
cuacggcacucaggaagca

SEQ ID NO: 611743 - RNA, 19 nt, Homo sapiens
gaugccgacucacccaagu

SEQ ID NO: 611744 - RNA, 19 nt, Homo sapiens
gcaggggcgucguuuuguu

SEQ ID NO: 611745 - RNA, 19 nt, Homo sapiens
gccauuuuguugaacguua

SEQ ID NO: 611746 - RNA, 19 nt, Homo sapiens
guugccacauccaagaaga

SEQ ID NO: 611747 - RNA, 19 nt, Homo sapiens
cccgaucagugucaaguuc

SEQ ID NO: 611748 - RNA, 19 nt, Homo sapiens
guccgaaggcaucaaguau

SEQ ID NO: 611749 - RNA, 19 nt, Homo sapiens
ccucacccuucuugucuuc

SEQ ID NO: 611750 - RNA, 19 nt, Homo sapiens
aaacacaacaaccuguauc

SEQ ID NO: 611751 - RNA, 19 nt, Homo sapiens
ccuggaacuugucuuugug

SEQ ID NO: 611752 - RNA, 19 nt, Homo sapiens
cguuauaucacgcagaaug

SEQ ID NO: 611753 - RNA, 19 nt, Homo sapiens
cacgagaugcugucacuca

SEQ ID NO: 611754 - RNA, 19 nt, Homo sapiens
uccuggaacuugucuuugu

SEQ ID NO: 611755 - RNA, 19 nt, Homo sapiens
accugaagaucauugagaa

SEQ ID NO: 611756 - RNA, 19 nt, Homo sapiens
cuaucacgcuucgagaaug

SEQ ID NO: 611757 - RNA, 19 nt, Homo sapiens
ggaaggccacaagcuggaa

SEQ ID NO: 611758 - RNA, 19 nt, Homo sapiens
gccaaacccaccagaugga

SEQ ID NO: 611759 - RNA, 19 nt, Homo sapiens
auaagguggugcagguguu

SEQ ID NO: 611760 - RNA, 19 nt, Homo sapiens
cggcaaggaguaccugaug

SEQ ID NO: 611761 - RNA, 19 nt, Homo sapiens
ggucaacagccaacaacgu

SEQ ID NO: 611762 - RNA, 19 nt, Homo sapiens
auucguugcuguuuguguu

SEQ ID NO: 611763 - RNA, 19 nt, Homo sapiens
uaagguggugcagguguuu

SEQ ID NO: 611764 - RNA, 19 nt, Homo sapiens
cugaagaucauugagaaga

SEQ ID NO: 611765 - RNA, 19 nt, Homo sapiens
gaucgugugguccaucaag

SEQ ID NO: 611766 - RNA, 19 nt, Homo sapiens
gcaucgaguacaugaucaa

SEQ ID NO: 611767 - RNA, 19 nt, Homo sapiens
gccugggccucaacgacaa

SEQ ID NO: 611768 - RNA, 19 nt, Homo sapiens
gcaucaaguaucggaagaa

SEQ ID NO: 611769 - RNA, 19 nt, Homo sapiens
ugcauucguugcuguuugu

SEQ ID NO: 611770 - RNA, 19 nt, Homo sapiens
guacaugaucaaggccaaa

SEQ ID NO: 611771 - RNA, 19 nt, Homo sapiens
gaccgcaccaucuccuuca

SEQ ID NO: 611772 - RNA, 19 nt, Homo sapiens
ucuacgugcuggaccugaa

SEQ ID NO: 611773 - RNA, 19 nt, Homo sapiens
gaccaaggcuuacugaaua

SEQ ID NO: 611774 - RNA, 19 nt, Homo sapiens
guaacacgauguacacuua

SEQ ID NO: 611775 - RNA, 19 nt, Homo sapiens
gaaccugccugaauuuaug

SEQ ID NO: 611776 - RNA, 19 nt, Homo sapiens
caaauaaagucgaaagugu

SEQ ID NO: 611777 - RNA, 19 nt, Homo sapiens
gaagcuaacaacacuaaua

SEQ ID NO: 611778 - RNA, 19 nt, Homo sapiens
guauagaaauccaccuuaa

SEQ ID NO: 611779 - RNA, 19 nt, Homo sapiens
ucaccaagcuucacuguug

SEQ ID NO: 611780 - RNA, 19 nt, Homo sapiens
ggagaggcguggccacuuu

SEQ ID NO: 611781 - RNA, 19 nt, Homo sapiens
gaagugaaucuaaucgaua

SEQ ID NO: 611782 - RNA, 19 nt, Homo sapiens
uaugauagcuuguccugaa

SEQ ID NO: 611783 - RNA, 19 nt, Homo sapiens
gggcgaugcucguaggaua

SEQ ID NO: 611784 - RNA, 19 nt, Homo sapiens
cgagaaagccucauuguca

SEQ ID NO: 611785 - RNA, 19 nt, Homo sapiens
cgaggaagcuggugguguu

SEQ ID NO: 611786 - RNA, 19 nt, Homo sapiens
ugaaauguuuggaagguuu

SEQ ID NO: 611787 - RNA, 19 nt, Homo sapiens
aagagaaggugaaggaauu

SEQ ID NO: 611788 - RNA, 19 nt, Homo sapiens
ccaaagugcuggaaugaca

SEQ ID NO: 611789 - RNA, 19 nt, Homo sapiens
gaauuaaaccucacugcaa

SEQ ID NO: 611790 - RNA, 19 nt, Homo sapiens
ccacagacauccacaagca

SEQ ID NO: 611791 - RNA, 19 nt, Homo sapiens
agaggaaccugccugaauu

SEQ ID NO: 611792 - RNA, 19 nt, Homo sapiens
gaucuaaaccgauucacuu

SEQ ID NO: 611793 - RNA, 19 nt, Homo sapiens
gaggaaaccuucgaaccaa

SEQ ID NO: 611794 - RNA, 19 nt, Homo sapiens
cuaccucaguucucaauaa

SEQ ID NO: 611795 - RNA, 19 nt, Homo sapiens
ggacgccguucagaagaua

SEQ ID NO: 611796 - RNA, 19 nt, Homo sapiens
gcuguggucucucugcuuu

SEQ ID NO: 611797 - RNA, 19 nt, Homo sapiens
ucaaagccauuuccacuca

SEQ ID NO: 611798 - RNA, 19 nt, Homo sapiens
gagcaguaauaacauucua

SEQ ID NO: 611799 - RNA, 19 nt, Homo sapiens
gugcaaaggucguccacuu

SEQ ID NO: 611800 - RNA, 19 nt, Homo sapiens
gaaauguuuggaagguuua

SEQ ID NO: 611801 - RNA, 19 nt, Homo sapiens
gaauguggguggcuuagag

SEQ ID NO: 611802 - RNA, 19 nt, Homo sapiens
aaaccucacugcaaauuuc

SEQ ID NO: 611803 - RNA, 19 nt, Homo sapiens
caaugucgaugagcuguuu

SEQ ID NO: 611804 - RNA, 19 nt, Homo sapiens
gugccucuauuuaugcuua

SEQ ID NO: 611805 - RNA, 19 nt, Homo sapiens
gaaggacgccguucagaag

SEQ ID NO: 611806 - RNA, 19 nt, Homo sapiens
gacacaggcugacgaggaa

SEQ ID NO: 611807 - RNA, 19 nt, Homo sapiens
gaagagaaggugaaggaau

SEQ ID NO: 611808 - RNA, 19 nt, Homo sapiens
aauuaaaccucacugcaaa

SEQ ID NO: 611809 - RNA, 19 nt, Homo sapiens
gcaaauaaagucgaaagug

SEQ ID NO: 611810 - RNA, 19 nt, Homo sapiens
gcucuuggcuuggucucua

SEQ ID NO: 611811 - RNA, 19 nt, Homo sapiens
ucacgaagcuaacaacacu

SEQ ID NO: 611812 - RNA, 19 nt, Homo sapiens
ccgaaggaccucugaagua

SEQ ID NO: 611813 - RNA, 19 nt, Homo sapiens
gaaccuugugccucuauuu

SEQ ID NO: 611814 - RNA, 19 nt, Homo sapiens
gggaaacgcuguugaaccu

SEQ ID NO: 611815 - RNA, 19 nt, Homo sapiens
gaucuccucugguccuuuc

SEQ ID NO: 611816 - RNA, 19 nt, Homo sapiens
ugagacuccugccgugaua

SEQ ID NO: 611817 - RNA, 19 nt, Homo sapiens
gcucucugcuugacaacaa

SEQ ID NO: 611818 - RNA, 19 nt, Homo sapiens
gaggauaacaggaucuaga

SEQ ID NO: 611819 - RNA, 19 nt, Homo sapiens
caacgagggcuugcucuaa

SEQ ID NO: 611820 - RNA, 19 nt, Homo sapiens
gcagagaguaaauuagaga

SEQ ID NO: 611821 - RNA, 19 nt, Homo sapiens
ugacugacuuucauuugga

SEQ ID NO: 611822 - RNA, 19 nt, Homo sapiens
cgaaggaccucugaaguac

SEQ ID NO: 611823 - RNA, 19 nt, Homo sapiens
cgacccagauaguggauga

SEQ ID NO: 611824 - RNA, 19 nt, Homo sapiens
ccgugugggugguuaauaa

SEQ ID NO: 611825 - RNA, 19 nt, Homo sapiens
gcuaacaacacuaauauac

SEQ ID NO: 611826 - RNA, 19 nt, Homo sapiens
gguggacggucuaccagaa

SEQ ID NO: 611827 - RNA, 19 nt, Homo sapiens
caaguacaauccacagagu

SEQ ID NO: 611828 - RNA, 19 nt, Homo sapiens
guuggacucucacucacua

SEQ ID NO: 611829 - RNA, 19 nt, Homo sapiens
gaugcucucugcuugacaa

SEQ ID NO: 611830 - RNA, 19 nt, Homo sapiens
ugugagaccuacccuauuc

SEQ ID NO: 611831 - RNA, 19 nt, Homo sapiens
ccuugaagcugucggcaaa

SEQ ID NO: 611832 - RNA, 19 nt, Homo sapiens
ugaagugaaucuaaucgau

SEQ ID NO: 611833 - RNA, 19 nt, Homo sapiens
gaaacaaugucagcuucuc

SEQ ID NO: 611834 - RNA, 19 nt, Homo sapiens
gagacgggaaacuuuauuu

SEQ ID NO: 611835 - RNA, 19 nt, Homo sapiens
gcaaaagcgagcaguaaua

SEQ ID NO: 611836 - RNA, 19 nt, Homo sapiens
gcaguuuagccuuuggaua

SEQ ID NO: 611837 - RNA, 19 nt, Homo sapiens
caugaaaccuuggaacuac

SEQ ID NO: 611838 - RNA, 19 nt, Homo sapiens
caccugccguucaucuaua

SEQ ID NO: 611839 - RNA, 19 nt, Homo sapiens
ggaaccugccugaauuuau

SEQ ID NO: 611840 - RNA, 19 nt, Homo sapiens
cugaagcaguuuagccuuu

SEQ ID NO: 611841 - RNA, 19 nt, Homo sapiens
guaaauuagagacgggaua

SEQ ID NO: 611842 - RNA, 19 nt, Homo sapiens
uaugagacgggaaacuuua

SEQ ID NO: 611843 - RNA, 19 nt, Homo sapiens
ccuagagcguugacagaaa

SEQ ID NO: 611844 - RNA, 19 nt, Homo sapiens
ggaaggccguaucgacuac

SEQ ID NO: 611845 - RNA, 19 nt, Homo sapiens
gcaccugccguucaucuau

SEQ ID NO: 611846 - RNA, 19 nt, Homo sapiens
caccuggccuuucugaaga

SEQ ID NO: 611847 - RNA, 19 nt, Homo sapiens
ugaagucauugaagugaau

SEQ ID NO: 611848 - RNA, 19 nt, Homo sapiens
gaggaaccugccugaauuu

SEQ ID NO: 611849 - RNA, 19 nt, Homo sapiens
ggaagcuggugguguugau

SEQ ID NO: 611850 - RNA, 19 nt, Homo sapiens
cuagagcguugacagaaau

SEQ ID NO: 611851 - RNA, 19 nt, Homo sapiens
ggauucagccucugguguu

SEQ ID NO: 611852 - RNA, 19 nt, Homo sapiens
uuacagcccugccuucaag

SEQ ID NO: 611853 - RNA, 19 nt, Homo sapiens
aacgagggcuugcucuaaa

SEQ ID NO: 611854 - RNA, 19 nt, Homo sapiens
ucacagagacugaaaccau

SEQ ID NO: 611855 - RNA, 19 nt, Homo sapiens
cuccugaggucaagcaauu

SEQ ID NO: 611856 - RNA, 19 nt, Homo sapiens
aagcagagaguaaauuaga

SEQ ID NO: 611857 - RNA, 19 nt, Homo sapiens
caccgagagugucguuaaa

SEQ ID NO: 611858 - RNA, 19 nt, Homo sapiens
ccaccgagagugucguuaa

SEQ ID NO: 611859 - RNA, 19 nt, Homo sapiens
gaaagccucauugucagaa

SEQ ID NO: 611860 - RNA, 19 nt, Homo sapiens
gaccuggccgucucuguuu

SEQ ID NO: 611861 - RNA, 19 nt, Homo sapiens
uagcuuguccugaaacuga

SEQ ID NO: 611862 - RNA, 19 nt, Homo sapiens
cuguguaucucaccaggua

SEQ ID NO: 611863 - RNA, 19 nt, Homo sapiens
ggucacuucuacccuugaa

SEQ ID NO: 611864 - RNA, 19 nt, Homo sapiens
ggagaccacgggaauguuc

SEQ ID NO: 611865 - RNA, 19 nt, Homo sapiens
caguuuagccuuuggauag

SEQ ID NO: 611866 - RNA, 19 nt, Homo sapiens
agaccuacccuauucagaa

SEQ ID NO: 611867 - RNA, 19 nt, Homo sapiens
gcugugagaccuacccuau

SEQ ID NO: 611868 - RNA, 19 nt, Homo sapiens
aaagcgagcaguaauaaca

SEQ ID NO: 611869 - RNA, 19 nt, Homo sapiens
gaagauaugauagcuuguc

SEQ ID NO: 611870 - RNA, 19 nt, Homo sapiens
ggagagccgugugaaaauu

SEQ ID NO: 611871 - RNA, 19 nt, Homo sapiens
ccaugaaaccuuggaacua

SEQ ID NO: 611872 - RNA, 19 nt, Homo sapiens
guucaucuauaacuugagu

SEQ ID NO: 611873 - RNA, 19 nt, Homo sapiens
caaagccacucuucacuua

SEQ ID NO: 611874 - RNA, 19 nt, Homo sapiens
ugaaagaguucuccucaua

SEQ ID NO: 611875 - RNA, 19 nt, Homo sapiens
gaauaaggcucgucugaga

SEQ ID NO: 611876 - RNA, 19 nt, Homo sapiens
gaagacaucguucucaaua

SEQ ID NO: 611877 - RNA, 19 nt, Homo sapiens
gauaaacagucaaaccuuu

SEQ ID NO: 611878 - RNA, 19 nt, Homo sapiens
gaagaacagcugauagaaa

SEQ ID NO: 611879 - RNA, 19 nt, Homo sapiens
gaacuaugguuuagaaggu

SEQ ID NO: 611880 - RNA, 19 nt, Homo sapiens
gaagugggcucugcuuuca

SEQ ID NO: 611881 - RNA, 19 nt, Homo sapiens
ccacagcagugaugccaua

SEQ ID NO: 611882 - RNA, 19 nt, Homo sapiens
caacaaagcccagaaggaa

SEQ ID NO: 611883 - RNA, 19 nt, Homo sapiens
ucacuuaugucaaugagaa

SEQ ID NO: 611884 - RNA, 19 nt, Homo sapiens
cauagugucuuccaccuaa

SEQ ID NO: 611885 - RNA, 19 nt, Homo sapiens
gaagaagaaggaacccaua

SEQ ID NO: 611886 - RNA, 19 nt, Homo sapiens
gaacuccaaugcugaaugg

SEQ ID NO: 611887 - RNA, 19 nt, Homo sapiens
aagaacagcugauagaaau

SEQ ID NO: 611888 - RNA, 19 nt, Homo sapiens
aggaucagcuugaggaaua

SEQ ID NO: 611889 - RNA, 19 nt, Homo sapiens
gcagugaugccauaacaaa

SEQ ID NO: 611890 - RNA, 19 nt, Homo sapiens
gaaguaaggccacaguaau

SEQ ID NO: 611891 - RNA, 19 nt, Homo sapiens
caccaaaucucaaagcaau

SEQ ID NO: 611892 - RNA, 19 nt, Homo sapiens
gaagacagcagucaugaag

SEQ ID NO: 611893 - RNA, 19 nt, Homo sapiens
ggacucgaguggcuuugaa

SEQ ID NO: 611894 - RNA, 19 nt, Homo sapiens
gguucaaguuuccaauuaa

SEQ ID NO: 611895 - RNA, 19 nt, Homo sapiens
gaacagcugauagaaauuc

SEQ ID NO: 611896 - RNA, 19 nt, Homo sapiens
ggaaagagauaaaauguac

SEQ ID NO: 611897 - RNA, 19 nt, Homo sapiens
cacaaguccuggugucuuu

SEQ ID NO: 611898 - RNA, 19 nt, Homo sapiens
agacuguaguucccuauuu

SEQ ID NO: 611899 - RNA, 19 nt, Homo sapiens
gggaacugcugcaaggauu

SEQ ID NO: 611900 - RNA, 19 nt, Homo sapiens
gcagccauaauuugaauaa

SEQ ID NO: 611901 - RNA, 19 nt, Homo sapiens
ugagaagcauuccuaaauc

SEQ ID NO: 611902 - RNA, 19 nt, Homo sapiens
caacugggacggcuacuau

SEQ ID NO: 611903 - RNA, 19 nt, Homo sapiens
ucagagagaucaugaagac

SEQ ID NO: 611904 - RNA, 19 nt, Homo sapiens
ggacggcuacuauaaggaa

SEQ ID NO: 611905 - RNA, 19 nt, Homo sapiens
agacagcagucaugaagga

SEQ ID NO: 611906 - RNA, 19 nt, Homo sapiens
gaaagaguucuccucauag

SEQ ID NO: 611907 - RNA, 19 nt, Homo sapiens
ggaagaacagcugauagaa

SEQ ID NO: 611908 - RNA, 19 nt, Homo sapiens
ggacauauaccugggacaa

SEQ ID NO: 611909 - RNA, 19 nt, Homo sapiens
cagcagugaugccauaaca

SEQ ID NO: 611910 - RNA, 19 nt, Homo sapiens
ccacagacuuguauuuuga

SEQ ID NO: 611911 - RNA, 19 nt, Homo sapiens
gggcaaacccugauauuuu

SEQ ID NO: 611912 - RNA, 19 nt, Homo sapiens
augcuucccuuuaauguaa

SEQ ID NO: 611913 - RNA, 19 nt, Homo sapiens
gaacuucgagccagaaagg

SEQ ID NO: 611914 - RNA, 19 nt, Homo sapiens
ggaagugggcucugcuuuc

SEQ ID NO: 611915 - RNA, 19 nt, Homo sapiens
gacaccagcuccacaaguc

SEQ ID NO: 611916 - RNA, 19 nt, Homo sapiens
ucugagagcugugacauuc

SEQ ID NO: 611917 - RNA, 19 nt, Homo sapiens
ugugaacuaugguuuagaa

SEQ ID NO: 611918 - RNA, 19 nt, Homo sapiens
gaccagagagacuguaguu

SEQ ID NO: 611919 - RNA, 19 nt, Homo sapiens
ccuuuauccucuagaauuu

SEQ ID NO: 611920 - RNA, 19 nt, Homo sapiens
uggaagggaucaccaaauc

SEQ ID NO: 611921 - RNA, 19 nt, Homo sapiens
ggagaaggagggucugguu

SEQ ID NO: 611922 - RNA, 19 nt, Homo sapiens
agguucaaguuuccaauua

SEQ ID NO: 611923 - RNA, 19 nt, Homo sapiens
cagcagccauaauuugaau

SEQ ID NO: 611924 - RNA, 19 nt, Homo sapiens
gcagcagcccugaguuuga

SEQ ID NO: 611925 - RNA, 19 nt, Homo sapiens
ccaccaaugucacugcaau

SEQ ID NO: 611926 - RNA, 19 nt, Homo sapiens
cuacgaagccuuugacaag

SEQ ID NO: 611927 - RNA, 19 nt, Homo sapiens
ucaucugacucuagugaaa

SEQ ID NO: 611928 - RNA, 19 nt, Homo sapiens
aaaccuuuauccucuagaa

SEQ ID NO: 611929 - RNA, 19 nt, Homo sapiens
gguuugggcucuauucaag

SEQ ID NO: 611930 - RNA, 19 nt, Homo sapiens
ucaucaaccuccucaacaa

SEQ ID NO: 611931 - RNA, 19 nt, Homo sapiens
gggcugaggaccacaaaga

SEQ ID NO: 611932 - RNA, 19 nt, Homo sapiens
gaauggagaaggguaauag

SEQ ID NO: 611933 - RNA, 19 nt, Homo sapiens
gagaagcauuccuaaaucc

SEQ ID NO: 611934 - RNA, 19 nt, Homo sapiens
agcaagaguuugucgauga

SEQ ID NO: 611935 - RNA, 19 nt, Homo sapiens
agaaguaaggccacaguaa

SEQ ID NO: 611936 - RNA, 19 nt, Homo sapiens
ggauaaacagucaaaccuu

SEQ ID NO: 611937 - RNA, 19 nt, Homo sapiens
ccaaaucucaaagcaauga

SEQ ID NO: 611938 - RNA, 19 nt, Homo sapiens
gaagggaucaccaaaucuc

SEQ ID NO: 611939 - RNA, 19 nt, Homo sapiens
ggaucagcuugaggaauaa

SEQ ID NO: 611940 - RNA, 19 nt, Homo sapiens
cucaguaucugcaacaaga

SEQ ID NO: 611941 - RNA, 19 nt, Homo sapiens
gaagggguuugcccacuuu

SEQ ID NO: 611942 - RNA, 19 nt, Homo sapiens
ggaagacaucguucucaau

SEQ ID NO: 611943 - RNA, 19 nt, Homo sapiens
uuuagaagguucaaguuuc

SEQ ID NO: 611944 - RNA, 19 nt, Homo sapiens
ggugugaacuaugguuuag

SEQ ID NO: 611945 - RNA, 19 nt, Homo sapiens
gaagaaggaacccauagcu

SEQ ID NO: 611946 - RNA, 19 nt, Homo sapiens
ucaaccuccucaacaacua

SEQ ID NO: 611947 - RNA, 19 nt, Homo sapiens
acucuucacuuaugucaau

SEQ ID NO: 611948 - RNA, 19 nt, Homo sapiens
ugacaagcaccaccaaugu

SEQ ID NO: 611949 - RNA, 19 nt, Homo sapiens
uggcaauguugacuaagaa

SEQ ID NO: 611950 - RNA, 19 nt, Homo sapiens
aaauguggauaaacaguca

SEQ ID NO: 611951 - RNA, 19 nt, Homo sapiens
gaccagaaaccaaguggau

SEQ ID NO: 611952 - RNA, 19 nt, Homo sapiens
gaaggaagacaucguucuc

SEQ ID NO: 611953 - RNA, 19 nt, Homo sapiens
caaagagucagagccauug

SEQ ID NO: 611954 - RNA, 19 nt, Homo sapiens
gccauaauuugaauaacuc

SEQ ID NO: 611955 - RNA, 19 nt, Homo sapiens
gcugauagaaauucaagau

SEQ ID NO: 611956 - RNA, 19 nt, Homo sapiens
ggccucaugcuucccuuua

SEQ ID NO: 611957 - RNA, 19 nt, Homo sapiens
ccacaugggaaagagauaa

SEQ ID NO: 611958 - RNA, 19 nt, Homo sapiens
caagguuacuggcuuccau

SEQ ID NO: 611959 - RNA, 19 nt, Homo sapiens
ugaagaacaugugguuugg

SEQ ID NO: 611960 - RNA, 19 nt, Homo sapiens
gucgaugacuugaagaaca

SEQ ID NO: 611961 - RNA, 19 nt, Homo sapiens
gcaagaguuugucgaugac

SEQ ID NO: 611962 - RNA, 19 nt, Homo sapiens
ccaaagccacucuucacuu

SEQ ID NO: 611963 - RNA, 19 nt, Homo sapiens
aagaggagauucagagcau

SEQ ID NO: 611964 - RNA, 19 nt, Homo sapiens
ggaacugcugcaaggauuu

SEQ ID NO: 611965 - RNA, 19 nt, Homo sapiens
guuuagaagguucaaguuu

SEQ ID NO: 611966 - RNA, 19 nt, Homo sapiens
guauuuugauccccaauuu

SEQ ID NO: 611967 - RNA, 19 nt, Homo sapiens
gaagguguuuucaguuguu

SEQ ID NO: 611968 - RNA, 19 nt, Homo sapiens
agggucugguugacuauua

SEQ ID NO: 611969 - RNA, 19 nt, Homo sapiens
aggagggucugguugacua

SEQ ID NO: 611970 - RNA, 19 nt, Homo sapiens
ucgaguggcuuugaacaug

SEQ ID NO: 611971 - RNA, 19 nt, Homo sapiens
ccagaaggaagacaucguu

SEQ ID NO: 611972 - RNA, 19 nt, Homo sapiens
gggugugaacuaugguuua

SEQ ID NO: 611973 - RNA, 19 nt, Homo sapiens
gcacaaacaugccauugau

SEQ ID NO: 611974 - RNA, 19 nt, Homo sapiens
caagcagaauucuucauua

SEQ ID NO: 611975 - RNA, 19 nt, Homo sapiens
cgagacauguccaagaaua

SEQ ID NO: 611976 - RNA, 19 nt, Homo sapiens
cagaaucaauugagaugua

SEQ ID NO: 611977 - RNA, 19 nt, Homo sapiens
gaaauggagccuguaauaa

SEQ ID NO: 611978 - RNA, 19 nt, Homo sapiens
ucacagugcuauucagaaa

SEQ ID NO: 611979 - RNA, 19 nt, Homo sapiens
caaagcaaguguccaccua

SEQ ID NO: 611980 - RNA, 19 nt, Homo sapiens
gaauguagaagaaauguug

SEQ ID NO: 611981 - RNA, 19 nt, Homo sapiens
gcaguuacaucacauuucu

SEQ ID NO: 611982 - RNA, 19 nt, Homo sapiens
uuacacggauuuccuaauu

SEQ ID NO: 611983 - RNA, 19 nt, Homo sapiens
cagcagaacuugccacauc

SEQ ID NO: 611984 - RNA, 19 nt, Homo sapiens
ggaaaucauaccuccuuua

SEQ ID NO: 611985 - RNA, 19 nt, Homo sapiens
caauauagcaguuacauca

SEQ ID NO: 611986 - RNA, 19 nt, Homo sapiens
uaaaugguaucccugaaga

SEQ ID NO: 611987 - RNA, 19 nt, Homo sapiens
agaaauggagccuguaaua

SEQ ID NO: 611988 - RNA, 19 nt, Homo sapiens
gagauguagucaagaaaug

SEQ ID NO: 611989 - RNA, 19 nt, Homo sapiens
ggagggcguuuaugucaug

SEQ ID NO: 611990 - RNA, 19 nt, Homo sapiens
ugacugaagcaaugaauuu

SEQ ID NO: 611991 - RNA, 19 nt, Homo sapiens
caaaggacaccauauagug

SEQ ID NO: 611992 - RNA, 19 nt, Homo sapiens
gcaaacaccagacauccaa

SEQ ID NO: 611993 - RNA, 19 nt, Homo sapiens
ugagauaacugccuacaac

SEQ ID NO: 611994 - RNA, 19 nt, Homo sapiens
caacagcagacuacaggua

SEQ ID NO: 611995 - RNA, 19 nt, Homo sapiens
gaaaucauaccuccuuuac

SEQ ID NO: 611996 - RNA, 19 nt, Homo sapiens
caagaaauggagccuguaa

SEQ ID NO: 611997 - RNA, 19 nt, Homo sapiens
guccaagaauagagagaua

SEQ ID NO: 611998 - RNA, 19 nt, Homo sapiens
ugucaacgcuuccuguguu

SEQ ID NO: 611999 - RNA, 19 nt, Homo sapiens
ccaaggagcuucgagacau

SEQ ID NO: 612000 - RNA, 19 nt, Homo sapiens
gcagguguccucuuuguuc

SEQ ID NO: 612001 - RNA, 19 nt, Homo sapiens
gggaaaucauaccuccuuu

SEQ ID NO: 612002 - RNA, 19 nt, Homo sapiens
uacacggauuuccuaauua

SEQ ID NO: 612003 - RNA, 19 nt, Homo sapiens
gaaaagagaaacaugcaaa

SEQ ID NO: 612004 - RNA, 19 nt, Homo sapiens
gcacauucuugcugacagu

SEQ ID NO: 612005 - RNA, 19 nt, Homo sapiens
gcaaggcauaauuugauaa

SEQ ID NO: 612006 - RNA, 19 nt, Homo sapiens
cagcagguguccucuuugu

SEQ ID NO: 612007 - RNA, 19 nt, Homo sapiens
gggugccacuucccauuaa

SEQ ID NO: 612008 - RNA, 19 nt, Homo sapiens
gguaaaugguaucccugaa

SEQ ID NO: 612009 - RNA, 19 nt, Homo sapiens
ucaagcagaauucuucauu

SEQ ID NO: 612010 - RNA, 19 nt, Homo sapiens
ugcaaggcauaauuugaua

SEQ ID NO: 612011 - RNA, 19 nt, Homo sapiens
cuggauggcuucgauauau

SEQ ID NO: 612012 - RNA, 19 nt, Homo sapiens
aaucauaccuccuuuacac

SEQ ID NO: 612013 - RNA, 19 nt, Homo sapiens
caaggagcuucgagacaug

SEQ ID NO: 612014 - RNA, 19 nt, Homo sapiens
gaaggagggcguuuauguc

SEQ ID NO: 612015 - RNA, 19 nt, Homo sapiens
ugaaggagggcguuuaugu

SEQ ID NO: 612016 - RNA, 19 nt, Homo sapiens
aaaccuggcgagauuagua

SEQ ID NO: 612017 - RNA, 19 nt, Homo sapiens
gacugaagcaaugaauuua

SEQ ID NO: 612018 - RNA, 19 nt, Homo sapiens
gacuacagguaaaugguau

SEQ ID NO: 612019 - RNA, 19 nt, Homo sapiens
gaacuugccacaucagacu

SEQ ID NO: 612020 - RNA, 19 nt, Homo sapiens
gagacuauuacacggauuu

SEQ ID NO: 612021 - RNA, 19 nt, Homo sapiens
ugguaucccugaagaaaga

SEQ ID NO: 612022 - RNA, 19 nt, Homo sapiens
gggcguuuaugucaugguu

SEQ ID NO: 612023 - RNA, 19 nt, Homo sapiens
agacugcaaggcauaauuu

SEQ ID NO: 612024 - RNA, 19 nt, Homo sapiens
acagugcuauucagaaauc

SEQ ID NO: 612025 - RNA, 19 nt, Homo sapiens
aauggagccuguaauaaca

SEQ ID NO: 612026 - RNA, 19 nt, Homo sapiens
aagaaauguuggccaguga

SEQ ID NO: 612027 - RNA, 19 nt, Homo sapiens
acacggauuuccuaauuac

SEQ ID NO: 612028 - RNA, 19 nt, Homo sapiens
gugauggaguccuauaugg

SEQ ID NO: 612029 - RNA, 19 nt, Homo sapiens
aaaggacaccauauaguga

SEQ ID NO: 612030 - RNA, 19 nt, Homo sapiens
ccaaaggacaccauauagu

SEQ ID NO: 612031 - RNA, 19 nt, Homo sapiens
cgaccuggauggcuucgau

SEQ ID NO: 612032 - RNA, 19 nt, Homo sapiens
ccuguaauaacaugugaua

SEQ ID NO: 612033 - RNA, 19 nt, Homo sapiens
gagacugcaaggcauaauu

SEQ ID NO: 612034 - RNA, 19 nt, Homo sapiens
uggcuucgauauauccaaa

SEQ ID NO: 612035 - RNA, 19 nt, Homo sapiens
gagcuuuucuggcauaugu

SEQ ID NO: 612036 - RNA, 19 nt, Homo sapiens
ccaauaaugcaugagcuuu

SEQ ID NO: 612037 - RNA, 19 nt, Homo sapiens
gaaagaaaacugacugaag

SEQ ID NO: 612038 - RNA, 19 nt, Homo sapiens
ccacaucagacucagauuc

SEQ ID NO: 612039 - RNA, 19 nt, Homo sapiens
ugagguucuuggagacuuu

SEQ ID NO: 612040 - RNA, 19 nt, Homo sapiens
ucacauuucuuuucucuuc

SEQ ID NO: 612041 - RNA, 19 nt, Homo sapiens
guaaaugguaucccugaag

SEQ ID NO: 612042 - RNA, 19 nt, Homo sapiens
agacuacagguaaauggua

SEQ ID NO: 612043 - RNA, 19 nt, Homo sapiens
cauucuugcugacagugua

SEQ ID NO: 612044 - RNA, 19 nt, Homo sapiens
gaaaauccacagaaucaau

SEQ ID NO: 612045 - RNA, 19 nt, Homo sapiens
uaguaaugaucccauaaca

SEQ ID NO: 612046 - RNA, 19 nt, Homo sapiens
cauguuggcaguauuaagu

SEQ ID NO: 612047 - RNA, 19 nt, Homo sapiens
gcaaacgcagcagaacuug

SEQ ID NO: 612048 - RNA, 19 nt, Homo sapiens
gguguccucuuuguucaug

SEQ ID NO: 612049 - RNA, 19 nt, Homo sapiens
aaauggagccuguaauaac

SEQ ID NO: 612050 - RNA, 19 nt, Homo sapiens
ccacagaaucaauugagau

SEQ ID NO: 612051 - RNA, 19 nt, Homo sapiens
cugacaguguacaguauuu

SEQ ID NO: 612052 - RNA, 19 nt, Homo sapiens
ucagacaauauagcaguua

SEQ ID NO: 612053 - RNA, 19 nt, Homo sapiens
caucacagugcuauucaga

SEQ ID NO: 612054 - RNA, 19 nt, Homo sapiens
aacaugccauugaugcaaa

SEQ ID NO: 612055 - RNA, 19 nt, Homo sapiens
uucgagacauguccaagaa

SEQ ID NO: 612056 - RNA, 19 nt, Homo sapiens
cccaaaaccuggcgagauu

SEQ ID NO: 612057 - RNA, 19 nt, Homo sapiens
gugcaaaauuucauugguu

SEQ ID NO: 612058 - RNA, 19 nt, Homo sapiens
acaacaggcgcaccuuuga

SEQ ID NO: 612059 - RNA, 19 nt, Homo sapiens
cuacaacaggcgcaccuuu

SEQ ID NO: 612060 - RNA, 19 nt, Homo sapiens
gagauaacugccuacaaca

SEQ ID NO: 612061 - RNA, 19 nt, Homo sapiens
gcagacuacagguaaaugg

SEQ ID NO: 612062 - RNA, 19 nt, Homo sapiens
acagcagacuacagguaaa

SEQ ID NO: 612063 - RNA, 19 nt, Homo sapiens
ugaaaagcagagacuauua

SEQ ID NO: 612064 - RNA, 19 nt, Homo sapiens
cagguguccucuuuguuca

SEQ ID NO: 612065 - RNA, 19 nt, Homo sapiens
ugucaugguuggugcagau

SEQ ID NO: 612066 - RNA, 19 nt, Homo sapiens
auauagugauggaguccua

SEQ ID NO: 612067 - RNA, 19 nt, Homo sapiens
uagcaguuacaucacauuu

SEQ ID NO: 612068 - RNA, 19 nt, Homo sapiens
aaaacugacugaagcaaug

SEQ ID NO: 612069 - RNA, 19 nt, Homo sapiens
aaacaugccauugaugcaa

SEQ ID NO: 612070 - RNA, 19 nt, Homo sapiens
guugccauaucaagcagaa

SEQ ID NO: 612071 - RNA, 19 nt, Homo sapiens
aauauaaugucugcagaag

SEQ ID NO: 612072 - RNA, 19 nt, Homo sapiens
gcugacaguguacaguauu

SEQ ID NO: 612073 - RNA, 19 nt, Homo sapiens
gaccagagcucauccaaca

SEQ ID NO: 612074 - RNA, 19 nt, Homo sapiens
gaggagaucuuccaguaug

SEQ ID NO: 612075 - RNA, 19 nt, Homo sapiens
gaggagaacuucaccauac

SEQ ID NO: 612076 - RNA, 19 nt, Homo sapiens
ggaggaggaugaugagaug

SEQ ID NO: 612077 - RNA, 19 nt, Homo sapiens
gguccuggcugaaacauga

SEQ ID NO: 612078 - RNA, 19 nt, Homo sapiens
ggaacgggaucaugaagga

SEQ ID NO: 612079 - RNA, 19 nt, Homo sapiens
gaagauggccacaggaaug

SEQ ID NO: 612080 - RNA, 19 nt, Homo sapiens
gcaacuaugugcucuucaa

SEQ ID NO: 612081 - RNA, 19 nt, Homo sapiens
acacauagacagacauaua

SEQ ID NO: 612082 - RNA, 19 nt, Homo sapiens
gcaagaugaucgacgucua

SEQ ID NO: 612083 - RNA, 19 nt, Homo sapiens
ggguggagaucauguacua

SEQ ID NO: 612084 - RNA, 19 nt, Homo sapiens
ggaacagccucaagcacaa

SEQ ID NO: 612085 - RNA, 19 nt, Homo sapiens
gagcugugcccgcaacaua

SEQ ID NO: 612086 - RNA, 19 nt, Homo sapiens
gacagcgucucuuuaauca

SEQ ID NO: 612087 - RNA, 19 nt, Homo sapiens
gcucugaugucccucuuug

SEQ ID NO: 612088 - RNA, 19 nt, Homo sapiens
ggacagcgucucuuuaauc

SEQ ID NO: 612089 - RNA, 19 nt, Homo sapiens
acugagagcuuaugacuuc

SEQ ID NO: 612090 - RNA, 19 nt, Homo sapiens
ggagacagcccucaaguac

SEQ ID NO: 612091 - RNA, 19 nt, Homo sapiens
ccagagcucauccaacaua

SEQ ID NO: 612092 - RNA, 19 nt, Homo sapiens
cagagaacuuccuguguga

SEQ ID NO: 612093 - RNA, 19 nt, Homo sapiens
acgaggagaucuuccagua

SEQ ID NO: 612094 - RNA, 19 nt, Homo sapiens
ggaggagaacuucaccaua

SEQ ID NO: 612095 - RNA, 19 nt, Homo sapiens
gcaggucuuugaugacuuc

SEQ ID NO: 612096 - RNA, 19 nt, Homo sapiens
cagcgucucuuuaaucauc

SEQ ID NO: 612097 - RNA, 19 nt, Homo sapiens
gagcucauccaacauagaa

SEQ ID NO: 612098 - RNA, 19 nt, Homo sapiens
uggcagggauggucgagua

SEQ ID NO: 612099 - RNA, 19 nt, Homo sapiens
gagcagacagcaauacuuc

SEQ ID NO: 612100 - RNA, 19 nt, Homo sapiens
agacagcccucaaguacug

SEQ ID NO: 612101 - RNA, 19 nt, Homo sapiens
cauuugggcucuucgacua

SEQ ID NO: 612102 - RNA, 19 nt, Homo sapiens
cggaggagcugaccaacau

SEQ ID NO: 612103 - RNA, 19 nt, Homo sapiens
ggaaccgccuggauuucuu

SEQ ID NO: 612104 - RNA, 19 nt, Homo sapiens
ggaccuggccauugugcua

SEQ ID NO: 612105 - RNA, 19 nt, Homo sapiens
ccacaagggugccaucaac

SEQ ID NO: 612106 - RNA, 19 nt, Homo sapiens
cgaaagagcagugucaugu

SEQ ID NO: 612107 - RNA, 19 nt, Homo sapiens
cuucaucuuuggcaucaua

SEQ ID NO: 612108 - RNA, 19 nt, Homo sapiens
gaccauuauugcccacaaa

SEQ ID NO: 612109 - RNA, 19 nt, Homo sapiens
ggucuucaccagcauguuu

SEQ ID NO: 612110 - RNA, 19 nt, Homo sapiens
caagggugccaucaacuuu

SEQ ID NO: 612111 - RNA, 19 nt, Homo sapiens
guacugcaacuauauguuc

SEQ ID NO: 612112 - RNA, 19 nt, Homo sapiens
ccaugucccuggagcacua

SEQ ID NO: 612113 - RNA, 19 nt, Homo sapiens
gaacgugcuggauggcuuu

SEQ ID NO: 612114 - RNA, 19 nt, Homo sapiens
uagaagaguuugauaagcu

SEQ ID NO: 612115 - RNA, 19 nt, Homo sapiens
caacauagaagaguuugau

SEQ ID NO: 612116 - RNA, 19 nt, Homo sapiens
gaucugcaauguggucuuc

SEQ ID NO: 612117 - RNA, 19 nt, Homo sapiens
gcucaucgucagcuucuuu

SEQ ID NO: 612118 - RNA, 19 nt, Homo sapiens
cagugcauauacauacaua

SEQ ID NO: 612119 - RNA, 19 nt, Homo sapiens
acacgguggugcaagcuuu

SEQ ID NO: 612120 - RNA, 19 nt, Homo sapiens
guucaccacugucuuugug

SEQ ID NO: 612121 - RNA, 19 nt, Homo sapiens
ggauggcuuucuugucuuc

SEQ ID NO: 612122 - RNA, 19 nt, Homo sapiens
gggccucccucuacuuugu

SEQ ID NO: 612123 - RNA, 19 nt, Homo sapiens
uggaggagaucccauucaa

SEQ ID NO: 612124 - RNA, 19 nt, Homo sapiens
gaacuuccugugugagaug

SEQ ID NO: 612125 - RNA, 19 nt, Homo sapiens
gccacuaccuggacaucuu

SEQ ID NO: 612126 - RNA, 19 nt, Homo sapiens
caucugcugugccuucuuc

SEQ ID NO: 612127 - RNA, 19 nt, Homo sapiens
cccacaaacucuucgacua

SEQ ID NO: 612128 - RNA, 19 nt, Homo sapiens
gaugaucgacgucuauaag

SEQ ID NO: 612129 - RNA, 19 nt, Homo sapiens
ggugguggcugugcucaug

SEQ ID NO: 612130 - RNA, 19 nt, Homo sapiens
caagaugaucgacgucuau

SEQ ID NO: 612131 - RNA, 19 nt, Homo sapiens
aaagagcagugucaugucu

SEQ ID NO: 612132 - RNA, 19 nt, Homo sapiens
cauccaacauagaagaguu

SEQ ID NO: 612133 - RNA, 19 nt, Homo sapiens
gggcgacaaugggauaaug

SEQ ID NO: 612134 - RNA, 19 nt, Homo sapiens
cauggaaccgccuggauuu

SEQ ID NO: 612135 - RNA, 19 nt, Homo sapiens
ggagauggugcucaagaug

SEQ ID NO: 612136 - RNA, 19 nt, Homo sapiens
ucaaguacugcaacuauau

SEQ ID NO: 612137 - RNA, 19 nt, Homo sapiens
cagcaucauugucaucauc

SEQ ID NO: 612138 - RNA, 19 nt, Homo sapiens
caccaagggucaacuguac

SEQ ID NO: 612139 - RNA, 19 nt, Homo sapiens
gagaacuuccugugugaga

SEQ ID NO: 612140 - RNA, 19 nt, Homo sapiens
cucaaguacugcaacuaua

SEQ ID NO: 612141 - RNA, 19 nt, Homo sapiens
uagggaggaugagcuauga

SEQ ID NO: 612142 - RNA, 19 nt, Homo sapiens
ggucugaggcgcuucuuca

SEQ ID NO: 612143 - RNA, 19 nt, Homo sapiens
gcuggguccaucacaaaua

SEQ ID NO: 612144 - RNA, 19 nt, Homo sapiens
cgagaugacauugaaggua

SEQ ID NO: 612145 - RNA, 19 nt, Homo sapiens
gcaccgaacgcaucuuucu

SEQ ID NO: 612146 - RNA, 19 nt, Homo sapiens
cguccuggccuucaucuuu

SEQ ID NO: 612147 - RNA, 19 nt, Homo sapiens
gaaacuggugcgcuucaug

SEQ ID NO: 612148 - RNA, 19 nt, Homo sapiens
ugaccaacauccuggagau

SEQ ID NO: 612149 - RNA, 19 nt, Homo sapiens
gcgugacacuuggcaugua

SEQ ID NO: 612150 - RNA, 19 nt, Homo sapiens
gaugcucacuccuucuaca

SEQ ID NO: 612151 - RNA, 19 nt, Homo sapiens
gacaacaucgguuaugcuu

SEQ ID NO: 612152 - RNA, 19 nt, Homo sapiens
gcaucacccuggaggagau

SEQ ID NO: 612153 - RNA, 19 nt, Homo sapiens
gaaagagcagugucauguc

SEQ ID NO: 612154 - RNA, 19 nt, Homo sapiens
cacauagacagacauauau

SEQ ID NO: 612155 - RNA, 19 nt, Homo sapiens
acacacauagacagacaua

SEQ ID NO: 612156 - RNA, 19 nt, Homo sapiens
gcccuacuaugccaccuau

SEQ ID NO: 612157 - RNA, 19 nt, Homo sapiens
gcucauccaacauagaaga

SEQ ID NO: 612158 - RNA, 19 nt, Homo sapiens
caucgguuaugcuuggauu

SEQ ID NO: 612159 - RNA, 19 nt, Homo sapiens
acacacacauagacagaca

SEQ ID NO: 612160 - RNA, 19 nt, Homo sapiens
acaaauacaacuucgacaa

SEQ ID NO: 612161 - RNA, 19 nt, Homo sapiens
ccacaaacucuucgacuac

SEQ ID NO: 612162 - RNA, 19 nt, Homo sapiens
cauagaagaguuugauaag

SEQ ID NO: 612163 - RNA, 19 nt, Homo sapiens
auagugggcuccuucuuca

SEQ ID NO: 612164 - RNA, 19 nt, Homo sapiens
gguuaugcuuggauuguca

SEQ ID NO: 612165 - RNA, 19 nt, Homo sapiens
ggagaacuucaccauacaa

SEQ ID NO: 612166 - RNA, 19 nt, Homo sapiens
ggagcagacagcaauacuu

SEQ ID NO: 612167 - RNA, 19 nt, Homo sapiens
ucaccaagggucaacugua

SEQ ID NO: 612168 - RNA, 19 nt, Homo sapiens
caaccugggccuccucuuc

SEQ ID NO: 612169 - RNA, 19 nt, Homo sapiens
cuggauggcuuucuugucu

SEQ ID NO: 612170 - RNA, 19 nt, Homo sapiens
cagcaccgaacgcaucuuu

SEQ ID NO: 612171 - RNA, 19 nt, Homo sapiens
caucuucgacagcaucauu

SEQ ID NO: 612172 - RNA, 19 nt, Homo sapiens
ggacagcaaguacuucaac

SEQ ID NO: 612173 - RNA, 19 nt, Homo sapiens
acgaagagcugcugaagua

SEQ ID NO: 612174 - RNA, 19 nt, Homo sapiens
ggaacaggcuggauuucuu

SEQ ID NO: 612175 - RNA, 19 nt, Homo sapiens
ggaacgggaucaugaagga

SEQ ID NO: 612176 - RNA, 19 nt, Homo sapiens
gcaacuaugugcucuucaa

SEQ ID NO: 612177 - RNA, 19 nt, Homo sapiens
ggagggcgaugccaacaga

SEQ ID NO: 612178 - RNA, 19 nt, Homo sapiens
ggaacgugguccuguacaa

SEQ ID NO: 612179 - RNA, 19 nt, Homo sapiens
gcaacuacgucuucaccau

SEQ ID NO: 612180 - RNA, 19 nt, Homo sapiens
ucaaagggaaguucuacua

SEQ ID NO: 612181 - RNA, 19 nt, Homo sapiens
ggagaggccugacauugac

SEQ ID NO: 612182 - RNA, 19 nt, Homo sapiens
ccgaggagcugacuaaugc

SEQ ID NO: 612183 - RNA, 19 nt, Homo sapiens
gccagaaggucaucacaca

SEQ ID NO: 612184 - RNA, 19 nt, Homo sapiens
gaaaguggagacucagaug

SEQ ID NO: 612185 - RNA, 19 nt, Homo sapiens
gaacaggcuggauuucuuc

SEQ ID NO: 612186 - RNA, 19 nt, Homo sapiens
ggagagaagccgcgucugu

SEQ ID NO: 612187 - RNA, 19 nt, Homo sapiens
cacacaagauguuugauca

SEQ ID NO: 612188 - RNA, 19 nt, Homo sapiens
ccacaacggugccaucaac

SEQ ID NO: 612189 - RNA, 19 nt, Homo sapiens
ccaggaacaucuccaccaa

SEQ ID NO: 612190 - RNA, 19 nt, Homo sapiens
gcacgcugcucaugcucuu

SEQ ID NO: 612191 - RNA, 19 nt, Homo sapiens
gcagaaagaagaagaugag

SEQ ID NO: 612192 - RNA, 19 nt, Homo sapiens
cacugaagcugguagcauu

SEQ ID NO: 612193 - RNA, 19 nt, Homo sapiens
gcaucacgcuggaggagau

SEQ ID NO: 612194 - RNA, 19 nt, Homo sapiens
caacgacagcuacauguuc

SEQ ID NO: 612195 - RNA, 19 nt, Homo sapiens
gcacgcaacgccugcauca

SEQ ID NO: 612196 - RNA, 19 nt, Homo sapiens
ggagugcagugaagacaac

SEQ ID NO: 612197 - RNA, 19 nt, Homo sapiens
ucacacacaagauguuuga

SEQ ID NO: 612198 - RNA, 19 nt, Homo sapiens
guacugcaacuacgucuuc

SEQ ID NO: 612199 - RNA, 19 nt, Homo sapiens
uggcggagaugauggugaa

SEQ ID NO: 612200 - RNA, 19 nt, Homo sapiens
guaccagguugcguccuuu

SEQ ID NO: 612201 - RNA, 19 nt, Homo sapiens
gcccugaucccuacgagaa

SEQ ID NO: 612202 - RNA, 19 nt, Homo sapiens
caacggugccaucaacuuc

SEQ ID NO: 612203 - RNA, 19 nt, Homo sapiens
gguaccagguugcguccuu

SEQ ID NO: 612204 - RNA, 19 nt, Homo sapiens
cgaagcagcgggagaguca

SEQ ID NO: 612205 - RNA, 19 nt, Homo sapiens
ggagacaccgugccugaca

SEQ ID NO: 612206 - RNA, 19 nt, Homo sapiens
gccguggcgucuaugaauu

SEQ ID NO: 612207 - RNA, 19 nt, Homo sapiens
ggaaaguggagacucagau

SEQ ID NO: 612208 - RNA, 19 nt, Homo sapiens
acgagaagaucccgcaugu

SEQ ID NO: 612209 - RNA, 19 nt, Homo sapiens
caacuucaucuauuucauc

SEQ ID NO: 612210 - RNA, 19 nt, Homo sapiens
gaggaggucagccacauca

SEQ ID NO: 612211 - RNA, 19 nt, Homo sapiens
gccacuaucucgaccucuu

SEQ ID NO: 612212 - RNA, 19 nt, Homo sapiens
uggagaggccugacauuga

SEQ ID NO: 612213 - RNA, 19 nt, Homo sapiens
ggaacaacaaccugaccuu

SEQ ID NO: 612214 - RNA, 19 nt, Homo sapiens
guggagacccuuucuugga

SEQ ID NO: 612215 - RNA, 19 nt, Homo sapiens
cacgugagcaugcugguaa

SEQ ID NO: 612216 - RNA, 19 nt, Homo sapiens
gcccagcgaagcaggagua

SEQ ID NO: 612217 - RNA, 19 nt, Homo sapiens
ccuggaugcugcuguacuu

SEQ ID NO: 612218 - RNA, 19 nt, Homo sapiens
cccaagagcucaccauucc

SEQ ID NO: 612219 - RNA, 19 nt, Homo sapiens
ucacucugcugcuggauac

SEQ ID NO: 612220 - RNA, 19 nt, Homo sapiens
cgucuucaccaucguguuu

SEQ ID NO: 612221 - RNA, 19 nt, Homo sapiens
ggaugcugcuguacuucau

SEQ ID NO: 612222 - RNA, 19 nt, Homo sapiens
aaagggaaguucuacuacu

SEQ ID NO: 612223 - RNA, 19 nt, Homo sapiens
gccaagauccuggguguuc

SEQ ID NO: 612224 - RNA, 19 nt, Homo sapiens
agacgucgguccacuucga

SEQ ID NO: 612225 - RNA, 19 nt, Homo sapiens
gcacgugagcaugcuggua

SEQ ID NO: 612226 - RNA, 19 nt, Homo sapiens
ugacuaaugcucuggagau

SEQ ID NO: 612227 - RNA, 19 nt, Homo sapiens
cugaagagcugcccguacu

SEQ ID NO: 612228 - RNA, 19 nt, Homo sapiens
caccaccacuaccauuuca

SEQ ID NO: 612229 - RNA, 19 nt, Homo sapiens
cauggacgcccacucauuc

SEQ ID NO: 612230 - RNA, 19 nt, Homo sapiens
caguggagacccuuucuug

SEQ ID NO: 612231 - RNA, 19 nt, Homo sapiens
ggaacaucguccucaucug

SEQ ID NO: 612232 - RNA, 19 nt, Homo sapiens
caagacgucgguccacuuc

SEQ ID NO: 612233 - RNA, 19 nt, Homo sapiens
ugaagaccauggacaacgu

SEQ ID NO: 612234 - RNA, 19 nt, Homo sapiens
cuaaugcucuggagaucag

SEQ ID NO: 612235 - RNA, 19 nt, Homo sapiens
gccaucaacuucgacaaca

SEQ ID NO: 612236 - RNA, 19 nt, Homo sapiens
gagacaacggcaugcagaa

SEQ ID NO: 612237 - RNA, 19 nt, Homo sapiens
ccagaagcguccugugacu

SEQ ID NO: 612238 - RNA, 19 nt, Homo sapiens
aaugucaccuucacucaca

SEQ ID NO: 612239 - RNA, 19 nt, Homo sapiens
gggaaccugggccuucuuu

SEQ ID NO: 612240 - RNA, 19 nt, Homo sapiens
gugcugaagcugcugaaga

SEQ ID NO: 612241 - RNA, 19 nt, Homo sapiens
aagggaaguucuacuacug

SEQ ID NO: 612242 - RNA, 19 nt, Homo sapiens
gugugcagcucuucaaagg

SEQ ID NO: 612243 - RNA, 19 nt, Homo sapiens
cgucuccaauuacaucuuc

SEQ ID NO: 612244 - RNA, 19 nt, Homo sapiens
gagcucaccauuccuggau

SEQ ID NO: 612245 - RNA, 19 nt, Homo sapiens
ccacucauucuacaacuuc

SEQ ID NO: 612246 - RNA, 19 nt, Homo sapiens
caggcuggauuucuucauc

SEQ ID NO: 612247 - RNA, 19 nt, Homo sapiens
gcuggacacuguggugcaa

SEQ ID NO: 612248 - RNA, 19 nt, Homo sapiens
caaagggaaguucuacuac

SEQ ID NO: 612249 - RNA, 19 nt, Homo sapiens
gggaacaucguccucaucu

SEQ ID NO: 612250 - RNA, 19 nt, Homo sapiens
gaacccguacaacaucuuc

SEQ ID NO: 612251 - RNA, 19 nt, Homo sapiens
caucgugggcuccuucuuc

SEQ ID NO: 612252 - RNA, 19 nt, Homo sapiens
acaacggcaugcagaagug

SEQ ID NO: 612253 - RNA, 19 nt, Homo sapiens
ugcugaagcugcugaagau

SEQ ID NO: 612254 - RNA, 19 nt, Homo sapiens
gcucaucgucagcuucuuc

SEQ ID NO: 612255 - RNA, 19 nt, Homo sapiens
cagaaggucaucacacaca

SEQ ID NO: 612256 - RNA, 19 nt, Homo sapiens
cggcaacuaugugcucuuc

SEQ ID NO: 612257 - RNA, 19 nt, Homo sapiens
gcaugggcguggaguacca

SEQ ID NO: 612258 - RNA, 19 nt, Homo sapiens
cuucagccguggcaucaug

SEQ ID NO: 612259 - RNA, 19 nt, Homo sapiens
ccaugccgacugccacaua

SEQ ID NO: 612260 - RNA, 19 nt, Homo sapiens
ugcaggagguggagaugga

SEQ ID NO: 612261 - RNA, 19 nt, Homo sapiens
aacgacagcuacauguuca

SEQ ID NO: 612262 - RNA, 19 nt, Homo sapiens
ccaacgacagcuacauguu

SEQ ID NO: 612263 - RNA, 19 nt, Homo sapiens
caacuggaacgggaucaug

SEQ ID NO: 612264 - RNA, 19 nt, Homo sapiens
gcacugaagcugguagcau

SEQ ID NO: 612265 - RNA, 19 nt, Homo sapiens
agaaggucaucacacacaa

SEQ ID NO: 612266 - RNA, 19 nt, Homo sapiens
gagaacuccagaccacaga

SEQ ID NO: 612267 - RNA, 19 nt, Homo sapiens
acuggaacgugguccugua

SEQ ID NO: 612268 - RNA, 19 nt, Homo sapiens
gacuaaugcucuggagauc

SEQ ID NO: 612269 - RNA, 19 nt, Homo sapiens
gugggcuccuucuucauga

SEQ ID NO: 612270 - RNA, 19 nt, Homo sapiens
gacaacggcaugcagaagu

SEQ ID NO: 612271 - RNA, 19 nt, Homo sapiens
ucaccuucaucaucugugu

SEQ ID NO: 612272 - RNA, 19 nt, Homo sapiens
gcccuacuaugccgacuac

SEQ ID NO: 612273 - RNA, 19 nt, Homo sapiens
ccaggaacaucaccaauaa

SEQ ID NO: 612274 - RNA, 19 nt, Homo sapiens
gaacaaaguccucuacaau

SEQ ID NO: 612275 - RNA, 19 nt, Homo sapiens
caucuucacugucaucuuu

SEQ ID NO: 612276 - RNA, 19 nt, Homo sapiens
gcaauacguuugugcagaa

SEQ ID NO: 612277 - RNA, 19 nt, Homo sapiens
ggacuucucuucauguugu

SEQ ID NO: 612278 - RNA, 19 nt, Homo sapiens
ggaacaaaguccucuacaa

SEQ ID NO: 612279 - RNA, 19 nt, Homo sapiens
gagaucagccucccacuuu

SEQ ID NO: 612280 - RNA, 19 nt, Homo sapiens
gcucauuccuucuacaauu

SEQ ID NO: 612281 - RNA, 19 nt, Homo sapiens
gcaacuacaucuucacugu

SEQ ID NO: 612282 - RNA, 19 nt, Homo sapiens
ggagaaagcaauacguuug

SEQ ID NO: 612283 - RNA, 19 nt, Homo sapiens
gcaacuacgugcucuucaa

SEQ ID NO: 612284 - RNA, 19 nt, Homo sapiens
gaaagauuguggacagcaa

SEQ ID NO: 612285 - RNA, 19 nt, Homo sapiens
gaacaucaccaauaaaucg

SEQ ID NO: 612286 - RNA, 19 nt, Homo sapiens
ugcagaaucucuauguaua

SEQ ID NO: 612287 - RNA, 19 nt, Homo sapiens
gaaggagaaggcacuagua

SEQ ID NO: 612288 - RNA, 19 nt, Homo sapiens
ugaagagacuuguuuccuu

SEQ ID NO: 612289 - RNA, 19 nt, Homo sapiens
gaaccguccugcucucuag

SEQ ID NO: 612290 - RNA, 19 nt, Homo sapiens
guacaacuuugacaaccuu

SEQ ID NO: 612291 - RNA, 19 nt, Homo sapiens
gcaucacgcuggaggaaau

SEQ ID NO: 612292 - RNA, 19 nt, Homo sapiens
aagcagaacuuccaaagag

SEQ ID NO: 612293 - RNA, 19 nt, Homo sapiens
ugacaugcacacacucuua

SEQ ID NO: 612294 - RNA, 19 nt, Homo sapiens
gcagcuguuugacaccaua

SEQ ID NO: 612295 - RNA, 19 nt, Homo sapiens
cuaguuauauucccucuuc

SEQ ID NO: 612296 - RNA, 19 nt, Homo sapiens
caucucgccuaucuacuuu

SEQ ID NO: 612297 - RNA, 19 nt, Homo sapiens
gaggauaccaggaacauca

SEQ ID NO: 612298 - RNA, 19 nt, Homo sapiens
gcgaggcaguuuaugaguu

SEQ ID NO: 612299 - RNA, 19 nt, Homo sapiens
cggagacgcugaaggagaa

SEQ ID NO: 612300 - RNA, 19 nt, Homo sapiens
ucgcagggaugcuggagua

SEQ ID NO: 612301 - RNA, 19 nt, Homo sapiens
agaaagaugugcugagucu

SEQ ID NO: 612302 - RNA, 19 nt, Homo sapiens
aaagaaagaugugcugagu

SEQ ID NO: 612303 - RNA, 19 nt, Homo sapiens
gcugauguccucacugaaa

SEQ ID NO: 612304 - RNA, 19 nt, Homo sapiens
caucuucaccgcagucuuu

SEQ ID NO: 612305 - RNA, 19 nt, Homo sapiens
aaaguccucuacaauggua

SEQ ID NO: 612306 - RNA, 19 nt, Homo sapiens
ugacugaagagacuuguuu

SEQ ID NO: 612307 - RNA, 19 nt, Homo sapiens
acaaaguccucuacaaugg

SEQ ID NO: 612308 - RNA, 19 nt, Homo sapiens
ggagaaggcacuaguagag

SEQ ID NO: 612309 - RNA, 19 nt, Homo sapiens
agacagagaacgaggauga

SEQ ID NO: 612310 - RNA, 19 nt, Homo sapiens
gcuauuaccagacagagaa

SEQ ID NO: 612311 - RNA, 19 nt, Homo sapiens
gcagaaucucuauguauau

SEQ ID NO: 612312 - RNA, 19 nt, Homo sapiens
ugacaaaaguuccauauag

SEQ ID NO: 612313 - RNA, 19 nt, Homo sapiens
ggaugaggcucugaagauc

SEQ ID NO: 612314 - RNA, 19 nt, Homo sapiens
ugugacaccuuccgaaaga

SEQ ID NO: 612315 - RNA, 19 nt, Homo sapiens
uacaacagcuccagcaaca

SEQ ID NO: 612316 - RNA, 19 nt, Homo sapiens
gacaaaaguuccauauaga

SEQ ID NO: 612317 - RNA, 19 nt, Homo sapiens
acuacgugcucuucaauuu

SEQ ID NO: 612318 - RNA, 19 nt, Homo sapiens
cgaggcaguuuaugaguuc

SEQ ID NO: 612319 - RNA, 19 nt, Homo sapiens
cagaagcuguugggagaaa

SEQ ID NO: 612320 - RNA, 19 nt, Homo sapiens
gaccagacuuacugacugu

SEQ ID NO: 612321 - RNA, 19 nt, Homo sapiens
gcaacaaggaggccaagga

SEQ ID NO: 612322 - RNA, 19 nt, Homo sapiens
gaaccugggacuucucuuc

SEQ ID NO: 612323 - RNA, 19 nt, Homo sapiens
gagaagcgccuacgaagac

SEQ ID NO: 612324 - RNA, 19 nt, Homo sapiens
ggagaagcgccuacgaaga

SEQ ID NO: 612325 - RNA, 19 nt, Homo sapiens
gaggagaagcgccuacgaa

SEQ ID NO: 612326 - RNA, 19 nt, Homo sapiens
uuggagaccuggaguguga

SEQ ID NO: 612327 - RNA, 19 nt, Homo sapiens
gaagaucugcaacuacauc

SEQ ID NO: 612328 - RNA, 19 nt, Homo sapiens
ucaagaaucccuacaacau

SEQ ID NO: 612329 - RNA, 19 nt, Homo sapiens
gaucugcaacuacaucuuc

SEQ ID NO: 612330 - RNA, 19 nt, Homo sapiens
cuucaucuuugccuucuuu

SEQ ID NO: 612331 - RNA, 19 nt, Homo sapiens
gggagaaagcaauacguuu

SEQ ID NO: 612332 - RNA, 19 nt, Homo sapiens
cugaagaucugcaacuaca

SEQ ID NO: 612333 - RNA, 19 nt, Homo sapiens
uccugacccucuccaauua

SEQ ID NO: 612334 - RNA, 19 nt, Homo sapiens
caggaggacuggaacaaag

SEQ ID NO: 612335 - RNA, 19 nt, Homo sapiens
ccaccugugucaacuggaa

SEQ ID NO: 612336 - RNA, 19 nt, Homo sapiens
ggcaugcgguccugcagaa

SEQ ID NO: 612337 - RNA, 19 nt, Homo sapiens
ucacguugcugcuggauac

SEQ ID NO: 612338 - RNA, 19 nt, Homo sapiens
gagaaagcaauacguuugu

SEQ ID NO: 612339 - RNA, 19 nt, Homo sapiens
cacgggaccugaagaagug

SEQ ID NO: 612340 - RNA, 19 nt, Homo sapiens
gcacacacucuuacuuagu

SEQ ID NO: 612341 - RNA, 19 nt, Homo sapiens
caucugcugugccuucuuc

SEQ ID NO: 612342 - RNA, 19 nt, Homo sapiens
gcaagcagaacuuccaaag

SEQ ID NO: 612343 - RNA, 19 nt, Homo sapiens
gggcuauauuccugacaaa

SEQ ID NO: 612344 - RNA, 19 nt, Homo sapiens
gaccagcagcccaucauga

SEQ ID NO: 612345 - RNA, 19 nt, Homo sapiens
ugccagaccggaagaauuu

SEQ ID NO: 612346 - RNA, 19 nt, Homo sapiens
gcuuguguauggucccuuu

SEQ ID NO: 612347 - RNA, 19 nt, Homo sapiens
ggagcgcuauuaccagaca

SEQ ID NO: 612348 - RNA, 19 nt, Homo sapiens
uauauucccucuucuugca

SEQ ID NO: 612349 - RNA, 19 nt, Homo sapiens
gugcagaaucucuauguau

SEQ ID NO: 612350 - RNA, 19 nt, Homo sapiens
gcaggccuuugaugacuuc

SEQ ID NO: 612351 - RNA, 19 nt, Homo sapiens
gaagcccagugcaaaccuu

SEQ ID NO: 612352 - RNA, 19 nt, Homo sapiens
ggaagaauuuugacuccuu

SEQ ID NO: 612353 - RNA, 19 nt, Homo sapiens
ucuggaggcuaaucuguga

SEQ ID NO: 612354 - RNA, 19 nt, Homo sapiens
acgcugauguccucacuga

SEQ ID NO: 612355 - RNA, 19 nt, Homo sapiens
caagaaucccuacaacauc

SEQ ID NO: 612356 - RNA, 19 nt, Homo sapiens
caucaagaaucccuacaac

SEQ ID NO: 612357 - RNA, 19 nt, Homo sapiens
cuccagcccuugcuugaaa

SEQ ID NO: 612358 - RNA, 19 nt, Homo sapiens
aaagagaaggaaucuaaug

SEQ ID NO: 612359 - RNA, 19 nt, Homo sapiens
gggugcagcucuucaaagg

SEQ ID NO: 612360 - RNA, 19 nt, Homo sapiens
ccaugucgcugcccaagag

SEQ ID NO: 612361 - RNA, 19 nt, Homo sapiens
agaugcgaguggacaguua

SEQ ID NO: 612362 - RNA, 19 nt, Homo sapiens
cgaaggcgucugucucuug

SEQ ID NO: 612363 - RNA, 19 nt, Homo sapiens
uggcugaaaugacagugaa

SEQ ID NO: 612364 - RNA, 19 nt, Homo sapiens
gaagaggagagcucagaag

SEQ ID NO: 612365 - RNA, 19 nt, Homo sapiens
ccaacaaguccgaaucaga

SEQ ID NO: 612366 - RNA, 19 nt, Homo sapiens
gagcagcccgaggagcuua

SEQ ID NO: 612367 - RNA, 19 nt, Homo sapiens
gcucugugcuggccuucug

SEQ ID NO: 612368 - RNA, 19 nt, Homo sapiens
caagcagaacuuccaaaga

SEQ ID NO: 612369 - RNA, 19 nt, Homo sapiens
cgcacucucugcccaauga

SEQ ID NO: 612370 - RNA, 19 nt, Homo sapiens
ccacaggugacaauuggaa

SEQ ID NO: 612371 - RNA, 19 nt, Homo sapiens
gaaacccaucggcaacauu

SEQ ID NO: 612372 - RNA, 19 nt, Homo sapiens
uaccaacgcccuagaaauc

SEQ ID NO: 612373 - RNA, 19 nt, Homo sapiens
gaagacaacuugcugauug

SEQ ID NO: 612374 - RNA, 19 nt, Homo sapiens
gaaaggaacccauauugua

SEQ ID NO: 612375 - RNA, 19 nt, Homo sapiens
gaacagagcaccagaguug

SEQ ID NO: 612376 - RNA, 19 nt, Homo sapiens
ggaagacgcuguugguaaa

SEQ ID NO: 612377 - RNA, 19 nt, Homo sapiens
caacaggcauucucgauuu

SEQ ID NO: 612378 - RNA, 19 nt, Homo sapiens
gaugagaccuauuauaugu

SEQ ID NO: 612379 - RNA, 19 nt, Homo sapiens
agaagaagauugaugauga

SEQ ID NO: 612380 - RNA, 19 nt, Homo sapiens
ggacaagccucucuuugau

SEQ ID NO: 612381 - RNA, 19 nt, Homo sapiens
gagauaggguuggaauaua

SEQ ID NO: 612382 - RNA, 19 nt, Homo sapiens
gaggaugacugaagagcua

SEQ ID NO: 612383 - RNA, 19 nt, Homo sapiens
gaaggaagaagaagaagaa

SEQ ID NO: 612384 - RNA, 19 nt, Homo sapiens
gaagaaacgauaccagauu

SEQ ID NO: 612385 - RNA, 19 nt, Homo sapiens
gauaccagauugaggauga

SEQ ID NO: 612386 - RNA, 19 nt, Homo sapiens
gaugaacugugaacuucua

SEQ ID NO: 612387 - RNA, 19 nt, Homo sapiens
ggacuucucugcugucagu

SEQ ID NO: 612388 - RNA, 19 nt, Homo sapiens
gaaggcagcacccaagaaa

SEQ ID NO: 612389 - RNA, 19 nt, Homo sapiens
ggagaaagcucagcagcau

SEQ ID NO: 612390 - RNA, 19 nt, Homo sapiens
ggcgggagcuguacaagaa

SEQ ID NO: 612391 - RNA, 19 nt, Homo sapiens
ugaaugagauggacuuauc

SEQ ID NO: 612392 - RNA, 19 nt, Homo sapiens
gaacuucuagccacaugua

SEQ ID NO: 612393 - RNA, 19 nt, Homo sapiens
gaaaccuucuggcgaauuc

SEQ ID NO: 612394 - RNA, 19 nt, Homo sapiens
gaaccagauugcuuagaga

SEQ ID NO: 612395 - RNA, 19 nt, Homo sapiens
uaaagucccuggagagcaa

SEQ ID NO: 612396 - RNA, 19 nt, Homo sapiens
gcuuaguccuuucaaauga

SEQ ID NO: 612397 - RNA, 19 nt, Homo sapiens
cggagucccugaaagauuu

SEQ ID NO: 612398 - RNA, 19 nt, Homo sapiens
caggguagcuuaguccuuu

SEQ ID NO: 612399 - RNA, 19 nt, Homo sapiens
caaaggaaaggaacccaua

SEQ ID NO: 612400 - RNA, 19 nt, Homo sapiens
ucaaucgucugcuuaguga

SEQ ID NO: 612401 - RNA, 19 nt, Homo sapiens
gaacuauuccuggcacuuu

SEQ ID NO: 612402 - RNA, 19 nt, Homo sapiens
gcucugaguuccuggagaa

SEQ ID NO: 612403 - RNA, 19 nt, Homo sapiens
gaauauaguacucuagaug

SEQ ID NO: 612404 - RNA, 19 nt, Homo sapiens
ggccuuggcuuucuucaug

SEQ ID NO: 612405 - RNA, 19 nt, Homo sapiens
ggaaccagauugcuuagag

SEQ ID NO: 612406 - RNA, 19 nt, Homo sapiens
ggacagagcaguagaaucc

SEQ ID NO: 612407 - RNA, 19 nt, Homo sapiens
ggaaaggaacccauauugu

SEQ ID NO: 612408 - RNA, 19 nt, Homo sapiens
caaaggccuucacaaccua

SEQ ID NO: 612409 - RNA, 19 nt, Homo sapiens
aggaagaucuggaagaaga

SEQ ID NO: 612410 - RNA, 19 nt, Homo sapiens
ugaugaauguguuugcuuu

SEQ ID NO: 612411 - RNA, 19 nt, Homo sapiens
ggagcuccuuagcaaauaa

SEQ ID NO: 612412 - RNA, 19 nt, Homo sapiens
gaaccucaccaacuacuau

SEQ ID NO: 612413 - RNA, 19 nt, Homo sapiens
caacuacuaugagaugaug

SEQ ID NO: 612414 - RNA, 19 nt, Homo sapiens
gaauguguuugcuuugugu

SEQ ID NO: 612415 - RNA, 19 nt, Homo sapiens
agccagagcugcagccuaa

SEQ ID NO: 612416 - RNA, 19 nt, Homo sapiens
gaaacgcuuugcauguuca

SEQ ID NO: 612417 - RNA, 19 nt, Homo sapiens
ggaagaagaagaagaaggu

SEQ ID NO: 612418 - RNA, 19 nt, Homo sapiens
gagagcagccgcaucauca

SEQ ID NO: 612419 - RNA, 19 nt, Homo sapiens
caaccagccuugcucuguu

SEQ ID NO: 612420 - RNA, 19 nt, Homo sapiens
ggaauauaguacucuagau

SEQ ID NO: 612421 - RNA, 19 nt, Homo sapiens
gcaaauaagaggagugagu

SEQ ID NO: 612422 - RNA, 19 nt, Homo sapiens
gauuuaggcugagaaacuu

SEQ ID NO: 612423 - RNA, 19 nt, Homo sapiens
agacauuucuccagaggaa

SEQ ID NO: 612424 - RNA, 19 nt, Homo sapiens
gauugucucccuuauguuu

SEQ ID NO: 612425 - RNA, 19 nt, Homo sapiens
aagaaacgauaccagauug

SEQ ID NO: 612426 - RNA, 19 nt, Homo sapiens
gagcggagucccugaaaga

SEQ ID NO: 612427 - RNA, 19 nt, Homo sapiens
gcaacaggcauucucgauu

SEQ ID NO: 612428 - RNA, 19 nt, Homo sapiens
uguauggacuugcacauga

SEQ ID NO: 612429 - RNA, 19 nt, Homo sapiens
cauguaagauuagaaguuc

SEQ ID NO: 612430 - RNA, 19 nt, Homo sapiens
ggguagagauagacacguu

SEQ ID NO: 612431 - RNA, 19 nt, Homo sapiens
gucaaggacuuccaaagga

SEQ ID NO: 612432 - RNA, 19 nt, Homo sapiens
gaagaagauugaugaugac

SEQ ID NO: 612433 - RNA, 19 nt, Homo sapiens
ucagugaaaccuuguauga

SEQ ID NO: 612434 - RNA, 19 nt, Homo sapiens
guugggagcuccaggaauc

SEQ ID NO: 612435 - RNA, 19 nt, Homo sapiens
uugcagaacuggagguauu

SEQ ID NO: 612436 - RNA, 19 nt, Homo sapiens
ucauuucugucuccuguuu

SEQ ID NO: 612437 - RNA, 19 nt, Homo sapiens
ggcagcagcuucuuugagu

SEQ ID NO: 612438 - RNA, 19 nt, Homo sapiens
ggaagacagcgaagaggaa

SEQ ID NO: 612439 - RNA, 19 nt, Homo sapiens
gagcuguuguucuggaaga

SEQ ID NO: 612440 - RNA, 19 nt, Homo sapiens
cccgagagcuguccauuca

SEQ ID NO: 612441 - RNA, 19 nt, Homo sapiens
ccacugauguauggacuug

SEQ ID NO: 612442 - RNA, 19 nt, Homo sapiens
gagcagaaccucaccaacu

SEQ ID NO: 612443 - RNA, 19 nt, Homo sapiens
uauuggagcuccuuagcaa

SEQ ID NO: 612444 - RNA, 19 nt, Homo sapiens
aauaguggauaaacucuug

SEQ ID NO: 612445 - RNA, 19 nt, Homo sapiens
gcaggaggaagacaacuug

SEQ ID NO: 612446 - RNA, 19 nt, Homo sapiens
gagggagacacuuaccaua

SEQ ID NO: 612447 - RNA, 19 nt, Homo sapiens
gcagccgcaucaucaagaa

SEQ ID NO: 612448 - RNA, 19 nt, Homo sapiens
ggaagacaacuugcugauu

SEQ ID NO: 612449 - RNA, 19 nt, Homo sapiens
ggagcuaccagcagaauag

SEQ ID NO: 612450 - RNA, 19 nt, Homo sapiens
agcagaaccucaccaacua

SEQ ID NO: 612451 - RNA, 19 nt, Homo sapiens
uaagaggagugagugaaau

SEQ ID NO: 612452 - RNA, 19 nt, Homo sapiens
gauugaggaugaugaggau

SEQ ID NO: 612453 - RNA, 19 nt, Homo sapiens
cagcgaagaggaagaagaa

SEQ ID NO: 612454 - RNA, 19 nt, Homo sapiens
gaaaguuugaugagagaug

SEQ ID NO: 612455 - RNA, 19 nt, Homo sapiens
guagugcccuuggguacuu

SEQ ID NO: 612456 - RNA, 19 nt, Homo sapiens
agauuuaguucucuucuuc

SEQ ID NO: 612457 - RNA, 19 nt, Homo sapiens
ugaugaggaugacugaaga

SEQ ID NO: 612458 - RNA, 19 nt, Homo sapiens
guuuggcucucaagacauu

SEQ ID NO: 612459 - RNA, 19 nt, Homo sapiens
ggagaccacccaccucuuc

SEQ ID NO: 612460 - RNA, 19 nt, Homo sapiens
gauggaguaccgagaacua

SEQ ID NO: 612461 - RNA, 19 nt, Homo sapiens
cuacugcuggucagaaaua

SEQ ID NO: 612462 - RNA, 19 nt, Homo sapiens
ugcaggugcuaacuuauuu

SEQ ID NO: 612463 - RNA, 19 nt, Homo sapiens
ggauuuaggcugagaaacu

SEQ ID NO: 612464 - RNA, 19 nt, Homo sapiens
guagcuuaguccuuucaaa

SEQ ID NO: 612465 - RNA, 19 nt, Homo sapiens
cugaaacgcuuugcauguu

SEQ ID NO: 612466 - RNA, 19 nt, Homo sapiens
ggaaccugguggugcagaa

SEQ ID NO: 612467 - RNA, 19 nt, Homo sapiens
caugaugagaccuauuaua

SEQ ID NO: 612468 - RNA, 19 nt, Homo sapiens
ggaccucaucuuucacaaa

SEQ ID NO: 612469 - RNA, 19 nt, Homo sapiens
gagaagaagauugaugaug

SEQ ID NO: 612470 - RNA, 19 nt, Homo sapiens
auaguacucuagaugauga

SEQ ID NO: 612471 - RNA, 19 nt, Homo sapiens
agauaggguuggaauauag

SEQ ID NO: 612472 - RNA, 19 nt, Homo sapiens
ugagauaggguuggaauau

SEQ ID NO: 612473 - RNA, 19 nt, Homo sapiens
gaauuugccuguucuagaa

SEQ ID NO: 612474 - RNA, 19 nt, Homo sapiens
gcauuaagcuguuccuguu

SEQ ID NO: 612475 - RNA, 19 nt, Homo sapiens
caccaugccucacuaauuu

SEQ ID NO: 612476 - RNA, 19 nt, Homo sapiens
gccuaaaccucaguuauua

SEQ ID NO: 612477 - RNA, 19 nt, Homo sapiens
gaauagacccuuacuagga

SEQ ID NO: 612478 - RNA, 19 nt, Homo sapiens
agaagacacugaagaaauu

SEQ ID NO: 612479 - RNA, 19 nt, Homo sapiens
gaaguaggcagaacugaaa

SEQ ID NO: 612480 - RNA, 19 nt, Homo sapiens
ucacgacaaugacacuuua

SEQ ID NO: 612481 - RNA, 19 nt, Homo sapiens
gagaauagacccuuacuag

SEQ ID NO: 612482 - RNA, 19 nt, Homo sapiens
uaggauagcuaacuguaaa

SEQ ID NO: 612483 - RNA, 19 nt, Homo sapiens
gccaccagaucuacaguua

SEQ ID NO: 612484 - RNA, 19 nt, Homo sapiens
gugcugaaacuuagaaaua

SEQ ID NO: 612485 - RNA, 19 nt, Homo sapiens
uacagaagauuacagauga

SEQ ID NO: 612486 - RNA, 19 nt, Homo sapiens
acacagaacuuccugauac

SEQ ID NO: 612487 - RNA, 19 nt, Homo sapiens
ggaccaauguacaguugaa

SEQ ID NO: 612488 - RNA, 19 nt, Homo sapiens
ugagauguuucuucccuua

SEQ ID NO: 612489 - RNA, 19 nt, Homo sapiens
cuucucagguugcuucuua

SEQ ID NO: 612490 - RNA, 19 nt, Homo sapiens
gagaagacacugaagaaau

SEQ ID NO: 612491 - RNA, 19 nt, Homo sapiens
ccaauguacaguugaaaua

SEQ ID NO: 612492 - RNA, 19 nt, Homo sapiens
cauguaauuugaugaggua

SEQ ID NO: 612493 - RNA, 19 nt, Homo sapiens
caaauucagaugagaguaa

SEQ ID NO: 612494 - RNA, 19 nt, Homo sapiens
gaggaccaauguacaguug

SEQ ID NO: 612495 - RNA, 19 nt, Homo sapiens
cagcaaauuuucagcauua

SEQ ID NO: 612496 - RNA, 19 nt, Homo sapiens
gaacaaccucuccagauca

SEQ ID NO: 612497 - RNA, 19 nt, Homo sapiens
uaauauagcugagacuaca

SEQ ID NO: 612498 - RNA, 19 nt, Homo sapiens
cgaacaaccucuccagauc

SEQ ID NO: 612499 - RNA, 19 nt, Homo sapiens
ggacuaaaauguagcaguu

SEQ ID NO: 612500 - RNA, 19 nt, Homo sapiens
gaagauuacagaugaagug

SEQ ID NO: 612501 - RNA, 19 nt, Homo sapiens
gaaauuucuugucgaacau

SEQ ID NO: 612502 - RNA, 19 nt, Homo sapiens
caccuaagaucucgguuug

SEQ ID NO: 612503 - RNA, 19 nt, Homo sapiens
gaacaucugaaaggacuaa

SEQ ID NO: 612504 - RNA, 19 nt, Homo sapiens
ggagugcaguggcgcauuc

SEQ ID NO: 612505 - RNA, 19 nt, Homo sapiens
ggacacccuuguugaaucu

SEQ ID NO: 612506 - RNA, 19 nt, Homo sapiens
ugucgaacaucaaguagaa

SEQ ID NO: 612507 - RNA, 19 nt, Homo sapiens
caccuagccugaugagauu

SEQ ID NO: 612508 - RNA, 19 nt, Homo sapiens
ggccuaaaccucaguuauu

SEQ ID NO: 612509 - RNA, 19 nt, Homo sapiens
aaagcauacuucuaggaua

SEQ ID NO: 612510 - RNA, 19 nt, Homo sapiens
caccucagccucucaagua

SEQ ID NO: 612511 - RNA, 19 nt, Homo sapiens
aauagacccuuacuaggaa

SEQ ID NO: 612512 - RNA, 19 nt, Homo sapiens
aaaccucaguuauuacaug

SEQ ID NO: 612513 - RNA, 19 nt, Homo sapiens
gcauguaaacagccucuuu

SEQ ID NO: 612514 - RNA, 19 nt, Homo sapiens
ccaaagugcugggauuaca

SEQ ID NO: 612515 - RNA, 19 nt, Homo sapiens
gggcauccacugucaugua

SEQ ID NO: 612516 - RNA, 19 nt, Homo sapiens
uaaggucuuucaguacuuu

SEQ ID NO: 612517 - RNA, 19 nt, Homo sapiens
caucuucucuucaacuaca

SEQ ID NO: 612518 - RNA, 19 nt, Homo sapiens
acacagcgccauaguaguu

SEQ ID NO: 612519 - RNA, 19 nt, Homo sapiens
ccaccaugccucacuaauu

SEQ ID NO: 612520 - RNA, 19 nt, Homo sapiens
cauccacacuucucagguu

SEQ ID NO: 612521 - RNA, 19 nt, Homo sapiens
gaagacacugaagaaauuu

SEQ ID NO: 612522 - RNA, 19 nt, Homo sapiens
cagaugaagugcugaaacu

SEQ ID NO: 612523 - RNA, 19 nt, Homo sapiens
guagagaagacacugaaga

SEQ ID NO: 612524 - RNA, 19 nt, Homo sapiens
aaucauagcugagagacau

SEQ ID NO: 612525 - RNA, 19 nt, Homo sapiens
aagcauacuucuaggauag

SEQ ID NO: 612526 - RNA, 19 nt, Homo sapiens
gaaaauaccaucuucucuu

SEQ ID NO: 612527 - RNA, 19 nt, Homo sapiens
ucagguugcuucuuacaca

SEQ ID NO: 612528 - RNA, 19 nt, Homo sapiens
cucagccucucaaguaaua

SEQ ID NO: 612529 - RNA, 19 nt, Homo sapiens
ugggaaaacugccaauaua

SEQ ID NO: 612530 - RNA, 19 nt, Homo sapiens
gauagucgucucuucauca

SEQ ID NO: 612531 - RNA, 19 nt, Homo sapiens
guguauaccugugugagaa

SEQ ID NO: 612532 - RNA, 19 nt, Homo sapiens
cggaagcgcuacgguuuga

SEQ ID NO: 612533 - RNA, 19 nt, Homo sapiens
gaaaacugccaauauagaa

SEQ ID NO: 612534 - RNA, 19 nt, Homo sapiens
ccagaucaaauucagauga

SEQ ID NO: 612535 - RNA, 19 nt, Homo sapiens
uagagaagacacugaagaa

SEQ ID NO: 612536 - RNA, 19 nt, Homo sapiens
ggauagucgucucuucauc

SEQ ID NO: 612537 - RNA, 19 nt, Homo sapiens
cuuaugcucucacuguuug

SEQ ID NO: 612538 - RNA, 19 nt, Homo sapiens
cuucaaauaccaucuaguu

SEQ ID NO: 612539 - RNA, 19 nt, Homo sapiens
ucacauucuuggcuuaauc

SEQ ID NO: 612540 - RNA, 19 nt, Homo sapiens
uggcuguaaucauuuguuu

SEQ ID NO: 612541 - RNA, 19 nt, Homo sapiens
ucaccuagccugaugagau

SEQ ID NO: 612542 - RNA, 19 nt, Homo sapiens
gauacuggaggaacacuug

SEQ ID NO: 612543 - RNA, 19 nt, Homo sapiens
ccacuccauugucguauag

SEQ ID NO: 612544 - RNA, 19 nt, Homo sapiens
uaagaucacguacuguuuc

SEQ ID NO: 612545 - RNA, 19 nt, Homo sapiens
uagcugagacuacaagugu

SEQ ID NO: 612546 - RNA, 19 nt, Homo sapiens
ucuacuaauucuucucuga

SEQ ID NO: 612547 - RNA, 19 nt, Homo sapiens
cauguaccauccagaagga

SEQ ID NO: 612548 - RNA, 19 nt, Homo sapiens
agaacuuccugauacagaa

SEQ ID NO: 612549 - RNA, 19 nt, Homo sapiens
gcaauguaagcauacuuug

SEQ ID NO: 612550 - RNA, 19 nt, Homo sapiens
ugugcaaacucuagugaga

SEQ ID NO: 612551 - RNA, 19 nt, Homo sapiens
ugaauuugccuguucuaga

SEQ ID NO: 612552 - RNA, 19 nt, Homo sapiens
ggucuggacacccuuguug

SEQ ID NO: 612553 - RNA, 19 nt, Homo sapiens
uuagacuacuuacaggaaa

SEQ ID NO: 612554 - RNA, 19 nt, Homo sapiens
uuacacagcgccauaguag

SEQ ID NO: 612555 - RNA, 19 nt, Homo sapiens
ggaaaacugccaauauaga

SEQ ID NO: 612556 - RNA, 19 nt, Homo sapiens
gccggaagcgcuacgguuu

SEQ ID NO: 612557 - RNA, 19 nt, Homo sapiens
aauaccaucuucucuucaa

SEQ ID NO: 612558 - RNA, 19 nt, Homo sapiens
ccaccuaagaucucgguuu

SEQ ID NO: 612559 - RNA, 19 nt, Homo sapiens
ucucugaauuugccuguuc

SEQ ID NO: 612560 - RNA, 19 nt, Homo sapiens
cagaucaaauucagaugag

SEQ ID NO: 612561 - RNA, 19 nt, Homo sapiens
caaccucuccagaucaaau

SEQ ID NO: 612562 - RNA, 19 nt, Homo sapiens
cagcguggccucccaaagu

SEQ ID NO: 612563 - RNA, 19 nt, Homo sapiens
gauagcuaacuguaaauca

SEQ ID NO: 612564 - RNA, 19 nt, Homo sapiens
gagauguuucuucccuuaa

SEQ ID NO: 612565 - RNA, 19 nt, Homo sapiens
ugaaaggacuaaaauguag

SEQ ID NO: 612566 - RNA, 19 nt, Homo sapiens
uaauaaaaccggucacuga

SEQ ID NO: 612567 - RNA, 19 nt, Homo sapiens
ugcaaacucuagugagaug

SEQ ID NO: 612568 - RNA, 19 nt, Homo sapiens
acagaagauuacagaugaa

SEQ ID NO: 612569 - RNA, 19 nt, Homo sapiens
caauguaagcauacuuugu

SEQ ID NO: 612570 - RNA, 19 nt, Homo sapiens
caaacucuagugagauguu

SEQ ID NO: 612571 - RNA, 19 nt, Homo sapiens
gaacugaaaauaccaucuu

SEQ ID NO: 612572 - RNA, 19 nt, Homo sapiens
ucucguagcuucaaauacc

SEQ ID NO: 612573 - RNA, 19 nt, Homo sapiens
gaacucaacuaggguguua

SEQ ID NO: 612574 - RNA, 19 nt, Homo sapiens
gaugaaggauuguagauuu

SEQ ID NO: 612575 - RNA, 19 nt, Homo sapiens
ggaaaggacugcuucagaa

SEQ ID NO: 612576 - RNA, 19 nt, Homo sapiens
gcagaacuccuaagaauuu

SEQ ID NO: 612577 - RNA, 19 nt, Homo sapiens
caacuaggguguuauuuga

SEQ ID NO: 612578 - RNA, 19 nt, Homo sapiens
gauaaagcaucaaaucuug

SEQ ID NO: 612579 - RNA, 19 nt, Homo sapiens
gaacugggcacacuuguaa

SEQ ID NO: 612580 - RNA, 19 nt, Homo sapiens
gagcugaucgcuuuaaaua

SEQ ID NO: 612581 - RNA, 19 nt, Homo sapiens
gggcacacuuguaauguua

SEQ ID NO: 612582 - RNA, 19 nt, Homo sapiens
gaacacaacaaugcaaaua

SEQ ID NO: 612583 - RNA, 19 nt, Homo sapiens
ggacacgacuccaugaaug

SEQ ID NO: 612584 - RNA, 19 nt, Homo sapiens
gaacaucaccuuccucugu

SEQ ID NO: 612585 - RNA, 19 nt, Homo sapiens
uaagagagcugagcauuca

SEQ ID NO: 612586 - RNA, 19 nt, Homo sapiens
gagccaaccugcagaaugu

SEQ ID NO: 612587 - RNA, 19 nt, Homo sapiens
gaaacaagccagaacaaau

SEQ ID NO: 612588 - RNA, 19 nt, Homo sapiens
gagcauucauucugauauu

SEQ ID NO: 612589 - RNA, 19 nt, Homo sapiens
gcugaucgcuuuaaauauc

SEQ ID NO: 612590 - RNA, 19 nt, Homo sapiens
gaauauuucuggcuucuag

SEQ ID NO: 612591 - RNA, 19 nt, Homo sapiens
ugacaacuaugaaggguuu

SEQ ID NO: 612592 - RNA, 19 nt, Homo sapiens
cgagaaagcuauggaguga

SEQ ID NO: 612593 - RNA, 19 nt, Homo sapiens
gaaccagcaaacaauauua

SEQ ID NO: 612594 - RNA, 19 nt, Homo sapiens
ugaagcauguggaauauga

SEQ ID NO: 612595 - RNA, 19 nt, Homo sapiens
gcugauggguagugaagua

SEQ ID NO: 612596 - RNA, 19 nt, Homo sapiens
gcaaaguacuugagcucuu

SEQ ID NO: 612597 - RNA, 19 nt, Homo sapiens
caacugguuucacuugauu

SEQ ID NO: 612598 - RNA, 19 nt, Homo sapiens
gcaaaguacuagauaacug

SEQ ID NO: 612599 - RNA, 19 nt, Homo sapiens
gaacagauuuugaacaguu

SEQ ID NO: 612600 - RNA, 19 nt, Homo sapiens
ggacucaucuaugcauuug

SEQ ID NO: 612601 - RNA, 19 nt, Homo sapiens
gcaccaaccugcagggaau

SEQ ID NO: 612602 - RNA, 19 nt, Homo sapiens
gcacucugcuggaugaaau

SEQ ID NO: 612603 - RNA, 19 nt, Homo sapiens
acagacagaugcugaacua

SEQ ID NO: 612604 - RNA, 19 nt, Homo sapiens
gguguuauuugagaaguua

SEQ ID NO: 612605 - RNA, 19 nt, Homo sapiens
gagucuggguccauuauuu

SEQ ID NO: 612606 - RNA, 19 nt, Homo sapiens
gagccugguugauguguuu

SEQ ID NO: 612607 - RNA, 19 nt, Homo sapiens
guaacugugugcaaggaua

SEQ ID NO: 612608 - RNA, 19 nt, Homo sapiens
gaaaggacugcuucagaaa

SEQ ID NO: 612609 - RNA, 19 nt, Homo sapiens
ggaaaugccucuggcuugu

SEQ ID NO: 612610 - RNA, 19 nt, Homo sapiens
agaaagcuauggagugauu

SEQ ID NO: 612611 - RNA, 19 nt, Homo sapiens
aaacaagccagaacaaauu

SEQ ID NO: 612612 - RNA, 19 nt, Homo sapiens
uccaagagcuuuuagauua

SEQ ID NO: 612613 - RNA, 19 nt, Homo sapiens
aaaccaaacuacccaguau

SEQ ID NO: 612614 - RNA, 19 nt, Homo sapiens
gagcacaacugguuucacu

SEQ ID NO: 612615 - RNA, 19 nt, Homo sapiens
acacagcaguucucacaaa

SEQ ID NO: 612616 - RNA, 19 nt, Homo sapiens
gauuuaaggacguucuuua

SEQ ID NO: 612617 - RNA, 19 nt, Homo sapiens
gcuguugacuucaggacua

SEQ ID NO: 612618 - RNA, 19 nt, Homo sapiens
gaacagccaugggcagcuu

SEQ ID NO: 612619 - RNA, 19 nt, Homo sapiens
ggacguucuuuauuaugaa

SEQ ID NO: 612620 - RNA, 19 nt, Homo sapiens
uggcagaacuccuaagaau

SEQ ID NO: 612621 - RNA, 19 nt, Homo sapiens
gcacaacugguuucacuug

SEQ ID NO: 612622 - RNA, 19 nt, Homo sapiens
cuucucagcuuguccagua

SEQ ID NO: 612623 - RNA, 19 nt, Homo sapiens
ccagcaaaguacuagauaa

SEQ ID NO: 612624 - RNA, 19 nt, Homo sapiens
gguauaaccuguggacuag

SEQ ID NO: 612625 - RNA, 19 nt, Homo sapiens
caaugguguuguucagaua

SEQ ID NO: 612626 - RNA, 19 nt, Homo sapiens
guagugaaguaacucaaau

SEQ ID NO: 612627 - RNA, 19 nt, Homo sapiens
gggagccuauauaaacaua

SEQ ID NO: 612628 - RNA, 19 nt, Homo sapiens
ccacacaucccacuguaaa

SEQ ID NO: 612629 - RNA, 19 nt, Homo sapiens
ggugugugguggcaaagua

SEQ ID NO: 612630 - RNA, 19 nt, Homo sapiens
uacaagaaguuacucaaug

SEQ ID NO: 612631 - RNA, 19 nt, Homo sapiens
gccaugagaaucuauuuaa

SEQ ID NO: 612632 - RNA, 19 nt, Homo sapiens
ggaaacaagccagaacaaa

SEQ ID NO: 612633 - RNA, 19 nt, Homo sapiens
acaagaaguuacucaaugu

SEQ ID NO: 612634 - RNA, 19 nt, Homo sapiens
gcuagaccaucaauaauac

SEQ ID NO: 612635 - RNA, 19 nt, Homo sapiens
ggcuagaccaucaauaaua

SEQ ID NO: 612636 - RNA, 19 nt, Homo sapiens
cgaaauguuuguuuacagu

SEQ ID NO: 612637 - RNA, 19 nt, Homo sapiens
ucucauuccucuauaagaa

SEQ ID NO: 612638 - RNA, 19 nt, Homo sapiens
caaaguacuugagcucuuc

SEQ ID NO: 612639 - RNA, 19 nt, Homo sapiens
ggagaaguuauauaaggua

SEQ ID NO: 612640 - RNA, 19 nt, Homo sapiens
caucuccugucaaggguua

SEQ ID NO: 612641 - RNA, 19 nt, Homo sapiens
ugcaagguguggaauauuu

SEQ ID NO: 612642 - RNA, 19 nt, Homo sapiens
gaagaguucuagagcugau

SEQ ID NO: 612643 - RNA, 19 nt, Homo sapiens
gaaacuuuaucacauucga

SEQ ID NO: 612644 - RNA, 19 nt, Homo sapiens
ccaaaucucaguucaugaa

SEQ ID NO: 612645 - RNA, 19 nt, Homo sapiens
ucaaaucucuugugguuuu

SEQ ID NO: 612646 - RNA, 19 nt, Homo sapiens
ugaaguaacucaaauugcu

SEQ ID NO: 612647 - RNA, 19 nt, Homo sapiens
uaacuucucauuccucuau

SEQ ID NO: 612648 - RNA, 19 nt, Homo sapiens
gcgaucggauucccaucua

SEQ ID NO: 612649 - RNA, 19 nt, Homo sapiens
guacacagccuucucuagu

SEQ ID NO: 612650 - RNA, 19 nt, Homo sapiens
gaacagaagaagcugauac

SEQ ID NO: 612651 - RNA, 19 nt, Homo sapiens
auucaaaucucuugugguu

SEQ ID NO: 612652 - RNA, 19 nt, Homo sapiens
gcacauuauaccaguuuaa

SEQ ID NO: 612653 - RNA, 19 nt, Homo sapiens
gcuccaaauacgagaauua

SEQ ID NO: 612654 - RNA, 19 nt, Homo sapiens
cagaacuccuaagaauuua

SEQ ID NO: 612655 - RNA, 19 nt, Homo sapiens
cagcagcucucaaacucuu

SEQ ID NO: 612656 - RNA, 19 nt, Homo sapiens
acacaacaaugcaaauaca

SEQ ID NO: 612657 - RNA, 19 nt, Homo sapiens
gugcccagguuaauacaaa

SEQ ID NO: 612658 - RNA, 19 nt, Homo sapiens
ccucuucccuaauugcuaa

SEQ ID NO: 612659 - RNA, 19 nt, Homo sapiens
gcuacaugauucccugaaa

SEQ ID NO: 612660 - RNA, 19 nt, Homo sapiens
ucucagcacuccaugauuc

SEQ ID NO: 612661 - RNA, 19 nt, Homo sapiens
gaauggaaguuuucuugaa

SEQ ID NO: 612662 - RNA, 19 nt, Homo sapiens
gcucauccuugucccuuug

SEQ ID NO: 612663 - RNA, 19 nt, Homo sapiens
gcagagcagcuuagcauuc

SEQ ID NO: 612664 - RNA, 19 nt, Homo sapiens
gaacuccuaagaauuuaug

SEQ ID NO: 612665 - RNA, 19 nt, Homo sapiens
gggauuguauagcaguaaa

SEQ ID NO: 612666 - RNA, 19 nt, Homo sapiens
ggccacacaucccacugua

SEQ ID NO: 612667 - RNA, 19 nt, Homo sapiens
caugauucccugaaagaua

SEQ ID NO: 612668 - RNA, 19 nt, Homo sapiens
cauuggcucucuacaagaa

SEQ ID NO: 612669 - RNA, 19 nt, Homo sapiens
gaucuccacuucccauugg

SEQ ID NO: 612670 - RNA, 19 nt, Homo sapiens
gagcugagcauucauucug

SEQ ID NO: 612671 - RNA, 19 nt, Homo sapiens
uaucacagcagcucucaaa

SEQ ID NO: 612672 - RNA, 19 nt, Homo sapiens
gaaguuuacacaugugguu

SEQ ID NO: 612673 - RNA, 19 nt, Homo sapiens
ggucagaacuguagaaaua

SEQ ID NO: 612674 - RNA, 19 nt, Homo sapiens
ggaaugaaaugguuaaaga

SEQ ID NO: 612675 - RNA, 19 nt, Homo sapiens
ggaaauaacuguguaacaa

SEQ ID NO: 612676 - RNA, 19 nt, Homo sapiens
ggaaugggcucaucaacaa

SEQ ID NO: 612677 - RNA, 19 nt, Homo sapiens
ggaaagcacuggauucguu

SEQ ID NO: 612678 - RNA, 19 nt, Homo sapiens
ggaagaaggugauugaugu

SEQ ID NO: 612679 - RNA, 19 nt, Homo sapiens
gcaagaggcuggagcugua

SEQ ID NO: 612680 - RNA, 19 nt, Homo sapiens
ggaagaagaucgugcaugu

SEQ ID NO: 612681 - RNA, 19 nt, Homo sapiens
gaagguggcuguucacuca

SEQ ID NO: 612682 - RNA, 19 nt, Homo sapiens
gaaaguagcugugaacucu

SEQ ID NO: 612683 - RNA, 19 nt, Homo sapiens
gaucuuagcugugcauuug

SEQ ID NO: 612684 - RNA, 19 nt, Homo sapiens
cuaaagaacuccucucuga

SEQ ID NO: 612685 - RNA, 19 nt, Homo sapiens
guaaugaccucucuauaau

SEQ ID NO: 612686 - RNA, 19 nt, Homo sapiens
caucauaacuucuaucaug

SEQ ID NO: 612687 - RNA, 19 nt, Homo sapiens
gaggauagcucaaaagaua

SEQ ID NO: 612688 - RNA, 19 nt, Homo sapiens
gguuaaagauggagaaauu

SEQ ID NO: 612689 - RNA, 19 nt, Homo sapiens
gagcugauuucuugaguaa

SEQ ID NO: 612690 - RNA, 19 nt, Homo sapiens
ggacagagauggauugcau

SEQ ID NO: 612691 - RNA, 19 nt, Homo sapiens
gaaauuguauacacuggaa

SEQ ID NO: 612692 - RNA, 19 nt, Homo sapiens
gcucaggaaucgauuguaa

SEQ ID NO: 612693 - RNA, 19 nt, Homo sapiens
uuacagguguucacaaaua

SEQ ID NO: 612694 - RNA, 19 nt, Homo sapiens
gaaauacuaugccaaugug

SEQ ID NO: 612695 - RNA, 19 nt, Homo sapiens
ccaaauggcuucagucauc

SEQ ID NO: 612696 - RNA, 19 nt, Homo sapiens
gaagguguaugauauaaag

SEQ ID NO: 612697 - RNA, 19 nt, Homo sapiens
gcaaugaagugaacauaag

SEQ ID NO: 612698 - RNA, 19 nt, Homo sapiens
gacgaaagauggccaaguu

SEQ ID NO: 612699 - RNA, 19 nt, Homo sapiens
gcauacauuuggcagaaua

SEQ ID NO: 612700 - RNA, 19 nt, Homo sapiens
caucaugucuggacuuuga

SEQ ID NO: 612701 - RNA, 19 nt, Homo sapiens
ccaaauccauggcaagaaa

SEQ ID NO: 612702 - RNA, 19 nt, Homo sapiens
ggaaucagcagcuacgaua

SEQ ID NO: 612703 - RNA, 19 nt, Homo sapiens
guuguuauguugccucuua

SEQ ID NO: 612704 - RNA, 19 nt, Homo sapiens
ggugaaaggucuuccagaa

SEQ ID NO: 612705 - RNA, 19 nt, Homo sapiens
gaagauaccaggugcagaa

SEQ ID NO: 612706 - RNA, 19 nt, Homo sapiens
cagcaggccuuaucgcaua

SEQ ID NO: 612707 - RNA, 19 nt, Homo sapiens
cagaaacugugaugacuuu

SEQ ID NO: 612708 - RNA, 19 nt, Homo sapiens
ggagguggcuuacauugug

SEQ ID NO: 612709 - RNA, 19 nt, Homo sapiens
guaggacuguguuuacuaa

SEQ ID NO: 612710 - RNA, 19 nt, Homo sapiens
cugaaaggcuccaagauaa

SEQ ID NO: 612711 - RNA, 19 nt, Homo sapiens
gaagggauagauacaauuu

SEQ ID NO: 612712 - RNA, 19 nt, Homo sapiens
gaaaggaacgggaugauca

SEQ ID NO: 612713 - RNA, 19 nt, Homo sapiens
gcagaugugugcuaagaug

SEQ ID NO: 612714 - RNA, 19 nt, Homo sapiens
gaauugaaguggucgaugu

SEQ ID NO: 612715 - RNA, 19 nt, Homo sapiens
gcggaagccucauuagaaa

SEQ ID NO: 612716 - RNA, 19 nt, Homo sapiens
uaccagcacuauuaacuua

SEQ ID NO: 612717 - RNA, 19 nt, Homo sapiens
ugagauuccucuuuaauga

SEQ ID NO: 612718 - RNA, 19 nt, Homo sapiens
ggaugaucaugaagaguua

SEQ ID NO: 612719 - RNA, 19 nt, Homo sapiens
cagcauguguuuauuaaga

SEQ ID NO: 612720 - RNA, 19 nt, Homo sapiens
guagugcucuugcugcuuu

SEQ ID NO: 612721 - RNA, 19 nt, Homo sapiens
gcugaaaggcuccaagaua

SEQ ID NO: 612722 - RNA, 19 nt, Homo sapiens
ggaacgggaugaucaugaa

SEQ ID NO: 612723 - RNA, 19 nt, Homo sapiens
acaacgagcuugccauuga

SEQ ID NO: 612724 - RNA, 19 nt, Homo sapiens
caacauugcuugaauccau

SEQ ID NO: 612725 - RNA, 19 nt, Homo sapiens
ccaaaucgcccuucucuug

SEQ ID NO: 612726 - RNA, 19 nt, Homo sapiens
ggacuggguugcuaucaga

SEQ ID NO: 612727 - RNA, 19 nt, Homo sapiens
ugaaaugccucguggagaa

SEQ ID NO: 612728 - RNA, 19 nt, Homo sapiens
gggaaccucuuacugauug

SEQ ID NO: 612729 - RNA, 19 nt, Homo sapiens
cgaagagagugauuuagaa

SEQ ID NO: 612730 - RNA, 19 nt, Homo sapiens
ggucgucgauucaugauug

SEQ ID NO: 612731 - RNA, 19 nt, Homo sapiens
gagaagcguuuccugauuc

SEQ ID NO: 612732 - RNA, 19 nt, Homo sapiens
cgaugaagguuugguauuu

SEQ ID NO: 612733 - RNA, 19 nt, Homo sapiens
gaagaaacaaggaaggaaa

SEQ ID NO: 612734 - RNA, 19 nt, Homo sapiens
cagaaucuauggaugauga

SEQ ID NO: 612735 - RNA, 19 nt, Homo sapiens
gcaacacagucgugaaaga

SEQ ID NO: 612736 - RNA, 19 nt, Homo sapiens
gaacugaaggagugucuuu

SEQ ID NO: 612737 - RNA, 19 nt, Homo sapiens
gaaacaagagcuuugaguu

SEQ ID NO: 612738 - RNA, 19 nt, Homo sapiens
gcagcuacguggucaagaa

SEQ ID NO: 612739 - RNA, 19 nt, Homo sapiens
caagauuggugauaaagug

SEQ ID NO: 612740 - RNA, 19 nt, Homo sapiens
guggacaucugcucaauga

SEQ ID NO: 612741 - RNA, 19 nt, Homo sapiens
cgaaagauggccaaguuua

SEQ ID NO: 612742 - RNA, 19 nt, Homo sapiens
cauggaaaguguacuauau

SEQ ID NO: 612743 - RNA, 19 nt, Homo sapiens
gagaaaagaugcccucuga

SEQ ID NO: 612744 - RNA, 19 nt, Homo sapiens
aaaggcaguuugaauauga

SEQ ID NO: 612745 - RNA, 19 nt, Homo sapiens
gauaagaaccaagguguuu

SEQ ID NO: 612746 - RNA, 19 nt, Homo sapiens
ggagaggacggauggauaa

SEQ ID NO: 612747 - RNA, 19 nt, Homo sapiens
ggagaaccauaauaaagau

SEQ ID NO: 612748 - RNA, 19 nt, Homo sapiens
gaaagaagaucugaaugac

SEQ ID NO: 612749 - RNA, 19 nt, Homo sapiens
gaaacguccucgugagaug

SEQ ID NO: 612750 - RNA, 19 nt, Homo sapiens
gauaauacgacacagcuaa

SEQ ID NO: 612751 - RNA, 19 nt, Homo sapiens
gaugucagauguuuccuau

SEQ ID NO: 612752 - RNA, 19 nt, Homo sapiens
caagagacccauugcaauu

SEQ ID NO: 612753 - RNA, 19 nt, Homo sapiens
aaacgaagagagugauuua

SEQ ID NO: 612754 - RNA, 19 nt, Homo sapiens
gccagaaccugcagcauug

SEQ ID NO: 612755 - RNA, 19 nt, Homo sapiens
gaaagauggccaaguuuau

SEQ ID NO: 612756 - RNA, 19 nt, Homo sapiens
aagaagaucugaaugacaa

SEQ ID NO: 612757 - RNA, 19 nt, Homo sapiens
gaacaaagaaagaagaucu

SEQ ID NO: 612758 - RNA, 19 nt, Homo sapiens
ucagugagguugauaagga

SEQ ID NO: 612759 - RNA, 19 nt, Homo sapiens
gcugauuucuugaguaaug

SEQ ID NO: 612760 - RNA, 19 nt, Homo sapiens
gaaggaacaucgaguuugc

SEQ ID NO: 612761 - RNA, 19 nt, Homo sapiens
gaacagaaucaacccagaa

SEQ ID NO: 612762 - RNA, 19 nt, Homo sapiens
gaauugagaccugcuguuu

SEQ ID NO: 612763 - RNA, 19 nt, Homo sapiens
cauuaagacucaucaagaa

SEQ ID NO: 612764 - RNA, 19 nt, Homo sapiens
gggaagguguaugauauaa

SEQ ID NO: 612765 - RNA, 19 nt, Homo sapiens
aaacaucgcuucucagacu

SEQ ID NO: 612766 - RNA, 19 nt, Homo sapiens
gcaaguccauagacacaga

SEQ ID NO: 612767 - RNA, 19 nt, Homo sapiens
ggaaugcggaucccaguuu

SEQ ID NO: 612768 - RNA, 19 nt, Homo sapiens
ugaaggccauauuugauaa

SEQ ID NO: 612769 - RNA, 19 nt, Homo sapiens
cguuugagauuccucuuua

SEQ ID NO: 612770 - RNA, 19 nt, Homo sapiens
gaaccaaguggaacaaaga

SEQ ID NO: 612771 - RNA, 19 nt, Homo sapiens
gggcagaugugugcuaaga

SEQ ID NO: 612772 - RNA, 19 nt, Homo sapiens
gaaaagagagagauuguuu

SEQ ID NO: 612773 - RNA, 19 nt, Homo sapiens
gugaauaucuggcaaguua

SEQ ID NO: 612774 - RNA, 19 nt, Homo sapiens
gaacaggccuaacaucuga

SEQ ID NO: 612775 - RNA, 19 nt, Homo sapiens
ggaaauaguucaacacaga

SEQ ID NO: 612776 - RNA, 19 nt, Homo sapiens
gaacagaccguuggacuua

SEQ ID NO: 612777 - RNA, 19 nt, Homo sapiens
gcagucaccuggagacaua

SEQ ID NO: 612778 - RNA, 19 nt, Homo sapiens
gaagagaaagguaaacaua

SEQ ID NO: 612779 - RNA, 19 nt, Homo sapiens
gaaaguaugucuacaaguc

SEQ ID NO: 612780 - RNA, 19 nt, Homo sapiens
ggaaauaccucuaacaaaa

SEQ ID NO: 612781 - RNA, 19 nt, Homo sapiens
ugaagaagcugaaauggaa

SEQ ID NO: 612782 - RNA, 19 nt, Homo sapiens
gcaccgaccuuauugugua

SEQ ID NO: 612783 - RNA, 19 nt, Homo sapiens
gaagggauguccuggauug

SEQ ID NO: 612784 - RNA, 19 nt, Homo sapiens
gaacuuguauuucuaaugg

SEQ ID NO: 612785 - RNA, 19 nt, Homo sapiens
gacaagaccugaccaguga

SEQ ID NO: 612786 - RNA, 19 nt, Homo sapiens
gggauuagcugaucuggaa

SEQ ID NO: 612787 - RNA, 19 nt, Homo sapiens
ugaaauugcugucuaugua

SEQ ID NO: 612788 - RNA, 19 nt, Homo sapiens
uagauuagcuucugaguug

SEQ ID NO: 612789 - RNA, 19 nt, Homo sapiens
ugaaagcccugauaauuug

SEQ ID NO: 612790 - RNA, 19 nt, Homo sapiens
guagucaguugaagaauuu

SEQ ID NO: 612791 - RNA, 19 nt, Homo sapiens
gaaauggcuugaacacuug

SEQ ID NO: 612792 - RNA, 19 nt, Homo sapiens
aaacuaggcuuaggaaauu

SEQ ID NO: 612793 - RNA, 19 nt, Homo sapiens
caaacaugcuauucagaua

SEQ ID NO: 612794 - RNA, 19 nt, Homo sapiens
gcaagaagacggugaagaa

SEQ ID NO: 612795 - RNA, 19 nt, Homo sapiens
gaaagugaguggcuuagau

SEQ ID NO: 612796 - RNA, 19 nt, Homo sapiens
ccaaauagcgagacaagua

SEQ ID NO: 612797 - RNA, 19 nt, Homo sapiens
gaaaggcccucuggaguug

SEQ ID NO: 612798 - RNA, 19 nt, Homo sapiens
gcaguagacuuucaacuuc

SEQ ID NO: 612799 - RNA, 19 nt, Homo sapiens
ggaaggaggcaaaguuuaa

SEQ ID NO: 612800 - RNA, 19 nt, Homo sapiens
caauaaugcucacuucuga

SEQ ID NO: 612801 - RNA, 19 nt, Homo sapiens
ugaaauggcuugaacacuu

SEQ ID NO: 612802 - RNA, 19 nt, Homo sapiens
caacagcauucuucacauu

SEQ ID NO: 612803 - RNA, 19 nt, Homo sapiens
gaacagcacaucccauuau

SEQ ID NO: 612804 - RNA, 19 nt, Homo sapiens
gaaaggaggcauuguucua

SEQ ID NO: 612805 - RNA, 19 nt, Homo sapiens
gaaaggaugugucuguuac

SEQ ID NO: 612806 - RNA, 19 nt, Homo sapiens
gcugaggacucuuugcaua

SEQ ID NO: 612807 - RNA, 19 nt, Homo sapiens
gacccaagcuuauugaaga

SEQ ID NO: 612808 - RNA, 19 nt, Homo sapiens
gaacgugagucucuuucaa

SEQ ID NO: 612809 - RNA, 19 nt, Homo sapiens
uugaacagcuccuggauua

SEQ ID NO: 612810 - RNA, 19 nt, Homo sapiens
ggaaauugaucuugaugau

SEQ ID NO: 612811 - RNA, 19 nt, Homo sapiens
gaaauuugcucuucagacu

SEQ ID NO: 612812 - RNA, 19 nt, Homo sapiens
acuaauggcugaaggauaa

SEQ ID NO: 612813 - RNA, 19 nt, Homo sapiens
gaagaagacugggacaugu

SEQ ID NO: 612814 - RNA, 19 nt, Homo sapiens
gggacaagcuccagaucua

SEQ ID NO: 612815 - RNA, 19 nt, Homo sapiens
caagagaacaccacaguuu

SEQ ID NO: 612816 - RNA, 19 nt, Homo sapiens
ccacagguccuauuacuaa

SEQ ID NO: 612817 - RNA, 19 nt, Homo sapiens
gaggagaguuuccaugaga

SEQ ID NO: 612818 - RNA, 19 nt, Homo sapiens
gaacaaaggaaccacuuga

SEQ ID NO: 612819 - RNA, 19 nt, Homo sapiens
gcagaaaccugagagugaa

SEQ ID NO: 612820 - RNA, 19 nt, Homo sapiens
gaucagagcagcuaagaga

SEQ ID NO: 612821 - RNA, 19 nt, Homo sapiens
ggugguaauugaaacuuua

SEQ ID NO: 612822 - RNA, 19 nt, Homo sapiens
ggagagggccauugaauau

SEQ ID NO: 612823 - RNA, 19 nt, Homo sapiens
ccaaguuucucaccaguuu

SEQ ID NO: 612824 - RNA, 19 nt, Homo sapiens
gaagcaauauucacugcaa

SEQ ID NO: 612825 - RNA, 19 nt, Homo sapiens
ucaacaagcugaagaaagu

SEQ ID NO: 612826 - RNA, 19 nt, Homo sapiens
gagcaaagaggaagagaaa

SEQ ID NO: 612827 - RNA, 19 nt, Homo sapiens
ccaauaaucagucaacuuu

SEQ ID NO: 612828 - RNA, 19 nt, Homo sapiens
caaagauggucauguguau

SEQ ID NO: 612829 - RNA, 19 nt, Homo sapiens
cggcauggaugaacaaauu

SEQ ID NO: 612830 - RNA, 19 nt, Homo sapiens
gaauguuucucaaccacua

SEQ ID NO: 612831 - RNA, 19 nt, Homo sapiens
ggaaaaggauuaguagaua

SEQ ID NO: 612832 - RNA, 19 nt, Homo sapiens
gcacagacuccuccaauau

SEQ ID NO: 612833 - RNA, 19 nt, Homo sapiens
gaaauguucuucagguauc

SEQ ID NO: 612834 - RNA, 19 nt, Homo sapiens
uaaacugagucccaaagua

SEQ ID NO: 612835 - RNA, 19 nt, Homo sapiens
ccagguagcugugcauaaa

SEQ ID NO: 612836 - RNA, 19 nt, Homo sapiens
gaaagguaguuguuugugu

SEQ ID NO: 612837 - RNA, 19 nt, Homo sapiens
gaucagcuuugacugcuuu

SEQ ID NO: 612838 - RNA, 19 nt, Homo sapiens
gagaagaaguggugcagau

SEQ ID NO: 612839 - RNA, 19 nt, Homo sapiens
uggaagaaauguaauggua

SEQ ID NO: 612840 - RNA, 19 nt, Homo sapiens
ggcagaagcuggaagaaau

SEQ ID NO: 612841 - RNA, 19 nt, Homo sapiens
ggcaaauguucucuaguua

SEQ ID NO: 612842 - RNA, 19 nt, Homo sapiens
aaagagagcauugggauua

SEQ ID NO: 612843 - RNA, 19 nt, Homo sapiens
caaacaagcaucacauuga

SEQ ID NO: 612844 - RNA, 19 nt, Homo sapiens
ugacugcacuggagggaua

SEQ ID NO: 612845 - RNA, 19 nt, Homo sapiens
gaaugggccugguuagaau

SEQ ID NO: 612846 - RNA, 19 nt, Homo sapiens
uggaucagcuguuguguaa

SEQ ID NO: 612847 - RNA, 19 nt, Homo sapiens
gcaagagauugaucaacaa

SEQ ID NO: 612848 - RNA, 19 nt, Homo sapiens
gaacagacucucacauugu

SEQ ID NO: 612849 - RNA, 19 nt, Homo sapiens
aaacaagcaucacauugaa

SEQ ID NO: 612850 - RNA, 19 nt, Homo sapiens
gggcagaacuucguuuaga

SEQ ID NO: 612851 - RNA, 19 nt, Homo sapiens
gguaaacacuuaucagaag

SEQ ID NO: 612852 - RNA, 19 nt, Homo sapiens
gcagagaaauaaagcagau

SEQ ID NO: 612853 - RNA, 19 nt, Homo sapiens
caaagaagacagugugaaa

SEQ ID NO: 612854 - RNA, 19 nt, Homo sapiens
aaagcuaacuggugaagaa

SEQ ID NO: 612855 - RNA, 19 nt, Homo sapiens
gugaaagcccugauaauuu

SEQ ID NO: 612856 - RNA, 19 nt, Homo sapiens
gaaggagacuuuggaagau

SEQ ID NO: 612857 - RNA, 19 nt, Homo sapiens
gaagagguuugcagaaugg

SEQ ID NO: 612858 - RNA, 19 nt, Homo sapiens
cacuuuaggucguagauua

SEQ ID NO: 612859 - RNA, 19 nt, Homo sapiens
gaauaucgacuucaugaga

SEQ ID NO: 612860 - RNA, 19 nt, Homo sapiens
caacauggcaacuaugauu

SEQ ID NO: 612861 - RNA, 19 nt, Homo sapiens
ggaugaacuuguauuucua

SEQ ID NO: 612862 - RNA, 19 nt, Homo sapiens
gaguaucaguggcaaauau

SEQ ID NO: 612863 - RNA, 19 nt, Homo sapiens
gcacagacaccaguuacua

SEQ ID NO: 612864 - RNA, 19 nt, Homo sapiens
ccaaugggaugaagcagaa

SEQ ID NO: 612865 - RNA, 19 nt, Homo sapiens
gagaagggauguccuggau

SEQ ID NO: 612866 - RNA, 19 nt, Homo sapiens
ggucagaauuguaccuuug

SEQ ID NO: 612867 - RNA, 19 nt, Homo sapiens
gagaaguacuuagccauga

SEQ ID NO: 612868 - RNA, 19 nt, Homo sapiens
uguagaagaugaucaaaug

SEQ ID NO: 612869 - RNA, 19 nt, Homo sapiens
gcaggaagcagauugaguu

SEQ ID NO: 612870 - RNA, 19 nt, Homo sapiens
ggagaaagccgauaucaac

SEQ ID NO: 612871 - RNA, 19 nt, Homo sapiens
gauaucauccugacaaguu

SEQ ID NO: 612872 - RNA, 19 nt, Homo sapiens
gcagaaguggguuacaaua

SEQ ID NO: 612873 - RNA, 19 nt, Homo sapiens
gaaauuguguagaguguuu

SEQ ID NO: 612874 - RNA, 19 nt, Homo sapiens
cgucauaccuuuaucuaua

SEQ ID NO: 612875 - RNA, 19 nt, Homo sapiens
ucagaaagaucaagccaaa

SEQ ID NO: 612876 - RNA, 19 nt, Homo sapiens
caaugcgucuugugaaauu

SEQ ID NO: 612877 - RNA, 19 nt, Homo sapiens
gcaaguaccugugguggau

SEQ ID NO: 612878 - RNA, 19 nt, Homo sapiens
ugaauuugauccucuguga

SEQ ID NO: 612879 - RNA, 19 nt, Homo sapiens
gaccuuagcauacuguuga

SEQ ID NO: 612880 - RNA, 19 nt, Homo sapiens
ccaccaagaccuuagcaua

SEQ ID NO: 612881 - RNA, 19 nt, Homo sapiens
uuaaagccauauuggagua

SEQ ID NO: 612882 - RNA, 19 nt, Homo sapiens
ugagauguauccugcaaga

SEQ ID NO: 612883 - RNA, 19 nt, Homo sapiens
gcauagagcaauuaaacug

SEQ ID NO: 612884 - RNA, 19 nt, Homo sapiens
gaaagaucaagccaaagaa

SEQ ID NO: 612885 - RNA, 19 nt, Homo sapiens
gacuauagaaugagaugua

SEQ ID NO: 612886 - RNA, 19 nt, Homo sapiens
ucagaagcaucaaguuuua

SEQ ID NO: 612887 - RNA, 19 nt, Homo sapiens
gacauuggauuugguggaa

SEQ ID NO: 612888 - RNA, 19 nt, Homo sapiens
ugacaagcauaugaauuug

SEQ ID NO: 612889 - RNA, 19 nt, Homo sapiens
gcaaccagagcgugaagaa

SEQ ID NO: 612890 - RNA, 19 nt, Homo sapiens
agaaagaucaagccaaaga

SEQ ID NO: 612891 - RNA, 19 nt, Homo sapiens
gcagcacauugacuauaga

SEQ ID NO: 612892 - RNA, 19 nt, Homo sapiens
cagcuugcauuguuucuag

SEQ ID NO: 612893 - RNA, 19 nt, Homo sapiens
gagacgaacuacagaacag

SEQ ID NO: 612894 - RNA, 19 nt, Homo sapiens
gcacguaccagagguggaa

SEQ ID NO: 612895 - RNA, 19 nt, Homo sapiens
guagaguguuugugagcuu

SEQ ID NO: 612896 - RNA, 19 nt, Homo sapiens
ugugaugaguucagaaaga

SEQ ID NO: 612897 - RNA, 19 nt, Homo sapiens
gugaaauuguguagagugu

SEQ ID NO: 612898 - RNA, 19 nt, Homo sapiens
caaagauacuggcauugcu

SEQ ID NO: 612899 - RNA, 19 nt, Homo sapiens
gugaugaguucagaaagau

SEQ ID NO: 612900 - RNA, 19 nt, Homo sapiens
ggaguagcgaggaaucuga

SEQ ID NO: 612901 - RNA, 19 nt, Homo sapiens
ugcaaugcgucuugugaaa

SEQ ID NO: 612902 - RNA, 19 nt, Homo sapiens
agaggugguuaaagccaua

SEQ ID NO: 612903 - RNA, 19 nt, Homo sapiens
gaacugaggcaggcauucu

SEQ ID NO: 612904 - RNA, 19 nt, Homo sapiens
caagucaaacgcagaagga

SEQ ID NO: 612905 - RNA, 19 nt, Homo sapiens
gacaagcauaugaauuuga

SEQ ID NO: 612906 - RNA, 19 nt, Homo sapiens
guucccucauucugcauua

SEQ ID NO: 612907 - RNA, 19 nt, Homo sapiens
gcaaugcgucuugugaaau

SEQ ID NO: 612908 - RNA, 19 nt, Homo sapiens
gggaagaggcacuguagca

SEQ ID NO: 612909 - RNA, 19 nt, Homo sapiens
gggagaacuugguauccau

SEQ ID NO: 612910 - RNA, 19 nt, Homo sapiens
gaugaguucagaaagauca

SEQ ID NO: 612911 - RNA, 19 nt, Homo sapiens
gauccucugugauugugau

SEQ ID NO: 612912 - RNA, 19 nt, Homo sapiens
aaucuucauuggcaccuuu

SEQ ID NO: 612913 - RNA, 19 nt, Homo sapiens
gguggaacagcaaucauga

SEQ ID NO: 612914 - RNA, 19 nt, Homo sapiens
gaacuugguauccaugacu

SEQ ID NO: 612915 - RNA, 19 nt, Homo sapiens
gucauaccuuuaucuauag

SEQ ID NO: 612916 - RNA, 19 nt, Homo sapiens
cccaugggcccaccaauug

SEQ ID NO: 612917 - RNA, 19 nt, Homo sapiens
ggaccaucccagcagguaa

SEQ ID NO: 612918 - RNA, 19 nt, Homo sapiens
aaugagauguauccugcaa

SEQ ID NO: 612919 - RNA, 19 nt, Homo sapiens
cugcccagcuugcauuguu

SEQ ID NO: 612920 - RNA, 19 nt, Homo sapiens
aauuugauccucugugauu

SEQ ID NO: 612921 - RNA, 19 nt, Homo sapiens
uaacuguggacauuggauu

SEQ ID NO: 612922 - RNA, 19 nt, Homo sapiens
aggaaugcguccaccaaga

SEQ ID NO: 612923 - RNA, 19 nt, Homo sapiens
gagaacuugguauccauga

SEQ ID NO: 612924 - RNA, 19 nt, Homo sapiens
gaagcaaccagagcgugaa

SEQ ID NO: 612925 - RNA, 19 nt, Homo sapiens
gccaaagaaugcgaagcaa

SEQ ID NO: 612926 - RNA, 19 nt, Homo sapiens
ucacugagcaaccaagagu

SEQ ID NO: 612927 - RNA, 19 nt, Homo sapiens
gauggccgaaucuucauug

SEQ ID NO: 612928 - RNA, 19 nt, Homo sapiens
gcauacuguugauccaucu

SEQ ID NO: 612929 - RNA, 19 nt, Homo sapiens
ccaagaccuuagcauacug

SEQ ID NO: 612930 - RNA, 19 nt, Homo sapiens
ggcaagggaucgcuuacac

SEQ ID NO: 612931 - RNA, 19 nt, Homo sapiens
agauguauccugcaagaug

SEQ ID NO: 612932 - RNA, 19 nt, Homo sapiens
uagaguguuugugagcuuu

SEQ ID NO: 612933 - RNA, 19 nt, Homo sapiens
ggaaugcguccaccaagac

SEQ ID NO: 612934 - RNA, 19 nt, Homo sapiens
aaagaucaagccaaagaau

SEQ ID NO: 612935 - RNA, 19 nt, Homo sapiens
aaguaccugugguggauuu

SEQ ID NO: 612936 - RNA, 19 nt, Homo sapiens
uggcaagaguagcaagaug

SEQ ID NO: 612937 - RNA, 19 nt, Homo sapiens
cccucauucugcauuaaua

SEQ ID NO: 612938 - RNA, 19 nt, Homo sapiens
gcucgagggacgccaauag

SEQ ID NO: 612939 - RNA, 19 nt, Homo sapiens
gaccaucccagcagguaau

SEQ ID NO: 612940 - RNA, 19 nt, Homo sapiens
caaccagagcgugaagaaa

SEQ ID NO: 612941 - RNA, 19 nt, Homo sapiens
ccucauucugcauuaauaa

SEQ ID NO: 612942 - RNA, 19 nt, Homo sapiens
ccaggaaugcguccaccaa

SEQ ID NO: 612943 - RNA, 19 nt, Homo sapiens
ugcagcacauugacuauag

SEQ ID NO: 612944 - RNA, 19 nt, Homo sapiens
gcgggcaagggaucgcuua

SEQ ID NO: 612945 - RNA, 19 nt, Homo sapiens
caccaagaccuuagcauac

SEQ ID NO: 612946 - RNA, 19 nt, Homo sapiens
ccugcaagauggccgaauc

SEQ ID NO: 612947 - RNA, 19 nt, Homo sapiens
cuugugaaauuguguagag

SEQ ID NO: 612948 - RNA, 19 nt, Homo sapiens
ggcagcugguagaggagua

SEQ ID NO: 612949 - RNA, 19 nt, Homo sapiens
cauagagcaauuaaacugu

SEQ ID NO: 612950 - RNA, 19 nt, Homo sapiens
ccaaagauacuggcauugc

SEQ ID NO: 612951 - RNA, 19 nt, Homo sapiens
cauuggauuugguggaaca

SEQ ID NO: 612952 - RNA, 19 nt, Homo sapiens
agaaggacugccucacuga

SEQ ID NO: 612953 - RNA, 19 nt, Homo sapiens
acugaggcaggcauucuua

SEQ ID NO: 612954 - RNA, 19 nt, Homo sapiens
gaauuugauccucugugau

SEQ ID NO: 612955 - RNA, 19 nt, Homo sapiens
ggugguuaaagccauauug

SEQ ID NO: 612956 - RNA, 19 nt, Homo sapiens
cagggaagaggcacuguag

SEQ ID NO: 612957 - RNA, 19 nt, Homo sapiens
ugauugugaugaguucaga

SEQ ID NO: 612958 - RNA, 19 nt, Homo sapiens
uuacaccugagacgaacua

SEQ ID NO: 612959 - RNA, 19 nt, Homo sapiens
guucucagcagcagcaagu

SEQ ID NO: 612960 - RNA, 19 nt, Homo sapiens
gaaucuucauuggcaccuu

SEQ ID NO: 612961 - RNA, 19 nt, Homo sapiens
cagcacauugacuauagaa

SEQ ID NO: 612962 - RNA, 19 nt, Homo sapiens
aagaucaagccaaagaaug

SEQ ID NO: 612963 - RNA, 19 nt, Homo sapiens
ggauuugguggaacagcaa

SEQ ID NO: 612964 - RNA, 19 nt, Homo sapiens
gcaaguaccugugguggau

SEQ ID NO: 612965 - RNA, 19 nt, Homo sapiens
uuaaagccauauuggagua

SEQ ID NO: 612966 - RNA, 19 nt, Homo sapiens
gcacguaccagagguggaa

SEQ ID NO: 612967 - RNA, 19 nt, Homo sapiens
gagacgaacuacagaacag

SEQ ID NO: 612968 - RNA, 19 nt, Homo sapiens
ggaguagcgaggaaucuga

SEQ ID NO: 612969 - RNA, 19 nt, Homo sapiens
agaggugguuaaagccaua

SEQ ID NO: 612970 - RNA, 19 nt, Homo sapiens
gaacugaggcaggcauucu

SEQ ID NO: 612971 - RNA, 19 nt, Homo sapiens
caagucaaacgcagaagga

SEQ ID NO: 612972 - RNA, 19 nt, Homo sapiens
ucacugagcaaccaagagu

SEQ ID NO: 612973 - RNA, 19 nt, Homo sapiens
ggcaagggaucgcuuacac

SEQ ID NO: 612974 - RNA, 19 nt, Homo sapiens
aaguaccugugguggauuu

SEQ ID NO: 612975 - RNA, 19 nt, Homo sapiens
gcgggcaagggaucgcuua

SEQ ID NO: 612976 - RNA, 19 nt, Homo sapiens
acugaggcaggcauucuua

SEQ ID NO: 612977 - RNA, 19 nt, Homo sapiens
agaaggacugccucacuga

SEQ ID NO: 612978 - RNA, 19 nt, Homo sapiens
ggugguuaaagccauauug

SEQ ID NO: 612979 - RNA, 19 nt, Homo sapiens
guucucagcagcagcaagu

SEQ ID NO: 612980 - RNA, 19 nt, Homo sapiens
uuacaccugagacgaacua

SEQ ID NO: 612981 - RNA, 19 nt, Homo sapiens
ccacaagucucaucucuaa

SEQ ID NO: 612982 - RNA, 19 nt, Homo sapiens
gaagagugcuguacaaagu

SEQ ID NO: 612983 - RNA, 19 nt, Homo sapiens
gaaacuacguaaugauuga

SEQ ID NO: 612984 - RNA, 19 nt, Homo sapiens
ccaaguagauuucccauug

SEQ ID NO: 612985 - RNA, 19 nt, Homo sapiens
cagcagaacugacugauga

SEQ ID NO: 612986 - RNA, 19 nt, Homo sapiens
gagacggacugguuugaua

SEQ ID NO: 612987 - RNA, 19 nt, Homo sapiens
guaaauacuugucaucaug

SEQ ID NO: 612988 - RNA, 19 nt, Homo sapiens
ggagaauguugacuuagaa

SEQ ID NO: 612989 - RNA, 19 nt, Homo sapiens
ucucaucgcugaaauaaga

SEQ ID NO: 612990 - RNA, 19 nt, Homo sapiens
guacccagcuccugccuuu

SEQ ID NO: 612991 - RNA, 19 nt, Homo sapiens
ggacaggccuaaucaacug

SEQ ID NO: 612992 - RNA, 19 nt, Homo sapiens
ggaguuaauugcaaacaug

SEQ ID NO: 612993 - RNA, 19 nt, Homo sapiens
gcccugaccuugugcagua

SEQ ID NO: 612994 - RNA, 19 nt, Homo sapiens
gagggaagccaucaucuaa

SEQ ID NO: 612995 - RNA, 19 nt, Homo sapiens
gaagaaaugaagagaggua

SEQ ID NO: 612996 - RNA, 19 nt, Homo sapiens
gaacguuccucgaaacuac

SEQ ID NO: 612997 - RNA, 19 nt, Homo sapiens
ucaagaggcucccuuuaug

SEQ ID NO: 612998 - RNA, 19 nt, Homo sapiens
uugagaaacuggauagaua

SEQ ID NO: 612999 - RNA, 19 nt, Homo sapiens
ggagaacuuuacaaacauu

SEQ ID NO: 613000 - RNA, 19 nt, Homo sapiens
gaccuggacuccuugguaa

SEQ ID NO: 613001 - RNA, 19 nt, Homo sapiens
gugaggaccugccagaauu

SEQ ID NO: 613002 - RNA, 19 nt, Homo sapiens
gggagaauguugacuuaga

SEQ ID NO: 613003 - RNA, 19 nt, Homo sapiens
gaaauaagaggccauagca

SEQ ID NO: 613004 - RNA, 19 nt, Homo sapiens
gaaaguagagagcaacaga

SEQ ID NO: 613005 - RNA, 19 nt, Homo sapiens
cagggagaauguugacuua

SEQ ID NO: 613006 - RNA, 19 nt, Homo sapiens
gaagagagguaucauugcu

SEQ ID NO: 613007 - RNA, 19 nt, Homo sapiens
ccuaugggcucaagaagaa

SEQ ID NO: 613008 - RNA, 19 nt, Homo sapiens
ccaaagacguagagucaga

SEQ ID NO: 613009 - RNA, 19 nt, Homo sapiens
gggcagggcuugcaguaug

SEQ ID NO: 613010 - RNA, 19 nt, Homo sapiens
guacaggccuuacgcaucu

SEQ ID NO: 613011 - RNA, 19 nt, Homo sapiens
gagcagccguguacgaaga

SEQ ID NO: 613012 - RNA, 19 nt, Homo sapiens
cgucaaggcuguuccagaa

SEQ ID NO: 613013 - RNA, 19 nt, Homo sapiens
caaagaccaugccgaagga

SEQ ID NO: 613014 - RNA, 19 nt, Homo sapiens
uauaaacccucaaugacaa

SEQ ID NO: 613015 - RNA, 19 nt, Homo sapiens
gaaggagccuggagaacca

SEQ ID NO: 613016 - RNA, 19 nt, Homo sapiens
gagcagaacguuccucgaa

SEQ ID NO: 613017 - RNA, 19 nt, Homo sapiens
ccacagagccucagugaca

SEQ ID NO: 613018 - RNA, 19 nt, Homo sapiens
ucaagaagaacguguauga

SEQ ID NO: 613019 - RNA, 19 nt, Homo sapiens
gauauaaccuacccaacca

SEQ ID NO: 613020 - RNA, 19 nt, Homo sapiens
gaaguuauggucaugaguu

SEQ ID NO: 613021 - RNA, 19 nt, Homo sapiens
gggaagccaucaucuaaca

SEQ ID NO: 613022 - RNA, 19 nt, Homo sapiens
cuaaguuucuugugaaguu

SEQ ID NO: 613023 - RNA, 19 nt, Homo sapiens
cuggauagauacacucaua

SEQ ID NO: 613024 - RNA, 19 nt, Homo sapiens
gaacguguaugagcagcaa

SEQ ID NO: 613025 - RNA, 19 nt, Homo sapiens
uaaccuacccaaccaagua

SEQ ID NO: 613026 - RNA, 19 nt, Homo sapiens
gaaaugaagagagguauca

SEQ ID NO: 613027 - RNA, 19 nt, Homo sapiens
ggcaugaucuacucgacua

SEQ ID NO: 613028 - RNA, 19 nt, Homo sapiens
caacagacacaucuccaaa

SEQ ID NO: 613029 - RNA, 19 nt, Homo sapiens
ggauagauacacucauaaa

SEQ ID NO: 613030 - RNA, 19 nt, Homo sapiens
gcaaacaugcaauugagaa

SEQ ID NO: 613031 - RNA, 19 nt, Homo sapiens
gcaauuccagucguucuua

SEQ ID NO: 613032 - RNA, 19 nt, Homo sapiens
aagaacagccuuaaucauu

SEQ ID NO: 613033 - RNA, 19 nt, Homo sapiens
gcucuggacucugcguaua

SEQ ID NO: 613034 - RNA, 19 nt, Homo sapiens
ccaccaaacugcgcaagaa

SEQ ID NO: 613035 - RNA, 19 nt, Homo sapiens
gcaagagcccagccaacua

SEQ ID NO: 613036 - RNA, 19 nt, Homo sapiens
guacaaagucaaacaaaca

SEQ ID NO: 613037 - RNA, 19 nt, Homo sapiens
gcucaccucugguagcuau

SEQ ID NO: 613038 - RNA, 19 nt, Homo sapiens
ugggagaacuuuacaaaca

SEQ ID NO: 613039 - RNA, 19 nt, Homo sapiens
ggaguuggguaucacacaa

SEQ ID NO: 613040 - RNA, 19 nt, Homo sapiens
gcauggaccucaccucucu

SEQ ID NO: 613041 - RNA, 19 nt, Homo sapiens
acaggaagcugccaaccuu

SEQ ID NO: 613042 - RNA, 19 nt, Homo sapiens
cuugugaaguuucucaaua

SEQ ID NO: 613043 - RNA, 19 nt, Homo sapiens
gaaacuggauagauacacu

SEQ ID NO: 613044 - RNA, 19 nt, Homo sapiens
ccaguuugauuuacgugua

SEQ ID NO: 613045 - RNA, 19 nt, Homo sapiens
cgagcaagcuggcaaacug

SEQ ID NO: 613046 - RNA, 19 nt, Homo sapiens
gcugugacauggucuacaa

SEQ ID NO: 613047 - RNA, 19 nt, Homo sapiens
gcucuugacugcaccuguu

SEQ ID NO: 613048 - RNA, 19 nt, Homo sapiens
gaagguuugcuguaggaua

SEQ ID NO: 613049 - RNA, 19 nt, Homo sapiens
cgaagagucugccaaagag

SEQ ID NO: 613050 - RNA, 19 nt, Homo sapiens
ccucagaccuggacuccuu

SEQ ID NO: 613051 - RNA, 19 nt, Homo sapiens
gagaagagcauggcagaug

SEQ ID NO: 613052 - RNA, 19 nt, Homo sapiens
ucagacaugucacugcaaa

SEQ ID NO: 613053 - RNA, 19 nt, Homo sapiens
gcucagugcuccacagagu

SEQ ID NO: 613054 - RNA, 19 nt, Homo sapiens
ccauggcagucgugagaua

SEQ ID NO: 613055 - RNA, 19 nt, Homo sapiens
acagacacaucuccaaaug

SEQ ID NO: 613056 - RNA, 19 nt, Homo sapiens
caacagagccagccaacca

SEQ ID NO: 613057 - RNA, 19 nt, Homo sapiens
ggaggacgaccgcauuuau

SEQ ID NO: 613058 - RNA, 19 nt, Homo sapiens
agucagaccuggcguccua

SEQ ID NO: 613059 - RNA, 19 nt, Homo sapiens
ccucgaaacuacguaauga

SEQ ID NO: 613060 - RNA, 19 nt, Homo sapiens
ggccaggguucgagaaaga

SEQ ID NO: 613061 - RNA, 19 nt, Homo sapiens
gcgcugaggaggcuuauga

SEQ ID NO: 613062 - RNA, 19 nt, Homo sapiens
caacagcacgggaaguuau

SEQ ID NO: 613063 - RNA, 19 nt, Homo sapiens
gaacaaccaguccaaagca

SEQ ID NO: 613064 - RNA, 19 nt, Homo sapiens
cgugagauauuguaugugu

SEQ ID NO: 613065 - RNA, 19 nt, Homo sapiens
cagcagugguggcaacuau

SEQ ID NO: 613066 - RNA, 19 nt, Homo sapiens
ugaaguuucucaauagcaa

SEQ ID NO: 613067 - RNA, 19 nt, Homo sapiens
guguauaccucauaaacau

SEQ ID NO: 613068 - RNA, 19 nt, Homo sapiens
uuacguguauaccucauaa

SEQ ID NO: 613069 - RNA, 19 nt, Homo sapiens
ugaagaggccaaagacgua

SEQ ID NO: 613070 - RNA, 19 nt, Homo sapiens
gaggagaagaggaaucuga

SEQ ID NO: 613071 - RNA, 19 nt, Homo sapiens
gcagaacguuccucgaaac

SEQ ID NO: 613072 - RNA, 19 nt, Homo sapiens
agacaucgcuagccgacuu

SEQ ID NO: 613073 - RNA, 19 nt, Homo sapiens
ggagauaggcaugcccuuu

SEQ ID NO: 613074 - RNA, 19 nt, Homo sapiens
gcaggcagcgucuagaaga

SEQ ID NO: 613075 - RNA, 19 nt, Homo sapiens
gcaugguccugcccuguug

SEQ ID NO: 613076 - RNA, 19 nt, Homo sapiens
ggccaagcccucugaguuu

SEQ ID NO: 613077 - RNA, 19 nt, Homo sapiens
gucaauggaugcucaggaa

SEQ ID NO: 613078 - RNA, 19 nt, Homo sapiens
gcaauugagaaacuggaua

SEQ ID NO: 613079 - RNA, 19 nt, Homo sapiens
agaacagccuuaaucauuc

SEQ ID NO: 613080 - RNA, 19 nt, Homo sapiens
cagcugccaucuccucaaa

SEQ ID NO: 613081 - RNA, 19 nt, Homo sapiens
gggaagacgggauaaagua

SEQ ID NO: 613082 - RNA, 19 nt, Homo sapiens
ccacagagcagcccaguuc

SEQ ID NO: 613083 - RNA, 19 nt, Homo sapiens
agagguaccugcgacauga

SEQ ID NO: 613084 - RNA, 19 nt, Homo sapiens
uaucuacacucccaaugug

SEQ ID NO: 613085 - RNA, 19 nt, Homo sapiens
gccacaaccuuuccuccaa

SEQ ID NO: 613086 - RNA, 19 nt, Homo sapiens
gaccagggaagacgggaua

SEQ ID NO: 613087 - RNA, 19 nt, Homo sapiens
agugagggcuucagcauca

SEQ ID NO: 613088 - RNA, 19 nt, Homo sapiens
ggaagacgggauaaaguag

SEQ ID NO: 613089 - RNA, 19 nt, Homo sapiens
gcugcuagaucuugaacuc

SEQ ID NO: 613090 - RNA, 19 nt, Homo sapiens
caugaucgccuuggugauu

SEQ ID NO: 613091 - RNA, 19 nt, Homo sapiens
gggcugcucugcgaucuag

SEQ ID NO: 613092 - RNA, 19 nt, Homo sapiens
ccuaagaggaggaagaaga

SEQ ID NO: 613093 - RNA, 19 nt, Homo sapiens
gagcuuggcaugggcuaaa

SEQ ID NO: 613094 - RNA, 19 nt, Homo sapiens
gaucauguccuggguggau

SEQ ID NO: 613095 - RNA, 19 nt, Homo sapiens
ccuccuacuugccuaucua

SEQ ID NO: 613096 - RNA, 19 nt, Homo sapiens
gccccucccuuccagauua

SEQ ID NO: 613097 - RNA, 19 nt, Homo sapiens
cgacacagcagcucgaaaa

SEQ ID NO: 613098 - RNA, 19 nt, Homo sapiens
caaccagcccugccuacug

SEQ ID NO: 613099 - RNA, 19 nt, Homo sapiens
cuacuugccuaucuacacu

SEQ ID NO: 613100 - RNA, 19 nt, Homo sapiens
caucaagucccugcuagga

SEQ ID NO: 613101 - RNA, 19 nt, Homo sapiens
uacgagggcuggaaagacu

SEQ ID NO: 613102 - RNA, 19 nt, Homo sapiens
agaggaggaagaagaggua

SEQ ID NO: 613103 - RNA, 19 nt, Homo sapiens
gaagagguaccugcgacau

SEQ ID NO: 613104 - RNA, 19 nt, Homo sapiens
gaagcuccaccugaucaug

SEQ ID NO: 613105 - RNA, 19 nt, Homo sapiens
cuacacucccaauguggua

SEQ ID NO: 613106 - RNA, 19 nt, Homo sapiens
ucuagacgcccucuuccaa

SEQ ID NO: 613107 - RNA, 19 nt, Homo sapiens
agacuacgagggcuggaaa

SEQ ID NO: 613108 - RNA, 19 nt, Homo sapiens
acaccuacuuggccaugau

SEQ ID NO: 613109 - RNA, 19 nt, Homo sapiens
uaaaguagccaugggucau

SEQ ID NO: 613110 - RNA, 19 nt, Homo sapiens
cgaucuagacgcccucuuc

SEQ ID NO: 613111 - RNA, 19 nt, Homo sapiens
gcuuggcaugggcuaaaua

SEQ ID NO: 613112 - RNA, 19 nt, Homo sapiens
gcccaaggacccugcaaag

SEQ ID NO: 613113 - RNA, 19 nt, Homo sapiens
cugugaggcucuuaagaca

SEQ ID NO: 613114 - RNA, 19 nt, Homo sapiens
aaaagcaucuacgacguuu

SEQ ID NO: 613115 - RNA, 19 nt, Homo sapiens
gaaagagccaaguuuauua

SEQ ID NO: 613116 - RNA, 19 nt, Homo sapiens
gcacaaacucuagauauua

SEQ ID NO: 613117 - RNA, 19 nt, Homo sapiens
gugcaugucugucugauuu

SEQ ID NO: 613118 - RNA, 19 nt, Homo sapiens
guaacuggcugcagagaaa

SEQ ID NO: 613119 - RNA, 19 nt, Homo sapiens
ggaaagagccaaguuuauu

SEQ ID NO: 613120 - RNA, 19 nt, Homo sapiens
uaaauccgcucccuccuaa

SEQ ID NO: 613121 - RNA, 19 nt, Homo sapiens
ggaauauucuuaccucaau

SEQ ID NO: 613122 - RNA, 19 nt, Homo sapiens
aaacuaggcucugcuggua

SEQ ID NO: 613123 - RNA, 19 nt, Homo sapiens
ccaauagacggaugaguua

SEQ ID NO: 613124 - RNA, 19 nt, Homo sapiens
gaagagcaguauguucuga

SEQ ID NO: 613125 - RNA, 19 nt, Homo sapiens
ggcacaaacucuagauauu

SEQ ID NO: 613126 - RNA, 19 nt, Homo sapiens
ggacucacauccuguaugg

SEQ ID NO: 613127 - RNA, 19 nt, Homo sapiens
cuacaacuguguucuguga

SEQ ID NO: 613128 - RNA, 19 nt, Homo sapiens
caaaaugugucucauguuu

SEQ ID NO: 613129 - RNA, 19 nt, Homo sapiens
caacuuagugacuuguuua

SEQ ID NO: 613130 - RNA, 19 nt, Homo sapiens
gauccgaacuggacucaca

SEQ ID NO: 613131 - RNA, 19 nt, Homo sapiens
gcugaaggcucgaucuugu

SEQ ID NO: 613132 - RNA, 19 nt, Homo sapiens
gacaaggcaucucauagga

SEQ ID NO: 613133 - RNA, 19 nt, Homo sapiens
ccaguggcuuccaguauaa

SEQ ID NO: 613134 - RNA, 19 nt, Homo sapiens
guaaucgcgcuaagaauaa

SEQ ID NO: 613135 - RNA, 19 nt, Homo sapiens
gaacaccaucccgccauua

SEQ ID NO: 613136 - RNA, 19 nt, Homo sapiens
guaguaaggaggccaguuu

SEQ ID NO: 613137 - RNA, 19 nt, Homo sapiens
uggauggacuguauauuga

SEQ ID NO: 613138 - RNA, 19 nt, Homo sapiens
caaccaacuuagugacuug

SEQ ID NO: 613139 - RNA, 19 nt, Homo sapiens
aaagaugcccuauccauga

SEQ ID NO: 613140 - RNA, 19 nt, Homo sapiens
gaaggcagaaaccauuaaa

SEQ ID NO: 613141 - RNA, 19 nt, Homo sapiens
cuuagugacuuguuuagaa

SEQ ID NO: 613142 - RNA, 19 nt, Homo sapiens
guggaaagagccaaguuua

SEQ ID NO: 613143 - RNA, 19 nt, Homo sapiens
ccaacuuagugacuuguuu

SEQ ID NO: 613144 - RNA, 19 nt, Homo sapiens
accauuaacuugauuguug

SEQ ID NO: 613145 - RNA, 19 nt, Homo sapiens
agagaaaucuaccgagcaa

SEQ ID NO: 613146 - RNA, 19 nt, Homo sapiens
cacaaacucuagauauuag

SEQ ID NO: 613147 - RNA, 19 nt, Homo sapiens
aaaguaaucgcgcuaagaa

SEQ ID NO: 613148 - RNA, 19 nt, Homo sapiens
gagccaaguuuauuaugag

SEQ ID NO: 613149 - RNA, 19 nt, Homo sapiens
ccauuaacuugauuguuga

SEQ ID NO: 613150 - RNA, 19 nt, Homo sapiens
ggaaggcagaaaccauuaa

SEQ ID NO: 613151 - RNA, 19 nt, Homo sapiens
aguaaucgcgcuaagaaua

SEQ ID NO: 613152 - RNA, 19 nt, Homo sapiens
gaacggcuccucgggcaaa

SEQ ID NO: 613153 - RNA, 19 nt, Homo sapiens
ccagccaccuucuccauau

SEQ ID NO: 613154 - RNA, 19 nt, Homo sapiens
uuccaagaguguaccauua

SEQ ID NO: 613155 - RNA, 19 nt, Homo sapiens
guggauggacuguauauug

SEQ ID NO: 613156 - RNA, 19 nt, Homo sapiens
agagccaaguuuauuauga

SEQ ID NO: 613157 - RNA, 19 nt, Homo sapiens
agacaucucuguuuugauu

SEQ ID NO: 613158 - RNA, 19 nt, Homo sapiens
uaugguggauggacuguau

SEQ ID NO: 613159 - RNA, 19 nt, Homo sapiens
caauaagaccaaccgcuuu

SEQ ID NO: 613160 - RNA, 19 nt, Homo sapiens
acucaauuguaucguguua

SEQ ID NO: 613161 - RNA, 19 nt, Homo sapiens
gaguguaccauuaacuuga

SEQ ID NO: 613162 - RNA, 19 nt, Homo sapiens
guucagacaaugguauaua

SEQ ID NO: 613163 - RNA, 19 nt, Homo sapiens
ccaccucgcugaacaccau

SEQ ID NO: 613164 - RNA, 19 nt, Homo sapiens
ucauugagggccuaaagua

SEQ ID NO: 613165 - RNA, 19 nt, Homo sapiens
caaagccgccuuagugaag

SEQ ID NO: 613166 - RNA, 19 nt, Homo sapiens
caguauaacccgauaagga

SEQ ID NO: 613167 - RNA, 19 nt, Homo sapiens
ucagacaaggcaucucaua

SEQ ID NO: 613168 - RNA, 19 nt, Homo sapiens
aauuagagaugcaggaauc

SEQ ID NO: 613169 - RNA, 19 nt, Homo sapiens
gagaugcaggaaucaauga

SEQ ID NO: 613170 - RNA, 19 nt, Homo sapiens
uaaucgcgcuaagaauaaa

SEQ ID NO: 613171 - RNA, 19 nt, Homo sapiens
guugaauguugaggcuuua

SEQ ID NO: 613172 - RNA, 19 nt, Homo sapiens
gaccaaccgcuuugcuauu

SEQ ID NO: 613173 - RNA, 19 nt, Homo sapiens
uaacagcacggauucucuu

SEQ ID NO: 613174 - RNA, 19 nt, Homo sapiens
uaaaguaaucgcgcuaaga

SEQ ID NO: 613175 - RNA, 19 nt, Homo sapiens
gcguugagcugugcacauc

SEQ ID NO: 613176 - RNA, 19 nt, Homo sapiens
ucacugcggcgacgacuug

SEQ ID NO: 613177 - RNA, 19 nt, Homo sapiens
gccaaagccgccuuaguga

SEQ ID NO: 613178 - RNA, 19 nt, Homo sapiens
guaaggaggccaguuugga

SEQ ID NO: 613179 - RNA, 19 nt, Homo sapiens
guucugugacucaauugua

SEQ ID NO: 613180 - RNA, 19 nt, Homo sapiens
gaaaucuaccgagcaagga

SEQ ID NO: 613181 - RNA, 19 nt, Homo sapiens
cccaauagacggaugaguu

SEQ ID NO: 613182 - RNA, 19 nt, Homo sapiens
ugaacaccaucccgccauu

SEQ ID NO: 613183 - RNA, 19 nt, Homo sapiens
auagacggaugaguuauug

SEQ ID NO: 613184 - RNA, 19 nt, Homo sapiens
gugaagagcaguauguucu

SEQ ID NO: 613185 - RNA, 19 nt, Homo sapiens
ccaaagccgccuuagugaa

SEQ ID NO: 613186 - RNA, 19 nt, Homo sapiens
gggucaaucuuuuguguuu

SEQ ID NO: 613187 - RNA, 19 nt, Homo sapiens
uguguucugugacucaauu

SEQ ID NO: 613188 - RNA, 19 nt, Homo sapiens
ccugaaagaugcccuaucc

SEQ ID NO: 613189 - RNA, 19 nt, Homo sapiens
cuaaauccgcucccuccua

SEQ ID NO: 613190 - RNA, 19 nt, Homo sapiens
ucaaccaacuuagugacuu

SEQ ID NO: 613191 - RNA, 19 nt, Homo sapiens
cauugagggccuaaaguaa

SEQ ID NO: 613192 - RNA, 19 nt, Homo sapiens
guuggacuauguuugugaa

SEQ ID NO: 613193 - RNA, 19 nt, Homo sapiens
gugucuuuaugguguaaua

SEQ ID NO: 613194 - RNA, 19 nt, Homo sapiens
ugaaagaugcccuauccau

SEQ ID NO: 613195 - RNA, 19 nt, Homo sapiens
ugccaaagccgccuuagug

SEQ ID NO: 613196 - RNA, 19 nt, Homo sapiens
ucuauggcgugucuuuaug

SEQ ID NO: 613197 - RNA, 19 nt, Homo sapiens
ucaauugcaguccacguaa

SEQ ID NO: 613198 - RNA, 19 nt, Homo sapiens
gcaggugacaggaagagau

SEQ ID NO: 613199 - RNA, 19 nt, Homo sapiens
ccagaaccuuuucaaugua

SEQ ID NO: 613200 - RNA, 19 nt, Homo sapiens
accaaccgcuuugcuauug

SEQ ID NO: 613201 - RNA, 19 nt, Homo sapiens
ccagugcccagcucaaaga

SEQ ID NO: 613202 - RNA, 19 nt, Homo sapiens
cgccgcaguuccuuacaaa

SEQ ID NO: 613203 - RNA, 19 nt, Homo sapiens
ccaagaguguaccauuaac

SEQ ID NO: 613204 - RNA, 19 nt, Homo sapiens
uccaagaguguaccauuaa

SEQ ID NO: 613205 - RNA, 19 nt, Homo sapiens
caaccgcuuugcuauuguc

SEQ ID NO: 613206 - RNA, 19 nt, Homo sapiens
gucaauugcaguccacgua

SEQ ID NO: 613207 - RNA, 19 nt, Homo sapiens
aaaugugucucauguuucg

SEQ ID NO: 613208 - RNA, 19 nt, Homo sapiens
ugaaggcucgaucuuguga

SEQ ID NO: 613209 - RNA, 19 nt, Homo sapiens
aguauguucugaucuggaa

SEQ ID NO: 613210 - RNA, 19 nt, Homo sapiens
aguugaauguugaggcuuu

SEQ ID NO: 613211 - RNA, 19 nt, Homo sapiens
gagguuggacagcucaguu

SEQ ID NO: 613212 - RNA, 19 nt, Homo sapiens
ccgcuuugcuauuguccaa

SEQ ID NO: 613213 - RNA, 19 nt, Homo sapiens
gcaugucugucugauuucu

SEQ ID NO: 613214 - RNA, 19 nt, Homo sapiens
uggaaggcagaaaccauua

SEQ ID NO: 613215 - RNA, 19 nt, Homo sapiens
gaagacagcaggaagauuu

SEQ ID NO: 613216 - RNA, 19 nt, Homo sapiens
caacgacucuuaccgaauu

SEQ ID NO: 613217 - RNA, 19 nt, Homo sapiens
gagaaucuguguguaauaa

SEQ ID NO: 613218 - RNA, 19 nt, Homo sapiens
gaacacagauagaaagaag

SEQ ID NO: 613219 - RNA, 19 nt, Homo sapiens
caaagaagauguugcuaug

SEQ ID NO: 613220 - RNA, 19 nt, Homo sapiens
gaaagaagaugaggguguu

SEQ ID NO: 613221 - RNA, 19 nt, Homo sapiens
ugaaaggaaucccaauuaa

SEQ ID NO: 613222 - RNA, 19 nt, Homo sapiens
ucucaucgcuacuauauuu

SEQ ID NO: 613223 - RNA, 19 nt, Homo sapiens
gaagauaccaucccacgaa

SEQ ID NO: 613224 - RNA, 19 nt, Homo sapiens
ggaaagaguugugaagcaa

SEQ ID NO: 613225 - RNA, 19 nt, Homo sapiens
gauguuaacuucagaaagg

SEQ ID NO: 613226 - RNA, 19 nt, Homo sapiens
gaucuuugcuacugaaugu

SEQ ID NO: 613227 - RNA, 19 nt, Homo sapiens
ggaaagaacauuugcauac

SEQ ID NO: 613228 - RNA, 19 nt, Homo sapiens
gcaggaagauuugaugugu

SEQ ID NO: 613229 - RNA, 19 nt, Homo sapiens
cgaaugaccuccgcaaaga

SEQ ID NO: 613230 - RNA, 19 nt, Homo sapiens
gcucugaaauggacaacaa

SEQ ID NO: 613231 - RNA, 19 nt, Homo sapiens
ugauagaacugucugcauu

SEQ ID NO: 613232 - RNA, 19 nt, Homo sapiens
uuaauuagcccaacuagaa

SEQ ID NO: 613233 - RNA, 19 nt, Homo sapiens
ugacaaagcaguggaagua

SEQ ID NO: 613234 - RNA, 19 nt, Homo sapiens
gacaacaacugcucaccaa

SEQ ID NO: 613235 - RNA, 19 nt, Homo sapiens
gaaagaacauuugcauacu

SEQ ID NO: 613236 - RNA, 19 nt, Homo sapiens
ggaaaggaaagaacauuug

SEQ ID NO: 613237 - RNA, 19 nt, Homo sapiens
aggaagagcuguucagguu

SEQ ID NO: 613238 - RNA, 19 nt, Homo sapiens
ggagagaugugucagaacu

SEQ ID NO: 613239 - RNA, 19 nt, Homo sapiens
gaagaaaacagccuuguaa

SEQ ID NO: 613240 - RNA, 19 nt, Homo sapiens
gaagaugaggaacaaauga

SEQ ID NO: 613241 - RNA, 19 nt, Homo sapiens
gcucaucuguuaugcauag

SEQ ID NO: 613242 - RNA, 19 nt, Homo sapiens
aaaggaaucccaauuaaga

SEQ ID NO: 613243 - RNA, 19 nt, Homo sapiens
cuuucaagcucaucuguua

SEQ ID NO: 613244 - RNA, 19 nt, Homo sapiens
gccgugagcugaagagguu

SEQ ID NO: 613245 - RNA, 19 nt, Homo sapiens
gaagagcuguucagguuuu

SEQ ID NO: 613246 - RNA, 19 nt, Homo sapiens
gggagaagaugaggaacaa

SEQ ID NO: 613247 - RNA, 19 nt, Homo sapiens
ggaaagagugggagaagau

SEQ ID NO: 613248 - RNA, 19 nt, Homo sapiens
gaacacaacgagaaguaug

SEQ ID NO: 613249 - RNA, 19 nt, Homo sapiens
ggaacagaaugccguaagu

SEQ ID NO: 613250 - RNA, 19 nt, Homo sapiens
gaaucuguguguaauaaag

SEQ ID NO: 613251 - RNA, 19 nt, Homo sapiens
aaagagaaucuguguguaa

SEQ ID NO: 613252 - RNA, 19 nt, Homo sapiens
gaaaggaaucccaauuaag

SEQ ID NO: 613253 - RNA, 19 nt, Homo sapiens
uuagaaagcccaaaggaaa

SEQ ID NO: 613254 - RNA, 19 nt, Homo sapiens
gaggaacaaaugaugauaa

SEQ ID NO: 613255 - RNA, 19 nt, Homo sapiens
gcuacuauauuucucaauc

SEQ ID NO: 613256 - RNA, 19 nt, Homo sapiens
aaacguggcucugaaaugg

SEQ ID NO: 613257 - RNA, 19 nt, Homo sapiens
gauagaacugucugcauuu

SEQ ID NO: 613258 - RNA, 19 nt, Homo sapiens
aaaggaaaggugacuauuu

SEQ ID NO: 613259 - RNA, 19 nt, Homo sapiens
gccagaagauuuugauuuu

SEQ ID NO: 613260 - RNA, 19 nt, Homo sapiens
gggaaagaguugugaagca

SEQ ID NO: 613261 - RNA, 19 nt, Homo sapiens
gagaagaugaggaacaaau

SEQ ID NO: 613262 - RNA, 19 nt, Homo sapiens
aaagucagcuugauagaac

SEQ ID NO: 613263 - RNA, 19 nt, Homo sapiens
uagugugugugcuuucuua

SEQ ID NO: 613264 - RNA, 19 nt, Homo sapiens
aagaagauguugcuaugga

SEQ ID NO: 613265 - RNA, 19 nt, Homo sapiens
gaaagaguugugaagcaaa

SEQ ID NO: 613266 - RNA, 19 nt, Homo sapiens
aagaacauuugcauacuga

SEQ ID NO: 613267 - RNA, 19 nt, Homo sapiens
gaaagaucauugaguucag

SEQ ID NO: 613268 - RNA, 19 nt, Homo sapiens
aauaaaagcugaccccaaa

SEQ ID NO: 613269 - RNA, 19 nt, Homo sapiens
gcauagcuuugcacuucaa

SEQ ID NO: 613270 - RNA, 19 nt, Homo sapiens
caauaccugugcuuuggaa

SEQ ID NO: 613271 - RNA, 19 nt, Homo sapiens
uugaaaggaaucccaauua

SEQ ID NO: 613272 - RNA, 19 nt, Homo sapiens
caucgcuucugcucaguuu

SEQ ID NO: 613273 - RNA, 19 nt, Homo sapiens
ggaaaacaagccuguauuu

SEQ ID NO: 613274 - RNA, 19 nt, Homo sapiens
ccacgaacacagauagaaa

SEQ ID NO: 613275 - RNA, 19 nt, Homo sapiens
gaagauuugauguguacuu

SEQ ID NO: 613276 - RNA, 19 nt, Homo sapiens
caggaagauuugaugugua

SEQ ID NO: 613277 - RNA, 19 nt, Homo sapiens
gaugaggaacaaaugauga

SEQ ID NO: 613278 - RNA, 19 nt, Homo sapiens
cagaacacaacgagaagua

SEQ ID NO: 613279 - RNA, 19 nt, Homo sapiens
gaacuucuuaaaccucuug

SEQ ID NO: 613280 - RNA, 19 nt, Homo sapiens
ggcaauaccugugcuuugg

SEQ ID NO: 613281 - RNA, 19 nt, Homo sapiens
gaacauuugcauacugaca

SEQ ID NO: 613282 - RNA, 19 nt, Homo sapiens
aaagaacauuugcauacug

SEQ ID NO: 613283 - RNA, 19 nt, Homo sapiens
ugugugugcuuucuuaaug

SEQ ID NO: 613284 - RNA, 19 nt, Homo sapiens
cugaagaccacaaauuaaa

SEQ ID NO: 613285 - RNA, 19 nt, Homo sapiens
cccugaagaccacaaauua

SEQ ID NO: 613286 - RNA, 19 nt, Homo sapiens
aaggaaaggugacuauuuu

SEQ ID NO: 613287 - RNA, 19 nt, Homo sapiens
cuuaaacucugcagcuuuc

SEQ ID NO: 613288 - RNA, 19 nt, Homo sapiens
uagaaguuguggaaaggaa

SEQ ID NO: 613289 - RNA, 19 nt, Homo sapiens
gaacugucugcauuucuga

SEQ ID NO: 613290 - RNA, 19 nt, Homo sapiens
ggaagagcuguucagguuu

SEQ ID NO: 613291 - RNA, 19 nt, Homo sapiens
ccaaaggaaaggugacuau

SEQ ID NO: 613292 - RNA, 19 nt, Homo sapiens
augaauaccugacaaagca

SEQ ID NO: 613293 - RNA, 19 nt, Homo sapiens
caaguucucagaugaauac

SEQ ID NO: 613294 - RNA, 19 nt, Homo sapiens
gaaaggaaagaacauuugc

SEQ ID NO: 613295 - RNA, 19 nt, Homo sapiens
uaacuuuacuuccacucau

SEQ ID NO: 613296 - RNA, 19 nt, Homo sapiens
ucaugggauugguaaauau

SEQ ID NO: 613297 - RNA, 19 nt, Homo sapiens
acaaagcaguggaaguauc

SEQ ID NO: 613298 - RNA, 19 nt, Homo sapiens
gaacagaaugccguaaguc

SEQ ID NO: 613299 - RNA, 19 nt, Homo sapiens
gaaugaccuccgcaaagaa

SEQ ID NO: 613300 - RNA, 19 nt, Homo sapiens
ccugaagaccacaaauuaa

SEQ ID NO: 613301 - RNA, 19 nt, Homo sapiens
aaacuucuggcaucauaaa

SEQ ID NO: 613302 - RNA, 19 nt, Homo sapiens
gaagauguugcuauggaau

SEQ ID NO: 613303 - RNA, 19 nt, Homo sapiens
uaaaagggguaucaaguca

SEQ ID NO: 613304 - RNA, 19 nt, Homo sapiens
agaagauguugcuauggaa

SEQ ID NO: 613305 - RNA, 19 nt, Homo sapiens
gaaagagugggagaagaug

SEQ ID NO: 613306 - RNA, 19 nt, Homo sapiens
aagagaaucuguguguaau

SEQ ID NO: 613307 - RNA, 19 nt, Homo sapiens
caaaggaaaggugacuauu

SEQ ID NO: 613308 - RNA, 19 nt, Homo sapiens
gaagaugaggguguugaug

SEQ ID NO: 613309 - RNA, 19 nt, Homo sapiens
uucaugggauugguaaaua

SEQ ID NO: 613310 - RNA, 19 nt, Homo sapiens
guuagaaagcccaaaggaa

SEQ ID NO: 613311 - RNA, 19 nt, Homo sapiens
gcccugacaucccaucuac

SEQ ID NO: 613312 - RNA, 19 nt, Homo sapiens
gagcuucaugggauuggua

SEQ ID NO: 613313 - RNA, 19 nt, Homo sapiens
uuaaaccucuuggucucua

SEQ ID NO: 613314 - RNA, 19 nt, Homo sapiens
uaaucucguucaagaaaca

SEQ ID NO: 613315 - RNA, 19 nt, Homo sapiens
gaagauagcgcauauauuu

SEQ ID NO: 613316 - RNA, 19 nt, Homo sapiens
gaugaugccuaguaaauua

SEQ ID NO: 613317 - RNA, 19 nt, Homo sapiens
gaaagaugaugccuaguaa

SEQ ID NO: 613318 - RNA, 19 nt, Homo sapiens
gaacagaucaggaauucua

SEQ ID NO: 613319 - RNA, 19 nt, Homo sapiens
cagaagagauggauauuga

SEQ ID NO: 613320 - RNA, 19 nt, Homo sapiens
ggaaagaugaugccuagua

SEQ ID NO: 613321 - RNA, 19 nt, Homo sapiens
gaaacgauccucucaauca

SEQ ID NO: 613322 - RNA, 19 nt, Homo sapiens
gaaaggguuuguaauacuu

SEQ ID NO: 613323 - RNA, 19 nt, Homo sapiens
gcaaucuacuggaaaugua

SEQ ID NO: 613324 - RNA, 19 nt, Homo sapiens
ggaggaagauagcgcauau

SEQ ID NO: 613325 - RNA, 19 nt, Homo sapiens
cuaagaauaugaucaggua

SEQ ID NO: 613326 - RNA, 19 nt, Homo sapiens
gagaugaagccuaagaaua

SEQ ID NO: 613327 - RNA, 19 nt, Homo sapiens
ucacaaaucauccuaguaa

SEQ ID NO: 613328 - RNA, 19 nt, Homo sapiens
gaacagccacgucagcuuu

SEQ ID NO: 613329 - RNA, 19 nt, Homo sapiens
uaaccaaagucacaaauca

SEQ ID NO: 613330 - RNA, 19 nt, Homo sapiens
gaagagauggauauugaaa

SEQ ID NO: 613331 - RNA, 19 nt, Homo sapiens
uagaaggcguccauguuua

SEQ ID NO: 613332 - RNA, 19 nt, Homo sapiens
gcgcauauauuugcaguau

SEQ ID NO: 613333 - RNA, 19 nt, Homo sapiens
gcgaaacgauccucucaau

SEQ ID NO: 613334 - RNA, 19 nt, Homo sapiens
gguaagaaguucagaagca

SEQ ID NO: 613335 - RNA, 19 nt, Homo sapiens
ccacuagcuuacugaguua

SEQ ID NO: 613336 - RNA, 19 nt, Homo sapiens
gcacuuacguaaaacauuu

SEQ ID NO: 613337 - RNA, 19 nt, Homo sapiens
gaaaucagacccacaacga

SEQ ID NO: 613338 - RNA, 19 nt, Homo sapiens
caagagcgaugucuacuac

SEQ ID NO: 613339 - RNA, 19 nt, Homo sapiens
agacaaacagcaucaauuu

SEQ ID NO: 613340 - RNA, 19 nt, Homo sapiens
gaaaagaacccugcuguuu

SEQ ID NO: 613341 - RNA, 19 nt, Homo sapiens
aaaccagacuugaauacaa

SEQ ID NO: 613342 - RNA, 19 nt, Homo sapiens
aggcagaguugcuuaauga

SEQ ID NO: 613343 - RNA, 19 nt, Homo sapiens
gcaagguaccugggaaaua

SEQ ID NO: 613344 - RNA, 19 nt, Homo sapiens
ucaccuagcauguguaauu

SEQ ID NO: 613345 - RNA, 19 nt, Homo sapiens
ggacaccuguacauucuuc

SEQ ID NO: 613346 - RNA, 19 nt, Homo sapiens
cuucagaacuggaaagaug

SEQ ID NO: 613347 - RNA, 19 nt, Homo sapiens
caagguaccugggaaauac

SEQ ID NO: 613348 - RNA, 19 nt, Homo sapiens
agagauggauauugaaaug

SEQ ID NO: 613349 - RNA, 19 nt, Homo sapiens
guaagaaguucagaagcaa

SEQ ID NO: 613350 - RNA, 19 nt, Homo sapiens
gaguguaacuuucauacca

SEQ ID NO: 613351 - RNA, 19 nt, Homo sapiens
gaaaagcacacacaauaaa

SEQ ID NO: 613352 - RNA, 19 nt, Homo sapiens
gaaauguagcacuuacgua

SEQ ID NO: 613353 - RNA, 19 nt, Homo sapiens
caguggagaugaagccuaa

SEQ ID NO: 613354 - RNA, 19 nt, Homo sapiens
agaugaagccuaagaauau

SEQ ID NO: 613355 - RNA, 19 nt, Homo sapiens
gcaaguacgcaagaaauug

SEQ ID NO: 613356 - RNA, 19 nt, Homo sapiens
gaagaaggaggaagugauc

SEQ ID NO: 613357 - RNA, 19 nt, Homo sapiens
gcagaguugcuuaaugaaa

SEQ ID NO: 613358 - RNA, 19 nt, Homo sapiens
gaugaagccuaagaauaug

SEQ ID NO: 613359 - RNA, 19 nt, Homo sapiens
gcaagagcgaugucuacua

SEQ ID NO: 613360 - RNA, 19 nt, Homo sapiens
aaauguagcacuuacguaa

SEQ ID NO: 613361 - RNA, 19 nt, Homo sapiens
aaagaacccugcuguuugg

SEQ ID NO: 613362 - RNA, 19 nt, Homo sapiens
caaacaaccgguaaccaaa

SEQ ID NO: 613363 - RNA, 19 nt, Homo sapiens
cuagaaggcguccauguuu

SEQ ID NO: 613364 - RNA, 19 nt, Homo sapiens
ggaagauagcgcauauauu

SEQ ID NO: 613365 - RNA, 19 nt, Homo sapiens
gauuuacauucaacucuga

SEQ ID NO: 613366 - RNA, 19 nt, Homo sapiens
cagaguugcuuaaugaaag

SEQ ID NO: 613367 - RNA, 19 nt, Homo sapiens
gcgagcugcugauacagaa

SEQ ID NO: 613368 - RNA, 19 nt, Homo sapiens
agacuugaauacaacauug

SEQ ID NO: 613369 - RNA, 19 nt, Homo sapiens
aaacgauccucucaaucaa

SEQ ID NO: 613370 - RNA, 19 nt, Homo sapiens
aagaacagaucaggaauuc

SEQ ID NO: 613371 - RNA, 19 nt, Homo sapiens
gaaauggacaguggagaug

SEQ ID NO: 613372 - RNA, 19 nt, Homo sapiens
caccuagcauguguaauuu

SEQ ID NO: 613373 - RNA, 19 nt, Homo sapiens
gaaacaggaagagcgagua

SEQ ID NO: 613374 - RNA, 19 nt, Homo sapiens
gguaaaccagacuugaaua

SEQ ID NO: 613375 - RNA, 19 nt, Homo sapiens
ugaaaggguuuguaauacu

SEQ ID NO: 613376 - RNA, 19 nt, Homo sapiens
gauuggaauucuuucuguu

SEQ ID NO: 613377 - RNA, 19 nt, Homo sapiens
caaaggucuucaaggaguu

SEQ ID NO: 613378 - RNA, 19 nt, Homo sapiens
ucaaacaaccgguaaccaa

SEQ ID NO: 613379 - RNA, 19 nt, Homo sapiens
uaacuuucauaccacuuga

SEQ ID NO: 613380 - RNA, 19 nt, Homo sapiens
ggaagaaggaggaagugau

SEQ ID NO: 613381 - RNA, 19 nt, Homo sapiens
ggugcaaucuacuggaaau

SEQ ID NO: 613382 - RNA, 19 nt, Homo sapiens
uccacuagcuuacugaguu

SEQ ID NO: 613383 - RNA, 19 nt, Homo sapiens
gcguccauguuuauuguuu

SEQ ID NO: 613384 - RNA, 19 nt, Homo sapiens
ugagucagauacacaagga

SEQ ID NO: 613385 - RNA, 19 nt, Homo sapiens
uaagaacagaucaggaauu

SEQ ID NO: 613386 - RNA, 19 nt, Homo sapiens
aauaagaacagaucaggaa

SEQ ID NO: 613387 - RNA, 19 nt, Homo sapiens
uaauagcacuaaccaaugc

SEQ ID NO: 613388 - RNA, 19 nt, Homo sapiens
ggaaauacuguugaucuca

SEQ ID NO: 613389 - RNA, 19 nt, Homo sapiens
ggagaugaagccuaagaau

SEQ ID NO: 613390 - RNA, 19 nt, Homo sapiens
acccaaaggucuucaagga

SEQ ID NO: 613391 - RNA, 19 nt, Homo sapiens
acauggagguggaggaaga

SEQ ID NO: 613392 - RNA, 19 nt, Homo sapiens
ggagaagaggcuacaagga

SEQ ID NO: 613393 - RNA, 19 nt, Homo sapiens
gggaaauacuguugaucuc

SEQ ID NO: 613394 - RNA, 19 nt, Homo sapiens
aagcaggacccuaagauga

SEQ ID NO: 613395 - RNA, 19 nt, Homo sapiens
gauuauauucacagacuga

SEQ ID NO: 613396 - RNA, 19 nt, Homo sapiens
aaacagagacugcgaaacg

SEQ ID NO: 613397 - RNA, 19 nt, Homo sapiens
agacugauuggaauucuuu

SEQ ID NO: 613398 - RNA, 19 nt, Homo sapiens
caggugcaaucuacuggaa

SEQ ID NO: 613399 - RNA, 19 nt, Homo sapiens
gaugccaggugcaaucuac

SEQ ID NO: 613400 - RNA, 19 nt, Homo sapiens
ggaacuacccaaaggucuu

SEQ ID NO: 613401 - RNA, 19 nt, Homo sapiens
uauauucacagacugauug

SEQ ID NO: 613402 - RNA, 19 nt, Homo sapiens
gcgggaagaggauggauug

SEQ ID NO: 613403 - RNA, 19 nt, Homo sapiens
ggaaauguagcacuuacgu

SEQ ID NO: 613404 - RNA, 19 nt, Homo sapiens
agauggauauugaaaugga

SEQ ID NO: 613405 - RNA, 19 nt, Homo sapiens
gaacuacccaaaggucuuc

SEQ ID NO: 613406 - RNA, 19 nt, Homo sapiens
gaaggcguccauguuuauu

SEQ ID NO: 613407 - RNA, 19 nt, Homo sapiens
aauaucaccuagcaugugu

SEQ ID NO: 613408 - RNA, 19 nt, Homo sapiens
agagcgaugucuacuacuu

SEQ ID NO: 613409 - RNA, 19 nt, Homo sapiens
ugauuggaauucuuucugu

SEQ ID NO: 613410 - RNA, 19 nt, Homo sapiens
gcaggacccuaagaugaag

SEQ ID NO: 613411 - RNA, 19 nt, Homo sapiens
uagacaaacagcaucaauu

SEQ ID NO: 613412 - RNA, 19 nt, Homo sapiens
acucuuggcuacagugaga

SEQ ID NO: 613413 - RNA, 19 nt, Homo sapiens
aggaggaagugauccgaaa

SEQ ID NO: 613414 - RNA, 19 nt, Homo sapiens
gcgcuuggaggaccuaaga

SEQ ID NO: 613415 - RNA, 19 nt, Homo sapiens
gaagauagcgcauauauuu

SEQ ID NO: 613416 - RNA, 19 nt, Homo sapiens
gaugaugccuaguaaauua

SEQ ID NO: 613417 - RNA, 19 nt, Homo sapiens
gaaagaugaugccuaguaa

SEQ ID NO: 613418 - RNA, 19 nt, Homo sapiens
gaacagaucaggaauucua

SEQ ID NO: 613419 - RNA, 19 nt, Homo sapiens
cagaagagauggauauuga

SEQ ID NO: 613420 - RNA, 19 nt, Homo sapiens
ggaaagaugaugccuagua

SEQ ID NO: 613421 - RNA, 19 nt, Homo sapiens
gaaacgauccucucaauca

SEQ ID NO: 613422 - RNA, 19 nt, Homo sapiens
gaaaggguuuguaauacuu

SEQ ID NO: 613423 - RNA, 19 nt, Homo sapiens
gcaaucuacuggaaaugua

SEQ ID NO: 613424 - RNA, 19 nt, Homo sapiens
ggaggaagauagcgcauau

SEQ ID NO: 613425 - RNA, 19 nt, Homo sapiens
cuaagaauaugaucaggua

SEQ ID NO: 613426 - RNA, 19 nt, Homo sapiens
gagaugaagccuaagaaua

SEQ ID NO: 613427 - RNA, 19 nt, Homo sapiens
ucacaaaucauccuaguaa

SEQ ID NO: 613428 - RNA, 19 nt, Homo sapiens
gaacagccacgucagcuuu

SEQ ID NO: 613429 - RNA, 19 nt, Homo sapiens
uaaccaaagucacaaauca

SEQ ID NO: 613430 - RNA, 19 nt, Homo sapiens
gaagagauggauauugaaa

SEQ ID NO: 613431 - RNA, 19 nt, Homo sapiens
uagaaggcguccauguuua

SEQ ID NO: 613432 - RNA, 19 nt, Homo sapiens
gcgcauauauuugcaguau

SEQ ID NO: 613433 - RNA, 19 nt, Homo sapiens
gcgaaacgauccucucaau

SEQ ID NO: 613434 - RNA, 19 nt, Homo sapiens
gguaagaaguucagaagca

SEQ ID NO: 613435 - RNA, 19 nt, Homo sapiens
ccacuagcuuacugaguua

SEQ ID NO: 613436 - RNA, 19 nt, Homo sapiens
gcacuuacguaaaacauuu

SEQ ID NO: 613437 - RNA, 19 nt, Homo sapiens
gaaaucagacccacaacga

SEQ ID NO: 613438 - RNA, 19 nt, Homo sapiens
caagagcgaugucuacuac

SEQ ID NO: 613439 - RNA, 19 nt, Homo sapiens
agacaaacagcaucaauuu

SEQ ID NO: 613440 - RNA, 19 nt, Homo sapiens
gaaaagaacccugcuguuu

SEQ ID NO: 613441 - RNA, 19 nt, Homo sapiens
aaaccagacuugaauacaa

SEQ ID NO: 613442 - RNA, 19 nt, Homo sapiens
aggcagaguugcuuaauga

SEQ ID NO: 613443 - RNA, 19 nt, Homo sapiens
gcaagguaccugggaaaua

SEQ ID NO: 613444 - RNA, 19 nt, Homo sapiens
ucaccuagcauguguaauu

SEQ ID NO: 613445 - RNA, 19 nt, Homo sapiens
ggacaccuguacauucuuc

SEQ ID NO: 613446 - RNA, 19 nt, Homo sapiens
cuucagaacuggaaagaug

SEQ ID NO: 613447 - RNA, 19 nt, Homo sapiens
caagguaccugggaaauac

SEQ ID NO: 613448 - RNA, 19 nt, Homo sapiens
agagauggauauugaaaug

SEQ ID NO: 613449 - RNA, 19 nt, Homo sapiens
guaagaaguucagaagcaa

SEQ ID NO: 613450 - RNA, 19 nt, Homo sapiens
gaguguaacuuucauacca

SEQ ID NO: 613451 - RNA, 19 nt, Homo sapiens
gaaaagcacacacaauaaa

SEQ ID NO: 613452 - RNA, 19 nt, Homo sapiens
gaaauguagcacuuacgua

SEQ ID NO: 613453 - RNA, 19 nt, Homo sapiens
caguggagaugaagccuaa

SEQ ID NO: 613454 - RNA, 19 nt, Homo sapiens
agaugaagccuaagaauau

SEQ ID NO: 613455 - RNA, 19 nt, Homo sapiens
gcaaguacgcaagaaauug

SEQ ID NO: 613456 - RNA, 19 nt, Homo sapiens
ccaauccuuuccuccauaa

SEQ ID NO: 613457 - RNA, 19 nt, Homo sapiens
gaagaaggaggaagugauc

SEQ ID NO: 613458 - RNA, 19 nt, Homo sapiens
gcagaguugcuuaaugaaa

SEQ ID NO: 613459 - RNA, 19 nt, Homo sapiens
gaugaagccuaagaauaug

SEQ ID NO: 613460 - RNA, 19 nt, Homo sapiens
gcaagagcgaugucuacua

SEQ ID NO: 613461 - RNA, 19 nt, Homo sapiens
aaauguagcacuuacguaa

SEQ ID NO: 613462 - RNA, 19 nt, Homo sapiens
aaagaacccugcuguuugg

SEQ ID NO: 613463 - RNA, 19 nt, Homo sapiens
caaacaaccgguaaccaaa

SEQ ID NO: 613464 - RNA, 19 nt, Homo sapiens
cuagaaggcguccauguuu

SEQ ID NO: 613465 - RNA, 19 nt, Homo sapiens
ggaagauagcgcauauauu

SEQ ID NO: 613466 - RNA, 19 nt, Homo sapiens
gauuuacauucaacucuga

SEQ ID NO: 613467 - RNA, 19 nt, Homo sapiens
cagaguugcuuaaugaaag

SEQ ID NO: 613468 - RNA, 19 nt, Homo sapiens
gcgagcugcugauacagaa

SEQ ID NO: 613469 - RNA, 19 nt, Homo sapiens
agacuugaauacaacauug

SEQ ID NO: 613470 - RNA, 19 nt, Homo sapiens
aaacgauccucucaaucaa

SEQ ID NO: 613471 - RNA, 19 nt, Homo sapiens
aagaacagaucaggaauuc

SEQ ID NO: 613472 - RNA, 19 nt, Homo sapiens
gaaauggacaguggagaug

SEQ ID NO: 613473 - RNA, 19 nt, Homo sapiens
caccuagcauguguaauuu

SEQ ID NO: 613474 - RNA, 19 nt, Homo sapiens
gaaacaggaagagcgagua

SEQ ID NO: 613475 - RNA, 19 nt, Homo sapiens
gguaaaccagacuugaaua

SEQ ID NO: 613476 - RNA, 19 nt, Homo sapiens
ugaaaggguuuguaauacu

SEQ ID NO: 613477 - RNA, 19 nt, Homo sapiens
gauuggaauucuuucuguu

SEQ ID NO: 613478 - RNA, 19 nt, Homo sapiens
caaaggucuucaaggaguu

SEQ ID NO: 613479 - RNA, 19 nt, Homo sapiens
ucaaacaaccgguaaccaa

SEQ ID NO: 613480 - RNA, 19 nt, Homo sapiens
uaacuuucauaccacuuga

SEQ ID NO: 613481 - RNA, 19 nt, Homo sapiens
ggaagaaggaggaagugau

SEQ ID NO: 613482 - RNA, 19 nt, Homo sapiens
ggugcaaucuacuggaaau

SEQ ID NO: 613483 - RNA, 19 nt, Homo sapiens
uccacuagcuuacugaguu

SEQ ID NO: 613484 - RNA, 19 nt, Homo sapiens
gcguccauguuuauuguuu

SEQ ID NO: 613485 - RNA, 19 nt, Homo sapiens
ugagucagauacacaagga

SEQ ID NO: 613486 - RNA, 19 nt, Homo sapiens
uaagaacagaucaggaauu

SEQ ID NO: 613487 - RNA, 19 nt, Homo sapiens
aauaagaacagaucaggaa

SEQ ID NO: 613488 - RNA, 19 nt, Homo sapiens
uaauagcacuaaccaaugc

SEQ ID NO: 613489 - RNA, 19 nt, Homo sapiens
ggaaauacuguugaucuca

SEQ ID NO: 613490 - RNA, 19 nt, Homo sapiens
ggagaugaagccuaagaau

SEQ ID NO: 613491 - RNA, 19 nt, Homo sapiens
acccaaaggucuucaagga

SEQ ID NO: 613492 - RNA, 19 nt, Homo sapiens
ccaagacccagcuucauug

SEQ ID NO: 613493 - RNA, 19 nt, Homo sapiens
acauggagguggaggaaga

SEQ ID NO: 613494 - RNA, 19 nt, Homo sapiens
ggagaagaggcuacaagga

SEQ ID NO: 613495 - RNA, 19 nt, Homo sapiens
gggaaauacuguugaucuc

SEQ ID NO: 613496 - RNA, 19 nt, Homo sapiens
aagcaggacccuaagauga

SEQ ID NO: 613497 - RNA, 19 nt, Homo sapiens
ggcaugcgcuuucaagacu

SEQ ID NO: 613498 - RNA, 19 nt, Homo sapiens
aaaauaagcugcgcuggaa

SEQ ID NO: 613499 - RNA, 19 nt, Homo sapiens
gauuauauucacagacuga

SEQ ID NO: 613500 - RNA, 19 nt, Homo sapiens
aaacagagacugcgaaacg

SEQ ID NO: 613501 - RNA, 19 nt, Homo sapiens
agacugauuggaauucuuu

SEQ ID NO: 613502 - RNA, 19 nt, Homo sapiens
caggugcaaucuacuggaa

SEQ ID NO: 613503 - RNA, 19 nt, Homo sapiens
gaugccaggugcaaucuac

SEQ ID NO: 613504 - RNA, 19 nt, Homo sapiens
ggaacuacccaaaggucuu

SEQ ID NO: 613505 - RNA, 19 nt, Homo sapiens
uauauucacagacugauug

SEQ ID NO: 613506 - RNA, 19 nt, Homo sapiens
gcgggaagaggauggauug

SEQ ID NO: 613507 - RNA, 19 nt, Homo sapiens
ggaaauguagcacuuacgu

SEQ ID NO: 613508 - RNA, 19 nt, Homo sapiens
agauggauauugaaaugga

SEQ ID NO: 613509 - RNA, 19 nt, Homo sapiens
gaacuacccaaaggucuuc

SEQ ID NO: 613510 - RNA, 19 nt, Homo sapiens
gaaggcguccauguuuauu

SEQ ID NO: 613511 - RNA, 19 nt, Homo sapiens
aauaucaccuagcaugugu

SEQ ID NO: 613512 - RNA, 19 nt, Homo sapiens
agagcgaugucuacuacuu

SEQ ID NO: 613513 - RNA, 19 nt, Homo sapiens
ugauuggaauucuuucugu

SEQ ID NO: 613514 - RNA, 19 nt, Homo sapiens
gcaggacccuaagaugaag

SEQ ID NO: 613515 - RNA, 19 nt, Homo sapiens
ccagaaaccucuuguguuc

SEQ ID NO: 613516 - RNA, 19 nt, Homo sapiens
gcaacugucucucugaugu

SEQ ID NO: 613517 - RNA, 19 nt, Homo sapiens
gggaggguccgcuguguua

SEQ ID NO: 613518 - RNA, 19 nt, Homo sapiens
ccaaaucgagucucucauu

SEQ ID NO: 613519 - RNA, 19 nt, Homo sapiens
gcaagcugggcuccuguua

SEQ ID NO: 613520 - RNA, 19 nt, Homo sapiens
ccagacgacuacaucauuc

SEQ ID NO: 613521 - RNA, 19 nt, Homo sapiens
cagacgggcuccuacaugu

SEQ ID NO: 613522 - RNA, 19 nt, Homo sapiens
gaaggugacguuccucauc

SEQ ID NO: 613523 - RNA, 19 nt, Homo sapiens
gcguagugcuugccuuugu

SEQ ID NO: 613524 - RNA, 19 nt, Homo sapiens
gcagacgggcuccuacaug

SEQ ID NO: 613525 - RNA, 19 nt, Homo sapiens
aagcugggcuccuguuaca

SEQ ID NO: 613526 - RNA, 19 nt, Homo sapiens
uacacuaccuggagaaagu

SEQ ID NO: 613527 - RNA, 19 nt, Homo sapiens
gccagacgacuacaucauu

SEQ ID NO: 613528 - RNA, 19 nt, Homo sapiens
gcagccaaaucgagucucu

SEQ ID NO: 613529 - RNA, 19 nt, Homo sapiens
ggaggacgaggacuucuag

SEQ ID NO: 613530 - RNA, 19 nt, Homo sapiens
gaaaccucuuguguucuug

SEQ ID NO: 613531 - RNA, 19 nt, Homo sapiens
aaggugacguuccucauca

SEQ ID NO: 613532 - RNA, 19 nt, Homo sapiens
ccacagccaucgccaucca

SEQ ID NO: 613533 - RNA, 19 nt, Homo sapiens
ggucgggugcagcugauaa

SEQ ID NO: 613534 - RNA, 19 nt, Homo sapiens
ggaggaggacgaggacuuc

SEQ ID NO: 613535 - RNA, 19 nt, Homo sapiens
agacugcugcuccuaguga

SEQ ID NO: 613536 - RNA, 19 nt, Homo sapiens
gacgggcuccuacauguuc

SEQ ID NO: 613537 - RNA, 19 nt, Homo sapiens
ccaguuaguuuugcccaua

SEQ ID NO: 613538 - RNA, 19 nt, Homo sapiens
cguagugcuugccuuuguu

SEQ ID NO: 613539 - RNA, 19 nt, Homo sapiens
gggaggaggacgaggacuu

SEQ ID NO: 613540 - RNA, 19 nt, Homo sapiens
cccagaaaccucuuguguu

SEQ ID NO: 613541 - RNA, 19 nt, Homo sapiens
ccagacugccagacgacua

SEQ ID NO: 613542 - RNA, 19 nt, Homo sapiens
gcugggcuccuguuacaca

SEQ ID NO: 613543 - RNA, 19 nt, Homo sapiens
cgacagacugcugcuccua

SEQ ID NO: 613544 - RNA, 19 nt, Homo sapiens
ccgcguagugcuugccuuu

SEQ ID NO: 613545 - RNA, 19 nt, Homo sapiens
acagacugcugcuccuagu

SEQ ID NO: 613546 - RNA, 19 nt, Homo sapiens
ccucaucacccgccucaca

SEQ ID NO: 613547 - RNA, 19 nt, Homo sapiens
gaaaguagauagacagaaa

SEQ ID NO: 613548 - RNA, 19 nt, Homo sapiens
gggaauaccugggaaguuu

SEQ ID NO: 613549 - RNA, 19 nt, Homo sapiens
gagcugagaucacaccauu

SEQ ID NO: 613550 - RNA, 19 nt, Homo sapiens
gaaaucagcaccugcguuu

SEQ ID NO: 613551 - RNA, 19 nt, Homo sapiens
gaugagaaauuccacagaa

SEQ ID NO: 613552 - RNA, 19 nt, Homo sapiens
uaucaugacuuccaauuga

SEQ ID NO: 613553 - RNA, 19 nt, Homo sapiens
ggaggcccauugucacuua

SEQ ID NO: 613554 - RNA, 19 nt, Homo sapiens
guugaugucuuaaugcaua

SEQ ID NO: 613555 - RNA, 19 nt, Homo sapiens
ggccugaaguucugugaua

SEQ ID NO: 613556 - RNA, 19 nt, Homo sapiens
ucucuaggauggugauuua

SEQ ID NO: 613557 - RNA, 19 nt, Homo sapiens
gagcuuaauccucaugaua

SEQ ID NO: 613558 - RNA, 19 nt, Homo sapiens
aaacaucagucaaggagaa

SEQ ID NO: 613559 - RNA, 19 nt, Homo sapiens
cuacuagaccguuuaauuu

SEQ ID NO: 613560 - RNA, 19 nt, Homo sapiens
gcaacuuugugaacaugua

SEQ ID NO: 613561 - RNA, 19 nt, Homo sapiens
ggauuagccuuucacaugu

SEQ ID NO: 613562 - RNA, 19 nt, Homo sapiens
cuaggauggugauuuauaa

SEQ ID NO: 613563 - RNA, 19 nt, Homo sapiens
gcugugaugcuucgaaaua

SEQ ID NO: 613564 - RNA, 19 nt, Homo sapiens
cagcuacucuggagacuga

SEQ ID NO: 613565 - RNA, 19 nt, Homo sapiens
ugaaacuucuaacgucaua

SEQ ID NO: 613566 - RNA, 19 nt, Homo sapiens
gaaauuccacagaagauau

SEQ ID NO: 613567 - RNA, 19 nt, Homo sapiens
ggucaggaguucaagauca

SEQ ID NO: 613568 - RNA, 19 nt, Homo sapiens
gguguaagaucuucucauc

SEQ ID NO: 613569 - RNA, 19 nt, Homo sapiens
cuaccuaucucaugcaaug

SEQ ID NO: 613570 - RNA, 19 nt, Homo sapiens
caucaagaauagucaaguu

SEQ ID NO: 613571 - RNA, 19 nt, Homo sapiens
gagaacgguuucacagguu

SEQ ID NO: 613572 - RNA, 19 nt, Homo sapiens
gaaucugaauggaagaaga

SEQ ID NO: 613573 - RNA, 19 nt, Homo sapiens
caucagcccucaauuugug

SEQ ID NO: 613574 - RNA, 19 nt, Homo sapiens
gauggugauuuauaaccua

SEQ ID NO: 613575 - RNA, 19 nt, Homo sapiens
gcuaguaguguuuggcuua

SEQ ID NO: 613576 - RNA, 19 nt, Homo sapiens
caggagcgcuucaccucua

SEQ ID NO: 613577 - RNA, 19 nt, Homo sapiens
guaaggaggcccauuguca

SEQ ID NO: 613578 - RNA, 19 nt, Homo sapiens
gaacccaugugcauuucug

SEQ ID NO: 613579 - RNA, 19 nt, Homo sapiens
gugaacauguaggcacuua

SEQ ID NO: 613580 - RNA, 19 nt, Homo sapiens
uuaaguuucucuugucuug

SEQ ID NO: 613581 - RNA, 19 nt, Homo sapiens
guuagugccuucgguguaa

SEQ ID NO: 613582 - RNA, 19 nt, Homo sapiens
ugaauugucuccugacuac

SEQ ID NO: 613583 - RNA, 19 nt, Homo sapiens
gaacauguaggcacuuagu

SEQ ID NO: 613584 - RNA, 19 nt, Homo sapiens
gacagaaaaucauuaggua

SEQ ID NO: 613585 - RNA, 19 nt, Homo sapiens
gaucaaccuggccaacaua

SEQ ID NO: 613586 - RNA, 19 nt, Homo sapiens
guaggaaaguagauagaca

SEQ ID NO: 613587 - RNA, 19 nt, Homo sapiens
gaagaaaagagagaaguua

SEQ ID NO: 613588 - RNA, 19 nt, Homo sapiens
uuucuggguugaugucuua

SEQ ID NO: 613589 - RNA, 19 nt, Homo sapiens
ggacagaaacaucagucaa

SEQ ID NO: 613590 - RNA, 19 nt, Homo sapiens
aaauaaguguccuaaguca

SEQ ID NO: 613591 - RNA, 19 nt, Homo sapiens
cagauugaccgguucagua

SEQ ID NO: 613592 - RNA, 19 nt, Homo sapiens
ccaaaguuaucgauauucu

SEQ ID NO: 613593 - RNA, 19 nt, Homo sapiens
gcagugaaccgagaucaug

SEQ ID NO: 613594 - RNA, 19 nt, Homo sapiens
gauaucaugacuuccaauu

SEQ ID NO: 613595 - RNA, 19 nt, Homo sapiens
gcgaccaccuguucaaagu

SEQ ID NO: 613596 - RNA, 19 nt, Homo sapiens
ucaccuacuucugagcuua

SEQ ID NO: 613597 - RNA, 19 nt, Homo sapiens
gauuagccuuucacauguu

SEQ ID NO: 613598 - RNA, 19 nt, Homo sapiens
gcaggagaaucacuugaac

SEQ ID NO: 613599 - RNA, 19 nt, Homo sapiens
caggacagcuucagcaaac

SEQ ID NO: 613600 - RNA, 19 nt, Homo sapiens
ucauaauucucaccuacuu

SEQ ID NO: 613601 - RNA, 19 nt, Homo sapiens
gcagguuucuggguugaug

SEQ ID NO: 613602 - RNA, 19 nt, Homo sapiens
uggauuagccuuucacaug

SEQ ID NO: 613603 - RNA, 19 nt, Homo sapiens
aguaguguuuggcuuauuu

SEQ ID NO: 613604 - RNA, 19 nt, Homo sapiens
gaaaccccgucucuacuaa

SEQ ID NO: 613605 - RNA, 19 nt, Homo sapiens
cuagaccguuuaauuuguu

SEQ ID NO: 613606 - RNA, 19 nt, Homo sapiens
aggcagagguugcagugaa

SEQ ID NO: 613607 - RNA, 19 nt, Homo sapiens
gccacuaccuucagcaaca

SEQ ID NO: 613608 - RNA, 19 nt, Homo sapiens
uaaauaaguguccuaaguc

SEQ ID NO: 613609 - RNA, 19 nt, Homo sapiens
ucaccucuaugacacgauu

SEQ ID NO: 613610 - RNA, 19 nt, Homo sapiens
guucugugauagaccuuaa

SEQ ID NO: 613611 - RNA, 19 nt, Homo sapiens
ccucacagcuuugggaauc

SEQ ID NO: 613612 - RNA, 19 nt, Homo sapiens
gauggcacgugucuguaau

SEQ ID NO: 613613 - RNA, 19 nt, Homo sapiens
ucucaucagcccucaauuu

SEQ ID NO: 613614 - RNA, 19 nt, Homo sapiens
uguaagaucuucucaucag

SEQ ID NO: 613615 - RNA, 19 nt, Homo sapiens
uuaagucucuucccuuugg

SEQ ID NO: 613616 - RNA, 19 nt, Homo sapiens
gccucugccuguguuauua

SEQ ID NO: 613617 - RNA, 19 nt, Homo sapiens
uacccaaaguuaucgauau

SEQ ID NO: 613618 - RNA, 19 nt, Homo sapiens
ggaugccucugccuguguu

SEQ ID NO: 613619 - RNA, 19 nt, Homo sapiens
ucccagaagucacuguauu

SEQ ID NO: 613620 - RNA, 19 nt, Homo sapiens
gggacuacaucaaucuaca

SEQ ID NO: 613621 - RNA, 19 nt, Homo sapiens
gagaaauuccacagaagau

SEQ ID NO: 613622 - RNA, 19 nt, Homo sapiens
gaaggacuccgucucaaaa

SEQ ID NO: 613623 - RNA, 19 nt, Homo sapiens
cagccugggugacagagaa

SEQ ID NO: 613624 - RNA, 19 nt, Homo sapiens
cuaugacacgauuguauua

SEQ ID NO: 613625 - RNA, 19 nt, Homo sapiens
ccaguaaggaggcccauug

SEQ ID NO: 613626 - RNA, 19 nt, Homo sapiens
ucuaggauggugauuuaua

SEQ ID NO: 613627 - RNA, 19 nt, Homo sapiens
gaucacaugaggccaggaa

SEQ ID NO: 613628 - RNA, 19 nt, Homo sapiens
gauucuuucugucuuggaa

SEQ ID NO: 613629 - RNA, 19 nt, Homo sapiens
ggacuacaucaaucuacaa

SEQ ID NO: 613630 - RNA, 19 nt, Homo sapiens
cacagaagauaucaugucu

SEQ ID NO: 613631 - RNA, 19 nt, Homo sapiens
gucaggaguucaagaucaa

SEQ ID NO: 613632 - RNA, 19 nt, Homo sapiens
gcacuuagucauaggaaac

SEQ ID NO: 613633 - RNA, 19 nt, Homo sapiens
gggcaacuuugugaacaug

SEQ ID NO: 613634 - RNA, 19 nt, Homo sapiens
agacugaggugggagaauc

SEQ ID NO: 613635 - RNA, 19 nt, Homo sapiens
ucacauuagugccaguuag

SEQ ID NO: 613636 - RNA, 19 nt, Homo sapiens
ugagaaauuccacagaaga

SEQ ID NO: 613637 - RNA, 19 nt, Homo sapiens
acccaaaguuaucgauauu

SEQ ID NO: 613638 - RNA, 19 nt, Homo sapiens
gauauucccaggacagcuu

SEQ ID NO: 613639 - RNA, 19 nt, Homo sapiens
gacagaaacaucagucaag

SEQ ID NO: 613640 - RNA, 19 nt, Homo sapiens
uuuauaaccuacccaaagu

SEQ ID NO: 613641 - RNA, 19 nt, Homo sapiens
acuacuagaccguuuaauu

SEQ ID NO: 613642 - RNA, 19 nt, Homo sapiens
ucacaugaggccaggaauu

SEQ ID NO: 613643 - RNA, 19 nt, Homo sapiens
uaaagagaacgguuucaca

SEQ ID NO: 613644 - RNA, 19 nt, Homo sapiens
ucaguaaagagaacgguuu

SEQ ID NO: 613645 - RNA, 19 nt, Homo sapiens
agauugaccgguucaguaa

SEQ ID NO: 613646 - RNA, 19 nt, Homo sapiens
caaccuggccaacauacug

SEQ ID NO: 613647 - RNA, 19 nt, Homo sapiens
ggacagugcuccagugaaa

SEQ ID NO: 613648 - RNA, 19 nt, Homo sapiens
ggagauguaugauauuuga

SEQ ID NO: 613649 - RNA, 19 nt, Homo sapiens
gaauaacacucuaagaaag

SEQ ID NO: 613650 - RNA, 19 nt, Homo sapiens
gaaacccugucucuacuaa

SEQ ID NO: 613651 - RNA, 19 nt, Homo sapiens
gaaaggugaauuugcaaua

SEQ ID NO: 613652 - RNA, 19 nt, Homo sapiens
agacaaaggugaugcagaa

SEQ ID NO: 613653 - RNA, 19 nt, Homo sapiens
ugaagaaugugguugcuaa

SEQ ID NO: 613654 - RNA, 19 nt, Homo sapiens
gggauaagagcacugauua

SEQ ID NO: 613655 - RNA, 19 nt, Homo sapiens
caaagaugcugaagaaugg

SEQ ID NO: 613656 - RNA, 19 nt, Homo sapiens
aagagagaaucccuuauua

SEQ ID NO: 613657 - RNA, 19 nt, Homo sapiens
gcaaggaauacaauagaua

SEQ ID NO: 613658 - RNA, 19 nt, Homo sapiens
gaggagaauuauaugauga

SEQ ID NO: 613659 - RNA, 19 nt, Homo sapiens
gaaagaaagauugcuguuu

SEQ ID NO: 613660 - RNA, 19 nt, Homo sapiens
ggugugauuuguaauguuu

SEQ ID NO: 613661 - RNA, 19 nt, Homo sapiens
ccaauaagcaauccacuaa

SEQ ID NO: 613662 - RNA, 19 nt, Homo sapiens
gaaugugguugcuaaacaa

SEQ ID NO: 613663 - RNA, 19 nt, Homo sapiens
gguagaugcugaagaaugu

SEQ ID NO: 613664 - RNA, 19 nt, Homo sapiens
gaucauccucuaccaauaa

SEQ ID NO: 613665 - RNA, 19 nt, Homo sapiens
gaugcaaccaguuaaguua

SEQ ID NO: 613666 - RNA, 19 nt, Homo sapiens
aagaaaggauggaaagaaa

SEQ ID NO: 613667 - RNA, 19 nt, Homo sapiens
gaagaacaaaggaagauga

SEQ ID NO: 613668 - RNA, 19 nt, Homo sapiens
gaaaggauggaaagaaaga

SEQ ID NO: 613669 - RNA, 19 nt, Homo sapiens
caaagaaugcuaaagaaug

SEQ ID NO: 613670 - RNA, 19 nt, Homo sapiens
ccucugaugugaaauuaaa

SEQ ID NO: 613671 - RNA, 19 nt, Homo sapiens
gaaaagagagaaucccuua

SEQ ID NO: 613672 - RNA, 19 nt, Homo sapiens
gaagugcguaccagaagua

SEQ ID NO: 613673 - RNA, 19 nt, Homo sapiens
caaaggugaugcagaagau

SEQ ID NO: 613674 - RNA, 19 nt, Homo sapiens
ugagagaggagaauuauau

SEQ ID NO: 613675 - RNA, 19 nt, Homo sapiens
ccaaagaugcugaagaaug

SEQ ID NO: 613676 - RNA, 19 nt, Homo sapiens
ucccaaagaugcugaagaa

SEQ ID NO: 613677 - RNA, 19 nt, Homo sapiens
ucaggaauuucaagacaaa

SEQ ID NO: 613678 - RNA, 19 nt, Homo sapiens
gauguaaagucuaucuauc

SEQ ID NO: 613679 - RNA, 19 nt, Homo sapiens
gcuaaagaauguucaaacu

SEQ ID NO: 613680 - RNA, 19 nt, Homo sapiens
gaagaugagucaggauagu

SEQ ID NO: 613681 - RNA, 19 nt, Homo sapiens
gcugaaauuuguauugcaa

SEQ ID NO: 613682 - RNA, 19 nt, Homo sapiens
gcagucaaccaauagauga

SEQ ID NO: 613683 - RNA, 19 nt, Homo sapiens
aaagagagaaucccuuauu

SEQ ID NO: 613684 - RNA, 19 nt, Homo sapiens
uccagacacuauuucauua

SEQ ID NO: 613685 - RNA, 19 nt, Homo sapiens
gcacgagaauugcuugaac

SEQ ID NO: 613686 - RNA, 19 nt, Homo sapiens
aacaagcagucaaccaaua

SEQ ID NO: 613687 - RNA, 19 nt, Homo sapiens
ugaaaucucugcuccugau

SEQ ID NO: 613688 - RNA, 19 nt, Homo sapiens
gccuaaagccuacauaaug

SEQ ID NO: 613689 - RNA, 19 nt, Homo sapiens
gaaaguggaagaacaaagg

SEQ ID NO: 613690 - RNA, 19 nt, Homo sapiens
acagaaaggugaauuugca

SEQ ID NO: 613691 - RNA, 19 nt, Homo sapiens
caacagaaaggugaauuug

SEQ ID NO: 613692 - RNA, 19 nt, Homo sapiens
cuaucuaucuucaggaauu

SEQ ID NO: 613693 - RNA, 19 nt, Homo sapiens
ggagaaaauuuauccaaga

SEQ ID NO: 613694 - RNA, 19 nt, Homo sapiens
gauaaagacaaacaacaga

SEQ ID NO: 613695 - RNA, 19 nt, Homo sapiens
ggaaagaaagauugcuguu

SEQ ID NO: 613696 - RNA, 19 nt, Homo sapiens
ggccaaggcacgagaauug

SEQ ID NO: 613697 - RNA, 19 nt, Homo sapiens
gcuaaacaaagaaugcuaa

SEQ ID NO: 613698 - RNA, 19 nt, Homo sapiens
uuuaugcagucgcucauua

SEQ ID NO: 613699 - RNA, 19 nt, Homo sapiens
gagaggagaauuauaugau

SEQ ID NO: 613700 - RNA, 19 nt, Homo sapiens
uaagaaaggauggaaagaa

SEQ ID NO: 613701 - RNA, 19 nt, Homo sapiens
cagaaugaauaacacucua

SEQ ID NO: 613702 - RNA, 19 nt, Homo sapiens
gaagugauaaagacaaaca

SEQ ID NO: 613703 - RNA, 19 nt, Homo sapiens
ucacagcuuucugggauuu

SEQ ID NO: 613704 - RNA, 19 nt, Homo sapiens
gauaugauaaagacgauga

SEQ ID NO: 613705 - RNA, 19 nt, Homo sapiens
ccucagaacgauaugauaa

SEQ ID NO: 613706 - RNA, 19 nt, Homo sapiens
gugcguaccagaaguauga

SEQ ID NO: 613707 - RNA, 19 nt, Homo sapiens
aauaagcaauccacuaaca

SEQ ID NO: 613708 - RNA, 19 nt, Homo sapiens
cuucuggugugauuuguaa

SEQ ID NO: 613709 - RNA, 19 nt, Homo sapiens
agagagaaucccuuauuaa

SEQ ID NO: 613710 - RNA, 19 nt, Homo sapiens
ccuaaagccuacauaaugg

SEQ ID NO: 613711 - RNA, 19 nt, Homo sapiens
ugaaacauuuguagcagau

SEQ ID NO: 613712 - RNA, 19 nt, Homo sapiens
gaugagagaggagaauuau

SEQ ID NO: 613713 - RNA, 19 nt, Homo sapiens
gcacaagaccuuccuuuug

SEQ ID NO: 613714 - RNA, 19 nt, Homo sapiens
gaagaaugugguugcuaaa

SEQ ID NO: 613715 - RNA, 19 nt, Homo sapiens
ugauuugugugaagaauuc

SEQ ID NO: 613716 - RNA, 19 nt, Homo sapiens
uaccagggauugugggauu

SEQ ID NO: 613717 - RNA, 19 nt, Homo sapiens
uguagcagauauacugaaa

SEQ ID NO: 613718 - RNA, 19 nt, Homo sapiens
ugaugggccuggcaacauu

SEQ ID NO: 613719 - RNA, 19 nt, Homo sapiens
uaagcguggugaugugauu

SEQ ID NO: 613720 - RNA, 19 nt, Homo sapiens
agaaugugguugcuaaaca

SEQ ID NO: 613721 - RNA, 19 nt, Homo sapiens
uuugguagaugcugaagaa

SEQ ID NO: 613722 - RNA, 19 nt, Homo sapiens
aguuauaccuguugcuauu

SEQ ID NO: 613723 - RNA, 19 nt, Homo sapiens
ugcaaccaguuaaguuaua

SEQ ID NO: 613724 - RNA, 19 nt, Homo sapiens
ggaaaauucuucugcuugu

SEQ ID NO: 613725 - RNA, 19 nt, Homo sapiens
ggagaauuauaugaugaug

SEQ ID NO: 613726 - RNA, 19 nt, Homo sapiens
agaggagaauuauaugaug

SEQ ID NO: 613727 - RNA, 19 nt, Homo sapiens
gcagcugaaauuuguauug

SEQ ID NO: 613728 - RNA, 19 nt, Homo sapiens
auagauggcuacaguguca

SEQ ID NO: 613729 - RNA, 19 nt, Homo sapiens
uagcagauauacugaaagg

SEQ ID NO: 613730 - RNA, 19 nt, Homo sapiens
aaauauuccucugauguga

SEQ ID NO: 613731 - RNA, 19 nt, Homo sapiens
ugaucauccucuaccaaua

SEQ ID NO: 613732 - RNA, 19 nt, Homo sapiens
gcccugcgcucccuaacau

SEQ ID NO: 613733 - RNA, 19 nt, Homo sapiens
aaucucugcuccugauaaa

SEQ ID NO: 613734 - RNA, 19 nt, Homo sapiens
ggugaaacccugucucuac

SEQ ID NO: 613735 - RNA, 19 nt, Homo sapiens
uggaagugauaaagacaaa

SEQ ID NO: 613736 - RNA, 19 nt, Homo sapiens
guggugugcucucaguaaa

SEQ ID NO: 613737 - RNA, 19 nt, Homo sapiens
ggauuuagaagcgucauga

SEQ ID NO: 613738 - RNA, 19 nt, Homo sapiens
gaaaucucugcuccugaua

SEQ ID NO: 613739 - RNA, 19 nt, Homo sapiens
ugcaauagauggcuacagu

SEQ ID NO: 613740 - RNA, 19 nt, Homo sapiens
aaaggugaauuugcaauag

SEQ ID NO: 613741 - RNA, 19 nt, Homo sapiens
uaaguacagccgcaagaaa

SEQ ID NO: 613742 - RNA, 19 nt, Homo sapiens
caugaaagcacgagugaca

SEQ ID NO: 613743 - RNA, 19 nt, Homo sapiens
ggaaauuaggaaccuguug

SEQ ID NO: 613744 - RNA, 19 nt, Homo sapiens
uaaguuauaccuguugcua

SEQ ID NO: 613745 - RNA, 19 nt, Homo sapiens
aagaauaugaugacccuuu

SEQ ID NO: 613746 - RNA, 19 nt, Homo sapiens
gcaaccaguuaaguuauac

SEQ ID NO: 613747 - RNA, 19 nt, Homo sapiens
gaugauagcuguuggagua

SEQ ID NO: 613748 - RNA, 19 nt, Homo sapiens
gaaagcaacugaaauugaa

SEQ ID NO: 613749 - RNA, 19 nt, Homo sapiens
gcacaaagguuaaucucaa

SEQ ID NO: 613750 - RNA, 19 nt, Homo sapiens
gaaauacucugacuuaaac

SEQ ID NO: 613751 - RNA, 19 nt, Homo sapiens
gaaaguacauuuagcuugu

SEQ ID NO: 613752 - RNA, 19 nt, Homo sapiens
uaaagaaggucugaaguuu

SEQ ID NO: 613753 - RNA, 19 nt, Homo sapiens
ggagaaaucagcauguuaa

SEQ ID NO: 613754 - RNA, 19 nt, Homo sapiens
gaauaacgaugaaagaaag

SEQ ID NO: 613755 - RNA, 19 nt, Homo sapiens
cgaauacacucagaaagua

SEQ ID NO: 613756 - RNA, 19 nt, Homo sapiens
ucaauauacucacuccuua

SEQ ID NO: 613757 - RNA, 19 nt, Homo sapiens
gaacuggaauaacgaugaa

SEQ ID NO: 613758 - RNA, 19 nt, Homo sapiens
aaacaagaccucagacaua

SEQ ID NO: 613759 - RNA, 19 nt, Homo sapiens
ccacuuauauauuguguga

SEQ ID NO: 613760 - RNA, 19 nt, Homo sapiens
uuacacagcuugauccaaa

SEQ ID NO: 613761 - RNA, 19 nt, Homo sapiens
ggauggaucuuacucacuu

SEQ ID NO: 613762 - RNA, 19 nt, Homo sapiens
agacauacguggaucauau

SEQ ID NO: 613763 - RNA, 19 nt, Homo sapiens
ggacagcuguuguuagagu

SEQ ID NO: 613764 - RNA, 19 nt, Homo sapiens
caacuaaguagccuaagua

SEQ ID NO: 613765 - RNA, 19 nt, Homo sapiens
ggaauaacgaugaaagaaa

SEQ ID NO: 613766 - RNA, 19 nt, Homo sapiens
ugagugagcuucugacuag

SEQ ID NO: 613767 - RNA, 19 nt, Homo sapiens
cuaaguagccuaaguaaau

SEQ ID NO: 613768 - RNA, 19 nt, Homo sapiens
agaaugaacuggaaugugu

SEQ ID NO: 613769 - RNA, 19 nt, Homo sapiens
gggcagcuguaucuacuaa

SEQ ID NO: 613770 - RNA, 19 nt, Homo sapiens
gaguaaaguugcaguggaa

SEQ ID NO: 613771 - RNA, 19 nt, Homo sapiens
aagaaacacugccuugauu

SEQ ID NO: 613772 - RNA, 19 nt, Homo sapiens
gacuuugccuauuccauua

SEQ ID NO: 613773 - RNA, 19 nt, Homo sapiens
gaaagcacauccgaucuca

SEQ ID NO: 613774 - RNA, 19 nt, Homo sapiens
guaaagaaggucugaaguu

SEQ ID NO: 613775 - RNA, 19 nt, Homo sapiens
gaagaaacacugccuugau

SEQ ID NO: 613776 - RNA, 19 nt, Homo sapiens
gcagcuguaucuacuaaug

SEQ ID NO: 613777 - RNA, 19 nt, Homo sapiens
cuugucaacuuccucauua

SEQ ID NO: 613778 - RNA, 19 nt, Homo sapiens
gaacuggcacaaagguuaa

SEQ ID NO: 613779 - RNA, 19 nt, Homo sapiens
guggaccguuuaucuguua

SEQ ID NO: 613780 - RNA, 19 nt, Homo sapiens
cccuauaaccgauuaauua

SEQ ID NO: 613781 - RNA, 19 nt, Homo sapiens
gaaacacugccuugauuau

SEQ ID NO: 613782 - RNA, 19 nt, Homo sapiens
cauccgaucucaacauuca

SEQ ID NO: 613783 - RNA, 19 nt, Homo sapiens
acauuuagcuuguaguguu

SEQ ID NO: 613784 - RNA, 19 nt, Homo sapiens
gcuacagguuugauagaaa

SEQ ID NO: 613785 - RNA, 19 nt, Homo sapiens
ugugaaauacucugacuua

SEQ ID NO: 613786 - RNA, 19 nt, Homo sapiens
ggaaaggguauuagucaga

SEQ ID NO: 613787 - RNA, 19 nt, Homo sapiens
gaggaaaggguauuaguca

SEQ ID NO: 613788 - RNA, 19 nt, Homo sapiens
gaaacaagaccucagacau

SEQ ID NO: 613789 - RNA, 19 nt, Homo sapiens
caagaugccgcuagugaaa

SEQ ID NO: 613790 - RNA, 19 nt, Homo sapiens
aagaaggucugaaguuuua

SEQ ID NO: 613791 - RNA, 19 nt, Homo sapiens
gaacuggaauguguaacca

SEQ ID NO: 613792 - RNA, 19 nt, Homo sapiens
uagauugguuggaguaaga

SEQ ID NO: 613793 - RNA, 19 nt, Homo sapiens
uagagaugaugguaaagaa

SEQ ID NO: 613794 - RNA, 19 nt, Homo sapiens
gaacagccuccaccucuca

SEQ ID NO: 613795 - RNA, 19 nt, Homo sapiens
gaaguucuacaauucaaga

SEQ ID NO: 613796 - RNA, 19 nt, Homo sapiens
ucaaugaagcacauaguuu

SEQ ID NO: 613797 - RNA, 19 nt, Homo sapiens
ugaacuggcacaaagguua

SEQ ID NO: 613798 - RNA, 19 nt, Homo sapiens
gugaaauacucugacuuaa

SEQ ID NO: 613799 - RNA, 19 nt, Homo sapiens
guugaauucucuuaaagga

SEQ ID NO: 613800 - RNA, 19 nt, Homo sapiens
gaugcuaaucucuuacaua

SEQ ID NO: 613801 - RNA, 19 nt, Homo sapiens
uaacaaugaggaaagcuuu

SEQ ID NO: 613802 - RNA, 19 nt, Homo sapiens
gcuguugaauauagugauu

SEQ ID NO: 613803 - RNA, 19 nt, Homo sapiens
aaacacugccuugauuaua

SEQ ID NO: 613804 - RNA, 19 nt, Homo sapiens
gacguacgauguuugugaa

SEQ ID NO: 613805 - RNA, 19 nt, Homo sapiens
agaaagcaacugaaauuga

SEQ ID NO: 613806 - RNA, 19 nt, Homo sapiens
ucuccuccaucacaaguua

SEQ ID NO: 613807 - RNA, 19 nt, Homo sapiens
uagaguagcagauucaguu

SEQ ID NO: 613808 - RNA, 19 nt, Homo sapiens
caucaacccuaccuguaau

SEQ ID NO: 613809 - RNA, 19 nt, Homo sapiens
gagcuucaaugacuucaac

SEQ ID NO: 613810 - RNA, 19 nt, Homo sapiens
gaggauaagaggaaggaaa

SEQ ID NO: 613811 - RNA, 19 nt, Homo sapiens
uggaauguguaaccaauau

SEQ ID NO: 613812 - RNA, 19 nt, Homo sapiens
gcauggacagcuguuguua

SEQ ID NO: 613813 - RNA, 19 nt, Homo sapiens
aauugcaccuccucuagua

SEQ ID NO: 613814 - RNA, 19 nt, Homo sapiens
agaaacacugccuugauua

SEQ ID NO: 613815 - RNA, 19 nt, Homo sapiens
cuaaugagccuuauuccau

SEQ ID NO: 613816 - RNA, 19 nt, Homo sapiens
ccaaagcgccauccaucaa

SEQ ID NO: 613817 - RNA, 19 nt, Homo sapiens
caggagacguacgauguuu

SEQ ID NO: 613818 - RNA, 19 nt, Homo sapiens
gagaaaucagcauguuaaa

SEQ ID NO: 613819 - RNA, 19 nt, Homo sapiens
gaaugaacuggaaugugua

SEQ ID NO: 613820 - RNA, 19 nt, Homo sapiens
cacauccgaucucaacauu

SEQ ID NO: 613821 - RNA, 19 nt, Homo sapiens
gagggcagcuguaucuacu

SEQ ID NO: 613822 - RNA, 19 nt, Homo sapiens
acaggaagcuaagcaugaa

SEQ ID NO: 613823 - RNA, 19 nt, Homo sapiens
ccaucaacccuaccuguaa

SEQ ID NO: 613824 - RNA, 19 nt, Homo sapiens
gacuagagcugaggaaagg

SEQ ID NO: 613825 - RNA, 19 nt, Homo sapiens
gacagcuguuguuagagua

SEQ ID NO: 613826 - RNA, 19 nt, Homo sapiens
cauccugucucgccguauu

SEQ ID NO: 613827 - RNA, 19 nt, Homo sapiens
uuugcaagcuccagcagua

SEQ ID NO: 613828 - RNA, 19 nt, Homo sapiens
auuaagagcuucaaugacu

SEQ ID NO: 613829 - RNA, 19 nt, Homo sapiens
gccuccaccucucaauaua

SEQ ID NO: 613830 - RNA, 19 nt, Homo sapiens
gauauaacaaugaggaaag

SEQ ID NO: 613831 - RNA, 19 nt, Homo sapiens
gauggaucuuacucacuuu

SEQ ID NO: 613832 - RNA, 19 nt, Homo sapiens
uggaagcuauggcugcaaa

SEQ ID NO: 613833 - RNA, 19 nt, Homo sapiens
gcacauccgaucucaacau

SEQ ID NO: 613834 - RNA, 19 nt, Homo sapiens
ccguuuaucuguuaguguu

SEQ ID NO: 613835 - RNA, 19 nt, Homo sapiens
cuacuaaugagccuuauuc

SEQ ID NO: 613836 - RNA, 19 nt, Homo sapiens
gaaaucagcauguuaaaac

SEQ ID NO: 613837 - RNA, 19 nt, Homo sapiens
gaagcaauacgaaaaggua

SEQ ID NO: 613838 - RNA, 19 nt, Homo sapiens
guauuucuuugaucuaugg

SEQ ID NO: 613839 - RNA, 19 nt, Homo sapiens
uaucuacuaaugagccuua

SEQ ID NO: 613840 - RNA, 19 nt, Homo sapiens
ccaucugccuugucaacuu

SEQ ID NO: 613841 - RNA, 19 nt, Homo sapiens
agaggaagcagaagcagaa

SEQ ID NO: 613842 - RNA, 19 nt, Homo sapiens
auacagaggauaagaggaa

SEQ ID NO: 613843 - RNA, 19 nt, Homo sapiens
ggagacguacgauguuugu

SEQ ID NO: 613844 - RNA, 19 nt, Homo sapiens
agacuuugccuauuccauu

SEQ ID NO: 613845 - RNA, 19 nt, Homo sapiens
gauagcuguuggaguaaag

SEQ ID NO: 613846 - RNA, 19 nt, Homo sapiens
auggacagcuguuguuaga

SEQ ID NO: 613847 - RNA, 19 nt, Homo sapiens
ggaagaagguggacacuca

SEQ ID NO: 613848 - RNA, 19 nt, Homo sapiens
gcaggaagcugaaugaagu

SEQ ID NO: 613849 - RNA, 19 nt, Homo sapiens
ucaaggagcuggagaagug

SEQ ID NO: 613850 - RNA, 19 nt, Homo sapiens
ugaaguaccuggaugagaa

SEQ ID NO: 613851 - RNA, 19 nt, Homo sapiens
cgaccuugcuggacauuaa

SEQ ID NO: 613852 - RNA, 19 nt, Homo sapiens
cagcgcaccugaccucuaa

SEQ ID NO: 613853 - RNA, 19 nt, Homo sapiens
gcaaagggcaggugaguca

SEQ ID NO: 613854 - RNA, 19 nt, Homo sapiens
ucaaacagaucgucaaguc

SEQ ID NO: 613855 - RNA, 19 nt, Homo sapiens
ugacgucucugcugauuuc

SEQ ID NO: 613856 - RNA, 19 nt, Homo sapiens
gcagguacuucaaacagau

SEQ ID NO: 613857 - RNA, 19 nt, Homo sapiens
cgacgaacucuucuacuuu

SEQ ID NO: 613858 - RNA, 19 nt, Homo sapiens
ggaguucuuugcccacaug

SEQ ID NO: 613859 - RNA, 19 nt, Homo sapiens
gcaccugaccucuaagaug

SEQ ID NO: 613860 - RNA, 19 nt, Homo sapiens
uggaggcccuggucaguuu

SEQ ID NO: 613861 - RNA, 19 nt, Homo sapiens
gcacuuccucuucgagauu

SEQ ID NO: 613862 - RNA, 19 nt, Homo sapiens
ccauuuaugucccucaugu

SEQ ID NO: 613863 - RNA, 19 nt, Homo sapiens
gcgagugcaucgagcaguu

SEQ ID NO: 613864 - RNA, 19 nt, Homo sapiens
gagcugaacauggacauug

SEQ ID NO: 613865 - RNA, 19 nt, Homo sapiens
ggaccacaccgaugacuuc

SEQ ID NO: 613866 - RNA, 19 nt, Homo sapiens
agucggagcugaacaugga

SEQ ID NO: 613867 - RNA, 19 nt, Homo sapiens
ccucaugucucuagauuuu

SEQ ID NO: 613868 - RNA, 19 nt, Homo sapiens
ggacgcugcacccuguaua

SEQ ID NO: 613869 - RNA, 19 nt, Homo sapiens
gacgaacucuucuacuuuu

SEQ ID NO: 613870 - RNA, 19 nt, Homo sapiens
gagcguccguugccauuac

SEQ ID NO: 613871 - RNA, 19 nt, Homo sapiens
gagcugagccccaagauga

SEQ ID NO: 613872 - RNA, 19 nt, Homo sapiens
ggcagguacuucaaacaga

SEQ ID NO: 613873 - RNA, 19 nt, Homo sapiens
gaggcaaccgugaguggua

SEQ ID NO: 613874 - RNA, 19 nt, Homo sapiens
agaggacccuggagcagaa

SEQ ID NO: 613875 - RNA, 19 nt, Homo sapiens
gagcugcggcugcacaaau

SEQ ID NO: 613876 - RNA, 19 nt, Homo sapiens
gccuggagcugcugcugaa

SEQ ID NO: 613877 - RNA, 19 nt, Homo sapiens
ugaagggcaugggcaggua

SEQ ID NO: 613878 - RNA, 19 nt, Homo sapiens
ccacguaugcccugaaagu

SEQ ID NO: 613879 - RNA, 19 nt, Homo sapiens
gggauggcguggaguucuu

SEQ ID NO: 613880 - RNA, 19 nt, Homo sapiens
guacagcacaucagucucu

SEQ ID NO: 613881 - RNA, 19 nt, Homo sapiens
acgacgaacucuucuacuu

SEQ ID NO: 613882 - RNA, 19 nt, Homo sapiens
caacuggucagcuguccuu

SEQ ID NO: 613883 - RNA, 19 nt, Homo sapiens
uacagccgcuuccauuuca

SEQ ID NO: 613884 - RNA, 19 nt, Homo sapiens
gaccuucaguucugcuaca

SEQ ID NO: 613885 - RNA, 19 nt, Homo sapiens
gaucaugacgacgauguau

SEQ ID NO: 613886 - RNA, 19 nt, Homo sapiens
caaggcugguggucagugu

SEQ ID NO: 613887 - RNA, 19 nt, Homo sapiens
gcgugguccucaacaaugu

SEQ ID NO: 613888 - RNA, 19 nt, Homo sapiens
cagaggagguggagaugcu

SEQ ID NO: 613889 - RNA, 19 nt, Homo sapiens
gcuacaagaggcugaagga

SEQ ID NO: 613890 - RNA, 19 nt, Homo sapiens
cgauguaucccugguagaa

SEQ ID NO: 613891 - RNA, 19 nt, Homo sapiens
gggcccaccgcaucucuuu

SEQ ID NO: 613892 - RNA, 19 nt, Homo sapiens
aggaggcccugcucagcua

SEQ ID NO: 613893 - RNA, 19 nt, Homo sapiens
gaagcucugguuccaagug

SEQ ID NO: 613894 - RNA, 19 nt, Homo sapiens
ggaucaugacgacgaugua

SEQ ID NO: 613895 - RNA, 19 nt, Homo sapiens
ucccucaugucucuagauu

SEQ ID NO: 613896 - RNA, 19 nt, Homo sapiens
gaggcugccaggcccauuu

SEQ ID NO: 613897 - RNA, 19 nt, Homo sapiens
gugaguggcugugcucucu

SEQ ID NO: 613898 - RNA, 19 nt, Homo sapiens
cuacagccgcuuccauuuc

SEQ ID NO: 613899 - RNA, 19 nt, Homo sapiens
ccuggacgaugaucugcaa

SEQ ID NO: 613900 - RNA, 19 nt, Homo sapiens
uuccaacccuccuuugaga

SEQ ID NO: 613901 - RNA, 19 nt, Homo sapiens
guucucaagcugaucacua

SEQ ID NO: 613902 - RNA, 19 nt, Homo sapiens
ucagggagccguggacaug

SEQ ID NO: 613903 - RNA, 19 nt, Homo sapiens
gcucuuccaacccuccuuu

SEQ ID NO: 613904 - RNA, 19 nt, Homo sapiens
ccugaaagucucugucaug

SEQ ID NO: 613905 - RNA, 19 nt, Homo sapiens
cgugacgucucugcugauu

SEQ ID NO: 613906 - RNA, 19 nt, Homo sapiens
ucagccacauccaggaguu

SEQ ID NO: 613907 - RNA, 19 nt, Homo sapiens
caaacagaucgucaaguca

SEQ ID NO: 613908 - RNA, 19 nt, Homo sapiens
gaagagcagcacccugaac

SEQ ID NO: 613909 - RNA, 19 nt, Homo sapiens
acgcagagggucaggguuu

SEQ ID NO: 613910 - RNA, 19 nt, Homo sapiens
cgucucugcugauuucuac

SEQ ID NO: 613911 - RNA, 19 nt, Homo sapiens
gaaguaccuggaugagaag

SEQ ID NO: 613912 - RNA, 19 nt, Homo sapiens
ugagggaccaggccaagug

SEQ ID NO: 613913 - RNA, 19 nt, Homo sapiens
ggacaucugggaucaugac

SEQ ID NO: 613914 - RNA, 19 nt, Homo sapiens
uguauacgacgaacucuuc

SEQ ID NO: 613915 - RNA, 19 nt, Homo sapiens
gcucaugaaguaccuggau

SEQ ID NO: 613916 - RNA, 19 nt, Homo sapiens
gcgcaccugaccucuaaga

SEQ ID NO: 613917 - RNA, 19 nt, Homo sapiens
augaugaccuucaguucug

SEQ ID NO: 613918 - RNA, 19 nt, Homo sapiens
ugaagugucugggcaagcu

SEQ ID NO: 613919 - RNA, 19 nt, Homo sapiens
cgacgauguaucccuggua

SEQ ID NO: 613920 - RNA, 19 nt, Homo sapiens
ccagagcccaggugagauc

SEQ ID NO: 613921 - RNA, 19 nt, Homo sapiens
acgacuggcuguccaccaa

SEQ ID NO: 613922 - RNA, 19 nt, Homo sapiens
gaagcuacaagaggcugaa

SEQ ID NO: 613923 - RNA, 19 nt, Homo sapiens
uggagcugcugcugaagug

SEQ ID NO: 613924 - RNA, 19 nt, Homo sapiens
aaaccugcacgcuggacua

SEQ ID NO: 613925 - RNA, 19 nt, Homo sapiens
uuaugucccucaugucucu

SEQ ID NO: 613926 - RNA, 19 nt, Homo sapiens
ugucuggugugugcuguga

SEQ ID NO: 613927 - RNA, 19 nt, Homo sapiens
cggcuuaagugaccccuuu

SEQ ID NO: 613928 - RNA, 19 nt, Homo sapiens
gaagcuggcccugcugaac

SEQ ID NO: 613929 - RNA, 19 nt, Homo sapiens
ggcgacauccgcaaguaug

SEQ ID NO: 613930 - RNA, 19 nt, Homo sapiens
gggcgacauccgcaaguau

SEQ ID NO: 613931 - RNA, 19 nt, Homo sapiens
ggauggcguggaguucuuu

SEQ ID NO: 613932 - RNA, 19 nt, Homo sapiens
gcccugaaagucucuguca

SEQ ID NO: 613933 - RNA, 19 nt, Homo sapiens
cagcagaggagcccaacuc

SEQ ID NO: 613934 - RNA, 19 nt, Homo sapiens
gggcagguacuucaaacag

SEQ ID NO: 613935 - RNA, 19 nt, Homo sapiens
ucuucgagauugaggaugu

SEQ ID NO: 613936 - RNA, 19 nt, Homo sapiens
gaagggcuccgugccaacu

SEQ ID NO: 613937 - RNA, 19 nt, Homo sapiens
ccugugcugugacgugugu

SEQ ID NO: 613938 - RNA, 19 nt, Homo sapiens
ggcaugggcagguacuuca

SEQ ID NO: 613939 - RNA, 19 nt, Homo sapiens
cuggacaucugggaucaug

SEQ ID NO: 613940 - RNA, 19 nt, Homo sapiens
caucuggguggccaacuug

SEQ ID NO: 613941 - RNA, 19 nt, Homo sapiens
acaucuggguggccaacuu

SEQ ID NO: 613942 - RNA, 19 nt, Homo sapiens
gaacgccucgcuggugaag

SEQ ID NO: 613943 - RNA, 19 nt, Homo sapiens
ugggcgacauccgcaagua

SEQ ID NO: 613944 - RNA, 19 nt, Homo sapiens
ugacaaagcuggagaagga

SEQ ID NO: 613945 - RNA, 19 nt, Homo sapiens
ggacagagaccacccacua

SEQ ID NO: 613946 - RNA, 19 nt, Homo sapiens
gcacaugggcugcgucuuu

SEQ ID NO: 613947 - RNA, 19 nt, Homo sapiens
ccagugcgcuucaagauga

SEQ ID NO: 613948 - RNA, 19 nt, Homo sapiens
gaacaucugcuuugagguu

SEQ ID NO: 613949 - RNA, 19 nt, Homo sapiens
gagacaagaugaagacugu

SEQ ID NO: 613950 - RNA, 19 nt, Homo sapiens
ggagucagcauugguaaua

SEQ ID NO: 613951 - RNA, 19 nt, Homo sapiens
ccacuacccugagaacuuu

SEQ ID NO: 613952 - RNA, 19 nt, Homo sapiens
gcgcugugguuaauacuuu

SEQ ID NO: 613953 - RNA, 19 nt, Homo sapiens
gcggaagaguggagucuaa

SEQ ID NO: 613954 - RNA, 19 nt, Homo sapiens
ggagaucgcacagauguuu

SEQ ID NO: 613955 - RNA, 19 nt, Homo sapiens
ggacugggaccgaguaaga

SEQ ID NO: 613956 - RNA, 19 nt, Homo sapiens
gcacggcuacuauaagauu

SEQ ID NO: 613957 - RNA, 19 nt, Homo sapiens
ccaucaagcucuacaagga

SEQ ID NO: 613958 - RNA, 19 nt, Homo sapiens
caacaaaugggacaaagug

SEQ ID NO: 613959 - RNA, 19 nt, Homo sapiens
gugcacggcuacuauaaga

SEQ ID NO: 613960 - RNA, 19 nt, Homo sapiens
gaagguggccugcaacaag

SEQ ID NO: 613961 - RNA, 19 nt, Homo sapiens
gaggagagccugcccacuu

SEQ ID NO: 613962 - RNA, 19 nt, Homo sapiens
ggagagacaugauaaaauc

SEQ ID NO: 613963 - RNA, 19 nt, Homo sapiens
ucaccagguuucagacuaa

SEQ ID NO: 613964 - RNA, 19 nt, Homo sapiens
gggagaacaucugcuuuga

SEQ ID NO: 613965 - RNA, 19 nt, Homo sapiens
ggugagaucugcuguacca

SEQ ID NO: 613966 - RNA, 19 nt, Homo sapiens
caacaagugcaacguggua

SEQ ID NO: 613967 - RNA, 19 nt, Homo sapiens
agaguggagucuaaacuuu

SEQ ID NO: 613968 - RNA, 19 nt, Homo sapiens
gcgggaagcgcacgcauuu

SEQ ID NO: 613969 - RNA, 19 nt, Homo sapiens
gaaacuggagugugaagga

SEQ ID NO: 613970 - RNA, 19 nt, Homo sapiens
ucauggcacuucaaacuau

SEQ ID NO: 613971 - RNA, 19 nt, Homo sapiens
agacagaucucuccuuuug

SEQ ID NO: 613972 - RNA, 19 nt, Homo sapiens
gagcaggcgcugugguuaa

SEQ ID NO: 613973 - RNA, 19 nt, Homo sapiens
guacaucaccagacacuuc

SEQ ID NO: 613974 - RNA, 19 nt, Homo sapiens
gcagugcaguggagaagca

SEQ ID NO: 613975 - RNA, 19 nt, Homo sapiens
uuagacagcucucucaucu

SEQ ID NO: 613976 - RNA, 19 nt, Homo sapiens
cgaguacacugggaccuuu

SEQ ID NO: 613977 - RNA, 19 nt, Homo sapiens
ccagguuucagacuaaaua

SEQ ID NO: 613978 - RNA, 19 nt, Homo sapiens
gagccuguccucacacaaa

SEQ ID NO: 613979 - RNA, 19 nt, Homo sapiens
agaagcagcugaaccugau

SEQ ID NO: 613980 - RNA, 19 nt, Homo sapiens
ggaccgaguaagaguguuu

SEQ ID NO: 613981 - RNA, 19 nt, Homo sapiens
gccagugcguggaauguga

SEQ ID NO: 613982 - RNA, 19 nt, Homo sapiens
caccaucuccuucagaauu

SEQ ID NO: 613983 - RNA, 19 nt, Homo sapiens
cguggcggcucuaugagua

SEQ ID NO: 613984 - RNA, 19 nt, Homo sapiens
caagaugacgucugucugu

SEQ ID NO: 613985 - RNA, 19 nt, Homo sapiens
ucaucacgcucauggagaa

SEQ ID NO: 613986 - RNA, 19 nt, Homo sapiens
gccacaagcaggaaagaaa

SEQ ID NO: 613987 - RNA, 19 nt, Homo sapiens
aggccaagguuaacacuga

SEQ ID NO: 613988 - RNA, 19 nt, Homo sapiens
ggagcaggcgcugugguua

SEQ ID NO: 613989 - RNA, 19 nt, Homo sapiens
ccacagaggccgaauuagg

SEQ ID NO: 613990 - RNA, 19 nt, Homo sapiens
gcuucaagaugacgucugu

SEQ ID NO: 613991 - RNA, 19 nt, Homo sapiens
cagcaucccugugcauauc

SEQ ID NO: 613992 - RNA, 19 nt, Homo sapiens
gguuaacacugacaaagac

SEQ ID NO: 613993 - RNA, 19 nt, Homo sapiens
gaaggaccgagacaagaug

SEQ ID NO: 613994 - RNA, 19 nt, Homo sapiens
ugccacagaggccgaauua

SEQ ID NO: 613995 - RNA, 19 nt, Homo sapiens
gaagaguggagucuaaacu

SEQ ID NO: 613996 - RNA, 19 nt, Homo sapiens
gggauucuguguggagaga

SEQ ID NO: 613997 - RNA, 19 nt, Homo sapiens
gcauucaccagguuucaga

SEQ ID NO: 613998 - RNA, 19 nt, Homo sapiens
cauggcacuucaaacuauu

SEQ ID NO: 613999 - RNA, 19 nt, Homo sapiens
uggcauggaugaguugaug

SEQ ID NO: 614000 - RNA, 19 nt, Homo sapiens
aggagagccugcccacuug

SEQ ID NO: 614001 - RNA, 19 nt, Homo sapiens
agacgaacccacccgacua

SEQ ID NO: 614002 - RNA, 19 nt, Homo sapiens
ugagaacuuugaccugaag

SEQ ID NO: 614003 - RNA, 19 nt, Homo sapiens
gcugugcauucaccagguu

SEQ ID NO: 614004 - RNA, 19 nt, Homo sapiens
ccagacggcccaaggacaa

SEQ ID NO: 614005 - RNA, 19 nt, Homo sapiens
ccugaacacuguggagaug

SEQ ID NO: 614006 - RNA, 19 nt, Homo sapiens
caaagacagaucucuccuu

SEQ ID NO: 614007 - RNA, 19 nt, Homo sapiens
gagcuggaccugcgaaucg

SEQ ID NO: 614008 - RNA, 19 nt, Homo sapiens
ugaagacugugcucauggu

SEQ ID NO: 614009 - RNA, 19 nt, Homo sapiens
gcauucuuguugccucuuc

SEQ ID NO: 614010 - RNA, 19 nt, Homo sapiens
cgccuacuuuguaugauga

SEQ ID NO: 614011 - RNA, 19 nt, Homo sapiens
gcgaugagacgcagcacau

SEQ ID NO: 614012 - RNA, 19 nt, Homo sapiens
ucacaggagucagcauugg

SEQ ID NO: 614013 - RNA, 19 nt, Homo sapiens
uaacacugacaaagacaga

SEQ ID NO: 614014 - RNA, 19 nt, Homo sapiens
cggagaagaaagaagcuaa

SEQ ID NO: 614015 - RNA, 19 nt, Homo sapiens
gaagacugugcucaugguu

SEQ ID NO: 614016 - RNA, 19 nt, Homo sapiens
ccgccuacuuuguaugaug

SEQ ID NO: 614017 - RNA, 19 nt, Homo sapiens
ggaagguggccugcaacaa

SEQ ID NO: 614018 - RNA, 19 nt, Homo sapiens
ugauggaggugucuuucuc

SEQ ID NO: 614019 - RNA, 19 nt, Homo sapiens
gcauggaugaguugaugga

SEQ ID NO: 614020 - RNA, 19 nt, Homo sapiens
acaggagucagcauuggua

SEQ ID NO: 614021 - RNA, 19 nt, Homo sapiens
gagcaccaucuccuucaga

SEQ ID NO: 614022 - RNA, 19 nt, Homo sapiens
gauaaaauccaguccuuca

SEQ ID NO: 614023 - RNA, 19 nt, Homo sapiens
ugaaggaccgagacaagau

SEQ ID NO: 614024 - RNA, 19 nt, Homo sapiens
acagcucucucaucuccuu

SEQ ID NO: 614025 - RNA, 19 nt, Homo sapiens
agaaaggcaugggcugcaa

SEQ ID NO: 614026 - RNA, 19 nt, Homo sapiens
caagguuaacacugacaaa

SEQ ID NO: 614027 - RNA, 19 nt, Homo sapiens
gauuuagacagcucucuca

SEQ ID NO: 614028 - RNA, 19 nt, Homo sapiens
gugcauaucaacaacaucu

SEQ ID NO: 614029 - RNA, 19 nt, Homo sapiens
aggugaagaugcuggagaa

SEQ ID NO: 614030 - RNA, 19 nt, Homo sapiens
gugcugcaggccaagguua

SEQ ID NO: 614031 - RNA, 19 nt, Homo sapiens
gggcucugcauucuuguug

SEQ ID NO: 614032 - RNA, 19 nt, Homo sapiens
gcucaugguugcugaaaag

SEQ ID NO: 614033 - RNA, 19 nt, Homo sapiens
gcaucccugugcauaucaa

SEQ ID NO: 614034 - RNA, 19 nt, Homo sapiens
gccagcaucccugugcaua

SEQ ID NO: 614035 - RNA, 19 nt, Homo sapiens
gugaaggaccgagacaaga

SEQ ID NO: 614036 - RNA, 19 nt, Homo sapiens
gaagcgguuguuagcagaa

SEQ ID NO: 614037 - RNA, 19 nt, Homo sapiens
ggagaacaucugcuuugag

SEQ ID NO: 614038 - RNA, 19 nt, Homo sapiens
gggagccuguccucacaca

SEQ ID NO: 614039 - RNA, 19 nt, Homo sapiens
ccucauggcacuucaaacu

SEQ ID NO: 614040 - RNA, 19 nt, Homo sapiens
guuguuagcagaagguauc

SEQ ID NO: 614041 - RNA, 19 nt, Homo sapiens
cugagaacuuugaccugaa

SEQ ID NO: 614042 - RNA, 19 nt, Homo sapiens
gagucagcauugguaauag

SEQ ID NO: 614043 - RNA, 19 nt, Homo sapiens
gauucuguguggagagaca

SEQ ID NO: 614044 - RNA, 19 nt, Homo sapiens
gaaccaagcacuggacuau

SEQ ID NO: 614045 - RNA, 19 nt, Homo sapiens
gaagaaaggcagcaagaag

SEQ ID NO: 614046 - RNA, 19 nt, Homo sapiens
caagaccaggccuucauua

SEQ ID NO: 614047 - RNA, 19 nt, Homo sapiens
gaucaaagggaauauuagu

SEQ ID NO: 614048 - RNA, 19 nt, Homo sapiens
accaagcacuggacuauga

SEQ ID NO: 614049 - RNA, 19 nt, Homo sapiens
gcaagaccaggccuucauu

SEQ ID NO: 614050 - RNA, 19 nt, Homo sapiens
caaaccugguguucgugua

SEQ ID NO: 614051 - RNA, 19 nt, Homo sapiens
ucucggcgcucaccuggaa

SEQ ID NO: 614052 - RNA, 19 nt, Homo sapiens
cugaucaaagggaauauua

SEQ ID NO: 614053 - RNA, 19 nt, Homo sapiens
ccauuuccuugccuccuuu

SEQ ID NO: 614054 - RNA, 19 nt, Homo sapiens
uucaagaccucaagaacga

SEQ ID NO: 614055 - RNA, 19 nt, Homo sapiens
gagaucuccuacccacuca

SEQ ID NO: 614056 - RNA, 19 nt, Homo sapiens
ugucaugugucaccaucuu

SEQ ID NO: 614057 - RNA, 19 nt, Homo sapiens
ccuccugucugccuucuuc

SEQ ID NO: 614058 - RNA, 19 nt, Homo sapiens
ggaaccaagcacuggacua

SEQ ID NO: 614059 - RNA, 19 nt, Homo sapiens
ugucugcaucuccaucuua

SEQ ID NO: 614060 - RNA, 19 nt, Homo sapiens
cugcaaaccugguguucgu

SEQ ID NO: 614061 - RNA, 19 nt, Homo sapiens
aagaagaaaggcagcaaga

SEQ ID NO: 614062 - RNA, 19 nt, Homo sapiens
gcacuccaaccucacucuu

SEQ ID NO: 614063 - RNA, 19 nt, Homo sapiens
ccacuugugucagcuugca

SEQ ID NO: 614064 - RNA, 19 nt, Homo sapiens
ccaucugcccuucuuguug

SEQ ID NO: 614065 - RNA, 19 nt, Homo sapiens
gcugcuaucgccucaagga

SEQ ID NO: 614066 - RNA, 19 nt, Homo sapiens
cuacaugggcaacgagauc

SEQ ID NO: 614067 - RNA, 19 nt, Homo sapiens
agaagaaaggcagcaagaa

SEQ ID NO: 614068 - RNA, 19 nt, Homo sapiens
ucuuguugcuccugucaug

SEQ ID NO: 614069 - RNA, 19 nt, Homo sapiens
gggaaaggcacuccaaccu

SEQ ID NO: 614070 - RNA, 19 nt, Homo sapiens
ccaagcacuggacuaugaa

SEQ ID NO: 614071 - RNA, 19 nt, Homo sapiens
ggcaagaccaggccuucau

SEQ ID NO: 614072 - RNA, 19 nt, Homo sapiens
gaagaaaccuuaagaauag

SEQ ID NO: 614073 - RNA, 19 nt, Homo sapiens
gaaaguaugucaccauuga

SEQ ID NO: 614074 - RNA, 19 nt, Homo sapiens
ggacagcacuuuaauauuc

SEQ ID NO: 614075 - RNA, 19 nt, Homo sapiens
ggaagaaaccuuaagaaua

SEQ ID NO: 614076 - RNA, 19 nt, Homo sapiens
gaacucagcaccagauuua

SEQ ID NO: 614077 - RNA, 19 nt, Homo sapiens
gaaaguaugcggaugauaa

SEQ ID NO: 614078 - RNA, 19 nt, Homo sapiens
gaaaccaguugugaacaua

SEQ ID NO: 614079 - RNA, 19 nt, Homo sapiens
gauuaaaccugcauuagug

SEQ ID NO: 614080 - RNA, 19 nt, Homo sapiens
gaaauagcccuaaugaaug

SEQ ID NO: 614081 - RNA, 19 nt, Homo sapiens
gaacuggccuguacauuuu

SEQ ID NO: 614082 - RNA, 19 nt, Homo sapiens
ggauauccuugaaguaauu

SEQ ID NO: 614083 - RNA, 19 nt, Homo sapiens
gaagaaaguaugcggauga

SEQ ID NO: 614084 - RNA, 19 nt, Homo sapiens
gaaagcugcugugguuauu

SEQ ID NO: 614085 - RNA, 19 nt, Homo sapiens
gaaggaaggagacucaauu

SEQ ID NO: 614086 - RNA, 19 nt, Homo sapiens
gaaauucucuuggccuuca

SEQ ID NO: 614087 - RNA, 19 nt, Homo sapiens
gcgaaggguuguuauguug

SEQ ID NO: 614088 - RNA, 19 nt, Homo sapiens
agaaauagcccuaaugaau

SEQ ID NO: 614089 - RNA, 19 nt, Homo sapiens
ggacuuaacauugaagaaa

SEQ ID NO: 614090 - RNA, 19 nt, Homo sapiens
gaaagaaauagcccuaaug

SEQ ID NO: 614091 - RNA, 19 nt, Homo sapiens
gggaagcguccuuggauua

SEQ ID NO: 614092 - RNA, 19 nt, Homo sapiens
ccacauguaacuaacaaua

SEQ ID NO: 614093 - RNA, 19 nt, Homo sapiens
aaagaggagugguuuguga

SEQ ID NO: 614094 - RNA, 19 nt, Homo sapiens
aagaagaacuagauaagug

SEQ ID NO: 614095 - RNA, 19 nt, Homo sapiens
ccaaucugcucacuucuau

SEQ ID NO: 614096 - RNA, 19 nt, Homo sapiens
ccaaagccuucccuucuga

SEQ ID NO: 614097 - RNA, 19 nt, Homo sapiens
uaagauggauaacaaacug

SEQ ID NO: 614098 - RNA, 19 nt, Homo sapiens
aaagaaauagcccuaauga

SEQ ID NO: 614099 - RNA, 19 nt, Homo sapiens
ggaaggagacucaauugca

SEQ ID NO: 614100 - RNA, 19 nt, Homo sapiens
gaccacauguaacuaacaa

SEQ ID NO: 614101 - RNA, 19 nt, Homo sapiens
acugaaagcugcugugguu

SEQ ID NO: 614102 - RNA, 19 nt, Homo sapiens
uggaauaccugaucaagca

SEQ ID NO: 614103 - RNA, 19 nt, Homo sapiens
gaacucuacuuacaugacu

SEQ ID NO: 614104 - RNA, 19 nt, Homo sapiens
gggaagaaaccuuaagaau

SEQ ID NO: 614105 - RNA, 19 nt, Homo sapiens
gcuggugccuucauucaug

SEQ ID NO: 614106 - RNA, 19 nt, Homo sapiens
uuaccaaucugcucacuuc

SEQ ID NO: 614107 - RNA, 19 nt, Homo sapiens
uaaagcagcaaccaagaaa

SEQ ID NO: 614108 - RNA, 19 nt, Homo sapiens
guuuagagaucuuuaagca

SEQ ID NO: 614109 - RNA, 19 nt, Homo sapiens
gaagaagaacuagauaagu

SEQ ID NO: 614110 - RNA, 19 nt, Homo sapiens
aagcaugcccauacgauua

SEQ ID NO: 614111 - RNA, 19 nt, Homo sapiens
ccaguugugaacauaauua

SEQ ID NO: 614112 - RNA, 19 nt, Homo sapiens
gcaccagauuuaagaugga

SEQ ID NO: 614113 - RNA, 19 nt, Homo sapiens
guugaacucuacuuacaug

SEQ ID NO: 614114 - RNA, 19 nt, Homo sapiens
caacuucacggacuuaaca

SEQ ID NO: 614115 - RNA, 19 nt, Homo sapiens
ugaaugcuuugacuguaaa

SEQ ID NO: 614116 - RNA, 19 nt, Homo sapiens
agaaagaaauagcccuaau

SEQ ID NO: 614117 - RNA, 19 nt, Homo sapiens
gaauaccugaucaagcaua

SEQ ID NO: 614118 - RNA, 19 nt, Homo sapiens
ccaccuagaugaggaagau

SEQ ID NO: 614119 - RNA, 19 nt, Homo sapiens
gauaaagcagcaaccaaga

SEQ ID NO: 614120 - RNA, 19 nt, Homo sapiens
ugaaguaauugagaaggaa

SEQ ID NO: 614121 - RNA, 19 nt, Homo sapiens
ucacggacuuaacauugaa

SEQ ID NO: 614122 - RNA, 19 nt, Homo sapiens
gcuauugagucacaacuac

SEQ ID NO: 614123 - RNA, 19 nt, Homo sapiens
ccaagaaaccaguugugaa

SEQ ID NO: 614124 - RNA, 19 nt, Homo sapiens
aagauaagcugaggcacuu

SEQ ID NO: 614125 - RNA, 19 nt, Homo sapiens
cauugcggcugaacucaaa

SEQ ID NO: 614126 - RNA, 19 nt, Homo sapiens
gauccuagcuguuuuagag

SEQ ID NO: 614127 - RNA, 19 nt, Homo sapiens
gcacaugcaguuggaaaug

SEQ ID NO: 614128 - RNA, 19 nt, Homo sapiens
uaauauuccugccaucaca

SEQ ID NO: 614129 - RNA, 19 nt, Homo sapiens
ccagcuaacaauaacauuu

SEQ ID NO: 614130 - RNA, 19 nt, Homo sapiens
caagaaaccaguugugaac

SEQ ID NO: 614131 - RNA, 19 nt, Homo sapiens
uaacuggcuaucuggaaua

SEQ ID NO: 614132 - RNA, 19 nt, Homo sapiens
guuguuauguuggcuuuga

SEQ ID NO: 614133 - RNA, 19 nt, Homo sapiens
ggagaugagaguauuguag

SEQ ID NO: 614134 - RNA, 19 nt, Homo sapiens
auacuugacucugcagaaa

SEQ ID NO: 614135 - RNA, 19 nt, Homo sapiens
acacuggacagcacuuuaa

SEQ ID NO: 614136 - RNA, 19 nt, Homo sapiens
caauugcagugauccuguu

SEQ ID NO: 614137 - RNA, 19 nt, Homo sapiens
gacuuaacauugaagaaag

SEQ ID NO: 614138 - RNA, 19 nt, Homo sapiens
gccaaagccuucccuucug

SEQ ID NO: 614139 - RNA, 19 nt, Homo sapiens
uguaggagccaaugagaaa

SEQ ID NO: 614140 - RNA, 19 nt, Homo sapiens
gagaguauuguaggccuua

SEQ ID NO: 614141 - RNA, 19 nt, Homo sapiens
caguuccucucuauaauuc

SEQ ID NO: 614142 - RNA, 19 nt, Homo sapiens
acaaagauguuuuccaaga

SEQ ID NO: 614143 - RNA, 19 nt, Homo sapiens
uaauggagccuucaucucu

SEQ ID NO: 614144 - RNA, 19 nt, Homo sapiens
gagaaagaaauagcccuaa

SEQ ID NO: 614145 - RNA, 19 nt, Homo sapiens
uauguuggcuuugaucuag

SEQ ID NO: 614146 - RNA, 19 nt, Homo sapiens
aaugaaugcuuugacugua

SEQ ID NO: 614147 - RNA, 19 nt, Homo sapiens
ggaucugccuccaguugau

SEQ ID NO: 614148 - RNA, 19 nt, Homo sapiens
caccauugaccacauguaa

SEQ ID NO: 614149 - RNA, 19 nt, Homo sapiens
ccagauuuaagauggauaa

SEQ ID NO: 614150 - RNA, 19 nt, Homo sapiens
aaaguaugcggaugauaaa

SEQ ID NO: 614151 - RNA, 19 nt, Homo sapiens
uacaggagaugagaguauu

SEQ ID NO: 614152 - RNA, 19 nt, Homo sapiens
ccaguuccucucuauaauu

SEQ ID NO: 614153 - RNA, 19 nt, Homo sapiens
caaagauguuuuccaagaa

SEQ ID NO: 614154 - RNA, 19 nt, Homo sapiens
cuaacuggcuaucuggaau

SEQ ID NO: 614155 - RNA, 19 nt, Homo sapiens
aaggaauucuugagagguu

SEQ ID NO: 614156 - RNA, 19 nt, Homo sapiens
aaauagcccuaaugaaugc

SEQ ID NO: 614157 - RNA, 19 nt, Homo sapiens
ugaagaagaacuagauaag

SEQ ID NO: 614158 - RNA, 19 nt, Homo sapiens
uugaaaguaugucaccauu

SEQ ID NO: 614159 - RNA, 19 nt, Homo sapiens
ugaaagcugcugugguuau

SEQ ID NO: 614160 - RNA, 19 nt, Homo sapiens
gaaauguugaacucuacuu

SEQ ID NO: 614161 - RNA, 19 nt, Homo sapiens
gagacucaauugcagugau

SEQ ID NO: 614162 - RNA, 19 nt, Homo sapiens
ucauuaugcuauugaguca

SEQ ID NO: 614163 - RNA, 19 nt, Homo sapiens
gaagcguccuuggauuaca

SEQ ID NO: 614164 - RNA, 19 nt, Homo sapiens
cuagaacaacuuaagcaaa

SEQ ID NO: 614165 - RNA, 19 nt, Homo sapiens
gacaagcggaauccaaaug

SEQ ID NO: 614166 - RNA, 19 nt, Homo sapiens
gugacaagcggaauccaaa

SEQ ID NO: 614167 - RNA, 19 nt, Homo sapiens
agaaaccaguugugaacau

SEQ ID NO: 614168 - RNA, 19 nt, Homo sapiens
uuggaaauguugaacucua

SEQ ID NO: 614169 - RNA, 19 nt, Homo sapiens
gagagguucuuggagagau

SEQ ID NO: 614170 - RNA, 19 nt, Homo sapiens
augaaugcuuugacuguaa

SEQ ID NO: 614171 - RNA, 19 nt, Homo sapiens
uaaugaaugcuuugacugu

SEQ ID NO: 614172 - RNA, 19 nt, Homo sapiens
caaaggaguuuacuguuua

SEQ ID NO: 614173 - RNA, 19 nt, Homo sapiens
agacaaaggugacuuauaa

SEQ ID NO: 614174 - RNA, 19 nt, Homo sapiens
gcaaaggaguuuacuguuu

SEQ ID NO: 614175 - RNA, 19 nt, Homo sapiens
ugacaacacuaucagauua

SEQ ID NO: 614176 - RNA, 19 nt, Homo sapiens
cacauaaacucguaucuua

SEQ ID NO: 614177 - RNA, 19 nt, Homo sapiens
gcacucaaguuuaugaauu

SEQ ID NO: 614178 - RNA, 19 nt, Homo sapiens
gcagagagauuucauaacu

SEQ ID NO: 614179 - RNA, 19 nt, Homo sapiens
gcacugcuaugaagacuga

SEQ ID NO: 614180 - RNA, 19 nt, Homo sapiens
gaccuuaaauggacacaaa

SEQ ID NO: 614181 - RNA, 19 nt, Homo sapiens
gcacuugcguuucaauaau

SEQ ID NO: 614182 - RNA, 19 nt, Homo sapiens
agacauaguuuacagagaa

SEQ ID NO: 614183 - RNA, 19 nt, Homo sapiens
gagaaggcacucaaguuua

SEQ ID NO: 614184 - RNA, 19 nt, Homo sapiens
agagaagacuguaauaaug

SEQ ID NO: 614185 - RNA, 19 nt, Homo sapiens
caucuuauaucccaaaugu

SEQ ID NO: 614186 - RNA, 19 nt, Homo sapiens
gagagaagacuguaauaau

SEQ ID NO: 614187 - RNA, 19 nt, Homo sapiens
caacaacaguaacaaucaa

SEQ ID NO: 614188 - RNA, 19 nt, Homo sapiens
gaagaagcuuaucgagaga

SEQ ID NO: 614189 - RNA, 19 nt, Homo sapiens
agaauguggugcauguuua

SEQ ID NO: 614190 - RNA, 19 nt, Homo sapiens
aaauacaggugaaaugcua

SEQ ID NO: 614191 - RNA, 19 nt, Homo sapiens
agaaggcacucaaguuuau

SEQ ID NO: 614192 - RNA, 19 nt, Homo sapiens
caaucaagaucugggauaa

SEQ ID NO: 614193 - RNA, 19 nt, Homo sapiens
cauuaaaguugcgguauuu

SEQ ID NO: 614194 - RNA, 19 nt, Homo sapiens
gaacauacaccuacaucuc

SEQ ID NO: 614195 - RNA, 19 nt, Homo sapiens
ccaguggccucggcgauua

SEQ ID NO: 614196 - RNA, 19 nt, Homo sapiens
auagagcacuuuauccuaa

SEQ ID NO: 614197 - RNA, 19 nt, Homo sapiens
gaacaucuuauaucccaaa

SEQ ID NO: 614198 - RNA, 19 nt, Homo sapiens
ggaacugugugucaaauac

SEQ ID NO: 614199 - RNA, 19 nt, Homo sapiens
gggacaguauuuauucaaa

SEQ ID NO: 614200 - RNA, 19 nt, Homo sapiens
gagaagaauucacuuagac

SEQ ID NO: 614201 - RNA, 19 nt, Homo sapiens
ccagagaagaauucacuua

SEQ ID NO: 614202 - RNA, 19 nt, Homo sapiens
gaauuuguggaacaucuua

SEQ ID NO: 614203 - RNA, 19 nt, Homo sapiens
ccagauaaauaaccauaca

SEQ ID NO: 614204 - RNA, 19 nt, Homo sapiens
gacuacaguuugaugaauu

SEQ ID NO: 614205 - RNA, 19 nt, Homo sapiens
cauagaauguggugcaugu

SEQ ID NO: 614206 - RNA, 19 nt, Homo sapiens
acaccgagcugcugucaau

SEQ ID NO: 614207 - RNA, 19 nt, Homo sapiens
ggaagauaauaccagagaa

SEQ ID NO: 614208 - RNA, 19 nt, Homo sapiens
gcaacaacaguaacaauca

SEQ ID NO: 614209 - RNA, 19 nt, Homo sapiens
gagcauuccggaagaguuu

SEQ ID NO: 614210 - RNA, 19 nt, Homo sapiens
gugaaaugcuaaacacguu

SEQ ID NO: 614211 - RNA, 19 nt, Homo sapiens
gcacauaaacucguaucuu

SEQ ID NO: 614212 - RNA, 19 nt, Homo sapiens
ccauuaaaguugcgguauu

SEQ ID NO: 614213 - RNA, 19 nt, Homo sapiens
gagagagaagacuguaaua

SEQ ID NO: 614214 - RNA, 19 nt, Homo sapiens
aaacaaaacuugccaaugg

SEQ ID NO: 614215 - RNA, 19 nt, Homo sapiens
gauaauaccagagaagaau

SEQ ID NO: 614216 - RNA, 19 nt, Homo sapiens
acucguaucuuaaaccuau

SEQ ID NO: 614217 - RNA, 19 nt, Homo sapiens
gaaacucucagcaagcuau

SEQ ID NO: 614218 - RNA, 19 nt, Homo sapiens
agagaagaauucacuuaga

SEQ ID NO: 614219 - RNA, 19 nt, Homo sapiens
gagcugcugucaauguugu

SEQ ID NO: 614220 - RNA, 19 nt, Homo sapiens
guucugcacuugcguuuca

SEQ ID NO: 614221 - RNA, 19 nt, Homo sapiens
agagaaggcacucaaguuu

SEQ ID NO: 614222 - RNA, 19 nt, Homo sapiens
ggacacaaacgaggcauug

SEQ ID NO: 614223 - RNA, 19 nt, Homo sapiens
guacauuguuucugcaucu

SEQ ID NO: 614224 - RNA, 19 nt, Homo sapiens
acacguugauucaccauug

SEQ ID NO: 614225 - RNA, 19 nt, Homo sapiens
caauggcacuuccaguaug

SEQ ID NO: 614226 - RNA, 19 nt, Homo sapiens
gaacuauaaagguauggaa

SEQ ID NO: 614227 - RNA, 19 nt, Homo sapiens
ugucaauguuguagacuuu

SEQ ID NO: 614228 - RNA, 19 nt, Homo sapiens
caacggaaacucucagcaa

SEQ ID NO: 614229 - RNA, 19 nt, Homo sapiens
gaaaugcuaaacacguuga

SEQ ID NO: 614230 - RNA, 19 nt, Homo sapiens
gaagauaauaccagagaag

SEQ ID NO: 614231 - RNA, 19 nt, Homo sapiens
cagaucaaguggaauuugu

SEQ ID NO: 614232 - RNA, 19 nt, Homo sapiens
agagucagaucaaguggaa

SEQ ID NO: 614233 - RNA, 19 nt, Homo sapiens
cuccaaagaucguuccauu

SEQ ID NO: 614234 - RNA, 19 nt, Homo sapiens
accauacacugaccucaua

SEQ ID NO: 614235 - RNA, 19 nt, Homo sapiens
gagaagacuguaauaaugg

SEQ ID NO: 614236 - RNA, 19 nt, Homo sapiens
gauaacaagaggauaguca

SEQ ID NO: 614237 - RNA, 19 nt, Homo sapiens
ggaauuggugcguuguauu

SEQ ID NO: 614238 - RNA, 19 nt, Homo sapiens
cuaugaagacugagaauug

SEQ ID NO: 614239 - RNA, 19 nt, Homo sapiens
gucaguaguucacaugaug

SEQ ID NO: 614240 - RNA, 19 nt, Homo sapiens
cuucagugcugcuaucaga

SEQ ID NO: 614241 - RNA, 19 nt, Homo sapiens
cgacuacaguuugaugaau

SEQ ID NO: 614242 - RNA, 19 nt, Homo sapiens
uuaccaacaugggcacaua

SEQ ID NO: 614243 - RNA, 19 nt, Homo sapiens
guuagaaggccaugaggaa

SEQ ID NO: 614244 - RNA, 19 nt, Homo sapiens
auaaagguauggaacacaa

SEQ ID NO: 614245 - RNA, 19 nt, Homo sapiens
gauggugaccugcuccaaa

SEQ ID NO: 614246 - RNA, 19 nt, Homo sapiens
cgagacaacacaaucaaga

SEQ ID NO: 614247 - RNA, 19 nt, Homo sapiens
ggaaugcuccucccaacuc

SEQ ID NO: 614248 - RNA, 19 nt, Homo sapiens
gcacuuccaguaugauugu

SEQ ID NO: 614249 - RNA, 19 nt, Homo sapiens
gagcaacaacaguaacaau

SEQ ID NO: 614250 - RNA, 19 nt, Homo sapiens
ggaugagcaacaacaguaa

SEQ ID NO: 614251 - RNA, 19 nt, Homo sapiens
agaaggccaugaggaauug

SEQ ID NO: 614252 - RNA, 19 nt, Homo sapiens
cugcugaacuugugugcaa

SEQ ID NO: 614253 - RNA, 19 nt, Homo sapiens
caacaugggcacauaaacu

SEQ ID NO: 614254 - RNA, 19 nt, Homo sapiens
cagacaaaggugacuuaua

SEQ ID NO: 614255 - RNA, 19 nt, Homo sapiens
ucugggacuuccuaaauga

SEQ ID NO: 614256 - RNA, 19 nt, Homo sapiens
caucugggacuuccuaaau

SEQ ID NO: 614257 - RNA, 19 nt, Homo sapiens
ccaaagaucguuccauugc

SEQ ID NO: 614258 - RNA, 19 nt, Homo sapiens
ggaagacauaguuuacaga

SEQ ID NO: 614259 - RNA, 19 nt, Homo sapiens
uaugaagacugagaauugu

SEQ ID NO: 614260 - RNA, 19 nt, Homo sapiens
guauggaacacaaguacuu

SEQ ID NO: 614261 - RNA, 19 nt, Homo sapiens
gaauucacuuagacagaca

SEQ ID NO: 614262 - RNA, 19 nt, Homo sapiens
agagagaagacuguaauaa

SEQ ID NO: 614263 - RNA, 19 nt, Homo sapiens
gaaaaggaacuguguguca

SEQ ID NO: 614264 - RNA, 19 nt, Homo sapiens
ccaauggcacuuccaguau

SEQ ID NO: 614265 - RNA, 19 nt, Homo sapiens
uagaaggccaugaggaauu

SEQ ID NO: 614266 - RNA, 19 nt, Homo sapiens
uagaauguggugcauguuu

SEQ ID NO: 614267 - RNA, 19 nt, Homo sapiens
gcucaucugacaacacuau

SEQ ID NO: 614268 - RNA, 19 nt, Homo sapiens
guacagggacaggcuggua

SEQ ID NO: 614269 - RNA, 19 nt, Homo sapiens
gaugccaaaucacuaugug

SEQ ID NO: 614270 - RNA, 19 nt, Homo sapiens
auaccuggaugccaaauca

SEQ ID NO: 614271 - RNA, 19 nt, Homo sapiens
ccaggacccauuaaaguug

SEQ ID NO: 614272 - RNA, 19 nt, Homo sapiens
caaaggaguuuacuguuua

SEQ ID NO: 614273 - RNA, 19 nt, Homo sapiens
agacaaaggugacuuauaa

SEQ ID NO: 614274 - RNA, 19 nt, Homo sapiens
gcaaaggaguuuacuguuu

SEQ ID NO: 614275 - RNA, 19 nt, Homo sapiens
ugacaacacuaucagauua

SEQ ID NO: 614276 - RNA, 19 nt, Homo sapiens
cacauaaacucguaucuua

SEQ ID NO: 614277 - RNA, 19 nt, Homo sapiens
gcagagagauuucauaacu

SEQ ID NO: 614278 - RNA, 19 nt, Homo sapiens
gcacugcuaugaagacuga

SEQ ID NO: 614279 - RNA, 19 nt, Homo sapiens
gaccuuaaauggacacaaa

SEQ ID NO: 614280 - RNA, 19 nt, Homo sapiens
gcacuugcguuucaauaau

SEQ ID NO: 614281 - RNA, 19 nt, Homo sapiens
agacauaguuuacagagaa

SEQ ID NO: 614282 - RNA, 19 nt, Homo sapiens
gagaaggcacucaaguuua

SEQ ID NO: 614283 - RNA, 19 nt, Homo sapiens
agagaagacuguaauaaug

SEQ ID NO: 614284 - RNA, 19 nt, Homo sapiens
caucuuauaucccaaaugu

SEQ ID NO: 614285 - RNA, 19 nt, Homo sapiens
gagagaagacuguaauaau

SEQ ID NO: 614286 - RNA, 19 nt, Homo sapiens
caacaacaguaacaaucaa

SEQ ID NO: 614287 - RNA, 19 nt, Homo sapiens
gaagaagcuuaucgagaga

SEQ ID NO: 614288 - RNA, 19 nt, Homo sapiens
agaauguggugcauguuua

SEQ ID NO: 614289 - RNA, 19 nt, Homo sapiens
aaauacaggugaaaugcua

SEQ ID NO: 614290 - RNA, 19 nt, Homo sapiens
agaaggcacucaaguuuau

SEQ ID NO: 614291 - RNA, 19 nt, Homo sapiens
caaucaagaucugggauaa

SEQ ID NO: 614292 - RNA, 19 nt, Homo sapiens
cauuaaaguugcgguauuu

SEQ ID NO: 614293 - RNA, 19 nt, Homo sapiens
gaacauacaccuacaucuc

SEQ ID NO: 614294 - RNA, 19 nt, Homo sapiens
ccaguggccucggcgauua

SEQ ID NO: 614295 - RNA, 19 nt, Homo sapiens
auagagcacuuuauccuaa

SEQ ID NO: 614296 - RNA, 19 nt, Homo sapiens
gaacaucuuauaucccaaa

SEQ ID NO: 614297 - RNA, 19 nt, Homo sapiens
ggaacugugugucaaauac

SEQ ID NO: 614298 - RNA, 19 nt, Homo sapiens
gggacaguauuuauucaaa

SEQ ID NO: 614299 - RNA, 19 nt, Homo sapiens
gagaagaauucacuuagac

SEQ ID NO: 614300 - RNA, 19 nt, Homo sapiens
ccagagaagaauucacuua

SEQ ID NO: 614301 - RNA, 19 nt, Homo sapiens
gaauuuguggaacaucuua

SEQ ID NO: 614302 - RNA, 19 nt, Homo sapiens
ucacagcuuuccagaauuc

SEQ ID NO: 614303 - RNA, 19 nt, Homo sapiens
ccagauaaauaaccauaca

SEQ ID NO: 614304 - RNA, 19 nt, Homo sapiens
gacuacaguuugaugaauu

SEQ ID NO: 614305 - RNA, 19 nt, Homo sapiens
cauagaauguggugcaugu

SEQ ID NO: 614306 - RNA, 19 nt, Homo sapiens
acaccgagcugcugucaau

SEQ ID NO: 614307 - RNA, 19 nt, Homo sapiens
ggaagauaauaccagagaa

SEQ ID NO: 614308 - RNA, 19 nt, Homo sapiens
gcaacaacaguaacaauca

SEQ ID NO: 614309 - RNA, 19 nt, Homo sapiens
gagcauuccggaagaguuu

SEQ ID NO: 614310 - RNA, 19 nt, Homo sapiens
gugaaaugcuaaacacguu

SEQ ID NO: 614311 - RNA, 19 nt, Homo sapiens
gcacauaaacucguaucuu

SEQ ID NO: 614312 - RNA, 19 nt, Homo sapiens
ccauuaaaguugcgguauu

SEQ ID NO: 614313 - RNA, 19 nt, Homo sapiens
aaacaaaacuugccaaugg

SEQ ID NO: 614314 - RNA, 19 nt, Homo sapiens
gauaauaccagagaagaau

SEQ ID NO: 614315 - RNA, 19 nt, Homo sapiens
gagagagaagacuguaaua

SEQ ID NO: 614316 - RNA, 19 nt, Homo sapiens
acucguaucuuaaaccuau

SEQ ID NO: 614317 - RNA, 19 nt, Homo sapiens
gaaacucucagcaagcuau

SEQ ID NO: 614318 - RNA, 19 nt, Homo sapiens
agagaagaauucacuuaga

SEQ ID NO: 614319 - RNA, 19 nt, Homo sapiens
acucacagcuuuccagaau

SEQ ID NO: 614320 - RNA, 19 nt, Homo sapiens
gagcugcugucaauguugu

SEQ ID NO: 614321 - RNA, 19 nt, Homo sapiens
guucugcacuugcguuuca

SEQ ID NO: 614322 - RNA, 19 nt, Homo sapiens
agagaaggcacucaaguuu

SEQ ID NO: 614323 - RNA, 19 nt, Homo sapiens
ggacacaaacgaggcauug

SEQ ID NO: 614324 - RNA, 19 nt, Homo sapiens
guacauuguuucugcaucu

SEQ ID NO: 614325 - RNA, 19 nt, Homo sapiens
acacguugauucaccauug

SEQ ID NO: 614326 - RNA, 19 nt, Homo sapiens
caauggcacuuccaguaug

SEQ ID NO: 614327 - RNA, 19 nt, Homo sapiens
gaacuauaaagguauggaa

SEQ ID NO: 614328 - RNA, 19 nt, Homo sapiens
ugucaauguuguagacuuu

SEQ ID NO: 614329 - RNA, 19 nt, Homo sapiens
caacggaaacucucagcaa

SEQ ID NO: 614330 - RNA, 19 nt, Homo sapiens
gaaaugcuaaacacguuga

SEQ ID NO: 614331 - RNA, 19 nt, Homo sapiens
cagaucaaguggaauuugu

SEQ ID NO: 614332 - RNA, 19 nt, Homo sapiens
agagucagaucaaguggaa

SEQ ID NO: 614333 - RNA, 19 nt, Homo sapiens
gaagauaauaccagagaag

SEQ ID NO: 614334 - RNA, 19 nt, Homo sapiens
cuccaaagaucguuccauu

SEQ ID NO: 614335 - RNA, 19 nt, Homo sapiens
accauacacugaccucaua

SEQ ID NO: 614336 - RNA, 19 nt, Homo sapiens
gauaacaagaggauaguca

SEQ ID NO: 614337 - RNA, 19 nt, Homo sapiens
ggaauuggugcguuguauu

SEQ ID NO: 614338 - RNA, 19 nt, Homo sapiens
gagaagacuguaauaaugg

SEQ ID NO: 614339 - RNA, 19 nt, Homo sapiens
cuaugaagacugagaauug

SEQ ID NO: 614340 - RNA, 19 nt, Homo sapiens
gucaguaguucacaugaug

SEQ ID NO: 614341 - RNA, 19 nt, Homo sapiens
cuucagugcugcuaucaga

SEQ ID NO: 614342 - RNA, 19 nt, Homo sapiens
cgacuacaguuugaugaau

SEQ ID NO: 614343 - RNA, 19 nt, Homo sapiens
uuaccaacaugggcacaua

SEQ ID NO: 614344 - RNA, 19 nt, Homo sapiens
guuagaaggccaugaggaa

SEQ ID NO: 614345 - RNA, 19 nt, Homo sapiens
auaaagguauggaacacaa

SEQ ID NO: 614346 - RNA, 19 nt, Homo sapiens
gauggugaccugcuccaaa

SEQ ID NO: 614347 - RNA, 19 nt, Homo sapiens
cgagacaacacaaucaaga

SEQ ID NO: 614348 - RNA, 19 nt, Homo sapiens
ggaaugcuccucccaacuc

SEQ ID NO: 614349 - RNA, 19 nt, Homo sapiens
gcacuuccaguaugauugu

SEQ ID NO: 614350 - RNA, 19 nt, Homo sapiens
gagcaacaacaguaacaau

SEQ ID NO: 614351 - RNA, 19 nt, Homo sapiens
ggaugagcaacaacaguaa

SEQ ID NO: 614352 - RNA, 19 nt, Homo sapiens
agaaggccaugaggaauug

SEQ ID NO: 614353 - RNA, 19 nt, Homo sapiens
cugcugaacuugugugcaa

SEQ ID NO: 614354 - RNA, 19 nt, Homo sapiens
caacaugggcacauaaacu

SEQ ID NO: 614355 - RNA, 19 nt, Homo sapiens
cagacaaaggugacuuaua

SEQ ID NO: 614356 - RNA, 19 nt, Homo sapiens
ucugggacuuccuaaauga

SEQ ID NO: 614357 - RNA, 19 nt, Homo sapiens
caucugggacuuccuaaau

SEQ ID NO: 614358 - RNA, 19 nt, Homo sapiens
ccaaagaucguuccauugc

SEQ ID NO: 614359 - RNA, 19 nt, Homo sapiens
ggaagacauaguuuacaga

SEQ ID NO: 614360 - RNA, 19 nt, Homo sapiens
uaugaagacugagaauugu

SEQ ID NO: 614361 - RNA, 19 nt, Homo sapiens
guauggaacacaaguacuu

SEQ ID NO: 614362 - RNA, 19 nt, Homo sapiens
gaaaaggaacuguguguca

SEQ ID NO: 614363 - RNA, 19 nt, Homo sapiens
gaauucacuuagacagaca

SEQ ID NO: 614364 - RNA, 19 nt, Homo sapiens
agagagaagacuguaauaa

SEQ ID NO: 614365 - RNA, 19 nt, Homo sapiens
ccaauggcacuuccaguau

SEQ ID NO: 614366 - RNA, 19 nt, Homo sapiens
uagaaggccaugaggaauu

SEQ ID NO: 614367 - RNA, 19 nt, Homo sapiens
uagaauguggugcauguuu

SEQ ID NO: 614368 - RNA, 19 nt, Homo sapiens
gcucaucugacaacacuau

SEQ ID NO: 614369 - RNA, 19 nt, Homo sapiens
guacagggacaggcuggua

SEQ ID NO: 614370 - RNA, 19 nt, Homo sapiens
gaugccaaaucacuaugug

SEQ ID NO: 614371 - RNA, 19 nt, Homo sapiens
auaccuggaugccaaauca

SEQ ID NO: 614372 - RNA, 19 nt, Homo sapiens
gcaagcagcuggcuaccaa

SEQ ID NO: 614373 - RNA, 19 nt, Homo sapiens
gaaagagcguaaauguaaa

SEQ ID NO: 614374 - RNA, 19 nt, Homo sapiens
agaaagagcguaaauguaa

SEQ ID NO: 614375 - RNA, 19 nt, Homo sapiens
gagcguaaauguaaaguca

SEQ ID NO: 614376 - RNA, 19 nt, Homo sapiens
gcuaagcgagugacuauua

SEQ ID NO: 614377 - RNA, 19 nt, Homo sapiens
ggagaaagagcguaaaugu

SEQ ID NO: 614378 - RNA, 19 nt, Homo sapiens
gagaaagagcguaaaugua

SEQ ID NO: 614379 - RNA, 19 nt, Homo sapiens
agaaaucgcccaagacuuc

SEQ ID NO: 614380 - RNA, 19 nt, Homo sapiens
ugacuauuaugcccaaaga

SEQ ID NO: 614381 - RNA, 19 nt, Homo sapiens
cuaagcgagugacuauuau

SEQ ID NO: 614382 - RNA, 19 nt, Homo sapiens
aaacagacagcucggaaau

SEQ ID NO: 614383 - RNA, 19 nt, Homo sapiens
uaaacagacagcucggaaa

SEQ ID NO: 614384 - RNA, 19 nt, Homo sapiens
guaaagcgccacgcaagca

SEQ ID NO: 614385 - RNA, 19 nt, Homo sapiens
gagaaaucgcccaagacuu

SEQ ID NO: 614386 - RNA, 19 nt, Homo sapiens
cgaccgaguugcugauucg

SEQ ID NO: 614387 - RNA, 19 nt, Homo sapiens
gcguaaauguaaagucacu

SEQ ID NO: 614388 - RNA, 19 nt, Homo sapiens
gaaaucgcccaagacuuca

SEQ ID NO: 614389 - RNA, 19 nt, Homo sapiens
gcggagaaagagcguaaau

SEQ ID NO: 614390 - RNA, 19 nt, Homo sapiens
cgagaaaucgcccaagacu

SEQ ID NO: 614391 - RNA, 19 nt, Homo sapiens
acagacagcucggaaaucc

SEQ ID NO: 614392 - RNA, 19 nt, Homo sapiens
gcaagcagcuggccacuaa

SEQ ID NO: 614393 - RNA, 19 nt, Homo sapiens
ggagagagggcauaaguug

SEQ ID NO: 614394 - RNA, 19 nt, Homo sapiens
gaaaucgacugagcuacug

SEQ ID NO: 614395 - RNA, 19 nt, Homo sapiens
cgacugagcuacugauucg

SEQ ID NO: 614396 - RNA, 19 nt, Homo sapiens
gagggugugcgccaacuua

SEQ ID NO: 614397 - RNA, 19 nt, Homo sapiens
agagagggcauaaguugua

SEQ ID NO: 614398 - RNA, 19 nt, Homo sapiens
uaaguccacuggcggcaaa

SEQ ID NO: 614399 - RNA, 19 nt, Homo sapiens
ugacuaucaugcccaagga

SEQ ID NO: 614400 - RNA, 19 nt, Homo sapiens
gcuacugauucgcaagcua

SEQ ID NO: 614401 - RNA, 19 nt, Homo sapiens
gaagcaaacagcucguaag

SEQ ID NO: 614402 - RNA, 19 nt, Homo sapiens
uuccagagcucggcuguga

SEQ ID NO: 614403 - RNA, 19 nt, Homo sapiens
cgaagcaaacagcucguaa

SEQ ID NO: 614404 - RNA, 19 nt, Homo sapiens
gcggagagagggcauaagu

SEQ ID NO: 614405 - RNA, 19 nt, Homo sapiens
gccaagcgagugacuauca

SEQ ID NO: 614406 - RNA, 19 nt, Homo sapiens
gagagagggcauaaguugu

SEQ ID NO: 614407 - RNA, 19 nt, Homo sapiens
ccagagcucggcugugaug

SEQ ID NO: 614408 - RNA, 19 nt, Homo sapiens
ccaagcgagugacuaucau

SEQ ID NO: 614409 - RNA, 19 nt, Homo sapiens
gagagggcauaaguuguac

SEQ ID NO: 614410 - RNA, 19 nt, Homo sapiens
gcgccaacuuaaaccaaag

SEQ ID NO: 614411 - RNA, 19 nt, Homo sapiens
aagcaaacagcucguaagu

SEQ ID NO: 614412 - RNA, 19 nt, Homo sapiens
ggugugcgccaacuuaaac

SEQ ID NO: 614413 - RNA, 19 nt, Homo sapiens
ugagaucgcgcaggacuuc

SEQ ID NO: 614414 - RNA, 19 nt, Homo sapiens
gcgaagggcaaguaacuau

SEQ ID NO: 614415 - RNA, 19 nt, Homo sapiens
caagaagacccgcaucauc

SEQ ID NO: 614416 - RNA, 19 nt, Homo sapiens
gaguugcgcucgcuauguc

SEQ ID NO: 614417 - RNA, 19 nt, Homo sapiens
gaagggcaaguaacuaucu

SEQ ID NO: 614418 - RNA, 19 nt, Homo sapiens
gggcaaguaacuaucugua

SEQ ID NO: 614419 - RNA, 19 nt, Homo sapiens
caaguaaaaucgaguccaa

SEQ ID NO: 614420 - RNA, 19 nt, Homo sapiens
caacauucaggccgugcua

SEQ ID NO: 614421 - RNA, 19 nt, Homo sapiens
guuuguggcagcucaagua

SEQ ID NO: 614422 - RNA, 19 nt, Homo sapiens
caaggcgaagggcaaguaa

SEQ ID NO: 614423 - RNA, 19 nt, Homo sapiens
uguggcagcucaaguaaaa

SEQ ID NO: 614424 - RNA, 19 nt, Homo sapiens
agacugagagccaccacaa

SEQ ID NO: 614425 - RNA, 19 nt, Homo sapiens
guaccugaccgccgagauc

SEQ ID NO: 614426 - RNA, 19 nt, Homo sapiens
acaaggcgaagggcaagua

SEQ ID NO: 614427 - RNA, 19 nt, Homo sapiens
gcgguguccugcccaacau

SEQ ID NO: 614428 - RNA, 19 nt, Homo sapiens
gcaacgacgaggagcucaa

SEQ ID NO: 614429 - RNA, 19 nt, Homo sapiens
cgacgaggagcucaacaag

SEQ ID NO: 614430 - RNA, 19 nt, Homo sapiens
acaagcugcugggcaaagu

SEQ ID NO: 614431 - RNA, 19 nt, Homo sapiens
caacaagcugcugggcaaa

SEQ ID NO: 614432 - RNA, 19 nt, Homo sapiens
ggagagcuauuccaucuau

SEQ ID NO: 614433 - RNA, 19 nt, Homo sapiens
gaagaaagacggcaagaag

SEQ ID NO: 614434 - RNA, 19 nt, Homo sapiens
ccaagaaggcggugacuaa

SEQ ID NO: 614435 - RNA, 19 nt, Homo sapiens
gcuauuccaucuaugugua

SEQ ID NO: 614436 - RNA, 19 nt, Homo sapiens
cuaaggccgucaccaagua

SEQ ID NO: 614437 - RNA, 19 nt, Homo sapiens
ugacuaaggcgcagaagaa

SEQ ID NO: 614438 - RNA, 19 nt, Homo sapiens
guacaccagcgcuaaguaa

SEQ ID NO: 614439 - RNA, 19 nt, Homo sapiens
ugcaaacucucaacccuaa

SEQ ID NO: 614440 - RNA, 19 nt, Homo sapiens
guacuaaggccgucaccaa

SEQ ID NO: 614441 - RNA, 19 nt, Homo sapiens
acagugaguugguugcaaa

SEQ ID NO: 614442 - RNA, 19 nt, Homo sapiens
aacaagcgcucgaccauca

SEQ ID NO: 614443 - RNA, 19 nt, Homo sapiens
gcaaggagagcuauuccau

SEQ ID NO: 614444 - RNA, 19 nt, Homo sapiens
cguuggcgcuuuauagcua

SEQ ID NO: 614445 - RNA, 19 nt, Homo sapiens
aaggagagcuauuccaucu

SEQ ID NO: 614446 - RNA, 19 nt, Homo sapiens
cuaaggcgcagaagaaaga

SEQ ID NO: 614447 - RNA, 19 nt, Homo sapiens
cuaaguaaacagugaguug

SEQ ID NO: 614448 - RNA, 19 nt, Homo sapiens
caucaugaauucguuugug

SEQ ID NO: 614449 - RNA, 19 nt, Homo sapiens
caccagcgcuaaguaaaca

SEQ ID NO: 614450 - RNA, 19 nt, Homo sapiens
ccaaguacaccagcgcuaa

SEQ ID NO: 614451 - RNA, 19 nt, Homo sapiens
uguacaagguucugaagca

SEQ ID NO: 614452 - RNA, 19 nt, Homo sapiens
ccaucuauguguacaaggu

SEQ ID NO: 614453 - RNA, 19 nt, Homo sapiens
gagcuauuccaucuaugug

SEQ ID NO: 614454 - RNA, 19 nt, Homo sapiens
gacuaaggcgcagaagaaa

SEQ ID NO: 614455 - RNA, 19 nt, Homo sapiens
gagagcuauuccaucuaug

SEQ ID NO: 614456 - RNA, 19 nt, Homo sapiens
aguaaacagugaguugguu

SEQ ID NO: 614457 - RNA, 19 nt, Homo sapiens
gggcaucaugaauucguuu

SEQ ID NO: 614458 - RNA, 19 nt, Homo sapiens
acaccggcauuucguccaa

SEQ ID NO: 614459 - RNA, 19 nt, Homo sapiens
caagaaggcggugacuaag

SEQ ID NO: 614460 - RNA, 19 nt, Homo sapiens
aucaugaauucguuuguga

SEQ ID NO: 614461 - RNA, 19 nt, Homo sapiens
agaagaaagacggcaagaa

SEQ ID NO: 614462 - RNA, 19 nt, Homo sapiens
ccaagaagguuccgugguu

SEQ ID NO: 614463 - RNA, 19 nt, Homo sapiens
ggaagaauagcaagaagaa

SEQ ID NO: 614464 - RNA, 19 nt, Homo sapiens
gcaccuaccucaaguacuc

SEQ ID NO: 614465 - RNA, 19 nt, Homo sapiens
ucaaggcgcuggugcagaa

SEQ ID NO: 614466 - RNA, 19 nt, Homo sapiens
gcucgucgcuggccaagau

SEQ ID NO: 614467 - RNA, 19 nt, Homo sapiens
gcucuucccuucauuccau

SEQ ID NO: 614468 - RNA, 19 nt, Homo sapiens
ucuaagaagaggaagaaua

SEQ ID NO: 614469 - RNA, 19 nt, Homo sapiens
cuaagaagaggaagaauag

SEQ ID NO: 614470 - RNA, 19 nt, Homo sapiens
gaggaagaauagcaagaag

SEQ ID NO: 614471 - RNA, 19 nt, Homo sapiens
aagaauagcaagaagaaga

SEQ ID NO: 614472 - RNA, 19 nt, Homo sapiens
ccaauccucuugcuaccau

SEQ ID NO: 614473 - RNA, 19 nt, Homo sapiens
ccgagggaauggccaagaa

SEQ ID NO: 614474 - RNA, 19 nt, Homo sapiens
caucuaagaagaggaagaa

SEQ ID NO: 614475 - RNA, 19 nt, Homo sapiens
gggcgcaccuaccucaagu

SEQ ID NO: 614476 - RNA, 19 nt, Homo sapiens
gcucggacucggucucuga

SEQ ID NO: 614477 - RNA, 19 nt, Homo sapiens
agaauagcaagaagaagaa

SEQ ID NO: 614478 - RNA, 19 nt, Homo sapiens
cgccaacgguuccuucaag

SEQ ID NO: 614479 - RNA, 19 nt, Homo sapiens
guuguuugcuuuagguuuu

SEQ ID NO: 614480 - RNA, 19 nt, Homo sapiens
agaggaagaauagcaagaa

SEQ ID NO: 614481 - RNA, 19 nt, Homo sapiens
agaagaggaagaauagcaa

SEQ ID NO: 614482 - RNA, 19 nt, Homo sapiens
acacgcuucugcaggugaa

SEQ ID NO: 614483 - RNA, 19 nt, Homo sapiens
uaccucaaguacucgauca

SEQ ID NO: 614484 - RNA, 19 nt, Homo sapiens
gaagaauagcaagaagaag

SEQ ID NO: 614485 - RNA, 19 nt, Homo sapiens
aagaagaggaagaauagca

SEQ ID NO: 614486 - RNA, 19 nt, Homo sapiens
ggaaaggacucuauuacuu

SEQ ID NO: 614487 - RNA, 19 nt, Homo sapiens
ggaaaggucuggccugauu

SEQ ID NO: 614488 - RNA, 19 nt, Homo sapiens
gagaggagcuugaaguuug

SEQ ID NO: 614489 - RNA, 19 nt, Homo sapiens
gaaauucgccggaagagua

SEQ ID NO: 614490 - RNA, 19 nt, Homo sapiens
gaaagaacaucugcuaguu

SEQ ID NO: 614491 - RNA, 19 nt, Homo sapiens
gaauggagcauaaagauaa

SEQ ID NO: 614492 - RNA, 19 nt, Homo sapiens
ggacuucacuuaugauuca

SEQ ID NO: 614493 - RNA, 19 nt, Homo sapiens
cagcacagcucccuuauga

SEQ ID NO: 614494 - RNA, 19 nt, Homo sapiens
ccagaaaugucacugcaua

SEQ ID NO: 614495 - RNA, 19 nt, Homo sapiens
ucagugauguucaguauaa

SEQ ID NO: 614496 - RNA, 19 nt, Homo sapiens
gaagcaauguugacaaugu

SEQ ID NO: 614497 - RNA, 19 nt, Homo sapiens
caacaaaggccacauguga

SEQ ID NO: 614498 - RNA, 19 nt, Homo sapiens
gcaagauucuaacuaacua

SEQ ID NO: 614499 - RNA, 19 nt, Homo sapiens
gcaaugagacacagccuua

SEQ ID NO: 614500 - RNA, 19 nt, Homo sapiens
ggaugaaggugcagagaaa

SEQ ID NO: 614501 - RNA, 19 nt, Homo sapiens
gauaagcacucugugaauu

SEQ ID NO: 614502 - RNA, 19 nt, Homo sapiens
gaacagcaaugccauggau

SEQ ID NO: 614503 - RNA, 19 nt, Homo sapiens
gcaaguuguucaagaauau

SEQ ID NO: 614504 - RNA, 19 nt, Homo sapiens
ggaaagaucagaugaaaca

SEQ ID NO: 614505 - RNA, 19 nt, Homo sapiens
caacaacucuuccucaagu

SEQ ID NO: 614506 - RNA, 19 nt, Homo sapiens
gaaaugcugcugcuucuuu

SEQ ID NO: 614507 - RNA, 19 nt, Homo sapiens
ccacaaacaaccuaaauaa

SEQ ID NO: 614508 - RNA, 19 nt, Homo sapiens
uuacgaauauggaaccuua

SEQ ID NO: 614509 - RNA, 19 nt, Homo sapiens
caacacaaaugcaggauuc

SEQ ID NO: 614510 - RNA, 19 nt, Homo sapiens
ugagaaauccuuagcauaa

SEQ ID NO: 614511 - RNA, 19 nt, Homo sapiens
aaacugggcuacauugaaa

SEQ ID NO: 614512 - RNA, 19 nt, Homo sapiens
gaaaggacucuauuacuug

SEQ ID NO: 614513 - RNA, 19 nt, Homo sapiens
gcaguagugugcuuugaaa

SEQ ID NO: 614514 - RNA, 19 nt, Homo sapiens
gcaaagcauugauaccuau

SEQ ID NO: 614515 - RNA, 19 nt, Homo sapiens
gauggcauguggauugaua

SEQ ID NO: 614516 - RNA, 19 nt, Homo sapiens
ggaggaaccuagcaauguu

SEQ ID NO: 614517 - RNA, 19 nt, Homo sapiens
aaagagaguuuggagguua

SEQ ID NO: 614518 - RNA, 19 nt, Homo sapiens
gcacugaacacccacuuaa

SEQ ID NO: 614519 - RNA, 19 nt, Homo sapiens
gaagaacuauacaacaauc

SEQ ID NO: 614520 - RNA, 19 nt, Homo sapiens
gcauaaagauaagggauga

SEQ ID NO: 614521 - RNA, 19 nt, Homo sapiens
cagaauaucagacaucuaa

SEQ ID NO: 614522 - RNA, 19 nt, Homo sapiens
gagaaauccuuagcauaaa

SEQ ID NO: 614523 - RNA, 19 nt, Homo sapiens
ggacauagacagucaguuc

SEQ ID NO: 614524 - RNA, 19 nt, Homo sapiens
gaaacggaacuaauuugua

SEQ ID NO: 614525 - RNA, 19 nt, Homo sapiens
gcauguggauugauaugaa

SEQ ID NO: 614526 - RNA, 19 nt, Homo sapiens
ucaacgaguuacacaauaa

SEQ ID NO: 614527 - RNA, 19 nt, Homo sapiens
gcacagcucccuuaugaug

SEQ ID NO: 614528 - RNA, 19 nt, Homo sapiens
ccagggagcuguaaguguu

SEQ ID NO: 614529 - RNA, 19 nt, Homo sapiens
acagcaagauucuaacuaa

SEQ ID NO: 614530 - RNA, 19 nt, Homo sapiens
uaucagacaucuaaucguu

SEQ ID NO: 614531 - RNA, 19 nt, Homo sapiens
aaugagagauggcaagaaa

SEQ ID NO: 614532 - RNA, 19 nt, Homo sapiens
ucaagaaaguauccagaaa

SEQ ID NO: 614533 - RNA, 19 nt, Homo sapiens
cagcugacaucuccuuaaa

SEQ ID NO: 614534 - RNA, 19 nt, Homo sapiens
ggaauggagcauaaagaua

SEQ ID NO: 614535 - RNA, 19 nt, Homo sapiens
ucuaaucguuuccacuuua

SEQ ID NO: 614536 - RNA, 19 nt, Homo sapiens
caacaagaaucgguaugaa

SEQ ID NO: 614537 - RNA, 19 nt, Homo sapiens
ccaagacuguguucccuaa

SEQ ID NO: 614538 - RNA, 19 nt, Homo sapiens
guaaaugaauuggaacgaa

SEQ ID NO: 614539 - RNA, 19 nt, Homo sapiens
gauccuaaguaagaacaua

SEQ ID NO: 614540 - RNA, 19 nt, Homo sapiens
gggaucagcugaagaaguc

SEQ ID NO: 614541 - RNA, 19 nt, Homo sapiens
gaagagggaaauagaagaa

SEQ ID NO: 614542 - RNA, 19 nt, Homo sapiens
gcugacaucuccuuaaagu

SEQ ID NO: 614543 - RNA, 19 nt, Homo sapiens
gggaaacacuccagagcaa

SEQ ID NO: 614544 - RNA, 19 nt, Homo sapiens
ggaggaauaauauaccuaa

SEQ ID NO: 614545 - RNA, 19 nt, Homo sapiens
gaaacugggcuacauugaa

SEQ ID NO: 614546 - RNA, 19 nt, Homo sapiens
uuacaucacugguacaaau

SEQ ID NO: 614547 - RNA, 19 nt, Homo sapiens
gaugcacccuguugccaua

SEQ ID NO: 614548 - RNA, 19 nt, Homo sapiens
gcaagacucucuguaugga

SEQ ID NO: 614549 - RNA, 19 nt, Homo sapiens
ggauugauaugaaugaagu

SEQ ID NO: 614550 - RNA, 19 nt, Homo sapiens
gcuaguggauuguccuuug

SEQ ID NO: 614551 - RNA, 19 nt, Homo sapiens
aaagugauccuaaguaaga

SEQ ID NO: 614552 - RNA, 19 nt, Homo sapiens
gauuucaccucagucguua

SEQ ID NO: 614553 - RNA, 19 nt, Homo sapiens
gcgcagacauucuucuugu

SEQ ID NO: 614554 - RNA, 19 nt, Homo sapiens
gaagaccuggcccauauuu

SEQ ID NO: 614555 - RNA, 19 nt, Homo sapiens
caaccacauuucacauaaa

SEQ ID NO: 614556 - RNA, 19 nt, Homo sapiens
gaaaguauccagaaagaac

SEQ ID NO: 614557 - RNA, 19 nt, Homo sapiens
gaacuggguccaugaugaa

SEQ ID NO: 614558 - RNA, 19 nt, Homo sapiens
uaaugucucugugugguua

SEQ ID NO: 614559 - RNA, 19 nt, Homo sapiens
uggaagaccuggcccauau

SEQ ID NO: 614560 - RNA, 19 nt, Homo sapiens
ggcaugauaugaauuggaa

SEQ ID NO: 614561 - RNA, 19 nt, Homo sapiens
gacauuuacugaagaugaa

SEQ ID NO: 614562 - RNA, 19 nt, Homo sapiens
gcaagagccugcacugaac

SEQ ID NO: 614563 - RNA, 19 nt, Homo sapiens
caacagcacuugggaugug

SEQ ID NO: 614564 - RNA, 19 nt, Homo sapiens
ggcaaagcauugauaccua

SEQ ID NO: 614565 - RNA, 19 nt, Homo sapiens
cugaagaagucuaucauug

SEQ ID NO: 614566 - RNA, 19 nt, Homo sapiens
gcaaugccauggagguugu

SEQ ID NO: 614567 - RNA, 19 nt, Homo sapiens
ugacugaccaaaccaauaa

SEQ ID NO: 614568 - RNA, 19 nt, Homo sapiens
gaacaucugcuaguugguu

SEQ ID NO: 614569 - RNA, 19 nt, Homo sapiens
aagaaaguauccagaaaga

SEQ ID NO: 614570 - RNA, 19 nt, Homo sapiens
agaaacaucagccuacaua

SEQ ID NO: 614571 - RNA, 19 nt, Homo sapiens
gaugguggcugcccagauc

SEQ ID NO: 614572 - RNA, 19 nt, Homo sapiens
agacuguguucccuaauaa

SEQ ID NO: 614573 - RNA, 19 nt, Homo sapiens
ugaagaugcuaguggauug

SEQ ID NO: 614574 - RNA, 19 nt, Homo sapiens
acaaccacauuucacauaa

SEQ ID NO: 614575 - RNA, 19 nt, Homo sapiens
ugaacuggguccaugauga

SEQ ID NO: 614576 - RNA, 19 nt, Homo sapiens
gaaauucaugggcuucaaa

SEQ ID NO: 614577 - RNA, 19 nt, Homo sapiens
agaaugaaaugccgcaguu

SEQ ID NO: 614578 - RNA, 19 nt, Homo sapiens
gcuuggaggugaauauuuc

SEQ ID NO: 614579 - RNA, 19 nt, Homo sapiens
agacacaacucccaaugga

SEQ ID NO: 614580 - RNA, 19 nt, Homo sapiens
guagugugcuuugaaaugu

SEQ ID NO: 614581 - RNA, 19 nt, Homo sapiens
cauaugacauuuacugaag

SEQ ID NO: 614582 - RNA, 19 nt, Homo sapiens
gaugcaaagccauauaauu

SEQ ID NO: 614583 - RNA, 19 nt, Homo sapiens
cuguauaccuugaugcaua

SEQ ID NO: 614584 - RNA, 19 nt, Homo sapiens
ggccugugaugguaccuua

SEQ ID NO: 614585 - RNA, 19 nt, Homo sapiens
gaacaaagaagcaaaagga

SEQ ID NO: 614586 - RNA, 19 nt, Homo sapiens
gaagagauauacacagaua

SEQ ID NO: 614587 - RNA, 19 nt, Homo sapiens
gaucaucccuugucucuuu

SEQ ID NO: 614588 - RNA, 19 nt, Homo sapiens
ugacaaagcugaaauugau

SEQ ID NO: 614589 - RNA, 19 nt, Homo sapiens
gcaugucucuguaauguaa

SEQ ID NO: 614590 - RNA, 19 nt, Homo sapiens
cuacaaacaugacaucaaa

SEQ ID NO: 614591 - RNA, 19 nt, Homo sapiens
gguagaagaugacuggaaa

SEQ ID NO: 614592 - RNA, 19 nt, Homo sapiens
guucacaccuuucuuuaaa

SEQ ID NO: 614593 - RNA, 19 nt, Homo sapiens
ccaaggagguagaagauga

SEQ ID NO: 614594 - RNA, 19 nt, Homo sapiens
ggagaagugagaaguguua

SEQ ID NO: 614595 - RNA, 19 nt, Homo sapiens
gaaauuuacagacaccaua

SEQ ID NO: 614596 - RNA, 19 nt, Homo sapiens
ggaaauacguggccauggu

SEQ ID NO: 614597 - RNA, 19 nt, Homo sapiens
gcacucgccugaaguugaa

SEQ ID NO: 614598 - RNA, 19 nt, Homo sapiens
gaagugagaaguguuauga

SEQ ID NO: 614599 - RNA, 19 nt, Homo sapiens
caauacagccuaauuaugu

SEQ ID NO: 614600 - RNA, 19 nt, Homo sapiens
gaagaugacuggaaauacg

SEQ ID NO: 614601 - RNA, 19 nt, Homo sapiens
gaagauugccgauguuuua

SEQ ID NO: 614602 - RNA, 19 nt, Homo sapiens
gagaaguguuaugacauua

SEQ ID NO: 614603 - RNA, 19 nt, Homo sapiens
acacagauauaaccuauuc

SEQ ID NO: 614604 - RNA, 19 nt, Homo sapiens
gugaagagauauacacaga

SEQ ID NO: 614605 - RNA, 19 nt, Homo sapiens
cgucacaucuggaaugauu

SEQ ID NO: 614606 - RNA, 19 nt, Homo sapiens
caacguggaugaaguaaac

SEQ ID NO: 614607 - RNA, 19 nt, Homo sapiens
ugagaaguguuaugacauu

SEQ ID NO: 614608 - RNA, 19 nt, Homo sapiens
gggcagggauuccuucaug

SEQ ID NO: 614609 - RNA, 19 nt, Homo sapiens
cagaauauccuccagugua

SEQ ID NO: 614610 - RNA, 19 nt, Homo sapiens
guucagaaauuuacagaca

SEQ ID NO: 614611 - RNA, 19 nt, Homo sapiens
agacaagaaugacuuacaa

SEQ ID NO: 614612 - RNA, 19 nt, Homo sapiens
caucaaaacuguucccuaa

SEQ ID NO: 614613 - RNA, 19 nt, Homo sapiens
uaacaucaagccacacuaa

SEQ ID NO: 614614 - RNA, 19 nt, Homo sapiens
gaucaaaaguggauaugaa

SEQ ID NO: 614615 - RNA, 19 nt, Homo sapiens
gaaguguuaugacauuagu

SEQ ID NO: 614616 - RNA, 19 nt, Homo sapiens
ugacauuagugcccugauu

SEQ ID NO: 614617 - RNA, 19 nt, Homo sapiens
ggacagaguauuucuuugg

SEQ ID NO: 614618 - RNA, 19 nt, Homo sapiens
aagagaagauuaagucauc

SEQ ID NO: 614619 - RNA, 19 nt, Homo sapiens
ggaauaugauggcauugag

SEQ ID NO: 614620 - RNA, 19 nt, Homo sapiens
gugcaugucucuguaaugu

SEQ ID NO: 614621 - RNA, 19 nt, Homo sapiens
ggaauuggaccaugcaaca

SEQ ID NO: 614622 - RNA, 19 nt, Homo sapiens
gaaguugaagaugugauua

SEQ ID NO: 614623 - RNA, 19 nt, Homo sapiens
gaucauggaaaccaauuug

SEQ ID NO: 614624 - RNA, 19 nt, Homo sapiens
caggugaacucugggaauu

SEQ ID NO: 614625 - RNA, 19 nt, Homo sapiens
ggacuuucuugcacauuag

SEQ ID NO: 614626 - RNA, 19 nt, Homo sapiens
ucaaaacuguucccuaaaa

SEQ ID NO: 614627 - RNA, 19 nt, Homo sapiens
gaacccagacaucuuaaag

SEQ ID NO: 614628 - RNA, 19 nt, Homo sapiens
acuauugcauccuugauuu

SEQ ID NO: 614629 - RNA, 19 nt, Homo sapiens
gcaacacuuugugaacuau

SEQ ID NO: 614630 - RNA, 19 nt, Homo sapiens
caagaaugacuuacaauac

SEQ ID NO: 614631 - RNA, 19 nt, Homo sapiens
uagaagaugacuggaaaua

SEQ ID NO: 614632 - RNA, 19 nt, Homo sapiens
ucaguauuaugacauguga

SEQ ID NO: 614633 - RNA, 19 nt, Homo sapiens
uggaugcuguuucucagua

SEQ ID NO: 614634 - RNA, 19 nt, Homo sapiens
uaaaccagaucauggaaac

SEQ ID NO: 614635 - RNA, 19 nt, Homo sapiens
aggacuuucuugcacauua

SEQ ID NO: 614636 - RNA, 19 nt, Homo sapiens
gaacacaggaaaaucuuaa

SEQ ID NO: 614637 - RNA, 19 nt, Homo sapiens
gaguauuucuuuggguauu

SEQ ID NO: 614638 - RNA, 19 nt, Homo sapiens
ggugguggacagaguauuu

SEQ ID NO: 614639 - RNA, 19 nt, Homo sapiens
gaaaccaucccauccacau

SEQ ID NO: 614640 - RNA, 19 nt, Homo sapiens
guggacagaguauuucuuu

SEQ ID NO: 614641 - RNA, 19 nt, Homo sapiens
ugacuguguuuguguugaa

SEQ ID NO: 614642 - RNA, 19 nt, Homo sapiens
gacaucaaauacaacuguu

SEQ ID NO: 614643 - RNA, 19 nt, Homo sapiens
gaccaugcaacauuuguga

SEQ ID NO: 614644 - RNA, 19 nt, Homo sapiens
agaauauccuccaguguag

SEQ ID NO: 614645 - RNA, 19 nt, Homo sapiens
uuacagacaccauauuugu

SEQ ID NO: 614646 - RNA, 19 nt, Homo sapiens
ucacaaaucaaaugagcuu

SEQ ID NO: 614647 - RNA, 19 nt, Homo sapiens
gaagacaguuuuccugaag

SEQ ID NO: 614648 - RNA, 19 nt, Homo sapiens
ccgacauuguucucuauaa

SEQ ID NO: 614649 - RNA, 19 nt, Homo sapiens
gacauuagugcccugauug

SEQ ID NO: 614650 - RNA, 19 nt, Homo sapiens
ccaggugggugaagacagu

SEQ ID NO: 614651 - RNA, 19 nt, Homo sapiens
cacauuaggaagcagaaua

SEQ ID NO: 614652 - RNA, 19 nt, Homo sapiens
ccauauuuguucugcauuc

SEQ ID NO: 614653 - RNA, 19 nt, Homo sapiens
gauuaagucaucagccauu

SEQ ID NO: 614654 - RNA, 19 nt, Homo sapiens
gcugaaauugaucuucuaa

SEQ ID NO: 614655 - RNA, 19 nt, Homo sapiens
cgacauuguucucuauaac

SEQ ID NO: 614656 - RNA, 19 nt, Homo sapiens
gaauaugauggcauugaga

SEQ ID NO: 614657 - RNA, 19 nt, Homo sapiens
gaugcuguuucucaguauu

SEQ ID NO: 614658 - RNA, 19 nt, Homo sapiens
acugauggcuacauggaaa

SEQ ID NO: 614659 - RNA, 19 nt, Homo sapiens
gaacugcagggcuauuucu

SEQ ID NO: 614660 - RNA, 19 nt, Homo sapiens
gcaagagaagauuaaguca

SEQ ID NO: 614661 - RNA, 19 nt, Homo sapiens
ugaugccucuggcuacaaa

SEQ ID NO: 614662 - RNA, 19 nt, Homo sapiens
caaugaaaccaaggaggua

SEQ ID NO: 614663 - RNA, 19 nt, Homo sapiens
ggccaacguggaugaagua

SEQ ID NO: 614664 - RNA, 19 nt, Homo sapiens
guauuucaguccugcuuuc

SEQ ID NO: 614665 - RNA, 19 nt, Homo sapiens
ggugaacucugggaauugg

SEQ ID NO: 614666 - RNA, 19 nt, Homo sapiens
guaaaccagaucauggaaa

SEQ ID NO: 614667 - RNA, 19 nt, Homo sapiens
ggaugcuguuucucaguau

SEQ ID NO: 614668 - RNA, 19 nt, Homo sapiens
gacuuacaauacagccuaa

SEQ ID NO: 614669 - RNA, 19 nt, Homo sapiens
cuaaagacaagaaugacuu

SEQ ID NO: 614670 - RNA, 19 nt, Homo sapiens
ucagguuucucgugucugu

SEQ ID NO: 614671 - RNA, 19 nt, Homo sapiens
ggucagguuucucgugucu

SEQ ID NO: 614672 - RNA, 19 nt, Homo sapiens
ggagcacucgccugaaguu

SEQ ID NO: 614673 - RNA, 19 nt, Homo sapiens
acaagcaagagaagauuaa

SEQ ID NO: 614674 - RNA, 19 nt, Homo sapiens
cacaagcaagagaagauua

SEQ ID NO: 614675 - RNA, 19 nt, Homo sapiens
uaccugcuguucaccauga

SEQ ID NO: 614676 - RNA, 19 nt, Homo sapiens
ucccuugucucuuuauuuc

SEQ ID NO: 614677 - RNA, 19 nt, Homo sapiens
gcccgacauuguucucuau

SEQ ID NO: 614678 - RNA, 19 nt, Homo sapiens
ugcaacacuuugugaacua

SEQ ID NO: 614679 - RNA, 19 nt, Homo sapiens
aaaccaaggagguagaaga

SEQ ID NO: 614680 - RNA, 19 nt, Homo sapiens
augaagagccacaaugaaa

SEQ ID NO: 614681 - RNA, 19 nt, Homo sapiens
aagaugugauuaacagugu

SEQ ID NO: 614682 - RNA, 19 nt, Homo sapiens
auuagaagauugccgaugu

SEQ ID NO: 614683 - RNA, 19 nt, Homo sapiens
cgccugaaguugaagaugu

SEQ ID NO: 614684 - RNA, 19 nt, Homo sapiens
ugacaucaaauacaacugu

SEQ ID NO: 614685 - RNA, 19 nt, Homo sapiens
gcuacaaacaugacaucaa

SEQ ID NO: 614686 - RNA, 19 nt, Homo sapiens
gcaagugggucuccaauaa

SEQ ID NO: 614687 - RNA, 19 nt, Homo sapiens
gcacaugacugaccugauu

SEQ ID NO: 614688 - RNA, 19 nt, Homo sapiens
guacagcuguguucuggua

SEQ ID NO: 614689 - RNA, 19 nt, Homo sapiens
gaaguugacugacauccuu

SEQ ID NO: 614690 - RNA, 19 nt, Homo sapiens
ggaaucguguggcuacuuu

SEQ ID NO: 614691 - RNA, 19 nt, Homo sapiens
gagauacuuucaagcauuu

SEQ ID NO: 614692 - RNA, 19 nt, Homo sapiens
gaaggugacuaccgaacaa

SEQ ID NO: 614693 - RNA, 19 nt, Homo sapiens
uguuacagguugcaaauua

SEQ ID NO: 614694 - RNA, 19 nt, Homo sapiens
gccaagcuuuccaagauua

SEQ ID NO: 614695 - RNA, 19 nt, Homo sapiens
gaaggggacuauuaucaua

SEQ ID NO: 614696 - RNA, 19 nt, Homo sapiens
ggacucagcugcagguuuu

SEQ ID NO: 614697 - RNA, 19 nt, Homo sapiens
cgagauacuuucaagcauu

SEQ ID NO: 614698 - RNA, 19 nt, Homo sapiens
aguaaagacugcagaauug

SEQ ID NO: 614699 - RNA, 19 nt, Homo sapiens
ugacugaccugauuuaugc

SEQ ID NO: 614700 - RNA, 19 nt, Homo sapiens
ggaagaugaugacccuguu

SEQ ID NO: 614701 - RNA, 19 nt, Homo sapiens
guacuacgaugucaugucu

SEQ ID NO: 614702 - RNA, 19 nt, Homo sapiens
cgaacgagcuggagggaau

SEQ ID NO: 614703 - RNA, 19 nt, Homo sapiens
gaguguggaugacugcuuu

SEQ ID NO: 614704 - RNA, 19 nt, Homo sapiens
gagggaaucugcgguacuu

SEQ ID NO: 614705 - RNA, 19 nt, Homo sapiens
caacgugacagacaccuuu

SEQ ID NO: 614706 - RNA, 19 nt, Homo sapiens
aaagacugcagaauuguua

SEQ ID NO: 614707 - RNA, 19 nt, Homo sapiens
ugagauaacgugccuggua

SEQ ID NO: 614708 - RNA, 19 nt, Homo sapiens
ucacaggguuaacaguaaa

SEQ ID NO: 614709 - RNA, 19 nt, Homo sapiens
gcuaugcugucuuccaguu

SEQ ID NO: 614710 - RNA, 19 nt, Homo sapiens
ccaaagcccugaugagacu

SEQ ID NO: 614711 - RNA, 19 nt, Homo sapiens
acaagacccuggagugaga

SEQ ID NO: 614712 - RNA, 19 nt, Homo sapiens
ucugauaccuuguuuacau

SEQ ID NO: 614713 - RNA, 19 nt, Homo sapiens
gcagagggagaccauacua

SEQ ID NO: 614714 - RNA, 19 nt, Homo sapiens
ccaauaagugguuccauga

SEQ ID NO: 614715 - RNA, 19 nt, Homo sapiens
ucguguggcuacuuucuua

SEQ ID NO: 614716 - RNA, 19 nt, Homo sapiens
ugaagcggcuaaacacaga

SEQ ID NO: 614717 - RNA, 19 nt, Homo sapiens
gacagacaccuuuguaugu

SEQ ID NO: 614718 - RNA, 19 nt, Homo sapiens
uguguaagaugcccaguug

SEQ ID NO: 614719 - RNA, 19 nt, Homo sapiens
ccagaaggcaucuaugaga

SEQ ID NO: 614720 - RNA, 19 nt, Homo sapiens
ggaaucugcgguacuuuga

SEQ ID NO: 614721 - RNA, 19 nt, Homo sapiens
guauguuccuuguauguuc

SEQ ID NO: 614722 - RNA, 19 nt, Homo sapiens
cuugagaccuuguggauca

SEQ ID NO: 614723 - RNA, 19 nt, Homo sapiens
uaucacaggguuaacagua

SEQ ID NO: 614724 - RNA, 19 nt, Homo sapiens
guuaacaaaucagacagaa

SEQ ID NO: 614725 - RNA, 19 nt, Homo sapiens
gcgguacuuugagcaguua

SEQ ID NO: 614726 - RNA, 19 nt, Homo sapiens
gaaagaguacauccuugug

SEQ ID NO: 614727 - RNA, 19 nt, Homo sapiens
acagacaccuuuguauguu

SEQ ID NO: 614728 - RNA, 19 nt, Homo sapiens
gcccgcacaucgucaggua

SEQ ID NO: 614729 - RNA, 19 nt, Homo sapiens
cgagauaggagcugccaaa

SEQ ID NO: 614730 - RNA, 19 nt, Homo sapiens
ugacagacaccuuuguaug

SEQ ID NO: 614731 - RNA, 19 nt, Homo sapiens
gggcugcaauuuggccuaa

SEQ ID NO: 614732 - RNA, 19 nt, Homo sapiens
gaggaaaucgagaggauca

SEQ ID NO: 614733 - RNA, 19 nt, Homo sapiens
gcugcaauuuggccuaaga

SEQ ID NO: 614734 - RNA, 19 nt, Homo sapiens
guuacagguugcaaauuau

SEQ ID NO: 614735 - RNA, 19 nt, Homo sapiens
cagcauaucacaggguuaa

SEQ ID NO: 614736 - RNA, 19 nt, Homo sapiens
uggcuacuuucuuaaacua

SEQ ID NO: 614737 - RNA, 19 nt, Homo sapiens
ccacggacgcugucuacaa

SEQ ID NO: 614738 - RNA, 19 nt, Homo sapiens
gaaccaaguaccaggcaau

SEQ ID NO: 614739 - RNA, 19 nt, Homo sapiens
gaauucuucaccucuauug

SEQ ID NO: 614740 - RNA, 19 nt, Homo sapiens
gaagaugaugacccuguug

SEQ ID NO: 614741 - RNA, 19 nt, Homo sapiens
gaugagacuucaggacaca

SEQ ID NO: 614742 - RNA, 19 nt, Homo sapiens
uuggagaaaugaauguuug

SEQ ID NO: 614743 - RNA, 19 nt, Homo sapiens
gaaggguacagcuguguuc

SEQ ID NO: 614744 - RNA, 19 nt, Homo sapiens
gggaaucugcgguacuuug

SEQ ID NO: 614745 - RNA, 19 nt, Homo sapiens
ccugauuuaugcagagaaa

SEQ ID NO: 614746 - RNA, 19 nt, Homo sapiens
gccgaauucuucaccucua

SEQ ID NO: 614747 - RNA, 19 nt, Homo sapiens
caggaguucuugagaccuu

SEQ ID NO: 614748 - RNA, 19 nt, Homo sapiens
ggaaggugacuaccgaaca

SEQ ID NO: 614749 - RNA, 19 nt, Homo sapiens
gcgagauacuuucaagcau

SEQ ID NO: 614750 - RNA, 19 nt, Homo sapiens
gauaccuuguuuacauguu

SEQ ID NO: 614751 - RNA, 19 nt, Homo sapiens
uaagagcugggccaacaaa

SEQ ID NO: 614752 - RNA, 19 nt, Homo sapiens
gcuacuuucuuaaacuaca

SEQ ID NO: 614753 - RNA, 19 nt, Homo sapiens
uaaagacugcagaauuguu

SEQ ID NO: 614754 - RNA, 19 nt, Homo sapiens
acuacgaugucaugucuga

SEQ ID NO: 614755 - RNA, 19 nt, Homo sapiens
cuacaagacccuggaguga

SEQ ID NO: 614756 - RNA, 19 nt, Homo sapiens
gagcagagggagaccauac

SEQ ID NO: 614757 - RNA, 19 nt, Homo sapiens
gagaaaugaauguuugucu

SEQ ID NO: 614758 - RNA, 19 nt, Homo sapiens
guacuuugagcaguuauug

SEQ ID NO: 614759 - RNA, 19 nt, Homo sapiens
ugaaagaguacauccuugu

SEQ ID NO: 614760 - RNA, 19 nt, Homo sapiens
uaaaaugucccuaccagaa

SEQ ID NO: 614761 - RNA, 19 nt, Homo sapiens
uagggcgacuccuguguga

SEQ ID NO: 614762 - RNA, 19 nt, Homo sapiens
gaugagcgagauacuuuca

SEQ ID NO: 614763 - RNA, 19 nt, Homo sapiens
gagcuggugcagucucuga

SEQ ID NO: 614764 - RNA, 19 nt, Homo sapiens
uggcauuucuaucuauugu

SEQ ID NO: 614765 - RNA, 19 nt, Homo sapiens
caauaagugguuccaugaa

SEQ ID NO: 614766 - RNA, 19 nt, Homo sapiens
ugagcgagauacuuucaag

SEQ ID NO: 614767 - RNA, 19 nt, Homo sapiens
cacggacgcugucuacaag

SEQ ID NO: 614768 - RNA, 19 nt, Homo sapiens
ggagugggaggacaguaug

SEQ ID NO: 614769 - RNA, 19 nt, Homo sapiens
acaaugaaggggacuauua

SEQ ID NO: 614770 - RNA, 19 nt, Homo sapiens
gaccugauuuaugcagaga

SEQ ID NO: 614771 - RNA, 19 nt, Homo sapiens
cuuuguauguuccuuguau

SEQ ID NO: 614772 - RNA, 19 nt, Homo sapiens
ccgaauucuucaccucuau

SEQ ID NO: 614773 - RNA, 19 nt, Homo sapiens
gcauaucacaggguuaaca

SEQ ID NO: 614774 - RNA, 19 nt, Homo sapiens
gucccuaccagaagccuua

SEQ ID NO: 614775 - RNA, 19 nt, Homo sapiens
cagacaccuuuguauguuc

SEQ ID NO: 614776 - RNA, 19 nt, Homo sapiens
guaaagacugcagaauugu

SEQ ID NO: 614777 - RNA, 19 nt, Homo sapiens
ucgagaggaucaaggagau

SEQ ID NO: 614778 - RNA, 19 nt, Homo sapiens
ugccugagagggauguuua

SEQ ID NO: 614779 - RNA, 19 nt, Homo sapiens
ugagaggccuguggacuac

SEQ ID NO: 614780 - RNA, 19 nt, Homo sapiens
ugagacuucaggacacaua

SEQ ID NO: 614781 - RNA, 19 nt, Homo sapiens
auuaagagcugggccaaca

SEQ ID NO: 614782 - RNA, 19 nt, Homo sapiens
ggaaugaugagcgagauac

SEQ ID NO: 614783 - RNA, 19 nt, Homo sapiens
acugugcccugcaugugua

SEQ ID NO: 614784 - RNA, 19 nt, Homo sapiens
guucugauaccuuguuuac

SEQ ID NO: 614785 - RNA, 19 nt, Homo sapiens
ugauuuaugcagagaaaga

SEQ ID NO: 614786 - RNA, 19 nt, Homo sapiens
gaagaugggugauuuacaa

SEQ ID NO: 614787 - RNA, 19 nt, Homo sapiens
gaaggaagaugggugauuu

SEQ ID NO: 614788 - RNA, 19 nt, Homo sapiens
gaaauagcacuaccaaaua

SEQ ID NO: 614789 - RNA, 19 nt, Homo sapiens
gggcagauguuuauucuuu

SEQ ID NO: 614790 - RNA, 19 nt, Homo sapiens
ggugaaaucugaacucauu

SEQ ID NO: 614791 - RNA, 19 nt, Homo sapiens
gcacuggauuggaucuuua

SEQ ID NO: 614792 - RNA, 19 nt, Homo sapiens
gcacgaaacugaagccaau

SEQ ID NO: 614793 - RNA, 19 nt, Homo sapiens
ggauggaucuggaacauau

SEQ ID NO: 614794 - RNA, 19 nt, Homo sapiens
ugauugagauggagaauaa

SEQ ID NO: 614795 - RNA, 19 nt, Homo sapiens
caacaaggaugaacugauc

SEQ ID NO: 614796 - RNA, 19 nt, Homo sapiens
guacuucacuggaaauaug

SEQ ID NO: 614797 - RNA, 19 nt, Homo sapiens
cauaugagcuauuugcauu

SEQ ID NO: 614798 - RNA, 19 nt, Homo sapiens
acacacagaugacuaaguu

SEQ ID NO: 614799 - RNA, 19 nt, Homo sapiens
gaugggugauuuacaauga

SEQ ID NO: 614800 - RNA, 19 nt, Homo sapiens
gcacuacgagcaacgaaua

SEQ ID NO: 614801 - RNA, 19 nt, Homo sapiens
gaaaaugaauugccaguau

SEQ ID NO: 614802 - RNA, 19 nt, Homo sapiens
aggaugaacugaucgcuua

SEQ ID NO: 614803 - RNA, 19 nt, Homo sapiens
gcagcaagaugcccaggaa

SEQ ID NO: 614804 - RNA, 19 nt, Homo sapiens
ggcaacagcugcuaucuca

SEQ ID NO: 614805 - RNA, 19 nt, Homo sapiens
gaagguggacucuauguau

SEQ ID NO: 614806 - RNA, 19 nt, Homo sapiens
uagcgacgauuaugaauau

SEQ ID NO: 614807 - RNA, 19 nt, Homo sapiens
gaucauuguucacauggaa

SEQ ID NO: 614808 - RNA, 19 nt, Homo sapiens
ugaaauagcacuaccaaau

SEQ ID NO: 614809 - RNA, 19 nt, Homo sapiens
gaugaagccaaacuuguua

SEQ ID NO: 614810 - RNA, 19 nt, Homo sapiens
gcagugcccuacaagcaaa

SEQ ID NO: 614811 - RNA, 19 nt, Homo sapiens
gaagaugaagccaaacuug

SEQ ID NO: 614812 - RNA, 19 nt, Homo sapiens
acugaucgcuuaugaacua

SEQ ID NO: 614813 - RNA, 19 nt, Homo sapiens
gauuuacaaugaccacaaa

SEQ ID NO: 614814 - RNA, 19 nt, Homo sapiens
gaacugaucgcuuaugaac

SEQ ID NO: 614815 - RNA, 19 nt, Homo sapiens
gaggguggauuaccugaug

SEQ ID NO: 614816 - RNA, 19 nt, Homo sapiens
gaacauaugagcuauuugc

SEQ ID NO: 614817 - RNA, 19 nt, Homo sapiens
ccagagagcguauguagga

SEQ ID NO: 614818 - RNA, 19 nt, Homo sapiens
gaagggaacauguugaaag

SEQ ID NO: 614819 - RNA, 19 nt, Homo sapiens
gcgacagggucuacaagaa

SEQ ID NO: 614820 - RNA, 19 nt, Homo sapiens
cagaggaaaucguagcuau

SEQ ID NO: 614821 - RNA, 19 nt, Homo sapiens
acacggagaggguggauua

SEQ ID NO: 614822 - RNA, 19 nt, Homo sapiens
uaccaaauauugaggaguu

SEQ ID NO: 614823 - RNA, 19 nt, Homo sapiens
gggaacauguugaaagaca

SEQ ID NO: 614824 - RNA, 19 nt, Homo sapiens
caagcuaaaccucaaauau

SEQ ID NO: 614825 - RNA, 19 nt, Homo sapiens
aaagagcacuggauuggau

SEQ ID NO: 614826 - RNA, 19 nt, Homo sapiens
uggauuaccugaugcaguu

SEQ ID NO: 614827 - RNA, 19 nt, Homo sapiens
aaucugaacucauugaaca

SEQ ID NO: 614828 - RNA, 19 nt, Homo sapiens
cgaaggaccuagagucaag

SEQ ID NO: 614829 - RNA, 19 nt, Homo sapiens
ggaaagagcacuggauugg

SEQ ID NO: 614830 - RNA, 19 nt, Homo sapiens
gcaagagccacccggaauu

SEQ ID NO: 614831 - RNA, 19 nt, Homo sapiens
agaaugggcuccaggacaa

SEQ ID NO: 614832 - RNA, 19 nt, Homo sapiens
uggaacauaugagcuauuu

SEQ ID NO: 614833 - RNA, 19 nt, Homo sapiens
ggaagcagaagcaaacaga

SEQ ID NO: 614834 - RNA, 19 nt, Homo sapiens
gaagggaagcagaagcaaa

SEQ ID NO: 614835 - RNA, 19 nt, Homo sapiens
cgacgauuaugaauaugaa

SEQ ID NO: 614836 - RNA, 19 nt, Homo sapiens
uaaauagcgacgauuauga

SEQ ID NO: 614837 - RNA, 19 nt, Homo sapiens
agauacugaugacgauuua

SEQ ID NO: 614838 - RNA, 19 nt, Homo sapiens
gaaacugaagccaauguau

SEQ ID NO: 614839 - RNA, 19 nt, Homo sapiens
ugacggcucuguccugugu

SEQ ID NO: 614840 - RNA, 19 nt, Homo sapiens
ccaagcacuuagcgcauuu

SEQ ID NO: 614841 - RNA, 19 nt, Homo sapiens
ucacccagcuggacaaugg

SEQ ID NO: 614842 - RNA, 19 nt, Homo sapiens
cuaaagaccugggcuacau

SEQ ID NO: 614843 - RNA, 19 nt, Homo sapiens
ggucauuacauuugccaua

SEQ ID NO: 614844 - RNA, 19 nt, Homo sapiens
gaggaaaucguagcuauca

SEQ ID NO: 614845 - RNA, 19 nt, Homo sapiens
gcaagaugcccaggaauuc

SEQ ID NO: 614846 - RNA, 19 nt, Homo sapiens
ggacaauggagucaggauu

SEQ ID NO: 614847 - RNA, 19 nt, Homo sapiens
aagggaacauguugaaaga

SEQ ID NO: 614848 - RNA, 19 nt, Homo sapiens
ggagaauaaugccaaugca

SEQ ID NO: 614849 - RNA, 19 nt, Homo sapiens
gaaaucguagcuaucauca

SEQ ID NO: 614850 - RNA, 19 nt, Homo sapiens
ggaaaucguagcuaucauc

SEQ ID NO: 614851 - RNA, 19 nt, Homo sapiens
gaaaucugaacucauugaa

SEQ ID NO: 614852 - RNA, 19 nt, Homo sapiens
cuacgagcaacgaauaaua

SEQ ID NO: 614853 - RNA, 19 nt, Homo sapiens
ucaacuggaucauuguuca

SEQ ID NO: 614854 - RNA, 19 nt, Homo sapiens
ugccagaccuacuugauau

SEQ ID NO: 614855 - RNA, 19 nt, Homo sapiens
caagaagaagaaccuguuu

SEQ ID NO: 614856 - RNA, 19 nt, Homo sapiens
gaagccaaacuuguuauau

SEQ ID NO: 614857 - RNA, 19 nt, Homo sapiens
ggaaggaagaugggugauu

SEQ ID NO: 614858 - RNA, 19 nt, Homo sapiens
gcuguguacuucacuggaa

SEQ ID NO: 614859 - RNA, 19 nt, Homo sapiens
gaaaacaucucgcuuugcu

SEQ ID NO: 614860 - RNA, 19 nt, Homo sapiens
gccaagauaccauuuagug

SEQ ID NO: 614861 - RNA, 19 nt, Homo sapiens
gccaagcacuuagcgcauu

SEQ ID NO: 614862 - RNA, 19 nt, Homo sapiens
gaauugccaguaucuaaau

SEQ ID NO: 614863 - RNA, 19 nt, Homo sapiens
aggaggaauuccaagauuu

SEQ ID NO: 614864 - RNA, 19 nt, Homo sapiens
aaggaggaauuccaagauu

SEQ ID NO: 614865 - RNA, 19 nt, Homo sapiens
agaauaaugccaaugcaaa

SEQ ID NO: 614866 - RNA, 19 nt, Homo sapiens
gagcagugcccuacaagca

SEQ ID NO: 614867 - RNA, 19 nt, Homo sapiens
gagaauaaugccaaugcaa

SEQ ID NO: 614868 - RNA, 19 nt, Homo sapiens
gccuucaacuggaucauug

SEQ ID NO: 614869 - RNA, 19 nt, Homo sapiens
cacaagauuucaacacaca

SEQ ID NO: 614870 - RNA, 19 nt, Homo sapiens
cuacgacucucccaauucu

SEQ ID NO: 614871 - RNA, 19 nt, Homo sapiens
auaugaagaugaagccaaa

SEQ ID NO: 614872 - RNA, 19 nt, Homo sapiens
ucgcaaggcuguguacuuc

SEQ ID NO: 614873 - RNA, 19 nt, Homo sapiens
ccugaugaaccaauugaua

SEQ ID NO: 614874 - RNA, 19 nt, Homo sapiens
caaagccuccggugaaauc

SEQ ID NO: 614875 - RNA, 19 nt, Homo sapiens
ucaacacacagaugacuaa

SEQ ID NO: 614876 - RNA, 19 nt, Homo sapiens
uacaaugaccacaaaguuu

SEQ ID NO: 614877 - RNA, 19 nt, Homo sapiens
cauuacauuugccauauca

SEQ ID NO: 614878 - RNA, 19 nt, Homo sapiens
uugaacaggugaugaagga

SEQ ID NO: 614879 - RNA, 19 nt, Homo sapiens
gccuuuagauccaacacaa

SEQ ID NO: 614880 - RNA, 19 nt, Homo sapiens
aaacugaagccaauguaug

SEQ ID NO: 614881 - RNA, 19 nt, Homo sapiens
gacaauggagucaggauuc

SEQ ID NO: 614882 - RNA, 19 nt, Homo sapiens
ugaauugccaguaucuaaa

SEQ ID NO: 614883 - RNA, 19 nt, Homo sapiens
gucauuacauuugccauau

SEQ ID NO: 614884 - RNA, 19 nt, Homo sapiens
gaaagagcacuggauugga

SEQ ID NO: 614885 - RNA, 19 nt, Homo sapiens
gaauaauaaccuggaaaga

SEQ ID NO: 614886 - RNA, 19 nt, Homo sapiens
gcucugaucugaauaauuu

SEQ ID NO: 614887 - RNA, 19 nt, Homo sapiens
gaacaagagcuauacaaua

SEQ ID NO: 614888 - RNA, 19 nt, Homo sapiens
gcaaagccauucauucuuc

SEQ ID NO: 614889 - RNA, 19 nt, Homo sapiens
ccagaaaucacaacaaaua

SEQ ID NO: 614890 - RNA, 19 nt, Homo sapiens
ugauauguguggaaucuua

SEQ ID NO: 614891 - RNA, 19 nt, Homo sapiens
caacaucucccauaccaaa

SEQ ID NO: 614892 - RNA, 19 nt, Homo sapiens
uggacgagaugcacuguua

SEQ ID NO: 614893 - RNA, 19 nt, Homo sapiens
gguguugcuugucuuguua

SEQ ID NO: 614894 - RNA, 19 nt, Homo sapiens
ggaagacugaucuauauau

SEQ ID NO: 614895 - RNA, 19 nt, Homo sapiens
agaugaagaugaugaagaa

SEQ ID NO: 614896 - RNA, 19 nt, Homo sapiens
gagcaaagccauucauucu

SEQ ID NO: 614897 - RNA, 19 nt, Homo sapiens
caagggagauauaggaaca

SEQ ID NO: 614898 - RNA, 19 nt, Homo sapiens
caagaaaugugugacuaug

SEQ ID NO: 614899 - RNA, 19 nt, Homo sapiens
ugggaagacugaucuauau

SEQ ID NO: 614900 - RNA, 19 nt, Homo sapiens
ggaacuguauguggucaaa

SEQ ID NO: 614901 - RNA, 19 nt, Homo sapiens
uaauggaagugaugcagaa

SEQ ID NO: 614902 - RNA, 19 nt, Homo sapiens
ggaacaagagcuauacaau

SEQ ID NO: 614903 - RNA, 19 nt, Homo sapiens
gacaggguauccaacuaaa

SEQ ID NO: 614904 - RNA, 19 nt, Homo sapiens
gcaagaaaugugugacuau

SEQ ID NO: 614905 - RNA, 19 nt, Homo sapiens
ggcaagaaaugugugacua

SEQ ID NO: 614906 - RNA, 19 nt, Homo sapiens
agaugaagaugaagaugaa

SEQ ID NO: 614907 - RNA, 19 nt, Homo sapiens
uaaggacaauccacagaga

SEQ ID NO: 614908 - RNA, 19 nt, Homo sapiens
ugaagaugaugaagaagau

SEQ ID NO: 614909 - RNA, 19 nt, Homo sapiens
ggagauauaggaacaccaa

SEQ ID NO: 614910 - RNA, 19 nt, Homo sapiens
cagcagaucggaacuguau

SEQ ID NO: 614911 - RNA, 19 nt, Homo sapiens
cgacaggguauccaacuaa

SEQ ID NO: 614912 - RNA, 19 nt, Homo sapiens
gauccagaauugaagaauc

SEQ ID NO: 614913 - RNA, 19 nt, Homo sapiens
caagagcuauacaauaacu

SEQ ID NO: 614914 - RNA, 19 nt, Homo sapiens
gaacgagucccucuucacu

SEQ ID NO: 614915 - RNA, 19 nt, Homo sapiens
acgagucccucuucacuuu

SEQ ID NO: 614916 - RNA, 19 nt, Homo sapiens
uagagagggugcucagcua

SEQ ID NO: 614917 - RNA, 19 nt, Homo sapiens
cgacaaaggaaaucugaga

SEQ ID NO: 614918 - RNA, 19 nt, Homo sapiens
gcacccacuucaggaauug

SEQ ID NO: 614919 - RNA, 19 nt, Homo sapiens
gagaacgagucccucuuca

SEQ ID NO: 614920 - RNA, 19 nt, Homo sapiens
gcagugguguugcuugucu

SEQ ID NO: 614921 - RNA, 19 nt, Homo sapiens
gggaagacugaucuauaua

SEQ ID NO: 614922 - RNA, 19 nt, Homo sapiens
gugggaagacugaucuaua

SEQ ID NO: 614923 - RNA, 19 nt, Homo sapiens
ggagaacgagucccucuuc

SEQ ID NO: 614924 - RNA, 19 nt, Homo sapiens
cauuaaggaugggaaacua

SEQ ID NO: 614925 - RNA, 19 nt, Homo sapiens
ggaauugugggugcauuaa

SEQ ID NO: 614926 - RNA, 19 nt, Homo sapiens
uggcuacaguugauauaaa

SEQ ID NO: 614927 - RNA, 19 nt, Homo sapiens
caaaggaaaucugagaaaa

SEQ ID NO: 614928 - RNA, 19 nt, Homo sapiens
gcagaucggaacuguaugu

SEQ ID NO: 614929 - RNA, 19 nt, Homo sapiens
ggagcaaagccauucauuc

SEQ ID NO: 614930 - RNA, 19 nt, Homo sapiens
caaagccauucauucuuca

SEQ ID NO: 614931 - RNA, 19 nt, Homo sapiens
agaaaugugugacuauguc

SEQ ID NO: 614932 - RNA, 19 nt, Homo sapiens
agaugaagaugaagaugau

SEQ ID NO: 614933 - RNA, 19 nt, Homo sapiens
cagaugaagaugaagauga

SEQ ID NO: 614934 - RNA, 19 nt, Homo sapiens
gaccaucagguuccaacua

SEQ ID NO: 614935 - RNA, 19 nt, Homo sapiens
ucaacaacaucucccauac

SEQ ID NO: 614936 - RNA, 19 nt, Homo sapiens
gaagugcagugguguugcu

SEQ ID NO: 614937 - RNA, 19 nt, Homo sapiens
ucacuuuccucggcaagaa

SEQ ID NO: 614938 - RNA, 19 nt, Homo sapiens
aggcacaacuuaaagaaag

SEQ ID NO: 614939 - RNA, 19 nt, Homo sapiens
aauacaggcucugaucuga

SEQ ID NO: 614940 - RNA, 19 nt, Homo sapiens
ccaaauacaggcucugauc

SEQ ID NO: 614941 - RNA, 19 nt, Homo sapiens
gagagggugcucagcuaaa

SEQ ID NO: 614942 - RNA, 19 nt, Homo sapiens
uacaggcucugaucugaau

SEQ ID NO: 614943 - RNA, 19 nt, Homo sapiens
cccaaaugguccuaaucua

SEQ ID NO: 614944 - RNA, 19 nt, Homo sapiens
acaaaggaaaucugagaaa

SEQ ID NO: 614945 - RNA, 19 nt, Homo sapiens
auccagaaaucacaacaaa

SEQ ID NO: 614946 - RNA, 19 nt, Homo sapiens
ccaaaugguccuaaucuac

SEQ ID NO: 614947 - RNA, 19 nt, Homo sapiens
uugcuugucuuguuaagga

SEQ ID NO: 614948 - RNA, 19 nt, Homo sapiens
ugaagaagauuuugaggau

SEQ ID NO: 614949 - RNA, 19 nt, Homo sapiens
gccauucauucuucagaug

SEQ ID NO: 614950 - RNA, 19 nt, Homo sapiens
ggcacaacuuaaagaaaga

SEQ ID NO: 614951 - RNA, 19 nt, Homo sapiens
gaggcacaacuuaaagaaa

SEQ ID NO: 614952 - RNA, 19 nt, Homo sapiens
gauauaggaacaccaagca

SEQ ID NO: 614953 - RNA, 19 nt, Homo sapiens
gucaacaacaucucccaua

SEQ ID NO: 614954 - RNA, 19 nt, Homo sapiens
gacaaaggaaaucugagaa

SEQ ID NO: 614955 - RNA, 19 nt, Homo sapiens
gucaaguugcucuuaauuu

SEQ ID NO: 614956 - RNA, 19 nt, Homo sapiens
aauugugggugcauuaaug

SEQ ID NO: 614957 - RNA, 19 nt, Homo sapiens
gggaacaagagcuauacaa

SEQ ID NO: 614958 - RNA, 19 nt, Homo sapiens
ccaaugaagaagaagcaaa

SEQ ID NO: 614959 - RNA, 19 nt, Homo sapiens
gaagaugaugaagaagauu

SEQ ID NO: 614960 - RNA, 19 nt, Homo sapiens
gaagaugaagaugaagaug

SEQ ID NO: 614961 - RNA, 19 nt, Homo sapiens
gugcagugguguugcuugu

SEQ ID NO: 614962 - RNA, 19 nt, Homo sapiens
gaggauauuuucauaccuu

SEQ ID NO: 614963 - RNA, 19 nt, Homo sapiens
caagcaauuuccagcacau

SEQ ID NO: 614964 - RNA, 19 nt, Homo sapiens
ccuagaggauauuuucaua

SEQ ID NO: 614965 - RNA, 19 nt, Homo sapiens
cuucagcaguggugcaguu

SEQ ID NO: 614966 - RNA, 19 nt, Homo sapiens
aagaugaagaugaagauga

SEQ ID NO: 614967 - RNA, 19 nt, Homo sapiens
gaauugugggugcauuaau

SEQ ID NO: 614968 - RNA, 19 nt, Homo sapiens
gacgagaugcacuguuaga

SEQ ID NO: 614969 - RNA, 19 nt, Homo sapiens
uaggaacaccaagcaauuu

SEQ ID NO: 614970 - RNA, 19 nt, Homo sapiens
gagauuaaccaagggagau

SEQ ID NO: 614971 - RNA, 19 nt, Homo sapiens
guccacaagucaacaacau

SEQ ID NO: 614972 - RNA, 19 nt, Homo sapiens
gaaaaggagcaaagccauu

SEQ ID NO: 614973 - RNA, 19 nt, Homo sapiens
cuuagaggcacaacuuaaa

SEQ ID NO: 614974 - RNA, 19 nt, Homo sapiens
gaauaauuuggauccagaa

SEQ ID NO: 614975 - RNA, 19 nt, Homo sapiens
gaacaccaagcaauuucca

SEQ ID NO: 614976 - RNA, 19 nt, Homo sapiens
gagcuauacaauaacuuug

SEQ ID NO: 614977 - RNA, 19 nt, Homo sapiens
aaucuuagaggcacaacuu

SEQ ID NO: 614978 - RNA, 19 nt, Homo sapiens
aacaacaucucccauacca

SEQ ID NO: 614979 - RNA, 19 nt, Homo sapiens
aagaagauuuugaggauga

SEQ ID NO: 614980 - RNA, 19 nt, Homo sapiens
ggaaacuauugugggaaca

SEQ ID NO: 614981 - RNA, 19 nt, Homo sapiens
uuaaggaugggaaacuauu

SEQ ID NO: 614982 - RNA, 19 nt, Homo sapiens
gaugaugagugggaagacu

SEQ ID NO: 614983 - RNA, 19 nt, Homo sapiens
aacuguauguggucaaaga

SEQ ID NO: 614984 - RNA, 19 nt, Homo sapiens
cgagauguggcgccucuga

SEQ ID NO: 614985 - RNA, 19 nt, Homo sapiens
caaauacaggcucugaucu

SEQ ID NO: 614986 - RNA, 19 nt, Homo sapiens
ccacagagcugcugaagaa

SEQ ID NO: 614987 - RNA, 19 nt, Homo sapiens
agaaggaaauggagaaaua

SEQ ID NO: 614988 - RNA, 19 nt, Homo sapiens
gacauggccuucuguaaga

SEQ ID NO: 614989 - RNA, 19 nt, Homo sapiens
gggagaaacucagccuuaa

SEQ ID NO: 614990 - RNA, 19 nt, Homo sapiens
ggaacagccuacuccguuu

SEQ ID NO: 614991 - RNA, 19 nt, Homo sapiens
gccuuaaucuggaucauaa

SEQ ID NO: 614992 - RNA, 19 nt, Homo sapiens
gaauaaaggacaguuugua

SEQ ID NO: 614993 - RNA, 19 nt, Homo sapiens
acaagggccuggacuauga

SEQ ID NO: 614994 - RNA, 19 nt, Homo sapiens
uguaagagcuuucgagaca

SEQ ID NO: 614995 - RNA, 19 nt, Homo sapiens
ggaaguacaaggaugauga

SEQ ID NO: 614996 - RNA, 19 nt, Homo sapiens
ggacauggccuucuguaag

SEQ ID NO: 614997 - RNA, 19 nt, Homo sapiens
acaacgaggucuuccauga

SEQ ID NO: 614998 - RNA, 19 nt, Homo sapiens
uggcagagauggagcacua

SEQ ID NO: 614999 - RNA, 19 nt, Homo sapiens
ucaacuaccugggaaacua

SEQ ID NO: 615000 - RNA, 19 nt, Homo sapiens
gcaaucagcaugaauuugg

SEQ ID NO: 615001 - RNA, 19 nt, Homo sapiens
cagagaagcugcuggugau

SEQ ID NO: 615002 - RNA, 19 nt, Homo sapiens
gagcaaucagcaugaauuu

SEQ ID NO: 615003 - RNA, 19 nt, Homo sapiens
ucauaagucucggaucuuu

SEQ ID NO: 615004 - RNA, 19 nt, Homo sapiens
cagaacaaaugugugauga

SEQ ID NO: 615005 - RNA, 19 nt, Homo sapiens
caacggggcuuuagaugaa

SEQ ID NO: 615006 - RNA, 19 nt, Homo sapiens
gagaaacucagccuuaauc

SEQ ID NO: 615007 - RNA, 19 nt, Homo sapiens
gaacugaauaugucaccuu

SEQ ID NO: 615008 - RNA, 19 nt, Homo sapiens
ugauguggcucgaacaguu

SEQ ID NO: 615009 - RNA, 19 nt, Homo sapiens
cagagcugcugaagaaguu

SEQ ID NO: 615010 - RNA, 19 nt, Homo sapiens
cagaagguccggugguuaa

SEQ ID NO: 615011 - RNA, 19 nt, Homo sapiens
gacagaagguccggugguu

SEQ ID NO: 615012 - RNA, 19 nt, Homo sapiens
ccacugcugucagaacaaa

SEQ ID NO: 615013 - RNA, 19 nt, Homo sapiens
ggaaggagcaguacaucca

SEQ ID NO: 615014 - RNA, 19 nt, Homo sapiens
ggauagcuacgacgugauu

SEQ ID NO: 615015 - RNA, 19 nt, Homo sapiens
uaaagaaggaaauggagaa

SEQ ID NO: 615016 - RNA, 19 nt, Homo sapiens
ggcuuuagaugaagugguu

SEQ ID NO: 615017 - RNA, 19 nt, Homo sapiens
cacgagggcuuccacaugu

SEQ ID NO: 615018 - RNA, 19 nt, Homo sapiens
gcagucucacucugaauaa

SEQ ID NO: 615019 - RNA, 19 nt, Homo sapiens
caacgaggucuuccaugaa

SEQ ID NO: 615020 - RNA, 19 nt, Homo sapiens
ccucaauucugguggauuc

SEQ ID NO: 615021 - RNA, 19 nt, Homo sapiens
gcccugccauugugccuuu

SEQ ID NO: 615022 - RNA, 19 nt, Homo sapiens
gcccggacguguacugguu

SEQ ID NO: 615023 - RNA, 19 nt, Homo sapiens
gggcggugaugaacuuugu

SEQ ID NO: 615024 - RNA, 19 nt, Homo sapiens
gcacaacaacgaggucuuc

SEQ ID NO: 615025 - RNA, 19 nt, Homo sapiens
gaaacuacguccccaaugg

SEQ ID NO: 615026 - RNA, 19 nt, Homo sapiens
uaagagcuuucgagacaag

SEQ ID NO: 615027 - RNA, 19 nt, Homo sapiens
gaagugguuuuaaaguuug

SEQ ID NO: 615028 - RNA, 19 nt, Homo sapiens
ggagaaacucagccuuaau

SEQ ID NO: 615029 - RNA, 19 nt, Homo sapiens
gaagaaguucguccagagu

SEQ ID NO: 615030 - RNA, 19 nt, Homo sapiens
gaacagccuacuccguuuc

SEQ ID NO: 615031 - RNA, 19 nt, Homo sapiens
ccgcgugccugaacugaau

SEQ ID NO: 615032 - RNA, 19 nt, Homo sapiens
gaccacuucucagcuguga

SEQ ID NO: 615033 - RNA, 19 nt, Homo sapiens
gaaacggucccacuaagcu

SEQ ID NO: 615034 - RNA, 19 nt, Homo sapiens
gaaacucagccuuaaucug

SEQ ID NO: 615035 - RNA, 19 nt, Homo sapiens
ccaccaccauccaccaaau

SEQ ID NO: 615036 - RNA, 19 nt, Homo sapiens
gagugugaguucuacuuca

SEQ ID NO: 615037 - RNA, 19 nt, Homo sapiens
ccacaagggccuggacuau

SEQ ID NO: 615038 - RNA, 19 nt, Homo sapiens
ggugaugaacuuugugguu

SEQ ID NO: 615039 - RNA, 19 nt, Homo sapiens
caacaacgaggucuuccau

SEQ ID NO: 615040 - RNA, 19 nt, Homo sapiens
caaccacucugccaaaccu

SEQ ID NO: 615041 - RNA, 19 nt, Homo sapiens
gggcacacgcuacaucaug

SEQ ID NO: 615042 - RNA, 19 nt, Homo sapiens
ugucagaacaaauguguga

SEQ ID NO: 615043 - RNA, 19 nt, Homo sapiens
ugagcaaucagcaugaauu

SEQ ID NO: 615044 - RNA, 19 nt, Homo sapiens
gcuggaggcuacgagaaug

SEQ ID NO: 615045 - RNA, 19 nt, Homo sapiens
uaaucuggaucauaagucu

SEQ ID NO: 615046 - RNA, 19 nt, Homo sapiens
guaagagcuuucgagacaa

SEQ ID NO: 615047 - RNA, 19 nt, Homo sapiens
gacccugcguauccucauu

SEQ ID NO: 615048 - RNA, 19 nt, Homo sapiens
agggagaaacucagccuua

SEQ ID NO: 615049 - RNA, 19 nt, Homo sapiens
gguuaaagaaggaaaugga

SEQ ID NO: 615050 - RNA, 19 nt, Homo sapiens
cauggaaacggucccacua

SEQ ID NO: 615051 - RNA, 19 nt, Homo sapiens
gaaggaaauggagaaauac

SEQ ID NO: 615052 - RNA, 19 nt, Homo sapiens
gagaagcugcuggugauca

SEQ ID NO: 615053 - RNA, 19 nt, Homo sapiens
gcgaguggguguguggaau

SEQ ID NO: 615054 - RNA, 19 nt, Homo sapiens
ugccugaacugaauauguc

SEQ ID NO: 615055 - RNA, 19 nt, Homo sapiens
aagguccggugguuaaaga

SEQ ID NO: 615056 - RNA, 19 nt, Homo sapiens
gagggaggcuguggcuucu

SEQ ID NO: 615057 - RNA, 19 nt, Homo sapiens
ccaagacacggcccucuca

SEQ ID NO: 615058 - RNA, 19 nt, Homo sapiens
gcgcuacgacugugugauc

SEQ ID NO: 615059 - RNA, 19 nt, Homo sapiens
gccggcaucuggagcuuuc

SEQ ID NO: 615060 - RNA, 19 nt, Homo sapiens
gauguggcucgaacaguug

SEQ ID NO: 615061 - RNA, 19 nt, Homo sapiens
ccaaaccugcccugccauu

SEQ ID NO: 615062 - RNA, 19 nt, Homo sapiens
gcaucuggagcuuucugua

SEQ ID NO: 615063 - RNA, 19 nt, Homo sapiens
gaguggguguguggaaugu

SEQ ID NO: 615064 - RNA, 19 nt, Homo sapiens
caauucugguggauucauc

SEQ ID NO: 615065 - RNA, 19 nt, Homo sapiens
ucauguuuguggauagcua

SEQ ID NO: 615066 - RNA, 19 nt, Homo sapiens
gaucaucauguuuguggau

SEQ ID NO: 615067 - RNA, 19 nt, Homo sapiens
cgcagucucacucugaaua

SEQ ID NO: 615068 - RNA, 19 nt, Homo sapiens
uggaaacggucccacuaag

SEQ ID NO: 615069 - RNA, 19 nt, Homo sapiens
agucucggaucuuucagaa

SEQ ID NO: 615070 - RNA, 19 nt, Homo sapiens
ugaauaaaggacaguuugu

SEQ ID NO: 615071 - RNA, 19 nt, Homo sapiens
cagucucacucugaauaaa

SEQ ID NO: 615072 - RNA, 19 nt, Homo sapiens
ucagaacaaaugugugaug

SEQ ID NO: 615073 - RNA, 19 nt, Homo sapiens
ugacacagacccggacaug

SEQ ID NO: 615074 - RNA, 19 nt, Homo sapiens
gugauacccugcggaugga

SEQ ID NO: 615075 - RNA, 19 nt, Homo sapiens
ggaaacggucccacuaagc

SEQ ID NO: 615076 - RNA, 19 nt, Homo sapiens
aaaccugcccugccauugu

SEQ ID NO: 615077 - RNA, 19 nt, Homo sapiens
gcugucagaacaaaugugu

SEQ ID NO: 615078 - RNA, 19 nt, Homo sapiens
agcaguacauccacgagaa

SEQ ID NO: 615079 - RNA, 19 nt, Homo sapiens
ggccuucuguaagagcuuu

SEQ ID NO: 615080 - RNA, 19 nt, Homo sapiens
ggcaagcugugguccaacu

SEQ ID NO: 615081 - RNA, 19 nt, Homo sapiens
ucauugaggagaacaggaa

SEQ ID NO: 615082 - RNA, 19 nt, Homo sapiens
gcuccaggaccacuucuca

SEQ ID NO: 615083 - RNA, 19 nt, Homo sapiens
gacacggcccucucaggaa

SEQ ID NO: 615084 - RNA, 19 nt, Homo sapiens
caccuucacccucaacguu

SEQ ID NO: 615085 - RNA, 19 nt, Homo sapiens
acagaagguccggugguua

SEQ ID NO: 615086 - RNA, 19 nt, Homo sapiens
agacagagcagaaguauuu

SEQ ID NO: 615087 - RNA, 19 nt, Homo sapiens
gaaaucauccguagcaaga

SEQ ID NO: 615088 - RNA, 19 nt, Homo sapiens
gcaauuacguccaccaaag

SEQ ID NO: 615089 - RNA, 19 nt, Homo sapiens
gagcggaccuucuccuucu

SEQ ID NO: 615090 - RNA, 19 nt, Homo sapiens
gcauuucugccucacuuua

SEQ ID NO: 615091 - RNA, 19 nt, Homo sapiens
gggacccucugaagcauuu

SEQ ID NO: 615092 - RNA, 19 nt, Homo sapiens
gcacaagcucggcaucauu

SEQ ID NO: 615093 - RNA, 19 nt, Homo sapiens
gcugugccuuugacuuuaa

SEQ ID NO: 615094 - RNA, 19 nt, Homo sapiens
uggacugucugugcaauua

SEQ ID NO: 615095 - RNA, 19 nt, Homo sapiens
ggacugcuccaacaggaaa

SEQ ID NO: 615096 - RNA, 19 nt, Homo sapiens
gcuggagccugucuacuca

SEQ ID NO: 615097 - RNA, 19 nt, Homo sapiens
ccucaacugucacuuuaug

SEQ ID NO: 615098 - RNA, 19 nt, Homo sapiens
ggaguucgcagucaagauc

SEQ ID NO: 615099 - RNA, 19 nt, Homo sapiens
gaacacgcagcgcgaagug

SEQ ID NO: 615100 - RNA, 19 nt, Homo sapiens
gaugaccgaugggcuggaa

SEQ ID NO: 615101 - RNA, 19 nt, Homo sapiens
cacaagcucggcaucauuu

SEQ ID NO: 615102 - RNA, 19 nt, Homo sapiens
acgaccagcugcacacgua

SEQ ID NO: 615103 - RNA, 19 nt, Homo sapiens
ggacuccgagggccacauu

SEQ ID NO: 615104 - RNA, 19 nt, Homo sapiens
ggcugugccuuugacuuua

SEQ ID NO: 615105 - RNA, 19 nt, Homo sapiens
gggaagcuguacgccauga

SEQ ID NO: 615106 - RNA, 19 nt, Homo sapiens
gcaggacucgcccuucuuc

SEQ ID NO: 615107 - RNA, 19 nt, Homo sapiens
caauuacguccaccaaaga

SEQ ID NO: 615108 - RNA, 19 nt, Homo sapiens
caacuuugcggaggaauuc

SEQ ID NO: 615109 - RNA, 19 nt, Homo sapiens
aagcauuucugccucacuu

SEQ ID NO: 615110 - RNA, 19 nt, Homo sapiens
ugaagagcguggagaaugc

SEQ ID NO: 615111 - RNA, 19 nt, Homo sapiens
cggccgagaucaugugcaa

SEQ ID NO: 615112 - RNA, 19 nt, Homo sapiens
ggacgaggacgacgaugag

SEQ ID NO: 615113 - RNA, 19 nt, Homo sapiens
ccaggacacugccucuucu

SEQ ID NO: 615114 - RNA, 19 nt, Homo sapiens
gccaggaguucgcagucaa

SEQ ID NO: 615115 - RNA, 19 nt, Homo sapiens
gggacgaggacgacgauga

SEQ ID NO: 615116 - RNA, 19 nt, Homo sapiens
cacccuccauucucuuuga

SEQ ID NO: 615117 - RNA, 19 nt, Homo sapiens
gggagggcuucuuccugaa

SEQ ID NO: 615118 - RNA, 19 nt, Homo sapiens
ccggaaccaucccuucuuc

SEQ ID NO: 615119 - RNA, 19 nt, Homo sapiens
gauguucacccaccucuac

SEQ ID NO: 615120 - RNA, 19 nt, Homo sapiens
ugucuuaccagauagaguu

SEQ ID NO: 615121 - RNA, 19 nt, Homo sapiens
uuucagggauacuccuuug

SEQ ID NO: 615122 - RNA, 19 nt, Homo sapiens
ccaccaaagacccguguug

SEQ ID NO: 615123 - RNA, 19 nt, Homo sapiens
gaagcuguacgccaugaag

SEQ ID NO: 615124 - RNA, 19 nt, Homo sapiens
gaccugaaacuggagaaug

SEQ ID NO: 615125 - RNA, 19 nt, Homo sapiens
uggaacaccugcacaagcu

SEQ ID NO: 615126 - RNA, 19 nt, Homo sapiens
cacuuuaugucaucugcuu

SEQ ID NO: 615127 - RNA, 19 nt, Homo sapiens
ccagacagagcagaaguau

SEQ ID NO: 615128 - RNA, 19 nt, Homo sapiens
ccaccuucauggcauucaa

SEQ ID NO: 615129 - RNA, 19 nt, Homo sapiens
ucucaacgccaccuucaug

SEQ ID NO: 615130 - RNA, 19 nt, Homo sapiens
gggcgucauucuguacaug

SEQ ID NO: 615131 - RNA, 19 nt, Homo sapiens
ggccaggaguucgcaguca

SEQ ID NO: 615132 - RNA, 19 nt, Homo sapiens
ccccucaacugucacuuua

SEQ ID NO: 615133 - RNA, 19 nt, Homo sapiens
gagcugcggaucacagaag

SEQ ID NO: 615134 - RNA, 19 nt, Homo sapiens
ccacaacaacgcggugaug

SEQ ID NO: 615135 - RNA, 19 nt, Homo sapiens
ucagggauacuccuuugug

SEQ ID NO: 615136 - RNA, 19 nt, Homo sapiens
gguggagccugggcaucuu

SEQ ID NO: 615137 - RNA, 19 nt, Homo sapiens
aggcugaggugcgcgugua

SEQ ID NO: 615138 - RNA, 19 nt, Homo sapiens
agugcuaacuccuaaacug

SEQ ID NO: 615139 - RNA, 19 nt, Homo sapiens
accugaaacuggagaaugu

SEQ ID NO: 615140 - RNA, 19 nt, Homo sapiens
ugaccgggcacgaggagaa

SEQ ID NO: 615141 - RNA, 19 nt, Homo sapiens
ucacgcugcacuacgcuuu

SEQ ID NO: 615142 - RNA, 19 nt, Homo sapiens
ggucucaacgccaccuuca

SEQ ID NO: 615143 - RNA, 19 nt, Homo sapiens
gccugggcgucauucugua

SEQ ID NO: 615144 - RNA, 19 nt, Homo sapiens
ggccaggagcgcuaugaug

SEQ ID NO: 615145 - RNA, 19 nt, Homo sapiens
ucaacugucacuuuaugga

SEQ ID NO: 615146 - RNA, 19 nt, Homo sapiens
gggcaccccucaacuguca

SEQ ID NO: 615147 - RNA, 19 nt, Homo sapiens
cagggcagcuuuucugugu

SEQ ID NO: 615148 - RNA, 19 nt, Homo sapiens
cacaagaaguccggaacca

SEQ ID NO: 615149 - RNA, 19 nt, Homo sapiens
cugaagagcguggagaaug

SEQ ID NO: 615150 - RNA, 19 nt, Homo sapiens
uggagcacauccgcaagaa

SEQ ID NO: 615151 - RNA, 19 nt, Homo sapiens
gagccuacggcaagguguu

SEQ ID NO: 615152 - RNA, 19 nt, Homo sapiens
gaagagcguggagaaugca

SEQ ID NO: 615153 - RNA, 19 nt, Homo sapiens
acaagcucggcaucauuua

SEQ ID NO: 615154 - RNA, 19 nt, Homo sapiens
gaacagagcuaaagaagaa

SEQ ID NO: 615155 - RNA, 19 nt, Homo sapiens
aaacauagcugacuuccua

SEQ ID NO: 615156 - RNA, 19 nt, Homo sapiens
gaaaugagccucucugauu

SEQ ID NO: 615157 - RNA, 19 nt, Homo sapiens
ggacagugguacagaaaua

SEQ ID NO: 615158 - RNA, 19 nt, Homo sapiens
gacaagagauaucugcuaa

SEQ ID NO: 615159 - RNA, 19 nt, Homo sapiens
guacagaaauacaucuuug

SEQ ID NO: 615160 - RNA, 19 nt, Homo sapiens
gcugauccauuauuacuuu

SEQ ID NO: 615161 - RNA, 19 nt, Homo sapiens
gaaaauaucuggucuggau

SEQ ID NO: 615162 - RNA, 19 nt, Homo sapiens
ugucuaaugugcagaaaua

SEQ ID NO: 615163 - RNA, 19 nt, Homo sapiens
ggaagucugugacaauuca

SEQ ID NO: 615164 - RNA, 19 nt, Homo sapiens
gcaaguacgucuuugucuu

SEQ ID NO: 615165 - RNA, 19 nt, Homo sapiens
gaaacaaagggccuaauga

SEQ ID NO: 615166 - RNA, 19 nt, Homo sapiens
gacuugugcugauccauua

SEQ ID NO: 615167 - RNA, 19 nt, Homo sapiens
ucuuaaggcuccaguguua

SEQ ID NO: 615168 - RNA, 19 nt, Homo sapiens
caaguacgucuuugucuua

SEQ ID NO: 615169 - RNA, 19 nt, Homo sapiens
uggcuaagcuucaggugua

SEQ ID NO: 615170 - RNA, 19 nt, Homo sapiens
ggaagaggcugagguugug

SEQ ID NO: 615171 - RNA, 19 nt, Homo sapiens
uggagaagcuguagaacaa

SEQ ID NO: 615172 - RNA, 19 nt, Homo sapiens
caucuuugcucugagaaua

SEQ ID NO: 615173 - RNA, 19 nt, Homo sapiens
guacgucuuugucuuaaug

SEQ ID NO: 615174 - RNA, 19 nt, Homo sapiens
gccuuuaggugaucuuuaa

SEQ ID NO: 615175 - RNA, 19 nt, Homo sapiens
gauaaugcuuccagugaau

SEQ ID NO: 615176 - RNA, 19 nt, Homo sapiens
gagaagcuguagaacaaug

SEQ ID NO: 615177 - RNA, 19 nt, Homo sapiens
caagagauaucugcuaaag

SEQ ID NO: 615178 - RNA, 19 nt, Homo sapiens
guauauauaugcacacaca

SEQ ID NO: 615179 - RNA, 19 nt, Homo sapiens
gaagaaugcagcaauagau

SEQ ID NO: 615180 - RNA, 19 nt, Homo sapiens
gaaaugaaagccuugaauc

SEQ ID NO: 615181 - RNA, 19 nt, Homo sapiens
gaccaucucucucccacuu

SEQ ID NO: 615182 - RNA, 19 nt, Homo sapiens
ugucuacugugcagaaaua

SEQ ID NO: 615183 - RNA, 19 nt, Homo sapiens
agcaauagauuccuagaaa

SEQ ID NO: 615184 - RNA, 19 nt, Homo sapiens
gauggguucuggucucauu

SEQ ID NO: 615185 - RNA, 19 nt, Homo sapiens
ggacaagagauaucugcua

SEQ ID NO: 615186 - RNA, 19 nt, Homo sapiens
ugauucaguuugcaaagua

SEQ ID NO: 615187 - RNA, 19 nt, Homo sapiens
gaaacuggccaugaggaua

SEQ ID NO: 615188 - RNA, 19 nt, Homo sapiens
gagaaccaaucaucaugga

SEQ ID NO: 615189 - RNA, 19 nt, Homo sapiens
acaaagggccuaaugagaa

SEQ ID NO: 615190 - RNA, 19 nt, Homo sapiens
ggaaguuuguguugguaga

SEQ ID NO: 615191 - RNA, 19 nt, Homo sapiens
guucuggucucauuccauu

SEQ ID NO: 615192 - RNA, 19 nt, Homo sapiens
aaauacaucuuugcucuga

SEQ ID NO: 615193 - RNA, 19 nt, Homo sapiens
ggaagaaugcagcaauaga

SEQ ID NO: 615194 - RNA, 19 nt, Homo sapiens
ggacauuugauuucuaaga

SEQ ID NO: 615195 - RNA, 19 nt, Homo sapiens
gcuccaguguuaaaccuaa

SEQ ID NO: 615196 - RNA, 19 nt, Homo sapiens
ugagugagguggccugaau

SEQ ID NO: 615197 - RNA, 19 nt, Homo sapiens
ggaacacacugaauaaaau

SEQ ID NO: 615198 - RNA, 19 nt, Homo sapiens
cuaaagcagcuacauguuu

SEQ ID NO: 615199 - RNA, 19 nt, Homo sapiens
ggacugagcccuggaccuu

SEQ ID NO: 615200 - RNA, 19 nt, Homo sapiens
gugcagaaauauauaugug

SEQ ID NO: 615201 - RNA, 19 nt, Homo sapiens
uaaagcagcuacauguuuu

SEQ ID NO: 615202 - RNA, 19 nt, Homo sapiens
guucuaagacugccuaaug

SEQ ID NO: 615203 - RNA, 19 nt, Homo sapiens
caaagaccuugguaaacug

SEQ ID NO: 615204 - RNA, 19 nt, Homo sapiens
gcaaaguaauggagaagcu

SEQ ID NO: 615205 - RNA, 19 nt, Homo sapiens
aaacuggccaugaggauaa

SEQ ID NO: 615206 - RNA, 19 nt, Homo sapiens
gcaauagauuccuagaaac

SEQ ID NO: 615207 - RNA, 19 nt, Homo sapiens
ugggaagaaugcagcaaua

SEQ ID NO: 615208 - RNA, 19 nt, Homo sapiens
uaagacugccuaaugcuuu

SEQ ID NO: 615209 - RNA, 19 nt, Homo sapiens
acgaaacugugauuagaaa

SEQ ID NO: 615210 - RNA, 19 nt, Homo sapiens
caagaacagagcuaaagaa

SEQ ID NO: 615211 - RNA, 19 nt, Homo sapiens
caaagggccuaaugagaac

SEQ ID NO: 615212 - RNA, 19 nt, Homo sapiens
auacgaaacugugauuaga

SEQ ID NO: 615213 - RNA, 19 nt, Homo sapiens
aaaauaagccucacucaaa

SEQ ID NO: 615214 - RNA, 19 nt, Homo sapiens
cagauaaugcuuccaguga

SEQ ID NO: 615215 - RNA, 19 nt, Homo sapiens
gcacacacacacagauaau

SEQ ID NO: 615216 - RNA, 19 nt, Homo sapiens
ggaaaggguagcagugaug

SEQ ID NO: 615217 - RNA, 19 nt, Homo sapiens
gcagugugacuccaaauuc

SEQ ID NO: 615218 - RNA, 19 nt, Homo sapiens
gauucaguuugcaaaguaa

SEQ ID NO: 615219 - RNA, 19 nt, Homo sapiens
gaugugauuaguaaggaua

SEQ ID NO: 615220 - RNA, 19 nt, Homo sapiens
guguguauguguguauaua

SEQ ID NO: 615221 - RNA, 19 nt, Homo sapiens
gugcagaaauauauauguc

SEQ ID NO: 615222 - RNA, 19 nt, Homo sapiens
gagccucucugauuugaac

SEQ ID NO: 615223 - RNA, 19 nt, Homo sapiens
ccucuucccucuccuuuca

SEQ ID NO: 615224 - RNA, 19 nt, Homo sapiens
gucuggaugugauuaguaa

SEQ ID NO: 615225 - RNA, 19 nt, Homo sapiens
gauacgaaacugugauuag

SEQ ID NO: 615226 - RNA, 19 nt, Homo sapiens
ggagauggaacacuuacau

SEQ ID NO: 615227 - RNA, 19 nt, Homo sapiens
cuacugugcagaaauauau

SEQ ID NO: 615228 - RNA, 19 nt, Homo sapiens
uaauggagaagcuguagaa

SEQ ID NO: 615229 - RNA, 19 nt, Homo sapiens
ggaguggaaguuuguguug

SEQ ID NO: 615230 - RNA, 19 nt, Homo sapiens
guaaggauacaagauaaug

SEQ ID NO: 615231 - RNA, 19 nt, Homo sapiens
ggagugacuuggcuaagcu

SEQ ID NO: 615232 - RNA, 19 nt, Homo sapiens
gcacugauugacagacuug

SEQ ID NO: 615233 - RNA, 19 nt, Homo sapiens
aagaagcacuuugguggaa

SEQ ID NO: 615234 - RNA, 19 nt, Homo sapiens
gggaauggacaauggaaga

SEQ ID NO: 615235 - RNA, 19 nt, Homo sapiens
aaauaagccucacucaaac

SEQ ID NO: 615236 - RNA, 19 nt, Homo sapiens
agauaaugcuuccagugaa

SEQ ID NO: 615237 - RNA, 19 nt, Homo sapiens
gacauuugauuucuaagac

SEQ ID NO: 615238 - RNA, 19 nt, Homo sapiens
cagugugacuccaaauuca

SEQ ID NO: 615239 - RNA, 19 nt, Homo sapiens
ccaugaggauaaagugguu

SEQ ID NO: 615240 - RNA, 19 nt, Homo sapiens
ccagguccauuaugucaca

SEQ ID NO: 615241 - RNA, 19 nt, Homo sapiens
ggaauggacaauggaagaa

SEQ ID NO: 615242 - RNA, 19 nt, Homo sapiens
cuacagcaaucguuuccau

SEQ ID NO: 615243 - RNA, 19 nt, Homo sapiens
guagaacaauguggaagag

SEQ ID NO: 615244 - RNA, 19 nt, Homo sapiens
ccuagaaacuggccaugag

SEQ ID NO: 615245 - RNA, 19 nt, Homo sapiens
acaucccacuccacuauaa

SEQ ID NO: 615246 - RNA, 19 nt, Homo sapiens
gcaaccugcucaagaacag

SEQ ID NO: 615247 - RNA, 19 nt, Homo sapiens
auacaucuuugcucugaga

SEQ ID NO: 615248 - RNA, 19 nt, Homo sapiens
caugggagcaucuguagga

SEQ ID NO: 615249 - RNA, 19 nt, Homo sapiens
auacagugguggaguggaa

SEQ ID NO: 615250 - RNA, 19 nt, Homo sapiens
gguacagaaauacaucuuu

SEQ ID NO: 615251 - RNA, 19 nt, Homo sapiens
cuuagaggacugugaagua

SEQ ID NO: 615252 - RNA, 19 nt, Homo sapiens
aaacaaagggccuaaugag

SEQ ID NO: 615253 - RNA, 19 nt, Homo sapiens
uaaggcugguguagaaaca

SEQ ID NO: 615254 - RNA, 19 nt, Homo sapiens
gaagacaucaucauucaga

SEQ ID NO: 615255 - RNA, 19 nt, Homo sapiens
gcacggcuauaaaccacua

SEQ ID NO: 615256 - RNA, 19 nt, Homo sapiens
gggacuaagugacaucgua

SEQ ID NO: 615257 - RNA, 19 nt, Homo sapiens
gaaggcaaaucccacuuuc

SEQ ID NO: 615258 - RNA, 19 nt, Homo sapiens
gcaguccucugucaugaug

SEQ ID NO: 615259 - RNA, 19 nt, Homo sapiens
gcacaacacggaaccagaa

SEQ ID NO: 615260 - RNA, 19 nt, Homo sapiens
ggaaguaaaggauccaguu

SEQ ID NO: 615261 - RNA, 19 nt, Homo sapiens
gcaaaucccacuuucagau

SEQ ID NO: 615262 - RNA, 19 nt, Homo sapiens
gaaguaaaggauccaguug

SEQ ID NO: 615263 - RNA, 19 nt, Homo sapiens
caggcuggaucaugcuuua

SEQ ID NO: 615264 - RNA, 19 nt, Homo sapiens
cuacgagaauguuuguauu

SEQ ID NO: 615265 - RNA, 19 nt, Homo sapiens
guuugaagcucgaggucua

SEQ ID NO: 615266 - RNA, 19 nt, Homo sapiens
gaauggaugagcacgguuu

SEQ ID NO: 615267 - RNA, 19 nt, Homo sapiens
gcuggaucaugcuuuauau

SEQ ID NO: 615268 - RNA, 19 nt, Homo sapiens
ggacuaagugacaucguau

SEQ ID NO: 615269 - RNA, 19 nt, Homo sapiens
gcagaaggaggcuguucaa

SEQ ID NO: 615270 - RNA, 19 nt, Homo sapiens
ggaucaugcuuuauaugca

SEQ ID NO: 615271 - RNA, 19 nt, Homo sapiens
guauuacccacauuugaaa

SEQ ID NO: 615272 - RNA, 19 nt, Homo sapiens
uaugauucaggccuaauua

SEQ ID NO: 615273 - RNA, 19 nt, Homo sapiens
caacacggaaccagaaugg

SEQ ID NO: 615274 - RNA, 19 nt, Homo sapiens
ggcuggaucaugcuuuaua

SEQ ID NO: 615275 - RNA, 19 nt, Homo sapiens
gauucaggccuaauuaagu

SEQ ID NO: 615276 - RNA, 19 nt, Homo sapiens
ccucugucaugauggaauu

SEQ ID NO: 615277 - RNA, 19 nt, Homo sapiens
guacuacgagaauguuugu

SEQ ID NO: 615278 - RNA, 19 nt, Homo sapiens
ccacugguacuacgagaau

SEQ ID NO: 615279 - RNA, 19 nt, Homo sapiens
caucguaucgguuccuguu

SEQ ID NO: 615280 - RNA, 19 nt, Homo sapiens
guuccucccugaagacauc

SEQ ID NO: 615281 - RNA, 19 nt, Homo sapiens
uguauuacccacauuugaa

SEQ ID NO: 615282 - RNA, 19 nt, Homo sapiens
caaaucccacuuucagauc

SEQ ID NO: 615283 - RNA, 19 nt, Homo sapiens
agaaggcaaaucccacuuu

SEQ ID NO: 615284 - RNA, 19 nt, Homo sapiens
cgucugggcacggcuauaa

SEQ ID NO: 615285 - RNA, 19 nt, Homo sapiens
gaagcucgaggucuagaag

SEQ ID NO: 615286 - RNA, 19 nt, Homo sapiens
uagagauuccagugcguua

SEQ ID NO: 615287 - RNA, 19 nt, Homo sapiens
auucaggccuaauuaagug

SEQ ID NO: 615288 - RNA, 19 nt, Homo sapiens
cuagcugcuucaacuggua

SEQ ID NO: 615289 - RNA, 19 nt, Homo sapiens
gguacuacgagaauguuug

SEQ ID NO: 615290 - RNA, 19 nt, Homo sapiens
ugucugcaguccucuguca

SEQ ID NO: 615291 - RNA, 19 nt, Homo sapiens
gcaggcuggaucaugcuuu

SEQ ID NO: 615292 - RNA, 19 nt, Homo sapiens
cugcaguccucugucauga

SEQ ID NO: 615293 - RNA, 19 nt, Homo sapiens
acacggaaccagaauggau

SEQ ID NO: 615294 - RNA, 19 nt, Homo sapiens
gaagcuucacccgacagua

SEQ ID NO: 615295 - RNA, 19 nt, Homo sapiens
ccugaagacaucaucauuc

SEQ ID NO: 615296 - RNA, 19 nt, Homo sapiens
gagaaggcaaaucccacuu

SEQ ID NO: 615297 - RNA, 19 nt, Homo sapiens
gaugguucagccacuggua

SEQ ID NO: 615298 - RNA, 19 nt, Homo sapiens
ucguaucgguuccuguuca

SEQ ID NO: 615299 - RNA, 19 nt, Homo sapiens
ggcaaaucccacuuucaga

SEQ ID NO: 615300 - RNA, 19 nt, Homo sapiens
gaauuuuggugguggaagu

SEQ ID NO: 615301 - RNA, 19 nt, Homo sapiens
ccaggaagaguuugaagcu

SEQ ID NO: 615302 - RNA, 19 nt, Homo sapiens
gcguuaccaggaagaguuu

SEQ ID NO: 615303 - RNA, 19 nt, Homo sapiens
ggcagaaggaggcuguuca

SEQ ID NO: 615304 - RNA, 19 nt, Homo sapiens
caguacaaacuaccagaug

SEQ ID NO: 615305 - RNA, 19 nt, Homo sapiens
caucguggaccugaggaaa

SEQ ID NO: 615306 - RNA, 19 nt, Homo sapiens
gaaggacgcucuccacuua

SEQ ID NO: 615307 - RNA, 19 nt, Homo sapiens
ucacagagcuucauuguuu

SEQ ID NO: 615308 - RNA, 19 nt, Homo sapiens
ggacaauggugcacaaaua

SEQ ID NO: 615309 - RNA, 19 nt, Homo sapiens
ucacauaccucaucauuaa

SEQ ID NO: 615310 - RNA, 19 nt, Homo sapiens
ggcaauaaauguccaauua

SEQ ID NO: 615311 - RNA, 19 nt, Homo sapiens
gcauagagcuucucaauca

SEQ ID NO: 615312 - RNA, 19 nt, Homo sapiens
gaauggacaugauaaagua

SEQ ID NO: 615313 - RNA, 19 nt, Homo sapiens
gcauauaccuuaaucuuug

SEQ ID NO: 615314 - RNA, 19 nt, Homo sapiens
gggacgauauguacuauua

SEQ ID NO: 615315 - RNA, 19 nt, Homo sapiens
ucaaagagcugguaaugga

SEQ ID NO: 615316 - RNA, 19 nt, Homo sapiens
ggacuuugaugagauauaa

SEQ ID NO: 615317 - RNA, 19 nt, Homo sapiens
gaagcagaaugauugauuu

SEQ ID NO: 615318 - RNA, 19 nt, Homo sapiens
ggaagaagcagaaugauug

SEQ ID NO: 615319 - RNA, 19 nt, Homo sapiens
guagacaguugcacauuaa

SEQ ID NO: 615320 - RNA, 19 nt, Homo sapiens
ggaugaaugucuuaagauu

SEQ ID NO: 615321 - RNA, 19 nt, Homo sapiens
gcacagaucgcuuggauga

SEQ ID NO: 615322 - RNA, 19 nt, Homo sapiens
gcagauauguucaaauugg

SEQ ID NO: 615323 - RNA, 19 nt, Homo sapiens
caggagauauucacuguaa

SEQ ID NO: 615324 - RNA, 19 nt, Homo sapiens
ccagaaacaugcaucauug

SEQ ID NO: 615325 - RNA, 19 nt, Homo sapiens
gcaaagaauggacaugaua

SEQ ID NO: 615326 - RNA, 19 nt, Homo sapiens
acagcaaccuuauggauua

SEQ ID NO: 615327 - RNA, 19 nt, Homo sapiens
gcauuuaacuguacagcaa

SEQ ID NO: 615328 - RNA, 19 nt, Homo sapiens
ccaaugagcauaauaaaug

SEQ ID NO: 615329 - RNA, 19 nt, Homo sapiens
agaagaagcugccacuuug

SEQ ID NO: 615330 - RNA, 19 nt, Homo sapiens
gagaagaagcugccacuuu

SEQ ID NO: 615331 - RNA, 19 nt, Homo sapiens
gcuaggagauaucaauuau

SEQ ID NO: 615332 - RNA, 19 nt, Homo sapiens
ggaaggagguuguucuuac

SEQ ID NO: 615333 - RNA, 19 nt, Homo sapiens
gaacacugcacuucacuuu

SEQ ID NO: 615334 - RNA, 19 nt, Homo sapiens
uaagaucgauucugaagga

SEQ ID NO: 615335 - RNA, 19 nt, Homo sapiens
guauuuaucuuccuucuuc

SEQ ID NO: 615336 - RNA, 19 nt, Homo sapiens
uagaauaccucccugaaug

SEQ ID NO: 615337 - RNA, 19 nt, Homo sapiens
gagaagaucaccagagauu

SEQ ID NO: 615338 - RNA, 19 nt, Homo sapiens
gaagcaauauccaaagauc

SEQ ID NO: 615339 - RNA, 19 nt, Homo sapiens
caauauagaucucagucaa

SEQ ID NO: 615340 - RNA, 19 nt, Homo sapiens
ggacuggacuuugaugaga

SEQ ID NO: 615341 - RNA, 19 nt, Homo sapiens
caagacagguuuaagaaag

SEQ ID NO: 615342 - RNA, 19 nt, Homo sapiens
ggugggauguuauuccaua

SEQ ID NO: 615343 - RNA, 19 nt, Homo sapiens
aaacaugcaucauugaaga

SEQ ID NO: 615344 - RNA, 19 nt, Homo sapiens
cacaggauguuauauauga

SEQ ID NO: 615345 - RNA, 19 nt, Homo sapiens
auacgaggcuucugaauga

SEQ ID NO: 615346 - RNA, 19 nt, Homo sapiens
ugaaauggaugauuaugga

SEQ ID NO: 615347 - RNA, 19 nt, Homo sapiens
caacucaacuggcaucauc

SEQ ID NO: 615348 - RNA, 19 nt, Homo sapiens
gagccacaaugcugacaua

SEQ ID NO: 615349 - RNA, 19 nt, Homo sapiens
cuacuuggcuuuaaugugu

SEQ ID NO: 615350 - RNA, 19 nt, Homo sapiens
ccacugagauuguuaaacu

SEQ ID NO: 615351 - RNA, 19 nt, Homo sapiens
caaaggagcuaagccaugu

SEQ ID NO: 615352 - RNA, 19 nt, Homo sapiens
gcacucauucucaaacaua

SEQ ID NO: 615353 - RNA, 19 nt, Homo sapiens
uaauaggccuuaugauaug

SEQ ID NO: 615354 - RNA, 19 nt, Homo sapiens
gcaauguucuugaauggau

SEQ ID NO: 615355 - RNA, 19 nt, Homo sapiens
gaauaugucuuuggcuaug

SEQ ID NO: 615356 - RNA, 19 nt, Homo sapiens
ccauauaguugaaguacaa

SEQ ID NO: 615357 - RNA, 19 nt, Homo sapiens
ggauuuagagcucauauga

SEQ ID NO: 615358 - RNA, 19 nt, Homo sapiens
ccacaaugcugacauaguc

SEQ ID NO: 615359 - RNA, 19 nt, Homo sapiens
caacacaccugaugucacu

SEQ ID NO: 615360 - RNA, 19 nt, Homo sapiens
gaacaaaggaauagcagau

SEQ ID NO: 615361 - RNA, 19 nt, Homo sapiens
gcuagcagacuauuuaauu

SEQ ID NO: 615362 - RNA, 19 nt, Homo sapiens
ugcaugaaauggaugauua

SEQ ID NO: 615363 - RNA, 19 nt, Homo sapiens
gcccuuguuuguugaaaua

SEQ ID NO: 615364 - RNA, 19 nt, Homo sapiens
caaagaaugcauggaaaua

SEQ ID NO: 615365 - RNA, 19 nt, Homo sapiens
aaauugagcuaauggagaa

SEQ ID NO: 615366 - RNA, 19 nt, Homo sapiens
gagauggacagcuugguua

SEQ ID NO: 615367 - RNA, 19 nt, Homo sapiens
cuacaagacauaagugaua

SEQ ID NO: 615368 - RNA, 19 nt, Homo sapiens
ugagcuagcagacuauuua

SEQ ID NO: 615369 - RNA, 19 nt, Homo sapiens
cuggaaagcuucauguuga

SEQ ID NO: 615370 - RNA, 19 nt, Homo sapiens
aaccauaucugagaaauga

SEQ ID NO: 615371 - RNA, 19 nt, Homo sapiens
ucaaucauccuguguguaa

SEQ ID NO: 615372 - RNA, 19 nt, Homo sapiens
uauaguaucccugugauua

SEQ ID NO: 615373 - RNA, 19 nt, Homo sapiens
gaugauagccauuguucuu

SEQ ID NO: 615374 - RNA, 19 nt, Homo sapiens
ggaacuucauaccagcuua

SEQ ID NO: 615375 - RNA, 19 nt, Homo sapiens
caaagaauggacaugauaa

SEQ ID NO: 615376 - RNA, 19 nt, Homo sapiens
gcuaagccauguaaaucaa

SEQ ID NO: 615377 - RNA, 19 nt, Homo sapiens
ccucaaaccuuguguagca

SEQ ID NO: 615378 - RNA, 19 nt, Homo sapiens
gggauguuauuccauauau

SEQ ID NO: 615379 - RNA, 19 nt, Homo sapiens
cuacacaggauguuauaua

SEQ ID NO: 615380 - RNA, 19 nt, Homo sapiens
gaugucacuuugagccaua

SEQ ID NO: 615381 - RNA, 19 nt, Homo sapiens
aauauuagguugaggucua

SEQ ID NO: 615382 - RNA, 19 nt, Homo sapiens
guuccugcaugcuauauaa

SEQ ID NO: 615383 - RNA, 19 nt, Homo sapiens
aggaauagcagauggaaua

SEQ ID NO: 615384 - RNA, 19 nt, Homo sapiens
caauugcuguuuacuucua

SEQ ID NO: 615385 - RNA, 19 nt, Homo sapiens
uaagcaauguucuugaaug

SEQ ID NO: 615386 - RNA, 19 nt, Homo sapiens
gaauuuaggaucuuacugu

SEQ ID NO: 615387 - RNA, 19 nt, Homo sapiens
cagaagcaauauccaaaga

SEQ ID NO: 615388 - RNA, 19 nt, Homo sapiens
gaaaaucacuauacagaag

SEQ ID NO: 615389 - RNA, 19 nt, Homo sapiens
aaauuggacuggacuuuga

SEQ ID NO: 615390 - RNA, 19 nt, Homo sapiens
gaaauccaccaucguguau

SEQ ID NO: 615391 - RNA, 19 nt, Homo sapiens
gugcugcccuuguuuguug

SEQ ID NO: 615392 - RNA, 19 nt, Homo sapiens
ugaaaugguuggcuuaugg

SEQ ID NO: 615393 - RNA, 19 nt, Homo sapiens
gagcuucauuguuugauca

SEQ ID NO: 615394 - RNA, 19 nt, Homo sapiens
uaacacaaccgauggaugu

SEQ ID NO: 615395 - RNA, 19 nt, Homo sapiens
caucguguaucccaacaaa

SEQ ID NO: 615396 - RNA, 19 nt, Homo sapiens
ugaaggaagugcauaugga

SEQ ID NO: 615397 - RNA, 19 nt, Homo sapiens
gguaauggaugaagacaac

SEQ ID NO: 615398 - RNA, 19 nt, Homo sapiens
gaucaaagagcugguaaug

SEQ ID NO: 615399 - RNA, 19 nt, Homo sapiens
caaauaauagcgaagcauu

SEQ ID NO: 615400 - RNA, 19 nt, Homo sapiens
gauggcuccucuccacaua

SEQ ID NO: 615401 - RNA, 19 nt, Homo sapiens
ggagauauucacuguaaug

SEQ ID NO: 615402 - RNA, 19 nt, Homo sapiens
uguaugagccuuuguuuga

SEQ ID NO: 615403 - RNA, 19 nt, Homo sapiens
gaagaagcagaaugauuga

SEQ ID NO: 615404 - RNA, 19 nt, Homo sapiens
cacaccaucuugagccuua

SEQ ID NO: 615405 - RNA, 19 nt, Homo sapiens
gacaagaaauaccaaaugc

SEQ ID NO: 615406 - RNA, 19 nt, Homo sapiens
ggcaauguguugagucaua

SEQ ID NO: 615407 - RNA, 19 nt, Homo sapiens
gggagccacuuauauguau

SEQ ID NO: 615408 - RNA, 19 nt, Homo sapiens
gcacugaggccccagauua

SEQ ID NO: 615409 - RNA, 19 nt, Homo sapiens
gcucugacaucuggauuug

SEQ ID NO: 615410 - RNA, 19 nt, Homo sapiens
gggaagcgccucuacauca

SEQ ID NO: 615411 - RNA, 19 nt, Homo sapiens
gcaauguguugagucauau

SEQ ID NO: 615412 - RNA, 19 nt, Homo sapiens
guaccagccucgacacaau

SEQ ID NO: 615413 - RNA, 19 nt, Homo sapiens
aaggagggcugaaguugaa

SEQ ID NO: 615414 - RNA, 19 nt, Homo sapiens
cagcauggcuacgaaaugu

SEQ ID NO: 615415 - RNA, 19 nt, Homo sapiens
gcagguugauguagacaca

SEQ ID NO: 615416 - RNA, 19 nt, Homo sapiens
gggaagagaucgucuaccu

SEQ ID NO: 615417 - RNA, 19 nt, Homo sapiens
gauuguagcucugacaucu

SEQ ID NO: 615418 - RNA, 19 nt, Homo sapiens
guacgggagccacuuauau

SEQ ID NO: 615419 - RNA, 19 nt, Homo sapiens
caucuccucucgcaucuau

SEQ ID NO: 615420 - RNA, 19 nt, Homo sapiens
ucugacaucuggauuugaa

SEQ ID NO: 615421 - RNA, 19 nt, Homo sapiens
gaaaugccaggccugauca

SEQ ID NO: 615422 - RNA, 19 nt, Homo sapiens
gcuacgaaaugugggaauu

SEQ ID NO: 615423 - RNA, 19 nt, Homo sapiens
cccaaugucuuacgagaug

SEQ ID NO: 615424 - RNA, 19 nt, Homo sapiens
ugaccacuguugcuuguug

SEQ ID NO: 615425 - RNA, 19 nt, Homo sapiens
ggaggcaccaagaaauaaa

SEQ ID NO: 615426 - RNA, 19 nt, Homo sapiens
gaaaggacccagggaagag

SEQ ID NO: 615427 - RNA, 19 nt, Homo sapiens
gggagacguucgaggugaa

SEQ ID NO: 615428 - RNA, 19 nt, Homo sapiens
guacauggucaguggagaa

SEQ ID NO: 615429 - RNA, 19 nt, Homo sapiens
ucacccacacucccuauuu

SEQ ID NO: 615430 - RNA, 19 nt, Homo sapiens
ggaggacgaggaacuaaag

SEQ ID NO: 615431 - RNA, 19 nt, Homo sapiens
ccaacuuccugguggacuu

SEQ ID NO: 615432 - RNA, 19 nt, Homo sapiens
ggaagcgccucuacaucac

SEQ ID NO: 615433 - RNA, 19 nt, Homo sapiens
aaaggagggcugaaguuga

SEQ ID NO: 615434 - RNA, 19 nt, Homo sapiens
cgaaaugccaggccugauc

SEQ ID NO: 615435 - RNA, 19 nt, Homo sapiens
gcagcauggcuacgaaaug

SEQ ID NO: 615436 - RNA, 19 nt, Homo sapiens
ugaaaggacccagggaaga

SEQ ID NO: 615437 - RNA, 19 nt, Homo sapiens
guggcaauguguugaguca

SEQ ID NO: 615438 - RNA, 19 nt, Homo sapiens
ggcaguaugacaucucuga

SEQ ID NO: 615439 - RNA, 19 nt, Homo sapiens
ggacgaccgcuuccucuac

SEQ ID NO: 615440 - RNA, 19 nt, Homo sapiens
auccagcgcuucuacaaga

SEQ ID NO: 615441 - RNA, 19 nt, Homo sapiens
gggcagcucccaaugucuu

SEQ ID NO: 615442 - RNA, 19 nt, Homo sapiens
uacauuuacugaccacugu

SEQ ID NO: 615443 - RNA, 19 nt, Homo sapiens
gaggcaguaugacaucucu

SEQ ID NO: 615444 - RNA, 19 nt, Homo sapiens
gaccugaggcaguaugaca

SEQ ID NO: 615445 - RNA, 19 nt, Homo sapiens
gcuggcugcugcccgaaau

SEQ ID NO: 615446 - RNA, 19 nt, Homo sapiens
ggagccacuuauauguaug

SEQ ID NO: 615447 - RNA, 19 nt, Homo sapiens
gacgaccgcuuccucuacu

SEQ ID NO: 615448 - RNA, 19 nt, Homo sapiens
cgggagccacuuauaugua

SEQ ID NO: 615449 - RNA, 19 nt, Homo sapiens
ggaggcagcauuguuaagg

SEQ ID NO: 615450 - RNA, 19 nt, Homo sapiens
caagaacgagggagguaca

SEQ ID NO: 615451 - RNA, 19 nt, Homo sapiens
ucuaaaagaugggcuuauu

SEQ ID NO: 615452 - RNA, 19 nt, Homo sapiens
ggacgagcugcaucacuca

SEQ ID NO: 615453 - RNA, 19 nt, Homo sapiens
ccaagucuccccaguauug

SEQ ID NO: 615454 - RNA, 19 nt, Homo sapiens
guacagugccugggacaag

SEQ ID NO: 615455 - RNA, 19 nt, Homo sapiens
uacgaaaugugggaauugu

SEQ ID NO: 615456 - RNA, 19 nt, Homo sapiens
uguggaggcuggacuguac

SEQ ID NO: 615457 - RNA, 19 nt, Homo sapiens
ugaaggacgagcugcauca

SEQ ID NO: 615458 - RNA, 19 nt, Homo sapiens
gcagcgccaugagauugug

SEQ ID NO: 615459 - RNA, 19 nt, Homo sapiens
caauguguugagucauaua

SEQ ID NO: 615460 - RNA, 19 nt, Homo sapiens
guugauguagacacaguaa

SEQ ID NO: 615461 - RNA, 19 nt, Homo sapiens
gcuggaggacgaggaacua

SEQ ID NO: 615462 - RNA, 19 nt, Homo sapiens
cauggucaguggagaaggu

SEQ ID NO: 615463 - RNA, 19 nt, Homo sapiens
gcuaugacuucugguacca

SEQ ID NO: 615464 - RNA, 19 nt, Homo sapiens
ucauugagcccaaggacau

SEQ ID NO: 615465 - RNA, 19 nt, Homo sapiens
ccagggaagagaucgucua

SEQ ID NO: 615466 - RNA, 19 nt, Homo sapiens
ggcagcucccaaugucuua

SEQ ID NO: 615467 - RNA, 19 nt, Homo sapiens
cgucaagggcaauggcaaa

SEQ ID NO: 615468 - RNA, 19 nt, Homo sapiens
aagcugagacuguggcaau

SEQ ID NO: 615469 - RNA, 19 nt, Homo sapiens
gaugggaagcgccucuaca

SEQ ID NO: 615470 - RNA, 19 nt, Homo sapiens
gcaccaagucgcgcaccaa

SEQ ID NO: 615471 - RNA, 19 nt, Homo sapiens
uggaggcaccaagaaauaa

SEQ ID NO: 615472 - RNA, 19 nt, Homo sapiens
cucggaggcagcauuguua

SEQ ID NO: 615473 - RNA, 19 nt, Homo sapiens
gcagcugcuucggugauag

SEQ ID NO: 615474 - RNA, 19 nt, Homo sapiens
uguguugagucauauacau

SEQ ID NO: 615475 - RNA, 19 nt, Homo sapiens
ccaagucgcgcaccaagcu

SEQ ID NO: 615476 - RNA, 19 nt, Homo sapiens
cuacgaaaugugggaauug

SEQ ID NO: 615477 - RNA, 19 nt, Homo sapiens
gacccugucucuaaaagau

SEQ ID NO: 615478 - RNA, 19 nt, Homo sapiens
uacgggagccacuuauaug

SEQ ID NO: 615479 - RNA, 19 nt, Homo sapiens
guaacccuguccuucaaaa

SEQ ID NO: 615480 - RNA, 19 nt, Homo sapiens
guguugagucauauacauu

SEQ ID NO: 615481 - RNA, 19 nt, Homo sapiens
ccccaaagcugcacaaggu

SEQ ID NO: 615482 - RNA, 19 nt, Homo sapiens
gaagagccaucucaacaga

SEQ ID NO: 615483 - RNA, 19 nt, Homo sapiens
gggaaucagugaaguguuu

SEQ ID NO: 615484 - RNA, 19 nt, Homo sapiens
ugaauuacgugccuccaua

SEQ ID NO: 615485 - RNA, 19 nt, Homo sapiens
ucagugaaguguuuagaaa

SEQ ID NO: 615486 - RNA, 19 nt, Homo sapiens
gccauuagcugccuuaaac

SEQ ID NO: 615487 - RNA, 19 nt, Homo sapiens
ggaguuaucauuaccaugu

SEQ ID NO: 615488 - RNA, 19 nt, Homo sapiens
caacucaacccucucuuug

SEQ ID NO: 615489 - RNA, 19 nt, Homo sapiens
uuagcugccuuaaacguua

SEQ ID NO: 615490 - RNA, 19 nt, Homo sapiens
ucugguaucugaaguauca

SEQ ID NO: 615491 - RNA, 19 nt, Homo sapiens
gcacuuuggugaauuacgu

SEQ ID NO: 615492 - RNA, 19 nt, Homo sapiens
gggaagagccaucucaaca

SEQ ID NO: 615493 - RNA, 19 nt, Homo sapiens
gaauuacgugccuccauaa

SEQ ID NO: 615494 - RNA, 19 nt, Homo sapiens
uuucuugacuugccuguuu

SEQ ID NO: 615495 - RNA, 19 nt, Homo sapiens
gaagaagacaugcucuaca

SEQ ID NO: 615496 - RNA, 19 nt, Homo sapiens
gaaguaucauuggccuuga

SEQ ID NO: 615497 - RNA, 19 nt, Homo sapiens
uuggugaccuguucaguuu

SEQ ID NO: 615498 - RNA, 19 nt, Homo sapiens
uuuagaaacugcugcaaga

SEQ ID NO: 615499 - RNA, 19 nt, Homo sapiens
guuaacagcacauuugaau

SEQ ID NO: 615500 - RNA, 19 nt, Homo sapiens
cuacagugcucagucuuug

SEQ ID NO: 615501 - RNA, 19 nt, Homo sapiens
agaaacugcugcaagacaa

SEQ ID NO: 615502 - RNA, 19 nt, Homo sapiens
gaaacugcugcaagacaaa

SEQ ID NO: 615503 - RNA, 19 nt, Homo sapiens
ggaaucagugaaguguuua

SEQ ID NO: 615504 - RNA, 19 nt, Homo sapiens
ucauuggccuugaggaaga

SEQ ID NO: 615505 - RNA, 19 nt, Homo sapiens
caucugguaucugaaguau

SEQ ID NO: 615506 - RNA, 19 nt, Homo sapiens
ccaacucaacccucucuuu

SEQ ID NO: 615507 - RNA, 19 nt, Homo sapiens
gcaauucuggcccaacuca

SEQ ID NO: 615508 - RNA, 19 nt, Homo sapiens
ugagauagaagaugcuguu

SEQ ID NO: 615509 - RNA, 19 nt, Homo sapiens
gaguuaucauuaccauguu

SEQ ID NO: 615510 - RNA, 19 nt, Homo sapiens
gcucuacagugcucagucu

SEQ ID NO: 615511 - RNA, 19 nt, Homo sapiens
acucaacccucucuuugga

SEQ ID NO: 615512 - RNA, 19 nt, Homo sapiens
gcuguucuucugagagaua

SEQ ID NO: 615513 - RNA, 19 nt, Homo sapiens
aagaagacaugcucuacag

SEQ ID NO: 615514 - RNA, 19 nt, Homo sapiens
ggaagaagacaugcucuac

SEQ ID NO: 615515 - RNA, 19 nt, Homo sapiens
guuacucucuccuuggaau

SEQ ID NO: 615516 - RNA, 19 nt, Homo sapiens
agagccaucucaacagaau

SEQ ID NO: 615517 - RNA, 19 nt, Homo sapiens
gauggcuccugccuucuca

SEQ ID NO: 615518 - RNA, 19 nt, Homo sapiens
ggaagagccaucucaacag

SEQ ID NO: 615519 - RNA, 19 nt, Homo sapiens
ucacugugccucucauugu

SEQ ID NO: 615520 - RNA, 19 nt, Homo sapiens
cggcgaccauggcguauca

SEQ ID NO: 615521 - RNA, 19 nt, Homo sapiens
gggcuucgucggcuucuug

SEQ ID NO: 615522 - RNA, 19 nt, Homo sapiens
ccauguuggugaccuguuc

SEQ ID NO: 615523 - RNA, 19 nt, Homo sapiens
uuugcacuuuggugaauua

SEQ ID NO: 615524 - RNA, 19 nt, Homo sapiens
aaacguuaacagcacauuu

SEQ ID NO: 615525 - RNA, 19 nt, Homo sapiens
cuccaaaccagaccacuuu

SEQ ID NO: 615526 - RNA, 19 nt, Homo sapiens
gagggaagagccaucucaa

SEQ ID NO: 615527 - RNA, 19 nt, Homo sapiens
ugccuugguucaucccuaa

SEQ ID NO: 615528 - RNA, 19 nt, Homo sapiens
uaucauuggccuugaggaa

SEQ ID NO: 615529 - RNA, 19 nt, Homo sapiens
ggccauuagcugccuuaaa

SEQ ID NO: 615530 - RNA, 19 nt, Homo sapiens
guuggugaccuguucaguu

SEQ ID NO: 615531 - RNA, 19 nt, Homo sapiens
gguaucugaaguaucauug

SEQ ID NO: 615532 - RNA, 19 nt, Homo sapiens
uagaaacugcugcaagaca

SEQ ID NO: 615533 - RNA, 19 nt, Homo sapiens
uuacgugccuccauaaccu

SEQ ID NO: 615534 - RNA, 19 nt, Homo sapiens
ggugaccuguucaguuugc

SEQ ID NO: 615535 - RNA, 19 nt, Homo sapiens
caaaaucaccuccaaacca

SEQ ID NO: 615536 - RNA, 19 nt, Homo sapiens
ucuuugaggucacgagaag

SEQ ID NO: 615537 - RNA, 19 nt, Homo sapiens
gaggucacgagaagagaau

SEQ ID NO: 615538 - RNA, 19 nt, Homo sapiens
aacguuaacagcacauuug

SEQ ID NO: 615539 - RNA, 19 nt, Homo sapiens
ccuguucaguuugcugcua

SEQ ID NO: 615540 - RNA, 19 nt, Homo sapiens
gaugcaaaaucaccuccaa

SEQ ID NO: 615541 - RNA, 19 nt, Homo sapiens
ccaucugguaucugaagua

SEQ ID NO: 615542 - RNA, 19 nt, Homo sapiens
ggaaggcccuggcaucaga

SEQ ID NO: 615543 - RNA, 19 nt, Homo sapiens
ccacucaggucacuuaugg

SEQ ID NO: 615544 - RNA, 19 nt, Homo sapiens
gagaagacgggcucguaua

SEQ ID NO: 615545 - RNA, 19 nt, Homo sapiens
ggcuacaacuuccugauug

SEQ ID NO: 615546 - RNA, 19 nt, Homo sapiens
gcccugagguccaacuaug

SEQ ID NO: 615547 - RNA, 19 nt, Homo sapiens
ccaacuaugugcucaaagg

SEQ ID NO: 615548 - RNA, 19 nt, Homo sapiens
ggccguggcuggaacuuca

SEQ ID NO: 615549 - RNA, 19 nt, Homo sapiens
ggagaagacgggcucguau

SEQ ID NO: 615550 - RNA, 19 nt, Homo sapiens
gggcuacaacuuccugauu

SEQ ID NO: 615551 - RNA, 19 nt, Homo sapiens
cgacgugggcuacaacuuc

SEQ ID NO: 615552 - RNA, 19 nt, Homo sapiens
gcaccugagccugcccuua

SEQ ID NO: 615553 - RNA, 19 nt, Homo sapiens
guccaacuaugugcucaaa

SEQ ID NO: 615554 - RNA, 19 nt, Homo sapiens
gcuacaacuuccugauugg

SEQ ID NO: 615555 - RNA, 19 nt, Homo sapiens
gagccugcccuuacgcuau

SEQ ID NO: 615556 - RNA, 19 nt, Homo sapiens
ucuaccaccucauccagaa

SEQ ID NO: 615557 - RNA, 19 nt, Homo sapiens
caacuaugugcucaaagga

SEQ ID NO: 615558 - RNA, 19 nt, Homo sapiens
caaaggacaccgggaugug

SEQ ID NO: 615559 - RNA, 19 nt, Homo sapiens
cuucacgggugcccacuca

SEQ ID NO: 615560 - RNA, 19 nt, Homo sapiens
uggagaagacgggcucgua

SEQ ID NO: 615561 - RNA, 19 nt, Homo sapiens
caacuuccugauuggagaa

SEQ ID NO: 615562 - RNA, 19 nt, Homo sapiens
ggugcgacgugggcuacaa

SEQ ID NO: 615563 - RNA, 19 nt, Homo sapiens
caccugagccugcccuuac

SEQ ID NO: 615564 - RNA, 19 nt, Homo sapiens
gcagcacuaccacaugaag

SEQ ID NO: 615565 - RNA, 19 nt, Homo sapiens
ucaaaggacaccgggaugu

SEQ ID NO: 615566 - RNA, 19 nt, Homo sapiens
acucaggucacuuauggaa

SEQ ID NO: 615567 - RNA, 19 nt, Homo sapiens
gcacuaccacaugaagaca

SEQ ID NO: 615568 - RNA, 19 nt, Homo sapiens
cagaauggcugcaaauuua

SEQ ID NO: 615569 - RNA, 19 nt, Homo sapiens
gaaggaagcucuaaugugu

SEQ ID NO: 615570 - RNA, 19 nt, Homo sapiens
gggaagagcugcccgcaua

SEQ ID NO: 615571 - RNA, 19 nt, Homo sapiens
gcacaggcauuauguuuga

SEQ ID NO: 615572 - RNA, 19 nt, Homo sapiens
gaauagcccuucuggguuu

SEQ ID NO: 615573 - RNA, 19 nt, Homo sapiens
ucacagagcuucaccaaau

SEQ ID NO: 615574 - RNA, 19 nt, Homo sapiens
gcagagugaucguaacuaa

SEQ ID NO: 615575 - RNA, 19 nt, Homo sapiens
ggaaaucacuggcuucaca

SEQ ID NO: 615576 - RNA, 19 nt, Homo sapiens
agagacagcuucuuauaaa

SEQ ID NO: 615577 - RNA, 19 nt, Homo sapiens
gaaaauaccuauacccaaa

SEQ ID NO: 615578 - RNA, 19 nt, Homo sapiens
ucagauagguuugcgaaua

SEQ ID NO: 615579 - RNA, 19 nt, Homo sapiens
gaagccagccaauguguua

SEQ ID NO: 615580 - RNA, 19 nt, Homo sapiens
gagaagagacccucaucua

SEQ ID NO: 615581 - RNA, 19 nt, Homo sapiens
ggacucagauaccuucuuc

SEQ ID NO: 615582 - RNA, 19 nt, Homo sapiens
gaauuggugccauggauua

SEQ ID NO: 615583 - RNA, 19 nt, Homo sapiens
gagagacagcuucuuauaa

SEQ ID NO: 615584 - RNA, 19 nt, Homo sapiens
auacaaggauccauucgua

SEQ ID NO: 615585 - RNA, 19 nt, Homo sapiens
gaagagacccucaucuaca

SEQ ID NO: 615586 - RNA, 19 nt, Homo sapiens
gaagaaaccaggauaaggu

SEQ ID NO: 615587 - RNA, 19 nt, Homo sapiens
gaacauuucaugcuucaga

SEQ ID NO: 615588 - RNA, 19 nt, Homo sapiens
ucgaggaccugaacaugua

SEQ ID NO: 615589 - RNA, 19 nt, Homo sapiens
gaagagacaacccaguuug

SEQ ID NO: 615590 - RNA, 19 nt, Homo sapiens
cagauagguuugcgaauau

SEQ ID NO: 615591 - RNA, 19 nt, Homo sapiens
cccgaaggcugauuacuuu

SEQ ID NO: 615592 - RNA, 19 nt, Homo sapiens
cgacagaaauuugcccuau

SEQ ID NO: 615593 - RNA, 19 nt, Homo sapiens
ccaauacauucaacccuuu

SEQ ID NO: 615594 - RNA, 19 nt, Homo sapiens
caucauagcaccaaaggaa

SEQ ID NO: 615595 - RNA, 19 nt, Homo sapiens
aaucuuaccuuuccaguuc

SEQ ID NO: 615596 - RNA, 19 nt, Homo sapiens
gagaagagacaacccaguu

SEQ ID NO: 615597 - RNA, 19 nt, Homo sapiens
gguuagugcucgagugaaa

SEQ ID NO: 615598 - RNA, 19 nt, Homo sapiens
aaagccagccuccaucuua

SEQ ID NO: 615599 - RNA, 19 nt, Homo sapiens
agaaguagcugggauuugu

SEQ ID NO: 615600 - RNA, 19 nt, Homo sapiens
aaagaaaggcagcccauuu

SEQ ID NO: 615601 - RNA, 19 nt, Homo sapiens
ggagggagaguuccuguga

SEQ ID NO: 615602 - RNA, 19 nt, Homo sapiens
gaagauggccaccgcuguu

SEQ ID NO: 615603 - RNA, 19 nt, Homo sapiens
agaagaagcugcaaaagaa

SEQ ID NO: 615604 - RNA, 19 nt, Homo sapiens
ugaagaggcuggagaagag

SEQ ID NO: 615605 - RNA, 19 nt, Homo sapiens
cuucugagaugucugcuuu

SEQ ID NO: 615606 - RNA, 19 nt, Homo sapiens
ggcauuauguuugaagaaa

SEQ ID NO: 615607 - RNA, 19 nt, Homo sapiens
agaacaagaucuacugugu

SEQ ID NO: 615608 - RNA, 19 nt, Homo sapiens
gaaggcugauuacuuugga

SEQ ID NO: 615609 - RNA, 19 nt, Homo sapiens
ugagagacagcuucuuaua

SEQ ID NO: 615610 - RNA, 19 nt, Homo sapiens
caagaaggaagcucuaaug

SEQ ID NO: 615611 - RNA, 19 nt, Homo sapiens
aaaccagagucaagauuug

SEQ ID NO: 615612 - RNA, 19 nt, Homo sapiens
ggagcucaaugaugaagau

SEQ ID NO: 615613 - RNA, 19 nt, Homo sapiens
gucuggagcucaaugauga

SEQ ID NO: 615614 - RNA, 19 nt, Homo sapiens
gcacuucccauuucucugu

SEQ ID NO: 615615 - RNA, 19 nt, Homo sapiens
ucuaaugugugcuuuguau

SEQ ID NO: 615616 - RNA, 19 nt, Homo sapiens
uuauugagcuuguuucaca

SEQ ID NO: 615617 - RNA, 19 nt, Homo sapiens
ccagggaggugaacacuac

SEQ ID NO: 615618 - RNA, 19 nt, Homo sapiens
agaagggcauuuaguccua

SEQ ID NO: 615619 - RNA, 19 nt, Homo sapiens
guaaugggguuguauuuau

SEQ ID NO: 615620 - RNA, 19 nt, Homo sapiens
gggcccaaaucuuaccuuu

SEQ ID NO: 615621 - RNA, 19 nt, Homo sapiens
aggaugggcccaaaucuua

SEQ ID NO: 615622 - RNA, 19 nt, Homo sapiens
ugacaauucuuggacuuga

SEQ ID NO: 615623 - RNA, 19 nt, Homo sapiens
ggaauccuuuggccagaug

SEQ ID NO: 615624 - RNA, 19 nt, Homo sapiens
gaacucaggcuuuucauug

SEQ ID NO: 615625 - RNA, 19 nt, Homo sapiens
gacagcuucuuauaaacaa

SEQ ID NO: 615626 - RNA, 19 nt, Homo sapiens
gacagaaauuugcccuaug

SEQ ID NO: 615627 - RNA, 19 nt, Homo sapiens
ucaaauccuuacucuccua

SEQ ID NO: 615628 - RNA, 19 nt, Homo sapiens
aggcaggguuuccuccuua

SEQ ID NO: 615629 - RNA, 19 nt, Homo sapiens
gcucuaaugugugcuuugu

SEQ ID NO: 615630 - RNA, 19 nt, Homo sapiens
gcucagcugccaauacauu

SEQ ID NO: 615631 - RNA, 19 nt, Homo sapiens
gcugacagguguuuucuuu

SEQ ID NO: 615632 - RNA, 19 nt, Homo sapiens
ucacucauggagacuauua

SEQ ID NO: 615633 - RNA, 19 nt, Homo sapiens
gcaauacaaggauccauuc

SEQ ID NO: 615634 - RNA, 19 nt, Homo sapiens
gggaacauuucaugcuuca

SEQ ID NO: 615635 - RNA, 19 nt, Homo sapiens
guggacaucugaucaugga

SEQ ID NO: 615636 - RNA, 19 nt, Homo sapiens
gccggaagcugagaggaaa

SEQ ID NO: 615637 - RNA, 19 nt, Homo sapiens
gcccaaaucuuaccuuucc

SEQ ID NO: 615638 - RNA, 19 nt, Homo sapiens
ggaggauuguggccggauu

SEQ ID NO: 615639 - RNA, 19 nt, Homo sapiens
caaaagccaugaagagaug

SEQ ID NO: 615640 - RNA, 19 nt, Homo sapiens
gccaucggcugcgguauga

SEQ ID NO: 615641 - RNA, 19 nt, Homo sapiens
gaguagaggcccugucaau

SEQ ID NO: 615642 - RNA, 19 nt, Homo sapiens
ccaaauagaacuguaaugg

SEQ ID NO: 615643 - RNA, 19 nt, Homo sapiens
acagaaauuugcccuaugg

SEQ ID NO: 615644 - RNA, 19 nt, Homo sapiens
gcaagaaggaagcucuaau

SEQ ID NO: 615645 - RNA, 19 nt, Homo sapiens
uagaaauccuagcaacaga

SEQ ID NO: 615646 - RNA, 19 nt, Homo sapiens
ccagaggucaguacccuuu

SEQ ID NO: 615647 - RNA, 19 nt, Homo sapiens
ggauaagguacacugcuuu

SEQ ID NO: 615648 - RNA, 19 nt, Homo sapiens
ccacguguuugcgcuguuu

SEQ ID NO: 615649 - RNA, 19 nt, Homo sapiens
cugcugaguugaaauuaga

SEQ ID NO: 615650 - RNA, 19 nt, Homo sapiens
guagaggcccugucaaugg

SEQ ID NO: 615651 - RNA, 19 nt, Homo sapiens
gacccucucuucccaucaa

SEQ ID NO: 615652 - RNA, 19 nt, Homo sapiens
ccacuucuaggccauguuu

SEQ ID NO: 615653 - RNA, 19 nt, Homo sapiens
acugagagacagcuucuua

SEQ ID NO: 615654 - RNA, 19 nt, Homo sapiens
gcaaggcaagucucaggaa

SEQ ID NO: 615655 - RNA, 19 nt, Homo sapiens
aaacauacuuugggagaag

SEQ ID NO: 615656 - RNA, 19 nt, Homo sapiens
gaaccucuaccaugacaca

SEQ ID NO: 615657 - RNA, 19 nt, Homo sapiens
auaggaaucuccaaucagu

SEQ ID NO: 615658 - RNA, 19 nt, Homo sapiens
cagaauuggugccauggau

SEQ ID NO: 615659 - RNA, 19 nt, Homo sapiens
gcacugaagagguaaaauu

SEQ ID NO: 615660 - RNA, 19 nt, Homo sapiens
ccacacacuggcaagauuu

SEQ ID NO: 615661 - RNA, 19 nt, Homo sapiens
cuuagacacugacagcauu

SEQ ID NO: 615662 - RNA, 19 nt, Homo sapiens
gggaaccucuaccaugaca

SEQ ID NO: 615663 - RNA, 19 nt, Homo sapiens
gggcuggucuucugauggu

SEQ ID NO: 615664 - RNA, 19 nt, Homo sapiens
ugccugaguuaucuuguaa

SEQ ID NO: 615665 - RNA, 19 nt, Homo sapiens
uagaggcccugucaaugga

SEQ ID NO: 615666 - RNA, 19 nt, Homo sapiens
agauugaggugauucagau

SEQ ID NO: 615667 - RNA, 19 nt, Homo sapiens
aaaugaagccagccaaugu

SEQ ID NO: 615668 - RNA, 19 nt, Homo sapiens
gcaaauggcaucuucugaa

SEQ ID NO: 615669 - RNA, 19 nt, Homo sapiens
gauacaaacucuaacaaac

SEQ ID NO: 615670 - RNA, 19 nt, Homo sapiens
ucaaggagcucagagauca

SEQ ID NO: 615671 - RNA, 19 nt, Homo sapiens
gaaccuccuugcgugaaua

SEQ ID NO: 615672 - RNA, 19 nt, Homo sapiens
ucaguuggcuaaucuuuau

SEQ ID NO: 615673 - RNA, 19 nt, Homo sapiens
acaaugauguagcuccuuu

SEQ ID NO: 615674 - RNA, 19 nt, Homo sapiens
gacaugauacaaacucuaa

SEQ ID NO: 615675 - RNA, 19 nt, Homo sapiens
ccaaguggcucccaaugca

SEQ ID NO: 615676 - RNA, 19 nt, Homo sapiens
acaaagacaugauacaaac

SEQ ID NO: 615677 - RNA, 19 nt, Homo sapiens
ggacaccauagacuugaua

SEQ ID NO: 615678 - RNA, 19 nt, Homo sapiens
aggagggacuuaugaauug

SEQ ID NO: 615679 - RNA, 19 nt, Homo sapiens
ggcuaaguuuggaccauua

SEQ ID NO: 615680 - RNA, 19 nt, Homo sapiens
caaauggcaucuucugaac

SEQ ID NO: 615681 - RNA, 19 nt, Homo sapiens
ccaaugcaaacuacaauga

SEQ ID NO: 615682 - RNA, 19 nt, Homo sapiens
ggacuuaugaauugcaugu

SEQ ID NO: 615683 - RNA, 19 nt, Homo sapiens
caccauagacuugauauuc

SEQ ID NO: 615684 - RNA, 19 nt, Homo sapiens
uaggagggacuuaugaauu

SEQ ID NO: 615685 - RNA, 19 nt, Homo sapiens
aaugcaaacuacaaugaug

SEQ ID NO: 615686 - RNA, 19 nt, Homo sapiens
uuucuuugcuccuucaguu

SEQ ID NO: 615687 - RNA, 19 nt, Homo sapiens
ccuuuaagccauucaagaa

SEQ ID NO: 615688 - RNA, 19 nt, Homo sapiens
accauagacuugauauuca

SEQ ID NO: 615689 - RNA, 19 nt, Homo sapiens
aauaugccuuuaagccauu

SEQ ID NO: 615690 - RNA, 19 nt, Homo sapiens
gcuaaggagcccuguaugg

SEQ ID NO: 615691 - RNA, 19 nt, Homo sapiens
guaggagggacuuaugaau

SEQ ID NO: 615692 - RNA, 19 nt, Homo sapiens
gauauucaacucugagcau

SEQ ID NO: 615693 - RNA, 19 nt, Homo sapiens
acuuaugaauugcauguug

SEQ ID NO: 615694 - RNA, 19 nt, Homo sapiens
uggagauacuucagaaugg

SEQ ID NO: 615695 - RNA, 19 nt, Homo sapiens
uggcuaaguuuggaccauu

SEQ ID NO: 615696 - RNA, 19 nt, Homo sapiens
gcucaauaguuauguugcu

SEQ ID NO: 615697 - RNA, 19 nt, Homo sapiens
aauggcaaauggcaucuuc

SEQ ID NO: 615698 - RNA, 19 nt, Homo sapiens
acuggaagcuggagauacu

SEQ ID NO: 615699 - RNA, 19 nt, Homo sapiens
ggcaaauggcaucuucuga

SEQ ID NO: 615700 - RNA, 19 nt, Homo sapiens
gaggugcggcuguauaaaa

SEQ ID NO: 615701 - RNA, 19 nt, Homo sapiens
gauacuucagaauggcuua

SEQ ID NO: 615702 - RNA, 19 nt, Homo sapiens
ccuggaagcuguggcucuu

SEQ ID NO: 615703 - RNA, 19 nt, Homo sapiens
caugauacaaacucuaaca

SEQ ID NO: 615704 - RNA, 19 nt, Homo sapiens
caaugcaaacuacaaugau

SEQ ID NO: 615705 - RNA, 19 nt, Homo sapiens
uuuaauuuauggccaagug

SEQ ID NO: 615706 - RNA, 19 nt, Homo sapiens
ugacuggaagcuggagaua

SEQ ID NO: 615707 - RNA, 19 nt, Homo sapiens
gcgugaauaaggugucuga

SEQ ID NO: 615708 - RNA, 19 nt, Homo sapiens
ugaaccuccuugcgugaau

SEQ ID NO: 615709 - RNA, 19 nt, Homo sapiens
cucaauaguuauguugcua

SEQ ID NO: 615710 - RNA, 19 nt, Homo sapiens
ggagggacuuaugaauugc

SEQ ID NO: 615711 - RNA, 19 nt, Homo sapiens
cuucagaauggcuuauauu

SEQ ID NO: 615712 - RNA, 19 nt, Homo sapiens
gcaaauccccaauucaucu

SEQ ID NO: 615713 - RNA, 19 nt, Homo sapiens
gggacaccauagacuugau

SEQ ID NO: 615714 - RNA, 19 nt, Homo sapiens
uugaggugcggcuguauaa

SEQ ID NO: 615715 - RNA, 19 nt, Homo sapiens
cuggagauacuucagaaug

SEQ ID NO: 615716 - RNA, 19 nt, Homo sapiens
agacaugauacaaacucua

SEQ ID NO: 615717 - RNA, 19 nt, Homo sapiens
gccuuuaagccauucaaga

SEQ ID NO: 615718 - RNA, 19 nt, Homo sapiens
aaaaggcgcucuauacaua

SEQ ID NO: 615719 - RNA, 19 nt, Homo sapiens
ggugacuucucuccacaua

SEQ ID NO: 615720 - RNA, 19 nt, Homo sapiens
ccacuuggcagcauaugua

SEQ ID NO: 615721 - RNA, 19 nt, Homo sapiens
acacacaucauugucauua

SEQ ID NO: 615722 - RNA, 19 nt, Homo sapiens
ccacgauucuggcuguuug

SEQ ID NO: 615723 - RNA, 19 nt, Homo sapiens
ugaggauucugaccaguga

SEQ ID NO: 615724 - RNA, 19 nt, Homo sapiens
gaccagugacuuacacaaa

SEQ ID NO: 615725 - RNA, 19 nt, Homo sapiens
uuaauugucuggcuucucu

SEQ ID NO: 615726 - RNA, 19 nt, Homo sapiens
ccacacacaucauugucau

SEQ ID NO: 615727 - RNA, 19 nt, Homo sapiens
ugacuucucuccacauagg

SEQ ID NO: 615728 - RNA, 19 nt, Homo sapiens
gauucugaccagugacuua

SEQ ID NO: 615729 - RNA, 19 nt, Homo sapiens
gacaaaggccacacacauc

SEQ ID NO: 615730 - RNA, 19 nt, Homo sapiens
ccgcauacacaacccauuu

SEQ ID NO: 615731 - RNA, 19 nt, Homo sapiens
aagcugaggccucuaaaga

SEQ ID NO: 615732 - RNA, 19 nt, Homo sapiens
caguaccgcuggaagugaa

SEQ ID NO: 615733 - RNA, 19 nt, Homo sapiens
agacaaaggccacacacau

SEQ ID NO: 615734 - RNA, 19 nt, Homo sapiens
gcaggaggacaccgaguuc

SEQ ID NO: 615735 - RNA, 19 nt, Homo sapiens
uuccugagcugaacaugga

SEQ ID NO: 615736 - RNA, 19 nt, Homo sapiens
acaaaggccacacacauca

SEQ ID NO: 615737 - RNA, 19 nt, Homo sapiens
ggaagugagacuagaagag

SEQ ID NO: 615738 - RNA, 19 nt, Homo sapiens
gagcccgacuucgaggaaa

SEQ ID NO: 615739 - RNA, 19 nt, Homo sapiens
gcucacagccuugggaagu

SEQ ID NO: 615740 - RNA, 19 nt, Homo sapiens
acacaucauugucauuacu

SEQ ID NO: 615741 - RNA, 19 nt, Homo sapiens
ugacccuccugcccgcaua

SEQ ID NO: 615742 - RNA, 19 nt, Homo sapiens
acccgaggcugaagcagaa

SEQ ID NO: 615743 - RNA, 19 nt, Homo sapiens
gaacuuaggguggguaccu

SEQ ID NO: 615744 - RNA, 19 nt, Homo sapiens
ggaagcugaggccucuaaa

SEQ ID NO: 615745 - RNA, 19 nt, Homo sapiens
aaggcgcucuauacauauu

SEQ ID NO: 615746 - RNA, 19 nt, Homo sapiens
ggccagaguacgaggcauu

SEQ ID NO: 615747 - RNA, 19 nt, Homo sapiens
gaagcugaggccucuaaag

SEQ ID NO: 615748 - RNA, 19 nt, Homo sapiens
ggacucgggacugcuguug

SEQ ID NO: 615749 - RNA, 19 nt, Homo sapiens
ggcaggaggacaccgaguu

SEQ ID NO: 615750 - RNA, 19 nt, Homo sapiens
aaaggccacacacaucauu

SEQ ID NO: 615751 - RNA, 19 nt, Homo sapiens
acucgggacugcuguugga

SEQ ID NO: 615752 - RNA, 19 nt, Homo sapiens
ggcgcucuauacauauuau

SEQ ID NO: 615753 - RNA, 19 nt, Homo sapiens
uggaagcugaggccucuaa

SEQ ID NO: 615754 - RNA, 19 nt, Homo sapiens
gggaagugagacuagaaga

SEQ ID NO: 615755 - RNA, 19 nt, Homo sapiens
ccugggcucucuccacgau

SEQ ID NO: 615756 - RNA, 19 nt, Homo sapiens
ucaaagagcuggagaagua

SEQ ID NO: 615757 - RNA, 19 nt, Homo sapiens
gaagaggcaugaugacuuu

SEQ ID NO: 615758 - RNA, 19 nt, Homo sapiens
gagaauugcugcugucuuu

SEQ ID NO: 615759 - RNA, 19 nt, Homo sapiens
gcaaggagaucaaagauuc

SEQ ID NO: 615760 - RNA, 19 nt, Homo sapiens
gauuaaaccugauuucuga

SEQ ID NO: 615761 - RNA, 19 nt, Homo sapiens
gaagauguuugacuggaua

SEQ ID NO: 615762 - RNA, 19 nt, Homo sapiens
gaauugaguugaucuguga

SEQ ID NO: 615763 - RNA, 19 nt, Homo sapiens
gacaggaucugcaccagua

SEQ ID NO: 615764 - RNA, 19 nt, Homo sapiens
gcaaagcacuacuugaugu

SEQ ID NO: 615765 - RNA, 19 nt, Homo sapiens
ggaaacucgugacguauuu

SEQ ID NO: 615766 - RNA, 19 nt, Homo sapiens
ggacauucauuauaccauu

SEQ ID NO: 615767 - RNA, 19 nt, Homo sapiens
caacaugagugaagagguu

SEQ ID NO: 615768 - RNA, 19 nt, Homo sapiens
gcagacaaauuucagaugu

SEQ ID NO: 615769 - RNA, 19 nt, Homo sapiens
ccaagaaacaggugaauuu

SEQ ID NO: 615770 - RNA, 19 nt, Homo sapiens
gaagaugaggguuaacuuu

SEQ ID NO: 615771 - RNA, 19 nt, Homo sapiens
gcugaaagccuccaacauu

SEQ ID NO: 615772 - RNA, 19 nt, Homo sapiens
aaacguggcuucacuguca

SEQ ID NO: 615773 - RNA, 19 nt, Homo sapiens
gugggacacugcuuuguua

SEQ ID NO: 615774 - RNA, 19 nt, Homo sapiens
gacaagcacuacagagauu

SEQ ID NO: 615775 - RNA, 19 nt, Homo sapiens
gaagagguggcucagaaua

SEQ ID NO: 615776 - RNA, 19 nt, Homo sapiens
ggccacauguugauaauug

SEQ ID NO: 615777 - RNA, 19 nt, Homo sapiens
uccaaaggaucaccaaaua

SEQ ID NO: 615778 - RNA, 19 nt, Homo sapiens
uccaagagaucuacgauuu

SEQ ID NO: 615779 - RNA, 19 nt, Homo sapiens
cagcagagaucgaccaugu

SEQ ID NO: 615780 - RNA, 19 nt, Homo sapiens
aaacagaggaacaauagua

SEQ ID NO: 615781 - RNA, 19 nt, Homo sapiens
ggaagagugagaagauaua

SEQ ID NO: 615782 - RNA, 19 nt, Homo sapiens
gaugaugugugguagagaa

SEQ ID NO: 615783 - RNA, 19 nt, Homo sapiens
gugaagagguuaauuagag

SEQ ID NO: 615784 - RNA, 19 nt, Homo sapiens
ugaaagccauccugaguga

SEQ ID NO: 615785 - RNA, 19 nt, Homo sapiens
cagcaaucaugacagaaua

SEQ ID NO: 615786 - RNA, 19 nt, Homo sapiens
gaagggaugauguguggua

SEQ ID NO: 615787 - RNA, 19 nt, Homo sapiens
cuagaggucugcaacauga

SEQ ID NO: 615788 - RNA, 19 nt, Homo sapiens
gaaagcuucugauguccuu

SEQ ID NO: 615789 - RNA, 19 nt, Homo sapiens
guagagaagaugaggguua

SEQ ID NO: 615790 - RNA, 19 nt, Homo sapiens
ucaaguacauccacaggaa

SEQ ID NO: 615791 - RNA, 19 nt, Homo sapiens
gggacacacuuaucucuga

SEQ ID NO: 615792 - RNA, 19 nt, Homo sapiens
ugagugaagagguuaauua

SEQ ID NO: 615793 - RNA, 19 nt, Homo sapiens
gagaagugauucaagaaag

SEQ ID NO: 615794 - RNA, 19 nt, Homo sapiens
gaacuacuccagacagaga

SEQ ID NO: 615795 - RNA, 19 nt, Homo sapiens
gaagucagcccggaagaaa

SEQ ID NO: 615796 - RNA, 19 nt, Homo sapiens
ugaacaacaugaccuuuga

SEQ ID NO: 615797 - RNA, 19 nt, Homo sapiens
gaugguacguggacauuca

SEQ ID NO: 615798 - RNA, 19 nt, Homo sapiens
gaacggaagcuagccauga

SEQ ID NO: 615799 - RNA, 19 nt, Homo sapiens
gagcuucucuccaaagucu

SEQ ID NO: 615800 - RNA, 19 nt, Homo sapiens
ggacacacgaaauauguuu

SEQ ID NO: 615801 - RNA, 19 nt, Homo sapiens
ggauuugcaugagugcuua

SEQ ID NO: 615802 - RNA, 19 nt, Homo sapiens
gccgauagcuuuguggaaa

SEQ ID NO: 615803 - RNA, 19 nt, Homo sapiens
ccaaagaguuguggacaug

SEQ ID NO: 615804 - RNA, 19 nt, Homo sapiens
cauuaugccucacaacaaa

SEQ ID NO: 615805 - RNA, 19 nt, Homo sapiens
gaacauucgagaagugauu

SEQ ID NO: 615806 - RNA, 19 nt, Homo sapiens
gagaaucgcgugcugcauu

SEQ ID NO: 615807 - RNA, 19 nt, Homo sapiens
gaacacacacagcucaaga

SEQ ID NO: 615808 - RNA, 19 nt, Homo sapiens
guaugucacuuucuugaau

SEQ ID NO: 615809 - RNA, 19 nt, Homo sapiens
ccaacacacucaagagaga

SEQ ID NO: 615810 - RNA, 19 nt, Homo sapiens
caagaacauucgagaagug

SEQ ID NO: 615811 - RNA, 19 nt, Homo sapiens
gaucuacgauuuccauaac

SEQ ID NO: 615812 - RNA, 19 nt, Homo sapiens
gcauuugcaugacugagaa

SEQ ID NO: 615813 - RNA, 19 nt, Homo sapiens
uagagaagaugaggguuaa

SEQ ID NO: 615814 - RNA, 19 nt, Homo sapiens
aggcugaacauuucuauua

SEQ ID NO: 615815 - RNA, 19 nt, Homo sapiens
ggacacacuuaucucugaa

SEQ ID NO: 615816 - RNA, 19 nt, Homo sapiens
ccacggagauaaggaaaug

SEQ ID NO: 615817 - RNA, 19 nt, Homo sapiens
gcggaaugcugagguguuu

SEQ ID NO: 615818 - RNA, 19 nt, Homo sapiens
cagaauacguacaccaaug

SEQ ID NO: 615819 - RNA, 19 nt, Homo sapiens
ucugagagguccugaaguu

SEQ ID NO: 615820 - RNA, 19 nt, Homo sapiens
ugaaggaacuuuuaacuug

SEQ ID NO: 615821 - RNA, 19 nt, Homo sapiens
cagacaaauuucagaugua

SEQ ID NO: 615822 - RNA, 19 nt, Homo sapiens
ccagaaggcugagcaguuc

SEQ ID NO: 615823 - RNA, 19 nt, Homo sapiens
caaaggaucaccaaauauc

SEQ ID NO: 615824 - RNA, 19 nt, Homo sapiens
ggacugucuuuguacuuga

SEQ ID NO: 615825 - RNA, 19 nt, Homo sapiens
gaugugacuuguucagugu

SEQ ID NO: 615826 - RNA, 19 nt, Homo sapiens
gaagagugagaagauauaa

SEQ ID NO: 615827 - RNA, 19 nt, Homo sapiens
gaaagagggaagaagaaga

SEQ ID NO: 615828 - RNA, 19 nt, Homo sapiens
gaaagccuccaacauugaa

SEQ ID NO: 615829 - RNA, 19 nt, Homo sapiens
uuugagaucuccuugguuu

SEQ ID NO: 615830 - RNA, 19 nt, Homo sapiens
caggaugccuuucaagugu

SEQ ID NO: 615831 - RNA, 19 nt, Homo sapiens
aggaacugcugaaagaaua

SEQ ID NO: 615832 - RNA, 19 nt, Homo sapiens
gcaggaugcugagaagaug

SEQ ID NO: 615833 - RNA, 19 nt, Homo sapiens
cauguggcccucaucauua

SEQ ID NO: 615834 - RNA, 19 nt, Homo sapiens
gcaacauguuccaagcaaa

SEQ ID NO: 615835 - RNA, 19 nt, Homo sapiens
gggauggaguggaggauau

SEQ ID NO: 615836 - RNA, 19 nt, Homo sapiens
cugaaagccuccaacauug

SEQ ID NO: 615837 - RNA, 19 nt, Homo sapiens
uaacaacaucuuccucaaa

SEQ ID NO: 615838 - RNA, 19 nt, Homo sapiens
caacaucaaccgcaucaug

SEQ ID NO: 615839 - RNA, 19 nt, Homo sapiens
gaaggaaucgugcucucaa

SEQ ID NO: 615840 - RNA, 19 nt, Homo sapiens
gugaggaugugacuuguuc

SEQ ID NO: 615841 - RNA, 19 nt, Homo sapiens
ccacuucuguauuuguuug

SEQ ID NO: 615842 - RNA, 19 nt, Homo sapiens
gaagaagaagggaugaugu

SEQ ID NO: 615843 - RNA, 19 nt, Homo sapiens
gagaaagagggaagaagaa

SEQ ID NO: 615844 - RNA, 19 nt, Homo sapiens
ccaaacagaggaacaauag

SEQ ID NO: 615845 - RNA, 19 nt, Homo sapiens
gagcuuagagcaagaauac

SEQ ID NO: 615846 - RNA, 19 nt, Homo sapiens
ccuccaggcugaagucaaa

SEQ ID NO: 615847 - RNA, 19 nt, Homo sapiens
cacaaucacuuugccauga

SEQ ID NO: 615848 - RNA, 19 nt, Homo sapiens
aggguuaacuuuagccuuu

SEQ ID NO: 615849 - RNA, 19 nt, Homo sapiens
aagaugaggguuaacuuua

SEQ ID NO: 615850 - RNA, 19 nt, Homo sapiens
gcagagaucgaccauguca

SEQ ID NO: 615851 - RNA, 19 nt, Homo sapiens
gaaacagaagaccaacuuu

SEQ ID NO: 615852 - RNA, 19 nt, Homo sapiens
ccaaagaaagccaaugaug

SEQ ID NO: 615853 - RNA, 19 nt, Homo sapiens
ccaacuccaucucuuccua

SEQ ID NO: 615854 - RNA, 19 nt, Homo sapiens
caccuucuuugaugagaua

SEQ ID NO: 615855 - RNA, 19 nt, Homo sapiens
gcgggcaccuucuuugaug

SEQ ID NO: 615856 - RNA, 19 nt, Homo sapiens
gcaaagaaaugcuuacaua

SEQ ID NO: 615857 - RNA, 19 nt, Homo sapiens
guacagagcuccagaacua

SEQ ID NO: 615858 - RNA, 19 nt, Homo sapiens
ggaguaagguugccugaaa

SEQ ID NO: 615859 - RNA, 19 nt, Homo sapiens
gaauaaagauacuggaaga

SEQ ID NO: 615860 - RNA, 19 nt, Homo sapiens
gaaguguucuauuccauuu

SEQ ID NO: 615861 - RNA, 19 nt, Homo sapiens
gaagaauuguggccauaaa

SEQ ID NO: 615862 - RNA, 19 nt, Homo sapiens
gugaugaaguguaggaaua

SEQ ID NO: 615863 - RNA, 19 nt, Homo sapiens
gaugguaccuagucuuuga

SEQ ID NO: 615864 - RNA, 19 nt, Homo sapiens
gaaagacgcuauccuaagc

SEQ ID NO: 615865 - RNA, 19 nt, Homo sapiens
gaaaucaaguuacuaaagc

SEQ ID NO: 615866 - RNA, 19 nt, Homo sapiens
guaccuagucuuugaauuu

SEQ ID NO: 615867 - RNA, 19 nt, Homo sapiens
ggugauagauuuagcaaag

SEQ ID NO: 615868 - RNA, 19 nt, Homo sapiens
uaaagcaacuuaggcauga

SEQ ID NO: 615869 - RNA, 19 nt, Homo sapiens
caaauuuguuuccaaguug

SEQ ID NO: 615870 - RNA, 19 nt, Homo sapiens
gaacagacauuccccauca

SEQ ID NO: 615871 - RNA, 19 nt, Homo sapiens
gcgcuggaauugcuaguuu

SEQ ID NO: 615872 - RNA, 19 nt, Homo sapiens
ggacugagacuauaccaau

SEQ ID NO: 615873 - RNA, 19 nt, Homo sapiens
acagaaagaugccagaaau

SEQ ID NO: 615874 - RNA, 19 nt, Homo sapiens
gauauaaagccagagaaua

SEQ ID NO: 615875 - RNA, 19 nt, Homo sapiens
gaaagaugccagaaauguu

SEQ ID NO: 615876 - RNA, 19 nt, Homo sapiens
caacagcgcuggaauugcu

SEQ ID NO: 615877 - RNA, 19 nt, Homo sapiens
cgagaaaucaaguuacuaa

SEQ ID NO: 615878 - RNA, 19 nt, Homo sapiens
aaagaugauuccuuaguug

SEQ ID NO: 615879 - RNA, 19 nt, Homo sapiens
gaauggugaugaaguguag

SEQ ID NO: 615880 - RNA, 19 nt, Homo sapiens
ccacuuacacacaaucuuu

SEQ ID NO: 615881 - RNA, 19 nt, Homo sapiens
aaagaugccagaaauguuu

SEQ ID NO: 615882 - RNA, 19 nt, Homo sapiens
ggccauugguugucuggua

SEQ ID NO: 615883 - RNA, 19 nt, Homo sapiens
ggaugaugcucuugcacuu

SEQ ID NO: 615884 - RNA, 19 nt, Homo sapiens
gaagggaguuauggaaugg

SEQ ID NO: 615885 - RNA, 19 nt, Homo sapiens
caaauggacuagacuacca

SEQ ID NO: 615886 - RNA, 19 nt, Homo sapiens
ggagaagggaguuauggaa

SEQ ID NO: 615887 - RNA, 19 nt, Homo sapiens
caucaggcauuuauaacau

SEQ ID NO: 615888 - RNA, 19 nt, Homo sapiens
ggcaauagagcuucaaaug

SEQ ID NO: 615889 - RNA, 19 nt, Homo sapiens
ggagguuuauacugauuau

SEQ ID NO: 615890 - RNA, 19 nt, Homo sapiens
acacaauucuugaugacuu

SEQ ID NO: 615891 - RNA, 19 nt, Homo sapiens
gaauuguggccauaaagaa

SEQ ID NO: 615892 - RNA, 19 nt, Homo sapiens
gaugaaguguaggaauaaa

SEQ ID NO: 615893 - RNA, 19 nt, Homo sapiens
caccaugauuucuuucaaa

SEQ ID NO: 615894 - RNA, 19 nt, Homo sapiens
cugaaguggugauagauuu

SEQ ID NO: 615895 - RNA, 19 nt, Homo sapiens
gccauugguugucugguaa

SEQ ID NO: 615896 - RNA, 19 nt, Homo sapiens
gcuaugcgauuuuggauuu

SEQ ID NO: 615897 - RNA, 19 nt, Homo sapiens
gaguaagguugccugaaau

SEQ ID NO: 615898 - RNA, 19 nt, Homo sapiens
ucugguaacugaaauguuc

SEQ ID NO: 615899 - RNA, 19 nt, Homo sapiens
ggaauggugaugaagugua

SEQ ID NO: 615900 - RNA, 19 nt, Homo sapiens
cuauaccaauucaggguua

SEQ ID NO: 615901 - RNA, 19 nt, Homo sapiens
uaccaaugcugaucccaaa

SEQ ID NO: 615902 - RNA, 19 nt, Homo sapiens
uggcaaggcuguugaugug

SEQ ID NO: 615903 - RNA, 19 nt, Homo sapiens
ggaauuggauuuugucaca

SEQ ID NO: 615904 - RNA, 19 nt, Homo sapiens
ccaaguaguucaaaaguau

SEQ ID NO: 615905 - RNA, 19 nt, Homo sapiens
ggaagaauuguggccauaa

SEQ ID NO: 615906 - RNA, 19 nt, Homo sapiens
guuauggaauggugaugaa

SEQ ID NO: 615907 - RNA, 19 nt, Homo sapiens
ccuacaccaugauuucuuu

SEQ ID NO: 615908 - RNA, 19 nt, Homo sapiens
gugaaucucuuggaagugu

SEQ ID NO: 615909 - RNA, 19 nt, Homo sapiens
uggaauugcuaguuugcua

SEQ ID NO: 615910 - RNA, 19 nt, Homo sapiens
aaagauacuggaagaauug

SEQ ID NO: 615911 - RNA, 19 nt, Homo sapiens
gacugagacuauaccaauu

SEQ ID NO: 615912 - RNA, 19 nt, Homo sapiens
agaagggaguuauggaaug

SEQ ID NO: 615913 - RNA, 19 nt, Homo sapiens
gcaauagagcuucaaaugc

SEQ ID NO: 615914 - RNA, 19 nt, Homo sapiens
ugaaguggugauagauuua

SEQ ID NO: 615915 - RNA, 19 nt, Homo sapiens
ucucugaaguggugauaga

SEQ ID NO: 615916 - RNA, 19 nt, Homo sapiens
ucacaacagcgcuggaauu

SEQ ID NO: 615917 - RNA, 19 nt, Homo sapiens
gagaagggaguuauggaau

SEQ ID NO: 615918 - RNA, 19 nt, Homo sapiens
gcgaacggauugaagaaac

SEQ ID NO: 615919 - RNA, 19 nt, Homo sapiens
uuacagaguggaugagaaa

SEQ ID NO: 615920 - RNA, 19 nt, Homo sapiens
gaugauuccuuaguugaag

SEQ ID NO: 615921 - RNA, 19 nt, Homo sapiens
ucacagucacaauaucaua

SEQ ID NO: 615922 - RNA, 19 nt, Homo sapiens
agaaagugacgaugacaaa

SEQ ID NO: 615923 - RNA, 19 nt, Homo sapiens
uggacuagacuaccaagua

SEQ ID NO: 615924 - RNA, 19 nt, Homo sapiens
uaccuagucuuugaauuug

SEQ ID NO: 615925 - RNA, 19 nt, Homo sapiens
ugaaaucaaggaaagagaa

SEQ ID NO: 615926 - RNA, 19 nt, Homo sapiens
uggaagaauuguggccaua

SEQ ID NO: 615927 - RNA, 19 nt, Homo sapiens
gguuggugaugucaaguau

SEQ ID NO: 615928 - RNA, 19 nt, Homo sapiens
ugaaguguaggaauaaaga

SEQ ID NO: 615929 - RNA, 19 nt, Homo sapiens
ugaacuggaugaugcucuu

SEQ ID NO: 615930 - RNA, 19 nt, Homo sapiens
ggacaagccacaacaaaau

SEQ ID NO: 615931 - RNA, 19 nt, Homo sapiens
agaaagaugccagaaaugu

SEQ ID NO: 615932 - RNA, 19 nt, Homo sapiens
uaagguugccugaaaucaa

SEQ ID NO: 615933 - RNA, 19 nt, Homo sapiens
ccuagucuuugaauuuguu

SEQ ID NO: 615934 - RNA, 19 nt, Homo sapiens
guuacagaguggaugagaa

SEQ ID NO: 615935 - RNA, 19 nt, Homo sapiens
acacaaucuuucugcaguu

SEQ ID NO: 615936 - RNA, 19 nt, Homo sapiens
cucaaagacugcagcaaug

SEQ ID NO: 615937 - RNA, 19 nt, Homo sapiens
ccucaaagacugcagcaau

SEQ ID NO: 615938 - RNA, 19 nt, Homo sapiens
uuccuuaguugaagaaaga

SEQ ID NO: 615939 - RNA, 19 nt, Homo sapiens
cugcgaaccauaugcauuu

SEQ ID NO: 615940 - RNA, 19 nt, Homo sapiens
gguuuauacugauuaugug

SEQ ID NO: 615941 - RNA, 19 nt, Homo sapiens
cacaauucuugaugacuug

SEQ ID NO: 615942 - RNA, 19 nt, Homo sapiens
gcaaugcgagaaaucaagu

SEQ ID NO: 615943 - RNA, 19 nt, Homo sapiens
uggauuugcugagagguuu

SEQ ID NO: 615944 - RNA, 19 nt, Homo sapiens
gugauagauuuagcaaaga

SEQ ID NO: 615945 - RNA, 19 nt, Homo sapiens
ugaauuuguugaccacaca

SEQ ID NO: 615946 - RNA, 19 nt, Homo sapiens
cccaagacuuugugccuau

SEQ ID NO: 615947 - RNA, 19 nt, Homo sapiens
ucaacaagccucaaagacu

SEQ ID NO: 615948 - RNA, 19 nt, Homo sapiens
ugaaagacgcuauccuaag

SEQ ID NO: 615949 - RNA, 19 nt, Homo sapiens
cuugaaagacgcuauccua

SEQ ID NO: 615950 - RNA, 19 nt, Homo sapiens
uugguugucugguaacuga

SEQ ID NO: 615951 - RNA, 19 nt, Homo sapiens
gggagguuuauacugauua

SEQ ID NO: 615952 - RNA, 19 nt, Homo sapiens
ccacacaauucuugaugac

SEQ ID NO: 615953 - RNA, 19 nt, Homo sapiens
gaccacacaauucuugaug

SEQ ID NO: 615954 - RNA, 19 nt, Homo sapiens
gcuccuacaccaugauuuc

SEQ ID NO: 615955 - RNA, 19 nt, Homo sapiens
uccuggagauucugauauu

SEQ ID NO: 615956 - RNA, 19 nt, Homo sapiens
guuauaaacugaaccauga

SEQ ID NO: 615957 - RNA, 19 nt, Homo sapiens
ggagaggaauuaugagaug

SEQ ID NO: 615958 - RNA, 19 nt, Homo sapiens
gagcuaaggacacuuguuu

SEQ ID NO: 615959 - RNA, 19 nt, Homo sapiens
ggaaauaaaggaucuauac

SEQ ID NO: 615960 - RNA, 19 nt, Homo sapiens
gaaaagagaggguggauaa

SEQ ID NO: 615961 - RNA, 19 nt, Homo sapiens
ggaagaugcuccagaaagg

SEQ ID NO: 615962 - RNA, 19 nt, Homo sapiens
cagcaggcgugucauguaa

SEQ ID NO: 615963 - RNA, 19 nt, Homo sapiens
ggacuuugcauaucauuug

SEQ ID NO: 615964 - RNA, 19 nt, Homo sapiens
ucucagacccuguguauuu

SEQ ID NO: 615965 - RNA, 19 nt, Homo sapiens
gcauggacuuugcauauca

SEQ ID NO: 615966 - RNA, 19 nt, Homo sapiens
uaaggaggaugaucucaga

SEQ ID NO: 615967 - RNA, 19 nt, Homo sapiens
caugaaagaugaccuugug

SEQ ID NO: 615968 - RNA, 19 nt, Homo sapiens
aggcagagcuggugucaga

SEQ ID NO: 615969 - RNA, 19 nt, Homo sapiens
ggggcaaccugcauaauua

SEQ ID NO: 615970 - RNA, 19 nt, Homo sapiens
ugugagcccugccucuuua

SEQ ID NO: 615971 - RNA, 19 nt, Homo sapiens
ugucagugcucauuuaugu

SEQ ID NO: 615972 - RNA, 19 nt, Homo sapiens
gaacgucucuaaggaggau

SEQ ID NO: 615973 - RNA, 19 nt, Homo sapiens
gagcucagaacgucucuaa

SEQ ID NO: 615974 - RNA, 19 nt, Homo sapiens
gaaaugggacccugugucu

SEQ ID NO: 615975 - RNA, 19 nt, Homo sapiens
gcucauuuauguggcauuu

SEQ ID NO: 615976 - RNA, 19 nt, Homo sapiens
gaucucagacccuguguau

SEQ ID NO: 615977 - RNA, 19 nt, Homo sapiens
gaaagaugaccuugugaca

SEQ ID NO: 615978 - RNA, 19 nt, Homo sapiens
ggaacaggaagaagaagaa

SEQ ID NO: 615979 - RNA, 19 nt, Homo sapiens
ggaugaggaugaagaagag

SEQ ID NO: 615980 - RNA, 19 nt, Homo sapiens
ccagaucuccauccacuuu

SEQ ID NO: 615981 - RNA, 19 nt, Homo sapiens
uagugucagugcucauuua

SEQ ID NO: 615982 - RNA, 19 nt, Homo sapiens
uggagacucuuccugguuu

SEQ ID NO: 615983 - RNA, 19 nt, Homo sapiens
ggacaugaaagaugaccuu

SEQ ID NO: 615984 - RNA, 19 nt, Homo sapiens
gaaggugccggcugaggaa

SEQ ID NO: 615985 - RNA, 19 nt, Homo sapiens
ggaugguccugcagagaga

SEQ ID NO: 615986 - RNA, 19 nt, Homo sapiens
caaccugcauaauuaucaa

SEQ ID NO: 615987 - RNA, 19 nt, Homo sapiens
cgcaggacaugaaagauga

SEQ ID NO: 615988 - RNA, 19 nt, Homo sapiens
caaaggccuucaccagcaa

SEQ ID NO: 615989 - RNA, 19 nt, Homo sapiens
ggagaaucaucagcugaga

SEQ ID NO: 615990 - RNA, 19 nt, Homo sapiens
ucacacagcaccucucaau

SEQ ID NO: 615991 - RNA, 19 nt, Homo sapiens
aauuaucaauggcgacuuu

SEQ ID NO: 615992 - RNA, 19 nt, Homo sapiens
ggacacauccagccuaagg

SEQ ID NO: 615993 - RNA, 19 nt, Homo sapiens
ggucuaugcccgacaauuc

SEQ ID NO: 615994 - RNA, 19 nt, Homo sapiens
ccaggaagacgucaaagug

SEQ ID NO: 615995 - RNA, 19 nt, Homo sapiens
acaccuuuguuccucaaua

SEQ ID NO: 615996 - RNA, 19 nt, Homo sapiens
gggagagcguuaccuaugg

SEQ ID NO: 615997 - RNA, 19 nt, Homo sapiens
gaacagggcccagcuucca

SEQ ID NO: 615998 - RNA, 19 nt, Homo sapiens
agaugcagcuccaggaaga

SEQ ID NO: 615999 - RNA, 19 nt, Homo sapiens
ugagggaccuggcugucuu

SEQ ID NO: 616000 - RNA, 19 nt, Homo sapiens
gcaaccugcauaauuauca

SEQ ID NO: 616001 - RNA, 19 nt, Homo sapiens
aaacugaaccaugaccuuu

SEQ ID NO: 616002 - RNA, 19 nt, Homo sapiens
gcucagaacgucucuaagg

SEQ ID NO: 616003 - RNA, 19 nt, Homo sapiens
gggagaaguacauggauug

SEQ ID NO: 616004 - RNA, 19 nt, Homo sapiens
ggagaaggaaauccagaug

SEQ ID NO: 616005 - RNA, 19 nt, Homo sapiens
ggaagacgucaaagugaug

SEQ ID NO: 616006 - RNA, 19 nt, Homo sapiens
gcauaucauuugcauagac

SEQ ID NO: 616007 - RNA, 19 nt, Homo sapiens
agaaggaaauccagaugca

SEQ ID NO: 616008 - RNA, 19 nt, Homo sapiens
ucgacacucuugaggauga

SEQ ID NO: 616009 - RNA, 19 nt, Homo sapiens
ggaggaugaggaugaagaa

SEQ ID NO: 616010 - RNA, 19 nt, Homo sapiens
ccaaggaggagauuuuaua

SEQ ID NO: 616011 - RNA, 19 nt, Homo sapiens
aagaugaccuugugacacu

SEQ ID NO: 616012 - RNA, 19 nt, Homo sapiens
cauaucauuugcauagaca

SEQ ID NO: 616013 - RNA, 19 nt, Homo sapiens
uaccugcugugcuuauuug

SEQ ID NO: 616014 - RNA, 19 nt, Homo sapiens
cgggagaaguacauggauu

SEQ ID NO: 616015 - RNA, 19 nt, Homo sapiens
caggaagacgucaaaguga

SEQ ID NO: 616016 - RNA, 19 nt, Homo sapiens
agaagaagaagcagaggaa

SEQ ID NO: 616017 - RNA, 19 nt, Homo sapiens
acacagcaccucucaaucu

SEQ ID NO: 616018 - RNA, 19 nt, Homo sapiens
gugagcgccuucccaacaa

SEQ ID NO: 616019 - RNA, 19 nt, Homo sapiens
guaagcuugugcagguuau

SEQ ID NO: 616020 - RNA, 19 nt, Homo sapiens
cauccagccuaagguauga

SEQ ID NO: 616021 - RNA, 19 nt, Homo sapiens
gcagcgggcaucuggaaga

SEQ ID NO: 616022 - RNA, 19 nt, Homo sapiens
ucagagagcuaaggacacu

SEQ ID NO: 616023 - RNA, 19 nt, Homo sapiens
cagaagaggaacaggaaga

SEQ ID NO: 616024 - RNA, 19 nt, Homo sapiens
aaaggaggcagaagaggaa

SEQ ID NO: 616025 - RNA, 19 nt, Homo sapiens
ugaggaggaugaggaugaa

SEQ ID NO: 616026 - RNA, 19 nt, Homo sapiens
gagcuucucccaccugucu

SEQ ID NO: 616027 - RNA, 19 nt, Homo sapiens
gcaagggccacaguuggaa

SEQ ID NO: 616028 - RNA, 19 nt, Homo sapiens
gaugaggcaacgcggauga

SEQ ID NO: 616029 - RNA, 19 nt, Homo sapiens
acacauccagccuaaggua

SEQ ID NO: 616030 - RNA, 19 nt, Homo sapiens
uuauggagaggaauuauga

SEQ ID NO: 616031 - RNA, 19 nt, Homo sapiens
gaagaggaggaggaagaaa

SEQ ID NO: 616032 - RNA, 19 nt, Homo sapiens
gcuaaggacacuuguuugg

SEQ ID NO: 616033 - RNA, 19 nt, Homo sapiens
cagcagcagucaaaacaaa

SEQ ID NO: 616034 - RNA, 19 nt, Homo sapiens
ccucucaacucgacacucu

SEQ ID NO: 616035 - RNA, 19 nt, Homo sapiens
guucugcccuuucccacau

SEQ ID NO: 616036 - RNA, 19 nt, Homo sapiens
acugaaccaugaccuuuau

SEQ ID NO: 616037 - RNA, 19 nt, Homo sapiens
gaggaacagaugcucauuc

SEQ ID NO: 616038 - RNA, 19 nt, Homo sapiens
ggcagaagaggaacaggaa

SEQ ID NO: 616039 - RNA, 19 nt, Homo sapiens
aagaagaggaggaggaaga

SEQ ID NO: 616040 - RNA, 19 nt, Homo sapiens
ccacaccuuuguuccucaa

SEQ ID NO: 616041 - RNA, 19 nt, Homo sapiens
gaagcacuguguccuaacc

SEQ ID NO: 616042 - RNA, 19 nt, Homo sapiens
acgucaaagugauguuaua

SEQ ID NO: 616043 - RNA, 19 nt, Homo sapiens
aggaacagaugcucauucu

SEQ ID NO: 616044 - RNA, 19 nt, Homo sapiens
cuccagcucuacucagauu

SEQ ID NO: 616045 - RNA, 19 nt, Homo sapiens
gcaccucucaaucuccuau

SEQ ID NO: 616046 - RNA, 19 nt, Homo sapiens
ccacccugguucuuguuga

SEQ ID NO: 616047 - RNA, 19 nt, Homo sapiens
ucagcaggcgugucaugua

SEQ ID NO: 616048 - RNA, 19 nt, Homo sapiens
agacgucaaagugauguua

SEQ ID NO: 616049 - RNA, 19 nt, Homo sapiens
caccuuuguuccucaauag

SEQ ID NO: 616050 - RNA, 19 nt, Homo sapiens
ucccuguucuucauccuuu

SEQ ID NO: 616051 - RNA, 19 nt, Homo sapiens
gggcaaccugcauaauuau

SEQ ID NO: 616052 - RNA, 19 nt, Homo sapiens
gcaggcgugucauguaagc

SEQ ID NO: 616053 - RNA, 19 nt, Homo sapiens
ucauuuauguggcauuugc

SEQ ID NO: 616054 - RNA, 19 nt, Homo sapiens
ggagacucuuccugguuuc

SEQ ID NO: 616055 - RNA, 19 nt, Homo sapiens
agaaucaucagcugagaga

SEQ ID NO: 616056 - RNA, 19 nt, Homo sapiens
gaagaaacgugaucccauu

SEQ ID NO: 616057 - RNA, 19 nt, Homo sapiens
caucaccucugucuaguua

SEQ ID NO: 616058 - RNA, 19 nt, Homo sapiens
gcagugagcuaugauugua

SEQ ID NO: 616059 - RNA, 19 nt, Homo sapiens
gagccugucucuaaauuaa

SEQ ID NO: 616060 - RNA, 19 nt, Homo sapiens
gcagaacugugagacaaua

SEQ ID NO: 616061 - RNA, 19 nt, Homo sapiens
ccacaaaucuuuccaacuc

SEQ ID NO: 616062 - RNA, 19 nt, Homo sapiens
ggaaucauguacucuguga

SEQ ID NO: 616063 - RNA, 19 nt, Homo sapiens
ccaaguagcugggauaaca

SEQ ID NO: 616064 - RNA, 19 nt, Homo sapiens
gagcgacucugucuccaaa

SEQ ID NO: 616065 - RNA, 19 nt, Homo sapiens
gaaauccuaucucuaccaa

SEQ ID NO: 616066 - RNA, 19 nt, Homo sapiens
gggcagccuuccugguuua

SEQ ID NO: 616067 - RNA, 19 nt, Homo sapiens
aaugugaccuuauuuggaa

SEQ ID NO: 616068 - RNA, 19 nt, Homo sapiens
gggauaaggugggacaaug

SEQ ID NO: 616069 - RNA, 19 nt, Homo sapiens
ccacuucccuuccgcacuu

SEQ ID NO: 616070 - RNA, 19 nt, Homo sapiens
gaucccaucucuacacaca

SEQ ID NO: 616071 - RNA, 19 nt, Homo sapiens
gugguguccucauaagaua

SEQ ID NO: 616072 - RNA, 19 nt, Homo sapiens
gaaugugaccuuauuugga

SEQ ID NO: 616073 - RNA, 19 nt, Homo sapiens
gauggaggauugcuugaag

SEQ ID NO: 616074 - RNA, 19 nt, Homo sapiens
gcucacgccuauaaucuca

SEQ ID NO: 616075 - RNA, 19 nt, Homo sapiens
ccaccaugcugcugaugaa

SEQ ID NO: 616076 - RNA, 19 nt, Homo sapiens
agacggaguuucaccaugu

SEQ ID NO: 616077 - RNA, 19 nt, Homo sapiens
ggacacagagacacacaga

SEQ ID NO: 616078 - RNA, 19 nt, Homo sapiens
gaagaggagaggacacaga

SEQ ID NO: 616079 - RNA, 19 nt, Homo sapiens
acaaaucuuuccaacucua

SEQ ID NO: 616080 - RNA, 19 nt, Homo sapiens
ggugaaauccuaucucuac

SEQ ID NO: 616081 - RNA, 19 nt, Homo sapiens
ggagugcaguggcgugauc

SEQ ID NO: 616082 - RNA, 19 nt, Homo sapiens
ugaccacccucaacccauu

SEQ ID NO: 616083 - RNA, 19 nt, Homo sapiens
gccugucucuaaauuaauu

SEQ ID NO: 616084 - RNA, 19 nt, Homo sapiens
gcuuugggaugucucuuga

SEQ ID NO: 616085 - RNA, 19 nt, Homo sapiens
caaggcggauggaucacuu

SEQ ID NO: 616086 - RNA, 19 nt, Homo sapiens
caccgcacccugcuaauuu

SEQ ID NO: 616087 - RNA, 19 nt, Homo sapiens
gcugcguucuccugacuuu

SEQ ID NO: 616088 - RNA, 19 nt, Homo sapiens
uggcuaacauggugaaauc

SEQ ID NO: 616089 - RNA, 19 nt, Homo sapiens
gcaaucaucaccucugucu

SEQ ID NO: 616090 - RNA, 19 nt, Homo sapiens
ucacgauacugugcaauca

SEQ ID NO: 616091 - RNA, 19 nt, Homo sapiens
acacagagacacacagaga

SEQ ID NO: 616092 - RNA, 19 nt, Homo sapiens
ggccaagucugugccaaug

SEQ ID NO: 616093 - RNA, 19 nt, Homo sapiens
cuaacauggugaaauccua

SEQ ID NO: 616094 - RNA, 19 nt, Homo sapiens
ucaauggaaucauguacuc

SEQ ID NO: 616095 - RNA, 19 nt, Homo sapiens
ucccaucucuacacacaaa

SEQ ID NO: 616096 - RNA, 19 nt, Homo sapiens
ggacggacacaaacuaagg

SEQ ID NO: 616097 - RNA, 19 nt, Homo sapiens
aaucauguacucugugaaa

SEQ ID NO: 616098 - RNA, 19 nt, Homo sapiens
aggccaagauggaggauug

SEQ ID NO: 616099 - RNA, 19 nt, Homo sapiens
cagaaugugaccuuauuug

SEQ ID NO: 616100 - RNA, 19 nt, Homo sapiens
cucagaaugugaccuuauu

SEQ ID NO: 616101 - RNA, 19 nt, Homo sapiens
ccucagcacuaaccacauc

SEQ ID NO: 616102 - RNA, 19 nt, Homo sapiens
gcguggaucccuucaucua

SEQ ID NO: 616103 - RNA, 19 nt, Homo sapiens
ugggaugucucuugagcaa

SEQ ID NO: 616104 - RNA, 19 nt, Homo sapiens
cugcagaacugugagacaa

SEQ ID NO: 616105 - RNA, 19 nt, Homo sapiens
ccuauaaucucagcacucu

SEQ ID NO: 616106 - RNA, 19 nt, Homo sapiens
gugcaaucaucaccucugu

SEQ ID NO: 616107 - RNA, 19 nt, Homo sapiens
gagcucaggcccagaacug

SEQ ID NO: 616108 - RNA, 19 nt, Homo sapiens
gagaagaggagaggacaca

SEQ ID NO: 616109 - RNA, 19 nt, Homo sapiens
ccucuuugcuccagugaca

SEQ ID NO: 616110 - RNA, 19 nt, Homo sapiens
cuaaccacauccacucuca

SEQ ID NO: 616111 - RNA, 19 nt, Homo sapiens
gucaaugucaccagggaua

SEQ ID NO: 616112 - RNA, 19 nt, Homo sapiens
gaacugugagacaauaaac

SEQ ID NO: 616113 - RNA, 19 nt, Homo sapiens
gcggacggacacaaacuaa

SEQ ID NO: 616114 - RNA, 19 nt, Homo sapiens
uaacauggugaaauccuau

SEQ ID NO: 616115 - RNA, 19 nt, Homo sapiens
gaugacagcacgcccucaa

SEQ ID NO: 616116 - RNA, 19 nt, Homo sapiens
ggccaaggcggauggauca

SEQ ID NO: 616117 - RNA, 19 nt, Homo sapiens
ugugggugguguccucaua

SEQ ID NO: 616118 - RNA, 19 nt, Homo sapiens
ucaccugccuggcgcuguu

SEQ ID NO: 616119 - RNA, 19 nt, Homo sapiens
ucaccucugucuaguuaca

SEQ ID NO: 616120 - RNA, 19 nt, Homo sapiens
aaucaucaccucugucuag

SEQ ID NO: 616121 - RNA, 19 nt, Homo sapiens
gacggaguuucaccauguu

SEQ ID NO: 616122 - RNA, 19 nt, Homo sapiens
ugccucagccucccaagua

SEQ ID NO: 616123 - RNA, 19 nt, Homo sapiens
ggugguguccucauaagau

SEQ ID NO: 616124 - RNA, 19 nt, Homo sapiens
ucugaaacaccacuccuuu

SEQ ID NO: 616125 - RNA, 19 nt, Homo sapiens
gagccugguuggccauucu

SEQ ID NO: 616126 - RNA, 19 nt, Homo sapiens
ugaaacaggaucaaacucu

SEQ ID NO: 616127 - RNA, 19 nt, Homo sapiens
gggaucccaucucuacaca

SEQ ID NO: 616128 - RNA, 19 nt, Homo sapiens
ugcaguggcucacgccuau

SEQ ID NO: 616129 - RNA, 19 nt, Homo sapiens
acucuauggucacauguau

SEQ ID NO: 616130 - RNA, 19 nt, Homo sapiens
gagaggacacagagacaca

SEQ ID NO: 616131 - RNA, 19 nt, Homo sapiens
agucagcacauucacgaua

SEQ ID NO: 616132 - RNA, 19 nt, Homo sapiens
ccaccgcacccugcuaauu

SEQ ID NO: 616133 - RNA, 19 nt, Homo sapiens
gagacacacagagaagaaa

SEQ ID NO: 616134 - RNA, 19 nt, Homo sapiens
aauccuaucucuaccaaaa

SEQ ID NO: 616135 - RNA, 19 nt, Homo sapiens
cagccugagugcagucaug

SEQ ID NO: 616136 - RNA, 19 nt, Homo sapiens
cagccuuccugguuuaucu

SEQ ID NO: 616137 - RNA, 19 nt, Homo sapiens
caacuccugcccucaagug

SEQ ID NO: 616138 - RNA, 19 nt, Homo sapiens
gauguuggcagccgguugu

SEQ ID NO: 616139 - RNA, 19 nt, Homo sapiens
ccaagucugugccaaugac

SEQ ID NO: 616140 - RNA, 19 nt, Homo sapiens
ggauaaggugggacaaugg

SEQ ID NO: 616141 - RNA, 19 nt, Homo sapiens
acgacgcacuggugucuga

SEQ ID NO: 616142 - RNA, 19 nt, Homo sapiens
caguggcucacgccuauaa

SEQ ID NO: 616143 - RNA, 19 nt, Homo sapiens
ugacagcacgcccucaauc

SEQ ID NO: 616144 - RNA, 19 nt, Homo sapiens
ucagaaugugaccuuauuu

SEQ ID NO: 616145 - RNA, 19 nt, Homo sapiens
cuacggauuugccuguucu

SEQ ID NO: 616146 - RNA, 19 nt, Homo sapiens
ccaggacgcgugaaacaca

SEQ ID NO: 616147 - RNA, 19 nt, Homo sapiens
ggagacucacugcaaguuc

SEQ ID NO: 616148 - RNA, 19 nt, Homo sapiens
guggaucccuucaucuacu

SEQ ID NO: 616149 - RNA, 19 nt, Homo sapiens
uggccaugcugcugugcua

SEQ ID NO: 616150 - RNA, 19 nt, Homo sapiens
ucacuugagcccaggaguu

SEQ ID NO: 616151 - RNA, 19 nt, Homo sapiens
caaccacaaaucuuuccaa

SEQ ID NO: 616152 - RNA, 19 nt, Homo sapiens
cuccuggguucaaaugauu

SEQ ID NO: 616153 - RNA, 19 nt, Homo sapiens
ccuccuggguucaaaugau

SEQ ID NO: 616154 - RNA, 19 nt, Homo sapiens
gcaggcugauccuucuuuu

SEQ ID NO: 616155 - RNA, 19 nt, Homo sapiens
caucugaggccaggaguuc

SEQ ID NO: 616156 - RNA, 19 nt, Homo sapiens
ugaaaggaauugcauguga

SEQ ID NO: 616157 - RNA, 19 nt, Homo sapiens
ccaguucucucucuaccua

SEQ ID NO: 616158 - RNA, 19 nt, Homo sapiens
gaagggacagggcaacaaa

SEQ ID NO: 616159 - RNA, 19 nt, Homo sapiens
aagcagagcucgccaccuu

SEQ ID NO: 616160 - RNA, 19 nt, Homo sapiens
gcaacaaaauacaguagua

SEQ ID NO: 616161 - RNA, 19 nt, Homo sapiens
ugaagaugcuggacacuca

SEQ ID NO: 616162 - RNA, 19 nt, Homo sapiens
ggaagcugaugcuggagaa

SEQ ID NO: 616163 - RNA, 19 nt, Homo sapiens
gagagaugauggcugaugu

SEQ ID NO: 616164 - RNA, 19 nt, Homo sapiens
gcacuaagaagaagacagu

SEQ ID NO: 616165 - RNA, 19 nt, Homo sapiens
gaagaugaauuggaauggu

SEQ ID NO: 616166 - RNA, 19 nt, Homo sapiens
gcaggucccucaguucuca

SEQ ID NO: 616167 - RNA, 19 nt, Homo sapiens
ggagcuagcccaaucauac

SEQ ID NO: 616168 - RNA, 19 nt, Homo sapiens
gaugaugagccaagcaauu

SEQ ID NO: 616169 - RNA, 19 nt, Homo sapiens
gcacacacccguccucucu

SEQ ID NO: 616170 - RNA, 19 nt, Homo sapiens
gaugauggcugauguuccu

SEQ ID NO: 616171 - RNA, 19 nt, Homo sapiens
guacccaguucucucucua

SEQ ID NO: 616172 - RNA, 19 nt, Homo sapiens
ggucugauguuuccuacag

SEQ ID NO: 616173 - RNA, 19 nt, Homo sapiens
cgacgucccugaccucucu

SEQ ID NO: 616174 - RNA, 19 nt, Homo sapiens
ucaggcaggucccucaguu

SEQ ID NO: 616175 - RNA, 19 nt, Homo sapiens
ggaggccacugugaugaug

SEQ ID NO: 616176 - RNA, 19 nt, Homo sapiens
gaggaugggcugcggcaaa

SEQ ID NO: 616177 - RNA, 19 nt, Homo sapiens
gaucagccgguuccucuug

SEQ ID NO: 616178 - RNA, 19 nt, Homo sapiens
cagguuggcuggugaaagg

SEQ ID NO: 616179 - RNA, 19 nt, Homo sapiens
gcaguggaagauucuguuu

SEQ ID NO: 616180 - RNA, 19 nt, Homo sapiens
gacaccagcuccccucaua

SEQ ID NO: 616181 - RNA, 19 nt, Homo sapiens
gggucugucugguuucuga

SEQ ID NO: 616182 - RNA, 19 nt, Homo sapiens
gaaagcaccgaccauaggu

SEQ ID NO: 616183 - RNA, 19 nt, Homo sapiens
agaagacaguggucagugu

SEQ ID NO: 616184 - RNA, 19 nt, Homo sapiens
ggaugugacugagcagauc

SEQ ID NO: 616185 - RNA, 19 nt, Homo sapiens
uagcugcaguggaagauuc

SEQ ID NO: 616186 - RNA, 19 nt, Homo sapiens
cuuggcagcugaagaugaa

SEQ ID NO: 616187 - RNA, 19 nt, Homo sapiens
gauccagguucagggacua

SEQ ID NO: 616188 - RNA, 19 nt, Homo sapiens
ggcgggagaugucuucuac

SEQ ID NO: 616189 - RNA, 19 nt, Homo sapiens
gaagaagacaguggucagu

SEQ ID NO: 616190 - RNA, 19 nt, Homo sapiens
ucauggagacguagccuuu

SEQ ID NO: 616191 - RNA, 19 nt, Homo sapiens
ucacggucaugucaguuug

SEQ ID NO: 616192 - RNA, 19 nt, Homo sapiens
cagguucagggacuaaaua

SEQ ID NO: 616193 - RNA, 19 nt, Homo sapiens
ccugaccucucuuucaugu

SEQ ID NO: 616194 - RNA, 19 nt, Homo sapiens
gagcuagcccaaucauaca

SEQ ID NO: 616195 - RNA, 19 nt, Homo sapiens
ggugaaaggaauugcaugu

SEQ ID NO: 616196 - RNA, 19 nt, Homo sapiens
ccacagcuacuaccugaca

SEQ ID NO: 616197 - RNA, 19 nt, Homo sapiens
ccugaaagcaccgaccaua

SEQ ID NO: 616198 - RNA, 19 nt, Homo sapiens
ggacaggcugcauuuccaa

SEQ ID NO: 616199 - RNA, 19 nt, Homo sapiens
aacaggagcuagcccaauc

SEQ ID NO: 616200 - RNA, 19 nt, Homo sapiens
ccugugggcugucgauagu

SEQ ID NO: 616201 - RNA, 19 nt, Homo sapiens
acacacccguccucucuag

SEQ ID NO: 616202 - RNA, 19 nt, Homo sapiens
gcuguggucuguugcuuuu

SEQ ID NO: 616203 - RNA, 19 nt, Homo sapiens
acacuuggcagcugaagau

SEQ ID NO: 616204 - RNA, 19 nt, Homo sapiens
ggacagcacccaccuucac

SEQ ID NO: 616205 - RNA, 19 nt, Homo sapiens
gagaugauggcugauguuc

SEQ ID NO: 616206 - RNA, 19 nt, Homo sapiens
cgggagaugucuucuacca

SEQ ID NO: 616207 - RNA, 19 nt, Homo sapiens
gggagccgcacuaagaaga

SEQ ID NO: 616208 - RNA, 19 nt, Homo sapiens
ugccuaagggagacauuua

SEQ ID NO: 616209 - RNA, 19 nt, Homo sapiens
ugacucgcguggguguuaa

SEQ ID NO: 616210 - RNA, 19 nt, Homo sapiens
gagcucaugcagagagaug

SEQ ID NO: 616211 - RNA, 19 nt, Homo sapiens
uagaggacaagcucaguga

SEQ ID NO: 616212 - RNA, 19 nt, Homo sapiens
ugaaagcaccgaccauagg

SEQ ID NO: 616213 - RNA, 19 nt, Homo sapiens
gcaccggagugaagaugcu

SEQ ID NO: 616214 - RNA, 19 nt, Homo sapiens
gggaacguguccugcuuac

SEQ ID NO: 616215 - RNA, 19 nt, Homo sapiens
agacaguggucagugugaa

SEQ ID NO: 616216 - RNA, 19 nt, Homo sapiens
ggagccgcacuaagaagaa

SEQ ID NO: 616217 - RNA, 19 nt, Homo sapiens
acccgggucugucugguuu

SEQ ID NO: 616218 - RNA, 19 nt, Homo sapiens
ggacagggcaacaaaauac

SEQ ID NO: 616219 - RNA, 19 nt, Homo sapiens
gcagagcucgccaccuucu

SEQ ID NO: 616220 - RNA, 19 nt, Homo sapiens
gcggagggaggaagaggaa

SEQ ID NO: 616221 - RNA, 19 nt, Homo sapiens
ugccgaugcugaaguggaa

SEQ ID NO: 616222 - RNA, 19 nt, Homo sapiens
agcugaugcuggagaauuu

SEQ ID NO: 616223 - RNA, 19 nt, Homo sapiens
gccgguuccucuuggauca

SEQ ID NO: 616224 - RNA, 19 nt, Homo sapiens
augaugagccaagcaauuu

SEQ ID NO: 616225 - RNA, 19 nt, Homo sapiens
caucagagcagcggcagau

SEQ ID NO: 616226 - RNA, 19 nt, Homo sapiens
ugaaggcccugcuaaaagu

SEQ ID NO: 616227 - RNA, 19 nt, Homo sapiens
ucgacucccucccugcauu

SEQ ID NO: 616228 - RNA, 19 nt, Homo sapiens
ggguucuacuugagauuuc

SEQ ID NO: 616229 - RNA, 19 nt, Homo sapiens
cagcugaagaugaauugga

SEQ ID NO: 616230 - RNA, 19 nt, Homo sapiens
ggccuguguugcugggauu

SEQ ID NO: 616231 - RNA, 19 nt, Homo sapiens
agucaggccuagaggacaa

SEQ ID NO: 616232 - RNA, 19 nt, Homo sapiens
cgacucccucccugcauuu

SEQ ID NO: 616233 - RNA, 19 nt, Homo sapiens
cucacuggcugaccugcua

SEQ ID NO: 616234 - RNA, 19 nt, Homo sapiens
gcccaggacaggcugcauu

SEQ ID NO: 616235 - RNA, 19 nt, Homo sapiens
gagccgcacuaagaagaag

SEQ ID NO: 616236 - RNA, 19 nt, Homo sapiens
ugucgauagugcccucuga

SEQ ID NO: 616237 - RNA, 19 nt, Homo sapiens
ucccugaccucucuuucau

SEQ ID NO: 616238 - RNA, 19 nt, Homo sapiens
agcugaagaugaauuggaa

SEQ ID NO: 616239 - RNA, 19 nt, Homo sapiens
gcucaguggccauguggau

SEQ ID NO: 616240 - RNA, 19 nt, Homo sapiens
gggcuguggucuguugcuu

SEQ ID NO: 616241 - RNA, 19 nt, Homo sapiens
gaugggcugcggcaaaucu

SEQ ID NO: 616242 - RNA, 19 nt, Homo sapiens
ggugcuugguccuuguuuc

SEQ ID NO: 616243 - RNA, 19 nt, Homo sapiens
ucugucugguuucugauga

SEQ ID NO: 616244 - RNA, 19 nt, Homo sapiens
gauggcugauguuccuucu

SEQ ID NO: 616245 - RNA, 19 nt, Homo sapiens
guggguugcuuugucaauc

SEQ ID NO: 616246 - RNA, 19 nt, Homo sapiens
gugcuggcuccucguguuu

SEQ ID NO: 616247 - RNA, 19 nt, Homo sapiens
aggaugggcugcggcaaau

SEQ ID NO: 616248 - RNA, 19 nt, Homo sapiens
gcugaaggcccugcuaaaa

SEQ ID NO: 616249 - RNA, 19 nt, Homo sapiens
guguccugcuuacccagua

SEQ ID NO: 616250 - RNA, 19 nt, Homo sapiens
gcccuuauauacacuuucc

SEQ ID NO: 616251 - RNA, 19 nt, Homo sapiens
ugaaaggaauugcauguga

SEQ ID NO: 616252 - RNA, 19 nt, Homo sapiens
ccaguucucucucuaccua

SEQ ID NO: 616253 - RNA, 19 nt, Homo sapiens
gaagggacagggcaacaaa

SEQ ID NO: 616254 - RNA, 19 nt, Homo sapiens
aagcagagcucgccaccuu

SEQ ID NO: 616255 - RNA, 19 nt, Homo sapiens
gcaacaaaauacaguagua

SEQ ID NO: 616256 - RNA, 19 nt, Homo sapiens
ugaagaugcuggacacuca

SEQ ID NO: 616257 - RNA, 19 nt, Homo sapiens
ggaagcugaugcuggagaa

SEQ ID NO: 616258 - RNA, 19 nt, Homo sapiens
gagagaugauggcugaugu

SEQ ID NO: 616259 - RNA, 19 nt, Homo sapiens
gcacuaagaagaagacagu

SEQ ID NO: 616260 - RNA, 19 nt, Homo sapiens
gaagaugaauuggaauggu

SEQ ID NO: 616261 - RNA, 19 nt, Homo sapiens
gcaggucccucaguucuca

SEQ ID NO: 616262 - RNA, 19 nt, Homo sapiens
ggagcuagcccaaucauac

SEQ ID NO: 616263 - RNA, 19 nt, Homo sapiens
gaugaugagccaagcaauu

SEQ ID NO: 616264 - RNA, 19 nt, Homo sapiens
gcacacacccguccucucu

SEQ ID NO: 616265 - RNA, 19 nt, Homo sapiens
gaugauggcugauguuccu

SEQ ID NO: 616266 - RNA, 19 nt, Homo sapiens
guacccaguucucucucua

SEQ ID NO: 616267 - RNA, 19 nt, Homo sapiens
ggucugauguuuccuacag

SEQ ID NO: 616268 - RNA, 19 nt, Homo sapiens
ucaggcaggucccucaguu

SEQ ID NO: 616269 - RNA, 19 nt, Homo sapiens
ggaggccacugugaugaug

SEQ ID NO: 616270 - RNA, 19 nt, Homo sapiens
gaggaugggcugcggcaaa

SEQ ID NO: 616271 - RNA, 19 nt, Homo sapiens
gaucagccgguuccucuug

SEQ ID NO: 616272 - RNA, 19 nt, Homo sapiens
cagguuggcuggugaaagg

SEQ ID NO: 616273 - RNA, 19 nt, Homo sapiens
gcaguggaagauucuguuu

SEQ ID NO: 616274 - RNA, 19 nt, Homo sapiens
gacaccagcuccccucaua

SEQ ID NO: 616275 - RNA, 19 nt, Homo sapiens
gggucugucugguuucuga

SEQ ID NO: 616276 - RNA, 19 nt, Homo sapiens
gaaagcaccgaccauaggu

SEQ ID NO: 616277 - RNA, 19 nt, Homo sapiens
agaagacaguggucagugu

SEQ ID NO: 616278 - RNA, 19 nt, Homo sapiens
ggaugugacugagcagauc

SEQ ID NO: 616279 - RNA, 19 nt, Homo sapiens
uagcugcaguggaagauuc

SEQ ID NO: 616280 - RNA, 19 nt, Homo sapiens
cuuggcagcugaagaugaa

SEQ ID NO: 616281 - RNA, 19 nt, Homo sapiens
gauccagguucagggacua

SEQ ID NO: 616282 - RNA, 19 nt, Homo sapiens
ggcgggagaugucuucuac

SEQ ID NO: 616283 - RNA, 19 nt, Homo sapiens
gaagaagacaguggucagu

SEQ ID NO: 616284 - RNA, 19 nt, Homo sapiens
ucauggagacguagccuuu

SEQ ID NO: 616285 - RNA, 19 nt, Homo sapiens
ucacggucaugucaguuug

SEQ ID NO: 616286 - RNA, 19 nt, Homo sapiens
cagguucagggacuaaaua

SEQ ID NO: 616287 - RNA, 19 nt, Homo sapiens
gagcuagcccaaucauaca

SEQ ID NO: 616288 - RNA, 19 nt, Homo sapiens
ggugaaaggaauugcaugu

SEQ ID NO: 616289 - RNA, 19 nt, Homo sapiens
ccacagcuacuaccugaca

SEQ ID NO: 616290 - RNA, 19 nt, Homo sapiens
ccugaaagcaccgaccaua

SEQ ID NO: 616291 - RNA, 19 nt, Homo sapiens
ggacaggcugcauuuccaa

SEQ ID NO: 616292 - RNA, 19 nt, Homo sapiens
aacaggagcuagcccaauc

SEQ ID NO: 616293 - RNA, 19 nt, Homo sapiens
ccugugggcugucgauagu

SEQ ID NO: 616294 - RNA, 19 nt, Homo sapiens
acacacccguccucucuag

SEQ ID NO: 616295 - RNA, 19 nt, Homo sapiens
gcuguggucuguugcuuuu

SEQ ID NO: 616296 - RNA, 19 nt, Homo sapiens
acacuuggcagcugaagau

SEQ ID NO: 616297 - RNA, 19 nt, Homo sapiens
ggacagcacccaccuucac

SEQ ID NO: 616298 - RNA, 19 nt, Homo sapiens
gagaugauggcugauguuc

SEQ ID NO: 616299 - RNA, 19 nt, Homo sapiens
cgggagaugucuucuacca

SEQ ID NO: 616300 - RNA, 19 nt, Homo sapiens
gggagccgcacuaagaaga

SEQ ID NO: 616301 - RNA, 19 nt, Homo sapiens
ugccuaagggagacauuua

SEQ ID NO: 616302 - RNA, 19 nt, Homo sapiens
ugacucgcguggguguuaa

SEQ ID NO: 616303 - RNA, 19 nt, Homo sapiens
gagcucaugcagagagaug

SEQ ID NO: 616304 - RNA, 19 nt, Homo sapiens
uagaggacaagcucaguga

SEQ ID NO: 616305 - RNA, 19 nt, Homo sapiens
ugaaagcaccgaccauagg

SEQ ID NO: 616306 - RNA, 19 nt, Homo sapiens
gcaccggagugaagaugcu

SEQ ID NO: 616307 - RNA, 19 nt, Homo sapiens
gggaacguguccugcuuac

SEQ ID NO: 616308 - RNA, 19 nt, Homo sapiens
agacaguggucagugugaa

SEQ ID NO: 616309 - RNA, 19 nt, Homo sapiens
ggagccgcacuaagaagaa

SEQ ID NO: 616310 - RNA, 19 nt, Homo sapiens
acccgggucugucugguuu

SEQ ID NO: 616311 - RNA, 19 nt, Homo sapiens
ggacagggcaacaaaauac

SEQ ID NO: 616312 - RNA, 19 nt, Homo sapiens
gcagagcucgccaccuucu

SEQ ID NO: 616313 - RNA, 19 nt, Homo sapiens
gcggagggaggaagaggaa

SEQ ID NO: 616314 - RNA, 19 nt, Homo sapiens
gccgguuccucuuggauca

SEQ ID NO: 616315 - RNA, 19 nt, Homo sapiens
ugccgaugcugaaguggaa

SEQ ID NO: 616316 - RNA, 19 nt, Homo sapiens
agcugaugcuggagaauuu

SEQ ID NO: 616317 - RNA, 19 nt, Homo sapiens
augaugagccaagcaauuu

SEQ ID NO: 616318 - RNA, 19 nt, Homo sapiens
caucagagcagcggcagau

SEQ ID NO: 616319 - RNA, 19 nt, Homo sapiens
ugaaggcccugcuaaaagu

SEQ ID NO: 616320 - RNA, 19 nt, Homo sapiens
ucgacucccucccugcauu

SEQ ID NO: 616321 - RNA, 19 nt, Homo sapiens
ggguucuacuugagauuuc

SEQ ID NO: 616322 - RNA, 19 nt, Homo sapiens
cagcugaagaugaauugga

SEQ ID NO: 616323 - RNA, 19 nt, Homo sapiens
ggccuguguugcugggauu

SEQ ID NO: 616324 - RNA, 19 nt, Homo sapiens
agucaggccuagaggacaa

SEQ ID NO: 616325 - RNA, 19 nt, Homo sapiens
cgacucccucccugcauuu

SEQ ID NO: 616326 - RNA, 19 nt, Homo sapiens
gcccaggacaggcugcauu

SEQ ID NO: 616327 - RNA, 19 nt, Homo sapiens
gagccgcacuaagaagaag

SEQ ID NO: 616328 - RNA, 19 nt, Homo sapiens
ugucgauagugcccucuga

SEQ ID NO: 616329 - RNA, 19 nt, Homo sapiens
agcugaagaugaauuggaa

SEQ ID NO: 616330 - RNA, 19 nt, Homo sapiens
gcucaguggccauguggau

SEQ ID NO: 616331 - RNA, 19 nt, Homo sapiens
gggcuguggucuguugcuu

SEQ ID NO: 616332 - RNA, 19 nt, Homo sapiens
gaugggcugcggcaaaucu

SEQ ID NO: 616333 - RNA, 19 nt, Homo sapiens
ucugucugguuucugauga

SEQ ID NO: 616334 - RNA, 19 nt, Homo sapiens
gauggcugauguuccuucu

SEQ ID NO: 616335 - RNA, 19 nt, Homo sapiens
guggguugcuuugucaauc

SEQ ID NO: 616336 - RNA, 19 nt, Homo sapiens
gugcuggcuccucguguuu

SEQ ID NO: 616337 - RNA, 19 nt, Homo sapiens
aggaugggcugcggcaaau

SEQ ID NO: 616338 - RNA, 19 nt, Homo sapiens
gcugaaggcccugcuaaaa

SEQ ID NO: 616339 - RNA, 19 nt, Homo sapiens
guguccugcuuacccagua

SEQ ID NO: 616340 - RNA, 19 nt, Homo sapiens
gaagugagcuuaguugaga

SEQ ID NO: 616341 - RNA, 19 nt, Homo sapiens
uaaacuagaucccuucauu

SEQ ID NO: 616342 - RNA, 19 nt, Homo sapiens
gauaagccaugguuugauu

SEQ ID NO: 616343 - RNA, 19 nt, Homo sapiens
acacugaucuuauuccuaa

SEQ ID NO: 616344 - RNA, 19 nt, Homo sapiens
agaaagugguaccaaauua

SEQ ID NO: 616345 - RNA, 19 nt, Homo sapiens
gccaaucacugcugacuaa

SEQ ID NO: 616346 - RNA, 19 nt, Homo sapiens
guacacaugugacaaccua

SEQ ID NO: 616347 - RNA, 19 nt, Homo sapiens
gaaggaaaccuacgguauu

SEQ ID NO: 616348 - RNA, 19 nt, Homo sapiens
caaccucccugaugaaaug

SEQ ID NO: 616349 - RNA, 19 nt, Homo sapiens
gagcuuaguugagaagaaa

SEQ ID NO: 616350 - RNA, 19 nt, Homo sapiens
cuagaucccuucauuauuc

SEQ ID NO: 616351 - RNA, 19 nt, Homo sapiens
gaagaaagcuuuugaugag

SEQ ID NO: 616352 - RNA, 19 nt, Homo sapiens
gcaagcaggcauauuguaa

SEQ ID NO: 616353 - RNA, 19 nt, Homo sapiens
gaaaucaagauccaagaaa

SEQ ID NO: 616354 - RNA, 19 nt, Homo sapiens
aaggaaaccuacgguauua

SEQ ID NO: 616355 - RNA, 19 nt, Homo sapiens
caauagaaguuggaacauu

SEQ ID NO: 616356 - RNA, 19 nt, Homo sapiens
ggaagcuucuccagccuuu

SEQ ID NO: 616357 - RNA, 19 nt, Homo sapiens
gaccauauuccuuacauaa

SEQ ID NO: 616358 - RNA, 19 nt, Homo sapiens
cagcaaagcaucacaauca

SEQ ID NO: 616359 - RNA, 19 nt, Homo sapiens
aaagaacgcuguacucagu

SEQ ID NO: 616360 - RNA, 19 nt, Homo sapiens
uaucaagugugcuuagaaa

SEQ ID NO: 616361 - RNA, 19 nt, Homo sapiens
gagaaaugguggugaaucu

SEQ ID NO: 616362 - RNA, 19 nt, Homo sapiens
cgacaaaccaguagcauau

SEQ ID NO: 616363 - RNA, 19 nt, Homo sapiens
ggaccauauuccuuacaua

SEQ ID NO: 616364 - RNA, 19 nt, Homo sapiens
gcagagagaagcaauaaca

SEQ ID NO: 616365 - RNA, 19 nt, Homo sapiens
gaugucagcuguccuccuu

SEQ ID NO: 616366 - RNA, 19 nt, Homo sapiens
guaugaacauucuaagaga

SEQ ID NO: 616367 - RNA, 19 nt, Homo sapiens
uauagacucugacacauau

SEQ ID NO: 616368 - RNA, 19 nt, Homo sapiens
agacuucccuucuccauga

SEQ ID NO: 616369 - RNA, 19 nt, Homo sapiens
gaaagugguaccaaauuau

SEQ ID NO: 616370 - RNA, 19 nt, Homo sapiens
caauaacacuuucagaucu

SEQ ID NO: 616371 - RNA, 19 nt, Homo sapiens
ucaacaagcagaagccuua

SEQ ID NO: 616372 - RNA, 19 nt, Homo sapiens
gaaagugagacgacauuga

SEQ ID NO: 616373 - RNA, 19 nt, Homo sapiens
gaagaagugagcuuaguug

SEQ ID NO: 616374 - RNA, 19 nt, Homo sapiens
aaagagaaaugguggugaa

SEQ ID NO: 616375 - RNA, 19 nt, Homo sapiens
gcaauaacacuuucagauc

SEQ ID NO: 616376 - RNA, 19 nt, Homo sapiens
caggugagcuucauuugau

SEQ ID NO: 616377 - RNA, 19 nt, Homo sapiens
gacaaccuaugaagaauca

SEQ ID NO: 616378 - RNA, 19 nt, Homo sapiens
acaaaccaguagcauauaa

SEQ ID NO: 616379 - RNA, 19 nt, Homo sapiens
gaagucaaccucccugaug

SEQ ID NO: 616380 - RNA, 19 nt, Homo sapiens
gaaagagaaaggccaauca

SEQ ID NO: 616381 - RNA, 19 nt, Homo sapiens
gguaccaaauuaugaagaa

SEQ ID NO: 616382 - RNA, 19 nt, Homo sapiens
ggaaggaaaccuacgguau

SEQ ID NO: 616383 - RNA, 19 nt, Homo sapiens
gaagaggacacugauagaa

SEQ ID NO: 616384 - RNA, 19 nt, Homo sapiens
ggacugaagaggacacuga

SEQ ID NO: 616385 - RNA, 19 nt, Homo sapiens
aaacugcucuuucuauugg

SEQ ID NO: 616386 - RNA, 19 nt, Homo sapiens
gaugaaaugcauagcuuaa

SEQ ID NO: 616387 - RNA, 19 nt, Homo sapiens
gagaagcaauaacacuuuc

SEQ ID NO: 616388 - RNA, 19 nt, Homo sapiens
aaacuagaucccuucauua

SEQ ID NO: 616389 - RNA, 19 nt, Homo sapiens
gaauaaagacuucccuucu

SEQ ID NO: 616390 - RNA, 19 nt, Homo sapiens
gugaagguuuccaguauau

SEQ ID NO: 616391 - RNA, 19 nt, Homo sapiens
ccagaaauguauacucauc

SEQ ID NO: 616392 - RNA, 19 nt, Homo sapiens
guauagacucugacacaua

SEQ ID NO: 616393 - RNA, 19 nt, Homo sapiens
gguggugaaucuacagaaa

SEQ ID NO: 616394 - RNA, 19 nt, Homo sapiens
caaagcaucacaaucagaa

SEQ ID NO: 616395 - RNA, 19 nt, Homo sapiens
guaagaacccaguuuauac

SEQ ID NO: 616396 - RNA, 19 nt, Homo sapiens
ggaguaggcccagaguuaa

SEQ ID NO: 616397 - RNA, 19 nt, Homo sapiens
gaaauucugcagaugcuau

SEQ ID NO: 616398 - RNA, 19 nt, Homo sapiens
ggaaaccuacgguauuaga

SEQ ID NO: 616399 - RNA, 19 nt, Homo sapiens
gaagguuuccaguauauuc

SEQ ID NO: 616400 - RNA, 19 nt, Homo sapiens
aaucacugcugacuaagaa

SEQ ID NO: 616401 - RNA, 19 nt, Homo sapiens
gagagaagcaauaacacuu

SEQ ID NO: 616402 - RNA, 19 nt, Homo sapiens
uguaagaacccaguuuaua

SEQ ID NO: 616403 - RNA, 19 nt, Homo sapiens
uggaguaggcccagaguua

SEQ ID NO: 616404 - RNA, 19 nt, Homo sapiens
gcaggugagcuucauuuga

SEQ ID NO: 616405 - RNA, 19 nt, Homo sapiens
agaggaaucuuugguauag

SEQ ID NO: 616406 - RNA, 19 nt, Homo sapiens
agagagauaucaggaaguu

SEQ ID NO: 616407 - RNA, 19 nt, Homo sapiens
gaaaugcauagcuuaacuu

SEQ ID NO: 616408 - RNA, 19 nt, Homo sapiens
agccugagcugcuaaguga

SEQ ID NO: 616409 - RNA, 19 nt, Homo sapiens
acacuugccuucuguuauc

SEQ ID NO: 616410 - RNA, 19 nt, Homo sapiens
cugaugaaggcaaauauua

SEQ ID NO: 616411 - RNA, 19 nt, Homo sapiens
gcaggcauauuguaagaac

SEQ ID NO: 616412 - RNA, 19 nt, Homo sapiens
gugugaagguuuccaguau

SEQ ID NO: 616413 - RNA, 19 nt, Homo sapiens
agaaagaaaucaagaucca

SEQ ID NO: 616414 - RNA, 19 nt, Homo sapiens
aaagauaagccaugguuug

SEQ ID NO: 616415 - RNA, 19 nt, Homo sapiens
gauaucaggaaguuacaaa

SEQ ID NO: 616416 - RNA, 19 nt, Homo sapiens
ugugaagguuuccaguaua

SEQ ID NO: 616417 - RNA, 19 nt, Homo sapiens
uauauuggcuuaguacaca

SEQ ID NO: 616418 - RNA, 19 nt, Homo sapiens
acagaggaaucuuugguau

SEQ ID NO: 616419 - RNA, 19 nt, Homo sapiens
gacagaggaaucuuuggua

SEQ ID NO: 616420 - RNA, 19 nt, Homo sapiens
ccacaauguuacagagaga

SEQ ID NO: 616421 - RNA, 19 nt, Homo sapiens
gaaaugguggugaaucuac

SEQ ID NO: 616422 - RNA, 19 nt, Homo sapiens
cagaaagugguaccaaauu

SEQ ID NO: 616423 - RNA, 19 nt, Homo sapiens
ucagugugcugcugucuca

SEQ ID NO: 616424 - RNA, 19 nt, Homo sapiens
gcaaagcaucacaaucaga

SEQ ID NO: 616425 - RNA, 19 nt, Homo sapiens
gcccagaguuaaagaacga

SEQ ID NO: 616426 - RNA, 19 nt, Homo sapiens
aagcagaagccuuaaagaa

SEQ ID NO: 616427 - RNA, 19 nt, Homo sapiens
ccacucuacuacucauuug

SEQ ID NO: 616428 - RNA, 19 nt, Homo sapiens
cagaggaaucuuugguaua

SEQ ID NO: 616429 - RNA, 19 nt, Homo sapiens
guuacaaacacugaucuua

SEQ ID NO: 616430 - RNA, 19 nt, Homo sapiens
gaaaccuacgguauuagaa

SEQ ID NO: 616431 - RNA, 19 nt, Homo sapiens
aagcaggcauauuguaaga

SEQ ID NO: 616432 - RNA, 19 nt, Homo sapiens
gcacacuggucgagucaac

SEQ ID NO: 616433 - RNA, 19 nt, Homo sapiens
uaacuugccacgugguaaa

SEQ ID NO: 616434 - RNA, 19 nt, Homo sapiens
ugaaaugcauagcuuaacu

SEQ ID NO: 616435 - RNA, 19 nt, Homo sapiens
uguuaucuguccuuacuuu

SEQ ID NO: 616436 - RNA, 19 nt, Homo sapiens
uacuaaaucucuucuccuu

SEQ ID NO: 616437 - RNA, 19 nt, Homo sapiens
caaccuaugaagaaucaaa

SEQ ID NO: 616438 - RNA, 19 nt, Homo sapiens
agaagggaaucgugaagau

SEQ ID NO: 616439 - RNA, 19 nt, Homo sapiens
gaaguuacaaacacugauc

SEQ ID NO: 616440 - RNA, 19 nt, Homo sapiens
gaagacaucugcaaauauu

SEQ ID NO: 616441 - RNA, 19 nt, Homo sapiens
gaauauaacugcuuggaaa

SEQ ID NO: 616442 - RNA, 19 nt, Homo sapiens
guaaguagcuugguagaua

SEQ ID NO: 616443 - RNA, 19 nt, Homo sapiens
cagaauacauguacaguua

SEQ ID NO: 616444 - RNA, 19 nt, Homo sapiens
gguauuauuuggagucuua

SEQ ID NO: 616445 - RNA, 19 nt, Homo sapiens
cugaggagcucuaaauuua

SEQ ID NO: 616446 - RNA, 19 nt, Homo sapiens
gaaggaagauacagcuuug

SEQ ID NO: 616447 - RNA, 19 nt, Homo sapiens
ggaaauacuuggcaaaaua

SEQ ID NO: 616448 - RNA, 19 nt, Homo sapiens
gaagaguuauguagaaaug

SEQ ID NO: 616449 - RNA, 19 nt, Homo sapiens
gcaaauauuucugcauuga

SEQ ID NO: 616450 - RNA, 19 nt, Homo sapiens
gagacugaguuuagcuuua

SEQ ID NO: 616451 - RNA, 19 nt, Homo sapiens
ggaauuccauacauuacuu

SEQ ID NO: 616452 - RNA, 19 nt, Homo sapiens
gcucggaagugaaauucua

SEQ ID NO: 616453 - RNA, 19 nt, Homo sapiens
aagagguacucaccaauua

SEQ ID NO: 616454 - RNA, 19 nt, Homo sapiens
uauuauaccuggucugaaa

SEQ ID NO: 616455 - RNA, 19 nt, Homo sapiens
ggaaacaucugugcucagu

SEQ ID NO: 616456 - RNA, 19 nt, Homo sapiens
aaacauacguagaaacugu

SEQ ID NO: 616457 - RNA, 19 nt, Homo sapiens
ccaagacucugauacugaa

SEQ ID NO: 616458 - RNA, 19 nt, Homo sapiens
uggaagacaucugcaaaua

SEQ ID NO: 616459 - RNA, 19 nt, Homo sapiens
ggaaaagguuguagauauu

SEQ ID NO: 616460 - RNA, 19 nt, Homo sapiens
ggaaggaagauacagcuuu

SEQ ID NO: 616461 - RNA, 19 nt, Homo sapiens
cauuauaccuucugcauca

SEQ ID NO: 616462 - RNA, 19 nt, Homo sapiens
aaagcaacauggagaguuu

SEQ ID NO: 616463 - RNA, 19 nt, Homo sapiens
caccugagauuauuuggaa

SEQ ID NO: 616464 - RNA, 19 nt, Homo sapiens
cuacagcaguuauuguuug

SEQ ID NO: 616465 - RNA, 19 nt, Homo sapiens
guagcuugguagauaguua

SEQ ID NO: 616466 - RNA, 19 nt, Homo sapiens
gcccauaucuacuuauaca

SEQ ID NO: 616467 - RNA, 19 nt, Homo sapiens
uuaaagaucuccuuacaac

SEQ ID NO: 616468 - RNA, 19 nt, Homo sapiens
ccaagaagcucugcugaag

SEQ ID NO: 616469 - RNA, 19 nt, Homo sapiens
ggaagacaucugcaaauau

SEQ ID NO: 616470 - RNA, 19 nt, Homo sapiens
aaagcaagaucaccaaauc

SEQ ID NO: 616471 - RNA, 19 nt, Homo sapiens
uguaccaucucauaaauug

SEQ ID NO: 616472 - RNA, 19 nt, Homo sapiens
ccaauuaugcauaugauga

SEQ ID NO: 616473 - RNA, 19 nt, Homo sapiens
caagagguacucaccaauu

SEQ ID NO: 616474 - RNA, 19 nt, Homo sapiens
auauuggcgucaugaauua

SEQ ID NO: 616475 - RNA, 19 nt, Homo sapiens
uuccuuggcuucaaacaua

SEQ ID NO: 616476 - RNA, 19 nt, Homo sapiens
ugugacagaugaugaagaa

SEQ ID NO: 616477 - RNA, 19 nt, Homo sapiens
caaaugcccauaucuacuu

SEQ ID NO: 616478 - RNA, 19 nt, Homo sapiens
gugaagaguuauguagaaa

SEQ ID NO: 616479 - RNA, 19 nt, Homo sapiens
gcucaguggugcaggaaug

SEQ ID NO: 616480 - RNA, 19 nt, Homo sapiens
gauuguaccaucucauaaa

SEQ ID NO: 616481 - RNA, 19 nt, Homo sapiens
gacagaugaugaagaagug

SEQ ID NO: 616482 - RNA, 19 nt, Homo sapiens
gguagauaguuauugaaug

SEQ ID NO: 616483 - RNA, 19 nt, Homo sapiens
cacaguaaguagcuuggua

SEQ ID NO: 616484 - RNA, 19 nt, Homo sapiens
agacucugauacugaauuu

SEQ ID NO: 616485 - RNA, 19 nt, Homo sapiens
auauaaagcucuccuaacu

SEQ ID NO: 616486 - RNA, 19 nt, Homo sapiens
gcagaauacauguacaguu

SEQ ID NO: 616487 - RNA, 19 nt, Homo sapiens
cggaugcacuaagaauaua

SEQ ID NO: 616488 - RNA, 19 nt, Homo sapiens
ugugaagaguuauguagaa

SEQ ID NO: 616489 - RNA, 19 nt, Homo sapiens
gaagcucggaagugaaauu

SEQ ID NO: 616490 - RNA, 19 nt, Homo sapiens
uuucagaccuuggaagauu

SEQ ID NO: 616491 - RNA, 19 nt, Homo sapiens
ggaaaaggaggaaggauuu

SEQ ID NO: 616492 - RNA, 19 nt, Homo sapiens
gaugaagagaucugugaaa

SEQ ID NO: 616493 - RNA, 19 nt, Homo sapiens
aaaugcccauaucuacuua

SEQ ID NO: 616494 - RNA, 19 nt, Homo sapiens
ggaugauuaugcuuacaau

SEQ ID NO: 616495 - RNA, 19 nt, Homo sapiens
caacauggagaguuucaau

SEQ ID NO: 616496 - RNA, 19 nt, Homo sapiens
cguagaaacuguggccauu

SEQ ID NO: 616497 - RNA, 19 nt, Homo sapiens
cuugguagauaguuauuga

SEQ ID NO: 616498 - RNA, 19 nt, Homo sapiens
agauggagcccaagaggua

SEQ ID NO: 616499 - RNA, 19 nt, Homo sapiens
uggagaguuucaauacuuu

SEQ ID NO: 616500 - RNA, 19 nt, Homo sapiens
uaaguagcuugguagauag

SEQ ID NO: 616501 - RNA, 19 nt, Homo sapiens
gcaguuauuguuugcaaau

SEQ ID NO: 616502 - RNA, 19 nt, Homo sapiens
cagcaguuauuguuugcaa

SEQ ID NO: 616503 - RNA, 19 nt, Homo sapiens
gaagauggaauugucaaag

SEQ ID NO: 616504 - RNA, 19 nt, Homo sapiens
ggagacugaguuuagcuuu

SEQ ID NO: 616505 - RNA, 19 nt, Homo sapiens
gaaaugcuggaauucuaug

SEQ ID NO: 616506 - RNA, 19 nt, Homo sapiens
aaagaucuccuuacaacau

SEQ ID NO: 616507 - RNA, 19 nt, Homo sapiens
aauauuggcgucaugaauu

SEQ ID NO: 616508 - RNA, 19 nt, Homo sapiens
gcaagcugcagaauacaug

SEQ ID NO: 616509 - RNA, 19 nt, Homo sapiens
uuuagcgccugcucauaua

SEQ ID NO: 616510 - RNA, 19 nt, Homo sapiens
agauucagauagcuacaaa

SEQ ID NO: 616511 - RNA, 19 nt, Homo sapiens
ucauauaaagcucuccuaa

SEQ ID NO: 616512 - RNA, 19 nt, Homo sapiens
gaugcuaagagaaaucuga

SEQ ID NO: 616513 - RNA, 19 nt, Homo sapiens
gagguacucaccaauuaug

SEQ ID NO: 616514 - RNA, 19 nt, Homo sapiens
uguggcugguuuacuguua

SEQ ID NO: 616515 - RNA, 19 nt, Homo sapiens
gguuggagguauuauuugg

SEQ ID NO: 616516 - RNA, 19 nt, Homo sapiens
uuacugaggagcucuaaau

SEQ ID NO: 616517 - RNA, 19 nt, Homo sapiens
caucauggaaugcuuaaag

SEQ ID NO: 616518 - RNA, 19 nt, Homo sapiens
uagaaacuguggccauugg

SEQ ID NO: 616519 - RNA, 19 nt, Homo sapiens
cuucaaacauacguagaaa

SEQ ID NO: 616520 - RNA, 19 nt, Homo sapiens
uaaauccaagacucugaua

SEQ ID NO: 616521 - RNA, 19 nt, Homo sapiens
ggguaugagugauuucagu

SEQ ID NO: 616522 - RNA, 19 nt, Homo sapiens
uauaacugcuuggaaauac

SEQ ID NO: 616523 - RNA, 19 nt, Homo sapiens
guuuagcgccugcucauau

SEQ ID NO: 616524 - RNA, 19 nt, Homo sapiens
cccaagagguacucaccaa

SEQ ID NO: 616525 - RNA, 19 nt, Homo sapiens
gcuggaagacaucugcaaa

SEQ ID NO: 616526 - RNA, 19 nt, Homo sapiens
ccuuacaacaugcauuaua

SEQ ID NO: 616527 - RNA, 19 nt, Homo sapiens
uuuggaagcucggaaguga

SEQ ID NO: 616528 - RNA, 19 nt, Homo sapiens
gcucagacaacaagugcuu

SEQ ID NO: 616529 - RNA, 19 nt, Homo sapiens
ggaugcacuaagaauauaa

SEQ ID NO: 616530 - RNA, 19 nt, Homo sapiens
caaauccaaaugcccauau

SEQ ID NO: 616531 - RNA, 19 nt, Homo sapiens
ucaccaauuaugcauauga

SEQ ID NO: 616532 - RNA, 19 nt, Homo sapiens
acucaccaauuaugcauau

SEQ ID NO: 616533 - RNA, 19 nt, Homo sapiens
aaaagaagauggaauuguc

SEQ ID NO: 616534 - RNA, 19 nt, Homo sapiens
cauggaaugcuuaaagaug

SEQ ID NO: 616535 - RNA, 19 nt, Homo sapiens
ugacagaugaugaagaagu

SEQ ID NO: 616536 - RNA, 19 nt, Homo sapiens
uaaagcaagaucaccaaau

SEQ ID NO: 616537 - RNA, 19 nt, Homo sapiens
aggaaaagguuguagauau

SEQ ID NO: 616538 - RNA, 19 nt, Homo sapiens
acagaaggcaccaagauca

SEQ ID NO: 616539 - RNA, 19 nt, Homo sapiens
ucaaacauacguagaaacu

SEQ ID NO: 616540 - RNA, 19 nt, Homo sapiens
gaagacaucugcaaauauu

SEQ ID NO: 616541 - RNA, 19 nt, Homo sapiens
gaauauaacugcuuggaaa

SEQ ID NO: 616542 - RNA, 19 nt, Homo sapiens
guaaguagcuugguagaua

SEQ ID NO: 616543 - RNA, 19 nt, Homo sapiens
gguauuauuuggagucuua

SEQ ID NO: 616544 - RNA, 19 nt, Homo sapiens
cugaggagcucuaaauuua

SEQ ID NO: 616545 - RNA, 19 nt, Homo sapiens
gaaggaagauacagcuuug

SEQ ID NO: 616546 - RNA, 19 nt, Homo sapiens
ggaaauacuuggcaaaaua

SEQ ID NO: 616547 - RNA, 19 nt, Homo sapiens
gaagaguuauguagaaaug

SEQ ID NO: 616548 - RNA, 19 nt, Homo sapiens
gcaaauauuucugcauuga

SEQ ID NO: 616549 - RNA, 19 nt, Homo sapiens
gagacugaguuuagcuuua

SEQ ID NO: 616550 - RNA, 19 nt, Homo sapiens
ggaauuccauacauuacuu

SEQ ID NO: 616551 - RNA, 19 nt, Homo sapiens
gcucggaagugaaauucua

SEQ ID NO: 616552 - RNA, 19 nt, Homo sapiens
aagagguacucaccaauua

SEQ ID NO: 616553 - RNA, 19 nt, Homo sapiens
uauuauaccuggucugaaa

SEQ ID NO: 616554 - RNA, 19 nt, Homo sapiens
ggaaacaucugugcucagu

SEQ ID NO: 616555 - RNA, 19 nt, Homo sapiens
aaacauacguagaaacugu

SEQ ID NO: 616556 - RNA, 19 nt, Homo sapiens
ccaagacucugauacugaa

SEQ ID NO: 616557 - RNA, 19 nt, Homo sapiens
uggaagacaucugcaaaua

SEQ ID NO: 616558 - RNA, 19 nt, Homo sapiens
ggaaaagguuguagauauu

SEQ ID NO: 616559 - RNA, 19 nt, Homo sapiens
ggaaggaagauacagcuuu

SEQ ID NO: 616560 - RNA, 19 nt, Homo sapiens
cauuauaccuucugcauca

SEQ ID NO: 616561 - RNA, 19 nt, Homo sapiens
aaagcaacauggagaguuu

SEQ ID NO: 616562 - RNA, 19 nt, Homo sapiens
cuacagcaguuauuguuug

SEQ ID NO: 616563 - RNA, 19 nt, Homo sapiens
guagcuugguagauaguua

SEQ ID NO: 616564 - RNA, 19 nt, Homo sapiens
gcccauaucuacuuauaca

SEQ ID NO: 616565 - RNA, 19 nt, Homo sapiens
uuaaagaucuccuuacaac

SEQ ID NO: 616566 - RNA, 19 nt, Homo sapiens
ggaagacaucugcaaauau

SEQ ID NO: 616567 - RNA, 19 nt, Homo sapiens
aaagcaagaucaccaaauc

SEQ ID NO: 616568 - RNA, 19 nt, Homo sapiens
uguaccaucucauaaauug

SEQ ID NO: 616569 - RNA, 19 nt, Homo sapiens
ccaauuaugcauaugauga

SEQ ID NO: 616570 - RNA, 19 nt, Homo sapiens
caagagguacucaccaauu

SEQ ID NO: 616571 - RNA, 19 nt, Homo sapiens
auauuggcgucaugaauua

SEQ ID NO: 616572 - RNA, 19 nt, Homo sapiens
cguagaaacuguggauuau

SEQ ID NO: 616573 - RNA, 19 nt, Homo sapiens
uuccuuggcuucaaacaua

SEQ ID NO: 616574 - RNA, 19 nt, Homo sapiens
ugugacagaugaugaagaa

SEQ ID NO: 616575 - RNA, 19 nt, Homo sapiens
caaaugcccauaucuacuu

SEQ ID NO: 616576 - RNA, 19 nt, Homo sapiens
gugaagaguuauguagaaa

SEQ ID NO: 616577 - RNA, 19 nt, Homo sapiens
gcucaguggugcaggaaug

SEQ ID NO: 616578 - RNA, 19 nt, Homo sapiens
gauuguaccaucucauaaa

SEQ ID NO: 616579 - RNA, 19 nt, Homo sapiens
gacagaugaugaagaagug

SEQ ID NO: 616580 - RNA, 19 nt, Homo sapiens
gguagauaguuauugaaug

SEQ ID NO: 616581 - RNA, 19 nt, Homo sapiens
cacaguaaguagcuuggua

SEQ ID NO: 616582 - RNA, 19 nt, Homo sapiens
agacucugauacugaauuu

SEQ ID NO: 616583 - RNA, 19 nt, Homo sapiens
auauaaagcucuccuaacu

SEQ ID NO: 616584 - RNA, 19 nt, Homo sapiens
cggaugcacuaagaauaua

SEQ ID NO: 616585 - RNA, 19 nt, Homo sapiens
ugugaagaguuauguagaa

SEQ ID NO: 616586 - RNA, 19 nt, Homo sapiens
gaagcucggaagugaaauu

SEQ ID NO: 616587 - RNA, 19 nt, Homo sapiens
gaugaagagaucugugaaa

SEQ ID NO: 616588 - RNA, 19 nt, Homo sapiens
aaaugcccauaucuacuua

SEQ ID NO: 616589 - RNA, 19 nt, Homo sapiens
ggaugauuaugcuuacaau

SEQ ID NO: 616590 - RNA, 19 nt, Homo sapiens
caacauggagaguuucaau

SEQ ID NO: 616591 - RNA, 19 nt, Homo sapiens
cuugguagauaguuauuga

SEQ ID NO: 616592 - RNA, 19 nt, Homo sapiens
agauggagcccaagaggua

SEQ ID NO: 616593 - RNA, 19 nt, Homo sapiens
uggagaguuucaauacuuu

SEQ ID NO: 616594 - RNA, 19 nt, Homo sapiens
uaaguagcuugguagauag

SEQ ID NO: 616595 - RNA, 19 nt, Homo sapiens
gcaguuauuguuugcaaau

SEQ ID NO: 616596 - RNA, 19 nt, Homo sapiens
cagcaguuauuguuugcaa

SEQ ID NO: 616597 - RNA, 19 nt, Homo sapiens
gaagauggaauugucaaag

SEQ ID NO: 616598 - RNA, 19 nt, Homo sapiens
ggagacugaguuuagcuuu

SEQ ID NO: 616599 - RNA, 19 nt, Homo sapiens
gaaaugcuggaauucuaug

SEQ ID NO: 616600 - RNA, 19 nt, Homo sapiens
aaagaucuccuuacaacau

SEQ ID NO: 616601 - RNA, 19 nt, Homo sapiens
aauauuggcgucaugaauu

SEQ ID NO: 616602 - RNA, 19 nt, Homo sapiens
uuuagcgccugcucauaua

SEQ ID NO: 616603 - RNA, 19 nt, Homo sapiens
ucauauaaagcucuccuaa

SEQ ID NO: 616604 - RNA, 19 nt, Homo sapiens
gaugcuaagagaaaucuga

SEQ ID NO: 616605 - RNA, 19 nt, Homo sapiens
gagguacucaccaauuaug

SEQ ID NO: 616606 - RNA, 19 nt, Homo sapiens
uguggcugguuuacuguua

SEQ ID NO: 616607 - RNA, 19 nt, Homo sapiens
gguuggagguauuauuugg

SEQ ID NO: 616608 - RNA, 19 nt, Homo sapiens
uuacugaggagcucuaaau

SEQ ID NO: 616609 - RNA, 19 nt, Homo sapiens
caucauggaaugcuuaaag

SEQ ID NO: 616610 - RNA, 19 nt, Homo sapiens
cuucaaacauacguagaaa

SEQ ID NO: 616611 - RNA, 19 nt, Homo sapiens
uaaauccaagacucugaua

SEQ ID NO: 616612 - RNA, 19 nt, Homo sapiens
uauaacugcuuggaaauac

SEQ ID NO: 616613 - RNA, 19 nt, Homo sapiens
cccaagagguacucaccaa

SEQ ID NO: 616614 - RNA, 19 nt, Homo sapiens
ggguaugagugauuucagu

SEQ ID NO: 616615 - RNA, 19 nt, Homo sapiens
gcuggaagacaucugcaaa

SEQ ID NO: 616616 - RNA, 19 nt, Homo sapiens
ccuuacaacaugcauuaua

SEQ ID NO: 616617 - RNA, 19 nt, Homo sapiens
guuuagcgccugcucauau

SEQ ID NO: 616618 - RNA, 19 nt, Homo sapiens
uuuggaagcucggaaguga

SEQ ID NO: 616619 - RNA, 19 nt, Homo sapiens
acguagaaacuguggauua

SEQ ID NO: 616620 - RNA, 19 nt, Homo sapiens
ggaugcacuaagaauauaa

SEQ ID NO: 616621 - RNA, 19 nt, Homo sapiens
caaauccaaaugcccauau

SEQ ID NO: 616622 - RNA, 19 nt, Homo sapiens
ucaccaauuaugcauauga

SEQ ID NO: 616623 - RNA, 19 nt, Homo sapiens
acucaccaauuaugcauau

SEQ ID NO: 616624 - RNA, 19 nt, Homo sapiens
ugacagaugaugaagaagu

SEQ ID NO: 616625 - RNA, 19 nt, Homo sapiens
aaaagaagauggaauuguc

SEQ ID NO: 616626 - RNA, 19 nt, Homo sapiens
cauggaaugcuuaaagaug

SEQ ID NO: 616627 - RNA, 19 nt, Homo sapiens
uaaagcaagaucaccaaau

SEQ ID NO: 616628 - RNA, 19 nt, Homo sapiens
aggaaaagguuguagauau

SEQ ID NO: 616629 - RNA, 19 nt, Homo sapiens
acagaaggcaccaagauca

SEQ ID NO: 616630 - RNA, 19 nt, Homo sapiens
aaccacagcuggaagacau

SEQ ID NO: 616631 - RNA, 19 nt, Homo sapiens
ucaaacauacguagaaacu

SEQ ID NO: 616632 - RNA, 19 nt, Homo sapiens
guagaaacuguggauuauu

SEQ ID NO: 616633 - RNA, 19 nt, Homo sapiens
agacugaguuuagcuuuac

SEQ ID NO: 616634 - RNA, 19 nt, Homo sapiens
ccuuugcucuuuguaacua

SEQ ID NO: 616635 - RNA, 19 nt, Homo sapiens
caauauuacugccuuugcu

SEQ ID NO: 616636 - RNA, 19 nt, Homo sapiens
uuaagcggaugaagagauc

SEQ ID NO: 616637 - RNA, 19 nt, Homo sapiens
ugauuaugcuuacaaugca

SEQ ID NO: 616638 - RNA, 19 nt, Homo sapiens
uuacugccuuugcucuuug

SEQ ID NO: 616639 - RNA, 19 nt, Homo sapiens
ggaugaagagaucugugaa

SEQ ID NO: 616640 - RNA, 19 nt, Homo sapiens
uaaagaggcuucaaaucua

SEQ ID NO: 616641 - RNA, 19 nt, Homo sapiens
gagagaaaguguuaacauu

SEQ ID NO: 616642 - RNA, 19 nt, Homo sapiens
gagaaaguguuaacauuga

SEQ ID NO: 616643 - RNA, 19 nt, Homo sapiens
gagcaugauuggaagcuuu

SEQ ID NO: 616644 - RNA, 19 nt, Homo sapiens
aaagaggcuucaaaucuaa

SEQ ID NO: 616645 - RNA, 19 nt, Homo sapiens
cuaccagucuaugauauua

SEQ ID NO: 616646 - RNA, 19 nt, Homo sapiens
cuaugaagauggauacuga

SEQ ID NO: 616647 - RNA, 19 nt, Homo sapiens
ggaaacccuuuguauaugg

SEQ ID NO: 616648 - RNA, 19 nt, Homo sapiens
ucacuucguuuccagcuuu

SEQ ID NO: 616649 - RNA, 19 nt, Homo sapiens
caagggagcaugauuggaa

SEQ ID NO: 616650 - RNA, 19 nt, Homo sapiens
ugagaugucuggucugaau

SEQ ID NO: 616651 - RNA, 19 nt, Homo sapiens
agaccucgguucucauuaa

SEQ ID NO: 616652 - RNA, 19 nt, Homo sapiens
uaaagaggaagguguauug

SEQ ID NO: 616653 - RNA, 19 nt, Homo sapiens
ccaaaugugguuaaaugua

SEQ ID NO: 616654 - RNA, 19 nt, Homo sapiens
auuggaagcuuuaucgaua

SEQ ID NO: 616655 - RNA, 19 nt, Homo sapiens
ggacauguggaucucuaua

SEQ ID NO: 616656 - RNA, 19 nt, Homo sapiens
ccaccgauguucuaaagau

SEQ ID NO: 616657 - RNA, 19 nt, Homo sapiens
uguauuggcucucuauuca

SEQ ID NO: 616658 - RNA, 19 nt, Homo sapiens
aaacacgacuucagguuca

SEQ ID NO: 616659 - RNA, 19 nt, Homo sapiens
gaacucgcaugaugaacca

SEQ ID NO: 616660 - RNA, 19 nt, Homo sapiens
gagcuaccagucuaugaua

SEQ ID NO: 616661 - RNA, 19 nt, Homo sapiens
cuaaagaggcuucaaaucu

SEQ ID NO: 616662 - RNA, 19 nt, Homo sapiens
cgauauauaccaacaagaa

SEQ ID NO: 616663 - RNA, 19 nt, Homo sapiens
gguagugucaggagugaua

SEQ ID NO: 616664 - RNA, 19 nt, Homo sapiens
uuacagaccucgguucuca

SEQ ID NO: 616665 - RNA, 19 nt, Homo sapiens
guagaacguuuagaagaug

SEQ ID NO: 616666 - RNA, 19 nt, Homo sapiens
gcuaagacaagcaucauau

SEQ ID NO: 616667 - RNA, 19 nt, Homo sapiens
gauguuccaugcgcuguuu

SEQ ID NO: 616668 - RNA, 19 nt, Homo sapiens
gaugggcgauacaauuuua

SEQ ID NO: 616669 - RNA, 19 nt, Homo sapiens
gaccucgguucucauuaaa

SEQ ID NO: 616670 - RNA, 19 nt, Homo sapiens
cguagaacguuuagaagau

SEQ ID NO: 616671 - RNA, 19 nt, Homo sapiens
caugagaugucuggucuga

SEQ ID NO: 616672 - RNA, 19 nt, Homo sapiens
cuucaaaucuaagaacuga

SEQ ID NO: 616673 - RNA, 19 nt, Homo sapiens
gaauuggaaacccuuugua

SEQ ID NO: 616674 - RNA, 19 nt, Homo sapiens
guucaaggccaaagcauug

SEQ ID NO: 616675 - RNA, 19 nt, Homo sapiens
gacauguggaucucuauaa

SEQ ID NO: 616676 - RNA, 19 nt, Homo sapiens
ugucuggucugaauuggaa

SEQ ID NO: 616677 - RNA, 19 nt, Homo sapiens
guggaaacaugagggcuuu

SEQ ID NO: 616678 - RNA, 19 nt, Homo sapiens
uggaagcuuuaucgauaua

SEQ ID NO: 616679 - RNA, 19 nt, Homo sapiens
gaagguguauuggcucucu

SEQ ID NO: 616680 - RNA, 19 nt, Homo sapiens
cuaagggccuccugaugga

SEQ ID NO: 616681 - RNA, 19 nt, Homo sapiens
gguuauugcuauauguguu

SEQ ID NO: 616682 - RNA, 19 nt, Homo sapiens
ggcuagagcagaaggcaua

SEQ ID NO: 616683 - RNA, 19 nt, Homo sapiens
uuccaaaugugguuaaaug

SEQ ID NO: 616684 - RNA, 19 nt, Homo sapiens
uaagggcacuguugauggu

SEQ ID NO: 616685 - RNA, 19 nt, Homo sapiens
gguucgaacucgcaugaug

SEQ ID NO: 616686 - RNA, 19 nt, Homo sapiens
ccagggugguuauugcuau

SEQ ID NO: 616687 - RNA, 19 nt, Homo sapiens
gcauaggccagggugguua

SEQ ID NO: 616688 - RNA, 19 nt, Homo sapiens
gaaaguguuaacauugaga

SEQ ID NO: 616689 - RNA, 19 nt, Homo sapiens
agagaaaguguuaacauug

SEQ ID NO: 616690 - RNA, 19 nt, Homo sapiens
ugucaggagugauaucuuc

SEQ ID NO: 616691 - RNA, 19 nt, Homo sapiens
cagggugguuauugcuaua

SEQ ID NO: 616692 - RNA, 19 nt, Homo sapiens
gacuugggcuagagcagaa

SEQ ID NO: 616693 - RNA, 19 nt, Homo sapiens
uggaaacccuuuguauaug

SEQ ID NO: 616694 - RNA, 19 nt, Homo sapiens
ggaaugaugggcgauacaa

SEQ ID NO: 616695 - RNA, 19 nt, Homo sapiens
ugccaucguuguaggagua

SEQ ID NO: 616696 - RNA, 19 nt, Homo sapiens
guaaagaggaagguguauu

SEQ ID NO: 616697 - RNA, 19 nt, Homo sapiens
uggcugaguuugggacuuu

SEQ ID NO: 616698 - RNA, 19 nt, Homo sapiens
uuggaaacccuuuguauau

SEQ ID NO: 616699 - RNA, 19 nt, Homo sapiens
cugaggaacuggcaagauc

SEQ ID NO: 616700 - RNA, 19 nt, Homo sapiens
cagcuaaagaggcuucaaa

SEQ ID NO: 616701 - RNA, 19 nt, Homo sapiens
gggcacuguugaugguauu

SEQ ID NO: 616702 - RNA, 19 nt, Homo sapiens
acugaugggugacauugaa

SEQ ID NO: 616703 - RNA, 19 nt, Homo sapiens
guaccacuguaagucauga

SEQ ID NO: 616704 - RNA, 19 nt, Homo sapiens
ccucgguucucauuaaagu

SEQ ID NO: 616705 - RNA, 19 nt, Homo sapiens
gugguuaaauguaauuggu

SEQ ID NO: 616706 - RNA, 19 nt, Homo sapiens
gcuaaagaggcuucaaauc

SEQ ID NO: 616707 - RNA, 19 nt, Homo sapiens
caccgauguucuaaagauu

SEQ ID NO: 616708 - RNA, 19 nt, Homo sapiens
aaugaugggcgauacaauu

SEQ ID NO: 616709 - RNA, 19 nt, Homo sapiens
gcuaccagucuaugauauu

SEQ ID NO: 616710 - RNA, 19 nt, Homo sapiens
uagaacguuuagaagauga

SEQ ID NO: 616711 - RNA, 19 nt, Homo sapiens
cgagagaaaguguuaacau

SEQ ID NO: 616712 - RNA, 19 nt, Homo sapiens
cccguguucuaauguauuu

SEQ ID NO: 616713 - RNA, 19 nt, Homo sapiens
uuacauacgagcagcuaaa

SEQ ID NO: 616714 - RNA, 19 nt, Homo sapiens
gcuuauucguagaacguuu

SEQ ID NO: 616715 - RNA, 19 nt, Homo sapiens
gaagcgcuuauucguagaa

SEQ ID NO: 616716 - RNA, 19 nt, Homo sapiens
gaugcccguuucaaagaga

SEQ ID NO: 616717 - RNA, 19 nt, Homo sapiens
ggugguuauugcuauaugu

SEQ ID NO: 616718 - RNA, 19 nt, Homo sapiens
ccagaaaaguaccacugua

SEQ ID NO: 616719 - RNA, 19 nt, Homo sapiens
ucgcaucuguaaagaggaa

SEQ ID NO: 616720 - RNA, 19 nt, Homo sapiens
gaagaacaguggggugguu

SEQ ID NO: 616721 - RNA, 19 nt, Homo sapiens
guucgaacucgcaugauga

SEQ ID NO: 616722 - RNA, 19 nt, Homo sapiens
gaacguuuagaagaugaaa

SEQ ID NO: 616723 - RNA, 19 nt, Homo sapiens
gagggugaauggguaucuu

SEQ ID NO: 616724 - RNA, 19 nt, Homo sapiens
cacuguaagucaugagaug

SEQ ID NO: 616725 - RNA, 19 nt, Homo sapiens
gcgauacaauuuuaacuca

SEQ ID NO: 616726 - RNA, 19 nt, Homo sapiens
uaagacaagcaucauaugg

SEQ ID NO: 616727 - RNA, 19 nt, Homo sapiens
guauuuauuggcagaauca

SEQ ID NO: 616728 - RNA, 19 nt, Homo sapiens
guuuccagcuuuacaugug

SEQ ID NO: 616729 - RNA, 19 nt, Homo sapiens
gaaugaugggcgauacaau

SEQ ID NO: 616730 - RNA, 19 nt, Homo sapiens
gauauauaccaacaagaag

SEQ ID NO: 616731 - RNA, 19 nt, Homo sapiens
gauuggaagcuuuaucgau

SEQ ID NO: 616732 - RNA, 19 nt, Homo sapiens
gugauaucuuccacuauag

SEQ ID NO: 616733 - RNA, 19 nt, Homo sapiens
gaaaaguaccacuguaagu

SEQ ID NO: 616734 - RNA, 19 nt, Homo sapiens
aaaguaccacuguaaguca

SEQ ID NO: 616735 - RNA, 19 nt, Homo sapiens
acauguggaucucuauaag

SEQ ID NO: 616736 - RNA, 19 nt, Homo sapiens
ggagcaugauuggaagcuu

SEQ ID NO: 616737 - RNA, 19 nt, Homo sapiens
guguuaacauugagacucu

SEQ ID NO: 616738 - RNA, 19 nt, Homo sapiens
cauacgagcagcuaaagag

SEQ ID NO: 616739 - RNA, 19 nt, Homo sapiens
uauaagggcacuguugaug

SEQ ID NO: 616740 - RNA, 19 nt, Homo sapiens
uaaagaggcuucaaaucua

SEQ ID NO: 616741 - RNA, 19 nt, Homo sapiens
gagagaaaguguuaacauu

SEQ ID NO: 616742 - RNA, 19 nt, Homo sapiens
gagaaaguguuaacauuga

SEQ ID NO: 616743 - RNA, 19 nt, Homo sapiens
gagcaugauuggaagcuuu

SEQ ID NO: 616744 - RNA, 19 nt, Homo sapiens
aaagaggcuucaaaucuaa

SEQ ID NO: 616745 - RNA, 19 nt, Homo sapiens
cuaccagucuaugauauua

SEQ ID NO: 616746 - RNA, 19 nt, Homo sapiens
cuaugaagauggauacuga

SEQ ID NO: 616747 - RNA, 19 nt, Homo sapiens
ggaaacccuuuguauaugg

SEQ ID NO: 616748 - RNA, 19 nt, Homo sapiens
ucacuucguuuccagcuuu

SEQ ID NO: 616749 - RNA, 19 nt, Homo sapiens
caagggagcaugauuggaa

SEQ ID NO: 616750 - RNA, 19 nt, Homo sapiens
ugagaugucuggucugaau

SEQ ID NO: 616751 - RNA, 19 nt, Homo sapiens
agaccucgguucucauuaa

SEQ ID NO: 616752 - RNA, 19 nt, Homo sapiens
uaaagaggaagguguauug

SEQ ID NO: 616753 - RNA, 19 nt, Homo sapiens
ccaaaugugguuaaaugua

SEQ ID NO: 616754 - RNA, 19 nt, Homo sapiens
auuggaagcuuuaucgaua

SEQ ID NO: 616755 - RNA, 19 nt, Homo sapiens
ggacauguggaucucuaua

SEQ ID NO: 616756 - RNA, 19 nt, Homo sapiens
ccaccgauguucuaaagau

SEQ ID NO: 616757 - RNA, 19 nt, Homo sapiens
uguauuggcucucuauuca

SEQ ID NO: 616758 - RNA, 19 nt, Homo sapiens
aaacacgacuucagguuca

SEQ ID NO: 616759 - RNA, 19 nt, Homo sapiens
gaacucgcaugaugaacca

SEQ ID NO: 616760 - RNA, 19 nt, Homo sapiens
gagcuaccagucuaugaua

SEQ ID NO: 616761 - RNA, 19 nt, Homo sapiens
cuaaagaggcuucaaaucu

SEQ ID NO: 616762 - RNA, 19 nt, Homo sapiens
cgauauauaccaacaagaa

SEQ ID NO: 616763 - RNA, 19 nt, Homo sapiens
gguagugucaggagugaua

SEQ ID NO: 616764 - RNA, 19 nt, Homo sapiens
uuacagaccucgguucuca

SEQ ID NO: 616765 - RNA, 19 nt, Homo sapiens
guagaacguuuagaagaug

SEQ ID NO: 616766 - RNA, 19 nt, Homo sapiens
gcuaagacaagcaucauau

SEQ ID NO: 616767 - RNA, 19 nt, Homo sapiens
gauguuccaugcgcuguuu

SEQ ID NO: 616768 - RNA, 19 nt, Homo sapiens
gaugggcgauacaauuuua

SEQ ID NO: 616769 - RNA, 19 nt, Homo sapiens
gaccucgguucucauuaaa

SEQ ID NO: 616770 - RNA, 19 nt, Homo sapiens
cguagaacguuuagaagau

SEQ ID NO: 616771 - RNA, 19 nt, Homo sapiens
caugagaugucuggucuga

SEQ ID NO: 616772 - RNA, 19 nt, Homo sapiens
cuucaaaucuaagaacuga

SEQ ID NO: 616773 - RNA, 19 nt, Homo sapiens
gaauuggaaacccuuugua

SEQ ID NO: 616774 - RNA, 19 nt, Homo sapiens
guucaaggccaaagcauug

SEQ ID NO: 616775 - RNA, 19 nt, Homo sapiens
gacauguggaucucuauaa

SEQ ID NO: 616776 - RNA, 19 nt, Homo sapiens
ugucuggucugaauuggaa

SEQ ID NO: 616777 - RNA, 19 nt, Homo sapiens
guggaaacaugagggcuuu

SEQ ID NO: 616778 - RNA, 19 nt, Homo sapiens
uggaagcuuuaucgauaua

SEQ ID NO: 616779 - RNA, 19 nt, Homo sapiens
gaagguguauuggcucucu

SEQ ID NO: 616780 - RNA, 19 nt, Homo sapiens
cuaagggccuccugaugga

SEQ ID NO: 616781 - RNA, 19 nt, Homo sapiens
gguuauugcuauauguguu

SEQ ID NO: 616782 - RNA, 19 nt, Homo sapiens
ggcuagagcagaaggcaua

SEQ ID NO: 616783 - RNA, 19 nt, Homo sapiens
uuccaaaugugguuaaaug

SEQ ID NO: 616784 - RNA, 19 nt, Homo sapiens
uaagggcacuguugauggu

SEQ ID NO: 616785 - RNA, 19 nt, Homo sapiens
gguucgaacucgcaugaug

SEQ ID NO: 616786 - RNA, 19 nt, Homo sapiens
ccagggugguuauugcuau

SEQ ID NO: 616787 - RNA, 19 nt, Homo sapiens
gcauaggccagggugguua

SEQ ID NO: 616788 - RNA, 19 nt, Homo sapiens
gaaaguguuaacauugaga

SEQ ID NO: 616789 - RNA, 19 nt, Homo sapiens
agagaaaguguuaacauug

SEQ ID NO: 616790 - RNA, 19 nt, Homo sapiens
ugucaggagugauaucuuc

SEQ ID NO: 616791 - RNA, 19 nt, Homo sapiens
cagggugguuauugcuaua

SEQ ID NO: 616792 - RNA, 19 nt, Homo sapiens
gacuugggcuagagcagaa

SEQ ID NO: 616793 - RNA, 19 nt, Homo sapiens
uggaaacccuuuguauaug

SEQ ID NO: 616794 - RNA, 19 nt, Homo sapiens
ggaaugaugggcgauacaa

SEQ ID NO: 616795 - RNA, 19 nt, Homo sapiens
ugccaucguuguaggagua

SEQ ID NO: 616796 - RNA, 19 nt, Homo sapiens
guaaagaggaagguguauu

SEQ ID NO: 616797 - RNA, 19 nt, Homo sapiens
uggcugaguuugggacuuu

SEQ ID NO: 616798 - RNA, 19 nt, Homo sapiens
uuggaaacccuuuguauau

SEQ ID NO: 616799 - RNA, 19 nt, Homo sapiens
cugaggaacuggcaagauc

SEQ ID NO: 616800 - RNA, 19 nt, Homo sapiens
cagcuaaagaggcuucaaa

SEQ ID NO: 616801 - RNA, 19 nt, Homo sapiens
gggcacuguugaugguauu

SEQ ID NO: 616802 - RNA, 19 nt, Homo sapiens
acugaugggugacauugaa

SEQ ID NO: 616803 - RNA, 19 nt, Homo sapiens
guaccacuguaagucauga

SEQ ID NO: 616804 - RNA, 19 nt, Homo sapiens
ccucgguucucauuaaagu

SEQ ID NO: 616805 - RNA, 19 nt, Homo sapiens
gugguuaaauguaauuggu

SEQ ID NO: 616806 - RNA, 19 nt, Homo sapiens
gcuaaagaggcuucaaauc

SEQ ID NO: 616807 - RNA, 19 nt, Homo sapiens
caccgauguucuaaagauu

SEQ ID NO: 616808 - RNA, 19 nt, Homo sapiens
aaugaugggcgauacaauu

SEQ ID NO: 616809 - RNA, 19 nt, Homo sapiens
gcuaccagucuaugauauu

SEQ ID NO: 616810 - RNA, 19 nt, Homo sapiens
uagaacguuuagaagauga

SEQ ID NO: 616811 - RNA, 19 nt, Homo sapiens
cgagagaaaguguuaacau

SEQ ID NO: 616812 - RNA, 19 nt, Homo sapiens
cccguguucuaauguauuu

SEQ ID NO: 616813 - RNA, 19 nt, Homo sapiens
uuacauacgagcagcuaaa

SEQ ID NO: 616814 - RNA, 19 nt, Homo sapiens
gcuuauucguagaacguuu

SEQ ID NO: 616815 - RNA, 19 nt, Homo sapiens
gaagcgcuuauucguagaa

SEQ ID NO: 616816 - RNA, 19 nt, Homo sapiens
gaugcccguuucaaagaga

SEQ ID NO: 616817 - RNA, 19 nt, Homo sapiens
ggugguuauugcuauaugu

SEQ ID NO: 616818 - RNA, 19 nt, Homo sapiens
ccagaaaaguaccacugua

SEQ ID NO: 616819 - RNA, 19 nt, Homo sapiens
ucgcaucuguaaagaggaa

SEQ ID NO: 616820 - RNA, 19 nt, Homo sapiens
gaagaacaguggggugguu

SEQ ID NO: 616821 - RNA, 19 nt, Homo sapiens
guucgaacucgcaugauga

SEQ ID NO: 616822 - RNA, 19 nt, Homo sapiens
gaacguuuagaagaugaaa

SEQ ID NO: 616823 - RNA, 19 nt, Homo sapiens
gagggugaauggguaucuu

SEQ ID NO: 616824 - RNA, 19 nt, Homo sapiens
gcgauacaauuuuaacuca

SEQ ID NO: 616825 - RNA, 19 nt, Homo sapiens
cacuguaagucaugagaug

SEQ ID NO: 616826 - RNA, 19 nt, Homo sapiens
uaagacaagcaucauaugg

SEQ ID NO: 616827 - RNA, 19 nt, Homo sapiens
guauuuauuggcagaauca

SEQ ID NO: 616828 - RNA, 19 nt, Homo sapiens
guuuccagcuuuacaugug

SEQ ID NO: 616829 - RNA, 19 nt, Homo sapiens
gaaugaugggcgauacaau

SEQ ID NO: 616830 - RNA, 19 nt, Homo sapiens
gauauauaccaacaagaag

SEQ ID NO: 616831 - RNA, 19 nt, Homo sapiens
gauuggaagcuuuaucgau

SEQ ID NO: 616832 - RNA, 19 nt, Homo sapiens
gugauaucuuccacuauag

SEQ ID NO: 616833 - RNA, 19 nt, Homo sapiens
gaaaaguaccacuguaagu

SEQ ID NO: 616834 - RNA, 19 nt, Homo sapiens
acauguggaucucuauaag

SEQ ID NO: 616835 - RNA, 19 nt, Homo sapiens
ggagcaugauuggaagcuu

SEQ ID NO: 616836 - RNA, 19 nt, Homo sapiens
aaaguaccacuguaaguca

SEQ ID NO: 616837 - RNA, 19 nt, Homo sapiens
guguuaacauugagacucu

SEQ ID NO: 616838 - RNA, 19 nt, Homo sapiens
cauacgagcagcuaaagag

SEQ ID NO: 616839 - RNA, 19 nt, Homo sapiens
uauaagggcacuguugaug

SEQ ID NO: 616840 - RNA, 19 nt, Homo sapiens
ggacacaguuggaucaaua

SEQ ID NO: 616841 - RNA, 19 nt, Homo sapiens
gaacauauccucagcaaga

SEQ ID NO: 616842 - RNA, 19 nt, Homo sapiens
gagaauaccuagaacauau

SEQ ID NO: 616843 - RNA, 19 nt, Homo sapiens
ggaauuauccaccauuuaa

SEQ ID NO: 616844 - RNA, 19 nt, Homo sapiens
gaaaugguuugccuuaaug

SEQ ID NO: 616845 - RNA, 19 nt, Homo sapiens
caagaaagaugcaucaauc

SEQ ID NO: 616846 - RNA, 19 nt, Homo sapiens
agucauauaugcacaguua

SEQ ID NO: 616847 - RNA, 19 nt, Homo sapiens
gagaguuugucaccaguua

SEQ ID NO: 616848 - RNA, 19 nt, Homo sapiens
ggauggagaugcuaugaug

SEQ ID NO: 616849 - RNA, 19 nt, Homo sapiens
gacaauagcagauccugua

SEQ ID NO: 616850 - RNA, 19 nt, Homo sapiens
aauagcagauccuguagua

SEQ ID NO: 616851 - RNA, 19 nt, Homo sapiens
agagaaagauguguacaaa

SEQ ID NO: 616852 - RNA, 19 nt, Homo sapiens
aaguguaccuugggaauua

SEQ ID NO: 616853 - RNA, 19 nt, Homo sapiens
agaaagauguguacaaagg

SEQ ID NO: 616854 - RNA, 19 nt, Homo sapiens
gcaccuauaucugugaugu

SEQ ID NO: 616855 - RNA, 19 nt, Homo sapiens
gauucuggcuguccucuau

SEQ ID NO: 616856 - RNA, 19 nt, Homo sapiens
agaaaugguuugccuuaau

SEQ ID NO: 616857 - RNA, 19 nt, Homo sapiens
aaagagaauuugccugugu

SEQ ID NO: 616858 - RNA, 19 nt, Homo sapiens
uagcagauccuguaguauu

SEQ ID NO: 616859 - RNA, 19 nt, Homo sapiens
uaucagccuuggaaguaua

SEQ ID NO: 616860 - RNA, 19 nt, Homo sapiens
cuugacagcuggaguauca

SEQ ID NO: 616861 - RNA, 19 nt, Homo sapiens
aaagaugcaucaaucaaca

SEQ ID NO: 616862 - RNA, 19 nt, Homo sapiens
cuugaaaugugucauauca

SEQ ID NO: 616863 - RNA, 19 nt, Homo sapiens
ccgaaagaauuaagagaau

SEQ ID NO: 616864 - RNA, 19 nt, Homo sapiens
cuauaucugugaugucaaa

SEQ ID NO: 616865 - RNA, 19 nt, Homo sapiens
gugacaagauuaacaaguc

SEQ ID NO: 616866 - RNA, 19 nt, Homo sapiens
gggaauuauccaccauuua

SEQ ID NO: 616867 - RNA, 19 nt, Homo sapiens
gaagcugaccugcaaguuc

SEQ ID NO: 616868 - RNA, 19 nt, Homo sapiens
gcaagauuagcaaaggaua

SEQ ID NO: 616869 - RNA, 19 nt, Homo sapiens
gagagaaagauguguacaa

SEQ ID NO: 616870 - RNA, 19 nt, Homo sapiens
guaguggugggcauaguua

SEQ ID NO: 616871 - RNA, 19 nt, Homo sapiens
cacaguaucaguaccauuu

SEQ ID NO: 616872 - RNA, 19 nt, Homo sapiens
uuagaaaugguuugccuua

SEQ ID NO: 616873 - RNA, 19 nt, Homo sapiens
gagccaguguugcaugaug

SEQ ID NO: 616874 - RNA, 19 nt, Homo sapiens
gaaagaugcaucaaucaac

SEQ ID NO: 616875 - RNA, 19 nt, Homo sapiens
gaaagauguguacaaagga

SEQ ID NO: 616876 - RNA, 19 nt, Homo sapiens
uagaacauauccucagcaa

SEQ ID NO: 616877 - RNA, 19 nt, Homo sapiens
caagauuagcaaaggauaa

SEQ ID NO: 616878 - RNA, 19 nt, Homo sapiens
cauaucaauuucuggauuc

SEQ ID NO: 616879 - RNA, 19 nt, Homo sapiens
uagaaaugguuugccuuaa

SEQ ID NO: 616880 - RNA, 19 nt, Homo sapiens
ucacagagggagagaaaga

SEQ ID NO: 616881 - RNA, 19 nt, Homo sapiens
aagggaagcugaccugcaa

SEQ ID NO: 616882 - RNA, 19 nt, Homo sapiens
aagcugaccugcaaguuca

SEQ ID NO: 616883 - RNA, 19 nt, Homo sapiens
gauaugaggagccaguguu

SEQ ID NO: 616884 - RNA, 19 nt, Homo sapiens
guaaagagucugccuucug

SEQ ID NO: 616885 - RNA, 19 nt, Homo sapiens
gcucuugacagcuggagua

SEQ ID NO: 616886 - RNA, 19 nt, Homo sapiens
uuuguaacguggagaguaa

SEQ ID NO: 616887 - RNA, 19 nt, Homo sapiens
uaaguuugcacccuugaaa

SEQ ID NO: 616888 - RNA, 19 nt, Homo sapiens
caguagacauggccuuuua

SEQ ID NO: 616889 - RNA, 19 nt, Homo sapiens
gcaucaaucaacauagaaa

SEQ ID NO: 616890 - RNA, 19 nt, Homo sapiens
gacauggccuuuuaaucua

SEQ ID NO: 616891 - RNA, 19 nt, Homo sapiens
gcaguacaucagagaguuu

SEQ ID NO: 616892 - RNA, 19 nt, Homo sapiens
aaguucaagucuacuagua

SEQ ID NO: 616893 - RNA, 19 nt, Homo sapiens
ggaaguauauacgccaaaa

SEQ ID NO: 616894 - RNA, 19 nt, Homo sapiens
agucuuagcauuuacugua

SEQ ID NO: 616895 - RNA, 19 nt, Homo sapiens
cugauuagucuuagcauuu

SEQ ID NO: 616896 - RNA, 19 nt, Homo sapiens
aaagauguguacaaaggau

SEQ ID NO: 616897 - RNA, 19 nt, Homo sapiens
ucaccagggcccagucaua

SEQ ID NO: 616898 - RNA, 19 nt, Homo sapiens
agcagauccuguaguauuu

SEQ ID NO: 616899 - RNA, 19 nt, Homo sapiens
gaauuugccuguguuucca

SEQ ID NO: 616900 - RNA, 19 nt, Homo sapiens
gauuagcaaaggauaaaug

SEQ ID NO: 616901 - RNA, 19 nt, Homo sapiens
acacugagggucuuguaaa

SEQ ID NO: 616902 - RNA, 19 nt, Homo sapiens
caauggcaccuauaucugu

SEQ ID NO: 616903 - RNA, 19 nt, Homo sapiens
ugggaauuauccaccauuu

SEQ ID NO: 616904 - RNA, 19 nt, Homo sapiens
caguaucaguaccauuuau

SEQ ID NO: 616905 - RNA, 19 nt, Homo sapiens
ccagggcccagucauauau

SEQ ID NO: 616906 - RNA, 19 nt, Homo sapiens
aaggauaaaugccgaaggu

SEQ ID NO: 616907 - RNA, 19 nt, Homo sapiens
ucaguaccauuuauuuguc

SEQ ID NO: 616908 - RNA, 19 nt, Homo sapiens
gaaaagaugguaugauucu

SEQ ID NO: 616909 - RNA, 19 nt, Homo sapiens
gaaaucuucguggcaaaug

SEQ ID NO: 616910 - RNA, 19 nt, Homo sapiens
uagcaagauuagcaaagga

SEQ ID NO: 616911 - RNA, 19 nt, Homo sapiens
agagaauaccuagaacaua

SEQ ID NO: 616912 - RNA, 19 nt, Homo sapiens
guaucagccuuggaaguau

SEQ ID NO: 616913 - RNA, 19 nt, Homo sapiens
ggacacauuaggcucuaug

SEQ ID NO: 616914 - RNA, 19 nt, Homo sapiens
cuauuuagucauccugaua

SEQ ID NO: 616915 - RNA, 19 nt, Homo sapiens
agaaagaugcaucaaucaa

SEQ ID NO: 616916 - RNA, 19 nt, Homo sapiens
ugacaagaaagaugcauca

SEQ ID NO: 616917 - RNA, 19 nt, Homo sapiens
gaggauggagaugcuauga

SEQ ID NO: 616918 - RNA, 19 nt, Homo sapiens
aagagaauuugccuguguu

SEQ ID NO: 616919 - RNA, 19 nt, Homo sapiens
cacaauggcaccuauaucu

SEQ ID NO: 616920 - RNA, 19 nt, Homo sapiens
gcacaguaucaguaccauu

SEQ ID NO: 616921 - RNA, 19 nt, Homo sapiens
aguaucagccuuggaagua

SEQ ID NO: 616922 - RNA, 19 nt, Homo sapiens
uauacacaauggcaccuau

SEQ ID NO: 616923 - RNA, 19 nt, Homo sapiens
gcaaguucaagucuacuag

SEQ ID NO: 616924 - RNA, 19 nt, Homo sapiens
acaauugggagauuucaga

SEQ ID NO: 616925 - RNA, 19 nt, Homo sapiens
uaagagaauaccuagaaca

SEQ ID NO: 616926 - RNA, 19 nt, Homo sapiens
ggauauccgaaagaauuaa

SEQ ID NO: 616927 - RNA, 19 nt, Homo sapiens
cgacacugagggucuugua

SEQ ID NO: 616928 - RNA, 19 nt, Homo sapiens
augcaucaaucaacauaga

SEQ ID NO: 616929 - RNA, 19 nt, Homo sapiens
uauccaccauuuaaagaca

SEQ ID NO: 616930 - RNA, 19 nt, Homo sapiens
ccuguaguauuuccaguag

SEQ ID NO: 616931 - RNA, 19 nt, Homo sapiens
uguagcccauuaccacauu

SEQ ID NO: 616932 - RNA, 19 nt, Homo sapiens
aaacccuccugacaucguu

SEQ ID NO: 616933 - RNA, 19 nt, Homo sapiens
acaagaaagaugcaucaau

SEQ ID NO: 616934 - RNA, 19 nt, Homo sapiens
gcaauuguuagccuuacau

SEQ ID NO: 616935 - RNA, 19 nt, Homo sapiens
cauuuacaauugggagauu

SEQ ID NO: 616936 - RNA, 19 nt, Homo sapiens
gagaaagauguguacaaag

SEQ ID NO: 616937 - RNA, 19 nt, Homo sapiens
guagcccauuaccacauuu

SEQ ID NO: 616938 - RNA, 19 nt, Homo sapiens
ucauauaugcacaguuaga

SEQ ID NO: 616939 - RNA, 19 nt, Homo sapiens
gagucugccuucuggaucu

SEQ ID NO: 616940 - RNA, 19 nt, Homo sapiens
gcacgaugcugcccugaaa

SEQ ID NO: 616941 - RNA, 19 nt, Homo sapiens
gaucagaacuccacaaacu

SEQ ID NO: 616942 - RNA, 19 nt, Homo sapiens
caaauacagucucuuaaug

SEQ ID NO: 616943 - RNA, 19 nt, Homo sapiens
ucaaaccucuuccagauuu

SEQ ID NO: 616944 - RNA, 19 nt, Homo sapiens
ggaagaaacggaagaagaa

SEQ ID NO: 616945 - RNA, 19 nt, Homo sapiens
caaagaagguguguaagug

SEQ ID NO: 616946 - RNA, 19 nt, Homo sapiens
ggauugaccucacccagaa

SEQ ID NO: 616947 - RNA, 19 nt, Homo sapiens
gaagggugaugcaggauau

SEQ ID NO: 616948 - RNA, 19 nt, Homo sapiens
ggacucacguagcauuaaa

SEQ ID NO: 616949 - RNA, 19 nt, Homo sapiens
ggucugggauucuaaguga

SEQ ID NO: 616950 - RNA, 19 nt, Homo sapiens
ucaguucccucaucuguaa

SEQ ID NO: 616951 - RNA, 19 nt, Homo sapiens
gaccaaagaagguguguaa

SEQ ID NO: 616952 - RNA, 19 nt, Homo sapiens
uaagugaccugcucugugu

SEQ ID NO: 616953 - RNA, 19 nt, Homo sapiens
gcacucugaugaccucaaa

SEQ ID NO: 616954 - RNA, 19 nt, Homo sapiens
cagaaugccucccaggauu

SEQ ID NO: 616955 - RNA, 19 nt, Homo sapiens
gagaagaacccaucaaagg

SEQ ID NO: 616956 - RNA, 19 nt, Homo sapiens
gcagcuggaaauagaauua

SEQ ID NO: 616957 - RNA, 19 nt, Homo sapiens
gauccugaaugacgugauu

SEQ ID NO: 616958 - RNA, 19 nt, Homo sapiens
aaacagagcuccgucuaca

SEQ ID NO: 616959 - RNA, 19 nt, Homo sapiens
gaggauguuuggaggauga

SEQ ID NO: 616960 - RNA, 19 nt, Homo sapiens
gcacuuugcacucugauga

SEQ ID NO: 616961 - RNA, 19 nt, Homo sapiens
guauggagcugugagagaa

SEQ ID NO: 616962 - RNA, 19 nt, Homo sapiens
ugaaugacgugauuaccaa

SEQ ID NO: 616963 - RNA, 19 nt, Homo sapiens
ggaagaagaagagcucaaa

SEQ ID NO: 616964 - RNA, 19 nt, Homo sapiens
ccucaaaccucuuccagau

SEQ ID NO: 616965 - RNA, 19 nt, Homo sapiens
gaucagugaccauuuguug

SEQ ID NO: 616966 - RNA, 19 nt, Homo sapiens
ccagaauugucccuuugua

SEQ ID NO: 616967 - RNA, 19 nt, Homo sapiens
gauggcaugugcaggauug

SEQ ID NO: 616968 - RNA, 19 nt, Homo sapiens
gcacucaguucccucaucu

SEQ ID NO: 616969 - RNA, 19 nt, Homo sapiens
ucaagccaguggauuauga

SEQ ID NO: 616970 - RNA, 19 nt, Homo sapiens
gggaaagcgucgcagcaaa

SEQ ID NO: 616971 - RNA, 19 nt, Homo sapiens
gguggacucuguuaccauu

SEQ ID NO: 616972 - RNA, 19 nt, Homo sapiens
cagcaaagcccggaagaaa

SEQ ID NO: 616973 - RNA, 19 nt, Homo sapiens
gaaagugggagauccugaa

SEQ ID NO: 616974 - RNA, 19 nt, Homo sapiens
cgccaaaucaagccaauua

SEQ ID NO: 616975 - RNA, 19 nt, Homo sapiens
gagagugucaaguguguaa

SEQ ID NO: 616976 - RNA, 19 nt, Homo sapiens
ccaaauacagucucuuaau

SEQ ID NO: 616977 - RNA, 19 nt, Homo sapiens
guccaaauacagucucuua

SEQ ID NO: 616978 - RNA, 19 nt, Homo sapiens
gagaauagccaagaguuca

SEQ ID NO: 616979 - RNA, 19 nt, Homo sapiens
caugaucagugcuaaggaa

SEQ ID NO: 616980 - RNA, 19 nt, Homo sapiens
guagaauacaccacacuuu

SEQ ID NO: 616981 - RNA, 19 nt, Homo sapiens
ggaaggcucccugguagaa

SEQ ID NO: 616982 - RNA, 19 nt, Homo sapiens
agugggagauccugaauga

SEQ ID NO: 616983 - RNA, 19 nt, Homo sapiens
ucaaaggccucucaaagcu

SEQ ID NO: 616984 - RNA, 19 nt, Homo sapiens
gaaccgggcacuacagcaa

SEQ ID NO: 616985 - RNA, 19 nt, Homo sapiens
ggaaagcagcagagagaga

SEQ ID NO: 616986 - RNA, 19 nt, Homo sapiens
ucaccaagccucugaagga

SEQ ID NO: 616987 - RNA, 19 nt, Homo sapiens
gaacucuuuguaagcaaua

SEQ ID NO: 616988 - RNA, 19 nt, Homo sapiens
ggagauggcagugauggaa

SEQ ID NO: 616989 - RNA, 19 nt, Homo sapiens
ccaaagaagguguguaagu

SEQ ID NO: 616990 - RNA, 19 nt, Homo sapiens
ugagcaaacuggccugugu

SEQ ID NO: 616991 - RNA, 19 nt, Homo sapiens
ggagaagagcccuguguuc

SEQ ID NO: 616992 - RNA, 19 nt, Homo sapiens
uaaaucagcugugaaucgu

SEQ ID NO: 616993 - RNA, 19 nt, Homo sapiens
gcagaaugccucccaggau

SEQ ID NO: 616994 - RNA, 19 nt, Homo sapiens
caucaaaggccucucaaag

SEQ ID NO: 616995 - RNA, 19 nt, Homo sapiens
caagacauccaccgccaaa

SEQ ID NO: 616996 - RNA, 19 nt, Homo sapiens
gggagaauauaaagaacca

SEQ ID NO: 616997 - RNA, 19 nt, Homo sapiens
gagcaaacuggccugugua

SEQ ID NO: 616998 - RNA, 19 nt, Homo sapiens
gaacuccacaaacugauca

SEQ ID NO: 616999 - RNA, 19 nt, Homo sapiens
ggaaagcgucgcagcaaag

SEQ ID NO: 617000 - RNA, 19 nt, Homo sapiens
gagucuggguuguagagaa

SEQ ID NO: 617001 - RNA, 19 nt, Homo sapiens
aaggcucccugguagaaua

SEQ ID NO: 617002 - RNA, 19 nt, Homo sapiens
gugagaagaacccaucaaa

SEQ ID NO: 617003 - RNA, 19 nt, Homo sapiens
gaauaccuccacucacgaa

SEQ ID NO: 617004 - RNA, 19 nt, Homo sapiens
gccaguggauuaugaguac

SEQ ID NO: 617005 - RNA, 19 nt, Homo sapiens
ggugaugacaaauguuaaa

SEQ ID NO: 617006 - RNA, 19 nt, Homo sapiens
gucuugagcuguccacaug

SEQ ID NO: 617007 - RNA, 19 nt, Homo sapiens
aagaagguguguaagugaa

SEQ ID NO: 617008 - RNA, 19 nt, Homo sapiens
ggccuugggucaacaucuu

SEQ ID NO: 617009 - RNA, 19 nt, Homo sapiens
gaauugucccuuuguaugg

SEQ ID NO: 617010 - RNA, 19 nt, Homo sapiens
gaagcucauucccacaucu

SEQ ID NO: 617011 - RNA, 19 nt, Homo sapiens
gaagguguguaagugaagu

SEQ ID NO: 617012 - RNA, 19 nt, Homo sapiens
ccuccaggcugcugugaga

SEQ ID NO: 617013 - RNA, 19 nt, Homo sapiens
gcagaggcacacauaaaca

SEQ ID NO: 617014 - RNA, 19 nt, Homo sapiens
aaacuggccuguguagaca

SEQ ID NO: 617015 - RNA, 19 nt, Homo sapiens
aaacuggccuguguagaca

SEQ ID NO: 617016 - RNA, 19 nt, Homo sapiens
gugagagugucaagugugu

SEQ ID NO: 617017 - RNA, 19 nt, Homo sapiens
gaacguguagcuguugaga

SEQ ID NO: 617018 - RNA, 19 nt, Homo sapiens
ucuccucccuugacuuuga

SEQ ID NO: 617019 - RNA, 19 nt, Homo sapiens
caccaagccucugaaggaa

SEQ ID NO: 617020 - RNA, 19 nt, Homo sapiens
ccgagagucuugaucagau

SEQ ID NO: 617021 - RNA, 19 nt, Homo sapiens
gagaacucuuuguaagcaa

SEQ ID NO: 617022 - RNA, 19 nt, Homo sapiens
aaagaagguguguaaguga

SEQ ID NO: 617023 - RNA, 19 nt, Homo sapiens
cggaagaaacggaagaaga

SEQ ID NO: 617024 - RNA, 19 nt, Homo sapiens
gcaaagcccggaagaaacg

SEQ ID NO: 617025 - RNA, 19 nt, Homo sapiens
guguguaagugaagugguu

SEQ ID NO: 617026 - RNA, 19 nt, Homo sapiens
ggaggaauaccuagugcau

SEQ ID NO: 617027 - RNA, 19 nt, Homo sapiens
caaaauggcccgugugugu

SEQ ID NO: 617028 - RNA, 19 nt, Homo sapiens
gaaacagagcuccgucuac

SEQ ID NO: 617029 - RNA, 19 nt, Homo sapiens
aaggaaagcagcagagaga

SEQ ID NO: 617030 - RNA, 19 nt, Homo sapiens
gaucagugcuaaggaaagc

SEQ ID NO: 617031 - RNA, 19 nt, Homo sapiens
agaaccaggucagcaggua

SEQ ID NO: 617032 - RNA, 19 nt, Homo sapiens
ugggaacccuuaccucugu

SEQ ID NO: 617033 - RNA, 19 nt, Homo sapiens
caaaucaagccaauuacca

SEQ ID NO: 617034 - RNA, 19 nt, Homo sapiens
caagugggaggucugaaga

SEQ ID NO: 617035 - RNA, 19 nt, Homo sapiens
gcaagugggaggucugaag

SEQ ID NO: 617036 - RNA, 19 nt, Homo sapiens
gaaggugaaccgggcacua

SEQ ID NO: 617037 - RNA, 19 nt, Homo sapiens
gauguuuggaggaugagua

SEQ ID NO: 617038 - RNA, 19 nt, Homo sapiens
gagaagcucauucccacau

SEQ ID NO: 617039 - RNA, 19 nt, Homo sapiens
gcaugugacuccucaaacc

SEQ ID NO: 617040 - RNA, 19 nt, Homo sapiens
cagcaucucugucggaaga

SEQ ID NO: 617041 - RNA, 19 nt, Homo sapiens
cagaagagccuauuacauc

SEQ ID NO: 617042 - RNA, 19 nt, Homo sapiens
gaagagccuauuacaucua

SEQ ID NO: 617043 - RNA, 19 nt, Homo sapiens
caccuggacuccuaugaga

SEQ ID NO: 617044 - RNA, 19 nt, Homo sapiens
agaagagccuauuacaucu

SEQ ID NO: 617045 - RNA, 19 nt, Homo sapiens
gaccagcgccacuucuuca

SEQ ID NO: 617046 - RNA, 19 nt, Homo sapiens
ccaagaaccugcgcaucca

SEQ ID NO: 617047 - RNA, 19 nt, Homo sapiens
ggaccagcgccacuucuuc

SEQ ID NO: 617048 - RNA, 19 nt, Homo sapiens
ggucacccacagcaaguuu

SEQ ID NO: 617049 - RNA, 19 nt, Homo sapiens
ccuggacuccuaugagaaa

SEQ ID NO: 617050 - RNA, 19 nt, Homo sapiens
ccagaagagccuauuacau

SEQ ID NO: 617051 - RNA, 19 nt, Homo sapiens
caacguggccacucuucag

SEQ ID NO: 617052 - RNA, 19 nt, Homo sapiens
gcaggagagcggcuucuac

SEQ ID NO: 617053 - RNA, 19 nt, Homo sapiens
ucaagaccuucagcuccaa

SEQ ID NO: 617054 - RNA, 19 nt, Homo sapiens
gagaaagaguucaaauaca

SEQ ID NO: 617055 - RNA, 19 nt, Homo sapiens
ggagaaagaguucaaauac

SEQ ID NO: 617056 - RNA, 19 nt, Homo sapiens
ccgcgucugucgcccaaua

SEQ ID NO: 617057 - RNA, 19 nt, Homo sapiens
agaaagaguucaaauacac

SEQ ID NO: 617058 - RNA, 19 nt, Homo sapiens
aggagaaagaguucaaaua

SEQ ID NO: 617059 - RNA, 19 nt, Homo sapiens
cagacacgcugcagaucga

SEQ ID NO: 617060 - RNA, 19 nt, Homo sapiens
ugacagcgacgccaagaca

SEQ ID NO: 617061 - RNA, 19 nt, Homo sapiens
gcaggagaaagaguucaaa

SEQ ID NO: 617062 - RNA, 19 nt, Homo sapiens
agacagacacgcugcagau

SEQ ID NO: 617063 - RNA, 19 nt, Homo sapiens
ucuccgcguucaucaagaa

SEQ ID NO: 617064 - RNA, 19 nt, Homo sapiens
aggcaucuuugucgggaaa

SEQ ID NO: 617065 - RNA, 19 nt, Homo sapiens
caaguucuccgcguucauc

SEQ ID NO: 617066 - RNA, 19 nt, Homo sapiens
cggacgugcugaaggacuu

SEQ ID NO: 617067 - RNA, 19 nt, Homo sapiens
caggagaaagaguucaaau

SEQ ID NO: 617068 - RNA, 19 nt, Homo sapiens
ugcccauccugcucuauga

SEQ ID NO: 617069 - RNA, 19 nt, Homo sapiens
ggacuuguuuguagaauaa

SEQ ID NO: 617070 - RNA, 19 nt, Homo sapiens
ggacagugaccaagaauua

SEQ ID NO: 617071 - RNA, 19 nt, Homo sapiens
caacuucgcuccguacuuu

SEQ ID NO: 617072 - RNA, 19 nt, Homo sapiens
gcaaugagcugccacaacu

SEQ ID NO: 617073 - RNA, 19 nt, Homo sapiens
gagaaacaccugagcuaua

SEQ ID NO: 617074 - RNA, 19 nt, Homo sapiens
gaaauguuauucgugcuuu

SEQ ID NO: 617075 - RNA, 19 nt, Homo sapiens
cugcaucacucucacuuua

SEQ ID NO: 617076 - RNA, 19 nt, Homo sapiens
agaaacaccugagcuauau

SEQ ID NO: 617077 - RNA, 19 nt, Homo sapiens
auucaucacuggcauauuu

SEQ ID NO: 617078 - RNA, 19 nt, Homo sapiens
gaauccugcauaugaauua

SEQ ID NO: 617079 - RNA, 19 nt, Homo sapiens
acacuugaaugaagagaaa

SEQ ID NO: 617080 - RNA, 19 nt, Homo sapiens
uaaaaggacuuguuuguag

SEQ ID NO: 617081 - RNA, 19 nt, Homo sapiens
gcuggacagugaccaagaa

SEQ ID NO: 617082 - RNA, 19 nt, Homo sapiens
ggaugguguugacuucuga

SEQ ID NO: 617083 - RNA, 19 nt, Homo sapiens
caccugagcuauauauuuu

SEQ ID NO: 617084 - RNA, 19 nt, Homo sapiens
gaaacaccugagcuauaua

SEQ ID NO: 617085 - RNA, 19 nt, Homo sapiens
gguguugacuucugacucu

SEQ ID NO: 617086 - RNA, 19 nt, Homo sapiens
ucacuggcauauuuagaau

SEQ ID NO: 617087 - RNA, 19 nt, Homo sapiens
gagcgucugggaacuguuu

SEQ ID NO: 617088 - RNA, 19 nt, Homo sapiens
acagugaccaagaauuaua

SEQ ID NO: 617089 - RNA, 19 nt, Homo sapiens
acaccugagcuauauauuu

SEQ ID NO: 617090 - RNA, 19 nt, Homo sapiens
caagauccacccugacuuc

SEQ ID NO: 617091 - RNA, 19 nt, Homo sapiens
uagucuagcucaccucaau

SEQ ID NO: 617092 - RNA, 19 nt, Homo sapiens
ccuugaauccugcauauga

SEQ ID NO: 617093 - RNA, 19 nt, Homo sapiens
aaacaccugagcuauauau

SEQ ID NO: 617094 - RNA, 19 nt, Homo sapiens
gcaucacucucacuuuaac

SEQ ID NO: 617095 - RNA, 19 nt, Homo sapiens
ccgugacgcugcugcauug

SEQ ID NO: 617096 - RNA, 19 nt, Homo sapiens
guugacuucugacucuaaa

SEQ ID NO: 617097 - RNA, 19 nt, Homo sapiens
ccggucaucuucuccauca

SEQ ID NO: 617098 - RNA, 19 nt, Homo sapiens
cuaccagcaugugauguuu

SEQ ID NO: 617099 - RNA, 19 nt, Homo sapiens
ggacugcugugccuuucac

SEQ ID NO: 617100 - RNA, 19 nt, Homo sapiens
aagagaaacaccugagcua

SEQ ID NO: 617101 - RNA, 19 nt, Homo sapiens
ucugggaacuguuuucuuu

SEQ ID NO: 617102 - RNA, 19 nt, Homo sapiens
ucuaaaaccuggcuaaaag

SEQ ID NO: 617103 - RNA, 19 nt, Homo sapiens
cuugaauccugcauaugaa

SEQ ID NO: 617104 - RNA, 19 nt, Homo sapiens
ccacuccggcuacaacuuc

SEQ ID NO: 617105 - RNA, 19 nt, Homo sapiens
ugaccaagaauuauaguac

SEQ ID NO: 617106 - RNA, 19 nt, Homo sapiens
aggacuuguuuguagaaua

SEQ ID NO: 617107 - RNA, 19 nt, Homo sapiens
gcgcuggcaacgcaguaua

SEQ ID NO: 617108 - RNA, 19 nt, Homo sapiens
gacagugaccaagaauuau

SEQ ID NO: 617109 - RNA, 19 nt, Homo sapiens
aaaccuggcuaaaagaaug

SEQ ID NO: 617110 - RNA, 19 nt, Homo sapiens
gacauucaucacuggcaua

SEQ ID NO: 617111 - RNA, 19 nt, Homo sapiens
ggaccacuccggcuacaac

SEQ ID NO: 617112 - RNA, 19 nt, Homo sapiens
gcaacuucgcuccguacuu

SEQ ID NO: 617113 - RNA, 19 nt, Homo sapiens
guaccgcaccuuccacaag

SEQ ID NO: 617114 - RNA, 19 nt, Homo sapiens
cagcaugugauguuugugu

SEQ ID NO: 617115 - RNA, 19 nt, Homo sapiens
aaaaggacuuguuuguaga

SEQ ID NO: 617116 - RNA, 19 nt, Homo sapiens
ugaauccugcauaugaauu

SEQ ID NO: 617117 - RNA, 19 nt, Homo sapiens
ucacuuuaacugcaacuuc

SEQ ID NO: 617118 - RNA, 19 nt, Homo sapiens
ggcuacaacuucccuuggu

SEQ ID NO: 617119 - RNA, 19 nt, Homo sapiens
gaggaccacuccggcuaca

SEQ ID NO: 617120 - RNA, 19 nt, Homo sapiens
guggucaacaucuggcuuu

SEQ ID NO: 617121 - RNA, 19 nt, Homo sapiens
aaaggacuuguuuguagaa

SEQ ID NO: 617122 - RNA, 19 nt, Homo sapiens
gcuccguacuuuacacacu

SEQ ID NO: 617123 - RNA, 19 nt, Homo sapiens
ucuucuccaucaccacaua

SEQ ID NO: 617124 - RNA, 19 nt, Homo sapiens
ucaccacccugaccuucca

SEQ ID NO: 617125 - RNA, 19 nt, Homo sapiens
gggcuucuucgacaugaug

SEQ ID NO: 617126 - RNA, 19 nt, Homo sapiens
agccuugaauccugcauau

SEQ ID NO: 617127 - RNA, 19 nt, Homo sapiens
gugaccaagaauuauagua

SEQ ID NO: 617128 - RNA, 19 nt, Homo sapiens
uguggaugguguugacuuc

SEQ ID NO: 617129 - RNA, 19 nt, Homo sapiens
uguguucuugguauucuua

SEQ ID NO: 617130 - RNA, 19 nt, Homo sapiens
agagaaacaccugagcuau

SEQ ID NO: 617131 - RNA, 19 nt, Homo sapiens
gcaugugauguuuguguuc

SEQ ID NO: 617132 - RNA, 19 nt, Homo sapiens
gcgaagaaguccugguuug

SEQ ID NO: 617133 - RNA, 19 nt, Homo sapiens
guggugagcucuucgacua

SEQ ID NO: 617134 - RNA, 19 nt, Homo sapiens
gcgagcuacuguaaacuuu

SEQ ID NO: 617135 - RNA, 19 nt, Homo sapiens
aaagaauuccugcaagaua

SEQ ID NO: 617136 - RNA, 19 nt, Homo sapiens
uuaaagaauuccugcaaga

SEQ ID NO: 617137 - RNA, 19 nt, Homo sapiens
cagaaacacauaugguaua

SEQ ID NO: 617138 - RNA, 19 nt, Homo sapiens
gcgagucggugcugaugaa

SEQ ID NO: 617139 - RNA, 19 nt, Homo sapiens
ggaauuaucccgaaaaguu

SEQ ID NO: 617140 - RNA, 19 nt, Homo sapiens
caacguagccacaggaaca

SEQ ID NO: 617141 - RNA, 19 nt, Homo sapiens
gcacauucagaaacacaua

SEQ ID NO: 617142 - RNA, 19 nt, Homo sapiens
aagaauuccugcaagauau

SEQ ID NO: 617143 - RNA, 19 nt, Homo sapiens
aggagaagaugauuuacuu

SEQ ID NO: 617144 - RNA, 19 nt, Homo sapiens
uaaggaggcucggaaguuc

SEQ ID NO: 617145 - RNA, 19 nt, Homo sapiens
gaagguggccaucaagauc

SEQ ID NO: 617146 - RNA, 19 nt, Homo sapiens
ucgacuaccuggugaagaa

SEQ ID NO: 617147 - RNA, 19 nt, Homo sapiens
uggcugagguggaaacaga

SEQ ID NO: 617148 - RNA, 19 nt, Homo sapiens
cggcucaacuccaucaaga

SEQ ID NO: 617149 - RNA, 19 nt, Homo sapiens
gcugggaucaguguuauuu

SEQ ID NO: 617150 - RNA, 19 nt, Homo sapiens
gaauuaucccgaaaaguua

SEQ ID NO: 617151 - RNA, 19 nt, Homo sapiens
gaucuucguggucaucaaa

SEQ ID NO: 617152 - RNA, 19 nt, Homo sapiens
ggccagccguguuccagaa

SEQ ID NO: 617153 - RNA, 19 nt, Homo sapiens
uagagcacauucagaaaca

SEQ ID NO: 617154 - RNA, 19 nt, Homo sapiens
cuucgacgaugacaacuug

SEQ ID NO: 617155 - RNA, 19 nt, Homo sapiens
ugggaucaguguuauuuau

SEQ ID NO: 617156 - RNA, 19 nt, Homo sapiens
gggcugggaucaguguuau

SEQ ID NO: 617157 - RNA, 19 nt, Homo sapiens
gggaucaguguuauuuauu

SEQ ID NO: 617158 - RNA, 19 nt, Homo sapiens
ucagacaccacuaacugua

SEQ ID NO: 617159 - RNA, 19 nt, Homo sapiens
gaaggagaacggcaucuac

SEQ ID NO: 617160 - RNA, 19 nt, Homo sapiens
ggccagguuuuguguuuua

SEQ ID NO: 617161 - RNA, 19 nt, Homo sapiens
agacaccacuaacuguaug

SEQ ID NO: 617162 - RNA, 19 nt, Homo sapiens
cuacacacacaucuaaaga

SEQ ID NO: 617163 - RNA, 19 nt, Homo sapiens
gggaggcgcagaaggagaa

SEQ ID NO: 617164 - RNA, 19 nt, Homo sapiens
gaggagaaccaggagaaga

SEQ ID NO: 617165 - RNA, 19 nt, Homo sapiens
ccacaugccgcacuuuauc

SEQ ID NO: 617166 - RNA, 19 nt, Homo sapiens
gaauuccugcaagauauuu

SEQ ID NO: 617167 - RNA, 19 nt, Homo sapiens
gaaccaggagaagaugauu

SEQ ID NO: 617168 - RNA, 19 nt, Homo sapiens
ucagaaacacauaugguau

SEQ ID NO: 617169 - RNA, 19 nt, Homo sapiens
uccagaagccggucaaguu

SEQ ID NO: 617170 - RNA, 19 nt, Homo sapiens
accaggagaagaugauuua

SEQ ID NO: 617171 - RNA, 19 nt, Homo sapiens
ccagaagccggucaaguuc

SEQ ID NO: 617172 - RNA, 19 nt, Homo sapiens
gaaccagagcagcccauuc

SEQ ID NO: 617173 - RNA, 19 nt, Homo sapiens
gcuagagcacauucagaaa

SEQ ID NO: 617174 - RNA, 19 nt, Homo sapiens
cuaaggaggcucggaaguu

SEQ ID NO: 617175 - RNA, 19 nt, Homo sapiens
ugucauggguuccgucucu

SEQ ID NO: 617176 - RNA, 19 nt, Homo sapiens
cuaacuguauggaaaugau

SEQ ID NO: 617177 - RNA, 19 nt, Homo sapiens
accacuaacuguauggaaa

SEQ ID NO: 617178 - RNA, 19 nt, Homo sapiens
ccacuaacuguauggaaau

SEQ ID NO: 617179 - RNA, 19 nt, Homo sapiens
ugugaggcuuuucuuauua

SEQ ID NO: 617180 - RNA, 19 nt, Homo sapiens
ucucugcgcuggacuucug

SEQ ID NO: 617181 - RNA, 19 nt, Homo sapiens
uaaagaauuccugcaagau

SEQ ID NO: 617182 - RNA, 19 nt, Homo sapiens
ucaucagccuggagaagga

SEQ ID NO: 617183 - RNA, 19 nt, Homo sapiens
gagaaccaggagaagauga

SEQ ID NO: 617184 - RNA, 19 nt, Homo sapiens
ccacagggaucugaaaccu

SEQ ID NO: 617185 - RNA, 19 nt, Homo sapiens
gaucgucaaccgugagaag

SEQ ID NO: 617186 - RNA, 19 nt, Homo sapiens
ccacagccacuccauaugc

SEQ ID NO: 617187 - RNA, 19 nt, Homo sapiens
ggagaaccaggagaagaug

SEQ ID NO: 617188 - RNA, 19 nt, Homo sapiens
ggacgagaagaacaacauc

SEQ ID NO: 617189 - RNA, 19 nt, Homo sapiens
uuucuacacacacaucuaa

SEQ ID NO: 617190 - RNA, 19 nt, Homo sapiens
ccgccuccguguagucuug

SEQ ID NO: 617191 - RNA, 19 nt, Homo sapiens
agaaggaggagcagaucuu

SEQ ID NO: 617192 - RNA, 19 nt, Homo sapiens
ggagaaggaggagcagauc

SEQ ID NO: 617193 - RNA, 19 nt, Homo sapiens
gcucaacuccaucaagaac

SEQ ID NO: 617194 - RNA, 19 nt, Homo sapiens
gagcacauucagaaacaca

SEQ ID NO: 617195 - RNA, 19 nt, Homo sapiens
gugaggcuuuucuuauuaa

SEQ ID NO: 617196 - RNA, 19 nt, Homo sapiens
cagaagguggccaucaaga

SEQ ID NO: 617197 - RNA, 19 nt, Homo sapiens
gcagcacgcgcaguauguu

SEQ ID NO: 617198 - RNA, 19 nt, Homo sapiens
cggaggagauguccaaccu

SEQ ID NO: 617199 - RNA, 19 nt, Homo sapiens
ucaacuccaucaagaacag

SEQ ID NO: 617200 - RNA, 19 nt, Homo sapiens
ggccagaacgcaaauccau

SEQ ID NO: 617201 - RNA, 19 nt, Homo sapiens
gcugcacgacguuuaugaa

SEQ ID NO: 617202 - RNA, 19 nt, Homo sapiens
caaguuccagguugauauc

SEQ ID NO: 617203 - RNA, 19 nt, Homo sapiens
ggcgagcuacuguaaacuu

SEQ ID NO: 617204 - RNA, 19 nt, Homo sapiens
gaagguggagcgggagauc

SEQ ID NO: 617205 - RNA, 19 nt, Homo sapiens
cagacaccacuaacuguau

SEQ ID NO: 617206 - RNA, 19 nt, Homo sapiens
agaaggagaacggcaucua

SEQ ID NO: 617207 - RNA, 19 nt, Homo sapiens
uucagaaacacauauggua

SEQ ID NO: 617208 - RNA, 19 nt, Homo sapiens
ggugcuagaacacguguca

SEQ ID NO: 617209 - RNA, 19 nt, Homo sapiens
agaauuccugcaagauauu

SEQ ID NO: 617210 - RNA, 19 nt, Homo sapiens
ccgaaaaguuaacauguca

SEQ ID NO: 617211 - RNA, 19 nt, Homo sapiens
acaaaccucugagcuccau

SEQ ID NO: 617212 - RNA, 19 nt, Homo sapiens
cgcuagagcacauucagaa

SEQ ID NO: 617213 - RNA, 19 nt, Homo sapiens
gggcuggcgagcuacugua

SEQ ID NO: 617214 - RNA, 19 nt, Homo sapiens
agucggugcugaugaaggu

SEQ ID NO: 617215 - RNA, 19 nt, Homo sapiens
cgaagaaguccugguuugg

SEQ ID NO: 617216 - RNA, 19 nt, Homo sapiens
ggcgaagaaguccugguuu

SEQ ID NO: 617217 - RNA, 19 nt, Homo sapiens
ugccacagccacuccauau

SEQ ID NO: 617218 - RNA, 19 nt, Homo sapiens
gcaaagagauuguucugaa

SEQ ID NO: 617219 - RNA, 19 nt, Homo sapiens
gaaagugacuguaucagau

SEQ ID NO: 617220 - RNA, 19 nt, Homo sapiens
gaaggaaugucuacuuugu

SEQ ID NO: 617221 - RNA, 19 nt, Homo sapiens
agaaugagcuccaauguau

SEQ ID NO: 617222 - RNA, 19 nt, Homo sapiens
gcucauagauuacaaccaa

SEQ ID NO: 617223 - RNA, 19 nt, Homo sapiens
ggagauagcccaaggagaa

SEQ ID NO: 617224 - RNA, 19 nt, Homo sapiens
guacauaguuuccuuucuu

SEQ ID NO: 617225 - RNA, 19 nt, Homo sapiens
gagcuccaauguauuauuu

SEQ ID NO: 617226 - RNA, 19 nt, Homo sapiens
caaagaaaguugugcaaau

SEQ ID NO: 617227 - RNA, 19 nt, Homo sapiens
cagagaagcuuacagaugu

SEQ ID NO: 617228 - RNA, 19 nt, Homo sapiens
ccaguucucucacuacuuu

SEQ ID NO: 617229 - RNA, 19 nt, Homo sapiens
cuaguuagcuucauucaga

SEQ ID NO: 617230 - RNA, 19 nt, Homo sapiens
gcaggaacuucaggacuua

SEQ ID NO: 617231 - RNA, 19 nt, Homo sapiens
cgaaagaguuauuugaguu

SEQ ID NO: 617232 - RNA, 19 nt, Homo sapiens
ggacaauuauggacaacaa

SEQ ID NO: 617233 - RNA, 19 nt, Homo sapiens
gagggccaauggacaauua

SEQ ID NO: 617234 - RNA, 19 nt, Homo sapiens
ggagaauccuggaauuguu

SEQ ID NO: 617235 - RNA, 19 nt, Homo sapiens
gcacaaaugguaaacugua

SEQ ID NO: 617236 - RNA, 19 nt, Homo sapiens
uaaagugucuugugaaucu

SEQ ID NO: 617237 - RNA, 19 nt, Homo sapiens
gaaaauacacgguaacuuu

SEQ ID NO: 617238 - RNA, 19 nt, Homo sapiens
gcagaaagccucaaacucu

SEQ ID NO: 617239 - RNA, 19 nt, Homo sapiens
gaagaagacugggagacaa

SEQ ID NO: 617240 - RNA, 19 nt, Homo sapiens
ugaacuaucuucuugauuc

SEQ ID NO: 617241 - RNA, 19 nt, Homo sapiens
ccacaucccucucaagugu

SEQ ID NO: 617242 - RNA, 19 nt, Homo sapiens
gaacacacaggcaaugauu

SEQ ID NO: 617243 - RNA, 19 nt, Homo sapiens
gagauggucuggaggauuc

SEQ ID NO: 617244 - RNA, 19 nt, Homo sapiens
gcauaugaauccuaggaaa

SEQ ID NO: 617245 - RNA, 19 nt, Homo sapiens
caauuuggauccuaaguug

SEQ ID NO: 617246 - RNA, 19 nt, Homo sapiens
ggauacccaucaucuguuu

SEQ ID NO: 617247 - RNA, 19 nt, Homo sapiens
ugaaugaugugcuagagaa

SEQ ID NO: 617248 - RNA, 19 nt, Homo sapiens
gauacagacuuguucauag

SEQ ID NO: 617249 - RNA, 19 nt, Homo sapiens
cauaaaggguuggaaacua

SEQ ID NO: 617250 - RNA, 19 nt, Homo sapiens
ggaaacaccuccguugaca

SEQ ID NO: 617251 - RNA, 19 nt, Homo sapiens
gaaugucuacuuuguauug

SEQ ID NO: 617252 - RNA, 19 nt, Homo sapiens
gagaauccuggaauuguua

SEQ ID NO: 617253 - RNA, 19 nt, Homo sapiens
aagaaggaaugucuacuuu

SEQ ID NO: 617254 - RNA, 19 nt, Homo sapiens
gagaaugagcuccaaugua

SEQ ID NO: 617255 - RNA, 19 nt, Homo sapiens
gagcgcgucuggaaccuuu

SEQ ID NO: 617256 - RNA, 19 nt, Homo sapiens
accagcagcucauagauua

SEQ ID NO: 617257 - RNA, 19 nt, Homo sapiens
aaagaaaguugugcaaaug

SEQ ID NO: 617258 - RNA, 19 nt, Homo sapiens
ggacgaggauuugguguca

SEQ ID NO: 617259 - RNA, 19 nt, Homo sapiens
agaggugggucacuguuua

SEQ ID NO: 617260 - RNA, 19 nt, Homo sapiens
caacaagagucuaaauggu

SEQ ID NO: 617261 - RNA, 19 nt, Homo sapiens
ggaacaggaucugccauug

SEQ ID NO: 617262 - RNA, 19 nt, Homo sapiens
cuaggaaagugagcucuua

SEQ ID NO: 617263 - RNA, 19 nt, Homo sapiens
uagcggaguuugaaucuug

SEQ ID NO: 617264 - RNA, 19 nt, Homo sapiens
ggacauagagugauuugca

SEQ ID NO: 617265 - RNA, 19 nt, Homo sapiens
gaaaugccucucacccuuu

SEQ ID NO: 617266 - RNA, 19 nt, Homo sapiens
caucacacccagcuaauuu

SEQ ID NO: 617267 - RNA, 19 nt, Homo sapiens
guacaguagugcaaucuca

SEQ ID NO: 617268 - RNA, 19 nt, Homo sapiens
gaaggacuuugaagcaauc

SEQ ID NO: 617269 - RNA, 19 nt, Homo sapiens
ucagaggcaacaaguauua

SEQ ID NO: 617270 - RNA, 19 nt, Homo sapiens
cuacaugucgaaagaguua

SEQ ID NO: 617271 - RNA, 19 nt, Homo sapiens
ugaagacuauguacagaga

SEQ ID NO: 617272 - RNA, 19 nt, Homo sapiens
ggaugaagcggaagauaga

SEQ ID NO: 617273 - RNA, 19 nt, Homo sapiens
aaacaaugcugcaguuaac

SEQ ID NO: 617274 - RNA, 19 nt, Homo sapiens
guauuugcaccaucauuua

SEQ ID NO: 617275 - RNA, 19 nt, Homo sapiens
ccaagaaagugacuguauc

SEQ ID NO: 617276 - RNA, 19 nt, Homo sapiens
gcugggcuuugguguauuu

SEQ ID NO: 617277 - RNA, 19 nt, Homo sapiens
gcuuaccucuucuuuguga

SEQ ID NO: 617278 - RNA, 19 nt, Homo sapiens
ggacagagacuugaguuag

SEQ ID NO: 617279 - RNA, 19 nt, Homo sapiens
gcucuaagggcauuugaaa

SEQ ID NO: 617280 - RNA, 19 nt, Homo sapiens
gaacuaucuucuugauucu

SEQ ID NO: 617281 - RNA, 19 nt, Homo sapiens
uuaagagaguacagacaua

SEQ ID NO: 617282 - RNA, 19 nt, Homo sapiens
aaugagcuccaauguauua

SEQ ID NO: 617283 - RNA, 19 nt, Homo sapiens
gaagcuuacagauguuuaa

SEQ ID NO: 617284 - RNA, 19 nt, Homo sapiens
cagaaagccucaaacucuu

SEQ ID NO: 617285 - RNA, 19 nt, Homo sapiens
ggaaauucaguuuggauga

SEQ ID NO: 617286 - RNA, 19 nt, Homo sapiens
uaucucugcuguccacuuu

SEQ ID NO: 617287 - RNA, 19 nt, Homo sapiens
uaccugagcucaucuaguc

SEQ ID NO: 617288 - RNA, 19 nt, Homo sapiens
acccaaacuugcauuauuu

SEQ ID NO: 617289 - RNA, 19 nt, Homo sapiens
ccaaagugcugagauuaca

SEQ ID NO: 617290 - RNA, 19 nt, Homo sapiens
auaaaggguuggaaacuau

SEQ ID NO: 617291 - RNA, 19 nt, Homo sapiens
cagcugggcuuugguguau

SEQ ID NO: 617292 - RNA, 19 nt, Homo sapiens
ggacuuugaagcaaucauu

SEQ ID NO: 617293 - RNA, 19 nt, Homo sapiens
guacacccucugacaauuu

SEQ ID NO: 617294 - RNA, 19 nt, Homo sapiens
gaaugcagccagcuauaug

SEQ ID NO: 617295 - RNA, 19 nt, Homo sapiens
guuaacacccuuguacaua

SEQ ID NO: 617296 - RNA, 19 nt, Homo sapiens
ucaaauuccugaccuuaag

SEQ ID NO: 617297 - RNA, 19 nt, Homo sapiens
uggcuuaccucuucuuugu

SEQ ID NO: 617298 - RNA, 19 nt, Homo sapiens
gaaagaguuauuugaguuc

SEQ ID NO: 617299 - RNA, 19 nt, Homo sapiens
caaagagauuguucugaag

SEQ ID NO: 617300 - RNA, 19 nt, Homo sapiens
gcagcaagaaggacuuuga

SEQ ID NO: 617301 - RNA, 19 nt, Homo sapiens
ugugauaggcauucaauaa

SEQ ID NO: 617302 - RNA, 19 nt, Homo sapiens
ccagugcugugcagucuga

SEQ ID NO: 617303 - RNA, 19 nt, Homo sapiens
gaguacagacauacacuuu

SEQ ID NO: 617304 - RNA, 19 nt, Homo sapiens
cguagacucugccucacua

SEQ ID NO: 617305 - RNA, 19 nt, Homo sapiens
cuggacaauugcauuaaua

SEQ ID NO: 617306 - RNA, 19 nt, Homo sapiens
ggacaacaagagucuaaau

SEQ ID NO: 617307 - RNA, 19 nt, Homo sapiens
gugauaggcauucaauaaa

SEQ ID NO: 617308 - RNA, 19 nt, Homo sapiens
ccagugauuagcuaaauuu

SEQ ID NO: 617309 - RNA, 19 nt, Homo sapiens
auuggaagcugcuguugua

SEQ ID NO: 617310 - RNA, 19 nt, Homo sapiens
ccuccugacugucguguuu

SEQ ID NO: 617311 - RNA, 19 nt, Homo sapiens
caagaaggacuuugaagca

SEQ ID NO: 617312 - RNA, 19 nt, Homo sapiens
ggagaaauaaugaacuauc

SEQ ID NO: 617313 - RNA, 19 nt, Homo sapiens
guauugugguccuaaucua

SEQ ID NO: 617314 - RNA, 19 nt, Homo sapiens
aacccaaacuugcauuauu

SEQ ID NO: 617315 - RNA, 19 nt, Homo sapiens
ggaaagugagcucuuaaag

SEQ ID NO: 617316 - RNA, 19 nt, Homo sapiens
gacuugagccugaagacua

SEQ ID NO: 617317 - RNA, 19 nt, Homo sapiens
agacaggguuucaccaugu

SEQ ID NO: 617318 - RNA, 19 nt, Homo sapiens
gaagcucccuggacacuca

SEQ ID NO: 617319 - RNA, 19 nt, Homo sapiens
gguaggagcucugccuguu

SEQ ID NO: 617320 - RNA, 19 nt, Homo sapiens
gaccagggcuacagugaag

SEQ ID NO: 617321 - RNA, 19 nt, Homo sapiens
gaagguggugggcauggua

SEQ ID NO: 617322 - RNA, 19 nt, Homo sapiens
uaggagcucugccuguuga

SEQ ID NO: 617323 - RNA, 19 nt, Homo sapiens
gggcuacagugaaguuauc

SEQ ID NO: 617324 - RNA, 19 nt, Homo sapiens
gagcucugccuguugauga

SEQ ID NO: 617325 - RNA, 19 nt, Homo sapiens
gguugcagcuguuucaucu

SEQ ID NO: 617326 - RNA, 19 nt, Homo sapiens
ucauacaguucauuucauc

SEQ ID NO: 617327 - RNA, 19 nt, Homo sapiens
ggucagaauagaauccauu

SEQ ID NO: 617328 - RNA, 19 nt, Homo sapiens
ggaccagggcuacagugaa

SEQ ID NO: 617329 - RNA, 19 nt, Homo sapiens
gugacagucugacguaaag

SEQ ID NO: 617330 - RNA, 19 nt, Homo sapiens
ccaaauccuaccugaguga

SEQ ID NO: 617331 - RNA, 19 nt, Homo sapiens
ggugacagucugacguaaa

SEQ ID NO: 617332 - RNA, 19 nt, Homo sapiens
uaccaaauccuaccugagu

SEQ ID NO: 617333 - RNA, 19 nt, Homo sapiens
cuugucacauccgcaaaua

SEQ ID NO: 617334 - RNA, 19 nt, Homo sapiens
gcuucuagcccucguguuc

SEQ ID NO: 617335 - RNA, 19 nt, Homo sapiens
ccagccaccuuccggcaau

SEQ ID NO: 617336 - RNA, 19 nt, Homo sapiens
cuccuggacuuagagauuu

SEQ ID NO: 617337 - RNA, 19 nt, Homo sapiens
gcccucguguucagcauca

SEQ ID NO: 617338 - RNA, 19 nt, Homo sapiens
cuucauacaguucauuuca

SEQ ID NO: 617339 - RNA, 19 nt, Homo sapiens
guaggagcucugccuguug

SEQ ID NO: 617340 - RNA, 19 nt, Homo sapiens
guggugacagucugacgua

SEQ ID NO: 617341 - RNA, 19 nt, Homo sapiens
gggaccagggcuacaguga

SEQ ID NO: 617342 - RNA, 19 nt, Homo sapiens
cagacgguaucuccuggau

SEQ ID NO: 617343 - RNA, 19 nt, Homo sapiens
agaagcgguugcagcuguu

SEQ ID NO: 617344 - RNA, 19 nt, Homo sapiens
ggcugagucugaagagaag

SEQ ID NO: 617345 - RNA, 19 nt, Homo sapiens
uggcugagucugaagagaa

SEQ ID NO: 617346 - RNA, 19 nt, Homo sapiens
ccagggcuacagugaaguu

SEQ ID NO: 617347 - RNA, 19 nt, Homo sapiens
gacauugugcacagacaug

SEQ ID NO: 617348 - RNA, 19 nt, Homo sapiens
gaagcgguugcagcuguuu

SEQ ID NO: 617349 - RNA, 19 nt, Homo sapiens
agagauuucagacacagaa

SEQ ID NO: 617350 - RNA, 19 nt, Homo sapiens
gcucugucuccuggacuua

SEQ ID NO: 617351 - RNA, 19 nt, Homo sapiens
gaacugggcugggaugaga

SEQ ID NO: 617352 - RNA, 19 nt, Homo sapiens
gaugagaugucccuacaag

SEQ ID NO: 617353 - RNA, 19 nt, Homo sapiens
ugagaugucccuacaaguu

SEQ ID NO: 617354 - RNA, 19 nt, Homo sapiens
gagaugucccuacaaguug

SEQ ID NO: 617355 - RNA, 19 nt, Homo sapiens
ggguguggguggccucaaa

SEQ ID NO: 617356 - RNA, 19 nt, Homo sapiens
gaucaucguguuccugugu

SEQ ID NO: 617357 - RNA, 19 nt, Homo sapiens
ggaccuuggcccucgcuuu

SEQ ID NO: 617358 - RNA, 19 nt, Homo sapiens
agcaagcgcuccagcaguu

SEQ ID NO: 617359 - RNA, 19 nt, Homo sapiens
gaccuuggcccucgcuuuc

SEQ ID NO: 617360 - RNA, 19 nt, Homo sapiens
ucaucguguuccuguguua

SEQ ID NO: 617361 - RNA, 19 nt, Homo sapiens
ggauggugcuggccuuggu

SEQ ID NO: 617362 - RNA, 19 nt, Homo sapiens
ggcccucgcuuuccaggau

SEQ ID NO: 617363 - RNA, 19 nt, Homo sapiens
ggccaacguugucaugaac

SEQ ID NO: 617364 - RNA, 19 nt, Homo sapiens
uggccaacguugucaugaa

SEQ ID NO: 617365 - RNA, 19 nt, Homo sapiens
cuucacgucugcccuuugu

SEQ ID NO: 617366 - RNA, 19 nt, Homo sapiens
acgagauccugccuuguga

SEQ ID NO: 617367 - RNA, 19 nt, Homo sapiens
uuacguggccuacgagauc

SEQ ID NO: 617368 - RNA, 19 nt, Homo sapiens
cgagaacacaggcuucauc

SEQ ID NO: 617369 - RNA, 19 nt, Homo sapiens
ggaacgucuucgccuacga

SEQ ID NO: 617370 - RNA, 19 nt, Homo sapiens
ccuacaaguugcugaggau

SEQ ID NO: 617371 - RNA, 19 nt, Homo sapiens
ccaacguugucaugaacug

SEQ ID NO: 617372 - RNA, 19 nt, Homo sapiens
caggauggguaggguggaa

SEQ ID NO: 617373 - RNA, 19 nt, Homo sapiens
gcaagcgcuccagcaguuu

SEQ ID NO: 617374 - RNA, 19 nt, Homo sapiens
agugggugcugcagaccua

SEQ ID NO: 617375 - RNA, 19 nt, Homo sapiens
cggccaagcuggacaugcu

SEQ ID NO: 617376 - RNA, 19 nt, Homo sapiens
ugaccauccugcggagcua

SEQ ID NO: 617377 - RNA, 19 nt, Homo sapiens
gcaucagccugcucuaccu

SEQ ID NO: 617378 - RNA, 19 nt, Homo sapiens
ggauggguaggguggaaga

SEQ ID NO: 617379 - RNA, 19 nt, Homo sapiens
uacgagauccugccuugug

SEQ ID NO: 617380 - RNA, 19 nt, Homo sapiens
aggccuaggugucuacaag

SEQ ID NO: 617381 - RNA, 19 nt, Homo sapiens
acaaguugcugaggauggu

SEQ ID NO: 617382 - RNA, 19 nt, Homo sapiens
ccaauaagcugcacacuaa

SEQ ID NO: 617383 - RNA, 19 nt, Homo sapiens
gcagacagcuugauucgua

SEQ ID NO: 617384 - RNA, 19 nt, Homo sapiens
ggagauaguucgauacuuu

SEQ ID NO: 617385 - RNA, 19 nt, Homo sapiens
ggaagaaacaucagaauuu

SEQ ID NO: 617386 - RNA, 19 nt, Homo sapiens
gaaucaagccucuuaauuu

SEQ ID NO: 617387 - RNA, 19 nt, Homo sapiens
gaagaaacaucagaauuug

SEQ ID NO: 617388 - RNA, 19 nt, Homo sapiens
gaagagauccuccacauga

SEQ ID NO: 617389 - RNA, 19 nt, Homo sapiens
gugaagaacucaaagaauu

SEQ ID NO: 617390 - RNA, 19 nt, Homo sapiens
ggaaggagagagaguauua

SEQ ID NO: 617391 - RNA, 19 nt, Homo sapiens
gcacguagaucgccacgaa

SEQ ID NO: 617392 - RNA, 19 nt, Homo sapiens
gaagaaaacuccaaaguga

SEQ ID NO: 617393 - RNA, 19 nt, Homo sapiens
acagacaacucuucucuua

SEQ ID NO: 617394 - RNA, 19 nt, Homo sapiens
ggagagagaguauuaauga

SEQ ID NO: 617395 - RNA, 19 nt, Homo sapiens
gcaagaaguuuccugauag

SEQ ID NO: 617396 - RNA, 19 nt, Homo sapiens
gaagauaagaucaucagua

SEQ ID NO: 617397 - RNA, 19 nt, Homo sapiens
gcacagaucgaaaccauaa

SEQ ID NO: 617398 - RNA, 19 nt, Homo sapiens
gauaauguguuugcucuaa

SEQ ID NO: 617399 - RNA, 19 nt, Homo sapiens
gcagugauauuguauaaag

SEQ ID NO: 617400 - RNA, 19 nt, Homo sapiens
gaagaaaugaugaagauga

SEQ ID NO: 617401 - RNA, 19 nt, Homo sapiens
gaagguugcuugccauuca

SEQ ID NO: 617402 - RNA, 19 nt, Homo sapiens
caagaugaguuccuagaaa

SEQ ID NO: 617403 - RNA, 19 nt, Homo sapiens
gaaaugggcuccuccaaaa

SEQ ID NO: 617404 - RNA, 19 nt, Homo sapiens
aaagagaacuccagucaga

SEQ ID NO: 617405 - RNA, 19 nt, Homo sapiens
agacacagaugacaauaaa

SEQ ID NO: 617406 - RNA, 19 nt, Homo sapiens
ugaagaacaucuagaagaa

SEQ ID NO: 617407 - RNA, 19 nt, Homo sapiens
gaacgaagagagaaagaaa

SEQ ID NO: 617408 - RNA, 19 nt, Homo sapiens
gaaagaaaggugaggauga

SEQ ID NO: 617409 - RNA, 19 nt, Homo sapiens
gcaaaggcauccugaaugg

SEQ ID NO: 617410 - RNA, 19 nt, Homo sapiens
gcucuucuguaccuauuua

SEQ ID NO: 617411 - RNA, 19 nt, Homo sapiens
gcauauaaccuuuacuuug

SEQ ID NO: 617412 - RNA, 19 nt, Homo sapiens
gaacuauacugaagagucu

SEQ ID NO: 617413 - RNA, 19 nt, Homo sapiens
gauacuggcucuucucaga

SEQ ID NO: 617414 - RNA, 19 nt, Homo sapiens
gaagaugaauuggugaaga

SEQ ID NO: 617415 - RNA, 19 nt, Homo sapiens
cagcagugauauuguauaa

SEQ ID NO: 617416 - RNA, 19 nt, Homo sapiens
ggaaguggaugaagagaag

SEQ ID NO: 617417 - RNA, 19 nt, Homo sapiens
gcaggaagcgcaagaaguu

SEQ ID NO: 617418 - RNA, 19 nt, Homo sapiens
guagugaucucauugaagu

SEQ ID NO: 617419 - RNA, 19 nt, Homo sapiens
gaaagcaaacuuagguaaa

SEQ ID NO: 617420 - RNA, 19 nt, Homo sapiens
gaugcucaguauccuauua

SEQ ID NO: 617421 - RNA, 19 nt, Homo sapiens
gaaagagaaaugaaaguga

SEQ ID NO: 617422 - RNA, 19 nt, Homo sapiens
ggacuacuaugaugugauc

SEQ ID NO: 617423 - RNA, 19 nt, Homo sapiens
gcagucagcuaacacacaa

SEQ ID NO: 617424 - RNA, 19 nt, Homo sapiens
ggaaaugggcuccuccaaa

SEQ ID NO: 617425 - RNA, 19 nt, Homo sapiens
gcaggaagaauuuaaaugu

SEQ ID NO: 617426 - RNA, 19 nt, Homo sapiens
cgcaagaaguuuccugaua

SEQ ID NO: 617427 - RNA, 19 nt, Homo sapiens
ggacauuauucacucuauu

SEQ ID NO: 617428 - RNA, 19 nt, Homo sapiens
aaacagaaacggaaagaaa

SEQ ID NO: 617429 - RNA, 19 nt, Homo sapiens
guacagagcgcccaccaaa

SEQ ID NO: 617430 - RNA, 19 nt, Homo sapiens
agaugaaguuccaggauua

SEQ ID NO: 617431 - RNA, 19 nt, Homo sapiens
gcagaagugugaagagauc

SEQ ID NO: 617432 - RNA, 19 nt, Homo sapiens
aagaaaugcuugagagauu

SEQ ID NO: 617433 - RNA, 19 nt, Homo sapiens
cagaugacuuuguuggaua

SEQ ID NO: 617434 - RNA, 19 nt, Homo sapiens
acagagcgcccaccaaaua

SEQ ID NO: 617435 - RNA, 19 nt, Homo sapiens
gaaggagacaguugugaaa

SEQ ID NO: 617436 - RNA, 19 nt, Homo sapiens
aaauugaucuugugugaug

SEQ ID NO: 617437 - RNA, 19 nt, Homo sapiens
caucugcacuggagaaaug

SEQ ID NO: 617438 - RNA, 19 nt, Homo sapiens
ugaagcagaugacuuuguu

SEQ ID NO: 617439 - RNA, 19 nt, Homo sapiens
aagaugaugucgcccaaua

SEQ ID NO: 617440 - RNA, 19 nt, Homo sapiens
caguacaguuucuaugaua

SEQ ID NO: 617441 - RNA, 19 nt, Homo sapiens
ugaaacaguuguggucuuu

SEQ ID NO: 617442 - RNA, 19 nt, Homo sapiens
uacagaagcugaagacaug

SEQ ID NO: 617443 - RNA, 19 nt, Homo sapiens
agaagacuauggugaauug

SEQ ID NO: 617444 - RNA, 19 nt, Homo sapiens
gcauucagauugguggaua

SEQ ID NO: 617445 - RNA, 19 nt, Homo sapiens
gaagaacaacggaaagaau

SEQ ID NO: 617446 - RNA, 19 nt, Homo sapiens
caaauaugcugugggagaa

SEQ ID NO: 617447 - RNA, 19 nt, Homo sapiens
gaucuugugugaugagugu

SEQ ID NO: 617448 - RNA, 19 nt, Homo sapiens
agaaaugcuugagagauua

SEQ ID NO: 617449 - RNA, 19 nt, Homo sapiens
gcagaugacuuuguuggau

SEQ ID NO: 617450 - RNA, 19 nt, Homo sapiens
auaaggagauaguucgaua

SEQ ID NO: 617451 - RNA, 19 nt, Homo sapiens
ugacaucacagcuucauaa

SEQ ID NO: 617452 - RNA, 19 nt, Homo sapiens
gaaagaaauggaagccaaa

SEQ ID NO: 617453 - RNA, 19 nt, Homo sapiens
gaaagaaaugcuugagaga

SEQ ID NO: 617454 - RNA, 19 nt, Homo sapiens
ggucguagaagaugaauug

SEQ ID NO: 617455 - RNA, 19 nt, Homo sapiens
gagaugaggccgaggacua

SEQ ID NO: 617456 - RNA, 19 nt, Homo sapiens
gaaaggugaggaugacaaa

SEQ ID NO: 617457 - RNA, 19 nt, Homo sapiens
cagaugaaguuccaggauu

SEQ ID NO: 617458 - RNA, 19 nt, Homo sapiens
guaugaggaccaagaguua

SEQ ID NO: 617459 - RNA, 19 nt, Homo sapiens
gaacaucuagaagaaauga

SEQ ID NO: 617460 - RNA, 19 nt, Homo sapiens
gagauaguucgauacuuua

SEQ ID NO: 617461 - RNA, 19 nt, Homo sapiens
gaaggaaggagagagagua

SEQ ID NO: 617462 - RNA, 19 nt, Homo sapiens
gaucgaaaccauaauagau

SEQ ID NO: 617463 - RNA, 19 nt, Homo sapiens
auaaugagguacaagauga

SEQ ID NO: 617464 - RNA, 19 nt, Homo sapiens
gaacaacggaaagaauauu

SEQ ID NO: 617465 - RNA, 19 nt, Homo sapiens
gaggugggcuucuaugucu

SEQ ID NO: 617466 - RNA, 19 nt, Homo sapiens
gcaaagggcagaagcaaag

SEQ ID NO: 617467 - RNA, 19 nt, Homo sapiens
ccacugagaagaaaucuga

SEQ ID NO: 617468 - RNA, 19 nt, Homo sapiens
gcagaagacuauggugaau

SEQ ID NO: 617469 - RNA, 19 nt, Homo sapiens
gagcucgucucccagaaga

SEQ ID NO: 617470 - RNA, 19 nt, Homo sapiens
aaaugaagcagaugacuuu

SEQ ID NO: 617471 - RNA, 19 nt, Homo sapiens
gaaaugaugaagaugaugu

SEQ ID NO: 617472 - RNA, 19 nt, Homo sapiens
agacaacucuucucuuagu

SEQ ID NO: 617473 - RNA, 19 nt, Homo sapiens
ggaaauccaggaaagagaa

SEQ ID NO: 617474 - RNA, 19 nt, Homo sapiens
gcuggagaccucugaauuu

SEQ ID NO: 617475 - RNA, 19 nt, Homo sapiens
ggaguuuccugccugguau

SEQ ID NO: 617476 - RNA, 19 nt, Homo sapiens
uaacacagccuccuuagag

SEQ ID NO: 617477 - RNA, 19 nt, Homo sapiens
agugacaccugaauuguuu

SEQ ID NO: 617478 - RNA, 19 nt, Homo sapiens
guaagauacuccugacauc

SEQ ID NO: 617479 - RNA, 19 nt, Homo sapiens
gguacaagaugaguuccua

SEQ ID NO: 617480 - RNA, 19 nt, Homo sapiens
guucaccacuaaauccuaa

SEQ ID NO: 617481 - RNA, 19 nt, Homo sapiens
gacgaagacagaagaagua

SEQ ID NO: 617482 - RNA, 19 nt, Homo sapiens
ccaauaagcugcacacuaa

SEQ ID NO: 617483 - RNA, 19 nt, Homo sapiens
gcagacagcuugauucgua

SEQ ID NO: 617484 - RNA, 19 nt, Homo sapiens
ggagauaguucgauacuuu

SEQ ID NO: 617485 - RNA, 19 nt, Homo sapiens
ggaagaaacaucagaauuu

SEQ ID NO: 617486 - RNA, 19 nt, Homo sapiens
gaaucaagccucuuaauuu

SEQ ID NO: 617487 - RNA, 19 nt, Homo sapiens
gaagaaacaucagaauuug

SEQ ID NO: 617488 - RNA, 19 nt, Homo sapiens
gugaagaacucaaagaauu

SEQ ID NO: 617489 - RNA, 19 nt, Homo sapiens
ggaaggagagagaguauua

SEQ ID NO: 617490 - RNA, 19 nt, Homo sapiens
gcacguagaucgccacgaa

SEQ ID NO: 617491 - RNA, 19 nt, Homo sapiens
gaagaaaacuccaaaguga

SEQ ID NO: 617492 - RNA, 19 nt, Homo sapiens
acagacaacucuucucuua

SEQ ID NO: 617493 - RNA, 19 nt, Homo sapiens
ggagagagaguauuaauga

SEQ ID NO: 617494 - RNA, 19 nt, Homo sapiens
gaagagauccuccacaaga

SEQ ID NO: 617495 - RNA, 19 nt, Homo sapiens
gcaagaaguuuccugauag

SEQ ID NO: 617496 - RNA, 19 nt, Homo sapiens
gaagauaagaucaucagua

SEQ ID NO: 617497 - RNA, 19 nt, Homo sapiens
gcacagaucgaaaccauaa

SEQ ID NO: 617498 - RNA, 19 nt, Homo sapiens
gauaauguguuugcucuaa

SEQ ID NO: 617499 - RNA, 19 nt, Homo sapiens
gcagugauauuguauaaag

SEQ ID NO: 617500 - RNA, 19 nt, Homo sapiens
gaagaaaugaugaagauga

SEQ ID NO: 617501 - RNA, 19 nt, Homo sapiens
gaagguugcuugccauuca

SEQ ID NO: 617502 - RNA, 19 nt, Homo sapiens
caagaugaguuccuagaaa

SEQ ID NO: 617503 - RNA, 19 nt, Homo sapiens
gaaaugggcuccuccaaaa

SEQ ID NO: 617504 - RNA, 19 nt, Homo sapiens
aaagagaacuccagucaga

SEQ ID NO: 617505 - RNA, 19 nt, Homo sapiens
agacacagaugacaauaaa

SEQ ID NO: 617506 - RNA, 19 nt, Homo sapiens
ugaagaacaucuagaagaa

SEQ ID NO: 617507 - RNA, 19 nt, Homo sapiens
gaucuuaugugaugagugu

SEQ ID NO: 617508 - RNA, 19 nt, Homo sapiens
gaacgaagagagaaagaaa

SEQ ID NO: 617509 - RNA, 19 nt, Homo sapiens
gaaagaaaggugaggauga

SEQ ID NO: 617510 - RNA, 19 nt, Homo sapiens
gcaaaggcauccugaaugg

SEQ ID NO: 617511 - RNA, 19 nt, Homo sapiens
gcucuucuguaccuauuua

SEQ ID NO: 617512 - RNA, 19 nt, Homo sapiens
gcauauaaccuuuacuuug

SEQ ID NO: 617513 - RNA, 19 nt, Homo sapiens
gaacuauacugaagagucu

SEQ ID NO: 617514 - RNA, 19 nt, Homo sapiens
gauacuggcucuucucaga

SEQ ID NO: 617515 - RNA, 19 nt, Homo sapiens
gaagaugaauuggugaaga

SEQ ID NO: 617516 - RNA, 19 nt, Homo sapiens
cagcagugauauuguauaa

SEQ ID NO: 617517 - RNA, 19 nt, Homo sapiens
ggaaguggaugaagagaag

SEQ ID NO: 617518 - RNA, 19 nt, Homo sapiens
gcaggaagcgcaagaaguu

SEQ ID NO: 617519 - RNA, 19 nt, Homo sapiens
guagugaucucauugaagu

SEQ ID NO: 617520 - RNA, 19 nt, Homo sapiens
gaaagcaaacuuagguaaa

SEQ ID NO: 617521 - RNA, 19 nt, Homo sapiens
gaugcucaguauccuauua

SEQ ID NO: 617522 - RNA, 19 nt, Homo sapiens
gaaagagaaaugaaaguga

SEQ ID NO: 617523 - RNA, 19 nt, Homo sapiens
ggacuacuaugaugugauc

SEQ ID NO: 617524 - RNA, 19 nt, Homo sapiens
gcagucagcuaacacacaa

SEQ ID NO: 617525 - RNA, 19 nt, Homo sapiens
ggaaaugggcuccuccaaa

SEQ ID NO: 617526 - RNA, 19 nt, Homo sapiens
gcaggaagaauuuaaaugu

SEQ ID NO: 617527 - RNA, 19 nt, Homo sapiens
cgcaagaaguuuccugaua

SEQ ID NO: 617528 - RNA, 19 nt, Homo sapiens
ggacauuauucacucuauu

SEQ ID NO: 617529 - RNA, 19 nt, Homo sapiens
aaacagaaacggaaagaaa

SEQ ID NO: 617530 - RNA, 19 nt, Homo sapiens
guacagagcgcccaccaaa

SEQ ID NO: 617531 - RNA, 19 nt, Homo sapiens
agaugaaguuccaggauua

SEQ ID NO: 617532 - RNA, 19 nt, Homo sapiens
gcagaagugugaagagauc

SEQ ID NO: 617533 - RNA, 19 nt, Homo sapiens
aagaaaugcuugagagauu

SEQ ID NO: 617534 - RNA, 19 nt, Homo sapiens
cagaugacuuuguuggaua

SEQ ID NO: 617535 - RNA, 19 nt, Homo sapiens
acagagcgcccaccaaaua

SEQ ID NO: 617536 - RNA, 19 nt, Homo sapiens
gaaggagacaguugugaaa

SEQ ID NO: 617537 - RNA, 19 nt, Homo sapiens
gugaagagauccuccacaa

SEQ ID NO: 617538 - RNA, 19 nt, Homo sapiens
caucugcacuggagaaaug

SEQ ID NO: 617539 - RNA, 19 nt, Homo sapiens
ugaagcagaugacuuuguu

SEQ ID NO: 617540 - RNA, 19 nt, Homo sapiens
aagaugaugucgcccaaua

SEQ ID NO: 617541 - RNA, 19 nt, Homo sapiens
caguacaguuucuaugaua

SEQ ID NO: 617542 - RNA, 19 nt, Homo sapiens
uacagaagcugaagacaug

SEQ ID NO: 617543 - RNA, 19 nt, Homo sapiens
agaagacuauggugaauug

SEQ ID NO: 617544 - RNA, 19 nt, Homo sapiens
gcauucagauugguggaua

SEQ ID NO: 617545 - RNA, 19 nt, Homo sapiens
gaagaacaacggaaagaau

SEQ ID NO: 617546 - RNA, 19 nt, Homo sapiens
caaauaugcugugggagaa

SEQ ID NO: 617547 - RNA, 19 nt, Homo sapiens
agaaaugcuugagagauua

SEQ ID NO: 617548 - RNA, 19 nt, Homo sapiens
gcagaugacuuuguuggau

SEQ ID NO: 617549 - RNA, 19 nt, Homo sapiens
auaaggagauaguucgaua

SEQ ID NO: 617550 - RNA, 19 nt, Homo sapiens
ugacaucacagcuucauaa

SEQ ID NO: 617551 - RNA, 19 nt, Homo sapiens
gaaagaaauggaagccaaa

SEQ ID NO: 617552 - RNA, 19 nt, Homo sapiens
gaaagaaaugcuugagaga

SEQ ID NO: 617553 - RNA, 19 nt, Homo sapiens
ggucguagaagaugaauug

SEQ ID NO: 617554 - RNA, 19 nt, Homo sapiens
gagaugaggccgaggacua

SEQ ID NO: 617555 - RNA, 19 nt, Homo sapiens
gaaaggugaggaugacaaa

SEQ ID NO: 617556 - RNA, 19 nt, Homo sapiens
cagaugaaguuccaggauu

SEQ ID NO: 617557 - RNA, 19 nt, Homo sapiens
guaugaggaccaagaguua

SEQ ID NO: 617558 - RNA, 19 nt, Homo sapiens
gaacaucuagaagaaauga

SEQ ID NO: 617559 - RNA, 19 nt, Homo sapiens
gagauaguucgauacuuua

SEQ ID NO: 617560 - RNA, 19 nt, Homo sapiens
gaaggaaggagagagagua

SEQ ID NO: 617561 - RNA, 19 nt, Homo sapiens
gaucgaaaccauaauagau

SEQ ID NO: 617562 - RNA, 19 nt, Homo sapiens
auaaugagguacaagauga

SEQ ID NO: 617563 - RNA, 19 nt, Homo sapiens
gaacaacggaaagaauauu

SEQ ID NO: 617564 - RNA, 19 nt, Homo sapiens
gaggugggcuucuaugucu

SEQ ID NO: 617565 - RNA, 19 nt, Homo sapiens
gcaaagggcagaagcaaag

SEQ ID NO: 617566 - RNA, 19 nt, Homo sapiens
ccacugagaagaaaucuga

SEQ ID NO: 617567 - RNA, 19 nt, Homo sapiens
gcagaagacuauggugaau

SEQ ID NO: 617568 - RNA, 19 nt, Homo sapiens
gagcucgucucccagaaga

SEQ ID NO: 617569 - RNA, 19 nt, Homo sapiens
aaaugaagcagaugacuuu

SEQ ID NO: 617570 - RNA, 19 nt, Homo sapiens
gaaaugaugaagaugaugu

SEQ ID NO: 617571 - RNA, 19 nt, Homo sapiens
agacaacucuucucuuagu

SEQ ID NO: 617572 - RNA, 19 nt, Homo sapiens
ggaaauccaggaaagagaa

SEQ ID NO: 617573 - RNA, 19 nt, Homo sapiens
gcuggagaccucugaauuu

SEQ ID NO: 617574 - RNA, 19 nt, Homo sapiens
uaacacagccuccuuagag

SEQ ID NO: 617575 - RNA, 19 nt, Homo sapiens
ggaguuuccugccugguau

SEQ ID NO: 617576 - RNA, 19 nt, Homo sapiens
agugacaccugaauuguuu

SEQ ID NO: 617577 - RNA, 19 nt, Homo sapiens
ggagagagcggcagagaag

SEQ ID NO: 617578 - RNA, 19 nt, Homo sapiens
guaagauacuccugacauc

SEQ ID NO: 617579 - RNA, 19 nt, Homo sapiens
gguacaagaugaguuccua

SEQ ID NO: 617580 - RNA, 19 nt, Homo sapiens
guucaccacuaaauccuaa

SEQ ID NO: 617581 - RNA, 19 nt, Homo sapiens
gacgaagacagaagaagua

SEQ ID NO: 617582 - RNA, 19 nt, Homo sapiens
ggacccagaugcuuaauga

SEQ ID NO: 617583 - RNA, 19 nt, Homo sapiens
caucucagcuugcaagucu

SEQ ID NO: 617584 - RNA, 19 nt, Homo sapiens
gaaauggacccagaugcuu

SEQ ID NO: 617585 - RNA, 19 nt, Homo sapiens
aaauggacccagaugcuua

SEQ ID NO: 617586 - RNA, 19 nt, Homo sapiens
ggaccaacaccaaccaucu

SEQ ID NO: 617587 - RNA, 19 nt, Homo sapiens
ccugacaccucaccaugug

SEQ ID NO: 617588 - RNA, 19 nt, Homo sapiens
ggugcugggugcuguggaa

SEQ ID NO: 617589 - RNA, 19 nt, Homo sapiens
guggggcucucccucauua

SEQ ID NO: 617590 - RNA, 19 nt, Homo sapiens
gcuagaauaaacugcuuug

SEQ ID NO: 617591 - RNA, 19 nt, Homo sapiens
gagaccuccuggaccaaca

SEQ ID NO: 617592 - RNA, 19 nt, Homo sapiens
ggaaugugacgcucuucuc

SEQ ID NO: 617593 - RNA, 19 nt, Homo sapiens
cgaaauggacccagaugcu

SEQ ID NO: 617594 - RNA, 19 nt, Homo sapiens
ccaaccaucucagcuugca

SEQ ID NO: 617595 - RNA, 19 nt, Homo sapiens
acaggacacaccucacuga

SEQ ID NO: 617596 - RNA, 19 nt, Homo sapiens
aaacaggacacaccucacu

SEQ ID NO: 617597 - RNA, 19 nt, Homo sapiens
ccuggaaugugacgcucuu

SEQ ID NO: 617598 - RNA, 19 nt, Homo sapiens
gcucaaccgcacucuaugg

SEQ ID NO: 617599 - RNA, 19 nt, Homo sapiens
ucgcuagaauaaacugcuu

SEQ ID NO: 617600 - RNA, 19 nt, Homo sapiens
gaacaacccugacugagaa

SEQ ID NO: 617601 - RNA, 19 nt, Homo sapiens
ggaaacagcugcucucaga

SEQ ID NO: 617602 - RNA, 19 nt, Homo sapiens
ugagggagcuguugguaua

SEQ ID NO: 617603 - RNA, 19 nt, Homo sapiens
gcagaggaguuaaguguga

SEQ ID NO: 617604 - RNA, 19 nt, Homo sapiens
ggaucaagauauucaagua

SEQ ID NO: 617605 - RNA, 19 nt, Homo sapiens
caagaagccugaagaugaa

SEQ ID NO: 617606 - RNA, 19 nt, Homo sapiens
agagugagguucccuauaa

SEQ ID NO: 617607 - RNA, 19 nt, Homo sapiens
ccaagaagccugaagauga

SEQ ID NO: 617608 - RNA, 19 nt, Homo sapiens
caacaagacccuacuaaga

SEQ ID NO: 617609 - RNA, 19 nt, Homo sapiens
aaacagggcuacaacaaga

SEQ ID NO: 617610 - RNA, 19 nt, Homo sapiens
gaaacugagugggcuuuaa

SEQ ID NO: 617611 - RNA, 19 nt, Homo sapiens
gaaacuaggccgaucuauu

SEQ ID NO: 617612 - RNA, 19 nt, Homo sapiens
aaacuaggccgaucuauug

SEQ ID NO: 617613 - RNA, 19 nt, Homo sapiens
caacucggcuaccugcuuu

SEQ ID NO: 617614 - RNA, 19 nt, Homo sapiens
aaacacguaugcagacuuu

SEQ ID NO: 617615 - RNA, 19 nt, Homo sapiens
ggaguagugucccagauug

SEQ ID NO: 617616 - RNA, 19 nt, Homo sapiens
ucugagcucuucuuacaua

SEQ ID NO: 617617 - RNA, 19 nt, Homo sapiens
gagcaaagucuaugaagga

SEQ ID NO: 617618 - RNA, 19 nt, Homo sapiens
ggaaaugaacucaggauuc

SEQ ID NO: 617619 - RNA, 19 nt, Homo sapiens
guacaucagcuucaacaaa

SEQ ID NO: 617620 - RNA, 19 nt, Homo sapiens
ggaacaacccugacugaga

SEQ ID NO: 617621 - RNA, 19 nt, Homo sapiens
caugguggcuaucaauaaa

SEQ ID NO: 617622 - RNA, 19 nt, Homo sapiens
cuacugaccuauggaauga

SEQ ID NO: 617623 - RNA, 19 nt, Homo sapiens
caaagucuaugaaggaucu

SEQ ID NO: 617624 - RNA, 19 nt, Homo sapiens
caacaugaaugcugucaac

SEQ ID NO: 617625 - RNA, 19 nt, Homo sapiens
cauaagaccauguggguuu

SEQ ID NO: 617626 - RNA, 19 nt, Homo sapiens
ggauuucaccaacaccuua

SEQ ID NO: 617627 - RNA, 19 nt, Homo sapiens
ucagacgccuuuccauuug

SEQ ID NO: 617628 - RNA, 19 nt, Homo sapiens
acacugagauugagaaacu

SEQ ID NO: 617629 - RNA, 19 nt, Homo sapiens
ugucugagcucuucuuaca

SEQ ID NO: 617630 - RNA, 19 nt, Homo sapiens
caacguugcagaggaguua

SEQ ID NO: 617631 - RNA, 19 nt, Homo sapiens
ggagcuggcuggacagaag

SEQ ID NO: 617632 - RNA, 19 nt, Homo sapiens
acaccaaagugaugucuga

SEQ ID NO: 617633 - RNA, 19 nt, Homo sapiens
gaacucaggauucagagau

SEQ ID NO: 617634 - RNA, 19 nt, Homo sapiens
guggugagauuccaacguu

SEQ ID NO: 617635 - RNA, 19 nt, Homo sapiens
ucaccaaguuugacagaga

SEQ ID NO: 617636 - RNA, 19 nt, Homo sapiens
cuacaaugcuaucgacaau

SEQ ID NO: 617637 - RNA, 19 nt, Homo sapiens
gucauguucuucauuguuu

SEQ ID NO: 617638 - RNA, 19 nt, Homo sapiens
gguggguucugacauuauu

SEQ ID NO: 617639 - RNA, 19 nt, Homo sapiens
gagugagguucccuauaaa

SEQ ID NO: 617640 - RNA, 19 nt, Homo sapiens
gcuggagacuguccuggaa

SEQ ID NO: 617641 - RNA, 19 nt, Homo sapiens
gagcugcuaugaugucuac

SEQ ID NO: 617642 - RNA, 19 nt, Homo sapiens
gcugagaaccgggaacuuu

SEQ ID NO: 617643 - RNA, 19 nt, Homo sapiens
gagaagaggaagccuuaga

SEQ ID NO: 617644 - RNA, 19 nt, Homo sapiens
gagaaccgggaacuuuaua

SEQ ID NO: 617645 - RNA, 19 nt, Homo sapiens
gaaacagggcuacaacaag

SEQ ID NO: 617646 - RNA, 19 nt, Homo sapiens
caacugggacuucuuuauc

SEQ ID NO: 617647 - RNA, 19 nt, Homo sapiens
aggaugagcugcaacuuuc

SEQ ID NO: 617648 - RNA, 19 nt, Homo sapiens
cacugaaccuggaaacuga

SEQ ID NO: 617649 - RNA, 19 nt, Homo sapiens
gagcagcccacaaggcaaa

SEQ ID NO: 617650 - RNA, 19 nt, Homo sapiens
gcugugaggucaucuucug

SEQ ID NO: 617651 - RNA, 19 nt, Homo sapiens
gcaacugggacuucuuuau

SEQ ID NO: 617652 - RNA, 19 nt, Homo sapiens
auucugagcugcuaugaug

SEQ ID NO: 617653 - RNA, 19 nt, Homo sapiens
aagagaagaggaagccuua

SEQ ID NO: 617654 - RNA, 19 nt, Homo sapiens
gaaggaacaagcuauuugg

SEQ ID NO: 617655 - RNA, 19 nt, Homo sapiens
cagcggagguggcuacuac

SEQ ID NO: 617656 - RNA, 19 nt, Homo sapiens
gagaaacuaggccgaucua

SEQ ID NO: 617657 - RNA, 19 nt, Homo sapiens
ggguggcccucaacacuga

SEQ ID NO: 617658 - RNA, 19 nt, Homo sapiens
ccugggcccugccuacuuu

SEQ ID NO: 617659 - RNA, 19 nt, Homo sapiens
gggcuucgccgucauguuc

SEQ ID NO: 617660 - RNA, 19 nt, Homo sapiens
gaaccgggaacuuuauauc

SEQ ID NO: 617661 - RNA, 19 nt, Homo sapiens
gugguggguucugacauua

SEQ ID NO: 617662 - RNA, 19 nt, Homo sapiens
gagagugagguucccuaua

SEQ ID NO: 617663 - RNA, 19 nt, Homo sapiens
ugaaggaacaagcuauuug

SEQ ID NO: 617664 - RNA, 19 nt, Homo sapiens
cuaggccgaucuauuguga

SEQ ID NO: 617665 - RNA, 19 nt, Homo sapiens
ggagaggguuucggaugug

SEQ ID NO: 617666 - RNA, 19 nt, Homo sapiens
gacuuugacuacaaugcua

SEQ ID NO: 617667 - RNA, 19 nt, Homo sapiens
ucaaguacaucagcuucaa

SEQ ID NO: 617668 - RNA, 19 nt, Homo sapiens
ggaaucaggcaaggaaaug

SEQ ID NO: 617669 - RNA, 19 nt, Homo sapiens
guugguauauauuguguuc

SEQ ID NO: 617670 - RNA, 19 nt, Homo sapiens
gggagcuguugguauauau

SEQ ID NO: 617671 - RNA, 19 nt, Homo sapiens
ggaaacugagugggcuuua

SEQ ID NO: 617672 - RNA, 19 nt, Homo sapiens
ugaaacagggcuacaacaa

SEQ ID NO: 617673 - RNA, 19 nt, Homo sapiens
gccgucauguucuucauug

SEQ ID NO: 617674 - RNA, 19 nt, Homo sapiens
agcaggagauccaguuuga

SEQ ID NO: 617675 - RNA, 19 nt, Homo sapiens
gagcuguugguauauauug

SEQ ID NO: 617676 - RNA, 19 nt, Homo sapiens
gcagcaagagggagagaga

SEQ ID NO: 617677 - RNA, 19 nt, Homo sapiens
ucaaugacacauauucaga

SEQ ID NO: 617678 - RNA, 19 nt, Homo sapiens
cagcaacugggacuucuuu

SEQ ID NO: 617679 - RNA, 19 nt, Homo sapiens
gaugucugagcucuucuua

SEQ ID NO: 617680 - RNA, 19 nt, Homo sapiens
ccaugguggcuaucaauaa

SEQ ID NO: 617681 - RNA, 19 nt, Homo sapiens
ugaaaaugcuggagaggaa

SEQ ID NO: 617682 - RNA, 19 nt, Homo sapiens
ccacauccuccuccuauuc

SEQ ID NO: 617683 - RNA, 19 nt, Homo sapiens
gagcucuucuuacauacuc

SEQ ID NO: 617684 - RNA, 19 nt, Homo sapiens
ugugguggguucugacauu

SEQ ID NO: 617685 - RNA, 19 nt, Homo sapiens
gcucaaagcugaaaaugcu

SEQ ID NO: 617686 - RNA, 19 nt, Homo sapiens
gaugagaaggaacaggaaa

SEQ ID NO: 617687 - RNA, 19 nt, Homo sapiens
caaggcaucagaggacuuu

SEQ ID NO: 617688 - RNA, 19 nt, Homo sapiens
ugacagagaugggaaucgu

SEQ ID NO: 617689 - RNA, 19 nt, Homo sapiens
gagcaggagauccaguuug

SEQ ID NO: 617690 - RNA, 19 nt, Homo sapiens
ucgccuggaucaagauauu

SEQ ID NO: 617691 - RNA, 19 nt, Homo sapiens
ugaaugcugucaaccucuu

SEQ ID NO: 617692 - RNA, 19 nt, Homo sapiens
caucuacuaugagaacaug

SEQ ID NO: 617693 - RNA, 19 nt, Homo sapiens
cugagaaccgggaacuuua

SEQ ID NO: 617694 - RNA, 19 nt, Homo sapiens
gcaaauccgcacagucaag

SEQ ID NO: 617695 - RNA, 19 nt, Homo sapiens
uggcaaauccgcacaguca

SEQ ID NO: 617696 - RNA, 19 nt, Homo sapiens
cuacaaugccaauaucaau

SEQ ID NO: 617697 - RNA, 19 nt, Homo sapiens
gcuccagugcuuauuacua

SEQ ID NO: 617698 - RNA, 19 nt, Homo sapiens
gaaucaggcaaggaaauga

SEQ ID NO: 617699 - RNA, 19 nt, Homo sapiens
gcaggaggcuggguuucag

SEQ ID NO: 617700 - RNA, 19 nt, Homo sapiens
ggacaaacgacaugaaaua

SEQ ID NO: 617701 - RNA, 19 nt, Homo sapiens
gagcagagguauagccuuu

SEQ ID NO: 617702 - RNA, 19 nt, Homo sapiens
gugcaaggcucuuuacaaa

SEQ ID NO: 617703 - RNA, 19 nt, Homo sapiens
gcaaagguaccuaguguuu

SEQ ID NO: 617704 - RNA, 19 nt, Homo sapiens
ggaaauuugucuaagauca

SEQ ID NO: 617705 - RNA, 19 nt, Homo sapiens
ggacuagucucauuucucu

SEQ ID NO: 617706 - RNA, 19 nt, Homo sapiens
ggauaggacuagucucauu

SEQ ID NO: 617707 - RNA, 19 nt, Homo sapiens
ggaaguggcagaacugauu

SEQ ID NO: 617708 - RNA, 19 nt, Homo sapiens
gaagugggcacacguuaaa

SEQ ID NO: 617709 - RNA, 19 nt, Homo sapiens
caucaacccucuccuguau

SEQ ID NO: 617710 - RNA, 19 nt, Homo sapiens
gucugaagauggccaauua

SEQ ID NO: 617711 - RNA, 19 nt, Homo sapiens
ccaaaugcaagaagaauaa

SEQ ID NO: 617712 - RNA, 19 nt, Homo sapiens
gcaaggcucuuuacaaacg

SEQ ID NO: 617713 - RNA, 19 nt, Homo sapiens
gcuaagcacugaauuuguc

SEQ ID NO: 617714 - RNA, 19 nt, Homo sapiens
gggaagaaccugaccauuc

SEQ ID NO: 617715 - RNA, 19 nt, Homo sapiens
ucaauugccuucugacugu

SEQ ID NO: 617716 - RNA, 19 nt, Homo sapiens
uaacuuguguuucuugcuu

SEQ ID NO: 617717 - RNA, 19 nt, Homo sapiens
caagaagaauaaacaugga

SEQ ID NO: 617718 - RNA, 19 nt, Homo sapiens
ucacaucacuaaacucauc

SEQ ID NO: 617719 - RNA, 19 nt, Homo sapiens
gcggaaauuugucuaagau

SEQ ID NO: 617720 - RNA, 19 nt, Homo sapiens
gaggugagcuaacauuugc

SEQ ID NO: 617721 - RNA, 19 nt, Homo sapiens
uaaacuagcauccaccaaa

SEQ ID NO: 617722 - RNA, 19 nt, Homo sapiens
gugcaaagguaccuagugu

SEQ ID NO: 617723 - RNA, 19 nt, Homo sapiens
gaauccagguccaguuugu

SEQ ID NO: 617724 - RNA, 19 nt, Homo sapiens
aaauguagcuccagaaagg

SEQ ID NO: 617725 - RNA, 19 nt, Homo sapiens
ggaagugggcacacguuaa

SEQ ID NO: 617726 - RNA, 19 nt, Homo sapiens
ggacaaaaguguucacauc

SEQ ID NO: 617727 - RNA, 19 nt, Homo sapiens
gacaaacgacaugaaauaa

SEQ ID NO: 617728 - RNA, 19 nt, Homo sapiens
gauaggacuagucucauuu

SEQ ID NO: 617729 - RNA, 19 nt, Homo sapiens
aaacuagcauccaccaaau

SEQ ID NO: 617730 - RNA, 19 nt, Homo sapiens
ccaccgaaguguaaacuag

SEQ ID NO: 617731 - RNA, 19 nt, Homo sapiens
gagacauucuggaagcauu

SEQ ID NO: 617732 - RNA, 19 nt, Homo sapiens
gaauuacucuggcuaaaau

SEQ ID NO: 617733 - RNA, 19 nt, Homo sapiens
gcccuacaauauugcauuu

SEQ ID NO: 617734 - RNA, 19 nt, Homo sapiens
cuucugaaauagggaauua

SEQ ID NO: 617735 - RNA, 19 nt, Homo sapiens
caccagaggaugaauauga

SEQ ID NO: 617736 - RNA, 19 nt, Homo sapiens
ggaagcauuuucugacuuu

SEQ ID NO: 617737 - RNA, 19 nt, Homo sapiens
ccacagggcagucugaaga

SEQ ID NO: 617738 - RNA, 19 nt, Homo sapiens
uaagaucacauaacuagga

SEQ ID NO: 617739 - RNA, 19 nt, Homo sapiens
ggagaggugagcuaacauu

SEQ ID NO: 617740 - RNA, 19 nt, Homo sapiens
gggaauuacucuggcuaaa

SEQ ID NO: 617741 - RNA, 19 nt, Homo sapiens
acucugcucugcuguguuu

SEQ ID NO: 617742 - RNA, 19 nt, Homo sapiens
gagaggugagcuaacauuu

SEQ ID NO: 617743 - RNA, 19 nt, Homo sapiens
gcagagcaaugugacaagu

SEQ ID NO: 617744 - RNA, 19 nt, Homo sapiens
ugucuaagaucacauaacu

SEQ ID NO: 617745 - RNA, 19 nt, Homo sapiens
gcaucaacccucuccugua

SEQ ID NO: 617746 - RNA, 19 nt, Homo sapiens
uuauaaaccucagauggaa

SEQ ID NO: 617747 - RNA, 19 nt, Homo sapiens
agagcaaugugacaaguau

SEQ ID NO: 617748 - RNA, 19 nt, Homo sapiens
gagcuaacauuugcuaagc

SEQ ID NO: 617749 - RNA, 19 nt, Homo sapiens
gggaagugggcacacguua

SEQ ID NO: 617750 - RNA, 19 nt, Homo sapiens
cagcuacaaucuggacaaa

SEQ ID NO: 617751 - RNA, 19 nt, Homo sapiens
gggcacacguuaaaagaaa

SEQ ID NO: 617752 - RNA, 19 nt, Homo sapiens
ucagauggaagaccagaaa

SEQ ID NO: 617753 - RNA, 19 nt, Homo sapiens
ucuaagaucacauaacuag

SEQ ID NO: 617754 - RNA, 19 nt, Homo sapiens
uuacaaacgugagcuccuu

SEQ ID NO: 617755 - RNA, 19 nt, Homo sapiens
guucacaucacuaaacuca

SEQ ID NO: 617756 - RNA, 19 nt, Homo sapiens
gcaagagcagcuacaaucu

SEQ ID NO: 617757 - RNA, 19 nt, Homo sapiens
uggaagaccagaaauacaa

SEQ ID NO: 617758 - RNA, 19 nt, Homo sapiens
gauggaagaccagaaauac

SEQ ID NO: 617759 - RNA, 19 nt, Homo sapiens
gaucacauaacuaggaagu

SEQ ID NO: 617760 - RNA, 19 nt, Homo sapiens
gcgaugaggcagagcaaug

SEQ ID NO: 617761 - RNA, 19 nt, Homo sapiens
gaacaucaaacuccaaacc

SEQ ID NO: 617762 - RNA, 19 nt, Homo sapiens
ugaaauagggaauuacucu

SEQ ID NO: 617763 - RNA, 19 nt, Homo sapiens
agauggaagaccagaaaua

SEQ ID NO: 617764 - RNA, 19 nt, Homo sapiens
ggacucaaacgcguggaaa

SEQ ID NO: 617765 - RNA, 19 nt, Homo sapiens
gcucugcuguguuugugau

SEQ ID NO: 617766 - RNA, 19 nt, Homo sapiens
aaauaccucugccgcuguu

SEQ ID NO: 617767 - RNA, 19 nt, Homo sapiens
cagaacaucaaacuccaaa

SEQ ID NO: 617768 - RNA, 19 nt, Homo sapiens
gaaguggcagaacugauuc

SEQ ID NO: 617769 - RNA, 19 nt, Homo sapiens
ccauuccaccgaaguguaa

SEQ ID NO: 617770 - RNA, 19 nt, Homo sapiens
aagaucacauaacuaggaa

SEQ ID NO: 617771 - RNA, 19 nt, Homo sapiens
gcuacaaucuggacaaaag

SEQ ID NO: 617772 - RNA, 19 nt, Homo sapiens
gaucccauguguaaaauuc

SEQ ID NO: 617773 - RNA, 19 nt, Homo sapiens
gcgcggaaauuugucuaag

SEQ ID NO: 617774 - RNA, 19 nt, Homo sapiens
guggauaggacuagucuca

SEQ ID NO: 617775 - RNA, 19 nt, Homo sapiens
ggugagcuaacauuugcua

SEQ ID NO: 617776 - RNA, 19 nt, Homo sapiens
ccuguacagugagacauuu

SEQ ID NO: 617777 - RNA, 19 nt, Homo sapiens
ucaaacgcguggaaaauau

SEQ ID NO: 617778 - RNA, 19 nt, Homo sapiens
cgcggaaauuugucuaaga

SEQ ID NO: 617779 - RNA, 19 nt, Homo sapiens
caagagcagcuacaaucug

SEQ ID NO: 617780 - RNA, 19 nt, Homo sapiens
guuucuaacuuguguuucu

SEQ ID NO: 617781 - RNA, 19 nt, Homo sapiens
cagguccaguuuguuguuu

SEQ ID NO: 617782 - RNA, 19 nt, Homo sapiens
ggaaaguggggcuguauga

SEQ ID NO: 617783 - RNA, 19 nt, Homo sapiens
ccaccaaaugcaagaagaa

SEQ ID NO: 617784 - RNA, 19 nt, Homo sapiens
gcagagguauagccuuuuc

SEQ ID NO: 617785 - RNA, 19 nt, Homo sapiens
cagagcaaugugacaagua

SEQ ID NO: 617786 - RNA, 19 nt, Homo sapiens
ccucauagaaggugaacug

SEQ ID NO: 617787 - RNA, 19 nt, Homo sapiens
aaagggagaggugagcuaa

SEQ ID NO: 617788 - RNA, 19 nt, Homo sapiens
gcagcuacaaucuggacaa

SEQ ID NO: 617789 - RNA, 19 nt, Homo sapiens
ucagggagcagagguauag

SEQ ID NO: 617790 - RNA, 19 nt, Homo sapiens
uaacuaggaaguggcagaa

SEQ ID NO: 617791 - RNA, 19 nt, Homo sapiens
guuuccaucugcguaguaa

SEQ ID NO: 617792 - RNA, 19 nt, Homo sapiens
augguagucuuccuucuga

SEQ ID NO: 617793 - RNA, 19 nt, Homo sapiens
agaaauacaagugugcauu

SEQ ID NO: 617794 - RNA, 19 nt, Homo sapiens
ggaauuacucuggcuaaaa

SEQ ID NO: 617795 - RNA, 19 nt, Homo sapiens
ucaacccucuccuguaugc

SEQ ID NO: 617796 - RNA, 19 nt, Homo sapiens
gaagaccagaaauacaagu

SEQ ID NO: 617797 - RNA, 19 nt, Homo sapiens
ggaagaccagaaauacaag

SEQ ID NO: 617798 - RNA, 19 nt, Homo sapiens
gguugugcuuauccuggua

SEQ ID NO: 617799 - RNA, 19 nt, Homo sapiens
ccuggacaaucuccugguu

SEQ ID NO: 617800 - RNA, 19 nt, Homo sapiens
gcaguugguugaauaauua

SEQ ID NO: 617801 - RNA, 19 nt, Homo sapiens
ggaaauagucggauaagua

SEQ ID NO: 617802 - RNA, 19 nt, Homo sapiens
caucgaagcuggucuuuaa

SEQ ID NO: 617803 - RNA, 19 nt, Homo sapiens
gaagggaaccuguguuaua

SEQ ID NO: 617804 - RNA, 19 nt, Homo sapiens
gaauguggccaaacaauua

SEQ ID NO: 617805 - RNA, 19 nt, Homo sapiens
gaaggagucuuucuuuaga

SEQ ID NO: 617806 - RNA, 19 nt, Homo sapiens
gaaagaacuuguuguagga

SEQ ID NO: 617807 - RNA, 19 nt, Homo sapiens
gaucaucgauaagcauuua

SEQ ID NO: 617808 - RNA, 19 nt, Homo sapiens
gaaauaagacaucgugaaa

SEQ ID NO: 617809 - RNA, 19 nt, Homo sapiens
gugcauagguccauaauau

SEQ ID NO: 617810 - RNA, 19 nt, Homo sapiens
gaaaugcgguacuguucua

SEQ ID NO: 617811 - RNA, 19 nt, Homo sapiens
ucaacaaacuggacaagua

SEQ ID NO: 617812 - RNA, 19 nt, Homo sapiens
gaaacuccaucucuacaaa

SEQ ID NO: 617813 - RNA, 19 nt, Homo sapiens
uuacagagaugacacagua

SEQ ID NO: 617814 - RNA, 19 nt, Homo sapiens
ggaaacguguucuuacaaa

SEQ ID NO: 617815 - RNA, 19 nt, Homo sapiens
gggaagaccuauucuaaug

SEQ ID NO: 617816 - RNA, 19 nt, Homo sapiens
ucgcuuggcuuuagucuua

SEQ ID NO: 617817 - RNA, 19 nt, Homo sapiens
ggauaaagcugugggauuc

SEQ ID NO: 617818 - RNA, 19 nt, Homo sapiens
ggaaagauacugcaaugaa

SEQ ID NO: 617819 - RNA, 19 nt, Homo sapiens
ucacagaggucccuggaaa

SEQ ID NO: 617820 - RNA, 19 nt, Homo sapiens
gaggagagccugagcauga

SEQ ID NO: 617821 - RNA, 19 nt, Homo sapiens
gauauggacuuagugaauu

SEQ ID NO: 617822 - RNA, 19 nt, Homo sapiens
gcucagcucuggugccuuu

SEQ ID NO: 617823 - RNA, 19 nt, Homo sapiens
gaggaaagauacugcaaug

SEQ ID NO: 617824 - RNA, 19 nt, Homo sapiens
gaagaaugcugcggauuuc

SEQ ID NO: 617825 - RNA, 19 nt, Homo sapiens
gcauagguccauaauauuu

SEQ ID NO: 617826 - RNA, 19 nt, Homo sapiens
gggcugagguucuaaagga

SEQ ID NO: 617827 - RNA, 19 nt, Homo sapiens
caaguaggcucucacuaga

SEQ ID NO: 617828 - RNA, 19 nt, Homo sapiens
gaagacaccuggaccacau

SEQ ID NO: 617829 - RNA, 19 nt, Homo sapiens
ggaaagaaacaaauacuuc

SEQ ID NO: 617830 - RNA, 19 nt, Homo sapiens
gagcaacgauuccgauaca

SEQ ID NO: 617831 - RNA, 19 nt, Homo sapiens
uggauccucuguagaauua

SEQ ID NO: 617832 - RNA, 19 nt, Homo sapiens
gacgugauccugccauuua

SEQ ID NO: 617833 - RNA, 19 nt, Homo sapiens
gcucuguacuccacgcuua

SEQ ID NO: 617834 - RNA, 19 nt, Homo sapiens
gaaagauacugcaaugaac

SEQ ID NO: 617835 - RNA, 19 nt, Homo sapiens
gaaauagucggauaaguag

SEQ ID NO: 617836 - RNA, 19 nt, Homo sapiens
caucucagcuucuucaugu

SEQ ID NO: 617837 - RNA, 19 nt, Homo sapiens
gauaagcauuuaagagugu

SEQ ID NO: 617838 - RNA, 19 nt, Homo sapiens
caacagcauuuccaagaug

SEQ ID NO: 617839 - RNA, 19 nt, Homo sapiens
auaaguaggugacgugaaa

SEQ ID NO: 617840 - RNA, 19 nt, Homo sapiens
ggaaacgguugcccacuuc

SEQ ID NO: 617841 - RNA, 19 nt, Homo sapiens
gaugaguacuaacagcuuu

SEQ ID NO: 617842 - RNA, 19 nt, Homo sapiens
gaagacacgugcccagagu

SEQ ID NO: 617843 - RNA, 19 nt, Homo sapiens
ucucauauacccagauuua

SEQ ID NO: 617844 - RNA, 19 nt, Homo sapiens
gaaacguguucuuacaaau

SEQ ID NO: 617845 - RNA, 19 nt, Homo sapiens
uggaaggagucuuucuuua

SEQ ID NO: 617846 - RNA, 19 nt, Homo sapiens
caucaaggcauuuaacaaa

SEQ ID NO: 617847 - RNA, 19 nt, Homo sapiens
ggacagaaccgcgaggaaa

SEQ ID NO: 617848 - RNA, 19 nt, Homo sapiens
ggacagaaagaacuuguug

SEQ ID NO: 617849 - RNA, 19 nt, Homo sapiens
gagcugagaucacaucacu

SEQ ID NO: 617850 - RNA, 19 nt, Homo sapiens
ggaaggagaagaacagaau

SEQ ID NO: 617851 - RNA, 19 nt, Homo sapiens
ggaaggagucuuucuuuag

SEQ ID NO: 617852 - RNA, 19 nt, Homo sapiens
cuuggaaacuccuucauaa

SEQ ID NO: 617853 - RNA, 19 nt, Homo sapiens
cgaagcuggucuuuaauga

SEQ ID NO: 617854 - RNA, 19 nt, Homo sapiens
gcaacagcauuuccaagau

SEQ ID NO: 617855 - RNA, 19 nt, Homo sapiens
gagccaggguggugaaguu

SEQ ID NO: 617856 - RNA, 19 nt, Homo sapiens
cgaagaaugcugcggauuu

SEQ ID NO: 617857 - RNA, 19 nt, Homo sapiens
ggaauaaguuguguuuguc

SEQ ID NO: 617858 - RNA, 19 nt, Homo sapiens
ugagucuucuucccuaaua

SEQ ID NO: 617859 - RNA, 19 nt, Homo sapiens
caggauagcuggaaguaag

SEQ ID NO: 617860 - RNA, 19 nt, Homo sapiens
guguaaaucuucaugaugu

SEQ ID NO: 617861 - RNA, 19 nt, Homo sapiens
ggacuggucugagugugaa

SEQ ID NO: 617862 - RNA, 19 nt, Homo sapiens
gcauggagaucgccaacug

SEQ ID NO: 617863 - RNA, 19 nt, Homo sapiens
gcggauuucucgcaguuaa

SEQ ID NO: 617864 - RNA, 19 nt, Homo sapiens
gaguuaccauucauauuug

SEQ ID NO: 617865 - RNA, 19 nt, Homo sapiens
ccuaauaguuuguaagcuu

SEQ ID NO: 617866 - RNA, 19 nt, Homo sapiens
gcuccaagguccauacuca

SEQ ID NO: 617867 - RNA, 19 nt, Homo sapiens
ggcaguugguugaauaauu

SEQ ID NO: 617868 - RNA, 19 nt, Homo sapiens
gagccagucuguaaaauaa

SEQ ID NO: 617869 - RNA, 19 nt, Homo sapiens
ccagucaucuccuauaaag

SEQ ID NO: 617870 - RNA, 19 nt, Homo sapiens
ccaaagguguacuuacuuc

SEQ ID NO: 617871 - RNA, 19 nt, Homo sapiens
gcaaauggaggaaauaguc

SEQ ID NO: 617872 - RNA, 19 nt, Homo sapiens
ugaaugauauggacuuagu

SEQ ID NO: 617873 - RNA, 19 nt, Homo sapiens
uaaagccgcucuuccuuag

SEQ ID NO: 617874 - RNA, 19 nt, Homo sapiens
gaaaguguuagaagaauuc

SEQ ID NO: 617875 - RNA, 19 nt, Homo sapiens
caaaugaaccuucggaucu

SEQ ID NO: 617876 - RNA, 19 nt, Homo sapiens
gaaaagguguggagaguuc

SEQ ID NO: 617877 - RNA, 19 nt, Homo sapiens
uagcauggcuguucucaag

SEQ ID NO: 617878 - RNA, 19 nt, Homo sapiens
ggaggacaauagccgcuuu

SEQ ID NO: 617879 - RNA, 19 nt, Homo sapiens
caagugcuauggacaguuc

SEQ ID NO: 617880 - RNA, 19 nt, Homo sapiens
caucagaaauuuccaacuc

SEQ ID NO: 617881 - RNA, 19 nt, Homo sapiens
caaguccauugguuuguuu

SEQ ID NO: 617882 - RNA, 19 nt, Homo sapiens
gaaaagagacgauaaacau

SEQ ID NO: 617883 - RNA, 19 nt, Homo sapiens
ccagggacauguagcuuug

SEQ ID NO: 617884 - RNA, 19 nt, Homo sapiens
gaauacaguugcagauagg

SEQ ID NO: 617885 - RNA, 19 nt, Homo sapiens
gguuaaagagggauucuaa

SEQ ID NO: 617886 - RNA, 19 nt, Homo sapiens
gcugggaugugguaaugaa

SEQ ID NO: 617887 - RNA, 19 nt, Homo sapiens
acauguagcuuuggugaaa

SEQ ID NO: 617888 - RNA, 19 nt, Homo sapiens
ggaaacuccuucauaaagc

SEQ ID NO: 617889 - RNA, 19 nt, Homo sapiens
uggaauaaguuguguuugu

SEQ ID NO: 617890 - RNA, 19 nt, Homo sapiens
ggacuaaggaacauagaau

SEQ ID NO: 617891 - RNA, 19 nt, Homo sapiens
uauggcaguugguugaaua

SEQ ID NO: 617892 - RNA, 19 nt, Homo sapiens
gugaaaaucuugaccauug

SEQ ID NO: 617893 - RNA, 19 nt, Homo sapiens
guggagaguucaacauguu

SEQ ID NO: 617894 - RNA, 19 nt, Homo sapiens
agaaguaucuguggcaaga

SEQ ID NO: 617895 - RNA, 19 nt, Homo sapiens
gcaggaugcucagaaguuc

SEQ ID NO: 617896 - RNA, 19 nt, Homo sapiens
gcaaaucaaaggaggaaug

SEQ ID NO: 617897 - RNA, 19 nt, Homo sapiens
ggaggaaauagucggauaa

SEQ ID NO: 617898 - RNA, 19 nt, Homo sapiens
ucacuagaguuaccauuca

SEQ ID NO: 617899 - RNA, 19 nt, Homo sapiens
gacagaauagcaaguguuu

SEQ ID NO: 617900 - RNA, 19 nt, Homo sapiens
gcacugaaacucacacuga

SEQ ID NO: 617901 - RNA, 19 nt, Homo sapiens
aaacuucccuuuguucuuu

SEQ ID NO: 617902 - RNA, 19 nt, Homo sapiens
ggcccuggcugacauguuu

SEQ ID NO: 617903 - RNA, 19 nt, Homo sapiens
gacacgcacuguugauuug

SEQ ID NO: 617904 - RNA, 19 nt, Homo sapiens
cagcauacacuucguuauu

SEQ ID NO: 617905 - RNA, 19 nt, Homo sapiens
uggaagagaugccuugugu

SEQ ID NO: 617906 - RNA, 19 nt, Homo sapiens
ugacaucuuuaucugguuu

SEQ ID NO: 617907 - RNA, 19 nt, Homo sapiens
uuccaucucuguuucauuu

SEQ ID NO: 617908 - RNA, 19 nt, Homo sapiens
gacagccuccuucacuuua

SEQ ID NO: 617909 - RNA, 19 nt, Homo sapiens
gguuaaacuucccuuuguu

SEQ ID NO: 617910 - RNA, 19 nt, Homo sapiens
gcuagggaauguauuugug

SEQ ID NO: 617911 - RNA, 19 nt, Homo sapiens
augaucagcuuguauguga

SEQ ID NO: 617912 - RNA, 19 nt, Homo sapiens
guggagagcugcugguucu

SEQ ID NO: 617913 - RNA, 19 nt, Homo sapiens
cgacagccuccuucacuuu

SEQ ID NO: 617914 - RNA, 19 nt, Homo sapiens
gcauuguugugggcauaua

SEQ ID NO: 617915 - RNA, 19 nt, Homo sapiens
gcauccaguuggucaucua

SEQ ID NO: 617916 - RNA, 19 nt, Homo sapiens
cagacaggcucagcagauu

SEQ ID NO: 617917 - RNA, 19 nt, Homo sapiens
gggcauuguugugggcaua

SEQ ID NO: 617918 - RNA, 19 nt, Homo sapiens
ccaagacccugggcauugu

SEQ ID NO: 617919 - RNA, 19 nt, Homo sapiens
gcuuguaugugaagaucuu

SEQ ID NO: 617920 - RNA, 19 nt, Homo sapiens
cauccaaggugcugaagag

SEQ ID NO: 617921 - RNA, 19 nt, Homo sapiens
caucuuccaucucuguuuc

SEQ ID NO: 617922 - RNA, 19 nt, Homo sapiens
ccacuggucuuugacaucu

SEQ ID NO: 617923 - RNA, 19 nt, Homo sapiens
agacacgcacuguugauuu

SEQ ID NO: 617924 - RNA, 19 nt, Homo sapiens
gccaagacccugggcauug

SEQ ID NO: 617925 - RNA, 19 nt, Homo sapiens
cagcagauuaccacauuga

SEQ ID NO: 617926 - RNA, 19 nt, Homo sapiens
agacaggcucagcagauua

SEQ ID NO: 617927 - RNA, 19 nt, Homo sapiens
uaucugguuugcuuacuuc

SEQ ID NO: 617928 - RNA, 19 nt, Homo sapiens
ugguuaaacuucccuuugu

SEQ ID NO: 617929 - RNA, 19 nt, Homo sapiens
acacuucguuauuccucua

SEQ ID NO: 617930 - RNA, 19 nt, Homo sapiens
ugauuuguaccaagaauga

SEQ ID NO: 617931 - RNA, 19 nt, Homo sapiens
ccgcagacacgcacuguug

SEQ ID NO: 617932 - RNA, 19 nt, Homo sapiens
cucagcagauuaccacauu

SEQ ID NO: 617933 - RNA, 19 nt, Homo sapiens
uggcugcccuucaccauag

SEQ ID NO: 617934 - RNA, 19 nt, Homo sapiens
gaagaucuuugugguugcu

SEQ ID NO: 617935 - RNA, 19 nt, Homo sapiens
ggagagcugcugguucuuc

SEQ ID NO: 617936 - RNA, 19 nt, Homo sapiens
cacgcacuguugauuugua

SEQ ID NO: 617937 - RNA, 19 nt, Homo sapiens
cguuauuccucuacacaga

SEQ ID NO: 617938 - RNA, 19 nt, Homo sapiens
ccagacaggcucagcagau

SEQ ID NO: 617939 - RNA, 19 nt, Homo sapiens
gcucuaucccuccaaguuc

SEQ ID NO: 617940 - RNA, 19 nt, Homo sapiens
cauuugcuguguccuacuu

SEQ ID NO: 617941 - RNA, 19 nt, Homo sapiens
gcaggcaugcugauuaucg

SEQ ID NO: 617942 - RNA, 19 nt, Homo sapiens
gcauacacuucguuauucc

SEQ ID NO: 617943 - RNA, 19 nt, Homo sapiens
gcagacacgcacuguugau

SEQ ID NO: 617944 - RNA, 19 nt, Homo sapiens
cagcuuguaugugaagauc

SEQ ID NO: 617945 - RNA, 19 nt, Homo sapiens
uaaacuucccuuuguucuu

SEQ ID NO: 617946 - RNA, 19 nt, Homo sapiens
guuaaacuucccuuuguuc

SEQ ID NO: 617947 - RNA, 19 nt, Homo sapiens
acuggucuuugacaucuuu

SEQ ID NO: 617948 - RNA, 19 nt, Homo sapiens
ucuguuucauuuccauuga

SEQ ID NO: 617949 - RNA, 19 nt, Homo sapiens
ucaccuccaucuuccaucu

SEQ ID NO: 617950 - RNA, 19 nt, Homo sapiens
cugccaagcaugagagaaa

SEQ ID NO: 617951 - RNA, 19 nt, Homo sapiens
gaucagcuuguaugugaag

SEQ ID NO: 617952 - RNA, 19 nt, Homo sapiens
guugauuuguaccaagaau

SEQ ID NO: 617953 - RNA, 19 nt, Homo sapiens
gcuguguccuacuucaaag

SEQ ID NO: 617954 - RNA, 19 nt, Homo sapiens
gcaaccccaucaucuaugu

SEQ ID NO: 617955 - RNA, 19 nt, Homo sapiens
cgugcuagggaauguauuu

SEQ ID NO: 617956 - RNA, 19 nt, Homo sapiens
agcauacacuucguuauuc

SEQ ID NO: 617957 - RNA, 19 nt, Homo sapiens
cggaaggcacugaaacuca

SEQ ID NO: 617958 - RNA, 19 nt, Homo sapiens
cagaugugguagagacaag

SEQ ID NO: 617959 - RNA, 19 nt, Homo sapiens
ucacacgcccaccaacuuc

SEQ ID NO: 617960 - RNA, 19 nt, Homo sapiens
gcagcauacacuucguuau

SEQ ID NO: 617961 - RNA, 19 nt, Homo sapiens
ucgacagccuccuucacuu

SEQ ID NO: 617962 - RNA, 19 nt, Homo sapiens
ucagcagauuaccacauug

SEQ ID NO: 617963 - RNA, 19 nt, Homo sapiens
gcugcugcucaauaaauuu

SEQ ID NO: 617964 - RNA, 19 nt, Homo sapiens
cagacacgcacuguugauu

SEQ ID NO: 617965 - RNA, 19 nt, Homo sapiens
gauggucgacagccuccuu

SEQ ID NO: 617966 - RNA, 19 nt, Homo sapiens
gacaggcucagcagauuac

SEQ ID NO: 617967 - RNA, 19 nt, Homo sapiens
gcugauaucucuucuaaau

SEQ ID NO: 617968 - RNA, 19 nt, Homo sapiens
gagagagcaucacaauaua

SEQ ID NO: 617969 - RNA, 19 nt, Homo sapiens
uagaugggcuguauacaua

SEQ ID NO: 617970 - RNA, 19 nt, Homo sapiens
ugaaguugcugcagaauuu

SEQ ID NO: 617971 - RNA, 19 nt, Homo sapiens
gagaugauccugaacauau

SEQ ID NO: 617972 - RNA, 19 nt, Homo sapiens
gccagaagauggauaaaug

SEQ ID NO: 617973 - RNA, 19 nt, Homo sapiens
cauuggagcuggcggcuua

SEQ ID NO: 617974 - RNA, 19 nt, Homo sapiens
gcuaagaaguugaaucgau

SEQ ID NO: 617975 - RNA, 19 nt, Homo sapiens
gguaaccucuauugaagaa

SEQ ID NO: 617976 - RNA, 19 nt, Homo sapiens
gugcauacauucccuugaa

SEQ ID NO: 617977 - RNA, 19 nt, Homo sapiens
ggaaccauguaaagaaguu

SEQ ID NO: 617978 - RNA, 19 nt, Homo sapiens
gaaaauggcuguugauggu

SEQ ID NO: 617979 - RNA, 19 nt, Homo sapiens
gaauaccugugcaugaaug

SEQ ID NO: 617980 - RNA, 19 nt, Homo sapiens
gagauuaugagcaaaugua

SEQ ID NO: 617981 - RNA, 19 nt, Homo sapiens
agagagagauuaugagcaa

SEQ ID NO: 617982 - RNA, 19 nt, Homo sapiens
gcgaggagccggagaagaa

SEQ ID NO: 617983 - RNA, 19 nt, Homo sapiens
gcaugaaugggcaauauuu

SEQ ID NO: 617984 - RNA, 19 nt, Homo sapiens
uaacgacacuuucuaucga

SEQ ID NO: 617985 - RNA, 19 nt, Homo sapiens
gaaaugauaccuggagaga

SEQ ID NO: 617986 - RNA, 19 nt, Homo sapiens
gaacgaacaaggccaaauc

SEQ ID NO: 617987 - RNA, 19 nt, Homo sapiens
gcaguagcuuccacaaaug

SEQ ID NO: 617988 - RNA, 19 nt, Homo sapiens
agagagagcaucacaauau

SEQ ID NO: 617989 - RNA, 19 nt, Homo sapiens
ccagaacacuguauugagu

SEQ ID NO: 617990 - RNA, 19 nt, Homo sapiens
caauagugcuucucugcaa

SEQ ID NO: 617991 - RNA, 19 nt, Homo sapiens
ccacauuucuacaagauuc

SEQ ID NO: 617992 - RNA, 19 nt, Homo sapiens
ggaagcauacaaccucuuu

SEQ ID NO: 617993 - RNA, 19 nt, Homo sapiens
aaugauaccuggagagaga

SEQ ID NO: 617994 - RNA, 19 nt, Homo sapiens
ucugacaucuggaguauau

SEQ ID NO: 617995 - RNA, 19 nt, Homo sapiens
gugcuucucugcaaaugaa

SEQ ID NO: 617996 - RNA, 19 nt, Homo sapiens
uaaggaaaaucuccacaua

SEQ ID NO: 617997 - RNA, 19 nt, Homo sapiens
aaugcacgcuggaacuuua

SEQ ID NO: 617998 - RNA, 19 nt, Homo sapiens
uaaauggcaugcugauauc

SEQ ID NO: 617999 - RNA, 19 nt, Homo sapiens
uaacuaaugccaagacaug

SEQ ID NO: 618000 - RNA, 19 nt, Homo sapiens
uggauuaucuaaccaauag

SEQ ID NO: 618001 - RNA, 19 nt, Homo sapiens
gaaguugaaucgaugucau

SEQ ID NO: 618002 - RNA, 19 nt, Homo sapiens
caagcuccauugucccuuu

SEQ ID NO: 618003 - RNA, 19 nt, Homo sapiens
guuccuaacugcaauguag

SEQ ID NO: 618004 - RNA, 19 nt, Homo sapiens
guaaaguucuagucauugg

SEQ ID NO: 618005 - RNA, 19 nt, Homo sapiens
gaaaaucuccacauaauag

SEQ ID NO: 618006 - RNA, 19 nt, Homo sapiens
ugcaguagcuuccacaaau

SEQ ID NO: 618007 - RNA, 19 nt, Homo sapiens
gauauggacacuauagaug

SEQ ID NO: 618008 - RNA, 19 nt, Homo sapiens
agaugauccugaacauaua

SEQ ID NO: 618009 - RNA, 19 nt, Homo sapiens
ggagaugauccugaacaua

SEQ ID NO: 618010 - RNA, 19 nt, Homo sapiens
gccuaaagauauuggaaga

SEQ ID NO: 618011 - RNA, 19 nt, Homo sapiens
gugcaugaaugggcaauau

SEQ ID NO: 618012 - RNA, 19 nt, Homo sapiens
uacaggagguuuuggauua

SEQ ID NO: 618013 - RNA, 19 nt, Homo sapiens
gcuggaaccauguaaagaa

SEQ ID NO: 618014 - RNA, 19 nt, Homo sapiens
gagagcaucacaauauaau

SEQ ID NO: 618015 - RNA, 19 nt, Homo sapiens
uauguggacuggacucuau

SEQ ID NO: 618016 - RNA, 19 nt, Homo sapiens
uggaguauauugaacauag

SEQ ID NO: 618017 - RNA, 19 nt, Homo sapiens
gagagauuaugagcaaaug

SEQ ID NO: 618018 - RNA, 19 nt, Homo sapiens
gacagaagguuuuaaagga

SEQ ID NO: 618019 - RNA, 19 nt, Homo sapiens
gauggugucuuagauccaa

SEQ ID NO: 618020 - RNA, 19 nt, Homo sapiens
augcugauaucucuucuaa

SEQ ID NO: 618021 - RNA, 19 nt, Homo sapiens
uaaaugacagaguuccuaa

SEQ ID NO: 618022 - RNA, 19 nt, Homo sapiens
cuccaguucuuguuagaua

SEQ ID NO: 618023 - RNA, 19 nt, Homo sapiens
gauaaauggcaugcugaua

SEQ ID NO: 618024 - RNA, 19 nt, Homo sapiens
cacuuucuaucgacaauuu

SEQ ID NO: 618025 - RNA, 19 nt, Homo sapiens
cugaauaccugugcaugaa

SEQ ID NO: 618026 - RNA, 19 nt, Homo sapiens
caauaguguugccacgauu

SEQ ID NO: 618027 - RNA, 19 nt, Homo sapiens
gccauccaaaugaauauua

SEQ ID NO: 618028 - RNA, 19 nt, Homo sapiens
auaaauggcaugcugauau

SEQ ID NO: 618029 - RNA, 19 nt, Homo sapiens
caaucuaaauaggcaguuu

SEQ ID NO: 618030 - RNA, 19 nt, Homo sapiens
cacuauagauguuuccaau

SEQ ID NO: 618031 - RNA, 19 nt, Homo sapiens
aaucuggccuugucugguu

SEQ ID NO: 618032 - RNA, 19 nt, Homo sapiens
gaucuggacccuucacaca

SEQ ID NO: 618033 - RNA, 19 nt, Homo sapiens
guagaugggcuguauacau

SEQ ID NO: 618034 - RNA, 19 nt, Homo sapiens
ugauguagaugggcuguau

SEQ ID NO: 618035 - RNA, 19 nt, Homo sapiens
gcugaauaccugugcauga

SEQ ID NO: 618036 - RNA, 19 nt, Homo sapiens
ggaaaaucuccacauaaua

SEQ ID NO: 618037 - RNA, 19 nt, Homo sapiens
auacacauuugaagcagaa

SEQ ID NO: 618038 - RNA, 19 nt, Homo sapiens
gaaugcacgcuggaacuuu

SEQ ID NO: 618039 - RNA, 19 nt, Homo sapiens
cugaaucucuccaguucuu

SEQ ID NO: 618040 - RNA, 19 nt, Homo sapiens
ccaaaucucuccaaaacau

SEQ ID NO: 618041 - RNA, 19 nt, Homo sapiens
gaagcagaaagaaaggaaa

SEQ ID NO: 618042 - RNA, 19 nt, Homo sapiens
uauggacacuauagauguu

SEQ ID NO: 618043 - RNA, 19 nt, Homo sapiens
ugacaucuggaguauauug

SEQ ID NO: 618044 - RNA, 19 nt, Homo sapiens
uuuguaaccuucccuugaa

SEQ ID NO: 618045 - RNA, 19 nt, Homo sapiens
guagccagcuuccucaaaa

SEQ ID NO: 618046 - RNA, 19 nt, Homo sapiens
uggaaugacugcuuguauc

SEQ ID NO: 618047 - RNA, 19 nt, Homo sapiens
aaucugacaucuggaguau

SEQ ID NO: 618048 - RNA, 19 nt, Homo sapiens
gguguuuaaugauguagau

SEQ ID NO: 618049 - RNA, 19 nt, Homo sapiens
aaugacugcuuguaucgaa

SEQ ID NO: 618050 - RNA, 19 nt, Homo sapiens
cacacacccugauuucgaa

SEQ ID NO: 618051 - RNA, 19 nt, Homo sapiens
aaagauauuggaagaccua

SEQ ID NO: 618052 - RNA, 19 nt, Homo sapiens
ucgguaaccucuauugaag

SEQ ID NO: 618053 - RNA, 19 nt, Homo sapiens
ccaagacauggcuguuuaa

SEQ ID NO: 618054 - RNA, 19 nt, Homo sapiens
cuagagagagcaucacaau

SEQ ID NO: 618055 - RNA, 19 nt, Homo sapiens
ucacacacccugauuucga

SEQ ID NO: 618056 - RNA, 19 nt, Homo sapiens
caagacauggcuguuuaaa

SEQ ID NO: 618057 - RNA, 19 nt, Homo sapiens
gagagagauuaugagcaaa

SEQ ID NO: 618058 - RNA, 19 nt, Homo sapiens
agaacacuguauugaguau

SEQ ID NO: 618059 - RNA, 19 nt, Homo sapiens
cagaacacuguauugagua

SEQ ID NO: 618060 - RNA, 19 nt, Homo sapiens
gauauuggaagaccuaagg

SEQ ID NO: 618061 - RNA, 19 nt, Homo sapiens
uauacuuuguggaugcuaa

SEQ ID NO: 618062 - RNA, 19 nt, Homo sapiens
cgaacaaggccaaaucucu

SEQ ID NO: 618063 - RNA, 19 nt, Homo sapiens
uacagucgguaaccucuau

SEQ ID NO: 618064 - RNA, 19 nt, Homo sapiens
agagagcaucacaauauaa

SEQ ID NO: 618065 - RNA, 19 nt, Homo sapiens
gaagaaaagaaggagaaua

SEQ ID NO: 618066 - RNA, 19 nt, Homo sapiens
caaucugacaucuggagua

SEQ ID NO: 618067 - RNA, 19 nt, Homo sapiens
gaaauaggguuggcgcaua

SEQ ID NO: 618068 - RNA, 19 nt, Homo sapiens
gaugagggcuucuacaaga

SEQ ID NO: 618069 - RNA, 19 nt, Homo sapiens
ggaaguuuguguucaguuu

SEQ ID NO: 618070 - RNA, 19 nt, Homo sapiens
gauaucagcuucucagauc

SEQ ID NO: 618071 - RNA, 19 nt, Homo sapiens
gagcugaaccugcccaaga

SEQ ID NO: 618072 - RNA, 19 nt, Homo sapiens
cuacaagagugggaaguuu

SEQ ID NO: 618073 - RNA, 19 nt, Homo sapiens
gaagccaguccuuacgaua

SEQ ID NO: 618074 - RNA, 19 nt, Homo sapiens
cagacgaccuccucaacuu

SEQ ID NO: 618075 - RNA, 19 nt, Homo sapiens
ggaagccaguccuuacgau

SEQ ID NO: 618076 - RNA, 19 nt, Homo sapiens
cagagguccugcagaacaa

SEQ ID NO: 618077 - RNA, 19 nt, Homo sapiens
ugaagcagcagaagaagga

SEQ ID NO: 618078 - RNA, 19 nt, Homo sapiens
ugcaguaucucuucuugga

SEQ ID NO: 618079 - RNA, 19 nt, Homo sapiens
uaauuuauggccugcagua

SEQ ID NO: 618080 - RNA, 19 nt, Homo sapiens
ggugaagugugagacaaug

SEQ ID NO: 618081 - RNA, 19 nt, Homo sapiens
ggacauaaacgagcugaac

SEQ ID NO: 618082 - RNA, 19 nt, Homo sapiens
caucggcuccaccuacuuu

SEQ ID NO: 618083 - RNA, 19 nt, Homo sapiens
cccaagacgugugauauca

SEQ ID NO: 618084 - RNA, 19 nt, Homo sapiens
uuugagcgcugccugaaau

SEQ ID NO: 618085 - RNA, 19 nt, Homo sapiens
caacgucugccucaacauc

SEQ ID NO: 618086 - RNA, 19 nt, Homo sapiens
uaacaccaggcuaacuaaa

SEQ ID NO: 618087 - RNA, 19 nt, Homo sapiens
acaccaggcuaacuaaagg

SEQ ID NO: 618088 - RNA, 19 nt, Homo sapiens
ggauccagaaggacauaaa

SEQ ID NO: 618089 - RNA, 19 nt, Homo sapiens
aagccaguccuuacgauaa

SEQ ID NO: 618090 - RNA, 19 nt, Homo sapiens
aaauaggguuggcgcauac

SEQ ID NO: 618091 - RNA, 19 nt, Homo sapiens
agccaguccuuacgauaaa

SEQ ID NO: 618092 - RNA, 19 nt, Homo sapiens
uuuauggccugcaguaucu

SEQ ID NO: 618093 - RNA, 19 nt, Homo sapiens
uuuaacaccaggcuaacua

SEQ ID NO: 618094 - RNA, 19 nt, Homo sapiens
ccugcaguaucucuucuug

SEQ ID NO: 618095 - RNA, 19 nt, Homo sapiens
gcaccaagggcagcagcaa

SEQ ID NO: 618096 - RNA, 19 nt, Homo sapiens
gcccaagacgugugauauc

SEQ ID NO: 618097 - RNA, 19 nt, Homo sapiens
ccgaggacccacugaacaa

SEQ ID NO: 618098 - RNA, 19 nt, Homo sapiens
gccucaacauccucagaga

SEQ ID NO: 618099 - RNA, 19 nt, Homo sapiens
uuaaggugggccaggguua

SEQ ID NO: 618100 - RNA, 19 nt, Homo sapiens
uacaagagugggaaguuug

SEQ ID NO: 618101 - RNA, 19 nt, Homo sapiens
gacgaccuccucaacuuca

SEQ ID NO: 618102 - RNA, 19 nt, Homo sapiens
uuaacaccaggcuaacuaa

SEQ ID NO: 618103 - RNA, 19 nt, Homo sapiens
ucaagcuguucucgcugaa

SEQ ID NO: 618104 - RNA, 19 nt, Homo sapiens
caaggugaagugugagaca

SEQ ID NO: 618105 - RNA, 19 nt, Homo sapiens
ccacgugccccuaguuauu

SEQ ID NO: 618106 - RNA, 19 nt, Homo sapiens
gugggaaguuuguguucag

SEQ ID NO: 618107 - RNA, 19 nt, Homo sapiens
ggaaacacuugauaaauga

SEQ ID NO: 618108 - RNA, 19 nt, Homo sapiens
gagaagaucuuucagaauc

SEQ ID NO: 618109 - RNA, 19 nt, Homo sapiens
gggaaacacuugauaaaug

SEQ ID NO: 618110 - RNA, 19 nt, Homo sapiens
gagaggaucuuccacuuga

SEQ ID NO: 618111 - RNA, 19 nt, Homo sapiens
gaaacuguaccguuaaaua

SEQ ID NO: 618112 - RNA, 19 nt, Homo sapiens
gcacccacgucucauguua

SEQ ID NO: 618113 - RNA, 19 nt, Homo sapiens
acacugagaugauccauaa

SEQ ID NO: 618114 - RNA, 19 nt, Homo sapiens
aaaugaaacuguaccguua

SEQ ID NO: 618115 - RNA, 19 nt, Homo sapiens
ggacauuuauacccuauug

SEQ ID NO: 618116 - RNA, 19 nt, Homo sapiens
gagcaugucuuuacagauc

SEQ ID NO: 618117 - RNA, 19 nt, Homo sapiens
gaacugaccugugagaaag

SEQ ID NO: 618118 - RNA, 19 nt, Homo sapiens
gcaaacuggugaauuauag

SEQ ID NO: 618119 - RNA, 19 nt, Homo sapiens
acaaagaucucaguggaua

SEQ ID NO: 618120 - RNA, 19 nt, Homo sapiens
ccaggaaacuagaaaugua

SEQ ID NO: 618121 - RNA, 19 nt, Homo sapiens
ccugcaaacuggugaauua

SEQ ID NO: 618122 - RNA, 19 nt, Homo sapiens
agaaaggagucacuugaua

SEQ ID NO: 618123 - RNA, 19 nt, Homo sapiens
ugacucagaugcauauaaa

SEQ ID NO: 618124 - RNA, 19 nt, Homo sapiens
gcaccaguguuauagguaa

SEQ ID NO: 618125 - RNA, 19 nt, Homo sapiens
gaagcaagccaaacugaaa

SEQ ID NO: 618126 - RNA, 19 nt, Homo sapiens
gcaccgggaugcugugaaa

SEQ ID NO: 618127 - RNA, 19 nt, Homo sapiens
aaacuaugcugaccagauu

SEQ ID NO: 618128 - RNA, 19 nt, Homo sapiens
ggaacuagcuguguuacug

SEQ ID NO: 618129 - RNA, 19 nt, Homo sapiens
gucaaacuaucaccucuua

SEQ ID NO: 618130 - RNA, 19 nt, Homo sapiens
gaagaauuauccagucuag

SEQ ID NO: 618131 - RNA, 19 nt, Homo sapiens
ggaugaaggagcagauuua

SEQ ID NO: 618132 - RNA, 19 nt, Homo sapiens
gcaaacacauugaaguaca

SEQ ID NO: 618133 - RNA, 19 nt, Homo sapiens
caagauggauuaucaggau

SEQ ID NO: 618134 - RNA, 19 nt, Homo sapiens
gaacagagaauuggaggaa

SEQ ID NO: 618135 - RNA, 19 nt, Homo sapiens
gaugagcuuucugauguua

SEQ ID NO: 618136 - RNA, 19 nt, Homo sapiens
ugaaggagcagauuuacua

SEQ ID NO: 618137 - RNA, 19 nt, Homo sapiens
uaucaguacugccaaauga

SEQ ID NO: 618138 - RNA, 19 nt, Homo sapiens
gcaacauccuagacaguuu

SEQ ID NO: 618139 - RNA, 19 nt, Homo sapiens
gagauaagcaaacacauug

SEQ ID NO: 618140 - RNA, 19 nt, Homo sapiens
gcaacaauuccuacugaua

SEQ ID NO: 618141 - RNA, 19 nt, Homo sapiens
aagcagaacugaagaagga

SEQ ID NO: 618142 - RNA, 19 nt, Homo sapiens
gcauagagaacaaagcuuu

SEQ ID NO: 618143 - RNA, 19 nt, Homo sapiens
agaacgcccuauaucauua

SEQ ID NO: 618144 - RNA, 19 nt, Homo sapiens
gcagaaaggagucacuuga

SEQ ID NO: 618145 - RNA, 19 nt, Homo sapiens
ggauaaaccaccagaaaug

SEQ ID NO: 618146 - RNA, 19 nt, Homo sapiens
acaaggauguugcugguuu

SEQ ID NO: 618147 - RNA, 19 nt, Homo sapiens
gaagaaugauuugauagca

SEQ ID NO: 618148 - RNA, 19 nt, Homo sapiens
uuacagaugcgccaaauaa

SEQ ID NO: 618149 - RNA, 19 nt, Homo sapiens
cugagaugauccauaauua

SEQ ID NO: 618150 - RNA, 19 nt, Homo sapiens
gaacugaagaaggaauaua

SEQ ID NO: 618151 - RNA, 19 nt, Homo sapiens
gaaguguaauccguguaua

SEQ ID NO: 618152 - RNA, 19 nt, Homo sapiens
uagcagacuugaagaaaga

SEQ ID NO: 618153 - RNA, 19 nt, Homo sapiens
gagauaaguuucaccacau

SEQ ID NO: 618154 - RNA, 19 nt, Homo sapiens
gaaaggagucacuugauag

SEQ ID NO: 618155 - RNA, 19 nt, Homo sapiens
caaguaacacgacuaagaa

SEQ ID NO: 618156 - RNA, 19 nt, Homo sapiens
uggaugaacugaccuguga

SEQ ID NO: 618157 - RNA, 19 nt, Homo sapiens
caaaauccguucuaccaua

SEQ ID NO: 618158 - RNA, 19 nt, Homo sapiens
gaagggaaucguguuagua

SEQ ID NO: 618159 - RNA, 19 nt, Homo sapiens
gagagaagaagcccagaaa

SEQ ID NO: 618160 - RNA, 19 nt, Homo sapiens
ugaagaaacugaagcuagu

SEQ ID NO: 618161 - RNA, 19 nt, Homo sapiens
gaaaagaagcagcaccuua

SEQ ID NO: 618162 - RNA, 19 nt, Homo sapiens
uacagaaucucucuuugaa

SEQ ID NO: 618163 - RNA, 19 nt, Homo sapiens
caaggcggaucuaaagcua

SEQ ID NO: 618164 - RNA, 19 nt, Homo sapiens
gcucauaguagaauuagaa

SEQ ID NO: 618165 - RNA, 19 nt, Homo sapiens
gcaaugacucagaugcaua

SEQ ID NO: 618166 - RNA, 19 nt, Homo sapiens
caauacagaaucucucuuu

SEQ ID NO: 618167 - RNA, 19 nt, Homo sapiens
ccaaaggcauagagaacaa

SEQ ID NO: 618168 - RNA, 19 nt, Homo sapiens
gaucugagcaauggaaauu

SEQ ID NO: 618169 - RNA, 19 nt, Homo sapiens
gcacacacuuaucaacauc

SEQ ID NO: 618170 - RNA, 19 nt, Homo sapiens
caagcacgcugaggagaaa

SEQ ID NO: 618171 - RNA, 19 nt, Homo sapiens
ggaggaagagcuuaggaaa

SEQ ID NO: 618172 - RNA, 19 nt, Homo sapiens
ggaaguugagaaucuuaua

SEQ ID NO: 618173 - RNA, 19 nt, Homo sapiens
gagcagauuuacuaggaau

SEQ ID NO: 618174 - RNA, 19 nt, Homo sapiens
ggagauggauugcuuacac

SEQ ID NO: 618175 - RNA, 19 nt, Homo sapiens
ggaggacggugugguguau

SEQ ID NO: 618176 - RNA, 19 nt, Homo sapiens
ucaaguaacacgacuaaga

SEQ ID NO: 618177 - RNA, 19 nt, Homo sapiens
ggcagaagcugaagaugca

SEQ ID NO: 618178 - RNA, 19 nt, Homo sapiens
aggaugagcuuucugaugu

SEQ ID NO: 618179 - RNA, 19 nt, Homo sapiens
caauggaaauuucaggaau

SEQ ID NO: 618180 - RNA, 19 nt, Homo sapiens
aagauucgauucucaguau

SEQ ID NO: 618181 - RNA, 19 nt, Homo sapiens
gaauuauccagucuaguuu

SEQ ID NO: 618182 - RNA, 19 nt, Homo sapiens
gaagaaggaauauaaugca

SEQ ID NO: 618183 - RNA, 19 nt, Homo sapiens
caaacuaucaccucuuaga

SEQ ID NO: 618184 - RNA, 19 nt, Homo sapiens
gaguucagaucccagaaga

SEQ ID NO: 618185 - RNA, 19 nt, Homo sapiens
gaaauggcccguguucuca

SEQ ID NO: 618186 - RNA, 19 nt, Homo sapiens
uaggaaagcucgggcagaa

SEQ ID NO: 618187 - RNA, 19 nt, Homo sapiens
guauguccauucaucugua

SEQ ID NO: 618188 - RNA, 19 nt, Homo sapiens
aaacuggcgucuacacaga

SEQ ID NO: 618189 - RNA, 19 nt, Homo sapiens
agacuacccugcaggagaa

SEQ ID NO: 618190 - RNA, 19 nt, Homo sapiens
gagcgaaaccaguauaaag

SEQ ID NO: 618191 - RNA, 19 nt, Homo sapiens
cuacacagagcaugucuuu

SEQ ID NO: 618192 - RNA, 19 nt, Homo sapiens
aggagaagaucuuucagaa

SEQ ID NO: 618193 - RNA, 19 nt, Homo sapiens
ggauguugcugguuuggau

SEQ ID NO: 618194 - RNA, 19 nt, Homo sapiens
cgaaaccaguauaaagaga

SEQ ID NO: 618195 - RNA, 19 nt, Homo sapiens
ugagaaagaugugcugcaa

SEQ ID NO: 618196 - RNA, 19 nt, Homo sapiens
gaagaaaagucagaaguuc

SEQ ID NO: 618197 - RNA, 19 nt, Homo sapiens
ggaagaaaacgaaggauuu

SEQ ID NO: 618198 - RNA, 19 nt, Homo sapiens
caaagaauguuuacuuccu

SEQ ID NO: 618199 - RNA, 19 nt, Homo sapiens
cagaggaacuagcuguguu

SEQ ID NO: 618200 - RNA, 19 nt, Homo sapiens
agauaaguuucaccacaua

SEQ ID NO: 618201 - RNA, 19 nt, Homo sapiens
ugagugagcccaugggaaa

SEQ ID NO: 618202 - RNA, 19 nt, Homo sapiens
gucaucagcccacaaagua

SEQ ID NO: 618203 - RNA, 19 nt, Homo sapiens
aaacugggcuucucuuuug

SEQ ID NO: 618204 - RNA, 19 nt, Homo sapiens
cagagcaugucuuuacaga

SEQ ID NO: 618205 - RNA, 19 nt, Homo sapiens
gcacucauucggcuacaaa

SEQ ID NO: 618206 - RNA, 19 nt, Homo sapiens
agaauuauccagucuaguu

SEQ ID NO: 618207 - RNA, 19 nt, Homo sapiens
aaacguagaugucaaauug

SEQ ID NO: 618208 - RNA, 19 nt, Homo sapiens
gagaagaucuuucagaauc

SEQ ID NO: 618209 - RNA, 19 nt, Homo sapiens
gaagaaagcagcaccuuau

SEQ ID NO: 618210 - RNA, 19 nt, Homo sapiens
gagcaugucuuuacagauc

SEQ ID NO: 618211 - RNA, 19 nt, Homo sapiens
acaaagaucucaguggaua

SEQ ID NO: 618212 - RNA, 19 nt, Homo sapiens
ccaggaaacuagaaaugua

SEQ ID NO: 618213 - RNA, 19 nt, Homo sapiens
gauccucacuacaaagaua

SEQ ID NO: 618214 - RNA, 19 nt, Homo sapiens
ugacucagaugcauauaaa

SEQ ID NO: 618215 - RNA, 19 nt, Homo sapiens
guauaaaccuaugggauaa

SEQ ID NO: 618216 - RNA, 19 nt, Homo sapiens
gucaaacuaucaccucuua

SEQ ID NO: 618217 - RNA, 19 nt, Homo sapiens
gaagaauuauccagucuag

SEQ ID NO: 618218 - RNA, 19 nt, Homo sapiens
gcaaacacauugaaguaca

SEQ ID NO: 618219 - RNA, 19 nt, Homo sapiens
uguagccacucauguauua

SEQ ID NO: 618220 - RNA, 19 nt, Homo sapiens
gaugagcuuucugauguua

SEQ ID NO: 618221 - RNA, 19 nt, Homo sapiens
uaucaguacugccaaauga

SEQ ID NO: 618222 - RNA, 19 nt, Homo sapiens
gcaacauccuagacaguuu

SEQ ID NO: 618223 - RNA, 19 nt, Homo sapiens
gagauaagcaaacacauug

SEQ ID NO: 618224 - RNA, 19 nt, Homo sapiens
gcaacaauuccuacugaua

SEQ ID NO: 618225 - RNA, 19 nt, Homo sapiens
gcauagagaacaaagcuuu

SEQ ID NO: 618226 - RNA, 19 nt, Homo sapiens
agaacgcccuauaucauua

SEQ ID NO: 618227 - RNA, 19 nt, Homo sapiens
uaggcuagauugugaagua

SEQ ID NO: 618228 - RNA, 19 nt, Homo sapiens
ggauaaaccaccagaaaug

SEQ ID NO: 618229 - RNA, 19 nt, Homo sapiens
acaaggauguugcugguuu

SEQ ID NO: 618230 - RNA, 19 nt, Homo sapiens
uuacagaugcgccaaauaa

SEQ ID NO: 618231 - RNA, 19 nt, Homo sapiens
ugacagauccucacuacaa

SEQ ID NO: 618232 - RNA, 19 nt, Homo sapiens
gacagauccucacuacaaa

SEQ ID NO: 618233 - RNA, 19 nt, Homo sapiens
cgauuaggcuagauuguga

SEQ ID NO: 618234 - RNA, 19 nt, Homo sapiens
aaaccacgaugcugcaauu

SEQ ID NO: 618235 - RNA, 19 nt, Homo sapiens
gaagggaaucguguuagua

SEQ ID NO: 618236 - RNA, 19 nt, Homo sapiens
gagagaagaagcccagaaa

SEQ ID NO: 618237 - RNA, 19 nt, Homo sapiens
ugaagaaacugaagcuagu

SEQ ID NO: 618238 - RNA, 19 nt, Homo sapiens
uacagaaucucucuuugaa

SEQ ID NO: 618239 - RNA, 19 nt, Homo sapiens
caaggcggaucuaaagcua

SEQ ID NO: 618240 - RNA, 19 nt, Homo sapiens
ggacuauuauacaaagaug

SEQ ID NO: 618241 - RNA, 19 nt, Homo sapiens
gcaaugacucagaugcaua

SEQ ID NO: 618242 - RNA, 19 nt, Homo sapiens
caauacagaaucucucuuu

SEQ ID NO: 618243 - RNA, 19 nt, Homo sapiens
ccaaaggcauagagaacaa

SEQ ID NO: 618244 - RNA, 19 nt, Homo sapiens
gaucugagcaauggaaauu

SEQ ID NO: 618245 - RNA, 19 nt, Homo sapiens
ggagauggauugcuuacac

SEQ ID NO: 618246 - RNA, 19 nt, Homo sapiens
aggaugagcuuucugaugu

SEQ ID NO: 618247 - RNA, 19 nt, Homo sapiens
caauggaaauuucaggaau

SEQ ID NO: 618248 - RNA, 19 nt, Homo sapiens
ggaggcauuuggauccauu

SEQ ID NO: 618249 - RNA, 19 nt, Homo sapiens
aagauucgauucucaguau

SEQ ID NO: 618250 - RNA, 19 nt, Homo sapiens
gaauuauccagucuaguuu

SEQ ID NO: 618251 - RNA, 19 nt, Homo sapiens
caaacuaucaccucuuaga

SEQ ID NO: 618252 - RNA, 19 nt, Homo sapiens
agcagcagcucuaugguua

SEQ ID NO: 618253 - RNA, 19 nt, Homo sapiens
gaguucagaucccagaaga

SEQ ID NO: 618254 - RNA, 19 nt, Homo sapiens
gggcgguggucauuaauuc

SEQ ID NO: 618255 - RNA, 19 nt, Homo sapiens
guauguccauucaucugua

SEQ ID NO: 618256 - RNA, 19 nt, Homo sapiens
aaacuggcgucuacacaga

SEQ ID NO: 618257 - RNA, 19 nt, Homo sapiens
agacuacccugcaggagaa

SEQ ID NO: 618258 - RNA, 19 nt, Homo sapiens
guggaaagcugcugcugau

SEQ ID NO: 618259 - RNA, 19 nt, Homo sapiens
gaugucaaauugucuaaac

SEQ ID NO: 618260 - RNA, 19 nt, Homo sapiens
aggcaaagcuaaauguaau

SEQ ID NO: 618261 - RNA, 19 nt, Homo sapiens
cuacacagagcaugucuuu

SEQ ID NO: 618262 - RNA, 19 nt, Homo sapiens
aggagaagaucuuucagaa

SEQ ID NO: 618263 - RNA, 19 nt, Homo sapiens
ggauguugcugguuuggau

SEQ ID NO: 618264 - RNA, 19 nt, Homo sapiens
ugaagaaagcagcaccuua

SEQ ID NO: 618265 - RNA, 19 nt, Homo sapiens
gaagaaaagucagaaguuc

SEQ ID NO: 618266 - RNA, 19 nt, Homo sapiens
ggaagaaaacgaaggauuu

SEQ ID NO: 618267 - RNA, 19 nt, Homo sapiens
cagagcaugucuuuacaga

SEQ ID NO: 618268 - RNA, 19 nt, Homo sapiens
gcacucauucggcuacaaa

SEQ ID NO: 618269 - RNA, 19 nt, Homo sapiens
agaauuauccagucuaguu

SEQ ID NO: 618270 - RNA, 19 nt, Homo sapiens
acaaacagguaaccaaugg

SEQ ID NO: 618271 - RNA, 19 nt, Homo sapiens
gaaagcagcaccuuaucuc

SEQ ID NO: 618272 - RNA, 19 nt, Homo sapiens
gauaagcaaacacauugaa

SEQ ID NO: 618273 - RNA, 19 nt, Homo sapiens
uggcaacaauuccuacuga

SEQ ID NO: 618274 - RNA, 19 nt, Homo sapiens
gcaauggaaauuucaggaa

SEQ ID NO: 618275 - RNA, 19 nt, Homo sapiens
gaaagcaaacguagauguc

SEQ ID NO: 618276 - RNA, 19 nt, Homo sapiens
uaccaaggauacucagaaa

SEQ ID NO: 618277 - RNA, 19 nt, Homo sapiens
aaagaaagcaaacguagau

SEQ ID NO: 618278 - RNA, 19 nt, Homo sapiens
gaagaagcccagaaaauga

SEQ ID NO: 618279 - RNA, 19 nt, Homo sapiens
ggaaguaugacaagcaaca

SEQ ID NO: 618280 - RNA, 19 nt, Homo sapiens
aagcaaacacauugaagua

SEQ ID NO: 618281 - RNA, 19 nt, Homo sapiens
cuacugauacucccuuaaa

SEQ ID NO: 618282 - RNA, 19 nt, Homo sapiens
caacaauuccuacugauac

SEQ ID NO: 618283 - RNA, 19 nt, Homo sapiens
gaauuaagucaaccacguu

SEQ ID NO: 618284 - RNA, 19 nt, Homo sapiens
aguauaaaccuaugggaua

SEQ ID NO: 618285 - RNA, 19 nt, Homo sapiens
ucacugauuuucuugcuua

SEQ ID NO: 618286 - RNA, 19 nt, Homo sapiens
gaugcaugcugcuguuugu

SEQ ID NO: 618287 - RNA, 19 nt, Homo sapiens
cagaguaguuuagauaagu

SEQ ID NO: 618288 - RNA, 19 nt, Homo sapiens
ucucagaguaguuuagaua

SEQ ID NO: 618289 - RNA, 19 nt, Homo sapiens
guacaaacagguaaccaau

SEQ ID NO: 618290 - RNA, 19 nt, Homo sapiens
gaaggauuugugaagguua

SEQ ID NO: 618291 - RNA, 19 nt, Homo sapiens
caacagcuaauucagaugu

SEQ ID NO: 618292 - RNA, 19 nt, Homo sapiens
cuuaguaucucucucuguu

SEQ ID NO: 618293 - RNA, 19 nt, Homo sapiens
ccaaucaucagaaggacua

SEQ ID NO: 618294 - RNA, 19 nt, Homo sapiens
gauggugguucuguuguug

SEQ ID NO: 618295 - RNA, 19 nt, Homo sapiens
cgaaggauuugugaagguu

SEQ ID NO: 618296 - RNA, 19 nt, Homo sapiens
ggaugagcuuucugauguu

SEQ ID NO: 618297 - RNA, 19 nt, Homo sapiens
gaaaagaacgcccuauauc

SEQ ID NO: 618298 - RNA, 19 nt, Homo sapiens
acacagagcaugucuuuac

SEQ ID NO: 618299 - RNA, 19 nt, Homo sapiens
ggagaagaucuuucagaau

SEQ ID NO: 618300 - RNA, 19 nt, Homo sapiens
gaacagcagaaggaguuaa

SEQ ID NO: 618301 - RNA, 19 nt, Homo sapiens
ggauacagaaggcaguaaa

SEQ ID NO: 618302 - RNA, 19 nt, Homo sapiens
aagcacauguucagaagga

SEQ ID NO: 618303 - RNA, 19 nt, Homo sapiens
aaagaucucaguggauaua

SEQ ID NO: 618304 - RNA, 19 nt, Homo sapiens
gcagaaccuaccaaggaua

SEQ ID NO: 618305 - RNA, 19 nt, Homo sapiens
gaagaagcaacugaagcua

SEQ ID NO: 618306 - RNA, 19 nt, Homo sapiens
caacagcucagcagagaca

SEQ ID NO: 618307 - RNA, 19 nt, Homo sapiens
gaacaggccuccuaucuuu

SEQ ID NO: 618308 - RNA, 19 nt, Homo sapiens
gagauuagauggcagcaua

SEQ ID NO: 618309 - RNA, 19 nt, Homo sapiens
ggauggaacuguugaguaa

SEQ ID NO: 618310 - RNA, 19 nt, Homo sapiens
ggaauacaaucgacauaaa

SEQ ID NO: 618311 - RNA, 19 nt, Homo sapiens
gaacaaagcuaaaagaaug

SEQ ID NO: 618312 - RNA, 19 nt, Homo sapiens
gcacagagguauaauuaca

SEQ ID NO: 618313 - RNA, 19 nt, Homo sapiens
gagcaugacuggaauccua

SEQ ID NO: 618314 - RNA, 19 nt, Homo sapiens
gcacuuuguugcuguauuu

SEQ ID NO: 618315 - RNA, 19 nt, Homo sapiens
gcacauggcugcucguugu

SEQ ID NO: 618316 - RNA, 19 nt, Homo sapiens
ggacuuagggaaauucuua

SEQ ID NO: 618317 - RNA, 19 nt, Homo sapiens
ccagacagcucuuccuuaa

SEQ ID NO: 618318 - RNA, 19 nt, Homo sapiens
aaacaugucagcagaauua

SEQ ID NO: 618319 - RNA, 19 nt, Homo sapiens
gaagaaacuuggccuuaau

SEQ ID NO: 618320 - RNA, 19 nt, Homo sapiens
gaacaccaauccagaacaa

SEQ ID NO: 618321 - RNA, 19 nt, Homo sapiens
gaugcagccuucucauuua

SEQ ID NO: 618322 - RNA, 19 nt, Homo sapiens
caagaacaaugggaaguua

SEQ ID NO: 618323 - RNA, 19 nt, Homo sapiens
agacagcucuuccuuaauu

SEQ ID NO: 618324 - RNA, 19 nt, Homo sapiens
cacaucaucuuucgauuua

SEQ ID NO: 618325 - RNA, 19 nt, Homo sapiens
guaaauagaucuggagaau

SEQ ID NO: 618326 - RNA, 19 nt, Homo sapiens
gugaagaacuuugcaauga

SEQ ID NO: 618327 - RNA, 19 nt, Homo sapiens
gacaggcgcugacacagua

SEQ ID NO: 618328 - RNA, 19 nt, Homo sapiens
ggaaugagcaauagacaaa

SEQ ID NO: 618329 - RNA, 19 nt, Homo sapiens
ggaaacaaguuauucucaa

SEQ ID NO: 618330 - RNA, 19 nt, Homo sapiens
gaccagaacucuucaucuu

SEQ ID NO: 618331 - RNA, 19 nt, Homo sapiens
uaacguauaccgauugaua

SEQ ID NO: 618332 - RNA, 19 nt, Homo sapiens
gugcaaccauccagcauua

SEQ ID NO: 618333 - RNA, 19 nt, Homo sapiens
ggaaugacauagauuucuu

SEQ ID NO: 618334 - RNA, 19 nt, Homo sapiens
ugaaugggcugcuuuacaa

SEQ ID NO: 618335 - RNA, 19 nt, Homo sapiens
gaauuugcuuugacaacua

SEQ ID NO: 618336 - RNA, 19 nt, Homo sapiens
agacagauuuggagacuuu

SEQ ID NO: 618337 - RNA, 19 nt, Homo sapiens
cuacagagcgauugaauuu

SEQ ID NO: 618338 - RNA, 19 nt, Homo sapiens
gggaugcucuucuggaauu

SEQ ID NO: 618339 - RNA, 19 nt, Homo sapiens
gaaagcaaguaugaaauca

SEQ ID NO: 618340 - RNA, 19 nt, Homo sapiens
caaaauagcuaccauggaa

SEQ ID NO: 618341 - RNA, 19 nt, Homo sapiens
gauaugcuccgacacauuu

SEQ ID NO: 618342 - RNA, 19 nt, Homo sapiens
caucuuggcuuauaccuau

SEQ ID NO: 618343 - RNA, 19 nt, Homo sapiens
caugaguacuuuaguguuu

SEQ ID NO: 618344 - RNA, 19 nt, Homo sapiens
gagcuguggucauuauuug

SEQ ID NO: 618345 - RNA, 19 nt, Homo sapiens
gggaugcaguggaaacuaa

SEQ ID NO: 618346 - RNA, 19 nt, Homo sapiens
ggaaguaguggaaauauuc

SEQ ID NO: 618347 - RNA, 19 nt, Homo sapiens
gugcauagcuaaacuccuu

SEQ ID NO: 618348 - RNA, 19 nt, Homo sapiens
gaaaaguggugguaaaaug

SEQ ID NO: 618349 - RNA, 19 nt, Homo sapiens
ccaaagucuugauugauaa

SEQ ID NO: 618350 - RNA, 19 nt, Homo sapiens
uccaaagucuugauugaua

SEQ ID NO: 618351 - RNA, 19 nt, Homo sapiens
gaaaagagacggaaaauag

SEQ ID NO: 618352 - RNA, 19 nt, Homo sapiens
ggacugaucagcuucuuga

SEQ ID NO: 618353 - RNA, 19 nt, Homo sapiens
gagaggagcugaauuugcu

SEQ ID NO: 618354 - RNA, 19 nt, Homo sapiens
gaaugcagaaugaauguaa

SEQ ID NO: 618355 - RNA, 19 nt, Homo sapiens
uuacuacucuuccauuuga

SEQ ID NO: 618356 - RNA, 19 nt, Homo sapiens
ugugguaacucaagaaauu

SEQ ID NO: 618357 - RNA, 19 nt, Homo sapiens
uggagaauauucagcauaa

SEQ ID NO: 618358 - RNA, 19 nt, Homo sapiens
ucacacgaaugcagaauga

SEQ ID NO: 618359 - RNA, 19 nt, Homo sapiens
gaaauugccguuccauuca

SEQ ID NO: 618360 - RNA, 19 nt, Homo sapiens
ucuaacagcuucaacaaau

SEQ ID NO: 618361 - RNA, 19 nt, Homo sapiens
gaaacaggaguucauaaga

SEQ ID NO: 618362 - RNA, 19 nt, Homo sapiens
gcacuggacuuagggaaau

SEQ ID NO: 618363 - RNA, 19 nt, Homo sapiens
gcaaaugauuccaaagucu

SEQ ID NO: 618364 - RNA, 19 nt, Homo sapiens
caacugacugcuaauuaua

SEQ ID NO: 618365 - RNA, 19 nt, Homo sapiens
uaaaacaacugacugcuaa

SEQ ID NO: 618366 - RNA, 19 nt, Homo sapiens
cauaugauguugugaggaa

SEQ ID NO: 618367 - RNA, 19 nt, Homo sapiens
ggaugaaguagguaaauuu

SEQ ID NO: 618368 - RNA, 19 nt, Homo sapiens
gcagugaaguugccacauc

SEQ ID NO: 618369 - RNA, 19 nt, Homo sapiens
gaugaggauuuggauuaua

SEQ ID NO: 618370 - RNA, 19 nt, Homo sapiens
agaagaaacuuggccuuaa

SEQ ID NO: 618371 - RNA, 19 nt, Homo sapiens
ccaagagaauucuaguuug

SEQ ID NO: 618372 - RNA, 19 nt, Homo sapiens
gcucucagcuuugaaacaa

SEQ ID NO: 618373 - RNA, 19 nt, Homo sapiens
gcacuugccuguguaaugg

SEQ ID NO: 618374 - RNA, 19 nt, Homo sapiens
guggaaauauucuuguuga

SEQ ID NO: 618375 - RNA, 19 nt, Homo sapiens
aagcacagagguauaauua

SEQ ID NO: 618376 - RNA, 19 nt, Homo sapiens
gaacuccaagucugcuuua

SEQ ID NO: 618377 - RNA, 19 nt, Homo sapiens
gaaagcagccaggaaauuc

SEQ ID NO: 618378 - RNA, 19 nt, Homo sapiens
gccaagagaauucuaguuu

SEQ ID NO: 618379 - RNA, 19 nt, Homo sapiens
cagcuacacuuucugaaga

SEQ ID NO: 618380 - RNA, 19 nt, Homo sapiens
gaaauuaaaccagcugaau

SEQ ID NO: 618381 - RNA, 19 nt, Homo sapiens
ugacagcacuuuagaagag

SEQ ID NO: 618382 - RNA, 19 nt, Homo sapiens
gauauucugucagcugaaa

SEQ ID NO: 618383 - RNA, 19 nt, Homo sapiens
gcauuacaguacuuacgua

SEQ ID NO: 618384 - RNA, 19 nt, Homo sapiens
ccaggaauaugcaagauca

SEQ ID NO: 618385 - RNA, 19 nt, Homo sapiens
ggacugcgguuugggaaau

SEQ ID NO: 618386 - RNA, 19 nt, Homo sapiens
caagugugauguugaugaa

SEQ ID NO: 618387 - RNA, 19 nt, Homo sapiens
ugagaagaaugaaagaaga

SEQ ID NO: 618388 - RNA, 19 nt, Homo sapiens
ccaguuugcugcucgauau

SEQ ID NO: 618389 - RNA, 19 nt, Homo sapiens
ugaaggccaugucaucaaa

SEQ ID NO: 618390 - RNA, 19 nt, Homo sapiens
gcaaguaugaaaucaauuc

SEQ ID NO: 618391 - RNA, 19 nt, Homo sapiens
ccggagaaauuaaauccua

SEQ ID NO: 618392 - RNA, 19 nt, Homo sapiens
ggaaagcagccaggaaauu

SEQ ID NO: 618393 - RNA, 19 nt, Homo sapiens
cuaacagcuucaacaaaua

SEQ ID NO: 618394 - RNA, 19 nt, Homo sapiens
ucuuaaagcucaugggaaa

SEQ ID NO: 618395 - RNA, 19 nt, Homo sapiens
gagcaggaaugagcaauag

SEQ ID NO: 618396 - RNA, 19 nt, Homo sapiens
ggaaagcaaguaugaaauc

SEQ ID NO: 618397 - RNA, 19 nt, Homo sapiens
cagcuucaauggauucuga

SEQ ID NO: 618398 - RNA, 19 nt, Homo sapiens
gcaggaaguaguggaaaua

SEQ ID NO: 618399 - RNA, 19 nt, Homo sapiens
cuaaauacagguaauggua

SEQ ID NO: 618400 - RNA, 19 nt, Homo sapiens
gagaauauucagcauaaug

SEQ ID NO: 618401 - RNA, 19 nt, Homo sapiens
caaguacuaccguuucuuu

SEQ ID NO: 618402 - RNA, 19 nt, Homo sapiens
uuggaagacuugguuauua

SEQ ID NO: 618403 - RNA, 19 nt, Homo sapiens
caggugaaguggauccuaa

SEQ ID NO: 618404 - RNA, 19 nt, Homo sapiens
uugcagaaauucaagauga

SEQ ID NO: 618405 - RNA, 19 nt, Homo sapiens
ggucagaggcauuccauug

SEQ ID NO: 618406 - RNA, 19 nt, Homo sapiens
acaacugacugcuaauuau

SEQ ID NO: 618407 - RNA, 19 nt, Homo sapiens
gcaugcagcucacugauuu

SEQ ID NO: 618408 - RNA, 19 nt, Homo sapiens
gaacagggcuuuggucgau

SEQ ID NO: 618409 - RNA, 19 nt, Homo sapiens
gaagguuccugcccagaaa

SEQ ID NO: 618410 - RNA, 19 nt, Homo sapiens
aaaggcagcucuccugaaa

SEQ ID NO: 618411 - RNA, 19 nt, Homo sapiens
ggaggcagauugauaguag

SEQ ID NO: 618412 - RNA, 19 nt, Homo sapiens
ccugaaagcuucucccaaa

SEQ ID NO: 618413 - RNA, 19 nt, Homo sapiens
ggaacagaauaaucaagaa

SEQ ID NO: 618414 - RNA, 19 nt, Homo sapiens
gcagauugauaguaggauu

SEQ ID NO: 618415 - RNA, 19 nt, Homo sapiens
gcagaaggcagacaucaau

SEQ ID NO: 618416 - RNA, 19 nt, Homo sapiens
gcagcucacugauuucauc

SEQ ID NO: 618417 - RNA, 19 nt, Homo sapiens
gaaagccacaggccagaaa

SEQ ID NO: 618418 - RNA, 19 nt, Homo sapiens
aggcagacaucaauacaaa

SEQ ID NO: 618419 - RNA, 19 nt, Homo sapiens
gaaaauuggucgcgauugu

SEQ ID NO: 618420 - RNA, 19 nt, Homo sapiens
guuaggaggcagauugaua

SEQ ID NO: 618421 - RNA, 19 nt, Homo sapiens
gaagauugaagccagagaa

SEQ ID NO: 618422 - RNA, 19 nt, Homo sapiens
gaaugaaguuaagaagcuu

SEQ ID NO: 618423 - RNA, 19 nt, Homo sapiens
gaaaaugaggaacagaaua

SEQ ID NO: 618424 - RNA, 19 nt, Homo sapiens
gaaggcagacaucaauaca

SEQ ID NO: 618425 - RNA, 19 nt, Homo sapiens
ugacagauuuugaucguuu

SEQ ID NO: 618426 - RNA, 19 nt, Homo sapiens
agaaugaaguuaagaagcu

SEQ ID NO: 618427 - RNA, 19 nt, Homo sapiens
ucacugauuucauccucaa

SEQ ID NO: 618428 - RNA, 19 nt, Homo sapiens
cgauggaccuugcacucaa

SEQ ID NO: 618429 - RNA, 19 nt, Homo sapiens
cagauugauaguaggauua

SEQ ID NO: 618430 - RNA, 19 nt, Homo sapiens
guauuuaagccuuuggauu

SEQ ID NO: 618431 - RNA, 19 nt, Homo sapiens
gguggccuaugucuccuuu

SEQ ID NO: 618432 - RNA, 19 nt, Homo sapiens
cagaaggcagacaucaaua

SEQ ID NO: 618433 - RNA, 19 nt, Homo sapiens
gaucagaacagggcuuugg

SEQ ID NO: 618434 - RNA, 19 nt, Homo sapiens
gauuucauccucaaguuuc

SEQ ID NO: 618435 - RNA, 19 nt, Homo sapiens
agaguuaggaggcagauug

SEQ ID NO: 618436 - RNA, 19 nt, Homo sapiens
ggucgcgauuguagauguu

SEQ ID NO: 618437 - RNA, 19 nt, Homo sapiens
gaguuaggaggcagauuga

SEQ ID NO: 618438 - RNA, 19 nt, Homo sapiens
caagaaugaaguuaagaag

SEQ ID NO: 618439 - RNA, 19 nt, Homo sapiens
gaugggccaagaagauuga

SEQ ID NO: 618440 - RNA, 19 nt, Homo sapiens
acagugcccaccagaagua

SEQ ID NO: 618441 - RNA, 19 nt, Homo sapiens
gcaaagaaaaugaggaaca

SEQ ID NO: 618442 - RNA, 19 nt, Homo sapiens
ccuguugaggcuagaguua

SEQ ID NO: 618443 - RNA, 19 nt, Homo sapiens
cugauuucauccucaaguu

SEQ ID NO: 618444 - RNA, 19 nt, Homo sapiens
cuucuuccuucucgccuaa

SEQ ID NO: 618445 - RNA, 19 nt, Homo sapiens
gcagacaucaauacaaaau

SEQ ID NO: 618446 - RNA, 19 nt, Homo sapiens
ugauuucauccucaaguuu

SEQ ID NO: 618447 - RNA, 19 nt, Homo sapiens
aggaacagaauaaucaaga

SEQ ID NO: 618448 - RNA, 19 nt, Homo sapiens
ggcagaaggcagacaucaa

SEQ ID NO: 618449 - RNA, 19 nt, Homo sapiens
uuaggaggcagauugauag

SEQ ID NO: 618450 - RNA, 19 nt, Homo sapiens
ggauuuaaagccuguugag

SEQ ID NO: 618451 - RNA, 19 nt, Homo sapiens
gaugacagauuuugaucgu

SEQ ID NO: 618452 - RNA, 19 nt, Homo sapiens
agaagguuccugcccagaa

SEQ ID NO: 618453 - RNA, 19 nt, Homo sapiens
aggcagcucuccugaaagc

SEQ ID NO: 618454 - RNA, 19 nt, Homo sapiens
augaggaacagaauaauca

SEQ ID NO: 618455 - RNA, 19 nt, Homo sapiens
gcgauuguagauguuauug

SEQ ID NO: 618456 - RNA, 19 nt, Homo sapiens
gaccuguugacaaauguau

SEQ ID NO: 618457 - RNA, 19 nt, Homo sapiens
gccacacgaugggccaaga

SEQ ID NO: 618458 - RNA, 19 nt, Homo sapiens
gaacugaguaugacaaugu

SEQ ID NO: 618459 - RNA, 19 nt, Homo sapiens
ggacaccagugccuucuuc

SEQ ID NO: 618460 - RNA, 19 nt, Homo sapiens
aaagaaaggcccaaaguga

SEQ ID NO: 618461 - RNA, 19 nt, Homo sapiens
gcagacguuuggaaagaaa

SEQ ID NO: 618462 - RNA, 19 nt, Homo sapiens
gcaaggcaaugagaucuuc

SEQ ID NO: 618463 - RNA, 19 nt, Homo sapiens
cagcagacguuuggaaaga

SEQ ID NO: 618464 - RNA, 19 nt, Homo sapiens
cgacuggcccuacagguuu

SEQ ID NO: 618465 - RNA, 19 nt, Homo sapiens
uaaagaaaggcccaaagug

SEQ ID NO: 618466 - RNA, 19 nt, Homo sapiens
ggaacugaguaugacaaug

SEQ ID NO: 618467 - RNA, 19 nt, Homo sapiens
ggagagggcaacuuugagu

SEQ ID NO: 618468 - RNA, 19 nt, Homo sapiens
ggaggaaaaugaauuguac

SEQ ID NO: 618469 - RNA, 19 nt, Homo sapiens
gaccugaccacauauacga

SEQ ID NO: 618470 - RNA, 19 nt, Homo sapiens
cuaaagaaaggcccaaagu

SEQ ID NO: 618471 - RNA, 19 nt, Homo sapiens
guacagcagcgcagucaca

SEQ ID NO: 618472 - RNA, 19 nt, Homo sapiens
cccucgaccugaccacaua

SEQ ID NO: 618473 - RNA, 19 nt, Homo sapiens
gaccaugagaccuacagaa

SEQ ID NO: 618474 - RNA, 19 nt, Homo sapiens
uggcugcccugucccucua

SEQ ID NO: 618475 - RNA, 19 nt, Homo sapiens
ccaaagaacgccuguaccu

SEQ ID NO: 618476 - RNA, 19 nt, Homo sapiens
cugaccacauauacgauaa

SEQ ID NO: 618477 - RNA, 19 nt, Homo sapiens
gaaggucauccgccucagu

SEQ ID NO: 618478 - RNA, 19 nt, Homo sapiens
gaacuucaggggcaucuug

SEQ ID NO: 618479 - RNA, 19 nt, Homo sapiens
ccugaccacauauacgaua

SEQ ID NO: 618480 - RNA, 19 nt, Homo sapiens
gcagccaggaacugaguau

SEQ ID NO: 618481 - RNA, 19 nt, Homo sapiens
gcagcagacguuuggaaag

SEQ ID NO: 618482 - RNA, 19 nt, Homo sapiens
cagcagcagacguuuggaa

SEQ ID NO: 618483 - RNA, 19 nt, Homo sapiens
gccaggaacugaguaugac

SEQ ID NO: 618484 - RNA, 19 nt, Homo sapiens
gaucuucuuggcccuggaa

SEQ ID NO: 618485 - RNA, 19 nt, Homo sapiens
cuggagagggcaacuuuga

SEQ ID NO: 618486 - RNA, 19 nt, Homo sapiens
gaccacauauacgauaagc

SEQ ID NO: 618487 - RNA, 19 nt, Homo sapiens
gacuggcccuacagguuuc

SEQ ID NO: 618488 - RNA, 19 nt, Homo sapiens
gcaaagaagugugcaagga

SEQ ID NO: 618489 - RNA, 19 nt, Homo sapiens
gcuaauaaaucaucaccaa

SEQ ID NO: 618490 - RNA, 19 nt, Homo sapiens
gaacuuguuuguugauucu

SEQ ID NO: 618491 - RNA, 19 nt, Homo sapiens
cuaagaagaucccaagaau

SEQ ID NO: 618492 - RNA, 19 nt, Homo sapiens
ccaauccuaucuacaauga

SEQ ID NO: 618493 - RNA, 19 nt, Homo sapiens
ggaggugccuggagaagga

SEQ ID NO: 618494 - RNA, 19 nt, Homo sapiens
gcucccagcugcauucuga

SEQ ID NO: 618495 - RNA, 19 nt, Homo sapiens
gaucuaagacagcaaagaa

SEQ ID NO: 618496 - RNA, 19 nt, Homo sapiens
gcucugggaucccuuguga

SEQ ID NO: 618497 - RNA, 19 nt, Homo sapiens
gaccgaagaaucaaacuuu

SEQ ID NO: 618498 - RNA, 19 nt, Homo sapiens
uguuagaacuuguuuguug

SEQ ID NO: 618499 - RNA, 19 nt, Homo sapiens
auucuugucuggcuaauaa

SEQ ID NO: 618500 - RNA, 19 nt, Homo sapiens
guuagaacuuguuuguuga

SEQ ID NO: 618501 - RNA, 19 nt, Homo sapiens
caaugcugcuguugucuga

SEQ ID NO: 618502 - RNA, 19 nt, Homo sapiens
guacagcccaaucaucaaa

SEQ ID NO: 618503 - RNA, 19 nt, Homo sapiens
ugaccuucgugcugacuua

SEQ ID NO: 618504 - RNA, 19 nt, Homo sapiens
gauguuagaacuuguuugu

SEQ ID NO: 618505 - RNA, 19 nt, Homo sapiens
gaagaucccaagaauccaa

SEQ ID NO: 618506 - RNA, 19 nt, Homo sapiens
ucugagaacucugugauug

SEQ ID NO: 618507 - RNA, 19 nt, Homo sapiens
ggaaugguuuggugagaac

SEQ ID NO: 618508 - RNA, 19 nt, Homo sapiens
gaggaaugguuuggugaga

SEQ ID NO: 618509 - RNA, 19 nt, Homo sapiens
cccaagcccuccaauccua

SEQ ID NO: 618510 - RNA, 19 nt, Homo sapiens
gcaaggagggcccuguuag

SEQ ID NO: 618511 - RNA, 19 nt, Homo sapiens
ccaacugccuucuccuaca

SEQ ID NO: 618512 - RNA, 19 nt, Homo sapiens
cugaugaacccauagcuuu

SEQ ID NO: 618513 - RNA, 19 nt, Homo sapiens
ccuaagaagaucccaagaa

SEQ ID NO: 618514 - RNA, 19 nt, Homo sapiens
ccagaagucuacacaaucc

SEQ ID NO: 618515 - RNA, 19 nt, Homo sapiens
gcuguugucugaggaaugg

SEQ ID NO: 618516 - RNA, 19 nt, Homo sapiens
caguacagcccaaucauca

SEQ ID NO: 618517 - RNA, 19 nt, Homo sapiens
caacugccuucuccuacag

SEQ ID NO: 618518 - RNA, 19 nt, Homo sapiens
ggaccgaagaaucaaacuu

SEQ ID NO: 618519 - RNA, 19 nt, Homo sapiens
cccacaaucuuucuagaca

SEQ ID NO: 618520 - RNA, 19 nt, Homo sapiens
ccuccaauccuaucuacaa

SEQ ID NO: 618521 - RNA, 19 nt, Homo sapiens
ccugaggaccgaagaauca

SEQ ID NO: 618522 - RNA, 19 nt, Homo sapiens
aauaaaucaucaccaacug

SEQ ID NO: 618523 - RNA, 19 nt, Homo sapiens
guccaaugcugcuguuguc

SEQ ID NO: 618524 - RNA, 19 nt, Homo sapiens
gcucaguccuuggugaucu

SEQ ID NO: 618525 - RNA, 19 nt, Homo sapiens
ggaggucagagaagcaaau

SEQ ID NO: 618526 - RNA, 19 nt, Homo sapiens
agaacuuguuuguugauuc

SEQ ID NO: 618527 - RNA, 19 nt, Homo sapiens
gcaccuuccagaucacaga

SEQ ID NO: 618528 - RNA, 19 nt, Homo sapiens
gcaaaagccaggacccaaa

SEQ ID NO: 618529 - RNA, 19 nt, Homo sapiens
aggcugcccucauggaguu

SEQ ID NO: 618530 - RNA, 19 nt, Homo sapiens
gggcuugguuccagaagac

SEQ ID NO: 618531 - RNA, 19 nt, Homo sapiens
ggugaucuaagacagcaaa

SEQ ID NO: 618532 - RNA, 19 nt, Homo sapiens
ugagccugaugaacccaua

SEQ ID NO: 618533 - RNA, 19 nt, Homo sapiens
gggcuacacugcggcaucu

SEQ ID NO: 618534 - RNA, 19 nt, Homo sapiens
uaagacagcaaagaagugu

SEQ ID NO: 618535 - RNA, 19 nt, Homo sapiens
uaagaagaucccaagaauc

SEQ ID NO: 618536 - RNA, 19 nt, Homo sapiens
ccuggagucuaauuuccuu

SEQ ID NO: 618537 - RNA, 19 nt, Homo sapiens
aagaagaucccaagaaucc

SEQ ID NO: 618538 - RNA, 19 nt, Homo sapiens
caccaacugccuucuccua

SEQ ID NO: 618539 - RNA, 19 nt, Homo sapiens
cuacaaugagccugaugaa

SEQ ID NO: 618540 - RNA, 19 nt, Homo sapiens
ucugggcccugguccaaug

SEQ ID NO: 618541 - RNA, 19 nt, Homo sapiens
caccuuuccggaacacaua

SEQ ID NO: 618542 - RNA, 19 nt, Homo sapiens
augaugaguugcugagugu

SEQ ID NO: 618543 - RNA, 19 nt, Homo sapiens
aggaaugguuuggugagaa

SEQ ID NO: 618544 - RNA, 19 nt, Homo sapiens
aguccuuggugaucuaaga

SEQ ID NO: 618545 - RNA, 19 nt, Homo sapiens
gguccaaugcugcuguugu

SEQ ID NO: 618546 - RNA, 19 nt, Homo sapiens
cagucccgaugcagaaaga

SEQ ID NO: 618547 - RNA, 19 nt, Homo sapiens
ugcaaggagggcccuguua

SEQ ID NO: 618548 - RNA, 19 nt, Homo sapiens
gaugaacccauagcuuucu

SEQ ID NO: 618549 - RNA, 19 nt, Homo sapiens
gcccuccaauccuaucuac

SEQ ID NO: 618550 - RNA, 19 nt, Homo sapiens
uucagcaccuuccagauca

SEQ ID NO: 618551 - RNA, 19 nt, Homo sapiens
gcaaagcaccuaacacaua

SEQ ID NO: 618552 - RNA, 19 nt, Homo sapiens
gggaacagcucaacaaugg

SEQ ID NO: 618553 - RNA, 19 nt, Homo sapiens
gaaagugccugugcuggaa

SEQ ID NO: 618554 - RNA, 19 nt, Homo sapiens
gaacuggccuguacucacu

SEQ ID NO: 618555 - RNA, 19 nt, Homo sapiens
caaagcaccuaacacauag

SEQ ID NO: 618556 - RNA, 19 nt, Homo sapiens
gaugggcgcuccugguguu

SEQ ID NO: 618557 - RNA, 19 nt, Homo sapiens
ccgacgagcuggugcguuu

SEQ ID NO: 618558 - RNA, 19 nt, Homo sapiens
ccagagaccucagcuaugg

SEQ ID NO: 618559 - RNA, 19 nt, Homo sapiens
gauggaacuuggacuugga

SEQ ID NO: 618560 - RNA, 19 nt, Homo sapiens
gugaaagaauagcugcaaa

SEQ ID NO: 618561 - RNA, 19 nt, Homo sapiens
ggacgaaggccucaaagcu

SEQ ID NO: 618562 - RNA, 19 nt, Homo sapiens
gagcuucucugagccuugu

SEQ ID NO: 618563 - RNA, 19 nt, Homo sapiens
gcaguugcuugguugaaag

SEQ ID NO: 618564 - RNA, 19 nt, Homo sapiens
ccuaacacauaguaagguu

SEQ ID NO: 618565 - RNA, 19 nt, Homo sapiens
gguugagucuagcugugua

SEQ ID NO: 618566 - RNA, 19 nt, Homo sapiens
gcaccuaacacauaguaag

SEQ ID NO: 618567 - RNA, 19 nt, Homo sapiens
ucauggaguugugaaagaa

SEQ ID NO: 618568 - RNA, 19 nt, Homo sapiens
aaaaggggauuaaaccauu

SEQ ID NO: 618569 - RNA, 19 nt, Homo sapiens
caccagagaccucagcuau

SEQ ID NO: 618570 - RNA, 19 nt, Homo sapiens
acucaucucuuaauuugca

SEQ ID NO: 618571 - RNA, 19 nt, Homo sapiens
gcauuugaaggacacauau

SEQ ID NO: 618572 - RNA, 19 nt, Homo sapiens
gagauggaacuuggacuug

SEQ ID NO: 618573 - RNA, 19 nt, Homo sapiens
gugaagggacaacugacua

SEQ ID NO: 618574 - RNA, 19 nt, Homo sapiens
gaaagaauagcugcaaagc

SEQ ID NO: 618575 - RNA, 19 nt, Homo sapiens
uacaguggcugaggcauca

SEQ ID NO: 618576 - RNA, 19 nt, Homo sapiens
cuuguuugcucaucuggaa

SEQ ID NO: 618577 - RNA, 19 nt, Homo sapiens
uuugcagacuggacccuua

SEQ ID NO: 618578 - RNA, 19 nt, Homo sapiens
gucaacagcaccuggagaa

SEQ ID NO: 618579 - RNA, 19 nt, Homo sapiens
aaggacacauauugcaguu

SEQ ID NO: 618580 - RNA, 19 nt, Homo sapiens
cugcaaagcaccuaacaca

SEQ ID NO: 618581 - RNA, 19 nt, Homo sapiens
auggaguugugaaagaaua

SEQ ID NO: 618582 - RNA, 19 nt, Homo sapiens
cucauggaguugugaaaga

SEQ ID NO: 618583 - RNA, 19 nt, Homo sapiens
ugaaagaauagcugcaaag

SEQ ID NO: 618584 - RNA, 19 nt, Homo sapiens
caggugaagggacaacuga

SEQ ID NO: 618585 - RNA, 19 nt, Homo sapiens
aagcaccuaacacauagua

SEQ ID NO: 618586 - RNA, 19 nt, Homo sapiens
ugcaguugcuugguugaaa

SEQ ID NO: 618587 - RNA, 19 nt, Homo sapiens
guagggacagcauuugaag

SEQ ID NO: 618588 - RNA, 19 nt, Homo sapiens
cggacccacuucucacaga

SEQ ID NO: 618589 - RNA, 19 nt, Homo sapiens
uuugcaagcugccucaaca

SEQ ID NO: 618590 - RNA, 19 nt, Homo sapiens
gauagagauggaacuugga

SEQ ID NO: 618591 - RNA, 19 nt, Homo sapiens
gggcgcuccugguguugau

SEQ ID NO: 618592 - RNA, 19 nt, Homo sapiens
gcuacgaagcggucuccuu

SEQ ID NO: 618593 - RNA, 19 nt, Homo sapiens
auauugcaguugcuugguu

SEQ ID NO: 618594 - RNA, 19 nt, Homo sapiens
cagggacgaaggccucaaa

SEQ ID NO: 618595 - RNA, 19 nt, Homo sapiens
agagauggaacuuggacuu

SEQ ID NO: 618596 - RNA, 19 nt, Homo sapiens
gaaagugccugugcuggaa

SEQ ID NO: 618597 - RNA, 19 nt, Homo sapiens
gaacuggccuguacucacu

SEQ ID NO: 618598 - RNA, 19 nt, Homo sapiens
gaugggcgcuccugguguu

SEQ ID NO: 618599 - RNA, 19 nt, Homo sapiens
ccgacgagcuggugcguuu

SEQ ID NO: 618600 - RNA, 19 nt, Homo sapiens
ccagagaccucagcuaugg

SEQ ID NO: 618601 - RNA, 19 nt, Homo sapiens
gauggaacuuggacuugga

SEQ ID NO: 618602 - RNA, 19 nt, Homo sapiens
ggacgaaggccucaaagcu

SEQ ID NO: 618603 - RNA, 19 nt, Homo sapiens
gcaguugcuugguugaaag

SEQ ID NO: 618604 - RNA, 19 nt, Homo sapiens
caccagagaccucagcuau

SEQ ID NO: 618605 - RNA, 19 nt, Homo sapiens
gcauuugaaggacacauau

SEQ ID NO: 618606 - RNA, 19 nt, Homo sapiens
gagauggaacuuggacuug

SEQ ID NO: 618607 - RNA, 19 nt, Homo sapiens
gugaagggacaacugacua

SEQ ID NO: 618608 - RNA, 19 nt, Homo sapiens
uacaguggcugaggcauca

SEQ ID NO: 618609 - RNA, 19 nt, Homo sapiens
uuugcagacuggacccuua

SEQ ID NO: 618610 - RNA, 19 nt, Homo sapiens
gucaacagcaccuggagaa

SEQ ID NO: 618611 - RNA, 19 nt, Homo sapiens
aaggacacauauugcaguu

SEQ ID NO: 618612 - RNA, 19 nt, Homo sapiens
caggugaagggacaacuga

SEQ ID NO: 618613 - RNA, 19 nt, Homo sapiens
ugcaguugcuugguugaaa

SEQ ID NO: 618614 - RNA, 19 nt, Homo sapiens
guagggacagcauuugaag

SEQ ID NO: 618615 - RNA, 19 nt, Homo sapiens
cggacccacuucucacaga

SEQ ID NO: 618616 - RNA, 19 nt, Homo sapiens
gauagagauggaacuugga

SEQ ID NO: 618617 - RNA, 19 nt, Homo sapiens
gggcgcuccugguguugau

SEQ ID NO: 618618 - RNA, 19 nt, Homo sapiens
gcuacgaagcggucuccuu

SEQ ID NO: 618619 - RNA, 19 nt, Homo sapiens
agagauggaacuuggacuu

SEQ ID NO: 618620 - RNA, 19 nt, Homo sapiens
auauugcaguugcuugguu

SEQ ID NO: 618621 - RNA, 19 nt, Homo sapiens
cagggacgaaggccucaaa

SEQ ID NO: 618622 - RNA, 19 nt, Homo sapiens
gggaacagcucaacaaugg

SEQ ID NO: 618623 - RNA, 19 nt, Homo sapiens
gaaagugccugugcuggaa

SEQ ID NO: 618624 - RNA, 19 nt, Homo sapiens
gaacuggccuguacucacu

SEQ ID NO: 618625 - RNA, 19 nt, Homo sapiens
ggaaaggugccuagaagaa

SEQ ID NO: 618626 - RNA, 19 nt, Homo sapiens
gaugggcgcuccugguguu

SEQ ID NO: 618627 - RNA, 19 nt, Homo sapiens
ccgacgagcuggugcguuu

SEQ ID NO: 618628 - RNA, 19 nt, Homo sapiens
ccagagaccucagcuaugg

SEQ ID NO: 618629 - RNA, 19 nt, Homo sapiens
gauggaacuuggacuugga

SEQ ID NO: 618630 - RNA, 19 nt, Homo sapiens
ggacgaaggccucaaagcu

SEQ ID NO: 618631 - RNA, 19 nt, Homo sapiens
gcaguugcuugguugaaag

SEQ ID NO: 618632 - RNA, 19 nt, Homo sapiens
ccucccagcucucuacuuc

SEQ ID NO: 618633 - RNA, 19 nt, Homo sapiens
ccggaaaggugccuagaag

SEQ ID NO: 618634 - RNA, 19 nt, Homo sapiens
aaaggugccuagaagaaca

SEQ ID NO: 618635 - RNA, 19 nt, Homo sapiens
caccagagaccucagcuau

SEQ ID NO: 618636 - RNA, 19 nt, Homo sapiens
cuacuucgcgugucuacaa

SEQ ID NO: 618637 - RNA, 19 nt, Homo sapiens
gaaaggugccuagaagaac

SEQ ID NO: 618638 - RNA, 19 nt, Homo sapiens
gcauuugaaggacacauau

SEQ ID NO: 618639 - RNA, 19 nt, Homo sapiens
gagauggaacuuggacuug

SEQ ID NO: 618640 - RNA, 19 nt, Homo sapiens
gugaagggacaacugacua

SEQ ID NO: 618641 - RNA, 19 nt, Homo sapiens
uacaguggcugaggcauca

SEQ ID NO: 618642 - RNA, 19 nt, Homo sapiens
ucgcgugucuacaaacuca

SEQ ID NO: 618643 - RNA, 19 nt, Homo sapiens
uuugcagacuggacccuua

SEQ ID NO: 618644 - RNA, 19 nt, Homo sapiens
gucaacagcaccuggagaa

SEQ ID NO: 618645 - RNA, 19 nt, Homo sapiens
aaggacacauauugcaguu

SEQ ID NO: 618646 - RNA, 19 nt, Homo sapiens
caggugaagggacaacuga

SEQ ID NO: 618647 - RNA, 19 nt, Homo sapiens
guucucuacucuccauauc

SEQ ID NO: 618648 - RNA, 19 nt, Homo sapiens
ugcaguugcuugguugaaa

SEQ ID NO: 618649 - RNA, 19 nt, Homo sapiens
guagggacagcauuugaag

SEQ ID NO: 618650 - RNA, 19 nt, Homo sapiens
cggacccacuucucacaga

SEQ ID NO: 618651 - RNA, 19 nt, Homo sapiens
gauagagauggaacuugga

SEQ ID NO: 618652 - RNA, 19 nt, Homo sapiens
gggcgcuccugguguugau

SEQ ID NO: 618653 - RNA, 19 nt, Homo sapiens
gcuacgaagcggucuccuu

SEQ ID NO: 618654 - RNA, 19 nt, Homo sapiens
auauugcaguugcuugguu

SEQ ID NO: 618655 - RNA, 19 nt, Homo sapiens
cagggacgaaggccucaaa

SEQ ID NO: 618656 - RNA, 19 nt, Homo sapiens
agagauggaacuuggacuu

SEQ ID NO: 618657 - RNA, 19 nt, Homo sapiens
gaaagugccugugcuggaa

SEQ ID NO: 618658 - RNA, 19 nt, Homo sapiens
gaacuggccuguacucacu

SEQ ID NO: 618659 - RNA, 19 nt, Homo sapiens
ccgacgagcuggugcguuu

SEQ ID NO: 618660 - RNA, 19 nt, Homo sapiens
ccagagaccucagcuaugg

SEQ ID NO: 618661 - RNA, 19 nt, Homo sapiens
ggacgaaggccucaaagcu

SEQ ID NO: 618662 - RNA, 19 nt, Homo sapiens
gcaguugcuugguugaaag

SEQ ID NO: 618663 - RNA, 19 nt, Homo sapiens
caccagagaccucagcuau

SEQ ID NO: 618664 - RNA, 19 nt, Homo sapiens
gcauuugaaggacacauau

SEQ ID NO: 618665 - RNA, 19 nt, Homo sapiens
gugaagggacaacugacua

SEQ ID NO: 618666 - RNA, 19 nt, Homo sapiens
uacaguggcugaggcauca

SEQ ID NO: 618667 - RNA, 19 nt, Homo sapiens
uuugcagacuggacccuua

SEQ ID NO: 618668 - RNA, 19 nt, Homo sapiens
gucaacagcaccuggagaa

SEQ ID NO: 618669 - RNA, 19 nt, Homo sapiens
aaggacacauauugcaguu

SEQ ID NO: 618670 - RNA, 19 nt, Homo sapiens
caggugaagggacaacuga

SEQ ID NO: 618671 - RNA, 19 nt, Homo sapiens
ugcaguugcuugguugaaa

SEQ ID NO: 618672 - RNA, 19 nt, Homo sapiens
guagggacagcauuugaag

SEQ ID NO: 618673 - RNA, 19 nt, Homo sapiens
cggacccacuucucacaga

SEQ ID NO: 618674 - RNA, 19 nt, Homo sapiens
gcuacgaagcggucuccuu

SEQ ID NO: 618675 - RNA, 19 nt, Homo sapiens
auauugcaguugcuugguu

SEQ ID NO: 618676 - RNA, 19 nt, Homo sapiens
cagggacgaaggccucaaa

SEQ ID NO: 618677 - RNA, 19 nt, Homo sapiens
gaaggaggauggcggauau

SEQ ID NO: 618678 - RNA, 19 nt, Homo sapiens
ccauggagcucaucauugg

SEQ ID NO: 618679 - RNA, 19 nt, Homo sapiens
gcucuuccauccucaacaa

SEQ ID NO: 618680 - RNA, 19 nt, Homo sapiens
ucaagcaugugguccugua

SEQ ID NO: 618681 - RNA, 19 nt, Homo sapiens
ggaaggaggauggcggaua

SEQ ID NO: 618682 - RNA, 19 nt, Homo sapiens
gccauugccugccucaaga

SEQ ID NO: 618683 - RNA, 19 nt, Homo sapiens
gcuaggaguugccgaagca

SEQ ID NO: 618684 - RNA, 19 nt, Homo sapiens
gaaggacgaagaggacaaa

SEQ ID NO: 618685 - RNA, 19 nt, Homo sapiens
gcacagaugcgugaacaca

SEQ ID NO: 618686 - RNA, 19 nt, Homo sapiens
ggaggcugcugccaaguac

SEQ ID NO: 618687 - RNA, 19 nt, Homo sapiens
gcucaucauuggcaagaag

SEQ ID NO: 618688 - RNA, 19 nt, Homo sapiens
caaguacuacgaugccauu

SEQ ID NO: 618689 - RNA, 19 nt, Homo sapiens
gaagcaaguccggaagcua

SEQ ID NO: 618690 - RNA, 19 nt, Homo sapiens
ccaagagucuccgcaacau

SEQ ID NO: 618691 - RNA, 19 nt, Homo sapiens
ucacgccgcugcugcucaa

SEQ ID NO: 618692 - RNA, 19 nt, Homo sapiens
cgucaugcuucuguguaua

SEQ ID NO: 618693 - RNA, 19 nt, Homo sapiens
gcgucaugcuucuguguau

SEQ ID NO: 618694 - RNA, 19 nt, Homo sapiens
caacaaguacgacgacaac

SEQ ID NO: 618695 - RNA, 19 nt, Homo sapiens
cuuccauccucaacaagua

SEQ ID NO: 618696 - RNA, 19 nt, Homo sapiens
gcccauggagcucaucauu

SEQ ID NO: 618697 - RNA, 19 nt, Homo sapiens
ccaaggccacguuccacua

SEQ ID NO: 618698 - RNA, 19 nt, Homo sapiens
cgucaaggccuacuucaag

SEQ ID NO: 618699 - RNA, 19 nt, Homo sapiens
caacgucaaggccuacuuc

SEQ ID NO: 618700 - RNA, 19 nt, Homo sapiens
acauggagaugcugaaggu

SEQ ID NO: 618701 - RNA, 19 nt, Homo sapiens
gcacuuggcccugccuuac

SEQ ID NO: 618702 - RNA, 19 nt, Homo sapiens
ucaugcuucuguguauaua

SEQ ID NO: 618703 - RNA, 19 nt, Homo sapiens
gagcucaucauuggcaaga

SEQ ID NO: 618704 - RNA, 19 nt, Homo sapiens
gcaagcccauggagcucau

SEQ ID NO: 618705 - RNA, 19 nt, Homo sapiens
ggaggcccaggcugacuuu

SEQ ID NO: 618706 - RNA, 19 nt, Homo sapiens
ggaccaaggccacguucca

SEQ ID NO: 618707 - RNA, 19 nt, Homo sapiens
gcacugcugcgguguugca

SEQ ID NO: 618708 - RNA, 19 nt, Homo sapiens
gccaagagucuccgcaaca

SEQ ID NO: 618709 - RNA, 19 nt, Homo sapiens
ggccuuuauuuaucucuca

SEQ ID NO: 618710 - RNA, 19 nt, Homo sapiens
cgccgcugcugcucaacua

SEQ ID NO: 618711 - RNA, 19 nt, Homo sapiens
guccggaaguugccgaaag

SEQ ID NO: 618712 - RNA, 19 nt, Homo sapiens
caugacagacgaagagaag

SEQ ID NO: 618713 - RNA, 19 nt, Homo sapiens
accggacgcugcacaguga

SEQ ID NO: 618714 - RNA, 19 nt, Homo sapiens
ggaagcuaccgaggugcua

SEQ ID NO: 618715 - RNA, 19 nt, Homo sapiens
gagagcucccggacuuuca

SEQ ID NO: 618716 - RNA, 19 nt, Homo sapiens
guuccucugugacaucaag

SEQ ID NO: 618717 - RNA, 19 nt, Homo sapiens
ggaggauggcggauaucau

SEQ ID NO: 618718 - RNA, 19 nt, Homo sapiens
gaagugaacccuugcuaua

SEQ ID NO: 618719 - RNA, 19 nt, Homo sapiens
ucaagaaugugaacgaaua

SEQ ID NO: 618720 - RNA, 19 nt, Homo sapiens
ggacaaagaugaggcagaa

SEQ ID NO: 618721 - RNA, 19 nt, Homo sapiens
gcacagaguuuaagagaag

SEQ ID NO: 618722 - RNA, 19 nt, Homo sapiens
caaaagagcuuacaauuca

SEQ ID NO: 618723 - RNA, 19 nt, Homo sapiens
gcagggaggucauguacuu

SEQ ID NO: 618724 - RNA, 19 nt, Homo sapiens
cuacagagcaugauguuua

SEQ ID NO: 618725 - RNA, 19 nt, Homo sapiens
gaagaacuaugagcagaaa

SEQ ID NO: 618726 - RNA, 19 nt, Homo sapiens
agacagagcucauaaugga

SEQ ID NO: 618727 - RNA, 19 nt, Homo sapiens
gaaauaaagccuacaagug

SEQ ID NO: 618728 - RNA, 19 nt, Homo sapiens
ccaggaagauggaagaauu

SEQ ID NO: 618729 - RNA, 19 nt, Homo sapiens
caccacaccuggcuaauuu

SEQ ID NO: 618730 - RNA, 19 nt, Homo sapiens
ccagaacuauggacaaauu

SEQ ID NO: 618731 - RNA, 19 nt, Homo sapiens
ccacaucacuauucuucua

SEQ ID NO: 618732 - RNA, 19 nt, Homo sapiens
gcaaagaucugcucaaccu

SEQ ID NO: 618733 - RNA, 19 nt, Homo sapiens
uuacucagguuaugaauga

SEQ ID NO: 618734 - RNA, 19 nt, Homo sapiens
gagaaucuuucccuugcua

SEQ ID NO: 618735 - RNA, 19 nt, Homo sapiens
ggacagaaccagaacuaga

SEQ ID NO: 618736 - RNA, 19 nt, Homo sapiens
ugaaucagcugucacaaca

SEQ ID NO: 618737 - RNA, 19 nt, Homo sapiens
gaagagagguauggcaaag

SEQ ID NO: 618738 - RNA, 19 nt, Homo sapiens
gaacaugacagcuucuugu

SEQ ID NO: 618739 - RNA, 19 nt, Homo sapiens
gcauugugguuacauguga

SEQ ID NO: 618740 - RNA, 19 nt, Homo sapiens
acaguuugcucuaucagua

SEQ ID NO: 618741 - RNA, 19 nt, Homo sapiens
caaguagaguucugcaguu

SEQ ID NO: 618742 - RNA, 19 nt, Homo sapiens
caccagaugaucccaauua

SEQ ID NO: 618743 - RNA, 19 nt, Homo sapiens
gagcuuacaauucaagaaa

SEQ ID NO: 618744 - RNA, 19 nt, Homo sapiens
ccaagcccaucugaauuua

SEQ ID NO: 618745 - RNA, 19 nt, Homo sapiens
aaauaaagccuacaagugu

SEQ ID NO: 618746 - RNA, 19 nt, Homo sapiens
ggaaauaaagccuacaagu

SEQ ID NO: 618747 - RNA, 19 nt, Homo sapiens
ugucagcaaugaagacuuu

SEQ ID NO: 618748 - RNA, 19 nt, Homo sapiens
ggcuagugcuucugugaua

SEQ ID NO: 618749 - RNA, 19 nt, Homo sapiens
gagaagaguggcagaguga

SEQ ID NO: 618750 - RNA, 19 nt, Homo sapiens
ccucaguggugcaagauuu

SEQ ID NO: 618751 - RNA, 19 nt, Homo sapiens
gccuacaagugugaaauua

SEQ ID NO: 618752 - RNA, 19 nt, Homo sapiens
caucggcuaugacaacauu

SEQ ID NO: 618753 - RNA, 19 nt, Homo sapiens
uuacagagagcaaauaguu

SEQ ID NO: 618754 - RNA, 19 nt, Homo sapiens
uaaaaccaguccucaauuu

SEQ ID NO: 618755 - RNA, 19 nt, Homo sapiens
gccaagcccaucugaauuu

SEQ ID NO: 618756 - RNA, 19 nt, Homo sapiens
gagaaucaccaggguuuaa

SEQ ID NO: 618757 - RNA, 19 nt, Homo sapiens
gucgaggaguugccaauaa

SEQ ID NO: 618758 - RNA, 19 nt, Homo sapiens
gcagaaaugccgggacaaa

SEQ ID NO: 618759 - RNA, 19 nt, Homo sapiens
uacagagcaugauguuuaa

SEQ ID NO: 618760 - RNA, 19 nt, Homo sapiens
gaacuacagagcaugaugu

SEQ ID NO: 618761 - RNA, 19 nt, Homo sapiens
gcucaagaaugugaacgaa

SEQ ID NO: 618762 - RNA, 19 nt, Homo sapiens
gaugcuauccauaaacaaa

SEQ ID NO: 618763 - RNA, 19 nt, Homo sapiens
guaaggugcuacugaacau

SEQ ID NO: 618764 - RNA, 19 nt, Homo sapiens
ggacaaauugaucagaaga

SEQ ID NO: 618765 - RNA, 19 nt, Homo sapiens
ucgaggaguugccaauaaa

SEQ ID NO: 618766 - RNA, 19 nt, Homo sapiens
gggagaaucaccaggguuu

SEQ ID NO: 618767 - RNA, 19 nt, Homo sapiens
acaggaaacuugcaucagu

SEQ ID NO: 618768 - RNA, 19 nt, Homo sapiens
ccaaagugcugggauuaca

SEQ ID NO: 618769 - RNA, 19 nt, Homo sapiens
gugaacccuugcuauaauu

SEQ ID NO: 618770 - RNA, 19 nt, Homo sapiens
ugaacgggcucaggaaaug

SEQ ID NO: 618771 - RNA, 19 nt, Homo sapiens
gaaaugccgggacaaagau

SEQ ID NO: 618772 - RNA, 19 nt, Homo sapiens
gagaagaggccaggaagau

SEQ ID NO: 618773 - RNA, 19 nt, Homo sapiens
guagaggacucagacaaag

SEQ ID NO: 618774 - RNA, 19 nt, Homo sapiens
cgcaagaacugcaaagagu

SEQ ID NO: 618775 - RNA, 19 nt, Homo sapiens
gaacuauggacaaauugau

SEQ ID NO: 618776 - RNA, 19 nt, Homo sapiens
uaaaauagcacucucaguu

SEQ ID NO: 618777 - RNA, 19 nt, Homo sapiens
caccaggguuuaaauguca

SEQ ID NO: 618778 - RNA, 19 nt, Homo sapiens
gugcuucugugauauggaa

SEQ ID NO: 618779 - RNA, 19 nt, Homo sapiens
ccuaaaagcucaccagaug

SEQ ID NO: 618780 - RNA, 19 nt, Homo sapiens
agaaagggcagcaauugaa

SEQ ID NO: 618781 - RNA, 19 nt, Homo sapiens
gagcaugauguuuaaucua

SEQ ID NO: 618782 - RNA, 19 nt, Homo sapiens
cagagcagcaggaccuaua

SEQ ID NO: 618783 - RNA, 19 nt, Homo sapiens
gaacaauggccgcaagaac

SEQ ID NO: 618784 - RNA, 19 nt, Homo sapiens
aaagacagagcucauaaug

SEQ ID NO: 618785 - RNA, 19 nt, Homo sapiens
aaagaaagggcagcaauug

SEQ ID NO: 618786 - RNA, 19 nt, Homo sapiens
caacccacaucacuauucu

SEQ ID NO: 618787 - RNA, 19 nt, Homo sapiens
ugacuacaguuugcucuau

SEQ ID NO: 618788 - RNA, 19 nt, Homo sapiens
caagaaugugaacgaauaa

SEQ ID NO: 618789 - RNA, 19 nt, Homo sapiens
gaaacuggcaacuucaaag

SEQ ID NO: 618790 - RNA, 19 nt, Homo sapiens
cguguaaggugcuacugaa

SEQ ID NO: 618791 - RNA, 19 nt, Homo sapiens
ggagaaucaccaggguuua

SEQ ID NO: 618792 - RNA, 19 nt, Homo sapiens
aaucagcugucacaacaau

SEQ ID NO: 618793 - RNA, 19 nt, Homo sapiens
cgucuuacacuuucacaaa

SEQ ID NO: 618794 - RNA, 19 nt, Homo sapiens
gguuaugaaugaauuaggu

SEQ ID NO: 618795 - RNA, 19 nt, Homo sapiens
ggaaugcauugugguuaca

SEQ ID NO: 618796 - RNA, 19 nt, Homo sapiens
gaaagggcagcaauugaag

SEQ ID NO: 618797 - RNA, 19 nt, Homo sapiens
agaaaugccgggacaaaga

SEQ ID NO: 618798 - RNA, 19 nt, Homo sapiens
agagagguauggcaaagau

SEQ ID NO: 618799 - RNA, 19 nt, Homo sapiens
uuuaaaugcauccgucuua

SEQ ID NO: 618800 - RNA, 19 nt, Homo sapiens
cacguuaugucagcaauga

SEQ ID NO: 618801 - RNA, 19 nt, Homo sapiens
caauuacucuuugguugau

SEQ ID NO: 618802 - RNA, 19 nt, Homo sapiens
ggacucagacaaagcauac

SEQ ID NO: 618803 - RNA, 19 nt, Homo sapiens
aaauguuccuuuacacuca

SEQ ID NO: 618804 - RNA, 19 nt, Homo sapiens
uccaacaucugaacaaugg

SEQ ID NO: 618805 - RNA, 19 nt, Homo sapiens
gaauuagguuuucaacaug

SEQ ID NO: 618806 - RNA, 19 nt, Homo sapiens
ggaccuauagccacguuau

SEQ ID NO: 618807 - RNA, 19 nt, Homo sapiens
gcacaucggcacccuggau

SEQ ID NO: 618808 - RNA, 19 nt, Homo sapiens
gcucacuguucaagggaaa

SEQ ID NO: 618809 - RNA, 19 nt, Homo sapiens
uaagagaagaggccaggaa

SEQ ID NO: 618810 - RNA, 19 nt, Homo sapiens
gaagugcagcggcaugauc

SEQ ID NO: 618811 - RNA, 19 nt, Homo sapiens
gaggaaauaaagccuacaa

SEQ ID NO: 618812 - RNA, 19 nt, Homo sapiens
gaagccgccugaucauacu

SEQ ID NO: 618813 - RNA, 19 nt, Homo sapiens
ucaaugaaaccagagcuuu

SEQ ID NO: 618814 - RNA, 19 nt, Homo sapiens
gaacccgaagcaacaagaa

SEQ ID NO: 618815 - RNA, 19 nt, Homo sapiens
ucaguguaguugauguaaa

SEQ ID NO: 618816 - RNA, 19 nt, Homo sapiens
ggcaguuccucagggauuu

SEQ ID NO: 618817 - RNA, 19 nt, Homo sapiens
gaaacugaauuuugcaaag

SEQ ID NO: 618818 - RNA, 19 nt, Homo sapiens
ggaaggagcuggugcagau

SEQ ID NO: 618819 - RNA, 19 nt, Homo sapiens
gcaggaagaugugcaaaga

SEQ ID NO: 618820 - RNA, 19 nt, Homo sapiens
gcucguggcugccuucuga

SEQ ID NO: 618821 - RNA, 19 nt, Homo sapiens
ucacugagcuccacuccuu

SEQ ID NO: 618822 - RNA, 19 nt, Homo sapiens
ggagaagagucagaacaaa

SEQ ID NO: 618823 - RNA, 19 nt, Homo sapiens
gcaaccagcucuccaugca

SEQ ID NO: 618824 - RNA, 19 nt, Homo sapiens
ggagugcguucuguucaaa

SEQ ID NO: 618825 - RNA, 19 nt, Homo sapiens
cagcugcaguucaaagaug

SEQ ID NO: 618826 - RNA, 19 nt, Homo sapiens
gagaagagucagaacaaag

SEQ ID NO: 618827 - RNA, 19 nt, Homo sapiens
gagcagaggaagaaguaug

SEQ ID NO: 618828 - RNA, 19 nt, Homo sapiens
ggcagacgccugaggauga

SEQ ID NO: 618829 - RNA, 19 nt, Homo sapiens
cagcauagacgccgacauc

SEQ ID NO: 618830 - RNA, 19 nt, Homo sapiens
gcagacgccugaggaugau

SEQ ID NO: 618831 - RNA, 19 nt, Homo sapiens
gguggacuguggagaggaa

SEQ ID NO: 618832 - RNA, 19 nt, Homo sapiens
ccuuucagcugcaagaguu

SEQ ID NO: 618833 - RNA, 19 nt, Homo sapiens
gcauugcgcagcuggagaa

SEQ ID NO: 618834 - RNA, 19 nt, Homo sapiens
cagcagcccuggcauacag

SEQ ID NO: 618835 - RNA, 19 nt, Homo sapiens
agaagcagguggagaagag

SEQ ID NO: 618836 - RNA, 19 nt, Homo sapiens
gcuccacuccuuccucauu

SEQ ID NO: 618837 - RNA, 19 nt, Homo sapiens
cuggaaggcugcagcauag

SEQ ID NO: 618838 - RNA, 19 nt, Homo sapiens
agaaggagcagaggaagaa

SEQ ID NO: 618839 - RNA, 19 nt, Homo sapiens
aggaagaugugcaaagaca

SEQ ID NO: 618840 - RNA, 19 nt, Homo sapiens
ugcccuaccagaacuauua

SEQ ID NO: 618841 - RNA, 19 nt, Homo sapiens
cgacaucgacaguuucauc

SEQ ID NO: 618842 - RNA, 19 nt, Homo sapiens
guauacaggcagagcauug

SEQ ID NO: 618843 - RNA, 19 nt, Homo sapiens
gugaggagcugcggagucu

SEQ ID NO: 618844 - RNA, 19 nt, Homo sapiens
uaaaggagugcguucuguu

SEQ ID NO: 618845 - RNA, 19 nt, Homo sapiens
gaccaccugugaggccuuu

SEQ ID NO: 618846 - RNA, 19 nt, Homo sapiens
acgccgacaucgacaguuu

SEQ ID NO: 618847 - RNA, 19 nt, Homo sapiens
ugaagcagcaaauggagaa

SEQ ID NO: 618848 - RNA, 19 nt, Homo sapiens
gcauagacgccgacaucga

SEQ ID NO: 618849 - RNA, 19 nt, Homo sapiens
cagacuguguccuccauca

SEQ ID NO: 618850 - RNA, 19 nt, Homo sapiens
guuccuaccuggagaagcu

SEQ ID NO: 618851 - RNA, 19 nt, Homo sapiens
ugcaggagauacagggaaa

SEQ ID NO: 618852 - RNA, 19 nt, Homo sapiens
ucaaggaugaugagcucua

SEQ ID NO: 618853 - RNA, 19 nt, Homo sapiens
gaauaaaggagugcguucu

SEQ ID NO: 618854 - RNA, 19 nt, Homo sapiens
gagacauccuggaggugau

SEQ ID NO: 618855 - RNA, 19 nt, Homo sapiens
cagcgcagaacccagauga

SEQ ID NO: 618856 - RNA, 19 nt, Homo sapiens
caaggaugaugagcucuac

SEQ ID NO: 618857 - RNA, 19 nt, Homo sapiens
ugcagugugucaaggauga

SEQ ID NO: 618858 - RNA, 19 nt, Homo sapiens
ggcagaaggagcagaggaa

SEQ ID NO: 618859 - RNA, 19 nt, Homo sapiens
ggcaggagagugagcuuug

SEQ ID NO: 618860 - RNA, 19 nt, Homo sapiens
gagaagguccgggcugagu

SEQ ID NO: 618861 - RNA, 19 nt, Homo sapiens
gcaagcugucgcucuacaa

SEQ ID NO: 618862 - RNA, 19 nt, Homo sapiens
cuccacuccuuccucauuu

SEQ ID NO: 618863 - RNA, 19 nt, Homo sapiens
auaaaggagugcguucugu

SEQ ID NO: 618864 - RNA, 19 nt, Homo sapiens
guggcugccuucugagugu

SEQ ID NO: 618865 - RNA, 19 nt, Homo sapiens
uggagaagagucagaacaa

SEQ ID NO: 618866 - RNA, 19 nt, Homo sapiens
gcaggagagugagcuuugc

SEQ ID NO: 618867 - RNA, 19 nt, Homo sapiens
aaaggagugcguucuguuc

SEQ ID NO: 618868 - RNA, 19 nt, Homo sapiens
gauucuagccccaaacaaa

SEQ ID NO: 618869 - RNA, 19 nt, Homo sapiens
uugcgcagcuggagaaggu

SEQ ID NO: 618870 - RNA, 19 nt, Homo sapiens
agcugucgcucuacaagaa

SEQ ID NO: 618871 - RNA, 19 nt, Homo sapiens
aggagcagaggaagaagua

SEQ ID NO: 618872 - RNA, 19 nt, Homo sapiens
cagaaggagcagaggaaga

SEQ ID NO: 618873 - RNA, 19 nt, Homo sapiens
gcggcaugauaaagagguu

SEQ ID NO: 618874 - RNA, 19 nt, Homo sapiens
agcagcaaauggagaaugu

SEQ ID NO: 618875 - RNA, 19 nt, Homo sapiens
gggccuccuuugacuccuu

SEQ ID NO: 618876 - RNA, 19 nt, Homo sapiens
uagaggcgcuguaguauuu

SEQ ID NO: 618877 - RNA, 19 nt, Homo sapiens
gcaauggccugaaauccaa

SEQ ID NO: 618878 - RNA, 19 nt, Homo sapiens
gcacuaggguccagaaugg

SEQ ID NO: 618879 - RNA, 19 nt, Homo sapiens
ggaggaguguucauuguau

SEQ ID NO: 618880 - RNA, 19 nt, Homo sapiens
caaagacuaugaaguaaag

SEQ ID NO: 618881 - RNA, 19 nt, Homo sapiens
cuaaagaucacccuaaauu

SEQ ID NO: 618882 - RNA, 19 nt, Homo sapiens
gaggaguguucauuguaua

SEQ ID NO: 618883 - RNA, 19 nt, Homo sapiens
gcucaugcuuccugacuuu

SEQ ID NO: 618884 - RNA, 19 nt, Homo sapiens
gcgcugaccuuccucaugu

SEQ ID NO: 618885 - RNA, 19 nt, Homo sapiens
ggcgaaaucuugagucuuc

SEQ ID NO: 618886 - RNA, 19 nt, Homo sapiens
gggcugaugugggcuagua

SEQ ID NO: 618887 - RNA, 19 nt, Homo sapiens
caaccucuguaaauagauu

SEQ ID NO: 618888 - RNA, 19 nt, Homo sapiens
ggaccaacgucaaugucuu

SEQ ID NO: 618889 - RNA, 19 nt, Homo sapiens
ggcuaaagaucacccuaaa

SEQ ID NO: 618890 - RNA, 19 nt, Homo sapiens
ugaggaugcuuucuguaaa

SEQ ID NO: 618891 - RNA, 19 nt, Homo sapiens
uauaacaacugcucagagu

SEQ ID NO: 618892 - RNA, 19 nt, Homo sapiens
aaagaaagagggcagcuaa

SEQ ID NO: 618893 - RNA, 19 nt, Homo sapiens
guuuagacccuuacucuuu

SEQ ID NO: 618894 - RNA, 19 nt, Homo sapiens
caggagaauuuguagauca

SEQ ID NO: 618895 - RNA, 19 nt, Homo sapiens
ggaagcagcaccaaguuca

SEQ ID NO: 618896 - RNA, 19 nt, Homo sapiens
cgggauagcuguccaaggu

SEQ ID NO: 618897 - RNA, 19 nt, Homo sapiens
gauguuaucgcuauugaau

SEQ ID NO: 618898 - RNA, 19 nt, Homo sapiens
cuaaaggucuggucaucug

SEQ ID NO: 618899 - RNA, 19 nt, Homo sapiens
gaauaggaccaacgucaau

SEQ ID NO: 618900 - RNA, 19 nt, Homo sapiens
guagaucauucucacuuca

SEQ ID NO: 618901 - RNA, 19 nt, Homo sapiens
ccacuggccugaaucuaca

SEQ ID NO: 618902 - RNA, 19 nt, Homo sapiens
ggguguuccuguuggcuua

SEQ ID NO: 618903 - RNA, 19 nt, Homo sapiens
cuacagacuuugugauaag

SEQ ID NO: 618904 - RNA, 19 nt, Homo sapiens
gaaauccaaguacuacaga

SEQ ID NO: 618905 - RNA, 19 nt, Homo sapiens
ccaaagugcugggaugaca

SEQ ID NO: 618906 - RNA, 19 nt, Homo sapiens
ggaugugggcgaaaucuug

SEQ ID NO: 618907 - RNA, 19 nt, Homo sapiens
gaccaacgucaaugucuuu

SEQ ID NO: 618908 - RNA, 19 nt, Homo sapiens
ggcauggucuccuaaugga

SEQ ID NO: 618909 - RNA, 19 nt, Homo sapiens
gcugauacuucucucaucu

SEQ ID NO: 618910 - RNA, 19 nt, Homo sapiens
uauauuguccugaccauga

SEQ ID NO: 618911 - RNA, 19 nt, Homo sapiens
gaugugggcuaguaagacu

SEQ ID NO: 618912 - RNA, 19 nt, Homo sapiens
aaccucaacucgugaagaa

SEQ ID NO: 618913 - RNA, 19 nt, Homo sapiens
gaggaugcuuucuguaaac

SEQ ID NO: 618914 - RNA, 19 nt, Homo sapiens
gaaaucuugagucuucuga

SEQ ID NO: 618915 - RNA, 19 nt, Homo sapiens
gaaagagggcagcuaacuc

SEQ ID NO: 618916 - RNA, 19 nt, Homo sapiens
ccuguuggcuuauguuagu

SEQ ID NO: 618917 - RNA, 19 nt, Homo sapiens
ugauacuucucucaucuug

SEQ ID NO: 618918 - RNA, 19 nt, Homo sapiens
uaggagaggcuaaagauca

SEQ ID NO: 618919 - RNA, 19 nt, Homo sapiens
gguaggagaggcuaaagau

SEQ ID NO: 618920 - RNA, 19 nt, Homo sapiens
ucaccuacguccucuucuu

SEQ ID NO: 618921 - RNA, 19 nt, Homo sapiens
cccaaccucuguaaauaga

SEQ ID NO: 618922 - RNA, 19 nt, Homo sapiens
aaucuugagucuucugaga

SEQ ID NO: 618923 - RNA, 19 nt, Homo sapiens
gaaccagccuccccaaaag

SEQ ID NO: 618924 - RNA, 19 nt, Homo sapiens
gcucugccaggaauucuuu

SEQ ID NO: 618925 - RNA, 19 nt, Homo sapiens
caaacuugcugucaauucc

SEQ ID NO: 618926 - RNA, 19 nt, Homo sapiens
gacuaaaggucuggucauc

SEQ ID NO: 618927 - RNA, 19 nt, Homo sapiens
gcaaggugcaggacuccaa

SEQ ID NO: 618928 - RNA, 19 nt, Homo sapiens
gcccuuaaucuugcuguua

SEQ ID NO: 618929 - RNA, 19 nt, Homo sapiens
acucaaguuuagacccuua

SEQ ID NO: 618930 - RNA, 19 nt, Homo sapiens
ucuuagaggcgcuguagua

SEQ ID NO: 618931 - RNA, 19 nt, Homo sapiens
gccugaaucuacacuggaa

SEQ ID NO: 618932 - RNA, 19 nt, Homo sapiens
gacacuacgggaacaguuu

SEQ ID NO: 618933 - RNA, 19 nt, Homo sapiens
gaugugggcgaaaucuuga

SEQ ID NO: 618934 - RNA, 19 nt, Homo sapiens
ucacgaugcuccucuccau

SEQ ID NO: 618935 - RNA, 19 nt, Homo sapiens
ggccgagcccuuacaaaga

SEQ ID NO: 618936 - RNA, 19 nt, Homo sapiens
caacgaaaccccauggauu

SEQ ID NO: 618937 - RNA, 19 nt, Homo sapiens
uacuacagacuuugugaua

SEQ ID NO: 618938 - RNA, 19 nt, Homo sapiens
cacccuaaauuuacucauc

SEQ ID NO: 618939 - RNA, 19 nt, Homo sapiens
acuacagacuuugugauaa

SEQ ID NO: 618940 - RNA, 19 nt, Homo sapiens
gcuaguaagacuccaguuc

SEQ ID NO: 618941 - RNA, 19 nt, Homo sapiens
aaagggaugugggcgaaau

SEQ ID NO: 618942 - RNA, 19 nt, Homo sapiens
auacuucucucaucuugca

SEQ ID NO: 618943 - RNA, 19 nt, Homo sapiens
gggcauggucuccuaaugg

SEQ ID NO: 618944 - RNA, 19 nt, Homo sapiens
ugccaggaauucuuucaga

SEQ ID NO: 618945 - RNA, 19 nt, Homo sapiens
ggucaccccucucuucuug

SEQ ID NO: 618946 - RNA, 19 nt, Homo sapiens
cccuuaaucuugcuguuau

SEQ ID NO: 618947 - RNA, 19 nt, Homo sapiens
gcaauccucccaucuccau

SEQ ID NO: 618948 - RNA, 19 nt, Homo sapiens
gcuaugguguggagaacag

SEQ ID NO: 618949 - RNA, 19 nt, Homo sapiens
ccaaacuugcugucaauuc

SEQ ID NO: 618950 - RNA, 19 nt, Homo sapiens
uaaagaaagagggcagcua

SEQ ID NO: 618951 - RNA, 19 nt, Homo sapiens
gcccuuacaaagacuauga

SEQ ID NO: 618952 - RNA, 19 nt, Homo sapiens
acacgcuucuuccucuuug

SEQ ID NO: 618953 - RNA, 19 nt, Homo sapiens
aaugcugccuacucaguuu

SEQ ID NO: 618954 - RNA, 19 nt, Homo sapiens
gcuaaagaucacccuaaau

SEQ ID NO: 618955 - RNA, 19 nt, Homo sapiens
gccgagcccuuacaaagac

SEQ ID NO: 618956 - RNA, 19 nt, Homo sapiens
ccucaacucgugaagaaga

SEQ ID NO: 618957 - RNA, 19 nt, Homo sapiens
uugaggaugcuuucuguaa

SEQ ID NO: 618958 - RNA, 19 nt, Homo sapiens
uccaggauguuaucgcuau

SEQ ID NO: 618959 - RNA, 19 nt, Homo sapiens
agaucauucucacuucaaa

SEQ ID NO: 618960 - RNA, 19 nt, Homo sapiens
ggacuaaaggucuggucau

SEQ ID NO: 618961 - RNA, 19 nt, Homo sapiens
gaguaugcaauaaagaugu

SEQ ID NO: 618962 - RNA, 19 nt, Homo sapiens
gccuaggcccuuaaucuug

SEQ ID NO: 618963 - RNA, 19 nt, Homo sapiens
ugagaaaacuguacaagac

SEQ ID NO: 618964 - RNA, 19 nt, Homo sapiens
gaccgcaggugggaugaca

SEQ ID NO: 618965 - RNA, 19 nt, Homo sapiens
ugaauaggaccaacgucaa

SEQ ID NO: 618966 - RNA, 19 nt, Homo sapiens
gcgggaagcagcaccaagu

SEQ ID NO: 618967 - RNA, 19 nt, Homo sapiens
ggccugcuccucuaacuca

SEQ ID NO: 618968 - RNA, 19 nt, Homo sapiens
guaaaccucaacucgugaa

SEQ ID NO: 618969 - RNA, 19 nt, Homo sapiens
ccaggauguuaucgcuauu

SEQ ID NO: 618970 - RNA, 19 nt, Homo sapiens
ccacacgcuucuuccucuu

SEQ ID NO: 618971 - RNA, 19 nt, Homo sapiens
uggaggaguguucauugua

SEQ ID NO: 618972 - RNA, 19 nt, Homo sapiens
cagccuaggcccuuaaucu

SEQ ID NO: 618973 - RNA, 19 nt, Homo sapiens
uuauguuagucccgaguuu

SEQ ID NO: 618974 - RNA, 19 nt, Homo sapiens
ggccugaaauccaaguacu

SEQ ID NO: 618975 - RNA, 19 nt, Homo sapiens
caacgucaaugucuuuucu

SEQ ID NO: 618976 - RNA, 19 nt, Homo sapiens
gaacagaagcuacagauaa

SEQ ID NO: 618977 - RNA, 19 nt, Homo sapiens
gaaauagugugguuagaaa

SEQ ID NO: 618978 - RNA, 19 nt, Homo sapiens
gaaccaaagcugaaauuua

SEQ ID NO: 618979 - RNA, 19 nt, Homo sapiens
gaagaaagauccugagaag

SEQ ID NO: 618980 - RNA, 19 nt, Homo sapiens
ccaugaaucuuucgaaaua

SEQ ID NO: 618981 - RNA, 19 nt, Homo sapiens
gauagaauguuacugauga

SEQ ID NO: 618982 - RNA, 19 nt, Homo sapiens
gaaggaaccucagaaaguu

SEQ ID NO: 618983 - RNA, 19 nt, Homo sapiens
ccaagucucuuccucauuu

SEQ ID NO: 618984 - RNA, 19 nt, Homo sapiens
aaacccagcugucacauuu

SEQ ID NO: 618985 - RNA, 19 nt, Homo sapiens
gcacuuccauguacaacaa

SEQ ID NO: 618986 - RNA, 19 nt, Homo sapiens
gcuacaaagugcaagauaa

SEQ ID NO: 618987 - RNA, 19 nt, Homo sapiens
gcaagcggcucuccucuuc

SEQ ID NO: 618988 - RNA, 19 nt, Homo sapiens
cuacaaagcugcacacucu

SEQ ID NO: 618989 - RNA, 19 nt, Homo sapiens
gagcagcguuguuaacaga

SEQ ID NO: 618990 - RNA, 19 nt, Homo sapiens
caagagaaauagugugguu

SEQ ID NO: 618991 - RNA, 19 nt, Homo sapiens
uuacugcccucuuacauaa

SEQ ID NO: 618992 - RNA, 19 nt, Homo sapiens
gaaguuauaugaguguuuc

SEQ ID NO: 618993 - RNA, 19 nt, Homo sapiens
ggacaaagaacgccacgaa

SEQ ID NO: 618994 - RNA, 19 nt, Homo sapiens
gaaauacgucucauucuuc

SEQ ID NO: 618995 - RNA, 19 nt, Homo sapiens
ggacuuaucuuugccuuac

SEQ ID NO: 618996 - RNA, 19 nt, Homo sapiens
auaauuuacugcccucuua

SEQ ID NO: 618997 - RNA, 19 nt, Homo sapiens
gcccagaaauuccuuugaa

SEQ ID NO: 618998 - RNA, 19 nt, Homo sapiens
gcaaauuauaggcagauua

SEQ ID NO: 618999 - RNA, 19 nt, Homo sapiens
ucagagaaacggugauaua

SEQ ID NO: 619000 - RNA, 19 nt, Homo sapiens
gcaggaagagcuugaaaga

SEQ ID NO: 619001 - RNA, 19 nt, Homo sapiens
ccagcucgcucccgacuuu

SEQ ID NO: 619002 - RNA, 19 nt, Homo sapiens
caacaaacgcuccgggaaa

SEQ ID NO: 619003 - RNA, 19 nt, Homo sapiens
gcugcacacucuagaaauu

SEQ ID NO: 619004 - RNA, 19 nt, Homo sapiens
uuaccacgauagaauguua

SEQ ID NO: 619005 - RNA, 19 nt, Homo sapiens
cuggauagcuuuucuaaua

SEQ ID NO: 619006 - RNA, 19 nt, Homo sapiens
ggaagagcuugaaagacaa

SEQ ID NO: 619007 - RNA, 19 nt, Homo sapiens
gaauuccuuuccugcuaua

SEQ ID NO: 619008 - RNA, 19 nt, Homo sapiens
aggaagagcuugaaagaca

SEQ ID NO: 619009 - RNA, 19 nt, Homo sapiens
ggaaauggaaagccaguug

SEQ ID NO: 619010 - RNA, 19 nt, Homo sapiens
gcagagcaccuuuagugaa

SEQ ID NO: 619011 - RNA, 19 nt, Homo sapiens
gggcagagcaccuuuagug

SEQ ID NO: 619012 - RNA, 19 nt, Homo sapiens
gacaagagaauuugguuau

SEQ ID NO: 619013 - RNA, 19 nt, Homo sapiens
ccuuacugaucacaaauua

SEQ ID NO: 619014 - RNA, 19 nt, Homo sapiens
gcagauuaccagguucuua

SEQ ID NO: 619015 - RNA, 19 nt, Homo sapiens
gaagcgacuugaggagauu

SEQ ID NO: 619016 - RNA, 19 nt, Homo sapiens
gaauaggagaagaguuuaa

SEQ ID NO: 619017 - RNA, 19 nt, Homo sapiens
ccagacaggcggucaguuu

SEQ ID NO: 619018 - RNA, 19 nt, Homo sapiens
caaagugcaagauaagaaa

SEQ ID NO: 619019 - RNA, 19 nt, Homo sapiens
aaacagcacccgacagcua

SEQ ID NO: 619020 - RNA, 19 nt, Homo sapiens
aaagaaauacgucucauuc

SEQ ID NO: 619021 - RNA, 19 nt, Homo sapiens
gaaaaccagugaucagaga

SEQ ID NO: 619022 - RNA, 19 nt, Homo sapiens
caccaugaaucuuucgaaa

SEQ ID NO: 619023 - RNA, 19 nt, Homo sapiens
guacggcgcacaauggaaa

SEQ ID NO: 619024 - RNA, 19 nt, Homo sapiens
caaccacucaggaaauaaa

SEQ ID NO: 619025 - RNA, 19 nt, Homo sapiens
aaagaaagagagagagaaa

SEQ ID NO: 619026 - RNA, 19 nt, Homo sapiens
gagaaauagugugguuaga

SEQ ID NO: 619027 - RNA, 19 nt, Homo sapiens
gauguuaccacgauagaau

SEQ ID NO: 619028 - RNA, 19 nt, Homo sapiens
uaacaaccacucaggaaau

SEQ ID NO: 619029 - RNA, 19 nt, Homo sapiens
aacaaccacucaggaaaua

SEQ ID NO: 619030 - RNA, 19 nt, Homo sapiens
gauuagaugucaccaacag

SEQ ID NO: 619031 - RNA, 19 nt, Homo sapiens
agagaagcauuuccagaga

SEQ ID NO: 619032 - RNA, 19 nt, Homo sapiens
agaagaagccacaguugaa

SEQ ID NO: 619033 - RNA, 19 nt, Homo sapiens
cagagcaccuuuagugaag

SEQ ID NO: 619034 - RNA, 19 nt, Homo sapiens
gaugguggacuuaucuuug

SEQ ID NO: 619035 - RNA, 19 nt, Homo sapiens
cuagaguucuugaccauca

SEQ ID NO: 619036 - RNA, 19 nt, Homo sapiens
caagagcgccuggagagaa

SEQ ID NO: 619037 - RNA, 19 nt, Homo sapiens
agaagaagcucgcguucgu

SEQ ID NO: 619038 - RNA, 19 nt, Homo sapiens
gcagaaagaagaagaagcu

SEQ ID NO: 619039 - RNA, 19 nt, Homo sapiens
gaagagcuugaaagacaaa

SEQ ID NO: 619040 - RNA, 19 nt, Homo sapiens
gagaagaaagauccugaga

SEQ ID NO: 619041 - RNA, 19 nt, Homo sapiens
aagcacagcugccuugucu

SEQ ID NO: 619042 - RNA, 19 nt, Homo sapiens
guacauggacauucugcaa

SEQ ID NO: 619043 - RNA, 19 nt, Homo sapiens
caaauuauaggcagauuac

SEQ ID NO: 619044 - RNA, 19 nt, Homo sapiens
gugcuucuguuaagacuuc

SEQ ID NO: 619045 - RNA, 19 nt, Homo sapiens
ucagaaaguugccaaugag

SEQ ID NO: 619046 - RNA, 19 nt, Homo sapiens
caagagggaagucaaagug

SEQ ID NO: 619047 - RNA, 19 nt, Homo sapiens
gggcugcuguggaggagaa

SEQ ID NO: 619048 - RNA, 19 nt, Homo sapiens
acaaguagaaugaauagga

SEQ ID NO: 619049 - RNA, 19 nt, Homo sapiens
gaaugccagugcuucuguu

SEQ ID NO: 619050 - RNA, 19 nt, Homo sapiens
gguagaagaagccacaguu

SEQ ID NO: 619051 - RNA, 19 nt, Homo sapiens
cucagaaaguugccaauga

SEQ ID NO: 619052 - RNA, 19 nt, Homo sapiens
agaaggaaccucagaaagu

SEQ ID NO: 619053 - RNA, 19 nt, Homo sapiens
gauuaccagguucuuauaa

SEQ ID NO: 619054 - RNA, 19 nt, Homo sapiens
auaaguaccucuuuguucu

SEQ ID NO: 619055 - RNA, 19 nt, Homo sapiens
ccagugugcuccuucuuag

SEQ ID NO: 619056 - RNA, 19 nt, Homo sapiens
aaauacgucucauucuuca

SEQ ID NO: 619057 - RNA, 19 nt, Homo sapiens
gaagaaccaaagcugaaau

SEQ ID NO: 619058 - RNA, 19 nt, Homo sapiens
gagaacagaagcuacagau

SEQ ID NO: 619059 - RNA, 19 nt, Homo sapiens
gguagaugguguucagaca

SEQ ID NO: 619060 - RNA, 19 nt, Homo sapiens
uagaagaagccacaguuga

SEQ ID NO: 619061 - RNA, 19 nt, Homo sapiens
cacgauagaauguuacuga

SEQ ID NO: 619062 - RNA, 19 nt, Homo sapiens
uuuguuagcugcauuccuu

SEQ ID NO: 619063 - RNA, 19 nt, Homo sapiens
cagauuaccagguucuuau

SEQ ID NO: 619064 - RNA, 19 nt, Homo sapiens
ccaaagcugaaauuuaaug

SEQ ID NO: 619065 - RNA, 19 nt, Homo sapiens
cugcagaaguuauaugagu

SEQ ID NO: 619066 - RNA, 19 nt, Homo sapiens
gaugaugaagggacacuug

SEQ ID NO: 619067 - RNA, 19 nt, Homo sapiens
acuaaauucuccagauaga

SEQ ID NO: 619068 - RNA, 19 nt, Homo sapiens
agacaagagaauuugguua

SEQ ID NO: 619069 - RNA, 19 nt, Homo sapiens
gagagaaagaagcgacuug

SEQ ID NO: 619070 - RNA, 19 nt, Homo sapiens
gcggacaccugcugaacca

SEQ ID NO: 619071 - RNA, 19 nt, Homo sapiens
guagaagaagccacaguug

SEQ ID NO: 619072 - RNA, 19 nt, Homo sapiens
gagaaggaaccucagaaag

SEQ ID NO: 619073 - RNA, 19 nt, Homo sapiens
ugggagagcagcguuguua

SEQ ID NO: 619074 - RNA, 19 nt, Homo sapiens
gaagaguuuaagccuguuu

SEQ ID NO: 619075 - RNA, 19 nt, Homo sapiens
gcuagcugcaagagaaaua

SEQ ID NO: 619076 - RNA, 19 nt, Homo sapiens
gaaauaaacucaccuucua

SEQ ID NO: 619077 - RNA, 19 nt, Homo sapiens
caaaggcuaucucuucaua

SEQ ID NO: 619078 - RNA, 19 nt, Homo sapiens
gcaaguagcaucucugauu

SEQ ID NO: 619079 - RNA, 19 nt, Homo sapiens
ggaauuggcgcuuucacua

SEQ ID NO: 619080 - RNA, 19 nt, Homo sapiens
ccaacaacauagcaauuaa

SEQ ID NO: 619081 - RNA, 19 nt, Homo sapiens
uaauggagcuagaaauaug

SEQ ID NO: 619082 - RNA, 19 nt, Homo sapiens
gagcauuaguggucacaaa

SEQ ID NO: 619083 - RNA, 19 nt, Homo sapiens
caaguagcaucucugauug

SEQ ID NO: 619084 - RNA, 19 nt, Homo sapiens
gaagcagccuauugcagaa

SEQ ID NO: 619085 - RNA, 19 nt, Homo sapiens
gcagaagagugggaucauu

SEQ ID NO: 619086 - RNA, 19 nt, Homo sapiens
cauauugacugcagacaga

SEQ ID NO: 619087 - RNA, 19 nt, Homo sapiens
ggacuaugaugcucuacau

SEQ ID NO: 619088 - RNA, 19 nt, Homo sapiens
gcacucuucuaucagguuu

SEQ ID NO: 619089 - RNA, 19 nt, Homo sapiens
agcaagagauggaguauga

SEQ ID NO: 619090 - RNA, 19 nt, Homo sapiens
ccaguugacuucagcauca

SEQ ID NO: 619091 - RNA, 19 nt, Homo sapiens
ccuaauggagcuagaaaua

SEQ ID NO: 619092 - RNA, 19 nt, Homo sapiens
ggcuaucucuucauauuga

SEQ ID NO: 619093 - RNA, 19 nt, Homo sapiens
uuucaucccuuaagccaua

SEQ ID NO: 619094 - RNA, 19 nt, Homo sapiens
cauaauccacuucaaugua

SEQ ID NO: 619095 - RNA, 19 nt, Homo sapiens
cagagcggcugauacagaa

SEQ ID NO: 619096 - RNA, 19 nt, Homo sapiens
ggagugaagcagccuauug

SEQ ID NO: 619097 - RNA, 19 nt, Homo sapiens
gaucauugaccuaaaggaa

SEQ ID NO: 619098 - RNA, 19 nt, Homo sapiens
gaauagggcccugacuuug

SEQ ID NO: 619099 - RNA, 19 nt, Homo sapiens
caaccucuccuuugcauau

SEQ ID NO: 619100 - RNA, 19 nt, Homo sapiens
gcugcgaccucucuauaug

SEQ ID NO: 619101 - RNA, 19 nt, Homo sapiens
gggcuugucuccuuucuac

SEQ ID NO: 619102 - RNA, 19 nt, Homo sapiens
uuagagggcuugucuccuu

SEQ ID NO: 619103 - RNA, 19 nt, Homo sapiens
ggacccaacacuagaagaa

SEQ ID NO: 619104 - RNA, 19 nt, Homo sapiens
gaauggacaguuucuuaga

SEQ ID NO: 619105 - RNA, 19 nt, Homo sapiens
aaggcuaucucuucauauu

SEQ ID NO: 619106 - RNA, 19 nt, Homo sapiens
gagcggcugauacagaaua

SEQ ID NO: 619107 - RNA, 19 nt, Homo sapiens
aagcgaaucucaaaguugu

SEQ ID NO: 619108 - RNA, 19 nt, Homo sapiens
gacagaaacacaagaaauc

SEQ ID NO: 619109 - RNA, 19 nt, Homo sapiens
uaaaguguguggacauuuu

SEQ ID NO: 619110 - RNA, 19 nt, Homo sapiens
cagcaucaguccaccucua

SEQ ID NO: 619111 - RNA, 19 nt, Homo sapiens
ucccuuaccuaaucaacua

SEQ ID NO: 619112 - RNA, 19 nt, Homo sapiens
ccucuuuccuuuccuuuga

SEQ ID NO: 619113 - RNA, 19 nt, Homo sapiens
acccaacacuagaagaaua

SEQ ID NO: 619114 - RNA, 19 nt, Homo sapiens
ggacuacacaguggagaaa

SEQ ID NO: 619115 - RNA, 19 nt, Homo sapiens
guauagaccaguugacuuc

SEQ ID NO: 619116 - RNA, 19 nt, Homo sapiens
uggaugcucuagauuggua

SEQ ID NO: 619117 - RNA, 19 nt, Homo sapiens
agaauagggcccugacuuu

SEQ ID NO: 619118 - RNA, 19 nt, Homo sapiens
aaauugaucucaugagcau

SEQ ID NO: 619119 - RNA, 19 nt, Homo sapiens
cugaauggacaguuucuua

SEQ ID NO: 619120 - RNA, 19 nt, Homo sapiens
ucuaucagguuuggaauug

SEQ ID NO: 619121 - RNA, 19 nt, Homo sapiens
cggcugauacagaauauaa

SEQ ID NO: 619122 - RNA, 19 nt, Homo sapiens
acaagcgaaucucaaaguu

SEQ ID NO: 619123 - RNA, 19 nt, Homo sapiens
gacagugcccacacccuua

SEQ ID NO: 619124 - RNA, 19 nt, Homo sapiens
ggagcccucuuaugugcuu

SEQ ID NO: 619125 - RNA, 19 nt, Homo sapiens
cagaagagugggaucauug

SEQ ID NO: 619126 - RNA, 19 nt, Homo sapiens
ugacagaaacacaagaaau

SEQ ID NO: 619127 - RNA, 19 nt, Homo sapiens
gauggaguaugaccacaag

SEQ ID NO: 619128 - RNA, 19 nt, Homo sapiens
ccagacagaacacaaaugu

SEQ ID NO: 619129 - RNA, 19 nt, Homo sapiens
ggagaaauaaacucaccuu

SEQ ID NO: 619130 - RNA, 19 nt, Homo sapiens
uggaccagcuucuuuaaca

SEQ ID NO: 619131 - RNA, 19 nt, Homo sapiens
gcaagaggaaccaaagaag

SEQ ID NO: 619132 - RNA, 19 nt, Homo sapiens
gcauaauccacuucaaugu

SEQ ID NO: 619133 - RNA, 19 nt, Homo sapiens
gugaaucgucuucgagaaa

SEQ ID NO: 619134 - RNA, 19 nt, Homo sapiens
gcugauacagaauauaaug

SEQ ID NO: 619135 - RNA, 19 nt, Homo sapiens
gcuagaaauaugucuguga

SEQ ID NO: 619136 - RNA, 19 nt, Homo sapiens
gccaugcucccuuaccuaa

SEQ ID NO: 619137 - RNA, 19 nt, Homo sapiens
cagcaagcauaauccacuu

SEQ ID NO: 619138 - RNA, 19 nt, Homo sapiens
gcaugugaaucgucuucga

SEQ ID NO: 619139 - RNA, 19 nt, Homo sapiens
cagauguggugaugaaugg

SEQ ID NO: 619140 - RNA, 19 nt, Homo sapiens
gagcaagaggaaccaaaga

SEQ ID NO: 619141 - RNA, 19 nt, Homo sapiens
caucaguccaccucuauga

SEQ ID NO: 619142 - RNA, 19 nt, Homo sapiens
gaaucgucuucgagaaaug

SEQ ID NO: 619143 - RNA, 19 nt, Homo sapiens
uuagcgcacucuucuauca

SEQ ID NO: 619144 - RNA, 19 nt, Homo sapiens
gugcugcgaccucucuaua

SEQ ID NO: 619145 - RNA, 19 nt, Homo sapiens
gcaguuccagaaagguaua

SEQ ID NO: 619146 - RNA, 19 nt, Homo sapiens
gcaagcauaauccacuuca

SEQ ID NO: 619147 - RNA, 19 nt, Homo sapiens
caagaggaaccaaagaagu

SEQ ID NO: 619148 - RNA, 19 nt, Homo sapiens
ugaaucgucuucgagaaau

SEQ ID NO: 619149 - RNA, 19 nt, Homo sapiens
uggcacugaugaggauuua

SEQ ID NO: 619150 - RNA, 19 nt, Homo sapiens
gagcaauuggcacugauga

SEQ ID NO: 619151 - RNA, 19 nt, Homo sapiens
uugaugccaugcucccuua

SEQ ID NO: 619152 - RNA, 19 nt, Homo sapiens
caugcucccuuaccuaauc

SEQ ID NO: 619153 - RNA, 19 nt, Homo sapiens
caagcgaaucucaaaguug

SEQ ID NO: 619154 - RNA, 19 nt, Homo sapiens
gcuacugaauccaacaaca

SEQ ID NO: 619155 - RNA, 19 nt, Homo sapiens
uagagggcuugucuccuuu

SEQ ID NO: 619156 - RNA, 19 nt, Homo sapiens
cuuaagccauagagacauu

SEQ ID NO: 619157 - RNA, 19 nt, Homo sapiens
ggauuuagcgcacucuucu

SEQ ID NO: 619158 - RNA, 19 nt, Homo sapiens
uccaacaacauagcaauua

SEQ ID NO: 619159 - RNA, 19 nt, Homo sapiens
gagcuagaaauaugucugu

SEQ ID NO: 619160 - RNA, 19 nt, Homo sapiens
guaucaaccucuccuuugc

SEQ ID NO: 619161 - RNA, 19 nt, Homo sapiens
gaucucaugagcauuagug

SEQ ID NO: 619162 - RNA, 19 nt, Homo sapiens
gagcugauccucgugagau

SEQ ID NO: 619163 - RNA, 19 nt, Homo sapiens
gauuugcaguuccagaaag

SEQ ID NO: 619164 - RNA, 19 nt, Homo sapiens
ggauuugcaguuccagaaa

SEQ ID NO: 619165 - RNA, 19 nt, Homo sapiens
ggaacuagaggcugcuauc

SEQ ID NO: 619166 - RNA, 19 nt, Homo sapiens
cagcaaguagcaucucuga

SEQ ID NO: 619167 - RNA, 19 nt, Homo sapiens
ggaccagcuucuuuaacag

SEQ ID NO: 619168 - RNA, 19 nt, Homo sapiens
cagggacuaugaugcucua

SEQ ID NO: 619169 - RNA, 19 nt, Homo sapiens
ggaggaaguggacuacaca

SEQ ID NO: 619170 - RNA, 19 nt, Homo sapiens
uuagagcaauuggcacuga

SEQ ID NO: 619171 - RNA, 19 nt, Homo sapiens
gaucaccacccagacagaa

SEQ ID NO: 619172 - RNA, 19 nt, Homo sapiens
gaccuaauggagcuagaaa

SEQ ID NO: 619173 - RNA, 19 nt, Homo sapiens
uccaaaggcuaucucuuca

SEQ ID NO: 619174 - RNA, 19 nt, Homo sapiens
gagagcaagaggaaccaaa

SEQ ID NO: 619175 - RNA, 19 nt, Homo sapiens
caagcauaauccacuucaa

SEQ ID NO: 619176 - RNA, 19 nt, Homo sapiens
gcaaauaccugaagaagaa

SEQ ID NO: 619177 - RNA, 19 nt, Homo sapiens
gaacugaggugguaaagaa

SEQ ID NO: 619178 - RNA, 19 nt, Homo sapiens
gaagaaaccuggaggcuuu

SEQ ID NO: 619179 - RNA, 19 nt, Homo sapiens
ggaaagcgcugcaauuaga

SEQ ID NO: 619180 - RNA, 19 nt, Homo sapiens
cagcgcaacuucagcauua

SEQ ID NO: 619181 - RNA, 19 nt, Homo sapiens
gaguggagcugguucagua

SEQ ID NO: 619182 - RNA, 19 nt, Homo sapiens
uagaagagcugaaccaguu

SEQ ID NO: 619183 - RNA, 19 nt, Homo sapiens
gagcagcuuuguuaaauug

SEQ ID NO: 619184 - RNA, 19 nt, Homo sapiens
gaaagcccaucauagguuu

SEQ ID NO: 619185 - RNA, 19 nt, Homo sapiens
gagaagcccugaucaguca

SEQ ID NO: 619186 - RNA, 19 nt, Homo sapiens
gaccagcgguuacaaagaa

SEQ ID NO: 619187 - RNA, 19 nt, Homo sapiens
gaggaaagccugaaggaaa

SEQ ID NO: 619188 - RNA, 19 nt, Homo sapiens
gaugauugcugaagaggaa

SEQ ID NO: 619189 - RNA, 19 nt, Homo sapiens
aaagagaugugguguguga

SEQ ID NO: 619190 - RNA, 19 nt, Homo sapiens
acaaagaacugagguggua

SEQ ID NO: 619191 - RNA, 19 nt, Homo sapiens
guuuaggcauguucaauua

SEQ ID NO: 619192 - RNA, 19 nt, Homo sapiens
aaagacaacugaagaacaa

SEQ ID NO: 619193 - RNA, 19 nt, Homo sapiens
ugacuucucuaccacauaa

SEQ ID NO: 619194 - RNA, 19 nt, Homo sapiens
gaacugugcgaaauucuuu

SEQ ID NO: 619195 - RNA, 19 nt, Homo sapiens
uaaagaagcauaucaagga

SEQ ID NO: 619196 - RNA, 19 nt, Homo sapiens
gaaugaguguuacaguuga

SEQ ID NO: 619197 - RNA, 19 nt, Homo sapiens
ggcaacaugugacaacuuu

SEQ ID NO: 619198 - RNA, 19 nt, Homo sapiens
gcacguaagcugaacacua

SEQ ID NO: 619199 - RNA, 19 nt, Homo sapiens
gaaggaaagacucaucaaa

SEQ ID NO: 619200 - RNA, 19 nt, Homo sapiens
ggaaauaugggagcuaauu

SEQ ID NO: 619201 - RNA, 19 nt, Homo sapiens
caacauaguguaaaugguu

SEQ ID NO: 619202 - RNA, 19 nt, Homo sapiens
gggagcagcuuuguuaaau

SEQ ID NO: 619203 - RNA, 19 nt, Homo sapiens
gggccuaacuuaaagaugu

SEQ ID NO: 619204 - RNA, 19 nt, Homo sapiens
guggagaucuggaacuuug

SEQ ID NO: 619205 - RNA, 19 nt, Homo sapiens
ggagcagcuuuguuaaauu

SEQ ID NO: 619206 - RNA, 19 nt, Homo sapiens
gaagaugccuuuuguuugu

SEQ ID NO: 619207 - RNA, 19 nt, Homo sapiens
ugaaagagauguggugugu

SEQ ID NO: 619208 - RNA, 19 nt, Homo sapiens
gcugaggacuacacagaaa

SEQ ID NO: 619209 - RNA, 19 nt, Homo sapiens
cagcaccuauucugaguuu

SEQ ID NO: 619210 - RNA, 19 nt, Homo sapiens
ggagaauauugcaacacua

SEQ ID NO: 619211 - RNA, 19 nt, Homo sapiens
caagaacugugcgaaauuc

SEQ ID NO: 619212 - RNA, 19 nt, Homo sapiens
ggacagccuuccuccugaa

SEQ ID NO: 619213 - RNA, 19 nt, Homo sapiens
gaaagacaacugaagaaca

SEQ ID NO: 619214 - RNA, 19 nt, Homo sapiens
ggcagaaauucauggagua

SEQ ID NO: 619215 - RNA, 19 nt, Homo sapiens
gaaauaugggagcuaauug

SEQ ID NO: 619216 - RNA, 19 nt, Homo sapiens
gugaggaguuugucaguau

SEQ ID NO: 619217 - RNA, 19 nt, Homo sapiens
gcaaagcacguaagcugaa

SEQ ID NO: 619218 - RNA, 19 nt, Homo sapiens
gaaaugcagaaaucacaaa

SEQ ID NO: 619219 - RNA, 19 nt, Homo sapiens
caacaugugacaacuuuga

SEQ ID NO: 619220 - RNA, 19 nt, Homo sapiens
uaaaucaccuucgggaaau

SEQ ID NO: 619221 - RNA, 19 nt, Homo sapiens
gagauggccugcccuacug

SEQ ID NO: 619222 - RNA, 19 nt, Homo sapiens
gcaagaagugcaaauuuua

SEQ ID NO: 619223 - RNA, 19 nt, Homo sapiens
gugaaugaguguuacaguu

SEQ ID NO: 619224 - RNA, 19 nt, Homo sapiens
gaccaugggccuaacuuaa

SEQ ID NO: 619225 - RNA, 19 nt, Homo sapiens
caaaggcauuuauggugaa

SEQ ID NO: 619226 - RNA, 19 nt, Homo sapiens
gaacauucaaaggcauuua

SEQ ID NO: 619227 - RNA, 19 nt, Homo sapiens
gcuccacgaugcugagauu

SEQ ID NO: 619228 - RNA, 19 nt, Homo sapiens
gaagcuguggccaccauua

SEQ ID NO: 619229 - RNA, 19 nt, Homo sapiens
ccggaaagcgcugcaauua

SEQ ID NO: 619230 - RNA, 19 nt, Homo sapiens
gaucaagaacugugcgaaa

SEQ ID NO: 619231 - RNA, 19 nt, Homo sapiens
gcagcgaguuacauguuga

SEQ ID NO: 619232 - RNA, 19 nt, Homo sapiens
guauaccuguaacuaguaa

SEQ ID NO: 619233 - RNA, 19 nt, Homo sapiens
agacuggaccuaauuauau

SEQ ID NO: 619234 - RNA, 19 nt, Homo sapiens
gcggaggaguccauaguau

SEQ ID NO: 619235 - RNA, 19 nt, Homo sapiens
uaaauuguguucaguucug

SEQ ID NO: 619236 - RNA, 19 nt, Homo sapiens
ccacgcuguuuaccucaua

SEQ ID NO: 619237 - RNA, 19 nt, Homo sapiens
gcagaaagcccuaaaucac

SEQ ID NO: 619238 - RNA, 19 nt, Homo sapiens
agaaauucauggaguaugu

SEQ ID NO: 619239 - RNA, 19 nt, Homo sapiens
gaacaggaacauucaaagg

SEQ ID NO: 619240 - RNA, 19 nt, Homo sapiens
aaagaagcauaucaaggaa

SEQ ID NO: 619241 - RNA, 19 nt, Homo sapiens
gagaaaagcuucagaucca

SEQ ID NO: 619242 - RNA, 19 nt, Homo sapiens
gcacccaaguggaauugau

SEQ ID NO: 619243 - RNA, 19 nt, Homo sapiens
gcucuagcuuccacgauga

SEQ ID NO: 619244 - RNA, 19 nt, Homo sapiens
ggcaagaagugcaaauuuu

SEQ ID NO: 619245 - RNA, 19 nt, Homo sapiens
gacuggaccuaauuauaug

SEQ ID NO: 619246 - RNA, 19 nt, Homo sapiens
cuaaaucaccuucgggaaa

SEQ ID NO: 619247 - RNA, 19 nt, Homo sapiens
ggguugagcugucuuuguc

SEQ ID NO: 619248 - RNA, 19 nt, Homo sapiens
gagacuugguuuugacuua

SEQ ID NO: 619249 - RNA, 19 nt, Homo sapiens
cacguaagcugaacacuac

SEQ ID NO: 619250 - RNA, 19 nt, Homo sapiens
gaauauugcaacacuacaa

SEQ ID NO: 619251 - RNA, 19 nt, Homo sapiens
ugaggaguuugucaguaua

SEQ ID NO: 619252 - RNA, 19 nt, Homo sapiens
gcaguugccagccagauug

SEQ ID NO: 619253 - RNA, 19 nt, Homo sapiens
guuaaauuguguucaguuc

SEQ ID NO: 619254 - RNA, 19 nt, Homo sapiens
caaaggcuuccaaaucuga

SEQ ID NO: 619255 - RNA, 19 nt, Homo sapiens
aaugggagaugcaucgauu

SEQ ID NO: 619256 - RNA, 19 nt, Homo sapiens
ucuuagaguuugagagaaa

SEQ ID NO: 619257 - RNA, 19 nt, Homo sapiens
ccuauccucucaaucacua

SEQ ID NO: 619258 - RNA, 19 nt, Homo sapiens
gcauguauaccuguaacua

SEQ ID NO: 619259 - RNA, 19 nt, Homo sapiens
caacauccaguccugagaa

SEQ ID NO: 619260 - RNA, 19 nt, Homo sapiens
gagaagcuguggccaccau

SEQ ID NO: 619261 - RNA, 19 nt, Homo sapiens
guaggaaaaugauugacua

SEQ ID NO: 619262 - RNA, 19 nt, Homo sapiens
ccacauaauucuacuugcu

SEQ ID NO: 619263 - RNA, 19 nt, Homo sapiens
ugaaugaguguuacaguug

SEQ ID NO: 619264 - RNA, 19 nt, Homo sapiens
gagauguggugugugaaga

SEQ ID NO: 619265 - RNA, 19 nt, Homo sapiens
uagacuggaccuaauuaua

SEQ ID NO: 619266 - RNA, 19 nt, Homo sapiens
ucacaaggaacucuuugaa

SEQ ID NO: 619267 - RNA, 19 nt, Homo sapiens
gaacuuugcacaugucacu

SEQ ID NO: 619268 - RNA, 19 nt, Homo sapiens
caauuaaugcuguagcuau

SEQ ID NO: 619269 - RNA, 19 nt, Homo sapiens
gaacuccuggauaugauga

SEQ ID NO: 619270 - RNA, 19 nt, Homo sapiens
ugaaagcccaucauagguu

SEQ ID NO: 619271 - RNA, 19 nt, Homo sapiens
uaggagugcuugaaaccuu

SEQ ID NO: 619272 - RNA, 19 nt, Homo sapiens
guccagaagugggaagaaa

SEQ ID NO: 619273 - RNA, 19 nt, Homo sapiens
gaaagcgcugcaauuagaa

SEQ ID NO: 619274 - RNA, 19 nt, Homo sapiens
gcagaaaucacaaaaugaa

SEQ ID NO: 619275 - RNA, 19 nt, Homo sapiens
gguguuagccacgcuguuu

SEQ ID NO: 619276 - RNA, 19 nt, Homo sapiens
gagcagagcugacaaagga

SEQ ID NO: 619277 - RNA, 19 nt, Homo sapiens
gaacugggcaccaccauua

SEQ ID NO: 619278 - RNA, 19 nt, Homo sapiens
ggacccagaugguugcuua

SEQ ID NO: 619279 - RNA, 19 nt, Homo sapiens
ugaccaauguggccuauua

SEQ ID NO: 619280 - RNA, 19 nt, Homo sapiens
aaggagaucucacugcuua

SEQ ID NO: 619281 - RNA, 19 nt, Homo sapiens
ccaagggugugcucauaua

SEQ ID NO: 619282 - RNA, 19 nt, Homo sapiens
ggaggagcaugucagguuu

SEQ ID NO: 619283 - RNA, 19 nt, Homo sapiens
gaggagagaugcccaagca

SEQ ID NO: 619284 - RNA, 19 nt, Homo sapiens
ccaauuuccugucuccuuu

SEQ ID NO: 619285 - RNA, 19 nt, Homo sapiens
uaucacaggugcuggauga

SEQ ID NO: 619286 - RNA, 19 nt, Homo sapiens
cuaggcagcuucaaccuuu

SEQ ID NO: 619287 - RNA, 19 nt, Homo sapiens
gagagagagugcuguguau

SEQ ID NO: 619288 - RNA, 19 nt, Homo sapiens
gcaccaccauuaagaaauc

SEQ ID NO: 619289 - RNA, 19 nt, Homo sapiens
ggaagcuggugaaggguuu

SEQ ID NO: 619290 - RNA, 19 nt, Homo sapiens
uaacugugccuaugucaaa

SEQ ID NO: 619291 - RNA, 19 nt, Homo sapiens
ggucaucguugcaggcauu

SEQ ID NO: 619292 - RNA, 19 nt, Homo sapiens
gcuaaaguauuggcacuga

SEQ ID NO: 619293 - RNA, 19 nt, Homo sapiens
gugagaaccugcuuauauc

SEQ ID NO: 619294 - RNA, 19 nt, Homo sapiens
ugacagcacugaguaugaa

SEQ ID NO: 619295 - RNA, 19 nt, Homo sapiens
gcucuucaaugguaucaug

SEQ ID NO: 619296 - RNA, 19 nt, Homo sapiens
ucucugcucuucaauggua

SEQ ID NO: 619297 - RNA, 19 nt, Homo sapiens
ucaacuaugucacugaaga

SEQ ID NO: 619298 - RNA, 19 nt, Homo sapiens
cauauacagugccuccuuu

SEQ ID NO: 619299 - RNA, 19 nt, Homo sapiens
ggaggcaccuguccagaag

SEQ ID NO: 619300 - RNA, 19 nt, Homo sapiens
ccagaugguugcuuaauac

SEQ ID NO: 619301 - RNA, 19 nt, Homo sapiens
gguuugggcuugguuguuu

SEQ ID NO: 619302 - RNA, 19 nt, Homo sapiens
gggacacccucaacuaugu

SEQ ID NO: 619303 - RNA, 19 nt, Homo sapiens
gcucaggcaucuuuguuuc

SEQ ID NO: 619304 - RNA, 19 nt, Homo sapiens
gaucggcucaggcaucuuu

SEQ ID NO: 619305 - RNA, 19 nt, Homo sapiens
ccuccacccuucuugcuua

SEQ ID NO: 619306 - RNA, 19 nt, Homo sapiens
ggugcuggaugacaauaaa

SEQ ID NO: 619307 - RNA, 19 nt, Homo sapiens
caccuaugcuaaaguauug

SEQ ID NO: 619308 - RNA, 19 nt, Homo sapiens
cagggagccucuacucauu

SEQ ID NO: 619309 - RNA, 19 nt, Homo sapiens
gaacccugguacaagauau

SEQ ID NO: 619310 - RNA, 19 nt, Homo sapiens
cgugagaaccugcuuauau

SEQ ID NO: 619311 - RNA, 19 nt, Homo sapiens
cccagaugguugcuuaaua

SEQ ID NO: 619312 - RNA, 19 nt, Homo sapiens
gcagaucagauauuuggaa

SEQ ID NO: 619313 - RNA, 19 nt, Homo sapiens
gcacuguacucagcucugu

SEQ ID NO: 619314 - RNA, 19 nt, Homo sapiens
ugagagagcaccuucuuau

SEQ ID NO: 619315 - RNA, 19 nt, Homo sapiens
gggaggagcaugucagguu

SEQ ID NO: 619316 - RNA, 19 nt, Homo sapiens
cuacuccucuuuucuuuua

SEQ ID NO: 619317 - RNA, 19 nt, Homo sapiens
gagagagugcuguguauuc

SEQ ID NO: 619318 - RNA, 19 nt, Homo sapiens
acucagcucuguucuccua

SEQ ID NO: 619319 - RNA, 19 nt, Homo sapiens
ggaccucccugcucaucau

SEQ ID NO: 619320 - RNA, 19 nt, Homo sapiens
ccacaaugcuccaauuucc

SEQ ID NO: 619321 - RNA, 19 nt, Homo sapiens
gucaguugcugcagaaaug

SEQ ID NO: 619322 - RNA, 19 nt, Homo sapiens
agaaagugcugagccaaga

SEQ ID NO: 619323 - RNA, 19 nt, Homo sapiens
agagagacaugaaacuauc

SEQ ID NO: 619324 - RNA, 19 nt, Homo sapiens
ggacaaugaaggugacugu

SEQ ID NO: 619325 - RNA, 19 nt, Homo sapiens
ggcuagagcuaaggaaguu

SEQ ID NO: 619326 - RNA, 19 nt, Homo sapiens
ucagagugccagaacauaa

SEQ ID NO: 619327 - RNA, 19 nt, Homo sapiens
cagaucagauauuuggaau

SEQ ID NO: 619328 - RNA, 19 nt, Homo sapiens
ucacugaagagaucaagaa

SEQ ID NO: 619329 - RNA, 19 nt, Homo sapiens
uuucaccuaugcuaaagua

SEQ ID NO: 619330 - RNA, 19 nt, Homo sapiens
ccucaacuaugucacugaa

SEQ ID NO: 619331 - RNA, 19 nt, Homo sapiens
caucauugccaucaccuuu

SEQ ID NO: 619332 - RNA, 19 nt, Homo sapiens
gcuccuagcugccccuuuu

SEQ ID NO: 619333 - RNA, 19 nt, Homo sapiens
agagagcaccuucuuauca

SEQ ID NO: 619334 - RNA, 19 nt, Homo sapiens
ggaacccugguacaagaua

SEQ ID NO: 619335 - RNA, 19 nt, Homo sapiens
gagagcaccuucuuaucac

SEQ ID NO: 619336 - RNA, 19 nt, Homo sapiens
gcuuaaauccauaggcauu

SEQ ID NO: 619337 - RNA, 19 nt, Homo sapiens
ucucaggccugcccuuuua

SEQ ID NO: 619338 - RNA, 19 nt, Homo sapiens
ucaguugcauuauccuguu

SEQ ID NO: 619339 - RNA, 19 nt, Homo sapiens
gcugggacacccucaacua

SEQ ID NO: 619340 - RNA, 19 nt, Homo sapiens
ggccagcuaugccuauauc

SEQ ID NO: 619341 - RNA, 19 nt, Homo sapiens
gggcaccaccauuaagaaa

SEQ ID NO: 619342 - RNA, 19 nt, Homo sapiens
ccacccuucuugcuuaaau

SEQ ID NO: 619343 - RNA, 19 nt, Homo sapiens
uaaggaaguugaaaaggaa

SEQ ID NO: 619344 - RNA, 19 nt, Homo sapiens
ucuuccagcucauuaacua

SEQ ID NO: 619345 - RNA, 19 nt, Homo sapiens
agagagagagugcugugua

SEQ ID NO: 619346 - RNA, 19 nt, Homo sapiens
gacaucuuccagcucauua

SEQ ID NO: 619347 - RNA, 19 nt, Homo sapiens
cugaagagaucaagaaucc

SEQ ID NO: 619348 - RNA, 19 nt, Homo sapiens
ucaccuaugcuaaaguauu

SEQ ID NO: 619349 - RNA, 19 nt, Homo sapiens
ggaggccuuuggaggauuc

SEQ ID NO: 619350 - RNA, 19 nt, Homo sapiens
aggugaagcugaagaagga

SEQ ID NO: 619351 - RNA, 19 nt, Homo sapiens
ggacacagagagagagagu

SEQ ID NO: 619352 - RNA, 19 nt, Homo sapiens
ggaagauggaggagagaug

SEQ ID NO: 619353 - RNA, 19 nt, Homo sapiens
cuuugaggguucaucauuu

SEQ ID NO: 619354 - RNA, 19 nt, Homo sapiens
caagauauuuucaccuaug

SEQ ID NO: 619355 - RNA, 19 nt, Homo sapiens
ggcccacaaugcuccaauu

SEQ ID NO: 619356 - RNA, 19 nt, Homo sapiens
gaaggagaucucacugcuu

SEQ ID NO: 619357 - RNA, 19 nt, Homo sapiens
cacaggugcuggaugacaa

SEQ ID NO: 619358 - RNA, 19 nt, Homo sapiens
uaugucaguugcugcagaa

SEQ ID NO: 619359 - RNA, 19 nt, Homo sapiens
gagacaucuuggccaguga

SEQ ID NO: 619360 - RNA, 19 nt, Homo sapiens
ggaacugggcaccaccauu

SEQ ID NO: 619361 - RNA, 19 nt, Homo sapiens
cggagcaggugaagcugaa

SEQ ID NO: 619362 - RNA, 19 nt, Homo sapiens
ugucuggccuucccuuuua

SEQ ID NO: 619363 - RNA, 19 nt, Homo sapiens
uagagagacaugaaacuau

SEQ ID NO: 619364 - RNA, 19 nt, Homo sapiens
gcccacaaugcuccaauuu

SEQ ID NO: 619365 - RNA, 19 nt, Homo sapiens
ucaucuauaucuugaccaa

SEQ ID NO: 619366 - RNA, 19 nt, Homo sapiens
cuaugucacugaagagauc

SEQ ID NO: 619367 - RNA, 19 nt, Homo sapiens
gagagagcaccuucuuauc

SEQ ID NO: 619368 - RNA, 19 nt, Homo sapiens
gcaggcauuguuagacuug

SEQ ID NO: 619369 - RNA, 19 nt, Homo sapiens
uuagagagacaugaaacua

SEQ ID NO: 619370 - RNA, 19 nt, Homo sapiens
caauuuccugucuccuuua

SEQ ID NO: 619371 - RNA, 19 nt, Homo sapiens
gggcuugguuguuuuagaa

SEQ ID NO: 619372 - RNA, 19 nt, Homo sapiens
agacaugagagacaucuug

SEQ ID NO: 619373 - RNA, 19 nt, Homo sapiens
caauguggccuauuauacu

SEQ ID NO: 619374 - RNA, 19 nt, Homo sapiens
ccaauguggccuauuauac

SEQ ID NO: 619375 - RNA, 19 nt, Homo sapiens
uaacggcgugugccugauu

SEQ ID NO: 619376 - RNA, 19 nt, Homo sapiens
gaacaugacuucugucuga

SEQ ID NO: 619377 - RNA, 19 nt, Homo sapiens
gaagguaccucccugugua

SEQ ID NO: 619378 - RNA, 19 nt, Homo sapiens
gcccaacucuccugaauua

SEQ ID NO: 619379 - RNA, 19 nt, Homo sapiens
ggaauaaccuuggccauau

SEQ ID NO: 619380 - RNA, 19 nt, Homo sapiens
gcugguggcuucugaauuu

SEQ ID NO: 619381 - RNA, 19 nt, Homo sapiens
gaaagcaagaugucuaaua

SEQ ID NO: 619382 - RNA, 19 nt, Homo sapiens
ggaagucagucaguaauuu

SEQ ID NO: 619383 - RNA, 19 nt, Homo sapiens
gaauaaccuuggccauaua

SEQ ID NO: 619384 - RNA, 19 nt, Homo sapiens
ugaccaauguggccuauua

SEQ ID NO: 619385 - RNA, 19 nt, Homo sapiens
guacaacaccugacuuuaa

SEQ ID NO: 619386 - RNA, 19 nt, Homo sapiens
ggagguggcuuaugaaagu

SEQ ID NO: 619387 - RNA, 19 nt, Homo sapiens
gaacaacuccauguagaua

SEQ ID NO: 619388 - RNA, 19 nt, Homo sapiens
uguaagaguuguagucaua

SEQ ID NO: 619389 - RNA, 19 nt, Homo sapiens
cagcuacgcuuauauucua

SEQ ID NO: 619390 - RNA, 19 nt, Homo sapiens
caaaggaagucagucagua

SEQ ID NO: 619391 - RNA, 19 nt, Homo sapiens
gacauaaagucaaagaaug

SEQ ID NO: 619392 - RNA, 19 nt, Homo sapiens
gcaguuaacucuggacuca

SEQ ID NO: 619393 - RNA, 19 nt, Homo sapiens
ugucagcccuuuaauauug

SEQ ID NO: 619394 - RNA, 19 nt, Homo sapiens
guacuggacccauuuauga

SEQ ID NO: 619395 - RNA, 19 nt, Homo sapiens
gggaguggauucuaaaugu

SEQ ID NO: 619396 - RNA, 19 nt, Homo sapiens
ugacuugccugaacgcuaa

SEQ ID NO: 619397 - RNA, 19 nt, Homo sapiens
ggacauaaagucaaagaau

SEQ ID NO: 619398 - RNA, 19 nt, Homo sapiens
cuugagaccuuacaucuuu

SEQ ID NO: 619399 - RNA, 19 nt, Homo sapiens
agaaaugucugugguauug

SEQ ID NO: 619400 - RNA, 19 nt, Homo sapiens
uuaaaggccugaaaugcua

SEQ ID NO: 619401 - RNA, 19 nt, Homo sapiens
gaagcuuacugcuaaugaa

SEQ ID NO: 619402 - RNA, 19 nt, Homo sapiens
gggcccaagucaucaaaua

SEQ ID NO: 619403 - RNA, 19 nt, Homo sapiens
ucacguaccuguuacacuu

SEQ ID NO: 619404 - RNA, 19 nt, Homo sapiens
gaauggcuuucaauccuuu

SEQ ID NO: 619405 - RNA, 19 nt, Homo sapiens
ccuaauggaucuuacugua

SEQ ID NO: 619406 - RNA, 19 nt, Homo sapiens
ggagagauacuuaggaaau

SEQ ID NO: 619407 - RNA, 19 nt, Homo sapiens
gagaagaaccugcuagcuu

SEQ ID NO: 619408 - RNA, 19 nt, Homo sapiens
ggacuucauuuccuucuca

SEQ ID NO: 619409 - RNA, 19 nt, Homo sapiens
ggaauguccuggcugcuau

SEQ ID NO: 619410 - RNA, 19 nt, Homo sapiens
gaugaaggagagauacuua

SEQ ID NO: 619411 - RNA, 19 nt, Homo sapiens
gagcuaauccuuuaagcaa

SEQ ID NO: 619412 - RNA, 19 nt, Homo sapiens
aaggacagaugaacaaauu

SEQ ID NO: 619413 - RNA, 19 nt, Homo sapiens
gcauacagauagaucauag

SEQ ID NO: 619414 - RNA, 19 nt, Homo sapiens
uacaacaccugacuuuaaa

SEQ ID NO: 619415 - RNA, 19 nt, Homo sapiens
ccucaaagguccuccgaaa

SEQ ID NO: 619416 - RNA, 19 nt, Homo sapiens
caaaauccuugcucaauaa

SEQ ID NO: 619417 - RNA, 19 nt, Homo sapiens
uaauggaucuuacuguaug

SEQ ID NO: 619418 - RNA, 19 nt, Homo sapiens
ggagccagcuacgcuuaua

SEQ ID NO: 619419 - RNA, 19 nt, Homo sapiens
ucacuuuccuaucaucuaa

SEQ ID NO: 619420 - RNA, 19 nt, Homo sapiens
uaagagggcugaaacuucu

SEQ ID NO: 619421 - RNA, 19 nt, Homo sapiens
acacagugcugaacauuuc

SEQ ID NO: 619422 - RNA, 19 nt, Homo sapiens
gggaauaaccuuggccaua

SEQ ID NO: 619423 - RNA, 19 nt, Homo sapiens
gaagagggaaugcuagguu

SEQ ID NO: 619424 - RNA, 19 nt, Homo sapiens
acucugcccucuucucuua

SEQ ID NO: 619425 - RNA, 19 nt, Homo sapiens
gcaaagggguccuacugua

SEQ ID NO: 619426 - RNA, 19 nt, Homo sapiens
gagaauggcuuucaauccu

SEQ ID NO: 619427 - RNA, 19 nt, Homo sapiens
caaagguccuccgaaacua

SEQ ID NO: 619428 - RNA, 19 nt, Homo sapiens
gaauuacuuucuuccaugu

SEQ ID NO: 619429 - RNA, 19 nt, Homo sapiens
gcaccaggcuuuguuuaca

SEQ ID NO: 619430 - RNA, 19 nt, Homo sapiens
gaacugugccuaugucaag

SEQ ID NO: 619431 - RNA, 19 nt, Homo sapiens
aagcagaaauagcuguuaa

SEQ ID NO: 619432 - RNA, 19 nt, Homo sapiens
ggcugaaacuucugauauu

SEQ ID NO: 619433 - RNA, 19 nt, Homo sapiens
caacaaugaaccuuaaaga

SEQ ID NO: 619434 - RNA, 19 nt, Homo sapiens
ggugggcucuucucuguug

SEQ ID NO: 619435 - RNA, 19 nt, Homo sapiens
ugaauguucuguguuguuu

SEQ ID NO: 619436 - RNA, 19 nt, Homo sapiens
gauguucgcguauuucuug

SEQ ID NO: 619437 - RNA, 19 nt, Homo sapiens
cuacagcacucaagcuuca

SEQ ID NO: 619438 - RNA, 19 nt, Homo sapiens
cagcuaaucccaggaauuu

SEQ ID NO: 619439 - RNA, 19 nt, Homo sapiens
gaaggaagcauggucauag

SEQ ID NO: 619440 - RNA, 19 nt, Homo sapiens
aggaagagcuugguacuug

SEQ ID NO: 619441 - RNA, 19 nt, Homo sapiens
caacucuccugaauuaaag

SEQ ID NO: 619442 - RNA, 19 nt, Homo sapiens
ggauuucuaugccaauugu

SEQ ID NO: 619443 - RNA, 19 nt, Homo sapiens
aaacauuacucaguggaaa

SEQ ID NO: 619444 - RNA, 19 nt, Homo sapiens
guucuguguuguuuccuua

SEQ ID NO: 619445 - RNA, 19 nt, Homo sapiens
gcagacaaguggaauuagg

SEQ ID NO: 619446 - RNA, 19 nt, Homo sapiens
guaaaucucuggguuucug

SEQ ID NO: 619447 - RNA, 19 nt, Homo sapiens
gaaacuaugcagcugaaga

SEQ ID NO: 619448 - RNA, 19 nt, Homo sapiens
gcaggaaccguuugucaug

SEQ ID NO: 619449 - RNA, 19 nt, Homo sapiens
gaguuuggaagcagaaaua

SEQ ID NO: 619450 - RNA, 19 nt, Homo sapiens
ggaaaggcauacggacaga

SEQ ID NO: 619451 - RNA, 19 nt, Homo sapiens
ggacaauguuacgcuagaa

SEQ ID NO: 619452 - RNA, 19 nt, Homo sapiens
ccuaggauguuuguuguuu

SEQ ID NO: 619453 - RNA, 19 nt, Homo sapiens
uaaccuuggccauauauuu

SEQ ID NO: 619454 - RNA, 19 nt, Homo sapiens
gaugucagcagggcaguua

SEQ ID NO: 619455 - RNA, 19 nt, Homo sapiens
ccacugcucagacuacuuu

SEQ ID NO: 619456 - RNA, 19 nt, Homo sapiens
cuuaaguccuugguauuua

SEQ ID NO: 619457 - RNA, 19 nt, Homo sapiens
guggaaagcuaaguucaga

SEQ ID NO: 619458 - RNA, 19 nt, Homo sapiens
guagauaagagcaagugua

SEQ ID NO: 619459 - RNA, 19 nt, Homo sapiens
ggaagagcuugguacuugu

SEQ ID NO: 619460 - RNA, 19 nt, Homo sapiens
gcugaaacuucugauauuc

SEQ ID NO: 619461 - RNA, 19 nt, Homo sapiens
ucacugacaccauuaauuc

SEQ ID NO: 619462 - RNA, 19 nt, Homo sapiens
caucaucgccaucaccuuu

SEQ ID NO: 619463 - RNA, 19 nt, Homo sapiens
ggacaucacaagaccauca

SEQ ID NO: 619464 - RNA, 19 nt, Homo sapiens
gagagauacuuaggaaauc

SEQ ID NO: 619465 - RNA, 19 nt, Homo sapiens
uaaguugucagcccuuuaa

SEQ ID NO: 619466 - RNA, 19 nt, Homo sapiens
ggaagcauggucauaguug

SEQ ID NO: 619467 - RNA, 19 nt, Homo sapiens
uaugggaugucacugauug

SEQ ID NO: 619468 - RNA, 19 nt, Homo sapiens
gaguuguagucauauugua

SEQ ID NO: 619469 - RNA, 19 nt, Homo sapiens
ggaguggauucuaaaugug

SEQ ID NO: 619470 - RNA, 19 nt, Homo sapiens
uauccagucuguauugcua

SEQ ID NO: 619471 - RNA, 19 nt, Homo sapiens
ucacaaccguuaucagagu

SEQ ID NO: 619472 - RNA, 19 nt, Homo sapiens
gcuaaucacauuucaagug

SEQ ID NO: 619473 - RNA, 19 nt, Homo sapiens
gugcaugccuaggauguuu

SEQ ID NO: 619474 - RNA, 19 nt, Homo sapiens
acaaguugcugccuguuau

SEQ ID NO: 619475 - RNA, 19 nt, Homo sapiens
guugucagcccuuuaauau

SEQ ID NO: 619476 - RNA, 19 nt, Homo sapiens
ggaagacggugaaccagaa

SEQ ID NO: 619477 - RNA, 19 nt, Homo sapiens
ugaccaagcuugauaaugg

SEQ ID NO: 619478 - RNA, 19 nt, Homo sapiens
cagaagaugccguggaaua

SEQ ID NO: 619479 - RNA, 19 nt, Homo sapiens
cggaagaacuuuggcauug

SEQ ID NO: 619480 - RNA, 19 nt, Homo sapiens
caucauacccuccaaguuc

SEQ ID NO: 619481 - RNA, 19 nt, Homo sapiens
gcuccuaccugaucguguu

SEQ ID NO: 619482 - RNA, 19 nt, Homo sapiens
gggcacaucucagccagaa

SEQ ID NO: 619483 - RNA, 19 nt, Homo sapiens
gaggugaccaagcuugaua

SEQ ID NO: 619484 - RNA, 19 nt, Homo sapiens
cagaguggcugggaaacaa

SEQ ID NO: 619485 - RNA, 19 nt, Homo sapiens
gccguggaauaucguguua

SEQ ID NO: 619486 - RNA, 19 nt, Homo sapiens
ggaagaacuuuggcauugg

SEQ ID NO: 619487 - RNA, 19 nt, Homo sapiens
uuaauccuguucccuauga

SEQ ID NO: 619488 - RNA, 19 nt, Homo sapiens
gaacacuggaaccugcaua

SEQ ID NO: 619489 - RNA, 19 nt, Homo sapiens
cccaugaccuuugcagaaa

SEQ ID NO: 619490 - RNA, 19 nt, Homo sapiens
gaagaugccguggaauauc

SEQ ID NO: 619491 - RNA, 19 nt, Homo sapiens
agaaggaggugaccaagcu

SEQ ID NO: 619492 - RNA, 19 nt, Homo sapiens
gaccucaaaguguuggaua

SEQ ID NO: 619493 - RNA, 19 nt, Homo sapiens
caucuucaucggcauaauu

SEQ ID NO: 619494 - RNA, 19 nt, Homo sapiens
ggacaguggccaucuucau

SEQ ID NO: 619495 - RNA, 19 nt, Homo sapiens
ggacuccaaccuccuguuc

SEQ ID NO: 619496 - RNA, 19 nt, Homo sapiens
ggauuccuccucaacauca

SEQ ID NO: 619497 - RNA, 19 nt, Homo sapiens
ccaaugccaucgucuucuc

SEQ ID NO: 619498 - RNA, 19 nt, Homo sapiens
accagaagaugccguggaa

SEQ ID NO: 619499 - RNA, 19 nt, Homo sapiens
gacaguggccaucuucauc

SEQ ID NO: 619500 - RNA, 19 nt, Homo sapiens
ccaccucccuggccuucau

SEQ ID NO: 619501 - RNA, 19 nt, Homo sapiens
agaagaugccguggaauau

SEQ ID NO: 619502 - RNA, 19 nt, Homo sapiens
ugagguugccgucgaguau

SEQ ID NO: 619503 - RNA, 19 nt, Homo sapiens
acuccaaccuccuguucuu

SEQ ID NO: 619504 - RNA, 19 nt, Homo sapiens
ucuucagccugcacucuuu

SEQ ID NO: 619505 - RNA, 19 nt, Homo sapiens
ugugccagcuccagccauu

SEQ ID NO: 619506 - RNA, 19 nt, Homo sapiens
ccuuaauccuguucccuau

SEQ ID NO: 619507 - RNA, 19 nt, Homo sapiens
gaucuuccugcccauccua

SEQ ID NO: 619508 - RNA, 19 nt, Homo sapiens
ggccaucagcauccuauuc

SEQ ID NO: 619509 - RNA, 19 nt, Homo sapiens
gcccaaugccaucgucuuc

SEQ ID NO: 619510 - RNA, 19 nt, Homo sapiens
gaaggaggugaccaagcuu

SEQ ID NO: 619511 - RNA, 19 nt, Homo sapiens
gccaacaccaccacaccaa

SEQ ID NO: 619512 - RNA, 19 nt, Homo sapiens
ucaucgcacuggccaucaa

SEQ ID NO: 619513 - RNA, 19 nt, Homo sapiens
gccaucgucuucucuuucg

SEQ ID NO: 619514 - RNA, 19 nt, Homo sapiens
ggccaccacuacgaucuuc

SEQ ID NO: 619515 - RNA, 19 nt, Homo sapiens
gcuaauccugggcuucaug

SEQ ID NO: 619516 - RNA, 19 nt, Homo sapiens
ggaggccuacugcgcguau

SEQ ID NO: 619517 - RNA, 19 nt, Homo sapiens
aagaugccguggaauaucg

SEQ ID NO: 619518 - RNA, 19 nt, Homo sapiens
ggccaucuucaucggcaua

SEQ ID NO: 619519 - RNA, 19 nt, Homo sapiens
ugucagaguggcugggaaa

SEQ ID NO: 619520 - RNA, 19 nt, Homo sapiens
ccagaucaacucgcucuuc

SEQ ID NO: 619521 - RNA, 19 nt, Homo sapiens
caccucacccagugcauga

SEQ ID NO: 619522 - RNA, 19 nt, Homo sapiens
ggaagguccugacagauua

SEQ ID NO: 619523 - RNA, 19 nt, Homo sapiens
gcagaaauccaccaaugua

SEQ ID NO: 619524 - RNA, 19 nt, Homo sapiens
cugaagugcucuuugauua

SEQ ID NO: 619525 - RNA, 19 nt, Homo sapiens
gagaagaacuaagccuuug

SEQ ID NO: 619526 - RNA, 19 nt, Homo sapiens
gaaacucucccuucauuau

SEQ ID NO: 619527 - RNA, 19 nt, Homo sapiens
gaggguagcuaucuuacga

SEQ ID NO: 619528 - RNA, 19 nt, Homo sapiens
caagaaggaucuguaugaa

SEQ ID NO: 619529 - RNA, 19 nt, Homo sapiens
ccaagaaggaucuguauga

SEQ ID NO: 619530 - RNA, 19 nt, Homo sapiens
cagcagaaauccaccaaug

SEQ ID NO: 619531 - RNA, 19 nt, Homo sapiens
uuacagguauugauucuga

SEQ ID NO: 619532 - RNA, 19 nt, Homo sapiens
ggagaagaacuaagccuuu

SEQ ID NO: 619533 - RNA, 19 nt, Homo sapiens
gcagaacauuguacccuau

SEQ ID NO: 619534 - RNA, 19 nt, Homo sapiens
guaaaaggccucuauaaaa

SEQ ID NO: 619535 - RNA, 19 nt, Homo sapiens
aaucaaagauauccacgaa

SEQ ID NO: 619536 - RNA, 19 nt, Homo sapiens
gggcugccauucuuugaaa

SEQ ID NO: 619537 - RNA, 19 nt, Homo sapiens
ugaauucuaugaacacaga

SEQ ID NO: 619538 - RNA, 19 nt, Homo sapiens
gaucccaagucaaccauug

SEQ ID NO: 619539 - RNA, 19 nt, Homo sapiens
gaccaaggaugacgaugug

SEQ ID NO: 619540 - RNA, 19 nt, Homo sapiens
aaggaguacuuacagguua

SEQ ID NO: 619541 - RNA, 19 nt, Homo sapiens
cauggaagguccugacaga

SEQ ID NO: 619542 - RNA, 19 nt, Homo sapiens
gcaauccuguccacaaugg

SEQ ID NO: 619543 - RNA, 19 nt, Homo sapiens
gaaggaguacuuacagguu

SEQ ID NO: 619544 - RNA, 19 nt, Homo sapiens
ucaaagauauccacgaacu

SEQ ID NO: 619545 - RNA, 19 nt, Homo sapiens
ccaccaauguagucuauca

SEQ ID NO: 619546 - RNA, 19 nt, Homo sapiens
gcgcaauccuguccacaau

SEQ ID NO: 619547 - RNA, 19 nt, Homo sapiens
gucauggccuuaacagaaa

SEQ ID NO: 619548 - RNA, 19 nt, Homo sapiens
gcacaaugaguuugacuuc

SEQ ID NO: 619549 - RNA, 19 nt, Homo sapiens
ggaagggugcagcaaguuu

SEQ ID NO: 619550 - RNA, 19 nt, Homo sapiens
ggauguaccguguggcuaa

SEQ ID NO: 619551 - RNA, 19 nt, Homo sapiens
ccucuagacuggcggauga

SEQ ID NO: 619552 - RNA, 19 nt, Homo sapiens
augaugggcuggaccaaua

SEQ ID NO: 619553 - RNA, 19 nt, Homo sapiens
acgagacgcugaauucuau

SEQ ID NO: 619554 - RNA, 19 nt, Homo sapiens
ggauuuacagguauugauu

SEQ ID NO: 619555 - RNA, 19 nt, Homo sapiens
uaaaaggccucuauaaaag

SEQ ID NO: 619556 - RNA, 19 nt, Homo sapiens
agaugcaccucuaaauauu

SEQ ID NO: 619557 - RNA, 19 nt, Homo sapiens
ugagguggcuaagcuguuu

SEQ ID NO: 619558 - RNA, 19 nt, Homo sapiens
caugugagcaggaauaaga

SEQ ID NO: 619559 - RNA, 19 nt, Homo sapiens
cccaugccaucccuuguua

SEQ ID NO: 619560 - RNA, 19 nt, Homo sapiens
uaagagagggcaagugguu

SEQ ID NO: 619561 - RNA, 19 nt, Homo sapiens
gagcucaaacagaaaugua

SEQ ID NO: 619562 - RNA, 19 nt, Homo sapiens
gaagggugcagcaaguuug

SEQ ID NO: 619563 - RNA, 19 nt, Homo sapiens
caaaggaucgugagaaugc

SEQ ID NO: 619564 - RNA, 19 nt, Homo sapiens
cgucauggccuuaacagaa

SEQ ID NO: 619565 - RNA, 19 nt, Homo sapiens
gccauggacuucuaugauc

SEQ ID NO: 619566 - RNA, 19 nt, Homo sapiens
caauggccaugcccuguug

SEQ ID NO: 619567 - RNA, 19 nt, Homo sapiens
gaaugcugaugcgguguuu

SEQ ID NO: 619568 - RNA, 19 nt, Homo sapiens
gaaauccaccaauguaguc

SEQ ID NO: 619569 - RNA, 19 nt, Homo sapiens
gcaagagcagaacauugua

SEQ ID NO: 619570 - RNA, 19 nt, Homo sapiens
gcuaagcuguuugcugaug

SEQ ID NO: 619571 - RNA, 19 nt, Homo sapiens
cagcaaggcacaaugaguu

SEQ ID NO: 619572 - RNA, 19 nt, Homo sapiens
ggaccaaggaugacgaugu

SEQ ID NO: 619573 - RNA, 19 nt, Homo sapiens
gagcugaggcugaaacucu

SEQ ID NO: 619574 - RNA, 19 nt, Homo sapiens
uaguggaacuucugcaaga

SEQ ID NO: 619575 - RNA, 19 nt, Homo sapiens
gguccuggaucccaaguca

SEQ ID NO: 619576 - RNA, 19 nt, Homo sapiens
uuucugaagugcucuuuga

SEQ ID NO: 619577 - RNA, 19 nt, Homo sapiens
gcucaaacagaaauguaaa

SEQ ID NO: 619578 - RNA, 19 nt, Homo sapiens
gaugcaccucuaaauauuu

SEQ ID NO: 619579 - RNA, 19 nt, Homo sapiens
aaaccaagaaggaucugua

SEQ ID NO: 619580 - RNA, 19 nt, Homo sapiens
ggaugacgaugugccucua

SEQ ID NO: 619581 - RNA, 19 nt, Homo sapiens
ugacaccucuggagcucaa

SEQ ID NO: 619582 - RNA, 19 nt, Homo sapiens
ugcauuaccagcuuuauuu

SEQ ID NO: 619583 - RNA, 19 nt, Homo sapiens
ggaccaauaccgucugaca

SEQ ID NO: 619584 - RNA, 19 nt, Homo sapiens
cgcaaaggaucgugagaau

SEQ ID NO: 619585 - RNA, 19 nt, Homo sapiens
ggucugcauuaccagcuuu

SEQ ID NO: 619586 - RNA, 19 nt, Homo sapiens
gcuagaugauggcgugauc

SEQ ID NO: 619587 - RNA, 19 nt, Homo sapiens
gcacuuugacacccugcua

SEQ ID NO: 619588 - RNA, 19 nt, Homo sapiens
gcuggucuggucugcauua

SEQ ID NO: 619589 - RNA, 19 nt, Homo sapiens
gaagugcucuuugauuacc

SEQ ID NO: 619590 - RNA, 19 nt, Homo sapiens
caaggcacaaugaguuuga

SEQ ID NO: 619591 - RNA, 19 nt, Homo sapiens
aaccauuguugccaucuuu

SEQ ID NO: 619592 - RNA, 19 nt, Homo sapiens
aaaccaauuuguccacagu

SEQ ID NO: 619593 - RNA, 19 nt, Homo sapiens
gguauugauucugauuaug

SEQ ID NO: 619594 - RNA, 19 nt, Homo sapiens
uggaagguccugacagauu

SEQ ID NO: 619595 - RNA, 19 nt, Homo sapiens
ggacggaggguagcuaucu

SEQ ID NO: 619596 - RNA, 19 nt, Homo sapiens
gcaaaggaucgugagaaug

SEQ ID NO: 619597 - RNA, 19 nt, Homo sapiens
gaacucgaaugaggaagcu

SEQ ID NO: 619598 - RNA, 19 nt, Homo sapiens
ggagaaggaguacuuacag

SEQ ID NO: 619599 - RNA, 19 nt, Homo sapiens
gcugccauucuuugaaaua

SEQ ID NO: 619600 - RNA, 19 nt, Homo sapiens
ggacagagaggaaaauauc

SEQ ID NO: 619601 - RNA, 19 nt, Homo sapiens
ggccucaccucuguggaaa

SEQ ID NO: 619602 - RNA, 19 nt, Homo sapiens
gggagaaggaguacuuaca

SEQ ID NO: 619603 - RNA, 19 nt, Homo sapiens
gggugccaauuucuacauu

SEQ ID NO: 619604 - RNA, 19 nt, Homo sapiens
uaucaggcccaccauguga

SEQ ID NO: 619605 - RNA, 19 nt, Homo sapiens
cucccuucauuaucaauua

SEQ ID NO: 619606 - RNA, 19 nt, Homo sapiens
cagaacauuguacccuaua

SEQ ID NO: 619607 - RNA, 19 nt, Homo sapiens
ugagaaugcccgcaaaaua

SEQ ID NO: 619608 - RNA, 19 nt, Homo sapiens
caccaugugagcaggaaua

SEQ ID NO: 619609 - RNA, 19 nt, Homo sapiens
gcacccgguccuccuacua

SEQ ID NO: 619610 - RNA, 19 nt, Homo sapiens
gccaugcccuguugaugca

SEQ ID NO: 619611 - RNA, 19 nt, Homo sapiens
gcauuccaguugcgcaauc

SEQ ID NO: 619612 - RNA, 19 nt, Homo sapiens
agauauccacgaacucuuu

SEQ ID NO: 619613 - RNA, 19 nt, Homo sapiens
gaacauuguacccuauacu

SEQ ID NO: 619614 - RNA, 19 nt, Homo sapiens
ccgaguggcugccuacaac

SEQ ID NO: 619615 - RNA, 19 nt, Homo sapiens
agacggagaaccagcagaa

SEQ ID NO: 619616 - RNA, 19 nt, Homo sapiens
gguguuugcauuccaguug

SEQ ID NO: 619617 - RNA, 19 nt, Homo sapiens
ccagcuuuauuucuccauu

SEQ ID NO: 619618 - RNA, 19 nt, Homo sapiens
gacggaggguagcuaucuu

SEQ ID NO: 619619 - RNA, 19 nt, Homo sapiens
ccacuccccucaaagguuu

SEQ ID NO: 619620 - RNA, 19 nt, Homo sapiens
cagguauugauucugauua

SEQ ID NO: 619621 - RNA, 19 nt, Homo sapiens
cagcuuuauuucuccauuc

SEQ ID NO: 619622 - RNA, 19 nt, Homo sapiens
ggaugcaucuuaugaagua

SEQ ID NO: 619623 - RNA, 19 nt, Homo sapiens
ggaccgugcugacagaaua

SEQ ID NO: 619624 - RNA, 19 nt, Homo sapiens
ggagaaagcuuaggcuguu

SEQ ID NO: 619625 - RNA, 19 nt, Homo sapiens
caauggacaugcccuguua

SEQ ID NO: 619626 - RNA, 19 nt, Homo sapiens
ucaugaaggugcaaguuua

SEQ ID NO: 619627 - RNA, 19 nt, Homo sapiens
caggagaaauuaaagguuu

SEQ ID NO: 619628 - RNA, 19 nt, Homo sapiens
gaggagaucuucaagucuu

SEQ ID NO: 619629 - RNA, 19 nt, Homo sapiens
ccaguaguauucacauuaa

SEQ ID NO: 619630 - RNA, 19 nt, Homo sapiens
gacaaaggaugacgauguu

SEQ ID NO: 619631 - RNA, 19 nt, Homo sapiens
cuacugagcuaaagcagaa

SEQ ID NO: 619632 - RNA, 19 nt, Homo sapiens
ggacuacuaugacucugaa

SEQ ID NO: 619633 - RNA, 19 nt, Homo sapiens
caucacaaguuucauauca

SEQ ID NO: 619634 - RNA, 19 nt, Homo sapiens
ggacaaaggaugacgaugu

SEQ ID NO: 619635 - RNA, 19 nt, Homo sapiens
ccaugaagacuuugaauuu

SEQ ID NO: 619636 - RNA, 19 nt, Homo sapiens
ucacugggaucgauucuga

SEQ ID NO: 619637 - RNA, 19 nt, Homo sapiens
gaaugcugaugcugucuuu

SEQ ID NO: 619638 - RNA, 19 nt, Homo sapiens
gagaaagcuuaggcuguua

SEQ ID NO: 619639 - RNA, 19 nt, Homo sapiens
aaacagggaaggaucuuua

SEQ ID NO: 619640 - RNA, 19 nt, Homo sapiens
ggaugacgauguuccuuug

SEQ ID NO: 619641 - RNA, 19 nt, Homo sapiens
aaacagaugcggaaacauu

SEQ ID NO: 619642 - RNA, 19 nt, Homo sapiens
caaguuucauaucaccuua

SEQ ID NO: 619643 - RNA, 19 nt, Homo sapiens
cauuugcucugauguauga

SEQ ID NO: 619644 - RNA, 19 nt, Homo sapiens
uaacuugucaguaccuaua

SEQ ID NO: 619645 - RNA, 19 nt, Homo sapiens
ugaacaccaugaagacuuu

SEQ ID NO: 619646 - RNA, 19 nt, Homo sapiens
ggacaugcccuguuaaugc

SEQ ID NO: 619647 - RNA, 19 nt, Homo sapiens
acaaggagauuggcugauu

SEQ ID NO: 619648 - RNA, 19 nt, Homo sapiens
cuacaaauccuuggagaaa

SEQ ID NO: 619649 - RNA, 19 nt, Homo sapiens
caaggagauuggcugauug

SEQ ID NO: 619650 - RNA, 19 nt, Homo sapiens
ggauggaggugucauuaac

SEQ ID NO: 619651 - RNA, 19 nt, Homo sapiens
acagagggaugucaaagga

SEQ ID NO: 619652 - RNA, 19 nt, Homo sapiens
gcaauaacgcgcagaacug

SEQ ID NO: 619653 - RNA, 19 nt, Homo sapiens
agagguggcuuucgugguu

SEQ ID NO: 619654 - RNA, 19 nt, Homo sapiens
guuugcagaugcuggcuua

SEQ ID NO: 619655 - RNA, 19 nt, Homo sapiens
gaacacgaaugcgcaaacu

SEQ ID NO: 619656 - RNA, 19 nt, Homo sapiens
ggaggaaggaguucugaau

SEQ ID NO: 619657 - RNA, 19 nt, Homo sapiens
aaacagaccauuuuccuua

SEQ ID NO: 619658 - RNA, 19 nt, Homo sapiens
ggaucgaguuuauuggaau

SEQ ID NO: 619659 - RNA, 19 nt, Homo sapiens
caaccaaugucaccuacca

SEQ ID NO: 619660 - RNA, 19 nt, Homo sapiens
gucauuaacuugucaguac

SEQ ID NO: 619661 - RNA, 19 nt, Homo sapiens
gcauggccuuggaggagua

SEQ ID NO: 619662 - RNA, 19 nt, Homo sapiens
uggcaugccucauccagaa

SEQ ID NO: 619663 - RNA, 19 nt, Homo sapiens
gaucgaguuuauuggaaug

SEQ ID NO: 619664 - RNA, 19 nt, Homo sapiens
gaccagagguggcuuucgu

SEQ ID NO: 619665 - RNA, 19 nt, Homo sapiens
gcugacagaauacuacaaa

SEQ ID NO: 619666 - RNA, 19 nt, Homo sapiens
cgacagugguggccaucuu

SEQ ID NO: 619667 - RNA, 19 nt, Homo sapiens
gacaugcccuguuaaugca

SEQ ID NO: 619668 - RNA, 19 nt, Homo sapiens
aaagucaagcugagcaaua

SEQ ID NO: 619669 - RNA, 19 nt, Homo sapiens
cuugaucaguaucgucuua

SEQ ID NO: 619670 - RNA, 19 nt, Homo sapiens
ugaauggcuuuaugagaga

SEQ ID NO: 619671 - RNA, 19 nt, Homo sapiens
aagucaagcugagcaauaa

SEQ ID NO: 619672 - RNA, 19 nt, Homo sapiens
agaagcguauggacuacua

SEQ ID NO: 619673 - RNA, 19 nt, Homo sapiens
cagggaaggaucuuuauga

SEQ ID NO: 619674 - RNA, 19 nt, Homo sapiens
gcagagagcaaccaauguc

SEQ ID NO: 619675 - RNA, 19 nt, Homo sapiens
caacaaugcaaggcaaauu

SEQ ID NO: 619676 - RNA, 19 nt, Homo sapiens
gugcaucacaaguuucaua

SEQ ID NO: 619677 - RNA, 19 nt, Homo sapiens
gaaagacuacugugagcau

SEQ ID NO: 619678 - RNA, 19 nt, Homo sapiens
auaguucccuuucgaguug

SEQ ID NO: 619679 - RNA, 19 nt, Homo sapiens
gagcaaccaaugucaccua

SEQ ID NO: 619680 - RNA, 19 nt, Homo sapiens
gaacagagggaugucaaag

SEQ ID NO: 619681 - RNA, 19 nt, Homo sapiens
aggaguaccugguuuguca

SEQ ID NO: 619682 - RNA, 19 nt, Homo sapiens
ggagccaacuuuuacauug

SEQ ID NO: 619683 - RNA, 19 nt, Homo sapiens
ccuuugauguggcguauga

SEQ ID NO: 619684 - RNA, 19 nt, Homo sapiens
gaacuauaugugccagaaa

SEQ ID NO: 619685 - RNA, 19 nt, Homo sapiens
guaacacacugaugguuuu

SEQ ID NO: 619686 - RNA, 19 nt, Homo sapiens
uggaggagaucuucaaguc

SEQ ID NO: 619687 - RNA, 19 nt, Homo sapiens
gcaagaaccaccccuauau

SEQ ID NO: 619688 - RNA, 19 nt, Homo sapiens
ugucaaaggacucuacaaa

SEQ ID NO: 619689 - RNA, 19 nt, Homo sapiens
gaaacagggaaggaucuuu

SEQ ID NO: 619690 - RNA, 19 nt, Homo sapiens
gauguaugcuggaccaacu

SEQ ID NO: 619691 - RNA, 19 nt, Homo sapiens
cauaagcaacuucuagaga

SEQ ID NO: 619692 - RNA, 19 nt, Homo sapiens
gcaacccagugcacaaugg

SEQ ID NO: 619693 - RNA, 19 nt, Homo sapiens
agucuuggaucgaguuuau

SEQ ID NO: 619694 - RNA, 19 nt, Homo sapiens
acacgaaugcgcaaacuug

SEQ ID NO: 619695 - RNA, 19 nt, Homo sapiens
agacuccugugauguaaau

SEQ ID NO: 619696 - RNA, 19 nt, Homo sapiens
gcaggagaaauuaaagguu

SEQ ID NO: 619697 - RNA, 19 nt, Homo sapiens
ugacgauguuccuuugaug

SEQ ID NO: 619698 - RNA, 19 nt, Homo sapiens
uaaugcaggauacccauaa

SEQ ID NO: 619699 - RNA, 19 nt, Homo sapiens
ugacugcgacucaugaaga

SEQ ID NO: 619700 - RNA, 19 nt, Homo sapiens
ugagagagagggaguacuu

SEQ ID NO: 619701 - RNA, 19 nt, Homo sapiens
uaccagcacugaaaauuaa

SEQ ID NO: 619702 - RNA, 19 nt, Homo sapiens
gaagacagagaagagaaug

SEQ ID NO: 619703 - RNA, 19 nt, Homo sapiens
guuguaaccaguaguauuc

SEQ ID NO: 619704 - RNA, 19 nt, Homo sapiens
gaccacauagucucuguug

SEQ ID NO: 619705 - RNA, 19 nt, Homo sapiens
ggaggugucauuaacuugu

SEQ ID NO: 619706 - RNA, 19 nt, Homo sapiens
ugacagaauacuacaaauc

SEQ ID NO: 619707 - RNA, 19 nt, Homo sapiens
gguuuaaucacuuuggaaa

SEQ ID NO: 619708 - RNA, 19 nt, Homo sapiens
uauuuaugcuucuguguca

SEQ ID NO: 619709 - RNA, 19 nt, Homo sapiens
gccaagucauggugccaaa

SEQ ID NO: 619710 - RNA, 19 nt, Homo sapiens
gcaggauacccauaagcaa

SEQ ID NO: 619711 - RNA, 19 nt, Homo sapiens
gaggaaggaguucugaauc

SEQ ID NO: 619712 - RNA, 19 nt, Homo sapiens
auauuaagauggugaugga

SEQ ID NO: 619713 - RNA, 19 nt, Homo sapiens
uuucgugguugcacaguuu

SEQ ID NO: 619714 - RNA, 19 nt, Homo sapiens
agaacuauaugugccagaa

SEQ ID NO: 619715 - RNA, 19 nt, Homo sapiens
gcaaggcaaauucaugaag

SEQ ID NO: 619716 - RNA, 19 nt, Homo sapiens
ucauaucaccuuacacuca

SEQ ID NO: 619717 - RNA, 19 nt, Homo sapiens
gaaacauuaccagcacuga

SEQ ID NO: 619718 - RNA, 19 nt, Homo sapiens
guggaugcaucuuaugaag

SEQ ID NO: 619719 - RNA, 19 nt, Homo sapiens
aaaagaagcguauggacua

SEQ ID NO: 619720 - RNA, 19 nt, Homo sapiens
aacagaugcggaaacauua

SEQ ID NO: 619721 - RNA, 19 nt, Homo sapiens
ggaacgggauauuguaccu

SEQ ID NO: 619722 - RNA, 19 nt, Homo sapiens
gaaagaagcuaugaaagua

SEQ ID NO: 619723 - RNA, 19 nt, Homo sapiens
ggaauaugguuucuaguuu

SEQ ID NO: 619724 - RNA, 19 nt, Homo sapiens
gaaguaacauuccugaaau

SEQ ID NO: 619725 - RNA, 19 nt, Homo sapiens
gaagaaagaagcuaugaaa

SEQ ID NO: 619726 - RNA, 19 nt, Homo sapiens
ugaaggacuuucugauuua

SEQ ID NO: 619727 - RNA, 19 nt, Homo sapiens
gaaagcaguacucauguua

SEQ ID NO: 619728 - RNA, 19 nt, Homo sapiens
ggaagacccuccugccaaa

SEQ ID NO: 619729 - RNA, 19 nt, Homo sapiens
guacuguccuccuauguuu

SEQ ID NO: 619730 - RNA, 19 nt, Homo sapiens
ggacgccccuugaauauua

SEQ ID NO: 619731 - RNA, 19 nt, Homo sapiens
ggaaaugcaucuuuauguc

SEQ ID NO: 619732 - RNA, 19 nt, Homo sapiens
ccagagcacuaauuaaaga

SEQ ID NO: 619733 - RNA, 19 nt, Homo sapiens
uaucagccaucuucuguaa

SEQ ID NO: 619734 - RNA, 19 nt, Homo sapiens
uaacauuccugaaaucauc

SEQ ID NO: 619735 - RNA, 19 nt, Homo sapiens
ugagggcgcugcauuuauu

SEQ ID NO: 619736 - RNA, 19 nt, Homo sapiens
caucagauuugccagguuu

SEQ ID NO: 619737 - RNA, 19 nt, Homo sapiens
ucaacaaguuagagagaua

SEQ ID NO: 619738 - RNA, 19 nt, Homo sapiens
guucaagcguccucaguaa

SEQ ID NO: 619739 - RNA, 19 nt, Homo sapiens
caucagaaauugggaagaa

SEQ ID NO: 619740 - RNA, 19 nt, Homo sapiens
caaugacuguucugaugua

SEQ ID NO: 619741 - RNA, 19 nt, Homo sapiens
gcccugcgguucagauuaa

SEQ ID NO: 619742 - RNA, 19 nt, Homo sapiens
ucaagcaugucaucagauu

SEQ ID NO: 619743 - RNA, 19 nt, Homo sapiens
gaauuacucuaugucugua

SEQ ID NO: 619744 - RNA, 19 nt, Homo sapiens
gggaagaauuacucuaugu

SEQ ID NO: 619745 - RNA, 19 nt, Homo sapiens
uugaaggacuuucugauuu

SEQ ID NO: 619746 - RNA, 19 nt, Homo sapiens
gaugagggcgcugcauuua

SEQ ID NO: 619747 - RNA, 19 nt, Homo sapiens
gaaaugcaucuuuauguca

SEQ ID NO: 619748 - RNA, 19 nt, Homo sapiens
acaaucaaaucaucgguuu

SEQ ID NO: 619749 - RNA, 19 nt, Homo sapiens
gaaggacuuucugauuuau

SEQ ID NO: 619750 - RNA, 19 nt, Homo sapiens
gagaucaaauuccaagaag

SEQ ID NO: 619751 - RNA, 19 nt, Homo sapiens
gcagugacuuguacacauc

SEQ ID NO: 619752 - RNA, 19 nt, Homo sapiens
gaucaaauuccaagaagau

SEQ ID NO: 619753 - RNA, 19 nt, Homo sapiens
auacuaagcccacauuuga

SEQ ID NO: 619754 - RNA, 19 nt, Homo sapiens
ucaguaccauuccaccaua

SEQ ID NO: 619755 - RNA, 19 nt, Homo sapiens
gcaagaagaaaguagaugu

SEQ ID NO: 619756 - RNA, 19 nt, Homo sapiens
uaucaagcaugucaucaga

SEQ ID NO: 619757 - RNA, 19 nt, Homo sapiens
ugaggaauaugguuucuag

SEQ ID NO: 619758 - RNA, 19 nt, Homo sapiens
ccaaagggguucucaugua

SEQ ID NO: 619759 - RNA, 19 nt, Homo sapiens
ggauuuguccuguguguga

SEQ ID NO: 619760 - RNA, 19 nt, Homo sapiens
ugaaagcaguacucauguu

SEQ ID NO: 619761 - RNA, 19 nt, Homo sapiens
caaagcagcccaaccaaag

SEQ ID NO: 619762 - RNA, 19 nt, Homo sapiens
caucagccauguuauuaca

SEQ ID NO: 619763 - RNA, 19 nt, Homo sapiens
gauacuaagcccacauuug

SEQ ID NO: 619764 - RNA, 19 nt, Homo sapiens
guucugugcugcuucaaga

SEQ ID NO: 619765 - RNA, 19 nt, Homo sapiens
gcuauuccgccuucauuaa

SEQ ID NO: 619766 - RNA, 19 nt, Homo sapiens
ucgaagaguugaggaauau

SEQ ID NO: 619767 - RNA, 19 nt, Homo sapiens
ugacuguucugauguagau

SEQ ID NO: 619768 - RNA, 19 nt, Homo sapiens
gcaguacucauguuaguuc

SEQ ID NO: 619769 - RNA, 19 nt, Homo sapiens
caaguugcccucaagaaga

SEQ ID NO: 619770 - RNA, 19 nt, Homo sapiens
caaugagaccgaagaaaga

SEQ ID NO: 619771 - RNA, 19 nt, Homo sapiens
gagacaaguugcccucaag

SEQ ID NO: 619772 - RNA, 19 nt, Homo sapiens
gcgcugcauuuauugaaga

SEQ ID NO: 619773 - RNA, 19 nt, Homo sapiens
agaaagaagcuaugaaagu

SEQ ID NO: 619774 - RNA, 19 nt, Homo sapiens
ccaaugagaccgaagaaag

SEQ ID NO: 619775 - RNA, 19 nt, Homo sapiens
uuagaaacccugaucauuc

SEQ ID NO: 619776 - RNA, 19 nt, Homo sapiens
guacucauguuaguucauc

SEQ ID NO: 619777 - RNA, 19 nt, Homo sapiens
uagaugagaucaaauucca

SEQ ID NO: 619778 - RNA, 19 nt, Homo sapiens
cugcagauccugauaguga

SEQ ID NO: 619779 - RNA, 19 nt, Homo sapiens
gaagaauuacucuaugucu

SEQ ID NO: 619780 - RNA, 19 nt, Homo sapiens
ucaucaagcccacgaguuu

SEQ ID NO: 619781 - RNA, 19 nt, Homo sapiens
caagaagaaaguagauguu

SEQ ID NO: 619782 - RNA, 19 nt, Homo sapiens
gaugugcccuuuaggaaaa

SEQ ID NO: 619783 - RNA, 19 nt, Homo sapiens
caacuagccuucggguauc

SEQ ID NO: 619784 - RNA, 19 nt, Homo sapiens
agucucaccucacccuuaa

SEQ ID NO: 619785 - RNA, 19 nt, Homo sapiens
guaagggugcccaguguga

SEQ ID NO: 619786 - RNA, 19 nt, Homo sapiens
gaucauuccagagcacuaa

SEQ ID NO: 619787 - RNA, 19 nt, Homo sapiens
ucaccauccucuccuguug

SEQ ID NO: 619788 - RNA, 19 nt, Homo sapiens
aaucaucgguuuucaguuu

SEQ ID NO: 619789 - RNA, 19 nt, Homo sapiens
aagcaugaccuccugauga

SEQ ID NO: 619790 - RNA, 19 nt, Homo sapiens
acaacuagccuucggguau

SEQ ID NO: 619791 - RNA, 19 nt, Homo sapiens
uaucuuguacggcagcuua

SEQ ID NO: 619792 - RNA, 19 nt, Homo sapiens
ggugguaggagagauuaua

SEQ ID NO: 619793 - RNA, 19 nt, Homo sapiens
caaagggguucucauguau

SEQ ID NO: 619794 - RNA, 19 nt, Homo sapiens
gaaauucucaaugacuguu

SEQ ID NO: 619795 - RNA, 19 nt, Homo sapiens
aaaaugggauugaacagaa

SEQ ID NO: 619796 - RNA, 19 nt, Homo sapiens
gauuauacaguccaaguuc

SEQ ID NO: 619797 - RNA, 19 nt, Homo sapiens
gcaagcaguacgucuguca

SEQ ID NO: 619798 - RNA, 19 nt, Homo sapiens
cucaaugacuguucugaug

SEQ ID NO: 619799 - RNA, 19 nt, Homo sapiens
gaagaguugaggaauaugg

SEQ ID NO: 619800 - RNA, 19 nt, Homo sapiens
gagagauuauacaguccaa

SEQ ID NO: 619801 - RNA, 19 nt, Homo sapiens
aaagcaguauucagcgauu

SEQ ID NO: 619802 - RNA, 19 nt, Homo sapiens
caucaagcccacgaguuua

SEQ ID NO: 619803 - RNA, 19 nt, Homo sapiens
ccaguacuguccuccuaug

SEQ ID NO: 619804 - RNA, 19 nt, Homo sapiens
guucugauguagaugagau

SEQ ID NO: 619805 - RNA, 19 nt, Homo sapiens
ucagccauguuauuacaga

SEQ ID NO: 619806 - RNA, 19 nt, Homo sapiens
gagauuauacaguccaagu

SEQ ID NO: 619807 - RNA, 19 nt, Homo sapiens
auucagcgauuucaagaga

SEQ ID NO: 619808 - RNA, 19 nt, Homo sapiens
gaguugaggaauaugguuu

SEQ ID NO: 619809 - RNA, 19 nt, Homo sapiens
caagcaagaagaaaguaga

SEQ ID NO: 619810 - RNA, 19 nt, Homo sapiens
ugagaucaaauuccaagaa

SEQ ID NO: 619811 - RNA, 19 nt, Homo sapiens
gcuaugcaccaccgccuaa

SEQ ID NO: 619812 - RNA, 19 nt, Homo sapiens
aagcaugucaucagauuug

SEQ ID NO: 619813 - RNA, 19 nt, Homo sapiens
gccaauaucaagcauguca

SEQ ID NO: 619814 - RNA, 19 nt, Homo sapiens
aagaagcuaugaaaguauc

SEQ ID NO: 619815 - RNA, 19 nt, Homo sapiens
cauuccagagcacuaauua

SEQ ID NO: 619816 - RNA, 19 nt, Homo sapiens
ggaagaauuacucuauguc

SEQ ID NO: 619817 - RNA, 19 nt, Homo sapiens
uuuaugauguccuugaugu

SEQ ID NO: 619818 - RNA, 19 nt, Homo sapiens
uaggguuucugaacuacaa

SEQ ID NO: 619819 - RNA, 19 nt, Homo sapiens
uuccugaaaucaucucauu

SEQ ID NO: 619820 - RNA, 19 nt, Homo sapiens
aagcaguacucauguuagu

SEQ ID NO: 619821 - RNA, 19 nt, Homo sapiens
acacaaagcagcccaacca

SEQ ID NO: 619822 - RNA, 19 nt, Homo sapiens
gaaagaagcuaugaaagua

SEQ ID NO: 619823 - RNA, 19 nt, Homo sapiens
ggaauaugguuucuaguuu

SEQ ID NO: 619824 - RNA, 19 nt, Homo sapiens
gaagaaagaagcuaugaaa

SEQ ID NO: 619825 - RNA, 19 nt, Homo sapiens
ugaaggacuuucugauuua

SEQ ID NO: 619826 - RNA, 19 nt, Homo sapiens
ggaagacccuccugccaaa

SEQ ID NO: 619827 - RNA, 19 nt, Homo sapiens
ggacgccccuugaauauua

SEQ ID NO: 619828 - RNA, 19 nt, Homo sapiens
ggaaaugcaucuuuauguc

SEQ ID NO: 619829 - RNA, 19 nt, Homo sapiens
ccagagcacuaauuaaaga

SEQ ID NO: 619830 - RNA, 19 nt, Homo sapiens
uaucagccaucuucuguaa

SEQ ID NO: 619831 - RNA, 19 nt, Homo sapiens
ugagggcgcugcauuuauu

SEQ ID NO: 619832 - RNA, 19 nt, Homo sapiens
ucaacaaguuagagagaua

SEQ ID NO: 619833 - RNA, 19 nt, Homo sapiens
guucaagcguccucaguaa

SEQ ID NO: 619834 - RNA, 19 nt, Homo sapiens
caucagaaauugggaagaa

SEQ ID NO: 619835 - RNA, 19 nt, Homo sapiens
gaacaucuucugauacugu

SEQ ID NO: 619836 - RNA, 19 nt, Homo sapiens
caaugacuguucugaugua

SEQ ID NO: 619837 - RNA, 19 nt, Homo sapiens
gcccugcgguucagauuaa

SEQ ID NO: 619838 - RNA, 19 nt, Homo sapiens
ucaagcaugucaucagauu

SEQ ID NO: 619839 - RNA, 19 nt, Homo sapiens
gaauuacucuaugucugua

SEQ ID NO: 619840 - RNA, 19 nt, Homo sapiens
gggaagaauuacucuaugu

SEQ ID NO: 619841 - RNA, 19 nt, Homo sapiens
uugaaggacuuucugauuu

SEQ ID NO: 619842 - RNA, 19 nt, Homo sapiens
gaugagggcgcugcauuua

SEQ ID NO: 619843 - RNA, 19 nt, Homo sapiens
gaaaugcaucuuuauguca

SEQ ID NO: 619844 - RNA, 19 nt, Homo sapiens
acaaucaaaucaucgguuu

SEQ ID NO: 619845 - RNA, 19 nt, Homo sapiens
gaaggacuuucugauuuau

SEQ ID NO: 619846 - RNA, 19 nt, Homo sapiens
gagaucaaauuccaagaag

SEQ ID NO: 619847 - RNA, 19 nt, Homo sapiens
gcagugacuuguacacauc

SEQ ID NO: 619848 - RNA, 19 nt, Homo sapiens
gaucaaauuccaagaagau

SEQ ID NO: 619849 - RNA, 19 nt, Homo sapiens
auacuaagcccacauuuga

SEQ ID NO: 619850 - RNA, 19 nt, Homo sapiens
ggagaacaaagaagaaaug

SEQ ID NO: 619851 - RNA, 19 nt, Homo sapiens
ucaguaccauuccaccaua

SEQ ID NO: 619852 - RNA, 19 nt, Homo sapiens
gcaagaagaaaguagaugu

SEQ ID NO: 619853 - RNA, 19 nt, Homo sapiens
uaucaagcaugucaucaga

SEQ ID NO: 619854 - RNA, 19 nt, Homo sapiens
ugaggaauaugguuucuag

SEQ ID NO: 619855 - RNA, 19 nt, Homo sapiens
ccaaagggguucucaugua

SEQ ID NO: 619856 - RNA, 19 nt, Homo sapiens
ggauuuguccuguguguga

SEQ ID NO: 619857 - RNA, 19 nt, Homo sapiens
cuuggaacaucuucugaua

SEQ ID NO: 619858 - RNA, 19 nt, Homo sapiens
caaagcagcccaaccaaag

SEQ ID NO: 619859 - RNA, 19 nt, Homo sapiens
caucagccauguuauuaca

SEQ ID NO: 619860 - RNA, 19 nt, Homo sapiens
gauacuaagcccacauuug

SEQ ID NO: 619861 - RNA, 19 nt, Homo sapiens
guucugugcugcuucaaga

SEQ ID NO: 619862 - RNA, 19 nt, Homo sapiens
gcuauuccgccuucauuaa

SEQ ID NO: 619863 - RNA, 19 nt, Homo sapiens
ucgaagaguugaggaauau

SEQ ID NO: 619864 - RNA, 19 nt, Homo sapiens
ugacuguucugauguagau

SEQ ID NO: 619865 - RNA, 19 nt, Homo sapiens
caaguugcccucaagaaga

SEQ ID NO: 619866 - RNA, 19 nt, Homo sapiens
gaacugaagcuuggaacau

SEQ ID NO: 619867 - RNA, 19 nt, Homo sapiens
caaugagaccgaagaaaga

SEQ ID NO: 619868 - RNA, 19 nt, Homo sapiens
gagacaaguugcccucaag

SEQ ID NO: 619869 - RNA, 19 nt, Homo sapiens
gcgcugcauuuauugaaga

SEQ ID NO: 619870 - RNA, 19 nt, Homo sapiens
agaaagaagcuaugaaagu

SEQ ID NO: 619871 - RNA, 19 nt, Homo sapiens
ccaaugagaccgaagaaag

SEQ ID NO: 619872 - RNA, 19 nt, Homo sapiens
uuagaaacccugaucauuc

SEQ ID NO: 619873 - RNA, 19 nt, Homo sapiens
uagaugagaucaaauucca

SEQ ID NO: 619874 - RNA, 19 nt, Homo sapiens
cugcagauccugauaguga

SEQ ID NO: 619875 - RNA, 19 nt, Homo sapiens
gaagaauuacucuaugucu

SEQ ID NO: 619876 - RNA, 19 nt, Homo sapiens
ucaucaagcccacgaguuu

SEQ ID NO: 619877 - RNA, 19 nt, Homo sapiens
caagaagaaaguagauguu

SEQ ID NO: 619878 - RNA, 19 nt, Homo sapiens
gaugugcccuuuaggaaaa

SEQ ID NO: 619879 - RNA, 19 nt, Homo sapiens
caacuagccuucggguauc

SEQ ID NO: 619880 - RNA, 19 nt, Homo sapiens
guaagggugcccaguguga

SEQ ID NO: 619881 - RNA, 19 nt, Homo sapiens
gaucauuccagagcacuaa

SEQ ID NO: 619882 - RNA, 19 nt, Homo sapiens
ucaccauccucuccuguug

SEQ ID NO: 619883 - RNA, 19 nt, Homo sapiens
aaucaucgguuuucaguuu

SEQ ID NO: 619884 - RNA, 19 nt, Homo sapiens
gagaacaaagaagaaauga

SEQ ID NO: 619885 - RNA, 19 nt, Homo sapiens
aagcaugaccuccugauga

SEQ ID NO: 619886 - RNA, 19 nt, Homo sapiens
acaacuagccuucggguau

SEQ ID NO: 619887 - RNA, 19 nt, Homo sapiens
uaucuuguacggcagcuua

SEQ ID NO: 619888 - RNA, 19 nt, Homo sapiens
ggugguaggagagauuaua

SEQ ID NO: 619889 - RNA, 19 nt, Homo sapiens
caaagggguucucauguau

SEQ ID NO: 619890 - RNA, 19 nt, Homo sapiens
gaaauucucaaugacuguu

SEQ ID NO: 619891 - RNA, 19 nt, Homo sapiens
aaaaugggauugaacagaa

SEQ ID NO: 619892 - RNA, 19 nt, Homo sapiens
gauuauacaguccaaguuc

SEQ ID NO: 619893 - RNA, 19 nt, Homo sapiens
gaagaguugaggaauaugg

SEQ ID NO: 619894 - RNA, 19 nt, Homo sapiens
cucaaugacuguucugaug

SEQ ID NO: 619895 - RNA, 19 nt, Homo sapiens
gagagauuauacaguccaa

SEQ ID NO: 619896 - RNA, 19 nt, Homo sapiens
aaagcaguauucagcgauu

SEQ ID NO: 619897 - RNA, 19 nt, Homo sapiens
caucaagcccacgaguuua

SEQ ID NO: 619898 - RNA, 19 nt, Homo sapiens
guucugauguagaugagau

SEQ ID NO: 619899 - RNA, 19 nt, Homo sapiens
ucagccauguuauuacaga

SEQ ID NO: 619900 - RNA, 19 nt, Homo sapiens
gagauuauacaguccaagu

SEQ ID NO: 619901 - RNA, 19 nt, Homo sapiens
auucagcgauuucaagaga

SEQ ID NO: 619902 - RNA, 19 nt, Homo sapiens
caagcaagaagaaaguaga

SEQ ID NO: 619903 - RNA, 19 nt, Homo sapiens
gaguugaggaauaugguuu

SEQ ID NO: 619904 - RNA, 19 nt, Homo sapiens
ugagaucaaauuccaagaa

SEQ ID NO: 619905 - RNA, 19 nt, Homo sapiens
gcuaugcaccaccgccuaa

SEQ ID NO: 619906 - RNA, 19 nt, Homo sapiens
uggaacaucuucugauacu

SEQ ID NO: 619907 - RNA, 19 nt, Homo sapiens
aagcaugucaucagauuug

SEQ ID NO: 619908 - RNA, 19 nt, Homo sapiens
uaggguuucugaacuacaa

SEQ ID NO: 619909 - RNA, 19 nt, Homo sapiens
gccaauaucaagcauguca

SEQ ID NO: 619910 - RNA, 19 nt, Homo sapiens
aagaagcuaugaaaguauc

SEQ ID NO: 619911 - RNA, 19 nt, Homo sapiens
cauuccagagcacuaauua

SEQ ID NO: 619912 - RNA, 19 nt, Homo sapiens
ggaagaauuacucuauguc

SEQ ID NO: 619913 - RNA, 19 nt, Homo sapiens
uuuaugauguccuugaugu

SEQ ID NO: 619914 - RNA, 19 nt, Homo sapiens
gccaggagaacaaagaaga

SEQ ID NO: 619915 - RNA, 19 nt, Homo sapiens
acacaaagcagcccaacca

SEQ ID NO: 619916 - RNA, 19 nt, Homo sapiens
aguaagccuuguucaguga

SEQ ID NO: 619917 - RNA, 19 nt, Homo sapiens
aaaguggacgcaagcauga

SEQ ID NO: 619918 - RNA, 19 nt, Homo sapiens
gcagauccugauagugaaa

SEQ ID NO: 619919 - RNA, 19 nt, Homo sapiens
uuccagagcacuaauuaaa

SEQ ID NO: 619920 - RNA, 19 nt, Homo sapiens
uagaaacccugaucauucc

SEQ ID NO: 619921 - RNA, 19 nt, Homo sapiens
gacaaguugcccucaagaa

SEQ ID NO: 619922 - RNA, 19 nt, Homo sapiens
uggagaagaugcaguauua

SEQ ID NO: 619923 - RNA, 19 nt, Homo sapiens
caaaugcuguugaaccaua

SEQ ID NO: 619924 - RNA, 19 nt, Homo sapiens
cagaggagcugaguaauga

SEQ ID NO: 619925 - RNA, 19 nt, Homo sapiens
ggacaaaggcagcuucuga

SEQ ID NO: 619926 - RNA, 19 nt, Homo sapiens
cgugagagcuucagcauga

SEQ ID NO: 619927 - RNA, 19 nt, Homo sapiens
caggaacucugcaguauau

SEQ ID NO: 619928 - RNA, 19 nt, Homo sapiens
ccaaagagcuccggcuaau

SEQ ID NO: 619929 - RNA, 19 nt, Homo sapiens
gcagaaaccauguggaaga

SEQ ID NO: 619930 - RNA, 19 nt, Homo sapiens
gcagggacuuggcuacuug

SEQ ID NO: 619931 - RNA, 19 nt, Homo sapiens
caaagcguauuaaacagaa

SEQ ID NO: 619932 - RNA, 19 nt, Homo sapiens
gaccggagguggagaagga

SEQ ID NO: 619933 - RNA, 19 nt, Homo sapiens
ucacugggcugcacuguca

SEQ ID NO: 619934 - RNA, 19 nt, Homo sapiens
agacaaagcguauuaaaca

SEQ ID NO: 619935 - RNA, 19 nt, Homo sapiens
ggacuacucggccaucauu

SEQ ID NO: 619936 - RNA, 19 nt, Homo sapiens
gcccaaggauggaugaaug

SEQ ID NO: 619937 - RNA, 19 nt, Homo sapiens
ccgaagcgcugccucaguu

SEQ ID NO: 619938 - RNA, 19 nt, Homo sapiens
ggaguuugauuaugaguac

SEQ ID NO: 619939 - RNA, 19 nt, Homo sapiens
aaaggcagcuucugacaca

SEQ ID NO: 619940 - RNA, 19 nt, Homo sapiens
gcucaagauuucugacuuc

SEQ ID NO: 619941 - RNA, 19 nt, Homo sapiens
gggcagcacuuugaggauu

SEQ ID NO: 619942 - RNA, 19 nt, Homo sapiens
ucagugggcugcucaagau

SEQ ID NO: 619943 - RNA, 19 nt, Homo sapiens
ugaacuugcugcucuccua

SEQ ID NO: 619944 - RNA, 19 nt, Homo sapiens
gggcagaaaccauguggaa

SEQ ID NO: 619945 - RNA, 19 nt, Homo sapiens
ucacaggaacucugcagua

SEQ ID NO: 619946 - RNA, 19 nt, Homo sapiens
guuggcagcuacacacuga

SEQ ID NO: 619947 - RNA, 19 nt, Homo sapiens
gcggcuaccuuaagaucuu

SEQ ID NO: 619948 - RNA, 19 nt, Homo sapiens
gggagauguuggaguuuga

SEQ ID NO: 619949 - RNA, 19 nt, Homo sapiens
acugagaccuucacaggaa

SEQ ID NO: 619950 - RNA, 19 nt, Homo sapiens
gcaggccuaucacugguau

SEQ ID NO: 619951 - RNA, 19 nt, Homo sapiens
cacaggaacucugcaguau

SEQ ID NO: 619952 - RNA, 19 nt, Homo sapiens
gggacaaugugcugaucaa

SEQ ID NO: 619953 - RNA, 19 nt, Homo sapiens
uguuggaguuugauuauga

SEQ ID NO: 619954 - RNA, 19 nt, Homo sapiens
gauguuggaguuugauuau

SEQ ID NO: 619955 - RNA, 19 nt, Homo sapiens
aaagagcuccggcuaauag

SEQ ID NO: 619956 - RNA, 19 nt, Homo sapiens
uaccagacaaagcguauua

SEQ ID NO: 619957 - RNA, 19 nt, Homo sapiens
cccacaggcugccauguuu

SEQ ID NO: 619958 - RNA, 19 nt, Homo sapiens
caaagagcuccggcuaaua

SEQ ID NO: 619959 - RNA, 19 nt, Homo sapiens
ggaaggaacgggaguacca

SEQ ID NO: 619960 - RNA, 19 nt, Homo sapiens
ggaaagcagcugacaucug

SEQ ID NO: 619961 - RNA, 19 nt, Homo sapiens
ccagacaaagcguauuaaa

SEQ ID NO: 619962 - RNA, 19 nt, Homo sapiens
gggcugcacugucauugag

SEQ ID NO: 619963 - RNA, 19 nt, Homo sapiens
ucgcaaggcuuuugacgua

SEQ ID NO: 619964 - RNA, 19 nt, Homo sapiens
gacaaagcguauuaaacag

SEQ ID NO: 619965 - RNA, 19 nt, Homo sapiens
gauguucguucuggacuca

SEQ ID NO: 619966 - RNA, 19 nt, Homo sapiens
gcaaaggcugcguggagaa

SEQ ID NO: 619967 - RNA, 19 nt, Homo sapiens
gaggaagcccggaccuaug

SEQ ID NO: 619968 - RNA, 19 nt, Homo sapiens
caugcuggccgcaguauug

SEQ ID NO: 619969 - RNA, 19 nt, Homo sapiens
caagguccauccgccaaug

SEQ ID NO: 619970 - RNA, 19 nt, Homo sapiens
gaagcgcugccucaguuau

SEQ ID NO: 619971 - RNA, 19 nt, Homo sapiens
gacaaugugcugaucaaca

SEQ ID NO: 619972 - RNA, 19 nt, Homo sapiens
cccagauccucgccaauga

SEQ ID NO: 619973 - RNA, 19 nt, Homo sapiens
gcagcugugcuccucauug

SEQ ID NO: 619974 - RNA, 19 nt, Homo sapiens
gggaggauguuuuccagaa

SEQ ID NO: 619975 - RNA, 19 nt, Homo sapiens
gcguggagaagaugcagua

SEQ ID NO: 619976 - RNA, 19 nt, Homo sapiens
acaaagcguauuaaacaga

SEQ ID NO: 619977 - RNA, 19 nt, Homo sapiens
cuacaguccugccaaccau

SEQ ID NO: 619978 - RNA, 19 nt, Homo sapiens
gcagagcagcuguauaagc

SEQ ID NO: 619979 - RNA, 19 nt, Homo sapiens
acaaggacauguucuucag

SEQ ID NO: 619980 - RNA, 19 nt, Homo sapiens
gauguggccgagcagcaua

SEQ ID NO: 619981 - RNA, 19 nt, Homo sapiens
ccauccaaaugcuguugaa

SEQ ID NO: 619982 - RNA, 19 nt, Homo sapiens
cggaugcggugaagcagau

SEQ ID NO: 619983 - RNA, 19 nt, Homo sapiens
caacucaaccacccagucu

SEQ ID NO: 619984 - RNA, 19 nt, Homo sapiens
gcccacaggcugccauguu

SEQ ID NO: 619985 - RNA, 19 nt, Homo sapiens
gagagcaccaucaguuucu

SEQ ID NO: 619986 - RNA, 19 nt, Homo sapiens
gcgcugcugcuuccucuau

SEQ ID NO: 619987 - RNA, 19 nt, Homo sapiens
ggcagcacuuugaggauuc

SEQ ID NO: 619988 - RNA, 19 nt, Homo sapiens
cagcugugcuccucauugc

SEQ ID NO: 619989 - RNA, 19 nt, Homo sapiens
cagaaaccauguggaagag

SEQ ID NO: 619990 - RNA, 19 nt, Homo sapiens
ccaaugcccagcucucugu

SEQ ID NO: 619991 - RNA, 19 nt, Homo sapiens
acaggaacucugcaguaua

SEQ ID NO: 619992 - RNA, 19 nt, Homo sapiens
acaaugugcugaucaacac

SEQ ID NO: 619993 - RNA, 19 nt, Homo sapiens
gcaucgccaucaaggagau

SEQ ID NO: 619994 - RNA, 19 nt, Homo sapiens
ggagucagcgccucaaagc

SEQ ID NO: 619995 - RNA, 19 nt, Homo sapiens
gcccagauccucgccaaug

SEQ ID NO: 619996 - RNA, 19 nt, Homo sapiens
ugaggaagcccggaccuau

SEQ ID NO: 619997 - RNA, 19 nt, Homo sapiens
ggaacucugcaguauaugg

SEQ ID NO: 619998 - RNA, 19 nt, Homo sapiens
cagcaugaccaacaaugug

SEQ ID NO: 619999 - RNA, 19 nt, Homo sapiens
cagcucggguuuccaggau

SEQ ID NO: 620000 - RNA, 19 nt, Homo sapiens
cccaagcacuaccagacaa

SEQ ID NO: 620001 - RNA, 19 nt, Homo sapiens
acacucugcucaccuaugc

SEQ ID NO: 620002 - RNA, 19 nt, Homo sapiens
cgaagcgcugccucaguua

SEQ ID NO: 620003 - RNA, 19 nt, Homo sapiens
gugggcugcucaagauuuc

SEQ ID NO: 620004 - RNA, 19 nt, Homo sapiens
cgagagcaccaucaguuuc

SEQ ID NO: 620005 - RNA, 19 nt, Homo sapiens
gcaggauccacaccaguca

SEQ ID NO: 620006 - RNA, 19 nt, Homo sapiens
agauguuggaguuugauua

SEQ ID NO: 620007 - RNA, 19 nt, Homo sapiens
ccaagcacuaccagacaaa

SEQ ID NO: 620008 - RNA, 19 nt, Homo sapiens
cacaggcacccaagcacua

SEQ ID NO: 620009 - RNA, 19 nt, Homo sapiens
gaugaauggagaggacaaa

SEQ ID NO: 620010 - RNA, 19 nt, Homo sapiens
gauucaggcaccauccaaa

SEQ ID NO: 620011 - RNA, 19 nt, Homo sapiens
gcaucacaccuugcacuga

SEQ ID NO: 620012 - RNA, 19 nt, Homo sapiens
ccacacccacagacucuug

SEQ ID NO: 620013 - RNA, 19 nt, Homo sapiens
gaggauguuuuccagaaga

SEQ ID NO: 620014 - RNA, 19 nt, Homo sapiens
uuacugggauguggguuuc

SEQ ID NO: 620015 - RNA, 19 nt, Homo sapiens
guggagaagaugcaguauu

SEQ ID NO: 620016 - RNA, 19 nt, Homo sapiens
gcaaggcuuuugacguaga

SEQ ID NO: 620017 - RNA, 19 nt, Homo sapiens
uccaaaugcuguugaacca

SEQ ID NO: 620018 - RNA, 19 nt, Homo sapiens
gcugcacugucauugagau

SEQ ID NO: 620019 - RNA, 19 nt, Homo sapiens
gcaggcaucacaccuugca

SEQ ID NO: 620020 - RNA, 19 nt, Homo sapiens
aacgagagcaccaucaguu

SEQ ID NO: 620021 - RNA, 19 nt, Homo sapiens
gcuucagcaugaccaacaa

SEQ ID NO: 620022 - RNA, 19 nt, Homo sapiens
uggagaagaugcaguauua

SEQ ID NO: 620023 - RNA, 19 nt, Homo sapiens
ggacaaaggcagcuucuga

SEQ ID NO: 620024 - RNA, 19 nt, Homo sapiens
cgugagagcuucagcauga

SEQ ID NO: 620025 - RNA, 19 nt, Homo sapiens
caggaacucugcaguauau

SEQ ID NO: 620026 - RNA, 19 nt, Homo sapiens
ccaaagagcuccggcuaau

SEQ ID NO: 620027 - RNA, 19 nt, Homo sapiens
gcagaaaccauguggaaga

SEQ ID NO: 620028 - RNA, 19 nt, Homo sapiens
gcagggacuuggcuacuug

SEQ ID NO: 620029 - RNA, 19 nt, Homo sapiens
caaagcguauuaaacagaa

SEQ ID NO: 620030 - RNA, 19 nt, Homo sapiens
ucacugggcugcacuguca

SEQ ID NO: 620031 - RNA, 19 nt, Homo sapiens
agacaaagcguauuaaaca

SEQ ID NO: 620032 - RNA, 19 nt, Homo sapiens
ggacuacucggccaucauu

SEQ ID NO: 620033 - RNA, 19 nt, Homo sapiens
ccgaagcgcugccucaguu

SEQ ID NO: 620034 - RNA, 19 nt, Homo sapiens
ggaguuugauuaugaguac

SEQ ID NO: 620035 - RNA, 19 nt, Homo sapiens
aaaggcagcuucugacaca

SEQ ID NO: 620036 - RNA, 19 nt, Homo sapiens
gcucaagauuucugacuuc

SEQ ID NO: 620037 - RNA, 19 nt, Homo sapiens
gggcagcacuuugaggauu

SEQ ID NO: 620038 - RNA, 19 nt, Homo sapiens
ucagugggcugcucaagau

SEQ ID NO: 620039 - RNA, 19 nt, Homo sapiens
ugaacuugcugcucuccua

SEQ ID NO: 620040 - RNA, 19 nt, Homo sapiens
gggcagaaaccauguggaa

SEQ ID NO: 620041 - RNA, 19 nt, Homo sapiens
ucacaggaacucugcagua

SEQ ID NO: 620042 - RNA, 19 nt, Homo sapiens
guuggcagcuacacacuga

SEQ ID NO: 620043 - RNA, 19 nt, Homo sapiens
gcggcuaccuuaagaucuu

SEQ ID NO: 620044 - RNA, 19 nt, Homo sapiens
gggagauguuggaguuuga

SEQ ID NO: 620045 - RNA, 19 nt, Homo sapiens
acugagaccuucacaggaa

SEQ ID NO: 620046 - RNA, 19 nt, Homo sapiens
gcaggccuaucacugguau

SEQ ID NO: 620047 - RNA, 19 nt, Homo sapiens
cacaggaacucugcaguau

SEQ ID NO: 620048 - RNA, 19 nt, Homo sapiens
gggacaaugugcugaucaa

SEQ ID NO: 620049 - RNA, 19 nt, Homo sapiens
uguuggaguuugauuauga

SEQ ID NO: 620050 - RNA, 19 nt, Homo sapiens
gauguuggaguuugauuau

SEQ ID NO: 620051 - RNA, 19 nt, Homo sapiens
aaagagcuccggcuaauag

SEQ ID NO: 620052 - RNA, 19 nt, Homo sapiens
uaccagacaaagcguauua

SEQ ID NO: 620053 - RNA, 19 nt, Homo sapiens
cccacaggcugccauguuu

SEQ ID NO: 620054 - RNA, 19 nt, Homo sapiens
caaagagcuccggcuaaua

SEQ ID NO: 620055 - RNA, 19 nt, Homo sapiens
cugcaaggauggaugaaug

SEQ ID NO: 620056 - RNA, 19 nt, Homo sapiens
ggaaagcagcugacaucug

SEQ ID NO: 620057 - RNA, 19 nt, Homo sapiens
ccagacaaagcguauuaaa

SEQ ID NO: 620058 - RNA, 19 nt, Homo sapiens
gggcugcacugucauugag

SEQ ID NO: 620059 - RNA, 19 nt, Homo sapiens
ucgcaaggcuuuugacgua

SEQ ID NO: 620060 - RNA, 19 nt, Homo sapiens
gacaaagcguauuaaacag

SEQ ID NO: 620061 - RNA, 19 nt, Homo sapiens
gcaaaggcugcguggagaa

SEQ ID NO: 620062 - RNA, 19 nt, Homo sapiens
caugcuggccgcaguauug

SEQ ID NO: 620063 - RNA, 19 nt, Homo sapiens
caagguccauccgccaaug

SEQ ID NO: 620064 - RNA, 19 nt, Homo sapiens
gaagcgcugccucaguuau

SEQ ID NO: 620065 - RNA, 19 nt, Homo sapiens
gacaaugugcugaucaaca

SEQ ID NO: 620066 - RNA, 19 nt, Homo sapiens
cccagauccucgccaauga

SEQ ID NO: 620067 - RNA, 19 nt, Homo sapiens
gcagcugugcuccucauug

SEQ ID NO: 620068 - RNA, 19 nt, Homo sapiens
gcguggagaagaugcagua

SEQ ID NO: 620069 - RNA, 19 nt, Homo sapiens
gggaggauguuuuccagaa

SEQ ID NO: 620070 - RNA, 19 nt, Homo sapiens
acaaagcguauuaaacaga

SEQ ID NO: 620071 - RNA, 19 nt, Homo sapiens
cuacaguccugccaaccau

SEQ ID NO: 620072 - RNA, 19 nt, Homo sapiens
gcagagcagcuguauaagc

SEQ ID NO: 620073 - RNA, 19 nt, Homo sapiens
acaaggacauguucuucag

SEQ ID NO: 620074 - RNA, 19 nt, Homo sapiens
gauguggccgagcagcaua

SEQ ID NO: 620075 - RNA, 19 nt, Homo sapiens
caacucaaccacccagucu

SEQ ID NO: 620076 - RNA, 19 nt, Homo sapiens
gcccacaggcugccauguu

SEQ ID NO: 620077 - RNA, 19 nt, Homo sapiens
gagagcaccaucaguuucu

SEQ ID NO: 620078 - RNA, 19 nt, Homo sapiens
gcgcugcugcuuccucuau

SEQ ID NO: 620079 - RNA, 19 nt, Homo sapiens
ggcagcacuuugaggauuc

SEQ ID NO: 620080 - RNA, 19 nt, Homo sapiens
cagcugugcuccucauugc

SEQ ID NO: 620081 - RNA, 19 nt, Homo sapiens
cagaaaccauguggaagag

SEQ ID NO: 620082 - RNA, 19 nt, Homo sapiens
ccaaugcccagcucucugu

SEQ ID NO: 620083 - RNA, 19 nt, Homo sapiens
acaggaacucugcaguaua

SEQ ID NO: 620084 - RNA, 19 nt, Homo sapiens
acaaugugcugaucaacac

SEQ ID NO: 620085 - RNA, 19 nt, Homo sapiens
gcaucgccaucaaggagau

SEQ ID NO: 620086 - RNA, 19 nt, Homo sapiens
ggagucagcgccucaaagc

SEQ ID NO: 620087 - RNA, 19 nt, Homo sapiens
gcccagauccucgccaaug

SEQ ID NO: 620088 - RNA, 19 nt, Homo sapiens
ggaacucugcaguauaugg

SEQ ID NO: 620089 - RNA, 19 nt, Homo sapiens
cagcaugaccaacaaugug

SEQ ID NO: 620090 - RNA, 19 nt, Homo sapiens
cagcucggguuuccaggau

SEQ ID NO: 620091 - RNA, 19 nt, Homo sapiens
cccaagcacuaccagacaa

SEQ ID NO: 620092 - RNA, 19 nt, Homo sapiens
gcgcugcaaggauggauga

SEQ ID NO: 620093 - RNA, 19 nt, Homo sapiens
cgaagcgcugccucaguua

SEQ ID NO: 620094 - RNA, 19 nt, Homo sapiens
gugggcugcucaagauuuc

SEQ ID NO: 620095 - RNA, 19 nt, Homo sapiens
cgagagcaccaucaguuuc

SEQ ID NO: 620096 - RNA, 19 nt, Homo sapiens
agauguuggaguuugauua

SEQ ID NO: 620097 - RNA, 19 nt, Homo sapiens
ccaagcacuaccagacaaa

SEQ ID NO: 620098 - RNA, 19 nt, Homo sapiens
cacaggcacccaagcacua

SEQ ID NO: 620099 - RNA, 19 nt, Homo sapiens
gaugaauggagaggacaaa

SEQ ID NO: 620100 - RNA, 19 nt, Homo sapiens
gaggauguuuuccagaaga

SEQ ID NO: 620101 - RNA, 19 nt, Homo sapiens
gcaucacaccuugcacuga

SEQ ID NO: 620102 - RNA, 19 nt, Homo sapiens
ccacacccacagacucuug

SEQ ID NO: 620103 - RNA, 19 nt, Homo sapiens
uuacugggauguggguuuc

SEQ ID NO: 620104 - RNA, 19 nt, Homo sapiens
guggagaagaugcaguauu

SEQ ID NO: 620105 - RNA, 19 nt, Homo sapiens
gcaaggcuuuugacguaga

SEQ ID NO: 620106 - RNA, 19 nt, Homo sapiens
gcugcacugucauugagau

SEQ ID NO: 620107 - RNA, 19 nt, Homo sapiens
gcuucagcaugaccaacaa

SEQ ID NO: 620108 - RNA, 19 nt, Homo sapiens
gcaggcaucacaccuugca

SEQ ID NO: 620109 - RNA, 19 nt, Homo sapiens
aacgagagcaccaucaguu

SEQ ID NO: 620110 - RNA, 19 nt, Homo sapiens
gcaaggauggaugaaugga

SEQ ID NO: 620111 - RNA, 19 nt, Homo sapiens
gagauguuggaguuugauu

SEQ ID NO: 620112 - RNA, 19 nt, Homo sapiens
ugggaaagcagcugacauc

SEQ ID NO: 620113 - RNA, 19 nt, Homo sapiens
agacucuuguggcuauuuc

SEQ ID NO: 620114 - RNA, 19 nt, Homo sapiens
ccacuucuggcuccacuuc

SEQ ID NO: 620115 - RNA, 19 nt, Homo sapiens
uggccgagcagcauaaugu

SEQ ID NO: 620116 - RNA, 19 nt, Homo sapiens
cagacaaagcguauuaaac

SEQ ID NO: 620117 - RNA, 19 nt, Homo sapiens
caacgagagcaccaucagu

SEQ ID NO: 620118 - RNA, 19 nt, Homo sapiens
gcacguaugggguggugua

SEQ ID NO: 620119 - RNA, 19 nt, Homo sapiens
gugcugguccuggagauga

SEQ ID NO: 620120 - RNA, 19 nt, Homo sapiens
cggauugcguuggcagcua

SEQ ID NO: 620121 - RNA, 19 nt, Homo sapiens
cuacaaggacauguucuuc

SEQ ID NO: 620122 - RNA, 19 nt, Homo sapiens
gaacaaacuucuacacuga

SEQ ID NO: 620123 - RNA, 19 nt, Homo sapiens
gaacagugcuugaggauau

SEQ ID NO: 620124 - RNA, 19 nt, Homo sapiens
ggacagagauaaagauaug

SEQ ID NO: 620125 - RNA, 19 nt, Homo sapiens
gaccagaacuuccacuaua

SEQ ID NO: 620126 - RNA, 19 nt, Homo sapiens
gagagacacucgccaauuu

SEQ ID NO: 620127 - RNA, 19 nt, Homo sapiens
ggagauagauguucugcaa

SEQ ID NO: 620128 - RNA, 19 nt, Homo sapiens
gaaauacgcuuccuugacu

SEQ ID NO: 620129 - RNA, 19 nt, Homo sapiens
acacagaacuuuguacuuu

SEQ ID NO: 620130 - RNA, 19 nt, Homo sapiens
ccacagaaauguugaagau

SEQ ID NO: 620131 - RNA, 19 nt, Homo sapiens
uuagaagacuggagugaua

SEQ ID NO: 620132 - RNA, 19 nt, Homo sapiens
gcaaagaaaugugcauaca

SEQ ID NO: 620133 - RNA, 19 nt, Homo sapiens
gaaagugaauucuauagac

SEQ ID NO: 620134 - RNA, 19 nt, Homo sapiens
uuacauagguggcuuguca

SEQ ID NO: 620135 - RNA, 19 nt, Homo sapiens
caagaugcaaguaccauua

SEQ ID NO: 620136 - RNA, 19 nt, Homo sapiens
gaugaucacuuuguuggaa

SEQ ID NO: 620137 - RNA, 19 nt, Homo sapiens
uacaugagauuauccguaa

SEQ ID NO: 620138 - RNA, 19 nt, Homo sapiens
gaauaagggcagcaaguuu

SEQ ID NO: 620139 - RNA, 19 nt, Homo sapiens
gcauaaugguaaacaauuc

SEQ ID NO: 620140 - RNA, 19 nt, Homo sapiens
uagcaacuaugaagagaaa

SEQ ID NO: 620141 - RNA, 19 nt, Homo sapiens
gcagcaaguuucuggauuc

SEQ ID NO: 620142 - RNA, 19 nt, Homo sapiens
aaacagcaauggaccaaug

SEQ ID NO: 620143 - RNA, 19 nt, Homo sapiens
gcaaguaccauuaaagaca

SEQ ID NO: 620144 - RNA, 19 nt, Homo sapiens
guaaagaggaagcaaagaa

SEQ ID NO: 620145 - RNA, 19 nt, Homo sapiens
ccauuaaagucacagauga

SEQ ID NO: 620146 - RNA, 19 nt, Homo sapiens
auagguggcuugucaaauu

SEQ ID NO: 620147 - RNA, 19 nt, Homo sapiens
uaaccuaaauggaguaugg

SEQ ID NO: 620148 - RNA, 19 nt, Homo sapiens
uaagagggauaauucacuu

SEQ ID NO: 620149 - RNA, 19 nt, Homo sapiens
ccugguaccugaacaaaga

SEQ ID NO: 620150 - RNA, 19 nt, Homo sapiens
aaagggaaccuauaaaugu

SEQ ID NO: 620151 - RNA, 19 nt, Homo sapiens
gcugggagguaacgagauu

SEQ ID NO: 620152 - RNA, 19 nt, Homo sapiens
gaaggaccauucaaagacu

SEQ ID NO: 620153 - RNA, 19 nt, Homo sapiens
aaggaaagccguaacauga

SEQ ID NO: 620154 - RNA, 19 nt, Homo sapiens
agguaaagcugcugagaaa

SEQ ID NO: 620155 - RNA, 19 nt, Homo sapiens
caccugaucuggcaacuuc

SEQ ID NO: 620156 - RNA, 19 nt, Homo sapiens
ucagagggauccagguuau

SEQ ID NO: 620157 - RNA, 19 nt, Homo sapiens
gaagauggcaacaagauac

SEQ ID NO: 620158 - RNA, 19 nt, Homo sapiens
uaaagaggaagcaaagaaa

SEQ ID NO: 620159 - RNA, 19 nt, Homo sapiens
gcaaguuucuggauucacu

SEQ ID NO: 620160 - RNA, 19 nt, Homo sapiens
ccuauugacugaagagaga

SEQ ID NO: 620161 - RNA, 19 nt, Homo sapiens
gcaauggaccaaugcaguu

SEQ ID NO: 620162 - RNA, 19 nt, Homo sapiens
uaaccaaucugugaugauc

SEQ ID NO: 620163 - RNA, 19 nt, Homo sapiens
uugcagagguggacaauuc

SEQ ID NO: 620164 - RNA, 19 nt, Homo sapiens
uaagagcaguucagaugau

SEQ ID NO: 620165 - RNA, 19 nt, Homo sapiens
gcaccaagauggaauuuuc

SEQ ID NO: 620166 - RNA, 19 nt, Homo sapiens
ggaaagccguaacaugaac

SEQ ID NO: 620167 - RNA, 19 nt, Homo sapiens
gagacacucgccaauuuaa

SEQ ID NO: 620168 - RNA, 19 nt, Homo sapiens
agacggcucugucaacuuc

SEQ ID NO: 620169 - RNA, 19 nt, Homo sapiens
ccuaacagccaacaguaua

SEQ ID NO: 620170 - RNA, 19 nt, Homo sapiens
guaccugaacaaagaauaa

SEQ ID NO: 620171 - RNA, 19 nt, Homo sapiens
gauguggcauaaugguaaa

SEQ ID NO: 620172 - RNA, 19 nt, Homo sapiens
gacccuaggugugcuauuc

SEQ ID NO: 620173 - RNA, 19 nt, Homo sapiens
uaaagucacagaugaacaa

SEQ ID NO: 620174 - RNA, 19 nt, Homo sapiens
ucaccacacuggacagaga

SEQ ID NO: 620175 - RNA, 19 nt, Homo sapiens
gaacuuaccagggaaaugc

SEQ ID NO: 620176 - RNA, 19 nt, Homo sapiens
ucagugggauuuauaugau

SEQ ID NO: 620177 - RNA, 19 nt, Homo sapiens
ggagguaacgagauucaga

SEQ ID NO: 620178 - RNA, 19 nt, Homo sapiens
caaguaccauuaaagacau

SEQ ID NO: 620179 - RNA, 19 nt, Homo sapiens
uaaaugacacagaacuuug

SEQ ID NO: 620180 - RNA, 19 nt, Homo sapiens
aaagauauguaugcaggaa

SEQ ID NO: 620181 - RNA, 19 nt, Homo sapiens
gcuuagcaaucaagauaau

SEQ ID NO: 620182 - RNA, 19 nt, Homo sapiens
gaacucucguguuacucaa

SEQ ID NO: 620183 - RNA, 19 nt, Homo sapiens
guaaacaauucaccacacu

SEQ ID NO: 620184 - RNA, 19 nt, Homo sapiens
gucaauaaccaaucuguga

SEQ ID NO: 620185 - RNA, 19 nt, Homo sapiens
ucaccaggauggaccuuga

SEQ ID NO: 620186 - RNA, 19 nt, Homo sapiens
guacagaggaggccauuac

SEQ ID NO: 620187 - RNA, 19 nt, Homo sapiens
aaaggaggcuggugguaca

SEQ ID NO: 620188 - RNA, 19 nt, Homo sapiens
cgcuuucucugcuggauua

SEQ ID NO: 620189 - RNA, 19 nt, Homo sapiens
uaaagcugcugagaaagga

SEQ ID NO: 620190 - RNA, 19 nt, Homo sapiens
gagguaaagcugcugagaa

SEQ ID NO: 620191 - RNA, 19 nt, Homo sapiens
guagauggaaacauuguga

SEQ ID NO: 620192 - RNA, 19 nt, Homo sapiens
ggugguggauguagaugga

SEQ ID NO: 620193 - RNA, 19 nt, Homo sapiens
acaaacuucuacacugauu

SEQ ID NO: 620194 - RNA, 19 nt, Homo sapiens
cagaggaggccauuacaga

SEQ ID NO: 620195 - RNA, 19 nt, Homo sapiens
ggaggcuggugguacaaug

SEQ ID NO: 620196 - RNA, 19 nt, Homo sapiens
caagauacagggaacuaga

SEQ ID NO: 620197 - RNA, 19 nt, Homo sapiens
gcaagaugcaaguaccauu

SEQ ID NO: 620198 - RNA, 19 nt, Homo sapiens
cagcagcuuucgucuggaa

SEQ ID NO: 620199 - RNA, 19 nt, Homo sapiens
uuacucaacucuauaugca

SEQ ID NO: 620200 - RNA, 19 nt, Homo sapiens
aaaauuaacccaacgcaua

SEQ ID NO: 620201 - RNA, 19 nt, Homo sapiens
ggcagcaaguuucuggauu

SEQ ID NO: 620202 - RNA, 19 nt, Homo sapiens
gagauaaagauauguaugc

SEQ ID NO: 620203 - RNA, 19 nt, Homo sapiens
caauggaccaaugcaguua

SEQ ID NO: 620204 - RNA, 19 nt, Homo sapiens
caaagacugucagcaagca

SEQ ID NO: 620205 - RNA, 19 nt, Homo sapiens
cagguuaucccagagauuu

SEQ ID NO: 620206 - RNA, 19 nt, Homo sapiens
agagacacucgccaauuua

SEQ ID NO: 620207 - RNA, 19 nt, Homo sapiens
ggcauaaugguaaacaauu

SEQ ID NO: 620208 - RNA, 19 nt, Homo sapiens
ucuggaaccugaaagugaa

SEQ ID NO: 620209 - RNA, 19 nt, Homo sapiens
guuggacuguuauucagaa

SEQ ID NO: 620210 - RNA, 19 nt, Homo sapiens
gugcuauucuuccuacuag

SEQ ID NO: 620211 - RNA, 19 nt, Homo sapiens
guauauuacuuggcacaau

SEQ ID NO: 620212 - RNA, 19 nt, Homo sapiens
gacacucgccaauuuaaau

SEQ ID NO: 620213 - RNA, 19 nt, Homo sapiens
cuuaagagcaguucagaug

SEQ ID NO: 620214 - RNA, 19 nt, Homo sapiens
guacaaugccugugcacau

SEQ ID NO: 620215 - RNA, 19 nt, Homo sapiens
uauaagaaaggguuuggaa

SEQ ID NO: 620216 - RNA, 19 nt, Homo sapiens
gaacuuccacuauacuacu

SEQ ID NO: 620217 - RNA, 19 nt, Homo sapiens
acagggaacuagaggugaa

SEQ ID NO: 620218 - RNA, 19 nt, Homo sapiens
ugaagauggcaacaagaua

SEQ ID NO: 620219 - RNA, 19 nt, Homo sapiens
caugaacucucguguuacu

SEQ ID NO: 620220 - RNA, 19 nt, Homo sapiens
gaaaggaaagccguaacau

SEQ ID NO: 620221 - RNA, 19 nt, Homo sapiens
ggcagaagcgggagauaga

SEQ ID NO: 620222 - RNA, 19 nt, Homo sapiens
agaagaaccugacuguuua

SEQ ID NO: 620223 - RNA, 19 nt, Homo sapiens
gagaagaaccugacuguuu

SEQ ID NO: 620224 - RNA, 19 nt, Homo sapiens
gaaccugacuguuuacaca

SEQ ID NO: 620225 - RNA, 19 nt, Homo sapiens
ccaagugucuggucaauag

SEQ ID NO: 620226 - RNA, 19 nt, Homo sapiens
ugacuucccuuauacuauu

SEQ ID NO: 620227 - RNA, 19 nt, Homo sapiens
guuuaugacuucccuuaua

SEQ ID NO: 620228 - RNA, 19 nt, Homo sapiens
gaaauugacauuccaguag

SEQ ID NO: 620229 - RNA, 19 nt, Homo sapiens
gaaguuugagccagucuuu

SEQ ID NO: 620230 - RNA, 19 nt, Homo sapiens
ggugaaaugugcccgguau

SEQ ID NO: 620231 - RNA, 19 nt, Homo sapiens
ggacucugcuucccaacug

SEQ ID NO: 620232 - RNA, 19 nt, Homo sapiens
uaacauccaucugaacaag

SEQ ID NO: 620233 - RNA, 19 nt, Homo sapiens
ugaaauugacauuccagua

SEQ ID NO: 620234 - RNA, 19 nt, Homo sapiens
ucucugccauugaaauuga

SEQ ID NO: 620235 - RNA, 19 nt, Homo sapiens
gagccagucuuuucauuug

SEQ ID NO: 620236 - RNA, 19 nt, Homo sapiens
acauccaucugaacaagaa

SEQ ID NO: 620237 - RNA, 19 nt, Homo sapiens
cugcugcucugccugauug

SEQ ID NO: 620238 - RNA, 19 nt, Homo sapiens
cgacacuacuugguacuca

SEQ ID NO: 620239 - RNA, 19 nt, Homo sapiens
ugaaaugugcccgguauga

SEQ ID NO: 620240 - RNA, 19 nt, Homo sapiens
acaucaaacuggccaagug

SEQ ID NO: 620241 - RNA, 19 nt, Homo sapiens
aaauugacauuccaguagu

SEQ ID NO: 620242 - RNA, 19 nt, Homo sapiens
aaucuuugccuucuccuuu

SEQ ID NO: 620243 - RNA, 19 nt, Homo sapiens
caucugaacaagaaguuug

SEQ ID NO: 620244 - RNA, 19 nt, Homo sapiens
caacagaaacgagaagaac

SEQ ID NO: 620245 - RNA, 19 nt, Homo sapiens
uaguuucacacaccacuua

SEQ ID NO: 620246 - RNA, 19 nt, Homo sapiens
gugacugccugauguacga

SEQ ID NO: 620247 - RNA, 19 nt, Homo sapiens
ugacauuccaguaguuuca

SEQ ID NO: 620248 - RNA, 19 nt, Homo sapiens
gacuucccuuauacuauuu

SEQ ID NO: 620249 - RNA, 19 nt, Homo sapiens
gguccucggugcccaacau

SEQ ID NO: 620250 - RNA, 19 nt, Homo sapiens
ccacgcagccacaguccuu

SEQ ID NO: 620251 - RNA, 19 nt, Homo sapiens
cauccacccaguaugcaua

SEQ ID NO: 620252 - RNA, 19 nt, Homo sapiens
uauaacauccaucugaaca

SEQ ID NO: 620253 - RNA, 19 nt, Homo sapiens
ggccaagugucuggucaau

SEQ ID NO: 620254 - RNA, 19 nt, Homo sapiens
uggaaucgccucaguagca

SEQ ID NO: 620255 - RNA, 19 nt, Homo sapiens
ucgccucucugccauugaa

SEQ ID NO: 620256 - RNA, 19 nt, Homo sapiens
cucaguagcaggccucuuu

SEQ ID NO: 620257 - RNA, 19 nt, Homo sapiens
ccauugaaauugacauucc

SEQ ID NO: 620258 - RNA, 19 nt, Homo sapiens
uaugacuucccuuauacua

SEQ ID NO: 620259 - RNA, 19 nt, Homo sapiens
ugaucacauucaacagaaa

SEQ ID NO: 620260 - RNA, 19 nt, Homo sapiens
uggagaaaauuacgauuga

SEQ ID NO: 620261 - RNA, 19 nt, Homo sapiens
ccacaguccuuuccuuccu

SEQ ID NO: 620262 - RNA, 19 nt, Homo sapiens
gaaaugugcccgguaugac

SEQ ID NO: 620263 - RNA, 19 nt, Homo sapiens
cagccacaguccuuuccuu

SEQ ID NO: 620264 - RNA, 19 nt, Homo sapiens
uuuaugacuucccuuauac

SEQ ID NO: 620265 - RNA, 19 nt, Homo sapiens
uguacgacacuacuuggua

SEQ ID NO: 620266 - RNA, 19 nt, Homo sapiens
guguaugucacuauugcua

SEQ ID NO: 620267 - RNA, 19 nt, Homo sapiens
cuaucugggucaucuuuua

SEQ ID NO: 620268 - RNA, 19 nt, Homo sapiens
caucaaacuggccaagugu

SEQ ID NO: 620269 - RNA, 19 nt, Homo sapiens
gaagaaccugacuguuuac

SEQ ID NO: 620270 - RNA, 19 nt, Homo sapiens
ggucaucuuuuauaacauc

SEQ ID NO: 620271 - RNA, 19 nt, Homo sapiens
ucaacagaaacgagaagaa

SEQ ID NO: 620272 - RNA, 19 nt, Homo sapiens
gguaugacgggagcaguga

SEQ ID NO: 620273 - RNA, 19 nt, Homo sapiens
ccaucuaucugggucaucu

SEQ ID NO: 620274 - RNA, 19 nt, Homo sapiens
gccaagugucuggucaaua

SEQ ID NO: 620275 - RNA, 19 nt, Homo sapiens
ugauguacgacacuacuug

SEQ ID NO: 620276 - RNA, 19 nt, Homo sapiens
ccucucugccauugaaauu

SEQ ID NO: 620277 - RNA, 19 nt, Homo sapiens
aauugacauuccaguaguu

SEQ ID NO: 620278 - RNA, 19 nt, Homo sapiens
ucauuugacuaugcagugu

SEQ ID NO: 620279 - RNA, 19 nt, Homo sapiens
gacacuacuugguacucau

SEQ ID NO: 620280 - RNA, 19 nt, Homo sapiens
gaucacauucaacagaaac

SEQ ID NO: 620281 - RNA, 19 nt, Homo sapiens
gagaacaccugaaaucaau

SEQ ID NO: 620282 - RNA, 19 nt, Homo sapiens
ccgaguaacuaacuuauuu

SEQ ID NO: 620283 - RNA, 19 nt, Homo sapiens
aaagauggcuaucgguaua

SEQ ID NO: 620284 - RNA, 19 nt, Homo sapiens
ccgagaagcuggaaauuga

SEQ ID NO: 620285 - RNA, 19 nt, Homo sapiens
uacaagagcugcacgguuu

SEQ ID NO: 620286 - RNA, 19 nt, Homo sapiens
gagaagggcuacucuaugg

SEQ ID NO: 620287 - RNA, 19 nt, Homo sapiens
guucacggcugacacauuu

SEQ ID NO: 620288 - RNA, 19 nt, Homo sapiens
gaacacccguuuaacaaag

SEQ ID NO: 620289 - RNA, 19 nt, Homo sapiens
aaaccaaucuaaacgcuaa

SEQ ID NO: 620290 - RNA, 19 nt, Homo sapiens
ccagacacauacaaagaua

SEQ ID NO: 620291 - RNA, 19 nt, Homo sapiens
gaugagaugccaccagaua

SEQ ID NO: 620292 - RNA, 19 nt, Homo sapiens
caguaaagauccagaagaa

SEQ ID NO: 620293 - RNA, 19 nt, Homo sapiens
acaauguucuccaaagaua

SEQ ID NO: 620294 - RNA, 19 nt, Homo sapiens
guaaagauccagaagaaga

SEQ ID NO: 620295 - RNA, 19 nt, Homo sapiens
caaauguucucccaaagau

SEQ ID NO: 620296 - RNA, 19 nt, Homo sapiens
uaacauugguccugcuuau

SEQ ID NO: 620297 - RNA, 19 nt, Homo sapiens
gaaaugugccuuagugcuu

SEQ ID NO: 620298 - RNA, 19 nt, Homo sapiens
gagacagaaucaucuaaug

SEQ ID NO: 620299 - RNA, 19 nt, Homo sapiens
gaucaggaccuuaguaaca

SEQ ID NO: 620300 - RNA, 19 nt, Homo sapiens
agagauguauucuugguaa

SEQ ID NO: 620301 - RNA, 19 nt, Homo sapiens
gagcugcaaugugggauuu

SEQ ID NO: 620302 - RNA, 19 nt, Homo sapiens
ugaaaucggugcuguacug

SEQ ID NO: 620303 - RNA, 19 nt, Homo sapiens
ugaaaucaauggcuauaca

SEQ ID NO: 620304 - RNA, 19 nt, Homo sapiens
gcugcacgguuuccauuaa

SEQ ID NO: 620305 - RNA, 19 nt, Homo sapiens
gcagugcugugucuacuag

SEQ ID NO: 620306 - RNA, 19 nt, Homo sapiens
ucucaaauguucucccaaa

SEQ ID NO: 620307 - RNA, 19 nt, Homo sapiens
ggaccaugcuucaaguauc

SEQ ID NO: 620308 - RNA, 19 nt, Homo sapiens
ggaacacccguuuaacaaa

SEQ ID NO: 620309 - RNA, 19 nt, Homo sapiens
ccacagggaccaccaagaa

SEQ ID NO: 620310 - RNA, 19 nt, Homo sapiens
acacuacucuucuggcuau

SEQ ID NO: 620311 - RNA, 19 nt, Homo sapiens
ggaagggugccugguauuu

SEQ ID NO: 620312 - RNA, 19 nt, Homo sapiens
gcugugacuuguuauccua

SEQ ID NO: 620313 - RNA, 19 nt, Homo sapiens
ugccagcugugacuuguua

SEQ ID NO: 620314 - RNA, 19 nt, Homo sapiens
caaggacuuucugggaaua

SEQ ID NO: 620315 - RNA, 19 nt, Homo sapiens
cgaagacaauguucuccaa

SEQ ID NO: 620316 - RNA, 19 nt, Homo sapiens
ggacuuucugggaauaaua

SEQ ID NO: 620317 - RNA, 19 nt, Homo sapiens
agacaauguucuccaaaga

SEQ ID NO: 620318 - RNA, 19 nt, Homo sapiens
gaguaaagaaagagaugua

SEQ ID NO: 620319 - RNA, 19 nt, Homo sapiens
guccugggauuuuauauua

SEQ ID NO: 620320 - RNA, 19 nt, Homo sapiens
gaagacaauguucuccaaa

SEQ ID NO: 620321 - RNA, 19 nt, Homo sapiens
ugacacauuuggcauagau

SEQ ID NO: 620322 - RNA, 19 nt, Homo sapiens
gcaguaaagauccagaaga

SEQ ID NO: 620323 - RNA, 19 nt, Homo sapiens
gagauguauucuugguaaa

SEQ ID NO: 620324 - RNA, 19 nt, Homo sapiens
gacuguaucccaccuguuu

SEQ ID NO: 620325 - RNA, 19 nt, Homo sapiens
ggagacagaaucaucuaau

SEQ ID NO: 620326 - RNA, 19 nt, Homo sapiens
aagcaaacuugaaggaaau

SEQ ID NO: 620327 - RNA, 19 nt, Homo sapiens
uggcugacgucuuguauca

SEQ ID NO: 620328 - RNA, 19 nt, Homo sapiens
gguguggcuuacaaagaua

SEQ ID NO: 620329 - RNA, 19 nt, Homo sapiens
gcuauacauuccaaaccaa

SEQ ID NO: 620330 - RNA, 19 nt, Homo sapiens
cacccuggcugacgucuug

SEQ ID NO: 620331 - RNA, 19 nt, Homo sapiens
gacagaaucaucuaaugga

SEQ ID NO: 620332 - RNA, 19 nt, Homo sapiens
ucaaggacuuucugggaau

SEQ ID NO: 620333 - RNA, 19 nt, Homo sapiens
ucaaucaagguguggcuua

SEQ ID NO: 620334 - RNA, 19 nt, Homo sapiens
aaaugugccuuagugcuuu

SEQ ID NO: 620335 - RNA, 19 nt, Homo sapiens
ggagacugccugccuuuca

SEQ ID NO: 620336 - RNA, 19 nt, Homo sapiens
ucaaauguucucccaaaga

SEQ ID NO: 620337 - RNA, 19 nt, Homo sapiens
gagcugcacgguuuccauu

SEQ ID NO: 620338 - RNA, 19 nt, Homo sapiens
ugaucgagcuccccaguua

SEQ ID NO: 620339 - RNA, 19 nt, Homo sapiens
caaagauggcuaucgguau

SEQ ID NO: 620340 - RNA, 19 nt, Homo sapiens
cagaggugauggauacuca

SEQ ID NO: 620341 - RNA, 19 nt, Homo sapiens
gaaaucaauggcuauacau

SEQ ID NO: 620342 - RNA, 19 nt, Homo sapiens
aaugguaaccuguuucuga

SEQ ID NO: 620343 - RNA, 19 nt, Homo sapiens
gaagauuaccccaaauuug

SEQ ID NO: 620344 - RNA, 19 nt, Homo sapiens
acagaaucaucuaauggaa

SEQ ID NO: 620345 - RNA, 19 nt, Homo sapiens
ugagaacaccugaaaucaa

SEQ ID NO: 620346 - RNA, 19 nt, Homo sapiens
uaaaagacauuuccuucug

SEQ ID NO: 620347 - RNA, 19 nt, Homo sapiens
gacuuguuauccuacuaua

SEQ ID NO: 620348 - RNA, 19 nt, Homo sapiens
ucaagcuccuuuagguuau

SEQ ID NO: 620349 - RNA, 19 nt, Homo sapiens
ugaaaucacuguggaugag

SEQ ID NO: 620350 - RNA, 19 nt, Homo sapiens
gaagagaauggccgacagu

SEQ ID NO: 620351 - RNA, 19 nt, Homo sapiens
gaacaccugaaaucaaugg

SEQ ID NO: 620352 - RNA, 19 nt, Homo sapiens
aggaaaugguaaccuguuu

SEQ ID NO: 620353 - RNA, 19 nt, Homo sapiens
aaacacagccucuccuuuu

SEQ ID NO: 620354 - RNA, 19 nt, Homo sapiens
agaagaagauuaccccaaa

SEQ ID NO: 620355 - RNA, 19 nt, Homo sapiens
ggcaaacacuacucuucug

SEQ ID NO: 620356 - RNA, 19 nt, Homo sapiens
caaacuuggucgauguaag

SEQ ID NO: 620357 - RNA, 19 nt, Homo sapiens
cauuggaacacccguuuaa

SEQ ID NO: 620358 - RNA, 19 nt, Homo sapiens
caggagcggucgcaaaugc

SEQ ID NO: 620359 - RNA, 19 nt, Homo sapiens
cagaaucaucuaauggaaa

SEQ ID NO: 620360 - RNA, 19 nt, Homo sapiens
gcugacacauuuggcauag

SEQ ID NO: 620361 - RNA, 19 nt, Homo sapiens
uggaaaagauacacuagaa

SEQ ID NO: 620362 - RNA, 19 nt, Homo sapiens
uucaagcuccuuuagguua

SEQ ID NO: 620363 - RNA, 19 nt, Homo sapiens
uggaacacccguuuaacaa

SEQ ID NO: 620364 - RNA, 19 nt, Homo sapiens
ggagugacccuuuguuuuc

SEQ ID NO: 620365 - RNA, 19 nt, Homo sapiens
acauugguccugcuuauga

SEQ ID NO: 620366 - RNA, 19 nt, Homo sapiens
ucaggaccuuaguaacauu

SEQ ID NO: 620367 - RNA, 19 nt, Homo sapiens
gauguauucuugguaaagg

SEQ ID NO: 620368 - RNA, 19 nt, Homo sapiens
cuccaaagauaaggauauu

SEQ ID NO: 620369 - RNA, 19 nt, Homo sapiens
gcacgguuuccauuaacuu

SEQ ID NO: 620370 - RNA, 19 nt, Homo sapiens
cagagacagccaagucauu

SEQ ID NO: 620371 - RNA, 19 nt, Homo sapiens
gaaaucacuguggaugaga

SEQ ID NO: 620372 - RNA, 19 nt, Homo sapiens
ugacugugguuggagagaa

SEQ ID NO: 620373 - RNA, 19 nt, Homo sapiens
cuacuagugggaauuuaaa

SEQ ID NO: 620374 - RNA, 19 nt, Homo sapiens
gcaaacuuggucgauguaa

SEQ ID NO: 620375 - RNA, 19 nt, Homo sapiens
uaaagauccagaagaagau

SEQ ID NO: 620376 - RNA, 19 nt, Homo sapiens
caaugugggauuuguacaa

SEQ ID NO: 620377 - RNA, 19 nt, Homo sapiens
gacaauguucuccaaagau

SEQ ID NO: 620378 - RNA, 19 nt, Homo sapiens
uaccuuucaugaccaacua

SEQ ID NO: 620379 - RNA, 19 nt, Homo sapiens
uguaucacguggagacaga

SEQ ID NO: 620380 - RNA, 19 nt, Homo sapiens
cuccgaaggaucucacuua

SEQ ID NO: 620381 - RNA, 19 nt, Homo sapiens
cauaauugguggugucaua

SEQ ID NO: 620382 - RNA, 19 nt, Homo sapiens
ggaaugaaguguaccaaag

SEQ ID NO: 620383 - RNA, 19 nt, Homo sapiens
ucaaggcccucccauaauu

SEQ ID NO: 620384 - RNA, 19 nt, Homo sapiens
caucaaggcccucccauaa

SEQ ID NO: 620385 - RNA, 19 nt, Homo sapiens
ugaagcaucuguugauugu

SEQ ID NO: 620386 - RNA, 19 nt, Homo sapiens
gcauguagaggacuuauga

SEQ ID NO: 620387 - RNA, 19 nt, Homo sapiens
gauguucccuauaugcaaa

SEQ ID NO: 620388 - RNA, 19 nt, Homo sapiens
gcaaaaguaugaauuagga

SEQ ID NO: 620389 - RNA, 19 nt, Homo sapiens
gacuggauguucccuauau

SEQ ID NO: 620390 - RNA, 19 nt, Homo sapiens
gggcuucuuugguuccaua

SEQ ID NO: 620391 - RNA, 19 nt, Homo sapiens
aagcaucuguugauuguau

SEQ ID NO: 620392 - RNA, 19 nt, Homo sapiens
ccucuugaguuuguuauaa

SEQ ID NO: 620393 - RNA, 19 nt, Homo sapiens
cgauaaagccaaagcuaaa

SEQ ID NO: 620394 - RNA, 19 nt, Homo sapiens
ucagggcugugcucaauga

SEQ ID NO: 620395 - RNA, 19 nt, Homo sapiens
cuucuuugguuccauauuu

SEQ ID NO: 620396 - RNA, 19 nt, Homo sapiens
uguuguggcuuucuauaaa

SEQ ID NO: 620397 - RNA, 19 nt, Homo sapiens
caaggcccucccauaauua

SEQ ID NO: 620398 - RNA, 19 nt, Homo sapiens
caacaaacccuucaaaaca

SEQ ID NO: 620399 - RNA, 19 nt, Homo sapiens
ucacaaccgccaccuauug

SEQ ID NO: 620400 - RNA, 19 nt, Homo sapiens
aaacaacaaacccuucaaa

SEQ ID NO: 620401 - RNA, 19 nt, Homo sapiens
aaucacaacggaauucuuu

SEQ ID NO: 620402 - RNA, 19 nt, Homo sapiens
gaaugaaguguaccaaagu

SEQ ID NO: 620403 - RNA, 19 nt, Homo sapiens
gagccucacugugcauaau

SEQ ID NO: 620404 - RNA, 19 nt, Homo sapiens
ucacaacggaauucuuuga

SEQ ID NO: 620405 - RNA, 19 nt, Homo sapiens
aauugguggugucauauuu

SEQ ID NO: 620406 - RNA, 19 nt, Homo sapiens
ggagaucaucgccuucaug

SEQ ID NO: 620407 - RNA, 19 nt, Homo sapiens
ccgauaaagccaaagcuaa

SEQ ID NO: 620408 - RNA, 19 nt, Homo sapiens
caucacaaccgccaccuau

SEQ ID NO: 620409 - RNA, 19 nt, Homo sapiens
aaaguaucaugguggagaa

SEQ ID NO: 620410 - RNA, 19 nt, Homo sapiens
ugucagggcugugcucaau

SEQ ID NO: 620411 - RNA, 19 nt, Homo sapiens
uauuugcgcucuuuggaau

SEQ ID NO: 620412 - RNA, 19 nt, Homo sapiens
gcuggacgguuauauacag

SEQ ID NO: 620413 - RNA, 19 nt, Homo sapiens
gcauuugaagcaucuguug

SEQ ID NO: 620414 - RNA, 19 nt, Homo sapiens
ggcugggauuguauucaua

SEQ ID NO: 620415 - RNA, 19 nt, Homo sapiens
aaacacccagauacacaua

SEQ ID NO: 620416 - RNA, 19 nt, Homo sapiens
caauaucugacaacaacaa

SEQ ID NO: 620417 - RNA, 19 nt, Homo sapiens
ccaucaaggcccucccaua

SEQ ID NO: 620418 - RNA, 19 nt, Homo sapiens
auucuuugauccucucuuu

SEQ ID NO: 620419 - RNA, 19 nt, Homo sapiens
acaacggaauucuuugauc

SEQ ID NO: 620420 - RNA, 19 nt, Homo sapiens
ugcuggcgcuggacgguua

SEQ ID NO: 620421 - RNA, 19 nt, Homo sapiens
uucaauaucugacaacaac

SEQ ID NO: 620422 - RNA, 19 nt, Homo sapiens
ggugucauauuuugcuuuu

SEQ ID NO: 620423 - RNA, 19 nt, Homo sapiens
gagcaaaaguaugaauuag

SEQ ID NO: 620424 - RNA, 19 nt, Homo sapiens
ggauguucccuauaugcaa

SEQ ID NO: 620425 - RNA, 19 nt, Homo sapiens
uagcacggcuucggagauc

SEQ ID NO: 620426 - RNA, 19 nt, Homo sapiens
gcgcuggacgguuauauac

SEQ ID NO: 620427 - RNA, 19 nt, Homo sapiens
guaucaugguggagaagau

SEQ ID NO: 620428 - RNA, 19 nt, Homo sapiens
caacaaaacacccagauac

SEQ ID NO: 620429 - RNA, 19 nt, Homo sapiens
ggcgcuggacgguuauaua

SEQ ID NO: 620430 - RNA, 19 nt, Homo sapiens
gccucacugugcauaauug

SEQ ID NO: 620431 - RNA, 19 nt, Homo sapiens
uugauccucucuuuguuga

SEQ ID NO: 620432 - RNA, 19 nt, Homo sapiens
acacccagauacacauaca

SEQ ID NO: 620433 - RNA, 19 nt, Homo sapiens
uaauugguggugucauauu

SEQ ID NO: 620434 - RNA, 19 nt, Homo sapiens
uucccuauaugcaaacaaa

SEQ ID NO: 620435 - RNA, 19 nt, Homo sapiens
ugacuggauguucccuaua

SEQ ID NO: 620436 - RNA, 19 nt, Homo sapiens
gcucaaugacuggauguuc

SEQ ID NO: 620437 - RNA, 19 nt, Homo sapiens
uggcugggauuguauucau

SEQ ID NO: 620438 - RNA, 19 nt, Homo sapiens
ggaaggugucuaccaucga

SEQ ID NO: 620439 - RNA, 19 nt, Homo sapiens
cauauuugcgcucuuugga

SEQ ID NO: 620440 - RNA, 19 nt, Homo sapiens
uuccauauuugcgcucuuu

SEQ ID NO: 620441 - RNA, 19 nt, Homo sapiens
cgacggcacggucaucaca

SEQ ID NO: 620442 - RNA, 19 nt, Homo sapiens
ggagccucacugugcauaa

SEQ ID NO: 620443 - RNA, 19 nt, Homo sapiens
aaugaaguguaccaaaguc

SEQ ID NO: 620444 - RNA, 19 nt, Homo sapiens
uuguauggauguaaguguu

SEQ ID NO: 620445 - RNA, 19 nt, Homo sapiens
uuugaagcaucuguugauu

SEQ ID NO: 620446 - RNA, 19 nt, Homo sapiens
uuguuuggcugggauugua

SEQ ID NO: 620447 - RNA, 19 nt, Homo sapiens
gauaaagccaaagcuaaaa

SEQ ID NO: 620448 - RNA, 19 nt, Homo sapiens
gcuaaagacugcauuauuu

SEQ ID NO: 620449 - RNA, 19 nt, Homo sapiens
gaaggacuguggaugaauu

SEQ ID NO: 620450 - RNA, 19 nt, Homo sapiens
gaaacugacaauccaauuu

SEQ ID NO: 620451 - RNA, 19 nt, Homo sapiens
agaaaucgcugggcuguuu

SEQ ID NO: 620452 - RNA, 19 nt, Homo sapiens
gaacuucaccugcuccuau

SEQ ID NO: 620453 - RNA, 19 nt, Homo sapiens
guacagacuuugagguuuc

SEQ ID NO: 620454 - RNA, 19 nt, Homo sapiens
gaacucaacuauugcuuuu

SEQ ID NO: 620455 - RNA, 19 nt, Homo sapiens
gagacaugcuuauaugguu

SEQ ID NO: 620456 - RNA, 19 nt, Homo sapiens
caucagagauuucuauaac

SEQ ID NO: 620457 - RNA, 19 nt, Homo sapiens
cgacgucugucuagcuuaa

SEQ ID NO: 620458 - RNA, 19 nt, Homo sapiens
ucacauagagacaugcuua

SEQ ID NO: 620459 - RNA, 19 nt, Homo sapiens
uugaauggcuuucugauau

SEQ ID NO: 620460 - RNA, 19 nt, Homo sapiens
ccaaugccaucaucagaga

SEQ ID NO: 620461 - RNA, 19 nt, Homo sapiens
ggacugaugugugcugcuu

SEQ ID NO: 620462 - RNA, 19 nt, Homo sapiens
gcucuguucugcugcguuu

SEQ ID NO: 620463 - RNA, 19 nt, Homo sapiens
gaagucaguauguguaguu

SEQ ID NO: 620464 - RNA, 19 nt, Homo sapiens
gaagcucucuacuuaggau

SEQ ID NO: 620465 - RNA, 19 nt, Homo sapiens
gggaaggacuguggaugaa

SEQ ID NO: 620466 - RNA, 19 nt, Homo sapiens
cagagaacccugcuucaaa

SEQ ID NO: 620467 - RNA, 19 nt, Homo sapiens
guauuugaguacagacuuu

SEQ ID NO: 620468 - RNA, 19 nt, Homo sapiens
gcuuuaaucagcauuguaa

SEQ ID NO: 620469 - RNA, 19 nt, Homo sapiens
ggauaggguugaagaaggu

SEQ ID NO: 620470 - RNA, 19 nt, Homo sapiens
ucagggaaaucauggauag

SEQ ID NO: 620471 - RNA, 19 nt, Homo sapiens
auagagacaugcuuauaug

SEQ ID NO: 620472 - RNA, 19 nt, Homo sapiens
gcugacggcuggaaucauc

SEQ ID NO: 620473 - RNA, 19 nt, Homo sapiens
cuucuuggcuuucaugaug

SEQ ID NO: 620474 - RNA, 19 nt, Homo sapiens
gcuauacucagaagaaaga

SEQ ID NO: 620475 - RNA, 19 nt, Homo sapiens
aaacugacaauccaauuug

SEQ ID NO: 620476 - RNA, 19 nt, Homo sapiens
caaagcagaaguagcaguu

SEQ ID NO: 620477 - RNA, 19 nt, Homo sapiens
gggcuauacucagaagaaa

SEQ ID NO: 620478 - RNA, 19 nt, Homo sapiens
agacaugcuuauaugguuu

SEQ ID NO: 620479 - RNA, 19 nt, Homo sapiens
gagagugucggccuucauu

SEQ ID NO: 620480 - RNA, 19 nt, Homo sapiens
uaacuucuuuauccucuuc

SEQ ID NO: 620481 - RNA, 19 nt, Homo sapiens
cauagagacaugcuuauau

SEQ ID NO: 620482 - RNA, 19 nt, Homo sapiens
gaaaagagcaguagcuaca

SEQ ID NO: 620483 - RNA, 19 nt, Homo sapiens
ccagaagucaguaugugua

SEQ ID NO: 620484 - RNA, 19 nt, Homo sapiens
cuuguaccauuucuguuua

SEQ ID NO: 620485 - RNA, 19 nt, Homo sapiens
ugaauggcuuucugauaug

SEQ ID NO: 620486 - RNA, 19 nt, Homo sapiens
aaagagcaguagcuacaga

SEQ ID NO: 620487 - RNA, 19 nt, Homo sapiens
agagaacccugcuucaaag

SEQ ID NO: 620488 - RNA, 19 nt, Homo sapiens
gaguacagacuuugagguu

SEQ ID NO: 620489 - RNA, 19 nt, Homo sapiens
guaauuucuccacgacaua

SEQ ID NO: 620490 - RNA, 19 nt, Homo sapiens
aaaguuaucacaccggaaa

SEQ ID NO: 620491 - RNA, 19 nt, Homo sapiens
aaucagcauuguaaaggaa

SEQ ID NO: 620492 - RNA, 19 nt, Homo sapiens
ccaaauuugaugaaacuga

SEQ ID NO: 620493 - RNA, 19 nt, Homo sapiens
gcuggaaucaucuucauca

SEQ ID NO: 620494 - RNA, 19 nt, Homo sapiens
uaaucagcauuguaaagga

SEQ ID NO: 620495 - RNA, 19 nt, Homo sapiens
gucaguauguguaguugug

SEQ ID NO: 620496 - RNA, 19 nt, Homo sapiens
caucaucagagauuucuau

SEQ ID NO: 620497 - RNA, 19 nt, Homo sapiens
gagugucggccuucauuga

SEQ ID NO: 620498 - RNA, 19 nt, Homo sapiens
gacaauccaauuugaaagu

SEQ ID NO: 620499 - RNA, 19 nt, Homo sapiens
ugaugaaacugacaaucca

SEQ ID NO: 620500 - RNA, 19 nt, Homo sapiens
caguauguguaguugugua

SEQ ID NO: 620501 - RNA, 19 nt, Homo sapiens
gaauguguucuauuugcuu

SEQ ID NO: 620502 - RNA, 19 nt, Homo sapiens
gguugaagaagguuacuau

SEQ ID NO: 620503 - RNA, 19 nt, Homo sapiens
cugucuagcuuaaaugaau

SEQ ID NO: 620504 - RNA, 19 nt, Homo sapiens
aauccuaacuucuuuaucc

SEQ ID NO: 620505 - RNA, 19 nt, Homo sapiens
caacccaugccuuagaaau

SEQ ID NO: 620506 - RNA, 19 nt, Homo sapiens
acauagagacaugcuuaua

SEQ ID NO: 620507 - RNA, 19 nt, Homo sapiens
aaucauggauaggguugaa

SEQ ID NO: 620508 - RNA, 19 nt, Homo sapiens
ugauguccuucuuggcuuu

SEQ ID NO: 620509 - RNA, 19 nt, Homo sapiens
gaauggcuuucugauaugc

SEQ ID NO: 620510 - RNA, 19 nt, Homo sapiens
cauagaugaguguaacauu

SEQ ID NO: 620511 - RNA, 19 nt, Homo sapiens
uauguguaguuguguaugu

SEQ ID NO: 620512 - RNA, 19 nt, Homo sapiens
ugaaacugacaauccaauu

SEQ ID NO: 620513 - RNA, 19 nt, Homo sapiens
agaacucaacuauugcuuu

SEQ ID NO: 620514 - RNA, 19 nt, Homo sapiens
uuccagggcuauacucaga

SEQ ID NO: 620515 - RNA, 19 nt, Homo sapiens
gcauuguaaaggaaauuga

SEQ ID NO: 620516 - RNA, 19 nt, Homo sapiens
gagcgucuacuccagaagu

SEQ ID NO: 620517 - RNA, 19 nt, Homo sapiens
gaagucaccgagcgucuac

SEQ ID NO: 620518 - RNA, 19 nt, Homo sapiens
ucuuguaccauuucuguuu

SEQ ID NO: 620519 - RNA, 19 nt, Homo sapiens
ucuccacgacauagcauua

SEQ ID NO: 620520 - RNA, 19 nt, Homo sapiens
uagcuacagauacucgaua

SEQ ID NO: 620521 - RNA, 19 nt, Homo sapiens
gagcaguagcuacagauac

SEQ ID NO: 620522 - RNA, 19 nt, Homo sapiens
uguaauuucuccacgacau

SEQ ID NO: 620523 - RNA, 19 nt, Homo sapiens
ggaaggacuguggaugaau

SEQ ID NO: 620524 - RNA, 19 nt, Homo sapiens
uacagauacucgauaccuu

SEQ ID NO: 620525 - RNA, 19 nt, Homo sapiens
gcagccagaggacugaugu

SEQ ID NO: 620526 - RNA, 19 nt, Homo sapiens
ugggaaggacuguggauga

SEQ ID NO: 620527 - RNA, 19 nt, Homo sapiens
cugacaauccaauuugaaa

SEQ ID NO: 620528 - RNA, 19 nt, Homo sapiens
gaugaaacugacaauccaa

SEQ ID NO: 620529 - RNA, 19 nt, Homo sapiens
guaccauuucuguuuaguu

SEQ ID NO: 620530 - RNA, 19 nt, Homo sapiens
aguacagacuuugagguuu

SEQ ID NO: 620531 - RNA, 19 nt, Homo sapiens
ccagggcuauacucagaag

SEQ ID NO: 620532 - RNA, 19 nt, Homo sapiens
ugcuaaagacugcauuauu

SEQ ID NO: 620533 - RNA, 19 nt, Homo sapiens
acagagaacccugcuucaa

SEQ ID NO: 620534 - RNA, 19 nt, Homo sapiens
aaauugaauggcuuucuga

SEQ ID NO: 620535 - RNA, 19 nt, Homo sapiens
ccgagcgucuacuccagaa

SEQ ID NO: 620536 - RNA, 19 nt, Homo sapiens
uaucacaccggaaagaagu

SEQ ID NO: 620537 - RNA, 19 nt, Homo sapiens
ugagcuggguugccaaugc

SEQ ID NO: 620538 - RNA, 19 nt, Homo sapiens
gucgacgucugucuagcuu

SEQ ID NO: 620539 - RNA, 19 nt, Homo sapiens
ucaaggggcuuugcauuca

SEQ ID NO: 620540 - RNA, 19 nt, Homo sapiens
guugaagaagguuacuauu

SEQ ID NO: 620541 - RNA, 19 nt, Homo sapiens
guaccugagucaaaauugu

SEQ ID NO: 620542 - RNA, 19 nt, Homo sapiens
uagccuaggaguuagaaau

SEQ ID NO: 620543 - RNA, 19 nt, Homo sapiens
gcucucuacuuaggaugga

SEQ ID NO: 620544 - RNA, 19 nt, Homo sapiens
gcaacccaugccuuagaaa

SEQ ID NO: 620545 - RNA, 19 nt, Homo sapiens
ugucuagcuuaaaugaaug

SEQ ID NO: 620546 - RNA, 19 nt, Homo sapiens
ccaauuugaaaguuugugu

SEQ ID NO: 620547 - RNA, 19 nt, Homo sapiens
aacugacaauccaauuuga

SEQ ID NO: 620548 - RNA, 19 nt, Homo sapiens
gaacuucugaccucuguuu

SEQ ID NO: 620549 - RNA, 19 nt, Homo sapiens
ugacucagacucucacuua

SEQ ID NO: 620550 - RNA, 19 nt, Homo sapiens
gagccaagguguugacuca

SEQ ID NO: 620551 - RNA, 19 nt, Homo sapiens
gggcugggcuucccuagau

SEQ ID NO: 620552 - RNA, 19 nt, Homo sapiens
gggauggguucguaccuuu

SEQ ID NO: 620553 - RNA, 19 nt, Homo sapiens
gcacgugcccucuguguca

SEQ ID NO: 620554 - RNA, 19 nt, Homo sapiens
uaccaagaauuacgucuga

SEQ ID NO: 620555 - RNA, 19 nt, Homo sapiens
ugacaugcccaucuuagaa

SEQ ID NO: 620556 - RNA, 19 nt, Homo sapiens
gccaagguguugacucaga

SEQ ID NO: 620557 - RNA, 19 nt, Homo sapiens
gauucuggaucuugacaug

SEQ ID NO: 620558 - RNA, 19 nt, Homo sapiens
aaacugagccaagguguug

SEQ ID NO: 620559 - RNA, 19 nt, Homo sapiens
ccucugggauugucuuugu

SEQ ID NO: 620560 - RNA, 19 nt, Homo sapiens
ucacuuaggcucugcuguu

SEQ ID NO: 620561 - RNA, 19 nt, Homo sapiens
cuagagccauccagaagug

SEQ ID NO: 620562 - RNA, 19 nt, Homo sapiens
ugaguacccuaccaagaau

SEQ ID NO: 620563 - RNA, 19 nt, Homo sapiens
gggauugucuuugucaucu

SEQ ID NO: 620564 - RNA, 19 nt, Homo sapiens
gugcucaccucugggauug

SEQ ID NO: 620565 - RNA, 19 nt, Homo sapiens
gauugucuuugucaucuca

SEQ ID NO: 620566 - RNA, 19 nt, Homo sapiens
gcuuugggauggguucgua

SEQ ID NO: 620567 - RNA, 19 nt, Homo sapiens
cagucaagcuauggaacua

SEQ ID NO: 620568 - RNA, 19 nt, Homo sapiens
cacuuaggcucugcuguuu

SEQ ID NO: 620569 - RNA, 19 nt, Homo sapiens
cugaguacccuaccaagaa

SEQ ID NO: 620570 - RNA, 19 nt, Homo sapiens
gucaagcuauggaacuaau

SEQ ID NO: 620571 - RNA, 19 nt, Homo sapiens
aaugaucuguuaacaaagg

SEQ ID NO: 620572 - RNA, 19 nt, Homo sapiens
gaucuugacaugcccaucu

SEQ ID NO: 620573 - RNA, 19 nt, Homo sapiens
ccaaguguaccaccugugu

SEQ ID NO: 620574 - RNA, 19 nt, Homo sapiens
gcagugcccaacagcuuug

SEQ ID NO: 620575 - RNA, 19 nt, Homo sapiens
cauggccucugccggaaug

SEQ ID NO: 620576 - RNA, 19 nt, Homo sapiens
cggaacuucugaccucugu

SEQ ID NO: 620577 - RNA, 19 nt, Homo sapiens
gcgcuagagccauccagaa

SEQ ID NO: 620578 - RNA, 19 nt, Homo sapiens
uuagaagccagucaagcua

SEQ ID NO: 620579 - RNA, 19 nt, Homo sapiens
gcucaccucugggauuguc

SEQ ID NO: 620580 - RNA, 19 nt, Homo sapiens
caucuuagaagccagucaa

SEQ ID NO: 620581 - RNA, 19 nt, Homo sapiens
ugucaucgcccuccuugug

SEQ ID NO: 620582 - RNA, 19 nt, Homo sapiens
agaagccagucaagcuaug

SEQ ID NO: 620583 - RNA, 19 nt, Homo sapiens
guucguaccuuuuguuucu

SEQ ID NO: 620584 - RNA, 19 nt, Homo sapiens
cuuaggcucugcuguuucu

SEQ ID NO: 620585 - RNA, 19 nt, Homo sapiens
gacaugcccaucuuagaag

SEQ ID NO: 620586 - RNA, 19 nt, Homo sapiens
gacucagacucucacuuag

SEQ ID NO: 620587 - RNA, 19 nt, Homo sapiens
guuucugccuccugcuauu

SEQ ID NO: 620588 - RNA, 19 nt, Homo sapiens
cugcugggcugggugaaug

SEQ ID NO: 620589 - RNA, 19 nt, Homo sapiens
ggccaggucccagcuaugu

SEQ ID NO: 620590 - RNA, 19 nt, Homo sapiens
cucuggagcuccucucuuc

SEQ ID NO: 620591 - RNA, 19 nt, Homo sapiens
gcuagagccauccagaagu

SEQ ID NO: 620592 - RNA, 19 nt, Homo sapiens
ccaggucccagcuauguag

SEQ ID NO: 620593 - RNA, 19 nt, Homo sapiens
aguacccuaccaagaauua

SEQ ID NO: 620594 - RNA, 19 nt, Homo sapiens
gcagugcagcuccuucaac

SEQ ID NO: 620595 - RNA, 19 nt, Homo sapiens
gugcuggcuuugcaacaag

SEQ ID NO: 620596 - RNA, 19 nt, Homo sapiens
uagaagccagucaagcuau

SEQ ID NO: 620597 - RNA, 19 nt, Homo sapiens
gaggggaugcuuugagauu

SEQ ID NO: 620598 - RNA, 19 nt, Homo sapiens
ugggagggccuguggaugu

SEQ ID NO: 620599 - RNA, 19 nt, Homo sapiens
gguagcagguggagucuuu

SEQ ID NO: 620600 - RNA, 19 nt, Homo sapiens
gcucuuuacuugggcauua

SEQ ID NO: 620601 - RNA, 19 nt, Homo sapiens
agagugaguucaauuccua

SEQ ID NO: 620602 - RNA, 19 nt, Homo sapiens
gaaaucgcuccaacuacua

SEQ ID NO: 620603 - RNA, 19 nt, Homo sapiens
gaaaacaaguucuuauguc

SEQ ID NO: 620604 - RNA, 19 nt, Homo sapiens
agagaaaucgcuccaacua

SEQ ID NO: 620605 - RNA, 19 nt, Homo sapiens
gcaugaaauuugagauugg

SEQ ID NO: 620606 - RNA, 19 nt, Homo sapiens
cuacuacgaugccuaccaa

SEQ ID NO: 620607 - RNA, 19 nt, Homo sapiens
agaaaucgcuccaacuacu

SEQ ID NO: 620608 - RNA, 19 nt, Homo sapiens
ccaggaaucccgagccaaa

SEQ ID NO: 620609 - RNA, 19 nt, Homo sapiens
ggaaucauccucugcuuuu

SEQ ID NO: 620610 - RNA, 19 nt, Homo sapiens
cauuauuucuucccuguuc

SEQ ID NO: 620611 - RNA, 19 nt, Homo sapiens
cagcaugaaauuugagauu

SEQ ID NO: 620612 - RNA, 19 nt, Homo sapiens
ccugacagcaugaaauuug

SEQ ID NO: 620613 - RNA, 19 nt, Homo sapiens
ccuguugccuggaaucuuc

SEQ ID NO: 620614 - RNA, 19 nt, Homo sapiens
ccaagggccucuggaugga

SEQ ID NO: 620615 - RNA, 19 nt, Homo sapiens
caugaaauuugagauugga

SEQ ID NO: 620616 - RNA, 19 nt, Homo sapiens
gcacacugguugccaugcu

SEQ ID NO: 620617 - RNA, 19 nt, Homo sapiens
ggaaaacaaguucuuaugu

SEQ ID NO: 620618 - RNA, 19 nt, Homo sapiens
ucaagagugaguucaauuc

SEQ ID NO: 620619 - RNA, 19 nt, Homo sapiens
gaaucuucaugggauccua

SEQ ID NO: 620620 - RNA, 19 nt, Homo sapiens
caaagucaagagugaguuc

SEQ ID NO: 620621 - RNA, 19 nt, Homo sapiens
cugacagcaugaaauuuga

SEQ ID NO: 620622 - RNA, 19 nt, Homo sapiens
ggucaaccucccaaaguca

SEQ ID NO: 620623 - RNA, 19 nt, Homo sapiens
cuaccaagcccaaccucuu

SEQ ID NO: 620624 - RNA, 19 nt, Homo sapiens
cacccagugugacaucuau

SEQ ID NO: 620625 - RNA, 19 nt, Homo sapiens
uuaugucggugccagcauu

SEQ ID NO: 620626 - RNA, 19 nt, Homo sapiens
gagaaaucgcuccaacuac

SEQ ID NO: 620627 - RNA, 19 nt, Homo sapiens
agcaugaaauuugagauug

SEQ ID NO: 620628 - RNA, 19 nt, Homo sapiens
caugagaugcacagucuuc

SEQ ID NO: 620629 - RNA, 19 nt, Homo sapiens
gucaagagugaguucaauu

SEQ ID NO: 620630 - RNA, 19 nt, Homo sapiens
cucccaaagucaagaguga

SEQ ID NO: 620631 - RNA, 19 nt, Homo sapiens
ggugacauccagugcaauc

SEQ ID NO: 620632 - RNA, 19 nt, Homo sapiens
acacacagcacaggcauca

SEQ ID NO: 620633 - RNA, 19 nt, Homo sapiens
ucccuggccugcauuaucu

SEQ ID NO: 620634 - RNA, 19 nt, Homo sapiens
agucaagagugaguucaau

SEQ ID NO: 620635 - RNA, 19 nt, Homo sapiens
uggaaucauccucugcuuu

SEQ ID NO: 620636 - RNA, 19 nt, Homo sapiens
gauccuacgggacuucuac

SEQ ID NO: 620637 - RNA, 19 nt, Homo sapiens
gacagcaugaaauuugaga

SEQ ID NO: 620638 - RNA, 19 nt, Homo sapiens
guaacaaccugcauaaguu

SEQ ID NO: 620639 - RNA, 19 nt, Homo sapiens
acaggaagaucagagauua

SEQ ID NO: 620640 - RNA, 19 nt, Homo sapiens
ggacucauuucacuauguu

SEQ ID NO: 620641 - RNA, 19 nt, Homo sapiens
guaacagcuuauugacuua

SEQ ID NO: 620642 - RNA, 19 nt, Homo sapiens
uguaacagcuuauugacuu

SEQ ID NO: 620643 - RNA, 19 nt, Homo sapiens
guaacccgauuauugugua

SEQ ID NO: 620644 - RNA, 19 nt, Homo sapiens
ucuaugagcugaucugcaa

SEQ ID NO: 620645 - RNA, 19 nt, Homo sapiens
gagcagcgcauuugucuuc

SEQ ID NO: 620646 - RNA, 19 nt, Homo sapiens
guaaggccuuuaguaauga

SEQ ID NO: 620647 - RNA, 19 nt, Homo sapiens
caauacguauaccuuguaa

SEQ ID NO: 620648 - RNA, 19 nt, Homo sapiens
aaaguacgcugcugcacaa

SEQ ID NO: 620649 - RNA, 19 nt, Homo sapiens
aguaaggccuuuaguaaug

SEQ ID NO: 620650 - RNA, 19 nt, Homo sapiens
guaaaaguguaacagcuua

SEQ ID NO: 620651 - RNA, 19 nt, Homo sapiens
caacuuccgucaugaguac

SEQ ID NO: 620652 - RNA, 19 nt, Homo sapiens
gcuguuguuuggacuguaa

SEQ ID NO: 620653 - RNA, 19 nt, Homo sapiens
uccacaugcugcugaauua

SEQ ID NO: 620654 - RNA, 19 nt, Homo sapiens
gguaacaaccugcauaagu

SEQ ID NO: 620655 - RNA, 19 nt, Homo sapiens
guacgcugcugcacaagug

SEQ ID NO: 620656 - RNA, 19 nt, Homo sapiens
gcugcugaauuacaagaaa

SEQ ID NO: 620657 - RNA, 19 nt, Homo sapiens
gggagaacuugugcacgua

SEQ ID NO: 620658 - RNA, 19 nt, Homo sapiens
gcagcgcauuugucuucua

SEQ ID NO: 620659 - RNA, 19 nt, Homo sapiens
ucugcaagaucaaagguaa

SEQ ID NO: 620660 - RNA, 19 nt, Homo sapiens
gaaggaaacccuggaagag

SEQ ID NO: 620661 - RNA, 19 nt, Homo sapiens
guuaguaguuucucauguc

SEQ ID NO: 620662 - RNA, 19 nt, Homo sapiens
uaaauugcugcgugacaua

SEQ ID NO: 620663 - RNA, 19 nt, Homo sapiens
gcaacuuccgucaugagua

SEQ ID NO: 620664 - RNA, 19 nt, Homo sapiens
ggaauugcgccuucaugga

SEQ ID NO: 620665 - RNA, 19 nt, Homo sapiens
gcucugcagcgccacguua

SEQ ID NO: 620666 - RNA, 19 nt, Homo sapiens
acccgauuauuguguauua

SEQ ID NO: 620667 - RNA, 19 nt, Homo sapiens
gacaagugcauaaucaugu

SEQ ID NO: 620668 - RNA, 19 nt, Homo sapiens
caagaccgaugugaaugug

SEQ ID NO: 620669 - RNA, 19 nt, Homo sapiens
ucaauacguauaccuugua

SEQ ID NO: 620670 - RNA, 19 nt, Homo sapiens
aguaguuucucaugucauu

SEQ ID NO: 620671 - RNA, 19 nt, Homo sapiens
uagaaaacguggacucauu

SEQ ID NO: 620672 - RNA, 19 nt, Homo sapiens
gagguggcccugaaugaug

SEQ ID NO: 620673 - RNA, 19 nt, Homo sapiens
aaacauuggcauuugaaga

SEQ ID NO: 620674 - RNA, 19 nt, Homo sapiens
guacaugguugauuuugug

SEQ ID NO: 620675 - RNA, 19 nt, Homo sapiens
gucaauacguauaccuugu

SEQ ID NO: 620676 - RNA, 19 nt, Homo sapiens
gggagguggcccugaauga

SEQ ID NO: 620677 - RNA, 19 nt, Homo sapiens
caagaaggaaacccuggaa

SEQ ID NO: 620678 - RNA, 19 nt, Homo sapiens
uaacaaccugcauaaguuc

SEQ ID NO: 620679 - RNA, 19 nt, Homo sapiens
agaaggaaacccuggaaga

SEQ ID NO: 620680 - RNA, 19 nt, Homo sapiens
caaaauguagcaugaugua

SEQ ID NO: 620681 - RNA, 19 nt, Homo sapiens
ugacaagugcauaaucaug

SEQ ID NO: 620682 - RNA, 19 nt, Homo sapiens
ccugugcgauggaguggaa

SEQ ID NO: 620683 - RNA, 19 nt, Homo sapiens
cagcgcauuugucuucuag

SEQ ID NO: 620684 - RNA, 19 nt, Homo sapiens
gagaacuugugcacguauc

SEQ ID NO: 620685 - RNA, 19 nt, Homo sapiens
gauaaauugcugcgugaca

SEQ ID NO: 620686 - RNA, 19 nt, Homo sapiens
uuugguaacccgauuauug

SEQ ID NO: 620687 - RNA, 19 nt, Homo sapiens
uccaggagcccgagaagaa

SEQ ID NO: 620688 - RNA, 19 nt, Homo sapiens
ggagguggcccugaaugau

SEQ ID NO: 620689 - RNA, 19 nt, Homo sapiens
ggagaacuugugcacguau

SEQ ID NO: 620690 - RNA, 19 nt, Homo sapiens
acaagugcauaaucaugug

SEQ ID NO: 620691 - RNA, 19 nt, Homo sapiens
ccagcuaagugugggagaa

SEQ ID NO: 620692 - RNA, 19 nt, Homo sapiens
cagagaaaauugugaaagu

SEQ ID NO: 620693 - RNA, 19 nt, Homo sapiens
guuaaaacauuggcauuug

SEQ ID NO: 620694 - RNA, 19 nt, Homo sapiens
ugcaggagcuguuccacau

SEQ ID NO: 620695 - RNA, 19 nt, Homo sapiens
ccaagaccgaugugaaugu

SEQ ID NO: 620696 - RNA, 19 nt, Homo sapiens
gagaaaauugugaaaguga

SEQ ID NO: 620697 - RNA, 19 nt, Homo sapiens
gcgugacauauacuaaaua

SEQ ID NO: 620698 - RNA, 19 nt, Homo sapiens
uaacccgauuauuguguau

SEQ ID NO: 620699 - RNA, 19 nt, Homo sapiens
ggccuuuaguaaugaaugu

SEQ ID NO: 620700 - RNA, 19 nt, Homo sapiens
agaacaaaauguagcauga

SEQ ID NO: 620701 - RNA, 19 nt, Homo sapiens
cauguugucaauacguaua

SEQ ID NO: 620702 - RNA, 19 nt, Homo sapiens
uuaguaguuucucauguca

SEQ ID NO: 620703 - RNA, 19 nt, Homo sapiens
gacucucacuaaagauguu

SEQ ID NO: 620704 - RNA, 19 nt, Homo sapiens
uaaggccuuuaguaaugaa

SEQ ID NO: 620705 - RNA, 19 nt, Homo sapiens
acaugcugcugaauuacaa

SEQ ID NO: 620706 - RNA, 19 nt, Homo sapiens
auacguauaccuuguaagu

SEQ ID NO: 620707 - RNA, 19 nt, Homo sapiens
cgagaagaaaucccagaug

SEQ ID NO: 620708 - RNA, 19 nt, Homo sapiens
guuugaguauucugcauag

SEQ ID NO: 620709 - RNA, 19 nt, Homo sapiens
ccaggagcccgagaagaaa

SEQ ID NO: 620710 - RNA, 19 nt, Homo sapiens
cacaggaagaucagagauu

SEQ ID NO: 620711 - RNA, 19 nt, Homo sapiens
cagccaagaccgaugugaa

SEQ ID NO: 620712 - RNA, 19 nt, Homo sapiens
gcgccuucauggagauuuc

SEQ ID NO: 620713 - RNA, 19 nt, Homo sapiens
uauuucacauccuguaagu

SEQ ID NO: 620714 - RNA, 19 nt, Homo sapiens
uccauguugucaauacgua

SEQ ID NO: 620715 - RNA, 19 nt, Homo sapiens
gauggguaacgccagcuuu

SEQ ID NO: 620716 - RNA, 19 nt, Homo sapiens
caagaucaaagguaacaac

SEQ ID NO: 620717 - RNA, 19 nt, Homo sapiens
aaguguaacagcuuauuga

SEQ ID NO: 620718 - RNA, 19 nt, Homo sapiens
aaaguguaacagcuuauug

SEQ ID NO: 620719 - RNA, 19 nt, Homo sapiens
ugcgugacauauacuaaau

SEQ ID NO: 620720 - RNA, 19 nt, Homo sapiens
gcggcaacuuccgucauga

SEQ ID NO: 620721 - RNA, 19 nt, Homo sapiens
auaaauugcugcgugacau

SEQ ID NO: 620722 - RNA, 19 nt, Homo sapiens
gguaacccgauuauugugu

SEQ ID NO: 620723 - RNA, 19 nt, Homo sapiens
guucgugccuccgagaaag

SEQ ID NO: 620724 - RNA, 19 nt, Homo sapiens
caagugcauaaucauguga

SEQ ID NO: 620725 - RNA, 19 nt, Homo sapiens
gaguaccugccgaccauug

SEQ ID NO: 620726 - RNA, 19 nt, Homo sapiens
aaguaaggccuuuaguaau

SEQ ID NO: 620727 - RNA, 19 nt, Homo sapiens
ugaaugugcaggagcuguu

SEQ ID NO: 620728 - RNA, 19 nt, Homo sapiens
cauagcaguuuguaaaagu

SEQ ID NO: 620729 - RNA, 19 nt, Homo sapiens
guaccugccgaccauugaa

SEQ ID NO: 620730 - RNA, 19 nt, Homo sapiens
uggacucauuucacuaugu

SEQ ID NO: 620731 - RNA, 19 nt, Homo sapiens
gcaggagcuguuccacaug

SEQ ID NO: 620732 - RNA, 19 nt, Homo sapiens
gauguuaguaguuucucau

SEQ ID NO: 620733 - RNA, 19 nt, Homo sapiens
gagcagagaaaauugugaa

SEQ ID NO: 620734 - RNA, 19 nt, Homo sapiens
gcugcgugacauauacuaa

SEQ ID NO: 620735 - RNA, 19 nt, Homo sapiens
gaagaggagaacaaaaugu

SEQ ID NO: 620736 - RNA, 19 nt, Homo sapiens
cagcucuuccuauccugua

SEQ ID NO: 620737 - RNA, 19 nt, Homo sapiens
gaggaggacuucaacaauu

SEQ ID NO: 620738 - RNA, 19 nt, Homo sapiens
guaaagcucucaccugguu

SEQ ID NO: 620739 - RNA, 19 nt, Homo sapiens
gaagaugacgccacauuaa

SEQ ID NO: 620740 - RNA, 19 nt, Homo sapiens
uaauaaaccugaaccuuug

SEQ ID NO: 620741 - RNA, 19 nt, Homo sapiens
gagcugaugucaauugguu

SEQ ID NO: 620742 - RNA, 19 nt, Homo sapiens
caagguaauuuaugguuga

SEQ ID NO: 620743 - RNA, 19 nt, Homo sapiens
aaagacaauuggacccuua

SEQ ID NO: 620744 - RNA, 19 nt, Homo sapiens
gauaagugugccaauaaua

SEQ ID NO: 620745 - RNA, 19 nt, Homo sapiens
gggcaacuccaguguauuu

SEQ ID NO: 620746 - RNA, 19 nt, Homo sapiens
ucaauugguucuugucuug

SEQ ID NO: 620747 - RNA, 19 nt, Homo sapiens
gcucaggaucucauuaaua

SEQ ID NO: 620748 - RNA, 19 nt, Homo sapiens
caagagaccaaaucagaaa

SEQ ID NO: 620749 - RNA, 19 nt, Homo sapiens
cacauuaacccuuucauuu

SEQ ID NO: 620750 - RNA, 19 nt, Homo sapiens
caacuccaguguauuuaug

SEQ ID NO: 620751 - RNA, 19 nt, Homo sapiens
gaaccuaacuacagaugac

SEQ ID NO: 620752 - RNA, 19 nt, Homo sapiens
uaacaaacuucacccucaa

SEQ ID NO: 620753 - RNA, 19 nt, Homo sapiens
gacgaaaggcuaaucacua

SEQ ID NO: 620754 - RNA, 19 nt, Homo sapiens
gcagacugaucuuggaguu

SEQ ID NO: 620755 - RNA, 19 nt, Homo sapiens
gaccaaagcgauacacuau

SEQ ID NO: 620756 - RNA, 19 nt, Homo sapiens
gauacucuguuuagcuuga

SEQ ID NO: 620757 - RNA, 19 nt, Homo sapiens
gcaccagaauccacuguca

SEQ ID NO: 620758 - RNA, 19 nt, Homo sapiens
cagguuguguguaauauug

SEQ ID NO: 620759 - RNA, 19 nt, Homo sapiens
gagaguuucuuguuucagu

SEQ ID NO: 620760 - RNA, 19 nt, Homo sapiens
cucaggaucucauuaauau

SEQ ID NO: 620761 - RNA, 19 nt, Homo sapiens
aaaccacaaugaucugauu

SEQ ID NO: 620762 - RNA, 19 nt, Homo sapiens
ggaccaaagcgauacacua

SEQ ID NO: 620763 - RNA, 19 nt, Homo sapiens
ggaagcccauguuuaccaa

SEQ ID NO: 620764 - RNA, 19 nt, Homo sapiens
ugaagaugacgccacauua

SEQ ID NO: 620765 - RNA, 19 nt, Homo sapiens
gaaaggcuaaucacuagau

SEQ ID NO: 620766 - RNA, 19 nt, Homo sapiens
gaucuuggaguucaccuuu

SEQ ID NO: 620767 - RNA, 19 nt, Homo sapiens
gcauggacguuacugauac

SEQ ID NO: 620768 - RNA, 19 nt, Homo sapiens
gcacgggaagcccauguuu

SEQ ID NO: 620769 - RNA, 19 nt, Homo sapiens
uagacaauaccgagaguua

SEQ ID NO: 620770 - RNA, 19 nt, Homo sapiens
uaccacaacucauccauca

SEQ ID NO: 620771 - RNA, 19 nt, Homo sapiens
gcacagaggauagugacaa

SEQ ID NO: 620772 - RNA, 19 nt, Homo sapiens
uaaaguugcuguugaucca

SEQ ID NO: 620773 - RNA, 19 nt, Homo sapiens
cugaagaccugcuuguuuc

SEQ ID NO: 620774 - RNA, 19 nt, Homo sapiens
uggcacugauuguaauuaa

SEQ ID NO: 620775 - RNA, 19 nt, Homo sapiens
gcacuggcagcaagaagaa

SEQ ID NO: 620776 - RNA, 19 nt, Homo sapiens
gaaagagucauaccacaac

SEQ ID NO: 620777 - RNA, 19 nt, Homo sapiens
ccagcaagguaauuuaugg

SEQ ID NO: 620778 - RNA, 19 nt, Homo sapiens
ggaguucaccuuugaugau

SEQ ID NO: 620779 - RNA, 19 nt, Homo sapiens
cagaguaccgaaucuauga

SEQ ID NO: 620780 - RNA, 19 nt, Homo sapiens
caagccauguaauccauug

SEQ ID NO: 620781 - RNA, 19 nt, Homo sapiens
acaauuggacccuuaagaa

SEQ ID NO: 620782 - RNA, 19 nt, Homo sapiens
ggaagaacacagcccaugu

SEQ ID NO: 620783 - RNA, 19 nt, Homo sapiens
ucuaugagaugaacaagag

SEQ ID NO: 620784 - RNA, 19 nt, Homo sapiens
ccugaaccuuuguguguuu

SEQ ID NO: 620785 - RNA, 19 nt, Homo sapiens
gcuguugauccaaauauuu

SEQ ID NO: 620786 - RNA, 19 nt, Homo sapiens
auuggacccuuaagaauuu

SEQ ID NO: 620787 - RNA, 19 nt, Homo sapiens
cccaagugcugaaacaaga

SEQ ID NO: 620788 - RNA, 19 nt, Homo sapiens
agacugaucuuggaguuca

SEQ ID NO: 620789 - RNA, 19 nt, Homo sapiens
ccacauuaacccuuucauu

SEQ ID NO: 620790 - RNA, 19 nt, Homo sapiens
acugauaagugugccaaua

SEQ ID NO: 620791 - RNA, 19 nt, Homo sapiens
guaaagaaagacaauugga

SEQ ID NO: 620792 - RNA, 19 nt, Homo sapiens
ugauaagugugccaauaau

SEQ ID NO: 620793 - RNA, 19 nt, Homo sapiens
ccaguguauuuaugugaaa

SEQ ID NO: 620794 - RNA, 19 nt, Homo sapiens
caucugagaguuucuuguu

SEQ ID NO: 620795 - RNA, 19 nt, Homo sapiens
gccauauuguccauaaaug

SEQ ID NO: 620796 - RNA, 19 nt, Homo sapiens
guaaaccucccgccacuca

SEQ ID NO: 620797 - RNA, 19 nt, Homo sapiens
acgaaaggcuaaucacuag

SEQ ID NO: 620798 - RNA, 19 nt, Homo sapiens
ccugaagaccugcuuguuu

SEQ ID NO: 620799 - RNA, 19 nt, Homo sapiens
gcaacuccaguguauuuau

SEQ ID NO: 620800 - RNA, 19 nt, Homo sapiens
gauacuggcacugauugua

SEQ ID NO: 620801 - RNA, 19 nt, Homo sapiens
cgaaagagucauaccacaa

SEQ ID NO: 620802 - RNA, 19 nt, Homo sapiens
gaucugauuuucuuucuuc

SEQ ID NO: 620803 - RNA, 19 nt, Homo sapiens
cagaauccacugucaauag

SEQ ID NO: 620804 - RNA, 19 nt, Homo sapiens
gcacuuuaccauuagacaa

SEQ ID NO: 620805 - RNA, 19 nt, Homo sapiens
gcucucaccugguucuuuu

SEQ ID NO: 620806 - RNA, 19 nt, Homo sapiens
caauuggacccuuaagaau

SEQ ID NO: 620807 - RNA, 19 nt, Homo sapiens
gcugaaacaagaaauguca

SEQ ID NO: 620808 - RNA, 19 nt, Homo sapiens
gaugucaauugguucuugu

SEQ ID NO: 620809 - RNA, 19 nt, Homo sapiens
ucugagaguuucuuguuuc

SEQ ID NO: 620810 - RNA, 19 nt, Homo sapiens
aaacgaaggccauauuguc

SEQ ID NO: 620811 - RNA, 19 nt, Homo sapiens
gacgccacauuaacccuuu

SEQ ID NO: 620812 - RNA, 19 nt, Homo sapiens
ggacgccuuugccacugaa

SEQ ID NO: 620813 - RNA, 19 nt, Homo sapiens
gugcucaggaucucauuaa

SEQ ID NO: 620814 - RNA, 19 nt, Homo sapiens
ggcacugauuguaauuaaa

SEQ ID NO: 620815 - RNA, 19 nt, Homo sapiens
uuggaggccuucacaggua

SEQ ID NO: 620816 - RNA, 19 nt, Homo sapiens
ggaacaacagcccguggaa

SEQ ID NO: 620817 - RNA, 19 nt, Homo sapiens
gacaauuggacccuuaaga

SEQ ID NO: 620818 - RNA, 19 nt, Homo sapiens
ugacuugcaucugagaguu

SEQ ID NO: 620819 - RNA, 19 nt, Homo sapiens
ucaagagaccaaaucagaa

SEQ ID NO: 620820 - RNA, 19 nt, Homo sapiens
cugauacucuguuuagcuu

SEQ ID NO: 620821 - RNA, 19 nt, Homo sapiens
cugauaagugugccaauaa

SEQ ID NO: 620822 - RNA, 19 nt, Homo sapiens
caaacgaaggccauauugu

SEQ ID NO: 620823 - RNA, 19 nt, Homo sapiens
ucaaacgaaggccauauug

SEQ ID NO: 620824 - RNA, 19 nt, Homo sapiens
ccucagguuguguguaaua

SEQ ID NO: 620825 - RNA, 19 nt, Homo sapiens
aaacuucacccucaacuac

SEQ ID NO: 620826 - RNA, 19 nt, Homo sapiens
caaacuucacccucaacua

SEQ ID NO: 620827 - RNA, 19 nt, Homo sapiens
gagaguuagucccgagaag

SEQ ID NO: 620828 - RNA, 19 nt, Homo sapiens
gaguucaccuuugaugauc

SEQ ID NO: 620829 - RNA, 19 nt, Homo sapiens
gugcgugcgucuacuuugu

SEQ ID NO: 620830 - RNA, 19 nt, Homo sapiens
aaggccauauuguccauaa

SEQ ID NO: 620831 - RNA, 19 nt, Homo sapiens
ugggugaucauuacaauug

SEQ ID NO: 620832 - RNA, 19 nt, Homo sapiens
gcccgugggugaucauuac

SEQ ID NO: 620833 - RNA, 19 nt, Homo sapiens
aggaggacuucaacaauuc

SEQ ID NO: 620834 - RNA, 19 nt, Homo sapiens
ggacgaaaggcuaaucacu

SEQ ID NO: 620835 - RNA, 19 nt, Homo sapiens
gacaauaccgagaguuagu

SEQ ID NO: 620836 - RNA, 19 nt, Homo sapiens
gccauguaauccauugguu

SEQ ID NO: 620837 - RNA, 19 nt, Homo sapiens
caagagggacuacguguga

SEQ ID NO: 620838 - RNA, 19 nt, Homo sapiens
caucacaggugcccagugu

SEQ ID NO: 620839 - RNA, 19 nt, Homo sapiens
gcacgugcccucuguguca

SEQ ID NO: 620840 - RNA, 19 nt, Homo sapiens
caucuggacuggacaagag

SEQ ID NO: 620841 - RNA, 19 nt, Homo sapiens
ucacaggugcccaguguac

SEQ ID NO: 620842 - RNA, 19 nt, Homo sapiens
ugggagggccuguggaugu

SEQ ID NO: 620843 - RNA, 19 nt, Homo sapiens
ggacagagcuuccuucuca

SEQ ID NO: 620844 - RNA, 19 nt, Homo sapiens
gggcuuggcuuucuacuuu

SEQ ID NO: 620845 - RNA, 19 nt, Homo sapiens
ugagagagcuucugagaga

SEQ ID NO: 620846 - RNA, 19 nt, Homo sapiens
gagaugaccgccuggauua

SEQ ID NO: 620847 - RNA, 19 nt, Homo sapiens
ggacaucuguggccacguu

SEQ ID NO: 620848 - RNA, 19 nt, Homo sapiens
gcacugagccugcaaacca

SEQ ID NO: 620849 - RNA, 19 nt, Homo sapiens
ugccagggaugcaauauuu

SEQ ID NO: 620850 - RNA, 19 nt, Homo sapiens
gagcacaccacaccagaaa

SEQ ID NO: 620851 - RNA, 19 nt, Homo sapiens
gagaguacauggcauugag

SEQ ID NO: 620852 - RNA, 19 nt, Homo sapiens
gauaaaaccuccuucucuu

SEQ ID NO: 620853 - RNA, 19 nt, Homo sapiens
agacuaagccuacuucauc

SEQ ID NO: 620854 - RNA, 19 nt, Homo sapiens
acagacaucuugcaguguu

SEQ ID NO: 620855 - RNA, 19 nt, Homo sapiens
ugucacagcuaccaaagug

SEQ ID NO: 620856 - RNA, 19 nt, Homo sapiens
ggagacaagacaauuugaa

SEQ ID NO: 620857 - RNA, 19 nt, Homo sapiens
gaagguuggcuguaucuca

SEQ ID NO: 620858 - RNA, 19 nt, Homo sapiens
cgaccagggugagaauaaa

SEQ ID NO: 620859 - RNA, 19 nt, Homo sapiens
gcacaccacaccagaaaca

SEQ ID NO: 620860 - RNA, 19 nt, Homo sapiens
ccucaacaaucccaagaga

SEQ ID NO: 620861 - RNA, 19 nt, Homo sapiens
gagacaagacaauuugaau

SEQ ID NO: 620862 - RNA, 19 nt, Homo sapiens
ggagaggcgcugaguggaa

SEQ ID NO: 620863 - RNA, 19 nt, Homo sapiens
gacaagacaauuugaaugg

SEQ ID NO: 620864 - RNA, 19 nt, Homo sapiens
gaagaagacuaagccuacu

SEQ ID NO: 620865 - RNA, 19 nt, Homo sapiens
cuuaaagacucauuucucu

SEQ ID NO: 620866 - RNA, 19 nt, Homo sapiens
ccacugggcuuggcuuucu

SEQ ID NO: 620867 - RNA, 19 nt, Homo sapiens
ggacucagagagacaugaa

SEQ ID NO: 620868 - RNA, 19 nt, Homo sapiens
caaccuccaacaacacuuu

SEQ ID NO: 620869 - RNA, 19 nt, Homo sapiens
gaaaggagaggcgcugagu

SEQ ID NO: 620870 - RNA, 19 nt, Homo sapiens
ccaauucugaccuuacaaa

SEQ ID NO: 620871 - RNA, 19 nt, Homo sapiens
gagagaggccgugguuuca

SEQ ID NO: 620872 - RNA, 19 nt, Homo sapiens
cgagagaggccgugguuuc

SEQ ID NO: 620873 - RNA, 19 nt, Homo sapiens
ucagagagacaugaauaaa

SEQ ID NO: 620874 - RNA, 19 nt, Homo sapiens
ugagaugaccgccuggauu

SEQ ID NO: 620875 - RNA, 19 nt, Homo sapiens
agagaccacucaaggacaa

SEQ ID NO: 620876 - RNA, 19 nt, Homo sapiens
acucagagagacaugaaua

SEQ ID NO: 620877 - RNA, 19 nt, Homo sapiens
gcagugaccacgcauuguc

SEQ ID NO: 620878 - RNA, 19 nt, Homo sapiens
ucugagagacccaggauga

SEQ ID NO: 620879 - RNA, 19 nt, Homo sapiens
ccaagagaccacucaagga

SEQ ID NO: 620880 - RNA, 19 nt, Homo sapiens
ggagaguacauggcauuga

SEQ ID NO: 620881 - RNA, 19 nt, Homo sapiens
gguccaccaugaggauaaa

SEQ ID NO: 620882 - RNA, 19 nt, Homo sapiens
cuacuuuccuggagacaag

SEQ ID NO: 620883 - RNA, 19 nt, Homo sapiens
ucacugacacccaccucua

SEQ ID NO: 620884 - RNA, 19 nt, Homo sapiens
uuacaaaagugucccuuga

SEQ ID NO: 620885 - RNA, 19 nt, Homo sapiens
gacuaagccuacuucaucu

SEQ ID NO: 620886 - RNA, 19 nt, Homo sapiens
agacaagacaauuugaaug

SEQ ID NO: 620887 - RNA, 19 nt, Homo sapiens
guacauggcauugagacau

SEQ ID NO: 620888 - RNA, 19 nt, Homo sapiens
gcccuggccuccaauucug

SEQ ID NO: 620889 - RNA, 19 nt, Homo sapiens
cagacaucuugcaguguuu

SEQ ID NO: 620890 - RNA, 19 nt, Homo sapiens
ggagcacaccacaccagaa

SEQ ID NO: 620891 - RNA, 19 nt, Homo sapiens
caucacaaccuccaacaac

SEQ ID NO: 620892 - RNA, 19 nt, Homo sapiens
aaagugugguuugcagaug

SEQ ID NO: 620893 - RNA, 19 nt, Homo sapiens
gucaagagcccaaccuucu

SEQ ID NO: 620894 - RNA, 19 nt, Homo sapiens
caaccuucuuucacugaca

SEQ ID NO: 620895 - RNA, 19 nt, Homo sapiens
caggagaguacauggcauu

SEQ ID NO: 620896 - RNA, 19 nt, Homo sapiens
uggccacguucaugaagaa

SEQ ID NO: 620897 - RNA, 19 nt, Homo sapiens
ccagggaugcaauauuuua

SEQ ID NO: 620898 - RNA, 19 nt, Homo sapiens
gaugaucugggcuuguuuc

SEQ ID NO: 620899 - RNA, 19 nt, Homo sapiens
gaguggccguugcuacaag

SEQ ID NO: 620900 - RNA, 19 nt, Homo sapiens
ggaguggccguugcuacaa

SEQ ID NO: 620901 - RNA, 19 nt, Homo sapiens
ccacguucaugaagaagac

SEQ ID NO: 620902 - RNA, 19 nt, Homo sapiens
ucacagugccucggacaga

SEQ ID NO: 620903 - RNA, 19 nt, Homo sapiens
uaaaaugggccucaacaau

SEQ ID NO: 620904 - RNA, 19 nt, Homo sapiens
aagugugguuugcagauga

SEQ ID NO: 620905 - RNA, 19 nt, Homo sapiens
ggaugaagggaugcaguga

SEQ ID NO: 620906 - RNA, 19 nt, Homo sapiens
ugacacccaccucuaagga

SEQ ID NO: 620907 - RNA, 19 nt, Homo sapiens
cugcaaaccaacucucuga

SEQ ID NO: 620908 - RNA, 19 nt, Homo sapiens
uacauggcauugagacauc

SEQ ID NO: 620909 - RNA, 19 nt, Homo sapiens
ccagaaggaagaaggaucu

SEQ ID NO: 620910 - RNA, 19 nt, Homo sapiens
ccuggagacaagacaauuu

SEQ ID NO: 620911 - RNA, 19 nt, Homo sapiens
aaaugggccucaacaaucc

SEQ ID NO: 620912 - RNA, 19 nt, Homo sapiens
aaaagugucccuugaguga

SEQ ID NO: 620913 - RNA, 19 nt, Homo sapiens
ggauaaaaccuccuucucu

SEQ ID NO: 620914 - RNA, 19 nt, Homo sapiens
cugagaagcagguuaucuu

SEQ ID NO: 620915 - RNA, 19 nt, Homo sapiens
ucugagagagcuucugaga

SEQ ID NO: 620916 - RNA, 19 nt, Homo sapiens
gggaugcagugaggucaag

SEQ ID NO: 620917 - RNA, 19 nt, Homo sapiens
ggccuccaauucugaccuu

SEQ ID NO: 620918 - RNA, 19 nt, Homo sapiens
cuggagauaugggaagguu

SEQ ID NO: 620919 - RNA, 19 nt, Homo sapiens
guggccacguucaugaaga

SEQ ID NO: 620920 - RNA, 19 nt, Homo sapiens
ccacgcauugucacagcua

SEQ ID NO: 620921 - RNA, 19 nt, Homo sapiens
cagagagacaugaauaaaa

SEQ ID NO: 620922 - RNA, 19 nt, Homo sapiens
ggucuugaggccagaagga

SEQ ID NO: 620923 - RNA, 19 nt, Homo sapiens
cacugacacccaccucuaa

SEQ ID NO: 620924 - RNA, 19 nt, Homo sapiens
caccagaaacagacaucuu

SEQ ID NO: 620925 - RNA, 19 nt, Homo sapiens
cacugagccugcaaaccaa

SEQ ID NO: 620926 - RNA, 19 nt, Homo sapiens
ucugaacuuuccuugaaca

SEQ ID NO: 620927 - RNA, 19 nt, Homo sapiens
guaagcagcugaggaauua

SEQ ID NO: 620928 - RNA, 19 nt, Homo sapiens
gagcuuacacuuucuauua

SEQ ID NO: 620929 - RNA, 19 nt, Homo sapiens
gaugacauauucccucuua

SEQ ID NO: 620930 - RNA, 19 nt, Homo sapiens
gaacucaucuuccuagcaa

SEQ ID NO: 620931 - RNA, 19 nt, Homo sapiens
ccacacaaaucacuuaauu

SEQ ID NO: 620932 - RNA, 19 nt, Homo sapiens
gaaguguugugacucaaua

SEQ ID NO: 620933 - RNA, 19 nt, Homo sapiens
ggagaaggguaggauauuu

SEQ ID NO: 620934 - RNA, 19 nt, Homo sapiens
gcacugugauauuguguaa

SEQ ID NO: 620935 - RNA, 19 nt, Homo sapiens
guaaagaggcugaguguga

SEQ ID NO: 620936 - RNA, 19 nt, Homo sapiens
cuaaaucccugauaauaga

SEQ ID NO: 620937 - RNA, 19 nt, Homo sapiens
cagaagcacugugauauug

SEQ ID NO: 620938 - RNA, 19 nt, Homo sapiens
gcaugcauauauucacuaa

SEQ ID NO: 620939 - RNA, 19 nt, Homo sapiens
guauguguguauucacuua

SEQ ID NO: 620940 - RNA, 19 nt, Homo sapiens
gcauucaccuccuauuuua

SEQ ID NO: 620941 - RNA, 19 nt, Homo sapiens
gacauacaauccuacacua

SEQ ID NO: 620942 - RNA, 19 nt, Homo sapiens
acaaaugucucuauccaau

SEQ ID NO: 620943 - RNA, 19 nt, Homo sapiens
ggagguggguugggagaaa

SEQ ID NO: 620944 - RNA, 19 nt, Homo sapiens
gaagcacugugauauugug

SEQ ID NO: 620945 - RNA, 19 nt, Homo sapiens
caccguaauuuccuacuuu

SEQ ID NO: 620946 - RNA, 19 nt, Homo sapiens
caacgacuuugcugccauu

SEQ ID NO: 620947 - RNA, 19 nt, Homo sapiens
gagaaaguggccauuacua

SEQ ID NO: 620948 - RNA, 19 nt, Homo sapiens
gaacuccacagcuuauuuc

SEQ ID NO: 620949 - RNA, 19 nt, Homo sapiens
caacaaaaccuuggaagua

SEQ ID NO: 620950 - RNA, 19 nt, Homo sapiens
cgacuuugcugccauuaag

SEQ ID NO: 620951 - RNA, 19 nt, Homo sapiens
gccauucacugcaauauac

SEQ ID NO: 620952 - RNA, 19 nt, Homo sapiens
cauauucccucuuaucagu

SEQ ID NO: 620953 - RNA, 19 nt, Homo sapiens
uauuuccgauuuccuguua

SEQ ID NO: 620954 - RNA, 19 nt, Homo sapiens
cagcuccacuuccagaauu

SEQ ID NO: 620955 - RNA, 19 nt, Homo sapiens
ggaauuacuaucacucaug

SEQ ID NO: 620956 - RNA, 19 nt, Homo sapiens
aaagagaaaguggccauua

SEQ ID NO: 620957 - RNA, 19 nt, Homo sapiens
aaaguaagcagcugaggaa

SEQ ID NO: 620958 - RNA, 19 nt, Homo sapiens
guaagcaucuggagaaaau

SEQ ID NO: 620959 - RNA, 19 nt, Homo sapiens
ggugggacauacaauccua

SEQ ID NO: 620960 - RNA, 19 nt, Homo sapiens
guauggaugcuuaucuuaa

SEQ ID NO: 620961 - RNA, 19 nt, Homo sapiens
agaaaguggccauuacuaa

SEQ ID NO: 620962 - RNA, 19 nt, Homo sapiens
ggcauucguuggugauuau

SEQ ID NO: 620963 - RNA, 19 nt, Homo sapiens
ccauauauacuuucacaga

SEQ ID NO: 620964 - RNA, 19 nt, Homo sapiens
gcugucaaaugaggaauug

SEQ ID NO: 620965 - RNA, 19 nt, Homo sapiens
gaggcugagugugacuuua

SEQ ID NO: 620966 - RNA, 19 nt, Homo sapiens
caucaauucuccugcuugu

SEQ ID NO: 620967 - RNA, 19 nt, Homo sapiens
cacuaaaucccugauaaua

SEQ ID NO: 620968 - RNA, 19 nt, Homo sapiens
ccagaagcacugugauauu

SEQ ID NO: 620969 - RNA, 19 nt, Homo sapiens
ggacauacaauccuacacu

SEQ ID NO: 620970 - RNA, 19 nt, Homo sapiens
ggcugagugugacuuuaua

SEQ ID NO: 620971 - RNA, 19 nt, Homo sapiens
ccauuaagcuacaggugau

SEQ ID NO: 620972 - RNA, 19 nt, Homo sapiens
uuaccuaaguacacacaaa

SEQ ID NO: 620973 - RNA, 19 nt, Homo sapiens
aaacaugcccacacaaauc

SEQ ID NO: 620974 - RNA, 19 nt, Homo sapiens
caaaugaggaauugauaag

SEQ ID NO: 620975 - RNA, 19 nt, Homo sapiens
ucaauucuccugcuuguca

SEQ ID NO: 620976 - RNA, 19 nt, Homo sapiens
cuaaguacacacaaacaaa

SEQ ID NO: 620977 - RNA, 19 nt, Homo sapiens
aacugcagcugucaaauga

SEQ ID NO: 620978 - RNA, 19 nt, Homo sapiens
gacauauucccucuuauca

SEQ ID NO: 620979 - RNA, 19 nt, Homo sapiens
aaacugcagcugucaaaug

SEQ ID NO: 620980 - RNA, 19 nt, Homo sapiens
uaacgucagauacaaaugu

SEQ ID NO: 620981 - RNA, 19 nt, Homo sapiens
ccuuggaaguaguuucuaa

SEQ ID NO: 620982 - RNA, 19 nt, Homo sapiens
gaguaaagaggcugagugu

SEQ ID NO: 620983 - RNA, 19 nt, Homo sapiens
uggcauucguuggugauua

SEQ ID NO: 620984 - RNA, 19 nt, Homo sapiens
uauccaauuucaugaguuc

SEQ ID NO: 620985 - RNA, 19 nt, Homo sapiens
caaaugucucuauccaauu

SEQ ID NO: 620986 - RNA, 19 nt, Homo sapiens
uacuaucacucauggagaa

SEQ ID NO: 620987 - RNA, 19 nt, Homo sapiens
acacuacagauuucaguuu

SEQ ID NO: 620988 - RNA, 19 nt, Homo sapiens
ugaaacugcagcugucaaa

SEQ ID NO: 620989 - RNA, 19 nt, Homo sapiens
gauuaucucaccuguagug

SEQ ID NO: 620990 - RNA, 19 nt, Homo sapiens
ugacauauucccucuuauc

SEQ ID NO: 620991 - RNA, 19 nt, Homo sapiens
auacaaaugucucuaucca

SEQ ID NO: 620992 - RNA, 19 nt, Homo sapiens
gcauugcugaugacauauu

SEQ ID NO: 620993 - RNA, 19 nt, Homo sapiens
ucuaguaccuuguauucca

SEQ ID NO: 620994 - RNA, 19 nt, Homo sapiens
ucacagaacaaagaguaaa

SEQ ID NO: 620995 - RNA, 19 nt, Homo sapiens
gaggaauuacuaucacuca

SEQ ID NO: 620996 - RNA, 19 nt, Homo sapiens
ugaacuccacagcuuauuu

SEQ ID NO: 620997 - RNA, 19 nt, Homo sapiens
aguauaugcugccaucaau

SEQ ID NO: 620998 - RNA, 19 nt, Homo sapiens
ccagcaugguggguaagua

SEQ ID NO: 620999 - RNA, 19 nt, Homo sapiens
aagagaaaguggccauuac

SEQ ID NO: 621000 - RNA, 19 nt, Homo sapiens
ucacuaaaucccugauaau

SEQ ID NO: 621001 - RNA, 19 nt, Homo sapiens
uucaugaguuccaguuauu

SEQ ID NO: 621002 - RNA, 19 nt, Homo sapiens
accguaauuuccuacuuua

SEQ ID NO: 621003 - RNA, 19 nt, Homo sapiens
aaguauggaugcuuaucuu

SEQ ID NO: 621004 - RNA, 19 nt, Homo sapiens
uucacuaaaucccugauaa

SEQ ID NO: 621005 - RNA, 19 nt, Homo sapiens
uuucaugaguuccaguuau

SEQ ID NO: 621006 - RNA, 19 nt, Homo sapiens
cacagcuuauuuccgauuu

SEQ ID NO: 621007 - RNA, 19 nt, Homo sapiens
uaagugaguaugcaauauc

SEQ ID NO: 621008 - RNA, 19 nt, Homo sapiens
aaugaggaauugauaagag

SEQ ID NO: 621009 - RNA, 19 nt, Homo sapiens
uauaugcugccaucaauuc

SEQ ID NO: 621010 - RNA, 19 nt, Homo sapiens
gagguggguugggagaaau

SEQ ID NO: 621011 - RNA, 19 nt, Homo sapiens
aauugagacuucuuucuag

SEQ ID NO: 621012 - RNA, 19 nt, Homo sapiens
caaaguauugccaggagau

SEQ ID NO: 621013 - RNA, 19 nt, Homo sapiens
ccucuuaucaguuguguag

SEQ ID NO: 621014 - RNA, 19 nt, Homo sapiens
gcugagugugacuuuauaa

SEQ ID NO: 621015 - RNA, 19 nt, Homo sapiens
ccgcuucugucaguauuug

SEQ ID NO: 621016 - RNA, 19 nt, Homo sapiens
gacacgaggugggacauac

SEQ ID NO: 621017 - RNA, 19 nt, Homo sapiens
cagcaugguggguaaguau

SEQ ID NO: 621018 - RNA, 19 nt, Homo sapiens
caccauggcuggaguuuuc

SEQ ID NO: 621019 - RNA, 19 nt, Homo sapiens
ccacagcuuauuuccgauu

SEQ ID NO: 621020 - RNA, 19 nt, Homo sapiens
cagauacaaaugucucuau

SEQ ID NO: 621021 - RNA, 19 nt, Homo sapiens
uuucacagaacaaagagua

SEQ ID NO: 621022 - RNA, 19 nt, Homo sapiens
gagaaggguaggauauuuu

SEQ ID NO: 621023 - RNA, 19 nt, Homo sapiens
uguguaagcaucuggagaa

SEQ ID NO: 621024 - RNA, 19 nt, Homo sapiens
gauauuguguaagcaucug

SEQ ID NO: 621025 - RNA, 19 nt, Homo sapiens
cauacaauccuacacuaca

SEQ ID NO: 621026 - RNA, 19 nt, Homo sapiens
ggagcuuacacuuucuauu

SEQ ID NO: 621027 - RNA, 19 nt, Homo sapiens
gaacagaaccugcaaauaa

SEQ ID NO: 621028 - RNA, 19 nt, Homo sapiens
caaaugagauuaugcugua

SEQ ID NO: 621029 - RNA, 19 nt, Homo sapiens
gaaccuaagugauguuaau

SEQ ID NO: 621030 - RNA, 19 nt, Homo sapiens
guauaaaguucacacagua

SEQ ID NO: 621031 - RNA, 19 nt, Homo sapiens
gcauaaagcugacacuucu

SEQ ID NO: 621032 - RNA, 19 nt, Homo sapiens
uaucauaccuggacccaaa

SEQ ID NO: 621033 - RNA, 19 nt, Homo sapiens
cagauaccaugcaaugaua

SEQ ID NO: 621034 - RNA, 19 nt, Homo sapiens
uaaugcaacucuccucuuu

SEQ ID NO: 621035 - RNA, 19 nt, Homo sapiens
agaaauaccuugcuucagu

SEQ ID NO: 621036 - RNA, 19 nt, Homo sapiens
gcccagccuucaaauaaua

SEQ ID NO: 621037 - RNA, 19 nt, Homo sapiens
ccaaagaggagagauauuu

SEQ ID NO: 621038 - RNA, 19 nt, Homo sapiens
aacaagggauuaucacaua

SEQ ID NO: 621039 - RNA, 19 nt, Homo sapiens
caaaguaaugguucucaua

SEQ ID NO: 621040 - RNA, 19 nt, Homo sapiens
caaagaaccuaagugaugu

SEQ ID NO: 621041 - RNA, 19 nt, Homo sapiens
cagagggcaucaugacaua

SEQ ID NO: 621042 - RNA, 19 nt, Homo sapiens
gcaacucuccucuuuauuc

SEQ ID NO: 621043 - RNA, 19 nt, Homo sapiens
ugacaaagaaccuaaguga

SEQ ID NO: 621044 - RNA, 19 nt, Homo sapiens
aacagaaccugcaaauaaa

SEQ ID NO: 621045 - RNA, 19 nt, Homo sapiens
gguauaaaguucacacagu

SEQ ID NO: 621046 - RNA, 19 nt, Homo sapiens
cagaaguaauugugccaua

SEQ ID NO: 621047 - RNA, 19 nt, Homo sapiens
acaaagaaccuaagugaug

SEQ ID NO: 621048 - RNA, 19 nt, Homo sapiens
ggugauauuguuccauuua

SEQ ID NO: 621049 - RNA, 19 nt, Homo sapiens
acauaacgcugacugcaaa

SEQ ID NO: 621050 - RNA, 19 nt, Homo sapiens
ggaacaagcagcuaagcaa

SEQ ID NO: 621051 - RNA, 19 nt, Homo sapiens
ccagaucacagaaguaauu

SEQ ID NO: 621052 - RNA, 19 nt, Homo sapiens
acauauugcuugacaaaga

SEQ ID NO: 621053 - RNA, 19 nt, Homo sapiens
gugcaggacaggaucauua

SEQ ID NO: 621054 - RNA, 19 nt, Homo sapiens
gaggagagauauuuugauu

SEQ ID NO: 621055 - RNA, 19 nt, Homo sapiens
gaugauguccugcccacua

SEQ ID NO: 621056 - RNA, 19 nt, Homo sapiens
gcagcuaagcaauagauaa

SEQ ID NO: 621057 - RNA, 19 nt, Homo sapiens
ugggcuugcugacauauua

SEQ ID NO: 621058 - RNA, 19 nt, Homo sapiens
caggugauauuguuccauu

SEQ ID NO: 621059 - RNA, 19 nt, Homo sapiens
gaacaagcagcuaagcaau

SEQ ID NO: 621060 - RNA, 19 nt, Homo sapiens
cauauugcuugacaaagaa

SEQ ID NO: 621061 - RNA, 19 nt, Homo sapiens
ugucacaucaccaagauua

SEQ ID NO: 621062 - RNA, 19 nt, Homo sapiens
gaaguaauugugccauaug

SEQ ID NO: 621063 - RNA, 19 nt, Homo sapiens
ucacaucaccaagauuaua

SEQ ID NO: 621064 - RNA, 19 nt, Homo sapiens
gcaaaguaaugguucucau

SEQ ID NO: 621065 - RNA, 19 nt, Homo sapiens
gcuaagcaauagauaacau

SEQ ID NO: 621066 - RNA, 19 nt, Homo sapiens
gaagugugcuuggugacau

SEQ ID NO: 621067 - RNA, 19 nt, Homo sapiens
ggagagauauuuugauucu

SEQ ID NO: 621068 - RNA, 19 nt, Homo sapiens
ugacauauugcuugacaaa

SEQ ID NO: 621069 - RNA, 19 nt, Homo sapiens
caacucuccucuuuauucu

SEQ ID NO: 621070 - RNA, 19 nt, Homo sapiens
aaagugggcuugcugacau

SEQ ID NO: 621071 - RNA, 19 nt, Homo sapiens
gacaggaucauuacucuca

SEQ ID NO: 621072 - RNA, 19 nt, Homo sapiens
ugauaugacucuccugcuu

SEQ ID NO: 621073 - RNA, 19 nt, Homo sapiens
gacccaggaccaugugaua

SEQ ID NO: 621074 - RNA, 19 nt, Homo sapiens
acaagcagcuaagcaauag

SEQ ID NO: 621075 - RNA, 19 nt, Homo sapiens
gcccagucccguaaugaua

SEQ ID NO: 621076 - RNA, 19 nt, Homo sapiens
cagcauacaaaugagauua

SEQ ID NO: 621077 - RNA, 19 nt, Homo sapiens
gcccagaucacagaaguaa

SEQ ID NO: 621078 - RNA, 19 nt, Homo sapiens
caugacauauugcuugaca

SEQ ID NO: 621079 - RNA, 19 nt, Homo sapiens
gagggcaucaugacauauu

SEQ ID NO: 621080 - RNA, 19 nt, Homo sapiens
guaguacaaugaguguuau

SEQ ID NO: 621081 - RNA, 19 nt, Homo sapiens
caagggauuaucacauauu

SEQ ID NO: 621082 - RNA, 19 nt, Homo sapiens
agaaguaauugugccauau

SEQ ID NO: 621083 - RNA, 19 nt, Homo sapiens
cacaggugcugcuuacaga

SEQ ID NO: 621084 - RNA, 19 nt, Homo sapiens
augcaacucuccucuuuau

SEQ ID NO: 621085 - RNA, 19 nt, Homo sapiens
cugccuaggucaugcguaa

SEQ ID NO: 621086 - RNA, 19 nt, Homo sapiens
cccaacaccuggaugaugu

SEQ ID NO: 621087 - RNA, 19 nt, Homo sapiens
gcugucacaucaccaagau

SEQ ID NO: 621088 - RNA, 19 nt, Homo sapiens
aguaguacaaugaguguua

SEQ ID NO: 621089 - RNA, 19 nt, Homo sapiens
ggaauuagggcauauugcu

SEQ ID NO: 621090 - RNA, 19 nt, Homo sapiens
gacccaaagaggagagaua

SEQ ID NO: 621091 - RNA, 19 nt, Homo sapiens
gaauuagggcauauugcuu

SEQ ID NO: 621092 - RNA, 19 nt, Homo sapiens
cgacuaucauucucucaca

SEQ ID NO: 621093 - RNA, 19 nt, Homo sapiens
aguaaugguucucauagug

SEQ ID NO: 621094 - RNA, 19 nt, Homo sapiens
gcacccagguaaaauuuug

SEQ ID NO: 621095 - RNA, 19 nt, Homo sapiens
gagauuaugcuguaucacu

SEQ ID NO: 621096 - RNA, 19 nt, Homo sapiens
gaaaaugugaguaguacaa

SEQ ID NO: 621097 - RNA, 19 nt, Homo sapiens
caucguggcucugccuuca

SEQ ID NO: 621098 - RNA, 19 nt, Homo sapiens
ugagaaauaccuugcuuca

SEQ ID NO: 621099 - RNA, 19 nt, Homo sapiens
ucagauaccaugcaaugau

SEQ ID NO: 621100 - RNA, 19 nt, Homo sapiens
acaagggauuaucacauau

SEQ ID NO: 621101 - RNA, 19 nt, Homo sapiens
gacauaacgcugacugcaa

SEQ ID NO: 621102 - RNA, 19 nt, Homo sapiens
aguacuaaaucucaccaaa

SEQ ID NO: 621103 - RNA, 19 nt, Homo sapiens
ucauagugguauaaaguuc

SEQ ID NO: 621104 - RNA, 19 nt, Homo sapiens
ucauauacccagcuucaga

SEQ ID NO: 621105 - RNA, 19 nt, Homo sapiens
aagggauuaucacauauug

SEQ ID NO: 621106 - RNA, 19 nt, Homo sapiens
aacaagcagcuaagcaaua

SEQ ID NO: 621107 - RNA, 19 nt, Homo sapiens
caagcaaaguaaugguucu

SEQ ID NO: 621108 - RNA, 19 nt, Homo sapiens
aagagggaauuagggcaua

SEQ ID NO: 621109 - RNA, 19 nt, Homo sapiens
gacuaucauucucucacaa

SEQ ID NO: 621110 - RNA, 19 nt, Homo sapiens
aaaugugaguaguacaaug

SEQ ID NO: 621111 - RNA, 19 nt, Homo sapiens
aaaguaaugguucucauag

SEQ ID NO: 621112 - RNA, 19 nt, Homo sapiens
aaacaagggauuaucacau

SEQ ID NO: 621113 - RNA, 19 nt, Homo sapiens
aaugggaaugugagaaaua

SEQ ID NO: 621114 - RNA, 19 nt, Homo sapiens
guuaauauucugcauaggu

SEQ ID NO: 621115 - RNA, 19 nt, Homo sapiens
aagcugacacuucugacua

SEQ ID NO: 621116 - RNA, 19 nt, Homo sapiens
caagaacagaaccugcaaa

SEQ ID NO: 621117 - RNA, 19 nt, Homo sapiens
gggaacagcaaaccaaugc

SEQ ID NO: 621118 - RNA, 19 nt, Homo sapiens
aaugugaguaguacaauga

SEQ ID NO: 621119 - RNA, 19 nt, Homo sapiens
guaaugcaacucuccucuu

SEQ ID NO: 621120 - RNA, 19 nt, Homo sapiens
ugugagaaauaccuugcuu

SEQ ID NO: 621121 - RNA, 19 nt, Homo sapiens
ggaaugugagaaauaccuu

SEQ ID NO: 621122 - RNA, 19 nt, Homo sapiens
agaacagaaccugcaaaua

SEQ ID NO: 621123 - RNA, 19 nt, Homo sapiens
guacaaugaguguuauaac

SEQ ID NO: 621124 - RNA, 19 nt, Homo sapiens
cuucagauaccaugcaaug

SEQ ID NO: 621125 - RNA, 19 nt, Homo sapiens
aaagaauugugacauaacg

SEQ ID NO: 621126 - RNA, 19 nt, Homo sapiens
caaagugggcuugcugaca

SEQ ID NO: 621127 - RNA, 19 nt, Homo sapiens
gcagggugcuucccauguu

SEQ ID NO: 621128 - RNA, 19 nt, Homo sapiens
ccauguugaugacaauaaa

SEQ ID NO: 621129 - RNA, 19 nt, Homo sapiens
cuaccaagguggccgagaa

SEQ ID NO: 621130 - RNA, 19 nt, Homo sapiens
cgaagaagaagacuaccaa

SEQ ID NO: 621131 - RNA, 19 nt, Homo sapiens
ccaguggcccgaagaagaa

SEQ ID NO: 621132 - RNA, 19 nt, Homo sapiens
gaaaggggcugcgacaaag

SEQ ID NO: 621133 - RNA, 19 nt, Homo sapiens
uggaggaaccacugaguaa

SEQ ID NO: 621134 - RNA, 19 nt, Homo sapiens
agaagaagacuaccaaggu

SEQ ID NO: 621135 - RNA, 19 nt, Homo sapiens
gaagggagaagcaguucgu

SEQ ID NO: 621136 - RNA, 19 nt, Homo sapiens
cgagaagggagaagcaguu

SEQ ID NO: 621137 - RNA, 19 nt, Homo sapiens
gugcuucccauguugauga

SEQ ID NO: 621138 - RNA, 19 nt, Homo sapiens
ggagagcgagcuggaggaa

SEQ ID NO: 621139 - RNA, 19 nt, Homo sapiens
cagggugcuucccauguug

SEQ ID NO: 621140 - RNA, 19 nt, Homo sapiens
gaggaaccacugaguaagg

SEQ ID NO: 621141 - RNA, 19 nt, Homo sapiens
gggagacgcgggaagaaag

SEQ ID NO: 621142 - RNA, 19 nt, Homo sapiens
gagcuggaggaaccacuga

SEQ ID NO: 621143 - RNA, 19 nt, Homo sapiens
gagaagggagaagcaguuc

SEQ ID NO: 621144 - RNA, 19 nt, Homo sapiens
ggaggaaccacugaguaag

SEQ ID NO: 621145 - RNA, 19 nt, Homo sapiens
ugccagaccucagagaucu

SEQ ID NO: 621146 - RNA, 19 nt, Homo sapiens
cccaguggcccgaagaaga

SEQ ID NO: 621147 - RNA, 19 nt, Homo sapiens
gagggagacgcgggaagaa

SEQ ID NO: 621148 - RNA, 19 nt, Homo sapiens
gcccgaagaagaagacuac

SEQ ID NO: 621149 - RNA, 19 nt, Homo sapiens
uuaaggagcuugccucaua

SEQ ID NO: 621150 - RNA, 19 nt, Homo sapiens
gugaagcacuuaaggaaua

SEQ ID NO: 621151 - RNA, 19 nt, Homo sapiens
uagaagagguucauccaua

SEQ ID NO: 621152 - RNA, 19 nt, Homo sapiens
ccagauggcuguucuucua

SEQ ID NO: 621153 - RNA, 19 nt, Homo sapiens
gaacacaugacuagaauug

SEQ ID NO: 621154 - RNA, 19 nt, Homo sapiens
ggaaauauccagguucuaa

SEQ ID NO: 621155 - RNA, 19 nt, Homo sapiens
gcaagaacguuaggagaaa

SEQ ID NO: 621156 - RNA, 19 nt, Homo sapiens
uaaagcaucugccaaugaa

SEQ ID NO: 621157 - RNA, 19 nt, Homo sapiens
gaagaaagaggauggauuc

SEQ ID NO: 621158 - RNA, 19 nt, Homo sapiens
gaaaggguauagugguauu

SEQ ID NO: 621159 - RNA, 19 nt, Homo sapiens
guggaaagguuaugacaaa

SEQ ID NO: 621160 - RNA, 19 nt, Homo sapiens
ggugagauaucgcuugauu

SEQ ID NO: 621161 - RNA, 19 nt, Homo sapiens
ucaacuagaucgacagaaa

SEQ ID NO: 621162 - RNA, 19 nt, Homo sapiens
gagaaaggcagcuucaauu

SEQ ID NO: 621163 - RNA, 19 nt, Homo sapiens
ccaaaggccuggucucuca

SEQ ID NO: 621164 - RNA, 19 nt, Homo sapiens
uagaauugguggugagaua

SEQ ID NO: 621165 - RNA, 19 nt, Homo sapiens
gaaagacacagaaugauca

SEQ ID NO: 621166 - RNA, 19 nt, Homo sapiens
gagcucagcccaagggaua

SEQ ID NO: 621167 - RNA, 19 nt, Homo sapiens
gauggcuguucuucuauua

SEQ ID NO: 621168 - RNA, 19 nt, Homo sapiens
aaacugacauggacuacaa

SEQ ID NO: 621169 - RNA, 19 nt, Homo sapiens
cucguucgcuguaauauua

SEQ ID NO: 621170 - RNA, 19 nt, Homo sapiens
gagcuugccucauacaauc

SEQ ID NO: 621171 - RNA, 19 nt, Homo sapiens
gaacagacuggaauacaga

SEQ ID NO: 621172 - RNA, 19 nt, Homo sapiens
aagaugcacuucaccauaa

SEQ ID NO: 621173 - RNA, 19 nt, Homo sapiens
ccagaaagacacagaauga

SEQ ID NO: 621174 - RNA, 19 nt, Homo sapiens
ccacuaaugucgcagaugu

SEQ ID NO: 621175 - RNA, 19 nt, Homo sapiens
gaacaagacucagauacac

SEQ ID NO: 621176 - RNA, 19 nt, Homo sapiens
uguggaaugugcagauuua

SEQ ID NO: 621177 - RNA, 19 nt, Homo sapiens
cuucagagacacacaauua

SEQ ID NO: 621178 - RNA, 19 nt, Homo sapiens
agaaagaagugucuaugug

SEQ ID NO: 621179 - RNA, 19 nt, Homo sapiens
aaauaccucuguugggaua

SEQ ID NO: 621180 - RNA, 19 nt, Homo sapiens
gcagauuuagguuacuuua

SEQ ID NO: 621181 - RNA, 19 nt, Homo sapiens
cagagacacacaauuauaa

SEQ ID NO: 621182 - RNA, 19 nt, Homo sapiens
gcuguaauauuaaguugga

SEQ ID NO: 621183 - RNA, 19 nt, Homo sapiens
ggguauagugguauuaaua

SEQ ID NO: 621184 - RNA, 19 nt, Homo sapiens
guaaagcaucugccaauga

SEQ ID NO: 621185 - RNA, 19 nt, Homo sapiens
ggagaaaggcagcuucaau

SEQ ID NO: 621186 - RNA, 19 nt, Homo sapiens
cacaaacgcuucagagaca

SEQ ID NO: 621187 - RNA, 19 nt, Homo sapiens
cccaagagguuaugauuca

SEQ ID NO: 621188 - RNA, 19 nt, Homo sapiens
ccgaaaggguauaguggua

SEQ ID NO: 621189 - RNA, 19 nt, Homo sapiens
gaaagguuaugacaaacag

SEQ ID NO: 621190 - RNA, 19 nt, Homo sapiens
ccacauuagugaauuaugg

SEQ ID NO: 621191 - RNA, 19 nt, Homo sapiens
ucagagacacacaauuaua

SEQ ID NO: 621192 - RNA, 19 nt, Homo sapiens
ucaagaacuuugugaauac

SEQ ID NO: 621193 - RNA, 19 nt, Homo sapiens
gaauacagaacaagacuca

SEQ ID NO: 621194 - RNA, 19 nt, Homo sapiens
gaacuuccagaucuacaaa

SEQ ID NO: 621195 - RNA, 19 nt, Homo sapiens
acaccacauuagugaauua

SEQ ID NO: 621196 - RNA, 19 nt, Homo sapiens
acagagacauuguagugaa

SEQ ID NO: 621197 - RNA, 19 nt, Homo sapiens
ggugggcaaagaaauauua

SEQ ID NO: 621198 - RNA, 19 nt, Homo sapiens
aaaggugggcaaagaaaua

SEQ ID NO: 621199 - RNA, 19 nt, Homo sapiens
ucuaagaacucuccuaaaa

SEQ ID NO: 621200 - RNA, 19 nt, Homo sapiens
gacacacaauuauaagaga

SEQ ID NO: 621201 - RNA, 19 nt, Homo sapiens
caauuguacuggaagaaug

SEQ ID NO: 621202 - RNA, 19 nt, Homo sapiens
gcacuuaaggaauaacaga

SEQ ID NO: 621203 - RNA, 19 nt, Homo sapiens
ggaacaggccaaugagaga

SEQ ID NO: 621204 - RNA, 19 nt, Homo sapiens
gcacugaauacagaaguaa

SEQ ID NO: 621205 - RNA, 19 nt, Homo sapiens
gaaaggcagcuucaauucu

SEQ ID NO: 621206 - RNA, 19 nt, Homo sapiens
ccauaaggcuaacagaaag

SEQ ID NO: 621207 - RNA, 19 nt, Homo sapiens
ucagauacacccacuaaug

SEQ ID NO: 621208 - RNA, 19 nt, Homo sapiens
gaaauauccagguucuaau

SEQ ID NO: 621209 - RNA, 19 nt, Homo sapiens
gauggugcccuugacuuua

SEQ ID NO: 621210 - RNA, 19 nt, Homo sapiens
gaaaggugggcaaagaaau

SEQ ID NO: 621211 - RNA, 19 nt, Homo sapiens
guucuaauguguggaaugu

SEQ ID NO: 621212 - RNA, 19 nt, Homo sapiens
aaacugaacacaugacuag

SEQ ID NO: 621213 - RNA, 19 nt, Homo sapiens
gguaaagcaucugccaaug

SEQ ID NO: 621214 - RNA, 19 nt, Homo sapiens
guuccaaucccgugucuuu

SEQ ID NO: 621215 - RNA, 19 nt, Homo sapiens
agacgcaacugaaacaaag

SEQ ID NO: 621216 - RNA, 19 nt, Homo sapiens
ccaaugagagagaguguga

SEQ ID NO: 621217 - RNA, 19 nt, Homo sapiens
cacaaagaauauggagaua

SEQ ID NO: 621218 - RNA, 19 nt, Homo sapiens
ggaaagguuaugacaaaca

SEQ ID NO: 621219 - RNA, 19 nt, Homo sapiens
gacacagaaugaucagaga

SEQ ID NO: 621220 - RNA, 19 nt, Homo sapiens
gcauccauccugccucuuu

SEQ ID NO: 621221 - RNA, 19 nt, Homo sapiens
ugaagcacuuaaggaauaa

SEQ ID NO: 621222 - RNA, 19 nt, Homo sapiens
gagaaacuggacccuauug

SEQ ID NO: 621223 - RNA, 19 nt, Homo sapiens
aaaggcagcuucaauucuc

SEQ ID NO: 621224 - RNA, 19 nt, Homo sapiens
gcugcuauuucgcacaauu

SEQ ID NO: 621225 - RNA, 19 nt, Homo sapiens
aaacaaugccagaagaaga

SEQ ID NO: 621226 - RNA, 19 nt, Homo sapiens
ggaaugugcagauuuaggu

SEQ ID NO: 621227 - RNA, 19 nt, Homo sapiens
guggugagauaucgcuuga

SEQ ID NO: 621228 - RNA, 19 nt, Homo sapiens
cacagaaccuggugaagag

SEQ ID NO: 621229 - RNA, 19 nt, Homo sapiens
agacaugcauaccucaguu

SEQ ID NO: 621230 - RNA, 19 nt, Homo sapiens
cagauacacccacuaaugu

SEQ ID NO: 621231 - RNA, 19 nt, Homo sapiens
gaaacuggacccuauugca

SEQ ID NO: 621232 - RNA, 19 nt, Homo sapiens
gcagaaagaagugucuaug

SEQ ID NO: 621233 - RNA, 19 nt, Homo sapiens
gaucauucuccuaaacuga

SEQ ID NO: 621234 - RNA, 19 nt, Homo sapiens
ugacgaucauucuccuaaa

SEQ ID NO: 621235 - RNA, 19 nt, Homo sapiens
caagagguuaugauucaaa

SEQ ID NO: 621236 - RNA, 19 nt, Homo sapiens
ucaauucucuccgacacaa

SEQ ID NO: 621237 - RNA, 19 nt, Homo sapiens
gauuuagguuacuuuagug

SEQ ID NO: 621238 - RNA, 19 nt, Homo sapiens
aaaaugcacugaauacaga

SEQ ID NO: 621239 - RNA, 19 nt, Homo sapiens
ggauggauucacccagaua

SEQ ID NO: 621240 - RNA, 19 nt, Homo sapiens
gagacauuguagugaagaa

SEQ ID NO: 621241 - RNA, 19 nt, Homo sapiens
acaaacaggaugacacuug

SEQ ID NO: 621242 - RNA, 19 nt, Homo sapiens
gagacgcaacugaaacaaa

SEQ ID NO: 621243 - RNA, 19 nt, Homo sapiens
acacaugacuagaauuggu

SEQ ID NO: 621244 - RNA, 19 nt, Homo sapiens
cuccuaaacugaacacaug

SEQ ID NO: 621245 - RNA, 19 nt, Homo sapiens
gggcaaagaaauauuacug

SEQ ID NO: 621246 - RNA, 19 nt, Homo sapiens
ggacaacagacaugcauac

SEQ ID NO: 621247 - RNA, 19 nt, Homo sapiens
uugagaaacuggacccuau

SEQ ID NO: 621248 - RNA, 19 nt, Homo sapiens
acacaaagaauauggagau

SEQ ID NO: 621249 - RNA, 19 nt, Homo sapiens
uuaaggagcuugccucaua

SEQ ID NO: 621250 - RNA, 19 nt, Homo sapiens
gugaagcacuuaaggaaua

SEQ ID NO: 621251 - RNA, 19 nt, Homo sapiens
uagaagagguucauccaua

SEQ ID NO: 621252 - RNA, 19 nt, Homo sapiens
ccagauggcuguucuucua

SEQ ID NO: 621253 - RNA, 19 nt, Homo sapiens
gcaagaacguuaggagaaa

SEQ ID NO: 621254 - RNA, 19 nt, Homo sapiens
uaaagcaucugccaaugaa

SEQ ID NO: 621255 - RNA, 19 nt, Homo sapiens
gaagaaagaggauggauuc

SEQ ID NO: 621256 - RNA, 19 nt, Homo sapiens
gaaaggguauagugguauu

SEQ ID NO: 621257 - RNA, 19 nt, Homo sapiens
guggaaagguuaugacaaa

SEQ ID NO: 621258 - RNA, 19 nt, Homo sapiens
caccuaagcccaaauauaa

SEQ ID NO: 621259 - RNA, 19 nt, Homo sapiens
aaacagaacuggaaauguc

SEQ ID NO: 621260 - RNA, 19 nt, Homo sapiens
ucaacuagaucgacagaaa

SEQ ID NO: 621261 - RNA, 19 nt, Homo sapiens
gagaaaggcagcuucaauu

SEQ ID NO: 621262 - RNA, 19 nt, Homo sapiens
ccaaaggccuggucucuca

SEQ ID NO: 621263 - RNA, 19 nt, Homo sapiens
gagcucagcccaagggaua

SEQ ID NO: 621264 - RNA, 19 nt, Homo sapiens
gauggcuguucuucuauua

SEQ ID NO: 621265 - RNA, 19 nt, Homo sapiens
aaacugacauggacuacaa

SEQ ID NO: 621266 - RNA, 19 nt, Homo sapiens
cucguucgcuguaauauua

SEQ ID NO: 621267 - RNA, 19 nt, Homo sapiens
gaacagacuggaauacaga

SEQ ID NO: 621268 - RNA, 19 nt, Homo sapiens
gcacaccuaagcccaaaua

SEQ ID NO: 621269 - RNA, 19 nt, Homo sapiens
acaaaugcaucaugaguug

SEQ ID NO: 621270 - RNA, 19 nt, Homo sapiens
aagaugcacuucaccauaa

SEQ ID NO: 621271 - RNA, 19 nt, Homo sapiens
ccacuaaugucgcagaugu

SEQ ID NO: 621272 - RNA, 19 nt, Homo sapiens
gaacaagacucagauacac

SEQ ID NO: 621273 - RNA, 19 nt, Homo sapiens
ggcaacaaaugcaucauga

SEQ ID NO: 621274 - RNA, 19 nt, Homo sapiens
agaaagaagugucuaugug

SEQ ID NO: 621275 - RNA, 19 nt, Homo sapiens
uguccaagcuauguauuua

SEQ ID NO: 621276 - RNA, 19 nt, Homo sapiens
gcuguaauauuaaguugga

SEQ ID NO: 621277 - RNA, 19 nt, Homo sapiens
ggguauagugguauuaaua

SEQ ID NO: 621278 - RNA, 19 nt, Homo sapiens
guaaagcaucugccaauga

SEQ ID NO: 621279 - RNA, 19 nt, Homo sapiens
ggagaaaggcagcuucaau

SEQ ID NO: 621280 - RNA, 19 nt, Homo sapiens
gaaauguccaagcuaugua

SEQ ID NO: 621281 - RNA, 19 nt, Homo sapiens
cccaagagguuaugauuca

SEQ ID NO: 621282 - RNA, 19 nt, Homo sapiens
ccgaaaggguauaguggua

SEQ ID NO: 621283 - RNA, 19 nt, Homo sapiens
gaaagguuaugacaaacag

SEQ ID NO: 621284 - RNA, 19 nt, Homo sapiens
ggaaacagaacuggaaaug

SEQ ID NO: 621285 - RNA, 19 nt, Homo sapiens
gcccuaauccaucuucaua

SEQ ID NO: 621286 - RNA, 19 nt, Homo sapiens
ucaagaacuuugugaauac

SEQ ID NO: 621287 - RNA, 19 nt, Homo sapiens
gaauacagaacaagacuca

SEQ ID NO: 621288 - RNA, 19 nt, Homo sapiens
gaacuuccagaucuacaaa

SEQ ID NO: 621289 - RNA, 19 nt, Homo sapiens
gcucaggacacaagaacua

SEQ ID NO: 621290 - RNA, 19 nt, Homo sapiens
ggaaauguccaagcuaugu

SEQ ID NO: 621291 - RNA, 19 nt, Homo sapiens
gcuaaggcuuggaaacaga

SEQ ID NO: 621292 - RNA, 19 nt, Homo sapiens
caaaacaauuucacccaua

SEQ ID NO: 621293 - RNA, 19 nt, Homo sapiens
gaauccauguuaaaguaug

SEQ ID NO: 621294 - RNA, 19 nt, Homo sapiens
acagagacauuguagugaa

SEQ ID NO: 621295 - RNA, 19 nt, Homo sapiens
ggugggcaaagaaauauua

SEQ ID NO: 621296 - RNA, 19 nt, Homo sapiens
caauuucacccauagcuaa

SEQ ID NO: 621297 - RNA, 19 nt, Homo sapiens
aaaggugggcaaagaaaua

SEQ ID NO: 621298 - RNA, 19 nt, Homo sapiens
ucuaagaacucuccuaaaa

SEQ ID NO: 621299 - RNA, 19 nt, Homo sapiens
caauuguacuggaagaaug

SEQ ID NO: 621300 - RNA, 19 nt, Homo sapiens
gcacuuaaggaauaacaga

SEQ ID NO: 621301 - RNA, 19 nt, Homo sapiens
ggaacaggccaaugagaga

SEQ ID NO: 621302 - RNA, 19 nt, Homo sapiens
gcacugaauacagaaguaa

SEQ ID NO: 621303 - RNA, 19 nt, Homo sapiens
gaaaggcagcuucaauucu

SEQ ID NO: 621304 - RNA, 19 nt, Homo sapiens
caacaaaugcaucaugagu

SEQ ID NO: 621305 - RNA, 19 nt, Homo sapiens
ccauaaggcuaacagaaag

SEQ ID NO: 621306 - RNA, 19 nt, Homo sapiens
ucagauacacccacuaaug

SEQ ID NO: 621307 - RNA, 19 nt, Homo sapiens
gaaaggugggcaaagaaau

SEQ ID NO: 621308 - RNA, 19 nt, Homo sapiens
gguaaagcaucugccaaug

SEQ ID NO: 621309 - RNA, 19 nt, Homo sapiens
guuccaaucccgugucuuu

SEQ ID NO: 621310 - RNA, 19 nt, Homo sapiens
agacgcaacugaaacaaag

SEQ ID NO: 621311 - RNA, 19 nt, Homo sapiens
acaccuaagcccaaauaua

SEQ ID NO: 621312 - RNA, 19 nt, Homo sapiens
ccaaugagagagaguguga

SEQ ID NO: 621313 - RNA, 19 nt, Homo sapiens
cacaaagaauauggagaua

SEQ ID NO: 621314 - RNA, 19 nt, Homo sapiens
ggaaagguuaugacaaaca

SEQ ID NO: 621315 - RNA, 19 nt, Homo sapiens
gaaacagaacuggaaaugu

SEQ ID NO: 621316 - RNA, 19 nt, Homo sapiens
gcauccauccugccucuuu

SEQ ID NO: 621317 - RNA, 19 nt, Homo sapiens
ugaagcacuuaaggaauaa

SEQ ID NO: 621318 - RNA, 19 nt, Homo sapiens
gcugcuauuucgcacaauu

SEQ ID NO: 621319 - RNA, 19 nt, Homo sapiens
gagaaacuggacccuauug

SEQ ID NO: 621320 - RNA, 19 nt, Homo sapiens
aaaggcagcuucaauucuc

SEQ ID NO: 621321 - RNA, 19 nt, Homo sapiens
aaacaaugccagaagaaga

SEQ ID NO: 621322 - RNA, 19 nt, Homo sapiens
gauagaauccauguuaaag

SEQ ID NO: 621323 - RNA, 19 nt, Homo sapiens
agacaugcauaccucaguu

SEQ ID NO: 621324 - RNA, 19 nt, Homo sapiens
cagauacacccacuaaugu

SEQ ID NO: 621325 - RNA, 19 nt, Homo sapiens
gaaacuggacccuauugca

SEQ ID NO: 621326 - RNA, 19 nt, Homo sapiens
gcagaaagaagugucuaug

SEQ ID NO: 621327 - RNA, 19 nt, Homo sapiens
cacagaaccuggugaagag

SEQ ID NO: 621328 - RNA, 19 nt, Homo sapiens
gcaagaugcccuaauccau

SEQ ID NO: 621329 - RNA, 19 nt, Homo sapiens
caagagguuaugauucaaa

SEQ ID NO: 621330 - RNA, 19 nt, Homo sapiens
ucaauucucuccgacacaa

SEQ ID NO: 621331 - RNA, 19 nt, Homo sapiens
guugcaagaugcccuaauc

SEQ ID NO: 621332 - RNA, 19 nt, Homo sapiens
aaaaugcacugaauacaga

SEQ ID NO: 621333 - RNA, 19 nt, Homo sapiens
ggauggauucacccagaua

SEQ ID NO: 621334 - RNA, 19 nt, Homo sapiens
gagacauuguagugaagaa

SEQ ID NO: 621335 - RNA, 19 nt, Homo sapiens
acaaacaggaugacacuug

SEQ ID NO: 621336 - RNA, 19 nt, Homo sapiens
gagacgcaacugaaacaaa

SEQ ID NO: 621337 - RNA, 19 nt, Homo sapiens
aacagacucuucuugcaaa

SEQ ID NO: 621338 - RNA, 19 nt, Homo sapiens
aaacagacucuucuugcaa

SEQ ID NO: 621339 - RNA, 19 nt, Homo sapiens
gggcaaagaaauauuacug

SEQ ID NO: 621340 - RNA, 19 nt, Homo sapiens
ggacaacagacaugcauac

SEQ ID NO: 621341 - RNA, 19 nt, Homo sapiens
uugagaaacuggacccuau

SEQ ID NO: 621342 - RNA, 19 nt, Homo sapiens
acacaaagaauauggagau

SEQ ID NO: 621343 - RNA, 19 nt, Homo sapiens
gaacuaaggggcaacaaau

SEQ ID NO: 621344 - RNA, 19 nt, Homo sapiens
uauacgaccuuuggacaga

SEQ ID NO: 621345 - RNA, 19 nt, Homo sapiens
gaucucgugugggcuaaug

SEQ ID NO: 621346 - RNA, 19 nt, Homo sapiens
caucaagaacuuugugaau

SEQ ID NO: 621347 - RNA, 19 nt, Homo sapiens
ggcaaagaaauauuacuga

SEQ ID NO: 621348 - RNA, 19 nt, Homo sapiens
ugaaaggugggcaaagaaa

SEQ ID NO: 621349 - RNA, 19 nt, Homo sapiens
uuacuuagauggucucaua

SEQ ID NO: 621350 - RNA, 19 nt, Homo sapiens
aaagagaguugguguuuaa

SEQ ID NO: 621351 - RNA, 19 nt, Homo sapiens
gugauaacgucaaguaauu

SEQ ID NO: 621352 - RNA, 19 nt, Homo sapiens
gaaauccaguuugacgaua

SEQ ID NO: 621353 - RNA, 19 nt, Homo sapiens
gagaguugguguuuaaaga

SEQ ID NO: 621354 - RNA, 19 nt, Homo sapiens
gaggaugguucuacaguug

SEQ ID NO: 621355 - RNA, 19 nt, Homo sapiens
ggacauugaauuaccuuaa

SEQ ID NO: 621356 - RNA, 19 nt, Homo sapiens
gauacaauuugaagacaga

SEQ ID NO: 621357 - RNA, 19 nt, Homo sapiens
auacauuucugccugauaa

SEQ ID NO: 621358 - RNA, 19 nt, Homo sapiens
guaauggaacuuaaggaua

SEQ ID NO: 621359 - RNA, 19 nt, Homo sapiens
uaaagaggauggacaagag

SEQ ID NO: 621360 - RNA, 19 nt, Homo sapiens
uaaauaaacgagugccuuu

SEQ ID NO: 621361 - RNA, 19 nt, Homo sapiens
acaagaguaugcucaggua

SEQ ID NO: 621362 - RNA, 19 nt, Homo sapiens
uagauggucucauaagguu

SEQ ID NO: 621363 - RNA, 19 nt, Homo sapiens
gaugaagacauugaugaua

SEQ ID NO: 621364 - RNA, 19 nt, Homo sapiens
uaaaguacaaugcagauga

SEQ ID NO: 621365 - RNA, 19 nt, Homo sapiens
caucagacauuauauuggu

SEQ ID NO: 621366 - RNA, 19 nt, Homo sapiens
ccaagaagagaaauucauu

SEQ ID NO: 621367 - RNA, 19 nt, Homo sapiens
caaugcagaugaagcuaga

SEQ ID NO: 621368 - RNA, 19 nt, Homo sapiens
aaaguacaaugcagaugaa

SEQ ID NO: 621369 - RNA, 19 nt, Homo sapiens
gauaacaaagcugauguaa

SEQ ID NO: 621370 - RNA, 19 nt, Homo sapiens
guugggaaauggacgauug

SEQ ID NO: 621371 - RNA, 19 nt, Homo sapiens
gcacccaccugcugcaucu

SEQ ID NO: 621372 - RNA, 19 nt, Homo sapiens
gcaaccaauuaucuuaaca

SEQ ID NO: 621373 - RNA, 19 nt, Homo sapiens
uauuggagaugaugaugaa

SEQ ID NO: 621374 - RNA, 19 nt, Homo sapiens
ggauaacaaagcugaugua

SEQ ID NO: 621375 - RNA, 19 nt, Homo sapiens
aauaaguggcaaccaauua

SEQ ID NO: 621376 - RNA, 19 nt, Homo sapiens
cagaaaacauggacauauu

SEQ ID NO: 621377 - RNA, 19 nt, Homo sapiens
ucucauaagguuucugaua

SEQ ID NO: 621378 - RNA, 19 nt, Homo sapiens
gcccaagaauaaagguaaa

SEQ ID NO: 621379 - RNA, 19 nt, Homo sapiens
ccagaaaggagucggaaga

SEQ ID NO: 621380 - RNA, 19 nt, Homo sapiens
ucugaaagcaaacugauuu

SEQ ID NO: 621381 - RNA, 19 nt, Homo sapiens
caaccaagaagagaaauuc

SEQ ID NO: 621382 - RNA, 19 nt, Homo sapiens
uuaguucagucggcucuua

SEQ ID NO: 621383 - RNA, 19 nt, Homo sapiens
gauuggaagcauuguguuu

SEQ ID NO: 621384 - RNA, 19 nt, Homo sapiens
uggcuuucaugaacaagua

SEQ ID NO: 621385 - RNA, 19 nt, Homo sapiens
gugccucgguuauuaagga

SEQ ID NO: 621386 - RNA, 19 nt, Homo sapiens
ucauuguaauccacuguuu

SEQ ID NO: 621387 - RNA, 19 nt, Homo sapiens
aacaauaaguggcaaccaa

SEQ ID NO: 621388 - RNA, 19 nt, Homo sapiens
ugaggaugguucuacaguu

SEQ ID NO: 621389 - RNA, 19 nt, Homo sapiens
ugaagacauugaugauauc

SEQ ID NO: 621390 - RNA, 19 nt, Homo sapiens
cauaucagagggaaauuga

SEQ ID NO: 621391 - RNA, 19 nt, Homo sapiens
cauaagguuucugauacaa

SEQ ID NO: 621392 - RNA, 19 nt, Homo sapiens
ucaccgccaugcccaagaa

SEQ ID NO: 621393 - RNA, 19 nt, Homo sapiens
augaugaaauccaguuuga

SEQ ID NO: 621394 - RNA, 19 nt, Homo sapiens
caauaaguggcaaccaauu

SEQ ID NO: 621395 - RNA, 19 nt, Homo sapiens
cuuugugccucgguuauua

SEQ ID NO: 621396 - RNA, 19 nt, Homo sapiens
ucauaagguuucugauaca

SEQ ID NO: 621397 - RNA, 19 nt, Homo sapiens
caucaaccaagaagagaaa

SEQ ID NO: 621398 - RNA, 19 nt, Homo sapiens
gaugaugaaauccaguuug

SEQ ID NO: 621399 - RNA, 19 nt, Homo sapiens
guggcaaccaauuaucuua

SEQ ID NO: 621400 - RNA, 19 nt, Homo sapiens
cuaauaagcccuacuucca

SEQ ID NO: 621401 - RNA, 19 nt, Homo sapiens
uaaacgagugccuuuccua

SEQ ID NO: 621402 - RNA, 19 nt, Homo sapiens
agaugaugaugaagacauu

SEQ ID NO: 621403 - RNA, 19 nt, Homo sapiens
ggucucauaagguuucuga

SEQ ID NO: 621404 - RNA, 19 nt, Homo sapiens
gguauguuucaguuacuua

SEQ ID NO: 621405 - RNA, 19 nt, Homo sapiens
aagcugaggacauugaauu

SEQ ID NO: 621406 - RNA, 19 nt, Homo sapiens
caaguucucugaggauggu

SEQ ID NO: 621407 - RNA, 19 nt, Homo sapiens
uaucagagggaaauugaga

SEQ ID NO: 621408 - RNA, 19 nt, Homo sapiens
gaauacauuucugccugau

SEQ ID NO: 621409 - RNA, 19 nt, Homo sapiens
aaauccaguuugacgauau

SEQ ID NO: 621410 - RNA, 19 nt, Homo sapiens
ccgccaugcccaagaauaa

SEQ ID NO: 621411 - RNA, 19 nt, Homo sapiens
caagaauaaagguaaagga

SEQ ID NO: 621412 - RNA, 19 nt, Homo sapiens
gaccauaauauuugcuguu

SEQ ID NO: 621413 - RNA, 19 nt, Homo sapiens
ggauaaauacaucagacau

SEQ ID NO: 621414 - RNA, 19 nt, Homo sapiens
aaagaaaccgaacaauaag

SEQ ID NO: 621415 - RNA, 19 nt, Homo sapiens
cgagugccuuuccuacugu

SEQ ID NO: 621416 - RNA, 19 nt, Homo sapiens
aaaagagaguugguguuua

SEQ ID NO: 621417 - RNA, 19 nt, Homo sapiens
uggagaugaugaugaaauc

SEQ ID NO: 621418 - RNA, 19 nt, Homo sapiens
ucagagggaaauugagaaa

SEQ ID NO: 621419 - RNA, 19 nt, Homo sapiens
guaguaaccgccagaaagg

SEQ ID NO: 621420 - RNA, 19 nt, Homo sapiens
gaguaguaacuuagaaugu

SEQ ID NO: 621421 - RNA, 19 nt, Homo sapiens
cucauaagguuucugauac

SEQ ID NO: 621422 - RNA, 19 nt, Homo sapiens
gauggucucauaagguuuc

SEQ ID NO: 621423 - RNA, 19 nt, Homo sapiens
gagaugaugaugaagacau

SEQ ID NO: 621424 - RNA, 19 nt, Homo sapiens
guacaaugcagaugaagcu

SEQ ID NO: 621425 - RNA, 19 nt, Homo sapiens
agaguaugcucagguaauc

SEQ ID NO: 621426 - RNA, 19 nt, Homo sapiens
gggaaauggacgauuggaa

SEQ ID NO: 621427 - RNA, 19 nt, Homo sapiens
ugccuuuccuacugugaua

SEQ ID NO: 621428 - RNA, 19 nt, Homo sapiens
uuaaagaggauggacaaga

SEQ ID NO: 621429 - RNA, 19 nt, Homo sapiens
gaugaugaagacauugaug

SEQ ID NO: 621430 - RNA, 19 nt, Homo sapiens
ggcaaccaauuaucuuaac

SEQ ID NO: 621431 - RNA, 19 nt, Homo sapiens
guucuaauaagcccuacuu

SEQ ID NO: 621432 - RNA, 19 nt, Homo sapiens
uaacgucaaguaauuggau

SEQ ID NO: 621433 - RNA, 19 nt, Homo sapiens
uuuaaaagcugaggacauu

SEQ ID NO: 621434 - RNA, 19 nt, Homo sapiens
cugaaagcaaacugauuua

SEQ ID NO: 621435 - RNA, 19 nt, Homo sapiens
agaaaccgaacaauaagug

SEQ ID NO: 621436 - RNA, 19 nt, Homo sapiens
gguuucugauacaauuuga

SEQ ID NO: 621437 - RNA, 19 nt, Homo sapiens
gauaacgucaaguaauugg

SEQ ID NO: 621438 - RNA, 19 nt, Homo sapiens
caucaucaaccaagaagag

SEQ ID NO: 621439 - RNA, 19 nt, Homo sapiens
aauccaguuugacgauauu

SEQ ID NO: 621440 - RNA, 19 nt, Homo sapiens
uggcaaccaauuaucuuaa

SEQ ID NO: 621441 - RNA, 19 nt, Homo sapiens
caagaguaugcucagguaa

SEQ ID NO: 621442 - RNA, 19 nt, Homo sapiens
uuuaguguguaguuucuga

SEQ ID NO: 621443 - RNA, 19 nt, Homo sapiens
gagaugaugaugaaaucca

SEQ ID NO: 621444 - RNA, 19 nt, Homo sapiens
gaguaguaaccgccagaaa

SEQ ID NO: 621445 - RNA, 19 nt, Homo sapiens
cuacuuccaccuaaucugu

SEQ ID NO: 621446 - RNA, 19 nt, Homo sapiens
acgagugccuuuccuacug

SEQ ID NO: 621447 - RNA, 19 nt, Homo sapiens
uaaagguaaaggagguaaa

SEQ ID NO: 621448 - RNA, 19 nt, Homo sapiens
ugaaauccaguuugacgau

SEQ ID NO: 621449 - RNA, 19 nt, Homo sapiens
gaaaauagcuugaauguug

SEQ ID NO: 621450 - RNA, 19 nt, Homo sapiens
ggacaggccugcguuguuu

SEQ ID NO: 621451 - RNA, 19 nt, Homo sapiens
ucaaagaccugcugacaau

SEQ ID NO: 621452 - RNA, 19 nt, Homo sapiens
gcaagcaggcgaaucuuaa

SEQ ID NO: 621453 - RNA, 19 nt, Homo sapiens
ggaaagaggaagcucauga

SEQ ID NO: 621454 - RNA, 19 nt, Homo sapiens
uggcugagaucgagaaauu

SEQ ID NO: 621455 - RNA, 19 nt, Homo sapiens
caaagaaacuaucgaacag

SEQ ID NO: 621456 - RNA, 19 nt, Homo sapiens
gaacagacagauccuuugu

SEQ ID NO: 621457 - RNA, 19 nt, Homo sapiens
ggagggcagugaaaucuag

SEQ ID NO: 621458 - RNA, 19 nt, Homo sapiens
gaauguuggugaaagacuu

SEQ ID NO: 621459 - RNA, 19 nt, Homo sapiens
caaacacguuggaugaguu

SEQ ID NO: 621460 - RNA, 19 nt, Homo sapiens
acagacagauccuuuguuc

SEQ ID NO: 621461 - RNA, 19 nt, Homo sapiens
gcaaacacguuggaugagu

SEQ ID NO: 621462 - RNA, 19 nt, Homo sapiens
ccaaagaaacuaucgaaca

SEQ ID NO: 621463 - RNA, 19 nt, Homo sapiens
ggacuaugcugcccuuuug

SEQ ID NO: 621464 - RNA, 19 nt, Homo sapiens
gaaguggcuuuccuauucu

SEQ ID NO: 621465 - RNA, 19 nt, Homo sapiens
ccaccaauaucuacuguac

SEQ ID NO: 621466 - RNA, 19 nt, Homo sapiens
ccaagccagccuuuaauuu

SEQ ID NO: 621467 - RNA, 19 nt, Homo sapiens
gaagcacaguucccaguac

SEQ ID NO: 621468 - RNA, 19 nt, Homo sapiens
gaaggaaaauagcuugaau

SEQ ID NO: 621469 - RNA, 19 nt, Homo sapiens
cagaaacgcaagagaagaa

SEQ ID NO: 621470 - RNA, 19 nt, Homo sapiens
agacagaaacgcaagagaa

SEQ ID NO: 621471 - RNA, 19 nt, Homo sapiens
ggcaagcaggcgaaucuua

SEQ ID NO: 621472 - RNA, 19 nt, Homo sapiens
ggaacagacagauccuuug

SEQ ID NO: 621473 - RNA, 19 nt, Homo sapiens
caauaucuacuguacauuc

SEQ ID NO: 621474 - RNA, 19 nt, Homo sapiens
gcaagagaagaauccauug

SEQ ID NO: 621475 - RNA, 19 nt, Homo sapiens
gcacaguucccaguacaga

SEQ ID NO: 621476 - RNA, 19 nt, Homo sapiens
gaaagaggaagcucaugag

SEQ ID NO: 621477 - RNA, 19 nt, Homo sapiens
uagcuugaauguuggugaa

SEQ ID NO: 621478 - RNA, 19 nt, Homo sapiens
aaacugaagaagacagaaa

SEQ ID NO: 621479 - RNA, 19 nt, Homo sapiens
caagcaggcgaaucuuaaa

SEQ ID NO: 621480 - RNA, 19 nt, Homo sapiens
caagagaagaauccauugu

SEQ ID NO: 621481 - RNA, 19 nt, Homo sapiens
gggucaaauuccuuuauuc

SEQ ID NO: 621482 - RNA, 19 nt, Homo sapiens
agagaagaauccauugucu

SEQ ID NO: 621483 - RNA, 19 nt, Homo sapiens
gcaggcgaaucuuaaacag

SEQ ID NO: 621484 - RNA, 19 nt, Homo sapiens
gaacugguagggcgguugu

SEQ ID NO: 621485 - RNA, 19 nt, Homo sapiens
aagccagccuuuaauuuua

SEQ ID NO: 621486 - RNA, 19 nt, Homo sapiens
gacagaaacgcaagagaag

SEQ ID NO: 621487 - RNA, 19 nt, Homo sapiens
caagccagccuuuaauuuu

SEQ ID NO: 621488 - RNA, 19 nt, Homo sapiens
gaggcaagcaggcgaaucu

SEQ ID NO: 621489 - RNA, 19 nt, Homo sapiens
caucaaagaccugcugaca

SEQ ID NO: 621490 - RNA, 19 nt, Homo sapiens
guacauucuacaagcauug

SEQ ID NO: 621491 - RNA, 19 nt, Homo sapiens
accaauaucuacuguacau

SEQ ID NO: 621492 - RNA, 19 nt, Homo sapiens
agucgaaacugaagaagac

SEQ ID NO: 621493 - RNA, 19 nt, Homo sapiens
cuuccaagccagccuuuaa

SEQ ID NO: 621494 - RNA, 19 nt, Homo sapiens
ggagugggagggcagugaa

SEQ ID NO: 621495 - RNA, 19 nt, Homo sapiens
gcaugugccaccaauaucu

SEQ ID NO: 621496 - RNA, 19 nt, Homo sapiens
cgcaagagaagaauccauu

SEQ ID NO: 621497 - RNA, 19 nt, Homo sapiens
cuugaauguuggugaaaga

SEQ ID NO: 621498 - RNA, 19 nt, Homo sapiens
uaucuacuguacauucuac

SEQ ID NO: 621499 - RNA, 19 nt, Homo sapiens
gaaacgcaagagaagaauc

SEQ ID NO: 621500 - RNA, 19 nt, Homo sapiens
gagggcagaagcacaguuc

SEQ ID NO: 621501 - RNA, 19 nt, Homo sapiens
gguuagaugcaaacacguu

SEQ ID NO: 621502 - RNA, 19 nt, Homo sapiens
cgaaacugaagaagacaga

SEQ ID NO: 621503 - RNA, 19 nt, Homo sapiens
agaagcacaguucccagua

SEQ ID NO: 621504 - RNA, 19 nt, Homo sapiens
gggagggcagugaaaucua

SEQ ID NO: 621505 - RNA, 19 nt, Homo sapiens
cacguuggaugaguuugaa

SEQ ID NO: 621506 - RNA, 19 nt, Homo sapiens
gaagacagaaacgcaagag

SEQ ID NO: 621507 - RNA, 19 nt, Homo sapiens
gauaagucgaaacugaaga

SEQ ID NO: 621508 - RNA, 19 nt, Homo sapiens
aagcacaguucccaguaca

SEQ ID NO: 621509 - RNA, 19 nt, Homo sapiens
cgaccugggcuccauuuua

SEQ ID NO: 621510 - RNA, 19 nt, Homo sapiens
ggggucaaauuccuuuauu

SEQ ID NO: 621511 - RNA, 19 nt, Homo sapiens
caugugccaccaauaucua

SEQ ID NO: 621512 - RNA, 19 nt, Homo sapiens
uacgugagaagacuagaaa

SEQ ID NO: 621513 - RNA, 19 nt, Homo sapiens
gaaacugaagaagacagaa

SEQ ID NO: 621514 - RNA, 19 nt, Homo sapiens
gcuugaauguuggugaaag

SEQ ID NO: 621515 - RNA, 19 nt, Homo sapiens
augcaaacacguuggauga

SEQ ID NO: 621516 - RNA, 19 nt, Homo sapiens
agaauccauugucuuccaa

SEQ ID NO: 621517 - RNA, 19 nt, Homo sapiens
gaacgcggaaguggcuuuc

SEQ ID NO: 621518 - RNA, 19 nt, Homo sapiens
ugcuagggaugccgaaaug

SEQ ID NO: 621519 - RNA, 19 nt, Homo sapiens
ggucaaauuccuuuauucc

SEQ ID NO: 621520 - RNA, 19 nt, Homo sapiens
uggcuuuccuauucucuuc

SEQ ID NO: 621521 - RNA, 19 nt, Homo sapiens
acacguuggaugaguuuga

SEQ ID NO: 621522 - RNA, 19 nt, Homo sapiens
gaauccauugucuuccaaa

SEQ ID NO: 621523 - RNA, 19 nt, Homo sapiens
aauguuggugaaagacuua

SEQ ID NO: 621524 - RNA, 19 nt, Homo sapiens
gggaggaacuuaccgucua

SEQ ID NO: 621525 - RNA, 19 nt, Homo sapiens
uaagugacaucaacucaga

SEQ ID NO: 621526 - RNA, 19 nt, Homo sapiens
gguaaagcguuccauguca

SEQ ID NO: 621527 - RNA, 19 nt, Homo sapiens
ggaccuaagugacaucaac

SEQ ID NO: 621528 - RNA, 19 nt, Homo sapiens
ggacagcagcggauguguu

SEQ ID NO: 621529 - RNA, 19 nt, Homo sapiens
gaacucccauggucuucuc

SEQ ID NO: 621530 - RNA, 19 nt, Homo sapiens
gaaccuccucagcauguuu

SEQ ID NO: 621531 - RNA, 19 nt, Homo sapiens
gauucugccucugcacuuu

SEQ ID NO: 621532 - RNA, 19 nt, Homo sapiens
gccuggccgugucuaauaa

SEQ ID NO: 621533 - RNA, 19 nt, Homo sapiens
cagcggauguguucagucu

SEQ ID NO: 621534 - RNA, 19 nt, Homo sapiens
ggaggaacuuaccgucuac

SEQ ID NO: 621535 - RNA, 19 nt, Homo sapiens
ugucaagccugccaacauc

SEQ ID NO: 621536 - RNA, 19 nt, Homo sapiens
gggaugcccuggaccuaag

SEQ ID NO: 621537 - RNA, 19 nt, Homo sapiens
gacagcagcggauguguuc

SEQ ID NO: 621538 - RNA, 19 nt, Homo sapiens
gcugcaagcugggugacuu

SEQ ID NO: 621539 - RNA, 19 nt, Homo sapiens
gaaagguggccagcagaug

SEQ ID NO: 621540 - RNA, 19 nt, Homo sapiens
ggaaagguggccagcagau

SEQ ID NO: 621541 - RNA, 19 nt, Homo sapiens
gcagagcccuggguaugac

SEQ ID NO: 621542 - RNA, 19 nt, Homo sapiens
guucuguccuugucaugau

SEQ ID NO: 621543 - RNA, 19 nt, Homo sapiens
ggaaccuccucagcauguu

SEQ ID NO: 621544 - RNA, 19 nt, Homo sapiens
acggagaggucuucaaggu

SEQ ID NO: 621545 - RNA, 19 nt, Homo sapiens
ccacgcagaaccuggauuc

SEQ ID NO: 621546 - RNA, 19 nt, Homo sapiens
gcgguaaagcguuccaugu

SEQ ID NO: 621547 - RNA, 19 nt, Homo sapiens
aaagguggccagcagaugu

SEQ ID NO: 621548 - RNA, 19 nt, Homo sapiens
ucaccacccugcaguuugc

SEQ ID NO: 621549 - RNA, 19 nt, Homo sapiens
ccuggauucucccucaaga

SEQ ID NO: 621550 - RNA, 19 nt, Homo sapiens
ccaggccagucaugcuaga

SEQ ID NO: 621551 - RNA, 19 nt, Homo sapiens
ugccuggccgugucuaaua

SEQ ID NO: 621552 - RNA, 19 nt, Homo sapiens
cgagcugcguucuguccuu

SEQ ID NO: 621553 - RNA, 19 nt, Homo sapiens
ucaaggugcgcuccaagga

SEQ ID NO: 621554 - RNA, 19 nt, Homo sapiens
cuuccgagcugcguucugu

SEQ ID NO: 621555 - RNA, 19 nt, Homo sapiens
cuacggagaggucuucaag

SEQ ID NO: 621556 - RNA, 19 nt, Homo sapiens
gcccuggaccuaagugaca

SEQ ID NO: 621557 - RNA, 19 nt, Homo sapiens
cuacuuccgccacgcagaa

SEQ ID NO: 621558 - RNA, 19 nt, Homo sapiens
ucccaccacugaagcuguu

SEQ ID NO: 621559 - RNA, 19 nt, Homo sapiens
gaaugaaacuguaaccaaa

SEQ ID NO: 621560 - RNA, 19 nt, Homo sapiens
gaagaaagaaguugaauca

SEQ ID NO: 621561 - RNA, 19 nt, Homo sapiens
guaguagacuuguuaagaa

SEQ ID NO: 621562 - RNA, 19 nt, Homo sapiens
gcaaugaggaugugacuaa

SEQ ID NO: 621563 - RNA, 19 nt, Homo sapiens
gcaguuauaucccugagaa

SEQ ID NO: 621564 - RNA, 19 nt, Homo sapiens
agaaggagaugaucaagaa

SEQ ID NO: 621565 - RNA, 19 nt, Homo sapiens
ccugagagauuaaacagua

SEQ ID NO: 621566 - RNA, 19 nt, Homo sapiens
gaaggaauaugcugaaagg

SEQ ID NO: 621567 - RNA, 19 nt, Homo sapiens
aaacaugacucgcgauuuc

SEQ ID NO: 621568 - RNA, 19 nt, Homo sapiens
ggaagaagauaagccaaga

SEQ ID NO: 621569 - RNA, 19 nt, Homo sapiens
ggauauauuuccuuacuca

SEQ ID NO: 621570 - RNA, 19 nt, Homo sapiens
gcauuacuguguuaugauu

SEQ ID NO: 621571 - RNA, 19 nt, Homo sapiens
gaaagaagcagcagaucga

SEQ ID NO: 621572 - RNA, 19 nt, Homo sapiens
gacuaaagcaguugacaua

SEQ ID NO: 621573 - RNA, 19 nt, Homo sapiens
gguacacacuacauacuaa

SEQ ID NO: 621574 - RNA, 19 nt, Homo sapiens
ggagauagauaacaaucca

SEQ ID NO: 621575 - RNA, 19 nt, Homo sapiens
caaacaacauguaaucuac

SEQ ID NO: 621576 - RNA, 19 nt, Homo sapiens
cagcaucuguuaaucuaaa

SEQ ID NO: 621577 - RNA, 19 nt, Homo sapiens
guagacuuguuaagaauga

SEQ ID NO: 621578 - RNA, 19 nt, Homo sapiens
gauggugguuguacauuau

SEQ ID NO: 621579 - RNA, 19 nt, Homo sapiens
ucgccaagaugaaagguua

SEQ ID NO: 621580 - RNA, 19 nt, Homo sapiens
gaaaggccaacaugagaaa

SEQ ID NO: 621581 - RNA, 19 nt, Homo sapiens
gaacucaugagacugcuuu

SEQ ID NO: 621582 - RNA, 19 nt, Homo sapiens
ccaaacaacauguaaucua

SEQ ID NO: 621583 - RNA, 19 nt, Homo sapiens
agagugacaucauuacuga

SEQ ID NO: 621584 - RNA, 19 nt, Homo sapiens
aaaugaagcuuuguguuug

SEQ ID NO: 621585 - RNA, 19 nt, Homo sapiens
ggaugugacuaaagcaguu

SEQ ID NO: 621586 - RNA, 19 nt, Homo sapiens
gcaacuaaacaaucaaaug

SEQ ID NO: 621587 - RNA, 19 nt, Homo sapiens
gcaagaggaacaaauggaa

SEQ ID NO: 621588 - RNA, 19 nt, Homo sapiens
caaacaaacuacccauuuu

SEQ ID NO: 621589 - RNA, 19 nt, Homo sapiens
gaauacaaguggagcaaac

SEQ ID NO: 621590 - RNA, 19 nt, Homo sapiens
guaagguacacacuacaua

SEQ ID NO: 621591 - RNA, 19 nt, Homo sapiens
ugacauaacuacuccaaaa

SEQ ID NO: 621592 - RNA, 19 nt, Homo sapiens
acaaacaaacuacccauuu

SEQ ID NO: 621593 - RNA, 19 nt, Homo sapiens
augaagaucuugauacaga

SEQ ID NO: 621594 - RNA, 19 nt, Homo sapiens
gcaaacaagagaugaagau

SEQ ID NO: 621595 - RNA, 19 nt, Homo sapiens
gaagauaccgaccaugaag

SEQ ID NO: 621596 - RNA, 19 nt, Homo sapiens
agauggugguuguacauua

SEQ ID NO: 621597 - RNA, 19 nt, Homo sapiens
agacgaagauggugguugu

SEQ ID NO: 621598 - RNA, 19 nt, Homo sapiens
ucagagagugacaucauua

SEQ ID NO: 621599 - RNA, 19 nt, Homo sapiens
ggcagcaacuaaacaauca

SEQ ID NO: 621600 - RNA, 19 nt, Homo sapiens
ggaagauaccgaccaugaa

SEQ ID NO: 621601 - RNA, 19 nt, Homo sapiens
caaagcauuaauccaguua

SEQ ID NO: 621602 - RNA, 19 nt, Homo sapiens
gaaacaugacucgcgauuu

SEQ ID NO: 621603 - RNA, 19 nt, Homo sapiens
uaugggagauagauaacaa

SEQ ID NO: 621604 - RNA, 19 nt, Homo sapiens
agacgaaguuccugaugga

SEQ ID NO: 621605 - RNA, 19 nt, Homo sapiens
ucaaagcauuaauccaguu

SEQ ID NO: 621606 - RNA, 19 nt, Homo sapiens
aggaacaaauggaaacuga

SEQ ID NO: 621607 - RNA, 19 nt, Homo sapiens
caagcaagaggaacaaaug

SEQ ID NO: 621608 - RNA, 19 nt, Homo sapiens
guaaagccacccacaaaca

SEQ ID NO: 621609 - RNA, 19 nt, Homo sapiens
caaugaggaugugacuaaa

SEQ ID NO: 621610 - RNA, 19 nt, Homo sapiens
caacuaaacaaucaaaugc

SEQ ID NO: 621611 - RNA, 19 nt, Homo sapiens
gagauuaaacaguaguaga

SEQ ID NO: 621612 - RNA, 19 nt, Homo sapiens
gauucuaaauugaggacuu

SEQ ID NO: 621613 - RNA, 19 nt, Homo sapiens
gaagaagauaagccaagaa

SEQ ID NO: 621614 - RNA, 19 nt, Homo sapiens
gaagguuuaugggagauag

SEQ ID NO: 621615 - RNA, 19 nt, Homo sapiens
gaagauggugguuguacau

SEQ ID NO: 621616 - RNA, 19 nt, Homo sapiens
uggcauuacuguguuauga

SEQ ID NO: 621617 - RNA, 19 nt, Homo sapiens
gagcaccaaacaacaugua

SEQ ID NO: 621618 - RNA, 19 nt, Homo sapiens
gaaacugagcaccaaacaa

SEQ ID NO: 621619 - RNA, 19 nt, Homo sapiens
cagaaggaauaugcugaaa

SEQ ID NO: 621620 - RNA, 19 nt, Homo sapiens
gguuguacauuauucaucu

SEQ ID NO: 621621 - RNA, 19 nt, Homo sapiens
caagaggaacaaauggaaa

SEQ ID NO: 621622 - RNA, 19 nt, Homo sapiens
gcaagcaagaggaacaaau

SEQ ID NO: 621623 - RNA, 19 nt, Homo sapiens
ggaagaaagaaguugaauc

SEQ ID NO: 621624 - RNA, 19 nt, Homo sapiens
gaagauaagccaagaaaag

SEQ ID NO: 621625 - RNA, 19 nt, Homo sapiens
uaaagccacccacaaacaa

SEQ ID NO: 621626 - RNA, 19 nt, Homo sapiens
gccagaaggaagaagauaa

SEQ ID NO: 621627 - RNA, 19 nt, Homo sapiens
cuaaagcaguugacauaac

SEQ ID NO: 621628 - RNA, 19 nt, Homo sapiens
aaugaagcuuuguguuuga

SEQ ID NO: 621629 - RNA, 19 nt, Homo sapiens
gauggaagaauguucagau

SEQ ID NO: 621630 - RNA, 19 nt, Homo sapiens
gagagugacaucauuacug

SEQ ID NO: 621631 - RNA, 19 nt, Homo sapiens
acaaucaaaugcaucaucu

SEQ ID NO: 621632 - RNA, 19 nt, Homo sapiens
ggagcaaacaagagaugaa

SEQ ID NO: 621633 - RNA, 19 nt, Homo sapiens
gcaccaaacaacauguaau

SEQ ID NO: 621634 - RNA, 19 nt, Homo sapiens
aaacugagcaccaaacaac

SEQ ID NO: 621635 - RNA, 19 nt, Homo sapiens
aagaagauaagccaagaaa

SEQ ID NO: 621636 - RNA, 19 nt, Homo sapiens
aaucaaaugcaucaucuga

SEQ ID NO: 621637 - RNA, 19 nt, Homo sapiens
ggaccaaaggauauauuuc

SEQ ID NO: 621638 - RNA, 19 nt, Homo sapiens
caaacuacccauuuucuuu

SEQ ID NO: 621639 - RNA, 19 nt, Homo sapiens
cgaagauggugguuguaca

SEQ ID NO: 621640 - RNA, 19 nt, Homo sapiens
cuaaauugaggacuucauu

SEQ ID NO: 621641 - RNA, 19 nt, Homo sapiens
aaaggaagauaccgaccau

SEQ ID NO: 621642 - RNA, 19 nt, Homo sapiens
agaaugaaacuguaaccaa

SEQ ID NO: 621643 - RNA, 19 nt, Homo sapiens
gagagauuaaacaguagua

SEQ ID NO: 621644 - RNA, 19 nt, Homo sapiens
ggaaaaguauggcaaacca

SEQ ID NO: 621645 - RNA, 19 nt, Homo sapiens
ggaaacugagcaccaaaca

SEQ ID NO: 621646 - RNA, 19 nt, Homo sapiens
aaaagugaguccuaaaaga

SEQ ID NO: 621647 - RNA, 19 nt, Homo sapiens
aaguauggcaaaccaaaua

SEQ ID NO: 621648 - RNA, 19 nt, Homo sapiens
cgaaacaugacucgcgauu

SEQ ID NO: 621649 - RNA, 19 nt, Homo sapiens
auacuaaggucggccauca

SEQ ID NO: 621650 - RNA, 19 nt, Homo sapiens
gggcccuucucuugacauu

SEQ ID NO: 621651 - RNA, 19 nt, Homo sapiens
ugaagaagaaggagaugau

SEQ ID NO: 621652 - RNA, 19 nt, Homo sapiens
gaagaggacaaaaguaaga

SEQ ID NO: 621653 - RNA, 19 nt, Homo sapiens
uuaaacaguaguagacuug

SEQ ID NO: 621654 - RNA, 19 nt, Homo sapiens
ugacauuccuuuuguuguu

SEQ ID NO: 621655 - RNA, 19 nt, Homo sapiens
gagaauacaaguggagcaa

SEQ ID NO: 621656 - RNA, 19 nt, Homo sapiens
ugaaaggccaacaugagaa

SEQ ID NO: 621657 - RNA, 19 nt, Homo sapiens
ucaagaaggugaaaagaag

SEQ ID NO: 621658 - RNA, 19 nt, Homo sapiens
gaagaagaaggagaugauc

SEQ ID NO: 621659 - RNA, 19 nt, Homo sapiens
ggagggaccuugccaggau

SEQ ID NO: 621660 - RNA, 19 nt, Homo sapiens
gcagugaccgcuuugauga

SEQ ID NO: 621661 - RNA, 19 nt, Homo sapiens
ccaaaucugucucccuuca

SEQ ID NO: 621662 - RNA, 19 nt, Homo sapiens
gagccugggugcugucuuc

SEQ ID NO: 621663 - RNA, 19 nt, Homo sapiens
ggacucugcucuucaccau

SEQ ID NO: 621664 - RNA, 19 nt, Homo sapiens
ucaacucccugccgcugua

SEQ ID NO: 621665 - RNA, 19 nt, Homo sapiens
ccgaggagcuccagcaucu

SEQ ID NO: 621666 - RNA, 19 nt, Homo sapiens
ggagaggucgcuuugugaa

SEQ ID NO: 621667 - RNA, 19 nt, Homo sapiens
gaacagcacccugcaucug

SEQ ID NO: 621668 - RNA, 19 nt, Homo sapiens
gggagcagccucaguguca

SEQ ID NO: 621669 - RNA, 19 nt, Homo sapiens
ccaacacgguggccucugu

SEQ ID NO: 621670 - RNA, 19 nt, Homo sapiens
agaggucgcuuugugaaga

SEQ ID NO: 621671 - RNA, 19 nt, Homo sapiens
gcaccucacgcuaaucuuc

SEQ ID NO: 621672 - RNA, 19 nt, Homo sapiens
gugcggguguucccuguga

SEQ ID NO: 621673 - RNA, 19 nt, Homo sapiens
gaggucgcuuugugaagaa

SEQ ID NO: 621674 - RNA, 19 nt, Homo sapiens
aaaucugucucccuucaug

SEQ ID NO: 621675 - RNA, 19 nt, Homo sapiens
caucgggacucugcucuuc

SEQ ID NO: 621676 - RNA, 19 nt, Homo sapiens
ugacccagccguaccuauu

SEQ ID NO: 621677 - RNA, 19 nt, Homo sapiens
ggacuccuguuccuaugac

SEQ ID NO: 621678 - RNA, 19 nt, Homo sapiens
guacacggaaggcggagaa

SEQ ID NO: 621679 - RNA, 19 nt, Homo sapiens
cuggagaggucgcuuugug

SEQ ID NO: 621680 - RNA, 19 nt, Homo sapiens
gagcaccucacgcuaaucu

SEQ ID NO: 621681 - RNA, 19 nt, Homo sapiens
guccugcacuuucccuuca

SEQ ID NO: 621682 - RNA, 19 nt, Homo sapiens
cugcccagcugaugaggaa

SEQ ID NO: 621683 - RNA, 19 nt, Homo sapiens
ggagcagccucagugucaa

SEQ ID NO: 621684 - RNA, 19 nt, Homo sapiens
gucagugccugccgagugu

SEQ ID NO: 621685 - RNA, 19 nt, Homo sapiens
ucccuccucucggacauua

SEQ ID NO: 621686 - RNA, 19 nt, Homo sapiens
ggucaugcucaucuucuau

SEQ ID NO: 621687 - RNA, 19 nt, Homo sapiens
uaaacccacugcccuacag

SEQ ID NO: 621688 - RNA, 19 nt, Homo sapiens
uggagcaccucacgcuaau

SEQ ID NO: 621689 - RNA, 19 nt, Homo sapiens
gagagaggcggcacguucu

SEQ ID NO: 621690 - RNA, 19 nt, Homo sapiens
gacccagccguaccuauuc

SEQ ID NO: 621691 - RNA, 19 nt, Homo sapiens
gaacccugcccagcugaug

SEQ ID NO: 621692 - RNA, 19 nt, Homo sapiens
acgcuaaucuucaguacac

SEQ ID NO: 621693 - RNA, 19 nt, Homo sapiens
ggguuuauuugcggauguu

SEQ ID NO: 621694 - RNA, 19 nt, Homo sapiens
gcugcugugugcuccugaa

SEQ ID NO: 621695 - RNA, 19 nt, Homo sapiens
guggacuccuguuccuaug

SEQ ID NO: 621696 - RNA, 19 nt, Homo sapiens
cuggagcaccucacgcuaa

SEQ ID NO: 621697 - RNA, 19 nt, Homo sapiens
ucacgcuaaucuucaguac

SEQ ID NO: 621698 - RNA, 19 nt, Homo sapiens
gagccucgggacccauuug

SEQ ID NO: 621699 - RNA, 19 nt, Homo sapiens
ggagggaccuugccaggau

SEQ ID NO: 621700 - RNA, 19 nt, Homo sapiens
gcagugaccgcuuugauga

SEQ ID NO: 621701 - RNA, 19 nt, Homo sapiens
ccaaaucugucucccuuca

SEQ ID NO: 621702 - RNA, 19 nt, Homo sapiens
ccuacaggcuggcggauaa

SEQ ID NO: 621703 - RNA, 19 nt, Homo sapiens
gagccugggugcugucuuc

SEQ ID NO: 621704 - RNA, 19 nt, Homo sapiens
ggacucugcucuucaccau

SEQ ID NO: 621705 - RNA, 19 nt, Homo sapiens
ucaacucccugccgcugua

SEQ ID NO: 621706 - RNA, 19 nt, Homo sapiens
ccgaggagcuccagcaucu

SEQ ID NO: 621707 - RNA, 19 nt, Homo sapiens
ggagaggucgcuuugugaa

SEQ ID NO: 621708 - RNA, 19 nt, Homo sapiens
gaacagcacccugcaucug

SEQ ID NO: 621709 - RNA, 19 nt, Homo sapiens
gggagcagccucaguguca

SEQ ID NO: 621710 - RNA, 19 nt, Homo sapiens
ccaacacgguggccucugu

SEQ ID NO: 621711 - RNA, 19 nt, Homo sapiens
agaggucgcuuugugaaga

SEQ ID NO: 621712 - RNA, 19 nt, Homo sapiens
gcaccucacgcuaaucuuc

SEQ ID NO: 621713 - RNA, 19 nt, Homo sapiens
gugcggguguucccuguga

SEQ ID NO: 621714 - RNA, 19 nt, Homo sapiens
gaggucgcuuugugaagaa

SEQ ID NO: 621715 - RNA, 19 nt, Homo sapiens
aaaucugucucccuucaug

SEQ ID NO: 621716 - RNA, 19 nt, Homo sapiens
caucgggacucugcucuuc

SEQ ID NO: 621717 - RNA, 19 nt, Homo sapiens
ugacccagccguaccuauu

SEQ ID NO: 621718 - RNA, 19 nt, Homo sapiens
ggacuccuguuccuaugac

SEQ ID NO: 621719 - RNA, 19 nt, Homo sapiens
guacacggaaggcggagaa

SEQ ID NO: 621720 - RNA, 19 nt, Homo sapiens
cuggagaggucgcuuugug

SEQ ID NO: 621721 - RNA, 19 nt, Homo sapiens
gagcaccucacgcuaaucu

SEQ ID NO: 621722 - RNA, 19 nt, Homo sapiens
guccugcacuuucccuuca

SEQ ID NO: 621723 - RNA, 19 nt, Homo sapiens
cugcccagcugaugaggaa

SEQ ID NO: 621724 - RNA, 19 nt, Homo sapiens
ggagcagccucagugucaa

SEQ ID NO: 621725 - RNA, 19 nt, Homo sapiens
gucagugccugccgagugu

SEQ ID NO: 621726 - RNA, 19 nt, Homo sapiens
ggucaugcucaucuucuau

SEQ ID NO: 621727 - RNA, 19 nt, Homo sapiens
ucccuccucucggacauua

SEQ ID NO: 621728 - RNA, 19 nt, Homo sapiens
uaaacccacugcccuacag

SEQ ID NO: 621729 - RNA, 19 nt, Homo sapiens
uggagcaccucacgcuaau

SEQ ID NO: 621730 - RNA, 19 nt, Homo sapiens
gagagaggcggcacguucu

SEQ ID NO: 621731 - RNA, 19 nt, Homo sapiens
gacccagccguaccuauuc

SEQ ID NO: 621732 - RNA, 19 nt, Homo sapiens
gaacccugcccagcugaug

SEQ ID NO: 621733 - RNA, 19 nt, Homo sapiens
acgcuaaucuucaguacac

SEQ ID NO: 621734 - RNA, 19 nt, Homo sapiens
ggguuuauuugcggauguu

SEQ ID NO: 621735 - RNA, 19 nt, Homo sapiens
gcugcugugugcuccugaa

SEQ ID NO: 621736 - RNA, 19 nt, Homo sapiens
guggacuccuguuccuaug

SEQ ID NO: 621737 - RNA, 19 nt, Homo sapiens
cuggagcaccucacgcuaa

SEQ ID NO: 621738 - RNA, 19 nt, Homo sapiens
ucacgcuaaucuucaguac

SEQ ID NO: 621739 - RNA, 19 nt, Homo sapiens
gagccucgggacccauuug

SEQ ID NO: 621740 - RNA, 19 nt, Homo sapiens
aaauaaagcucccuccuua

SEQ ID NO: 621741 - RNA, 19 nt, Homo sapiens
ggagauggaccaagaguuu

SEQ ID NO: 621742 - RNA, 19 nt, Homo sapiens
gcucuauccuguccaagua

SEQ ID NO: 621743 - RNA, 19 nt, Homo sapiens
gagaggagcugcgggagaa

SEQ ID NO: 621744 - RNA, 19 nt, Homo sapiens
ggaagaagaagccugacua

SEQ ID NO: 621745 - RNA, 19 nt, Homo sapiens
ggagaaggacggcuacaaa

SEQ ID NO: 621746 - RNA, 19 nt, Homo sapiens
agaaggaccuggcagagaa

SEQ ID NO: 621747 - RNA, 19 nt, Homo sapiens
gaggagauggugaccuuua

SEQ ID NO: 621748 - RNA, 19 nt, Homo sapiens
gcgagaaggugguggagau

SEQ ID NO: 621749 - RNA, 19 nt, Homo sapiens
gaagauaaagacccuagga

SEQ ID NO: 621750 - RNA, 19 nt, Homo sapiens
gccucaaccuucauauuaa

SEQ ID NO: 621751 - RNA, 19 nt, Homo sapiens
uaaagcucccuccuuauuu

SEQ ID NO: 621752 - RNA, 19 nt, Homo sapiens
ccucaaccuucauauuaaa

SEQ ID NO: 621753 - RNA, 19 nt, Homo sapiens
gcuacaaacccgacguuaa

SEQ ID NO: 621754 - RNA, 19 nt, Homo sapiens
ggagaaggagguaguagug

SEQ ID NO: 621755 - RNA, 19 nt, Homo sapiens
ugccucaaccuucauauua

SEQ ID NO: 621756 - RNA, 19 nt, Homo sapiens
ggcaagggcucaggcaaga

SEQ ID NO: 621757 - RNA, 19 nt, Homo sapiens
caggcaagaugaagacaga

SEQ ID NO: 621758 - RNA, 19 nt, Homo sapiens
agaagcagcagcaggauuu

SEQ ID NO: 621759 - RNA, 19 nt, Homo sapiens
uggaggagauggaccaaga

SEQ ID NO: 621760 - RNA, 19 nt, Homo sapiens
uaaauaaagcucccuccuu

SEQ ID NO: 621761 - RNA, 19 nt, Homo sapiens
ggccaucgaugacaaguac

SEQ ID NO: 621762 - RNA, 19 nt, Homo sapiens
gaaggagaaggagguagua

SEQ ID NO: 621763 - RNA, 19 nt, Homo sapiens
gaagagggccaaguuacug

SEQ ID NO: 621764 - RNA, 19 nt, Homo sapiens
aggaggagcucauggacuu

SEQ ID NO: 621765 - RNA, 19 nt, Homo sapiens
ccaaguuacuggaggagau

SEQ ID NO: 621766 - RNA, 19 nt, Homo sapiens
uuaaugccaucaagaagga

SEQ ID NO: 621767 - RNA, 19 nt, Homo sapiens
ggcgaugccuccucacuca

SEQ ID NO: 621768 - RNA, 19 nt, Homo sapiens
cuacaaacccgacguuaag

SEQ ID NO: 621769 - RNA, 19 nt, Homo sapiens
cuaacaaacuccgggcaaa

SEQ ID NO: 621770 - RNA, 19 nt, Homo sapiens
cgaacaccaucaccaagug

SEQ ID NO: 621771 - RNA, 19 nt, Homo sapiens
ggagauggugaccuuuaaa

SEQ ID NO: 621772 - RNA, 19 nt, Homo sapiens
ugguggagauugugaagaa

SEQ ID NO: 621773 - RNA, 19 nt, Homo sapiens
gaagaagaagccugacuac

SEQ ID NO: 621774 - RNA, 19 nt, Homo sapiens
acgugaaccugguggauaa

SEQ ID NO: 621775 - RNA, 19 nt, Homo sapiens
gagaaggaccuggcagaga

SEQ ID NO: 621776 - RNA, 19 nt, Homo sapiens
gagaagagggccaaguuac

SEQ ID NO: 621777 - RNA, 19 nt, Homo sapiens
cagagaagagggccaaguu

SEQ ID NO: 621778 - RNA, 19 nt, Homo sapiens
ggagguuaaugccaucaag

SEQ ID NO: 621779 - RNA, 19 nt, Homo sapiens
agagaagagggccaaguua

SEQ ID NO: 621780 - RNA, 19 nt, Homo sapiens
ucacacaggacuucaagga

SEQ ID NO: 621781 - RNA, 19 nt, Homo sapiens
gggagacaaugauucuuac

SEQ ID NO: 621782 - RNA, 19 nt, Homo sapiens
cacaggacuucaaggagaa

SEQ ID NO: 621783 - RNA, 19 nt, Homo sapiens
uguacugcaucgaggauaa

SEQ ID NO: 621784 - RNA, 19 nt, Homo sapiens
aggagauggugaccuuuaa

SEQ ID NO: 621785 - RNA, 19 nt, Homo sapiens
caaugauucuuacccucaa

SEQ ID NO: 621786 - RNA, 19 nt, Homo sapiens
gagaagcagcagcaggauu

SEQ ID NO: 621787 - RNA, 19 nt, Homo sapiens
gcuccugugucagaacaaa

SEQ ID NO: 621788 - RNA, 19 nt, Homo sapiens
gaggaaccgaucgugaaua

SEQ ID NO: 621789 - RNA, 19 nt, Homo sapiens
agaaggugguggagauugu

SEQ ID NO: 621790 - RNA, 19 nt, Homo sapiens
cugaggagauggugaccuu

SEQ ID NO: 621791 - RNA, 19 nt, Homo sapiens
aggaaccgaucgugaauag

SEQ ID NO: 621792 - RNA, 19 nt, Homo sapiens
cgaggagacuaacaaacuc

SEQ ID NO: 621793 - RNA, 19 nt, Homo sapiens
uaagaucgaauacguggau

SEQ ID NO: 621794 - RNA, 19 nt, Homo sapiens
gcgagacaguggcgagaag

SEQ ID NO: 621795 - RNA, 19 nt, Homo sapiens
gcaucgaggagacuaacaa

SEQ ID NO: 621796 - RNA, 19 nt, Homo sapiens
caagggcucaggcaagaug

SEQ ID NO: 621797 - RNA, 19 nt, Homo sapiens
gagaaggacggcuacaaac

SEQ ID NO: 621798 - RNA, 19 nt, Homo sapiens
caagaaggagaaggaggua

SEQ ID NO: 621799 - RNA, 19 nt, Homo sapiens
auaaggagcgggcagagaa

SEQ ID NO: 621800 - RNA, 19 nt, Homo sapiens
gaacgugaaccugguggau

SEQ ID NO: 621801 - RNA, 19 nt, Homo sapiens
aaagcucccuccuuauuuu

SEQ ID NO: 621802 - RNA, 19 nt, Homo sapiens
ggaauaccgaggcuucaca

SEQ ID NO: 621803 - RNA, 19 nt, Homo sapiens
gagaaggugguggagauug

SEQ ID NO: 621804 - RNA, 19 nt, Homo sapiens
caaaagcuggggaagauaa

SEQ ID NO: 621805 - RNA, 19 nt, Homo sapiens
ggggagacaaugauucuua

SEQ ID NO: 621806 - RNA, 19 nt, Homo sapiens
gcgaacaccaucaccaagu

SEQ ID NO: 621807 - RNA, 19 nt, Homo sapiens
gauaaggagcgggcagaga

SEQ ID NO: 621808 - RNA, 19 nt, Homo sapiens
gagguuaaugccaucaaga

SEQ ID NO: 621809 - RNA, 19 nt, Homo sapiens
gaggcgcuccugaagaaga

SEQ ID NO: 621810 - RNA, 19 nt, Homo sapiens
caacgguggcuccgaaucu

SEQ ID NO: 621811 - RNA, 19 nt, Homo sapiens
caaguaugacgaagagcuu

SEQ ID NO: 621812 - RNA, 19 nt, Homo sapiens
guccaaguaugacgaagag

SEQ ID NO: 621813 - RNA, 19 nt, Homo sapiens
gaaccuggacgaggagaag

SEQ ID NO: 621814 - RNA, 19 nt, Homo sapiens
caacgccacguccgaguuc

SEQ ID NO: 621815 - RNA, 19 nt, Homo sapiens
ccaagcggagggugaagaa

SEQ ID NO: 621816 - RNA, 19 nt, Homo sapiens
gagauggaccaagaguuug

SEQ ID NO: 621817 - RNA, 19 nt, Homo sapiens
ugaagaaaauccgcaagaa

SEQ ID NO: 621818 - RNA, 19 nt, Homo sapiens
agaagaagccugacuaccu

SEQ ID NO: 621819 - RNA, 19 nt, Homo sapiens
caucgaggagacuaacaaa

SEQ ID NO: 621820 - RNA, 19 nt, Homo sapiens
ggcccugccucaaccuuca

SEQ ID NO: 621821 - RNA, 19 nt, Homo sapiens
caaacccgacguuaagauc

SEQ ID NO: 621822 - RNA, 19 nt, Homo sapiens
gcccugcuccugugucaga

SEQ ID NO: 621823 - RNA, 19 nt, Homo sapiens
gaggagcucauggacuuug

SEQ ID NO: 621824 - RNA, 19 nt, Homo sapiens
ugaaccugguggauaagga

SEQ ID NO: 621825 - RNA, 19 nt, Homo sapiens
ggaaacucacacccaagga

SEQ ID NO: 621826 - RNA, 19 nt, Homo sapiens
uaaggagcgggcagagaaa

SEQ ID NO: 621827 - RNA, 19 nt, Homo sapiens
aagcagaaggcucagaaga

SEQ ID NO: 621828 - RNA, 19 nt, Homo sapiens
agaagcagaaggcucagaa

SEQ ID NO: 621829 - RNA, 19 nt, Homo sapiens
cgaggaaccgaucgugaau

SEQ ID NO: 621830 - RNA, 19 nt, Homo sapiens
ggagaacauggacaucagu

SEQ ID NO: 621831 - RNA, 19 nt, Homo sapiens
gcaugaacgcgaacaccau

SEQ ID NO: 621832 - RNA, 19 nt, Homo sapiens
gaagaaaauccgcaagaag

SEQ ID NO: 621833 - RNA, 19 nt, Homo sapiens
ucacacccaaggaggcuuu

SEQ ID NO: 621834 - RNA, 19 nt, Homo sapiens
uaacaaacuccgggcaaag

SEQ ID NO: 621835 - RNA, 19 nt, Homo sapiens
ccucagccguguacugcau

SEQ ID NO: 621836 - RNA, 19 nt, Homo sapiens
agaagcgccugcugaacca

SEQ ID NO: 621837 - RNA, 19 nt, Homo sapiens
gcagagaagagggccaagu

SEQ ID NO: 621838 - RNA, 19 nt, Homo sapiens
aggaggacgugcuggugaa

SEQ ID NO: 621839 - RNA, 19 nt, Homo sapiens
ccguggagcaugccauuga

SEQ ID NO: 621840 - RNA, 19 nt, Homo sapiens
cagcugcucugcucaguua

SEQ ID NO: 621841 - RNA, 19 nt, Homo sapiens
gaggagagguuagaucuug

SEQ ID NO: 621842 - RNA, 19 nt, Homo sapiens
gaagaucuuuggcgaguuc

SEQ ID NO: 621843 - RNA, 19 nt, Homo sapiens
gcuuacagcuuagaaauga

SEQ ID NO: 621844 - RNA, 19 nt, Homo sapiens
gcagaagccuaugagguuu

SEQ ID NO: 621845 - RNA, 19 nt, Homo sapiens
ggauuccuuuccaaacuua

SEQ ID NO: 621846 - RNA, 19 nt, Homo sapiens
ccgaggagcuguucaggaa

SEQ ID NO: 621847 - RNA, 19 nt, Homo sapiens
gugaugaggugaagaggaa

SEQ ID NO: 621848 - RNA, 19 nt, Homo sapiens
ggaauugaauauuguggau

SEQ ID NO: 621849 - RNA, 19 nt, Homo sapiens
gaggagcuguucaggaaga

SEQ ID NO: 621850 - RNA, 19 nt, Homo sapiens
agaaagagaucaagaaagc

SEQ ID NO: 621851 - RNA, 19 nt, Homo sapiens
gaaaugccagccagaaaga

SEQ ID NO: 621852 - RNA, 19 nt, Homo sapiens
uuagacagguuaaugaaga

SEQ ID NO: 621853 - RNA, 19 nt, Homo sapiens
caagaaagccuauuaucag

SEQ ID NO: 621854 - RNA, 19 nt, Homo sapiens
gaaaauguuuaccucauga

SEQ ID NO: 621855 - RNA, 19 nt, Homo sapiens
guggauaucuuaguuaaag

SEQ ID NO: 621856 - RNA, 19 nt, Homo sapiens
ucaagaaagccuauuauca

SEQ ID NO: 621857 - RNA, 19 nt, Homo sapiens
guucucauccucuucauuu

SEQ ID NO: 621858 - RNA, 19 nt, Homo sapiens
ggccaaagaagauuauuau

SEQ ID NO: 621859 - RNA, 19 nt, Homo sapiens
gaucaagaaagccuauuau

SEQ ID NO: 621860 - RNA, 19 nt, Homo sapiens
ggaaagcacaggcuaagca

SEQ ID NO: 621861 - RNA, 19 nt, Homo sapiens
gugauuaauuuccuucuca

SEQ ID NO: 621862 - RNA, 19 nt, Homo sapiens
ggcagaagccuaugagguu

SEQ ID NO: 621863 - RNA, 19 nt, Homo sapiens
ccagaaagagaucaagaaa

SEQ ID NO: 621864 - RNA, 19 nt, Homo sapiens
caaguuacgaagugauuaa

SEQ ID NO: 621865 - RNA, 19 nt, Homo sapiens
cgucuucccugaccucuug

SEQ ID NO: 621866 - RNA, 19 nt, Homo sapiens
gcaguuuccuguccauugg

SEQ ID NO: 621867 - RNA, 19 nt, Homo sapiens
ggacucagacagaccagaa

SEQ ID NO: 621868 - RNA, 19 nt, Homo sapiens
cuacauccacaucaagaua

SEQ ID NO: 621869 - RNA, 19 nt, Homo sapiens
gggauuccuuuccaaacuu

SEQ ID NO: 621870 - RNA, 19 nt, Homo sapiens
ggagggauuccuuuccaaa

SEQ ID NO: 621871 - RNA, 19 nt, Homo sapiens
cgaccucuuuauuucuaua

SEQ ID NO: 621872 - RNA, 19 nt, Homo sapiens
gccuuaagcugcaucaagu

SEQ ID NO: 621873 - RNA, 19 nt, Homo sapiens
cccgagcgcugcugacauu

SEQ ID NO: 621874 - RNA, 19 nt, Homo sapiens
gaucuucgggcugucguua

SEQ ID NO: 621875 - RNA, 19 nt, Homo sapiens
ggugucagccuuacaggaa

SEQ ID NO: 621876 - RNA, 19 nt, Homo sapiens
gguagcaugucgcaguuuc

SEQ ID NO: 621877 - RNA, 19 nt, Homo sapiens
gugaugcguuccacgugua

SEQ ID NO: 621878 - RNA, 19 nt, Homo sapiens
acaccucucuccacggaaa

SEQ ID NO: 621879 - RNA, 19 nt, Homo sapiens
ccaaagccaaggagaaguu

SEQ ID NO: 621880 - RNA, 19 nt, Homo sapiens
guaucacccugacacaaau

SEQ ID NO: 621881 - RNA, 19 nt, Homo sapiens
aggccaugcuuacagcuua

SEQ ID NO: 621882 - RNA, 19 nt, Homo sapiens
ccacuccgaccucuuuauu

SEQ ID NO: 621883 - RNA, 19 nt, Homo sapiens
uugaucagccucaggaaua

SEQ ID NO: 621884 - RNA, 19 nt, Homo sapiens
gggcuugguucucccacuu

SEQ ID NO: 621885 - RNA, 19 nt, Homo sapiens
gccugucccugacuauuga

SEQ ID NO: 621886 - RNA, 19 nt, Homo sapiens
uaauuuccuucucagcaaa

SEQ ID NO: 621887 - RNA, 19 nt, Homo sapiens
uuaauuuccuucucagcaa

SEQ ID NO: 621888 - RNA, 19 nt, Homo sapiens
gcaucaaguuacgaaguga

SEQ ID NO: 621889 - RNA, 19 nt, Homo sapiens
aggaauacuucauggaguu

SEQ ID NO: 621890 - RNA, 19 nt, Homo sapiens
cgaagugauuaauuuccuu

SEQ ID NO: 621891 - RNA, 19 nt, Homo sapiens
caagauacgaguuccaaag

SEQ ID NO: 621892 - RNA, 19 nt, Homo sapiens
ccgggagguuccagaauga

SEQ ID NO: 621893 - RNA, 19 nt, Homo sapiens
acuccgaccucuuuauuuc

SEQ ID NO: 621894 - RNA, 19 nt, Homo sapiens
cauccacuccgaccucuuu

SEQ ID NO: 621895 - RNA, 19 nt, Homo sapiens
ccuaugagguuuugaguga

SEQ ID NO: 621896 - RNA, 19 nt, Homo sapiens
gcugguugcuggugguugu

SEQ ID NO: 621897 - RNA, 19 nt, Homo sapiens
gagcgcugcugacauugag

SEQ ID NO: 621898 - RNA, 19 nt, Homo sapiens
uuacacuguugacaucuau

SEQ ID NO: 621899 - RNA, 19 nt, Homo sapiens
cuuaagcugcaucaaguua

SEQ ID NO: 621900 - RNA, 19 nt, Homo sapiens
ggaagaucuuuggcgaguu

SEQ ID NO: 621901 - RNA, 19 nt, Homo sapiens
uagacagguuaaugaagaa

SEQ ID NO: 621902 - RNA, 19 nt, Homo sapiens
gcaguuuccauguguuuca

SEQ ID NO: 621903 - RNA, 19 nt, Homo sapiens
aaaggaaagcacaggcuaa

SEQ ID NO: 621904 - RNA, 19 nt, Homo sapiens
ucagugcuaaucauuguuu

SEQ ID NO: 621905 - RNA, 19 nt, Homo sapiens
agaucaagaaagccuauua

SEQ ID NO: 621906 - RNA, 19 nt, Homo sapiens
cuacggagaccacuacauc

SEQ ID NO: 621907 - RNA, 19 nt, Homo sapiens
gccagaaagagaucaagaa

SEQ ID NO: 621908 - RNA, 19 nt, Homo sapiens
ggagguuccagaaugaguu

SEQ ID NO: 621909 - RNA, 19 nt, Homo sapiens
ucagacagaccagaagauu

SEQ ID NO: 621910 - RNA, 19 nt, Homo sapiens
cgaaaugccagccagaaag

SEQ ID NO: 621911 - RNA, 19 nt, Homo sapiens
ccucuucauuuggagauuu

SEQ ID NO: 621912 - RNA, 19 nt, Homo sapiens
ccacuuacacuguugacau

SEQ ID NO: 621913 - RNA, 19 nt, Homo sapiens
cugaagcccugccacuguu

SEQ ID NO: 621914 - RNA, 19 nt, Homo sapiens
gcagaggagagguuagauc

SEQ ID NO: 621915 - RNA, 19 nt, Homo sapiens
uauuaggagugccucgaaa

SEQ ID NO: 621916 - RNA, 19 nt, Homo sapiens
gaaguaucacccugacaca

SEQ ID NO: 621917 - RNA, 19 nt, Homo sapiens
gaggaugccugugggaaaa

SEQ ID NO: 621918 - RNA, 19 nt, Homo sapiens
uggccaaagaagauuauua

SEQ ID NO: 621919 - RNA, 19 nt, Homo sapiens
aagcacaggcuaagcaguu

SEQ ID NO: 621920 - RNA, 19 nt, Homo sapiens
acacuguugacaucuauuu

SEQ ID NO: 621921 - RNA, 19 nt, Homo sapiens
ugacacaaauaaggaugau

SEQ ID NO: 621922 - RNA, 19 nt, Homo sapiens
uccgaccucuuuauuucua

SEQ ID NO: 621923 - RNA, 19 nt, Homo sapiens
gcacaggcuaagcaguuga

SEQ ID NO: 621924 - RNA, 19 nt, Homo sapiens
guugacaucuauuuucuga

SEQ ID NO: 621925 - RNA, 19 nt, Homo sapiens
acuauugaguccuguuguu

SEQ ID NO: 621926 - RNA, 19 nt, Homo sapiens
ucaaguuacgaagugauua

SEQ ID NO: 621927 - RNA, 19 nt, Homo sapiens
ccacaucaagauacgaguu

SEQ ID NO: 621928 - RNA, 19 nt, Homo sapiens
auugaguccuguuguugua

SEQ ID NO: 621929 - RNA, 19 nt, Homo sapiens
gcagaaaagcccuguguuc

SEQ ID NO: 621930 - RNA, 19 nt, Homo sapiens
ggacaagccaagcagaaaa

SEQ ID NO: 621931 - RNA, 19 nt, Homo sapiens
ggaauacuucauggaguug

SEQ ID NO: 621932 - RNA, 19 nt, Homo sapiens
ugucgcaguuuccaugugu

SEQ ID NO: 621933 - RNA, 19 nt, Homo sapiens
gaaugaguucuuccugaca

SEQ ID NO: 621934 - RNA, 19 nt, Homo sapiens
uaguuaaaggccaugcuua

SEQ ID NO: 621935 - RNA, 19 nt, Homo sapiens
cagcagaggagagguuaga

SEQ ID NO: 621936 - RNA, 19 nt, Homo sapiens
auggauagcuccgcaggaa

SEQ ID NO: 621937 - RNA, 19 nt, Homo sapiens
aagauacgaguuccaaaga

SEQ ID NO: 621938 - RNA, 19 nt, Homo sapiens
ugaggaugccugugggaaa

SEQ ID NO: 621939 - RNA, 19 nt, Homo sapiens
gagcaggacaagccaagca

SEQ ID NO: 621940 - RNA, 19 nt, Homo sapiens
gcacuguccucuuugaaau

SEQ ID NO: 621941 - RNA, 19 nt, Homo sapiens
gaucgacuuugucagguuu

SEQ ID NO: 621942 - RNA, 19 nt, Homo sapiens
gcaaggccaugaaggugaa

SEQ ID NO: 621943 - RNA, 19 nt, Homo sapiens
gggcccaaguuucagaaua

SEQ ID NO: 621944 - RNA, 19 nt, Homo sapiens
gucaacaacuuccgcauga

SEQ ID NO: 621945 - RNA, 19 nt, Homo sapiens
gguaggagcuggaccaacu

SEQ ID NO: 621946 - RNA, 19 nt, Homo sapiens
ccaagacacugccuaaggu

SEQ ID NO: 621947 - RNA, 19 nt, Homo sapiens
ucagaacgguugcccauca

SEQ ID NO: 621948 - RNA, 19 nt, Homo sapiens
gagcuggaccaacuguaua

SEQ ID NO: 621949 - RNA, 19 nt, Homo sapiens
uaucaaggcugugacuaga

SEQ ID NO: 621950 - RNA, 19 nt, Homo sapiens
gcacaauaaagcagacuau

SEQ ID NO: 621951 - RNA, 19 nt, Homo sapiens
gaacaccugcgagcacauu

SEQ ID NO: 621952 - RNA, 19 nt, Homo sapiens
ggcccaaguuucagaauag

SEQ ID NO: 621953 - RNA, 19 nt, Homo sapiens
gcgagcacauuuacgacuu

SEQ ID NO: 621954 - RNA, 19 nt, Homo sapiens
gggagggacuggcugagau

SEQ ID NO: 621955 - RNA, 19 nt, Homo sapiens
ggagcuggaccaacuguau

SEQ ID NO: 621956 - RNA, 19 nt, Homo sapiens
gagauugcagcccauggua

SEQ ID NO: 621957 - RNA, 19 nt, Homo sapiens
ucaaggcugugacuagauc

SEQ ID NO: 621958 - RNA, 19 nt, Homo sapiens
ggcuggugaugcacaauaa

SEQ ID NO: 621959 - RNA, 19 nt, Homo sapiens
gaggagaauaucuacaaga

SEQ ID NO: 621960 - RNA, 19 nt, Homo sapiens
aagcuucgacuuccacuuu

SEQ ID NO: 621961 - RNA, 19 nt, Homo sapiens
cucaggcacuguccucuuu

SEQ ID NO: 621962 - RNA, 19 nt, Homo sapiens
ggagggacuggcugagauu

SEQ ID NO: 621963 - RNA, 19 nt, Homo sapiens
gcaaccagcuacucaaaag

SEQ ID NO: 621964 - RNA, 19 nt, Homo sapiens
caacaacuuccgcaugauc

SEQ ID NO: 621965 - RNA, 19 nt, Homo sapiens
gggccaagacacugccuaa

SEQ ID NO: 621966 - RNA, 19 nt, Homo sapiens
acaagccugucaacaacuu

SEQ ID NO: 621967 - RNA, 19 nt, Homo sapiens
gcuucuacuucguggauga

SEQ ID NO: 621968 - RNA, 19 nt, Homo sapiens
cagaacgguugcccaucaa

SEQ ID NO: 621969 - RNA, 19 nt, Homo sapiens
gaugauccgccacccguau

SEQ ID NO: 621970 - RNA, 19 nt, Homo sapiens
ggcacuguccucuuugaaa

SEQ ID NO: 621971 - RNA, 19 nt, Homo sapiens
caggcacuguccucuuuga

SEQ ID NO: 621972 - RNA, 19 nt, Homo sapiens
gaucgagaggcacuacuuc

SEQ ID NO: 621973 - RNA, 19 nt, Homo sapiens
ccacuaccuucaggccauu

SEQ ID NO: 621974 - RNA, 19 nt, Homo sapiens
ccaaguuucagaauagugu

SEQ ID NO: 621975 - RNA, 19 nt, Homo sapiens
gagucaauguugggaggaa

SEQ ID NO: 621976 - RNA, 19 nt, Homo sapiens
uuugucagguuuaagauuc

SEQ ID NO: 621977 - RNA, 19 nt, Homo sapiens
gacuuugucagguuuaaga

SEQ ID NO: 621978 - RNA, 19 nt, Homo sapiens
cgagcacauuuacgacuuc

SEQ ID NO: 621979 - RNA, 19 nt, Homo sapiens
gggacuggcugagauugca

SEQ ID NO: 621980 - RNA, 19 nt, Homo sapiens
ggucguagggaggcuguuu

SEQ ID NO: 621981 - RNA, 19 nt, Homo sapiens
acaccugcgagcacauuua

SEQ ID NO: 621982 - RNA, 19 nt, Homo sapiens
uggaccaacuguauauagu

SEQ ID NO: 621983 - RNA, 19 nt, Homo sapiens
ugaggagaauaucuacaag

SEQ ID NO: 621984 - RNA, 19 nt, Homo sapiens
gccaagacacugccuaagg

SEQ ID NO: 621985 - RNA, 19 nt, Homo sapiens
gguuuaagauucgggacau

SEQ ID NO: 621986 - RNA, 19 nt, Homo sapiens
ggacccugagucaauguug

SEQ ID NO: 621987 - RNA, 19 nt, Homo sapiens
aaagcagacuauuccuaca

SEQ ID NO: 621988 - RNA, 19 nt, Homo sapiens
auaaagcagacuauuccua

SEQ ID NO: 621989 - RNA, 19 nt, Homo sapiens
cugaggagaauaucuacaa

SEQ ID NO: 621990 - RNA, 19 nt, Homo sapiens
cggcuggugaugcacaaua

SEQ ID NO: 621991 - RNA, 19 nt, Homo sapiens
ccgcaaccagcuacucaaa

SEQ ID NO: 621992 - RNA, 19 nt, Homo sapiens
gcuggaccaacuguauaua

SEQ ID NO: 621993 - RNA, 19 nt, Homo sapiens
caggccauuuagaguugua

SEQ ID NO: 621994 - RNA, 19 nt, Homo sapiens
cuucaggccauuuagaguu

SEQ ID NO: 621995 - RNA, 19 nt, Homo sapiens
ggacuuccggacaacuuag

SEQ ID NO: 621996 - RNA, 19 nt, Homo sapiens
uucaggccauuuagaguug

SEQ ID NO: 621997 - RNA, 19 nt, Homo sapiens
gcccaaguuucagaauagu

SEQ ID NO: 621998 - RNA, 19 nt, Homo sapiens
gcacuguccucuuugaaau

SEQ ID NO: 621999 - RNA, 19 nt, Homo sapiens
gaucgacuuugucagguuu

SEQ ID NO: 622000 - RNA, 19 nt, Homo sapiens
gcaaggccaugaaggugaa

SEQ ID NO: 622001 - RNA, 19 nt, Homo sapiens
gggcccaaguuucagaaua

SEQ ID NO: 622002 - RNA, 19 nt, Homo sapiens
gaaagaggcuggggauauu

SEQ ID NO: 622003 - RNA, 19 nt, Homo sapiens
gucaacaacuuccgcauga

SEQ ID NO: 622004 - RNA, 19 nt, Homo sapiens
gguaggagcuggaccaacu

SEQ ID NO: 622005 - RNA, 19 nt, Homo sapiens
ccaagacacugccuaaggu

SEQ ID NO: 622006 - RNA, 19 nt, Homo sapiens
ucagaacgguugcccauca

SEQ ID NO: 622007 - RNA, 19 nt, Homo sapiens
gagcuggaccaacuguaua

SEQ ID NO: 622008 - RNA, 19 nt, Homo sapiens
cauaucauccguagagaaa

SEQ ID NO: 622009 - RNA, 19 nt, Homo sapiens
uaucaaggcugugacuaga

SEQ ID NO: 622010 - RNA, 19 nt, Homo sapiens
uaucauccguagagaaaga

SEQ ID NO: 622011 - RNA, 19 nt, Homo sapiens
gcacaauaaagcagacuau

SEQ ID NO: 622012 - RNA, 19 nt, Homo sapiens
gaacaccugcgagcacauu

SEQ ID NO: 622013 - RNA, 19 nt, Homo sapiens
ggcccaaguuucagaauag

SEQ ID NO: 622014 - RNA, 19 nt, Homo sapiens
gcgagcacauuuacgacuu

SEQ ID NO: 622015 - RNA, 19 nt, Homo sapiens
gggagggacuggcugagau

SEQ ID NO: 622016 - RNA, 19 nt, Homo sapiens
ggagcuggaccaacuguau

SEQ ID NO: 622017 - RNA, 19 nt, Homo sapiens
gacucaagcuccugaccuu

SEQ ID NO: 622018 - RNA, 19 nt, Homo sapiens
gagauugcagcccauggua

SEQ ID NO: 622019 - RNA, 19 nt, Homo sapiens
ucaaggcugugacuagauc

SEQ ID NO: 622020 - RNA, 19 nt, Homo sapiens
ggcuggugaugcacaauaa

SEQ ID NO: 622021 - RNA, 19 nt, Homo sapiens
gaggagaauaucuacaaga

SEQ ID NO: 622022 - RNA, 19 nt, Homo sapiens
ggagggagagggacuugug

SEQ ID NO: 622023 - RNA, 19 nt, Homo sapiens
aagcuucgacuuccacuuu

SEQ ID NO: 622024 - RNA, 19 nt, Homo sapiens
cucaggcacuguccucuuu

SEQ ID NO: 622025 - RNA, 19 nt, Homo sapiens
ggagggacuggcugagauu

SEQ ID NO: 622026 - RNA, 19 nt, Homo sapiens
gcaaccagcuacucaaaag

SEQ ID NO: 622027 - RNA, 19 nt, Homo sapiens
caacaacuuccgcaugauc

SEQ ID NO: 622028 - RNA, 19 nt, Homo sapiens
gggccaagacacugccuaa

SEQ ID NO: 622029 - RNA, 19 nt, Homo sapiens
ggauauuucaggcuguuug

SEQ ID NO: 622030 - RNA, 19 nt, Homo sapiens
acaagccugucaacaacuu

SEQ ID NO: 622031 - RNA, 19 nt, Homo sapiens
gcuucuacuucguggauga

SEQ ID NO: 622032 - RNA, 19 nt, Homo sapiens
cagaacgguugcccaucaa

SEQ ID NO: 622033 - RNA, 19 nt, Homo sapiens
gaugauccgccacccguau

SEQ ID NO: 622034 - RNA, 19 nt, Homo sapiens
ggcacuguccucuuugaaa

SEQ ID NO: 622035 - RNA, 19 nt, Homo sapiens
caggcacuguccucuuuga

SEQ ID NO: 622036 - RNA, 19 nt, Homo sapiens
gaucgagaggcacuacuuc

SEQ ID NO: 622037 - RNA, 19 nt, Homo sapiens
ccacuaccuucaggccauu

SEQ ID NO: 622038 - RNA, 19 nt, Homo sapiens
uuugucagguuuaagauuc

SEQ ID NO: 622039 - RNA, 19 nt, Homo sapiens
ccaaguuucagaauagugu

SEQ ID NO: 622040 - RNA, 19 nt, Homo sapiens
gagucaauguugggaggaa

SEQ ID NO: 622041 - RNA, 19 nt, Homo sapiens
cuguuuggcugucccugua

SEQ ID NO: 622042 - RNA, 19 nt, Homo sapiens
gacuuugucagguuuaaga

SEQ ID NO: 622043 - RNA, 19 nt, Homo sapiens
cgagcacauuuacgacuuc

SEQ ID NO: 622044 - RNA, 19 nt, Homo sapiens
gggacuggcugagauugca

SEQ ID NO: 622045 - RNA, 19 nt, Homo sapiens
ggucguagggaggcuguuu

SEQ ID NO: 622046 - RNA, 19 nt, Homo sapiens
acaccugcgagcacauuua

SEQ ID NO: 622047 - RNA, 19 nt, Homo sapiens
uggaccaacuguauauagu

SEQ ID NO: 622048 - RNA, 19 nt, Homo sapiens
ugaggagaauaucuacaag

SEQ ID NO: 622049 - RNA, 19 nt, Homo sapiens
gccaagacacugccuaagg

SEQ ID NO: 622050 - RNA, 19 nt, Homo sapiens
gguuuaagauucgggacau

SEQ ID NO: 622051 - RNA, 19 nt, Homo sapiens
ggacccugagucaauguug

SEQ ID NO: 622052 - RNA, 19 nt, Homo sapiens
aaagcagacuauuccuaca

SEQ ID NO: 622053 - RNA, 19 nt, Homo sapiens
auaaagcagacuauuccua

SEQ ID NO: 622054 - RNA, 19 nt, Homo sapiens
cggcuggugaugcacaaua

SEQ ID NO: 622055 - RNA, 19 nt, Homo sapiens
cugaggagaauaucuacaa

SEQ ID NO: 622056 - RNA, 19 nt, Homo sapiens
ccgcaaccagcuacucaaa

SEQ ID NO: 622057 - RNA, 19 nt, Homo sapiens
gcuggaccaacuguauaua

SEQ ID NO: 622058 - RNA, 19 nt, Homo sapiens
caggccauuuagaguugua

SEQ ID NO: 622059 - RNA, 19 nt, Homo sapiens
ccauaucauccguagagaa

SEQ ID NO: 622060 - RNA, 19 nt, Homo sapiens
cuucaggccauuuagaguu

SEQ ID NO: 622061 - RNA, 19 nt, Homo sapiens
ggacuuccggacaacuuag

SEQ ID NO: 622062 - RNA, 19 nt, Homo sapiens
uucaggccauuuagaguug

SEQ ID NO: 622063 - RNA, 19 nt, Homo sapiens
gcccaaguuucagaauagu

SEQ ID NO: 622064 - RNA, 19 nt, Homo sapiens
ggaaagaaaucaccuaaga

SEQ ID NO: 622065 - RNA, 19 nt, Homo sapiens
gugcaaagcuguuaaauga

SEQ ID NO: 622066 - RNA, 19 nt, Homo sapiens
auagaaagcucaagcaaua

SEQ ID NO: 622067 - RNA, 19 nt, Homo sapiens
gacagaaguuuguuaagua

SEQ ID NO: 622068 - RNA, 19 nt, Homo sapiens
ccauagagcucaccucauu

SEQ ID NO: 622069 - RNA, 19 nt, Homo sapiens
ucaaggaagucacuaauga

SEQ ID NO: 622070 - RNA, 19 nt, Homo sapiens
caacugaucuagugaguca

SEQ ID NO: 622071 - RNA, 19 nt, Homo sapiens
gcaauaaucugcaaguuuu

SEQ ID NO: 622072 - RNA, 19 nt, Homo sapiens
ggaagucacuaaugagaug

SEQ ID NO: 622073 - RNA, 19 nt, Homo sapiens
gaacauucauugcacuuuc

SEQ ID NO: 622074 - RNA, 19 nt, Homo sapiens
ggagguggguuauuacaga

SEQ ID NO: 622075 - RNA, 19 nt, Homo sapiens
ggugguagaucaaggcuuu

SEQ ID NO: 622076 - RNA, 19 nt, Homo sapiens
ucaauucuccucacuauaa

SEQ ID NO: 622077 - RNA, 19 nt, Homo sapiens
gaauuaugauuguggcauu

SEQ ID NO: 622078 - RNA, 19 nt, Homo sapiens
gguaacggcucucggcaaa

SEQ ID NO: 622079 - RNA, 19 nt, Homo sapiens
gaugcuaguuagaucauuu

SEQ ID NO: 622080 - RNA, 19 nt, Homo sapiens
gaucaaggcuuuguuucau

SEQ ID NO: 622081 - RNA, 19 nt, Homo sapiens
ucaaggcuuuguuucauuu

SEQ ID NO: 622082 - RNA, 19 nt, Homo sapiens
gagaccagcuugugcaaca

SEQ ID NO: 622083 - RNA, 19 nt, Homo sapiens
cagcaggaaacuccaauua

SEQ ID NO: 622084 - RNA, 19 nt, Homo sapiens
gaaacuccaauuaccagua

SEQ ID NO: 622085 - RNA, 19 nt, Homo sapiens
gggcucagguucacacuuc

SEQ ID NO: 622086 - RNA, 19 nt, Homo sapiens
gaaucucccuucccacuag

SEQ ID NO: 622087 - RNA, 19 nt, Homo sapiens
cagcuuaggucccucuguu

SEQ ID NO: 622088 - RNA, 19 nt, Homo sapiens
ccuauaaucucagcccuuu

SEQ ID NO: 622089 - RNA, 19 nt, Homo sapiens
uugcaucucuccaccauuu

SEQ ID NO: 622090 - RNA, 19 nt, Homo sapiens
gggcagauaauguugaauu

SEQ ID NO: 622091 - RNA, 19 nt, Homo sapiens
aaagaaaucaccuaagaga

SEQ ID NO: 622092 - RNA, 19 nt, Homo sapiens
ucaaugugguggagaguga

SEQ ID NO: 622093 - RNA, 19 nt, Homo sapiens
gagugugucucucccuauu

SEQ ID NO: 622094 - RNA, 19 nt, Homo sapiens
cggcaaaguucgagaagug

SEQ ID NO: 622095 - RNA, 19 nt, Homo sapiens
aaacuccaauuaccaguau

SEQ ID NO: 622096 - RNA, 19 nt, Homo sapiens
ccaauaaacauuugcugaa

SEQ ID NO: 622097 - RNA, 19 nt, Homo sapiens
aggcaucucuguucucuga

SEQ ID NO: 622098 - RNA, 19 nt, Homo sapiens
guagaucaaggcuuuguuu

SEQ ID NO: 622099 - RNA, 19 nt, Homo sapiens
gcucagaguuuaccuagcu

SEQ ID NO: 622100 - RNA, 19 nt, Homo sapiens
gcacuuucccaccucuaua

SEQ ID NO: 622101 - RNA, 19 nt, Homo sapiens
gcaggaaacuccaauuacc

SEQ ID NO: 622102 - RNA, 19 nt, Homo sapiens
gauaacggcucucaaaauc

SEQ ID NO: 622103 - RNA, 19 nt, Homo sapiens
ucacacuucugcuuugaga

SEQ ID NO: 622104 - RNA, 19 nt, Homo sapiens
ggccacugcuuccugcuuu

SEQ ID NO: 622105 - RNA, 19 nt, Homo sapiens
gcucagaaaccuucaaugg

SEQ ID NO: 622106 - RNA, 19 nt, Homo sapiens
uuaaaugagcucagaguuu

SEQ ID NO: 622107 - RNA, 19 nt, Homo sapiens
gguugaggcugcagugaau

SEQ ID NO: 622108 - RNA, 19 nt, Homo sapiens
ugugaagccuggaaaguau

SEQ ID NO: 622109 - RNA, 19 nt, Homo sapiens
cuaguuagaucauuugcau

SEQ ID NO: 622110 - RNA, 19 nt, Homo sapiens
ggagaggguucaguuugga

SEQ ID NO: 622111 - RNA, 19 nt, Homo sapiens
gauagaaagcucaagcaau

SEQ ID NO: 622112 - RNA, 19 nt, Homo sapiens
aagugaagcugaccaacaa

SEQ ID NO: 622113 - RNA, 19 nt, Homo sapiens
ccacagcugcgucuacauu

SEQ ID NO: 622114 - RNA, 19 nt, Homo sapiens
aacauuugcugaacugaaa

SEQ ID NO: 622115 - RNA, 19 nt, Homo sapiens
gaaagaaagaaagaaagga

SEQ ID NO: 622116 - RNA, 19 nt, Homo sapiens
ccaguggaaugaagucaau

SEQ ID NO: 622117 - RNA, 19 nt, Homo sapiens
ggaugaugcuaguuagauc

SEQ ID NO: 622118 - RNA, 19 nt, Homo sapiens
gagguggguuauuacagaa

SEQ ID NO: 622119 - RNA, 19 nt, Homo sapiens
gaaagaaaucaccuaagag

SEQ ID NO: 622120 - RNA, 19 nt, Homo sapiens
uaacggcucucggcaaagu

SEQ ID NO: 622121 - RNA, 19 nt, Homo sapiens
gaagucaauucuccucacu

SEQ ID NO: 622122 - RNA, 19 nt, Homo sapiens
gggagaggguucaguuugg

SEQ ID NO: 622123 - RNA, 19 nt, Homo sapiens
cuuccucacuggaugguua

SEQ ID NO: 622124 - RNA, 19 nt, Homo sapiens
gccagcaugugaccuauuc

SEQ ID NO: 622125 - RNA, 19 nt, Homo sapiens
gcaggcaucucuguucucu

SEQ ID NO: 622126 - RNA, 19 nt, Homo sapiens
aaauagucaugcacacaaa

SEQ ID NO: 622127 - RNA, 19 nt, Homo sapiens
gcuguuaaaugagcucaga

SEQ ID NO: 622128 - RNA, 19 nt, Homo sapiens
cugcguacaugcacagaaa

SEQ ID NO: 622129 - RNA, 19 nt, Homo sapiens
gcccagcgauggcacuguu

SEQ ID NO: 622130 - RNA, 19 nt, Homo sapiens
cagauaauguugaauucuc

SEQ ID NO: 622131 - RNA, 19 nt, Homo sapiens
gcgggcagauaauguugaa

SEQ ID NO: 622132 - RNA, 19 nt, Homo sapiens
gaaggugcaaagcuguuaa

SEQ ID NO: 622133 - RNA, 19 nt, Homo sapiens
ggcagauaauguugaauuc

SEQ ID NO: 622134 - RNA, 19 nt, Homo sapiens
caauaaacauuugcugaac

SEQ ID NO: 622135 - RNA, 19 nt, Homo sapiens
aggcugcagugaauuauga

SEQ ID NO: 622136 - RNA, 19 nt, Homo sapiens
agguggagguggguuauua

SEQ ID NO: 622137 - RNA, 19 nt, Homo sapiens
guugaauucucugcauaaa

SEQ ID NO: 622138 - RNA, 19 nt, Homo sapiens
gcaaagugaagcugaccaa

SEQ ID NO: 622139 - RNA, 19 nt, Homo sapiens
ugaaagcucccaucuccuu

SEQ ID NO: 622140 - RNA, 19 nt, Homo sapiens
cacaccaucuggccugaaa

SEQ ID NO: 622141 - RNA, 19 nt, Homo sapiens
guuuaagccuauaaucuca

SEQ ID NO: 622142 - RNA, 19 nt, Homo sapiens
agucaauucuccucacuau

SEQ ID NO: 622143 - RNA, 19 nt, Homo sapiens
gcccagacuuguggaaaug

SEQ ID NO: 622144 - RNA, 19 nt, Homo sapiens
ucucaaaucguucuggaaa

SEQ ID NO: 622145 - RNA, 19 nt, Homo sapiens
gguuauuacagaagucaua

SEQ ID NO: 622146 - RNA, 19 nt, Homo sapiens
uuucucaucugcucaaugu

SEQ ID NO: 622147 - RNA, 19 nt, Homo sapiens
gcagugaauuaugauugug

SEQ ID NO: 622148 - RNA, 19 nt, Homo sapiens
cagcgauccuuccaugugu

SEQ ID NO: 622149 - RNA, 19 nt, Homo sapiens
aaacccagcugugacuuca

SEQ ID NO: 622150 - RNA, 19 nt, Homo sapiens
gagaugauugugaccaaga

SEQ ID NO: 622151 - RNA, 19 nt, Homo sapiens
ccuguuggccuccuaugua

SEQ ID NO: 622152 - RNA, 19 nt, Homo sapiens
cagccugggugguagauca

SEQ ID NO: 622153 - RNA, 19 nt, Homo sapiens
ugacagcuggacuuccuua

SEQ ID NO: 622154 - RNA, 19 nt, Homo sapiens
caaggaaagaaaucaccua

SEQ ID NO: 622155 - RNA, 19 nt, Homo sapiens
gccuagccuucuugucuuu

SEQ ID NO: 622156 - RNA, 19 nt, Homo sapiens
ggccuagccuucuugucuu

SEQ ID NO: 622157 - RNA, 19 nt, Homo sapiens
ccagacuuguggaaaugaa

SEQ ID NO: 622158 - RNA, 19 nt, Homo sapiens
guucacacuucugcuuuga

SEQ ID NO: 622159 - RNA, 19 nt, Homo sapiens
gaaacccagcugugacuuc

SEQ ID NO: 622160 - RNA, 19 nt, Homo sapiens
ucugagagccagcauguga

SEQ ID NO: 622161 - RNA, 19 nt, Homo sapiens
uaacggcucucaaaaucaa

SEQ ID NO: 622162 - RNA, 19 nt, Homo sapiens
aaacugcuccuucccugaa

SEQ ID NO: 622163 - RNA, 19 nt, Homo sapiens
ugugguaguuuaagccuau

SEQ ID NO: 622164 - RNA, 19 nt, Homo sapiens
gcacaccuauuaccuauua

SEQ ID NO: 622165 - RNA, 19 nt, Homo sapiens
gcaaagaaaugccuuguau

SEQ ID NO: 622166 - RNA, 19 nt, Homo sapiens
gaaacaagaugaauggauu

SEQ ID NO: 622167 - RNA, 19 nt, Homo sapiens
gcauaucgcuuacguucua

SEQ ID NO: 622168 - RNA, 19 nt, Homo sapiens
ggacuuaaauugcgacuuc

SEQ ID NO: 622169 - RNA, 19 nt, Homo sapiens
ggagaaauuugaaggugua

SEQ ID NO: 622170 - RNA, 19 nt, Homo sapiens
gaagacauguuuaauacug

SEQ ID NO: 622171 - RNA, 19 nt, Homo sapiens
gaaacuaccaugaaaugua

SEQ ID NO: 622172 - RNA, 19 nt, Homo sapiens
ggauuaaguuugaugauga

SEQ ID NO: 622173 - RNA, 19 nt, Homo sapiens
gaggaacgcuaaaggauga

SEQ ID NO: 622174 - RNA, 19 nt, Homo sapiens
gagcuuggcugaagacaug

SEQ ID NO: 622175 - RNA, 19 nt, Homo sapiens
gaaacccugucucuacuaa

SEQ ID NO: 622176 - RNA, 19 nt, Homo sapiens
agaaaugccuuguauauca

SEQ ID NO: 622177 - RNA, 19 nt, Homo sapiens
cgagaaaggugaacaagga

SEQ ID NO: 622178 - RNA, 19 nt, Homo sapiens
uggaauggcuuuguaauaa

SEQ ID NO: 622179 - RNA, 19 nt, Homo sapiens
ggaaugacucuacuaauga

SEQ ID NO: 622180 - RNA, 19 nt, Homo sapiens
gaaaugccuuguauaucaa

SEQ ID NO: 622181 - RNA, 19 nt, Homo sapiens
ggauugugcugcccuauau

SEQ ID NO: 622182 - RNA, 19 nt, Homo sapiens
gaacaaggacaguaucuuc

SEQ ID NO: 622183 - RNA, 19 nt, Homo sapiens
caagaugaauggauuaagu

SEQ ID NO: 622184 - RNA, 19 nt, Homo sapiens
caccagaacuucaagagaa

SEQ ID NO: 622185 - RNA, 19 nt, Homo sapiens
gcugaagacauguuuaaua

SEQ ID NO: 622186 - RNA, 19 nt, Homo sapiens
gaagaaaucaccaaacagu

SEQ ID NO: 622187 - RNA, 19 nt, Homo sapiens
caacagaaauuggaagcaa

SEQ ID NO: 622188 - RNA, 19 nt, Homo sapiens
guucuucgguguugaguuu

SEQ ID NO: 622189 - RNA, 19 nt, Homo sapiens
ggaauggcuuuguaauaau

SEQ ID NO: 622190 - RNA, 19 nt, Homo sapiens
ccaaaguucuuaaggaugu

SEQ ID NO: 622191 - RNA, 19 nt, Homo sapiens
gaagaagucaccaaaggaa

SEQ ID NO: 622192 - RNA, 19 nt, Homo sapiens
agaggaaagugaacaguaa

SEQ ID NO: 622193 - RNA, 19 nt, Homo sapiens
gaaaaucaacuucagcuua

SEQ ID NO: 622194 - RNA, 19 nt, Homo sapiens
ggauauguaugaacugugu

SEQ ID NO: 622195 - RNA, 19 nt, Homo sapiens
gaaauuugaagguguagaa

SEQ ID NO: 622196 - RNA, 19 nt, Homo sapiens
acucaaagaugcccuuaaa

SEQ ID NO: 622197 - RNA, 19 nt, Homo sapiens
uagaagacaugacagaaga

SEQ ID NO: 622198 - RNA, 19 nt, Homo sapiens
ggaguuaccauguggauug

SEQ ID NO: 622199 - RNA, 19 nt, Homo sapiens
gcuaaaggaugaugauugg

SEQ ID NO: 622200 - RNA, 19 nt, Homo sapiens
uggaaugacucuacuaaug

SEQ ID NO: 622201 - RNA, 19 nt, Homo sapiens
ucgcagaguugaaauaaug

SEQ ID NO: 622202 - RNA, 19 nt, Homo sapiens
gagacuggcauaucgcuua

SEQ ID NO: 622203 - RNA, 19 nt, Homo sapiens
gaucaguucuucgguguug

SEQ ID NO: 622204 - RNA, 19 nt, Homo sapiens
gcaggugccuugagagcuu

SEQ ID NO: 622205 - RNA, 19 nt, Homo sapiens
gacagaaaguuauggugaa

SEQ ID NO: 622206 - RNA, 19 nt, Homo sapiens
gaauggcuuuguaauaauc

SEQ ID NO: 622207 - RNA, 19 nt, Homo sapiens
gaagguguagaauugaaua

SEQ ID NO: 622208 - RNA, 19 nt, Homo sapiens
agaugaaccuccaauggua

SEQ ID NO: 622209 - RNA, 19 nt, Homo sapiens
gauaaaacuucuuccagua

SEQ ID NO: 622210 - RNA, 19 nt, Homo sapiens
gaaugacucuacuaaugau

SEQ ID NO: 622211 - RNA, 19 nt, Homo sapiens
gauguuuacugcacaccua

SEQ ID NO: 622212 - RNA, 19 nt, Homo sapiens
ccagaaagaaguuaaguau

SEQ ID NO: 622213 - RNA, 19 nt, Homo sapiens
gagaaggaaucugugaaug

SEQ ID NO: 622214 - RNA, 19 nt, Homo sapiens
ggaaacaugggcacaauca

SEQ ID NO: 622215 - RNA, 19 nt, Homo sapiens
caaagaaaugccuuguaua

SEQ ID NO: 622216 - RNA, 19 nt, Homo sapiens
gcuaaugaauguuggauac

SEQ ID NO: 622217 - RNA, 19 nt, Homo sapiens
caugacagaagaacaguua

SEQ ID NO: 622218 - RNA, 19 nt, Homo sapiens
gcuguuaagcauccauuua

SEQ ID NO: 622219 - RNA, 19 nt, Homo sapiens
gcucaguuguguuuguauu

SEQ ID NO: 622220 - RNA, 19 nt, Homo sapiens
ucaacaggaugcuaaugaa

SEQ ID NO: 622221 - RNA, 19 nt, Homo sapiens
gaagaacaguuagcaucug

SEQ ID NO: 622222 - RNA, 19 nt, Homo sapiens
ccacccauccuuugccuua

SEQ ID NO: 622223 - RNA, 19 nt, Homo sapiens
gaguugaaauaauggaaga

SEQ ID NO: 622224 - RNA, 19 nt, Homo sapiens
gacaaagucagcaucguaa

SEQ ID NO: 622225 - RNA, 19 nt, Homo sapiens
caaauucaaggaucuagaa

SEQ ID NO: 622226 - RNA, 19 nt, Homo sapiens
gaauguuggauacaaauga

SEQ ID NO: 622227 - RNA, 19 nt, Homo sapiens
gaagaacccucagccaaaa

SEQ ID NO: 622228 - RNA, 19 nt, Homo sapiens
gauguuaucagucagauuc

SEQ ID NO: 622229 - RNA, 19 nt, Homo sapiens
uuacaugaaugccacaguu

SEQ ID NO: 622230 - RNA, 19 nt, Homo sapiens
gaaagugaacaguaaucuu

SEQ ID NO: 622231 - RNA, 19 nt, Homo sapiens
guaauggauuucuuuggau

SEQ ID NO: 622232 - RNA, 19 nt, Homo sapiens
cugaagacauguuuaauac

SEQ ID NO: 622233 - RNA, 19 nt, Homo sapiens
aaacuaccaugaaauguac

SEQ ID NO: 622234 - RNA, 19 nt, Homo sapiens
ucagucagauucuuuccuu

SEQ ID NO: 622235 - RNA, 19 nt, Homo sapiens
gcucuacuccguuacugua

SEQ ID NO: 622236 - RNA, 19 nt, Homo sapiens
ucuauaauccagagcuuua

SEQ ID NO: 622237 - RNA, 19 nt, Homo sapiens
cagggaaggucuaguucuu

SEQ ID NO: 622238 - RNA, 19 nt, Homo sapiens
caugaaauguacagaaucu

SEQ ID NO: 622239 - RNA, 19 nt, Homo sapiens
guaugcaggugccuugaga

SEQ ID NO: 622240 - RNA, 19 nt, Homo sapiens
gaacucaaagaugcccuua

SEQ ID NO: 622241 - RNA, 19 nt, Homo sapiens
gaaauaauggaagaggaaa

SEQ ID NO: 622242 - RNA, 19 nt, Homo sapiens
ggaugauucuguuaaagag

SEQ ID NO: 622243 - RNA, 19 nt, Homo sapiens
caauagaggaugauucugu

SEQ ID NO: 622244 - RNA, 19 nt, Homo sapiens
ggggaaacaucaaaauaaa

SEQ ID NO: 622245 - RNA, 19 nt, Homo sapiens
ugaaugcagugauguuauc

SEQ ID NO: 622246 - RNA, 19 nt, Homo sapiens
ggaaacaagaugaauggau

SEQ ID NO: 622247 - RNA, 19 nt, Homo sapiens
ugacuuacaagcaguacua

SEQ ID NO: 622248 - RNA, 19 nt, Homo sapiens
gugaaucagcagccaaaua

SEQ ID NO: 622249 - RNA, 19 nt, Homo sapiens
aggaagaaaucaccaaaca

SEQ ID NO: 622250 - RNA, 19 nt, Homo sapiens
agaggaugauucuguuaaa

SEQ ID NO: 622251 - RNA, 19 nt, Homo sapiens
gcugaaugcagugauguua

SEQ ID NO: 622252 - RNA, 19 nt, Homo sapiens
auccagagcuuuagaggaa

SEQ ID NO: 622253 - RNA, 19 nt, Homo sapiens
agaagaacccucagccaaa

SEQ ID NO: 622254 - RNA, 19 nt, Homo sapiens
aguaauggauuucuuugga

SEQ ID NO: 622255 - RNA, 19 nt, Homo sapiens
aaagugaacaguaaucuuc

SEQ ID NO: 622256 - RNA, 19 nt, Homo sapiens
gcucagcuguuugcguuga

SEQ ID NO: 622257 - RNA, 19 nt, Homo sapiens
ccaaacagucuccaacguu

SEQ ID NO: 622258 - RNA, 19 nt, Homo sapiens
gaagaagaagucaccaaag

SEQ ID NO: 622259 - RNA, 19 nt, Homo sapiens
cugcagcccuuagagauuu

SEQ ID NO: 622260 - RNA, 19 nt, Homo sapiens
acagaaaguuauggugaaa

SEQ ID NO: 622261 - RNA, 19 nt, Homo sapiens
aagaagaagucaccaaagg

SEQ ID NO: 622262 - RNA, 19 nt, Homo sapiens
aauagaggaugauucuguu

SEQ ID NO: 622263 - RNA, 19 nt, Homo sapiens
auucaaggcucagcuguuu

SEQ ID NO: 622264 - RNA, 19 nt, Homo sapiens
gaacaaauauguagugagu

SEQ ID NO: 622265 - RNA, 19 nt, Homo sapiens
gcuaagaucucaagucaaa

SEQ ID NO: 622266 - RNA, 19 nt, Homo sapiens
gcauauaaguguccgauuu

SEQ ID NO: 622267 - RNA, 19 nt, Homo sapiens
gaacuuggaugccagcaaa

SEQ ID NO: 622268 - RNA, 19 nt, Homo sapiens
caaaugaacuugcuugugu

SEQ ID NO: 622269 - RNA, 19 nt, Homo sapiens
ggacaaccaucuaagaaga

SEQ ID NO: 622270 - RNA, 19 nt, Homo sapiens
guccagauaugaacaaaua

SEQ ID NO: 622271 - RNA, 19 nt, Homo sapiens
caagagaggugaagaaagu

SEQ ID NO: 622272 - RNA, 19 nt, Homo sapiens
guacaugauuccaacauaa

SEQ ID NO: 622273 - RNA, 19 nt, Homo sapiens
ggacaaaucccauugguau

SEQ ID NO: 622274 - RNA, 19 nt, Homo sapiens
caaaugguguuauugcuaa

SEQ ID NO: 622275 - RNA, 19 nt, Homo sapiens
agacagagcuuucauugga

SEQ ID NO: 622276 - RNA, 19 nt, Homo sapiens
gaagauaccagaucaugaa

SEQ ID NO: 622277 - RNA, 19 nt, Homo sapiens
gaagaaagaccuauaugau

SEQ ID NO: 622278 - RNA, 19 nt, Homo sapiens
gagaaugggagacauauaa

SEQ ID NO: 622279 - RNA, 19 nt, Homo sapiens
gagaacacaugcaaaugaa

SEQ ID NO: 622280 - RNA, 19 nt, Homo sapiens
ggagaaagcaagaucauga

SEQ ID NO: 622281 - RNA, 19 nt, Homo sapiens
ggacuuaauucagaacaaa

SEQ ID NO: 622282 - RNA, 19 nt, Homo sapiens
cgaagaaacuaacaaggaa

SEQ ID NO: 622283 - RNA, 19 nt, Homo sapiens
gaaagguuaucuuaaaugg

SEQ ID NO: 622284 - RNA, 19 nt, Homo sapiens
ggaggcaucuuacauuuag

SEQ ID NO: 622285 - RNA, 19 nt, Homo sapiens
gaaagacaagcuaaaugua

SEQ ID NO: 622286 - RNA, 19 nt, Homo sapiens
ggaaaggguuguagauaag

SEQ ID NO: 622287 - RNA, 19 nt, Homo sapiens
gaagacagagcuuucauug

SEQ ID NO: 622288 - RNA, 19 nt, Homo sapiens
ggacuaagacugaauaugg

SEQ ID NO: 622289 - RNA, 19 nt, Homo sapiens
ggaccuacccaaaccaaua

SEQ ID NO: 622290 - RNA, 19 nt, Homo sapiens
caagacaugugggcauaua

SEQ ID NO: 622291 - RNA, 19 nt, Homo sapiens
ggagacaucuuuaugaacu

SEQ ID NO: 622292 - RNA, 19 nt, Homo sapiens
gcggagagguucacaacaa

SEQ ID NO: 622293 - RNA, 19 nt, Homo sapiens
uaacuaagcauuuguguuc

SEQ ID NO: 622294 - RNA, 19 nt, Homo sapiens
gcaacaagacucccaagaa

SEQ ID NO: 622295 - RNA, 19 nt, Homo sapiens
aaacacaucccagacauua

SEQ ID NO: 622296 - RNA, 19 nt, Homo sapiens
caaauggaaugguuaaugg

SEQ ID NO: 622297 - RNA, 19 nt, Homo sapiens
cagcuaagaucucaaguca

SEQ ID NO: 622298 - RNA, 19 nt, Homo sapiens
cauacaagcugucugauag

SEQ ID NO: 622299 - RNA, 19 nt, Homo sapiens
caacaagacucccaagaac

SEQ ID NO: 622300 - RNA, 19 nt, Homo sapiens
caacggaccuggauauagg

SEQ ID NO: 622301 - RNA, 19 nt, Homo sapiens
gagacuaucuucccuugug

SEQ ID NO: 622302 - RNA, 19 nt, Homo sapiens
aauaagccgucaaguagua

SEQ ID NO: 622303 - RNA, 19 nt, Homo sapiens
uaucaaacaucccaggaaa

SEQ ID NO: 622304 - RNA, 19 nt, Homo sapiens
gaugggaucuccugugcuu

SEQ ID NO: 622305 - RNA, 19 nt, Homo sapiens
ggaacugggugcacacaug

SEQ ID NO: 622306 - RNA, 19 nt, Homo sapiens
gaacucaacaggacaaauc

SEQ ID NO: 622307 - RNA, 19 nt, Homo sapiens
gauaccagaucaugaagga

SEQ ID NO: 622308 - RNA, 19 nt, Homo sapiens
ggauggacaugguagagaa

SEQ ID NO: 622309 - RNA, 19 nt, Homo sapiens
gcucuaagggcuauaaauu

SEQ ID NO: 622310 - RNA, 19 nt, Homo sapiens
ugaaagggaggcucucuua

SEQ ID NO: 622311 - RNA, 19 nt, Homo sapiens
uaucuuaaauggcuaccua

SEQ ID NO: 622312 - RNA, 19 nt, Homo sapiens
ccauuagccuguaaacaaa

SEQ ID NO: 622313 - RNA, 19 nt, Homo sapiens
gaagaagacagcacugaug

SEQ ID NO: 622314 - RNA, 19 nt, Homo sapiens
aggaaaggguuguagauaa

SEQ ID NO: 622315 - RNA, 19 nt, Homo sapiens
gaaugucacuggugcuuag

SEQ ID NO: 622316 - RNA, 19 nt, Homo sapiens
gaacuugcuuguguguauu

SEQ ID NO: 622317 - RNA, 19 nt, Homo sapiens
caagcugucugauagagaa

SEQ ID NO: 622318 - RNA, 19 nt, Homo sapiens
gaaaguggaugcgcagagu

SEQ ID NO: 622319 - RNA, 19 nt, Homo sapiens
aaagugagauguacuacug

SEQ ID NO: 622320 - RNA, 19 nt, Homo sapiens
ucacuucccuccacuccua

SEQ ID NO: 622321 - RNA, 19 nt, Homo sapiens
gaucucaagucaaaugcaa

SEQ ID NO: 622322 - RNA, 19 nt, Homo sapiens
gaagaguguugccccauua

SEQ ID NO: 622323 - RNA, 19 nt, Homo sapiens
ggaaucaacagcagcauug

SEQ ID NO: 622324 - RNA, 19 nt, Homo sapiens
acaaugcacugacuuuaga

SEQ ID NO: 622325 - RNA, 19 nt, Homo sapiens
guacuacuguuccaagugu

SEQ ID NO: 622326 - RNA, 19 nt, Homo sapiens
ggaaccaugucuucuuuag

SEQ ID NO: 622327 - RNA, 19 nt, Homo sapiens
gaaagggaggcucucuuaa

SEQ ID NO: 622328 - RNA, 19 nt, Homo sapiens
cuuaagcgauuucaauuug

SEQ ID NO: 622329 - RNA, 19 nt, Homo sapiens
gcauugcucuuaagguuca

SEQ ID NO: 622330 - RNA, 19 nt, Homo sapiens
gggagcaguugccaauauu

SEQ ID NO: 622331 - RNA, 19 nt, Homo sapiens
guggaggcaucuuacauuu

SEQ ID NO: 622332 - RNA, 19 nt, Homo sapiens
gaacuucacaaauggaaug

SEQ ID NO: 622333 - RNA, 19 nt, Homo sapiens
gugauuaaguuagauggua

SEQ ID NO: 622334 - RNA, 19 nt, Homo sapiens
ggacguguauuugguggaa

SEQ ID NO: 622335 - RNA, 19 nt, Homo sapiens
gcacaguagcaaacucaua

SEQ ID NO: 622336 - RNA, 19 nt, Homo sapiens
gagcggaaggacauacuua

SEQ ID NO: 622337 - RNA, 19 nt, Homo sapiens
ggaaagguuaucuuaaaug

SEQ ID NO: 622338 - RNA, 19 nt, Homo sapiens
gaacugggugcacacauga

SEQ ID NO: 622339 - RNA, 19 nt, Homo sapiens
gcuaaaugcuauggugauu

SEQ ID NO: 622340 - RNA, 19 nt, Homo sapiens
gaggucaucugaacacauc

SEQ ID NO: 622341 - RNA, 19 nt, Homo sapiens
ugaacuugcuuguguguau

SEQ ID NO: 622342 - RNA, 19 nt, Homo sapiens
agacagcacugaugaccaa

SEQ ID NO: 622343 - RNA, 19 nt, Homo sapiens
gaacacaccuggggccuaa

SEQ ID NO: 622344 - RNA, 19 nt, Homo sapiens
gccaguaacuauuaauauc

SEQ ID NO: 622345 - RNA, 19 nt, Homo sapiens
aagcauuuguguucugaua

SEQ ID NO: 622346 - RNA, 19 nt, Homo sapiens
gcaauggucagcuuggaaa

SEQ ID NO: 622347 - RNA, 19 nt, Homo sapiens
ggaauguucacccuaacua

SEQ ID NO: 622348 - RNA, 19 nt, Homo sapiens
ccacaucccuggaauagac

SEQ ID NO: 622349 - RNA, 19 nt, Homo sapiens
gcacugaugaccaaagaga

SEQ ID NO: 622350 - RNA, 19 nt, Homo sapiens
caacaaagaagcuggaucu

SEQ ID NO: 622351 - RNA, 19 nt, Homo sapiens
gcaaguggauggaaaugcu

SEQ ID NO: 622352 - RNA, 19 nt, Homo sapiens
gggcaguuguggaaaguga

SEQ ID NO: 622353 - RNA, 19 nt, Homo sapiens
ggccuaagcugggucuuga

SEQ ID NO: 622354 - RNA, 19 nt, Homo sapiens
guaaaugaucaguggauaa

SEQ ID NO: 622355 - RNA, 19 nt, Homo sapiens
uagcagaaguacaugauuc

SEQ ID NO: 622356 - RNA, 19 nt, Homo sapiens
cagaagcgccucaugaaga

SEQ ID NO: 622357 - RNA, 19 nt, Homo sapiens
gagcaaggacccacuguuc

SEQ ID NO: 622358 - RNA, 19 nt, Homo sapiens
aagggaggcucucuuaaga

SEQ ID NO: 622359 - RNA, 19 nt, Homo sapiens
cuuccacccuuccugauua

SEQ ID NO: 622360 - RNA, 19 nt, Homo sapiens
ggaagacagagcuuucauu

SEQ ID NO: 622361 - RNA, 19 nt, Homo sapiens
caaguauccugguuagcaa

SEQ ID NO: 622362 - RNA, 19 nt, Homo sapiens
gacuaagacugaauaugga

SEQ ID NO: 622363 - RNA, 19 nt, Homo sapiens
ggaagauaccagaucauga

SEQ ID NO: 622364 - RNA, 19 nt, Homo sapiens
gaagggacaucuuuggaaa

SEQ ID NO: 622365 - RNA, 19 nt, Homo sapiens
acacaaaccugacaagaga

SEQ ID NO: 622366 - RNA, 19 nt, Homo sapiens
ccagcaagcucacaacauu

SEQ ID NO: 622367 - RNA, 19 nt, Homo sapiens
caaucuggcugccuccuua

SEQ ID NO: 622368 - RNA, 19 nt, Homo sapiens
gagacggcaugaauucuaa

SEQ ID NO: 622369 - RNA, 19 nt, Homo sapiens
gaagagacggcaugaauuc

SEQ ID NO: 622370 - RNA, 19 nt, Homo sapiens
gggaacacgugcuucauga

SEQ ID NO: 622371 - RNA, 19 nt, Homo sapiens
ucagauagcuaccggauag

SEQ ID NO: 622372 - RNA, 19 nt, Homo sapiens
uaagagaauuugccucaga

SEQ ID NO: 622373 - RNA, 19 nt, Homo sapiens
cuacacagaugcccacuau

SEQ ID NO: 622374 - RNA, 19 nt, Homo sapiens
gcaugaggcucuucaccaa

SEQ ID NO: 622375 - RNA, 19 nt, Homo sapiens
gagaaaggccgacagaugu

SEQ ID NO: 622376 - RNA, 19 nt, Homo sapiens
gaccuggacuuaagagaau

SEQ ID NO: 622377 - RNA, 19 nt, Homo sapiens
ggaagagacggcaugaauu

SEQ ID NO: 622378 - RNA, 19 nt, Homo sapiens
cugaauaccuggucgacua

SEQ ID NO: 622379 - RNA, 19 nt, Homo sapiens
agacccagauccagagaua

SEQ ID NO: 622380 - RNA, 19 nt, Homo sapiens
uaacuaaaguguucagacu

SEQ ID NO: 622381 - RNA, 19 nt, Homo sapiens
gagaauggcacacuuucaa

SEQ ID NO: 622382 - RNA, 19 nt, Homo sapiens
acacagcccucguggaaga

SEQ ID NO: 622383 - RNA, 19 nt, Homo sapiens
ccaaagaggaugugcuuga

SEQ ID NO: 622384 - RNA, 19 nt, Homo sapiens
gggaagagacggcaugaau

SEQ ID NO: 622385 - RNA, 19 nt, Homo sapiens
ucgacuaccuggagaacua

SEQ ID NO: 622386 - RNA, 19 nt, Homo sapiens
caaagaggaugugcuugau

SEQ ID NO: 622387 - RNA, 19 nt, Homo sapiens
gcaggaugcucaggaguuc

SEQ ID NO: 622388 - RNA, 19 nt, Homo sapiens
cgagaaaggccgacagaug

SEQ ID NO: 622389 - RNA, 19 nt, Homo sapiens
cgacagauguggagaaaau

SEQ ID NO: 622390 - RNA, 19 nt, Homo sapiens
caaccaugcuguuuacaac

SEQ ID NO: 622391 - RNA, 19 nt, Homo sapiens
ucgcugacguguacagauu

SEQ ID NO: 622392 - RNA, 19 nt, Homo sapiens
acacacagcccucguggaa

SEQ ID NO: 622393 - RNA, 19 nt, Homo sapiens
acaccaaccaugcuguuua

SEQ ID NO: 622394 - RNA, 19 nt, Homo sapiens
agaaaacgguguauaaaga

SEQ ID NO: 622395 - RNA, 19 nt, Homo sapiens
ggaguuccuucgcuuucuu

SEQ ID NO: 622396 - RNA, 19 nt, Homo sapiens
cagaaacaacugugucuug

SEQ ID NO: 622397 - RNA, 19 nt, Homo sapiens
gaaccucgaucaucuuccu

SEQ ID NO: 622398 - RNA, 19 nt, Homo sapiens
caacaacaacaacacacaa

SEQ ID NO: 622399 - RNA, 19 nt, Homo sapiens
gauugugguuacuguucua

SEQ ID NO: 622400 - RNA, 19 nt, Homo sapiens
gccgacagauguggagaaa

SEQ ID NO: 622401 - RNA, 19 nt, Homo sapiens
ucagcuaccugcccaucaa

SEQ ID NO: 622402 - RNA, 19 nt, Homo sapiens
aagagaauuugccucagaa

SEQ ID NO: 622403 - RNA, 19 nt, Homo sapiens
cugaagcgcuacacagaau

SEQ ID NO: 622404 - RNA, 19 nt, Homo sapiens
gaacacgugcuucaugaac

SEQ ID NO: 622405 - RNA, 19 nt, Homo sapiens
cgaagggacaucuuuggaa

SEQ ID NO: 622406 - RNA, 19 nt, Homo sapiens
gaacgggaagacaguagga

SEQ ID NO: 622407 - RNA, 19 nt, Homo sapiens
gagauacgcaccgcgcuuu

SEQ ID NO: 622408 - RNA, 19 nt, Homo sapiens
guacugagcggccuuuagg

SEQ ID NO: 622409 - RNA, 19 nt, Homo sapiens
gcgcuuuguuggcuauaau

SEQ ID NO: 622410 - RNA, 19 nt, Homo sapiens
cggcaugaauucuaagagu

SEQ ID NO: 622411 - RNA, 19 nt, Homo sapiens
uuccauaacuaaaguguuc

SEQ ID NO: 622412 - RNA, 19 nt, Homo sapiens
auccagagguucccaaaga

SEQ ID NO: 622413 - RNA, 19 nt, Homo sapiens
ccagagccaugagccaaga

SEQ ID NO: 622414 - RNA, 19 nt, Homo sapiens
ggagaauggcacacuuuca

SEQ ID NO: 622415 - RNA, 19 nt, Homo sapiens
gcaagggcagugcaucuca

SEQ ID NO: 622416 - RNA, 19 nt, Homo sapiens
aagaagaggcagcccauga

SEQ ID NO: 622417 - RNA, 19 nt, Homo sapiens
acgccuaccugcucuucua

SEQ ID NO: 622418 - RNA, 19 nt, Homo sapiens
gaaaacgguguauaaagaa

SEQ ID NO: 622419 - RNA, 19 nt, Homo sapiens
cugagaaccucgaucaucu

SEQ ID NO: 622420 - RNA, 19 nt, Homo sapiens
gaaaucaucagcccaaccu

SEQ ID NO: 622421 - RNA, 19 nt, Homo sapiens
gagcccaucugaguucaag

SEQ ID NO: 622422 - RNA, 19 nt, Homo sapiens
gcagcggauucccuuaugg

SEQ ID NO: 622423 - RNA, 19 nt, Homo sapiens
ggcagcggauucccuuaug

SEQ ID NO: 622424 - RNA, 19 nt, Homo sapiens
ggaugugcuugauggagau

SEQ ID NO: 622425 - RNA, 19 nt, Homo sapiens
ugacauuaauggacugcau

SEQ ID NO: 622426 - RNA, 19 nt, Homo sapiens
ggaacacgugcuucaugaa

SEQ ID NO: 622427 - RNA, 19 nt, Homo sapiens
gugccacccugaaggaugu

SEQ ID NO: 622428 - RNA, 19 nt, Homo sapiens
ccuccucccuccuggacua

SEQ ID NO: 622429 - RNA, 19 nt, Homo sapiens
gagaaggagaaacuugguu

SEQ ID NO: 622430 - RNA, 19 nt, Homo sapiens
gcccucggcguuugcauuu

SEQ ID NO: 622431 - RNA, 19 nt, Homo sapiens
caggagaauggcacacuuu

SEQ ID NO: 622432 - RNA, 19 nt, Homo sapiens
caccaaccaugcuguuuac

SEQ ID NO: 622433 - RNA, 19 nt, Homo sapiens
gcagaaaacgguguauaaa

SEQ ID NO: 622434 - RNA, 19 nt, Homo sapiens
gagaaccucgaucaucuuc

SEQ ID NO: 622435 - RNA, 19 nt, Homo sapiens
cagacgaagggacaucuuu

SEQ ID NO: 622436 - RNA, 19 nt, Homo sapiens
gaauuugccucagaaaaca

SEQ ID NO: 622437 - RNA, 19 nt, Homo sapiens
cagcaagcucacaacauuu

SEQ ID NO: 622438 - RNA, 19 nt, Homo sapiens
cggcagcaaugcacacaca

SEQ ID NO: 622439 - RNA, 19 nt, Homo sapiens
ucacgagucccugaaauca

SEQ ID NO: 622440 - RNA, 19 nt, Homo sapiens
gggcagcggauucccuuau

SEQ ID NO: 622441 - RNA, 19 nt, Homo sapiens
ccucggcguuugcauuugu

SEQ ID NO: 622442 - RNA, 19 nt, Homo sapiens
caacacacaaaccugacaa

SEQ ID NO: 622443 - RNA, 19 nt, Homo sapiens
aaacaacaacaacaacaca

SEQ ID NO: 622444 - RNA, 19 nt, Homo sapiens
agagacggcaugaauucua

SEQ ID NO: 622445 - RNA, 19 nt, Homo sapiens
gcugagacccgacaucacu

SEQ ID NO: 622446 - RNA, 19 nt, Homo sapiens
ccaaccaugcuguuuacaa

SEQ ID NO: 622447 - RNA, 19 nt, Homo sapiens
ggugagcccaucugaguuc

SEQ ID NO: 622448 - RNA, 19 nt, Homo sapiens
cuuauggagugaccaacaa

SEQ ID NO: 622449 - RNA, 19 nt, Homo sapiens
caccaaagaggaugugcuu

SEQ ID NO: 622450 - RNA, 19 nt, Homo sapiens
gcugacguguacagauugu

SEQ ID NO: 622451 - RNA, 19 nt, Homo sapiens
acacagaugcccacuaugc

SEQ ID NO: 622452 - RNA, 19 nt, Homo sapiens
gacgagaaaggccgacaga

SEQ ID NO: 622453 - RNA, 19 nt, Homo sapiens
guggugagcccaucugagu

SEQ ID NO: 622454 - RNA, 19 nt, Homo sapiens
cucgggaguugagagauua

SEQ ID NO: 622455 - RNA, 19 nt, Homo sapiens
acgagucccugaaaucauc

SEQ ID NO: 622456 - RNA, 19 nt, Homo sapiens
ccucacgagucccugaaau

SEQ ID NO: 622457 - RNA, 19 nt, Homo sapiens
uuuguaaacuuguggucuu

SEQ ID NO: 622458 - RNA, 19 nt, Homo sapiens
acaggagaauggcacacuu

SEQ ID NO: 622459 - RNA, 19 nt, Homo sapiens
aaacuuguggucuuccuau

SEQ ID NO: 622460 - RNA, 19 nt, Homo sapiens
agaccuggacuuaagagaa

SEQ ID NO: 622461 - RNA, 19 nt, Homo sapiens
ggcagaaaacgguguauaa

SEQ ID NO: 622462 - RNA, 19 nt, Homo sapiens
guguacagauugugguuac

SEQ ID NO: 622463 - RNA, 19 nt, Homo sapiens
acaaaccugacaagagaaa

SEQ ID NO: 622464 - RNA, 19 nt, Homo sapiens
ccagcaagcucacaacauu

SEQ ID NO: 622465 - RNA, 19 nt, Homo sapiens
gggaacacgugcuucauga

SEQ ID NO: 622466 - RNA, 19 nt, Homo sapiens
uaagagaauuugccucaga

SEQ ID NO: 622467 - RNA, 19 nt, Homo sapiens
gcaugaggcucuucaccaa

SEQ ID NO: 622468 - RNA, 19 nt, Homo sapiens
gagaaaggccgacagaugu

SEQ ID NO: 622469 - RNA, 19 nt, Homo sapiens
gaccuggacuuaagagaau

SEQ ID NO: 622470 - RNA, 19 nt, Homo sapiens
agacccagauccagagaua

SEQ ID NO: 622471 - RNA, 19 nt, Homo sapiens
gagaauggcacacuuucaa

SEQ ID NO: 622472 - RNA, 19 nt, Homo sapiens
acacagcccucguggaaga

SEQ ID NO: 622473 - RNA, 19 nt, Homo sapiens
ccaaagaggaugugcuuga

SEQ ID NO: 622474 - RNA, 19 nt, Homo sapiens
caacaaagccaagaauucu

SEQ ID NO: 622475 - RNA, 19 nt, Homo sapiens
caaagaggaugugcuugau

SEQ ID NO: 622476 - RNA, 19 nt, Homo sapiens
gcaggaugcucaggaguuc

SEQ ID NO: 622477 - RNA, 19 nt, Homo sapiens
cgagaaaggccgacagaug

SEQ ID NO: 622478 - RNA, 19 nt, Homo sapiens
cgacagauguggagaaaau

SEQ ID NO: 622479 - RNA, 19 nt, Homo sapiens
caaccaugcuguuuacaac

SEQ ID NO: 622480 - RNA, 19 nt, Homo sapiens
ucgcugacguguacagauu

SEQ ID NO: 622481 - RNA, 19 nt, Homo sapiens
acacacagcccucguggaa

SEQ ID NO: 622482 - RNA, 19 nt, Homo sapiens
acaccaaccaugcuguuua

SEQ ID NO: 622483 - RNA, 19 nt, Homo sapiens
agaaaacgguguauaaaga

SEQ ID NO: 622484 - RNA, 19 nt, Homo sapiens
ggaguuccuucgcuuucuu

SEQ ID NO: 622485 - RNA, 19 nt, Homo sapiens
acaaagccaagaauucuaa

SEQ ID NO: 622486 - RNA, 19 nt, Homo sapiens
gaaccucgaucaucuuccu

SEQ ID NO: 622487 - RNA, 19 nt, Homo sapiens
gauugugguuacuguucua

SEQ ID NO: 622488 - RNA, 19 nt, Homo sapiens
gccgacagauguggagaaa

SEQ ID NO: 622489 - RNA, 19 nt, Homo sapiens
ucaacaaagccaagaauuc

SEQ ID NO: 622490 - RNA, 19 nt, Homo sapiens
aagagaauuugccucagaa

SEQ ID NO: 622491 - RNA, 19 nt, Homo sapiens
gaacacgugcuucaugaac

SEQ ID NO: 622492 - RNA, 19 nt, Homo sapiens
gaacgggaagacaguagga

SEQ ID NO: 622493 - RNA, 19 nt, Homo sapiens
gagauacgcaccgcgcuuu

SEQ ID NO: 622494 - RNA, 19 nt, Homo sapiens
gcgcuuuguuggcuauaau

SEQ ID NO: 622495 - RNA, 19 nt, Homo sapiens
auccagagguucccaaaga

SEQ ID NO: 622496 - RNA, 19 nt, Homo sapiens
ggagaauggcacacuuuca

SEQ ID NO: 622497 - RNA, 19 nt, Homo sapiens
acgccuaccugcucuucua

SEQ ID NO: 622498 - RNA, 19 nt, Homo sapiens
gaaaacgguguauaaagaa

SEQ ID NO: 622499 - RNA, 19 nt, Homo sapiens
cugagaaccucgaucaucu

SEQ ID NO: 622500 - RNA, 19 nt, Homo sapiens
gagcccaucugaguucaag

SEQ ID NO: 622501 - RNA, 19 nt, Homo sapiens
ggaugugcuugauggagau

SEQ ID NO: 622502 - RNA, 19 nt, Homo sapiens
ugacauuaauggacugcau

SEQ ID NO: 622503 - RNA, 19 nt, Homo sapiens
ggaacacgugcuucaugaa

SEQ ID NO: 622504 - RNA, 19 nt, Homo sapiens
caggagaauggcacacuuu

SEQ ID NO: 622505 - RNA, 19 nt, Homo sapiens
caccaaccaugcuguuuac

SEQ ID NO: 622506 - RNA, 19 nt, Homo sapiens
gcagaaaacgguguauaaa

SEQ ID NO: 622507 - RNA, 19 nt, Homo sapiens
gagaaccucgaucaucuuc

SEQ ID NO: 622508 - RNA, 19 nt, Homo sapiens
gcucaacaaagccaagaau

SEQ ID NO: 622509 - RNA, 19 nt, Homo sapiens
gaauuugccucagaaaaca

SEQ ID NO: 622510 - RNA, 19 nt, Homo sapiens
cagcaagcucacaacauuu

SEQ ID NO: 622511 - RNA, 19 nt, Homo sapiens
cggcagcaaugcacacaca

SEQ ID NO: 622512 - RNA, 19 nt, Homo sapiens
ccaaccaugcuguuuacaa

SEQ ID NO: 622513 - RNA, 19 nt, Homo sapiens
ggugagcccaucugaguuc

SEQ ID NO: 622514 - RNA, 19 nt, Homo sapiens
caccaaagaggaugugcuu

SEQ ID NO: 622515 - RNA, 19 nt, Homo sapiens
gcugacguguacagauugu

SEQ ID NO: 622516 - RNA, 19 nt, Homo sapiens
agagcucgcugacguguac

SEQ ID NO: 622517 - RNA, 19 nt, Homo sapiens
gacgagaaaggccgacaga

SEQ ID NO: 622518 - RNA, 19 nt, Homo sapiens
guggugagcccaucugagu

SEQ ID NO: 622519 - RNA, 19 nt, Homo sapiens
cucgggaguugagagauua

SEQ ID NO: 622520 - RNA, 19 nt, Homo sapiens
acaggagaauggcacacuu

SEQ ID NO: 622521 - RNA, 19 nt, Homo sapiens
agaccuggacuuaagagaa

SEQ ID NO: 622522 - RNA, 19 nt, Homo sapiens
ggcagaaaacgguguauaa

SEQ ID NO: 622523 - RNA, 19 nt, Homo sapiens
guguacagauugugguuac

SEQ ID NO: 622524 - RNA, 19 nt, Homo sapiens
uguacgcuguguccaauca

SEQ ID NO: 622525 - RNA, 19 nt, Homo sapiens
ucucacugcccauugcuaa

SEQ ID NO: 622526 - RNA, 19 nt, Homo sapiens
auccugaggugacauuaau

SEQ ID NO: 622527 - RNA, 19 nt, Homo sapiens
ggaccucucacugcccauu

SEQ ID NO: 622528 - RNA, 19 nt, Homo sapiens
guacagauugugguuacug

SEQ ID NO: 622529 - RNA, 19 nt, Homo sapiens
ccuguacgcuguguccaau

SEQ ID NO: 622530 - RNA, 19 nt, Homo sapiens
gggucuggcuggucuucga

SEQ ID NO: 622531 - RNA, 19 nt, Homo sapiens
cagauugugguuacuguuc

SEQ ID NO: 622532 - RNA, 19 nt, Homo sapiens
caacgacuccagcgucacu

SEQ ID NO: 622533 - RNA, 19 nt, Homo sapiens
gagaauuugccucagaaaa

SEQ ID NO: 622534 - RNA, 19 nt, Homo sapiens
ccagcaugcgcaccucgua

SEQ ID NO: 622535 - RNA, 19 nt, Homo sapiens
gaaccagcaagcucacaac

SEQ ID NO: 622536 - RNA, 19 nt, Homo sapiens
uauccugaggugacauuaa

SEQ ID NO: 622537 - RNA, 19 nt, Homo sapiens
cagaccauauggacuucau

SEQ ID NO: 622538 - RNA, 19 nt, Homo sapiens
acacgugcuucaugaacuc

SEQ ID NO: 622539 - RNA, 19 nt, Homo sapiens
aacgguguauaaagaaguu

SEQ ID NO: 622540 - RNA, 19 nt, Homo sapiens
gagaaucuguccaagguua

SEQ ID NO: 622541 - RNA, 19 nt, Homo sapiens
cagccuaccuccuguauua

SEQ ID NO: 622542 - RNA, 19 nt, Homo sapiens
gaggaaauguugaaccuaa

SEQ ID NO: 622543 - RNA, 19 nt, Homo sapiens
ggacaagaauaucagagaa

SEQ ID NO: 622544 - RNA, 19 nt, Homo sapiens
gggaacuggugcuacauua

SEQ ID NO: 622545 - RNA, 19 nt, Homo sapiens
gaaguucauuccucuguau

SEQ ID NO: 622546 - RNA, 19 nt, Homo sapiens
ccauaaagauugcagaguu

SEQ ID NO: 622547 - RNA, 19 nt, Homo sapiens
caaacaagagguugagaua

SEQ ID NO: 622548 - RNA, 19 nt, Homo sapiens
uaaacuaccugauggacaa

SEQ ID NO: 622549 - RNA, 19 nt, Homo sapiens
acaagaagaugcugaggaa

SEQ ID NO: 622550 - RNA, 19 nt, Homo sapiens
gaaagaugguggcgaugau

SEQ ID NO: 622551 - RNA, 19 nt, Homo sapiens
gagauaagaaaguggauuu

SEQ ID NO: 622552 - RNA, 19 nt, Homo sapiens
aagcuucucucaccaagua

SEQ ID NO: 622553 - RNA, 19 nt, Homo sapiens
ccacauauauuuacagacu

SEQ ID NO: 622554 - RNA, 19 nt, Homo sapiens
cagcuucuguugacucuaa

SEQ ID NO: 622555 - RNA, 19 nt, Homo sapiens
gagauaagucgaagaguga

SEQ ID NO: 622556 - RNA, 19 nt, Homo sapiens
gaacuggugcuacauuaau

SEQ ID NO: 622557 - RNA, 19 nt, Homo sapiens
gcacaccacggaaagcaua

SEQ ID NO: 622558 - RNA, 19 nt, Homo sapiens
ucaaggugaucaaccagua

SEQ ID NO: 622559 - RNA, 19 nt, Homo sapiens
ccuguggacuuggaaauua

SEQ ID NO: 622560 - RNA, 19 nt, Homo sapiens
gcucagcccugcguuggua

SEQ ID NO: 622561 - RNA, 19 nt, Homo sapiens
ggaaauuaguaaagaacug

SEQ ID NO: 622562 - RNA, 19 nt, Homo sapiens
cauaaagauugcagaguug

SEQ ID NO: 622563 - RNA, 19 nt, Homo sapiens
cccgugggcugaucaauaa

SEQ ID NO: 622564 - RNA, 19 nt, Homo sapiens
cagaguugcuggagaaugu

SEQ ID NO: 622565 - RNA, 19 nt, Homo sapiens
gcgcaucgaugaccagaca

SEQ ID NO: 622566 - RNA, 19 nt, Homo sapiens
cagaagcccuggucaaugg

SEQ ID NO: 622567 - RNA, 19 nt, Homo sapiens
gacucuaacuuccaaauca

SEQ ID NO: 622568 - RNA, 19 nt, Homo sapiens
aagaagaugcugaggaaua

SEQ ID NO: 622569 - RNA, 19 nt, Homo sapiens
gauaagaaaguggauuuga

SEQ ID NO: 622570 - RNA, 19 nt, Homo sapiens
ggacaccaccucacacuca

SEQ ID NO: 622571 - RNA, 19 nt, Homo sapiens
ggaagaacaaggugaagga

SEQ ID NO: 622572 - RNA, 19 nt, Homo sapiens
gcuaauggacaaauacuug

SEQ ID NO: 622573 - RNA, 19 nt, Homo sapiens
cuacagacgucuuccagau

SEQ ID NO: 622574 - RNA, 19 nt, Homo sapiens
gaauguaacccuaauccau

SEQ ID NO: 622575 - RNA, 19 nt, Homo sapiens
ggacuuggaaauuaguaaa

SEQ ID NO: 622576 - RNA, 19 nt, Homo sapiens
gaguggaccugcuguaaac

SEQ ID NO: 622577 - RNA, 19 nt, Homo sapiens
gauaaaaucgugagggaua

SEQ ID NO: 622578 - RNA, 19 nt, Homo sapiens
ggaacuggugcuacauuaa

SEQ ID NO: 622579 - RNA, 19 nt, Homo sapiens
aaagggaacuggugcuaca

SEQ ID NO: 622580 - RNA, 19 nt, Homo sapiens
gcucugcccucgcuuugga

SEQ ID NO: 622581 - RNA, 19 nt, Homo sapiens
gcugauuccugagauaaga

SEQ ID NO: 622582 - RNA, 19 nt, Homo sapiens
gcaggaagaacaaggugaa

SEQ ID NO: 622583 - RNA, 19 nt, Homo sapiens
uacagacuccugacaguua

SEQ ID NO: 622584 - RNA, 19 nt, Homo sapiens
gcccacauauauuuacaga

SEQ ID NO: 622585 - RNA, 19 nt, Homo sapiens
uggccuauguggaaacuaa

SEQ ID NO: 622586 - RNA, 19 nt, Homo sapiens
ggauauuacagcuauuuga

SEQ ID NO: 622587 - RNA, 19 nt, Homo sapiens
ggaaaaugauggugucuca

SEQ ID NO: 622588 - RNA, 19 nt, Homo sapiens
aaaaugggcuagaaugaaa

SEQ ID NO: 622589 - RNA, 19 nt, Homo sapiens
aagagaaucuguccaaggu

SEQ ID NO: 622590 - RNA, 19 nt, Homo sapiens
aauguaacccuaauccaua

SEQ ID NO: 622591 - RNA, 19 nt, Homo sapiens
gcagaggaugcagaauuua

SEQ ID NO: 622592 - RNA, 19 nt, Homo sapiens
ccagucucauugcuuagua

SEQ ID NO: 622593 - RNA, 19 nt, Homo sapiens
gaaggaagcgaggaugaau

SEQ ID NO: 622594 - RNA, 19 nt, Homo sapiens
ggaauacuuaggcuucauu

SEQ ID NO: 622595 - RNA, 19 nt, Homo sapiens
ugaaaagggucgacaagaa

SEQ ID NO: 622596 - RNA, 19 nt, Homo sapiens
aacaagagguugagauaag

SEQ ID NO: 622597 - RNA, 19 nt, Homo sapiens
gaaauguugaaccuaaaga

SEQ ID NO: 622598 - RNA, 19 nt, Homo sapiens
agaggauccuguagccaua

SEQ ID NO: 622599 - RNA, 19 nt, Homo sapiens
ugaauauccuguggacuug

SEQ ID NO: 622600 - RNA, 19 nt, Homo sapiens
auacuuaggcuucauucua

SEQ ID NO: 622601 - RNA, 19 nt, Homo sapiens
ggacaaagggagcguaaaa

SEQ ID NO: 622602 - RNA, 19 nt, Homo sapiens
ucacuucccgccucucuuu

SEQ ID NO: 622603 - RNA, 19 nt, Homo sapiens
gaaccuaucggcucuuugc

SEQ ID NO: 622604 - RNA, 19 nt, Homo sapiens
ccuuugagcccacauauau

SEQ ID NO: 622605 - RNA, 19 nt, Homo sapiens
caacacuuguaaauuugug

SEQ ID NO: 622606 - RNA, 19 nt, Homo sapiens
uaagaaaguggauuugauc

SEQ ID NO: 622607 - RNA, 19 nt, Homo sapiens
ucucuuuaguggcucuuua

SEQ ID NO: 622608 - RNA, 19 nt, Homo sapiens
gaagaacaaggugaaggaa

SEQ ID NO: 622609 - RNA, 19 nt, Homo sapiens
acagacuccugacaguuaa

SEQ ID NO: 622610 - RNA, 19 nt, Homo sapiens
caaaggccuuguacgucaa

SEQ ID NO: 622611 - RNA, 19 nt, Homo sapiens
gaugguaucacuaaagaag

SEQ ID NO: 622612 - RNA, 19 nt, Homo sapiens
aaacaagagguugagauaa

SEQ ID NO: 622613 - RNA, 19 nt, Homo sapiens
gaaucuguccaagguuaua

SEQ ID NO: 622614 - RNA, 19 nt, Homo sapiens
gauauccagucagacaaga

SEQ ID NO: 622615 - RNA, 19 nt, Homo sapiens
ugaguuuggugucgaugaa

SEQ ID NO: 622616 - RNA, 19 nt, Homo sapiens
aaauggacuucaugaggaa

SEQ ID NO: 622617 - RNA, 19 nt, Homo sapiens
gaggaauacuuaggcuuca

SEQ ID NO: 622618 - RNA, 19 nt, Homo sapiens
caugauagacagcuuuguu

SEQ ID NO: 622619 - RNA, 19 nt, Homo sapiens
uguaccaccugaugaaguu

SEQ ID NO: 622620 - RNA, 19 nt, Homo sapiens
caucaggucugugguuuac

SEQ ID NO: 622621 - RNA, 19 nt, Homo sapiens
gaauaucagagaauugagu

SEQ ID NO: 622622 - RNA, 19 nt, Homo sapiens
uugcagaguugcuggagaa

SEQ ID NO: 622623 - RNA, 19 nt, Homo sapiens
gaagggcuuguuccgguuu

SEQ ID NO: 622624 - RNA, 19 nt, Homo sapiens
gaugguggcgaugauagua

SEQ ID NO: 622625 - RNA, 19 nt, Homo sapiens
ucucauugcuuaguagaau

SEQ ID NO: 622626 - RNA, 19 nt, Homo sapiens
uaaaugccaccgaaccuau

SEQ ID NO: 622627 - RNA, 19 nt, Homo sapiens
aagaagagcaggaagaaca

SEQ ID NO: 622628 - RNA, 19 nt, Homo sapiens
gagcccacauauauuuaca

SEQ ID NO: 622629 - RNA, 19 nt, Homo sapiens
cgucaacacccaugauaga

SEQ ID NO: 622630 - RNA, 19 nt, Homo sapiens
gcaccagcaacaacacuug

SEQ ID NO: 622631 - RNA, 19 nt, Homo sapiens
gacaagaauaucagagaau

SEQ ID NO: 622632 - RNA, 19 nt, Homo sapiens
cgaguggaccugcuguaaa

SEQ ID NO: 622633 - RNA, 19 nt, Homo sapiens
gaggaugaaugggaacaag

SEQ ID NO: 622634 - RNA, 19 nt, Homo sapiens
ugaagaagagcaggaagaa

SEQ ID NO: 622635 - RNA, 19 nt, Homo sapiens
ggugggugccagaagcuua

SEQ ID NO: 622636 - RNA, 19 nt, Homo sapiens
caagaauaucagagaauug

SEQ ID NO: 622637 - RNA, 19 nt, Homo sapiens
ggcaagagaaucuguccaa

SEQ ID NO: 622638 - RNA, 19 nt, Homo sapiens
cagcagaguucaaaagaau

SEQ ID NO: 622639 - RNA, 19 nt, Homo sapiens
ggaugaaugggaacaagug

SEQ ID NO: 622640 - RNA, 19 nt, Homo sapiens
gaagaucaaugaccaguuu

SEQ ID NO: 622641 - RNA, 19 nt, Homo sapiens
caacacaacucuugaaaug

SEQ ID NO: 622642 - RNA, 19 nt, Homo sapiens
ugaaauacgugacuguuua

SEQ ID NO: 622643 - RNA, 19 nt, Homo sapiens
uaacuucaguccuuucuua

SEQ ID NO: 622644 - RNA, 19 nt, Homo sapiens
ggaaagggccuauguacua

SEQ ID NO: 622645 - RNA, 19 nt, Homo sapiens
ggaaauggcuccuucaucu

SEQ ID NO: 622646 - RNA, 19 nt, Homo sapiens
ggacaggacaguauagaua

SEQ ID NO: 622647 - RNA, 19 nt, Homo sapiens
aaauaaagcucaacgagaa

SEQ ID NO: 622648 - RNA, 19 nt, Homo sapiens
ggcaagccauuuaagauua

SEQ ID NO: 622649 - RNA, 19 nt, Homo sapiens
caaaggaacuauacacaau

SEQ ID NO: 622650 - RNA, 19 nt, Homo sapiens
ggaaauauagcauccauug

SEQ ID NO: 622651 - RNA, 19 nt, Homo sapiens
gaacagaaagagaaacuga

SEQ ID NO: 622652 - RNA, 19 nt, Homo sapiens
gaaagaagcacuuguaagg

SEQ ID NO: 622653 - RNA, 19 nt, Homo sapiens
ccacuagcauccacaagua

SEQ ID NO: 622654 - RNA, 19 nt, Homo sapiens
gaaacaagaagcugaagaa

SEQ ID NO: 622655 - RNA, 19 nt, Homo sapiens
gcacagcggcuacaacaaa

SEQ ID NO: 622656 - RNA, 19 nt, Homo sapiens
ggaauuucauuuacagcua

SEQ ID NO: 622657 - RNA, 19 nt, Homo sapiens
gcaacaaucuccucagagu

SEQ ID NO: 622658 - RNA, 19 nt, Homo sapiens
gaaagggccuauguacuau

SEQ ID NO: 622659 - RNA, 19 nt, Homo sapiens
gaacucagaggauugcuuu

SEQ ID NO: 622660 - RNA, 19 nt, Homo sapiens
aaagaaaccucagcaaaga

SEQ ID NO: 622661 - RNA, 19 nt, Homo sapiens
gaaagaagauaaagaaacc

SEQ ID NO: 622662 - RNA, 19 nt, Homo sapiens
gagcaacaaucuccucaga

SEQ ID NO: 622663 - RNA, 19 nt, Homo sapiens
gaagaaugcaggauuauca

SEQ ID NO: 622664 - RNA, 19 nt, Homo sapiens
gcagaagaaugcagauuag

SEQ ID NO: 622665 - RNA, 19 nt, Homo sapiens
gcaagacaacggugguuua

SEQ ID NO: 622666 - RNA, 19 nt, Homo sapiens
gauggcagguggaaacaaa

SEQ ID NO: 622667 - RNA, 19 nt, Homo sapiens
gaaggaagaacaagaacaa

SEQ ID NO: 622668 - RNA, 19 nt, Homo sapiens
acacaaugaugacggauaa

SEQ ID NO: 622669 - RNA, 19 nt, Homo sapiens
gcacuuguaaggaaauaua

SEQ ID NO: 622670 - RNA, 19 nt, Homo sapiens
gaaaguggaauucuaagga

SEQ ID NO: 622671 - RNA, 19 nt, Homo sapiens
aagaagaaauggagaagaa

SEQ ID NO: 622672 - RNA, 19 nt, Homo sapiens
gaacuauacacaaugauga

SEQ ID NO: 622673 - RNA, 19 nt, Homo sapiens
cuucguaacuuaggaaaua

SEQ ID NO: 622674 - RNA, 19 nt, Homo sapiens
uaaagaauguuccacagau

SEQ ID NO: 622675 - RNA, 19 nt, Homo sapiens
gauaaucggaagagauaua

SEQ ID NO: 622676 - RNA, 19 nt, Homo sapiens
gaacaugaaacuucugaug

SEQ ID NO: 622677 - RNA, 19 nt, Homo sapiens
ucaaaucgauguacauagu

SEQ ID NO: 622678 - RNA, 19 nt, Homo sapiens
caacggugguuuaaguuug

SEQ ID NO: 622679 - RNA, 19 nt, Homo sapiens
gacgauaccgaaagaaaua

SEQ ID NO: 622680 - RNA, 19 nt, Homo sapiens
guauuugucucuaccacua

SEQ ID NO: 622681 - RNA, 19 nt, Homo sapiens
ucagcaagauucacaagaa

SEQ ID NO: 622682 - RNA, 19 nt, Homo sapiens
gaagaggaagccaacagua

SEQ ID NO: 622683 - RNA, 19 nt, Homo sapiens
ugccaaagauuuacagauu

SEQ ID NO: 622684 - RNA, 19 nt, Homo sapiens
uauaauggaugcucgaaga

SEQ ID NO: 622685 - RNA, 19 nt, Homo sapiens
gcugaaagacucucugaaa

SEQ ID NO: 622686 - RNA, 19 nt, Homo sapiens
gauagaaaucuggaaguua

SEQ ID NO: 622687 - RNA, 19 nt, Homo sapiens
ggauugccuuagauuauuu

SEQ ID NO: 622688 - RNA, 19 nt, Homo sapiens
aaacugcucuucuaaugga

SEQ ID NO: 622689 - RNA, 19 nt, Homo sapiens
ugaguuaacuucaguccuu

SEQ ID NO: 622690 - RNA, 19 nt, Homo sapiens
uaaagcagauaggaaugua

SEQ ID NO: 622691 - RNA, 19 nt, Homo sapiens
caaauugccugaagagcau

SEQ ID NO: 622692 - RNA, 19 nt, Homo sapiens
aaaacuggcuccuuuguua

SEQ ID NO: 622693 - RNA, 19 nt, Homo sapiens
gcaaugagccuuugguuuu

SEQ ID NO: 622694 - RNA, 19 nt, Homo sapiens
cgaaagaaauaaagcucaa

SEQ ID NO: 622695 - RNA, 19 nt, Homo sapiens
gcaaaggaacuauacacaa

SEQ ID NO: 622696 - RNA, 19 nt, Homo sapiens
cgagaaggcuggcguuagu

SEQ ID NO: 622697 - RNA, 19 nt, Homo sapiens
ugaauacucuagaaugaug

SEQ ID NO: 622698 - RNA, 19 nt, Homo sapiens
agacaacggugguuuaagu

SEQ ID NO: 622699 - RNA, 19 nt, Homo sapiens
ucaagcaacagcaggauua

SEQ ID NO: 622700 - RNA, 19 nt, Homo sapiens
aagaagcacuuguaaggaa

SEQ ID NO: 622701 - RNA, 19 nt, Homo sapiens
uuagucugcuccaaaguua

SEQ ID NO: 622702 - RNA, 19 nt, Homo sapiens
cagcuuauauccucuuuua

SEQ ID NO: 622703 - RNA, 19 nt, Homo sapiens
gaagaggugucuaucucau

SEQ ID NO: 622704 - RNA, 19 nt, Homo sapiens
aaagacacauggaagaaga

SEQ ID NO: 622705 - RNA, 19 nt, Homo sapiens
gggccuauguacuauauau

SEQ ID NO: 622706 - RNA, 19 nt, Homo sapiens
gaagaaugcagauuagauc

SEQ ID NO: 622707 - RNA, 19 nt, Homo sapiens
gaaguuaccaccugugcuu

SEQ ID NO: 622708 - RNA, 19 nt, Homo sapiens
gccaacauguuauccuaaa

SEQ ID NO: 622709 - RNA, 19 nt, Homo sapiens
gaaauggagaagaaagaaa

SEQ ID NO: 622710 - RNA, 19 nt, Homo sapiens
gaauguggaguauguggua

SEQ ID NO: 622711 - RNA, 19 nt, Homo sapiens
aagcacaccugccagauga

SEQ ID NO: 622712 - RNA, 19 nt, Homo sapiens
guacaaaccaugagcaaca

SEQ ID NO: 622713 - RNA, 19 nt, Homo sapiens
gaaccuuucguuauuauca

SEQ ID NO: 622714 - RNA, 19 nt, Homo sapiens
gacaagagcacgaagugaa

SEQ ID NO: 622715 - RNA, 19 nt, Homo sapiens
uaaagaaaccucagcaaag

SEQ ID NO: 622716 - RNA, 19 nt, Homo sapiens
gaaugggaccacugaauau

SEQ ID NO: 622717 - RNA, 19 nt, Homo sapiens
gccaaagauuuacagauug

SEQ ID NO: 622718 - RNA, 19 nt, Homo sapiens
gcaggauuauuuccauuca

SEQ ID NO: 622719 - RNA, 19 nt, Homo sapiens
gaaaugacagggcaaagca

SEQ ID NO: 622720 - RNA, 19 nt, Homo sapiens
ucacagauaacaacagauu

SEQ ID NO: 622721 - RNA, 19 nt, Homo sapiens
cccaaucacuggaaccuuu

SEQ ID NO: 622722 - RNA, 19 nt, Homo sapiens
acaagaagcugaagaaaau

SEQ ID NO: 622723 - RNA, 19 nt, Homo sapiens
aaagaauguuccacagauu

SEQ ID NO: 622724 - RNA, 19 nt, Homo sapiens
acauuuggcugauuauuuc

SEQ ID NO: 622725 - RNA, 19 nt, Homo sapiens
gcagucaaauugccugaag

SEQ ID NO: 622726 - RNA, 19 nt, Homo sapiens
agaaugggaccacugaaua

SEQ ID NO: 622727 - RNA, 19 nt, Homo sapiens
gaaauacgugacuguuuau

SEQ ID NO: 622728 - RNA, 19 nt, Homo sapiens
gaggaaggaagaacaagaa

SEQ ID NO: 622729 - RNA, 19 nt, Homo sapiens
gcagcaagaggaacagaaa

SEQ ID NO: 622730 - RNA, 19 nt, Homo sapiens
ucacuuacagguaccauuu

SEQ ID NO: 622731 - RNA, 19 nt, Homo sapiens
cggaagagauauaaagaag

SEQ ID NO: 622732 - RNA, 19 nt, Homo sapiens
ucacuggaaccuuucguua

SEQ ID NO: 622733 - RNA, 19 nt, Homo sapiens
gacgccaccugcaucuaua

SEQ ID NO: 622734 - RNA, 19 nt, Homo sapiens
cagauuagaucgugaugag

SEQ ID NO: 622735 - RNA, 19 nt, Homo sapiens
gaagacagaaguuaaacca

SEQ ID NO: 622736 - RNA, 19 nt, Homo sapiens
cauaaggagacauagguua

SEQ ID NO: 622737 - RNA, 19 nt, Homo sapiens
caagacaacggugguuuaa

SEQ ID NO: 622738 - RNA, 19 nt, Homo sapiens
aauauagcauccauuguga

SEQ ID NO: 622739 - RNA, 19 nt, Homo sapiens
gaacaggccaagaaagaag

SEQ ID NO: 622740 - RNA, 19 nt, Homo sapiens
ggaaacagcuccagcaguu

SEQ ID NO: 622741 - RNA, 19 nt, Homo sapiens
gaaguugccuguugauaaa

SEQ ID NO: 622742 - RNA, 19 nt, Homo sapiens
guacauaucucuucuugau

SEQ ID NO: 622743 - RNA, 19 nt, Homo sapiens
gaacaaaucccagauggaa

SEQ ID NO: 622744 - RNA, 19 nt, Homo sapiens
gaggaagagugauucguuu

SEQ ID NO: 622745 - RNA, 19 nt, Homo sapiens
gauggaauguguauugaug

SEQ ID NO: 622746 - RNA, 19 nt, Homo sapiens
gaagagugauucguuuaga

SEQ ID NO: 622747 - RNA, 19 nt, Homo sapiens
gaaagaacaaucagcaguu

SEQ ID NO: 622748 - RNA, 19 nt, Homo sapiens
gcgaccaugucuuccauua

SEQ ID NO: 622749 - RNA, 19 nt, Homo sapiens
gggaagaauuacucugaaa

SEQ ID NO: 622750 - RNA, 19 nt, Homo sapiens
gaagaauuacucugaaaug

SEQ ID NO: 622751 - RNA, 19 nt, Homo sapiens
ggaaaagacuucaaacugu

SEQ ID NO: 622752 - RNA, 19 nt, Homo sapiens
gaacuggaaagaacaauca

SEQ ID NO: 622753 - RNA, 19 nt, Homo sapiens
gaccaugucuuccauuaag

SEQ ID NO: 622754 - RNA, 19 nt, Homo sapiens
ccauuaagauugagugugu

SEQ ID NO: 622755 - RNA, 19 nt, Homo sapiens
ugaaguugccuguugauaa

SEQ ID NO: 622756 - RNA, 19 nt, Homo sapiens
gaauugcucccuacuccua

SEQ ID NO: 622757 - RNA, 19 nt, Homo sapiens
aacaaucgcuucaaugaug

SEQ ID NO: 622758 - RNA, 19 nt, Homo sapiens
gagggaagaauuacucuga

SEQ ID NO: 622759 - RNA, 19 nt, Homo sapiens
ggaggaagagugauucguu

SEQ ID NO: 622760 - RNA, 19 nt, Homo sapiens
gcagaaguguuuacaagcu

SEQ ID NO: 622761 - RNA, 19 nt, Homo sapiens
gaagaacaaaucccagaug

SEQ ID NO: 622762 - RNA, 19 nt, Homo sapiens
acauaucucuucuugauuc

SEQ ID NO: 622763 - RNA, 19 nt, Homo sapiens
ggguacauaucucuucuug

SEQ ID NO: 622764 - RNA, 19 nt, Homo sapiens
ccagauggaauguguauug

SEQ ID NO: 622765 - RNA, 19 nt, Homo sapiens
ccaacucucugcucuuugu

SEQ ID NO: 622766 - RNA, 19 nt, Homo sapiens
cagaaguguuuacaagcua

SEQ ID NO: 622767 - RNA, 19 nt, Homo sapiens
cgaagaaucguucaacugu

SEQ ID NO: 622768 - RNA, 19 nt, Homo sapiens
cuuauaaggcuuucuguaa

SEQ ID NO: 622769 - RNA, 19 nt, Homo sapiens
aaagaacaaucagcaguug

SEQ ID NO: 622770 - RNA, 19 nt, Homo sapiens
guccaacucucugcucuuu

SEQ ID NO: 622771 - RNA, 19 nt, Homo sapiens
ggaagaauuacucugaaau

SEQ ID NO: 622772 - RNA, 19 nt, Homo sapiens
gaggcaggcucaaccuuca

SEQ ID NO: 622773 - RNA, 19 nt, Homo sapiens
cagcggcucuaccagauug

SEQ ID NO: 622774 - RNA, 19 nt, Homo sapiens
aagaaucguucaacuguca

SEQ ID NO: 622775 - RNA, 19 nt, Homo sapiens
ccgcagaaguguuuacaag

SEQ ID NO: 622776 - RNA, 19 nt, Homo sapiens
cagauggaauguguauuga

SEQ ID NO: 622777 - RNA, 19 nt, Homo sapiens
caccauggcugaggaaaca

SEQ ID NO: 622778 - RNA, 19 nt, Homo sapiens
aauaguaaccugguaauga

SEQ ID NO: 622779 - RNA, 19 nt, Homo sapiens
caggguggguggguacaua

SEQ ID NO: 622780 - RNA, 19 nt, Homo sapiens
gggaggaaguguccaacuc

SEQ ID NO: 622781 - RNA, 19 nt, Homo sapiens
ggaagagugauucguuuag

SEQ ID NO: 622782 - RNA, 19 nt, Homo sapiens
gauucugcauuucauacuu

SEQ ID NO: 622783 - RNA, 19 nt, Homo sapiens
gaggacaggucuucuuucc

SEQ ID NO: 622784 - RNA, 19 nt, Homo sapiens
gcuuuggagggaagaauua

SEQ ID NO: 622785 - RNA, 19 nt, Homo sapiens
gguggaauuuucaagauaa

SEQ ID NO: 622786 - RNA, 19 nt, Homo sapiens
uggaugccuuugacuauga

SEQ ID NO: 622787 - RNA, 19 nt, Homo sapiens
ccucuugauucuuuguaaa

SEQ ID NO: 622788 - RNA, 19 nt, Homo sapiens
acaaaucccagauggaaug

SEQ ID NO: 622789 - RNA, 19 nt, Homo sapiens
gcgaagaaucguucaacug

SEQ ID NO: 622790 - RNA, 19 nt, Homo sapiens
gaugaggacaggucuucuu

SEQ ID NO: 622791 - RNA, 19 nt, Homo sapiens
caauggaggaagagugauu

SEQ ID NO: 622792 - RNA, 19 nt, Homo sapiens
ggaagaacaaaucccagau

SEQ ID NO: 622793 - RNA, 19 nt, Homo sapiens
gggauucauucaccaagca

SEQ ID NO: 622794 - RNA, 19 nt, Homo sapiens
aagcuucaaggaacaauaa

SEQ ID NO: 622795 - RNA, 19 nt, Homo sapiens
acugugaaguugccuguug

SEQ ID NO: 622796 - RNA, 19 nt, Homo sapiens
accugaagcugguggaauu

SEQ ID NO: 622797 - RNA, 19 nt, Homo sapiens
gaggcuauguugccaccau

SEQ ID NO: 622798 - RNA, 19 nt, Homo sapiens
gccucuugauucuuuguaa

SEQ ID NO: 622799 - RNA, 19 nt, Homo sapiens
aaucccagauggaaugugu

SEQ ID NO: 622800 - RNA, 19 nt, Homo sapiens
guggaugccuuugacuaug

SEQ ID NO: 622801 - RNA, 19 nt, Homo sapiens
ugaagacaacuagagaauu

SEQ ID NO: 622802 - RNA, 19 nt, Homo sapiens
cgaccaugucuuccauuaa

SEQ ID NO: 622803 - RNA, 19 nt, Homo sapiens
uggguggccuguuacaaug

SEQ ID NO: 622804 - RNA, 19 nt, Homo sapiens
ggaggaaguguccaacucu

SEQ ID NO: 622805 - RNA, 19 nt, Homo sapiens
uacaauggaggaagaguga

SEQ ID NO: 622806 - RNA, 19 nt, Homo sapiens
aagagugauucguuuagau

SEQ ID NO: 622807 - RNA, 19 nt, Homo sapiens
aggaagagugauucguuua

SEQ ID NO: 622808 - RNA, 19 nt, Homo sapiens
gcccuguacucccucuuuc

SEQ ID NO: 622809 - RNA, 19 nt, Homo sapiens
agacaggacagaucuccaa

SEQ ID NO: 622810 - RNA, 19 nt, Homo sapiens
aaaacaaucgcuucaauga

SEQ ID NO: 622811 - RNA, 19 nt, Homo sapiens
auaguaaccugguaaugac

SEQ ID NO: 622812 - RNA, 19 nt, Homo sapiens
uauagaagggcgaagaauc

SEQ ID NO: 622813 - RNA, 19 nt, Homo sapiens
gggaaaagacuucaaacug

SEQ ID NO: 622814 - RNA, 19 nt, Homo sapiens
ucguuuagauccugugaca

SEQ ID NO: 622815 - RNA, 19 nt, Homo sapiens
uuguagacauuccugcaaa

SEQ ID NO: 622816 - RNA, 19 nt, Homo sapiens
cuacuccuaugcgggauga

SEQ ID NO: 622817 - RNA, 19 nt, Homo sapiens
uguggugagucuccaguau

SEQ ID NO: 622818 - RNA, 19 nt, Homo sapiens
gguggccuguuacaaugga

SEQ ID NO: 622819 - RNA, 19 nt, Homo sapiens
aaacaaucgcuucaaugau

SEQ ID NO: 622820 - RNA, 19 nt, Homo sapiens
ggagcucugaagacaacua

SEQ ID NO: 622821 - RNA, 19 nt, Homo sapiens
agggaagaauuacucugaa

SEQ ID NO: 622822 - RNA, 19 nt, Homo sapiens
gugaaguugccuguugaua

SEQ ID NO: 622823 - RNA, 19 nt, Homo sapiens
ggcgaagaaucguucaacu

SEQ ID NO: 622824 - RNA, 19 nt, Homo sapiens
gggaugaggacaggucuuc

SEQ ID NO: 622825 - RNA, 19 nt, Homo sapiens
acaacuucaugcugcuuug

SEQ ID NO: 622826 - RNA, 19 nt, Homo sapiens
uccaaccgcagaaguguuu

SEQ ID NO: 622827 - RNA, 19 nt, Homo sapiens
gaaacagcuccagcaguuc

SEQ ID NO: 622828 - RNA, 19 nt, Homo sapiens
gguggauaacgacaagaaa

SEQ ID NO: 622829 - RNA, 19 nt, Homo sapiens
ucucugcucuuuguagaca

SEQ ID NO: 622830 - RNA, 19 nt, Homo sapiens
ucuucuugauucugcauuu

SEQ ID NO: 622831 - RNA, 19 nt, Homo sapiens
gaaguguuuacaagcuaga

SEQ ID NO: 622832 - RNA, 19 nt, Homo sapiens
cguggaugccuuugacuau

SEQ ID NO: 622833 - RNA, 19 nt, Homo sapiens
aaacagcuccagcaguucu

SEQ ID NO: 622834 - RNA, 19 nt, Homo sapiens
ggugacaggugguuuugau

SEQ ID NO: 622835 - RNA, 19 nt, Homo sapiens
ggcccuguacucccucuuu

SEQ ID NO: 622836 - RNA, 19 nt, Homo sapiens
ugacaggugguuuugauaa

SEQ ID NO: 622837 - RNA, 19 nt, Homo sapiens
acucucugcucuuuguaga

SEQ ID NO: 622838 - RNA, 19 nt, Homo sapiens
cugugaaguugccuguuga

SEQ ID NO: 622839 - RNA, 19 nt, Homo sapiens
aagcaaguacagcgaguga

SEQ ID NO: 622840 - RNA, 19 nt, Homo sapiens
ggaaacagcuccagcaguu

SEQ ID NO: 622841 - RNA, 19 nt, Homo sapiens
gaaguugccuguugauaaa

SEQ ID NO: 622842 - RNA, 19 nt, Homo sapiens
guacauaucucuucuugau

SEQ ID NO: 622843 - RNA, 19 nt, Homo sapiens
gaacaaaucccagauggaa

SEQ ID NO: 622844 - RNA, 19 nt, Homo sapiens
gaggaagagugauucguuu

SEQ ID NO: 622845 - RNA, 19 nt, Homo sapiens
gauggaauguguauugaug

SEQ ID NO: 622846 - RNA, 19 nt, Homo sapiens
gaagagugauucguuuaga

SEQ ID NO: 622847 - RNA, 19 nt, Homo sapiens
gaaagaacaaucagcaguu

SEQ ID NO: 622848 - RNA, 19 nt, Homo sapiens
gcgaccaugucuuccauua

SEQ ID NO: 622849 - RNA, 19 nt, Homo sapiens
ugaaagaucauucgagaaa

SEQ ID NO: 622850 - RNA, 19 nt, Homo sapiens
gggaagaauuacucugaaa

SEQ ID NO: 622851 - RNA, 19 nt, Homo sapiens
gaagaauuacucugaaaug

SEQ ID NO: 622852 - RNA, 19 nt, Homo sapiens
ggaaaagacuucaaacugu

SEQ ID NO: 622853 - RNA, 19 nt, Homo sapiens
gaacuggaaagaacaauca

SEQ ID NO: 622854 - RNA, 19 nt, Homo sapiens
gaccaugucuuccauuaag

SEQ ID NO: 622855 - RNA, 19 nt, Homo sapiens
ccauuaagauugagugugu

SEQ ID NO: 622856 - RNA, 19 nt, Homo sapiens
ugaaguugccuguugauaa

SEQ ID NO: 622857 - RNA, 19 nt, Homo sapiens
gaauugcucccuacuccua

SEQ ID NO: 622858 - RNA, 19 nt, Homo sapiens
aacaaucgcuucaaugaug

SEQ ID NO: 622859 - RNA, 19 nt, Homo sapiens
gagggaagaauuacucuga

SEQ ID NO: 622860 - RNA, 19 nt, Homo sapiens
ggaggaagagugauucguu

SEQ ID NO: 622861 - RNA, 19 nt, Homo sapiens
gcagaaguguuuacaagcu

SEQ ID NO: 622862 - RNA, 19 nt, Homo sapiens
gaagaacaaaucccagaug

SEQ ID NO: 622863 - RNA, 19 nt, Homo sapiens
acauaucucuucuugauuc

SEQ ID NO: 622864 - RNA, 19 nt, Homo sapiens
ggguacauaucucuucuug

SEQ ID NO: 622865 - RNA, 19 nt, Homo sapiens
ccagauggaauguguauug

SEQ ID NO: 622866 - RNA, 19 nt, Homo sapiens
ccaacucucugcucuuugu

SEQ ID NO: 622867 - RNA, 19 nt, Homo sapiens
cagaaguguuuacaagcua

SEQ ID NO: 622868 - RNA, 19 nt, Homo sapiens
cgaagaaucguucaacugu

SEQ ID NO: 622869 - RNA, 19 nt, Homo sapiens
cuuauaaggcuuucuguaa

SEQ ID NO: 622870 - RNA, 19 nt, Homo sapiens
aaagaacaaucagcaguug

SEQ ID NO: 622871 - RNA, 19 nt, Homo sapiens
guccaacucucugcucuuu

SEQ ID NO: 622872 - RNA, 19 nt, Homo sapiens
ggaagaauuacucugaaau

SEQ ID NO: 622873 - RNA, 19 nt, Homo sapiens
aaagaucauucgagaaaca

SEQ ID NO: 622874 - RNA, 19 nt, Homo sapiens
aagaaucguucaacuguca

SEQ ID NO: 622875 - RNA, 19 nt, Homo sapiens
gagaaacacgucacugauc

SEQ ID NO: 622876 - RNA, 19 nt, Homo sapiens
ccgcagaaguguuuacaag

SEQ ID NO: 622877 - RNA, 19 nt, Homo sapiens
cagauggaauguguauuga

SEQ ID NO: 622878 - RNA, 19 nt, Homo sapiens
caccauggcugaggaaaca

SEQ ID NO: 622879 - RNA, 19 nt, Homo sapiens
aauaguaaccugguaauga

SEQ ID NO: 622880 - RNA, 19 nt, Homo sapiens
caggguggguggguacaua

SEQ ID NO: 622881 - RNA, 19 nt, Homo sapiens
gggaggaaguguccaacuc

SEQ ID NO: 622882 - RNA, 19 nt, Homo sapiens
gaaagaucauucgagaaac

SEQ ID NO: 622883 - RNA, 19 nt, Homo sapiens
ggaagagugauucguuuag

SEQ ID NO: 622884 - RNA, 19 nt, Homo sapiens
agaaacacgucacugaucu

SEQ ID NO: 622885 - RNA, 19 nt, Homo sapiens
gauucugcauuucauacuu

SEQ ID NO: 622886 - RNA, 19 nt, Homo sapiens
gaggacaggucuucuuucc

SEQ ID NO: 622887 - RNA, 19 nt, Homo sapiens
gcuuuggagggaagaauua

SEQ ID NO: 622888 - RNA, 19 nt, Homo sapiens
gguggaauuuucaagauaa

SEQ ID NO: 622889 - RNA, 19 nt, Homo sapiens
uggaugccuuugacuauga

SEQ ID NO: 622890 - RNA, 19 nt, Homo sapiens
ccucuugauucuuuguaaa

SEQ ID NO: 622891 - RNA, 19 nt, Homo sapiens
acaaaucccagauggaaug

SEQ ID NO: 622892 - RNA, 19 nt, Homo sapiens
gcgaagaaucguucaacug

SEQ ID NO: 622893 - RNA, 19 nt, Homo sapiens
gaugaggacaggucuucuu

SEQ ID NO: 622894 - RNA, 19 nt, Homo sapiens
caauggaggaagagugauu

SEQ ID NO: 622895 - RNA, 19 nt, Homo sapiens
ggaagaacaaaucccagau

SEQ ID NO: 622896 - RNA, 19 nt, Homo sapiens
gggauucauucaccaagca

SEQ ID NO: 622897 - RNA, 19 nt, Homo sapiens
aagcuucaaggaacaauaa

SEQ ID NO: 622898 - RNA, 19 nt, Homo sapiens
acugugaaguugccuguug

SEQ ID NO: 622899 - RNA, 19 nt, Homo sapiens
accugaagcugguggaauu

SEQ ID NO: 622900 - RNA, 19 nt, Homo sapiens
gaggcuauguugccaccau

SEQ ID NO: 622901 - RNA, 19 nt, Homo sapiens
gccucuugauucuuuguaa

SEQ ID NO: 622902 - RNA, 19 nt, Homo sapiens
ucgagaaacacgucacuga

SEQ ID NO: 622903 - RNA, 19 nt, Homo sapiens
aaucccagauggaaugugu

SEQ ID NO: 622904 - RNA, 19 nt, Homo sapiens
guggaugccuuugacuaug

SEQ ID NO: 622905 - RNA, 19 nt, Homo sapiens
ugaagacaacuagagaauu

SEQ ID NO: 622906 - RNA, 19 nt, Homo sapiens
ggaggaaguguccaacucu

SEQ ID NO: 622907 - RNA, 19 nt, Homo sapiens
uggguggccuguuacaaug

SEQ ID NO: 622908 - RNA, 19 nt, Homo sapiens
cgaccaugucuuccauuaa

SEQ ID NO: 622909 - RNA, 19 nt, Homo sapiens
cgagaaacacgucacugau

SEQ ID NO: 622910 - RNA, 19 nt, Homo sapiens
uacaauggaggaagaguga

SEQ ID NO: 622911 - RNA, 19 nt, Homo sapiens
aagagugauucguuuagau

SEQ ID NO: 622912 - RNA, 19 nt, Homo sapiens
aggaagagugauucguuua

SEQ ID NO: 622913 - RNA, 19 nt, Homo sapiens
gcccuguacucccucuuuc

SEQ ID NO: 622914 - RNA, 19 nt, Homo sapiens
agacaggacagaucuccaa

SEQ ID NO: 622915 - RNA, 19 nt, Homo sapiens
aaaacaaucgcuucaauga

SEQ ID NO: 622916 - RNA, 19 nt, Homo sapiens
auaguaaccugguaaugac

SEQ ID NO: 622917 - RNA, 19 nt, Homo sapiens
ggaguggaggucagagugu

SEQ ID NO: 622918 - RNA, 19 nt, Homo sapiens
uauagaagggcgaagaauc

SEQ ID NO: 622919 - RNA, 19 nt, Homo sapiens
uuguagacauuccugcaaa

SEQ ID NO: 622920 - RNA, 19 nt, Homo sapiens
gggaaaagacuucaaacug

SEQ ID NO: 622921 - RNA, 19 nt, Homo sapiens
ucguuuagauccugugaca

SEQ ID NO: 622922 - RNA, 19 nt, Homo sapiens
uguggugagucuccaguau

SEQ ID NO: 622923 - RNA, 19 nt, Homo sapiens
cuacuccuaugcgggauga

SEQ ID NO: 622924 - RNA, 19 nt, Homo sapiens
gguggccuguuacaaugga

SEQ ID NO: 622925 - RNA, 19 nt, Homo sapiens
aaacaaucgcuucaaugau

SEQ ID NO: 622926 - RNA, 19 nt, Homo sapiens
ggagcucugaagacaacua

SEQ ID NO: 622927 - RNA, 19 nt, Homo sapiens
agggaagaauuacucugaa

SEQ ID NO: 622928 - RNA, 19 nt, Homo sapiens
gugaaguugccuguugaua

SEQ ID NO: 622929 - RNA, 19 nt, Homo sapiens
ggcgaagaaucguucaacu

SEQ ID NO: 622930 - RNA, 19 nt, Homo sapiens
gggaugaggacaggucuuc

SEQ ID NO: 622931 - RNA, 19 nt, Homo sapiens
acaacuucaugcugcuuug

SEQ ID NO: 622932 - RNA, 19 nt, Homo sapiens
uccaaccgcagaaguguuu

SEQ ID NO: 622933 - RNA, 19 nt, Homo sapiens
gaaacagcuccagcaguuc

SEQ ID NO: 622934 - RNA, 19 nt, Homo sapiens
gguggauaacgacaagaaa

SEQ ID NO: 622935 - RNA, 19 nt, Homo sapiens
ucucugcucuuuguagaca

SEQ ID NO: 622936 - RNA, 19 nt, Homo sapiens
ucuucuugauucugcauuu

SEQ ID NO: 622937 - RNA, 19 nt, Homo sapiens
gaaguguuuacaagcuaga

SEQ ID NO: 622938 - RNA, 19 nt, Homo sapiens
cguggaugccuuugacuau

SEQ ID NO: 622939 - RNA, 19 nt, Homo sapiens
aaacagcuccagcaguucu

SEQ ID NO: 622940 - RNA, 19 nt, Homo sapiens
gaaagagauugccaugaua

SEQ ID NO: 622941 - RNA, 19 nt, Homo sapiens
gaacauguaccaucaguuu

SEQ ID NO: 622942 - RNA, 19 nt, Homo sapiens
uaucaaagcuguuauggau

SEQ ID NO: 622943 - RNA, 19 nt, Homo sapiens
gagauugccaugauauuua

SEQ ID NO: 622944 - RNA, 19 nt, Homo sapiens
ggaagucaauggcacuaaa

SEQ ID NO: 622945 - RNA, 19 nt, Homo sapiens
ggaggaacauguaccauca

SEQ ID NO: 622946 - RNA, 19 nt, Homo sapiens
ucucacagauuuacaguuu

SEQ ID NO: 622947 - RNA, 19 nt, Homo sapiens
aaagaaaccuggauauuac

SEQ ID NO: 622948 - RNA, 19 nt, Homo sapiens
ggacauaaauuuucagaga

SEQ ID NO: 622949 - RNA, 19 nt, Homo sapiens
gauaggacuucccagguuu

SEQ ID NO: 622950 - RNA, 19 nt, Homo sapiens
ggauaggacuucccagguu

SEQ ID NO: 622951 - RNA, 19 nt, Homo sapiens
ggaagucucaccaguguuu

SEQ ID NO: 622952 - RNA, 19 nt, Homo sapiens
guacuuaaauccucucuac

SEQ ID NO: 622953 - RNA, 19 nt, Homo sapiens
gguccagccuucagaaauu

SEQ ID NO: 622954 - RNA, 19 nt, Homo sapiens
uaaggaggcugccauuugu

SEQ ID NO: 622955 - RNA, 19 nt, Homo sapiens
agaaagagauugccaugau

SEQ ID NO: 622956 - RNA, 19 nt, Homo sapiens
uaaauccucucuacaguuc

SEQ ID NO: 622957 - RNA, 19 nt, Homo sapiens
gaaauugucccaaggaaag

SEQ ID NO: 622958 - RNA, 19 nt, Homo sapiens
ugaaucaccuaaccucaaa

SEQ ID NO: 622959 - RNA, 19 nt, Homo sapiens
ccacaagccuuugaauuca

SEQ ID NO: 622960 - RNA, 19 nt, Homo sapiens
gcauuugaccgaacaguuu

SEQ ID NO: 622961 - RNA, 19 nt, Homo sapiens
ccaaagcaauaacaguuga

SEQ ID NO: 622962 - RNA, 19 nt, Homo sapiens
gaacugugcauuucauugu

SEQ ID NO: 622963 - RNA, 19 nt, Homo sapiens
ggcuacacaucuauuauuu

SEQ ID NO: 622964 - RNA, 19 nt, Homo sapiens
gcaagaacuucagaacugu

SEQ ID NO: 622965 - RNA, 19 nt, Homo sapiens
gaagaucucuaugcauuuu

SEQ ID NO: 622966 - RNA, 19 nt, Homo sapiens
gaucgaacacugcauccua

SEQ ID NO: 622967 - RNA, 19 nt, Homo sapiens
gauagcaagcaaaccaaua

SEQ ID NO: 622968 - RNA, 19 nt, Homo sapiens
gcaagugugucggugcauu

SEQ ID NO: 622969 - RNA, 19 nt, Homo sapiens
ugaaggagaagacuuauuc

SEQ ID NO: 622970 - RNA, 19 nt, Homo sapiens
ggaaauugucccaaggaaa

SEQ ID NO: 622971 - RNA, 19 nt, Homo sapiens
augaagaucucuaugcauu

SEQ ID NO: 622972 - RNA, 19 nt, Homo sapiens
uuacaacucuuugcuacaa

SEQ ID NO: 622973 - RNA, 19 nt, Homo sapiens
ugaauaugcagaagaguuu

SEQ ID NO: 622974 - RNA, 19 nt, Homo sapiens
ggacuucccagguuuguuc

SEQ ID NO: 622975 - RNA, 19 nt, Homo sapiens
caacagagcagcuggaaaa

SEQ ID NO: 622976 - RNA, 19 nt, Homo sapiens
ccuaggcagucuguauuua

SEQ ID NO: 622977 - RNA, 19 nt, Homo sapiens
guccagccuucagaaauua

SEQ ID NO: 622978 - RNA, 19 nt, Homo sapiens
caaccgggacuacaagauu

SEQ ID NO: 622979 - RNA, 19 nt, Homo sapiens
aaacuugcuuugacuacuu

SEQ ID NO: 622980 - RNA, 19 nt, Homo sapiens
guagagaaacuugcuuuga

SEQ ID NO: 622981 - RNA, 19 nt, Homo sapiens
uaaagccaauccagucaau

SEQ ID NO: 622982 - RNA, 19 nt, Homo sapiens
cauauugccucaguagaga

SEQ ID NO: 622983 - RNA, 19 nt, Homo sapiens
ggaaagagaagagcucaag

SEQ ID NO: 622984 - RNA, 19 nt, Homo sapiens
ucagauccaugagcauauu

SEQ ID NO: 622985 - RNA, 19 nt, Homo sapiens
ggccaaagcaauaacaguu

SEQ ID NO: 622986 - RNA, 19 nt, Homo sapiens
ugcaagaacuucagaacug

SEQ ID NO: 622987 - RNA, 19 nt, Homo sapiens
aaagagaagagcucaaguu

SEQ ID NO: 622988 - RNA, 19 nt, Homo sapiens
ccuggaggaugaacauuug

SEQ ID NO: 622989 - RNA, 19 nt, Homo sapiens
gccaugauauuuacaacuc

SEQ ID NO: 622990 - RNA, 19 nt, Homo sapiens
uuacucaguucuuggaaug

SEQ ID NO: 622991 - RNA, 19 nt, Homo sapiens
agagagguguggccaguug

SEQ ID NO: 622992 - RNA, 19 nt, Homo sapiens
ggcuuucugucaaugauuu

SEQ ID NO: 622993 - RNA, 19 nt, Homo sapiens
ggucgaacaaguaaaauua

SEQ ID NO: 622994 - RNA, 19 nt, Homo sapiens
caagauuugugaaacuuac

SEQ ID NO: 622995 - RNA, 19 nt, Homo sapiens
cuucagaacugugcauuuc

SEQ ID NO: 622996 - RNA, 19 nt, Homo sapiens
caggaacacuguaucuuac

SEQ ID NO: 622997 - RNA, 19 nt, Homo sapiens
gaaacuugcuuugacuacu

SEQ ID NO: 622998 - RNA, 19 nt, Homo sapiens
gagaaacuugcuuugacua

SEQ ID NO: 622999 - RNA, 19 nt, Homo sapiens
gauuucaguuuguuggaau

SEQ ID NO: 623000 - RNA, 19 nt, Homo sapiens
uagagaaacuugcuuugac

SEQ ID NO: 623001 - RNA, 19 nt, Homo sapiens
aaggaagucucaccagugu

SEQ ID NO: 623002 - RNA, 19 nt, Homo sapiens
gauaaggaggcugccauuu

SEQ ID NO: 623003 - RNA, 19 nt, Homo sapiens
ucccaguucuuuccuacua

SEQ ID NO: 623004 - RNA, 19 nt, Homo sapiens
gaaaaggauuggaucucuu

SEQ ID NO: 623005 - RNA, 19 nt, Homo sapiens
ggaaaagguuaugaaaaug

SEQ ID NO: 623006 - RNA, 19 nt, Homo sapiens
aaccgggacuacaagauuu

SEQ ID NO: 623007 - RNA, 19 nt, Homo sapiens
guaaaugaugcucuucgaa

SEQ ID NO: 623008 - RNA, 19 nt, Homo sapiens
aagcauuucuucuucagau

SEQ ID NO: 623009 - RNA, 19 nt, Homo sapiens
uauggaugcugcagucuuc

SEQ ID NO: 623010 - RNA, 19 nt, Homo sapiens
ugaucucgcugaggaauau

SEQ ID NO: 623011 - RNA, 19 nt, Homo sapiens
accaaggaauuguuacauu

SEQ ID NO: 623012 - RNA, 19 nt, Homo sapiens
cuucuuggccaaagcaaua

SEQ ID NO: 623013 - RNA, 19 nt, Homo sapiens
ucaguuuguuggaauugaa

SEQ ID NO: 623014 - RNA, 19 nt, Homo sapiens
auaaggaggcugccauuug

SEQ ID NO: 623015 - RNA, 19 nt, Homo sapiens
gagaaagagauugccauga

SEQ ID NO: 623016 - RNA, 19 nt, Homo sapiens
gugaauaugcagaagaguu

SEQ ID NO: 623017 - RNA, 19 nt, Homo sapiens
cuaggcagucuguauuuaa

SEQ ID NO: 623018 - RNA, 19 nt, Homo sapiens
aucaaaggauucaugguuu

SEQ ID NO: 623019 - RNA, 19 nt, Homo sapiens
aaagagauugccaugauau

SEQ ID NO: 623020 - RNA, 19 nt, Homo sapiens
ucagaacugugcauuucau

SEQ ID NO: 623021 - RNA, 19 nt, Homo sapiens
uuuaucgacucucaucaaa

SEQ ID NO: 623022 - RNA, 19 nt, Homo sapiens
ccucaccaaggaauuguua

SEQ ID NO: 623023 - RNA, 19 nt, Homo sapiens
uaggcagucuguauuuaau

SEQ ID NO: 623024 - RNA, 19 nt, Homo sapiens
gaagucucaccaguguuua

SEQ ID NO: 623025 - RNA, 19 nt, Homo sapiens
cagaaauuauuggaaguca

SEQ ID NO: 623026 - RNA, 19 nt, Homo sapiens
gcugccauuugucgaugua

SEQ ID NO: 623027 - RNA, 19 nt, Homo sapiens
agagauugccaugauauuu

SEQ ID NO: 623028 - RNA, 19 nt, Homo sapiens
ccaccauauugccucagua

SEQ ID NO: 623029 - RNA, 19 nt, Homo sapiens
aagagaagagcucaaguug

SEQ ID NO: 623030 - RNA, 19 nt, Homo sapiens
gaaagagaagagcucaagu

SEQ ID NO: 623031 - RNA, 19 nt, Homo sapiens
caccaguguuuacucaguu

SEQ ID NO: 623032 - RNA, 19 nt, Homo sapiens
ggccaaaacugaaugcaau

SEQ ID NO: 623033 - RNA, 19 nt, Homo sapiens
auagcaagcaaaccaauaa

SEQ ID NO: 623034 - RNA, 19 nt, Homo sapiens
ccucaaaacuucccugugu

SEQ ID NO: 623035 - RNA, 19 nt, Homo sapiens
gaagucaauggcacuaaag

SEQ ID NO: 623036 - RNA, 19 nt, Homo sapiens
guggucagcuuagaguaug

SEQ ID NO: 623037 - RNA, 19 nt, Homo sapiens
cguaaaugaugcucuucga

SEQ ID NO: 623038 - RNA, 19 nt, Homo sapiens
ucacagauuuacaguuuug

SEQ ID NO: 623039 - RNA, 19 nt, Homo sapiens
ucaaaggauucaugguuuu

SEQ ID NO: 623040 - RNA, 19 nt, Homo sapiens
gcaagaggccaaacaguaa

SEQ ID NO: 623041 - RNA, 19 nt, Homo sapiens
cagcauagguuacggcaaa

SEQ ID NO: 623042 - RNA, 19 nt, Homo sapiens
caauaaaccuuucaagagu

SEQ ID NO: 623043 - RNA, 19 nt, Homo sapiens
ccaaauggcugcagcacuu

SEQ ID NO: 623044 - RNA, 19 nt, Homo sapiens
caacagcaacuacaaauug

SEQ ID NO: 623045 - RNA, 19 nt, Homo sapiens
uaacaagugugauggaguu

SEQ ID NO: 623046 - RNA, 19 nt, Homo sapiens
aaacauggaucuuuaccuu

SEQ ID NO: 623047 - RNA, 19 nt, Homo sapiens
gcaauaaaccuuucaagag

SEQ ID NO: 623048 - RNA, 19 nt, Homo sapiens
ggagagccgugauauguuc

SEQ ID NO: 623049 - RNA, 19 nt, Homo sapiens
ccaaggaacuagugaagga

SEQ ID NO: 623050 - RNA, 19 nt, Homo sapiens
gagagaagcgcaacaucua

SEQ ID NO: 623051 - RNA, 19 nt, Homo sapiens
aaagacuacuugagcaaua

SEQ ID NO: 623052 - RNA, 19 nt, Homo sapiens
gcugguggcuaauacagua

SEQ ID NO: 623053 - RNA, 19 nt, Homo sapiens
gagagaaggugugaaguca

SEQ ID NO: 623054 - RNA, 19 nt, Homo sapiens
acaaagagcuggagaacgu

SEQ ID NO: 623055 - RNA, 19 nt, Homo sapiens
gaagucaccugucuguucu

SEQ ID NO: 623056 - RNA, 19 nt, Homo sapiens
uaauaggaaugggcaguua

SEQ ID NO: 623057 - RNA, 19 nt, Homo sapiens
gcaagucucuagcacaaag

SEQ ID NO: 623058 - RNA, 19 nt, Homo sapiens
gggaaccuguugauaagaa

SEQ ID NO: 623059 - RNA, 19 nt, Homo sapiens
gcugggaaccuguugauaa

SEQ ID NO: 623060 - RNA, 19 nt, Homo sapiens
gaaauugugggaauguauu

SEQ ID NO: 623061 - RNA, 19 nt, Homo sapiens
ucuccaaggucauuucuaa

SEQ ID NO: 623062 - RNA, 19 nt, Homo sapiens
aaauauuacuggacccaua

SEQ ID NO: 623063 - RNA, 19 nt, Homo sapiens
gaagaaacccauugcuaca

SEQ ID NO: 623064 - RNA, 19 nt, Homo sapiens
gaagacaccauugcagaaa

SEQ ID NO: 623065 - RNA, 19 nt, Homo sapiens
guuacaaacugcuuaauac

SEQ ID NO: 623066 - RNA, 19 nt, Homo sapiens
gaaagagacugaggugacu

SEQ ID NO: 623067 - RNA, 19 nt, Homo sapiens
ggaaugggcaguuauugga

SEQ ID NO: 623068 - RNA, 19 nt, Homo sapiens
ggagccaccugaacauugu

SEQ ID NO: 623069 - RNA, 19 nt, Homo sapiens
gcaaugcugaugaugagua

SEQ ID NO: 623070 - RNA, 19 nt, Homo sapiens
ggaggaagacauugguaaa

SEQ ID NO: 623071 - RNA, 19 nt, Homo sapiens
gugauggaguuuguaauuu

SEQ ID NO: 623072 - RNA, 19 nt, Homo sapiens
ucagcaaacuguaggagaa

SEQ ID NO: 623073 - RNA, 19 nt, Homo sapiens
ggagggcuuccaaguguua

SEQ ID NO: 623074 - RNA, 19 nt, Homo sapiens
gaguggcucucacggcuaa

SEQ ID NO: 623075 - RNA, 19 nt, Homo sapiens
gcacugacuuccucaacca

SEQ ID NO: 623076 - RNA, 19 nt, Homo sapiens
gcaccuuccuggccaacaa

SEQ ID NO: 623077 - RNA, 19 nt, Homo sapiens
ggucauuucuaacaagugu

SEQ ID NO: 623078 - RNA, 19 nt, Homo sapiens
gaucaaaguccuagaagag

SEQ ID NO: 623079 - RNA, 19 nt, Homo sapiens
gaucguagcccuggccaaa

SEQ ID NO: 623080 - RNA, 19 nt, Homo sapiens
uauagacacuugcgcaaug

SEQ ID NO: 623081 - RNA, 19 nt, Homo sapiens
ggaaccuguugauaagaaa

SEQ ID NO: 623082 - RNA, 19 nt, Homo sapiens
ggagucagauggcagugau

SEQ ID NO: 623083 - RNA, 19 nt, Homo sapiens
caagugugauggaguuugu

SEQ ID NO: 623084 - RNA, 19 nt, Homo sapiens
gaagaguacuaucccaacu

SEQ ID NO: 623085 - RNA, 19 nt, Homo sapiens
guauuuggaugaugaugga

SEQ ID NO: 623086 - RNA, 19 nt, Homo sapiens
agacaccauugcagaaauu

SEQ ID NO: 623087 - RNA, 19 nt, Homo sapiens
gaagcaggguacaaacaag

SEQ ID NO: 623088 - RNA, 19 nt, Homo sapiens
ccacugaacugcccuucuc

SEQ ID NO: 623089 - RNA, 19 nt, Homo sapiens
ccaaggucauuucuaacaa

SEQ ID NO: 623090 - RNA, 19 nt, Homo sapiens
caaggacucugucaucaac

SEQ ID NO: 623091 - RNA, 19 nt, Homo sapiens
aagcaagucucuagcacaa

SEQ ID NO: 623092 - RNA, 19 nt, Homo sapiens
ccagugggcucagagagaa

SEQ ID NO: 623093 - RNA, 19 nt, Homo sapiens
guacauccagugacccuaa

SEQ ID NO: 623094 - RNA, 19 nt, Homo sapiens
gcgcaaugcugaugaugag

SEQ ID NO: 623095 - RNA, 19 nt, Homo sapiens
ccagcacacucaccuaugu

SEQ ID NO: 623096 - RNA, 19 nt, Homo sapiens
gaagacugccuuucagaag

SEQ ID NO: 623097 - RNA, 19 nt, Homo sapiens
uaacugugacugugaauuc

SEQ ID NO: 623098 - RNA, 19 nt, Homo sapiens
ucauugccaucucuaacua

SEQ ID NO: 623099 - RNA, 19 nt, Homo sapiens
ccuucgagcuggcaauaaa

SEQ ID NO: 623100 - RNA, 19 nt, Homo sapiens
gaagcggauucccgugguu

SEQ ID NO: 623101 - RNA, 19 nt, Homo sapiens
caaagcccguuccacugaa

SEQ ID NO: 623102 - RNA, 19 nt, Homo sapiens
gaggaaagaaccagaugug

SEQ ID NO: 623103 - RNA, 19 nt, Homo sapiens
ggaagacauugguaaaaga

SEQ ID NO: 623104 - RNA, 19 nt, Homo sapiens
acauggaucuuuaccuuuc

SEQ ID NO: 623105 - RNA, 19 nt, Homo sapiens
aagcggaccugcucugugu

SEQ ID NO: 623106 - RNA, 19 nt, Homo sapiens
gccgugauauguuccaguu

SEQ ID NO: 623107 - RNA, 19 nt, Homo sapiens
cagaaauugugggaaugua

SEQ ID NO: 623108 - RNA, 19 nt, Homo sapiens
gcaucacacugcuauaacu

SEQ ID NO: 623109 - RNA, 19 nt, Homo sapiens
ggauucccgugguugugua

SEQ ID NO: 623110 - RNA, 19 nt, Homo sapiens
ucaccugucuguucuaguc

SEQ ID NO: 623111 - RNA, 19 nt, Homo sapiens
gggaggaagacauugguaa

SEQ ID NO: 623112 - RNA, 19 nt, Homo sapiens
caaggucauuucuaacaag

SEQ ID NO: 623113 - RNA, 19 nt, Homo sapiens
uuucauaacuuccucuaca

SEQ ID NO: 623114 - RNA, 19 nt, Homo sapiens
guggaucacugacaaagag

SEQ ID NO: 623115 - RNA, 19 nt, Homo sapiens
gccaacagcugaagaaacc

SEQ ID NO: 623116 - RNA, 19 nt, Homo sapiens
gaaagacuacuugagcaau

SEQ ID NO: 623117 - RNA, 19 nt, Homo sapiens
gcacuugucggugaugcua

SEQ ID NO: 623118 - RNA, 19 nt, Homo sapiens
ggcgugugaugcugacuuu

SEQ ID NO: 623119 - RNA, 19 nt, Homo sapiens
gcccauuccugaucagcaa

SEQ ID NO: 623120 - RNA, 19 nt, Homo sapiens
ugaagucaccugucuguuc

SEQ ID NO: 623121 - RNA, 19 nt, Homo sapiens
cacaaaagcuguucuccaa

SEQ ID NO: 623122 - RNA, 19 nt, Homo sapiens
ccagugacccuaaccugaa

SEQ ID NO: 623123 - RNA, 19 nt, Homo sapiens
acaaagcccguuccacuga

SEQ ID NO: 623124 - RNA, 19 nt, Homo sapiens
uaaccugaauaaccacugu

SEQ ID NO: 623125 - RNA, 19 nt, Homo sapiens
ucagccaggugagcacaua

SEQ ID NO: 623126 - RNA, 19 nt, Homo sapiens
cgaagacaccauugcagaa

SEQ ID NO: 623127 - RNA, 19 nt, Homo sapiens
guggagagccgugauaugu

SEQ ID NO: 623128 - RNA, 19 nt, Homo sapiens
ucagugcacucuccaaggu

SEQ ID NO: 623129 - RNA, 19 nt, Homo sapiens
ccugaacauuguccugaaa

SEQ ID NO: 623130 - RNA, 19 nt, Homo sapiens
aagacuacuugagcaauaa

SEQ ID NO: 623131 - RNA, 19 nt, Homo sapiens
gcacuggagaguaccaaau

SEQ ID NO: 623132 - RNA, 19 nt, Homo sapiens
aggcggagcuugcaaggau

SEQ ID NO: 623133 - RNA, 19 nt, Homo sapiens
gcuauaacugugacuguga

SEQ ID NO: 623134 - RNA, 19 nt, Homo sapiens
cgaagcaggguacaaacaa

SEQ ID NO: 623135 - RNA, 19 nt, Homo sapiens
gaaugggcaguuauuggaa

SEQ ID NO: 623136 - RNA, 19 nt, Homo sapiens
cagggucuguggcaaguau

SEQ ID NO: 623137 - RNA, 19 nt, Homo sapiens
uccaguggcuugauucugu

SEQ ID NO: 623138 - RNA, 19 nt, Homo sapiens
gguggaggcugugaaugug

SEQ ID NO: 623139 - RNA, 19 nt, Homo sapiens
gacuuugauucuucucuga

SEQ ID NO: 623140 - RNA, 19 nt, Homo sapiens
gaaaguuccuuaugagaua

SEQ ID NO: 623141 - RNA, 19 nt, Homo sapiens
gaauggagguggagaagua

SEQ ID NO: 623142 - RNA, 19 nt, Homo sapiens
ccaaagaauuccagauuaa

SEQ ID NO: 623143 - RNA, 19 nt, Homo sapiens
caagugagcucgaaaguuc

SEQ ID NO: 623144 - RNA, 19 nt, Homo sapiens
gcucgaaaguuccuuauga

SEQ ID NO: 623145 - RNA, 19 nt, Homo sapiens
ggagucagauuccagguuu

SEQ ID NO: 623146 - RNA, 19 nt, Homo sapiens
gcacuuaucaccuuugaaa

SEQ ID NO: 623147 - RNA, 19 nt, Homo sapiens
cauggaagcugauaaagau

SEQ ID NO: 623148 - RNA, 19 nt, Homo sapiens
ucacauagcauacuuugaa

SEQ ID NO: 623149 - RNA, 19 nt, Homo sapiens
gacaagcacuuaucaccuu

SEQ ID NO: 623150 - RNA, 19 nt, Homo sapiens
acaagaggcuaccaaagaa

SEQ ID NO: 623151 - RNA, 19 nt, Homo sapiens
gaauagacuuaacagaauc

SEQ ID NO: 623152 - RNA, 19 nt, Homo sapiens
caaauggugcugcauguuu

SEQ ID NO: 623153 - RNA, 19 nt, Homo sapiens
ugauaaagaugacacacaa

SEQ ID NO: 623154 - RNA, 19 nt, Homo sapiens
acacagaaauacacuugaa

SEQ ID NO: 623155 - RNA, 19 nt, Homo sapiens
gaguuacuguuucuccaua

SEQ ID NO: 623156 - RNA, 19 nt, Homo sapiens
ggagugcagucaucacguu

SEQ ID NO: 623157 - RNA, 19 nt, Homo sapiens
ucaaauaucuccuguucgu

SEQ ID NO: 623158 - RNA, 19 nt, Homo sapiens
gcgugaagaucaaaugaga

SEQ ID NO: 623159 - RNA, 19 nt, Homo sapiens
uggaguggcugacaagauu

SEQ ID NO: 623160 - RNA, 19 nt, Homo sapiens
ggauauuccugaaacaaag

SEQ ID NO: 623161 - RNA, 19 nt, Homo sapiens
accaaagaauuccagauua

SEQ ID NO: 623162 - RNA, 19 nt, Homo sapiens
aaucaaaccugccauagag

SEQ ID NO: 623163 - RNA, 19 nt, Homo sapiens
ccaagccaguuccauuaaa

SEQ ID NO: 623164 - RNA, 19 nt, Homo sapiens
ggccaagccaguuccauua

SEQ ID NO: 623165 - RNA, 19 nt, Homo sapiens
ugucaaauaucuccuguuc

SEQ ID NO: 623166 - RNA, 19 nt, Homo sapiens
caagccaguuccauuaaau

SEQ ID NO: 623167 - RNA, 19 nt, Homo sapiens
cacaacaaauucuuaagga

SEQ ID NO: 623168 - RNA, 19 nt, Homo sapiens
agacuuaacagaaucauga

SEQ ID NO: 623169 - RNA, 19 nt, Homo sapiens
ggucaaguguucucuaggu

SEQ ID NO: 623170 - RNA, 19 nt, Homo sapiens
caaaccugccauagaguua

SEQ ID NO: 623171 - RNA, 19 nt, Homo sapiens
auaagggacuaauugauga

SEQ ID NO: 623172 - RNA, 19 nt, Homo sapiens
aaagaugacacacaacaaa

SEQ ID NO: 623173 - RNA, 19 nt, Homo sapiens
gaagaauagacuuaacaga

SEQ ID NO: 623174 - RNA, 19 nt, Homo sapiens
caaaugagagacaaacuag

SEQ ID NO: 623175 - RNA, 19 nt, Homo sapiens
gaagaucaaaugagagaca

SEQ ID NO: 623176 - RNA, 19 nt, Homo sapiens
aaauaucuccuguucguuu

SEQ ID NO: 623177 - RNA, 19 nt, Homo sapiens
ucaaaugagagacaaacua

SEQ ID NO: 623178 - RNA, 19 nt, Homo sapiens
ccagguuuauguagaaguu

SEQ ID NO: 623179 - RNA, 19 nt, Homo sapiens
uacaagaggcuaccaaaga

SEQ ID NO: 623180 - RNA, 19 nt, Homo sapiens
caaaauaagggacuaauug

SEQ ID NO: 623181 - RNA, 19 nt, Homo sapiens
caaguguucucuaggucaa

SEQ ID NO: 623182 - RNA, 19 nt, Homo sapiens
gaagaaauuguggaggauu

SEQ ID NO: 623183 - RNA, 19 nt, Homo sapiens
gacacacaacaaauucuua

SEQ ID NO: 623184 - RNA, 19 nt, Homo sapiens
gauguaaaucuggagguua

SEQ ID NO: 623185 - RNA, 19 nt, Homo sapiens
gaugacacacaacaaauuc

SEQ ID NO: 623186 - RNA, 19 nt, Homo sapiens
gagucagauuccagguuua

SEQ ID NO: 623187 - RNA, 19 nt, Homo sapiens
cauagcauacuuugaagaa

SEQ ID NO: 623188 - RNA, 19 nt, Homo sapiens
uaccaaagaauuccagauu

SEQ ID NO: 623189 - RNA, 19 nt, Homo sapiens
gauuccagguuuauguaga

SEQ ID NO: 623190 - RNA, 19 nt, Homo sapiens
gagaaugacagccaguugu

SEQ ID NO: 623191 - RNA, 19 nt, Homo sapiens
agaaguagauguggucaag

SEQ ID NO: 623192 - RNA, 19 nt, Homo sapiens
ugacaagaaugaauaugcu

SEQ ID NO: 623193 - RNA, 19 nt, Homo sapiens
aauaagggacuaauugaug

SEQ ID NO: 623194 - RNA, 19 nt, Homo sapiens
guggaggauuuaauuaaca

SEQ ID NO: 623195 - RNA, 19 nt, Homo sapiens
ugccauagaguuacuguuu

SEQ ID NO: 623196 - RNA, 19 nt, Homo sapiens
gugaagaucaaaugagaga

SEQ ID NO: 623197 - RNA, 19 nt, Homo sapiens
cgaaaguuccuuaugagau

SEQ ID NO: 623198 - RNA, 19 nt, Homo sapiens
acagccaguugucaaauau

SEQ ID NO: 623199 - RNA, 19 nt, Homo sapiens
uugaaacuccugagaauga

SEQ ID NO: 623200 - RNA, 19 nt, Homo sapiens
uagauguggucaaguguuc

SEQ ID NO: 623201 - RNA, 19 nt, Homo sapiens
ccauagaguuacuguuucu

SEQ ID NO: 623202 - RNA, 19 nt, Homo sapiens
gccauagaguuacuguuuc

SEQ ID NO: 623203 - RNA, 19 nt, Homo sapiens
gaacaucuaagaggacagu

SEQ ID NO: 623204 - RNA, 19 nt, Homo sapiens
gccaagccaguuccauuaa

SEQ ID NO: 623205 - RNA, 19 nt, Homo sapiens
aagaagaaguugcucaaaa

SEQ ID NO: 623206 - RNA, 19 nt, Homo sapiens
acaagcacuuaucaccuuu

SEQ ID NO: 623207 - RNA, 19 nt, Homo sapiens
aaguagauguggucaagug

SEQ ID NO: 623208 - RNA, 19 nt, Homo sapiens
cagauuccagguuuaugua

SEQ ID NO: 623209 - RNA, 19 nt, Homo sapiens
uaaauucaggagucagauu

SEQ ID NO: 623210 - RNA, 19 nt, Homo sapiens
ucauggaagcugauaaaga

SEQ ID NO: 623211 - RNA, 19 nt, Homo sapiens
auauucagcuaaagaagga

SEQ ID NO: 623212 - RNA, 19 nt, Homo sapiens
gcagcgacaguuucgagaa

SEQ ID NO: 623213 - RNA, 19 nt, Homo sapiens
gugcagucaucacguuugu

SEQ ID NO: 623214 - RNA, 19 nt, Homo sapiens
agaagaaguugcucaaaau

SEQ ID NO: 623215 - RNA, 19 nt, Homo sapiens
uaaagaaggagauccaaaa

SEQ ID NO: 623216 - RNA, 19 nt, Homo sapiens
uaaagaugacacacaacaa

SEQ ID NO: 623217 - RNA, 19 nt, Homo sapiens
cuaaagaaggagauccaaa

SEQ ID NO: 623218 - RNA, 19 nt, Homo sapiens
gcaggaggcagcgacaguu

SEQ ID NO: 623219 - RNA, 19 nt, Homo sapiens
ugaagaaauuguggaggau

SEQ ID NO: 623220 - RNA, 19 nt, Homo sapiens
auaaaucaaaccugccaua

SEQ ID NO: 623221 - RNA, 19 nt, Homo sapiens
aagcacuuaucaccuuuga

SEQ ID NO: 623222 - RNA, 19 nt, Homo sapiens
guggucaaguguucucuag

SEQ ID NO: 623223 - RNA, 19 nt, Homo sapiens
ucaaaccugccauagaguu

SEQ ID NO: 623224 - RNA, 19 nt, Homo sapiens
aaaucaaaccugccauaga

SEQ ID NO: 623225 - RNA, 19 nt, Homo sapiens
guaagcaugaguaaacauc

SEQ ID NO: 623226 - RNA, 19 nt, Homo sapiens
gauauuccugaaacaaaga

SEQ ID NO: 623227 - RNA, 19 nt, Homo sapiens
ggaguggcugacaagauuu

SEQ ID NO: 623228 - RNA, 19 nt, Homo sapiens
caucacguuuguggagauu

SEQ ID NO: 623229 - RNA, 19 nt, Homo sapiens
ugacacacaacaaauucuu

SEQ ID NO: 623230 - RNA, 19 nt, Homo sapiens
ccauuaaauucaggaguca

SEQ ID NO: 623231 - RNA, 19 nt, Homo sapiens
ccaguuccauuaaauucag

SEQ ID NO: 623232 - RNA, 19 nt, Homo sapiens
guagauguggucaaguguu

SEQ ID NO: 623233 - RNA, 19 nt, Homo sapiens
agaugacacacaacaaauu

SEQ ID NO: 623234 - RNA, 19 nt, Homo sapiens
gaacaaaauaagggacuaa

SEQ ID NO: 623235 - RNA, 19 nt, Homo sapiens
ucagauuccagguuuaugu

SEQ ID NO: 623236 - RNA, 19 nt, Homo sapiens
caaaaugugguaagcauga

SEQ ID NO: 623237 - RNA, 19 nt, Homo sapiens
gugguaagcaugaguaaac

SEQ ID NO: 623238 - RNA, 19 nt, Homo sapiens
guuacaagaggcuaccaaa

SEQ ID NO: 623239 - RNA, 19 nt, Homo sapiens
gucaaccucacauagcaua

SEQ ID NO: 623240 - RNA, 19 nt, Homo sapiens
gaaauaugguggcuugaaa

SEQ ID NO: 623241 - RNA, 19 nt, Homo sapiens
agacaucaccgacuuguua

SEQ ID NO: 623242 - RNA, 19 nt, Homo sapiens
gaggauuucuucuucuauu

SEQ ID NO: 623243 - RNA, 19 nt, Homo sapiens
ggaaauagaagaggaaaug

SEQ ID NO: 623244 - RNA, 19 nt, Homo sapiens
ggaagaccaccgacagaua

SEQ ID NO: 623245 - RNA, 19 nt, Homo sapiens
ucacggacauucagcaaga

SEQ ID NO: 623246 - RNA, 19 nt, Homo sapiens
gggaggauuucuucuucua

SEQ ID NO: 623247 - RNA, 19 nt, Homo sapiens
gcccucaccugaagagaaa

SEQ ID NO: 623248 - RNA, 19 nt, Homo sapiens
ggaccaaaccgcaguaaca

SEQ ID NO: 623249 - RNA, 19 nt, Homo sapiens
acuuacaccuggaauguua

SEQ ID NO: 623250 - RNA, 19 nt, Homo sapiens
uaaaggagagauucgagua

SEQ ID NO: 623251 - RNA, 19 nt, Homo sapiens
ccgagucgcucaaguccua

SEQ ID NO: 623252 - RNA, 19 nt, Homo sapiens
ggaaggauuucacggacau

SEQ ID NO: 623253 - RNA, 19 nt, Homo sapiens
gaacguggaggccaaagug

SEQ ID NO: 623254 - RNA, 19 nt, Homo sapiens
ccaaaccgcaguaacauga

SEQ ID NO: 623255 - RNA, 19 nt, Homo sapiens
acagauacgugcagcagaa

SEQ ID NO: 623256 - RNA, 19 nt, Homo sapiens
ccaaagaggagaccaggaa

SEQ ID NO: 623257 - RNA, 19 nt, Homo sapiens
ugaccagcaucauugagua

SEQ ID NO: 623258 - RNA, 19 nt, Homo sapiens
acaagcagaucgaccaguu

SEQ ID NO: 623259 - RNA, 19 nt, Homo sapiens
gcgggaggauuucuucuuc

SEQ ID NO: 623260 - RNA, 19 nt, Homo sapiens
gaacuugagcucuguaacu

SEQ ID NO: 623261 - RNA, 19 nt, Homo sapiens
ccaaaguggugugcuucua

SEQ ID NO: 623262 - RNA, 19 nt, Homo sapiens
gaagaccaccgacagauac

SEQ ID NO: 623263 - RNA, 19 nt, Homo sapiens
gaagagaaacgcgcuccuu

SEQ ID NO: 623264 - RNA, 19 nt, Homo sapiens
gaaauggagaauccggaaa

SEQ ID NO: 623265 - RNA, 19 nt, Homo sapiens
uaacuuacaccuggaaugu

SEQ ID NO: 623266 - RNA, 19 nt, Homo sapiens
gaagcugagagcaaguuaa

SEQ ID NO: 623267 - RNA, 19 nt, Homo sapiens
gcagauaaaggagagauuc

SEQ ID NO: 623268 - RNA, 19 nt, Homo sapiens
ggaccugcccgagaaacua

SEQ ID NO: 623269 - RNA, 19 nt, Homo sapiens
gugcuucgguaucuugaga

SEQ ID NO: 623270 - RNA, 19 nt, Homo sapiens
ggagagaggccaggaccaa

SEQ ID NO: 623271 - RNA, 19 nt, Homo sapiens
gcaucuuguuggacauauu

SEQ ID NO: 623272 - RNA, 19 nt, Homo sapiens
acaagaacaucuacgacau

SEQ ID NO: 623273 - RNA, 19 nt, Homo sapiens
gaaucgaggagcucaacaa

SEQ ID NO: 623274 - RNA, 19 nt, Homo sapiens
ucgaggagcucaacaagac

SEQ ID NO: 623275 - RNA, 19 nt, Homo sapiens
ggagagauucgaguaggaa

SEQ ID NO: 623276 - RNA, 19 nt, Homo sapiens
ccagcaucauugaguacua

SEQ ID NO: 623277 - RNA, 19 nt, Homo sapiens
aagcugagagcaaguuaaa

SEQ ID NO: 623278 - RNA, 19 nt, Homo sapiens
gacuacgucuacuuugaga

SEQ ID NO: 623279 - RNA, 19 nt, Homo sapiens
cagcccagccugcacauga

SEQ ID NO: 623280 - RNA, 19 nt, Homo sapiens
gaccugcccgagaaacuaa

SEQ ID NO: 623281 - RNA, 19 nt, Homo sapiens
ccaacuauaacaagccaaa

SEQ ID NO: 623282 - RNA, 19 nt, Homo sapiens
cagcagaaacgcuugaaag

SEQ ID NO: 623283 - RNA, 19 nt, Homo sapiens
gacaucaccgacuuguuaa

SEQ ID NO: 623284 - RNA, 19 nt, Homo sapiens
uagaagaggaaauggagaa

SEQ ID NO: 623285 - RNA, 19 nt, Homo sapiens
gccggaaccuccugcucaa

SEQ ID NO: 623286 - RNA, 19 nt, Homo sapiens
ccaaauccgaaccaaauca

SEQ ID NO: 623287 - RNA, 19 nt, Homo sapiens
gagagaggccaggaccaaa

SEQ ID NO: 623288 - RNA, 19 nt, Homo sapiens
ucaacaagacggccaaugg

SEQ ID NO: 623289 - RNA, 19 nt, Homo sapiens
aggcagacaucaccgacuu

SEQ ID NO: 623290 - RNA, 19 nt, Homo sapiens
guacagggucggagacuac

SEQ ID NO: 623291 - RNA, 19 nt, Homo sapiens
gaagaggaaauggagaauc

SEQ ID NO: 623292 - RNA, 19 nt, Homo sapiens
cgagaaugccgaggaguug

SEQ ID NO: 623293 - RNA, 19 nt, Homo sapiens
gaccaggcaggcuuucuau

SEQ ID NO: 623294 - RNA, 19 nt, Homo sapiens
gcagcagaaacgcuugaaa

SEQ ID NO: 623295 - RNA, 19 nt, Homo sapiens
caagaacaucuacgacauc

SEQ ID NO: 623296 - RNA, 19 nt, Homo sapiens
ucuauucucuagucuacga

SEQ ID NO: 623297 - RNA, 19 nt, Homo sapiens
ggaggauuucuucuucuau

SEQ ID NO: 623298 - RNA, 19 nt, Homo sapiens
caggcaggcuuucuaucug

SEQ ID NO: 623299 - RNA, 19 nt, Homo sapiens
gaaauagaagaggaaaugg

SEQ ID NO: 623300 - RNA, 19 nt, Homo sapiens
guuacaccacacagucuua

SEQ ID NO: 623301 - RNA, 19 nt, Homo sapiens
caucagaggccaaccuuuu

SEQ ID NO: 623302 - RNA, 19 nt, Homo sapiens
ccaggcaggcuuucuaucu

SEQ ID NO: 623303 - RNA, 19 nt, Homo sapiens
caucuuguuggacauauug

SEQ ID NO: 623304 - RNA, 19 nt, Homo sapiens
ggaggaguggucugcauca

SEQ ID NO: 623305 - RNA, 19 nt, Homo sapiens
ggagcgggaggauuucuuc

SEQ ID NO: 623306 - RNA, 19 nt, Homo sapiens
ccaggaagauccgcaagcu

SEQ ID NO: 623307 - RNA, 19 nt, Homo sapiens
gaccaaaccgcaguaacau

SEQ ID NO: 623308 - RNA, 19 nt, Homo sapiens
gcgcaucuuguuggacaua

SEQ ID NO: 623309 - RNA, 19 nt, Homo sapiens
ccaaaucagcgucaacaac

SEQ ID NO: 623310 - RNA, 19 nt, Homo sapiens
gcugagagcaaguuaaagc

SEQ ID NO: 623311 - RNA, 19 nt, Homo sapiens
ggacauucagcaagauuuu

SEQ ID NO: 623312 - RNA, 19 nt, Homo sapiens
gauacucuccacaagaaca

SEQ ID NO: 623313 - RNA, 19 nt, Homo sapiens
acaacccacucacagacaa

SEQ ID NO: 623314 - RNA, 19 nt, Homo sapiens
cagcaacccauaccugauc

SEQ ID NO: 623315 - RNA, 19 nt, Homo sapiens
aagaggaaauggagaaucc

SEQ ID NO: 623316 - RNA, 19 nt, Homo sapiens
caaaguggugugcuucuac

SEQ ID NO: 623317 - RNA, 19 nt, Homo sapiens
gccgagaccaguccagguu

SEQ ID NO: 623318 - RNA, 19 nt, Homo sapiens
gcagacaucaccgacuugu

SEQ ID NO: 623319 - RNA, 19 nt, Homo sapiens
gagagauucgaguaggaaa

SEQ ID NO: 623320 - RNA, 19 nt, Homo sapiens
aacuugagcucuguaacuu

SEQ ID NO: 623321 - RNA, 19 nt, Homo sapiens
cgggugacguguucuacau

SEQ ID NO: 623322 - RNA, 19 nt, Homo sapiens
ugaagaccaggcaggcuuu

SEQ ID NO: 623323 - RNA, 19 nt, Homo sapiens
agaaauaugguggcuugaa

SEQ ID NO: 623324 - RNA, 19 nt, Homo sapiens
aaauagaagaggaaaugga

SEQ ID NO: 623325 - RNA, 19 nt, Homo sapiens
caagccaaauccgaaccaa

SEQ ID NO: 623326 - RNA, 19 nt, Homo sapiens
ugaagcugagagcaaguua

SEQ ID NO: 623327 - RNA, 19 nt, Homo sapiens
aaauggagaauccggaaau

SEQ ID NO: 623328 - RNA, 19 nt, Homo sapiens
ucacagacaagcagaucga

SEQ ID NO: 623329 - RNA, 19 nt, Homo sapiens
ugguggaccugcccgagaa

SEQ ID NO: 623330 - RNA, 19 nt, Homo sapiens
cuucuucuauucucuaguc

SEQ ID NO: 623331 - RNA, 19 nt, Homo sapiens
gcccuaagguuuuguugug

SEQ ID NO: 623332 - RNA, 19 nt, Homo sapiens
agaccaggcaggcuuucua

SEQ ID NO: 623333 - RNA, 19 nt, Homo sapiens
cccgagacaucacccuguu

SEQ ID NO: 623334 - RNA, 19 nt, Homo sapiens
gagaccgagucgcucaagu

SEQ ID NO: 623335 - RNA, 19 nt, Homo sapiens
aaagaggagaccaggaaga

SEQ ID NO: 623336 - RNA, 19 nt, Homo sapiens
aaaccgcaguaacaugagu

SEQ ID NO: 623337 - RNA, 19 nt, Homo sapiens
gaaccaaaucagcgucaac

SEQ ID NO: 623338 - RNA, 19 nt, Homo sapiens
agccaaauccgaaccaaau

SEQ ID NO: 623339 - RNA, 19 nt, Homo sapiens
cagcaucauugaguacuac

SEQ ID NO: 623340 - RNA, 19 nt, Homo sapiens
gaacaaagcugccauaaau

SEQ ID NO: 623341 - RNA, 19 nt, Homo sapiens
gcaaacaucucuucacauu

SEQ ID NO: 623342 - RNA, 19 nt, Homo sapiens
gaagaaagcucuggaucua

SEQ ID NO: 623343 - RNA, 19 nt, Homo sapiens
ggagaaaccugguaucuau

SEQ ID NO: 623344 - RNA, 19 nt, Homo sapiens
gaauggugcugaugaaaua

SEQ ID NO: 623345 - RNA, 19 nt, Homo sapiens
gaaccaaacucucaaacaa

SEQ ID NO: 623346 - RNA, 19 nt, Homo sapiens
aaacagagcuggaaagguu

SEQ ID NO: 623347 - RNA, 19 nt, Homo sapiens
gaagaucgcuuaggcaaga

SEQ ID NO: 623348 - RNA, 19 nt, Homo sapiens
gcagaguucuagcaaauuu

SEQ ID NO: 623349 - RNA, 19 nt, Homo sapiens
gcacaaacaccauuagaaa

SEQ ID NO: 623350 - RNA, 19 nt, Homo sapiens
gcaagucacucugcuaauu

SEQ ID NO: 623351 - RNA, 19 nt, Homo sapiens
gaaacucucugcuuccauu

SEQ ID NO: 623352 - RNA, 19 nt, Homo sapiens
gaaaucaagucgcucaugu

SEQ ID NO: 623353 - RNA, 19 nt, Homo sapiens
gauaaagacacuaggaaua

SEQ ID NO: 623354 - RNA, 19 nt, Homo sapiens
ggacagagaggcauuaguu

SEQ ID NO: 623355 - RNA, 19 nt, Homo sapiens
ugacagagcuauauaugug

SEQ ID NO: 623356 - RNA, 19 nt, Homo sapiens
uauacaagcucuucagaaa

SEQ ID NO: 623357 - RNA, 19 nt, Homo sapiens
gagaaaguguggccuauca

SEQ ID NO: 623358 - RNA, 19 nt, Homo sapiens
ggacacacgauucuaagua

SEQ ID NO: 623359 - RNA, 19 nt, Homo sapiens
gauuacaacuucaccuauu

SEQ ID NO: 623360 - RNA, 19 nt, Homo sapiens
caacagaaguauagaagca

SEQ ID NO: 623361 - RNA, 19 nt, Homo sapiens
gaaauuaagccaucguguu

SEQ ID NO: 623362 - RNA, 19 nt, Homo sapiens
agaaacagauuacaacuuc

SEQ ID NO: 623363 - RNA, 19 nt, Homo sapiens
cauaaagccuugcaggaaa

SEQ ID NO: 623364 - RNA, 19 nt, Homo sapiens
cggcaaauguuacaagaaa

SEQ ID NO: 623365 - RNA, 19 nt, Homo sapiens
gaaacacaaaugaagguua

SEQ ID NO: 623366 - RNA, 19 nt, Homo sapiens
gggacaaccuccuuucuug

SEQ ID NO: 623367 - RNA, 19 nt, Homo sapiens
ccagaaggauauagacaaa

SEQ ID NO: 623368 - RNA, 19 nt, Homo sapiens
gauaugaugagccuauuaa

SEQ ID NO: 623369 - RNA, 19 nt, Homo sapiens
gaaauagucauaacaugga

SEQ ID NO: 623370 - RNA, 19 nt, Homo sapiens
acaaagcgcuauucuggaa

SEQ ID NO: 623371 - RNA, 19 nt, Homo sapiens
gcaaucaguuaaccgcaaa

SEQ ID NO: 623372 - RNA, 19 nt, Homo sapiens
caagaauggugcugaugaa

SEQ ID NO: 623373 - RNA, 19 nt, Homo sapiens
gcagcugccagaccuauua

SEQ ID NO: 623374 - RNA, 19 nt, Homo sapiens
gcaagaauggugcugauga

SEQ ID NO: 623375 - RNA, 19 nt, Homo sapiens
gagacagacugaagccauu

SEQ ID NO: 623376 - RNA, 19 nt, Homo sapiens
ccagugaggucaaauucuu

SEQ ID NO: 623377 - RNA, 19 nt, Homo sapiens
ggaacaaagcugccauaaa

SEQ ID NO: 623378 - RNA, 19 nt, Homo sapiens
gaucgugauggucauauua

SEQ ID NO: 623379 - RNA, 19 nt, Homo sapiens
ucaagucgcucauguuaag

SEQ ID NO: 623380 - RNA, 19 nt, Homo sapiens
gggaaccgcuucaaaugug

SEQ ID NO: 623381 - RNA, 19 nt, Homo sapiens
gucauaacauggaacuaua

SEQ ID NO: 623382 - RNA, 19 nt, Homo sapiens
ccaaacagaaauagucaua

SEQ ID NO: 623383 - RNA, 19 nt, Homo sapiens
gaaaguguggccuaucauu

SEQ ID NO: 623384 - RNA, 19 nt, Homo sapiens
ccugguaucuauuuguaua

SEQ ID NO: 623385 - RNA, 19 nt, Homo sapiens
gcauggauuucaguaauga

SEQ ID NO: 623386 - RNA, 19 nt, Homo sapiens
gaaguauuccucagucuau

SEQ ID NO: 623387 - RNA, 19 nt, Homo sapiens
gaagauaaagacacuagga

SEQ ID NO: 623388 - RNA, 19 nt, Homo sapiens
caacuucaccuauuacugu

SEQ ID NO: 623389 - RNA, 19 nt, Homo sapiens
ucagaaauccacccaaauu

SEQ ID NO: 623390 - RNA, 19 nt, Homo sapiens
cgugugggcuacauauaua

SEQ ID NO: 623391 - RNA, 19 nt, Homo sapiens
gaaaccugguaucuauuug

SEQ ID NO: 623392 - RNA, 19 nt, Homo sapiens
aaacacaggcucagagauu

SEQ ID NO: 623393 - RNA, 19 nt, Homo sapiens
caauugacuucuccaguga

SEQ ID NO: 623394 - RNA, 19 nt, Homo sapiens
ggugaagucugucuagcaa

SEQ ID NO: 623395 - RNA, 19 nt, Homo sapiens
caaggaagaugagagugaa

SEQ ID NO: 623396 - RNA, 19 nt, Homo sapiens
caaccuaacauaccaguga

SEQ ID NO: 623397 - RNA, 19 nt, Homo sapiens
caaauuggccucagucauc

SEQ ID NO: 623398 - RNA, 19 nt, Homo sapiens
gcaagcugcuggauuugau

SEQ ID NO: 623399 - RNA, 19 nt, Homo sapiens
agaaggauauagacaaaug

SEQ ID NO: 623400 - RNA, 19 nt, Homo sapiens
guaaaugacacucucaaug

SEQ ID NO: 623401 - RNA, 19 nt, Homo sapiens
cuaauuacauccgucuuaa

SEQ ID NO: 623402 - RNA, 19 nt, Homo sapiens
ggacaaacugauuucauga

SEQ ID NO: 623403 - RNA, 19 nt, Homo sapiens
gaucugguauaucagcauu

SEQ ID NO: 623404 - RNA, 19 nt, Homo sapiens
ggaaucccuuaggaauuua

SEQ ID NO: 623405 - RNA, 19 nt, Homo sapiens
caagauagcauggauuuca

SEQ ID NO: 623406 - RNA, 19 nt, Homo sapiens
ggaaacauggaauacguaa

SEQ ID NO: 623407 - RNA, 19 nt, Homo sapiens
ccuccagaguuaauuauuu

SEQ ID NO: 623408 - RNA, 19 nt, Homo sapiens
acagacagauguaggaaga

SEQ ID NO: 623409 - RNA, 19 nt, Homo sapiens
ggcugaagcugacaaugaa

SEQ ID NO: 623410 - RNA, 19 nt, Homo sapiens
aaucaagucgcucauguua

SEQ ID NO: 623411 - RNA, 19 nt, Homo sapiens
ggaaauagagcaagucacu

SEQ ID NO: 623412 - RNA, 19 nt, Homo sapiens
gacagcagcuaauggacaa

SEQ ID NO: 623413 - RNA, 19 nt, Homo sapiens
gcaggaaauucgaaacucu

SEQ ID NO: 623414 - RNA, 19 nt, Homo sapiens
gcucuggaucuaucaaaua

SEQ ID NO: 623415 - RNA, 19 nt, Homo sapiens
aaaugaagguuaucaacug

SEQ ID NO: 623416 - RNA, 19 nt, Homo sapiens
uagcauggauuucaguaau

SEQ ID NO: 623417 - RNA, 19 nt, Homo sapiens
gaccauccacggcaagaua

SEQ ID NO: 623418 - RNA, 19 nt, Homo sapiens
gagcauaacaugaguaaaa

SEQ ID NO: 623419 - RNA, 19 nt, Homo sapiens
gaacaggauacacacaguu

SEQ ID NO: 623420 - RNA, 19 nt, Homo sapiens
gauggacacacgauucuaa

SEQ ID NO: 623421 - RNA, 19 nt, Homo sapiens
ugaagucugucuagcaaga

SEQ ID NO: 623422 - RNA, 19 nt, Homo sapiens
guuccuaggcuaaugauaa

SEQ ID NO: 623423 - RNA, 19 nt, Homo sapiens
ugaagcuucugaucuuauu

SEQ ID NO: 623424 - RNA, 19 nt, Homo sapiens
gguaguucgucuauauuau

SEQ ID NO: 623425 - RNA, 19 nt, Homo sapiens
gcaauuacaccagcuccua

SEQ ID NO: 623426 - RNA, 19 nt, Homo sapiens
guacuggacaaacugauuu

SEQ ID NO: 623427 - RNA, 19 nt, Homo sapiens
gcagaaugguacuggacaa

SEQ ID NO: 623428 - RNA, 19 nt, Homo sapiens
gcgcuauucuggaaacaug

SEQ ID NO: 623429 - RNA, 19 nt, Homo sapiens
cuugcaagcugcuggauuu

SEQ ID NO: 623430 - RNA, 19 nt, Homo sapiens
caaauaugacagagcuaua

SEQ ID NO: 623431 - RNA, 19 nt, Homo sapiens
gcagucggaugaagaugau

SEQ ID NO: 623432 - RNA, 19 nt, Homo sapiens
uaaaugacacucucaaugg

SEQ ID NO: 623433 - RNA, 19 nt, Homo sapiens
gaaggaucauuuucacuuu

SEQ ID NO: 623434 - RNA, 19 nt, Homo sapiens
ggguaguucgucuauauua

SEQ ID NO: 623435 - RNA, 19 nt, Homo sapiens
gagcgaagggaaucucgua

SEQ ID NO: 623436 - RNA, 19 nt, Homo sapiens
gaaacagauuacaacuuca

SEQ ID NO: 623437 - RNA, 19 nt, Homo sapiens
cagaaauagucauaacaug

SEQ ID NO: 623438 - RNA, 19 nt, Homo sapiens
agaaagcucuggaucuauc

SEQ ID NO: 623439 - RNA, 19 nt, Homo sapiens
cacaaaugcuucaagacuu

SEQ ID NO: 623440 - RNA, 19 nt, Homo sapiens
ucaagaacguggccgauua

SEQ ID NO: 623441 - RNA, 19 nt, Homo sapiens
gaacguggccgauuacuac

SEQ ID NO: 623442 - RNA, 19 nt, Homo sapiens
ucccggagcuuuacuuuaa

SEQ ID NO: 623443 - RNA, 19 nt, Homo sapiens
cuaagaagcaugucacuuu

SEQ ID NO: 623444 - RNA, 19 nt, Homo sapiens
gcagagcacugauuauggu

SEQ ID NO: 623445 - RNA, 19 nt, Homo sapiens
gcucucaauugcacucuuu

SEQ ID NO: 623446 - RNA, 19 nt, Homo sapiens
ccacuuuggugucuucuau

SEQ ID NO: 623447 - RNA, 19 nt, Homo sapiens
agguaaagcugaacaaguu

SEQ ID NO: 623448 - RNA, 19 nt, Homo sapiens
uaagaagcaugucacuuuc

SEQ ID NO: 623449 - RNA, 19 nt, Homo sapiens
gagcaggagugucgcaaca

SEQ ID NO: 623450 - RNA, 19 nt, Homo sapiens
cuacaucccuaucuucuag

SEQ ID NO: 623451 - RNA, 19 nt, Homo sapiens
caccaaggauggacgaaga

SEQ ID NO: 623452 - RNA, 19 nt, Homo sapiens
gcaggagugucgcaacauc

SEQ ID NO: 623453 - RNA, 19 nt, Homo sapiens
gcgagacgcuagaggacuu

SEQ ID NO: 623454 - RNA, 19 nt, Homo sapiens
ccgcugauguaucuaagaa

SEQ ID NO: 623455 - RNA, 19 nt, Homo sapiens
gcccaaggcucucaauugc

SEQ ID NO: 623456 - RNA, 19 nt, Homo sapiens
guggaucgcugaauguauc

SEQ ID NO: 623457 - RNA, 19 nt, Homo sapiens
gcaggaccuugacgagaug

SEQ ID NO: 623458 - RNA, 19 nt, Homo sapiens
ugaggaaccaugccuauga

SEQ ID NO: 623459 - RNA, 19 nt, Homo sapiens
gcuggaggaccgauucuuu

SEQ ID NO: 623460 - RNA, 19 nt, Homo sapiens
uagcaacccuggagacaag

SEQ ID NO: 623461 - RNA, 19 nt, Homo sapiens
acacgccucuugcggcuuu

SEQ ID NO: 623462 - RNA, 19 nt, Homo sapiens
acaguuacaugaucgacaa

SEQ ID NO: 623463 - RNA, 19 nt, Homo sapiens
uccuagacuucauuacuua

SEQ ID NO: 623464 - RNA, 19 nt, Homo sapiens
cuaacucccugaccugaga

SEQ ID NO: 623465 - RNA, 19 nt, Homo sapiens
cugcugagcucuacaaugc

SEQ ID NO: 623466 - RNA, 19 nt, Homo sapiens
cagcagccaugucguucuu

SEQ ID NO: 623467 - RNA, 19 nt, Homo sapiens
ucaucaccaucaauucuuu

SEQ ID NO: 623468 - RNA, 19 nt, Homo sapiens
gauggaggccgugaacauu

SEQ ID NO: 623469 - RNA, 19 nt, Homo sapiens
guguguauguggucuguga

SEQ ID NO: 623470 - RNA, 19 nt, Homo sapiens
acaacuacaucccuaucuu

SEQ ID NO: 623471 - RNA, 19 nt, Homo sapiens
gaggaaccaugccuaugag

SEQ ID NO: 623472 - RNA, 19 nt, Homo sapiens
ggcccaaggcucucaauug

SEQ ID NO: 623473 - RNA, 19 nt, Homo sapiens
gccaagcucuuuccacacu

SEQ ID NO: 623474 - RNA, 19 nt, Homo sapiens
agaagauggugguggaguu

SEQ ID NO: 623475 - RNA, 19 nt, Homo sapiens
guaacuuccuggccaacga

SEQ ID NO: 623476 - RNA, 19 nt, Homo sapiens
caacuacaucccuaucuuc

SEQ ID NO: 623477 - RNA, 19 nt, Homo sapiens
caaguuggccuuccugaac

SEQ ID NO: 623478 - RNA, 19 nt, Homo sapiens
gagguaaagcugaacaagu

SEQ ID NO: 623479 - RNA, 19 nt, Homo sapiens
caauaaaacugcccucucu

SEQ ID NO: 623480 - RNA, 19 nt, Homo sapiens
gaagauggugguggaguuc

SEQ ID NO: 623481 - RNA, 19 nt, Homo sapiens
gcacugauuaugguaacuu

SEQ ID NO: 623482 - RNA, 19 nt, Homo sapiens
gagcacugauuaugguaac

SEQ ID NO: 623483 - RNA, 19 nt, Homo sapiens
caagcucuuuccacacugu

SEQ ID NO: 623484 - RNA, 19 nt, Homo sapiens
cguggacaauggcuacuug

SEQ ID NO: 623485 - RNA, 19 nt, Homo sapiens
ucaauugcacucuuugugu

SEQ ID NO: 623486 - RNA, 19 nt, Homo sapiens
ggaccgugccaagcucuuu

SEQ ID NO: 623487 - RNA, 19 nt, Homo sapiens
gacgcuagaggacuugaaa

SEQ ID NO: 623488 - RNA, 19 nt, Homo sapiens
aguacaagcugcucuucga

SEQ ID NO: 623489 - RNA, 19 nt, Homo sapiens
agaagcaugucacuuucau

SEQ ID NO: 623490 - RNA, 19 nt, Homo sapiens
acuaugaacaggucaagaa

SEQ ID NO: 623491 - RNA, 19 nt, Homo sapiens
uggaguccuucuacaaguu

SEQ ID NO: 623492 - RNA, 19 nt, Homo sapiens
uuucagagcaggaccuuga

SEQ ID NO: 623493 - RNA, 19 nt, Homo sapiens
ucaauucuuucggcacaga

SEQ ID NO: 623494 - RNA, 19 nt, Homo sapiens
ggcucgggcugacgacuau

SEQ ID NO: 623495 - RNA, 19 nt, Homo sapiens
caucaucaccaucaauucu

SEQ ID NO: 623496 - RNA, 19 nt, Homo sapiens
uuccuagacuucauuacuu

SEQ ID NO: 623497 - RNA, 19 nt, Homo sapiens
ccucagcccugugguuaca

SEQ ID NO: 623498 - RNA, 19 nt, Homo sapiens
gguguaguacgcuguccua

SEQ ID NO: 623499 - RNA, 19 nt, Homo sapiens
gcagauggaggccgugaac

SEQ ID NO: 623500 - RNA, 19 nt, Homo sapiens
cuucauuacuuacaguuac

SEQ ID NO: 623501 - RNA, 19 nt, Homo sapiens
gguaaagcugaacaaguug

SEQ ID NO: 623502 - RNA, 19 nt, Homo sapiens
ggaguccuucuacaaguuc

SEQ ID NO: 623503 - RNA, 19 nt, Homo sapiens
cuuagagacuguucuuagg

SEQ ID NO: 623504 - RNA, 19 nt, Homo sapiens
gggcugacgacuaugaaca

SEQ ID NO: 623505 - RNA, 19 nt, Homo sapiens
caucugcagagcacugauu

SEQ ID NO: 623506 - RNA, 19 nt, Homo sapiens
guuccacuuuggugucuuc

SEQ ID NO: 623507 - RNA, 19 nt, Homo sapiens
caagaacguggccgauuac

SEQ ID NO: 623508 - RNA, 19 nt, Homo sapiens
aggccuaccuggaguccuu

SEQ ID NO: 623509 - RNA, 19 nt, Homo sapiens
agcaggaccuugacgagau

SEQ ID NO: 623510 - RNA, 19 nt, Homo sapiens
agacuucauuacuuacagu

SEQ ID NO: 623511 - RNA, 19 nt, Homo sapiens
cugcagagcacugauuaug

SEQ ID NO: 623512 - RNA, 19 nt, Homo sapiens
uggaggaccgauucuuuga

SEQ ID NO: 623513 - RNA, 19 nt, Homo sapiens
ccgcaacacccucuacaag

SEQ ID NO: 623514 - RNA, 19 nt, Homo sapiens
gcuagaggacuugaaacug

SEQ ID NO: 623515 - RNA, 19 nt, Homo sapiens
cgacaacuacaucccuauc

SEQ ID NO: 623516 - RNA, 19 nt, Homo sapiens
guagcaacccuggagacaa

SEQ ID NO: 623517 - RNA, 19 nt, Homo sapiens
agaacguggccgauuacua

SEQ ID NO: 623518 - RNA, 19 nt, Homo sapiens
cgugaacauugcucagaca

SEQ ID NO: 623519 - RNA, 19 nt, Homo sapiens
ugauguaucuaagaagcau

SEQ ID NO: 623520 - RNA, 19 nt, Homo sapiens
ucgaugaccggcucaagga

SEQ ID NO: 623521 - RNA, 19 nt, Homo sapiens
ggagacggcucaagaguuu

SEQ ID NO: 623522 - RNA, 19 nt, Homo sapiens
uaaaugagguggcuucaga

SEQ ID NO: 623523 - RNA, 19 nt, Homo sapiens
gcagaagguugugacuuua

SEQ ID NO: 623524 - RNA, 19 nt, Homo sapiens
cuucagaaauggcagaaua

SEQ ID NO: 623525 - RNA, 19 nt, Homo sapiens
gagcagugaugucaaacuu

SEQ ID NO: 623526 - RNA, 19 nt, Homo sapiens
ugagguggcuucagaaaug

SEQ ID NO: 623527 - RNA, 19 nt, Homo sapiens
gcagagcuguugcccacaa

SEQ ID NO: 623528 - RNA, 19 nt, Homo sapiens
ucagaaguguuauuucaug

SEQ ID NO: 623529 - RNA, 19 nt, Homo sapiens
gaaaagggcaugucaguga

SEQ ID NO: 623530 - RNA, 19 nt, Homo sapiens
gcagugaugucaaacuucu

SEQ ID NO: 623531 - RNA, 19 nt, Homo sapiens
ugaggaaauuggaaacauu

SEQ ID NO: 623532 - RNA, 19 nt, Homo sapiens
ugcagaagguugugacuuu

SEQ ID NO: 623533 - RNA, 19 nt, Homo sapiens
gacccaugcuuaguacaua

SEQ ID NO: 623534 - RNA, 19 nt, Homo sapiens
aaagugaaguggcauuuua

SEQ ID NO: 623535 - RNA, 19 nt, Homo sapiens
ccuuuaacccuuacauuua

SEQ ID NO: 623536 - RNA, 19 nt, Homo sapiens
gaaguggcauuuuaacuau

SEQ ID NO: 623537 - RNA, 19 nt, Homo sapiens
agaaauggcagaauaaauc

SEQ ID NO: 623538 - RNA, 19 nt, Homo sapiens
gguauccucucccucauuc

SEQ ID NO: 623539 - RNA, 19 nt, Homo sapiens
gaccauguccgugaucuuu

SEQ ID NO: 623540 - RNA, 19 nt, Homo sapiens
ccucaugacuucucuugug

SEQ ID NO: 623541 - RNA, 19 nt, Homo sapiens
cagaaguguuauuucauga

SEQ ID NO: 623542 - RNA, 19 nt, Homo sapiens
caaaugaggagagcucuga

SEQ ID NO: 623543 - RNA, 19 nt, Homo sapiens
uauguaaguuccucucaga

SEQ ID NO: 623544 - RNA, 19 nt, Homo sapiens
gguugugacuuuaguauac

SEQ ID NO: 623545 - RNA, 19 nt, Homo sapiens
gcaaaaccauuuacuuuac

SEQ ID NO: 623546 - RNA, 19 nt, Homo sapiens
uuaaugggcuuuucuacua

SEQ ID NO: 623547 - RNA, 19 nt, Homo sapiens
guaguacaaccuaaacuug

SEQ ID NO: 623548 - RNA, 19 nt, Homo sapiens
gaaauggcagaauaaaucu

SEQ ID NO: 623549 - RNA, 19 nt, Homo sapiens
gaagguugugacuuuagua

SEQ ID NO: 623550 - RNA, 19 nt, Homo sapiens
cacaagcgccuuuuauuua

SEQ ID NO: 623551 - RNA, 19 nt, Homo sapiens
uuggaaacauucuggcuuu

SEQ ID NO: 623552 - RNA, 19 nt, Homo sapiens
gggcaaaaccauuuacuuu

SEQ ID NO: 623553 - RNA, 19 nt, Homo sapiens
caucugcccauguguauug

SEQ ID NO: 623554 - RNA, 19 nt, Homo sapiens
cgggagcagugaugucaaa

SEQ ID NO: 623555 - RNA, 19 nt, Homo sapiens
gaggaaauuggaaacauuc

SEQ ID NO: 623556 - RNA, 19 nt, Homo sapiens
gcuccuaauuuccgaaugg

SEQ ID NO: 623557 - RNA, 19 nt, Homo sapiens
acacaccgaugcacuugga

SEQ ID NO: 623558 - RNA, 19 nt, Homo sapiens
ggcaaaaccauuuacuuua

SEQ ID NO: 623559 - RNA, 19 nt, Homo sapiens
ucagugaaaucugggaaug

SEQ ID NO: 623560 - RNA, 19 nt, Homo sapiens
caaauggggugaugaaugg

SEQ ID NO: 623561 - RNA, 19 nt, Homo sapiens
aauacuugcuguucauguu

SEQ ID NO: 623562 - RNA, 19 nt, Homo sapiens
caugugugcugcccugaau

SEQ ID NO: 623563 - RNA, 19 nt, Homo sapiens
ccacaagcgccuuuuauuu

SEQ ID NO: 623564 - RNA, 19 nt, Homo sapiens
aggaggagcucaaguugca

SEQ ID NO: 623565 - RNA, 19 nt, Homo sapiens
uuaacaaacucaguaguac

SEQ ID NO: 623566 - RNA, 19 nt, Homo sapiens
cuuuacagguugcccauga

SEQ ID NO: 623567 - RNA, 19 nt, Homo sapiens
cagcaucauucagaaagug

SEQ ID NO: 623568 - RNA, 19 nt, Homo sapiens
cagaaauggcagaauaaau

SEQ ID NO: 623569 - RNA, 19 nt, Homo sapiens
ucagaaauggcagaauaaa

SEQ ID NO: 623570 - RNA, 19 nt, Homo sapiens
ggagcugguucugcugguu

SEQ ID NO: 623571 - RNA, 19 nt, Homo sapiens
gaccuuuaacccuuacauu

SEQ ID NO: 623572 - RNA, 19 nt, Homo sapiens
auaugaccuuuaacccuua

SEQ ID NO: 623573 - RNA, 19 nt, Homo sapiens
ugacagcaucauucagaaa

SEQ ID NO: 623574 - RNA, 19 nt, Homo sapiens
uaacaaacucaguaguaca

SEQ ID NO: 623575 - RNA, 19 nt, Homo sapiens
gcaaauggggugaugaaug

SEQ ID NO: 623576 - RNA, 19 nt, Homo sapiens
cuaugacacuaccugcauu

SEQ ID NO: 623577 - RNA, 19 nt, Homo sapiens
cagcagccauggccuucug

SEQ ID NO: 623578 - RNA, 19 nt, Homo sapiens
guacauaugaccuuuaacc

SEQ ID NO: 623579 - RNA, 19 nt, Homo sapiens
ggaaauuggaaacauucug

SEQ ID NO: 623580 - RNA, 19 nt, Homo sapiens
ugaaguggcauuuuaacua

SEQ ID NO: 623581 - RNA, 19 nt, Homo sapiens
gaauucacagcuuccuaug

SEQ ID NO: 623582 - RNA, 19 nt, Homo sapiens
auacuugcuguucauguua

SEQ ID NO: 623583 - RNA, 19 nt, Homo sapiens
ccaggauucuauuuuguuu

SEQ ID NO: 623584 - RNA, 19 nt, Homo sapiens
cuuaguacauaugaccuuu

SEQ ID NO: 623585 - RNA, 19 nt, Homo sapiens
gaguuugacagcaucauuc

SEQ ID NO: 623586 - RNA, 19 nt, Homo sapiens
uuucaauacuugcuguuca

SEQ ID NO: 623587 - RNA, 19 nt, Homo sapiens
ggaggagacggcucaagag

SEQ ID NO: 623588 - RNA, 19 nt, Homo sapiens
gaggagacggcucaagagu

SEQ ID NO: 623589 - RNA, 19 nt, Homo sapiens
uacugaggcugauuuaguc

SEQ ID NO: 623590 - RNA, 19 nt, Homo sapiens
auacugaggcugauuuagu

SEQ ID NO: 623591 - RNA, 19 nt, Homo sapiens
acaaauccauucuauuccu

SEQ ID NO: 623592 - RNA, 19 nt, Homo sapiens
ucaggaggagcucaaguug

SEQ ID NO: 623593 - RNA, 19 nt, Homo sapiens
gacagcaucauucagaaag

SEQ ID NO: 623594 - RNA, 19 nt, Homo sapiens
agaagguugugacuuuagu

SEQ ID NO: 623595 - RNA, 19 nt, Homo sapiens
cacaagcuucuuacgguuu

SEQ ID NO: 623596 - RNA, 19 nt, Homo sapiens
uggaggagacggcucaaga

SEQ ID NO: 623597 - RNA, 19 nt, Homo sapiens
gugcugcccugaaucucau

SEQ ID NO: 623598 - RNA, 19 nt, Homo sapiens
gaaagugaaguggcauuuu

SEQ ID NO: 623599 - RNA, 19 nt, Homo sapiens
acucaguaguacaaccuaa

SEQ ID NO: 623600 - RNA, 19 nt, Homo sapiens
gagacccuguggugggaau

SEQ ID NO: 623601 - RNA, 19 nt, Homo sapiens
uaucugcuccugccagugu

SEQ ID NO: 623602 - RNA, 19 nt, Homo sapiens
agaaagugaaguggcauuu

SEQ ID NO: 623603 - RNA, 19 nt, Homo sapiens
gagguggcuucagaaaugg

SEQ ID NO: 623604 - RNA, 19 nt, Homo sapiens
gggcaugucagugaaaucu

SEQ ID NO: 623605 - RNA, 19 nt, Homo sapiens
aacaaacucaguaguacaa

SEQ ID NO: 623606 - RNA, 19 nt, Homo sapiens
uaaugggcuuuucuacuaa

SEQ ID NO: 623607 - RNA, 19 nt, Homo sapiens
gguugcccaugaggaaauu

SEQ ID NO: 623608 - RNA, 19 nt, Homo sapiens
ucgaggaguucaccuugca

SEQ ID NO: 623609 - RNA, 19 nt, Homo sapiens
acagguugcccaugaggaa

SEQ ID NO: 623610 - RNA, 19 nt, Homo sapiens
gauggagugcagcuuggaa

SEQ ID NO: 623611 - RNA, 19 nt, Homo sapiens
uguaaguuccucucagaug

SEQ ID NO: 623612 - RNA, 19 nt, Homo sapiens
accuuuaacccuuacauuu

SEQ ID NO: 623613 - RNA, 19 nt, Homo sapiens
auucacagcuuccuaugac

SEQ ID NO: 623614 - RNA, 19 nt, Homo sapiens
ucacacaccgaugcacuug

SEQ ID NO: 623615 - RNA, 19 nt, Homo sapiens
guugugacuuuaguauaca

SEQ ID NO: 623616 - RNA, 19 nt, Homo sapiens
ugaguuugacagcaucauu

SEQ ID NO: 623617 - RNA, 19 nt, Homo sapiens
ccuccaggccauacgcuuu

SEQ ID NO: 623618 - RNA, 19 nt, Homo sapiens
gauccaaggagcugguucu

SEQ ID NO: 623619 - RNA, 19 nt, Homo sapiens
ggagacggcucaagaguuu

SEQ ID NO: 623620 - RNA, 19 nt, Homo sapiens
gcagaagguugugacuuua

SEQ ID NO: 623621 - RNA, 19 nt, Homo sapiens
caaggcagcuucaggagaa

SEQ ID NO: 623622 - RNA, 19 nt, Homo sapiens
gucaugagguugcuugaua

SEQ ID NO: 623623 - RNA, 19 nt, Homo sapiens
gaagagagaaaggaaauau

SEQ ID NO: 623624 - RNA, 19 nt, Homo sapiens
gcaaauccuuuuccacaua

SEQ ID NO: 623625 - RNA, 19 nt, Homo sapiens
gaggaucaaucuauguuuc

SEQ ID NO: 623626 - RNA, 19 nt, Homo sapiens
ugaggaaauuggaaacauu

SEQ ID NO: 623627 - RNA, 19 nt, Homo sapiens
ugcagaagguugugacuuu

SEQ ID NO: 623628 - RNA, 19 nt, Homo sapiens
aaagugaaguggcauuuua

SEQ ID NO: 623629 - RNA, 19 nt, Homo sapiens
uuaaacaguugcaguggaa

SEQ ID NO: 623630 - RNA, 19 nt, Homo sapiens
gugcuuaugcugcucuuua

SEQ ID NO: 623631 - RNA, 19 nt, Homo sapiens
gaaguggcauuuuaacuau

SEQ ID NO: 623632 - RNA, 19 nt, Homo sapiens
gguauccucucccucauuc

SEQ ID NO: 623633 - RNA, 19 nt, Homo sapiens
ccucaugacuucucuugug

SEQ ID NO: 623634 - RNA, 19 nt, Homo sapiens
gaccauguccgugaucuuu

SEQ ID NO: 623635 - RNA, 19 nt, Homo sapiens
ggaugacacugugaugaau

SEQ ID NO: 623636 - RNA, 19 nt, Homo sapiens
ggaagagagaaaggaaaua

SEQ ID NO: 623637 - RNA, 19 nt, Homo sapiens
caaucuauguuucucuuuc

SEQ ID NO: 623638 - RNA, 19 nt, Homo sapiens
uauguaaguuccucucaga

SEQ ID NO: 623639 - RNA, 19 nt, Homo sapiens
gguugugacuuuaguauac

SEQ ID NO: 623640 - RNA, 19 nt, Homo sapiens
acacugugaugaauggauu

SEQ ID NO: 623641 - RNA, 19 nt, Homo sapiens
cuaugaagguggugcuuau

SEQ ID NO: 623642 - RNA, 19 nt, Homo sapiens
gaagguugugacuuuagua

SEQ ID NO: 623643 - RNA, 19 nt, Homo sapiens
uuggaaacauucuggcuuu

SEQ ID NO: 623644 - RNA, 19 nt, Homo sapiens
gaggaaauuggaaacauuc

SEQ ID NO: 623645 - RNA, 19 nt, Homo sapiens
gcuccuaauuuccgaaugg

SEQ ID NO: 623646 - RNA, 19 nt, Homo sapiens
acacaccgaugcacuugga

SEQ ID NO: 623647 - RNA, 19 nt, Homo sapiens
caaauggggugaugaaugg

SEQ ID NO: 623648 - RNA, 19 nt, Homo sapiens
caugugugcugcccugaau

SEQ ID NO: 623649 - RNA, 19 nt, Homo sapiens
caguggaagucaugagguu

SEQ ID NO: 623650 - RNA, 19 nt, Homo sapiens
gaggaugacacugugauga

SEQ ID NO: 623651 - RNA, 19 nt, Homo sapiens
aggaggagcucaaguugca

SEQ ID NO: 623652 - RNA, 19 nt, Homo sapiens
cuuaugcugcucuuuauuu

SEQ ID NO: 623653 - RNA, 19 nt, Homo sapiens
uacaguaaaccacuugauu

SEQ ID NO: 623654 - RNA, 19 nt, Homo sapiens
cuacuuuacacuccaguuu

SEQ ID NO: 623655 - RNA, 19 nt, Homo sapiens
gaaccucuggcaaauccuu

SEQ ID NO: 623656 - RNA, 19 nt, Homo sapiens
cuuuacagguugcccauga

SEQ ID NO: 623657 - RNA, 19 nt, Homo sapiens
cagcaucauucagaaagug

SEQ ID NO: 623658 - RNA, 19 nt, Homo sapiens
caguaaaccacuugauuca

SEQ ID NO: 623659 - RNA, 19 nt, Homo sapiens
acaguaaaccacuugauuc

SEQ ID NO: 623660 - RNA, 19 nt, Homo sapiens
uuaugcugcucuuuauuug

SEQ ID NO: 623661 - RNA, 19 nt, Homo sapiens
ucagcacguuuaccuagga

SEQ ID NO: 623662 - RNA, 19 nt, Homo sapiens
ugacagcaucauucagaaa

SEQ ID NO: 623663 - RNA, 19 nt, Homo sapiens
aagcauuacugcaggaucu

SEQ ID NO: 623664 - RNA, 19 nt, Homo sapiens
gcaaauggggugaugaaug

SEQ ID NO: 623665 - RNA, 19 nt, Homo sapiens
cuaugacacuaccugcauu

SEQ ID NO: 623666 - RNA, 19 nt, Homo sapiens
cagcagccauggccuucug

SEQ ID NO: 623667 - RNA, 19 nt, Homo sapiens
gguucugugccaagcauua

SEQ ID NO: 623668 - RNA, 19 nt, Homo sapiens
ggaaauuggaaacauucug

SEQ ID NO: 623669 - RNA, 19 nt, Homo sapiens
ugaaguggcauuuuaacua

SEQ ID NO: 623670 - RNA, 19 nt, Homo sapiens
gaauucacagcuuccuaug

SEQ ID NO: 623671 - RNA, 19 nt, Homo sapiens
gaguuugacagcaucauuc

SEQ ID NO: 623672 - RNA, 19 nt, Homo sapiens
gaugacacugugaugaaug

SEQ ID NO: 623673 - RNA, 19 nt, Homo sapiens
gucugacuguggaguauga

SEQ ID NO: 623674 - RNA, 19 nt, Homo sapiens
gaggagacggcucaagagu

SEQ ID NO: 623675 - RNA, 19 nt, Homo sapiens
ggaggagacggcucaagag

SEQ ID NO: 623676 - RNA, 19 nt, Homo sapiens
guugaaugauacaguaaac

SEQ ID NO: 623677 - RNA, 19 nt, Homo sapiens
ucaggaggagcucaaguug

SEQ ID NO: 623678 - RNA, 19 nt, Homo sapiens
gacagcaucauucagaaag

SEQ ID NO: 623679 - RNA, 19 nt, Homo sapiens
uggaggagacggcucaaga

SEQ ID NO: 623680 - RNA, 19 nt, Homo sapiens
gugcugcccugaaucucau

SEQ ID NO: 623681 - RNA, 19 nt, Homo sapiens
gaaagugaaguggcauuuu

SEQ ID NO: 623682 - RNA, 19 nt, Homo sapiens
agaagguugugacuuuagu

SEQ ID NO: 623683 - RNA, 19 nt, Homo sapiens
uaucugcuccugccagugu

SEQ ID NO: 623684 - RNA, 19 nt, Homo sapiens
ggaucaaucuauguuucuc

SEQ ID NO: 623685 - RNA, 19 nt, Homo sapiens
gagacccuguggugggaau

SEQ ID NO: 623686 - RNA, 19 nt, Homo sapiens
agaaagugaaguggcauuu

SEQ ID NO: 623687 - RNA, 19 nt, Homo sapiens
ugaaugauacaguaaacca

SEQ ID NO: 623688 - RNA, 19 nt, Homo sapiens
ucaugagguugcuugauac

SEQ ID NO: 623689 - RNA, 19 nt, Homo sapiens
uggaagagagaaaggaaau

SEQ ID NO: 623690 - RNA, 19 nt, Homo sapiens
ugaggaucaaucuauguuu

SEQ ID NO: 623691 - RNA, 19 nt, Homo sapiens
uggcuuuucugucuucaua

SEQ ID NO: 623692 - RNA, 19 nt, Homo sapiens
gguugcccaugaggaaauu

SEQ ID NO: 623693 - RNA, 19 nt, Homo sapiens
ucgaggaguucaccuugca

SEQ ID NO: 623694 - RNA, 19 nt, Homo sapiens
caggaucuccagccaguuc

SEQ ID NO: 623695 - RNA, 19 nt, Homo sapiens
acagguugcccaugaggaa

SEQ ID NO: 623696 - RNA, 19 nt, Homo sapiens
gauggagugcagcuuggaa

SEQ ID NO: 623697 - RNA, 19 nt, Homo sapiens
uguaaguuccucucagaug

SEQ ID NO: 623698 - RNA, 19 nt, Homo sapiens
auucacagcuuccuaugac

SEQ ID NO: 623699 - RNA, 19 nt, Homo sapiens
ucacacaccgaugcacuug

SEQ ID NO: 623700 - RNA, 19 nt, Homo sapiens
guugugacuuuaguauaca

SEQ ID NO: 623701 - RNA, 19 nt, Homo sapiens
ugaguuugacagcaucauu

SEQ ID NO: 623702 - RNA, 19 nt, Homo sapiens
gauacaguaaaccacuuga

SEQ ID NO: 623703 - RNA, 19 nt, Homo sapiens
ugaagguggugcuuaugcu

SEQ ID NO: 623704 - RNA, 19 nt, Homo sapiens
aguguuauuuguaccuguu

SEQ ID NO: 623705 - RNA, 19 nt, Homo sapiens
ccuccaggccauacgcuuu

SEQ ID NO: 623706 - RNA, 19 nt, Homo sapiens
gauagcagcuuacaggaaa

SEQ ID NO: 623707 - RNA, 19 nt, Homo sapiens
ggccagagcugaagaguug

SEQ ID NO: 623708 - RNA, 19 nt, Homo sapiens
gcugugaacugaaauuaaa

SEQ ID NO: 623709 - RNA, 19 nt, Homo sapiens
gaccuuagauuuaguagug

SEQ ID NO: 623710 - RNA, 19 nt, Homo sapiens
gaagugaguguuucuauga

SEQ ID NO: 623711 - RNA, 19 nt, Homo sapiens
gcacaugcuucaauaguuc

SEQ ID NO: 623712 - RNA, 19 nt, Homo sapiens
aaacuaaggugcuaaaucu

SEQ ID NO: 623713 - RNA, 19 nt, Homo sapiens
uaagguagccucuaagaaa

SEQ ID NO: 623714 - RNA, 19 nt, Homo sapiens
ccacugggcuaucacuuaa

SEQ ID NO: 623715 - RNA, 19 nt, Homo sapiens
caucuaagguagccucuaa

SEQ ID NO: 623716 - RNA, 19 nt, Homo sapiens
gaagccgaccuuagauuua

SEQ ID NO: 623717 - RNA, 19 nt, Homo sapiens
uuuaagagcucuggugaua

SEQ ID NO: 623718 - RNA, 19 nt, Homo sapiens
cagaggaaguacaaacuaa

SEQ ID NO: 623719 - RNA, 19 nt, Homo sapiens
gauaaggacaugaugcuuu

SEQ ID NO: 623720 - RNA, 19 nt, Homo sapiens
ggacgugacuguggcuaaa

SEQ ID NO: 623721 - RNA, 19 nt, Homo sapiens
guucauuuguggugauaua

SEQ ID NO: 623722 - RNA, 19 nt, Homo sapiens
ggaggaggcaucuaaggua

SEQ ID NO: 623723 - RNA, 19 nt, Homo sapiens
uaagaucacugccagagau

SEQ ID NO: 623724 - RNA, 19 nt, Homo sapiens
gccauuacccagcuaaaua

SEQ ID NO: 623725 - RNA, 19 nt, Homo sapiens
uaagagcucuggugauaag

SEQ ID NO: 623726 - RNA, 19 nt, Homo sapiens
gauaugcauuugacuuguu

SEQ ID NO: 623727 - RNA, 19 nt, Homo sapiens
gccuauuccugaacuauaa

SEQ ID NO: 623728 - RNA, 19 nt, Homo sapiens
acauugagauagcagcuua

SEQ ID NO: 623729 - RNA, 19 nt, Homo sapiens
gccaaggugucauuuaugu

SEQ ID NO: 623730 - RNA, 19 nt, Homo sapiens
gcuuucagcuuacacaaau

SEQ ID NO: 623731 - RNA, 19 nt, Homo sapiens
gcaaagaaucccuagacuu

SEQ ID NO: 623732 - RNA, 19 nt, Homo sapiens
gcagaggaaguacaaacua

SEQ ID NO: 623733 - RNA, 19 nt, Homo sapiens
ggcuaucacuuaagaaaga

SEQ ID NO: 623734 - RNA, 19 nt, Homo sapiens
caaggcugaugcaggauuu

SEQ ID NO: 623735 - RNA, 19 nt, Homo sapiens
cuucaaggcuucagucuca

SEQ ID NO: 623736 - RNA, 19 nt, Homo sapiens
guaguauucuucccuuuua

SEQ ID NO: 623737 - RNA, 19 nt, Homo sapiens
gaggagacaguaauaucua

SEQ ID NO: 623738 - RNA, 19 nt, Homo sapiens
uaagaaaaccucccagaua

SEQ ID NO: 623739 - RNA, 19 nt, Homo sapiens
gcuacaaccuccaaagucu

SEQ ID NO: 623740 - RNA, 19 nt, Homo sapiens
ucacacgaaucucaccaaa

SEQ ID NO: 623741 - RNA, 19 nt, Homo sapiens
acuuuaggcuuucagcuua

SEQ ID NO: 623742 - RNA, 19 nt, Homo sapiens
aagccaaggugucauuuau

SEQ ID NO: 623743 - RNA, 19 nt, Homo sapiens
ugccagagauaaacuaaug

SEQ ID NO: 623744 - RNA, 19 nt, Homo sapiens
aggcuucagucucauauuu

SEQ ID NO: 623745 - RNA, 19 nt, Homo sapiens
uuacugaacuuucuuaucc

SEQ ID NO: 623746 - RNA, 19 nt, Homo sapiens
ggauguagcuuuucaccuu

SEQ ID NO: 623747 - RNA, 19 nt, Homo sapiens
gaaaaccaccccuuagauu

SEQ ID NO: 623748 - RNA, 19 nt, Homo sapiens
uaaacagccuauuccugaa

SEQ ID NO: 623749 - RNA, 19 nt, Homo sapiens
uaccaggacuugcucaaug

SEQ ID NO: 623750 - RNA, 19 nt, Homo sapiens
ccacucugauagaauuauu

SEQ ID NO: 623751 - RNA, 19 nt, Homo sapiens
gaucacugccagagauaaa

SEQ ID NO: 623752 - RNA, 19 nt, Homo sapiens
ccauuacccagcuaaauaa

SEQ ID NO: 623753 - RNA, 19 nt, Homo sapiens
gccuggaccuggagaagaa

SEQ ID NO: 623754 - RNA, 19 nt, Homo sapiens
gaacuuucuuauccuagca

SEQ ID NO: 623755 - RNA, 19 nt, Homo sapiens
gcacaguaaauaucccaaa

SEQ ID NO: 623756 - RNA, 19 nt, Homo sapiens
caauuccacucugauagaa

SEQ ID NO: 623757 - RNA, 19 nt, Homo sapiens
cagcguauauauaagaaag

SEQ ID NO: 623758 - RNA, 19 nt, Homo sapiens
ugaagccgaccuuagauuu

SEQ ID NO: 623759 - RNA, 19 nt, Homo sapiens
caacacuaccagcguauau

SEQ ID NO: 623760 - RNA, 19 nt, Homo sapiens
uaaauaucccaaacuguga

SEQ ID NO: 623761 - RNA, 19 nt, Homo sapiens
aagaaucccuagacuuuag

SEQ ID NO: 623762 - RNA, 19 nt, Homo sapiens
ccuagaauccucagugcua

SEQ ID NO: 623763 - RNA, 19 nt, Homo sapiens
ggacuugcucaaugucaaa

SEQ ID NO: 623764 - RNA, 19 nt, Homo sapiens
gaucugaggaacaccaaga

SEQ ID NO: 623765 - RNA, 19 nt, Homo sapiens
gcggaagaaugguacaagu

SEQ ID NO: 623766 - RNA, 19 nt, Homo sapiens
uugggcagcuggagaauga

SEQ ID NO: 623767 - RNA, 19 nt, Homo sapiens
uuccaugucuccuuuaaga

SEQ ID NO: 623768 - RNA, 19 nt, Homo sapiens
ucauuuaugugucaguuca

SEQ ID NO: 623769 - RNA, 19 nt, Homo sapiens
caaggugucauuuaugugu

SEQ ID NO: 623770 - RNA, 19 nt, Homo sapiens
uagaagaagugaguguuuc

SEQ ID NO: 623771 - RNA, 19 nt, Homo sapiens
ugaugaagccgaccuuaga

SEQ ID NO: 623772 - RNA, 19 nt, Homo sapiens
caaacuaaggugcuaaauc

SEQ ID NO: 623773 - RNA, 19 nt, Homo sapiens
acagucagcucuucaucug

SEQ ID NO: 623774 - RNA, 19 nt, Homo sapiens
gaaguagauucuggacagu

SEQ ID NO: 623775 - RNA, 19 nt, Homo sapiens
uagccuaggucauaaagag

SEQ ID NO: 623776 - RNA, 19 nt, Homo sapiens
cauuuguggugauauagaa

SEQ ID NO: 623777 - RNA, 19 nt, Homo sapiens
uuacccagcuaaauaaucu

SEQ ID NO: 623778 - RNA, 19 nt, Homo sapiens
cauuugcugugaacugaaa

SEQ ID NO: 623779 - RNA, 19 nt, Homo sapiens
ugauucaggugcagaggaa

SEQ ID NO: 623780 - RNA, 19 nt, Homo sapiens
ccaauuccacucugauaga

SEQ ID NO: 623781 - RNA, 19 nt, Homo sapiens
gcauugggcagcuggagaa

SEQ ID NO: 623782 - RNA, 19 nt, Homo sapiens
accaguggguuaagcauuu

SEQ ID NO: 623783 - RNA, 19 nt, Homo sapiens
gaacaccaagagugagaug

SEQ ID NO: 623784 - RNA, 19 nt, Homo sapiens
ugaggaacaccaagaguga

SEQ ID NO: 623785 - RNA, 19 nt, Homo sapiens
gcaccaacgaguacaagau

SEQ ID NO: 623786 - RNA, 19 nt, Homo sapiens
uaacaccugccaccacuau

SEQ ID NO: 623787 - RNA, 19 nt, Homo sapiens
cuaaaagacuucccuaaca

SEQ ID NO: 623788 - RNA, 19 nt, Homo sapiens
gcuucagucucauauuuag

SEQ ID NO: 623789 - RNA, 19 nt, Homo sapiens
acuaccagcguauauauaa

SEQ ID NO: 623790 - RNA, 19 nt, Homo sapiens
cuagaagaagugaguguuu

SEQ ID NO: 623791 - RNA, 19 nt, Homo sapiens
gucauuugcugugaacuga

SEQ ID NO: 623792 - RNA, 19 nt, Homo sapiens
accgagaaaucaaauauag

SEQ ID NO: 623793 - RNA, 19 nt, Homo sapiens
gcccaacuguguagcaucu

SEQ ID NO: 623794 - RNA, 19 nt, Homo sapiens
gagaaugaucugaggaaca

SEQ ID NO: 623795 - RNA, 19 nt, Homo sapiens
agcaaucacagaugaguua

SEQ ID NO: 623796 - RNA, 19 nt, Homo sapiens
acaccugccaccacuauaa

SEQ ID NO: 623797 - RNA, 19 nt, Homo sapiens
ucuuuacuccucacacuua

SEQ ID NO: 623798 - RNA, 19 nt, Homo sapiens
ccuacucgcuugcuagaag

SEQ ID NO: 623799 - RNA, 19 nt, Homo sapiens
aaagccaaggugucauuua

SEQ ID NO: 623800 - RNA, 19 nt, Homo sapiens
cagcuuacacaaaucuauu

SEQ ID NO: 623801 - RNA, 19 nt, Homo sapiens
cuccuucaauuccauauau

SEQ ID NO: 623802 - RNA, 19 nt, Homo sapiens
cuggagcaaucacagauga

SEQ ID NO: 623803 - RNA, 19 nt, Homo sapiens
ggcuucagucucauauuua

SEQ ID NO: 623804 - RNA, 19 nt, Homo sapiens
gcacgccaccuucgggaau

SEQ ID NO: 623805 - RNA, 19 nt, Homo sapiens
gcaguccgcggaagaaugg

SEQ ID NO: 623806 - RNA, 19 nt, Homo sapiens
ucaagacccucaacaauaa

SEQ ID NO: 623807 - RNA, 19 nt, Homo sapiens
ggacguagaugcugccuau

SEQ ID NO: 623808 - RNA, 19 nt, Homo sapiens
guacgaagaugaaauuaac

SEQ ID NO: 623809 - RNA, 19 nt, Homo sapiens
cagcagcacccgucuguua

SEQ ID NO: 623810 - RNA, 19 nt, Homo sapiens
gaaugugucuauuaaaugc

SEQ ID NO: 623811 - RNA, 19 nt, Homo sapiens
gaucaagacccucaacaau

SEQ ID NO: 623812 - RNA, 19 nt, Homo sapiens
ccuggaaugugucuauuaa

SEQ ID NO: 623813 - RNA, 19 nt, Homo sapiens
guggucaccucuacucuuu

SEQ ID NO: 623814 - RNA, 19 nt, Homo sapiens
uuacacaugugaaaccaaa

SEQ ID NO: 623815 - RNA, 19 nt, Homo sapiens
ggaaugugucuauuaaaug

SEQ ID NO: 623816 - RNA, 19 nt, Homo sapiens
ccaccugucucauaguguu

SEQ ID NO: 623817 - RNA, 19 nt, Homo sapiens
gaagagcuacacgcacuaa

SEQ ID NO: 623818 - RNA, 19 nt, Homo sapiens
augcagagcugucccaguu

SEQ ID NO: 623819 - RNA, 19 nt, Homo sapiens
acaauaaguucgccuccuu

SEQ ID NO: 623820 - RNA, 19 nt, Homo sapiens
gguacgaagaugaaauuaa

SEQ ID NO: 623821 - RNA, 19 nt, Homo sapiens
cguagaugcugccuauaug

SEQ ID NO: 623822 - RNA, 19 nt, Homo sapiens
ucacccaccugucucauag

SEQ ID NO: 623823 - RNA, 19 nt, Homo sapiens
gaacaagguggagcuggaa

SEQ ID NO: 623824 - RNA, 19 nt, Homo sapiens
ccugggagguucuggauuc

SEQ ID NO: 623825 - RNA, 19 nt, Homo sapiens
agaacuggcucucaaggau

SEQ ID NO: 623826 - RNA, 19 nt, Homo sapiens
uaaguucgccuccuucauc

SEQ ID NO: 623827 - RNA, 19 nt, Homo sapiens
gcacccgucuguuacacau

SEQ ID NO: 623828 - RNA, 19 nt, Homo sapiens
gcugagagcugagauugac

SEQ ID NO: 623829 - RNA, 19 nt, Homo sapiens
ccaagcgggucuccaucaa

SEQ ID NO: 623830 - RNA, 19 nt, Homo sapiens
guucuagcgucaaguuugu

SEQ ID NO: 623831 - RNA, 19 nt, Homo sapiens
aagcgggucuccaucaaug

SEQ ID NO: 623832 - RNA, 19 nt, Homo sapiens
cgaaacaccaaacaagaga

SEQ ID NO: 623833 - RNA, 19 nt, Homo sapiens
uaucaucgccgaggucaaa

SEQ ID NO: 623834 - RNA, 19 nt, Homo sapiens
guagaugcugccuauauga

SEQ ID NO: 623835 - RNA, 19 nt, Homo sapiens
uguggaagauuucaaaguc

SEQ ID NO: 623836 - RNA, 19 nt, Homo sapiens
caacaguggauuuggcuau

SEQ ID NO: 623837 - RNA, 19 nt, Homo sapiens
aaagccugcucucuccuaa

SEQ ID NO: 623838 - RNA, 19 nt, Homo sapiens
gggagguucuggauucagu

SEQ ID NO: 623839 - RNA, 19 nt, Homo sapiens
gaugcugccuauaugaaca

SEQ ID NO: 623840 - RNA, 19 nt, Homo sapiens
guggaagauuucaaaguca

SEQ ID NO: 623841 - RNA, 19 nt, Homo sapiens
caugcaggauguuguggaa

SEQ ID NO: 623842 - RNA, 19 nt, Homo sapiens
ggagucaacaguggauuug

SEQ ID NO: 623843 - RNA, 19 nt, Homo sapiens
cagguacgaagaugaaauu

SEQ ID NO: 623844 - RNA, 19 nt, Homo sapiens
aucaagacccucaacaaua

SEQ ID NO: 623845 - RNA, 19 nt, Homo sapiens
caaagccugcucucuccua

SEQ ID NO: 623846 - RNA, 19 nt, Homo sapiens
gcuggaagccaaggucaaa

SEQ ID NO: 623847 - RNA, 19 nt, Homo sapiens
caaagucagguacgaagau

SEQ ID NO: 623848 - RNA, 19 nt, Homo sapiens
ggcgaggagugcagguuga

SEQ ID NO: 623849 - RNA, 19 nt, Homo sapiens
caacggguuuggagucaac

SEQ ID NO: 623850 - RNA, 19 nt, Homo sapiens
uccaagaggucacugucaa

SEQ ID NO: 623851 - RNA, 19 nt, Homo sapiens
accaggagcugaugaacau

SEQ ID NO: 623852 - RNA, 19 nt, Homo sapiens
ugaaaugaaccgcaugauc

SEQ ID NO: 623853 - RNA, 19 nt, Homo sapiens
gaagcugaacugaggaaca

SEQ ID NO: 623854 - RNA, 19 nt, Homo sapiens
gaggagcgcgagcagauca

SEQ ID NO: 623855 - RNA, 19 nt, Homo sapiens
gggaugaccuucgaaacac

SEQ ID NO: 623856 - RNA, 19 nt, Homo sapiens
aagccaaggucaaaucucu

SEQ ID NO: 623857 - RNA, 19 nt, Homo sapiens
gcaggauguuguggaagau

SEQ ID NO: 623858 - RNA, 19 nt, Homo sapiens
gagcuacacgcacuaagag

SEQ ID NO: 623859 - RNA, 19 nt, Homo sapiens
aggauguuguggaagauuu

SEQ ID NO: 623860 - RNA, 19 nt, Homo sapiens
ugcaggauguuguggaaga

SEQ ID NO: 623861 - RNA, 19 nt, Homo sapiens
aagcugaacugaggaacau

SEQ ID NO: 623862 - RNA, 19 nt, Homo sapiens
gcaacggguuuggagucaa

SEQ ID NO: 623863 - RNA, 19 nt, Homo sapiens
aaagucagguacgaagaug

SEQ ID NO: 623864 - RNA, 19 nt, Homo sapiens
gaucaacuucagccacuca

SEQ ID NO: 623865 - RNA, 19 nt, Homo sapiens
ccgaggagaucaacuucag

SEQ ID NO: 623866 - RNA, 19 nt, Homo sapiens
ggaagccgcagccucuaca

SEQ ID NO: 623867 - RNA, 19 nt, Homo sapiens
cuucagccacucagucuuu

SEQ ID NO: 623868 - RNA, 19 nt, Homo sapiens
ccaggacugugaggcagaa

SEQ ID NO: 623869 - RNA, 19 nt, Homo sapiens
aguacuggcuauacccauu

SEQ ID NO: 623870 - RNA, 19 nt, Homo sapiens
gguucuagcgucaaguuug

SEQ ID NO: 623871 - RNA, 19 nt, Homo sapiens
ggaagccaaggucaaaucu

SEQ ID NO: 623872 - RNA, 19 nt, Homo sapiens
gaaacaccaaacaagagau

SEQ ID NO: 623873 - RNA, 19 nt, Homo sapiens
cucauaguguuuauaagug

SEQ ID NO: 623874 - RNA, 19 nt, Homo sapiens
ggcagcggcuacuccuuca

SEQ ID NO: 623875 - RNA, 19 nt, Homo sapiens
uagaugcugccuauaugaa

SEQ ID NO: 623876 - RNA, 19 nt, Homo sapiens
ucucggcaguccuccauca

SEQ ID NO: 623877 - RNA, 19 nt, Homo sapiens
gcaguguuccagcuugcaa

SEQ ID NO: 623878 - RNA, 19 nt, Homo sapiens
agugagugcucccucuguu

SEQ ID NO: 623879 - RNA, 19 nt, Homo sapiens
gccaagcgggucuccauca

SEQ ID NO: 623880 - RNA, 19 nt, Homo sapiens
guacuggcuauacccauuc

SEQ ID NO: 623881 - RNA, 19 nt, Homo sapiens
agagcuacacgcacuaaga

SEQ ID NO: 623882 - RNA, 19 nt, Homo sapiens
ggucaccucuacucuuucc

SEQ ID NO: 623883 - RNA, 19 nt, Homo sapiens
gcagcacccgucuguuaca

SEQ ID NO: 623884 - RNA, 19 nt, Homo sapiens
ccacucagucuuugaugca

SEQ ID NO: 623885 - RNA, 19 nt, Homo sapiens
ugaauuuguagcccugaaa

SEQ ID NO: 623886 - RNA, 19 nt, Homo sapiens
ugcugagaaugaauuugua

SEQ ID NO: 623887 - RNA, 19 nt, Homo sapiens
ucaaagucagguacgaaga

SEQ ID NO: 623888 - RNA, 19 nt, Homo sapiens
accuggaccuggauaguau

SEQ ID NO: 623889 - RNA, 19 nt, Homo sapiens
gaguuucuccaguuaacau

SEQ ID NO: 623890 - RNA, 19 nt, Homo sapiens
caaacggccauugcugaug

SEQ ID NO: 623891 - RNA, 19 nt, Homo sapiens
caagcgggucuccaucaau

SEQ ID NO: 623892 - RNA, 19 nt, Homo sapiens
aaacaccaaacaagagauc

SEQ ID NO: 623893 - RNA, 19 nt, Homo sapiens
cugccuauaugaacaaggu

SEQ ID NO: 623894 - RNA, 19 nt, Homo sapiens
gcugagaaugaauuuguag

SEQ ID NO: 623895 - RNA, 19 nt, Homo sapiens
cugcugagaaugaauuugu

SEQ ID NO: 623896 - RNA, 19 nt, Homo sapiens
ggacauaccugaagacuuu

SEQ ID NO: 623897 - RNA, 19 nt, Homo sapiens
aaacuacucuccugaauaa

SEQ ID NO: 623898 - RNA, 19 nt, Homo sapiens
ggaaagaagcgcaguauau

SEQ ID NO: 623899 - RNA, 19 nt, Homo sapiens
ggcgguagcuguuucauuu

SEQ ID NO: 623900 - RNA, 19 nt, Homo sapiens
gaagagcacuaccaacauc

SEQ ID NO: 623901 - RNA, 19 nt, Homo sapiens
gacuacagauuaagaauga

SEQ ID NO: 623902 - RNA, 19 nt, Homo sapiens
gacaugaacuggcaaagug

SEQ ID NO: 623903 - RNA, 19 nt, Homo sapiens
caagcacucuuccauauau

SEQ ID NO: 623904 - RNA, 19 nt, Homo sapiens
cacaagagguuucucauau

SEQ ID NO: 623905 - RNA, 19 nt, Homo sapiens
ggaaauggaucuugcaaaa

SEQ ID NO: 623906 - RNA, 19 nt, Homo sapiens
gaaagaagcgcaguauaug

SEQ ID NO: 623907 - RNA, 19 nt, Homo sapiens
ggucugggauacugcuuua

SEQ ID NO: 623908 - RNA, 19 nt, Homo sapiens
gcucaucugcgucaucuua

SEQ ID NO: 623909 - RNA, 19 nt, Homo sapiens
gguaugacacacuuucuua

SEQ ID NO: 623910 - RNA, 19 nt, Homo sapiens
caagagguuucucauaugu

SEQ ID NO: 623911 - RNA, 19 nt, Homo sapiens
caacccaggucauugaaau

SEQ ID NO: 623912 - RNA, 19 nt, Homo sapiens
uaaccauccuaucacaaua

SEQ ID NO: 623913 - RNA, 19 nt, Homo sapiens
cuacuacaguuaaacauug

SEQ ID NO: 623914 - RNA, 19 nt, Homo sapiens
cuauuagacuucuccauuu

SEQ ID NO: 623915 - RNA, 19 nt, Homo sapiens
gcaccuuccuuguacauca

SEQ ID NO: 623916 - RNA, 19 nt, Homo sapiens
gcuauuagacuucuccauu

SEQ ID NO: 623917 - RNA, 19 nt, Homo sapiens
gaacuaacuaccucaccua

SEQ ID NO: 623918 - RNA, 19 nt, Homo sapiens
gcaaauggagccgguauga

SEQ ID NO: 623919 - RNA, 19 nt, Homo sapiens
guuuaugguuggaacaaua

SEQ ID NO: 623920 - RNA, 19 nt, Homo sapiens
ggucuugucugaauaaacu

SEQ ID NO: 623921 - RNA, 19 nt, Homo sapiens
gcauuagucugggcauuga

SEQ ID NO: 623922 - RNA, 19 nt, Homo sapiens
gagaauguuucgcuguguu

SEQ ID NO: 623923 - RNA, 19 nt, Homo sapiens
uaaacuacucuccugaaua

SEQ ID NO: 623924 - RNA, 19 nt, Homo sapiens
ucacaagagguuucucaua

SEQ ID NO: 623925 - RNA, 19 nt, Homo sapiens
agcaggaucucauggauaa

SEQ ID NO: 623926 - RNA, 19 nt, Homo sapiens
ucucuucccuucuaacuug

SEQ ID NO: 623927 - RNA, 19 nt, Homo sapiens
caagagugcaguaguguga

SEQ ID NO: 623928 - RNA, 19 nt, Homo sapiens
acagggagcccauucguaa

SEQ ID NO: 623929 - RNA, 19 nt, Homo sapiens
gcacuaccaacaucgcuuu

SEQ ID NO: 623930 - RNA, 19 nt, Homo sapiens
guuaaacauugucaucuuc

SEQ ID NO: 623931 - RNA, 19 nt, Homo sapiens
cauuuggugucuucuuuaa

SEQ ID NO: 623932 - RNA, 19 nt, Homo sapiens
ggacuacagauuaagaaug

SEQ ID NO: 623933 - RNA, 19 nt, Homo sapiens
ccuauggucuugucugaau

SEQ ID NO: 623934 - RNA, 19 nt, Homo sapiens
acacgaaccucaauagacu

SEQ ID NO: 623935 - RNA, 19 nt, Homo sapiens
caaaagacguuccauaguc

SEQ ID NO: 623936 - RNA, 19 nt, Homo sapiens
acaagagguuucucauaug

SEQ ID NO: 623937 - RNA, 19 nt, Homo sapiens
ccaagcacucuuccauaua

SEQ ID NO: 623938 - RNA, 19 nt, Homo sapiens
gcacugcucagacccauca

SEQ ID NO: 623939 - RNA, 19 nt, Homo sapiens
aagccaauguguauacuga

SEQ ID NO: 623940 - RNA, 19 nt, Homo sapiens
gcacucuuccauauauaaa

SEQ ID NO: 623941 - RNA, 19 nt, Homo sapiens
ggaaggaucggagcugguu

SEQ ID NO: 623942 - RNA, 19 nt, Homo sapiens
cuaacuaccucaccuaaaa

SEQ ID NO: 623943 - RNA, 19 nt, Homo sapiens
gaaccucaauagacuccau

SEQ ID NO: 623944 - RNA, 19 nt, Homo sapiens
gcucagacccaucauuauc

SEQ ID NO: 623945 - RNA, 19 nt, Homo sapiens
uggcugggacuacagauua

SEQ ID NO: 623946 - RNA, 19 nt, Homo sapiens
gugaagagcacuaccaaca

SEQ ID NO: 623947 - RNA, 19 nt, Homo sapiens
ggugagaccguguaagaug

SEQ ID NO: 623948 - RNA, 19 nt, Homo sapiens
gaucggagcugguuuuguc

SEQ ID NO: 623949 - RNA, 19 nt, Homo sapiens
ugcauuauuuggucucuuu

SEQ ID NO: 623950 - RNA, 19 nt, Homo sapiens
guaaccauccuaucacaau

SEQ ID NO: 623951 - RNA, 19 nt, Homo sapiens
uuuauucucuucccuucua

SEQ ID NO: 623952 - RNA, 19 nt, Homo sapiens
gagcucaucugcgucaucu

SEQ ID NO: 623953 - RNA, 19 nt, Homo sapiens
ucucauggauaaucucaau

SEQ ID NO: 623954 - RNA, 19 nt, Homo sapiens
uaaagggaauguguaugug

SEQ ID NO: 623955 - RNA, 19 nt, Homo sapiens
gaaaacacgaaccucaaua

SEQ ID NO: 623956 - RNA, 19 nt, Homo sapiens
ggagaauguuucgcugugu

SEQ ID NO: 623957 - RNA, 19 nt, Homo sapiens
caauguguauacugaagug

SEQ ID NO: 623958 - RNA, 19 nt, Homo sapiens
gggaauguguaugugaaga

SEQ ID NO: 623959 - RNA, 19 nt, Homo sapiens
gagccgguaugacacacuu

SEQ ID NO: 623960 - RNA, 19 nt, Homo sapiens
ccaaguggcugggacuaca

SEQ ID NO: 623961 - RNA, 19 nt, Homo sapiens
cugcucagacccaucauua

SEQ ID NO: 623962 - RNA, 19 nt, Homo sapiens
accaagcacucuuccauau

SEQ ID NO: 623963 - RNA, 19 nt, Homo sapiens
ggaccaaaguaagaucuac

SEQ ID NO: 623964 - RNA, 19 nt, Homo sapiens
caucuucauucagagcaua

SEQ ID NO: 623965 - RNA, 19 nt, Homo sapiens
gucuacaucuucauucaga

SEQ ID NO: 623966 - RNA, 19 nt, Homo sapiens
ggagcccauucguaagauu

SEQ ID NO: 623967 - RNA, 19 nt, Homo sapiens
gauggccauugcagaaguu

SEQ ID NO: 623968 - RNA, 19 nt, Homo sapiens
aaaucuggcuguauucagu

SEQ ID NO: 623969 - RNA, 19 nt, Homo sapiens
caaccaagcacucuuccau

SEQ ID NO: 623970 - RNA, 19 nt, Homo sapiens
ggcugggacuacagauuaa

SEQ ID NO: 623971 - RNA, 19 nt, Homo sapiens
uuaaagggaauguguaugu

SEQ ID NO: 623972 - RNA, 19 nt, Homo sapiens
gagcccauucguaagauuu

SEQ ID NO: 623973 - RNA, 19 nt, Homo sapiens
caucauuccucugggcauu

SEQ ID NO: 623974 - RNA, 19 nt, Homo sapiens
gagauacagccuccucuuc

SEQ ID NO: 623975 - RNA, 19 nt, Homo sapiens
ggaagacuuuacaggacau

SEQ ID NO: 623976 - RNA, 19 nt, Homo sapiens
ggacaccgucugguaguga

SEQ ID NO: 623977 - RNA, 19 nt, Homo sapiens
uuuggugucuucuuuaaug

SEQ ID NO: 623978 - RNA, 19 nt, Homo sapiens
ugacacacuuucuuacaac

SEQ ID NO: 623979 - RNA, 19 nt, Homo sapiens
gaguucacgugcaaaugga

SEQ ID NO: 623980 - RNA, 19 nt, Homo sapiens
gauuaagaaugacccaaaa

SEQ ID NO: 623981 - RNA, 19 nt, Homo sapiens
aaauggagccgguaugaca

SEQ ID NO: 623982 - RNA, 19 nt, Homo sapiens
gggucuacaucuucauuca

SEQ ID NO: 623983 - RNA, 19 nt, Homo sapiens
aaacacgaaccucaauaga

SEQ ID NO: 623984 - RNA, 19 nt, Homo sapiens
cgcauuggcuggagauaca

SEQ ID NO: 623985 - RNA, 19 nt, Homo sapiens
cagcaaucauggcucugaa

SEQ ID NO: 623986 - RNA, 19 nt, Homo sapiens
gcaaagugguuuuaaaagc

SEQ ID NO: 623987 - RNA, 19 nt, Homo sapiens
aagcacucuuccauauaua

SEQ ID NO: 623988 - RNA, 19 nt, Homo sapiens
ccaaagccaauguguauac

SEQ ID NO: 623989 - RNA, 19 nt, Homo sapiens
aagggaauguguaugugaa

SEQ ID NO: 623990 - RNA, 19 nt, Homo sapiens
gaugaugucgugggcauug

SEQ ID NO: 623991 - RNA, 19 nt, Homo sapiens
gauacagccuccucuucgu

SEQ ID NO: 623992 - RNA, 19 nt, Homo sapiens
auaaacuacucuccugaau

SEQ ID NO: 623993 - RNA, 19 nt, Homo sapiens
aaacaaccaagcacucuuc

SEQ ID NO: 623994 - RNA, 19 nt, Homo sapiens
ggacugugccagcgucauc

SEQ ID NO: 623995 - RNA, 19 nt, Homo sapiens
gcaacacugggauucuuug

SEQ ID NO: 623996 - RNA, 19 nt, Homo sapiens
guaggagguuacuuuguua

SEQ ID NO: 623997 - RNA, 19 nt, Homo sapiens
caucucagcugcccucuuc

SEQ ID NO: 623998 - RNA, 19 nt, Homo sapiens
gccacuaucugccauguga

SEQ ID NO: 623999 - RNA, 19 nt, Homo sapiens
gugcugggcuucuacuuug

SEQ ID NO: 624000 - RNA, 19 nt, Homo sapiens
ggacgccaccaacaacuuu

SEQ ID NO: 624001 - RNA, 19 nt, Homo sapiens
ggaauagcccuaccugagu

SEQ ID NO: 624002 - RNA, 19 nt, Homo sapiens
caugugaguugggcaaauu

SEQ ID NO: 624003 - RNA, 19 nt, Homo sapiens
gagaucaugugccagucuu

SEQ ID NO: 624004 - RNA, 19 nt, Homo sapiens
cuaccugagugcccuguuu

SEQ ID NO: 624005 - RNA, 19 nt, Homo sapiens
aaacggcucugggcuggaa

SEQ ID NO: 624006 - RNA, 19 nt, Homo sapiens
ucaaugggcucacuaaccu

SEQ ID NO: 624007 - RNA, 19 nt, Homo sapiens
ccaacaacuuuagcuaugu

SEQ ID NO: 624008 - RNA, 19 nt, Homo sapiens
guacauacugggugugaug

SEQ ID NO: 624009 - RNA, 19 nt, Homo sapiens
ggagguuacuuuguuagag

SEQ ID NO: 624010 - RNA, 19 nt, Homo sapiens
gaccaccucugagccuuga

SEQ ID NO: 624011 - RNA, 19 nt, Homo sapiens
ucacggugcugggcuucua

SEQ ID NO: 624012 - RNA, 19 nt, Homo sapiens
gcguacagcguguccauga

SEQ ID NO: 624013 - RNA, 19 nt, Homo sapiens
ucaccucucugcccugcuu

SEQ ID NO: 624014 - RNA, 19 nt, Homo sapiens
ggagcgggaucuuuucuug

SEQ ID NO: 624015 - RNA, 19 nt, Homo sapiens
ucuacgcccugcagaagaa

SEQ ID NO: 624016 - RNA, 19 nt, Homo sapiens
cagcuggcgucaauaagca

SEQ ID NO: 624017 - RNA, 19 nt, Homo sapiens
cuacauguccagcuucuuc

SEQ ID NO: 624018 - RNA, 19 nt, Homo sapiens
ccaccaacaacuuuagcua

SEQ ID NO: 624019 - RNA, 19 nt, Homo sapiens
ggugcugggcuucuacuuu

SEQ ID NO: 624020 - RNA, 19 nt, Homo sapiens
gcaacagcgagaccucuug

SEQ ID NO: 624021 - RNA, 19 nt, Homo sapiens
accaacaacuuuagcuaug

SEQ ID NO: 624022 - RNA, 19 nt, Homo sapiens
ugaguugggcaaauuguug

SEQ ID NO: 624023 - RNA, 19 nt, Homo sapiens
guacugcaggccaagcaaa

SEQ ID NO: 624024 - RNA, 19 nt, Homo sapiens
ccaccuggccuucgacauc

SEQ ID NO: 624025 - RNA, 19 nt, Homo sapiens
ccacguguaucggcaucuu

SEQ ID NO: 624026 - RNA, 19 nt, Homo sapiens
guccagcuggcgucaauaa

SEQ ID NO: 624027 - RNA, 19 nt, Homo sapiens
gaguugggcaaauuguuga

SEQ ID NO: 624028 - RNA, 19 nt, Homo sapiens
acaggcagcagccacauug

SEQ ID NO: 624029 - RNA, 19 nt, Homo sapiens
caccaacaacuuuagcuau

SEQ ID NO: 624030 - RNA, 19 nt, Homo sapiens
guacagcguguccaugagu

SEQ ID NO: 624031 - RNA, 19 nt, Homo sapiens
gcuacugccuggcguacag

SEQ ID NO: 624032 - RNA, 19 nt, Homo sapiens
cuacuucacagcaggauuc

SEQ ID NO: 624033 - RNA, 19 nt, Homo sapiens
ugcgagcgguacaaagaaa

SEQ ID NO: 624034 - RNA, 19 nt, Homo sapiens
cgugcgagcgguacaaaga

SEQ ID NO: 624035 - RNA, 19 nt, Homo sapiens
gacgccaccaacaacuuua

SEQ ID NO: 624036 - RNA, 19 nt, Homo sapiens
cggccuugcuuuccucauc

SEQ ID NO: 624037 - RNA, 19 nt, Homo sapiens
gcuacugcguguacauacu

SEQ ID NO: 624038 - RNA, 19 nt, Homo sapiens
ccaccucugagccuugaaa

SEQ ID NO: 624039 - RNA, 19 nt, Homo sapiens
acagcgagaccucuugguu

SEQ ID NO: 624040 - RNA, 19 nt, Homo sapiens
ccaugugaguugggcaaau

SEQ ID NO: 624041 - RNA, 19 nt, Homo sapiens
cuucacagcaggauucauc

SEQ ID NO: 624042 - RNA, 19 nt, Homo sapiens
ccagcuccuucucucacaa

SEQ ID NO: 624043 - RNA, 19 nt, Homo sapiens
ucagguaccuuauguauua

SEQ ID NO: 624044 - RNA, 19 nt, Homo sapiens
gacaggagcccuuauauua

SEQ ID NO: 624045 - RNA, 19 nt, Homo sapiens
aaagggaucuucugcauuu

SEQ ID NO: 624046 - RNA, 19 nt, Homo sapiens
gaaacacacugccaugaga

SEQ ID NO: 624047 - RNA, 19 nt, Homo sapiens
ccaaguggcugcuguggua

SEQ ID NO: 624048 - RNA, 19 nt, Homo sapiens
gaagaaagugauaagguua

SEQ ID NO: 624049 - RNA, 19 nt, Homo sapiens
gaaagaagacugcaaucaa

SEQ ID NO: 624050 - RNA, 19 nt, Homo sapiens
aaacauagccauugauuga

SEQ ID NO: 624051 - RNA, 19 nt, Homo sapiens
gaucaaaacuggauuaaga

SEQ ID NO: 624052 - RNA, 19 nt, Homo sapiens
ugacauacuuggagagaaa

SEQ ID NO: 624053 - RNA, 19 nt, Homo sapiens
auagcaaccuguauuguua

SEQ ID NO: 624054 - RNA, 19 nt, Homo sapiens
gcaaucaagugagagcuaa

SEQ ID NO: 624055 - RNA, 19 nt, Homo sapiens
ccacaagucuuaccucauc

SEQ ID NO: 624056 - RNA, 19 nt, Homo sapiens
ugaagaaagugauaagguu

SEQ ID NO: 624057 - RNA, 19 nt, Homo sapiens
caggagcccuuauauuauu

SEQ ID NO: 624058 - RNA, 19 nt, Homo sapiens
gaaaucggaauguaccaua

SEQ ID NO: 624059 - RNA, 19 nt, Homo sapiens
gguccaaccuuacacuaaa

SEQ ID NO: 624060 - RNA, 19 nt, Homo sapiens
caaccuguauuguuaguau

SEQ ID NO: 624061 - RNA, 19 nt, Homo sapiens
gaaggcaccucagagcaaa

SEQ ID NO: 624062 - RNA, 19 nt, Homo sapiens
ugacauuucucucuuuaga

SEQ ID NO: 624063 - RNA, 19 nt, Homo sapiens
ggacaggagcccuuauauu

SEQ ID NO: 624064 - RNA, 19 nt, Homo sapiens
ucugagaaaugucuaauug

SEQ ID NO: 624065 - RNA, 19 nt, Homo sapiens
gguauaugcucccuccaaa

SEQ ID NO: 624066 - RNA, 19 nt, Homo sapiens
acacaucgcaucuacauuu

SEQ ID NO: 624067 - RNA, 19 nt, Homo sapiens
gauacugccuguacugguu

SEQ ID NO: 624068 - RNA, 19 nt, Homo sapiens
caagugagagcuaaacaaa

SEQ ID NO: 624069 - RNA, 19 nt, Homo sapiens
caauggcucuuucuacuuc

SEQ ID NO: 624070 - RNA, 19 nt, Homo sapiens
gauaaaggcagcaguuugu

SEQ ID NO: 624071 - RNA, 19 nt, Homo sapiens
caaauugguuggauuggau

SEQ ID NO: 624072 - RNA, 19 nt, Homo sapiens
uaucuccucucuucaguuu

SEQ ID NO: 624073 - RNA, 19 nt, Homo sapiens
gcaggcugguuauaugauu

SEQ ID NO: 624074 - RNA, 19 nt, Homo sapiens
ccucuuaccuuguuucugu

SEQ ID NO: 624075 - RNA, 19 nt, Homo sapiens
gcagaaggcuggacuaccu

SEQ ID NO: 624076 - RNA, 19 nt, Homo sapiens
gcaaauugguuggauugga

SEQ ID NO: 624077 - RNA, 19 nt, Homo sapiens
gagaaaugucuaauuggua

SEQ ID NO: 624078 - RNA, 19 nt, Homo sapiens
aaagaagacugcaaucaag

SEQ ID NO: 624079 - RNA, 19 nt, Homo sapiens
uaaccugcuugcuccuuua

SEQ ID NO: 624080 - RNA, 19 nt, Homo sapiens
gagacggucagucagauua

SEQ ID NO: 624081 - RNA, 19 nt, Homo sapiens
aaagaagugugaaacauag

SEQ ID NO: 624082 - RNA, 19 nt, Homo sapiens
ggagcuaucgcauugaauu

SEQ ID NO: 624083 - RNA, 19 nt, Homo sapiens
gguaguaagacaagaguaa

SEQ ID NO: 624084 - RNA, 19 nt, Homo sapiens
gaaguaucauuaccacaag

SEQ ID NO: 624085 - RNA, 19 nt, Homo sapiens
ggacuugccaguuucuuug

SEQ ID NO: 624086 - RNA, 19 nt, Homo sapiens
guugaucuguguaggaauu

SEQ ID NO: 624087 - RNA, 19 nt, Homo sapiens
gauggaugauugugauuca

SEQ ID NO: 624088 - RNA, 19 nt, Homo sapiens
gggaucuucugcauuuaaa

SEQ ID NO: 624089 - RNA, 19 nt, Homo sapiens
caucugcuuugccaucuuu

SEQ ID NO: 624090 - RNA, 19 nt, Homo sapiens
ggaugccucuuaccuuguu

SEQ ID NO: 624091 - RNA, 19 nt, Homo sapiens
aaagagugaugaagaaagu

SEQ ID NO: 624092 - RNA, 19 nt, Homo sapiens
gagcaaauugguuggauug

SEQ ID NO: 624093 - RNA, 19 nt, Homo sapiens
cuuagugacuggaauggua

SEQ ID NO: 624094 - RNA, 19 nt, Homo sapiens
gaccaagacuuuugcaauu

SEQ ID NO: 624095 - RNA, 19 nt, Homo sapiens
ucaaagggaucuucugcau

SEQ ID NO: 624096 - RNA, 19 nt, Homo sapiens
gaaacauagccauugauug

SEQ ID NO: 624097 - RNA, 19 nt, Homo sapiens
ugagaaaugucuaauuggu

SEQ ID NO: 624098 - RNA, 19 nt, Homo sapiens
gaaagaaagaagacugcaa

SEQ ID NO: 624099 - RNA, 19 nt, Homo sapiens
gaagacugcaaucaaguga

SEQ ID NO: 624100 - RNA, 19 nt, Homo sapiens
uuaaucagguaccuuaugu

SEQ ID NO: 624101 - RNA, 19 nt, Homo sapiens
ccaaagugcugggauuaca

SEQ ID NO: 624102 - RNA, 19 nt, Homo sapiens
caggcugguuauaugauua

SEQ ID NO: 624103 - RNA, 19 nt, Homo sapiens
ggagugcaguggcgcaauc

SEQ ID NO: 624104 - RNA, 19 nt, Homo sapiens
agacugcaaucaagugaga

SEQ ID NO: 624105 - RNA, 19 nt, Homo sapiens
gacauacaauggcucuuuc

SEQ ID NO: 624106 - RNA, 19 nt, Homo sapiens
aaaucggaauguaccauaa

SEQ ID NO: 624107 - RNA, 19 nt, Homo sapiens
cuacuucucuggcauaugc

SEQ ID NO: 624108 - RNA, 19 nt, Homo sapiens
uaagacccauccauaucaa

SEQ ID NO: 624109 - RNA, 19 nt, Homo sapiens
ugaauuuggugccuucuag

SEQ ID NO: 624110 - RNA, 19 nt, Homo sapiens
ugaaacauagccauugauu

SEQ ID NO: 624111 - RNA, 19 nt, Homo sapiens
caccacacccagcuaauuu

SEQ ID NO: 624112 - RNA, 19 nt, Homo sapiens
uaugcuaucuccucucuuc

SEQ ID NO: 624113 - RNA, 19 nt, Homo sapiens
acagaagagucuaccauca

SEQ ID NO: 624114 - RNA, 19 nt, Homo sapiens
gagcuaucgcauugaauuu

SEQ ID NO: 624115 - RNA, 19 nt, Homo sapiens
aaaacuaccuccauucuug

SEQ ID NO: 624116 - RNA, 19 nt, Homo sapiens
ugugaaacauagccauuga

SEQ ID NO: 624117 - RNA, 19 nt, Homo sapiens
agaaacacaucgcaucuac

SEQ ID NO: 624118 - RNA, 19 nt, Homo sapiens
gugguuaccuggcauugau

SEQ ID NO: 624119 - RNA, 19 nt, Homo sapiens
ugacuggaaugguauaugc

SEQ ID NO: 624120 - RNA, 19 nt, Homo sapiens
aauccaaacucucaauuac

SEQ ID NO: 624121 - RNA, 19 nt, Homo sapiens
cggaauguaccauaauaaa

SEQ ID NO: 624122 - RNA, 19 nt, Homo sapiens
ucaguuagcauacuucauc

SEQ ID NO: 624123 - RNA, 19 nt, Homo sapiens
aaaucaaagugaagaguuc

SEQ ID NO: 624124 - RNA, 19 nt, Homo sapiens
aagaguaacauuccagaaa

SEQ ID NO: 624125 - RNA, 19 nt, Homo sapiens
gacggagucucgcucuuuc

SEQ ID NO: 624126 - RNA, 19 nt, Homo sapiens
aaagaaagaagacugcaau

SEQ ID NO: 624127 - RNA, 19 nt, Homo sapiens
ggacaguacuacgcagaag

SEQ ID NO: 624128 - RNA, 19 nt, Homo sapiens
cagaagagucuaccaucaa

SEQ ID NO: 624129 - RNA, 19 nt, Homo sapiens
uuuggguucugcuuucuua

SEQ ID NO: 624130 - RNA, 19 nt, Homo sapiens
caaucucggcucacuguaa

SEQ ID NO: 624131 - RNA, 19 nt, Homo sapiens
gauuauacccagacauaca

SEQ ID NO: 624132 - RNA, 19 nt, Homo sapiens
gaccuacaccaucugcuuu

SEQ ID NO: 624133 - RNA, 19 nt, Homo sapiens
cuaaccugcuugcuccuuu

SEQ ID NO: 624134 - RNA, 19 nt, Homo sapiens
aaagauaaaggcagcaguu

SEQ ID NO: 624135 - RNA, 19 nt, Homo sapiens
gcagcugggccacaaguau

SEQ ID NO: 624136 - RNA, 19 nt, Homo sapiens
caaagggaucuucugcauu

SEQ ID NO: 624137 - RNA, 19 nt, Homo sapiens
agucugaccugaaagaaag

SEQ ID NO: 624138 - RNA, 19 nt, Homo sapiens
cagaaaacgguguaauuua

SEQ ID NO: 624139 - RNA, 19 nt, Homo sapiens
agaaguaucauuaccacaa

SEQ ID NO: 624140 - RNA, 19 nt, Homo sapiens
gcuauuauuugugacauac

SEQ ID NO: 624141 - RNA, 19 nt, Homo sapiens
aaacacaucgcaucuacau

SEQ ID NO: 624142 - RNA, 19 nt, Homo sapiens
gaaacaaaagcuugaaaga

SEQ ID NO: 624143 - RNA, 19 nt, Homo sapiens
ggcaacuucuucugcauua

SEQ ID NO: 624144 - RNA, 19 nt, Homo sapiens
gagacaacgugacuuuaau

SEQ ID NO: 624145 - RNA, 19 nt, Homo sapiens
ccuggaagauggaaauaaa

SEQ ID NO: 624146 - RNA, 19 nt, Homo sapiens
cgagacaacgugacuuuaa

SEQ ID NO: 624147 - RNA, 19 nt, Homo sapiens
cgacccacgucuacaugua

SEQ ID NO: 624148 - RNA, 19 nt, Homo sapiens
caacgcuugcuauuuauuu

SEQ ID NO: 624149 - RNA, 19 nt, Homo sapiens
aagccaagccgcaagguua

SEQ ID NO: 624150 - RNA, 19 nt, Homo sapiens
caugguggcugcguccuuu

SEQ ID NO: 624151 - RNA, 19 nt, Homo sapiens
gggcuucauugacaucuuc

SEQ ID NO: 624152 - RNA, 19 nt, Homo sapiens
gcucaccuccucccugauu

SEQ ID NO: 624153 - RNA, 19 nt, Homo sapiens
gguccgcucugcagugugu

SEQ ID NO: 624154 - RNA, 19 nt, Homo sapiens
ggucuucugcaucuucuuu

SEQ ID NO: 624155 - RNA, 19 nt, Homo sapiens
ugcgggagguggagcauuu

SEQ ID NO: 624156 - RNA, 19 nt, Homo sapiens
caaguucuccagugccauu

SEQ ID NO: 624157 - RNA, 19 nt, Homo sapiens
ggccgucagugucuucuuc

SEQ ID NO: 624158 - RNA, 19 nt, Homo sapiens
gaagccaagccgcaagguu

SEQ ID NO: 624159 - RNA, 19 nt, Homo sapiens
gcguguggguggaguguuc

SEQ ID NO: 624160 - RNA, 19 nt, Homo sapiens
ggagcaucauccaggucua

SEQ ID NO: 624161 - RNA, 19 nt, Homo sapiens
gaguggaucugcggugaag

SEQ ID NO: 624162 - RNA, 19 nt, Homo sapiens
gggcaacuucuucugcauu

SEQ ID NO: 624163 - RNA, 19 nt, Homo sapiens
gcucaacugcugcgugugu

SEQ ID NO: 624164 - RNA, 19 nt, Homo sapiens
gguggagcauuuccugaag

SEQ ID NO: 624165 - RNA, 19 nt, Homo sapiens
uuaggaagaagcccaaaga

SEQ ID NO: 624166 - RNA, 19 nt, Homo sapiens
agacaacgugacuuuaaug

SEQ ID NO: 624167 - RNA, 19 nt, Homo sapiens
gcaacuucuucugcauuag

SEQ ID NO: 624168 - RNA, 19 nt, Homo sapiens
gcaguucgaggugcucaug

SEQ ID NO: 624169 - RNA, 19 nt, Homo sapiens
acagggaggagguacagaa

SEQ ID NO: 624170 - RNA, 19 nt, Homo sapiens
ucagugucuucuucaagga

SEQ ID NO: 624171 - RNA, 19 nt, Homo sapiens
ggguuuggcacucaacuuc

SEQ ID NO: 624172 - RNA, 19 nt, Homo sapiens
ccaaggccgucagugucuu

SEQ ID NO: 624173 - RNA, 19 nt, Homo sapiens
caacuucuucugcauuagg

SEQ ID NO: 624174 - RNA, 19 nt, Homo sapiens
uuccagcccucgcucauca

SEQ ID NO: 624175 - RNA, 19 nt, Homo sapiens
cagguccgcucugcagugu

SEQ ID NO: 624176 - RNA, 19 nt, Homo sapiens
gacaacgugacuuuaaugg

SEQ ID NO: 624177 - RNA, 19 nt, Homo sapiens
gcacagggaggagguacag

SEQ ID NO: 624178 - RNA, 19 nt, Homo sapiens
gcuucuccauguucuucaa

SEQ ID NO: 624179 - RNA, 19 nt, Homo sapiens
ccgucuaccucuucagcuu

SEQ ID NO: 624180 - RNA, 19 nt, Homo sapiens
gaucaaaucuacugugaga

SEQ ID NO: 624181 - RNA, 19 nt, Homo sapiens
gcaccaaccugaaacagaa

SEQ ID NO: 624182 - RNA, 19 nt, Homo sapiens
caaagaaucugaaguuuac

SEQ ID NO: 624183 - RNA, 19 nt, Homo sapiens
caacuugacucucacugua

SEQ ID NO: 624184 - RNA, 19 nt, Homo sapiens
gaaaauaucuccaacuuca

SEQ ID NO: 624185 - RNA, 19 nt, Homo sapiens
gcucagaaguugccuaugu

SEQ ID NO: 624186 - RNA, 19 nt, Homo sapiens
cagcagaucugaccacugu

SEQ ID NO: 624187 - RNA, 19 nt, Homo sapiens
gacaaagaaucugaaguuu

SEQ ID NO: 624188 - RNA, 19 nt, Homo sapiens
cgacaaagaaucugaaguu

SEQ ID NO: 624189 - RNA, 19 nt, Homo sapiens
gaagggccauuucuuugug

SEQ ID NO: 624190 - RNA, 19 nt, Homo sapiens
uaaaguggcugcgucgauu

SEQ ID NO: 624191 - RNA, 19 nt, Homo sapiens
gcaaggcggcucuagcuaa

SEQ ID NO: 624192 - RNA, 19 nt, Homo sapiens
caacaagcccucaggauuc

SEQ ID NO: 624193 - RNA, 19 nt, Homo sapiens
acaaugcccuggagucaaa

SEQ ID NO: 624194 - RNA, 19 nt, Homo sapiens
uuaaagcuccugucacuaa

SEQ ID NO: 624195 - RNA, 19 nt, Homo sapiens
cgaaacaguccacgucuuu

SEQ ID NO: 624196 - RNA, 19 nt, Homo sapiens
gaagugccaugcccuuuac

SEQ ID NO: 624197 - RNA, 19 nt, Homo sapiens
guagccagaucugaacaua

SEQ ID NO: 624198 - RNA, 19 nt, Homo sapiens
ucaaauauaacgugucuga

SEQ ID NO: 624199 - RNA, 19 nt, Homo sapiens
ucacaaaccaguacaacaa

SEQ ID NO: 624200 - RNA, 19 nt, Homo sapiens
agccagaucugaacauaaa

SEQ ID NO: 624201 - RNA, 19 nt, Homo sapiens
acagacaacuugacucuca

SEQ ID NO: 624202 - RNA, 19 nt, Homo sapiens
acaagaugcuucaggagaa

SEQ ID NO: 624203 - RNA, 19 nt, Homo sapiens
caacccagcuggccucuac

SEQ ID NO: 624204 - RNA, 19 nt, Homo sapiens
ucacaccaccugaggguua

SEQ ID NO: 624205 - RNA, 19 nt, Homo sapiens
ccaacaagcccucaggauu

SEQ ID NO: 624206 - RNA, 19 nt, Homo sapiens
cgaagugccaugcccuuua

SEQ ID NO: 624207 - RNA, 19 nt, Homo sapiens
uaaagcuccugucacuaaa

SEQ ID NO: 624208 - RNA, 19 nt, Homo sapiens
agaaacaggaguugaauga

SEQ ID NO: 624209 - RNA, 19 nt, Homo sapiens
caaggcggcucuagcuaau

SEQ ID NO: 624210 - RNA, 19 nt, Homo sapiens
caagaugcuucaggagaaa

SEQ ID NO: 624211 - RNA, 19 nt, Homo sapiens
cagcuggccucuacucuuc

SEQ ID NO: 624212 - RNA, 19 nt, Homo sapiens
gcacagacaacuugacucu

SEQ ID NO: 624213 - RNA, 19 nt, Homo sapiens
gcucagaacagaaucaaag

SEQ ID NO: 624214 - RNA, 19 nt, Homo sapiens
gauuggaaaugcucagaag

SEQ ID NO: 624215 - RNA, 19 nt, Homo sapiens
ggaaaauacuagcaauaug

SEQ ID NO: 624216 - RNA, 19 nt, Homo sapiens
aggcggcucuagcuaauuu

SEQ ID NO: 624217 - RNA, 19 nt, Homo sapiens
ggcucuagcuaauuuaugu

SEQ ID NO: 624218 - RNA, 19 nt, Homo sapiens
ggaagcgucauccauacaa

SEQ ID NO: 624219 - RNA, 19 nt, Homo sapiens
caauaugacacacuuggaa

SEQ ID NO: 624220 - RNA, 19 nt, Homo sapiens
agaaguugccuauguguga

SEQ ID NO: 624221 - RNA, 19 nt, Homo sapiens
uggaaaugcucagaaguug

SEQ ID NO: 624222 - RNA, 19 nt, Homo sapiens
caacaaugcccuggaguca

SEQ ID NO: 624223 - RNA, 19 nt, Homo sapiens
caagugagccagcagaucu

SEQ ID NO: 624224 - RNA, 19 nt, Homo sapiens
ucaggauucagaaguguua

SEQ ID NO: 624225 - RNA, 19 nt, Homo sapiens
gaagggaagcgucauccau

SEQ ID NO: 624226 - RNA, 19 nt, Homo sapiens
gauguaaucacagccauug

SEQ ID NO: 624227 - RNA, 19 nt, Homo sapiens
guccacgucuuucuugguu

SEQ ID NO: 624228 - RNA, 19 nt, Homo sapiens
uauuggagauguaaucaca

SEQ ID NO: 624229 - RNA, 19 nt, Homo sapiens
gcagaucugaccacuguuc

SEQ ID NO: 624230 - RNA, 19 nt, Homo sapiens
ugaaacagaagggccauuu

SEQ ID NO: 624231 - RNA, 19 nt, Homo sapiens
cauacaagaugaauuuagc

SEQ ID NO: 624232 - RNA, 19 nt, Homo sapiens
aggaucaaaucuacuguga

SEQ ID NO: 624233 - RNA, 19 nt, Homo sapiens
gccuaugugugacaaaugu

SEQ ID NO: 624234 - RNA, 19 nt, Homo sapiens
ggagaaacaggaguugaau

SEQ ID NO: 624235 - RNA, 19 nt, Homo sapiens
ggccucuacucuucugaaa

SEQ ID NO: 624236 - RNA, 19 nt, Homo sapiens
gaagcgucauccauacaag

SEQ ID NO: 624237 - RNA, 19 nt, Homo sapiens
aagggaagcgucauccaua

SEQ ID NO: 624238 - RNA, 19 nt, Homo sapiens
gcaauaugacacacuugga

SEQ ID NO: 624239 - RNA, 19 nt, Homo sapiens
cagcagacccuuagaccau

SEQ ID NO: 624240 - RNA, 19 nt, Homo sapiens
cuuggaagcucagaacaga

SEQ ID NO: 624241 - RNA, 19 nt, Homo sapiens
cuagcaauaugacacacuu

SEQ ID NO: 624242 - RNA, 19 nt, Homo sapiens
ugggauuguugguguguuu

SEQ ID NO: 624243 - RNA, 19 nt, Homo sapiens
uguuaaagcuccugucacu

SEQ ID NO: 624244 - RNA, 19 nt, Homo sapiens
gagaaacaggaguugaaug

SEQ ID NO: 624245 - RNA, 19 nt, Homo sapiens
ucaaaucuacugugagaag

SEQ ID NO: 624246 - RNA, 19 nt, Homo sapiens
gaaucugaaguuuacaaga

SEQ ID NO: 624247 - RNA, 19 nt, Homo sapiens
gagcagccucucgccauuu

SEQ ID NO: 624248 - RNA, 19 nt, Homo sapiens
caaauguggcacugggauu

SEQ ID NO: 624249 - RNA, 19 nt, Homo sapiens
gaagcucagaacagaauca

SEQ ID NO: 624250 - RNA, 19 nt, Homo sapiens
cugccagggucaucacaaa

SEQ ID NO: 624251 - RNA, 19 nt, Homo sapiens
agaugaauuuagccucuga

SEQ ID NO: 624252 - RNA, 19 nt, Homo sapiens
ccgaaacaguccacgucuu

SEQ ID NO: 624253 - RNA, 19 nt, Homo sapiens
caugaccacccagcagaua

SEQ ID NO: 624254 - RNA, 19 nt, Homo sapiens
ccucuacucuucugaaaau

SEQ ID NO: 624255 - RNA, 19 nt, Homo sapiens
ucgccugccuccagcacua

SEQ ID NO: 624256 - RNA, 19 nt, Homo sapiens
gggaaaauacuagcaauau

SEQ ID NO: 624257 - RNA, 19 nt, Homo sapiens
aacaagcccucaggauuca

SEQ ID NO: 624258 - RNA, 19 nt, Homo sapiens
ccacgucuuucuugguuuu

SEQ ID NO: 624259 - RNA, 19 nt, Homo sapiens
ucccugccuugguuaauug

SEQ ID NO: 624260 - RNA, 19 nt, Homo sapiens
uguggaggaucaaaucuac

SEQ ID NO: 624261 - RNA, 19 nt, Homo sapiens
gcucuagcuaauuuaugua

SEQ ID NO: 624262 - RNA, 19 nt, Homo sapiens
aucaaaggcugcacagaca

SEQ ID NO: 624263 - RNA, 19 nt, Homo sapiens
ggucaucacaaaccaguac

SEQ ID NO: 624264 - RNA, 19 nt, Homo sapiens
ggcaccaaccugaaacaga

SEQ ID NO: 624265 - RNA, 19 nt, Homo sapiens
uuggaaaugcucagaaguu

SEQ ID NO: 624266 - RNA, 19 nt, Homo sapiens
ggaaauccuggagucugaa

SEQ ID NO: 624267 - RNA, 19 nt, Homo sapiens
gaaacaggaguugaaugag

SEQ ID NO: 624268 - RNA, 19 nt, Homo sapiens
cugaaaauaucuccaacuu

SEQ ID NO: 624269 - RNA, 19 nt, Homo sapiens
ccauacaagaugaauuuag

SEQ ID NO: 624270 - RNA, 19 nt, Homo sapiens
gauuguugguguguuugug

SEQ ID NO: 624271 - RNA, 19 nt, Homo sapiens
aagcuccugucacuaaagu

SEQ ID NO: 624272 - RNA, 19 nt, Homo sapiens
auucagaaguguuaaagcu

SEQ ID NO: 624273 - RNA, 19 nt, Homo sapiens
ggauucagaaguguuaaag

SEQ ID NO: 624274 - RNA, 19 nt, Homo sapiens
gaaauccuggagucugaag

SEQ ID NO: 624275 - RNA, 19 nt, Homo sapiens
uagccagaucugaacauaa

SEQ ID NO: 624276 - RNA, 19 nt, Homo sapiens
gaaucaaaggcugcacaga

SEQ ID NO: 624277 - RNA, 19 nt, Homo sapiens
aggagaaacaggaguugaa

SEQ ID NO: 624278 - RNA, 19 nt, Homo sapiens
uggaagcucagaacagaau

SEQ ID NO: 624279 - RNA, 19 nt, Homo sapiens
cucagaaguugccuaugug

SEQ ID NO: 624280 - RNA, 19 nt, Homo sapiens
caacagaaauuaucccuuu

SEQ ID NO: 624281 - RNA, 19 nt, Homo sapiens
gaaaacagaugaacaagaa

SEQ ID NO: 624282 - RNA, 19 nt, Homo sapiens
gagcguuucucccauguug

SEQ ID NO: 624283 - RNA, 19 nt, Homo sapiens
gauguuaccuucgacuuuc

SEQ ID NO: 624284 - RNA, 19 nt, Homo sapiens
aaacacgucccuuugagua

SEQ ID NO: 624285 - RNA, 19 nt, Homo sapiens
uaacagaguuugcaaugcu

SEQ ID NO: 624286 - RNA, 19 nt, Homo sapiens
gcugaagcauguagugaga

SEQ ID NO: 624287 - RNA, 19 nt, Homo sapiens
ugacagcacaccagucuaa

SEQ ID NO: 624288 - RNA, 19 nt, Homo sapiens
ccacauucauccuccagaa

SEQ ID NO: 624289 - RNA, 19 nt, Homo sapiens
guaagaagcgagaaucugu

SEQ ID NO: 624290 - RNA, 19 nt, Homo sapiens
uauggaaucuggaagugaa

SEQ ID NO: 624291 - RNA, 19 nt, Homo sapiens
gcauucauuugguacuauu

SEQ ID NO: 624292 - RNA, 19 nt, Homo sapiens
gcacaaguggauagagaaa

SEQ ID NO: 624293 - RNA, 19 nt, Homo sapiens
cagaaauuaucccuuuaug

SEQ ID NO: 624294 - RNA, 19 nt, Homo sapiens
gaacaagaaguaaucaacu

SEQ ID NO: 624295 - RNA, 19 nt, Homo sapiens
uugcacaacuggugaagaa

SEQ ID NO: 624296 - RNA, 19 nt, Homo sapiens
acacugguuuggcuuauau

SEQ ID NO: 624297 - RNA, 19 nt, Homo sapiens
ccuuuauguuugcgaauua

SEQ ID NO: 624298 - RNA, 19 nt, Homo sapiens
gacacugguuuggcuuaua

SEQ ID NO: 624299 - RNA, 19 nt, Homo sapiens
uccagaagaucuuguuaga

SEQ ID NO: 624300 - RNA, 19 nt, Homo sapiens
gcagcacacaucccacuuu

SEQ ID NO: 624301 - RNA, 19 nt, Homo sapiens
cuacuacacuggcacaagu

SEQ ID NO: 624302 - RNA, 19 nt, Homo sapiens
ugguuuggcuuauauaugu

SEQ ID NO: 624303 - RNA, 19 nt, Homo sapiens
gcucuggcauuacugcaau

SEQ ID NO: 624304 - RNA, 19 nt, Homo sapiens
uaccuucgacuuucagaua

SEQ ID NO: 624305 - RNA, 19 nt, Homo sapiens
ugaagcauguagugagaug

SEQ ID NO: 624306 - RNA, 19 nt, Homo sapiens
uaaaacaguugccacauuc

SEQ ID NO: 624307 - RNA, 19 nt, Homo sapiens
uggcacaaguggauagaga

SEQ ID NO: 624308 - RNA, 19 nt, Homo sapiens
caccagccuuggaguuauu

SEQ ID NO: 624309 - RNA, 19 nt, Homo sapiens
acaccagucuaacagaguu

SEQ ID NO: 624310 - RNA, 19 nt, Homo sapiens
cgaauuauggaaucuggaa

SEQ ID NO: 624311 - RNA, 19 nt, Homo sapiens
cuaaaacaguugccacauu

SEQ ID NO: 624312 - RNA, 19 nt, Homo sapiens
gaaacgcuggcuugcacaa

SEQ ID NO: 624313 - RNA, 19 nt, Homo sapiens
ucaccagccuuggaguuau

SEQ ID NO: 624314 - RNA, 19 nt, Homo sapiens
aaacagaugaacaagaagu

SEQ ID NO: 624315 - RNA, 19 nt, Homo sapiens
cagcacacaucccacuuuu

SEQ ID NO: 624316 - RNA, 19 nt, Homo sapiens
ugacacugguuuggcuuau

SEQ ID NO: 624317 - RNA, 19 nt, Homo sapiens
ggcauucauuugguacuau

SEQ ID NO: 624318 - RNA, 19 nt, Homo sapiens
uggcauucauuugguacua

SEQ ID NO: 624319 - RNA, 19 nt, Homo sapiens
uaagaugguccugcagcua

SEQ ID NO: 624320 - RNA, 19 nt, Homo sapiens
auauaugucagacguauga

SEQ ID NO: 624321 - RNA, 19 nt, Homo sapiens
gcuguggcauucauuuggu

SEQ ID NO: 624322 - RNA, 19 nt, Homo sapiens
uaagaagcgagaaucuguu

SEQ ID NO: 624323 - RNA, 19 nt, Homo sapiens
gagcuguccaguccugaga

SEQ ID NO: 624324 - RNA, 19 nt, Homo sapiens
cagaugaacaagaaguaau

SEQ ID NO: 624325 - RNA, 19 nt, Homo sapiens
ucuaacagaguuugcaaug

SEQ ID NO: 624326 - RNA, 19 nt, Homo sapiens
gagauguuaccuucgacuu

SEQ ID NO: 624327 - RNA, 19 nt, Homo sapiens
gcucaccagccuuggaguu

SEQ ID NO: 624328 - RNA, 19 nt, Homo sapiens
acacgucccuuugaguauc

SEQ ID NO: 624329 - RNA, 19 nt, Homo sapiens
aagaugacaccaccacgaa

SEQ ID NO: 624330 - RNA, 19 nt, Homo sapiens
agugagauguuaccuucga

SEQ ID NO: 624331 - RNA, 19 nt, Homo sapiens
uaaguaagaagcgagaauc

SEQ ID NO: 624332 - RNA, 19 nt, Homo sapiens
gaugacaccaccacgaaac

SEQ ID NO: 624333 - RNA, 19 nt, Homo sapiens
agauguuaccuucgacuuu

SEQ ID NO: 624334 - RNA, 19 nt, Homo sapiens
ucuaucaguggaucaauga

SEQ ID NO: 624335 - RNA, 19 nt, Homo sapiens
gaugaacaagaaguaauca

SEQ ID NO: 624336 - RNA, 19 nt, Homo sapiens
cagcaaaacacgucccuuu

SEQ ID NO: 624337 - RNA, 19 nt, Homo sapiens
acagaugaacaagaaguaa

SEQ ID NO: 624338 - RNA, 19 nt, Homo sapiens
aagaugguccugcagcuau

SEQ ID NO: 624339 - RNA, 19 nt, Homo sapiens
ugaacaagaaguaaucaac

SEQ ID NO: 624340 - RNA, 19 nt, Homo sapiens
ggugaaaacagaugaacaa

SEQ ID NO: 624341 - RNA, 19 nt, Homo sapiens
caacccacccaccuugaca

SEQ ID NO: 624342 - RNA, 19 nt, Homo sapiens
acauucauccuccagaaga

SEQ ID NO: 624343 - RNA, 19 nt, Homo sapiens
uccugcagcuauccaaaga

SEQ ID NO: 624344 - RNA, 19 nt, Homo sapiens
gaaagcaucuccuuaauga

SEQ ID NO: 624345 - RNA, 19 nt, Homo sapiens
gaacggaucuuuaugcaaa

SEQ ID NO: 624346 - RNA, 19 nt, Homo sapiens
caacguagcuuacagaguu

SEQ ID NO: 624347 - RNA, 19 nt, Homo sapiens
gaagaaagcaucuccuuaa

SEQ ID NO: 624348 - RNA, 19 nt, Homo sapiens
ggaauuagggugucauuua

SEQ ID NO: 624349 - RNA, 19 nt, Homo sapiens
gaagagagauuacauacuc

SEQ ID NO: 624350 - RNA, 19 nt, Homo sapiens
gguguaaaguucagaaaua

SEQ ID NO: 624351 - RNA, 19 nt, Homo sapiens
gaaaggcugugucagauau

SEQ ID NO: 624352 - RNA, 19 nt, Homo sapiens
gaacugauuugcuuucuca

SEQ ID NO: 624353 - RNA, 19 nt, Homo sapiens
ugacaaagcuuucaaacau

SEQ ID NO: 624354 - RNA, 19 nt, Homo sapiens
gaacagcgguuggcuuuau

SEQ ID NO: 624355 - RNA, 19 nt, Homo sapiens
gaaagaagaacgaggaauu

SEQ ID NO: 624356 - RNA, 19 nt, Homo sapiens
guacagccauguuaacaaa

SEQ ID NO: 624357 - RNA, 19 nt, Homo sapiens
uagaagaacuggacagaaa

SEQ ID NO: 624358 - RNA, 19 nt, Homo sapiens
ggaagacacugaagcaaau

SEQ ID NO: 624359 - RNA, 19 nt, Homo sapiens
gcagaaauauugaaaggau

SEQ ID NO: 624360 - RNA, 19 nt, Homo sapiens
gagaguagaugcacugaau

SEQ ID NO: 624361 - RNA, 19 nt, Homo sapiens
gaagucagcacgaagauuu

SEQ ID NO: 624362 - RNA, 19 nt, Homo sapiens
gaacaaaggaaacguuuau

SEQ ID NO: 624363 - RNA, 19 nt, Homo sapiens
cccaggaacuguaaauuua

SEQ ID NO: 624364 - RNA, 19 nt, Homo sapiens
gaacucaagucuuuagauc

SEQ ID NO: 624365 - RNA, 19 nt, Homo sapiens
cagcagagauggccaaaga

SEQ ID NO: 624366 - RNA, 19 nt, Homo sapiens
gaacauauggaugcuauaa

SEQ ID NO: 624367 - RNA, 19 nt, Homo sapiens
gaagccaguuuacaucaaa

SEQ ID NO: 624368 - RNA, 19 nt, Homo sapiens
agucaaagcucgaguagaa

SEQ ID NO: 624369 - RNA, 19 nt, Homo sapiens
ggaccaggaucuuaaugaa

SEQ ID NO: 624370 - RNA, 19 nt, Homo sapiens
ggaagaaagcaucuccuua

SEQ ID NO: 624371 - RNA, 19 nt, Homo sapiens
ucaaacagguaucuaagaa

SEQ ID NO: 624372 - RNA, 19 nt, Homo sapiens
gaaagacaagagcagauua

SEQ ID NO: 624373 - RNA, 19 nt, Homo sapiens
caaauucuaugguguaaag

SEQ ID NO: 624374 - RNA, 19 nt, Homo sapiens
guacaugcucaguuuauua

SEQ ID NO: 624375 - RNA, 19 nt, Homo sapiens
caaaauggcuaucauggua

SEQ ID NO: 624376 - RNA, 19 nt, Homo sapiens
gaagaacgaggaauugcua

SEQ ID NO: 624377 - RNA, 19 nt, Homo sapiens
gcagugcaacacagaauua

SEQ ID NO: 624378 - RNA, 19 nt, Homo sapiens
gaaagaagaguguaugaag

SEQ ID NO: 624379 - RNA, 19 nt, Homo sapiens
cagaagauuuggacaauuc

SEQ ID NO: 624380 - RNA, 19 nt, Homo sapiens
guagaucccuucaguucaa

SEQ ID NO: 624381 - RNA, 19 nt, Homo sapiens
ggaauaaaccagcauguuc

SEQ ID NO: 624382 - RNA, 19 nt, Homo sapiens
acaagaagauggucacgaa

SEQ ID NO: 624383 - RNA, 19 nt, Homo sapiens
gaauuagggugucauuuac

SEQ ID NO: 624384 - RNA, 19 nt, Homo sapiens
gaagcaaagcucaaugaaa

SEQ ID NO: 624385 - RNA, 19 nt, Homo sapiens
guuaguaccugguggcaaa

SEQ ID NO: 624386 - RNA, 19 nt, Homo sapiens
uagaugcacugaaugauga

SEQ ID NO: 624387 - RNA, 19 nt, Homo sapiens
uugaugagcuuucugcuaa

SEQ ID NO: 624388 - RNA, 19 nt, Homo sapiens
acagacaguugcuaaauga

SEQ ID NO: 624389 - RNA, 19 nt, Homo sapiens
aaagacagauugcugcuau

SEQ ID NO: 624390 - RNA, 19 nt, Homo sapiens
aaacagaacccaaauucaa

SEQ ID NO: 624391 - RNA, 19 nt, Homo sapiens
ggaagucacugcuggaaac

SEQ ID NO: 624392 - RNA, 19 nt, Homo sapiens
gaaagggauaaguggauua

SEQ ID NO: 624393 - RNA, 19 nt, Homo sapiens
gaaagaaacagagggcaaa

SEQ ID NO: 624394 - RNA, 19 nt, Homo sapiens
gcaauucaguuuguucuca

SEQ ID NO: 624395 - RNA, 19 nt, Homo sapiens
aaagaagaguguaugaaga

SEQ ID NO: 624396 - RNA, 19 nt, Homo sapiens
gaauagacagcauaaacaa

SEQ ID NO: 624397 - RNA, 19 nt, Homo sapiens
aagaugaacuacaaaguga

SEQ ID NO: 624398 - RNA, 19 nt, Homo sapiens
ccaaggauuuacaagauga

SEQ ID NO: 624399 - RNA, 19 nt, Homo sapiens
gcuauucaguuaacuuuca

SEQ ID NO: 624400 - RNA, 19 nt, Homo sapiens
uaauaaagcgucaagaaga

SEQ ID NO: 624401 - RNA, 19 nt, Homo sapiens
gcacgaagauuuuaaugga

SEQ ID NO: 624402 - RNA, 19 nt, Homo sapiens
gaauaaaccagcauguuca

SEQ ID NO: 624403 - RNA, 19 nt, Homo sapiens
gaaacuacuuguggagaga

SEQ ID NO: 624404 - RNA, 19 nt, Homo sapiens
gaauuaaggagcuucagaa

SEQ ID NO: 624405 - RNA, 19 nt, Homo sapiens
uaggugaacuugaagcaaa

SEQ ID NO: 624406 - RNA, 19 nt, Homo sapiens
ggaaacagguuauuuuauc

SEQ ID NO: 624407 - RNA, 19 nt, Homo sapiens
gauaucgaacgccaaguua

SEQ ID NO: 624408 - RNA, 19 nt, Homo sapiens
gaagaaaauucgagaacuu

SEQ ID NO: 624409 - RNA, 19 nt, Homo sapiens
aaacagaagcuggaauuaa

SEQ ID NO: 624410 - RNA, 19 nt, Homo sapiens
agaacuaggugaacuugaa

SEQ ID NO: 624411 - RNA, 19 nt, Homo sapiens
ggaauagacagcauaaaca

SEQ ID NO: 624412 - RNA, 19 nt, Homo sapiens
agaaagaacuggcagaaac

SEQ ID NO: 624413 - RNA, 19 nt, Homo sapiens
aggaagaacuagcucagua

SEQ ID NO: 624414 - RNA, 19 nt, Homo sapiens
gacaaauucuaugguguaa

SEQ ID NO: 624415 - RNA, 19 nt, Homo sapiens
aagcaaagcucaaugaaaa

SEQ ID NO: 624416 - RNA, 19 nt, Homo sapiens
ggaagccaguuuacaucaa

SEQ ID NO: 624417 - RNA, 19 nt, Homo sapiens
gagauuacauacucuagag

SEQ ID NO: 624418 - RNA, 19 nt, Homo sapiens
ugucauguuuguacugaua

SEQ ID NO: 624419 - RNA, 19 nt, Homo sapiens
ucaaugagaaucugagaaa

SEQ ID NO: 624420 - RNA, 19 nt, Homo sapiens
aagcagaacugggaacuga

SEQ ID NO: 624421 - RNA, 19 nt, Homo sapiens
gacaaagcuuucaaacaug

SEQ ID NO: 624422 - RNA, 19 nt, Homo sapiens
gacaagagcagauuaagca

SEQ ID NO: 624423 - RNA, 19 nt, Homo sapiens
cuacuuuggugaugaagaa

SEQ ID NO: 624424 - RNA, 19 nt, Homo sapiens
gaagaaagaagaguguaug

SEQ ID NO: 624425 - RNA, 19 nt, Homo sapiens
ugaaaccaaugaugcuauu

SEQ ID NO: 624426 - RNA, 19 nt, Homo sapiens
gagaagagaaugcagaaca

SEQ ID NO: 624427 - RNA, 19 nt, Homo sapiens
gacgagcccuggaauauac

SEQ ID NO: 624428 - RNA, 19 nt, Homo sapiens
ugggagauguauauaguaa

SEQ ID NO: 624429 - RNA, 19 nt, Homo sapiens
ucaguuaacuuucaaacag

SEQ ID NO: 624430 - RNA, 19 nt, Homo sapiens
gaagaagaaagaagagugu

SEQ ID NO: 624431 - RNA, 19 nt, Homo sapiens
gcgcagaaauauugaaagg

SEQ ID NO: 624432 - RNA, 19 nt, Homo sapiens
gaaaaccugcgcagaaaua

SEQ ID NO: 624433 - RNA, 19 nt, Homo sapiens
ugaaccagcuuucuacaca

SEQ ID NO: 624434 - RNA, 19 nt, Homo sapiens
gaaacagaacccaaauuca

SEQ ID NO: 624435 - RNA, 19 nt, Homo sapiens
gaaagaacuggcagaaaca

SEQ ID NO: 624436 - RNA, 19 nt, Homo sapiens
ggauuuacaagaugaacua

SEQ ID NO: 624437 - RNA, 19 nt, Homo sapiens
gagacgagcccuggaauau

SEQ ID NO: 624438 - RNA, 19 nt, Homo sapiens
gugaugaaccuccuugaaa

SEQ ID NO: 624439 - RNA, 19 nt, Homo sapiens
gaacuacaaagugaaagaa

SEQ ID NO: 624440 - RNA, 19 nt, Homo sapiens
gaaagaugaacuacaaagu

SEQ ID NO: 624441 - RNA, 19 nt, Homo sapiens
gagauaaaauggaggauau

SEQ ID NO: 624442 - RNA, 19 nt, Homo sapiens
caacagcaccagauucuca

SEQ ID NO: 624443 - RNA, 19 nt, Homo sapiens
cgaagcaauccuuauuaua

SEQ ID NO: 624444 - RNA, 19 nt, Homo sapiens
gaaauucacuucaguccaa

SEQ ID NO: 624445 - RNA, 19 nt, Homo sapiens
gcccacaccugcuuaguuu

SEQ ID NO: 624446 - RNA, 19 nt, Homo sapiens
gggcugacaucuagaauca

SEQ ID NO: 624447 - RNA, 19 nt, Homo sapiens
gcccagaacuucacacugu

SEQ ID NO: 624448 - RNA, 19 nt, Homo sapiens
agaggaagcugaugucaug

SEQ ID NO: 624449 - RNA, 19 nt, Homo sapiens
ggauggcccuguccaaguu

SEQ ID NO: 624450 - RNA, 19 nt, Homo sapiens
ggccaagcaauuauuauua

SEQ ID NO: 624451 - RNA, 19 nt, Homo sapiens
caccacaacugcccaggua

SEQ ID NO: 624452 - RNA, 19 nt, Homo sapiens
ggacaaagucacggaguaa

SEQ ID NO: 624453 - RNA, 19 nt, Homo sapiens
agacugggcugacaucuag

SEQ ID NO: 624454 - RNA, 19 nt, Homo sapiens
gaaagcaaccgccaacucu

SEQ ID NO: 624455 - RNA, 19 nt, Homo sapiens
gaaaccggcugugggaugu

SEQ ID NO: 624456 - RNA, 19 nt, Homo sapiens
caggugggcuagaagguaa

SEQ ID NO: 624457 - RNA, 19 nt, Homo sapiens
gggcggagcaugugucuug

SEQ ID NO: 624458 - RNA, 19 nt, Homo sapiens
gaucguggucuauguggua

SEQ ID NO: 624459 - RNA, 19 nt, Homo sapiens
aggcaugacuggaaaguug

SEQ ID NO: 624460 - RNA, 19 nt, Homo sapiens
ggauagagaagcccauuuc

SEQ ID NO: 624461 - RNA, 19 nt, Homo sapiens
gugaccaacuuccuuguga

SEQ ID NO: 624462 - RNA, 19 nt, Homo sapiens
uuacaggcaugacuggaaa

SEQ ID NO: 624463 - RNA, 19 nt, Homo sapiens
gcacccugcucaagcucua

SEQ ID NO: 624464 - RNA, 19 nt, Homo sapiens
gggcaaagacagcaagaga

SEQ ID NO: 624465 - RNA, 19 nt, Homo sapiens
cagcaaagccacccucuuc

SEQ ID NO: 624466 - RNA, 19 nt, Homo sapiens
caucaucaccaaacucaaa

SEQ ID NO: 624467 - RNA, 19 nt, Homo sapiens
gaacccugcugcccuuucu

SEQ ID NO: 624468 - RNA, 19 nt, Homo sapiens
caugagggccacacucuuu

SEQ ID NO: 624469 - RNA, 19 nt, Homo sapiens
aaacagcugucgccucagu

SEQ ID NO: 624470 - RNA, 19 nt, Homo sapiens
ccacaaagaaugccacagu

SEQ ID NO: 624471 - RNA, 19 nt, Homo sapiens
ggugggcucugaaggugaa

SEQ ID NO: 624472 - RNA, 19 nt, Homo sapiens
uggacaaagucacggagua

SEQ ID NO: 624473 - RNA, 19 nt, Homo sapiens
gcuggccaagcaauuauua

SEQ ID NO: 624474 - RNA, 19 nt, Homo sapiens
gagacugggcugacaucua

SEQ ID NO: 624475 - RNA, 19 nt, Homo sapiens
auuauaagacggagaagua

SEQ ID NO: 624476 - RNA, 19 nt, Homo sapiens
ggcagggaauucuaagugu

SEQ ID NO: 624477 - RNA, 19 nt, Homo sapiens
ccacaccugcuuaguuuau

SEQ ID NO: 624478 - RNA, 19 nt, Homo sapiens
gcuaccaggugggcuagaa

SEQ ID NO: 624479 - RNA, 19 nt, Homo sapiens
gggcagggaauucuaagug

SEQ ID NO: 624480 - RNA, 19 nt, Homo sapiens
ccugugagaucuggaguug

SEQ ID NO: 624481 - RNA, 19 nt, Homo sapiens
uggaguggcuggaaggaau

SEQ ID NO: 624482 - RNA, 19 nt, Homo sapiens
gccguucccugcugguuga

SEQ ID NO: 624483 - RNA, 19 nt, Homo sapiens
gaagacuuggugccacaaa

SEQ ID NO: 624484 - RNA, 19 nt, Homo sapiens
ccaccuggagccucaguaa

SEQ ID NO: 624485 - RNA, 19 nt, Homo sapiens
gguagaauuccacccuuga

SEQ ID NO: 624486 - RNA, 19 nt, Homo sapiens
acagucaccuucagcaagu

SEQ ID NO: 624487 - RNA, 19 nt, Homo sapiens
caaacaacaccaccgagau

SEQ ID NO: 624488 - RNA, 19 nt, Homo sapiens
uaugaggaccggcugcuuu

SEQ ID NO: 624489 - RNA, 19 nt, Homo sapiens
gguagaaagaggagugaug

SEQ ID NO: 624490 - RNA, 19 nt, Homo sapiens
cuacugcuguauguggaua

SEQ ID NO: 624491 - RNA, 19 nt, Homo sapiens
ugugagaucuggaguuggu

SEQ ID NO: 624492 - RNA, 19 nt, Homo sapiens
ggaggugggcucugaaggu

SEQ ID NO: 624493 - RNA, 19 nt, Homo sapiens
aaacaacaccaccgagauc

SEQ ID NO: 624494 - RNA, 19 nt, Homo sapiens
gggaggcuguacaucugaa

SEQ ID NO: 624495 - RNA, 19 nt, Homo sapiens
gugggaggcuguacaucug

SEQ ID NO: 624496 - RNA, 19 nt, Homo sapiens
cggcugcuuuccaguggua

SEQ ID NO: 624497 - RNA, 19 nt, Homo sapiens
acaccugcuuaguuuauga

SEQ ID NO: 624498 - RNA, 19 nt, Homo sapiens
ggaguaggcagauaaucca

SEQ ID NO: 624499 - RNA, 19 nt, Homo sapiens
guagaauuccacccuugaa

SEQ ID NO: 624500 - RNA, 19 nt, Homo sapiens
gccagugugugguguucaa

SEQ ID NO: 624501 - RNA, 19 nt, Homo sapiens
gccacccucuuccugugua

SEQ ID NO: 624502 - RNA, 19 nt, Homo sapiens
cagcuggaauucuccucuu

SEQ ID NO: 624503 - RNA, 19 nt, Homo sapiens
uuuaagcacugccgcuaug

SEQ ID NO: 624504 - RNA, 19 nt, Homo sapiens
uggagacaauugccugguu

SEQ ID NO: 624505 - RNA, 19 nt, Homo sapiens
gccuggcaccuacucuuua

SEQ ID NO: 624506 - RNA, 19 nt, Homo sapiens
ggccuggcaccuacucuuu

SEQ ID NO: 624507 - RNA, 19 nt, Homo sapiens
gacaaagucacggaguaaa

SEQ ID NO: 624508 - RNA, 19 nt, Homo sapiens
guugcuggguggcucugua

SEQ ID NO: 624509 - RNA, 19 nt, Homo sapiens
gcacugccgcuaugaacca

SEQ ID NO: 624510 - RNA, 19 nt, Homo sapiens
ggcuguacaucugaaauuc

SEQ ID NO: 624511 - RNA, 19 nt, Homo sapiens
ccaggugggcuagaaggua

SEQ ID NO: 624512 - RNA, 19 nt, Homo sapiens
gaaccccaguuuuccauca

SEQ ID NO: 624513 - RNA, 19 nt, Homo sapiens
ggguggaguaggcagauaa

SEQ ID NO: 624514 - RNA, 19 nt, Homo sapiens
uggccaagcaauuauuauu

SEQ ID NO: 624515 - RNA, 19 nt, Homo sapiens
aguaugugaugaccaggaa

SEQ ID NO: 624516 - RNA, 19 nt, Homo sapiens
gcucaagcucuauggaauc

SEQ ID NO: 624517 - RNA, 19 nt, Homo sapiens
gggcuucuggauuauaaga

SEQ ID NO: 624518 - RNA, 19 nt, Homo sapiens
guggguaccuggugaucag

SEQ ID NO: 624519 - RNA, 19 nt, Homo sapiens
ggcccacaccugcuuaguu

SEQ ID NO: 624520 - RNA, 19 nt, Homo sapiens
cgaaagcaaccgccaacuc

SEQ ID NO: 624521 - RNA, 19 nt, Homo sapiens
ccuuccagcugcaggagaa

SEQ ID NO: 624522 - RNA, 19 nt, Homo sapiens
agaguucacugggauugug

SEQ ID NO: 624523 - RNA, 19 nt, Homo sapiens
ccuggcaccuacucuuuag

SEQ ID NO: 624524 - RNA, 19 nt, Homo sapiens
guccaagucauaccuagga

SEQ ID NO: 624525 - RNA, 19 nt, Homo sapiens
cugugcagcuggagccaaa

SEQ ID NO: 624526 - RNA, 19 nt, Homo sapiens
agacuuggugccacaaaga

SEQ ID NO: 624527 - RNA, 19 nt, Homo sapiens
ugauguggauuggagacaa

SEQ ID NO: 624528 - RNA, 19 nt, Homo sapiens
ggcccgagcucagaaacag

SEQ ID NO: 624529 - RNA, 19 nt, Homo sapiens
gcaugagggccacacucuu

SEQ ID NO: 624530 - RNA, 19 nt, Homo sapiens
gcccagaggaagcugaugu

SEQ ID NO: 624531 - RNA, 19 nt, Homo sapiens
cuucaggaccuucuauauc

SEQ ID NO: 624532 - RNA, 19 nt, Homo sapiens
auaagacggagaaguaugu

SEQ ID NO: 624533 - RNA, 19 nt, Homo sapiens
gcaagggcggagcaugugu

SEQ ID NO: 624534 - RNA, 19 nt, Homo sapiens
acggagaaguaugugauga

SEQ ID NO: 624535 - RNA, 19 nt, Homo sapiens
ggguuuccgucacucagau

SEQ ID NO: 624536 - RNA, 19 nt, Homo sapiens
gaccugcuacugcuguaug

SEQ ID NO: 624537 - RNA, 19 nt, Homo sapiens
cccagaacuucacacuguu

SEQ ID NO: 624538 - RNA, 19 nt, Homo sapiens
gacuuggugccacaaagaa

SEQ ID NO: 624539 - RNA, 19 nt, Homo sapiens
gcaaagccacccucuuccu

SEQ ID NO: 624540 - RNA, 19 nt, Homo sapiens
ggaguggcuggaaggaaug

SEQ ID NO: 624541 - RNA, 19 nt, Homo sapiens
gcugggagucagacacaga

SEQ ID NO: 624542 - RNA, 19 nt, Homo sapiens
gugaccugcuacugcugua

SEQ ID NO: 624543 - RNA, 19 nt, Homo sapiens
cuugaagagugggcaaaga

SEQ ID NO: 624544 - RNA, 19 nt, Homo sapiens
gaucgaagcuggaaauauu

SEQ ID NO: 624545 - RNA, 19 nt, Homo sapiens
gagaagaauugaaguguuu

SEQ ID NO: 624546 - RNA, 19 nt, Homo sapiens
ggucaaagcuugccuuaga

SEQ ID NO: 624547 - RNA, 19 nt, Homo sapiens
ggauguacuucguguauua

SEQ ID NO: 624548 - RNA, 19 nt, Homo sapiens
gacuauggauugcuaauua

SEQ ID NO: 624549 - RNA, 19 nt, Homo sapiens
gaagaaaccacacaucuau

SEQ ID NO: 624550 - RNA, 19 nt, Homo sapiens
gaauugaaguguuuaguuc

SEQ ID NO: 624551 - RNA, 19 nt, Homo sapiens
caugggaacuucuugcuua

SEQ ID NO: 624552 - RNA, 19 nt, Homo sapiens
caagguggcugaacuauag

SEQ ID NO: 624553 - RNA, 19 nt, Homo sapiens
gaacugaacauuugcuuug

SEQ ID NO: 624554 - RNA, 19 nt, Homo sapiens
gaagagaaagguuaagaaa

SEQ ID NO: 624555 - RNA, 19 nt, Homo sapiens
gaaagaagagaaagguuaa

SEQ ID NO: 624556 - RNA, 19 nt, Homo sapiens
gaagaggcccgacuccaua

SEQ ID NO: 624557 - RNA, 19 nt, Homo sapiens
ggagaaguguuugaaauug

SEQ ID NO: 624558 - RNA, 19 nt, Homo sapiens
cagcaaaccugguaucaug

SEQ ID NO: 624559 - RNA, 19 nt, Homo sapiens
gaaauauccucucaguugu

SEQ ID NO: 624560 - RNA, 19 nt, Homo sapiens
gagaaguguuugaaauuga

SEQ ID NO: 624561 - RNA, 19 nt, Homo sapiens
uaaagcacccgacgacuua

SEQ ID NO: 624562 - RNA, 19 nt, Homo sapiens
ccacacaucuauuauggaa

SEQ ID NO: 624563 - RNA, 19 nt, Homo sapiens
gcauagacccucaguagaa

SEQ ID NO: 624564 - RNA, 19 nt, Homo sapiens
gcacaucucaccacucauu

SEQ ID NO: 624565 - RNA, 19 nt, Homo sapiens
agaaauauccucucaguug

SEQ ID NO: 624566 - RNA, 19 nt, Homo sapiens
uaagaaauauccucucagu

SEQ ID NO: 624567 - RNA, 19 nt, Homo sapiens
ugaaagaagagaaagguua

SEQ ID NO: 624568 - RNA, 19 nt, Homo sapiens
caaaugccgucucugcaaa

SEQ ID NO: 624569 - RNA, 19 nt, Homo sapiens
gagccgagauugcgccauu

SEQ ID NO: 624570 - RNA, 19 nt, Homo sapiens
gaacauuugcuuugucaga

SEQ ID NO: 624571 - RNA, 19 nt, Homo sapiens
gcucacgccuguaauccua

SEQ ID NO: 624572 - RNA, 19 nt, Homo sapiens
agaaaccacacaucuauua

SEQ ID NO: 624573 - RNA, 19 nt, Homo sapiens
guggauggcugaauagaug

SEQ ID NO: 624574 - RNA, 19 nt, Homo sapiens
gaaggccaccugaaagaaa

SEQ ID NO: 624575 - RNA, 19 nt, Homo sapiens
gcaagguggcugaacuaua

SEQ ID NO: 624576 - RNA, 19 nt, Homo sapiens
aaacuuggcuuuccauaac

SEQ ID NO: 624577 - RNA, 19 nt, Homo sapiens
uaauauaaccucuggagaa

SEQ ID NO: 624578 - RNA, 19 nt, Homo sapiens
acucugaacugaacauuug

SEQ ID NO: 624579 - RNA, 19 nt, Homo sapiens
guuaagaaauauccucuca

SEQ ID NO: 624580 - RNA, 19 nt, Homo sapiens
ugacgucucuauuguacaa

SEQ ID NO: 624581 - RNA, 19 nt, Homo sapiens
guuaaacaaugcaucauag

SEQ ID NO: 624582 - RNA, 19 nt, Homo sapiens
caaagaagaguaucagcaa

SEQ ID NO: 624583 - RNA, 19 nt, Homo sapiens
caaaggagagucugggauu

SEQ ID NO: 624584 - RNA, 19 nt, Homo sapiens
cgagaagaauugaaguguu

SEQ ID NO: 624585 - RNA, 19 nt, Homo sapiens
gaaagacggacuuaaagca

SEQ ID NO: 624586 - RNA, 19 nt, Homo sapiens
gcaaaugccgucucugcaa

SEQ ID NO: 624587 - RNA, 19 nt, Homo sapiens
gggcauaacacaaauguag

SEQ ID NO: 624588 - RNA, 19 nt, Homo sapiens
cauagccacuugcucauau

SEQ ID NO: 624589 - RNA, 19 nt, Homo sapiens
gcaaagugaugggccuaga

SEQ ID NO: 624590 - RNA, 19 nt, Homo sapiens
acaagucucuccggucuuu

SEQ ID NO: 624591 - RNA, 19 nt, Homo sapiens
gaucaauguuuccacagau

SEQ ID NO: 624592 - RNA, 19 nt, Homo sapiens
gacauugccuuccaucaag

SEQ ID NO: 624593 - RNA, 19 nt, Homo sapiens
uaucaugaaggaccaaaua

SEQ ID NO: 624594 - RNA, 19 nt, Homo sapiens
gguuaaacaaugcaucaua

SEQ ID NO: 624595 - RNA, 19 nt, Homo sapiens
gaaaccacacaucuauuau

SEQ ID NO: 624596 - RNA, 19 nt, Homo sapiens
gugaugggccuagauauuu

SEQ ID NO: 624597 - RNA, 19 nt, Homo sapiens
ucauggcgcuuaugggauu

SEQ ID NO: 624598 - RNA, 19 nt, Homo sapiens
aaagaagaguaucagcaaa

SEQ ID NO: 624599 - RNA, 19 nt, Homo sapiens
uauaaccucuggagaagug

SEQ ID NO: 624600 - RNA, 19 nt, Homo sapiens
ugaagaaaccacacaucua

SEQ ID NO: 624601 - RNA, 19 nt, Homo sapiens
ucucuccggucuuugaaua

SEQ ID NO: 624602 - RNA, 19 nt, Homo sapiens
acacaucuauuauggaagu

SEQ ID NO: 624603 - RNA, 19 nt, Homo sapiens
aaugggaugugaagcagua

SEQ ID NO: 624604 - RNA, 19 nt, Homo sapiens
gagcaagguggcugaacua

SEQ ID NO: 624605 - RNA, 19 nt, Homo sapiens
ugacaacaccugcaaagug

SEQ ID NO: 624606 - RNA, 19 nt, Homo sapiens
caacaaggaccucccagau

SEQ ID NO: 624607 - RNA, 19 nt, Homo sapiens
ggagauuccugagacaaca

SEQ ID NO: 624608 - RNA, 19 nt, Homo sapiens
gcugaacuauagucuggaa

SEQ ID NO: 624609 - RNA, 19 nt, Homo sapiens
gaagguggcaagacuaugg

SEQ ID NO: 624610 - RNA, 19 nt, Homo sapiens
gcagaaguauuggcugagu

SEQ ID NO: 624611 - RNA, 19 nt, Homo sapiens
cuucaccucuuccuauuga

SEQ ID NO: 624612 - RNA, 19 nt, Homo sapiens
gacuucaccucuuccuauu

SEQ ID NO: 624613 - RNA, 19 nt, Homo sapiens
aaagugaugggccuagaua

SEQ ID NO: 624614 - RNA, 19 nt, Homo sapiens
cacaggacguuguaucaug

SEQ ID NO: 624615 - RNA, 19 nt, Homo sapiens
ggaagaggcccgacuccau

SEQ ID NO: 624616 - RNA, 19 nt, Homo sapiens
aaaggagagucugggauuu

SEQ ID NO: 624617 - RNA, 19 nt, Homo sapiens
cacgaacuguguagacauu

SEQ ID NO: 624618 - RNA, 19 nt, Homo sapiens
gcaaaccugguaucaugaa

SEQ ID NO: 624619 - RNA, 19 nt, Homo sapiens
gcgacaggcagaaguauug

SEQ ID NO: 624620 - RNA, 19 nt, Homo sapiens
ucucuuggcuguuuaaagg

SEQ ID NO: 624621 - RNA, 19 nt, Homo sapiens
cuauugaguuugcuuggaa

SEQ ID NO: 624622 - RNA, 19 nt, Homo sapiens
gaacuguguagacauuguu

SEQ ID NO: 624623 - RNA, 19 nt, Homo sapiens
ccucaaacgagaagaauug

SEQ ID NO: 624624 - RNA, 19 nt, Homo sapiens
ggaugcauuuggucgaguu

SEQ ID NO: 624625 - RNA, 19 nt, Homo sapiens
gcucuggucuguuccugau

SEQ ID NO: 624626 - RNA, 19 nt, Homo sapiens
caaugaaacgcuuggaaga

SEQ ID NO: 624627 - RNA, 19 nt, Homo sapiens
gaggucaaagcuugccuua

SEQ ID NO: 624628 - RNA, 19 nt, Homo sapiens
ccacgccgaugguuauaca

SEQ ID NO: 624629 - RNA, 19 nt, Homo sapiens
gcagccacgccgaugguua

SEQ ID NO: 624630 - RNA, 19 nt, Homo sapiens
caucuauuauggaaguuug

SEQ ID NO: 624631 - RNA, 19 nt, Homo sapiens
ccacgaaggcaaagugaug

SEQ ID NO: 624632 - RNA, 19 nt, Homo sapiens
gggaacuucuugcuuacug

SEQ ID NO: 624633 - RNA, 19 nt, Homo sapiens
aaauguaggagcaauugua

SEQ ID NO: 624634 - RNA, 19 nt, Homo sapiens
gagaaugggaugugaagca

SEQ ID NO: 624635 - RNA, 19 nt, Homo sapiens
cauagacccucaguagaau

SEQ ID NO: 624636 - RNA, 19 nt, Homo sapiens
ugacauugccuuccaucaa

SEQ ID NO: 624637 - RNA, 19 nt, Homo sapiens
ugucaggagucaaacaaau

SEQ ID NO: 624638 - RNA, 19 nt, Homo sapiens
gccgaugguuauacaguga

SEQ ID NO: 624639 - RNA, 19 nt, Homo sapiens
caaacgagaagaauugaag

SEQ ID NO: 624640 - RNA, 19 nt, Homo sapiens
gggaaagacggacuuaaag

SEQ ID NO: 624641 - RNA, 19 nt, Homo sapiens
gacguuguaucauguucuu

SEQ ID NO: 624642 - RNA, 19 nt, Homo sapiens
gaaccaguggcagauauug

SEQ ID NO: 624643 - RNA, 19 nt, Homo sapiens
gcauaacacaaauguagga

SEQ ID NO: 624644 - RNA, 19 nt, Homo sapiens
gaagauugcucagcgauua

SEQ ID NO: 624645 - RNA, 19 nt, Homo sapiens
gaacagacaucuaacacaa

SEQ ID NO: 624646 - RNA, 19 nt, Homo sapiens
caacaaauguguacuaguc

SEQ ID NO: 624647 - RNA, 19 nt, Homo sapiens
ugacuaagcuccagaucaa

SEQ ID NO: 624648 - RNA, 19 nt, Homo sapiens
ggaagggcauggacaagaa

SEQ ID NO: 624649 - RNA, 19 nt, Homo sapiens
gccaagaaguucaagauug

SEQ ID NO: 624650 - RNA, 19 nt, Homo sapiens
gagaugaaguuuaaacagu

SEQ ID NO: 624651 - RNA, 19 nt, Homo sapiens
uaaagaaucaucaggagua

SEQ ID NO: 624652 - RNA, 19 nt, Homo sapiens
gacaaugacacaccaguua

SEQ ID NO: 624653 - RNA, 19 nt, Homo sapiens
cccaauggcuuugaucuua

SEQ ID NO: 624654 - RNA, 19 nt, Homo sapiens
ugaggaagcugugaagaaa

SEQ ID NO: 624655 - RNA, 19 nt, Homo sapiens
gaacccaaagugagaauuu

SEQ ID NO: 624656 - RNA, 19 nt, Homo sapiens
ggccgaagcucuaggcauu

SEQ ID NO: 624657 - RNA, 19 nt, Homo sapiens
ugagaucucuaaagaauca

SEQ ID NO: 624658 - RNA, 19 nt, Homo sapiens
aaacaggcauccauacuuc

SEQ ID NO: 624659 - RNA, 19 nt, Homo sapiens
ugaagaggguccuggguuu

SEQ ID NO: 624660 - RNA, 19 nt, Homo sapiens
uuggagagaugaaguuuaa

SEQ ID NO: 624661 - RNA, 19 nt, Homo sapiens
gcucagcgauuacggacaa

SEQ ID NO: 624662 - RNA, 19 nt, Homo sapiens
gggcaaauuugagaagauu

SEQ ID NO: 624663 - RNA, 19 nt, Homo sapiens
gguagaagcccacgucaga

SEQ ID NO: 624664 - RNA, 19 nt, Homo sapiens
ccagaacgacuuccuauug

SEQ ID NO: 624665 - RNA, 19 nt, Homo sapiens
ccgaucaucugaaaccuuu

SEQ ID NO: 624666 - RNA, 19 nt, Homo sapiens
ggacaaagggagaauaucu

SEQ ID NO: 624667 - RNA, 19 nt, Homo sapiens
gaacagagaaaggucaaga

SEQ ID NO: 624668 - RNA, 19 nt, Homo sapiens
ggagauauuccugaaauug

SEQ ID NO: 624669 - RNA, 19 nt, Homo sapiens
guaaagaagcgacgaauac

SEQ ID NO: 624670 - RNA, 19 nt, Homo sapiens
gagauauuccugaaauuga

SEQ ID NO: 624671 - RNA, 19 nt, Homo sapiens
ucugagaucucuaaagaau

SEQ ID NO: 624672 - RNA, 19 nt, Homo sapiens
acucugagaucucuaaaga

SEQ ID NO: 624673 - RNA, 19 nt, Homo sapiens
gaagaaaaccaacaaaugu

SEQ ID NO: 624674 - RNA, 19 nt, Homo sapiens
ugaggagucugaugaggaa

SEQ ID NO: 624675 - RNA, 19 nt, Homo sapiens
gagagaagauuauuuugga

SEQ ID NO: 624676 - RNA, 19 nt, Homo sapiens
gcuaaaggaaggagauauu

SEQ ID NO: 624677 - RNA, 19 nt, Homo sapiens
gaagagggaacaauucaag

SEQ ID NO: 624678 - RNA, 19 nt, Homo sapiens
gaggaaggccgaagcucua

SEQ ID NO: 624679 - RNA, 19 nt, Homo sapiens
gaaggcagccgaucaucug

SEQ ID NO: 624680 - RNA, 19 nt, Homo sapiens
ucaguccucucacuuauuc

SEQ ID NO: 624681 - RNA, 19 nt, Homo sapiens
ccaaggcccagaagaaauu

SEQ ID NO: 624682 - RNA, 19 nt, Homo sapiens
ccgcaugccuacucugaaa

SEQ ID NO: 624683 - RNA, 19 nt, Homo sapiens
caacaggcaaggagauuga

SEQ ID NO: 624684 - RNA, 19 nt, Homo sapiens
gcccuggcaugcugacuaa

SEQ ID NO: 624685 - RNA, 19 nt, Homo sapiens
caaagagggagcuggauga

SEQ ID NO: 624686 - RNA, 19 nt, Homo sapiens
gaagcuacaggcagagauu

SEQ ID NO: 624687 - RNA, 19 nt, Homo sapiens
uuugugagguguaguauug

SEQ ID NO: 624688 - RNA, 19 nt, Homo sapiens
gaagaaggcagccgaucau

SEQ ID NO: 624689 - RNA, 19 nt, Homo sapiens
gcugagugaaucuguguua

SEQ ID NO: 624690 - RNA, 19 nt, Homo sapiens
gagcugaaaccauggauag

SEQ ID NO: 624691 - RNA, 19 nt, Homo sapiens
ggauagagaagacagugaa

SEQ ID NO: 624692 - RNA, 19 nt, Homo sapiens
gaugaaguuuaaacagugu

SEQ ID NO: 624693 - RNA, 19 nt, Homo sapiens
aaagggagaugaugaugag

SEQ ID NO: 624694 - RNA, 19 nt, Homo sapiens
cagaaggaacuacaagaaa

SEQ ID NO: 624695 - RNA, 19 nt, Homo sapiens
aaagaaucaucaggaguaa

SEQ ID NO: 624696 - RNA, 19 nt, Homo sapiens
ccucucacuuauucuauuu

SEQ ID NO: 624697 - RNA, 19 nt, Homo sapiens
caaagggagaugaugauga

SEQ ID NO: 624698 - RNA, 19 nt, Homo sapiens
aaagugggaugaacagaca

SEQ ID NO: 624699 - RNA, 19 nt, Homo sapiens
gugggacucuuacauaauc

SEQ ID NO: 624700 - RNA, 19 nt, Homo sapiens
gggaacaauucaagcaaca

SEQ ID NO: 624701 - RNA, 19 nt, Homo sapiens
gagcaagggcgcacuguag

SEQ ID NO: 624702 - RNA, 19 nt, Homo sapiens
ccaagagagaagauuauuu

SEQ ID NO: 624703 - RNA, 19 nt, Homo sapiens
uaagaaggagcuaaaggaa

SEQ ID NO: 624704 - RNA, 19 nt, Homo sapiens
cgacuaggcuugcccucau

SEQ ID NO: 624705 - RNA, 19 nt, Homo sapiens
ggcagccgaucaucugaaa

SEQ ID NO: 624706 - RNA, 19 nt, Homo sapiens
gacaagggcaaauuugaga

SEQ ID NO: 624707 - RNA, 19 nt, Homo sapiens
cagaacgacuuccuauugg

SEQ ID NO: 624708 - RNA, 19 nt, Homo sapiens
acacaaagggagaugauga

SEQ ID NO: 624709 - RNA, 19 nt, Homo sapiens
ccugaugccuccuccagaa

SEQ ID NO: 624710 - RNA, 19 nt, Homo sapiens
ccucauugcuccuaagaag

SEQ ID NO: 624711 - RNA, 19 nt, Homo sapiens
gagacgcacuuuuaaauuc

SEQ ID NO: 624712 - RNA, 19 nt, Homo sapiens
gagugaaucuguguuagag

SEQ ID NO: 624713 - RNA, 19 nt, Homo sapiens
agagaaaggucaagaaaau

SEQ ID NO: 624714 - RNA, 19 nt, Homo sapiens
gacagaaagcgcaugaaga

SEQ ID NO: 624715 - RNA, 19 nt, Homo sapiens
cagcagcauugaacugugu

SEQ ID NO: 624716 - RNA, 19 nt, Homo sapiens
gcacagaaggaacuacaag

SEQ ID NO: 624717 - RNA, 19 nt, Homo sapiens
gcuuaaagaagacauuuca

SEQ ID NO: 624718 - RNA, 19 nt, Homo sapiens
uggugggacucuuacauaa

SEQ ID NO: 624719 - RNA, 19 nt, Homo sapiens
guggugggacucuuacaua

SEQ ID NO: 624720 - RNA, 19 nt, Homo sapiens
gcacugaagccaggacuca

SEQ ID NO: 624721 - RNA, 19 nt, Homo sapiens
acagacaucuaacacaaag

SEQ ID NO: 624722 - RNA, 19 nt, Homo sapiens
agaaggaacuacaagaaaa

SEQ ID NO: 624723 - RNA, 19 nt, Homo sapiens
gagcuaaaggaaggagaua

SEQ ID NO: 624724 - RNA, 19 nt, Homo sapiens
cuaagaaggagcuaaagga

SEQ ID NO: 624725 - RNA, 19 nt, Homo sapiens
caauucaagcaacaacuaa

SEQ ID NO: 624726 - RNA, 19 nt, Homo sapiens
uugaggagguggaagaaga

SEQ ID NO: 624727 - RNA, 19 nt, Homo sapiens
ggauaaagugggaugaaca

SEQ ID NO: 624728 - RNA, 19 nt, Homo sapiens
acagagaaaggucaagaaa

SEQ ID NO: 624729 - RNA, 19 nt, Homo sapiens
ggccaacgcugcccgaaaa

SEQ ID NO: 624730 - RNA, 19 nt, Homo sapiens
gagggaagcacagaaggaa

SEQ ID NO: 624731 - RNA, 19 nt, Homo sapiens
ggagggaagcacagaagga

SEQ ID NO: 624732 - RNA, 19 nt, Homo sapiens
cugaaaccauggauagaga

SEQ ID NO: 624733 - RNA, 19 nt, Homo sapiens
caaccagaacgacuuccua

SEQ ID NO: 624734 - RNA, 19 nt, Homo sapiens
ugauucuacucuccgauuu

SEQ ID NO: 624735 - RNA, 19 nt, Homo sapiens
gacaaagggagaauaucuu

SEQ ID NO: 624736 - RNA, 19 nt, Homo sapiens
ggagagaugaaguuuaaac

SEQ ID NO: 624737 - RNA, 19 nt, Homo sapiens
aaacuucggagacaaacaa

SEQ ID NO: 624738 - RNA, 19 nt, Homo sapiens
aguauugaguccuguuuga

SEQ ID NO: 624739 - RNA, 19 nt, Homo sapiens
caaaggcucaacuggagaa

SEQ ID NO: 624740 - RNA, 19 nt, Homo sapiens
gaaaagccaucagaagaca

SEQ ID NO: 624741 - RNA, 19 nt, Homo sapiens
ggugaugacucugagaucu

SEQ ID NO: 624742 - RNA, 19 nt, Homo sapiens
gagagaugaaguuuaaaca

SEQ ID NO: 624743 - RNA, 19 nt, Homo sapiens
aaauggcacugucaaagag

SEQ ID NO: 624744 - RNA, 19 nt, Homo sapiens
ccaaggagcugcagaugaa

SEQ ID NO: 624745 - RNA, 19 nt, Homo sapiens
gggaagagaucaccacgaa

SEQ ID NO: 624746 - RNA, 19 nt, Homo sapiens
gaagagaucaccacgaaga

SEQ ID NO: 624747 - RNA, 19 nt, Homo sapiens
ggaccacucuucaacuuug

SEQ ID NO: 624748 - RNA, 19 nt, Homo sapiens
agaagcagcuggccaagaa

SEQ ID NO: 624749 - RNA, 19 nt, Homo sapiens
ggaagaacccagacguuga

SEQ ID NO: 624750 - RNA, 19 nt, Homo sapiens
gcaacaccaugcagcaguu

SEQ ID NO: 624751 - RNA, 19 nt, Homo sapiens
gaggagaacaucaugaaau

SEQ ID NO: 624752 - RNA, 19 nt, Homo sapiens
ccaugcaccugaugaagaa

SEQ ID NO: 624753 - RNA, 19 nt, Homo sapiens
aggagaagaucaagaguga

SEQ ID NO: 624754 - RNA, 19 nt, Homo sapiens
gaaguucucugcgcacuac

SEQ ID NO: 624755 - RNA, 19 nt, Homo sapiens
gcaggaggcucuggugaag

SEQ ID NO: 624756 - RNA, 19 nt, Homo sapiens
ggacagucaagaugagaaa

SEQ ID NO: 624757 - RNA, 19 nt, Homo sapiens
ccgcugccauggcucaaua

SEQ ID NO: 624758 - RNA, 19 nt, Homo sapiens
aauccaacauugacaagaa

SEQ ID NO: 624759 - RNA, 19 nt, Homo sapiens
gcagaaggcgcucgagauc

SEQ ID NO: 624760 - RNA, 19 nt, Homo sapiens
gaacccagacguugacaca

SEQ ID NO: 624761 - RNA, 19 nt, Homo sapiens
gaaggagcguaagaaggaa

SEQ ID NO: 624762 - RNA, 19 nt, Homo sapiens
uggagaagcuucgagagaa

SEQ ID NO: 624763 - RNA, 19 nt, Homo sapiens
agaaggagcguaagaagga

SEQ ID NO: 624764 - RNA, 19 nt, Homo sapiens
gagcagauggagcagauga

SEQ ID NO: 624765 - RNA, 19 nt, Homo sapiens
gaaaagaagugggacaagu

SEQ ID NO: 624766 - RNA, 19 nt, Homo sapiens
gaucaucccucaccaucac

SEQ ID NO: 624767 - RNA, 19 nt, Homo sapiens
gagaucaccuucagcuacu

SEQ ID NO: 624768 - RNA, 19 nt, Homo sapiens
gcgagcagauggagcagau

SEQ ID NO: 624769 - RNA, 19 nt, Homo sapiens
agugacugcuuuauucuuu

SEQ ID NO: 624770 - RNA, 19 nt, Homo sapiens
gagaucaccacgaagaaga

SEQ ID NO: 624771 - RNA, 19 nt, Homo sapiens
gagagaaggagcguaagaa

SEQ ID NO: 624772 - RNA, 19 nt, Homo sapiens
ggaggagaacaucaugaaa

SEQ ID NO: 624773 - RNA, 19 nt, Homo sapiens
gagaagaacaagcacaucu

SEQ ID NO: 624774 - RNA, 19 nt, Homo sapiens
caacuuugauguucaugac

SEQ ID NO: 624775 - RNA, 19 nt, Homo sapiens
agaaggagcaguccaagga

SEQ ID NO: 624776 - RNA, 19 nt, Homo sapiens
uaaagaagugcacguguca

SEQ ID NO: 624777 - RNA, 19 nt, Homo sapiens
ugaagaagcgggagaagca

SEQ ID NO: 624778 - RNA, 19 nt, Homo sapiens
caucaugaaauccaacauu

SEQ ID NO: 624779 - RNA, 19 nt, Homo sapiens
aggagaacaucaugaaauc

SEQ ID NO: 624780 - RNA, 19 nt, Homo sapiens
ugccauggcucaauacaag

SEQ ID NO: 624781 - RNA, 19 nt, Homo sapiens
ccaagaaggagcaguccaa

SEQ ID NO: 624782 - RNA, 19 nt, Homo sapiens
ugaaggagcgggagaagca

SEQ ID NO: 624783 - RNA, 19 nt, Homo sapiens
gagaacaucaugaaaucca

SEQ ID NO: 624784 - RNA, 19 nt, Homo sapiens
gaaauccaacauugacaag

SEQ ID NO: 624785 - RNA, 19 nt, Homo sapiens
gaagaacccagacguugac

SEQ ID NO: 624786 - RNA, 19 nt, Homo sapiens
uggagcgccugcauuguga

SEQ ID NO: 624787 - RNA, 19 nt, Homo sapiens
gagcuggagcgccugcauu

SEQ ID NO: 624788 - RNA, 19 nt, Homo sapiens
gaaagggcaacaccaugca

SEQ ID NO: 624789 - RNA, 19 nt, Homo sapiens
gccaugcaccugaugaaga

SEQ ID NO: 624790 - RNA, 19 nt, Homo sapiens
cgagagaaggagcguaaga

SEQ ID NO: 624791 - RNA, 19 nt, Homo sapiens
ugaaauccaacauugacaa

SEQ ID NO: 624792 - RNA, 19 nt, Homo sapiens
caacauugacaagaaguuc

SEQ ID NO: 624793 - RNA, 19 nt, Homo sapiens
gagaagcagcuggccaaga

SEQ ID NO: 624794 - RNA, 19 nt, Homo sapiens
aggaggcucuggugaagga

SEQ ID NO: 624795 - RNA, 19 nt, Homo sapiens
gacccugaaugacaugaag

SEQ ID NO: 624796 - RNA, 19 nt, Homo sapiens
aucaugaaauccaacauug

SEQ ID NO: 624797 - RNA, 19 nt, Homo sapiens
ccaagcaggagaagaucaa

SEQ ID NO: 624798 - RNA, 19 nt, Homo sapiens
agagaaaacuggggaagaa

SEQ ID NO: 624799 - RNA, 19 nt, Homo sapiens
ucaccacgaagaagagaaa

SEQ ID NO: 624800 - RNA, 19 nt, Homo sapiens
ucaugaaauccaacauuga

SEQ ID NO: 624801 - RNA, 19 nt, Homo sapiens
cggaggagaacaucaugaa

SEQ ID NO: 624802 - RNA, 19 nt, Homo sapiens
ggagcugguacgagaagaa

SEQ ID NO: 624803 - RNA, 19 nt, Homo sapiens
ucacagcuucuacgacuuc

SEQ ID NO: 624804 - RNA, 19 nt, Homo sapiens
gauggaaagggaagagauc

SEQ ID NO: 624805 - RNA, 19 nt, Homo sapiens
gggaagccaagcaggagaa

SEQ ID NO: 624806 - RNA, 19 nt, Homo sapiens
aaaagaagugggacaagua

SEQ ID NO: 624807 - RNA, 19 nt, Homo sapiens
gcugguacgagaagaacaa

SEQ ID NO: 624808 - RNA, 19 nt, Homo sapiens
gaagccaagcggaagaucu

SEQ ID NO: 624809 - RNA, 19 nt, Homo sapiens
gguacgagaagaacaagca

SEQ ID NO: 624810 - RNA, 19 nt, Homo sapiens
gcagauggagcagaugaag

SEQ ID NO: 624811 - RNA, 19 nt, Homo sapiens
gaacccuacgacccugaaa

SEQ ID NO: 624812 - RNA, 19 nt, Homo sapiens
agaaggcgcucgagauccu

SEQ ID NO: 624813 - RNA, 19 nt, Homo sapiens
ugagaaagggcaacaccau

SEQ ID NO: 624814 - RNA, 19 nt, Homo sapiens
agaacaucaugaaauccaa

SEQ ID NO: 624815 - RNA, 19 nt, Homo sapiens
gaaggaugagucccaugca

SEQ ID NO: 624816 - RNA, 19 nt, Homo sapiens
ucgagauccuucggaaaga

SEQ ID NO: 624817 - RNA, 19 nt, Homo sapiens
gcucgagauccuucggaaa

SEQ ID NO: 624818 - RNA, 19 nt, Homo sapiens
cggcggacagucaagauga

SEQ ID NO: 624819 - RNA, 19 nt, Homo sapiens
aagaagugcacgugucaga

SEQ ID NO: 624820 - RNA, 19 nt, Homo sapiens
aagccaagcaggagaagau

SEQ ID NO: 624821 - RNA, 19 nt, Homo sapiens
ggaacccuacgacccugaa

SEQ ID NO: 624822 - RNA, 19 nt, Homo sapiens
cagcuucuacgacuucauc

SEQ ID NO: 624823 - RNA, 19 nt, Homo sapiens
agaagcagcgcgagcagau

SEQ ID NO: 624824 - RNA, 19 nt, Homo sapiens
caugaaauccaacauugac

SEQ ID NO: 624825 - RNA, 19 nt, Homo sapiens
gcggaggagaacaucauga

SEQ ID NO: 624826 - RNA, 19 nt, Homo sapiens
acccagacguugacacaag

SEQ ID NO: 624827 - RNA, 19 nt, Homo sapiens
gaucaccacgaagaagaga

SEQ ID NO: 624828 - RNA, 19 nt, Homo sapiens
gagauggaaagggaagaga

SEQ ID NO: 624829 - RNA, 19 nt, Homo sapiens
gguagaaacugaccacaua

SEQ ID NO: 624830 - RNA, 19 nt, Homo sapiens
gcaaaggugucaucuucua

SEQ ID NO: 624831 - RNA, 19 nt, Homo sapiens
caaggaagaucauuaagga

SEQ ID NO: 624832 - RNA, 19 nt, Homo sapiens
gagcagaggugaagaguag

SEQ ID NO: 624833 - RNA, 19 nt, Homo sapiens
aaugauggcucucaaauaa

SEQ ID NO: 624834 - RNA, 19 nt, Homo sapiens
gcaggaagguagaaacuga

SEQ ID NO: 624835 - RNA, 19 nt, Homo sapiens
gcaugaagaucucaaugaa

SEQ ID NO: 624836 - RNA, 19 nt, Homo sapiens
gaacuggccugugcucuug

SEQ ID NO: 624837 - RNA, 19 nt, Homo sapiens
caacauucaugaagacuga

SEQ ID NO: 624838 - RNA, 19 nt, Homo sapiens
gaacaucuuuaaccgaaug

SEQ ID NO: 624839 - RNA, 19 nt, Homo sapiens
gaagucaaaucaauuacga

SEQ ID NO: 624840 - RNA, 19 nt, Homo sapiens
gcacagaagugauucaacu

SEQ ID NO: 624841 - RNA, 19 nt, Homo sapiens
gaauagcggucgccgaaau

SEQ ID NO: 624842 - RNA, 19 nt, Homo sapiens
gaacugguauccgaucaga

SEQ ID NO: 624843 - RNA, 19 nt, Homo sapiens
gaaagauccuccccgaaua

SEQ ID NO: 624844 - RNA, 19 nt, Homo sapiens
gaaaagugcuugauugcaa

SEQ ID NO: 624845 - RNA, 19 nt, Homo sapiens
gauauaaaguugggaagga

SEQ ID NO: 624846 - RNA, 19 nt, Homo sapiens
gaucaaguccuuugugaau

SEQ ID NO: 624847 - RNA, 19 nt, Homo sapiens
gcucucaaauaaccuauga

SEQ ID NO: 624848 - RNA, 19 nt, Homo sapiens
ugaaguagccaaacuauuc

SEQ ID NO: 624849 - RNA, 19 nt, Homo sapiens
cggcaaaggugucaucuuc

SEQ ID NO: 624850 - RNA, 19 nt, Homo sapiens
gaucagagagugagacaga

SEQ ID NO: 624851 - RNA, 19 nt, Homo sapiens
gacaacauggugaaacuua

SEQ ID NO: 624852 - RNA, 19 nt, Homo sapiens
gaaaggaaauaugggaaag

SEQ ID NO: 624853 - RNA, 19 nt, Homo sapiens
ucaauguucuggagugauu

SEQ ID NO: 624854 - RNA, 19 nt, Homo sapiens
ggaggagucugcguaaugu

SEQ ID NO: 624855 - RNA, 19 nt, Homo sapiens
ucaaguccuuugugaauau

SEQ ID NO: 624856 - RNA, 19 nt, Homo sapiens
gccaaacuauucaacauuc

SEQ ID NO: 624857 - RNA, 19 nt, Homo sapiens
agucagcaguggcaaguua

SEQ ID NO: 624858 - RNA, 19 nt, Homo sapiens
caaagacacugcgauucaa

SEQ ID NO: 624859 - RNA, 19 nt, Homo sapiens
gauguuggcuaugaagcua

SEQ ID NO: 624860 - RNA, 19 nt, Homo sapiens
gcugcaugcuucuacgaua

SEQ ID NO: 624861 - RNA, 19 nt, Homo sapiens
caagcacgcucuaacaucu

SEQ ID NO: 624862 - RNA, 19 nt, Homo sapiens
gaaagacggcaggaaggua

SEQ ID NO: 624863 - RNA, 19 nt, Homo sapiens
ucagaaagauuggagacuu

SEQ ID NO: 624864 - RNA, 19 nt, Homo sapiens
ccagccaccuucuuucuau

SEQ ID NO: 624865 - RNA, 19 nt, Homo sapiens
gagacaacauggugaaacu

SEQ ID NO: 624866 - RNA, 19 nt, Homo sapiens
uagcaaggaagaucauuaa

SEQ ID NO: 624867 - RNA, 19 nt, Homo sapiens
gaaaagagagaagcauaua

SEQ ID NO: 624868 - RNA, 19 nt, Homo sapiens
ucacaaagacacugcgauu

SEQ ID NO: 624869 - RNA, 19 nt, Homo sapiens
uaaugauggcucucaaaua

SEQ ID NO: 624870 - RNA, 19 nt, Homo sapiens
gaacugugguuuucagaug

SEQ ID NO: 624871 - RNA, 19 nt, Homo sapiens
gaaguagccaaacuauuca

SEQ ID NO: 624872 - RNA, 19 nt, Homo sapiens
uccgaggccucagaaauua

SEQ ID NO: 624873 - RNA, 19 nt, Homo sapiens
gcaccaugaucacgcuguu

SEQ ID NO: 624874 - RNA, 19 nt, Homo sapiens
guaugagugugaaugauca

SEQ ID NO: 624875 - RNA, 19 nt, Homo sapiens
gcgauggcauguuccucua

SEQ ID NO: 624876 - RNA, 19 nt, Homo sapiens
ggagcccaauguugaguug

SEQ ID NO: 624877 - RNA, 19 nt, Homo sapiens
gauggcauguuccucuaga

SEQ ID NO: 624878 - RNA, 19 nt, Homo sapiens
cgggaagucaaaucaauua

SEQ ID NO: 624879 - RNA, 19 nt, Homo sapiens
ggaggaggagucugcguaa

SEQ ID NO: 624880 - RNA, 19 nt, Homo sapiens
gcaaggaagaucauuaagg

SEQ ID NO: 624881 - RNA, 19 nt, Homo sapiens
caagacugguggccuggaa

SEQ ID NO: 624882 - RNA, 19 nt, Homo sapiens
acaacauggugaaacuuaa

SEQ ID NO: 624883 - RNA, 19 nt, Homo sapiens
gaaugccaauagcaaggaa

SEQ ID NO: 624884 - RNA, 19 nt, Homo sapiens
caaugaaguagccaaacua

SEQ ID NO: 624885 - RNA, 19 nt, Homo sapiens
gcaugcuucuacgauauaa

SEQ ID NO: 624886 - RNA, 19 nt, Homo sapiens
caugcgaccuccucuuuca

SEQ ID NO: 624887 - RNA, 19 nt, Homo sapiens
ccgaauaccucagcaacug

SEQ ID NO: 624888 - RNA, 19 nt, Homo sapiens
cagaagugauucaacucuu

SEQ ID NO: 624889 - RNA, 19 nt, Homo sapiens
uuuagaagcuuggagaaga

SEQ ID NO: 624890 - RNA, 19 nt, Homo sapiens
gagagaagcauauauuucc

SEQ ID NO: 624891 - RNA, 19 nt, Homo sapiens
acaaagacacugcgauuca

SEQ ID NO: 624892 - RNA, 19 nt, Homo sapiens
gcugacaccagaacagaaa

SEQ ID NO: 624893 - RNA, 19 nt, Homo sapiens
ucaaugaaguagccaaacu

SEQ ID NO: 624894 - RNA, 19 nt, Homo sapiens
augaagaucucaaugaagu

SEQ ID NO: 624895 - RNA, 19 nt, Homo sapiens
guccgaggccucagaaauu

SEQ ID NO: 624896 - RNA, 19 nt, Homo sapiens
cuucuacgauauaaaguug

SEQ ID NO: 624897 - RNA, 19 nt, Homo sapiens
gaagaucucaaugaaguag

SEQ ID NO: 624898 - RNA, 19 nt, Homo sapiens
ggguagagcaccaugauca

SEQ ID NO: 624899 - RNA, 19 nt, Homo sapiens
ccggguaaaugcagagcua

SEQ ID NO: 624900 - RNA, 19 nt, Homo sapiens
aggaggaggucccgaauag

SEQ ID NO: 624901 - RNA, 19 nt, Homo sapiens
ggguacugauuguaucuga

SEQ ID NO: 624902 - RNA, 19 nt, Homo sapiens
caccagaacagaaacagaa

SEQ ID NO: 624903 - RNA, 19 nt, Homo sapiens
ccuacaagacuaugaaaga

SEQ ID NO: 624904 - RNA, 19 nt, Homo sapiens
gaggaggucgaauggguaa

SEQ ID NO: 624905 - RNA, 19 nt, Homo sapiens
ccaaacuauucaacauuca

SEQ ID NO: 624906 - RNA, 19 nt, Homo sapiens
gcagaggugaagaguagaa

SEQ ID NO: 624907 - RNA, 19 nt, Homo sapiens
cauguuccuuuccugcuaa

SEQ ID NO: 624908 - RNA, 19 nt, Homo sapiens
caacuauguagguaaauuc

SEQ ID NO: 624909 - RNA, 19 nt, Homo sapiens
gagugugaaugaucaaguc

SEQ ID NO: 624910 - RNA, 19 nt, Homo sapiens
cuaugaagcuauuggucuu

SEQ ID NO: 624911 - RNA, 19 nt, Homo sapiens
caacauggugaaacuuaau

SEQ ID NO: 624912 - RNA, 19 nt, Homo sapiens
ugaaugaucaaguccuuug

SEQ ID NO: 624913 - RNA, 19 nt, Homo sapiens
uagccaaacuauucaacau

SEQ ID NO: 624914 - RNA, 19 nt, Homo sapiens
ggaaagauccuccccgaau

SEQ ID NO: 624915 - RNA, 19 nt, Homo sapiens
gaggugaagaguagaacaa

SEQ ID NO: 624916 - RNA, 19 nt, Homo sapiens
ccagaugacaagacaaaug

SEQ ID NO: 624917 - RNA, 19 nt, Homo sapiens
gccuaugccuacaagacua

SEQ ID NO: 624918 - RNA, 19 nt, Homo sapiens
caaguccuuugugaauauu

SEQ ID NO: 624919 - RNA, 19 nt, Homo sapiens
ggcuagcucuggugcauca

SEQ ID NO: 624920 - RNA, 19 nt, Homo sapiens
uuugguggcuuccggguaa

SEQ ID NO: 624921 - RNA, 19 nt, Homo sapiens
gaaggaggaggucccgaau

SEQ ID NO: 624922 - RNA, 19 nt, Homo sapiens
cacgggaagucaaaucaau

SEQ ID NO: 624923 - RNA, 19 nt, Homo sapiens
gggcuuaucaacaguagga

SEQ ID NO: 624924 - RNA, 19 nt, Homo sapiens
aagaguagaacaacgcuuu

SEQ ID NO: 624925 - RNA, 19 nt, Homo sapiens
gaagucugucugccauuga

SEQ ID NO: 624926 - RNA, 19 nt, Homo sapiens
ucaaacaguggaauggaaa

SEQ ID NO: 624927 - RNA, 19 nt, Homo sapiens
ucauguuccuuuccugcua

SEQ ID NO: 624928 - RNA, 19 nt, Homo sapiens
ggaacaucuuuaaccgaau

SEQ ID NO: 624929 - RNA, 19 nt, Homo sapiens
gguagaaacugaccacaua

SEQ ID NO: 624930 - RNA, 19 nt, Homo sapiens
gcaaaggugucaucuucua

SEQ ID NO: 624931 - RNA, 19 nt, Homo sapiens
caaggaagaucauuaagga

SEQ ID NO: 624932 - RNA, 19 nt, Homo sapiens
gagcagaggugaagaguag

SEQ ID NO: 624933 - RNA, 19 nt, Homo sapiens
aaugauggcucucaaauaa

SEQ ID NO: 624934 - RNA, 19 nt, Homo sapiens
gcaggaagguagaaacuga

SEQ ID NO: 624935 - RNA, 19 nt, Homo sapiens
gcaugaagaucucaaugaa

SEQ ID NO: 624936 - RNA, 19 nt, Homo sapiens
gaacuggccugugcucuug

SEQ ID NO: 624937 - RNA, 19 nt, Homo sapiens
caacauucaugaagacuga

SEQ ID NO: 624938 - RNA, 19 nt, Homo sapiens
gaacaucuuuaaccgaaug

SEQ ID NO: 624939 - RNA, 19 nt, Homo sapiens
gaagucaaaucaauuacga

SEQ ID NO: 624940 - RNA, 19 nt, Homo sapiens
gcacagaagugauucaacu

SEQ ID NO: 624941 - RNA, 19 nt, Homo sapiens
gaauagcggucgccgaaau

SEQ ID NO: 624942 - RNA, 19 nt, Homo sapiens
caaccuaguguacuucuua

SEQ ID NO: 624943 - RNA, 19 nt, Homo sapiens
gaacugguauccgaucaga

SEQ ID NO: 624944 - RNA, 19 nt, Homo sapiens
gaaagauccuccccgaaua

SEQ ID NO: 624945 - RNA, 19 nt, Homo sapiens
gaaaagugcuugauugcaa

SEQ ID NO: 624946 - RNA, 19 nt, Homo sapiens
gauauaaaguugggaagga

SEQ ID NO: 624947 - RNA, 19 nt, Homo sapiens
gaucaaguccuuugugaau

SEQ ID NO: 624948 - RNA, 19 nt, Homo sapiens
gcucucaaauaaccuauga

SEQ ID NO: 624949 - RNA, 19 nt, Homo sapiens
gcagcaaccuaguguacuu

SEQ ID NO: 624950 - RNA, 19 nt, Homo sapiens
ugaaguagccaaacuauuc

SEQ ID NO: 624951 - RNA, 19 nt, Homo sapiens
cggcaaaggugucaucuuc

SEQ ID NO: 624952 - RNA, 19 nt, Homo sapiens
gaucagagagugagacaga

SEQ ID NO: 624953 - RNA, 19 nt, Homo sapiens
gacaacauggugaaacuua

SEQ ID NO: 624954 - RNA, 19 nt, Homo sapiens
gaaaggaaauaugggaaag

SEQ ID NO: 624955 - RNA, 19 nt, Homo sapiens
ucaauguucuggagugauu

SEQ ID NO: 624956 - RNA, 19 nt, Homo sapiens
ggaggagucugcguaaugu

SEQ ID NO: 624957 - RNA, 19 nt, Homo sapiens
ucaaguccuuugugaauau

SEQ ID NO: 624958 - RNA, 19 nt, Homo sapiens
cuaguguacuucuuaauug

SEQ ID NO: 624959 - RNA, 19 nt, Homo sapiens
gccaaacuauucaacauuc

SEQ ID NO: 624960 - RNA, 19 nt, Homo sapiens
agucagcaguggcaaguua

SEQ ID NO: 624961 - RNA, 19 nt, Homo sapiens
caaagacacugcgauucaa

SEQ ID NO: 624962 - RNA, 19 nt, Homo sapiens
gauguuggcuaugaagcua

SEQ ID NO: 624963 - RNA, 19 nt, Homo sapiens
gcugcaugcuucuacgaua

SEQ ID NO: 624964 - RNA, 19 nt, Homo sapiens
caagcacgcucuaacaucu

SEQ ID NO: 624965 - RNA, 19 nt, Homo sapiens
gaaagacggcaggaaggua

SEQ ID NO: 624966 - RNA, 19 nt, Homo sapiens
ucagaaagauuggagacuu

SEQ ID NO: 624967 - RNA, 19 nt, Homo sapiens
ggaaccggcucccaguugu

SEQ ID NO: 624968 - RNA, 19 nt, Homo sapiens
ccagccaccuucuuucuau

SEQ ID NO: 624969 - RNA, 19 nt, Homo sapiens
gagacaacauggugaaacu

SEQ ID NO: 624970 - RNA, 19 nt, Homo sapiens
gggcaggaguuuauuaugc

SEQ ID NO: 624971 - RNA, 19 nt, Homo sapiens
gaaagauggcagcaaccua

SEQ ID NO: 624972 - RNA, 19 nt, Homo sapiens
uagcaaggaagaucauuaa

SEQ ID NO: 624973 - RNA, 19 nt, Homo sapiens
gaaaagagagaagcauaua

SEQ ID NO: 624974 - RNA, 19 nt, Homo sapiens
ucacaaagacacugcgauu

SEQ ID NO: 624975 - RNA, 19 nt, Homo sapiens
uaaugauggcucucaaaua

SEQ ID NO: 624976 - RNA, 19 nt, Homo sapiens
gaacugugguuuucagaug

SEQ ID NO: 624977 - RNA, 19 nt, Homo sapiens
gaaguagccaaacuauuca

SEQ ID NO: 624978 - RNA, 19 nt, Homo sapiens
uccgaggccucagaaauua

SEQ ID NO: 624979 - RNA, 19 nt, Homo sapiens
gcaccaugaucacgcuguu

SEQ ID NO: 624980 - RNA, 19 nt, Homo sapiens
guaugagugugaaugauca

SEQ ID NO: 624981 - RNA, 19 nt, Homo sapiens
ggagcccaauguugaguug

SEQ ID NO: 624982 - RNA, 19 nt, Homo sapiens
cgggaagucaaaucaauua

SEQ ID NO: 624983 - RNA, 19 nt, Homo sapiens
ggaggaggagucugcguaa

SEQ ID NO: 624984 - RNA, 19 nt, Homo sapiens
gcaaggaagaucauuaagg

SEQ ID NO: 624985 - RNA, 19 nt, Homo sapiens
caagacugguggccuggaa

SEQ ID NO: 624986 - RNA, 19 nt, Homo sapiens
acaacauggugaaacuuaa

SEQ ID NO: 624987 - RNA, 19 nt, Homo sapiens
gaaugccaauagcaaggaa

SEQ ID NO: 624988 - RNA, 19 nt, Homo sapiens
caaugaaguagccaaacua

SEQ ID NO: 624989 - RNA, 19 nt, Homo sapiens
gcaugcuucuacgauauaa

SEQ ID NO: 624990 - RNA, 19 nt, Homo sapiens
caugcgaccuccucuuuca

SEQ ID NO: 624991 - RNA, 19 nt, Homo sapiens
ccgaauaccucagcaacug

SEQ ID NO: 624992 - RNA, 19 nt, Homo sapiens
cagaagugauucaacucuu

SEQ ID NO: 624993 - RNA, 19 nt, Homo sapiens
uuuagaagcuuggagaaga

SEQ ID NO: 624994 - RNA, 19 nt, Homo sapiens
gagagaagcauauauuucc

SEQ ID NO: 624995 - RNA, 19 nt, Homo sapiens
acaaagacacugcgauuca

SEQ ID NO: 624996 - RNA, 19 nt, Homo sapiens
gcugacaccagaacagaaa

SEQ ID NO: 624997 - RNA, 19 nt, Homo sapiens
uauuaugccuacaagacua

SEQ ID NO: 624998 - RNA, 19 nt, Homo sapiens
ucaaugaaguagccaaacu

SEQ ID NO: 624999 - RNA, 19 nt, Homo sapiens
augaagaucucaaugaagu

SEQ ID NO: 625000 - RNA, 19 nt, Homo sapiens
guccgaggccucagaaauu

SEQ ID NO: 625001 - RNA, 19 nt, Homo sapiens
cuucuacgauauaaaguug

SEQ ID NO: 625002 - RNA, 19 nt, Homo sapiens
gaagaucucaaugaaguag

SEQ ID NO: 625003 - RNA, 19 nt, Homo sapiens
ggguagagcaccaugauca

SEQ ID NO: 625004 - RNA, 19 nt, Homo sapiens
ccggguaaaugcagagcua

SEQ ID NO: 625005 - RNA, 19 nt, Homo sapiens
aggaggaggucccgaauag

SEQ ID NO: 625006 - RNA, 19 nt, Homo sapiens
ggguacugauuguaucuga

SEQ ID NO: 625007 - RNA, 19 nt, Homo sapiens
caccagaacagaaacagaa

SEQ ID NO: 625008 - RNA, 19 nt, Homo sapiens
ccuacaagacuaugaaaga

SEQ ID NO: 625009 - RNA, 19 nt, Homo sapiens
gaggaggucgaauggguaa

SEQ ID NO: 625010 - RNA, 19 nt, Homo sapiens
ccaaacuauucaacauuca

SEQ ID NO: 625011 - RNA, 19 nt, Homo sapiens
ccuaguguacuucuuaauu

SEQ ID NO: 625012 - RNA, 19 nt, Homo sapiens
gcagaggugaagaguagaa

SEQ ID NO: 625013 - RNA, 19 nt, Homo sapiens
cauguuccuuuccugcuaa

SEQ ID NO: 625014 - RNA, 19 nt, Homo sapiens
caacuauguagguaaauuc

SEQ ID NO: 625015 - RNA, 19 nt, Homo sapiens
gagugugaaugaucaaguc

SEQ ID NO: 625016 - RNA, 19 nt, Homo sapiens
cuaugaagcuauuggucuu

SEQ ID NO: 625017 - RNA, 19 nt, Homo sapiens
gcagucucaucaccuagga

SEQ ID NO: 625018 - RNA, 19 nt, Homo sapiens
caacauggugaaacuuaau

SEQ ID NO: 625019 - RNA, 19 nt, Homo sapiens
ugaaugaucaaguccuuug

SEQ ID NO: 625020 - RNA, 19 nt, Homo sapiens
uagccaaacuauucaacau

SEQ ID NO: 625021 - RNA, 19 nt, Homo sapiens
uacaggugcuucugggaaa

SEQ ID NO: 625022 - RNA, 19 nt, Homo sapiens
ggaaagauccuccccgaau

SEQ ID NO: 625023 - RNA, 19 nt, Homo sapiens
gaggugaagaguagaacaa

SEQ ID NO: 625024 - RNA, 19 nt, Homo sapiens
caaguccuuugugaauauu

SEQ ID NO: 625025 - RNA, 19 nt, Homo sapiens
gaaggaggaggucccgaau

SEQ ID NO: 625026 - RNA, 19 nt, Homo sapiens
uuugguggcuuccggguaa

SEQ ID NO: 625027 - RNA, 19 nt, Homo sapiens
cacgggaagucaaaucaau

SEQ ID NO: 625028 - RNA, 19 nt, Homo sapiens
aagaguagaacaacgcuuu

SEQ ID NO: 625029 - RNA, 19 nt, Homo sapiens
gguagaaacugaccacaua

SEQ ID NO: 625030 - RNA, 19 nt, Homo sapiens
gcaaaggugucaucuucua

SEQ ID NO: 625031 - RNA, 19 nt, Homo sapiens
caaggaagaucauuaagga

SEQ ID NO: 625032 - RNA, 19 nt, Homo sapiens
gcaggaagguagaaacuga

SEQ ID NO: 625033 - RNA, 19 nt, Homo sapiens
gcaugaagaucucaaugaa

SEQ ID NO: 625034 - RNA, 19 nt, Homo sapiens
caacauucaugaagacuga

SEQ ID NO: 625035 - RNA, 19 nt, Homo sapiens
gaacaucuuuaaccgaaug

SEQ ID NO: 625036 - RNA, 19 nt, Homo sapiens
gcacagaagugauucaacu

SEQ ID NO: 625037 - RNA, 19 nt, Homo sapiens
gaauagcggucgccgaaau

SEQ ID NO: 625038 - RNA, 19 nt, Homo sapiens
gaacugguauccgaucaga

SEQ ID NO: 625039 - RNA, 19 nt, Homo sapiens
gaaagauccuccccgaaua

SEQ ID NO: 625040 - RNA, 19 nt, Homo sapiens
gauauaaaguugggaagga

SEQ ID NO: 625041 - RNA, 19 nt, Homo sapiens
gaucaaguccuuugugaau

SEQ ID NO: 625042 - RNA, 19 nt, Homo sapiens
ugaaguagccaaacuauuc

SEQ ID NO: 625043 - RNA, 19 nt, Homo sapiens
cggcaaaggugucaucuuc

SEQ ID NO: 625044 - RNA, 19 nt, Homo sapiens
gaucagagagugagacaga

SEQ ID NO: 625045 - RNA, 19 nt, Homo sapiens
gaaaggaaauaugggaaag

SEQ ID NO: 625046 - RNA, 19 nt, Homo sapiens
ucaauguucuggagugauu

SEQ ID NO: 625047 - RNA, 19 nt, Homo sapiens
ggaggagucugcguaaugu

SEQ ID NO: 625048 - RNA, 19 nt, Homo sapiens
ucaaguccuuugugaauau

SEQ ID NO: 625049 - RNA, 19 nt, Homo sapiens
gccaaacuauucaacauuc

SEQ ID NO: 625050 - RNA, 19 nt, Homo sapiens
agucagcaguggcaaguua

SEQ ID NO: 625051 - RNA, 19 nt, Homo sapiens
gauguuggcuaugaagcua

SEQ ID NO: 625052 - RNA, 19 nt, Homo sapiens
gcugcaugcuucuacgaua

SEQ ID NO: 625053 - RNA, 19 nt, Homo sapiens
caagcacgcucuaacaucu

SEQ ID NO: 625054 - RNA, 19 nt, Homo sapiens
gaaagacggcaggaaggua

SEQ ID NO: 625055 - RNA, 19 nt, Homo sapiens
uagcaaggaagaucauuaa

SEQ ID NO: 625056 - RNA, 19 nt, Homo sapiens
gaaguagccaaacuauuca

SEQ ID NO: 625057 - RNA, 19 nt, Homo sapiens
uccgaggccucagaaauua

SEQ ID NO: 625058 - RNA, 19 nt, Homo sapiens
gcaccaugaucacgcuguu

SEQ ID NO: 625059 - RNA, 19 nt, Homo sapiens
guaugagugugaaugauca

SEQ ID NO: 625060 - RNA, 19 nt, Homo sapiens
ggaggaggagucugcguaa

SEQ ID NO: 625061 - RNA, 19 nt, Homo sapiens
ggagcccaauguugaguug

SEQ ID NO: 625062 - RNA, 19 nt, Homo sapiens
gcaaggaagaucauuaagg

SEQ ID NO: 625063 - RNA, 19 nt, Homo sapiens
caagacugguggccuggaa

SEQ ID NO: 625064 - RNA, 19 nt, Homo sapiens
gaaugccaauagcaaggaa

SEQ ID NO: 625065 - RNA, 19 nt, Homo sapiens
caaugaaguagccaaacua

SEQ ID NO: 625066 - RNA, 19 nt, Homo sapiens
gcaugcuucuacgauauaa

SEQ ID NO: 625067 - RNA, 19 nt, Homo sapiens
ccgaauaccucagcaacug

SEQ ID NO: 625068 - RNA, 19 nt, Homo sapiens
cagaagugauucaacucuu

SEQ ID NO: 625069 - RNA, 19 nt, Homo sapiens
ucaaugaaguagccaaacu

SEQ ID NO: 625070 - RNA, 19 nt, Homo sapiens
augaagaucucaaugaagu

SEQ ID NO: 625071 - RNA, 19 nt, Homo sapiens
guccgaggccucagaaauu

SEQ ID NO: 625072 - RNA, 19 nt, Homo sapiens
cuucuacgauauaaaguug

SEQ ID NO: 625073 - RNA, 19 nt, Homo sapiens
gaagaucucaaugaaguag

SEQ ID NO: 625074 - RNA, 19 nt, Homo sapiens
ggguagagcaccaugauca

SEQ ID NO: 625075 - RNA, 19 nt, Homo sapiens
ccggguaaaugcagagcua

SEQ ID NO: 625076 - RNA, 19 nt, Homo sapiens
aggaggaggucccgaauag

SEQ ID NO: 625077 - RNA, 19 nt, Homo sapiens
gaggaggucgaauggguaa

SEQ ID NO: 625078 - RNA, 19 nt, Homo sapiens
ccaaacuauucaacauuca

SEQ ID NO: 625079 - RNA, 19 nt, Homo sapiens
caacuauguagguaaauuc

SEQ ID NO: 625080 - RNA, 19 nt, Homo sapiens
gagugugaaugaucaaguc

SEQ ID NO: 625081 - RNA, 19 nt, Homo sapiens
cuaugaagcuauuggucuu

SEQ ID NO: 625082 - RNA, 19 nt, Homo sapiens
ugaaugaucaaguccuuug

SEQ ID NO: 625083 - RNA, 19 nt, Homo sapiens
uagccaaacuauucaacau

SEQ ID NO: 625084 - RNA, 19 nt, Homo sapiens
ggaaagauccuccccgaau

SEQ ID NO: 625085 - RNA, 19 nt, Homo sapiens
caaguccuuugugaauauu

SEQ ID NO: 625086 - RNA, 19 nt, Homo sapiens
gaaggaggaggucccgaau

SEQ ID NO: 625087 - RNA, 19 nt, Homo sapiens
uuugguggcuuccggguaa

SEQ ID NO: 625088 - RNA, 19 nt, Homo sapiens
ggaacaucuuuaaccgaau

SEQ ID NO: 625089 - RNA, 19 nt, Homo sapiens
ccucagaaauuacuauucc

SEQ ID NO: 625090 - RNA, 19 nt, Homo sapiens
ggucgugcgugagaggaaa

SEQ ID NO: 625091 - RNA, 19 nt, Homo sapiens
ggugaugcccaaugcuauu

SEQ ID NO: 625092 - RNA, 19 nt, Homo sapiens
aaggaaauaugggaaagau

SEQ ID NO: 625093 - RNA, 19 nt, Homo sapiens
gaggaggagucugcguaau

SEQ ID NO: 625094 - RNA, 19 nt, Homo sapiens
cggcuucucuguccaaugc

SEQ ID NO: 625095 - RNA, 19 nt, Homo sapiens
agaaaggaaauaugggaaa

SEQ ID NO: 625096 - RNA, 19 nt, Homo sapiens
cugcaugcuucuacgauau

SEQ ID NO: 625097 - RNA, 19 nt, Homo sapiens
cuacaagcacgcucuaaca

SEQ ID NO: 625098 - RNA, 19 nt, Homo sapiens
guaaugugcgugugaagag

SEQ ID NO: 625099 - RNA, 19 nt, Homo sapiens
aagauuggcuggagaaaau

SEQ ID NO: 625100 - RNA, 19 nt, Homo sapiens
gccuggagcccaauguuga

SEQ ID NO: 625101 - RNA, 19 nt, Homo sapiens
ccaauagcaaggaagauca

SEQ ID NO: 625102 - RNA, 19 nt, Homo sapiens
gguaaaugcagagcuacaa

SEQ ID NO: 625103 - RNA, 19 nt, Homo sapiens
ggauugugcuauggaacau

SEQ ID NO: 625104 - RNA, 19 nt, Homo sapiens
uaaugugcgugugaagaga

SEQ ID NO: 625105 - RNA, 19 nt, Homo sapiens
augaucaaguccuuuguga

SEQ ID NO: 625106 - RNA, 19 nt, Homo sapiens
auagcaaggaagaucauua

SEQ ID NO: 625107 - RNA, 19 nt, Homo sapiens
gcaacuggaccauggaaaa

SEQ ID NO: 625108 - RNA, 19 nt, Homo sapiens
ggaggacuacggcaaaggu

SEQ ID NO: 625109 - RNA, 19 nt, Homo sapiens
ugugaaugaucaaguccuu

SEQ ID NO: 625110 - RNA, 19 nt, Homo sapiens
caaaagcaacugcacaaga

SEQ ID NO: 625111 - RNA, 19 nt, Homo sapiens
cugguggccuggaaauaga

SEQ ID NO: 625112 - RNA, 19 nt, Homo sapiens
gggauugugcuauggaaca

SEQ ID NO: 625113 - RNA, 19 nt, Homo sapiens
gccuggaaauagacucaga

SEQ ID NO: 625114 - RNA, 19 nt, Homo sapiens
uuaaggugaugcccaaugc

SEQ ID NO: 625115 - RNA, 19 nt, Homo sapiens
ugaagaucucaaugaagua

SEQ ID NO: 625116 - RNA, 19 nt, Homo sapiens
ggagucagcaguggcaagu

SEQ ID NO: 625117 - RNA, 19 nt, Homo sapiens
ggaagauuggcuggagaaa

SEQ ID NO: 625118 - RNA, 19 nt, Homo sapiens
gaagcccgaggcagaggaa

SEQ ID NO: 625119 - RNA, 19 nt, Homo sapiens
uaaggacggugagcagcau

SEQ ID NO: 625120 - RNA, 19 nt, Homo sapiens
gugcuauggaacaucuuua

SEQ ID NO: 625121 - RNA, 19 nt, Homo sapiens
guaaaugcagagcuacaag

SEQ ID NO: 625122 - RNA, 19 nt, Homo sapiens
guagaaacugaccacauag

SEQ ID NO: 625123 - RNA, 19 nt, Homo sapiens
aucaaguccuuugugaaua

SEQ ID NO: 625124 - RNA, 19 nt, Homo sapiens
gaaugaucaaguccuuugu

SEQ ID NO: 625125 - RNA, 19 nt, Homo sapiens
agacuuucucuguguauga

SEQ ID NO: 625126 - RNA, 19 nt, Homo sapiens
ggaggucgaauggguaaag

SEQ ID NO: 625127 - RNA, 19 nt, Homo sapiens
ccugagaggaggucgaaug

SEQ ID NO: 625128 - RNA, 19 nt, Homo sapiens
uggcaucagucaauguucu

SEQ ID NO: 625129 - RNA, 19 nt, Homo sapiens
ggacuccucucguacuuga

SEQ ID NO: 625130 - RNA, 19 nt, Homo sapiens
caacgagugucuccucauc

SEQ ID NO: 625131 - RNA, 19 nt, Homo sapiens
gcacagacgcucagcaucu

SEQ ID NO: 625132 - RNA, 19 nt, Homo sapiens
caucaugccugcugugaag

SEQ ID NO: 625133 - RNA, 19 nt, Homo sapiens
cagggucgcuuccgcuuug

SEQ ID NO: 625134 - RNA, 19 nt, Homo sapiens
caucaggauucucaaguuc

SEQ ID NO: 625135 - RNA, 19 nt, Homo sapiens
gagcuggcccucuuguuug

SEQ ID NO: 625136 - RNA, 19 nt, Homo sapiens
aaacucggguggaccaaau

SEQ ID NO: 625137 - RNA, 19 nt, Homo sapiens
ccaucaggauucucaaguu

SEQ ID NO: 625138 - RNA, 19 nt, Homo sapiens
ggagaagagcuaccagugu

SEQ ID NO: 625139 - RNA, 19 nt, Homo sapiens
ggaaguagcagaggagaag

SEQ ID NO: 625140 - RNA, 19 nt, Homo sapiens
agagagaccacacgcagua

SEQ ID NO: 625141 - RNA, 19 nt, Homo sapiens
acgcggaggugguggauga

SEQ ID NO: 625142 - RNA, 19 nt, Homo sapiens
gagaccacacgcaguauug

SEQ ID NO: 625143 - RNA, 19 nt, Homo sapiens
ugucugugcuguccacuau

SEQ ID NO: 625144 - RNA, 19 nt, Homo sapiens
ccuccggacuccucucgua

SEQ ID NO: 625145 - RNA, 19 nt, Homo sapiens
cuaccacgucuucauauuu

SEQ ID NO: 625146 - RNA, 19 nt, Homo sapiens
cgacaucaccuccgacuac

SEQ ID NO: 625147 - RNA, 19 nt, Homo sapiens
cauccuaggcuccggcuuu

SEQ ID NO: 625148 - RNA, 19 nt, Homo sapiens
cgucuaccacgucuucaua

SEQ ID NO: 625149 - RNA, 19 nt, Homo sapiens
ucaguggucuacgcgcaua

SEQ ID NO: 625150 - RNA, 19 nt, Homo sapiens
ggaagcugcugggcucagu

SEQ ID NO: 625151 - RNA, 19 nt, Homo sapiens
ggacgucauugagcaguac

SEQ ID NO: 625152 - RNA, 19 nt, Homo sapiens
ggaacuugccaacgagugu

SEQ ID NO: 625153 - RNA, 19 nt, Homo sapiens
caucggcuauggugacaag

SEQ ID NO: 625154 - RNA, 19 nt, Homo sapiens
ggacgccaacuccgacuuc

SEQ ID NO: 625155 - RNA, 19 nt, Homo sapiens
gaucaccgccugguacauc

SEQ ID NO: 625156 - RNA, 19 nt, Homo sapiens
ucuaccacgucuucauauu

SEQ ID NO: 625157 - RNA, 19 nt, Homo sapiens
agaagcaggugcaguccau

SEQ ID NO: 625158 - RNA, 19 nt, Homo sapiens
ggaggugguggaugaaauc

SEQ ID NO: 625159 - RNA, 19 nt, Homo sapiens
ccaccugguacuacuauga

SEQ ID NO: 625160 - RNA, 19 nt, Homo sapiens
cgccuguacuccaccgaua

SEQ ID NO: 625161 - RNA, 19 nt, Homo sapiens
acaagacaccgcacacaug

SEQ ID NO: 625162 - RNA, 19 nt, Homo sapiens
ucuggcaccuccaacaaug

SEQ ID NO: 625163 - RNA, 19 nt, Homo sapiens
ugacagccaccugguacua

SEQ ID NO: 625164 - RNA, 19 nt, Homo sapiens
cugggcaucucuuucuuug

SEQ ID NO: 625165 - RNA, 19 nt, Homo sapiens
gacaagacaccgcacacau

SEQ ID NO: 625166 - RNA, 19 nt, Homo sapiens
gcagggucgcuuccgcuuu

SEQ ID NO: 625167 - RNA, 19 nt, Homo sapiens
uaccacgucuucauauuuu

SEQ ID NO: 625168 - RNA, 19 nt, Homo sapiens
cggaggugguggaugaaau

SEQ ID NO: 625169 - RNA, 19 nt, Homo sapiens
gaccguacgacgugaagga

SEQ ID NO: 625170 - RNA, 19 nt, Homo sapiens
acgagugucuccucaucuu

SEQ ID NO: 625171 - RNA, 19 nt, Homo sapiens
acaguauccucccauccuu

SEQ ID NO: 625172 - RNA, 19 nt, Homo sapiens
accaggaacuugccaacga

SEQ ID NO: 625173 - RNA, 19 nt, Homo sapiens
acgauuacauugacaacca

SEQ ID NO: 625174 - RNA, 19 nt, Homo sapiens
guggaugaaaucagcauga

SEQ ID NO: 625175 - RNA, 19 nt, Homo sapiens
agaacugggucuacaacgu

SEQ ID NO: 625176 - RNA, 19 nt, Homo sapiens
cugcagaacugggucuaca

SEQ ID NO: 625177 - RNA, 19 nt, Homo sapiens
caucuggcaccuccaacaa

SEQ ID NO: 625178 - RNA, 19 nt, Homo sapiens
cggcuauggugacaagaca

SEQ ID NO: 625179 - RNA, 19 nt, Homo sapiens
gcagaacugggucuacaac

SEQ ID NO: 625180 - RNA, 19 nt, Homo sapiens
caagcuggaccugcuguug

SEQ ID NO: 625181 - RNA, 19 nt, Homo sapiens
gaucaagagccugcaaacu

SEQ ID NO: 625182 - RNA, 19 nt, Homo sapiens
ggaaauucaaggagacacu

SEQ ID NO: 625183 - RNA, 19 nt, Homo sapiens
acagucauccgcuccauca

SEQ ID NO: 625184 - RNA, 19 nt, Homo sapiens
gacaucaugccugcuguga

SEQ ID NO: 625185 - RNA, 19 nt, Homo sapiens
uggucuaccuggcugagaa

SEQ ID NO: 625186 - RNA, 19 nt, Homo sapiens
gaaagcccuucugugucau

SEQ ID NO: 625187 - RNA, 19 nt, Homo sapiens
gaaguagcagaggagaaga

SEQ ID NO: 625188 - RNA, 19 nt, Homo sapiens
gcaucuggcaccuccaaca

SEQ ID NO: 625189 - RNA, 19 nt, Homo sapiens
guacccagggcaacaucuu

SEQ ID NO: 625190 - RNA, 19 nt, Homo sapiens
ccggacuccucucguacuu

SEQ ID NO: 625191 - RNA, 19 nt, Homo sapiens
caaacucggguggaccaaa

SEQ ID NO: 625192 - RNA, 19 nt, Homo sapiens
uuacugggcaucucuuucu

SEQ ID NO: 625193 - RNA, 19 nt, Homo sapiens
ggacuccucucguacuuga

SEQ ID NO: 625194 - RNA, 19 nt, Homo sapiens
caacgagugucuccucauc

SEQ ID NO: 625195 - RNA, 19 nt, Homo sapiens
gcacagacgcucagcaucu

SEQ ID NO: 625196 - RNA, 19 nt, Homo sapiens
caucaugccugcugugaag

SEQ ID NO: 625197 - RNA, 19 nt, Homo sapiens
cagggucgcuuccgcuuug

SEQ ID NO: 625198 - RNA, 19 nt, Homo sapiens
caucaggauucucaaguuc

SEQ ID NO: 625199 - RNA, 19 nt, Homo sapiens
aaacucggguggaccaaau

SEQ ID NO: 625200 - RNA, 19 nt, Homo sapiens
ccaucaggauucucaaguu

SEQ ID NO: 625201 - RNA, 19 nt, Homo sapiens
ggagaagagcuaccagugu

SEQ ID NO: 625202 - RNA, 19 nt, Homo sapiens
ggaaguagcagaggagaag

SEQ ID NO: 625203 - RNA, 19 nt, Homo sapiens
agagagaccacacgcagua

SEQ ID NO: 625204 - RNA, 19 nt, Homo sapiens
acgcggaggugguggauga

SEQ ID NO: 625205 - RNA, 19 nt, Homo sapiens
gagaccacacgcaguauug

SEQ ID NO: 625206 - RNA, 19 nt, Homo sapiens
ugucugugcuguccacuau

SEQ ID NO: 625207 - RNA, 19 nt, Homo sapiens
ccuccggacuccucucgua

SEQ ID NO: 625208 - RNA, 19 nt, Homo sapiens
cuaccacgucuucauauuu

SEQ ID NO: 625209 - RNA, 19 nt, Homo sapiens
cgacaucaccuccgacuac

SEQ ID NO: 625210 - RNA, 19 nt, Homo sapiens
cauccuaggcuccggcuuu

SEQ ID NO: 625211 - RNA, 19 nt, Homo sapiens
cgucuaccacgucuucaua

SEQ ID NO: 625212 - RNA, 19 nt, Homo sapiens
ucaguggucuacgcgcaua

SEQ ID NO: 625213 - RNA, 19 nt, Homo sapiens
ggaagcugcugggcucagu

SEQ ID NO: 625214 - RNA, 19 nt, Homo sapiens
ggacgucauugagcaguac

SEQ ID NO: 625215 - RNA, 19 nt, Homo sapiens
ggaacuugccaacgagugu

SEQ ID NO: 625216 - RNA, 19 nt, Homo sapiens
caucggcuauggugacaag

SEQ ID NO: 625217 - RNA, 19 nt, Homo sapiens
ggacgccaacuccgacuuc

SEQ ID NO: 625218 - RNA, 19 nt, Homo sapiens
gaucaccgccugguacauc

SEQ ID NO: 625219 - RNA, 19 nt, Homo sapiens
agaagcaggugcaguccau

SEQ ID NO: 625220 - RNA, 19 nt, Homo sapiens
ggaggugguggaugaaauc

SEQ ID NO: 625221 - RNA, 19 nt, Homo sapiens
ucuaccacgucuucauauu

SEQ ID NO: 625222 - RNA, 19 nt, Homo sapiens
ccaccugguacuacuauga

SEQ ID NO: 625223 - RNA, 19 nt, Homo sapiens
cgccuguacuccaccgaua

SEQ ID NO: 625224 - RNA, 19 nt, Homo sapiens
acaagacaccgcacacaug

SEQ ID NO: 625225 - RNA, 19 nt, Homo sapiens
ucuggcaccuccaacaaug

SEQ ID NO: 625226 - RNA, 19 nt, Homo sapiens
ugacagccaccugguacua

SEQ ID NO: 625227 - RNA, 19 nt, Homo sapiens
cugggcaucucuuucuuug

SEQ ID NO: 625228 - RNA, 19 nt, Homo sapiens
gacaagacaccgcacacau

SEQ ID NO: 625229 - RNA, 19 nt, Homo sapiens
gcagggucgcuuccgcuuu

SEQ ID NO: 625230 - RNA, 19 nt, Homo sapiens
uaccacgucuucauauuuu

SEQ ID NO: 625231 - RNA, 19 nt, Homo sapiens
cggaggugguggaugaaau

SEQ ID NO: 625232 - RNA, 19 nt, Homo sapiens
gaccguacgacgugaagga

SEQ ID NO: 625233 - RNA, 19 nt, Homo sapiens
acgagugucuccucaucuu

SEQ ID NO: 625234 - RNA, 19 nt, Homo sapiens
accaggaacuugccaacga

SEQ ID NO: 625235 - RNA, 19 nt, Homo sapiens
acaguauccucccauccuu

SEQ ID NO: 625236 - RNA, 19 nt, Homo sapiens
acgauuacauugacaacca

SEQ ID NO: 625237 - RNA, 19 nt, Homo sapiens
guggaugaaaucagcauga

SEQ ID NO: 625238 - RNA, 19 nt, Homo sapiens
agaacugggucuacaacgu

SEQ ID NO: 625239 - RNA, 19 nt, Homo sapiens
cugcagaacugggucuaca

SEQ ID NO: 625240 - RNA, 19 nt, Homo sapiens
caucuggcaccuccaacaa

SEQ ID NO: 625241 - RNA, 19 nt, Homo sapiens
cggcuauggugacaagaca

SEQ ID NO: 625242 - RNA, 19 nt, Homo sapiens
gcagaacugggucuacaac

SEQ ID NO: 625243 - RNA, 19 nt, Homo sapiens
caagcuggaccugcuguug

SEQ ID NO: 625244 - RNA, 19 nt, Homo sapiens
gaucaagagccugcaaacu

SEQ ID NO: 625245 - RNA, 19 nt, Homo sapiens
ggaaauucaaggagacacu

SEQ ID NO: 625246 - RNA, 19 nt, Homo sapiens
acagucauccgcuccauca

SEQ ID NO: 625247 - RNA, 19 nt, Homo sapiens
gacaucaugccugcuguga

SEQ ID NO: 625248 - RNA, 19 nt, Homo sapiens
uggucuaccuggcugagaa

SEQ ID NO: 625249 - RNA, 19 nt, Homo sapiens
gaaagcccuucugugucau

SEQ ID NO: 625250 - RNA, 19 nt, Homo sapiens
gaaguagcagaggagaaga

SEQ ID NO: 625251 - RNA, 19 nt, Homo sapiens
gcaucuggcaccuccaaca

SEQ ID NO: 625252 - RNA, 19 nt, Homo sapiens
guacccagggcaacaucuu

SEQ ID NO: 625253 - RNA, 19 nt, Homo sapiens
ccggacuccucucguacuu

SEQ ID NO: 625254 - RNA, 19 nt, Homo sapiens
caaacucggguggaccaaa

SEQ ID NO: 625255 - RNA, 19 nt, Homo sapiens
uuacugggcaucucuuucu

SEQ ID NO: 625256 - RNA, 19 nt, Homo sapiens
caacaaaugucaacaaaca

SEQ ID NO: 625257 - RNA, 19 nt, Homo sapiens
caaguccacuccaaguuua

SEQ ID NO: 625258 - RNA, 19 nt, Homo sapiens
acacaggaguuaauucuaa

SEQ ID NO: 625259 - RNA, 19 nt, Homo sapiens
caugaaaccucuucucaga

SEQ ID NO: 625260 - RNA, 19 nt, Homo sapiens
gcagcaaacuccugaagau

SEQ ID NO: 625261 - RNA, 19 nt, Homo sapiens
cauaaacccacauuucuua

SEQ ID NO: 625262 - RNA, 19 nt, Homo sapiens
acuaugauauggugcauua

SEQ ID NO: 625263 - RNA, 19 nt, Homo sapiens
ggacauugauaacgaagau

SEQ ID NO: 625264 - RNA, 19 nt, Homo sapiens
ccaagaauguggugaaagu

SEQ ID NO: 625265 - RNA, 19 nt, Homo sapiens
ccagugauuuggagaauau

SEQ ID NO: 625266 - RNA, 19 nt, Homo sapiens
ggaaauagaguuacaacca

SEQ ID NO: 625267 - RNA, 19 nt, Homo sapiens
gaacuuaaagcagcaguau

SEQ ID NO: 625268 - RNA, 19 nt, Homo sapiens
gcaggagacucuguacaug

SEQ ID NO: 625269 - RNA, 19 nt, Homo sapiens
acuuaaagcagcaguauua

SEQ ID NO: 625270 - RNA, 19 nt, Homo sapiens
ccacauuucuuagauggaa

SEQ ID NO: 625271 - RNA, 19 nt, Homo sapiens
cacagagaaugaaguauug

SEQ ID NO: 625272 - RNA, 19 nt, Homo sapiens
cagcacaaguagcuaagaa

SEQ ID NO: 625273 - RNA, 19 nt, Homo sapiens
caaggaaaauggaacuuaa

SEQ ID NO: 625274 - RNA, 19 nt, Homo sapiens
gaagaaauuggaaauagag

SEQ ID NO: 625275 - RNA, 19 nt, Homo sapiens
uggaagagauauaaaugga

SEQ ID NO: 625276 - RNA, 19 nt, Homo sapiens
gugacuacguuaaggauau

SEQ ID NO: 625277 - RNA, 19 nt, Homo sapiens
caacugaaaccuacugcuu

SEQ ID NO: 625278 - RNA, 19 nt, Homo sapiens
acacagagaaugaaguauu

SEQ ID NO: 625279 - RNA, 19 nt, Homo sapiens
gauggaagagauauaaaug

SEQ ID NO: 625280 - RNA, 19 nt, Homo sapiens
gcucugcagugacuacguu

SEQ ID NO: 625281 - RNA, 19 nt, Homo sapiens
caccaaaguuccaguucaa

SEQ ID NO: 625282 - RNA, 19 nt, Homo sapiens
gagcagcacaaguagcuaa

SEQ ID NO: 625283 - RNA, 19 nt, Homo sapiens
aaccagagcagcacaagua

SEQ ID NO: 625284 - RNA, 19 nt, Homo sapiens
agaauguggugaaaguaaa

SEQ ID NO: 625285 - RNA, 19 nt, Homo sapiens
cgagaaauggaaacucuaa

SEQ ID NO: 625286 - RNA, 19 nt, Homo sapiens
guacaugugcguuggcauu

SEQ ID NO: 625287 - RNA, 19 nt, Homo sapiens
ucccucagcugaacucaaa

SEQ ID NO: 625288 - RNA, 19 nt, Homo sapiens
uaacgaagauugggagaac

SEQ ID NO: 625289 - RNA, 19 nt, Homo sapiens
ccucuggucuaucucauga

SEQ ID NO: 625290 - RNA, 19 nt, Homo sapiens
ucaucgccaucaagaauaa

SEQ ID NO: 625291 - RNA, 19 nt, Homo sapiens
gacaaugcuuauaccaguu

SEQ ID NO: 625292 - RNA, 19 nt, Homo sapiens
aaacccacauuucuuagau

SEQ ID NO: 625293 - RNA, 19 nt, Homo sapiens
ggucgacccuugccacuac

SEQ ID NO: 625294 - RNA, 19 nt, Homo sapiens
cacaggaguuaauucuaaa

SEQ ID NO: 625295 - RNA, 19 nt, Homo sapiens
gcacaaguagcuaagaaag

SEQ ID NO: 625296 - RNA, 19 nt, Homo sapiens
ggccaagaauguggugaaa

SEQ ID NO: 625297 - RNA, 19 nt, Homo sapiens
caggauacacagagaauga

SEQ ID NO: 625298 - RNA, 19 nt, Homo sapiens
acuauuaggcgaacuguuu

SEQ ID NO: 625299 - RNA, 19 nt, Homo sapiens
cgaggacauugauaacgaa

SEQ ID NO: 625300 - RNA, 19 nt, Homo sapiens
gaauauugacacaggaguu

SEQ ID NO: 625301 - RNA, 19 nt, Homo sapiens
agaaugaaguauuggaagu

SEQ ID NO: 625302 - RNA, 19 nt, Homo sapiens
ugaagacuuuguuuacauc

SEQ ID NO: 625303 - RNA, 19 nt, Homo sapiens
gauuacugcucugcucuug

SEQ ID NO: 625304 - RNA, 19 nt, Homo sapiens
aaaguuaagagucauguga

SEQ ID NO: 625305 - RNA, 19 nt, Homo sapiens
ucacagacaaugcuuauac

SEQ ID NO: 625306 - RNA, 19 nt, Homo sapiens
uggauuggcugguacaagu

SEQ ID NO: 625307 - RNA, 19 nt, Homo sapiens
ccuaguggauuggcuggua

SEQ ID NO: 625308 - RNA, 19 nt, Homo sapiens
cuaaauucaucgccaucaa

SEQ ID NO: 625309 - RNA, 19 nt, Homo sapiens
ccaaauccgagaaauggaa

SEQ ID NO: 625310 - RNA, 19 nt, Homo sapiens
gcuuauaccaguucccaaa

SEQ ID NO: 625311 - RNA, 19 nt, Homo sapiens
ccaaguaugaggagauguu

SEQ ID NO: 625312 - RNA, 19 nt, Homo sapiens
acaaguccacuccaaguuu

SEQ ID NO: 625313 - RNA, 19 nt, Homo sapiens
guacaaguccacuccaagu

SEQ ID NO: 625314 - RNA, 19 nt, Homo sapiens
gaaaauggaacuuaaagca

SEQ ID NO: 625315 - RNA, 19 nt, Homo sapiens
gcuaagaaagcucagaaca

SEQ ID NO: 625316 - RNA, 19 nt, Homo sapiens
gguuuagaacucuugauuu

SEQ ID NO: 625317 - RNA, 19 nt, Homo sapiens
auacacagagaaugaagua

SEQ ID NO: 625318 - RNA, 19 nt, Homo sapiens
ucgaggacauugauaacga

SEQ ID NO: 625319 - RNA, 19 nt, Homo sapiens
acaccaaaguuccaguuca

SEQ ID NO: 625320 - RNA, 19 nt, Homo sapiens
aagaauguggugaaaguaa

SEQ ID NO: 625321 - RNA, 19 nt, Homo sapiens
ugcauuaucauccuucuaa

SEQ ID NO: 625322 - RNA, 19 nt, Homo sapiens
ugauggagcugacucucau

SEQ ID NO: 625323 - RNA, 19 nt, Homo sapiens
cuccaaauauugaagacuu

SEQ ID NO: 625324 - RNA, 19 nt, Homo sapiens
caugugcguuggcauuaug

SEQ ID NO: 625325 - RNA, 19 nt, Homo sapiens
gcagugacuacguuaagga

SEQ ID NO: 625326 - RNA, 19 nt, Homo sapiens
aaaucgaggacauugauaa

SEQ ID NO: 625327 - RNA, 19 nt, Homo sapiens
cugaggaugucuccaugaa

SEQ ID NO: 625328 - RNA, 19 nt, Homo sapiens
ucuggucuaucucaugaaa

SEQ ID NO: 625329 - RNA, 19 nt, Homo sapiens
caucacagacaaugcuuau

SEQ ID NO: 625330 - RNA, 19 nt, Homo sapiens
ccauaaacccacauuucuu

SEQ ID NO: 625331 - RNA, 19 nt, Homo sapiens
gaauguggugaaaguaaau

SEQ ID NO: 625332 - RNA, 19 nt, Homo sapiens
aauauugacacaggaguua

SEQ ID NO: 625333 - RNA, 19 nt, Homo sapiens
ggaacuuaaagcagcagua

SEQ ID NO: 625334 - RNA, 19 nt, Homo sapiens
ugucaaaccaguacagaug

SEQ ID NO: 625335 - RNA, 19 nt, Homo sapiens
ccucuucucagaccaguuu

SEQ ID NO: 625336 - RNA, 19 nt, Homo sapiens
caagaauguggugaaagua

SEQ ID NO: 625337 - RNA, 19 nt, Homo sapiens
ucaauuaguugggauuacu

SEQ ID NO: 625338 - RNA, 19 nt, Homo sapiens
ucaggcagcuggagguuuu

SEQ ID NO: 625339 - RNA, 19 nt, Homo sapiens
ucaaaccaguacagaugga

SEQ ID NO: 625340 - RNA, 19 nt, Homo sapiens
guggugaaaguaaaugaaa

SEQ ID NO: 625341 - RNA, 19 nt, Homo sapiens
caaauccgagaaauggaaa

SEQ ID NO: 625342 - RNA, 19 nt, Homo sapiens
guccauaaacccacauuuc

SEQ ID NO: 625343 - RNA, 19 nt, Homo sapiens
gacacaggaguuaauucua

SEQ ID NO: 625344 - RNA, 19 nt, Homo sapiens
agacuuuguuuacaucaca

SEQ ID NO: 625345 - RNA, 19 nt, Homo sapiens
ccucagcucugcagugacu

SEQ ID NO: 625346 - RNA, 19 nt, Homo sapiens
ugacacaggaguuaauucu

SEQ ID NO: 625347 - RNA, 19 nt, Homo sapiens
gaccuugccuccccacuga

SEQ ID NO: 625348 - RNA, 19 nt, Homo sapiens
gaacucaaaagccgucaaa

SEQ ID NO: 625349 - RNA, 19 nt, Homo sapiens
uaaagcagcaguauuacac

SEQ ID NO: 625350 - RNA, 19 nt, Homo sapiens
agaaagcucagaacaccaa

SEQ ID NO: 625351 - RNA, 19 nt, Homo sapiens
caaguaugaggagauguuu

SEQ ID NO: 625352 - RNA, 19 nt, Homo sapiens
gcauuaucauccuucuaag

SEQ ID NO: 625353 - RNA, 19 nt, Homo sapiens
acgcuaguguccucccuuu

SEQ ID NO: 625354 - RNA, 19 nt, Homo sapiens
ugaaguauuggaagucaug

SEQ ID NO: 625355 - RNA, 19 nt, Homo sapiens
gaagacuuuguuuacauca

SEQ ID NO: 625356 - RNA, 19 nt, Homo sapiens
ggauggaacucauuauauu

SEQ ID NO: 625357 - RNA, 19 nt, Homo sapiens
ugauaaagcuuaacacuug

SEQ ID NO: 625358 - RNA, 19 nt, Homo sapiens
ggaaaucuaugcuccuaaa

SEQ ID NO: 625359 - RNA, 19 nt, Homo sapiens
gaagauaacuaagcaaaca

SEQ ID NO: 625360 - RNA, 19 nt, Homo sapiens
gcagauauguucaugacaa

SEQ ID NO: 625361 - RNA, 19 nt, Homo sapiens
uaaagaugcuccuaaaguu

SEQ ID NO: 625362 - RNA, 19 nt, Homo sapiens
uaaguacccuuucaaacua

SEQ ID NO: 625363 - RNA, 19 nt, Homo sapiens
cagugaagcugaagacuuu

SEQ ID NO: 625364 - RNA, 19 nt, Homo sapiens
guagguugcuugguaauaa

SEQ ID NO: 625365 - RNA, 19 nt, Homo sapiens
cauaauauccagacacaua

SEQ ID NO: 625366 - RNA, 19 nt, Homo sapiens
caggaaacauucauucaaa

SEQ ID NO: 625367 - RNA, 19 nt, Homo sapiens
gugaaucucuucucccuuu

SEQ ID NO: 625368 - RNA, 19 nt, Homo sapiens
uaagaaagccucagguuug

SEQ ID NO: 625369 - RNA, 19 nt, Homo sapiens
gacuaaggcuuuauuuaug

SEQ ID NO: 625370 - RNA, 19 nt, Homo sapiens
gcaaacaaguuggaauuca

SEQ ID NO: 625371 - RNA, 19 nt, Homo sapiens
ggacaguauuucagaaugu

SEQ ID NO: 625372 - RNA, 19 nt, Homo sapiens
cuaaauuccuccauuguga

SEQ ID NO: 625373 - RNA, 19 nt, Homo sapiens
aaagaagucuggcuaaaca

SEQ ID NO: 625374 - RNA, 19 nt, Homo sapiens
ccaaguugaugcucuuaaa

SEQ ID NO: 625375 - RNA, 19 nt, Homo sapiens
acaaucaucuccuggcuaa

SEQ ID NO: 625376 - RNA, 19 nt, Homo sapiens
cagaugagguccauacuuc

SEQ ID NO: 625377 - RNA, 19 nt, Homo sapiens
uaaaggguauacuaaguga

SEQ ID NO: 625378 - RNA, 19 nt, Homo sapiens
gaacugguaucacugaacu

SEQ ID NO: 625379 - RNA, 19 nt, Homo sapiens
gaaaagaaaacaccacuaa

SEQ ID NO: 625380 - RNA, 19 nt, Homo sapiens
guagugcugugauugauug

SEQ ID NO: 625381 - RNA, 19 nt, Homo sapiens
uagauuggaugguaccuuu

SEQ ID NO: 625382 - RNA, 19 nt, Homo sapiens
ccauugaagugguuaagaa

SEQ ID NO: 625383 - RNA, 19 nt, Homo sapiens
gcuuaacacuugaccuaaa

SEQ ID NO: 625384 - RNA, 19 nt, Homo sapiens
gauaaagcuuaacacuuga

SEQ ID NO: 625385 - RNA, 19 nt, Homo sapiens
uuaagaagauuccuaugga

SEQ ID NO: 625386 - RNA, 19 nt, Homo sapiens
gacauaauauccagacaca

SEQ ID NO: 625387 - RNA, 19 nt, Homo sapiens
uaagauaucccuaaggaau

SEQ ID NO: 625388 - RNA, 19 nt, Homo sapiens
aaacuuaaguacccuuuca

SEQ ID NO: 625389 - RNA, 19 nt, Homo sapiens
acauguagguugcuuggua

SEQ ID NO: 625390 - RNA, 19 nt, Homo sapiens
gggaguaccaaagaaauua

SEQ ID NO: 625391 - RNA, 19 nt, Homo sapiens
gaaaguagugcugugauug

SEQ ID NO: 625392 - RNA, 19 nt, Homo sapiens
gagcagauauguucaugac

SEQ ID NO: 625393 - RNA, 19 nt, Homo sapiens
aauccagccucauaaagua

SEQ ID NO: 625394 - RNA, 19 nt, Homo sapiens
cgaaguagccguuuacaag

SEQ ID NO: 625395 - RNA, 19 nt, Homo sapiens
gaaagaagagaaugucaag

SEQ ID NO: 625396 - RNA, 19 nt, Homo sapiens
ucuaagauaucccuaagga

SEQ ID NO: 625397 - RNA, 19 nt, Homo sapiens
ggaaaacacuaaagaagau

SEQ ID NO: 625398 - RNA, 19 nt, Homo sapiens
ccagacacauacaaacuau

SEQ ID NO: 625399 - RNA, 19 nt, Homo sapiens
ucacuuuacuacucuaaga

SEQ ID NO: 625400 - RNA, 19 nt, Homo sapiens
gcaauuugguucuugaaaa

SEQ ID NO: 625401 - RNA, 19 nt, Homo sapiens
caauuggcacuaaagaaua

SEQ ID NO: 625402 - RNA, 19 nt, Homo sapiens
gauagaagccaaccacagu

SEQ ID NO: 625403 - RNA, 19 nt, Homo sapiens
ccaagaagcccagauaauc

SEQ ID NO: 625404 - RNA, 19 nt, Homo sapiens
cauuggaauuaccucauua

SEQ ID NO: 625405 - RNA, 19 nt, Homo sapiens
agaaaguagugcugugauu

SEQ ID NO: 625406 - RNA, 19 nt, Homo sapiens
uaggcuagcuauuucuaaa

SEQ ID NO: 625407 - RNA, 19 nt, Homo sapiens
gaccuaaacuucuauuuuc

SEQ ID NO: 625408 - RNA, 19 nt, Homo sapiens
aagagaaugucaagacgaa

SEQ ID NO: 625409 - RNA, 19 nt, Homo sapiens
ggaacuuuguccuguaaca

SEQ ID NO: 625410 - RNA, 19 nt, Homo sapiens
cagauauguucaugacaaa

SEQ ID NO: 625411 - RNA, 19 nt, Homo sapiens
cauguagguugcuugguaa

SEQ ID NO: 625412 - RNA, 19 nt, Homo sapiens
uaaagaaacagcaggacuu

SEQ ID NO: 625413 - RNA, 19 nt, Homo sapiens
uuauacaccugaaagaaga

SEQ ID NO: 625414 - RNA, 19 nt, Homo sapiens
gaugagguccauacuucua

SEQ ID NO: 625415 - RNA, 19 nt, Homo sapiens
gagagcagauauguucaug

SEQ ID NO: 625416 - RNA, 19 nt, Homo sapiens
agauaucccuaaggaauuu

SEQ ID NO: 625417 - RNA, 19 nt, Homo sapiens
caagguuacuggauagaag

SEQ ID NO: 625418 - RNA, 19 nt, Homo sapiens
cuagccaauucacaaguua

SEQ ID NO: 625419 - RNA, 19 nt, Homo sapiens
ugguaucacugaacuacua

SEQ ID NO: 625420 - RNA, 19 nt, Homo sapiens
gugacuaaggcuuuauuua

SEQ ID NO: 625421 - RNA, 19 nt, Homo sapiens
gaagccaaccacagucuau

SEQ ID NO: 625422 - RNA, 19 nt, Homo sapiens
gaagacagacauaauaucc

SEQ ID NO: 625423 - RNA, 19 nt, Homo sapiens
gaugguaccuuuugucaau

SEQ ID NO: 625424 - RNA, 19 nt, Homo sapiens
gggacaguauuucagaaug

SEQ ID NO: 625425 - RNA, 19 nt, Homo sapiens
ucauuggaauuaccucauu

SEQ ID NO: 625426 - RNA, 19 nt, Homo sapiens
uauacugacuccuagaaau

SEQ ID NO: 625427 - RNA, 19 nt, Homo sapiens
ggguagaacugguaucacu

SEQ ID NO: 625428 - RNA, 19 nt, Homo sapiens
ucuagccauugauucauua

SEQ ID NO: 625429 - RNA, 19 nt, Homo sapiens
caaaauuccuacacucuug

SEQ ID NO: 625430 - RNA, 19 nt, Homo sapiens
guagaacugguaucacuga

SEQ ID NO: 625431 - RNA, 19 nt, Homo sapiens
caaaagaagucuggcuaaa

SEQ ID NO: 625432 - RNA, 19 nt, Homo sapiens
uagcuggucuggcgagguu

SEQ ID NO: 625433 - RNA, 19 nt, Homo sapiens
uuaaggauggaacucauua

SEQ ID NO: 625434 - RNA, 19 nt, Homo sapiens
gcucuaaacagugggagua

SEQ ID NO: 625435 - RNA, 19 nt, Homo sapiens
aagacgaaguagccguuua

SEQ ID NO: 625436 - RNA, 19 nt, Homo sapiens
cuucaacucauuggaauua

SEQ ID NO: 625437 - RNA, 19 nt, Homo sapiens
ccacuaauuguguacauau

SEQ ID NO: 625438 - RNA, 19 nt, Homo sapiens
aaggguauacuaagugaua

SEQ ID NO: 625439 - RNA, 19 nt, Homo sapiens
guuacuguguuuaucuuga

SEQ ID NO: 625440 - RNA, 19 nt, Homo sapiens
uuaagaaagccucagguuu

SEQ ID NO: 625441 - RNA, 19 nt, Homo sapiens
uuaaagaugcuccuaaagu

SEQ ID NO: 625442 - RNA, 19 nt, Homo sapiens
ggaagacagacauaauauc

SEQ ID NO: 625443 - RNA, 19 nt, Homo sapiens
ggagugggacaguauuuca

SEQ ID NO: 625444 - RNA, 19 nt, Homo sapiens
uugaaguucugcauucuga

SEQ ID NO: 625445 - RNA, 19 nt, Homo sapiens
caaccacagucuauaccau

SEQ ID NO: 625446 - RNA, 19 nt, Homo sapiens
acaauuggcacuaaagaau

SEQ ID NO: 625447 - RNA, 19 nt, Homo sapiens
acauaaacaccuucagaaa

SEQ ID NO: 625448 - RNA, 19 nt, Homo sapiens
cagaauguguagauuggau

SEQ ID NO: 625449 - RNA, 19 nt, Homo sapiens
gcugcugccuugugccauu

SEQ ID NO: 625450 - RNA, 19 nt, Homo sapiens
gaaaacaccacuaauugug

SEQ ID NO: 625451 - RNA, 19 nt, Homo sapiens
gucaaagugauaaagcuua

SEQ ID NO: 625452 - RNA, 19 nt, Homo sapiens
uuuccuauguuagcuguua

SEQ ID NO: 625453 - RNA, 19 nt, Homo sapiens
caaacaaguuggaauucac

SEQ ID NO: 625454 - RNA, 19 nt, Homo sapiens
ugggaacuuuguccuguaa

SEQ ID NO: 625455 - RNA, 19 nt, Homo sapiens
aaggauggaacucauuaua

SEQ ID NO: 625456 - RNA, 19 nt, Homo sapiens
ggauggaacucauuauauu

SEQ ID NO: 625457 - RNA, 19 nt, Homo sapiens
ugauaaagcuuaacacuug

SEQ ID NO: 625458 - RNA, 19 nt, Homo sapiens
gagaggaggucaccaagaa

SEQ ID NO: 625459 - RNA, 19 nt, Homo sapiens
gaagauaacuaagcaaaca

SEQ ID NO: 625460 - RNA, 19 nt, Homo sapiens
gcagauauguucaugacaa

SEQ ID NO: 625461 - RNA, 19 nt, Homo sapiens
ugaaacaccucacaaagaa

SEQ ID NO: 625462 - RNA, 19 nt, Homo sapiens
uaaagaugcuccuaaaguu

SEQ ID NO: 625463 - RNA, 19 nt, Homo sapiens
uaaguacccuuucaaacua

SEQ ID NO: 625464 - RNA, 19 nt, Homo sapiens
gaaauaggaacaagugauu

SEQ ID NO: 625465 - RNA, 19 nt, Homo sapiens
cagugaagcugaagacuuu

SEQ ID NO: 625466 - RNA, 19 nt, Homo sapiens
guagguugcuugguaauaa

SEQ ID NO: 625467 - RNA, 19 nt, Homo sapiens
cauaauauccagacacaua

SEQ ID NO: 625468 - RNA, 19 nt, Homo sapiens
caggaaacauucauucaaa

SEQ ID NO: 625469 - RNA, 19 nt, Homo sapiens
gugaaucucuucucccuuu

SEQ ID NO: 625470 - RNA, 19 nt, Homo sapiens
uaagaaagccucagguuug

SEQ ID NO: 625471 - RNA, 19 nt, Homo sapiens
gacuaaggcuuuauuuaug

SEQ ID NO: 625472 - RNA, 19 nt, Homo sapiens
gcaaacaaguuggaauuca

SEQ ID NO: 625473 - RNA, 19 nt, Homo sapiens
caagugauuucuccagauu

SEQ ID NO: 625474 - RNA, 19 nt, Homo sapiens
caagaaacaucaguaugaa

SEQ ID NO: 625475 - RNA, 19 nt, Homo sapiens
ccaagaaacaucaguauga

SEQ ID NO: 625476 - RNA, 19 nt, Homo sapiens
ggacaguauuucagaaugu

SEQ ID NO: 625477 - RNA, 19 nt, Homo sapiens
cuaaauuccuccauuguga

SEQ ID NO: 625478 - RNA, 19 nt, Homo sapiens
aaagaagucuggcuaaaca

SEQ ID NO: 625479 - RNA, 19 nt, Homo sapiens
ccaaguugaugcucuuaaa

SEQ ID NO: 625480 - RNA, 19 nt, Homo sapiens
acaaucaucuccuggcuaa

SEQ ID NO: 625481 - RNA, 19 nt, Homo sapiens
cagaugagguccauacuuc

SEQ ID NO: 625482 - RNA, 19 nt, Homo sapiens
uaaaggguauacuaaguga

SEQ ID NO: 625483 - RNA, 19 nt, Homo sapiens
gaacugguaucacugaacu

SEQ ID NO: 625484 - RNA, 19 nt, Homo sapiens
gaucaguccuugcauuauc

SEQ ID NO: 625485 - RNA, 19 nt, Homo sapiens
gaaaagaaaacaccacuaa

SEQ ID NO: 625486 - RNA, 19 nt, Homo sapiens
guagugcugugauugauug

SEQ ID NO: 625487 - RNA, 19 nt, Homo sapiens
uagauuggaugguaccuuu

SEQ ID NO: 625488 - RNA, 19 nt, Homo sapiens
ccauugaagugguuaagaa

SEQ ID NO: 625489 - RNA, 19 nt, Homo sapiens
gaagagaggaggucaccaa

SEQ ID NO: 625490 - RNA, 19 nt, Homo sapiens
gcuuaacacuugaccuaaa

SEQ ID NO: 625491 - RNA, 19 nt, Homo sapiens
gauaaagcuuaacacuuga

SEQ ID NO: 625492 - RNA, 19 nt, Homo sapiens
uuaagaagauuccuaugga

SEQ ID NO: 625493 - RNA, 19 nt, Homo sapiens
gacauaauauccagacaca

SEQ ID NO: 625494 - RNA, 19 nt, Homo sapiens
uaagauaucccuaaggaau

SEQ ID NO: 625495 - RNA, 19 nt, Homo sapiens
aaacuuaaguacccuuuca

SEQ ID NO: 625496 - RNA, 19 nt, Homo sapiens
acauguagguugcuuggua

SEQ ID NO: 625497 - RNA, 19 nt, Homo sapiens
gggaguaccaaagaaauua

SEQ ID NO: 625498 - RNA, 19 nt, Homo sapiens
gaaaguagugcugugauug

SEQ ID NO: 625499 - RNA, 19 nt, Homo sapiens
gagcagauauguucaugac

SEQ ID NO: 625500 - RNA, 19 nt, Homo sapiens
gggaucaguccuugcauua

SEQ ID NO: 625501 - RNA, 19 nt, Homo sapiens
aauccagccucauaaagua

SEQ ID NO: 625502 - RNA, 19 nt, Homo sapiens
cgaaguagccguuuacaag

SEQ ID NO: 625503 - RNA, 19 nt, Homo sapiens
gaaagaagagaaugucaag

SEQ ID NO: 625504 - RNA, 19 nt, Homo sapiens
ucuaagauaucccuaagga

SEQ ID NO: 625505 - RNA, 19 nt, Homo sapiens
agugauuucuccagauuua

SEQ ID NO: 625506 - RNA, 19 nt, Homo sapiens
ggaaaacacuaaagaagau

SEQ ID NO: 625507 - RNA, 19 nt, Homo sapiens
ccagacacauacaaacuau

SEQ ID NO: 625508 - RNA, 19 nt, Homo sapiens
ucacuuuacuacucuaaga

SEQ ID NO: 625509 - RNA, 19 nt, Homo sapiens
gcaauuugguucuugaaaa

SEQ ID NO: 625510 - RNA, 19 nt, Homo sapiens
caauuggcacuaaagaaua

SEQ ID NO: 625511 - RNA, 19 nt, Homo sapiens
gauagaagccaaccacagu

SEQ ID NO: 625512 - RNA, 19 nt, Homo sapiens
ccaagaagcccagauaauc

SEQ ID NO: 625513 - RNA, 19 nt, Homo sapiens
agaaaguagugcugugauu

SEQ ID NO: 625514 - RNA, 19 nt, Homo sapiens
uaggcuagcuauuucuaaa

SEQ ID NO: 625515 - RNA, 19 nt, Homo sapiens
gaccuaaacuucuauuuuc

SEQ ID NO: 625516 - RNA, 19 nt, Homo sapiens
ggaacuuuguccuguaaca

SEQ ID NO: 625517 - RNA, 19 nt, Homo sapiens
aagagaaugucaagacgaa

SEQ ID NO: 625518 - RNA, 19 nt, Homo sapiens
cagauauguucaugacaaa

SEQ ID NO: 625519 - RNA, 19 nt, Homo sapiens
cauguagguugcuugguaa

SEQ ID NO: 625520 - RNA, 19 nt, Homo sapiens
uaaagaaacagcaggacuu

SEQ ID NO: 625521 - RNA, 19 nt, Homo sapiens
uuauacaccugaaagaaga

SEQ ID NO: 625522 - RNA, 19 nt, Homo sapiens
gaugagguccauacuucua

SEQ ID NO: 625523 - RNA, 19 nt, Homo sapiens
gagagcagauauguucaug

SEQ ID NO: 625524 - RNA, 19 nt, Homo sapiens
agauaucccuaaggaauuu

SEQ ID NO: 625525 - RNA, 19 nt, Homo sapiens
caagguuacuggauagaag

SEQ ID NO: 625526 - RNA, 19 nt, Homo sapiens
cuagccaauucacaaguua

SEQ ID NO: 625527 - RNA, 19 nt, Homo sapiens
ugguaucacugaacuacua

SEQ ID NO: 625528 - RNA, 19 nt, Homo sapiens
gugacuaaggcuuuauuua

SEQ ID NO: 625529 - RNA, 19 nt, Homo sapiens
gaagccaaccacagucuau

SEQ ID NO: 625530 - RNA, 19 nt, Homo sapiens
gaagacagacauaauaucc

SEQ ID NO: 625531 - RNA, 19 nt, Homo sapiens
gaugguaccuuuugucaau

SEQ ID NO: 625532 - RNA, 19 nt, Homo sapiens
gggacaguauuucagaaug

SEQ ID NO: 625533 - RNA, 19 nt, Homo sapiens
uauacugacuccuagaaau

SEQ ID NO: 625534 - RNA, 19 nt, Homo sapiens
ggguagaacugguaucacu

SEQ ID NO: 625535 - RNA, 19 nt, Homo sapiens
ucuagccauugauucauua

SEQ ID NO: 625536 - RNA, 19 nt, Homo sapiens
guccuugcauuaucauuga

SEQ ID NO: 625537 - RNA, 19 nt, Homo sapiens
caaaauuccuacacucuug

SEQ ID NO: 625538 - RNA, 19 nt, Homo sapiens
guagaacugguaucacuga

SEQ ID NO: 625539 - RNA, 19 nt, Homo sapiens
uagcuggucuggcgagguu

SEQ ID NO: 625540 - RNA, 19 nt, Homo sapiens
uuaaggauggaacucauua

SEQ ID NO: 625541 - RNA, 19 nt, Homo sapiens
caaaagaagucuggcuaaa

SEQ ID NO: 625542 - RNA, 19 nt, Homo sapiens
gaaacaccucacaaagaaa

SEQ ID NO: 625543 - RNA, 19 nt, Homo sapiens
gcucuaaacagugggagua

SEQ ID NO: 625544 - RNA, 19 nt, Homo sapiens
aagacgaaguagccguuua

SEQ ID NO: 625545 - RNA, 19 nt, Homo sapiens
aaagaaauaggaacaagug

SEQ ID NO: 625546 - RNA, 19 nt, Homo sapiens
ccacuaauuguguacauau

SEQ ID NO: 625547 - RNA, 19 nt, Homo sapiens
aaggguauacuaagugaua

SEQ ID NO: 625548 - RNA, 19 nt, Homo sapiens
guuacuguguuuaucuuga

SEQ ID NO: 625549 - RNA, 19 nt, Homo sapiens
uuaagaaagccucagguuu

SEQ ID NO: 625550 - RNA, 19 nt, Homo sapiens
uuaaagaugcuccuaaagu

SEQ ID NO: 625551 - RNA, 19 nt, Homo sapiens
ggaagacagacauaauauc

SEQ ID NO: 625552 - RNA, 19 nt, Homo sapiens
ggagugggacaguauuuca

SEQ ID NO: 625553 - RNA, 19 nt, Homo sapiens
uugaaguucugcauucuga

SEQ ID NO: 625554 - RNA, 19 nt, Homo sapiens
caaccacagucuauaccau

SEQ ID NO: 625555 - RNA, 19 nt, Homo sapiens
acaauuggcacuaaagaau

SEQ ID NO: 625556 - RNA, 19 nt, Homo sapiens
ggauggaacucauuauauu

SEQ ID NO: 625557 - RNA, 19 nt, Homo sapiens
ugauaaagcuuaacacuug

SEQ ID NO: 625558 - RNA, 19 nt, Homo sapiens
ggaaaucuaugcuccuaaa

SEQ ID NO: 625559 - RNA, 19 nt, Homo sapiens
gagaggaggucaccaagaa

SEQ ID NO: 625560 - RNA, 19 nt, Homo sapiens
gaagauaacuaagcaaaca

SEQ ID NO: 625561 - RNA, 19 nt, Homo sapiens
gcagauauguucaugacaa

SEQ ID NO: 625562 - RNA, 19 nt, Homo sapiens
ugaaacaccucacaaagaa

SEQ ID NO: 625563 - RNA, 19 nt, Homo sapiens
uaaagaugcuccuaaaguu

SEQ ID NO: 625564 - RNA, 19 nt, Homo sapiens
uaaguacccuuucaaacua

SEQ ID NO: 625565 - RNA, 19 nt, Homo sapiens
gaaauaggaacaagugauu

SEQ ID NO: 625566 - RNA, 19 nt, Homo sapiens
cagugaagcugaagacuuu

SEQ ID NO: 625567 - RNA, 19 nt, Homo sapiens
guagguugcuugguaauaa

SEQ ID NO: 625568 - RNA, 19 nt, Homo sapiens
cauaauauccagacacaua

SEQ ID NO: 625569 - RNA, 19 nt, Homo sapiens
caggaaacauucauucaaa

SEQ ID NO: 625570 - RNA, 19 nt, Homo sapiens
gugaaucucuucucccuuu

SEQ ID NO: 625571 - RNA, 19 nt, Homo sapiens
uaagaaagccucagguuug

SEQ ID NO: 625572 - RNA, 19 nt, Homo sapiens
gacuaaggcuuuauuuaug

SEQ ID NO: 625573 - RNA, 19 nt, Homo sapiens
gcaaacaaguuggaauuca

SEQ ID NO: 625574 - RNA, 19 nt, Homo sapiens
caagugauuucuccagauu

SEQ ID NO: 625575 - RNA, 19 nt, Homo sapiens
caagaaacaucaguaugaa

SEQ ID NO: 625576 - RNA, 19 nt, Homo sapiens
ccaagaaacaucaguauga

SEQ ID NO: 625577 - RNA, 19 nt, Homo sapiens
ggacaguauuucagaaugu

SEQ ID NO: 625578 - RNA, 19 nt, Homo sapiens
cuaaauuccuccauuguga

SEQ ID NO: 625579 - RNA, 19 nt, Homo sapiens
aaagaagucuggcuaaaca

SEQ ID NO: 625580 - RNA, 19 nt, Homo sapiens
ccaaguugaugcucuuaaa

SEQ ID NO: 625581 - RNA, 19 nt, Homo sapiens
acaaucaucuccuggcuaa

SEQ ID NO: 625582 - RNA, 19 nt, Homo sapiens
cagaugagguccauacuuc

SEQ ID NO: 625583 - RNA, 19 nt, Homo sapiens
uaaaggguauacuaaguga

SEQ ID NO: 625584 - RNA, 19 nt, Homo sapiens
gaacugguaucacugaacu

SEQ ID NO: 625585 - RNA, 19 nt, Homo sapiens
gaucaguccuugcauuauc

SEQ ID NO: 625586 - RNA, 19 nt, Homo sapiens
gaaaagaaaacaccacuaa

SEQ ID NO: 625587 - RNA, 19 nt, Homo sapiens
guagugcugugauugauug

SEQ ID NO: 625588 - RNA, 19 nt, Homo sapiens
uagauuggaugguaccuuu

SEQ ID NO: 625589 - RNA, 19 nt, Homo sapiens
ccauugaagugguuaagaa

SEQ ID NO: 625590 - RNA, 19 nt, Homo sapiens
gaagagaggaggucaccaa

SEQ ID NO: 625591 - RNA, 19 nt, Homo sapiens
gcuuaacacuugaccuaaa

SEQ ID NO: 625592 - RNA, 19 nt, Homo sapiens
gauaaagcuuaacacuuga

SEQ ID NO: 625593 - RNA, 19 nt, Homo sapiens
uuaagaagauuccuaugga

SEQ ID NO: 625594 - RNA, 19 nt, Homo sapiens
gacauaauauccagacaca

SEQ ID NO: 625595 - RNA, 19 nt, Homo sapiens
uaagauaucccuaaggaau

SEQ ID NO: 625596 - RNA, 19 nt, Homo sapiens
aaacuuaaguacccuuuca

SEQ ID NO: 625597 - RNA, 19 nt, Homo sapiens
acauguagguugcuuggua

SEQ ID NO: 625598 - RNA, 19 nt, Homo sapiens
gggaguaccaaagaaauua

SEQ ID NO: 625599 - RNA, 19 nt, Homo sapiens
gaaaguagugcugugauug

SEQ ID NO: 625600 - RNA, 19 nt, Homo sapiens
gagcagauauguucaugac

SEQ ID NO: 625601 - RNA, 19 nt, Homo sapiens
gggaucaguccuugcauua

SEQ ID NO: 625602 - RNA, 19 nt, Homo sapiens
aauccagccucauaaagua

SEQ ID NO: 625603 - RNA, 19 nt, Homo sapiens
gaaagaagagaaugucaag

SEQ ID NO: 625604 - RNA, 19 nt, Homo sapiens
cgaaguagccguuuacaag

SEQ ID NO: 625605 - RNA, 19 nt, Homo sapiens
ucuaagauaucccuaagga

SEQ ID NO: 625606 - RNA, 19 nt, Homo sapiens
agugauuucuccagauuua

SEQ ID NO: 625607 - RNA, 19 nt, Homo sapiens
ggaaaacacuaaagaagau

SEQ ID NO: 625608 - RNA, 19 nt, Homo sapiens
ccagacacauacaaacuau

SEQ ID NO: 625609 - RNA, 19 nt, Homo sapiens
ucacuuuacuacucuaaga

SEQ ID NO: 625610 - RNA, 19 nt, Homo sapiens
gcaauuugguucuugaaaa

SEQ ID NO: 625611 - RNA, 19 nt, Homo sapiens
caauuggcacuaaagaaua

SEQ ID NO: 625612 - RNA, 19 nt, Homo sapiens
ccaagaagcccagauaauc

SEQ ID NO: 625613 - RNA, 19 nt, Homo sapiens
gauagaagccaaccacagu

SEQ ID NO: 625614 - RNA, 19 nt, Homo sapiens
cauuggaauuaccucauua

SEQ ID NO: 625615 - RNA, 19 nt, Homo sapiens
agaaaguagugcugugauu

SEQ ID NO: 625616 - RNA, 19 nt, Homo sapiens
uaggcuagcuauuucuaaa

SEQ ID NO: 625617 - RNA, 19 nt, Homo sapiens
gaccuaaacuucuauuuuc

SEQ ID NO: 625618 - RNA, 19 nt, Homo sapiens
aagagaaugucaagacgaa

SEQ ID NO: 625619 - RNA, 19 nt, Homo sapiens
ggaacuuuguccuguaaca

SEQ ID NO: 625620 - RNA, 19 nt, Homo sapiens
cagauauguucaugacaaa

SEQ ID NO: 625621 - RNA, 19 nt, Homo sapiens
cauguagguugcuugguaa

SEQ ID NO: 625622 - RNA, 19 nt, Homo sapiens
uaaagaaacagcaggacuu

SEQ ID NO: 625623 - RNA, 19 nt, Homo sapiens
uuauacaccugaaagaaga

SEQ ID NO: 625624 - RNA, 19 nt, Homo sapiens
gaugagguccauacuucua

SEQ ID NO: 625625 - RNA, 19 nt, Homo sapiens
gagagcagauauguucaug

SEQ ID NO: 625626 - RNA, 19 nt, Homo sapiens
agauaucccuaaggaauuu

SEQ ID NO: 625627 - RNA, 19 nt, Homo sapiens
caagguuacuggauagaag

SEQ ID NO: 625628 - RNA, 19 nt, Homo sapiens
cuagccaauucacaaguua

SEQ ID NO: 625629 - RNA, 19 nt, Homo sapiens
ugguaucacugaacuacua

SEQ ID NO: 625630 - RNA, 19 nt, Homo sapiens
gugacuaaggcuuuauuua

SEQ ID NO: 625631 - RNA, 19 nt, Homo sapiens
gaagccaaccacagucuau

SEQ ID NO: 625632 - RNA, 19 nt, Homo sapiens
gaagacagacauaauaucc

SEQ ID NO: 625633 - RNA, 19 nt, Homo sapiens
gaugguaccuuuugucaau

SEQ ID NO: 625634 - RNA, 19 nt, Homo sapiens
gggacaguauuucagaaug

SEQ ID NO: 625635 - RNA, 19 nt, Homo sapiens
ucauuggaauuaccucauu

SEQ ID NO: 625636 - RNA, 19 nt, Homo sapiens
uauacugacuccuagaaau

SEQ ID NO: 625637 - RNA, 19 nt, Homo sapiens
ggguagaacugguaucacu

SEQ ID NO: 625638 - RNA, 19 nt, Homo sapiens
ucuagccauugauucauua

SEQ ID NO: 625639 - RNA, 19 nt, Homo sapiens
guccuugcauuaucauuga

SEQ ID NO: 625640 - RNA, 19 nt, Homo sapiens
caaaauuccuacacucuug

SEQ ID NO: 625641 - RNA, 19 nt, Homo sapiens
guagaacugguaucacuga

SEQ ID NO: 625642 - RNA, 19 nt, Homo sapiens
uagcuggucuggcgagguu

SEQ ID NO: 625643 - RNA, 19 nt, Homo sapiens
uuaaggauggaacucauua

SEQ ID NO: 625644 - RNA, 19 nt, Homo sapiens
caaaagaagucuggcuaaa

SEQ ID NO: 625645 - RNA, 19 nt, Homo sapiens
gaaacaccucacaaagaaa

SEQ ID NO: 625646 - RNA, 19 nt, Homo sapiens
aagacgaaguagccguuua

SEQ ID NO: 625647 - RNA, 19 nt, Homo sapiens
gcucuaaacagugggagua

SEQ ID NO: 625648 - RNA, 19 nt, Homo sapiens
cuucaacucauuggaauua

SEQ ID NO: 625649 - RNA, 19 nt, Homo sapiens
aaagaaauaggaacaagug

SEQ ID NO: 625650 - RNA, 19 nt, Homo sapiens
ccacuaauuguguacauau

SEQ ID NO: 625651 - RNA, 19 nt, Homo sapiens
aaggguauacuaagugaua

SEQ ID NO: 625652 - RNA, 19 nt, Homo sapiens
guuacuguguuuaucuuga

SEQ ID NO: 625653 - RNA, 19 nt, Homo sapiens
uuaagaaagccucagguuu

SEQ ID NO: 625654 - RNA, 19 nt, Homo sapiens
uuaaagaugcuccuaaagu

SEQ ID NO: 625655 - RNA, 19 nt, Homo sapiens
ggaagacagacauaauauc

SEQ ID NO: 625656 - RNA, 19 nt, Homo sapiens
gcaagaagcuauagaugaa

SEQ ID NO: 625657 - RNA, 19 nt, Homo sapiens
caacaaagacucaauaaga

SEQ ID NO: 625658 - RNA, 19 nt, Homo sapiens
gaacaacaaagacucaaua

SEQ ID NO: 625659 - RNA, 19 nt, Homo sapiens
gaacagcuccgacaaguug

SEQ ID NO: 625660 - RNA, 19 nt, Homo sapiens
gcagagauggagaauauua

SEQ ID NO: 625661 - RNA, 19 nt, Homo sapiens
ccaaguggguuuauguuaa

SEQ ID NO: 625662 - RNA, 19 nt, Homo sapiens
gacagaggcugaagacaaa

SEQ ID NO: 625663 - RNA, 19 nt, Homo sapiens
aaagagaagucacaacaaa

SEQ ID NO: 625664 - RNA, 19 nt, Homo sapiens
gagaagacaaugaaagaua

SEQ ID NO: 625665 - RNA, 19 nt, Homo sapiens
gaagaaagaucaggaggau

SEQ ID NO: 625666 - RNA, 19 nt, Homo sapiens
gcaagcuaaugaccaguua

SEQ ID NO: 625667 - RNA, 19 nt, Homo sapiens
ggaaagaauugcaugaagu

SEQ ID NO: 625668 - RNA, 19 nt, Homo sapiens
gaagagcaguuaaagaaag

SEQ ID NO: 625669 - RNA, 19 nt, Homo sapiens
aagcagagauggagaauau

SEQ ID NO: 625670 - RNA, 19 nt, Homo sapiens
gaaggccaaugaccaguuu

SEQ ID NO: 625671 - RNA, 19 nt, Homo sapiens
gagcaccaguuccaccuua

SEQ ID NO: 625672 - RNA, 19 nt, Homo sapiens
gagauuacagacagaauua

SEQ ID NO: 625673 - RNA, 19 nt, Homo sapiens
gaaagagacugcugcuaag

SEQ ID NO: 625674 - RNA, 19 nt, Homo sapiens
ugaagaaacucugcaacua

SEQ ID NO: 625675 - RNA, 19 nt, Homo sapiens
ccaagaggaugcugagaaa

SEQ ID NO: 625676 - RNA, 19 nt, Homo sapiens
uaacucaucuuuagagcaa

SEQ ID NO: 625677 - RNA, 19 nt, Homo sapiens
ggagauccuuucaguaaau

SEQ ID NO: 625678 - RNA, 19 nt, Homo sapiens
gaaagaauugcaugaaguu

SEQ ID NO: 625679 - RNA, 19 nt, Homo sapiens
gaacacagugggcacagua

SEQ ID NO: 625680 - RNA, 19 nt, Homo sapiens
ggaguuauauuuggcuaaa

SEQ ID NO: 625681 - RNA, 19 nt, Homo sapiens
gcugagaaaucuuguagga

SEQ ID NO: 625682 - RNA, 19 nt, Homo sapiens
uugaagaacugaagaagaa

SEQ ID NO: 625683 - RNA, 19 nt, Homo sapiens
aaagagggauguucaggaa

SEQ ID NO: 625684 - RNA, 19 nt, Homo sapiens
gcagaaagagguacauaau

SEQ ID NO: 625685 - RNA, 19 nt, Homo sapiens
acaggaagaugcugagaaa

SEQ ID NO: 625686 - RNA, 19 nt, Homo sapiens
gaaacagaauggaaucucu

SEQ ID NO: 625687 - RNA, 19 nt, Homo sapiens
ggaggaugaugaacaacaa

SEQ ID NO: 625688 - RNA, 19 nt, Homo sapiens
agaaagagacugcugcuaa

SEQ ID NO: 625689 - RNA, 19 nt, Homo sapiens
ggaaauaaagaucaguuug

SEQ ID NO: 625690 - RNA, 19 nt, Homo sapiens
gaagaaacucugcaacuag

SEQ ID NO: 625691 - RNA, 19 nt, Homo sapiens
gaaauaaagaucaguuugg

SEQ ID NO: 625692 - RNA, 19 nt, Homo sapiens
guacauaaugcuggaaaua

SEQ ID NO: 625693 - RNA, 19 nt, Homo sapiens
agaaacaguucgugacuau

SEQ ID NO: 625694 - RNA, 19 nt, Homo sapiens
gaauggagauugugcuaac

SEQ ID NO: 625695 - RNA, 19 nt, Homo sapiens
gaggcaaaaugcaguauua

SEQ ID NO: 625696 - RNA, 19 nt, Homo sapiens
gaaagagaagucacaacaa

SEQ ID NO: 625697 - RNA, 19 nt, Homo sapiens
gcugaaggcugagauacuu

SEQ ID NO: 625698 - RNA, 19 nt, Homo sapiens
caacaacacaaccaguuaa

SEQ ID NO: 625699 - RNA, 19 nt, Homo sapiens
ggaagaugcugagaaacug

SEQ ID NO: 625700 - RNA, 19 nt, Homo sapiens
ggaagagcaguuaaagaaa

SEQ ID NO: 625701 - RNA, 19 nt, Homo sapiens
ccaaagcuuuaggcuauaa

SEQ ID NO: 625702 - RNA, 19 nt, Homo sapiens
ugugauauguguuccaauu

SEQ ID NO: 625703 - RNA, 19 nt, Homo sapiens
agaaagagguacauaaugc

SEQ ID NO: 625704 - RNA, 19 nt, Homo sapiens
uaagagaaaggaucacaaa

SEQ ID NO: 625705 - RNA, 19 nt, Homo sapiens
aagcagauguugaggaaga

SEQ ID NO: 625706 - RNA, 19 nt, Homo sapiens
agaaagaucaggaggauga

SEQ ID NO: 625707 - RNA, 19 nt, Homo sapiens
uggaagagcaguuaaagaa

SEQ ID NO: 625708 - RNA, 19 nt, Homo sapiens
gaugacaccagaacaagaa

SEQ ID NO: 625709 - RNA, 19 nt, Homo sapiens
aaacuucgguccguuguga

SEQ ID NO: 625710 - RNA, 19 nt, Homo sapiens
aaggaagacuggagaaaug

SEQ ID NO: 625711 - RNA, 19 nt, Homo sapiens
gaaacucugcaacuagaaa

SEQ ID NO: 625712 - RNA, 19 nt, Homo sapiens
aauggaaucucuugcagaa

SEQ ID NO: 625713 - RNA, 19 nt, Homo sapiens
ucaggaggaugaugaacaa

SEQ ID NO: 625714 - RNA, 19 nt, Homo sapiens
cuggaggccucaaagguua

SEQ ID NO: 625715 - RNA, 19 nt, Homo sapiens
aagaaacucugcaacuaga

SEQ ID NO: 625716 - RNA, 19 nt, Homo sapiens
ggagagcacagucuacaga

SEQ ID NO: 625717 - RNA, 19 nt, Homo sapiens
uggcucaguucauuccuua

SEQ ID NO: 625718 - RNA, 19 nt, Homo sapiens
ccucaaagguuaaagaacu

SEQ ID NO: 625719 - RNA, 19 nt, Homo sapiens
ggaaauugcagcuuugaag

SEQ ID NO: 625720 - RNA, 19 nt, Homo sapiens
gaaugauacuaaacugaca

SEQ ID NO: 625721 - RNA, 19 nt, Homo sapiens
acagaaagauaaugacagu

SEQ ID NO: 625722 - RNA, 19 nt, Homo sapiens
ugacagaggcugaagacaa

SEQ ID NO: 625723 - RNA, 19 nt, Homo sapiens
aaacaguucgugacuauga

SEQ ID NO: 625724 - RNA, 19 nt, Homo sapiens
gauccaagcagaacagugu

SEQ ID NO: 625725 - RNA, 19 nt, Homo sapiens
ccaguagugugugcuuuaa

SEQ ID NO: 625726 - RNA, 19 nt, Homo sapiens
gaacugaagaagaaagauc

SEQ ID NO: 625727 - RNA, 19 nt, Homo sapiens
ucuggaaucucagcguuua

SEQ ID NO: 625728 - RNA, 19 nt, Homo sapiens
aaccaaagaucaggaaaga

SEQ ID NO: 625729 - RNA, 19 nt, Homo sapiens
ugagagacaugcagcgaau

SEQ ID NO: 625730 - RNA, 19 nt, Homo sapiens
gagaaacugcggaaagaau

SEQ ID NO: 625731 - RNA, 19 nt, Homo sapiens
gagcaaaauuuaaggaguu

SEQ ID NO: 625732 - RNA, 19 nt, Homo sapiens
gacagcagcagaccacgua

SEQ ID NO: 625733 - RNA, 19 nt, Homo sapiens
ccuccgagaucuuacuuga

SEQ ID NO: 625734 - RNA, 19 nt, Homo sapiens
gccaaguggguuuauguua

SEQ ID NO: 625735 - RNA, 19 nt, Homo sapiens
ggacaaugacauguuuaaa

SEQ ID NO: 625736 - RNA, 19 nt, Homo sapiens
gaaacugcggaaagaauug

SEQ ID NO: 625737 - RNA, 19 nt, Homo sapiens
gaagaaagagaagucacaa

SEQ ID NO: 625738 - RNA, 19 nt, Homo sapiens
gacaaugacauguuuaaag

SEQ ID NO: 625739 - RNA, 19 nt, Homo sapiens
caaagacucaauaagagaa

SEQ ID NO: 625740 - RNA, 19 nt, Homo sapiens
cagaacagcuccgacaagu

SEQ ID NO: 625741 - RNA, 19 nt, Homo sapiens
guauguagcuguuuugaau

SEQ ID NO: 625742 - RNA, 19 nt, Homo sapiens
cagccugcaugugucauua

SEQ ID NO: 625743 - RNA, 19 nt, Homo sapiens
gaaagcacagccugcaugu

SEQ ID NO: 625744 - RNA, 19 nt, Homo sapiens
aaacuacagcugaugcuaa

SEQ ID NO: 625745 - RNA, 19 nt, Homo sapiens
cuggagauccuuucaguaa

SEQ ID NO: 625746 - RNA, 19 nt, Homo sapiens
auacuaaacugacagacau

SEQ ID NO: 625747 - RNA, 19 nt, Homo sapiens
cagcagaccacguagaaga

SEQ ID NO: 625748 - RNA, 19 nt, Homo sapiens
uagagaagacaaugaaaga

SEQ ID NO: 625749 - RNA, 19 nt, Homo sapiens
ugacguuucucuucagcaa

SEQ ID NO: 625750 - RNA, 19 nt, Homo sapiens
gguagacguugugauaugu

SEQ ID NO: 625751 - RNA, 19 nt, Homo sapiens
ggaaauaaacuugguagac

SEQ ID NO: 625752 - RNA, 19 nt, Homo sapiens
gcauggagagugccuaugu

SEQ ID NO: 625753 - RNA, 19 nt, Homo sapiens
auccaaagcuuuaggcuau

SEQ ID NO: 625754 - RNA, 19 nt, Homo sapiens
gaagaggagcauuuagaca

SEQ ID NO: 625755 - RNA, 19 nt, Homo sapiens
gacaacaacacaaccaguu

SEQ ID NO: 625756 - RNA, 19 nt, Homo sapiens
ggaggaaacugcacaggaa

SEQ ID NO: 625757 - RNA, 19 nt, Homo sapiens
gagcagcccuucuggauau

SEQ ID NO: 625758 - RNA, 19 nt, Homo sapiens
ggacggaagcugcauguga

SEQ ID NO: 625759 - RNA, 19 nt, Homo sapiens
gcauccaccuaaucaauga

SEQ ID NO: 625760 - RNA, 19 nt, Homo sapiens
gcagcaagcucauucucau

SEQ ID NO: 625761 - RNA, 19 nt, Homo sapiens
gcaagcucauucucauuug

SEQ ID NO: 625762 - RNA, 19 nt, Homo sapiens
gccaaagacugcagcauca

SEQ ID NO: 625763 - RNA, 19 nt, Homo sapiens
caucuucucugcugccaaa

SEQ ID NO: 625764 - RNA, 19 nt, Homo sapiens
caaagaggcucggaauucu

SEQ ID NO: 625765 - RNA, 19 nt, Homo sapiens
acucuuauccuccuuauuu

SEQ ID NO: 625766 - RNA, 19 nt, Homo sapiens
gacggaagcugcaugugau

SEQ ID NO: 625767 - RNA, 19 nt, Homo sapiens
aaagacugcagcaucauua

SEQ ID NO: 625768 - RNA, 19 nt, Homo sapiens
ggagcagcccuucuggaua

SEQ ID NO: 625769 - RNA, 19 nt, Homo sapiens
ucaaagaggcucggaauuc

SEQ ID NO: 625770 - RNA, 19 nt, Homo sapiens
gaaggaggaugugcuugag

SEQ ID NO: 625771 - RNA, 19 nt, Homo sapiens
caagaugaaugaggagauc

SEQ ID NO: 625772 - RNA, 19 nt, Homo sapiens
caaagacugcagcaucauu

SEQ ID NO: 625773 - RNA, 19 nt, Homo sapiens
ggaauucugucugcaucau

SEQ ID NO: 625774 - RNA, 19 nt, Homo sapiens
ggacuguacguguguggaa

SEQ ID NO: 625775 - RNA, 19 nt, Homo sapiens
ugaaggaggaugugcuuga

SEQ ID NO: 625776 - RNA, 19 nt, Homo sapiens
ggccgaugguggagaauca

SEQ ID NO: 625777 - RNA, 19 nt, Homo sapiens
agucccagcuugucuucua

SEQ ID NO: 625778 - RNA, 19 nt, Homo sapiens
caccagcucucuaucacau

SEQ ID NO: 625779 - RNA, 19 nt, Homo sapiens
ccagcucucuaucacaugu

SEQ ID NO: 625780 - RNA, 19 nt, Homo sapiens
gaggaaacugcacaggaaa

SEQ ID NO: 625781 - RNA, 19 nt, Homo sapiens
gaugguggagaaucaaaga

SEQ ID NO: 625782 - RNA, 19 nt, Homo sapiens
uguggaauguggcagagaa

SEQ ID NO: 625783 - RNA, 19 nt, Homo sapiens
gcacuuguacaccuucaca

SEQ ID NO: 625784 - RNA, 19 nt, Homo sapiens
gcaagaugaaugaggagau

SEQ ID NO: 625785 - RNA, 19 nt, Homo sapiens
aggaggagcuggaggaaac

SEQ ID NO: 625786 - RNA, 19 nt, Homo sapiens
ugcagaaguugguggcaaa

SEQ ID NO: 625787 - RNA, 19 nt, Homo sapiens
uaucaacagccucaaguuc

SEQ ID NO: 625788 - RNA, 19 nt, Homo sapiens
gggcaccagcucucuauca

SEQ ID NO: 625789 - RNA, 19 nt, Homo sapiens
cucuuauccuccuuauuua

SEQ ID NO: 625790 - RNA, 19 nt, Homo sapiens
caagcucauucucauuugg

SEQ ID NO: 625791 - RNA, 19 nt, Homo sapiens
ggcugaggcccgugcauuu

SEQ ID NO: 625792 - RNA, 19 nt, Homo sapiens
ucaacagccucaaguucuc

SEQ ID NO: 625793 - RNA, 19 nt, Homo sapiens
ugacucagccaucuucucu

SEQ ID NO: 625794 - RNA, 19 nt, Homo sapiens
gcugaggcccgugcauuug

SEQ ID NO: 625795 - RNA, 19 nt, Homo sapiens
gcugguuccugacacucuu

SEQ ID NO: 625796 - RNA, 19 nt, Homo sapiens
gaccgcagcaagcucauuc

SEQ ID NO: 625797 - RNA, 19 nt, Homo sapiens
gaagggugccgagggaaag

SEQ ID NO: 625798 - RNA, 19 nt, Homo sapiens
aaucaaagaggcucggaau

SEQ ID NO: 625799 - RNA, 19 nt, Homo sapiens
agcuugaccuucucuguga

SEQ ID NO: 625800 - RNA, 19 nt, Homo sapiens
caaggguggcggcaagaug

SEQ ID NO: 625801 - RNA, 19 nt, Homo sapiens
gacacucuuauccuccuua

SEQ ID NO: 625802 - RNA, 19 nt, Homo sapiens
gcagcuugaccuucucugu

SEQ ID NO: 625803 - RNA, 19 nt, Homo sapiens
ccgugaagguguggaaugu

SEQ ID NO: 625804 - RNA, 19 nt, Homo sapiens
caccagcucuacagcacau

SEQ ID NO: 625805 - RNA, 19 nt, Homo sapiens
agcaagcucauucucauuu

SEQ ID NO: 625806 - RNA, 19 nt, Homo sapiens
cagcaagcucauucucauu

SEQ ID NO: 625807 - RNA, 19 nt, Homo sapiens
cgacugcauccaccuaauc

SEQ ID NO: 625808 - RNA, 19 nt, Homo sapiens
gccagcacuuguacaccuu

SEQ ID NO: 625809 - RNA, 19 nt, Homo sapiens
gacugcagcaucauuaagu

SEQ ID NO: 625810 - RNA, 19 nt, Homo sapiens
acacucuuauccuccuuau

SEQ ID NO: 625811 - RNA, 19 nt, Homo sapiens
ggaggaggagcuggaggaa

SEQ ID NO: 625812 - RNA, 19 nt, Homo sapiens
ucaaugaggagcacauggu

SEQ ID NO: 625813 - RNA, 19 nt, Homo sapiens
gaggaggagcuggaggaaa

SEQ ID NO: 625814 - RNA, 19 nt, Homo sapiens
cuacagcacaucccacgau

SEQ ID NO: 625815 - RNA, 19 nt, Homo sapiens
ggaauguggcagagaacuc

SEQ ID NO: 625816 - RNA, 19 nt, Homo sapiens
gcaccagcucucuaucaca

SEQ ID NO: 625817 - RNA, 19 nt, Homo sapiens
ucagcugacauucgcguuu

SEQ ID NO: 625818 - RNA, 19 nt, Homo sapiens
gaugggacuguacgugugu

SEQ ID NO: 625819 - RNA, 19 nt, Homo sapiens
gcuccugugugcggcuuug

SEQ ID NO: 625820 - RNA, 19 nt, Homo sapiens
cagcccuccucaacacaga

SEQ ID NO: 625821 - RNA, 19 nt, Homo sapiens
gacugcauccaccuaauca

SEQ ID NO: 625822 - RNA, 19 nt, Homo sapiens
agaaguugguggcaaaaga

SEQ ID NO: 625823 - RNA, 19 nt, Homo sapiens
ggagucccagcuugucuuc

SEQ ID NO: 625824 - RNA, 19 nt, Homo sapiens
gcagcuccgucagcaagag

SEQ ID NO: 625825 - RNA, 19 nt, Homo sapiens
aaggguggcggcaagauga

SEQ ID NO: 625826 - RNA, 19 nt, Homo sapiens
ggaaagugcugucccugaa

SEQ ID NO: 625827 - RNA, 19 nt, Homo sapiens
agaacgagcuggagacaaa

SEQ ID NO: 625828 - RNA, 19 nt, Homo sapiens
ugaagcagcuggaggaguu

SEQ ID NO: 625829 - RNA, 19 nt, Homo sapiens
caacgucgccuuugaacuu

SEQ ID NO: 625830 - RNA, 19 nt, Homo sapiens
gcacguggcccugcaguuu

SEQ ID NO: 625831 - RNA, 19 nt, Homo sapiens
ggugugcucucaucacuga

SEQ ID NO: 625832 - RNA, 19 nt, Homo sapiens
ugaauuggaggguuuauuu

SEQ ID NO: 625833 - RNA, 19 nt, Homo sapiens
ggacaucaccaagaagaaa

SEQ ID NO: 625834 - RNA, 19 nt, Homo sapiens
ccagggagauggaagacuu

SEQ ID NO: 625835 - RNA, 19 nt, Homo sapiens
ggucgggacuggagcuuga

SEQ ID NO: 625836 - RNA, 19 nt, Homo sapiens
gggcugaggaugaggauuu

SEQ ID NO: 625837 - RNA, 19 nt, Homo sapiens
ggaccaggaggcccagaua

SEQ ID NO: 625838 - RNA, 19 nt, Homo sapiens
ccacagaacgggagaaagu

SEQ ID NO: 625839 - RNA, 19 nt, Homo sapiens
ggaguuggaggaggaauuu

SEQ ID NO: 625840 - RNA, 19 nt, Homo sapiens
ugacguggcgggugacuaa

SEQ ID NO: 625841 - RNA, 19 nt, Homo sapiens
uggaggagcugcagaacau

SEQ ID NO: 625842 - RNA, 19 nt, Homo sapiens
caaugagccuggaguccuu

SEQ ID NO: 625843 - RNA, 19 nt, Homo sapiens
gaccaagaguggagacaag

SEQ ID NO: 625844 - RNA, 19 nt, Homo sapiens
ccaagugccuucgcucugu

SEQ ID NO: 625845 - RNA, 19 nt, Homo sapiens
aaacuggugugcucucauc

SEQ ID NO: 625846 - RNA, 19 nt, Homo sapiens
caaggacccucgguucugu

SEQ ID NO: 625847 - RNA, 19 nt, Homo sapiens
ccgagagaauccucaguga

SEQ ID NO: 625848 - RNA, 19 nt, Homo sapiens
gcgagcugcuggugacaga

SEQ ID NO: 625849 - RNA, 19 nt, Homo sapiens
gcaagaaggagaggaaugg

SEQ ID NO: 625850 - RNA, 19 nt, Homo sapiens
ucccauagccggacacuga

SEQ ID NO: 625851 - RNA, 19 nt, Homo sapiens
cgaggugcauucccuguuc

SEQ ID NO: 625852 - RNA, 19 nt, Homo sapiens
ggagacaaacucagaagag

SEQ ID NO: 625853 - RNA, 19 nt, Homo sapiens
ccacggcccuucggaaagu

SEQ ID NO: 625854 - RNA, 19 nt, Homo sapiens
uggaggagaugcaacauac

SEQ ID NO: 625855 - RNA, 19 nt, Homo sapiens
ucaagaaccuggacaucac

SEQ ID NO: 625856 - RNA, 19 nt, Homo sapiens
uaccaucucuaccgacgaa

SEQ ID NO: 625857 - RNA, 19 nt, Homo sapiens
gacaaacucagaagagcaa

SEQ ID NO: 625858 - RNA, 19 nt, Homo sapiens
caagugccuucgcucuguu

SEQ ID NO: 625859 - RNA, 19 nt, Homo sapiens
aggagaaccugcucagcuu

SEQ ID NO: 625860 - RNA, 19 nt, Homo sapiens
cccaggaaauccaggagaa

SEQ ID NO: 625861 - RNA, 19 nt, Homo sapiens
gcagagcagcgacccuaug

SEQ ID NO: 625862 - RNA, 19 nt, Homo sapiens
gcaaggacccucgguucug

SEQ ID NO: 625863 - RNA, 19 nt, Homo sapiens
ggagaguggcuaccucauc

SEQ ID NO: 625864 - RNA, 19 nt, Homo sapiens
guuccucgaucgccugaug

SEQ ID NO: 625865 - RNA, 19 nt, Homo sapiens
ggacucagggcuccauucu

SEQ ID NO: 625866 - RNA, 19 nt, Homo sapiens
gccagucauuugccuuaga

SEQ ID NO: 625867 - RNA, 19 nt, Homo sapiens
cacuagggcugaccucauc

SEQ ID NO: 625868 - RNA, 19 nt, Homo sapiens
acacagaagagcccacaga

SEQ ID NO: 625869 - RNA, 19 nt, Homo sapiens
gcacuagggcugaccucau

SEQ ID NO: 625870 - RNA, 19 nt, Homo sapiens
gaaagugcugucccugaag

SEQ ID NO: 625871 - RNA, 19 nt, Homo sapiens
gcaucgggcagaacacaga

SEQ ID NO: 625872 - RNA, 19 nt, Homo sapiens
ggaccaagaguggagacaa

SEQ ID NO: 625873 - RNA, 19 nt, Homo sapiens
gcaugagccucggccaucu

SEQ ID NO: 625874 - RNA, 19 nt, Homo sapiens
gaccaggaggcccagauau

SEQ ID NO: 625875 - RNA, 19 nt, Homo sapiens
ccagucauuugccuuagag

SEQ ID NO: 625876 - RNA, 19 nt, Homo sapiens
ggacaccccuggagucucu

SEQ ID NO: 625877 - RNA, 19 nt, Homo sapiens
ucaugcaccuggaggagau

SEQ ID NO: 625878 - RNA, 19 nt, Homo sapiens
accaggaggcccagauaua

SEQ ID NO: 625879 - RNA, 19 nt, Homo sapiens
cugcacagccugcccaaga

SEQ ID NO: 625880 - RNA, 19 nt, Homo sapiens
gaggagaugcaacauacca

SEQ ID NO: 625881 - RNA, 19 nt, Homo sapiens
gacaucaccaagaagaaau

SEQ ID NO: 625882 - RNA, 19 nt, Homo sapiens
cacagaagagcccacagaa

SEQ ID NO: 625883 - RNA, 19 nt, Homo sapiens
ccgccagucauuugccuua

SEQ ID NO: 625884 - RNA, 19 nt, Homo sapiens
ccaagaguggagacaagaa

SEQ ID NO: 625885 - RNA, 19 nt, Homo sapiens
gaauuggaggguuuauuuu

SEQ ID NO: 625886 - RNA, 19 nt, Homo sapiens
ggaaggccuuuugcaagaa

SEQ ID NO: 625887 - RNA, 19 nt, Homo sapiens
ccaggaggcccagauauac

SEQ ID NO: 625888 - RNA, 19 nt, Homo sapiens
gugcugagggcuccugguu

SEQ ID NO: 625889 - RNA, 19 nt, Homo sapiens
cagcacggacccaggaaau

SEQ ID NO: 625890 - RNA, 19 nt, Homo sapiens
gcuuggaggagaccaugaa

SEQ ID NO: 625891 - RNA, 19 nt, Homo sapiens
gagcaucgggcagaacaca

SEQ ID NO: 625892 - RNA, 19 nt, Homo sapiens
caagaguggagacaagaag

SEQ ID NO: 625893 - RNA, 19 nt, Homo sapiens
caucucuaccgacgaagaa

SEQ ID NO: 625894 - RNA, 19 nt, Homo sapiens
gccugcagcugaaggacau

SEQ ID NO: 625895 - RNA, 19 nt, Homo sapiens
gcacggacccaggaaaucc

SEQ ID NO: 625896 - RNA, 19 nt, Homo sapiens
cguggcgggugacuaagga

SEQ ID NO: 625897 - RNA, 19 nt, Homo sapiens
cgagugcugccgggaaauu

SEQ ID NO: 625898 - RNA, 19 nt, Homo sapiens
uggaggagaccaugaagca

SEQ ID NO: 625899 - RNA, 19 nt, Homo sapiens
ggaauaagcuugaaagaaa

SEQ ID NO: 625900 - RNA, 19 nt, Homo sapiens
gugaagagcuggucuguuu

SEQ ID NO: 625901 - RNA, 19 nt, Homo sapiens
gaaggugacucaagaaguu

SEQ ID NO: 625902 - RNA, 19 nt, Homo sapiens
ggaaucagaucgugaagaa

SEQ ID NO: 625903 - RNA, 19 nt, Homo sapiens
gaacugaacuagaaacaag

SEQ ID NO: 625904 - RNA, 19 nt, Homo sapiens
gggaaaagcugaucaauuu

SEQ ID NO: 625905 - RNA, 19 nt, Homo sapiens
gaaaguugguccugagaaa

SEQ ID NO: 625906 - RNA, 19 nt, Homo sapiens
caacuaguaucgucaaauu

SEQ ID NO: 625907 - RNA, 19 nt, Homo sapiens
ggaaugggcugaugaaugg

SEQ ID NO: 625908 - RNA, 19 nt, Homo sapiens
ucagaaaccuagaaacuaa

SEQ ID NO: 625909 - RNA, 19 nt, Homo sapiens
ccacagagauucagcaaug

SEQ ID NO: 625910 - RNA, 19 nt, Homo sapiens
gaucaucguuugacagaaa

SEQ ID NO: 625911 - RNA, 19 nt, Homo sapiens
uaacguggcuuuccaacuu

SEQ ID NO: 625912 - RNA, 19 nt, Homo sapiens
uacaacagcuuacuaguuu

SEQ ID NO: 625913 - RNA, 19 nt, Homo sapiens
gcaaggcaauggaaaguug

SEQ ID NO: 625914 - RNA, 19 nt, Homo sapiens
agaagucacuguugcaaua

SEQ ID NO: 625915 - RNA, 19 nt, Homo sapiens
guccaagccugaauaauaa

SEQ ID NO: 625916 - RNA, 19 nt, Homo sapiens
gcuaaagaaucuggaauaa

SEQ ID NO: 625917 - RNA, 19 nt, Homo sapiens
ugagagagcugacacaugu

SEQ ID NO: 625918 - RNA, 19 nt, Homo sapiens
gaccaaagaugccagaugu

SEQ ID NO: 625919 - RNA, 19 nt, Homo sapiens
caaccuugcuggcuacuuu

SEQ ID NO: 625920 - RNA, 19 nt, Homo sapiens
gcaaaacucugucucaaaa

SEQ ID NO: 625921 - RNA, 19 nt, Homo sapiens
ccaagaagccacaaacuuu

SEQ ID NO: 625922 - RNA, 19 nt, Homo sapiens
ggagagaagagaauaguuu

SEQ ID NO: 625923 - RNA, 19 nt, Homo sapiens
cagaagaagcugugaauaa

SEQ ID NO: 625924 - RNA, 19 nt, Homo sapiens
caaaccuucugcuguguua

SEQ ID NO: 625925 - RNA, 19 nt, Homo sapiens
uaaagaaucuggaauaagc

SEQ ID NO: 625926 - RNA, 19 nt, Homo sapiens
gaaccaaacggaagaauag

SEQ ID NO: 625927 - RNA, 19 nt, Homo sapiens
agaaaugucugucuggaaa

SEQ ID NO: 625928 - RNA, 19 nt, Homo sapiens
caaaccaacuuccuuagau

SEQ ID NO: 625929 - RNA, 19 nt, Homo sapiens
ccuggaaacuguagaauug

SEQ ID NO: 625930 - RNA, 19 nt, Homo sapiens
ggaaacaggacacaucuug

SEQ ID NO: 625931 - RNA, 19 nt, Homo sapiens
gugaagaacucaacuacug

SEQ ID NO: 625932 - RNA, 19 nt, Homo sapiens
gauugagcuuugaagauua

SEQ ID NO: 625933 - RNA, 19 nt, Homo sapiens
ggaacugccucccacauuc

SEQ ID NO: 625934 - RNA, 19 nt, Homo sapiens
cgauugagcuuugaagauu

SEQ ID NO: 625935 - RNA, 19 nt, Homo sapiens
ucauggauuuguuggauua

SEQ ID NO: 625936 - RNA, 19 nt, Homo sapiens
caucugcacucacaaauca

SEQ ID NO: 625937 - RNA, 19 nt, Homo sapiens
gcacacaacuucuguuucc

SEQ ID NO: 625938 - RNA, 19 nt, Homo sapiens
gaacuucugccaccacuug

SEQ ID NO: 625939 - RNA, 19 nt, Homo sapiens
ggauugaucugagagagaa

SEQ ID NO: 625940 - RNA, 19 nt, Homo sapiens
aagaggagcuuuggaauau

SEQ ID NO: 625941 - RNA, 19 nt, Homo sapiens
gaagcagcaauaagcauua

SEQ ID NO: 625942 - RNA, 19 nt, Homo sapiens
gaccaaaccaacuuccuua

SEQ ID NO: 625943 - RNA, 19 nt, Homo sapiens
gaacucaacuacuggaaaa

SEQ ID NO: 625944 - RNA, 19 nt, Homo sapiens
gaugaguugugggacauua

SEQ ID NO: 625945 - RNA, 19 nt, Homo sapiens
gaaagggaaugggcugaug

SEQ ID NO: 625946 - RNA, 19 nt, Homo sapiens
caaaggcuccgcucacaaa

SEQ ID NO: 625947 - RNA, 19 nt, Homo sapiens
guagugagcucuucaaaau

SEQ ID NO: 625948 - RNA, 19 nt, Homo sapiens
ggauuuccuuugcccauuu

SEQ ID NO: 625949 - RNA, 19 nt, Homo sapiens
cagauucucucagcaauga

SEQ ID NO: 625950 - RNA, 19 nt, Homo sapiens
gaacucaacagugacaauu

SEQ ID NO: 625951 - RNA, 19 nt, Homo sapiens
gugaauggcuaaagaaucu

SEQ ID NO: 625952 - RNA, 19 nt, Homo sapiens
gaucaucucuuggaaaugc

SEQ ID NO: 625953 - RNA, 19 nt, Homo sapiens
gcuagagcaucgagaaguu

SEQ ID NO: 625954 - RNA, 19 nt, Homo sapiens
gaaggcuggucuccgauug

SEQ ID NO: 625955 - RNA, 19 nt, Homo sapiens
ggccuggucucaucugaaa

SEQ ID NO: 625956 - RNA, 19 nt, Homo sapiens
aaaccaacuuccuuagauu

SEQ ID NO: 625957 - RNA, 19 nt, Homo sapiens
gaccagagaagaccaaaga

SEQ ID NO: 625958 - RNA, 19 nt, Homo sapiens
gacgggaguuucucucuug

SEQ ID NO: 625959 - RNA, 19 nt, Homo sapiens
gggcagugcuggguuagaa

SEQ ID NO: 625960 - RNA, 19 nt, Homo sapiens
gaccuucuauucacauuuc

SEQ ID NO: 625961 - RNA, 19 nt, Homo sapiens
ccaccacgcccaacuaauu

SEQ ID NO: 625962 - RNA, 19 nt, Homo sapiens
ucauaucccuuucagaaug

SEQ ID NO: 625963 - RNA, 19 nt, Homo sapiens
guugguagaucaucguuug

SEQ ID NO: 625964 - RNA, 19 nt, Homo sapiens
aaagcgaucuucccauguu

SEQ ID NO: 625965 - RNA, 19 nt, Homo sapiens
gaggauaucgcaacaagug

SEQ ID NO: 625966 - RNA, 19 nt, Homo sapiens
aguccaagccugaauaaua

SEQ ID NO: 625967 - RNA, 19 nt, Homo sapiens
auacguaccuguggaguuu

SEQ ID NO: 625968 - RNA, 19 nt, Homo sapiens
uagaggauauugcaacuuc

SEQ ID NO: 625969 - RNA, 19 nt, Homo sapiens
ccaggugaauggcuaaaga

SEQ ID NO: 625970 - RNA, 19 nt, Homo sapiens
aaggaacacugaugaguug

SEQ ID NO: 625971 - RNA, 19 nt, Homo sapiens
gagcucaucagaaagguuu

SEQ ID NO: 625972 - RNA, 19 nt, Homo sapiens
agaagaagcugugaauaag

SEQ ID NO: 625973 - RNA, 19 nt, Homo sapiens
gcagggcccuuccaacucu

SEQ ID NO: 625974 - RNA, 19 nt, Homo sapiens
ccgauugcguagauuauuu

SEQ ID NO: 625975 - RNA, 19 nt, Homo sapiens
ggucaccgauugcguagau

SEQ ID NO: 625976 - RNA, 19 nt, Homo sapiens
guacagaagguaucaguca

SEQ ID NO: 625977 - RNA, 19 nt, Homo sapiens
ucacagagccauuacaaca

SEQ ID NO: 625978 - RNA, 19 nt, Homo sapiens
gcacagucaucuuguucug

SEQ ID NO: 625979 - RNA, 19 nt, Homo sapiens
gcacaguccugcucucacu

SEQ ID NO: 625980 - RNA, 19 nt, Homo sapiens
uuaccuaacucugugcaua

SEQ ID NO: 625981 - RNA, 19 nt, Homo sapiens
gaaaacccaugcuuuacuu

SEQ ID NO: 625982 - RNA, 19 nt, Homo sapiens
cagagaaucauguuccuuu

SEQ ID NO: 625983 - RNA, 19 nt, Homo sapiens
cggcagagaagcagcaaua

SEQ ID NO: 625984 - RNA, 19 nt, Homo sapiens
ugacagcuaucgacaccaa

SEQ ID NO: 625985 - RNA, 19 nt, Homo sapiens
gcgcugaauugcauuaugg

SEQ ID NO: 625986 - RNA, 19 nt, Homo sapiens
guaccuggcucagcacgaa

SEQ ID NO: 625987 - RNA, 19 nt, Homo sapiens
gagaaggugcggacucuug

SEQ ID NO: 625988 - RNA, 19 nt, Homo sapiens
caaggaacacugaugaguu

SEQ ID NO: 625989 - RNA, 19 nt, Homo sapiens
ccucuacaguucauauuug

SEQ ID NO: 625990 - RNA, 19 nt, Homo sapiens
ggagugcaaucgcgcaauc

SEQ ID NO: 625991 - RNA, 19 nt, Homo sapiens
guucagacuugauaagauc

SEQ ID NO: 625992 - RNA, 19 nt, Homo sapiens
ggaaaagacgguacaauga

SEQ ID NO: 625993 - RNA, 19 nt, Homo sapiens
acacauguccagcuaauga

SEQ ID NO: 625994 - RNA, 19 nt, Homo sapiens
cauuacaccuuagaggaua

SEQ ID NO: 625995 - RNA, 19 nt, Homo sapiens
cuccaccucuucagcauua

SEQ ID NO: 625996 - RNA, 19 nt, Homo sapiens
caugugcgcuggugucugu

SEQ ID NO: 625997 - RNA, 19 nt, Homo sapiens
gcaucgacgugcucauuuc

SEQ ID NO: 625998 - RNA, 19 nt, Homo sapiens
ccaaagugcugggauuaca

SEQ ID NO: 625999 - RNA, 19 nt, Homo sapiens
ggaauaagcuugaaagaaa

SEQ ID NO: 626000 - RNA, 19 nt, Homo sapiens
gugaagagcuggucuguuu

SEQ ID NO: 626001 - RNA, 19 nt, Homo sapiens
gaaggugacucaagaaguu

SEQ ID NO: 626002 - RNA, 19 nt, Homo sapiens
ggaaucagaucgugaagaa

SEQ ID NO: 626003 - RNA, 19 nt, Homo sapiens
gaacugaacuagaaacaag

SEQ ID NO: 626004 - RNA, 19 nt, Homo sapiens
gggaaaagcugaucaauuu

SEQ ID NO: 626005 - RNA, 19 nt, Homo sapiens
caacuaguaucgucaaauu

SEQ ID NO: 626006 - RNA, 19 nt, Homo sapiens
ggaaugggcugaugaaugg

SEQ ID NO: 626007 - RNA, 19 nt, Homo sapiens
ucagaaaccuagaaacuaa

SEQ ID NO: 626008 - RNA, 19 nt, Homo sapiens
ccacagagauucagcaaug

SEQ ID NO: 626009 - RNA, 19 nt, Homo sapiens
gaucaucguuugacagaaa

SEQ ID NO: 626010 - RNA, 19 nt, Homo sapiens
uaacguggcuuuccaacuu

SEQ ID NO: 626011 - RNA, 19 nt, Homo sapiens
uacaacagcuuacuaguuu

SEQ ID NO: 626012 - RNA, 19 nt, Homo sapiens
agaagucacuguugcaaua

SEQ ID NO: 626013 - RNA, 19 nt, Homo sapiens
guccaagccugaauaauaa

SEQ ID NO: 626014 - RNA, 19 nt, Homo sapiens
gcuaaagaaucuggaauaa

SEQ ID NO: 626015 - RNA, 19 nt, Homo sapiens
ugagagagcugacacaugu

SEQ ID NO: 626016 - RNA, 19 nt, Homo sapiens
gaccaaagaugccagaugu

SEQ ID NO: 626017 - RNA, 19 nt, Homo sapiens
caaccuugcuggcuacuuu

SEQ ID NO: 626018 - RNA, 19 nt, Homo sapiens
gcaaaacucugucucaaaa

SEQ ID NO: 626019 - RNA, 19 nt, Homo sapiens
ccaagaagccacaaacuuu

SEQ ID NO: 626020 - RNA, 19 nt, Homo sapiens
ggagagaagagaauaguuu

SEQ ID NO: 626021 - RNA, 19 nt, Homo sapiens
cagaagaagcugugaauaa

SEQ ID NO: 626022 - RNA, 19 nt, Homo sapiens
caaaccuucugcuguguua

SEQ ID NO: 626023 - RNA, 19 nt, Homo sapiens
uaaagaaucuggaauaagc

SEQ ID NO: 626024 - RNA, 19 nt, Homo sapiens
gaaccaaacggaagaauag

SEQ ID NO: 626025 - RNA, 19 nt, Homo sapiens
agaaaugucugucuggaaa

SEQ ID NO: 626026 - RNA, 19 nt, Homo sapiens
caaaccaacuuccuuagau

SEQ ID NO: 626027 - RNA, 19 nt, Homo sapiens
ccuggaaacuguagaauug

SEQ ID NO: 626028 - RNA, 19 nt, Homo sapiens
ggaaacaggacacaucuug

SEQ ID NO: 626029 - RNA, 19 nt, Homo sapiens
gugaagaacucaacuacug

SEQ ID NO: 626030 - RNA, 19 nt, Homo sapiens
gauugagcuuugaagauua

SEQ ID NO: 626031 - RNA, 19 nt, Homo sapiens
ggaacugccucccacauuc

SEQ ID NO: 626032 - RNA, 19 nt, Homo sapiens
cgauugagcuuugaagauu

SEQ ID NO: 626033 - RNA, 19 nt, Homo sapiens
ucauggauuuguuggauua

SEQ ID NO: 626034 - RNA, 19 nt, Homo sapiens
caucugcacucacaaauca

SEQ ID NO: 626035 - RNA, 19 nt, Homo sapiens
gcacacaacuucuguuucc

SEQ ID NO: 626036 - RNA, 19 nt, Homo sapiens
gaacuucugccaccacuug

SEQ ID NO: 626037 - RNA, 19 nt, Homo sapiens
ggauugaucugagagagaa

SEQ ID NO: 626038 - RNA, 19 nt, Homo sapiens
aagaggagcuuuggaauau

SEQ ID NO: 626039 - RNA, 19 nt, Homo sapiens
gaagcagcaauaagcauua

SEQ ID NO: 626040 - RNA, 19 nt, Homo sapiens
gaccaaaccaacuuccuua

SEQ ID NO: 626041 - RNA, 19 nt, Homo sapiens
gaacucaacuacuggaaaa

SEQ ID NO: 626042 - RNA, 19 nt, Homo sapiens
gaugaguugugggacauua

SEQ ID NO: 626043 - RNA, 19 nt, Homo sapiens
gaaagggaaugggcugaug

SEQ ID NO: 626044 - RNA, 19 nt, Homo sapiens
caaaggcuccgcucacaaa

SEQ ID NO: 626045 - RNA, 19 nt, Homo sapiens
guagugagcucuucaaaau

SEQ ID NO: 626046 - RNA, 19 nt, Homo sapiens
ggauuuccuuugcccauuu

SEQ ID NO: 626047 - RNA, 19 nt, Homo sapiens
cagauucucucagcaauga

SEQ ID NO: 626048 - RNA, 19 nt, Homo sapiens
gaacucaacagugacaauu

SEQ ID NO: 626049 - RNA, 19 nt, Homo sapiens
gugaauggcuaaagaaucu

SEQ ID NO: 626050 - RNA, 19 nt, Homo sapiens
gaucaucucuuggaaaugc

SEQ ID NO: 626051 - RNA, 19 nt, Homo sapiens
gcuagagcaucgagaaguu

SEQ ID NO: 626052 - RNA, 19 nt, Homo sapiens
gaaggcuggucuccgauug

SEQ ID NO: 626053 - RNA, 19 nt, Homo sapiens
ggccuggucucaucugaaa

SEQ ID NO: 626054 - RNA, 19 nt, Homo sapiens
aaaccaacuuccuuagauu

SEQ ID NO: 626055 - RNA, 19 nt, Homo sapiens
gaccagagaagaccaaaga

SEQ ID NO: 626056 - RNA, 19 nt, Homo sapiens
gacgggaguuucucucuug

SEQ ID NO: 626057 - RNA, 19 nt, Homo sapiens
gggcagugcuggguuagaa

SEQ ID NO: 626058 - RNA, 19 nt, Homo sapiens
gaccuucuauucacauuuc

SEQ ID NO: 626059 - RNA, 19 nt, Homo sapiens
ccaccacgcccaacuaauu

SEQ ID NO: 626060 - RNA, 19 nt, Homo sapiens
ucauaucccuuucagaaug

SEQ ID NO: 626061 - RNA, 19 nt, Homo sapiens
guugguagaucaucguuug

SEQ ID NO: 626062 - RNA, 19 nt, Homo sapiens
aaagcgaucuucccauguu

SEQ ID NO: 626063 - RNA, 19 nt, Homo sapiens
gaggauaucgcaacaagug

SEQ ID NO: 626064 - RNA, 19 nt, Homo sapiens
aguccaagccugaauaaua

SEQ ID NO: 626065 - RNA, 19 nt, Homo sapiens
auacguaccuguggaguuu

SEQ ID NO: 626066 - RNA, 19 nt, Homo sapiens
uagaggauauugcaacuuc

SEQ ID NO: 626067 - RNA, 19 nt, Homo sapiens
ccaggugaauggcuaaaga

SEQ ID NO: 626068 - RNA, 19 nt, Homo sapiens
aaggaacacugaugaguug

SEQ ID NO: 626069 - RNA, 19 nt, Homo sapiens
gagcucaucagaaagguuu

SEQ ID NO: 626070 - RNA, 19 nt, Homo sapiens
agaagaagcugugaauaag

SEQ ID NO: 626071 - RNA, 19 nt, Homo sapiens
gcagggcccuuccaacucu

SEQ ID NO: 626072 - RNA, 19 nt, Homo sapiens
ccgauugcguagauuauuu

SEQ ID NO: 626073 - RNA, 19 nt, Homo sapiens
ggucaccgauugcguagau

SEQ ID NO: 626074 - RNA, 19 nt, Homo sapiens
guacagaagguaucaguca

SEQ ID NO: 626075 - RNA, 19 nt, Homo sapiens
ucacagagccauuacaaca

SEQ ID NO: 626076 - RNA, 19 nt, Homo sapiens
gcacagucaucuuguucug

SEQ ID NO: 626077 - RNA, 19 nt, Homo sapiens
gcacaguccugcucucacu

SEQ ID NO: 626078 - RNA, 19 nt, Homo sapiens
uuaccuaacucugugcaua

SEQ ID NO: 626079 - RNA, 19 nt, Homo sapiens
gaaaacccaugcuuuacuu

SEQ ID NO: 626080 - RNA, 19 nt, Homo sapiens
cagagaaucauguuccuuu

SEQ ID NO: 626081 - RNA, 19 nt, Homo sapiens
cggcagagaagcagcaaua

SEQ ID NO: 626082 - RNA, 19 nt, Homo sapiens
ugacagcuaucgacaccaa

SEQ ID NO: 626083 - RNA, 19 nt, Homo sapiens
gcgcugaauugcauuaugg

SEQ ID NO: 626084 - RNA, 19 nt, Homo sapiens
guaccuggcucagcacgaa

SEQ ID NO: 626085 - RNA, 19 nt, Homo sapiens
gagaaggugcggacucuug

SEQ ID NO: 626086 - RNA, 19 nt, Homo sapiens
acacauguccagcuaauga

SEQ ID NO: 626087 - RNA, 19 nt, Homo sapiens
caaggaacacugaugaguu

SEQ ID NO: 626088 - RNA, 19 nt, Homo sapiens
ccucuacaguucauauuug

SEQ ID NO: 626089 - RNA, 19 nt, Homo sapiens
ggagugcaaucgcgcaauc

SEQ ID NO: 626090 - RNA, 19 nt, Homo sapiens
guucagacuugauaagauc

SEQ ID NO: 626091 - RNA, 19 nt, Homo sapiens
ggaaaagacgguacaauga

SEQ ID NO: 626092 - RNA, 19 nt, Homo sapiens
cauuacaccuuagaggaua

SEQ ID NO: 626093 - RNA, 19 nt, Homo sapiens
cuccaccucuucagcauua

SEQ ID NO: 626094 - RNA, 19 nt, Homo sapiens
caugugcgcuggugucugu

SEQ ID NO: 626095 - RNA, 19 nt, Homo sapiens
gcaucgacgugcucauuuc

SEQ ID NO: 626096 - RNA, 19 nt, Homo sapiens
cuagggcagugcuggguua

SEQ ID NO: 626097 - RNA, 19 nt, Homo sapiens
gaggagcuuuggaauaucu

SEQ ID NO: 626098 - RNA, 19 nt, Homo sapiens
ccaaagugcugggauuaca

SEQ ID NO: 626099 - RNA, 19 nt, Homo sapiens
gggaaggacuuacggaugu

SEQ ID NO: 626100 - RNA, 19 nt, Homo sapiens
gggaugaaccacaaagaaa

SEQ ID NO: 626101 - RNA, 19 nt, Homo sapiens
gcagcuuccuacuucaauu

SEQ ID NO: 626102 - RNA, 19 nt, Homo sapiens
gagacacuccuauuaugaa

SEQ ID NO: 626103 - RNA, 19 nt, Homo sapiens
agacacuccuauuaugaaa

SEQ ID NO: 626104 - RNA, 19 nt, Homo sapiens
acaaagaagugggcaguag

SEQ ID NO: 626105 - RNA, 19 nt, Homo sapiens
gaaaaucaacuugcuacua

SEQ ID NO: 626106 - RNA, 19 nt, Homo sapiens
gcaguagagcgaacacgaa

SEQ ID NO: 626107 - RNA, 19 nt, Homo sapiens
caaagaagugggcaguaga

SEQ ID NO: 626108 - RNA, 19 nt, Homo sapiens
uccaaggacucauugacuu

SEQ ID NO: 626109 - RNA, 19 nt, Homo sapiens
uguugcagcuuccuacuuc

SEQ ID NO: 626110 - RNA, 19 nt, Homo sapiens
aaaaucaacuugcuacuac

SEQ ID NO: 626111 - RNA, 19 nt, Homo sapiens
ggaaggacuuacggauguc

SEQ ID NO: 626112 - RNA, 19 nt, Homo sapiens
ggaugaaccacaaagaaaa

SEQ ID NO: 626113 - RNA, 19 nt, Homo sapiens
uuaaacuuguggccucaga

SEQ ID NO: 626114 - RNA, 19 nt, Homo sapiens
ccaaggacucauugacuuc

SEQ ID NO: 626115 - RNA, 19 nt, Homo sapiens
caaagaaaaucaacuugcu

SEQ ID NO: 626116 - RNA, 19 nt, Homo sapiens
ggacucauugacuucauca

SEQ ID NO: 626117 - RNA, 19 nt, Homo sapiens
cagcuuccuacuucaauug

SEQ ID NO: 626118 - RNA, 19 nt, Homo sapiens
ccacaaagaaaaucaacuu

SEQ ID NO: 626119 - RNA, 19 nt, Homo sapiens
guagagcgaacacgaacca

SEQ ID NO: 626120 - RNA, 19 nt, Homo sapiens
aaucaguccuuugcuccuu

SEQ ID NO: 626121 - RNA, 19 nt, Homo sapiens
uuaugugaaucaguccuuu

SEQ ID NO: 626122 - RNA, 19 nt, Homo sapiens
caaggacucauugacuuca

SEQ ID NO: 626123 - RNA, 19 nt, Homo sapiens
gaggagccgcagucugugu

SEQ ID NO: 626124 - RNA, 19 nt, Homo sapiens
cuaaagcaguagagaauua

SEQ ID NO: 626125 - RNA, 19 nt, Homo sapiens
gaacaagucuaggacagaa

SEQ ID NO: 626126 - RNA, 19 nt, Homo sapiens
ggcaagauauggacaacua

SEQ ID NO: 626127 - RNA, 19 nt, Homo sapiens
gcagaaaugagaaacagua

SEQ ID NO: 626128 - RNA, 19 nt, Homo sapiens
gcucacagacuagaacuua

SEQ ID NO: 626129 - RNA, 19 nt, Homo sapiens
uaacuuagcacuuguaaag

SEQ ID NO: 626130 - RNA, 19 nt, Homo sapiens
uuauacagauggcaagaua

SEQ ID NO: 626131 - RNA, 19 nt, Homo sapiens
gaaaugagaaacaguaucu

SEQ ID NO: 626132 - RNA, 19 nt, Homo sapiens
gcacagggaagcagaaaug

SEQ ID NO: 626133 - RNA, 19 nt, Homo sapiens
gaagaugacgauuauugaa

SEQ ID NO: 626134 - RNA, 19 nt, Homo sapiens
ugaugaagaugacgauuau

SEQ ID NO: 626135 - RNA, 19 nt, Homo sapiens
gaaaaguaauggacucuga

SEQ ID NO: 626136 - RNA, 19 nt, Homo sapiens
gagaauuaccuuauacaga

SEQ ID NO: 626137 - RNA, 19 nt, Homo sapiens
gguaucagaacaagguuua

SEQ ID NO: 626138 - RNA, 19 nt, Homo sapiens
gaagguaucagaacaaggu

SEQ ID NO: 626139 - RNA, 19 nt, Homo sapiens
guagagaauuaccuuauac

SEQ ID NO: 626140 - RNA, 19 nt, Homo sapiens
uacaagugcucacagacua

SEQ ID NO: 626141 - RNA, 19 nt, Homo sapiens
gaugacgauuauugaacua

SEQ ID NO: 626142 - RNA, 19 nt, Homo sapiens
gaauuaccuuauacagaug

SEQ ID NO: 626143 - RNA, 19 nt, Homo sapiens
guaauggacucugaugaag

SEQ ID NO: 626144 - RNA, 19 nt, Homo sapiens
gcaguagagaauuaccuua

SEQ ID NO: 626145 - RNA, 19 nt, Homo sapiens
gagaagguaucagaacaag

SEQ ID NO: 626146 - RNA, 19 nt, Homo sapiens
gauauggacaacuaaguga

SEQ ID NO: 626147 - RNA, 19 nt, Homo sapiens
uaagugagaagguaucaga

SEQ ID NO: 626148 - RNA, 19 nt, Homo sapiens
gugagaagguaucagaaca

SEQ ID NO: 626149 - RNA, 19 nt, Homo sapiens
acaacuaagugagaaggua

SEQ ID NO: 626150 - RNA, 19 nt, Homo sapiens
uaacggaacaagucuagga

SEQ ID NO: 626151 - RNA, 19 nt, Homo sapiens
ugaagaugacgauuauuga

SEQ ID NO: 626152 - RNA, 19 nt, Homo sapiens
agacaacaacagugaaauu

SEQ ID NO: 626153 - RNA, 19 nt, Homo sapiens
gcaagauauggacaacuaa

SEQ ID NO: 626154 - RNA, 19 nt, Homo sapiens
gcacuuguaaagccugaaa

SEQ ID NO: 626155 - RNA, 19 nt, Homo sapiens
aaacuaaagcaguagagaa

SEQ ID NO: 626156 - RNA, 19 nt, Homo sapiens
cagggaagcagaaaugaga

SEQ ID NO: 626157 - RNA, 19 nt, Homo sapiens
gacaacaacagugaaauuc

SEQ ID NO: 626158 - RNA, 19 nt, Homo sapiens
aaagacaacaacagugaaa

SEQ ID NO: 626159 - RNA, 19 nt, Homo sapiens
caacuaagugagaagguau

SEQ ID NO: 626160 - RNA, 19 nt, Homo sapiens
ggaacaagucuaggacaga

SEQ ID NO: 626161 - RNA, 19 nt, Homo sapiens
gacgauuauugaacuacaa

SEQ ID NO: 626162 - RNA, 19 nt, Homo sapiens
uaucuuagcccaaguucug

SEQ ID NO: 626163 - RNA, 19 nt, Homo sapiens
cugaugaagaugacgauua

SEQ ID NO: 626164 - RNA, 19 nt, Homo sapiens
aauggacucugaugaagau

SEQ ID NO: 626165 - RNA, 19 nt, Homo sapiens
gaagcagaaaugagaaaca

SEQ ID NO: 626166 - RNA, 19 nt, Homo sapiens
cagaacaagguuuaauaga

SEQ ID NO: 626167 - RNA, 19 nt, Homo sapiens
ggacucugaugaagaugac

SEQ ID NO: 626168 - RNA, 19 nt, Homo sapiens
ucagaacaagguuuaauag

SEQ ID NO: 626169 - RNA, 19 nt, Homo sapiens
gggaagcagaaaugagaaa

SEQ ID NO: 626170 - RNA, 19 nt, Homo sapiens
caguagagaauuaccuuau

SEQ ID NO: 626171 - RNA, 19 nt, Homo sapiens
ugacgauuauugaacuaca

SEQ ID NO: 626172 - RNA, 19 nt, Homo sapiens
gauuauugaacuacaagug

SEQ ID NO: 626173 - RNA, 19 nt, Homo sapiens
aguaauggacucugaugaa

SEQ ID NO: 626174 - RNA, 19 nt, Homo sapiens
caacagaagaaaaguaaug

SEQ ID NO: 626175 - RNA, 19 nt, Homo sapiens
uagcccaaguucuggauca

SEQ ID NO: 626176 - RNA, 19 nt, Homo sapiens
uaauggacucugaugaaga

SEQ ID NO: 626177 - RNA, 19 nt, Homo sapiens
auacagauggcaagauaug

SEQ ID NO: 626178 - RNA, 19 nt, Homo sapiens
ugagaagguaucagaacaa

SEQ ID NO: 626179 - RNA, 19 nt, Homo sapiens
augaagaugacgauuauug

SEQ ID NO: 626180 - RNA, 19 nt, Homo sapiens
cagaaaugagaaacaguau

SEQ ID NO: 626181 - RNA, 19 nt, Homo sapiens
aagcagaaaugagaaacag

SEQ ID NO: 626182 - RNA, 19 nt, Homo sapiens
caagauauggacaacuaag

SEQ ID NO: 626183 - RNA, 19 nt, Homo sapiens
agaugacgauuauugaacu

SEQ ID NO: 626184 - RNA, 19 nt, Homo sapiens
aaaguaauggacucugaug

SEQ ID NO: 626185 - RNA, 19 nt, Homo sapiens
gauggcaagauauggacaa

SEQ ID NO: 626186 - RNA, 19 nt, Homo sapiens
acagauggcaagauaugga

SEQ ID NO: 626187 - RNA, 19 nt, Homo sapiens
cucacagacuagaacuuaa

SEQ ID NO: 626188 - RNA, 19 nt, Homo sapiens
aacuaaagcaguagagaau

SEQ ID NO: 626189 - RNA, 19 nt, Homo sapiens
aaagacagaugauaccuua

SEQ ID NO: 626190 - RNA, 19 nt, Homo sapiens
gaaagagguucugugauuu

SEQ ID NO: 626191 - RNA, 19 nt, Homo sapiens
gcaaauaauuguucucaag

SEQ ID NO: 626192 - RNA, 19 nt, Homo sapiens
ggaaacuugugaauucuuu

SEQ ID NO: 626193 - RNA, 19 nt, Homo sapiens
gaagaaagccguccagaca

SEQ ID NO: 626194 - RNA, 19 nt, Homo sapiens
uaaacucuguugccuaaua

SEQ ID NO: 626195 - RNA, 19 nt, Homo sapiens
caaccugugugccuuguua

SEQ ID NO: 626196 - RNA, 19 nt, Homo sapiens
uauaaacucuguugccuaa

SEQ ID NO: 626197 - RNA, 19 nt, Homo sapiens
gagcccaccugcauaguaa

SEQ ID NO: 626198 - RNA, 19 nt, Homo sapiens
uauauccucuugcuuguua

SEQ ID NO: 626199 - RNA, 19 nt, Homo sapiens
gagagagucuuaccugaau

SEQ ID NO: 626200 - RNA, 19 nt, Homo sapiens
guacuuugcuucucacaau

SEQ ID NO: 626201 - RNA, 19 nt, Homo sapiens
gacagaugauaccuuaaua

SEQ ID NO: 626202 - RNA, 19 nt, Homo sapiens
gcuaacggcuugugcuuga

SEQ ID NO: 626203 - RNA, 19 nt, Homo sapiens
agaggaaacuugugaauuc

SEQ ID NO: 626204 - RNA, 19 nt, Homo sapiens
guaaagauacuccuguaaa

SEQ ID NO: 626205 - RNA, 19 nt, Homo sapiens
gcacauauuccauaaagug

SEQ ID NO: 626206 - RNA, 19 nt, Homo sapiens
caucaagggcuuaauaauu

SEQ ID NO: 626207 - RNA, 19 nt, Homo sapiens
gagcugccauuuagaggaa

SEQ ID NO: 626208 - RNA, 19 nt, Homo sapiens
gaauauaccuguggcuaag

SEQ ID NO: 626209 - RNA, 19 nt, Homo sapiens
ggauauugcuauuucacuu

SEQ ID NO: 626210 - RNA, 19 nt, Homo sapiens
cgaauugcaugcauguuga

SEQ ID NO: 626211 - RNA, 19 nt, Homo sapiens
caauaucgacuuugcuuaa

SEQ ID NO: 626212 - RNA, 19 nt, Homo sapiens
acaaauaaccauucucuga

SEQ ID NO: 626213 - RNA, 19 nt, Homo sapiens
gaaauauacuggguuggau

SEQ ID NO: 626214 - RNA, 19 nt, Homo sapiens
gcucuuaauuaguugcuuu

SEQ ID NO: 626215 - RNA, 19 nt, Homo sapiens
aaagucacguguaaauuga

SEQ ID NO: 626216 - RNA, 19 nt, Homo sapiens
aaacucuguugccuaauaa

SEQ ID NO: 626217 - RNA, 19 nt, Homo sapiens
guauauagguguacuuugc

SEQ ID NO: 626218 - RNA, 19 nt, Homo sapiens
gcuaagagccuaauuuggu

SEQ ID NO: 626219 - RNA, 19 nt, Homo sapiens
gcaguacuuuagcuugaaa

SEQ ID NO: 626220 - RNA, 19 nt, Homo sapiens
cauaagcacauauuccaua

SEQ ID NO: 626221 - RNA, 19 nt, Homo sapiens
gaagucugaugugaauuga

SEQ ID NO: 626222 - RNA, 19 nt, Homo sapiens
uaaauagccuagcuuaguc

SEQ ID NO: 626223 - RNA, 19 nt, Homo sapiens
ugaccucugugacuuaauu

SEQ ID NO: 626224 - RNA, 19 nt, Homo sapiens
cuacaaaugacaaauggua

SEQ ID NO: 626225 - RNA, 19 nt, Homo sapiens
aaagaugacuacccaagau

SEQ ID NO: 626226 - RNA, 19 nt, Homo sapiens
aaaauaaggcccaauguua

SEQ ID NO: 626227 - RNA, 19 nt, Homo sapiens
uagcaguacuuuagcuuga

SEQ ID NO: 626228 - RNA, 19 nt, Homo sapiens
ccaauguuauggccuaaug

SEQ ID NO: 626229 - RNA, 19 nt, Homo sapiens
gccaagaacauaucuguau

SEQ ID NO: 626230 - RNA, 19 nt, Homo sapiens
gguauuccauaagcacaua

SEQ ID NO: 626231 - RNA, 19 nt, Homo sapiens
cuaauuugguucuggacua

SEQ ID NO: 626232 - RNA, 19 nt, Homo sapiens
cuaagagccuaauuugguu

SEQ ID NO: 626233 - RNA, 19 nt, Homo sapiens
gccaacccauuucaacaaa

SEQ ID NO: 626234 - RNA, 19 nt, Homo sapiens
gaugugaauugagcuauca

SEQ ID NO: 626235 - RNA, 19 nt, Homo sapiens
aaacagagcccaccugcau

SEQ ID NO: 626236 - RNA, 19 nt, Homo sapiens
guuauugagugcuuauuuc

SEQ ID NO: 626237 - RNA, 19 nt, Homo sapiens
agacuucugugccuaauag

SEQ ID NO: 626238 - RNA, 19 nt, Homo sapiens
uugcaugcauguugaaauu

SEQ ID NO: 626239 - RNA, 19 nt, Homo sapiens
caaauaaccauucucugau

SEQ ID NO: 626240 - RNA, 19 nt, Homo sapiens
ggaauauccauguuucaga

SEQ ID NO: 626241 - RNA, 19 nt, Homo sapiens
ugaaagcuauauacuugug

SEQ ID NO: 626242 - RNA, 19 nt, Homo sapiens
ucucagauguggccauguu

SEQ ID NO: 626243 - RNA, 19 nt, Homo sapiens
gaauggcaaucgcccagau

SEQ ID NO: 626244 - RNA, 19 nt, Homo sapiens
guaaacgaauugcaugcau

SEQ ID NO: 626245 - RNA, 19 nt, Homo sapiens
agaaagccguccagacaau

SEQ ID NO: 626246 - RNA, 19 nt, Homo sapiens
cgaauauaccuguggcuaa

SEQ ID NO: 626247 - RNA, 19 nt, Homo sapiens
uauuucacaugcagcuuua

SEQ ID NO: 626248 - RNA, 19 nt, Homo sapiens
aagcacauauuccauaaag

SEQ ID NO: 626249 - RNA, 19 nt, Homo sapiens
gcaugcauguugaaauuuu

SEQ ID NO: 626250 - RNA, 19 nt, Homo sapiens
aguagaggguauuccauaa

SEQ ID NO: 626251 - RNA, 19 nt, Homo sapiens
ucugaagucugaugugaau

SEQ ID NO: 626252 - RNA, 19 nt, Homo sapiens
gcuauauacuugugcuauc

SEQ ID NO: 626253 - RNA, 19 nt, Homo sapiens
gauuaacaguggagacagu

SEQ ID NO: 626254 - RNA, 19 nt, Homo sapiens
aaagacgccuacugagaga

SEQ ID NO: 626255 - RNA, 19 nt, Homo sapiens
gagagaaaauuaaguacug

SEQ ID NO: 626256 - RNA, 19 nt, Homo sapiens
uacccaagauuguaaauac

SEQ ID NO: 626257 - RNA, 19 nt, Homo sapiens
guccauucauuucuucauu

SEQ ID NO: 626258 - RNA, 19 nt, Homo sapiens
caagcacuuucgaccauau

SEQ ID NO: 626259 - RNA, 19 nt, Homo sapiens
caguagaggguauuccaua

SEQ ID NO: 626260 - RNA, 19 nt, Homo sapiens
ugacuacccaagauuguaa

SEQ ID NO: 626261 - RNA, 19 nt, Homo sapiens
uaaagaugacuacccaaga

SEQ ID NO: 626262 - RNA, 19 nt, Homo sapiens
gaaagccguccagacaauu

SEQ ID NO: 626263 - RNA, 19 nt, Homo sapiens
ccuaauagugacauuguuu

SEQ ID NO: 626264 - RNA, 19 nt, Homo sapiens
guucucaaguuauugcaau

SEQ ID NO: 626265 - RNA, 19 nt, Homo sapiens
cgacuuugcuuaaaacaga

SEQ ID NO: 626266 - RNA, 19 nt, Homo sapiens
gaggaaacuugugaauucu

SEQ ID NO: 626267 - RNA, 19 nt, Homo sapiens
uuaaagacgccuacugaga

SEQ ID NO: 626268 - RNA, 19 nt, Homo sapiens
ugaagucugaugugaauug

SEQ ID NO: 626269 - RNA, 19 nt, Homo sapiens
guaugaacacaauugcuaa

SEQ ID NO: 626270 - RNA, 19 nt, Homo sapiens
ucaagcacuuucgaccaua

SEQ ID NO: 626271 - RNA, 19 nt, Homo sapiens
cagcaucucuuuucucaga

SEQ ID NO: 626272 - RNA, 19 nt, Homo sapiens
aaugguaauucccuucuau

SEQ ID NO: 626273 - RNA, 19 nt, Homo sapiens
cauaaagugcucagaguca

SEQ ID NO: 626274 - RNA, 19 nt, Homo sapiens
agacagaugauaccuuaau

SEQ ID NO: 626275 - RNA, 19 nt, Homo sapiens
uaauuugguucuggacuau

SEQ ID NO: 626276 - RNA, 19 nt, Homo sapiens
ugucuggcccuacaaauga

SEQ ID NO: 626277 - RNA, 19 nt, Homo sapiens
gagcagccaacccauuuca

SEQ ID NO: 626278 - RNA, 19 nt, Homo sapiens
ucaauaucgacuuugcuua

SEQ ID NO: 626279 - RNA, 19 nt, Homo sapiens
ccauucauuucuucauuca

SEQ ID NO: 626280 - RNA, 19 nt, Homo sapiens
auaaauagccuagcuuagu

SEQ ID NO: 626281 - RNA, 19 nt, Homo sapiens
agucaucaagggcuuaaua

SEQ ID NO: 626282 - RNA, 19 nt, Homo sapiens
ccucugaccucugugacuu

SEQ ID NO: 626283 - RNA, 19 nt, Homo sapiens
ugaacacaauugcuaagag

SEQ ID NO: 626284 - RNA, 19 nt, Homo sapiens
uagcaguccugaacagucu

SEQ ID NO: 626285 - RNA, 19 nt, Homo sapiens
uauccauguuucagaggua

SEQ ID NO: 626286 - RNA, 19 nt, Homo sapiens
ccacuucucaguaugaaca

SEQ ID NO: 626287 - RNA, 19 nt, Homo sapiens
ccaccugcauaguaacugu

SEQ ID NO: 626288 - RNA, 19 nt, Homo sapiens
caugcagcuuuaagacgua

SEQ ID NO: 626289 - RNA, 19 nt, Homo sapiens
gaccagagauuguguauuu

SEQ ID NO: 626290 - RNA, 19 nt, Homo sapiens
uaacugagcugacugugaa

SEQ ID NO: 626291 - RNA, 19 nt, Homo sapiens
caauaaagacuguaacuga

SEQ ID NO: 626292 - RNA, 19 nt, Homo sapiens
gguagugacugucucguuu

SEQ ID NO: 626293 - RNA, 19 nt, Homo sapiens
gaugugcgcuuccagcaaa

SEQ ID NO: 626294 - RNA, 19 nt, Homo sapiens
cagaguagguggccgcuuu

SEQ ID NO: 626295 - RNA, 19 nt, Homo sapiens
cugcauagcugacuacuca

SEQ ID NO: 626296 - RNA, 19 nt, Homo sapiens
gaccaauucuguguggaua

SEQ ID NO: 626297 - RNA, 19 nt, Homo sapiens
gcaccgacaugucacucuu

SEQ ID NO: 626298 - RNA, 19 nt, Homo sapiens
ccaauucuguguggauauu

SEQ ID NO: 626299 - RNA, 19 nt, Homo sapiens
gagaugcaguugagugaca

SEQ ID NO: 626300 - RNA, 19 nt, Homo sapiens
cagcugcccucuacgauca

SEQ ID NO: 626301 - RNA, 19 nt, Homo sapiens
gagcugcgcugcguguuca

SEQ ID NO: 626302 - RNA, 19 nt, Homo sapiens
gcugacuacucaugcauug

SEQ ID NO: 626303 - RNA, 19 nt, Homo sapiens
gacugcaccuucuuuacaa

SEQ ID NO: 626304 - RNA, 19 nt, Homo sapiens
cacauuaagucaacaccaa

SEQ ID NO: 626305 - RNA, 19 nt, Homo sapiens
uguccuagcccuucaguaa

SEQ ID NO: 626306 - RNA, 19 nt, Homo sapiens
gcccagcccugucaguguu

SEQ ID NO: 626307 - RNA, 19 nt, Homo sapiens
gagccacucuccacuuucu

SEQ ID NO: 626308 - RNA, 19 nt, Homo sapiens
gcacagaccagggcuccaa

SEQ ID NO: 626309 - RNA, 19 nt, Homo sapiens
gaaagaccagagauugugu

SEQ ID NO: 626310 - RNA, 19 nt, Homo sapiens
ggccacaccugcucacucu

SEQ ID NO: 626311 - RNA, 19 nt, Homo sapiens
gugacugucucguuucugu

SEQ ID NO: 626312 - RNA, 19 nt, Homo sapiens
guaacugagcugacuguga

SEQ ID NO: 626313 - RNA, 19 nt, Homo sapiens
cgacugcaccuucuuuaca

SEQ ID NO: 626314 - RNA, 19 nt, Homo sapiens
ccacauuucaucagacaga

SEQ ID NO: 626315 - RNA, 19 nt, Homo sapiens
guguggauauuuaagugaa

SEQ ID NO: 626316 - RNA, 19 nt, Homo sapiens
guugguagcaucagcauca

SEQ ID NO: 626317 - RNA, 19 nt, Homo sapiens
guuggagucccucugcaua

SEQ ID NO: 626318 - RNA, 19 nt, Homo sapiens
gcauagcugacuacucaug

SEQ ID NO: 626319 - RNA, 19 nt, Homo sapiens
ugaaagaccagagauugug

SEQ ID NO: 626320 - RNA, 19 nt, Homo sapiens
ccugaaagaccagagauug

SEQ ID NO: 626321 - RNA, 19 nt, Homo sapiens
gccaggaaggcacaaggua

SEQ ID NO: 626322 - RNA, 19 nt, Homo sapiens
caacgagggcuacgugaac

SEQ ID NO: 626323 - RNA, 19 nt, Homo sapiens
ugcaccuucuuuacaauaa

SEQ ID NO: 626324 - RNA, 19 nt, Homo sapiens
uagccuagaccaauucugu

SEQ ID NO: 626325 - RNA, 19 nt, Homo sapiens
uccuagcccuucaguaaga

SEQ ID NO: 626326 - RNA, 19 nt, Homo sapiens
guugccacauuucaucaga

SEQ ID NO: 626327 - RNA, 19 nt, Homo sapiens
gguccagucuucggguuuc

SEQ ID NO: 626328 - RNA, 19 nt, Homo sapiens
acucaugcauugcucaaag

SEQ ID NO: 626329 - RNA, 19 nt, Homo sapiens
gggugguucuggccaggaa

SEQ ID NO: 626330 - RNA, 19 nt, Homo sapiens
acaagcugcuccucucucu

SEQ ID NO: 626331 - RNA, 19 nt, Homo sapiens
aaagaccagagauugugua

SEQ ID NO: 626332 - RNA, 19 nt, Homo sapiens
ucaacgagggcuacgugaa

SEQ ID NO: 626333 - RNA, 19 nt, Homo sapiens
gacuguaacugagcugacu

SEQ ID NO: 626334 - RNA, 19 nt, Homo sapiens
cugcaccuucuuuacaaua

SEQ ID NO: 626335 - RNA, 19 nt, Homo sapiens
gagauuguguauuuucagu

SEQ ID NO: 626336 - RNA, 19 nt, Homo sapiens
guggauauuuaagugaaca

SEQ ID NO: 626337 - RNA, 19 nt, Homo sapiens
gguuucaccuccuaguacu

SEQ ID NO: 626338 - RNA, 19 nt, Homo sapiens
gugugucccuagccuggaa

SEQ ID NO: 626339 - RNA, 19 nt, Homo sapiens
gcaaguaccuggucauugg

SEQ ID NO: 626340 - RNA, 19 nt, Homo sapiens
gcaaugcccacgagucuaa

SEQ ID NO: 626341 - RNA, 19 nt, Homo sapiens
ggagacggaauaaauguuu

SEQ ID NO: 626342 - RNA, 19 nt, Homo sapiens
gugcaucuguggacaacua

SEQ ID NO: 626343 - RNA, 19 nt, Homo sapiens
ggugagggcuacagcaaug

SEQ ID NO: 626344 - RNA, 19 nt, Homo sapiens
gcccuggacuuucccauga

SEQ ID NO: 626345 - RNA, 19 nt, Homo sapiens
gaggaugccugccgcuaug

SEQ ID NO: 626346 - RNA, 19 nt, Homo sapiens
gaagggcuuugccugacaa

SEQ ID NO: 626347 - RNA, 19 nt, Homo sapiens
gcuauuaucugcguucucu

SEQ ID NO: 626348 - RNA, 19 nt, Homo sapiens
guaaauauucugcaguugu

SEQ ID NO: 626349 - RNA, 19 nt, Homo sapiens
gcucuuguguccucacuca

SEQ ID NO: 626350 - RNA, 19 nt, Homo sapiens
caacacccagcuuuaugua

SEQ ID NO: 626351 - RNA, 19 nt, Homo sapiens
ggaagggcuuugccugaca

SEQ ID NO: 626352 - RNA, 19 nt, Homo sapiens
auucugcaguuguuacuua

SEQ ID NO: 626353 - RNA, 19 nt, Homo sapiens
gacaacacccagcuuuaug

SEQ ID NO: 626354 - RNA, 19 nt, Homo sapiens
ugacaacacccagcuuuau

SEQ ID NO: 626355 - RNA, 19 nt, Homo sapiens
ccacgagucuaagcagaug

SEQ ID NO: 626356 - RNA, 19 nt, Homo sapiens
acgacuucauccagaauua

SEQ ID NO: 626357 - RNA, 19 nt, Homo sapiens
ggaccuuccugugguuugu

SEQ ID NO: 626358 - RNA, 19 nt, Homo sapiens
cggaauaaauguuuucuca

SEQ ID NO: 626359 - RNA, 19 nt, Homo sapiens
ggccugggaugcuguuugg

SEQ ID NO: 626360 - RNA, 19 nt, Homo sapiens
guuuggagacggaauaaau

SEQ ID NO: 626361 - RNA, 19 nt, Homo sapiens
gccaucaccuucagcuucu

SEQ ID NO: 626362 - RNA, 19 nt, Homo sapiens
gcuguuuggagacggaaua

SEQ ID NO: 626363 - RNA, 19 nt, Homo sapiens
cagcuaaggagccucauag

SEQ ID NO: 626364 - RNA, 19 nt, Homo sapiens
ugugccgaguguauuauaa

SEQ ID NO: 626365 - RNA, 19 nt, Homo sapiens
ggacgacuucauccagaau

SEQ ID NO: 626366 - RNA, 19 nt, Homo sapiens
gggcagccaucaccuucag

SEQ ID NO: 626367 - RNA, 19 nt, Homo sapiens
gugccgaguguauuauaaa

SEQ ID NO: 626368 - RNA, 19 nt, Homo sapiens
cugcaguuguuacuuagga

SEQ ID NO: 626369 - RNA, 19 nt, Homo sapiens
cgugggagccgcuauuauc

SEQ ID NO: 626370 - RNA, 19 nt, Homo sapiens
gagacggaauaaauguuuu

SEQ ID NO: 626371 - RNA, 19 nt, Homo sapiens
ucucagcucucuggaccuu

SEQ ID NO: 626372 - RNA, 19 nt, Homo sapiens
cagcaaugcccacgagucu

SEQ ID NO: 626373 - RNA, 19 nt, Homo sapiens
cguguucuccugcaucuau

SEQ ID NO: 626374 - RNA, 19 nt, Homo sapiens
cugacaacacccagcuuua

SEQ ID NO: 626375 - RNA, 19 nt, Homo sapiens
ccugacaacacccagcuuu

SEQ ID NO: 626376 - RNA, 19 nt, Homo sapiens
ugugcccacugcuguauga

SEQ ID NO: 626377 - RNA, 19 nt, Homo sapiens
cgaggaugccugccgcuau

SEQ ID NO: 626378 - RNA, 19 nt, Homo sapiens
gccgugggagccgcuauua

SEQ ID NO: 626379 - RNA, 19 nt, Homo sapiens
ccaugagccuccuggaacu

SEQ ID NO: 626380 - RNA, 19 nt, Homo sapiens
agucuaagcagauguacug

SEQ ID NO: 626381 - RNA, 19 nt, Homo sapiens
cagauguacugcguguuca

SEQ ID NO: 626382 - RNA, 19 nt, Homo sapiens
gcccaugugcuacugacaa

SEQ ID NO: 626383 - RNA, 19 nt, Homo sapiens
acaacacccagcuuuaugu

SEQ ID NO: 626384 - RNA, 19 nt, Homo sapiens
caucaccuucagcuucuuu

SEQ ID NO: 626385 - RNA, 19 nt, Homo sapiens
gacgacuucauccagaauu

SEQ ID NO: 626386 - RNA, 19 nt, Homo sapiens
uguaaauauucugcaguug

SEQ ID NO: 626387 - RNA, 19 nt, Homo sapiens
gaacugaucugggacacua

SEQ ID NO: 626388 - RNA, 19 nt, Homo sapiens
gaacacggaucuaaacuca

SEQ ID NO: 626389 - RNA, 19 nt, Homo sapiens
ggacagggcuuuggaauca

SEQ ID NO: 626390 - RNA, 19 nt, Homo sapiens
gaaacucgcuccuucuguu

SEQ ID NO: 626391 - RNA, 19 nt, Homo sapiens
guaauaaagugaagacuca

SEQ ID NO: 626392 - RNA, 19 nt, Homo sapiens
auauaaggcuccacaaaua

SEQ ID NO: 626393 - RNA, 19 nt, Homo sapiens
gcagagaaguagcaccauu

SEQ ID NO: 626394 - RNA, 19 nt, Homo sapiens
cuacguaugugcaaguaua

SEQ ID NO: 626395 - RNA, 19 nt, Homo sapiens
gggcauggguggugacauu

SEQ ID NO: 626396 - RNA, 19 nt, Homo sapiens
gaucuaaacucaggugugu

SEQ ID NO: 626397 - RNA, 19 nt, Homo sapiens
ucaaaggacugaucacugu

SEQ ID NO: 626398 - RNA, 19 nt, Homo sapiens
ggucauagggugaguguaa

SEQ ID NO: 626399 - RNA, 19 nt, Homo sapiens
gcgaugagcuguggaggaa

SEQ ID NO: 626400 - RNA, 19 nt, Homo sapiens
ugagacacccugccuguua

SEQ ID NO: 626401 - RNA, 19 nt, Homo sapiens
ggaggaagcccugguggua

SEQ ID NO: 626402 - RNA, 19 nt, Homo sapiens
ggugacuucuggugacaua

SEQ ID NO: 626403 - RNA, 19 nt, Homo sapiens
cuagagaggucaagauuac

SEQ ID NO: 626404 - RNA, 19 nt, Homo sapiens
cagagaaguagcaccauua

SEQ ID NO: 626405 - RNA, 19 nt, Homo sapiens
cagguaagcuuaacuccau

SEQ ID NO: 626406 - RNA, 19 nt, Homo sapiens
gguuaagucucgagugaau

SEQ ID NO: 626407 - RNA, 19 nt, Homo sapiens
gcccaacucuguccgguau

SEQ ID NO: 626408 - RNA, 19 nt, Homo sapiens
gguuguugcugacuucauu

SEQ ID NO: 626409 - RNA, 19 nt, Homo sapiens
gggcuucccugcucagugu

SEQ ID NO: 626410 - RNA, 19 nt, Homo sapiens
gcagaaauggccacuggaa

SEQ ID NO: 626411 - RNA, 19 nt, Homo sapiens
caagagagggcccaggaaa

SEQ ID NO: 626412 - RNA, 19 nt, Homo sapiens
gaugagagagggugagaga

SEQ ID NO: 626413 - RNA, 19 nt, Homo sapiens
ucaggcagcuagugauaga

SEQ ID NO: 626414 - RNA, 19 nt, Homo sapiens
aaggugggcucuucacuga

SEQ ID NO: 626415 - RNA, 19 nt, Homo sapiens
gggaggaguucugcaucua

SEQ ID NO: 626416 - RNA, 19 nt, Homo sapiens
gucauaaucucuucugagu

SEQ ID NO: 626417 - RNA, 19 nt, Homo sapiens
ggacaacaaggcacagaug

SEQ ID NO: 626418 - RNA, 19 nt, Homo sapiens
ggaagaccaugggcuguag

SEQ ID NO: 626419 - RNA, 19 nt, Homo sapiens
gcacagagggagagguuca

SEQ ID NO: 626420 - RNA, 19 nt, Homo sapiens
guggcacccuccuuuauga

SEQ ID NO: 626421 - RNA, 19 nt, Homo sapiens
uaauauaaggcuccacaaa

SEQ ID NO: 626422 - RNA, 19 nt, Homo sapiens
cagcguuacugccugugua

SEQ ID NO: 626423 - RNA, 19 nt, Homo sapiens
gagacacccugccuguuag

SEQ ID NO: 626424 - RNA, 19 nt, Homo sapiens
acaagaggcugugagaugu

SEQ ID NO: 626425 - RNA, 19 nt, Homo sapiens
ggacaacccacugaacgaa

SEQ ID NO: 626426 - RNA, 19 nt, Homo sapiens
gcaccauuauccccauuua

SEQ ID NO: 626427 - RNA, 19 nt, Homo sapiens
gaggaguucugcaucuaca

SEQ ID NO: 626428 - RNA, 19 nt, Homo sapiens
ugaggaaacugaggucuag

SEQ ID NO: 626429 - RNA, 19 nt, Homo sapiens
ccaaaggacagcagugaug

SEQ ID NO: 626430 - RNA, 19 nt, Homo sapiens
gcaaggacagggcuuugga

SEQ ID NO: 626431 - RNA, 19 nt, Homo sapiens
ucacuguccuugccucuag

SEQ ID NO: 626432 - RNA, 19 nt, Homo sapiens
gggccagaguuaagggaaa

SEQ ID NO: 626433 - RNA, 19 nt, Homo sapiens
cuuacucacucagcaguua

SEQ ID NO: 626434 - RNA, 19 nt, Homo sapiens
uaugucaccucuccucuca

SEQ ID NO: 626435 - RNA, 19 nt, Homo sapiens
gacuucuggugacauagua

SEQ ID NO: 626436 - RNA, 19 nt, Homo sapiens
cgucaaggaccgcaagaaa

SEQ ID NO: 626437 - RNA, 19 nt, Homo sapiens
gacaacaaggcacagauga

SEQ ID NO: 626438 - RNA, 19 nt, Homo sapiens
ggaaacugaggucuagaga

SEQ ID NO: 626439 - RNA, 19 nt, Homo sapiens
auaaggcuccacaaauaua

SEQ ID NO: 626440 - RNA, 19 nt, Homo sapiens
aauauaaggcuccacaaau

SEQ ID NO: 626441 - RNA, 19 nt, Homo sapiens
ugagagagggugagagaug

SEQ ID NO: 626442 - RNA, 19 nt, Homo sapiens
ccauuuaacagaagggaaa

SEQ ID NO: 626443 - RNA, 19 nt, Homo sapiens
ggcgaucccucaccugcuu

SEQ ID NO: 626444 - RNA, 19 nt, Homo sapiens
gcacaaggugggcucuuca

SEQ ID NO: 626445 - RNA, 19 nt, Homo sapiens
gggaagaccaugggcugua

SEQ ID NO: 626446 - RNA, 19 nt, Homo sapiens
cuugugaccucccaggaaa

SEQ ID NO: 626447 - RNA, 19 nt, Homo sapiens
cugguuaagucucgaguga

SEQ ID NO: 626448 - RNA, 19 nt, Homo sapiens
uauaaggcuccacaaauau

SEQ ID NO: 626449 - RNA, 19 nt, Homo sapiens
guggugacauuggcagaaa

SEQ ID NO: 626450 - RNA, 19 nt, Homo sapiens
agggaaagcugucaagacu

SEQ ID NO: 626451 - RNA, 19 nt, Homo sapiens
aagauuacuugcccagaau

SEQ ID NO: 626452 - RNA, 19 nt, Homo sapiens
gaaauggccacuggaaagg

SEQ ID NO: 626453 - RNA, 19 nt, Homo sapiens
cuggugacauaguaauaaa

SEQ ID NO: 626454 - RNA, 19 nt, Homo sapiens
ugucuuggcuguucuccau

SEQ ID NO: 626455 - RNA, 19 nt, Homo sapiens
ccacuggccuguccuucag

SEQ ID NO: 626456 - RNA, 19 nt, Homo sapiens
ccaggaaacagaacugauc

SEQ ID NO: 626457 - RNA, 19 nt, Homo sapiens
ucuagagaggucaagauua

SEQ ID NO: 626458 - RNA, 19 nt, Homo sapiens
ugucagggccgucuccauu

SEQ ID NO: 626459 - RNA, 19 nt, Homo sapiens
gcacccuccuuuaugacau

SEQ ID NO: 626460 - RNA, 19 nt, Homo sapiens
guucaggagucaggucuuc

SEQ ID NO: 626461 - RNA, 19 nt, Homo sapiens
caucuaagaauccuaagag

SEQ ID NO: 626462 - RNA, 19 nt, Homo sapiens
gaggaggucauaaucucuu

SEQ ID NO: 626463 - RNA, 19 nt, Homo sapiens
caccguggcuuggucauag

SEQ ID NO: 626464 - RNA, 19 nt, Homo sapiens
cagaaauggccacuggaaa

SEQ ID NO: 626465 - RNA, 19 nt, Homo sapiens
caggucuucugccuucuga

SEQ ID NO: 626466 - RNA, 19 nt, Homo sapiens
gggagagguucaggaguca

SEQ ID NO: 626467 - RNA, 19 nt, Homo sapiens
ggaaacucgcuccuucugu

SEQ ID NO: 626468 - RNA, 19 nt, Homo sapiens
ggguacugcccaucuguuu

SEQ ID NO: 626469 - RNA, 19 nt, Homo sapiens
agaaauggccacuggaaag

SEQ ID NO: 626470 - RNA, 19 nt, Homo sapiens
ggugacauaguaauaaagu

SEQ ID NO: 626471 - RNA, 19 nt, Homo sapiens
caaauauaucugugugugu

SEQ ID NO: 626472 - RNA, 19 nt, Homo sapiens
gagauggagggcgagauuu

SEQ ID NO: 626473 - RNA, 19 nt, Homo sapiens
gcagggaaagcugucaaga

SEQ ID NO: 626474 - RNA, 19 nt, Homo sapiens
guacugcccaucuguuucu

SEQ ID NO: 626475 - RNA, 19 nt, Homo sapiens
gcugguuguugcugacuuc

SEQ ID NO: 626476 - RNA, 19 nt, Homo sapiens
ugucaccucuccucucauc

SEQ ID NO: 626477 - RNA, 19 nt, Homo sapiens
gucauagggugaguguaaa

SEQ ID NO: 626478 - RNA, 19 nt, Homo sapiens
agaaguagcaccauuaucc

SEQ ID NO: 626479 - RNA, 19 nt, Homo sapiens
cgucgugucuuggcuguuc

SEQ ID NO: 626480 - RNA, 19 nt, Homo sapiens
ccaaggacaacccacugaa

SEQ ID NO: 626481 - RNA, 19 nt, Homo sapiens
ucgauucccugcccuugug

SEQ ID NO: 626482 - RNA, 19 nt, Homo sapiens
uaaggcuccacaaauauau

SEQ ID NO: 626483 - RNA, 19 nt, Homo sapiens
agagauggagggcgagauu

SEQ ID NO: 626484 - RNA, 19 nt, Homo sapiens
ggaacacggaucuaaacuc

SEQ ID NO: 626485 - RNA, 19 nt, Homo sapiens
ucccucaccugcuuacuca

SEQ ID NO: 626486 - RNA, 19 nt, Homo sapiens
cauaagggacagggaggua

SEQ ID NO: 626487 - RNA, 19 nt, Homo sapiens
gcacaagcaugcucaauaa

SEQ ID NO: 626488 - RNA, 19 nt, Homo sapiens
ggacagccguggacaguua

SEQ ID NO: 626489 - RNA, 19 nt, Homo sapiens
gcaauagccucucccuuca

SEQ ID NO: 626490 - RNA, 19 nt, Homo sapiens
caauaucucuuccaaaugg

SEQ ID NO: 626491 - RNA, 19 nt, Homo sapiens
caagcaugcucaauaaaug

SEQ ID NO: 626492 - RNA, 19 nt, Homo sapiens
gcucuguccucaugugcua

SEQ ID NO: 626493 - RNA, 19 nt, Homo sapiens
gggaggaguucugcaucua

SEQ ID NO: 626494 - RNA, 19 nt, Homo sapiens
cuucaugcguucauucauu

SEQ ID NO: 626495 - RNA, 19 nt, Homo sapiens
ggacaacccacugaacgaa

SEQ ID NO: 626496 - RNA, 19 nt, Homo sapiens
gaggaguucugcaucuaca

SEQ ID NO: 626497 - RNA, 19 nt, Homo sapiens
guucuccacugacucauuc

SEQ ID NO: 626498 - RNA, 19 nt, Homo sapiens
guccucaugugcuauguga

SEQ ID NO: 626499 - RNA, 19 nt, Homo sapiens
cgucaaggaccgcaagaaa

SEQ ID NO: 626500 - RNA, 19 nt, Homo sapiens
ucaaggcuguugugccaau

SEQ ID NO: 626501 - RNA, 19 nt, Homo sapiens
acaaacacaucaauaucuc

SEQ ID NO: 626502 - RNA, 19 nt, Homo sapiens
ggaaggcuggcuugaggaa

SEQ ID NO: 626503 - RNA, 19 nt, Homo sapiens
gcuaugugacccugacaaa

SEQ ID NO: 626504 - RNA, 19 nt, Homo sapiens
ugccagaaauguccaagau

SEQ ID NO: 626505 - RNA, 19 nt, Homo sapiens
guucauucauucaguaaac

SEQ ID NO: 626506 - RNA, 19 nt, Homo sapiens
acaagcaugcucaauaaau

SEQ ID NO: 626507 - RNA, 19 nt, Homo sapiens
aauguaagcucuuuuguuc

SEQ ID NO: 626508 - RNA, 19 nt, Homo sapiens
ugucuuggcuguucuccau

SEQ ID NO: 626509 - RNA, 19 nt, Homo sapiens
gaacugaggggugauaaug

SEQ ID NO: 626510 - RNA, 19 nt, Homo sapiens
ugaccucacuguccuuagg

SEQ ID NO: 626511 - RNA, 19 nt, Homo sapiens
acagcggugugaagaguga

SEQ ID NO: 626512 - RNA, 19 nt, Homo sapiens
cgucgugucuuggcuguuc

SEQ ID NO: 626513 - RNA, 19 nt, Homo sapiens
ggagaaaacaaacacauca

SEQ ID NO: 626514 - RNA, 19 nt, Homo sapiens
cuucaccgccuccuucauu

SEQ ID NO: 626515 - RNA, 19 nt, Homo sapiens
ccaaggacaacccacugaa

SEQ ID NO: 626516 - RNA, 19 nt, Homo sapiens
acaucaauaucucuuccaa

SEQ ID NO: 626517 - RNA, 19 nt, Homo sapiens
ugugccuagugaugaauua

SEQ ID NO: 626518 - RNA, 19 nt, Homo sapiens
gcaugcucaauaaauguaa

SEQ ID NO: 626519 - RNA, 19 nt, Homo sapiens
aauagccucucccuucaca

SEQ ID NO: 626520 - RNA, 19 nt, Homo sapiens
gcagaucagcagcgucaag

SEQ ID NO: 626521 - RNA, 19 nt, Homo sapiens
uccacugacucauucauuc

SEQ ID NO: 626522 - RNA, 19 nt, Homo sapiens
ucacuguccuuaggguuag

SEQ ID NO: 626523 - RNA, 19 nt, Homo sapiens
ucaauaucucuuccaaaug

SEQ ID NO: 626524 - RNA, 19 nt, Homo sapiens
caucaauaucucuuccaaa

SEQ ID NO: 626525 - RNA, 19 nt, Homo sapiens
gcagccuagugccagaaau

SEQ ID NO: 626526 - RNA, 19 nt, Homo sapiens
ucaaggaccuaagcuucca

SEQ ID NO: 626527 - RNA, 19 nt, Homo sapiens
ucuccaagcccaaggacaa

SEQ ID NO: 626528 - RNA, 19 nt, Homo sapiens
ucaaggaccgcaagaaagc

SEQ ID NO: 626529 - RNA, 19 nt, Homo sapiens
ggaggaguucugcaucuac

SEQ ID NO: 626530 - RNA, 19 nt, Homo sapiens
cagccuagugccagaaaug

SEQ ID NO: 626531 - RNA, 19 nt, Homo sapiens
ugcguucauucauucagua

SEQ ID NO: 626532 - RNA, 19 nt, Homo sapiens
cccaacgccugcagcuaug

SEQ ID NO: 626533 - RNA, 19 nt, Homo sapiens
uaagcuuccaggaggagua

SEQ ID NO: 626534 - RNA, 19 nt, Homo sapiens
cacaagcaugcucaauaaa

SEQ ID NO: 626535 - RNA, 19 nt, Homo sapiens
gauucaaggaccuaagcuu

SEQ ID NO: 626536 - RNA, 19 nt, Homo sapiens
gaugugagcuguucuccau

SEQ ID NO: 626537 - RNA, 19 nt, Homo sapiens
gggaggaguucugcaucua

SEQ ID NO: 626538 - RNA, 19 nt, Homo sapiens
cauguugaccuuagaguuu

SEQ ID NO: 626539 - RNA, 19 nt, Homo sapiens
cuucaugcguucauucauu

SEQ ID NO: 626540 - RNA, 19 nt, Homo sapiens
ggacaacccacugaacgaa

SEQ ID NO: 626541 - RNA, 19 nt, Homo sapiens
gaccuuagaguuugggauu

SEQ ID NO: 626542 - RNA, 19 nt, Homo sapiens
gaggaguucugcaucuaca

SEQ ID NO: 626543 - RNA, 19 nt, Homo sapiens
guucuccacugacucauuc

SEQ ID NO: 626544 - RNA, 19 nt, Homo sapiens
auaggcagcuggacacaga

SEQ ID NO: 626545 - RNA, 19 nt, Homo sapiens
cgucaaggaccgcaagaaa

SEQ ID NO: 626546 - RNA, 19 nt, Homo sapiens
ggaaggcuggcuugaggaa

SEQ ID NO: 626547 - RNA, 19 nt, Homo sapiens
ugccagaaauguccaagau

SEQ ID NO: 626548 - RNA, 19 nt, Homo sapiens
guucauucauucaguaaac

SEQ ID NO: 626549 - RNA, 19 nt, Homo sapiens
gcccggaugugagcuguuc

SEQ ID NO: 626550 - RNA, 19 nt, Homo sapiens
cuucaccgccuccuucauu

SEQ ID NO: 626551 - RNA, 19 nt, Homo sapiens
ccaaggacaacccacugaa

SEQ ID NO: 626552 - RNA, 19 nt, Homo sapiens
ccuccuuggucucauguug

SEQ ID NO: 626553 - RNA, 19 nt, Homo sapiens
ugugagcuguucuccauag

SEQ ID NO: 626554 - RNA, 19 nt, Homo sapiens
gcagaucagcagcgucaag

SEQ ID NO: 626555 - RNA, 19 nt, Homo sapiens
uccacugacucauucauuc

SEQ ID NO: 626556 - RNA, 19 nt, Homo sapiens
gcagccuagugccagaaau

SEQ ID NO: 626557 - RNA, 19 nt, Homo sapiens
ucaaggaccuaagcuucca

SEQ ID NO: 626558 - RNA, 19 nt, Homo sapiens
ucuccaagcccaaggacaa

SEQ ID NO: 626559 - RNA, 19 nt, Homo sapiens
ucaaggaccgcaagaaagc

SEQ ID NO: 626560 - RNA, 19 nt, Homo sapiens
cagccuagugccagaaaug

SEQ ID NO: 626561 - RNA, 19 nt, Homo sapiens
ggaggaguucugcaucuac

SEQ ID NO: 626562 - RNA, 19 nt, Homo sapiens
ugcguucauucauucagua

SEQ ID NO: 626563 - RNA, 19 nt, Homo sapiens
uaagcuuccaggaggagua

SEQ ID NO: 626564 - RNA, 19 nt, Homo sapiens
cccaacgccugcagcuaug

SEQ ID NO: 626565 - RNA, 19 nt, Homo sapiens
gauucaaggaccuaagcuu

SEQ ID NO: 626566 - RNA, 19 nt, Homo sapiens
gaauucgauccuucaugga

SEQ ID NO: 626567 - RNA, 19 nt, Homo sapiens
gaaaguguucuuccaagua

SEQ ID NO: 626568 - RNA, 19 nt, Homo sapiens
guuagucucugcuuucuuu

SEQ ID NO: 626569 - RNA, 19 nt, Homo sapiens
ugaaacgccucgucucuaa

SEQ ID NO: 626570 - RNA, 19 nt, Homo sapiens
ggaacgagcccaaguacaa

SEQ ID NO: 626571 - RNA, 19 nt, Homo sapiens
gcacgucuuuccagaauuc

SEQ ID NO: 626572 - RNA, 19 nt, Homo sapiens
agagagcgaugccauguuu

SEQ ID NO: 626573 - RNA, 19 nt, Homo sapiens
ugaauuccaucaagaagaa

SEQ ID NO: 626574 - RNA, 19 nt, Homo sapiens
gauauucuguggaaagugu

SEQ ID NO: 626575 - RNA, 19 nt, Homo sapiens
gaagagacaaguggaggua

SEQ ID NO: 626576 - RNA, 19 nt, Homo sapiens
ugaaggaccugcugaagag

SEQ ID NO: 626577 - RNA, 19 nt, Homo sapiens
gggcacgucuuuccagaau

SEQ ID NO: 626578 - RNA, 19 nt, Homo sapiens
ccagaaugguacagcgaua

SEQ ID NO: 626579 - RNA, 19 nt, Homo sapiens
guaaacguccguaacaaga

SEQ ID NO: 626580 - RNA, 19 nt, Homo sapiens
gagauaaugcggcagaaga

SEQ ID NO: 626581 - RNA, 19 nt, Homo sapiens
ggucauggaaucuguggua

SEQ ID NO: 626582 - RNA, 19 nt, Homo sapiens
gaagaaagucaacgacaag

SEQ ID NO: 626583 - RNA, 19 nt, Homo sapiens
agaagaaagucaacgacaa

SEQ ID NO: 626584 - RNA, 19 nt, Homo sapiens
guacagcgauaauaaaaug

SEQ ID NO: 626585 - RNA, 19 nt, Homo sapiens
uggaaucugugguaaagaa

SEQ ID NO: 626586 - RNA, 19 nt, Homo sapiens
gcugugaauuccaucaaga

SEQ ID NO: 626587 - RNA, 19 nt, Homo sapiens
gaguaacacuacauacagu

SEQ ID NO: 626588 - RNA, 19 nt, Homo sapiens
gagccacaguuccacaaug

SEQ ID NO: 626589 - RNA, 19 nt, Homo sapiens
caaaauaugcugugaauuc

SEQ ID NO: 626590 - RNA, 19 nt, Homo sapiens
gaaugguacagcgauaaua

SEQ ID NO: 626591 - RNA, 19 nt, Homo sapiens
cuaccagccuuacaacaug

SEQ ID NO: 626592 - RNA, 19 nt, Homo sapiens
ugaaccgcaugaagaguaa

SEQ ID NO: 626593 - RNA, 19 nt, Homo sapiens
agacagaaguccacguaca

SEQ ID NO: 626594 - RNA, 19 nt, Homo sapiens
guaacaagauccuguaccu

SEQ ID NO: 626595 - RNA, 19 nt, Homo sapiens
agagacaaguggagguaaa

SEQ ID NO: 626596 - RNA, 19 nt, Homo sapiens
gaaagucaacgacaagaac

SEQ ID NO: 626597 - RNA, 19 nt, Homo sapiens
gacagacucucagcccauu

SEQ ID NO: 626598 - RNA, 19 nt, Homo sapiens
gagguaaacguccguaaca

SEQ ID NO: 626599 - RNA, 19 nt, Homo sapiens
cauguuugcugccgagaga

SEQ ID NO: 626600 - RNA, 19 nt, Homo sapiens
cauggaaucugugguaaag

SEQ ID NO: 626601 - RNA, 19 nt, Homo sapiens
gcucauuucauucgacuga

SEQ ID NO: 626602 - RNA, 19 nt, Homo sapiens
gugaaccgcaugaagagua

SEQ ID NO: 626603 - RNA, 19 nt, Homo sapiens
ccagcagccuguacucuuc

SEQ ID NO: 626604 - RNA, 19 nt, Homo sapiens
acgagcagcugaacaggaa

SEQ ID NO: 626605 - RNA, 19 nt, Homo sapiens
ccagccagcuccuguugga

SEQ ID NO: 626606 - RNA, 19 nt, Homo sapiens
caggacaccuaccagauca

SEQ ID NO: 626607 - RNA, 19 nt, Homo sapiens
aaagaacuguggccagaca

SEQ ID NO: 626608 - RNA, 19 nt, Homo sapiens
cuacugcagucccugaguu

SEQ ID NO: 626609 - RNA, 19 nt, Homo sapiens
ggcagaagaagcaggagua

SEQ ID NO: 626610 - RNA, 19 nt, Homo sapiens
ggaacuacugggagaagaa

SEQ ID NO: 626611 - RNA, 19 nt, Homo sapiens
aggcccagcucauuucauu

SEQ ID NO: 626612 - RNA, 19 nt, Homo sapiens
gcgaagagcaccgggagaa

SEQ ID NO: 626613 - RNA, 19 nt, Homo sapiens
ugagacagaaguccacgua

SEQ ID NO: 626614 - RNA, 19 nt, Homo sapiens
ggaguaacacuacauacag

SEQ ID NO: 626615 - RNA, 19 nt, Homo sapiens
gaagcagacgguccagaug

SEQ ID NO: 626616 - RNA, 19 nt, Homo sapiens
ccaacaagcagaccaugga

SEQ ID NO: 626617 - RNA, 19 nt, Homo sapiens
ccacagcgggcuaccagaa

SEQ ID NO: 626618 - RNA, 19 nt, Homo sapiens
gagcgcaggcuguacuaug

SEQ ID NO: 626619 - RNA, 19 nt, Homo sapiens
aaaguguucuuccaaguac

SEQ ID NO: 626620 - RNA, 19 nt, Homo sapiens
aaugguacagcgauaauaa

SEQ ID NO: 626621 - RNA, 19 nt, Homo sapiens
ugugagagguggcaggaau

SEQ ID NO: 626622 - RNA, 19 nt, Homo sapiens
aaacguccguaacaagauc

SEQ ID NO: 626623 - RNA, 19 nt, Homo sapiens
ggacacacaagcaaaauau

SEQ ID NO: 626624 - RNA, 19 nt, Homo sapiens
gaacgagcccaaguacaag

SEQ ID NO: 626625 - RNA, 19 nt, Homo sapiens
gcuaccagccuuacaacau

SEQ ID NO: 626626 - RNA, 19 nt, Homo sapiens
gccgcagcaucaccaauga

SEQ ID NO: 626627 - RNA, 19 nt, Homo sapiens
ggacaccuaccagaucaug

SEQ ID NO: 626628 - RNA, 19 nt, Homo sapiens
augaugagguggccaacaa

SEQ ID NO: 626629 - RNA, 19 nt, Homo sapiens
aggacaagcuggcacagau

SEQ ID NO: 626630 - RNA, 19 nt, Homo sapiens
gaaggaggugcgcgugugu

SEQ ID NO: 626631 - RNA, 19 nt, Homo sapiens
gguggacgcugaggaaugc

SEQ ID NO: 626632 - RNA, 19 nt, Homo sapiens
gguaaacguccguaacaag

SEQ ID NO: 626633 - RNA, 19 nt, Homo sapiens
gcaugaagaguaaccacau

SEQ ID NO: 626634 - RNA, 19 nt, Homo sapiens
aaggagaggcugagacaga

SEQ ID NO: 626635 - RNA, 19 nt, Homo sapiens
ggccagacaguucaugaug

SEQ ID NO: 626636 - RNA, 19 nt, Homo sapiens
gaguuagucucugcuuucu

SEQ ID NO: 626637 - RNA, 19 nt, Homo sapiens
cagcgaggcccagcucauu

SEQ ID NO: 626638 - RNA, 19 nt, Homo sapiens
ggagaaggagcggcagaug

SEQ ID NO: 626639 - RNA, 19 nt, Homo sapiens
ugagugcccugcgcgaaga

SEQ ID NO: 626640 - RNA, 19 nt, Homo sapiens
ggacaagcuggcacagauc

SEQ ID NO: 626641 - RNA, 19 nt, Homo sapiens
gaccagccagcuccuguug

SEQ ID NO: 626642 - RNA, 19 nt, Homo sapiens
ucaagaagaaagucaacga

SEQ ID NO: 626643 - RNA, 19 nt, Homo sapiens
cagaaugguacagcgauaa

SEQ ID NO: 626644 - RNA, 19 nt, Homo sapiens
gucauggaaucugugguaa

SEQ ID NO: 626645 - RNA, 19 nt, Homo sapiens
ggugagugccuacauguac

SEQ ID NO: 626646 - RNA, 19 nt, Homo sapiens
ggagagccacgagcaguuc

SEQ ID NO: 626647 - RNA, 19 nt, Homo sapiens
aggagaggcugagacagaa

SEQ ID NO: 626648 - RNA, 19 nt, Homo sapiens
acaccuaccagaucaugaa

SEQ ID NO: 626649 - RNA, 19 nt, Homo sapiens
ugaguuagucucugcuuuc

SEQ ID NO: 626650 - RNA, 19 nt, Homo sapiens
agcgcaggcuguacuauga

SEQ ID NO: 626651 - RNA, 19 nt, Homo sapiens
gugaauuccaucaagaaga

SEQ ID NO: 626652 - RNA, 19 nt, Homo sapiens
gaacuacugggagaagaag

SEQ ID NO: 626653 - RNA, 19 nt, Homo sapiens
agucagaggcggaggagaa

SEQ ID NO: 626654 - RNA, 19 nt, Homo sapiens
acaagauccuguaccugau

SEQ ID NO: 626655 - RNA, 19 nt, Homo sapiens
uaacacuacauacaguuca

SEQ ID NO: 626656 - RNA, 19 nt, Homo sapiens
guaacacuacauacaguuc

SEQ ID NO: 626657 - RNA, 19 nt, Homo sapiens
cuuacaacaugcagaaucu

SEQ ID NO: 626658 - RNA, 19 nt, Homo sapiens
acccacacgucgccuugua

SEQ ID NO: 626659 - RNA, 19 nt, Homo sapiens
aaagagagcgaugccaugu

SEQ ID NO: 626660 - RNA, 19 nt, Homo sapiens
ccuaccagaucaugaaggu

SEQ ID NO: 626661 - RNA, 19 nt, Homo sapiens
ccaggacaccuaccagauc

SEQ ID NO: 626662 - RNA, 19 nt, Homo sapiens
ggagguaaacguccguaac

SEQ ID NO: 626663 - RNA, 19 nt, Homo sapiens
gcgaggcccagcucauuuc

SEQ ID NO: 626664 - RNA, 19 nt, Homo sapiens
ggccgcagcaucaccaaug

SEQ ID NO: 626665 - RNA, 19 nt, Homo sapiens
cugaguuagucucugcuuu

SEQ ID NO: 626666 - RNA, 19 nt, Homo sapiens
cggaguaacacuacauaca

SEQ ID NO: 626667 - RNA, 19 nt, Homo sapiens
ggaaauagcugaaaugaaa

SEQ ID NO: 626668 - RNA, 19 nt, Homo sapiens
gagaaacaguggaauauuu

SEQ ID NO: 626669 - RNA, 19 nt, Homo sapiens
ggacacagauuuaucaaga

SEQ ID NO: 626670 - RNA, 19 nt, Homo sapiens
gggaagagacauuaaauua

SEQ ID NO: 626671 - RNA, 19 nt, Homo sapiens
gaaaucaccuggcuugguu

SEQ ID NO: 626672 - RNA, 19 nt, Homo sapiens
ggacgaaccugugaagaaa

SEQ ID NO: 626673 - RNA, 19 nt, Homo sapiens
gaagaagaccgugaacuua

SEQ ID NO: 626674 - RNA, 19 nt, Homo sapiens
gaaguggcuugauugcuua

SEQ ID NO: 626675 - RNA, 19 nt, Homo sapiens
gaaguggcuugauugcuua

SEQ ID NO: 626676 - RNA, 19 nt, Homo sapiens
gaaagaaacuccguuccuu

SEQ ID NO: 626677 - RNA, 19 nt, Homo sapiens
ggaaagaagggaaaugaaa

SEQ ID NO: 626678 - RNA, 19 nt, Homo sapiens
ucacagagccggagacauu

SEQ ID NO: 626679 - RNA, 19 nt, Homo sapiens
gagggucucugacaacauu

SEQ ID NO: 626680 - RNA, 19 nt, Homo sapiens
caaaaggacuuaauucuug

SEQ ID NO: 626681 - RNA, 19 nt, Homo sapiens
gaggaaacacugucuauga

SEQ ID NO: 626682 - RNA, 19 nt, Homo sapiens
caaaaggacuuaauucuug

SEQ ID NO: 626683 - RNA, 19 nt, Homo sapiens
uaucaggauuuccgcauua

SEQ ID NO: 626684 - RNA, 19 nt, Homo sapiens
ggaaacacugucuaugaua

SEQ ID NO: 626685 - RNA, 19 nt, Homo sapiens
gaagauguacuacuguuug

SEQ ID NO: 626686 - RNA, 19 nt, Homo sapiens
agaaagcucugaagacgaa

SEQ ID NO: 626687 - RNA, 19 nt, Homo sapiens
uggcagagaugaacuaaau

SEQ ID NO: 626688 - RNA, 19 nt, Homo sapiens
ugaaguggcuugauugcuu

SEQ ID NO: 626689 - RNA, 19 nt, Homo sapiens
ugaaguggcuugauugcuu

SEQ ID NO: 626690 - RNA, 19 nt, Homo sapiens
gagaagagccaauuuuaua

SEQ ID NO: 626691 - RNA, 19 nt, Homo sapiens
gaaauuggcuucaaaagag

SEQ ID NO: 626692 - RNA, 19 nt, Homo sapiens
acacugacuuuccuuauga

SEQ ID NO: 626693 - RNA, 19 nt, Homo sapiens
gcagagaugaacuaaauga

SEQ ID NO: 626694 - RNA, 19 nt, Homo sapiens
aaacauuccuggcaaagug

SEQ ID NO: 626695 - RNA, 19 nt, Homo sapiens
aaagguccauccagaaauu

SEQ ID NO: 626696 - RNA, 19 nt, Homo sapiens
gagcagugaugaggauaaa

SEQ ID NO: 626697 - RNA, 19 nt, Homo sapiens
caaagaagcaacagcaaga

SEQ ID NO: 626698 - RNA, 19 nt, Homo sapiens
ccaagugacucaggagauu

SEQ ID NO: 626699 - RNA, 19 nt, Homo sapiens
ugacucagguugaccaaga

SEQ ID NO: 626700 - RNA, 19 nt, Homo sapiens
gugaugaggauaaagaaua

SEQ ID NO: 626701 - RNA, 19 nt, Homo sapiens
gauaggauuuccaaaagua

SEQ ID NO: 626702 - RNA, 19 nt, Homo sapiens
gaggauaucacucuucaga

SEQ ID NO: 626703 - RNA, 19 nt, Homo sapiens
gaaauuugggagguuaaua

SEQ ID NO: 626704 - RNA, 19 nt, Homo sapiens
ugacuugucucaccuucaa

SEQ ID NO: 626705 - RNA, 19 nt, Homo sapiens
gcagugaugaggauaaaga

SEQ ID NO: 626706 - RNA, 19 nt, Homo sapiens
acagugaaguggcuugauu

SEQ ID NO: 626707 - RNA, 19 nt, Homo sapiens
acagugaaguggcuugauu

SEQ ID NO: 626708 - RNA, 19 nt, Homo sapiens
gaagcaacagcaagagaaa

SEQ ID NO: 626709 - RNA, 19 nt, Homo sapiens
ggacaaaagaguaaaauga

SEQ ID NO: 626710 - RNA, 19 nt, Homo sapiens
ucaccuggcuugguuggua

SEQ ID NO: 626711 - RNA, 19 nt, Homo sapiens
ggagaaauaugggagaaac

SEQ ID NO: 626712 - RNA, 19 nt, Homo sapiens
ccaaagguccauccagaaa

SEQ ID NO: 626713 - RNA, 19 nt, Homo sapiens
gaaaagaucaggauucugu

SEQ ID NO: 626714 - RNA, 19 nt, Homo sapiens
aaacauugccuugcuauau

SEQ ID NO: 626715 - RNA, 19 nt, Homo sapiens
aaacauugccuugcuauau

SEQ ID NO: 626716 - RNA, 19 nt, Homo sapiens
ugaaacuccuguggaagua

SEQ ID NO: 626717 - RNA, 19 nt, Homo sapiens
caggauuuccgcauuauaa

SEQ ID NO: 626718 - RNA, 19 nt, Homo sapiens
gaugaaagcaccauguauc

SEQ ID NO: 626719 - RNA, 19 nt, Homo sapiens
ccaaucuucugaacguaaa

SEQ ID NO: 626720 - RNA, 19 nt, Homo sapiens
ugaagaagaccgugaacuu

SEQ ID NO: 626721 - RNA, 19 nt, Homo sapiens
ggagaaacaguggaauauu

SEQ ID NO: 626722 - RNA, 19 nt, Homo sapiens
gcguaaaggacacagauuu

SEQ ID NO: 626723 - RNA, 19 nt, Homo sapiens
acaugaaacuccuguggaa

SEQ ID NO: 626724 - RNA, 19 nt, Homo sapiens
guacuacuguuugccauuc

SEQ ID NO: 626725 - RNA, 19 nt, Homo sapiens
aaguagaacucaugacuca

SEQ ID NO: 626726 - RNA, 19 nt, Homo sapiens
aacauugccuugcuauauu

SEQ ID NO: 626727 - RNA, 19 nt, Homo sapiens
aacauugccuugcuauauu

SEQ ID NO: 626728 - RNA, 19 nt, Homo sapiens
gacacagauuuaucaagaa

SEQ ID NO: 626729 - RNA, 19 nt, Homo sapiens
gaggaaaaccuauuugauu

SEQ ID NO: 626730 - RNA, 19 nt, Homo sapiens
acaaagaccaggaugaaga

SEQ ID NO: 626731 - RNA, 19 nt, Homo sapiens
caaagaccaggaugaagaa

SEQ ID NO: 626732 - RNA, 19 nt, Homo sapiens
gaaagaagggaaaugaaaa

SEQ ID NO: 626733 - RNA, 19 nt, Homo sapiens
uauuuaggauugugucuug

SEQ ID NO: 626734 - RNA, 19 nt, Homo sapiens
guggacaguuaaaugcuaa

SEQ ID NO: 626735 - RNA, 19 nt, Homo sapiens
uagaggaaacacuaugaua

SEQ ID NO: 626736 - RNA, 19 nt, Homo sapiens
guggacaguuaaaugcuaa

SEQ ID NO: 626737 - RNA, 19 nt, Homo sapiens
ggaaguagaacucaugacu

SEQ ID NO: 626738 - RNA, 19 nt, Homo sapiens
acaccaccaugacaaacua

SEQ ID NO: 626739 - RNA, 19 nt, Homo sapiens
agacuuugcuguagaugau

SEQ ID NO: 626740 - RNA, 19 nt, Homo sapiens
uauauuacaggccaaauga

SEQ ID NO: 626741 - RNA, 19 nt, Homo sapiens
uagaugauccacaugauga

SEQ ID NO: 626742 - RNA, 19 nt, Homo sapiens
ugaagacgaaggagaauau

SEQ ID NO: 626743 - RNA, 19 nt, Homo sapiens
ggaagaaagcucugaagac

SEQ ID NO: 626744 - RNA, 19 nt, Homo sapiens
gagagguuaauaccaagua

SEQ ID NO: 626745 - RNA, 19 nt, Homo sapiens
aaguauuuguggacaguua

SEQ ID NO: 626746 - RNA, 19 nt, Homo sapiens
aaguauuuguggacaguua

SEQ ID NO: 626747 - RNA, 19 nt, Homo sapiens
guaucaggauuuccgcauu

SEQ ID NO: 626748 - RNA, 19 nt, Homo sapiens
uuucaugcauuccaaagaa

SEQ ID NO: 626749 - RNA, 19 nt, Homo sapiens
gggagaaacaguggaauau

SEQ ID NO: 626750 - RNA, 19 nt, Homo sapiens
cauugauacuugucagaaa

SEQ ID NO: 626751 - RNA, 19 nt, Homo sapiens
gauugugucuugaaaacua

SEQ ID NO: 626752 - RNA, 19 nt, Homo sapiens
gaacagugaaguggcuuga

SEQ ID NO: 626753 - RNA, 19 nt, Homo sapiens
uaaaguauuuguggacagu

SEQ ID NO: 626754 - RNA, 19 nt, Homo sapiens
gaacagugaaguggcuuga

SEQ ID NO: 626755 - RNA, 19 nt, Homo sapiens
cugacaacauuaagaaaga

SEQ ID NO: 626756 - RNA, 19 nt, Homo sapiens
gaccgugaacuuaucauga

SEQ ID NO: 626757 - RNA, 19 nt, Homo sapiens
ccaaugaaacgaggacaaa

SEQ ID NO: 626758 - RNA, 19 nt, Homo sapiens
ugacucaggagauuuagaa

SEQ ID NO: 626759 - RNA, 19 nt, Homo sapiens
gaggauaaagaauaacaug

SEQ ID NO: 626760 - RNA, 19 nt, Homo sapiens
uuugagagguuaauaccaa

SEQ ID NO: 626761 - RNA, 19 nt, Homo sapiens
ccaugacaaacuacaaaua

SEQ ID NO: 626762 - RNA, 19 nt, Homo sapiens
cuugaaauuugagagguua

SEQ ID NO: 626763 - RNA, 19 nt, Homo sapiens
uagaagcguuagagggaaa

SEQ ID NO: 626764 - RNA, 19 nt, Homo sapiens
cuaauucuagugacaguaa

SEQ ID NO: 626765 - RNA, 19 nt, Homo sapiens
aggagaauaugaagagguu

SEQ ID NO: 626766 - RNA, 19 nt, Homo sapiens
ugguaagucuacuguauau

SEQ ID NO: 626767 - RNA, 19 nt, Homo sapiens
gguaacaacuucuccagua

SEQ ID NO: 626768 - RNA, 19 nt, Homo sapiens
ggaagucacugucccacua

SEQ ID NO: 626769 - RNA, 19 nt, Homo sapiens
gcagagggcuccagguucu

SEQ ID NO: 626770 - RNA, 19 nt, Homo sapiens
cagcuuccauuucuauaaa

SEQ ID NO: 626771 - RNA, 19 nt, Homo sapiens
ggaggaagccaucaucuca

SEQ ID NO: 626772 - RNA, 19 nt, Homo sapiens
guaacaacuucuccaguau

SEQ ID NO: 626773 - RNA, 19 nt, Homo sapiens
gcacuugggucgcugugau

SEQ ID NO: 626774 - RNA, 19 nt, Homo sapiens
gagcccagcuuccauuucu

SEQ ID NO: 626775 - RNA, 19 nt, Homo sapiens
aaagugauuucguaccaaa

SEQ ID NO: 626776 - RNA, 19 nt, Homo sapiens
ucgcugugauugugaauaa

SEQ ID NO: 626777 - RNA, 19 nt, Homo sapiens
gggcaggcuuucuguguga

SEQ ID NO: 626778 - RNA, 19 nt, Homo sapiens
gcaaacagugucuauuuua

SEQ ID NO: 626779 - RNA, 19 nt, Homo sapiens
ggaggugucuguaguccau

SEQ ID NO: 626780 - RNA, 19 nt, Homo sapiens
ggacagggagaccuuguga

SEQ ID NO: 626781 - RNA, 19 nt, Homo sapiens
aaaccaagccuccuuagug

SEQ ID NO: 626782 - RNA, 19 nt, Homo sapiens
gagcuggguuaucaugguu

SEQ ID NO: 626783 - RNA, 19 nt, Homo sapiens
uagaaaugcugccuuugug

SEQ ID NO: 626784 - RNA, 19 nt, Homo sapiens
cugaggaguuugccaauga

SEQ ID NO: 626785 - RNA, 19 nt, Homo sapiens
ggcugaagaucaccaagaa

SEQ ID NO: 626786 - RNA, 19 nt, Homo sapiens
ggaagccaucaucucauua

SEQ ID NO: 626787 - RNA, 19 nt, Homo sapiens
ccaugucucucucccacua

SEQ ID NO: 626788 - RNA, 19 nt, Homo sapiens
gaucucagccugcccuaau

SEQ ID NO: 626789 - RNA, 19 nt, Homo sapiens
cugacucgcugcccaagua

SEQ ID NO: 626790 - RNA, 19 nt, Homo sapiens
uggcaaacagugucuauuu

SEQ ID NO: 626791 - RNA, 19 nt, Homo sapiens
uaccuucucuuucuucguu

SEQ ID NO: 626792 - RNA, 19 nt, Homo sapiens
ccgcagaacucacucaacu

SEQ ID NO: 626793 - RNA, 19 nt, Homo sapiens
ggacgucaaacuucuagga

SEQ ID NO: 626794 - RNA, 19 nt, Homo sapiens
caacgacucggcuguuaug

SEQ ID NO: 626795 - RNA, 19 nt, Homo sapiens
gcaggcagggcauggguuu

SEQ ID NO: 626796 - RNA, 19 nt, Homo sapiens
aagaacagguuugcagcua

SEQ ID NO: 626797 - RNA, 19 nt, Homo sapiens
aggaagccaucaucucauu

SEQ ID NO: 626798 - RNA, 19 nt, Homo sapiens
cauaaggacgucaaacuuc

SEQ ID NO: 626799 - RNA, 19 nt, Homo sapiens
gcucccagauccucaugga

SEQ ID NO: 626800 - RNA, 19 nt, Homo sapiens
uaucaugguuggcuuaggu

SEQ ID NO: 626801 - RNA, 19 nt, Homo sapiens
ggcaaacagugucuauuuu

SEQ ID NO: 626802 - RNA, 19 nt, Homo sapiens
gggcuaaauugggaucuca

SEQ ID NO: 626803 - RNA, 19 nt, Homo sapiens
gcgaugagugcaccauuug

SEQ ID NO: 626804 - RNA, 19 nt, Homo sapiens
gaagucacugucccacuau

SEQ ID NO: 626805 - RNA, 19 nt, Homo sapiens
ccauaaggacgucaaacuu

SEQ ID NO: 626806 - RNA, 19 nt, Homo sapiens
ggcaaaccaagccuccuua

SEQ ID NO: 626807 - RNA, 19 nt, Homo sapiens
ggaaacugaagcccuugaa

SEQ ID NO: 626808 - RNA, 19 nt, Homo sapiens
ggucuccacuacccaguca

SEQ ID NO: 626809 - RNA, 19 nt, Homo sapiens
gaagccaucaucucauuac

SEQ ID NO: 626810 - RNA, 19 nt, Homo sapiens
gggccuaggcugauaguca

SEQ ID NO: 626811 - RNA, 19 nt, Homo sapiens
gcguccagcugcuugauag

SEQ ID NO: 626812 - RNA, 19 nt, Homo sapiens
ccagcuuccauuucuauaa

SEQ ID NO: 626813 - RNA, 19 nt, Homo sapiens
uuacagagaggcaaaccaa

SEQ ID NO: 626814 - RNA, 19 nt, Homo sapiens
cuagaaaugcugccuuugu

SEQ ID NO: 626815 - RNA, 19 nt, Homo sapiens
cccuagaaaugcugccuuu

SEQ ID NO: 626816 - RNA, 19 nt, Homo sapiens
ccauguggcaccuuuguga

SEQ ID NO: 626817 - RNA, 19 nt, Homo sapiens
gcaacaucaucgcauucug

SEQ ID NO: 626818 - RNA, 19 nt, Homo sapiens
ccuccagguucucuaaguu

SEQ ID NO: 626819 - RNA, 19 nt, Homo sapiens
gggccaguguuccuagugu

SEQ ID NO: 626820 - RNA, 19 nt, Homo sapiens
gcuacccucucugaccuuu

SEQ ID NO: 626821 - RNA, 19 nt, Homo sapiens
gcaccuuugugagaauuag

SEQ ID NO: 626822 - RNA, 19 nt, Homo sapiens
gcccuaaucuuuccccauu

SEQ ID NO: 626823 - RNA, 19 nt, Homo sapiens
gugcaccauuugcuaugaa

SEQ ID NO: 626824 - RNA, 19 nt, Homo sapiens
ggccggaugccauggguaa

SEQ ID NO: 626825 - RNA, 19 nt, Homo sapiens
ucuaggaggugucuguagu

SEQ ID NO: 626826 - RNA, 19 nt, Homo sapiens
acagggagaccuugugaug

SEQ ID NO: 626827 - RNA, 19 nt, Homo sapiens
uguacagccugcucaacaa

SEQ ID NO: 626828 - RNA, 19 nt, Homo sapiens
gaaacugaagcccuugaag

SEQ ID NO: 626829 - RNA, 19 nt, Homo sapiens
ucaagggcaucaucaagac

SEQ ID NO: 626830 - RNA, 19 nt, Homo sapiens
gcaacgccaucaccuucag

SEQ ID NO: 626831 - RNA, 19 nt, Homo sapiens
ggagagaggggcaggcuuu

SEQ ID NO: 626832 - RNA, 19 nt, Homo sapiens
acacggucaucuacacaug

SEQ ID NO: 626833 - RNA, 19 nt, Homo sapiens
gcuguuaugcuguucuuca

SEQ ID NO: 626834 - RNA, 19 nt, Homo sapiens
uaaggacgucaaacuucua

SEQ ID NO: 626835 - RNA, 19 nt, Homo sapiens
auaaggacgucaaacuucu

SEQ ID NO: 626836 - RNA, 19 nt, Homo sapiens
ucauggaccucagccacaa

SEQ ID NO: 626837 - RNA, 19 nt, Homo sapiens
gcaaaccaagccuccuuag

SEQ ID NO: 626838 - RNA, 19 nt, Homo sapiens
ucagccaacugcccuugug

SEQ ID NO: 626839 - RNA, 19 nt, Homo sapiens
uaacaacuucuccaguauc

SEQ ID NO: 626840 - RNA, 19 nt, Homo sapiens
ggacacggucaucuacaca

SEQ ID NO: 626841 - RNA, 19 nt, Homo sapiens
cugcuucccuugugcacuu

SEQ ID NO: 626842 - RNA, 19 nt, Homo sapiens
ugccauggguaacaacuuc

SEQ ID NO: 626843 - RNA, 19 nt, Homo sapiens
gguuaucaugguuggcuua

SEQ ID NO: 626844 - RNA, 19 nt, Homo sapiens
ucaagaggcaggccagcuu

SEQ ID NO: 626845 - RNA, 19 nt, Homo sapiens
ggguagcccuucgguaugg

SEQ ID NO: 626846 - RNA, 19 nt, Homo sapiens
agcgaugagugcaccauuu

SEQ ID NO: 626847 - RNA, 19 nt, Homo sapiens
gagcgaugagugcaccauu

SEQ ID NO: 626848 - RNA, 19 nt, Homo sapiens
ccacuaugggucuccacua

SEQ ID NO: 626849 - RNA, 19 nt, Homo sapiens
gcaagggcugccucuaaca

SEQ ID NO: 626850 - RNA, 19 nt, Homo sapiens
gcccgguccucaucuacga

SEQ ID NO: 626851 - RNA, 19 nt, Homo sapiens
uauuaaacaugggaaacug

SEQ ID NO: 626852 - RNA, 19 nt, Homo sapiens
uaaaagugauuucguacca

SEQ ID NO: 626853 - RNA, 19 nt, Homo sapiens
gcccagcuuccauuucuau

SEQ ID NO: 626854 - RNA, 19 nt, Homo sapiens
ggcgcugccugaggaguuu

SEQ ID NO: 626855 - RNA, 19 nt, Homo sapiens
aggcagucauaaugcagua

SEQ ID NO: 626856 - RNA, 19 nt, Homo sapiens
gcaugcugagggcuaaauu

SEQ ID NO: 626857 - RNA, 19 nt, Homo sapiens
caaaccaagccuccuuagu

SEQ ID NO: 626858 - RNA, 19 nt, Homo sapiens
gcagucauaaugcaguauc

SEQ ID NO: 626859 - RNA, 19 nt, Homo sapiens
gaugccaccacaagcagaa

SEQ ID NO: 626860 - RNA, 19 nt, Homo sapiens
caucaagggcaucaucaag

SEQ ID NO: 626861 - RNA, 19 nt, Homo sapiens
aucaacgacucggcuguua

SEQ ID NO: 626862 - RNA, 19 nt, Homo sapiens
ucagccugcccuaaucuuu

SEQ ID NO: 626863 - RNA, 19 nt, Homo sapiens
ugagugcaccauuugcuau

SEQ ID NO: 626864 - RNA, 19 nt, Homo sapiens
cacuaugggucuccacuac

SEQ ID NO: 626865 - RNA, 19 nt, Homo sapiens
caaacagugucuauuuuac

SEQ ID NO: 626866 - RNA, 19 nt, Homo sapiens
guguacagccugcucaaca

SEQ ID NO: 626867 - RNA, 19 nt, Homo sapiens
gaaauugacucgcucauug

SEQ ID NO: 626868 - RNA, 19 nt, Homo sapiens
acacggagaugaaguacua

SEQ ID NO: 626869 - RNA, 19 nt, Homo sapiens
gagaugaaguacuauauag

SEQ ID NO: 626870 - RNA, 19 nt, Homo sapiens
cgaaagaacucaggaagga

SEQ ID NO: 626871 - RNA, 19 nt, Homo sapiens
cagaggaucuaccaguaua

SEQ ID NO: 626872 - RNA, 19 nt, Homo sapiens
ggagaugaaguacuauaua

SEQ ID NO: 626873 - RNA, 19 nt, Homo sapiens
ggugaggccugcacugauu

SEQ ID NO: 626874 - RNA, 19 nt, Homo sapiens
gcacaucaaugagguauac

SEQ ID NO: 626875 - RNA, 19 nt, Homo sapiens
gcacggcacugcucuuucu

SEQ ID NO: 626876 - RNA, 19 nt, Homo sapiens
ccaaugaggucgaccagau

SEQ ID NO: 626877 - RNA, 19 nt, Homo sapiens
gcaacaagaaggagaagaa

SEQ ID NO: 626878 - RNA, 19 nt, Homo sapiens
gccagaggaucuaccagua

SEQ ID NO: 626879 - RNA, 19 nt, Homo sapiens
ccaucaagaucaucaagaa

SEQ ID NO: 626880 - RNA, 19 nt, Homo sapiens
uauuugagcugcuguccua

SEQ ID NO: 626881 - RNA, 19 nt, Homo sapiens
cgacaaccaugacuacauc

SEQ ID NO: 626882 - RNA, 19 nt, Homo sapiens
ucaaugagguauacuaugc

SEQ ID NO: 626883 - RNA, 19 nt, Homo sapiens
gcccaaggcucgcaaguac

SEQ ID NO: 626884 - RNA, 19 nt, Homo sapiens
ccuacgaccuggccauuga

SEQ ID NO: 626885 - RNA, 19 nt, Homo sapiens
ggugaaagccuaugaucau

SEQ ID NO: 626886 - RNA, 19 nt, Homo sapiens
agaagaagguccugaacca

SEQ ID NO: 626887 - RNA, 19 nt, Homo sapiens
ccuacaagcacaucaauga

SEQ ID NO: 626888 - RNA, 19 nt, Homo sapiens
gcagcgccaucaagauugu

SEQ ID NO: 626889 - RNA, 19 nt, Homo sapiens
ucaagaucaucaagaacaa

SEQ ID NO: 626890 - RNA, 19 nt, Homo sapiens
ggacgaaagaacucaggaa

SEQ ID NO: 626891 - RNA, 19 nt, Homo sapiens
ggaccuaccgcuacagcaa

SEQ ID NO: 626892 - RNA, 19 nt, Homo sapiens
ccaucaagauuguggacuu

SEQ ID NO: 626893 - RNA, 19 nt, Homo sapiens
aaagaacucaggaaggauu

SEQ ID NO: 626894 - RNA, 19 nt, Homo sapiens
cgaaauugacucgcucauu

SEQ ID NO: 626895 - RNA, 19 nt, Homo sapiens
ccaaggcucgcaaguacuu

SEQ ID NO: 626896 - RNA, 19 nt, Homo sapiens
uauacuaugcgaagaagaa

SEQ ID NO: 626897 - RNA, 19 nt, Homo sapiens
caucaaugagguauacuau

SEQ ID NO: 626898 - RNA, 19 nt, Homo sapiens
gaccagaugaaccgcauug

SEQ ID NO: 626899 - RNA, 19 nt, Homo sapiens
gcuggagcgcuacgaaauu

SEQ ID NO: 626900 - RNA, 19 nt, Homo sapiens
caucaagauuguggacuuc

SEQ ID NO: 626901 - RNA, 19 nt, Homo sapiens
gagcucagcaucauucacu

SEQ ID NO: 626902 - RNA, 19 nt, Homo sapiens
cuacagcaaccgauauugu

SEQ ID NO: 626903 - RNA, 19 nt, Homo sapiens
gaaccaggcccagauugag

SEQ ID NO: 626904 - RNA, 19 nt, Homo sapiens
ugaaccaggcccagauuga

SEQ ID NO: 626905 - RNA, 19 nt, Homo sapiens
gugaaagccuaugaucauc

SEQ ID NO: 626906 - RNA, 19 nt, Homo sapiens
cuggagcgcuacgaaauug

SEQ ID NO: 626907 - RNA, 19 nt, Homo sapiens
ccagcuccaucuccaguuc

SEQ ID NO: 626908 - RNA, 19 nt, Homo sapiens
gguauacuaugcgaagaag

SEQ ID NO: 626909 - RNA, 19 nt, Homo sapiens
gagguauacuaugcgaaga

SEQ ID NO: 626910 - RNA, 19 nt, Homo sapiens
cgaccuggccauugacaug

SEQ ID NO: 626911 - RNA, 19 nt, Homo sapiens
ccagaggaucuaccaguau

SEQ ID NO: 626912 - RNA, 19 nt, Homo sapiens
ccucaucucucuccuugac

SEQ ID NO: 626913 - RNA, 19 nt, Homo sapiens
gaaagaacucaggaaggau

SEQ ID NO: 626914 - RNA, 19 nt, Homo sapiens
ggagcacacgcagguauug

SEQ ID NO: 626915 - RNA, 19 nt, Homo sapiens
ccaccugugccugguauuu

SEQ ID NO: 626916 - RNA, 19 nt, Homo sapiens
gaagaagguccugaaccau

SEQ ID NO: 626917 - RNA, 19 nt, Homo sapiens
cagcaugacacggagauga

SEQ ID NO: 626918 - RNA, 19 nt, Homo sapiens
caagaucaucaagaacaaa

SEQ ID NO: 626919 - RNA, 19 nt, Homo sapiens
ccagaugaaccgcauugug

SEQ ID NO: 626920 - RNA, 19 nt, Homo sapiens
acaagaaggagaagaaggu

SEQ ID NO: 626921 - RNA, 19 nt, Homo sapiens
gcucgcaaguacuuugaac

SEQ ID NO: 626922 - RNA, 19 nt, Homo sapiens
ccucuucaguggcuccaau

SEQ ID NO: 626923 - RNA, 19 nt, Homo sapiens
caaugaggucgaccagaug

SEQ ID NO: 626924 - RNA, 19 nt, Homo sapiens
ggagaagaagguccugaac

SEQ ID NO: 626925 - RNA, 19 nt, Homo sapiens
caacaagaaggagaagaag

SEQ ID NO: 626926 - RNA, 19 nt, Homo sapiens
gaccuacaagcacaucaau

SEQ ID NO: 626927 - RNA, 19 nt, Homo sapiens
gaggaucuaccaguauauc

SEQ ID NO: 626928 - RNA, 19 nt, Homo sapiens
ugcgcaugcuggaguauga

SEQ ID NO: 626929 - RNA, 19 nt, Homo sapiens
aagaacucaggaaggauua

SEQ ID NO: 626930 - RNA, 19 nt, Homo sapiens
cggagaugaaguacuauau

SEQ ID NO: 626931 - RNA, 19 nt, Homo sapiens
caagcacaucaaugaggua

SEQ ID NO: 626932 - RNA, 19 nt, Homo sapiens
ucucucuccuugacuggaa

SEQ ID NO: 626933 - RNA, 19 nt, Homo sapiens
gcugcauccuuguggagau

SEQ ID NO: 626934 - RNA, 19 nt, Homo sapiens
cgagcaacaagaaggagaa

SEQ ID NO: 626935 - RNA, 19 nt, Homo sapiens
ugacgacaaccaugacuac

SEQ ID NO: 626936 - RNA, 19 nt, Homo sapiens
caggagcacacgcagguau

SEQ ID NO: 626937 - RNA, 19 nt, Homo sapiens
gaaauugacucgcucauug

SEQ ID NO: 626938 - RNA, 19 nt, Homo sapiens
acacggagaugaaguacua

SEQ ID NO: 626939 - RNA, 19 nt, Homo sapiens
gagaugaaguacuauauag

SEQ ID NO: 626940 - RNA, 19 nt, Homo sapiens
cgaaagaacucaggaagga

SEQ ID NO: 626941 - RNA, 19 nt, Homo sapiens
cagaggaucuaccaguaua

SEQ ID NO: 626942 - RNA, 19 nt, Homo sapiens
ggagaugaaguacuauaua

SEQ ID NO: 626943 - RNA, 19 nt, Homo sapiens
ggugaggccugcacugauu

SEQ ID NO: 626944 - RNA, 19 nt, Homo sapiens
gcacaucaaugagguauac

SEQ ID NO: 626945 - RNA, 19 nt, Homo sapiens
gcacggcacugcucuuucu

SEQ ID NO: 626946 - RNA, 19 nt, Homo sapiens
ccaaugaggucgaccagau

SEQ ID NO: 626947 - RNA, 19 nt, Homo sapiens
gcaacaagaaggagaagaa

SEQ ID NO: 626948 - RNA, 19 nt, Homo sapiens
gccagaggaucuaccagua

SEQ ID NO: 626949 - RNA, 19 nt, Homo sapiens
ccaucaagaucaucaagaa

SEQ ID NO: 626950 - RNA, 19 nt, Homo sapiens
uauuugagcugcuguccua

SEQ ID NO: 626951 - RNA, 19 nt, Homo sapiens
cgacaaccaugacuacauc

SEQ ID NO: 626952 - RNA, 19 nt, Homo sapiens
ucaaugagguauacuaugc

SEQ ID NO: 626953 - RNA, 19 nt, Homo sapiens
gcccaaggcucgcaaguac

SEQ ID NO: 626954 - RNA, 19 nt, Homo sapiens
ccuacgaccuggccauuga

SEQ ID NO: 626955 - RNA, 19 nt, Homo sapiens
ggugaaagccuaugaucau

SEQ ID NO: 626956 - RNA, 19 nt, Homo sapiens
agaagaagguccugaacca

SEQ ID NO: 626957 - RNA, 19 nt, Homo sapiens
ccuacaagcacaucaauga

SEQ ID NO: 626958 - RNA, 19 nt, Homo sapiens
gcagcgccaucaagauugu

SEQ ID NO: 626959 - RNA, 19 nt, Homo sapiens
ucaagaucaucaagaacaa

SEQ ID NO: 626960 - RNA, 19 nt, Homo sapiens
ggacgaaagaacucaggaa

SEQ ID NO: 626961 - RNA, 19 nt, Homo sapiens
ggaccuaccgcuacagcaa

SEQ ID NO: 626962 - RNA, 19 nt, Homo sapiens
ccaucaagauuguggacuu

SEQ ID NO: 626963 - RNA, 19 nt, Homo sapiens
cgaaauugacucgcucauu

SEQ ID NO: 626964 - RNA, 19 nt, Homo sapiens
ccaaggcucgcaaguacuu

SEQ ID NO: 626965 - RNA, 19 nt, Homo sapiens
uauacuaugcgaagaagaa

SEQ ID NO: 626966 - RNA, 19 nt, Homo sapiens
caucaaugagguauacuau

SEQ ID NO: 626967 - RNA, 19 nt, Homo sapiens
gaccagaugaaccgcauug

SEQ ID NO: 626968 - RNA, 19 nt, Homo sapiens
gcuggagcgcuacgaaauu

SEQ ID NO: 626969 - RNA, 19 nt, Homo sapiens
caucaagauuguggacuuc

SEQ ID NO: 626970 - RNA, 19 nt, Homo sapiens
gagcucagcaucauucacu

SEQ ID NO: 626971 - RNA, 19 nt, Homo sapiens
cuacagcaaccgauauugu

SEQ ID NO: 626972 - RNA, 19 nt, Homo sapiens
gaaccaggcccagauugag

SEQ ID NO: 626973 - RNA, 19 nt, Homo sapiens
ugaaccaggcccagauuga

SEQ ID NO: 626974 - RNA, 19 nt, Homo sapiens
gugaaagccuaugaucauc

SEQ ID NO: 626975 - RNA, 19 nt, Homo sapiens
cuggagcgcuacgaaauug

SEQ ID NO: 626976 - RNA, 19 nt, Homo sapiens
ccagcuccaucuccaguuc

SEQ ID NO: 626977 - RNA, 19 nt, Homo sapiens
gguauacuaugcgaagaag

SEQ ID NO: 626978 - RNA, 19 nt, Homo sapiens
gagguauacuaugcgaaga

SEQ ID NO: 626979 - RNA, 19 nt, Homo sapiens
cgaccuggccauugacaug

SEQ ID NO: 626980 - RNA, 19 nt, Homo sapiens
ccagaggaucuaccaguau

SEQ ID NO: 626981 - RNA, 19 nt, Homo sapiens
ccucaucucucuccuugac

SEQ ID NO: 626982 - RNA, 19 nt, Homo sapiens
ggagcacacgcagguauug

SEQ ID NO: 626983 - RNA, 19 nt, Homo sapiens
ccaccugugccugguauuu

SEQ ID NO: 626984 - RNA, 19 nt, Homo sapiens
gaagaagguccugaaccau

SEQ ID NO: 626985 - RNA, 19 nt, Homo sapiens
cagcaugacacggagauga

SEQ ID NO: 626986 - RNA, 19 nt, Homo sapiens
caagaucaucaagaacaaa

SEQ ID NO: 626987 - RNA, 19 nt, Homo sapiens
ccagaugaaccgcauugug

SEQ ID NO: 626988 - RNA, 19 nt, Homo sapiens
acaagaaggagaagaaggu

SEQ ID NO: 626989 - RNA, 19 nt, Homo sapiens
gcucgcaaguacuuugaac

SEQ ID NO: 626990 - RNA, 19 nt, Homo sapiens
ccucuucaguggcuccaau

SEQ ID NO: 626991 - RNA, 19 nt, Homo sapiens
caaugaggucgaccagaug

SEQ ID NO: 626992 - RNA, 19 nt, Homo sapiens
ggagaagaagguccugaac

SEQ ID NO: 626993 - RNA, 19 nt, Homo sapiens
caacaagaaggagaagaag

SEQ ID NO: 626994 - RNA, 19 nt, Homo sapiens
gaggaucuaccaguauauc

SEQ ID NO: 626995 - RNA, 19 nt, Homo sapiens
gaccuacaagcacaucaau

SEQ ID NO: 626996 - RNA, 19 nt, Homo sapiens
ugcgcaugcuggaguauga

SEQ ID NO: 626997 - RNA, 19 nt, Homo sapiens
cggagaugaaguacuauau

SEQ ID NO: 626998 - RNA, 19 nt, Homo sapiens
caagcacaucaaugaggua

SEQ ID NO: 626999 - RNA, 19 nt, Homo sapiens
ucucucuccuugacuggaa

SEQ ID NO: 627000 - RNA, 19 nt, Homo sapiens
gcugcauccuuguggagau

SEQ ID NO: 627001 - RNA, 19 nt, Homo sapiens
cgagcaacaagaaggagaa

SEQ ID NO: 627002 - RNA, 19 nt, Homo sapiens
ugacgacaaccaugacuac

SEQ ID NO: 627003 - RNA, 19 nt, Homo sapiens
caggagcacacgcagguau

SEQ ID NO: 627004 - RNA, 19 nt, Homo sapiens
gaaauugacucgcucauug

SEQ ID NO: 627005 - RNA, 19 nt, Homo sapiens
acacggagaugaaguacua

SEQ ID NO: 627006 - RNA, 19 nt, Homo sapiens
gagaugaaguacuauauag

SEQ ID NO: 627007 - RNA, 19 nt, Homo sapiens
cgaaagaacucaggaagga

SEQ ID NO: 627008 - RNA, 19 nt, Homo sapiens
cagaggaucuaccaguaua

SEQ ID NO: 627009 - RNA, 19 nt, Homo sapiens
ggagaugaaguacuauaua

SEQ ID NO: 627010 - RNA, 19 nt, Homo sapiens
ggugaggccugcacugauu

SEQ ID NO: 627011 - RNA, 19 nt, Homo sapiens
gcacaucaaugagguauac

SEQ ID NO: 627012 - RNA, 19 nt, Homo sapiens
gcacggcacugcucuuucu

SEQ ID NO: 627013 - RNA, 19 nt, Homo sapiens
ccaaugaggucgaccagau

SEQ ID NO: 627014 - RNA, 19 nt, Homo sapiens
gcaacaagaaggagaagaa

SEQ ID NO: 627015 - RNA, 19 nt, Homo sapiens
gccagaggaucuaccagua

SEQ ID NO: 627016 - RNA, 19 nt, Homo sapiens
ccaucaagaucaucaagaa

SEQ ID NO: 627017 - RNA, 19 nt, Homo sapiens
uauuugagcugcuguccua

SEQ ID NO: 627018 - RNA, 19 nt, Homo sapiens
cgacaaccaugacuacauc

SEQ ID NO: 627019 - RNA, 19 nt, Homo sapiens
ucaaugagguauacuaugc

SEQ ID NO: 627020 - RNA, 19 nt, Homo sapiens
gcccaaggcucgcaaguac

SEQ ID NO: 627021 - RNA, 19 nt, Homo sapiens
ccuacgaccuggccauuga

SEQ ID NO: 627022 - RNA, 19 nt, Homo sapiens
ggugaaagccuaugaucau

SEQ ID NO: 627023 - RNA, 19 nt, Homo sapiens
agaagaagguccugaacca

SEQ ID NO: 627024 - RNA, 19 nt, Homo sapiens
ccuacaagcacaucaauga

SEQ ID NO: 627025 - RNA, 19 nt, Homo sapiens
gcagcgccaucaagauugu

SEQ ID NO: 627026 - RNA, 19 nt, Homo sapiens
ucaagaucaucaagaacaa

SEQ ID NO: 627027 - RNA, 19 nt, Homo sapiens
ggacgaaagaacucaggaa

SEQ ID NO: 627028 - RNA, 19 nt, Homo sapiens
ggaccuaccgcuacagcaa

SEQ ID NO: 627029 - RNA, 19 nt, Homo sapiens
ccaucaagauuguggacuu

SEQ ID NO: 627030 - RNA, 19 nt, Homo sapiens
aaagaacucaggaaggauu

SEQ ID NO: 627031 - RNA, 19 nt, Homo sapiens
cgaaauugacucgcucauu

SEQ ID NO: 627032 - RNA, 19 nt, Homo sapiens
ccaaggcucgcaaguacuu

SEQ ID NO: 627033 - RNA, 19 nt, Homo sapiens
uauacuaugcgaagaagaa

SEQ ID NO: 627034 - RNA, 19 nt, Homo sapiens
caucaaugagguauacuau

SEQ ID NO: 627035 - RNA, 19 nt, Homo sapiens
gaccagaugaaccgcauug

SEQ ID NO: 627036 - RNA, 19 nt, Homo sapiens
gcuggagcgcuacgaaauu

SEQ ID NO: 627037 - RNA, 19 nt, Homo sapiens
caucaagauuguggacuuc

SEQ ID NO: 627038 - RNA, 19 nt, Homo sapiens
gagcucagcaucauucacu

SEQ ID NO: 627039 - RNA, 19 nt, Homo sapiens
cuacagcaaccgauauugu

SEQ ID NO: 627040 - RNA, 19 nt, Homo sapiens
gaaccaggcccagauugag

SEQ ID NO: 627041 - RNA, 19 nt, Homo sapiens
ugaaccaggcccagauuga

SEQ ID NO: 627042 - RNA, 19 nt, Homo sapiens
gugaaagccuaugaucauc

SEQ ID NO: 627043 - RNA, 19 nt, Homo sapiens
cuggagcgcuacgaaauug

SEQ ID NO: 627044 - RNA, 19 nt, Homo sapiens
ccagcuccaucuccaguuc

SEQ ID NO: 627045 - RNA, 19 nt, Homo sapiens
gguauacuaugcgaagaag

SEQ ID NO: 627046 - RNA, 19 nt, Homo sapiens
gagguauacuaugcgaaga

SEQ ID NO: 627047 - RNA, 19 nt, Homo sapiens
cgaccuggccauugacaug

SEQ ID NO: 627048 - RNA, 19 nt, Homo sapiens
ccagaggaucuaccaguau

SEQ ID NO: 627049 - RNA, 19 nt, Homo sapiens
ccucaucucucuccuugac

SEQ ID NO: 627050 - RNA, 19 nt, Homo sapiens
gaaagaacucaggaaggau

SEQ ID NO: 627051 - RNA, 19 nt, Homo sapiens
ggagcacacgcagguauug

SEQ ID NO: 627052 - RNA, 19 nt, Homo sapiens
ccaccugugccugguauuu

SEQ ID NO: 627053 - RNA, 19 nt, Homo sapiens
gaagaagguccugaaccau

SEQ ID NO: 627054 - RNA, 19 nt, Homo sapiens
cagcaugacacggagauga

SEQ ID NO: 627055 - RNA, 19 nt, Homo sapiens
caagaucaucaagaacaaa

SEQ ID NO: 627056 - RNA, 19 nt, Homo sapiens
ccagaugaaccgcauugug

SEQ ID NO: 627057 - RNA, 19 nt, Homo sapiens
acaagaaggagaagaaggu

SEQ ID NO: 627058 - RNA, 19 nt, Homo sapiens
gcucgcaaguacuuugaac

SEQ ID NO: 627059 - RNA, 19 nt, Homo sapiens
ccucuucaguggcuccaau

SEQ ID NO: 627060 - RNA, 19 nt, Homo sapiens
caaugaggucgaccagaug

SEQ ID NO: 627061 - RNA, 19 nt, Homo sapiens
ggagaagaagguccugaac

SEQ ID NO: 627062 - RNA, 19 nt, Homo sapiens
caacaagaaggagaagaag

SEQ ID NO: 627063 - RNA, 19 nt, Homo sapiens
gaccuacaagcacaucaau

SEQ ID NO: 627064 - RNA, 19 nt, Homo sapiens
gaggaucuaccaguauauc

SEQ ID NO: 627065 - RNA, 19 nt, Homo sapiens
ugcgcaugcuggaguauga

SEQ ID NO: 627066 - RNA, 19 nt, Homo sapiens
aagaacucaggaaggauua

SEQ ID NO: 627067 - RNA, 19 nt, Homo sapiens
cggagaugaaguacuauau

SEQ ID NO: 627068 - RNA, 19 nt, Homo sapiens
caagcacaucaaugaggua

SEQ ID NO: 627069 - RNA, 19 nt, Homo sapiens
ucucucuccuugacuggaa

SEQ ID NO: 627070 - RNA, 19 nt, Homo sapiens
gcugcauccuuguggagau

SEQ ID NO: 627071 - RNA, 19 nt, Homo sapiens
cgagcaacaagaaggagaa

SEQ ID NO: 627072 - RNA, 19 nt, Homo sapiens
ugacgacaaccaugacuac

SEQ ID NO: 627073 - RNA, 19 nt, Homo sapiens
caggagcacacgcagguau

SEQ ID NO: 627074 - RNA, 19 nt, Homo sapiens
ccaaacagauuucucuuua

SEQ ID NO: 627075 - RNA, 19 nt, Homo sapiens
gcacugaccuggacuuuga

SEQ ID NO: 627076 - RNA, 19 nt, Homo sapiens
gaacagcccugcggccuuu

SEQ ID NO: 627077 - RNA, 19 nt, Homo sapiens
ggagacaccugauguaaag

SEQ ID NO: 627078 - RNA, 19 nt, Homo sapiens
ccaaaggacauguauauuu

SEQ ID NO: 627079 - RNA, 19 nt, Homo sapiens
cuacaggaaugucuacuuu

SEQ ID NO: 627080 - RNA, 19 nt, Homo sapiens
agaggaagcugaaugaaga

SEQ ID NO: 627081 - RNA, 19 nt, Homo sapiens
aaagaugucuggaaguuug

SEQ ID NO: 627082 - RNA, 19 nt, Homo sapiens
gccaagaccucacccaguu

SEQ ID NO: 627083 - RNA, 19 nt, Homo sapiens
cgacaaacuucccgauaga

SEQ ID NO: 627084 - RNA, 19 nt, Homo sapiens
gaaaagaugucuggaaguu

SEQ ID NO: 627085 - RNA, 19 nt, Homo sapiens
gucagcagaugucgaauaa

SEQ ID NO: 627086 - RNA, 19 nt, Homo sapiens
cagcagaugucgaauaaag

SEQ ID NO: 627087 - RNA, 19 nt, Homo sapiens
gaccagacguugauucaca

SEQ ID NO: 627088 - RNA, 19 nt, Homo sapiens
uaccagagcacauuccuua

SEQ ID NO: 627089 - RNA, 19 nt, Homo sapiens
gacauggacuaggaguuua

SEQ ID NO: 627090 - RNA, 19 nt, Homo sapiens
gguccacgcugcuuucuuc

SEQ ID NO: 627091 - RNA, 19 nt, Homo sapiens
agaagacgcgggagcauua

SEQ ID NO: 627092 - RNA, 19 nt, Homo sapiens
gcucaacgaccucauguga

SEQ ID NO: 627093 - RNA, 19 nt, Homo sapiens
ugaccuggacuuugacuua

SEQ ID NO: 627094 - RNA, 19 nt, Homo sapiens
guaagugacagguguuaaa

SEQ ID NO: 627095 - RNA, 19 nt, Homo sapiens
uaaggaggauuuagagagu

SEQ ID NO: 627096 - RNA, 19 nt, Homo sapiens
gagcgguucuggugagguu

SEQ ID NO: 627097 - RNA, 19 nt, Homo sapiens
ucugauaacugugaagaaa

SEQ ID NO: 627098 - RNA, 19 nt, Homo sapiens
acaaagagguggacgacau

SEQ ID NO: 627099 - RNA, 19 nt, Homo sapiens
gcagacguggccauaauuu

SEQ ID NO: 627100 - RNA, 19 nt, Homo sapiens
gggcacgggugauaugaau

SEQ ID NO: 627101 - RNA, 19 nt, Homo sapiens
ucacccaguugcagaguaa

SEQ ID NO: 627102 - RNA, 19 nt, Homo sapiens
uagagaguauggacaaaga

SEQ ID NO: 627103 - RNA, 19 nt, Homo sapiens
gaaagcgacagcccaguau

SEQ ID NO: 627104 - RNA, 19 nt, Homo sapiens
gcagauguuuggugaagag

SEQ ID NO: 627105 - RNA, 19 nt, Homo sapiens
gcagagcuccacauacaga

SEQ ID NO: 627106 - RNA, 19 nt, Homo sapiens
cgagaaagaaaguaaauca

SEQ ID NO: 627107 - RNA, 19 nt, Homo sapiens
ccacauacagaaacacauu

SEQ ID NO: 627108 - RNA, 19 nt, Homo sapiens
uugcagagcuccacauaca

SEQ ID NO: 627109 - RNA, 19 nt, Homo sapiens
ggagcccucuuccuucaga

SEQ ID NO: 627110 - RNA, 19 nt, Homo sapiens
caaccgagcagcacuguca

SEQ ID NO: 627111 - RNA, 19 nt, Homo sapiens
gacaccugauguaaaguuu

SEQ ID NO: 627112 - RNA, 19 nt, Homo sapiens
gaccuggacuuugacuuau

SEQ ID NO: 627113 - RNA, 19 nt, Homo sapiens
gaacagcugggaagagaag

SEQ ID NO: 627114 - RNA, 19 nt, Homo sapiens
cacgagacauggacuagga

SEQ ID NO: 627115 - RNA, 19 nt, Homo sapiens
agacauggacuaggaguuu

SEQ ID NO: 627116 - RNA, 19 nt, Homo sapiens
ccgacaaacuucccgauag

SEQ ID NO: 627117 - RNA, 19 nt, Homo sapiens
gaagaucgccaagcuguac

SEQ ID NO: 627118 - RNA, 19 nt, Homo sapiens
cgggaaaccuuagaaaucu

SEQ ID NO: 627119 - RNA, 19 nt, Homo sapiens
acaagaggaagcugaauga

SEQ ID NO: 627120 - RNA, 19 nt, Homo sapiens
ggacgacauccuuggagaa

SEQ ID NO: 627121 - RNA, 19 nt, Homo sapiens
caaugccgcuguacacucu

SEQ ID NO: 627122 - RNA, 19 nt, Homo sapiens
uguacacacugacuacuau

SEQ ID NO: 627123 - RNA, 19 nt, Homo sapiens
ccacccgguugucaugaaa

SEQ ID NO: 627124 - RNA, 19 nt, Homo sapiens
gagaagacgcgggagcauu

SEQ ID NO: 627125 - RNA, 19 nt, Homo sapiens
uaucaagggaugaauguau

SEQ ID NO: 627126 - RNA, 19 nt, Homo sapiens
agaaagcgacagcccagua

SEQ ID NO: 627127 - RNA, 19 nt, Homo sapiens
cugaacagcugggaagaga

SEQ ID NO: 627128 - RNA, 19 nt, Homo sapiens
cagccuggcccuucuagaa

SEQ ID NO: 627129 - RNA, 19 nt, Homo sapiens
caaacuucccgauagagaa

SEQ ID NO: 627130 - RNA, 19 nt, Homo sapiens
cagacgagaaagaaaguaa

SEQ ID NO: 627131 - RNA, 19 nt, Homo sapiens
cuccaugguuugcauuauu

SEQ ID NO: 627132 - RNA, 19 nt, Homo sapiens
aaacgggaaaccuuagaaa

SEQ ID NO: 627133 - RNA, 19 nt, Homo sapiens
ucccaaaggacauguauau

SEQ ID NO: 627134 - RNA, 19 nt, Homo sapiens
ggaguggagcccagcaaug

SEQ ID NO: 627135 - RNA, 19 nt, Homo sapiens
gacgagaaagaaaguaaau

SEQ ID NO: 627136 - RNA, 19 nt, Homo sapiens
ggaagcuggugcucauggu

SEQ ID NO: 627137 - RNA, 19 nt, Homo sapiens
ccagaggccacaagaggaa

SEQ ID NO: 627138 - RNA, 19 nt, Homo sapiens
gaaaggccugugugcugaa

SEQ ID NO: 627139 - RNA, 19 nt, Homo sapiens
gagacuccaugguuugcau

SEQ ID NO: 627140 - RNA, 19 nt, Homo sapiens
uguacgagcugcacgucuu

SEQ ID NO: 627141 - RNA, 19 nt, Homo sapiens
ggagauccugguccgugua

SEQ ID NO: 627142 - RNA, 19 nt, Homo sapiens
ccaaucugauaacugugaa

SEQ ID NO: 627143 - RNA, 19 nt, Homo sapiens
gcagcacugucagcagaug

SEQ ID NO: 627144 - RNA, 19 nt, Homo sapiens
cacauacagaaacacauua

SEQ ID NO: 627145 - RNA, 19 nt, Homo sapiens
uaugaccgcuaccucaaca

SEQ ID NO: 627146 - RNA, 19 nt, Homo sapiens
uccaugguuugcauuauug

SEQ ID NO: 627147 - RNA, 19 nt, Homo sapiens
ugucagcagaugucgaaua

SEQ ID NO: 627148 - RNA, 19 nt, Homo sapiens
ccaccaaacagauuucucu

SEQ ID NO: 627149 - RNA, 19 nt, Homo sapiens
gagaccgagucacagaaca

SEQ ID NO: 627150 - RNA, 19 nt, Homo sapiens
gcacgggugauaugaaugc

SEQ ID NO: 627151 - RNA, 19 nt, Homo sapiens
ugguuugcauuauugauga

SEQ ID NO: 627152 - RNA, 19 nt, Homo sapiens
caccugauguaaaguuucu

SEQ ID NO: 627153 - RNA, 19 nt, Homo sapiens
ggugugcugugccaaagag

SEQ ID NO: 627154 - RNA, 19 nt, Homo sapiens
gagcucaacgaccucaugu

SEQ ID NO: 627155 - RNA, 19 nt, Homo sapiens
ccgcagauguuuggugaag

SEQ ID NO: 627156 - RNA, 19 nt, Homo sapiens
gcggagaccgagucacaga

SEQ ID NO: 627157 - RNA, 19 nt, Homo sapiens
aucaagggaugaauguauu

SEQ ID NO: 627158 - RNA, 19 nt, Homo sapiens
ugacccaccaaacagauuu

SEQ ID NO: 627159 - RNA, 19 nt, Homo sapiens
uggagaagaucgccaagcu

SEQ ID NO: 627160 - RNA, 19 nt, Homo sapiens
ggagcucaacgaccucaug

SEQ ID NO: 627161 - RNA, 19 nt, Homo sapiens
cugagacaaugccgcugua

SEQ ID NO: 627162 - RNA, 19 nt, Homo sapiens
gaguggagcccagcaaugg

SEQ ID NO: 627163 - RNA, 19 nt, Homo sapiens
acaggaaugucuacuuuug

SEQ ID NO: 627164 - RNA, 19 nt, Homo sapiens
caaagagguggacgacauc

SEQ ID NO: 627165 - RNA, 19 nt, Homo sapiens
aaggaggauuuagagagua

SEQ ID NO: 627166 - RNA, 19 nt, Homo sapiens
gagcagccuggcccuucua

SEQ ID NO: 627167 - RNA, 19 nt, Homo sapiens
guauugacccauuuucuaa

SEQ ID NO: 627168 - RNA, 19 nt, Homo sapiens
caagggaugaauguauuga

SEQ ID NO: 627169 - RNA, 19 nt, Homo sapiens
uggagacaccugauguaaa

SEQ ID NO: 627170 - RNA, 19 nt, Homo sapiens
gccacccgguugucaugaa

SEQ ID NO: 627171 - RNA, 19 nt, Homo sapiens
caagaggaagcugaaugaa

SEQ ID NO: 627172 - RNA, 19 nt, Homo sapiens
gaucacaccaaggcacaga

SEQ ID NO: 627173 - RNA, 19 nt, Homo sapiens
gggcuacacccgacaaacu

SEQ ID NO: 627174 - RNA, 19 nt, Homo sapiens
ccaaacagauuucucuuua

SEQ ID NO: 627175 - RNA, 19 nt, Homo sapiens
gcacugaccuggacuuuga

SEQ ID NO: 627176 - RNA, 19 nt, Homo sapiens
gaacagcccugcggccuuu

SEQ ID NO: 627177 - RNA, 19 nt, Homo sapiens
ggagacaccugauguaaag

SEQ ID NO: 627178 - RNA, 19 nt, Homo sapiens
ccaaaggacauguauauuu

SEQ ID NO: 627179 - RNA, 19 nt, Homo sapiens
cuacaggaaugucuacuuu

SEQ ID NO: 627180 - RNA, 19 nt, Homo sapiens
agaggaagcugaaugaaga

SEQ ID NO: 627181 - RNA, 19 nt, Homo sapiens
aaagaugucuggaaguuug

SEQ ID NO: 627182 - RNA, 19 nt, Homo sapiens
gccaagaccucacccaguu

SEQ ID NO: 627183 - RNA, 19 nt, Homo sapiens
cgacaaacuucccgauaga

SEQ ID NO: 627184 - RNA, 19 nt, Homo sapiens
gaaaagaugucuggaaguu

SEQ ID NO: 627185 - RNA, 19 nt, Homo sapiens
gucagcagaugucgaauaa

SEQ ID NO: 627186 - RNA, 19 nt, Homo sapiens
cagcagaugucgaauaaag

SEQ ID NO: 627187 - RNA, 19 nt, Homo sapiens
gaccagacguugauucaca

SEQ ID NO: 627188 - RNA, 19 nt, Homo sapiens
uaccagagcacauuccuua

SEQ ID NO: 627189 - RNA, 19 nt, Homo sapiens
gacauggacuaggaguuua

SEQ ID NO: 627190 - RNA, 19 nt, Homo sapiens
gguccacgcugcuuucuuc

SEQ ID NO: 627191 - RNA, 19 nt, Homo sapiens
agaagacgcgggagcauua

SEQ ID NO: 627192 - RNA, 19 nt, Homo sapiens
gcucaacgaccucauguga

SEQ ID NO: 627193 - RNA, 19 nt, Homo sapiens
ugaccuggacuuugacuua

SEQ ID NO: 627194 - RNA, 19 nt, Homo sapiens
guaagugacagguguuaaa

SEQ ID NO: 627195 - RNA, 19 nt, Homo sapiens
gagcgguucuggugagguu

SEQ ID NO: 627196 - RNA, 19 nt, Homo sapiens
ucugauaacugugaagaaa

SEQ ID NO: 627197 - RNA, 19 nt, Homo sapiens
gcagacguggccauaauuu

SEQ ID NO: 627198 - RNA, 19 nt, Homo sapiens
gggcacgggugauaugaau

SEQ ID NO: 627199 - RNA, 19 nt, Homo sapiens
ucacccaguugcagaguaa

SEQ ID NO: 627200 - RNA, 19 nt, Homo sapiens
gcagagcuccacauacaga

SEQ ID NO: 627201 - RNA, 19 nt, Homo sapiens
cgagaaagaaaguaaauca

SEQ ID NO: 627202 - RNA, 19 nt, Homo sapiens
ccacauacagaaacacauu

SEQ ID NO: 627203 - RNA, 19 nt, Homo sapiens
uugcagagcuccacauaca

SEQ ID NO: 627204 - RNA, 19 nt, Homo sapiens
ggagcccucuuccuucaga

SEQ ID NO: 627205 - RNA, 19 nt, Homo sapiens
caaccgagcagcacuguca

SEQ ID NO: 627206 - RNA, 19 nt, Homo sapiens
gacaccugauguaaaguuu

SEQ ID NO: 627207 - RNA, 19 nt, Homo sapiens
gaccuggacuuugacuuau

SEQ ID NO: 627208 - RNA, 19 nt, Homo sapiens
gaacagcugggaagagaag

SEQ ID NO: 627209 - RNA, 19 nt, Homo sapiens
cacgagacauggacuagga

SEQ ID NO: 627210 - RNA, 19 nt, Homo sapiens
agacauggacuaggaguuu

SEQ ID NO: 627211 - RNA, 19 nt, Homo sapiens
ccgacaaacuucccgauag

SEQ ID NO: 627212 - RNA, 19 nt, Homo sapiens
gaagaucgccaagcuguac

SEQ ID NO: 627213 - RNA, 19 nt, Homo sapiens
cgggaaaccuuagaaaucu

SEQ ID NO: 627214 - RNA, 19 nt, Homo sapiens
acaagaggaagcugaauga

SEQ ID NO: 627215 - RNA, 19 nt, Homo sapiens
ggacgacauccuuggagaa

SEQ ID NO: 627216 - RNA, 19 nt, Homo sapiens
uguacacacugacuacuau

SEQ ID NO: 627217 - RNA, 19 nt, Homo sapiens
ccacccgguugucaugaaa

SEQ ID NO: 627218 - RNA, 19 nt, Homo sapiens
gagaagacgcgggagcauu

SEQ ID NO: 627219 - RNA, 19 nt, Homo sapiens
uaucaagggaugaauguau

SEQ ID NO: 627220 - RNA, 19 nt, Homo sapiens
cugaacagcugggaagaga

SEQ ID NO: 627221 - RNA, 19 nt, Homo sapiens
caaacuucccgauagagaa

SEQ ID NO: 627222 - RNA, 19 nt, Homo sapiens
cagacgagaaagaaaguaa

SEQ ID NO: 627223 - RNA, 19 nt, Homo sapiens
cuccaugguuugcauuauu

SEQ ID NO: 627224 - RNA, 19 nt, Homo sapiens
aaacgggaaaccuuagaaa

SEQ ID NO: 627225 - RNA, 19 nt, Homo sapiens
ucccaaaggacauguauau

SEQ ID NO: 627226 - RNA, 19 nt, Homo sapiens
ggaagcuggugcucauggu

SEQ ID NO: 627227 - RNA, 19 nt, Homo sapiens
ggaguggagcccagcaaug

SEQ ID NO: 627228 - RNA, 19 nt, Homo sapiens
gacgagaaagaaaguaaau

SEQ ID NO: 627229 - RNA, 19 nt, Homo sapiens
ccagaggccacaagaggaa

SEQ ID NO: 627230 - RNA, 19 nt, Homo sapiens
gaaaggccugugugcugaa

SEQ ID NO: 627231 - RNA, 19 nt, Homo sapiens
gagacuccaugguuugcau

SEQ ID NO: 627232 - RNA, 19 nt, Homo sapiens
uguacgagcugcacgucuu

SEQ ID NO: 627233 - RNA, 19 nt, Homo sapiens
ggagauccugguccgugua

SEQ ID NO: 627234 - RNA, 19 nt, Homo sapiens
ccaaucugauaacugugaa

SEQ ID NO: 627235 - RNA, 19 nt, Homo sapiens
gcagcacugucagcagaug

SEQ ID NO: 627236 - RNA, 19 nt, Homo sapiens
cacauacagaaacacauua

SEQ ID NO: 627237 - RNA, 19 nt, Homo sapiens
uaugaccgcuaccucaaca

SEQ ID NO: 627238 - RNA, 19 nt, Homo sapiens
uccaugguuugcauuauug

SEQ ID NO: 627239 - RNA, 19 nt, Homo sapiens
ugucagcagaugucgaaua

SEQ ID NO: 627240 - RNA, 19 nt, Homo sapiens
ccaccaaacagauuucucu

SEQ ID NO: 627241 - RNA, 19 nt, Homo sapiens
gagaccgagucacagaaca

SEQ ID NO: 627242 - RNA, 19 nt, Homo sapiens
gcacgggugauaugaaugc

SEQ ID NO: 627243 - RNA, 19 nt, Homo sapiens
ugguuugcauuauugauga

SEQ ID NO: 627244 - RNA, 19 nt, Homo sapiens
caccugauguaaaguuucu

SEQ ID NO: 627245 - RNA, 19 nt, Homo sapiens
ggugugcugugccaaagag

SEQ ID NO: 627246 - RNA, 19 nt, Homo sapiens
gagcucaacgaccucaugu

SEQ ID NO: 627247 - RNA, 19 nt, Homo sapiens
gcggagaccgagucacaga

SEQ ID NO: 627248 - RNA, 19 nt, Homo sapiens
aucaagggaugaauguauu

SEQ ID NO: 627249 - RNA, 19 nt, Homo sapiens
ugacccaccaaacagauuu

SEQ ID NO: 627250 - RNA, 19 nt, Homo sapiens
ggagcucaacgaccucaug

SEQ ID NO: 627251 - RNA, 19 nt, Homo sapiens
gaguggagcccagcaaugg

SEQ ID NO: 627252 - RNA, 19 nt, Homo sapiens
uggagaagaucgccaagcu

SEQ ID NO: 627253 - RNA, 19 nt, Homo sapiens
acaggaaugucuacuuuug

SEQ ID NO: 627254 - RNA, 19 nt, Homo sapiens
guauugacccauuuucuaa

SEQ ID NO: 627255 - RNA, 19 nt, Homo sapiens
caagggaugaauguauuga

SEQ ID NO: 627256 - RNA, 19 nt, Homo sapiens
uggagacaccugauguaaa

SEQ ID NO: 627257 - RNA, 19 nt, Homo sapiens
gccacccgguugucaugaa

SEQ ID NO: 627258 - RNA, 19 nt, Homo sapiens
caagaggaagcugaaugaa

SEQ ID NO: 627259 - RNA, 19 nt, Homo sapiens
gaucacaccaaggcacaga

SEQ ID NO: 627260 - RNA, 19 nt, Homo sapiens
gggcuacacccgacaaacu

SEQ ID NO: 627261 - RNA, 19 nt, Homo sapiens
ggaaaccuuagaaaucucu

SEQ ID NO: 627262 - RNA, 19 nt, Homo sapiens
agacaccugauguaaaguu

SEQ ID NO: 627263 - RNA, 19 nt, Homo sapiens
gcagggaguccagcaacga

SEQ ID NO: 627264 - RNA, 19 nt, Homo sapiens
cacaagaggaagcugaaug

SEQ ID NO: 627265 - RNA, 19 nt, Homo sapiens
cgacagcgacagcgagaag

SEQ ID NO: 627266 - RNA, 19 nt, Homo sapiens
acaaacuucccgauagaga

SEQ ID NO: 627267 - RNA, 19 nt, Homo sapiens
ggcagacguggccauaauu

SEQ ID NO: 627268 - RNA, 19 nt, Homo sapiens
ccaggugugcugugccaaa

SEQ ID NO: 627269 - RNA, 19 nt, Homo sapiens
agacgagaaagaaaguaaa

SEQ ID NO: 627270 - RNA, 19 nt, Homo sapiens
gggaaaccuuagaaaucuc

SEQ ID NO: 627271 - RNA, 19 nt, Homo sapiens
aggaaugucuacuuuugua

SEQ ID NO: 627272 - RNA, 19 nt, Homo sapiens
gcauuauugaugaucgaaa

SEQ ID NO: 627273 - RNA, 19 nt, Homo sapiens
gacuccaugguuugcauua

SEQ ID NO: 627274 - RNA, 19 nt, Homo sapiens
gaucaucucuguccuaaua

SEQ ID NO: 627275 - RNA, 19 nt, Homo sapiens
gaagauuucugcagggauu

SEQ ID NO: 627276 - RNA, 19 nt, Homo sapiens
caaagauucugugaagaua

SEQ ID NO: 627277 - RNA, 19 nt, Homo sapiens
gaagauauagagaugauga

SEQ ID NO: 627278 - RNA, 19 nt, Homo sapiens
gcauugcauuugugguuua

SEQ ID NO: 627279 - RNA, 19 nt, Homo sapiens
ggaaagaugcugccacuca

SEQ ID NO: 627280 - RNA, 19 nt, Homo sapiens
gcaaagauucugugaagau

SEQ ID NO: 627281 - RNA, 19 nt, Homo sapiens
cagacgaguuucccaagua

SEQ ID NO: 627282 - RNA, 19 nt, Homo sapiens
caacaacccuuggaauaca

SEQ ID NO: 627283 - RNA, 19 nt, Homo sapiens
gaacgcaaagucaacauug

SEQ ID NO: 627284 - RNA, 19 nt, Homo sapiens
ugaucacucucucuucuua

SEQ ID NO: 627285 - RNA, 19 nt, Homo sapiens
ccaaggaaaugaauaaacu

SEQ ID NO: 627286 - RNA, 19 nt, Homo sapiens
gagaucagguggccacuag

SEQ ID NO: 627287 - RNA, 19 nt, Homo sapiens
gcaccuugcuuugcacuga

SEQ ID NO: 627288 - RNA, 19 nt, Homo sapiens
gaaagucugcugggcauuu

SEQ ID NO: 627289 - RNA, 19 nt, Homo sapiens
cuaaaggaaucaagacuuc

SEQ ID NO: 627290 - RNA, 19 nt, Homo sapiens
gaauacaccagaaugcaaa

SEQ ID NO: 627291 - RNA, 19 nt, Homo sapiens
gugcuuuccucaucccuua

SEQ ID NO: 627292 - RNA, 19 nt, Homo sapiens
gaaucaagacuucaggaaa

SEQ ID NO: 627293 - RNA, 19 nt, Homo sapiens
ggacuugacacuauguuug

SEQ ID NO: 627294 - RNA, 19 nt, Homo sapiens
ccuggaagauuuauugaga

SEQ ID NO: 627295 - RNA, 19 nt, Homo sapiens
acaccagaaugcaaagaua

SEQ ID NO: 627296 - RNA, 19 nt, Homo sapiens
gcucuuaccgcuauccuaa

SEQ ID NO: 627297 - RNA, 19 nt, Homo sapiens
ggguggaauuuacauguuu

SEQ ID NO: 627298 - RNA, 19 nt, Homo sapiens
acucugggcugcugcauuu

SEQ ID NO: 627299 - RNA, 19 nt, Homo sapiens
gcugggaucugguacuuca

SEQ ID NO: 627300 - RNA, 19 nt, Homo sapiens
gagcugggaucugguacuu

SEQ ID NO: 627301 - RNA, 19 nt, Homo sapiens
ggcaaugucuggagguuuc

SEQ ID NO: 627302 - RNA, 19 nt, Homo sapiens
guguauggcuugcaaagau

SEQ ID NO: 627303 - RNA, 19 nt, Homo sapiens
ccuaacaucuucuggaaag

SEQ ID NO: 627304 - RNA, 19 nt, Homo sapiens
ucaaguacuuugugcugaa

SEQ ID NO: 627305 - RNA, 19 nt, Homo sapiens
ggaauacaccagaaugcaa

SEQ ID NO: 627306 - RNA, 19 nt, Homo sapiens
gauauagagaugaugauug

SEQ ID NO: 627307 - RNA, 19 nt, Homo sapiens
ccaaggagauauagaaacg

SEQ ID NO: 627308 - RNA, 19 nt, Homo sapiens
gugaagauauagagaugau

SEQ ID NO: 627309 - RNA, 19 nt, Homo sapiens
cuacagggacacucuaauu

SEQ ID NO: 627310 - RNA, 19 nt, Homo sapiens
gcagugcucccaaggaaau

SEQ ID NO: 627311 - RNA, 19 nt, Homo sapiens
ggaaucaagacuucaggaa

SEQ ID NO: 627312 - RNA, 19 nt, Homo sapiens
guucugggccaucaucuuu

SEQ ID NO: 627313 - RNA, 19 nt, Homo sapiens
gccauauacuacaauguga

SEQ ID NO: 627314 - RNA, 19 nt, Homo sapiens
uagagaugaugauuggauu

SEQ ID NO: 627315 - RNA, 19 nt, Homo sapiens
aaauacagaucaagaacuc

SEQ ID NO: 627316 - RNA, 19 nt, Homo sapiens
gcaacaacccuuggaauac

SEQ ID NO: 627317 - RNA, 19 nt, Homo sapiens
gcuccucacucuuggacuu

SEQ ID NO: 627318 - RNA, 19 nt, Homo sapiens
ggccaggcauugcauuugu

SEQ ID NO: 627319 - RNA, 19 nt, Homo sapiens
uggcuugggucauugugua

SEQ ID NO: 627320 - RNA, 19 nt, Homo sapiens
uugcaaagauucugugaag

SEQ ID NO: 627321 - RNA, 19 nt, Homo sapiens
caaacccagucuugucaau

SEQ ID NO: 627322 - RNA, 19 nt, Homo sapiens
ucacucaggguggaauuua

SEQ ID NO: 627323 - RNA, 19 nt, Homo sapiens
caacaaauuccacaacaac

SEQ ID NO: 627324 - RNA, 19 nt, Homo sapiens
acaacaaauuccacaacaa

SEQ ID NO: 627325 - RNA, 19 nt, Homo sapiens
ccuaauagccauauacuac

SEQ ID NO: 627326 - RNA, 19 nt, Homo sapiens
ccaaguaccuacgcacaca

SEQ ID NO: 627327 - RNA, 19 nt, Homo sapiens
gcuaaaggaaucaagacuu

SEQ ID NO: 627328 - RNA, 19 nt, Homo sapiens
ugaauauccuggcgagauc

SEQ ID NO: 627329 - RNA, 19 nt, Homo sapiens
ugcaacaacccuuggaaua

SEQ ID NO: 627330 - RNA, 19 nt, Homo sapiens
auauagagaugaugauugg

SEQ ID NO: 627331 - RNA, 19 nt, Homo sapiens
ggggaucucuuauguguau

SEQ ID NO: 627332 - RNA, 19 nt, Homo sapiens
ccaaugaacgcaaagucaa

SEQ ID NO: 627333 - RNA, 19 nt, Homo sapiens
ggcauugcauuugugguuu

SEQ ID NO: 627334 - RNA, 19 nt, Homo sapiens
gaugcugccacucagauuu

SEQ ID NO: 627335 - RNA, 19 nt, Homo sapiens
ucaccagccaggccaauaa

SEQ ID NO: 627336 - RNA, 19 nt, Homo sapiens
gauuacccaucuucuucuu

SEQ ID NO: 627337 - RNA, 19 nt, Homo sapiens
ucaucuggaucccaauuau

SEQ ID NO: 627338 - RNA, 19 nt, Homo sapiens
caccuaugcugccuccuau

SEQ ID NO: 627339 - RNA, 19 nt, Homo sapiens
uacaacaaauuccacaaca

SEQ ID NO: 627340 - RNA, 19 nt, Homo sapiens
aaucaagacuucaggaaaa

SEQ ID NO: 627341 - RNA, 19 nt, Homo sapiens
caccagaaugcaaagauaa

SEQ ID NO: 627342 - RNA, 19 nt, Homo sapiens
ucuaggcuguugucccuuu

SEQ ID NO: 627343 - RNA, 19 nt, Homo sapiens
uaaccuuuauccuuugcuu

SEQ ID NO: 627344 - RNA, 19 nt, Homo sapiens
cauagugaccuccaucuca

SEQ ID NO: 627345 - RNA, 19 nt, Homo sapiens
gaucugguacuucaucaca

SEQ ID NO: 627346 - RNA, 19 nt, Homo sapiens
uuagauuccuguguuauca

SEQ ID NO: 627347 - RNA, 19 nt, Homo sapiens
caucauggguuuuccaaug

SEQ ID NO: 627348 - RNA, 19 nt, Homo sapiens
ucucucuucuuacaacaaa

SEQ ID NO: 627349 - RNA, 19 nt, Homo sapiens
ggaucccaauuauguuugu

SEQ ID NO: 627350 - RNA, 19 nt, Homo sapiens
ggcuaaugcucgccuguuc

SEQ ID NO: 627351 - RNA, 19 nt, Homo sapiens
cuauggcucuuaccgcuau

SEQ ID NO: 627352 - RNA, 19 nt, Homo sapiens
gguggaauuuacauguuuc

SEQ ID NO: 627353 - RNA, 19 nt, Homo sapiens
gcauuuguuucuucaucau

SEQ ID NO: 627354 - RNA, 19 nt, Homo sapiens
acgugacaaugguuaauuu

SEQ ID NO: 627355 - RNA, 19 nt, Homo sapiens
cugaucaucucuguccuaa

SEQ ID NO: 627356 - RNA, 19 nt, Homo sapiens
cgcccaaacuuuccaguca

SEQ ID NO: 627357 - RNA, 19 nt, Homo sapiens
guccagacuugauccuguu

SEQ ID NO: 627358 - RNA, 19 nt, Homo sapiens
uguauggcuugcaaagauu

SEQ ID NO: 627359 - RNA, 19 nt, Homo sapiens
gguuuacccggaagccuua

SEQ ID NO: 627360 - RNA, 19 nt, Homo sapiens
uucgucaucuucuccguua

SEQ ID NO: 627361 - RNA, 19 nt, Homo sapiens
uugcagugcucccaaggaa

SEQ ID NO: 627362 - RNA, 19 nt, Homo sapiens
gagcguuacaagaacauga

SEQ ID NO: 627363 - RNA, 19 nt, Homo sapiens
ccaaccauuuuaaccuuua

SEQ ID NO: 627364 - RNA, 19 nt, Homo sapiens
aaagucugcugggcauuug

SEQ ID NO: 627365 - RNA, 19 nt, Homo sapiens
gaccaagggccaggcauug

SEQ ID NO: 627366 - RNA, 19 nt, Homo sapiens
cuaccuguuugccuccuuu

SEQ ID NO: 627367 - RNA, 19 nt, Homo sapiens
gugggaugguccagacuug

SEQ ID NO: 627368 - RNA, 19 nt, Homo sapiens
caacuggccagcauacucu

SEQ ID NO: 627369 - RNA, 19 nt, Homo sapiens
cuaggcuguugucccuuua

SEQ ID NO: 627370 - RNA, 19 nt, Homo sapiens
ugacaaugguuaauuucac

SEQ ID NO: 627371 - RNA, 19 nt, Homo sapiens
gaucaagaacucgacuuuc

SEQ ID NO: 627372 - RNA, 19 nt, Homo sapiens
aaacccagucuugucaaua

SEQ ID NO: 627373 - RNA, 19 nt, Homo sapiens
ccuaugcccuugucaucau

SEQ ID NO: 627374 - RNA, 19 nt, Homo sapiens
uaaaugaguuuguggcuua

SEQ ID NO: 627375 - RNA, 19 nt, Homo sapiens
ggaaucaaguucuucauaa

SEQ ID NO: 627376 - RNA, 19 nt, Homo sapiens
gaacugaucuuggauauac

SEQ ID NO: 627377 - RNA, 19 nt, Homo sapiens
gggccuaggucuucaauuu

SEQ ID NO: 627378 - RNA, 19 nt, Homo sapiens
gcacuggccuuguuuguca

SEQ ID NO: 627379 - RNA, 19 nt, Homo sapiens
gauaaggaguucagugcua

SEQ ID NO: 627380 - RNA, 19 nt, Homo sapiens
gcaccaacccuccuucuuu

SEQ ID NO: 627381 - RNA, 19 nt, Homo sapiens
ugugagagcugaaaucauu

SEQ ID NO: 627382 - RNA, 19 nt, Homo sapiens
ucaaggaugucuuugcuuu

SEQ ID NO: 627383 - RNA, 19 nt, Homo sapiens
ccauaggccuugcuacuaa

SEQ ID NO: 627384 - RNA, 19 nt, Homo sapiens
cagcuugcaucuugaauuu

SEQ ID NO: 627385 - RNA, 19 nt, Homo sapiens
ggagagaaacaguggauuu

SEQ ID NO: 627386 - RNA, 19 nt, Homo sapiens
ggugaugacuggaggguuu

SEQ ID NO: 627387 - RNA, 19 nt, Homo sapiens
uugcaaagguguuuaugua

SEQ ID NO: 627388 - RNA, 19 nt, Homo sapiens
caagaggacugacgcacaa

SEQ ID NO: 627389 - RNA, 19 nt, Homo sapiens
gcaacugucucaauacaag

SEQ ID NO: 627390 - RNA, 19 nt, Homo sapiens
ggagaaagcaaguggaaga

SEQ ID NO: 627391 - RNA, 19 nt, Homo sapiens
gggauacacuggucaagga

SEQ ID NO: 627392 - RNA, 19 nt, Homo sapiens
gagcugaaaucauuacaac

SEQ ID NO: 627393 - RNA, 19 nt, Homo sapiens
gcaaagguguuuauguacu

SEQ ID NO: 627394 - RNA, 19 nt, Homo sapiens
gggaaucaaguucuucaua

SEQ ID NO: 627395 - RNA, 19 nt, Homo sapiens
gcaggagaauggcgugaau

SEQ ID NO: 627396 - RNA, 19 nt, Homo sapiens
ggacaugacacucucugaa

SEQ ID NO: 627397 - RNA, 19 nt, Homo sapiens
ggacugggcccuuccacuu

SEQ ID NO: 627398 - RNA, 19 nt, Homo sapiens
caucaaagcuagcguaucc

SEQ ID NO: 627399 - RNA, 19 nt, Homo sapiens
ggagagcagguccagauuu

SEQ ID NO: 627400 - RNA, 19 nt, Homo sapiens
caagcuggguugaggagaa

SEQ ID NO: 627401 - RNA, 19 nt, Homo sapiens
uaaggcugcuugaucuauu

SEQ ID NO: 627402 - RNA, 19 nt, Homo sapiens
gacaugacacucucugaaa

SEQ ID NO: 627403 - RNA, 19 nt, Homo sapiens
gagagcagguccagauuuu

SEQ ID NO: 627404 - RNA, 19 nt, Homo sapiens
gagaacaggagauggagaa

SEQ ID NO: 627405 - RNA, 19 nt, Homo sapiens
acacaaguuucaccaauag

SEQ ID NO: 627406 - RNA, 19 nt, Homo sapiens
gaaacaucuuuguggguau

SEQ ID NO: 627407 - RNA, 19 nt, Homo sapiens
ccuggcagcuugcaucuug

SEQ ID NO: 627408 - RNA, 19 nt, Homo sapiens
uaacugcuguggauucuac

SEQ ID NO: 627409 - RNA, 19 nt, Homo sapiens
cagaacugaucuuggauau

SEQ ID NO: 627410 - RNA, 19 nt, Homo sapiens
guucauccuuauccucuuu

SEQ ID NO: 627411 - RNA, 19 nt, Homo sapiens
aacacaaguuucaccaaua

SEQ ID NO: 627412 - RNA, 19 nt, Homo sapiens
gggaauugguggacauaca

SEQ ID NO: 627413 - RNA, 19 nt, Homo sapiens
cagcaacugucucaauaca

SEQ ID NO: 627414 - RNA, 19 nt, Homo sapiens
gcucauccgucccuaccuu

SEQ ID NO: 627415 - RNA, 19 nt, Homo sapiens
uuucaggccuuaccaauca

SEQ ID NO: 627416 - RNA, 19 nt, Homo sapiens
ucacucaccaagauguuua

SEQ ID NO: 627417 - RNA, 19 nt, Homo sapiens
ggucagggcccucuucaca

SEQ ID NO: 627418 - RNA, 19 nt, Homo sapiens
gaauggaggaguggauuga

SEQ ID NO: 627419 - RNA, 19 nt, Homo sapiens
aaacgucucucuggaaugg

SEQ ID NO: 627420 - RNA, 19 nt, Homo sapiens
acaaacgucucucuggaau

SEQ ID NO: 627421 - RNA, 19 nt, Homo sapiens
gaggagaacaggagaugga

SEQ ID NO: 627422 - RNA, 19 nt, Homo sapiens
ggucuucaauuugucuuug

SEQ ID NO: 627423 - RNA, 19 nt, Homo sapiens
caaagguguuuauguacuc

SEQ ID NO: 627424 - RNA, 19 nt, Homo sapiens
gcugaaaucauuacaacau

SEQ ID NO: 627425 - RNA, 19 nt, Homo sapiens
ggucaaggaugucuuugcu

SEQ ID NO: 627426 - RNA, 19 nt, Homo sapiens
ggugaucuuuguccugguu

SEQ ID NO: 627427 - RNA, 19 nt, Homo sapiens
gaaaccccgucucuacuaa

SEQ ID NO: 627428 - RNA, 19 nt, Homo sapiens
acaacucacucaccaagau

SEQ ID NO: 627429 - RNA, 19 nt, Homo sapiens
cuacaacaauaccgucugu

SEQ ID NO: 627430 - RNA, 19 nt, Homo sapiens
gaaccuaugagaccuacau

SEQ ID NO: 627431 - RNA, 19 nt, Homo sapiens
gacugggcccuuccacuua

SEQ ID NO: 627432 - RNA, 19 nt, Homo sapiens
ugaaauccaugcggugaug

SEQ ID NO: 627433 - RNA, 19 nt, Homo sapiens
gccuaggucuucaauuugu

SEQ ID NO: 627434 - RNA, 19 nt, Homo sapiens
caucugcuccuaucuccua

SEQ ID NO: 627435 - RNA, 19 nt, Homo sapiens
cagcaaagcaagaaguuuc

SEQ ID NO: 627436 - RNA, 19 nt, Homo sapiens
gcagcuugcaucuugaauu

SEQ ID NO: 627437 - RNA, 19 nt, Homo sapiens
gcugcuugaucuauuucua

SEQ ID NO: 627438 - RNA, 19 nt, Homo sapiens
guuuguggcuuaucagcaa

SEQ ID NO: 627439 - RNA, 19 nt, Homo sapiens
gcuguggauucuacaacaa

SEQ ID NO: 627440 - RNA, 19 nt, Homo sapiens
agagggcacuggccuuguu

SEQ ID NO: 627441 - RNA, 19 nt, Homo sapiens
uguggauucuacaacaaua

SEQ ID NO: 627442 - RNA, 19 nt, Homo sapiens
ggaauggaggaguggauug

SEQ ID NO: 627443 - RNA, 19 nt, Homo sapiens
aucagcaacugucucaaua

SEQ ID NO: 627444 - RNA, 19 nt, Homo sapiens
gacacucucugaaauccau

SEQ ID NO: 627445 - RNA, 19 nt, Homo sapiens
acaugacacucucugaaau

SEQ ID NO: 627446 - RNA, 19 nt, Homo sapiens
cuuaaaagcuuugugauug

SEQ ID NO: 627447 - RNA, 19 nt, Homo sapiens
ggaagagugacuuguccaa

SEQ ID NO: 627448 - RNA, 19 nt, Homo sapiens
uggcugagauggugggaau

SEQ ID NO: 627449 - RNA, 19 nt, Homo sapiens
gccauaggccuugcuacua

SEQ ID NO: 627450 - RNA, 19 nt, Homo sapiens
gaugugugguguccauucu

SEQ ID NO: 627451 - RNA, 19 nt, Homo sapiens
caauuugucuuugggaucu

SEQ ID NO: 627452 - RNA, 19 nt, Homo sapiens
uguugggccuguuguguuu

SEQ ID NO: 627453 - RNA, 19 nt, Homo sapiens
ucgagaccauccuggcuaa

SEQ ID NO: 627454 - RNA, 19 nt, Homo sapiens
aguccaaguucaagaguga

SEQ ID NO: 627455 - RNA, 19 nt, Homo sapiens
gaacaggagauggagaaag

SEQ ID NO: 627456 - RNA, 19 nt, Homo sapiens
guguuggccuucaucaaug

SEQ ID NO: 627457 - RNA, 19 nt, Homo sapiens
aaacaucuuuguggguaug

SEQ ID NO: 627458 - RNA, 19 nt, Homo sapiens
ggccuuaccaaucaucauu

SEQ ID NO: 627459 - RNA, 19 nt, Homo sapiens
gugcuauggcccuuacuaa

SEQ ID NO: 627460 - RNA, 19 nt, Homo sapiens
ucagaaggucgccugguuu

SEQ ID NO: 627461 - RNA, 19 nt, Homo sapiens
ggagauggagaaagcaagu

SEQ ID NO: 627462 - RNA, 19 nt, Homo sapiens
caauaccgucugugccuaa

SEQ ID NO: 627463 - RNA, 19 nt, Homo sapiens
ggauugagggagagaaaca

SEQ ID NO: 627464 - RNA, 19 nt, Homo sapiens
gcaauggguaguucagaag

SEQ ID NO: 627465 - RNA, 19 nt, Homo sapiens
cuccuugguuggccuuaua

SEQ ID NO: 627466 - RNA, 19 nt, Homo sapiens
cagcuacucgcgagacuga

SEQ ID NO: 627467 - RNA, 19 nt, Homo sapiens
gcuauggcccuuacuaacu

SEQ ID NO: 627468 - RNA, 19 nt, Homo sapiens
caggucaucugcuccuauc

SEQ ID NO: 627469 - RNA, 19 nt, Homo sapiens
ugcaauggguaguucagaa

SEQ ID NO: 627470 - RNA, 19 nt, Homo sapiens
ucgguggccuuucagcaaa

SEQ ID NO: 627471 - RNA, 19 nt, Homo sapiens
ugucugaagcccuuugaaa

SEQ ID NO: 627472 - RNA, 19 nt, Homo sapiens
gucaggagaucgagaccau

SEQ ID NO: 627473 - RNA, 19 nt, Homo sapiens
aaggcugcuugaucuauuu

SEQ ID NO: 627474 - RNA, 19 nt, Homo sapiens
gcaguagcuuugagauuua

SEQ ID NO: 627475 - RNA, 19 nt, Homo sapiens
guucaucgcucuccucuuu

SEQ ID NO: 627476 - RNA, 19 nt, Homo sapiens
ggaucaagcuguuucugaa

SEQ ID NO: 627477 - RNA, 19 nt, Homo sapiens
ggacugcaguuuguacuug

SEQ ID NO: 627478 - RNA, 19 nt, Homo sapiens
gagugaaacugaccuaugg

SEQ ID NO: 627479 - RNA, 19 nt, Homo sapiens
ggccaaagcugaggagguu

SEQ ID NO: 627480 - RNA, 19 nt, Homo sapiens
gagcgucaauccagaguuc

SEQ ID NO: 627481 - RNA, 19 nt, Homo sapiens
gaugccaccucguugauug

SEQ ID NO: 627482 - RNA, 19 nt, Homo sapiens
gaccgaggcuccauuacug

SEQ ID NO: 627483 - RNA, 19 nt, Homo sapiens
ggacuuggacugcaguuug

SEQ ID NO: 627484 - RNA, 19 nt, Homo sapiens
gugcuggacuuuaucaaug

SEQ ID NO: 627485 - RNA, 19 nt, Homo sapiens
gaaacugaccuauggagau

SEQ ID NO: 627486 - RNA, 19 nt, Homo sapiens
aucaagaccucuccaagua

SEQ ID NO: 627487 - RNA, 19 nt, Homo sapiens
gaacgaguuuguggccuau

SEQ ID NO: 627488 - RNA, 19 nt, Homo sapiens
ccaagggucuggagaacau

SEQ ID NO: 627489 - RNA, 19 nt, Homo sapiens
gcucagaaccucauagaag

SEQ ID NO: 627490 - RNA, 19 nt, Homo sapiens
gaguguggcuggaaacauc

SEQ ID NO: 627491 - RNA, 19 nt, Homo sapiens
aaacugaccuauggagaug

SEQ ID NO: 627492 - RNA, 19 nt, Homo sapiens
gaggaaggagugaaacuga

SEQ ID NO: 627493 - RNA, 19 nt, Homo sapiens
gaagauugccuggcugaug

SEQ ID NO: 627494 - RNA, 19 nt, Homo sapiens
gaacaugcuugugcuucug

SEQ ID NO: 627495 - RNA, 19 nt, Homo sapiens
agcaguagcuuugagauuu

SEQ ID NO: 627496 - RNA, 19 nt, Homo sapiens
caagaccucuccaaguaca

SEQ ID NO: 627497 - RNA, 19 nt, Homo sapiens
gaacagaaccaggauucau

SEQ ID NO: 627498 - RNA, 19 nt, Homo sapiens
gcuggaaacaucuuuguga

SEQ ID NO: 627499 - RNA, 19 nt, Homo sapiens
gagcgacuucucccagaua

SEQ ID NO: 627500 - RNA, 19 nt, Homo sapiens
ggagugaaacugaccuaug

SEQ ID NO: 627501 - RNA, 19 nt, Homo sapiens
ccagaccgaggcuccauua
